United States Patent 11,640,849 (METHODS FOR HISTOLOGICAL DIAGNOSIS AND TREATMENT OF DISEASES) - sequence listing, part 51

SEQ ID NO: 1949847 - protein, 16 aa, Staphylococcus
IDNQSALDSLTYTKKE

SEQ ID NO: 1949848 - protein, 7 aa, Staphylococcus
IDNREDI

SEQ ID NO: 1949849 - protein, 7 aa, Staphylococcus
IDNTQLN

SEQ ID NO: 1949850 - protein, 13 aa, Staphylococcus
IDNYGDPLPTSTL

SEQ ID NO: 1949851 - protein, 17 aa, Staphylococcus
IDPDFSSVKSANPEEHE

SEQ ID NO: 1949852 - protein, 14 aa, Staphylococcus
IDPDNYKSADEQEI

SEQ ID NO: 1949853 - protein, 4 aa, Staphylococcus
IDPE

SEQ ID NO: 1949854 - protein, 13 aa, Staphylococcus
IDPEKLKANQISY

SEQ ID NO: 1949855 - protein, 6 aa, Staphylococcus
IDPENG

SEQ ID NO: 1949856 - protein, 8 aa, Staphylococcus
IDPKDPRQ

SEQ ID NO: 1949857 - protein, 9 aa, Staphylococcus
IDPKGGCSG

SEQ ID NO: 1949858 - protein, 6 aa, Staphylococcus
IDPKSQ

SEQ ID NO: 1949859 - protein, 5 aa, Staphylococcus
IDPLG

SEQ ID NO: 1949860 - protein, 4 aa, Staphylococcus
IDPN

SEQ ID NO: 1949861 - protein, 6 aa, Staphylococcus
IDPNDG

SEQ ID NO: 1949862 - protein, 16 aa, Staphylococcus
IDPNGPNKLTDEESEV

SEQ ID NO: 1949863 - protein, 9 aa, Staphylococcus
IDPNKPYAQ

SEQ ID NO: 1949864 - protein, 5 aa, Staphylococcus
IDPNN

SEQ ID NO: 1949865 - protein, 6 aa, Staphylococcus
IDPNSQ

SEQ ID NO: 1949866 - protein, 16 aa, Staphylococcus
IDPNYEPEISIEDSKQ

SEQ ID NO: 1949867 - protein, 4 aa, Staphylococcus
IDPS

SEQ ID NO: 1949868 - protein, 6 aa, Staphylococcus
IDPSEI

SEQ ID NO: 1949869 - protein, 5 aa, Staphylococcus
IDPSL

SEQ ID NO: 1949870 - protein, 16 aa, Staphylococcus
IDPSNETWHDEAMRIQ

SEQ ID NO: 1949871 - protein, 7 aa, Staphylococcus
IDPSNGA

SEQ ID NO: 1949872 - protein, 6 aa, Staphylococcus
IDPSTI

SEQ ID NO: 1949873 - protein, 14 aa, Staphylococcus
IDPSYEPDISIETS

SEQ ID NO: 1949874 - protein, 17 aa, Staphylococcus
IDPSYEPEISIDESKSY

SEQ ID NO: 1949875 - protein, 14 aa, Staphylococcus
IDPSYEPEISVEDS

SEQ ID NO: 1949876 - protein, 9 aa, Staphylococcus
IDPVGAGDA

SEQ ID NO: 1949877 - protein, 12 aa, Staphylococcus
IDQAKKDGDSLG

SEQ ID NO: 1949878 - protein, 9 aa, Staphylococcus
IDQDTTANI

SEQ ID NO: 1949879 - protein, 5 aa, Staphylococcus
IDQDV

SEQ ID NO: 1949880 - protein, 4 aa, Staphylococcus
IDQE

SEQ ID NO: 1949881 - protein, 6 aa, Staphylococcus
IDQGIG

SEQ ID NO: 1949882 - protein, 10 aa, Staphylococcus
IDQGVKGSDV

SEQ ID NO: 1949883 - protein, 7 aa, Staphylococcus
IDQITSD

SEQ ID NO: 1949884 - protein, 6 aa, Staphylococcus
IDQKYK

SEQ ID NO: 1949885 - protein, 23 aa, Staphylococcus
IDQLEQSKEEAPHKREAQKALAE

SEQ ID NO: 1949886 - protein, 9 aa, Staphylococcus
IDQNRNKQD

SEQ ID NO: 1949887 - protein, 4 aa, Staphylococcus
IDQQ

SEQ ID NO: 1949888 - protein, 6 aa, Staphylococcus
IDQQGN

SEQ ID NO: 1949889 - protein, 7 aa, Staphylococcus
IDQQTAL

SEQ ID NO: 1949890 - protein, 10 aa, Staphylococcus
IDQSASSREK

SEQ ID NO: 1949891 - protein, 9 aa, Staphylococcus
IDQSMEKDD

SEQ ID NO: 1949892 - protein, 9 aa, Staphylococcus
IDQSMEKDE

SEQ ID NO: 1949893 - protein, 9 aa, Staphylococcus
IDQSMEQDE

SEQ ID NO: 1949894 - protein, 5 aa, Staphylococcus
IDQSY

SEQ ID NO: 1949895 - protein, 8 aa, Staphylococcus
IDQTTQNF

SEQ ID NO: 1949896 - protein, 17 aa, Staphylococcus
IDQYAKSKQLKSSEAKL

SEQ ID NO: 1949897 - protein, 12 aa, Staphylococcus
IDQYSKKSLRKV

SEQ ID NO: 1949898 - protein, 4 aa, Staphylococcus
IDRD

SEQ ID NO: 1949899 - protein, 18 aa, Staphylococcus
IDREHQDERHNLTKGRLQ

SEQ ID NO: 1949900 - protein, 6 aa, Staphylococcus
IDREKY

SEQ ID NO: 1949901 - protein, 15 aa, Staphylococcus
IDRLEQSKEEAPHLR

SEQ ID NO: 1949902 - protein, 6 aa, Staphylococcus
IDRNNS

SEQ ID NO: 1949903 - protein, 5 aa, Staphylococcus
IDRPI

SEQ ID NO: 1949904 - protein, 6 aa, Staphylococcus
IDRPVL

SEQ ID NO: 1949905 - protein, 4 aa, Staphylococcus
IDRR

SEQ ID NO: 1949906 - protein, 15 aa, Staphylococcus
IDRTSNGKGKVKDYT

SEQ ID NO: 1949907 - protein, 11 aa, Staphylococcus
IDRTSNGSGYI

SEQ ID NO: 1949908 - protein, 9 aa, Staphylococcus
IDRTSSDIG

SEQ ID NO: 1949909 - protein, 4 aa, Staphylococcus
IDRV

SEQ ID NO: 1949910 - protein, 12 aa, Staphylococcus
IDRVSSKTISEA

SEQ ID NO: 1949911 - protein, 9 aa, Staphylococcus
IDSAEAETS

SEQ ID NO: 1949912 - protein, 5 aa, Staphylococcus
IDSDE

SEQ ID NO: 1949913 - protein, 12 aa, Staphylococcus
IDSDEDAQFTQK

SEQ ID NO: 1949914 - protein, 13 aa, Staphylococcus
IDSDKLKANQIEY

SEQ ID NO: 1949915 - protein, 10 aa, Staphylococcus
IDSEEDKYRN

SEQ ID NO: 1949916 - protein, 12 aa, Staphylococcus
IDSEEHVQYTQK

SEQ ID NO: 1949917 - protein, 9 aa, Staphylococcus
IDSETDESQ

SEQ ID NO: 1949918 - protein, 10 aa, Staphylococcus
IDSETDESQF

SEQ ID NO: 1949919 - protein, 5 aa, Staphylococcus
IDSFR

SEQ ID NO: 1949920 - protein, 6 aa, Staphylococcus
IDSGAA

SEQ ID NO: 1949921 - protein, 11 aa, Staphylococcus
IDSGDLEQGMQ

SEQ ID NO: 1949922 - protein, 16 aa, Staphylococcus
IDSGEEKKNLPGAEAI

SEQ ID NO: 1949923 - protein, 15 aa, Staphylococcus
IDSGKALKQYQLMKG

SEQ ID NO: 1949924 - protein, 10 aa, Staphylococcus
IDSGKPGKTL

SEQ ID NO: 1949925 - protein, 10 aa, Staphylococcus
IDSGNPGKTI

SEQ ID NO: 1949926 - protein, 6 aa, Staphylococcus
IDSIDE

SEQ ID NO: 1949927 - protein, 12 aa, Staphylococcus
IDSIPTLDEIDH

SEQ ID NO: 1949928 - protein, 14 aa, Staphylococcus
IDSISQQIKPLDSE

SEQ ID NO: 1949929 - protein, 6 aa, Staphylococcus
IDSKEA

SEQ ID NO: 1949930 - protein, 12 aa, Staphylococcus
IDSKKNDVQSGF

SEQ ID NO: 1949931 - protein, 7 aa, Staphylococcus
IDSKTSK

SEQ ID NO: 1949932 - protein, 6 aa, Staphylococcus
IDSKVG

SEQ ID NO: 1949933 - protein, 22 aa, Staphylococcus
IDSKYNFEDKRSNFEDTIFKTI

SEQ ID NO: 1949934 - protein, 4 aa, Staphylococcus
IDSL

SEQ ID NO: 1949935 - protein, 8 aa, Staphylococcus
IDSNKPVY

SEQ ID NO: 1949936 - protein, 13 aa, Staphylococcus
IDSNNTEEKHEDK

SEQ ID NO: 1949937 - protein, 13 aa, Staphylococcus
IDSNPNQPASERR

SEQ ID NO: 1949938 - protein, 14 aa, Staphylococcus
IDSNPNQPASERRK

SEQ ID NO: 1949939 - protein, 17 aa, Staphylococcus
IDSNSSTIQNSLKSILN

SEQ ID NO: 1949940 - protein, 10 aa, Staphylococcus
IDSPGYRNFK

SEQ ID NO: 1949941 - protein, 6 aa, Staphylococcus
IDSPKA

SEQ ID NO: 1949942 - protein, 15 aa, Staphylococcus
IDSPNEVVKEGDAVE

SEQ ID NO: 1949943 - protein, 6 aa, Staphylococcus
IDSPVA

SEQ ID NO: 1949944 - protein, 8 aa, Staphylococcus
IDSQRRVS

SEQ ID NO: 1949945 - protein, 7 aa, Staphylococcus
IDSREDI

SEQ ID NO: 1949946 - protein, 15 aa, Staphylococcus
IDSSASENNSETEHN

SEQ ID NO: 1949947 - protein, 7 aa, Staphylococcus
IDSSKER

SEQ ID NO: 1949948 - protein, 13 aa, Staphylococcus
IDSSTKHSTPFTP

SEQ ID NO: 1949949 - protein, 4 aa, Staphylococcus
IDST

SEQ ID NO: 1949950 - protein, 5 aa, Staphylococcus
IDSTQ

SEQ ID NO: 1949951 - protein, 9 aa, Staphylococcus
IDSVDSKER

SEQ ID NO: 1949952 - protein, 11 aa, Staphylococcus
IDTADTSEIEP

SEQ ID NO: 1949953 - protein, 12 aa, Staphylococcus
IDTADTSSVEPT

SEQ ID NO: 1949954 - protein, 6 aa, Staphylococcus
IDTAGL

SEQ ID NO: 1949955 - protein, 10 aa, Staphylococcus
IDTDEKIPGL

SEQ ID NO: 1949956 - protein, 11 aa, Staphylococcus
IDTDETVRDGI

SEQ ID NO: 1949957 - protein, 6 aa, Staphylococcus
IDTDLA

SEQ ID NO: 1949958 - protein, 6 aa, Staphylococcus
IDTDPE

SEQ ID NO: 1949959 - protein, 5 aa, Staphylococcus
IDTED

SEQ ID NO: 1949960 - protein, 5 aa, Staphylococcus
IDTEN

SEQ ID NO: 1949961 - protein, 17 aa, Staphylococcus
IDTENKMRQQRHNEYLD

SEQ ID NO: 1949962 - protein, 9 aa, Staphylococcus
IDTGDESVA

SEQ ID NO: 1949963 - protein, 9 aa, Staphylococcus
IDTGDGDFL

SEQ ID NO: 1949964 - protein, 6 aa, Staphylococcus
IDTGSI

SEQ ID NO: 1949965 - protein, 13 aa, Staphylococcus
IDTHGTPLPNETL

SEQ ID NO: 1949966 - protein, 7 aa, Staphylococcus
IDTHNRS

SEQ ID NO: 1949967 - protein, 27 aa, Staphylococcus
IDTKNRKYPKEIEASGRIGIPNKGEWT

SEQ ID NO: 1949968 - protein, 13 aa, Staphylococcus
IDTKNRKYPREIE

SEQ ID NO: 1949969 - protein, 4 aa, Staphylococcus
IDTL

SEQ ID NO: 1949970 - protein, 8 aa, Staphylococcus
IDTNDGGE

SEQ ID NO: 1949971 - protein, 9 aa, Staphylococcus
IDTNKSGRV

SEQ ID NO: 1949972 - protein, 6 aa, Staphylococcus
IDTNPE

SEQ ID NO: 1949973 - protein, 8 aa, Staphylococcus
IDTNSITD

SEQ ID NO: 1949974 - protein, 17 aa, Staphylococcus
IDTQAEVYKNNADRALK

SEQ ID NO: 1949975 - protein, 16 aa, Staphylococcus
IDTQIGKGTIITLEIP

SEQ ID NO: 1949976 - protein, 10 aa, Staphylococcus
IDTRHNDNKK

SEQ ID NO: 1949977 - protein, 5 aa, Staphylococcus
IDTSD

SEQ ID NO: 1949978 - protein, 18 aa, Staphylococcus
IDTSKPLNKQIKEYTTGH

SEQ ID NO: 1949979 - protein, 6 aa, Staphylococcus
IDTSKR

SEQ ID NO: 1949980 - protein, 7 aa, Staphylococcus
IDTSPAF

SEQ ID NO: 1949981 - protein, 14 aa, Staphylococcus
IDTSPNARTQGGQL

SEQ ID NO: 1949982 - protein, 8 aa, Staphylococcus
IDTSQDYE

SEQ ID NO: 1949983 - protein, 9 aa, Staphylococcus
IDTTAAGDT

SEQ ID NO: 1949984 - protein, 5 aa, Staphylococcus
IDTTH

SEQ ID NO: 1949985 - protein, 10 aa, Staphylococcus
IDTTQTSGEF

SEQ ID NO: 1949986 - protein, 11 aa, Staphylococcus
IDTTTGISANE

SEQ ID NO: 1949987 - protein, 5 aa, Staphylococcus
IDTVK

SEQ ID NO: 1949988 - protein, 12 aa, Staphylococcus
IDTYKEKDLRNV

SEQ ID NO: 1949989 - protein, 13 aa, Staphylococcus
IDTYTSDKPQTIN

SEQ ID NO: 1949990 - protein, 11 aa, Staphylococcus
IDVDTGAGHGK

SEQ ID NO: 1949991 - protein, 5 aa, Staphylococcus
IDYET

SEQ ID NO: 1949992 - protein, 7 aa, Staphylococcus
IDYETTD

SEQ ID NO: 1949993 - protein, 6 aa, Staphylococcus
IDYQTN

SEQ ID NO: 1949994 - protein, 10 aa, Staphylococcus
IDYTAKKDGF

SEQ ID NO: 1949995 - protein, 10 aa, Staphylococcus
IEAAPNSPKM

SEQ ID NO: 1949996 - protein, 10 aa, Staphylococcus
IEADGNKYRN

SEQ ID NO: 1949997 - protein, 5 aa, Staphylococcus
IEADT

SEQ ID NO: 1949998 - protein, 17 aa, Staphylococcus
IEAEAGEQYRRTTKKFV

SEQ ID NO: 1949999 - protein, 9 aa, Staphylococcus
IEAEGDIAT

SEQ ID NO: 1950000 - protein, 12 aa, Staphylococcus
IEAGGPVTVTHP

SEQ ID NO: 1950001 - protein, 9 aa, Staphylococcus
IEAGKGDDV

SEQ ID NO: 1950002 - protein, 8 aa, Staphylococcus
IEAGQGDD

SEQ ID NO: 1950003 - protein, 4 aa, Staphylococcus
IEAK

SEQ ID NO: 1950004 - protein, 5 aa, Staphylococcus
IEANG

SEQ ID NO: 1950005 - protein, 12 aa, Staphylococcus
IEANREKQPIET

SEQ ID NO: 1950006 - protein, 6 aa, Staphylococcus
IEAPGY

SEQ ID NO: 1950007 - protein, 7 aa, Staphylococcus
IEASRDS

SEQ ID NO: 1950008 - protein, 24 aa, Staphylococcus
IEASTTNSYIDQKAQKRKQRQIER

SEQ ID NO: 1950009 - protein, 9 aa, Staphylococcus
IEDAGIEAS

SEQ ID NO: 1950010 - protein, 9 aa, Staphylococcus
IEDAGIQPE

SEQ ID NO: 1950011 - protein, 11 aa, Staphylococcus
IEDAKKTAEEI

SEQ ID NO: 1950012 - protein, 11 aa, Staphylococcus
IEDAKKVAKQI

SEQ ID NO: 1950013 - protein, 4 aa, Staphylococcus
IEDD

SEQ ID NO: 1950014 - protein, 5 aa, Staphylococcus
IEDDD

SEQ ID NO: 1950015 - protein, 11 aa, Staphylococcus
IEDDDNESRHG

SEQ ID NO: 1950016 - protein, 7 aa, Staphylococcus
IEDDGTY

SEQ ID NO: 1950017 - protein, 9 aa, Staphylococcus
IEDDNSKTH

SEQ ID NO: 1950018 - protein, 6 aa, Staphylococcus
IEDDVN

SEQ ID NO: 1950019 - protein, 4 aa, Staphylococcus
IEDE

SEQ ID NO: 1950020 - protein, 5 aa, Staphylococcus
IEDEA

SEQ ID NO: 1950021 - protein, 6 aa, Staphylococcus
IEDEAR

SEQ ID NO: 1950022 - protein, 6 aa, Staphylococcus
IEDEDN

SEQ ID NO: 1950023 - protein, 14 aa, Staphylococcus
IEDESGASTATISR

SEQ ID NO: 1950024 - protein, 8 aa, Staphylococcus
IEDESNYP

SEQ ID NO: 1950025 - protein, 4 aa, Staphylococcus
IEDG

SEQ ID NO: 1950026 - protein, 7 aa, Staphylococcus
IEDGEQI

SEQ ID NO: 1950027 - protein, 6 aa, Staphylococcus
IEDGMP

SEQ ID NO: 1950028 - protein, 4 aa, Staphylococcus
IEDI

SEQ ID NO: 1950029 - protein, 5 aa, Staphylococcus
IEDIP

SEQ ID NO: 1950030 - protein, 16 aa, Staphylococcus
IEDIQDKKEPETEQFQ

SEQ ID NO: 1950031 - protein, 17 aa, Staphylococcus
IEDKESLQRACEAGQVS

SEQ ID NO: 1950032 - protein, 6 aa, Staphylococcus
IEDKGG

SEQ ID NO: 1950033 - protein, 13 aa, Staphylococcus
IEDLNSNNNIPRH

SEQ ID NO: 1950034 - protein, 5 aa, Staphylococcus
IEDMK

SEQ ID NO: 1950035 - protein, 6 aa, Staphylococcus
IEDNGL

SEQ ID NO: 1950036 - protein, 9 aa, Staphylococcus
IEDNKGSVV

SEQ ID NO: 1950037 - protein, 11 aa, Staphylococcus
IEDNPDLTSAL

SEQ ID NO: 1950038 - protein, 7 aa, Staphylococcus
IEDPETF

SEQ ID NO: 1950039 - protein, 9 aa, Staphylococcus
IEDQDKREK

SEQ ID NO: 1950040 - protein, 7 aa, Staphylococcus
IEDQVEE

SEQ ID NO: 1950041 - protein, 9 aa, Staphylococcus
IEDSDRGLK

SEQ ID NO: 1950042 - protein, 8 aa, Staphylococcus
IEDSDSRH

SEQ ID NO: 1950043 - protein, 14 aa, Staphylococcus
IEDSESEQESRNIS

SEQ ID NO: 1950044 - protein, 12 aa, Staphylococcus
IEDSNAPQGTIH

SEQ ID NO: 1950045 - protein, 20 aa, Staphylococcus
IEDSNEVHYAASQKEALQTA

SEQ ID NO: 1950046 - protein, 10 aa, Staphylococcus
IEDSVNQGYV

SEQ ID NO: 1950047 - protein, 11 aa, Staphylococcus
IEDTEDGIPNT

SEQ ID NO: 1950048 - protein, 6 aa, Staphylococcus
IEDTKD

SEQ ID NO: 1950049 - protein, 9 aa, Staphylococcus
IEDTPDTPD

SEQ ID NO: 1950050 - protein, 5 aa, Staphylococcus
IEDTT

SEQ ID NO: 1950051 - protein, 10 aa, Staphylococcus
IEDYDSNREY

SEQ ID NO: 1950052 - protein, 4 aa, Staphylococcus
IEEA

SEQ ID NO: 1950053 - protein, 12 aa, Staphylococcus
IEEAAEEKKKIS

SEQ ID NO: 1950054 - protein, 22 aa, Staphylococcus
IEEAAKATTGKVVNNTGQVCTA

SEQ ID NO: 1950055 - protein, 6 aa, Staphylococcus
IEEAEA

SEQ ID NO: 1950056 - protein, 8 aa, Staphylococcus
IEEAESYR

SEQ ID NO: 1950057 - protein, 10 aa, Staphylococcus
IEEAQDGKEA

SEQ ID NO: 1950058 - protein, 6 aa, Staphylococcus
IEEASH

SEQ ID NO: 1950059 - protein, 11 aa, Staphylococcus
IEEASITAKDK

SEQ ID NO: 1950060 - protein, 13 aa, Staphylococcus
IEEATHGNNQPAE

SEQ ID NO: 1950061 - protein, 9 aa, Staphylococcus
IEEDAKKAV

SEQ ID NO: 1950062 - protein, 6 aa, Staphylococcus
IEEDNQ

SEQ ID NO: 1950063 - protein, 10 aa, Staphylococcus
IEEDRNNNVE

SEQ ID NO: 1950064 - protein, 6 aa, Staphylococcus
IEEDTG

SEQ ID NO: 1950065 - protein, 15 aa, Staphylococcus
IEEDTGLPFASENPG

SEQ ID NO: 1950066 - protein, 14 aa, Staphylococcus
IEEEAPNNKENEQQ

SEQ ID NO: 1950067 - protein, 5 aa, Staphylococcus
IEEEG

SEQ ID NO: 1950068 - protein, 6 aa, Staphylococcus
IEEEKE

SEQ ID NO: 1950069 - protein, 5 aa, Staphylococcus
IEEEN

SEQ ID NO: 1950070 - protein, 6 aa, Staphylococcus
IEEENL

SEQ ID NO: 1950071 - protein, 11 aa, Staphylococcus
IEEENLDIPPE

SEQ ID NO: 1950072 - protein, 7 aa, Staphylococcus
IEEENLE

SEQ ID NO: 1950073 - protein, 13 aa, Staphylococcus
IEEESFDGDALKF

SEQ ID NO: 1950074 - protein, 5 aa, Staphylococcus
IEEGA

SEQ ID NO: 1950075 - protein, 5 aa, Staphylococcus
IEEGD

SEQ ID NO: 1950076 - protein, 6 aa, Staphylococcus
IEEGIG

SEQ ID NO: 1950077 - protein, 8 aa, Staphylococcus
IEEGKEEE

SEQ ID NO: 1950078 - protein, 15 aa, Staphylococcus
IEEGKKGNPGEILET

SEQ ID NO: 1950079 - protein, 5 aa, Staphylococcus
IEEGM

SEQ ID NO: 1950080 - protein, 10 aa, Staphylococcus
IEEGQNNDGI

SEQ ID NO: 1950081 - protein, 16 aa, Staphylococcus
IEEKSNEIGIGKPTLE

SEQ ID NO: 1950082 - protein, 9 aa, Staphylococcus
IEEKSQNIS

SEQ ID NO: 1950083 - protein, 13 aa, Staphylococcus
IEEKTNVKHESPQ

SEQ ID NO: 1950084 - protein, 5 aa, Staphylococcus
IEEKY

SEQ ID NO: 1950085 - protein, 4 aa, Staphylococcus
IEEL

SEQ ID NO: 1950086 - protein, 11 aa, Staphylococcus
IEENDDGIPNT

SEQ ID NO: 1950087 - protein, 12 aa, Staphylococcus
IEENEAKQSRLD

SEQ ID NO: 1950088 - protein, 24 aa, Staphylococcus
IEENFTSKEMPNLPEDPKSYSRNE

SEQ ID NO: 1950089 - protein, 5 aa, Staphylococcus
IEENP

SEQ ID NO: 1950090 - protein, 9 aa, Staphylococcus
IEENPNQPK

SEQ ID NO: 1950091 - protein, 4 aa, Staphylococcus
IEEP

SEQ ID NO: 1950092 - protein, 18 aa, Staphylococcus
IEEQAEEVQKVKRSENGV

SEQ ID NO: 1950093 - protein, 21 aa, Staphylococcus
IEEQQAKEQLETLKKKQKELN

SEQ ID NO: 1950094 - protein, 6 aa, Staphylococcus
IEEQQV

SEQ ID NO: 1950095 - protein, 6 aa, Staphylococcus
IEEQTG

SEQ ID NO: 1950096 - protein, 6 aa, Staphylococcus
IEEQTY

SEQ ID NO: 1950097 - protein, 17 aa, Staphylococcus
IEEQTYERNREAADRIG

SEQ ID NO: 1950098 - protein, 15 aa, Staphylococcus
IEEQTYERNREAVDK

SEQ ID NO: 1950099 - protein, 15 aa, Staphylococcus
IEEQTYERNREAVNN

SEQ ID NO: 1950100 - protein, 20 aa, Staphylococcus
IEERNQVNYANSQKDALQTA

SEQ ID NO: 1950101 - protein, 10 aa, Staphylococcus
IEESAKVQEQ

SEQ ID NO: 1950102 - protein, 7 aa, Staphylococcus
IEESDVP

SEQ ID NO: 1950103 - protein, 12 aa, Staphylococcus
IEESGVTPNSDA

SEQ ID NO: 1950104 - protein, 8 aa, Staphylococcus
IEESQAET

SEQ ID NO: 1950105 - protein, 11 aa, Staphylococcus
IEESQKSNGRW

SEQ ID NO: 1950106 - protein, 5 aa, Staphylococcus
IEESY

SEQ ID NO: 1950107 - protein, 4 aa, Staphylococcus
IEET

SEQ ID NO: 1950108 - protein, 6 aa, Staphylococcus
IEETED

SEQ ID NO: 1950109 - protein, 5 aa, Staphylococcus
IEETG

SEQ ID NO: 1950110 - protein, 9 aa, Staphylococcus
IEETKNKRG

SEQ ID NO: 1950111 - protein, 5 aa, Staphylococcus
IEETN

SEQ ID NO: 1950112 - protein, 6 aa, Staphylococcus
IEETSG

SEQ ID NO: 1950113 - protein, 9 aa, Staphylococcus
IEETTNDRG

SEQ ID NO: 1950114 - protein, 8 aa, Staphylococcus
IEEVDSDR

SEQ ID NO: 1950115 - protein, 6 aa, Staphylococcus
IEEVEE

SEQ ID NO: 1950116 - protein, 14 aa, Staphylococcus
IEFEDGRTAEMTTG

SEQ ID NO: 1950117 - protein, 4 aa, Staphylococcus
IEFG

SEQ ID NO: 1950118 - protein, 7 aa, Staphylococcus
IEGAGLS

SEQ ID NO: 1950119 - protein, 5 aa, Staphylococcus
IEGAQ

SEQ ID NO: 1950120 - protein, 6 aa, Staphylococcus
IEGAVE

SEQ ID NO: 1950121 - protein, 11 aa, Staphylococcus
IEGDDDSFKSL

SEQ ID NO: 1950122 - protein, 10 aa, Staphylococcus
IEGDKALANN

SEQ ID NO: 1950123 - protein, 11 aa, Staphylococcus
IEGEDESFKSL

SEQ ID NO: 1950124 - protein, 9 aa, Staphylococcus
IEGEKTLAN

SEQ ID NO: 1950125 - protein, 10 aa, Staphylococcus
IEGEKTLANS

SEQ ID NO: 1950126 - protein, 6 aa, Staphylococcus
IEGENA

SEQ ID NO: 1950127 - protein, 17 aa, Staphylococcus
IEGFTEEQAQYTIDQLD

SEQ ID NO: 1950128 - protein, 6 aa, Staphylococcus
IEGITD

SEQ ID NO: 1950129 - protein, 5 aa, Staphylococcus
IEGKD

SEQ ID NO: 1950130 - protein, 8 aa, Staphylococcus
IEGKENKV

SEQ ID NO: 1950131 - protein, 11 aa, Staphylococcus
IEGKQQGKETI

SEQ ID NO: 1950132 - protein, 11 aa, Staphylococcus
IEGKSQNKETI

SEQ ID NO: 1950133 - protein, 10 aa, Staphylococcus
IEGKSYTPQE

SEQ ID NO: 1950134 - protein, 23 aa, Staphylococcus
IEGKTGTAQVVNENGSGYVKGAN

SEQ ID NO: 1950135 - protein, 5 aa, Staphylococcus
IEGLP

SEQ ID NO: 1950136 - protein, 4 aa, Staphylococcus
IEGN

SEQ ID NO: 1950137 - protein, 11 aa, Staphylococcus
IEGNDESFKSL

SEQ ID NO: 1950138 - protein, 14 aa, Staphylococcus
IEGNEITAYLNEVI

SEQ ID NO: 1950139 - protein, 6 aa, Staphylococcus
IEGNST

SEQ ID NO: 1950140 - protein, 8 aa, Staphylococcus
IEGNVTSS

SEQ ID NO: 1950141 - protein, 13 aa, Staphylococcus
IEGPGDKPITESF

SEQ ID NO: 1950142 - protein, 5 aa, Staphylococcus
IEGPV

SEQ ID NO: 1950143 - protein, 4 aa, Staphylococcus
IEGQ

SEQ ID NO: 1950144 - protein, 24 aa, Staphylococcus
IEGQEVKSYREEDRVAEDSITPTF

SEQ ID NO: 1950145 - protein, 9 aa, Staphylococcus
IEGTAGREL

SEQ ID NO: 1950146 - protein, 11 aa, Staphylococcus
IEGTDLENKSI

SEQ ID NO: 1950147 - protein, 12 aa, Staphylococcus
IEGTHVKGKRDR

SEQ ID NO: 1950148 - protein, 9 aa, Staphylococcus
IEGTPGREL

SEQ ID NO: 1950149 - protein, 9 aa, Staphylococcus
IEHEAEQQG

SEQ ID NO: 1950150 - protein, 8 aa, Staphylococcus
IEHTGTYT

SEQ ID NO: 1950151 - protein, 8 aa, Staphylococcus
IEIDSPGY

SEQ ID NO: 1950152 - protein, 5 aa, Staphylococcus
IEIEG

SEQ ID NO: 1950153 - protein, 13 aa, Staphylococcus
IEINKGTDDSETV

SEQ ID NO: 1950154 - protein, 9 aa, Staphylococcus
IEINPNLPE

SEQ ID NO: 1950155 - protein, 6 aa, Staphylococcus
IEKAER

SEQ ID NO: 1950156 - protein, 5 aa, Staphylococcus
IEKAN

SEQ ID NO: 1950157 - protein, 16 aa, Staphylococcus
IEKASSDVSLATESDN

SEQ ID NO: 1950158 - protein, 8 aa, Staphylococcus
IEKDEKGI

SEQ ID NO: 1950159 - protein, 12 aa, Staphylococcus
IEKDQKKTDLNE

SEQ ID NO: 1950160 - protein, 4 aa, Staphylococcus
IEKE

SEQ ID NO: 1950161 - protein, 10 aa, Staphylococcus
IEKEDTDEED

SEQ ID NO: 1950162 - protein, 17 aa, Staphylococcus
IEKEPNKNRVNSSTITN

SEQ ID NO: 1950163 - protein, 14 aa, Staphylococcus
IEKESGASTATISR

SEQ ID NO: 1950164 - protein, 8 aa, Staphylococcus
IEKGDEAL

SEQ ID NO: 1950165 - protein, 11 aa, Staphylococcus
IEKGQSNPTIT

SEQ ID NO: 1950166 - protein, 5 aa, Staphylococcus
IEKGT

SEQ ID NO: 1950167 - protein, 11 aa, Staphylococcus
IEKKQRKWSIT

SEQ ID NO: 1950168 - protein, 11 aa, Staphylococcus
IEKLPANKRRV

SEQ ID NO: 1950169 - protein, 4 aa, Staphylococcus
IEKN

SEQ ID NO: 1950170 - protein, 6 aa, Staphylococcus
IEKNDI

SEQ ID NO: 1950171 - protein, 8 aa, Staphylococcus
IEKNKEKI

SEQ ID NO: 1950172 - protein, 14 aa, Staphylococcus
IEKQNADLTDEELQ

SEQ ID NO: 1950173 - protein, 7 aa, Staphylococcus
IEKRPNE

SEQ ID NO: 1950174 - protein, 18 aa, Staphylococcus
IEKRTGELQKELNVLYYE

SEQ ID NO: 1950175 - protein, 20 aa, Staphylococcus
IEKRTNQLQKELNEIAKRLE

SEQ ID NO: 1950176 - protein, 11 aa, Staphylococcus
IEKSGKKVPMK

SEQ ID NO: 1950177 - protein, 18 aa, Staphylococcus
IEKSGKQVELKKTEDFEV

SEQ ID NO: 1950178 - protein, 9 aa, Staphylococcus
IEKSQKQEY

SEQ ID NO: 1950179 - protein, 7 aa, Staphylococcus
IEKSTAL

SEQ ID NO: 1950180 - protein, 7 aa, Staphylococcus
IEKTDDT

SEQ ID NO: 1950181 - protein, 8 aa, Staphylococcus
IEKTGNPH

SEQ ID NO: 1950182 - protein, 12 aa, Staphylococcus
IEKTRENEPIET

SEQ ID NO: 1950183 - protein, 6 aa, Staphylococcus
IEKVEK

SEQ ID NO: 1950184 - protein, 10 aa, Staphylococcus
IEKYTKQGSL

SEQ ID NO: 1950185 - protein, 10 aa, Staphylococcus
IEKYTSQGSL

SEQ ID NO: 1950186 - protein, 4 aa, Staphylococcus
IELE

SEQ ID NO: 1950187 - protein, 18 aa, Staphylococcus
IELNEGRMGAKKGPDEIK

SEQ ID NO: 1950188 - protein, 13 aa, Staphylococcus
IELQGGTPEENKN

SEQ ID NO: 1950189 - protein, 12 aa, Staphylococcus
IELSADGPIRPP

SEQ ID NO: 1950190 - protein, 14 aa, Staphylococcus
IELSADGPIRPPYE

SEQ ID NO: 1950191 - protein, 14 aa, Staphylococcus
IELSDGKVKPAQLE

SEQ ID NO: 1950192 - protein, 12 aa, Staphylococcus
IELSGSESYKDG

SEQ ID NO: 1950193 - protein, 6 aa, Staphylococcus
IELSPT

SEQ ID NO: 1950194 - protein, 12 aa, Staphylococcus
IELTDDELQESI

SEQ ID NO: 1950195 - protein, 12 aa, Staphylococcus
IELTGKKEQDKV

SEQ ID NO: 1950196 - protein, 12 aa, Staphylococcus
IELTGNKEQDKI

SEQ ID NO: 1950197 - protein, 5 aa, Staphylococcus
IEMSP

SEQ ID NO: 1950198 - protein, 12 aa, Staphylococcus
IEMTGKKASDKV

SEQ ID NO: 1950199 - protein, 7 aa, Staphylococcus
IEMTQDE

SEQ ID NO: 1950200 - protein, 6 aa, Staphylococcus
IENAGK

SEQ ID NO: 1950201 - protein, 9 aa, Staphylococcus
IENANNKSL

SEQ ID NO: 1950202 - protein, 20 aa, Staphylococcus
IENANNSGLKRDKINEQIEG

SEQ ID NO: 1950203 - protein, 15 aa, Staphylococcus
IENDGAEGLKTALSK

SEQ ID NO: 1950204 - protein, 7 aa, Staphylococcus
IENDGGS

SEQ ID NO: 1950205 - protein, 15 aa, Staphylococcus
IENDGQSGLDKALTK

SEQ ID NO: 1950206 - protein, 8 aa, Staphylococcus
IENDPEDS

SEQ ID NO: 1950207 - protein, 8 aa, Staphylococcus
IENDPEES

SEQ ID NO: 1950208 - protein, 10 aa, Staphylococcus
IENDSEGGSM

SEQ ID NO: 1950209 - protein, 7 aa, Staphylococcus
IENEDGA

SEQ ID NO: 1950210 - protein, 7 aa, Staphylococcus
IENEGKK

SEQ ID NO: 1950211 - protein, 8 aa, Staphylococcus
IENEKVTE

SEQ ID NO: 1950212 - protein, 9 aa, Staphylococcus
IENENDEQH

SEQ ID NO: 1950213 - protein, 8 aa, Staphylococcus
IENEPEAT

SEQ ID NO: 1950214 - protein, 8 aa, Staphylococcus
IENEPEDS

SEQ ID NO: 1950215 - protein, 6 aa, Staphylococcus
IENERT

SEQ ID NO: 1950216 - protein, 4 aa, Staphylococcus
IENG

SEQ ID NO: 1950217 - protein, 8 aa, Staphylococcus
IENGAEGI

SEQ ID NO: 1950218 - protein, 10 aa, Staphylococcus
IENGKRNFPS

SEQ ID NO: 1950219 - protein, 11 aa, Staphylococcus
IENGKYKGKTL

SEQ ID NO: 1950220 - protein, 11 aa, Staphylococcus
IENGQYAGQTL

SEQ ID NO: 1950221 - protein, 11 aa, Staphylococcus
IENGRRPSMRE

SEQ ID NO: 1950222 - protein, 16 aa, Staphylococcus
IENITGRTVTHSTGDI

SEQ ID NO: 1950223 - protein, 6 aa, Staphylococcus
IENKQD

SEQ ID NO: 1950224 - protein, 4 aa, Staphylococcus
IENN

SEQ ID NO: 1950225 - protein, 11 aa, Staphylococcus
IENNEEDEAGR

SEQ ID NO: 1950226 - protein, 5 aa, Staphylococcus
IENNS

SEQ ID NO: 1950227 - protein, 9 aa, Staphylococcus
IENNSEGGS

SEQ ID NO: 1950228 - protein, 10 aa, Staphylococcus
IENNSEGGSM

SEQ ID NO: 1950229 - protein, 10 aa, Staphylococcus
IENNSESGSM

SEQ ID NO: 1950230 - protein, 12 aa, Staphylococcus
IENNSVSLPKKE

SEQ ID NO: 1950231 - protein, 6 aa, Staphylococcus
IENPSE

SEQ ID NO: 1950232 - protein, 15 aa, Staphylococcus
IENPSEVVKQGDEIE

SEQ ID NO: 1950233 - protein, 4 aa, Staphylococcus
IENS

SEQ ID NO: 1950234 - protein, 9 aa, Staphylococcus
IENSGTGVY

SEQ ID NO: 1950235 - protein, 5 aa, Staphylococcus
IENSI

SEQ ID NO: 1950236 - protein, 9 aa, Staphylococcus
IENSKYSQV

SEQ ID NO: 1950237 - protein, 6 aa, Staphylococcus
IENTSS

SEQ ID NO: 1950238 - protein, 10 aa, Staphylococcus
IENTTVPTGT

SEQ ID NO: 1950239 - protein, 8 aa, Staphylococcus
IENVTELS

SEQ ID NO: 1950240 - protein, 7 aa, Staphylococcus
IENYESE

SEQ ID NO: 1950241 - protein, 12 aa, Staphylococcus
IENYESEVSVTD

SEQ ID NO: 1950242 - protein, 20 aa, Staphylococcus
IEPAATMAEGAQQIVKLVKE

SEQ ID NO: 1950243 - protein, 7 aa, Staphylococcus
IEPDSGQ

SEQ ID NO: 1950244 - protein, 12 aa, Staphylococcus
IEPEAAEEGYVS

SEQ ID NO: 1950245 - protein, 13 aa, Staphylococcus
IEPEASDEGYVSS

SEQ ID NO: 1950246 - protein, 10 aa, Staphylococcus
IEPGEDKREK

SEQ ID NO: 1950247 - protein, 7 aa, Staphylococcus
IEPGEPC

SEQ ID NO: 1950248 - protein, 5 aa, Staphylococcus
IEPGT

SEQ ID NO: 1950249 - protein, 7 aa, Staphylococcus
IEPGTDA

SEQ ID NO: 1950250 - protein, 4 aa, Staphylococcus
IEPK

SEQ ID NO: 1950251 - protein, 5 aa, Staphylococcus
IEPKQ

SEQ ID NO: 1950252 - protein, 4 aa, Staphylococcus
IEPL

SEQ ID NO: 1950253 - protein, 4 aa, Staphylococcus
IEPN

SEQ ID NO: 1950254 - protein, 9 aa, Staphylococcus
IEPNPAAGG

SEQ ID NO: 1950255 - protein, 18 aa, Staphylococcus
IEPNTAPIRGGTDGSQLS

SEQ ID NO: 1950256 - protein, 5 aa, Staphylococcus
IEPPE

SEQ ID NO: 1950257 - protein, 8 aa, Staphylococcus
IEPPSAQP

SEQ ID NO: 1950258 - protein, 6 aa, Staphylococcus
IEPQTI

SEQ ID NO: 1950259 - protein, 4 aa, Staphylococcus
IEPS

SEQ ID NO: 1950260 - protein, 5 aa, Staphylococcus
IEPSA

SEQ ID NO: 1950261 - protein, 6 aa, Staphylococcus
IEPSDK

SEQ ID NO: 1950262 - protein, 9 aa, Staphylococcus
IEPSEELEQ

SEQ ID NO: 1950263 - protein, 7 aa, Staphylococcus
IEPSIQN

SEQ ID NO: 1950264 - protein, 8 aa, Staphylococcus
IEPSQGSV

SEQ ID NO: 1950265 - protein, 7 aa, Staphylococcus
IEPSRKQ

SEQ ID NO: 1950266 - protein, 11 aa, Staphylococcus
IEPSTQVEGTI

SEQ ID NO: 1950267 - protein, 5 aa, Staphylococcus
IEPSY

SEQ ID NO: 1950268 - protein, 5 aa, Staphylococcus
IEPTE

SEQ ID NO: 1950269 - protein, 6 aa, Staphylococcus
IEPTKE

SEQ ID NO: 1950270 - protein, 9 aa, Staphylococcus
IEPTTDYTE

SEQ ID NO: 1950271 - protein, 4 aa, Staphylococcus
IEPV

SEQ ID NO: 1950272 - protein, 6 aa, Staphylococcus
IEPVTK

SEQ ID NO: 1950273 - protein, 11 aa, Staphylococcus
IEQAEKLKNDM

SEQ ID NO: 1950274 - protein, 9 aa, Staphylococcus
IEQAKKDGI

SEQ ID NO: 1950275 - protein, 11 aa, Staphylococcus
IEQASQKSKLS

SEQ ID NO: 1950276 - protein, 40 aa, Staphylococcus
IEQAVEKNNQQTTKAQNDSTIITTEHSKKEDHLSDSDRKV

SEQ ID NO: 1950277 - protein, 12 aa, Staphylococcus
IEQDADDKKTFR

SEQ ID NO: 1950278 - protein, 14 aa, Staphylococcus
IEQDDQKSLASRTW

SEQ ID NO: 1950279 - protein, 5 aa, Staphylococcus
IEQDG

SEQ ID NO: 1950280 - protein, 10 aa, Staphylococcus
IEQDSEDLDG

SEQ ID NO: 1950281 - protein, 6 aa, Staphylococcus
IEQENT

SEQ ID NO: 1950282 - protein, 4 aa, Staphylococcus
IEQG

SEQ ID NO: 1950283 - protein, 13 aa, Staphylococcus
IEQGDEVAKARLA

SEQ ID NO: 1950284 - protein, 14 aa, Staphylococcus
IEQGDEVAKSRLAE

SEQ ID NO: 1950285 - protein, 9 aa, Staphylococcus
IEQGETSYI

SEQ ID NO: 1950286 - protein, 5 aa, Staphylococcus
IEQGI

SEQ ID NO: 1950287 - protein, 5 aa, Staphylococcus
IEQGK

SEQ ID NO: 1950288 - protein, 5 aa, Staphylococcus
IEQGN

SEQ ID NO: 1950289 - protein, 6 aa, Staphylococcus
IEQHQN

SEQ ID NO: 1950290 - protein, 11 aa, Staphylococcus
IEQIESGKYDG

SEQ ID NO: 1950291 - protein, 9 aa, Staphylococcus
IEQKKKGID

SEQ ID NO: 1950292 - protein, 8 aa, Staphylococcus
IEQKRKGI

SEQ ID NO: 1950293 - protein, 4 aa, Staphylococcus
IEQL

SEQ ID NO: 1950294 - protein, 4 aa, Staphylococcus
IEQN

SEQ ID NO: 1950295 - protein, 7 aa, Staphylococcus
IEQNENK

SEQ ID NO: 1950296 - protein, 10 aa, Staphylococcus
IEQNSTPFTP

SEQ ID NO: 1950297 - protein, 8 aa, Staphylococcus
IEQPAYEI

SEQ ID NO: 1950298 - protein, 9 aa, Staphylococcus
IEQPNSGTI

SEQ ID NO: 1950299 - protein, 6 aa, Staphylococcus
IEQPNT

SEQ ID NO: 1950300 - protein, 15 aa, Staphylococcus
IEQQDEMGYTQKSPR

SEQ ID NO: 1950301 - protein, 5 aa, Staphylococcus
IEQRQ

SEQ ID NO: 1950302 - protein, 5 aa, Staphylococcus
IEQRR

SEQ ID NO: 1950303 - protein, 9 aa, Staphylococcus
IEQSDKDNN

SEQ ID NO: 1950304 - protein, 12 aa, Staphylococcus
IEQSLKDNHTSY

SEQ ID NO: 1950305 - protein, 5 aa, Staphylococcus
IEQSR

SEQ ID NO: 1950306 - protein, 4 aa, Staphylococcus
IEQY

SEQ ID NO: 1950307 - protein, 6 aa, Staphylococcus
IEQYAE

SEQ ID NO: 1950308 - protein, 30 aa, Staphylococcus
IEQYRDSEIDENEDLSNDAIKQPRQQLSPK

SEQ ID NO: 1950309 - protein, 7 aa, Staphylococcus
IERDEKG

SEQ ID NO: 1950310 - protein, 5 aa, Staphylococcus
IERDK

SEQ ID NO: 1950311 - protein, 10 aa, Staphylococcus
IEREEGDKEY

SEQ ID NO: 1950312 - protein, 10 aa, Staphylococcus
IEREENDKTY

SEQ ID NO: 1950313 - protein, 17 aa, Staphylococcus
IEREHQDERHNLTKGRL

SEQ ID NO: 1950314 - protein, 19 aa, Staphylococcus
IEREHQDERHNLTKGRLQR

SEQ ID NO: 1950315 - protein, 11 aa, Staphylococcus
IERGGAGGGIA

SEQ ID NO: 1950316 - protein, 17 aa, Staphylococcus
IERLEASRDEQPHLREA

SEQ ID NO: 1950317 - protein, 15 aa, Staphylococcus
IERLEQSKEEAPHLR

SEQ ID NO: 1950318 - protein, 12 aa, Staphylococcus
IERLKEDKAQLE

SEQ ID NO: 1950319 - protein, 8 aa, Staphylococcus
IERNEDLQ

SEQ ID NO: 1950320 - protein, 10 aa, Staphylococcus
IERNENKSIP

SEQ ID NO: 1950321 - protein, 4 aa, Staphylococcus
IERP

SEQ ID NO: 1950322 - protein, 9 aa, Staphylococcus
IERQPNQPT

SEQ ID NO: 1950323 - protein, 7 aa, Staphylococcus
IERRTAQ

SEQ ID NO: 1950324 - protein, 8 aa, Staphylococcus
IERTQALG

SEQ ID NO: 1950325 - protein, 14 aa, Staphylococcus
IERTQLSQAAQSYK

SEQ ID NO: 1950326 - protein, 9 aa, Staphylococcus
IERVTKSRQ

SEQ ID NO: 1950327 - protein, 5 aa, Staphylococcus
IERYK

SEQ ID NO: 1950328 - protein, 9 aa, Staphylococcus
IESAKKVIS

SEQ ID NO: 1950329 - protein, 7 aa, Staphylococcus
IESDGTL

SEQ ID NO: 1950330 - protein, 4 aa, Staphylococcus
IESE

SEQ ID NO: 1950331 - protein, 15 aa, Staphylococcus
IESEDKDNESKSSGF

SEQ ID NO: 1950332 - protein, 11 aa, Staphylococcus
IESEKTVHDDA

SEQ ID NO: 1950333 - protein, 15 aa, Staphylococcus
IESEPKEHTEKSGGF

SEQ ID NO: 1950334 - protein, 8 aa, Staphylococcus
IESEQEGK

SEQ ID NO: 1950335 - protein, 7 aa, Staphylococcus
IESESTF

SEQ ID NO: 1950336 - protein, 15 aa, Staphylococcus
IESFSEDAKAKLTDN

SEQ ID NO: 1950337 - protein, 4 aa, Staphylococcus
IESG

SEQ ID NO: 1950338 - protein, 11 aa, Staphylococcus
IESGDFDSSKT

SEQ ID NO: 1950339 - protein, 7 aa, Staphylococcus
IESGEAN

SEQ ID NO: 1950340 - protein, 10 aa, Staphylococcus
IESGEASSIL

SEQ ID NO: 1950341 - protein, 6 aa, Staphylococcus
IESGGQ

SEQ ID NO: 1950342 - protein, 7 aa, Staphylococcus
IESGGQA

SEQ ID NO: 1950343 - protein, 11 aa, Staphylococcus
IESGQSSPSME

SEQ ID NO: 1950344 - protein, 9 aa, Staphylococcus
IESGYRSID

SEQ ID NO: 1950345 - protein, 5 aa, Staphylococcus
IESHR

SEQ ID NO: 1950346 - protein, 4 aa, Staphylococcus
IESI

SEQ ID NO: 1950347 - protein, 5 aa, Staphylococcus
IESIK

SEQ ID NO: 1950348 - protein, 17 aa, Staphylococcus
IESKDGKLKVTSKGKQI

SEQ ID NO: 1950349 - protein, 16 aa, Staphylococcus
IESLKESQQKNDVDLQ

SEQ ID NO: 1950350 - protein, 10 aa, Staphylococcus
IESLSEDDRN

SEQ ID NO: 1950351 - protein, 10 aa, Staphylococcus
IESLSSREED

SEQ ID NO: 1950352 - protein, 6 aa, Staphylococcus
IESNEV

SEQ ID NO: 1950353 - protein, 16 aa, Staphylococcus
IESNPYDENKGENGYS

SEQ ID NO: 1950354 - protein, 10 aa, Staphylococcus
IESNRSDIEK

SEQ ID NO: 1950355 - protein, 11 aa, Staphylococcus
IESQNASPSME

SEQ ID NO: 1950356 - protein, 6 aa, Staphylococcus
IESQTV

SEQ ID NO: 1950357 - protein, 5 aa, Staphylococcus
IESQY

SEQ ID NO: 1950358 - protein, 7 aa, Staphylococcus
IESRDGK

SEQ ID NO: 1950359 - protein, 16 aa, Staphylococcus
IESRDGKIKVTSKGKQ

SEQ ID NO: 1950360 - protein, 4 aa, Staphylococcus
IESS

SEQ ID NO: 1950361 - protein, 10 aa, Staphylococcus
IESSAQQVKN

SEQ ID NO: 1950362 - protein, 8 aa, Staphylococcus
IESSETDT

SEQ ID NO: 1950363 - protein, 5 aa, Staphylococcus
IESSG

SEQ ID NO: 1950364 - protein, 5 aa, Staphylococcus
IESSN

SEQ ID NO: 1950365 - protein, 8 aa, Staphylococcus
IESSQTEK

SEQ ID NO: 1950366 - protein, 18 aa, Staphylococcus
IESSYDDKGQGVGQKQRE

SEQ ID NO: 1950367 - protein, 16 aa, Staphylococcus
IESTDGKIKVTSKGQQ

SEQ ID NO: 1950368 - protein, 5 aa, Staphylococcus
IESTR

SEQ ID NO: 1950369 - protein, 18 aa, Staphylococcus
IETAENVAQSLRDAGHEA

SEQ ID NO: 1950370 - protein, 12 aa, Staphylococcus
IETALETQGSRY

SEQ ID NO: 1950371 - protein, 5 aa, Staphylococcus
IETAR

SEQ ID NO: 1950372 - protein, 4 aa, Staphylococcus
IETD

SEQ ID NO: 1950373 - protein, 5 aa, Staphylococcus
IETDE

SEQ ID NO: 1950374 - protein, 6 aa, Staphylococcus
IETDQD

SEQ ID NO: 1950375 - protein, 6 aa, Staphylococcus
IETDQE

SEQ ID NO: 1950376 - protein, 7 aa, Staphylococcus
IETEDSY

SEQ ID NO: 1950377 - protein, 11 aa, Staphylococcus
IETENKISQLN

SEQ ID NO: 1950378 - protein, 5 aa, Staphylococcus
IETER

SEQ ID NO: 1950379 - protein, 4 aa, Staphylococcus
IETG

SEQ ID NO: 1950380 - protein, 11 aa, Staphylococcus
IETGEDGIPNT

SEQ ID NO: 1950381 - protein, 12 aa, Staphylococcus
IETHGVNPKAIE

SEQ ID NO: 1950382 - protein, 12 aa, Staphylococcus
IETHGVNPKAVE

SEQ ID NO: 1950383 - protein, 6 aa, Staphylococcus
IETHNP

SEQ ID NO: 1950384 - protein, 6 aa, Staphylococcus
IETHQQ

SEQ ID NO: 1950385 - protein, 8 aa, Staphylococcus
IETKETRK

SEQ ID NO: 1950386 - protein, 5 aa, Staphylococcus
IETLN

SEQ ID NO: 1950387 - protein, 11 aa, Staphylococcus
IETNDDGMPNT

SEQ ID NO: 1950388 - protein, 11 aa, Staphylococcus
IETNDNPKKVQ

SEQ ID NO: 1950389 - protein, 10 aa, Staphylococcus
IETNKREAKI

SEQ ID NO: 1950390 - protein, 6 aa, Staphylococcus
IETNNN

SEQ ID NO: 1950391 - protein, 5 aa, Staphylococcus
IETPT

SEQ ID NO: 1950392 - protein, 6 aa, Staphylococcus
IETPTY

SEQ ID NO: 1950393 - protein, 7 aa, Staphylococcus
IETPYKA

SEQ ID NO: 1950394 - protein, 14 aa, Staphylococcus
IETPYKADLNKNQK

SEQ ID NO: 1950395 - protein, 16 aa, Staphylococcus
IETPYKANLNNNQKKE

SEQ ID NO: 1950396 - protein, 14 aa, Staphylococcus
IETPYKATINSDEK

SEQ ID NO: 1950397 - protein, 14 aa, Staphylococcus
IETPYKATLNDNQK

SEQ ID NO: 1950398 - protein, 17 aa, Staphylococcus
IETPYKATLNNKQKTEL

SEQ ID NO: 1950399 - protein, 8 aa, Staphylococcus
IETQSSKV

SEQ ID NO: 1950400 - protein, 10 aa, Staphylococcus
IETRGENRHG

SEQ ID NO: 1950401 - protein, 5 aa, Staphylococcus
IETSE

SEQ ID NO: 1950402 - protein, 8 aa, Staphylococcus
IETSESSK

SEQ ID NO: 1950403 - protein, 6 aa, Staphylococcus
IETSNN

SEQ ID NO: 1950404 - protein, 12 aa, Staphylococcus
IETTEARAKELR

SEQ ID NO: 1950405 - protein, 12 aa, Staphylococcus
IETTEYEEVEYD

SEQ ID NO: 1950406 - protein, 7 aa, Staphylococcus
IETVSKE

SEQ ID NO: 1950407 - protein, 7 aa, Staphylococcus
IETVTDL

SEQ ID NO: 1950408 - protein, 9 aa, Staphylococcus
IEVNQGHNA

SEQ ID NO: 1950409 - protein, 17 aa, Staphylococcus
IEVSEKDTKADILDTLE

SEQ ID NO: 1950410 - protein, 17 aa, Staphylococcus
IEVTEKETVEADIKPEN

SEQ ID NO: 1950411 - protein, 6 aa, Staphylococcus
IEYDGE

SEQ ID NO: 1950412 - protein, 8 aa, Staphylococcus
IEYGGQAD

SEQ ID NO: 1950413 - protein, 8 aa, Staphylococcus
IEYGGRGM

SEQ ID NO: 1950414 - protein, 21 aa, Staphylococcus
IEYGGTSISDYRHADGKTGTM

SEQ ID NO: 1950415 - protein, 12 aa, Staphylococcus
IFPTKNAAQQAL

SEQ ID NO: 1950416 - protein, 11 aa, Staphylococcus
IFSEPASNASI

SEQ ID NO: 1950417 - protein, 4 aa, Staphylococcus
IFST

SEQ ID NO: 1950418 - protein, 8 aa, Staphylococcus
IFSTDEDG

SEQ ID NO: 1950419 - protein, 11 aa, Staphylococcus
IFSTDNEGQLR

SEQ ID NO: 1950420 - protein, 8 aa, Staphylococcus
IFSTGTSD

SEQ ID NO: 1950421 - protein, 4 aa, Staphylococcus
IFTD

SEQ ID NO: 1950422 - protein, 11 aa, Staphylococcus
IGADDKTFLQN

SEQ ID NO: 1950423 - protein, 10 aa, Staphylococcus
IGADNKEKIY

SEQ ID NO: 1950424 - protein, 6 aa, Staphylococcus
IGAELN

SEQ ID NO: 1950425 - protein, 14 aa, Staphylococcus
IGAGSTVAKDIPPN

SEQ ID NO: 1950426 - protein, 7 aa, Staphylococcus
IGAGTDT

SEQ ID NO: 1950427 - protein, 18 aa, Staphylococcus
IGALTDRNGLRPGRYTIT

SEQ ID NO: 1950428 - protein, 5 aa, Staphylococcus
IGAPY

SEQ ID NO: 1950429 - protein, 5 aa, Staphylococcus
IGASS

SEQ ID NO: 1950430 - protein, 6 aa, Staphylococcus
IGATTV

SEQ ID NO: 1950431 - protein, 12 aa, Staphylococcus
IGDADSRKEYNE

SEQ ID NO: 1950432 - protein, 12 aa, Staphylococcus
IGDAESRKEYNE

SEQ ID NO: 1950433 - protein, 9 aa, Staphylococcus
IGDDKNQRI

SEQ ID NO: 1950434 - protein, 8 aa, Staphylococcus
IGDDQGAY

SEQ ID NO: 1950435 - protein, 7 aa, Staphylococcus
IGDDSNT

SEQ ID NO: 1950436 - protein, 13 aa, Staphylococcus
IGDEDITVEKGER

SEQ ID NO: 1950437 - protein, 5 aa, Staphylococcus
IGDKD

SEQ ID NO: 1950438 - protein, 4 aa, Staphylococcus
IGDN

SEQ ID NO: 1950439 - protein, 4 aa, Staphylococcus
IGDP

SEQ ID NO: 1950440 - protein, 6 aa, Staphylococcus
IGDPEH

SEQ ID NO: 1950441 - protein, 19 aa, Staphylococcus
IGDPGGKLHTGRSRNDQVA

SEQ ID NO: 1950442 - protein, 12 aa, Staphylococcus
IGDQASRKEYNE

SEQ ID NO: 1950443 - protein, 5 aa, Staphylococcus
IGDQN

SEQ ID NO: 1950444 - protein, 9 aa, Staphylococcus
IGDREQQLQ

SEQ ID NO: 1950445 - protein, 7 aa, Staphylococcus
IGDRKQQ

SEQ ID NO: 1950446 - protein, 10 aa, Staphylococcus
IGDRSTSELK

SEQ ID NO: 1950447 - protein, 12 aa, Staphylococcus
IGDSDSRKEYNE

SEQ ID NO: 1950448 - protein, 5 aa, Staphylococcus
IGDSE

SEQ ID NO: 1950449 - protein, 6 aa, Staphylococcus
IGDSEH

SEQ ID NO: 1950450 - protein, 11 aa, Staphylococcus
IGDSESRKEYN

SEQ ID NO: 1950451 - protein, 12 aa, Staphylococcus
IGDTEHANHNLF

SEQ ID NO: 1950452 - protein, 8 aa, Staphylococcus
IGDTEKHE

SEQ ID NO: 1950453 - protein, 13 aa, Staphylococcus
IGEAKTQIYDSTS

SEQ ID NO: 1950454 - protein, 7 aa, Staphylococcus
IGEAPDA

SEQ ID NO: 1950455 - protein, 17 aa, Staphylococcus
IGEAPDAAAFNDEGAHT

SEQ ID NO: 1950456 - protein, 18 aa, Staphylococcus
IGEAPDAAAFNDEGSHTL

SEQ ID NO: 1950457 - protein, 7 aa, Staphylococcus
IGEAQDI

SEQ ID NO: 1950458 - protein, 7 aa, Staphylococcus
IGEDNKA

SEQ ID NO: 1950459 - protein, 10 aa, Staphylococcus
IGEDTVVEPG

SEQ ID NO: 1950460 - protein, 4 aa, Staphylococcus
IGEE

SEQ ID NO: 1950461 - protein, 6 aa, Staphylococcus
IGEEEP

SEQ ID NO: 1950462 - protein, 9 aa, Staphylococcus
IGEEGHGMP

SEQ ID NO: 1950463 - protein, 7 aa, Staphylococcus
IGEENKK

SEQ ID NO: 1950464 - protein, 7 aa, Staphylococcus
IGEGASR

SEQ ID NO: 1950465 - protein, 18 aa, Staphylococcus
IGEGPDAAAFKDEGSHTL

SEQ ID NO: 1950466 - protein, 10 aa, Staphylococcus
IGEGSPKLGI

SEQ ID NO: 1950467 - protein, 8 aa, Staphylococcus
IGEGSPVI

SEQ ID NO: 1950468 - protein, 12 aa, Staphylococcus
IGEGSTNQGDFH

SEQ ID NO: 1950469 - protein, 6 aa, Staphylococcus
IGEGSV

SEQ ID NO: 1950470 - protein, 4 aa, Staphylococcus
IGEK

SEQ ID NO: 1950471 - protein, 9 aa, Staphylococcus
IGELSSEQN

SEQ ID NO: 1950472 - protein, 9 aa, Staphylococcus
IGEPDKKLK

SEQ ID NO: 1950473 - protein, 15 aa, Staphylococcus
IGEPGSFKRTSNRHD

SEQ ID NO: 1950474 - protein, 10 aa, Staphylococcus
IGEQGTPDDI

SEQ ID NO: 1950475 - protein, 10 aa, Staphylococcus
IGEQGTPDEV

SEQ ID NO: 1950476 - protein, 5 aa, Staphylococcus
IGEQN

SEQ ID NO: 1950477 - protein, 4 aa, Staphylococcus
IGER

SEQ ID NO: 1950478 - protein, 8 aa, Staphylococcus
IGERETQL

SEQ ID NO: 1950479 - protein, 10 aa, Staphylococcus
IGESGPPEQI

SEQ ID NO: 1950480 - protein, 7 aa, Staphylococcus
IGESGPV

SEQ ID NO: 1950481 - protein, 6 aa, Staphylococcus
IGESKV

SEQ ID NO: 1950482 - protein, 5 aa, Staphylococcus
IGESL

SEQ ID NO: 1950483 - protein, 10 aa, Staphylococcus
IGETDQTGTA

SEQ ID NO: 1950484 - protein, 19 aa, Staphylococcus
IGETGGKLHTGRSRNDQVA

SEQ ID NO: 1950485 - protein, 13 aa, Staphylococcus
IGETNRTYEPIEE

SEQ ID NO: 1950486 - protein, 15 aa, Staphylococcus
IGETVKGNEPIQLTG

SEQ ID NO: 1950487 - protein, 7 aa, Staphylococcus
IGGAATE

SEQ ID NO: 1950488 - protein, 8 aa, Staphylococcus
IGGASGPL

SEQ ID NO: 1950489 - protein, 10 aa, Staphylococcus
IGGASTPSIH

SEQ ID NO: 1950490 - protein, 10 aa, Staphylococcus
IGGATTPSIH

SEQ ID NO: 1950491 - protein, 5 aa, Staphylococcus
IGGDR

SEQ ID NO: 1950492 - protein, 6 aa, Staphylococcus
IGGEDD

SEQ ID NO: 1950493 - protein, 9 aa, Staphylococcus
IGGEGTSLN

SEQ ID NO: 1950494 - protein, 6 aa, Staphylococcus
IGGEND

SEQ ID NO: 1950495 - protein, 8 aa, Staphylococcus
IGGETAEI

SEQ ID NO: 1950496 - protein, 7 aa, Staphylococcus
IGGGARN

SEQ ID NO: 1950497 - protein, 13 aa, Staphylococcus
IGGGLGNAVLFER

SEQ ID NO: 1950498 - protein, 15 aa, Staphylococcus
IGGGMGNAALLQREH

SEQ ID NO: 1950499 - protein, 12 aa, Staphylococcus
IGGGQAGTNAAK

SEQ ID NO: 1950500 - protein, 7 aa, Staphylococcus
IGGGSKS

SEQ ID NO: 1950501 - protein, 5 aa, Staphylococcus
IGGGT

SEQ ID NO: 1950502 - protein, 6 aa, Staphylococcus
IGGITR

SEQ ID NO: 1950503 - protein, 7 aa, Staphylococcus
IGGKDDE

SEQ ID NO: 1950504 - protein, 20 aa, Staphylococcus
IGGKEGKIEIGGEADDSTGY

SEQ ID NO: 1950505 - protein, 12 aa, Staphylococcus
IGGKRPDDEDLK

SEQ ID NO: 1950506 - protein, 11 aa, Staphylococcus
IGGKRPDREDL

SEQ ID NO: 1950507 - protein, 18 aa, Staphylococcus
IGGKTKKDKIRISYKTLF

SEQ ID NO: 1950508 - protein, 4 aa, Staphylococcus
IGGN

SEQ ID NO: 1950509 - protein, 6 aa, Staphylococcus
IGGNDQ

SEQ ID NO: 1950510 - protein, 5 aa, Staphylococcus
IGGNQ

SEQ ID NO: 1950511 - protein, 17 aa, Staphylococcus
IGGPAGNQHVMSLKIQQ

SEQ ID NO: 1950512 - protein, 5 aa, Staphylococcus
IGGPG

SEQ ID NO: 1950513 - protein, 11 aa, Staphylococcus
IGGQVNDTATI

SEQ ID NO: 1950514 - protein, 10 aa, Staphylococcus
IGGQVNETAD

SEQ ID NO: 1950515 - protein, 4 aa, Staphylococcus
IGGR

SEQ ID NO: 1950516 - protein, 9 aa, Staphylococcus
IGGRQGLHK

SEQ ID NO: 1950517 - protein, 10 aa, Staphylococcus
IGGSDQWGNI

SEQ ID NO: 1950518 - protein, 12 aa, Staphylococcus
IGGSEISDDQGV

SEQ ID NO: 1950519 - protein, 6 aa, Staphylococcus
IGGSGK

SEQ ID NO: 1950520 - protein, 9 aa, Staphylococcus
IGGSGKHQF

SEQ ID NO: 1950521 - protein, 10 aa, Staphylococcus
IGGSGKNQFY

SEQ ID NO: 1950522 - protein, 9 aa, Staphylococcus
IGGSGTNQF

SEQ ID NO: 1950523 - protein, 6 aa, Staphylococcus
IGGTAK

SEQ ID NO: 1950524 - protein, 19 aa, Staphylococcus
IGGTTQSELAKSLGKSQSF

SEQ ID NO: 1950525 - protein, 7 aa, Staphylococcus
IGGVTDA

SEQ ID NO: 1950526 - protein, 14 aa, Staphylococcus
IGHPVDEGSFQPSR

SEQ ID NO: 1950527 - protein, 6 aa, Staphylococcus
IGHQDD

SEQ ID NO: 1950528 - protein, 11 aa, Staphylococcus
IGHTGTLDPEV

SEQ ID NO: 1950529 - protein, 11 aa, Staphylococcus
IGIKGKQDIEK

SEQ ID NO: 1950530 - protein, 13 aa, Staphylococcus
IGIPNKGDWTNKP

SEQ ID NO: 1950531 - protein, 13 aa, Staphylococcus
IGIPNKGEWTDKP

SEQ ID NO: 1950532 - protein, 13 aa, Staphylococcus
IGIPNKGEWTNKP

SEQ ID NO: 1950533 - protein, 11 aa, Staphylococcus
IGISDNGGYNF

SEQ ID NO: 1950534 - protein, 6 aa, Staphylococcus
IGKAER

SEQ ID NO: 1950535 - protein, 13 aa, Staphylococcus
IGKATEKEWREND

SEQ ID NO: 1950536 - protein, 6 aa, Staphylococcus
IGKDKN

SEQ ID NO: 1950537 - protein, 4 aa, Staphylococcus
IGKE

SEQ ID NO: 1950538 - protein, 17 aa, Staphylococcus
IGKEGGEKTASEHDREY

SEQ ID NO: 1950539 - protein, 6 aa, Staphylococcus
IGKEQN

SEQ ID NO: 1950540 - protein, 5 aa, Staphylococcus
IGKGQ

SEQ ID NO: 1950541 - protein, 9 aa, Staphylococcus
IGKGSPGVL

SEQ ID NO: 1950542 - protein, 8 aa, Staphylococcus
IGKKDGYM

SEQ ID NO: 1950543 - protein, 8 aa, Staphylococcus
IGKKEGYM

SEQ ID NO: 1950544 - protein, 5 aa, Staphylococcus
IGKKG

SEQ ID NO: 1950545 - protein, 18 aa, Staphylococcus
IGKKGGDATAKEKGKEFY

SEQ ID NO: 1950546 - protein, 9 aa, Staphylococcus
IGKKTAENI

SEQ ID NO: 1950547 - protein, 8 aa, Staphylococcus
IGKKTAQN

SEQ ID NO: 1950548 - protein, 9 aa, Staphylococcus
IGKKTAQSI

SEQ ID NO: 1950549 - protein, 7 aa, Staphylococcus
IGKNEKL

SEQ ID NO: 1950550 - protein, 5 aa, Staphylococcus
IGKPD

SEQ ID NO: 1950551 - protein, 10 aa, Staphylococcus
IGKPERLKGG

SEQ ID NO: 1950552 - protein, 6 aa, Staphylococcus
IGKPGV

SEQ ID NO: 1950553 - protein, 6 aa, Staphylococcus
IGKPTL

SEQ ID NO: 1950554 - protein, 5 aa, Staphylococcus
IGKRP

SEQ ID NO: 1950555 - protein, 4 aa, Staphylococcus
IGKT

SEQ ID NO: 1950556 - protein, 11 aa, Staphylococcus
IGKTKNASTYN

SEQ ID NO: 1950557 - protein, 4 aa, Staphylococcus
IGLK

SEQ ID NO: 1950558 - protein, 5 aa, Staphylococcus
IGLKT

SEQ ID NO: 1950559 - protein, 15 aa, Staphylococcus
IGLSEEQAKEAGYDV

SEQ ID NO: 1950560 - protein, 6 aa, Staphylococcus
IGMTDP

SEQ ID NO: 1950561 - protein, 9 aa, Staphylococcus
IGMTDPGFN

SEQ ID NO: 1950562 - protein, 9 aa, Staphylococcus
IGNDNDTRI

SEQ ID NO: 1950563 - protein, 6 aa, Staphylococcus
IGNEDI

SEQ ID NO: 1950564 - protein, 15 aa, Staphylococcus
IGNGDNVKSQSIKAN

SEQ ID NO: 1950565 - protein, 6 aa, Staphylococcus
IGNGGQ

SEQ ID NO: 1950566 - protein, 17 aa, Staphylococcus
IGNGKLSDKQQRNSGVE

SEQ ID NO: 1950567 - protein, 14 aa, Staphylococcus
IGNLAKKARDKKLG

SEQ ID NO: 1950568 - protein, 12 aa, Staphylococcus
IGNNDEHLKSIE

SEQ ID NO: 1950569 - protein, 8 aa, Staphylococcus
IGNNGPSL

SEQ ID NO: 1950570 - protein, 9 aa, Staphylococcus
IGNNPGTAV

SEQ ID NO: 1950571 - protein, 11 aa, Staphylococcus
IGNNPGTPAVK

SEQ ID NO: 1950572 - protein, 8 aa, Staphylococcus
IGNNTDTT

SEQ ID NO: 1950573 - protein, 4 aa, Staphylococcus
IGNP

SEQ ID NO: 1950574 - protein, 5 aa, Staphylococcus
IGNPA

SEQ ID NO: 1950575 - protein, 9 aa, Staphylococcus
IGNQPSAKL

SEQ ID NO: 1950576 - protein, 5 aa, Staphylococcus
IGNRH

SEQ ID NO: 1950577 - protein, 9 aa, Staphylococcus
IGNSESPIT

SEQ ID NO: 1950578 - protein, 5 aa, Staphylococcus
IGNSG

SEQ ID NO: 1950579 - protein, 8 aa, Staphylococcus
IGNSGPSL

SEQ ID NO: 1950580 - protein, 14 aa, Staphylococcus
IGNSSDYTSQIASN

SEQ ID NO: 1950581 - protein, 10 aa, Staphylococcus
IGPDAVKTGM

SEQ ID NO: 1950582 - protein, 5 aa, Staphylococcus
IGPEA

SEQ ID NO: 1950583 - protein, 6 aa, Staphylococcus
IGPEAS

SEQ ID NO: 1950584 - protein, 6 aa, Staphylococcus
IGPESK

SEQ ID NO: 1950585 - protein, 5 aa, Staphylococcus
IGPGR

SEQ ID NO: 1950586 - protein, 5 aa, Staphylococcus
IGPGS

SEQ ID NO: 1950587 - protein, 5 aa, Staphylococcus
IGPHQ

SEQ ID NO: 1950588 - protein, 6 aa, Staphylococcus
IGPKET

SEQ ID NO: 1950589 - protein, 10 aa, Staphylococcus
IGPKKRRSVL

SEQ ID NO: 1950590 - protein, 5 aa, Staphylococcus
IGPKP

SEQ ID NO: 1950591 - protein, 15 aa, Staphylococcus
IGPKSSVEAEQQSQT

SEQ ID NO: 1950592 - protein, 6 aa, Staphylococcus
IGPKSV

SEQ ID NO: 1950593 - protein, 12 aa, Staphylococcus
IGPPKEALTSER

SEQ ID NO: 1950594 - protein, 15 aa, Staphylococcus
IGPPPGYVGYGRDGD

SEQ ID NO: 1950595 - protein, 4 aa, Staphylococcus
IGPR

SEQ ID NO: 1950596 - protein, 6 aa, Staphylococcus
IGPRDK

SEQ ID NO: 1950597 - protein, 24 aa, Staphylococcus
IGPRIKKTTDELTNELERSPSISE

SEQ ID NO: 1950598 - protein, 11 aa, Staphylococcus
IGPSGSGKTTL

SEQ ID NO: 1950599 - protein, 6 aa, Staphylococcus
IGPSTE

SEQ ID NO: 1950600 - protein, 5 aa, Staphylococcus
IGPVP

SEQ ID NO: 1950601 - protein, 10 aa, Staphylococcus
IGPYYGSKTE

SEQ ID NO: 1950602 - protein, 4 aa, Staphylococcus
IGQD

SEQ ID NO: 1950603 - protein, 4 aa, Staphylococcus
IGQE

SEQ ID NO: 1950604 - protein, 15 aa, Staphylococcus
IGQETRRFDESTGKT

SEQ ID NO: 1950605 - protein, 5 aa, Staphylococcus
IGQGD

SEQ ID NO: 1950606 - protein, 5 aa, Staphylococcus
IGQGE

SEQ ID NO: 1950607 - protein, 8 aa, Staphylococcus
IGQKTDTT

SEQ ID NO: 1950608 - protein, 6 aa, Staphylococcus
IGQNNN

SEQ ID NO: 1950609 - protein, 6 aa, Staphylococcus
IGQNQN

SEQ ID NO: 1950610 - protein, 6 aa, Staphylococcus
IGQPTL

SEQ ID NO: 1950611 - protein, 10 aa, Staphylococcus
IGQPTSGFNK

SEQ ID NO: 1950612 - protein, 6 aa, Staphylococcus
IGQPVN

SEQ ID NO: 1950613 - protein, 4 aa, Staphylococcus
IGQR

SEQ ID NO: 1950614 - protein, 5 aa, Staphylococcus
IGQSR

SEQ ID NO: 1950615 - protein, 6 aa, Staphylococcus
IGQSRI

SEQ ID NO: 1950616 - protein, 8 aa, Staphylococcus
IGQSSIKN

SEQ ID NO: 1950617 - protein, 8 aa, Staphylococcus
IGQSSIKS

SEQ ID NO: 1950618 - protein, 6 aa, Staphylococcus
IGQTDI

SEQ ID NO: 1950619 - protein, 31 aa, Staphylococcus
IGQTEEMKANRNKVSEQIAEKKRNQENADDV

SEQ ID NO: 1950620 - protein, 4 aa, Staphylococcus
IGRE

SEQ ID NO: 1950621 - protein, 10 aa, Staphylococcus
IGRGANRRKM

SEQ ID NO: 1950622 - protein, 5 aa, Staphylococcus
IGRGE

SEQ ID NO: 1950623 - protein, 6 aa, Staphylococcus
IGRKKH

SEQ ID NO: 1950624 - protein, 7 aa, Staphylococcus
IGRKYAG

SEQ ID NO: 1950625 - protein, 4 aa, Staphylococcus
IGRN

SEQ ID NO: 1950626 - protein, 8 aa, Staphylococcus
IGRNQSKD

SEQ ID NO: 1950627 - protein, 4 aa, Staphylococcus
IGRP

SEQ ID NO: 1950628 - protein, 5 aa, Staphylococcus
IGRPG

SEQ ID NO: 1950629 - protein, 12 aa, Staphylococcus
IGRPSTYAPTID

SEQ ID NO: 1950630 - protein, 11 aa, Staphylococcus
IGRQADKLQTY

SEQ ID NO: 1950631 - protein, 6 aa, Staphylococcus
IGRQYA

SEQ ID NO: 1950632 - protein, 12 aa, Staphylococcus
IGRRSTRIDRSK

SEQ ID NO: 1950633 - protein, 16 aa, Staphylococcus
IGRSTTTEDQTGETVE

SEQ ID NO: 1950634 - protein, 30 aa, Staphylococcus
IGRVSNKNGWKKGSNDPKVRKQDSMGTGTV

SEQ ID NO: 1950635 - protein, 8 aa, Staphylococcus
IGSAEQRK

SEQ ID NO: 1950636 - protein, 12 aa, Staphylococcus
IGSAKDAAEAME

SEQ ID NO: 1950637 - protein, 8 aa, Staphylococcus
IGSAPQSH

SEQ ID NO: 1950638 - protein, 4 aa, Staphylococcus
IGSD

SEQ ID NO: 1950639 - protein, 11 aa, Staphylococcus
IGSDDKSKELK

SEQ ID NO: 1950640 - protein, 16 aa, Staphylococcus
IGSDKVTRYKPDPDGI

SEQ ID NO: 1950641 - protein, 7 aa, Staphylococcus
IGSDRAV

SEQ ID NO: 1950642 - protein, 10 aa, Staphylococcus
IGSEKKTAAM

SEQ ID NO: 1950643 - protein, 9 aa, Staphylococcus
IGSENPSID

SEQ ID NO: 1950644 - protein, 10 aa, Staphylococcus
IGSENSVKRQ

SEQ ID NO: 1950645 - protein, 9 aa, Staphylococcus
IGSESTVKQ

SEQ ID NO: 1950646 - protein, 15 aa, Staphylococcus
IGSGKLTDKERRNFG

SEQ ID NO: 1950647 - protein, 7 aa, Staphylococcus
IGSGRPV

SEQ ID NO: 1950648 - protein, 6 aa, Staphylococcus
IGSGSP

SEQ ID NO: 1950649 - protein, 7 aa, Staphylococcus
IGSGSPV

SEQ ID NO: 1950650 - protein, 20 aa, Staphylococcus
IGSKEGKIEIGGDTDDSTGY

SEQ ID NO: 1950651 - protein, 19 aa, Staphylococcus
IGSKEGKIEIGGEADDSTG

SEQ ID NO: 1950652 - protein, 19 aa, Staphylococcus
IGSKEGKLKQGGGTDDATG

SEQ ID NO: 1950653 - protein, 5 aa, Staphylococcus
IGSKH

SEQ ID NO: 1950654 - protein, 8 aa, Staphylococcus
IGSKNEEM

SEQ ID NO: 1950655 - protein, 34 aa, Staphylococcus
IGSKPKDTDSEQVVSESIKSAKERKYSKSNPYEA

SEQ ID NO: 1950656 - protein, 13 aa, Staphylococcus
IGSKVAEKLKENH

SEQ ID NO: 1950657 - protein, 12 aa, Staphylococcus
IGSKVTKFNKGD

SEQ ID NO: 1950658 - protein, 10 aa, Staphylococcus
IGSLKENGVA

SEQ ID NO: 1950659 - protein, 4 aa, Staphylococcus
IGSN

SEQ ID NO: 1950660 - protein, 6 aa, Staphylococcus
IGSNAE

SEQ ID NO: 1950661 - protein, 14 aa, Staphylococcus
IGSPAMATGGMGDT

SEQ ID NO: 1950662 - protein, 8 aa, Staphylococcus
IGSPATHK

SEQ ID NO: 1950663 - protein, 8 aa, Staphylococcus
IGSPINGT

SEQ ID NO: 1950664 - protein, 9 aa, Staphylococcus
IGSQERKKR

SEQ ID NO: 1950665 - protein, 8 aa, Staphylococcus
IGSQQDKQ

SEQ ID NO: 1950666 - protein, 4 aa, Staphylococcus
IGSR

SEQ ID NO: 1950667 - protein, 7 aa, Staphylococcus
IGSRPIE

SEQ ID NO: 1950668 - protein, 15 aa, Staphylococcus
IGSSFAKKAAVASID

SEQ ID NO: 1950669 - protein, 7 aa, Staphylococcus
IGSSIQS

SEQ ID NO: 1950670 - protein, 4 aa, Staphylococcus
IGST

SEQ ID NO: 1950671 - protein, 8 aa, Staphylococcus
IGSTAGGI

SEQ ID NO: 1950672 - protein, 11 aa, Staphylococcus
IGSTDKTGTAI

SEQ ID NO: 1950673 - protein, 6 aa, Staphylococcus
IGSTPY

SEQ ID NO: 1950674 - protein, 6 aa, Staphylococcus
IGSVGS

SEQ ID NO: 1950675 - protein, 5 aa, Staphylococcus
IGSYE

SEQ ID NO: 1950676 - protein, 16 aa, Staphylococcus
IGTAEQRADIKTNFPQ

SEQ ID NO: 1950677 - protein, 13 aa, Staphylococcus
IGTGHSPSYKNVN

SEQ ID NO: 1950678 - protein, 9 aa, Staphylococcus
IGTIEENKK

SEQ ID NO: 1950679 - protein, 6 aa, Staphylococcus
IGTLSD

SEQ ID NO: 1950680 - protein, 11 aa, Staphylococcus
IGTNKTDTKTF

SEQ ID NO: 1950681 - protein, 7 aa, Staphylococcus
IGTNVTK

SEQ ID NO: 1950682 - protein, 19 aa, Staphylococcus
IGTPAARMDDQIDETIKNE

SEQ ID NO: 1950683 - protein, 13 aa, Staphylococcus
IGTPGEKLEPGQQ

SEQ ID NO: 1950684 - protein, 8 aa, Staphylococcus
IGTPNKVK

SEQ ID NO: 1950685 - protein, 13 aa, Staphylococcus
IGTPSETPQIASD

SEQ ID NO: 1950686 - protein, 13 aa, Staphylococcus
IGTPSEVLEPGQQ

SEQ ID NO: 1950687 - protein, 4 aa, Staphylococcus
IGTQ

SEQ ID NO: 1950688 - protein, 6 aa, Staphylococcus
IGTQEE

SEQ ID NO: 1950689 - protein, 13 aa, Staphylococcus
IGTQQGVKKMNRQ

SEQ ID NO: 1950690 - protein, 7 aa, Staphylococcus
IGTSDGH

SEQ ID NO: 1950691 - protein, 6 aa, Staphylococcus
IGTSDI

SEQ ID NO: 1950692 - protein, 7 aa, Staphylococcus
IGTSELK

SEQ ID NO: 1950693 - protein, 5 aa, Staphylococcus
IGTSG

SEQ ID NO: 1950694 - protein, 10 aa, Staphylococcus
IGTVAEKTAF

SEQ ID NO: 1950695 - protein, 5 aa, Staphylococcus
IGVGK

SEQ ID NO: 1950696 - protein, 7 aa, Staphylococcus
IGVGKSS

SEQ ID NO: 1950697 - protein, 11 aa, Staphylococcus
IGVGKSSLAHK

SEQ ID NO: 1950698 - protein, 12 aa, Staphylococcus
IGVGKSSLAHKL

SEQ ID NO: 1950699 - protein, 11 aa, Staphylococcus
IGVGKSSLAHQ

SEQ ID NO: 1950700 - protein, 16 aa, Staphylococcus
IGVNKPNTDGDKPAWF

SEQ ID NO: 1950701 - protein, 7 aa, Staphylococcus
IGYAPDN

SEQ ID NO: 1950702 - protein, 7 aa, Staphylococcus
IGYAPNN

SEQ ID NO: 1950703 - protein, 8 aa, Staphylococcus
IGYAPNSS

SEQ ID NO: 1950704 - protein, 18 aa, Staphylococcus
IGYDDNSNTLTEKVRRNP

SEQ ID NO: 1950705 - protein, 5 aa, Staphylococcus
IGYEP

SEQ ID NO: 1950706 - protein, 10 aa, Staphylococcus
IGYESEEAKD

SEQ ID NO: 1950707 - protein, 5 aa, Staphylococcus
IGYGG

SEQ ID NO: 1950708 - protein, 22 aa, Staphylococcus
IGYKPIKASDFKNASLEEYKEN

SEQ ID NO: 1950709 - protein, 5 aa, Staphylococcus
IHATK

SEQ ID NO: 1950710 - protein, 6 aa, Staphylococcus
IHDDDN

SEQ ID NO: 1950711 - protein, 4 aa, Staphylococcus
IHDP

SEQ ID NO: 1950712 - protein, 7 aa, Staphylococcus
IHEDERK

SEQ ID NO: 1950713 - protein, 7 aa, Staphylococcus
IHEDGAE

SEQ ID NO: 1950714 - protein, 6 aa, Staphylococcus
IHEDPR

SEQ ID NO: 1950715 - protein, 5 aa, Staphylococcus
IHEET

SEQ ID NO: 1950716 - protein, 10 aa, Staphylococcus
IHEGTGAGNN

SEQ ID NO: 1950717 - protein, 10 aa, Staphylococcus
IHENPDSLNP

SEQ ID NO: 1950718 - protein, 10 aa, Staphylococcus
IHENTSIEQK

SEQ ID NO: 1950719 - protein, 5 aa, Staphylococcus
IHETE

SEQ ID NO: 1950720 - protein, 6 aa, Staphylococcus
IHNSVK

SEQ ID NO: 1950721 - protein, 4 aa, Staphylococcus
IHPE

SEQ ID NO: 1950722 - protein, 5 aa, Staphylococcus
IHPES

SEQ ID NO: 1950723 - protein, 10 aa, Staphylococcus
IHPPTPSNIM

SEQ ID NO: 1950724 - protein, 7 aa, Staphylococcus
IHPTSGS

SEQ ID NO: 1950725 - protein, 10 aa, Staphylococcus
IHQNEDEEFR

SEQ ID NO: 1950726 - protein, 5 aa, Staphylococcus
IHQQA

SEQ ID NO: 1950727 - protein, 11 aa, Staphylococcus
IHQQSKTKSTF

SEQ ID NO: 1950728 - protein, 23 aa, Staphylococcus
IHQTEQAHTTTSQKMNVTEKDMR

SEQ ID NO: 1950729 - protein, 4 aa, Staphylococcus
IHSD

SEQ ID NO: 1950730 - protein, 5 aa, Staphylococcus
IHSDI

SEQ ID NO: 1950731 - protein, 5 aa, Staphylococcus
IHSEG

SEQ ID NO: 1950732 - protein, 15 aa, Staphylococcus
IHSEINQGEDSKQAF

SEQ ID NO: 1950733 - protein, 12 aa, Staphylococcus
IHSTKDKHHHFN

SEQ ID NO: 1950734 - protein, 9 aa, Staphylococcus
IHTDGDDRG

SEQ ID NO: 1950735 - protein, 13 aa, Staphylococcus
IHTSGHGSKGDQQ

SEQ ID NO: 1950736 - protein, 7 aa, Staphylococcus
IHTTSER

SEQ ID NO: 1950737 - protein, 9 aa, Staphylococcus
IHTTSERIA

SEQ ID NO: 1950738 - protein, 6 aa, Staphylococcus
IHVGQD

SEQ ID NO: 1950739 - protein, 10 aa, Staphylococcus
IHVGQDDAKV

SEQ ID NO: 1950740 - protein, 10 aa, Staphylococcus
IIDNDDSSQV

SEQ ID NO: 1950741 - protein, 10 aa, Staphylococcus
IIDNEDSSQV

SEQ ID NO: 1950742 - protein, 10 aa, Staphylococcus
IIDNGPTDQV

SEQ ID NO: 1950743 - protein, 10 aa, Staphylococcus
IIDSDNSSEL

SEQ ID NO: 1950744 - protein, 10 aa, Staphylococcus
IIDSEDSSQL

SEQ ID NO: 1950745 - protein, 9 aa, Staphylococcus
IIDSESSSE

SEQ ID NO: 1950746 - protein, 9 aa, Staphylococcus
IIEGREKQR

SEQ ID NO: 1950747 - protein, 5 aa, Staphylococcus
IIGQD

SEQ ID NO: 1950748 - protein, 6 aa, Staphylococcus
IIGQDK

SEQ ID NO: 1950749 - protein, 12 aa, Staphylococcus
IIGQSQTGTGKS

SEQ ID NO: 1950750 - protein, 15 aa, Staphylococcus
IIGSEPDKTLRPNDG

SEQ ID NO: 1950751 - protein, 17 aa, Staphylococcus
IIGTTNGVKIKNKASLI

SEQ ID NO: 1950752 - protein, 8 aa, Staphylococcus
IIKGEGQG

SEQ ID NO: 1950753 - protein, 13 aa, Staphylococcus
IIKGTSSPGLSTR

SEQ ID NO: 1950754 - protein, 11 aa, Staphylococcus
IINDDNIEKQL

SEQ ID NO: 1950755 - protein, 45 aa, Staphylococcus
IINDENTRENEHQDVDNSQNNDMPKGNQFSKVQNSNNQNDNKHDI

SEQ ID NO: 1950756 - protein, 6 aa, Staphylococcus
IINENQ

SEQ ID NO: 1950757 - protein, 15 aa, Staphylococcus
IIPEETYNEEMAALY

SEQ ID NO: 1950758 - protein, 7 aa, Staphylococcus
IIPEKND

SEQ ID NO: 1950759 - protein, 6 aa, Staphylococcus
IIPTQS

SEQ ID NO: 1950760 - protein, 23 aa, Staphylococcus
IIPTQSNASYNENLGKATDYKPL

SEQ ID NO: 1950761 - protein, 12 aa, Staphylococcus
IIPTSTGAAKAL

SEQ ID NO: 1950762 - protein, 11 aa, Staphylococcus
IIQPGTRGTEF

SEQ ID NO: 1950763 - protein, 7 aa, Staphylococcus
IISDSEA

SEQ ID NO: 1950764 - protein, 5 aa, Staphylococcus
IISGS

SEQ ID NO: 1950765 - protein, 20 aa, Staphylococcus
IISSKSKIKYATPKHTVRER

SEQ ID NO: 1950766 - protein, 6 aa, Staphylococcus
IISTGA

SEQ ID NO: 1950767 - protein, 10 aa, Staphylococcus
IISTQDKADI

SEQ ID NO: 1950768 - protein, 13 aa, Staphylococcus
IITSDADQYTATK

SEQ ID NO: 1950769 - protein, 16 aa, Staphylococcus
IITTSHGRDMNYSKSA

SEQ ID NO: 1950770 - protein, 17 aa, Staphylococcus
IKAAKERKYSKSNPYEA

SEQ ID NO: 1950771 - protein, 8 aa, Staphylococcus
IKAETERL

SEQ ID NO: 1950772 - protein, 10 aa, Staphylococcus
IKAKKGEQVL

SEQ ID NO: 1950773 - protein, 8 aa, Staphylococcus
IKAKKGLE

SEQ ID NO: 1950774 - protein, 8 aa, Staphylococcus
IKAKQSKL

SEQ ID NO: 1950775 - protein, 15 aa, Staphylococcus
IKAKYTNLAESGATM

SEQ ID NO: 1950776 - protein, 12 aa, Staphylococcus
IKANITKSLTPH

SEQ ID NO: 1950777 - protein, 7 aa, Staphylococcus
IKANQSK

SEQ ID NO: 1950778 - protein, 5 aa, Staphylococcus
IKAPV

SEQ ID NO: 1950779 - protein, 5 aa, Staphylococcus
IKAQD

SEQ ID NO: 1950780 - protein, 30 aa, Staphylococcus
IKAQQAREAARKARDDARSGKKNKRKDTLL

SEQ ID NO: 1950781 - protein, 30 aa, Staphylococcus; identical to SEQ ID NO: 1611607

SEQ ID NO: 1950782 - protein, 8 aa, Staphylococcus
IKATHKDG

SEQ ID NO: 1950783 - protein, 5 aa, Staphylococcus
IKATR

SEQ ID NO: 1950784 - protein, 17 aa, Staphylococcus
IKATVTGKIKEFGTSNR

SEQ ID NO: 1950785 - protein, 10 aa, Staphylococcus
IKAVNPKGEV

SEQ ID NO: 1950786 - protein, 8 aa, Staphylococcus
IKCKTNRE

SEQ ID NO: 1950787 - protein, 7 aa, Staphylococcus
IKDADSA

SEQ ID NO: 1950788 - protein, 8 aa, Staphylococcus
IKDADSAL

SEQ ID NO: 1950789 - protein, 6 aa, Staphylococcus
IKDAEP

SEQ ID NO: 1950790 - protein, 8 aa, Staphylococcus
IKDAERYK

SEQ ID NO: 1950791 - protein, 10 aa, Staphylococcus
IKDAGIKPED

SEQ ID NO: 1950792 - protein, 16 aa, Staphylococcus
IKDAPKDGFSKGDTVK

SEQ ID NO: 1950793 - protein, 17 aa, Staphylococcus
IKDAQENATKNQLNNTT

SEQ ID NO: 1950794 - protein, 13 aa, Staphylococcus
IKDAQQNATLNGF

SEQ ID NO: 1950795 - protein, 8 aa, Staphylococcus
IKDARQNA

SEQ ID NO: 1950796 - protein, 9 aa, Staphylococcus
IKDASAGSW

SEQ ID NO: 1950797 - protein, 6 aa, Staphylococcus
IKDASQ

SEQ ID NO: 1950798 - protein, 10 aa, Staphylococcus
IKDDITTDSG

SEQ ID NO: 1950799 - protein, 9 aa, Staphylococcus
IKDDTDYDL

SEQ ID NO: 1950800 - protein, 7 aa, Staphylococcus
IKDEEGY

SEQ ID NO: 1950801 - protein, 6 aa, Staphylococcus
IKDEEQ

SEQ ID NO: 1950802 - protein, 14 aa, Staphylococcus
IKDEPAGEDCEECG

SEQ ID NO: 1950803 - protein, 9 aa, Staphylococcus
IKDGKEDEI

SEQ ID NO: 1950804 - protein, 11 aa, Staphylococcus
IKDGQKIQSEG

SEQ ID NO: 1950805 - protein, 10 aa, Staphylococcus
IKDGTNDHGE

SEQ ID NO: 1950806 - protein, 6 aa, Staphylococcus
IKDHEE

SEQ ID NO: 1950807 - protein, 7 aa, Staphylococcus
IKDHETE

SEQ ID NO: 1950808 - protein, 7 aa, Staphylococcus
IKDKDTQ

SEQ ID NO: 1950809 - protein, 11 aa, Staphylococcus
IKDKKERYETL

SEQ ID NO: 1950810 - protein, 10 aa, Staphylococcus
IKDKRYDSEV

SEQ ID NO: 1950811 - protein, 43 aa, Staphylococcus
IKDLGDNISEDDKKNAEEKKDALKSALEGQDIDDIKAKKEELE

SEQ ID NO: 1950812 - protein, 6 aa, Staphylococcus
IKDNQT

SEQ ID NO: 1950813 - protein, 6 aa, Staphylococcus
IKDNSK

SEQ ID NO: 1950814 - protein, 6 aa, Staphylococcus
IKDPDV

SEQ ID NO: 1950815 - protein, 5 aa, Staphylococcus
IKDPN

SEQ ID NO: 1950816 - protein, 9 aa, Staphylococcus
IKDQHGADS

SEQ ID NO: 1950817 - protein, 10 aa, Staphylococcus
IKDQTQKETF

SEQ ID NO: 1950818 - protein, 6 aa, Staphylococcus
IKDSDG

SEQ ID NO: 1950819 - protein, 11 aa, Staphylococcus
IKDSKTLQEEG

SEQ ID NO: 1950820 - protein, 20 aa, Staphylococcus
IKDSTDEDGKEYKKYRNNDN

SEQ ID NO: 1950821 - protein, 22 aa, Staphylococcus
IKDTTHRAIDTTKPKAPTPTLR

SEQ ID NO: 1950822 - protein, 23 aa, Staphylococcus
IKDTTNRAVDTTKPKPVSPKFKS

SEQ ID NO: 1950823 - protein, 22 aa, Staphylococcus
IKEAAKATKGKVVNNTGQVCTA

SEQ ID NO: 1950824 - protein, 22 aa, Staphylococcus
IKEAAKATTGKVVNNTGQVCTA

SEQ ID NO: 1950825 - protein, 10 aa, Staphylococcus
IKEADADDIQ

SEQ ID NO: 1950826 - protein, 13 aa, Staphylococcus
IKEADNTDKQTVT

SEQ ID NO: 1950827 - protein, 11 aa, Staphylococcus
IKEADNTEKQT

SEQ ID NO: 1950828 - protein, 11 aa, Staphylococcus
IKEAKKKVDNF

SEQ ID NO: 1950829 - protein, 17 aa, Staphylococcus
IKEAKQANQSQDDIPNF

SEQ ID NO: 1950830 - protein, 17 aa, Staphylococcus
IKEAKQANQSQGDIPNF

SEQ ID NO: 1950831 - protein, 17 aa, Staphylococcus
IKEAQQATESQDEVPNF

SEQ ID NO: 1950832 - protein, 8 aa, Staphylococcus
IKEASTRI

SEQ ID NO: 1950833 - protein, 14 aa, Staphylococcus
IKEAVDADAEAEAM

SEQ ID NO: 1950834 - protein, 12 aa, Staphylococcus
IKEDDDIKKEKT

SEQ ID NO: 1950835 - protein, 17 aa, Staphylococcus
IKEDKDKLSGEDTREGL

SEQ ID NO: 1950836 - protein, 17 aa, Staphylococcus
IKEDKDRLSGEDTREGL

SEQ ID NO: 1950837 - protein, 17 aa, Staphylococcus
IKEDKERLSGEDTREGL

SEQ ID NO: 1950838 - protein, 12 aa, Staphylococcus
IKEDRDNDLTKK

SEQ ID NO: 1950839 - protein, 7 aa, Staphylococcus
IKEDSDH

SEQ ID NO: 1950840 - protein, 8 aa, Staphylococcus
IKEDTGDD

SEQ ID NO: 1950841 - protein, 4 aa, Staphylococcus
IKEE

SEQ ID NO: 1950842 - protein, 8 aa, Staphylococcus
IKEEDENQ

SEQ ID NO: 1950843 - protein, 6 aa, Staphylococcus
IKEEGH

SEQ ID NO: 1950844 - protein, 6 aa, Staphylococcus
IKEEKD

SEQ ID NO: 1950845 - protein, 8 aa, Staphylococcus
IKEENDDQ

SEQ ID NO: 1950846 - protein, 11 aa, Staphylococcus
IKEERGDQGEI

SEQ ID NO: 1950847 - protein, 6 aa, Staphylococcus
IKEESD

SEQ ID NO: 1950848 - protein, 15 aa, Staphylococcus
IKEETGLPFASKNEG

SEQ ID NO: 1950849 - protein, 4 aa, Staphylococcus
IKEF

SEQ ID NO: 1950850 - protein, 16 aa, Staphylococcus
IKEGDKITGEVQQVED

SEQ ID NO: 1950851 - protein, 16 aa, Staphylococcus
IKEGDKVTGEVQEIEE

SEQ ID NO: 1950852 - protein, 16 aa, Staphylococcus
IKEGDKVTGKVQQVED

SEQ ID NO: 1950853 - protein, 11 aa, Staphylococcus
IKEGKYPKKDY

SEQ ID NO: 1950854 - protein, 11 aa, Staphylococcus
IKEGNKNKTLG

SEQ ID NO: 1950855 - protein, 12 aa, Staphylococcus
IKEGNTSLTPGK

SEQ ID NO: 1950856 - protein, 8 aa, Staphylococcus
IKEGRESE

SEQ ID NO: 1950857 - protein, 7 aa, Staphylococcus
IKEIDTK

SEQ ID NO: 1950858 - protein, 15 aa, Staphylococcus
IKEKLPSDIRTISDK

SEQ ID NO: 1950859 - protein, 7 aa, Staphylococcus
IKEKYNK

SEQ ID NO: 1950860 - protein, 5 aa, Staphylococcus
IKELS

SEQ ID NO: 1950861 - protein, 7 aa, Staphylococcus
IKENDHE

SEQ ID NO: 1950862 - protein, 6 aa, Staphylococcus
IKENDY

SEQ ID NO: 1950863 - protein, 7 aa, Staphylococcus
IKENEHR

SEQ ID NO: 1950864 - protein, 12 aa, Staphylococcus
IKENGQTPEEYT

SEQ ID NO: 1950865 - protein, 7 aa, Staphylococcus
IKENGWD

SEQ ID NO: 1950866 - protein, 7 aa, Staphylococcus
IKENHPQ

SEQ ID NO: 1950867 - protein, 7 aa, Staphylococcus
IKENPDV

SEQ ID NO: 1950868 - protein, 8 aa, Staphylococcus
IKENREEL

SEQ ID NO: 1950869 - protein, 6 aa, Staphylococcus
IKENSK

SEQ ID NO: 1950870 - protein, 11 aa, Staphylococcus
IKEPTISAEGK

SEQ ID NO: 1950871 - protein, 24 aa, Staphylococcus
IKEQKAQRATKKPKNLSSSEGKIK

SEQ ID NO: 1950872 - protein, 5 aa, Staphylococcus
IKERR

SEQ ID NO: 1950873 - protein, 9 aa, Staphylococcus
IKESAEDVE

SEQ ID NO: 1950874 - protein, 25 aa, Staphylococcus
IKESAKERDKTISDAKKKYKDTVAE

SEQ ID NO: 1950875 - protein, 9 aa, Staphylococcus
IKESEKEIK

SEQ ID NO: 1950876 - protein, 19 aa, Staphylococcus
IKESEQNYKHDNLTTTECP

SEQ ID NO: 1950877 - protein, 8 aa, Staphylococcus
IKESPDFG

SEQ ID NO: 1950878 - protein, 9 aa, Staphylococcus
IKESTLNQI

SEQ ID NO: 1950879 - protein, 18 aa, Staphylococcus
IKETSDSGVAKTIQGNLD

SEQ ID NO: 1950880 - protein, 17 aa, Staphylococcus
IKETTKEELNQEDENDL

SEQ ID NO: 1950881 - protein, 15 aa, Staphylococcus
IKFNDGRTSTMKTGD

SEQ ID NO: 1950882 - protein, 4 aa, Staphylococcus
IKGA

SEQ ID NO: 1950883 - protein, 10 aa, Staphylococcus
IKGAGTSTIK

SEQ ID NO: 1950884 - protein, 10 aa, Staphylococcus
IKGAGTSTLK

SEQ ID NO: 1950885 - protein, 11 aa, Staphylococcus
IKGALKSYKKS

SEQ ID NO: 1950886 - protein, 5 aa, Staphylococcus
IKGAR

SEQ ID NO: 1950887 - protein, 10 aa, Staphylococcus
IKGARSNNLK

SEQ ID NO: 1950888 - protein, 11 aa, Staphylococcus
IKGARSNNLKG

SEQ ID NO: 1950889 - protein, 13 aa, Staphylococcus
IKGDLTGNEITEE

SEQ ID NO: 1950890 - protein, 7 aa, Staphylococcus
IKGEPQG

SEQ ID NO: 1950891 - protein, 12 aa, Staphylococcus
IKGETKVVDVTM

SEQ ID NO: 1950892 - protein, 10 aa, Staphylococcus
IKGETNEETF

SEQ ID NO: 1950893 - protein, 7 aa, Staphylococcus
IKGETNG

SEQ ID NO: 1950894 - protein, 21 aa, Staphylococcus
IKGEVKVKSNSDFTDTRFQPG

SEQ ID NO: 1950895 - protein, 22 aa, Staphylococcus
IKGEVKVKSNSDFTDTRFQPGE

SEQ ID NO: 1950896 - protein, 15 aa, Staphylococcus
IKGGGEPLIEEKLKD

SEQ ID NO: 1950897 - protein, 9 aa, Staphylococcus
IKGGHTNNK

SEQ ID NO: 1950898 - protein, 11 aa, Staphylococcus
IKGGHTNNKIR

SEQ ID NO: 1950899 - protein, 19 aa, Staphylococcus
IKGGHTNNKIRVSTKPVHA

SEQ ID NO: 1950900 - protein, 16 aa, Staphylococcus
IKGGHTNNKIRVSTSP

SEQ ID NO: 1950901 - protein, 18 aa, Staphylococcus
IKGGHTNNKIRVSTSPVH

SEQ ID NO: 1950902 - protein, 16 aa, Staphylococcus
IKGGHTNNKIRVSTTP

SEQ ID NO: 1950903 - protein, 9 aa, Staphylococcus
IKGGKDDSC

SEQ ID NO: 1950904 - protein, 17 aa, Staphylococcus
IKGGKVNLDPNSTSDEL

SEQ ID NO: 1950905 - protein, 7 aa, Staphylococcus
IKGGYRL

SEQ ID NO: 1950906 - protein, 17 aa, Staphylococcus
IKGIGEKTFEKLKQYFT

SEQ ID NO: 1950907 - protein, 8 aa, Staphylococcus
IKGKDSED

SEQ ID NO: 1950908 - protein, 7 aa, Staphylococcus
IKGNDLS

SEQ ID NO: 1950909 - protein, 5 aa, Staphylococcus
IKGPD

SEQ ID NO: 1950910 - protein, 9 aa, Staphylococcus
IKGQQQEIE

SEQ ID NO: 1950911 - protein, 11 aa, Staphylococcus
IKGTARYQNDD

SEQ ID NO: 1950912 - protein, 14 aa, Staphylococcus
IKGTEEEDIMPNGN

SEQ ID NO: 1950913 - protein, 10 aa, Staphylococcus
IKGTGGNARI

SEQ ID NO: 1950914 - protein, 10 aa, Staphylococcus
IKGTGGNDRI

SEQ ID NO: 1950915 - protein, 5 aa, Staphylococcus
IKGTV

SEQ ID NO: 1950916 - protein, 13 aa, Staphylococcus
IKGVRTNIGTEYR

SEQ ID NO: 1950917 - protein, 7 aa, Staphylococcus
IKGYKQT

SEQ ID NO: 1950918 - protein, 17 aa, Staphylococcus
IKHANKLKKKKERDKSG

SEQ ID NO: 1950919 - protein, 16 aa, Staphylococcus
IKHETTPRVQTDSKEF

SEQ ID NO: 1950920 - protein, 23 aa, Staphylococcus
IKHTPKDEGMIGAQTKARSYAQE

SEQ ID NO: 1950921 - protein, 14 aa, Staphylococcus
IKIDSQNIKSSQYY

SEQ ID NO: 1950922 - protein, 5 aa, Staphylococcus
IKIGE

SEQ ID NO: 1950923 - protein, 14 aa, Staphylococcus
IKKAPKKDKADEKR

SEQ ID NO: 1950924 - protein, 14 aa, Staphylococcus
IKKATKQDKAEDKR

SEQ ID NO: 1950925 - protein, 10 aa, Staphylococcus
IKKDIQQAKE

SEQ ID NO: 1950926 - protein, 8 aa, Staphylococcus
IKKDNTSF

SEQ ID NO: 1950927 - protein, 7 aa, Staphylococcus
IKKDPYG

SEQ ID NO: 1950928 - protein, 9 aa, Staphylococcus
IKKELSKNN

SEQ ID NO: 1950929 - protein, 25 aa, Staphylococcus
IKKEQELKKKSRKKLKKSHKEQLKA

SEQ ID NO: 1950930 - protein, 7 aa, Staphylococcus
IKKGERV

SEQ ID NO: 1950931 - protein, 9 aa, Staphylococcus
IKKGFDPSL

SEQ ID NO: 1950932 - protein, 7 aa, Staphylococcus
IKKGSEV

SEQ ID NO: 1950933 - protein, 11 aa, Staphylococcus
IKKHQRQSHNY

SEQ ID NO: 1950934 - protein, 15 aa, Staphylococcus
IKKKISSDAMKNNEF

SEQ ID NO: 1950935 - protein, 8 aa, Staphylococcus
IKKKTQKA

SEQ ID NO: 1950936 - protein, 8 aa, Staphylococcus
IKKKTQRA

SEQ ID NO: 1950937 - protein, 9 aa, Staphylococcus
IKKKTQRAV

SEQ ID NO: 1950938 - protein, 13 aa, Staphylococcus
IKKLTGETPQFIV

SEQ ID NO: 1950939 - protein, 9 aa, Staphylococcus
IKKQDDQSI

SEQ ID NO: 1950940 - protein, 17 aa, Staphylococcus
IKKQPTQNYNDRKLFGL

SEQ ID NO: 1950941 - protein, 12 aa, Staphylococcus
IKKQSEETITDL

SEQ ID NO: 1950942 - protein, 5 aa, Staphylococcus
IKKQT

SEQ ID NO: 1950943 - protein, 9 aa, Staphylococcus
IKKRGKDIE

SEQ ID NO: 1950944 - protein, 16 aa, Staphylococcus
IKKRNIKKKVTILYCE

SEQ ID NO: 1950945 - protein, 6 aa, Staphylococcus
IKKSNA

SEQ ID NO: 1950946 - protein, 14 aa, Staphylococcus
IKKSPKKDKAENKR

SEQ ID NO: 1950947 - protein, 15 aa, Staphylococcus
IKKTPKQDKADDKRV

SEQ ID NO: 1950948 - protein, 15 aa, Staphylococcus
IKKTPKQDKSKEKRV

SEQ ID NO: 1950949 - protein, 4 aa, Staphylococcus
IKLD

SEQ ID NO: 1950950 - protein, 6 aa, Staphylococcus
IKLGSG

SEQ ID NO: 1950951 - protein, 11 aa, Staphylococcus
IKLRGDDPKVV

SEQ ID NO: 1950952 - protein, 6 aa, Staphylococcus
IKLSNS

SEQ ID NO: 1950953 - protein, 9 aa, Staphylococcus
IKLTDGNEV

SEQ ID NO: 1950954 - protein, 7 aa, Staphylococcus
IKNAGKK

SEQ ID NO: 1950955 - protein, 17 aa, Staphylococcus
IKNANKLKKKKDRDKTG

SEQ ID NO: 1950956 - protein, 17 aa, Staphylococcus
IKNANKLKKKRDRDKTG

SEQ ID NO: 1950957 - protein, 19 aa, Staphylococcus
IKNANKLKKKRDRDKTGQA

SEQ ID NO: 1950958 - protein, 17 aa, Staphylococcus
IKNANKLKKKRERDKTG

SEQ ID NO: 1950959 - protein, 19 aa, Staphylococcus
IKNANKLKKKRERDKTGQA

SEQ ID NO: 1950960 - protein, 9 aa, Staphylococcus
IKNDEDEYD

SEQ ID NO: 1950961 - protein, 9 aa, Staphylococcus
IKNDHVNAA

SEQ ID NO: 1950962 - protein, 11 aa, Staphylococcus
IKNEAQQLNME

SEQ ID NO: 1950963 - protein, 10 aa, Staphylococcus
IKNEGKPAVE

SEQ ID NO: 1950964 - protein, 9 aa, Staphylococcus
IKNEGQPAV

SEQ ID NO: 1950965 - protein, 9 aa, Staphylococcus
IKNEIEKNP

SEQ ID NO: 1950966 - protein, 6 aa, Staphylococcus
IKNEKG

SEQ ID NO: 1950967 - protein, 6 aa, Staphylococcus
IKNEPY

SEQ ID NO: 1950968 - protein, 10 aa, Staphylococcus
IKNESEIENI

SEQ ID NO: 1950969 - protein, 9 aa, Staphylococcus
IKNGEKPIL

SEQ ID NO: 1950970 - protein, 9 aa, Staphylococcus
IKNGQEDEI

SEQ ID NO: 1950971 - protein, 9 aa, Staphylococcus
IKNGQYGND

SEQ ID NO: 1950972 - protein, 7 aa, Staphylococcus
IKNHEND

SEQ ID NO: 1950973 - protein, 4 aa, Staphylococcus
IKNK

SEQ ID NO: 1950974 - protein, 19 aa, Staphylococcus
IKNKDTKNLKEIAKDNKTY

SEQ ID NO: 1950975 - protein, 10 aa, Staphylococcus
IKNKENKEIK

SEQ ID NO: 1950976 - protein, 9 aa, Staphylococcus
IKNKGKKAG

SEQ ID NO: 1950977 - protein, 14 aa, Staphylococcus
IKNNENRVGLSPSG

SEQ ID NO: 1950978 - protein, 9 aa, Staphylococcus
IKNNKDKQN

SEQ ID NO: 1950979 - protein, 6 aa, Staphylococcus
IKNNKE

SEQ ID NO: 1950980 - protein, 13 aa, Staphylococcus
IKNNKELSKIRGK

SEQ ID NO: 1950981 - protein, 16 aa, Staphylococcus
IKNNKQQQIWDLISTY

SEQ ID NO: 1950982 - protein, 12 aa, Staphylococcus
IKNNSERKPKGL

SEQ ID NO: 1950983 - protein, 22 aa, Staphylococcus
IKNNSERKPKGLWTGNTSGDKI

SEQ ID NO: 1950984 - protein, 6 aa, Staphylococcus
IKNNTK

SEQ ID NO: 1950985 - protein, 12 aa, Staphylococcus
IKNPNPRGKGAI

SEQ ID NO: 1950986 - protein, 10 aa, Staphylococcus
IKNPNQDGHG

SEQ ID NO: 1950987 - protein, 11 aa, Staphylococcus
IKNQNKEKNTT

SEQ ID NO: 1950988 - protein, 12 aa, Staphylococcus
IKNQNKEKNTTV

SEQ ID NO: 1950989 - protein, 8 aa, Staphylococcus
IKNQSDIK

SEQ ID NO: 1950990 - protein, 4 aa, Staphylococcus
IKNR

SEQ ID NO: 1950991 - protein, 9 aa, Staphylococcus
IKNRKDSLK

SEQ ID NO: 1950992 - protein, 20 aa, Staphylococcus
IKNSEQKYKHDNLTSTECPT

SEQ ID NO: 1950993 - protein, 5 aa, Staphylococcus
IKNSI

SEQ ID NO: 1950994 - protein, 8 aa, Staphylococcus
IKNSKSPY

SEQ ID NO: 1950995 - protein, 33 aa, Staphylococcus
IKNSPLWDTKDNTLTDFTAEGSEQLNQNTSLNP

SEQ ID NO: 1950996 - protein, 16 aa, Staphylococcus
IKNSRQQQIWNLLEPY

SEQ ID NO: 1950997 - protein, 9 aa, Staphylococcus
IKNTRGGSV

SEQ ID NO: 1950998 - protein, 8 aa, Staphylococcus
IKNTRNGS

SEQ ID NO: 1950999 - protein, 8 aa, Staphylococcus
IKNTRTGS

SEQ ID NO: 1951000 - protein, 7 aa, Staphylococcus
IKNTSPP

SEQ ID NO: 1951001 - protein, 6 aa, Staphylococcus
IKNVDD

SEQ ID NO: 1951002 - protein, 16 aa, Staphylococcus
IKNYTKTELSEKLTNQ

SEQ ID NO: 1951003 - protein, 4 aa, Staphylococcus
IKPA

SEQ ID NO: 1951004 - protein, 6 aa, Staphylococcus
IKPAGG

SEQ ID NO: 1951005 - protein, 4 aa, Staphylococcus
IKPD

SEQ ID NO: 1951006 - protein, 6 aa, Staphylococcus
IKPDAI

SEQ ID NO: 1951007 - protein, 10 aa, Staphylococcus
IKPDGNKEYI

SEQ ID NO: 1951008 - protein, 6 aa, Staphylococcus
IKPDTI

SEQ ID NO: 1951009 - protein, 5 aa, Staphylococcus
IKPEH

SEQ ID NO: 1951010 - protein, 15 aa, Staphylococcus
IKPGMTTKEADALSR

SEQ ID NO: 1951011 - protein, 8 aa, Staphylococcus
IKPGTTYH

SEQ ID NO: 1951012 - protein, 5 aa, Staphylococcus
IKPGV

SEQ ID NO: 1951013 - protein, 6 aa, Staphylococcus
IKPIKN

SEQ ID NO: 1951014 - protein, 5 aa, Staphylococcus
IKPKE

SEQ ID NO: 1951015 - protein, 7 aa, Staphylococcus
IKPLDND

SEQ ID NO: 1951016 - protein, 11 aa, Staphylococcus
IKPLDNHEKND

SEQ ID NO: 1951017 - protein, 18 aa, Staphylococcus
IKPLPNDRQSILDYIKGA

SEQ ID NO: 1951018 - protein, 4 aa, Staphylococcus
IKPN

SEQ ID NO: 1951019 - protein, 6 aa, Staphylococcus
IKPNET

SEQ ID NO: 1951020 - protein, 39 aa, Staphylococcus; identical to SEQ ID NO: 1769520

SEQ ID NO: 1951021 - protein, 13 aa, Staphylococcus
IKPQEAGSHNQTT

SEQ ID NO: 1951022 - protein, 9 aa, Staphylococcus
IKPREKKGK

SEQ ID NO: 1951023 - protein, 9 aa, Staphylococcus
IKPSDRLRA

SEQ ID NO: 1951024 - protein, 12 aa, Staphylococcus
IKPTRKGKGSVV

SEQ ID NO: 1951025 - protein, 4 aa, Staphylococcus
IKQD

SEQ ID NO: 1951026 - protein, 13 aa, Staphylococcus
IKQDDTKENLEER

SEQ ID NO: 1951027 - protein, 9 aa, Staphylococcus
IKQDGGEAS

SEQ ID NO: 1951028 - protein, 4 aa, Staphylococcus
IKQE

SEQ ID NO: 1951029 - protein, 8 aa, Staphylococcus
IKQEGTHD

SEQ ID NO: 1951030 - protein, 6 aa, Staphylococcus
IKQEPY

SEQ ID NO: 1951031 - protein, 14 aa, Staphylococcus
IKQEQQRGNELGLN

SEQ ID NO: 1951032 - protein, 4 aa, Staphylococcus
IKQG

SEQ ID NO: 1951033 - protein, 7 aa, Staphylococcus
IKQGEIV

SEQ ID NO: 1951034 - protein, 13 aa, Staphylococcus
IKQGQKEADNIKK

SEQ ID NO: 1951035 - protein, 9 aa, Staphylococcus
IKQGTPNDV

SEQ ID NO: 1951036 - protein, 6 aa, Staphylococcus
IKQHSD

SEQ ID NO: 1951037 - protein, 6 aa, Staphylococcus
IKQKDY

SEQ ID NO: 1951038 - protein, 5 aa, Staphylococcus
IKQKQ

SEQ ID NO: 1951039 - protein, 9 aa, Staphylococcus
IKQKQIRDN

SEQ ID NO: 1951040 - protein, 5 aa, Staphylococcus
IKQKT

SEQ ID NO: 1951041 - protein, 7 aa, Staphylococcus
IKQKYTE

SEQ ID NO: 1951042 - protein, 4 aa, Staphylococcus
IKQL

SEQ ID NO: 1951043 - protein, 7 aa, Staphylococcus
IKQLTSE

SEQ ID NO: 1951044 - protein, 4 aa, Staphylococcus
IKQN

SEQ ID NO: 1951045 - protein, 5 aa, Staphylococcus
IKQNS

SEQ ID NO: 1951046 - protein, 4 aa, Staphylococcus
IKQP

SEQ ID NO: 1951047 - protein, 6 aa, Staphylococcus
IKQPTI

SEQ ID NO: 1951048 - protein, 16 aa, Staphylococcus
IKQQGIPAKLSNSAGT

SEQ ID NO: 1951049 - protein, 6 aa, Staphylococcus
IKQQGY

SEQ ID NO: 1951050 - protein, 65 aa, Staphylococcus
IKQRDQNGTLSKEQADKVIKNAKKQYDESKDKAKKQHKDVVNEAKKQNKGVGANIDSQTGKVKTG

SEQ ID NO: 1951051 - protein, 4 aa, Staphylococcus
IKQS

SEQ ID NO: 1951052 - protein, 19 aa, Staphylococcus
IKQSNLEADNLKEKQDDIE

SEQ ID NO: 1951053 - protein, 5 aa, Staphylococcus
IKQSS

SEQ ID NO: 1951054 - protein, 13 aa, Staphylococcus
IKQTQALDQPGYV

SEQ ID NO: 1951055 - protein, 7 aa, Staphylococcus
IKQTYDV

SEQ ID NO: 1951056 - protein, 9 aa, Staphylococcus
IKRDAQDIA

SEQ ID NO: 1951057 - protein, 10 aa, Staphylococcus
IKRDKQPTKV

SEQ ID NO: 1951058 - protein, 8 aa, Staphylococcus
IKRENDDK

SEQ ID NO: 1951059 - protein, 10 aa, Staphylococcus
IKRGEVGDER

SEQ ID NO: 1951060 - protein, 4 aa, Staphylococcus
IKRN

SEQ ID NO: 1951061 - protein, 8 aa, Staphylococcus
IKRNNPKD

SEQ ID NO: 1951062 - protein, 12 aa, Staphylococcus
IKRQDKDKNTTL

SEQ ID NO: 1951063 - protein, 11 aa, Staphylococcus
IKRQDKEKNTT

SEQ ID NO: 1951064 - protein, 14 aa, Staphylococcus
IKRRGDMEEDPSYK

SEQ ID NO: 1951065 - protein, 9 aa, Staphylococcus
IKRSQTKNI

SEQ ID NO: 1951066 - protein, 7 aa, Staphylococcus
IKRSSKK

SEQ ID NO: 1951067 - protein, 22 aa, Staphylococcus
IKRTPKNKGMMGAQKEARHYAD

SEQ ID NO: 1951068 - protein, 24 aa, Staphylococcus
IKRTSTRSFNASGVTEVGLKDGDS

SEQ ID NO: 1951069 - protein, 15 aa, Staphylococcus
IKRYSNCKEEHDINE

SEQ ID NO: 1951070 - protein, 11 aa, Staphylococcus
IKSAENTQSMN

SEQ ID NO: 1951071 - protein, 9 aa, Staphylococcus
IKSASEIEN

SEQ ID NO: 1951072 - protein, 10 aa, Staphylococcus
IKSAVTDSDG

SEQ ID NO: 1951073 - protein, 6 aa, Staphylococcus
IKSDAD

SEQ ID NO: 1951074 - protein, 4 aa, Staphylococcus
IKSE

SEQ ID NO: 1951075 - protein, 7 aa, Staphylococcus
IKSEEDI

SEQ ID NO: 1951076 - protein, 13 aa, Staphylococcus
IKSEKELNKLRGK

SEQ ID NO: 1951077 - protein, 5 aa, Staphylococcus
IKSEQ

SEQ ID NO: 1951078 - protein, 8 aa, Staphylococcus
IKSESNDK

SEQ ID NO: 1951079 - protein, 5 aa, Staphylococcus
IKSEV

SEQ ID NO: 1951080 - protein, 14 aa, Staphylococcus
IKSFDEPDASKLPW

SEQ ID NO: 1951081 - protein, 9 aa, Staphylococcus
IKSHHEHGN

SEQ ID NO: 1951082 - protein, 9 aa, Staphylococcus
IKSHNESEH

SEQ ID NO: 1951083 - protein, 4 aa, Staphylococcus
IKSK

SEQ ID NO: 1951084 - protein, 21 aa, Staphylococcus
IKSKFKGLSPKNFRKQTFEIL

SEQ ID NO: 1951085 - protein, 19 aa, Staphylococcus
IKSLPNDKESIVKYIKGVM

SEQ ID NO: 1951086 - protein, 5 aa, Staphylococcus
IKSND

SEQ ID NO: 1951087 - protein, 4 aa, Staphylococcus
IKSP

SEQ ID NO: 1951088 - protein, 8 aa, Staphylococcus
IKSPDKEI

SEQ ID NO: 1951089 - protein, 7 aa, Staphylococcus
IKSPEDV

SEQ ID NO: 1951090 - protein, 7 aa, Staphylococcus
IKSPENL

SEQ ID NO: 1951091 - protein, 19 aa, Staphylococcus
IKSPGRLPAGSLSGGNQQK

SEQ ID NO: 1951092 - protein, 7 aa, Staphylococcus
IKSPKDV

SEQ ID NO: 1951093 - protein, 12 aa, Staphylococcus
IKSPKTQIDPNE

SEQ ID NO: 1951094 - protein, 5 aa, Staphylococcus
IKSQK

SEQ ID NO: 1951095 - protein, 12 aa, Staphylococcus
IKSQVTISVLDG

SEQ ID NO: 1951096 - protein, 12 aa, Staphylococcus
IKSQVTVSVLDG

SEQ ID NO: 1951097 - protein, 10 aa, Staphylococcus
IKSSHNSQHY

SEQ ID NO: 1951098 - protein, 12 aa, Staphylococcus
IKSSPVPTGNGK

SEQ ID NO: 1951099 - protein, 10 aa, Staphylococcus
IKSSVAGDAD

SEQ ID NO: 1951100 - protein, 10 aa, Staphylococcus
IKSTAQASDG

SEQ ID NO: 1951101 - protein, 8 aa, Staphylococcus
IKSTRDGY

SEQ ID NO: 1951102 - protein, 6 aa, Staphylococcus
IKSVQD

SEQ ID NO: 1951103 - protein, 7 aa, Staphylococcus
IKSVSDV

SEQ ID NO: 1951104 - protein, 5 aa, Staphylococcus
IKSYD

SEQ ID NO: 1951105 - protein, 9 aa, Staphylococcus
IKTAKEAYN

SEQ ID NO: 1951106 - protein, 8 aa, Staphylococcus
IKTAQQAY

SEQ ID NO: 1951107 - protein, 10 aa, Staphylococcus
IKTATINNDS

SEQ ID NO: 1951108 - protein, 8 aa, Staphylococcus
IKTATTSG

SEQ ID NO: 1951109 - protein, 6 aa, Staphylococcus
IKTDDT

SEQ ID NO: 1951110 - protein, 11 aa, Staphylococcus
IKTDKISKQGI

SEQ ID NO: 1951111 - protein, 5 aa, Staphylococcus
IKTED

SEQ ID NO: 1951112 - protein, 6 aa, Staphylococcus
IKTEED

SEQ ID NO: 1951113 - protein, 9 aa, Staphylococcus
IKTEGQPAV

SEQ ID NO: 1951114 - protein, 8 aa, Staphylococcus
IKTERNKI

SEQ ID NO: 1951115 - protein, 4 aa, Staphylococcus
IKTG

SEQ ID NO: 1951116 - protein, 15 aa, Staphylococcus
IKTISSKIDSSSENI

SEQ ID NO: 1951117 - protein, 15 aa, Staphylococcus
IKTISSKINSSSPNI

SEQ ID NO: 1951118 - protein, 10 aa, Staphylococcus
IKTKARTTEV

SEQ ID NO: 1951119 - protein, 5 aa, Staphylococcus
IKTKD

SEQ ID NO: 1951120 - protein, 9 aa, Staphylococcus
IKTKDNKGK

SEQ ID NO: 1951121 - protein, 9 aa, Staphylococcus
IKTKGDTLN

SEQ ID NO: 1951122 - protein, 20 aa, Staphylococcus
IKTKHNGDAIYQRTGTPIHP

SEQ ID NO: 1951123 - protein, 10 aa, Staphylococcus
IKTKKQAKKI

SEQ ID NO: 1951124 - protein, 9 aa, Staphylococcus
IKTKQNKIV

SEQ ID NO: 1951125 - protein, 4 aa, Staphylococcus
IKTL

SEQ ID NO: 1951126 - protein, 4 aa, Staphylococcus
IKTM

SEQ ID NO: 1951127 - protein, 10 aa, Staphylococcus
IKTNARTTEV

SEQ ID NO: 1951128 - protein, 8 aa, Staphylococcus
IKTNEGRV

SEQ ID NO: 1951129 - protein, 9 aa, Staphylococcus
IKTNNSTQL

SEQ ID NO: 1951130 - protein, 8 aa, Staphylococcus
IKTNPKDV

SEQ ID NO: 1951131 - protein, 7 aa, Staphylococcus
IKTPARL

SEQ ID NO: 1951132 - protein, 6 aa, Staphylococcus
IKTPDN

SEQ ID NO: 1951133 - protein, 8 aa, Staphylococcus
IKTPDNKK

SEQ ID NO: 1951134 - protein, 8 aa, Staphylococcus
IKTPEEIE

SEQ ID NO: 1951135 - protein, 5 aa, Staphylococcus
IKTQH

SEQ ID NO: 1951136 - protein, 11 aa, Staphylococcus
IKTQNNNFSDE

SEQ ID NO: 1951137 - protein, 7 aa, Staphylococcus
IKTQQQK

SEQ ID NO: 1951138 - protein, 8 aa, Staphylococcus
IKTRENDG

SEQ ID NO: 1951139 - protein, 8 aa, Staphylococcus
IKTRQGDQ

SEQ ID NO: 1951140 - protein, 4 aa, Staphylococcus
IKTS

SEQ ID NO: 1951141 - protein, 6 aa, Staphylococcus
IKTSDV

SEQ ID NO: 1951142 - protein, 9 aa, Staphylococcus
IKTSQPPIG

SEQ ID NO: 1951143 - protein, 4 aa, Staphylococcus
IKTT

SEQ ID NO: 1951144 - protein, 7 aa, Staphylococcus
IKTTEGI

SEQ ID NO: 1951145 - protein, 13 aa, Staphylococcus
IKTTEIEGHPEFN

SEQ ID NO: 1951146 - protein, 18 aa, Staphylococcus
IKTTHTKNHASLFGAVSQ

SEQ ID NO: 1951147 - protein, 9 aa, Staphylococcus
IKTTQSQVD

SEQ ID NO: 1951148 - protein, 6 aa, Staphylococcus
IKTVDK

SEQ ID NO: 1951149 - protein, 9 aa, Staphylococcus
IKTYEQATQ

SEQ ID NO: 1951150 - protein, 9 aa, Staphylococcus
IKTYESHGD

SEQ ID NO: 1951151 - protein, 7 aa, Staphylococcus
IKVGERG

SEQ ID NO: 1951152 - protein, 6 aa, Staphylococcus
IKVGSG

SEQ ID NO: 1951153 - protein, 11 aa, Staphylococcus
IKVGSTTGYTK

SEQ ID NO: 1951154 - protein, 16 aa, Staphylococcus
IKVKSNSDFTDTRFQP

SEQ ID NO: 1951155 - protein, 16 aa, Staphylococcus
IKVKSNSDFTETRFQP

SEQ ID NO: 1951156 - protein, 7 aa, Staphylococcus
IKVNSQY

SEQ ID NO: 1951157 - protein, 6 aa, Staphylococcus
IKVTTK

SEQ ID NO: 1951158 - protein, 9 aa, Staphylococcus
IKYQTEASR

SEQ ID NO: 1951159 - protein, 7 aa, Staphylococcus
IKYTPRG

SEQ ID NO: 1951160 - protein, 11 aa, Staphylococcus
IKYTQSQDSIQ

SEQ ID NO: 1951161 - protein, 6 aa, Staphylococcus
ILEEGS

SEQ ID NO: 1951162 - protein, 5 aa, Staphylococcus
ILETS

SEQ ID NO: 1951163 - protein, 8 aa, Staphylococcus
ILNGGPRH

SEQ ID NO: 1951164 - protein, 31 aa, Staphylococcus
ILNGKDGAKGENGKTPSVEQQAIQDKDGKQI

SEQ ID NO: 1951165 - protein, 10 aa, Staphylococcus
ILPDDHPYSI

SEQ ID NO: 1951166 - protein, 4 aa, Staphylococcus
ILPN

SEQ ID NO: 1951167 - protein, 7 aa, Staphylococcus
ILPNESA

SEQ ID NO: 1951168 - protein, 6 aa, Staphylococcus
ILPNRS

SEQ ID NO: 1951169 - protein, 14 aa, Staphylococcus
ILPRKSGVSDAPMK

SEQ ID NO: 1951170 - protein, 5 aa, Staphylococcus
ILPSD

SEQ ID NO: 1951171 - protein, 13 aa, Staphylococcus
ILPTESKSIANTL

SEQ ID NO: 1951172 - protein, 13 aa, Staphylococcus
ILPTESTQIASSL

SEQ ID NO: 1951173 - protein, 4 aa, Staphylococcus
ILQE

SEQ ID NO: 1951174 - protein, 13 aa, Staphylococcus
ILQPKSQSAIQEQ

SEQ ID NO: 1951175 - protein, 9 aa, Staphylococcus
ILSEEDNYK

SEQ ID NO: 1951176 - protein, 13 aa, Staphylococcus
ILSQSSPVATQIP

SEQ ID NO: 1951177 - protein, 9 aa, Staphylococcus
ILTESKDSV

SEQ ID NO: 1951178 - protein, 19 aa, Staphylococcus
ILTGQRRLNSNGDKADHRA

SEQ ID NO: 1951179 - protein, 6 aa, Staphylococcus
ILTNPA

SEQ ID NO: 1951180 - protein, 8 aa, Staphylococcus
ILTQSTTS

SEQ ID NO: 1951181 - protein, 13 aa, Staphylococcus
IMKQDNNNQWDEQ

SEQ ID NO: 1951182 - protein, 10 aa, Staphylococcus
IMPGGSQEMI

SEQ ID NO: 1951183 - protein, 9 aa, Staphylococcus
IMTPNNKQQ

SEQ ID NO: 1951184 - protein, 11 aa, Staphylococcus
INADGIGRDAS

SEQ ID NO: 1951185 - protein, 12 aa, Staphylococcus
INADGIGRDAST

SEQ ID NO: 1951186 - protein, 7 aa, Staphylococcus
INADKGA

SEQ ID NO: 1951187 - protein, 10 aa, Staphylococcus
INAENKEEIE

SEQ ID NO: 1951188 - protein, 10 aa, Staphylococcus
INAGRANSNL

SEQ ID NO: 1951189 - protein, 11 aa, Staphylococcus
INAGYSPASAH

SEQ ID NO: 1951190 - protein, 11 aa, Staphylococcus
INAKDKEAIEA

SEQ ID NO: 1951191 - protein, 8 aa, Staphylococcus
INAKKNNR

SEQ ID NO: 1951192 - protein, 16 aa, Staphylococcus
INAKTGKYTGRSPKDK

SEQ ID NO: 1951193 - protein, 4 aa, Staphylococcus
INAN

SEQ ID NO: 1951194 - protein, 5 aa, Staphylococcus
INANG

SEQ ID NO: 1951195 - protein, 14 aa, Staphylococcus
INANGGEGKADAKY

SEQ ID NO: 1951196 - protein, 8 aa, Staphylococcus
INANQESE

SEQ ID NO: 1951197 - protein, 7 aa, Staphylococcus
INANSDR

SEQ ID NO: 1951198 - protein, 18 aa, Staphylococcus
INAQKASLERTDKQIETI

SEQ ID NO: 1951199 - protein, 4 aa, Staphylococcus
INAS

SEQ ID NO: 1951200 - protein, 4 aa, Staphylococcus
INAT

SEQ ID NO: 1951201 - protein, 9 aa, Staphylococcus
INDASQKSL

SEQ ID NO: 1951202 - protein, 4 aa, Staphylococcus
INDD

SEQ ID NO: 1951203 - protein, 11 aa, Staphylococcus
INDDKGNQNLK

SEQ ID NO: 1951204 - protein, 5 aa, Staphylococcus
INDDM

SEQ ID NO: 1951205 - protein, 12 aa, Staphylococcus
INDDQPKAIGDF

SEQ ID NO: 1951206 - protein, 5 aa, Staphylococcus
INDDR

SEQ ID NO: 1951207 - protein, 10 aa, Staphylococcus
INDDTSKALY

SEQ ID NO: 1951208 - protein, 7 aa, Staphylococcus
INDEATR

SEQ ID NO: 1951209 - protein, 6 aa, Staphylococcus
INDERA

SEQ ID NO: 1951210 - protein, 17 aa, Staphylococcus
INDETKKKYGNDAKQIK

SEQ ID NO: 1951211 - protein, 5 aa, Staphylococcus
INDGM

SEQ ID NO: 1951212 - protein, 6 aa, Staphylococcus
INDGMS

SEQ ID NO: 1951213 - protein, 7 aa, Staphylococcus
INDKETQ

SEQ ID NO: 1951214 - protein, 12 aa, Staphylococcus
INDNNQQSIDTL

SEQ ID NO: 1951215 - protein, 17 aa, Staphylococcus
INDPEQIKKYIQALEDL

SEQ ID NO: 1951216 - protein, 6 aa, Staphylococcus
INDPNG

SEQ ID NO: 1951217 - protein, 35 aa, Staphylococcus
INDQLKKDEKNGDITEDDLRSQSDDVQKATDDSIK

SEQ ID NO: 1951218 - protein, 35 aa, Staphylococcus
INDQLKKDEKNGDITEDDLRSQTEDVQKVTDNSIK

SEQ ID NO: 1951219 - protein, 5 aa, Staphylococcus
INDSD

SEQ ID NO: 1951220 - protein, 6 aa, Staphylococcus
INDSDY

SEQ ID NO: 1951221 - protein, 17 aa, Staphylococcus
INDTAQSVKALSGGQQK

SEQ ID NO: 1951222 - protein, 7 aa, Staphylococcus
INDTEQR

SEQ ID NO: 1951223 - protein, 5 aa, Staphylococcus
INDTN

SEQ ID NO: 1951224 - protein, 6 aa, Staphylococcus
INDTNK

SEQ ID NO: 1951225 - protein, 18 aa, Staphylococcus
INDTTKKVNELSGGQQKR

SEQ ID NO: 1951226 - protein, 4 aa, Staphylococcus
INDY

SEQ ID NO: 1951227 - protein, 33 aa, Staphylococcus
INDYGDGDFSYNPNVPSYSAKYQLTNDDDNVRQ

SEQ ID NO: 1951228 - protein, 24 aa, Staphylococcus
INEAGRKPDLPFGGYKQSGLGREW

SEQ ID NO: 1951229 - protein, 6 aa, Staphylococcus
INEAPP

SEQ ID NO: 1951230 - protein, 4 aa, Staphylococcus
INED

SEQ ID NO: 1951231 - protein, 11 aa, Staphylococcus
INEDGDAYRKL

SEQ ID NO: 1951232 - protein, 5 aa, Staphylococcus
INEDL

SEQ ID NO: 1951233 - protein, 6 aa, Staphylococcus
INEDQE

SEQ ID NO: 1951234 - protein, 6 aa, Staphylococcus
INEDSV

SEQ ID NO: 1951235 - protein, 9 aa, Staphylococcus
INEEDEEFG

SEQ ID NO: 1951236 - protein, 10 aa, Staphylococcus
INEEEKNLNQ

SEQ ID NO: 1951237 - protein, 6 aa, Staphylococcus
INEEIE

SEQ ID NO: 1951238 - protein, 15 aa, Staphylococcus
INEEKTKGANTTPET

SEQ ID NO: 1951239 - protein, 11 aa, Staphylococcus
INEENGKVGSV

SEQ ID NO: 1951240 - protein, 4 aa, Staphylococcus
INEK

SEQ ID NO: 1951241 - protein, 9 aa, Staphylococcus
INEKAGINY

SEQ ID NO: 1951242 - protein, 14 aa, Staphylococcus
INEKGVIEEVVYLK

SEQ ID NO: 1951243 - protein, 6 aa, Staphylococcus
INEKQM

SEQ ID NO: 1951244 - protein, 10 aa, Staphylococcus
INEKRNGYFE

SEQ ID NO: 1951245 - protein, 4 aa, Staphylococcus
INEL

SEQ ID NO: 1951246 - protein, 8 aa, Staphylococcus
INEMRGDD

SEQ ID NO: 1951247 - protein, 8 aa, Staphylococcus
INEMRPGS

SEQ ID NO: 1951248 - protein, 4 aa, Staphylococcus
INEN

SEQ ID NO: 1951249 - protein, 5 aa, Staphylococcus
INENE

SEQ ID NO: 1951250 - protein, 11 aa, Staphylococcus
INENNEKYGQE

SEQ ID NO: 1951251 - protein, 8 aa, Staphylococcus
INENNESE

SEQ ID NO: 1951252 - protein, 6 aa, Staphylococcus
INENPF

SEQ ID NO: 1951253 - protein, 8 aa, Staphylococcus
INENQRQI

SEQ ID NO: 1951254 - protein, 7 aa, Staphylococcus
INEPEAA

SEQ ID NO: 1951255 - protein, 8 aa, Staphylococcus
INEPEAAI

SEQ ID NO: 1951256 - protein, 11 aa, Staphylococcus
INEPKAAEEEF

SEQ ID NO: 1951257 - protein, 13 aa, Staphylococcus
INEPNTNDDGRIK

SEQ ID NO: 1951258 - protein, 4 aa, Staphylococcus
INEQ

SEQ ID NO: 1951259 - protein, 25 aa, Staphylococcus
INEQDGKYKRTSKVDNAYQYPDENK

SEQ ID NO: 1951260 - protein, 17 aa, Staphylococcus
INEQKTKGANTTPETVS

SEQ ID NO: 1951261 - protein, 7 aa, Staphylococcus
INEQNNI

SEQ ID NO: 1951262 - protein, 7 aa, Staphylococcus
INEQNTP

SEQ ID NO: 1951263 - protein, 27 aa, Staphylococcus
INEQSLQDNQEDETSELSNVQNENTQA

SEQ ID NO: 1951264 - protein, 9 aa, Staphylococcus
INEQTSYDA

SEQ ID NO: 1951265 - protein, 4 aa, Staphylococcus
INER

SEQ ID NO: 1951266 - protein, 6 aa, Staphylococcus
INESDV

SEQ ID NO: 1951267 - protein, 5 aa, Staphylococcus
INESH

SEQ ID NO: 1951268 - protein, 9 aa, Staphylococcus
INESPNEPY

SEQ ID NO: 1951269 - protein, 6 aa, Staphylococcus
INETAT

SEQ ID NO: 1951270 - protein, 15 aa, Staphylococcus
INETEEKKGLENYDA

SEQ ID NO: 1951271 - protein, 14 aa, Staphylococcus
INETKVDKKAGTGI

SEQ ID NO: 1951272 - protein, 14 aa, Staphylococcus
INFADGSTATMKTG

SEQ ID NO: 1951273 - protein, 8 aa, Staphylococcus
INFSKKDG

SEQ ID NO: 1951274 - protein, 8 aa, Staphylococcus
INGAKNSA

SEQ ID NO: 1951275 - protein, 15 aa, Staphylococcus
INGDANGSIPTSEPL

SEQ ID NO: 1951276 - protein, 6 aa, Staphylococcus
INGDER

SEQ ID NO: 1951277 - protein, 12 aa, Staphylococcus
INGDQSEEGLES

SEQ ID NO: 1951278 - protein, 23 aa, Staphylococcus
INGEDVSEQPSNFKDRAKRFFKG

SEQ ID NO: 1951279 - protein, 7 aa, Staphylococcus
INGEKVD

SEQ ID NO: 1951280 - protein, 7 aa, Staphylococcus
INGESYP

SEQ ID NO: 1951281 - protein, 13 aa, Staphylococcus
INGGDQVNSIPEY

SEQ ID NO: 1951282 - protein, 7 aa, Staphylococcus
INGGEQN

SEQ ID NO: 1951283 - protein, 14 aa, Staphylococcus
INGNDRIVSFQWKS

SEQ ID NO: 1951284 - protein, 7 aa, Staphylococcus
INGPKVT

SEQ ID NO: 1951285 - protein, 10 aa, Staphylococcus
INGTGGNQRI

SEQ ID NO: 1951286 - protein, 10 aa, Staphylococcus
INHESNNGKI

SEQ ID NO: 1951287 - protein, 8 aa, Staphylococcus
INHSQSNE

SEQ ID NO: 1951288 - protein, 7 aa, Staphylococcus
INIPPEG

SEQ ID NO: 1951289 - protein, 7 aa, Staphylococcus
INIPTDT

SEQ ID NO: 1951290 - protein, 8 aa, Staphylococcus
INKAAEEH

SEQ ID NO: 1951291 - protein, 9 aa, Staphylococcus
INKAELDQT

SEQ ID NO: 1951292 - protein, 5 aa, Staphylococcus
INKAK

SEQ ID NO: 1951293 - protein, 6 aa, Staphylococcus
INKARG

SEQ ID NO: 1951294 - protein, 8 aa, Staphylococcus
INKARGIE

SEQ ID NO: 1951295 - protein, 8 aa, Staphylococcus
INKATEDA

SEQ ID NO: 1951296 - protein, 9 aa, Staphylococcus
INKDEKPMP

SEQ ID NO: 1951297 - protein, 8 aa, Staphylococcus
INKDKGEV

SEQ ID NO: 1951298 - protein, 6 aa, Staphylococcus
INKEDQ

SEQ ID NO: 1951299 - protein, 8 aa, Staphylococcus
INKEPEKY

SEQ ID NO: 1951300 - protein, 30 aa, Staphylococcus
INKGFADEKSSRKSVDKQKEGVKNVGNSKY

SEQ ID NO: 1951301 - protein, 9 aa, Staphylococcus
INKGKEGVL

SEQ ID NO: 1951302 - protein, 9 aa, Staphylococcus
INKGQTVTE

SEQ ID NO: 1951303 - protein, 10 aa, Staphylococcus
INKKNNSSYL

SEQ ID NO: 1951304 - protein, 5 aa, Staphylococcus
INKKQ

SEQ ID NO: 1951305 - protein, 12 aa, Staphylococcus
INKLPKDSKGYE

SEQ ID NO: 1951306 - protein, 14 aa, Staphylococcus
INKLSKAELRRKRQ

SEQ ID NO: 1951307 - protein, 15 aa, Staphylococcus
INKLSKSDLRKKRQK

SEQ ID NO: 1951308 - protein, 8 aa, Staphylococcus
INKMRGEN

SEQ ID NO: 1951309 - protein, 8 aa, Staphylococcus
INKNDEVN

SEQ ID NO: 1951310 - protein, 7 aa, Staphylococcus
INKNDQK

SEQ ID NO: 1951311 - protein, 5 aa, Staphylococcus
INKNE

SEQ ID NO: 1951312 - protein, 9 aa, Staphylococcus
INKNEKDDF

SEQ ID NO: 1951313 - protein, 8 aa, Staphylococcus
INKNEQER

SEQ ID NO: 1951314 - protein, 8 aa, Staphylococcus
INKPHSVE

SEQ ID NO: 1951315 - protein, 27 aa, Staphylococcus
INKQGVDEGPKYRTGIYSDEQKHLEEA

SEQ ID NO: 1951316 - protein, 7 aa, Staphylococcus
INKRAEH

SEQ ID NO: 1951317 - protein, 8 aa, Staphylococcus
INKRNSIE

SEQ ID NO: 1951318 - protein, 8 aa, Staphylococcus
INKSVHPR

SEQ ID NO: 1951319 - protein, 10 aa, Staphylococcus
INKSVHPRYT

SEQ ID NO: 1951320 - protein, 12 aa, Staphylococcus
INKYNSRSIETS

SEQ ID NO: 1951321 - protein, 12 aa, Staphylococcus
INLDKDDKRQSE

SEQ ID NO: 1951322 - protein, 4 aa, Staphylococcus
INLE

SEQ ID NO: 1951323 - protein, 9 aa, Staphylococcus
INLNNKETL

SEQ ID NO: 1951324 - protein, 4 aa, Staphylococcus
INLT

SEQ ID NO: 1951325 - protein, 4 aa, Staphylococcus
INMP

SEQ ID NO: 1951326 - protein, 7 aa, Staphylococcus
INNARGE

SEQ ID NO: 1951327 - protein, 6 aa, Staphylococcus
INNDAR

SEQ ID NO: 1951328 - protein, 5 aa, Staphylococcus
INNDD

SEQ ID NO: 1951329 - protein, 7 aa, Staphylococcus
INNDPRG

SEQ ID NO: 1951330 - protein, 17 aa, Staphylococcus
INNGNYYKNDDQQVGST

SEQ ID NO: 1951331 - protein, 10 aa, Staphylococcus
INNNETGPIT

SEQ ID NO: 1951332 - protein, 10 aa, Staphylococcus
INNNSQKIEE

SEQ ID NO: 1951333 - protein, 11 aa, Staphylococcus
INNQKRENEDA

SEQ ID NO: 1951334 - protein, 6 aa, Staphylococcus
INNQNS

SEQ ID NO: 1951335 - protein, 6 aa, Staphylococcus
INNSNY

SEQ ID NO: 1951336 - protein, 10 aa, Staphylococcus
INNTKQSGYR

SEQ ID NO: 1951337 - protein, 18 aa, Staphylococcus
INNTTKKVKELSGGQQKR

SEQ ID NO: 1951338 - protein, 4 aa, Staphylococcus
INPD

SEQ ID NO: 1951339 - protein, 13 aa, Staphylococcus
INPDAYKEGYVSS

SEQ ID NO: 1951340 - protein, 14 aa, Staphylococcus
INPDKDVDGFHPSN

SEQ ID NO: 1951341 - protein, 6 aa, Staphylococcus
INPEEY

SEQ ID NO: 1951342 - protein, 13 aa, Staphylococcus
INPEKDVDGFHPQ

SEQ ID NO: 1951343 - protein, 8 aa, Staphylococcus
INPENQNR

SEQ ID NO: 1951344 - protein, 17 aa, Staphylococcus
INPERSADSLNDDEQKR

SEQ ID NO: 1951345 - protein, 5 aa, Staphylococcus
INPET

SEQ ID NO: 1951346 - protein, 6 aa, Staphylococcus
INPETF

SEQ ID NO: 1951347 - protein, 4 aa, Staphylococcus
INPI

SEQ ID NO: 1951348 - protein, 12 aa, Staphylococcus
INPLEDREKNDA

SEQ ID NO: 1951349 - protein, 11 aa, Staphylococcus
INPLPNHDKND

SEQ ID NO: 1951350 - protein, 4 aa, Staphylococcus
INPN

SEQ ID NO: 1951351 - protein, 7 aa, Staphylococcus
INPNEVT

SEQ ID NO: 1951352 - protein, 6 aa, Staphylococcus
INPNGE

SEQ ID NO: 1951353 - protein, 5 aa, Staphylococcus
INPPE

SEQ ID NO: 1951354 - protein, 9 aa, Staphylococcus
INPPKRTHL

SEQ ID NO: 1951355 - protein, 8 aa, Staphylococcus
INPPYTAT

SEQ ID NO: 1951356 - protein, 5 aa, Staphylococcus
INPQQ

SEQ ID NO: 1951357 - protein, 4 aa, Staphylococcus
INPR

SEQ ID NO: 1951358 - protein, 11 aa, Staphylococcus
INPSYQNPKKL

SEQ ID NO: 1951359 - protein, 7 aa, Staphylococcus
INPTEGE

SEQ ID NO: 1951360 - protein, 14 aa, Staphylococcus
INPTEGEVVSPIDG

SEQ ID NO: 1951361 - protein, 8 aa, Staphylococcus
INPTEGTV

SEQ ID NO: 1951362 - protein, 11 aa, Staphylococcus
INPVEGHEKND

SEQ ID NO: 1951363 - protein, 8 aa, Staphylococcus
INQADQMG

SEQ ID NO: 1951364 - protein, 5 aa, Staphylococcus
INQAE

SEQ ID NO: 1951365 - protein, 9 aa, Staphylococcus
INQDEAKEL

SEQ ID NO: 1951366 - protein, 6 aa, Staphylococcus
INQDRQ

SEQ ID NO: 1951367 - protein, 8 aa, Staphylococcus
INQDSTVE

SEQ ID NO: 1951368 - protein, 4 aa, Staphylococcus
INQE

SEQ ID NO: 1951369 - protein, 10 aa, Staphylococcus
INQEPYDSEI

SEQ ID NO: 1951370 - protein, 6 aa, Staphylococcus
INQGGN

SEQ ID NO: 1951371 - protein, 12 aa, Staphylococcus
INQIQKETTTSV

SEQ ID NO: 1951372 - protein, 6 aa, Staphylococcus
INQLPQ

SEQ ID NO: 1951373 - protein, 19 aa, Staphylococcus
INQLSGTKQILDDQGPRGL

SEQ ID NO: 1951374 - protein, 8 aa, Staphylococcus
INQMRGKE

SEQ ID NO: 1951375 - protein, 21 aa, Staphylococcus
INQNNNEQRRKELSQKSKRDV

SEQ ID NO: 1951376 - protein, 7 aa, Staphylococcus
INQPDND

SEQ ID NO: 1951377 - protein, 7 aa, Staphylococcus
INQPKGY

SEQ ID NO: 1951378 - protein, 10 aa, Staphylococcus
INQPTITAKN

SEQ ID NO: 1951379 - protein, 4 aa, Staphylococcus
INQR

SEQ ID NO: 1951380 - protein, 8 aa, Staphylococcus
INQRDTQN

SEQ ID NO: 1951381 - protein, 7 aa, Staphylococcus
INQRQQV

SEQ ID NO: 1951382 - protein, 9 aa, Staphylococcus
INQSSLPDK

SEQ ID NO: 1951383 - protein, 8 aa, Staphylococcus
INQTADSK

SEQ ID NO: 1951384 - protein, 17 aa, Staphylococcus
INRDGALGGIGKPEKLV

SEQ ID NO: 1951385 - protein, 6 aa, Staphylococcus
INREKY

SEQ ID NO: 1951386 - protein, 15 aa, Staphylococcus
INRLEESKNQEPHLR

SEQ ID NO: 1951387 - protein, 16 aa, Staphylococcus
INRLEQSRDEAPHLRE

SEQ ID NO: 1951388 - protein, 7 aa, Staphylococcus
INRQGEE

SEQ ID NO: 1951389 - protein, 21 aa, Staphylococcus
INRQQAGEPGTRQGDGWAEPY

SEQ ID NO: 1951390 - protein, 14 aa, Staphylococcus
INRSKELNESVPEI

SEQ ID NO: 1951391 - protein, 14 aa, Staphylococcus
INRSTIGDRTTVKQ

SEQ ID NO: 1951392 - protein, 7 aa, Staphylococcus
INRTDDT

SEQ ID NO: 1951393 - protein, 14 aa, Staphylococcus
INSAPGSVSQVRES

SEQ ID NO: 1951394 - protein, 10 aa, Staphylococcus
INSAQDPEKL

SEQ ID NO: 1951395 - protein, 7 aa, Staphylococcus
INSDETT

SEQ ID NO: 1951396 - protein, 6 aa, Staphylococcus
INSEDH

SEQ ID NO: 1951397 - protein, 13 aa, Staphylococcus
INSENKVSKETKN

SEQ ID NO: 1951398 - protein, 16 aa, Staphylococcus
INSGELNGLDNETAIS

SEQ ID NO: 1951399 - protein, 11 aa, Staphylococcus
INSGGPSESLK

SEQ ID NO: 1951400 - protein, 5 aa, Staphylococcus
INSKN

SEQ ID NO: 1951401 - protein, 9 aa, Staphylococcus
INSLSGTKQ

SEQ ID NO: 1951402 - protein, 4 aa, Staphylococcus
INSN

SEQ ID NO: 1951403 - protein, 10 aa, Staphylococcus
INSNDENARY

SEQ ID NO: 1951404 - protein, 6 aa, Staphylococcus
INSNED

SEQ ID NO: 1951405 - protein, 10 aa, Staphylococcus
INSPEDAAPQ

SEQ ID NO: 1951406 - protein, 10 aa, Staphylococcus
INSPSGYAEK

SEQ ID NO: 1951407 - protein, 4 aa, Staphylococcus
INSS

SEQ ID NO: 1951408 - protein, 10 aa, Staphylococcus
INSSDAYNED

SEQ ID NO: 1951409 - protein, 6 aa, Staphylococcus
INSTKN

SEQ ID NO: 1951410 - protein, 6 aa, Staphylococcus
INSVPK

SEQ ID NO: 1951411 - protein, 12 aa, Staphylococcus
INTDHLSSNKQL

SEQ ID NO: 1951412 - protein, 7 aa, Staphylococcus
INTDPYN

SEQ ID NO: 1951413 - protein, 5 aa, Staphylococcus
INTDQ

SEQ ID NO: 1951414 - protein, 11 aa, Staphylococcus
INTDTSDTTGY

SEQ ID NO: 1951415 - protein, 5 aa, Staphylococcus
INTEF

SEQ ID NO: 1951416 - protein, 7 aa, Staphylococcus
INTEKAK

SEQ ID NO: 1951417 - protein, 7 aa, Staphylococcus
INTEPDY

SEQ ID NO: 1951418 - protein, 5 aa, Staphylococcus
INTGA

SEQ ID NO: 1951419 - protein, 5 aa, Staphylococcus
INTGE

SEQ ID NO: 1951420 - protein, 6 aa, Staphylococcus
INTGNG

SEQ ID NO: 1951421 - protein, 6 aa, Staphylococcus
INTHGA

SEQ ID NO: 1951422 - protein, 6 aa, Staphylococcus
INTHQQ

SEQ ID NO: 1951423 - protein, 6 aa, Staphylococcus
INTKSQ

SEQ ID NO: 1951424 - protein, 7 aa, Staphylococcus
INTPEDT

SEQ ID NO: 1951425 - protein, 7 aa, Staphylococcus
INTPKQL

SEQ ID NO: 1951426 - protein, 8 aa, Staphylococcus
INTPKQLS

SEQ ID NO: 1951427 - protein, 14 aa, Staphylococcus
INTPYSPNGPPPGY

SEQ ID NO: 1951428 - protein, 10 aa, Staphylococcus
INTRASEADI

SEQ ID NO: 1951429 - protein, 7 aa, Staphylococcus
INTSARY

SEQ ID NO: 1951430 - protein, 12 aa, Staphylococcus
INTSIESNKDIN

SEQ ID NO: 1951431 - protein, 4 aa, Staphylococcus
INTT

SEQ ID NO: 1951432 - protein, 10 aa, Staphylococcus
INTTDKGPEI

SEQ ID NO: 1951433 - protein, 11 aa, Staphylococcus
INTTDKGPEIY

SEQ ID NO: 1951434 - protein, 11 aa, Staphylococcus
INTTDKGPEVF

SEQ ID NO: 1951435 - protein, 5 aa, Staphylococcus
INTVP

SEQ ID NO: 1951436 - protein, 10 aa, Staphylococcus
INTYDQQYYG

SEQ ID NO: 1951437 - protein, 12 aa, Staphylococcus
INTYSEKELRNV

SEQ ID NO: 1951438 - protein, 4 aa, Staphylococcus
INYD

SEQ ID NO: 1951439 - protein, 13 aa, Staphylococcus
IPADQEALDIGPK

SEQ ID NO: 1951440 - protein, 14 aa, Staphylococcus
IPADQEALDVGPKT

SEQ ID NO: 1951441 - protein, 9 aa, Staphylococcus
IPAESSGYF

SEQ ID NO: 1951442 - protein, 4 aa, Staphylococcus
IPAG

SEQ ID NO: 1951443 - protein, 5 aa, Staphylococcus
IPAGR

SEQ ID NO: 1951444 - protein, 4 aa, Staphylococcus
IPAI

SEQ ID NO: 1951445 - protein, 15 aa, Staphylococcus
IPAKDLNNRLNELSQ

SEQ ID NO: 1951446 - protein, 4 aa, Staphylococcus
IPAL

SEQ ID NO: 1951447 - protein, 17 aa, Staphylococcus
IPANTAPIRGGTDGSQL

SEQ ID NO: 1951448 - protein, 8 aa, Staphylococcus
IPANTGNI

SEQ ID NO: 1951449 - protein, 9 aa, Staphylococcus
IPANTPNKN

SEQ ID NO: 1951450 - protein, 8 aa, Staphylococcus
IPANTTSK

SEQ ID NO: 1951451 - protein, 7 aa, Staphylococcus
IPAPATA

SEQ ID NO: 1951452 - protein, 12 aa, Staphylococcus
IPAPKDNRDEPL

SEQ ID NO: 1951453 - protein, 10 aa, Staphylococcus
IPAPPTGYTQ

SEQ ID NO: 1951454 - protein, 12 aa, Staphylococcus
IPAPSGDPSAPL

SEQ ID NO: 1951455 - protein, 8 aa, Staphylococcus
IPAPYSER

SEQ ID NO: 1951456 - protein, 5 aa, Staphylococcus
IPASD

SEQ ID NO: 1951457 - protein, 5 aa, Staphylococcus
IPASV

SEQ ID NO: 1951458 - protein, 6 aa, Staphylococcus
IPDAPH

SEQ ID NO: 1951459 - protein, 5 aa, Staphylococcus
IPDDE

SEQ ID NO: 1951460 - protein, 14 aa, Staphylococcus
IPDDHKERAEEARA

SEQ ID NO: 1951461 - protein, 6 aa, Staphylococcus
IPDDHP

SEQ ID NO: 1951462 - protein, 9 aa, Staphylococcus
IPDDHPYSI

SEQ ID NO: 1951463 - protein, 4 aa, Staphylococcus
IPDE

SEQ ID NO: 1951464 - protein, 7 aa, Staphylococcus
IPDEVQA

SEQ ID NO: 1951465 - protein, 11 aa, Staphylococcus
IPDGEAETTLT

SEQ ID NO: 1951466 - protein, 9 aa, Staphylococcus
IPDGETPEG

SEQ ID NO: 1951467 - protein, 9 aa, Staphylococcus
IPDGETPQG

SEQ ID NO: 1951468 - protein, 9 aa, Staphylococcus
IPDGETPTG

SEQ ID NO: 1951469 - protein, 4 aa, Staphylococcus
IPDH

SEQ ID NO: 1951470 - protein, 12 aa, Staphylococcus
IPDIRSDNLNGG

SEQ ID NO: 1951471 - protein, 11 aa, Staphylococcus
IPDITDKGYYQ

SEQ ID NO: 1951472 - protein, 4 aa, Staphylococcus
IPDN

SEQ ID NO: 1951473 - protein, 6 aa, Staphylococcus
IPDNEF

SEQ ID NO: 1951474 - protein, 8 aa, Staphylococcus
IPDQDTIN

SEQ ID NO: 1951475 - protein, 4 aa, Staphylococcus
IPDR

SEQ ID NO: 1951476 - protein, 14 aa, Staphylococcus
IPDSHKEKAEEARA

SEQ ID NO: 1951477 - protein, 5 aa, Staphylococcus
IPDVT

SEQ ID NO: 1951478 - protein, 5 aa, Staphylococcus
IPDYR

SEQ ID NO: 1951479 - protein, 10 aa, Staphylococcus
IPEADNDSYQ

SEQ ID NO: 1951480 - protein, 7 aa, Staphylococcus
IPEAEQK

SEQ ID NO: 1951481 - protein, 14 aa, Staphylococcus
IPEDDENGSPKPRL

SEQ ID NO: 1951482 - protein, 9 aa, Staphylococcus
IPEDDQTQY

SEQ ID NO: 1951483 - protein, 15 aa, Staphylococcus
IPEDHKERAEEARSN

SEQ ID NO: 1951484 - protein, 15 aa, Staphylococcus
IPEDHKERAEEARST

SEQ ID NO: 1951485 - protein, 34 aa, Staphylococcus
IPEDKREEKHKTSSGEMKNSYEMTTKEREDFKRH

SEQ ID NO: 1951486 - protein, 11 aa, Staphylococcus
IPEDNENTKYR

SEQ ID NO: 1951487 - protein, 6 aa, Staphylococcus
IPEDTV

SEQ ID NO: 1951488 - protein, 10 aa, Staphylococcus
IPEDVRNQRG

SEQ ID NO: 1951489 - protein, 6 aa, Staphylococcus
IPEEDD

SEQ ID NO: 1951490 - protein, 13 aa, Staphylococcus
IPEEDTKKALQAF

SEQ ID NO: 1951491 - protein, 8 aa, Staphylococcus
IPEEEHDE

SEQ ID NO: 1951492 - protein, 6 aa, Staphylococcus
IPEEKL

SEQ ID NO: 1951493 - protein, 5 aa, Staphylococcus
IPEEN

SEQ ID NO: 1951494 - protein, 10 aa, Staphylococcus
IPEENDQTKL

SEQ ID NO: 1951495 - protein, 9 aa, Staphylococcus
IPEENKQHQ

SEQ ID NO: 1951496 - protein, 8 aa, Staphylococcus
IPEGEGQS

SEQ ID NO: 1951497 - protein, 11 aa, Staphylococcus
IPEGVDNEQQI

SEQ ID NO: 1951498 - protein, 20 aa, Staphylococcus
IPEKELEETKLKAKSLLEVS

SEQ ID NO: 1951499 - protein, 20 aa, Staphylococcus
IPEKELEETKLKAKSLLEVT

SEQ ID NO: 1951500 - protein, 20 aa, Staphylococcus
IPEKELEETRLKAKSLLEVT

SEQ ID NO: 1951501 - protein, 20 aa, Staphylococcus
IPEKELRETQLKAKSLLEVT

SEQ ID NO: 1951502 - protein, 18 aa, Staphylococcus
IPEKENNEQPGMGGMPGM

SEQ ID NO: 1951503 - protein, 14 aa, Staphylococcus
IPELPDARKEKYVN

SEQ ID NO: 1951504 - protein, 11 aa, Staphylococcus
IPENDSTLTEQ

SEQ ID NO: 1951505 - protein, 5 aa, Staphylococcus
IPENK

SEQ ID NO: 1951506 - protein, 11 aa, Staphylococcus
IPENPSEEDLD

SEQ ID NO: 1951507 - protein, 18 aa, Staphylococcus
IPEPESNDNAAMGGMPGM

SEQ ID NO: 1951508 - protein, 5 aa, Staphylococcus
IPEPY

SEQ ID NO: 1951509 - protein, 5 aa, Staphylococcus
IPEQK

SEQ ID NO: 1951510 - protein, 13 aa, Staphylococcus
IPEQPSEEDREWG

SEQ ID NO: 1951511 - protein, 5 aa, Staphylococcus
IPEQY

SEQ ID NO: 1951512 - protein, 11 aa, Staphylococcus
IPESPSEADLE

SEQ ID NO: 1951513 - protein, 13 aa, Staphylococcus
IPESPSEDDKEWG

SEQ ID NO: 1951514 - protein, 6 aa, Staphylococcus
IPESQD

SEQ ID NO: 1951515 - protein, 5 aa, Staphylococcus
IPESR

SEQ ID NO: 1951516 - protein, 15 aa, Staphylococcus
IPESYNSISRTATLS

SEQ ID NO: 1951517 - protein, 8 aa, Staphylococcus
IPETGESC

SEQ ID NO: 1951518 - protein, 11 aa, Staphylococcus
IPFDEDNKPVP

SEQ ID NO: 1951519 - protein, 8 aa, Staphylococcus
IPFGQNGK

SEQ ID NO: 1951520 - protein, 8 aa, Staphylococcus
IPGANAGL

SEQ ID NO: 1951521 - protein, 4 aa, Staphylococcus
IPGD

SEQ ID NO: 1951522 - protein, 6 aa, Staphylococcus
IPGDSI

SEQ ID NO: 1951523 - protein, 5 aa, Staphylococcus
IPGED

SEQ ID NO: 1951524 - protein, 10 aa, Staphylococcus
IPGEDELRNK

SEQ ID NO: 1951525 - protein, 5 aa, Staphylococcus
IPGGA

SEQ ID NO: 1951526 - protein, 9 aa, Staphylococcus
IPGINSTPI

SEQ ID NO: 1951527 - protein, 14 aa, Staphylococcus
IPGLTSKVKGNTVN

SEQ ID NO: 1951528 - protein, 4 aa, Staphylococcus
IPGN

SEQ ID NO: 1951529 - protein, 5 aa, Staphylococcus
IPGNG

SEQ ID NO: 1951530 - protein, 11 aa, Staphylococcus
IPGNTGSIART

SEQ ID NO: 1951531 - protein, 8 aa, Staphylococcus
IPGPNAGL

SEQ ID NO: 1951532 - protein, 8 aa, Staphylococcus
IPGQPYTR

SEQ ID NO: 1951533 - protein, 12 aa, Staphylococcus
IPGRHNDDTPTI

SEQ ID NO: 1951534 - protein, 12 aa, Staphylococcus
IPGSDGEVESVD

SEQ ID NO: 1951535 - protein, 16 aa, Staphylococcus
IPGSLGGQGVGTNPDE

SEQ ID NO: 1951536 - protein, 11 aa, Staphylococcus
IPGSTGAVNSV

SEQ ID NO: 1951537 - protein, 13 aa, Staphylococcus
IPGSTSAVDSISE

SEQ ID NO: 1951538 - protein, 11 aa, Staphylococcus
IPGTDGPIEDY

SEQ ID NO: 1951539 - protein, 11 aa, Staphylococcus
IPGTDGPIESF

SEQ ID NO: 1951540 - protein, 22 aa, Staphylococcus
IPGTDGPIESYEAAQSFANEAG

SEQ ID NO: 1951541 - protein, 5 aa, Staphylococcus
IPGTI

SEQ ID NO: 1951542 - protein, 13 aa, Staphylococcus
IPGTIDNDINGSD

SEQ ID NO: 1951543 - protein, 22 aa, Staphylococcus
IPGTPPDLLNPPKGDAFSRRSD

SEQ ID NO: 1951544 - protein, 12 aa, Staphylococcus
IPGYSGAKAAIS

SEQ ID NO: 1951545 - protein, 6 aa, Staphylococcus
IPHQQN

SEQ ID NO: 1951546 - protein, 4 aa, Staphylococcus
IPKA

SEQ ID NO: 1951547 - protein, 6 aa, Staphylococcus
IPKAEM

SEQ ID NO: 1951548 - protein, 9 aa, Staphylococcus
IPKANSRDS

SEQ ID NO: 1951549 - protein, 11 aa, Staphylococcus
IPKDASKEQME

SEQ ID NO: 1951550 - protein, 12 aa, Staphylococcus
IPKDDANGDYST

SEQ ID NO: 1951551 - protein, 28 aa, Staphylococcus
IPKDDVKKIRENAKVDVNRAKEIEQETR

SEQ ID NO: 1951552 - protein, 28 aa, Staphylococcus
IPKDDVKKIRQNAKVDVNRAKEIEEQTR

SEQ ID NO: 1951553 - protein, 11 aa, Staphylococcus
IPKDLSKEDMQ

SEQ ID NO: 1951554 - protein, 11 aa, Staphylococcus
IPKDLSKEEMQ

SEQ ID NO: 1951555 - protein, 23 aa, Staphylococcus
IPKDNVENFKDSLDKHGLAKEGN

SEQ ID NO: 1951556 - protein, 12 aa, Staphylococcus
IPKDPKNGDYST

SEQ ID NO: 1951557 - protein, 12 aa, Staphylococcus
IPKDSKNGDYST

SEQ ID NO: 1951558 - protein, 4 aa, Staphylococcus
IPKE

SEQ ID NO: 1951559 - protein, 5 aa, Staphylococcus
IPKED

SEQ ID NO: 1951560 - protein, 5 aa, Staphylococcus
IPKEI

SEQ ID NO: 1951561 - protein, 5 aa, Staphylococcus
IPKEL

SEQ ID NO: 1951562 - protein, 11 aa, Staphylococcus
IPKELSKEEMQ

SEQ ID NO: 1951563 - protein, 12 aa, Staphylococcus
IPKGAVRPSEDE

SEQ ID NO: 1951564 - protein, 12 aa, Staphylococcus
IPKGAVRSQNDD

SEQ ID NO: 1951565 - protein, 5 aa, Staphylococcus
IPKGK

SEQ ID NO: 1951566 - protein, 6 aa, Staphylococcus
IPKGRG

SEQ ID NO: 1951567 - protein, 16 aa, Staphylococcus
IPKGSAGTNSITRPSF

SEQ ID NO: 1951568 - protein, 11 aa, Staphylococcus
IPKGTHGTDEI

SEQ ID NO: 1951569 - protein, 24 aa, Staphylococcus
IPKKAKTRDELQAKRNNYLEDSEV

SEQ ID NO: 1951570 - protein, 9 aa, Staphylococcus
IPKKEARRM

SEQ ID NO: 1951571 - protein, 16 aa, Staphylococcus
IPKLREQAKSTGNQMD

SEQ ID NO: 1951572 - protein, 4 aa, Staphylococcus
IPKN

SEQ ID NO: 1951573 - protein, 8 aa, Staphylococcus
IPKNKNNT

SEQ ID NO: 1951574 - protein, 7 aa, Staphylococcus
IPKPYQD

SEQ ID NO: 1951575 - protein, 4 aa, Staphylococcus
IPKQ

SEQ ID NO: 1951576 - protein, 5 aa, Staphylococcus
IPKSL

SEQ ID NO: 1951577 - protein, 11 aa, Staphylococcus
IPKSVPNDAYE

SEQ ID NO: 1951578 - protein, 6 aa, Staphylococcus
IPKVSQ

SEQ ID NO: 1951579 - protein, 8 aa, Staphylococcus
IPKYPGVS

SEQ ID NO: 1951580 - protein, 4 aa, Staphylococcus
IPLD

SEQ ID NO: 1951581 - protein, 21 aa, Staphylococcus
IPLDTEGNIVSDDVKEQTKQV

SEQ ID NO: 1951582 - protein, 21 aa, Staphylococcus
IPLDTEGNIVSSDVKEQTKQV

SEQ ID NO: 1951583 - protein, 5 aa, Staphylococcus
IPLEE

SEQ ID NO: 1951584 - protein, 5 aa, Staphylococcus
IPLPE

SEQ ID NO: 1951585 - protein, 12 aa, Staphylococcus
IPLPEKKKASYI

SEQ ID NO: 1951586 - protein, 13 aa, Staphylococcus
IPNAHASLQQGAW

SEQ ID NO: 1951587 - protein, 5 aa, Staphylococcus
IPNDG

SEQ ID NO: 1951588 - protein, 5 aa, Staphylococcus
IPNDK

SEQ ID NO: 1951589 - protein, 15 aa, Staphylococcus
IPNDKALPNTEDPFE

SEQ ID NO: 1951590 - protein, 4 aa, Staphylococcus
IPNE

SEQ ID NO: 1951591 - protein, 8 aa, Staphylococcus
IPNEKVPT

SEQ ID NO: 1951592 - protein, 5 aa, Staphylococcus
IPNEQ

SEQ ID NO: 1951593 - protein, 7 aa, Staphylococcus
IPNEQSK

SEQ ID NO: 1951594 - protein, 8 aa, Staphylococcus
IPNEQSKI

SEQ ID NO: 1951595 - protein, 27 aa, Staphylococcus
IPNFGQNNDDEEETPTDEVKTKRSEIK

SEQ ID NO: 1951596 - protein, 12 aa, Staphylococcus
IPNGASLSSSAS

SEQ ID NO: 1951597 - protein, 9 aa, Staphylococcus
IPNGEDETT

SEQ ID NO: 1951598 - protein, 5 aa, Staphylococcus
IPNHN

SEQ ID NO: 1951599 - protein, 5 aa, Staphylococcus
IPNKP

SEQ ID NO: 1951600 - protein, 6 aa, Staphylococcus
IPNNEI

SEQ ID NO: 1951601 - protein, 6 aa, Staphylococcus
IPNNGQ

SEQ ID NO: 1951602 - protein, 13 aa, Staphylococcus
IPNPENKETVNHI

SEQ ID NO: 1951603 - protein, 5 aa, Staphylococcus
IPNQD

SEQ ID NO: 1951604 - protein, 80 aa, Staphylococcus
IPNRDRGQRPSRGKTIQAKPRGNSSDKSKDDKNGKGGRGRTKQKQRKGKNKRQSDQSKGNTKHKPFYKDKNVKNKARKKK

SEQ ID NO: 1951605 - protein, 4 aa, Staphylococcus
IPNT

SEQ ID NO: 1951606 - protein, 11 aa, Staphylococcus
IPNTVGKAMEG

SEQ ID NO: 1951607 - protein, 8 aa, Staphylococcus
IPNTVSKA

SEQ ID NO: 1951608 - protein, 9 aa, Staphylococcus
IPNTVSKAM

SEQ ID NO: 1951609 - protein, 9 aa, Staphylococcus
IPPAPRGIP

SEQ ID NO: 1951610 - protein, 13 aa, Staphylococcus
IPPDIRAKEGITD

SEQ ID NO: 1951611 - protein, 5 aa, Staphylococcus
IPPDN

SEQ ID NO: 1951612 - protein, 4 aa, Staphylococcus
IPPE

SEQ ID NO: 1951613 - protein, 7 aa, Staphylococcus
IPPEGSK

SEQ ID NO: 1951614 - protein, 6 aa, Staphylococcus
IPPEKE

SEQ ID NO: 1951615 - protein, 11 aa, Staphylococcus
IPPEVKTYEGA

SEQ ID NO: 1951616 - protein, 5 aa, Staphylococcus
IPPKL

SEQ ID NO: 1951617 - protein, 12 aa, Staphylococcus
IPPPDGDPEAPL

SEQ ID NO: 1951618 - protein, 6 aa, Staphylococcus
IPPQPF

SEQ ID NO: 1951619 - protein, 8 aa, Staphylococcus
IPPQPQNK

SEQ ID NO: 1951620 - protein, 9 aa, Staphylococcus
IPPQSTTAK

SEQ ID NO: 1951621 - protein, 9 aa, Staphylococcus
IPPQTTTAK

SEQ ID NO: 1951622 - protein, 16 aa, Staphylococcus
IPQAHASLKNKEWNRK

SEQ ID NO: 1951623 - protein, 14 aa, Staphylococcus
IPQAHQSLKAGEWN

SEQ ID NO: 1951624 - protein, 23 aa, Staphylococcus
IPQAHQSLKDGKWDRKTYRGTEL

SEQ ID NO: 1951625 - protein, 14 aa, Staphylococcus
IPQAHQSLRNKEWN

SEQ ID NO: 1951626 - protein, 16 aa, Staphylococcus
IPQAYTSLKNKEWNRK

SEQ ID NO: 1951627 - protein, 8 aa, Staphylococcus
IPQEKQNV

SEQ ID NO: 1951628 - protein, 8 aa, Staphylococcus
IPQEPVER

SEQ ID NO: 1951629 - protein, 21 aa, Staphylococcus
IPQGRKGTNSITKPSFRVPSD

SEQ ID NO: 1951630 - protein, 4 aa, Staphylococcus
IPQN

SEQ ID NO: 1951631 - protein, 11 aa, Staphylococcus
IPQNNNNKYAR

SEQ ID NO: 1951632 - protein, 11 aa, Staphylococcus
IPQNNTNKYAR

SEQ ID NO: 1951633 - protein, 15 aa, Staphylococcus
IPQNNTNKYARGTAV

SEQ ID NO: 1951634 - protein, 13 aa, Staphylococcus
IPQPDPDSERTRK

SEQ ID NO: 1951635 - protein, 15 aa, Staphylococcus
IPQPDPDSERTRKRV

SEQ ID NO: 1951636 - protein, 28 aa, Staphylococcus
IPQPDPDVERQRKRITYEASNADDQNRQ

SEQ ID NO: 1951637 - protein, 7 aa, Staphylococcus
IPQPIAS

SEQ ID NO: 1951638 - protein, 8 aa, Staphylococcus
IPQPTRAE

SEQ ID NO: 1951639 - protein, 12 aa, Staphylococcus
IPQQVSQDSTKQ

SEQ ID NO: 1951640 - protein, 5 aa, Staphylococcus
IPQSD

SEQ ID NO: 1951641 - protein, 10 aa, Staphylococcus
IPRDNQYKEL

SEQ ID NO: 1951642 - protein, 9 aa, Staphylococcus
IPRKPGMTR

SEQ ID NO: 1951643 - protein, 10 aa, Staphylococcus
IPRKYGTDDE

SEQ ID NO: 1951644 - protein, 5 aa, Staphylococcus
IPRNG

SEQ ID NO: 1951645 - protein, 16 aa, Staphylococcus
IPRSKEERAKLKQPRS

SEQ ID NO: 1951646 - protein, 4 aa, Staphylococcus
IPSA

SEQ ID NO: 1951647 - protein, 10 aa, Staphylococcus
IPSDEGLDEY

SEQ ID NO: 1951648 - protein, 6 aa, Staphylococcus
IPSDGT

SEQ ID NO: 1951649 - protein, 10 aa, Staphylococcus
IPSDQTGESW

SEQ ID NO: 1951650 - protein, 4 aa, Staphylococcus
IPSE

SEQ ID NO: 1951651 - protein, 10 aa, Staphylococcus
IPSEDAGKCM

SEQ ID NO: 1951652 - protein, 13 aa, Staphylococcus
IPSEEGKISAKGV

SEQ ID NO: 1951653 - protein, 8 aa, Staphylococcus
IPSEQTGE

SEQ ID NO: 1951654 - protein, 8 aa, Staphylococcus
IPSESTGE

SEQ ID NO: 1951655 - protein, 4 aa, Staphylococcus
IPSG

SEQ ID NO: 1951656 - protein, 12 aa, Staphylococcus
IPSGKANNEMEG

SEQ ID NO: 1951657 - protein, 6 aa, Staphylococcus
IPSGKK

SEQ ID NO: 1951658 - protein, 16 aa, Staphylococcus
IPSGLGGNGTGTNPDE

SEQ ID NO: 1951659 - protein, 5 aa, Staphylococcus
IPSGQ

SEQ ID NO: 1951660 - protein, 5 aa, Staphylococcus
IPSIN

SEQ ID NO: 1951661 - protein, 7 aa, Staphylococcus
IPSKGQI

SEQ ID NO: 1951662 - protein, 7 aa, Staphylococcus
IPSPKLC

SEQ ID NO: 1951663 - protein, 5 aa, Staphylococcus
IPSQE

SEQ ID NO: 1951664 - protein, 11 aa, Staphylococcus
IPSQPEGYTSH

SEQ ID NO: 1951665 - protein, 5 aa, Staphylococcus
IPSRG

SEQ ID NO: 1951666 - protein, 4 aa, Staphylococcus
IPSS

SEQ ID NO: 1951667 - protein, 13 aa, Staphylococcus
IPSSEGKITANGV

SEQ ID NO: 1951668 - protein, 10 aa, Staphylococcus
IPSSGETDID

SEQ ID NO: 1951669 - protein, 10 aa, Staphylococcus
IPSSVKEQAR

SEQ ID NO: 1951670 - protein, 5 aa, Staphylococcus
IPSTL

SEQ ID NO: 1951671 - protein, 8 aa, Staphylococcus
IPSTNTAR

SEQ ID NO: 1951672 - protein, 15 aa, Staphylococcus
IPTAAYKETNNKTDA

SEQ ID NO: 1951673 - protein, 16 aa, Staphylococcus
IPTADYKEIDNKTEAL

SEQ ID NO: 1951674 - protein, 15 aa, Staphylococcus
IPTADYKEVTNRSDA

SEQ ID NO: 1951675 - protein, 15 aa, Staphylococcus
IPTAEYKETNNKTDA

SEQ ID NO: 1951676 - protein, 6 aa, Staphylococcus
IPTAQY

SEQ ID NO: 1951677 - protein, 13 aa, Staphylococcus
IPTDEEKSNYLPS

SEQ ID NO: 1951678 - protein, 17 aa, Staphylococcus
IPTDKNLNASSDEVTEI

SEQ ID NO: 1951679 - protein, 5 aa, Staphylococcus
IPTDN

SEQ ID NO: 1951680 - protein, 11 aa, Staphylococcus
IPTDYSERSAI

SEQ ID NO: 1951681 - protein, 4 aa, Staphylococcus
IPTE

SEQ ID NO: 1951682 - protein, 8 aa, Staphylococcus
IPTEDRES

SEQ ID NO: 1951683 - protein, 28 aa, Staphylococcus
IPTEGNVSVNGESYTANNKKSQISVRKQ

SEQ ID NO: 1951684 - protein, 27 aa, Staphylococcus
IPTEGNVTVNDKTYTAKDKKSQIEVRK

SEQ ID NO: 1951685 - protein, 9 aa, Staphylococcus
IPTEGTVSV

SEQ ID NO: 1951686 - protein, 13 aa, Staphylococcus
IPTESITSIREDQ

SEQ ID NO: 1951687 - protein, 25 aa, Staphylococcus
IPTGDGDPIIGPREQWNDGSNTLTI

SEQ ID NO: 1951688 - protein, 21 aa, Staphylococcus
IPTGNGDVIDGAREQWNDGSN

SEQ ID NO: 1951689 - protein, 7 aa, Staphylococcus
IPTGNGK

SEQ ID NO: 1951690 - protein, 5 aa, Staphylococcus
IPTGS

SEQ ID NO: 1951691 - protein, 7 aa, Staphylococcus
IPTGVPR

SEQ ID NO: 1951692 - protein, 4 aa, Staphylococcus
IPTK

SEQ ID NO: 1951693 - protein, 9 aa, Staphylococcus
IPTKELEDA

SEQ ID NO: 1951694 - protein, 5 aa, Staphylococcus
IPTNE

SEQ ID NO: 1951695 - protein, 8 aa, Staphylococcus
IPTNKAPK

SEQ ID NO: 1951696 - protein, 13 aa, Staphylococcus
IPTNRPVQREDRP

SEQ ID NO: 1951697 - protein, 13 aa, Staphylococcus
IPTPDEKSNYLPS

SEQ ID NO: 1951698 - protein, 9 aa, Staphylococcus
IPTPDEVSN

SEQ ID NO: 1951699 - protein, 6 aa, Staphylococcus
IPTPED

SEQ ID NO: 1951700 - protein, 7 aa, Staphylococcus
IPTPNNI

SEQ ID NO: 1951701 - protein, 6 aa, Staphylococcus
IPTQDI

SEQ ID NO: 1951702 - protein, 6 aa, Staphylococcus
IPTSED

SEQ ID NO: 1951703 - protein, 14 aa, Staphylococcus
IPTSEDWKSLQQQV

SEQ ID NO: 1951704 - protein, 14 aa, Staphylococcus
IPTSEIKNISQDQE

SEQ ID NO: 1951705 - protein, 15 aa, Staphylococcus
IPTSEIKNISQDQNI

SEQ ID NO: 1951706 - protein, 10 aa, Staphylococcus
IPTSESLKDT

SEQ ID NO: 1951707 - protein, 4 aa, Staphylococcus
IPVD

SEQ ID NO: 1951708 - protein, 4 aa, Staphylococcus
IPVE

SEQ ID NO: 1951709 - protein, 11 aa, Staphylococcus
IPVKPSSIEVD

SEQ ID NO: 1951710 - protein, 19 aa, Staphylococcus
IPVSAGLAGGSTDAAATMR

SEQ ID NO: 1951711 - protein, 6 aa, Staphylococcus
IPYEPM

SEQ ID NO: 1951712 - protein, 6 aa, Staphylococcus
IPYGEP

SEQ ID NO: 1951713 - protein, 5 aa, Staphylococcus
IPYSE

SEQ ID NO: 1951714 - protein, 9 aa, Staphylococcus
IPYSSRNPM

SEQ ID NO: 1951715 - protein, 8 aa, Staphylococcus
IPYSSRNS

SEQ ID NO: 1951716 - protein, 7 aa, Staphylococcus
IQAERSH

SEQ ID NO: 1951717 - protein, 6 aa, Staphylococcus
IQAPGY

SEQ ID NO: 1951718 - protein, 5 aa, Staphylococcus
IQAPQ

SEQ ID NO: 1951719 - protein, 14 aa, Staphylococcus
IQASDDTLSRSQVD

SEQ ID NO: 1951720 - protein, 7 aa, Staphylococcus
IQASPDF

SEQ ID NO: 1951721 - protein, 19 aa, Staphylococcus
IQATNDNPYGNSKRQGEGV

SEQ ID NO: 1951722 - protein, 7 aa, Staphylococcus
IQATRDG

SEQ ID NO: 1951723 - protein, 13 aa, Staphylococcus
IQATRNNYEPITQ

SEQ ID NO: 1951724 - protein, 10 aa, Staphylococcus
IQDELKSQGV

SEQ ID NO: 1951725 - protein, 7 aa, Staphylococcus
IQDGSAL

SEQ ID NO: 1951726 - protein, 5 aa, Staphylococcus
IQDNA

SEQ ID NO: 1951727 - protein, 7 aa, Staphylococcus
IQDQAAK

SEQ ID NO: 1951728 - protein, 13 aa, Staphylococcus
IQDRGKAKIGDKT

SEQ ID NO: 1951729 - protein, 9 aa, Staphylococcus
IQDSDNPTL

SEQ ID NO: 1951730 - protein, 10 aa, Staphylococcus
IQDTDSVTPQ

SEQ ID NO: 1951731 - protein, 7 aa, Staphylococcus
IQDTPSY

SEQ ID NO: 1951732 - protein, 4 aa, Staphylococcus
IQEA

SEQ ID NO: 1951733 - protein, 5 aa, Staphylococcus
IQEDA

SEQ ID NO: 1951734 - protein, 8 aa, Staphylococcus
IQEDENSI

SEQ ID NO: 1951735 - protein, 6 aa, Staphylococcus
IQEDTG

SEQ ID NO: 1951736 - protein, 15 aa, Staphylococcus
IQEDTGLSFASKNDG

SEQ ID NO: 1951737 - protein, 15 aa, Staphylococcus
IQEDTGLSFSSKNDG

SEQ ID NO: 1951738 - protein, 15 aa, Staphylococcus
IQEDTGLSYASQNEG

SEQ ID NO: 1951739 - protein, 16 aa, Staphylococcus
IQEEDEKSAREATEKI

SEQ ID NO: 1951740 - protein, 37 aa, Staphylococcus
IQEEDEKSAREATEKLEKMKAEKAKQQDNNESDVSKC

SEQ ID NO: 1951741 - protein, 36 aa, Staphylococcus
IQEEDEQSAREATEKLEKMKAEKAKQQDNNESDVDR

SEQ ID NO: 1951742 - protein, 37 aa, Staphylococcus
IQEEDQQSAKEATEKIEKIKAEKAKQQDNNGSSVEKC

SEQ ID NO: 1951743 - protein, 33 aa, Staphylococcus
IQEENNIIPNNKDISEAIYEDDQDDWIPEEDDE

SEQ ID NO: 1951744 - protein, 9 aa, Staphylococcus
IQEENNKPF

SEQ ID NO: 1951745 - protein, 7 aa, Staphylococcus
IQEGDNV

SEQ ID NO: 1951746 - protein, 6 aa, Staphylococcus
IQEGDT

SEQ ID NO: 1951747 - protein, 9 aa, Staphylococcus
IQEGKEDEI

SEQ ID NO: 1951748 - protein, 10 aa, Staphylococcus
IQEGKPKDSL

SEQ ID NO: 1951749 - protein, 8 aa, Staphylococcus
IQELDDEG

SEQ ID NO: 1951750 - protein, 37 aa, Staphylococcus
IQENEHEYGTEIREKYGDKTVDESNAKFKDMTEAEYN

SEQ ID NO: 1951751 - protein, 12 aa, Staphylococcus
IQENETKKTRLD

SEQ ID NO: 1951752 - protein, 10 aa, Staphylococcus
IQENKDKTSI

SEQ ID NO: 1951753 - protein, 11 aa, Staphylococcus
IQERGENPSDY

SEQ ID NO: 1951754 - protein, 6 aa, Staphylococcus
IQESPD

SEQ ID NO: 1951755 - protein, 7 aa, Staphylococcus
IQETGRT

SEQ ID NO: 1951756 - protein, 10 aa, Staphylococcus
IQETRPLSAT

SEQ ID NO: 1951757 - protein, 14 aa, Staphylococcus
IQFSDGSTATMTTG

SEQ ID NO: 1951758 - protein, 19 aa, Staphylococcus
IQGASDSPLTDLGKQQAAL

SEQ ID NO: 1951759 - protein, 4 aa, Staphylococcus
IQGD

SEQ ID NO: 1951760 - protein, 7 aa, Staphylococcus
IQGDGGL

SEQ ID NO: 1951761 - protein, 13 aa, Staphylococcus
IQGEAGINIPPEG

SEQ ID NO: 1951762 - protein, 6 aa, Staphylococcus
IQGEDA

SEQ ID NO: 1951763 - protein, 7 aa, Staphylococcus
IQGEDAR

SEQ ID NO: 1951764 - protein, 10 aa, Staphylococcus
IQGEGGVNIP

SEQ ID NO: 1951765 - protein, 4 aa, Staphylococcus
IQGH

SEQ ID NO: 1951766 - protein, 7 aa, Staphylococcus
IQGNDAK

SEQ ID NO: 1951767 - protein, 6 aa, Staphylococcus
IQGPKA

SEQ ID NO: 1951768 - protein, 9 aa, Staphylococcus
IQGPKARDL

SEQ ID NO: 1951769 - protein, 8 aa, Staphylococcus
IQGPQART

SEQ ID NO: 1951770 - protein, 4 aa, Staphylococcus
IQGQ

SEQ ID NO: 1951771 - protein, 4 aa, Staphylococcus
IQGS

SEQ ID NO: 1951772 - protein, 5 aa, Staphylococcus
IQGSS

SEQ ID NO: 1951773 - protein, 6 aa, Staphylococcus
IQGSTV

SEQ ID NO: 1951774 - protein, 5 aa, Staphylococcus
IQGSV

SEQ ID NO: 1951775 - protein, 5 aa, Staphylococcus
IQGTG

SEQ ID NO: 1951776 - protein, 17 aa, Staphylococcus
IQHESTPRVQTKSQEFN

SEQ ID NO: 1951777 - protein, 4 aa, Staphylococcus
IQKA

SEQ ID NO: 1951778 - protein, 23 aa, Staphylococcus
IQKANQSKDNKDGAFTKDFSTTK

SEQ ID NO: 1951779 - protein, 25 aa, Staphylococcus
IQKDPKHKSYYEKNYKKLDKDIANI

SEQ ID NO: 1951780 - protein, 5 aa, Staphylococcus
IQKGY

SEQ ID NO: 1951781 - protein, 7 aa, Staphylococcus
IQKISKR

SEQ ID NO: 1951782 - protein, 6 aa, Staphylococcus
IQKITK

SEQ ID NO: 1951783 - protein, 9 aa, Staphylococcus
IQKKDDFER

SEQ ID NO: 1951784 - protein, 24 aa, Staphylococcus
IQKRDDLEKQLNQKLTSKLEQQQH

SEQ ID NO: 1951785 - protein, 7 aa, Staphylococcus
IQKRNPE

SEQ ID NO: 1951786 - protein, 14 aa, Staphylococcus
IQKSEMEQNYKEVT

SEQ ID NO: 1951787 - protein, 12 aa, Staphylococcus
IQKTTQASVGDL

SEQ ID NO: 1951788 - protein, 12 aa, Staphylococcus
IQLEDGKTHPAE

SEQ ID NO: 1951789 - protein, 9 aa, Staphylococcus
IQLGGTGQT

SEQ ID NO: 1951790 - protein, 11 aa, Staphylococcus
IQMASDQAAEI

SEQ ID NO: 1951791 - protein, 7 aa, Staphylococcus
IQNDGEV

SEQ ID NO: 1951792 - protein, 20 aa, Staphylococcus
IQNDPTFKQEVENLEKEIRN

SEQ ID NO: 1951793 - protein, 10 aa, Staphylococcus
IQNEDKVPYY

SEQ ID NO: 1951794 - protein, 16 aa, Staphylococcus
IQNETYKQYDKNYQQF

SEQ ID NO: 1951795 - protein, 10 aa, Staphylococcus
IQNINSSKRL

SEQ ID NO: 1951796 - protein, 33 aa, Staphylococcus
IQNKDTKNNSIKKNNYKNNREKKNSSSYDTTTA

SEQ ID NO: 1951797 - protein, 6 aa, Staphylococcus
IQNNPR

SEQ ID NO: 1951798 - protein, 6 aa, Staphylococcus
IQNPEY

SEQ ID NO: 1951799 - protein, 4 aa, Staphylococcus
IQNQ

SEQ ID NO: 1951800 - protein, 24 aa, Staphylococcus
IQNRKKGGANNASQESANEPEQQE

SEQ ID NO: 1951801 - protein, 4 aa, Staphylococcus
IQNS

SEQ ID NO: 1951802 - protein, 6 aa, Staphylococcus
IQNSEK

SEQ ID NO: 1951803 - protein, 10 aa, Staphylococcus
IQNSSNGTPR

SEQ ID NO: 1951804 - protein, 16 aa, Staphylococcus
IQNTKQQQIWDLIANY

SEQ ID NO: 1951805 - protein, 8 aa, Staphylococcus
IQNYESNR

SEQ ID NO: 1951806 - protein, 20 aa, Staphylococcus
IQPAEAHERGASNAKFRDHG

SEQ ID NO: 1951807 - protein, 4 aa, Staphylococcus
IQPD

SEQ ID NO: 1951808 - protein, 12 aa, Staphylococcus
IQPDAPTEGYVS

SEQ ID NO: 1951809 - protein, 6 aa, Staphylococcus
IQPEHR

SEQ ID NO: 1951810 - protein, 6 aa, Staphylococcus
IQPELT

SEQ ID NO: 1951811 - protein, 5 aa, Staphylococcus
IQPGS

SEQ ID NO: 1951812 - protein, 10 aa, Staphylococcus
IQPGTRATQI

SEQ ID NO: 1951813 - protein, 10 aa, Staphylococcus
IQPGTRGRSV

SEQ ID NO: 1951814 - protein, 7 aa, Staphylococcus
IQPHGGT

SEQ ID NO: 1951815 - protein, 9 aa, Staphylococcus
IQPKGAPAY

SEQ ID NO: 1951816 - protein, 8 aa, Staphylococcus
IQPKNKDN

SEQ ID NO: 1951817 - protein, 5 aa, Staphylococcus
IQPKT

SEQ ID NO: 1951818 - protein, 18 aa, Staphylococcus
IQPLPNDKDSIIKYIKGA

SEQ ID NO: 1951819 - protein, 18 aa, Staphylococcus
IQPLPNDKESIIKYIKGA

SEQ ID NO: 1951820 - protein, 19 aa, Staphylococcus
IQPLPNDKRSIIEYIKGVL

SEQ ID NO: 1951821 - protein, 18 aa, Staphylococcus
IQPLPNDKSSIIDYIKGA

SEQ ID NO: 1951822 - protein, 18 aa, Staphylococcus
IQPLPNNKESIINYIKGT

SEQ ID NO: 1951823 - protein, 5 aa, Staphylococcus
IQPNG

SEQ ID NO: 1951824 - protein, 9 aa, Staphylococcus
IQPNKMQKE

SEQ ID NO: 1951825 - protein, 10 aa, Staphylococcus
IQPPADKYGE

SEQ ID NO: 1951826 - protein, 9 aa, Staphylococcus
IQPPSRKNE

SEQ ID NO: 1951827 - protein, 4 aa, Staphylococcus
IQPQ

SEQ ID NO: 1951828 - protein, 8 aa, Staphylococcus
IQPSANSN

SEQ ID NO: 1951829 - protein, 11 aa, Staphylococcus
IQPSDQRLKSD

SEQ ID NO: 1951830 - protein, 9 aa, Staphylococcus
IQPSKGSVI

SEQ ID NO: 1951831 - protein, 5 aa, Staphylococcus
IQPSN

SEQ ID NO: 1951832 - protein, 10 aa, Staphylococcus
IQPSTRGTKV

SEQ ID NO: 1951833 - protein, 4 aa, Staphylococcus
IQPT

SEQ ID NO: 1951834 - protein, 5 aa, Staphylococcus
IQPYS

SEQ ID NO: 1951835 - protein, 4 aa, Staphylococcus
IQQD

SEQ ID NO: 1951836 - protein, 21 aa, Staphylococcus
IQQDGRQKRQAAEKELNGLEN

SEQ ID NO: 1951837 - protein, 36 aa, Staphylococcus
IQQEDEQSAREATEKLEKMKAEKAKQQDNNESTVSK

SEQ ID NO: 1951838 - protein, 5 aa, Staphylococcus
IQQEN

SEQ ID NO: 1951839 - protein, 13 aa, Staphylococcus
IQQFGTPNDIYDE

SEQ ID NO: 1951840 - protein, 19 aa, Staphylococcus
IQQGAPESLYYNPQSKKVA

SEQ ID NO: 1951841 - protein, 6 aa, Staphylococcus
IQQGRI

SEQ ID NO: 1951842 - protein, 5 aa, Staphylococcus
IQQLQ

SEQ ID NO: 1951843 - protein, 6 aa, Staphylococcus
IQQNAS

SEQ ID NO: 1951844 - protein, 4 aa, Staphylococcus
IQQP

SEQ ID NO: 1951845 - protein, 8 aa, Staphylococcus
IQQPADDE

SEQ ID NO: 1951846 - protein, 7 aa, Staphylococcus
IQQPTTM

SEQ ID NO: 1951847 - protein, 22 aa, Staphylococcus
IQQQGRQKRQQAEKELNQLETE

SEQ ID NO: 1951848 - protein, 12 aa, Staphylococcus
IQQQHSSDSIDA

SEQ ID NO: 1951849 - protein, 40 aa, Staphylococcus
IQQRKNHNGEQHETQDESSQQTKTREQSQPTDVAQKARDL

SEQ ID NO: 1951850 - protein, 8 aa, Staphylococcus
IQQRLNKK

SEQ ID NO: 1951851 - protein, 5 aa, Staphylococcus
IQQTL

SEQ ID NO: 1951852 - protein, 5 aa, Staphylococcus
IQREG

SEQ ID NO: 1951853 - protein, 10 aa, Staphylococcus
IQRKDDLERQ

SEQ ID NO: 1951854 - protein, 6 aa, Staphylococcus
IQRPPE

SEQ ID NO: 1951855 - protein, 7 aa, Staphylococcus
IQRPTSM

SEQ ID NO: 1951856 - protein, 37 aa, Staphylococcus
IQRQQQEREYDKDIQPKRPTSNRDEPAQRDTGVTQSD

SEQ ID NO: 1951857 - protein, 36 aa, Staphylococcus
IQRQQQGREDDKDIQPKRPTSNRDEPAQRDTGVTQS

SEQ ID NO: 1951858 - protein, 9 aa, Staphylococcus
IQRRDDLEK

SEQ ID NO: 1951859 - protein, 8 aa, Staphylococcus
IQRSDNQN

SEQ ID NO: 1951860 - protein, 12 aa, Staphylococcus
IQRSEEDNYSQV

SEQ ID NO: 1951861 - protein, 8 aa, Staphylococcus
IQRSENEQ

SEQ ID NO: 1951862 - protein, 9 aa, Staphylococcus
IQRVSGDNE

SEQ ID NO: 1951863 - protein, 10 aa, Staphylococcus
IQSADTDAIQ

SEQ ID NO: 1951864 - protein, 10 aa, Staphylococcus
IQSANVNESW

SEQ ID NO: 1951865 - protein, 8 aa, Staphylococcus
IQSDDDAV

SEQ ID NO: 1951866 - protein, 7 aa, Staphylococcus
IQSGKAL

SEQ ID NO: 1951867 - protein, 8 aa, Staphylococcus
IQSGKALD

SEQ ID NO: 1951868 - protein, 9 aa, Staphylococcus
IQSGRNDLA

SEQ ID NO: 1951869 - protein, 9 aa, Staphylococcus
IQSGRNDLT

SEQ ID NO: 1951870 - protein, 15 aa, Staphylococcus
IQSKDGKISQDDMNK

SEQ ID NO: 1951871 - protein, 9 aa, Staphylococcus
IQSKDSPYR

SEQ ID NO: 1951872 - protein, 8 aa, Staphylococcus
IQSKEGKY

SEQ ID NO: 1951873 - protein, 10 aa, Staphylococcus
IQSKKDNNLH

SEQ ID NO: 1951874 - protein, 10 aa, Staphylococcus
IQSNPNSGGY

SEQ ID NO: 1951875 - protein, 5 aa, Staphylococcus
IQSNT

SEQ ID NO: 1951876 - protein, 5 aa, Staphylococcus
IQSPD

SEQ ID NO: 1951877 - protein, 5 aa, Staphylococcus
IQSPE

SEQ ID NO: 1951878 - protein, 6 aa, Staphylococcus
IQSQGA

SEQ ID NO: 1951879 - protein, 7 aa, Staphylococcus
IQSQHPK

SEQ ID NO: 1951880 - protein, 8 aa, Staphylococcus
IQSQVKED

SEQ ID NO: 1951881 - protein, 9 aa, Staphylococcus
IQSRDEKGK

SEQ ID NO: 1951882 - protein, 6 aa, Staphylococcus
IQSRKA

SEQ ID NO: 1951883 - protein, 6 aa, Staphylococcus
IQSSAI

SEQ ID NO: 1951884 - protein, 9 aa, Staphylococcus
IQSSNPEQY

SEQ ID NO: 1951885 - protein, 13 aa, Staphylococcus
IQSSSKSMNLPNK

SEQ ID NO: 1951886 - protein, 7 aa, Staphylococcus
IQSTDEV

SEQ ID NO: 1951887 - protein, 8 aa, Staphylococcus
IQSTDLET

SEQ ID NO: 1951888 - protein, 10 aa, Staphylococcus
IQSTDQTLEE

SEQ ID NO: 1951889 - protein, 11 aa, Staphylococcus
IQSTDSGQHWE

SEQ ID NO: 1951890 - protein, 5 aa, Staphylococcus
IQSTE

SEQ ID NO: 1951891 - protein, 13 aa, Staphylococcus
IQSTSQKGFEQSR

SEQ ID NO: 1951892 - protein, 5 aa, Staphylococcus
IQSYQ

SEQ ID NO: 1951893 - protein, 23 aa, Staphylococcus
IQTATPDADLTTISNETILEMQE

SEQ ID NO: 1951894 - protein, 4 aa, Staphylococcus
IQTE

SEQ ID NO: 1951895 - protein, 9 aa, Staphylococcus
IQTEGQPAV

SEQ ID NO: 1951896 - protein, 23 aa, Staphylococcus
IQTEKAGKKVEMKKTEDYEVPEE

SEQ ID NO: 1951897 - protein, 5 aa, Staphylococcus
IQTEN

SEQ ID NO: 1951898 - protein, 9 aa, Staphylococcus
IQTHQQATE

SEQ ID NO: 1951899 - protein, 8 aa, Staphylococcus
IQTKNNYL

SEQ ID NO: 1951900 - protein, 4 aa, Staphylococcus
IQTN

SEQ ID NO: 1951901 - protein, 9 aa, Staphylococcus
IQTNTYGAN

SEQ ID NO: 1951902 - protein, 11 aa, Staphylococcus
IQTPKSKKITI

SEQ ID NO: 1951903 - protein, 8 aa, Staphylococcus
IQTPTHKT

SEQ ID NO: 1951904 - protein, 7 aa, Staphylococcus
IQTQRDA

SEQ ID NO: 1951905 - protein, 5 aa, Staphylococcus
IQTQS

SEQ ID NO: 1951906 - protein, 8 aa, Staphylococcus
IQTRENDG

SEQ ID NO: 1951907 - protein, 15 aa, Staphylococcus
IQTSDERVLPNGTGY

SEQ ID NO: 1951908 - protein, 15 aa, Staphylococcus
IQTSDNRILPNGTGY

SEQ ID NO: 1951909 - protein, 15 aa, Staphylococcus
IQTSDNRVLPNGTGY

SEQ ID NO: 1951910 - protein, 6 aa, Staphylococcus
IQTTDS

SEQ ID NO: 1951911 - protein, 7 aa, Staphylococcus
IQTTMNR

SEQ ID NO: 1951912 - protein, 10 aa, Staphylococcus
IQTTTSTYLG

SEQ ID NO: 1951913 - protein, 9 aa, Staphylococcus
IQTYQQATE

SEQ ID NO: 1951914 - protein, 8 aa, Staphylococcus
IQVDSDYQ

SEQ ID NO: 1951915 - protein, 11 aa, Staphylococcus
IQYNVSNDKNI

SEQ ID NO: 1951916 - protein, 10 aa, Staphylococcus
IRAEDGRSVE

SEQ ID NO: 1951917 - protein, 7 aa, Staphylococcus
IRANTKE

SEQ ID NO: 1951918 - protein, 8 aa, Staphylococcus
IRANTKED

SEQ ID NO: 1951919 - protein, 11 aa, Staphylococcus
IRANTKEDIEA

SEQ ID NO: 1951920 - protein, 8 aa, Staphylococcus
IRDAENKI

SEQ ID NO: 1951921 - protein, 6 aa, Staphylococcus
IRDELA

SEQ ID NO: 1951922 - protein, 20 aa, Staphylococcus
IRDENTNESYYDRSSNTLDG

SEQ ID NO: 1951923 - protein, 6 aa, Staphylococcus
IRDGAN

SEQ ID NO: 1951924 - protein, 12 aa, Staphylococcus
IRDGENEAFREK

SEQ ID NO: 1951925 - protein, 14 aa, Staphylococcus
IRDGKARVSVGARS

SEQ ID NO: 1951926 - protein, 10 aa, Staphylococcus
IRDKNDVPET

SEQ ID NO: 1951927 - protein, 10 aa, Staphylococcus
IRDKNDVPGT

SEQ ID NO: 1951928 - protein, 10 aa, Staphylococcus
IRDKNDVTET

SEQ ID NO: 1951929 - protein, 5 aa, Staphylococcus
IRDKR

SEQ ID NO: 1951930 - protein, 12 aa, Staphylococcus
IRDNQGDAFREK

SEQ ID NO: 1951931 - protein, 27 aa, Staphylococcus
IRDSYKEQLEGMKKKAEEFREGGNTIY

SEQ ID NO: 1951932 - protein, 4 aa, Staphylococcus
IRDV

SEQ ID NO: 1951933 - protein, 5 aa, Staphylococcus
IREAS

SEQ ID NO: 1951934 - protein, 7 aa, Staphylococcus
IREATTN

SEQ ID NO: 1951935 - protein, 8 aa, Staphylococcus
IREENDDQ

SEQ ID NO: 1951936 - protein, 10 aa, Staphylococcus
IREENRPDKQ

SEQ ID NO: 1951937 - protein, 6 aa, Staphylococcus
IREEVN

SEQ ID NO: 1951938 - protein, 5 aa, Staphylococcus
IREND

SEQ ID NO: 1951939 - protein, 6 aa, Staphylococcus
IRENND

SEQ ID NO: 1951940 - protein, 14 aa, Staphylococcus
IREPEADSPIKDGP

SEQ ID NO: 1951941 - protein, 14 aa, Staphylococcus
IREPEADSPVNDGP

SEQ ID NO: 1951942 - protein, 14 aa, Staphylococcus
IREPEANSPVQNGP

SEQ ID NO: 1951943 - protein, 14 aa, Staphylococcus
IREPEEDSPVNNGP

SEQ ID NO: 1951944 - protein, 14 aa, Staphylococcus
IREPEEGSALKNGP

SEQ ID NO: 1951945 - protein, 5 aa, Staphylococcus
IREQA

SEQ ID NO: 1951946 - protein, 8 aa, Staphylococcus
IREQASET

SEQ ID NO: 1951947 - protein, 4 aa, Staphylococcus
IRER

SEQ ID NO: 1951948 - protein, 6 aa, Staphylococcus
IRERTQ

SEQ ID NO: 1951949 - protein, 10 aa, Staphylococcus
IRESETDKVA

SEQ ID NO: 1951950 - protein, 8 aa, Staphylococcus
IRETEKYG

SEQ ID NO: 1951951 - protein, 12 aa, Staphylococcus
IRGDLTEKAENH

SEQ ID NO: 1951952 - protein, 5 aa, Staphylococcus
IRGER

SEQ ID NO: 1951953 - protein, 5 aa, Staphylococcus
IRGKG

SEQ ID NO: 1951954 - protein, 17 aa, Staphylococcus
IRGKGGGYRANAHTPTI

SEQ ID NO: 1951955 - protein, 19 aa, Staphylococcus
IRGNAKDAINPKKNKLPEG

SEQ ID NO: 1951956 - protein, 7 aa, Staphylococcus
IRGSREE

SEQ ID NO: 1951957 - protein, 12 aa, Staphylococcus
IRGTDENYSPGT

SEQ ID NO: 1951958 - protein, 5 aa, Staphylococcus
IRHQQ

SEQ ID NO: 1951959 - protein, 12 aa, Staphylococcus
IRHTNTGQDIQE

SEQ ID NO: 1951960 - protein, 5 aa, Staphylococcus
IRHTS

SEQ ID NO: 1951961 - protein, 7 aa, Staphylococcus
IRKATTD

SEQ ID NO: 1951962 - protein, 22 aa, Staphylococcus
IRKDGNKEYEKKEPIRRKTDGF

SEQ ID NO: 1951963 - protein, 6 aa, Staphylococcus
IRKDTG

SEQ ID NO: 1951964 - protein, 7 aa, Staphylococcus
IRKETIA

SEQ ID NO: 1951965 - protein, 9 aa, Staphylococcus
IRKGQDPKI

SEQ ID NO: 1951966 - protein, 6 aa, Staphylococcus
IRKHDP

SEQ ID NO: 1951967 - protein, 9 aa, Staphylococcus
IRKNENKST

SEQ ID NO: 1951968 - protein, 5 aa, Staphylococcus
IRKRN

SEQ ID NO: 1951969 - protein, 5 aa, Staphylococcus
IRKSG

SEQ ID NO: 1951970 - protein, 10 aa, Staphylococcus
IRKTENKTQA

SEQ ID NO: 1951971 - protein, 12 aa, Staphylococcus
IRMSSDQAATLV

SEQ ID NO: 1951972 - protein, 6 aa, Staphylococcus
IRNDSA

SEQ ID NO: 1951973 - protein, 5 aa, Staphylococcus
IRNHR

SEQ ID NO: 1951974 - protein, 10 aa, Staphylococcus
IRNNEPEAFR

SEQ ID NO: 1951975 - protein, 5 aa, Staphylococcus
IRNNG

SEQ ID NO: 1951976 - protein, 9 aa, Staphylococcus
IRNNKSANI

SEQ ID NO: 1951977 - protein, 8 aa, Staphylococcus
IRNQQKEN

SEQ ID NO: 1951978 - protein, 7 aa, Staphylococcus
IRNSGKV

SEQ ID NO: 1951979 - protein, 10 aa, Staphylococcus
IRNTKESGYR

SEQ ID NO: 1951980 - protein, 6 aa, Staphylococcus
IRPGEK

SEQ ID NO: 1951981 - protein, 6 aa, Staphylococcus
IRPHGG

SEQ ID NO: 1951982 - protein, 7 aa, Staphylococcus
IRPKNKR

SEQ ID NO: 1951983 - protein, 20 aa, Staphylococcus
IRPKQSELGKLERANAPNPF

SEQ ID NO: 1951984 - protein, 15 aa, Staphylococcus
IRPLGDPDNISPSTV

SEQ ID NO: 1951985 - protein, 8 aa, Staphylococcus
IRPNPNMG

SEQ ID NO: 1951986 - protein, 5 aa, Staphylococcus
IRPSI

SEQ ID NO: 1951987 - protein, 6 aa, Staphylococcus
IRPTVR

SEQ ID NO: 1951988 - protein, 24 aa, Staphylococcus
IRQNGNEPKAYSYLKGEKEDYWFL

SEQ ID NO: 1951989 - protein, 9 aa, Staphylococcus
IRQNNNKEL

SEQ ID NO: 1951990 - protein, 11 aa, Staphylococcus
IRQSENKDDIV

SEQ ID NO: 1951991 - protein, 10 aa, Staphylococcus
IRQSKNKNAI

SEQ ID NO: 1951992 - protein, 11 aa, Staphylococcus
IRQSKNNDEIV

SEQ ID NO: 1951993 - protein, 10 aa, Staphylococcus
IRQSKNRDDI

SEQ ID NO: 1951994 - protein, 18 aa, Staphylococcus
IRQSKNRDDILKQTKKKL

SEQ ID NO: 1951995 - protein, 10 aa, Staphylococcus
IRQSNNQQDI

SEQ ID NO: 1951996 - protein, 10 aa, Staphylococcus
IRQSTNRDKI

SEQ ID NO: 1951997 - protein, 16 aa, Staphylococcus
IRQTKQVGVGPQQREF

SEQ ID NO: 1951998 - protein, 12 aa, Staphylococcus
IRRAYETGRGSI

SEQ ID NO: 1951999 - protein, 10 aa, Staphylococcus
IRRDPTKPRA

SEQ ID NO: 1952000 - protein, 10 aa, Staphylococcus
IRREQGADID

SEQ ID NO: 1952001 - protein, 12 aa, Staphylococcus
IRSDLTEKAENH

SEQ ID NO: 1952002 - protein, 11 aa, Staphylococcus
IRSDLTNKAEH

SEQ ID NO: 1952003 - protein, 5 aa, Staphylococcus
IRSGE

SEQ ID NO: 1952004 - protein, 17 aa, Staphylococcus
IRSKSEPMQNSLKSILA

SEQ ID NO: 1952005 - protein, 10 aa, Staphylococcus
IRSNKTTVAL

SEQ ID NO: 1952006 - protein, 4 aa, Staphylococcus
IRSQ

SEQ ID NO: 1952007 - protein, 19 aa, Staphylococcus
IRSSEEKCNDLAPEDKTEL

SEQ ID NO: 1952008 - protein, 13 aa, Staphylococcus
IRTDDTKEDLEER

SEQ ID NO: 1952009 - protein, 6 aa, Staphylococcus
IRTHGD

SEQ ID NO: 1952010 - protein, 10 aa, Staphylococcus
IRTKGTKGLT

SEQ ID NO: 1952011 - protein, 8 aa, Staphylococcus
IRTKKGQQ

SEQ ID NO: 1952012 - protein, 8 aa, Staphylococcus
IRTKNGQP

SEQ ID NO: 1952013 - protein, 7 aa, Staphylococcus
IRTKTGQ

SEQ ID NO: 1952014 - protein, 10 aa, Staphylococcus
IRTPKDIDTL

SEQ ID NO: 1952015 - protein, 10 aa, Staphylococcus
IRTPKDIETL

SEQ ID NO: 1952016 - protein, 7 aa, Staphylococcus
IRTPKEI

SEQ ID NO: 1952017 - protein, 7 aa, Staphylococcus
IRTPQDI

SEQ ID NO: 1952018 - protein, 8 aa, Staphylococcus
IRTPQDID

SEQ ID NO: 1952019 - protein, 11 aa, Staphylococcus
IRTSDKGPEIY

SEQ ID NO: 1952020 - protein, 11 aa, Staphylococcus
IRTTDKGPEVF

SEQ ID NO: 1952021 - protein, 22 aa, Staphylococcus
IRVEQRDKEHDDYYEIKIKIYK

SEQ ID NO: 1952022 - protein, 5 aa, Staphylococcus
IRVGS

SEQ ID NO: 1952023 - protein, 10 aa, Staphylococcus
IRVTSPEELE

SEQ ID NO: 1952024 - protein, 5 aa, Staphylococcus
ISAAE

SEQ ID NO: 1952025 - protein, 9 aa, Staphylococcus
ISADDYRNY

SEQ ID NO: 1952026 - protein, 8 aa, Staphylococcus
ISADDYRR

SEQ ID NO: 1952027 - protein, 16 aa, Staphylococcus
ISAEDGKEKVKPQPIV

SEQ ID NO: 1952028 - protein, 8 aa, Staphylococcus
ISAEHSET

SEQ ID NO: 1952029 - protein, 8 aa, Staphylococcus
ISAENDEG

SEQ ID NO: 1952030 - protein, 8 aa, Staphylococcus
ISAESARE

SEQ ID NO: 1952031 - protein, 11 aa, Staphylococcus
ISAGTYSDCKD

SEQ ID NO: 1952032 - protein, 9 aa, Staphylococcus
ISAKEDEHV

SEQ ID NO: 1952033 - protein, 9 aa, Staphylococcus
ISAPTDVEK

SEQ ID NO: 1952034 - protein, 6 aa, Staphylococcus
ISAQDQ

SEQ ID NO: 1952035 - protein, 13 aa, Staphylococcus
ISAQENERKRISR

SEQ ID NO: 1952036 - protein, 14 aa, Staphylococcus
ISAQENERKRISRE

SEQ ID NO: 1952037 - protein, 5 aa, Staphylococcus
ISAQG

SEQ ID NO: 1952038 - protein, 8 aa, Staphylococcus
ISAQQQSK

SEQ ID NO: 1952039 - protein, 12 aa, Staphylococcus
ISASMAQQTGGY

SEQ ID NO: 1952040 - protein, 12 aa, Staphylococcus
ISDAKRYTLTDE

SEQ ID NO: 1952041 - protein, 9 aa, Staphylococcus
ISDASYEVN

SEQ ID NO: 1952042 - protein, 4 aa, Staphylococcus
ISDD

SEQ ID NO: 1952043 - protein, 8 aa, Staphylococcus
ISDDKEDL

SEQ ID NO: 1952044 - protein, 7 aa, Staphylococcus
ISDDTYN

SEQ ID NO: 1952045 - protein, 11 aa, Staphylococcus
ISDEARENMKR

SEQ ID NO: 1952046 - protein, 5 aa, Staphylococcus
ISDEE

SEQ ID NO: 1952047 - protein, 21 aa, Staphylococcus
ISDEERDNMKRTITKPRPGHA

SEQ ID NO: 1952048 - protein, 8 aa, Staphylococcus
ISDEEREY

SEQ ID NO: 1952049 - protein, 7 aa, Staphylococcus
ISDEEWE

SEQ ID NO: 1952050 - protein, 5 aa, Staphylococcus
ISDEG

SEQ ID NO: 1952051 - protein, 8 aa, Staphylococcus
ISDEGTFK

SEQ ID NO: 1952052 - protein, 9 aa, Staphylococcus
ISDEGTFNE

SEQ ID NO: 1952053 - protein, 9 aa, Staphylococcus
ISDEGTFTE

SEQ ID NO: 1952054 - protein, 9 aa, Staphylococcus
ISDEKDLEN

SEQ ID NO: 1952055 - protein, 10 aa, Staphylococcus
ISDEKYREQA

SEQ ID NO: 1952056 - protein, 7 aa, Staphylococcus
ISDFTNS

SEQ ID NO: 1952057 - protein, 5 aa, Staphylococcus
ISDGA

SEQ ID NO: 1952058 - protein, 8 aa, Staphylococcus
ISDGQNGY

SEQ ID NO: 1952059 - protein, 4 aa, Staphylococcus
ISDI

SEQ ID NO: 1952060 - protein, 8 aa, Staphylococcus
ISDKDGDM

SEQ ID NO: 1952061 - protein, 6 aa, Staphylococcus
ISDKKI

SEQ ID NO: 1952062 - protein, 9 aa, Staphylococcus
ISDKSGKRG

SEQ ID NO: 1952063 - protein, 20 aa, Staphylococcus
ISDKYPSELSGGQRQRTSAA

SEQ ID NO: 1952064 - protein, 17 aa, Staphylococcus
ISDLGREKVDAMTPATE

SEQ ID NO: 1952065 - protein, 8 aa, Staphylococcus
ISDNDQRL

SEQ ID NO: 1952066 - protein, 9 aa, Staphylococcus
ISDNPKYRQ

SEQ ID NO: 1952067 - protein, 9 aa, Staphylococcus
ISDNPKYRS

SEQ ID NO: 1952068 - protein, 6 aa, Staphylococcus
ISDPES

SEQ ID NO: 1952069 - protein, 8 aa, Staphylococcus
ISDQSDRM

SEQ ID NO: 1952070 - protein, 5 aa, Staphylococcus
ISDQT

SEQ ID NO: 1952071 - protein, 5 aa, Staphylococcus
ISDRE

SEQ ID NO: 1952072 - protein, 10 aa, Staphylococcus
ISDSAKNDGV

SEQ ID NO: 1952073 - protein, 10 aa, Staphylococcus
ISDSASRSKV

SEQ ID NO: 1952074 - protein, 6 aa, Staphylococcus
ISDSNN

SEQ ID NO: 1952075 - protein, 9 aa, Staphylococcus
ISDSSDRMG

SEQ ID NO: 1952076 - protein, 8 aa, Staphylococcus
ISDSVAKD

SEQ ID NO: 1952077 - protein, 16 aa, Staphylococcus
ISDTGNEPTLIHKIIT

SEQ ID NO: 1952078 - protein, 8 aa, Staphylococcus
ISDTNITD

SEQ ID NO: 1952079 - protein, 7 aa, Staphylococcus
ISDTQME

SEQ ID NO: 1952080 - protein, 7 aa, Staphylococcus
ISDWKQE

SEQ ID NO: 1952081 - protein, 11 aa, Staphylococcus
ISEADENGNRT

SEQ ID NO: 1952082 - protein, 9 aa, Staphylococcus
ISEADKIDN

SEQ ID NO: 1952083 - protein, 7 aa, Staphylococcus
ISEAQKY

SEQ ID NO: 1952084 - protein, 18 aa, Staphylococcus
ISEDKKGRPQSKEKRYPV

SEQ ID NO: 1952085 - protein, 5 aa, Staphylococcus
ISEDM

SEQ ID NO: 1952086 - protein, 9 aa, Staphylococcus
ISEDSNEIL

SEQ ID NO: 1952087 - protein, 8 aa, Staphylococcus
ISEEDKDK

SEQ ID NO: 1952088 - protein, 9 aa, Staphylococcus
ISEEEKNAI

SEQ ID NO: 1952089 - protein, 11 aa, Staphylococcus
ISEEEQEQMKR

SEQ ID NO: 1952090 - protein, 5 aa, Staphylococcus
ISEEN

SEQ ID NO: 1952091 - protein, 9 aa, Staphylococcus
ISEENDQSK

SEQ ID NO: 1952092 - protein, 6 aa, Staphylococcus
ISEERE

SEQ ID NO: 1952093 - protein, 13 aa, Staphylococcus
ISEETFNDLTKQF

SEQ ID NO: 1952094 - protein, 6 aa, Staphylococcus
ISEGEK

SEQ ID NO: 1952095 - protein, 6 aa, Staphylococcus
ISEGKN

SEQ ID NO: 1952096 - protein, 8 aa, Staphylococcus
ISEGNSAQ

SEQ ID NO: 1952097 - protein, 5 aa, Staphylococcus
ISEGT

SEQ ID NO: 1952098 - protein, 21 aa, Staphylococcus
ISEKNDEEKVNQSHDTSKSSN

SEQ ID NO: 1952099 - protein, 5 aa, Staphylococcus
ISELK

SEQ ID NO: 1952100 - protein, 7 aa, Staphylococcus
ISELNES

SEQ ID NO: 1952101 - protein, 10 aa, Staphylococcus
ISENAKSIAT

SEQ ID NO: 1952102 - protein, 6 aa, Staphylococcus
ISENDE

SEQ ID NO: 1952103 - protein, 7 aa, Staphylococcus
ISENDKD

SEQ ID NO: 1952104 - protein, 13 aa, Staphylococcus
ISENEAKKSRLDS

SEQ ID NO: 1952105 - protein, 7 aa, Staphylococcus
ISENKDS

SEQ ID NO: 1952106 - protein, 6 aa, Staphylococcus
ISENND

SEQ ID NO: 1952107 - protein, 9 aa, Staphylococcus
ISENTGISK

SEQ ID NO: 1952108 - protein, 9 aa, Staphylococcus
ISENTYEKV

SEQ ID NO: 1952109 - protein, 10 aa, Staphylococcus
ISEPDENGNR

SEQ ID NO: 1952110 - protein, 11 aa, Staphylococcus
ISEPDENGNRT

SEQ ID NO: 1952111 - protein, 10 aa, Staphylococcus
ISEPDENGQR

SEQ ID NO: 1952112 - protein, 10 aa, Staphylococcus
ISEPDENGYR

SEQ ID NO: 1952113 - protein, 9 aa, Staphylococcus
ISEPDNPYR

SEQ ID NO: 1952114 - protein, 7 aa, Staphylococcus
ISEQEKI

SEQ ID NO: 1952115 - protein, 8 aa, Staphylococcus
ISEQSDRM

SEQ ID NO: 1952116 - protein, 5 aa, Staphylococcus
ISERE

SEQ ID NO: 1952117 - protein, 6 aa, Staphylococcus
ISESDT

SEQ ID NO: 1952118 - protein, 8 aa, Staphylococcus
ISESGLKE

SEQ ID NO: 1952119 - protein, 10 aa, Staphylococcus
ISESNYRDVK

SEQ ID NO: 1952120 - protein, 6 aa, Staphylococcus
ISESTL

SEQ ID NO: 1952121 - protein, 6 aa, Staphylococcus
ISESTY

SEQ ID NO: 1952122 - protein, 5 aa, Staphylococcus
ISESY

SEQ ID NO: 1952123 - protein, 10 aa, Staphylococcus
ISETAKKIQQ

SEQ ID NO: 1952124 - protein, 6 aa, Staphylococcus
ISETLT

SEQ ID NO: 1952125 - protein, 6 aa, Staphylococcus
ISETRK

SEQ ID NO: 1952126 - protein, 6 aa, Staphylococcus
ISETTQ

SEQ ID NO: 1952127 - protein, 4 aa, Staphylococcus
ISEV

SEQ ID NO: 1952128 - protein, 12 aa, Staphylococcus
ISEVASNVQSTV

SEQ ID NO: 1952129 - protein, 13 aa, Staphylococcus
ISFDSEKGLRGLK

SEQ ID NO: 1952130 - protein, 6 aa, Staphylococcus
ISFGQG

SEQ ID NO: 1952131 - protein, 9 aa, Staphylococcus
ISGAPNDLN

SEQ ID NO: 1952132 - protein, 5 aa, Staphylococcus
ISGDF

SEQ ID NO: 1952133 - protein, 11 aa, Staphylococcus
ISGDSRKKHEN

SEQ ID NO: 1952134 - protein, 4 aa, Staphylococcus
ISGE

SEQ ID NO: 1952135 - protein, 7 aa, Staphylococcus
ISGEDGY

SEQ ID NO: 1952136 - protein, 9 aa, Staphylococcus
ISGEGTYEN

SEQ ID NO: 1952137 - protein, 5 aa, Staphylococcus
ISGEN

SEQ ID NO: 1952138 - protein, 23 aa, Staphylococcus
ISGENPEEQPANFKDKARKFFRG

SEQ ID NO: 1952139 - protein, 11 aa, Staphylococcus
ISGGDVGGSAN

SEQ ID NO: 1952140 - protein, 9 aa, Staphylococcus
ISGGDVNDA

SEQ ID NO: 1952141 - protein, 8 aa, Staphylococcus
ISGGEQQR

SEQ ID NO: 1952142 - protein, 6 aa, Staphylococcus
ISGGGA

SEQ ID NO: 1952143 - protein, 12 aa, Staphylococcus
ISGGKGTAAEKI

SEQ ID NO: 1952144 - protein, 13 aa, Staphylococcus
ISGGKGTAAEKIK

SEQ ID NO: 1952145 - protein, 13 aa, Staphylococcus
ISGGKGTAEEKIK

SEQ ID NO: 1952146 - protein, 10 aa, Staphylococcus
ISGGQDSTLA

SEQ ID NO: 1952147 - protein, 15 aa, Staphylococcus
ISGKLKDAEFTKDST

SEQ ID NO: 1952148 - protein, 16 aa, Staphylococcus
ISGKLKDAEYKKDETF

SEQ ID NO: 1952149 - protein, 11 aa, Staphylococcus
ISGKLKQATFT

SEQ ID NO: 1952150 - protein, 11 aa, Staphylococcus
ISGKNPKNDYE

SEQ ID NO: 1952151 - protein, 8 aa, Staphylococcus
ISGNNLSK

SEQ ID NO: 1952152 - protein, 6 aa, Staphylococcus
ISGNSN

SEQ ID NO: 1952153 - protein, 7 aa, Staphylococcus
ISGPDLS

SEQ ID NO: 1952154 - protein, 11 aa, Staphylococcus
ISGPSLERPGD

SEQ ID NO: 1952155 - protein, 4 aa, Staphylococcus
ISGQ

SEQ ID NO: 1952156 - protein, 8 aa, Staphylococcus
ISGQASEV

SEQ ID NO: 1952157 - protein, 6 aa, Staphylococcus
ISGSND

SEQ ID NO: 1952158 - protein, 14 aa, Staphylococcus
ISGSYQSGKQAGEL

SEQ ID NO: 1952159 - protein, 13 aa, Staphylococcus
ISGTAHTKEMPGG

SEQ ID NO: 1952160 - protein, 9 aa, Staphylococcus
ISGTSSDLR

SEQ ID NO: 1952161 - protein, 23 aa, Staphylococcus
ISGTSSDLRDIQGEAEEGKDRAQ

SEQ ID NO: 1952162 - protein, 23 aa, Staphylococcus
ISGTSSDLRDLEGDAQEGNKRAQ

SEQ ID NO: 1952163 - protein, 23 aa, Staphylococcus
ISGTSSDLRDLEQDAEEGKTRAQ

SEQ ID NO: 1952164 - protein, 23 aa, Staphylococcus
ISGTSSDLRDLESDAEEGKERAQ

SEQ ID NO: 1952165 - protein, 14 aa, Staphylococcus
ISGTYQAATQAGEM

SEQ ID NO: 1952166 - protein, 6 aa, Staphylococcus
ISHDNG

SEQ ID NO: 1952167 - protein, 8 aa, Staphylococcus
ISHDTEDE

SEQ ID NO: 1952168 - protein, 4 aa, Staphylococcus
ISHQ

SEQ ID NO: 1952169 - protein, 15 aa, Staphylococcus
ISHQTSDKITEQDLK

SEQ ID NO: 1952170 - protein, 5 aa, Staphylococcus
ISHSD

SEQ ID NO: 1952171 - protein, 5 aa, Staphylococcus
ISHSG

SEQ ID NO: 1952172 - protein, 17 aa, Staphylococcus
ISHSPKESVEVSEIEKG

SEQ ID NO: 1952173 - protein, 4 aa, Staphylococcus
ISIE

SEQ ID NO: 1952174 - protein, 12 aa, Staphylococcus
ISIKGARSNNLK

SEQ ID NO: 1952175 - protein, 10 aa, Staphylococcus
ISIRNQGKKN

SEQ ID NO: 1952176 - protein, 10 aa, Staphylococcus
ISIRNQKKEN

SEQ ID NO: 1952177 - protein, 7 aa, Staphylococcus
ISISDEE

SEQ ID NO: 1952178 - protein, 9 aa, Staphylococcus
ISISDKEVE

SEQ ID NO: 1952179 - protein, 7 aa, Staphylococcus
ISISGDG

SEQ ID NO: 1952180 - protein, 7 aa, Staphylococcus
ISKAERA

SEQ ID NO: 1952181 - protein, 8 aa, Staphylococcus
ISKAERAD

SEQ ID NO: 1952182 - protein, 11 aa, Staphylococcus
ISKAGLAQEGN

SEQ ID NO: 1952183 - protein, 9 aa, Staphylococcus
ISKARGIDQ

SEQ ID NO: 1952184 - protein, 16 aa, Staphylococcus
ISKARGIDSVKDELGV

SEQ ID NO: 1952185 - protein, 20 aa, Staphylococcus
ISKDAKGINYSTSNTATTNE

SEQ ID NO: 1952186 - protein, 11 aa, Staphylococcus
ISKDATDKQLS

SEQ ID NO: 1952187 - protein, 18 aa, Staphylococcus
ISKDGKKKVYSITEEGEK

SEQ ID NO: 1952188 - protein, 9 aa, Staphylococcus
ISKDGNKKV

SEQ ID NO: 1952189 - protein, 9 aa, Staphylococcus
ISKDTDIRA

SEQ ID NO: 1952190 - protein, 14 aa, Staphylococcus
ISKEDDAKVALGET

SEQ ID NO: 1952191 - protein, 7 aa, Staphylococcus
ISKEERA

SEQ ID NO: 1952192 - protein, 8 aa, Staphylococcus
ISKEERAD

SEQ ID NO: 1952193 - protein, 20 aa, Staphylococcus
ISKENTDTFNVSESQEPEYL

SEQ ID NO: 1952194 - protein, 8 aa, Staphylococcus
ISKEQVGA

SEQ ID NO: 1952195 - protein, 4 aa, Staphylococcus
ISKG

SEQ ID NO: 1952196 - protein, 8 aa, Staphylococcus
ISKGTISI

SEQ ID NO: 1952197 - protein, 10 aa, Staphylococcus
ISKKSETQRI

SEQ ID NO: 1952198 - protein, 8 aa, Staphylococcus
ISKMSQKQ

SEQ ID NO: 1952199 - protein, 6 aa, Staphylococcus
ISKNGV

SEQ ID NO: 1952200 - protein, 10 aa, Staphylococcus
ISKNKLSKKS

SEQ ID NO: 1952201 - protein, 5 aa, Staphylococcus
ISKNT

SEQ ID NO: 1952202 - protein, 7 aa, Staphylococcus
ISKNTHP

SEQ ID NO: 1952203 - protein, 5 aa, Staphylococcus
ISKPE

SEQ ID NO: 1952204 - protein, 6 aa, Staphylococcus
ISKPIT

SEQ ID NO: 1952205 - protein, 10 aa, Staphylococcus
ISKQGSHQTL

SEQ ID NO: 1952206 - protein, 7 aa, Staphylococcus
ISKQSNS

SEQ ID NO: 1952207 - protein, 5 aa, Staphylococcus
ISKQY

SEQ ID NO: 1952208 - protein, 12 aa, Staphylococcus
ISKRELKSTLAN

SEQ ID NO: 1952209 - protein, 11 aa, Staphylococcus
ISKSKNEDAMN

SEQ ID NO: 1952210 - protein, 24 aa, Staphylococcus
ISKSKNEDAMNMSDEDTNDQFDDQ

SEQ ID NO: 1952211 - protein, 12 aa, Staphylococcus
ISKSKNEEAMNM

SEQ ID NO: 1952212 - protein, 23 aa, Staphylococcus
ISKSKNEEAMNMSDEDANEQFEE

SEQ ID NO: 1952213 - protein, 15 aa, Staphylococcus
ISKSYGGKSKGIPYA

SEQ ID NO: 1952214 - protein, 9 aa, Staphylococcus
ISKTANNIQ

SEQ ID NO: 1952215 - protein, 10 aa, Staphylococcus
ISKTSTYNSL

SEQ ID NO: 1952216 - protein, 7 aa, Staphylococcus
ISKVTTS

SEQ ID NO: 1952217 - protein, 6 aa, Staphylococcus
ISLDGE

SEQ ID NO: 1952218 - protein, 7 aa, Staphylococcus
ISLPAGE

SEQ ID NO: 1952219 - protein, 16 aa, Staphylococcus
ISLTKKGWSRTEDEQN

SEQ ID NO: 1952220 - protein, 6 aa, Staphylococcus
ISLTTE

SEQ ID NO: 1952221 - protein, 5 aa, Staphylococcus
ISLYP

SEQ ID NO: 1952222 - protein, 8 aa, Staphylococcus
ISNDIKAD

SEQ ID NO: 1952223 - protein, 11 aa, Staphylococcus
ISNDKKDAYNT

SEQ ID NO: 1952224 - protein, 9 aa, Staphylococcus
ISNDPWETY

SEQ ID NO: 1952225 - protein, 7 aa, Staphylococcus
ISNDYRK

SEQ ID NO: 1952226 - protein, 8 aa, Staphylococcus
ISNEDEEV

SEQ ID NO: 1952227 - protein, 8 aa, Staphylococcus
ISNEDLSN

SEQ ID NO: 1952228 - protein, 9 aa, Staphylococcus
ISNEEMSKK

SEQ ID NO: 1952229 - protein, 6 aa, Staphylococcus
ISNEEW

SEQ ID NO: 1952230 - protein, 9 aa, Staphylococcus
ISNEGLEEE

SEQ ID NO: 1952231 - protein, 5 aa, Staphylococcus
ISNEI

SEQ ID NO: 1952232 - protein, 6 aa, Staphylococcus
ISNEIA

SEQ ID NO: 1952233 - protein, 8 aa, Staphylococcus
ISNEIPAE

SEQ ID NO: 1952234 - protein, 7 aa, Staphylococcus
ISNEQYQ

SEQ ID NO: 1952235 - protein, 10 aa, Staphylococcus
ISNETETRIQ

SEQ ID NO: 1952236 - protein, 9 aa, Staphylococcus
ISNKEKSDI

SEQ ID NO: 1952237 - protein, 9 aa, Staphylococcus
ISNNEKQKI

SEQ ID NO: 1952238 - protein, 11 aa, Staphylococcus
ISNNEKTKINQ

SEQ ID NO: 1952239 - protein, 8 aa, Staphylococcus
ISNNEYRS

SEQ ID NO: 1952240 - protein, 7 aa, Staphylococcus
ISNNGKS

SEQ ID NO: 1952241 - protein, 5 aa, Staphylococcus
ISNNY

SEQ ID NO: 1952242 - protein, 6 aa, Staphylococcus
ISNSAV

SEQ ID NO: 1952243 - protein, 10 aa, Staphylococcus
ISNSGKAKAY

SEQ ID NO: 1952244 - protein, 5 aa, Staphylococcus
ISNSK

SEQ ID NO: 1952245 - protein, 10 aa, Staphylococcus
ISNSKPSDKY

SEQ ID NO: 1952246 - protein, 10 aa, Staphylococcus
ISNSKVVNSS

SEQ ID NO: 1952247 - protein, 9 aa, Staphylococcus
ISNSQINKR

SEQ ID NO: 1952248 - protein, 7 aa, Staphylococcus
ISNSTVN

SEQ ID NO: 1952249 - protein, 6 aa, Staphylococcus
ISNTAR

SEQ ID NO: 1952250 - protein, 6 aa, Staphylococcus
ISNTEN

SEQ ID NO: 1952251 - protein, 6 aa, Staphylococcus
ISNTLT

SEQ ID NO: 1952252 - protein, 14 aa, Staphylococcus
ISNTNINDDIESYR

SEQ ID NO: 1952253 - protein, 6 aa, Staphylococcus
ISNYEE

SEQ ID NO: 1952254 - protein, 13 aa, Staphylococcus
ISNYSAPRDKWLY

SEQ ID NO: 1952255 - protein, 9 aa, Staphylococcus
ISPAAQGIH

SEQ ID NO: 1952256 - protein, 6 aa, Staphylococcus
ISPASS

SEQ ID NO: 1952257 - protein, 4 aa, Staphylococcus
ISPD

SEQ ID NO: 1952258 - protein, 11 aa, Staphylococcus
ISPEAAAGGPI

SEQ ID NO: 1952259 - protein, 11 aa, Staphylococcus
ISPEAASDGPI

SEQ ID NO: 1952260 - protein, 11 aa, Staphylococcus
ISPEAASGGPI

SEQ ID NO: 1952261 - protein, 11 aa, Staphylococcus
ISPEETDEMAN

SEQ ID NO: 1952262 - protein, 11 aa, Staphylococcus
ISPEETEEMAN

SEQ ID NO: 1952263 - protein, 11 aa, Staphylococcus
ISPEETEEMAT

SEQ ID NO: 1952264 - protein, 6 aa, Staphylococcus
ISPEGA

SEQ ID NO: 1952265 - protein, 7 aa, Staphylococcus
ISPEGER

SEQ ID NO: 1952266 - protein, 4 aa, Staphylococcus
ISPG

SEQ ID NO: 1952267 - protein, 5 aa, Staphylococcus
ISPGA

SEQ ID NO: 1952268 - protein, 9 aa, Staphylococcus
ISPGDYEKR

SEQ ID NO: 1952269 - protein, 5 aa, Staphylococcus
ISPGE

SEQ ID NO: 1952270 - protein, 21 aa, Staphylococcus
ISPGGTDGGEIHKANKGVPTA

SEQ ID NO: 1952271 - protein, 7 aa, Staphylococcus
ISPGQYE

SEQ ID NO: 1952272 - protein, 5 aa, Staphylococcus
ISPIS

SEQ ID NO: 1952273 - protein, 12 aa, Staphylococcus
ISPKPPSSGMKP

SEQ ID NO: 1952274 - protein, 14 aa, Staphylococcus
ISPKPPSSKMKPNL

SEQ ID NO: 1952275 - protein, 10 aa, Staphylococcus
ISPKPPSSMM

SEQ ID NO: 1952276 - protein, 10 aa, Staphylococcus
ISPKPPSSNM

SEQ ID NO: 1952277 - protein, 13 aa, Staphylococcus
ISPKPPSSSMTPN

SEQ ID NO: 1952278 - protein, 12 aa, Staphylococcus
ISPKTKEGINKT

SEQ ID NO: 1952279 - protein, 20 aa, Staphylococcus
ISPLKKADDAITLDTTGKSI

SEQ ID NO: 1952280 - protein, 20 aa, Staphylococcus
ISPLKKADDAITVDTTGKSI

SEQ ID NO: 1952281 - protein, 33 aa, Staphylococcus
ISPLKKADDAVTVDTTGKTIEEVTEEIMTLVNN

SEQ ID NO: 1952282 - protein, 34 aa, Staphylococcus
ISPLKKATDAITLDTTGKSIEEVTDEILNLVDKI

SEQ ID NO: 1952283 - protein, 33 aa, Staphylococcus
ISPLRKAEDAITVDTTSKTIEDVTEEILKLVEN

SEQ ID NO: 1952284 - protein, 5 aa, Staphylococcus
ISPSL

SEQ ID NO: 1952285 - protein, 8 aa, Staphylococcus
ISPSTGLK

SEQ ID NO: 1952286 - protein, 12 aa, Staphylococcus
ISPSTISQLPTG

SEQ ID NO: 1952287 - protein, 7 aa, Staphylococcus
ISPTDGE

SEQ ID NO: 1952288 - protein, 6 aa, Staphylococcus
ISPTEG

SEQ ID NO: 1952289 - protein, 7 aa, Staphylococcus
ISPTEGE

SEQ ID NO: 1952290 - protein, 7 aa, Staphylococcus
ISPTERT

SEQ ID NO: 1952291 - protein, 8 aa, Staphylococcus
ISPTIEEK

SEQ ID NO: 1952292 - protein, 7 aa, Staphylococcus
ISPTSGE

SEQ ID NO: 1952293 - protein, 37 aa, Staphylococcus
ISPVSANKNDIQTTSTNHSDSNKQDEANPKEETQQIK

SEQ ID NO: 1952294 - protein, 10 aa, Staphylococcus
ISPVSGGDVN

SEQ ID NO: 1952295 - protein, 11 aa, Staphylococcus
ISPVSGGDVNE

SEQ ID NO: 1952296 - protein, 5 aa, Staphylococcus
ISPYT

SEQ ID NO: 1952297 - protein, 5 aa, Staphylococcus
ISQDD

SEQ ID NO: 1952298 - protein, 9 aa, Staphylococcus
ISQDDKDAI

SEQ ID NO: 1952299 - protein, 5 aa, Staphylococcus
ISQDE

SEQ ID NO: 1952300 - protein, 10 aa, Staphylococcus
ISQDEKDNLV

SEQ ID NO: 1952301 - protein, 7 aa, Staphylococcus
ISQDNQE

SEQ ID NO: 1952302 - protein, 10 aa, Staphylococcus
ISQEDAEKYV

SEQ ID NO: 1952303 - protein, 11 aa, Staphylococcus
ISQETHQSPES

SEQ ID NO: 1952304 - protein, 9 aa, Staphylococcus
ISQETLSKN

SEQ ID NO: 1952305 - protein, 11 aa, Staphylococcus
ISQGGKGEMTH

SEQ ID NO: 1952306 - protein, 12 aa, Staphylococcus
ISQGGKGQLTNK

SEQ ID NO: 1952307 - protein, 6 aa, Staphylococcus
ISQHEA

SEQ ID NO: 1952308 - protein, 17 aa, Staphylococcus
ISQKNNERASRIVHWYT

SEQ ID NO: 1952309 - protein, 12 aa, Staphylococcus
ISQKSDKANYEL

SEQ ID NO: 1952310 - protein, 4 aa, Staphylococcus
ISQN

SEQ ID NO: 1952311 - protein, 10 aa, Staphylococcus
ISQNGRATQG

SEQ ID NO: 1952312 - protein, 10 aa, Staphylococcus
ISQNGRSAQG

SEQ ID NO: 1952313 - protein, 27 aa, Staphylococcus
ISQNPKRHSKENIGLNKPNTDGDKPSW

SEQ ID NO: 1952314 - protein, 4 aa, Staphylococcus
ISQQ

SEQ ID NO: 1952315 - protein, 7 aa, Staphylococcus
ISQQEAE

SEQ ID NO: 1952316 - protein, 11 aa, Staphylococcus
ISQQPEGYTSH

SEQ ID NO: 1952317 - protein, 8 aa, Staphylococcus
ISQQPMQQ

SEQ ID NO: 1952318 - protein, 14 aa, Staphylococcus
ISQQTSIRSYEAQK

SEQ ID NO: 1952319 - protein, 8 aa, Staphylococcus
ISQSAVNE

SEQ ID NO: 1952320 - protein, 12 aa, Staphylococcus
ISQSGLSDTNGF

SEQ ID NO: 1952321 - protein, 10 aa, Staphylococcus
ISQSKETDTV

SEQ ID NO: 1952322 - protein, 8 aa, Staphylococcus
ISQSPNKS

SEQ ID NO: 1952323 - protein, 76 aa, Staphylococcus
ISQSSSQRPARGKTIQAKTRGKALDKSKNDGQRRKKSKKLKQRKGKNARKKEKNGQTNHKPFYKDKSVKKKSRRKK

SEQ ID NO: 1952324 - protein, 26 aa, Staphylococcus
ISREAQDEFAAQSQQKAEAAQNSGAF

SEQ ID NO: 1952325 - protein, 14 aa, Staphylococcus
ISREEDIKVAMGET

SEQ ID NO: 1952326 - protein, 26 aa, Staphylococcus
ISREEQDQFAAQSQQKAAHAQETGGF

SEQ ID NO: 1952327 - protein, 7 aa, Staphylococcus
ISRETAV

SEQ ID NO: 1952328 - protein, 11 aa, Staphylococcus
ISRGGRFDSYG

SEQ ID NO: 1952329 - protein, 15 aa, Staphylococcus
ISRKKEEKEKQQKEN

SEQ ID NO: 1952330 - protein, 8 aa, Staphylococcus
ISRNDETN

SEQ ID NO: 1952331 - protein, 7 aa, Staphylococcus
ISRNDQD

SEQ ID NO: 1952332 - protein, 6 aa, Staphylococcus
ISRPGL

SEQ ID NO: 1952333 - protein, 4 aa, Staphylococcus
ISRQ

SEQ ID NO: 1952334 - protein, 7 aa, Staphylococcus
ISRQEAE

SEQ ID NO: 1952335 - protein, 10 aa, Staphylococcus
ISRQEAKQRA

SEQ ID NO: 1952336 - protein, 6 aa, Staphylococcus
ISRREA

SEQ ID NO: 1952337 - protein, 7 aa, Staphylococcus
ISRTEAE

SEQ ID NO: 1952338 - protein, 16 aa, Staphylococcus
ISRYSTAKNNGVSSAT

SEQ ID NO: 1952339 - protein, 4 aa, Staphylococcus
ISSA

SEQ ID NO: 1952340 - protein, 9 aa, Staphylococcus
ISSAADPVK

SEQ ID NO: 1952341 - protein, 9 aa, Staphylococcus
ISSAREAEK

SEQ ID NO: 1952342 - protein, 4 aa, Staphylococcus
ISSD

SEQ ID NO: 1952343 - protein, 6 aa, Staphylococcus
ISSDDY

SEQ ID NO: 1952344 - protein, 7 aa, Staphylococcus
ISSDGDT

SEQ ID NO: 1952345 - protein, 9 aa, Staphylococcus
ISSDRSAEK

SEQ ID NO: 1952346 - protein, 9 aa, Staphylococcus
ISSEKHKGK

SEQ ID NO: 1952347 - protein, 8 aa, Staphylococcus
ISSELQKQ

SEQ ID NO: 1952348 - protein, 9 aa, Staphylococcus
ISSERASEK

SEQ ID NO: 1952349 - protein, 4 aa, Staphylococcus
ISSF

SEQ ID NO: 1952350 - protein, 4 aa, Staphylococcus
ISSG

SEQ ID NO: 1952351 - protein, 11 aa, Staphylococcus
ISSGAMPSQSA

SEQ ID NO: 1952352 - protein, 5 aa, Staphylococcus
ISSGK

SEQ ID NO: 1952353 - protein, 10 aa, Staphylococcus
ISSGPMPSQS

SEQ ID NO: 1952354 - protein, 8 aa, Staphylococcus
ISSGQSAQ

SEQ ID NO: 1952355 - protein, 11 aa, Staphylococcus
ISSGREPQLTE

SEQ ID NO: 1952356 - protein, 5 aa, Staphylococcus
ISSKI

SEQ ID NO: 1952357 - protein, 20 aa, Staphylococcus
ISSKKSSNQYIENNTLGSYP

SEQ ID NO: 1952358 - protein, 21 aa, Staphylococcus
ISSKKSSNQYNERNNSKGYPV

SEQ ID NO: 1952359 - protein, 23 aa, Staphylococcus
ISSKNSFNFKGSNEYLTKNKRED

SEQ ID NO: 1952360 - protein, 6 aa, Staphylococcus
ISSKPP

SEQ ID NO: 1952361 - protein, 9 aa, Staphylococcus
ISSKSESKL

SEQ ID NO: 1952362 - protein, 15 aa, Staphylococcus
ISSKTIEPKQGESVG

SEQ ID NO: 1952363 - protein, 5 aa, Staphylococcus
ISSKV

SEQ ID NO: 1952364 - protein, 10 aa, Staphylococcus
ISSNDDGTIS

SEQ ID NO: 1952365 - protein, 6 aa, Staphylococcus
ISSNGR

SEQ ID NO: 1952366 - protein, 11 aa, Staphylococcus
ISSNGTRGDIE

SEQ ID NO: 1952367 - protein, 11 aa, Staphylococcus
ISSNKSPEEIS

SEQ ID NO: 1952368 - protein, 5 aa, Staphylococcus
ISSNR

SEQ ID NO: 1952369 - protein, 6 aa, Staphylococcus
ISSNSY

SEQ ID NO: 1952370 - protein, 8 aa, Staphylococcus
ISSQKESN

SEQ ID NO: 1952371 - protein, 20 aa, Staphylococcus
ISSQPVPTQAAPPASNQQDF

SEQ ID NO: 1952372 - protein, 35 aa, Staphylococcus
ISSQSKIKYATPKNKVRDRLGKPLDEIKKGNKRFE

SEQ ID NO: 1952373 - protein, 10 aa, Staphylococcus
ISSSARGNIE

SEQ ID NO: 1952374 - protein, 14 aa, Staphylococcus
ISSSKRQAREDVSN

SEQ ID NO: 1952375 - protein, 10 aa, Staphylococcus
ISSSSRGNLE

SEQ ID NO: 1952376 - protein, 6 aa, Staphylococcus
ISSTDY

SEQ ID NO: 1952377 - protein, 7 aa, Staphylococcus
ISSTQLK

SEQ ID NO: 1952378 - protein, 11 aa, Staphylococcus
ISSTSQKDNYI

SEQ ID NO: 1952379 - protein, 8 aa, Staphylococcus
ISSVPFKE

SEQ ID NO: 1952380 - protein, 11 aa, Staphylococcus
ISTDDATKGAY

SEQ ID NO: 1952381 - protein, 7 aa, Staphylococcus
ISTDTPS

SEQ ID NO: 1952382 - protein, 7 aa, Staphylococcus
ISTEDAP

SEQ ID NO: 1952383 - protein, 12 aa, Staphylococcus
ISTEKSEPRFNY

SEQ ID NO: 1952384 - protein, 8 aa, Staphylococcus
ISTEQEKQ

SEQ ID NO: 1952385 - protein, 8 aa, Staphylococcus
ISTERKHD

SEQ ID NO: 1952386 - protein, 7 aa, Staphylococcus
ISTETLQ

SEQ ID NO: 1952387 - protein, 6 aa, Staphylococcus
ISTGAS

SEQ ID NO: 1952388 - protein, 18 aa, Staphylococcus
ISTGKDYGEVVEAVESEY

SEQ ID NO: 1952389 - protein, 5 aa, Staphylococcus
ISTHT

SEQ ID NO: 1952390 - protein, 11 aa, Staphylococcus
ISTKNKKGQIT

SEQ ID NO: 1952391 - protein, 8 aa, Staphylococcus
ISTLSGGQ

SEQ ID NO: 1952392 - protein, 4 aa, Staphylococcus
ISTN

SEQ ID NO: 1952393 - protein, 11 aa, Staphylococcus
ISTNGASPTLT

SEQ ID NO: 1952394 - protein, 12 aa, Staphylococcus
ISTNPDVSIPKE

SEQ ID NO: 1952395 - protein, 22 aa, Staphylococcus
ISTNPDVSIPKESGLLPGNGAI

SEQ ID NO: 1952396 - protein, 12 aa, Staphylococcus
ISTNQDVSIPKE

SEQ ID NO: 1952397 - protein, 11 aa, Staphylococcus
ISTPEQRRGVA

SEQ ID NO: 1952398 - protein, 5 aa, Staphylococcus
ISTPY

SEQ ID NO: 1952399 - protein, 5 aa, Staphylococcus
ISTRP

SEQ ID NO: 1952400 - protein, 7 aa, Staphylococcus
ISTRPGF

SEQ ID NO: 1952401 - protein, 5 aa, Staphylococcus
ISTSP

SEQ ID NO: 1952402 - protein, 10 aa, Staphylococcus
ISTSRGNYTG

SEQ ID NO: 1952403 - protein, 16 aa, Staphylococcus
ISTTDNELTLSQTSTQ

SEQ ID NO: 1952404 - protein, 5 aa, Staphylococcus
ISTTR

SEQ ID NO: 1952405 - protein, 4 aa, Staphylococcus
ISVP

SEQ ID NO: 1952406 - protein, 13 aa, Staphylococcus
ISVSEETQRRGVA

SEQ ID NO: 1952407 - protein, 12 aa, Staphylococcus
ISVSNSSRCNAE

SEQ ID NO: 1952408 - protein, 5 aa, Staphylococcus
ISYAP

SEQ ID NO: 1952409 - protein, 6 aa, Staphylococcus
ISYPSL

SEQ ID NO: 1952410 - protein, 26 aa, Staphylococcus
ISYQANKKRLSQLPNNNLTNRNPNHE

SEQ ID NO: 1952411 - protein, 11 aa, Staphylococcus
ITADQSNELKA

SEQ ID NO: 1952412 - protein, 13 aa, Staphylococcus
ITAEAMLEDIEHG

SEQ ID NO: 1952413 - protein, 13 aa, Staphylococcus
ITAGELREKNPER

SEQ ID NO: 1952414 - protein, 9 aa, Staphylococcus
ITAGTNLEG

SEQ ID NO: 1952415 - protein, 11 aa, Staphylococcus
ITAKEQQEMKR

SEQ ID NO: 1952416 - protein, 4 aa, Staphylococcus
ITAP

SEQ ID NO: 1952417 - protein, 6 aa, Staphylococcus
ITASAT

SEQ ID NO: 1952418 - protein, 15 aa, Staphylococcus
ITATKLSEDTGVSRT

SEQ ID NO: 1952419 - protein, 11 aa, Staphylococcus
ITDADDDWSSG

SEQ ID NO: 1952420 - protein, 6 aa, Staphylococcus
ITDAEY

SEQ ID NO: 1952421 - protein, 12 aa, Staphylococcus
ITDAQQNATINQ

SEQ ID NO: 1952422 - protein, 9 aa, Staphylococcus
ITDAYNEKV

SEQ ID NO: 1952423 - protein, 4 aa, Staphylococcus
ITDD

SEQ ID NO: 1952424 - protein, 6 aa, Staphylococcus
ITDDLS

SEQ ID NO: 1952425 - protein, 6 aa, Staphylococcus
ITDDST

SEQ ID NO: 1952426 - protein, 4 aa, Staphylococcus
ITDE

SEQ ID NO: 1952427 - protein, 9 aa, Staphylococcus
ITDEATVNR

SEQ ID NO: 1952428 - protein, 5 aa, Staphylococcus
ITDED

SEQ ID NO: 1952429 - protein, 7 aa, Staphylococcus
ITDEDLK

SEQ ID NO: 1952430 - protein, 6 aa, Staphylococcus
ITDEKA

SEQ ID NO: 1952431 - protein, 5 aa, Staphylococcus
ITDEN

SEQ ID NO: 1952432 - protein, 4 aa, Staphylococcus
ITDG

SEQ ID NO: 1952433 - protein, 14 aa, Staphylococcus
ITDITTDSRTAQHG

SEQ ID NO: 1952434 - protein, 4 aa, Staphylococcus
ITDK

SEQ ID NO: 1952435 - protein, 6 aa, Staphylococcus
ITDKES

SEQ ID NO: 1952436 - protein, 30 aa, Staphylococcus
ITDKESLQEACEAGKVSELSGFAKKTEQNI

SEQ ID NO: 1952437 - protein, 8 aa, Staphylococcus
ITDKGTEF

SEQ ID NO: 1952438 - protein, 8 aa, Staphylococcus
ITDKGTQF

SEQ ID NO: 1952439 - protein, 8 aa, Staphylococcus
ITDKGYYQ

SEQ ID NO: 1952440 - protein, 30 aa, Staphylococcus
ITDKTSLQEACEAGKVSELSGFAKKTEQNI

SEQ ID NO: 1952441 - protein, 43 aa, Staphylococcus
ITDLGDNISEDDKKNAEEKKDALKSALEGEDMEDIKSKKEELE

SEQ ID NO: 1952442 - protein, 43 aa, Staphylococcus
ITDLGDNISEEDKSNAESKKDALKSALEGQDIEDIKAKKEELE

SEQ ID NO: 1952443 - protein, 43 aa, Staphylococcus
ITDLGENISEEDKQNAEDKKEALKSALEGEDIDDIKAKKEDLE

SEQ ID NO: 1952444 - protein, 8 aa, Staphylococcus
ITDMTDRS

SEQ ID NO: 1952445 - protein, 10 aa, Staphylococcus
ITDNKDKITE

SEQ ID NO: 1952446 - protein, 7 aa, Staphylococcus
ITDNNLS

SEQ ID NO: 1952447 - protein, 4 aa, Staphylococcus
ITDQ

SEQ ID NO: 1952448 - protein, 9 aa, Staphylococcus
ITDRATVNR

SEQ ID NO: 1952449 - protein, 5 aa, Staphylococcus
ITDSD

SEQ ID NO: 1952450 - protein, 6 aa, Staphylococcus
ITDSPY

SEQ ID NO: 1952451 - protein, 7 aa, Staphylococcus
ITDTSTY

SEQ ID NO: 1952452 - protein, 6 aa, Staphylococcus
ITDVES

SEQ ID NO: 1952453 - protein, 27 aa, Staphylococcus
ITDVSADKSSNNIQQLDDQETLEAEQH

SEQ ID NO: 1952454 - protein, 15 aa, Staphylococcus
ITEASDEPIVLTGVK

SEQ ID NO: 1952455 - protein, 10 aa, Staphylococcus
ITEAVTEGVP

SEQ ID NO: 1952456 - protein, 5 aa, Staphylococcus
ITEDG

SEQ ID NO: 1952457 - protein, 6 aa, Staphylococcus
ITEDGK

SEQ ID NO: 1952458 - protein, 5 aa, Staphylococcus
ITEDI

SEQ ID NO: 1952459 - protein, 6 aa, Staphylococcus
ITEDKN

SEQ ID NO: 1952460 - protein, 9 aa, Staphylococcus
ITEDKYKGH

SEQ ID NO: 1952461 - protein, 5 aa, Staphylococcus
ITEDM

SEQ ID NO: 1952462 - protein, 6 aa, Staphylococcus
ITEDRD

SEQ ID NO: 1952463 - protein, 13 aa, Staphylococcus
ITEDTFNDLTAQF

SEQ ID NO: 1952464 - protein, 11 aa, Staphylococcus
ITEEEAFNHPQ

SEQ ID NO: 1952465 - protein, 11 aa, Staphylococcus
ITEEEAYRHPQ

SEQ ID NO: 1952466 - protein, 6 aa, Staphylococcus
ITEEED

SEQ ID NO: 1952467 - protein, 13 aa, Staphylococcus
ITEERSKRLEKTR

SEQ ID NO: 1952468 - protein, 9 aa, Staphylococcus
ITEETGQSE

SEQ ID NO: 1952469 - protein, 4 aa, Staphylococcus
ITEG

SEQ ID NO: 1952470 - protein, 10 aa, Staphylococcus
ITEGADAQAE

SEQ ID NO: 1952471 - protein, 8 aa, Staphylococcus
ITEGDTYQ

SEQ ID NO: 1952472 - protein, 6 aa, Staphylococcus
ITEGDV

SEQ ID NO: 1952473 - protein, 5 aa, Staphylococcus
ITEGG

SEQ ID NO: 1952474 - protein, 5 aa, Staphylococcus
ITEGL

SEQ ID NO: 1952475 - protein, 7 aa, Staphylococcus
ITEHRDE

SEQ ID NO: 1952476 - protein, 4 aa, Staphylococcus
ITEK

SEQ ID NO: 1952477 - protein, 8 aa, Staphylococcus
ITEKGTQF

SEQ ID NO: 1952478 - protein, 14 aa, Staphylococcus
ITEKQGVNKAAISR

SEQ ID NO: 1952479 - protein, 15 aa, Staphylococcus
ITEKQGVNKAAVSRR

SEQ ID NO: 1952480 - protein, 12 aa, Staphylococcus
ITEKSSAAMAED

SEQ ID NO: 1952481 - protein, 13 aa, Staphylococcus
ITEKSSEAMAEDK

SEQ ID NO: 1952482 - protein, 13 aa, Staphylococcus
ITEKSSEAMAEEK

SEQ ID NO: 1952483 - protein, 12 aa, Staphylococcus
ITEKSSEAMAEN

SEQ ID NO: 1952484 - protein, 9 aa, Staphylococcus
ITEKTPPHF

SEQ ID NO: 1952485 - protein, 8 aa, Staphylococcus
ITENAGKL

SEQ ID NO: 1952486 - protein, 10 aa, Staphylococcus
ITENARVKEA

SEQ ID NO: 1952487 - protein, 7 aa, Staphylococcus
ITENGTQ

SEQ ID NO: 1952488 - protein, 5 aa, Staphylococcus
ITENS

SEQ ID NO: 1952489 - protein, 6 aa, Staphylococcus
ITENTK

SEQ ID NO: 1952490 - protein, 9 aa, Staphylococcus
ITEPDDKGI

SEQ ID NO: 1952491 - protein, 9 aa, Staphylococcus
ITEPDEKGI

SEQ ID NO: 1952492 - protein, 5 aa, Staphylococcus
ITEPG

SEQ ID NO: 1952493 - protein, 7 aa, Staphylococcus
ITEPSGV

SEQ ID NO: 1952494 - protein, 4 aa, Staphylococcus
ITEQ

SEQ ID NO: 1952495 - protein, 6 aa, Staphylococcus
ITEQGS

SEQ ID NO: 1952496 - protein, 7 aa, Staphylococcus
ITEQGSQ

SEQ ID NO: 1952497 - protein, 7 aa, Staphylococcus
ITERATV

SEQ ID NO: 1952498 - protein, 8 aa, Staphylococcus
ITERATVN

SEQ ID NO: 1952499 - protein, 11 aa, Staphylococcus
ITERRPEGTLP

SEQ ID NO: 1952500 - protein, 9 aa, Staphylococcus
ITESGRKEL

SEQ ID NO: 1952501 - protein, 8 aa, Staphylococcus
ITESNTYN

SEQ ID NO: 1952502 - protein, 12 aa, Staphylococcus
ITESTQLATEGE

SEQ ID NO: 1952503 - protein, 6 aa, Staphylococcus
ITESYS

SEQ ID NO: 1952504 - protein, 4 aa, Staphylococcus
ITET

SEQ ID NO: 1952505 - protein, 6 aa, Staphylococcus
ITETGS

SEQ ID NO: 1952506 - protein, 5 aa, Staphylococcus
ITETS

SEQ ID NO: 1952507 - protein, 15 aa, Staphylococcus
ITGADKTTDQLTEEE

SEQ ID NO: 1952508 - protein, 7 aa, Staphylococcus
ITGAPKI

SEQ ID NO: 1952509 - protein, 7 aa, Staphylococcus
ITGAPKL

SEQ ID NO: 1952510 - protein, 8 aa, Staphylococcus
ITGAPKLS

SEQ ID NO: 1952511 - protein, 10 aa, Staphylococcus
ITGAPKQSTM

SEQ ID NO: 1952512 - protein, 4 aa, Staphylococcus
ITGD

SEQ ID NO: 1952513 - protein, 5 aa, Staphylococcus
ITGEK

SEQ ID NO: 1952514 - protein, 10 aa, Staphylococcus
ITGEKEYSAS

SEQ ID NO: 1952515 - protein, 11 aa, Staphylococcus
ITGENKEVEAE

SEQ ID NO: 1952516 - protein, 12 aa, Staphylococcus
ITGGHGDKMTKS

SEQ ID NO: 1952517 - protein, 10 aa, Staphylococcus
ITGGSTMASV

SEQ ID NO: 1952518 - protein, 9 aa, Staphylococcus
ITGGTKDRY

SEQ ID NO: 1952519 - protein, 11 aa, Staphylococcus
ITGKADEQGDF

SEQ ID NO: 1952520 - protein, 9 aa, Staphylococcus
ITGNADPLE

SEQ ID NO: 1952521 - protein, 9 aa, Staphylococcus
ITGQEQPIT

SEQ ID NO: 1952522 - protein, 10 aa, Staphylococcus
ITGQGEPNTK

SEQ ID NO: 1952523 - protein, 11 aa, Staphylococcus
ITGQLKNTEYI

SEQ ID NO: 1952524 - protein, 8 aa, Staphylococcus
ITGSSTRT

SEQ ID NO: 1952525 - protein, 13 aa, Staphylococcus
ITGTIQKVNGAWY

SEQ ID NO: 1952526 - protein, 22 aa, Staphylococcus
ITGTSSDLRDLTEEAKHGRHRA

SEQ ID NO: 1952527 - protein, 6 aa, Staphylococcus
ITGTSY

SEQ ID NO: 1952528 - protein, 13 aa, Staphylococcus
ITGTVQKINGGWY

SEQ ID NO: 1952529 - protein, 13 aa, Staphylococcus
ITGTVQKVNGAWY

SEQ ID NO: 1952530 - protein, 5 aa, Staphylococcus
ITHNN

SEQ ID NO: 1952531 - protein, 5 aa, Staphylococcus
ITHPD

SEQ ID NO: 1952532 - protein, 6 aa, Staphylococcus
ITHSKK

SEQ ID NO: 1952533 - protein, 12 aa, Staphylococcus
ITKAKQQNGPTL

SEQ ID NO: 1952534 - protein, 6 aa, Staphylococcus
ITKDDN

SEQ ID NO: 1952535 - protein, 8 aa, Staphylococcus
ITKDTQAV

SEQ ID NO: 1952536 - protein, 8 aa, Staphylococcus
ITKDYRGK

SEQ ID NO: 1952537 - protein, 12 aa, Staphylococcus
ITKENPPIPGHY

SEQ ID NO: 1952538 - protein, 11 aa, Staphylococcus
ITKESPPIPGH

SEQ ID NO: 1952539 - protein, 9 aa, Staphylococcus
ITKGSITYN

SEQ ID NO: 1952540 - protein, 11 aa, Staphylococcus
ITKKNAKEREK

SEQ ID NO: 1952541 - protein, 16 aa, Staphylococcus
ITKKQKEEAQNTSLQD

SEQ ID NO: 1952542 - protein, 4 aa, Staphylococcus
ITKM

SEQ ID NO: 1952543 - protein, 5 aa, Staphylococcus
ITKNI

SEQ ID NO: 1952544 - protein, 8 aa, Staphylococcus
ITKNTGAK

SEQ ID NO: 1952545 - protein, 4 aa, Staphylococcus
ITKP

SEQ ID NO: 1952546 - protein, 10 aa, Staphylococcus
ITKPRPGHAD

SEQ ID NO: 1952547 - protein, 5 aa, Staphylococcus
ITKQG

SEQ ID NO: 1952548 - protein, 7 aa, Staphylococcus
ITKQNYQ

SEQ ID NO: 1952549 - protein, 5 aa, Staphylococcus
ITKRL

SEQ ID NO: 1952550 - protein, 6 aa, Staphylococcus
ITKRQY

SEQ ID NO: 1952551 - protein, 26 aa, Staphylococcus
ITKRSAPQVPYAHSSPNRKSNHTSKS

SEQ ID NO: 1952552 - protein, 9 aa, Staphylococcus
ITKSMNNND

SEQ ID NO: 1952553 - protein, 4 aa, Staphylococcus
ITKT

SEQ ID NO: 1952554 - protein, 5 aa, Staphylococcus
ITKYT

SEQ ID NO: 1952555 - protein, 6 aa, Staphylococcus
ITKYTS

SEQ ID NO: 1952556 - protein, 5 aa, Staphylococcus
ITLNG

SEQ ID NO: 1952557 - protein, 17 aa, Staphylococcus
ITLSNSDNGIPHTLRQI

SEQ ID NO: 1952558 - protein, 6 aa, Staphylococcus
ITLSSQ

SEQ ID NO: 1952559 - protein, 7 aa, Staphylococcus
ITMPSLS

SEQ ID NO: 1952560 - protein, 4 aa, Staphylococcus
ITND

SEQ ID NO: 1952561 - protein, 7 aa, Staphylococcus
ITNDKEA

SEQ ID NO: 1952562 - protein, 10 aa, Staphylococcus
ITNDNRQSYI

SEQ ID NO: 1952563 - protein, 5 aa, Staphylococcus
ITNDY

SEQ ID NO: 1952564 - protein, 9 aa, Staphylococcus
ITNEDETVN

SEQ ID NO: 1952565 - protein, 7 aa, Staphylococcus
ITNEQGH

SEQ ID NO: 1952566 - protein, 6 aa, Staphylococcus
ITNERE

SEQ ID NO: 1952567 - protein, 7 aa, Staphylococcus
ITNERET

SEQ ID NO: 1952568 - protein, 7 aa, Staphylococcus
ITNGDAV

SEQ ID NO: 1952569 - protein, 7 aa, Staphylococcus
ITNGECE

SEQ ID NO: 1952570 - protein, 5 aa, Staphylococcus
ITNIK

SEQ ID NO: 1952571 - protein, 10 aa, Staphylococcus
ITNKDDQQRA

SEQ ID NO: 1952572 - protein, 5 aa, Staphylococcus
ITNKQ

SEQ ID NO: 1952573 - protein, 4 aa, Staphylococcus
ITNL

SEQ ID NO: 1952574 - protein, 10 aa, Staphylococcus
ITNNSKTNHS

SEQ ID NO: 1952575 - protein, 5 aa, Staphylococcus
ITNPS

SEQ ID NO: 1952576 - protein, 5 aa, Staphylococcus
ITNPT

SEQ ID NO: 1952577 - protein, 7 aa, Staphylococcus
ITNPYTG

SEQ ID NO: 1952578 - protein, 12 aa, Staphylococcus
ITNQDIKRAEKV

SEQ ID NO: 1952579 - protein, 6 aa, Staphylococcus
ITNQTD

SEQ ID NO: 1952580 - protein, 7 aa, Staphylococcus
ITNQVEE

SEQ ID NO: 1952581 - protein, 7 aa, Staphylococcus
ITNRKDI

SEQ ID NO: 1952582 - protein, 7 aa, Staphylococcus
ITNRKDV

SEQ ID NO: 1952583 - protein, 7 aa, Staphylococcus
ITNRQDV

SEQ ID NO: 1952584 - protein, 17 aa, Staphylococcus
ITNVESKMQQIHSEISS

SEQ ID NO: 1952585 - protein, 5 aa, Staphylococcus
ITPDD

SEQ ID NO: 1952586 - protein, 11 aa, Staphylococcus
ITPDDQRLKTD

SEQ ID NO: 1952587 - protein, 9 aa, Staphylococcus
ITPDGTELA

SEQ ID NO: 1952588 - protein, 10 aa, Staphylococcus
ITPDGTELEG

SEQ ID NO: 1952589 - protein, 4 aa, Staphylococcus
ITPE

SEQ ID NO: 1952590 - protein, 17 aa, Staphylococcus
ITPEDVDKAASKIKEAD

SEQ ID NO: 1952591 - protein, 5 aa, Staphylococcus
ITPEQ

SEQ ID NO: 1952592 - protein, 9 aa, Staphylococcus
ITPEQVKET

SEQ ID NO: 1952593 - protein, 7 aa, Staphylococcus
ITPESIQ

SEQ ID NO: 1952594 - protein, 5 aa, Staphylococcus
ITPET

SEQ ID NO: 1952595 - protein, 15 aa, Staphylococcus
ITPGLGDAGDRLFGT

SEQ ID NO: 1952596 - protein, 5 aa, Staphylococcus
ITPGV

SEQ ID NO: 1952597 - protein, 16 aa, Staphylococcus
ITPIEPELNESEFETK

SEQ ID NO: 1952598 - protein, 4 aa, Staphylococcus
ITPK

SEQ ID NO: 1952599 - protein, 13 aa, Staphylococcus
ITPKPQPGNPKPR

SEQ ID NO: 1952600 - protein, 7 aa, Staphylococcus
ITPNKDT

SEQ ID NO: 1952601 - protein, 5 aa, Staphylococcus
ITPNT

SEQ ID NO: 1952602 - protein, 17 aa, Staphylococcus
ITPNTAPIRGGTDGSQL

SEQ ID NO: 1952603 - protein, 4 aa, Staphylococcus
ITPQ

SEQ ID NO: 1952604 - protein, 8 aa, Staphylococcus
ITPQKSEG

SEQ ID NO: 1952605 - protein, 5 aa, Staphylococcus
ITPQR

SEQ ID NO: 1952606 - protein, 6 aa, Staphylococcus
ITPQSK

SEQ ID NO: 1952607 - protein, 4 aa, Staphylococcus
ITPR

SEQ ID NO: 1952608 - protein, 17 aa, Staphylococcus
ITQADSNKYPEYKNGPY

SEQ ID NO: 1952609 - protein, 10 aa, Staphylococcus
ITQAGENPDI

SEQ ID NO: 1952610 - protein, 14 aa, Staphylococcus
ITQAGLQKGQEILN

SEQ ID NO: 1952611 - protein, 6 aa, Staphylococcus
ITQANA

SEQ ID NO: 1952612 - protein, 8 aa, Staphylococcus
ITQDDGYG

SEQ ID NO: 1952613 - protein, 14 aa, Staphylococcus
ITQEGLEKGQELLA

SEQ ID NO: 1952614 - protein, 7 aa, Staphylococcus
ITQETGA

SEQ ID NO: 1952615 - protein, 7 aa, Staphylococcus
ITQGDAV

SEQ ID NO: 1952616 - protein, 9 aa, Staphylococcus
ITQGSNSDV

SEQ ID NO: 1952617 - protein, 8 aa, Staphylococcus
ITQGTNGD

SEQ ID NO: 1952618 - protein, 9 aa, Staphylococcus
ITQGTNGDV

SEQ ID NO: 1952619 - protein, 16 aa, Staphylococcus
ITQHEKDNSAQPQLND

SEQ ID NO: 1952620 - protein, 17 aa, Staphylococcus
ITQHQQDKSAQPELNEK

SEQ ID NO: 1952621 - protein, 10 aa, Staphylococcus
ITQKGKARTV

SEQ ID NO: 1952622 - protein, 5 aa, Staphylococcus
ITQMD

SEQ ID NO: 1952623 - protein, 11 aa, Staphylococcus
ITQNQKSKKSI

SEQ ID NO: 1952624 - protein, 8 aa, Staphylococcus
ITQNRQQV

SEQ ID NO: 1952625 - protein, 13 aa, Staphylococcus
ITQPNSKPCNTLT

SEQ ID NO: 1952626 - protein, 4 aa, Staphylococcus
ITQQ

SEQ ID NO: 1952627 - protein, 7 aa, Staphylococcus
ITQQGQG

SEQ ID NO: 1952628 - protein, 5 aa, Staphylococcus
ITQQR

SEQ ID NO: 1952629 - protein, 6 aa, Staphylococcus
ITQQSI

SEQ ID NO: 1952630 - protein, 5 aa, Staphylococcus
ITQSE

SEQ ID NO: 1952631 - protein, 19 aa, Staphylococcus
ITQSEHPQESYTKIKESWL

SEQ ID NO: 1952632 - protein, 21 aa, Staphylococcus
ITQSKDRIEEKTYVGKGKQYE

SEQ ID NO: 1952633 - protein, 8 aa, Staphylococcus
ITQSMENK

SEQ ID NO: 1952634 - protein, 7 aa, Staphylococcus
ITQSTGA

SEQ ID NO: 1952635 - protein, 6 aa, Staphylococcus
ITQYTS

SEQ ID NO: 1952636 - protein, 18 aa, Staphylococcus
ITRASTSGMAKSRRKTLE

SEQ ID NO: 1952637 - protein, 5 aa, Staphylococcus
ITRDN

SEQ ID NO: 1952638 - protein, 13 aa, Staphylococcus
ITRDPNSYTIPRE

SEQ ID NO: 1952639 - protein, 7 aa, Staphylococcus
ITREANN

SEQ ID NO: 1952640 - protein, 7 aa, Staphylococcus
ITREASN

SEQ ID NO: 1952641 - protein, 5 aa, Staphylococcus
ITRGS

SEQ ID NO: 1952642 - protein, 9 aa, Staphylococcus
ITRGTNSDV

SEQ ID NO: 1952643 - protein, 5 aa, Staphylococcus
ITRNA

SEQ ID NO: 1952644 - protein, 16 aa, Staphylococcus
ITRPKEITKRFINAFD

SEQ ID NO: 1952645 - protein, 6 aa, Staphylococcus
ITRPKQ

SEQ ID NO: 1952646 - protein, 17 aa, Staphylococcus
ITRPKQITERFIKAIAE

SEQ ID NO: 1952647 - protein, 6 aa, Staphylococcus
ITRPRG

SEQ ID NO: 1952648 - protein, 4 aa, Staphylococcus
ITRR

SEQ ID NO: 1952649 - protein, 8 aa, Staphylococcus
ITRRPKRD

SEQ ID NO: 1952650 - protein, 6 aa, Staphylococcus
ITRTQN

SEQ ID NO: 1952651 - protein, 12 aa, Staphylococcus
ITSADGDSIQSI

SEQ ID NO: 1952652 - protein, 10 aa, Staphylococcus
ITSASAAAAT

SEQ ID NO: 1952653 - protein, 9 aa, Staphylococcus
ITSDDGSLA

SEQ ID NO: 1952654 - protein, 9 aa, Staphylococcus
ITSDEKLEE

SEQ ID NO: 1952655 - protein, 6 aa, Staphylococcus
ITSEDK

SEQ ID NO: 1952656 - protein, 8 aa, Staphylococcus
ITSEDKLE

SEQ ID NO: 1952657 - protein, 36 aa, Staphylococcus
ITSEDKQEEVKAYQEEASKKSDLERTDLAKGKTGVF

SEQ ID NO: 1952658 - protein, 7 aa, Staphylococcus
ITSEDTF

SEQ ID NO: 1952659 - protein, 29 aa, Staphylococcus
ITSELSEQFAKSKELEDQIRKSLEGLGYG

SEQ ID NO: 1952660 - protein, 17 aa, Staphylococcus
ITSEPAKELPLAQRYFL

SEQ ID NO: 1952661 - protein, 4 aa, Staphylococcus
ITSG

SEQ ID NO: 1952662 - protein, 10 aa, Staphylococcus
ITSGSAFGSG

SEQ ID NO: 1952663 - protein, 4 aa, Staphylococcus
ITSK

SEQ ID NO: 1952664 - protein, 12 aa, Staphylococcus
ITSKGKAAHSSV

SEQ ID NO: 1952665 - protein, 11 aa, Staphylococcus
ITSKGNFKASI

SEQ ID NO: 1952666 - protein, 11 aa, Staphylococcus
ITSKHADASEY

SEQ ID NO: 1952667 - protein, 5 aa, Staphylococcus
ITSKS

SEQ ID NO: 1952668 - protein, 17 aa, Staphylococcus
ITSKSEPMQTSLKSILA

SEQ ID NO: 1952669 - protein, 8 aa, Staphylococcus
ITSKSPMN

SEQ ID NO: 1952670 - protein, 9 aa, Staphylococcus
ITSLDTENR

SEQ ID NO: 1952671 - protein, 6 aa, Staphylococcus
ITSLRN

SEQ ID NO: 1952672 - protein, 22 aa, Staphylococcus
ITSNEDGTYGYDQEAKDGLNKT

SEQ ID NO: 1952673 - protein, 6 aa, Staphylococcus
ITSNEN

SEQ ID NO: 1952674 - protein, 5 aa, Staphylococcus
ITSPE

SEQ ID NO: 1952675 - protein, 7 aa, Staphylococcus
ITSPSDV

SEQ ID NO: 1952676 - protein, 25 aa, Staphylococcus
ITSQKALKNKVTEAYTNQYHFLGGQ

SEQ ID NO: 1952677 - protein, 10 aa, Staphylococcus
ITSQQSHEDL

SEQ ID NO: 1952678 - protein, 13 aa, Staphylococcus
ITSRSDSKLAGEA

SEQ ID NO: 1952679 - protein, 5 aa, Staphylococcus
ITSSS

SEQ ID NO: 1952680 - protein, 7 aa, Staphylococcus
ITSSSKI

SEQ ID NO: 1952681 - protein, 10 aa, Staphylococcus
ITSTMKGSIT

SEQ ID NO: 1952682 - protein, 8 aa, Staphylococcus
ITTDAPLK

SEQ ID NO: 1952683 - protein, 10 aa, Staphylococcus
ITTDDKKEMV

SEQ ID NO: 1952684 - protein, 5 aa, Staphylococcus
ITTDS

SEQ ID NO: 1952685 - protein, 12 aa, Staphylococcus
ITTDSRTASGES

SEQ ID NO: 1952686 - protein, 6 aa, Staphylococcus
ITTDST

SEQ ID NO: 1952687 - protein, 6 aa, Staphylococcus
ITTDTI

SEQ ID NO: 1952688 - protein, 4 aa, Staphylococcus
ITTE

SEQ ID NO: 1952689 - protein, 6 aa, Staphylococcus
ITTEAA

SEQ ID NO: 1952690 - protein, 5 aa, Staphylococcus
ITTED

SEQ ID NO: 1952691 - protein, 8 aa, Staphylococcus
ITTEEERE

SEQ ID NO: 1952692 - protein, 10 aa, Staphylococcus
ITTENGKEIR

SEQ ID NO: 1952693 - protein, 6 aa, Staphylococcus
ITTENN

SEQ ID NO: 1952694 - protein, 6 aa, Staphylococcus
ITTEQD

SEQ ID NO: 1952695 - protein, 5 aa, Staphylococcus
ITTES

SEQ ID NO: 1952696 - protein, 8 aa, Staphylococcus
ITTETSPQ

SEQ ID NO: 1952697 - protein, 6 aa, Staphylococcus
ITTGTL

SEQ ID NO: 1952698 - protein, 8 aa, Staphylococcus
ITTGTNSD

SEQ ID NO: 1952699 - protein, 4 aa, Staphylococcus
ITTK

SEQ ID NO: 1952700 - protein, 8 aa, Staphylococcus
ITTKENEN

SEQ ID NO: 1952701 - protein, 28 aa, Staphylococcus
ITTKGSGFVSQQSTTKGQKVSKNDKIEV

SEQ ID NO: 1952702 - protein, 15 aa, Staphylococcus
ITTKSIQPKDGESVG

SEQ ID NO: 1952703 - protein, 9 aa, Staphylococcus
ITTKSSPQV

SEQ ID NO: 1952704 - protein, 4 aa, Staphylococcus
ITTN

SEQ ID NO: 1952705 - protein, 11 aa, Staphylococcus
ITTNARTTEVL

SEQ ID NO: 1952706 - protein, 8 aa, Staphylococcus
ITTNKPDA

SEQ ID NO: 1952707 - protein, 15 aa, Staphylococcus
ITTQKKKKAEDEKQT

SEQ ID NO: 1952708 - protein, 8 aa, Staphylococcus
ITTQSTFT

SEQ ID NO: 1952709 - protein, 13 aa, Staphylococcus
ITTREDGLSPYPH

SEQ ID NO: 1952710 - protein, 9 aa, Staphylococcus
ITTRQAGKE

SEQ ID NO: 1952711 - protein, 6 aa, Staphylococcus
ITTSGG

SEQ ID NO: 1952712 - protein, 6 aa, Staphylococcus
ITTSPY

SEQ ID NO: 1952713 - protein, 13 aa, Staphylococcus
ITTSVATRGQSPY

SEQ ID NO: 1952714 - protein, 5 aa, Staphylococcus
ITTTD

SEQ ID NO: 1952715 - protein, 8 aa, Staphylococcus
ITTTEKFE

SEQ ID NO: 1952716 - protein, 5 aa, Staphylococcus
ITTTK

SEQ ID NO: 1952717 - protein, 5 aa, Staphylococcus
ITTTR

SEQ ID NO: 1952718 - protein, 12 aa, Staphylococcus
ITTTTEDQTGEI

SEQ ID NO: 1952719 - protein, 4 aa, Staphylococcus
ITVE

SEQ ID NO: 1952720 - protein, 12 aa, Staphylococcus
ITVNEKDLSSIG

SEQ ID NO: 1952721 - protein, 16 aa, Staphylococcus
ITVTNTPDVLTETTAE

SEQ ID NO: 1952722 - protein, 17 aa, Staphylococcus
ITYDSGGYSIKSKAGMQ

SEQ ID NO: 1952723 - protein, 14 aa, Staphylococcus
ITYSEAMNNEDYRP

SEQ ID NO: 1952724 - protein, 8 aa, Staphylococcus
IVADKERG

SEQ ID NO: 1952725 - protein, 10 aa, Staphylococcus
IVANGETNEV

SEQ ID NO: 1952726 - protein, 10 aa, Staphylococcus
IVANGTTKEV

SEQ ID NO: 1952727 - protein, 11 aa, Staphylococcus
IVANGTTQEVL

SEQ ID NO: 1952728 - protein, 10 aa, Staphylococcus
IVDKSGAWYS

SEQ ID NO: 1952729 - protein, 12 aa, Staphylococcus
IVDKTTTVLFEL

SEQ ID NO: 1952730 - protein, 4 aa, Staphylococcus
IVED

SEQ ID NO: 1952731 - protein, 5 aa, Staphylococcus
IVEDD

SEQ ID NO: 1952732 - protein, 7 aa, Staphylococcus
IVEQSEQ

SEQ ID NO: 1952733 - protein, 10 aa, Staphylococcus
IVESNAPGHY

SEQ ID NO: 1952734 - protein, 12 aa, Staphylococcus
IVESNDKSLDKV

SEQ ID NO: 1952735 - protein, 14 aa, Staphylococcus
IVETNDELEDSPEF

SEQ ID NO: 1952736 - protein, 6 aa, Staphylococcus
IVGANE

SEQ ID NO: 1952737 - protein, 6 aa, Staphylococcus
IVGPGN

SEQ ID NO: 1952738 - protein, 10 aa, Staphylococcus
IVKADTKDNV

SEQ ID NO: 1952739 - protein, 8 aa, Staphylococcus
IVKENPDV

SEQ ID NO: 1952740 - protein, 8 aa, Staphylococcus
IVKNTPES

SEQ ID NO: 1952741 - protein, 8 aa, Staphylococcus
IVKRSSLS

SEQ ID NO: 1952742 - protein, 13 aa, Staphylococcus
IVNGDQSEEGLES

SEQ ID NO: 1952743 - protein, 4 aa, Staphylococcus
IVNN

SEQ ID NO: 1952744 - protein, 29 aa, Staphylococcus
IVNPGGSMTGGGARKTKSILTQKDELSQM

SEQ ID NO: 1952745 - protein, 8 aa, Staphylococcus
IVNSETGE

SEQ ID NO: 1952746 - protein, 10 aa, Staphylococcus
IVNSETGEIV

SEQ ID NO: 1952747 - protein, 6 aa, Staphylococcus
IVPENQ

SEQ ID NO: 1952748 - protein, 8 aa, Staphylococcus
IVPGGAQQ

SEQ ID NO: 1952749 - protein, 16 aa, Staphylococcus
IVQPQDTVALIPPVSG

SEQ ID NO: 1952750 - protein, 11 aa, Staphylococcus
IVSEPSIDRCA

SEQ ID NO: 1952751 - protein, 4 aa, Staphylococcus
IVST

SEQ ID NO: 1952752 - protein, 12 aa, Staphylococcus
IVTDRNNQTNVP

SEQ ID NO: 1952753 - protein, 11 aa, Staphylococcus
IVTEGSSSNVY

SEQ ID NO: 1952754 - protein, 18 aa, Staphylococcus
IVTETTEEELNKYEDNDL

SEQ ID NO: 1952755 - protein, 18 aa, Staphylococcus
IVTETTEEELNQYKDNDL

SEQ ID NO: 1952756 - protein, 10 aa, Staphylococcus
IVTPEGKGQV

SEQ ID NO: 1952757 - protein, 11 aa, Staphylococcus
IVTSDADQLTA

SEQ ID NO: 1952758 - protein, 8 aa, Staphylococcus
IWNETSAS

SEQ ID NO: 1952759 - protein, 12 aa, Staphylococcus
IYASTKDGLKGT

SEQ ID NO: 1952760 - protein, 12 aa, Staphylococcus
IYASTKEGLKGA

SEQ ID NO: 1952761 - protein, 10 aa, Staphylococcus
IYATGQKAQE

SEQ ID NO: 1952762 - protein, 5 aa, Staphylococcus
IYDES

SEQ ID NO: 1952763 - protein, 4 aa, Staphylococcus
IYEE

SEQ ID NO: 1952764 - protein, 15 aa, Staphylococcus
IYEGRKLGSDNLTKG

SEQ ID NO: 1952765 - protein, 9 aa, Staphylococcus
IYEKAPAKI

SEQ ID NO: 1952766 - protein, 5 aa, Staphylococcus
IYEKK

SEQ ID NO: 1952767 - protein, 8 aa, Staphylococcus
IYESNNAK

SEQ ID NO: 1952768 - protein, 12 aa, Staphylococcus
IYGGTRSSQSKW

SEQ ID NO: 1952769 - protein, 12 aa, Staphylococcus
IYGKEDKAKSLI

SEQ ID NO: 1952770 - protein, 13 aa, Staphylococcus
IYGKGKKRHVPED

SEQ ID NO: 1952771 - protein, 8 aa, Staphylococcus
IYGPSVKS

SEQ ID NO: 1952772 - protein, 10 aa, Staphylococcus
IYGSKNVAQE

SEQ ID NO: 1952773 - protein, 11 aa, Staphylococcus
IYKENKDGSLE

SEQ ID NO: 1952774 - protein, 9 aa, Staphylococcus
IYKESGNKR

SEQ ID NO: 1952775 - protein, 9 aa, Staphylococcus
IYKNQTEDD

SEQ ID NO: 1952776 - protein, 4 aa, Staphylococcus
IYNP

SEQ ID NO: 1952777 - protein, 7 aa, Staphylococcus
IYNRPRG

SEQ ID NO: 1952778 - protein, 13 aa, Staphylococcus
IYPDDNKSDLEER

SEQ ID NO: 1952779 - protein, 12 aa, Staphylococcus
IYPDDTKEQLED

SEQ ID NO: 1952780 - protein, 5 aa, Staphylococcus
IYPNG

SEQ ID NO: 1952781 - protein, 13 aa, Staphylococcus
IYPRPKTDSSEDI

SEQ ID NO: 1952782 - protein, 4 aa, Staphylococcus
IYSD

SEQ ID NO: 1952783 - protein, 17 aa, Staphylococcus
IYSDGTTVLGADDKAGL

SEQ ID NO: 1952784 - protein, 7 aa, Staphylococcus
IYSERTA

SEQ ID NO: 1952785 - protein, 10 aa, Staphylococcus
IYTENPDKDL

SEQ ID NO: 1952786 - protein, 8 aa, Staphylococcus
IYTNDRSR

SEQ ID NO: 1952787 - protein, 11 aa, Staphylococcus
IYTPQSNISLE

SEQ ID NO: 1952788 - protein, 11 aa, Staphylococcus
IYTTDKPNELR

SEQ ID NO: 1952789 - protein, 7 aa, Staphylococcus
IYTTGRN

SEQ ID NO: 1952790 - protein, 13 aa, Staphylococcus
KAAAESTKTGKPI

SEQ ID NO: 1952791 - protein, 9 aa, Staphylococcus
KAAAKAGFQ

SEQ ID NO: 1952792 - protein, 8 aa, Staphylococcus
KAAAQNGW

SEQ ID NO: 1952793 - protein, 5 aa, Staphylococcus
KAAAT

SEQ ID NO: 1952794 - protein, 7 aa, Staphylococcus
KAAATTL

SEQ ID NO: 1952795 - protein, 4 aa, Staphylococcus
KAAD

SEQ ID NO: 1952796 - protein, 11 aa, Staphylococcus
KAADAPNHGMR

SEQ ID NO: 1952797 - protein, 7 aa, Staphylococcus
KAADDFK

SEQ ID NO: 1952798 - protein, 6 aa, Staphylococcus
KAADIN

SEQ ID NO: 1952799 - protein, 6 aa, Staphylococcus
KAADKG

SEQ ID NO: 1952800 - protein, 7 aa, Staphylococcus
KAADNAI

SEQ ID NO: 1952801 - protein, 7 aa, Staphylococcus
KAAEDFK

SEQ ID NO: 1952802 - protein, 11 aa, Staphylococcus
KAAEELEKDGV

SEQ ID NO: 1952803 - protein, 12 aa, Staphylococcus
KAAEELEKDGYS

SEQ ID NO: 1952804 - protein, 13 aa, Staphylococcus
KAAEESTKTGKPI

SEQ ID NO: 1952805 - protein, 11 aa, Staphylococcus
KAAEKPGSQIQ

SEQ ID NO: 1952806 - protein, 6 aa, Staphylococcus
KAAELA

SEQ ID NO: 1952807 - protein, 9 aa, Staphylococcus
KAAELGTEE

SEQ ID NO: 1952808 - protein, 8 aa, Staphylococcus
KAAEQGAD

SEQ ID NO: 1952809 - protein, 8 aa, Staphylococcus
KAAESGPF

SEQ ID NO: 1952810 - protein, 5 aa, Staphylococcus
KAAGA

SEQ ID NO: 1952811 - protein, 6 aa, Staphylococcus
KAAGES

SEQ ID NO: 1952812 - protein, 9 aa, Staphylococcus
KAAGLAEEV

SEQ ID NO: 1952813 - protein, 8 aa, Staphylococcus
KAAGYEEQ

SEQ ID NO: 1952814 - protein, 16 aa, Staphylococcus
KAAHGYGGKQTPKVTS

SEQ ID NO: 1952815 - protein, 12 aa, Staphylococcus
KAAHNATFWEGL

SEQ ID NO: 1952816 - protein, 20 aa, Staphylococcus
KAAHPKHGVKAQTATGKVQK

SEQ ID NO: 1952817 - protein, 7 aa, Staphylococcus
KAAIEKV

SEQ ID NO: 1952818 - protein, 7 aa, Staphylococcus
KAAKDIK

SEQ ID NO: 1952819 - protein, 8 aa, Staphylococcus
KAAKEMKA

SEQ ID NO: 1952820 - protein, 13 aa, Staphylococcus
KAAKESTKTGKPI

SEQ ID NO: 1952821 - protein, 20 aa, Staphylococcus
KAANPKHGVKSKEAAGKVQK

SEQ ID NO: 1952822 - protein, 22 aa, Staphylococcus
KAANPKHGVKSKEAAGKVQTLD

SEQ ID NO: 1952823 - protein, 12 aa, Staphylococcus
KAANTQSFWEGL

SEQ ID NO: 1952824 - protein, 8 aa, Staphylococcus
KAAQEGYT

SEQ ID NO: 1952825 - protein, 6 aa, Staphylococcus
KAAQLA

SEQ ID NO: 1952826 - protein, 8 aa, Staphylococcus
KAAQPDDI

SEQ ID NO: 1952827 - protein, 9 aa, Staphylococcus
KAAQQNGDL

SEQ ID NO: 1952828 - protein, 16 aa, Staphylococcus
KAAQSSSNIVEQLVKE

SEQ ID NO: 1952829 - protein, 5 aa, Staphylococcus
KAAQT

SEQ ID NO: 1952830 - protein, 20 aa, Staphylococcus
KAAQVQGKFSRQSGGRGQYG

SEQ ID NO: 1952831 - protein, 7 aa, Staphylococcus
KAARDHA

SEQ ID NO: 1952832 - protein, 16 aa, Staphylococcus
KAARDRVKNLEYTQHL

SEQ ID NO: 1952833 - protein, 17 aa, Staphylococcus
KAAREKEAKRVKQMMQD

SEQ ID NO: 1952834 - protein, 18 aa, Staphylococcus
KAAREKEAKRVKQMMQDN

SEQ ID NO: 1952835 - protein, 8 aa, Staphylococcus
KAAREMKE

SEQ ID NO: 1952836 - protein, 16 aa, Staphylococcus
KAARERVKNLEYTQHL

SEQ ID NO: 1952837 - protein, 16 aa, Staphylococcus
KAARHRVKNIEYTQHL

SEQ ID NO: 1952838 - protein, 8 aa, Staphylococcus
KAARKPLI

SEQ ID NO: 1952839 - protein, 5 aa, Staphylococcus
KAARN

SEQ ID NO: 1952840 - protein, 9 aa, Staphylococcus
KAAVTNMTR

SEQ ID NO: 1952841 - protein, 7 aa, Staphylococcus
KADCGEV

SEQ ID NO: 1952842 - protein, 8 aa, Staphylococcus
KADDFETK

SEQ ID NO: 1952843 - protein, 8 aa, Staphylococcus
KADDNAEF

SEQ ID NO: 1952844 - protein, 8 aa, Staphylococcus
KADDNGEF

SEQ ID NO: 1952845 - protein, 8 aa, Staphylococcus
KADDQRYK

SEQ ID NO: 1952846 - protein, 7 aa, Staphylococcus
KADDTFH

SEQ ID NO: 1952847 - protein, 11 aa, Staphylococcus
KADEKSITGNV

SEQ ID NO: 1952848 - protein, 8 aa, Staphylococcus
KADEQFKQ

SEQ ID NO: 1952849 - protein, 8 aa, Staphylococcus
KADEQTTL

SEQ ID NO: 1952850 - protein, 6 aa, Staphylococcus
KADESY

SEQ ID NO: 1952851 - protein, 14 aa, Staphylococcus
KADGKKFGKSEAGT

SEQ ID NO: 1952852 - protein, 6 aa, Staphylococcus
KADGRV

SEQ ID NO: 1952853 - protein, 4 aa, Staphylococcus
KADH

SEQ ID NO: 1952854 - protein, 6 aa, Staphylococcus
KADIPR

SEQ ID NO: 1952855 - protein, 7 aa, Staphylococcus
KADKDYL

SEQ ID NO: 1952856 - protein, 6 aa, Staphylococcus
KADKTE

SEQ ID NO: 1952857 - protein, 19 aa, Staphylococcus
KADMKNNNATPKLDVDPQT

SEQ ID NO: 1952858 - protein, 19 aa, Staphylococcus
KADMKNNSATPKLDVDPQT

SEQ ID NO: 1952859 - protein, 10 aa, Staphylococcus
KADNEIEIKG

SEQ ID NO: 1952860 - protein, 9 aa, Staphylococcus
KADNLKDAR

SEQ ID NO: 1952861 - protein, 5 aa, Staphylococcus
KADPA

SEQ ID NO: 1952862 - protein, 12 aa, Staphylococcus
KADPEVDGTKSE

SEQ ID NO: 1952863 - protein, 12 aa, Staphylococcus
KADPEVDGTKTE

SEQ ID NO: 1952864 - protein, 12 aa, Staphylococcus
KADPSIDGTNSE

SEQ ID NO: 1952865 - protein, 19 aa, Staphylococcus
KADPTFKQEVENLEKEIRN

SEQ ID NO: 1952866 - protein, 8 aa, Staphylococcus
KADPTLKY

SEQ ID NO: 1952867 - protein, 8 aa, Staphylococcus
KADQGEDV

SEQ ID NO: 1952868 - protein, 14 aa, Staphylococcus
KADRDKLKQQLSDI

SEQ ID NO: 1952869 - protein, 8 aa, Staphylococcus
KADSIKEG

SEQ ID NO: 1952870 - protein, 7 aa, Staphylococcus
KADTLAR

SEQ ID NO: 1952871 - protein, 7 aa, Staphylococcus
KADTNLK

SEQ ID NO: 1952872 - protein, 17 aa, Staphylococcus
KADTTYQTKDKSSEDVF

SEQ ID NO: 1952873 - protein, 7 aa, Staphylococcus
KADVTKP

SEQ ID NO: 1952874 - protein, 5 aa, Staphylococcus
KADYE

SEQ ID NO: 1952875 - protein, 7 aa, Staphylococcus
KADYPIN

SEQ ID NO: 1952876 - protein, 10 aa, Staphylococcus
KAEAEKKYKK

SEQ ID NO: 1952877 - protein, 11 aa, Staphylococcus
KAEAEKKYKKY

SEQ ID NO: 1952878 - protein, 17 aa, Staphylococcus
KAEAEVAEALSDEEITY

SEQ ID NO: 1952879 - protein, 7 aa, Staphylococcus
KAEATEV

SEQ ID NO: 1952880 - protein, 8 aa, Staphylococcus
KAEDPFTC

SEQ ID NO: 1952881 - protein, 6 aa, Staphylococcus
KAEDPL

SEQ ID NO: 1952882 - protein, 9 aa, Staphylococcus
KAEEPIESL

SEQ ID NO: 1952883 - protein, 5 aa, Staphylococcus
KAEEY

SEQ ID NO: 1952884 - protein, 4 aa, Staphylococcus
KAEF

SEQ ID NO: 1952885 - protein, 6 aa, Staphylococcus
KAEFPE

SEQ ID NO: 1952886 - protein, 7 aa, Staphylococcus
KAEFPEV

SEQ ID NO: 1952887 - protein, 4 aa, Staphylococcus
KAEG

SEQ ID NO: 1952888 - protein, 15 aa, Staphylococcus
KAEGIPAKLSNTAGT

SEQ ID NO: 1952889 - protein, 19 aa, Staphylococcus
KAEGLVSGAAHSTGDTVRP

SEQ ID NO: 1952890 - protein, 5 aa, Staphylococcus
KAEIP

SEQ ID NO: 1952891 - protein, 4 aa, Staphylococcus
KAEK

SEQ ID NO: 1952892 - protein, 10 aa, Staphylococcus
KAEKADTDLG

SEQ ID NO: 1952893 - protein, 10 aa, Staphylococcus
KAEKDDTDLG

SEQ ID NO: 1952894 - protein, 8 aa, Staphylococcus
KAEKGADA

SEQ ID NO: 1952895 - protein, 4 aa, Staphylococcus
KAEL

SEQ ID NO: 1952896 - protein, 12 aa, Staphylococcus
KAELGKKYSHPS

SEQ ID NO: 1952897 - protein, 8 aa, Staphylococcus
KAENGEVE

SEQ ID NO: 1952898 - protein, 8 aa, Staphylococcus
KAENLDEA

SEQ ID NO: 1952899 - protein, 8 aa, Staphylococcus
KAEPDKYI

SEQ ID NO: 1952900 - protein, 6 aa, Staphylococcus
KAEQAI

SEQ ID NO: 1952901 - protein, 9 aa, Staphylococcus
KAEQQPKDL

SEQ ID NO: 1952902 - protein, 11 aa, Staphylococcus
KAEQSLNNTPN

SEQ ID NO: 1952903 - protein, 6 aa, Staphylococcus
KAEQYN

SEQ ID NO: 1952904 - protein, 24 aa, Staphylococcus
KAEREGKIQPGDTIVEPTSGNTGI

SEQ ID NO: 1952905 - protein, 10 aa, Staphylococcus
KAERKPDRKM

SEQ ID NO: 1952906 - protein, 7 aa, Staphylococcus
KAERPKY

SEQ ID NO: 1952907 - protein, 12 aa, Staphylococcus
KAERQKMETAQN

SEQ ID NO: 1952908 - protein, 17 aa, Staphylococcus
KAETEVAEALSGEDLTY

SEQ ID NO: 1952909 - protein, 10 aa, Staphylococcus
KAETLKGERP

SEQ ID NO: 1952910 - protein, 17 aa, Staphylococcus
KAETNNKKLDDTQQLKE

SEQ ID NO: 1952911 - protein, 6 aa, Staphylococcus
KAETSG

SEQ ID NO: 1952912 - protein, 8 aa, Staphylococcus
KAEVPKGE

SEQ ID NO: 1952913 - protein, 12 aa, Staphylococcus
KAEYIDGSNIKA

SEQ ID NO: 1952914 - protein, 7 aa, Staphylococcus
KAFAKEA

SEQ ID NO: 1952915 - protein, 10 aa, Staphylococcus
KAFASSGRYG

SEQ ID NO: 1952916 - protein, 4 aa, Staphylococcus
KAFD

SEQ ID NO: 1952917 - protein, 9 aa, Staphylococcus
KAFDGRGNY

SEQ ID NO: 1952918 - protein, 5 aa, Staphylococcus
KAFDI

SEQ ID NO: 1952919 - protein, 17 aa, Staphylococcus
KAFDSDPKNIAEDRNSL

SEQ ID NO: 1952920 - protein, 5 aa, Staphylococcus
KAFDV

SEQ ID NO: 1952921 - protein, 7 aa, Staphylococcus
KAFEDAD

SEQ ID NO: 1952922 - protein, 6 aa, Staphylococcus
KAFGDA

SEQ ID NO: 1952923 - protein, 18 aa, Staphylococcus
KAFGDEGLKSSLHDTEKE

SEQ ID NO: 1952924 - protein, 5 aa, Staphylococcus
KAFKQ

SEQ ID NO: 1952925 - protein, 5 aa, Staphylococcus
KAFKS

SEQ ID NO: 1952926 - protein, 10 aa, Staphylococcus
KAFNKQYTER

SEQ ID NO: 1952927 - protein, 4 aa, Staphylococcus
KAFP

SEQ ID NO: 1952928 - protein, 11 aa, Staphylococcus
KAFPGQPSVAH

SEQ ID NO: 1952929 - protein, 17 aa, Staphylococcus
KAFPGQPSVAHDSDIDG

SEQ ID NO: 1952930 - protein, 18 aa, Staphylococcus
KAFPGQPSVAHDSDIPGL

SEQ ID NO: 1952931 - protein, 17 aa, Staphylococcus
KAFPGQPSVAHDSNLEG

SEQ ID NO: 1952932 - protein, 7 aa, Staphylococcus
KAFQPDG

SEQ ID NO: 1952933 - protein, 12 aa, Staphylococcus
KAFSEGKTDTPL

SEQ ID NO: 1952934 - protein, 6 aa, Staphylococcus
KAFSEN

SEQ ID NO: 1952935 - protein, 9 aa, Staphylococcus
KAFSSEGPA

SEQ ID NO: 1952936 - protein, 13 aa, Staphylococcus
KAGAAHTWIEHLG

SEQ ID NO: 1952937 - protein, 13 aa, Staphylococcus
KAGAAHTWIENLG

SEQ ID NO: 1952938 - protein, 13 aa, Staphylococcus
KAGAQHTWIEKLG

SEQ ID NO: 1952939 - protein, 10 aa, Staphylococcus
KAGDFDSSKT

SEQ ID NO: 1952940 - protein, 5 aa, Staphylococcus
KAGDM

SEQ ID NO: 1952941 - protein, 6 aa, Staphylococcus
KAGDTI

SEQ ID NO: 1952942 - protein, 4 aa, Staphylococcus
KAGE

SEQ ID NO: 1952943 - protein, 7 aa, Staphylococcus
KAGEAEM

SEQ ID NO: 1952944 - protein, 7 aa, Staphylococcus
KAGFEPS

SEQ ID NO: 1952945 - protein, 6 aa, Staphylococcus
KAGGML

SEQ ID NO: 1952946 - protein, 10 aa, Staphylococcus
KAGGSKNPVE

SEQ ID NO: 1952947 - protein, 11 aa, Staphylococcus
KAGGSKSPVEL

SEQ ID NO: 1952948 - protein, 8 aa, Staphylococcus
KAGGSMSP

SEQ ID NO: 1952949 - protein, 9 aa, Staphylococcus
KAGGSMSPV

SEQ ID NO: 1952950 - protein, 10 aa, Staphylococcus
KAGGSQSPIE

SEQ ID NO: 1952951 - protein, 4 aa, Staphylococcus
KAGI

SEQ ID NO: 1952952 - protein, 5 aa, Staphylococcus
KAGID

SEQ ID NO: 1952953 - protein, 5 aa, Staphylococcus
KAGIE

SEQ ID NO: 1952954 - protein, 19 aa, Staphylococcus
KAGIEGLTKSSARELASRG

SEQ ID NO: 1952955 - protein, 7 aa, Staphylococcus
KAGIEKE

SEQ ID NO: 1952956 - protein, 8 aa, Staphylococcus
KAGIPADA

SEQ ID NO: 1952957 - protein, 10 aa, Staphylococcus
KAGKNPGKIR

SEQ ID NO: 1952958 - protein, 20 aa, Staphylococcus
KAGKTKKTGTKVTFKPDPEI

SEQ ID NO: 1952959 - protein, 19 aa, Staphylococcus
KAGKTKKTGTKVTFKPDSS

SEQ ID NO: 1952960 - protein, 16 aa, Staphylococcus
KAGKTLAKYASSQGQQ

SEQ ID NO: 1952961 - protein, 4 aa, Staphylococcus
KAGL

SEQ ID NO: 1952962 - protein, 7 aa, Staphylococcus
KAGLAVG

SEQ ID NO: 1952963 - protein, 9 aa, Staphylococcus
KAGLKGGGY

SEQ ID NO: 1952964 - protein, 7 aa, Staphylococcus
KAGLPEK

SEQ ID NO: 1952965 - protein, 12 aa, Staphylococcus
KAGLSAEGTQHR

SEQ ID NO: 1952966 - protein, 8 aa, Staphylococcus
KAGLSGQI

SEQ ID NO: 1952967 - protein, 17 aa, Staphylococcus
KAGMSPKSETAAKKGLP

SEQ ID NO: 1952968 - protein, 6 aa, Staphylococcus
KAGNGI

SEQ ID NO: 1952969 - protein, 9 aa, Staphylococcus
KAGNISNKT

SEQ ID NO: 1952970 - protein, 6 aa, Staphylococcus
KAGNKN

SEQ ID NO: 1952971 - protein, 11 aa, Staphylococcus
KAGNPKGERIT

SEQ ID NO: 1952972 - protein, 6 aa, Staphylococcus
KAGQKE

SEQ ID NO: 1952973 - protein, 11 aa, Staphylococcus
KAGQKGTGKWT

SEQ ID NO: 1952974 - protein, 5 aa, Staphylococcus
KAGQM

SEQ ID NO: 1952975 - protein, 8 aa, Staphylococcus
KAGSQISD

SEQ ID NO: 1952976 - protein, 6 aa, Staphylococcus
KAGTLN

SEQ ID NO: 1952977 - protein, 14 aa, Staphylococcus
KAGVPASLSNTAGT

SEQ ID NO: 1952978 - protein, 26 aa, Staphylococcus
KAGYETSAFATEKAGDATIEAERALS

SEQ ID NO: 1952979 - protein, 26 aa, Staphylococcus
KAGYETSAYATEREGDATLEAERALK

SEQ ID NO: 1952980 - protein, 5 aa, Staphylococcus
KAGYL

SEQ ID NO: 1952981 - protein, 6 aa, Staphylococcus
KAGYPV

SEQ ID NO: 1952982 - protein, 18 aa, Staphylococcus
KAGYVETKPYKGVKLSQE

SEQ ID NO: 1952983 - protein, 5 aa, Staphylococcus
KAHAQ

SEQ ID NO: 1952984 - protein, 12 aa, Staphylococcus
KAHASTPNKGVS

SEQ ID NO: 1952985 - protein, 14 aa, Staphylococcus
KAHDSKQITHANTT

SEQ ID NO: 1952986 - protein, 9 aa, Staphylococcus
KAHGGSNAR

SEQ ID NO: 1952987 - protein, 6 aa, Staphylococcus
KAHKTT

SEQ ID NO: 1952988 - protein, 5 aa, Staphylococcus
KAHNA

SEQ ID NO: 1952989 - protein, 12 aa, Staphylococcus
KAHNETDIADNA

SEQ ID NO: 1952990 - protein, 14 aa, Staphylococcus
KAHNETDIADNTVS

SEQ ID NO: 1952991 - protein, 19 aa, Staphylococcus
KAHNTRKTRTKKDDHLTTQ

SEQ ID NO: 1952992 - protein, 8 aa, Staphylococcus
KAHPQKKG

SEQ ID NO: 1952993 - protein, 10 aa, Staphylococcus
KAHQFESYDE

SEQ ID NO: 1952994 - protein, 9 aa, Staphylococcus
KAHQNSLDQ

SEQ ID NO: 1952995 - protein, 7 aa, Staphylococcus
KAHQQQE

SEQ ID NO: 1952996 - protein, 9 aa, Staphylococcus
KAIAGSTEY

SEQ ID NO: 1952997 - protein, 8 aa, Staphylococcus
KAIAGSTQ

SEQ ID NO: 1952998 - protein, 15 aa, Staphylococcus
KAIAKTGNTPGVTKQ

SEQ ID NO: 1952999 - protein, 5 aa, Staphylococcus
KAIDA

SEQ ID NO: 1953000 - protein, 9 aa, Staphylococcus
KAIDGHGEP

SEQ ID NO: 1953001 - protein, 10 aa, Staphylococcus
KAIDGQSGHI

SEQ ID NO: 1953002 - protein, 16 aa, Staphylococcus
KAIDSNPSLTADERKS

SEQ ID NO: 1953003 - protein, 7 aa, Staphylococcus
KAIEASK

SEQ ID NO: 1953004 - protein, 11 aa, Staphylococcus
KAIEASKKAGV

SEQ ID NO: 1953005 - protein, 6 aa, Staphylococcus
KAIEEG

SEQ ID NO: 1953006 - protein, 17 aa, Staphylococcus
KAIEETANDVIQIIESK

SEQ ID NO: 1953007 - protein, 6 aa, Staphylococcus
KAIEKG

SEQ ID NO: 1953008 - protein, 12 aa, Staphylococcus
KAIEKKDDKIPM

SEQ ID NO: 1953009 - protein, 12 aa, Staphylococcus
KAIEKKDSKIPM

SEQ ID NO: 1953010 - protein, 7 aa, Staphylococcus
KAIENEP

SEQ ID NO: 1953011 - protein, 10 aa, Staphylococcus
KAIESNDPIL

SEQ ID NO: 1953012 - protein, 8 aa, Staphylococcus
KAIGQDKK

SEQ ID NO: 1953013 - protein, 8 aa, Staphylococcus
KAIGTANT

SEQ ID NO: 1953014 - protein, 4 aa, Staphylococcus
KAII

SEQ ID NO: 1953015 - protein, 7 aa, Staphylococcus
KAIKKEG

SEQ ID NO: 1953016 - protein, 12 aa, Staphylococcus
KAIKNSSSEDIG

SEQ ID NO: 1953017 - protein, 6 aa, Staphylococcus
KAIPEE

SEQ ID NO: 1953018 - protein, 7 aa, Staphylococcus
KAIPGIP

SEQ ID NO: 1953019 - protein, 5 aa, Staphylococcus
KAIPR

SEQ ID NO: 1953020 - protein, 6 aa, Staphylococcus
KAIPRF

SEQ ID NO: 1953021 - protein, 15 aa, Staphylococcus
KAIQNNADALEQYKT

SEQ ID NO: 1953022 - protein, 15 aa, Staphylococcus
KAIQNNAEALDQYKT

SEQ ID NO: 1953023 - protein, 195 aa, Staphylococcus
KAIQTSTDEIKTTQSVIQDSQKEQSELAKSNVETEHVSTANTTTNNSDALTEHSTESASNDEKSDDKVTSTTSETVADTTDATASNPTDKSSAQVATEESEITQISEQPTETTTADTDASTSATKREMASAEQVKADDKTDETSTSSTDNSSINEEITKPNTQTQPTEDTHAQSSSVANDTPKEERKGFFARLFN

SEQ ID NO: 1953024 - protein, 4 aa, Staphylococcus
KAIR

SEQ ID NO: 1953025 - protein, 16 aa, Staphylococcus
KAIRDGKASHVQTVGK

SEQ ID NO: 1953026 - protein, 7 aa, Staphylococcus
KAISEEV

SEQ ID NO: 1953027 - protein, 12 aa, Staphylococcus
KAISKGLKNVPQ

SEQ ID NO: 1953028 - protein, 12 aa, Staphylococcus
KAITDYKSNDLA

SEQ ID NO: 1953029 - protein, 6 aa, Staphylococcus
KAITQN

SEQ ID NO: 1953030 - protein, 8 aa, Staphylococcus
KAITRPRD

SEQ ID NO: 1953031 - protein, 9 aa, Staphylococcus
KAITTSDDD

SEQ ID NO: 1953032 - protein, 4 aa, Staphylococcus
KAIV

SEQ ID NO: 1953033 - protein, 7 aa, Staphylococcus
KAKAGDK

SEQ ID NO: 1953034 - protein, 6 aa, Staphylococcus
KAKALG

SEQ ID NO: 1953035 - protein, 7 aa, Staphylococcus
KAKAQAD

SEQ ID NO: 1953036 - protein, 7 aa, Staphylococcus
KAKAVGA

SEQ ID NO: 1953037 - protein, 8 aa, Staphylococcus
KAKAYKKS

SEQ ID NO: 1953038 - protein, 11 aa, Staphylococcus
KAKDDQSKETY

SEQ ID NO: 1953039 - protein, 8 aa, Staphylococcus
KAKDGFNT

SEQ ID NO: 1953040 - protein, 9 aa, Staphylococcus
KAKDGRTFY

SEQ ID NO: 1953041 - protein, 9 aa, Staphylococcus
KAKDKEKGE

SEQ ID NO: 1953042 - protein, 7 aa, Staphylococcus
KAKDNSL

SEQ ID NO: 1953043 - protein, 31 aa, Staphylococcus
KAKDRPKRQHHRGGNNHHGKPAQSKPEDFEK

SEQ ID NO: 1953044 - protein, 29 aa, Staphylococcus
KAKDRPQRKPQHNNKSHQSKPAPKGEDFE

SEQ ID NO: 1953045 - protein, 29 aa, Staphylococcus
KAKDRPRKPHHNNKSNHGRPAQKTEDFEK

SEQ ID NO: 1953046 - protein, 28 aa, Staphylococcus
KAKDRPRRPHHKSNQNKPPQQKAEDFEK

SEQ ID NO: 1953047 - protein, 28 aa, Staphylococcus
KAKDRPRRPQHKSNHNRSPQQKGEDFEK

SEQ ID NO: 1953048 - protein, 9 aa, Staphylococcus
KAKDTGRDE

SEQ ID NO: 1953049 - protein, 12 aa, Staphylococcus
KAKDTLRQKGKI

SEQ ID NO: 1953050 - protein, 6 aa, Staphylococcus
KAKDYK

SEQ ID NO: 1953051 - protein, 8 aa, Staphylococcus
KAKEDGKK

SEQ ID NO: 1953052 - protein, 8 aa, Staphylococcus
KAKEEGKK

SEQ ID NO: 1953053 - protein, 10 aa, Staphylococcus
KAKEKSNEGK

SEQ ID NO: 1953054 - protein, 10 aa, Staphylococcus
KAKELGKGKT

SEQ ID NO: 1953055 - protein, 7 aa, Staphylococcus
KAKEYQD

SEQ ID NO: 1953056 - protein, 11 aa, Staphylococcus
KAKGSGKVKIG

SEQ ID NO: 1953057 - protein, 6 aa, Staphylococcus
KAKGVE

SEQ ID NO: 1953058 - protein, 8 aa, Staphylococcus
KAKGYTPK

SEQ ID NO: 1953059 - protein, 14 aa, Staphylococcus
KAKINASKYERQYQ

SEQ ID NO: 1953060 - protein, 8 aa, Staphylococcus
KAKKDDKY

SEQ ID NO: 1953061 - protein, 13 aa, Staphylococcus
KAKKDNHEIKGED

SEQ ID NO: 1953062 - protein, 7 aa, Staphylococcus
KAKKGRK

SEQ ID NO: 1953063 - protein, 9 aa, Staphylococcus
KAKKISNKK

SEQ ID NO: 1953064 - protein, 14 aa, Staphylococcus
KAKKKYNINEDVTP

SEQ ID NO: 1953065 - protein, 7 aa, Staphylococcus
KAKKNTI

SEQ ID NO: 1953066 - protein, 6 aa, Staphylococcus
KAKKYK

SEQ ID NO: 1953067 - protein, 5 aa, Staphylococcus
KAKLE

SEQ ID NO: 1953068 - protein, 12 aa, Staphylococcus
KAKLGQTENTQP

SEQ ID NO: 1953069 - protein, 18 aa, Staphylococcus
KAKLTSESFEISEKSDRM

SEQ ID NO: 1953070 - protein, 8 aa, Staphylococcus
KAKNEGIE

SEQ ID NO: 1953071 - protein, 12 aa, Staphylococcus
KAKNEGMSLKND

SEQ ID NO: 1953072 - protein, 8 aa, Staphylococcus
KAKNEGYR

SEQ ID NO: 1953073 - protein, 20 aa, Staphylococcus
KAKNPAHGSYRLPTETVTKY

SEQ ID NO: 1953074 - protein, 6 aa, Staphylococcus
KAKNYK

SEQ ID NO: 1953075 - protein, 8 aa, Staphylococcus
KAKPNTLN

SEQ ID NO: 1953076 - protein, 11 aa, Staphylococcus
KAKPSSSKGTY

SEQ ID NO: 1953077 - protein, 10 aa, Staphylococcus
KAKPSTLKDG

SEQ ID NO: 1953078 - protein, 10 aa, Staphylococcus
KAKPSTLKKG

SEQ ID NO: 1953079 - protein, 6 aa, Staphylococcus
KAKPTL

SEQ ID NO: 1953080 - protein, 10 aa, Staphylococcus
KAKQAADDIG

SEQ ID NO: 1953081 - protein, 7 aa, Staphylococcus
KAKQDLN

SEQ ID NO: 1953082 - protein, 8 aa, Staphylococcus
KAKQRMSD

SEQ ID NO: 1953083 - protein, 7 aa, Staphylococcus
KAKQSKL

SEQ ID NO: 1953084 - protein, 19 aa, Staphylococcus
KAKRGEGGQGSNMHGKNAE

SEQ ID NO: 1953085 - protein, 7 aa, Staphylococcus
KAKRGRK

SEQ ID NO: 1953086 - protein, 4 aa, Staphylococcus
KAKS

SEQ ID NO: 1953087 - protein, 7 aa, Staphylococcus
KAKSAGF

SEQ ID NO: 1953088 - protein, 7 aa, Staphylococcus
KAKSAGY

SEQ ID NO: 1953089 - protein, 8 aa, Staphylococcus
KAKSISVS

SEQ ID NO: 1953090 - protein, 9 aa, Staphylococcus
KAKSKEETE

SEQ ID NO: 1953091 - protein, 6 aa, Staphylococcus
KAKSLD

SEQ ID NO: 1953092 - protein, 10 aa, Staphylococcus
KAKSNEKRIT

SEQ ID NO: 1953093 - protein, 7 aa, Staphylococcus
KAKSQGC

SEQ ID NO: 1953094 - protein, 8 aa, Staphylococcus
KAKSSGVV

SEQ ID NO: 1953095 - protein, 13 aa, Staphylococcus
KAKSSNNEINGSD

SEQ ID NO: 1953096 - protein, 9 aa, Staphylococcus
KAKSTEKTL

SEQ ID NO: 1953097 - protein, 6 aa, Staphylococcus
KAKSTL

SEQ ID NO: 1953098 - protein, 7 aa, Staphylococcus
KAKSVGA

SEQ ID NO: 1953099 - protein, 8 aa, Staphylococcus
KAKSYSLG

SEQ ID NO: 1953100 - protein, 7 aa, Staphylococcus
KAKTGDQ

SEQ ID NO: 1953101 - protein, 13 aa, Staphylococcus
KAKTLNQENGQSF

SEQ ID NO: 1953102 - protein, 5 aa, Staphylococcus
KAKTR

SEQ ID NO: 1953103 - protein, 8 aa, Staphylococcus
KAKTYSLG

SEQ ID NO: 1953104 - protein, 4 aa, Staphylococcus
KAKY

SEQ ID NO: 1953105 - protein, 7 aa, Staphylococcus
KAKYITG

SEQ ID NO: 1953106 - protein, 7 aa, Staphylococcus
KAKYKNV

SEQ ID NO: 1953107 - protein, 5 aa, Staphylococcus
KAKYN

SEQ ID NO: 1953108 - protein, 5 aa, Staphylococcus
KAKYT

SEQ ID NO: 1953109 - protein, 8 aa, Staphylococcus
KALAEAGA

SEQ ID NO: 1953110 - protein, 6 aa, Staphylococcus
KALAES

SEQ ID NO: 1953111 - protein, 10 aa, Staphylococcus
KALAGLSDEQ

SEQ ID NO: 1953112 - protein, 9 aa, Staphylococcus
KALDLTNKT

SEQ ID NO: 1953113 - protein, 7 aa, Staphylococcus
KALEDDE

SEQ ID NO: 1953114 - protein, 11 aa, Staphylococcus
KALEGDADYEQ

SEQ ID NO: 1953115 - protein, 10 aa, Staphylococcus
KALEGDEKYE

SEQ ID NO: 1953116 - protein, 11 aa, Staphylococcus
KALEGDEKYEE

SEQ ID NO: 1953117 - protein, 10 aa, Staphylococcus
KALEGLSEEQ

SEQ ID NO: 1953118 - protein, 7 aa, Staphylococcus
KALGEYA

SEQ ID NO: 1953119 - protein, 7 aa, Staphylococcus
KALGTGL

SEQ ID NO: 1953120 - protein, 9 aa, Staphylococcus
KALGTGLGQ

SEQ ID NO: 1953121 - protein, 7 aa, Staphylococcus
KALKDKQ

SEQ ID NO: 1953122 - protein, 13 aa, Staphylococcus
KALNAAQEVTKSV

SEQ ID NO: 1953123 - protein, 14 aa, Staphylococcus
KALNEAQEITKSVP

SEQ ID NO: 1953124 - protein, 14 aa, Staphylococcus
KALNEAQEVTKSVP

SEQ ID NO: 1953125 - protein, 6 aa, Staphylococcus
KALNEE

SEQ ID NO: 1953126 - protein, 8 aa, Staphylococcus
KALNKDQV

SEQ ID NO: 1953127 - protein, 6 aa, Staphylococcus
KALNTT

SEQ ID NO: 1953128 - protein, 4 aa, Staphylococcus
KALP

SEQ ID NO: 1953129 - protein, 5 aa, Staphylococcus
KALPE

SEQ ID NO: 1953130 - protein, 6 aa, Staphylococcus
KALPKE

SEQ ID NO: 1953131 - protein, 6 aa, Staphylococcus
KALPSE

SEQ ID NO: 1953132 - protein, 6 aa, Staphylococcus
KALQNK

SEQ ID NO: 1953133 - protein, 7 aa, Staphylococcus
KALQRQD

SEQ ID NO: 1953134 - protein, 20 aa, Staphylococcus
KALREADYSNSEIDKQQLSK

SEQ ID NO: 1953135 - protein, 5 aa, Staphylococcus
KALRS

SEQ ID NO: 1953136 - protein, 8 aa, Staphylococcus
KALSDETV

SEQ ID NO: 1953137 - protein, 6 aa, Staphylococcus
KALSEK

SEQ ID NO: 1953138 - protein, 12 aa, Staphylococcus
KALSSALGKTVG

SEQ ID NO: 1953139 - protein, 12 aa, Staphylococcus
KALTDKVKAGDI

SEQ ID NO: 1953140 - protein, 6 aa, Staphylococcus
KALTDS

SEQ ID NO: 1953141 - protein, 5 aa, Staphylococcus
KALTE

SEQ ID NO: 1953142 - protein, 15 aa, Staphylococcus
KALTFSKEDREEVAD

SEQ ID NO: 1953143 - protein, 5 aa, Staphylococcus
KALTT

SEQ ID NO: 1953144 - protein, 18 aa, Staphylococcus
KALYDPNTFKSNIDKNDV

SEQ ID NO: 1953145 - protein, 7 aa, Staphylococcus
KALYGDK

SEQ ID NO: 1953146 - protein, 6 aa, Staphylococcus
KAMEGL

SEQ ID NO: 1953147 - protein, 18 aa, Staphylococcus
KAMKNAADESFGYTEDEI

SEQ ID NO: 1953148 - protein, 15 aa, Staphylococcus
KAMKNASNESFGYTE

SEQ ID NO: 1953149 - protein, 6 aa, Staphylococcus
KAMNRY

SEQ ID NO: 1953150 - protein, 4 aa, Staphylococcus
KAMP

SEQ ID NO: 1953151 - protein, 6 aa, Staphylococcus
KAMQEA

SEQ ID NO: 1953152 - protein, 24 aa, Staphylococcus
KAMQNGREKISRSEVEETVEEIQK

SEQ ID NO: 1953153 - protein, 14 aa, Staphylococcus
KAMQTKAQNDERVK

SEQ ID NO: 1953154 - protein, 5 aa, Staphylococcus
KAMRT

SEQ ID NO: 1953155 - protein, 9 aa, Staphylococcus
KAMTGHQAG

SEQ ID NO: 1953156 - protein, 9 aa, Staphylococcus
KANADADRI

SEQ ID NO: 1953157 - protein, 6 aa, Staphylococcus
KANANR

SEQ ID NO: 1953158 - protein, 8 aa, Staphylococcus
KANAPSHY

SEQ ID NO: 1953159 - protein, 13 aa, Staphylococcus
KANARASHTGDQA

SEQ ID NO: 1953160 - protein, 14 aa, Staphylococcus
KANDDGEPTGTAGV

SEQ ID NO: 1953161 - protein, 5 aa, Staphylococcus
KANDF

SEQ ID NO: 1953162 - protein, 7 aa, Staphylococcus
KANDQLA

SEQ ID NO: 1953163 - protein, 4 aa, Staphylococcus
KANE

SEQ ID NO: 1953164 - protein, 7 aa, Staphylococcus
KANEASQ

SEQ ID NO: 1953165 - protein, 5 aa, Staphylococcus
KANEG

SEQ ID NO: 1953166 - protein, 8 aa, Staphylococcus
KANENEEK

SEQ ID NO: 1953167 - protein, 8 aa, Staphylococcus
KANENGTF

SEQ ID NO: 1953168 - protein, 5 aa, Staphylococcus
KANEP

SEQ ID NO: 1953169 - protein, 8 aa, Staphylococcus
KANERIAG

SEQ ID NO: 1953170 - protein, 36 aa, Staphylococcus
KANESKSEYKGNDQRQSRKRYSKSREIVSREKTPKW

SEQ ID NO: 1953171 - protein, 15 aa, Staphylococcus
KANGELLQKPKERFA

SEQ ID NO: 1953172 - protein, 16 aa, Staphylococcus
KANGTGFLSEPNASDM

SEQ ID NO: 1953173 - protein, 14 aa, Staphylococcus
KANGVSKNKKLSLS

SEQ ID NO: 1953174 - protein, 28 aa, Staphylococcus
KANGVTTSAQPQQSKRSTTKSSQSKNAF

SEQ ID NO: 1953175 - protein, 6 aa, Staphylococcus
KANINT

SEQ ID NO: 1953176 - protein, 17 aa, Staphylococcus
KANKELAAKAVDAAKEA

SEQ ID NO: 1953177 - protein, 8 aa, Staphylococcus
KANKREIP

SEQ ID NO: 1953178 - protein, 7 aa, Staphylococcus
KANKRQI

SEQ ID NO: 1953179 - protein, 8 aa, Staphylococcus
KANLKNKI

SEQ ID NO: 1953180 - protein, 7 aa, Staphylococcus
KANNETI

SEQ ID NO: 1953181 - protein, 12 aa, Staphylococcus
KANPEEDGTASE

SEQ ID NO: 1953182 - protein, 16 aa, Staphylococcus
KANPYQPRKTFDDDRL

SEQ ID NO: 1953183 - protein, 16 aa, Staphylococcus
KANPYQPRKTFDEEKL

SEQ ID NO: 1953184 - protein, 16 aa, Staphylococcus
KANPYQPRKTFDEERL

SEQ ID NO: 1953185 - protein, 6 aa, Staphylococcus
KANQLS

SEQ ID NO: 1953186 - protein, 6 aa, Staphylococcus
KANQTY

SEQ ID NO: 1953187 - protein, 5 aa, Staphylococcus
KANRD

SEQ ID NO: 1953188 - protein, 19 aa, Staphylococcus
KANRGKTGYEITNGPGKWT

SEQ ID NO: 1953189 - protein, 7 aa, Staphylococcus
KANSERL

SEQ ID NO: 1953190 - protein, 10 aa, Staphylococcus
KANTDNPTGN

SEQ ID NO: 1953191 - protein, 4 aa, Staphylococcus
KANV

SEQ ID NO: 1953192 - protein, 7 aa, Staphylococcus
KANVEKG

SEQ ID NO: 1953193 - protein, 8 aa, Staphylococcus
KANVEKGD

SEQ ID NO: 1953194 - protein, 24 aa, Staphylococcus
KANYKKNALEKAKDYADTQDMSND

SEQ ID NO: 1953195 - protein, 7 aa, Staphylococcus
KAPEEND

SEQ ID NO: 1953196 - protein, 9 aa, Staphylococcus
KAPEGESYN

SEQ ID NO: 1953197 - protein, 4 aa, Staphylococcus
KAPF

SEQ ID NO: 1953198 - protein, 8 aa, Staphylococcus
KAPHPDAD

SEQ ID NO: 1953199 - protein, 5 aa, Staphylococcus
KAPHR

SEQ ID NO: 1953200 - protein, 11 aa, Staphylococcus
KAPIGSPRPRF

SEQ ID NO: 1953201 - protein, 9 aa, Staphylococcus
KAPKGESYR

SEQ ID NO: 1953202 - protein, 10 aa, Staphylococcus
KAPKNISAEQ

SEQ ID NO: 1953203 - protein, 15 aa, Staphylococcus
KAPKNISAQASASLP

SEQ ID NO: 1953204 - protein, 15 aa, Staphylococcus
KAPKNLSAEQAASLP

SEQ ID NO: 1953205 - protein, 5 aa, Staphylococcus
KAPLN

SEQ ID NO: 1953206 - protein, 6 aa, Staphylococcus
KAPNAY

SEQ ID NO: 1953207 - protein, 9 aa, Staphylococcus
KAPNEDPHI

SEQ ID NO: 1953208 - protein, 7 aa, Staphylococcus
KAPNLEG

SEQ ID NO: 1953209 - protein, 13 aa, Staphylococcus
KAPNRDPRDEFET

SEQ ID NO: 1953210 - protein, 17 aa, Staphylococcus
KAPQMAKGEDKETTKAG

SEQ ID NO: 1953211 - protein, 13 aa, Staphylococcus
KAPRKKSNQKHET

SEQ ID NO: 1953212 - protein, 14 aa, Staphylococcus
KAPSNLKPEQAASL

SEQ ID NO: 1953213 - protein, 10 aa, Staphylococcus
KAPSSKVGDL

SEQ ID NO: 1953214 - protein, 9 aa, Staphylococcus
KAPSSTVGD

SEQ ID NO: 1953215 - protein, 5 aa, Staphylococcus
KAPTI

SEQ ID NO: 1953216 - protein, 7 aa, Staphylococcus
KAPTLND

SEQ ID NO: 1953217 - protein, 4 aa, Staphylococcus
KAQA

SEQ ID NO: 1953218 - protein, 11 aa, Staphylococcus
KAQANAYAPYS

SEQ ID NO: 1953219 - protein, 6 aa, Staphylococcus
KAQAQA

SEQ ID NO: 1953220 - protein, 4 aa, Staphylococcus
KAQD

SEQ ID NO: 1953221 - protein, 5 aa, Staphylococcus
KAQDD

SEQ ID NO: 1953222 - protein, 6 aa, Staphylococcus
KAQDDF

SEQ ID NO: 1953223 - protein, 6 aa, Staphylococcus
KAQDEL

SEQ ID NO: 1953224 - protein, 6 aa, Staphylococcus
KAQDII

SEQ ID NO: 1953225 - protein, 14 aa, Staphylococcus
KAQDNKKVPDFDES

SEQ ID NO: 1953226 - protein, 8 aa, Staphylococcus
KAQDQYNA

SEQ ID NO: 1953227 - protein, 12 aa, Staphylococcus
KAQDVIDKNNAL

SEQ ID NO: 1953228 - protein, 7 aa, Staphylococcus
KAQEDDD

SEQ ID NO: 1953229 - protein, 17 aa, Staphylococcus
KAQEEKVSEYGIEKANG

SEQ ID NO: 1953230 - protein, 7 aa, Staphylococcus
KAQEKGV

SEQ ID NO: 1953231 - protein, 8 aa, Staphylococcus
KAQEKTKR

SEQ ID NO: 1953232 - protein, 6 aa, Staphylococcus
KAQGAR

SEQ ID NO: 1953233 - protein, 7 aa, Staphylococcus
KAQGEGT

SEQ ID NO: 1953234 - protein, 18 aa, Staphylococcus
KAQGEKVSEYGIETSDGQ

SEQ ID NO: 1953235 - protein, 5 aa, Staphylococcus
KAQGH

SEQ ID NO: 1953236 - protein, 29 aa, Staphylococcus
KAQGISQSNNKHTQTNTHSRSKRQSKAAF

SEQ ID NO: 1953237 - protein, 11 aa, Staphylococcus
KAQGKKAKWID

SEQ ID NO: 1953238 - protein, 6 aa, Staphylococcus
KAQGSE

SEQ ID NO: 1953239 - protein, 28 aa, Staphylococcus
KAQGVSNSGQTQQPKKPTRTVQRSKNAF

SEQ ID NO: 1953240 - protein, 5 aa, Staphylococcus
KAQGY

SEQ ID NO: 1953241 - protein, 7 aa, Staphylococcus
KAQGYAD

SEQ ID NO: 1953242 - protein, 5 aa, Staphylococcus
KAQHE

SEQ ID NO: 1953243 - protein, 8 aa, Staphylococcus
KAQKDSDN

SEQ ID NO: 1953244 - protein, 19 aa, Staphylococcus
KAQKEKLNDLNENKEAIRA

SEQ ID NO: 1953245 - protein, 6 aa, Staphylococcus
KAQKGD

SEQ ID NO: 1953246 - protein, 6 aa, Staphylococcus
KAQKIG

SEQ ID NO: 1953247 - protein, 5 aa, Staphylococcus
KAQKY

SEQ ID NO: 1953248 - protein, 7 aa, Staphylococcus
KAQNDGV

SEQ ID NO: 1953249 - protein, 7 aa, Staphylococcus
KAQNDYH

SEQ ID NO: 1953250 - protein, 25 aa, Staphylococcus
KAQNEDFTAGVRKEEQVSKLQDEGI

SEQ ID NO: 1953251 - protein, 18 aa, Staphylococcus
KAQNEKISEYGIEQQDGS

SEQ ID NO: 1953252 - protein, 17 aa, Staphylococcus
KAQNEKVSEYGIEQQDG

SEQ ID NO: 1953253 - protein, 8 aa, Staphylococcus
KAQNLDEA

SEQ ID NO: 1953254 - protein, 7 aa, Staphylococcus
KAQNNHY

SEQ ID NO: 1953255 - protein, 7 aa, Staphylococcus
KAQNQLE

SEQ ID NO: 1953256 - protein, 10 aa, Staphylococcus
KAQQKELNEK

SEQ ID NO: 1953257 - protein, 11 aa, Staphylococcus
KAQQQDATQTD

SEQ ID NO: 1953258 - protein, 7 aa, Staphylococcus
KAQQRAY

SEQ ID NO: 1953259 - protein, 6 aa, Staphylococcus
KAQQSN

SEQ ID NO: 1953260 - protein, 9 aa, Staphylococcus
KAQRAEQYE

SEQ ID NO: 1953261 - protein, 8 aa, Staphylococcus
KAQRQKEA

SEQ ID NO: 1953262 - protein, 6 aa, Staphylococcus
KAQSIG

SEQ ID NO: 1953263 - protein, 6 aa, Staphylococcus
KAQSQK

SEQ ID NO: 1953264 - protein, 5 aa, Staphylococcus
KAQSR

SEQ ID NO: 1953265 - protein, 7 aa, Staphylococcus
KAQSSGV

SEQ ID NO: 1953266 - protein, 6 aa, Staphylococcus
KAQTVG

SEQ ID NO: 1953267 - protein, 7 aa, Staphylococcus
KAQVQAD

SEQ ID NO: 1953268 - protein, 24 aa, Staphylococcus
KARAQFEQGTIDQEALSKAEDEEI

SEQ ID NO: 1953269 - protein, 7 aa, Staphylococcus
KARATAI

SEQ ID NO: 1953270 - protein, 7 aa, Staphylococcus
KARATAL

SEQ ID NO: 1953271 - protein, 16 aa, Staphylococcus
KARDGKLSADEMKGAT

SEQ ID NO: 1953272 - protein, 16 aa, Staphylococcus
KARDGKLTSDEMKGAS

SEQ ID NO: 1953273 - protein, 16 aa, Staphylococcus
KARDGKLTSEEMKGAT

SEQ ID NO: 1953274 - protein, 16 aa, Staphylococcus
KARDGKLTSQEMSGAT

SEQ ID NO: 1953275 - protein, 9 aa, Staphylococcus
KARDKKLGL

SEQ ID NO: 1953276 - protein, 6 aa, Staphylococcus
KARDLN

SEQ ID NO: 1953277 - protein, 8 aa, Staphylococcus
KARDNKLS

SEQ ID NO: 1953278 - protein, 10 aa, Staphylococcus
KAREDDIKDK

SEQ ID NO: 1953279 - protein, 10 aa, Staphylococcus
KAREEDIKDK

SEQ ID NO: 1953280 - protein, 13 aa, Staphylococcus
KAREELSSEDLEQ

SEQ ID NO: 1953281 - protein, 7 aa, Staphylococcus
KARELNK

SEQ ID NO: 1953282 - protein, 10 aa, Staphylococcus
KARENDIKGK

SEQ ID NO: 1953283 - protein, 4 aa, Staphylococcus
KARF

SEQ ID NO: 1953284 - protein, 7 aa, Staphylococcus
KARGDAN

SEQ ID NO: 1953285 - protein, 35 aa, Staphylococcus
KARGIDDSPVKSSRIRKSVGTERTFATDVNDDDEI

SEQ ID NO: 1953286 - protein, 7 aa, Staphylococcus
KARGTKR

SEQ ID NO: 1953287 - protein, 10 aa, Staphylococcus
KARIQDYGEA

SEQ ID NO: 1953288 - protein, 7 aa, Staphylococcus
KARKEVD

SEQ ID NO: 1953289 - protein, 9 aa, Staphylococcus
KARKSIRKN

SEQ ID NO: 1953290 - protein, 5 aa, Staphylococcus
KARLR

SEQ ID NO: 1953291 - protein, 6 aa, Staphylococcus
KARLRG

SEQ ID NO: 1953292 - protein, 7 aa, Staphylococcus
KARNFQE

SEQ ID NO: 1953293 - protein, 5 aa, Staphylococcus
KARNI

SEQ ID NO: 1953294 - protein, 8 aa, Staphylococcus
KARNSDTD

SEQ ID NO: 1953295 - protein, 6 aa, Staphylococcus
KARPSF

SEQ ID NO: 1953296 - protein, 6 aa, Staphylococcus
KARQLN

SEQ ID NO: 1953297 - protein, 5 aa, Staphylococcus
KARQM

SEQ ID NO: 1953298 - protein, 6 aa, Staphylococcus
KARQQI

SEQ ID NO: 1953299 - protein, 17 aa, Staphylococcus
KARSTKQQARKNRFNDL

SEQ ID NO: 1953300 - protein, 13 aa, Staphylococcus
KARTNGERTETWS

SEQ ID NO: 1953301 - protein, 6 aa, Staphylococcus
KARYGE

SEQ ID NO: 1953302 - protein, 7 aa, Staphylococcus
KASANIF

SEQ ID NO: 1953303 - protein, 14 aa, Staphylococcus
KASANIFETDSETM

SEQ ID NO: 1953304 - protein, 12 aa, Staphylococcus
KASDDSRTTTHV

SEQ ID NO: 1953305 - protein, 7 aa, Staphylococcus
KASDEDV

SEQ ID NO: 1953306 - protein, 7 aa, Staphylococcus
KASDSAG

SEQ ID NO: 1953307 - protein, 16 aa, Staphylococcus
KASEAPSHISGQQDNN

SEQ ID NO: 1953308 - protein, 9 aa, Staphylococcus
KASEDTQYE

SEQ ID NO: 1953309 - protein, 7 aa, Staphylococcus
KASEEHN

SEQ ID NO: 1953310 - protein, 8 aa, Staphylococcus
KASEENEW

SEQ ID NO: 1953311 - protein, 7 aa, Staphylococcus
KASEGTI

SEQ ID NO: 1953312 - protein, 8 aa, Staphylococcus
KASEGTIA

SEQ ID NO: 1953313 - protein, 8 aa, Staphylococcus
KASEGTMN

SEQ ID NO: 1953314 - protein, 6 aa, Staphylococcus
KASEHA

SEQ ID NO: 1953315 - protein, 8 aa, Staphylococcus
KASEHATR

SEQ ID NO: 1953316 - protein, 7 aa, Staphylococcus
KASEIKN

SEQ ID NO: 1953317 - protein, 9 aa, Staphylococcus
KASENNEYD

SEQ ID NO: 1953318 - protein, 18 aa, Staphylococcus
KASESDLQGTTGYGYDDI

SEQ ID NO: 1953319 - protein, 10 aa, Staphylococcus
KASEVDDELD

SEQ ID NO: 1953320 - protein, 5 aa, Staphylococcus
KASFS

SEQ ID NO: 1953321 - protein, 20 aa, Staphylococcus
KASFTPSEASAIADALGQIR

SEQ ID NO: 1953322 - protein, 9 aa, Staphylococcus
KASGGVRSL

SEQ ID NO: 1953323 - protein, 17 aa, Staphylococcus
KASGNQKESKIAKEIEK

SEQ ID NO: 1953324 - protein, 6 aa, Staphylococcus
KASGQS

SEQ ID NO: 1953325 - protein, 6 aa, Staphylococcus
KASGVD

SEQ ID NO: 1953326 - protein, 5 aa, Staphylococcus
KASGY

SEQ ID NO: 1953327 - protein, 6 aa, Staphylococcus
KASHGY

SEQ ID NO: 1953328 - protein, 11 aa, Staphylococcus
KASHKEEKNPY

SEQ ID NO: 1953329 - protein, 9 aa, Staphylococcus
KASHKEVKN

SEQ ID NO: 1953330 - protein, 6 aa, Staphylococcus
KASIDS

SEQ ID NO: 1953331 - protein, 6 aa, Staphylococcus
KASILT

SEQ ID NO: 1953332 - protein, 5 aa, Staphylococcus
KASKH

SEQ ID NO: 1953333 - protein, 8 aa, Staphylococcus
KASKQGYT

SEQ ID NO: 1953334 - protein, 9 aa, Staphylococcus
KASKRGTLK

SEQ ID NO: 1953335 - protein, 6 aa, Staphylococcus
KASLKE

SEQ ID NO: 1953336 - protein, 5 aa, Staphylococcus
KASLL

SEQ ID NO: 1953337 - protein, 8 aa, Staphylococcus
KASNENEW

SEQ ID NO: 1953338 - protein, 7 aa, Staphylococcus
KASNEVV

SEQ ID NO: 1953339 - protein, 7 aa, Staphylococcus
KASNFAP

SEQ ID NO: 1953340 - protein, 30 aa, Staphylococcus
KASNHSKKITLSANEEAFSSNDNNVDVRSS

SEQ ID NO: 1953341 - protein, 21 aa, Staphylococcus
KASNPKHGVKTSTSSAKVQKL

SEQ ID NO: 1953342 - protein, 14 aa, Staphylococcus
KASNPYGDGEASRR

SEQ ID NO: 1953343 - protein, 7 aa, Staphylococcus
KASNSAG

SEQ ID NO: 1953344 - protein, 9 aa, Staphylococcus
KASNYRSAG

SEQ ID NO: 1953345 - protein, 7 aa, Staphylococcus
KASPFEG

SEQ ID NO: 1953346 - protein, 7 aa, Staphylococcus
KASPFKG

SEQ ID NO: 1953347 - protein, 7 aa, Staphylococcus
KASPLSS

SEQ ID NO: 1953348 - protein, 8 aa, Staphylococcus
KASPNIFE

SEQ ID NO: 1953349 - protein, 5 aa, Staphylococcus
KASQI

SEQ ID NO: 1953350 - protein, 8 aa, Staphylococcus
KASQNTGT

SEQ ID NO: 1953351 - protein, 11 aa, Staphylococcus
KASQRYPGESG

SEQ ID NO: 1953352 - protein, 5 aa, Staphylococcus
KASQY

SEQ ID NO: 1953353 - protein, 6 aa, Staphylococcus
KASREQ

SEQ ID NO: 1953354 - protein, 16 aa, Staphylococcus
KASRERVKDLQYTQHL

SEQ ID NO: 1953355 - protein, 5 aa, Staphylococcus
KASRI

SEQ ID NO: 1953356 - protein, 12 aa, Staphylococcus
KASRIKQVAPND

SEQ ID NO: 1953357 - protein, 9 aa, Staphylococcus
KASRIRQVA

SEQ ID NO: 1953358 - protein, 12 aa, Staphylococcus
KASRIRQVAPDD

SEQ ID NO: 1953359 - protein, 12 aa, Staphylococcus
KASRIRQVAPQD

SEQ ID NO: 1953360 - protein, 8 aa, Staphylococcus
KASRKPVR

SEQ ID NO: 1953361 - protein, 4 aa, Staphylococcus
KASS

SEQ ID NO: 1953362 - protein, 21 aa, Staphylococcus
KASSDDRTTTNVKELTGDARI

SEQ ID NO: 1953363 - protein, 7 aa, Staphylococcus
KASSEIY

SEQ ID NO: 1953364 - protein, 7 aa, Staphylococcus
KASSEVY

SEQ ID NO: 1953365 - protein, 9 aa, Staphylococcus
KASSFKPTN

SEQ ID NO: 1953366 - protein, 29 aa, Staphylococcus
KASSIAQSKSLAKKGFSGLKKSLFSGEKD

SEQ ID NO: 1953367 - protein, 6 aa, Staphylococcus
KASSQF

SEQ ID NO: 1953368 - protein, 10 aa, Staphylococcus
KASTDTSVTG

SEQ ID NO: 1953369 - protein, 12 aa, Staphylococcus
KASTEGRNEGEL

SEQ ID NO: 1953370 - protein, 12 aa, Staphylococcus
KASTEGRSEAGL

SEQ ID NO: 1953371 - protein, 7 aa, Staphylococcus
KASTGAI

SEQ ID NO: 1953372 - protein, 12 aa, Staphylococcus
KASTSSRKETAL

SEQ ID NO: 1953373 - protein, 8 aa, Staphylococcus
KASYEAKV

SEQ ID NO: 1953374 - protein, 10 aa, Staphylococcus
KATAKSMEYK

SEQ ID NO: 1953375 - protein, 9 aa, Staphylococcus
KATAKTMDY

SEQ ID NO: 1953376 - protein, 8 aa, Staphylococcus
KATAKTMN

SEQ ID NO: 1953377 - protein, 12 aa, Staphylococcus
KATAREKQAGDY

SEQ ID NO: 1953378 - protein, 12 aa, Staphylococcus
KATARTMDYSGK

SEQ ID NO: 1953379 - protein, 23 aa, Staphylococcus
KATATIDPASINTGNEDRDNHLK

SEQ ID NO: 1953380 - protein, 23 aa, Staphylococcus
KATATIDPKSIDTKNEDRDNHLR

SEQ ID NO: 1953381 - protein, 6 aa, Staphylococcus
KATDCS

SEQ ID NO: 1953382 - protein, 19 aa, Staphylococcus
KATDKVSGLMSNNDKRKVD

SEQ ID NO: 1953383 - protein, 10 aa, Staphylococcus
KATEAGRHTM

SEQ ID NO: 1953384 - protein, 12 aa, Staphylococcus
KATEHKKPTYFG

SEQ ID NO: 1953385 - protein, 11 aa, Staphylococcus
KATENKKAEDI

SEQ ID NO: 1953386 - protein, 17 aa, Staphylococcus
KATESDLLGTTGYGYDD

SEQ ID NO: 1953387 - protein, 17 aa, Staphylococcus
KATESDLQGTTGYGYDD

SEQ ID NO: 1953388 - protein, 13 aa, Staphylococcus
KATFKGKENGPTV

SEQ ID NO: 1953389 - protein, 11 aa, Staphylococcus
KATGKFKGAQV

SEQ ID NO: 1953390 - protein, 6 aa, Staphylococcus
KATGKY

SEQ ID NO: 1953391 - protein, 5 aa, Staphylococcus
KATGL

SEQ ID NO: 1953392 - protein, 12 aa, Staphylococcus
KATGNQIVGAEQ

SEQ ID NO: 1953393 - protein, 12 aa, Staphylococcus
KATGSAAAPTAG

SEQ ID NO: 1953394 - protein, 13 aa, Staphylococcus
KATHKEEKNPYYS

SEQ ID NO: 1953395 - protein, 6 aa, Staphylococcus
KATHNE

SEQ ID NO: 1953396 - protein, 15 aa, Staphylococcus
KATKAAEEAPYPSIE

SEQ ID NO: 1953397 - protein, 6 aa, Staphylococcus
KATKDV

SEQ ID NO: 1953398 - protein, 7 aa, Staphylococcus
KATKEIK

SEQ ID NO: 1953399 - protein, 18 aa, Staphylococcus
KATKIATVQQRNKFEPGQ

SEQ ID NO: 1953400 - protein, 12 aa, Staphylococcus
KATKKVGNRTYD

SEQ ID NO: 1953401 - protein, 4 aa, Staphylococcus
KATL

SEQ ID NO: 1953402 - protein, 5 aa, Staphylococcus
KATLD

SEQ ID NO: 1953403 - protein, 17 aa, Staphylococcus
KATLGQLDNQYKKTTME

SEQ ID NO: 1953404 - protein, 7 aa, Staphylococcus
KATLNSE

SEQ ID NO: 1953405 - protein, 8 aa, Staphylococcus
KATNNGKI

SEQ ID NO: 1953406 - protein, 7 aa, Staphylococcus
KATPFKK

SEQ ID NO: 1953407 - protein, 5 aa, Staphylococcus
KATPK

SEQ ID NO: 1953408 - protein, 7 aa, Staphylococcus
KATPKDI

SEQ ID NO: 1953409 - protein, 8 aa, Staphylococcus
KATPTDDF

SEQ ID NO: 1953410 - protein, 4 aa, Staphylococcus
KATQ

SEQ ID NO: 1953411 - protein, 6 aa, Staphylococcus
KATQND

SEQ ID NO: 1953412 - protein, 16 aa, Staphylococcus
KATRGNIDVDLNLQVV

SEQ ID NO: 1953413 - protein, 16 aa, Staphylococcus
KATRGNIDVDLNVQVV

SEQ ID NO: 1953414 - protein, 16 aa, Staphylococcus
KATRGNIDVDLSVEVV

SEQ ID NO: 1953415 - protein, 16 aa, Staphylococcus
KATRGNIDVNLKVEVI

SEQ ID NO: 1953416 - protein, 16 aa, Staphylococcus
KATRGNIDVNLNVKVE

SEQ ID NO: 1953417 - protein, 15 aa, Staphylococcus
KATRGNIDVQLEVTA

SEQ ID NO: 1953418 - protein, 16 aa, Staphylococcus
KATRGNIEVDLNVAVV

SEQ ID NO: 1953419 - protein, 15 aa, Staphylococcus
KATRRMTKDLLELQK

SEQ ID NO: 1953420 - protein, 5 aa, Staphylococcus
KATSN

SEQ ID NO: 1953421 - protein, 11 aa, Staphylococcus
KATSNEDTLFN

SEQ ID NO: 1953422 - protein, 22 aa, Staphylococcus
KATSYTEAGTKHGRLGLMAGHK

SEQ ID NO: 1953423 - protein, 10 aa, Staphylococcus
KATTAPSSVN

SEQ ID NO: 1953424 - protein, 8 aa, Staphylococcus
KATTTTYE

SEQ ID NO: 1953425 - protein, 22 aa, Staphylococcus
KATVGDANAINRKGQMPPSSNA

SEQ ID NO: 1953426 - protein, 24 aa, Staphylococcus
KATVGDANAINRKGQMPPSSNAFV

SEQ ID NO: 1953427 - protein, 11 aa, Staphylococcus
KATVKTMSPEE

SEQ ID NO: 1953428 - protein, 13 aa, Staphylococcus
KATVKTMSPEELR

SEQ ID NO: 1953429 - protein, 14 aa, Staphylococcus
KATVKTMSPEELTD

SEQ ID NO: 1953430 - protein, 6 aa, Staphylococcus
KATVTG

SEQ ID NO: 1953431 - protein, 7 aa, Staphylococcus
KAVAGKF

SEQ ID NO: 1953432 - protein, 9 aa, Staphylococcus
KAVAGLTDA

SEQ ID NO: 1953433 - protein, 18 aa, Staphylococcus
KAVAGTIKRSHNEVEDEA

SEQ ID NO: 1953434 - protein, 19 aa, Staphylococcus
KAVAGTIKRTHQDEVDKEN

SEQ ID NO: 1953435 - protein, 8 aa, Staphylococcus
KAVDKGTT

SEQ ID NO: 1953436 - protein, 8 aa, Staphylococcus
KAVEAAGL

SEQ ID NO: 1953437 - protein, 10 aa, Staphylococcus
KAVEASKEYE

SEQ ID NO: 1953438 - protein, 9 aa, Staphylococcus
KAVEGLSEA

SEQ ID NO: 1953439 - protein, 10 aa, Staphylococcus
KAVEGLSEDQ

SEQ ID NO: 1953440 - protein, 10 aa, Staphylococcus
KAVEGLSNEQ

SEQ ID NO: 1953441 - protein, 8 aa, Staphylococcus
KAVENDKV

SEQ ID NO: 1953442 - protein, 8 aa, Staphylococcus
KAVESAKK

SEQ ID NO: 1953443 - protein, 8 aa, Staphylococcus
KAVGAKTA

SEQ ID NO: 1953444 - protein, 11 aa, Staphylococcus
KAVKQTEGVPA

SEQ ID NO: 1953445 - protein, 12 aa, Staphylococcus
KAVNPPNVMGAS

SEQ ID NO: 1953446 - protein, 8 aa, Staphylococcus
KAVNPQGK

SEQ ID NO: 1953447 - protein, 5 aa, Staphylococcus
KAVPN

SEQ ID NO: 1953448 - protein, 9 aa, Staphylococcus
KAVQNSAIS

SEQ ID NO: 1953449 - protein, 12 aa, Staphylococcus
KAVQQVDESGKD

SEQ ID NO: 1953450 - protein, 6 aa, Staphylococcus
KAWDNR

SEQ ID NO: 1953451 - protein, 10 aa, Staphylococcus
KAWKDDDEKW

SEQ ID NO: 1953452 - protein, 13 aa, Staphylococcus
KAYAKQKETLGDQ

SEQ ID NO: 1953453 - protein, 6 aa, Staphylococcus
KAYAPE

SEQ ID NO: 1953454 - protein, 9 aa, Staphylococcus
KAYDKTPAQ

SEQ ID NO: 1953455 - protein, 13 aa, Staphylococcus
KAYEAQKANIPDQ

SEQ ID NO: 1953456 - protein, 23 aa, Staphylococcus
KAYEQTRPKIDKSVRNDLKETYE

SEQ ID NO: 1953457 - protein, 14 aa, Staphylococcus
KAYERQKEKLGDQM

SEQ ID NO: 1953458 - protein, 9 aa, Staphylococcus
KAYESGKGK

SEQ ID NO: 1953459 - protein, 11 aa, Staphylococcus
KAYFGKKDAQQ

SEQ ID NO: 1953460 - protein, 6 aa, Staphylococcus
KAYGAT

SEQ ID NO: 1953461 - protein, 5 aa, Staphylococcus
KAYGE

SEQ ID NO: 1953462 - protein, 9 aa, Staphylococcus
KAYGGAPSF

SEQ ID NO: 1953463 - protein, 19 aa, Staphylococcus
KAYGGAPSFWGDEKQPSYI

SEQ ID NO: 1953464 - protein, 10 aa, Staphylococcus
KAYGGEGASV

SEQ ID NO: 1953465 - protein, 10 aa, Staphylococcus
KAYGGEGGTI

SEQ ID NO: 1953466 - protein, 6 aa, Staphylococcus
KAYGKR

SEQ ID NO: 1953467 - protein, 7 aa, Staphylococcus
KAYIGTT

SEQ ID NO: 1953468 - protein, 19 aa, Staphylococcus
KAYNDRNFKDEAGSNFEEG

SEQ ID NO: 1953469 - protein, 8 aa, Staphylococcus
KAYNGEKR

SEQ ID NO: 1953470 - protein, 5 aa, Staphylococcus
KAYNM

SEQ ID NO: 1953471 - protein, 11 aa, Staphylococcus
KAYNNASPITE

SEQ ID NO: 1953472 - protein, 7 aa, Staphylococcus
KAYPQEN

SEQ ID NO: 1953473 - protein, 9 aa, Staphylococcus
KAYPQPDTL

SEQ ID NO: 1953474 - protein, 13 aa, Staphylococcus
KAYPTVQGDNVQY

SEQ ID NO: 1953475 - protein, 6 aa, Staphylococcus
KAYQKY

SEQ ID NO: 1953476 - protein, 12 aa, Staphylococcus
KAYSEKNGGTLL

SEQ ID NO: 1953477 - protein, 22 aa, Staphylococcus
KAYSESQKDNQGRDYPILHLKL

SEQ ID NO: 1953478 - protein, 16 aa, Staphylococcus
KAYSHDLKDADQSKKL

SEQ ID NO: 1953479 - protein, 7 aa, Staphylococcus
KAYYDDY

SEQ ID NO: 1953480 - protein, 6 aa, Staphylococcus
KCATKP

SEQ ID NO: 1953481 - protein, 17 aa, Staphylococcus
KCDDGQVVERKSKKGRV

SEQ ID NO: 1953482 - protein, 5 aa, Staphylococcus
KCDTH

SEQ ID NO: 1953483 - protein, 5 aa, Staphylococcus
KCDTY

SEQ ID NO: 1953484 - protein, 5 aa, Staphylococcus
KCECG

SEQ ID NO: 1953485 - protein, 5 aa, Staphylococcus
KCESP

SEQ ID NO: 1953486 - protein, 16 aa, Staphylococcus
KCKDGDVVERKSKKNR

SEQ ID NO: 1953487 - protein, 16 aa, Staphylococcus
KCKEGDVVERKSKKNR

SEQ ID NO: 1953488 - protein, 11 aa, Staphylococcus
KCNEQGIESTR

SEQ ID NO: 1953489 - protein, 7 aa, Staphylococcus
KCNSNQV

SEQ ID NO: 1953490 - protein, 5 aa, Staphylococcus
KCRPI

SEQ ID NO: 1953491 - protein, 4 aa, Staphylococcus
KCSA

SEQ ID NO: 1953492 - protein, 5 aa, Staphylococcus
KCSAC

SEQ ID NO: 1953493 - protein, 5 aa, Staphylococcus
KCSSI

SEQ ID NO: 1953494 - protein, 12 aa, Staphylococcus
KCTADLGGTYTT

SEQ ID NO: 1953495 - protein, 7 aa, Staphylococcus
KCVNDED

SEQ ID NO: 1953496 - protein, 17 aa, Staphylococcus
KDAAKAAVNKAEETDDC

SEQ ID NO: 1953497 - protein, 16 aa, Staphylococcus
KDAAKGAVAKAEETSD

SEQ ID NO: 1953498 - protein, 5 aa, Staphylococcus
KDAAQ

SEQ ID NO: 1953499 - protein, 16 aa, Staphylococcus
KDAASAAMTKAEETDD

SEQ ID NO: 1953500 - protein, 7 aa, Staphylococcus
KDADATL

SEQ ID NO: 1953501 - protein, 8 aa, Staphylococcus
KDADEVED

SEQ ID NO: 1953502 - protein, 9 aa, Staphylococcus
KDADQNGHG

SEQ ID NO: 1953503 - protein, 7 aa, Staphylococcus
KDADSAL

SEQ ID NO: 1953504 - protein, 17 aa, Staphylococcus
KDAEELKVKETNRIDTT

SEQ ID NO: 1953505 - protein, 8 aa, Staphylococcus
KDAEGKHI

SEQ ID NO: 1953506 - protein, 5 aa, Staphylococcus
KDAEI

SEQ ID NO: 1953507 - protein, 6 aa, Staphylococcus
KDAEIK

SEQ ID NO: 1953508 - protein, 8 aa, Staphylococcus
KDAEKAVH

SEQ ID NO: 1953509 - protein, 5 aa, Staphylococcus
KDAEL

SEQ ID NO: 1953510 - protein, 10 aa, Staphylococcus
KDAENEITDT

SEQ ID NO: 1953511 - protein, 8 aa, Staphylococcus
KDAETLQA

SEQ ID NO: 1953512 - protein, 7 aa, Staphylococcus
KDAEYTC

SEQ ID NO: 1953513 - protein, 5 aa, Staphylococcus
KDAFN

SEQ ID NO: 1953514 - protein, 6 aa, Staphylococcus
KDAGAD

SEQ ID NO: 1953515 - protein, 8 aa, Staphylococcus
KDAGIQPE

SEQ ID NO: 1953516 - protein, 7 aa, Staphylococcus
KDAGQHH

SEQ ID NO: 1953517 - protein, 14 aa, Staphylococcus
KDAGQSDDVADTVN

SEQ ID NO: 1953518 - protein, 7 aa, Staphylococcus
KDAHGPF

SEQ ID NO: 1953519 - protein, 9 aa, Staphylococcus
KDAHKRRSM

SEQ ID NO: 1953520 - protein, 12 aa, Staphylococcus
KDAHNKEANEIN

SEQ ID NO: 1953521 - protein, 5 aa, Staphylococcus
KDAIA

SEQ ID NO: 1953522 - protein, 7 aa, Staphylococcus
KDAIKRA

SEQ ID NO: 1953523 - protein, 10 aa, Staphylococcus
KDAINKGASE

SEQ ID NO: 1953524 - protein, 7 aa, Staphylococcus
KDAINTG

SEQ ID NO: 1953525 - protein, 6 aa, Staphylococcus
KDAKKP

SEQ ID NO: 1953526 - protein, 6 aa, Staphylococcus
KDAKMR

SEQ ID NO: 1953527 - protein, 10 aa, Staphylococcus
KDAKRYELTD

SEQ ID NO: 1953528 - protein, 8 aa, Staphylococcus
KDAKYISD

SEQ ID NO: 1953529 - protein, 5 aa, Staphylococcus
KDALE

SEQ ID NO: 1953530 - protein, 8 aa, Staphylococcus
KDALKGKK

SEQ ID NO: 1953531 - protein, 5 aa, Staphylococcus
KDALN

SEQ ID NO: 1953532 - protein, 5 aa, Staphylococcus
KDALT

SEQ ID NO: 1953533 - protein, 6 aa, Staphylococcus
KDAMEN

SEQ ID NO: 1953534 - protein, 12 aa, Staphylococcus
KDAMKERGVTEE

SEQ ID NO: 1953535 - protein, 7 aa, Staphylococcus
KDAMNTG

SEQ ID NO: 1953536 - protein, 20 aa, Staphylococcus
KDANGKLLQNENERNATLQK

SEQ ID NO: 1953537 - protein, 15 aa, Staphylococcus
KDANIGNYIALLYSN

SEQ ID NO: 1953538 - protein, 13 aa, Staphylococcus
KDANTEEKAITEI

SEQ ID NO: 1953539 - protein, 5 aa, Staphylococcus
KDANY

SEQ ID NO: 1953540 - protein, 8 aa, Staphylococcus
KDAPSILQ

SEQ ID NO: 1953541 - protein, 9 aa, Staphylococcus
KDAPYTESH

SEQ ID NO: 1953542 - protein, 4 aa, Staphylococcus
KDAQ

SEQ ID NO: 1953543 - protein, 6 aa, Staphylococcus
KDAQFD

SEQ ID NO: 1953544 - protein, 14 aa, Staphylococcus
KDAQLYTEVLQTHE

SEQ ID NO: 1953545 - protein, 8 aa, Staphylococcus
KDAQNEAD

SEQ ID NO: 1953546 - protein, 9 aa, Staphylococcus
KDAQQSKDL

SEQ ID NO: 1953547 - protein, 9 aa, Staphylococcus
KDARDINDE

SEQ ID NO: 1953548 - protein, 7 aa, Staphylococcus
KDARQNK

SEQ ID NO: 1953549 - protein, 9 aa, Staphylococcus
KDARRKREV

SEQ ID NO: 1953550 - protein, 10 aa, Staphylococcus
KDASGPYHKG

SEQ ID NO: 1953551 - protein, 7 aa, Staphylococcus
KDASQKI

SEQ ID NO: 1953552 - protein, 18 aa, Staphylococcus
KDASSHNEVEKNNAAYEE

SEQ ID NO: 1953553 - protein, 8 aa, Staphylococcus
KDATGAIA

SEQ ID NO: 1953554 - protein, 8 aa, Staphylococcus
KDATGLGL

SEQ ID NO: 1953555 - protein, 11 aa, Staphylococcus
KDATKGSQVAK

SEQ ID NO: 1953556 - protein, 14 aa, Staphylococcus
KDATSVLESAQTTV

SEQ ID NO: 1953557 - protein, 5 aa, Staphylococcus
KDAVN

SEQ ID NO: 1953558 - protein, 8 aa, Staphylococcus
KDAVTSIS

SEQ ID NO: 1953559 - protein, 10 aa, Staphylococcus
KDAVTTYKNN

SEQ ID NO: 1953560 - protein, 6 aa, Staphylococcus
KDAYSE

SEQ ID NO: 1953561 - protein, 14 aa, Staphylococcus
KDCEVETNVGDNGV

SEQ ID NO: 1953562 - protein, 14 aa, Staphylococcus
KDCEVETNVGPNGL

SEQ ID NO: 1953563 - protein, 14 aa, Staphylococcus
KDCEVETNVGPNGV

SEQ ID NO: 1953564 - protein, 14 aa, Staphylococcus
KDCEVKTNVGENGV

SEQ ID NO: 1953565 - protein, 9 aa, Staphylococcus
KDDAPVLKG

SEQ ID NO: 1953566 - protein, 9 aa, Staphylococcus
KDDAPVLNG

SEQ ID NO: 1953567 - protein, 8 aa, Staphylococcus
KDDATGHD

SEQ ID NO: 1953568 - protein, 5 aa, Staphylococcus
KDDDE

SEQ ID NO: 1953569 - protein, 6 aa, Staphylococcus
KDDDEK

SEQ ID NO: 1953570 - protein, 6 aa, Staphylococcus
KDDDEL

SEQ ID NO: 1953571 - protein, 7 aa, Staphylococcus
KDDDNRV

SEQ ID NO: 1953572 - protein, 6 aa, Staphylococcus
KDDDYK

SEQ ID NO: 1953573 - protein, 8 aa, Staphylococcus
KDDEIIPY

SEQ ID NO: 1953574 - protein, 9 aa, Staphylococcus
KDDEKEGKG

SEQ ID NO: 1953575 - protein, 9 aa, Staphylococcus
KDDEKRENI

SEQ ID NO: 1953576 - protein, 8 aa, Staphylococcus
KDDELKPI

SEQ ID NO: 1953577 - protein, 11 aa, Staphylococcus
KDDEQNFEETQ

SEQ ID NO: 1953578 - protein, 10 aa, Staphylococcus
KDDESRPIAQ

SEQ ID NO: 1953579 - protein, 5 aa, Staphylococcus
KDDET

SEQ ID NO: 1953580 - protein, 4 aa, Staphylococcus
KDDF

SEQ ID NO: 1953581 - protein, 8 aa, Staphylococcus
KDDFPTDG

SEQ ID NO: 1953582 - protein, 8 aa, Staphylococcus
KDDFTDYR

SEQ ID NO: 1953583 - protein, 5 aa, Staphylococcus
KDDGE

SEQ ID NO: 1953584 - protein, 5 aa, Staphylococcus
KDDHQ

SEQ ID NO: 1953585 - protein, 5 aa, Staphylococcus
KDDID

SEQ ID NO: 1953586 - protein, 5 aa, Staphylococcus
KDDIM

SEQ ID NO: 1953587 - protein, 5 aa, Staphylococcus
KDDIN

SEQ ID NO: 1953588 - protein, 8 aa, Staphylococcus
KDDITDDN

SEQ ID NO: 1953589 - protein, 28 aa, Staphylococcus
KDDKENDKENKLPKLEEGDKVTATQIEP

SEQ ID NO: 1953590 - protein, 9 aa, Staphylococcus
KDDKGVVDK

SEQ ID NO: 1953591 - protein, 6 aa, Staphylococcus
KDDKKR

SEQ ID NO: 1953592 - protein, 7 aa, Staphylococcus
KDDKNIT

SEQ ID NO: 1953593 - protein, 16 aa, Staphylococcus
KDDKNRKSDIIDLFFG

SEQ ID NO: 1953594 - protein, 7 aa, Staphylococcus
KDDKQDN

SEQ ID NO: 1953595 - protein, 10 aa, Staphylococcus
KDDKRKESYT

SEQ ID NO: 1953596 - protein, 9 aa, Staphylococcus
KDDKVKNIG

SEQ ID NO: 1953597 - protein, 5 aa, Staphylococcus
KDDKY

SEQ ID NO: 1953598 - protein, 8 aa, Staphylococcus
KDDKYTIR

SEQ ID NO: 1953599 - protein, 10 aa, Staphylococcus
KDDLEKISPG

SEQ ID NO: 1953600 - protein, 7 aa, Staphylococcus
KDDNDEV

SEQ ID NO: 1953601 - protein, 8 aa, Staphylococcus
KDDNGDLH

SEQ ID NO: 1953602 - protein, 6 aa, Staphylococcus
KDDNGR

SEQ ID NO: 1953603 - protein, 9 aa, Staphylococcus
KDDNQTIEQ

SEQ ID NO: 1953604 - protein, 14 aa, Staphylococcus
KDDNVKQTLKDNAS

SEQ ID NO: 1953605 - protein, 11 aa, Staphylococcus
KDDPAFDHPTK

SEQ ID NO: 1953606 - protein, 5 aa, Staphylococcus
KDDPF

SEQ ID NO: 1953607 - protein, 14 aa, Staphylococcus
KDDPFGDYGKGIRK

SEQ ID NO: 1953608 - protein, 13 aa, Staphylococcus
KDDPFGEYGKGVK

SEQ ID NO: 1953609 - protein, 7 aa, Staphylococcus
KDDPIKV

SEQ ID NO: 1953610 - protein, 6 aa, Staphylococcus
KDDQFE

SEQ ID NO: 1953611 - protein, 6 aa, Staphylococcus
KDDQLS

SEQ ID NO: 1953612 - protein, 7 aa, Staphylococcus
KDDQNEV

SEQ ID NO: 1953613 - protein, 4 aa, Staphylococcus
KDDR

SEQ ID NO: 1953614 - protein, 6 aa, Staphylococcus
KDDRPY

SEQ ID NO: 1953615 - protein, 4 aa, Staphylococcus
KDDS

SEQ ID NO: 1953616 - protein, 7 aa, Staphylococcus
KDDSDNV

SEQ ID NO: 1953617 - protein, 7 aa, Staphylococcus
KDDSGDV

SEQ ID NO: 1953618 - protein, 7 aa, Staphylococcus
KDDSKIK

SEQ ID NO: 1953619 - protein, 17 aa, Staphylococcus
KDDSKRQIAIAQNRQLF

SEQ ID NO: 1953620 - protein, 8 aa, Staphylococcus
KDDSKVLK

SEQ ID NO: 1953621 - protein, 6 aa, Staphylococcus
KDDSLD

SEQ ID NO: 1953622 - protein, 7 aa, Staphylococcus
KDDSNDF

SEQ ID NO: 1953623 - protein, 5 aa, Staphylococcus
KDDTD

SEQ ID NO: 1953624 - protein, 17 aa, Staphylococcus
KDDTERQTEIAKNRELF

SEQ ID NO: 1953625 - protein, 7 aa, Staphylococcus
KDDTGNI

SEQ ID NO: 1953626 - protein, 5 aa, Staphylococcus
KDDTI

SEQ ID NO: 1953627 - protein, 4 aa, Staphylococcus
KDDV

SEQ ID NO: 1953628 - protein, 8 aa, Staphylococcus
KDDVDDED

SEQ ID NO: 1953629 - protein, 10 aa, Staphylococcus
KDDVSNETDI

SEQ ID NO: 1953630 - protein, 4 aa, Staphylococcus
KDEA

SEQ ID NO: 1953631 - protein, 7 aa, Staphylococcus
KDEALTK

SEQ ID NO: 1953632 - protein, 13 aa, Staphylococcus
KDEARTKAAHAGK

SEQ ID NO: 1953633 - protein, 4 aa, Staphylococcus
KDED

SEQ ID NO: 1953634 - protein, 7 aa, Staphylococcus
KDEDDKV

SEQ ID NO: 1953635 - protein, 5 aa, Staphylococcus
KDEDI

SEQ ID NO: 1953636 - protein, 8 aa, Staphylococcus
KDEDQKEM

SEQ ID NO: 1953637 - protein, 18 aa, Staphylococcus
KDEDTRSLPKSDKKIKES

SEQ ID NO: 1953638 - protein, 7 aa, Staphylococcus
KDEDVKA

SEQ ID NO: 1953639 - protein, 8 aa, Staphylococcus
KDEEGDVS

SEQ ID NO: 1953640 - protein, 8 aa, Staphylococcus
KDEEGKFT

SEQ ID NO: 1953641 - protein, 7 aa, Staphylococcus
KDEEHNQ

SEQ ID NO: 1953642 - protein, 10 aa, Staphylococcus
KDEEKRKNIE

SEQ ID NO: 1953643 - protein, 6 aa, Staphylococcus
KDEELT

SEQ ID NO: 1953644 - protein, 14 aa, Staphylococcus
KDEERTKAAQAGDY

SEQ ID NO: 1953645 - protein, 14 aa, Staphylococcus
KDEERTKAASAGDY

SEQ ID NO: 1953646 - protein, 7 aa, Staphylococcus
KDEESRT

SEQ ID NO: 1953647 - protein, 9 aa, Staphylococcus
KDEEYREDL

SEQ ID NO: 1953648 - protein, 4 aa, Staphylococcus
KDEF

SEQ ID NO: 1953649 - protein, 8 aa, Staphylococcus
KDEFPNQK

SEQ ID NO: 1953650 - protein, 4 aa, Staphylococcus
KDEG

SEQ ID NO: 1953651 - protein, 15 aa, Staphylococcus
KDEGDVTASDITHDS

SEQ ID NO: 1953652 - protein, 9 aa, Staphylococcus
KDEGEVTAA

SEQ ID NO: 1953653 - protein, 5 aa, Staphylococcus
KDEGL

SEQ ID NO: 1953654 - protein, 9 aa, Staphylococcus
KDEGLYDTE

SEQ ID NO: 1953655 - protein, 10 aa, Staphylococcus
KDEGLYDTET

SEQ ID NO: 1953656 - protein, 6 aa, Staphylococcus
KDEGQF

SEQ ID NO: 1953657 - protein, 7 aa, Staphylococcus
KDEGQGI

SEQ ID NO: 1953658 - protein, 5 aa, Staphylococcus
KDEGV

SEQ ID NO: 1953659 - protein, 6 aa, Staphylococcus
KDEGYR

SEQ ID NO: 1953660 - protein, 6 aa, Staphylococcus
KDEHKA

SEQ ID NO: 1953661 - protein, 7 aa, Staphylococcus
KDEHKIA

SEQ ID NO: 1953662 - protein, 8 aa, Staphylococcus
KDEHTQYQ

SEQ ID NO: 1953663 - protein, 4 aa, Staphylococcus
KDEI

SEQ ID NO: 1953664 - protein, 6 aa, Staphylococcus
KDEIAN

SEQ ID NO: 1953665 - protein, 7 aa, Staphylococcus
KDEIDKD

SEQ ID NO: 1953666 - protein, 11 aa, Staphylococcus
KDEIKANDGQY

SEQ ID NO: 1953667 - protein, 19 aa, Staphylococcus
KDEIQEAQKYYSQKRAKKH

SEQ ID NO: 1953668 - protein, 21 aa, Staphylococcus
KDEIQEAQRYYSKKRAKKHNQ

SEQ ID NO: 1953669 - protein, 6 aa, Staphylococcus
KDEIQS

SEQ ID NO: 1953670 - protein, 11 aa, Staphylococcus
KDEISQKDNDD

SEQ ID NO: 1953671 - protein, 20 aa, Staphylococcus
KDEIYKNKNELSIDTGAGHN

SEQ ID NO: 1953672 - protein, 6 aa, Staphylococcus
KDEKHR

SEQ ID NO: 1953673 - protein, 11 aa, Staphylococcus
KDEKKQIESRY

SEQ ID NO: 1953674 - protein, 32 aa, Staphylococcus
KDEKQDKQQDEKLKPNENNNRKFTEIKTEDVG

SEQ ID NO: 1953675 - protein, 8 aa, Staphylococcus
KDEKQTIS

SEQ ID NO: 1953676 - protein, 14 aa, Staphylococcus
KDEKRTKDAHAGDY

SEQ ID NO: 1953677 - protein, 8 aa, Staphylococcus
KDEKSRKH

SEQ ID NO: 1953678 - protein, 8 aa, Staphylococcus
KDEKTLSQ

SEQ ID NO: 1953679 - protein, 11 aa, Staphylococcus
KDEKYSTGKWG

SEQ ID NO: 1953680 - protein, 6 aa, Staphylococcus
KDELDE

SEQ ID NO: 1953681 - protein, 7 aa, Staphylococcus
KDELKSR

SEQ ID NO: 1953682 - protein, 6 aa, Staphylococcus
KDELPK

SEQ ID NO: 1953683 - protein, 9 aa, Staphylococcus
KDELTGRAP

SEQ ID NO: 1953684 - protein, 8 aa, Staphylococcus
KDEMASGV

SEQ ID NO: 1953685 - protein, 10 aa, Staphylococcus
KDEMIDPQSA

SEQ ID NO: 1953686 - protein, 4 aa, Staphylococcus
KDEN

SEQ ID NO: 1953687 - protein, 7 aa, Staphylococcus
KDENEAI

SEQ ID NO: 1953688 - protein, 6 aa, Staphylococcus
KDENGG

SEQ ID NO: 1953689 - protein, 8 aa, Staphylococcus
KDENGGTV

SEQ ID NO: 1953690 - protein, 15 aa, Staphylococcus
KDENGNDYPDWEETT

SEQ ID NO: 1953691 - protein, 10 aa, Staphylococcus
KDENGNDYPE

SEQ ID NO: 1953692 - protein, 9 aa, Staphylococcus
KDENGNEYP

SEQ ID NO: 1953693 - protein, 8 aa, Staphylococcus
KDENGNVY

SEQ ID NO: 1953694 - protein, 6 aa, Staphylococcus
KDENIK

SEQ ID NO: 1953695 - protein, 5 aa, Staphylococcus
KDENL

SEQ ID NO: 1953696 - protein, 7 aa, Staphylococcus
KDENNKV

SEQ ID NO: 1953697 - protein, 5 aa, Staphylococcus
KDENR

SEQ ID NO: 1953698 - protein, 7 aa, Staphylococcus
KDEPALE

SEQ ID NO: 1953699 - protein, 14 aa, Staphylococcus
KDEQALEAHNQSEH

SEQ ID NO: 1953700 - protein, 8 aa, Staphylococcus
KDEQGQDI

SEQ ID NO: 1953701 - protein, 15 aa, Staphylococcus
KDEQHNQAVVLQDLL

SEQ ID NO: 1953702 - protein, 5 aa, Staphylococcus
KDEQI

SEQ ID NO: 1953703 - protein, 8 aa, Staphylococcus
KDEQTNPH

SEQ ID NO: 1953704 - protein, 6 aa, Staphylococcus
KDEQVH

SEQ ID NO: 1953705 - protein, 18 aa, Staphylococcus
KDERDDEEQREDTYHYEG

SEQ ID NO: 1953706 - protein, 11 aa, Staphylococcus
KDERGNNHPSW

SEQ ID NO: 1953707 - protein, 6 aa, Staphylococcus
KDERKV

SEQ ID NO: 1953708 - protein, 5 aa, Staphylococcus
KDESI

SEQ ID NO: 1953709 - protein, 12 aa, Staphylococcus
KDESIKPTLTEQ

SEQ ID NO: 1953710 - protein, 26 aa, Staphylococcus
KDESITIEDNGRGMPTGIHTSGKPTV

SEQ ID NO: 1953711 - protein, 8 aa, Staphylococcus
KDESRTIK

SEQ ID NO: 1953712 - protein, 8 aa, Staphylococcus
KDESRTVK

SEQ ID NO: 1953713 - protein, 9 aa, Staphylococcus
KDESSTVYG

SEQ ID NO: 1953714 - protein, 6 aa, Staphylococcus
KDESTI

SEQ ID NO: 1953715 - protein, 4 aa, Staphylococcus
KDET

SEQ ID NO: 1953716 - protein, 7 aa, Staphylococcus
KDETKAI

SEQ ID NO: 1953717 - protein, 4 aa, Staphylococcus
KDEV

SEQ ID NO: 1953718 - protein, 6 aa, Staphylococcus
KDEVKS

SEQ ID NO: 1953719 - protein, 5 aa, Staphylococcus
KDEVR

SEQ ID NO: 1953720 - protein, 4 aa, Staphylococcus
KDFA

SEQ ID NO: 1953721 - protein, 4 aa, Staphylococcus
KDFD

SEQ ID NO: 1953722 - protein, 6 aa, Staphylococcus
KDFDNR

SEQ ID NO: 1953723 - protein, 20 aa, Staphylococcus
KDFDPNRRDVRQRYSRHQQT

SEQ ID NO: 1953724 - protein, 6 aa, Staphylococcus
KDFEKR

SEQ ID NO: 1953725 - protein, 35 aa, Staphylococcus
KDFENWKNSDAFKQAHQRSDKKESDNQEKKESPII

SEQ ID NO: 1953726 - protein, 21 aa, Staphylococcus
KDFGSAASSLGKEVANKAIGG

SEQ ID NO: 1953727 - protein, 5 aa, Staphylococcus
KDFGY

SEQ ID NO: 1953728 - protein, 8 aa, Staphylococcus
KDFKEGDH

SEQ ID NO: 1953729 - protein, 9 aa, Staphylococcus
KDFKEKMAK

SEQ ID NO: 1953730 - protein, 10 aa, Staphylococcus
KDFKGDAVKG

SEQ ID NO: 1953731 - protein, 8 aa, Staphylococcus
KDFKGNNA

SEQ ID NO: 1953732 - protein, 4 aa, Staphylococcus
KDFP

SEQ ID NO: 1953733 - protein, 6 aa, Staphylococcus
KDFPDT

SEQ ID NO: 1953734 - protein, 7 aa, Staphylococcus
KDFPNEK

SEQ ID NO: 1953735 - protein, 8 aa, Staphylococcus
KDGAENKL

SEQ ID NO: 1953736 - protein, 9 aa, Staphylococcus
KDGDIDTSQ

SEQ ID NO: 1953737 - protein, 7 aa, Staphylococcus
KDGDLQN

SEQ ID NO: 1953738 - protein, 8 aa, Staphylococcus
KDGDPFAT

SEQ ID NO: 1953739 - protein, 9 aa, Staphylococcus
KDGDPRAKY

SEQ ID NO: 1953740 - protein, 18 aa, Staphylococcus
KDGDSADSLGLDGKEEIS

SEQ ID NO: 1953741 - protein, 7 aa, Staphylococcus
KDGEEHR

SEQ ID NO: 1953742 - protein, 21 aa, Staphylococcus
KDGENSVAPIPAHEQQLPTVT

SEQ ID NO: 1953743 - protein, 16 aa, Staphylococcus
KDGESADSLGLNGREE

SEQ ID NO: 1953744 - protein, 17 aa, Staphylococcus
KDGESAESLGLDGKEAI

SEQ ID NO: 1953745 - protein, 5 aa, Staphylococcus
KDGEV

SEQ ID NO: 1953746 - protein, 6 aa, Staphylococcus
KDGFLG

SEQ ID NO: 1953747 - protein, 16 aa, Staphylococcus
KDGGIKSNSKVADEQT

SEQ ID NO: 1953748 - protein, 30 aa, Staphylococcus
KDGGIPATGLNKKGKTKKTGTKVTFKPDPE

SEQ ID NO: 1953749 - protein, 17 aa, Staphylococcus
KDGGISARGSQVADETT

SEQ ID NO: 1953750 - protein, 9 aa, Staphylococcus
KDGGPEDST

SEQ ID NO: 1953751 - protein, 7 aa, Staphylococcus
KDGGRPV

SEQ ID NO: 1953752 - protein, 5 aa, Staphylococcus
KDGGT

SEQ ID NO: 1953753 - protein, 4 aa, Staphylococcus
KDGH

SEQ ID NO: 1953754 - protein, 11 aa, Staphylococcus
KDGKAKGLQIG

SEQ ID NO: 1953755 - protein, 9 aa, Staphylococcus
KDGKGVVDE

SEQ ID NO: 1953756 - protein, 7 aa, Staphylococcus
KDGKTDE

SEQ ID NO: 1953757 - protein, 7 aa, Staphylococcus
KDGKTYH

SEQ ID NO: 1953758 - protein, 12 aa, Staphylococcus
KDGLGHGKGGSM

SEQ ID NO: 1953759 - protein, 10 aa, Staphylococcus
KDGLTEEEMK

SEQ ID NO: 1953760 - protein, 14 aa, Staphylococcus
KDGNIYQDSSIGTG

SEQ ID NO: 1953761 - protein, 19 aa, Staphylococcus
KDGNKVGFKDTTKTASSYR

SEQ ID NO: 1953762 - protein, 9 aa, Staphylococcus
KDGNNSRAL

SEQ ID NO: 1953763 - protein, 6 aa, Staphylococcus
KDGNQI

SEQ ID NO: 1953764 - protein, 10 aa, Staphylococcus
KDGNQTIEAV

SEQ ID NO: 1953765 - protein, 6 aa, Staphylococcus
KDGQIN

SEQ ID NO: 1953766 - protein, 9 aa, Staphylococcus
KDGQINANH

SEQ ID NO: 1953767 - protein, 7 aa, Staphylococcus
KDGQLNR

SEQ ID NO: 1953768 - protein, 6 aa, Staphylococcus
KDGRAY

SEQ ID NO: 1953769 - protein, 6 aa, Staphylococcus
KDGREY

SEQ ID NO: 1953770 - protein, 6 aa, Staphylococcus
KDGRQY

SEQ ID NO: 1953771 - protein, 15 aa, Staphylococcus
KDGRYDDVKKDIEGV

SEQ ID NO: 1953772 - protein, 8 aa, Staphylococcus
KDGRYDEV

SEQ ID NO: 1953773 - protein, 13 aa, Staphylococcus
KDGRYEDVQKDIE

SEQ ID NO: 1953774 - protein, 4 aa, Staphylococcus
KDGS

SEQ ID NO: 1953775 - protein, 17 aa, Staphylococcus
KDGSIGSRGSSVADETT

SEQ ID NO: 1953776 - protein, 8 aa, Staphylococcus
KDGSISKD

SEQ ID NO: 1953777 - protein, 8 aa, Staphylococcus
KDGSLAEQ

SEQ ID NO: 1953778 - protein, 14 aa, Staphylococcus
KDGSLTGYGGGIDT

SEQ ID NO: 1953779 - protein, 12 aa, Staphylococcus
KDGSLTGYGGTI

SEQ ID NO: 1953780 - protein, 15 aa, Staphylococcus
KDGSTIADIGTGSGA

SEQ ID NO: 1953781 - protein, 6 aa, Staphylococcus
KDGTCN

SEQ ID NO: 1953782 - protein, 7 aa, Staphylococcus
KDGTDEP

SEQ ID NO: 1953783 - protein, 18 aa, Staphylococcus
KDGTHSDGRVSNSSSRSL

SEQ ID NO: 1953784 - protein, 9 aa, Staphylococcus
KDGTLDPVI

SEQ ID NO: 1953785 - protein, 15 aa, Staphylococcus
KDGTLDPVVGRDKEI

SEQ ID NO: 1953786 - protein, 7 aa, Staphylococcus
KDGWEQE

SEQ ID NO: 1953787 - protein, 9 aa, Staphylococcus
KDGWESKVP

SEQ ID NO: 1953788 - protein, 5 aa, Staphylococcus
KDGYE

SEQ ID NO: 1953789 - protein, 12 aa, Staphylococcus
KDGYKSLSREQM

SEQ ID NO: 1953790 - protein, 11 aa, Staphylococcus
KDGYRIGYGGG

SEQ ID NO: 1953791 - protein, 6 aa, Staphylococcus
KDGYRS

SEQ ID NO: 1953792 - protein, 5 aa, Staphylococcus
KDGYY

SEQ ID NO: 1953793 - protein, 8 aa, Staphylococcus
KDGYYADT

SEQ ID NO: 1953794 - protein, 5 aa, Staphylococcus
KDHEE

SEQ ID NO: 1953795 - protein, 6 aa, Staphylococcus
KDHEPV

SEQ ID NO: 1953796 - protein, 7 aa, Staphylococcus
KDHGAEA

SEQ ID NO: 1953797 - protein, 7 aa, Staphylococcus
KDHKGDI

SEQ ID NO: 1953798 - protein, 4 aa, Staphylococcus
KDHL

SEQ ID NO: 1953799 - protein, 6 aa, Staphylococcus
KDHPEI

SEQ ID NO: 1953800 - protein, 5 aa, Staphylococcus
KDHQS

SEQ ID NO: 1953801 - protein, 5 aa, Staphylococcus
KDHQV

SEQ ID NO: 1953802 - protein, 6 aa, Staphylococcus
KDHSSF

SEQ ID NO: 1953803 - protein, 14 aa, Staphylococcus
KDHSTIQTERSEQL

SEQ ID NO: 1953804 - protein, 13 aa, Staphylococcus
KDHVEKCEKVINN

SEQ ID NO: 1953805 - protein, 8 aa, Staphylococcus
KDHYAEDK

SEQ ID NO: 1953806 - protein, 6 aa, Staphylococcus
KDIADG

SEQ ID NO: 1953807 - protein, 8 aa, Staphylococcus
KDIAKEEM

SEQ ID NO: 1953808 - protein, 7 aa, Staphylococcus
KDIAQPL

SEQ ID NO: 1953809 - protein, 12 aa, Staphylococcus
KDIASAKEKSDA

SEQ ID NO: 1953810 - protein, 7 aa, Staphylococcus
KDIASPD

SEQ ID NO: 1953811 - protein, 5 aa, Staphylococcus
KDIDD

SEQ ID NO: 1953812 - protein, 6 aa, Staphylococcus
KDIDES

SEQ ID NO: 1953813 - protein, 28 aa, Staphylococcus
KDIEATKGRASYFKEDSKGHVDPGAQSS

SEQ ID NO: 1953814 - protein, 5 aa, Staphylococcus
KDIED

SEQ ID NO: 1953815 - protein, 7 aa, Staphylococcus
KDIEDKH

SEQ ID NO: 1953816 - protein, 8 aa, Staphylococcus
KDIEDTAN

SEQ ID NO: 1953817 - protein, 8 aa, Staphylococcus
KDIEEGYK

SEQ ID NO: 1953818 - protein, 6 aa, Staphylococcus
KDIEGA

SEQ ID NO: 1953819 - protein, 11 aa, Staphylococcus
KDIEGLSSHRP

SEQ ID NO: 1953820 - protein, 20 aa, Staphylococcus
KDIEKRPDNKKAQNKKINLE

SEQ ID NO: 1953821 - protein, 45 aa, Staphylococcus
KDIEKRPDNKKAYNKRDNLQQQLDANQQKLNEANQLQAEHGNELP

SEQ ID NO: 1953822 - protein, 8 aa, Staphylococcus
KDIEPDKA

SEQ ID NO: 1953823 - protein, 7 aa, Staphylococcus
KDIEQSN

SEQ ID NO: 1953824 - protein, 8 aa, Staphylococcus
KDIEQSNN

SEQ ID NO: 1953825 - protein, 5 aa, Staphylococcus
KDIES

SEQ ID NO: 1953826 - protein, 10 aa, Staphylococcus
KDIGKAQRVA

SEQ ID NO: 1953827 - protein, 8 aa, Staphylococcus
KDIKDVPK

SEQ ID NO: 1953828 - protein, 9 aa, Staphylococcus
KDIKKDHPQ

SEQ ID NO: 1953829 - protein, 6 aa, Staphylococcus
KDIKKS

SEQ ID NO: 1953830 - protein, 6 aa, Staphylococcus
KDIKQD

SEQ ID NO: 1953831 - protein, 6 aa, Staphylococcus
KDIKSD

SEQ ID NO: 1953832 - protein, 6 aa, Staphylococcus
KDILDE

SEQ ID NO: 1953833 - protein, 16 aa, Staphylococcus
KDINESEATFQPDIAN

SEQ ID NO: 1953834 - protein, 15 aa, Staphylococcus
KDINRAKHKQPPTLN

SEQ ID NO: 1953835 - protein, 7 aa, Staphylococcus
KDINTAK

SEQ ID NO: 1953836 - protein, 8 aa, Staphylococcus
KDINTDDL

SEQ ID NO: 1953837 - protein, 6 aa, Staphylococcus
KDINTY

SEQ ID NO: 1953838 - protein, 14 aa, Staphylococcus
KDINTYSEKDLRNV

SEQ ID NO: 1953839 - protein, 4 aa, Staphylococcus
KDIP

SEQ ID NO: 1953840 - protein, 8 aa, Staphylococcus
KDIPPNSL

SEQ ID NO: 1953841 - protein, 4 aa, Staphylococcus
KDIQ

SEQ ID NO: 1953842 - protein, 7 aa, Staphylococcus
KDIQDDL

SEQ ID NO: 1953843 - protein, 5 aa, Staphylococcus
KDISE

SEQ ID NO: 1953844 - protein, 7 aa, Staphylococcus
KDISKEN

SEQ ID NO: 1953845 - protein, 7 aa, Staphylococcus
KDISKSK

SEQ ID NO: 1953846 - protein, 18 aa, Staphylococcus
KDISNQVKEGALSSAHGR

SEQ ID NO: 1953847 - protein, 8 aa, Staphylococcus
KDITDDLS

SEQ ID NO: 1953848 - protein, 6 aa, Staphylococcus
KDITEM

SEQ ID NO: 1953849 - protein, 7 aa, Staphylococcus
KDITKQS

SEQ ID NO: 1953850 - protein, 8 aa, Staphylococcus
KDITPEQF

SEQ ID NO: 1953851 - protein, 6 aa, Staphylococcus
KDKADF

SEQ ID NO: 1953852 - protein, 11 aa, Staphylococcus
KDKAELTNETA

SEQ ID NO: 1953853 - protein, 12 aa, Staphylococcus
KDKAEQQRNRDQ

SEQ ID NO: 1953854 - protein, 13 aa, Staphylococcus
KDKAETTTFWRHY

SEQ ID NO: 1953855 - protein, 13 aa, Staphylococcus
KDKAQKRTDGVPA

SEQ ID NO: 1953856 - protein, 12 aa, Staphylococcus
KDKAQKRVDGVP

SEQ ID NO: 1953857 - protein, 5 aa, Staphylococcus
KDKAY

SEQ ID NO: 1953858 - protein, 8 aa, Staphylococcus
KDKAYPNY

SEQ ID NO: 1953859 - protein, 7 aa, Staphylococcus
KDKDGLP

SEQ ID NO: 1953860 - protein, 7 aa, Staphylococcus
KDKDINK

SEQ ID NO: 1953861 - protein, 8 aa, Staphylococcus
KDKEDNPS

SEQ ID NO: 1953862 - protein, 9 aa, Staphylococcus
KDKEGNLNT

SEQ ID NO: 1953863 - protein, 5 aa, Staphylococcus
KDKEI

SEQ ID NO: 1953864 - protein, 40 aa, Staphylococcus
KDKEIAESIESSTNDISTSSDDITETHSSEDGRPRTPQEN

SEQ ID NO: 1953865 - protein, 7 aa, Staphylococcus
KDKEINK

SEQ ID NO: 1953866 - protein, 8 aa, Staphylococcus
KDKELNGI

SEQ ID NO: 1953867 - protein, 9 aa, Staphylococcus
KDKEPYDEH

SEQ ID NO: 1953868 - protein, 8 aa, Staphylococcus
KDKEQLTS

SEQ ID NO: 1953869 - protein, 5 aa, Staphylococcus
KDKFI

SEQ ID NO: 1953870 - protein, 11 aa, Staphylococcus
KDKGAIVKPNT

SEQ ID NO: 1953871 - protein, 10 aa, Staphylococcus
KDKGDGRGSM

SEQ ID NO: 1953872 - protein, 6 aa, Staphylococcus
KDKGDI

SEQ ID NO: 1953873 - protein, 11 aa, Staphylococcus
KDKGDIIKPNT

SEQ ID NO: 1953874 - protein, 16 aa, Staphylococcus
KDKGDRSLTLRPEGTA

SEQ ID NO: 1953875 - protein, 17 aa, Staphylococcus
KDKGDRSLTLRPEGTAG

SEQ ID NO: 1953876 - protein, 6 aa, Staphylococcus
KDKGLT

SEQ ID NO: 1953877 - protein, 7 aa, Staphylococcus
KDKGNLT

SEQ ID NO: 1953878 - protein, 17 aa, Staphylococcus
KDKGNRSITLRPEGTAA

SEQ ID NO: 1953879 - protein, 15 aa, Staphylococcus
KDKGTLPDKEAMNSA

SEQ ID NO: 1953880 - protein, 5 aa, Staphylococcus
KDKGV

SEQ ID NO: 1953881 - protein, 12 aa, Staphylococcus
KDKGYELYNFNQ

SEQ ID NO: 1953882 - protein, 6 aa, Staphylococcus
KDKGYN

SEQ ID NO: 1953883 - protein, 10 aa, Staphylococcus
KDKHYSSTEL

SEQ ID NO: 1953884 - protein, 10 aa, Staphylococcus
KDKIDDSSMS

SEQ ID NO: 1953885 - protein, 19 aa, Staphylococcus
KDKIIKSNDGNQLSLTKTE

SEQ ID NO: 1953886 - protein, 14 aa, Staphylococcus
KDKIQSLAKDKGLD

SEQ ID NO: 1953887 - protein, 8 aa, Staphylococcus
KDKKASLH

SEQ ID NO: 1953888 - protein, 10 aa, Staphylococcus
KDKKNDKSGI

SEQ ID NO: 1953889 - protein, 8 aa, Staphylococcus
KDKKQNGV

SEQ ID NO: 1953890 - protein, 5 aa, Staphylococcus
KDKKT

SEQ ID NO: 1953891 - protein, 9 aa, Staphylococcus
KDKKTTGVT

SEQ ID NO: 1953892 - protein, 8 aa, Staphylococcus
KDKKYIKE

SEQ ID NO: 1953893 - protein, 10 aa, Staphylococcus
KDKLDDSTMQ

SEQ ID NO: 1953894 - protein, 11 aa, Staphylococcus
KDKLNEHSQSL

SEQ ID NO: 1953895 - protein, 14 aa, Staphylococcus
KDKLNKESKAANWG

SEQ ID NO: 1953896 - protein, 12 aa, Staphylococcus
KDKLNQISKGTL

SEQ ID NO: 1953897 - protein, 8 aa, Staphylococcus
KDKLREPI

SEQ ID NO: 1953898 - protein, 8 aa, Staphylococcus
KDKLSQKI

SEQ ID NO: 1953899 - protein, 8 aa, Staphylococcus
KDKNEDQL

SEQ ID NO: 1953900 - protein, 22 aa, Staphylococcus
KDKNQQDEKPNNNDAQFEKDRE

SEQ ID NO: 1953901 - protein, 6 aa, Staphylococcus
KDKPAI

SEQ ID NO: 1953902 - protein, 7 aa, Staphylococcus
KDKPARL

SEQ ID NO: 1953903 - protein, 6 aa, Staphylococcus
KDKPGG

SEQ ID NO: 1953904 - protein, 8 aa, Staphylococcus
KDKPLSDD

SEQ ID NO: 1953905 - protein, 4 aa, Staphylococcus
KDKQ

SEQ ID NO: 1953906 - protein, 6 aa, Staphylococcus
KDKQEM

SEQ ID NO: 1953907 - protein, 10 aa, Staphylococcus
KDKQIKGGTD

SEQ ID NO: 1953908 - protein, 6 aa, Staphylococcus
KDKQIQ

SEQ ID NO: 1953909 - protein, 9 aa, Staphylococcus
KDKQITEAF

SEQ ID NO: 1953910 - protein, 10 aa, Staphylococcus
KDKQKATQKV

SEQ ID NO: 1953911 - protein, 7 aa, Staphylococcus
KDKQNEL

SEQ ID NO: 1953912 - protein, 8 aa, Staphylococcus
KDKQYIKD

SEQ ID NO: 1953913 - protein, 15 aa, Staphylococcus
KDKRKELEDLESADQ

SEQ ID NO: 1953914 - protein, 7 aa, Staphylococcus
KDKRTEY

SEQ ID NO: 1953915 - protein, 6 aa, Staphylococcus
KDKSAA

SEQ ID NO: 1953916 - protein, 21 aa, Staphylococcus
KDKSDAKKIKETVDVPKNPKR

SEQ ID NO: 1953917 - protein, 8 aa, Staphylococcus
KDKSEDQL

SEQ ID NO: 1953918 - protein, 10 aa, Staphylococcus
KDKSEQLSEQ

SEQ ID NO: 1953919 - protein, 8 aa, Staphylococcus
KDKSKETI

SEQ ID NO: 1953920 - protein, 7 aa, Staphylococcus
KDKSNIK

SEQ ID NO: 1953921 - protein, 7 aa, Staphylococcus
KDKSPFK

SEQ ID NO: 1953922 - protein, 8 aa, Staphylococcus
KDKSPQDV

SEQ ID NO: 1953923 - protein, 12 aa, Staphylococcus
KDKSQKQTEGIP

SEQ ID NO: 1953924 - protein, 9 aa, Staphylococcus
KDKTAKDVL

SEQ ID NO: 1953925 - protein, 8 aa, Staphylococcus
KDKTEDQL

SEQ ID NO: 1953926 - protein, 8 aa, Staphylococcus
KDKTETQI

SEQ ID NO: 1953927 - protein, 6 aa, Staphylococcus
KDKTIE

SEQ ID NO: 1953928 - protein, 8 aa, Staphylococcus
KDKTNQDE

SEQ ID NO: 1953929 - protein, 10 aa, Staphylococcus
KDKTPNGRDA

SEQ ID NO: 1953930 - protein, 8 aa, Staphylococcus
KDKTSKDI

SEQ ID NO: 1953931 - protein, 6 aa, Staphylococcus
KDKTYS

SEQ ID NO: 1953932 - protein, 31 aa, Staphylococcus
KDKVDEVKNDKDKQKEVKDQAQDKAKDLKDK

SEQ ID NO: 1953933 - protein, 9 aa, Staphylococcus
KDKVSVSTD

SEQ ID NO: 1953934 - protein, 4 aa, Staphylococcus
KDKY

SEQ ID NO: 1953935 - protein, 5 aa, Staphylococcus
KDKYA

SEQ ID NO: 1953936 - protein, 6 aa, Staphylococcus
KDKYDA

SEQ ID NO: 1953937 - protein, 8 aa, Staphylococcus
KDKYDATV

SEQ ID NO: 1953938 - protein, 6 aa, Staphylococcus
KDKYPE

SEQ ID NO: 1953939 - protein, 7 aa, Staphylococcus
KDLARTG

SEQ ID NO: 1953940 - protein, 5 aa, Staphylococcus
KDLDK

SEQ ID NO: 1953941 - protein, 10 aa, Staphylococcus
KDLDKQGKGV

SEQ ID NO: 1953942 - protein, 13 aa, Staphylococcus
KDLDKVQNEYQDQ

SEQ ID NO: 1953943 - protein, 4 aa, Staphylococcus
KDLE

SEQ ID NO: 1953944 - protein, 10 aa, Staphylococcus
KDLEAQGKGV

SEQ ID NO: 1953945 - protein, 6 aa, Staphylococcus
KDLEEE

SEQ ID NO: 1953946 - protein, 8 aa, Staphylococcus
KDLEPDEL

SEQ ID NO: 1953947 - protein, 6 aa, Staphylococcus
KDLEPL

SEQ ID NO: 1953948 - protein, 9 aa, Staphylococcus
KDLETERVR

SEQ ID NO: 1953949 - protein, 19 aa, Staphylococcus
KDLETGDPTEAQTGENEGY

SEQ ID NO: 1953950 - protein, 7 aa, Staphylococcus
KDLGDHF

SEQ ID NO: 1953951 - protein, 42 aa, Staphylococcus
KDLGENISEEDKSNAESKKDALKSALEGQDLDDIKAKKEELE

SEQ ID NO: 1953952 - protein, 33 aa, Staphylococcus
KDLGKEMEQISEENDEDKLNQSHDSELRSDLDQ

SEQ ID NO: 1953953 - protein, 12 aa, Staphylococcus
KDLGKSKVEAYA

SEQ ID NO: 1953954 - protein, 11 aa, Staphylococcus
KDLGKSNVEAY

SEQ ID NO: 1953955 - protein, 12 aa, Staphylococcus
KDLGKSNVEAYA

SEQ ID NO: 1953956 - protein, 8 aa, Staphylococcus
KDLGNPVT

SEQ ID NO: 1953957 - protein, 7 aa, Staphylococcus
KDLGNTS

SEQ ID NO: 1953958 - protein, 24 aa, Staphylococcus
KDLGTNKEQNITIESSSALSDDEI

SEQ ID NO: 1953959 - protein, 24 aa, Staphylococcus
KDLGTNKEQNITIQSSSALSDDEI

SEQ ID NO: 1953960 - protein, 24 aa, Staphylococcus
KDLGTNKEQNITIQSSSSLSDDEI

SEQ ID NO: 1953961 - protein, 24 aa, Staphylococcus
KDLGTNKEQNITIQSSSSLSDEEI

SEQ ID NO: 1953962 - protein, 4 aa, Staphylococcus
KDLH

SEQ ID NO: 1953963 - protein, 9 aa, Staphylococcus
KDLKPVKNK

SEQ ID NO: 1953964 - protein, 20 aa, Staphylococcus
KDLKRTPSFSVNRPGEETGV

SEQ ID NO: 1953965 - protein, 10 aa, Staphylococcus
KDLNDKGSTI

SEQ ID NO: 1953966 - protein, 9 aa, Staphylococcus
KDLNDQGST

SEQ ID NO: 1953967 - protein, 7 aa, Staphylococcus
KDLNHQE

SEQ ID NO: 1953968 - protein, 9 aa, Staphylococcus
KDLNKEGTT

SEQ ID NO: 1953969 - protein, 22 aa, Staphylococcus
KDLNKNPDNQKAAKKKENLEKQ

SEQ ID NO: 1953970 - protein, 6 aa, Staphylococcus
KDLNQI

SEQ ID NO: 1953971 - protein, 4 aa, Staphylococcus
KDLP

SEQ ID NO: 1953972 - protein, 8 aa, Staphylococcus
KDLPDGNL

SEQ ID NO: 1953973 - protein, 7 aa, Staphylococcus
KDLPINK

SEQ ID NO: 1953974 - protein, 16 aa, Staphylococcus
KDLPQRVEEKGEGLRE

SEQ ID NO: 1953975 - protein, 9 aa, Staphylococcus
KDLQEDKEG

SEQ ID NO: 1953976 - protein, 9 aa, Staphylococcus
KDLQSRGEK

SEQ ID NO: 1953977 - protein, 7 aa, Staphylococcus
KDLQSTH

SEQ ID NO: 1953978 - protein, 4 aa, Staphylococcus
KDLS

SEQ ID NO: 1953979 - protein, 6 aa, Staphylococcus
KDLSDF

SEQ ID NO: 1953980 - protein, 12 aa, Staphylococcus
KDLSKDMNYEKN

SEQ ID NO: 1953981 - protein, 8 aa, Staphylococcus
KDLSKEEM

SEQ ID NO: 1953982 - protein, 8 aa, Staphylococcus
KDLSNAGA

SEQ ID NO: 1953983 - protein, 15 aa, Staphylococcus
KDLSRLARRGSGSAC

SEQ ID NO: 1953984 - protein, 8 aa, Staphylococcus
KDLSTDEK

SEQ ID NO: 1953985 - protein, 4 aa, Staphylococcus
KDLT

SEQ ID NO: 1953986 - protein, 6 aa, Staphylococcus
KDLTEE

SEQ ID NO: 1953987 - protein, 28 aa, Staphylococcus
KDLTEEEKAMKAKAEADNTAQSNDDPNK

SEQ ID NO: 1953988 - protein, 6 aa, Staphylococcus
KDLTEP

SEQ ID NO: 1953989 - protein, 19 aa, Staphylococcus
KDLTPINKPTFKSTLSKSK

SEQ ID NO: 1953990 - protein, 8 aa, Staphylococcus
KDLTQDEK

SEQ ID NO: 1953991 - protein, 11 aa, Staphylococcus
KDMADDNQIEK

SEQ ID NO: 1953992 - protein, 12 aa, Staphylococcus
KDMASDSQIERI

SEQ ID NO: 1953993 - protein, 7 aa, Staphylococcus
KDMDPDE

SEQ ID NO: 1953994 - protein, 14 aa, Staphylococcus
KDMDPKPDCGEESY

SEQ ID NO: 1953995 - protein, 7 aa, Staphylococcus
KDMENSR

SEQ ID NO: 1953996 - protein, 6 aa, Staphylococcus
KDMNED

SEQ ID NO: 1953997 - protein, 21 aa, Staphylococcus
KDNAIKKAKELDELQAKGQME

SEQ ID NO: 1953998 - protein, 17 aa, Staphylococcus
KDNALTFSKEDREKVQD

SEQ ID NO: 1953999 - protein, 5 aa, Staphylococcus
KDNAS

SEQ ID NO: 1954000 - protein, 10 aa, Staphylococcus
KDNCKDSIEE

SEQ ID NO: 1954001 - protein, 7 aa, Staphylococcus
KDNDDNV

SEQ ID NO: 1954002 - protein, 12 aa, Staphylococcus
KDNDGEEAENTD

SEQ ID NO: 1954003 - protein, 10 aa, Staphylococcus
KDNDGTVTSD

SEQ ID NO: 1954004 - protein, 15 aa, Staphylococcus
KDNDKYEVKGRISKT

SEQ ID NO: 1954005 - protein, 9 aa, Staphylococcus
KDNDMNDEG

SEQ ID NO: 1954006 - protein, 5 aa, Staphylococcus
KDNDT

SEQ ID NO: 1954007 - protein, 5 aa, Staphylococcus
KDNDY

SEQ ID NO: 1954008 - protein, 4 aa, Staphylococcus
KDNE

SEQ ID NO: 1954009 - protein, 7 aa, Staphylococcus
KDNEENI

SEQ ID NO: 1954010 - protein, 7 aa, Staphylococcus
KDNELRG

SEQ ID NO: 1954011 - protein, 8 aa, Staphylococcus
KDNEPRLQ

SEQ ID NO: 1954012 - protein, 8 aa, Staphylococcus
KDNFEYQG

SEQ ID NO: 1954013 - protein, 8 aa, Staphylococcus
KDNFKNKE

SEQ ID NO: 1954014 - protein, 9 aa, Staphylococcus
KDNFSPSEV

SEQ ID NO: 1954015 - protein, 8 aa, Staphylococcus
KDNGANTV

SEQ ID NO: 1954016 - protein, 6 aa, Staphylococcus
KDNGEI

SEQ ID NO: 1954017 - protein, 8 aa, Staphylococcus
KDNGELTY

SEQ ID NO: 1954018 - protein, 4 aa, Staphylococcus
KDNI

SEQ ID NO: 1954019 - protein, 6 aa, Staphylococcus
KDNISK

SEQ ID NO: 1954020 - protein, 9 aa, Staphylococcus
KDNKGNLTD

SEQ ID NO: 1954021 - protein, 10 aa, Staphylococcus
KDNKIEPYTA

SEQ ID NO: 1954022 - protein, 7 aa, Staphylococcus
KDNKIPM

SEQ ID NO: 1954023 - protein, 8 aa, Staphylococcus
KDNKPGIS

SEQ ID NO: 1954024 - protein, 8 aa, Staphylococcus
KDNKSELE

SEQ ID NO: 1954025 - protein, 26 aa, Staphylococcus
KDNKTIVKQNKASNTVTYRFRILPIN

SEQ ID NO: 1954026 - protein, 8 aa, Staphylococcus
KDNKVKNI

SEQ ID NO: 1954027 - protein, 9 aa, Staphylococcus
KDNKVKNIG

SEQ ID NO: 1954028 - protein, 6 aa, Staphylococcus
KDNLEG

SEQ ID NO: 1954029 - protein, 9 aa, Staphylococcus
KDNLENDDE

SEQ ID NO: 1954030 - protein, 9 aa, Staphylococcus
KDNLQEARE

SEQ ID NO: 1954031 - protein, 12 aa, Staphylococcus
KDNLTNEGIEVS

SEQ ID NO: 1954032 - protein, 13 aa, Staphylococcus
KDNLTTKVKSGPT

SEQ ID NO: 1954033 - protein, 4 aa, Staphylococcus
KDNM

SEQ ID NO: 1954034 - protein, 13 aa, Staphylococcus
KDNNSGSIPKPKD

SEQ ID NO: 1954035 - protein, 12 aa, Staphylococcus
KDNPDEKYFSAN

SEQ ID NO: 1954036 - protein, 8 aa, Staphylococcus
KDNPDLTK

SEQ ID NO: 1954037 - protein, 9 aa, Staphylococcus
KDNPKKPDI

SEQ ID NO: 1954038 - protein, 8 aa, Staphylococcus
KDNPPQIY

SEQ ID NO: 1954039 - protein, 9 aa, Staphylococcus
KDNPSKERI

SEQ ID NO: 1954040 - protein, 16 aa, Staphylococcus
KDNQAGAALYDTNSVD

SEQ ID NO: 1954041 - protein, 6 aa, Staphylococcus
KDNQDV

SEQ ID NO: 1954042 - protein, 8 aa, Staphylococcus
KDNQEQLK

SEQ ID NO: 1954043 - protein, 6 aa, Staphylococcus
KDNQEV

SEQ ID NO: 1954044 - protein, 5 aa, Staphylococcus
KDNQH

SEQ ID NO: 1954045 - protein, 5 aa, Staphylococcus
KDNQI

SEQ ID NO: 1954046 - protein, 11 aa, Staphylococcus
KDNQNQQRKIR

SEQ ID NO: 1954047 - protein, 7 aa, Staphylococcus
KDNQPEF

SEQ ID NO: 1954048 - protein, 6 aa, Staphylococcus
KDNQTY

SEQ ID NO: 1954049 - protein, 5 aa, Staphylococcus
KDNQV

SEQ ID NO: 1954050 - protein, 6 aa, Staphylococcus
KDNRNN

SEQ ID NO: 1954051 - protein, 7 aa, Staphylococcus
KDNRRIN

SEQ ID NO: 1954052 - protein, 8 aa, Staphylococcus
KDNRSAGY

SEQ ID NO: 1954053 - protein, 7 aa, Staphylococcus
KDNRVKN

SEQ ID NO: 1954054 - protein, 17 aa, Staphylococcus
KDNSITIEDNGRGMPTG

SEQ ID NO: 1954055 - protein, 11 aa, Staphylococcus
KDNSLAQKASY

SEQ ID NO: 1954056 - protein, 10 aa, Staphylococcus
KDNSLAQQAN

SEQ ID NO: 1954057 - protein, 8 aa, Staphylococcus
KDNSQIIR

SEQ ID NO: 1954058 - protein, 17 aa, Staphylococcus
KDNSSHDEVEENNSAYE

SEQ ID NO: 1954059 - protein, 7 aa, Staphylococcus
KDNTDKA

SEQ ID NO: 1954060 - protein, 10 aa, Staphylococcus
KDNTLAQQAN

SEQ ID NO: 1954061 - protein, 8 aa, Staphylococcus
KDNVDQAK

SEQ ID NO: 1954062 - protein, 9 aa, Staphylococcus
KDNVKLNRE

SEQ ID NO: 1954063 - protein, 9 aa, Staphylococcus
KDNVQVGYE

SEQ ID NO: 1954064 - protein, 9 aa, Staphylococcus
KDNYEVSKE

SEQ ID NO: 1954065 - protein, 5 aa, Staphylococcus
KDNYN

SEQ ID NO: 1954066 - protein, 4 aa, Staphylococcus
KDPD

SEQ ID NO: 1954067 - protein, 7 aa, Staphylococcus
KDPDARV

SEQ ID NO: 1954068 - protein, 12 aa, Staphylococcus
KDPDGHKFNFLV

SEQ ID NO: 1954069 - protein, 8 aa, Staphylococcus
KDPDGHQI

SEQ ID NO: 1954070 - protein, 5 aa, Staphylococcus
KDPDI

SEQ ID NO: 1954071 - protein, 8 aa, Staphylococcus
KDPEDTAK

SEQ ID NO: 1954072 - protein, 12 aa, Staphylococcus
KDPEFRTTPSGV

SEQ ID NO: 1954073 - protein, 12 aa, Staphylococcus
KDPEFRTTQSGV

SEQ ID NO: 1954074 - protein, 8 aa, Staphylococcus
KDPEGNKY

SEQ ID NO: 1954075 - protein, 9 aa, Staphylococcus
KDPELNGSL

SEQ ID NO: 1954076 - protein, 7 aa, Staphylococcus
KDPENKK

SEQ ID NO: 1954077 - protein, 10 aa, Staphylococcus
KDPERTQERV

SEQ ID NO: 1954078 - protein, 7 aa, Staphylococcus
KDPETPI

SEQ ID NO: 1954079 - protein, 5 aa, Staphylococcus
KDPEV

SEQ ID NO: 1954080 - protein, 5 aa, Staphylococcus
KDPHE

SEQ ID NO: 1954081 - protein, 7 aa, Staphylococcus
KDPIGAM

SEQ ID NO: 1954082 - protein, 5 aa, Staphylococcus
KDPKA

SEQ ID NO: 1954083 - protein, 13 aa, Staphylococcus
KDPKIYDKEEKKL

SEQ ID NO: 1954084 - protein, 8 aa, Staphylococcus
KDPNDDKN

SEQ ID NO: 1954085 - protein, 11 aa, Staphylococcus
KDPNGPSIPQA

SEQ ID NO: 1954086 - protein, 20 aa, Staphylococcus
KDPNIPDDPNISQNLEPNSA

SEQ ID NO: 1954087 - protein, 5 aa, Staphylococcus
KDPNN

SEQ ID NO: 1954088 - protein, 14 aa, Staphylococcus
KDPNRHSLPQEDTN

SEQ ID NO: 1954089 - protein, 14 aa, Staphylococcus
KDPNRHSLPQEETN

SEQ ID NO: 1954090 - protein, 7 aa, Staphylococcus
KDPNRID

SEQ ID NO: 1954091 - protein, 14 aa, Staphylococcus
KDPNRQSLPQSETN

SEQ ID NO: 1954092 - protein, 6 aa, Staphylococcus
KDPQTP

SEQ ID NO: 1954093 - protein, 9 aa, Staphylococcus
KDPREHTSK

SEQ ID NO: 1954094 - protein, 7 aa, Staphylococcus
KDPSVPD

SEQ ID NO: 1954095 - protein, 19 aa, Staphylococcus
KDPTVINENANKDSETYTT

SEQ ID NO: 1954096 - protein, 19 aa, Staphylococcus
KDPTVVNENANKDSATFST

SEQ ID NO: 1954097 - protein, 9 aa, Staphylococcus
KDQADKGLL

SEQ ID NO: 1954098 - protein, 7 aa, Staphylococcus
KDQADKV

SEQ ID NO: 1954099 - protein, 7 aa, Staphylococcus
KDQAEKV

SEQ ID NO: 1954100 - protein, 8 aa, Staphylococcus
KDQAEVEK

SEQ ID NO: 1954101 - protein, 17 aa, Staphylococcus
KDQCGDSDDKPLSASPS

SEQ ID NO: 1954102 - protein, 7 aa, Staphylococcus
KDQCPSN

SEQ ID NO: 1954103 - protein, 15 aa, Staphylococcus
KDQCSEETDVPVSDH

SEQ ID NO: 1954104 - protein, 9 aa, Staphylococcus
KDQDASTKL

SEQ ID NO: 1954105 - protein, 6 aa, Staphylococcus
KDQDKL

SEQ ID NO: 1954106 - protein, 12 aa, Staphylococcus
KDQESVKAEHEL

SEQ ID NO: 1954107 - protein, 7 aa, Staphylococcus
KDQETLR

SEQ ID NO: 1954108 - protein, 9 aa, Staphylococcus
KDQETQEHY

SEQ ID NO: 1954109 - protein, 4 aa, Staphylococcus
KDQF

SEQ ID NO: 1954110 - protein, 6 aa, Staphylococcus
KDQFIN

SEQ ID NO: 1954111 - protein, 4 aa, Staphylococcus
KDQG

SEQ ID NO: 1954112 - protein, 14 aa, Staphylococcus
KDQGGNTQGFGGDG

SEQ ID NO: 1954113 - protein, 6 aa, Staphylococcus
KDQGHE

SEQ ID NO: 1954114 - protein, 8 aa, Staphylococcus
KDQGKTVD

SEQ ID NO: 1954115 - protein, 6 aa, Staphylococcus
KDQGTT

SEQ ID NO: 1954116 - protein, 8 aa, Staphylococcus
KDQGVITN

SEQ ID NO: 1954117 - protein, 12 aa, Staphylococcus
KDQGYEETFRDK

SEQ ID NO: 1954118 - protein, 18 aa, Staphylococcus
KDQHADSNQQPQKEKQKT

SEQ ID NO: 1954119 - protein, 21 aa, Staphylococcus
KDQINEYTGGEKHDNKDKKDD

SEQ ID NO: 1954120 - protein, 7 aa, Staphylococcus
KDQIQGE

SEQ ID NO: 1954121 - protein, 6 aa, Staphylococcus
KDQIQN

SEQ ID NO: 1954122 - protein, 8 aa, Staphylococcus
KDQITYDE

SEQ ID NO: 1954123 - protein, 11 aa, Staphylococcus
KDQKEKIGTQF

SEQ ID NO: 1954124 - protein, 13 aa, Staphylococcus
KDQKENGSERRTV

SEQ ID NO: 1954125 - protein, 13 aa, Staphylococcus
KDQKENGSSRRTV

SEQ ID NO: 1954126 - protein, 13 aa, Staphylococcus
KDQKENGSTKRTV

SEQ ID NO: 1954127 - protein, 8 aa, Staphylococcus
KDQKNHPK

SEQ ID NO: 1954128 - protein, 11 aa, Staphylococcus
KDQLSNETYQI

SEQ ID NO: 1954129 - protein, 8 aa, Staphylococcus
KDQMPGES

SEQ ID NO: 1954130 - protein, 4 aa, Staphylococcus
KDQN

SEQ ID NO: 1954131 - protein, 8 aa, Staphylococcus
KDQNKQLE

SEQ ID NO: 1954132 - protein, 15 aa, Staphylococcus
KDQNLSLNPAKISGA

SEQ ID NO: 1954133 - protein, 8 aa, Staphylococcus
KDQPLSEG

SEQ ID NO: 1954134 - protein, 7 aa, Staphylococcus
KDQQADA

SEQ ID NO: 1954135 - protein, 10 aa, Staphylococcus
KDQQKHYDGH

SEQ ID NO: 1954136 - protein, 10 aa, Staphylococcus
KDQQSKYGIS

SEQ ID NO: 1954137 - protein, 12 aa, Staphylococcus
KDQRKEGIAGSA

SEQ ID NO: 1954138 - protein, 9 aa, Staphylococcus
KDQRNSDLA

SEQ ID NO: 1954139 - protein, 6 aa, Staphylococcus
KDQRQR

SEQ ID NO: 1954140 - protein, 9 aa, Staphylococcus
KDQSDSTYE

SEQ ID NO: 1954141 - protein, 18 aa, Staphylococcus
KDQSINLKKADDGGYTFE

SEQ ID NO: 1954142 - protein, 7 aa, Staphylococcus
KDQSNKA

SEQ ID NO: 1954143 - protein, 9 aa, Staphylococcus
KDQSPSTEI

SEQ ID NO: 1954144 - protein, 14 aa, Staphylococcus
KDQSTQAPEGVCVM

SEQ ID NO: 1954145 - protein, 16 aa, Staphylococcus
KDQTELGKEAKSYMDR

SEQ ID NO: 1954146 - protein, 8 aa, Staphylococcus
KDQTHEET

SEQ ID NO: 1954147 - protein, 9 aa, Staphylococcus
KDQTQINEK

SEQ ID NO: 1954148 - protein, 7 aa, Staphylococcus
KDQVEES

SEQ ID NO: 1954149 - protein, 5 aa, Staphylococcus
KDQVN

SEQ ID NO: 1954150 - protein, 4 aa, Staphylococcus
KDQY

SEQ ID NO: 1954151 - protein, 8 aa, Staphylococcus
KDQYSWKD

SEQ ID NO: 1954152 - protein, 5 aa, Staphylococcus
KDQYT

SEQ ID NO: 1954153 - protein, 4 aa, Staphylococcus
KDRA

SEQ ID NO: 1954154 - protein, 10 aa, Staphylococcus
KDRAEGLKAA

SEQ ID NO: 1954155 - protein, 6 aa, Staphylococcus
KDRAEN

SEQ ID NO: 1954156 - protein, 14 aa, Staphylococcus
KDRAKEFSVSDRPN

SEQ ID NO: 1954157 - protein, 4 aa, Staphylococcus
KDRD

SEQ ID NO: 1954158 - protein, 9 aa, Staphylococcus
KDRENNVNK

SEQ ID NO: 1954159 - protein, 8 aa, Staphylococcus
KDREQDVN

SEQ ID NO: 1954160 - protein, 11 aa, Staphylococcus
KDREQNPNKQW

SEQ ID NO: 1954161 - protein, 5 aa, Staphylococcus
KDRER

SEQ ID NO: 1954162 - protein, 6 aa, Staphylococcus
KDRERL

SEQ ID NO: 1954163 - protein, 9 aa, Staphylococcus
KDRESSQRD

SEQ ID NO: 1954164 - protein, 7 aa, Staphylococcus
KDRIDQR

SEQ ID NO: 1954165 - protein, 13 aa, Staphylococcus
KDRKQVPFTAPAE

SEQ ID NO: 1954166 - protein, 5 aa, Staphylococcus
KDRLE

SEQ ID NO: 1954167 - protein, 10 aa, Staphylococcus
KDRLGNKFTA

SEQ ID NO: 1954168 - protein, 15 aa, Staphylococcus
KDRNIKTLSGGQRQR

SEQ ID NO: 1954169 - protein, 9 aa, Staphylococcus
KDRQENVNK

SEQ ID NO: 1954170 - protein, 9 aa, Staphylococcus
KDRQNNVDK

SEQ ID NO: 1954171 - protein, 9 aa, Staphylococcus
KDRSKNELE

SEQ ID NO: 1954172 - protein, 7 aa, Staphylococcus
KDRVGGT

SEQ ID NO: 1954173 - protein, 23 aa, Staphylococcus
KDRVKPDNIPEKERLSNISEKVT

SEQ ID NO: 1954174 - protein, 7 aa, Staphylococcus
KDSADAL

SEQ ID NO: 1954175 - protein, 8 aa, Staphylococcus
KDSAKDKH

SEQ ID NO: 1954176 - protein, 7 aa, Staphylococcus
KDSAKRM

SEQ ID NO: 1954177 - protein, 7 aa, Staphylococcus
KDSAPVL

SEQ ID NO: 1954178 - protein, 14 aa, Staphylococcus
KDSAQDAKMPEGKN

SEQ ID NO: 1954179 - protein, 5 aa, Staphylococcus
KDSDI

SEQ ID NO: 1954180 - protein, 15 aa, Staphylococcus
KDSDIKSLKDLKGKK

SEQ ID NO: 1954181 - protein, 11 aa, Staphylococcus
KDSDPDSEIAE

SEQ ID NO: 1954182 - protein, 12 aa, Staphylococcus
KDSDPDSELAET

SEQ ID NO: 1954183 - protein, 7 aa, Staphylococcus
KDSDPLL

SEQ ID NO: 1954184 - protein, 8 aa, Staphylococcus
KDSDSKIG

SEQ ID NO: 1954185 - protein, 13 aa, Staphylococcus
KDSDSKPDMEEAG

SEQ ID NO: 1954186 - protein, 8 aa, Staphylococcus
KDSDYITG

SEQ ID NO: 1954187 - protein, 4 aa, Staphylococcus
KDSE

SEQ ID NO: 1954188 - protein, 24 aa, Staphylococcus
KDSEDKLTSIKRQTESRRGGKGAR

SEQ ID NO: 1954189 - protein, 24 aa, Staphylococcus
KDSEEKMTSIKRQTESRRGGRGSR

SEQ ID NO: 1954190 - protein, 5 aa, Staphylococcus
KDSEG

SEQ ID NO: 1954191 - protein, 9 aa, Staphylococcus
KDSEGPVAV

SEQ ID NO: 1954192 - protein, 11 aa, Staphylococcus
KDSEPPIPGEL

SEQ ID NO: 1954193 - protein, 10 aa, Staphylococcus
KDSEPPISGD

SEQ ID NO: 1954194 - protein, 11 aa, Staphylococcus
KDSEPPISGDL

SEQ ID NO: 1954195 - protein, 9 aa, Staphylococcus
KDSETTVKE

SEQ ID NO: 1954196 - protein, 9 aa, Staphylococcus
KDSEVYDPR

SEQ ID NO: 1954197 - protein, 7 aa, Staphylococcus
KDSFNDN

SEQ ID NO: 1954198 - protein, 8 aa, Staphylococcus
KDSFSGKV

SEQ ID NO: 1954199 - protein, 9 aa, Staphylococcus
KDSFSPSEV

SEQ ID NO: 1954200 - protein, 8 aa, Staphylococcus
KDSGAEIV

SEQ ID NO: 1954201 - protein, 7 aa, Staphylococcus
KDSGAKE

SEQ ID NO: 1954202 - protein, 10 aa, Staphylococcus
KDSGEGESVE

SEQ ID NO: 1954203 - protein, 14 aa, Staphylococcus
KDSGEITESTEKAV

SEQ ID NO: 1954204 - protein, 5 aa, Staphylococcus
KDSGI

SEQ ID NO: 1954205 - protein, 6 aa, Staphylococcus
KDSGMS

SEQ ID NO: 1954206 - protein, 8 aa, Staphylococcus
KDSGNINV

SEQ ID NO: 1954207 - protein, 9 aa, Staphylococcus
KDSGTNFDK

SEQ ID NO: 1954208 - protein, 9 aa, Staphylococcus
KDSHKRRSM

SEQ ID NO: 1954209 - protein, 4 aa, Staphylococcus
KDSI

SEQ ID NO: 1954210 - protein, 8 aa, Staphylococcus
KDSIDDLT

SEQ ID NO: 1954211 - protein, 5 aa, Staphylococcus
KDSIE

SEQ ID NO: 1954212 - protein, 8 aa, Staphylococcus
KDSIKNPD

SEQ ID NO: 1954213 - protein, 9 aa, Staphylococcus
KDSINKEDH

SEQ ID NO: 1954214 - protein, 8 aa, Staphylococcus
KDSIQKAD

SEQ ID NO: 1954215 - protein, 8 aa, Staphylococcus
KDSIQKDD

SEQ ID NO: 1954216 - protein, 8 aa, Staphylococcus
KDSITDSN

SEQ ID NO: 1954217 - protein, 7 aa, Staphylococcus
KDSKGFS

SEQ ID NO: 1954218 - protein, 10 aa, Staphylococcus
KDSKGTIDED

SEQ ID NO: 1954219 - protein, 9 aa, Staphylococcus
KDSKGVVDE

SEQ ID NO: 1954220 - protein, 4 aa, Staphylococcus
KDSL

SEQ ID NO: 1954221 - protein, 8 aa, Staphylococcus
KDSLAQTD

SEQ ID NO: 1954222 - protein, 5 aa, Staphylococcus
KDSLE

SEQ ID NO: 1954223 - protein, 9 aa, Staphylococcus
KDSLKNTGL

SEQ ID NO: 1954224 - protein, 8 aa, Staphylococcus
KDSLPEGT

SEQ ID NO: 1954225 - protein, 5 aa, Staphylococcus
KDSMT

SEQ ID NO: 1954226 - protein, 4 aa, Staphylococcus
KDSN

SEQ ID NO: 1954227 - protein, 13 aa, Staphylococcus
KDSNAESEVEETS

SEQ ID NO: 1954228 - protein, 7 aa, Staphylococcus
KDSPDSI

SEQ ID NO: 1954229 - protein, 10 aa, Staphylococcus
KDSPLNDDTV

SEQ ID NO: 1954230 - protein, 6 aa, Staphylococcus
KDSQSP

SEQ ID NO: 1954231 - protein, 7 aa, Staphylococcus
KDSQVKI

SEQ ID NO: 1954232 - protein, 8 aa, Staphylococcus
KDSQWKEE

SEQ ID NO: 1954233 - protein, 4 aa, Staphylococcus
KDSR

SEQ ID NO: 1954234 - protein, 8 aa, Staphylococcus
KDSSAQLT

SEQ ID NO: 1954235 - protein, 10 aa, Staphylococcus
KDSSGPYHKG

SEQ ID NO: 1954236 - protein, 6 aa, Staphylococcus
KDSSKR

SEQ ID NO: 1954237 - protein, 12 aa, Staphylococcus
KDSTFKQSASTV

SEQ ID NO: 1954238 - protein, 4 aa, Staphylococcus
KDSV

SEQ ID NO: 1954239 - protein, 8 aa, Staphylococcus
KDSYDPDI

SEQ ID NO: 1954240 - protein, 14 aa, Staphylococcus
KDSYGTSRPIRYEK

SEQ ID NO: 1954241 - protein, 5 aa, Staphylococcus
KDTAD

SEQ ID NO: 1954242 - protein, 27 aa, Staphylococcus
KDTAINDDDVSSTTVKEDIKDQETEVP

SEQ ID NO: 1954243 - protein, 6 aa, Staphylococcus
KDTASL

SEQ ID NO: 1954244 - protein, 9 aa, Staphylococcus
KDTDADVEQ

SEQ ID NO: 1954245 - protein, 13 aa, Staphylococcus
KDTDGPEARQGYG

SEQ ID NO: 1954246 - protein, 8 aa, Staphylococcus
KDTDIQLS

SEQ ID NO: 1954247 - protein, 9 aa, Staphylococcus
KDTDKGTLQ

SEQ ID NO: 1954248 - protein, 11 aa, Staphylococcus
KDTDKSKGNLQ

SEQ ID NO: 1954249 - protein, 7 aa, Staphylococcus
KDTDQFQ

SEQ ID NO: 1954250 - protein, 11 aa, Staphylococcus
KDTDQGKGTLQ

SEQ ID NO: 1954251 - protein, 18 aa, Staphylococcus
KDTEDLTQRIQKQENQIK

SEQ ID NO: 1954252 - protein, 26 aa, Staphylococcus
KDTEGNVQERESYTAEIDASDAEKGV

SEQ ID NO: 1954253 - protein, 7 aa, Staphylococcus
KDTEHSS

SEQ ID NO: 1954254 - protein, 14 aa, Staphylococcus
KDTEKPSKQSVSEL

SEQ ID NO: 1954255 - protein, 10 aa, Staphylococcus
KDTENLTDHD

SEQ ID NO: 1954256 - protein, 11 aa, Staphylococcus
KDTEPPIPGEL

SEQ ID NO: 1954257 - protein, 11 aa, Staphylococcus
KDTEQSKGNLQ

SEQ ID NO: 1954258 - protein, 7 aa, Staphylococcus
KDTETPE

SEQ ID NO: 1954259 - protein, 6 aa, Staphylococcus
KDTFDT

SEQ ID NO: 1954260 - protein, 6 aa, Staphylococcus
KDTFEE

SEQ ID NO: 1954261 - protein, 6 aa, Staphylococcus
KDTFET

SEQ ID NO: 1954262 - protein, 13 aa, Staphylococcus
KDTGDITEETEKA

SEQ ID NO: 1954263 - protein, 5 aa, Staphylococcus
KDTGE

SEQ ID NO: 1954264 - protein, 6 aa, Staphylococcus
KDTGEI

SEQ ID NO: 1954265 - protein, 5 aa, Staphylococcus
KDTGG

SEQ ID NO: 1954266 - protein, 6 aa, Staphylococcus
KDTGLN

SEQ ID NO: 1954267 - protein, 14 aa, Staphylococcus
KDTGSITEETEKAV

SEQ ID NO: 1954268 - protein, 5 aa, Staphylococcus
KDTHE

SEQ ID NO: 1954269 - protein, 7 aa, Staphylococcus
KDTIDSA

SEQ ID NO: 1954270 - protein, 13 aa, Staphylococcus
KDTIKKASIASGV

SEQ ID NO: 1954271 - protein, 9 aa, Staphylococcus
KDTKKKYNL

SEQ ID NO: 1954272 - protein, 10 aa, Staphylococcus
KDTKKKYNLN

SEQ ID NO: 1954273 - protein, 8 aa, Staphylococcus
KDTKQLKQ

SEQ ID NO: 1954274 - protein, 4 aa, Staphylococcus
KDTL

SEQ ID NO: 1954275 - protein, 7 aa, Staphylococcus
KDTNAYV

SEQ ID NO: 1954276 - protein, 10 aa, Staphylococcus
KDTNKENSSK

SEQ ID NO: 1954277 - protein, 8 aa, Staphylococcus
KDTNKSAI

SEQ ID NO: 1954278 - protein, 6 aa, Staphylococcus
KDTNLD

SEQ ID NO: 1954279 - protein, 7 aa, Staphylococcus
KDTNMEN

SEQ ID NO: 1954280 - protein, 6 aa, Staphylococcus
KDTNYH

SEQ ID NO: 1954281 - protein, 9 aa, Staphylococcus
KDTPENGKG

SEQ ID NO: 1954282 - protein, 6 aa, Staphylococcus
KDTPKK

SEQ ID NO: 1954283 - protein, 11 aa, Staphylococcus
KDTPPPIPGEL

SEQ ID NO: 1954284 - protein, 7 aa, Staphylococcus
KDTPYEY

SEQ ID NO: 1954285 - protein, 5 aa, Staphylococcus
KDTQA

SEQ ID NO: 1954286 - protein, 7 aa, Staphylococcus
KDTRDKH

SEQ ID NO: 1954287 - protein, 10 aa, Staphylococcus
KDTRDKQYRY

SEQ ID NO: 1954288 - protein, 8 aa, Staphylococcus
KDTRDNQL

SEQ ID NO: 1954289 - protein, 7 aa, Staphylococcus
KDTSFKK

SEQ ID NO: 1954290 - protein, 9 aa, Staphylococcus
KDTSIKSIS

SEQ ID NO: 1954291 - protein, 7 aa, Staphylococcus
KDTSKVK

SEQ ID NO: 1954292 - protein, 8 aa, Staphylococcus
KDTSRATV

SEQ ID NO: 1954293 - protein, 11 aa, Staphylococcus
KDTSSTSKTDI

SEQ ID NO: 1954294 - protein, 12 aa, Staphylococcus
KDTTDDRTTTHV

SEQ ID NO: 1954295 - protein, 9 aa, Staphylococcus
KDTTEADID

SEQ ID NO: 1954296 - protein, 9 aa, Staphylococcus
KDTTGAGDA

SEQ ID NO: 1954297 - protein, 7 aa, Staphylococcus
KDTTTTH

SEQ ID NO: 1954298 - protein, 6 aa, Staphylococcus
KDTTYS

SEQ ID NO: 1954299 - protein, 13 aa, Staphylococcus
KDTVDQLKDYDGV

SEQ ID NO: 1954300 - protein, 6 aa, Staphylococcus
KDTWSH

SEQ ID NO: 1954301 - protein, 14 aa, Staphylococcus
KDTYNKQSQLTERD

SEQ ID NO: 1954302 - protein, 49 aa, Staphylococcus
KDVAEEEKGDSIKEDEFPKDDKLSEEIESETADRGEQTPKKGFWSRLFG

SEQ ID NO: 1954303 - protein, 8 aa, Staphylococcus
KDVATSRK

SEQ ID NO: 1954304 - protein, 6 aa, Staphylococcus
KDVDHN

SEQ ID NO: 1954305 - protein, 7 aa, Staphylococcus
KDVDHSR

SEQ ID NO: 1954306 - protein, 13 aa, Staphylococcus
KDVEALAKNAGVP

SEQ ID NO: 1954307 - protein, 14 aa, Staphylococcus
KDVEKWAKKGIAKT

SEQ ID NO: 1954308 - protein, 12 aa, Staphylococcus
KDVENSRSHALQ

SEQ ID NO: 1954309 - protein, 5 aa, Staphylococcus
KDVEQ

SEQ ID NO: 1954310 - protein, 13 aa, Staphylococcus
KDVETQKASSEDI

SEQ ID NO: 1954311 - protein, 8 aa, Staphylococcus
KDVGEAAY

SEQ ID NO: 1954312 - protein, 8 aa, Staphylococcus
KDVIDSGK

SEQ ID NO: 1954313 - protein, 10 aa, Staphylococcus
KDVKNGDYST

SEQ ID NO: 1954314 - protein, 10 aa, Staphylococcus
KDVLNKDEYK

SEQ ID NO: 1954315 - protein, 9 aa, Staphylococcus
KDVLSTEEY

SEQ ID NO: 1954316 - protein, 5 aa, Staphylococcus
KDVND

SEQ ID NO: 1954317 - protein, 6 aa, Staphylococcus
KDVNSD

SEQ ID NO: 1954318 - protein, 6 aa, Staphylococcus
KDVNSE

SEQ ID NO: 1954319 - protein, 8 aa, Staphylococcus
KDVNSESI

SEQ ID NO: 1954320 - protein, 8 aa, Staphylococcus
KDVPPNSL

SEQ ID NO: 1954321 - protein, 9 aa, Staphylococcus
KDVQENEEK

SEQ ID NO: 1954322 - protein, 6 aa, Staphylococcus
KDVRNN

SEQ ID NO: 1954323 - protein, 8 aa, Staphylococcus
KDVSNQER

SEQ ID NO: 1954324 - protein, 6 aa, Staphylococcus
KDVSTA

SEQ ID NO: 1954325 - protein, 20 aa, Staphylococcus
KDVTKHKKDKDANPELNEND

SEQ ID NO: 1954326 - protein, 6 aa, Staphylococcus
KDVTSI

SEQ ID NO: 1954327 - protein, 6 aa, Staphylococcus
KDWGKR

SEQ ID NO: 1954328 - protein, 4 aa, Staphylococcus
KDWR

SEQ ID NO: 1954329 - protein, 12 aa, Staphylococcus
KDWVKESSNRNS

SEQ ID NO: 1954330 - protein, 8 aa, Staphylococcus
KDYAETRD

SEQ ID NO: 1954331 - protein, 8 aa, Staphylococcus
KDYAETRS

SEQ ID NO: 1954332 - protein, 8 aa, Staphylococcus
KDYDGKKK

SEQ ID NO: 1954333 - protein, 6 aa, Staphylococcus
KDYDID

SEQ ID NO: 1954334 - protein, 6 aa, Staphylococcus
KDYDKD

SEQ ID NO: 1954335 - protein, 6 aa, Staphylococcus
KDYDKS

SEQ ID NO: 1954336 - protein, 10 aa, Staphylococcus
KDYDTSVPKS

SEQ ID NO: 1954337 - protein, 11 aa, Staphylococcus
KDYEENTPLEE

SEQ ID NO: 1954338 - protein, 8 aa, Staphylococcus
KDYEGKNI

SEQ ID NO: 1954339 - protein, 12 aa, Staphylococcus
KDYEKDTPLEEQ

SEQ ID NO: 1954340 - protein, 6 aa, Staphylococcus
KDYENN

SEQ ID NO: 1954341 - protein, 13 aa, Staphylococcus
KDYESQTQDFEKQ

SEQ ID NO: 1954342 - protein, 9 aa, Staphylococcus
KDYGKQKVK

SEQ ID NO: 1954343 - protein, 6 aa, Staphylococcus
KDYGMS

SEQ ID NO: 1954344 - protein, 6 aa, Staphylococcus
KDYGSL

SEQ ID NO: 1954345 - protein, 13 aa, Staphylococcus
KDYISATEDNAHQ

SEQ ID NO: 1954346 - protein, 13 aa, Staphylococcus
KDYISATTDEQHK

SEQ ID NO: 1954347 - protein, 16 aa, Staphylococcus
KDYKDAGADIVSEQSS

SEQ ID NO: 1954348 - protein, 18 aa, Staphylococcus
KDYKNGDISYNPNVPSYS

SEQ ID NO: 1954349 - protein, 31 aa, Staphylococcus
KDYKNGDISYNPNVPSYSAKYQLSNDDYNVQ

SEQ ID NO: 1954350 - protein, 12 aa, Staphylococcus
KDYKSAIEVGKE

SEQ ID NO: 1954351 - protein, 18 aa, Staphylococcus
KDYKSEKDQNTDALIDEL

SEQ ID NO: 1954352 - protein, 18 aa, Staphylococcus
KDYKTEKDKHTDALIDEL

SEQ ID NO: 1954353 - protein, 4 aa, Staphylococcus
KDYN

SEQ ID NO: 1954354 - protein, 7 aa, Staphylococcus
KDYNDLR

SEQ ID NO: 1954355 - protein, 17 aa, Staphylococcus
KDYNEAELSAFLEKKEG

SEQ ID NO: 1954356 - protein, 10 aa, Staphylococcus
KDYNTNPHSA

SEQ ID NO: 1954357 - protein, 5 aa, Staphylococcus
KDYNV

SEQ ID NO: 1954358 - protein, 5 aa, Staphylococcus
KDYPE

SEQ ID NO: 1954359 - protein, 9 aa, Staphylococcus
KDYPEYASG

SEQ ID NO: 1954360 - protein, 18 aa, Staphylococcus
KDYQSQKDKDTETLMQDL

SEQ ID NO: 1954361 - protein, 13 aa, Staphylococcus
KDYRQGLQDQVQT

SEQ ID NO: 1954362 - protein, 4 aa, Staphylococcus
KDYS

SEQ ID NO: 1954363 - protein, 7 aa, Staphylococcus
KDYSQEG

SEQ ID NO: 1954364 - protein, 7 aa, Staphylococcus
KDYTEEE

SEQ ID NO: 1954365 - protein, 6 aa, Staphylococcus
KDYTEQ

SEQ ID NO: 1954366 - protein, 6 aa, Staphylococcus
KDYTKQ

SEQ ID NO: 1954367 - protein, 7 aa, Staphylococcus
KDYTSEE

SEQ ID NO: 1954368 - protein, 8 aa, Staphylococcus
KEAADNND

SEQ ID NO: 1954369 - protein, 7 aa, Staphylococcus
KEAAENA

SEQ ID NO: 1954370 - protein, 9 aa, Staphylococcus
KEAAENGKQ

SEQ ID NO: 1954371 - protein, 6 aa, Staphylococcus
KEAAEV

SEQ ID NO: 1954372 - protein, 8 aa, Staphylococcus
KEAAHEQA

SEQ ID NO: 1954373 - protein, 7 aa, Staphylococcus
KEAAKKC

SEQ ID NO: 1954374 - protein, 7 aa, Staphylococcus
KEAAREI

SEQ ID NO: 1954375 - protein, 5 aa, Staphylococcus
KEAAS

SEQ ID NO: 1954376 - protein, 7 aa, Staphylococcus
KEAATEI

SEQ ID NO: 1954377 - protein, 24 aa, Staphylococcus
KEAAVSGKSSSKKNTKSSNQTYPF

SEQ ID NO: 1954378 - protein, 4 aa, Staphylococcus
KEAD

SEQ ID NO: 1954379 - protein, 5 aa, Staphylococcus
KEADD

SEQ ID NO: 1954380 - protein, 8 aa, Staphylococcus
KEADEDTL

SEQ ID NO: 1954381 - protein, 8 aa, Staphylococcus
KEADGTRH

SEQ ID NO: 1954382 - protein, 13 aa, Staphylococcus
KEADKKEIHDISK

SEQ ID NO: 1954383 - protein, 7 aa, Staphylococcus
KEADQEQ

SEQ ID NO: 1954384 - protein, 8 aa, Staphylococcus
KEADSGLG

SEQ ID NO: 1954385 - protein, 13 aa, Staphylococcus
KEAEELKQRLKQT

SEQ ID NO: 1954386 - protein, 17 aa, Staphylococcus
KEAEELKVKETNRIDTT

SEQ ID NO: 1954387 - protein, 8 aa, Staphylococcus
KEAEHRKV

SEQ ID NO: 1954388 - protein, 7 aa, Staphylococcus
KEAEPGY

SEQ ID NO: 1954389 - protein, 6 aa, Staphylococcus
KEAEVT

SEQ ID NO: 1954390 - protein, 11 aa, Staphylococcus
KEAFKPIEPGK

SEQ ID NO: 1954391 - protein, 6 aa, Staphylococcus
KEAGAD

SEQ ID NO: 1954392 - protein, 7 aa, Staphylococcus
KEAGADA

SEQ ID NO: 1954393 - protein, 10 aa, Staphylococcus
KEAGADAIHP

SEQ ID NO: 1954394 - protein, 7 aa, Staphylococcus
KEAGAEV

SEQ ID NO: 1954395 - protein, 8 aa, Staphylococcus
KEAGEQAL

SEQ ID NO: 1954396 - protein, 10 aa, Staphylococcus
KEAGGIEADA

SEQ ID NO: 1954397 - protein, 9 aa, Staphylococcus
KEAGIPAEA

SEQ ID NO: 1954398 - protein, 12 aa, Staphylococcus
KEAGIYEELLTI

SEQ ID NO: 1954399 - protein, 12 aa, Staphylococcus
KEAGIYEELLTV

SEQ ID NO: 1954400 - protein, 13 aa, Staphylococcus
KEAGIYEQLLTID

SEQ ID NO: 1954401 - protein, 14 aa, Staphylococcus
KEAGMSKREAKLRA

SEQ ID NO: 1954402 - protein, 16 aa, Staphylococcus
KEAGQSHNDAQQRART

SEQ ID NO: 1954403 - protein, 13 aa, Staphylococcus
KEAHITDYTNASR

SEQ ID NO: 1954404 - protein, 16 aa, Staphylococcus
KEAHPRSLSGGEKQRV

SEQ ID NO: 1954405 - protein, 4 aa, Staphylococcus
KEAK

SEQ ID NO: 1954406 - protein, 6 aa, Staphylococcus
KEAKKL

SEQ ID NO: 1954407 - protein, 8 aa, Staphylococcus
KEAKQYSL

SEQ ID NO: 1954408 - protein, 11 aa, Staphylococcus
KEAKSEGQKYF

SEQ ID NO: 1954409 - protein, 8 aa, Staphylococcus
KEALEDEN

SEQ ID NO: 1954410 - protein, 6 aa, Staphylococcus
KEALPE

SEQ ID NO: 1954411 - protein, 18 aa, Staphylococcus
KEALQQKREQEDTDSIQK

SEQ ID NO: 1954412 - protein, 17 aa, Staphylococcus
KEALSFTKEDREKVENQ

SEQ ID NO: 1954413 - protein, 4 aa, Staphylococcus
KEAM

SEQ ID NO: 1954414 - protein, 13 aa, Staphylococcus
KEAMTDEEKRKQF

SEQ ID NO: 1954415 - protein, 5 aa, Staphylococcus
KEANG

SEQ ID NO: 1954416 - protein, 8 aa, Staphylococcus
KEANKDGL

SEQ ID NO: 1954417 - protein, 27 aa, Staphylococcus
KEANLDDLKGAGLPEKVAKNLQKALQN

SEQ ID NO: 1954418 - protein, 15 aa, Staphylococcus
KEANNHKDDTPQTVE

SEQ ID NO: 1954419 - protein, 8 aa, Staphylococcus
KEANSEAI

SEQ ID NO: 1954420 - protein, 10 aa, Staphylococcus
KEANVDIETP

SEQ ID NO: 1954421 - protein, 8 aa, Staphylococcus
KEAPDYTL

SEQ ID NO: 1954422 - protein, 9 aa, Staphylococcus
KEAPGPLIK

SEQ ID NO: 1954423 - protein, 5 aa, Staphylococcus
KEAPR

SEQ ID NO: 1954424 - protein, 10 aa, Staphylococcus
KEAQAERQVT

SEQ ID NO: 1954425 - protein, 8 aa, Staphylococcus
KEAQGDEI

SEQ ID NO: 1954426 - protein, 6 aa, Staphylococcus
KEAQLK

SEQ ID NO: 1954427 - protein, 5 aa, Staphylococcus
KEAQQ

SEQ ID NO: 1954428 - protein, 13 aa, Staphylococcus
KEARDHVMSVFKQ

SEQ ID NO: 1954429 - protein, 6 aa, Staphylococcus
KEAREH

SEQ ID NO: 1954430 - protein, 14 aa, Staphylococcus
KEARERALNGEGAT

SEQ ID NO: 1954431 - protein, 14 aa, Staphylococcus
KEARERALNGEGTT

SEQ ID NO: 1954432 - protein, 11 aa, Staphylococcus
KEARLASGALA

SEQ ID NO: 1954433 - protein, 11 aa, Staphylococcus
KEARLENGALA

SEQ ID NO: 1954434 - protein, 10 aa, Staphylococcus
KEARLESGAL

SEQ ID NO: 1954435 - protein, 14 aa, Staphylococcus
KEARNRALNGEGAT

SEQ ID NO: 1954436 - protein, 7 aa, Staphylococcus
KEARVEY

SEQ ID NO: 1954437 - protein, 10 aa, Staphylococcus
KEASDQISEN

SEQ ID NO: 1954438 - protein, 8 aa, Staphylococcus
KEASEKFG

SEQ ID NO: 1954439 - protein, 17 aa, Staphylococcus
KEASGNQKKQDKHETVE

SEQ ID NO: 1954440 - protein, 10 aa, Staphylococcus
KEASHLKPQD

SEQ ID NO: 1954441 - protein, 6 aa, Staphylococcus
KEASIE

SEQ ID NO: 1954442 - protein, 27 aa, Staphylococcus
KEASLEDLKKSGLPENVAKNLQHALQN

SEQ ID NO: 1954443 - protein, 6 aa, Staphylococcus
KEASPV

SEQ ID NO: 1954444 - protein, 8 aa, Staphylococcus
KEASQITE

SEQ ID NO: 1954445 - protein, 17 aa, Staphylococcus
KEASVEDLKNSGLPQNV

SEQ ID NO: 1954446 - protein, 9 aa, Staphylococcus
KEASVEDTF

SEQ ID NO: 1954447 - protein, 7 aa, Staphylococcus
KEATEAT

SEQ ID NO: 1954448 - protein, 7 aa, Staphylococcus
KEATESY

SEQ ID NO: 1954449 - protein, 9 aa, Staphylococcus
KEATGGLDE

SEQ ID NO: 1954450 - protein, 6 aa, Staphylococcus
KEATID

SEQ ID NO: 1954451 - protein, 7 aa, Staphylococcus
KEATLPE

SEQ ID NO: 1954452 - protein, 9 aa, Staphylococcus
KEATNGGKI

SEQ ID NO: 1954453 - protein, 8 aa, Staphylococcus
KEATVDIE

SEQ ID NO: 1954454 - protein, 6 aa, Staphylococcus
KEATVS

SEQ ID NO: 1954455 - protein, 10 aa, Staphylococcus
KEAVDEGAEA

SEQ ID NO: 1954456 - protein, 6 aa, Staphylococcus
KEAVEI

SEQ ID NO: 1954457 - protein, 13 aa, Staphylococcus
KEAVEKAKELNSD

SEQ ID NO: 1954458 - protein, 14 aa, Staphylococcus
KEAVNTGTIYNDTN

SEQ ID NO: 1954459 - protein, 6 aa, Staphylococcus
KEAVRT

SEQ ID NO: 1954460 - protein, 6 aa, Staphylococcus
KEAYEK

SEQ ID NO: 1954461 - protein, 6 aa, Staphylococcus
KEAYQN

SEQ ID NO: 1954462 - protein, 4 aa, Staphylococcus
KECA

SEQ ID NO: 1954463 - protein, 6 aa, Staphylococcus
KECKAT

SEQ ID NO: 1954464 - protein, 10 aa, Staphylococcus
KEDAAELANK

SEQ ID NO: 1954465 - protein, 6 aa, Staphylococcus
KEDADT

SEQ ID NO: 1954466 - protein, 8 aa, Staphylococcus
KEDADTIS

SEQ ID NO: 1954467 - protein, 11 aa, Staphylococcus
KEDAKKIDDSI

SEQ ID NO: 1954468 - protein, 10 aa, Staphylococcus
KEDAQDIDEN

SEQ ID NO: 1954469 - protein, 10 aa, Staphylococcus
KEDAQDIDES

SEQ ID NO: 1954470 - protein, 9 aa, Staphylococcus
KEDASVQGA

SEQ ID NO: 1954471 - protein, 4 aa, Staphylococcus
KEDD

SEQ ID NO: 1954472 - protein, 8 aa, Staphylococcus
KEDDEDEV

SEQ ID NO: 1954473 - protein, 5 aa, Staphylococcus
KEDDL

SEQ ID NO: 1954474 - protein, 7 aa, Staphylococcus
KEDDQEK

SEQ ID NO: 1954475 - protein, 7 aa, Staphylococcus
KEDEDRV

SEQ ID NO: 1954476 - protein, 8 aa, Staphylococcus
KEDENALD

SEQ ID NO: 1954477 - protein, 7 aa, Staphylococcus
KEDEQSI

SEQ ID NO: 1954478 - protein, 7 aa, Staphylococcus
KEDESSI

SEQ ID NO: 1954479 - protein, 12 aa, Staphylococcus
KEDETKNDQRTL

SEQ ID NO: 1954480 - protein, 4 aa, Staphylococcus
KEDF

SEQ ID NO: 1954481 - protein, 8 aa, Staphylococcus
KEDGAPAY

SEQ ID NO: 1954482 - protein, 8 aa, Staphylococcus
KEDGATIA

SEQ ID NO: 1954483 - protein, 5 aa, Staphylococcus
KEDGI

SEQ ID NO: 1954484 - protein, 9 aa, Staphylococcus
KEDGSVEKF

SEQ ID NO: 1954485 - protein, 6 aa, Staphylococcus
KEDGTF

SEQ ID NO: 1954486 - protein, 6 aa, Staphylococcus
KEDGTL

SEQ ID NO: 1954487 - protein, 4 aa, Staphylococcus
KEDI

SEQ ID NO: 1954488 - protein, 5 aa, Staphylococcus
KEDID

SEQ ID NO: 1954489 - protein, 5 aa, Staphylococcus
KEDIE

SEQ ID NO: 1954490 - protein, 7 aa, Staphylococcus
KEDIRDY

SEQ ID NO: 1954491 - protein, 11 aa, Staphylococcus
KEDISETTAYE

SEQ ID NO: 1954492 - protein, 6 aa, Staphylococcus
KEDISH

SEQ ID NO: 1954493 - protein, 8 aa, Staphylococcus
KEDKDSAF

SEQ ID NO: 1954494 - protein, 11 aa, Staphylococcus
KEDKIAKGKVQ

SEQ ID NO: 1954495 - protein, 5 aa, Staphylococcus
KEDKM

SEQ ID NO: 1954496 - protein, 7 aa, Staphylococcus
KEDKPGV

SEQ ID NO: 1954497 - protein, 19 aa, Staphylococcus
KEDKTSYSHNKGLPETRQA

SEQ ID NO: 1954498 - protein, 6 aa, Staphylococcus
KEDKVK

SEQ ID NO: 1954499 - protein, 11 aa, Staphylococcus
KEDLDKAFDPK

SEQ ID NO: 1954500 - protein, 8 aa, Staphylococcus
KEDLEEKG

SEQ ID NO: 1954501 - protein, 11 aa, Staphylococcus
KEDLKATTNNE

SEQ ID NO: 1954502 - protein, 13 aa, Staphylococcus
KEDLKSLSKELKI

SEQ ID NO: 1954503 - protein, 5 aa, Staphylococcus
KEDLP

SEQ ID NO: 1954504 - protein, 11 aa, Staphylococcus
KEDLSDEEIKT

SEQ ID NO: 1954505 - protein, 6 aa, Staphylococcus
KEDNDV

SEQ ID NO: 1954506 - protein, 13 aa, Staphylococcus
KEDNDWKDTPTVT

SEQ ID NO: 1954507 - protein, 5 aa, Staphylococcus
KEDNI

SEQ ID NO: 1954508 - protein, 13 aa, Staphylococcus
KEDNKEIIEKYNQ

SEQ ID NO: 1954509 - protein, 8 aa, Staphylococcus
KEDNKKLD

SEQ ID NO: 1954510 - protein, 9 aa, Staphylococcus
KEDNKKVEQ

SEQ ID NO: 1954511 - protein, 15 aa, Staphylococcus
KEDNRQLTHDQQSAF

SEQ ID NO: 1954512 - protein, 12 aa, Staphylococcus
KEDPEAKQAMPK

SEQ ID NO: 1954513 - protein, 8 aa, Staphylococcus
KEDPEYTD

SEQ ID NO: 1954514 - protein, 13 aa, Staphylococcus
KEDPFGDYGKGIK

SEQ ID NO: 1954515 - protein, 15 aa, Staphylococcus
KEDPFGDYGKGVRKL

SEQ ID NO: 1954516 - protein, 11 aa, Staphylococcus
KEDPFGDYSKG

SEQ ID NO: 1954517 - protein, 8 aa, Staphylococcus
KEDPSYTD

SEQ ID NO: 1954518 - protein, 7 aa, Staphylococcus
KEDQDFK

SEQ ID NO: 1954519 - protein, 4 aa, Staphylococcus
KEDR

SEQ ID NO: 1954520 - protein, 19 aa, Staphylococcus
KEDRKDKVKDEAVKKANDK

SEQ ID NO: 1954521 - protein, 6 aa, Staphylococcus
KEDRTM

SEQ ID NO: 1954522 - protein, 7 aa, Staphylococcus
KEDSDIE

SEQ ID NO: 1954523 - protein, 7 aa, Staphylococcus
KEDSIQS

SEQ ID NO: 1954524 - protein, 8 aa, Staphylococcus
KEDSRPSW

SEQ ID NO: 1954525 - protein, 4 aa, Staphylococcus
KEDT

SEQ ID NO: 1954526 - protein, 5 aa, Staphylococcus
KEDTL

SEQ ID NO: 1954527 - protein, 6 aa, Staphylococcus
KEDVDE

SEQ ID NO: 1954528 - protein, 9 aa, Staphylococcus
KEDYPEQGV

SEQ ID NO: 1954529 - protein, 12 aa, Staphylococcus
KEDYSIQYKREF

SEQ ID NO: 1954530 - protein, 4 aa, Staphylococcus
KEEA

SEQ ID NO: 1954531 - protein, 10 aa, Staphylococcus
KEEAAELANK

SEQ ID NO: 1954532 - protein, 25 aa, Staphylococcus
KEEAEQLQQANPESTYKEDAGRGYR

SEQ ID NO: 1954533 - protein, 14 aa, Staphylococcus
KEEAKDEDDVEEIN

SEQ ID NO: 1954534 - protein, 6 aa, Staphylococcus
KEEALE

SEQ ID NO: 1954535 - protein, 7 aa, Staphylococcus
KEEAMSN

SEQ ID NO: 1954536 - protein, 7 aa, Staphylococcus
KEEAVTQ

SEQ ID NO: 1954537 - protein, 4 aa, Staphylococcus
KEED

SEQ ID NO: 1954538 - protein, 5 aa, Staphylococcus
KEEDQ

SEQ ID NO: 1954539 - protein, 10 aa, Staphylococcus
KEEDSDPYDD

SEQ ID NO: 1954540 - protein, 15 aa, Staphylococcus
KEEDTLTSKHLKRYI

SEQ ID NO: 1954541 - protein, 4 aa, Staphylococcus
KEEE

SEQ ID NO: 1954542 - protein, 13 aa, Staphylococcus
KEEEAKNKIGADE

SEQ ID NO: 1954543 - protein, 16 aa, Staphylococcus
KEEEGKDKYCEILIPV

SEQ ID NO: 1954544 - protein, 5 aa, Staphylococcus
KEEEP

SEQ ID NO: 1954545 - protein, 12 aa, Staphylococcus
KEEEPDPYDDDT

SEQ ID NO: 1954546 - protein, 8 aa, Staphylococcus
KEEESYRD

SEQ ID NO: 1954547 - protein, 13 aa, Staphylococcus
KEEFERLIKLLHD

SEQ ID NO: 1954548 - protein, 8 aa, Staphylococcus
KEEGATIA

SEQ ID NO: 1954549 - protein, 19 aa, Staphylococcus
KEEGATIATGGKRPEREDL

SEQ ID NO: 1954550 - protein, 6 aa, Staphylococcus
KEEGCQ

SEQ ID NO: 1954551 - protein, 6 aa, Staphylococcus
KEEGDE

SEQ ID NO: 1954552 - protein, 6 aa, Staphylococcus
KEEGIT

SEQ ID NO: 1954553 - protein, 6 aa, Staphylococcus
KEEGKD

SEQ ID NO: 1954554 - protein, 20 aa, Staphylococcus
KEEGKISENDIQTLVDWRDN

SEQ ID NO: 1954555 - protein, 6 aa, Staphylococcus
KEEGLS

SEQ ID NO: 1954556 - protein, 6 aa, Staphylococcus
KEEGQD

SEQ ID NO: 1954557 - protein, 6 aa, Staphylococcus
KEEGQV

SEQ ID NO: 1954558 - protein, 6 aa, Staphylococcus
KEEGRL

SEQ ID NO: 1954559 - protein, 6 aa, Staphylococcus
KEEGSL

SEQ ID NO: 1954560 - protein, 5 aa, Staphylococcus
KEEGV

SEQ ID NO: 1954561 - protein, 8 aa, Staphylococcus
KEEHGQPL

SEQ ID NO: 1954562 - protein, 7 aa, Staphylococcus
KEEHGYE

SEQ ID NO: 1954563 - protein, 8 aa, Staphylococcus
KEEHNAVR

SEQ ID NO: 1954564 - protein, 9 aa, Staphylococcus
KEEHSTIKQ

SEQ ID NO: 1954565 - protein, 5 aa, Staphylococcus
KEEIE

SEQ ID NO: 1954566 - protein, 7 aa, Staphylococcus
KEEINAP

SEQ ID NO: 1954567 - protein, 6 aa, Staphylococcus
KEEIPL

SEQ ID NO: 1954568 - protein, 11 aa, Staphylococcus
KEEIPNSRTVQ

SEQ ID NO: 1954569 - protein, 21 aa, Staphylococcus
KEEIQEAQKYYSKKRAKKHNN

SEQ ID NO: 1954570 - protein, 21 aa, Staphylococcus
KEEIQEAQKYYSQKRAKKHDN

SEQ ID NO: 1954571 - protein, 19 aa, Staphylococcus
KEEIQEAQKYYTQKRAKKH

SEQ ID NO: 1954572 - protein, 12 aa, Staphylococcus
KEEISETQSNKI

SEQ ID NO: 1954573 - protein, 16 aa, Staphylococcus
KEEITADSAEQKSIQE

SEQ ID NO: 1954574 - protein, 6 aa, Staphylococcus
KEEIYR

SEQ ID NO: 1954575 - protein, 4 aa, Staphylococcus
KEEK

SEQ ID NO: 1954576 - protein, 6 aa, Staphylococcus
KEEKAY

SEQ ID NO: 1954577 - protein, 7 aa, Staphylococcus
KEEKEKY

SEQ ID NO: 1954578 - protein, 10 aa, Staphylococcus
KEEKIEDDAE

SEQ ID NO: 1954579 - protein, 5 aa, Staphylococcus
KEEKP

SEQ ID NO: 1954580 - protein, 6 aa, Staphylococcus
KEEKPD

SEQ ID NO: 1954581 - protein, 6 aa, Staphylococcus
KEEKPH

SEQ ID NO: 1954582 - protein, 16 aa, Staphylococcus
KEEKRTLTSAQNDAFQ

SEQ ID NO: 1954583 - protein, 5 aa, Staphylococcus
KEELD

SEQ ID NO: 1954584 - protein, 6 aa, Staphylococcus
KEELED

SEQ ID NO: 1954585 - protein, 13 aa, Staphylococcus
KEELHDKEDESHV

SEQ ID NO: 1954586 - protein, 12 aa, Staphylococcus
KEELHEKEEESH

SEQ ID NO: 1954587 - protein, 13 aa, Staphylococcus
KEELHEKEEESHV

SEQ ID NO: 1954588 - protein, 9 aa, Staphylococcus
KEELNNKEI

SEQ ID NO: 1954589 - protein, 10 aa, Staphylococcus
KEELNQQSAK

SEQ ID NO: 1954590 - protein, 5 aa, Staphylococcus
KEELP

SEQ ID NO: 1954591 - protein, 7 aa, Staphylococcus
KEELQKS

SEQ ID NO: 1954592 - protein, 17 aa, Staphylococcus
KEELQQKLQQKLQALNM

SEQ ID NO: 1954593 - protein, 12 aa, Staphylococcus
KEELSQKANEMA

SEQ ID NO: 1954594 - protein, 7 aa, Staphylococcus
KEELTDL

SEQ ID NO: 1954595 - protein, 8 aa, Staphylococcus
KEEMEQTL

SEQ ID NO: 1954596 - protein, 7 aa, Staphylococcus
KEEMNKR

SEQ ID NO: 1954597 - protein, 10 aa, Staphylococcus
KEEMTQTGDN

SEQ ID NO: 1954598 - protein, 6 aa, Staphylococcus
KEENEK

SEQ ID NO: 1954599 - protein, 7 aa, Staphylococcus
KEENIPF

SEQ ID NO: 1954600 - protein, 15 aa, Staphylococcus
KEENLDRKSDLLDKK

SEQ ID NO: 1954601 - protein, 8 aa, Staphylococcus
KEENQQAY

SEQ ID NO: 1954602 - protein, 4 aa, Staphylococcus
KEEP

SEQ ID NO: 1954603 - protein, 7 aa, Staphylococcus
KEEPKHG

SEQ ID NO: 1954604 - protein, 15 aa, Staphylococcus
KEEQAEKLKGAGVDR

SEQ ID NO: 1954605 - protein, 35 aa, Staphylococcus
KEEQEKAKEAAKQLPKQVKERQRKGLSYKEKREYE

SEQ ID NO: 1954606 - protein, 9 aa, Staphylococcus
KEEQHHRDV

SEQ ID NO: 1954607 - protein, 6 aa, Staphylococcus
KEEQLK

SEQ ID NO: 1954608 - protein, 5 aa, Staphylococcus
KEEQP

SEQ ID NO: 1954609 - protein, 6 aa, Staphylococcus
KEEQPT

SEQ ID NO: 1954610 - protein, 28 aa, Staphylococcus
KEEQQRKKKRRKQRYKADKEAEKAYKRR

SEQ ID NO: 1954611 - protein, 14 aa, Staphylococcus
KEEQQRLKNQYGIQ

SEQ ID NO: 1954612 - protein, 7 aa, Staphylococcus
KEEQVSE

SEQ ID NO: 1954613 - protein, 10 aa, Staphylococcus
KEEQYPDTNL

SEQ ID NO: 1954614 - protein, 10 aa, Staphylococcus
KEEQYPETNL

SEQ ID NO: 1954615 - protein, 4 aa, Staphylococcus
KEER

SEQ ID NO: 1954616 - protein, 6 aa, Staphylococcus
KEERLK

SEQ ID NO: 1954617 - protein, 15 aa, Staphylococcus
KEERNPLKTTTFGTG

SEQ ID NO: 1954618 - protein, 7 aa, Staphylococcus
KEERVKA

SEQ ID NO: 1954619 - protein, 7 aa, Staphylococcus
KEERVNA

SEQ ID NO: 1954620 - protein, 24 aa, Staphylococcus
KEERVNASKQLNGPNAKFEGNKDE

SEQ ID NO: 1954621 - protein, 24 aa, Staphylococcus
KEERVNASKSLNGPQASFDGNKEE

SEQ ID NO: 1954622 - protein, 11 aa, Staphylococcus
KEESEKQYGAK

SEQ ID NO: 1954623 - protein, 7 aa, Staphylococcus
KEESIKD

SEQ ID NO: 1954624 - protein, 6 aa, Staphylococcus
KEESKD

SEQ ID NO: 1954625 - protein, 5 aa, Staphylococcus
KEESM

SEQ ID NO: 1954626 - protein, 4 aa, Staphylococcus
KEET

SEQ ID NO: 1954627 - protein, 6 aa, Staphylococcus
KEETEK

SEQ ID NO: 1954628 - protein, 6 aa, Staphylococcus
KEETGI

SEQ ID NO: 1954629 - protein, 19 aa, Staphylococcus
KEETKGLIDQNNHQEDIQD

SEQ ID NO: 1954630 - protein, 7 aa, Staphylococcus
KEEVEES

SEQ ID NO: 1954631 - protein, 28 aa, Staphylococcus
KEEVGSLEAGTRVEASDIQYTSKGTPRL

SEQ ID NO: 1954632 - protein, 6 aa, Staphylococcus
KEEYAN

SEQ ID NO: 1954633 - protein, 6 aa, Staphylococcus
KEEYEE

SEQ ID NO: 1954634 - protein, 13 aa, Staphylococcus
KEFADKAAGRFGS

SEQ ID NO: 1954635 - protein, 13 aa, Staphylococcus
KEFDPEKKVSESD

SEQ ID NO: 1954636 - protein, 9 aa, Staphylococcus
KEFEEQKAE

SEQ ID NO: 1954637 - protein, 5 aa, Staphylococcus
KEFEK

SEQ ID NO: 1954638 - protein, 28 aa, Staphylococcus
KEFEKSVTAPAGNQGHGFDKSEFDKTAT

SEQ ID NO: 1954639 - protein, 27 aa, Staphylococcus
KEFEKSVTAPAGNQGHGLDKSEFDKKA

SEQ ID NO: 1954640 - protein, 26 aa, Staphylococcus
KEFEKSVTAPAGNQGHGLDQSEFDKS

SEQ ID NO: 1954641 - protein, 8 aa, Staphylococcus
KEFEPGET

SEQ ID NO: 1954642 - protein, 5 aa, Staphylococcus
KEFGD

SEQ ID NO: 1954643 - protein, 5 aa, Staphylococcus
KEFGR

SEQ ID NO: 1954644 - protein, 7 aa, Staphylococcus
KEFKEAQ

SEQ ID NO: 1954645 - protein, 8 aa, Staphylococcus
KEFKGKDL

SEQ ID NO: 1954646 - protein, 7 aa, Staphylococcus
KEFKQTY

SEQ ID NO: 1954647 - protein, 4 aa, Staphylococcus
KEFP

SEQ ID NO: 1954648 - protein, 17 aa, Staphylococcus
KEFPTKLNTPTSEDEQL

SEQ ID NO: 1954649 - protein, 17 aa, Staphylococcus
KEFRESKASILTSRREG

SEQ ID NO: 1954650 - protein, 5 aa, Staphylococcus
KEFSD

SEQ ID NO: 1954651 - protein, 11 aa, Staphylococcus
KEFSNDAEITE

SEQ ID NO: 1954652 - protein, 7 aa, Staphylococcus
KEFTADT

SEQ ID NO: 1954653 - protein, 10 aa, Staphylococcus
KEFTPEQQQK

SEQ ID NO: 1954654 - protein, 7 aa, Staphylococcus
KEGADGV

SEQ ID NO: 1954655 - protein, 5 aa, Staphylococcus
KEGAE

SEQ ID NO: 1954656 - protein, 11 aa, Staphylococcus
KEGAEDKLEYH

SEQ ID NO: 1954657 - protein, 8 aa, Staphylococcus
KEGAIEKS

SEQ ID NO: 1954658 - protein, 6 aa, Staphylococcus
KEGANV

SEQ ID NO: 1954659 - protein, 5 aa, Staphylococcus
KEGAQ

SEQ ID NO: 1954660 - protein, 13 aa, Staphylococcus
KEGDAPVANPDMH

SEQ ID NO: 1954661 - protein, 7 aa, Staphylococcus
KEGDDCG

SEQ ID NO: 1954662 - protein, 15 aa, Staphylococcus
KEGDKISGQVQKVED

SEQ ID NO: 1954663 - protein, 7 aa, Staphylococcus
KEGDNCG

SEQ ID NO: 1954664 - protein, 9 aa, Staphylococcus
KEGDPRAKY

SEQ ID NO: 1954665 - protein, 6 aa, Staphylococcus
KEGERC

SEQ ID NO: 1954666 - protein, 6 aa, Staphylococcus
KEGESQ

SEQ ID NO: 1954667 - protein, 5 aa, Staphylococcus
KEGEV

SEQ ID NO: 1954668 - protein, 5 aa, Staphylococcus
KEGFE

SEQ ID NO: 1954669 - protein, 16 aa, Staphylococcus
KEGFRDQEFDKNDKGT

SEQ ID NO: 1954670 - protein, 16 aa, Staphylococcus
KEGFRDQEFEKGDKGT

SEQ ID NO: 1954671 - protein, 17 aa, Staphylococcus
KEGFRDQEFEKGDKGTW

SEQ ID NO: 1954672 - protein, 6 aa, Staphylococcus
KEGFTS

SEQ ID NO: 1954673 - protein, 6 aa, Staphylococcus
KEGGVN

SEQ ID NO: 1954674 - protein, 6 aa, Staphylococcus
KEGHPV

SEQ ID NO: 1954675 - protein, 5 aa, Staphylococcus
KEGIK

SEQ ID NO: 1954676 - protein, 6 aa, Staphylococcus
KEGITC

SEQ ID NO: 1954677 - protein, 16 aa, Staphylococcus
KEGITVTQKSPIYETD

SEQ ID NO: 1954678 - protein, 8 aa, Staphylococcus
KEGKLSKE

SEQ ID NO: 1954679 - protein, 6 aa, Staphylococcus
KEGKPL

SEQ ID NO: 1954680 - protein, 10 aa, Staphylococcus
KEGKRKAGQV

SEQ ID NO: 1954681 - protein, 8 aa, Staphylococcus
KEGKSYPR

SEQ ID NO: 1954682 - protein, 19 aa, Staphylococcus
KEGKTKKTGTKVTFKPDPE

SEQ ID NO: 1954683 - protein, 8 aa, Staphylococcus
KEGKTTQI

SEQ ID NO: 1954684 - protein, 14 aa, Staphylococcus
KEGKTVDEKTQDFQ

SEQ ID NO: 1954685 - protein, 10 aa, Staphylococcus
KEGLASTGLQ

SEQ ID NO: 1954686 - protein, 5 aa, Staphylococcus
KEGLP

SEQ ID NO: 1954687 - protein, 5 aa, Staphylococcus
KEGLS

SEQ ID NO: 1954688 - protein, 12 aa, Staphylococcus
KEGLSAHAAPRE

SEQ ID NO: 1954689 - protein, 8 aa, Staphylococcus
KEGMTSQP

SEQ ID NO: 1954690 - protein, 4 aa, Staphylococcus
KEGN

SEQ ID NO: 1954691 - protein, 9 aa, Staphylococcus
KEGNERIEY

SEQ ID NO: 1954692 - protein, 12 aa, Staphylococcus
KEGNKNPTNPNL

SEQ ID NO: 1954693 - protein, 13 aa, Staphylococcus
KEGNLKKANEELG

SEQ ID NO: 1954694 - protein, 5 aa, Staphylococcus
KEGNQ

SEQ ID NO: 1954695 - protein, 6 aa, Staphylococcus
KEGNSY

SEQ ID NO: 1954696 - protein, 11 aa, Staphylococcus
KEGNTTKTQAK

SEQ ID NO: 1954697 - protein, 10 aa, Staphylococcus
KEGPASANSD

SEQ ID NO: 1954698 - protein, 5 aa, Staphylococcus
KEGPR

SEQ ID NO: 1954699 - protein, 4 aa, Staphylococcus
KEGQ

SEQ ID NO: 1954700 - protein, 7 aa, Staphylococcus
KEGQEKL

SEQ ID NO: 1954701 - protein, 7 aa, Staphylococcus
KEGQETY

SEQ ID NO: 1954702 - protein, 7 aa, Staphylococcus
KEGQIER

SEQ ID NO: 1954703 - protein, 7 aa, Staphylococcus
KEGQPLR

SEQ ID NO: 1954704 - protein, 5 aa, Staphylococcus
KEGQS

SEQ ID NO: 1954705 - protein, 7 aa, Staphylococcus
KEGQYRS

SEQ ID NO: 1954706 - protein, 10 aa, Staphylococcus
KEGRKNTDAL

SEQ ID NO: 1954707 - protein, 7 aa, Staphylococcus
KEGRLPN

SEQ ID NO: 1954708 - protein, 21 aa, Staphylococcus
KEGRPALCENGAKANEKGEML

SEQ ID NO: 1954709 - protein, 8 aa, Staphylococcus
KEGRTGYP

SEQ ID NO: 1954710 - protein, 7 aa, Staphylococcus
KEGRTTH

SEQ ID NO: 1954711 - protein, 12 aa, Staphylococcus
KEGRVSSGDTIV

SEQ ID NO: 1954712 - protein, 15 aa, Staphylococcus
KEGSALDKEAYDRAT

SEQ ID NO: 1954713 - protein, 15 aa, Staphylococcus
KEGSALDKEAYDRGT

SEQ ID NO: 1954714 - protein, 8 aa, Staphylococcus
KEGSITKE

SEQ ID NO: 1954715 - protein, 6 aa, Staphylococcus
KEGSQA

SEQ ID NO: 1954716 - protein, 6 aa, Staphylococcus
KEGSYG

SEQ ID NO: 1954717 - protein, 13 aa, Staphylococcus
KEGSYPGDITPDG

SEQ ID NO: 1954718 - protein, 4 aa, Staphylococcus
KEGT

SEQ ID NO: 1954719 - protein, 7 aa, Staphylococcus
KEGTDEV

SEQ ID NO: 1954720 - protein, 6 aa, Staphylococcus
KEGTEM

SEQ ID NO: 1954721 - protein, 6 aa, Staphylococcus
KEGTEQ

SEQ ID NO: 1954722 - protein, 12 aa, Staphylococcus
KEGTLRSNERLH

SEQ ID NO: 1954723 - protein, 8 aa, Staphylococcus
KEGTPEAE

SEQ ID NO: 1954724 - protein, 7 aa, Staphylococcus
KEGTSEV

SEQ ID NO: 1954725 - protein, 5 aa, Staphylococcus
KEGTT

SEQ ID NO: 1954726 - protein, 4 aa, Staphylococcus
KEGV

SEQ ID NO: 1954727 - protein, 6 aa, Staphylococcus
KEGVTD

SEQ ID NO: 1954728 - protein, 8 aa, Staphylococcus
KEGVTNVE

SEQ ID NO: 1954729 - protein, 8 aa, Staphylococcus
KEGWQNDV

SEQ ID NO: 1954730 - protein, 5 aa, Staphylococcus
KEGYE

SEQ ID NO: 1954731 - protein, 8 aa, Staphylococcus
KEGYETDG

SEQ ID NO: 1954732 - protein, 6 aa, Staphylococcus
KEGYQA

SEQ ID NO: 1954733 - protein, 6 aa, Staphylococcus
KEGYQK

SEQ ID NO: 1954734 - protein, 30 aa, Staphylococcus
KEGYSEVTSTKNHKDGDDANHKAPIRRGPN

SEQ ID NO: 1954735 - protein, 9 aa, Staphylococcus
KEGYVETKH

SEQ ID NO: 1954736 - protein, 7 aa, Staphylococcus
KEHEQQL

SEQ ID NO: 1954737 - protein, 6 aa, Staphylococcus
KEHGIE

SEQ ID NO: 1954738 - protein, 5 aa, Staphylococcus
KEHGT

SEQ ID NO: 1954739 - protein, 4 aa, Staphylococcus
KEHK

SEQ ID NO: 1954740 - protein, 14 aa, Staphylococcus
KEHKGEVKQRVQNQ

SEQ ID NO: 1954741 - protein, 6 aa, Staphylococcus
KEHKPK

SEQ ID NO: 1954742 - protein, 5 aa, Staphylococcus
KEHKT

SEQ ID NO: 1954743 - protein, 5 aa, Staphylococcus
KEHNA

SEQ ID NO: 1954744 - protein, 8 aa, Staphylococcus
KEHNSDEM

SEQ ID NO: 1954745 - protein, 26 aa, Staphylococcus
KEHNSDESIHPNDDVNKSQSSNDTFP

SEQ ID NO: 1954746 - protein, 7 aa, Staphylococcus
KEHPDGI

SEQ ID NO: 1954747 - protein, 4 aa, Staphylococcus
KEHQ

SEQ ID NO: 1954748 - protein, 6 aa, Staphylococcus
KEHQGD

SEQ ID NO: 1954749 - protein, 18 aa, Staphylococcus
KEHQGSDIYQRTGTPIHP

SEQ ID NO: 1954750 - protein, 26 aa, Staphylococcus
KEHQSDESIHPNDDVNKSQSSNDTFP

SEQ ID NO: 1954751 - protein, 15 aa, Staphylococcus
KEHQYDSDADITAEG

SEQ ID NO: 1954752 - protein, 7 aa, Staphylococcus
KEHRDKI

SEQ ID NO: 1954753 - protein, 7 aa, Staphylococcus
KEHRDQY

SEQ ID NO: 1954754 - protein, 9 aa, Staphylococcus
KEHREATHN

SEQ ID NO: 1954755 - protein, 6 aa, Staphylococcus
KEHREE

SEQ ID NO: 1954756 - protein, 5 aa, Staphylococcus
KEHSN

SEQ ID NO: 1954757 - protein, 6 aa, Staphylococcus
KEIDAN

SEQ ID NO: 1954758 - protein, 8 aa, Staphylococcus
KEIDENDY

SEQ ID NO: 1954759 - protein, 7 aa, Staphylococcus
KEIDENL

SEQ ID NO: 1954760 - protein, 7 aa, Staphylococcus
KEIDESL

SEQ ID NO: 1954761 - protein, 7 aa, Staphylococcus
KEIEARD

SEQ ID NO: 1954762 - protein, 7 aa, Staphylococcus
KEIEDKT

SEQ ID NO: 1954763 - protein, 6 aa, Staphylococcus
KEIEGA

SEQ ID NO: 1954764 - protein, 6 aa, Staphylococcus
KEIELE

SEQ ID NO: 1954765 - protein, 7 aa, Staphylococcus
KEIENNE

SEQ ID NO: 1954766 - protein, 6 aa, Staphylococcus
KEIEQS

SEQ ID NO: 1954767 - protein, 18 aa, Staphylococcus
KEIESESINLDTDKLPDI

SEQ ID NO: 1954768 - protein, 4 aa, Staphylococcus
KEIG

SEQ ID NO: 1954769 - protein, 5 aa, Staphylococcus
KEIGD

SEQ ID NO: 1954770 - protein, 18 aa, Staphylococcus
KEIGEITSGTQSPSSGKS

SEQ ID NO: 1954771 - protein, 5 aa, Staphylococcus
KEIGK

SEQ ID NO: 1954772 - protein, 5 aa, Staphylococcus
KEIGT

SEQ ID NO: 1954773 - protein, 13 aa, Staphylococcus
KEIISEDNNYSTM

SEQ ID NO: 1954774 - protein, 4 aa, Staphylococcus
KEIK

SEQ ID NO: 1954775 - protein, 6 aa, Staphylococcus
KEIKEL

SEQ ID NO: 1954776 - protein, 8 aa, Staphylococcus
KEIKPSQI

SEQ ID NO: 1954777 - protein, 10 aa, Staphylococcus
KEIKQFKPED

SEQ ID NO: 1954778 - protein, 7 aa, Staphylococcus
KEIKQQE

SEQ ID NO: 1954779 - protein, 20 aa, Staphylococcus
KEIKSSAEAVRDGNTNDVKL

SEQ ID NO: 1954780 - protein, 11 aa, Staphylococcus
KEIKTRDSEAA

SEQ ID NO: 1954781 - protein, 10 aa, Staphylococcus
KEINEAEEIE

SEQ ID NO: 1954782 - protein, 7 aa, Staphylococcus
KEINNKE

SEQ ID NO: 1954783 - protein, 6 aa, Staphylococcus
KEINQF

SEQ ID NO: 1954784 - protein, 13 aa, Staphylococcus
KEINQTKQQIEIE

SEQ ID NO: 1954785 - protein, 12 aa, Staphylococcus
KEINRTGTYTHT

SEQ ID NO: 1954786 - protein, 7 aa, Staphylococcus
KEIQENI

SEQ ID NO: 1954787 - protein, 6 aa, Staphylococcus
KEIQND

SEQ ID NO: 1954788 - protein, 7 aa, Staphylococcus
KEIQNDK

SEQ ID NO: 1954789 - protein, 8 aa, Staphylococcus
KEISADEA

SEQ ID NO: 1954790 - protein, 9 aa, Staphylococcus
KEISDQGRI

SEQ ID NO: 1954791 - protein, 26 aa, Staphylococcus
KEISDQGRVTVNGNVAKAGTDVKEND

SEQ ID NO: 1954792 - protein, 12 aa, Staphylococcus
KEISENKVTGDL

SEQ ID NO: 1954793 - protein, 6 aa, Staphylococcus
KEISES

SEQ ID NO: 1954794 - protein, 6 aa, Staphylococcus
KEISGE

SEQ ID NO: 1954795 - protein, 7 aa, Staphylococcus
KEISKPN

SEQ ID NO: 1954796 - protein, 9 aa, Staphylococcus
KEISSEHNG

SEQ ID NO: 1954797 - protein, 4 aa, Staphylococcus
KEIT

SEQ ID NO: 1954798 - protein, 8 aa, Staphylococcus
KEITDDIS

SEQ ID NO: 1954799 - protein, 13 aa, Staphylococcus
KEITKGKDLTGMT

SEQ ID NO: 1954800 - protein, 7 aa, Staphylococcus
KEITKPD

SEQ ID NO: 1954801 - protein, 8 aa, Staphylococcus
KEITPSKV

SEQ ID NO: 1954802 - protein, 7 aa, Staphylococcus
KEITQES

SEQ ID NO: 1954803 - protein, 7 aa, Staphylococcus
KEITSQK

SEQ ID NO: 1954804 - protein, 7 aa, Staphylococcus
KEITSTK

SEQ ID NO: 1954805 - protein, 4 aa, Staphylococcus
KEKA

SEQ ID NO: 1954806 - protein, 6 aa, Staphylococcus
KEKAEA

SEQ ID NO: 1954807 - protein, 7 aa, Staphylococcus
KEKAEQL

SEQ ID NO: 1954808 - protein, 9 aa, Staphylococcus
KEKAEQSRF

SEQ ID NO: 1954809 - protein, 16 aa, Staphylococcus
KEKAETHYGEHADKPF

SEQ ID NO: 1954810 - protein, 6 aa, Staphylococcus
KEKAKE

SEQ ID NO: 1954811 - protein, 9 aa, Staphylococcus
KEKAKEKVL

SEQ ID NO: 1954812 - protein, 24 aa, Staphylococcus
KEKAKKKQISIPRNKIAKARHAVM

SEQ ID NO: 1954813 - protein, 6 aa, Staphylococcus
KEKAKT

SEQ ID NO: 1954814 - protein, 14 aa, Staphylococcus
KEKASNVVSYDDTD

SEQ ID NO: 1954815 - protein, 10 aa, Staphylococcus
KEKDLSPRKK

SEQ ID NO: 1954816 - protein, 15 aa, Staphylococcus
KEKDNDNSQTQQVDP

SEQ ID NO: 1954817 - protein, 6 aa, Staphylococcus
KEKDQI

SEQ ID NO: 1954818 - protein, 5 aa, Staphylococcus
KEKDS

SEQ ID NO: 1954819 - protein, 7 aa, Staphylococcus
KEKDSAQ

SEQ ID NO: 1954820 - protein, 10 aa, Staphylococcus
KEKEDNADIT

SEQ ID NO: 1954821 - protein, 5 aa, Staphylococcus
KEKEE

SEQ ID NO: 1954822 - protein, 9 aa, Staphylococcus
KEKEENQLG

SEQ ID NO: 1954823 - protein, 5 aa, Staphylococcus
KEKEI

SEQ ID NO: 1954824 - protein, 12 aa, Staphylococcus
KEKEIDSYKEHI

SEQ ID NO: 1954825 - protein, 6 aa, Staphylococcus
KEKEKV

SEQ ID NO: 1954826 - protein, 14 aa, Staphylococcus
KEKEQGNDEAHEMD

SEQ ID NO: 1954827 - protein, 7 aa, Staphylococcus
KEKEREI

SEQ ID NO: 1954828 - protein, 8 aa, Staphylococcus
KEKETADS

SEQ ID NO: 1954829 - protein, 9 aa, Staphylococcus
KEKETADSY

SEQ ID NO: 1954830 - protein, 7 aa, Staphylococcus
KEKETPV

SEQ ID NO: 1954831 - protein, 4 aa, Staphylococcus
KEKG

SEQ ID NO: 1954832 - protein, 11 aa, Staphylococcus
KEKGDTQRKVA

SEQ ID NO: 1954833 - protein, 5 aa, Staphylococcus
KEKGF

SEQ ID NO: 1954834 - protein, 9 aa, Staphylococcus
KEKGFEQSR

SEQ ID NO: 1954835 - protein, 6 aa, Staphylococcus
KEKGFT

SEQ ID NO: 1954836 - protein, 6 aa, Staphylococcus
KEKGIE

SEQ ID NO: 1954837 - protein, 6 aa, Staphylococcus
KEKGIT

SEQ ID NO: 1954838 - protein, 6 aa, Staphylococcus
KEKGNT

SEQ ID NO: 1954839 - protein, 8 aa, Staphylococcus
KEKGQNID

SEQ ID NO: 1954840 - protein, 8 aa, Staphylococcus
KEKGRPIP

SEQ ID NO: 1954841 - protein, 6 aa, Staphylococcus
KEKGTT

SEQ ID NO: 1954842 - protein, 6 aa, Staphylococcus
KEKGVE

SEQ ID NO: 1954843 - protein, 7 aa, Staphylococcus
KEKGVES

SEQ ID NO: 1954844 - protein, 7 aa, Staphylococcus
KEKGVYK

SEQ ID NO: 1954845 - protein, 8 aa, Staphylococcus
KEKGYAVG

SEQ ID NO: 1954846 - protein, 4 aa, Staphylococcus
KEKH

SEQ ID NO: 1954847 - protein, 14 aa, Staphylococcus
KEKHEDKKQNKYKI

SEQ ID NO: 1954848 - protein, 9 aa, Staphylococcus
KEKHTNSDE

SEQ ID NO: 1954849 - protein, 10 aa, Staphylococcus
KEKHTSSDEY

SEQ ID NO: 1954850 - protein, 8 aa, Staphylococcus
KEKITTEN

SEQ ID NO: 1954851 - protein, 8 aa, Staphylococcus
KEKKDDKY

SEQ ID NO: 1954852 - protein, 14 aa, Staphylococcus
KEKKLGETENTQPA

SEQ ID NO: 1954853 - protein, 7 aa, Staphylococcus
KEKKLQT

SEQ ID NO: 1954854 - protein, 5 aa, Staphylococcus
KEKLD

SEQ ID NO: 1954855 - protein, 8 aa, Staphylococcus
KEKLETDL

SEQ ID NO: 1954856 - protein, 6 aa, Staphylococcus
KEKLGE

SEQ ID NO: 1954857 - protein, 8 aa, Staphylococcus
KEKLNKQG

SEQ ID NO: 1954858 - protein, 11 aa, Staphylococcus
KEKLQEKAKKE

SEQ ID NO: 1954859 - protein, 6 aa, Staphylococcus
KEKMSQ

SEQ ID NO: 1954860 - protein, 8 aa, Staphylococcus
KEKNADAA

SEQ ID NO: 1954861 - protein, 12 aa, Staphylococcus
KEKNAMPTTQDE

SEQ ID NO: 1954862 - protein, 6 aa, Staphylococcus
KEKNAY

SEQ ID NO: 1954863 - protein, 19 aa, Staphylococcus
KEKNNLPKTKEELARRREQ

SEQ ID NO: 1954864 - protein, 5 aa, Staphylococcus
KEKPD

SEQ ID NO: 1954865 - protein, 10 aa, Staphylococcus
KEKPEITEST

SEQ ID NO: 1954866 - protein, 22 aa, Staphylococcus
KEKPESVQTLATTSVATEPNND

SEQ ID NO: 1954867 - protein, 6 aa, Staphylococcus
KEKPKA

SEQ ID NO: 1954868 - protein, 6 aa, Staphylococcus
KEKPVF

SEQ ID NO: 1954869 - protein, 10 aa, Staphylococcus
KEKPVVTEST

SEQ ID NO: 1954870 - protein, 4 aa, Staphylococcus
KEKQ

SEQ ID NO: 1954871 - protein, 10 aa, Staphylococcus
KEKQKELNNS

SEQ ID NO: 1954872 - protein, 5 aa, Staphylococcus
KEKQL

SEQ ID NO: 1954873 - protein, 12 aa, Staphylococcus
KEKQPFWTENYT

SEQ ID NO: 1954874 - protein, 4 aa, Staphylococcus
KEKR

SEQ ID NO: 1954875 - protein, 9 aa, Staphylococcus
KEKRPSTIY

SEQ ID NO: 1954876 - protein, 9 aa, Staphylococcus
KEKRTTDWG

SEQ ID NO: 1954877 - protein, 8 aa, Staphylococcus
KEKSEYKY

SEQ ID NO: 1954878 - protein, 21 aa, Staphylococcus
KEKSHQEKHTENIEEKRAVAR

SEQ ID NO: 1954879 - protein, 9 aa, Staphylococcus
KEKSKEKVL

SEQ ID NO: 1954880 - protein, 13 aa, Staphylococcus
KEKSKKKTIEIPR

SEQ ID NO: 1954881 - protein, 23 aa, Staphylococcus
KEKSNLPVTQNELQQRRAQAENL

SEQ ID NO: 1954882 - protein, 9 aa, Staphylococcus
KEKSQDNPI

SEQ ID NO: 1954883 - protein, 10 aa, Staphylococcus
KEKSTDRVEP

SEQ ID NO: 1954884 - protein, 7 aa, Staphylococcus
KEKTAHM

SEQ ID NO: 1954885 - protein, 7 aa, Staphylococcus
KEKTDGI

SEQ ID NO: 1954886 - protein, 12 aa, Staphylococcus
KEKTGSEAKAEE

SEQ ID NO: 1954887 - protein, 7 aa, Staphylococcus
KEKWSEE

SEQ ID NO: 1954888 - protein, 6 aa, Staphylococcus
KEKYPE

SEQ ID NO: 1954889 - protein, 5 aa, Staphylococcus
KEKYT

SEQ ID NO: 1954890 - protein, 8 aa, Staphylococcus
KELAESID

SEQ ID NO: 1954891 - protein, 10 aa, Staphylococcus
KELAKTGVKV

SEQ ID NO: 1954892 - protein, 13 aa, Staphylococcus
KELALSKAEDLSQ

SEQ ID NO: 1954893 - protein, 4 aa, Staphylococcus
KELD

SEQ ID NO: 1954894 - protein, 5 aa, Staphylococcus
KELDN

SEQ ID NO: 1954895 - protein, 6 aa, Staphylococcus
KELDRV

SEQ ID NO: 1954896 - protein, 15 aa, Staphylococcus
KELDRVDKKLSNENF

SEQ ID NO: 1954897 - protein, 5 aa, Staphylococcus
KELED

SEQ ID NO: 1954898 - protein, 26 aa, Staphylococcus
KELEDKKSKAVSEEAYSEADKYQKEI

SEQ ID NO: 1954899 - protein, 9 aa, Staphylococcus
KELEDTRRN

SEQ ID NO: 1954900 - protein, 14 aa, Staphylococcus
KELEEKQEREVTEQ

SEQ ID NO: 1954901 - protein, 7 aa, Staphylococcus
KELENDT

SEQ ID NO: 1954902 - protein, 8 aa, Staphylococcus
KELENGGV

SEQ ID NO: 1954903 - protein, 9 aa, Staphylococcus
KELERHREE

SEQ ID NO: 1954904 - protein, 5 aa, Staphylococcus
KELGA

SEQ ID NO: 1954905 - protein, 6 aa, Staphylococcus
KELGGL

SEQ ID NO: 1954906 - protein, 5 aa, Staphylococcus
KELGK

SEQ ID NO: 1954907 - protein, 33 aa, Staphylococcus
KELGKEMEQISEENDEDKLNQSHDEDVRSDLNN

SEQ ID NO: 1954908 - protein, 14 aa, Staphylococcus
KELGRKSAGLDTTR

SEQ ID NO: 1954909 - protein, 7 aa, Staphylococcus
KELHAKA

SEQ ID NO: 1954910 - protein, 10 aa, Staphylococcus
KELKKQGLFD

SEQ ID NO: 1954911 - protein, 5 aa, Staphylococcus
KELKR

SEQ ID NO: 1954912 - protein, 9 aa, Staphylococcus
KELKRNEKI

SEQ ID NO: 1954913 - protein, 7 aa, Staphylococcus
KELNEME

SEQ ID NO: 1954914 - protein, 8 aa, Staphylococcus
KELNGSLR

SEQ ID NO: 1954915 - protein, 18 aa, Staphylococcus
KELNNGAPVNQYKNSVGD

SEQ ID NO: 1954916 - protein, 7 aa, Staphylococcus
KELNVAD

SEQ ID NO: 1954917 - protein, 8 aa, Staphylococcus
KELPPKLE

SEQ ID NO: 1954918 - protein, 8 aa, Staphylococcus
KELPPSLE

SEQ ID NO: 1954919 - protein, 8 aa, Staphylococcus
KELPQTKD

SEQ ID NO: 1954920 - protein, 6 aa, Staphylococcus
KELQEN

SEQ ID NO: 1954921 - protein, 13 aa, Staphylococcus
KELQKLRDAETVS

SEQ ID NO: 1954922 - protein, 20 aa, Staphylococcus
KELQKLRDAETVTVDGEHAE

SEQ ID NO: 1954923 - protein, 20 aa, Staphylococcus
KELQPGESVSYGSTYTAQSP

SEQ ID NO: 1954924 - protein, 9 aa, Staphylococcus
KELRKEQYT

SEQ ID NO: 1954925 - protein, 8 aa, Staphylococcus
KELRNQGL

SEQ ID NO: 1954926 - protein, 9 aa, Staphylococcus
KELSADEAD

SEQ ID NO: 1954927 - protein, 8 aa, Staphylococcus
KELSAEEA

SEQ ID NO: 1954928 - protein, 13 aa, Staphylococcus
KELSDTLSRVRND

SEQ ID NO: 1954929 - protein, 13 aa, Staphylococcus
KELSGPVATSYTV

SEQ ID NO: 1954930 - protein, 12 aa, Staphylococcus
KELSGPVATTYT

SEQ ID NO: 1954931 - protein, 5 aa, Staphylococcus
KELSH

SEQ ID NO: 1954932 - protein, 7 aa, Staphylococcus
KELSRQQ

SEQ ID NO: 1954933 - protein, 10 aa, Staphylococcus
KELTDKNIPV

SEQ ID NO: 1954934 - protein, 8 aa, Staphylococcus
KELTDPQI

SEQ ID NO: 1954935 - protein, 6 aa, Staphylococcus
KELTEP

SEQ ID NO: 1954936 - protein, 8 aa, Staphylococcus
KELTEPQI

SEQ ID NO: 1954937 - protein, 6 aa, Staphylococcus
KELTNP

SEQ ID NO: 1954938 - protein, 6 aa, Staphylococcus
KELTPE

SEQ ID NO: 1954939 - protein, 6 aa, Staphylococcus
KELTQR

SEQ ID NO: 1954940 - protein, 8 aa, Staphylococcus
KELTSKDV

SEQ ID NO: 1954941 - protein, 11 aa, Staphylococcus
KELTSQVKAGD

SEQ ID NO: 1954942 - protein, 9 aa, Staphylococcus
KELVDNAPK

SEQ ID NO: 1954943 - protein, 10 aa, Staphylococcus
KELVDNAPKV

SEQ ID NO: 1954944 - protein, 11 aa, Staphylococcus
KELVDNAPKVI

SEQ ID NO: 1954945 - protein, 4 aa, Staphylococcus
KEMD

SEQ ID NO: 1954946 - protein, 7 aa, Staphylococcus
KEMDVNG

SEQ ID NO: 1954947 - protein, 4 aa, Staphylococcus
KEMG

SEQ ID NO: 1954948 - protein, 16 aa, Staphylococcus
KEMGRKSTGLDTTRKS

SEQ ID NO: 1954949 - protein, 11 aa, Staphylococcus
KEMKQAAKDLD

SEQ ID NO: 1954950 - protein, 9 aa, Staphylococcus
KEMKQQAEQ

SEQ ID NO: 1954951 - protein, 4 aa, Staphylococcus
KEML

SEQ ID NO: 1954952 - protein, 8 aa, Staphylococcus
KEMPDGSL

SEQ ID NO: 1954953 - protein, 10 aa, Staphylococcus
KEMQNELQEK

SEQ ID NO: 1954954 - protein, 39 aa, Staphylococcus
KEMRAAQDKIDKSDKMDNPDMERPESLQEPLQSDDKDFS

SEQ ID NO: 1954955 - protein, 27 aa, Staphylococcus
KEMRTAQDKIDKSDKMNSTAMNKPESL

SEQ ID NO: 1954956 - protein, 12 aa, Staphylococcus
KEMSTGETKTIQ

SEQ ID NO: 1954957 - protein, 4 aa, Staphylococcus
KEMT

SEQ ID NO: 1954958 - protein, 6 aa, Staphylococcus
KEMTED

SEQ ID NO: 1954959 - protein, 20 aa, Staphylococcus
KEMTGFKDEHQKLAKEMQDK

SEQ ID NO: 1954960 - protein, 6 aa, Staphylococcus
KEMTSE

SEQ ID NO: 1954961 - protein, 8 aa, Staphylococcus
KEMVQSSS

SEQ ID NO: 1954962 - protein, 6 aa, Staphylococcus
KENAAY

SEQ ID NO: 1954963 - protein, 6 aa, Staphylococcus
KENADA

SEQ ID NO: 1954964 - protein, 14 aa, Staphylococcus
KENAFYDPNGDMEL

SEQ ID NO: 1954965 - protein, 16 aa, Staphylococcus
KENAFYDPNGREQMTE

SEQ ID NO: 1954966 - protein, 10 aa, Staphylococcus
KENAGAVPKV

SEQ ID NO: 1954967 - protein, 21 aa, Staphylococcus
KENAIKKAKELDELQAKDQFE

SEQ ID NO: 1954968 - protein, 14 aa, Staphylococcus
KENAIKKAQELDEL

SEQ ID NO: 1954969 - protein, 11 aa, Staphylococcus
KENAKRFDTTP

SEQ ID NO: 1954970 - protein, 14 aa, Staphylococcus
KENAMKKAEELDEL

SEQ ID NO: 1954971 - protein, 14 aa, Staphylococcus
KENAMKKAQELDEL

SEQ ID NO: 1954972 - protein, 7 aa, Staphylococcus
KENASSV

SEQ ID NO: 1954973 - protein, 13 aa, Staphylococcus
KENAVKKAQELDH

SEQ ID NO: 1954974 - protein, 4 aa, Staphylococcus
KEND

SEQ ID NO: 1954975 - protein, 7 aa, Staphylococcus
KENDDNV

SEQ ID NO: 1954976 - protein, 7 aa, Staphylococcus
KENDEIA

SEQ ID NO: 1954977 - protein, 9 aa, Staphylococcus
KENDEQLYT

SEQ ID NO: 1954978 - protein, 7 aa, Staphylococcus
KENDEVN

SEQ ID NO: 1954979 - protein, 7 aa, Staphylococcus
KENDLKN

SEQ ID NO: 1954980 - protein, 12 aa, Staphylococcus
KENDNESFNNRN

SEQ ID NO: 1954981 - protein, 26 aa, Staphylococcus
KENDPAYIEKKGEKLEKENRKEADKM

SEQ ID NO: 1954982 - protein, 6 aa, Staphylococcus
KENDVS

SEQ ID NO: 1954983 - protein, 6 aa, Staphylococcus
KENEAC

SEQ ID NO: 1954984 - protein, 12 aa, Staphylococcus
KENEAKKSRLDS

SEQ ID NO: 1954985 - protein, 7 aa, Staphylococcus
KENEDRV

SEQ ID NO: 1954986 - protein, 6 aa, Staphylococcus
KENEEI

SEQ ID NO: 1954987 - protein, 5 aa, Staphylococcus
KENEK

SEQ ID NO: 1954988 - protein, 7 aa, Staphylococcus
KENENCG

SEQ ID NO: 1954989 - protein, 10 aa, Staphylococcus
KENENFSKQD

SEQ ID NO: 1954990 - protein, 8 aa, Staphylococcus
KENESLKG

SEQ ID NO: 1954991 - protein, 8 aa, Staphylococcus
KENETAIN

SEQ ID NO: 1954992 - protein, 5 aa, Staphylococcus
KENFE

SEQ ID NO: 1954993 - protein, 7 aa, Staphylococcus
KENFESN

SEQ ID NO: 1954994 - protein, 12 aa, Staphylococcus
KENFKKNRCEDA

SEQ ID NO: 1954995 - protein, 10 aa, Staphylococcus
KENFRKNHCE

SEQ ID NO: 1954996 - protein, 4 aa, Staphylococcus
KENG

SEQ ID NO: 1954997 - protein, 11 aa, Staphylococcus
KENGDQNEFAN

SEQ ID NO: 1954998 - protein, 10 aa, Staphylococcus
KENGEISDND

SEQ ID NO: 1954999 - protein, 7 aa, Staphylococcus
KENGERD

SEQ ID NO: 1955000 - protein, 6 aa, Staphylococcus
KENGKL

SEQ ID NO: 1955001 - protein, 6 aa, Staphylococcus
KENGQF

SEQ ID NO: 1955002 - protein, 5 aa, Staphylococcus
KENGR

SEQ ID NO: 1955003 - protein, 6 aa, Staphylococcus
KENGWD

SEQ ID NO: 1955004 - protein, 7 aa, Staphylococcus
KENGYAL

SEQ ID NO: 1955005 - protein, 14 aa, Staphylococcus
KENGYTYEKDGATW

SEQ ID NO: 1955006 - protein, 15 aa, Staphylococcus
KENHDTTYNDKNTNI

SEQ ID NO: 1955007 - protein, 9 aa, Staphylococcus
KENHPSDEV

SEQ ID NO: 1955008 - protein, 5 aa, Staphylococcus
KENIE

SEQ ID NO: 1955009 - protein, 17 aa, Staphylococcus
KENIKKDKDNKLVKTYT

SEQ ID NO: 1955010 - protein, 9 aa, Staphylococcus
KENIKKPNP

SEQ ID NO: 1955011 - protein, 5 aa, Staphylococcus
KENIR

SEQ ID NO: 1955012 - protein, 7 aa, Staphylococcus
KENITEE

SEQ ID NO: 1955013 - protein, 4 aa, Staphylococcus
KENK

SEQ ID NO: 1955014 - protein, 7 aa, Staphylococcus
KENKDVD

SEQ ID NO: 1955015 - protein, 11 aa, Staphylococcus
KENKKPIDVNN

SEQ ID NO: 1955016 - protein, 9 aa, Staphylococcus
KENKMSQEG

SEQ ID NO: 1955017 - protein, 11 aa, Staphylococcus
KENKSFSKDDA

SEQ ID NO: 1955018 - protein, 19 aa, Staphylococcus
KENKSRQTPKSEYIESGST

SEQ ID NO: 1955019 - protein, 8 aa, Staphylococcus
KENKTEFH

SEQ ID NO: 1955020 - protein, 11 aa, Staphylococcus
KENKTSYSHNK

SEQ ID NO: 1955021 - protein, 9 aa, Staphylococcus
KENLEEARE

SEQ ID NO: 1955022 - protein, 14 aa, Staphylococcus
KENLKNDGHDVSDE

SEQ ID NO: 1955023 - protein, 14 aa, Staphylococcus
KENLKNEGHDVSDD

SEQ ID NO: 1955024 - protein, 5 aa, Staphylococcus
KENLN

SEQ ID NO: 1955025 - protein, 9 aa, Staphylococcus
KENNGYMPP

SEQ ID NO: 1955026 - protein, 12 aa, Staphylococcus
KENNKEVRQNNQ

SEQ ID NO: 1955027 - protein, 8 aa, Staphylococcus
KENNKPIK

SEQ ID NO: 1955028 - protein, 9 aa, Staphylococcus
KENNNLQDA

SEQ ID NO: 1955029 - protein, 9 aa, Staphylococcus
KENNQPEEW

SEQ ID NO: 1955030 - protein, 7 aa, Staphylococcus
KENNRIN

SEQ ID NO: 1955031 - protein, 9 aa, Staphylococcus
KENNRSNQI

SEQ ID NO: 1955032 - protein, 6 aa, Staphylococcus
KENNVE

SEQ ID NO: 1955033 - protein, 6 aa, Staphylococcus
KENNVP

SEQ ID NO: 1955034 - protein, 7 aa, Staphylococcus
KENPDLK

SEQ ID NO: 1955035 - protein, 13 aa, Staphylococcus
KENPDLSKETITR

SEQ ID NO: 1955036 - protein, 14 aa, Staphylococcus
KENPEIADAMKKES

SEQ ID NO: 1955037 - protein, 14 aa, Staphylococcus
KENPEVRDDIDRKL

SEQ ID NO: 1955038 - protein, 14 aa, Staphylococcus
KENPLQPHEDAIRL

SEQ ID NO: 1955039 - protein, 14 aa, Staphylococcus
KENPQIKDEIDQKL

SEQ ID NO: 1955040 - protein, 14 aa, Staphylococcus
KENPQIKDEIDRKL

SEQ ID NO: 1955041 - protein, 10 aa, Staphylococcus
KENPQIKEEI

SEQ ID NO: 1955042 - protein, 13 aa, Staphylococcus
KENPQVKEEIDRK

SEQ ID NO: 1955043 - protein, 14 aa, Staphylococcus
KENPSLKASSISRP

SEQ ID NO: 1955044 - protein, 4 aa, Staphylococcus
KENQ

SEQ ID NO: 1955045 - protein, 5 aa, Staphylococcus
KENQD

SEQ ID NO: 1955046 - protein, 18 aa, Staphylococcus
KENQELKAEKALNQMKEE

SEQ ID NO: 1955047 - protein, 8 aa, Staphylococcus
KENQGDYE

SEQ ID NO: 1955048 - protein, 9 aa, Staphylococcus
KENQGKLEI

SEQ ID NO: 1955049 - protein, 19 aa, Staphylococcus
KENQGKLEIKPDDAKEVVL

SEQ ID NO: 1955050 - protein, 10 aa, Staphylococcus
KENQGKLEIT

SEQ ID NO: 1955051 - protein, 9 aa, Staphylococcus
KENQGKLEV

SEQ ID NO: 1955052 - protein, 21 aa, Staphylococcus
KENQGKLQVTPNVKVTNKKEL

SEQ ID NO: 1955053 - protein, 6 aa, Staphylococcus
KENQTD

SEQ ID NO: 1955054 - protein, 15 aa, Staphylococcus
KENRNSTEVRDGQQN

SEQ ID NO: 1955055 - protein, 6 aa, Staphylococcus
KENRPT

SEQ ID NO: 1955056 - protein, 6 aa, Staphylococcus
KENRSL

SEQ ID NO: 1955057 - protein, 6 aa, Staphylococcus
KENRTL

SEQ ID NO: 1955058 - protein, 9 aa, Staphylococcus
KENSAENPV

SEQ ID NO: 1955059 - protein, 6 aa, Staphylococcus
KENSKL

SEQ ID NO: 1955060 - protein, 15 aa, Staphylococcus
KENSVGIGAHPGLPD

SEQ ID NO: 1955061 - protein, 7 aa, Staphylococcus
KENTDKA

SEQ ID NO: 1955062 - protein, 6 aa, Staphylococcus
KENTEA

SEQ ID NO: 1955063 - protein, 6 aa, Staphylococcus
KENTIE

SEQ ID NO: 1955064 - protein, 5 aa, Staphylococcus
KENTS

SEQ ID NO: 1955065 - protein, 5 aa, Staphylococcus
KENTW

SEQ ID NO: 1955066 - protein, 25 aa, Staphylococcus
KENVKTKEDAENKIKPKNKKSAADD

SEQ ID NO: 1955067 - protein, 8 aa, Staphylococcus
KENVPEST

SEQ ID NO: 1955068 - protein, 8 aa, Staphylococcus
KENWTTHQ

SEQ ID NO: 1955069 - protein, 6 aa, Staphylococcus
KENYPD

SEQ ID NO: 1955070 - protein, 6 aa, Staphylococcus
KENYSG

SEQ ID NO: 1955071 - protein, 8 aa, Staphylococcus
KENYTVER

SEQ ID NO: 1955072 - protein, 19 aa, Staphylococcus
KEPAEESSNAWNNAGTGHS

SEQ ID NO: 1955073 - protein, 7 aa, Staphylococcus
KEPDAKE

SEQ ID NO: 1955074 - protein, 8 aa, Staphylococcus
KEPEDISE

SEQ ID NO: 1955075 - protein, 5 aa, Staphylococcus
KEPEI

SEQ ID NO: 1955076 - protein, 14 aa, Staphylococcus
KEPEKISGKIDQEA

SEQ ID NO: 1955077 - protein, 5 aa, Staphylococcus
KEPER

SEQ ID NO: 1955078 - protein, 10 aa, Staphylococcus
KEPERTAAAR

SEQ ID NO: 1955079 - protein, 9 aa, Staphylococcus
KEPESEKVK

SEQ ID NO: 1955080 - protein, 10 aa, Staphylococcus
KEPFEPLEPG

SEQ ID NO: 1955081 - protein, 7 aa, Staphylococcus
KEPFQNK

SEQ ID NO: 1955082 - protein, 4 aa, Staphylococcus
KEPG

SEQ ID NO: 1955083 - protein, 6 aa, Staphylococcus
KEPIEV

SEQ ID NO: 1955084 - protein, 4 aa, Staphylococcus
KEPK

SEQ ID NO: 1955085 - protein, 5 aa, Staphylococcus
KEPKC

SEQ ID NO: 1955086 - protein, 10 aa, Staphylococcus
KEPKCKVKEE

SEQ ID NO: 1955087 - protein, 7 aa, Staphylococcus
KEPKSDW

SEQ ID NO: 1955088 - protein, 13 aa, Staphylococcus
KEPKTVDDKTDKI

SEQ ID NO: 1955089 - protein, 4 aa, Staphylococcus
KEPL

SEQ ID NO: 1955090 - protein, 5 aa, Staphylococcus
KEPLD

SEQ ID NO: 1955091 - protein, 7 aa, Staphylococcus
KEPLGGA

SEQ ID NO: 1955092 - protein, 14 aa, Staphylococcus
KEPLTTDEETNKVL

SEQ ID NO: 1955093 - protein, 5 aa, Staphylococcus
KEPPL

SEQ ID NO: 1955094 - protein, 5 aa, Staphylococcus
KEPQC

SEQ ID NO: 1955095 - protein, 14 aa, Staphylococcus
KEPQLNKLKDGNHA

SEQ ID NO: 1955096 - protein, 4 aa, Staphylococcus
KEPR

SEQ ID NO: 1955097 - protein, 10 aa, Staphylococcus
KEPREHSSEE

SEQ ID NO: 1955098 - protein, 9 aa, Staphylococcus
KEPREHTSK

SEQ ID NO: 1955099 - protein, 9 aa, Staphylococcus
KEPSAKDTV

SEQ ID NO: 1955100 - protein, 6 aa, Staphylococcus
KEPSDI

SEQ ID NO: 1955101 - protein, 4 aa, Staphylococcus
KEPT

SEQ ID NO: 1955102 - protein, 6 aa, Staphylococcus
KEPTER

SEQ ID NO: 1955103 - protein, 10 aa, Staphylococcus
KEPTPIQKDS

SEQ ID NO: 1955104 - protein, 9 aa, Staphylococcus
KEPTPIQKE

SEQ ID NO: 1955105 - protein, 7 aa, Staphylococcus
KEPTRFS

SEQ ID NO: 1955106 - protein, 7 aa, Staphylococcus
KEPYDKH

SEQ ID NO: 1955107 - protein, 7 aa, Staphylococcus
KEPYFST

SEQ ID NO: 1955108 - protein, 5 aa, Staphylococcus
KEPYG

SEQ ID NO: 1955109 - protein, 9 aa, Staphylococcus
KEQAASTNL

SEQ ID NO: 1955110 - protein, 9 aa, Staphylococcus
KEQAEEYGH

SEQ ID NO: 1955111 - protein, 10 aa, Staphylococcus
KEQAESYNHS

SEQ ID NO: 1955112 - protein, 7 aa, Staphylococcus
KEQARDQ

SEQ ID NO: 1955113 - protein, 7 aa, Staphylococcus
KEQAREQ

SEQ ID NO: 1955114 - protein, 9 aa, Staphylococcus
KEQDAATNL

SEQ ID NO: 1955115 - protein, 6 aa, Staphylococcus
KEQDDN

SEQ ID NO: 1955116 - protein, 7 aa, Staphylococcus
KEQDTRK

SEQ ID NO: 1955117 - protein, 5 aa, Staphylococcus
KEQDV

SEQ ID NO: 1955118 - protein, 10 aa, Staphylococcus
KEQEGITEEQ

SEQ ID NO: 1955119 - protein, 6 aa, Staphylococcus
KEQELT

SEQ ID NO: 1955120 - protein, 8 aa, Staphylococcus
KEQETPKY

SEQ ID NO: 1955121 - protein, 4 aa, Staphylococcus
KEQF

SEQ ID NO: 1955122 - protein, 7 aa, Staphylococcus
KEQFGEK

SEQ ID NO: 1955123 - protein, 17 aa, Staphylococcus
KEQFQSYSEKNDLESRF

SEQ ID NO: 1955124 - protein, 15 aa, Staphylococcus
KEQGAKEIIDALNEE

SEQ ID NO: 1955125 - protein, 6 aa, Staphylococcus
KEQGDK

SEQ ID NO: 1955126 - protein, 10 aa, Staphylococcus
KEQGEISEDD

SEQ ID NO: 1955127 - protein, 7 aa, Staphylococcus
KEQGFRT

SEQ ID NO: 1955128 - protein, 8 aa, Staphylococcus
KEQGGDVD

SEQ ID NO: 1955129 - protein, 13 aa, Staphylococcus
KEQGHEEKFRDRT

SEQ ID NO: 1955130 - protein, 12 aa, Staphylococcus
KEQGHEKTFRNK

SEQ ID NO: 1955131 - protein, 6 aa, Staphylococcus
KEQGIE

SEQ ID NO: 1955132 - protein, 5 aa, Staphylococcus
KEQGK

SEQ ID NO: 1955133 - protein, 13 aa, Staphylococcus
KEQGLEDKFRNKT

SEQ ID NO: 1955134 - protein, 6 aa, Staphylococcus
KEQGYR

SEQ ID NO: 1955135 - protein, 7 aa, Staphylococcus
KEQIEER

SEQ ID NO: 1955136 - protein, 6 aa, Staphylococcus
KEQKDR

SEQ ID NO: 1955137 - protein, 6 aa, Staphylococcus
KEQKEL

SEQ ID NO: 1955138 - protein, 12 aa, Staphylococcus
KEQKENGSAERT

SEQ ID NO: 1955139 - protein, 7 aa, Staphylococcus
KEQKKQV

SEQ ID NO: 1955140 - protein, 6 aa, Staphylococcus
KEQKQN

SEQ ID NO: 1955141 - protein, 5 aa, Staphylococcus
KEQLD

SEQ ID NO: 1955142 - protein, 15 aa, Staphylococcus
KEQLGQALGKSERVN

SEQ ID NO: 1955143 - protein, 7 aa, Staphylococcus
KEQLKRF

SEQ ID NO: 1955144 - protein, 13 aa, Staphylococcus
KEQLQEKEGRLPD

SEQ ID NO: 1955145 - protein, 7 aa, Staphylococcus
KEQLQQN

SEQ ID NO: 1955146 - protein, 9 aa, Staphylococcus
KEQNGAAMS

SEQ ID NO: 1955147 - protein, 6 aa, Staphylococcus
KEQNLS

SEQ ID NO: 1955148 - protein, 4 aa, Staphylococcus
KEQP

SEQ ID NO: 1955149 - protein, 10 aa, Staphylococcus
KEQPAAKGYG

SEQ ID NO: 1955150 - protein, 13 aa, Staphylococcus
KEQPIDEKTAKHR

SEQ ID NO: 1955151 - protein, 10 aa, Staphylococcus
KEQPSYSKQD

SEQ ID NO: 1955152 - protein, 5 aa, Staphylococcus
KEQPY

SEQ ID NO: 1955153 - protein, 6 aa, Staphylococcus
KEQQER

SEQ ID NO: 1955154 - protein, 16 aa, Staphylococcus
KEQQQAFRQQLELDWE

SEQ ID NO: 1955155 - protein, 14 aa, Staphylococcus
KEQRAEKERRSKEL

SEQ ID NO: 1955156 - protein, 19 aa, Staphylococcus
KEQRGALEGDTDYNDNNRI

SEQ ID NO: 1955157 - protein, 17 aa, Staphylococcus
KEQRGGLEGDTEYNDNH

SEQ ID NO: 1955158 - protein, 7 aa, Staphylococcus
KEQRNQN

SEQ ID NO: 1955159 - protein, 6 aa, Staphylococcus
KEQRQK

SEQ ID NO: 1955160 - protein, 4 aa, Staphylococcus
KEQS

SEQ ID NO: 1955161 - protein, 11 aa, Staphylococcus
KEQSEPNGNFP

SEQ ID NO: 1955162 - protein, 19 aa, Staphylococcus
KEQSGQEQKDNADEPNTVE

SEQ ID NO: 1955163 - protein, 7 aa, Staphylococcus
KEQSGTG

SEQ ID NO: 1955164 - protein, 18 aa, Staphylococcus
KEQSHQQATASQQPKTVE

SEQ ID NO: 1955165 - protein, 12 aa, Staphylococcus
KEQSNRDKEQIN

SEQ ID NO: 1955166 - protein, 9 aa, Staphylococcus
KEQSQDNPV

SEQ ID NO: 1955167 - protein, 10 aa, Staphylococcus
KEQSSTNNDV

SEQ ID NO: 1955168 - protein, 16 aa, Staphylococcus
KEQSYTNKWEKQAQVK

SEQ ID NO: 1955169 - protein, 8 aa, Staphylococcus
KEQTGGLD

SEQ ID NO: 1955170 - protein, 9 aa, Staphylococcus
KEQTGGLDE

SEQ ID NO: 1955171 - protein, 12 aa, Staphylococcus
KEQTGSEAKAEE

SEQ ID NO: 1955172 - protein, 21 aa, Staphylococcus
KEQTGSEAKAQEIYEKTRDAA

SEQ ID NO: 1955173 - protein, 10 aa, Staphylococcus
KEQVEGDEAK

SEQ ID NO: 1955174 - protein, 6 aa, Staphylococcus
KEQVTN

SEQ ID NO: 1955175 - protein, 6 aa, Staphylococcus
KEQVTP

SEQ ID NO: 1955176 - protein, 6 aa, Staphylococcus
KEQYTG

SEQ ID NO: 1955177 - protein, 8 aa, Staphylococcus
KERAKIGH

SEQ ID NO: 1955178 - protein, 4 aa, Staphylococcus
KERD

SEQ ID NO: 1955179 - protein, 5 aa, Staphylococcus
KERDH

SEQ ID NO: 1955180 - protein, 5 aa, Staphylococcus
KEREA

SEQ ID NO: 1955181 - protein, 8 aa, Staphylococcus
KEREESQY

SEQ ID NO: 1955182 - protein, 8 aa, Staphylococcus
KERESAEQ

SEQ ID NO: 1955183 - protein, 7 aa, Staphylococcus
KERGEVY

SEQ ID NO: 1955184 - protein, 7 aa, Staphylococcus
KERGFTP

SEQ ID NO: 1955185 - protein, 5 aa, Staphylococcus
KERGH

SEQ ID NO: 1955186 - protein, 5 aa, Staphylococcus
KERGI

SEQ ID NO: 1955187 - protein, 6 aa, Staphylococcus
KERGIA

SEQ ID NO: 1955188 - protein, 6 aa, Staphylococcus
KERGQV

SEQ ID NO: 1955189 - protein, 6 aa, Staphylococcus
KERGRL

SEQ ID NO: 1955190 - protein, 8 aa, Staphylococcus
KERGYDPV

SEQ ID NO: 1955191 - protein, 14 aa, Staphylococcus
KERHEDKKKNKYTI

SEQ ID NO: 1955192 - protein, 13 aa, Staphylococcus
KERKQLDKMSDSY

SEQ ID NO: 1955193 - protein, 4 aa, Staphylococcus
KERL

SEQ ID NO: 1955194 - protein, 7 aa, Staphylococcus
KERLEGE

SEQ ID NO: 1955195 - protein, 18 aa, Staphylococcus
KERLTELSTDNNRQNKPL

SEQ ID NO: 1955196 - protein, 16 aa, Staphylococcus
KERPELASKVSTKTIP

SEQ ID NO: 1955197 - protein, 15 aa, Staphylococcus
KERPNLAQKVSTKRV

SEQ ID NO: 1955198 - protein, 8 aa, Staphylococcus
KERPNRNI

SEQ ID NO: 1955199 - protein, 8 aa, Staphylococcus
KERPSTAK

SEQ ID NO: 1955200 - protein, 6 aa, Staphylococcus
KERQEE

SEQ ID NO: 1955201 - protein, 6 aa, Staphylococcus
KERQEV

SEQ ID NO: 1955202 - protein, 6 aa, Staphylococcus
KERQMA

SEQ ID NO: 1955203 - protein, 12 aa, Staphylococcus
KERQPFWTEDYT

SEQ ID NO: 1955204 - protein, 8 aa, Staphylococcus
KERQPING

SEQ ID NO: 1955205 - protein, 6 aa, Staphylococcus
KERQRL

SEQ ID NO: 1955206 - protein, 8 aa, Staphylococcus
KERRSAEF

SEQ ID NO: 1955207 - protein, 8 aa, Staphylococcus
KERSGREA

SEQ ID NO: 1955208 - protein, 9 aa, Staphylococcus
KERSKKELE

SEQ ID NO: 1955209 - protein, 9 aa, Staphylococcus
KERSKKQLE

SEQ ID NO: 1955210 - protein, 5 aa, Staphylococcus
KERSV

SEQ ID NO: 1955211 - protein, 8 aa, Staphylococcus
KERTEGEH

SEQ ID NO: 1955212 - protein, 9 aa, Staphylococcus
KERTGGLDE

SEQ ID NO: 1955213 - protein, 12 aa, Staphylococcus
KERTKDFTPWPA

SEQ ID NO: 1955214 - protein, 13 aa, Staphylococcus
KERTNGERTETWT

SEQ ID NO: 1955215 - protein, 14 aa, Staphylococcus
KERTNGKRQETWSQ

SEQ ID NO: 1955216 - protein, 7 aa, Staphylococcus
KERTVET

SEQ ID NO: 1955217 - protein, 14 aa, Staphylococcus
KERYEDKKKNKYSI

SEQ ID NO: 1955218 - protein, 14 aa, Staphylococcus
KERYEEKKKNKYTI

SEQ ID NO: 1955219 - protein, 12 aa, Staphylococcus
KERYGDERRTEI

SEQ ID NO: 1955220 - protein, 7 aa, Staphylococcus
KERYKSE

SEQ ID NO: 1955221 - protein, 11 aa, Staphylococcus
KERYPQLTASR

SEQ ID NO: 1955222 - protein, 5 aa, Staphylococcus
KESAA

SEQ ID NO: 1955223 - protein, 7 aa, Staphylococcus
KESAEAG

SEQ ID NO: 1955224 - protein, 12 aa, Staphylococcus
KESAKVTSLEPS

SEQ ID NO: 1955225 - protein, 16 aa, Staphylococcus
KESANRASDFIDLFFG

SEQ ID NO: 1955226 - protein, 4 aa, Staphylococcus
KESC

SEQ ID NO: 1955227 - protein, 4 aa, Staphylococcus
KESD

SEQ ID NO: 1955228 - protein, 11 aa, Staphylococcus
KESDDLYDGPS

SEQ ID NO: 1955229 - protein, 5 aa, Staphylococcus
KESDE

SEQ ID NO: 1955230 - protein, 7 aa, Staphylococcus
KESDPTE

SEQ ID NO: 1955231 - protein, 10 aa, Staphylococcus
KESDQMLREG

SEQ ID NO: 1955232 - protein, 9 aa, Staphylococcus
KESEERTRE

SEQ ID NO: 1955233 - protein, 7 aa, Staphylococcus
KESEERV

SEQ ID NO: 1955234 - protein, 5 aa, Staphylococcus
KESEL

SEQ ID NO: 1955235 - protein, 5 aa, Staphylococcus
KESFA

SEQ ID NO: 1955236 - protein, 27 aa, Staphylococcus
KESFEKSVTAPAGNQGFGYDESEFDKK

SEQ ID NO: 1955237 - protein, 17 aa, Staphylococcus
KESFGEQAIDENGEMNR

SEQ ID NO: 1955238 - protein, 6 aa, Staphylococcus
KESFTR

SEQ ID NO: 1955239 - protein, 5 aa, Staphylococcus
KESGC

SEQ ID NO: 1955240 - protein, 6 aa, Staphylococcus
KESGCT

SEQ ID NO: 1955241 - protein, 7 aa, Staphylococcus
KESGESF

SEQ ID NO: 1955242 - protein, 15 aa, Staphylococcus
KESGGCATGGSCGCS

SEQ ID NO: 1955243 - protein, 12 aa, Staphylococcus
KESGMGREGGHY

SEQ ID NO: 1955244 - protein, 5 aa, Staphylococcus
KESGV

SEQ ID NO: 1955245 - protein, 12 aa, Staphylococcus
KESIDIEIQVSV

SEQ ID NO: 1955246 - protein, 7 aa, Staphylococcus
KESIGKA

SEQ ID NO: 1955247 - protein, 8 aa, Staphylococcus
KESIRNTV

SEQ ID NO: 1955248 - protein, 4 aa, Staphylococcus
KESK

SEQ ID NO: 1955249 - protein, 5 aa, Staphylococcus
KESKA

SEQ ID NO: 1955250 - protein, 12 aa, Staphylococcus
KESKTVNQYDDQ

SEQ ID NO: 1955251 - protein, 9 aa, Staphylococcus
KESLEEARE

SEQ ID NO: 1955252 - protein, 7 aa, Staphylococcus
KESLQGA

SEQ ID NO: 1955253 - protein, 8 aa, Staphylococcus
KESLTTKN

SEQ ID NO: 1955254 - protein, 14 aa, Staphylococcus
KESMQDNDKKEQLD

SEQ ID NO: 1955255 - protein, 4 aa, Staphylococcus
KESN

SEQ ID NO: 1955256 - protein, 12 aa, Staphylococcus
KESNKDIVNQYL

SEQ ID NO: 1955257 - protein, 12 aa, Staphylococcus
KESNPDSEVAET

SEQ ID NO: 1955258 - protein, 8 aa, Staphylococcus
KESQQKVN

SEQ ID NO: 1955259 - protein, 6 aa, Staphylococcus
KESQYN

SEQ ID NO: 1955260 - protein, 14 aa, Staphylococcus
KESRKRALNGEGAT

SEQ ID NO: 1955261 - protein, 5 aa, Staphylococcus
KESRM

SEQ ID NO: 1955262 - protein, 7 aa, Staphylococcus
KESSEAG

SEQ ID NO: 1955263 - protein, 9 aa, Staphylococcus
KESSEDTAK

SEQ ID NO: 1955264 - protein, 7 aa, Staphylococcus
KESSEVY

SEQ ID NO: 1955265 - protein, 7 aa, Staphylococcus
KESSGTG

SEQ ID NO: 1955266 - protein, 8 aa, Staphylococcus
KESSVQTV

SEQ ID NO: 1955267 - protein, 7 aa, Staphylococcus
KESTELF

SEQ ID NO: 1955268 - protein, 16 aa, Staphylococcus
KESTENFKKKQQRIKT

SEQ ID NO: 1955269 - protein, 8 aa, Staphylococcus
KESTGHEV

SEQ ID NO: 1955270 - protein, 7 aa, Staphylococcus
KESTSPI

SEQ ID NO: 1955271 - protein, 7 aa, Staphylococcus
KESTVET

SEQ ID NO: 1955272 - protein, 6 aa, Staphylococcus
KESTYE

SEQ ID NO: 1955273 - protein, 4 aa, Staphylococcus
KESV

SEQ ID NO: 1955274 - protein, 5 aa, Staphylococcus
KESVE

SEQ ID NO: 1955275 - protein, 10 aa, Staphylococcus
KESVEGPEAK

SEQ ID NO: 1955276 - protein, 10 aa, Staphylococcus
KESVRSDGKA

SEQ ID NO: 1955277 - protein, 6 aa, Staphylococcus
KESYEE

SEQ ID NO: 1955278 - protein, 6 aa, Staphylococcus
KESYEG

SEQ ID NO: 1955279 - protein, 6 aa, Staphylococcus
KESYEN

SEQ ID NO: 1955280 - protein, 6 aa, Staphylococcus
KESYEQ

SEQ ID NO: 1955281 - protein, 7 aa, Staphylococcus
KESYSKM

SEQ ID NO: 1955282 - protein, 6 aa, Staphylococcus
KESYTK

SEQ ID NO: 1955283 - protein, 15 aa, Staphylococcus
KETAAEFKNETGNKA

SEQ ID NO: 1955284 - protein, 5 aa, Staphylococcus
KETAH

SEQ ID NO: 1955285 - protein, 6 aa, Staphylococcus
KETAHR

SEQ ID NO: 1955286 - protein, 18 aa, Staphylococcus
KETASSFPENKKNKDHQA

SEQ ID NO: 1955287 - protein, 14 aa, Staphylococcus
KETDANAIKAEGAH

SEQ ID NO: 1955288 - protein, 11 aa, Staphylococcus
KETDGPKFSSA

SEQ ID NO: 1955289 - protein, 8 aa, Staphylococcus
KETDKKDD

SEQ ID NO: 1955290 - protein, 9 aa, Staphylococcus
KETDKKDDM

SEQ ID NO: 1955291 - protein, 11 aa, Staphylococcus
KETDVPDPYYT

SEQ ID NO: 1955292 - protein, 7 aa, Staphylococcus
KETEEKF

SEQ ID NO: 1955293 - protein, 8 aa, Staphylococcus
KETEHSKD

SEQ ID NO: 1955294 - protein, 12 aa, Staphylococcus
KETENLSDHDQQ

SEQ ID NO: 1955295 - protein, 7 aa, Staphylococcus
KETEQQK

SEQ ID NO: 1955296 - protein, 7 aa, Staphylococcus
KETERYG

SEQ ID NO: 1955297 - protein, 4 aa, Staphylococcus
KETF

SEQ ID NO: 1955298 - protein, 5 aa, Staphylococcus
KETFP

SEQ ID NO: 1955299 - protein, 4 aa, Staphylococcus
KETG

SEQ ID NO: 1955300 - protein, 7 aa, Staphylococcus
KETGDMK

SEQ ID NO: 1955301 - protein, 8 aa, Staphylococcus
KETGEVKD

SEQ ID NO: 1955302 - protein, 6 aa, Staphylococcus
KETGHT

SEQ ID NO: 1955303 - protein, 6 aa, Staphylococcus
KETGKP

SEQ ID NO: 1955304 - protein, 7 aa, Staphylococcus
KETGLSE

SEQ ID NO: 1955305 - protein, 6 aa, Staphylococcus
KETGMK

SEQ ID NO: 1955306 - protein, 5 aa, Staphylococcus
KETGV

SEQ ID NO: 1955307 - protein, 6 aa, Staphylococcus
KETGVS

SEQ ID NO: 1955308 - protein, 11 aa, Staphylococcus
KETHWDKNQTI

SEQ ID NO: 1955309 - protein, 6 aa, Staphylococcus
KETIDM

SEQ ID NO: 1955310 - protein, 8 aa, Staphylococcus
KETINEKT

SEQ ID NO: 1955311 - protein, 6 aa, Staphylococcus
KETITS

SEQ ID NO: 1955312 - protein, 9 aa, Staphylococcus
KETKERMKR

SEQ ID NO: 1955313 - protein, 7 aa, Staphylococcus
KETKHTN

SEQ ID NO: 1955314 - protein, 9 aa, Staphylococcus
KETLEKEPL

SEQ ID NO: 1955315 - protein, 8 aa, Staphylococcus
KETLENIS

SEQ ID NO: 1955316 - protein, 7 aa, Staphylococcus
KETLENV

SEQ ID NO: 1955317 - protein, 6 aa, Staphylococcus
KETLNT

SEQ ID NO: 1955318 - protein, 15 aa, Staphylococcus
KETMSQASADPNGVP

SEQ ID NO: 1955319 - protein, 4 aa, Staphylococcus
KETN

SEQ ID NO: 1955320 - protein, 15 aa, Staphylococcus
KETNDVETPNRNGLM

SEQ ID NO: 1955321 - protein, 8 aa, Staphylococcus
KETNKTSR

SEQ ID NO: 1955322 - protein, 12 aa, Staphylococcus
KETNTSSQGLKN

SEQ ID NO: 1955323 - protein, 8 aa, Staphylococcus
KETNVTKP

SEQ ID NO: 1955324 - protein, 7 aa, Staphylococcus
KETPKLE

SEQ ID NO: 1955325 - protein, 5 aa, Staphylococcus
KETPL

SEQ ID NO: 1955326 - protein, 6 aa, Staphylococcus
KETPLQ

SEQ ID NO: 1955327 - protein, 7 aa, Staphylococcus
KETPLQK

SEQ ID NO: 1955328 - protein, 13 aa, Staphylococcus
KETPNYSKADNTI

SEQ ID NO: 1955329 - protein, 5 aa, Staphylococcus
KETQG

SEQ ID NO: 1955330 - protein, 25 aa, Staphylococcus
KETQKALEYSESGRAKGKIIVKMED

SEQ ID NO: 1955331 - protein, 8 aa, Staphylococcus
KETQSNID

SEQ ID NO: 1955332 - protein, 8 aa, Staphylococcus
KETQSNIG

SEQ ID NO: 1955333 - protein, 9 aa, Staphylococcus
KETQTQPVN

SEQ ID NO: 1955334 - protein, 11 aa, Staphylococcus
KETRGQKSRLT

SEQ ID NO: 1955335 - protein, 16 aa, Staphylococcus
KETRRAHPLNGNGQRS

SEQ ID NO: 1955336 - protein, 9 aa, Staphylococcus
KETSDAVTL

SEQ ID NO: 1955337 - protein, 9 aa, Staphylococcus
KETSDKEEV

SEQ ID NO: 1955338 - protein, 7 aa, Staphylococcus
KETSEAV

SEQ ID NO: 1955339 - protein, 6 aa, Staphylococcus
KETSIA

SEQ ID NO: 1955340 - protein, 7 aa, Staphylococcus
KETSIAN

SEQ ID NO: 1955341 - protein, 7 aa, Staphylococcus
KETSLGA

SEQ ID NO: 1955342 - protein, 8 aa, Staphylococcus
KETSTTSR

SEQ ID NO: 1955343 - protein, 5 aa, Staphylococcus
KETSY

SEQ ID NO: 1955344 - protein, 7 aa, Staphylococcus
KETTDES

SEQ ID NO: 1955345 - protein, 25 aa, Staphylococcus
KETTKNKIKSKAKPVKKAKSKKGKK

SEQ ID NO: 1955346 - protein, 12 aa, Staphylococcus
KETTKTSKSYRT

SEQ ID NO: 1955347 - protein, 16 aa, Staphylococcus
KETTPAERDEATAATT

SEQ ID NO: 1955348 - protein, 19 aa, Staphylococcus
KETTVNQIKSSMKRGGIPV

SEQ ID NO: 1955349 - protein, 10 aa, Staphylococcus
KETVDKEKGI

SEQ ID NO: 1955350 - protein, 8 aa, Staphylococcus
KETVDQLK

SEQ ID NO: 1955351 - protein, 12 aa, Staphylococcus
KETVEADIQPEN

SEQ ID NO: 1955352 - protein, 10 aa, Staphylococcus
KETVEGDDAK

SEQ ID NO: 1955353 - protein, 10 aa, Staphylococcus
KETVEGPEAK

SEQ ID NO: 1955354 - protein, 22 aa, Staphylococcus
KETVGDANASTRKAQIPPSSNA

SEQ ID NO: 1955355 - protein, 22 aa, Staphylococcus
KETVGDKNAATRKGQIPPSSNA

SEQ ID NO: 1955356 - protein, 6 aa, Staphylococcus
KETYAN

SEQ ID NO: 1955357 - protein, 5 aa, Staphylococcus
KETYD

SEQ ID NO: 1955358 - protein, 6 aa, Staphylococcus
KETYGV

SEQ ID NO: 1955359 - protein, 7 aa, Staphylococcus
KETYGVS

SEQ ID NO: 1955360 - protein, 6 aa, Staphylococcus
KETYPE

SEQ ID NO: 1955361 - protein, 7 aa, Staphylococcus
KETYRGV

SEQ ID NO: 1955362 - protein, 4 aa, Staphylococcus
KEVA

SEQ ID NO: 1955363 - protein, 6 aa, Staphylococcus
KEVADN

SEQ ID NO: 1955364 - protein, 8 aa, Staphylococcus
KEVAENPD

SEQ ID NO: 1955365 - protein, 5 aa, Staphylococcus
KEVAQ

SEQ ID NO: 1955366 - protein, 13 aa, Staphylococcus
KEVASNAGVKNVE

SEQ ID NO: 1955367 - protein, 12 aa, Staphylococcus
KEVASRAGVTNV

SEQ ID NO: 1955368 - protein, 13 aa, Staphylococcus
KEVATNAGVKNVE

SEQ ID NO: 1955369 - protein, 13 aa, Staphylococcus
KEVDGTIRVHTVE

SEQ ID NO: 1955370 - protein, 8 aa, Staphylococcus
KEVDKTSL

SEQ ID NO: 1955371 - protein, 4 aa, Staphylococcus
KEVE

SEQ ID NO: 1955372 - protein, 6 aa, Staphylococcus
KEVEDR

SEQ ID NO: 1955373 - protein, 8 aa, Staphylococcus
KEVEEQDY

SEQ ID NO: 1955374 - protein, 5 aa, Staphylococcus
KEVEI

SEQ ID NO: 1955375 - protein, 10 aa, Staphylococcus
KEVEKSKNDR

SEQ ID NO: 1955376 - protein, 11 aa, Staphylococcus
KEVEKSKNSTL

SEQ ID NO: 1955377 - protein, 9 aa, Staphylococcus
KEVEKSNHE

SEQ ID NO: 1955378 - protein, 10 aa, Staphylococcus
KEVEKSNNTA

SEQ ID NO: 1955379 - protein, 10 aa, Staphylococcus
KEVEKSNNYS

SEQ ID NO: 1955380 - protein, 46 aa, Staphylococcus
KEVEKTLEENPNSKKNKTKHTQVKQQYDSNERKINQTKDKIAEEGQ

SEQ ID NO: 1955381 - protein, 8 aa, Staphylococcus
KEVENKEV

SEQ ID NO: 1955382 - protein, 7 aa, Staphylococcus
KEVESNL

SEQ ID NO: 1955383 - protein, 6 aa, Staphylococcus
KEVGFS

SEQ ID NO: 1955384 - protein, 6 aa, Staphylococcus
KEVKED

SEQ ID NO: 1955385 - protein, 7 aa, Staphylococcus
KEVKNND

SEQ ID NO: 1955386 - protein, 14 aa, Staphylococcus
KEVKPGDNNNREAI

SEQ ID NO: 1955387 - protein, 6 aa, Staphylococcus
KEVLST

SEQ ID NO: 1955388 - protein, 7 aa, Staphylococcus
KEVNDAF

SEQ ID NO: 1955389 - protein, 9 aa, Staphylococcus
KEVNDNHDN

SEQ ID NO: 1955390 - protein, 8 aa, Staphylococcus
KEVNETMG

SEQ ID NO: 1955391 - protein, 10 aa, Staphylococcus
KEVNGESAIE

SEQ ID NO: 1955392 - protein, 6 aa, Staphylococcus
KEVPNN

SEQ ID NO: 1955393 - protein, 7 aa, Staphylococcus
KEVPTKL

SEQ ID NO: 1955394 - protein, 5 aa, Staphylococcus
KEVQA

SEQ ID NO: 1955395 - protein, 6 aa, Staphylococcus
KEVQHV

SEQ ID NO: 1955396 - protein, 7 aa, Staphylococcus
KEVSGQQ

SEQ ID NO: 1955397 - protein, 8 aa, Staphylococcus
KEVSPEEL

SEQ ID NO: 1955398 - protein, 6 aa, Staphylococcus
KEVSSS

SEQ ID NO: 1955399 - protein, 5 aa, Staphylococcus
KEVTA

SEQ ID NO: 1955400 - protein, 6 aa, Staphylococcus
KEVTKT

SEQ ID NO: 1955401 - protein, 10 aa, Staphylococcus
KEVTQDTTED

SEQ ID NO: 1955402 - protein, 28 aa, Staphylococcus
KEWAQKNQKNNNNNNNNNNNNNFERSDL

SEQ ID NO: 1955403 - protein, 23 aa, Staphylococcus
KEWQQKHEKENNQNNNNNERQGL

SEQ ID NO: 1955404 - protein, 22 aa, Staphylococcus
KEWQQKNEKDNKDNNHSDRQGL

SEQ ID NO: 1955405 - protein, 21 aa, Staphylococcus
KEWQQKNEKNNDNNNKERQGL

SEQ ID NO: 1955406 - protein, 23 aa, Staphylococcus
KEWQQKNEKNNNNNNNNSERSGL

SEQ ID NO: 1955407 - protein, 20 aa, Staphylococcus
KEWSQKNEKSQSSNNEDKGL

SEQ ID NO: 1955408 - protein, 10 aa, Staphylococcus
KEYADKEGSE

SEQ ID NO: 1955409 - protein, 8 aa, Staphylococcus
KEYAETRS

SEQ ID NO: 1955410 - protein, 13 aa, Staphylococcus
KEYANYTDEQLKA

SEQ ID NO: 1955411 - protein, 13 aa, Staphylococcus
KEYARPALDKEKL

SEQ ID NO: 1955412 - protein, 4 aa, Staphylococcus
KEYE

SEQ ID NO: 1955413 - protein, 15 aa, Staphylococcus
KEYEAKFGKEPRAYG

SEQ ID NO: 1955414 - protein, 15 aa, Staphylococcus
KEYEARFGKEPRAYG

SEQ ID NO: 1955415 - protein, 14 aa, Staphylococcus
KEYEARFGREPRAY

SEQ ID NO: 1955416 - protein, 16 aa, Staphylococcus
KEYEELTQTVKGESLD

SEQ ID NO: 1955417 - protein, 13 aa, Staphylococcus
KEYEGQGIASQSL

SEQ ID NO: 1955418 - protein, 13 aa, Staphylococcus
KEYEGSTFRQHLG

SEQ ID NO: 1955419 - protein, 6 aa, Staphylococcus
KEYEKV

SEQ ID NO: 1955420 - protein, 4 aa, Staphylococcus
KEYG

SEQ ID NO: 1955421 - protein, 6 aa, Staphylococcus
KEYKEF

SEQ ID NO: 1955422 - protein, 9 aa, Staphylococcus
KEYKEQGKI

SEQ ID NO: 1955423 - protein, 10 aa, Staphylococcus
KEYKNQGKID

SEQ ID NO: 1955424 - protein, 8 aa, Staphylococcus
KEYKQDGI

SEQ ID NO: 1955425 - protein, 21 aa, Staphylococcus
KEYKQSNGNPNIKGYTRRDSA

SEQ ID NO: 1955426 - protein, 6 aa, Staphylococcus
KEYNQE

SEQ ID NO: 1955427 - protein, 11 aa, Staphylococcus
KEYNVSRSPVR

SEQ ID NO: 1955428 - protein, 4 aa, Staphylococcus
KEYP

SEQ ID NO: 1955429 - protein, 8 aa, Staphylococcus
KEYQGLGH

SEQ ID NO: 1955430 - protein, 13 aa, Staphylococcus
KEYQKHLDDVDIR

SEQ ID NO: 1955431 - protein, 6 aa, Staphylococcus
KEYQQL

SEQ ID NO: 1955432 - protein, 7 aa, Staphylococcus
KEYRRDA

SEQ ID NO: 1955433 - protein, 12 aa, Staphylococcus
KEYSDKNGTQLP

SEQ ID NO: 1955434 - protein, 5 aa, Staphylococcus
KEYSN

SEQ ID NO: 1955435 - protein, 17 aa, Staphylococcus
KEYTESDQAQTAIDTDK

SEQ ID NO: 1955436 - protein, 50 aa, Staphylococcus; identical to SEQ ID NO: 1771724

SEQ ID NO: 1955437 - protein, 5 aa, Staphylococcus
KEYTS

SEQ ID NO: 1955438 - protein, 13 aa, Staphylococcus
KEYYTATLGEDAR

SEQ ID NO: 1955439 - protein, 8 aa, Staphylococcus
KFADKGSR

SEQ ID NO: 1955440 - protein, 18 aa, Staphylococcus
KFAEDTKDKDGKTVTTPG

SEQ ID NO: 1955441 - protein, 12 aa, Staphylococcus
KFAGISQRRVRG

SEQ ID NO: 1955442 - protein, 6 aa, Staphylococcus
KFANKE

SEQ ID NO: 1955443 - protein, 12 aa, Staphylococcus
KFDEDLKNKILQ

SEQ ID NO: 1955444 - protein, 17 aa, Staphylococcus
KFDNEDIQSQAIAASET

SEQ ID NO: 1955445 - protein, 18 aa, Staphylococcus
KFDNEEIQTKAIEASGTD

SEQ ID NO: 1955446 - protein, 10 aa, Staphylococcus
KFDNEEIQTQ

SEQ ID NO: 1955447 - protein, 6 aa, Staphylococcus
KFDPDE

SEQ ID NO: 1955448 - protein, 12 aa, Staphylococcus
KFDSDLKNKILN

SEQ ID NO: 1955449 - protein, 7 aa, Staphylococcus
KFEANGA

SEQ ID NO: 1955450 - protein, 16 aa, Staphylococcus
KFEDEATQTKAIEAAE

SEQ ID NO: 1955451 - protein, 17 aa, Staphylococcus
KFEDEETQSKAIKAAET

SEQ ID NO: 1955452 - protein, 8 aa, Staphylococcus
KFEGHSQK

SEQ ID NO: 1955453 - protein, 19 aa, Staphylococcus
KFEGMSKGKALDIQESGPI

SEQ ID NO: 1955454 - protein, 8 aa, Staphylococcus
KFELPETK

SEQ ID NO: 1955455 - protein, 18 aa, Staphylococcus
KFENEDVQTEAIKASETN

SEQ ID NO: 1955456 - protein, 19 aa, Staphylococcus
KFEQQKKEKEMKKKQKTIN

SEQ ID NO: 1955457 - protein, 10 aa, Staphylococcus
KFESENTVPL

SEQ ID NO: 1955458 - protein, 16 aa, Staphylococcus
KFGDDSKDIAEQGGFK

SEQ ID NO: 1955459 - protein, 7 aa, Staphylococcus
KFGDEAQ

SEQ ID NO: 1955460 - protein, 16 aa, Staphylococcus
KFGDEVKDIAKNGGFS

SEQ ID NO: 1955461 - protein, 6 aa, Staphylococcus
KFGEKM

SEQ ID NO: 1955462 - protein, 14 aa, Staphylococcus
KFGGGGHPNASGVS

SEQ ID NO: 1955463 - protein, 13 aa, Staphylococcus
KFGNGGEGEVPFK

SEQ ID NO: 1955464 - protein, 4 aa, Staphylococcus
KFGT

SEQ ID NO: 1955465 - protein, 12 aa, Staphylococcus
KFGTRDGTITQN

SEQ ID NO: 1955466 - protein, 11 aa, Staphylococcus
KFGTTDGTITK

SEQ ID NO: 1955467 - protein, 6 aa, Staphylococcus
KFGVSS

SEQ ID NO: 1955468 - protein, 16 aa, Staphylococcus
KFHPNKRRISNTGQRA

SEQ ID NO: 1955469 - protein, 6 aa, Staphylococcus
KFKGKS

SEQ ID NO: 1955470 - protein, 42 aa, Staphylococcus
KFKKSNKVTVPELKPETKLERKSVSIPSSSPSVKATNNHEEY

SEQ ID NO: 1955471 - protein, 10 aa, Staphylococcus
KFKNANQDDI

SEQ ID NO: 1955472 - protein, 8 aa, Staphylococcus
KFKPANLQ

SEQ ID NO: 1955473 - protein, 94 aa, Staphylococcus
KFKPGQSNETQKNTQNNHNKSENKQQSNQKQNNNKSNNQNKQNNNNKGKQQSNQNNNNNKKNNKNNKNNKNNKKNNQKQSAPQQAEPKEMPSKI

SEQ ID NO: 1955474 - protein, 77 aa, Staphylococcus
KFKPGSSKDKQDNKAAQNNHKKHQNNNKDKNNNNNGGNAKKNNKKNHNNKNQKNNKNNKNNKNQKQAPKQEAVKEMP

SEQ ID NO: 1955475 - protein, 9 aa, Staphylococcus
KFKPHGSDT

SEQ ID NO: 1955476 - protein, 28 aa, Staphylococcus
KFKSAQDNRKETQKEKTNLEQQSQSEMQ

SEQ ID NO: 1955477 - protein, 4 aa, Staphylococcus
KFKT

SEQ ID NO: 1955478 - protein, 11 aa, Staphylococcus
KFNDGSDFDAS

SEQ ID NO: 1955479 - protein, 13 aa, Staphylococcus
KFNDGSTSTMKTG

SEQ ID NO: 1955480 - protein, 5 aa, Staphylococcus
KFNGA

SEQ ID NO: 1955481 - protein, 7 aa, Staphylococcus
KFNKENY

SEQ ID NO: 1955482 - protein, 8 aa, Staphylococcus
KFNKPDAN

SEQ ID NO: 1955483 - protein, 12 aa, Staphylococcus
KFNSDVQAGGYV

SEQ ID NO: 1955484 - protein, 12 aa, Staphylococcus
KFNSEKKSERYY

SEQ ID NO: 1955485 - protein, 7 aa, Staphylococcus
KFNSPGF

SEQ ID NO: 1955486 - protein, 6 aa, Staphylococcus
KFNSVK

SEQ ID NO: 1955487 - protein, 5 aa, Staphylococcus
KFNTE

SEQ ID NO: 1955488 - protein, 12 aa, Staphylococcus
KFNTRDKYRFER

SEQ ID NO: 1955489 - protein, 5 aa, Staphylococcus
KFPER

SEQ ID NO: 1955490 - protein, 4 aa, Staphylococcus
KFPG

SEQ ID NO: 1955491 - protein, 5 aa, Staphylococcus
KFPGV

SEQ ID NO: 1955492 - protein, 6 aa, Staphylococcus
KFPGVS

SEQ ID NO: 1955493 - protein, 12 aa, Staphylococcus
KFPKNERNNKEI

SEQ ID NO: 1955494 - protein, 4 aa, Staphylococcus
KFPL

SEQ ID NO: 1955495 - protein, 12 aa, Staphylococcus
KFPSEARDQVFD

SEQ ID NO: 1955496 - protein, 12 aa, Staphylococcus
KFPYAANGRALS

SEQ ID NO: 1955497 - protein, 12 aa, Staphylococcus
KFPYAGNGRALS

SEQ ID NO: 1955498 - protein, 4 aa, Staphylococcus
KFQG

SEQ ID NO: 1955499 - protein, 8 aa, Staphylococcus
KFQGNGYG

SEQ ID NO: 1955500 - protein, 8 aa, Staphylococcus
KFQGQGYG

SEQ ID NO: 1955501 - protein, 5 aa, Staphylococcus
KFRGA

SEQ ID NO: 1955502 - protein, 96 aa, Staphylococcus
KFRPQKQQNNKQEAQNNHQKSSNKSTQKSNQQQGSKQQGNQQTKNNQKKSNQNNNKGNKNNKSNKNSKNNKNNKNNTVKKPVEPKEIPSKISYTEG

SEQ ID NO: 1955503 - protein, 8 aa, Staphylococcus
KFRQDDTK

SEQ ID NO: 1955504 - protein, 7 aa, Staphylococcus
KFSDGKE

SEQ ID NO: 1955505 - protein, 7 aa, Staphylococcus
KFSESAI

SEQ ID NO: 1955506 - protein, 9 aa, Staphylococcus
KFSGKGFAK

SEQ ID NO: 1955507 - protein, 6 aa, Staphylococcus
KFSKEG

SEQ ID NO: 1955508 - protein, 8 aa, Staphylococcus
KFSPTAND

SEQ ID NO: 1955509 - protein, 4 aa, Staphylococcus
KFSQ

SEQ ID NO: 1955510 - protein, 7 aa, Staphylococcus
KFSSTYI

SEQ ID NO: 1955511 - protein, 6 aa, Staphylococcus
KFTDEN

SEQ ID NO: 1955512 - protein, 21 aa, Staphylococcus
KFTEPTTVKAGTAISRNEDTG

SEQ ID NO: 1955513 - protein, 7 aa, Staphylococcus
KFTTNEL

SEQ ID NO: 1955514 - protein, 6 aa, Staphylococcus
KFYNNP

SEQ ID NO: 1955515 - protein, 20 aa, Staphylococcus
KFYPSTSYAAQRKYSSRELE

SEQ ID NO: 1955516 - protein, 11 aa, Staphylococcus
KGAADNYTRKD

SEQ ID NO: 1955517 - protein, 14 aa, Staphylococcus
KGAADNYTRKDMDG

SEQ ID NO: 1955518 - protein, 11 aa, Staphylococcus
KGAADQYTRKD

SEQ ID NO: 1955519 - protein, 10 aa, Staphylococcus
KGAAKVDKTK

SEQ ID NO: 1955520 - protein, 12 aa, Staphylococcus
KGADAARIVGEN

SEQ ID NO: 1955521 - protein, 7 aa, Staphylococcus
KGAEGAA

SEQ ID NO: 1955522 - protein, 8 aa, Staphylococcus
KGAFNEEN

SEQ ID NO: 1955523 - protein, 9 aa, Staphylococcus
KGAFNEENE

SEQ ID NO: 1955524 - protein, 9 aa, Staphylococcus
KGAFNETSP

SEQ ID NO: 1955525 - protein, 9 aa, Staphylococcus
KGAGEKKVN

SEQ ID NO: 1955526 - protein, 15 aa, Staphylococcus
KGAHAAKPEQGNDPV

SEQ ID NO: 1955527 - protein, 14 aa, Staphylococcus
KGAHASKPEQGNDP

SEQ ID NO: 1955528 - protein, 14 aa, Staphylococcus
KGAHYGYASEPKNK

SEQ ID NO: 1955529 - protein, 16 aa, Staphylococcus
KGAIEEGSKRLNNNGI

SEQ ID NO: 1955530 - protein, 15 aa, Staphylococcus
KGAINEGAERLESQG

SEQ ID NO: 1955531 - protein, 14 aa, Staphylococcus
KGAIQEGAERLNAQ

SEQ ID NO: 1955532 - protein, 15 aa, Staphylococcus
KGAIQEGAERLNNQN

SEQ ID NO: 1955533 - protein, 15 aa, Staphylococcus
KGAIQEGKARLENQG

SEQ ID NO: 1955534 - protein, 15 aa, Staphylococcus
KGAIQEGKSRLESQN

SEQ ID NO: 1955535 - protein, 15 aa, Staphylococcus
KGAIQEGTSRLKDAG

SEQ ID NO: 1955536 - protein, 6 aa, Staphylococcus
KGAKQL

SEQ ID NO: 1955537 - protein, 6 aa, Staphylococcus
KGAQIN

SEQ ID NO: 1955538 - protein, 11 aa, Staphylococcus
KGAREKAENGD

SEQ ID NO: 1955539 - protein, 9 aa, Staphylococcus
KGASGQAIQ

SEQ ID NO: 1955540 - protein, 8 aa, Staphylococcus
KGASGQAL

SEQ ID NO: 1955541 - protein, 6 aa, Staphylococcus
KGASHK

SEQ ID NO: 1955542 - protein, 11 aa, Staphylococcus
KGASKGEGLGN

SEQ ID NO: 1955543 - protein, 7 aa, Staphylococcus
KGASQVY

SEQ ID NO: 1955544 - protein, 7 aa, Staphylococcus
KGASTEV

SEQ ID NO: 1955545 - protein, 5 aa, Staphylococcus
KGASV

SEQ ID NO: 1955546 - protein, 6 aa, Staphylococcus
KGATEI

SEQ ID NO: 1955547 - protein, 5 aa, Staphylococcus
KGATV

SEQ ID NO: 1955548 - protein, 5 aa, Staphylococcus
KGATY

SEQ ID NO: 1955549 - protein, 21 aa, Staphylococcus
KGAWDQYSKEELHDKEAESHV

SEQ ID NO: 1955550 - protein, 7 aa, Staphylococcus
KGAWQKR

SEQ ID NO: 1955551 - protein, 5 aa, Staphylococcus
KGAYP

SEQ ID NO: 1955552 - protein, 7 aa, Staphylococcus
KGDADRD

SEQ ID NO: 1955553 - protein, 8 aa, Staphylococcus
KGDDFEKG

SEQ ID NO: 1955554 - protein, 9 aa, Staphylococcus
KGDDTGSVS

SEQ ID NO: 1955555 - protein, 4 aa, Staphylococcus
KGDE

SEQ ID NO: 1955556 - protein, 19 aa, Staphylococcus
KGDEAETDNPSHINTDEDT

SEQ ID NO: 1955557 - protein, 13 aa, Staphylococcus
KGDEDKSSETMQV

SEQ ID NO: 1955558 - protein, 7 aa, Staphylococcus
KGDEIAQ

SEQ ID NO: 1955559 - protein, 8 aa, Staphylococcus
KGDEIQQV

SEQ ID NO: 1955560 - protein, 6 aa, Staphylococcus
KGDEPL

SEQ ID NO: 1955561 - protein, 5 aa, Staphylococcus
KGDEV

SEQ ID NO: 1955562 - protein, 4 aa, Staphylococcus
KGDF

SEQ ID NO: 1955563 - protein, 14 aa, Staphylococcus
KGDGVINGTATQRM

SEQ ID NO: 1955564 - protein, 5 aa, Staphylococcus
KGDII

SEQ ID NO: 1955565 - protein, 11 aa, Staphylococcus
KGDKALTGLKK

SEQ ID NO: 1955566 - protein, 13 aa, Staphylococcus
KGDLDTLKKEAHN

SEQ ID NO: 1955567 - protein, 6 aa, Staphylococcus
KGDMTE

SEQ ID NO: 1955568 - protein, 6 aa, Staphylococcus
KGDNEH

SEQ ID NO: 1955569 - protein, 7 aa, Staphylococcus
KGDNIQY

SEQ ID NO: 1955570 - protein, 10 aa, Staphylococcus
KGDNKSAKIM

SEQ ID NO: 1955571 - protein, 10 aa, Staphylococcus
KGDNTSTEAF

SEQ ID NO: 1955572 - protein, 9 aa, Staphylococcus
KGDPNQLDN

SEQ ID NO: 1955573 - protein, 14 aa, Staphylococcus
KGDQMDQLKDGHNA

SEQ ID NO: 1955574 - protein, 8 aa, Staphylococcus
KGDQPIQR

SEQ ID NO: 1955575 - protein, 13 aa, Staphylococcus
KGDQPIYPYLFAV

SEQ ID NO: 1955576 - protein, 6 aa, Staphylococcus
KGDRVA

SEQ ID NO: 1955577 - protein, 17 aa, Staphylococcus
KGDRVEGIKQEKILVKD

SEQ ID NO: 1955578 - protein, 8 aa, Staphylococcus
KGDSDYQC

SEQ ID NO: 1955579 - protein, 27 aa, Staphylococcus
KGDTPKITTVKNKPGSASTPANRRDMN

SEQ ID NO: 1955580 - protein, 7 aa, Staphylococcus
KGDTYDK

SEQ ID NO: 1955581 - protein, 4 aa, Staphylococcus
KGDV

SEQ ID NO: 1955582 - protein, 11 aa, Staphylococcus
KGDVKNTYGTG

SEQ ID NO: 1955583 - protein, 15 aa, Staphylococcus
KGDVPKYAAPIRETD

SEQ ID NO: 1955584 - protein, 8 aa, Staphylococcus
KGDVSAPY

SEQ ID NO: 1955585 - protein, 16 aa, Staphylococcus
KGEAEQLGYPTEVTNK

SEQ ID NO: 1955586 - protein, 6 aa, Staphylococcus
KGEAIG

SEQ ID NO: 1955587 - protein, 6 aa, Staphylococcus
KGEAPQ

SEQ ID NO: 1955588 - protein, 11 aa, Staphylococcus
KGEATKFTYPD

SEQ ID NO: 1955589 - protein, 23 aa, Staphylococcus
KGEATTKNTGKYKVGKDIKPGHY

SEQ ID NO: 1955590 - protein, 9 aa, Staphylococcus
KGEDEDAPK

SEQ ID NO: 1955591 - protein, 9 aa, Staphylococcus
KGEDPEAPK

SEQ ID NO: 1955592 - protein, 9 aa, Staphylococcus
KGEDPTAPK

SEQ ID NO: 1955593 - protein, 7 aa, Staphylococcus
KGEDVTD

SEQ ID NO: 1955594 - protein, 7 aa, Staphylococcus
KGEEAAR

SEQ ID NO: 1955595 - protein, 8 aa, Staphylococcus
KGEEISKV

SEQ ID NO: 1955596 - protein, 6 aa, Staphylococcus
KGEENV

SEQ ID NO: 1955597 - protein, 7 aa, Staphylococcus
KGEEQKR

SEQ ID NO: 1955598 - protein, 8 aa, Staphylococcus
KGEERTKI

SEQ ID NO: 1955599 - protein, 9 aa, Staphylococcus
KGEETTTGD

SEQ ID NO: 1955600 - protein, 11 aa, Staphylococcus
KGEGDNGYSDF

SEQ ID NO: 1955601 - protein, 11 aa, Staphylococcus
KGEGLKAAEDL

SEQ ID NO: 1955602 - protein, 13 aa, Staphylococcus
KGEHYEAMKEALE

SEQ ID NO: 1955603 - protein, 6 aa, Staphylococcus
KGEIAG

SEQ ID NO: 1955604 - protein, 8 aa, Staphylococcus
KGEKATHT

SEQ ID NO: 1955605 - protein, 9 aa, Staphylococcus
KGEKEYSTS

SEQ ID NO: 1955606 - protein, 8 aa, Staphylococcus
KGEKIGTH

SEQ ID NO: 1955607 - protein, 9 aa, Staphylococcus
KGEKLKQAI

SEQ ID NO: 1955608 - protein, 12 aa, Staphylococcus
KGEKTNEISNDK

SEQ ID NO: 1955609 - protein, 8 aa, Staphylococcus
KGEKTSHT

SEQ ID NO: 1955610 - protein, 16 aa, Staphylococcus
KGEKVEANKQKLDTED

SEQ ID NO: 1955611 - protein, 18 aa, Staphylococcus
KGEKVEAQAPKLDTESLV

SEQ ID NO: 1955612 - protein, 17 aa, Staphylococcus
KGEKVETTAPKLDTESF

SEQ ID NO: 1955613 - protein, 4 aa, Staphylococcus
KGEL

SEQ ID NO: 1955614 - protein, 7 aa, Staphylococcus
KGELDNN

SEQ ID NO: 1955615 - protein, 5 aa, Staphylococcus
KGELG

SEQ ID NO: 1955616 - protein, 6 aa, Staphylococcus
KGELGQ

SEQ ID NO: 1955617 - protein, 11 aa, Staphylococcus
KGELKNAEFEK

SEQ ID NO: 1955618 - protein, 10 aa, Staphylococcus
KGENDEAQKC

SEQ ID NO: 1955619 - protein, 8 aa, Staphylococcus
KGENPRTH

SEQ ID NO: 1955620 - protein, 8 aa, Staphylococcus
KGENVDAQ

SEQ ID NO: 1955621 - protein, 13 aa, Staphylococcus
KGEPFYAYYKNLE

SEQ ID NO: 1955622 - protein, 7 aa, Staphylococcus
KGEPIEN

SEQ ID NO: 1955623 - protein, 9 aa, Staphylococcus
KGEPRTTEN

SEQ ID NO: 1955624 - protein, 10 aa, Staphylococcus
KGEPRTTENV

SEQ ID NO: 1955625 - protein, 7 aa, Staphylococcus
KGEQDIP

SEQ ID NO: 1955626 - protein, 7 aa, Staphylococcus
KGEQELV

SEQ ID NO: 1955627 - protein, 16 aa, Staphylococcus
KGEQVEAQAPKLDTET

SEQ ID NO: 1955628 - protein, 24 aa, Staphylococcus
KGEQVGRNDPCPCGSGKKYKNCHG

SEQ ID NO: 1955629 - protein, 18 aa, Staphylococcus
KGERPQETIPIQPSGTTF

SEQ ID NO: 1955630 - protein, 11 aa, Staphylococcus
KGERQQVDSDI

SEQ ID NO: 1955631 - protein, 6 aa, Staphylococcus
KGERVN

SEQ ID NO: 1955632 - protein, 19 aa, Staphylococcus
KGESFDKSPQEKDTPLDNT

SEQ ID NO: 1955633 - protein, 5 aa, Staphylococcus
KGESP

SEQ ID NO: 1955634 - protein, 6 aa, Staphylococcus
KGESQL

SEQ ID NO: 1955635 - protein, 8 aa, Staphylococcus
KGESTSHT

SEQ ID NO: 1955636 - protein, 9 aa, Staphylococcus
KGETAKGVG

SEQ ID NO: 1955637 - protein, 8 aa, Staphylococcus
KGETHEEK

SEQ ID NO: 1955638 - protein, 20 aa, Staphylococcus
KGETISAQSPKLNKESLVNE

SEQ ID NO: 1955639 - protein, 26 aa, Staphylococcus
KGETIVQASSKDKDIASDSTSKVDLA

SEQ ID NO: 1955640 - protein, 6 aa, Staphylococcus
KGETKI

SEQ ID NO: 1955641 - protein, 42 aa, Staphylococcus
KGETLAQASSKDKDIANESATKVDLSTKVGETIAKKASDKGI

SEQ ID NO: 1955642 - protein, 42 aa, Staphylococcus
KGETLAQASSQDKDIANESASKVDLSTKVGQTIAKKANDKGI

SEQ ID NO: 1955643 - protein, 42 aa, Staphylococcus
KGETLVQASSKDKDIASDSTSKVDLSTKVGEAIAKKASDKGI

SEQ ID NO: 1955644 - protein, 6 aa, Staphylococcus
KGETMG

SEQ ID NO: 1955645 - protein, 21 aa, Staphylococcus
KGETPASLKKQFDSQRKRNIN

SEQ ID NO: 1955646 - protein, 9 aa, Staphylococcus
KGETPASLR

SEQ ID NO: 1955647 - protein, 8 aa, Staphylococcus
KGETPDDR

SEQ ID NO: 1955648 - protein, 5 aa, Staphylococcus
KGETQ

SEQ ID NO: 1955649 - protein, 8 aa, Staphylococcus
KGETQAHY

SEQ ID NO: 1955650 - protein, 6 aa, Staphylococcus
KGETRN

SEQ ID NO: 1955651 - protein, 6 aa, Staphylococcus
KGETTK

SEQ ID NO: 1955652 - protein, 5 aa, Staphylococcus
KGETV

SEQ ID NO: 1955653 - protein, 6 aa, Staphylococcus
KGETVA

SEQ ID NO: 1955654 - protein, 7 aa, Staphylococcus
KGETYDK

SEQ ID NO: 1955655 - protein, 4 aa, Staphylococcus
KGEV

SEQ ID NO: 1955656 - protein, 8 aa, Staphylococcus
KGEVEESY

SEQ ID NO: 1955657 - protein, 8 aa, Staphylococcus
KGEVEETH

SEQ ID NO: 1955658 - protein, 6 aa, Staphylococcus
KGEYES

SEQ ID NO: 1955659 - protein, 6 aa, Staphylococcus
KGEYGQ

SEQ ID NO: 1955660 - protein, 6 aa, Staphylococcus
KGEYTS

SEQ ID NO: 1955661 - protein, 21 aa, Staphylococcus
KGFAQSKNLDQSDLKSITAQE

SEQ ID NO: 1955662 - protein, 4 aa, Staphylococcus
KGFD

SEQ ID NO: 1955663 - protein, 13 aa, Staphylococcus
KGFDTASFSETFE

SEQ ID NO: 1955664 - protein, 6 aa, Staphylococcus
KGFEPA

SEQ ID NO: 1955665 - protein, 5 aa, Staphylococcus
KGFES

SEQ ID NO: 1955666 - protein, 6 aa, Staphylococcus
KGFNAD

SEQ ID NO: 1955667 - protein, 7 aa, Staphylococcus
KGFNEGE

SEQ ID NO: 1955668 - protein, 5 aa, Staphylococcus
KGFPK

SEQ ID NO: 1955669 - protein, 8 aa, Staphylococcus
KGFSDNLQ

SEQ ID NO: 1955670 - protein, 12 aa, Staphylococcus
KGFSDNLQGHRV

SEQ ID NO: 1955671 - protein, 7 aa, Staphylococcus
KGFSPDD

SEQ ID NO: 1955672 - protein, 13 aa, Staphylococcus
KGFSSEEAASKEA

SEQ ID NO: 1955673 - protein, 6 aa, Staphylococcus
KGFTAD

SEQ ID NO: 1955674 - protein, 8 aa, Staphylococcus
KGFTKNEK

SEQ ID NO: 1955675 - protein, 6 aa, Staphylococcus
KGFYDD

SEQ ID NO: 1955676 - protein, 5 aa, Staphylococcus
KGGDP

SEQ ID NO: 1955677 - protein, 7 aa, Staphylococcus
KGGDPAV

SEQ ID NO: 1955678 - protein, 7 aa, Staphylococcus
KGGEAYN

SEQ ID NO: 1955679 - protein, 9 aa, Staphylococcus
KGGEESGIS

SEQ ID NO: 1955680 - protein, 5 aa, Staphylococcus
KGGEI

SEQ ID NO: 1955681 - protein, 7 aa, Staphylococcus
KGGEPYS

SEQ ID NO: 1955682 - protein, 12 aa, Staphylococcus
KGGFQDDQTMAS

SEQ ID NO: 1955683 - protein, 6 aa, Staphylococcus
KGGGMK

SEQ ID NO: 1955684 - protein, 40 aa, Staphylococcus
KGGHDDDASSEEAPAQEEAKTEEAPAASASQDEEVDENRQ

SEQ ID NO: 1955685 - protein, 6 aa, Staphylococcus
KGGINE

SEQ ID NO: 1955686 - protein, 7 aa, Staphylococcus
KGGKTLA

SEQ ID NO: 1955687 - protein, 13 aa, Staphylococcus
KGGKTSDSERPLT

SEQ ID NO: 1955688 - protein, 13 aa, Staphylococcus
KGGKTSESERPLT

SEQ ID NO: 1955689 - protein, 10 aa, Staphylococcus
KGGNEDEEVS

SEQ ID NO: 1955690 - protein, 11 aa, Staphylococcus
KGGNSSKTEYT

SEQ ID NO: 1955691 - protein, 5 aa, Staphylococcus
KGGQE

SEQ ID NO: 1955692 - protein, 7 aa, Staphylococcus
KGGQIQS

SEQ ID NO: 1955693 - protein, 12 aa, Staphylococcus
KGGRGSGKSSDI

SEQ ID NO: 1955694 - protein, 10 aa, Staphylococcus
KGGRNEIGTV

SEQ ID NO: 1955695 - protein, 6 aa, Staphylococcus
KGGRNS

SEQ ID NO: 1955696 - protein, 8 aa, Staphylococcus
KGGSALKD

SEQ ID NO: 1955697 - protein, 8 aa, Staphylococcus
KGGSEIDK

SEQ ID NO: 1955698 - protein, 8 aa, Staphylococcus
KGGSMTQE

SEQ ID NO: 1955699 - protein, 20 aa, Staphylococcus
KGGTEMSTEEKIASGLNDSN

SEQ ID NO: 1955700 - protein, 21 aa, Staphylococcus
KGGTEMSTEEKLAAGLNDSNV

SEQ ID NO: 1955701 - protein, 8 aa, Staphylococcus
KGGTSRSN

SEQ ID NO: 1955702 - protein, 8 aa, Staphylococcus
KGGVGKSA

SEQ ID NO: 1955703 - protein, 11 aa, Staphylococcus
KGGVGKTTISS

SEQ ID NO: 1955704 - protein, 6 aa, Staphylococcus
KGHASQ

SEQ ID NO: 1955705 - protein, 11 aa, Staphylococcus
KGHDDESSYSF

SEQ ID NO: 1955706 - protein, 7 aa, Staphylococcus
KGHEAME

SEQ ID NO: 1955707 - protein, 8 aa, Staphylococcus
KGHEAMKS

SEQ ID NO: 1955708 - protein, 6 aa, Staphylococcus
KGHGTD

SEQ ID NO: 1955709 - protein, 14 aa, Staphylococcus
KGHIYQDSSIGTGS

SEQ ID NO: 1955710 - protein, 12 aa, Staphylococcus
KGHLPSVRGEMP

SEQ ID NO: 1955711 - protein, 7 aa, Staphylococcus
KGHNGNL

SEQ ID NO: 1955712 - protein, 9 aa, Staphylococcus
KGHQLKSLP

SEQ ID NO: 1955713 - protein, 12 aa, Staphylococcus
KGHTEISSRDIG

SEQ ID NO: 1955714 - protein, 8 aa, Staphylococcus
KGHTITRL

SEQ ID NO: 1955715 - protein, 10 aa, Staphylococcus
KGHVTNKGVA

SEQ ID NO: 1955716 - protein, 6 aa, Staphylococcus
KGIAEG

SEQ ID NO: 1955717 - protein, 15 aa, Staphylococcus
KGIAKAAKKADRIAA

SEQ ID NO: 1955718 - protein, 6 aa, Staphylococcus
KGIAQN

SEQ ID NO: 1955719 - protein, 7 aa, Staphylococcus
KGIDEGA

SEQ ID NO: 1955720 - protein, 5 aa, Staphylococcus
KGIDP

SEQ ID NO: 1955721 - protein, 8 aa, Staphylococcus
KGIDQAIK

SEQ ID NO: 1955722 - protein, 4 aa, Staphylococcus
KGIE

SEQ ID NO: 1955723 - protein, 14 aa, Staphylococcus
KGIEAAKKGITGKA

SEQ ID NO: 1955724 - protein, 7 aa, Staphylococcus
KGIEEGA

SEQ ID NO: 1955725 - protein, 5 aa, Staphylococcus
KGIET

SEQ ID NO: 1955726 - protein, 5 aa, Staphylococcus
KGIFS

SEQ ID NO: 1955727 - protein, 9 aa, Staphylococcus
KGIGATKAG

SEQ ID NO: 1955728 - protein, 7 aa, Staphylococcus
KGIGKGV

SEQ ID NO: 1955729 - protein, 6 aa, Staphylococcus
KGIGPK

SEQ ID NO: 1955730 - protein, 8 aa, Staphylococcus
KGIGQEGK

SEQ ID NO: 1955731 - protein, 9 aa, Staphylococcus
KGIGSTRAG

SEQ ID NO: 1955732 - protein, 7 aa, Staphylococcus
KGIGTTM

SEQ ID NO: 1955733 - protein, 12 aa, Staphylococcus
KGIKTYGATGRF

SEQ ID NO: 1955734 - protein, 4 aa, Staphylococcus
KGIN

SEQ ID NO: 1955735 - protein, 7 aa, Staphylococcus
KGIQDPE

SEQ ID NO: 1955736 - protein, 14 aa, Staphylococcus
KGIQQLNKDGNANY

SEQ ID NO: 1955737 - protein, 14 aa, Staphylococcus
KGIQSALETQGSKF

SEQ ID NO: 1955738 - protein, 12 aa, Staphylococcus
KGIRSNITHLFK

SEQ ID NO: 1955739 - protein, 14 aa, Staphylococcus
KGIRTNAISPGPIE

SEQ ID NO: 1955740 - protein, 20 aa, Staphylococcus
KGITSYAPQYEGHAAPPEEI

SEQ ID NO: 1955741 - protein, 6 aa, Staphylococcus
KGIVDD

SEQ ID NO: 1955742 - protein, 12 aa, Staphylococcus
KGIVSTKTKVIN

SEQ ID NO: 1955743 - protein, 7 aa, Staphylococcus
KGIYTQN

SEQ ID NO: 1955744 - protein, 11 aa, Staphylococcus
KGKAFINGKAG

SEQ ID NO: 1955745 - protein, 11 aa, Staphylococcus
KGKAFINGSAG

SEQ ID NO: 1955746 - protein, 6 aa, Staphylococcus
KGKAGQ

SEQ ID NO: 1955747 - protein, 7 aa, Staphylococcus
KGKASEY

SEQ ID NO: 1955748 - protein, 10 aa, Staphylococcus
KGKASVSHDI

SEQ ID NO: 1955749 - protein, 26 aa, Staphylococcus
KGKDFDRVAKEGARTVPPRENGGNCD

SEQ ID NO: 1955750 - protein, 12 aa, Staphylococcus
KGKDGYSDEALN

SEQ ID NO: 1955751 - protein, 8 aa, Staphylococcus
KGKDNHKT

SEQ ID NO: 1955752 - protein, 7 aa, Staphylococcus
KGKDPIY

SEQ ID NO: 1955753 - protein, 7 aa, Staphylococcus
KGKEATY

SEQ ID NO: 1955754 - protein, 7 aa, Staphylococcus
KGKEDTV

SEQ ID NO: 1955755 - protein, 9 aa, Staphylococcus
KGKEGPCID

SEQ ID NO: 1955756 - protein, 10 aa, Staphylococcus
KGKEGPCIDK

SEQ ID NO: 1955757 - protein, 7 aa, Staphylococcus
KGKEKDV

SEQ ID NO: 1955758 - protein, 12 aa, Staphylococcus
KGKENKIQGSYR

SEQ ID NO: 1955759 - protein, 5 aa, Staphylococcus
KGKGI

SEQ ID NO: 1955760 - protein, 16 aa, Staphylococcus
KGKGQFKPVGEARPHI

SEQ ID NO: 1955761 - protein, 6 aa, Staphylococcus
KGKGSI

SEQ ID NO: 1955762 - protein, 7 aa, Staphylococcus
KGKGTDF

SEQ ID NO: 1955763 - protein, 6 aa, Staphylococcus
KGKHGH

SEQ ID NO: 1955764 - protein, 10 aa, Staphylococcus
KGKHSYRLDG

SEQ ID NO: 1955765 - protein, 6 aa, Staphylococcus
KGKIDE

SEQ ID NO: 1955766 - protein, 5 aa, Staphylococcus
KGKIE

SEQ ID NO: 1955767 - protein, 11 aa, Staphylococcus
KGKIKKDISPM

SEQ ID NO: 1955768 - protein, 12 aa, Staphylococcus
KGKKAKKKHPSL

SEQ ID NO: 1955769 - protein, 9 aa, Staphylococcus
KGKKEYSDS

SEQ ID NO: 1955770 - protein, 9 aa, Staphylococcus
KGKKGEIKD

SEQ ID NO: 1955771 - protein, 11 aa, Staphylococcus
KGKKGEVKDVP

SEQ ID NO: 1955772 - protein, 9 aa, Staphylococcus
KGKKPLAEV

SEQ ID NO: 1955773 - protein, 16 aa, Staphylococcus
KGKKQNCAPSREHPHG

SEQ ID NO: 1955774 - protein, 12 aa, Staphylococcus
KGKKSGVDYKKS

SEQ ID NO: 1955775 - protein, 7 aa, Staphylococcus
KGKKVKV

SEQ ID NO: 1955776 - protein, 14 aa, Staphylococcus
KGKLKNAEFTKDEK

SEQ ID NO: 1955777 - protein, 7 aa, Staphylococcus
KGKLTRR

SEQ ID NO: 1955778 - protein, 15 aa, Staphylococcus
KGKNAIVTGGARGLG

SEQ ID NO: 1955779 - protein, 15 aa, Staphylococcus
KGKNGGYQIQKSEDK

SEQ ID NO: 1955780 - protein, 12 aa, Staphylococcus
KGKNRENDKKHY

SEQ ID NO: 1955781 - protein, 7 aa, Staphylococcus
KGKPVNE

SEQ ID NO: 1955782 - protein, 7 aa, Staphylococcus
KGKQAEV

SEQ ID NO: 1955783 - protein, 7 aa, Staphylococcus
KGKQATY

SEQ ID NO: 1955784 - protein, 9 aa, Staphylococcus
KGKQQDELL

SEQ ID NO: 1955785 - protein, 5 aa, Staphylococcus
KGKRD

SEQ ID NO: 1955786 - protein, 10 aa, Staphylococcus
KGKREPQEVP

SEQ ID NO: 1955787 - protein, 9 aa, Staphylococcus
KGKRHASEV

SEQ ID NO: 1955788 - protein, 9 aa, Staphylococcus
KGKRNGYIE

SEQ ID NO: 1955789 - protein, 10 aa, Staphylococcus
KGKRQPDEVP

SEQ ID NO: 1955790 - protein, 8 aa, Staphylococcus
KGKRQPEE

SEQ ID NO: 1955791 - protein, 9 aa, Staphylococcus
KGKRSPEEI

SEQ ID NO: 1955792 - protein, 11 aa, Staphylococcus
KGKSAHSSMPE

SEQ ID NO: 1955793 - protein, 8 aa, Staphylococcus
KGKSEDQL

SEQ ID NO: 1955794 - protein, 9 aa, Staphylococcus
KGKSKDEIN

SEQ ID NO: 1955795 - protein, 9 aa, Staphylococcus
KGKSKLQNH

SEQ ID NO: 1955796 - protein, 8 aa, Staphylococcus
KGKSLGAK

SEQ ID NO: 1955797 - protein, 9 aa, Staphylococcus
KGKSPSTEI

SEQ ID NO: 1955798 - protein, 7 aa, Staphylococcus
KGKSVAN

SEQ ID NO: 1955799 - protein, 11 aa, Staphylococcus
KGKSYFGESNA

SEQ ID NO: 1955800 - protein, 14 aa, Staphylococcus
KGKTAHASTPTKGI

SEQ ID NO: 1955801 - protein, 15 aa, Staphylococcus
KGKTEVTVNNDNSTI

SEQ ID NO: 1955802 - protein, 5 aa, Staphylococcus
KGKTI

SEQ ID NO: 1955803 - protein, 8 aa, Staphylococcus
KGKTIERD

SEQ ID NO: 1955804 - protein, 22 aa, Staphylococcus
KGKTIQQAQKDAYGNVEKIKSD

SEQ ID NO: 1955805 - protein, 6 aa, Staphylococcus
KGKTIY

SEQ ID NO: 1955806 - protein, 22 aa, Staphylococcus
KGKTMAQLTTTEKSEISHRGNA

SEQ ID NO: 1955807 - protein, 9 aa, Staphylococcus
KGKTNKDIA

SEQ ID NO: 1955808 - protein, 8 aa, Staphylococcus
KGKTNREI

SEQ ID NO: 1955809 - protein, 8 aa, Staphylococcus
KGKVGAHG

SEQ ID NO: 1955810 - protein, 8 aa, Staphylococcus
KGKVPEAI

SEQ ID NO: 1955811 - protein, 8 aa, Staphylococcus
KGKVPQSI

SEQ ID NO: 1955812 - protein, 7 aa, Staphylococcus
KGKVPRQ

SEQ ID NO: 1955813 - protein, 10 aa, Staphylococcus
KGKYGSNKNY

SEQ ID NO: 1955814 - protein, 7 aa, Staphylococcus
KGKYTLT

SEQ ID NO: 1955815 - protein, 14 aa, Staphylococcus
KGLAATKTLDVTDT

SEQ ID NO: 1955816 - protein, 9 aa, Staphylococcus
KGLAGAYST

SEQ ID NO: 1955817 - protein, 21 aa, Staphylococcus
KGLAQQKGLNEDDIKSITAED

SEQ ID NO: 1955818 - protein, 12 aa, Staphylococcus
KGLDEDTPEGYT

SEQ ID NO: 1955819 - protein, 7 aa, Staphylococcus
KGLDNAG

SEQ ID NO: 1955820 - protein, 5 aa, Staphylococcus
KGLGF

SEQ ID NO: 1955821 - protein, 6 aa, Staphylococcus
KGLGFE

SEQ ID NO: 1955822 - protein, 6 aa, Staphylococcus
KGLGKD

SEQ ID NO: 1955823 - protein, 5 aa, Staphylococcus
KGLGR

SEQ ID NO: 1955824 - protein, 15 aa, Staphylococcus
KGLGYETAKELKAKG

SEQ ID NO: 1955825 - protein, 4 aa, Staphylococcus
KGLH

SEQ ID NO: 1955826 - protein, 8 aa, Staphylococcus
KGLHPGRT

SEQ ID NO: 1955827 - protein, 8 aa, Staphylococcus
KGLKEVSE

SEQ ID NO: 1955828 - protein, 7 aa, Staphylococcus
KGLKRNL

SEQ ID NO: 1955829 - protein, 5 aa, Staphylococcus
KGLND

SEQ ID NO: 1955830 - protein, 6 aa, Staphylococcus
KGLNDE

SEQ ID NO: 1955831 - protein, 6 aa, Staphylococcus
KGLNKK

SEQ ID NO: 1955832 - protein, 17 aa, Staphylococcus
KGLNKQIKNTDISRPGL

SEQ ID NO: 1955833 - protein, 16 aa, Staphylococcus
KGLNTSFETAEKVKHQ

SEQ ID NO: 1955834 - protein, 5 aa, Staphylococcus
KGLNY

SEQ ID NO: 1955835 - protein, 7 aa, Staphylococcus
KGLPEQT

SEQ ID NO: 1955836 - protein, 19 aa, Staphylococcus
KGLSDSNHANVAWYNLVKE

SEQ ID NO: 1955837 - protein, 16 aa, Staphylococcus
KGLSKGYVENKVNDNK

SEQ ID NO: 1955838 - protein, 18 aa, Staphylococcus
KGLSVANKANPNQKTSIT

SEQ ID NO: 1955839 - protein, 7 aa, Staphylococcus
KGLTDGE

SEQ ID NO: 1955840 - protein, 12 aa, Staphylococcus
KGLTGSGVEVKD

SEQ ID NO: 1955841 - protein, 13 aa, Staphylococcus
KGLTTPDEQEAYV

SEQ ID NO: 1955842 - protein, 4 aa, Staphylococcus
KGME

SEQ ID NO: 1955843 - protein, 6 aa, Staphylococcus
KGMTNA

SEQ ID NO: 1955844 - protein, 10 aa, Staphylococcus
KGMTSANPLD

SEQ ID NO: 1955845 - protein, 28 aa, Staphylococcus
KGMTSANPLDFPGYEEKIEKDQQKTDLQ

SEQ ID NO: 1955846 - protein, 28 aa, Staphylococcus
KGMTSANPLDFPGYEEKIKKDQEKTGLD

SEQ ID NO: 1955847 - protein, 12 aa, Staphylococcus
KGMTYEKYNNAL

SEQ ID NO: 1955848 - protein, 6 aa, Staphylococcus
KGNASE

SEQ ID NO: 1955849 - protein, 6 aa, Staphylococcus
KGNDDI

SEQ ID NO: 1955850 - protein, 6 aa, Staphylococcus
KGNDVT

SEQ ID NO: 1955851 - protein, 4 aa, Staphylococcus
KGNE

SEQ ID NO: 1955852 - protein, 5 aa, Staphylococcus
KGNEI

SEQ ID NO: 1955853 - protein, 6 aa, Staphylococcus
KGNEIN

SEQ ID NO: 1955854 - protein, 20 aa, Staphylococcus
KGNENVKALKADDNNNVTGV

SEQ ID NO: 1955855 - protein, 13 aa, Staphylococcus
KGNEQWKSLDDNE

SEQ ID NO: 1955856 - protein, 11 aa, Staphylococcus
KGNFKQNINEN

SEQ ID NO: 1955857 - protein, 17 aa, Staphylococcus
KGNGQFKPTGNANPHIG

SEQ ID NO: 1955858 - protein, 8 aa, Staphylococcus
KGNHKPDL

SEQ ID NO: 1955859 - protein, 7 aa, Staphylococcus
KGNIPDY

SEQ ID NO: 1955860 - protein, 9 aa, Staphylococcus
KGNITTKPD

SEQ ID NO: 1955861 - protein, 6 aa, Staphylococcus
KGNKKI

SEQ ID NO: 1955862 - protein, 5 aa, Staphylococcus
KGNKR

SEQ ID NO: 1955863 - protein, 5 aa, Staphylococcus
KGNLG

SEQ ID NO: 1955864 - protein, 5 aa, Staphylococcus
KGNLQ

SEQ ID NO: 1955865 - protein, 6 aa, Staphylococcus
KGNNPI

SEQ ID NO: 1955866 - protein, 6 aa, Staphylococcus
KGNNYK

SEQ ID NO: 1955867 - protein, 5 aa, Staphylococcus
KGNPF

SEQ ID NO: 1955868 - protein, 11 aa, Staphylococcus
KGNPGTGKTTV

SEQ ID NO: 1955869 - protein, 8 aa, Staphylococcus
KGNPMQTE

SEQ ID NO: 1955870 - protein, 6 aa, Staphylococcus
KGNPRA

SEQ ID NO: 1955871 - protein, 7 aa, Staphylococcus
KGNPYVS

SEQ ID NO: 1955872 - protein, 8 aa, Staphylococcus
KGNPYVSR

SEQ ID NO: 1955873 - protein, 6 aa, Staphylococcus
KGNRFS

SEQ ID NO: 1955874 - protein, 9 aa, Staphylococcus
KGNRSPEEV

SEQ ID NO: 1955875 - protein, 6 aa, Staphylococcus
KGNSGV

SEQ ID NO: 1955876 - protein, 5 aa, Staphylococcus
KGNSI

SEQ ID NO: 1955877 - protein, 8 aa, Staphylococcus
KGNSNYGK

SEQ ID NO: 1955878 - protein, 7 aa, Staphylococcus
KGNSVQR

SEQ ID NO: 1955879 - protein, 6 aa, Staphylococcus
KGNSYI

SEQ ID NO: 1955880 - protein, 4 aa, Staphylococcus
KGNV

SEQ ID NO: 1955881 - protein, 17 aa, Staphylococcus
KGNVDVDSKHIKANANA

SEQ ID NO: 1955882 - protein, 20 aa, Staphylococcus
KGNVEEKYGKAKRITTNEYG

SEQ ID NO: 1955883 - protein, 13 aa, Staphylococcus
KGNYAVSADRTIG

SEQ ID NO: 1955884 - protein, 7 aa, Staphylococcus
KGNYNNT

SEQ ID NO: 1955885 - protein, 7 aa, Staphylococcus
KGNYSSD

SEQ ID NO: 1955886 - protein, 12 aa, Staphylococcus
KGPAASNHFEGG

SEQ ID NO: 1955887 - protein, 13 aa, Staphylococcus
KGPAGQELERKHP

SEQ ID NO: 1955888 - protein, 8 aa, Staphylococcus
KGPDFPTS

SEQ ID NO: 1955889 - protein, 14 aa, Staphylococcus
KGPDGIEFRFNYLG

SEQ ID NO: 1955890 - protein, 15 aa, Staphylococcus
KGPDGIQFRFNFIKV

SEQ ID NO: 1955891 - protein, 8 aa, Staphylococcus
KGPEIRTH

SEQ ID NO: 1955892 - protein, 9 aa, Staphylococcus
KGPESKKRE

SEQ ID NO: 1955893 - protein, 5 aa, Staphylococcus
KGPFE

SEQ ID NO: 1955894 - protein, 6 aa, Staphylococcus
KGPGDV

SEQ ID NO: 1955895 - protein, 15 aa, Staphylococcus
KGPIGKGSAKATVDG

SEQ ID NO: 1955896 - protein, 9 aa, Staphylococcus
KGPKGAQAF

SEQ ID NO: 1955897 - protein, 59 aa, Staphylococcus
KGPKGDTGEQGPAGQDGKDGKNGINGIDGVNGNSGPQGPPGRDGKDGVDGQDGSDGKSF

SEQ ID NO: 1955898 - protein, 8 aa, Staphylococcus
KGPKRPNG

SEQ ID NO: 1955899 - protein, 10 aa, Staphylococcus
KGPLHGGANE

SEQ ID NO: 1955900 - protein, 6 aa, Staphylococcus
KGPNHV

SEQ ID NO: 1955901 - protein, 9 aa, Staphylococcus
KGPSGIGKT

SEQ ID NO: 1955902 - protein, 16 aa, Staphylococcus
KGPTGSGKTKLAETLS

SEQ ID NO: 1955903 - protein, 21 aa, Staphylococcus
KGPTGSGKTKLAETLSDEVRR

SEQ ID NO: 1955904 - protein, 20 aa, Staphylococcus
KGPTGSGKTKLAETLSETMN

SEQ ID NO: 1955905 - protein, 14 aa, Staphylococcus
KGPTGSGKTRLAET

SEQ ID NO: 1955906 - protein, 8 aa, Staphylococcus
KGPTKSLY

SEQ ID NO: 1955907 - protein, 8 aa, Staphylococcus
KGPVPESI

SEQ ID NO: 1955908 - protein, 12 aa, Staphylococcus
KGPVPKSVQQTM

SEQ ID NO: 1955909 - protein, 5 aa, Staphylococcus
KGPVS

SEQ ID NO: 1955910 - protein, 14 aa, Staphylococcus
KGPYEAARNNVQEY

SEQ ID NO: 1955911 - protein, 9 aa, Staphylococcus
KGPYENEIK

SEQ ID NO: 1955912 - protein, 6 aa, Staphylococcus
KGPYKA

SEQ ID NO: 1955913 - protein, 14 aa, Staphylococcus
KGPYTAAKKNVAQH

SEQ ID NO: 1955914 - protein, 6 aa, Staphylococcus
KGQDTL

SEQ ID NO: 1955915 - protein, 7 aa, Staphylococcus
KGQEGAF

SEQ ID NO: 1955916 - protein, 8 aa, Staphylococcus
KGQGASFL

SEQ ID NO: 1955917 - protein, 9 aa, Staphylococcus
KGQGDGPTV

SEQ ID NO: 1955918 - protein, 10 aa, Staphylococcus
KGQGDGPTVA

SEQ ID NO: 1955919 - protein, 17 aa, Staphylococcus
KGQGQFKPVDDANPYLG

SEQ ID NO: 1955920 - protein, 10 aa, Staphylococcus
KGQGVGRNSV

SEQ ID NO: 1955921 - protein, 13 aa, Staphylococcus
KGQKNNLSVREDS

SEQ ID NO: 1955922 - protein, 17 aa, Staphylococcus
KGQKSYGGGKGANQAIA

SEQ ID NO: 1955923 - protein, 4 aa, Staphylococcus
KGQL

SEQ ID NO: 1955924 - protein, 8 aa, Staphylococcus
KGQLENDS

SEQ ID NO: 1955925 - protein, 7 aa, Staphylococcus
KGQLNPG

SEQ ID NO: 1955926 - protein, 12 aa, Staphylococcus
KGQMKQANRVGA

SEQ ID NO: 1955927 - protein, 4 aa, Staphylococcus
KGQN

SEQ ID NO: 1955928 - protein, 8 aa, Staphylococcus
KGQNLSEA

SEQ ID NO: 1955929 - protein, 7 aa, Staphylococcus
KGQNVSQ

SEQ ID NO: 1955930 - protein, 4 aa, Staphylococcus
KGQP

SEQ ID NO: 1955931 - protein, 5 aa, Staphylococcus
KGQQM

SEQ ID NO: 1955932 - protein, 7 aa, Staphylococcus
KGQRDKA

SEQ ID NO: 1955933 - protein, 7 aa, Staphylococcus
KGQRLNS

SEQ ID NO: 1955934 - protein, 4 aa, Staphylococcus
KGQS

SEQ ID NO: 1955935 - protein, 9 aa, Staphylococcus
KGQSLGAID

SEQ ID NO: 1955936 - protein, 6 aa, Staphylococcus
KGQTDI

SEQ ID NO: 1955937 - protein, 19 aa, Staphylococcus
KGQTFAQDESLKPRLTPAK

SEQ ID NO: 1955938 - protein, 10 aa, Staphylococcus
KGQTGVNPPV

SEQ ID NO: 1955939 - protein, 6 aa, Staphylococcus
KGQTII

SEQ ID NO: 1955940 - protein, 8 aa, Staphylococcus
KGQTLSEI

SEQ ID NO: 1955941 - protein, 6 aa, Staphylococcus
KGQTVI

SEQ ID NO: 1955942 - protein, 7 aa, Staphylococcus
KGQYNKE

SEQ ID NO: 1955943 - protein, 5 aa, Staphylococcus
KGRAA

SEQ ID NO: 1955944 - protein, 32 aa, Staphylococcus
KGRAAYYKEESRGHTDPGAQSSVYILNALIGD

SEQ ID NO: 1955945 - protein, 12 aa, Staphylococcus
KGRDKAHKASMK

SEQ ID NO: 1955946 - protein, 20 aa, Staphylococcus
KGREDAYPSELSGGQKQRVG

SEQ ID NO: 1955947 - protein, 20 aa, Staphylococcus
KGREKAYPSELSGGQKQRVG

SEQ ID NO: 1955948 - protein, 19 aa, Staphylococcus
KGRESAYPSELSGGQKQRV

SEQ ID NO: 1955949 - protein, 14 aa, Staphylococcus
KGREVSAIDPSDDM

SEQ ID NO: 1955950 - protein, 7 aa, Staphylococcus
KGRFKDS

SEQ ID NO: 1955951 - protein, 7 aa, Staphylococcus
KGRFTDS

SEQ ID NO: 1955952 - protein, 14 aa, Staphylococcus
KGRGGHGAKPHETI

SEQ ID NO: 1955953 - protein, 6 aa, Staphylococcus
KGRGLY

SEQ ID NO: 1955954 - protein, 5 aa, Staphylococcus
KGRIE

SEQ ID NO: 1955955 - protein, 5 aa, Staphylococcus
KGRKS

SEQ ID NO: 1955956 - protein, 8 aa, Staphylococcus
KGRKTTDA

SEQ ID NO: 1955957 - protein, 4 aa, Staphylococcus
KGRL

SEQ ID NO: 1955958 - protein, 19 aa, Staphylococcus
KGRLLDDGSRVAPEVKEGD

SEQ ID NO: 1955959 - protein, 7 aa, Staphylococcus
KGRPSTQ

SEQ ID NO: 1955960 - protein, 11 aa, Staphylococcus
KGRQYTEENNE

SEQ ID NO: 1955961 - protein, 6 aa, Staphylococcus
KGRSIH

SEQ ID NO: 1955962 - protein, 5 aa, Staphylococcus
KGRTI

SEQ ID NO: 1955963 - protein, 22 aa, Staphylococcus
KGRTMAELSATEKSQISHRGEA

SEQ ID NO: 1955964 - protein, 5 aa, Staphylococcus
KGRTY

SEQ ID NO: 1955965 - protein, 6 aa, Staphylococcus
KGRYTS

SEQ ID NO: 1955966 - protein, 8 aa, Staphylococcus
KGSAAQSL

SEQ ID NO: 1955967 - protein, 6 aa, Staphylococcus
KGSAGI

SEQ ID NO: 1955968 - protein, 5 aa, Staphylococcus
KGSAI

SEQ ID NO: 1955969 - protein, 9 aa, Staphylococcus
KGSAIYSAT

SEQ ID NO: 1955970 - protein, 10 aa, Staphylococcus
KGSDEEKQHA

SEQ ID NO: 1955971 - protein, 9 aa, Staphylococcus
KGSDKGVKN

SEQ ID NO: 1955972 - protein, 9 aa, Staphylococcus
KGSDRSSAI

SEQ ID NO: 1955973 - protein, 4 aa, Staphylococcus
KGSE

SEQ ID NO: 1955974 - protein, 7 aa, Staphylococcus
KGSEFGP

SEQ ID NO: 1955975 - protein, 5 aa, Staphylococcus
KGSEL

SEQ ID NO: 1955976 - protein, 12 aa, Staphylococcus
KGSEVGEPLSAH

SEQ ID NO: 1955977 - protein, 7 aa, Staphylococcus
KGSEVTV

SEQ ID NO: 1955978 - protein, 14 aa, Staphylococcus
KGSGGHGAKPHETI

SEQ ID NO: 1955979 - protein, 7 aa, Staphylococcus
KGSGTRF

SEQ ID NO: 1955980 - protein, 7 aa, Staphylococcus
KGSGYNS

SEQ ID NO: 1955981 - protein, 6 aa, Staphylococcus
KGSIHE

SEQ ID NO: 1955982 - protein, 7 aa, Staphylococcus
KGSITSA

SEQ ID NO: 1955983 - protein, 7 aa, Staphylococcus
KGSKERI

SEQ ID NO: 1955984 - protein, 12 aa, Staphylococcus
KGSKVSQDKKIE

SEQ ID NO: 1955985 - protein, 23 aa, Staphylococcus
KGSLAGVDGRLQSRSYENKEGQR

SEQ ID NO: 1955986 - protein, 22 aa, Staphylococcus
KGSLAGVDGRLQSRSYENQEGR

SEQ ID NO: 1955987 - protein, 8 aa, Staphylococcus
KGSLGQSY

SEQ ID NO: 1955988 - protein, 4 aa, Staphylococcus
KGSM

SEQ ID NO: 1955989 - protein, 6 aa, Staphylococcus
KGSMGL

SEQ ID NO: 1955990 - protein, 12 aa, Staphylococcus
KGSNPPKDEQSK

SEQ ID NO: 1955991 - protein, 9 aa, Staphylococcus
KGSNPSAPK

SEQ ID NO: 1955992 - protein, 8 aa, Staphylococcus
KGSNPTYV

SEQ ID NO: 1955993 - protein, 15 aa, Staphylococcus
KGSNVLTSTIDEAYT

SEQ ID NO: 1955994 - protein, 6 aa, Staphylococcus
KGSPIG

SEQ ID NO: 1955995 - protein, 7 aa, Staphylococcus
KGSPQVR

SEQ ID NO: 1955996 - protein, 7 aa, Staphylococcus
KGSQTIE

SEQ ID NO: 1955997 - protein, 8 aa, Staphylococcus
KGSQTIEG

SEQ ID NO: 1955998 - protein, 15 aa, Staphylococcus
KGSRGMKLEEVVEAL

SEQ ID NO: 1955999 - protein, 15 aa, Staphylococcus
KGSRGNKLEDIVNAI

SEQ ID NO: 1956000 - protein, 15 aa, Staphylococcus
KGSRGNKLEEVVNAL

SEQ ID NO: 1956001 - protein, 15 aa, Staphylococcus
KGSRGNKLEEVVNKL

SEQ ID NO: 1956002 - protein, 6 aa, Staphylococcus
KGSSYP

SEQ ID NO: 1956003 - protein, 19 aa, Staphylococcus
KGSTGEGVKSVTGYTGQDA

SEQ ID NO: 1956004 - protein, 5 aa, Staphylococcus
KGSTM

SEQ ID NO: 1956005 - protein, 6 aa, Staphylococcus
KGSTTQ

SEQ ID NO: 1956006 - protein, 6 aa, Staphylococcus
KGSTVS

SEQ ID NO: 1956007 - protein, 7 aa, Staphylococcus
KGSVNGP

SEQ ID NO: 1956008 - protein, 7 aa, Staphylococcus
KGSVQGE

SEQ ID NO: 1956009 - protein, 6 aa, Staphylococcus
KGTAEG

SEQ ID NO: 1956010 - protein, 9 aa, Staphylococcus
KGTAKGVGN

SEQ ID NO: 1956011 - protein, 7 aa, Staphylococcus
KGTDLEV

SEQ ID NO: 1956012 - protein, 13 aa, Staphylococcus
KGTEDFDKETQSH

SEQ ID NO: 1956013 - protein, 8 aa, Staphylococcus
KGTEDFEQ

SEQ ID NO: 1956014 - protein, 23 aa, Staphylococcus
KGTEIKSIRRGSANLKDSYAQVK

SEQ ID NO: 1956015 - protein, 6 aa, Staphylococcus
KGTENA

SEQ ID NO: 1956016 - protein, 9 aa, Staphylococcus
KGTENKTYL

SEQ ID NO: 1956017 - protein, 17 aa, Staphylococcus
KGTESMTIEPTKDEVAS

SEQ ID NO: 1956018 - protein, 4 aa, Staphylococcus
KGTF

SEQ ID NO: 1956019 - protein, 17 aa, Staphylococcus
KGTFGKADRLYVNLPKE

SEQ ID NO: 1956020 - protein, 13 aa, Staphylococcus
KGTFVKEQDNSIL

SEQ ID NO: 1956021 - protein, 4 aa, Staphylococcus
KGTG

SEQ ID NO: 1956022 - protein, 8 aa, Staphylococcus
KGTGAGND

SEQ ID NO: 1956023 - protein, 10 aa, Staphylococcus
KGTGALQKGV

SEQ ID NO: 1956024 - protein, 11 aa, Staphylococcus
KGTGALQKGVQ

SEQ ID NO: 1956025 - protein, 12 aa, Staphylococcus
KGTGALQKGVQN

SEQ ID NO: 1956026 - protein, 12 aa, Staphylococcus
KGTGALQKGVQQ

SEQ ID NO: 1956027 - protein, 14 aa, Staphylococcus
KGTGFEGRVTKKDI

SEQ ID NO: 1956028 - protein, 6 aa, Staphylococcus
KGTGFV

SEQ ID NO: 1956029 - protein, 14 aa, Staphylococcus
KGTGQFKPVGEANP

SEQ ID NO: 1956030 - protein, 4 aa, Staphylococcus
KGTH

SEQ ID NO: 1956031 - protein, 12 aa, Staphylococcus
KGTIKEVQTGYE

SEQ ID NO: 1956032 - protein, 12 aa, Staphylococcus
KGTIPAQREEEK

SEQ ID NO: 1956033 - protein, 8 aa, Staphylococcus
KGTIPTDY

SEQ ID NO: 1956034 - protein, 7 aa, Staphylococcus
KGTMEAA

SEQ ID NO: 1956035 - protein, 7 aa, Staphylococcus
KGTMEYS

SEQ ID NO: 1956036 - protein, 13 aa, Staphylococcus
KGTNDFDTDTQQT

SEQ ID NO: 1956037 - protein, 9 aa, Staphylococcus
KGTNDGKIK

SEQ ID NO: 1956038 - protein, 13 aa, Staphylococcus
KGTNFSHSDPNYD

SEQ ID NO: 1956039 - protein, 13 aa, Staphylococcus
KGTNFSPDDPNYD

SEQ ID NO: 1956040 - protein, 5 aa, Staphylococcus
KGTPF

SEQ ID NO: 1956041 - protein, 9 aa, Staphylococcus
KGTPYEKEA

SEQ ID NO: 1956042 - protein, 6 aa, Staphylococcus
KGTQQI

SEQ ID NO: 1956043 - protein, 6 aa, Staphylococcus
KGTRIS

SEQ ID NO: 1956044 - protein, 6 aa, Staphylococcus
KGTRKE

SEQ ID NO: 1956045 - protein, 6 aa, Staphylococcus
KGTRMK

SEQ ID NO: 1956046 - protein, 8 aa, Staphylococcus
KGTRMKSN

SEQ ID NO: 1956047 - protein, 4 aa, Staphylococcus
KGTS

SEQ ID NO: 1956048 - protein, 16 aa, Staphylococcus
KGTSASSNTKSTVAGA

SEQ ID NO: 1956049 - protein, 15 aa, Staphylococcus
KGTSLNPLNGKNTAG

SEQ ID NO: 1956050 - protein, 6 aa, Staphylococcus
KGTSME

SEQ ID NO: 1956051 - protein, 5 aa, Staphylococcus
KGTSR

SEQ ID NO: 1956052 - protein, 30 aa, Staphylococcus
KGTTGDGVESVTGYTGHDAAKIRDYNENHH

SEQ ID NO: 1956053 - protein, 20 aa, Staphylococcus
KGTTGEGVESVTGYTGHDAA

SEQ ID NO: 1956054 - protein, 8 aa, Staphylococcus
KGTTHEET

SEQ ID NO: 1956055 - protein, 18 aa, Staphylococcus
KGTVEREGKADANSEQDA

SEQ ID NO: 1956056 - protein, 5 aa, Staphylococcus
KGTVV

SEQ ID NO: 1956057 - protein, 4 aa, Staphylococcus
KGTY

SEQ ID NO: 1956058 - protein, 15 aa, Staphylococcus
KGTYPTTSFQDNYDE

SEQ ID NO: 1956059 - protein, 13 aa, Staphylococcus
KGVAAHSSLPNLG

SEQ ID NO: 1956060 - protein, 7 aa, Staphylococcus
KGVDSKI

SEQ ID NO: 1956061 - protein, 4 aa, Staphylococcus
KGVE

SEQ ID NO: 1956062 - protein, 18 aa, Staphylococcus
KGVENNKGRIGSRKGPDI

SEQ ID NO: 1956063 - protein, 10 aa, Staphylococcus
KGVFTEEGGQ

SEQ ID NO: 1956064 - protein, 9 aa, Staphylococcus
KGVKDQVDE

SEQ ID NO: 1956065 - protein, 12 aa, Staphylococcus
KGVKHKNKSRLT

SEQ ID NO: 1956066 - protein, 8 aa, Staphylococcus
KGVKQNEL

SEQ ID NO: 1956067 - protein, 7 aa, Staphylococcus
KGVNDDQ

SEQ ID NO: 1956068 - protein, 7 aa, Staphylococcus
KGVNEGA

SEQ ID NO: 1956069 - protein, 6 aa, Staphylococcus
KGVNGI

SEQ ID NO: 1956070 - protein, 14 aa, Staphylococcus
KGVPMNKQDESTQI

SEQ ID NO: 1956071 - protein, 6 aa, Staphylococcus
KGVSGI

SEQ ID NO: 1956072 - protein, 11 aa, Staphylococcus
KGVSKKTFENR

SEQ ID NO: 1956073 - protein, 11 aa, Staphylococcus
KGVSKVSDTTG

SEQ ID NO: 1956074 - protein, 6 aa, Staphylococcus
KGWLNQ

SEQ ID NO: 1956075 - protein, 12 aa, Staphylococcus
KGWTNSAISRSA

SEQ ID NO: 1956076 - protein, 9 aa, Staphylococcus
KGYEESTIP

SEQ ID NO: 1956077 - protein, 6 aa, Staphylococcus
KGYEIQ

SEQ ID NO: 1956078 - protein, 7 aa, Staphylococcus
KGYEQTR

SEQ ID NO: 1956079 - protein, 15 aa, Staphylococcus
KGYESQKEKIGDQMP

SEQ ID NO: 1956080 - protein, 6 aa, Staphylococcus
KGYFEQ

SEQ ID NO: 1956081 - protein, 4 aa, Staphylococcus
KGYG

SEQ ID NO: 1956082 - protein, 11 aa, Staphylococcus
KGYGKRTPVSE

SEQ ID NO: 1956083 - protein, 14 aa, Staphylococcus
KGYGRIANTPEAAI

SEQ ID NO: 1956084 - protein, 4 aa, Staphylococcus
KGYH

SEQ ID NO: 1956085 - protein, 14 aa, Staphylococcus
KGYISATHDESNRT

SEQ ID NO: 1956086 - protein, 14 aa, Staphylococcus
KGYKAEGLHGDITQ

SEQ ID NO: 1956087 - protein, 15 aa, Staphylococcus
KGYKAEGLHGDITQA

SEQ ID NO: 1956088 - protein, 20 aa, Staphylococcus
KGYKHKDADFKKLSQKVGAP

SEQ ID NO: 1956089 - protein, 9 aa, Staphylococcus
KGYKKTPHV

SEQ ID NO: 1956090 - protein, 7 aa, Staphylococcus
KGYKPKE

SEQ ID NO: 1956091 - protein, 6 aa, Staphylococcus
KGYLDD

SEQ ID NO: 1956092 - protein, 6 aa, Staphylococcus
KGYLKD

SEQ ID NO: 1956093 - protein, 13 aa, Staphylococcus
KGYLPDEYRSKIG

SEQ ID NO: 1956094 - protein, 5 aa, Staphylococcus
KGYLQ

SEQ ID NO: 1956095 - protein, 6 aa, Staphylococcus
KGYLQD

SEQ ID NO: 1956096 - protein, 11 aa, Staphylococcus
KGYMEASQKNQ

SEQ ID NO: 1956097 - protein, 5 aa, Staphylococcus
KGYNS

SEQ ID NO: 1956098 - protein, 6 aa, Staphylococcus
KGYNSK

SEQ ID NO: 1956099 - protein, 10 aa, Staphylococcus
KGYNYSENQP

SEQ ID NO: 1956100 - protein, 14 aa, Staphylococcus
KGYPGNYEKGHQVS

SEQ ID NO: 1956101 - protein, 14 aa, Staphylococcus
KGYPGSYAKGTKVA

SEQ ID NO: 1956102 - protein, 11 aa, Staphylococcus
KGYPGSYDKGY

SEQ ID NO: 1956103 - protein, 16 aa, Staphylococcus
KGYPGSYEKGAEVSGF

SEQ ID NO: 1956104 - protein, 11 aa, Staphylococcus
KGYPGSYEKGV

SEQ ID NO: 1956105 - protein, 11 aa, Staphylococcus
KGYPGTYNKGE

SEQ ID NO: 1956106 - protein, 8 aa, Staphylococcus
KGYPPSVR

SEQ ID NO: 1956107 - protein, 22 aa, Staphylococcus
KGYQDANNKSFKSVRKQTRRRL

SEQ ID NO: 1956108 - protein, 9 aa, Staphylococcus
KGYQHKDKD

SEQ ID NO: 1956109 - protein, 9 aa, Staphylococcus
KGYQHRDTD

SEQ ID NO: 1956110 - protein, 7 aa, Staphylococcus
KGYQKGL

SEQ ID NO: 1956111 - protein, 6 aa, Staphylococcus
KGYREA

SEQ ID NO: 1956112 - protein, 11 aa, Staphylococcus
KGYRKLNGDQA

SEQ ID NO: 1956113 - protein, 7 aa, Staphylococcus
KGYRTIN

SEQ ID NO: 1956114 - protein, 5 aa, Staphylococcus
KGYSE

SEQ ID NO: 1956115 - protein, 8 aa, Staphylococcus
KGYSTDEI

SEQ ID NO: 1956116 - protein, 8 aa, Staphylococcus
KGYSTGGS

SEQ ID NO: 1956117 - protein, 6 aa, Staphylococcus
KGYTAK

SEQ ID NO: 1956118 - protein, 7 aa, Staphylococcus
KGYTKGK

SEQ ID NO: 1956119 - protein, 6 aa, Staphylococcus
KGYTLN

SEQ ID NO: 1956120 - protein, 6 aa, Staphylococcus
KGYTST

SEQ ID NO: 1956121 - protein, 5 aa, Staphylococcus
KGYTT

SEQ ID NO: 1956122 - protein, 7 aa, Staphylococcus
KGYTTGG

SEQ ID NO: 1956123 - protein, 6 aa, Staphylococcus
KGYTVD

SEQ ID NO: 1956124 - protein, 6 aa, Staphylococcus
KGYVEA

SEQ ID NO: 1956125 - protein, 20 aa, Staphylococcus
KGYVQSEMRKSDNGGPKRKY

SEQ ID NO: 1956126 - protein, 8 aa, Staphylococcus
KHADTNEV

SEQ ID NO: 1956127 - protein, 8 aa, Staphylococcus
KHAETGEI

SEQ ID NO: 1956128 - protein, 38 aa, Staphylococcus
KHAGEETKAAATKEAEATVAKAKAEADKIVNDGVEKAR

SEQ ID NO: 1956129 - protein, 11 aa, Staphylococcus
KHAKEAAKKVG

SEQ ID NO: 1956130 - protein, 7 aa, Staphylococcus
KHAKKAK

SEQ ID NO: 1956131 - protein, 8 aa, Staphylococcus
KHAKTKEV

SEQ ID NO: 1956132 - protein, 9 aa, Staphylococcus
KHASNQNKQ

SEQ ID NO: 1956133 - protein, 9 aa, Staphylococcus
KHASNTSKK

SEQ ID NO: 1956134 - protein, 7 aa, Staphylococcus
KHATKKE

SEQ ID NO: 1956135 - protein, 14 aa, Staphylococcus
KHATPQQKEKMNKE

SEQ ID NO: 1956136 - protein, 11 aa, Staphylococcus
KHATTKEDIPD

SEQ ID NO: 1956137 - protein, 11 aa, Staphylococcus
KHCSEKEKNEI

SEQ ID NO: 1956138 - protein, 5 aa, Staphylococcus
KHDDY

SEQ ID NO: 1956139 - protein, 8 aa, Staphylococcus
KHDEPASI

SEQ ID NO: 1956140 - protein, 12 aa, Staphylococcus
KHDEVKTSTKRR

SEQ ID NO: 1956141 - protein, 6 aa, Staphylococcus
KHDGAK

SEQ ID NO: 1956142 - protein, 6 aa, Staphylococcus
KHDGKS

SEQ ID NO: 1956143 - protein, 17 aa, Staphylococcus
KHDISEKDSDTIIDYLN

SEQ ID NO: 1956144 - protein, 6 aa, Staphylococcus
KHDKAG

SEQ ID NO: 1956145 - protein, 6 aa, Staphylococcus
KHDPLG

SEQ ID NO: 1956146 - protein, 16 aa, Staphylococcus
KHDPNDGAMEHNPYYP

SEQ ID NO: 1956147 - protein, 6 aa, Staphylococcus
KHDQTF

SEQ ID NO: 1956148 - protein, 6 aa, Staphylococcus
KHDSTN

SEQ ID NO: 1956149 - protein, 9 aa, Staphylococcus
KHDVATSDA

SEQ ID NO: 1956150 - protein, 4 aa, Staphylococcus
KHED

SEQ ID NO: 1956151 - protein, 5 aa, Staphylococcus
KHEDQ

SEQ ID NO: 1956152 - protein, 15 aa, Staphylococcus
KHEDTFYSGRGLNEA

SEQ ID NO: 1956153 - protein, 16 aa, Staphylococcus
KHEDTYYNGRGLNESA

SEQ ID NO: 1956154 - protein, 6 aa, Staphylococcus
KHEHEK

SEQ ID NO: 1956155 - protein, 7 aa, Staphylococcus
KHEKAER

SEQ ID NO: 1956156 - protein, 4 aa, Staphylococcus
KHEL

SEQ ID NO: 1956157 - protein, 5 aa, Staphylococcus
KHELN

SEQ ID NO: 1956158 - protein, 9 aa, Staphylococcus
KHELTDKQN

SEQ ID NO: 1956159 - protein, 7 aa, Staphylococcus
KHENNNL

SEQ ID NO: 1956160 - protein, 4 aa, Staphylococcus
KHEQ

SEQ ID NO: 1956161 - protein, 5 aa, Staphylococcus
KHEQY

SEQ ID NO: 1956162 - protein, 7 aa, Staphylococcus
KHERNRY

SEQ ID NO: 1956163 - protein, 7 aa, Staphylococcus
KHESAER

SEQ ID NO: 1956164 - protein, 20 aa, Staphylococcus
KHETRANTAKAKEILEELRQ

SEQ ID NO: 1956165 - protein, 15 aa, Staphylococcus
KHETTPRVKTNSNEF

SEQ ID NO: 1956166 - protein, 6 aa, Staphylococcus
KHEVAK

SEQ ID NO: 1956167 - protein, 18 aa, Staphylococcus
KHFANRKKAENLVQKKYN

SEQ ID NO: 1956168 - protein, 5 aa, Staphylococcus
KHFTK

SEQ ID NO: 1956169 - protein, 5 aa, Staphylococcus
KHGAK

SEQ ID NO: 1956170 - protein, 10 aa, Staphylococcus
KHGASKVKKQ

SEQ ID NO: 1956171 - protein, 5 aa, Staphylococcus
KHGDY

SEQ ID NO: 1956172 - protein, 10 aa, Staphylococcus
KHGESKIKSQ

SEQ ID NO: 1956173 - protein, 13 aa, Staphylococcus
KHGGTKSIANQES

SEQ ID NO: 1956174 - protein, 7 aa, Staphylococcus
KHGGYEI

SEQ ID NO: 1956175 - protein, 7 aa, Staphylococcus
KHGIGTH

SEQ ID NO: 1956176 - protein, 8 aa, Staphylococcus
KHGIGTHY

SEQ ID NO: 1956177 - protein, 7 aa, Staphylococcus
KHGKENS

SEQ ID NO: 1956178 - protein, 7 aa, Staphylococcus
KHGKGNM

SEQ ID NO: 1956179 - protein, 13 aa, Staphylococcus
KHGKTEKRAHNAE

SEQ ID NO: 1956180 - protein, 7 aa, Staphylococcus
KHGNENV

SEQ ID NO: 1956181 - protein, 9 aa, Staphylococcus
KHGNQGEEI

SEQ ID NO: 1956182 - protein, 13 aa, Staphylococcus
KHGNVKSESMPQA

SEQ ID NO: 1956183 - protein, 8 aa, Staphylococcus
KHGQIEPD

SEQ ID NO: 1956184 - protein, 6 aa, Staphylococcus
KHGRRY

SEQ ID NO: 1956185 - protein, 5 aa, Staphylococcus
KHGSF

SEQ ID NO: 1956186 - protein, 15 aa, Staphylococcus
KHGVTDNEDVKAEMD

SEQ ID NO: 1956187 - protein, 7 aa, Staphylococcus
KHGYGDA

SEQ ID NO: 1956188 - protein, 4 aa, Staphylococcus
KHHE

SEQ ID NO: 1956189 - protein, 8 aa, Staphylococcus
KHHPGTNS

SEQ ID NO: 1956190 - protein, 11 aa, Staphylococcus
KHHVEDNEDVK

SEQ ID NO: 1956191 - protein, 10 aa, Staphylococcus
KHHVSENEDV

SEQ ID NO: 1956192 - protein, 8 aa, Staphylococcus
KHIEPRSQ

SEQ ID NO: 1956193 - protein, 23 aa, Staphylococcus
KHIQTPGSEITDTRGGSHNAPTR

SEQ ID NO: 1956194 - protein, 23 aa, Staphylococcus
KHIQTPGSEITGLRGGSHNAPTR

SEQ ID NO: 1956195 - protein, 17 aa, Staphylococcus
KHITETDDAHYDQWSPS

SEQ ID NO: 1956196 - protein, 8 aa, Staphylococcus
KHKAGQPV

SEQ ID NO: 1956197 - protein, 8 aa, Staphylococcus
KHKDLSKQ

SEQ ID NO: 1956198 - protein, 8 aa, Staphylococcus
KHKDNGAQ

SEQ ID NO: 1956199 - protein, 6 aa, Staphylococcus
KHKEQA

SEQ ID NO: 1956200 - protein, 9 aa, Staphylococcus
KHKERYKDK

SEQ ID NO: 1956201 - protein, 6 aa, Staphylococcus
KHKGRD

SEQ ID NO: 1956202 - protein, 11 aa, Staphylococcus
KHKHKDTKALQ

SEQ ID NO: 1956203 - protein, 12 aa, Staphylococcus
KHKITWGPFKPE

SEQ ID NO: 1956204 - protein, 8 aa, Staphylococcus
KHKKSNIG

SEQ ID NO: 1956205 - protein, 8 aa, Staphylococcus
KHKKSNVG

SEQ ID NO: 1956206 - protein, 9 aa, Staphylococcus
KHKKTYPRS

SEQ ID NO: 1956207 - protein, 4 aa, Staphylococcus
KHKN

SEQ ID NO: 1956208 - protein, 10 aa, Staphylococcus
KHKNMDEEGY

SEQ ID NO: 1956209 - protein, 8 aa, Staphylococcus
KHKNNLKK

SEQ ID NO: 1956210 - protein, 13 aa, Staphylococcus
KHKNNNKISKKEM

SEQ ID NO: 1956211 - protein, 5 aa, Staphylococcus
KHKQY

SEQ ID NO: 1956212 - protein, 13 aa, Staphylococcus
KHKRRDTKAIQKA

SEQ ID NO: 1956213 - protein, 7 aa, Staphylococcus
KHKRSRN

SEQ ID NO: 1956214 - protein, 9 aa, Staphylococcus
KHKSDDEWR

SEQ ID NO: 1956215 - protein, 8 aa, Staphylococcus
KHKSKNVK

SEQ ID NO: 1956216 - protein, 6 aa, Staphylococcus
KHKSRD

SEQ ID NO: 1956217 - protein, 22 aa, Staphylococcus
KHLEDQYEAKSLKQNVKKQKWD

SEQ ID NO: 1956218 - protein, 16 aa, Staphylococcus
KHLEGPSPKFNGNKEE

SEQ ID NO: 1956219 - protein, 12 aa, Staphylococcus
KHLSDRQKAYIN

SEQ ID NO: 1956220 - protein, 15 aa, Staphylococcus
KHNAGKGAKYTKTRR

SEQ ID NO: 1956221 - protein, 13 aa, Staphylococcus
KHNDATTYNTILH

SEQ ID NO: 1956222 - protein, 6 aa, Staphylococcus
KHNEAP

SEQ ID NO: 1956223 - protein, 7 aa, Staphylococcus
KHNEEEI

SEQ ID NO: 1956224 - protein, 7 aa, Staphylococcus
KHNENEI

SEQ ID NO: 1956225 - protein, 5 aa, Staphylococcus
KHNGL

SEQ ID NO: 1956226 - protein, 7 aa, Staphylococcus
KHNHEEI

SEQ ID NO: 1956227 - protein, 5 aa, Staphylococcus
KHNHV

SEQ ID NO: 1956228 - protein, 8 aa, Staphylococcus
KHNKNNLT

SEQ ID NO: 1956229 - protein, 7 aa, Staphylococcus
KHNNDNL

SEQ ID NO: 1956230 - protein, 6 aa, Staphylococcus
KHNPVE

SEQ ID NO: 1956231 - protein, 19 aa, Staphylococcus
KHNREANKLVDSEKIQPFN

SEQ ID NO: 1956232 - protein, 16 aa, Staphylococcus
KHNSGKGAKYTKTRRP

SEQ ID NO: 1956233 - protein, 6 aa, Staphylococcus
KHPDGL

SEQ ID NO: 1956234 - protein, 6 aa, Staphylococcus
KHPDLA

SEQ ID NO: 1956235 - protein, 5 aa, Staphylococcus
KHPDY

SEQ ID NO: 1956236 - protein, 4 aa, Staphylococcus
KHPE

SEQ ID NO: 1956237 - protein, 8 aa, Staphylococcus
KHPEDEEK

SEQ ID NO: 1956238 - protein, 14 aa, Staphylococcus
KHPEYDGAYKGQVD

SEQ ID NO: 1956239 - protein, 6 aa, Staphylococcus
KHPFKY

SEQ ID NO: 1956240 - protein, 5 aa, Staphylococcus
KHPGD

SEQ ID NO: 1956241 - protein, 10 aa, Staphylococcus
KHPGKFPEEL

SEQ ID NO: 1956242 - protein, 5 aa, Staphylococcus
KHPHE

SEQ ID NO: 1956243 - protein, 13 aa, Staphylococcus
KHPKQGDLHDPNA

SEQ ID NO: 1956244 - protein, 15 aa, Staphylococcus
KHPKQGDLHNPTETE

SEQ ID NO: 1956245 - protein, 4 aa, Staphylococcus
KHPL

SEQ ID NO: 1956246 - protein, 9 aa, Staphylococcus
KHPNNPYKG

SEQ ID NO: 1956247 - protein, 12 aa, Staphylococcus
KHPPENWPKTAK

SEQ ID NO: 1956248 - protein, 4 aa, Staphylococcus
KHPQ

SEQ ID NO: 1956249 - protein, 10 aa, Staphylococcus
KHPRGATSYY

SEQ ID NO: 1956250 - protein, 4 aa, Staphylococcus
KHPS

SEQ ID NO: 1956251 - protein, 7 aa, Staphylococcus
KHQEEEL

SEQ ID NO: 1956252 - protein, 5 aa, Staphylococcus
KHQGR

SEQ ID NO: 1956253 - protein, 10 aa, Staphylococcus
KHQHQKEAHK

SEQ ID NO: 1956254 - protein, 20 aa, Staphylococcus
KHQKSDKKSDKKSDKKSDDK

SEQ ID NO: 1956255 - protein, 6 aa, Staphylococcus
KHQNEI

SEQ ID NO: 1956256 - protein, 7 aa, Staphylococcus
KHQPARS

SEQ ID NO: 1956257 - protein, 6 aa, Staphylococcus
KHQPDF

SEQ ID NO: 1956258 - protein, 6 aa, Staphylococcus
KHQPNR

SEQ ID NO: 1956259 - protein, 10 aa, Staphylococcus
KHQPSNSSDY

SEQ ID NO: 1956260 - protein, 4 aa, Staphylococcus
KHRD

SEQ ID NO: 1956261 - protein, 8 aa, Staphylococcus
KHRDPFQS

SEQ ID NO: 1956262 - protein, 5 aa, Staphylococcus
KHRGA

SEQ ID NO: 1956263 - protein, 8 aa, Staphylococcus
KHRGERLK

SEQ ID NO: 1956264 - protein, 16 aa, Staphylococcus
KHRKGDDCLFCLEVLS

SEQ ID NO: 1956265 - protein, 8 aa, Staphylococcus
KHRKYPRD

SEQ ID NO: 1956266 - protein, 10 aa, Staphylococcus
KHRPKSAESI

SEQ ID NO: 1956267 - protein, 16 aa, Staphylococcus
KHRQGEDCLLCLNVLS

SEQ ID NO: 1956268 - protein, 16 aa, Staphylococcus
KHRQGEDCLLCMAVLN

SEQ ID NO: 1956269 - protein, 7 aa, Staphylococcus
KHSDEEL

SEQ ID NO: 1956270 - protein, 10 aa, Staphylococcus
KHSDKDRAEN

SEQ ID NO: 1956271 - protein, 19 aa, Staphylococcus
KHSDQKYKHDNLTSTECPN

SEQ ID NO: 1956272 - protein, 4 aa, Staphylococcus
KHSE

SEQ ID NO: 1956273 - protein, 6 aa, Staphylococcus
KHSEEM

SEQ ID NO: 1956274 - protein, 7 aa, Staphylococcus
KHSESKL

SEQ ID NO: 1956275 - protein, 4 aa, Staphylococcus
KHSF

SEQ ID NO: 1956276 - protein, 11 aa, Staphylococcus
KHSIQNGHSFT

SEQ ID NO: 1956277 - protein, 6 aa, Staphylococcus
KHSKGY

SEQ ID NO: 1956278 - protein, 10 aa, Staphylococcus
KHSKKDIDKK

SEQ ID NO: 1956279 - protein, 10 aa, Staphylococcus
KHSNTEKDIA

SEQ ID NO: 1956280 - protein, 7 aa, Staphylococcus
KHTANGV

SEQ ID NO: 1956281 - protein, 7 aa, Staphylococcus
KHTEDGI

SEQ ID NO: 1956282 - protein, 4 aa, Staphylococcus
KHTG

SEQ ID NO: 1956283 - protein, 7 aa, Staphylococcus
KHTKDGS

SEQ ID NO: 1956284 - protein, 8 aa, Staphylococcus
KHTKPDID

SEQ ID NO: 1956285 - protein, 6 aa, Staphylococcus
KHTNTK

SEQ ID NO: 1956286 - protein, 6 aa, Staphylococcus
KHTPLN

SEQ ID NO: 1956287 - protein, 8 aa, Staphylococcus
KHTSNGIT

SEQ ID NO: 1956288 - protein, 7 aa, Staphylococcus
KHTSQQE

SEQ ID NO: 1956289 - protein, 27 aa, Staphylococcus
KHTTYEAYEEAKAKGETYRLEHADTYI

SEQ ID NO: 1956290 - protein, 32 aa, Staphylococcus
KHVDEDDKKILTSRNTTLENLPNRGLTAVNES

SEQ ID NO: 1956291 - protein, 12 aa, Staphylococcus
KHVEKQKNKYKI

SEQ ID NO: 1956292 - protein, 9 aa, Staphylococcus
KHVGDPLDY

SEQ ID NO: 1956293 - protein, 5 aa, Staphylococcus
KHVSS

SEQ ID NO: 1956294 - protein, 8 aa, Staphylococcus
KHVSSQAT

SEQ ID NO: 1956295 - protein, 19 aa, Staphylococcus
KHYDGKNKAFRPKNAEGLT

SEQ ID NO: 1956296 - protein, 6 aa, Staphylococcus
KHYDNG

SEQ ID NO: 1956297 - protein, 11 aa, Staphylococcus
KHYGEHEGKPF

SEQ ID NO: 1956298 - protein, 6 aa, Staphylococcus
KHYNNG

SEQ ID NO: 1956299 - protein, 10 aa, Staphylococcus
KHYNNKPQHQ

SEQ ID NO: 1956300 - protein, 11 aa, Staphylococcus
KHYSEHEGKPF

SEQ ID NO: 1956301 - protein, 6 aa, Staphylococcus
KHYSNG

SEQ ID NO: 1956302 - protein, 7 aa, Staphylococcus
KIAAPKK

SEQ ID NO: 1956303 - protein, 12 aa, Staphylococcus
KIADEVGKSPAQ

SEQ ID NO: 1956304 - protein, 12 aa, Staphylococcus
KIADQLSDTTFK

SEQ ID NO: 1956305 - protein, 13 aa, Staphylococcus
KIADTKAKVEKLD

SEQ ID NO: 1956306 - protein, 5 aa, Staphylococcus
KIAEG

SEQ ID NO: 1956307 - protein, 34 aa, Staphylococcus
KIAEKYDVTREAQDAFANESQLKAHQATQAKKFE

SEQ ID NO: 1956308 - protein, 5 aa, Staphylococcus
KIAGE

SEQ ID NO: 1956309 - protein, 7 aa, Staphylococcus
KIAGEEN

SEQ ID NO: 1956310 - protein, 7 aa, Staphylococcus
KIAGEQE

SEQ ID NO: 1956311 - protein, 7 aa, Staphylococcus
KIAGEQQ

SEQ ID NO: 1956312 - protein, 10 aa, Staphylococcus
KIAKDDIKDY

SEQ ID NO: 1956313 - protein, 16 aa, Staphylococcus
KIANEKVSAPEALDEV

SEQ ID NO: 1956314 - protein, 15 aa, Staphylococcus
KIANEKVSAPEALNE

SEQ ID NO: 1956315 - protein, 6 aa, Staphylococcus
KIANKE

SEQ ID NO: 1956316 - protein, 7 aa, Staphylococcus
KIAPDTL

SEQ ID NO: 1956317 - protein, 5 aa, Staphylococcus
KIATR

SEQ ID NO: 1956318 - protein, 17 aa, Staphylococcus
KIAYDSQKLTDEPRAGQ

SEQ ID NO: 1956319 - protein, 7 aa, Staphylococcus
KIDAGYQ

SEQ ID NO: 1956320 - protein, 8 aa, Staphylococcus
KIDANEER

SEQ ID NO: 1956321 - protein, 143 aa, Staphylococcus
KIDANTESLKTIQTSQEAIQSSQEKQAKEIEKANTQSSETVSSLSSSENKEKVISESASSTKSESASTSDSLSTSQSESSNSLNGSASNSQSPSTTVSTSEQPESTNSESTINSNSTTSSHSPNEMNTQPREEKKGFFARLFN

SEQ ID NO: 1956322 - protein, 6 aa, Staphylococcus
KIDAQA

SEQ ID NO: 1956323 - protein, 21 aa, Staphylococcus
KIDDSVRRDPIHRQSPGFDEL

SEQ ID NO: 1956324 - protein, 13 aa, Staphylococcus
KIDEAKKEGDSIG

SEQ ID NO: 1956325 - protein, 6 aa, Staphylococcus
KIDEDG

SEQ ID NO: 1956326 - protein, 12 aa, Staphylococcus
KIDEEALEAAPN

SEQ ID NO: 1956327 - protein, 18 aa, Staphylococcus
KIDEESVTYTQDGETYTI

SEQ ID NO: 1956328 - protein, 9 aa, Staphylococcus
KIDEGSDVN

SEQ ID NO: 1956329 - protein, 17 aa, Staphylococcus
KIDETRVYRPTGEHDSY

SEQ ID NO: 1956330 - protein, 7 aa, Staphylococcus
KIDGITD

SEQ ID NO: 1956331 - protein, 6 aa, Staphylococcus
KIDGVE

SEQ ID NO: 1956332 - protein, 8 aa, Staphylococcus
KIDHDESR

SEQ ID NO: 1956333 - protein, 9 aa, Staphylococcus
KIDHDGKEF

SEQ ID NO: 1956334 - protein, 18 aa, Staphylococcus
KIDKSDKFESLNPADTSQ

SEQ ID NO: 1956335 - protein, 15 aa, Staphylococcus
KIDNKNDDFKPKKGD

SEQ ID NO: 1956336 - protein, 7 aa, Staphylococcus
KIDNYDD

SEQ ID NO: 1956337 - protein, 5 aa, Staphylococcus
KIDPE

SEQ ID NO: 1956338 - protein, 14 aa, Staphylococcus
KIDPENVEAAAKLK

SEQ ID NO: 1956339 - protein, 5 aa, Staphylococcus
KIDPR

SEQ ID NO: 1956340 - protein, 13 aa, Staphylococcus
KIDQAKKEGDSIG

SEQ ID NO: 1956341 - protein, 6 aa, Staphylococcus
KIDQMS

SEQ ID NO: 1956342 - protein, 12 aa, Staphylococcus
KIDQPETSSDWL

SEQ ID NO: 1956343 - protein, 11 aa, Staphylococcus
KIDQPRTESDW

SEQ ID NO: 1956344 - protein, 8 aa, Staphylococcus
KIDREKYG

SEQ ID NO: 1956345 - protein, 14 aa, Staphylococcus
KIDRNAKKVETDKG

SEQ ID NO: 1956346 - protein, 14 aa, Staphylococcus
KIDRNAKKVETNHG

SEQ ID NO: 1956347 - protein, 15 aa, Staphylococcus
KIDRNAKRVETDKGV

SEQ ID NO: 1956348 - protein, 5 aa, Staphylococcus
KIDSP

SEQ ID NO: 1956349 - protein, 9 aa, Staphylococcus
KIDSTNLDK

SEQ ID NO: 1956350 - protein, 11 aa, Staphylococcus
KIDVEKEQKLV

SEQ ID NO: 1956351 - protein, 5 aa, Staphylococcus
KIEAG

SEQ ID NO: 1956352 - protein, 6 aa, Staphylococcus
KIEAGN

SEQ ID NO: 1956353 - protein, 7 aa, Staphylococcus
KIEAGNP

SEQ ID NO: 1956354 - protein, 8 aa, Staphylococcus
KIEAGNPF

SEQ ID NO: 1956355 - protein, 7 aa, Staphylococcus
KIEDSGM

SEQ ID NO: 1956356 - protein, 4 aa, Staphylococcus
KIEE

SEQ ID NO: 1956357 - protein, 7 aa, Staphylococcus
KIEENNK

SEQ ID NO: 1956358 - protein, 7 aa, Staphylococcus
KIEEPQT

SEQ ID NO: 1956359 - protein, 5 aa, Staphylococcus
KIEEQ

SEQ ID NO: 1956360 - protein, 4 aa, Staphylococcus
KIEG

SEQ ID NO: 1956361 - protein, 6 aa, Staphylococcus
KIEGNG

SEQ ID NO: 1956362 - protein, 14 aa, Staphylococcus
KIEGSQHINRDEGV

SEQ ID NO: 1956363 - protein, 5 aa, Staphylococcus
KIEID

SEQ ID NO: 1956364 - protein, 4 aa, Staphylococcus
KIEM

SEQ ID NO: 1956365 - protein, 13 aa, Staphylococcus
KIENGTYQNTTTK

SEQ ID NO: 1956366 - protein, 6 aa, Staphylococcus
KIENLK

SEQ ID NO: 1956367 - protein, 6 aa, Staphylococcus
KIEPNP

SEQ ID NO: 1956368 - protein, 6 aa, Staphylococcus
KIEQHQ

SEQ ID NO: 1956369 - protein, 6 aa, Staphylococcus
KIEQSK

SEQ ID NO: 1956370 - protein, 6 aa, Staphylococcus
KIEQTK

SEQ ID NO: 1956371 - protein, 8 aa, Staphylococcus
KIERQQDE

SEQ ID NO: 1956372 - protein, 7 aa, Staphylococcus
KIESETQ

SEQ ID NO: 1956373 - protein, 13 aa, Staphylococcus
KIESKQDYLETNG

SEQ ID NO: 1956374 - protein, 6 aa, Staphylococcus
KIESRL

SEQ ID NO: 1956375 - protein, 7 aa, Staphylococcus
KIESYDD

SEQ ID NO: 1956376 - protein, 12 aa, Staphylococcus
KIETDGKLLTGR

SEQ ID NO: 1956377 - protein, 5 aa, Staphylococcus
KIETE

SEQ ID NO: 1956378 - protein, 12 aa, Staphylococcus
KIETPNIKTAQE

SEQ ID NO: 1956379 - protein, 12 aa, Staphylococcus
KIETPNVKTAQE

SEQ ID NO: 1956380 - protein, 9 aa, Staphylococcus
KIGDGDHGV

SEQ ID NO: 1956381 - protein, 5 aa, Staphylococcus
KIGEA

SEQ ID NO: 1956382 - protein, 5 aa, Staphylococcus
KIGEE

SEQ ID NO: 1956383 - protein, 11 aa, Staphylococcus
KIGEENLNIPT

SEQ ID NO: 1956384 - protein, 5 aa, Staphylococcus
KIGES

SEQ ID NO: 1956385 - protein, 7 aa, Staphylococcus
KIGGDDD

SEQ ID NO: 1956386 - protein, 7 aa, Staphylococcus
KIGGEND

SEQ ID NO: 1956387 - protein, 27 aa, Staphylococcus
KIGGKSNSGEGGENPKRYEIQEDGTVL

SEQ ID NO: 1956388 - protein, 8 aa, Staphylococcus
KIGGRRNG

SEQ ID NO: 1956389 - protein, 12 aa, Staphylococcus
KIGHTGTLDPEV

SEQ ID NO: 1956390 - protein, 13 aa, Staphylococcus
KIGHTGTLDPEVS

SEQ ID NO: 1956391 - protein, 6 aa, Staphylococcus
KIGKKT

SEQ ID NO: 1956392 - protein, 16 aa, Staphylococcus
KIGNAGRTVLQGTPEN

SEQ ID NO: 1956393 - protein, 6 aa, Staphylococcus
KIGNKT

SEQ ID NO: 1956394 - protein, 7 aa, Staphylococcus
KIGTNKL

SEQ ID NO: 1956395 - protein, 14 aa, Staphylococcus
KIGVPGEEELGGRG

SEQ ID NO: 1956396 - protein, 14 aa, Staphylococcus
KIGVPGEQELGGRG

SEQ ID NO: 1956397 - protein, 12 aa, Staphylococcus
KIGYESEEAKDF

SEQ ID NO: 1956398 - protein, 7 aa, Staphylococcus
KIHASSH

SEQ ID NO: 1956399 - protein, 4 aa, Staphylococcus
KIHD

SEQ ID NO: 1956400 - protein, 4 aa, Staphylococcus
KIIE

SEQ ID NO: 1956401 - protein, 19 aa, Staphylococcus
KIKAEKAKQQDNNESNVDK

SEQ ID NO: 1956402 - protein, 5 aa, Staphylococcus
KIKDA

SEQ ID NO: 1956403 - protein, 23 aa, Staphylococcus
KIKDDNGKLTEPTKKTIKNGSYA

SEQ ID NO: 1956404 - protein, 7 aa, Staphylococcus
KIKDLQS

SEQ ID NO: 1956405 - protein, 7 aa, Staphylococcus
KIKDSAQ

SEQ ID NO: 1956406 - protein, 10 aa, Staphylococcus
KIKDTTHKAV

SEQ ID NO: 1956407 - protein, 25 aa, Staphylococcus
KIKDTTNRPVDTSRPVLPTPSYRSI

SEQ ID NO: 1956408 - protein, 23 aa, Staphylococcus
KIKEANEGMEEALDDAKKHYDKY

SEQ ID NO: 1956409 - protein, 12 aa, Staphylococcus
KIKEAVDAGAEA

SEQ ID NO: 1956410 - protein, 10 aa, Staphylococcus
KIKEEDENLN

SEQ ID NO: 1956411 - protein, 6 aa, Staphylococcus
KIKEEN

SEQ ID NO: 1956412 - protein, 9 aa, Staphylococcus
KIKENREEL

SEQ ID NO: 1956413 - protein, 10 aa, Staphylococcus
KIKEQNTKID

SEQ ID NO: 1956414 - protein, 5 aa, Staphylococcus
KIKGK

SEQ ID NO: 1956415 - protein, 8 aa, Staphylococcus
KIKGQLKT

SEQ ID NO: 1956416 - protein, 10 aa, Staphylococcus
KIKGSQHEAQ

SEQ ID NO: 1956417 - protein, 7 aa, Staphylococcus
KIKGTPY

SEQ ID NO: 1956418 - protein, 10 aa, Staphylococcus
KIKKEGQKAV

SEQ ID NO: 1956419 - protein, 20 aa, Staphylococcus
KIKKYKKQINNYSERKHKYE

SEQ ID NO: 1956420 - protein, 8 aa, Staphylococcus
KIKNDNEF

SEQ ID NO: 1956421 - protein, 10 aa, Staphylococcus
KIKNEGQPAV

SEQ ID NO: 1956422 - protein, 16 aa, Staphylococcus
KIKNEQVNAPTALSDV

SEQ ID NO: 1956423 - protein, 16 aa, Staphylococcus
KIKNESVNAAQALTDV

SEQ ID NO: 1956424 - protein, 6 aa, Staphylococcus
KIKNKT

SEQ ID NO: 1956425 - protein, 10 aa, Staphylococcus
KIKNRKDSLR

SEQ ID NO: 1956426 - protein, 14 aa, Staphylococcus
KIKNSTKQKCLNNL

SEQ ID NO: 1956427 - protein, 32 aa, Staphylococcus
KIKPGDANTAVSYQKGNLTRNPGRIDPNNPAF

SEQ ID NO: 1956428 - protein, 6 aa, Staphylococcus
KIKPSK

SEQ ID NO: 1956429 - protein, 10 aa, Staphylococcus
KIKQEGQPAV

SEQ ID NO: 1956430 - protein, 14 aa, Staphylococcus
KIKQGIQKRIDNGT

SEQ ID NO: 1956431 - protein, 8 aa, Staphylococcus
KIKQNTED

SEQ ID NO: 1956432 - protein, 8 aa, Staphylococcus
KIKQNTSL

SEQ ID NO: 1956433 - protein, 12 aa, Staphylococcus
KIKQQKGLQPNM

SEQ ID NO: 1956434 - protein, 5 aa, Staphylococcus
KIKQT

SEQ ID NO: 1956435 - protein, 16 aa, Staphylococcus
KIKRGNKKKVKPGYKK

SEQ ID NO: 1956436 - protein, 4 aa, Staphylococcus
KIKS

SEQ ID NO: 1956437 - protein, 41 aa, Staphylococcus
KIKSDGAKQASDSFDKKEDAMKRARNIADNRRTEIIEHKKD

SEQ ID NO: 1956438 - protein, 8 aa, Staphylococcus
KIKSGSQI

SEQ ID NO: 1956439 - protein, 13 aa, Staphylococcus
KIKSKLEESGILD

SEQ ID NO: 1956440 - protein, 9 aa, Staphylococcus
KIKTESNEK

SEQ ID NO: 1956441 - protein, 8 aa, Staphylococcus
KIKTKVSI

SEQ ID NO: 1956442 - protein, 8 aa, Staphylococcus
KIKTPLKE

SEQ ID NO: 1956443 - protein, 10 aa, Staphylococcus
KIKTQTTVAK

SEQ ID NO: 1956444 - protein, 7 aa, Staphylococcus
KIKTTLK

SEQ ID NO: 1956445 - protein, 11 aa, Staphylococcus
KIKYNTPKKVV

SEQ ID NO: 1956446 - protein, 5 aa, Staphylococcus
KILGS

SEQ ID NO: 1956447 - protein, 7 aa, Staphylococcus
KIMPNGG

SEQ ID NO: 1956448 - protein, 8 aa, Staphylococcus
KIMPNGGS

SEQ ID NO: 1956449 - protein, 7 aa, Staphylococcus
KINASDL

SEQ ID NO: 1956450 - protein, 11 aa, Staphylococcus
KINDIKGNSDM

SEQ ID NO: 1956451 - protein, 6 aa, Staphylococcus
KINDTP

SEQ ID NO: 1956452 - protein, 5 aa, Staphylococcus
KINEA

SEQ ID NO: 1956453 - protein, 13 aa, Staphylococcus
KINEAVEKNAEAM

SEQ ID NO: 1956454 - protein, 7 aa, Staphylococcus
KINESAN

SEQ ID NO: 1956455 - protein, 9 aa, Staphylococcus
KINESANSK

SEQ ID NO: 1956456 - protein, 11 aa, Staphylococcus
KINFDPKEGDE

SEQ ID NO: 1956457 - protein, 11 aa, Staphylococcus
KINGDNTKPYL

SEQ ID NO: 1956458 - protein, 11 aa, Staphylococcus
KINKTRASEAA

SEQ ID NO: 1956459 - protein, 17 aa, Staphylococcus
KINNDEAKLTDKVHTGD

SEQ ID NO: 1956460 - protein, 8 aa, Staphylococcus
KINNDGRG

SEQ ID NO: 1956461 - protein, 8 aa, Staphylococcus
KINNDSRG

SEQ ID NO: 1956462 - protein, 20 aa, Staphylococcus
KINNENYKSQLNERSNGELE

SEQ ID NO: 1956463 - protein, 10 aa, Staphylococcus
KINNESIEIN

SEQ ID NO: 1956464 - protein, 7 aa, Staphylococcus
KINNLKK

SEQ ID NO: 1956465 - protein, 7 aa, Staphylococcus
KINNNNK

SEQ ID NO: 1956466 - protein, 7 aa, Staphylococcus
KINQNDD

SEQ ID NO: 1956467 - protein, 5 aa, Staphylococcus
KINQS

SEQ ID NO: 1956468 - protein, 7 aa, Staphylococcus
KINRQGA

SEQ ID NO: 1956469 - protein, 5 aa, Staphylococcus
KINRS

SEQ ID NO: 1956470 - protein, 10 aa, Staphylococcus
KINSEAPKFY

SEQ ID NO: 1956471 - protein, 6 aa, Staphylococcus
KINSKT

SEQ ID NO: 1956472 - protein, 10 aa, Staphylococcus
KINSPQNSAP

SEQ ID NO: 1956473 - protein, 7 aa, Staphylococcus
KINSTDP

SEQ ID NO: 1956474 - protein, 16 aa, Staphylococcus
KIPDGSTKIDDTEKHW

SEQ ID NO: 1956475 - protein, 6 aa, Staphylococcus
KIPELE

SEQ ID NO: 1956476 - protein, 13 aa, Staphylococcus
KIPGSRRRKGNIE

SEQ ID NO: 1956477 - protein, 6 aa, Staphylococcus
KIPGYR

SEQ ID NO: 1956478 - protein, 6 aa, Staphylococcus
KIPNIS

SEQ ID NO: 1956479 - protein, 4 aa, Staphylococcus
KIPR

SEQ ID NO: 1956480 - protein, 13 aa, Staphylococcus
KIPRENAAQYGRN

SEQ ID NO: 1956481 - protein, 10 aa, Staphylococcus
KIPRSEMDNE

SEQ ID NO: 1956482 - protein, 6 aa, Staphylococcus
KIPSEL

SEQ ID NO: 1956483 - protein, 4 aa, Staphylococcus
KIPT

SEQ ID NO: 1956484 - protein, 8 aa, Staphylococcus
KIPTPNNT

SEQ ID NO: 1956485 - protein, 5 aa, Staphylococcus
KIPYE

SEQ ID NO: 1956486 - protein, 5 aa, Staphylococcus
KIQEA

SEQ ID NO: 1956487 - protein, 8 aa, Staphylococcus
KIQETKQQ

SEQ ID NO: 1956488 - protein, 21 aa, Staphylococcus
KIQGASDSPLTDRGIEQAQAA

SEQ ID NO: 1956489 - protein, 11 aa, Staphylococcus
KIQGTKHETQF

SEQ ID NO: 1956490 - protein, 4 aa, Staphylococcus
KIQH

SEQ ID NO: 1956491 - protein, 10 aa, Staphylococcus
KIQKSTDEGH

SEQ ID NO: 1956492 - protein, 5 aa, Staphylococcus
KIQPF

SEQ ID NO: 1956493 - protein, 4 aa, Staphylococcus
KIQS

SEQ ID NO: 1956494 - protein, 6 aa, Staphylococcus
KIQSLY

SEQ ID NO: 1956495 - protein, 7 aa, Staphylococcus
KIQSTTV

SEQ ID NO: 1956496 - protein, 16 aa, Staphylococcus
KIRDKKEKIILSMLAR

SEQ ID NO: 1956497 - protein, 7 aa, Staphylococcus
KIREISS

SEQ ID NO: 1956498 - protein, 11 aa, Staphylococcus
KIRGKGKVTEA

SEQ ID NO: 1956499 - protein, 12 aa, Staphylococcus
KIRGKGKVTEAD

SEQ ID NO: 1956500 - protein, 13 aa, Staphylococcus
KIRNDKVNAATAL

SEQ ID NO: 1956501 - protein, 12 aa, Staphylococcus
KIRPDGRKPDEI

SEQ ID NO: 1956502 - protein, 16 aa, Staphylococcus
KIRPDGRKTDEIRPLE

SEQ ID NO: 1956503 - protein, 15 aa, Staphylococcus
KIRPDGRKVDEIRPL

SEQ ID NO: 1956504 - protein, 6 aa, Staphylococcus
KIRVGS

SEQ ID NO: 1956505 - protein, 13 aa, Staphylococcus
KISATKSTSRAIN

SEQ ID NO: 1956506 - protein, 13 aa, Staphylococcus
KISDIQKGDYKGH

SEQ ID NO: 1956507 - protein, 14 aa, Staphylococcus
KISDIQQGTYTGEL

SEQ ID NO: 1956508 - protein, 6 aa, Staphylococcus
KISDQE

SEQ ID NO: 1956509 - protein, 7 aa, Staphylococcus
KISEEGV

SEQ ID NO: 1956510 - protein, 8 aa, Staphylococcus
KISEKQKV

SEQ ID NO: 1956511 - protein, 13 aa, Staphylococcus
KISETTVTYKKDG

SEQ ID NO: 1956512 - protein, 12 aa, Staphylococcus
KISEVANNVQST

SEQ ID NO: 1956513 - protein, 14 aa, Staphylococcus
KISGGDVGGSANYE

SEQ ID NO: 1956514 - protein, 12 aa, Staphylococcus
KISGGDVGGSKN

SEQ ID NO: 1956515 - protein, 6 aa, Staphylococcus
KISGKI

SEQ ID NO: 1956516 - protein, 14 aa, Staphylococcus
KISGKKYQEDADQD

SEQ ID NO: 1956517 - protein, 7 aa, Staphylococcus
KISGNGH

SEQ ID NO: 1956518 - protein, 6 aa, Staphylococcus
KISGTY

SEQ ID NO: 1956519 - protein, 6 aa, Staphylococcus
KISHND

SEQ ID NO: 1956520 - protein, 13 aa, Staphylococcus
KISHTARKHSEDM

SEQ ID NO: 1956521 - protein, 21 aa, Staphylococcus
KISKKERLSKDDYRKQNSDLK

SEQ ID NO: 1956522 - protein, 13 aa, Staphylococcus
KISKSNKKHEVNV

SEQ ID NO: 1956523 - protein, 19 aa, Staphylococcus
KISQTTNSRHSENANEAEK

SEQ ID NO: 1956524 - protein, 5 aa, Staphylococcus
KISSD

SEQ ID NO: 1956525 - protein, 11 aa, Staphylococcus
KISSDDFPEIE

SEQ ID NO: 1956526 - protein, 6 aa, Staphylococcus
KISSKD

SEQ ID NO: 1956527 - protein, 17 aa, Staphylococcus
KISSKISSSSRNALNNT

SEQ ID NO: 1956528 - protein, 7 aa, Staphylococcus
KISTQQS

SEQ ID NO: 1956529 - protein, 5 aa, Staphylococcus
KISTV

SEQ ID NO: 1956530 - protein, 10 aa, Staphylococcus
KITAETGQSQ

SEQ ID NO: 1956531 - protein, 5 aa, Staphylococcus
KITCN

SEQ ID NO: 1956532 - protein, 18 aa, Staphylococcus
KITDEQAALSEAEDDIEA

SEQ ID NO: 1956533 - protein, 11 aa, Staphylococcus
KITDEQAEALK

SEQ ID NO: 1956534 - protein, 8 aa, Staphylococcus
KITDKQRK

SEQ ID NO: 1956535 - protein, 6 aa, Staphylococcus
KITDYQ

SEQ ID NO: 1956536 - protein, 4 aa, Staphylococcus
KITE

SEQ ID NO: 1956537 - protein, 9 aa, Staphylococcus
KITEDYKDR

SEQ ID NO: 1956538 - protein, 6 aa, Staphylococcus
KITEES

SEQ ID NO: 1956539 - protein, 11 aa, Staphylococcus
KITEETGQSEL

SEQ ID NO: 1956540 - protein, 9 aa, Staphylococcus
KITEETSET

SEQ ID NO: 1956541 - protein, 8 aa, Staphylococcus
KITEGKEV

SEQ ID NO: 1956542 - protein, 7 aa, Staphylococcus
KITEGLK

SEQ ID NO: 1956543 - protein, 13 aa, Staphylococcus
KITEIKSGDYHGN

SEQ ID NO: 1956544 - protein, 7 aa, Staphylococcus
KITENPN

SEQ ID NO: 1956545 - protein, 4 aa, Staphylococcus
KITG

SEQ ID NO: 1956546 - protein, 7 aa, Staphylococcus
KITGKGF

SEQ ID NO: 1956547 - protein, 13 aa, Staphylococcus
KITKMPTVFQKIL

SEQ ID NO: 1956548 - protein, 6 aa, Staphylococcus
KITNEK

SEQ ID NO: 1956549 - protein, 6 aa, Staphylococcus
KITPDA

SEQ ID NO: 1956550 - protein, 8 aa, Staphylococcus
KITPYSET

SEQ ID NO: 1956551 - protein, 5 aa, Staphylococcus
KITQS

SEQ ID NO: 1956552 - protein, 21 aa, Staphylococcus
KITRDKKGEPRTRQGDGWPEP

SEQ ID NO: 1956553 - protein, 6 aa, Staphylococcus
KITRNA

SEQ ID NO: 1956554 - protein, 9 aa, Staphylococcus
KITSPQDAA

SEQ ID NO: 1956555 - protein, 17 aa, Staphylococcus
KITSTTAAIAPLGSGER

SEQ ID NO: 1956556 - protein, 13 aa, Staphylococcus
KITSTTSLNSDKN

SEQ ID NO: 1956557 - protein, 6 aa, Staphylococcus
KITTFD

SEQ ID NO: 1956558 - protein, 6 aa, Staphylococcus
KIVKED

SEQ ID NO: 1956559 - protein, 14 aa, Staphylococcus
KIVPDEKVRTKKRA

SEQ ID NO: 1956560 - protein, 18 aa, Staphylococcus
KIVPEEKVRTKKRALKAL

SEQ ID NO: 1956561 - protein, 18 aa, Staphylococcus
KIVPEEKVRTKKRAYKSL

SEQ ID NO: 1956562 - protein, 14 aa, Staphylococcus
KIVPGNTDLKKYTS

SEQ ID NO: 1956563 - protein, 12 aa, Staphylococcus
KIVTSNADEFKT

SEQ ID NO: 1956564 - protein, 9 aa, Staphylococcus
KIVTSNDDE

SEQ ID NO: 1956565 - protein, 15 aa, Staphylococcus
KIYAGENVGRGGDDT

SEQ ID NO: 1956566 - protein, 7 aa, Staphylococcus
KIYKPQP

SEQ ID NO: 1956567 - protein, 12 aa, Staphylococcus
KKAADELGATTH

SEQ ID NO: 1956568 - protein, 7 aa, Staphylococcus
KKAAELA

SEQ ID NO: 1956569 - protein, 8 aa, Staphylococcus
KKAANGNK

SEQ ID NO: 1956570 - protein, 8 aa, Staphylococcus
KKAAPDAK

SEQ ID NO: 1956571 - protein, 13 aa, Staphylococcus
KKADEGSEKPRHV

SEQ ID NO: 1956572 - protein, 9 aa, Staphylococcus
KKADEPAGE

SEQ ID NO: 1956573 - protein, 22 aa, Staphylococcus
KKADLDDVKGVEECEAQPPSED

SEQ ID NO: 1956574 - protein, 7 aa, Staphylococcus
KKADPSL

SEQ ID NO: 1956575 - protein, 10 aa, Staphylococcus
KKADPSLKYA

SEQ ID NO: 1956576 - protein, 9 aa, Staphylococcus
KKADPTMTY

SEQ ID NO: 1956577 - protein, 9 aa, Staphylococcus
KKADQAEIE

SEQ ID NO: 1956578 - protein, 5 aa, Staphylococcus
KKAED

SEQ ID NO: 1956579 - protein, 17 aa, Staphylococcus
KKAEERRKLEQAKGPDL

SEQ ID NO: 1956580 - protein, 8 aa, Staphylococcus
KKAEGYSE

SEQ ID NO: 1956581 - protein, 9 aa, Staphylococcus
KKAEGYSEN

SEQ ID NO: 1956582 - protein, 31 aa, Staphylococcus
KKAEKQRKTKQNNNQRNFKNYGQQVASKEIT

SEQ ID NO: 1956583 - protein, 9 aa, Staphylococcus
KKAELANDI

SEQ ID NO: 1956584 - protein, 8 aa, Staphylococcus
KKAEMERV

SEQ ID NO: 1956585 - protein, 6 aa, Staphylococcus
KKAEPQ

SEQ ID NO: 1956586 - protein, 7 aa, Staphylococcus
KKAEQYS

SEQ ID NO: 1956587 - protein, 10 aa, Staphylococcus
KKAETTGNQM

SEQ ID NO: 1956588 - protein, 8 aa, Staphylococcus
KKAEVGSK

SEQ ID NO: 1956589 - protein, 8 aa, Staphylococcus
KKAEVGST

SEQ ID NO: 1956590 - protein, 5 aa, Staphylococcus
KKAGA

SEQ ID NO: 1956591 - protein, 25 aa, Staphylococcus
KKAGGIPLSEPHANTRYEDTPGNQT

SEQ ID NO: 1956592 - protein, 9 aa, Staphylococcus
KKAGIPDEA

SEQ ID NO: 1956593 - protein, 13 aa, Staphylococcus
KKAGIYDELLTVD

SEQ ID NO: 1956594 - protein, 12 aa, Staphylococcus
KKAGIYEELLTV

SEQ ID NO: 1956595 - protein, 9 aa, Staphylococcus
KKAGLAEDI

SEQ ID NO: 1956596 - protein, 7 aa, Staphylococcus
KKAGQGM

SEQ ID NO: 1956597 - protein, 6 aa, Staphylococcus
KKAGVN

SEQ ID NO: 1956598 - protein, 8 aa, Staphylococcus
KKAGVSKG

SEQ ID NO: 1956599 - protein, 6 aa, Staphylococcus
KKAHQA

SEQ ID NO: 1956600 - protein, 7 aa, Staphylococcus
KKAIKDG

SEQ ID NO: 1956601 - protein, 6 aa, Staphylococcus
KKAIQN

SEQ ID NO: 1956602 - protein, 6 aa, Staphylococcus
KKAIQQ

SEQ ID NO: 1956603 - protein, 7 aa, Staphylococcus
KKAIQQG

SEQ ID NO: 1956604 - protein, 9 aa, Staphylococcus
KKAKDDVNK

SEQ ID NO: 1956605 - protein, 28 aa, Staphylococcus
KKAKDRPRRPQHKSHHSKPPQKAEDFEK

SEQ ID NO: 1956606 - protein, 28 aa, Staphylococcus
KKAKDRPRRPQSKPSHKQPQPKGEDFEK

SEQ ID NO: 1956607 - protein, 9 aa, Staphylococcus
KKAKEAHTS

SEQ ID NO: 1956608 - protein, 13 aa, Staphylococcus
KKAKELKEEYGYY

SEQ ID NO: 1956609 - protein, 20 aa, Staphylococcus
KKAKEPRESFRMPTEKFVEY

SEQ ID NO: 1956610 - protein, 14 aa, Staphylococcus
KKAKGFDEMKMEEE

SEQ ID NO: 1956611 - protein, 9 aa, Staphylococcus
KKAKPIPPQ

SEQ ID NO: 1956612 - protein, 12 aa, Staphylococcus
KKAKSDIKDKGY

SEQ ID NO: 1956613 - protein, 8 aa, Staphylococcus
KKAKSLNT

SEQ ID NO: 1956614 - protein, 10 aa, Staphylococcus
KKALDKGRLN

SEQ ID NO: 1956615 - protein, 7 aa, Staphylococcus
KKALSQS

SEQ ID NO: 1956616 - protein, 7 aa, Staphylococcus
KKALSSS

SEQ ID NO: 1956617 - protein, 7 aa, Staphylococcus
KKALTSS

SEQ ID NO: 1956618 - protein, 9 aa, Staphylococcus
KKANETKPV

SEQ ID NO: 1956619 - protein, 9 aa, Staphylococcus
KKANLAEDI

SEQ ID NO: 1956620 - protein, 10 aa, Staphylococcus
KKANNSEVAG

SEQ ID NO: 1956621 - protein, 7 aa, Staphylococcus
KKANVDR

SEQ ID NO: 1956622 - protein, 33 aa, Staphylococcus
KKAPEKVINEERDKKERYQEKYDGVKARIEQLK

SEQ ID NO: 1956623 - protein, 9 aa, Staphylococcus
KKAQEAHGS

SEQ ID NO: 1956624 - protein, 8 aa, Staphylococcus
KKAQGARL

SEQ ID NO: 1956625 - protein, 8 aa, Staphylococcus
KKAQGSRL

SEQ ID NO: 1956626 - protein, 6 aa, Staphylococcus
KKAQQT

SEQ ID NO: 1956627 - protein, 4 aa, Staphylococcus
KKAR

SEQ ID NO: 1956628 - protein, 8 aa, Staphylococcus
KKASDKGI

SEQ ID NO: 1956629 - protein, 10 aa, Staphylococcus
KKASDNGTKS

SEQ ID NO: 1956630 - protein, 23 aa, Staphylococcus
KKASEGSDKPKHVTDKKKTAKKL

SEQ ID NO: 1956631 - protein, 15 aa, Staphylococcus
KKASPNIFETDEETM

SEQ ID NO: 1956632 - protein, 13 aa, Staphylococcus
KKASQNSKKPRHV

SEQ ID NO: 1956633 - protein, 9 aa, Staphylococcus
KKASREVTT

SEQ ID NO: 1956634 - protein, 7 aa, Staphylococcus
KKATDNA

SEQ ID NO: 1956635 - protein, 7 aa, Staphylococcus
KKATKAL

SEQ ID NO: 1956636 - protein, 7 aa, Staphylococcus
KKATKQL

SEQ ID NO: 1956637 - protein, 16 aa, Staphylococcus
KKATTREEVKAKRENY

SEQ ID NO: 1956638 - protein, 8 aa, Staphylococcus
KKATYEDR

SEQ ID NO: 1956639 - protein, 10 aa, Staphylococcus
KKAYETGKGK

SEQ ID NO: 1956640 - protein, 6 aa, Staphylococcus
KKCREL

SEQ ID NO: 1956641 - protein, 6 aa, Staphylococcus
KKDARE

SEQ ID NO: 1956642 - protein, 8 aa, Staphylococcus
KKDARERA

SEQ ID NO: 1956643 - protein, 7 aa, Staphylococcus
KKDDDGK

SEQ ID NO: 1956644 - protein, 6 aa, Staphylococcus
KKDDYV

SEQ ID NO: 1956645 - protein, 6 aa, Staphylococcus
KKDEAL

SEQ ID NO: 1956646 - protein, 6 aa, Staphylococcus
KKDEIT

SEQ ID NO: 1956647 - protein, 8 aa, Staphylococcus
KKDENGQL

SEQ ID NO: 1956648 - protein, 14 aa, Staphylococcus
KKDEYTKKCSEKDI

SEQ ID NO: 1956649 - protein, 14 aa, Staphylococcus
KKDFGEENVIGPND

SEQ ID NO: 1956650 - protein, 8 aa, Staphylococcus
KKDFKSLG

SEQ ID NO: 1956651 - protein, 7 aa, Staphylococcus
KKDGCKI

SEQ ID NO: 1956652 - protein, 8 aa, Staphylococcus
KKDGIKKG

SEQ ID NO: 1956653 - protein, 8 aa, Staphylococcus
KKDGPDRI

SEQ ID NO: 1956654 - protein, 6 aa, Staphylococcus
KKDGRI

SEQ ID NO: 1956655 - protein, 6 aa, Staphylococcus
KKDGYK

SEQ ID NO: 1956656 - protein, 8 aa, Staphylococcus
KKDHHSRR

SEQ ID NO: 1956657 - protein, 9 aa, Staphylococcus
KKDHPFAYT

SEQ ID NO: 1956658 - protein, 4 aa, Staphylococcus
KKDI

SEQ ID NO: 1956659 - protein, 15 aa, Staphylococcus
KKDIKSVYDPTCGSG

SEQ ID NO: 1956660 - protein, 7 aa, Staphylococcus
KKDIPNS

SEQ ID NO: 1956661 - protein, 15 aa, Staphylococcus
KKDKSTGEYYNEPVD

SEQ ID NO: 1956662 - protein, 9 aa, Staphylococcus
KKDKTNEHH

SEQ ID NO: 1956663 - protein, 8 aa, Staphylococcus
KKDLADKQ

SEQ ID NO: 1956664 - protein, 7 aa, Staphylococcus
KKDLDNI

SEQ ID NO: 1956665 - protein, 8 aa, Staphylococcus
KKDLKDQE

SEQ ID NO: 1956666 - protein, 6 aa, Staphylococcus
KKDLSP

SEQ ID NO: 1956667 - protein, 19 aa, Staphylococcus
KKDMKNNDATPKLDVDPQT

SEQ ID NO: 1956668 - protein, 18 aa, Staphylococcus
KKDMKNNSETPKLDVDPQ

SEQ ID NO: 1956669 - protein, 8 aa, Staphylococcus
KKDMTDEA

SEQ ID NO: 1956670 - protein, 9 aa, Staphylococcus
KKDMTDQEW

SEQ ID NO: 1956671 - protein, 7 aa, Staphylococcus
KKDNDID

SEQ ID NO: 1956672 - protein, 11 aa, Staphylococcus
KKDNDQFVNSG

SEQ ID NO: 1956673 - protein, 8 aa, Staphylococcus
KKDNKKYE

SEQ ID NO: 1956674 - protein, 8 aa, Staphylococcus
KKDNNKYE

SEQ ID NO: 1956675 - protein, 7 aa, Staphylococcus
KKDNPNI

SEQ ID NO: 1956676 - protein, 8 aa, Staphylococcus
KKDPIGAM

SEQ ID NO: 1956677 - protein, 8 aa, Staphylococcus
KKDPIKSL

SEQ ID NO: 1956678 - protein, 7 aa, Staphylococcus
KKDPLEM

SEQ ID NO: 1956679 - protein, 20 aa, Staphylococcus
KKDPTYNVKAKGTKQAKKED

SEQ ID NO: 1956680 - protein, 7 aa, Staphylococcus
KKDQQAV

SEQ ID NO: 1956681 - protein, 6 aa, Staphylococcus
KKDQQS

SEQ ID NO: 1956682 - protein, 7 aa, Staphylococcus
KKDQSEA

SEQ ID NO: 1956683 - protein, 6 aa, Staphylococcus
KKDSGC

SEQ ID NO: 1956684 - protein, 8 aa, Staphylococcus
KKDTDGQL

SEQ ID NO: 1956685 - protein, 9 aa, Staphylococcus
KKDTEKIAP

SEQ ID NO: 1956686 - protein, 6 aa, Staphylococcus
KKDTGV

SEQ ID NO: 1956687 - protein, 7 aa, Staphylococcus
KKDTLSA

SEQ ID NO: 1956688 - protein, 8 aa, Staphylococcus
KKDTNQLK

SEQ ID NO: 1956689 - protein, 9 aa, Staphylococcus
KKDTRDNGT

SEQ ID NO: 1956690 - protein, 7 aa, Staphylococcus
KKDYPGR

SEQ ID NO: 1956691 - protein, 12 aa, Staphylococcus
KKDYSIQYKQNF

SEQ ID NO: 1956692 - protein, 10 aa, Staphylococcus
KKDYTRNNKQ

SEQ ID NO: 1956693 - protein, 12 aa, Staphylococcus
KKDYTRNNKQLR

SEQ ID NO: 1956694 - protein, 9 aa, Staphylococcus
KKEADGSLT

SEQ ID NO: 1956695 - protein, 7 aa, Staphylococcus
KKEAMKK

SEQ ID NO: 1956696 - protein, 20 aa, Staphylococcus
KKEAPSGRGMRTREQTAKVT

SEQ ID NO: 1956697 - protein, 7 aa, Staphylococcus
KKEARRM

SEQ ID NO: 1956698 - protein, 8 aa, Staphylococcus
KKEASGSL

SEQ ID NO: 1956699 - protein, 7 aa, Staphylococcus
KKEDGDI

SEQ ID NO: 1956700 - protein, 8 aa, Staphylococcus
KKEDIASD

SEQ ID NO: 1956701 - protein, 7 aa, Staphylococcus
KKEEDNL

SEQ ID NO: 1956702 - protein, 6 aa, Staphylococcus
KKEEIQ

SEQ ID NO: 1956703 - protein, 5 aa, Staphylococcus
KKEEL

SEQ ID NO: 1956704 - protein, 6 aa, Staphylococcus
KKEELH

SEQ ID NO: 1956705 - protein, 7 aa, Staphylococcus
KKEEQPT

SEQ ID NO: 1956706 - protein, 19 aa, Staphylococcus
KKEEVGTELSKKANEDEFK

SEQ ID NO: 1956707 - protein, 14 aa, Staphylococcus
KKEFDEKKPEKEYE

SEQ ID NO: 1956708 - protein, 4 aa, Staphylococcus
KKEG

SEQ ID NO: 1956709 - protein, 8 aa, Staphylococcus
KKEGATIA

SEQ ID NO: 1956710 - protein, 7 aa, Staphylococcus
KKEGEKH

SEQ ID NO: 1956711 - protein, 5 aa, Staphylococcus
KKEGF

SEQ ID NO: 1956712 - protein, 7 aa, Staphylococcus
KKEGKGV

SEQ ID NO: 1956713 - protein, 8 aa, Staphylococcus
KKEGKLQA

SEQ ID NO: 1956714 - protein, 7 aa, Staphylococcus
KKEGKSQ

SEQ ID NO: 1956715 - protein, 7 aa, Staphylococcus
KKEGKTQ

SEQ ID NO: 1956716 - protein, 8 aa, Staphylococcus
KKEGNDAK

SEQ ID NO: 1956717 - protein, 6 aa, Staphylococcus
KKEGVN

SEQ ID NO: 1956718 - protein, 19 aa, Staphylococcus
KKEHDGGKAISTEETQAVD

SEQ ID NO: 1956719 - protein, 6 aa, Staphylococcus
KKEIAQ

SEQ ID NO: 1956720 - protein, 8 aa, Staphylococcus
KKEIDALN

SEQ ID NO: 1956721 - protein, 7 aa, Staphylococcus
KKEINQP

SEQ ID NO: 1956722 - protein, 7 aa, Staphylococcus
KKEIPRF

SEQ ID NO: 1956723 - protein, 5 aa, Staphylococcus
KKEIS

SEQ ID NO: 1956724 - protein, 7 aa, Staphylococcus
KKEISPY

SEQ ID NO: 1956725 - protein, 4 aa, Staphylococcus
KKEK

SEQ ID NO: 1956726 - protein, 10 aa, Staphylococcus
KKEKDNQSIT

SEQ ID NO: 1956727 - protein, 7 aa, Staphylococcus
KKEKDTL

SEQ ID NO: 1956728 - protein, 20 aa, Staphylococcus
KKEKEPHTSYRMPVDKVVDY

SEQ ID NO: 1956729 - protein, 7 aa, Staphylococcus
KKEKNDF

SEQ ID NO: 1956730 - protein, 7 aa, Staphylococcus
KKEKNTY

SEQ ID NO: 1956731 - protein, 8 aa, Staphylococcus
KKEKPETV

SEQ ID NO: 1956732 - protein, 7 aa, Staphylococcus
KKEKRKI

SEQ ID NO: 1956733 - protein, 8 aa, Staphylococcus
KKEKVRTD

SEQ ID NO: 1956734 - protein, 6 aa, Staphylococcus
KKELGE

SEQ ID NO: 1956735 - protein, 6 aa, Staphylococcus
KKELKN

SEQ ID NO: 1956736 - protein, 8 aa, Staphylococcus
KKELSDSF

SEQ ID NO: 1956737 - protein, 8 aa, Staphylococcus
KKELSTDT

SEQ ID NO: 1956738 - protein, 6 aa, Staphylococcus
KKELTQ

SEQ ID NO: 1956739 - protein, 16 aa, Staphylococcus
KKELVTRKREEDDERN

SEQ ID NO: 1956740 - protein, 4 aa, Staphylococcus
KKEN

SEQ ID NO: 1956741 - protein, 9 aa, Staphylococcus
KKENAPNLI

SEQ ID NO: 1956742 - protein, 11 aa, Staphylococcus
KKENDTFLTSG

SEQ ID NO: 1956743 - protein, 7 aa, Staphylococcus
KKENGEV

SEQ ID NO: 1956744 - protein, 9 aa, Staphylococcus
KKENGIDLS

SEQ ID NO: 1956745 - protein, 11 aa, Staphylococcus
KKENGVDLSQD

SEQ ID NO: 1956746 - protein, 5 aa, Staphylococcus
KKENI

SEQ ID NO: 1956747 - protein, 6 aa, Staphylococcus
KKENKD

SEQ ID NO: 1956748 - protein, 8 aa, Staphylococcus
KKENPNAS

SEQ ID NO: 1956749 - protein, 6 aa, Staphylococcus
KKENQQ

SEQ ID NO: 1956750 - protein, 7 aa, Staphylococcus
KKENQQT

SEQ ID NO: 1956751 - protein, 7 aa, Staphylococcus
KKENQWN

SEQ ID NO: 1956752 - protein, 8 aa, Staphylococcus
KKENSKYK

SEQ ID NO: 1956753 - protein, 11 aa, Staphylococcus
KKENSVDLSKD

SEQ ID NO: 1956754 - protein, 6 aa, Staphylococcus
KKENVL

SEQ ID NO: 1956755 - protein, 5 aa, Staphylococcus
KKENY

SEQ ID NO: 1956756 - protein, 6 aa, Staphylococcus
KKEPEK

SEQ ID NO: 1956757 - protein, 7 aa, Staphylococcus
KKEPISE

SEQ ID NO: 1956758 - protein, 5 aa, Staphylococcus
KKEPL

SEQ ID NO: 1956759 - protein, 6 aa, Staphylococcus
KKEPNI

SEQ ID NO: 1956760 - protein, 7 aa, Staphylococcus
KKEPSLE

SEQ ID NO: 1956761 - protein, 8 aa, Staphylococcus
KKEQENMA

SEQ ID NO: 1956762 - protein, 11 aa, Staphylococcus
KKEQEQTTKSG

SEQ ID NO: 1956763 - protein, 9 aa, Staphylococcus
KKEQLDGRY

SEQ ID NO: 1956764 - protein, 5 aa, Staphylococcus
KKEQP

SEQ ID NO: 1956765 - protein, 14 aa, Staphylococcus
KKEQVPKNDERVEI

SEQ ID NO: 1956766 - protein, 8 aa, Staphylococcus
KKEREGRL

SEQ ID NO: 1956767 - protein, 17 aa, Staphylococcus
KKERIDVNEDVESHEAT

SEQ ID NO: 1956768 - protein, 5 aa, Staphylococcus
KKERP

SEQ ID NO: 1956769 - protein, 6 aa, Staphylococcus
KKESPD

SEQ ID NO: 1956770 - protein, 14 aa, Staphylococcus
KKESSRLKASDLNN

SEQ ID NO: 1956771 - protein, 10 aa, Staphylococcus
KKETKKLGKL

SEQ ID NO: 1956772 - protein, 9 aa, Staphylococcus
KKETKRLGK

SEQ ID NO: 1956773 - protein, 8 aa, Staphylococcus
KKETKRLS

SEQ ID NO: 1956774 - protein, 9 aa, Staphylococcus
KKETNLEQE

SEQ ID NO: 1956775 - protein, 14 aa, Staphylococcus
KKETRYYANSDKEI

SEQ ID NO: 1956776 - protein, 21 aa, Staphylococcus
KKEVEDKLGKEKRITSNEYGT

SEQ ID NO: 1956777 - protein, 16 aa, Staphylococcus
KKEVGKEPNKSVNPDE

SEQ ID NO: 1956778 - protein, 6 aa, Staphylococcus
KKEVKQ

SEQ ID NO: 1956779 - protein, 14 aa, Staphylococcus
KKEVKRLSKKADEV

SEQ ID NO: 1956780 - protein, 8 aa, Staphylococcus
KKEVNDTF

SEQ ID NO: 1956781 - protein, 7 aa, Staphylococcus
KKEYGIE

SEQ ID NO: 1956782 - protein, 9 aa, Staphylococcus
KKFATARNT

SEQ ID NO: 1956783 - protein, 7 aa, Staphylococcus
KKFDDTT

SEQ ID NO: 1956784 - protein, 12 aa, Staphylococcus
KKFDSQRKRNIN

SEQ ID NO: 1956785 - protein, 6 aa, Staphylococcus
KKFKNA

SEQ ID NO: 1956786 - protein, 18 aa, Staphylococcus
KKFKNRKPDELSGGQRQR

SEQ ID NO: 1956787 - protein, 5 aa, Staphylococcus
KKFKQ

SEQ ID NO: 1956788 - protein, 7 aa, Staphylococcus
KKFKQGD

SEQ ID NO: 1956789 - protein, 11 aa, Staphylococcus
KKFKTQPKKDI

SEQ ID NO: 1956790 - protein, 6 aa, Staphylococcus
KKFQDK

SEQ ID NO: 1956791 - protein, 9 aa, Staphylococcus
KKFSDKGSR

SEQ ID NO: 1956792 - protein, 19 aa, Staphylococcus
KKFSDKGSRIYRMEAKFHK

SEQ ID NO: 1956793 - protein, 9 aa, Staphylococcus
KKFSEKGSR

SEQ ID NO: 1956794 - protein, 22 aa, Staphylococcus
KKFSEPKTSTVKERLIWILFLD

SEQ ID NO: 1956795 - protein, 4 aa, Staphylococcus
KKFT

SEQ ID NO: 1956796 - protein, 7 aa, Staphylococcus
KKFTESV

SEQ ID NO: 1956797 - protein, 4 aa, Staphylococcus
KKGA

SEQ ID NO: 1956798 - protein, 9 aa, Staphylococcus
KKGADAGLS

SEQ ID NO: 1956799 - protein, 6 aa, Staphylococcus
KKGADN

SEQ ID NO: 1956800 - protein, 7 aa, Staphylococcus
KKGALAG

SEQ ID NO: 1956801 - protein, 5 aa, Staphylococcus
KKGAQ

SEQ ID NO: 1956802 - protein, 7 aa, Staphylococcus
KKGDIPR

SEQ ID NO: 1956803 - protein, 13 aa, Staphylococcus
KKGDLASRRQAAK

SEQ ID NO: 1956804 - protein, 14 aa, Staphylococcus
KKGDVVERKSKKNR

SEQ ID NO: 1956805 - protein, 4 aa, Staphylococcus
KKGE

SEQ ID NO: 1956806 - protein, 8 aa, Staphylococcus
KKGEFDDN

SEQ ID NO: 1956807 - protein, 9 aa, Staphylococcus
KKGEGKDSD

SEQ ID NO: 1956808 - protein, 7 aa, Staphylococcus
KKGEPFN

SEQ ID NO: 1956809 - protein, 6 aa, Staphylococcus
KKGERS

SEQ ID NO: 1956810 - protein, 5 aa, Staphylococcus
KKGGQ

SEQ ID NO: 1956811 - protein, 8 aa, Staphylococcus
KKGGTRTR

SEQ ID NO: 1956812 - protein, 14 aa, Staphylococcus
KKGHTVTRLKGGDP

SEQ ID NO: 1956813 - protein, 4 aa, Staphylococcus
KKGI

SEQ ID NO: 1956814 - protein, 6 aa, Staphylococcus
KKGIGR

SEQ ID NO: 1956815 - protein, 10 aa, Staphylococcus
KKGIKPTPEG

SEQ ID NO: 1956816 - protein, 16 aa, Staphylococcus
KKGILSQSSPVATQIP

SEQ ID NO: 1956817 - protein, 15 aa, Staphylococcus
KKGIQLNTSEGALSS

SEQ ID NO: 1956818 - protein, 12 aa, Staphylococcus
KKGITVNGSEMN

SEQ ID NO: 1956819 - protein, 24 aa, Staphylococcus
KKGKGSNDTIDNQEGGQTGGSQPF

SEQ ID NO: 1956820 - protein, 18 aa, Staphylococcus
KKGKGSQNTLDHDEGGFI

SEQ ID NO: 1956821 - protein, 18 aa, Staphylococcus
KKGKGSQNTLDREEGGFI

SEQ ID NO: 1956822 - protein, 9 aa, Staphylococcus
KKGKHYGAT

SEQ ID NO: 1956823 - protein, 7 aa, Staphylococcus
KKGKIQN

SEQ ID NO: 1956824 - protein, 13 aa, Staphylococcus
KKGKLDLKAGSRW

SEQ ID NO: 1956825 - protein, 26 aa, Staphylococcus
KKGKSNKHTGKGFSTMNKSRKTTLSE

SEQ ID NO: 1956826 - protein, 8 aa, Staphylococcus
KKGKSVAN

SEQ ID NO: 1956827 - protein, 8 aa, Staphylococcus
KKGKTAQT

SEQ ID NO: 1956828 - protein, 8 aa, Staphylococcus
KKGKTEHA

SEQ ID NO: 1956829 - protein, 22 aa, Staphylococcus
KKGLAQKKGVNEEDIKSITAED

SEQ ID NO: 1956830 - protein, 30 aa, Staphylococcus
KKGLGSTKNGRDSESKRLGAKRADGQYVTG

SEQ ID NO: 1956831 - protein, 6 aa, Staphylococcus
KKGMSI

SEQ ID NO: 1956832 - protein, 26 aa, Staphylococcus
KKGNKIGVTGSIQTGSYEKDGQRVYT

SEQ ID NO: 1956833 - protein, 32 aa, Staphylococcus
KKGNNKGSEETEKQTESKPAENSFARLFNMNI

SEQ ID NO: 1956834 - protein, 18 aa, Staphylococcus
KKGNRPGFSDSMPPEAAN

SEQ ID NO: 1956835 - protein, 19 aa, Staphylococcus
KKGNRPGFSNSKSPEEAKQ

SEQ ID NO: 1956836 - protein, 19 aa, Staphylococcus
KKGNRPGFSNSMPPDEANQ

SEQ ID NO: 1956837 - protein, 17 aa, Staphylococcus
KKGNRPGFSQSMRPEDA

SEQ ID NO: 1956838 - protein, 18 aa, Staphylococcus
KKGNRPGFTNSKPPEEAN

SEQ ID NO: 1956839 - protein, 12 aa, Staphylococcus
KKGPLSEGTVSG

SEQ ID NO: 1956840 - protein, 5 aa, Staphylococcus
KKGQI

SEQ ID NO: 1956841 - protein, 6 aa, Staphylococcus
KKGQKV

SEQ ID NO: 1956842 - protein, 5 aa, Staphylococcus
KKGQR

SEQ ID NO: 1956843 - protein, 13 aa, Staphylococcus
KKGQTITRLKGGD

SEQ ID NO: 1956844 - protein, 23 aa, Staphylococcus
KKGRGSDNTLNNDEGGSIGENTS

SEQ ID NO: 1956845 - protein, 23 aa, Staphylococcus
KKGRGSESTLDNQEGGAIGQNAS

SEQ ID NO: 1956846 - protein, 24 aa, Staphylococcus
KKGRGSNHSLDRDEGGSIGSNPSF

SEQ ID NO: 1956847 - protein, 6 aa, Staphylococcus
KKGRIE

SEQ ID NO: 1956848 - protein, 10 aa, Staphylococcus
KKGRKTTDDL

SEQ ID NO: 1956849 - protein, 9 aa, Staphylococcus
KKGSDDDIA

SEQ ID NO: 1956850 - protein, 9 aa, Staphylococcus
KKGSGNRPY

SEQ ID NO: 1956851 - protein, 25 aa, Staphylococcus
KKGSIENISKKQLSRGVKVDTNDEG

SEQ ID NO: 1956852 - protein, 10 aa, Staphylococcus
KKGSIINTSS

SEQ ID NO: 1956853 - protein, 6 aa, Staphylococcus
KKGSTA

SEQ ID NO: 1956854 - protein, 13 aa, Staphylococcus
KKGTETEKAQTED

SEQ ID NO: 1956855 - protein, 20 aa, Staphylococcus
KKGTTGEGVKSVTGYTGQDA

SEQ ID NO: 1956856 - protein, 8 aa, Staphylococcus
KKGTVRTN

SEQ ID NO: 1956857 - protein, 9 aa, Staphylococcus
KKGTVRTNE

SEQ ID NO: 1956858 - protein, 5 aa, Staphylococcus
KKGVE

SEQ ID NO: 1956859 - protein, 6 aa, Staphylococcus
KKGVPQ

SEQ ID NO: 1956860 - protein, 28 aa, Staphylococcus
KKGVSSTKNGRDSESKRLGAKRADGQFV

SEQ ID NO: 1956861 - protein, 30 aa, Staphylococcus; identical to SEQ ID NO: 1757268

SEQ ID NO: 1956862 - protein, 6 aa, Staphylococcus
KKGVTK

SEQ ID NO: 1956863 - protein, 8 aa, Staphylococcus
KKGWENQV

SEQ ID NO: 1956864 - protein, 15 aa, Staphylococcus
KKGYPKFKKKSGIGS

SEQ ID NO: 1956865 - protein, 9 aa, Staphylococcus
KKGYQSDEI

SEQ ID NO: 1956866 - protein, 5 aa, Staphylococcus
KKGYS

SEQ ID NO: 1956867 - protein, 22 aa, Staphylococcus
KKGYTSYAPQYEGHAAPPEEIL

SEQ ID NO: 1956868 - protein, 8 aa, Staphylococcus
KKHADELN

SEQ ID NO: 1956869 - protein, 8 aa, Staphylococcus
KKHAKKAK

SEQ ID NO: 1956870 - protein, 9 aa, Staphylococcus
KKHAKKAKK

SEQ ID NO: 1956871 - protein, 9 aa, Staphylococcus
KKHANTEDV

SEQ ID NO: 1956872 - protein, 17 aa, Staphylococcus
KKHANTLRQTGGIGTVA

SEQ ID NO: 1956873 - protein, 8 aa, Staphylococcus
KKHAQTDQ

SEQ ID NO: 1956874 - protein, 6 aa, Staphylococcus
KKHDAL

SEQ ID NO: 1956875 - protein, 4 aa, Staphylococcus
KKHE

SEQ ID NO: 1956876 - protein, 9 aa, Staphylococcus
KKHEDSNDV

SEQ ID NO: 1956877 - protein, 18 aa, Staphylococcus
KKHFKNREKALKLVERKQ

SEQ ID NO: 1956878 - protein, 26 aa, Staphylococcus
KKHGSEETVHPNDDVNKSQSSNDTFP

SEQ ID NO: 1956879 - protein, 7 aa, Staphylococcus
KKHHIPE

SEQ ID NO: 1956880 - protein, 14 aa, Staphylococcus
KKHIKESVKQSLKN

SEQ ID NO: 1956881 - protein, 4 aa, Staphylococcus
KKHL

SEQ ID NO: 1956882 - protein, 8 aa, Staphylococcus
KKHMTEEI

SEQ ID NO: 1956883 - protein, 18 aa, Staphylococcus
KKHPDKIAVRNKKESITY

SEQ ID NO: 1956884 - protein, 6 aa, Staphylococcus
KKHPGS

SEQ ID NO: 1956885 - protein, 8 aa, Staphylococcus
KKHPTSRR

SEQ ID NO: 1956886 - protein, 11 aa, Staphylococcus
KKHQTTPPDYF

SEQ ID NO: 1956887 - protein, 10 aa, Staphylococcus
KKHRGKGFGN

SEQ ID NO: 1956888 - protein, 10 aa, Staphylococcus
KKHSSRKRNY

SEQ ID NO: 1956889 - protein, 9 aa, Staphylococcus
KKIAEVDYN

SEQ ID NO: 1956890 - protein, 6 aa, Staphylococcus
KKIAKT

SEQ ID NO: 1956891 - protein, 6 aa, Staphylococcus
KKIASG

SEQ ID NO: 1956892 - protein, 6 aa, Staphylococcus
KKIEDD

SEQ ID NO: 1956893 - protein, 7 aa, Staphylococcus
KKIEEKK

SEQ ID NO: 1956894 - protein, 6 aa, Staphylococcus
KKIETQ

SEQ ID NO: 1956895 - protein, 6 aa, Staphylococcus
KKIGDK

SEQ ID NO: 1956896 - protein, 10 aa, Staphylococcus
KKIGEDSKVS

SEQ ID NO: 1956897 - protein, 14 aa, Staphylococcus
KKIGHTGTLDPEVS

SEQ ID NO: 1956898 - protein, 6 aa, Staphylococcus
KKIGNA

SEQ ID NO: 1956899 - protein, 11 aa, Staphylococcus
KKIGNAVTRNR

SEQ ID NO: 1956900 - protein, 8 aa, Staphylococcus
KKIHASSH

SEQ ID NO: 1956901 - protein, 6 aa, Staphylococcus
KKIKAT

SEQ ID NO: 1956902 - protein, 7 aa, Staphylococcus
KKIKGKK

SEQ ID NO: 1956903 - protein, 6 aa, Staphylococcus
KKIKNE

SEQ ID NO: 1956904 - protein, 7 aa, Staphylococcus
KKIKNEI

SEQ ID NO: 1956905 - protein, 6 aa, Staphylococcus
KKIKQA

SEQ ID NO: 1956906 - protein, 9 aa, Staphylococcus
KKIKSGLQA

SEQ ID NO: 1956907 - protein, 15 aa, Staphylococcus
KKIKTPKSQIDPETD

SEQ ID NO: 1956908 - protein, 9 aa, Staphylococcus
KKINETEDY

SEQ ID NO: 1956909 - protein, 7 aa, Staphylococcus
KKINSEI

SEQ ID NO: 1956910 - protein, 6 aa, Staphylococcus
KKIPRV

SEQ ID NO: 1956911 - protein, 7 aa, Staphylococcus
KKIQSEN

SEQ ID NO: 1956912 - protein, 5 aa, Staphylococcus
KKIRE

SEQ ID NO: 1956913 - protein, 6 aa, Staphylococcus
KKIRED

SEQ ID NO: 1956914 - protein, 9 aa, Staphylococcus
KKIRENAKV

SEQ ID NO: 1956915 - protein, 20 aa, Staphylococcus
KKIRENAKVDVDRAKEIELE

SEQ ID NO: 1956916 - protein, 8 aa, Staphylococcus
KKIRENAR

SEQ ID NO: 1956917 - protein, 9 aa, Staphylococcus
KKIRQNAKV

SEQ ID NO: 1956918 - protein, 5 aa, Staphylococcus
KKISD

SEQ ID NO: 1956919 - protein, 6 aa, Staphylococcus
KKISEI

SEQ ID NO: 1956920 - protein, 7 aa, Staphylococcus
KKISGAA

SEQ ID NO: 1956921 - protein, 7 aa, Staphylococcus
KKISGNR

SEQ ID NO: 1956922 - protein, 44 aa, Staphylococcus
KKISKKDQFESINPAKTSQTIAKVSKATKEDVEKAFQSTNEAYQ

SEQ ID NO: 1956923 - protein, 11 aa, Staphylococcus
KKISKYEPGLT

SEQ ID NO: 1956924 - protein, 8 aa, Staphylococcus
KKISNSLK

SEQ ID NO: 1956925 - protein, 26 aa, Staphylococcus
KKISNSSISNKYYPNASQSNLKSIGR

SEQ ID NO: 1956926 - protein, 10 aa, Staphylococcus
KKITDETGQK

SEQ ID NO: 1956927 - protein, 5 aa, Staphylococcus
KKITE

SEQ ID NO: 1956928 - protein, 6 aa, Staphylococcus
KKITEG

SEQ ID NO: 1956929 - protein, 12 aa, Staphylococcus
KKITGQDYEPLA

SEQ ID NO: 1956930 - protein, 6 aa, Staphylococcus
KKITRI

SEQ ID NO: 1956931 - protein, 11 aa, Staphylococcus
KKKAAQGNNPL

SEQ ID NO: 1956932 - protein, 12 aa, Staphylococcus
KKKAAQNNNPLE

SEQ ID NO: 1956933 - protein, 7 aa, Staphylococcus
KKKAAVY

SEQ ID NO: 1956934 - protein, 8 aa, Staphylococcus
KKKAGKFP

SEQ ID NO: 1956935 - protein, 15 aa, Staphylococcus
KKKANNNTNSNNPLE

SEQ ID NO: 1956936 - protein, 12 aa, Staphylococcus
KKKANQNAGNPF

SEQ ID NO: 1956937 - protein, 12 aa, Staphylococcus
KKKAPDAKIQGD

SEQ ID NO: 1956938 - protein, 6 aa, Staphylococcus
KKKAPN

SEQ ID NO: 1956939 - protein, 10 aa, Staphylococcus
KKKARQVEQA

SEQ ID NO: 1956940 - protein, 12 aa, Staphylococcus
KKKASNNSNPLE

SEQ ID NO: 1956941 - protein, 11 aa, Staphylococcus
KKKASQGNNPL

SEQ ID NO: 1956942 - protein, 12 aa, Staphylococcus
KKKASQGNNPLE

SEQ ID NO: 1956943 - protein, 12 aa, Staphylococcus
KKKDAEIKEKVK

SEQ ID NO: 1956944 - protein, 12 aa, Staphylococcus
KKKDIKTAKQAY

SEQ ID NO: 1956945 - protein, 9 aa, Staphylococcus
KKKDSIPVV

SEQ ID NO: 1956946 - protein, 11 aa, Staphylococcus
KKKELASAEQA

SEQ ID NO: 1956947 - protein, 8 aa, Staphylococcus
KKKENIRE

SEQ ID NO: 1956948 - protein, 8 aa, Staphylococcus
KKKENQLS

SEQ ID NO: 1956949 - protein, 8 aa, Staphylococcus
KKKENRTV

SEQ ID NO: 1956950 - protein, 6 aa, Staphylococcus
KKKERQ

SEQ ID NO: 1956951 - protein, 11 aa, Staphylococcus
KKKEYHDSTAH

SEQ ID NO: 1956952 - protein, 9 aa, Staphylococcus
KKKGIRVGD

SEQ ID NO: 1956953 - protein, 13 aa, Staphylococcus
KKKGITTAKQAYE

SEQ ID NO: 1956954 - protein, 16 aa, Staphylococcus
KKKGNITATIESPEEL

SEQ ID NO: 1956955 - protein, 8 aa, Staphylococcus
KKKGRSSQ

SEQ ID NO: 1956956 - protein, 9 aa, Staphylococcus
KKKGRSSQV

SEQ ID NO: 1956957 - protein, 10 aa, Staphylococcus
KKKGRSSQVT

SEQ ID NO: 1956958 - protein, 6 aa, Staphylococcus
KKKGVY

SEQ ID NO: 1956959 - protein, 6 aa, Staphylococcus
KKKGYT

SEQ ID NO: 1956960 - protein, 7 aa, Staphylococcus
KKKHRDT

SEQ ID NO: 1956961 - protein, 9 aa, Staphylococcus
KKKKDAREM

SEQ ID NO: 1956962 - protein, 11 aa, Staphylococcus
KKKKEEEQQRR

SEQ ID NO: 1956963 - protein, 31 aa, Staphylococcus
KKKKKEEEQEQRLNQATDALQDKVNQQIRQP

SEQ ID NO: 1956964 - protein, 10 aa, Staphylococcus
KKKKKGDEDY

SEQ ID NO: 1956965 - protein, 13 aa, Staphylococcus
KKKKKQEEQEARL

SEQ ID NO: 1956966 - protein, 13 aa, Staphylococcus
KKKKTEEEQQRRL

SEQ ID NO: 1956967 - protein, 13 aa, Staphylococcus
KKKKTEEERAKRL

SEQ ID NO: 1956968 - protein, 12 aa, Staphylococcus
KKKKTEEERQAR

SEQ ID NO: 1956969 - protein, 17 aa, Staphylococcus
KKKLSTAFQAPKVNPAA

SEQ ID NO: 1956970 - protein, 6 aa, Staphylococcus
KKKNAN

SEQ ID NO: 1956971 - protein, 7 aa, Staphylococcus
KKKNTEY

SEQ ID NO: 1956972 - protein, 9 aa, Staphylococcus
KKKPGKPLD

SEQ ID NO: 1956973 - protein, 8 aa, Staphylococcus
KKKPNQTI

SEQ ID NO: 1956974 - protein, 5 aa, Staphylococcus
KKKPS

SEQ ID NO: 1956975 - protein, 7 aa, Staphylococcus
KKKQAIN

SEQ ID NO: 1956976 - protein, 8 aa, Staphylococcus
KKKRGYAT

SEQ ID NO: 1956977 - protein, 7 aa, Staphylococcus
KKKRSRN

SEQ ID NO: 1956978 - protein, 8 aa, Staphylococcus
KKKSGELP

SEQ ID NO: 1956979 - protein, 22 aa, Staphylococcus
KKKSKADQKAFRKGLDEKRFIV

SEQ ID NO: 1956980 - protein, 22 aa, Staphylococcus
KKKSKAQQKAFRSELDESRFVI

SEQ ID NO: 1956981 - protein, 22 aa, Staphylococcus
KKKSKKDQKAFRQQLDEKRFVV

SEQ ID NO: 1956982 - protein, 11 aa, Staphylococcus
KKKSKNEQKAF

SEQ ID NO: 1956983 - protein, 11 aa, Staphylococcus
KKKSTQTTSNV

SEQ ID NO: 1956984 - protein, 8 aa, Staphylococcus
KKKTAEKL

SEQ ID NO: 1956985 - protein, 8 aa, Staphylococcus
KKKTAKEL

SEQ ID NO: 1956986 - protein, 8 aa, Staphylococcus
KKKTAKQL

SEQ ID NO: 1956987 - protein, 8 aa, Staphylococcus
KKKTGQFP

SEQ ID NO: 1956988 - protein, 5 aa, Staphylococcus
KKKVE

SEQ ID NO: 1956989 - protein, 5 aa, Staphylococcus
KKKYD

SEQ ID NO: 1956990 - protein, 17 aa, Staphylococcus
KKKYLTVPDSKQNDVPA

SEQ ID NO: 1956991 - protein, 17 aa, Staphylococcus
KKKYLTVQDSKQNDVPA

SEQ ID NO: 1956992 - protein, 18 aa, Staphylococcus
KKKYVTVQDSKQNDVPTG

SEQ ID NO: 1956993 - protein, 18 aa, Staphylococcus
KKKYVTVSDSKQSDVPAG

SEQ ID NO: 1956994 - protein, 7 aa, Staphylococcus
KKLANEN

SEQ ID NO: 1956995 - protein, 7 aa, Staphylococcus
KKLDDEV

SEQ ID NO: 1956996 - protein, 8 aa, Staphylococcus
KKLDDGTY

SEQ ID NO: 1956997 - protein, 6 aa, Staphylococcus
KKLDSG

SEQ ID NO: 1956998 - protein, 7 aa, Staphylococcus
KKLEDGL

SEQ ID NO: 1956999 - protein, 13 aa, Staphylococcus
KKLEKENKALKNE

SEQ ID NO: 1957000 - protein, 13 aa, Staphylococcus
KKLEKENKSLKDE

SEQ ID NO: 1957001 - protein, 9 aa, Staphylococcus
KKLERGKRT

SEQ ID NO: 1957002 - protein, 7 aa, Staphylococcus
KKLESGT

SEQ ID NO: 1957003 - protein, 5 aa, Staphylococcus
KKLGD

SEQ ID NO: 1957004 - protein, 5 aa, Staphylococcus
KKLGK

SEQ ID NO: 1957005 - protein, 6 aa, Staphylococcus
KKLGKG

SEQ ID NO: 1957006 - protein, 7 aa, Staphylococcus
KKLGKGF

SEQ ID NO: 1957007 - protein, 6 aa, Staphylococcus
KKLGNA

SEQ ID NO: 1957008 - protein, 11 aa, Staphylococcus
KKLGNAVTRNK

SEQ ID NO: 1957009 - protein, 8 aa, Staphylococcus
KKLGSRTE

SEQ ID NO: 1957010 - protein, 26 aa, Staphylococcus
KKLHDKRQALKDKAMKRDVDRAMKAR

SEQ ID NO: 1957011 - protein, 7 aa, Staphylococcus
KKLHSTK

SEQ ID NO: 1957012 - protein, 16 aa, Staphylococcus
KKLIPNLSSERLVLVN

SEQ ID NO: 1957013 - protein, 9 aa, Staphylococcus
KKLKDYSKE

SEQ ID NO: 1957014 - protein, 9 aa, Staphylococcus
KKLKDYTKD

SEQ ID NO: 1957015 - protein, 9 aa, Staphylococcus
KKLKKQEIA

SEQ ID NO: 1957016 - protein, 13 aa, Staphylococcus
KKLKRQLDTANEH

SEQ ID NO: 1957017 - protein, 5 aa, Staphylococcus
KKLKS

SEQ ID NO: 1957018 - protein, 5 aa, Staphylococcus
KKLKT

SEQ ID NO: 1957019 - protein, 6 aa, Staphylococcus
KKLLPN

SEQ ID NO: 1957020 - protein, 7 aa, Staphylococcus
KKLNDEL

SEQ ID NO: 1957021 - protein, 11 aa, Staphylococcus
KKLNGDEMTPY

SEQ ID NO: 1957022 - protein, 14 aa, Staphylococcus
KKLNGEEPQFVVNK

SEQ ID NO: 1957023 - protein, 14 aa, Staphylococcus
KKLNGEEPQFVVNR

SEQ ID NO: 1957024 - protein, 13 aa, Staphylococcus
KKLNGETPQFIVN

SEQ ID NO: 1957025 - protein, 14 aa, Staphylococcus
KKLNGKTPQFIVNP

SEQ ID NO: 1957026 - protein, 7 aa, Staphylococcus
KKLNSDI

SEQ ID NO: 1957027 - protein, 6 aa, Staphylococcus
KKLPDI

SEQ ID NO: 1957028 - protein, 6 aa, Staphylococcus
KKLPER

SEQ ID NO: 1957029 - protein, 7 aa, Staphylococcus
KKLPKLK

SEQ ID NO: 1957030 - protein, 23 aa, Staphylococcus
KKLQAESYTSVDEAVKAGLKILV

SEQ ID NO: 1957031 - protein, 10 aa, Staphylococcus
KKLRSSEENY

SEQ ID NO: 1957032 - protein, 6 aa, Staphylococcus
KKLSDN

SEQ ID NO: 1957033 - protein, 12 aa, Staphylococcus
KKLSEGIEKGIG

SEQ ID NO: 1957034 - protein, 8 aa, Staphylococcus
KKLSEPEI

SEQ ID NO: 1957035 - protein, 18 aa, Staphylococcus
KKLSEPETKNIYSQRKID

SEQ ID NO: 1957036 - protein, 7 aa, Staphylococcus
KKLSGDA

SEQ ID NO: 1957037 - protein, 7 aa, Staphylococcus
KKLSGEA

SEQ ID NO: 1957038 - protein, 20 aa, Staphylococcus
KKLSKEGYFDNSNKKTIPRF

SEQ ID NO: 1957039 - protein, 12 aa, Staphylococcus
KKLSKNDNFYDV

SEQ ID NO: 1957040 - protein, 8 aa, Staphylococcus
KKLSNDEY

SEQ ID NO: 1957041 - protein, 6 aa, Staphylococcus
KKLSPV

SEQ ID NO: 1957042 - protein, 10 aa, Staphylococcus
KKLSTRLAER

SEQ ID NO: 1957043 - protein, 8 aa, Staphylococcus
KKLTDRQQ

SEQ ID NO: 1957044 - protein, 10 aa, Staphylococcus
KKLTKEGYFD

SEQ ID NO: 1957045 - protein, 16 aa, Staphylococcus
KKLTNEDAYKRARPSH

SEQ ID NO: 1957046 - protein, 7 aa, Staphylococcus
KKLTPHS

SEQ ID NO: 1957047 - protein, 6 aa, Staphylococcus
KKLTQN

SEQ ID NO: 1957048 - protein, 7 aa, Staphylococcus
KKMAQEI

SEQ ID NO: 1957049 - protein, 6 aa, Staphylococcus
KKMEDS

SEQ ID NO: 1957050 - protein, 23 aa, Staphylococcus
KKMEQEQEKLKDERVEGTAGGGM

SEQ ID NO: 1957051 - protein, 20 aa, Staphylococcus
KKMERNHARQDGTADKDKGY

SEQ ID NO: 1957052 - protein, 6 aa, Staphylococcus
KKMETS

SEQ ID NO: 1957053 - protein, 7 aa, Staphylococcus
KKMGDEV

SEQ ID NO: 1957054 - protein, 23 aa, Staphylococcus
KKMGEEQEKLKEEKVQGTAGGGM

SEQ ID NO: 1957055 - protein, 6 aa, Staphylococcus
KKMGNN

SEQ ID NO: 1957056 - protein, 6 aa, Staphylococcus
KKMGQH

SEQ ID NO: 1957057 - protein, 23 aa, Staphylococcus
KKMHSRAKGALNNANEKIDDKTI

SEQ ID NO: 1957058 - protein, 5 aa, Staphylococcus
KKMKD

SEQ ID NO: 1957059 - protein, 5 aa, Staphylococcus
KKMSE

SEQ ID NO: 1957060 - protein, 18 aa, Staphylococcus
KKMSSNANRVISGSPYQV

SEQ ID NO: 1957061 - protein, 5 aa, Staphylococcus
KKNAE

SEQ ID NO: 1957062 - protein, 7 aa, Staphylococcus
KKNAQLK

SEQ ID NO: 1957063 - protein, 8 aa, Staphylococcus
KKNDEKFA

SEQ ID NO: 1957064 - protein, 6 aa, Staphylococcus
KKNDQK

SEQ ID NO: 1957065 - protein, 8 aa, Staphylococcus
KKNDQQGV

SEQ ID NO: 1957066 - protein, 7 aa, Staphylococcus
KKNENRT

SEQ ID NO: 1957067 - protein, 5 aa, Staphylococcus
KKNER

SEQ ID NO: 1957068 - protein, 9 aa, Staphylococcus
KKNESIHGE

SEQ ID NO: 1957069 - protein, 9 aa, Staphylococcus
KKNESNHRI

SEQ ID NO: 1957070 - protein, 9 aa, Staphylococcus
KKNETIRGE

SEQ ID NO: 1957071 - protein, 9 aa, Staphylococcus
KKNETTIQP

SEQ ID NO: 1957072 - protein, 7 aa, Staphylococcus
KKNFAEL

SEQ ID NO: 1957073 - protein, 6 aa, Staphylococcus
KKNFAN

SEQ ID NO: 1957074 - protein, 7 aa, Staphylococcus
KKNGAKA

SEQ ID NO: 1957075 - protein, 7 aa, Staphylococcus
KKNGEKI

SEQ ID NO: 1957076 - protein, 21 aa, Staphylococcus
KKNGIDGLKDKRGKNKKQELS

SEQ ID NO: 1957077 - protein, 22 aa, Staphylococcus
KKNGKDQPMTTNNGTKVSEDEL

SEQ ID NO: 1957078 - protein, 9 aa, Staphylococcus
KKNGKKRIS

SEQ ID NO: 1957079 - protein, 14 aa, Staphylococcus
KKNGNLVSRFEIPN

SEQ ID NO: 1957080 - protein, 14 aa, Staphylococcus
KKNGQPVSRFEIPN

SEQ ID NO: 1957081 - protein, 10 aa, Staphylococcus
KKNGREHTVN

SEQ ID NO: 1957082 - protein, 14 aa, Staphylococcus
KKNGSPVKRYHIPI

SEQ ID NO: 1957083 - protein, 17 aa, Staphylococcus
KKNGSVTAGNASGINDG

SEQ ID NO: 1957084 - protein, 12 aa, Staphylococcus
KKNGTTAFTQRR

SEQ ID NO: 1957085 - protein, 4 aa, Staphylococcus
KKNH

SEQ ID NO: 1957086 - protein, 10 aa, Staphylococcus
KKNITKEDYT

SEQ ID NO: 1957087 - protein, 7 aa, Staphylococcus
KKNKQAV

SEQ ID NO: 1957088 - protein, 8 aa, Staphylococcus
KKNKQGIQ

SEQ ID NO: 1957089 - protein, 7 aa, Staphylococcus
KKNKTVH

SEQ ID NO: 1957090 - protein, 7 aa, Staphylococcus
KKNLDEH

SEQ ID NO: 1957091 - protein, 7 aa, Staphylococcus
KKNLGEH

SEQ ID NO: 1957092 - protein, 7 aa, Staphylococcus
KKNLNEH

SEQ ID NO: 1957093 - protein, 7 aa, Staphylococcus
KKNLPIN

SEQ ID NO: 1957094 - protein, 8 aa, Staphylococcus
KKNNGEGI

SEQ ID NO: 1957095 - protein, 7 aa, Staphylococcus
KKNNVKE

SEQ ID NO: 1957096 - protein, 28 aa, Staphylococcus
KKNPAHYEQYQRGSGRKSFIETHWGSQN

SEQ ID NO: 1957097 - protein, 7 aa, Staphylococcus
KKNPEKV

SEQ ID NO: 1957098 - protein, 21 aa, Staphylococcus
KKNPERYAKEQQDRANYQADL

SEQ ID NO: 1957099 - protein, 22 aa, Staphylococcus
KKNPERYAKEQQDRQNYKQQTD

SEQ ID NO: 1957100 - protein, 19 aa, Staphylococcus
KKNPERYAQEQQDRANYKS

SEQ ID NO: 1957101 - protein, 22 aa, Staphylococcus
KKNPERYAQEQRDRANYDPRSN

SEQ ID NO: 1957102 - protein, 17 aa, Staphylococcus
KKNPTHYEQYQRGSGRK

SEQ ID NO: 1957103 - protein, 16 aa, Staphylococcus
KKNQFPDELSGGQKQR

SEQ ID NO: 1957104 - protein, 10 aa, Staphylococcus
KKNQGKLEVT

SEQ ID NO: 1957105 - protein, 7 aa, Staphylococcus
KKNQPIY

SEQ ID NO: 1957106 - protein, 7 aa, Staphylococcus
KKNQQAV

SEQ ID NO: 1957107 - protein, 10 aa, Staphylococcus
KKNQSQAQDE

SEQ ID NO: 1957108 - protein, 10 aa, Staphylococcus
KKNQTQAQDE

SEQ ID NO: 1957109 - protein, 6 aa, Staphylococcus
KKNRPD

SEQ ID NO: 1957110 - protein, 7 aa, Staphylococcus
KKNRPEA

SEQ ID NO: 1957111 - protein, 7 aa, Staphylococcus
KKNRPET

SEQ ID NO: 1957112 - protein, 6 aa, Staphylococcus
KKNRTW

SEQ ID NO: 1957113 - protein, 9 aa, Staphylococcus
KKNSKINSV

SEQ ID NO: 1957114 - protein, 9 aa, Staphylococcus
KKNSQNKDI

SEQ ID NO: 1957115 - protein, 8 aa, Staphylococcus
KKNTALDE

SEQ ID NO: 1957116 - protein, 7 aa, Staphylococcus
KKNTENI

SEQ ID NO: 1957117 - protein, 6 aa, Staphylococcus
KKNTKI

SEQ ID NO: 1957118 - protein, 9 aa, Staphylococcus
KKNYDSART

SEQ ID NO: 1957119 - protein, 12 aa, Staphylococcus
KKNYNNLASKDN

SEQ ID NO: 1957120 - protein, 8 aa, Staphylococcus
KKPEAKLT

SEQ ID NO: 1957121 - protein, 7 aa, Staphylococcus
KKPENLY

SEQ ID NO: 1957122 - protein, 6 aa, Staphylococcus
KKPEYI

SEQ ID NO: 1957123 - protein, 13 aa, Staphylococcus
KKPGFNTDHDETI

SEQ ID NO: 1957124 - protein, 8 aa, Staphylococcus
KKPGLTGT

SEQ ID NO: 1957125 - protein, 6 aa, Staphylococcus
KKPGNG

SEQ ID NO: 1957126 - protein, 7 aa, Staphylococcus
KKPHFTN

SEQ ID NO: 1957127 - protein, 5 aa, Staphylococcus
KKPHH

SEQ ID NO: 1957128 - protein, 7 aa, Staphylococcus
KKPHVTK

SEQ ID NO: 1957129 - protein, 13 aa, Staphylococcus
KKPHYTNKLSKRE

SEQ ID NO: 1957130 - protein, 6 aa, Staphylococcus
KKPIEL

SEQ ID NO: 1957131 - protein, 6 aa, Staphylococcus
KKPIGV

SEQ ID NO: 1957132 - protein, 7 aa, Staphylococcus
KKPIPKF

SEQ ID NO: 1957133 - protein, 7 aa, Staphylococcus
KKPIPRF

SEQ ID NO: 1957134 - protein, 11 aa, Staphylococcus
KKPITARTSYG

SEQ ID NO: 1957135 - protein, 7 aa, Staphylococcus
KKPKAVV

SEQ ID NO: 1957136 - protein, 14 aa, Staphylococcus
KKPKIKAGVNTIEE

SEQ ID NO: 1957137 - protein, 10 aa, Staphylococcus
KKPKNISNVE

SEQ ID NO: 1957138 - protein, 6 aa, Staphylococcus
KKPKYD

SEQ ID NO: 1957139 - protein, 5 aa, Staphylococcus
KKPLN

SEQ ID NO: 1957140 - protein, 8 aa, Staphylococcus
KKPNAKLT

SEQ ID NO: 1957141 - protein, 6 aa, Staphylococcus
KKPNIA

SEQ ID NO: 1957142 - protein, 9 aa, Staphylococcus
KKPPEEWRK

SEQ ID NO: 1957143 - protein, 10 aa, Staphylococcus
KKPQQSDELA

SEQ ID NO: 1957144 - protein, 40 aa, Staphylococcus
KKPRDPEEEERLRKRNEERKRRKEEQDRKLKEKLEKRKAA

SEQ ID NO: 1957145 - protein, 10 aa, Staphylococcus
KKPRGRAFNQ

SEQ ID NO: 1957146 - protein, 8 aa, Staphylococcus
KKPSANIF

SEQ ID NO: 1957147 - protein, 8 aa, Staphylococcus
KKPSPNIF

SEQ ID NO: 1957148 - protein, 7 aa, Staphylococcus
KKPTSSL

SEQ ID NO: 1957149 - protein, 7 aa, Staphylococcus
KKPVYKE

SEQ ID NO: 1957150 - protein, 7 aa, Staphylococcus
KKPYAKH

SEQ ID NO: 1957151 - protein, 6 aa, Staphylococcus
KKPYHK

SEQ ID NO: 1957152 - protein, 6 aa, Staphylococcus
KKPYIE

SEQ ID NO: 1957153 - protein, 7 aa, Staphylococcus
KKPYSRH

SEQ ID NO: 1957154 - protein, 7 aa, Staphylococcus
KKPYTKH

SEQ ID NO: 1957155 - protein, 8 aa, Staphylococcus
KKPYTKHI

SEQ ID NO: 1957156 - protein, 10 aa, Staphylococcus
KKQADKENYD

SEQ ID NO: 1957157 - protein, 9 aa, Staphylococcus
KKQAGSYPQ

SEQ ID NO: 1957158 - protein, 17 aa, Staphylococcus
KKQAQESIKNEAERAGQ

SEQ ID NO: 1957159 - protein, 16 aa, Staphylococcus
KKQAQESVKAEAERAG

SEQ ID NO: 1957160 - protein, 10 aa, Staphylococcus
KKQEENIDET

SEQ ID NO: 1957161 - protein, 7 aa, Staphylococcus
KKQEGRT

SEQ ID NO: 1957162 - protein, 6 aa, Staphylococcus
KKQELN

SEQ ID NO: 1957163 - protein, 14 aa, Staphylococcus
KKQETHIKSEHEEF

SEQ ID NO: 1957164 - protein, 14 aa, Staphylococcus
KKQETHLKDEHEEF

SEQ ID NO: 1957165 - protein, 6 aa, Staphylococcus
KKQFGS

SEQ ID NO: 1957166 - protein, 5 aa, Staphylococcus
KKQGC

SEQ ID NO: 1957167 - protein, 6 aa, Staphylococcus
KKQGLD

SEQ ID NO: 1957168 - protein, 6 aa, Staphylococcus
KKQGLE

SEQ ID NO: 1957169 - protein, 8 aa, Staphylococcus
KKQGRKSQ

SEQ ID NO: 1957170 - protein, 6 aa, Staphylococcus
KKQGVD

SEQ ID NO: 1957171 - protein, 6 aa, Staphylococcus
KKQGVE

SEQ ID NO: 1957172 - protein, 9 aa, Staphylococcus
KKQHQSLNK

SEQ ID NO: 1957173 - protein, 7 aa, Staphylococcus
KKQINND

SEQ ID NO: 1957174 - protein, 8 aa, Staphylococcus
KKQISKKA

SEQ ID NO: 1957175 - protein, 15 aa, Staphylococcus
KKQKDIEAKNTLTQE

SEQ ID NO: 1957176 - protein, 6 aa, Staphylococcus
KKQKDM

SEQ ID NO: 1957177 - protein, 6 aa, Staphylococcus
KKQKEI

SEQ ID NO: 1957178 - protein, 6 aa, Staphylococcus
KKQKEL

SEQ ID NO: 1957179 - protein, 7 aa, Staphylococcus
KKQKFPV

SEQ ID NO: 1957180 - protein, 6 aa, Staphylococcus
KKQKFQ

SEQ ID NO: 1957181 - protein, 12 aa, Staphylococcus
KKQKITSSDNTI

SEQ ID NO: 1957182 - protein, 16 aa, Staphylococcus
KKQKKKASDLRRIKSM

SEQ ID NO: 1957183 - protein, 15 aa, Staphylococcus
KKQKRQFNQRRHETN

SEQ ID NO: 1957184 - protein, 30 aa, Staphylococcus
KKQLDDQYEAKSIKQNVQKQKYDKIQAGDE

SEQ ID NO: 1957185 - protein, 30 aa, Staphylococcus
KKQLDDQYEAKSIKQSVQKKKYDKINAGDE

SEQ ID NO: 1957186 - protein, 30 aa, Staphylococcus
KKQLDDQYEAKSLKQNVQKKKWDEINAGDE

SEQ ID NO: 1957187 - protein, 29 aa, Staphylococcus
KKQLDDQYEAKSLKQNVQKQKYDEIHAGD

SEQ ID NO: 1957188 - protein, 23 aa, Staphylococcus
KKQLDNQYEAKSIKQQVQKQKYD

SEQ ID NO: 1957189 - protein, 7 aa, Staphylococcus
KKQPNQY

SEQ ID NO: 1957190 - protein, 6 aa, Staphylococcus
KKQPYR

SEQ ID NO: 1957191 - protein, 4 aa, Staphylococcus
KKQQ

SEQ ID NO: 1957192 - protein, 5 aa, Staphylococcus
KKQQI

SEQ ID NO: 1957193 - protein, 5 aa, Staphylococcus
KKQQL

SEQ ID NO: 1957194 - protein, 7 aa, Staphylococcus
KKQQSKF

SEQ ID NO: 1957195 - protein, 10 aa, Staphylococcus
KKQRDDNLDE

SEQ ID NO: 1957196 - protein, 4 aa, Staphylococcus
KKQS

SEQ ID NO: 1957197 - protein, 12 aa, Staphylococcus
KKQSKSEAKTKA

SEQ ID NO: 1957198 - protein, 7 aa, Staphylococcus
KKQSNGT

SEQ ID NO: 1957199 - protein, 5 aa, Staphylococcus
KKQTH

SEQ ID NO: 1957200 - protein, 11 aa, Staphylococcus
KKQTNSTTYNA

SEQ ID NO: 1957201 - protein, 11 aa, Staphylococcus
KKQTQSTTYNA

SEQ ID NO: 1957202 - protein, 7 aa, Staphylococcus
KKQVEES

SEQ ID NO: 1957203 - protein, 13 aa, Staphylococcus
KKQVVPQITEVLI

SEQ ID NO: 1957204 - protein, 7 aa, Staphylococcus
KKRAAIE

SEQ ID NO: 1957205 - protein, 8 aa, Staphylococcus
KKRAKTAG

SEQ ID NO: 1957206 - protein, 7 aa, Staphylococcus
KKRAPKV

SEQ ID NO: 1957207 - protein, 9 aa, Staphylococcus
KKRDEPVGE

SEQ ID NO: 1957208 - protein, 5 aa, Staphylococcus
KKRDN

SEQ ID NO: 1957209 - protein, 17 aa, Staphylococcus
KKRDPQTVNPKIATGQV

SEQ ID NO: 1957210 - protein, 6 aa, Staphylococcus
KKREDD

SEQ ID NO: 1957211 - protein, 7 aa, Staphylococcus
KKREDNF

SEQ ID NO: 1957212 - protein, 4 aa, Staphylococcus
KKRF

SEQ ID NO: 1957213 - protein, 7 aa, Staphylococcus
KKRFKED

SEQ ID NO: 1957214 - protein, 7 aa, Staphylococcus
KKRGKQA

SEQ ID NO: 1957215 - protein, 8 aa, Staphylococcus
KKRHPNRK

SEQ ID NO: 1957216 - protein, 7 aa, Staphylococcus
KKRIEVP

SEQ ID NO: 1957217 - protein, 8 aa, Staphylococcus
KKRKANEI

SEQ ID NO: 1957218 - protein, 13 aa, Staphylococcus
KKRKAYKEKPVSV

SEQ ID NO: 1957219 - protein, 8 aa, Staphylococcus
KKRKPHQL

SEQ ID NO: 1957220 - protein, 12 aa, Staphylococcus
KKRKRSNIPNGK

SEQ ID NO: 1957221 - protein, 12 aa, Staphylococcus
KKRKSKENDDIG

SEQ ID NO: 1957222 - protein, 9 aa, Staphylococcus
KKRKTESLQ

SEQ ID NO: 1957223 - protein, 4 aa, Staphylococcus
KKRN

SEQ ID NO: 1957224 - protein, 9 aa, Staphylococcus
KKRNEHDER

SEQ ID NO: 1957225 - protein, 6 aa, Staphylococcus
KKRNNI

SEQ ID NO: 1957226 - protein, 23 aa, Staphylococcus
KKRNQKMTITSPENIVTDKNGFP

SEQ ID NO: 1957227 - protein, 5 aa, Staphylococcus
KKRRM

SEQ ID NO: 1957228 - protein, 7 aa, Staphylococcus
KKRRMAD

SEQ ID NO: 1957229 - protein, 7 aa, Staphylococcus
KKRRPIE

SEQ ID NO: 1957230 - protein, 8 aa, Staphylococcus
KKRRPIEN

SEQ ID NO: 1957231 - protein, 9 aa, Staphylococcus
KKRSEREEY

SEQ ID NO: 1957232 - protein, 22 aa, Staphylococcus
KKRSKGEQKKFRNDLDSSRFVV

SEQ ID NO: 1957233 - protein, 10 aa, Staphylococcus
KKRSKKQGKL

SEQ ID NO: 1957234 - protein, 9 aa, Staphylococcus
KKRSNEDER

SEQ ID NO: 1957235 - protein, 11 aa, Staphylococcus
KKRSQQTGHSR

SEQ ID NO: 1957236 - protein, 7 aa, Staphylococcus
KKRTDNK

SEQ ID NO: 1957237 - protein, 9 aa, Staphylococcus
KKRTEKEVR

SEQ ID NO: 1957238 - protein, 11 aa, Staphylococcus
KKRTEKEVSDY

SEQ ID NO: 1957239 - protein, 12 aa, Staphylococcus
KKRTNGTRVETW

SEQ ID NO: 1957240 - protein, 23 aa, Staphylococcus
KKRVREIAEEQDLATAKKKDSTG

SEQ ID NO: 1957241 - protein, 6 aa, Staphylococcus
KKRYTA

SEQ ID NO: 1957242 - protein, 8 aa, Staphylococcus
KKSAEEIN

SEQ ID NO: 1957243 - protein, 7 aa, Staphylococcus
KKSAEIA

SEQ ID NO: 1957244 - protein, 10 aa, Staphylococcus
KKSAPSSRGL

SEQ ID NO: 1957245 - protein, 10 aa, Staphylococcus
KKSATNGDKT

SEQ ID NO: 1957246 - protein, 9 aa, Staphylococcus
KKSATVDSL

SEQ ID NO: 1957247 - protein, 4 aa, Staphylococcus
KKSD

SEQ ID NO: 1957248 - protein, 8 aa, Staphylococcus
KKSDEQIK

SEQ ID NO: 1957249 - protein, 7 aa, Staphylococcus
KKSDIDA

SEQ ID NO: 1957250 - protein, 8 aa, Staphylococcus
KKSDIDAV

SEQ ID NO: 1957251 - protein, 9 aa, Staphylococcus
KKSDIPFDS

SEQ ID NO: 1957252 - protein, 6 aa, Staphylococcus
KKSDRD

SEQ ID NO: 1957253 - protein, 5 aa, Staphylococcus
KKSEE

SEQ ID NO: 1957254 - protein, 11 aa, Staphylococcus
KKSEEETTDEE

SEQ ID NO: 1957255 - protein, 7 aa, Staphylococcus
KKSEIKQ

SEQ ID NO: 1957256 - protein, 7 aa, Staphylococcus
KKSEKVK

SEQ ID NO: 1957257 - protein, 8 aa, Staphylococcus
KKSFNNAH

SEQ ID NO: 1957258 - protein, 4 aa, Staphylococcus
KKSG

SEQ ID NO: 1957259 - protein, 14 aa, Staphylococcus
KKSGFTDADEISHH

SEQ ID NO: 1957260 - protein, 8 aa, Staphylococcus
KKSGGDVE

SEQ ID NO: 1957261 - protein, 4 aa, Staphylococcus
KKSH

SEQ ID NO: 1957262 - protein, 6 aa, Staphylococcus
KKSHQT

SEQ ID NO: 1957263 - protein, 6 aa, Staphylococcus
KKSIPD

SEQ ID NO: 1957264 - protein, 13 aa, Staphylococcus
KKSIPESTLNTNL

SEQ ID NO: 1957265 - protein, 12 aa, Staphylococcus
KKSIQGIETEPV

SEQ ID NO: 1957266 - protein, 21 aa, Staphylococcus
KKSKAEQKAFRKNLDANRFII

SEQ ID NO: 1957267 - protein, 21 aa, Staphylococcus
KKSKAQQKEFKQELDKSRFVM

SEQ ID NO: 1957268 - protein, 7 aa, Staphylococcus
KKSKDAH

SEQ ID NO: 1957269 - protein, 7 aa, Staphylococcus
KKSKEIV

SEQ ID NO: 1957270 - protein, 8 aa, Staphylococcus
KKSKGYAF

SEQ ID NO: 1957271 - protein, 9 aa, Staphylococcus
KKSKKANAK

SEQ ID NO: 1957272 - protein, 7 aa, Staphylococcus
KKSKNGL

SEQ ID NO: 1957273 - protein, 8 aa, Staphylococcus
KKSKNRSI

SEQ ID NO: 1957274 - protein, 5 aa, Staphylococcus
KKSKP

SEQ ID NO: 1957275 - protein, 10 aa, Staphylococcus
KKSKQNNAPK

SEQ ID NO: 1957276 - protein, 6 aa, Staphylococcus
KKSKTI

SEQ ID NO: 1957277 - protein, 7 aa, Staphylococcus
KKSKTIG

SEQ ID NO: 1957278 - protein, 8 aa, Staphylococcus
KKSKTNKE

SEQ ID NO: 1957279 - protein, 6 aa, Staphylococcus
KKSKVT

SEQ ID NO: 1957280 - protein, 7 aa, Staphylococcus
KKSLEHQ

SEQ ID NO: 1957281 - protein, 9 aa, Staphylococcus
KKSLTGQYL

SEQ ID NO: 1957282 - protein, 6 aa, Staphylococcus
KKSMTH

SEQ ID NO: 1957283 - protein, 7 aa, Staphylococcus
KKSNEIV

SEQ ID NO: 1957284 - protein, 7 aa, Staphylococcus
KKSNELT

SEQ ID NO: 1957285 - protein, 9 aa, Staphylococcus
KKSNETKPV

SEQ ID NO: 1957286 - protein, 9 aa, Staphylococcus
KKSNITYQP

SEQ ID NO: 1957287 - protein, 15 aa, Staphylococcus
KKSNSMQTSFTSILN

SEQ ID NO: 1957288 - protein, 13 aa, Staphylococcus
KKSPEQIKNENLN

SEQ ID NO: 1957289 - protein, 8 aa, Staphylococcus
KKSPETAT

SEQ ID NO: 1957290 - protein, 6 aa, Staphylococcus
KKSPHR

SEQ ID NO: 1957291 - protein, 9 aa, Staphylococcus
KKSQEDGRV

SEQ ID NO: 1957292 - protein, 5 aa, Staphylococcus
KKSQN

SEQ ID NO: 1957293 - protein, 13 aa, Staphylococcus
KKSRISHKDKQKY

SEQ ID NO: 1957294 - protein, 6 aa, Staphylococcus
KKSSEI

SEQ ID NO: 1957295 - protein, 33 aa, Staphylococcus
KKSSEIAKDIENTRDKLSGHPNSKKSKNKLKQL

SEQ ID NO: 1957296 - protein, 10 aa, Staphylococcus
KKSSGTKDTY

SEQ ID NO: 1957297 - protein, 13 aa, Staphylococcus
KKSTLSRAEQYQE

SEQ ID NO: 1957298 - protein, 13 aa, Staphylococcus
KKSTLYSASKAAV

SEQ ID NO: 1957299 - protein, 7 aa, Staphylococcus
KKSTYES

SEQ ID NO: 1957300 - protein, 8 aa, Staphylococcus
KKSYHTKI

SEQ ID NO: 1957301 - protein, 13 aa, Staphylococcus
KKTAEEAGQPESW

SEQ ID NO: 1957302 - protein, 8 aa, Staphylococcus
KKTAEIAK

SEQ ID NO: 1957303 - protein, 6 aa, Staphylococcus
KKTAPF

SEQ ID NO: 1957304 - protein, 10 aa, Staphylococcus
KKTATNGSKS

SEQ ID NO: 1957305 - protein, 29 aa, Staphylococcus
KKTAYFSPNKETWSRELGRNKNALDGNDL

SEQ ID NO: 1957306 - protein, 4 aa, Staphylococcus
KKTD

SEQ ID NO: 1957307 - protein, 5 aa, Staphylococcus
KKTDA

SEQ ID NO: 1957308 - protein, 9 aa, Staphylococcus
KKTDDTFCK

SEQ ID NO: 1957309 - protein, 5 aa, Staphylococcus
KKTDE

SEQ ID NO: 1957310 - protein, 14 aa, Staphylococcus
KKTDGMFDGEASGH

SEQ ID NO: 1957311 - protein, 12 aa, Staphylococcus
KKTDKPLKGKEL

SEQ ID NO: 1957312 - protein, 7 aa, Staphylococcus
KKTDTQT

SEQ ID NO: 1957313 - protein, 6 aa, Staphylococcus
KKTDVL

SEQ ID NO: 1957314 - protein, 4 aa, Staphylococcus
KKTE

SEQ ID NO: 1957315 - protein, 10 aa, Staphylococcus
KKTEAKLNKK

SEQ ID NO: 1957316 - protein, 11 aa, Staphylococcus
KKTESQPQDDL

SEQ ID NO: 1957317 - protein, 8 aa, Staphylococcus
KKTGAKNY

SEQ ID NO: 1957318 - protein, 6 aa, Staphylococcus
KKTGIN

SEQ ID NO: 1957319 - protein, 11 aa, Staphylococcus
KKTGITTTDTY

SEQ ID NO: 1957320 - protein, 9 aa, Staphylococcus
KKTGKGQFT

SEQ ID NO: 1957321 - protein, 10 aa, Staphylococcus
KKTGKSEGDY

SEQ ID NO: 1957322 - protein, 7 aa, Staphylococcus
KKTGLNK

SEQ ID NO: 1957323 - protein, 6 aa, Staphylococcus
KKTHQT

SEQ ID NO: 1957324 - protein, 10 aa, Staphylococcus
KKTISAIKTN

SEQ ID NO: 1957325 - protein, 4 aa, Staphylococcus
KKTK

SEQ ID NO: 1957326 - protein, 9 aa, Staphylococcus
KKTLGSTDI

SEQ ID NO: 1957327 - protein, 8 aa, Staphylococcus
KKTNELNR

SEQ ID NO: 1957328 - protein, 7 aa, Staphylococcus
KKTNHSQ

SEQ ID NO: 1957329 - protein, 7 aa, Staphylococcus
KKTNSSV

SEQ ID NO: 1957330 - protein, 5 aa, Staphylococcus
KKTNT

SEQ ID NO: 1957331 - protein, 8 aa, Staphylococcus
KKTNTTHA

SEQ ID NO: 1957332 - protein, 9 aa, Staphylococcus
KKTPDDMPN

SEQ ID NO: 1957333 - protein, 15 aa, Staphylococcus
KKTPLPSIYNNEDKG

SEQ ID NO: 1957334 - protein, 20 aa, Staphylococcus
KKTPTADLEEDKPQLPDEEA

SEQ ID NO: 1957335 - protein, 11 aa, Staphylococcus
KKTQSQAQDDL

SEQ ID NO: 1957336 - protein, 10 aa, Staphylococcus
KKTQTQAQDD

SEQ ID NO: 1957337 - protein, 10 aa, Staphylococcus
KKTQTQARDE

SEQ ID NO: 1957338 - protein, 4 aa, Staphylococcus
KKTR

SEQ ID NO: 1957339 - protein, 11 aa, Staphylococcus
KKTRGTQAKKN

SEQ ID NO: 1957340 - protein, 9 aa, Staphylococcus
KKTRVATET

SEQ ID NO: 1957341 - protein, 8 aa, Staphylococcus
KKTTKEDT

SEQ ID NO: 1957342 - protein, 27 aa, Staphylococcus
KKTTKESTKFDEKSTNKTESLNNQYSS

SEQ ID NO: 1957343 - protein, 7 aa, Staphylococcus
KKTTSRY

SEQ ID NO: 1957344 - protein, 9 aa, Staphylococcus
KKTVAPYKY

SEQ ID NO: 1957345 - protein, 24 aa, Staphylococcus
KKTVGDANAINRKGQMPPSSNAFV

SEQ ID NO: 1957346 - protein, 6 aa, Staphylococcus
KKTYDR

SEQ ID NO: 1957347 - protein, 7 aa, Staphylococcus
KKTYSDF

SEQ ID NO: 1957348 - protein, 10 aa, Staphylococcus
KKVAKDEKAY

SEQ ID NO: 1957349 - protein, 8 aa, Staphylococcus
KKVANKPI

SEQ ID NO: 1957350 - protein, 9 aa, Staphylococcus
KKVDAPSGT

SEQ ID NO: 1957351 - protein, 14 aa, Staphylococcus
KKVEAQSGSEKKQV

SEQ ID NO: 1957352 - protein, 8 aa, Staphylococcus
KKVEEEQP

SEQ ID NO: 1957353 - protein, 9 aa, Staphylococcus
KKVEGELGQ

SEQ ID NO: 1957354 - protein, 10 aa, Staphylococcus
KKVEREVSVE

SEQ ID NO: 1957355 - protein, 11 aa, Staphylococcus
KKVERKRQETF

SEQ ID NO: 1957356 - protein, 7 aa, Staphylococcus
KKVETEN

SEQ ID NO: 1957357 - protein, 4 aa, Staphylococcus
KKVG

SEQ ID NO: 1957358 - protein, 9 aa, Staphylococcus
KKVGEDAKV

SEQ ID NO: 1957359 - protein, 14 aa, Staphylococcus
KKVGHTGTLDPEVS

SEQ ID NO: 1957360 - protein, 13 aa, Staphylococcus
KKVGNNDKRNKKK

SEQ ID NO: 1957361 - protein, 6 aa, Staphylococcus
KKVHPK

SEQ ID NO: 1957362 - protein, 5 aa, Staphylococcus
KKVHT

SEQ ID NO: 1957363 - protein, 10 aa, Staphylococcus
KKVKDKKLRY

SEQ ID NO: 1957364 - protein, 8 aa, Staphylococcus
KKVKKDSN

SEQ ID NO: 1957365 - protein, 14 aa, Staphylococcus
KKVKKGSKAYYEAY

SEQ ID NO: 1957366 - protein, 8 aa, Staphylococcus
KKVKNQQP

SEQ ID NO: 1957367 - protein, 8 aa, Staphylococcus
KKVKPSDI

SEQ ID NO: 1957368 - protein, 14 aa, Staphylococcus
KKVNTEKYHNSDNE

SEQ ID NO: 1957369 - protein, 13 aa, Staphylococcus
KKVPTTVATDKGL

SEQ ID NO: 1957370 - protein, 12 aa, Staphylococcus
KKVQANAPEDAP

SEQ ID NO: 1957371 - protein, 9 aa, Staphylococcus
KKVQTDNTL

SEQ ID NO: 1957372 - protein, 5 aa, Staphylococcus
KKVRR

SEQ ID NO: 1957373 - protein, 6 aa, Staphylococcus
KKVRSN

SEQ ID NO: 1957374 - protein, 4 aa, Staphylococcus
KKVS

SEQ ID NO: 1957375 - protein, 6 aa, Staphylococcus
KKVSDH

SEQ ID NO: 1957376 - protein, 10 aa, Staphylococcus
KKVSTLSGGQ

SEQ ID NO: 1957377 - protein, 11 aa, Staphylococcus
KKVTAPDTPVP

SEQ ID NO: 1957378 - protein, 5 aa, Staphylococcus
KKWGE

SEQ ID NO: 1957379 - protein, 7 aa, Staphylococcus
KKWPGTI

SEQ ID NO: 1957380 - protein, 9 aa, Staphylococcus
KKWPTDKAF

SEQ ID NO: 1957381 - protein, 12 aa, Staphylococcus
KKWPTDRSFNQQ

SEQ ID NO: 1957382 - protein, 9 aa, Staphylococcus
KKWSAEDEY

SEQ ID NO: 1957383 - protein, 9 aa, Staphylococcus
KKWSTDKAF

SEQ ID NO: 1957384 - protein, 17 aa, Staphylococcus
KKYANTLHKTGGIGTVA

SEQ ID NO: 1957385 - protein, 7 aa, Staphylococcus
KKYAPES

SEQ ID NO: 1957386 - protein, 16 aa, Staphylococcus
KKYAQTLKQTGGIGTV

SEQ ID NO: 1957387 - protein, 8 aa, Staphylococcus
KKYDNPFE

SEQ ID NO: 1957388 - protein, 6 aa, Staphylococcus
KKYEEI

SEQ ID NO: 1957389 - protein, 13 aa, Staphylococcus
KKYEGKDEATIEK

SEQ ID NO: 1957390 - protein, 13 aa, Staphylococcus
KKYEGKDQETIDK

SEQ ID NO: 1957391 - protein, 10 aa, Staphylococcus
KKYELDANNG

SEQ ID NO: 1957392 - protein, 9 aa, Staphylococcus
KKYEQYQNY

SEQ ID NO: 1957393 - protein, 7 aa, Staphylococcus
KKYERKK

SEQ ID NO: 1957394 - protein, 16 aa, Staphylococcus
KKYGETPKIIMKVEMV

SEQ ID NO: 1957395 - protein, 10 aa, Staphylococcus
KKYGLDGDDT

SEQ ID NO: 1957396 - protein, 21 aa, Staphylococcus
KKYHPDINKEEGADEKFKEIS

SEQ ID NO: 1957397 - protein, 20 aa, Staphylococcus
KKYHPDINQEEGAEEKFKEI

SEQ ID NO: 1957398 - protein, 4 aa, Staphylococcus
KKYK

SEQ ID NO: 1957399 - protein, 8 aa, Staphylococcus
KKYKGAHG

SEQ ID NO: 1957400 - protein, 9 aa, Staphylococcus
KKYKSSQLS

SEQ ID NO: 1957401 - protein, 18 aa, Staphylococcus
KKYKSSSIKKLTDYYFKG

SEQ ID NO: 1957402 - protein, 23 aa, Staphylococcus
KKYMSSDEKLENNPFKDALKNLK

SEQ ID NO: 1957403 - protein, 8 aa, Staphylococcus
KKYNDKNS

SEQ ID NO: 1957404 - protein, 7 aa, Staphylococcus
KKYNDLR

SEQ ID NO: 1957405 - protein, 14 aa, Staphylococcus
KKYNGGLSSGEIQT

SEQ ID NO: 1957406 - protein, 9 aa, Staphylococcus
KKYNNPFDP

SEQ ID NO: 1957407 - protein, 8 aa, Staphylococcus
KKYNQDFA

SEQ ID NO: 1957408 - protein, 7 aa, Staphylococcus
KKYQDRS

SEQ ID NO: 1957409 - protein, 13 aa, Staphylococcus
KKYQGKDEATINR

SEQ ID NO: 1957410 - protein, 10 aa, Staphylococcus
KKYQNEQRLP

SEQ ID NO: 1957411 - protein, 9 aa, Staphylococcus
KKYRTVDES

SEQ ID NO: 1957412 - protein, 7 aa, Staphylococcus
KKYSEPR

SEQ ID NO: 1957413 - protein, 6 aa, Staphylococcus
KKYTKS

SEQ ID NO: 1957414 - protein, 6 aa, Staphylococcus
KKYVKN

SEQ ID NO: 1957415 - protein, 6 aa, Staphylococcus
KKYYED

SEQ ID NO: 1957416 - protein, 7 aa, Staphylococcus
KLAAPDK

SEQ ID NO: 1957417 - protein, 8 aa, Staphylococcus
KLADGKEV

SEQ ID NO: 1957418 - protein, 4 aa, Staphylococcus
KLAE

SEQ ID NO: 1957419 - protein, 8 aa, Staphylococcus
KLAEESDA

SEQ ID NO: 1957420 - protein, 8 aa, Staphylococcus
KLAETGKY

SEQ ID NO: 1957421 - protein, 10 aa, Staphylococcus
KLAGELQTAE

SEQ ID NO: 1957422 - protein, 11 aa, Staphylococcus
KLAGTAEKPRL

SEQ ID NO: 1957423 - protein, 16 aa, Staphylococcus
KLAGTERGVTEPEPSF

SEQ ID NO: 1957424 - protein, 21 aa, Staphylococcus
KLAKQRAQSHLNDEDNSDIYR

SEQ ID NO: 1957425 - protein, 39 aa, Staphylococcus
KLAKSRAESHLDNDDDNSDINRAKRALERANNRLRVAEL

SEQ ID NO: 1957426 - protein, 39 aa, Staphylococcus
KLAKSRAESHLEDDDDNSDINRAKRALERANNRLRVAEL

SEQ ID NO: 1957427 - protein, 6 aa, Staphylococcus
KLALTQ

SEQ ID NO: 1957428 - protein, 8 aa, Staphylococcus
KLALTQSQ

SEQ ID NO: 1957429 - protein, 9 aa, Staphylococcus
KLANDTGHT

SEQ ID NO: 1957430 - protein, 8 aa, Staphylococcus
KLANEHPE

SEQ ID NO: 1957431 - protein, 6 aa, Staphylococcus
KLANEN

SEQ ID NO: 1957432 - protein, 12 aa, Staphylococcus
KLANKAKKDGVN

SEQ ID NO: 1957433 - protein, 7 aa, Staphylococcus
KLANKEK

SEQ ID NO: 1957434 - protein, 4 aa, Staphylococcus
KLAQ

SEQ ID NO: 1957435 - protein, 23 aa, Staphylococcus
KLAQKIGEEKRKQGTKVYDPERE

SEQ ID NO: 1957436 - protein, 8 aa, Staphylococcus
KLAQSDEL

SEQ ID NO: 1957437 - protein, 11 aa, Staphylococcus
KLASQPSGVPV

SEQ ID NO: 1957438 - protein, 7 aa, Staphylococcus
KLATDDK

SEQ ID NO: 1957439 - protein, 4 aa, Staphylococcus
KLDA

SEQ ID NO: 1957440 - protein, 14 aa, Staphylococcus
KLDANGNVVKEKKV

SEQ ID NO: 1957441 - protein, 6 aa, Staphylococcus
KLDDED

SEQ ID NO: 1957442 - protein, 4 aa, Staphylococcus
KLDE

SEQ ID NO: 1957443 - protein, 9 aa, Staphylococcus
KLDEGYTKD

SEQ ID NO: 1957444 - protein, 19 aa, Staphylococcus
KLDEKMGRNNYESKWTSSN

SEQ ID NO: 1957445 - protein, 6 aa, Staphylococcus
KLDEPL

SEQ ID NO: 1957446 - protein, 7 aa, Staphylococcus
KLDERKK

SEQ ID NO: 1957447 - protein, 28 aa, Staphylococcus
KLDERKKITKTLKKTSKLTKVEQMSEQE

SEQ ID NO: 1957448 - protein, 18 aa, Staphylococcus
KLDERKKLTKALKKHGQI

SEQ ID NO: 1957449 - protein, 19 aa, Staphylococcus
KLDERKKLTKSLKKNAQLK

SEQ ID NO: 1957450 - protein, 28 aa, Staphylococcus
KLDERKKLTKSLKKSSKLSKVDQMSEEE

SEQ ID NO: 1957451 - protein, 20 aa, Staphylococcus
KLDERKKLTKTLKKNGQLKK

SEQ ID NO: 1957452 - protein, 11 aa, Staphylococcus
KLDFNPKEGDE

SEQ ID NO: 1957453 - protein, 14 aa, Staphylococcus
KLDGFNEQKPRTRI

SEQ ID NO: 1957454 - protein, 7 aa, Staphylococcus
KLDGQAL

SEQ ID NO: 1957455 - protein, 7 aa, Staphylococcus
KLDNGNW

SEQ ID NO: 1957456 - protein, 7 aa, Staphylococcus
KLDPDKE

SEQ ID NO: 1957457 - protein, 7 aa, Staphylococcus
KLDPEAE

SEQ ID NO: 1957458 - protein, 8 aa, Staphylococcus
KLDPEKPT

SEQ ID NO: 1957459 - protein, 10 aa, Staphylococcus
KLDPNYEKTR

SEQ ID NO: 1957460 - protein, 9 aa, Staphylococcus
KLDPTGYEV

SEQ ID NO: 1957461 - protein, 8 aa, Staphylococcus
KLDPTGYR

SEQ ID NO: 1957462 - protein, 8 aa, Staphylococcus
KLDRDDEA

SEQ ID NO: 1957463 - protein, 7 aa, Staphylococcus
KLDTEFN

SEQ ID NO: 1957464 - protein, 13 aa, Staphylococcus
KLDTNKEGRIANQ

SEQ ID NO: 1957465 - protein, 6 aa, Staphylococcus
KLEDEG

SEQ ID NO: 1957466 - protein, 7 aa, Staphylococcus
KLEDEKV

SEQ ID NO: 1957467 - protein, 5 aa, Staphylococcus
KLEDT

SEQ ID NO: 1957468 - protein, 9 aa, Staphylococcus
KLEEDSGQM

SEQ ID NO: 1957469 - protein, 6 aa, Staphylococcus
KLEEEK

SEQ ID NO: 1957470 - protein, 7 aa, Staphylococcus
KLEEENE

SEQ ID NO: 1957471 - protein, 22 aa, Staphylococcus
KLEEGEDPKEAAHRELEEETGY

SEQ ID NO: 1957472 - protein, 8 aa, Staphylococcus
KLEEGSYA

SEQ ID NO: 1957473 - protein, 7 aa, Staphylococcus
KLEEIEN

SEQ ID NO: 1957474 - protein, 11 aa, Staphylococcus
KLEENPKQPKL

SEQ ID NO: 1957475 - protein, 6 aa, Staphylococcus
KLEEQG

SEQ ID NO: 1957476 - protein, 7 aa, Staphylococcus
KLEESQI

SEQ ID NO: 1957477 - protein, 5 aa, Staphylococcus
KLEET

SEQ ID NO: 1957478 - protein, 6 aa, Staphylococcus
KLEGGQ

SEQ ID NO: 1957479 - protein, 7 aa, Staphylococcus
KLEGGQY

SEQ ID NO: 1957480 - protein, 7 aa, Staphylococcus
KLEGGSH

SEQ ID NO: 1957481 - protein, 6 aa, Staphylococcus
KLEGGT

SEQ ID NO: 1957482 - protein, 4 aa, Staphylococcus
KLEH

SEQ ID NO: 1957483 - protein, 8 aa, Staphylococcus
KLEKESQA

SEQ ID NO: 1957484 - protein, 22 aa, Staphylococcus
KLEKGEEREEAAKRELQEETGY

SEQ ID NO: 1957485 - protein, 6 aa, Staphylococcus
KLEKLE

SEQ ID NO: 1957486 - protein, 22 aa, Staphylococcus
KLEKNEEREEAAKRELEEETGY

SEQ ID NO: 1957487 - protein, 4 aa, Staphylococcus
KLEN

SEQ ID NO: 1957488 - protein, 6 aa, Staphylococcus
KLENEI

SEQ ID NO: 1957489 - protein, 6 aa, Staphylococcus
KLENKE

SEQ ID NO: 1957490 - protein, 5 aa, Staphylococcus
KLENQ

SEQ ID NO: 1957491 - protein, 5 aa, Staphylococcus
KLEPA

SEQ ID NO: 1957492 - protein, 7 aa, Staphylococcus
KLEPEEV

SEQ ID NO: 1957493 - protein, 8 aa, Staphylococcus
KLEPEEVK

SEQ ID NO: 1957494 - protein, 11 aa, Staphylococcus
KLEQDGGEFDD

SEQ ID NO: 1957495 - protein, 4 aa, Staphylococcus
KLER

SEQ ID NO: 1957496 - protein, 9 aa, Staphylococcus
KLERKKAID

SEQ ID NO: 1957497 - protein, 17 aa, Staphylococcus
KLERSYNAPGQMCVFVQ

SEQ ID NO: 1957498 - protein, 12 aa, Staphylococcus
KLETDGKLLTGK

SEQ ID NO: 1957499 - protein, 8 aa, Staphylococcus
KLETIEQS

SEQ ID NO: 1957500 - protein, 6 aa, Staphylococcus
KLETNQ

SEQ ID NO: 1957501 - protein, 10 aa, Staphylococcus
KLETTSDYIS

SEQ ID NO: 1957502 - protein, 13 aa, Staphylococcus
KLETYTEKYPELA

SEQ ID NO: 1957503 - protein, 5 aa, Staphylococcus
KLFEE

SEQ ID NO: 1957504 - protein, 4 aa, Staphylococcus
KLGE

SEQ ID NO: 1957505 - protein, 9 aa, Staphylococcus
KLGERTREV

SEQ ID NO: 1957506 - protein, 5 aa, Staphylococcus
KLGGK

SEQ ID NO: 1957507 - protein, 6 aa, Staphylococcus
KLGGSN

SEQ ID NO: 1957508 - protein, 6 aa, Staphylococcus
KLGHKS

SEQ ID NO: 1957509 - protein, 9 aa, Staphylococcus
KLGNAVTRN

SEQ ID NO: 1957510 - protein, 7 aa, Staphylococcus
KLGSGQQ

SEQ ID NO: 1957511 - protein, 5 aa, Staphylococcus
KLGSN

SEQ ID NO: 1957512 - protein, 12 aa, Staphylococcus
KLGSSAAMANGG

SEQ ID NO: 1957513 - protein, 17 aa, Staphylococcus
KLGSTQDASEYEDKDPY

SEQ ID NO: 1957514 - protein, 17 aa, Staphylococcus
KLGSTQDASEYENKDPY

SEQ ID NO: 1957515 - protein, 10 aa, Staphylococcus
KLGTGKVPTM

SEQ ID NO: 1957516 - protein, 8 aa, Staphylococcus
KLGTRTRE

SEQ ID NO: 1957517 - protein, 19 aa, Staphylococcus
KLHQRAANAINKSTQAIKP

SEQ ID NO: 1957518 - protein, 13 aa, Staphylococcus
KLHTGRSRNDQVA

SEQ ID NO: 1957519 - protein, 7 aa, Staphylococcus
KLIDKAK

SEQ ID NO: 1957520 - protein, 9 aa, Staphylococcus
KLIDKSKKP

SEQ ID NO: 1957521 - protein, 9 aa, Staphylococcus
KLIKTSNKC

SEQ ID NO: 1957522 - protein, 10 aa, Staphylococcus
KLIQSEEQVS

SEQ ID NO: 1957523 - protein, 6 aa, Staphylococcus
KLKAQL

SEQ ID NO: 1957524 - protein, 5 aa, Staphylococcus
KLKAS

SEQ ID NO: 1957525 - protein, 17 aa, Staphylococcus
KLKDKAHELSGDTTFSS

SEQ ID NO: 1957526 - protein, 12 aa, Staphylococcus
KLKDSVDDVSIN

SEQ ID NO: 1957527 - protein, 15 aa, Staphylococcus
KLKEADTPHAKRSLE

SEQ ID NO: 1957528 - protein, 6 aa, Staphylococcus
KLKEAH

SEQ ID NO: 1957529 - protein, 12 aa, Staphylococcus
KLKEASKAYRNE

SEQ ID NO: 1957530 - protein, 8 aa, Staphylococcus
KLKEDEEE

SEQ ID NO: 1957531 - protein, 14 aa, Staphylococcus
KLKEDIRKAELTQD

SEQ ID NO: 1957532 - protein, 5 aa, Staphylococcus
KLKEG

SEQ ID NO: 1957533 - protein, 10 aa, Staphylococcus
KLKENHSGEY

SEQ ID NO: 1957534 - protein, 10 aa, Staphylococcus
KLKEQNTKID

SEQ ID NO: 1957535 - protein, 11 aa, Staphylococcus
KLKGDEKTPYA

SEQ ID NO: 1957536 - protein, 11 aa, Staphylococcus
KLKIPNEDIGE

SEQ ID NO: 1957537 - protein, 5 aa, Staphylococcus
KLKNG

SEQ ID NO: 1957538 - protein, 6 aa, Staphylococcus
KLKNQG

SEQ ID NO: 1957539 - protein, 10 aa, Staphylococcus
KLKNSDAYKK

SEQ ID NO: 1957540 - protein, 7 aa, Staphylococcus
KLKNTKN

SEQ ID NO: 1957541 - protein, 5 aa, Staphylococcus
KLKPK

SEQ ID NO: 1957542 - protein, 12 aa, Staphylococcus
KLKQAEKCQTEK

SEQ ID NO: 1957543 - protein, 11 aa, Staphylococcus
KLKQHSRKYAK

SEQ ID NO: 1957544 - protein, 11 aa, Staphylococcus
KLKQNSRKYAK

SEQ ID NO: 1957545 - protein, 7 aa, Staphylococcus
KLKSNGE

SEQ ID NO: 1957546 - protein, 13 aa, Staphylococcus
KLKSPDGKFWKAK

SEQ ID NO: 1957547 - protein, 6 aa, Staphylococcus
KLKSQN

SEQ ID NO: 1957548 - protein, 10 aa, Staphylococcus
KLKSYPGNYE

SEQ ID NO: 1957549 - protein, 12 aa, Staphylococcus
KLKTDSYGRVQR

SEQ ID NO: 1957550 - protein, 7 aa, Staphylococcus
KLKTREH

SEQ ID NO: 1957551 - protein, 6 aa, Staphylococcus
KLLSGD

SEQ ID NO: 1957552 - protein, 6 aa, Staphylococcus
KLLSQT

SEQ ID NO: 1957553 - protein, 8 aa, Staphylococcus
KLMGQRSE

SEQ ID NO: 1957554 - protein, 7 aa, Staphylococcus
KLMPEGG

SEQ ID NO: 1957555 - protein, 8 aa, Staphylococcus
KLMPEGGS

SEQ ID NO: 1957556 - protein, 25 aa, Staphylococcus
KLNDQQYLDASRGKYGGYQANDQTM

SEQ ID NO: 1957557 - protein, 6 aa, Staphylococcus
KLNDSQ

SEQ ID NO: 1957558 - protein, 10 aa, Staphylococcus
KLNDVSKNCD

SEQ ID NO: 1957559 - protein, 7 aa, Staphylococcus
KLNEEGA

SEQ ID NO: 1957560 - protein, 7 aa, Staphylococcus
KLNEETV

SEQ ID NO: 1957561 - protein, 7 aa, Staphylococcus
KLNEEYD

SEQ ID NO: 1957562 - protein, 7 aa, Staphylococcus
KLNEEYS

SEQ ID NO: 1957563 - protein, 7 aa, Staphylococcus
KLNEGEA

SEQ ID NO: 1957564 - protein, 9 aa, Staphylococcus
KLNENQQKY

SEQ ID NO: 1957565 - protein, 7 aa, Staphylococcus
KLNGGDN

SEQ ID NO: 1957566 - protein, 7 aa, Staphylococcus
KLNGNKD

SEQ ID NO: 1957567 - protein, 8 aa, Staphylococcus
KLNIPDED

SEQ ID NO: 1957568 - protein, 4 aa, Staphylococcus
KLNK

SEQ ID NO: 1957569 - protein, 13 aa, Staphylococcus
KLNKAQRNSNQFK

SEQ ID NO: 1957570 - protein, 5 aa, Staphylococcus
KLNKF

SEQ ID NO: 1957571 - protein, 11 aa, Staphylococcus
KLNNNEQRTLN

SEQ ID NO: 1957572 - protein, 6 aa, Staphylococcus
KLNNRD

SEQ ID NO: 1957573 - protein, 8 aa, Staphylococcus
KLNPELAD

SEQ ID NO: 1957574 - protein, 7 aa, Staphylococcus
KLNPNLH

SEQ ID NO: 1957575 - protein, 18 aa, Staphylococcus
KLNQDGKDFEVTQSSDLE

SEQ ID NO: 1957576 - protein, 9 aa, Staphylococcus
KLNQEELTQ

SEQ ID NO: 1957577 - protein, 7 aa, Staphylococcus
KLNQEYQ

SEQ ID NO: 1957578 - protein, 5 aa, Staphylococcus
KLNQP

SEQ ID NO: 1957579 - protein, 8 aa, Staphylococcus
KLNQQLAE

SEQ ID NO: 1957580 - protein, 8 aa, Staphylococcus
KLNRSHGA

SEQ ID NO: 1957581 - protein, 4 aa, Staphylococcus
KLNS

SEQ ID NO: 1957582 - protein, 5 aa, Staphylococcus
KLNSK

SEQ ID NO: 1957583 - protein, 7 aa, Staphylococcus
KLNSNDD

SEQ ID NO: 1957584 - protein, 7 aa, Staphylococcus
KLNSNKD

SEQ ID NO: 1957585 - protein, 7 aa, Staphylococcus
KLNSQKE

SEQ ID NO: 1957586 - protein, 14 aa, Staphylococcus
KLNSQSPVHYRQKA

SEQ ID NO: 1957587 - protein, 9 aa, Staphylococcus
KLNTSYGKI

SEQ ID NO: 1957588 - protein, 16 aa, Staphylococcus
KLNYPDGEFWQSKMPK

SEQ ID NO: 1957589 - protein, 16 aa, Staphylococcus
KLNYPDGKFWKSKMPK

SEQ ID NO: 1957590 - protein, 11 aa, Staphylococcus
KLPDLSDRERT

SEQ ID NO: 1957591 - protein, 6 aa, Staphylococcus
KLPEDY

SEQ ID NO: 1957592 - protein, 8 aa, Staphylococcus
KLPEEGNY

SEQ ID NO: 1957593 - protein, 7 aa, Staphylococcus
KLPEKRY

SEQ ID NO: 1957594 - protein, 7 aa, Staphylococcus
KLPGLEH

SEQ ID NO: 1957595 - protein, 6 aa, Staphylococcus
KLPHYQ

SEQ ID NO: 1957596 - protein, 17 aa, Staphylococcus
KLPIGTPAMATGGMGDT

SEQ ID NO: 1957597 - protein, 9 aa, Staphylococcus
KLPLNKSEL

SEQ ID NO: 1957598 - protein, 9 aa, Staphylococcus
KLPLTNEEV

SEQ ID NO: 1957599 - protein, 5 aa, Staphylococcus
KLPNA

SEQ ID NO: 1957600 - protein, 9 aa, Staphylococcus
KLPNGNTQL

SEQ ID NO: 1957601 - protein, 9 aa, Staphylococcus
KLPNGPRPR

SEQ ID NO: 1957602 - protein, 13 aa, Staphylococcus
KLPNGQSVDEKMK

SEQ ID NO: 1957603 - protein, 12 aa, Staphylococcus
KLPPSRGLGSSA

SEQ ID NO: 1957604 - protein, 6 aa, Staphylococcus
KLPQGV

SEQ ID NO: 1957605 - protein, 8 aa, Staphylococcus
KLPSQLNN

SEQ ID NO: 1957606 - protein, 9 aa, Staphylococcus
KLPSSIKRG

SEQ ID NO: 1957607 - protein, 9 aa, Staphylococcus
KLPSSVQRG

SEQ ID NO: 1957608 - protein, 4 aa, Staphylococcus
KLPT

SEQ ID NO: 1957609 - protein, 6 aa, Staphylococcus
KLPTGV

SEQ ID NO: 1957610 - protein, 10 aa, Staphylococcus
KLPTNGKRAN

SEQ ID NO: 1957611 - protein, 5 aa, Staphylococcus
KLPTT

SEQ ID NO: 1957612 - protein, 17 aa, Staphylococcus
KLPTTGAPANFLTPNRE

SEQ ID NO: 1957613 - protein, 16 aa, Staphylococcus
KLPTTGKSADFLTPNR

SEQ ID NO: 1957614 - protein, 21 aa, Staphylococcus
KLQAAKKWNGPYINEPKIDKS

SEQ ID NO: 1957615 - protein, 17 aa, Staphylococcus
KLQEDNYTSKEKVEEAK

SEQ ID NO: 1957616 - protein, 8 aa, Staphylococcus
KLQEKAKK

SEQ ID NO: 1957617 - protein, 7 aa, Staphylococcus
KLQEKNY

SEQ ID NO: 1957618 - protein, 4 aa, Staphylococcus
KLQH

SEQ ID NO: 1957619 - protein, 7 aa, Staphylococcus
KLQKKQY

SEQ ID NO: 1957620 - protein, 9 aa, Staphylococcus
KLQKQLGKG

SEQ ID NO: 1957621 - protein, 30 aa, Staphylococcus
KLQNKKQDKKTLNKINDANSKIKKSQDLKN

SEQ ID NO: 1957622 - protein, 8 aa, Staphylococcus
KLQQKYPN

SEQ ID NO: 1957623 - protein, 8 aa, Staphylococcus
KLQQQGRL

SEQ ID NO: 1957624 - protein, 4 aa, Staphylococcus
KLQR

SEQ ID NO: 1957625 - protein, 6 aa, Staphylococcus
KLQRKQ

SEQ ID NO: 1957626 - protein, 8 aa, Staphylococcus
KLQSADKP

SEQ ID NO: 1957627 - protein, 16 aa, Staphylococcus
KLQSQDKQLKKDQIIS

SEQ ID NO: 1957628 - protein, 9 aa, Staphylococcus
KLRAGGAGI

SEQ ID NO: 1957629 - protein, 7 aa, Staphylococcus
KLRDEGY

SEQ ID NO: 1957630 - protein, 7 aa, Staphylococcus
KLRDSNK

SEQ ID NO: 1957631 - protein, 5 aa, Staphylococcus
KLRDY

SEQ ID NO: 1957632 - protein, 13 aa, Staphylococcus
KLRDYNENNHALS

SEQ ID NO: 1957633 - protein, 14 aa, Staphylococcus
KLRDYNENNHALSG

SEQ ID NO: 1957634 - protein, 7 aa, Staphylococcus
KLREARK

SEQ ID NO: 1957635 - protein, 9 aa, Staphylococcus
KLREASRLG

SEQ ID NO: 1957636 - protein, 6 aa, Staphylococcus
KLRETQ

SEQ ID NO: 1957637 - protein, 5 aa, Staphylococcus
KLRGP

SEQ ID NO: 1957638 - protein, 12 aa, Staphylococcus
KLRGSMDAAEYK

SEQ ID NO: 1957639 - protein, 4 aa, Staphylococcus
KLRN

SEQ ID NO: 1957640 - protein, 7 aa, Staphylococcus
KLRQEGA

SEQ ID NO: 1957641 - protein, 6 aa, Staphylococcus
KLRRPD

SEQ ID NO: 1957642 - protein, 11 aa, Staphylococcus
KLRSSGTYTGN

SEQ ID NO: 1957643 - protein, 10 aa, Staphylococcus
KLSDDQEEEI

SEQ ID NO: 1957644 - protein, 10 aa, Staphylococcus
KLSDDQENEI

SEQ ID NO: 1957645 - protein, 11 aa, Staphylococcus
KLSDDQENEIE

SEQ ID NO: 1957646 - protein, 10 aa, Staphylococcus
KLSDDQEQEI

SEQ ID NO: 1957647 - protein, 10 aa, Staphylococcus
KLSDDQESEI

SEQ ID NO: 1957648 - protein, 13 aa, Staphylococcus
KLSDDVKEVREQI

SEQ ID NO: 1957649 - protein, 7 aa, Staphylococcus
KLSDEGL

SEQ ID NO: 1957650 - protein, 13 aa, Staphylococcus
KLSDEIEDAVEDD

SEQ ID NO: 1957651 - protein, 11 aa, Staphylococcus
KLSDKQEEEIE

SEQ ID NO: 1957652 - protein, 5 aa, Staphylococcus
KLSDQ

SEQ ID NO: 1957653 - protein, 8 aa, Staphylococcus
KLSDTKKD

SEQ ID NO: 1957654 - protein, 8 aa, Staphylococcus
KLSEAKKE

SEQ ID NO: 1957655 - protein, 9 aa, Staphylococcus
KLSEDDVKQ

SEQ ID NO: 1957656 - protein, 8 aa, Staphylococcus
KLSEDKRV

SEQ ID NO: 1957657 - protein, 7 aa, Staphylococcus
KLSEEGF

SEQ ID NO: 1957658 - protein, 8 aa, Staphylococcus
KLSEPANT

SEQ ID NO: 1957659 - protein, 6 aa, Staphylococcus
KLSEQN

SEQ ID NO: 1957660 - protein, 5 aa, Staphylococcus
KLSES

SEQ ID NO: 1957661 - protein, 5 aa, Staphylococcus
KLSEY

SEQ ID NO: 1957662 - protein, 7 aa, Staphylococcus
KLSGEGT

SEQ ID NO: 1957663 - protein, 8 aa, Staphylococcus
KLSGGQQQ

SEQ ID NO: 1957664 - protein, 8 aa, Staphylococcus
KLSKDYNT

SEQ ID NO: 1957665 - protein, 8 aa, Staphylococcus
KLSKEGLS

SEQ ID NO: 1957666 - protein, 8 aa, Staphylococcus
KLSKKAVR

SEQ ID NO: 1957667 - protein, 7 aa, Staphylococcus
KLSKPQA

SEQ ID NO: 1957668 - protein, 11 aa, Staphylococcus
KLSKVRSTRDE

SEQ ID NO: 1957669 - protein, 7 aa, Staphylococcus
KLSLTEQ

SEQ ID NO: 1957670 - protein, 10 aa, Staphylococcus
KLSNDTSSIE

SEQ ID NO: 1957671 - protein, 15 aa, Staphylococcus
KLSNEDAYKRARPSH

SEQ ID NO: 1957672 - protein, 8 aa, Staphylococcus
KLSNEKYR

SEQ ID NO: 1957673 - protein, 7 aa, Staphylococcus
KLSNQDI

SEQ ID NO: 1957674 - protein, 6 aa, Staphylococcus
KLSNRY

SEQ ID NO: 1957675 - protein, 6 aa, Staphylococcus
KLSPIS

SEQ ID NO: 1957676 - protein, 5 aa, Staphylococcus
KLSPK

SEQ ID NO: 1957677 - protein, 10 aa, Staphylococcus
KLSPKTYEKY

SEQ ID NO: 1957678 - protein, 12 aa, Staphylococcus
KLSPRSREKYET

SEQ ID NO: 1957679 - protein, 5 aa, Staphylococcus
KLSQA

SEQ ID NO: 1957680 - protein, 13 aa, Staphylococcus
KLSQNKSEKDYTT

SEQ ID NO: 1957681 - protein, 11 aa, Staphylococcus
KLSQNRTAADY

SEQ ID NO: 1957682 - protein, 7 aa, Staphylococcus
KLSRQEQ

SEQ ID NO: 1957683 - protein, 5 aa, Staphylococcus
KLSSD

SEQ ID NO: 1957684 - protein, 12 aa, Staphylococcus
KLSSGQTVDERM

SEQ ID NO: 1957685 - protein, 5 aa, Staphylococcus
KLSSS

SEQ ID NO: 1957686 - protein, 6 aa, Staphylococcus
KLSSTL

SEQ ID NO: 1957687 - protein, 8 aa, Staphylococcus
KLSTSYGK

SEQ ID NO: 1957688 - protein, 11 aa, Staphylococcus
KLTCGKPGQEI

SEQ ID NO: 1957689 - protein, 8 aa, Staphylococcus
KLTDDRGK

SEQ ID NO: 1957690 - protein, 7 aa, Staphylococcus
KLTDKHH

SEQ ID NO: 1957691 - protein, 11 aa, Staphylococcus
KLTDQDESTRY

SEQ ID NO: 1957692 - protein, 7 aa, Staphylococcus
KLTDRFQ

SEQ ID NO: 1957693 - protein, 5 aa, Staphylococcus
KLTDV

SEQ ID NO: 1957694 - protein, 7 aa, Staphylococcus
KLTEEGL

SEQ ID NO: 1957695 - protein, 8 aa, Staphylococcus
KLTEGKEV

SEQ ID NO: 1957696 - protein, 7 aa, Staphylococcus
KLTEGTE

SEQ ID NO: 1957697 - protein, 7 aa, Staphylococcus
KLTETDY

SEQ ID NO: 1957698 - protein, 5 aa, Staphylococcus
KLTEV

SEQ ID NO: 1957699 - protein, 24 aa, Staphylococcus
KLTGEEIAKQTDVSRSTVYRIIKN

SEQ ID NO: 1957700 - protein, 6 aa, Staphylococcus
KLTGGV

SEQ ID NO: 1957701 - protein, 7 aa, Staphylococcus
KLTGGVE

SEQ ID NO: 1957702 - protein, 12 aa, Staphylococcus
KLTGHTSGMAKG

SEQ ID NO: 1957703 - protein, 13 aa, Staphylococcus
KLTGKVSNNVETY

SEQ ID NO: 1957704 - protein, 5 aa, Staphylococcus
KLTGW

SEQ ID NO: 1957705 - protein, 5 aa, Staphylococcus
KLTGY

SEQ ID NO: 1957706 - protein, 25 aa, Staphylococcus
KLTKDNKSESVEKLEATKTEIESNY

SEQ ID NO: 1957707 - protein, 6 aa, Staphylococcus
KLTKDQ

SEQ ID NO: 1957708 - protein, 25 aa, Staphylococcus
KLTKEKDNYKSAYEDEQTKHENTRK

SEQ ID NO: 1957709 - protein, 11 aa, Staphylococcus
KLTKNDIENLP

SEQ ID NO: 1957710 - protein, 6 aa, Staphylococcus
KLTKQD

SEQ ID NO: 1957711 - protein, 7 aa, Staphylococcus
KLTKQER

SEQ ID NO: 1957712 - protein, 6 aa, Staphylococcus
KLTKSQ

SEQ ID NO: 1957713 - protein, 8 aa, Staphylococcus
KLTKSTIS

SEQ ID NO: 1957714 - protein, 6 aa, Staphylococcus
KLTKTL

SEQ ID NO: 1957715 - protein, 8 aa, Staphylococcus
KLTNGNEV

SEQ ID NO: 1957716 - protein, 10 aa, Staphylococcus
KLTNGSEDAQ

SEQ ID NO: 1957717 - protein, 9 aa, Staphylococcus
KLTNKANAL

SEQ ID NO: 1957718 - protein, 6 aa, Staphylococcus
KLTNQT

SEQ ID NO: 1957719 - protein, 14 aa, Staphylococcus
KLTPAQSKNTDKNE

SEQ ID NO: 1957720 - protein, 13 aa, Staphylococcus
KLTPAQSKNTEKK

SEQ ID NO: 1957721 - protein, 14 aa, Staphylococcus
KLTPAQSKNTEKKE

SEQ ID NO: 1957722 - protein, 7 aa, Staphylococcus
KLTPENL

SEQ ID NO: 1957723 - protein, 9 aa, Staphylococcus
KLTPTATFE

SEQ ID NO: 1957724 - protein, 6 aa, Staphylococcus
KLTQEG

SEQ ID NO: 1957725 - protein, 8 aa, Staphylococcus
KLTQNNAD

SEQ ID NO: 1957726 - protein, 22 aa, Staphylococcus
KLTQNSREKKEIAKRAARQIRD

SEQ ID NO: 1957727 - protein, 6 aa, Staphylococcus
KLTQTD

SEQ ID NO: 1957728 - protein, 7 aa, Staphylococcus
KLTRQTH

SEQ ID NO: 1957729 - protein, 8 aa, Staphylococcus
KLTSDLKA

SEQ ID NO: 1957730 - protein, 18 aa, Staphylococcus
KLTSEQIQRISESGEYID

SEQ ID NO: 1957731 - protein, 4 aa, Staphylococcus
KLTT

SEQ ID NO: 1957732 - protein, 10 aa, Staphylococcus
KLTTDAGVFS

SEQ ID NO: 1957733 - protein, 8 aa, Staphylococcus
KLTTDPNM

SEQ ID NO: 1957734 - protein, 12 aa, Staphylococcus
KLTTKEINGSDA

SEQ ID NO: 1957735 - protein, 18 aa, Staphylococcus
KLTTLPDNRYSIQTEAAQ

SEQ ID NO: 1957736 - protein, 7 aa, Staphylococcus
KLTTRQA

SEQ ID NO: 1957737 - protein, 9 aa, Staphylococcus
KLTTYPGNY

SEQ ID NO: 1957738 - protein, 8 aa, Staphylococcus
KLTTYTGN

SEQ ID NO: 1957739 - protein, 15 aa, Staphylococcus
KLTYPSNHTNYTNHY

SEQ ID NO: 1957740 - protein, 8 aa, Staphylococcus
KLVEKQSE

SEQ ID NO: 1957741 - protein, 8 aa, Staphylococcus
KLVGDSPK

SEQ ID NO: 1957742 - protein, 6 aa, Staphylococcus
KLVGNQ

SEQ ID NO: 1957743 - protein, 11 aa, Staphylococcus
KLWQSKDNGFY

SEQ ID NO: 1957744 - protein, 6 aa, Staphylococcus
KLYGDD

SEQ ID NO: 1957745 - protein, 6 aa, Staphylococcus
KLYGED

SEQ ID NO: 1957746 - protein, 8 aa, Staphylococcus
KLYGKNSE

SEQ ID NO: 1957747 - protein, 17 aa, Staphylococcus
KLYKSGDIGYISSDSTL

SEQ ID NO: 1957748 - protein, 8 aa, Staphylococcus
KLYQSSKR

SEQ ID NO: 1957749 - protein, 7 aa, Staphylococcus
KMAEDKN

SEQ ID NO: 1957750 - protein, 21 aa, Staphylococcus
KMAEEQEKLKDEKVEGSAGGG

SEQ ID NO: 1957751 - protein, 6 aa, Staphylococcus
KMAERG

SEQ ID NO: 1957752 - protein, 5 aa, Staphylococcus
KMAGE

SEQ ID NO: 1957753 - protein, 5 aa, Staphylococcus
KMAKK

SEQ ID NO: 1957754 - protein, 22 aa, Staphylococcus
KMAQEQEKLKEERVAGTAGGGM

SEQ ID NO: 1957755 - protein, 14 aa, Staphylococcus
KMARQKDKGAVNET

SEQ ID NO: 1957756 - protein, 4 aa, Staphylococcus
KMDK

SEQ ID NO: 1957757 - protein, 6 aa, Staphylococcus
KMDRSN

SEQ ID NO: 1957758 - protein, 8 aa, Staphylococcus
KMDSENSV

SEQ ID NO: 1957759 - protein, 6 aa, Staphylococcus
KMDTSQ

SEQ ID NO: 1957760 - protein, 14 aa, Staphylococcus
KMEEALKGNKPSEV

SEQ ID NO: 1957761 - protein, 10 aa, Staphylococcus
KMEELEQGDE

SEQ ID NO: 1957762 - protein, 8 aa, Staphylococcus
KMEGANGD

SEQ ID NO: 1957763 - protein, 11 aa, Staphylococcus
KMEKDKRGKEE

SEQ ID NO: 1957764 - protein, 6 aa, Staphylococcus
KMEKRL

SEQ ID NO: 1957765 - protein, 7 aa, Staphylococcus
KMEKSYG

SEQ ID NO: 1957766 - protein, 19 aa, Staphylococcus
KMENRLQQQYGAPSDNLAQ

SEQ ID NO: 1957767 - protein, 5 aa, Staphylococcus
KMEQA

SEQ ID NO: 1957768 - protein, 11 aa, Staphylococcus
KMETLKNGDEL

SEQ ID NO: 1957769 - protein, 7 aa, Staphylococcus
KMGAEGI

SEQ ID NO: 1957770 - protein, 10 aa, Staphylococcus
KMGDEVGKPV

SEQ ID NO: 1957771 - protein, 7 aa, Staphylococcus
KMGENAK

SEQ ID NO: 1957772 - protein, 4 aa, Staphylococcus
KMGR

SEQ ID NO: 1957773 - protein, 17 aa, Staphylococcus
KMGRKEHKLTTEEREDF

SEQ ID NO: 1957774 - protein, 18 aa, Staphylococcus
KMGRKSHALTPQEKETYE

SEQ ID NO: 1957775 - protein, 21 aa, Staphylococcus
KMHSRAKGALNNANEALNDKT

SEQ ID NO: 1957776 - protein, 8 aa, Staphylococcus
KMIDPQSA

SEQ ID NO: 1957777 - protein, 7 aa, Staphylococcus
KMINPES

SEQ ID NO: 1957778 - protein, 17 aa, Staphylococcus
KMKAEKAKQQDNNENTV

SEQ ID NO: 1957779 - protein, 4 aa, Staphylococcus
KMKE

SEQ ID NO: 1957780 - protein, 5 aa, Staphylococcus
KMKEI

SEQ ID NO: 1957781 - protein, 7 aa, Staphylococcus
KMKEKQR

SEQ ID NO: 1957782 - protein, 6 aa, Staphylococcus
KMKEVD

SEQ ID NO: 1957783 - protein, 7 aa, Staphylococcus
KMKEVDD

SEQ ID NO: 1957784 - protein, 6 aa, Staphylococcus
KMKEVN

SEQ ID NO: 1957785 - protein, 8 aa, Staphylococcus
KMKQDPLG

SEQ ID NO: 1957786 - protein, 9 aa, Staphylococcus
KMKQDPLGD

SEQ ID NO: 1957787 - protein, 6 aa, Staphylococcus
KMKQPP

SEQ ID NO: 1957788 - protein, 8 aa, Staphylococcus
KMKRDPLG

SEQ ID NO: 1957789 - protein, 6 aa, Staphylococcus
KMNEAA

SEQ ID NO: 1957790 - protein, 12 aa, Staphylococcus
KMNERSGKYEGM

SEQ ID NO: 1957791 - protein, 7 aa, Staphylococcus
KMNLPTK

SEQ ID NO: 1957792 - protein, 11 aa, Staphylococcus
KMNRDQKTQYE

SEQ ID NO: 1957793 - protein, 11 aa, Staphylococcus
KMNTLDNGEEL

SEQ ID NO: 1957794 - protein, 6 aa, Staphylococcus
KMPNRK

SEQ ID NO: 1957795 - protein, 6 aa, Staphylococcus
KMPNSH

SEQ ID NO: 1957796 - protein, 6 aa, Staphylococcus
KMPTDI

SEQ ID NO: 1957797 - protein, 12 aa, Staphylococcus
KMQDLNAADEEA

SEQ ID NO: 1957798 - protein, 11 aa, Staphylococcus
KMQESSESLDF

SEQ ID NO: 1957799 - protein, 6 aa, Staphylococcus
KMQEVD

SEQ ID NO: 1957800 - protein, 10 aa, Staphylococcus
KMQGDPNQPI

SEQ ID NO: 1957801 - protein, 9 aa, Staphylococcus
KMQGEPNQP

SEQ ID NO: 1957802 - protein, 9 aa, Staphylococcus
KMQSQPNKR

SEQ ID NO: 1957803 - protein, 11 aa, Staphylococcus
KMQTLDAGDEL

SEQ ID NO: 1957804 - protein, 11 aa, Staphylococcus
KMQTLDNGDEL

SEQ ID NO: 1957805 - protein, 6 aa, Staphylococcus
KMREER

SEQ ID NO: 1957806 - protein, 6 aa, Staphylococcus
KMSEDL

SEQ ID NO: 1957807 - protein, 6 aa, Staphylococcus
KMSERH

SEQ ID NO: 1957808 - protein, 8 aa, Staphylococcus
KMSEYTKK

SEQ ID NO: 1957809 - protein, 13 aa, Staphylococcus
KMSGQTAQAYKAR

SEQ ID NO: 1957810 - protein, 8 aa, Staphylococcus
KMSKDGKH

SEQ ID NO: 1957811 - protein, 7 aa, Staphylococcus
KMSKDTR

SEQ ID NO: 1957812 - protein, 5 aa, Staphylococcus
KMSQG

SEQ ID NO: 1957813 - protein, 12 aa, Staphylococcus
KMSRRKKTAANK

SEQ ID NO: 1957814 - protein, 6 aa, Staphylococcus
KMTAAA

SEQ ID NO: 1957815 - protein, 6 aa, Staphylococcus
KMTEKD

SEQ ID NO: 1957816 - protein, 11 aa, Staphylococcus
KMTELDSGDEL

SEQ ID NO: 1957817 - protein, 15 aa, Staphylococcus
KMTKAGNSCGKCKGQ

SEQ ID NO: 1957818 - protein, 16 aa, Staphylococcus
KMTKAGNSCGKCKGQI

SEQ ID NO: 1957819 - protein, 17 aa, Staphylococcus
KMTKPETNSNEETNSAM

SEQ ID NO: 1957820 - protein, 9 aa, Staphylococcus
KMTNEKSAR

SEQ ID NO: 1957821 - protein, 7 aa, Staphylococcus
KMTQTDY

SEQ ID NO: 1957822 - protein, 5 aa, Staphylococcus
KMYDN

SEQ ID NO: 1957823 - protein, 13 aa, Staphylococcus
KNAAAGLNLGGGK

SEQ ID NO: 1957824 - protein, 7 aa, Staphylococcus
KNAAEGI

SEQ ID NO: 1957825 - protein, 10 aa, Staphylococcus
KNAAEKGKQV

SEQ ID NO: 1957826 - protein, 15 aa, Staphylococcus
KNADLDDHAKAEVDK

SEQ ID NO: 1957827 - protein, 5 aa, Staphylococcus
KNADY

SEQ ID NO: 1957828 - protein, 7 aa, Staphylococcus
KNAEAVA

SEQ ID NO: 1957829 - protein, 10 aa, Staphylococcus
KNAEETENGV

SEQ ID NO: 1957830 - protein, 18 aa, Staphylococcus
KNAEEVAKLRGKSVEELY

SEQ ID NO: 1957831 - protein, 20 aa, Staphylococcus
KNAEKYPVEKSKNNNSKYDE

SEQ ID NO: 1957832 - protein, 5 aa, Staphylococcus
KNAEP

SEQ ID NO: 1957833 - protein, 24 aa, Staphylococcus
KNAEVSASVNHKERRSIKKNHSAT

SEQ ID NO: 1957834 - protein, 9 aa, Staphylococcus
KNAFEEAEK

SEQ ID NO: 1957835 - protein, 8 aa, Staphylococcus
KNAGKTTL

SEQ ID NO: 1957836 - protein, 5 aa, Staphylococcus
KNAGQ

SEQ ID NO: 1957837 - protein, 5 aa, Staphylococcus
KNAGV

SEQ ID NO: 1957838 - protein, 9 aa, Staphylococcus
KNAHKRRSM

SEQ ID NO: 1957839 - protein, 13 aa, Staphylococcus
KNAHNEKADITQQ

SEQ ID NO: 1957840 - protein, 11 aa, Staphylococcus
KNAIKSNDSVL

SEQ ID NO: 1957841 - protein, 6 aa, Staphylococcus
KNAKAG

SEQ ID NO: 1957842 - protein, 26 aa, Staphylococcus
KNAKDGNDSVIKENTEKFVGKFKTIR

SEQ ID NO: 1957843 - protein, 26 aa, Staphylococcus
KNAKDGNDTVIKENTEKFVRKFQTVS

SEQ ID NO: 1957844 - protein, 7 aa, Staphylococcus
KNAKRNQ

SEQ ID NO: 1957845 - protein, 16 aa, Staphylococcus
KNAKTAINNNADNKAE

SEQ ID NO: 1957846 - protein, 9 aa, Staphylococcus
KNANKDADI

SEQ ID NO: 1957847 - protein, 9 aa, Staphylococcus
KNANKDANI

SEQ ID NO: 1957848 - protein, 6 aa, Staphylococcus
KNAPIT

SEQ ID NO: 1957849 - protein, 7 aa, Staphylococcus
KNAPKGS

SEQ ID NO: 1957850 - protein, 7 aa, Staphylococcus
KNAQIDD

SEQ ID NO: 1957851 - protein, 6 aa, Staphylococcus
KNARNL

SEQ ID NO: 1957852 - protein, 10 aa, Staphylococcus
KNASDNASDL

SEQ ID NO: 1957853 - protein, 10 aa, Staphylococcus
KNASDNASEI

SEQ ID NO: 1957854 - protein, 20 aa, Staphylococcus
KNASEFKQKMSDAGFASEGN

SEQ ID NO: 1957855 - protein, 7 aa, Staphylococcus
KNASISF

SEQ ID NO: 1957856 - protein, 9 aa, Staphylococcus
KNASKIGDE

SEQ ID NO: 1957857 - protein, 10 aa, Staphylococcus
KNASKIGDEY

SEQ ID NO: 1957858 - protein, 15 aa, Staphylococcus
KNASPEKLNRKNLTR

SEQ ID NO: 1957859 - protein, 7 aa, Staphylococcus
KNASQAI

SEQ ID NO: 1957860 - protein, 8 aa, Staphylococcus
KNASTGSW

SEQ ID NO: 1957861 - protein, 5 aa, Staphylococcus
KNATL

SEQ ID NO: 1957862 - protein, 9 aa, Staphylococcus
KNATNTEVY

SEQ ID NO: 1957863 - protein, 7 aa, Staphylococcus
KNAYTGG

SEQ ID NO: 1957864 - protein, 4 aa, Staphylococcus
KNCK

SEQ ID NO: 1957865 - protein, 7 aa, Staphylococcus
KNCPYNN

SEQ ID NO: 1957866 - protein, 6 aa, Staphylococcus
KNCQEE

SEQ ID NO: 1957867 - protein, 8 aa, Staphylococcus
KNDDGYYP

SEQ ID NO: 1957868 - protein, 6 aa, Staphylococcus
KNDDIY

SEQ ID NO: 1957869 - protein, 7 aa, Staphylococcus
KNDDKPL

SEQ ID NO: 1957870 - protein, 7 aa, Staphylococcus
KNDDVYA

SEQ ID NO: 1957871 - protein, 8 aa, Staphylococcus
KNDELTPI

SEQ ID NO: 1957872 - protein, 8 aa, Staphylococcus
KNDENGTI

SEQ ID NO: 1957873 - protein, 5 aa, Staphylococcus
KNDEV

SEQ ID NO: 1957874 - protein, 7 aa, Staphylococcus
KNDFGED

SEQ ID NO: 1957875 - protein, 25 aa, Staphylococcus
KNDFTDEEAYSQLQTSIRNNEIPSP

SEQ ID NO: 1957876 - protein, 8 aa, Staphylococcus
KNDGKSAI

SEQ ID NO: 1957877 - protein, 9 aa, Staphylococcus
KNDGQGEEI

SEQ ID NO: 1957878 - protein, 51 aa, Staphylococcus
KNDGSLPSNTLTAKGVAKVEGDKDYASTINSPLEYNPKLAKENWKKAKREL

SEQ ID NO: 1957879 - protein, 24 aa, Staphylococcus
KNDGYQSDKSKATLEQKQQQLSEI

SEQ ID NO: 1957880 - protein, 23 aa, Staphylococcus
KNDGYQSDKSKETLTQKQARLSE

SEQ ID NO: 1957881 - protein, 23 aa, Staphylococcus
KNDGYQSEASKQTLTEKKQRLDQ

SEQ ID NO: 1957882 - protein, 16 aa, Staphylococcus
KNDGYQSEKSRHTLKQ

SEQ ID NO: 1957883 - protein, 24 aa, Staphylococcus
KNDGYQSEKSRQTLKDKEVQKQAL

SEQ ID NO: 1957884 - protein, 19 aa, Staphylococcus
KNDGYQSENSRITLTEKQE

SEQ ID NO: 1957885 - protein, 15 aa, Staphylococcus
KNDGYRSENSRQTLV

SEQ ID NO: 1957886 - protein, 9 aa, Staphylococcus
KNDHSTLNE

SEQ ID NO: 1957887 - protein, 12 aa, Staphylococcus
KNDIPQTASYKG

SEQ ID NO: 1957888 - protein, 7 aa, Staphylococcus
KNDKDEV

SEQ ID NO: 1957889 - protein, 6 aa, Staphylococcus
KNDKEF

SEQ ID NO: 1957890 - protein, 8 aa, Staphylococcus
KNDKKDVA

SEQ ID NO: 1957891 - protein, 6 aa, Staphylococcus
KNDKRK

SEQ ID NO: 1957892 - protein, 5 aa, Staphylococcus
KNDKS

SEQ ID NO: 1957893 - protein, 8 aa, Staphylococcus
KNDKYGSE

SEQ ID NO: 1957894 - protein, 14 aa, Staphylococcus
KNDLAQLERQFIRV

SEQ ID NO: 1957895 - protein, 10 aa, Staphylococcus
KNDLKPKDIV

SEQ ID NO: 1957896 - protein, 9 aa, Staphylococcus
KNDNAQGEY

SEQ ID NO: 1957897 - protein, 9 aa, Staphylococcus
KNDNAQSEY

SEQ ID NO: 1957898 - protein, 10 aa, Staphylococcus
KNDNGQENLS

SEQ ID NO: 1957899 - protein, 8 aa, Staphylococcus
KNDNKTSF

SEQ ID NO: 1957900 - protein, 5 aa, Staphylococcus
KNDPF

SEQ ID NO: 1957901 - protein, 11 aa, Staphylococcus
KNDPFGEYGRG

SEQ ID NO: 1957902 - protein, 6 aa, Staphylococcus
KNDPIV

SEQ ID NO: 1957903 - protein, 8 aa, Staphylococcus
KNDPQGEA

SEQ ID NO: 1957904 - protein, 6 aa, Staphylococcus
KNDPSL

SEQ ID NO: 1957905 - protein, 7 aa, Staphylococcus
KNDPTDM

SEQ ID NO: 1957906 - protein, 9 aa, Staphylococcus
KNDSATGYT

SEQ ID NO: 1957907 - protein, 8 aa, Staphylococcus
KNDSDDAA

SEQ ID NO: 1957908 - protein, 6 aa, Staphylococcus
KNDSNQ

SEQ ID NO: 1957909 - protein, 13 aa, Staphylococcus
KNDSNRPNANNKS

SEQ ID NO: 1957910 - protein, 15 aa, Staphylococcus
KNDSNRPNASNKAFD

SEQ ID NO: 1957911 - protein, 12 aa, Staphylococcus
KNDSQEFDTEED

SEQ ID NO: 1957912 - protein, 8 aa, Staphylococcus
KNDSTQLK

SEQ ID NO: 1957913 - protein, 4 aa, Staphylococcus
KNDT

SEQ ID NO: 1957914 - protein, 13 aa, Staphylococcus
KNDTASLKSEAEE

SEQ ID NO: 1957915 - protein, 7 aa, Staphylococcus
KNDTEHS

SEQ ID NO: 1957916 - protein, 7 aa, Staphylococcus
KNDTNDV

SEQ ID NO: 1957917 - protein, 11 aa, Staphylococcus
KNDTVNGKQQK

SEQ ID NO: 1957918 - protein, 4 aa, Staphylococcus
KNDV

SEQ ID NO: 1957919 - protein, 11 aa, Staphylococcus
KNDVKADKDYL

SEQ ID NO: 1957920 - protein, 13 aa, Staphylococcus
KNDVSETTVKRIK

SEQ ID NO: 1957921 - protein, 8 aa, Staphylococcus
KNDVSQNA

SEQ ID NO: 1957922 - protein, 10 aa, Staphylococcus
KNDVTQSDVE

SEQ ID NO: 1957923 - protein, 4 aa, Staphylococcus
KNDY

SEQ ID NO: 1957924 - protein, 5 aa, Staphylococcus
KNDYN

SEQ ID NO: 1957925 - protein, 6 aa, Staphylococcus
KNEAGD

SEQ ID NO: 1957926 - protein, 8 aa, Staphylococcus
KNEDAHLS

SEQ ID NO: 1957927 - protein, 6 aa, Staphylococcus
KNEDIA

SEQ ID NO: 1957928 - protein, 6 aa, Staphylococcus
KNEDTV

SEQ ID NO: 1957929 - protein, 10 aa, Staphylococcus
KNEDYRDQNI

SEQ ID NO: 1957930 - protein, 4 aa, Staphylococcus
KNEE

SEQ ID NO: 1957931 - protein, 8 aa, Staphylococcus
KNEEDRER

SEQ ID NO: 1957932 - protein, 8 aa, Staphylococcus
KNEEEEMS

SEQ ID NO: 1957933 - protein, 7 aa, Staphylococcus
KNEEKTA

SEQ ID NO: 1957934 - protein, 12 aa, Staphylococcus
KNEETTLTPKEM

SEQ ID NO: 1957935 - protein, 8 aa, Staphylococcus
KNEEYRDF

SEQ ID NO: 1957936 - protein, 5 aa, Staphylococcus
KNEGA

SEQ ID NO: 1957937 - protein, 4 aa, Staphylococcus
KNEI

SEQ ID NO: 1957938 - protein, 6 aa, Staphylococcus
KNEIST

SEQ ID NO: 1957939 - protein, 6 aa, Staphylococcus
KNEITQ

SEQ ID NO: 1957940 - protein, 6 aa, Staphylococcus
KNEITS

SEQ ID NO: 1957941 - protein, 9 aa, Staphylococcus
KNEKALKEV

SEQ ID NO: 1957942 - protein, 9 aa, Staphylococcus
KNEKFNSKE

SEQ ID NO: 1957943 - protein, 5 aa, Staphylococcus
KNEKN

SEQ ID NO: 1957944 - protein, 10 aa, Staphylococcus
KNEKPARGKA

SEQ ID NO: 1957945 - protein, 5 aa, Staphylococcus
KNEKQ

SEQ ID NO: 1957946 - protein, 7 aa, Staphylococcus
KNEKQRM

SEQ ID NO: 1957947 - protein, 7 aa, Staphylococcus
KNEKSGI

SEQ ID NO: 1957948 - protein, 13 aa, Staphylococcus
KNELDLGDFKTCQ

SEQ ID NO: 1957949 - protein, 5 aa, Staphylococcus
KNELE

SEQ ID NO: 1957950 - protein, 12 aa, Staphylococcus
KNELGDGVCSDE

SEQ ID NO: 1957951 - protein, 6 aa, Staphylococcus
KNELHS

SEQ ID NO: 1957952 - protein, 17 aa, Staphylococcus
KNELKTPDDAQKEANDF

SEQ ID NO: 1957953 - protein, 18 aa, Staphylococcus
KNELKTPDDAQKEANNYH

SEQ ID NO: 1957954 - protein, 16 aa, Staphylococcus
KNELKTPEDAINEAND

SEQ ID NO: 1957955 - protein, 17 aa, Staphylococcus
KNELKTPEDAMKEANDF

SEQ ID NO: 1957956 - protein, 17 aa, Staphylococcus
KNELKTPEDAQKEANDF

SEQ ID NO: 1957957 - protein, 18 aa, Staphylococcus
KNELKTPEDAQKEANDYH

SEQ ID NO: 1957958 - protein, 8 aa, Staphylococcus
KNELSKEE

SEQ ID NO: 1957959 - protein, 9 aa, Staphylococcus
KNELTKDEV

SEQ ID NO: 1957960 - protein, 15 aa, Staphylococcus
KNELYNEEQKTLSEE

SEQ ID NO: 1957961 - protein, 9 aa, Staphylococcus
KNEMSEVAG

SEQ ID NO: 1957962 - protein, 7 aa, Staphylococcus
KNENEKL

SEQ ID NO: 1957963 - protein, 14 aa, Staphylococcus
KNENITDDETLDEE

SEQ ID NO: 1957964 - protein, 16 aa, Staphylococcus
KNENKAQQVTNRKSEY

SEQ ID NO: 1957965 - protein, 7 aa, Staphylococcus
KNENKKP

SEQ ID NO: 1957966 - protein, 9 aa, Staphylococcus
KNENNKIGD

SEQ ID NO: 1957967 - protein, 6 aa, Staphylococcus
KNENPS

SEQ ID NO: 1957968 - protein, 8 aa, Staphylococcus
KNENVQHP

SEQ ID NO: 1957969 - protein, 8 aa, Staphylococcus
KNENVTDD

SEQ ID NO: 1957970 - protein, 6 aa, Staphylococcus
KNENYS

SEQ ID NO: 1957971 - protein, 10 aa, Staphylococcus
KNEPLPDKMP

SEQ ID NO: 1957972 - protein, 7 aa, Staphylococcus
KNEQNEQ

SEQ ID NO: 1957973 - protein, 7 aa, Staphylococcus
KNEQNEV

SEQ ID NO: 1957974 - protein, 26 aa, Staphylococcus
KNEQYVSTNNNQQPTNSNETIQGQSQ

SEQ ID NO: 1957975 - protein, 6 aa, Staphylococcus
KNERFA

SEQ ID NO: 1957976 - protein, 8 aa, Staphylococcus
KNERKFNR

SEQ ID NO: 1957977 - protein, 37 aa, Staphylococcus
KNERNDFSKEDTSNQNEANENVNTYDSQKQQRREQRK

SEQ ID NO: 1957978 - protein, 7 aa, Staphylococcus
KNERTIY

SEQ ID NO: 1957979 - protein, 10 aa, Staphylococcus
KNERTNNYYK

SEQ ID NO: 1957980 - protein, 8 aa, Staphylococcus
KNERTNTE

SEQ ID NO: 1957981 - protein, 6 aa, Staphylococcus
KNESNF

SEQ ID NO: 1957982 - protein, 5 aa, Staphylococcus
KNESQ

SEQ ID NO: 1957983 - protein, 7 aa, Staphylococcus
KNETDAE

SEQ ID NO: 1957984 - protein, 6 aa, Staphylococcus
KNETEK

SEQ ID NO: 1957985 - protein, 17 aa, Staphylococcus
KNETNKNRPFNCKESKD

SEQ ID NO: 1957986 - protein, 20 aa, Staphylococcus
KNEVGPPPWTLEDSKEKFNQ

SEQ ID NO: 1957987 - protein, 10 aa, Staphylococcus
KNEVKQQIDD

SEQ ID NO: 1957988 - protein, 15 aa, Staphylococcus
KNEVTPRVQTESKEF

SEQ ID NO: 1957989 - protein, 6 aa, Staphylococcus
KNEYGG

SEQ ID NO: 1957990 - protein, 10 aa, Staphylococcus
KNEYKTDEVK

SEQ ID NO: 1957991 - protein, 6 aa, Staphylococcus
KNFAEI

SEQ ID NO: 1957992 - protein, 4 aa, Staphylococcus
KNFE

SEQ ID NO: 1957993 - protein, 14 aa, Staphylococcus
KNFEKVKDQTPNEK

SEQ ID NO: 1957994 - protein, 8 aa, Staphylococcus
KNFGQGMS

SEQ ID NO: 1957995 - protein, 10 aa, Staphylococcus
KNFGQGMSGG

SEQ ID NO: 1957996 - protein, 8 aa, Staphylococcus
KNFNKEDI

SEQ ID NO: 1957997 - protein, 8 aa, Staphylococcus
KNFNKGDL

SEQ ID NO: 1957998 - protein, 11 aa, Staphylococcus
KNFPRNETSSI

SEQ ID NO: 1957999 - protein, 4 aa, Staphylococcus
KNFQ

SEQ ID NO: 1958000 - protein, 5 aa, Staphylococcus
KNFQQ

SEQ ID NO: 1958001 - protein, 14 aa, Staphylococcus
KNFSISDKNQDDVF

SEQ ID NO: 1958002 - protein, 6 aa, Staphylococcus
KNFSSQ

SEQ ID NO: 1958003 - protein, 8 aa, Staphylococcus
KNGAGKST

SEQ ID NO: 1958004 - protein, 7 aa, Staphylococcus
KNGALPK

SEQ ID NO: 1958005 - protein, 5 aa, Staphylococcus
KNGAQ

SEQ ID NO: 1958006 - protein, 5 aa, Staphylococcus
KNGCH

SEQ ID NO: 1958007 - protein, 5 aa, Staphylococcus
KNGCP

SEQ ID NO: 1958008 - protein, 8 aa, Staphylococcus
KNGDETNH

SEQ ID NO: 1958009 - protein, 6 aa, Staphylococcus
KNGDKV

SEQ ID NO: 1958010 - protein, 9 aa, Staphylococcus
KNGDPRAKY

SEQ ID NO: 1958011 - protein, 7 aa, Staphylococcus
KNGDSQI

SEQ ID NO: 1958012 - protein, 25 aa, Staphylococcus
KNGEAHTIAQPATDGSGDLTDDSTI

SEQ ID NO: 1958013 - protein, 24 aa, Staphylococcus
KNGEANIATNTEGQSNVTKGDSTI

SEQ ID NO: 1958014 - protein, 25 aa, Staphylococcus
KNGEAQIKAKSTTDGSGTSADDSTI

SEQ ID NO: 1958015 - protein, 8 aa, Staphylococcus
KNGEGHRN

SEQ ID NO: 1958016 - protein, 6 aa, Staphylococcus
KNGEHE

SEQ ID NO: 1958017 - protein, 6 aa, Staphylococcus
KNGEID

SEQ ID NO: 1958018 - protein, 7 aa, Staphylococcus
KNGEIKP

SEQ ID NO: 1958019 - protein, 27 aa, Staphylococcus
KNGELKPIKAHDTRRTRQRKDDHLTNE

SEQ ID NO: 1958020 - protein, 27 aa, Staphylococcus
KNGELKPIKAHNTRHKRERKDDHLTNQ

SEQ ID NO: 1958021 - protein, 10 aa, Staphylococcus
KNGERNSEKI

SEQ ID NO: 1958022 - protein, 8 aa, Staphylococcus
KNGETGYP

SEQ ID NO: 1958023 - protein, 4 aa, Staphylococcus
KNGF

SEQ ID NO: 1958024 - protein, 5 aa, Staphylococcus
KNGGF

SEQ ID NO: 1958025 - protein, 6 aa, Staphylococcus
KNGGPW

SEQ ID NO: 1958026 - protein, 5 aa, Staphylococcus
KNGGT

SEQ ID NO: 1958027 - protein, 4 aa, Staphylococcus
KNGH

SEQ ID NO: 1958028 - protein, 6 aa, Staphylococcus
KNGIDM

SEQ ID NO: 1958029 - protein, 6 aa, Staphylococcus
KNGIQT

SEQ ID NO: 1958030 - protein, 6 aa, Staphylococcus
KNGKGI

SEQ ID NO: 1958031 - protein, 29 aa, Staphylococcus
KNGKIDQKKLSQLARKQRNSDSSVKANNL

SEQ ID NO: 1958032 - protein, 8 aa, Staphylococcus
KNGKIEIQ

SEQ ID NO: 1958033 - protein, 6 aa, Staphylococcus
KNGKIR

SEQ ID NO: 1958034 - protein, 8 aa, Staphylococcus
KNGKPRIT

SEQ ID NO: 1958035 - protein, 17 aa, Staphylococcus
KNGKQSQKEAQKRLNER

SEQ ID NO: 1958036 - protein, 30 aa, Staphylococcus
KNGKQSQKEAQKRLNERIDEKLNNKTPTTL

SEQ ID NO: 1958037 - protein, 12 aa, Staphylococcus
KNGKQSQKEAQR

SEQ ID NO: 1958038 - protein, 15 aa, Staphylococcus
KNGKQSQKEAQRRLN

SEQ ID NO: 1958039 - protein, 7 aa, Staphylococcus
KNGKQVG

SEQ ID NO: 1958040 - protein, 7 aa, Staphylococcus
KNGKSLD

SEQ ID NO: 1958041 - protein, 8 aa, Staphylococcus
KNGKTRIT

SEQ ID NO: 1958042 - protein, 8 aa, Staphylococcus
KNGKTTNI

SEQ ID NO: 1958043 - protein, 6 aa, Staphylococcus
KNGLEQ

SEQ ID NO: 1958044 - protein, 7 aa, Staphylococcus
KNGLTSV

SEQ ID NO: 1958045 - protein, 9 aa, Staphylococcus
KNGNETTQV

SEQ ID NO: 1958046 - protein, 16 aa, Staphylococcus
KNGNEVFTKCTKDLII

SEQ ID NO: 1958047 - protein, 10 aa, Staphylococcus
KNGNFDDDKL

SEQ ID NO: 1958048 - protein, 8 aa, Staphylococcus
KNGNFSEE

SEQ ID NO: 1958049 - protein, 14 aa, Staphylococcus
KNGNIYQDSSIGTG

SEQ ID NO: 1958050 - protein, 5 aa, Staphylococcus
KNGNK

SEQ ID NO: 1958051 - protein, 8 aa, Staphylococcus
KNGNMSID

SEQ ID NO: 1958052 - protein, 9 aa, Staphylococcus
KNGPYAGQT

SEQ ID NO: 1958053 - protein, 6 aa, Staphylococcus
KNGQFE

SEQ ID NO: 1958054 - protein, 7 aa, Staphylococcus
KNGQRGR

SEQ ID NO: 1958055 - protein, 5 aa, Staphylococcus
KNGRE

SEQ ID NO: 1958056 - protein, 8 aa, Staphylococcus
KNGRELEP

SEQ ID NO: 1958057 - protein, 15 aa, Staphylococcus
KNGRELKSDEMDQTR

SEQ ID NO: 1958058 - protein, 15 aa, Staphylococcus
KNGRELTSSEMSQRR

SEQ ID NO: 1958059 - protein, 5 aa, Staphylococcus
KNGRR

SEQ ID NO: 1958060 - protein, 8 aa, Staphylococcus
KNGSGKST

SEQ ID NO: 1958061 - protein, 14 aa, Staphylococcus
KNGSLTGYGGTLPN

SEQ ID NO: 1958062 - protein, 5 aa, Staphylococcus
KNGSN

SEQ ID NO: 1958063 - protein, 9 aa, Staphylococcus
KNGSNEGYI

SEQ ID NO: 1958064 - protein, 6 aa, Staphylococcus
KNGTEY

SEQ ID NO: 1958065 - protein, 9 aa, Staphylococcus
KNGTLDEAY

SEQ ID NO: 1958066 - protein, 10 aa, Staphylococcus
KNGTLQTKDM

SEQ ID NO: 1958067 - protein, 7 aa, Staphylococcus
KNGTQIQ

SEQ ID NO: 1958068 - protein, 4 aa, Staphylococcus
KNGV

SEQ ID NO: 1958069 - protein, 11 aa, Staphylococcus
KNGVDKAGGMP

SEQ ID NO: 1958070 - protein, 5 aa, Staphylococcus
KNGVR

SEQ ID NO: 1958071 - protein, 5 aa, Staphylococcus
KNGYD

SEQ ID NO: 1958072 - protein, 9 aa, Staphylococcus
KNGYDENLS

SEQ ID NO: 1958073 - protein, 7 aa, Staphylococcus
KNGYIEN

SEQ ID NO: 1958074 - protein, 6 aa, Staphylococcus
KNGYIN

SEQ ID NO: 1958075 - protein, 5 aa, Staphylococcus
KNGYK

SEQ ID NO: 1958076 - protein, 6 aa, Staphylococcus
KNGYLA

SEQ ID NO: 1958077 - protein, 9 aa, Staphylococcus
KNGYTYNNN

SEQ ID NO: 1958078 - protein, 6 aa, Staphylococcus
KNGYYN

SEQ ID NO: 1958079 - protein, 8 aa, Staphylococcus
KNHDAKRT

SEQ ID NO: 1958080 - protein, 4 aa, Staphylococcus
KNHE

SEQ ID NO: 1958081 - protein, 8 aa, Staphylococcus
KNHEREAE

SEQ ID NO: 1958082 - protein, 20 aa, Staphylococcus
KNHKYSAYKRTIGKVSNYVL

SEQ ID NO: 1958083 - protein, 7 aa, Staphylococcus
KNHPGDL

SEQ ID NO: 1958084 - protein, 5 aa, Staphylococcus
KNHPN

SEQ ID NO: 1958085 - protein, 6 aa, Staphylococcus
KNHPNV

SEQ ID NO: 1958086 - protein, 25 aa, Staphylococcus
KNHSGSKATTIKEKISNTNTVKNAI

SEQ ID NO: 1958087 - protein, 11 aa, Staphylococcus
KNHSIESKSQF

SEQ ID NO: 1958088 - protein, 5 aa, Staphylococcus
KNHSP

SEQ ID NO: 1958089 - protein, 9 aa, Staphylococcus
KNHTPLREL

SEQ ID NO: 1958090 - protein, 9 aa, Staphylococcus
KNHTPLSEL

SEQ ID NO: 1958091 - protein, 12 aa, Staphylococcus
KNHTRSDETIAF

SEQ ID NO: 1958092 - protein, 4 aa, Staphylococcus
KNHY

SEQ ID NO: 1958093 - protein, 15 aa, Staphylococcus
KNIAKTQDLQQEDGN

SEQ ID NO: 1958094 - protein, 7 aa, Staphylococcus
KNIDASD

SEQ ID NO: 1958095 - protein, 9 aa, Staphylococcus
KNIDESSSE

SEQ ID NO: 1958096 - protein, 23 aa, Staphylococcus
KNIDGSKNIDEVTSDVIDILNHL

SEQ ID NO: 1958097 - protein, 13 aa, Staphylococcus
KNIEEAKAQNIKA

SEQ ID NO: 1958098 - protein, 14 aa, Staphylococcus
KNIENSTRGHDSED

SEQ ID NO: 1958099 - protein, 6 aa, Staphylococcus
KNIESQ

SEQ ID NO: 1958100 - protein, 5 aa, Staphylococcus
KNIGD

SEQ ID NO: 1958101 - protein, 6 aa, Staphylococcus
KNIGGH

SEQ ID NO: 1958102 - protein, 6 aa, Staphylococcus
KNIIDE

SEQ ID NO: 1958103 - protein, 6 aa, Staphylococcus
KNIKAE

SEQ ID NO: 1958104 - protein, 6 aa, Staphylococcus
KNIKEE

SEQ ID NO: 1958105 - protein, 13 aa, Staphylococcus
KNIKHSSELSENA

SEQ ID NO: 1958106 - protein, 12 aa, Staphylococcus
KNIKKKKNDKIQ

SEQ ID NO: 1958107 - protein, 5 aa, Staphylococcus
KNIKN

SEQ ID NO: 1958108 - protein, 9 aa, Staphylococcus
KNIKNNEKA

SEQ ID NO: 1958109 - protein, 8 aa, Staphylococcus
KNIKNNNM

SEQ ID NO: 1958110 - protein, 6 aa, Staphylococcus
KNIKQE

SEQ ID NO: 1958111 - protein, 7 aa, Staphylococcus
KNIKQVQ

SEQ ID NO: 1958112 - protein, 6 aa, Staphylococcus
KNIKTD

SEQ ID NO: 1958113 - protein, 6 aa, Staphylococcus
KNIKYS

SEQ ID NO: 1958114 - protein, 6 aa, Staphylococcus
KNINDD

SEQ ID NO: 1958115 - protein, 10 aa, Staphylococcus
KNINKNRNDY

SEQ ID NO: 1958116 - protein, 12 aa, Staphylococcus
KNINKNRNKGLN

SEQ ID NO: 1958117 - protein, 6 aa, Staphylococcus
KNINNA

SEQ ID NO: 1958118 - protein, 4 aa, Staphylococcus
KNIP

SEQ ID NO: 1958119 - protein, 7 aa, Staphylococcus
KNIPKGK

SEQ ID NO: 1958120 - protein, 10 aa, Staphylococcus
KNIPNEDRQS

SEQ ID NO: 1958121 - protein, 10 aa, Staphylococcus
KNIPTAKDEA

SEQ ID NO: 1958122 - protein, 11 aa, Staphylococcus
KNIPTAKEEDV

SEQ ID NO: 1958123 - protein, 9 aa, Staphylococcus
KNIPTSKEE

SEQ ID NO: 1958124 - protein, 11 aa, Staphylococcus
KNIPTSKNESV

SEQ ID NO: 1958125 - protein, 65 aa, Staphylococcus
KNIQTSSVTHDNKESQNLGLQNPKFRDSRNSKFGTPESQILDPNDTDYNNTDYNNTDYNDTYDLN

SEQ ID NO: 1958126 - protein, 4 aa, Staphylococcus
KNIR

SEQ ID NO: 1958127 - protein, 6 aa, Staphylococcus
KNIRSN

SEQ ID NO: 1958128 - protein, 9 aa, Staphylococcus
KNISDENEK

SEQ ID NO: 1958129 - protein, 13 aa, Staphylococcus
KNISESNYFSEQD

SEQ ID NO: 1958130 - protein, 5 aa, Staphylococcus
KNISR

SEQ ID NO: 1958131 - protein, 6 aa, Staphylococcus
KNITAT

SEQ ID NO: 1958132 - protein, 8 aa, Staphylococcus
KNITKNDI

SEQ ID NO: 1958133 - protein, 12 aa, Staphylococcus
KNITNDKKGSLK

SEQ ID NO: 1958134 - protein, 7 aa, Staphylococcus
KNITPQT

SEQ ID NO: 1958135 - protein, 7 aa, Staphylococcus
KNIVDEK

SEQ ID NO: 1958136 - protein, 24 aa, Staphylococcus
KNKAKQYVETKDFSDKANKELKKY

SEQ ID NO: 1958137 - protein, 8 aa, Staphylococcus
KNKAPEVL

SEQ ID NO: 1958138 - protein, 12 aa, Staphylococcus
KNKARYGKAISK

SEQ ID NO: 1958139 - protein, 8 aa, Staphylococcus
KNKATDRF

SEQ ID NO: 1958140 - protein, 6 aa, Staphylococcus
KNKCES

SEQ ID NO: 1958141 - protein, 4 aa, Staphylococcus
KNKD

SEQ ID NO: 1958142 - protein, 7 aa, Staphylococcus
KNKDDLD

SEQ ID NO: 1958143 - protein, 7 aa, Staphylococcus
KNKDDLE

SEQ ID NO: 1958144 - protein, 8 aa, Staphylococcus
KNKDGETG

SEQ ID NO: 1958145 - protein, 8 aa, Staphylococcus
KNKDIEGA

SEQ ID NO: 1958146 - protein, 7 aa, Staphylococcus
KNKDITG

SEQ ID NO: 1958147 - protein, 8 aa, Staphylococcus
KNKDRSIY

SEQ ID NO: 1958148 - protein, 5 aa, Staphylococcus
KNKDS

SEQ ID NO: 1958149 - protein, 12 aa, Staphylococcus
KNKDSTDDVSTE

SEQ ID NO: 1958150 - protein, 19 aa, Staphylococcus
KNKDYNEAELSAFLEKKEG

SEQ ID NO: 1958151 - protein, 9 aa, Staphylococcus
KNKEDHIDG

SEQ ID NO: 1958152 - protein, 10 aa, Staphylococcus
KNKEGNTVPA

SEQ ID NO: 1958153 - protein, 14 aa, Staphylococcus
KNKEKVSLTMINPN

SEQ ID NO: 1958154 - protein, 7 aa, Staphylococcus
KNKEPLE

SEQ ID NO: 1958155 - protein, 7 aa, Staphylococcus
KNKFRSD

SEQ ID NO: 1958156 - protein, 7 aa, Staphylococcus
KNKGHES

SEQ ID NO: 1958157 - protein, 9 aa, Staphylococcus
KNKGINTEH

SEQ ID NO: 1958158 - protein, 14 aa, Staphylococcus
KNKGKVSLTMIDPH

SEQ ID NO: 1958159 - protein, 8 aa, Staphylococcus
KNKGPFND

SEQ ID NO: 1958160 - protein, 4 aa, Staphylococcus
KNKI

SEQ ID NO: 1958161 - protein, 12 aa, Staphylococcus
KNKIYEEHHETS

SEQ ID NO: 1958162 - protein, 5 aa, Staphylococcus
KNKKE

SEQ ID NO: 1958163 - protein, 7 aa, Staphylococcus
KNKKERE

SEQ ID NO: 1958164 - protein, 9 aa, Staphylococcus
KNKKGQIEK

SEQ ID NO: 1958165 - protein, 10 aa, Staphylococcus
KNKKIDNSGA

SEQ ID NO: 1958166 - protein, 13 aa, Staphylococcus
KNKKISGASFSGQ

SEQ ID NO: 1958167 - protein, 6 aa, Staphylococcus
KNKKPI

SEQ ID NO: 1958168 - protein, 7 aa, Staphylococcus
KNKKRRL

SEQ ID NO: 1958169 - protein, 9 aa, Staphylococcus
KNKKSYYNF

SEQ ID NO: 1958170 - protein, 6 aa, Staphylococcus
KNKKVK

SEQ ID NO: 1958171 - protein, 6 aa, Staphylococcus
KNKKYK

SEQ ID NO: 1958172 - protein, 7 aa, Staphylococcus
KNKLEKN

SEQ ID NO: 1958173 - protein, 4 aa, Staphylococcus
KNKN

SEQ ID NO: 1958174 - protein, 7 aa, Staphylococcus
KNKNDLD

SEQ ID NO: 1958175 - protein, 9 aa, Staphylococcus
KNKNEIKEK

SEQ ID NO: 1958176 - protein, 5 aa, Staphylococcus
KNKNH

SEQ ID NO: 1958177 - protein, 7 aa, Staphylococcus
KNKNRAL

SEQ ID NO: 1958178 - protein, 43 aa, Staphylococcus
KNKNSLTGQYLSGKKKIDVPEHRREATNKKISIKGAKSNNLKN

SEQ ID NO: 1958179 - protein, 7 aa, Staphylococcus
KNKNVKA

SEQ ID NO: 1958180 - protein, 7 aa, Staphylococcus
KNKNYKV

SEQ ID NO: 1958181 - protein, 9 aa, Staphylococcus
KNKPKDTDL

SEQ ID NO: 1958182 - protein, 5 aa, Staphylococcus
KNKPL

SEQ ID NO: 1958183 - protein, 8 aa, Staphylococcus
KNKQDEWN

SEQ ID NO: 1958184 - protein, 10 aa, Staphylococcus
KNKQKSEIKG

SEQ ID NO: 1958185 - protein, 8 aa, Staphylococcus
KNKQLTGI

SEQ ID NO: 1958186 - protein, 6 aa, Staphylococcus
KNKQPI

SEQ ID NO: 1958187 - protein, 7 aa, Staphylococcus
KNKQQAI

SEQ ID NO: 1958188 - protein, 10 aa, Staphylococcus
KNKRISDEAY

SEQ ID NO: 1958189 - protein, 19 aa, Staphylococcus
KNKRRHNSETQKNGEHTLL

SEQ ID NO: 1958190 - protein, 17 aa, Staphylococcus
KNKSEAASFIMMDYKRP

SEQ ID NO: 1958191 - protein, 8 aa, Staphylococcus
KNKSEVEA

SEQ ID NO: 1958192 - protein, 10 aa, Staphylococcus
KNKSKDRVEP

SEQ ID NO: 1958193 - protein, 16 aa, Staphylococcus
KNKTEAASASIASKKI

SEQ ID NO: 1958194 - protein, 8 aa, Staphylococcus
KNKTEDQL

SEQ ID NO: 1958195 - protein, 22 aa, Staphylococcus
KNKTMAELTTEEKSDVSHRGNA

SEQ ID NO: 1958196 - protein, 20 aa, Staphylococcus
KNKTMAQLSAEEKGEISHRR

SEQ ID NO: 1958197 - protein, 22 aa, Staphylococcus
KNKTMAQLSAEEKSEVSHRGKA

SEQ ID NO: 1958198 - protein, 8 aa, Staphylococcus
KNKTSKDI

SEQ ID NO: 1958199 - protein, 9 aa, Staphylococcus
KNKTYNDAQ

SEQ ID NO: 1958200 - protein, 5 aa, Staphylococcus
KNKVG

SEQ ID NO: 1958201 - protein, 7 aa, Staphylococcus
KNKVNPS

SEQ ID NO: 1958202 - protein, 19 aa, Staphylococcus
KNKVRSKTKRKVKPGYKKK

SEQ ID NO: 1958203 - protein, 7 aa, Staphylococcus
KNKYAND

SEQ ID NO: 1958204 - protein, 9 aa, Staphylococcus
KNKYDEKIS

SEQ ID NO: 1958205 - protein, 9 aa, Staphylococcus
KNKYEDQNT

SEQ ID NO: 1958206 - protein, 7 aa, Staphylococcus
KNKYGGD

SEQ ID NO: 1958207 - protein, 19 aa, Staphylococcus
KNKYGYKKDNIDNNPLDDG

SEQ ID NO: 1958208 - protein, 10 aa, Staphylococcus
KNKYSTDEVK

SEQ ID NO: 1958209 - protein, 4 aa, Staphylococcus
KNLA

SEQ ID NO: 1958210 - protein, 5 aa, Staphylococcus
KNLAY

SEQ ID NO: 1958211 - protein, 8 aa, Staphylococcus
KNLDAETK

SEQ ID NO: 1958212 - protein, 6 aa, Staphylococcus
KNLDEA

SEQ ID NO: 1958213 - protein, 7 aa, Staphylococcus
KNLDEVK

SEQ ID NO: 1958214 - protein, 5 aa, Staphylococcus
KNLDR

SEQ ID NO: 1958215 - protein, 9 aa, Staphylococcus
KNLEKDSFE

SEQ ID NO: 1958216 - protein, 10 aa, Staphylococcus
KNLEKQPNVD

SEQ ID NO: 1958217 - protein, 11 aa, Staphylococcus
KNLENEGYDIS

SEQ ID NO: 1958218 - protein, 7 aa, Staphylococcus
KNLEPQE

SEQ ID NO: 1958219 - protein, 15 aa, Staphylococcus
KNLEQAKQDNINAKN

SEQ ID NO: 1958220 - protein, 5 aa, Staphylococcus
KNLKE

SEQ ID NO: 1958221 - protein, 10 aa, Staphylococcus
KNLLENKDEY

SEQ ID NO: 1958222 - protein, 5 aa, Staphylococcus
KNLNE

SEQ ID NO: 1958223 - protein, 7 aa, Staphylococcus
KNLPNGK

SEQ ID NO: 1958224 - protein, 6 aa, Staphylococcus
KNLPPK

SEQ ID NO: 1958225 - protein, 8 aa, Staphylococcus
KNLQKYEE

SEQ ID NO: 1958226 - protein, 5 aa, Staphylococcus
KNLQN

SEQ ID NO: 1958227 - protein, 17 aa, Staphylococcus
KNLRQGKHPDDVKIGTL

SEQ ID NO: 1958228 - protein, 6 aa, Staphylococcus
KNLSDN

SEQ ID NO: 1958229 - protein, 6 aa, Staphylococcus
KNLSEG

SEQ ID NO: 1958230 - protein, 11 aa, Staphylococcus
KNLSNINGNQL

SEQ ID NO: 1958231 - protein, 11 aa, Staphylococcus
KNLSQINGNQL

SEQ ID NO: 1958232 - protein, 10 aa, Staphylococcus
KNLSQRQQDY

SEQ ID NO: 1958233 - protein, 10 aa, Staphylococcus
KNLTEGGLNS

SEQ ID NO: 1958234 - protein, 8 aa, Staphylococcus
KNLTPNQM

SEQ ID NO: 1958235 - protein, 6 aa, Staphylococcus
KNMDPD

SEQ ID NO: 1958236 - protein, 16 aa, Staphylococcus
KNMDPDEYIGKHGADA

SEQ ID NO: 1958237 - protein, 6 aa, Staphylococcus
KNMGNG

SEQ ID NO: 1958238 - protein, 7 aa, Staphylococcus
KNMTGKN

SEQ ID NO: 1958239 - protein, 8 aa, Staphylococcus
KNNAGGTC

SEQ ID NO: 1958240 - protein, 7 aa, Staphylococcus
KNNAGVQ

SEQ ID NO: 1958241 - protein, 17 aa, Staphylococcus
KNNALSFSKPDREKVQD

SEQ ID NO: 1958242 - protein, 10 aa, Staphylococcus
KNNANTEKYK

SEQ ID NO: 1958243 - protein, 20 aa, Staphylococcus
KNNCSKLTDTDGNKYKVEKL

SEQ ID NO: 1958244 - protein, 7 aa, Staphylococcus
KNNDGDV

SEQ ID NO: 1958245 - protein, 22 aa, Staphylococcus
KNNDGSVNSDFTQLTTDDLPKG

SEQ ID NO: 1958246 - protein, 6 aa, Staphylococcus
KNNDIH

SEQ ID NO: 1958247 - protein, 7 aa, Staphylococcus
KNNDSAT

SEQ ID NO: 1958248 - protein, 7 aa, Staphylococcus
KNNDTTA

SEQ ID NO: 1958249 - protein, 4 aa, Staphylococcus
KNNE

SEQ ID NO: 1958250 - protein, 6 aa, Staphylococcus
KNNEDT

SEQ ID NO: 1958251 - protein, 8 aa, Staphylococcus
KNNELTPI

SEQ ID NO: 1958252 - protein, 6 aa, Staphylococcus
KNNEND

SEQ ID NO: 1958253 - protein, 8 aa, Staphylococcus
KNNEPKHF

SEQ ID NO: 1958254 - protein, 8 aa, Staphylococcus
KNNEPKNF

SEQ ID NO: 1958255 - protein, 8 aa, Staphylococcus
KNNERPLL

SEQ ID NO: 1958256 - protein, 7 aa, Staphylococcus
KNNGGFD

SEQ ID NO: 1958257 - protein, 7 aa, Staphylococcus
KNNGITT

SEQ ID NO: 1958258 - protein, 8 aa, Staphylococcus
KNNGITTS

SEQ ID NO: 1958259 - protein, 18 aa, Staphylococcus
KNNGLEKIETEGQQFDPN

SEQ ID NO: 1958260 - protein, 8 aa, Staphylococcus
KNNGPFND

SEQ ID NO: 1958261 - protein, 6 aa, Staphylococcus
KNNGWD

SEQ ID NO: 1958262 - protein, 6 aa, Staphylococcus
KNNHDG

SEQ ID NO: 1958263 - protein, 7 aa, Staphylococcus
KNNHNDP

SEQ ID NO: 1958264 - protein, 4 aa, Staphylococcus
KNNI

SEQ ID NO: 1958265 - protein, 7 aa, Staphylococcus
KNNIEAR

SEQ ID NO: 1958266 - protein, 5 aa, Staphylococcus
KNNIS

SEQ ID NO: 1958267 - protein, 4 aa, Staphylococcus
KNNK

SEQ ID NO: 1958268 - protein, 9 aa, Staphylococcus
KNNKQNDYL

SEQ ID NO: 1958269 - protein, 16 aa, Staphylococcus
KNNKQNDYLTNKKAHK

SEQ ID NO: 1958270 - protein, 17 aa, Staphylococcus
KNNKQNDYLTNKKAQKN

SEQ ID NO: 1958271 - protein, 17 aa, Staphylococcus
KNNKQNDYLTNKKAQKS

SEQ ID NO: 1958272 - protein, 17 aa, Staphylococcus
KNNKQNDYLTNKKARKG

SEQ ID NO: 1958273 - protein, 16 aa, Staphylococcus
KNNKQNDYLTNRKAQK

SEQ ID NO: 1958274 - protein, 17 aa, Staphylococcus
KNNKQNDYLTNRKAQKS

SEQ ID NO: 1958275 - protein, 8 aa, Staphylococcus
KNNKRINT

SEQ ID NO: 1958276 - protein, 8 aa, Staphylococcus
KNNKTEND

SEQ ID NO: 1958277 - protein, 7 aa, Staphylococcus
KNNKTGK

SEQ ID NO: 1958278 - protein, 4 aa, Staphylococcus
KNNL

SEQ ID NO: 1958279 - protein, 7 aa, Staphylococcus
KNNLSKN

SEQ ID NO: 1958280 - protein, 19 aa, Staphylococcus
KNNNDKNNLDDSEYFYITS

SEQ ID NO: 1958281 - protein, 10 aa, Staphylococcus
KNNNKYNLKK

SEQ ID NO: 1958282 - protein, 6 aa, Staphylococcus
KNNNNE

SEQ ID NO: 1958283 - protein, 6 aa, Staphylococcus
KNNNQR

SEQ ID NO: 1958284 - protein, 10 aa, Staphylococcus
KNNNVEIKEE

SEQ ID NO: 1958285 - protein, 8 aa, Staphylococcus
KNNPEKNV

SEQ ID NO: 1958286 - protein, 6 aa, Staphylococcus
KNNPKA

SEQ ID NO: 1958287 - protein, 7 aa, Staphylococcus
KNNPKDV

SEQ ID NO: 1958288 - protein, 6 aa, Staphylococcus
KNNPRD

SEQ ID NO: 1958289 - protein, 9 aa, Staphylococcus
KNNPTQIKQ

SEQ ID NO: 1958290 - protein, 5 aa, Staphylococcus
KNNQP

SEQ ID NO: 1958291 - protein, 6 aa, Staphylococcus
KNNQPI

SEQ ID NO: 1958292 - protein, 5 aa, Staphylococcus
KNNQT

SEQ ID NO: 1958293 - protein, 7 aa, Staphylococcus
KNNQYRN

SEQ ID NO: 1958294 - protein, 10 aa, Staphylococcus
KNNRISDEEY

SEQ ID NO: 1958295 - protein, 9 aa, Staphylococcus
KNNRITDEA

SEQ ID NO: 1958296 - protein, 9 aa, Staphylococcus
KNNRNGNNE

SEQ ID NO: 1958297 - protein, 5 aa, Staphylococcus
KNNRV

SEQ ID NO: 1958298 - protein, 4 aa, Staphylococcus
KNNS

SEQ ID NO: 1958299 - protein, 9 aa, Staphylococcus
KNNSDKNIN

SEQ ID NO: 1958300 - protein, 7 aa, Staphylococcus
KNNSEGI

SEQ ID NO: 1958301 - protein, 6 aa, Staphylococcus
KNNTEP

SEQ ID NO: 1958302 - protein, 5 aa, Staphylococcus
KNNTK

SEQ ID NO: 1958303 - protein, 7 aa, Staphylococcus
KNNTKNN

SEQ ID NO: 1958304 - protein, 6 aa, Staphylococcus
KNNTNV

SEQ ID NO: 1958305 - protein, 17 aa, Staphylococcus
KNNTTKELTQKAKSLKL

SEQ ID NO: 1958306 - protein, 18 aa, Staphylococcus
KNNTTKELTQKAKSLKLT

SEQ ID NO: 1958307 - protein, 4 aa, Staphylococcus
KNNV

SEQ ID NO: 1958308 - protein, 8 aa, Staphylococcus
KNNVNESS

SEQ ID NO: 1958309 - protein, 6 aa, Staphylococcus
KNNVTS

SEQ ID NO: 1958310 - protein, 14 aa, Staphylococcus
KNNYTNVKDIIGLD

SEQ ID NO: 1958311 - protein, 6 aa, Staphylococcus
KNNYTY

SEQ ID NO: 1958312 - protein, 5 aa, Staphylococcus
KNPDE

SEQ ID NO: 1958313 - protein, 5 aa, Staphylococcus
KNPDM

SEQ ID NO: 1958314 - protein, 7 aa, Staphylococcus
KNPDQTV

SEQ ID NO: 1958315 - protein, 6 aa, Staphylococcus
KNPDVT

SEQ ID NO: 1958316 - protein, 6 aa, Staphylococcus
KNPEGS

SEQ ID NO: 1958317 - protein, 7 aa, Staphylococcus
KNPEKEL

SEQ ID NO: 1958318 - protein, 26 aa, Staphylococcus
KNPELHSKENIGVNKPGTEGDKPAWF

SEQ ID NO: 1958319 - protein, 17 aa, Staphylococcus
KNPELYAKEQQDRANYY

SEQ ID NO: 1958320 - protein, 8 aa, Staphylococcus
KNPELYSK

SEQ ID NO: 1958321 - protein, 5 aa, Staphylococcus
KNPEM

SEQ ID NO: 1958322 - protein, 21 aa, Staphylococcus
KNPERFAEEEQQREAIKQQQN

SEQ ID NO: 1958323 - protein, 6 aa, Staphylococcus
KNPETY

SEQ ID NO: 1958324 - protein, 8 aa, Staphylococcus
KNPGGGLA

SEQ ID NO: 1958325 - protein, 32 aa, Staphylococcus
KNPISKKTFYQGEKEIAGKPITASTASKVETE

SEQ ID NO: 1958326 - protein, 8 aa, Staphylococcus
KNPITDDD

SEQ ID NO: 1958327 - protein, 9 aa, Staphylococcus
KNPITEPDI

SEQ ID NO: 1958328 - protein, 5 aa, Staphylococcus
KNPKL

SEQ ID NO: 1958329 - protein, 8 aa, Staphylococcus
KNPLTPKE

SEQ ID NO: 1958330 - protein, 7 aa, Staphylococcus
KNPMDGY

SEQ ID NO: 1958331 - protein, 6 aa, Staphylococcus
KNPNDT

SEQ ID NO: 1958332 - protein, 26 aa, Staphylococcus
KNPNNDTKLKEARERVSRLTAKYPLY

SEQ ID NO: 1958333 - protein, 9 aa, Staphylococcus
KNPPNSVIA

SEQ ID NO: 1958334 - protein, 5 aa, Staphylococcus
KNPQK

SEQ ID NO: 1958335 - protein, 14 aa, Staphylococcus
KNPRNKGKLDNGSL

SEQ ID NO: 1958336 - protein, 14 aa, Staphylococcus
KNPRNKGVLDNGSM

SEQ ID NO: 1958337 - protein, 5 aa, Staphylococcus
KNPSI

SEQ ID NO: 1958338 - protein, 6 aa, Staphylococcus
KNPSIE

SEQ ID NO: 1958339 - protein, 13 aa, Staphylococcus
KNPSILQTEGAKD

SEQ ID NO: 1958340 - protein, 25 aa, Staphylococcus
KNPSLHSKENIGVNKPNTDGDKPAW

SEQ ID NO: 1958341 - protein, 5 aa, Staphylococcus
KNPTF

SEQ ID NO: 1958342 - protein, 8 aa, Staphylococcus
KNPTLQRD

SEQ ID NO: 1958343 - protein, 7 aa, Staphylococcus
KNPYDEH

SEQ ID NO: 1958344 - protein, 13 aa, Staphylococcus
KNPYGDGKSSERI

SEQ ID NO: 1958345 - protein, 5 aa, Staphylococcus
KNQAR

SEQ ID NO: 1958346 - protein, 10 aa, Staphylococcus
KNQDDNKDKI

SEQ ID NO: 1958347 - protein, 11 aa, Staphylococcus
KNQDKDKNTTL

SEQ ID NO: 1958348 - protein, 6 aa, Staphylococcus
KNQELK

SEQ ID NO: 1958349 - protein, 6 aa, Staphylococcus
KNQELN

SEQ ID NO: 1958350 - protein, 8 aa, Staphylococcus
KNQEYSSD

SEQ ID NO: 1958351 - protein, 7 aa, Staphylococcus
KNQHDDK

SEQ ID NO: 1958352 - protein, 89 aa, Staphylococcus
KNQHDTSKGNNDSDVDEGNNDNQSQEQDNNQQDNQNQGNPNDGSQQDPNAQQDPYGYNQDQQQAPDQSQQGNQQPDMNNSQQAPSNQGY

SEQ ID NO: 1958353 - protein, 6 aa, Staphylococcus
KNQHPY

SEQ ID NO: 1958354 - protein, 5 aa, Staphylococcus
KNQIE

SEQ ID NO: 1958355 - protein, 10 aa, Staphylococcus
KNQIKASYED

SEQ ID NO: 1958356 - protein, 8 aa, Staphylococcus
KNQKDKAI

SEQ ID NO: 1958357 - protein, 4 aa, Staphylococcus
KNQN

SEQ ID NO: 1958358 - protein, 8 aa, Staphylococcus
KNQNSLPK

SEQ ID NO: 1958359 - protein, 7 aa, Staphylococcus
KNQPSIR

SEQ ID NO: 1958360 - protein, 15 aa, Staphylococcus
KNQPVNLGSEKQRVE

SEQ ID NO: 1958361 - protein, 6 aa, Staphylococcus
KNQQAI

SEQ ID NO: 1958362 - protein, 6 aa, Staphylococcus
KNQQQQ

SEQ ID NO: 1958363 - protein, 11 aa, Staphylococcus
KNQRDQNRLDK

SEQ ID NO: 1958364 - protein, 10 aa, Staphylococcus
KNQRHSAPFP

SEQ ID NO: 1958365 - protein, 9 aa, Staphylococcus
KNQRISDEA

SEQ ID NO: 1958366 - protein, 5 aa, Staphylococcus
KNQRY

SEQ ID NO: 1958367 - protein, 4 aa, Staphylococcus
KNQS

SEQ ID NO: 1958368 - protein, 7 aa, Staphylococcus
KNQSNMK

SEQ ID NO: 1958369 - protein, 11 aa, Staphylococcus
KNQSNQKKLSD

SEQ ID NO: 1958370 - protein, 6 aa, Staphylococcus
KNQSNR

SEQ ID NO: 1958371 - protein, 5 aa, Staphylococcus
KNQTE

SEQ ID NO: 1958372 - protein, 11 aa, Staphylococcus
KNQTETEVNYS

SEQ ID NO: 1958373 - protein, 9 aa, Staphylococcus
KNQTFSTES

SEQ ID NO: 1958374 - protein, 13 aa, Staphylococcus
KNQTNKDNFSEAA

SEQ ID NO: 1958375 - protein, 5 aa, Staphylococcus
KNQTS

SEQ ID NO: 1958376 - protein, 7 aa, Staphylococcus
KNQVSIE

SEQ ID NO: 1958377 - protein, 7 aa, Staphylococcus
KNQYGGE

SEQ ID NO: 1958378 - protein, 5 aa, Staphylococcus
KNQYI

SEQ ID NO: 1958379 - protein, 8 aa, Staphylococcus
KNRAEALG

SEQ ID NO: 1958380 - protein, 18 aa, Staphylococcus
KNRAETLGLSSESRYNNL

SEQ ID NO: 1958381 - protein, 8 aa, Staphylococcus
KNRDRSDV

SEQ ID NO: 1958382 - protein, 12 aa, Staphylococcus
KNREAVDKYSYA

SEQ ID NO: 1958383 - protein, 8 aa, Staphylococcus
KNREKEWK

SEQ ID NO: 1958384 - protein, 8 aa, Staphylococcus
KNREQEWK

SEQ ID NO: 1958385 - protein, 28 aa, Staphylococcus
KNREYYTPKATSKTEQQFKAVYDNLKQQ

SEQ ID NO: 1958386 - protein, 6 aa, Staphylococcus
KNRFED

SEQ ID NO: 1958387 - protein, 9 aa, Staphylococcus
KNRGINTQH

SEQ ID NO: 1958388 - protein, 9 aa, Staphylococcus
KNRGINTTH

SEQ ID NO: 1958389 - protein, 7 aa, Staphylococcus
KNRNSSV

SEQ ID NO: 1958390 - protein, 7 aa, Staphylococcus
KNRPPRL

SEQ ID NO: 1958391 - protein, 12 aa, Staphylococcus
KNRQPFWTENYA

SEQ ID NO: 1958392 - protein, 7 aa, Staphylococcus
KNRSNGY

SEQ ID NO: 1958393 - protein, 7 aa, Staphylococcus
KNRSQAA

SEQ ID NO: 1958394 - protein, 16 aa, Staphylococcus
KNRSQAASFVMMEYKK

SEQ ID NO: 1958395 - protein, 7 aa, Staphylococcus
KNRSQAS

SEQ ID NO: 1958396 - protein, 11 aa, Staphylococcus
KNRSQRREKHI

SEQ ID NO: 1958397 - protein, 8 aa, Staphylococcus
KNRTRQSM

SEQ ID NO: 1958398 - protein, 6 aa, Staphylococcus
KNRYQS

SEQ ID NO: 1958399 - protein, 12 aa, Staphylococcus
KNSDADSEVEET

SEQ ID NO: 1958400 - protein, 16 aa, Staphylococcus
KNSDGSVWTNGKGDSF

SEQ ID NO: 1958401 - protein, 12 aa, Staphylococcus
KNSDPDSEVAET

SEQ ID NO: 1958402 - protein, 8 aa, Staphylococcus
KNSDPSLT

SEQ ID NO: 1958403 - protein, 16 aa, Staphylococcus
KNSDRIKQLSSELPKV

SEQ ID NO: 1958404 - protein, 4 aa, Staphylococcus
KNSE

SEQ ID NO: 1958405 - protein, 12 aa, Staphylococcus
KNSEIKHSKERI

SEQ ID NO: 1958406 - protein, 6 aa, Staphylococcus
KNSEKI

SEQ ID NO: 1958407 - protein, 7 aa, Staphylococcus
KNSELKD

SEQ ID NO: 1958408 - protein, 9 aa, Staphylococcus
KNSEPGDKF

SEQ ID NO: 1958409 - protein, 12 aa, Staphylococcus
KNSEPPIPGDLT

SEQ ID NO: 1958410 - protein, 7 aa, Staphylococcus
KNSETNY

SEQ ID NO: 1958411 - protein, 5 aa, Staphylococcus
KNSGC

SEQ ID NO: 1958412 - protein, 6 aa, Staphylococcus
KNSGIG

SEQ ID NO: 1958413 - protein, 16 aa, Staphylococcus
KNSGQTMTTEDDSTQI

SEQ ID NO: 1958414 - protein, 9 aa, Staphylococcus
KNSHKRRSM

SEQ ID NO: 1958415 - protein, 8 aa, Staphylococcus
KNSIKNTY

SEQ ID NO: 1958416 - protein, 14 aa, Staphylococcus
KNSIVGTSSLRRGA

SEQ ID NO: 1958417 - protein, 10 aa, Staphylococcus
KNSKAIKNNG

SEQ ID NO: 1958418 - protein, 11 aa, Staphylococcus
KNSKHDLSNKD

SEQ ID NO: 1958419 - protein, 5 aa, Staphylococcus
KNSLR

SEQ ID NO: 1958420 - protein, 15 aa, Staphylococcus
KNSNIEKISRKNLNR

SEQ ID NO: 1958421 - protein, 8 aa, Staphylococcus
KNSNQSVV

SEQ ID NO: 1958422 - protein, 14 aa, Staphylococcus
KNSNSITQSQEVSD

SEQ ID NO: 1958423 - protein, 15 aa, Staphylococcus
KNSNTLTLDKLKSYG

SEQ ID NO: 1958424 - protein, 7 aa, Staphylococcus
KNSPDEQ

SEQ ID NO: 1958425 - protein, 7 aa, Staphylococcus
KNSPGNF

SEQ ID NO: 1958426 - protein, 5 aa, Staphylococcus
KNSPL

SEQ ID NO: 1958427 - protein, 6 aa, Staphylococcus
KNSPLE

SEQ ID NO: 1958428 - protein, 8 aa, Staphylococcus
KNSPNSRR

SEQ ID NO: 1958429 - protein, 5 aa, Staphylococcus
KNSQT

SEQ ID NO: 1958430 - protein, 7 aa, Staphylococcus
KNSQVRD

SEQ ID NO: 1958431 - protein, 5 aa, Staphylococcus
KNSRD

SEQ ID NO: 1958432 - protein, 13 aa, Staphylococcus
KNSRVAKSNYQSL

SEQ ID NO: 1958433 - protein, 14 aa, Staphylococcus
KNSRVARSNYDSLT

SEQ ID NO: 1958434 - protein, 15 aa, Staphylococcus
KNSRVARSNYTSLTS

SEQ ID NO: 1958435 - protein, 10 aa, Staphylococcus
KNSTEADVQT

SEQ ID NO: 1958436 - protein, 6 aa, Staphylococcus
KNSVEI

SEQ ID NO: 1958437 - protein, 7 aa, Staphylococcus
KNSVPGV

SEQ ID NO: 1958438 - protein, 5 aa, Staphylococcus
KNTAD

SEQ ID NO: 1958439 - protein, 11 aa, Staphylococcus
KNTAESYLGEK

SEQ ID NO: 1958440 - protein, 8 aa, Staphylococcus
KNTAMERA

SEQ ID NO: 1958441 - protein, 5 aa, Staphylococcus
KNTAQ

SEQ ID NO: 1958442 - protein, 6 aa, Staphylococcus
KNTCRN

SEQ ID NO: 1958443 - protein, 4 aa, Staphylococcus
KNTD

SEQ ID NO: 1958444 - protein, 16 aa, Staphylococcus
KNTDTGRQAFKRFIKH

SEQ ID NO: 1958445 - protein, 6 aa, Staphylococcus
KNTEDY

SEQ ID NO: 1958446 - protein, 8 aa, Staphylococcus
KNTESFTP

SEQ ID NO: 1958447 - protein, 10 aa, Staphylococcus
KNTGDRPIQV

SEQ ID NO: 1958448 - protein, 7 aa, Staphylococcus
KNTGRPI

SEQ ID NO: 1958449 - protein, 4 aa, Staphylococcus
KNTI

SEQ ID NO: 1958450 - protein, 6 aa, Staphylococcus
KNTIPI

SEQ ID NO: 1958451 - protein, 7 aa, Staphylococcus
KNTKDIQ

SEQ ID NO: 1958452 - protein, 22 aa, Staphylococcus
KNTKEVSITHDKKEFKFKLKVV

SEQ ID NO: 1958453 - protein, 16 aa, Staphylococcus
KNTKYNQAIVLQELCT

SEQ ID NO: 1958454 - protein, 4 aa, Staphylococcus
KNTL

SEQ ID NO: 1958455 - protein, 4 aa, Staphylococcus
KNTN

SEQ ID NO: 1958456 - protein, 8 aa, Staphylococcus
KNTPNFNA

SEQ ID NO: 1958457 - protein, 8 aa, Staphylococcus
KNTPTFEE

SEQ ID NO: 1958458 - protein, 9 aa, Staphylococcus
KNTREEFTG

SEQ ID NO: 1958459 - protein, 7 aa, Staphylococcus
KNTRGGQ

SEQ ID NO: 1958460 - protein, 17 aa, Staphylococcus
KNTTIKVSGVSKEQVGA

SEQ ID NO: 1958461 - protein, 9 aa, Staphylococcus
KNTTKGQDI

SEQ ID NO: 1958462 - protein, 6 aa, Staphylococcus
KNTTLN

SEQ ID NO: 1958463 - protein, 8 aa, Staphylococcus
KNTTSEDT

SEQ ID NO: 1958464 - protein, 8 aa, Staphylococcus
KNTTVKVE

SEQ ID NO: 1958465 - protein, 8 aa, Staphylococcus
KNTTVRVS

SEQ ID NO: 1958466 - protein, 6 aa, Staphylococcus
KNTTVT

SEQ ID NO: 1958467 - protein, 17 aa, Staphylococcus
KNTTVTVSGVSKEQVGA

SEQ ID NO: 1958468 - protein, 7 aa, Staphylococcus
KNVADEI

SEQ ID NO: 1958469 - protein, 7 aa, Staphylococcus
KNVASQG

SEQ ID NO: 1958470 - protein, 6 aa, Staphylococcus
KNVDKH

SEQ ID NO: 1958471 - protein, 6 aa, Staphylococcus
KNVDTH

SEQ ID NO: 1958472 - protein, 4 aa, Staphylococcus
KNVE

SEQ ID NO: 1958473 - protein, 7 aa, Staphylococcus
KNVEEAI

SEQ ID NO: 1958474 - protein, 8 aa, Staphylococcus
KNVEKKKK

SEQ ID NO: 1958475 - protein, 15 aa, Staphylococcus
KNVENDKVQPQDIEK

SEQ ID NO: 1958476 - protein, 6 aa, Staphylococcus
KNVESD

SEQ ID NO: 1958477 - protein, 5 aa, Staphylococcus
KNVGE

SEQ ID NO: 1958478 - protein, 5 aa, Staphylococcus
KNVPP

SEQ ID NO: 1958479 - protein, 6 aa, Staphylococcus
KNVQAA

SEQ ID NO: 1958480 - protein, 8 aa, Staphylococcus
KNVQSNPK

SEQ ID NO: 1958481 - protein, 14 aa, Staphylococcus
KNVRHQSADASSPI

SEQ ID NO: 1958482 - protein, 6 aa, Staphylococcus
KNVRNM

SEQ ID NO: 1958483 - protein, 4 aa, Staphylococcus
KNVS

SEQ ID NO: 1958484 - protein, 7 aa, Staphylococcus
KNVSEQP

SEQ ID NO: 1958485 - protein, 5 aa, Staphylococcus
KNVSG

SEQ ID NO: 1958486 - protein, 10 aa, Staphylococcus
KNVSYKPENV

SEQ ID NO: 1958487 - protein, 8 aa, Staphylococcus
KNVTKERL

SEQ ID NO: 1958488 - protein, 14 aa, Staphylococcus
KNVTMRNDPDGRSR

SEQ ID NO: 1958489 - protein, 11 aa, Staphylococcus
KNWSKTKQVDT

SEQ ID NO: 1958490 - protein, 7 aa, Staphylococcus
KNYEAAR

SEQ ID NO: 1958491 - protein, 13 aa, Staphylococcus
KNYERKKEKQSVL

SEQ ID NO: 1958492 - protein, 8 aa, Staphylococcus
KNYERTKH

SEQ ID NO: 1958493 - protein, 5 aa, Staphylococcus
KNYGL

SEQ ID NO: 1958494 - protein, 7 aa, Staphylococcus
KNYHRKP

SEQ ID NO: 1958495 - protein, 4 aa, Staphylococcus
KNYI

SEQ ID NO: 1958496 - protein, 5 aa, Staphylococcus
KNYKD

SEQ ID NO: 1958497 - protein, 14 aa, Staphylococcus
KNYKSHLSDRQKAY

SEQ ID NO: 1958498 - protein, 18 aa, Staphylococcus
KNYKSKKDEDTAALINEL

SEQ ID NO: 1958499 - protein, 7 aa, Staphylococcus
KNYKTRK

SEQ ID NO: 1958500 - protein, 6 aa, Staphylococcus
KNYNAK

SEQ ID NO: 1958501 - protein, 9 aa, Staphylococcus
KNYNDKERI

SEQ ID NO: 1958502 - protein, 7 aa, Staphylococcus
KNYNDLR

SEQ ID NO: 1958503 - protein, 12 aa, Staphylococcus
KNYNDYSPEELR

SEQ ID NO: 1958504 - protein, 8 aa, Staphylococcus
KNYNKNSN

SEQ ID NO: 1958505 - protein, 6 aa, Staphylococcus
KNYPDP

SEQ ID NO: 1958506 - protein, 7 aa, Staphylococcus
KNYPENK

SEQ ID NO: 1958507 - protein, 10 aa, Staphylococcus
KNYPETDRQK

SEQ ID NO: 1958508 - protein, 11 aa, Staphylococcus
KNYPSVQGDNI

SEQ ID NO: 1958509 - protein, 13 aa, Staphylococcus
KNYPTVQGDNVQY

SEQ ID NO: 1958510 - protein, 7 aa, Staphylococcus
KNYPVTN

SEQ ID NO: 1958511 - protein, 12 aa, Staphylococcus
KNYQKSSDNQLA

SEQ ID NO: 1958512 - protein, 6 aa, Staphylococcus
KNYQRF

SEQ ID NO: 1958513 - protein, 10 aa, Staphylococcus
KNYSHAEAND

SEQ ID NO: 1958514 - protein, 10 aa, Staphylococcus
KNYSPEKVDN

SEQ ID NO: 1958515 - protein, 8 aa, Staphylococcus
KNYSSGMR

SEQ ID NO: 1958516 - protein, 6 aa, Staphylococcus
KNYTGV

SEQ ID NO: 1958517 - protein, 5 aa, Staphylococcus
KPADL

SEQ ID NO: 1958518 - protein, 6 aa, Staphylococcus
KPAGYS

SEQ ID NO: 1958519 - protein, 10 aa, Staphylococcus
KPAHASNRSN

SEQ ID NO: 1958520 - protein, 10 aa, Staphylococcus
KPAHASSRSN

SEQ ID NO: 1958521 - protein, 12 aa, Staphylococcus
KPAKARKGTDVK

SEQ ID NO: 1958522 - protein, 7 aa, Staphylococcus
KPALSKK

SEQ ID NO: 1958523 - protein, 12 aa, Staphylococcus
KPAPFKDRNGRA

SEQ ID NO: 1958524 - protein, 8 aa, Staphylococcus
KPARANQL

SEQ ID NO: 1958525 - protein, 10 aa, Staphylococcus
KPASEDGISD

SEQ ID NO: 1958526 - protein, 4 aa, Staphylococcus
KPDE

SEQ ID NO: 1958527 - protein, 13 aa, Staphylococcus
KPDEIEKRLNQKK

SEQ ID NO: 1958528 - protein, 10 aa, Staphylococcus
KPDEVTPEQC

SEQ ID NO: 1958529 - protein, 5 aa, Staphylococcus
KPDHF

SEQ ID NO: 1958530 - protein, 8 aa, Staphylococcus
KPDKPPLD

SEQ ID NO: 1958531 - protein, 22 aa, Staphylococcus
KPDKSVIPGNAKKVKRGSAEYY

SEQ ID NO: 1958532 - protein, 10 aa, Staphylococcus
KPDLKRHKTY

SEQ ID NO: 1958533 - protein, 14 aa, Staphylococcus
KPDLTVDEQAEHYG

SEQ ID NO: 1958534 - protein, 5 aa, Staphylococcus
KPDRL

SEQ ID NO: 1958535 - protein, 9 aa, Staphylococcus
KPDSTREQI

SEQ ID NO: 1958536 - protein, 4 aa, Staphylococcus
KPED

SEQ ID NO: 1958537 - protein, 8 aa, Staphylococcus
KPEDGFKT

SEQ ID NO: 1958538 - protein, 7 aa, Staphylococcus
KPEDSWN

SEQ ID NO: 1958539 - protein, 8 aa, Staphylococcus
KPEEHQSN

SEQ ID NO: 1958540 - protein, 6 aa, Staphylococcus
KPEEIV

SEQ ID NO: 1958541 - protein, 9 aa, Staphylococcus
KPEEKSDAI

SEQ ID NO: 1958542 - protein, 5 aa, Staphylococcus
KPEET

SEQ ID NO: 1958543 - protein, 13 aa, Staphylococcus
KPEGFAEVLLKIW

SEQ ID NO: 1958544 - protein, 5 aa, Staphylococcus
KPEGL

SEQ ID NO: 1958545 - protein, 8 aa, Staphylococcus
KPEGTDFQ

SEQ ID NO: 1958546 - protein, 4 aa, Staphylococcus
KPEH

SEQ ID NO: 1958547 - protein, 9 aa, Staphylococcus
KPEHSRSNR

SEQ ID NO: 1958548 - protein, 10 aa, Staphylococcus
KPEIDSETEV

SEQ ID NO: 1958549 - protein, 6 aa, Staphylococcus
KPEKSY

SEQ ID NO: 1958550 - protein, 4 aa, Staphylococcus
KPEL

SEQ ID NO: 1958551 - protein, 5 aa, Staphylococcus
KPELT

SEQ ID NO: 1958552 - protein, 15 aa, Staphylococcus
KPELTLEEQADKYNP

SEQ ID NO: 1958553 - protein, 16 aa, Staphylococcus
KPEPDTETPQGGSAHD

SEQ ID NO: 1958554 - protein, 16 aa, Staphylococcus
KPEPHNEMPQGGSAHD

SEQ ID NO: 1958555 - protein, 10 aa, Staphylococcus
KPEQYPETGL

SEQ ID NO: 1958556 - protein, 11 aa, Staphylococcus
KPEQYPETGLS

SEQ ID NO: 1958557 - protein, 8 aa, Staphylococcus
KPEQYPGI

SEQ ID NO: 1958558 - protein, 4 aa, Staphylococcus
KPER

SEQ ID NO: 1958559 - protein, 10 aa, Staphylococcus
KPERKPNRKM

SEQ ID NO: 1958560 - protein, 9 aa, Staphylococcus
KPERTSGNK

SEQ ID NO: 1958561 - protein, 10 aa, Staphylococcus
KPESRNSKDI

SEQ ID NO: 1958562 - protein, 9 aa, Staphylococcus
KPESTKAQI

SEQ ID NO: 1958563 - protein, 8 aa, Staphylococcus
KPESTRNQ

SEQ ID NO: 1958564 - protein, 6 aa, Staphylococcus
KPETHL

SEQ ID NO: 1958565 - protein, 7 aa, Staphylococcus
KPEVTEA

SEQ ID NO: 1958566 - protein, 6 aa, Staphylococcus
KPEVYN

SEQ ID NO: 1958567 - protein, 4 aa, Staphylococcus
KPEW

SEQ ID NO: 1958568 - protein, 5 aa, Staphylococcus
KPEYA

SEQ ID NO: 1958569 - protein, 7 aa, Staphylococcus
KPEYTEA

SEQ ID NO: 1958570 - protein, 7 aa, Staphylococcus
KPEYYNN

SEQ ID NO: 1958571 - protein, 6 aa, Staphylococcus
KPFGKD

SEQ ID NO: 1958572 - protein, 5 aa, Staphylococcus
KPFNK

SEQ ID NO: 1958573 - protein, 6 aa, Staphylococcus
KPFNKE

SEQ ID NO: 1958574 - protein, 19 aa, Staphylococcus
KPFNKEKSIETVRGVGYVI

SEQ ID NO: 1958575 - protein, 19 aa, Staphylococcus
KPFNKERTIETVRGVGYVI

SEQ ID NO: 1958576 - protein, 6 aa, Staphylococcus
KPFPEK

SEQ ID NO: 1958577 - protein, 8 aa, Staphylococcus
KPFPQEPI

SEQ ID NO: 1958578 - protein, 12 aa, Staphylococcus
KPFSKRNKYSAE

SEQ ID NO: 1958579 - protein, 5 aa, Staphylococcus
KPFSP

SEQ ID NO: 1958580 - protein, 7 aa, Staphylococcus
KPFTKDD

SEQ ID NO: 1958581 - protein, 6 aa, Staphylococcus
KPFTQE

SEQ ID NO: 1958582 - protein, 4 aa, Staphylococcus
KPGA

SEQ ID NO: 1958583 - protein, 21 aa, Staphylococcus
KPGAGEKAAQWTKDNYENTDH

SEQ ID NO: 1958584 - protein, 6 aa, Staphylococcus
KPGDIY

SEQ ID NO: 1958585 - protein, 9 aa, Staphylococcus
KPGEKAEDI

SEQ ID NO: 1958586 - protein, 6 aa, Staphylococcus
KPGENH

SEQ ID NO: 1958587 - protein, 14 aa, Staphylococcus
KPGFEDKKKELEER

SEQ ID NO: 1958588 - protein, 4 aa, Staphylococcus
KPGG

SEQ ID NO: 1958589 - protein, 8 aa, Staphylococcus
KPGGITIS

SEQ ID NO: 1958590 - protein, 8 aa, Staphylococcus
KPGGKIRD

SEQ ID NO: 1958591 - protein, 5 aa, Staphylococcus
KPGGT

SEQ ID NO: 1958592 - protein, 23 aa, Staphylococcus
KPGKGGQIARSAGASAQVLGKEG

SEQ ID NO: 1958593 - protein, 5 aa, Staphylococcus
KPGLQ

SEQ ID NO: 1958594 - protein, 6 aa, Staphylococcus
KPGLQS

SEQ ID NO: 1958595 - protein, 5 aa, Staphylococcus
KPGNI

SEQ ID NO: 1958596 - protein, 6 aa, Staphylococcus
KPGNLD

SEQ ID NO: 1958597 - protein, 23 aa, Staphylococcus
KPGRGGQIARSAGASAQVLGKEG

SEQ ID NO: 1958598 - protein, 7 aa, Staphylococcus
KPGSEEL

SEQ ID NO: 1958599 - protein, 7 aa, Staphylococcus
KPGSRIK

SEQ ID NO: 1958600 - protein, 8 aa, Staphylococcus
KPGSRIKV

SEQ ID NO: 1958601 - protein, 15 aa, Staphylococcus
KPGSSYKSFEPSESD

SEQ ID NO: 1958602 - protein, 12 aa, Staphylococcus
KPGTEGNKPSWF

SEQ ID NO: 1958603 - protein, 5 aa, Staphylococcus
KPGTF

SEQ ID NO: 1958604 - protein, 7 aa, Staphylococcus
KPGTLHP

SEQ ID NO: 1958605 - protein, 4 aa, Staphylococcus
KPGV

SEQ ID NO: 1958606 - protein, 7 aa, Staphylococcus
KPGVRQG

SEQ ID NO: 1958607 - protein, 14 aa, Staphylococcus
KPGYEDKKADLEAR

SEQ ID NO: 1958608 - protein, 14 aa, Staphylococcus
KPGYEDKKKELEDR

SEQ ID NO: 1958609 - protein, 14 aa, Staphylococcus
KPGYEDKKKELEER

SEQ ID NO: 1958610 - protein, 14 aa, Staphylococcus
KPGYEDKKQELEER

SEQ ID NO: 1958611 - protein, 8 aa, Staphylococcus
KPHDNETY

SEQ ID NO: 1958612 - protein, 5 aa, Staphylococcus
KPHFN

SEQ ID NO: 1958613 - protein, 6 aa, Staphylococcus
KPHRAS

SEQ ID NO: 1958614 - protein, 5 aa, Staphylococcus
KPHRN

SEQ ID NO: 1958615 - protein, 14 aa, Staphylococcus
KPHSWGAQKQLDSA

SEQ ID NO: 1958616 - protein, 5 aa, Staphylococcus
KPHYV

SEQ ID NO: 1958617 - protein, 4 aa, Staphylococcus
KPIA

SEQ ID NO: 1958618 - protein, 4 aa, Staphylococcus
KPID

SEQ ID NO: 1958619 - protein, 5 aa, Staphylococcus
KPIDT

SEQ ID NO: 1958620 - protein, 7 aa, Staphylococcus
KPIEPGK

SEQ ID NO: 1958621 - protein, 7 aa, Staphylococcus
KPIHDDK

SEQ ID NO: 1958622 - protein, 13 aa, Staphylococcus
KPIHSGITNERET

SEQ ID NO: 1958623 - protein, 11 aa, Staphylococcus
KPIKFEDNREW

SEQ ID NO: 1958624 - protein, 42 aa, Staphylococcus
KPIPKTEKQKAEEKSNSQQTPMTSQDNPFGNNDPLGYEDDLA

SEQ ID NO: 1958625 - protein, 7 aa, Staphylococcus
KPIRNED

SEQ ID NO: 1958626 - protein, 8 aa, Staphylococcus
KPIRNEEG

SEQ ID NO: 1958627 - protein, 5 aa, Staphylococcus
KPISS

SEQ ID NO: 1958628 - protein, 4 aa, Staphylococcus
KPIV

SEQ ID NO: 1958629 - protein, 6 aa, Staphylococcus
KPIVNS

SEQ ID NO: 1958630 - protein, 5 aa, Staphylococcus
KPIYR

SEQ ID NO: 1958631 - protein, 5 aa, Staphylococcus
KPKAT

SEQ ID NO: 1958632 - protein, 8 aa, Staphylococcus
KPKEGETV

SEQ ID NO: 1958633 - protein, 6 aa, Staphylococcus
KPKEIA

SEQ ID NO: 1958634 - protein, 19 aa, Staphylococcus
KPKGIVSTKSKVIQKAKSL

SEQ ID NO: 1958635 - protein, 13 aa, Staphylococcus
KPKGIVSTKTKVI

SEQ ID NO: 1958636 - protein, 16 aa, Staphylococcus
KPKGIVSTKTKVIQKA

SEQ ID NO: 1958637 - protein, 17 aa, Staphylococcus
KPKGVKTHPNDLKESNT

SEQ ID NO: 1958638 - protein, 17 aa, Staphylococcus
KPKKKRMGRYQGYTNKK

SEQ ID NO: 1958639 - protein, 4 aa, Staphylococcus
KPKL

SEQ ID NO: 1958640 - protein, 16 aa, Staphylococcus
KPKLTKAKIKLSRKLK

SEQ ID NO: 1958641 - protein, 17 aa, Staphylococcus
KPKLTKAKIKLSRKLKR

SEQ ID NO: 1958642 - protein, 4 aa, Staphylococcus
KPKM

SEQ ID NO: 1958643 - protein, 5 aa, Staphylococcus
KPKMG

SEQ ID NO: 1958644 - protein, 8 aa, Staphylococcus
KPKMKKPE

SEQ ID NO: 1958645 - protein, 16 aa, Staphylococcus
KPKMKKPELLAPAGNL

SEQ ID NO: 1958646 - protein, 11 aa, Staphylococcus
KPKMPEAEREK

SEQ ID NO: 1958647 - protein, 17 aa, Staphylococcus
KPKMSAQAVGGAVGKNP

SEQ ID NO: 1958648 - protein, 14 aa, Staphylococcus
KPKNKVQRFFDYKA

SEQ ID NO: 1958649 - protein, 5 aa, Staphylococcus
KPKPL

SEQ ID NO: 1958650 - protein, 8 aa, Staphylococcus
KPKQTDGI

SEQ ID NO: 1958651 - protein, 7 aa, Staphylococcus
KPKRKVK

SEQ ID NO: 1958652 - protein, 10 aa, Staphylococcus
KPKSVASERF

SEQ ID NO: 1958653 - protein, 5 aa, Staphylococcus
KPKTR

SEQ ID NO: 1958654 - protein, 6 aa, Staphylococcus
KPKYEE

SEQ ID NO: 1958655 - protein, 23 aa, Staphylococcus
KPKYNKIPKRISGLKAKKNTQNH

SEQ ID NO: 1958656 - protein, 10 aa, Staphylococcus
KPKYPKQRLE

SEQ ID NO: 1958657 - protein, 4 aa, Staphylococcus
KPLA

SEQ ID NO: 1958658 - protein, 7 aa, Staphylococcus
KPLDEHK

SEQ ID NO: 1958659 - protein, 9 aa, Staphylococcus
KPLEDSELK

SEQ ID NO: 1958660 - protein, 5 aa, Staphylococcus
KPLEK

SEQ ID NO: 1958661 - protein, 6 aa, Staphylococcus
KPLETE

SEQ ID NO: 1958662 - protein, 5 aa, Staphylococcus
KPLGN

SEQ ID NO: 1958663 - protein, 11 aa, Staphylococcus
KPLKNDKNKVS

SEQ ID NO: 1958664 - protein, 6 aa, Staphylococcus
KPLKNY

SEQ ID NO: 1958665 - protein, 5 aa, Staphylococcus
KPLKQ

SEQ ID NO: 1958666 - protein, 8 aa, Staphylococcus
KPLPSKDN

SEQ ID NO: 1958667 - protein, 8 aa, Staphylococcus
KPLQLSAK

SEQ ID NO: 1958668 - protein, 4 aa, Staphylococcus
KPLR

SEQ ID NO: 1958669 - protein, 5 aa, Staphylococcus
KPLSR

SEQ ID NO: 1958670 - protein, 69 aa, Staphylococcus
KPLSRGKGRQGKGGPKRGGNHKRGGGKFDNKNRRSGKGGFNNKKKNDRPSSDRNNNKKSMKGRTFADHK

SEQ ID NO: 1958671 - protein, 4 aa, Staphylococcus
KPLT

SEQ ID NO: 1958672 - protein, 6 aa, Staphylococcus
KPLTTD

SEQ ID NO: 1958673 - protein, 12 aa, Staphylococcus
KPLVTKAKKSIA

SEQ ID NO: 1958674 - protein, 13 aa, Staphylococcus
KPLVTKAKKSIAT

SEQ ID NO: 1958675 - protein, 4 aa, Staphylococcus
KPMG

SEQ ID NO: 1958676 - protein, 6 aa, Staphylococcus
KPMGKS

SEQ ID NO: 1958677 - protein, 6 aa, Staphylococcus
KPMGRA

SEQ ID NO: 1958678 - protein, 4 aa, Staphylococcus
KPMK

SEQ ID NO: 1958679 - protein, 10 aa, Staphylococcus
KPNAENHKRY

SEQ ID NO: 1958680 - protein, 9 aa, Staphylococcus
KPNAQETQF

SEQ ID NO: 1958681 - protein, 8 aa, Staphylococcus
KPNDHTQS

SEQ ID NO: 1958682 - protein, 20 aa, Staphylococcus
KPNDHTQSVIESKGGSRLKD

SEQ ID NO: 1958683 - protein, 7 aa, Staphylococcus
KPNDTAL

SEQ ID NO: 1958684 - protein, 8 aa, Staphylococcus
KPNDTATS

SEQ ID NO: 1958685 - protein, 8 aa, Staphylococcus
KPNEASQF

SEQ ID NO: 1958686 - protein, 5 aa, Staphylococcus
KPNEE

SEQ ID NO: 1958687 - protein, 8 aa, Staphylococcus
KPNEHTQE

SEQ ID NO: 1958688 - protein, 13 aa, Staphylococcus
KPNFESDTDTFQA

SEQ ID NO: 1958689 - protein, 56 aa, Staphylococcus
KPNKQAHEEHVETEQNAADEHVPEEEHHPNHENDQNSDQSHEKDESKFKKLLKSLF

SEQ ID NO: 1958690 - protein, 5 aa, Staphylococcus
KPNPL

SEQ ID NO: 1958691 - protein, 5 aa, Staphylococcus
KPNPY

SEQ ID NO: 1958692 - protein, 6 aa, Staphylococcus
KPNQNI

SEQ ID NO: 1958693 - protein, 5 aa, Staphylococcus
KPNQV

SEQ ID NO: 1958694 - protein, 7 aa, Staphylococcus
KPNRLHQ

SEQ ID NO: 1958695 - protein, 11 aa, Staphylococcus
KPNRRKADIEA

SEQ ID NO: 1958696 - protein, 7 aa, Staphylococcus
KPNSHID

SEQ ID NO: 1958697 - protein, 4 aa, Staphylococcus
KPNT

SEQ ID NO: 1958698 - protein, 17 aa, Staphylococcus
KPNTAPIRGGTDGSQLS

SEQ ID NO: 1958699 - protein, 6 aa, Staphylococcus
KPNVKA

SEQ ID NO: 1958700 - protein, 6 aa, Staphylococcus
KPNVTN

SEQ ID NO: 1958701 - protein, 7 aa, Staphylococcus
KPNYSAQ

SEQ ID NO: 1958702 - protein, 9 aa, Staphylococcus
KPPAKEVEE

SEQ ID NO: 1958703 - protein, 5 aa, Staphylococcus
KPPAT

SEQ ID NO: 1958704 - protein, 5 aa, Staphylococcus
KPPFQ

SEQ ID NO: 1958705 - protein, 9 aa, Staphylococcus
KPPHASNRS

SEQ ID NO: 1958706 - protein, 5 aa, Staphylococcus
KPPIH

SEQ ID NO: 1958707 - protein, 5 aa, Staphylococcus
KPPIN

SEQ ID NO: 1958708 - protein, 23 aa, Staphylococcus
KPPINQSEVNNTFKSILKKDCKN

SEQ ID NO: 1958709 - protein, 5 aa, Staphylococcus
KPPKD

SEQ ID NO: 1958710 - protein, 6 aa, Staphylococcus
KPPNEI

SEQ ID NO: 1958711 - protein, 7 aa, Staphylococcus
KPPRYSS

SEQ ID NO: 1958712 - protein, 7 aa, Staphylococcus
KPPSVSE

SEQ ID NO: 1958713 - protein, 12 aa, Staphylococcus
KPPYQNCAPSRD

SEQ ID NO: 1958714 - protein, 4 aa, Staphylococcus
KPQA

SEQ ID NO: 1958715 - protein, 5 aa, Staphylococcus
KPQAL

SEQ ID NO: 1958716 - protein, 4 aa, Staphylococcus
KPQD

SEQ ID NO: 1958717 - protein, 6 aa, Staphylococcus
KPQDEI

SEQ ID NO: 1958718 - protein, 11 aa, Staphylococcus
KPQGANIGEQR

SEQ ID NO: 1958719 - protein, 14 aa, Staphylococcus
KPQHERTKNFLSRV

SEQ ID NO: 1958720 - protein, 13 aa, Staphylococcus
KPQIKDDGYIYSD

SEQ ID NO: 1958721 - protein, 4 aa, Staphylococcus
KPQL

SEQ ID NO: 1958722 - protein, 10 aa, Staphylococcus
KPQNDENIKE

SEQ ID NO: 1958723 - protein, 5 aa, Staphylococcus
KPQNI

SEQ ID NO: 1958724 - protein, 6 aa, Staphylococcus
KPQNYT

SEQ ID NO: 1958725 - protein, 10 aa, Staphylococcus
KPQRSEGNKR

SEQ ID NO: 1958726 - protein, 8 aa, Staphylococcus
KPQSDMRD

SEQ ID NO: 1958727 - protein, 7 aa, Staphylococcus
KPQSGET

SEQ ID NO: 1958728 - protein, 10 aa, Staphylococcus
KPQSHPDKTV

SEQ ID NO: 1958729 - protein, 14 aa, Staphylococcus
KPQSLYEKQPPEIY

SEQ ID NO: 1958730 - protein, 28 aa, Staphylococcus
KPQTIDKPIGKDKFHPNKKRISNTGQRA

SEQ ID NO: 1958731 - protein, 28 aa, Staphylococcus
KPQTIDSPIGKDKFHPNKRRISNTGQRA

SEQ ID NO: 1958732 - protein, 5 aa, Staphylococcus
KPQYD

SEQ ID NO: 1958733 - protein, 5 aa, Staphylococcus
KPREI

SEQ ID NO: 1958734 - protein, 17 aa, Staphylococcus
KPRLTKAKIKLSRKLKR

SEQ ID NO: 1958735 - protein, 4 aa, Staphylococcus
KPSA

SEQ ID NO: 1958736 - protein, 21 aa, Staphylococcus
KPSAHVVPGNAKKVKKGSKEY

SEQ ID NO: 1958737 - protein, 5 aa, Staphylococcus
KPSAQ

SEQ ID NO: 1958738 - protein, 10 aa, Staphylococcus
KPSDKESRHT

SEQ ID NO: 1958739 - protein, 8 aa, Staphylococcus
KPSDRLKA

SEQ ID NO: 1958740 - protein, 7 aa, Staphylococcus
KPSDSND

SEQ ID NO: 1958741 - protein, 7 aa, Staphylococcus
KPSEATS

SEQ ID NO: 1958742 - protein, 5 aa, Staphylococcus
KPSEF

SEQ ID NO: 1958743 - protein, 7 aa, Staphylococcus
KPSELTP

SEQ ID NO: 1958744 - protein, 10 aa, Staphylococcus
KPSELTPHTT

SEQ ID NO: 1958745 - protein, 16 aa, Staphylococcus
KPSENTERSWDEVPEE

SEQ ID NO: 1958746 - protein, 10 aa, Staphylococcus
KPSEQRVEPP

SEQ ID NO: 1958747 - protein, 7 aa, Staphylococcus
KPSESLT

SEQ ID NO: 1958748 - protein, 7 aa, Staphylococcus
KPSFSNP

SEQ ID NO: 1958749 - protein, 4 aa, Staphylococcus
KPSH

SEQ ID NO: 1958750 - protein, 5 aa, Staphylococcus
KPSIE

SEQ ID NO: 1958751 - protein, 7 aa, Staphylococcus
KPSITGS

SEQ ID NO: 1958752 - protein, 8 aa, Staphylococcus
KPSKRADK

SEQ ID NO: 1958753 - protein, 13 aa, Staphylococcus
KPSKTRNNKGEPY

SEQ ID NO: 1958754 - protein, 6 aa, Staphylococcus
KPSLPA

SEQ ID NO: 1958755 - protein, 7 aa, Staphylococcus
KPSMSAG

SEQ ID NO: 1958756 - protein, 6 aa, Staphylococcus
KPSPIF

SEQ ID NO: 1958757 - protein, 5 aa, Staphylococcus
KPSQI

SEQ ID NO: 1958758 - protein, 8 aa, Staphylococcus
KPSQYPGI

SEQ ID NO: 1958759 - protein, 7 aa, Staphylococcus
KPSQYPN

SEQ ID NO: 1958760 - protein, 6 aa, Staphylococcus
KPSREH

SEQ ID NO: 1958761 - protein, 6 aa, Staphylococcus
KPSSGL

SEQ ID NO: 1958762 - protein, 8 aa, Staphylococcus
KPSSNTPV

SEQ ID NO: 1958763 - protein, 10 aa, Staphylococcus
KPSTEGPARK

SEQ ID NO: 1958764 - protein, 8 aa, Staphylococcus
KPSTGKLQ

SEQ ID NO: 1958765 - protein, 11 aa, Staphylococcus
KPSYDGKGIGS

SEQ ID NO: 1958766 - protein, 11 aa, Staphylococcus
KPSYDGQGYGS

SEQ ID NO: 1958767 - protein, 13 aa, Staphylococcus
KPTAKGSSRNLQD

SEQ ID NO: 1958768 - protein, 7 aa, Staphylococcus
KPTARST

SEQ ID NO: 1958769 - protein, 19 aa, Staphylococcus
KPTASGQGQNLKELRNSEG

SEQ ID NO: 1958770 - protein, 17 aa, Staphylococcus
KPTDEHVKASPHGQNIN

SEQ ID NO: 1958771 - protein, 13 aa, Staphylococcus
KPTEAIKLMNQLL

SEQ ID NO: 1958772 - protein, 5 aa, Staphylococcus
KPTEY

SEQ ID NO: 1958773 - protein, 5 aa, Staphylococcus
KPTHS

SEQ ID NO: 1958774 - protein, 4 aa, Staphylococcus
KPTI

SEQ ID NO: 1958775 - protein, 7 aa, Staphylococcus
KPTISKW

SEQ ID NO: 1958776 - protein, 5 aa, Staphylococcus
KPTKA

SEQ ID NO: 1958777 - protein, 7 aa, Staphylococcus
KPTKASV

SEQ ID NO: 1958778 - protein, 11 aa, Staphylococcus
KPTKEESIEEI

SEQ ID NO: 1958779 - protein, 7 aa, Staphylococcus
KPTKGSI

SEQ ID NO: 1958780 - protein, 8 aa, Staphylococcus
KPTKGSIT

SEQ ID NO: 1958781 - protein, 8 aa, Staphylococcus
KPTLETSE

SEQ ID NO: 1958782 - protein, 17 aa, Staphylococcus
KPTLTKAKIKLSRKLKR

SEQ ID NO: 1958783 - protein, 11 aa, Staphylococcus
KPTNGNEKVNN

SEQ ID NO: 1958784 - protein, 8 aa, Staphylococcus
KPTNGNIE

SEQ ID NO: 1958785 - protein, 9 aa, Staphylococcus
KPTNNKLKQ

SEQ ID NO: 1958786 - protein, 7 aa, Staphylococcus
KPTNQKL

SEQ ID NO: 1958787 - protein, 9 aa, Staphylococcus
KPTNTKLQQ

SEQ ID NO: 1958788 - protein, 6 aa, Staphylococcus
KPTPIF

SEQ ID NO: 1958789 - protein, 5 aa, Staphylococcus
KPTPL

SEQ ID NO: 1958790 - protein, 5 aa, Staphylococcus
KPTPY

SEQ ID NO: 1958791 - protein, 6 aa, Staphylococcus
KPTRYE

SEQ ID NO: 1958792 - protein, 11 aa, Staphylococcus
KPTSKECNIQS

SEQ ID NO: 1958793 - protein, 7 aa, Staphylococcus
KPTSLSF

SEQ ID NO: 1958794 - protein, 8 aa, Staphylococcus
KPTSSVSY

SEQ ID NO: 1958795 - protein, 8 aa, Staphylococcus
KPTTGSLS

SEQ ID NO: 1958796 - protein, 8 aa, Staphylococcus
KPTTSSIR

SEQ ID NO: 1958797 - protein, 8 aa, Staphylococcus
KPVANAPK

SEQ ID NO: 1958798 - protein, 6 aa, Staphylococcus
KPVDRR

SEQ ID NO: 1958799 - protein, 4 aa, Staphylococcus
KPVE

SEQ ID NO: 1958800 - protein, 6 aa, Staphylococcus
KPVGKA

SEQ ID NO: 1958801 - protein, 8 aa, Staphylococcus
KPVITEST

SEQ ID NO: 1958802 - protein, 21 aa, Staphylococcus
KPVKKDKRYSYDDTGNAERLK

SEQ ID NO: 1958803 - protein, 7 aa, Staphylococcus
KPVLEGT

SEQ ID NO: 1958804 - protein, 5 aa, Staphylococcus
KPVPH

SEQ ID NO: 1958805 - protein, 6 aa, Staphylococcus
KPVSDF

SEQ ID NO: 1958806 - protein, 6 aa, Staphylococcus
KPVSDY

SEQ ID NO: 1958807 - protein, 17 aa, Staphylococcus
KPVSEALEAETEYGTAT

SEQ ID NO: 1958808 - protein, 17 aa, Staphylococcus
KPVSEALEQETELGSAT

SEQ ID NO: 1958809 - protein, 7 aa, Staphylococcus
KPVSESL

SEQ ID NO: 1958810 - protein, 22 aa, Staphylococcus
KPVTIGSGKQIKSQSVKAGTKI

SEQ ID NO: 1958811 - protein, 12 aa, Staphylococcus
KPYDEYSPEELR

SEQ ID NO: 1958812 - protein, 5 aa, Staphylococcus
KPYEA

SEQ ID NO: 1958813 - protein, 6 aa, Staphylococcus
KPYEDQ

SEQ ID NO: 1958814 - protein, 5 aa, Staphylococcus
KPYEQ

SEQ ID NO: 1958815 - protein, 8 aa, Staphylococcus
KPYEQINP

SEQ ID NO: 1958816 - protein, 10 aa, Staphylococcus
KPYHDYAPES

SEQ ID NO: 1958817 - protein, 20 aa, Staphylococcus
KPYKLKTKKDVEKITSELND

SEQ ID NO: 1958818 - protein, 14 aa, Staphylococcus
KPYKLNKKEDVEKI

SEQ ID NO: 1958819 - protein, 9 aa, Staphylococcus
KPYKLNNKD

SEQ ID NO: 1958820 - protein, 21 aa, Staphylococcus
KPYKLNTKEDVEKITTALDGD

SEQ ID NO: 1958821 - protein, 6 aa, Staphylococcus
KPYNTG

SEQ ID NO: 1958822 - protein, 8 aa, Staphylococcus
KPYPPSIP

SEQ ID NO: 1958823 - protein, 13 aa, Staphylococcus
KPYQLDPKVEQTL

SEQ ID NO: 1958824 - protein, 11 aa, Staphylococcus
KPYRGNGYASS

SEQ ID NO: 1958825 - protein, 7 aa, Staphylococcus
KPYSGYR

SEQ ID NO: 1958826 - protein, 6 aa, Staphylococcus
KPYSWG

SEQ ID NO: 1958827 - protein, 9 aa, Staphylococcus
KPYTTEQND

SEQ ID NO: 1958828 - protein, 10 aa, Staphylococcus
KPYVRGTDEG

SEQ ID NO: 1958829 - protein, 8 aa, Staphylococcus
KQAAKEVT

SEQ ID NO: 1958830 - protein, 7 aa, Staphylococcus
KQAAKPL

SEQ ID NO: 1958831 - protein, 8 aa, Staphylococcus
KQAANDDT

SEQ ID NO: 1958832 - protein, 9 aa, Staphylococcus
KQAEEKMER

SEQ ID NO: 1958833 - protein, 8 aa, Staphylococcus
KQAEFKSN

SEQ ID NO: 1958834 - protein, 39 aa, Staphylococcus
KQAESWYKDASEKELESLKNKKITKHEKDDSADPSLNKK

SEQ ID NO: 1958835 - protein, 25 aa, Staphylococcus
KQAGGEPLSEPHSNTKYENTENNKT

SEQ ID NO: 1958836 - protein, 5 aa, Staphylococcus
KQAGL

SEQ ID NO: 1958837 - protein, 10 aa, Staphylococcus
KQAGQEADVE

SEQ ID NO: 1958838 - protein, 6 aa, Staphylococcus
KQAIDE

SEQ ID NO: 1958839 - protein, 7 aa, Staphylococcus
KQAIKEG

SEQ ID NO: 1958840 - protein, 5 aa, Staphylococcus
KQAIL

SEQ ID NO: 1958841 - protein, 8 aa, Staphylococcus
KQAIPESH

SEQ ID NO: 1958842 - protein, 10 aa, Staphylococcus
KQAIQDGTAL

SEQ ID NO: 1958843 - protein, 8 aa, Staphylococcus
KQAKDIAK

SEQ ID NO: 1958844 - protein, 9 aa, Staphylococcus
KQAKSSISE

SEQ ID NO: 1958845 - protein, 12 aa, Staphylococcus
KQALDNQKTDNR

SEQ ID NO: 1958846 - protein, 7 aa, Staphylococcus
KQALPKD

SEQ ID NO: 1958847 - protein, 10 aa, Staphylococcus
KQANEKMDRS

SEQ ID NO: 1958848 - protein, 7 aa, Staphylococcus
KQANHYS

SEQ ID NO: 1958849 - protein, 8 aa, Staphylococcus
KQAPHTIS

SEQ ID NO: 1958850 - protein, 5 aa, Staphylococcus
KQAPL

SEQ ID NO: 1958851 - protein, 4 aa, Staphylococcus
KQAQ

SEQ ID NO: 1958852 - protein, 6 aa, Staphylococcus
KQAQDI

SEQ ID NO: 1958853 - protein, 5 aa, Staphylococcus
KQAQN

SEQ ID NO: 1958854 - protein, 9 aa, Staphylococcus
KQAQPIKAY

SEQ ID NO: 1958855 - protein, 13 aa, Staphylococcus
KQAQQKLEKEEAE

SEQ ID NO: 1958856 - protein, 27 aa, Staphylococcus
KQAQQPKTKSNVRKKTGLSYKEKREYE

SEQ ID NO: 1958857 - protein, 7 aa, Staphylococcus
KQASEQL

SEQ ID NO: 1958858 - protein, 8 aa, Staphylococcus
KQASSQDK

SEQ ID NO: 1958859 - protein, 6 aa, Staphylococcus
KQASSV

SEQ ID NO: 1958860 - protein, 12 aa, Staphylococcus
KQATDAPNHGLR

SEQ ID NO: 1958861 - protein, 7 aa, Staphylococcus
KQATQNC

SEQ ID NO: 1958862 - protein, 10 aa, Staphylococcus
KQAVDENAEA

SEQ ID NO: 1958863 - protein, 11 aa, Staphylococcus
KQAVDSKAEAM

SEQ ID NO: 1958864 - protein, 6 aa, Staphylococcus
KQAVPQ

SEQ ID NO: 1958865 - protein, 13 aa, Staphylococcus
KQAYEDKEELPDK

SEQ ID NO: 1958866 - protein, 7 aa, Staphylococcus
KQAYNDN

SEQ ID NO: 1958867 - protein, 10 aa, Staphylococcus
KQCSKGTQQK

SEQ ID NO: 1958868 - protein, 10 aa, Staphylococcus
KQDAEDKKTF

SEQ ID NO: 1958869 - protein, 7 aa, Staphylococcus
KQDDKQF

SEQ ID NO: 1958870 - protein, 6 aa, Staphylococcus
KQDDLS

SEQ ID NO: 1958871 - protein, 16 aa, Staphylococcus
KQDDTKELVFKNGNWA

SEQ ID NO: 1958872 - protein, 4 aa, Staphylococcus
KQDE

SEQ ID NO: 1958873 - protein, 6 aa, Staphylococcus
KQDELQ

SEQ ID NO: 1958874 - protein, 7 aa, Staphylococcus
KQDENTL

SEQ ID NO: 1958875 - protein, 13 aa, Staphylococcus
KQDGALKDTNSNI

SEQ ID NO: 1958876 - protein, 8 aa, Staphylococcus
KQDGATIA

SEQ ID NO: 1958877 - protein, 9 aa, Staphylococcus
KQDGSIEKL

SEQ ID NO: 1958878 - protein, 10 aa, Staphylococcus
KQDGSRPGVF

SEQ ID NO: 1958879 - protein, 4 aa, Staphylococcus
KQDI

SEQ ID NO: 1958880 - protein, 6 aa, Staphylococcus
KQDIKT

SEQ ID NO: 1958881 - protein, 6 aa, Staphylococcus
KQDKNI

SEQ ID NO: 1958882 - protein, 9 aa, Staphylococcus
KQDLYQASK

SEQ ID NO: 1958883 - protein, 4 aa, Staphylococcus
KQDN

SEQ ID NO: 1958884 - protein, 8 aa, Staphylococcus
KQDNPKAN

SEQ ID NO: 1958885 - protein, 13 aa, Staphylococcus
KQDNRRKKISSSK

SEQ ID NO: 1958886 - protein, 6 aa, Staphylococcus
KQDQKK

SEQ ID NO: 1958887 - protein, 16 aa, Staphylococcus
KQDRNRSRDFIDLFFG

SEQ ID NO: 1958888 - protein, 10 aa, Staphylococcus
KQDSKKGIRD

SEQ ID NO: 1958889 - protein, 10 aa, Staphylococcus
KQDTPPDNPV

SEQ ID NO: 1958890 - protein, 7 aa, Staphylococcus
KQDTTVE

SEQ ID NO: 1958891 - protein, 21 aa, Staphylococcus
KQDVDNKLGKAKRVTSNEYGT

SEQ ID NO: 1958892 - protein, 6 aa, Staphylococcus
KQEDKK

SEQ ID NO: 1958893 - protein, 24 aa, Staphylococcus
KQEDYDQHTVREDDQLELLEFVGG

SEQ ID NO: 1958894 - protein, 6 aa, Staphylococcus
KQEERE

SEQ ID NO: 1958895 - protein, 9 aa, Staphylococcus
KQEETQLPH

SEQ ID NO: 1958896 - protein, 8 aa, Staphylococcus
KQEGMGPF

SEQ ID NO: 1958897 - protein, 5 aa, Staphylococcus
KQEGY

SEQ ID NO: 1958898 - protein, 4 aa, Staphylococcus
KQEH

SEQ ID NO: 1958899 - protein, 6 aa, Staphylococcus
KQEHQG

SEQ ID NO: 1958900 - protein, 7 aa, Staphylococcus
KQEIEDA

SEQ ID NO: 1958901 - protein, 31 aa, Staphylococcus
KQEIESEKISTTDIRKSLKTGDLQKANEELG

SEQ ID NO: 1958902 - protein, 7 aa, Staphylococcus
KQEINAP

SEQ ID NO: 1958903 - protein, 5 aa, Staphylococcus
KQEKN

SEQ ID NO: 1958904 - protein, 9 aa, Staphylococcus
KQEKQRADQ

SEQ ID NO: 1958905 - protein, 14 aa, Staphylococcus
KQELDDEKISTTAI

SEQ ID NO: 1958906 - protein, 13 aa, Staphylococcus
KQELDSEKISTTA

SEQ ID NO: 1958907 - protein, 10 aa, Staphylococcus
KQELQNKEHI

SEQ ID NO: 1958908 - protein, 5 aa, Staphylococcus
KQELR

SEQ ID NO: 1958909 - protein, 6 aa, Staphylococcus
KQEMET

SEQ ID NO: 1958910 - protein, 14 aa, Staphylococcus
KQEMETEKISTTAI

SEQ ID NO: 1958911 - protein, 7 aa, Staphylococcus
KQENTSF

SEQ ID NO: 1958912 - protein, 10 aa, Staphylococcus
KQEPIPAITG

SEQ ID NO: 1958913 - protein, 11 aa, Staphylococcus
KQEPIPAITGS

SEQ ID NO: 1958914 - protein, 11 aa, Staphylococcus
KQEPIPSITGS

SEQ ID NO: 1958915 - protein, 10 aa, Staphylococcus
KQEPLSKETV

SEQ ID NO: 1958916 - protein, 7 aa, Staphylococcus
KQEPPYQ

SEQ ID NO: 1958917 - protein, 6 aa, Staphylococcus
KQEQAD

SEQ ID NO: 1958918 - protein, 9 aa, Staphylococcus
KQERALKEK

SEQ ID NO: 1958919 - protein, 19 aa, Staphylococcus
KQERPAYVKTQKANINQPI

SEQ ID NO: 1958920 - protein, 8 aa, Staphylococcus
KQERPEYI

SEQ ID NO: 1958921 - protein, 7 aa, Staphylococcus
KQESEQH

SEQ ID NO: 1958922 - protein, 7 aa, Staphylococcus
KQESGSI

SEQ ID NO: 1958923 - protein, 9 aa, Staphylococcus
KQESQDNPV

SEQ ID NO: 1958924 - protein, 7 aa, Staphylococcus
KQETKAK

SEQ ID NO: 1958925 - protein, 8 aa, Staphylococcus
KQETNLAK

SEQ ID NO: 1958926 - protein, 15 aa, Staphylococcus
KQETSAQDVYAGGDA

SEQ ID NO: 1958927 - protein, 8 aa, Staphylococcus
KQEVEGDV

SEQ ID NO: 1958928 - protein, 8 aa, Staphylococcus
KQEVKGEV

SEQ ID NO: 1958929 - protein, 5 aa, Staphylococcus
KQEYN

SEQ ID NO: 1958930 - protein, 6 aa, Staphylococcus
KQFAEE

SEQ ID NO: 1958931 - protein, 13 aa, Staphylococcus
KQFDASKTISNED

SEQ ID NO: 1958932 - protein, 6 aa, Staphylococcus
KQFDGQ

SEQ ID NO: 1958933 - protein, 14 aa, Staphylococcus
KQFDPSKKVSDEDF

SEQ ID NO: 1958934 - protein, 12 aa, Staphylococcus
KQFDSQRKRNIN

SEQ ID NO: 1958935 - protein, 4 aa, Staphylococcus
KQFE

SEQ ID NO: 1958936 - protein, 4 aa, Staphylococcus
KQFF

SEQ ID NO: 1958937 - protein, 4 aa, Staphylococcus
KQFG

SEQ ID NO: 1958938 - protein, 13 aa, Staphylococcus
KQFQQNQAISEEA

SEQ ID NO: 1958939 - protein, 7 aa, Staphylococcus
KQFSDDD

SEQ ID NO: 1958940 - protein, 7 aa, Staphylococcus
KQFSDDG

SEQ ID NO: 1958941 - protein, 7 aa, Staphylococcus
KQFSDEG

SEQ ID NO: 1958942 - protein, 7 aa, Staphylococcus
KQFSTLD

SEQ ID NO: 1958943 - protein, 8 aa, Staphylococcus
KQGANESY

SEQ ID NO: 1958944 - protein, 7 aa, Staphylococcus
KQGDESV

SEQ ID NO: 1958945 - protein, 8 aa, Staphylococcus
KQGDESVT

SEQ ID NO: 1958946 - protein, 5 aa, Staphylococcus
KQGDI

SEQ ID NO: 1958947 - protein, 10 aa, Staphylococcus
KQGDKATRQN

SEQ ID NO: 1958948 - protein, 7 aa, Staphylococcus
KQGDKLD

SEQ ID NO: 1958949 - protein, 8 aa, Staphylococcus
KQGDKSVT

SEQ ID NO: 1958950 - protein, 8 aa, Staphylococcus
KQGDKTVT

SEQ ID NO: 1958951 - protein, 7 aa, Staphylococcus
KQGDYGQ

SEQ ID NO: 1958952 - protein, 4 aa, Staphylococcus
KQGE

SEQ ID NO: 1958953 - protein, 8 aa, Staphylococcus
KQGEDEDI

SEQ ID NO: 1958954 - protein, 9 aa, Staphylococcus
KQGEKHAEV

SEQ ID NO: 1958955 - protein, 16 aa, Staphylococcus
KQGEKTATTSGYETYK

SEQ ID NO: 1958956 - protein, 7 aa, Staphylococcus
KQGELPN

SEQ ID NO: 1958957 - protein, 8 aa, Staphylococcus
KQGERHAE

SEQ ID NO: 1958958 - protein, 6 aa, Staphylococcus
KQGERR

SEQ ID NO: 1958959 - protein, 17 aa, Staphylococcus
KQGESADSLGLEGKEEI

SEQ ID NO: 1958960 - protein, 4 aa, Staphylococcus
KQGI

SEQ ID NO: 1958961 - protein, 6 aa, Staphylococcus
KQGIER

SEQ ID NO: 1958962 - protein, 6 aa, Staphylococcus
KQGKEI

SEQ ID NO: 1958963 - protein, 5 aa, Staphylococcus
KQGLQ

SEQ ID NO: 1958964 - protein, 12 aa, Staphylococcus
KQGMPSAKKKMD

SEQ ID NO: 1958965 - protein, 12 aa, Staphylococcus
KQGMPSAKKKME

SEQ ID NO: 1958966 - protein, 15 aa, Staphylococcus
KQGMPSAKKKMQETF

SEQ ID NO: 1958967 - protein, 11 aa, Staphylococcus
KQGMSSAKKKL

SEQ ID NO: 1958968 - protein, 6 aa, Staphylococcus
KQGNAV

SEQ ID NO: 1958969 - protein, 13 aa, Staphylococcus
KQGNGSIINTSSM

SEQ ID NO: 1958970 - protein, 12 aa, Staphylococcus
KQGPLSEGTVSG

SEQ ID NO: 1958971 - protein, 4 aa, Staphylococcus
KQGQ

SEQ ID NO: 1958972 - protein, 10 aa, Staphylococcus
KQGQRHAFNP

SEQ ID NO: 1958973 - protein, 6 aa, Staphylococcus
KQGRFR

SEQ ID NO: 1958974 - protein, 6 aa, Staphylococcus
KQGRIN

SEQ ID NO: 1958975 - protein, 7 aa, Staphylococcus
KQGRLSS

SEQ ID NO: 1958976 - protein, 8 aa, Staphylococcus
KQGSHGTL

SEQ ID NO: 1958977 - protein, 9 aa, Staphylococcus
KQGTNEVKS

SEQ ID NO: 1958978 - protein, 10 aa, Staphylococcus
KQGVSSDNAT

SEQ ID NO: 1958979 - protein, 10 aa, Staphylococcus
KQGVSTDGAT

SEQ ID NO: 1958980 - protein, 9 aa, Staphylococcus
KQGVSTEGA

SEQ ID NO: 1958981 - protein, 14 aa, Staphylococcus
KQHAYQQSEDEIEA

SEQ ID NO: 1958982 - protein, 10 aa, Staphylococcus
KQHETTGDVY

SEQ ID NO: 1958983 - protein, 6 aa, Staphylococcus
KQHGHE

SEQ ID NO: 1958984 - protein, 5 aa, Staphylococcus
KQHGL

SEQ ID NO: 1958985 - protein, 8 aa, Staphylococcus
KQHKQNEI

SEQ ID NO: 1958986 - protein, 6 aa, Staphylococcus
KQHLNT

SEQ ID NO: 1958987 - protein, 4 aa, Staphylococcus
KQHM

SEQ ID NO: 1958988 - protein, 8 aa, Staphylococcus
KQHPNSRR

SEQ ID NO: 1958989 - protein, 6 aa, Staphylococcus
KQHQDI

SEQ ID NO: 1958990 - protein, 8 aa, Staphylococcus
KQHSPKTK

SEQ ID NO: 1958991 - protein, 6 aa, Staphylococcus
KQHSSH

SEQ ID NO: 1958992 - protein, 12 aa, Staphylococcus
KQHVGKGPEKVQ

SEQ ID NO: 1958993 - protein, 5 aa, Staphylococcus
KQIAK

SEQ ID NO: 1958994 - protein, 5 aa, Staphylococcus
KQIAQ

SEQ ID NO: 1958995 - protein, 7 aa, Staphylococcus
KQIDEQN

SEQ ID NO: 1958996 - protein, 6 aa, Staphylococcus
KQIDGE

SEQ ID NO: 1958997 - protein, 21 aa, Staphylococcus
KQIDHDKKELLNSSELRQTDG

SEQ ID NO: 1958998 - protein, 9 aa, Staphylococcus
KQIDHDQKE

SEQ ID NO: 1958999 - protein, 5 aa, Staphylococcus
KQIDT

SEQ ID NO: 1959000 - protein, 8 aa, Staphylococcus
KQIEANVS

SEQ ID NO: 1959001 - protein, 8 aa, Staphylococcus
KQIEEKSQ

SEQ ID NO: 1959002 - protein, 9 aa, Staphylococcus
KQIEEKSSY

SEQ ID NO: 1959003 - protein, 7 aa, Staphylococcus
KQIEEKT

SEQ ID NO: 1959004 - protein, 8 aa, Staphylococcus
KQIEEKTK

SEQ ID NO: 1959005 - protein, 6 aa, Staphylococcus
KQIEEL

SEQ ID NO: 1959006 - protein, 7 aa, Staphylococcus
KQIEHDK

SEQ ID NO: 1959007 - protein, 8 aa, Staphylococcus
KQIEHDKK

SEQ ID NO: 1959008 - protein, 9 aa, Staphylococcus
KQIEHDKKE

SEQ ID NO: 1959009 - protein, 7 aa, Staphylococcus
KQIEHDQ

SEQ ID NO: 1959010 - protein, 7 aa, Staphylococcus
KQIESRL

SEQ ID NO: 1959011 - protein, 5 aa, Staphylococcus
KQIGD

SEQ ID NO: 1959012 - protein, 16 aa, Staphylococcus
KQINKSKVKPGEYDEI

SEQ ID NO: 1959013 - protein, 4 aa, Staphylococcus
KQIP

SEQ ID NO: 1959014 - protein, 5 aa, Staphylococcus
KQIPG

SEQ ID NO: 1959015 - protein, 10 aa, Staphylococcus
KQIPSEEHDD

SEQ ID NO: 1959016 - protein, 4 aa, Staphylococcus
KQIQ

SEQ ID NO: 1959017 - protein, 24 aa, Staphylococcus
KQIQGASDSPLTELGKSQAEKTKR

SEQ ID NO: 1959018 - protein, 21 aa, Staphylococcus
KQIQKDAMSKLKEANTTAKRV

SEQ ID NO: 1959019 - protein, 6 aa, Staphylococcus
KQIQND

SEQ ID NO: 1959020 - protein, 6 aa, Staphylococcus
KQIRER

SEQ ID NO: 1959021 - protein, 9 aa, Staphylococcus
KQISADEAE

SEQ ID NO: 1959022 - protein, 8 aa, Staphylococcus
KQISKKQY

SEQ ID NO: 1959023 - protein, 6 aa, Staphylococcus
KQITQD

SEQ ID NO: 1959024 - protein, 5 aa, Staphylococcus
KQKAD

SEQ ID NO: 1959025 - protein, 11 aa, Staphylococcus
KQKADDIGATT

SEQ ID NO: 1959026 - protein, 10 aa, Staphylococcus
KQKADQKLEQ

SEQ ID NO: 1959027 - protein, 10 aa, Staphylococcus
KQKDDLSKAI

SEQ ID NO: 1959028 - protein, 8 aa, Staphylococcus
KQKDLAAK

SEQ ID NO: 1959029 - protein, 8 aa, Staphylococcus
KQKDLAAQ

SEQ ID NO: 1959030 - protein, 7 aa, Staphylococcus
KQKDTET

SEQ ID NO: 1959031 - protein, 6 aa, Staphylococcus
KQKEFK

SEQ ID NO: 1959032 - protein, 6 aa, Staphylococcus
KQKEIA

SEQ ID NO: 1959033 - protein, 24 aa, Staphylococcus
KQKEKNNEQPFANPRNAAAGSLRQ

SEQ ID NO: 1959034 - protein, 6 aa, Staphylococcus
KQKELA

SEQ ID NO: 1959035 - protein, 6 aa, Staphylococcus
KQKENV

SEQ ID NO: 1959036 - protein, 7 aa, Staphylococcus
KQKETEI

SEQ ID NO: 1959037 - protein, 8 aa, Staphylococcus
KQKETEII

SEQ ID NO: 1959038 - protein, 8 aa, Staphylococcus
KQKFQPNE

SEQ ID NO: 1959039 - protein, 7 aa, Staphylococcus
KQKGADI

SEQ ID NO: 1959040 - protein, 11 aa, Staphylococcus
KQKGATESDLK

SEQ ID NO: 1959041 - protein, 6 aa, Staphylococcus
KQKGMT

SEQ ID NO: 1959042 - protein, 6 aa, Staphylococcus
KQKGNE

SEQ ID NO: 1959043 - protein, 6 aa, Staphylococcus
KQKGNT

SEQ ID NO: 1959044 - protein, 5 aa, Staphylococcus
KQKGY

SEQ ID NO: 1959045 - protein, 6 aa, Staphylococcus
KQKGYK

SEQ ID NO: 1959046 - protein, 10 aa, Staphylococcus
KQKHNDSSEY

SEQ ID NO: 1959047 - protein, 10 aa, Staphylococcus
KQKHSKQTEI

SEQ ID NO: 1959048 - protein, 11 aa, Staphylococcus
KQKHSKQTEIK

SEQ ID NO: 1959049 - protein, 10 aa, Staphylococcus
KQKHSNQTEI

SEQ ID NO: 1959050 - protein, 7 aa, Staphylococcus
KQKIQSG

SEQ ID NO: 1959051 - protein, 9 aa, Staphylococcus
KQKITRSTS

SEQ ID NO: 1959052 - protein, 14 aa, Staphylococcus
KQKIYDEHNDTSHE

SEQ ID NO: 1959053 - protein, 16 aa, Staphylococcus
KQKKGPTVKRKEKLSQ

SEQ ID NO: 1959054 - protein, 9 aa, Staphylococcus
KQKKHSDFS

SEQ ID NO: 1959055 - protein, 12 aa, Staphylococcus
KQKKKEYHDSTA

SEQ ID NO: 1959056 - protein, 17 aa, Staphylococcus
KQKKKTRATEAKRKGLA

SEQ ID NO: 1959057 - protein, 17 aa, Staphylococcus
KQKKKTRATEAKRKGLE

SEQ ID NO: 1959058 - protein, 18 aa, Staphylococcus
KQKKKTRATEAKRKGLEP

SEQ ID NO: 1959059 - protein, 10 aa, Staphylococcus
KQKKNGYIEN

SEQ ID NO: 1959060 - protein, 10 aa, Staphylococcus
KQKKSYAKPL

SEQ ID NO: 1959061 - protein, 7 aa, Staphylococcus
KQKLPKN

SEQ ID NO: 1959062 - protein, 6 aa, Staphylococcus
KQKNDI

SEQ ID NO: 1959063 - protein, 13 aa, Staphylococcus
KQKNDRTNTGTIS

SEQ ID NO: 1959064 - protein, 8 aa, Staphylococcus
KQKNEAII

SEQ ID NO: 1959065 - protein, 16 aa, Staphylococcus
KQKNNQQQQQNQNKGL

SEQ ID NO: 1959066 - protein, 11 aa, Staphylococcus
KQKNYEDLQEY

SEQ ID NO: 1959067 - protein, 4 aa, Staphylococcus
KQKP

SEQ ID NO: 1959068 - protein, 7 aa, Staphylococcus
KQKPPVE

SEQ ID NO: 1959069 - protein, 15 aa, Staphylococcus
KQKQKELEELESADQ

SEQ ID NO: 1959070 - protein, 12 aa, Staphylococcus
KQKQKELNQTIQ

SEQ ID NO: 1959071 - protein, 13 aa, Staphylococcus
KQKRITEDASKNL

SEQ ID NO: 1959072 - protein, 12 aa, Staphylococcus
KQKRNADKDPVN

SEQ ID NO: 1959073 - protein, 10 aa, Staphylococcus
KQKSNIPTTN

SEQ ID NO: 1959074 - protein, 7 aa, Staphylococcus
KQKTDRT

SEQ ID NO: 1959075 - protein, 9 aa, Staphylococcus
KQKTNYPPF

SEQ ID NO: 1959076 - protein, 15 aa, Staphylococcus
KQKTQRQKLERDTDH

SEQ ID NO: 1959077 - protein, 10 aa, Staphylococcus
KQKTQSKNSL

SEQ ID NO: 1959078 - protein, 6 aa, Staphylococcus
KQKTTI

SEQ ID NO: 1959079 - protein, 62 aa, Staphylococcus
KQKVRSKSKNKVKPGYKKKFKQQVEQMKRQERKQYSKRQNRQNRKTKRLGDSYAIRISCVNE

SEQ ID NO: 1959080 - protein, 6 aa, Staphylococcus
KQKVSQ

SEQ ID NO: 1959081 - protein, 7 aa, Staphylococcus
KQKYASD

SEQ ID NO: 1959082 - protein, 6 aa, Staphylococcus
KQKYSF

SEQ ID NO: 1959083 - protein, 6 aa, Staphylococcus
KQKYSQ

SEQ ID NO: 1959084 - protein, 6 aa, Staphylococcus
KQLAND

SEQ ID NO: 1959085 - protein, 6 aa, Staphylococcus
KQLEKE

SEQ ID NO: 1959086 - protein, 11 aa, Staphylococcus
KQLEKQEKRHE

SEQ ID NO: 1959087 - protein, 53 aa, Staphylococcus
KQLENKNDPNVSTNNTFSTISSQYDEEHTSDDSYTREDNEHSSVYNNKRSMDK

SEQ ID NO: 1959088 - protein, 6 aa, Staphylococcus
KQLENT

SEQ ID NO: 1959089 - protein, 6 aa, Staphylococcus
KQLEQH

SEQ ID NO: 1959090 - protein, 10 aa, Staphylococcus
KQLEQRNQEI

SEQ ID NO: 1959091 - protein, 16 aa, Staphylococcus
KQLEQVKNGEIQDDYI

SEQ ID NO: 1959092 - protein, 15 aa, Staphylococcus
KQLESVEKQQEKLDE

SEQ ID NO: 1959093 - protein, 6 aa, Staphylococcus
KQLETD

SEQ ID NO: 1959094 - protein, 6 aa, Staphylococcus
KQLGEK

SEQ ID NO: 1959095 - protein, 6 aa, Staphylococcus
KQLGEQ

SEQ ID NO: 1959096 - protein, 5 aa, Staphylococcus
KQLGK

SEQ ID NO: 1959097 - protein, 5 aa, Staphylococcus
KQLKG

SEQ ID NO: 1959098 - protein, 8 aa, Staphylococcus
KQLKPGDQ

SEQ ID NO: 1959099 - protein, 9 aa, Staphylococcus
KQLPKGRKP

SEQ ID NO: 1959100 - protein, 13 aa, Staphylococcus
KQLPKGRKPIKTS

SEQ ID NO: 1959101 - protein, 9 aa, Staphylococcus
KQLPKGRKT

SEQ ID NO: 1959102 - protein, 5 aa, Staphylococcus
KQLPP

SEQ ID NO: 1959103 - protein, 5 aa, Staphylococcus
KQLPQ

SEQ ID NO: 1959104 - protein, 9 aa, Staphylococcus
KQLPQKNST

SEQ ID NO: 1959105 - protein, 42 aa, Staphylococcus
KQLQKPRDHEEEERLRKRNEERKRRKEEQDRKLKEKLAQRKH

SEQ ID NO: 1959106 - protein, 5 aa, Staphylococcus
KQLQN

SEQ ID NO: 1959107 - protein, 6 aa, Staphylococcus
KQLQQD

SEQ ID NO: 1959108 - protein, 6 aa, Staphylococcus
KQLSDK

SEQ ID NO: 1959109 - protein, 7 aa, Staphylococcus
KQLSEIR

SEQ ID NO: 1959110 - protein, 14 aa, Staphylococcus
KQLSRDSYAPPQLK

SEQ ID NO: 1959111 - protein, 10 aa, Staphylococcus
KQLSSEMKKS

SEQ ID NO: 1959112 - protein, 13 aa, Staphylococcus
KQLTDTAQNGNRD

SEQ ID NO: 1959113 - protein, 7 aa, Staphylococcus
KQLTDTL

SEQ ID NO: 1959114 - protein, 14 aa, Staphylococcus
KQLTEEELEAYLED

SEQ ID NO: 1959115 - protein, 13 aa, Staphylococcus
KQMNSDNGDSDDD

SEQ ID NO: 1959116 - protein, 30 aa, Staphylococcus
KQMQGQEIPEEELAKAQEQAQAIEKDENIS

SEQ ID NO: 1959117 - protein, 11 aa, Staphylococcus
KQMSELENNQK

SEQ ID NO: 1959118 - protein, 16 aa, Staphylococcus
KQMSPAKHVINEKEGI

SEQ ID NO: 1959119 - protein, 10 aa, Staphylococcus
KQNAKTSEEH

SEQ ID NO: 1959120 - protein, 13 aa, Staphylococcus
KQNDSAATEGVEP

SEQ ID NO: 1959121 - protein, 13 aa, Staphylococcus
KQNDSESLRITEN

SEQ ID NO: 1959122 - protein, 13 aa, Staphylococcus
KQNDTADTEGIEP

SEQ ID NO: 1959123 - protein, 7 aa, Staphylococcus
KQNDVDV

SEQ ID NO: 1959124 - protein, 8 aa, Staphylococcus
KQNEPKHF

SEQ ID NO: 1959125 - protein, 20 aa, Staphylococcus
KQNEPTIKEDKTKENKTSKY

SEQ ID NO: 1959126 - protein, 20 aa, Staphylococcus
KQNETYLKENNQKQEENKNL

SEQ ID NO: 1959127 - protein, 4 aa, Staphylococcus
KQNG

SEQ ID NO: 1959128 - protein, 19 aa, Staphylococcus
KQNGEKEKFDFTTEGSWHK

SEQ ID NO: 1959129 - protein, 11 aa, Staphylococcus
KQNHSGENIEY

SEQ ID NO: 1959130 - protein, 8 aa, Staphylococcus
KQNIDKND

SEQ ID NO: 1959131 - protein, 13 aa, Staphylococcus
KQNITEFDTFISR

SEQ ID NO: 1959132 - protein, 11 aa, Staphylococcus
KQNKSKLSIQA

SEQ ID NO: 1959133 - protein, 8 aa, Staphylococcus
KQNNPSFS

SEQ ID NO: 1959134 - protein, 4 aa, Staphylococcus
KQNQ

SEQ ID NO: 1959135 - protein, 5 aa, Staphylococcus
KQNRH

SEQ ID NO: 1959136 - protein, 14 aa, Staphylococcus
KQNRYSRKEIMDKL

SEQ ID NO: 1959137 - protein, 7 aa, Staphylococcus
KQNSNNQ

SEQ ID NO: 1959138 - protein, 4 aa, Staphylococcus
KQNT

SEQ ID NO: 1959139 - protein, 8 aa, Staphylococcus
KQNVTRKE

SEQ ID NO: 1959140 - protein, 6 aa, Staphylococcus
KQNYND

SEQ ID NO: 1959141 - protein, 14 aa, Staphylococcus
KQPASAVMTNEDES

SEQ ID NO: 1959142 - protein, 6 aa, Staphylococcus
KQPDLN

SEQ ID NO: 1959143 - protein, 12 aa, Staphylococcus
KQPDLNWDNPEV

SEQ ID NO: 1959144 - protein, 13 aa, Staphylococcus
KQPDLNWDNPEVR

SEQ ID NO: 1959145 - protein, 13 aa, Staphylococcus
KQPDLNWSNPDVR

SEQ ID NO: 1959146 - protein, 6 aa, Staphylococcus
KQPDYE

SEQ ID NO: 1959147 - protein, 6 aa, Staphylococcus
KQPELA

SEQ ID NO: 1959148 - protein, 7 aa, Staphylococcus
KQPENDF

SEQ ID NO: 1959149 - protein, 13 aa, Staphylococcus
KQPERQIETNIGE

SEQ ID NO: 1959150 - protein, 20 aa, Staphylococcus
KQPERYAKEQQDRENYKKNS

SEQ ID NO: 1959151 - protein, 4 aa, Staphylococcus
KQPI

SEQ ID NO: 1959152 - protein, 6 aa, Staphylococcus
KQPIFG

SEQ ID NO: 1959153 - protein, 7 aa, Staphylococcus
KQPKADW

SEQ ID NO: 1959154 - protein, 7 aa, Staphylococcus
KQPKANW

SEQ ID NO: 1959155 - protein, 9 aa, Staphylococcus
KQPKPKVNA

SEQ ID NO: 1959156 - protein, 7 aa, Staphylococcus
KQPKTLY

SEQ ID NO: 1959157 - protein, 15 aa, Staphylococcus
KQPLQEYKHKKLFGL

SEQ ID NO: 1959158 - protein, 4 aa, Staphylococcus
KQPN

SEQ ID NO: 1959159 - protein, 7 aa, Staphylococcus
KQPNHPK

SEQ ID NO: 1959160 - protein, 7 aa, Staphylococcus
KQPNKAH

SEQ ID NO: 1959161 - protein, 7 aa, Staphylococcus
KQPNKEH

SEQ ID NO: 1959162 - protein, 5 aa, Staphylococcus
KQPPH

SEQ ID NO: 1959163 - protein, 14 aa, Staphylococcus
KQPQEAIKLINQLF

SEQ ID NO: 1959164 - protein, 9 aa, Staphylococcus
KQPQETKPV

SEQ ID NO: 1959165 - protein, 10 aa, Staphylococcus
KQPQGAPLPV

SEQ ID NO: 1959166 - protein, 6 aa, Staphylococcus
KQPQIA

SEQ ID NO: 1959167 - protein, 8 aa, Staphylococcus
KQPRGGYL

SEQ ID NO: 1959168 - protein, 6 aa, Staphylococcus
KQPYST

SEQ ID NO: 1959169 - protein, 7 aa, Staphylococcus
KQQAQFQ

SEQ ID NO: 1959170 - protein, 7 aa, Staphylococcus
KQQASAE

SEQ ID NO: 1959171 - protein, 10 aa, Staphylococcus
KQQEGKTPRV

SEQ ID NO: 1959172 - protein, 8 aa, Staphylococcus
KQQELAAK

SEQ ID NO: 1959173 - protein, 7 aa, Staphylococcus
KQQENEI

SEQ ID NO: 1959174 - protein, 13 aa, Staphylococcus
KQQETEAKQNIAV

SEQ ID NO: 1959175 - protein, 5 aa, Staphylococcus
KQQFG

SEQ ID NO: 1959176 - protein, 6 aa, Staphylococcus
KQQFNK

SEQ ID NO: 1959177 - protein, 18 aa, Staphylococcus
KQQGRKEGIGKAKITPAY

SEQ ID NO: 1959178 - protein, 30 aa, Staphylococcus
KQQGVTSTNTPPKQKSNSRGRRRSKNSYSM

SEQ ID NO: 1959179 - protein, 14 aa, Staphylococcus
KQQHDSEDATTISI

SEQ ID NO: 1959180 - protein, 5 aa, Staphylococcus
KQQHK

SEQ ID NO: 1959181 - protein, 6 aa, Staphylococcus
KQQINV

SEQ ID NO: 1959182 - protein, 13 aa, Staphylococcus
KQQKKEYHDSTAH

SEQ ID NO: 1959183 - protein, 4 aa, Staphylococcus
KQQL

SEQ ID NO: 1959184 - protein, 6 aa, Staphylococcus
KQQLEN

SEQ ID NO: 1959185 - protein, 7 aa, Staphylococcus
KQQNGDP

SEQ ID NO: 1959186 - protein, 34 aa, Staphylococcus
KQQNLNNIDKPELPKEEKNEQPPKLDTENVPEPP

SEQ ID NO: 1959187 - protein, 6 aa, Staphylococcus
KQQNLT

SEQ ID NO: 1959188 - protein, 6 aa, Staphylococcus
KQQPDM

SEQ ID NO: 1959189 - protein, 8 aa, Staphylococcus
KQQPGESY

SEQ ID NO: 1959190 - protein, 5 aa, Staphylococcus
KQQQK

SEQ ID NO: 1959191 - protein, 8 aa, Staphylococcus
KQQQYASD

SEQ ID NO: 1959192 - protein, 7 aa, Staphylococcus
KQQQYDE

SEQ ID NO: 1959193 - protein, 10 aa, Staphylococcus
KQQRDENLDT

SEQ ID NO: 1959194 - protein, 7 aa, Staphylococcus
KQQRNQD

SEQ ID NO: 1959195 - protein, 5 aa, Staphylococcus
KQQRQ

SEQ ID NO: 1959196 - protein, 5 aa, Staphylococcus
KQQST

SEQ ID NO: 1959197 - protein, 5 aa, Staphylococcus
KQQTH

SEQ ID NO: 1959198 - protein, 7 aa, Staphylococcus
KQQTLQG

SEQ ID NO: 1959199 - protein, 8 aa, Staphylococcus
KQQTPLET

SEQ ID NO: 1959200 - protein, 7 aa, Staphylococcus
KQQTTNS

SEQ ID NO: 1959201 - protein, 4 aa, Staphylococcus
KQQV

SEQ ID NO: 1959202 - protein, 7 aa, Staphylococcus
KQQVQTL

SEQ ID NO: 1959203 - protein, 6 aa, Staphylococcus
KQQYGD

SEQ ID NO: 1959204 - protein, 7 aa, Staphylococcus
KQQYPDK

SEQ ID NO: 1959205 - protein, 10 aa, Staphylococcus
KQRAAEEDID

SEQ ID NO: 1959206 - protein, 5 aa, Staphylococcus
KQRDR

SEQ ID NO: 1959207 - protein, 6 aa, Staphylococcus
KQRDRT

SEQ ID NO: 1959208 - protein, 20 aa, Staphylococcus
KQREDNQSSTYTAVKEGQPE

SEQ ID NO: 1959209 - protein, 8 aa, Staphylococcus
KQREGESY

SEQ ID NO: 1959210 - protein, 6 aa, Staphylococcus
KQREKI

SEQ ID NO: 1959211 - protein, 7 aa, Staphylococcus
KQREQLS

SEQ ID NO: 1959212 - protein, 4 aa, Staphylococcus
KQRF

SEQ ID NO: 1959213 - protein, 5 aa, Staphylococcus
KQRGI

SEQ ID NO: 1959214 - protein, 8 aa, Staphylococcus
KQRGRDIE

SEQ ID NO: 1959215 - protein, 7 aa, Staphylococcus
KQRGTQF

SEQ ID NO: 1959216 - protein, 8 aa, Staphylococcus
KQRHPQYS

SEQ ID NO: 1959217 - protein, 17 aa, Staphylococcus
KQRIKSETKELYGKISW

SEQ ID NO: 1959218 - protein, 11 aa, Staphylococcus
KQRKLKEGNTV

SEQ ID NO: 1959219 - protein, 8 aa, Staphylococcus
KQRKNVKS

SEQ ID NO: 1959220 - protein, 12 aa, Staphylococcus
KQRKTSNENGIK

SEQ ID NO: 1959221 - protein, 55 aa, Staphylococcus; identical to SEQ ID NO: 1629354

SEQ ID NO: 1959222 - protein, 4 aa, Staphylococcus
KQRQ

SEQ ID NO: 1959223 - protein, 11 aa, Staphylococcus
KQRQKQSVNLQ

SEQ ID NO: 1959224 - protein, 8 aa, Staphylococcus
KQRQPQYS

SEQ ID NO: 1959225 - protein, 7 aa, Staphylococcus
KQRRPIE

SEQ ID NO: 1959226 - protein, 7 aa, Staphylococcus
KQRRPLE

SEQ ID NO: 1959227 - protein, 7 aa, Staphylococcus
KQRRSDL

SEQ ID NO: 1959228 - protein, 19 aa, Staphylococcus
KQRSETDERQVFYLLDEGT

SEQ ID NO: 1959229 - protein, 11 aa, Staphylococcus
KQRSTGESEEI

SEQ ID NO: 1959230 - protein, 5 aa, Staphylococcus
KQRTL

SEQ ID NO: 1959231 - protein, 14 aa, Staphylococcus
KQRWSNGNVGTNGV

SEQ ID NO: 1959232 - protein, 5 aa, Staphylococcus
KQSDC

SEQ ID NO: 1959233 - protein, 15 aa, Staphylococcus
KQSDDYKESVLPSSI

SEQ ID NO: 1959234 - protein, 6 aa, Staphylococcus
KQSDKH

SEQ ID NO: 1959235 - protein, 18 aa, Staphylococcus
KQSDVTISNTVSKDEEAM

SEQ ID NO: 1959236 - protein, 7 aa, Staphylococcus
KQSEDRV

SEQ ID NO: 1959237 - protein, 5 aa, Staphylococcus
KQSEE

SEQ ID NO: 1959238 - protein, 5 aa, Staphylococcus
KQSEF

SEQ ID NO: 1959239 - protein, 8 aa, Staphylococcus
KQSEKEVT

SEQ ID NO: 1959240 - protein, 15 aa, Staphylococcus
KQSGIGRELGKEGLE

SEQ ID NO: 1959241 - protein, 11 aa, Staphylococcus
KQSGKDRKNKL

SEQ ID NO: 1959242 - protein, 5 aa, Staphylococcus
KQSGL

SEQ ID NO: 1959243 - protein, 6 aa, Staphylococcus
KQSGVN

SEQ ID NO: 1959244 - protein, 11 aa, Staphylococcus
KQSHPRNRNDS

SEQ ID NO: 1959245 - protein, 7 aa, Staphylococcus
KQSHRPT

SEQ ID NO: 1959246 - protein, 4 aa, Staphylococcus
KQSI

SEQ ID NO: 1959247 - protein, 12 aa, Staphylococcus
KQSIENGENEPS

SEQ ID NO: 1959248 - protein, 4 aa, Staphylococcus
KQSK

SEQ ID NO: 1959249 - protein, 7 aa, Staphylococcus
KQSKEPV

SEQ ID NO: 1959250 - protein, 22 aa, Staphylococcus
KQSKGDHKGKIEGEVKSIEKHS

SEQ ID NO: 1959251 - protein, 9 aa, Staphylococcus
KQSKKDYDN

SEQ ID NO: 1959252 - protein, 5 aa, Staphylococcus
KQSKP

SEQ ID NO: 1959253 - protein, 11 aa, Staphylococcus
KQSKSVSVKDL

SEQ ID NO: 1959254 - protein, 7 aa, Staphylococcus
KQSMKDI

SEQ ID NO: 1959255 - protein, 7 aa, Staphylococcus
KQSMKEI

SEQ ID NO: 1959256 - protein, 4 aa, Staphylococcus
KQSN

SEQ ID NO: 1959257 - protein, 6 aa, Staphylococcus
KQSNLP

SEQ ID NO: 1959258 - protein, 4 aa, Staphylococcus
KQSQ

SEQ ID NO: 1959259 - protein, 8 aa, Staphylococcus
KQSQKYNG

SEQ ID NO: 1959260 - protein, 13 aa, Staphylococcus
KQSQTDFNTPIIR

SEQ ID NO: 1959261 - protein, 7 aa, Staphylococcus
KQSSDVY

SEQ ID NO: 1959262 - protein, 7 aa, Staphylococcus
KQSSELI

SEQ ID NO: 1959263 - protein, 16 aa, Staphylococcus
KQSTEGQKGFEKFIQT

SEQ ID NO: 1959264 - protein, 7 aa, Staphylococcus
KQSTQYQ

SEQ ID NO: 1959265 - protein, 7 aa, Staphylococcus
KQSTSGV

SEQ ID NO: 1959266 - protein, 7 aa, Staphylococcus
KQSTSMP

SEQ ID NO: 1959267 - protein, 8 aa, Staphylococcus
KQSTSNAE

SEQ ID NO: 1959268 - protein, 7 aa, Staphylococcus
KQSVDGQ

SEQ ID NO: 1959269 - protein, 8 aa, Staphylococcus
KQSVSSVD

SEQ ID NO: 1959270 - protein, 17 aa, Staphylococcus
KQSVTQGQKLKKSDNIE

SEQ ID NO: 1959271 - protein, 5 aa, Staphylococcus
KQSWQ

SEQ ID NO: 1959272 - protein, 12 aa, Staphylococcus
KQSYEEKEELSD

SEQ ID NO: 1959273 - protein, 6 aa, Staphylococcus
KQSYEQ

SEQ ID NO: 1959274 - protein, 6 aa, Staphylococcus
KQSYGK

SEQ ID NO: 1959275 - protein, 6 aa, Staphylococcus
KQSYPQ

SEQ ID NO: 1959276 - protein, 6 aa, Staphylococcus
KQTAED

SEQ ID NO: 1959277 - protein, 8 aa, Staphylococcus
KQTANTLH

SEQ ID NO: 1959278 - protein, 5 aa, Staphylococcus
KQTAT

SEQ ID NO: 1959279 - protein, 6 aa, Staphylococcus
KQTATD

SEQ ID NO: 1959280 - protein, 8 aa, Staphylococcus
KQTATDKR

SEQ ID NO: 1959281 - protein, 9 aa, Staphylococcus
KQTDERLDR

SEQ ID NO: 1959282 - protein, 5 aa, Staphylococcus
KQTDG

SEQ ID NO: 1959283 - protein, 6 aa, Staphylococcus
KQTEAR

SEQ ID NO: 1959284 - protein, 12 aa, Staphylococcus
KQTEEQKFPNIE

SEQ ID NO: 1959285 - protein, 6 aa, Staphylococcus
KQTEQQ

SEQ ID NO: 1959286 - protein, 7 aa, Staphylococcus
KQTEQSF

SEQ ID NO: 1959287 - protein, 6 aa, Staphylococcus
KQTETI

SEQ ID NO: 1959288 - protein, 5 aa, Staphylococcus
KQTID

SEQ ID NO: 1959289 - protein, 9 aa, Staphylococcus
KQTIDKDTI

SEQ ID NO: 1959290 - protein, 11 aa, Staphylococcus
KQTKAQSKDDL

SEQ ID NO: 1959291 - protein, 14 aa, Staphylococcus
KQTKELTKELLAIT

SEQ ID NO: 1959292 - protein, 8 aa, Staphylococcus
KQTKGYKP

SEQ ID NO: 1959293 - protein, 8 aa, Staphylococcus
KQTKVNSP

SEQ ID NO: 1959294 - protein, 7 aa, Staphylococcus
KQTLEGI

SEQ ID NO: 1959295 - protein, 15 aa, Staphylococcus
KQTLESLIDKVVESR

SEQ ID NO: 1959296 - protein, 8 aa, Staphylococcus
KQTLGNTD

SEQ ID NO: 1959297 - protein, 9 aa, Staphylococcus
KQTLGNTDI

SEQ ID NO: 1959298 - protein, 6 aa, Staphylococcus
KQTMKD

SEQ ID NO: 1959299 - protein, 5 aa, Staphylococcus
KQTNE

SEQ ID NO: 1959300 - protein, 11 aa, Staphylococcus
KQTNPTIAPLA

SEQ ID NO: 1959301 - protein, 4 aa, Staphylococcus
KQTP

SEQ ID NO: 1959302 - protein, 9 aa, Staphylococcus
KQTQGNASS

SEQ ID NO: 1959303 - protein, 7 aa, Staphylococcus
KQTQPKR

SEQ ID NO: 1959304 - protein, 5 aa, Staphylococcus
KQTRD

SEQ ID NO: 1959305 - protein, 8 aa, Staphylococcus
KQTRLDKQ

SEQ ID NO: 1959306 - protein, 8 aa, Staphylococcus
KQTRSDLK

SEQ ID NO: 1959307 - protein, 17 aa, Staphylococcus
KQTRSDLKQLRNSGKVP

SEQ ID NO: 1959308 - protein, 16 aa, Staphylococcus
KQTRSDLKTLRNTGKV

SEQ ID NO: 1959309 - protein, 7 aa, Staphylococcus
KQTRSEL

SEQ ID NO: 1959310 - protein, 5 aa, Staphylococcus
KQTSY

SEQ ID NO: 1959311 - protein, 14 aa, Staphylococcus
KQTTENAERLFKLK

SEQ ID NO: 1959312 - protein, 21 aa, Staphylococcus
KQTTEVEDSKREIVSALRKLN

SEQ ID NO: 1959313 - protein, 8 aa, Staphylococcus
KQTTKEDT

SEQ ID NO: 1959314 - protein, 6 aa, Staphylococcus
KQTTYA

SEQ ID NO: 1959315 - protein, 6 aa, Staphylococcus
KQTVER

SEQ ID NO: 1959316 - protein, 7 aa, Staphylococcus
KQTVGIG

SEQ ID NO: 1959317 - protein, 6 aa, Staphylococcus
KQTYSD

SEQ ID NO: 1959318 - protein, 4 aa, Staphylococcus
KQVA

SEQ ID NO: 1959319 - protein, 7 aa, Staphylococcus
KQVADDI

SEQ ID NO: 1959320 - protein, 5 aa, Staphylococcus
KQVDS

SEQ ID NO: 1959321 - protein, 7 aa, Staphylococcus
KQVEDEE

SEQ ID NO: 1959322 - protein, 8 aa, Staphylococcus
KQVEELQE

SEQ ID NO: 1959323 - protein, 5 aa, Staphylococcus
KQVHP

SEQ ID NO: 1959324 - protein, 7 aa, Staphylococcus
KQVIGGQ

SEQ ID NO: 1959325 - protein, 4 aa, Staphylococcus
KQVL

SEQ ID NO: 1959326 - protein, 6 aa, Staphylococcus
KQVNGE

SEQ ID NO: 1959327 - protein, 10 aa, Staphylococcus
KQVNSLGEDV

SEQ ID NO: 1959328 - protein, 6 aa, Staphylococcus
KQVPEF

SEQ ID NO: 1959329 - protein, 13 aa, Staphylococcus
KQVPMKSLKNSDN

SEQ ID NO: 1959330 - protein, 8 aa, Staphylococcus
KQVREQGK

SEQ ID NO: 1959331 - protein, 8 aa, Staphylococcus
KQVSVDDV

SEQ ID NO: 1959332 - protein, 7 aa, Staphylococcus
KQVTEEG

SEQ ID NO: 1959333 - protein, 12 aa, Staphylococcus
KQVVPQITEALT

SEQ ID NO: 1959334 - protein, 8 aa, Staphylococcus
KQVYEETK

SEQ ID NO: 1959335 - protein, 8 aa, Staphylococcus
KQWPTDKA

SEQ ID NO: 1959336 - protein, 6 aa, Staphylococcus
KQYDAI

SEQ ID NO: 1959337 - protein, 5 aa, Staphylococcus
KQYDD

SEQ ID NO: 1959338 - protein, 19 aa, Staphylococcus
KQYDKEVKAGAFPAEAHTY

SEQ ID NO: 1959339 - protein, 19 aa, Staphylococcus
KQYDNEVKSGEFPSEAHTY

SEQ ID NO: 1959340 - protein, 7 aa, Staphylococcus
KQYEEAK

SEQ ID NO: 1959341 - protein, 10 aa, Staphylococcus
KQYEQYQNHE

SEQ ID NO: 1959342 - protein, 12 aa, Staphylococcus
KQYEVEDNASPI

SEQ ID NO: 1959343 - protein, 11 aa, Staphylococcus
KQYEVGEDASP

SEQ ID NO: 1959344 - protein, 10 aa, Staphylococcus
KQYEVGEHAS

SEQ ID NO: 1959345 - protein, 12 aa, Staphylococcus
KQYEVGENASPI

SEQ ID NO: 1959346 - protein, 12 aa, Staphylococcus
KQYGATSQEAQQ

SEQ ID NO: 1959347 - protein, 7 aa, Staphylococcus
KQYGENS

SEQ ID NO: 1959348 - protein, 21 aa, Staphylococcus
KQYHPDINKEEGADEKFKEIS

SEQ ID NO: 1959349 - protein, 4 aa, Staphylococcus
KQYK

SEQ ID NO: 1959350 - protein, 6 aa, Staphylococcus
KQYKMS

SEQ ID NO: 1959351 - protein, 6 aa, Staphylococcus
KQYKPP

SEQ ID NO: 1959352 - protein, 5 aa, Staphylococcus
KQYPD

SEQ ID NO: 1959353 - protein, 7 aa, Staphylococcus
KQYPGYD

SEQ ID NO: 1959354 - protein, 6 aa, Staphylococcus
KQYPNA

SEQ ID NO: 1959355 - protein, 8 aa, Staphylococcus
KQYPSTET

SEQ ID NO: 1959356 - protein, 8 aa, Staphylococcus
KQYQKNDF

SEQ ID NO: 1959357 - protein, 6 aa, Staphylococcus
KQYQLQ

SEQ ID NO: 1959358 - protein, 6 aa, Staphylococcus
KQYQNR

SEQ ID NO: 1959359 - protein, 9 aa, Staphylococcus
KQYQQYQNY

SEQ ID NO: 1959360 - protein, 7 aa, Staphylococcus
KQYSDDD

SEQ ID NO: 1959361 - protein, 7 aa, Staphylococcus
KQYTGSL

SEQ ID NO: 1959362 - protein, 5 aa, Staphylococcus
KQYTL

SEQ ID NO: 1959363 - protein, 14 aa, Staphylococcus
KQYTYGKGLEELSE

SEQ ID NO: 1959364 - protein, 19 aa, Staphylococcus
KQYVENKDFSDKANAELRA

SEQ ID NO: 1959365 - protein, 7 aa, Staphylococcus
KRAANKE

SEQ ID NO: 1959366 - protein, 8 aa, Staphylococcus
KRAARPDT

SEQ ID NO: 1959367 - protein, 8 aa, Staphylococcus
KRADGLRV

SEQ ID NO: 1959368 - protein, 7 aa, Staphylococcus
KRADINR

SEQ ID NO: 1959369 - protein, 6 aa, Staphylococcus
KRAEAA

SEQ ID NO: 1959370 - protein, 8 aa, Staphylococcus
KRAEMGAA

SEQ ID NO: 1959371 - protein, 20 aa, Staphylococcus
KRAENEVIEQKQQAKQQSLY

SEQ ID NO: 1959372 - protein, 5 aa, Staphylococcus
KRAGA

SEQ ID NO: 1959373 - protein, 26 aa, Staphylococcus
KRAGAEPLSETHGNSTYEDSEGSKSV

SEQ ID NO: 1959374 - protein, 8 aa, Staphylococcus
KRAGVSKG

SEQ ID NO: 1959375 - protein, 10 aa, Staphylococcus
KRALETKDEG

SEQ ID NO: 1959376 - protein, 6 aa, Staphylococcus
KRALSD

SEQ ID NO: 1959377 - protein, 5 aa, Staphylococcus
KRAQK

SEQ ID NO: 1959378 - protein, 9 aa, Staphylococcus
KRAQNGSKS

SEQ ID NO: 1959379 - protein, 6 aa, Staphylococcus
KRAQRG

SEQ ID NO: 1959380 - protein, 7 aa, Staphylococcus
KRAQRGI

SEQ ID NO: 1959381 - protein, 13 aa, Staphylococcus
KRAREIQASTKIS

SEQ ID NO: 1959382 - protein, 13 aa, Staphylococcus
KRARELYDKPETA

SEQ ID NO: 1959383 - protein, 10 aa, Staphylococcus
KRASNQEAGA

SEQ ID NO: 1959384 - protein, 7 aa, Staphylococcus
KRATGYY

SEQ ID NO: 1959385 - protein, 7 aa, Staphylococcus
KRATHEA

SEQ ID NO: 1959386 - protein, 5 aa, Staphylococcus
KRATI

SEQ ID NO: 1959387 - protein, 8 aa, Staphylococcus
KRATSNPR

SEQ ID NO: 1959388 - protein, 8 aa, Staphylococcus
KRATVNQL

SEQ ID NO: 1959389 - protein, 10 aa, Staphylococcus
KRAVQSSAIS

SEQ ID NO: 1959390 - protein, 8 aa, Staphylococcus
KRAYEDLE

SEQ ID NO: 1959391 - protein, 6 aa, Staphylococcus
KRCAQK

SEQ ID NO: 1959392 - protein, 11 aa, Staphylococcus
KRDAKKDNPIP

SEQ ID NO: 1959393 - protein, 11 aa, Staphylococcus
KRDAKKEDPIP

SEQ ID NO: 1959394 - protein, 11 aa, Staphylococcus
KRDAKKEKPIP

SEQ ID NO: 1959395 - protein, 11 aa, Staphylococcus
KRDAKKENPIP

SEQ ID NO: 1959396 - protein, 19 aa, Staphylococcus
KRDDINSAGKQMPSHYSKK

SEQ ID NO: 1959397 - protein, 15 aa, Staphylococcus
KRDDINSGGKQMPSH

SEQ ID NO: 1959398 - protein, 32 aa, Staphylococcus
KRDDINSGGKQMPSHFGKREKGILSQSSPVGT

SEQ ID NO: 1959399 - protein, 9 aa, Staphylococcus
KRDDNPNIS

SEQ ID NO: 1959400 - protein, 5 aa, Staphylococcus
KRDED

SEQ ID NO: 1959401 - protein, 8 aa, Staphylococcus
KRDERSKE

SEQ ID NO: 1959402 - protein, 7 aa, Staphylococcus
KRDETFP

SEQ ID NO: 1959403 - protein, 6 aa, Staphylococcus
KRDGTP

SEQ ID NO: 1959404 - protein, 7 aa, Staphylococcus
KRDHQSA

SEQ ID NO: 1959405 - protein, 13 aa, Staphylococcus
KRDKEDSHGLQPE

SEQ ID NO: 1959406 - protein, 7 aa, Staphylococcus
KRDNHSA

SEQ ID NO: 1959407 - protein, 7 aa, Staphylococcus
KRDPLDQ

SEQ ID NO: 1959408 - protein, 13 aa, Staphylococcus
KRDPRTNMRSAQN

SEQ ID NO: 1959409 - protein, 10 aa, Staphylococcus
KRDQAEPAVA

SEQ ID NO: 1959410 - protein, 5 aa, Staphylococcus
KRDQD

SEQ ID NO: 1959411 - protein, 13 aa, Staphylococcus
KRDQLTNNQKRVE

SEQ ID NO: 1959412 - protein, 11 aa, Staphylococcus
KRDQRPDSREV

SEQ ID NO: 1959413 - protein, 12 aa, Staphylococcus
KRDQWNDIYGTG

SEQ ID NO: 1959414 - protein, 5 aa, Staphylococcus
KRDRP

SEQ ID NO: 1959415 - protein, 5 aa, Staphylococcus
KRDSM

SEQ ID NO: 1959416 - protein, 10 aa, Staphylococcus
KRDSSSEDAI

SEQ ID NO: 1959417 - protein, 6 aa, Staphylococcus
KRDVNG

SEQ ID NO: 1959418 - protein, 6 aa, Staphylococcus
KRDYEE

SEQ ID NO: 1959419 - protein, 13 aa, Staphylococcus
KREDYTFPGSQVD

SEQ ID NO: 1959420 - protein, 4 aa, Staphylococcus
KREE

SEQ ID NO: 1959421 - protein, 6 aa, Staphylococcus
KREEEF

SEQ ID NO: 1959422 - protein, 5 aa, Staphylococcus
KREGK

SEQ ID NO: 1959423 - protein, 8 aa, Staphylococcus
KREGSHHH

SEQ ID NO: 1959424 - protein, 13 aa, Staphylococcus
KREIKRLSKQADK

SEQ ID NO: 1959425 - protein, 4 aa, Staphylococcus
KREK

SEQ ID NO: 1959426 - protein, 6 aa, Staphylococcus
KREKPD

SEQ ID NO: 1959427 - protein, 8 aa, Staphylococcus
KREKTWTT

SEQ ID NO: 1959428 - protein, 13 aa, Staphylococcus
KRELAYTRYTWPK

SEQ ID NO: 1959429 - protein, 4 aa, Staphylococcus
KREM

SEQ ID NO: 1959430 - protein, 8 aa, Staphylococcus
KRENRQSI

SEQ ID NO: 1959431 - protein, 7 aa, Staphylococcus
KRENTWT

SEQ ID NO: 1959432 - protein, 6 aa, Staphylococcus
KREQEM

SEQ ID NO: 1959433 - protein, 6 aa, Staphylococcus
KREQSV

SEQ ID NO: 1959434 - protein, 10 aa, Staphylococcus
KRERTENGFS

SEQ ID NO: 1959435 - protein, 10 aa, Staphylococcus
KRESKTGSKS

SEQ ID NO: 1959436 - protein, 5 aa, Staphylococcus
KRETA

SEQ ID NO: 1959437 - protein, 5 aa, Staphylococcus
KRETG

SEQ ID NO: 1959438 - protein, 5 aa, Staphylococcus
KRETI

SEQ ID NO: 1959439 - protein, 10 aa, Staphylococcus
KREYSDKTYN

SEQ ID NO: 1959440 - protein, 14 aa, Staphylococcus
KRFDANKKISESDF

SEQ ID NO: 1959441 - protein, 7 aa, Staphylococcus
KRFEQTK

SEQ ID NO: 1959442 - protein, 7 aa, Staphylococcus
KRFEQTR

SEQ ID NO: 1959443 - protein, 6 aa, Staphylococcus
KRFGSP

SEQ ID NO: 1959444 - protein, 13 aa, Staphylococcus
KRFKDEKNQTKFV

SEQ ID NO: 1959445 - protein, 16 aa, Staphylococcus
KRFNGNSRSTVGTASD

SEQ ID NO: 1959446 - protein, 9 aa, Staphylococcus
KRFNKNDLS

SEQ ID NO: 1959447 - protein, 13 aa, Staphylococcus
KRFNPDKKVSDAD

SEQ ID NO: 1959448 - protein, 5 aa, Staphylococcus
KRFPN

SEQ ID NO: 1959449 - protein, 4 aa, Staphylococcus
KRFQ

SEQ ID NO: 1959450 - protein, 4 aa, Staphylococcus
KRFS

SEQ ID NO: 1959451 - protein, 13 aa, Staphylococcus
KRFSARKTQTSPL

SEQ ID NO: 1959452 - protein, 9 aa, Staphylococcus
KRFSPNSSV

SEQ ID NO: 1959453 - protein, 4 aa, Staphylococcus
KRGA

SEQ ID NO: 1959454 - protein, 4 aa, Staphylococcus
KRGD

SEQ ID NO: 1959455 - protein, 7 aa, Staphylococcus
KRGDELD

SEQ ID NO: 1959456 - protein, 8 aa, Staphylococcus
KRGDESNG

SEQ ID NO: 1959457 - protein, 6 aa, Staphylococcus
KRGEGI

SEQ ID NO: 1959458 - protein, 6 aa, Staphylococcus
KRGEGV

SEQ ID NO: 1959459 - protein, 5 aa, Staphylococcus
KRGEK

SEQ ID NO: 1959460 - protein, 28 aa, Staphylococcus
KRGELAQKIGEEKIKQGTKVYDPQREKE

SEQ ID NO: 1959461 - protein, 28 aa, Staphylococcus
KRGELAQKIGEEKIKQGTQVYDPQREKE

SEQ ID NO: 1959462 - protein, 28 aa, Staphylococcus
KRGELAQKIGEEKLKQGTRVYDPQREKE

SEQ ID NO: 1959463 - protein, 8 aa, Staphylococcus
KRGGKYRE

SEQ ID NO: 1959464 - protein, 8 aa, Staphylococcus
KRGGSEDL

SEQ ID NO: 1959465 - protein, 5 aa, Staphylococcus
KRGGT

SEQ ID NO: 1959466 - protein, 17 aa, Staphylococcus
KRGGTTVTTGLPHPKDE

SEQ ID NO: 1959467 - protein, 4 aa, Staphylococcus
KRGH

SEQ ID NO: 1959468 - protein, 6 aa, Staphylococcus
KRGHKL

SEQ ID NO: 1959469 - protein, 7 aa, Staphylococcus
KRGHKSL

SEQ ID NO: 1959470 - protein, 8 aa, Staphylococcus
KRGIEFPG

SEQ ID NO: 1959471 - protein, 10 aa, Staphylococcus
KRGIGPTSVE

SEQ ID NO: 1959472 - protein, 19 aa, Staphylococcus
KRGKIAQKIGEEKRKQGTL

SEQ ID NO: 1959473 - protein, 5 aa, Staphylococcus
KRGKQ

SEQ ID NO: 1959474 - protein, 7 aa, Staphylococcus
KRGNDLN

SEQ ID NO: 1959475 - protein, 6 aa, Staphylococcus
KRGNDT

SEQ ID NO: 1959476 - protein, 8 aa, Staphylococcus
KRGPAKNP

SEQ ID NO: 1959477 - protein, 5 aa, Staphylococcus
KRGPW

SEQ ID NO: 1959478 - protein, 27 aa, Staphylococcus
KRGRNAKSHTKAKNTDIQTYRKSSGLE

SEQ ID NO: 1959479 - protein, 5 aa, Staphylococcus
KRGRV

SEQ ID NO: 1959480 - protein, 4 aa, Staphylococcus
KRGS

SEQ ID NO: 1959481 - protein, 5 aa, Staphylococcus
KRGSG

SEQ ID NO: 1959482 - protein, 8 aa, Staphylococcus
KRGSGTYV

SEQ ID NO: 1959483 - protein, 6 aa, Staphylococcus
KRGSNS

SEQ ID NO: 1959484 - protein, 8 aa, Staphylococcus
KRGTVRTN

SEQ ID NO: 1959485 - protein, 4 aa, Staphylococcus
KRGV

SEQ ID NO: 1959486 - protein, 11 aa, Staphylococcus
KRGVGPSSVEK

SEQ ID NO: 1959487 - protein, 7 aa, Staphylococcus
KRGYNPH

SEQ ID NO: 1959488 - protein, 7 aa, Staphylococcus
KRGYNPK

SEQ ID NO: 1959489 - protein, 21 aa, Staphylococcus
KRHGRFEHNPNNRKNKFNDEN

SEQ ID NO: 1959490 - protein, 7 aa, Staphylococcus
KRHHKSL

SEQ ID NO: 1959491 - protein, 10 aa, Staphylococcus
KRHLNPQEYP

SEQ ID NO: 1959492 - protein, 6 aa, Staphylococcus
KRHPLE

SEQ ID NO: 1959493 - protein, 18 aa, Staphylococcus
KRHQTANNFKGERSDIDH

SEQ ID NO: 1959494 - protein, 13 aa, Staphylococcus
KRHVASDSTRDKV

SEQ ID NO: 1959495 - protein, 9 aa, Staphylococcus
KRIDNEHTY

SEQ ID NO: 1959496 - protein, 7 aa, Staphylococcus
KRIDNGT

SEQ ID NO: 1959497 - protein, 8 aa, Staphylococcus
KRIEATYE

SEQ ID NO: 1959498 - protein, 6 aa, Staphylococcus
KRIEKD

SEQ ID NO: 1959499 - protein, 6 aa, Staphylococcus
KRIGKQ

SEQ ID NO: 1959500 - protein, 7 aa, Staphylococcus
KRIKANS

SEQ ID NO: 1959501 - protein, 16 aa, Staphylococcus
KRIKDKKERYEQQANR

SEQ ID NO: 1959502 - protein, 16 aa, Staphylococcus
KRIKDKKERYETQANR

SEQ ID NO: 1959503 - protein, 13 aa, Staphylococcus
KRIKSAGPSTPVE

SEQ ID NO: 1959504 - protein, 6 aa, Staphylococcus
KRIKVN

SEQ ID NO: 1959505 - protein, 6 aa, Staphylococcus
KRINED

SEQ ID NO: 1959506 - protein, 13 aa, Staphylococcus
KRINEQNDELDNL

SEQ ID NO: 1959507 - protein, 5 aa, Staphylococcus
KRINQ

SEQ ID NO: 1959508 - protein, 4 aa, Staphylococcus
KRIP

SEQ ID NO: 1959509 - protein, 7 aa, Staphylococcus
KRIPKRI

SEQ ID NO: 1959510 - protein, 11 aa, Staphylococcus
KRIQDNKQAVV

SEQ ID NO: 1959511 - protein, 11 aa, Staphylococcus
KRIQKSFSDDG

SEQ ID NO: 1959512 - protein, 11 aa, Staphylococcus
KRIRDTNKGQL

SEQ ID NO: 1959513 - protein, 6 aa, Staphylococcus
KRIRKN

SEQ ID NO: 1959514 - protein, 8 aa, Staphylococcus
KRISQEAL

SEQ ID NO: 1959515 - protein, 4 aa, Staphylococcus
KRIV

SEQ ID NO: 1959516 - protein, 18 aa, Staphylococcus
KRKAASVQKLDQTEENLT

SEQ ID NO: 1959517 - protein, 8 aa, Staphylococcus
KRKAESIN

SEQ ID NO: 1959518 - protein, 8 aa, Staphylococcus
KRKAESLQ

SEQ ID NO: 1959519 - protein, 18 aa, Staphylococcus
KRKAESVQKLDQTEDNLS

SEQ ID NO: 1959520 - protein, 18 aa, Staphylococcus
KRKAESVQKLDQTEDNLT

SEQ ID NO: 1959521 - protein, 8 aa, Staphylococcus
KRKANEVG

SEQ ID NO: 1959522 - protein, 5 aa, Staphylococcus
KRKAS

SEQ ID NO: 1959523 - protein, 19 aa, Staphylococcus
KRKATSVQKLDQTEDNLSR

SEQ ID NO: 1959524 - protein, 8 aa, Staphylococcus
KRKDEPLP

SEQ ID NO: 1959525 - protein, 5 aa, Staphylococcus
KRKDI

SEQ ID NO: 1959526 - protein, 10 aa, Staphylococcus
KRKDPQKRPV

SEQ ID NO: 1959527 - protein, 10 aa, Staphylococcus
KRKEPFEKED

SEQ ID NO: 1959528 - protein, 14 aa, Staphylococcus
KRKGLDISAQSARD

SEQ ID NO: 1959529 - protein, 14 aa, Staphylococcus
KRKGLPVNAQNAKE

SEQ ID NO: 1959530 - protein, 9 aa, Staphylococcus
KRKGRVEHV

SEQ ID NO: 1959531 - protein, 16 aa, Staphylococcus
KRKGSTVSSTLKGLEN

SEQ ID NO: 1959532 - protein, 6 aa, Staphylococcus
KRKIKE

SEQ ID NO: 1959533 - protein, 16 aa, Staphylococcus
KRKIKKPELLAPAGNL

SEQ ID NO: 1959534 - protein, 10 aa, Staphylococcus
KRKKANTEIK

SEQ ID NO: 1959535 - protein, 6 aa, Staphylococcus
KRKKAS

SEQ ID NO: 1959536 - protein, 6 aa, Staphylococcus
KRKKAT

SEQ ID NO: 1959537 - protein, 10 aa, Staphylococcus
KRKKDSSMAR

SEQ ID NO: 1959538 - protein, 8 aa, Staphylococcus
KRKKEKFM

SEQ ID NO: 1959539 - protein, 11 aa, Staphylococcus
KRKKNKEDLET

SEQ ID NO: 1959540 - protein, 15 aa, Staphylococcus
KRKLSYSEKLQNLFE

SEQ ID NO: 1959541 - protein, 18 aa, Staphylococcus
KRKMQKQRNLKDLSQKRV

SEQ ID NO: 1959542 - protein, 5 aa, Staphylococcus
KRKNA

SEQ ID NO: 1959543 - protein, 6 aa, Staphylococcus
KRKNDL

SEQ ID NO: 1959544 - protein, 7 aa, Staphylococcus
KRKNPSP

SEQ ID NO: 1959545 - protein, 5 aa, Staphylococcus
KRKNQ

SEQ ID NO: 1959546 - protein, 20 aa, Staphylococcus
KRKNYYGEGEDAMVMWVNLN

SEQ ID NO: 1959547 - protein, 9 aa, Staphylococcus
KRKPASKQE

SEQ ID NO: 1959548 - protein, 8 aa, Staphylococcus
KRKPESKQ

SEQ ID NO: 1959549 - protein, 9 aa, Staphylococcus
KRKPESKQD

SEQ ID NO: 1959550 - protein, 9 aa, Staphylococcus
KRKPETKQE

SEQ ID NO: 1959551 - protein, 6 aa, Staphylococcus
KRKQAT

SEQ ID NO: 1959552 - protein, 8 aa, Staphylococcus
KRKQFGKE

SEQ ID NO: 1959553 - protein, 12 aa, Staphylococcus
KRKQISALSGGQ

SEQ ID NO: 1959554 - protein, 5 aa, Staphylococcus
KRKQQ

SEQ ID NO: 1959555 - protein, 9 aa, Staphylococcus
KRKQSELEN

SEQ ID NO: 1959556 - protein, 5 aa, Staphylococcus
KRKQT

SEQ ID NO: 1959557 - protein, 9 aa, Staphylococcus
KRKRPKRKI

SEQ ID NO: 1959558 - protein, 17 aa, Staphylococcus
KRKRYKPSNPQTIAENE

SEQ ID NO: 1959559 - protein, 4 aa, Staphylococcus
KRKY

SEQ ID NO: 1959560 - protein, 5 aa, Staphylococcus
KRKYL

SEQ ID NO: 1959561 - protein, 30 aa, Staphylococcus
KRLAEQKATEAENTEKEEAIKKATDNATID

SEQ ID NO: 1959562 - protein, 30 aa, Staphylococcus
KRLAEQKETNAENVEKEEAINKATENAKID

SEQ ID NO: 1959563 - protein, 6 aa, Staphylococcus
KRLAGK

SEQ ID NO: 1959564 - protein, 6 aa, Staphylococcus
KRLEDG

SEQ ID NO: 1959565 - protein, 5 aa, Staphylococcus
KRLEQ

SEQ ID NO: 1959566 - protein, 10 aa, Staphylococcus
KRLEQSIKSH

SEQ ID NO: 1959567 - protein, 8 aa, Staphylococcus
KRLGATTA

SEQ ID NO: 1959568 - protein, 5 aa, Staphylococcus
KRLGK

SEQ ID NO: 1959569 - protein, 9 aa, Staphylococcus
KRLGPKTFE

SEQ ID NO: 1959570 - protein, 10 aa, Staphylococcus
KRLGSKTFEQ

SEQ ID NO: 1959571 - protein, 4 aa, Staphylococcus
KRLK

SEQ ID NO: 1959572 - protein, 6 aa, Staphylococcus
KRLNKK

SEQ ID NO: 1959573 - protein, 5 aa, Staphylococcus
KRLQQ

SEQ ID NO: 1959574 - protein, 8 aa, Staphylococcus
KRLQQKEN

SEQ ID NO: 1959575 - protein, 7 aa, Staphylococcus
KRLRPGG

SEQ ID NO: 1959576 - protein, 9 aa, Staphylococcus
KRLSDGEMT

SEQ ID NO: 1959577 - protein, 6 aa, Staphylococcus
KRLSEQ

SEQ ID NO: 1959578 - protein, 7 aa, Staphylococcus
KRLSHAT

SEQ ID NO: 1959579 - protein, 6 aa, Staphylococcus
KRLSKE

SEQ ID NO: 1959580 - protein, 7 aa, Staphylococcus
KRLSKEA

SEQ ID NO: 1959581 - protein, 9 aa, Staphylococcus
KRLSKSPAF

SEQ ID NO: 1959582 - protein, 10 aa, Staphylococcus
KRLSKSPAFF

SEQ ID NO: 1959583 - protein, 10 aa, Staphylococcus
KRLSKSPAMF

SEQ ID NO: 1959584 - protein, 6 aa, Staphylococcus
KRLSRE

SEQ ID NO: 1959585 - protein, 6 aa, Staphylococcus
KRLSYA

SEQ ID NO: 1959586 - protein, 31 aa, Staphylococcus
KRLTEQKETDAENNQKEEAINKAANNASIDV

SEQ ID NO: 1959587 - protein, 9 aa, Staphylococcus
KRLYDDNSV

SEQ ID NO: 1959588 - protein, 8 aa, Staphylococcus
KRLYEDSG

SEQ ID NO: 1959589 - protein, 13 aa, Staphylococcus
KRMEQKKIPEDLD

SEQ ID NO: 1959590 - protein, 4 aa, Staphylococcus
KRMK

SEQ ID NO: 1959591 - protein, 6 aa, Staphylococcus
KRMKRK

SEQ ID NO: 1959592 - protein, 7 aa, Staphylococcus
KRMKSKS

SEQ ID NO: 1959593 - protein, 8 aa, Staphylococcus
KRMRKTEQ

SEQ ID NO: 1959594 - protein, 19 aa, Staphylococcus
KRNAEQRAIKADDKDPEMD

SEQ ID NO: 1959595 - protein, 4 aa, Staphylococcus
KRND

SEQ ID NO: 1959596 - protein, 9 aa, Staphylococcus
KRNDDDKPA

SEQ ID NO: 1959597 - protein, 6 aa, Staphylococcus
KRNEVR

SEQ ID NO: 1959598 - protein, 10 aa, Staphylococcus
KRNGKEHTVT

SEQ ID NO: 1959599 - protein, 40 aa, Staphylococcus
KRNGKRTKIPFNAETGEFAKSNDKSTWSSYETAVNAEGVD

SEQ ID NO: 1959600 - protein, 13 aa, Staphylococcus
KRNKGKRDWTHTA

SEQ ID NO: 1959601 - protein, 7 aa, Staphylococcus
KRNKGLI

SEQ ID NO: 1959602 - protein, 7 aa, Staphylococcus
KRNMKDK

SEQ ID NO: 1959603 - protein, 18 aa, Staphylococcus
KRNMTHTAENIARLLKLT

SEQ ID NO: 1959604 - protein, 5 aa, Staphylococcus
KRNNI

SEQ ID NO: 1959605 - protein, 7 aa, Staphylococcus
KRNPHEI

SEQ ID NO: 1959606 - protein, 7 aa, Staphylococcus
KRNPISI

SEQ ID NO: 1959607 - protein, 13 aa, Staphylococcus
KRNPKTLPDESGE

SEQ ID NO: 1959608 - protein, 8 aa, Staphylococcus
KRNPNDQR

SEQ ID NO: 1959609 - protein, 7 aa, Staphylococcus
KRNRSFE

SEQ ID NO: 1959610 - protein, 6 aa, Staphylococcus
KRNSYG

SEQ ID NO: 1959611 - protein, 8 aa, Staphylococcus
KRNTQFES

SEQ ID NO: 1959612 - protein, 5 aa, Staphylococcus
KRNVD

SEQ ID NO: 1959613 - protein, 14 aa, Staphylococcus
KRNYKEDNTEEAIS

SEQ ID NO: 1959614 - protein, 5 aa, Staphylococcus
KRPAF

SEQ ID NO: 1959615 - protein, 5 aa, Staphylococcus
KRPDL

SEQ ID NO: 1959616 - protein, 9 aa, Staphylococcus
KRPGYEPDI

SEQ ID NO: 1959617 - protein, 8 aa, Staphylococcus
KRPGYQPN

SEQ ID NO: 1959618 - protein, 6 aa, Staphylococcus
KRPKEL

SEQ ID NO: 1959619 - protein, 9 aa, Staphylococcus
KRPKRPNFL

SEQ ID NO: 1959620 - protein, 7 aa, Staphylococcus
KRPNDFG

SEQ ID NO: 1959621 - protein, 13 aa, Staphylococcus
KRPNPGKVKKTGI

SEQ ID NO: 1959622 - protein, 6 aa, Staphylococcus
KRPSQY

SEQ ID NO: 1959623 - protein, 6 aa, Staphylococcus
KRPTHN

SEQ ID NO: 1959624 - protein, 6 aa, Staphylococcus
KRPTLI

SEQ ID NO: 1959625 - protein, 7 aa, Staphylococcus
KRPYRRT

SEQ ID NO: 1959626 - protein, 12 aa, Staphylococcus
KRQAITNPNTIQ

SEQ ID NO: 1959627 - protein, 45 aa, Staphylococcus
KRQDDSEEGTQAENETNHRNYNDESSQQKHQTVKDSDSNSTDIQN

SEQ ID NO: 1959628 - protein, 5 aa, Staphylococcus
KRQEL

SEQ ID NO: 1959629 - protein, 14 aa, Staphylococcus
KRQELKAKGDYEGL

SEQ ID NO: 1959630 - protein, 5 aa, Staphylococcus
KRQGF

SEQ ID NO: 1959631 - protein, 7 aa, Staphylococcus
KRQGIKK

SEQ ID NO: 1959632 - protein, 5 aa, Staphylococcus
KRQGR

SEQ ID NO: 1959633 - protein, 6 aa, Staphylococcus
KRQGRA

SEQ ID NO: 1959634 - protein, 8 aa, Staphylococcus
KRQKNKAI

SEQ ID NO: 1959635 - protein, 8 aa, Staphylococcus
KRQLNSDL

SEQ ID NO: 1959636 - protein, 9 aa, Staphylococcus
KRQPARNNT

SEQ ID NO: 1959637 - protein, 11 aa, Staphylococcus
KRQRDENLAKT

SEQ ID NO: 1959638 - protein, 4 aa, Staphylococcus
KRQS

SEQ ID NO: 1959639 - protein, 10 aa, Staphylococcus
KRQSTCSTCS

SEQ ID NO: 1959640 - protein, 34 aa, Staphylococcus
KRQTIAPKSKSMVKRGYSKRVTSPKREVKSSDWH

SEQ ID NO: 1959641 - protein, 9 aa, Staphylococcus
KRQTSSTVR

SEQ ID NO: 1959642 - protein, 7 aa, Staphylococcus
KRQVEES

SEQ ID NO: 1959643 - protein, 17 aa, Staphylococcus
KRRDENSKKHKQPSSLN

SEQ ID NO: 1959644 - protein, 13 aa, Staphylococcus
KRRDHLPITSLFN

SEQ ID NO: 1959645 - protein, 13 aa, Staphylococcus
KRRDNLPITSLFN

SEQ ID NO: 1959646 - protein, 10 aa, Staphylococcus
KRREPFEKED

SEQ ID NO: 1959647 - protein, 10 aa, Staphylococcus
KRREPFEKEE

SEQ ID NO: 1959648 - protein, 10 aa, Staphylococcus
KRREPFEKEG

SEQ ID NO: 1959649 - protein, 10 aa, Staphylococcus
KRREPFESED

SEQ ID NO: 1959650 - protein, 10 aa, Staphylococcus
KRREPFESEN

SEQ ID NO: 1959651 - protein, 4 aa, Staphylococcus
KRRG

SEQ ID NO: 1959652 - protein, 5 aa, Staphylococcus
KRRGE

SEQ ID NO: 1959653 - protein, 21 aa, Staphylococcus
KRRIQREKEQEALRKERELKR

SEQ ID NO: 1959654 - protein, 23 aa, Staphylococcus
KRRKERRQESKETIEFLSNVQNI

SEQ ID NO: 1959655 - protein, 8 aa, Staphylococcus
KRRLPDSS

SEQ ID NO: 1959656 - protein, 6 aa, Staphylococcus
KRRNET

SEQ ID NO: 1959657 - protein, 7 aa, Staphylococcus
KRRNPSP

SEQ ID NO: 1959658 - protein, 10 aa, Staphylococcus
KRSDKNFPYD

SEQ ID NO: 1959659 - protein, 10 aa, Staphylococcus
KRSDKQFPYD

SEQ ID NO: 1959660 - protein, 13 aa, Staphylococcus
KRSDKSYPKDTYE

SEQ ID NO: 1959661 - protein, 9 aa, Staphylococcus
KRSDKTFPL

SEQ ID NO: 1959662 - protein, 10 aa, Staphylococcus
KRSDNEGISN

SEQ ID NO: 1959663 - protein, 6 aa, Staphylococcus
KRSDYK

SEQ ID NO: 1959664 - protein, 8 aa, Staphylococcus
KRSEHDMK

SEQ ID NO: 1959665 - protein, 8 aa, Staphylococcus
KRSEIDER

SEQ ID NO: 1959666 - protein, 8 aa, Staphylococcus
KRSENNKE

SEQ ID NO: 1959667 - protein, 5 aa, Staphylococcus
KRSEQ

SEQ ID NO: 1959668 - protein, 6 aa, Staphylococcus
KRSEQF

SEQ ID NO: 1959669 - protein, 5 aa, Staphylococcus
KRSET

SEQ ID NO: 1959670 - protein, 8 aa, Staphylococcus
KRSGQSHM

SEQ ID NO: 1959671 - protein, 15 aa, Staphylococcus
KRSIESRTENEEGRV

SEQ ID NO: 1959672 - protein, 15 aa, Staphylococcus
KRSIKRQKSKEKHKG

SEQ ID NO: 1959673 - protein, 6 aa, Staphylococcus
KRSINE

SEQ ID NO: 1959674 - protein, 7 aa, Staphylococcus
KRSIQDE

SEQ ID NO: 1959675 - protein, 5 aa, Staphylococcus
KRSIS

SEQ ID NO: 1959676 - protein, 7 aa, Staphylococcus
KRSKDVG

SEQ ID NO: 1959677 - protein, 12 aa, Staphylococcus
KRSKELDESVET

SEQ ID NO: 1959678 - protein, 13 aa, Staphylococcus
KRSKELNESVPEI

SEQ ID NO: 1959679 - protein, 14 aa, Staphylococcus
KRSKELNESVPEIA

SEQ ID NO: 1959680 - protein, 8 aa, Staphylococcus
KRSKSNKE

SEQ ID NO: 1959681 - protein, 9 aa, Staphylococcus
KRSKSNKEF

SEQ ID NO: 1959682 - protein, 10 aa, Staphylococcus
KRSKSSNPKR

SEQ ID NO: 1959683 - protein, 5 aa, Staphylococcus
KRSPI

SEQ ID NO: 1959684 - protein, 13 aa, Staphylococcus
KRSQELNESVPEI

SEQ ID NO: 1959685 - protein, 5 aa, Staphylococcus
KRSRV

SEQ ID NO: 1959686 - protein, 9 aa, Staphylococcus
KRSSEANTA

SEQ ID NO: 1959687 - protein, 6 aa, Staphylococcus
KRSSGK

SEQ ID NO: 1959688 - protein, 19 aa, Staphylococcus
KRSSKNDSIVQNGRKKDLD

SEQ ID NO: 1959689 - protein, 7 aa, Staphylococcus
KRSVQDE

SEQ ID NO: 1959690 - protein, 8 aa, Staphylococcus
KRTAAKQT

SEQ ID NO: 1959691 - protein, 38 aa, Staphylococcus
KRTDAANTDGKDQSQEENDAVTAEAETKAADSSSEGGA

SEQ ID NO: 1959692 - protein, 39 aa, Staphylococcus
KRTDAANVDGHDNTNEETDSESAEADTNAEDSKSEGGAY

SEQ ID NO: 1959693 - protein, 38 aa, Staphylococcus
KRTDASNTDGNDKHQSEEDVETAEAETKAADSETKGGA

SEQ ID NO: 1959694 - protein, 39 aa, Staphylococcus
KRTDASNVDGKDNTSEDTDSETAEAETNAQDSKSEGGAY

SEQ ID NO: 1959695 - protein, 39 aa, Staphylococcus
KRTDASNVDGNDSSSEDNDIETAEAETKAEDSKSQGGAY

SEQ ID NO: 1959696 - protein, 5 aa, Staphylococcus
KRTDH

SEQ ID NO: 1959697 - protein, 8 aa, Staphylococcus
KRTDNNQE

SEQ ID NO: 1959698 - protein, 8 aa, Staphylococcus
KRTEAKLN

SEQ ID NO: 1959699 - protein, 8 aa, Staphylococcus
KRTEKEVR

SEQ ID NO: 1959700 - protein, 9 aa, Staphylococcus
KRTEKEVRQ

SEQ ID NO: 1959701 - protein, 10 aa, Staphylococcus
KRTEKEVRQH

SEQ ID NO: 1959702 - protein, 10 aa, Staphylococcus
KRTEKKLNKR

SEQ ID NO: 1959703 - protein, 6 aa, Staphylococcus
KRTEQE

SEQ ID NO: 1959704 - protein, 5 aa, Staphylococcus
KRTEV

SEQ ID NO: 1959705 - protein, 5 aa, Staphylococcus
KRTEY

SEQ ID NO: 1959706 - protein, 8 aa, Staphylococcus
KRTGTPIH

SEQ ID NO: 1959707 - protein, 5 aa, Staphylococcus
KRTHG

SEQ ID NO: 1959708 - protein, 8 aa, Staphylococcus
KRTHSENM

SEQ ID NO: 1959709 - protein, 6 aa, Staphylococcus
KRTISR

SEQ ID NO: 1959710 - protein, 6 aa, Staphylococcus
KRTLEN

SEQ ID NO: 1959711 - protein, 20 aa, Staphylococcus
KRTMAELTNEEKSEISHRGN

SEQ ID NO: 1959712 - protein, 8 aa, Staphylococcus
KRTNEANT

SEQ ID NO: 1959713 - protein, 17 aa, Staphylococcus
KRTNKSFEADVQEGGKY

SEQ ID NO: 1959714 - protein, 13 aa, Staphylococcus
KRTNSFEKEDIES

SEQ ID NO: 1959715 - protein, 7 aa, Staphylococcus
KRTNSYE

SEQ ID NO: 1959716 - protein, 7 aa, Staphylococcus
KRTNTYE

SEQ ID NO: 1959717 - protein, 14 aa, Staphylococcus
KRTRSELVESGQDD

SEQ ID NO: 1959718 - protein, 6 aa, Staphylococcus
KRTRTY

SEQ ID NO: 1959719 - protein, 7 aa, Staphylococcus
KRTRTYN

SEQ ID NO: 1959720 - protein, 5 aa, Staphylococcus
KRTRV

SEQ ID NO: 1959721 - protein, 6 aa, Staphylococcus
KRTRYE

SEQ ID NO: 1959722 - protein, 8 aa, Staphylococcus
KRTSGVTN

SEQ ID NO: 1959723 - protein, 6 aa, Staphylococcus
KRTSSQ

SEQ ID NO: 1959724 - protein, 23 aa, Staphylococcus
KRTSTRSFNASGVSEVGLKDGDS

SEQ ID NO: 1959725 - protein, 23 aa, Staphylococcus
KRTSTRSFNASGVTEVGLKEGDS

SEQ ID NO: 1959726 - protein, 7 aa, Staphylococcus
KRTTSED

SEQ ID NO: 1959727 - protein, 8 aa, Staphylococcus
KRTTSFGT

SEQ ID NO: 1959728 - protein, 8 aa, Staphylococcus
KRTTVSRK

SEQ ID NO: 1959729 - protein, 11 aa, Staphylococcus
KRVAGYAHEEG

SEQ ID NO: 1959730 - protein, 9 aa, Staphylococcus
KRVAPSVAR

SEQ ID NO: 1959731 - protein, 9 aa, Staphylococcus
KRVDGGKVK

SEQ ID NO: 1959732 - protein, 9 aa, Staphylococcus
KRVEQVKEN

SEQ ID NO: 1959733 - protein, 7 aa, Staphylococcus
KRVGDPV

SEQ ID NO: 1959734 - protein, 11 aa, Staphylococcus
KRVKQGNPAER

SEQ ID NO: 1959735 - protein, 16 aa, Staphylococcus
KRVKRTASGKLKRSRA

SEQ ID NO: 1959736 - protein, 16 aa, Staphylococcus
KRVKRTGSGKLKRSRA

SEQ ID NO: 1959737 - protein, 6 aa, Staphylococcus
KRVNQD

SEQ ID NO: 1959738 - protein, 5 aa, Staphylococcus
KRVPE

SEQ ID NO: 1959739 - protein, 10 aa, Staphylococcus
KRVSQKGETI

SEQ ID NO: 1959740 - protein, 12 aa, Staphylococcus
KRWEREEKAYNA

SEQ ID NO: 1959741 - protein, 6 aa, Staphylococcus
KRWTDS

SEQ ID NO: 1959742 - protein, 6 aa, Staphylococcus
KRWTKS

SEQ ID NO: 1959743 - protein, 8 aa, Staphylococcus
KRWTSSYK

SEQ ID NO: 1959744 - protein, 9 aa, Staphylococcus
KRYATRSQL

SEQ ID NO: 1959745 - protein, 6 aa, Staphylococcus
KRYDVG

SEQ ID NO: 1959746 - protein, 5 aa, Staphylococcus
KRYET

SEQ ID NO: 1959747 - protein, 9 aa, Staphylococcus
KRYGGETKE

SEQ ID NO: 1959748 - protein, 12 aa, Staphylococcus
KRYGSDKPDTRF

SEQ ID NO: 1959749 - protein, 6 aa, Staphylococcus
KRYKPE

SEQ ID NO: 1959750 - protein, 7 aa, Staphylococcus
KRYNGKR

SEQ ID NO: 1959751 - protein, 7 aa, Staphylococcus
KRYNGQL

SEQ ID NO: 1959752 - protein, 8 aa, Staphylococcus
KRYRTVDE

SEQ ID NO: 1959753 - protein, 13 aa, Staphylococcus
KRYRTVDESINPL

SEQ ID NO: 1959754 - protein, 5 aa, Staphylococcus
KRYTY

SEQ ID NO: 1959755 - protein, 23 aa, Staphylococcus
KRYVKSRRYQGIPKNQYYKGLHI

SEQ ID NO: 1959756 - protein, 16 aa, Staphylococcus
KRYVSAKSQAATLDQL

SEQ ID NO: 1959757 - protein, 11 aa, Staphylococcus
KRYVSAKSQAL

SEQ ID NO: 1959758 - protein, 5 aa, Staphylococcus
KSAAK

SEQ ID NO: 1959759 - protein, 10 aa, Staphylococcus
KSAARELASR

SEQ ID NO: 1959760 - protein, 16 aa, Staphylococcus
KSADEHQDRLDKHPED

SEQ ID NO: 1959761 - protein, 7 aa, Staphylococcus
KSADKEK

SEQ ID NO: 1959762 - protein, 8 aa, Staphylococcus
KSAEDYQK

SEQ ID NO: 1959763 - protein, 13 aa, Staphylococcus
KSAEESTKTGKPI

SEQ ID NO: 1959764 - protein, 11 aa, Staphylococcus
KSAEKVRDEDF

SEQ ID NO: 1959765 - protein, 7 aa, Staphylococcus
KSAGAKE

SEQ ID NO: 1959766 - protein, 23 aa, Staphylococcus
KSAGKSGDKPRYVEDKKKTAKEL

SEQ ID NO: 1959767 - protein, 9 aa, Staphylococcus
KSAGLDTTR

SEQ ID NO: 1959768 - protein, 13 aa, Staphylococcus
KSAHASENADEAL

SEQ ID NO: 1959769 - protein, 15 aa, Staphylococcus
KSAHASENADEARNA

SEQ ID NO: 1959770 - protein, 6 aa, Staphylococcus
KSAKEI

SEQ ID NO: 1959771 - protein, 8 aa, Staphylococcus
KSAKKPVV

SEQ ID NO: 1959772 - protein, 7 aa, Staphylococcus
KSAKRVD

SEQ ID NO: 1959773 - protein, 26 aa, Staphylococcus
KSAKTINSGISPTEKATIAKDIKDGK

SEQ ID NO: 1959774 - protein, 9 aa, Staphylococcus
KSALESEAD

SEQ ID NO: 1959775 - protein, 7 aa, Staphylococcus
KSALGKA

SEQ ID NO: 1959776 - protein, 7 aa, Staphylococcus
KSALPND

SEQ ID NO: 1959777 - protein, 4 aa, Staphylococcus
KSAN

SEQ ID NO: 1959778 - protein, 15 aa, Staphylococcus
KSANEHQDRLENYPE

SEQ ID NO: 1959779 - protein, 5 aa, Staphylococcus
KSANK

SEQ ID NO: 1959780 - protein, 5 aa, Staphylococcus
KSAQH

SEQ ID NO: 1959781 - protein, 6 aa, Staphylococcus
KSAQLD

SEQ ID NO: 1959782 - protein, 16 aa, Staphylococcus
KSARERVKNLEYTQHL

SEQ ID NO: 1959783 - protein, 16 aa, Staphylococcus
KSARHRVKDLEYTQHL

SEQ ID NO: 1959784 - protein, 6 aa, Staphylococcus
KSATIS

SEQ ID NO: 1959785 - protein, 7 aa, Staphylococcus
KSATTIR

SEQ ID NO: 1959786 - protein, 10 aa, Staphylococcus
KSAVSKGYNM

SEQ ID NO: 1959787 - protein, 6 aa, Staphylococcus
KSAYEE

SEQ ID NO: 1959788 - protein, 6 aa, Staphylococcus
KSAYGK

SEQ ID NO: 1959789 - protein, 6 aa, Staphylococcus
KSCEVP

SEQ ID NO: 1959790 - protein, 7 aa, Staphylococcus
KSCEVPK

SEQ ID NO: 1959791 - protein, 8 aa, Staphylococcus
KSCEVPKA

SEQ ID NO: 1959792 - protein, 6 aa, Staphylococcus
KSCGKA

SEQ ID NO: 1959793 - protein, 11 aa, Staphylococcus
KSCQIDDSKGF

SEQ ID NO: 1959794 - protein, 24 aa, Staphylococcus
KSDAFKEAHQNRDKTSSESSPVIS

SEQ ID NO: 1959795 - protein, 11 aa, Staphylococcus
KSDDDHDMQEE

SEQ ID NO: 1959796 - protein, 10 aa, Staphylococcus
KSDDEHEMEE

SEQ ID NO: 1959797 - protein, 10 aa, Staphylococcus
KSDDEHEMQE

SEQ ID NO: 1959798 - protein, 6 aa, Staphylococcus
KSDDME

SEQ ID NO: 1959799 - protein, 6 aa, Staphylococcus
KSDDQV

SEQ ID NO: 1959800 - protein, 12 aa, Staphylococcus
KSDEEAKALAKE

SEQ ID NO: 1959801 - protein, 14 aa, Staphylococcus
KSDEEAKALAKEHG

SEQ ID NO: 1959802 - protein, 9 aa, Staphylococcus
KSDEGRVSF

SEQ ID NO: 1959803 - protein, 8 aa, Staphylococcus
KSDEGSAY

SEQ ID NO: 1959804 - protein, 7 aa, Staphylococcus
KSDEHGK

SEQ ID NO: 1959805 - protein, 6 aa, Staphylococcus
KSDEID

SEQ ID NO: 1959806 - protein, 9 aa, Staphylococcus
KSDEITAQY

SEQ ID NO: 1959807 - protein, 6 aa, Staphylococcus
KSDEKH

SEQ ID NO: 1959808 - protein, 6 aa, Staphylococcus
KSDELT

SEQ ID NO: 1959809 - protein, 10 aa, Staphylococcus
KSDENKETKH

SEQ ID NO: 1959810 - protein, 6 aa, Staphylococcus
KSDERI

SEQ ID NO: 1959811 - protein, 5 aa, Staphylococcus
KSDEV

SEQ ID NO: 1959812 - protein, 8 aa, Staphylococcus
KSDFDDEI

SEQ ID NO: 1959813 - protein, 9 aa, Staphylococcus
KSDGKIDTE

SEQ ID NO: 1959814 - protein, 58 aa, Staphylococcus
KSDGTFKKEEETQKHERIPTDPLNGARSYEKTEDKKSSDHQNDETAATSSKSKEELQH

SEQ ID NO: 1959815 - protein, 8 aa, Staphylococcus
KSDGYRIG

SEQ ID NO: 1959816 - protein, 8 aa, Staphylococcus
KSDHDNTG

SEQ ID NO: 1959817 - protein, 39 aa, Staphylococcus
KSDKEAKTTKPTITTPSTSKSKKTTPPKQTKAKVTVEKS

SEQ ID NO: 1959818 - protein, 10 aa, Staphylococcus
KSDKPIHGHT

SEQ ID NO: 1959819 - protein, 10 aa, Staphylococcus
KSDLKDGAKV

SEQ ID NO: 1959820 - protein, 8 aa, Staphylococcus
KSDLNQLK

SEQ ID NO: 1959821 - protein, 12 aa, Staphylococcus
KSDLNYIVHAAT

SEQ ID NO: 1959822 - protein, 14 aa, Staphylococcus
KSDMNRTVNGNRPH

SEQ ID NO: 1959823 - protein, 12 aa, Staphylococcus
KSDMRQPEYTWR

SEQ ID NO: 1959824 - protein, 4 aa, Staphylococcus
KSDN

SEQ ID NO: 1959825 - protein, 14 aa, Staphylococcus
KSDNIEESKAISEK

SEQ ID NO: 1959826 - protein, 7 aa, Staphylococcus
KSDPRNT

SEQ ID NO: 1959827 - protein, 6 aa, Staphylococcus
KSDQDV

SEQ ID NO: 1959828 - protein, 9 aa, Staphylococcus
KSDRDDLTN

SEQ ID NO: 1959829 - protein, 10 aa, Staphylococcus
KSDRDDLTNL

SEQ ID NO: 1959830 - protein, 7 aa, Staphylococcus
KSDTEKD

SEQ ID NO: 1959831 - protein, 6 aa, Staphylococcus
KSDTTQ

SEQ ID NO: 1959832 - protein, 5 aa, Staphylococcus
KSDVD

SEQ ID NO: 1959833 - protein, 7 aa, Staphylococcus
KSDVEAE

SEQ ID NO: 1959834 - protein, 7 aa, Staphylococcus
KSDYANG

SEQ ID NO: 1959835 - protein, 5 aa, Staphylococcus
KSDYQ

SEQ ID NO: 1959836 - protein, 8 aa, Staphylococcus
KSDYSGHD

SEQ ID NO: 1959837 - protein, 4 aa, Staphylococcus
KSEA

SEQ ID NO: 1959838 - protein, 9 aa, Staphylococcus
KSEAAAKRL

SEQ ID NO: 1959839 - protein, 8 aa, Staphylococcus
KSEAFKEK

SEQ ID NO: 1959840 - protein, 11 aa, Staphylococcus
KSEAIKPELGQ

SEQ ID NO: 1959841 - protein, 9 aa, Staphylococcus
KSEAIRPEL

SEQ ID NO: 1959842 - protein, 7 aa, Staphylococcus
KSEASTV

SEQ ID NO: 1959843 - protein, 20 aa, Staphylococcus
KSEAVTRLNDNNHIIKKAIQ

SEQ ID NO: 1959844 - protein, 4 aa, Staphylococcus
KSED

SEQ ID NO: 1959845 - protein, 6 aa, Staphylococcus
KSEEEI

SEQ ID NO: 1959846 - protein, 10 aa, Staphylococcus
KSEEEREEAL

SEQ ID NO: 1959847 - protein, 8 aa, Staphylococcus
KSEEGANY

SEQ ID NO: 1959848 - protein, 5 aa, Staphylococcus
KSEEI

SEQ ID NO: 1959849 - protein, 8 aa, Staphylococcus
KSEEIDGY

SEQ ID NO: 1959850 - protein, 16 aa, Staphylococcus
KSEEKEIPTYQKTASI

SEQ ID NO: 1959851 - protein, 8 aa, Staphylococcus
KSEEVEQF

SEQ ID NO: 1959852 - protein, 5 aa, Staphylococcus
KSEFT

SEQ ID NO: 1959853 - protein, 5 aa, Staphylococcus
KSEGA

SEQ ID NO: 1959854 - protein, 5 aa, Staphylococcus
KSEGF

SEQ ID NO: 1959855 - protein, 6 aa, Staphylococcus
KSEGID

SEQ ID NO: 1959856 - protein, 30 aa, Staphylococcus
KSEGIKPDLKDASSKVATASSLSADEAQEL

SEQ ID NO: 1959857 - protein, 16 aa, Staphylococcus
KSEGIKRLNGKPVASQ

SEQ ID NO: 1959858 - protein, 6 aa, Staphylococcus
KSEHAR

SEQ ID NO: 1959859 - protein, 8 aa, Staphylococcus
KSEKAQRA

SEQ ID NO: 1959860 - protein, 27 aa, Staphylococcus
KSEKFKPELSDASQKVANASSLSNDEV

SEQ ID NO: 1959861 - protein, 23 aa, Staphylococcus
KSEKIRPELSSASEKVATASSLS

SEQ ID NO: 1959862 - protein, 12 aa, Staphylococcus
KSEKKDVSTNNK

SEQ ID NO: 1959863 - protein, 8 aa, Staphylococcus
KSEKLDDN

SEQ ID NO: 1959864 - protein, 20 aa, Staphylococcus
KSEKLDQAFRDTQSKIEAQG

SEQ ID NO: 1959865 - protein, 6 aa, Staphylococcus
KSEKRK

SEQ ID NO: 1959866 - protein, 8 aa, Staphylococcus
KSEKSTHI

SEQ ID NO: 1959867 - protein, 6 aa, Staphylococcus
KSEKVS

SEQ ID NO: 1959868 - protein, 6 aa, Staphylococcus
KSEKWY

SEQ ID NO: 1959869 - protein, 4 aa, Staphylococcus
KSEL

SEQ ID NO: 1959870 - protein, 18 aa, Staphylococcus
KSELDEQRKDEYKNQGIE

SEQ ID NO: 1959871 - protein, 6 aa, Staphylococcus
KSELGD

SEQ ID NO: 1959872 - protein, 7 aa, Staphylococcus
KSELKRD

SEQ ID NO: 1959873 - protein, 10 aa, Staphylococcus
KSELSPTPKW

SEQ ID NO: 1959874 - protein, 6 aa, Staphylococcus
KSELTN

SEQ ID NO: 1959875 - protein, 8 aa, Staphylococcus
KSEMGRQA

SEQ ID NO: 1959876 - protein, 16 aa, Staphylococcus
KSENIKPELSDASQKV

SEQ ID NO: 1959877 - protein, 5 aa, Staphylococcus
KSENQ

SEQ ID NO: 1959878 - protein, 8 aa, Staphylococcus
KSENRDEL

SEQ ID NO: 1959879 - protein, 7 aa, Staphylococcus
KSENSRK

SEQ ID NO: 1959880 - protein, 4 aa, Staphylococcus
KSEP

SEQ ID NO: 1959881 - protein, 7 aa, Staphylococcus
KSEPEDI

SEQ ID NO: 1959882 - protein, 8 aa, Staphylococcus
KSEPGYGP

SEQ ID NO: 1959883 - protein, 6 aa, Staphylococcus
KSEPQL

SEQ ID NO: 1959884 - protein, 7 aa, Staphylococcus
KSEPSQS

SEQ ID NO: 1959885 - protein, 7 aa, Staphylococcus
KSEPYHS

SEQ ID NO: 1959886 - protein, 6 aa, Staphylococcus
KSEQDK

SEQ ID NO: 1959887 - protein, 29 aa, Staphylococcus
KSEQDVESTKANSESPHNKKSNENDFKSA

SEQ ID NO: 1959888 - protein, 11 aa, Staphylococcus
KSEQEQTTKSG

SEQ ID NO: 1959889 - protein, 6 aa, Staphylococcus
KSEQGQ

SEQ ID NO: 1959890 - protein, 8 aa, Staphylococcus
KSEQYTNG

SEQ ID NO: 1959891 - protein, 4 aa, Staphylococcus
KSER

SEQ ID NO: 1959892 - protein, 8 aa, Staphylococcus
KSERERLN

SEQ ID NO: 1959893 - protein, 10 aa, Staphylococcus
KSERKPNRKM

SEQ ID NO: 1959894 - protein, 7 aa, Staphylococcus
KSERLSS

SEQ ID NO: 1959895 - protein, 8 aa, Staphylococcus
KSERQGQS

SEQ ID NO: 1959896 - protein, 12 aa, Staphylococcus
KSERQLSNETFR

SEQ ID NO: 1959897 - protein, 8 aa, Staphylococcus
KSERTIYD

SEQ ID NO: 1959898 - protein, 7 aa, Staphylococcus
KSESCET

SEQ ID NO: 1959899 - protein, 7 aa, Staphylococcus
KSESDRK

SEQ ID NO: 1959900 - protein, 27 aa, Staphylococcus
KSESHMKHNDESKVPEDMTSTNEGEFK

SEQ ID NO: 1959901 - protein, 10 aa, Staphylococcus
KSESLEQSKP

SEQ ID NO: 1959902 - protein, 13 aa, Staphylococcus
KSESNKPFTSHSQ

SEQ ID NO: 1959903 - protein, 9 aa, Staphylococcus
KSESPSTKI

SEQ ID NO: 1959904 - protein, 4 aa, Staphylococcus
KSET

SEQ ID NO: 1959905 - protein, 8 aa, Staphylococcus
KSETDACE

SEQ ID NO: 1959906 - protein, 24 aa, Staphylococcus
KSETDARAAGVYPAEEALNEEDEM

SEQ ID NO: 1959907 - protein, 10 aa, Staphylococcus
KSETDARDAG

SEQ ID NO: 1959908 - protein, 9 aa, Staphylococcus
KSETDAREA

SEQ ID NO: 1959909 - protein, 28 aa, Staphylococcus
KSETIRPELSTASEKVATASSLSKEEVK

SEQ ID NO: 1959910 - protein, 7 aa, Staphylococcus
KSETMDK

SEQ ID NO: 1959911 - protein, 9 aa, Staphylococcus
KSETSGYEA

SEQ ID NO: 1959912 - protein, 15 aa, Staphylococcus
KSETSLGRAYEKTAI

SEQ ID NO: 1959913 - protein, 8 aa, Staphylococcus
KSETYRQA

SEQ ID NO: 1959914 - protein, 7 aa, Staphylococcus
KSEVAPY

SEQ ID NO: 1959915 - protein, 8 aa, Staphylococcus
KSEVTYRE

SEQ ID NO: 1959916 - protein, 8 aa, Staphylococcus
KSEWTTKK

SEQ ID NO: 1959917 - protein, 4 aa, Staphylococcus
KSEY

SEQ ID NO: 1959918 - protein, 9 aa, Staphylococcus
KSFAENGKG

SEQ ID NO: 1959919 - protein, 5 aa, Staphylococcus
KSFDG

SEQ ID NO: 1959920 - protein, 4 aa, Staphylococcus
KSFE

SEQ ID NO: 1959921 - protein, 11 aa, Staphylococcus
KSFFDSNKDPE

SEQ ID NO: 1959922 - protein, 11 aa, Staphylococcus
KSFFSSKDDPE

SEQ ID NO: 1959923 - protein, 6 aa, Staphylococcus
KSFHPE

SEQ ID NO: 1959924 - protein, 9 aa, Staphylococcus
KSFISPKSF

SEQ ID NO: 1959925 - protein, 7 aa, Staphylococcus
KSFKDST

SEQ ID NO: 1959926 - protein, 12 aa, Staphylococcus
KSFKERGLEEPT

SEQ ID NO: 1959927 - protein, 7 aa, Staphylococcus
KSFKPEG

SEQ ID NO: 1959928 - protein, 7 aa, Staphylococcus
KSFNRSD

SEQ ID NO: 1959929 - protein, 20 aa, Staphylococcus
KSFNTRKKRERKDDHLTNEV

SEQ ID NO: 1959930 - protein, 6 aa, Staphylococcus
KSFPER

SEQ ID NO: 1959931 - protein, 5 aa, Staphylococcus
KSFPM

SEQ ID NO: 1959932 - protein, 7 aa, Staphylococcus
KSFPYSD

SEQ ID NO: 1959933 - protein, 14 aa, Staphylococcus
KSFQESAHLSEKGS

SEQ ID NO: 1959934 - protein, 15 aa, Staphylococcus
KSFQESAHLSEKGSI

SEQ ID NO: 1959935 - protein, 5 aa, Staphylococcus
KSFQR

SEQ ID NO: 1959936 - protein, 4 aa, Staphylococcus
KSFS

SEQ ID NO: 1959937 - protein, 5 aa, Staphylococcus
KSFSD

SEQ ID NO: 1959938 - protein, 10 aa, Staphylococcus
KSFSKGGFLT

SEQ ID NO: 1959939 - protein, 6 aa, Staphylococcus
KSFSPQ

SEQ ID NO: 1959940 - protein, 6 aa, Staphylococcus
KSFSTG

SEQ ID NO: 1959941 - protein, 7 aa, Staphylococcus
KSFTDAE

SEQ ID NO: 1959942 - protein, 5 aa, Staphylococcus
KSGAD

SEQ ID NO: 1959943 - protein, 19 aa, Staphylococcus
KSGDETEINAPGPNVTSEQ

SEQ ID NO: 1959944 - protein, 18 aa, Staphylococcus
KSGDETEINAPGPSITDD

SEQ ID NO: 1959945 - protein, 7 aa, Staphylococcus
KSGDEWR

SEQ ID NO: 1959946 - protein, 21 aa, Staphylococcus
KSGDNAKDKAFDQIKGNKVDS

SEQ ID NO: 1959947 - protein, 15 aa, Staphylococcus
KSGDSLMDDDAKADL

SEQ ID NO: 1959948 - protein, 16 aa, Staphylococcus
KSGDSLMDDDTKKHLQ

SEQ ID NO: 1959949 - protein, 15 aa, Staphylococcus
KSGDSLMDDETKKHL

SEQ ID NO: 1959950 - protein, 8 aa, Staphylococcus
KSGDYNTN

SEQ ID NO: 1959951 - protein, 6 aa, Staphylococcus
KSGEIE

SEQ ID NO: 1959952 - protein, 12 aa, Staphylococcus
KSGEPDPESNQA

SEQ ID NO: 1959953 - protein, 12 aa, Staphylococcus
KSGEPDPESNQN

SEQ ID NO: 1959954 - protein, 4 aa, Staphylococcus
KSGG

SEQ ID NO: 1959955 - protein, 10 aa, Staphylococcus
KSGGHAQSNI

SEQ ID NO: 1959956 - protein, 6 aa, Staphylococcus
KSGGKL

SEQ ID NO: 1959957 - protein, 9 aa, Staphylococcus
KSGGSLSPV

SEQ ID NO: 1959958 - protein, 8 aa, Staphylococcus
KSGHHKDG

SEQ ID NO: 1959959 - protein, 6 aa, Staphylococcus
KSGHQT

SEQ ID NO: 1959960 - protein, 12 aa, Staphylococcus
KSGIKADKDYLQ

SEQ ID NO: 1959961 - protein, 7 aa, Staphylococcus
KSGINEN

SEQ ID NO: 1959962 - protein, 5 aa, Staphylococcus
KSGKA

SEQ ID NO: 1959963 - protein, 18 aa, Staphylococcus
KSGLLASPNEDDKPDEIQ

SEQ ID NO: 1959964 - protein, 8 aa, Staphylococcus
KSGLLNDP

SEQ ID NO: 1959965 - protein, 18 aa, Staphylococcus
KSGLMAEPNEHDKPEEIT

SEQ ID NO: 1959966 - protein, 7 aa, Staphylococcus
KSGLNDN

SEQ ID NO: 1959967 - protein, 15 aa, Staphylococcus
KSGLSGAGKNPTTAS

SEQ ID NO: 1959968 - protein, 7 aa, Staphylococcus
KSGLSQL

SEQ ID NO: 1959969 - protein, 18 aa, Staphylococcus
KSGNETEINANGPAISED

SEQ ID NO: 1959970 - protein, 7 aa, Staphylococcus
KSGNLAG

SEQ ID NO: 1959971 - protein, 9 aa, Staphylococcus
KSGPFANQV

SEQ ID NO: 1959972 - protein, 10 aa, Staphylococcus
KSGPFSNQVG

SEQ ID NO: 1959973 - protein, 19 aa, Staphylococcus
KSGQETEINAPGPKVTQEQ

SEQ ID NO: 1959974 - protein, 19 aa, Staphylococcus
KSGQETEINAPGPNISKQQ

SEQ ID NO: 1959975 - protein, 10 aa, Staphylococcus
KSGRNPLSQE

SEQ ID NO: 1959976 - protein, 6 aa, Staphylococcus
KSGSAV

SEQ ID NO: 1959977 - protein, 9 aa, Staphylococcus
KSGSGKSTI

SEQ ID NO: 1959978 - protein, 9 aa, Staphylococcus
KSGSGKSTL

SEQ ID NO: 1959979 - protein, 18 aa, Staphylococcus
KSGSGRLITDSKGKWKNK

SEQ ID NO: 1959980 - protein, 5 aa, Staphylococcus
KSGSI

SEQ ID NO: 1959981 - protein, 21 aa, Staphylococcus
KSGTITIGDTSFDASKHNKKD

SEQ ID NO: 1959982 - protein, 7 aa, Staphylococcus
KSGTLNR

SEQ ID NO: 1959983 - protein, 5 aa, Staphylococcus
KSGVD

SEQ ID NO: 1959984 - protein, 6 aa, Staphylococcus
KSGVEA

SEQ ID NO: 1959985 - protein, 8 aa, Staphylococcus
KSGVGTIA

SEQ ID NO: 1959986 - protein, 9 aa, Staphylococcus
KSGVGTIAS

SEQ ID NO: 1959987 - protein, 9 aa, Staphylococcus
KSGVGTTKF

SEQ ID NO: 1959988 - protein, 11 aa, Staphylococcus
KSGVRRDDGSY

SEQ ID NO: 1959989 - protein, 7 aa, Staphylococcus
KSGYEAA

SEQ ID NO: 1959990 - protein, 6 aa, Staphylococcus
KSGYKE

SEQ ID NO: 1959991 - protein, 5 aa, Staphylococcus
KSGYR

SEQ ID NO: 1959992 - protein, 6 aa, Staphylococcus
KSGYRD

SEQ ID NO: 1959993 - protein, 6 aa, Staphylococcus
KSHAKD

SEQ ID NO: 1959994 - protein, 5 aa, Staphylococcus
KSHAP

SEQ ID NO: 1959995 - protein, 4 aa, Staphylococcus
KSHD

SEQ ID NO: 1959996 - protein, 7 aa, Staphylococcus
KSHGADT

SEQ ID NO: 1959997 - protein, 7 aa, Staphylococcus
KSHIEEK

SEQ ID NO: 1959998 - protein, 10 aa, Staphylococcus
KSHNQFSNDE

SEQ ID NO: 1959999 - protein, 6 aa, Staphylococcus
KSHPEI

SEQ ID NO: 1960000 - protein, 11 aa, Staphylococcus
KSHQTTPPDYF

SEQ ID NO: 1960001 - protein, 10 aa, Staphylococcus
KSHTTPPNLK

SEQ ID NO: 1960002 - protein, 9 aa, Staphylococcus
KSHTTPTNL

SEQ ID NO: 1960003 - protein, 7 aa, Staphylococcus
KSIADGD

SEQ ID NO: 1960004 - protein, 6 aa, Staphylococcus
KSIDDD

SEQ ID NO: 1960005 - protein, 6 aa, Staphylococcus
KSIDRT

SEQ ID NO: 1960006 - protein, 6 aa, Staphylococcus
KSIDTL

SEQ ID NO: 1960007 - protein, 6 aa, Staphylococcus
KSIDTP

SEQ ID NO: 1960008 - protein, 4 aa, Staphylococcus
KSIE

SEQ ID NO: 1960009 - protein, 13 aa, Staphylococcus
KSIEDKGAYKEVN

SEQ ID NO: 1960010 - protein, 12 aa, Staphylococcus
KSIEEELQPAVV

SEQ ID NO: 1960011 - protein, 5 aa, Staphylococcus
KSIEF

SEQ ID NO: 1960012 - protein, 10 aa, Staphylococcus
KSIFSTNNEV

SEQ ID NO: 1960013 - protein, 7 aa, Staphylococcus
KSIGNKG

SEQ ID NO: 1960014 - protein, 9 aa, Staphylococcus
KSIGSKETR

SEQ ID NO: 1960015 - protein, 9 aa, Staphylococcus
KSIHSNDTL

SEQ ID NO: 1960016 - protein, 10 aa, Staphylococcus
KSIKASEANH

SEQ ID NO: 1960017 - protein, 7 aa, Staphylococcus
KSIKNHE

SEQ ID NO: 1960018 - protein, 6 aa, Staphylococcus
KSIKSV

SEQ ID NO: 1960019 - protein, 7 aa, Staphylococcus
KSINDEP

SEQ ID NO: 1960020 - protein, 5 aa, Staphylococcus
KSINI

SEQ ID NO: 1960021 - protein, 10 aa, Staphylococcus
KSINSEGNIT

SEQ ID NO: 1960022 - protein, 8 aa, Staphylococcus
KSIPKYPK

SEQ ID NO: 1960023 - protein, 6 aa, Staphylococcus
KSIPNV

SEQ ID NO: 1960024 - protein, 9 aa, Staphylococcus
KSIPPQPYN

SEQ ID NO: 1960025 - protein, 11 aa, Staphylococcus
KSIQGIETKPV

SEQ ID NO: 1960026 - protein, 10 aa, Staphylococcus
KSIQIDDSKG

SEQ ID NO: 1960027 - protein, 6 aa, Staphylococcus
KSIQNH

SEQ ID NO: 1960028 - protein, 14 aa, Staphylococcus
KSIRRGSANLKDSF

SEQ ID NO: 1960029 - protein, 17 aa, Staphylococcus
KSIRRGSANLKDSYAQV

SEQ ID NO: 1960030 - protein, 19 aa, Staphylococcus
KSIRRGSANLKDSYAQVKR

SEQ ID NO: 1960031 - protein, 18 aa, Staphylococcus
KSIRRGSANLKDSYAQVN

SEQ ID NO: 1960032 - protein, 7 aa, Staphylococcus
KSISDKG

SEQ ID NO: 1960033 - protein, 10 aa, Staphylococcus
KSISEALKTT

SEQ ID NO: 1960034 - protein, 7 aa, Staphylococcus
KSISLGT

SEQ ID NO: 1960035 - protein, 8 aa, Staphylococcus
KSITHEVK

SEQ ID NO: 1960036 - protein, 8 aa, Staphylococcus
KSITHQVK

SEQ ID NO: 1960037 - protein, 9 aa, Staphylococcus
KSITKAKGN

SEQ ID NO: 1960038 - protein, 7 aa, Staphylococcus
KSITQYD

SEQ ID NO: 1960039 - protein, 7 aa, Staphylococcus
KSITVPK

SEQ ID NO: 1960040 - protein, 9 aa, Staphylococcus
KSKAKDLSL

SEQ ID NO: 1960041 - protein, 7 aa, Staphylococcus
KSKANVE

SEQ ID NO: 1960042 - protein, 7 aa, Staphylococcus
KSKDEFE

SEQ ID NO: 1960043 - protein, 7 aa, Staphylococcus
KSKDEYE

SEQ ID NO: 1960044 - protein, 8 aa, Staphylococcus
KSKDNGKI

SEQ ID NO: 1960045 - protein, 5 aa, Staphylococcus
KSKDT

SEQ ID NO: 1960046 - protein, 11 aa, Staphylococcus
KSKDVGPVGDT

SEQ ID NO: 1960047 - protein, 6 aa, Staphylococcus
KSKEIN

SEQ ID NO: 1960048 - protein, 7 aa, Staphylococcus
KSKEITA

SEQ ID NO: 1960049 - protein, 10 aa, Staphylococcus
KSKEKSEKKD

SEQ ID NO: 1960050 - protein, 8 aa, Staphylococcus
KSKETDTV

SEQ ID NO: 1960051 - protein, 9 aa, Staphylococcus
KSKGDIPNS

SEQ ID NO: 1960052 - protein, 21 aa, Staphylococcus
KSKGEHKGKIEGEVKSIEKHS

SEQ ID NO: 1960053 - protein, 16 aa, Staphylococcus
KSKGIDRVNSKAISEA

SEQ ID NO: 1960054 - protein, 17 aa, Staphylococcus
KSKGIDRVNSKAISEGL

SEQ ID NO: 1960055 - protein, 6 aa, Staphylococcus
KSKGLN

SEQ ID NO: 1960056 - protein, 7 aa, Staphylococcus
KSKGLNA

SEQ ID NO: 1960057 - protein, 8 aa, Staphylococcus
KSKGVYKG

SEQ ID NO: 1960058 - protein, 12 aa, Staphylococcus
KSKGYYILKSLK

SEQ ID NO: 1960059 - protein, 12 aa, Staphylococcus
KSKGYYILRSVK

SEQ ID NO: 1960060 - protein, 5 aa, Staphylococcus
KSKHS

SEQ ID NO: 1960061 - protein, 6 aa, Staphylococcus
KSKIDV

SEQ ID NO: 1960062 - protein, 16 aa, Staphylococcus
KSKIKKPELLAPAGNL

SEQ ID NO: 1960063 - protein, 9 aa, Staphylococcus
KSKKEAEQF

SEQ ID NO: 1960064 - protein, 10 aa, Staphylococcus
KSKKGPIAKV

SEQ ID NO: 1960065 - protein, 10 aa, Staphylococcus
KSKKKAAEKI

SEQ ID NO: 1960066 - protein, 6 aa, Staphylococcus
KSKKPI

SEQ ID NO: 1960067 - protein, 9 aa, Staphylococcus
KSKKQNAKR

SEQ ID NO: 1960068 - protein, 18 aa, Staphylococcus
KSKKVKSRAGMSLTRNTS

SEQ ID NO: 1960069 - protein, 6 aa, Staphylococcus
KSKLEE

SEQ ID NO: 1960070 - protein, 7 aa, Staphylococcus
KSKLEKN

SEQ ID NO: 1960071 - protein, 8 aa, Staphylococcus
KSKLSLQD

SEQ ID NO: 1960072 - protein, 7 aa, Staphylococcus
KSKMKLS

SEQ ID NO: 1960073 - protein, 8 aa, Staphylococcus
KSKMKLSQ

SEQ ID NO: 1960074 - protein, 4 aa, Staphylococcus
KSKN

SEQ ID NO: 1960075 - protein, 9 aa, Staphylococcus
KSKNDEAMD

SEQ ID NO: 1960076 - protein, 7 aa, Staphylococcus
KSKNEEM

SEQ ID NO: 1960077 - protein, 6 aa, Staphylococcus
KSKNLE

SEQ ID NO: 1960078 - protein, 39 aa, Staphylococcus
KSKNMTQSKLSEKTGFSQNTISNHENGRRSIGEKEVEKY

SEQ ID NO: 1960079 - protein, 6 aa, Staphylococcus
KSKNTF

SEQ ID NO: 1960080 - protein, 7 aa, Staphylococcus
KSKNVRS

SEQ ID NO: 1960081 - protein, 6 aa, Staphylococcus
KSKPPI

SEQ ID NO: 1960082 - protein, 6 aa, Staphylococcus
KSKQAK

SEQ ID NO: 1960083 - protein, 5 aa, Staphylococcus
KSKQD

SEQ ID NO: 1960084 - protein, 6 aa, Staphylococcus
KSKQIM

SEQ ID NO: 1960085 - protein, 23 aa, Staphylococcus
KSKQKKAKKRTQTMSNAERIKSY

SEQ ID NO: 1960086 - protein, 25 aa, Staphylococcus
KSKQKKKPKQHKTLTNAEKIKSYQD

SEQ ID NO: 1960087 - protein, 5 aa, Staphylococcus
KSKQS

SEQ ID NO: 1960088 - protein, 4 aa, Staphylococcus
KSKR

SEQ ID NO: 1960089 - protein, 15 aa, Staphylococcus
KSKRKELEELESADQ

SEQ ID NO: 1960090 - protein, 8 aa, Staphylococcus
KSKRQGQS

SEQ ID NO: 1960091 - protein, 8 aa, Staphylococcus
KSKRQGQT

SEQ ID NO: 1960092 - protein, 9 aa, Staphylococcus
KSKSDNDAF

SEQ ID NO: 1960093 - protein, 10 aa, Staphylococcus
KSKSIEPFRD

SEQ ID NO: 1960094 - protein, 8 aa, Staphylococcus
KSKSKSVT

SEQ ID NO: 1960095 - protein, 6 aa, Staphylococcus
KSKSLQ

SEQ ID NO: 1960096 - protein, 17 aa, Staphylococcus
KSKSNDNQIDFQQSRLI

SEQ ID NO: 1960097 - protein, 9 aa, Staphylococcus
KSKSPSVKA

SEQ ID NO: 1960098 - protein, 10 aa, Staphylococcus
KSKSPSVKAF

SEQ ID NO: 1960099 - protein, 9 aa, Staphylococcus
KSKSPSVPV

SEQ ID NO: 1960100 - protein, 18 aa, Staphylococcus
KSKSPTLDQLPNRDLAQQ

SEQ ID NO: 1960101 - protein, 9 aa, Staphylococcus
KSKSPTLKQ

SEQ ID NO: 1960102 - protein, 17 aa, Staphylococcus
KSKSPTVKQLPERNLTQ

SEQ ID NO: 1960103 - protein, 9 aa, Staphylococcus
KSKSSVKEY

SEQ ID NO: 1960104 - protein, 9 aa, Staphylococcus
KSKTAGMGP

SEQ ID NO: 1960105 - protein, 8 aa, Staphylococcus
KSKTDRLT

SEQ ID NO: 1960106 - protein, 9 aa, Staphylococcus
KSKTPERIK

SEQ ID NO: 1960107 - protein, 10 aa, Staphylococcus
KSKTPERIKE

SEQ ID NO: 1960108 - protein, 10 aa, Staphylococcus
KSKTPSRIQE

SEQ ID NO: 1960109 - protein, 9 aa, Staphylococcus
KSKTPSRIR

SEQ ID NO: 1960110 - protein, 7 aa, Staphylococcus
KSKTVKS

SEQ ID NO: 1960111 - protein, 7 aa, Staphylococcus
KSKVRGI

SEQ ID NO: 1960112 - protein, 6 aa, Staphylococcus
KSKYKK

SEQ ID NO: 1960113 - protein, 14 aa, Staphylococcus
KSLAKEINKRATRP

SEQ ID NO: 1960114 - protein, 8 aa, Staphylococcus
KSLANGDR

SEQ ID NO: 1960115 - protein, 6 aa, Staphylococcus
KSLDDE

SEQ ID NO: 1960116 - protein, 16 aa, Staphylococcus
KSLDGQKYGAYKRTKG

SEQ ID NO: 1960117 - protein, 17 aa, Staphylococcus
KSLDGQKYGAYKRTKGV

SEQ ID NO: 1960118 - protein, 6 aa, Staphylococcus
KSLEDA

SEQ ID NO: 1960119 - protein, 6 aa, Staphylococcus
KSLEDG

SEQ ID NO: 1960120 - protein, 5 aa, Staphylococcus
KSLEK

SEQ ID NO: 1960121 - protein, 7 aa, Staphylococcus
KSLEQGV

SEQ ID NO: 1960122 - protein, 12 aa, Staphylococcus
KSLETSDDVKGY

SEQ ID NO: 1960123 - protein, 4 aa, Staphylococcus
KSLG

SEQ ID NO: 1960124 - protein, 6 aa, Staphylococcus
KSLGGE

SEQ ID NO: 1960125 - protein, 14 aa, Staphylococcus
KSLGKEDDDQNRNL

SEQ ID NO: 1960126 - protein, 4 aa, Staphylococcus
KSLK

SEQ ID NO: 1960127 - protein, 6 aa, Staphylococcus
KSLKDE

SEQ ID NO: 1960128 - protein, 7 aa, Staphylococcus
KSLKDNK

SEQ ID NO: 1960129 - protein, 9 aa, Staphylococcus
KSLKPKDYE

SEQ ID NO: 1960130 - protein, 5 aa, Staphylococcus
KSLLG

SEQ ID NO: 1960131 - protein, 4 aa, Staphylococcus
KSLN

SEQ ID NO: 1960132 - protein, 6 aa, Staphylococcus
KSLNDG

SEQ ID NO: 1960133 - protein, 19 aa, Staphylococcus
KSLNEAPHLREAQKALAEN

SEQ ID NO: 1960134 - protein, 6 aa, Staphylococcus
KSLNED

SEQ ID NO: 1960135 - protein, 7 aa, Staphylococcus
KSLNEDA

SEQ ID NO: 1960136 - protein, 11 aa, Staphylococcus
KSLNEENGQSF

SEQ ID NO: 1960137 - protein, 6 aa, Staphylococcus
KSLNEV

SEQ ID NO: 1960138 - protein, 10 aa, Staphylococcus
KSLNKEKDGV

SEQ ID NO: 1960139 - protein, 5 aa, Staphylococcus
KSLPQ

SEQ ID NO: 1960140 - protein, 6 aa, Staphylococcus
KSLQKA

SEQ ID NO: 1960141 - protein, 9 aa, Staphylococcus
KSLQSTQDL

SEQ ID NO: 1960142 - protein, 18 aa, Staphylococcus
KSLQVAPSYERGANPFPK

SEQ ID NO: 1960143 - protein, 4 aa, Staphylococcus
KSLS

SEQ ID NO: 1960144 - protein, 15 aa, Staphylococcus
KSLSAKELKEGFKDV

SEQ ID NO: 1960145 - protein, 11 aa, Staphylococcus
KSLSDDTTVTV

SEQ ID NO: 1960146 - protein, 7 aa, Staphylococcus
KSLSDEP

SEQ ID NO: 1960147 - protein, 13 aa, Staphylococcus
KSLSEKRRKVARE

SEQ ID NO: 1960148 - protein, 14 aa, Staphylococcus
KSLSGKELKEGFKD

SEQ ID NO: 1960149 - protein, 5 aa, Staphylococcus
KSLSN

SEQ ID NO: 1960150 - protein, 7 aa, Staphylococcus
KSLSNEP

SEQ ID NO: 1960151 - protein, 6 aa, Staphylococcus
KSLSNM

SEQ ID NO: 1960152 - protein, 10 aa, Staphylococcus
KSLTDQVKAG

SEQ ID NO: 1960153 - protein, 15 aa, Staphylococcus
KSLTGKELKEGFKDV

SEQ ID NO: 1960154 - protein, 5 aa, Staphylococcus
KSLTL

SEQ ID NO: 1960155 - protein, 5 aa, Staphylococcus
KSLTN

SEQ ID NO: 1960156 - protein, 7 aa, Staphylococcus
KSLTTGN

SEQ ID NO: 1960157 - protein, 6 aa, Staphylococcus
KSMEKA

SEQ ID NO: 1960158 - protein, 7 aa, Staphylococcus
KSMEKSL

SEQ ID NO: 1960159 - protein, 7 aa, Staphylococcus
KSMKPDD

SEQ ID NO: 1960160 - protein, 6 aa, Staphylococcus
KSMNQD

SEQ ID NO: 1960161 - protein, 9 aa, Staphylococcus
KSMQENDEP

SEQ ID NO: 1960162 - protein, 6 aa, Staphylococcus
KSMQIQ

SEQ ID NO: 1960163 - protein, 5 aa, Staphylococcus
KSMQS

SEQ ID NO: 1960164 - protein, 11 aa, Staphylococcus
KSMSKEAKTIG

SEQ ID NO: 1960165 - protein, 10 aa, Staphylococcus
KSMSKGEVEQ

SEQ ID NO: 1960166 - protein, 4 aa, Staphylococcus
KSMT

SEQ ID NO: 1960167 - protein, 7 aa, Staphylococcus
KSMTKAA

SEQ ID NO: 1960168 - protein, 10 aa, Staphylococcus
KSMTKASGNQ

SEQ ID NO: 1960169 - protein, 10 aa, Staphylococcus
KSMTKEAKTI

SEQ ID NO: 1960170 - protein, 7 aa, Staphylococcus
KSNATEL

SEQ ID NO: 1960171 - protein, 7 aa, Staphylococcus
KSNDDLK

SEQ ID NO: 1960172 - protein, 8 aa, Staphylococcus
KSNDEGNH

SEQ ID NO: 1960173 - protein, 7 aa, Staphylococcus
KSNDEHV

SEQ ID NO: 1960174 - protein, 5 aa, Staphylococcus
KSNDL

SEQ ID NO: 1960175 - protein, 8 aa, Staphylococcus
KSNDMEDG

SEQ ID NO: 1960176 - protein, 5 aa, Staphylococcus
KSNDP

SEQ ID NO: 1960177 - protein, 19 aa, Staphylococcus
KSNDRNSVKKGKELIEKTG

SEQ ID NO: 1960178 - protein, 5 aa, Staphylococcus
KSNDS

SEQ ID NO: 1960179 - protein, 18 aa, Staphylococcus
KSNDSSQYLGPDTQSMTF

SEQ ID NO: 1960180 - protein, 8 aa, Staphylococcus
KSNEIKTE

SEQ ID NO: 1960181 - protein, 8 aa, Staphylococcus
KSNELKSS

SEQ ID NO: 1960182 - protein, 9 aa, Staphylococcus
KSNFETYGY

SEQ ID NO: 1960183 - protein, 8 aa, Staphylococcus
KSNGESAV

SEQ ID NO: 1960184 - protein, 8 aa, Staphylococcus
KSNGYETV

SEQ ID NO: 1960185 - protein, 6 aa, Staphylococcus
KSNHKK

SEQ ID NO: 1960186 - protein, 9 aa, Staphylococcus
KSNHPSIPV

SEQ ID NO: 1960187 - protein, 7 aa, Staphylococcus
KSNIASA

SEQ ID NO: 1960188 - protein, 9 aa, Staphylococcus
KSNIDKNDV

SEQ ID NO: 1960189 - protein, 8 aa, Staphylococcus
KSNIDLND

SEQ ID NO: 1960190 - protein, 6 aa, Staphylococcus
KSNIGI

SEQ ID NO: 1960191 - protein, 7 aa, Staphylococcus
KSNINTF

SEQ ID NO: 1960192 - protein, 11 aa, Staphylococcus
KSNITKTLTPH

SEQ ID NO: 1960193 - protein, 11 aa, Staphylococcus
KSNKDNNRLPK

SEQ ID NO: 1960194 - protein, 27 aa, Staphylococcus
KSNKKDVYEDEPEAPHEEYDDREAHLE

SEQ ID NO: 1960195 - protein, 52 aa, Staphylococcus
KSNKKENHEEEPESPREETYEDRREHHEDDYHQSEGKDKEEGKFKKLMKSLF

SEQ ID NO: 1960196 - protein, 63 aa, Staphylococcus
KSNKNEDPDENHQPEVREKAEKHDDYETYDENNHQDGTHHYDDEHEKSDKEESKFKKLMKSLF

SEQ ID NO: 1960197 - protein, 63 aa, Staphylococcus
KSNKNENTYEEDYNEPHERTDKVDDDDKYDSNESHHDTTEHYDDQEQPQKEEGKFKKLMKSLF

SEQ ID NO: 1960198 - protein, 33 aa, Staphylococcus
KSNKQDDELQATSSESTRTKESVVDEEEPEVYD

SEQ ID NO: 1960199 - protein, 6 aa, Staphylococcus
KSNKRV

SEQ ID NO: 1960200 - protein, 10 aa, Staphylococcus
KSNKSRKDKI

SEQ ID NO: 1960201 - protein, 11 aa, Staphylococcus
KSNLNKEDLTS

SEQ ID NO: 1960202 - protein, 6 aa, Staphylococcus
KSNMKL

SEQ ID NO: 1960203 - protein, 6 aa, Staphylococcus
KSNNIK

SEQ ID NO: 1960204 - protein, 8 aa, Staphylococcus
KSNNKDVR

SEQ ID NO: 1960205 - protein, 8 aa, Staphylococcus
KSNNNIDQ

SEQ ID NO: 1960206 - protein, 8 aa, Staphylococcus
KSNNPNCT

SEQ ID NO: 1960207 - protein, 16 aa, Staphylococcus
KSNPSKSKDAEDIAKE

SEQ ID NO: 1960208 - protein, 10 aa, Staphylococcus
KSNQKKQGKL

SEQ ID NO: 1960209 - protein, 6 aa, Staphylococcus
KSNQQT

SEQ ID NO: 1960210 - protein, 23 aa, Staphylococcus
KSNQRRTDSIKQSLTSKVKQGPT

SEQ ID NO: 1960211 - protein, 8 aa, Staphylococcus
KSNQTHYK

SEQ ID NO: 1960212 - protein, 7 aa, Staphylococcus
KSNQYSN

SEQ ID NO: 1960213 - protein, 7 aa, Staphylococcus
KSNRHGQ

SEQ ID NO: 1960214 - protein, 8 aa, Staphylococcus
KSNSDYPQ

SEQ ID NO: 1960215 - protein, 9 aa, Staphylococcus
KSNSEIKEK

SEQ ID NO: 1960216 - protein, 10 aa, Staphylococcus
KSNSEKFNED

SEQ ID NO: 1960217 - protein, 6 aa, Staphylococcus
KSNSEY

SEQ ID NO: 1960218 - protein, 13 aa, Staphylococcus
KSNSIKENMEAQM

SEQ ID NO: 1960219 - protein, 10 aa, Staphylococcus
KSNTKNADLP

SEQ ID NO: 1960220 - protein, 6 aa, Staphylococcus
KSNTLK

SEQ ID NO: 1960221 - protein, 11 aa, Staphylococcus
KSNTSRAKQKE

SEQ ID NO: 1960222 - protein, 8 aa, Staphylococcus
KSNVDKND

SEQ ID NO: 1960223 - protein, 22 aa, Staphylococcus
KSNVTIPQYKPGSFGPKESDQL

SEQ ID NO: 1960224 - protein, 11 aa, Staphylococcus
KSNYDNKYGEP

SEQ ID NO: 1960225 - protein, 8 aa, Staphylococcus
KSNYKTKM

SEQ ID NO: 1960226 - protein, 5 aa, Staphylococcus
KSNYQ

SEQ ID NO: 1960227 - protein, 8 aa, Staphylococcus
KSPADIQK

SEQ ID NO: 1960228 - protein, 13 aa, Staphylococcus
KSPGMPPGANTIN

SEQ ID NO: 1960229 - protein, 4 aa, Staphylococcus
KSPI

SEQ ID NO: 1960230 - protein, 8 aa, Staphylococcus
KSPKDIQK

SEQ ID NO: 1960231 - protein, 8 aa, Staphylococcus
KSPKDVQQ

SEQ ID NO: 1960232 - protein, 5 aa, Staphylococcus
KSPKL

SEQ ID NO: 1960233 - protein, 4 aa, Staphylococcus
KSPL

SEQ ID NO: 1960234 - protein, 6 aa, Staphylococcus
KSPLAE

SEQ ID NO: 1960235 - protein, 10 aa, Staphylococcus
KSPLNGEAIY

SEQ ID NO: 1960236 - protein, 8 aa, Staphylococcus
KSPNIDGH

SEQ ID NO: 1960237 - protein, 16 aa, Staphylococcus
KSPNIKTNQKAALNQV

SEQ ID NO: 1960238 - protein, 6 aa, Staphylococcus
KSPNLL

SEQ ID NO: 1960239 - protein, 8 aa, Staphylococcus
KSPNLSAS

SEQ ID NO: 1960240 - protein, 8 aa, Staphylococcus
KSPQINYG

SEQ ID NO: 1960241 - protein, 17 aa, Staphylococcus
KSPQKMKSIAKKAVKES

SEQ ID NO: 1960242 - protein, 14 aa, Staphylococcus
KSPRNKGTLDNGSM

SEQ ID NO: 1960243 - protein, 7 aa, Staphylococcus
KSPRRAG

SEQ ID NO: 1960244 - protein, 12 aa, Staphylococcus
KSPSKIKKSDAV

SEQ ID NO: 1960245 - protein, 7 aa, Staphylococcus
KSPSNQV

SEQ ID NO: 1960246 - protein, 10 aa, Staphylococcus
KSPSPEESAY

SEQ ID NO: 1960247 - protein, 10 aa, Staphylococcus
KSPSSQRGRD

SEQ ID NO: 1960248 - protein, 8 aa, Staphylococcus
KSPTVKAL

SEQ ID NO: 1960249 - protein, 9 aa, Staphylococcus
KSPYPTYET

SEQ ID NO: 1960250 - protein, 12 aa, Staphylococcus
KSQAEHSTPFTP

SEQ ID NO: 1960251 - protein, 4 aa, Staphylococcus
KSQE

SEQ ID NO: 1960252 - protein, 7 aa, Staphylococcus
KSQEMYG

SEQ ID NO: 1960253 - protein, 8 aa, Staphylococcus
KSQFGDKL

SEQ ID NO: 1960254 - protein, 11 aa, Staphylococcus
KSQGAKVDSWG

SEQ ID NO: 1960255 - protein, 7 aa, Staphylococcus
KSQGERK

SEQ ID NO: 1960256 - protein, 8 aa, Staphylococcus
KSQGGDVN

SEQ ID NO: 1960257 - protein, 10 aa, Staphylococcus
KSQGTSAHSS

SEQ ID NO: 1960258 - protein, 19 aa, Staphylococcus
KSQHKGSTKFKYPKRRDND

SEQ ID NO: 1960259 - protein, 7 aa, Staphylococcus
KSQIPVG

SEQ ID NO: 1960260 - protein, 8 aa, Staphylococcus
KSQKERLT

SEQ ID NO: 1960261 - protein, 7 aa, Staphylococcus
KSQKQEY

SEQ ID NO: 1960262 - protein, 15 aa, Staphylococcus
KSQLPVGKDKNNKTI

SEQ ID NO: 1960263 - protein, 5 aa, Staphylococcus
KSQLQ

SEQ ID NO: 1960264 - protein, 6 aa, Staphylococcus
KSQLRT

SEQ ID NO: 1960265 - protein, 8 aa, Staphylococcus
KSQLRTDL

SEQ ID NO: 1960266 - protein, 22 aa, Staphylococcus
KSQLSDEDKHTYEQKGYEAIRN

SEQ ID NO: 1960267 - protein, 15 aa, Staphylococcus
KSQNKNKEAEEATEV

SEQ ID NO: 1960268 - protein, 7 aa, Staphylococcus
KSQNNEP

SEQ ID NO: 1960269 - protein, 8 aa, Staphylococcus
KSQNNRSS

SEQ ID NO: 1960270 - protein, 22 aa, Staphylococcus
KSQPDTVTNVATTQVASQPNNE

SEQ ID NO: 1960271 - protein, 6 aa, Staphylococcus
KSQPHL

SEQ ID NO: 1960272 - protein, 5 aa, Staphylococcus
KSQPL

SEQ ID NO: 1960273 - protein, 14 aa, Staphylococcus
KSQQAEKEGQQAQL

SEQ ID NO: 1960274 - protein, 18 aa, Staphylococcus
KSQQATKDAEKVQHTQSL

SEQ ID NO: 1960275 - protein, 7 aa, Staphylococcus
KSQQDHY

SEQ ID NO: 1960276 - protein, 7 aa, Staphylococcus
KSQRGQG

SEQ ID NO: 1960277 - protein, 10 aa, Staphylococcus
KSQRKPDRKM

SEQ ID NO: 1960278 - protein, 7 aa, Staphylococcus
KSQRNQD

SEQ ID NO: 1960279 - protein, 4 aa, Staphylococcus
KSQS

SEQ ID NO: 1960280 - protein, 5 aa, Staphylococcus
KSQSL

SEQ ID NO: 1960281 - protein, 11 aa, Staphylococcus
KSQTNAEEIYG

SEQ ID NO: 1960282 - protein, 8 aa, Staphylococcus
KSQTPSRI

SEQ ID NO: 1960283 - protein, 9 aa, Staphylococcus
KSQTPSRIK

SEQ ID NO: 1960284 - protein, 9 aa, Staphylococcus
KSQTSTGQA

SEQ ID NO: 1960285 - protein, 10 aa, Staphylococcus
KSQVPIGQDK

SEQ ID NO: 1960286 - protein, 11 aa, Staphylococcus
KSQVRKNGKAI

SEQ ID NO: 1960287 - protein, 6 aa, Staphylococcus
KSQVSY

SEQ ID NO: 1960288 - protein, 4 aa, Staphylococcus
KSRA

SEQ ID NO: 1960289 - protein, 7 aa, Staphylococcus
KSRAERH

SEQ ID NO: 1960290 - protein, 9 aa, Staphylococcus
KSRAETLGL

SEQ ID NO: 1960291 - protein, 4 aa, Staphylococcus
KSRE

SEQ ID NO: 1960292 - protein, 6 aa, Staphylococcus
KSREEY

SEQ ID NO: 1960293 - protein, 4 aa, Staphylococcus
KSRG

SEQ ID NO: 1960294 - protein, 17 aa, Staphylococcus
KSRGEHKGKVEGEVKSI

SEQ ID NO: 1960295 - protein, 21 aa, Staphylococcus
KSRGEHRGKVEGEVKSIEKHS

SEQ ID NO: 1960296 - protein, 15 aa, Staphylococcus
KSRGNSNSQHKDRIQ

SEQ ID NO: 1960297 - protein, 13 aa, Staphylococcus
KSRIDSAATQQEE

SEQ ID NO: 1960298 - protein, 8 aa, Staphylococcus
KSRKESPF

SEQ ID NO: 1960299 - protein, 45 aa, Staphylococcus
KSRLDKPKQRPYTQETQRNATDKRCHKQPKKSLKKNKKTAKTKKT

SEQ ID NO: 1960300 - protein, 6 aa, Staphylococcus
KSRLEE

SEQ ID NO: 1960301 - protein, 7 aa, Staphylococcus
KSRLEEK

SEQ ID NO: 1960302 - protein, 7 aa, Staphylococcus
KSRLEGE

SEQ ID NO: 1960303 - protein, 8 aa, Staphylococcus
KSRLKGEH

SEQ ID NO: 1960304 - protein, 19 aa, Staphylococcus
KSRLTKEAQDNKRDTEKAM

SEQ ID NO: 1960305 - protein, 4 aa, Staphylococcus
KSRN

SEQ ID NO: 1960306 - protein, 10 aa, Staphylococcus
KSRNGSPLKD

SEQ ID NO: 1960307 - protein, 5 aa, Staphylococcus
KSRNI

SEQ ID NO: 1960308 - protein, 9 aa, Staphylococcus
KSRNVDGEQ

SEQ ID NO: 1960309 - protein, 7 aa, Staphylococcus
KSRPATQ

SEQ ID NO: 1960310 - protein, 6 aa, Staphylococcus
KSRPHR

SEQ ID NO: 1960311 - protein, 8 aa, Staphylococcus
KSRPTTYE

SEQ ID NO: 1960312 - protein, 6 aa, Staphylococcus
KSRQLN

SEQ ID NO: 1960313 - protein, 5 aa, Staphylococcus
KSRRL

SEQ ID NO: 1960314 - protein, 16 aa, Staphylococcus
KSRSQNYAMINLINWF

SEQ ID NO: 1960315 - protein, 10 aa, Staphylococcus
KSRSSRKSLS

SEQ ID NO: 1960316 - protein, 8 aa, Staphylococcus
KSRSTRKK

SEQ ID NO: 1960317 - protein, 7 aa, Staphylococcus
KSRYERL

SEQ ID NO: 1960318 - protein, 5 aa, Staphylococcus
KSSAE

SEQ ID NO: 1960319 - protein, 10 aa, Staphylococcus
KSSAIYSATK

SEQ ID NO: 1960320 - protein, 7 aa, Staphylococcus
KSSAKQE

SEQ ID NO: 1960321 - protein, 13 aa, Staphylococcus
KSSAPEIRQNPFN

SEQ ID NO: 1960322 - protein, 14 aa, Staphylococcus
KSSATIADIGTGSG

SEQ ID NO: 1960323 - protein, 8 aa, Staphylococcus
KSSAYLGT

SEQ ID NO: 1960324 - protein, 24 aa, Staphylococcus
KSSDDDVNDAFGRTSHGSSEEDFA

SEQ ID NO: 1960325 - protein, 8 aa, Staphylococcus
KSSDGTAY

SEQ ID NO: 1960326 - protein, 7 aa, Staphylococcus
KSSDNEI

SEQ ID NO: 1960327 - protein, 6 aa, Staphylococcus
KSSDQI

SEQ ID NO: 1960328 - protein, 6 aa, Staphylococcus
KSSDRI

SEQ ID NO: 1960329 - protein, 12 aa, Staphylococcus
KSSDVEVRETDT

SEQ ID NO: 1960330 - protein, 8 aa, Staphylococcus
KSSEGTIN

SEQ ID NO: 1960331 - protein, 12 aa, Staphylococcus
KSSEIEGHPEFQ

SEQ ID NO: 1960332 - protein, 15 aa, Staphylococcus
KSSEPEEGLPIALLK

SEQ ID NO: 1960333 - protein, 15 aa, Staphylococcus
KSSEPEEGLPLALLK

SEQ ID NO: 1960334 - protein, 9 aa, Staphylococcus
KSSESSATL

SEQ ID NO: 1960335 - protein, 7 aa, Staphylococcus
KSSETDL

SEQ ID NO: 1960336 - protein, 6 aa, Staphylococcus
KSSEVD

SEQ ID NO: 1960337 - protein, 15 aa, Staphylococcus
KSSEVWTKSKSDDVE

SEQ ID NO: 1960338 - protein, 19 aa, Staphylococcus
KSSFKASRELYGKTGGNEG

SEQ ID NO: 1960339 - protein, 19 aa, Staphylococcus
KSSFKATRELYGKTGGNEG

SEQ ID NO: 1960340 - protein, 10 aa, Staphylococcus
KSSGAKSKIK

SEQ ID NO: 1960341 - protein, 10 aa, Staphylococcus
KSSGKTLSEL

SEQ ID NO: 1960342 - protein, 10 aa, Staphylococcus
KSSGLTETTG

SEQ ID NO: 1960343 - protein, 10 aa, Staphylococcus
KSSGLTKTRG

SEQ ID NO: 1960344 - protein, 10 aa, Staphylococcus
KSSGLTNTSG

SEQ ID NO: 1960345 - protein, 5 aa, Staphylococcus
KSSGR

SEQ ID NO: 1960346 - protein, 9 aa, Staphylococcus
KSSGYSGTL

SEQ ID NO: 1960347 - protein, 11 aa, Staphylococcus
KSSHKDATHNC

SEQ ID NO: 1960348 - protein, 10 aa, Staphylococcus
KSSHSSSLEN

SEQ ID NO: 1960349 - protein, 4 aa, Staphylococcus
KSSI

SEQ ID NO: 1960350 - protein, 6 aa, Staphylococcus
KSSIDG

SEQ ID NO: 1960351 - protein, 10 aa, Staphylococcus
KSSKDNPKRD

SEQ ID NO: 1960352 - protein, 16 aa, Staphylococcus
KSSKEFNSKYKNQLTN

SEQ ID NO: 1960353 - protein, 9 aa, Staphylococcus
KSSKESAKL

SEQ ID NO: 1960354 - protein, 9 aa, Staphylococcus
KSSKNNPKR

SEQ ID NO: 1960355 - protein, 7 aa, Staphylococcus
KSSKSYD

SEQ ID NO: 1960356 - protein, 6 aa, Staphylococcus
KSSLEY

SEQ ID NO: 1960357 - protein, 8 aa, Staphylococcus
KSSMPNAK

SEQ ID NO: 1960358 - protein, 9 aa, Staphylococcus
KSSNHSANL

SEQ ID NO: 1960359 - protein, 9 aa, Staphylococcus
KSSNPSAKL

SEQ ID NO: 1960360 - protein, 8 aa, Staphylococcus
KSSNQDYV

SEQ ID NO: 1960361 - protein, 5 aa, Staphylococcus
KSSPY

SEQ ID NO: 1960362 - protein, 5 aa, Staphylococcus
KSSQR

SEQ ID NO: 1960363 - protein, 8 aa, Staphylococcus
KSSQTTGT

SEQ ID NO: 1960364 - protein, 9 aa, Staphylococcus
KSSRDELKD

SEQ ID NO: 1960365 - protein, 9 aa, Staphylococcus
KSSRDELNN

SEQ ID NO: 1960366 - protein, 9 aa, Staphylococcus
KSSSAKSKI

SEQ ID NO: 1960367 - protein, 10 aa, Staphylococcus
KSSSAKSKIK

SEQ ID NO: 1960368 - protein, 7 aa, Staphylococcus
KSSSEAF

SEQ ID NO: 1960369 - protein, 15 aa, Staphylococcus
KSSSVSVDIKNNDTL

SEQ ID NO: 1960370 - protein, 8 aa, Staphylococcus
KSSTANAK

SEQ ID NO: 1960371 - protein, 9 aa, Staphylococcus
KSSTEQEIE

SEQ ID NO: 1960372 - protein, 9 aa, Staphylococcus
KSSTGSATL

SEQ ID NO: 1960373 - protein, 17 aa, Staphylococcus
KSSTKYSEEVQDPESLS

SEQ ID NO: 1960374 - protein, 7 aa, Staphylococcus
KSSVKAQ

SEQ ID NO: 1960375 - protein, 12 aa, Staphylococcus
KSTAEDYLGESV

SEQ ID NO: 1960376 - protein, 11 aa, Staphylococcus
KSTAESYLGDK

SEQ ID NO: 1960377 - protein, 11 aa, Staphylococcus
KSTAESYLGDT

SEQ ID NO: 1960378 - protein, 6 aa, Staphylococcus
KSTALR

SEQ ID NO: 1960379 - protein, 6 aa, Staphylococcus
KSTDEV

SEQ ID NO: 1960380 - protein, 12 aa, Staphylococcus
KSTDKPLKGREL

SEQ ID NO: 1960381 - protein, 12 aa, Staphylococcus
KSTDRPLKGAEL

SEQ ID NO: 1960382 - protein, 6 aa, Staphylococcus
KSTDSL

SEQ ID NO: 1960383 - protein, 6 aa, Staphylococcus
KSTDYD

SEQ ID NO: 1960384 - protein, 5 aa, Staphylococcus
KSTED

SEQ ID NO: 1960385 - protein, 12 aa, Staphylococcus
KSTEKSAPFPEQ

SEQ ID NO: 1960386 - protein, 8 aa, Staphylococcus
KSTELPRD

SEQ ID NO: 1960387 - protein, 13 aa, Staphylococcus
KSTERPLKGKELG

SEQ ID NO: 1960388 - protein, 7 aa, Staphylococcus
KSTFDSV

SEQ ID NO: 1960389 - protein, 6 aa, Staphylococcus
KSTGGI

SEQ ID NO: 1960390 - protein, 6 aa, Staphylococcus
KSTGIT

SEQ ID NO: 1960391 - protein, 5 aa, Staphylococcus
KSTGR

SEQ ID NO: 1960392 - protein, 5 aa, Staphylococcus
KSTHE

SEQ ID NO: 1960393 - protein, 7 aa, Staphylococcus
KSTHFNN

SEQ ID NO: 1960394 - protein, 12 aa, Staphylococcus
KSTIDKVDERRA

SEQ ID NO: 1960395 - protein, 8 aa, Staphylococcus
KSTINDNT

SEQ ID NO: 1960396 - protein, 8 aa, Staphylococcus
KSTKDVNG

SEQ ID NO: 1960397 - protein, 9 aa, Staphylococcus
KSTKGDRQL

SEQ ID NO: 1960398 - protein, 9 aa, Staphylococcus
KSTKKMNQI

SEQ ID NO: 1960399 - protein, 19 aa, Staphylococcus
KSTKSVTGQAIIIDGGYTV

SEQ ID NO: 1960400 - protein, 6 aa, Staphylococcus
KSTKTY

SEQ ID NO: 1960401 - protein, 8 aa, Staphylococcus
KSTLGNTD

SEQ ID NO: 1960402 - protein, 5 aa, Staphylococcus
KSTNE

SEQ ID NO: 1960403 - protein, 6 aa, Staphylococcus
KSTNGR

SEQ ID NO: 1960404 - protein, 8 aa, Staphylococcus
KSTPKSHY

SEQ ID NO: 1960405 - protein, 10 aa, Staphylococcus
KSTPLSEDTV

SEQ ID NO: 1960406 - protein, 6 aa, Staphylococcus
KSTQLL

SEQ ID NO: 1960407 - protein, 6 aa, Staphylococcus
KSTQMV

SEQ ID NO: 1960408 - protein, 5 aa, Staphylococcus
KSTQW

SEQ ID NO: 1960409 - protein, 10 aa, Staphylococcus
KSTREATEEE

SEQ ID NO: 1960410 - protein, 9 aa, Staphylococcus
KSTREINEE

SEQ ID NO: 1960411 - protein, 5 aa, Staphylococcus
KSTRL

SEQ ID NO: 1960412 - protein, 6 aa, Staphylococcus
KSTRPY

SEQ ID NO: 1960413 - protein, 8 aa, Staphylococcus
KSTRTYSQ

SEQ ID NO: 1960414 - protein, 6 aa, Staphylococcus
KSTSKS

SEQ ID NO: 1960415 - protein, 6 aa, Staphylococcus
KSTTEI

SEQ ID NO: 1960416 - protein, 13 aa, Staphylococcus
KSTVTPKTYKSYA

SEQ ID NO: 1960417 - protein, 13 aa, Staphylococcus
KSVAEEVGKSPAQ

SEQ ID NO: 1960418 - protein, 9 aa, Staphylococcus
KSVAETLTS

SEQ ID NO: 1960419 - protein, 8 aa, Staphylococcus
KSVAKQNY

SEQ ID NO: 1960420 - protein, 5 aa, Staphylococcus
KSVAN

SEQ ID NO: 1960421 - protein, 23 aa, Staphylococcus
KSVASYRNGMPSEGGFGVTVVEI

SEQ ID NO: 1960422 - protein, 7 aa, Staphylococcus
KSVDRNA

SEQ ID NO: 1960423 - protein, 13 aa, Staphylococcus
KSVDSSKEIATKY

SEQ ID NO: 1960424 - protein, 6 aa, Staphylococcus
KSVDTP

SEQ ID NO: 1960425 - protein, 9 aa, Staphylococcus
KSVEDKGDY

SEQ ID NO: 1960426 - protein, 10 aa, Staphylococcus
KSVEKDAERI

SEQ ID NO: 1960427 - protein, 10 aa, Staphylococcus
KSVEQDSERI

SEQ ID NO: 1960428 - protein, 24 aa, Staphylococcus
KSVGQKLGKPKMSAQAVGGAVGRN

SEQ ID NO: 1960429 - protein, 4 aa, Staphylococcus
KSVI

SEQ ID NO: 1960430 - protein, 17 aa, Staphylococcus
KSVKGFDPDYKIPKEEM

SEQ ID NO: 1960431 - protein, 9 aa, Staphylococcus
KSVKGFDPN

SEQ ID NO: 1960432 - protein, 23 aa, Staphylococcus
KSVKSFRGGMPSEGGFGVTVAEL

SEQ ID NO: 1960433 - protein, 23 aa, Staphylococcus
KSVKSYRGGMPSEGGFGVTVAEL

SEQ ID NO: 1960434 - protein, 6 aa, Staphylococcus
KSVNIS

SEQ ID NO: 1960435 - protein, 6 aa, Staphylococcus
KSVPQG

SEQ ID NO: 1960436 - protein, 23 aa, Staphylococcus
KSVQSFRGGMPSEGGFGVTVAEL

SEQ ID NO: 1960437 - protein, 18 aa, Staphylococcus
KSVREKEAKRVKQMMSDE

SEQ ID NO: 1960438 - protein, 8 aa, Staphylococcus
KSVSANSS

SEQ ID NO: 1960439 - protein, 8 aa, Staphylococcus
KSVSEDNK

SEQ ID NO: 1960440 - protein, 23 aa, Staphylococcus
KSVSKFRGGMPSEGGFGVTVAEL

SEQ ID NO: 1960441 - protein, 7 aa, Staphylococcus
KSVTNTQ

SEQ ID NO: 1960442 - protein, 9 aa, Staphylococcus
KSVTPSRIE

SEQ ID NO: 1960443 - protein, 6 aa, Staphylococcus
KSVTTH

SEQ ID NO: 1960444 - protein, 6 aa, Staphylococcus
KSWEDV

SEQ ID NO: 1960445 - protein, 7 aa, Staphylococcus
KSWKNSK

SEQ ID NO: 1960446 - protein, 15 aa, Staphylococcus
KSWPDSIDTSCARGE

SEQ ID NO: 1960447 - protein, 6 aa, Staphylococcus
KSYAAQ

SEQ ID NO: 1960448 - protein, 13 aa, Staphylococcus
KSYAKEGKFAEGS

SEQ ID NO: 1960449 - protein, 4 aa, Staphylococcus
KSYD

SEQ ID NO: 1960450 - protein, 13 aa, Staphylococcus
KSYDEVKAKRNKY

SEQ ID NO: 1960451 - protein, 7 aa, Staphylococcus
KSYEIKE

SEQ ID NO: 1960452 - protein, 6 aa, Staphylococcus
KSYELT

SEQ ID NO: 1960453 - protein, 6 aa, Staphylococcus
KSYEVD

SEQ ID NO: 1960454 - protein, 10 aa, Staphylococcus
KSYGGEGATI

SEQ ID NO: 1960455 - protein, 13 aa, Staphylococcus
KSYGKIANTPEEA

SEQ ID NO: 1960456 - protein, 6 aa, Staphylococcus
KSYGNM

SEQ ID NO: 1960457 - protein, 9 aa, Staphylococcus
KSYIPTNNI

SEQ ID NO: 1960458 - protein, 11 aa, Staphylococcus
KSYKKQNQSAL

SEQ ID NO: 1960459 - protein, 8 aa, Staphylococcus
KSYKNSNF

SEQ ID NO: 1960460 - protein, 7 aa, Staphylococcus
KSYLSAD

SEQ ID NO: 1960461 - protein, 8 aa, Staphylococcus
KSYLSTDD

SEQ ID NO: 1960462 - protein, 4 aa, Staphylococcus
KSYP

SEQ ID NO: 1960463 - protein, 6 aa, Staphylococcus
KSYPEP

SEQ ID NO: 1960464 - protein, 6 aa, Staphylococcus
KSYPKD

SEQ ID NO: 1960465 - protein, 13 aa, Staphylococcus
KSYQLSPAVEETL

SEQ ID NO: 1960466 - protein, 6 aa, Staphylococcus
KSYQSL

SEQ ID NO: 1960467 - protein, 9 aa, Staphylococcus
KSYSEALGG

SEQ ID NO: 1960468 - protein, 19 aa, Staphylococcus
KSYTADISKQLNADYAGKT

SEQ ID NO: 1960469 - protein, 7 aa, Staphylococcus
KSYTELD

SEQ ID NO: 1960470 - protein, 10 aa, Staphylococcus
KSYTFKSTRL

SEQ ID NO: 1960471 - protein, 8 aa, Staphylococcus
KSYTKSDF

SEQ ID NO: 1960472 - protein, 7 aa, Staphylococcus
KSYTNSE

SEQ ID NO: 1960473 - protein, 6 aa, Staphylococcus
KSYTQQ

SEQ ID NO: 1960474 - protein, 5 aa, Staphylococcus
KSYTY

SEQ ID NO: 1960475 - protein, 8 aa, Staphylococcus
KSYVDEKG

SEQ ID NO: 1960476 - protein, 13 aa, Staphylococcus
KSYVSAKSQAQTL

SEQ ID NO: 1960477 - protein, 8 aa, Staphylococcus
KSYYDDSK

SEQ ID NO: 1960478 - protein, 7 aa, Staphylococcus
KSYYDYE

SEQ ID NO: 1960479 - protein, 7 aa, Staphylococcus
KTAANLS

SEQ ID NO: 1960480 - protein, 9 aa, Staphylococcus
KTAEEKRTA

SEQ ID NO: 1960481 - protein, 7 aa, Staphylococcus
KTAEEYK

SEQ ID NO: 1960482 - protein, 25 aa, Staphylococcus
KTAELPRDEVTTVSTKTPYVSTGSD

SEQ ID NO: 1960483 - protein, 7 aa, Staphylococcus
KTAENKG

SEQ ID NO: 1960484 - protein, 6 aa, Staphylococcus
KTAEPE

SEQ ID NO: 1960485 - protein, 7 aa, Staphylococcus
KTAESWD

SEQ ID NO: 1960486 - protein, 7 aa, Staphylococcus
KTAETLG

SEQ ID NO: 1960487 - protein, 11 aa, Staphylococcus
KTAFDGRGNYT

SEQ ID NO: 1960488 - protein, 11 aa, Staphylococcus
KTAHKETKNPY

SEQ ID NO: 1960489 - protein, 4 aa, Staphylococcus
KTAK

SEQ ID NO: 1960490 - protein, 7 aa, Staphylococcus
KTAKLTE

SEQ ID NO: 1960491 - protein, 15 aa, Staphylococcus
KTALEKGKQNVSKRN

SEQ ID NO: 1960492 - protein, 6 aa, Staphylococcus
KTANEK

SEQ ID NO: 1960493 - protein, 8 aa, Staphylococcus
KTANGEDV

SEQ ID NO: 1960494 - protein, 7 aa, Staphylococcus
KTANYGL

SEQ ID NO: 1960495 - protein, 4 aa, Staphylococcus
KTAP

SEQ ID NO: 1960496 - protein, 4 aa, Staphylococcus
KTAQ

SEQ ID NO: 1960497 - protein, 9 aa, Staphylococcus
KTAQRETEY

SEQ ID NO: 1960498 - protein, 6 aa, Staphylococcus
KTAQVM

SEQ ID NO: 1960499 - protein, 18 aa, Staphylococcus
KTARKELKNWAKKKQVNT

SEQ ID NO: 1960500 - protein, 17 aa, Staphylococcus
KTARKELKNWAKTKQVD

SEQ ID NO: 1960501 - protein, 17 aa, Staphylococcus
KTARKELKNWSKTKQVD

SEQ ID NO: 1960502 - protein, 8 aa, Staphylococcus
KTASRLGS

SEQ ID NO: 1960503 - protein, 7 aa, Staphylococcus
KTASTIT

SEQ ID NO: 1960504 - protein, 16 aa, Staphylococcus
KTATEKLTVGDSAEYD

SEQ ID NO: 1960505 - protein, 14 aa, Staphylococcus
KTATNIEKYTSQGT

SEQ ID NO: 1960506 - protein, 14 aa, Staphylococcus
KTATNIESYTDQGT

SEQ ID NO: 1960507 - protein, 24 aa, Staphylococcus
KTAYEATRPKIDKSVRNDLKETYE

SEQ ID NO: 1960508 - protein, 8 aa, Staphylococcus
KTAYEKKG

SEQ ID NO: 1960509 - protein, 7 aa, Staphylococcus
KTCPHNA

SEQ ID NO: 1960510 - protein, 10 aa, Staphylococcus
KTDDDIPNGN

SEQ ID NO: 1960511 - protein, 7 aa, Staphylococcus
KTDDGLD

SEQ ID NO: 1960512 - protein, 6 aa, Staphylococcus
KTDDQV

SEQ ID NO: 1960513 - protein, 5 aa, Staphylococcus
KTDDV

SEQ ID NO: 1960514 - protein, 6 aa, Staphylococcus
KTDDVY

SEQ ID NO: 1960515 - protein, 7 aa, Staphylococcus
KTDDVYD

SEQ ID NO: 1960516 - protein, 6 aa, Staphylococcus
KTDEDL

SEQ ID NO: 1960517 - protein, 10 aa, Staphylococcus
KTDEEAKALA

SEQ ID NO: 1960518 - protein, 8 aa, Staphylococcus
KTDEEAVS

SEQ ID NO: 1960519 - protein, 5 aa, Staphylococcus
KTDEG

SEQ ID NO: 1960520 - protein, 5 aa, Staphylococcus
KTDEL

SEQ ID NO: 1960521 - protein, 7 aa, Staphylococcus
KTDESEA

SEQ ID NO: 1960522 - protein, 7 aa, Staphylococcus
KTDESNA

SEQ ID NO: 1960523 - protein, 17 aa, Staphylococcus
KTDFKQKEKEMHARHIF

SEQ ID NO: 1960524 - protein, 6 aa, Staphylococcus
KTDGKP

SEQ ID NO: 1960525 - protein, 8 aa, Staphylococcus
KTDGSMTR

SEQ ID NO: 1960526 - protein, 10 aa, Staphylococcus
KTDHDNDLTK

SEQ ID NO: 1960527 - protein, 8 aa, Staphylococcus
KTDHGNEI

SEQ ID NO: 1960528 - protein, 8 aa, Staphylococcus
KTDHGNEL

SEQ ID NO: 1960529 - protein, 7 aa, Staphylococcus
KTDHPLK

SEQ ID NO: 1960530 - protein, 10 aa, Staphylococcus
KTDISEKNNQ

SEQ ID NO: 1960531 - protein, 11 aa, Staphylococcus
KTDITNKQIST

SEQ ID NO: 1960532 - protein, 4 aa, Staphylococcus
KTDK

SEQ ID NO: 1960533 - protein, 6 aa, Staphylococcus
KTDKAL

SEQ ID NO: 1960534 - protein, 9 aa, Staphylococcus
KTDKTEEAI

SEQ ID NO: 1960535 - protein, 7 aa, Staphylococcus
KTDLPED

SEQ ID NO: 1960536 - protein, 4 aa, Staphylococcus
KTDN

SEQ ID NO: 1960537 - protein, 6 aa, Staphylococcus
KTDNER

SEQ ID NO: 1960538 - protein, 7 aa, Staphylococcus
KTDNGLD

SEQ ID NO: 1960539 - protein, 5 aa, Staphylococcus
KTDNR

SEQ ID NO: 1960540 - protein, 8 aa, Staphylococcus
KTDNTDTV

SEQ ID NO: 1960541 - protein, 7 aa, Staphylococcus
KTDNTLA

SEQ ID NO: 1960542 - protein, 7 aa, Staphylococcus
KTDQTLS

SEQ ID NO: 1960543 - protein, 4 aa, Staphylococcus
KTDR

SEQ ID NO: 1960544 - protein, 8 aa, Staphylococcus
KTDRDGAH

SEQ ID NO: 1960545 - protein, 14 aa, Staphylococcus
KTDRDGAKVDAGLP

SEQ ID NO: 1960546 - protein, 9 aa, Staphylococcus
KTDRDGARI

SEQ ID NO: 1960547 - protein, 6 aa, Staphylococcus
KTDRLS

SEQ ID NO: 1960548 - protein, 9 aa, Staphylococcus
KTDSDDARQ

SEQ ID NO: 1960549 - protein, 5 aa, Staphylococcus
KTDSL

SEQ ID NO: 1960550 - protein, 5 aa, Staphylococcus
KTDSS

SEQ ID NO: 1960551 - protein, 11 aa, Staphylococcus
KTDTSDHTGKT

SEQ ID NO: 1960552 - protein, 6 aa, Staphylococcus
KTDVEE

SEQ ID NO: 1960553 - protein, 7 aa, Staphylococcus
KTDVEEK

SEQ ID NO: 1960554 - protein, 6 aa, Staphylococcus
KTDVIT

SEQ ID NO: 1960555 - protein, 6 aa, Staphylococcus
KTDYDG

SEQ ID NO: 1960556 - protein, 9 aa, Staphylococcus
KTDYDNNKI

SEQ ID NO: 1960557 - protein, 23 aa, Staphylococcus
KTEADSETKLENQPVETESENDS

SEQ ID NO: 1960558 - protein, 8 aa, Staphylococcus
KTEAKLNK

SEQ ID NO: 1960559 - protein, 5 aa, Staphylococcus
KTEAY

SEQ ID NO: 1960560 - protein, 5 aa, Staphylococcus
KTEDF

SEQ ID NO: 1960561 - protein, 8 aa, Staphylococcus
KTEDFTNT

SEQ ID NO: 1960562 - protein, 22 aa, Staphylococcus
KTEDGSNPFAGADVIDDNEDYP

SEQ ID NO: 1960563 - protein, 14 aa, Staphylococcus
KTEDNVNSPSHYNY

SEQ ID NO: 1960564 - protein, 7 aa, Staphylococcus
KTEEAAA

SEQ ID NO: 1960565 - protein, 8 aa, Staphylococcus
KTEEAAAL

SEQ ID NO: 1960566 - protein, 47 aa, Staphylococcus
KTEEAAALKAQEELKNSYSKTNNNNDTSISSSAYSSQKQQKSHQRKI

SEQ ID NO: 1960567 - protein, 19 aa, Staphylococcus
KTEEEADELAKKVEAAGGI

SEQ ID NO: 1960568 - protein, 6 aa, Staphylococcus
KTEEFD

SEQ ID NO: 1960569 - protein, 6 aa, Staphylococcus
KTEEGL

SEQ ID NO: 1960570 - protein, 43 aa, Staphylococcus
KTEEKAALQAKAEAEQAEEKAQISTSNSYSDQKAQKREQRQIE

SEQ ID NO: 1960571 - protein, 5 aa, Staphylococcus
KTEEL

SEQ ID NO: 1960572 - protein, 28 aa, Staphylococcus
KTEEMKARRNKVSEEIAQKKRNKEDADD

SEQ ID NO: 1960573 - protein, 8 aa, Staphylococcus
KTEEQAAI

SEQ ID NO: 1960574 - protein, 5 aa, Staphylococcus
KTEET

SEQ ID NO: 1960575 - protein, 9 aa, Staphylococcus
KTEHHNQAI

SEQ ID NO: 1960576 - protein, 13 aa, Staphylococcus
KTEIDSASHDDSI

SEQ ID NO: 1960577 - protein, 6 aa, Staphylococcus
KTEIKL

SEQ ID NO: 1960578 - protein, 8 aa, Staphylococcus
KTEKEGVI

SEQ ID NO: 1960579 - protein, 11 aa, Staphylococcus
KTEKGKLRSEQ

SEQ ID NO: 1960580 - protein, 12 aa, Staphylococcus
KTELEEKGIDTV

SEQ ID NO: 1960581 - protein, 13 aa, Staphylococcus
KTELEEKSKRLNE

SEQ ID NO: 1960582 - protein, 8 aa, Staphylococcus
KTELKNDE

SEQ ID NO: 1960583 - protein, 13 aa, Staphylococcus
KTELNKRNKSAIS

SEQ ID NO: 1960584 - protein, 4 aa, Staphylococcus
KTEN

SEQ ID NO: 1960585 - protein, 6 aa, Staphylococcus
KTENEK

SEQ ID NO: 1960586 - protein, 9 aa, Staphylococcus
KTENTEDAL

SEQ ID NO: 1960587 - protein, 6 aa, Staphylococcus
KTEPDI

SEQ ID NO: 1960588 - protein, 7 aa, Staphylococcus
KTEPHAS

SEQ ID NO: 1960589 - protein, 7 aa, Staphylococcus
KTEPKRV

SEQ ID NO: 1960590 - protein, 8 aa, Staphylococcus
KTEPNAPI

SEQ ID NO: 1960591 - protein, 7 aa, Staphylococcus
KTEPWNA

SEQ ID NO: 1960592 - protein, 7 aa, Staphylococcus
KTEQKNL

SEQ ID NO: 1960593 - protein, 10 aa, Staphylococcus
KTEQSEKLTS

SEQ ID NO: 1960594 - protein, 10 aa, Staphylococcus
KTERKPDRKM

SEQ ID NO: 1960595 - protein, 9 aa, Staphylococcus
KTESETFGQ

SEQ ID NO: 1960596 - protein, 12 aa, Staphylococcus
KTESISESDDWS

SEQ ID NO: 1960597 - protein, 7 aa, Staphylococcus
KTESNYL

SEQ ID NO: 1960598 - protein, 8 aa, Staphylococcus
KTESSIGK

SEQ ID NO: 1960599 - protein, 6 aa, Staphylococcus
KTETIA

SEQ ID NO: 1960600 - protein, 24 aa, Staphylococcus
KTETKKAPTQTNKTKTKKIEVNTK

SEQ ID NO: 1960601 - protein, 6 aa, Staphylococcus
KTEVSI

SEQ ID NO: 1960602 - protein, 15 aa, Staphylococcus
KTEYRGREATDFKEE

SEQ ID NO: 1960603 - protein, 15 aa, Staphylococcus
KTEYRGREATDFQEE

SEQ ID NO: 1960604 - protein, 5 aa, Staphylococcus
KTFDG

SEQ ID NO: 1960605 - protein, 9 aa, Staphylococcus
KTFEPASSG

SEQ ID NO: 1960606 - protein, 18 aa, Staphylococcus
KTFGAAPHDQFRGHQGPI

SEQ ID NO: 1960607 - protein, 18 aa, Staphylococcus
KTFGAAPYDKYRGHDGPI

SEQ ID NO: 1960608 - protein, 12 aa, Staphylococcus
KTFKANDNLGQK

SEQ ID NO: 1960609 - protein, 6 aa, Staphylococcus
KTFNDN

SEQ ID NO: 1960610 - protein, 5 aa, Staphylococcus
KTFNE

SEQ ID NO: 1960611 - protein, 6 aa, Staphylococcus
KTFNGE

SEQ ID NO: 1960612 - protein, 5 aa, Staphylococcus
KTFNM

SEQ ID NO: 1960613 - protein, 11 aa, Staphylococcus
KTFNSKKEYEQ

SEQ ID NO: 1960614 - protein, 20 aa, Staphylococcus
KTFRGGMPSEGGFGVTVASL

SEQ ID NO: 1960615 - protein, 7 aa, Staphylococcus
KTFTETE

SEQ ID NO: 1960616 - protein, 8 aa, Staphylococcus
KTFTETEI

SEQ ID NO: 1960617 - protein, 7 aa, Staphylococcus
KTFTNTE

SEQ ID NO: 1960618 - protein, 4 aa, Staphylococcus
KTGA

SEQ ID NO: 1960619 - protein, 6 aa, Staphylococcus
KTGATG

SEQ ID NO: 1960620 - protein, 4 aa, Staphylococcus
KTGD

SEQ ID NO: 1960621 - protein, 8 aa, Staphylococcus
KTGDEKDV

SEQ ID NO: 1960622 - protein, 9 aa, Staphylococcus
KTGDNYPHD

SEQ ID NO: 1960623 - protein, 7 aa, Staphylococcus
KTGEFGT

SEQ ID NO: 1960624 - protein, 10 aa, Staphylococcus
KTGEGAYENG

SEQ ID NO: 1960625 - protein, 6 aa, Staphylococcus
KTGEID

SEQ ID NO: 1960626 - protein, 11 aa, Staphylococcus
KTGEPLTITDP

SEQ ID NO: 1960627 - protein, 6 aa, Staphylococcus
KTGEQP

SEQ ID NO: 1960628 - protein, 5 aa, Staphylococcus
KTGER

SEQ ID NO: 1960629 - protein, 18 aa, Staphylococcus
KTGFQLTDNPNDGGAGRV

SEQ ID NO: 1960630 - protein, 13 aa, Staphylococcus
KTGHTATVEPRNG

SEQ ID NO: 1960631 - protein, 6 aa, Staphylococcus
KTGIER

SEQ ID NO: 1960632 - protein, 8 aa, Staphylococcus
KTGIGTIA

SEQ ID NO: 1960633 - protein, 9 aa, Staphylococcus
KTGIGTIAS

SEQ ID NO: 1960634 - protein, 7 aa, Staphylococcus
KTGIKNT

SEQ ID NO: 1960635 - protein, 19 aa, Staphylococcus
KTGKETEINAPGPQITDEQ

SEQ ID NO: 1960636 - protein, 10 aa, Staphylococcus
KTGKGRKNKI

SEQ ID NO: 1960637 - protein, 8 aa, Staphylococcus
KTGKNADE

SEQ ID NO: 1960638 - protein, 8 aa, Staphylococcus
KTGKSAEA

SEQ ID NO: 1960639 - protein, 10 aa, Staphylococcus
KTGKSLAGPT

SEQ ID NO: 1960640 - protein, 9 aa, Staphylococcus
KTGKVSEAQ

SEQ ID NO: 1960641 - protein, 10 aa, Staphylococcus
KTGKVSEGQL

SEQ ID NO: 1960642 - protein, 12 aa, Staphylococcus
KTGLGHGKGGSM

SEQ ID NO: 1960643 - protein, 14 aa, Staphylococcus
KTGLKKSNNIMTTS

SEQ ID NO: 1960644 - protein, 5 aa, Staphylococcus
KTGLN

SEQ ID NO: 1960645 - protein, 12 aa, Staphylococcus
KTGLTSSAGVSY

SEQ ID NO: 1960646 - protein, 6 aa, Staphylococcus
KTGNIA

SEQ ID NO: 1960647 - protein, 7 aa, Staphylococcus
KTGPGYR

SEQ ID NO: 1960648 - protein, 17 aa, Staphylococcus
KTGPNPKRQKRNWKGGN

SEQ ID NO: 1960649 - protein, 10 aa, Staphylococcus
KTGQAMNKGM

SEQ ID NO: 1960650 - protein, 19 aa, Staphylococcus
KTGQETEVNAQGPNVTDAQ

SEQ ID NO: 1960651 - protein, 7 aa, Staphylococcus
KTGRLPD

SEQ ID NO: 1960652 - protein, 6 aa, Staphylococcus
KTGRPI

SEQ ID NO: 1960653 - protein, 6 aa, Staphylococcus
KTGSNL

SEQ ID NO: 1960654 - protein, 6 aa, Staphylococcus
KTGSNM

SEQ ID NO: 1960655 - protein, 5 aa, Staphylococcus
KTGTN

SEQ ID NO: 1960656 - protein, 6 aa, Staphylococcus
KTGVDT

SEQ ID NO: 1960657 - protein, 7 aa, Staphylococcus
KTGVGTI

SEQ ID NO: 1960658 - protein, 19 aa, Staphylococcus
KTGVGTPIAEGKETREFDG

SEQ ID NO: 1960659 - protein, 11 aa, Staphylococcus
KTGVSGAGRSL

SEQ ID NO: 1960660 - protein, 4 aa, Staphylococcus
KTGY

SEQ ID NO: 1960661 - protein, 13 aa, Staphylococcus
KTGYDSSEPGRLP

SEQ ID NO: 1960662 - protein, 5 aa, Staphylococcus
KTGYR

SEQ ID NO: 1960663 - protein, 9 aa, Staphylococcus
KTHALNNNY

SEQ ID NO: 1960664 - protein, 5 aa, Staphylococcus
KTHDL

SEQ ID NO: 1960665 - protein, 9 aa, Staphylococcus
KTHDSRQVL

SEQ ID NO: 1960666 - protein, 7 aa, Staphylococcus
KTHDWTR

SEQ ID NO: 1960667 - protein, 4 aa, Staphylococcus
KTHE

SEQ ID NO: 1960668 - protein, 6 aa, Staphylococcus
KTHEDV

SEQ ID NO: 1960669 - protein, 16 aa, Staphylococcus
KTHEEALEKKAALDDK

SEQ ID NO: 1960670 - protein, 4 aa, Staphylococcus
KTHH

SEQ ID NO: 1960671 - protein, 7 aa, Staphylococcus
KTHPNGD

SEQ ID NO: 1960672 - protein, 8 aa, Staphylococcus
KTHPNSRR

SEQ ID NO: 1960673 - protein, 7 aa, Staphylococcus
KTHPQSK

SEQ ID NO: 1960674 - protein, 8 aa, Staphylococcus
KTHPSADE

SEQ ID NO: 1960675 - protein, 4 aa, Staphylococcus
KTHQ

SEQ ID NO: 1960676 - protein, 8 aa, Staphylococcus
KTHQGHGT

SEQ ID NO: 1960677 - protein, 6 aa, Staphylococcus
KTHQNI

SEQ ID NO: 1960678 - protein, 14 aa, Staphylococcus
KTHSSSGRSPSEEG

SEQ ID NO: 1960679 - protein, 13 aa, Staphylococcus
KTHTSSGRIPSEE

SEQ ID NO: 1960680 - protein, 14 aa, Staphylococcus
KTHTSSGRYPSESG

SEQ ID NO: 1960681 - protein, 6 aa, Staphylococcus
KTHYDG

SEQ ID NO: 1960682 - protein, 7 aa, Staphylococcus
KTIATTV

SEQ ID NO: 1960683 - protein, 8 aa, Staphylococcus
KTIDDKNE

SEQ ID NO: 1960684 - protein, 6 aa, Staphylococcus
KTIDEL

SEQ ID NO: 1960685 - protein, 5 aa, Staphylococcus
KTIDG

SEQ ID NO: 1960686 - protein, 7 aa, Staphylococcus
KTIDGEK

SEQ ID NO: 1960687 - protein, 17 aa, Staphylococcus
KTIDYSKTEIQPGDDVG

SEQ ID NO: 1960688 - protein, 10 aa, Staphylococcus
KTIEASKEAD

SEQ ID NO: 1960689 - protein, 11 aa, Staphylococcus
KTIEASKKANV

SEQ ID NO: 1960690 - protein, 10 aa, Staphylococcus
KTIEASKQAN

SEQ ID NO: 1960691 - protein, 6 aa, Staphylococcus
KTIEDQ

SEQ ID NO: 1960692 - protein, 5 aa, Staphylococcus
KTIER

SEQ ID NO: 1960693 - protein, 10 aa, Staphylococcus
KTIKASEEAD

SEQ ID NO: 1960694 - protein, 8 aa, Staphylococcus
KTIKTQDI

SEQ ID NO: 1960695 - protein, 14 aa, Staphylococcus
KTIMKTNGSGRTNE

SEQ ID NO: 1960696 - protein, 25 aa, Staphylococcus
KTINDEVDPELYDSEGNLLNDSKTS

SEQ ID NO: 1960697 - protein, 12 aa, Staphylococcus
KTINKDDKATFS

SEQ ID NO: 1960698 - protein, 8 aa, Staphylococcus
KTINTNPK

SEQ ID NO: 1960699 - protein, 4 aa, Staphylococcus
KTIP

SEQ ID NO: 1960700 - protein, 5 aa, Staphylococcus
KTIPR

SEQ ID NO: 1960701 - protein, 5 aa, Staphylococcus
KTIPT

SEQ ID NO: 1960702 - protein, 7 aa, Staphylococcus
KTIRTSP

SEQ ID NO: 1960703 - protein, 7 aa, Staphylococcus
KTISNPE

SEQ ID NO: 1960704 - protein, 6 aa, Staphylococcus
KTISQI

SEQ ID NO: 1960705 - protein, 13 aa, Staphylococcus
KTISTNKDLSAFI

SEQ ID NO: 1960706 - protein, 6 aa, Staphylococcus
KTITNA

SEQ ID NO: 1960707 - protein, 8 aa, Staphylococcus
KTITPEEK

SEQ ID NO: 1960708 - protein, 7 aa, Staphylococcus
KTKAEDG

SEQ ID NO: 1960709 - protein, 9 aa, Staphylococcus
KTKDGRGFY

SEQ ID NO: 1960710 - protein, 8 aa, Staphylococcus
KTKDGRHF

SEQ ID NO: 1960711 - protein, 9 aa, Staphylococcus
KTKDGRTFY

SEQ ID NO: 1960712 - protein, 10 aa, Staphylococcus
KTKDKEIRPV

SEQ ID NO: 1960713 - protein, 9 aa, Staphylococcus
KTKDKHIRT

SEQ ID NO: 1960714 - protein, 7 aa, Staphylococcus
KTKEKFG

SEQ ID NO: 1960715 - protein, 7 aa, Staphylococcus
KTKEQSM

SEQ ID NO: 1960716 - protein, 14 aa, Staphylococcus
KTKETLSNNQKFKE

SEQ ID NO: 1960717 - protein, 16 aa, Staphylococcus
KTKGEKAEAPEPTKLT

SEQ ID NO: 1960718 - protein, 8 aa, Staphylococcus
KTKGQERL

SEQ ID NO: 1960719 - protein, 5 aa, Staphylococcus
KTKHQ

SEQ ID NO: 1960720 - protein, 21 aa, Staphylococcus
KTKHQTNVRSATKDQTQTMNR

SEQ ID NO: 1960721 - protein, 11 aa, Staphylococcus
KTKKDEAKQQA

SEQ ID NO: 1960722 - protein, 6 aa, Staphylococcus
KTKKEI

SEQ ID NO: 1960723 - protein, 9 aa, Staphylococcus
KTKKGPEIK

SEQ ID NO: 1960724 - protein, 8 aa, Staphylococcus
KTKKGPVV

SEQ ID NO: 1960725 - protein, 6 aa, Staphylococcus
KTKKKA

SEQ ID NO: 1960726 - protein, 10 aa, Staphylococcus
KTKKNLTEKA

SEQ ID NO: 1960727 - protein, 10 aa, Staphylococcus
KTKKQALEQI

SEQ ID NO: 1960728 - protein, 7 aa, Staphylococcus
KTKKQDV

SEQ ID NO: 1960729 - protein, 18 aa, Staphylococcus
KTKKVSSRAGMSHTRDTS

SEQ ID NO: 1960730 - protein, 5 aa, Staphylococcus
KTKKY

SEQ ID NO: 1960731 - protein, 16 aa, Staphylococcus
KTKMKKPELLAPAGNL

SEQ ID NO: 1960732 - protein, 10 aa, Staphylococcus
KTKNIKKKTI

SEQ ID NO: 1960733 - protein, 11 aa, Staphylococcus
KTKNKDFDEET

SEQ ID NO: 1960734 - protein, 11 aa, Staphylococcus
KTKNKDFNEET

SEQ ID NO: 1960735 - protein, 8 aa, Staphylococcus
KTKNMSLD

SEQ ID NO: 1960736 - protein, 11 aa, Staphylococcus
KTKNVKKKTID

SEQ ID NO: 1960737 - protein, 6 aa, Staphylococcus
KTKPDA

SEQ ID NO: 1960738 - protein, 6 aa, Staphylococcus
KTKPNL

SEQ ID NO: 1960739 - protein, 6 aa, Staphylococcus
KTKQAL

SEQ ID NO: 1960740 - protein, 25 aa, Staphylococcus
KTKQKKQHKRSKTISNAEKIKSYQD

SEQ ID NO: 1960741 - protein, 25 aa, Staphylococcus
KTKQKKQRKRTKTISNAEKIKSYQD

SEQ ID NO: 1960742 - protein, 7 aa, Staphylococcus
KTKQNFK

SEQ ID NO: 1960743 - protein, 10 aa, Staphylococcus
KTKQPNNNLN

SEQ ID NO: 1960744 - protein, 7 aa, Staphylococcus
KTKQVNT

SEQ ID NO: 1960745 - protein, 5 aa, Staphylococcus
KTKSI

SEQ ID NO: 1960746 - protein, 10 aa, Staphylococcus
KTKSLGKNTI

SEQ ID NO: 1960747 - protein, 9 aa, Staphylococcus
KTKSPSVPK

SEQ ID NO: 1960748 - protein, 9 aa, Staphylococcus
KTKSSIEKA

SEQ ID NO: 1960749 - protein, 10 aa, Staphylococcus
KTKTIEPFRD

SEQ ID NO: 1960750 - protein, 9 aa, Staphylococcus
KTKYNQAKD

SEQ ID NO: 1960751 - protein, 15 aa, Staphylococcus
KTKYQSIKVSIQQRI

SEQ ID NO: 1960752 - protein, 4 aa, Staphylococcus
KTLA

SEQ ID NO: 1960753 - protein, 10 aa, Staphylococcus
KTLAETLQDE

SEQ ID NO: 1960754 - protein, 10 aa, Staphylococcus
KTLANTLTDE

SEQ ID NO: 1960755 - protein, 7 aa, Staphylococcus
KTLAQPN

SEQ ID NO: 1960756 - protein, 6 aa, Staphylococcus
KTLDEL

SEQ ID NO: 1960757 - protein, 12 aa, Staphylococcus
KTLDPDDFTDAQ

SEQ ID NO: 1960758 - protein, 7 aa, Staphylococcus
KTLEDGR

SEQ ID NO: 1960759 - protein, 8 aa, Staphylococcus
KTLEGNQM

SEQ ID NO: 1960760 - protein, 7 aa, Staphylococcus
KTLEKQK

SEQ ID NO: 1960761 - protein, 11 aa, Staphylococcus
KTLGEDYDKGA

SEQ ID NO: 1960762 - protein, 23 aa, Staphylococcus
KTLGKEMEQISEENDEDKLNQSH

SEQ ID NO: 1960763 - protein, 14 aa, Staphylococcus
KTLISTNGSGRTNE

SEQ ID NO: 1960764 - protein, 4 aa, Staphylococcus
KTLK

SEQ ID NO: 1960765 - protein, 16 aa, Staphylococcus
KTLKGEVNISGAKNSA

SEQ ID NO: 1960766 - protein, 16 aa, Staphylococcus
KTLKQKEKCFSEKRKE

SEQ ID NO: 1960767 - protein, 14 aa, Staphylococcus
KTLNELGGRFDKES

SEQ ID NO: 1960768 - protein, 8 aa, Staphylococcus
KTLNGSLR

SEQ ID NO: 1960769 - protein, 5 aa, Staphylococcus
KTLNS

SEQ ID NO: 1960770 - protein, 23 aa, Staphylococcus
KTLPERARKLTDEQLSQELNEPV

SEQ ID NO: 1960771 - protein, 6 aa, Staphylococcus
KTLRDK

SEQ ID NO: 1960772 - protein, 5 aa, Staphylococcus
KTLSE

SEQ ID NO: 1960773 - protein, 10 aa, Staphylococcus
KTLSGGQRQR

SEQ ID NO: 1960774 - protein, 4 aa, Staphylococcus
KTLT

SEQ ID NO: 1960775 - protein, 11 aa, Staphylococcus
KTLTDDTTVTV

SEQ ID NO: 1960776 - protein, 12 aa, Staphylococcus
KTLTKPKTSYGL

SEQ ID NO: 1960777 - protein, 6 aa, Staphylococcus
KTLTPH

SEQ ID NO: 1960778 - protein, 17 aa, Staphylococcus
KTLYATPDYDHIQKMKV

SEQ ID NO: 1960779 - protein, 19 aa, Staphylococcus
KTLYATPDYDQIQHMKQDK

SEQ ID NO: 1960780 - protein, 12 aa, Staphylococcus
KTMDEVNTKAFE

SEQ ID NO: 1960781 - protein, 6 aa, Staphylococcus
KTMGDA

SEQ ID NO: 1960782 - protein, 14 aa, Staphylococcus
KTMLKTNGSGRTNE

SEQ ID NO: 1960783 - protein, 6 aa, Staphylococcus
KTMNQD

SEQ ID NO: 1960784 - protein, 5 aa, Staphylococcus
KTMPT

SEQ ID NO: 1960785 - protein, 11 aa, Staphylococcus
KTMSKEAKTIG

SEQ ID NO: 1960786 - protein, 4 aa, Staphylococcus
KTMT

SEQ ID NO: 1960787 - protein, 10 aa, Staphylococcus
KTMTRGYRRE

SEQ ID NO: 1960788 - protein, 6 aa, Staphylococcus
KTMYDG

SEQ ID NO: 1960789 - protein, 6 aa, Staphylococcus
KTNAEV

SEQ ID NO: 1960790 - protein, 7 aa, Staphylococcus
KTNALDD

SEQ ID NO: 1960791 - protein, 9 aa, Staphylococcus
KTNATVSKR

SEQ ID NO: 1960792 - protein, 8 aa, Staphylococcus
KTNDEDAR

SEQ ID NO: 1960793 - protein, 7 aa, Staphylococcus
KTNDEVD

SEQ ID NO: 1960794 - protein, 8 aa, Staphylococcus
KTNDQGDQ

SEQ ID NO: 1960795 - protein, 5 aa, Staphylococcus
KTNEI

SEQ ID NO: 1960796 - protein, 8 aa, Staphylococcus
KTNEQGHQ

SEQ ID NO: 1960797 - protein, 7 aa, Staphylococcus
KTNFDPQ

SEQ ID NO: 1960798 - protein, 6 aa, Staphylococcus
KTNGGS

SEQ ID NO: 1960799 - protein, 10 aa, Staphylococcus
KTNGSGRTNE

SEQ ID NO: 1960800 - protein, 9 aa, Staphylococcus
KTNHESDHN

SEQ ID NO: 1960801 - protein, 9 aa, Staphylococcus
KTNKAEGDY

SEQ ID NO: 1960802 - protein, 9 aa, Staphylococcus
KTNKERECV

SEQ ID NO: 1960803 - protein, 5 aa, Staphylococcus
KTNKN

SEQ ID NO: 1960804 - protein, 6 aa, Staphylococcus
KTNKNM

SEQ ID NO: 1960805 - protein, 6 aa, Staphylococcus
KTNKNN

SEQ ID NO: 1960806 - protein, 5 aa, Staphylococcus
KTNKS

SEQ ID NO: 1960807 - protein, 8 aa, Staphylococcus
KTNKTKDL

SEQ ID NO: 1960808 - protein, 7 aa, Staphylococcus
KTNLEKI

SEQ ID NO: 1960809 - protein, 19 aa, Staphylococcus
KTNLTTTPSKTVSVPSVKE

SEQ ID NO: 1960810 - protein, 4 aa, Staphylococcus
KTNN

SEQ ID NO: 1960811 - protein, 10 aa, Staphylococcus
KTNNDCPDGN

SEQ ID NO: 1960812 - protein, 12 aa, Staphylococcus
KTNNPAKTQQEM

SEQ ID NO: 1960813 - protein, 6 aa, Staphylococcus
KTNPDG

SEQ ID NO: 1960814 - protein, 6 aa, Staphylococcus
KTNPEG

SEQ ID NO: 1960815 - protein, 6 aa, Staphylococcus
KTNPER

SEQ ID NO: 1960816 - protein, 14 aa, Staphylococcus
KTNPSEATPGSIRG

SEQ ID NO: 1960817 - protein, 14 aa, Staphylococcus
KTNPSEATPGTIRG

SEQ ID NO: 1960818 - protein, 15 aa, Staphylococcus
KTNPTEAAPGTIRGD

SEQ ID NO: 1960819 - protein, 22 aa, Staphylococcus
KTNPTKVENVATTPVATEPNNE

SEQ ID NO: 1960820 - protein, 4 aa, Staphylococcus
KTNQ

SEQ ID NO: 1960821 - protein, 10 aa, Staphylococcus
KTNQERQRVQ

SEQ ID NO: 1960822 - protein, 7 aa, Staphylococcus
KTNQNDL

SEQ ID NO: 1960823 - protein, 11 aa, Staphylococcus
KTNQNRKRVSD

SEQ ID NO: 1960824 - protein, 9 aa, Staphylococcus
KTNQQHQHQ

SEQ ID NO: 1960825 - protein, 12 aa, Staphylococcus
KTNQSHIEQHQQ

SEQ ID NO: 1960826 - protein, 18 aa, Staphylococcus
KTNQYTGATYGKYQRPQR

SEQ ID NO: 1960827 - protein, 9 aa, Staphylococcus
KTNSDNFRY

SEQ ID NO: 1960828 - protein, 6 aa, Staphylococcus
KTNSEV

SEQ ID NO: 1960829 - protein, 9 aa, Staphylococcus
KTNSGGWDF

SEQ ID NO: 1960830 - protein, 6 aa, Staphylococcus
KTNSLI

SEQ ID NO: 1960831 - protein, 8 aa, Staphylococcus
KTNSSNLK

SEQ ID NO: 1960832 - protein, 8 aa, Staphylococcus
KTNTEQDV

SEQ ID NO: 1960833 - protein, 6 aa, Staphylococcus
KTNTNI

SEQ ID NO: 1960834 - protein, 5 aa, Staphylococcus
KTNTY

SEQ ID NO: 1960835 - protein, 9 aa, Staphylococcus
KTNTYRPAT

SEQ ID NO: 1960836 - protein, 4 aa, Staphylococcus
KTNV

SEQ ID NO: 1960837 - protein, 4 aa, Staphylococcus
KTPE

SEQ ID NO: 1960838 - protein, 7 aa, Staphylococcus
KTPEGEF

SEQ ID NO: 1960839 - protein, 5 aa, Staphylococcus
KTPEI

SEQ ID NO: 1960840 - protein, 7 aa, Staphylococcus
KTPELEE

SEQ ID NO: 1960841 - protein, 7 aa, Staphylococcus
KTPGIEG

SEQ ID NO: 1960842 - protein, 4 aa, Staphylococcus
KTPI

SEQ ID NO: 1960843 - protein, 7 aa, Staphylococcus
KTPIEYS

SEQ ID NO: 1960844 - protein, 13 aa, Staphylococcus
KTPIGVAKASKQF

SEQ ID NO: 1960845 - protein, 5 aa, Staphylococcus
KTPIR

SEQ ID NO: 1960846 - protein, 7 aa, Staphylococcus
KTPKADW

SEQ ID NO: 1960847 - protein, 5 aa, Staphylococcus
KTPMG

SEQ ID NO: 1960848 - protein, 6 aa, Staphylococcus
KTPNTQ

SEQ ID NO: 1960849 - protein, 6 aa, Staphylococcus
KTPPPW

SEQ ID NO: 1960850 - protein, 6 aa, Staphylococcus
KTPQDY

SEQ ID NO: 1960851 - protein, 7 aa, Staphylococcus
KTPQNHT

SEQ ID NO: 1960852 - protein, 6 aa, Staphylococcus
KTPQQH

SEQ ID NO: 1960853 - protein, 20 aa, Staphylococcus
KTPSERITVDERAKQLSKDL

SEQ ID NO: 1960854 - protein, 4 aa, Staphylococcus
KTPT

SEQ ID NO: 1960855 - protein, 7 aa, Staphylococcus
KTPTKEI

SEQ ID NO: 1960856 - protein, 9 aa, Staphylococcus
KTPTNQQDL

SEQ ID NO: 1960857 - protein, 17 aa, Staphylococcus
KTPVDKSSSYYYYYGED

SEQ ID NO: 1960858 - protein, 9 aa, Staphylococcus
KTPVKYAKT

SEQ ID NO: 1960859 - protein, 10 aa, Staphylococcus
KTPVKYASGE

SEQ ID NO: 1960860 - protein, 10 aa, Staphylococcus
KTPVKYASRD

SEQ ID NO: 1960861 - protein, 10 aa, Staphylococcus
KTPVKYASRE

SEQ ID NO: 1960862 - protein, 22 aa, Staphylococcus
KTPWNKESRHRQWQDGDDSALR

SEQ ID NO: 1960863 - protein, 11 aa, Staphylococcus
KTQEAHIKDEH

SEQ ID NO: 1960864 - protein, 6 aa, Staphylococcus
KTQEHD

SEQ ID NO: 1960865 - protein, 7 aa, Staphylococcus
KTQEQDT

SEQ ID NO: 1960866 - protein, 10 aa, Staphylococcus
KTQETHLKNE

SEQ ID NO: 1960867 - protein, 5 aa, Staphylococcus
KTQEV

SEQ ID NO: 1960868 - protein, 9 aa, Staphylococcus
KTQGNYNNE

SEQ ID NO: 1960869 - protein, 6 aa, Staphylococcus
KTQIED

SEQ ID NO: 1960870 - protein, 19 aa, Staphylococcus
KTQKESAKDEPDAKKVREL

SEQ ID NO: 1960871 - protein, 6 aa, Staphylococcus
KTQKGL

SEQ ID NO: 1960872 - protein, 11 aa, Staphylococcus
KTQKLTTQSGL

SEQ ID NO: 1960873 - protein, 4 aa, Staphylococcus
KTQL

SEQ ID NO: 1960874 - protein, 5 aa, Staphylococcus
KTQNM

SEQ ID NO: 1960875 - protein, 10 aa, Staphylococcus
KTQPRANTAV

SEQ ID NO: 1960876 - protein, 8 aa, Staphylococcus
KTQQKKIK

SEQ ID NO: 1960877 - protein, 13 aa, Staphylococcus
KTQQKKIKKMKES

SEQ ID NO: 1960878 - protein, 9 aa, Staphylococcus
KTQQNGDEL

SEQ ID NO: 1960879 - protein, 10 aa, Staphylococcus
KTQQQSETIT

SEQ ID NO: 1960880 - protein, 6 aa, Staphylococcus
KTQRHI

SEQ ID NO: 1960881 - protein, 9 aa, Staphylococcus
KTQSQAYEV

SEQ ID NO: 1960882 - protein, 10 aa, Staphylococcus
KTQTDDDAKK

SEQ ID NO: 1960883 - protein, 14 aa, Staphylococcus
KTQTFTDGHRYDHS

SEQ ID NO: 1960884 - protein, 6 aa, Staphylococcus
KTQTQF

SEQ ID NO: 1960885 - protein, 13 aa, Staphylococcus
KTQVSGRLGGADI

SEQ ID NO: 1960886 - protein, 16 aa, Staphylococcus
KTQWDNNNLDATSFGP

SEQ ID NO: 1960887 - protein, 4 aa, Staphylococcus
KTQY

SEQ ID NO: 1960888 - protein, 12 aa, Staphylococcus
KTQYKEHKEQHK

SEQ ID NO: 1960889 - protein, 19 aa, Staphylococcus
KTRAAQDDTHHAGGPTTDF

SEQ ID NO: 1960890 - protein, 20 aa, Staphylococcus
KTRAAQDNTHGVGKPTTDYH

SEQ ID NO: 1960891 - protein, 18 aa, Staphylococcus
KTRANQDTTDKPGAVTTE

SEQ ID NO: 1960892 - protein, 19 aa, Staphylococcus
KTRASQDDTKHAGKPTTDF

SEQ ID NO: 1960893 - protein, 11 aa, Staphylococcus
KTRDGQYEGQN

SEQ ID NO: 1960894 - protein, 6 aa, Staphylococcus
KTRDLG

SEQ ID NO: 1960895 - protein, 4 aa, Staphylococcus
KTRE

SEQ ID NO: 1960896 - protein, 5 aa, Staphylococcus
KTREE

SEQ ID NO: 1960897 - protein, 12 aa, Staphylococcus
KTREGQYKDKER

SEQ ID NO: 1960898 - protein, 4 aa, Staphylococcus
KTRH

SEQ ID NO: 1960899 - protein, 6 aa, Staphylococcus
KTRHES

SEQ ID NO: 1960900 - protein, 5 aa, Staphylococcus
KTRKE

SEQ ID NO: 1960901 - protein, 12 aa, Staphylococcus
KTRLRPGGKKAT

SEQ ID NO: 1960902 - protein, 4 aa, Staphylococcus
KTRN

SEQ ID NO: 1960903 - protein, 6 aa, Staphylococcus
KTRNGD

SEQ ID NO: 1960904 - protein, 9 aa, Staphylococcus
KTRQKHSFT

SEQ ID NO: 1960905 - protein, 13 aa, Staphylococcus
KTRRGKSPLNPTN

SEQ ID NO: 1960906 - protein, 8 aa, Staphylococcus
KTRSEERT

SEQ ID NO: 1960907 - protein, 10 aa, Staphylococcus
KTRSKLVESG

SEQ ID NO: 1960908 - protein, 10 aa, Staphylococcus
KTRTKKDKFP

SEQ ID NO: 1960909 - protein, 7 aa, Staphylococcus
KTRTTDW

SEQ ID NO: 1960910 - protein, 15 aa, Staphylococcus
KTRVNRKHKTHGEPE

SEQ ID NO: 1960911 - protein, 37 aa, Staphylococcus
KTRVNRKKRKESEHEPFPATPETPPETAVDHDKDDEI

SEQ ID NO: 1960912 - protein, 14 aa, Staphylococcus
KTRVNRKNRDHGDQ

SEQ ID NO: 1960913 - protein, 16 aa, Staphylococcus
KTRVNRRNRNRGEQEA

SEQ ID NO: 1960914 - protein, 7 aa, Staphylococcus
KTRYETQ

SEQ ID NO: 1960915 - protein, 7 aa, Staphylococcus
KTSAGNL

SEQ ID NO: 1960916 - protein, 10 aa, Staphylococcus
KTSALYSATK

SEQ ID NO: 1960917 - protein, 9 aa, Staphylococcus
KTSDENYKQ

SEQ ID NO: 1960918 - protein, 12 aa, Staphylococcus
KTSDIEGHPDFK

SEQ ID NO: 1960919 - protein, 5 aa, Staphylococcus
KTSDQ

SEQ ID NO: 1960920 - protein, 15 aa, Staphylococcus
KTSDYEQQEQELPGL

SEQ ID NO: 1960921 - protein, 8 aa, Staphylococcus
KTSEENYK

SEQ ID NO: 1960922 - protein, 9 aa, Staphylococcus
KTSEENYKQ

SEQ ID NO: 1960923 - protein, 14 aa, Staphylococcus
KTSEIQTDSEFNGK

SEQ ID NO: 1960924 - protein, 6 aa, Staphylococcus
KTSEIR

SEQ ID NO: 1960925 - protein, 6 aa, Staphylococcus
KTSERH

SEQ ID NO: 1960926 - protein, 9 aa, Staphylococcus
KTSESFKQH

SEQ ID NO: 1960927 - protein, 13 aa, Staphylococcus
KTSESHIKSEHEE

SEQ ID NO: 1960928 - protein, 4 aa, Staphylococcus
KTSF

SEQ ID NO: 1960929 - protein, 7 aa, Staphylococcus
KTSFNNS

SEQ ID NO: 1960930 - protein, 14 aa, Staphylococcus
KTSGALPKDEAFES

SEQ ID NO: 1960931 - protein, 5 aa, Staphylococcus
KTSGH

SEQ ID NO: 1960932 - protein, 5 aa, Staphylococcus
KTSGR

SEQ ID NO: 1960933 - protein, 12 aa, Staphylococcus
KTSGSKRTTIKT

SEQ ID NO: 1960934 - protein, 5 aa, Staphylococcus
KTSIG

SEQ ID NO: 1960935 - protein, 7 aa, Staphylococcus
KTSIRNT

SEQ ID NO: 1960936 - protein, 6 aa, Staphylococcus
KTSITQ

SEQ ID NO: 1960937 - protein, 18 aa, Staphylococcus
KTSKAKQEYSQKELKQNT

SEQ ID NO: 1960938 - protein, 6 aa, Staphylococcus
KTSKQF

SEQ ID NO: 1960939 - protein, 18 aa, Staphylococcus
KTSKSKQKYGQKELKQNT

SEQ ID NO: 1960940 - protein, 7 aa, Staphylococcus
KTSKYLD

SEQ ID NO: 1960941 - protein, 4 aa, Staphylococcus
KTSN

SEQ ID NO: 1960942 - protein, 7 aa, Staphylococcus
KTSNDLQ

SEQ ID NO: 1960943 - protein, 20 aa, Staphylococcus
KTSNGQPSYYTGDKATKKHE

SEQ ID NO: 1960944 - protein, 6 aa, Staphylococcus
KTSNLA

SEQ ID NO: 1960945 - protein, 8 aa, Staphylococcus
KTSNREHV

SEQ ID NO: 1960946 - protein, 23 aa, Staphylococcus
KTSPENVQNVATPAAVTQPTNDA

SEQ ID NO: 1960947 - protein, 8 aa, Staphylococcus
KTSPETCT

SEQ ID NO: 1960948 - protein, 7 aa, Staphylococcus
KTSPIKE

SEQ ID NO: 1960949 - protein, 17 aa, Staphylococcus
KTSPKGDATPYITSWGN

SEQ ID NO: 1960950 - protein, 6 aa, Staphylococcus
KTSPTA

SEQ ID NO: 1960951 - protein, 7 aa, Staphylococcus
KTSQRQH

SEQ ID NO: 1960952 - protein, 10 aa, Staphylococcus
KTSRLSSIEA

SEQ ID NO: 1960953 - protein, 14 aa, Staphylococcus
KTSTGFAGGATAED

SEQ ID NO: 1960954 - protein, 16 aa, Staphylococcus
KTSTGFAGGGATPEDV

SEQ ID NO: 1960955 - protein, 16 aa, Staphylococcus
KTSTGFAGLGATPEDV

SEQ ID NO: 1960956 - protein, 7 aa, Staphylococcus
KTSTSWQ

SEQ ID NO: 1960957 - protein, 8 aa, Staphylococcus
KTSTTDWS

SEQ ID NO: 1960958 - protein, 4 aa, Staphylococcus
KTSV

SEQ ID NO: 1960959 - protein, 6 aa, Staphylococcus
KTSVSF

SEQ ID NO: 1960960 - protein, 11 aa, Staphylococcus
KTSVSLKRHAD

SEQ ID NO: 1960961 - protein, 17 aa, Staphylococcus
KTSVSSKTKQYVGPDEV

SEQ ID NO: 1960962 - protein, 9 aa, Staphylococcus
KTSWSSPYQ

SEQ ID NO: 1960963 - protein, 4 aa, Staphylococcus
KTSY

SEQ ID NO: 1960964 - protein, 8 aa, Staphylococcus
KTSYKVTE

SEQ ID NO: 1960965 - protein, 21 aa, Staphylococcus
KTTAKGYQCPQCGNDDPKSVD

SEQ ID NO: 1960966 - protein, 7 aa, Staphylococcus
KTTAPYF

SEQ ID NO: 1960967 - protein, 12 aa, Staphylococcus
KTTDASASTTTE

SEQ ID NO: 1960968 - protein, 18 aa, Staphylococcus
KTTDDSKGRLKDDEKRYP

SEQ ID NO: 1960969 - protein, 5 aa, Staphylococcus
KTTDQ

SEQ ID NO: 1960970 - protein, 11 aa, Staphylococcus
KTTDTYGTEQR

SEQ ID NO: 1960971 - protein, 11 aa, Staphylococcus
KTTDVGPVGDS

SEQ ID NO: 1960972 - protein, 6 aa, Staphylococcus
KTTEFD

SEQ ID NO: 1960973 - protein, 12 aa, Staphylococcus
KTTELEGHPDFK

SEQ ID NO: 1960974 - protein, 7 aa, Staphylococcus
KTTENKL

SEQ ID NO: 1960975 - protein, 13 aa, Staphylococcus
KTTEPKSGGMYIV

SEQ ID NO: 1960976 - protein, 17 aa, Staphylococcus
KTTEQFKDKYSGQLNTV

SEQ ID NO: 1960977 - protein, 6 aa, Staphylococcus
KTTEQL

SEQ ID NO: 1960978 - protein, 6 aa, Staphylococcus
KTTERR

SEQ ID NO: 1960979 - protein, 7 aa, Staphylococcus
KTTESDT

SEQ ID NO: 1960980 - protein, 4 aa, Staphylococcus
KTTF

SEQ ID NO: 1960981 - protein, 5 aa, Staphylococcus
KTTGT

SEQ ID NO: 1960982 - protein, 12 aa, Staphylococcus
KTTIKNGMIHAF

SEQ ID NO: 1960983 - protein, 13 aa, Staphylococcus
KTTIKNGVPHHFR

SEQ ID NO: 1960984 - protein, 7 aa, Staphylococcus
KTTISQE

SEQ ID NO: 1960985 - protein, 5 aa, Staphylococcus
KTTIT

SEQ ID NO: 1960986 - protein, 5 aa, Staphylococcus
KTTKA

SEQ ID NO: 1960987 - protein, 12 aa, Staphylococcus
KTTKDLGGHYKT

SEQ ID NO: 1960988 - protein, 36 aa, Staphylococcus
KTTKENNKQTPEDTMQNNQNTVNQPVSQPQQPVTNI

SEQ ID NO: 1960989 - protein, 10 aa, Staphylococcus
KTTKTNPNSF

SEQ ID NO: 1960990 - protein, 6 aa, Staphylococcus
KTTKVG

SEQ ID NO: 1960991 - protein, 10 aa, Staphylococcus
KTTLDGDEAR

SEQ ID NO: 1960992 - protein, 7 aa, Staphylococcus
KTTLNEE

SEQ ID NO: 1960993 - protein, 16 aa, Staphylococcus
KTTNQQKSYDHVTPEE

SEQ ID NO: 1960994 - protein, 13 aa, Staphylococcus
KTTNSKKDHSSQL

SEQ ID NO: 1960995 - protein, 9 aa, Staphylococcus
KTTPKYNVK

SEQ ID NO: 1960996 - protein, 6 aa, Staphylococcus
KTTPQL

SEQ ID NO: 1960997 - protein, 6 aa, Staphylococcus
KTTQRD

SEQ ID NO: 1960998 - protein, 20 aa, Staphylococcus
KTTQTAEERNISKKNTMRTA

SEQ ID NO: 1960999 - protein, 37 aa, Staphylococcus
KTTQTAEERNISQKNAMRTAVKNAKAAIASNADNKAE

SEQ ID NO: 1961000 - protein, 4 aa, Staphylococcus
KTTR

SEQ ID NO: 1961001 - protein, 7 aa, Staphylococcus
KTTSLNE

SEQ ID NO: 1961002 - protein, 5 aa, Staphylococcus
KTVAP

SEQ ID NO: 1961003 - protein, 7 aa, Staphylococcus
KTVDNVN

SEQ ID NO: 1961004 - protein, 5 aa, Staphylococcus
KTVET

SEQ ID NO: 1961005 - protein, 10 aa, Staphylococcus
KTVGSLPSHD

SEQ ID NO: 1961006 - protein, 4 aa, Staphylococcus
KTVI

SEQ ID NO: 1961007 - protein, 12 aa, Staphylococcus
KTVITESGQSFE

SEQ ID NO: 1961008 - protein, 4 aa, Staphylococcus
KTVK

SEQ ID NO: 1961009 - protein, 7 aa, Staphylococcus
KTVKEAK

SEQ ID NO: 1961010 - protein, 8 aa, Staphylococcus
KTVKEAKD

SEQ ID NO: 1961011 - protein, 6 aa, Staphylococcus
KTVKEN

SEQ ID NO: 1961012 - protein, 6 aa, Staphylococcus
KTVKQD

SEQ ID NO: 1961013 - protein, 5 aa, Staphylococcus
KTVKT

SEQ ID NO: 1961014 - protein, 6 aa, Staphylococcus
KTVKTL

SEQ ID NO: 1961015 - protein, 10 aa, Staphylococcus
KTVNKKPTIS

SEQ ID NO: 1961016 - protein, 32 aa, Staphylococcus
KTVPKRQTQSNRLQSSSNERKYQPMNESTARN

SEQ ID NO: 1961017 - protein, 6 aa, Staphylococcus
KTVQEA

SEQ ID NO: 1961018 - protein, 12 aa, Staphylococcus
KTVTAGRQLPKI

SEQ ID NO: 1961019 - protein, 10 aa, Staphylococcus
KTVTETTEYE

SEQ ID NO: 1961020 - protein, 15 aa, Staphylococcus
KTVTGFSNTEEEAVG

SEQ ID NO: 1961021 - protein, 4 aa, Staphylococcus
KTVY

SEQ ID NO: 1961022 - protein, 6 aa, Staphylococcus
KTYDDV

SEQ ID NO: 1961023 - protein, 5 aa, Staphylococcus
KTYED

SEQ ID NO: 1961024 - protein, 9 aa, Staphylococcus
KTYETTEPL

SEQ ID NO: 1961025 - protein, 4 aa, Staphylococcus
KTYG

SEQ ID NO: 1961026 - protein, 8 aa, Staphylococcus
KTYGATPF

SEQ ID NO: 1961027 - protein, 6 aa, Staphylococcus
KTYGDN

SEQ ID NO: 1961028 - protein, 9 aa, Staphylococcus
KTYGNAKEN

SEQ ID NO: 1961029 - protein, 6 aa, Staphylococcus
KTYHHS

SEQ ID NO: 1961030 - protein, 5 aa, Staphylococcus
KTYKD

SEQ ID NO: 1961031 - protein, 17 aa, Staphylococcus
KTYKGQKSGKRVKKGTH

SEQ ID NO: 1961032 - protein, 5 aa, Staphylococcus
KTYKS

SEQ ID NO: 1961033 - protein, 5 aa, Staphylococcus
KTYNK

SEQ ID NO: 1961034 - protein, 6 aa, Staphylococcus
KTYNVP

SEQ ID NO: 1961035 - protein, 5 aa, Staphylococcus
KTYPN

SEQ ID NO: 1961036 - protein, 5 aa, Staphylococcus
KTYPQ

SEQ ID NO: 1961037 - protein, 5 aa, Staphylococcus
KTYPS

SEQ ID NO: 1961038 - protein, 6 aa, Staphylococcus
KTYPSN

SEQ ID NO: 1961039 - protein, 8 aa, Staphylococcus
KTYRDDDA

SEQ ID NO: 1961040 - protein, 5 aa, Staphylococcus
KTYRG

SEQ ID NO: 1961041 - protein, 11 aa, Staphylococcus
KTYSPNSIDGT

SEQ ID NO: 1961042 - protein, 12 aa, Staphylococcus
KTYSPNSIEGTI

SEQ ID NO: 1961043 - protein, 16 aa, Staphylococcus
KTYTAKDKKSQIEVRK

SEQ ID NO: 1961044 - protein, 5 aa, Staphylococcus
KTYTD

SEQ ID NO: 1961045 - protein, 8 aa, Staphylococcus
KTYYPKNK

SEQ ID NO: 1961046 - protein, 10 aa, Staphylococcus
KVAANKIKPD

SEQ ID NO: 1961047 - protein, 12 aa, Staphylococcus
KVADTLPAYRES

SEQ ID NO: 1961048 - protein, 11 aa, Staphylococcus
KVAEMSPATDF

SEQ ID NO: 1961049 - protein, 6 aa, Staphylococcus
KVAEQA

SEQ ID NO: 1961050 - protein, 34 aa, Staphylococcus
KVAKASKSDVDKAVQAAQDAFDSWSKTSKEERAD

SEQ ID NO: 1961051 - protein, 6 aa, Staphylococcus
KVAPPF

SEQ ID NO: 1961052 - protein, 6 aa, Staphylococcus
KVAQSI

SEQ ID NO: 1961053 - protein, 4 aa, Staphylococcus
KVAR

SEQ ID NO: 1961054 - protein, 9 aa, Staphylococcus
KVAREQGVM

SEQ ID NO: 1961055 - protein, 4 aa, Staphylococcus
KVAS

SEQ ID NO: 1961056 - protein, 8 aa, Staphylococcus
KVASGGEL

SEQ ID NO: 1961057 - protein, 25 aa, Staphylococcus
KVASQDVADATRIQYGGSVKPNNVK

SEQ ID NO: 1961058 - protein, 12 aa, Staphylococcus
KVASQSYLTKKD

SEQ ID NO: 1961059 - protein, 8 aa, Staphylococcus
KVATRRAN

SEQ ID NO: 1961060 - protein, 4 aa, Staphylococcus
KVDA

SEQ ID NO: 1961061 - protein, 6 aa, Staphylococcus
KVDAGS

SEQ ID NO: 1961062 - protein, 8 aa, Staphylococcus
KVDAPDSY

SEQ ID NO: 1961063 - protein, 6 aa, Staphylococcus
KVDDEI

SEQ ID NO: 1961064 - protein, 8 aa, Staphylococcus
KVDDTRRV

SEQ ID NO: 1961065 - protein, 10 aa, Staphylococcus
KVDEVTGADV

SEQ ID NO: 1961066 - protein, 16 aa, Staphylococcus
KVDGITDLRDETSLRT

SEQ ID NO: 1961067 - protein, 11 aa, Staphylococcus
KVDHQMNDDED

SEQ ID NO: 1961068 - protein, 7 aa, Staphylococcus
KVDKPNH

SEQ ID NO: 1961069 - protein, 10 aa, Staphylococcus
KVDKQKKVKD

SEQ ID NO: 1961070 - protein, 9 aa, Staphylococcus
KVDNDEYGL

SEQ ID NO: 1961071 - protein, 10 aa, Staphylococcus
KVDNISDNHE

SEQ ID NO: 1961072 - protein, 5 aa, Staphylococcus
KVDNK

SEQ ID NO: 1961073 - protein, 6 aa, Staphylococcus
KVDPDL

SEQ ID NO: 1961074 - protein, 9 aa, Staphylococcus
KVDPERAKW

SEQ ID NO: 1961075 - protein, 6 aa, Staphylococcus
KVDRPK

SEQ ID NO: 1961076 - protein, 4 aa, Staphylococcus
KVDS

SEQ ID NO: 1961077 - protein, 14 aa, Staphylococcus
KVDSDMEVSYGSAE

SEQ ID NO: 1961078 - protein, 9 aa, Staphylococcus
KVDSGQAIV

SEQ ID NO: 1961079 - protein, 8 aa, Staphylococcus
KVEDDLGR

SEQ ID NO: 1961080 - protein, 6 aa, Staphylococcus
KVEDIT

SEQ ID NO: 1961081 - protein, 11 aa, Staphylococcus
KVEDLPKEERF

SEQ ID NO: 1961082 - protein, 12 aa, Staphylococcus
KVEDNSRSQQLY

SEQ ID NO: 1961083 - protein, 7 aa, Staphylococcus
KVEDSQK

SEQ ID NO: 1961084 - protein, 4 aa, Staphylococcus
KVEE

SEQ ID NO: 1961085 - protein, 17 aa, Staphylococcus
KVEEAKSYQIDESTARH

SEQ ID NO: 1961086 - protein, 8 aa, Staphylococcus
KVEEGKAI

SEQ ID NO: 1961087 - protein, 7 aa, Staphylococcus
KVEEKGY

SEQ ID NO: 1961088 - protein, 7 aa, Staphylococcus
KVEEQIE

SEQ ID NO: 1961089 - protein, 8 aa, Staphylococcus
KVEEQSER

SEQ ID NO: 1961090 - protein, 6 aa, Staphylococcus
KVEETK

SEQ ID NO: 1961091 - protein, 8 aa, Staphylococcus
KVEETSAR

SEQ ID NO: 1961092 - protein, 6 aa, Staphylococcus
KVEGAG

SEQ ID NO: 1961093 - protein, 8 aa, Staphylococcus
KVENEAQL

SEQ ID NO: 1961094 - protein, 7 aa, Staphylococcus
KVENEEQ

SEQ ID NO: 1961095 - protein, 7 aa, Staphylococcus
KVENHDK

SEQ ID NO: 1961096 - protein, 10 aa, Staphylococcus
KVENQGKTRK

SEQ ID NO: 1961097 - protein, 8 aa, Staphylococcus
KVEPGKIY

SEQ ID NO: 1961098 - protein, 7 aa, Staphylococcus
KVEPVKE

SEQ ID NO: 1961099 - protein, 8 aa, Staphylococcus
KVEQADKL

SEQ ID NO: 1961100 - protein, 7 aa, Staphylococcus
KVEQEDI

SEQ ID NO: 1961101 - protein, 6 aa, Staphylococcus
KVEQSI

SEQ ID NO: 1961102 - protein, 6 aa, Staphylococcus
KVEREV

SEQ ID NO: 1961103 - protein, 7 aa, Staphylococcus
KVEREVP

SEQ ID NO: 1961104 - protein, 5 aa, Staphylococcus
KVERQ

SEQ ID NO: 1961105 - protein, 7 aa, Staphylococcus
KVESEEQ

SEQ ID NO: 1961106 - protein, 41 aa, Staphylococcus
KVESEIESANHSNTKQTTASSYENQKQRRREQRKIEREIEQ

SEQ ID NO: 1961107 - protein, 12 aa, Staphylococcus
KVESEVNNKLYK

SEQ ID NO: 1961108 - protein, 6 aa, Staphylococcus
KVESGN

SEQ ID NO: 1961109 - protein, 6 aa, Staphylococcus
KVETED

SEQ ID NO: 1961110 - protein, 6 aa, Staphylococcus
KVETEE

SEQ ID NO: 1961111 - protein, 6 aa, Staphylococcus
KVETEI

SEQ ID NO: 1961112 - protein, 13 aa, Staphylococcus
KVETPNIKTAEEV

SEQ ID NO: 1961113 - protein, 12 aa, Staphylococcus
KVETPNVKTAQE

SEQ ID NO: 1961114 - protein, 17 aa, Staphylococcus
KVEYKKPKRNDETLDNG

SEQ ID NO: 1961115 - protein, 5 aa, Staphylococcus
KVFEQ

SEQ ID NO: 1961116 - protein, 24 aa, Staphylococcus
KVGAPTVEGASVTATVQKQGRGKK

SEQ ID NO: 1961117 - protein, 24 aa, Staphylococcus
KVGAPTVEGATVSATVNKQGRGKK

SEQ ID NO: 1961118 - protein, 5 aa, Staphylococcus
KVGDK

SEQ ID NO: 1961119 - protein, 14 aa, Staphylococcus
KVGDPNAENPLEQE

SEQ ID NO: 1961120 - protein, 11 aa, Staphylococcus
KVGDPREKGVQ

SEQ ID NO: 1961121 - protein, 8 aa, Staphylococcus
KVGDQGEV

SEQ ID NO: 1961122 - protein, 5 aa, Staphylococcus
KVGDR

SEQ ID NO: 1961123 - protein, 19 aa, Staphylococcus
KVGEETKLAANKDAEATLA

SEQ ID NO: 1961124 - protein, 15 aa, Staphylococcus
KVGEYSQKAMSKYEG

SEQ ID NO: 1961125 - protein, 14 aa, Staphylococcus
KVGEYSQKAMSQYE

SEQ ID NO: 1961126 - protein, 8 aa, Staphylococcus
KVGGNKFS

SEQ ID NO: 1961127 - protein, 7 aa, Staphylococcus
KVGKEDF

SEQ ID NO: 1961128 - protein, 4 aa, Staphylococcus
KVGN

SEQ ID NO: 1961129 - protein, 18 aa, Staphylococcus
KVGNAMSDSKREQRKDDH

SEQ ID NO: 1961130 - protein, 10 aa, Staphylococcus
KVGNQARELQ

SEQ ID NO: 1961131 - protein, 15 aa, Staphylococcus
KVGQYSEKAMQNYEG

SEQ ID NO: 1961132 - protein, 9 aa, Staphylococcus
KVGQYSQQA

SEQ ID NO: 1961133 - protein, 7 aa, Staphylococcus
KVGRTAG

SEQ ID NO: 1961134 - protein, 6 aa, Staphylococcus
KVGRTS

SEQ ID NO: 1961135 - protein, 4 aa, Staphylococcus
KVGS

SEQ ID NO: 1961136 - protein, 5 aa, Staphylococcus
KVHPN

SEQ ID NO: 1961137 - protein, 4 aa, Staphylococcus
KVIE

SEQ ID NO: 1961138 - protein, 5 aa, Staphylococcus
KVIEK

SEQ ID NO: 1961139 - protein, 5 aa, Staphylococcus
KVIEQ

SEQ ID NO: 1961140 - protein, 7 aa, Staphylococcus
KVINDSD

SEQ ID NO: 1961141 - protein, 12 aa, Staphylococcus
KVISSGLETARE

SEQ ID NO: 1961142 - protein, 15 aa, Staphylococcus
KVITSTHDLNEQDEI

SEQ ID NO: 1961143 - protein, 15 aa, Staphylococcus
KVITSTQDLSKDDEI

SEQ ID NO: 1961144 - protein, 8 aa, Staphylococcus
KVITTEPY

SEQ ID NO: 1961145 - protein, 10 aa, Staphylococcus
KVKANEDSKK

SEQ ID NO: 1961146 - protein, 18 aa, Staphylococcus
KVKANQRVKAATKEADDI

SEQ ID NO: 1961147 - protein, 13 aa, Staphylococcus
KVKDLNDGNGQSF

SEQ ID NO: 1961148 - protein, 10 aa, Staphylococcus
KVKDNEESKK

SEQ ID NO: 1961149 - protein, 7 aa, Staphylococcus
KVKDPRV

SEQ ID NO: 1961150 - protein, 6 aa, Staphylococcus
KVKDSI

SEQ ID NO: 1961151 - protein, 37 aa, Staphylococcus
KVKDTTSKGVDTAPPARVAPKPRSVKKATKLINKSKR

SEQ ID NO: 1961152 - protein, 7 aa, Staphylococcus
KVKENNI

SEQ ID NO: 1961153 - protein, 10 aa, Staphylococcus
KVKENQESKD

SEQ ID NO: 1961154 - protein, 5 aa, Staphylococcus
KVKEY

SEQ ID NO: 1961155 - protein, 8 aa, Staphylococcus
KVKGELNQ

SEQ ID NO: 1961156 - protein, 9 aa, Staphylococcus
KVKKEGTDL

SEQ ID NO: 1961157 - protein, 54 aa, Staphylococcus
KVKNEKDAAVHSQEFENAANLRDKQTKLEKQYEDAKNEWKNAQGGSNTTLSEND

SEQ ID NO: 1961158 - protein, 6 aa, Staphylococcus
KVKNIG

SEQ ID NO: 1961159 - protein, 10 aa, Staphylococcus
KVKNNRALPE

SEQ ID NO: 1961160 - protein, 8 aa, Staphylococcus
KVKNPYKY

SEQ ID NO: 1961161 - protein, 6 aa, Staphylococcus
KVKPEH

SEQ ID NO: 1961162 - protein, 12 aa, Staphylococcus
KVKPGAKLSNIG

SEQ ID NO: 1961163 - protein, 12 aa, Staphylococcus
KVKPGSKLSQIG

SEQ ID NO: 1961164 - protein, 5 aa, Staphylococcus
KVKPY

SEQ ID NO: 1961165 - protein, 15 aa, Staphylococcus
KVKQKLSEGKITERH

SEQ ID NO: 1961166 - protein, 5 aa, Staphylococcus
KVKQP

SEQ ID NO: 1961167 - protein, 16 aa, Staphylococcus
KVKRKDTDKNDKGKTL

SEQ ID NO: 1961168 - protein, 17 aa, Staphylococcus
KVKRQMSYEDKLKNLFL

SEQ ID NO: 1961169 - protein, 7 aa, Staphylococcus
KVKSGES

SEQ ID NO: 1961170 - protein, 17 aa, Staphylococcus
KVKSNSDFTETRFQPGE

SEQ ID NO: 1961171 - protein, 41 aa, Staphylococcus
KVKTEDAKQASDTFDQKQDAVKRANEIADNRGTKVIEHKKD

SEQ ID NO: 1961172 - protein, 15 aa, Staphylococcus
KVKTEDAKQASETFK

SEQ ID NO: 1961173 - protein, 43 aa, Staphylococcus
KVKTEGAKQASDTFEKKADATKRAQDIADNRGTKVIEHNKNET

SEQ ID NO: 1961174 - protein, 7 aa, Staphylococcus
KVKTKQN

SEQ ID NO: 1961175 - protein, 45 aa, Staphylococcus
KVKTNKKKVKPGYKKKFKRDLDDLKRKERKQFSKQKSRQDRKNRK

SEQ ID NO: 1961176 - protein, 31 aa, Staphylococcus
KVKTSGAKQATATYNTKKQAVERAQKIAENR

SEQ ID NO: 1961177 - protein, 9 aa, Staphylococcus
KVLGGSSSI

SEQ ID NO: 1961178 - protein, 11 aa, Staphylococcus
KVLSDGADELS

SEQ ID NO: 1961179 - protein, 14 aa, Staphylococcus
KVMNDGNSQIPKDV

SEQ ID NO: 1961180 - protein, 15 aa, Staphylococcus
KVNANSKKTKTKYHQ

SEQ ID NO: 1961181 - protein, 7 aa, Staphylococcus
KVNAPSV

SEQ ID NO: 1961182 - protein, 9 aa, Staphylococcus
KVNDANPEV

SEQ ID NO: 1961183 - protein, 19 aa, Staphylococcus
KVNDGSTPEEANDFKNQYS

SEQ ID NO: 1961184 - protein, 11 aa, Staphylococcus
KVNDKEDANTI

SEQ ID NO: 1961185 - protein, 12 aa, Staphylococcus
KVNDKNQIHTPT

SEQ ID NO: 1961186 - protein, 38 aa, Staphylococcus
KVNEEDEAETETEAIASDSENTDATEQMAQDSQQGEAV

SEQ ID NO: 1961187 - protein, 11 aa, Staphylococcus
KVNEETLDAAP

SEQ ID NO: 1961188 - protein, 8 aa, Staphylococcus
KVNEYQAQ

SEQ ID NO: 1961189 - protein, 13 aa, Staphylococcus
KVNGDFKNLNPKQ

SEQ ID NO: 1961190 - protein, 22 aa, Staphylococcus
KVNGETVTELGTKVKPSDNVEV

SEQ ID NO: 1961191 - protein, 5 aa, Staphylococcus
KVNGQ

SEQ ID NO: 1961192 - protein, 22 aa, Staphylococcus
KVNGQTVTELGTKVKSSDTVEV

SEQ ID NO: 1961193 - protein, 22 aa, Staphylococcus
KVNGTVETELGTKVKPSDSIEV

SEQ ID NO: 1961194 - protein, 10 aa, Staphylococcus
KVNKQAKEGK

SEQ ID NO: 1961195 - protein, 8 aa, Staphylococcus
KVNNDPRG

SEQ ID NO: 1961196 - protein, 8 aa, Staphylococcus
KVNPSSEI

SEQ ID NO: 1961197 - protein, 8 aa, Staphylococcus
KVNPYGGA

SEQ ID NO: 1961198 - protein, 8 aa, Staphylococcus
KVNRIQGD

SEQ ID NO: 1961199 - protein, 6 aa, Staphylococcus
KVNSDN

SEQ ID NO: 1961200 - protein, 10 aa, Staphylococcus
KVNSKGEKGK

SEQ ID NO: 1961201 - protein, 6 aa, Staphylococcus
KVNYSN

SEQ ID NO: 1961202 - protein, 9 aa, Staphylococcus
KVPDSDLKD

SEQ ID NO: 1961203 - protein, 10 aa, Staphylococcus
KVPDSDLKDE

SEQ ID NO: 1961204 - protein, 7 aa, Staphylococcus
KVPEEKI

SEQ ID NO: 1961205 - protein, 6 aa, Staphylococcus
KVPEQW

SEQ ID NO: 1961206 - protein, 13 aa, Staphylococcus
KVPKEKRKILSTS

SEQ ID NO: 1961207 - protein, 9 aa, Staphylococcus
KVPNGANQS

SEQ ID NO: 1961208 - protein, 7 aa, Staphylococcus
KVPQSSY

SEQ ID NO: 1961209 - protein, 9 aa, Staphylococcus
KVPSKNEII

SEQ ID NO: 1961210 - protein, 7 aa, Staphylococcus
KVPSTDV

SEQ ID NO: 1961211 - protein, 6 aa, Staphylococcus
KVPTLK

SEQ ID NO: 1961212 - protein, 6 aa, Staphylococcus
KVPTLN

SEQ ID NO: 1961213 - protein, 7 aa, Staphylococcus
KVPTNTY

SEQ ID NO: 1961214 - protein, 7 aa, Staphylococcus
KVQDGQQ

SEQ ID NO: 1961215 - protein, 5 aa, Staphylococcus
KVQEA

SEQ ID NO: 1961216 - protein, 11 aa, Staphylococcus
KVQEGKALGLS

SEQ ID NO: 1961217 - protein, 12 aa, Staphylococcus
KVQEGKANHRET

SEQ ID NO: 1961218 - protein, 9 aa, Staphylococcus
KVQEPDSGC

SEQ ID NO: 1961219 - protein, 12 aa, Staphylococcus
KVQGASDSPLTE

SEQ ID NO: 1961220 - protein, 13 aa, Staphylococcus
KVQGASDSPLTSL

SEQ ID NO: 1961221 - protein, 11 aa, Staphylococcus
KVQKGSRAYYQ

SEQ ID NO: 1961222 - protein, 61 aa, Staphylococcus
KVQNDSEDDEQSEAMTDDDNKLTNDSEEVIENSAPGDAIHTEAPEAEHEDNDNTSNDDRID

SEQ ID NO: 1961223 - protein, 4 aa, Staphylococcus
KVQP

SEQ ID NO: 1961224 - protein, 22 aa, Staphylococcus
KVQPTTTKQKPKTTAPAKPVGK

SEQ ID NO: 1961225 - protein, 7 aa, Staphylococcus
KVQRKAK

SEQ ID NO: 1961226 - protein, 13 aa, Staphylococcus
KVQRKYPEKLWVI

SEQ ID NO: 1961227 - protein, 5 aa, Staphylococcus
KVQSD

SEQ ID NO: 1961228 - protein, 25 aa, Staphylococcus
KVQVNGKNEKQSKAHINPDTDEITV

SEQ ID NO: 1961229 - protein, 12 aa, Staphylococcus
KVQYNGEEIDLE

SEQ ID NO: 1961230 - protein, 8 aa, Staphylococcus
KVQYNGTE

SEQ ID NO: 1961231 - protein, 9 aa, Staphylococcus
KVRDAQPEV

SEQ ID NO: 1961232 - protein, 7 aa, Staphylococcus
KVRDSKR

SEQ ID NO: 1961233 - protein, 8 aa, Staphylococcus
KVRDTQKL

SEQ ID NO: 1961234 - protein, 9 aa, Staphylococcus
KVREENGTI

SEQ ID NO: 1961235 - protein, 6 aa, Staphylococcus
KVREGS

SEQ ID NO: 1961236 - protein, 10 aa, Staphylococcus
KVRIDGSKNL

SEQ ID NO: 1961237 - protein, 8 aa, Staphylococcus
KVRPKQSL

SEQ ID NO: 1961238 - protein, 8 aa, Staphylococcus
KVRSEHGN

SEQ ID NO: 1961239 - protein, 23 aa, Staphylococcus
KVRSKSKNKVKPGYKKKFKQEVE

SEQ ID NO: 1961240 - protein, 46 aa, Staphylococcus
KVRSKSKRKVKPGYKKKFKQEVEKMKRQERKIYSKRQNKQKRKNNK

SEQ ID NO: 1961241 - protein, 17 aa, Staphylococcus
KVRSKTKNKVKPGYKKK

SEQ ID NO: 1961242 - protein, 7 aa, Staphylococcus
KVRTADG

SEQ ID NO: 1961243 - protein, 10 aa, Staphylococcus
KVRVEGSKNL

SEQ ID NO: 1961244 - protein, 4 aa, Staphylococcus
KVSD

SEQ ID NO: 1961245 - protein, 17 aa, Staphylococcus
KVSEDVKRTVQSMNKDG

SEQ ID NO: 1961246 - protein, 7 aa, Staphylococcus
KVSEPVN

SEQ ID NO: 1961247 - protein, 8 aa, Staphylococcus
KVSGFDPD

SEQ ID NO: 1961248 - protein, 15 aa, Staphylococcus
KVSGKKLAQESPAQA

SEQ ID NO: 1961249 - protein, 12 aa, Staphylococcus
KVSGKTYLENDN

SEQ ID NO: 1961250 - protein, 11 aa, Staphylococcus
KVSGREDDKEV

SEQ ID NO: 1961251 - protein, 12 aa, Staphylococcus
KVSGRKTKRTEL

SEQ ID NO: 1961252 - protein, 15 aa, Staphylococcus
KVSKDEMEQNYKEVT

SEQ ID NO: 1961253 - protein, 7 aa, Staphylococcus
KVSKDSN

SEQ ID NO: 1961254 - protein, 10 aa, Staphylococcus
KVSKEKKLSQ

SEQ ID NO: 1961255 - protein, 10 aa, Staphylococcus
KVSKKEYKSQ

SEQ ID NO: 1961256 - protein, 10 aa, Staphylococcus
KVSKKQREAF

SEQ ID NO: 1961257 - protein, 10 aa, Staphylococcus
KVSKSQREKF

SEQ ID NO: 1961258 - protein, 8 aa, Staphylococcus
KVSKVSEE

SEQ ID NO: 1961259 - protein, 10 aa, Staphylococcus
KVSNKKVGSL

SEQ ID NO: 1961260 - protein, 10 aa, Staphylococcus
KVSNNEKKRI

SEQ ID NO: 1961261 - protein, 9 aa, Staphylococcus
KVSNNGKDY

SEQ ID NO: 1961262 - protein, 8 aa, Staphylococcus
KVSNNQRH

SEQ ID NO: 1961263 - protein, 8 aa, Staphylococcus
KVSPQTSV

SEQ ID NO: 1961264 - protein, 9 aa, Staphylococcus
KVSPSEEGL

SEQ ID NO: 1961265 - protein, 4 aa, Staphylococcus
KVSQ

SEQ ID NO: 1961266 - protein, 9 aa, Staphylococcus
KVSSEKDVA

SEQ ID NO: 1961267 - protein, 9 aa, Staphylococcus
KVSSTKSMT

SEQ ID NO: 1961268 - protein, 10 aa, Staphylococcus
KVSSTKSMTG

SEQ ID NO: 1961269 - protein, 10 aa, Staphylococcus
KVSTASGLTI

SEQ ID NO: 1961270 - protein, 16 aa, Staphylococcus
KVSTNAEMRGTQEGLE

SEQ ID NO: 1961271 - protein, 4 aa, Staphylococcus
KVSY

SEQ ID NO: 1961272 - protein, 9 aa, Staphylococcus
KVSYNDEEI

SEQ ID NO: 1961273 - protein, 14 aa, Staphylococcus
KVSYYKGEAKINSD

SEQ ID NO: 1961274 - protein, 12 aa, Staphylococcus
KVTAGEAGGITQ

SEQ ID NO: 1961275 - protein, 11 aa, Staphylococcus
KVTAPDTPVPF

SEQ ID NO: 1961276 - protein, 26 aa, Staphylococcus
KVTAQASEKQNLEKEIETFKKEKQSY

SEQ ID NO: 1961277 - protein, 6 aa, Staphylococcus
KVTDGQ

SEQ ID NO: 1961278 - protein, 4 aa, Staphylococcus
KVTE

SEQ ID NO: 1961279 - protein, 5 aa, Staphylococcus
KVTED

SEQ ID NO: 1961280 - protein, 7 aa, Staphylococcus
KVTEDYN

SEQ ID NO: 1961281 - protein, 16 aa, Staphylococcus
KVTESNQEIMQTKSER

SEQ ID NO: 1961282 - protein, 18 aa, Staphylococcus
KVTGEDTSDWARNTSQEL

SEQ ID NO: 1961283 - protein, 10 aa, Staphylococcus
KVTGHTSGMA

SEQ ID NO: 1961284 - protein, 4 aa, Staphylococcus
KVTK

SEQ ID NO: 1961285 - protein, 11 aa, Staphylococcus
KVTKQSSIYET

SEQ ID NO: 1961286 - protein, 21 aa, Staphylococcus
KVTKVYGDQDSVSFAPGEKAT

SEQ ID NO: 1961287 - protein, 18 aa, Staphylococcus
KVTLDNDSNGIPAALKEL

SEQ ID NO: 1961288 - protein, 6 aa, Staphylococcus
KVTMPQ

SEQ ID NO: 1961289 - protein, 8 aa, Staphylococcus
KVTNDQQF

SEQ ID NO: 1961290 - protein, 9 aa, Staphylococcus
KVTNEQSEI

SEQ ID NO: 1961291 - protein, 7 aa, Staphylococcus
KVTNKEE

SEQ ID NO: 1961292 - protein, 10 aa, Staphylococcus
KVTNPATNEV

SEQ ID NO: 1961293 - protein, 10 aa, Staphylococcus
KVTNSVNKST

SEQ ID NO: 1961294 - protein, 4 aa, Staphylococcus
KVTP

SEQ ID NO: 1961295 - protein, 11 aa, Staphylococcus
KVTPAHDPNDF

SEQ ID NO: 1961296 - protein, 6 aa, Staphylococcus
KVTPYV

SEQ ID NO: 1961297 - protein, 5 aa, Staphylococcus
KVTQG

SEQ ID NO: 1961298 - protein, 15 aa, Staphylococcus
KVTQLSNGSPMSAKI

SEQ ID NO: 1961299 - protein, 6 aa, Staphylococcus
KVTRAS

SEQ ID NO: 1961300 - protein, 8 aa, Staphylococcus
KVTREGDD

SEQ ID NO: 1961301 - protein, 7 aa, Staphylococcus
KVTRKNK

SEQ ID NO: 1961302 - protein, 13 aa, Staphylococcus
KVTRLPEVFQTIL

SEQ ID NO: 1961303 - protein, 7 aa, Staphylococcus
KVTRPRG

SEQ ID NO: 1961304 - protein, 7 aa, Staphylococcus
KVTRQAS

SEQ ID NO: 1961305 - protein, 8 aa, Staphylococcus
KVTSKANR

SEQ ID NO: 1961306 - protein, 13 aa, Staphylococcus
KVTSNDKGTNIDA

SEQ ID NO: 1961307 - protein, 10 aa, Staphylococcus
KVTSSVTKST

SEQ ID NO: 1961308 - protein, 6 aa, Staphylococcus
KVTTEE

SEQ ID NO: 1961309 - protein, 8 aa, Staphylococcus
KVTTPQDV

SEQ ID NO: 1961310 - protein, 6 aa, Staphylococcus
KVTTSL

SEQ ID NO: 1961311 - protein, 19 aa, Staphylococcus
KVTVNDGKDLSQDAHAKDL

SEQ ID NO: 1961312 - protein, 12 aa, Staphylococcus
KVTVNKNRQKVT

SEQ ID NO: 1961313 - protein, 19 aa, Staphylococcus
KVTVNTSVEKSPKSHINPT

SEQ ID NO: 1961314 - protein, 8 aa, Staphylococcus
KVTYGEET

SEQ ID NO: 1961315 - protein, 6 aa, Staphylococcus
KVVDDY

SEQ ID NO: 1961316 - protein, 9 aa, Staphylococcus
KVVDTGALD

SEQ ID NO: 1961317 - protein, 6 aa, Staphylococcus
KVVENN

SEQ ID NO: 1961318 - protein, 4 aa, Staphylococcus
KVVS

SEQ ID NO: 1961319 - protein, 4 aa, Staphylococcus
KVYE

SEQ ID NO: 1961320 - protein, 43 aa, Staphylococcus
KVYEQAAQAQQQAQGEDANASQDSNVEDADFKEVKDDDNQDNQ

SEQ ID NO: 1961321 - protein, 14 aa, Staphylococcus
KVYGKAKVGAPPMS

SEQ ID NO: 1961322 - protein, 14 aa, Staphylococcus
KVYGKEPQGTPPMT

SEQ ID NO: 1961323 - protein, 13 aa, Staphylococcus
KVYGNEEKVGAGI

SEQ ID NO: 1961324 - protein, 23 aa, Staphylococcus
KVYGNEEKVGQGIKEGLESAGLK

SEQ ID NO: 1961325 - protein, 10 aa, Staphylococcus
KVYGNEEQVG

SEQ ID NO: 1961326 - protein, 24 aa, Staphylococcus
KVYGNEEQVGQGIKEGLESTGLNR

SEQ ID NO: 1961327 - protein, 8 aa, Staphylococcus
KVYHNNEP

SEQ ID NO: 1961328 - protein, 8 aa, Staphylococcus
KVYKEGKP

SEQ ID NO: 1961329 - protein, 8 aa, Staphylococcus
KVYTNPIA

SEQ ID NO: 1961330 - protein, 5 aa, Staphylococcus
KWARP

SEQ ID NO: 1961331 - protein, 10 aa, Staphylococcus
KWDEKPKKNK

SEQ ID NO: 1961332 - protein, 14 aa, Staphylococcus
KWDEKRKNSTYGEQ

SEQ ID NO: 1961333 - protein, 5 aa, Staphylococcus
KWDKA

SEQ ID NO: 1961334 - protein, 6 aa, Staphylococcus
KWDQET

SEQ ID NO: 1961335 - protein, 7 aa, Staphylococcus
KWDQNTA

SEQ ID NO: 1961336 - protein, 6 aa, Staphylococcus
KWDQTT

SEQ ID NO: 1961337 - protein, 7 aa, Staphylococcus
KWDQTTA

SEQ ID NO: 1961338 - protein, 7 aa, Staphylococcus
KWEPQDS

SEQ ID NO: 1961339 - protein, 15 aa, Staphylococcus
KWERPDYVFPGNVVD

SEQ ID NO: 1961340 - protein, 15 aa, Staphylococcus
KWERQDYVFPGNKGD

SEQ ID NO: 1961341 - protein, 6 aa, Staphylococcus
KWGERS

SEQ ID NO: 1961342 - protein, 14 aa, Staphylococcus
KWKQQDFKKAADYY

SEQ ID NO: 1961343 - protein, 9 aa, Staphylococcus
KWNDENIGP

SEQ ID NO: 1961344 - protein, 5 aa, Staphylococcus
KWNEH

SEQ ID NO: 1961345 - protein, 11 aa, Staphylococcus
KWNRAKQEING

SEQ ID NO: 1961346 - protein, 8 aa, Staphylococcus
KWQGIPDE

SEQ ID NO: 1961347 - protein, 8 aa, Staphylococcus
KWSAEDEY

SEQ ID NO: 1961348 - protein, 8 aa, Staphylococcus
KWSSEDAY

SEQ ID NO: 1961349 - protein, 10 aa, Staphylococcus
KYADDFSPID

SEQ ID NO: 1961350 - protein, 19 aa, Staphylococcus
KYADDSDLPDVESLYKDVF

SEQ ID NO: 1961351 - protein, 19 aa, Staphylococcus
KYADESELPDVDSLHEDVF

SEQ ID NO: 1961352 - protein, 10 aa, Staphylococcus
KYAEDLGPLD

SEQ ID NO: 1961353 - protein, 11 aa, Staphylococcus
KYAEGYPGRRY

SEQ ID NO: 1961354 - protein, 11 aa, Staphylococcus
KYAEGYPNRRY

SEQ ID NO: 1961355 - protein, 7 aa, Staphylococcus
KYAENET

SEQ ID NO: 1961356 - protein, 21 aa, Staphylococcus
KYAEQSVKNVKQNFNTNRATP

SEQ ID NO: 1961357 - protein, 20 aa, Staphylococcus
KYAESQNIEEEDESADYSEY

SEQ ID NO: 1961358 - protein, 8 aa, Staphylococcus
KYAKDESK

SEQ ID NO: 1961359 - protein, 16 aa, Staphylococcus
KYAKELRDNESQKEAF

SEQ ID NO: 1961360 - protein, 10 aa, Staphylococcus
KYANDFKPLD

SEQ ID NO: 1961361 - protein, 6 aa, Staphylococcus
KYAPNA

SEQ ID NO: 1961362 - protein, 8 aa, Staphylococcus
KYAPSESE

SEQ ID NO: 1961363 - protein, 6 aa, Staphylococcus
KYAPSL

SEQ ID NO: 1961364 - protein, 8 aa, Staphylococcus
KYAPSQSK

SEQ ID NO: 1961365 - protein, 6 aa, Staphylococcus
KYAQGK

SEQ ID NO: 1961366 - protein, 7 aa, Staphylococcus
KYARGIN

SEQ ID NO: 1961367 - protein, 6 aa, Staphylococcus
KYARNF

SEQ ID NO: 1961368 - protein, 10 aa, Staphylococcus
KYASDSSKKA

SEQ ID NO: 1961369 - protein, 12 aa, Staphylococcus
KYASEINKKEGN

SEQ ID NO: 1961370 - protein, 5 aa, Staphylococcus
KYDAE

SEQ ID NO: 1961371 - protein, 5 aa, Staphylococcus
KYDDL

SEQ ID NO: 1961372 - protein, 8 aa, Staphylococcus
KYDEEISE

SEQ ID NO: 1961373 - protein, 8 aa, Staphylococcus
KYDEKTDE

SEQ ID NO: 1961374 - protein, 9 aa, Staphylococcus
KYDENLKRR

SEQ ID NO: 1961375 - protein, 18 aa, Staphylococcus
KYDKAETPVTETEEAEII

SEQ ID NO: 1961376 - protein, 6 aa, Staphylococcus
KYDKAG

SEQ ID NO: 1961377 - protein, 21 aa, Staphylococcus
KYDKIKSKLEESGIEHGTEEI

SEQ ID NO: 1961378 - protein, 21 aa, Staphylococcus
KYDKIKSKLEESGITDGTEEI

SEQ ID NO: 1961379 - protein, 19 aa, Staphylococcus
KYDKTTVPVAEQTEEQLTD

SEQ ID NO: 1961380 - protein, 10 aa, Staphylococcus
KYDNENDKSV

SEQ ID NO: 1961381 - protein, 9 aa, Staphylococcus
KYDNKIEKQ

SEQ ID NO: 1961382 - protein, 7 aa, Staphylococcus
KYDNNTI

SEQ ID NO: 1961383 - protein, 4 aa, Staphylococcus
KYDP

SEQ ID NO: 1961384 - protein, 6 aa, Staphylococcus
KYDPDD

SEQ ID NO: 1961385 - protein, 4 aa, Staphylococcus
KYDS

SEQ ID NO: 1961386 - protein, 38 aa, Staphylococcus
KYDSDKDSQRETLKAYDQTVSDYYSSRTNGERTESWSN

SEQ ID NO: 1961387 - protein, 6 aa, Staphylococcus
KYDSTE

SEQ ID NO: 1961388 - protein, 4 aa, Staphylococcus
KYED

SEQ ID NO: 1961389 - protein, 8 aa, Staphylococcus
KYEDADQQ

SEQ ID NO: 1961390 - protein, 7 aa, Staphylococcus
KYEDANF

SEQ ID NO: 1961391 - protein, 5 aa, Staphylococcus
KYEED

SEQ ID NO: 1961392 - protein, 10 aa, Staphylococcus
KYEEGPGEHD

SEQ ID NO: 1961393 - protein, 6 aa, Staphylococcus
KYEEQQ

SEQ ID NO: 1961394 - protein, 16 aa, Staphylococcus
KYEESGVDKLASPLAG

SEQ ID NO: 1961395 - protein, 14 aa, Staphylococcus
KYEESNVASLTSPL

SEQ ID NO: 1961396 - protein, 15 aa, Staphylococcus
KYEESNVDKLKSPLA

SEQ ID NO: 1961397 - protein, 16 aa, Staphylococcus
KYEESNVDKLKSPLAN

SEQ ID NO: 1961398 - protein, 17 aa, Staphylococcus
KYEESNVDKLKSPLANN

SEQ ID NO: 1961399 - protein, 10 aa, Staphylococcus
KYEESNVDQF

SEQ ID NO: 1961400 - protein, 5 aa, Staphylococcus
KYEHN

SEQ ID NO: 1961401 - protein, 13 aa, Staphylococcus
KYEINSEKVQSLS

SEQ ID NO: 1961402 - protein, 8 aa, Staphylococcus
KYEKDKQT

SEQ ID NO: 1961403 - protein, 10 aa, Staphylococcus
KYEKSGIPIP

SEQ ID NO: 1961404 - protein, 10 aa, Staphylococcus
KYELSELNQS

SEQ ID NO: 1961405 - protein, 8 aa, Staphylococcus
KYELSSKQ

SEQ ID NO: 1961406 - protein, 7 aa, Staphylococcus
KYENGAH

SEQ ID NO: 1961407 - protein, 8 aa, Staphylococcus
KYENSEEA

SEQ ID NO: 1961408 - protein, 5 aa, Staphylococcus
KYEPL

SEQ ID NO: 1961409 - protein, 7 aa, Staphylococcus
KYERTQH

SEQ ID NO: 1961410 - protein, 8 aa, Staphylococcus
KYETDYRK

SEQ ID NO: 1961411 - protein, 8 aa, Staphylococcus
KYETSISN

SEQ ID NO: 1961412 - protein, 6 aa, Staphylococcus
KYETTD

SEQ ID NO: 1961413 - protein, 9 aa, Staphylococcus
KYEYKTTQR

SEQ ID NO: 1961414 - protein, 8 aa, Staphylococcus
KYFAKSGR

SEQ ID NO: 1961415 - protein, 5 aa, Staphylococcus
KYGDA

SEQ ID NO: 1961416 - protein, 5 aa, Staphylococcus
KYGDE

SEQ ID NO: 1961417 - protein, 8 aa, Staphylococcus
KYGDGAAD

SEQ ID NO: 1961418 - protein, 4 aa, Staphylococcus
KYGE

SEQ ID NO: 1961419 - protein, 21 aa, Staphylococcus
KYGEEVSEDDFGYGSTDTGNV

SEQ ID NO: 1961420 - protein, 15 aa, Staphylococcus
KYGEQLGLPKGDTPI

SEQ ID NO: 1961421 - protein, 8 aa, Staphylococcus
KYGESDQL

SEQ ID NO: 1961422 - protein, 5 aa, Staphylococcus
KYGET

SEQ ID NO: 1961423 - protein, 6 aa, Staphylococcus
KYGETH

SEQ ID NO: 1961424 - protein, 12 aa, Staphylococcus
KYGFTTPDEQEA

SEQ ID NO: 1961425 - protein, 6 aa, Staphylococcus
KYGGEV

SEQ ID NO: 1961426 - protein, 21 aa, Staphylococcus
KYGGTSISDYRHADGSTGTMQ

SEQ ID NO: 1961427 - protein, 9 aa, Staphylococcus
KYGITPKTI

SEQ ID NO: 1961428 - protein, 6 aa, Staphylococcus
KYGKGI

SEQ ID NO: 1961429 - protein, 6 aa, Staphylococcus
KYGKHR

SEQ ID NO: 1961430 - protein, 11 aa, Staphylococcus
KYGKKATETDI

SEQ ID NO: 1961431 - protein, 17 aa, Staphylococcus
KYGKKLKKEATQPSGMP

SEQ ID NO: 1961432 - protein, 5 aa, Staphylococcus
KYGKQ

SEQ ID NO: 1961433 - protein, 12 aa, Staphylococcus
KYGKSYLTEMGV

SEQ ID NO: 1961434 - protein, 7 aa, Staphylococcus
KYGNNPV

SEQ ID NO: 1961435 - protein, 5 aa, Staphylococcus
KYGPG

SEQ ID NO: 1961436 - protein, 5 aa, Staphylococcus
KYGQD

SEQ ID NO: 1961437 - protein, 19 aa, Staphylococcus
KYGSQNETHYPVATSSRRG

SEQ ID NO: 1961438 - protein, 6 aa, Staphylococcus
KYGSQQ

SEQ ID NO: 1961439 - protein, 15 aa, Staphylococcus
KYGTPLPVKEAADDE

SEQ ID NO: 1961440 - protein, 10 aa, Staphylococcus
KYGVSTEQSN

SEQ ID NO: 1961441 - protein, 5 aa, Staphylococcus
KYHNR

SEQ ID NO: 1961442 - protein, 6 aa, Staphylococcus
KYHTNL

SEQ ID NO: 1961443 - protein, 4 aa, Staphylococcus
KYHY

SEQ ID NO: 1961444 - protein, 9 aa, Staphylococcus
KYIDEQRKR

SEQ ID NO: 1961445 - protein, 7 aa, Staphylococcus
KYIDETS

SEQ ID NO: 1961446 - protein, 12 aa, Staphylococcus
KYIETRDTDRHG

SEQ ID NO: 1961447 - protein, 6 aa, Staphylococcus
KYKDEA

SEQ ID NO: 1961448 - protein, 9 aa, Staphylococcus
KYKDNKNEI

SEQ ID NO: 1961449 - protein, 8 aa, Staphylococcus
KYKEQETA

SEQ ID NO: 1961450 - protein, 23 aa, Staphylococcus
KYKGKDAIGQAFNSGDKETGSTV

SEQ ID NO: 1961451 - protein, 22 aa, Staphylococcus
KYKGKDAIGQAFNSGDKVTGST

SEQ ID NO: 1961452 - protein, 8 aa, Staphylococcus
KYKNEYSL

SEQ ID NO: 1961453 - protein, 10 aa, Staphylococcus
KYKNNDFTKR

SEQ ID NO: 1961454 - protein, 6 aa, Staphylococcus
KYKNNK

SEQ ID NO: 1961455 - protein, 11 aa, Staphylococcus
KYKTPNQQQSD

SEQ ID NO: 1961456 - protein, 4 aa, Staphylococcus
KYKV

SEQ ID NO: 1961457 - protein, 4 aa, Staphylococcus
KYLN

SEQ ID NO: 1961458 - protein, 12 aa, Staphylococcus
KYLPGDKLPSNL

SEQ ID NO: 1961459 - protein, 5 aa, Staphylococcus
KYLPK

SEQ ID NO: 1961460 - protein, 17 aa, Staphylococcus
KYLSEEVKTVDEAIQGA

SEQ ID NO: 1961461 - protein, 5 aa, Staphylococcus
KYLTD

SEQ ID NO: 1961462 - protein, 11 aa, Staphylococcus
KYNAQKSSSFQ

SEQ ID NO: 1961463 - protein, 5 aa, Staphylococcus
KYNDS

SEQ ID NO: 1961464 - protein, 9 aa, Staphylococcus
KYNDTKEKS

SEQ ID NO: 1961465 - protein, 21 aa, Staphylococcus
KYNEKEAKENWKKAKKELGKK

SEQ ID NO: 1961466 - protein, 10 aa, Staphylococcus
KYNENNHALS

SEQ ID NO: 1961467 - protein, 10 aa, Staphylococcus
KYNESQHALS

SEQ ID NO: 1961468 - protein, 6 aa, Staphylococcus
KYNGDT

SEQ ID NO: 1961469 - protein, 5 aa, Staphylococcus
KYNKK

SEQ ID NO: 1961470 - protein, 7 aa, Staphylococcus
KYNKLAK

SEQ ID NO: 1961471 - protein, 4 aa, Staphylococcus
KYNN

SEQ ID NO: 1961472 - protein, 13 aa, Staphylococcus
KYNNTQKLIESSK

SEQ ID NO: 1961473 - protein, 6 aa, Staphylococcus
KYNSEP

SEQ ID NO: 1961474 - protein, 13 aa, Staphylococcus
KYNVEKNEDVKAE

SEQ ID NO: 1961475 - protein, 5 aa, Staphylococcus
KYPDA

SEQ ID NO: 1961476 - protein, 6 aa, Staphylococcus
KYPDID

SEQ ID NO: 1961477 - protein, 6 aa, Staphylococcus
KYPDKQ

SEQ ID NO: 1961478 - protein, 8 aa, Staphylococcus
KYPDMNRP

SEQ ID NO: 1961479 - protein, 9 aa, Staphylococcus
KYPDMNRPT

SEQ ID NO: 1961480 - protein, 5 aa, Staphylococcus
KYPEL

SEQ ID NO: 1961481 - protein, 7 aa, Staphylococcus
KYPENTR

SEQ ID NO: 1961482 - protein, 15 aa, Staphylococcus
KYPFDSSNPEDVKAA

SEQ ID NO: 1961483 - protein, 6 aa, Staphylococcus
KYPGVT

SEQ ID NO: 1961484 - protein, 6 aa, Staphylococcus
KYPHIS

SEQ ID NO: 1961485 - protein, 5 aa, Staphylococcus
KYPHM

SEQ ID NO: 1961486 - protein, 6 aa, Staphylococcus
KYPHNQ

SEQ ID NO: 1961487 - protein, 14 aa, Staphylococcus
KYPIQLSGGQSQRV

SEQ ID NO: 1961488 - protein, 8 aa, Staphylococcus
KYPKEKDF

SEQ ID NO: 1961489 - protein, 13 aa, Staphylococcus
KYPKPDKGSTEEI

SEQ ID NO: 1961490 - protein, 5 aa, Staphylococcus
KYPNK

SEQ ID NO: 1961491 - protein, 6 aa, Staphylococcus
KYPNKV

SEQ ID NO: 1961492 - protein, 10 aa, Staphylococcus
KYPNPQETKI

SEQ ID NO: 1961493 - protein, 12 aa, Staphylococcus
KYPNTKKEDNDR

SEQ ID NO: 1961494 - protein, 9 aa, Staphylococcus
KYPNTKKEF

SEQ ID NO: 1961495 - protein, 17 aa, Staphylococcus
KYPSDISGGQRQRTSAA

SEQ ID NO: 1961496 - protein, 17 aa, Staphylococcus
KYPSEISGGQQQRTAAA

SEQ ID NO: 1961497 - protein, 6 aa, Staphylococcus
KYPSYR

SEQ ID NO: 1961498 - protein, 8 aa, Staphylococcus
KYPTKRVT

SEQ ID NO: 1961499 - protein, 9 aa, Staphylococcus
KYPTTQIEA

SEQ ID NO: 1961500 - protein, 8 aa, Staphylococcus
KYPVTKDN

SEQ ID NO: 1961501 - protein, 5 aa, Staphylococcus
KYQDK

SEQ ID NO: 1961502 - protein, 5 aa, Staphylococcus
KYQDT

SEQ ID NO: 1961503 - protein, 25 aa, Staphylococcus
KYQEAASKKSDLERTDLAKDKSGVF

SEQ ID NO: 1961504 - protein, 25 aa, Staphylococcus
KYQEDSSKKSDLERTDLAKDKSGVF

SEQ ID NO: 1961505 - protein, 13 aa, Staphylococcus
KYQHTTAATYNQH

SEQ ID NO: 1961506 - protein, 21 aa, Staphylococcus
KYQKENNTNENLEKIFFDITK

SEQ ID NO: 1961507 - protein, 11 aa, Staphylococcus
KYQLNNNDYNV

SEQ ID NO: 1961508 - protein, 9 aa, Staphylococcus
KYQNDDNHI

SEQ ID NO: 1961509 - protein, 7 aa, Staphylococcus
KYQNKPI

SEQ ID NO: 1961510 - protein, 7 aa, Staphylococcus
KYQNTTA

SEQ ID NO: 1961511 - protein, 9 aa, Staphylococcus
KYQNTTAAT

SEQ ID NO: 1961512 - protein, 5 aa, Staphylococcus
KYQPD

SEQ ID NO: 1961513 - protein, 16 aa, Staphylococcus
KYQPDNYHGKAENNQF

SEQ ID NO: 1961514 - protein, 8 aa, Staphylococcus
KYQSDSAF

SEQ ID NO: 1961515 - protein, 4 aa, Staphylococcus
KYRD

SEQ ID NO: 1961516 - protein, 6 aa, Staphylococcus
KYRDGK

SEQ ID NO: 1961517 - protein, 6 aa, Staphylococcus
KYRDQE

SEQ ID NO: 1961518 - protein, 6 aa, Staphylococcus
KYRDSV

SEQ ID NO: 1961519 - protein, 22 aa, Staphylococcus
KYRKSSISKLDAKAKVKMPTEY

SEQ ID NO: 1961520 - protein, 8 aa, Staphylococcus
KYRNDENI

SEQ ID NO: 1961521 - protein, 6 aa, Staphylococcus
KYRPHS

SEQ ID NO: 1961522 - protein, 4 aa, Staphylococcus
KYRQ

SEQ ID NO: 1961523 - protein, 12 aa, Staphylococcus
KYRVPTHDADMN

SEQ ID NO: 1961524 - protein, 8 aa, Staphylococcus
KYSDKSMP

SEQ ID NO: 1961525 - protein, 7 aa, Staphylococcus
KYSDSKL

SEQ ID NO: 1961526 - protein, 17 aa, Staphylococcus
KYSEASIPATEKKFDDF

SEQ ID NO: 1961527 - protein, 7 aa, Staphylococcus
KYSEDNR

SEQ ID NO: 1961528 - protein, 9 aa, Staphylococcus
KYSEEYPEL

SEQ ID NO: 1961529 - protein, 18 aa, Staphylococcus
KYSEYKGGRQSTPPELSE

SEQ ID NO: 1961530 - protein, 9 aa, Staphylococcus
KYSGKDSDY

SEQ ID NO: 1961531 - protein, 17 aa, Staphylococcus
KYSKKYKTHDENNSAKL

SEQ ID NO: 1961532 - protein, 20 aa, Staphylococcus
KYSKKYKTHDENNSAKLGDT

SEQ ID NO: 1961533 - protein, 6 aa, Staphylococcus
KYSNDT

SEQ ID NO: 1961534 - protein, 9 aa, Staphylococcus
KYSNEETQQ

SEQ ID NO: 1961535 - protein, 9 aa, Staphylococcus
KYSPYPEEM

SEQ ID NO: 1961536 - protein, 17 aa, Staphylococcus
KYSQRRQKLEEKERHRQ

SEQ ID NO: 1961537 - protein, 7 aa, Staphylococcus
KYSQSIA

SEQ ID NO: 1961538 - protein, 8 aa, Staphylococcus
KYSRETME

SEQ ID NO: 1961539 - protein, 9 aa, Staphylococcus
KYTDDGSVG

SEQ ID NO: 1961540 - protein, 5 aa, Staphylococcus
KYTDE

SEQ ID NO: 1961541 - protein, 8 aa, Staphylococcus
KYTEDGSV

SEQ ID NO: 1961542 - protein, 4 aa, Staphylococcus
KYTF

SEQ ID NO: 1961543 - protein, 8 aa, Staphylococcus
KYTGEQYT

SEQ ID NO: 1961544 - protein, 14 aa, Staphylococcus
KYTGKEKEKPKTIE

SEQ ID NO: 1961545 - protein, 28 aa, Staphylococcus
KYTKEELEQPERKGKTSKKIQNDEEENI

SEQ ID NO: 1961546 - protein, 6 aa, Staphylococcus
KYTKKP

SEQ ID NO: 1961547 - protein, 13 aa, Staphylococcus
KYTKTTDNNVQMT

SEQ ID NO: 1961548 - protein, 5 aa, Staphylococcus
KYTQP

SEQ ID NO: 1961549 - protein, 11 aa, Staphylococcus
KYTSEGPQGLL

SEQ ID NO: 1961550 - protein, 5 aa, Staphylococcus
KYTTA

SEQ ID NO: 1961551 - protein, 7 aa, Staphylococcus
KYTTSED

SEQ ID NO: 1961552 - protein, 10 aa, Staphylococcus
KYTYDKEKEA

SEQ ID NO: 1961553 - protein, 24 aa, Staphylococcus
KYTYDKEKEAQHVYGTTDNAHPGV

SEQ ID NO: 1961554 - protein, 13 aa, Staphylococcus
KYTYPEDKDKIEY

SEQ ID NO: 1961555 - protein, 8 aa, Staphylococcus
KYVKTRNG

SEQ ID NO: 1961556 - protein, 16 aa, Staphylococcus
KYVSSEQVKEEEINHE

SEQ ID NO: 1961557 - protein, 6 aa, Staphylococcus
KYVSST

SEQ ID NO: 1961558 - protein, 10 aa, Staphylococcus
KYWKDKNDEI

SEQ ID NO: 1961559 - protein, 7 aa, Staphylococcus
KYYDENP

SEQ ID NO: 1961560 - protein, 7 aa, Staphylococcus
KYYKPRK

SEQ ID NO: 1961561 - protein, 8 aa, Staphylococcus
KYYNEQKE

SEQ ID NO: 1961562 - protein, 10 aa, Staphylococcus
KYYNQSENIN

SEQ ID NO: 1961563 - protein, 12 aa, Staphylococcus
KYYPNEKHTDIK

SEQ ID NO: 1961564 - protein, 17 aa, Staphylococcus
KYYQDRTNGVRNETWSQ

SEQ ID NO: 1961565 - protein, 12 aa, Staphylococcus
KYYQNDKDATNA

SEQ ID NO: 1961566 - protein, 5 aa, Staphylococcus
LAADD

SEQ ID NO: 1961567 - protein, 10 aa, Staphylococcus
LAAEGEDTYD

SEQ ID NO: 1961568 - protein, 6 aa, Staphylococcus
LAAEKN

SEQ ID NO: 1961569 - protein, 20 aa, Staphylococcus
LAAETDEEKDSDAEEDKNTE

SEQ ID NO: 1961570 - protein, 11 aa, Staphylococcus
LAAGSYTKITG

SEQ ID NO: 1961571 - protein, 15 aa, Staphylococcus
LAAKGAADKYTRKDM

SEQ ID NO: 1961572 - protein, 6 aa, Staphylococcus
LAANSG

SEQ ID NO: 1961573 - protein, 7 aa, Staphylococcus
LAAPADI

SEQ ID NO: 1961574 - protein, 8 aa, Staphylococcus
LAAPGPLA

SEQ ID NO: 1961575 - protein, 6 aa, Staphylococcus
LAASTK

SEQ ID NO: 1961576 - protein, 5 aa, Staphylococcus
LADGK

SEQ ID NO: 1961577 - protein, 20 aa, Staphylococcus
LADKADAYPSQLSGGQKQRV

SEQ ID NO: 1961578 - protein, 14 aa, Staphylococcus
LADKDKEATTQSDQ

SEQ ID NO: 1961579 - protein, 12 aa, Staphylococcus
LADKIRSGEHID

SEQ ID NO: 1961580 - protein, 12 aa, Staphylococcus
LADKIRSGEKID

SEQ ID NO: 1961581 - protein, 9 aa, Staphylococcus
LADKSEADM

SEQ ID NO: 1961582 - protein, 7 aa, Staphylococcus
LADKTDA

SEQ ID NO: 1961583 - protein, 17 aa, Staphylococcus
LADNPQYTTRVKDGKHP

SEQ ID NO: 1961584 - protein, 14 aa, Staphylococcus
LADPITGSISQDDA

SEQ ID NO: 1961585 - protein, 15 aa, Staphylococcus
LADPLTGAISDDDTK

SEQ ID NO: 1961586 - protein, 5 aa, Staphylococcus
LADRR

SEQ ID NO: 1961587 - protein, 13 aa, Staphylococcus
LADSTKGGAYEAT

SEQ ID NO: 1961588 - protein, 6 aa, Staphylococcus
LADTED

SEQ ID NO: 1961589 - protein, 6 aa, Staphylococcus
LADTGV

SEQ ID NO: 1961590 - protein, 5 aa, Staphylococcus
LADTT

SEQ ID NO: 1961591 - protein, 5 aa, Staphylococcus
LADYD

SEQ ID NO: 1961592 - protein, 16 aa, Staphylococcus
LAEAQKRIEEATEATD

SEQ ID NO: 1961593 - protein, 5 aa, Staphylococcus
LAEDI

SEQ ID NO: 1961594 - protein, 10 aa, Staphylococcus
LAEDRGIHEG

SEQ ID NO: 1961595 - protein, 6 aa, Staphylococcus
LAEEDI

SEQ ID NO: 1961596 - protein, 6 aa, Staphylococcus
LAEETN

SEQ ID NO: 1961597 - protein, 5 aa, Staphylococcus
LAEGI

SEQ ID NO: 1961598 - protein, 7 aa, Staphylococcus
LAEGNRS

SEQ ID NO: 1961599 - protein, 5 aa, Staphylococcus
LAEGQ

SEQ ID NO: 1961600 - protein, 8 aa, Staphylococcus
LAEGQLDA

SEQ ID NO: 1961601 - protein, 9 aa, Staphylococcus
LAEKAGATF

SEQ ID NO: 1961602 - protein, 5 aa, Staphylococcus
LAEKG

SEQ ID NO: 1961603 - protein, 6 aa, Staphylococcus
LAEKGK

SEQ ID NO: 1961604 - protein, 7 aa, Staphylococcus
LAEKGTQ

SEQ ID NO: 1961605 - protein, 11 aa, Staphylococcus
LAEKNKKANQI

SEQ ID NO: 1961606 - protein, 17 aa, Staphylococcus
LAEKQPELKDLSEDERI

SEQ ID NO: 1961607 - protein, 16 aa, Staphylococcus
LAEKRPELKDLPEDER

SEQ ID NO: 1961608 - protein, 12 aa, Staphylococcus
LAEKYSEEGQLK

SEQ ID NO: 1961609 - protein, 9 aa, Staphylococcus
LAELESTHA

SEQ ID NO: 1961610 - protein, 17 aa, Staphylococcus
LAENDNSNTFTNPEETI

SEQ ID NO: 1961611 - protein, 5 aa, Staphylococcus
LAENG

SEQ ID NO: 1961612 - protein, 17 aa, Staphylococcus
LAENKSQNIIFVGNNMC

SEQ ID NO: 1961613 - protein, 8 aa, Staphylococcus
LAEPGEYT

SEQ ID NO: 1961614 - protein, 12 aa, Staphylococcus
LAEPNEEDKPEE

SEQ ID NO: 1961615 - protein, 4 aa, Staphylococcus
LAEQ

SEQ ID NO: 1961616 - protein, 12 aa, Staphylococcus
LAEQDGTTEQEA

SEQ ID NO: 1961617 - protein, 5 aa, Staphylococcus
LAEQG

SEQ ID NO: 1961618 - protein, 9 aa, Staphylococcus
LAEQGDDLD

SEQ ID NO: 1961619 - protein, 9 aa, Staphylococcus
LAEQNDLRQ

SEQ ID NO: 1961620 - protein, 15 aa, Staphylococcus
LAEQSPHCQGPGSFQ

SEQ ID NO: 1961621 - protein, 7 aa, Staphylococcus
LAEQTGV

SEQ ID NO: 1961622 - protein, 8 aa, Staphylococcus
LAEQTNAD

SEQ ID NO: 1961623 - protein, 6 aa, Staphylococcus
LAETPF

SEQ ID NO: 1961624 - protein, 5 aa, Staphylococcus
LAGEV

SEQ ID NO: 1961625 - protein, 11 aa, Staphylococcus
LAGKDGGEITF

SEQ ID NO: 1961626 - protein, 5 aa, Staphylococcus
LAGKG

SEQ ID NO: 1961627 - protein, 5 aa, Staphylococcus
LAGKN

SEQ ID NO: 1961628 - protein, 11 aa, Staphylococcus
LAGKNGGEITF

SEQ ID NO: 1961629 - protein, 10 aa, Staphylococcus
LAGKYGGDIT

SEQ ID NO: 1961630 - protein, 21 aa, Staphylococcus
LAGPHEVSTRLTANGRNQEEC

SEQ ID NO: 1961631 - protein, 25 aa, Staphylococcus
LAGQDVSKWTRTASQSLIDERQPEH

SEQ ID NO: 1961632 - protein, 6 aa, Staphylococcus
LAGSFN

SEQ ID NO: 1961633 - protein, 5 aa, Staphylococcus
LAGYA

SEQ ID NO: 1961634 - protein, 4 aa, Staphylococcus
LAHQ

SEQ ID NO: 1961635 - protein, 5 aa, Staphylococcus
LAIEP

SEQ ID NO: 1961636 - protein, 13 aa, Staphylococcus
LAKDKGYYILKSK

SEQ ID NO: 1961637 - protein, 9 aa, Staphylococcus
LAKEDSQNM

SEQ ID NO: 1961638 - protein, 8 aa, Staphylococcus
LAKEGKPV

SEQ ID NO: 1961639 - protein, 7 aa, Staphylococcus
LAKEKNA

SEQ ID NO: 1961640 - protein, 6 aa, Staphylococcus
LAKEKR

SEQ ID NO: 1961641 - protein, 8 aa, Staphylococcus
LAKENNPY

SEQ ID NO: 1961642 - protein, 8 aa, Staphylococcus
LAKEPNEN

SEQ ID NO: 1961643 - protein, 6 aa, Staphylococcus
LAKERV

SEQ ID NO: 1961644 - protein, 10 aa, Staphylococcus
LAKEYTSKFE

SEQ ID NO: 1961645 - protein, 17 aa, Staphylococcus
LAKGLPGATVRDDAISK

SEQ ID NO: 1961646 - protein, 12 aa, Staphylococcus
LAKGQGIGRSSV

SEQ ID NO: 1961647 - protein, 9 aa, Staphylococcus
LAKKDEDGD

SEQ ID NO: 1961648 - protein, 22 aa, Staphylococcus
LAKKKKEKGLTEEEAKEQSKLR

SEQ ID NO: 1961649 - protein, 22 aa, Staphylococcus
LAKKKKEQGLTEAEAKEQSKLR

SEQ ID NO: 1961650 - protein, 23 aa, Staphylococcus
LAKKKKEQGLTEAEAKEQSKLRK

SEQ ID NO: 1961651 - protein, 22 aa, Staphylococcus
LAKKKKEQGLTENEAKEQSKLR

SEQ ID NO: 1961652 - protein, 22 aa, Staphylococcus
LAKKKKEQGLTNEEAKEQSKLR

SEQ ID NO: 1961653 - protein, 12 aa, Staphylococcus
LAKKNAEDPRFT

SEQ ID NO: 1961654 - protein, 8 aa, Staphylococcus
LAKKNDYD

SEQ ID NO: 1961655 - protein, 8 aa, Staphylococcus
LAKKSEQE

SEQ ID NO: 1961656 - protein, 10 aa, Staphylococcus
LAKKTPKKKG

SEQ ID NO: 1961657 - protein, 8 aa, Staphylococcus
LAKKYSRK

SEQ ID NO: 1961658 - protein, 9 aa, Staphylococcus
LAKKYSRNR

SEQ ID NO: 1961659 - protein, 13 aa, Staphylococcus
LAKLNDDSLKTDL

SEQ ID NO: 1961660 - protein, 8 aa, Staphylococcus
LAKNPDDS

SEQ ID NO: 1961661 - protein, 11 aa, Staphylococcus
LAKPNLKKQGK

SEQ ID NO: 1961662 - protein, 10 aa, Staphylococcus
LAKQTQSIIE

SEQ ID NO: 1961663 - protein, 9 aa, Staphylococcus
LAKSEIKRK

SEQ ID NO: 1961664 - protein, 7 aa, Staphylococcus
LAKSGVK

SEQ ID NO: 1961665 - protein, 19 aa, Staphylococcus
LAKSKKKDTSDLKGVTAEE

SEQ ID NO: 1961666 - protein, 8 aa, Staphylococcus
LAKSLGLT

SEQ ID NO: 1961667 - protein, 9 aa, Staphylococcus
LAKTEEGRV

SEQ ID NO: 1961668 - protein, 6 aa, Staphylococcus
LAKTEI

SEQ ID NO: 1961669 - protein, 5 aa, Staphylococcus
LAKTK

SEQ ID NO: 1961670 - protein, 12 aa, Staphylococcus
LAKYEKSGEINN

SEQ ID NO: 1961671 - protein, 8 aa, Staphylococcus
LALGESAC

SEQ ID NO: 1961672 - protein, 5 aa, Staphylococcus
LAMEK

SEQ ID NO: 1961673 - protein, 5 aa, Staphylococcus
LANDI

SEQ ID NO: 1961674 - protein, 9 aa, Staphylococcus
LANEAGVQP

SEQ ID NO: 1961675 - protein, 10 aa, Staphylococcus
LANEGDTVEV

SEQ ID NO: 1961676 - protein, 7 aa, Staphylococcus
LANEGKP

SEQ ID NO: 1961677 - protein, 5 aa, Staphylococcus
LANEI

SEQ ID NO: 1961678 - protein, 9 aa, Staphylococcus
LANESGVAP

SEQ ID NO: 1961679 - protein, 9 aa, Staphylococcus
LANETGVAP

SEQ ID NO: 1961680 - protein, 7 aa, Staphylococcus
LANETST

SEQ ID NO: 1961681 - protein, 8 aa, Staphylococcus
LANGDERY

SEQ ID NO: 1961682 - protein, 6 aa, Staphylococcus
LANGGT

SEQ ID NO: 1961683 - protein, 8 aa, Staphylococcus
LANGNRSM

SEQ ID NO: 1961684 - protein, 10 aa, Staphylococcus
LANKDKDYAT

SEQ ID NO: 1961685 - protein, 6 aa, Staphylococcus
LANKEK

SEQ ID NO: 1961686 - protein, 7 aa, Staphylococcus
LANKGTK

SEQ ID NO: 1961687 - protein, 7 aa, Staphylococcus
LANNPSH

SEQ ID NO: 1961688 - protein, 14 aa, Staphylococcus
LANPITGAISQDDA

SEQ ID NO: 1961689 - protein, 7 aa, Staphylococcus
LANRPNE

SEQ ID NO: 1961690 - protein, 12 aa, Staphylococcus
LANRSRALTEEN

SEQ ID NO: 1961691 - protein, 12 aa, Staphylococcus
LANRSRSLTEEN

SEQ ID NO: 1961692 - protein, 6 aa, Staphylococcus
LANSGF

SEQ ID NO: 1961693 - protein, 7 aa, Staphylococcus
LANSGVK

SEQ ID NO: 1961694 - protein, 13 aa, Staphylococcus
LANSKQCSIEATK

SEQ ID NO: 1961695 - protein, 7 aa, Staphylococcus
LAPEGAV

SEQ ID NO: 1961696 - protein, 8 aa, Staphylococcus
LAPEPPEW

SEQ ID NO: 1961697 - protein, 10 aa, Staphylococcus
LAPERKSDKD

SEQ ID NO: 1961698 - protein, 7 aa, Staphylococcus
LAPESKI

SEQ ID NO: 1961699 - protein, 12 aa, Staphylococcus
LAPGDQQEIQAS

SEQ ID NO: 1961700 - protein, 12 aa, Staphylococcus
LAPGFDKSCEVP

SEQ ID NO: 1961701 - protein, 10 aa, Staphylococcus
LAPGNQEEIQ

SEQ ID NO: 1961702 - protein, 5 aa, Staphylococcus
LAPHS

SEQ ID NO: 1961703 - protein, 5 aa, Staphylococcus
LAPHV

SEQ ID NO: 1961704 - protein, 6 aa, Staphylococcus
LAPKTV

SEQ ID NO: 1961705 - protein, 12 aa, Staphylococcus
LAPNDKRLKSDR

SEQ ID NO: 1961706 - protein, 6 aa, Staphylococcus
LAPNGA

SEQ ID NO: 1961707 - protein, 7 aa, Staphylococcus
LAPNGTA

SEQ ID NO: 1961708 - protein, 5 aa, Staphylococcus
LAPNH

SEQ ID NO: 1961709 - protein, 4 aa, Staphylococcus
LAPQ

SEQ ID NO: 1961710 - protein, 34 aa, Staphylococcus
LAPQQGVASNPVATGSTEETTSDASTTDDNLQTI

SEQ ID NO: 1961711 - protein, 4 aa, Staphylococcus
LAPS

SEQ ID NO: 1961712 - protein, 32 aa, Staphylococcus
LAPSDSSLARPSRGRRPPRRCRSRAGRPGHGV

SEQ ID NO: 1961713 - protein, 13 aa, Staphylococcus
LAPTFEGKAGVKK

SEQ ID NO: 1961714 - protein, 7 aa, Staphylococcus
LAPVKKA

SEQ ID NO: 1961715 - protein, 6 aa, Staphylococcus
LAQAGA

SEQ ID NO: 1961716 - protein, 17 aa, Staphylococcus
LAQATSEEFTELPTPKE

SEQ ID NO: 1961717 - protein, 7 aa, Staphylococcus
LAQETNA

SEQ ID NO: 1961718 - protein, 5 aa, Staphylococcus
LAQFR

SEQ ID NO: 1961719 - protein, 11 aa, Staphylococcus
LAQKGDRDSID

SEQ ID NO: 1961720 - protein, 8 aa, Staphylococcus
LAQKGEYD

SEQ ID NO: 1961721 - protein, 19 aa, Staphylococcus
LAQKMAQEQNKKKEEKIKE

SEQ ID NO: 1961722 - protein, 19 aa, Staphylococcus
LAQKMAQEQNKKKEEKMKE

SEQ ID NO: 1961723 - protein, 8 aa, Staphylococcus
LAQKNDYD

SEQ ID NO: 1961724 - protein, 8 aa, Staphylococcus
LAQKSENE

SEQ ID NO: 1961725 - protein, 17 aa, Staphylococcus
LAQNSSEELTELPTPKE

SEQ ID NO: 1961726 - protein, 17 aa, Staphylococcus
LAQNTSEGFTELPTPKE

SEQ ID NO: 1961727 - protein, 145 aa, Staphylococcus
LAQPQESKKEEQKAPSATVEKTEPAKTVNSDDKQNSTADFKGAAVSAQPEKKEENKSATAQSEAKPEASATASSNKEESSSTENKTSSDKPEQKEQKSVPAAEMQETPETTTPEPEIPVDAPRNEHQPTAQHKQEKKGFFARLFG

SEQ ID NO: 1961728 - protein, 4 aa, Staphylococcus
LAQQ

SEQ ID NO: 1961729 - protein, 16 aa, Staphylococcus
LAQQEEMGYTQKSPRW

SEQ ID NO: 1961730 - protein, 9 aa, Staphylococcus
LAQQGDRNH

SEQ ID NO: 1961731 - protein, 7 aa, Staphylococcus
LAQRPDE

SEQ ID NO: 1961732 - protein, 14 aa, Staphylococcus
LAQRSLDNQKTDDR

SEQ ID NO: 1961733 - protein, 17 aa, Staphylococcus
LAQSEPEGLTELPTPKE

SEQ ID NO: 1961734 - protein, 10 aa, Staphylococcus
LAQSGDRDTI

SEQ ID NO: 1961735 - protein, 18 aa, Staphylococcus
LAQSPNLAVSSSSRGNLE

SEQ ID NO: 1961736 - protein, 5 aa, Staphylococcus
LAQSR

SEQ ID NO: 1961737 - protein, 8 aa, Staphylococcus
LAQSSGLD

SEQ ID NO: 1961738 - protein, 6 aa, Staphylococcus
LAQSSV

SEQ ID NO: 1961739 - protein, 17 aa, Staphylococcus
LAQTATEEFTDLPTPKE

SEQ ID NO: 1961740 - protein, 7 aa, Staphylococcus
LAQTGKY

SEQ ID NO: 1961741 - protein, 14 aa, Staphylococcus
LAQTGRLSSIDPNL

SEQ ID NO: 1961742 - protein, 17 aa, Staphylococcus
LAQTSSEEFTEVPTPKE

SEQ ID NO: 1961743 - protein, 17 aa, Staphylococcus
LAQTTSEEFTELPTPKE

SEQ ID NO: 1961744 - protein, 6 aa, Staphylococcus
LARDGY

SEQ ID NO: 1961745 - protein, 21 aa, Staphylococcus
LARDKKIDGITDLRDETSLRT

SEQ ID NO: 1961746 - protein, 24 aa, Staphylococcus
LAREAAYDKVQPKAMESWETKTPF

SEQ ID NO: 1961747 - protein, 8 aa, Staphylococcus
LAREGKKV

SEQ ID NO: 1961748 - protein, 6 aa, Staphylococcus
LAREGY

SEQ ID NO: 1961749 - protein, 8 aa, Staphylococcus
LARETEKV

SEQ ID NO: 1961750 - protein, 8 aa, Staphylococcus
LARKGDYD

SEQ ID NO: 1961751 - protein, 68 aa, Staphylococcus
LARKGGRHNSKGPRRSGKPNKRSNNKFDNKNRRGKGNKGGKNNGGKKFKNDKKDHKKPIKGRTFADMQ

SEQ ID NO: 1961752 - protein, 72 aa, Staphylococcus
LARKNRNSRGGGSRRGNNNKRGNGKFDNKNRRSKGSKGHSNKKKNNKKFERRDKQNKGSNQSMRGRTFADHQ

SEQ ID NO: 1961753 - protein, 64 aa, Staphylococcus
LARKNRQGKGNGSRRGGKRNNKFDNKNKRSKGNFNKKKGKKTDRRERQDKGRSTMKGRTFADLQ

SEQ ID NO: 1961754 - protein, 65 aa, Staphylococcus
LARKNRQSKNGGNHRRSNKKRGGKFETRNKRTKGNYNKKKSNNFDRKDKSSKNRTTKGRTFADMQ

SEQ ID NO: 1961755 - protein, 64 aa, Staphylococcus
LARKSRNNKGNQSRRGGKRNNKFNNKNKRSKGNFNKKKGKKQDRRDRQDKRKTSIKGRTFADLQ

SEQ ID NO: 1961756 - protein, 22 aa, Staphylococcus
LARQASKAAGKKGTDLPGQVAR

SEQ ID NO: 1961757 - protein, 37 aa, Staphylococcus
LARQRAQSHLDEEDNSDINRAKRALARAENRLRVAEL

SEQ ID NO: 1961758 - protein, 37 aa, Staphylococcus
LARQRAQSHLEDQDNSDINRAKRALARAENRLRVAEL

SEQ ID NO: 1961759 - protein, 4 aa, Staphylococcus
LASE

SEQ ID NO: 1961760 - protein, 5 aa, Staphylococcus
LASED

SEQ ID NO: 1961761 - protein, 9 aa, Staphylococcus
LASEGDTVE

SEQ ID NO: 1961762 - protein, 10 aa, Staphylococcus
LASEGDTVEV

SEQ ID NO: 1961763 - protein, 8 aa, Staphylococcus
LASEGKPV

SEQ ID NO: 1961764 - protein, 12 aa, Staphylococcus
LASGEVQEPDEG

SEQ ID NO: 1961765 - protein, 6 aa, Staphylococcus
LASKGY

SEQ ID NO: 1961766 - protein, 13 aa, Staphylococcus
LASKPDDFAPNAK

SEQ ID NO: 1961767 - protein, 9 aa, Staphylococcus
LASKRNDNK

SEQ ID NO: 1961768 - protein, 8 aa, Staphylococcus
LASKRTDR

SEQ ID NO: 1961769 - protein, 13 aa, Staphylococcus
LASKSFKPGRPIG

SEQ ID NO: 1961770 - protein, 9 aa, Staphylococcus
LASKYGSNV

SEQ ID NO: 1961771 - protein, 10 aa, Staphylococcus
LASLSGGEAQ

SEQ ID NO: 1961772 - protein, 4 aa, Staphylococcus
LASN

SEQ ID NO: 1961773 - protein, 6 aa, Staphylococcus
LASNDY

SEQ ID NO: 1961774 - protein, 9 aa, Staphylococcus
LASNPEEFA

SEQ ID NO: 1961775 - protein, 10 aa, Staphylococcus
LASNPNEFAP

SEQ ID NO: 1961776 - protein, 7 aa, Staphylococcus
LASNTLS

SEQ ID NO: 1961777 - protein, 4 aa, Staphylococcus
LASP

SEQ ID NO: 1961778 - protein, 7 aa, Staphylococcus
LASQENI

SEQ ID NO: 1961779 - protein, 10 aa, Staphylococcus
LASQKRQNQT

SEQ ID NO: 1961780 - protein, 6 aa, Staphylococcus
LASYDK

SEQ ID NO: 1961781 - protein, 11 aa, Staphylococcus
LATATENERGV

SEQ ID NO: 1961782 - protein, 8 aa, Staphylococcus
LATDSGVF

SEQ ID NO: 1961783 - protein, 4 aa, Staphylococcus
LATE

SEQ ID NO: 1961784 - protein, 7 aa, Staphylococcus
LATEGAQ

SEQ ID NO: 1961785 - protein, 7 aa, Staphylococcus
LATEGAT

SEQ ID NO: 1961786 - protein, 6 aa, Staphylococcus
LATGKA

SEQ ID NO: 1961787 - protein, 10 aa, Staphylococcus
LATKEAIENI

SEQ ID NO: 1961788 - protein, 7 aa, Staphylococcus
LATNDTS

SEQ ID NO: 1961789 - protein, 6 aa, Staphylococcus
LATPAG

SEQ ID NO: 1961790 - protein, 13 aa, Staphylococcus
LATPDDNMKTQDF

SEQ ID NO: 1961791 - protein, 9 aa, Staphylococcus
LATPSTKKK

SEQ ID NO: 1961792 - protein, 4 aa, Staphylococcus
LATQ

SEQ ID NO: 1961793 - protein, 8 aa, Staphylococcus
LATQGQDV

SEQ ID NO: 1961794 - protein, 10 aa, Staphylococcus
LATQIEPGQP

SEQ ID NO: 1961795 - protein, 6 aa, Staphylococcus
LATQSD

SEQ ID NO: 1961796 - protein, 6 aa, Staphylococcus
LATRDA

SEQ ID NO: 1961797 - protein, 7 aa, Staphylococcus
LATRPNE

SEQ ID NO: 1961798 - protein, 4 aa, Staphylococcus
LATV

SEQ ID NO: 1961799 - protein, 13 aa, Staphylococcus
LATYTKEDAFNQE

SEQ ID NO: 1961800 - protein, 9 aa, Staphylococcus
LAVNAKEGL

SEQ ID NO: 1961801 - protein, 12 aa, Staphylococcus
LAYGDDRAMASA

SEQ ID NO: 1961802 - protein, 4 aa, Staphylococcus
LAYT

SEQ ID NO: 1961803 - protein, 8 aa, Staphylococcus
LDADKDVK

SEQ ID NO: 1961804 - protein, 7 aa, Staphylococcus
LDADTEK

SEQ ID NO: 1961805 - protein, 15 aa, Staphylococcus
LDAGGQFQDRGSQYQ

SEQ ID NO: 1961806 - protein, 11 aa, Staphylococcus
LDAKKGTKNLR

SEQ ID NO: 1961807 - protein, 5 aa, Staphylococcus
LDAKP

SEQ ID NO: 1961808 - protein, 9 aa, Staphylococcus
LDAPKTKEF

SEQ ID NO: 1961809 - protein, 7 aa, Staphylococcus
LDAPTES

SEQ ID NO: 1961810 - protein, 8 aa, Staphylococcus
LDATDERV

SEQ ID NO: 1961811 - protein, 8 aa, Staphylococcus
LDATEERV

SEQ ID NO: 1961812 - protein, 8 aa, Staphylococcus
LDATNERV

SEQ ID NO: 1961813 - protein, 15 aa, Staphylococcus
LDDAGQFQDRGSQYK

SEQ ID NO: 1961814 - protein, 6 aa, Staphylococcus
LDDAGY

SEQ ID NO: 1961815 - protein, 5 aa, Staphylococcus
LDDAK

SEQ ID NO: 1961816 - protein, 7 aa, Staphylococcus
LDDDFEE

SEQ ID NO: 1961817 - protein, 15 aa, Staphylococcus
LDDEGQFQDRGSQYQ

SEQ ID NO: 1961818 - protein, 14 aa, Staphylococcus
LDDFSQSKPRTRIP

SEQ ID NO: 1961819 - protein, 14 aa, Staphylococcus
LDDFTESKPRTRIS

SEQ ID NO: 1961820 - protein, 10 aa, Staphylococcus
LDDGSVEDTL

SEQ ID NO: 1961821 - protein, 6 aa, Staphylococcus
LDDKAS

SEQ ID NO: 1961822 - protein, 9 aa, Staphylococcus
LDDKGDRGK

SEQ ID NO: 1961823 - protein, 8 aa, Staphylococcus
LDDKNGAV

SEQ ID NO: 1961824 - protein, 9 aa, Staphylococcus
LDDLSDDEK

SEQ ID NO: 1961825 - protein, 8 aa, Staphylococcus
LDDNADDA

SEQ ID NO: 1961826 - protein, 6 aa, Staphylococcus
LDDPTQ

SEQ ID NO: 1961827 - protein, 8 aa, Staphylococcus
LDDQERYQ

SEQ ID NO: 1961828 - protein, 11 aa, Staphylococcus
LDDSEKFEKQH

SEQ ID NO: 1961829 - protein, 6 aa, Staphylococcus
LDDSQI

SEQ ID NO: 1961830 - protein, 8 aa, Staphylococcus
LDDSSPII

SEQ ID NO: 1961831 - protein, 5 aa, Staphylococcus
LDDTN

SEQ ID NO: 1961832 - protein, 7 aa, Staphylococcus
LDDTRPV

SEQ ID NO: 1961833 - protein, 14 aa, Staphylococcus
LDDVSGHKYGLGSS

SEQ ID NO: 1961834 - protein, 8 aa, Staphylococcus
LDDYSERI

SEQ ID NO: 1961835 - protein, 5 aa, Staphylococcus
LDEAG

SEQ ID NO: 1961836 - protein, 5 aa, Staphylococcus
LDEAN

SEQ ID NO: 1961837 - protein, 7 aa, Staphylococcus
LDEAPTS

SEQ ID NO: 1961838 - protein, 9 aa, Staphylococcus
LDEAQQADK

SEQ ID NO: 1961839 - protein, 8 aa, Staphylococcus
LDEASSKL

SEQ ID NO: 1961840 - protein, 17 aa, Staphylococcus
LDEATNKLKQHSRNYAK

SEQ ID NO: 1961841 - protein, 4 aa, Staphylococcus
LDEC

SEQ ID NO: 1961842 - protein, 5 aa, Staphylococcus
LDEDG

SEQ ID NO: 1961843 - protein, 15 aa, Staphylococcus
LDEDGQFQDRGSQYQ

SEQ ID NO: 1961844 - protein, 14 aa, Staphylococcus
LDEEEKEVINGEQV

SEQ ID NO: 1961845 - protein, 5 aa, Staphylococcus
LDEEH

SEQ ID NO: 1961846 - protein, 14 aa, Staphylococcus
LDEEHSKVTTKWTQ

SEQ ID NO: 1961847 - protein, 13 aa, Staphylococcus
LDEEQGKETVRTA

SEQ ID NO: 1961848 - protein, 13 aa, Staphylococcus
LDEERKPENTTEL

SEQ ID NO: 1961849 - protein, 8 aa, Staphylococcus
LDEESVIR

SEQ ID NO: 1961850 - protein, 7 aa, Staphylococcus
LDEETER

SEQ ID NO: 1961851 - protein, 9 aa, Staphylococcus
LDEGERKYI

SEQ ID NO: 1961852 - protein, 9 aa, Staphylococcus
LDEGTKGAY

SEQ ID NO: 1961853 - protein, 4 aa, Staphylococcus
LDEI

SEQ ID NO: 1961854 - protein, 8 aa, Staphylococcus
LDEKDKRI

SEQ ID NO: 1961855 - protein, 7 aa, Staphylococcus
LDEKDSE

SEQ ID NO: 1961856 - protein, 21 aa, Staphylococcus
LDEKEESDKAETTEENTSVES

SEQ ID NO: 1961857 - protein, 6 aa, Staphylococcus
LDEKGI

SEQ ID NO: 1961858 - protein, 10 aa, Staphylococcus
LDEKGPSGVA

SEQ ID NO: 1961859 - protein, 16 aa, Staphylococcus
LDEKNISRIGSTFGKT

SEQ ID NO: 1961860 - protein, 13 aa, Staphylococcus
LDEKRKPENTKEL

SEQ ID NO: 1961861 - protein, 4 aa, Staphylococcus
LDEL

SEQ ID NO: 1961862 - protein, 6 aa, Staphylococcus
LDENGD

SEQ ID NO: 1961863 - protein, 5 aa, Staphylococcus
LDENK

SEQ ID NO: 1961864 - protein, 5 aa, Staphylococcus
LDENS

SEQ ID NO: 1961865 - protein, 8 aa, Staphylococcus
LDEPERVA

SEQ ID NO: 1961866 - protein, 7 aa, Staphylococcus
LDEPNAQ

SEQ ID NO: 1961867 - protein, 6 aa, Staphylococcus
LDEPNI

SEQ ID NO: 1961868 - protein, 10 aa, Staphylococcus
LDEPNSEGIE

SEQ ID NO: 1961869 - protein, 7 aa, Staphylococcus
LDEPNYE

SEQ ID NO: 1961870 - protein, 6 aa, Staphylococcus
LDEQFS

SEQ ID NO: 1961871 - protein, 9 aa, Staphylococcus
LDEQGPKAV

SEQ ID NO: 1961872 - protein, 6 aa, Staphylococcus
LDEQSI

SEQ ID NO: 1961873 - protein, 8 aa, Staphylococcus
LDEQSVIK

SEQ ID NO: 1961874 - protein, 27 aa, Staphylococcus
LDEQYEGTDIKQNVKKQKWDEIQAGDE

SEQ ID NO: 1961875 - protein, 7 aa, Staphylococcus
LDERTEK

SEQ ID NO: 1961876 - protein, 4 aa, Staphylococcus
LDES

SEQ ID NO: 1961877 - protein, 17 aa, Staphylococcus
LDESEHEMAEAHKTQTR

SEQ ID NO: 1961878 - protein, 6 aa, Staphylococcus
LDESNA

SEQ ID NO: 1961879 - protein, 7 aa, Staphylococcus
LDESPTS

SEQ ID NO: 1961880 - protein, 9 aa, Staphylococcus
LDESSVLSD

SEQ ID NO: 1961881 - protein, 8 aa, Staphylococcus
LDETDERV

SEQ ID NO: 1961882 - protein, 10 aa, Staphylococcus
LDETKATSDL

SEQ ID NO: 1961883 - protein, 10 aa, Staphylococcus
LDETKKTSDL

SEQ ID NO: 1961884 - protein, 7 aa, Staphylococcus
LDETLDR

SEQ ID NO: 1961885 - protein, 6 aa, Staphylococcus
LDETNI

SEQ ID NO: 1961886 - protein, 8 aa, Staphylococcus
LDETTTDD

SEQ ID NO: 1961887 - protein, 15 aa, Staphylococcus
LDEVQEEMVKGLEKR

SEQ ID NO: 1961888 - protein, 4 aa, Staphylococcus
LDEY

SEQ ID NO: 1961889 - protein, 13 aa, Staphylococcus
LDEYRKNIEKDAA

SEQ ID NO: 1961890 - protein, 15 aa, Staphylococcus
LDEYTARKLERGKRT

SEQ ID NO: 1961891 - protein, 9 aa, Staphylococcus
LDFERAKEY

SEQ ID NO: 1961892 - protein, 4 aa, Staphylococcus
LDFS

SEQ ID NO: 1961893 - protein, 6 aa, Staphylococcus
LDFSTA

SEQ ID NO: 1961894 - protein, 6 aa, Staphylococcus
LDFTKT

SEQ ID NO: 1961895 - protein, 5 aa, Staphylococcus
LDGAD

SEQ ID NO: 1961896 - protein, 8 aa, Staphylococcus
LDGCPTDS

SEQ ID NO: 1961897 - protein, 20 aa, Staphylococcus
LDGDKIKDSYKTALENSNKV

SEQ ID NO: 1961898 - protein, 8 aa, Staphylococcus
LDGDPDLG

SEQ ID NO: 1961899 - protein, 8 aa, Staphylococcus
LDGDSLRQ

SEQ ID NO: 1961900 - protein, 17 aa, Staphylococcus
LDGDTIDEYDKYDESYL

SEQ ID NO: 1961901 - protein, 20 aa, Staphylococcus
LDGDTRGGAALSIRSVTDNA

SEQ ID NO: 1961902 - protein, 11 aa, Staphylococcus
LDGDVKSDLEQ

SEQ ID NO: 1961903 - protein, 6 aa, Staphylococcus
LDGEAS

SEQ ID NO: 1961904 - protein, 7 aa, Staphylococcus
LDGEDNL

SEQ ID NO: 1961905 - protein, 6 aa, Staphylococcus
LDGEHQ

SEQ ID NO: 1961906 - protein, 4 aa, Staphylococcus
LDGI

SEQ ID NO: 1961907 - protein, 11 aa, Staphylococcus
LDGKQATDLGQ

SEQ ID NO: 1961908 - protein, 14 aa, Staphylococcus
LDGKQATDSGQSQW

SEQ ID NO: 1961909 - protein, 32 aa, Staphylococcus
LDGKSTDQYAKQEMAGGESFKGSAGQFVRKNI

SEQ ID NO: 1961910 - protein, 10 aa, Staphylococcus
LDGPESKKRE

SEQ ID NO: 1961911 - protein, 14 aa, Staphylococcus
LDGQKYGAYKRTKG

SEQ ID NO: 1961912 - protein, 6 aa, Staphylococcus
LDGRYS

SEQ ID NO: 1961913 - protein, 8 aa, Staphylococcus
LDGSEHGM

SEQ ID NO: 1961914 - protein, 5 aa, Staphylococcus
LDGSN

SEQ ID NO: 1961915 - protein, 19 aa, Staphylococcus
LDGSVKKDLEQIERKFRRV

SEQ ID NO: 1961916 - protein, 6 aa, Staphylococcus
LDGTAY

SEQ ID NO: 1961917 - protein, 7 aa, Staphylococcus
LDGTNDF

SEQ ID NO: 1961918 - protein, 31 aa, Staphylococcus
LDGTNDSIVQDEAQASFASNISREDEKINWN

SEQ ID NO: 1961919 - protein, 9 aa, Staphylococcus
LDGYSTGGS

SEQ ID NO: 1961920 - protein, 9 aa, Staphylococcus
LDHHPKKNK

SEQ ID NO: 1961921 - protein, 8 aa, Staphylococcus
LDHSSTDI

SEQ ID NO: 1961922 - protein, 10 aa, Staphylococcus
LDINDTNANR

SEQ ID NO: 1961923 - protein, 4 aa, Staphylococcus
LDIP

SEQ ID NO: 1961924 - protein, 4 aa, Staphylococcus
LDKD

SEQ ID NO: 1961925 - protein, 8 aa, Staphylococcus
LDKDGDTY

SEQ ID NO: 1961926 - protein, 10 aa, Staphylococcus
LDKDKKSAIR

SEQ ID NO: 1961927 - protein, 4 aa, Staphylococcus
LDKE

SEQ ID NO: 1961928 - protein, 7 aa, Staphylococcus
LDKENGA

SEQ ID NO: 1961929 - protein, 6 aa, Staphylococcus
LDKGAK

SEQ ID NO: 1961930 - protein, 4 aa, Staphylococcus
LDKK

SEQ ID NO: 1961931 - protein, 20 aa, Staphylococcus
LDKKEASSISTDQSEIENAD

SEQ ID NO: 1961932 - protein, 14 aa, Staphylococcus
LDKLKSELSPTPKW

SEQ ID NO: 1961933 - protein, 4 aa, Staphylococcus
LDKN

SEQ ID NO: 1961934 - protein, 10 aa, Staphylococcus
LDKNGKQIGT

SEQ ID NO: 1961935 - protein, 9 aa, Staphylococcus
LDKNGRTNF

SEQ ID NO: 1961936 - protein, 9 aa, Staphylococcus
LDKNQDAEV

SEQ ID NO: 1961937 - protein, 4 aa, Staphylococcus
LDKP

SEQ ID NO: 1961938 - protein, 9 aa, Staphylococcus
LDKPKQTHV

SEQ ID NO: 1961939 - protein, 8 aa, Staphylococcus
LDKQGRIN

SEQ ID NO: 1961940 - protein, 4 aa, Staphylococcus
LDKR

SEQ ID NO: 1961941 - protein, 7 aa, Staphylococcus
LDKSAKD

SEQ ID NO: 1961942 - protein, 9 aa, Staphylococcus
LDKSTRNAI

SEQ ID NO: 1961943 - protein, 9 aa, Staphylococcus
LDKTEKDQK

SEQ ID NO: 1961944 - protein, 15 aa, Staphylococcus
LDKTFSEKTQSRFES

SEQ ID NO: 1961945 - protein, 6 aa, Staphylococcus
LDKTTI

SEQ ID NO: 1961946 - protein, 10 aa, Staphylococcus
LDLDKSSKLY

SEQ ID NO: 1961947 - protein, 8 aa, Staphylococcus
LDLDPDDT

SEQ ID NO: 1961948 - protein, 8 aa, Staphylococcus
LDLDPNDT

SEQ ID NO: 1961949 - protein, 9 aa, Staphylococcus
LDLDQAKAR

SEQ ID NO: 1961950 - protein, 8 aa, Staphylococcus
LDLEDEDN

SEQ ID NO: 1961951 - protein, 8 aa, Staphylococcus
LDLEEGDT

SEQ ID NO: 1961952 - protein, 4 aa, Staphylococcus
LDMD

SEQ ID NO: 1961953 - protein, 12 aa, Staphylococcus
LDMQSEDKKIDI

SEQ ID NO: 1961954 - protein, 12 aa, Staphylococcus
LDMQSEDKPVDL

SEQ ID NO: 1961955 - protein, 13 aa, Staphylococcus
LDMQSEGAETNID

SEQ ID NO: 1961956 - protein, 11 aa, Staphylococcus
LDMQSENQTVD

SEQ ID NO: 1961957 - protein, 4 aa, Staphylococcus
LDND

SEQ ID NO: 1961958 - protein, 6 aa, Staphylococcus
LDNDDA

SEQ ID NO: 1961959 - protein, 8 aa, Staphylococcus
LDNDESIS

SEQ ID NO: 1961960 - protein, 6 aa, Staphylococcus
LDNDEV

SEQ ID NO: 1961961 - protein, 8 aa, Staphylococcus
LDNDNDDV

SEQ ID NO: 1961962 - protein, 15 aa, Staphylococcus
LDNDSNGIPAALKTL

SEQ ID NO: 1961963 - protein, 5 aa, Staphylococcus
LDNEA

SEQ ID NO: 1961964 - protein, 6 aa, Staphylococcus
LDNEAS

SEQ ID NO: 1961965 - protein, 8 aa, Staphylococcus
LDNEDSKS

SEQ ID NO: 1961966 - protein, 11 aa, Staphylococcus
LDNEGITESLD

SEQ ID NO: 1961967 - protein, 38 aa, Staphylococcus
LDNGDASSLNDESTNDSEEVVTEQSNNDEASSKTYQTL

SEQ ID NO: 1961968 - protein, 7 aa, Staphylococcus
LDNGHTE

SEQ ID NO: 1961969 - protein, 8 aa, Staphylococcus
LDNGQRRA

SEQ ID NO: 1961970 - protein, 7 aa, Staphylococcus
LDNHSAE

SEQ ID NO: 1961971 - protein, 5 aa, Staphylococcus
LDNIE

SEQ ID NO: 1961972 - protein, 4 aa, Staphylococcus
LDNL

SEQ ID NO: 1961973 - protein, 7 aa, Staphylococcus
LDNLSNT

SEQ ID NO: 1961974 - protein, 18 aa, Staphylococcus
LDNNEQSIEDYKNGKGKA

SEQ ID NO: 1961975 - protein, 6 aa, Staphylococcus
LDNNEV

SEQ ID NO: 1961976 - protein, 6 aa, Staphylococcus
LDNNGS

SEQ ID NO: 1961977 - protein, 20 aa, Staphylococcus
LDNNPQSVEDFKNGKGRAKG

SEQ ID NO: 1961978 - protein, 19 aa, Staphylococcus
LDNNPQSVEDYKNGKGRAM

SEQ ID NO: 1961979 - protein, 15 aa, Staphylococcus
LDNNSEGIPHMLKKL

SEQ ID NO: 1961980 - protein, 4 aa, Staphylococcus
LDNQ

SEQ ID NO: 1961981 - protein, 22 aa, Staphylococcus
LDNQKSSDKGSDSKSGDYKPKE

SEQ ID NO: 1961982 - protein, 7 aa, Staphylococcus
LDNQPTK

SEQ ID NO: 1961983 - protein, 4 aa, Staphylococcus
LDNR

SEQ ID NO: 1961984 - protein, 21 aa, Staphylococcus
LDNTEEEAAKQAIVERLEKQH

SEQ ID NO: 1961985 - protein, 5 aa, Staphylococcus
LDNTF

SEQ ID NO: 1961986 - protein, 6 aa, Staphylococcus
LDNTKT

SEQ ID NO: 1961987 - protein, 5 aa, Staphylococcus
LDNTN

SEQ ID NO: 1961988 - protein, 10 aa, Staphylococcus
LDNTQQMDAK

SEQ ID NO: 1961989 - protein, 6 aa, Staphylococcus
LDNVQS

SEQ ID NO: 1961990 - protein, 13 aa, Staphylococcus
LDPAETPGTGTRV

SEQ ID NO: 1961991 - protein, 6 aa, Staphylococcus
LDPANN

SEQ ID NO: 1961992 - protein, 10 aa, Staphylococcus
LDPDKMTSTD

SEQ ID NO: 1961993 - protein, 6 aa, Staphylococcus
LDPDQG

SEQ ID NO: 1961994 - protein, 9 aa, Staphylococcus
LDPDRAREF

SEQ ID NO: 1961995 - protein, 6 aa, Staphylococcus
LDPDRP

SEQ ID NO: 1961996 - protein, 6 aa, Staphylococcus
LDPEIA

SEQ ID NO: 1961997 - protein, 7 aa, Staphylococcus
LDPEKRF

SEQ ID NO: 1961998 - protein, 9 aa, Staphylococcus
LDPENKENL

SEQ ID NO: 1961999 - protein, 6 aa, Staphylococcus
LDPEQG

SEQ ID NO: 1962000 - protein, 7 aa, Staphylococcus
LDPEQRF

SEQ ID NO: 1962001 - protein, 20 aa, Staphylococcus
LDPERAREYHDETLPKESAK

SEQ ID NO: 1962002 - protein, 7 aa, Staphylococcus
LDPETEK

SEQ ID NO: 1962003 - protein, 11 aa, Staphylococcus
LDPEVANDFDN

SEQ ID NO: 1962004 - protein, 5 aa, Staphylococcus
LDPEY

SEQ ID NO: 1962005 - protein, 11 aa, Staphylococcus
LDPKGDSKPDW

SEQ ID NO: 1962006 - protein, 9 aa, Staphylococcus
LDPKLAAKR

SEQ ID NO: 1962007 - protein, 6 aa, Staphylococcus
LDPKYQ

SEQ ID NO: 1962008 - protein, 5 aa, Staphylococcus
LDPLE

SEQ ID NO: 1962009 - protein, 6 aa, Staphylococcus
LDPNDG

SEQ ID NO: 1962010 - protein, 7 aa, Staphylococcus
LDPNKPT

SEQ ID NO: 1962011 - protein, 6 aa, Staphylococcus
LDPNRP

SEQ ID NO: 1962012 - protein, 9 aa, Staphylococcus
LDPNVANQF

SEQ ID NO: 1962013 - protein, 7 aa, Staphylococcus
LDPQNGA

SEQ ID NO: 1962014 - protein, 5 aa, Staphylococcus
LDPRM

SEQ ID NO: 1962015 - protein, 7 aa, Staphylococcus
LDPSETR

SEQ ID NO: 1962016 - protein, 6 aa, Staphylococcus
LDPSFS

SEQ ID NO: 1962017 - protein, 12 aa, Staphylococcus
LDPTETPGTGTR

SEQ ID NO: 1962018 - protein, 5 aa, Staphylococcus
LDPTI

SEQ ID NO: 1962019 - protein, 12 aa, Staphylococcus
LDPTKSPSVNAQ

SEQ ID NO: 1962020 - protein, 4 aa, Staphylococcus
LDPV

SEQ ID NO: 1962021 - protein, 10 aa, Staphylococcus
LDQATRQSVA

SEQ ID NO: 1962022 - protein, 8 aa, Staphylococcus
LDQEEITR

SEQ ID NO: 1962023 - protein, 9 aa, Staphylococcus
LDQEKIEKE

SEQ ID NO: 1962024 - protein, 9 aa, Staphylococcus
LDQESPFDR

SEQ ID NO: 1962025 - protein, 10 aa, Staphylococcus
LDQFKSNEIA

SEQ ID NO: 1962026 - protein, 6 aa, Staphylococcus
LDQGEH

SEQ ID NO: 1962027 - protein, 5 aa, Staphylococcus
LDQGG

SEQ ID NO: 1962028 - protein, 6 aa, Staphylococcus
LDQGGR

SEQ ID NO: 1962029 - protein, 14 aa, Staphylococcus
LDQGRDKAQKASFK

SEQ ID NO: 1962030 - protein, 13 aa, Staphylococcus
LDQKPAKAKRGTD

SEQ ID NO: 1962031 - protein, 13 aa, Staphylococcus
LDQLKDNSNQGVS

SEQ ID NO: 1962032 - protein, 15 aa, Staphylococcus
LDQQDEMGFTQKSPR

SEQ ID NO: 1962033 - protein, 15 aa, Staphylococcus
LDQQEEMGYTQKSPR

SEQ ID NO: 1962034 - protein, 6 aa, Staphylococcus
LDQQGA

SEQ ID NO: 1962035 - protein, 10 aa, Staphylococcus
LDQQGLNKYD

SEQ ID NO: 1962036 - protein, 9 aa, Staphylococcus
LDQQGPKGV

SEQ ID NO: 1962037 - protein, 5 aa, Staphylococcus
LDQQK

SEQ ID NO: 1962038 - protein, 6 aa, Staphylococcus
LDQQKD

SEQ ID NO: 1962039 - protein, 11 aa, Staphylococcus
LDQQSSHANEI

SEQ ID NO: 1962040 - protein, 4 aa, Staphylococcus
LDQS

SEQ ID NO: 1962041 - protein, 5 aa, Staphylococcus
LDQSD

SEQ ID NO: 1962042 - protein, 6 aa, Staphylococcus
LDQTLD

SEQ ID NO: 1962043 - protein, 6 aa, Staphylococcus
LDRDGV

SEQ ID NO: 1962044 - protein, 16 aa, Staphylococcus
LDRDKVSRIGSTFGKT

SEQ ID NO: 1962045 - protein, 9 aa, Staphylococcus
LDRDTSKLE

SEQ ID NO: 1962046 - protein, 16 aa, Staphylococcus
LDRDTSKLEKVTTPFP

SEQ ID NO: 1962047 - protein, 6 aa, Staphylococcus
LDREKY

SEQ ID NO: 1962048 - protein, 5 aa, Staphylococcus
LDRES

SEQ ID NO: 1962049 - protein, 11 aa, Staphylococcus
LDRKSDKLKTY

SEQ ID NO: 1962050 - protein, 5 aa, Staphylococcus
LDRNH

SEQ ID NO: 1962051 - protein, 21 aa, Staphylococcus
LDRNKDKKVQLEKNKDSIEKL

SEQ ID NO: 1962052 - protein, 5 aa, Staphylococcus
LDRPG

SEQ ID NO: 1962053 - protein, 19 aa, Staphylococcus
LDRPGDESSHERHNAGTGH

SEQ ID NO: 1962054 - protein, 9 aa, Staphylococcus
LDRQGNEVN

SEQ ID NO: 1962055 - protein, 7 aa, Staphylococcus
LDRRGNE

SEQ ID NO: 1962056 - protein, 6 aa, Staphylococcus
LDRSEQ

SEQ ID NO: 1962057 - protein, 26 aa, Staphylococcus
LDRSGYNPVDKQEIETNATVQFNDDI

SEQ ID NO: 1962058 - protein, 7 aa, Staphylococcus
LDRSSSL

SEQ ID NO: 1962059 - protein, 6 aa, Staphylococcus
LDRSVR

SEQ ID NO: 1962060 - protein, 4 aa, Staphylococcus
LDRV

SEQ ID NO: 1962061 - protein, 7 aa, Staphylococcus
LDSAVGQ

SEQ ID NO: 1962062 - protein, 8 aa, Staphylococcus
LDSDSPYL

SEQ ID NO: 1962063 - protein, 12 aa, Staphylococcus
LDSEDSRAGRWS

SEQ ID NO: 1962064 - protein, 8 aa, Staphylococcus
LDSEEDSL

SEQ ID NO: 1962065 - protein, 11 aa, Staphylococcus
LDSEKISTTSI

SEQ ID NO: 1962066 - protein, 6 aa, Staphylococcus
LDSEQY

SEQ ID NO: 1962067 - protein, 9 aa, Staphylococcus
LDSETDAKQ

SEQ ID NO: 1962068 - protein, 7 aa, Staphylococcus
LDSETDL

SEQ ID NO: 1962069 - protein, 9 aa, Staphylococcus
LDSETDPKQ

SEQ ID NO: 1962070 - protein, 24 aa, Staphylococcus
LDSGSVASPNRETEGMKDGSDAVG

SEQ ID NO: 1962071 - protein, 24 aa, Staphylococcus
LDSGSVASPNRETEGMQDGSDAVG

SEQ ID NO: 1962072 - protein, 24 aa, Staphylococcus
LDSGSVASPNRETEGMRDGSDAVG

SEQ ID NO: 1962073 - protein, 24 aa, Staphylococcus
LDSGSVASPNRETESMKDGSDAVG

SEQ ID NO: 1962074 - protein, 6 aa, Staphylococcus
LDSGTA

SEQ ID NO: 1962075 - protein, 4 aa, Staphylococcus
LDSH

SEQ ID NO: 1962076 - protein, 4 aa, Staphylococcus
LDSI

SEQ ID NO: 1962077 - protein, 19 aa, Staphylococcus
LDSIDDKVQNAVKNGAQLI

SEQ ID NO: 1962078 - protein, 15 aa, Staphylococcus
LDSIDNKVQEAIKNG

SEQ ID NO: 1962079 - protein, 23 aa, Staphylococcus
LDSISKKHFKNRDKAWTLVNKKY

SEQ ID NO: 1962080 - protein, 16 aa, Staphylococcus
LDSKNISRIGSTFGKT

SEQ ID NO: 1962081 - protein, 12 aa, Staphylococcus
LDSKTTKTCRGL

SEQ ID NO: 1962082 - protein, 10 aa, Staphylococcus
LDSLPKNKDN

SEQ ID NO: 1962083 - protein, 4 aa, Staphylococcus
LDSN

SEQ ID NO: 1962084 - protein, 7 aa, Staphylococcus
LDSNQIQ

SEQ ID NO: 1962085 - protein, 8 aa, Staphylococcus
LDSPGDEI

SEQ ID NO: 1962086 - protein, 28 aa, Staphylococcus
LDSQSENEQLSESLSQPDHGFENSESDI

SEQ ID NO: 1962087 - protein, 14 aa, Staphylococcus
LDSRSFKSFSKPKW

SEQ ID NO: 1962088 - protein, 5 aa, Staphylococcus
LDSRV

SEQ ID NO: 1962089 - protein, 15 aa, Staphylococcus
LDSRVNEALSSNNDD

SEQ ID NO: 1962090 - protein, 6 aa, Staphylococcus
LDSTTA

SEQ ID NO: 1962091 - protein, 5 aa, Staphylococcus
LDTCP

SEQ ID NO: 1962092 - protein, 8 aa, Staphylococcus
LDTEDKRV

SEQ ID NO: 1962093 - protein, 5 aa, Staphylococcus
LDTEN

SEQ ID NO: 1962094 - protein, 4 aa, Staphylococcus
LDTF

SEQ ID NO: 1962095 - protein, 10 aa, Staphylococcus
LDTKEITSQR

SEQ ID NO: 1962096 - protein, 5 aa, Staphylococcus
LDTLE

SEQ ID NO: 1962097 - protein, 12 aa, Staphylococcus
LDTLNDKYDNDL

SEQ ID NO: 1962098 - protein, 10 aa, Staphylococcus
LDTLSGGEIQ

SEQ ID NO: 1962099 - protein, 7 aa, Staphylococcus
LDTMEKE

SEQ ID NO: 1962100 - protein, 6 aa, Staphylococcus
LDTNNP

SEQ ID NO: 1962101 - protein, 7 aa, Staphylococcus
LDTPPTS

SEQ ID NO: 1962102 - protein, 4 aa, Staphylococcus
LDTQ

SEQ ID NO: 1962103 - protein, 4 aa, Staphylococcus
LDTR

SEQ ID NO: 1962104 - protein, 6 aa, Staphylococcus
LDTRAL

SEQ ID NO: 1962105 - protein, 22 aa, Staphylococcus
LDTSGVDGRKQGRSLYGTKKPK

SEQ ID NO: 1962106 - protein, 22 aa, Staphylococcus
LDTSGVEGRMQSRSLYGTKRPK

SEQ ID NO: 1962107 - protein, 5 aa, Staphylococcus
LDTSK

SEQ ID NO: 1962108 - protein, 7 aa, Staphylococcus
LDTSKAH

SEQ ID NO: 1962109 - protein, 5 aa, Staphylococcus
LDTVN

SEQ ID NO: 1962110 - protein, 20 aa, Staphylococcus
LDTYEGEKGLFPSDQRHTAF

SEQ ID NO: 1962111 - protein, 7 aa, Staphylococcus
LDVPKQR

SEQ ID NO: 1962112 - protein, 4 aa, Staphylococcus
LDVS

SEQ ID NO: 1962113 - protein, 18 aa, Staphylococcus
LDVSSHQSAQSGRYTYQA

SEQ ID NO: 1962114 - protein, 15 aa, Staphylococcus
LDVSTQQLAQSGRYT

SEQ ID NO: 1962115 - protein, 9 aa, Staphylococcus
LDVTGAQYT

SEQ ID NO: 1962116 - protein, 8 aa, Staphylococcus
LDVTTHER

SEQ ID NO: 1962117 - protein, 25 aa, Staphylococcus
LDYEGDIGPSEVLGGSASEFSPTQL

SEQ ID NO: 1962118 - protein, 5 aa, Staphylococcus
LDYEK

SEQ ID NO: 1962119 - protein, 5 aa, Staphylococcus
LDYGA

SEQ ID NO: 1962120 - protein, 11 aa, Staphylococcus
LDYPGVGPEHS

SEQ ID NO: 1962121 - protein, 7 aa, Staphylococcus
LEAAPNE

SEQ ID NO: 1962122 - protein, 6 aa, Staphylococcus
LEADNP

SEQ ID NO: 1962123 - protein, 8 aa, Staphylococcus
LEAETSLT

SEQ ID NO: 1962124 - protein, 8 aa, Staphylococcus
LEAGDPVR

SEQ ID NO: 1962125 - protein, 10 aa, Staphylococcus
LEAGTQYRGA

SEQ ID NO: 1962126 - protein, 15 aa, Staphylococcus
LEAGTQYRGAYEENV

SEQ ID NO: 1962127 - protein, 4 aa, Staphylococcus
LEAK

SEQ ID NO: 1962128 - protein, 9 aa, Staphylococcus
LEAKEENQI

SEQ ID NO: 1962129 - protein, 10 aa, Staphylococcus
LEAKQLNNNP

SEQ ID NO: 1962130 - protein, 10 aa, Staphylococcus
LEAKRLRNDP

SEQ ID NO: 1962131 - protein, 5 aa, Staphylococcus
LEANK

SEQ ID NO: 1962132 - protein, 7 aa, Staphylococcus
LEAPHKA

SEQ ID NO: 1962133 - protein, 6 aa, Staphylococcus
LEAPTP

SEQ ID NO: 1962134 - protein, 11 aa, Staphylococcus
LEAQQKETYER

SEQ ID NO: 1962135 - protein, 4 aa, Staphylococcus
LEAR

SEQ ID NO: 1962136 - protein, 10 aa, Staphylococcus
LEASKNGKNW

SEQ ID NO: 1962137 - protein, 8 aa, Staphylococcus
LEASPKQF

SEQ ID NO: 1962138 - protein, 13 aa, Staphylococcus
LEASYDSVKHLLE

SEQ ID NO: 1962139 - protein, 5 aa, Staphylococcus
LEDAS

SEQ ID NO: 1962140 - protein, 11 aa, Staphylococcus
LEDDKDTLRRD

SEQ ID NO: 1962141 - protein, 18 aa, Staphylococcus
LEDDQRGLKSYTPEVDDD

SEQ ID NO: 1962142 - protein, 5 aa, Staphylococcus
LEDED

SEQ ID NO: 1962143 - protein, 6 aa, Staphylococcus
LEDEDR

SEQ ID NO: 1962144 - protein, 33 aa, Staphylococcus
LEDEKAKLADKKQDKKTLNKINDADNKIAKTQE

SEQ ID NO: 1962145 - protein, 15 aa, Staphylococcus
LEDEKVTVRDRDTME

SEQ ID NO: 1962146 - protein, 5 aa, Staphylococcus
LEDEN

SEQ ID NO: 1962147 - protein, 7 aa, Staphylococcus
LEDENRV

SEQ ID NO: 1962148 - protein, 9 aa, Staphylococcus
LEDESENKN

SEQ ID NO: 1962149 - protein, 8 aa, Staphylococcus
LEDESREA

SEQ ID NO: 1962150 - protein, 8 aa, Staphylococcus
LEDGAGAA

SEQ ID NO: 1962151 - protein, 6 aa, Staphylococcus
LEDGSV

SEQ ID NO: 1962152 - protein, 4 aa, Staphylococcus
LEDH

SEQ ID NO: 1962153 - protein, 14 aa, Staphylococcus
LEDITETKPRTRIP

SEQ ID NO: 1962154 - protein, 4 aa, Staphylococcus
LEDK

SEQ ID NO: 1962155 - protein, 19 aa, Staphylococcus
LEDKANVYPSQLSGGQKQR

SEQ ID NO: 1962156 - protein, 11 aa, Staphylococcus
LEDKEGTSKIE

SEQ ID NO: 1962157 - protein, 9 aa, Staphylococcus
LEDKVQDSE

SEQ ID NO: 1962158 - protein, 13 aa, Staphylococcus
LEDKYRSDEWNYR

SEQ ID NO: 1962159 - protein, 9 aa, Staphylococcus
LEDNNGNRI

SEQ ID NO: 1962160 - protein, 14 aa, Staphylococcus
LEDNNSGRIVIDFN

SEQ ID NO: 1962161 - protein, 8 aa, Staphylococcus
LEDNPDLT

SEQ ID NO: 1962162 - protein, 15 aa, Staphylococcus
LEDNQVTVRDRDSMD

SEQ ID NO: 1962163 - protein, 15 aa, Staphylococcus
LEDNQVTVRDRDSME

SEQ ID NO: 1962164 - protein, 9 aa, Staphylococcus
LEDNSENKN

SEQ ID NO: 1962165 - protein, 5 aa, Staphylococcus
LEDPD

SEQ ID NO: 1962166 - protein, 4 aa, Staphylococcus
LEDQ

SEQ ID NO: 1962167 - protein, 8 aa, Staphylococcus
LEDQDRYQ

SEQ ID NO: 1962168 - protein, 4 aa, Staphylococcus
LEDR

SEQ ID NO: 1962169 - protein, 11 aa, Staphylococcus
LEDRKTRLVGP

SEQ ID NO: 1962170 - protein, 8 aa, Staphylococcus
LEDSKGRL

SEQ ID NO: 1962171 - protein, 6 aa, Staphylococcus
LEDSNY

SEQ ID NO: 1962172 - protein, 13 aa, Staphylococcus
LEDSRKPSNTKEL

SEQ ID NO: 1962173 - protein, 8 aa, Staphylococcus
LEDSYENM

SEQ ID NO: 1962174 - protein, 9 aa, Staphylococcus
LEDTPDEAD

SEQ ID NO: 1962175 - protein, 6 aa, Staphylococcus
LEDTRS

SEQ ID NO: 1962176 - protein, 5 aa, Staphylococcus
LEDTV

SEQ ID NO: 1962177 - protein, 16 aa, Staphylococcus
LEDYHAKGYASGFEES

SEQ ID NO: 1962178 - protein, 17 aa, Staphylococcus
LEDYHANGYASGFEESD

SEQ ID NO: 1962179 - protein, 16 aa, Staphylococcus
LEDYHSKGYASGFEES

SEQ ID NO: 1962180 - protein, 11 aa, Staphylococcus
LEDYSKEYPEL

SEQ ID NO: 1962181 - protein, 14 aa, Staphylococcus
LEEADKLREENPEQ

SEQ ID NO: 1962182 - protein, 7 aa, Staphylococcus
LEEAGAE

SEQ ID NO: 1962183 - protein, 6 aa, Staphylococcus
LEEDEI

SEQ ID NO: 1962184 - protein, 7 aa, Staphylococcus
LEEDPDV

SEQ ID NO: 1962185 - protein, 6 aa, Staphylococcus
LEEDTE

SEQ ID NO: 1962186 - protein, 4 aa, Staphylococcus
LEEE

SEQ ID NO: 1962187 - protein, 13 aa, Staphylococcus
LEEEDPKEIQASK

SEQ ID NO: 1962188 - protein, 6 aa, Staphylococcus
LEEEDV

SEQ ID NO: 1962189 - protein, 6 aa, Staphylococcus
LEEENR

SEQ ID NO: 1962190 - protein, 7 aa, Staphylococcus
LEEENRR

SEQ ID NO: 1962191 - protein, 15 aa, Staphylococcus
LEEERANLKNEGYEV

SEQ ID NO: 1962192 - protein, 8 aa, Staphylococcus
LEEGPNKT

SEQ ID NO: 1962193 - protein, 6 aa, Staphylococcus
LEEHGE

SEQ ID NO: 1962194 - protein, 8 aa, Staphylococcus
LEEKDKNH

SEQ ID NO: 1962195 - protein, 19 aa, Staphylococcus
LEEKEELSKPQNKVKHKFF

SEQ ID NO: 1962196 - protein, 13 aa, Staphylococcus
LEEKRVRAAVVEV

SEQ ID NO: 1962197 - protein, 13 aa, Staphylococcus
LEEKYRSDDWMFR

SEQ ID NO: 1962198 - protein, 6 aa, Staphylococcus
LEELGA

SEQ ID NO: 1962199 - protein, 5 aa, Staphylococcus
LEELP

SEQ ID NO: 1962200 - protein, 4 aa, Staphylococcus
LEEN

SEQ ID NO: 1962201 - protein, 8 aa, Staphylococcus
LEENAEME

SEQ ID NO: 1962202 - protein, 8 aa, Staphylococcus
LEENEKTA

SEQ ID NO: 1962203 - protein, 6 aa, Staphylococcus
LEENES

SEQ ID NO: 1962204 - protein, 13 aa, Staphylococcus
LEENNKAIEILSA

SEQ ID NO: 1962205 - protein, 8 aa, Staphylococcus
LEEPNQDG

SEQ ID NO: 1962206 - protein, 8 aa, Staphylococcus
LEEPNSQN

SEQ ID NO: 1962207 - protein, 6 aa, Staphylococcus
LEEPPS

SEQ ID NO: 1962208 - protein, 6 aa, Staphylococcus
LEEQAE

SEQ ID NO: 1962209 - protein, 15 aa, Staphylococcus
LEEQEELGYTQKSPR

SEQ ID NO: 1962210 - protein, 8 aa, Staphylococcus
LEEQGLTT

SEQ ID NO: 1962211 - protein, 9 aa, Staphylococcus
LEEQHQETT

SEQ ID NO: 1962212 - protein, 21 aa, Staphylococcus
LEEQRSSVEAEKLRQEYSKQH

SEQ ID NO: 1962213 - protein, 17 aa, Staphylococcus
LEEQSEVYKNNADRALK

SEQ ID NO: 1962214 - protein, 21 aa, Staphylococcus
LEEQSSKINNNKVESYSNEKF

SEQ ID NO: 1962215 - protein, 7 aa, Staphylococcus
LEEQYGR

SEQ ID NO: 1962216 - protein, 8 aa, Staphylococcus
LEERGYNA

SEQ ID NO: 1962217 - protein, 6 aa, Staphylococcus
LEERNI

SEQ ID NO: 1962218 - protein, 5 aa, Staphylococcus
LEERP

SEQ ID NO: 1962219 - protein, 8 aa, Staphylococcus
LEERPDVA

SEQ ID NO: 1962220 - protein, 6 aa, Staphylococcus
LEESES

SEQ ID NO: 1962221 - protein, 10 aa, Staphylococcus
LEESNLTTAE

SEQ ID NO: 1962222 - protein, 7 aa, Staphylococcus
LEESQIK

SEQ ID NO: 1962223 - protein, 13 aa, Staphylococcus
LEESRKPTNTKEL

SEQ ID NO: 1962224 - protein, 4 aa, Staphylococcus
LEET

SEQ ID NO: 1962225 - protein, 13 aa, Staphylococcus
LEETSKKPLGKRE

SEQ ID NO: 1962226 - protein, 7 aa, Staphylococcus
LEGAERE

SEQ ID NO: 1962227 - protein, 7 aa, Staphylococcus
LEGAGLN

SEQ ID NO: 1962228 - protein, 10 aa, Staphylococcus
LEGDSIKSSY

SEQ ID NO: 1962229 - protein, 13 aa, Staphylococcus
LEGEQDETYENFK

SEQ ID NO: 1962230 - protein, 16 aa, Staphylococcus
LEGETYKLEANDGQHH

SEQ ID NO: 1962231 - protein, 4 aa, Staphylococcus
LEGF

SEQ ID NO: 1962232 - protein, 4 aa, Staphylococcus
LEGG

SEQ ID NO: 1962233 - protein, 14 aa, Staphylococcus
LEGGTASFATSSGM

SEQ ID NO: 1962234 - protein, 7 aa, Staphylococcus
LEGKEND

SEQ ID NO: 1962235 - protein, 14 aa, Staphylococcus
LEGKGVSEAARQTI

SEQ ID NO: 1962236 - protein, 9 aa, Staphylococcus
LEGKTNRKA

SEQ ID NO: 1962237 - protein, 4 aa, Staphylococcus
LEGN

SEQ ID NO: 1962238 - protein, 5 aa, Staphylococcus
LEGNT

SEQ ID NO: 1962239 - protein, 44 aa, Staphylococcus
LEGNTKNSEGLFDSEATSNEAASAEIESSEDDVRETEHAKPHRR

SEQ ID NO: 1962240 - protein, 5 aa, Staphylococcus
LEGNY

SEQ ID NO: 1962241 - protein, 10 aa, Staphylococcus
LEGPTEATSK

SEQ ID NO: 1962242 - protein, 5 aa, Staphylococcus
LEGQP

SEQ ID NO: 1962243 - protein, 7 aa, Staphylococcus
LEGQPEG

SEQ ID NO: 1962244 - protein, 9 aa, Staphylococcus
LEGQPTNEF

SEQ ID NO: 1962245 - protein, 40 aa, Staphylococcus
LEGQQGVSNEEVAAEQNIDLDEKEEAKDAETTEENTSVES

SEQ ID NO: 1962246 - protein, 5 aa, Staphylococcus
LEGQS

SEQ ID NO: 1962247 - protein, 5 aa, Staphylococcus
LEGRK

SEQ ID NO: 1962248 - protein, 11 aa, Staphylococcus
LEGRKTRLVGP

SEQ ID NO: 1962249 - protein, 12 aa, Staphylococcus
LEGSISENVETY

SEQ ID NO: 1962250 - protein, 9 aa, Staphylococcus
LEGSKFSKS

SEQ ID NO: 1962251 - protein, 9 aa, Staphylococcus
LEGTAKSIG

SEQ ID NO: 1962252 - protein, 5 aa, Staphylococcus
LEGTH

SEQ ID NO: 1962253 - protein, 12 aa, Staphylococcus
LEGTVSDNVETY

SEQ ID NO: 1962254 - protein, 5 aa, Staphylococcus
LEHGN

SEQ ID NO: 1962255 - protein, 17 aa, Staphylococcus
LEINPNSKKSKTKYQQL

SEQ ID NO: 1962256 - protein, 14 aa, Staphylococcus
LEKAKNGEIQDDYI

SEQ ID NO: 1962257 - protein, 9 aa, Staphylococcus
LEKANTLKE

SEQ ID NO: 1962258 - protein, 14 aa, Staphylococcus
LEKAQEAKEAGKPL

SEQ ID NO: 1962259 - protein, 14 aa, Staphylococcus
LEKATYENMTIYDY

SEQ ID NO: 1962260 - protein, 6 aa, Staphylococcus
LEKDEK

SEQ ID NO: 1962261 - protein, 11 aa, Staphylococcus
LEKDGTETTDQ

SEQ ID NO: 1962262 - protein, 10 aa, Staphylococcus
LEKDKADAAT

SEQ ID NO: 1962263 - protein, 9 aa, Staphylococcus
LEKDNNAPF

SEQ ID NO: 1962264 - protein, 4 aa, Staphylococcus
LEKE

SEQ ID NO: 1962265 - protein, 5 aa, Staphylococcus
LEKED

SEQ ID NO: 1962266 - protein, 8 aa, Staphylococcus
LEKEHPNG

SEQ ID NO: 1962267 - protein, 7 aa, Staphylococcus
LEKETGV

SEQ ID NO: 1962268 - protein, 15 aa, Staphylococcus
LEKFEGNYDYIKEKM

SEQ ID NO: 1962269 - protein, 8 aa, Staphylococcus
LEKGDYVR

SEQ ID NO: 1962270 - protein, 14 aa, Staphylococcus
LEKGGFDFNNEGHE

SEQ ID NO: 1962271 - protein, 15 aa, Staphylococcus
LEKGNLDQYEITGQG

SEQ ID NO: 1962272 - protein, 9 aa, Staphylococcus
LEKLDPDAE

SEQ ID NO: 1962273 - protein, 9 aa, Staphylococcus
LEKLDPEAE

SEQ ID NO: 1962274 - protein, 13 aa, Staphylococcus
LEKLSNKALSEIR

SEQ ID NO: 1962275 - protein, 13 aa, Staphylococcus
LEKLSNRELSEIR

SEQ ID NO: 1962276 - protein, 8 aa, Staphylococcus
LEKNPAYE

SEQ ID NO: 1962277 - protein, 9 aa, Staphylococcus
LEKNPDEST

SEQ ID NO: 1962278 - protein, 8 aa, Staphylococcus
LEKPEIAE

SEQ ID NO: 1962279 - protein, 5 aa, Staphylococcus
LEKPR

SEQ ID NO: 1962280 - protein, 5 aa, Staphylococcus
LEKQG

SEQ ID NO: 1962281 - protein, 11 aa, Staphylococcus
LEKRESLNQNI

SEQ ID NO: 1962282 - protein, 12 aa, Staphylococcus
LEKRESTGQEVD

SEQ ID NO: 1962283 - protein, 8 aa, Staphylococcus
LEKRETTL

SEQ ID NO: 1962284 - protein, 11 aa, Staphylococcus
LEKSAKELDEM

SEQ ID NO: 1962285 - protein, 5 aa, Staphylococcus
LEKSG

SEQ ID NO: 1962286 - protein, 8 aa, Staphylococcus
LEKSGTQE

SEQ ID NO: 1962287 - protein, 10 aa, Staphylococcus
LEKSSNSAHP

SEQ ID NO: 1962288 - protein, 20 aa, Staphylococcus
LEKSVKKQIRNNRMSQDPHR

SEQ ID NO: 1962289 - protein, 4 aa, Staphylococcus
LEKT

SEQ ID NO: 1962290 - protein, 9 aa, Staphylococcus
LEKTKEPTN

SEQ ID NO: 1962291 - protein, 15 aa, Staphylococcus
LEKTKKKKEKPAKMV

SEQ ID NO: 1962292 - protein, 24 aa, Staphylococcus
LEKTKKKKEKPSKMVTRQNRQTIK

SEQ ID NO: 1962293 - protein, 25 aa, Staphylococcus
LEKTKKKKEKPTKMVTRQNRQTIKT

SEQ ID NO: 1962294 - protein, 14 aa, Staphylococcus
LEKTKKTKSEPTKM

SEQ ID NO: 1962295 - protein, 14 aa, Staphylococcus
LEKTRNGEIQDDYI

SEQ ID NO: 1962296 - protein, 7 aa, Staphylococcus
LELEEED

SEQ ID NO: 1962297 - protein, 19 aa, Staphylococcus
LELENSKDNDDSQTRQVDP

SEQ ID NO: 1962298 - protein, 7 aa, Staphylococcus
LELEPED

SEQ ID NO: 1962299 - protein, 12 aa, Staphylococcus
LELQDDGTVKGL

SEQ ID NO: 1962300 - protein, 9 aa, Staphylococcus
LELTDDDYL

SEQ ID NO: 1962301 - protein, 7 aa, Staphylococcus
LENAAEA

SEQ ID NO: 1962302 - protein, 8 aa, Staphylococcus
LENAEKEF

SEQ ID NO: 1962303 - protein, 6 aa, Staphylococcus
LENANR

SEQ ID NO: 1962304 - protein, 5 aa, Staphylococcus
LENDA

SEQ ID NO: 1962305 - protein, 10 aa, Staphylococcus
LENDETRQTF

SEQ ID NO: 1962306 - protein, 7 aa, Staphylococcus
LENDNQL

SEQ ID NO: 1962307 - protein, 7 aa, Staphylococcus
LENDPDV

SEQ ID NO: 1962308 - protein, 6 aa, Staphylococcus
LENDTD

SEQ ID NO: 1962309 - protein, 4 aa, Staphylococcus
LENE

SEQ ID NO: 1962310 - protein, 8 aa, Staphylococcus
LENEDEIK

SEQ ID NO: 1962311 - protein, 5 aa, Staphylococcus
LENEE

SEQ ID NO: 1962312 - protein, 7 aa, Staphylococcus
LENEESI

SEQ ID NO: 1962313 - protein, 15 aa, Staphylococcus
LENEGYEWVKEEFSE

SEQ ID NO: 1962314 - protein, 15 aa, Staphylococcus
LENEQEGKQMSDREK

SEQ ID NO: 1962315 - protein, 10 aa, Staphylococcus
LENERIKDDD

SEQ ID NO: 1962316 - protein, 9 aa, Staphylococcus
LENESDRRA

SEQ ID NO: 1962317 - protein, 17 aa, Staphylococcus
LENGADGAVMSGSGPTV

SEQ ID NO: 1962318 - protein, 10 aa, Staphylococcus
LENGPGTGNV

SEQ ID NO: 1962319 - protein, 12 aa, Staphylococcus
LENKDKSETERL

SEQ ID NO: 1962320 - protein, 12 aa, Staphylococcus
LENKKDSKWNDG

SEQ ID NO: 1962321 - protein, 9 aa, Staphylococcus
LENKPKKAL

SEQ ID NO: 1962322 - protein, 9 aa, Staphylococcus
LENKRTKND

SEQ ID NO: 1962323 - protein, 4 aa, Staphylococcus
LENN

SEQ ID NO: 1962324 - protein, 8 aa, Staphylococcus
LENNGVDS

SEQ ID NO: 1962325 - protein, 13 aa, Staphylococcus
LENNKDGDYDKNA

SEQ ID NO: 1962326 - protein, 10 aa, Staphylococcus
LENNKRKFPT

SEQ ID NO: 1962327 - protein, 9 aa, Staphylococcus
LENNKTEKD

SEQ ID NO: 1962328 - protein, 9 aa, Staphylococcus
LENNKTEND

SEQ ID NO: 1962329 - protein, 10 aa, Staphylococcus
LENNKTENDY

SEQ ID NO: 1962330 - protein, 14 aa, Staphylococcus
LENNSYKKESESIK

SEQ ID NO: 1962331 - protein, 9 aa, Staphylococcus
LENSEFENF

SEQ ID NO: 1962332 - protein, 6 aa, Staphylococcus
LENSNA

SEQ ID NO: 1962333 - protein, 16 aa, Staphylococcus
LENSSGKLQVDSTEVT

SEQ ID NO: 1962334 - protein, 29 aa, Staphylococcus
LENSTSSNSSLLEQEDIKGTISKTPSRRV

SEQ ID NO: 1962335 - protein, 7 aa, Staphylococcus
LENTENK

SEQ ID NO: 1962336 - protein, 8 aa, Staphylococcus
LENTPNQL

SEQ ID NO: 1962337 - protein, 12 aa, Staphylococcus
LENTSDMKSQLN

SEQ ID NO: 1962338 - protein, 6 aa, Staphylococcus
LENTSK

SEQ ID NO: 1962339 - protein, 9 aa, Staphylococcus
LENVQEAEN

SEQ ID NO: 1962340 - protein, 6 aa, Staphylococcus
LENVSN

SEQ ID NO: 1962341 - protein, 9 aa, Staphylococcus
LEPAEDEPI

SEQ ID NO: 1962342 - protein, 20 aa, Staphylococcus
LEPDTAYDSHGVYSGSAFEY

SEQ ID NO: 1962343 - protein, 6 aa, Staphylococcus
LEPGDK

SEQ ID NO: 1962344 - protein, 11 aa, Staphylococcus
LEPGGKHHRYG

SEQ ID NO: 1962345 - protein, 9 aa, Staphylococcus
LEPGKLDEI

SEQ ID NO: 1962346 - protein, 5 aa, Staphylococcus
LEPGN

SEQ ID NO: 1962347 - protein, 8 aa, Staphylococcus
LEPGNLNE

SEQ ID NO: 1962348 - protein, 5 aa, Staphylococcus
LEPGR

SEQ ID NO: 1962349 - protein, 5 aa, Staphylococcus
LEPGS

SEQ ID NO: 1962350 - protein, 6 aa, Staphylococcus
LEPGTY

SEQ ID NO: 1962351 - protein, 6 aa, Staphylococcus
LEPLAS

SEQ ID NO: 1962352 - protein, 11 aa, Staphylococcus
LEPNDKNQVRM

SEQ ID NO: 1962353 - protein, 6 aa, Staphylococcus
LEPPEE

SEQ ID NO: 1962354 - protein, 7 aa, Staphylococcus
LEPPEEL

SEQ ID NO: 1962355 - protein, 7 aa, Staphylococcus
LEPPNEL

SEQ ID NO: 1962356 - protein, 6 aa, Staphylococcus
LEPQVT

SEQ ID NO: 1962357 - protein, 8 aa, Staphylococcus
LEPSDSEP

SEQ ID NO: 1962358 - protein, 15 aa, Staphylococcus
LEPSSEVHSEKARSL

SEQ ID NO: 1962359 - protein, 7 aa, Staphylococcus
LEPYTED

SEQ ID NO: 1962360 - protein, 6 aa, Staphylococcus
LEPYVT

SEQ ID NO: 1962361 - protein, 14 aa, Staphylococcus
LEQALRDSDEYKAI

SEQ ID NO: 1962362 - protein, 24 aa, Staphylococcus
LEQDDSDSLRITEKSGISFIYTLE

SEQ ID NO: 1962363 - protein, 9 aa, Staphylococcus
LEQDKESLQ

SEQ ID NO: 1962364 - protein, 10 aa, Staphylococcus
LEQDVDNPHA

SEQ ID NO: 1962365 - protein, 5 aa, Staphylococcus
LEQED

SEQ ID NO: 1962366 - protein, 24 aa, Staphylococcus
LEQEESESLRITESSGISFIFTLE

SEQ ID NO: 1962367 - protein, 7 aa, Staphylococcus
LEQEESI

SEQ ID NO: 1962368 - protein, 5 aa, Staphylococcus
LEQEI

SEQ ID NO: 1962369 - protein, 6 aa, Staphylococcus
LEQFDS

SEQ ID NO: 1962370 - protein, 8 aa, Staphylococcus
LEQGESGF

SEQ ID NO: 1962371 - protein, 15 aa, Staphylococcus
LEQGKLEAYQVAGQG

SEQ ID NO: 1962372 - protein, 14 aa, Staphylococcus
LEQGPTVSTDEAAE

SEQ ID NO: 1962373 - protein, 10 aa, Staphylococcus
LEQKKDQDHY

SEQ ID NO: 1962374 - protein, 4 aa, Staphylococcus
LEQL

SEQ ID NO: 1962375 - protein, 12 aa, Staphylococcus
LEQPDDKGIGKL

SEQ ID NO: 1962376 - protein, 6 aa, Staphylococcus
LEQPDE

SEQ ID NO: 1962377 - protein, 6 aa, Staphylococcus
LEQPEE

SEQ ID NO: 1962378 - protein, 8 aa, Staphylococcus
LEQPTGQI

SEQ ID NO: 1962379 - protein, 15 aa, Staphylococcus
LEQQDEMGFTQKSPR

SEQ ID NO: 1962380 - protein, 15 aa, Staphylococcus
LEQQETLGFTQKSPR

SEQ ID NO: 1962381 - protein, 5 aa, Staphylococcus
LEQQL

SEQ ID NO: 1962382 - protein, 6 aa, Staphylococcus
LEQQQE

SEQ ID NO: 1962383 - protein, 9 aa, Staphylococcus
LEQQSDESC

SEQ ID NO: 1962384 - protein, 9 aa, Staphylococcus
LEQRDKEIT

SEQ ID NO: 1962385 - protein, 16 aa, Staphylococcus
LEQREKGHSIDEQERK

SEQ ID NO: 1962386 - protein, 14 aa, Staphylococcus
LEQRKSERKPFKAK

SEQ ID NO: 1962387 - protein, 5 aa, Staphylococcus
LEQSA

SEQ ID NO: 1962388 - protein, 14 aa, Staphylococcus
LEQSAYRNMTIYDF

SEQ ID NO: 1962389 - protein, 6 aa, Staphylococcus
LEQSDS

SEQ ID NO: 1962390 - protein, 9 aa, Staphylococcus
LEQSKDNDI

SEQ ID NO: 1962391 - protein, 8 aa, Staphylococcus
LEQSLKEG

SEQ ID NO: 1962392 - protein, 16 aa, Staphylococcus
LEQSRYENMTIYDFIE

SEQ ID NO: 1962393 - protein, 7 aa, Staphylococcus
LEQSSAK

SEQ ID NO: 1962394 - protein, 14 aa, Staphylococcus
LEQSSYRNMTIYDF

SEQ ID NO: 1962395 - protein, 5 aa, Staphylococcus
LEQTD

SEQ ID NO: 1962396 - protein, 12 aa, Staphylococcus
LEQTENKNSHLT

SEQ ID NO: 1962397 - protein, 6 aa, Staphylococcus
LEQTPR

SEQ ID NO: 1962398 - protein, 6 aa, Staphylococcus
LEREDY

SEQ ID NO: 1962399 - protein, 5 aa, Staphylococcus
LEREG

SEQ ID NO: 1962400 - protein, 7 aa, Staphylococcus
LERERKK

SEQ ID NO: 1962401 - protein, 6 aa, Staphylococcus
LERETE

SEQ ID NO: 1962402 - protein, 8 aa, Staphylococcus
LERETKKI

SEQ ID NO: 1962403 - protein, 6 aa, Staphylococcus
LERKKG

SEQ ID NO: 1962404 - protein, 6 aa, Staphylococcus
LERLSN

SEQ ID NO: 1962405 - protein, 4 aa, Staphylococcus
LERP

SEQ ID NO: 1962406 - protein, 5 aa, Staphylococcus
LERQG

SEQ ID NO: 1962407 - protein, 11 aa, Staphylococcus
LERQSDKLQTY

SEQ ID NO: 1962408 - protein, 14 aa, Staphylococcus
LERQSEPGGGLNPK

SEQ ID NO: 1962409 - protein, 9 aa, Staphylococcus
LERQTDKLR

SEQ ID NO: 1962410 - protein, 6 aa, Staphylococcus
LERQVR

SEQ ID NO: 1962411 - protein, 6 aa, Staphylococcus
LERSEQ

SEQ ID NO: 1962412 - protein, 15 aa, Staphylococcus
LERSEYNNDARKGVQ

SEQ ID NO: 1962413 - protein, 12 aa, Staphylococcus
LERTNKDIAQPI

SEQ ID NO: 1962414 - protein, 4 aa, Staphylococcus
LERY

SEQ ID NO: 1962415 - protein, 5 aa, Staphylococcus
LERYP

SEQ ID NO: 1962416 - protein, 5 aa, Staphylococcus
LESAK

SEQ ID NO: 1962417 - protein, 10 aa, Staphylococcus
LESANKQPSY

SEQ ID NO: 1962418 - protein, 7 aa, Staphylococcus
LESASQP

SEQ ID NO: 1962419 - protein, 7 aa, Staphylococcus
LESDAPP

SEQ ID NO: 1962420 - protein, 7 aa, Staphylococcus
LESDDFD

SEQ ID NO: 1962421 - protein, 7 aa, Staphylococcus
LESDPEV

SEQ ID NO: 1962422 - protein, 5 aa, Staphylococcus
LESED

SEQ ID NO: 1962423 - protein, 7 aa, Staphylococcus
LESEDNI

SEQ ID NO: 1962424 - protein, 5 aa, Staphylococcus
LESEG

SEQ ID NO: 1962425 - protein, 10 aa, Staphylococcus
LESGEEADIK

SEQ ID NO: 1962426 - protein, 14 aa, Staphylococcus
LESGSTYMINFTYM

SEQ ID NO: 1962427 - protein, 13 aa, Staphylococcus
LESHNVNVEVVRH

SEQ ID NO: 1962428 - protein, 5 aa, Staphylococcus
LESKG

SEQ ID NO: 1962429 - protein, 9 aa, Staphylococcus
LESKSEDFK

SEQ ID NO: 1962430 - protein, 16 aa, Staphylococcus
LESKSGGKSGDYHRQL

SEQ ID NO: 1962431 - protein, 13 aa, Staphylococcus
LESKSGGKSGDYR

SEQ ID NO: 1962432 - protein, 13 aa, Staphylococcus
LESNEGKITAESV

SEQ ID NO: 1962433 - protein, 12 aa, Staphylococcus
LESNSKRVDEQR

SEQ ID NO: 1962434 - protein, 7 aa, Staphylococcus
LESPKNH

SEQ ID NO: 1962435 - protein, 6 aa, Staphylococcus
LESQGY

SEQ ID NO: 1962436 - protein, 8 aa, Staphylococcus
LESQSPTL

SEQ ID NO: 1962437 - protein, 8 aa, Staphylococcus
LESSAEEK

SEQ ID NO: 1962438 - protein, 8 aa, Staphylococcus
LESSESRY

SEQ ID NO: 1962439 - protein, 8 aa, Staphylococcus
LESSNGKT

SEQ ID NO: 1962440 - protein, 7 aa, Staphylococcus
LESSPRS

SEQ ID NO: 1962441 - protein, 5 aa, Staphylococcus
LESTE

SEQ ID NO: 1962442 - protein, 7 aa, Staphylococcus
LESTNQA

SEQ ID NO: 1962443 - protein, 18 aa, Staphylococcus
LESTSLPSITVDNEEAAY

SEQ ID NO: 1962444 - protein, 4 aa, Staphylococcus
LESV

SEQ ID NO: 1962445 - protein, 6 aa, Staphylococcus
LESVTK

SEQ ID NO: 1962446 - protein, 4 aa, Staphylococcus
LESY

SEQ ID NO: 1962447 - protein, 8 aa, Staphylococcus
LESYHSKG

SEQ ID NO: 1962448 - protein, 8 aa, Staphylococcus
LESYTTKL

SEQ ID NO: 1962449 - protein, 6 aa, Staphylococcus
LETAER

SEQ ID NO: 1962450 - protein, 4 aa, Staphylococcus
LETD

SEQ ID NO: 1962451 - protein, 6 aa, Staphylococcus
LETDGK

SEQ ID NO: 1962452 - protein, 10 aa, Staphylococcus
LETDGKLMTG

SEQ ID NO: 1962453 - protein, 5 aa, Staphylococcus
LETDL

SEQ ID NO: 1962454 - protein, 4 aa, Staphylococcus
LETE

SEQ ID NO: 1962455 - protein, 12 aa, Staphylococcus
LETEEDETYENF

SEQ ID NO: 1962456 - protein, 19 aa, Staphylococcus
LETEITKSKSKEEEYETQI

SEQ ID NO: 1962457 - protein, 9 aa, Staphylococcus
LETGKAKRD

SEQ ID NO: 1962458 - protein, 9 aa, Staphylococcus
LETGKIPTM

SEQ ID NO: 1962459 - protein, 15 aa, Staphylococcus
LETGKKFNNNKQALR

SEQ ID NO: 1962460 - protein, 4 aa, Staphylococcus
LETI

SEQ ID NO: 1962461 - protein, 7 aa, Staphylococcus
LETKDDG

SEQ ID NO: 1962462 - protein, 18 aa, Staphylococcus
LETNDISKSLNRGKHTTR

SEQ ID NO: 1962463 - protein, 7 aa, Staphylococcus
LETNNPV

SEQ ID NO: 1962464 - protein, 6 aa, Staphylococcus
LETNSD

SEQ ID NO: 1962465 - protein, 8 aa, Staphylococcus
LETNSITD

SEQ ID NO: 1962466 - protein, 6 aa, Staphylococcus
LETNTN

SEQ ID NO: 1962467 - protein, 12 aa, Staphylococcus
LETPDNGVITND

SEQ ID NO: 1962468 - protein, 30 aa, Staphylococcus
LETPDSGSINHDERTYYDSNQHTYVSPAER

SEQ ID NO: 1962469 - protein, 10 aa, Staphylococcus
LETPNGNGGV

SEQ ID NO: 1962470 - protein, 6 aa, Staphylococcus
LETPTI

SEQ ID NO: 1962471 - protein, 7 aa, Staphylococcus
LETQAED

SEQ ID NO: 1962472 - protein, 7 aa, Staphylococcus
LETQEED

SEQ ID NO: 1962473 - protein, 11 aa, Staphylococcus
LETRAKELDEM

SEQ ID NO: 1962474 - protein, 10 aa, Staphylococcus
LETRPSTKID

SEQ ID NO: 1962475 - protein, 7 aa, Staphylococcus
LETSEAT

SEQ ID NO: 1962476 - protein, 8 aa, Staphylococcus
LETSEAVE

SEQ ID NO: 1962477 - protein, 6 aa, Staphylococcus
LETSER

SEQ ID NO: 1962478 - protein, 12 aa, Staphylococcus
LETSEVRGKKVR

SEQ ID NO: 1962479 - protein, 4 aa, Staphylococcus
LETT

SEQ ID NO: 1962480 - protein, 18 aa, Staphylococcus
LETTSDKYKDINDVPDSI

SEQ ID NO: 1962481 - protein, 6 aa, Staphylococcus
LETYET

SEQ ID NO: 1962482 - protein, 18 aa, Staphylococcus
LEVEKQDVELTDEELQES

SEQ ID NO: 1962483 - protein, 7 aa, Staphylococcus
LEVKNES

SEQ ID NO: 1962484 - protein, 7 aa, Staphylococcus
LEVPEPV

SEQ ID NO: 1962485 - protein, 8 aa, Staphylococcus
LEVSDSSL

SEQ ID NO: 1962486 - protein, 11 aa, Staphylococcus
LEVSEGTAYRA

SEQ ID NO: 1962487 - protein, 4 aa, Staphylococcus
LEYE

SEQ ID NO: 1962488 - protein, 13 aa, Staphylococcus
LEYEEKRQEEELL

SEQ ID NO: 1962489 - protein, 13 aa, Staphylococcus
LEYEEKSQEEELL

SEQ ID NO: 1962490 - protein, 6 aa, Staphylococcus
LEYEKP

SEQ ID NO: 1962491 - protein, 7 aa, Staphylococcus
LEYGSPK

SEQ ID NO: 1962492 - protein, 4 aa, Staphylococcus
LEYQ

SEQ ID NO: 1962493 - protein, 12 aa, Staphylococcus
LFGESTVNIIDE

SEQ ID NO: 1962494 - protein, 10 aa, Staphylococcus
LFGNDSRDKF

SEQ ID NO: 1962495 - protein, 11 aa, Staphylococcus
LFSKESEPTGR

SEQ ID NO: 1962496 - protein, 18 aa, Staphylococcus
LFSNPSDKQTEDYISGRF

SEQ ID NO: 1962497 - protein, 10 aa, Staphylococcus
LFSSNADEDM

SEQ ID NO: 1962498 - protein, 11 aa, Staphylococcus
LGADQGIKQAV

SEQ ID NO: 1962499 - protein, 6 aa, Staphylococcus
LGAEDV

SEQ ID NO: 1962500 - protein, 7 aa, Staphylococcus
LGAEPPF

SEQ ID NO: 1962501 - protein, 11 aa, Staphylococcus
LGAETEGGLEA

SEQ ID NO: 1962502 - protein, 6 aa, Staphylococcus
LGAEVD

SEQ ID NO: 1962503 - protein, 7 aa, Staphylococcus
LGAGKTT

SEQ ID NO: 1962504 - protein, 16 aa, Staphylococcus
LGAKDRLVKSEDGNYT

SEQ ID NO: 1962505 - protein, 12 aa, Staphylococcus
LGAKDTIEDGQI

SEQ ID NO: 1962506 - protein, 10 aa, Staphylococcus
LGAKKESYPI

SEQ ID NO: 1962507 - protein, 8 aa, Staphylococcus
LGAKTFEQ

SEQ ID NO: 1962508 - protein, 4 aa, Staphylococcus
LGAP

SEQ ID NO: 1962509 - protein, 5 aa, Staphylococcus
LGAPL

SEQ ID NO: 1962510 - protein, 8 aa, Staphylococcus
LGAQAGAQ

SEQ ID NO: 1962511 - protein, 20 aa, Staphylococcus
LGAQGVDSHRIQTDYSKTSL

SEQ ID NO: 1962512 - protein, 4 aa, Staphylococcus
LGAY

SEQ ID NO: 1962513 - protein, 7 aa, Staphylococcus
LGDDRPE

SEQ ID NO: 1962514 - protein, 9 aa, Staphylococcus
LGDETDRSA

SEQ ID NO: 1962515 - protein, 16 aa, Staphylococcus
LGDGNKYNEQTTPRGY

SEQ ID NO: 1962516 - protein, 11 aa, Staphylococcus
LGDGQASDEYT

SEQ ID NO: 1962517 - protein, 11 aa, Staphylococcus
LGDGQSSDEYT

SEQ ID NO: 1962518 - protein, 11 aa, Staphylococcus
LGDGQSSNEYT

SEQ ID NO: 1962519 - protein, 4 aa, Staphylococcus
LGDK

SEQ ID NO: 1962520 - protein, 7 aa, Staphylococcus
LGDKDTV

SEQ ID NO: 1962521 - protein, 9 aa, Staphylococcus
LGDKKEEAT

SEQ ID NO: 1962522 - protein, 6 aa, Staphylococcus
LGDKKG

SEQ ID NO: 1962523 - protein, 11 aa, Staphylococcus
LGDKSREERYY

SEQ ID NO: 1962524 - protein, 4 aa, Staphylococcus
LGDN

SEQ ID NO: 1962525 - protein, 6 aa, Staphylococcus
LGDNRI

SEQ ID NO: 1962526 - protein, 7 aa, Staphylococcus
LGDPESI

SEQ ID NO: 1962527 - protein, 6 aa, Staphylococcus
LGDQEV

SEQ ID NO: 1962528 - protein, 8 aa, Staphylococcus
LGDSAETL

SEQ ID NO: 1962529 - protein, 10 aa, Staphylococcus
LGDTQNNEVS

SEQ ID NO: 1962530 - protein, 4 aa, Staphylococcus
LGDY

SEQ ID NO: 1962531 - protein, 4 aa, Staphylococcus
LGEA

SEQ ID NO: 1962532 - protein, 6 aa, Staphylococcus
LGEAKS

SEQ ID NO: 1962533 - protein, 6 aa, Staphylococcus
LGEASD

SEQ ID NO: 1962534 - protein, 7 aa, Staphylococcus
LGEDGSE

SEQ ID NO: 1962535 - protein, 11 aa, Staphylococcus
LGEDTDTVGSV

SEQ ID NO: 1962536 - protein, 4 aa, Staphylococcus
LGEE

SEQ ID NO: 1962537 - protein, 12 aa, Staphylococcus
LGEEAYEPQFGA

SEQ ID NO: 1962538 - protein, 14 aa, Staphylococcus
LGEEEQEVLNGEQV

SEQ ID NO: 1962539 - protein, 7 aa, Staphylococcus
LGEEEQK

SEQ ID NO: 1962540 - protein, 11 aa, Staphylococcus
LGEETKQEIAP

SEQ ID NO: 1962541 - protein, 5 aa, Staphylococcus
LGEGN

SEQ ID NO: 1962542 - protein, 18 aa, Staphylococcus
LGEGPLSPERAGSLPNDT

SEQ ID NO: 1962543 - protein, 11 aa, Staphylococcus
LGEGQSSDEYT

SEQ ID NO: 1962544 - protein, 7 aa, Staphylococcus
LGEGVCS

SEQ ID NO: 1962545 - protein, 19 aa, Staphylococcus
LGEGVNEEVKTSVKQAVET

SEQ ID NO: 1962546 - protein, 19 aa, Staphylococcus
LGEGVSDEVKASVKEAVET

SEQ ID NO: 1962547 - protein, 19 aa, Staphylococcus
LGEGVSEDVKSSVKNAVET

SEQ ID NO: 1962548 - protein, 6 aa, Staphylococcus
LGEHGE

SEQ ID NO: 1962549 - protein, 5 aa, Staphylococcus
LGEKK

SEQ ID NO: 1962550 - protein, 6 aa, Staphylococcus
LGEKKG

SEQ ID NO: 1962551 - protein, 6 aa, Staphylococcus
LGEKQG

SEQ ID NO: 1962552 - protein, 9 aa, Staphylococcus
LGENENRDA

SEQ ID NO: 1962553 - protein, 8 aa, Staphylococcus
LGENGITG

SEQ ID NO: 1962554 - protein, 5 aa, Staphylococcus
LGENQ

SEQ ID NO: 1962555 - protein, 11 aa, Staphylococcus
LGENSKVVQKR

SEQ ID NO: 1962556 - protein, 8 aa, Staphylococcus
LGEPERVA

SEQ ID NO: 1962557 - protein, 5 aa, Staphylococcus
LGEPI

SEQ ID NO: 1962558 - protein, 14 aa, Staphylococcus
LGEPIKDKQKGNVK

SEQ ID NO: 1962559 - protein, 11 aa, Staphylococcus
LGEPPHEGTQD

SEQ ID NO: 1962560 - protein, 7 aa, Staphylococcus
LGEQQPI

SEQ ID NO: 1962561 - protein, 5 aa, Staphylococcus
LGERG

SEQ ID NO: 1962562 - protein, 7 aa, Staphylococcus
LGESKPD

SEQ ID NO: 1962563 - protein, 6 aa, Staphylococcus
LGESPV

SEQ ID NO: 1962564 - protein, 8 aa, Staphylococcus
LGESQGKY

SEQ ID NO: 1962565 - protein, 5 aa, Staphylococcus
LGEVQ

SEQ ID NO: 1962566 - protein, 14 aa, Staphylococcus
LGFSPEDRKENIRR

SEQ ID NO: 1962567 - protein, 8 aa, Staphylococcus
LGGATEGT

SEQ ID NO: 1962568 - protein, 7 aa, Staphylococcus
LGGDHKS

SEQ ID NO: 1962569 - protein, 6 aa, Staphylococcus
LGGDYQ

SEQ ID NO: 1962570 - protein, 12 aa, Staphylococcus
LGGEGNLLKPDK

SEQ ID NO: 1962571 - protein, 16 aa, Staphylococcus
LGGEGSPGENGGPNGD

SEQ ID NO: 1962572 - protein, 17 aa, Staphylococcus
LGGEQEMKRRAGTENVP

SEQ ID NO: 1962573 - protein, 17 aa, Staphylococcus
LGGEQETKRRAGTENVP

SEQ ID NO: 1962574 - protein, 10 aa, Staphylococcus
LGGEVTTGAN

SEQ ID NO: 1962575 - protein, 4 aa, Staphylococcus
LGGF

SEQ ID NO: 1962576 - protein, 12 aa, Staphylococcus
LGGGGTRGNGRI

SEQ ID NO: 1962577 - protein, 5 aa, Staphylococcus
LGGGL

SEQ ID NO: 1962578 - protein, 5 aa, Staphylococcus
LGGGN

SEQ ID NO: 1962579 - protein, 6 aa, Staphylococcus
LGGGSI

SEQ ID NO: 1962580 - protein, 4 aa, Staphylococcus
LGGI

SEQ ID NO: 1962581 - protein, 21 aa, Staphylococcus
LGGIQTDLDGRAINQQSEPIQ

SEQ ID NO: 1962582 - protein, 9 aa, Staphylococcus
LGGKGANLA

SEQ ID NO: 1962583 - protein, 9 aa, Staphylococcus
LGGKNDYKD

SEQ ID NO: 1962584 - protein, 7 aa, Staphylococcus
LGGKNPN

SEQ ID NO: 1962585 - protein, 8 aa, Staphylococcus
LGGKNPNV

SEQ ID NO: 1962586 - protein, 7 aa, Staphylococcus
LGGKPQL

SEQ ID NO: 1962587 - protein, 8 aa, Staphylococcus
LGGKSRVI

SEQ ID NO: 1962588 - protein, 7 aa, Staphylococcus
LGGKTQL

SEQ ID NO: 1962589 - protein, 4 aa, Staphylococcus
LGGN

SEQ ID NO: 1962590 - protein, 5 aa, Staphylococcus
LGGNA

SEQ ID NO: 1962591 - protein, 6 aa, Staphylococcus
LGGNAS

SEQ ID NO: 1962592 - protein, 8 aa, Staphylococcus
LGGNKPEL

SEQ ID NO: 1962593 - protein, 4 aa, Staphylococcus
LGGP

SEQ ID NO: 1962594 - protein, 22 aa, Staphylococcus
LGGPEDELEDEYEEDYETEEGL

SEQ ID NO: 1962595 - protein, 5 aa, Staphylococcus
LGGRN

SEQ ID NO: 1962596 - protein, 11 aa, Staphylococcus
LGGRQNQTDHA

SEQ ID NO: 1962597 - protein, 18 aa, Staphylococcus
LGGSQETKRRAGTENVPQ

SEQ ID NO: 1962598 - protein, 5 aa, Staphylococcus
LGGSR

SEQ ID NO: 1962599 - protein, 13 aa, Staphylococcus
LGGSTNGVPREDG

SEQ ID NO: 1962600 - protein, 19 aa, Staphylococcus
LGGTEWKKTKAKVQQSVED

SEQ ID NO: 1962601 - protein, 16 aa, Staphylococcus
LGGTGKQKGKRHPDIG

SEQ ID NO: 1962602 - protein, 6 aa, Staphylococcus
LGGYEY

SEQ ID NO: 1962603 - protein, 4 aa, Staphylococcus
LGHG

SEQ ID NO: 1962604 - protein, 8 aa, Staphylococcus
LGHNRATS

SEQ ID NO: 1962605 - protein, 13 aa, Staphylococcus
LGHPKRMTSNEYG

SEQ ID NO: 1962606 - protein, 10 aa, Staphylococcus
LGHTEDNLSR

SEQ ID NO: 1962607 - protein, 4 aa, Staphylococcus
LGID

SEQ ID NO: 1962608 - protein, 12 aa, Staphylococcus
LGIDEQTYEDYK

SEQ ID NO: 1962609 - protein, 10 aa, Staphylococcus
LGIDSDNNEW

SEQ ID NO: 1962610 - protein, 5 aa, Staphylococcus
LGIQD

SEQ ID NO: 1962611 - protein, 16 aa, Staphylococcus
LGISSKSNKIVRKPTS

SEQ ID NO: 1962612 - protein, 4 aa, Staphylococcus
LGIT

SEQ ID NO: 1962613 - protein, 8 aa, Staphylococcus
LGKAQRVA

SEQ ID NO: 1962614 - protein, 17 aa, Staphylococcus
LGKDASAIGEATTPSIK

SEQ ID NO: 1962615 - protein, 7 aa, Staphylococcus
LGKDGSE

SEQ ID NO: 1962616 - protein, 9 aa, Staphylococcus
LGKDGSHID

SEQ ID NO: 1962617 - protein, 5 aa, Staphylococcus
LGKDI

SEQ ID NO: 1962618 - protein, 41 aa, Staphylococcus
LGKDKVESGYDDSEKNINDTNTKLENMDKEGQSSLSSITSE

SEQ ID NO: 1962619 - protein, 9 aa, Staphylococcus
LGKDQSEVH

SEQ ID NO: 1962620 - protein, 16 aa, Staphylococcus
LGKEVPKKASPGVTDA

SEQ ID NO: 1962621 - protein, 8 aa, Staphylococcus
LGKGGKER

SEQ ID NO: 1962622 - protein, 11 aa, Staphylococcus
LGKGSAYLGTN

SEQ ID NO: 1962623 - protein, 10 aa, Staphylococcus
LGKGSVEAYA

SEQ ID NO: 1962624 - protein, 9 aa, Staphylococcus
LGKKGSVSA

SEQ ID NO: 1962625 - protein, 10 aa, Staphylococcus
LGKKGSVSGL

SEQ ID NO: 1962626 - protein, 9 aa, Staphylococcus
LGKKGSVTG

SEQ ID NO: 1962627 - protein, 9 aa, Staphylococcus
LGKPTRDKY

SEQ ID NO: 1962628 - protein, 9 aa, Staphylococcus
LGKPTRDQY

SEQ ID NO: 1962629 - protein, 10 aa, Staphylococcus
LGKPVSNRWG

SEQ ID NO: 1962630 - protein, 10 aa, Staphylococcus
LGKQGTAQNL

SEQ ID NO: 1962631 - protein, 8 aa, Staphylococcus
LGKQTVKA

SEQ ID NO: 1962632 - protein, 9 aa, Staphylococcus
LGKRATRKH

SEQ ID NO: 1962633 - protein, 6 aa, Staphylococcus
LGKRLE

SEQ ID NO: 1962634 - protein, 5 aa, Staphylococcus
LGKTF

SEQ ID NO: 1962635 - protein, 11 aa, Staphylococcus
LGKTSDYDAIE

SEQ ID NO: 1962636 - protein, 20 aa, Staphylococcus
LGLPDSPGVPEGTAKNTITV

SEQ ID NO: 1962637 - protein, 20 aa, Staphylococcus
LGLPDSPGVPEGTAKSTITV

SEQ ID NO: 1962638 - protein, 12 aa, Staphylococcus
LGLPNKDDVRDG

SEQ ID NO: 1962639 - protein, 12 aa, Staphylococcus
LGLPNKDDVREG

SEQ ID NO: 1962640 - protein, 4 aa, Staphylococcus
LGLR

SEQ ID NO: 1962641 - protein, 14 aa, Staphylococcus
LGLSPSASFGEQGT

SEQ ID NO: 1962642 - protein, 16 aa, Staphylococcus
LGLSPSASFGKDGTRL

SEQ ID NO: 1962643 - protein, 14 aa, Staphylococcus
LGLSPSASFSEHGT

SEQ ID NO: 1962644 - protein, 16 aa, Staphylococcus
LGLSPSASFSENGPRL

SEQ ID NO: 1962645 - protein, 16 aa, Staphylococcus
LGLSPSASFSEQGPRL

SEQ ID NO: 1962646 - protein, 8 aa, Staphylococcus
LGLSTASE

SEQ ID NO: 1962647 - protein, 10 aa, Staphylococcus
LGMESENNEW

SEQ ID NO: 1962648 - protein, 10 aa, Staphylococcus
LGMESENSEW

SEQ ID NO: 1962649 - protein, 14 aa, Staphylococcus
LGMKGNAPNNHIKR

SEQ ID NO: 1962650 - protein, 11 aa, Staphylococcus
LGNDAGIAGAA

SEQ ID NO: 1962651 - protein, 10 aa, Staphylococcus
LGNDAGITGA

SEQ ID NO: 1962652 - protein, 20 aa, Staphylococcus
LGNEPVSKATHTAKQRLKKH

SEQ ID NO: 1962653 - protein, 13 aa, Staphylococcus
LGNGFDDDTEMGP

SEQ ID NO: 1962654 - protein, 13 aa, Staphylococcus
LGNGFDDETEMGP

SEQ ID NO: 1962655 - protein, 12 aa, Staphylococcus
LGNGFDSETEMG

SEQ ID NO: 1962656 - protein, 20 aa, Staphylococcus
LGNGKLTDKQKRNSGVENES

SEQ ID NO: 1962657 - protein, 12 aa, Staphylococcus
LGNRSNRKNARF

SEQ ID NO: 1962658 - protein, 6 aa, Staphylococcus
LGPADD

SEQ ID NO: 1962659 - protein, 7 aa, Staphylococcus
LGPAREA

SEQ ID NO: 1962660 - protein, 25 aa, Staphylococcus
LGPAREAIKETVKGKIREFGTSNRA

SEQ ID NO: 1962661 - protein, 4 aa, Staphylococcus
LGPD

SEQ ID NO: 1962662 - protein, 5 aa, Staphylococcus
LGPDS

SEQ ID NO: 1962663 - protein, 4 aa, Staphylococcus
LGPE

SEQ ID NO: 1962664 - protein, 7 aa, Staphylococcus
LGPEEEK

SEQ ID NO: 1962665 - protein, 5 aa, Staphylococcus
LGPEI

SEQ ID NO: 1962666 - protein, 11 aa, Staphylococcus
LGPEISKTSQM

SEQ ID NO: 1962667 - protein, 5 aa, Staphylococcus
LGPEV

SEQ ID NO: 1962668 - protein, 4 aa, Staphylococcus
LGPK

SEQ ID NO: 1962669 - protein, 8 aa, Staphylococcus
LGPKETLN

SEQ ID NO: 1962670 - protein, 7 aa, Staphylococcus
LGPQDDI

SEQ ID NO: 1962671 - protein, 6 aa, Staphylococcus
LGPSEE

SEQ ID NO: 1962672 - protein, 9 aa, Staphylococcus
LGPSPAALS

SEQ ID NO: 1962673 - protein, 19 aa, Staphylococcus
LGPTGSQMGKKETAKDTAR

SEQ ID NO: 1962674 - protein, 19 aa, Staphylococcus
LGPTGTQMGVKETAKDTAR

SEQ ID NO: 1962675 - protein, 7 aa, Staphylococcus
LGPTKSV

SEQ ID NO: 1962676 - protein, 6 aa, Staphylococcus
LGPYGA

SEQ ID NO: 1962677 - protein, 14 aa, Staphylococcus
LGQAQTGTGKTGAF

SEQ ID NO: 1962678 - protein, 7 aa, Staphylococcus
LGQDEDT

SEQ ID NO: 1962679 - protein, 19 aa, Staphylococcus
LGQDVTPDKVYDLRKEYGN

SEQ ID NO: 1962680 - protein, 10 aa, Staphylococcus
LGQKPSRKTF

SEQ ID NO: 1962681 - protein, 8 aa, Staphylococcus
LGQKQDTT

SEQ ID NO: 1962682 - protein, 8 aa, Staphylococcus
LGQKTDKT

SEQ ID NO: 1962683 - protein, 4 aa, Staphylococcus
LGQN

SEQ ID NO: 1962684 - protein, 4 aa, Staphylococcus
LGQP

SEQ ID NO: 1962685 - protein, 28 aa, Staphylococcus
LGQPIDGQGPINSTKTRPVEQKATGVMD

SEQ ID NO: 1962686 - protein, 27 aa, Staphylococcus
LGQPIDGQGPINTTKTRPVEQKATGVM

SEQ ID NO: 1962687 - protein, 28 aa, Staphylococcus
LGQPIDGQGPVNTDKTRPVEQKATGVMD

SEQ ID NO: 1962688 - protein, 28 aa, Staphylococcus
LGQPIDGQGPVNTTSTRPVEKKATGVMD

SEQ ID NO: 1962689 - protein, 27 aa, Staphylococcus
LGQPLDGQGPIKTDKTRPVEEKATGVM

SEQ ID NO: 1962690 - protein, 5 aa, Staphylococcus
LGQSS

SEQ ID NO: 1962691 - protein, 20 aa, Staphylococcus
LGQSTGYDYTRTKNPTRSAF

SEQ ID NO: 1962692 - protein, 20 aa, Staphylococcus
LGQSTGYDYTRTKNPTRTAF

SEQ ID NO: 1962693 - protein, 8 aa, Staphylococcus
LGQTAGQR

SEQ ID NO: 1962694 - protein, 9 aa, Staphylococcus
LGQTAGQRV

SEQ ID NO: 1962695 - protein, 9 aa, Staphylococcus
LGQTTGQQV

SEQ ID NO: 1962696 - protein, 11 aa, Staphylococcus
LGRAGQPVELS

SEQ ID NO: 1962697 - protein, 4 aa, Staphylococcus
LGRD

SEQ ID NO: 1962698 - protein, 8 aa, Staphylococcus
LGRDDSYE

SEQ ID NO: 1962699 - protein, 10 aa, Staphylococcus
LGRGGSDTTA

SEQ ID NO: 1962700 - protein, 7 aa, Staphylococcus
LGRGNVT

SEQ ID NO: 1962701 - protein, 12 aa, Staphylococcus
LGRKSASSISEW

SEQ ID NO: 1962702 - protein, 4 aa, Staphylococcus
LGRL

SEQ ID NO: 1962703 - protein, 12 aa, Staphylococcus
LGRNGKNDRVPE

SEQ ID NO: 1962704 - protein, 12 aa, Staphylococcus
LGRNGKNERVPE

SEQ ID NO: 1962705 - protein, 6 aa, Staphylococcus
LGRNTA

SEQ ID NO: 1962706 - protein, 11 aa, Staphylococcus
LGRPGVPEELQ

SEQ ID NO: 1962707 - protein, 14 aa, Staphylococcus
LGRQPAGRFGKPED

SEQ ID NO: 1962708 - protein, 9 aa, Staphylococcus
LGRSSEGGQ

SEQ ID NO: 1962709 - protein, 4 aa, Staphylococcus
LGRT

SEQ ID NO: 1962710 - protein, 5 aa, Staphylococcus
LGRTG

SEQ ID NO: 1962711 - protein, 6 aa, Staphylococcus
LGRTTK

SEQ ID NO: 1962712 - protein, 8 aa, Staphylococcus
LGSDEGVL

SEQ ID NO: 1962713 - protein, 6 aa, Staphylococcus
LGSDEL

SEQ ID NO: 1962714 - protein, 9 aa, Staphylococcus
LGSDGSGAK

SEQ ID NO: 1962715 - protein, 6 aa, Staphylococcus
LGSDQL

SEQ ID NO: 1962716 - protein, 4 aa, Staphylococcus
LGSE

SEQ ID NO: 1962717 - protein, 15 aa, Staphylococcus
LGSEGNLLQPSEDAL

SEQ ID NO: 1962718 - protein, 4 aa, Staphylococcus
LGSF

SEQ ID NO: 1962719 - protein, 6 aa, Staphylococcus
LGSGAT

SEQ ID NO: 1962720 - protein, 5 aa, Staphylococcus
LGSGG

SEQ ID NO: 1962721 - protein, 6 aa, Staphylococcus
LGSGGI

SEQ ID NO: 1962722 - protein, 9 aa, Staphylococcus
LGSKETDTV

SEQ ID NO: 1962723 - protein, 8 aa, Staphylococcus
LGSKSELE

SEQ ID NO: 1962724 - protein, 8 aa, Staphylococcus
LGSKTFEQ

SEQ ID NO: 1962725 - protein, 31 aa, Staphylococcus
LGSKTGKKVTKTGLKRKHGASETEKEKMPLP

SEQ ID NO: 1962726 - protein, 22 aa, Staphylococcus
LGSLGNEGGTYGLPGGYTSPER

SEQ ID NO: 1962727 - protein, 7 aa, Staphylococcus
LGSNDLS

SEQ ID NO: 1962728 - protein, 5 aa, Staphylococcus
LGSNP

SEQ ID NO: 1962729 - protein, 24 aa, Staphylococcus
LGSPEMSNKNAQANKSNNTPTLDS

SEQ ID NO: 1962730 - protein, 9 aa, Staphylococcus
LGSPGQTAY

SEQ ID NO: 1962731 - protein, 16 aa, Staphylococcus
LGSQADPAEFNDKAPY

SEQ ID NO: 1962732 - protein, 8 aa, Staphylococcus
LGSSGLTA

SEQ ID NO: 1962733 - protein, 5 aa, Staphylococcus
LGSSV

SEQ ID NO: 1962734 - protein, 16 aa, Staphylococcus
LGSTADASEFEGKDPY

SEQ ID NO: 1962735 - protein, 5 aa, Staphylococcus
LGSTI

SEQ ID NO: 1962736 - protein, 16 aa, Staphylococcus
LGSTQDASEFEGKDPY

SEQ ID NO: 1962737 - protein, 16 aa, Staphylococcus
LGSTQDASEFNDKDPY

SEQ ID NO: 1962738 - protein, 5 aa, Staphylococcus
LGSVG

SEQ ID NO: 1962739 - protein, 11 aa, Staphylococcus
LGSVGDTIQRG

SEQ ID NO: 1962740 - protein, 19 aa, Staphylococcus
LGTDKLKTELSNINTNQIA

SEQ ID NO: 1962741 - protein, 4 aa, Staphylococcus
LGTE

SEQ ID NO: 1962742 - protein, 5 aa, Staphylococcus
LGTED

SEQ ID NO: 1962743 - protein, 7 aa, Staphylococcus
LGTEEEK

SEQ ID NO: 1962744 - protein, 5 aa, Staphylococcus
LGTEI

SEQ ID NO: 1962745 - protein, 15 aa, Staphylococcus
LGTEQNNLEKEINKA

SEQ ID NO: 1962746 - protein, 14 aa, Staphylococcus
LGTGHRAAVNKDAR

SEQ ID NO: 1962747 - protein, 9 aa, Staphylococcus
LGTGKQTTL

SEQ ID NO: 1962748 - protein, 9 aa, Staphylococcus
LGTGKVPTM

SEQ ID NO: 1962749 - protein, 8 aa, Staphylococcus
LGTGSTVA

SEQ ID NO: 1962750 - protein, 4 aa, Staphylococcus
LGTK

SEQ ID NO: 1962751 - protein, 8 aa, Staphylococcus
LGTNTPID

SEQ ID NO: 1962752 - protein, 15 aa, Staphylococcus
LGTPAATTRGFDESA

SEQ ID NO: 1962753 - protein, 15 aa, Staphylococcus
LGTPAATTRGFDETA

SEQ ID NO: 1962754 - protein, 12 aa, Staphylococcus
LGTPAATTRGFE

SEQ ID NO: 1962755 - protein, 19 aa, Staphylococcus
LGTPHNGSAAADRVGNQQA

SEQ ID NO: 1962756 - protein, 17 aa, Staphylococcus
LGTPHNGTIAADKLGNE

SEQ ID NO: 1962757 - protein, 5 aa, Staphylococcus
LGTPL

SEQ ID NO: 1962758 - protein, 15 aa, Staphylococcus
LGTPLPLKESKDDEW

SEQ ID NO: 1962759 - protein, 14 aa, Staphylococcus
LGTPTATTRGFDEE

SEQ ID NO: 1962760 - protein, 6 aa, Staphylococcus
LGTPTM

SEQ ID NO: 1962761 - protein, 8 aa, Staphylococcus
LGTQPEET

SEQ ID NO: 1962762 - protein, 13 aa, Staphylococcus
LGTRNTAEAAKLA

SEQ ID NO: 1962763 - protein, 7 aa, Staphylococcus
LGTRYGD

SEQ ID NO: 1962764 - protein, 4 aa, Staphylococcus
LGTS

SEQ ID NO: 1962765 - protein, 5 aa, Staphylococcus
LGTSD

SEQ ID NO: 1962766 - protein, 10 aa, Staphylococcus
LGTSDYQDIA

SEQ ID NO: 1962767 - protein, 7 aa, Staphylococcus
LGTSQGK

SEQ ID NO: 1962768 - protein, 9 aa, Staphylococcus
LGTTALKGA

SEQ ID NO: 1962769 - protein, 18 aa, Staphylococcus
LGTTALKGAIDSANIDPN

SEQ ID NO: 1962770 - protein, 14 aa, Staphylococcus
LGTTEKLYDYACKV

SEQ ID NO: 1962771 - protein, 7 aa, Staphylococcus
LGVKTGS

SEQ ID NO: 1962772 - protein, 11 aa, Staphylococcus
LGVNPSSDGEV

SEQ ID NO: 1962773 - protein, 4 aa, Staphylococcus
LGVR

SEQ ID NO: 1962774 - protein, 6 aa, Staphylococcus
LGVSRQ

SEQ ID NO: 1962775 - protein, 4 aa, Staphylococcus
LGYP

SEQ ID NO: 1962776 - protein, 10 aa, Staphylococcus
LGYPTSVTNK

SEQ ID NO: 1962777 - protein, 12 aa, Staphylococcus
LGYQPGVQPYSE

SEQ ID NO: 1962778 - protein, 7 aa, Staphylococcus
LGYQSKR

SEQ ID NO: 1962779 - protein, 5 aa, Staphylococcus
LGYQT

SEQ ID NO: 1962780 - protein, 6 aa, Staphylococcus
LHAGGE

SEQ ID NO: 1962781 - protein, 12 aa, Staphylococcus
LHDGSLPATNKP

SEQ ID NO: 1962782 - protein, 16 aa, Staphylococcus
LHDKDKSNVEGQEYKK

SEQ ID NO: 1962783 - protein, 6 aa, Staphylococcus
LHDPEG

SEQ ID NO: 1962784 - protein, 13 aa, Staphylococcus
LHDTIEDQGYDVK

SEQ ID NO: 1962785 - protein, 10 aa, Staphylococcus
LHEDAGSEHI

SEQ ID NO: 1962786 - protein, 13 aa, Staphylococcus
LHEDAGSKNIDEI

SEQ ID NO: 1962787 - protein, 10 aa, Staphylococcus
LHEDARSEHI

SEQ ID NO: 1962788 - protein, 4 aa, Staphylococcus
LHEG

SEQ ID NO: 1962789 - protein, 15 aa, Staphylococcus
LHEQSQKVENKNEIA

SEQ ID NO: 1962790 - protein, 7 aa, Staphylococcus
LHESHSE

SEQ ID NO: 1962791 - protein, 5 aa, Staphylococcus
LHGAD

SEQ ID NO: 1962792 - protein, 4 aa, Staphylococcus
LHGS

SEQ ID NO: 1962793 - protein, 9 aa, Staphylococcus
LHLKGQDTI

SEQ ID NO: 1962794 - protein, 10 aa, Staphylococcus
LHNGNSDRQA

SEQ ID NO: 1962795 - protein, 5 aa, Staphylococcus
LHPGR

SEQ ID NO: 1962796 - protein, 6 aa, Staphylococcus
LHPGRT

SEQ ID NO: 1962797 - protein, 6 aa, Staphylococcus
LHPNPV

SEQ ID NO: 1962798 - protein, 14 aa, Staphylococcus
LHPPKGDAFARRSQ

SEQ ID NO: 1962799 - protein, 13 aa, Staphylococcus
LHPPKGDSFAERS

SEQ ID NO: 1962800 - protein, 6 aa, Staphylococcus
LHPYEG

SEQ ID NO: 1962801 - protein, 7 aa, Staphylococcus
LHQKKSD

SEQ ID NO: 1962802 - protein, 10 aa, Staphylococcus
LHSDAGSRHV

SEQ ID NO: 1962803 - protein, 7 aa, Staphylococcus
LHSPTPH

SEQ ID NO: 1962804 - protein, 13 aa, Staphylococcus
LHTDAGSANVDEL

SEQ ID NO: 1962805 - protein, 12 aa, Staphylococcus
LHTDAGSEEVDE

SEQ ID NO: 1962806 - protein, 11 aa, Staphylococcus
LHTPRRSEPRL

SEQ ID NO: 1962807 - protein, 14 aa, Staphylococcus
LIDNDDESKLKEQR

SEQ ID NO: 1962808 - protein, 10 aa, Staphylococcus
LIDPNGELQA

SEQ ID NO: 1962809 - protein, 9 aa, Staphylococcus
LIEEAKKET

SEQ ID NO: 1962810 - protein, 10 aa, Staphylococcus
LIEEAQKETP

SEQ ID NO: 1962811 - protein, 5 aa, Staphylococcus
LIEES

SEQ ID NO: 1962812 - protein, 11 aa, Staphylococcus
LIGDRSESELK

SEQ ID NO: 1962813 - protein, 10 aa, Staphylococcus
LIGDRSTSEL

SEQ ID NO: 1962814 - protein, 13 aa, Staphylococcus
LIGGNGSIISTDN

SEQ ID NO: 1962815 - protein, 9 aa, Staphylococcus
LIGQDEQEI

SEQ ID NO: 1962816 - protein, 7 aa, Staphylococcus
LIGTPPK

SEQ ID NO: 1962817 - protein, 8 aa, Staphylococcus
LIKGENEG

SEQ ID NO: 1962818 - protein, 10 aa, Staphylococcus
LINENKQNAH

SEQ ID NO: 1962819 - protein, 13 aa, Staphylococcus
LINPDSKPESFHK

SEQ ID NO: 1962820 - protein, 7 aa, Staphylococcus
LINPETN

SEQ ID NO: 1962821 - protein, 7 aa, Staphylococcus
LINPTTN

SEQ ID NO: 1962822 - protein, 9 aa, Staphylococcus
LINQPADKF

SEQ ID NO: 1962823 - protein, 9 aa, Staphylococcus
LINQPTDKF

SEQ ID NO: 1962824 - protein, 7 aa, Staphylococcus
LIPGGAR

SEQ ID NO: 1962825 - protein, 7 aa, Staphylococcus
LIPSYTK

SEQ ID NO: 1962826 - protein, 6 aa, Staphylococcus
LIQSSS

SEQ ID NO: 1962827 - protein, 10 aa, Staphylococcus
LISEDKQLQL

SEQ ID NO: 1962828 - protein, 13 aa, Staphylococcus
LISSRKKVQQFTE

SEQ ID NO: 1962829 - protein, 4 aa, Staphylococcus
LITS

SEQ ID NO: 1962830 - protein, 10 aa, Staphylococcus
LITSRKDGNK

SEQ ID NO: 1962831 - protein, 5 aa, Staphylococcus
LITTT

SEQ ID NO: 1962832 - protein, 5 aa, Staphylococcus
LKAAH

SEQ ID NO: 1962833 - protein, 5 aa, Staphylococcus
LKAAI

SEQ ID NO: 1962834 - protein, 21 aa, Staphylococcus
LKAAPKANTAIAQQILKDLRQ

SEQ ID NO: 1962835 - protein, 17 aa, Staphylococcus
LKAEARSHSDKSIESQV

SEQ ID NO: 1962836 - protein, 6 aa, Staphylococcus
LKAENK

SEQ ID NO: 1962837 - protein, 7 aa, Staphylococcus
LKAENTL

SEQ ID NO: 1962838 - protein, 4 aa, Staphylococcus
LKAK

SEQ ID NO: 1962839 - protein, 13 aa, Staphylococcus
LKAKGKDPINWCE

SEQ ID NO: 1962840 - protein, 9 aa, Staphylococcus
LKAKGKGKL

SEQ ID NO: 1962841 - protein, 9 aa, Staphylococcus
LKAKKVPST

SEQ ID NO: 1962842 - protein, 8 aa, Staphylococcus
LKAKSVAS

SEQ ID NO: 1962843 - protein, 4 aa, Staphylococcus
LKAN

SEQ ID NO: 1962844 - protein, 13 aa, Staphylococcus
LKANEQKIDEATQ

SEQ ID NO: 1962845 - protein, 11 aa, Staphylococcus
LKANPDKRAVG

SEQ ID NO: 1962846 - protein, 10 aa, Staphylococcus
LKANPEKRAV

SEQ ID NO: 1962847 - protein, 7 aa, Staphylococcus
LKANPIL

SEQ ID NO: 1962848 - protein, 11 aa, Staphylococcus
LKANPSKRAVG

SEQ ID NO: 1962849 - protein, 11 aa, Staphylococcus
LKAPKTDFNGS

SEQ ID NO: 1962850 - protein, 11 aa, Staphylococcus
LKAPKTSFNGS

SEQ ID NO: 1962851 - protein, 4 aa, Staphylococcus
LKAQ

SEQ ID NO: 1962852 - protein, 17 aa, Staphylococcus
LKAQEQSPNEDSEPYSV

SEQ ID NO: 1962853 - protein, 10 aa, Staphylococcus
LKAQESELNG

SEQ ID NO: 1962854 - protein, 8 aa, Staphylococcus
LKAQGAKV

SEQ ID NO: 1962855 - protein, 30 aa, Staphylococcus
LKAQQAREAARKAREDARSGKKNKRKDTLL

SEQ ID NO: 1962856 - protein, 8 aa, Staphylococcus
LKASRSIE

SEQ ID NO: 1962857 - protein, 8 aa, Staphylococcus
LKATQSDI

SEQ ID NO: 1962858 - protein, 7 aa, Staphylococcus
LKATSYT

SEQ ID NO: 1962859 - protein, 9 aa, Staphylococcus
LKATTDYVT

SEQ ID NO: 1962860 - protein, 13 aa, Staphylococcus
LKAYSEGETDTPL

SEQ ID NO: 1962861 - protein, 23 aa, Staphylococcus
LKDAESKGAKLSRSLDEAQEMGG

SEQ ID NO: 1962862 - protein, 5 aa, Staphylococcus
LKDAG

SEQ ID NO: 1962863 - protein, 16 aa, Staphylococcus
LKDAGIEDKLDSDLSP

SEQ ID NO: 1962864 - protein, 4 aa, Staphylococcus
LKDD

SEQ ID NO: 1962865 - protein, 10 aa, Staphylococcus
LKDDDSEHAR

SEQ ID NO: 1962866 - protein, 5 aa, Staphylococcus
LKDDG

SEQ ID NO: 1962867 - protein, 5 aa, Staphylococcus
LKDEG

SEQ ID NO: 1962868 - protein, 6 aa, Staphylococcus
LKDEGI

SEQ ID NO: 1962869 - protein, 8 aa, Staphylococcus
LKDEGKIK

SEQ ID NO: 1962870 - protein, 9 aa, Staphylococcus
LKDENKTTQ

SEQ ID NO: 1962871 - protein, 10 aa, Staphylococcus
LKDEQQSKKL

SEQ ID NO: 1962872 - protein, 10 aa, Staphylococcus
LKDETQSQQL

SEQ ID NO: 1962873 - protein, 6 aa, Staphylococcus
LKDEVN

SEQ ID NO: 1962874 - protein, 4 aa, Staphylococcus
LKDG

SEQ ID NO: 1962875 - protein, 9 aa, Staphylococcus
LKDGAGAAF

SEQ ID NO: 1962876 - protein, 9 aa, Staphylococcus
LKDGAGASF

SEQ ID NO: 1962877 - protein, 20 aa, Staphylococcus
LKDGAGASFSEKGTELSEDI

SEQ ID NO: 1962878 - protein, 10 aa, Staphylococcus
LKDGAGASFY

SEQ ID NO: 1962879 - protein, 21 aa, Staphylococcus
LKDGAGASFYEKGQDISDSIQ

SEQ ID NO: 1962880 - protein, 6 aa, Staphylococcus
LKDGKA

SEQ ID NO: 1962881 - protein, 8 aa, Staphylococcus
LKDGQIDI

SEQ ID NO: 1962882 - protein, 6 aa, Staphylococcus
LKDGRE

SEQ ID NO: 1962883 - protein, 15 aa, Staphylococcus
LKDGSRVAPEVNEGD

SEQ ID NO: 1962884 - protein, 4 aa, Staphylococcus
LKDH

SEQ ID NO: 1962885 - protein, 4 aa, Staphylococcus
LKDK

SEQ ID NO: 1962886 - protein, 9 aa, Staphylococcus
LKDKADIDL

SEQ ID NO: 1962887 - protein, 19 aa, Staphylococcus
LKDKADVYPNQLSGGQKQR

SEQ ID NO: 1962888 - protein, 7 aa, Staphylococcus
LKDKEDE

SEQ ID NO: 1962889 - protein, 14 aa, Staphylococcus
LKDKGGEYEKGDDW

SEQ ID NO: 1962890 - protein, 43 aa, Staphylococcus
LKDLGDNVSEDDKKQAEDKKEALKSALEGQDLEDIKTKKEELE

SEQ ID NO: 1962891 - protein, 9 aa, Staphylococcus
LKDLTDDEK

SEQ ID NO: 1962892 - protein, 9 aa, Staphylococcus
LKDMSDDEK

SEQ ID NO: 1962893 - protein, 6 aa, Staphylococcus
LKDNGV

SEQ ID NO: 1962894 - protein, 6 aa, Staphylococcus
LKDNPN

SEQ ID NO: 1962895 - protein, 9 aa, Staphylococcus
LKDNSSKAV

SEQ ID NO: 1962896 - protein, 13 aa, Staphylococcus
LKDNTEKSLFPQT

SEQ ID NO: 1962897 - protein, 6 aa, Staphylococcus
LKDPDV

SEQ ID NO: 1962898 - protein, 9 aa, Staphylococcus
LKDPVPAKI

SEQ ID NO: 1962899 - protein, 7 aa, Staphylococcus
LKDQRES

SEQ ID NO: 1962900 - protein, 25 aa, Staphylococcus
LKDSEDKLTTIKRQTESRRGGKGSR

SEQ ID NO: 1962901 - protein, 15 aa, Staphylococcus
LKDSKTAKQGEYKNK

SEQ ID NO: 1962902 - protein, 7 aa, Staphylococcus
LKDTEAQ

SEQ ID NO: 1962903 - protein, 13 aa, Staphylococcus
LKDTGTGDTLCGE

SEQ ID NO: 1962904 - protein, 11 aa, Staphylococcus
LKDTNEDEGIS

SEQ ID NO: 1962905 - protein, 7 aa, Staphylococcus
LKDYDKK

SEQ ID NO: 1962906 - protein, 7 aa, Staphylococcus
LKEAGAD

SEQ ID NO: 1962907 - protein, 7 aa, Staphylococcus
LKEAGKI

SEQ ID NO: 1962908 - protein, 9 aa, Staphylococcus
LKEAQPEAI

SEQ ID NO: 1962909 - protein, 8 aa, Staphylococcus
LKEASVSN

SEQ ID NO: 1962910 - protein, 24 aa, Staphylococcus
LKEAYENTRPKIDKSVRNDVKDTY

SEQ ID NO: 1962911 - protein, 8 aa, Staphylococcus
LKEDGNDC

SEQ ID NO: 1962912 - protein, 7 aa, Staphylococcus
LKEEDRL

SEQ ID NO: 1962913 - protein, 10 aa, Staphylococcus
LKEEEEQLNG

SEQ ID NO: 1962914 - protein, 5 aa, Staphylococcus
LKEEG

SEQ ID NO: 1962915 - protein, 9 aa, Staphylococcus
LKEEGADYS

SEQ ID NO: 1962916 - protein, 8 aa, Staphylococcus
LKEEGHEV

SEQ ID NO: 1962917 - protein, 8 aa, Staphylococcus
LKEEGKIK

SEQ ID NO: 1962918 - protein, 7 aa, Staphylococcus
LKEEKPD

SEQ ID NO: 1962919 - protein, 40 aa, Staphylococcus
LKEENKEVSAAYRKDDQVDKAIGEGYDARNVDVEKDEIEK

SEQ ID NO: 1962920 - protein, 9 aa, Staphylococcus
LKEENSTAY

SEQ ID NO: 1962921 - protein, 10 aa, Staphylococcus
LKEEPPISVK

SEQ ID NO: 1962922 - protein, 4 aa, Staphylococcus
LKEG

SEQ ID NO: 1962923 - protein, 11 aa, Staphylococcus
LKEGKTKKSYK

SEQ ID NO: 1962924 - protein, 14 aa, Staphylococcus
LKEGKWNRSEFKGT

SEQ ID NO: 1962925 - protein, 8 aa, Staphylococcus
LKEGNDIN

SEQ ID NO: 1962926 - protein, 13 aa, Staphylococcus
LKEGNLKKANEQL

SEQ ID NO: 1962927 - protein, 4 aa, Staphylococcus
LKEI

SEQ ID NO: 1962928 - protein, 6 aa, Staphylococcus
LKEKDF

SEQ ID NO: 1962929 - protein, 8 aa, Staphylococcus
LKEKDGEY

SEQ ID NO: 1962930 - protein, 9 aa, Staphylococcus
LKEKEKELV

SEQ ID NO: 1962931 - protein, 10 aa, Staphylococcus
LKEKPDTAGL

SEQ ID NO: 1962932 - protein, 12 aa, Staphylococcus
LKEKRDKKKERK

SEQ ID NO: 1962933 - protein, 8 aa, Staphylococcus
LKEKTDEA

SEQ ID NO: 1962934 - protein, 6 aa, Staphylococcus
LKELDA

SEQ ID NO: 1962935 - protein, 10 aa, Staphylococcus
LKELEDSKIS

SEQ ID NO: 1962936 - protein, 31 aa, Staphylococcus
LKELESEKTQLQNKYERKQVKKTKNKLNDVE

SEQ ID NO: 1962937 - protein, 11 aa, Staphylococcus
LKELKEQFNSP

SEQ ID NO: 1962938 - protein, 9 aa, Staphylococcus
LKELSNDEK

SEQ ID NO: 1962939 - protein, 6 aa, Staphylococcus
LKENEN

SEQ ID NO: 1962940 - protein, 10 aa, Staphylococcus
LKENEREELE

SEQ ID NO: 1962941 - protein, 9 aa, Staphylococcus
LKENGAKTV

SEQ ID NO: 1962942 - protein, 7 aa, Staphylococcus
LKENPEL

SEQ ID NO: 1962943 - protein, 34 aa, Staphylococcus
LKENPNSKKSKSQHKQLEQKLQSNKKKVKEAQSL

SEQ ID NO: 1962944 - protein, 11 aa, Staphylococcus
LKENVQDKARV

SEQ ID NO: 1962945 - protein, 7 aa, Staphylococcus
LKEPPTS

SEQ ID NO: 1962946 - protein, 7 aa, Staphylococcus
LKEQAHK

SEQ ID NO: 1962947 - protein, 10 aa, Staphylococcus
LKEQEDKLKG

SEQ ID NO: 1962948 - protein, 5 aa, Staphylococcus
LKEQQ

SEQ ID NO: 1962949 - protein, 17 aa, Staphylococcus
LKEQQQAFRQQLELDWE

SEQ ID NO: 1962950 - protein, 7 aa, Staphylococcus
LKERNDD

SEQ ID NO: 1962951 - protein, 7 aa, Staphylococcus
LKESDKS

SEQ ID NO: 1962952 - protein, 6 aa, Staphylococcus
LKESEK

SEQ ID NO: 1962953 - protein, 7 aa, Staphylococcus
LKESGAE

SEQ ID NO: 1962954 - protein, 11 aa, Staphylococcus
LKESNRKSSYK

SEQ ID NO: 1962955 - protein, 40 aa, Staphylococcus
LKESPNSKKNKNKRNQLQQQFDSNERKINQTKDKIAAEGE

SEQ ID NO: 1962956 - protein, 7 aa, Staphylococcus
LKESTVS

SEQ ID NO: 1962957 - protein, 5 aa, Staphylococcus
LKETD

SEQ ID NO: 1962958 - protein, 27 aa, Staphylococcus
LKETDEDYYSKPVEDDEYEPVIYRNDL

SEQ ID NO: 1962959 - protein, 6 aa, Staphylococcus
LKETDG

SEQ ID NO: 1962960 - protein, 14 aa, Staphylococcus
LKETGTGDTLCGEK

SEQ ID NO: 1962961 - protein, 9 aa, Staphylococcus
LKETKKNVS

SEQ ID NO: 1962962 - protein, 12 aa, Staphylococcus
LKETKKSNDDYE

SEQ ID NO: 1962963 - protein, 10 aa, Staphylococcus
LKETKKTSDL

SEQ ID NO: 1962964 - protein, 5 aa, Staphylococcus
LKEYE

SEQ ID NO: 1962965 - protein, 6 aa, Staphylococcus
LKEYGD

SEQ ID NO: 1962966 - protein, 11 aa, Staphylococcus
LKFDREKAYGK

SEQ ID NO: 1962967 - protein, 4 aa, Staphylococcus
LKGA

SEQ ID NO: 1962968 - protein, 7 aa, Staphylococcus
LKGANRK

SEQ ID NO: 1962969 - protein, 6 aa, Staphylococcus
LKGDAV

SEQ ID NO: 1962970 - protein, 7 aa, Staphylococcus
LKGDEDL

SEQ ID NO: 1962971 - protein, 7 aa, Staphylococcus
LKGEAGQ

SEQ ID NO: 1962972 - protein, 10 aa, Staphylococcus
LKGEETQTGD

SEQ ID NO: 1962973 - protein, 12 aa, Staphylococcus
LKGEGAADIPNV

SEQ ID NO: 1962974 - protein, 12 aa, Staphylococcus
LKGEKEDYWFLQ

SEQ ID NO: 1962975 - protein, 12 aa, Staphylococcus
LKGELQNAGQDV

SEQ ID NO: 1962976 - protein, 16 aa, Staphylococcus
LKGEQAKTELENNDAD

SEQ ID NO: 1962977 - protein, 6 aa, Staphylococcus
LKGERG

SEQ ID NO: 1962978 - protein, 8 aa, Staphylococcus
LKGESLTD

SEQ ID NO: 1962979 - protein, 9 aa, Staphylococcus
LKGESPFDR

SEQ ID NO: 1962980 - protein, 8 aa, Staphylococcus
LKGETNKY

SEQ ID NO: 1962981 - protein, 8 aa, Staphylococcus
LKGETPTT

SEQ ID NO: 1962982 - protein, 8 aa, Staphylococcus
LKGETTKF

SEQ ID NO: 1962983 - protein, 12 aa, Staphylococcus
LKGEVKVEGAKN

SEQ ID NO: 1962984 - protein, 10 aa, Staphylococcus
LKGGEKDPYR

SEQ ID NO: 1962985 - protein, 9 aa, Staphylococcus
LKGGGKDPF

SEQ ID NO: 1962986 - protein, 11 aa, Staphylococcus
LKGGTPEENKN

SEQ ID NO: 1962987 - protein, 9 aa, Staphylococcus
LKGIGKGVG

SEQ ID NO: 1962988 - protein, 10 aa, Staphylococcus
LKGKAAKDEL

SEQ ID NO: 1962989 - protein, 11 aa, Staphylococcus
LKGKDSDELLD

SEQ ID NO: 1962990 - protein, 8 aa, Staphylococcus
LKGKEEDV

SEQ ID NO: 1962991 - protein, 10 aa, Staphylococcus
LKGKNENELL

SEQ ID NO: 1962992 - protein, 5 aa, Staphylococcus
LKGKQ

SEQ ID NO: 1962993 - protein, 17 aa, Staphylococcus
LKGNDFENRGSNDSLIQ

SEQ ID NO: 1962994 - protein, 7 aa, Staphylococcus
LKGNKSD

SEQ ID NO: 1962995 - protein, 12 aa, Staphylococcus
LKGNKVTLLGDH

SEQ ID NO: 1962996 - protein, 9 aa, Staphylococcus
LKGNQQDDL

SEQ ID NO: 1962997 - protein, 12 aa, Staphylococcus
LKGNQVTLLGEN

SEQ ID NO: 1962998 - protein, 11 aa, Staphylococcus
LKGNSGENKNL

SEQ ID NO: 1962999 - protein, 5 aa, Staphylococcus
LKGPD

SEQ ID NO: 1963000 - protein, 10 aa, Staphylococcus
LKGPQTKFEG

SEQ ID NO: 1963001 - protein, 6 aa, Staphylococcus
LKGQEA

SEQ ID NO: 1963002 - protein, 12 aa, Staphylococcus
LKGQEARKELEH

SEQ ID NO: 1963003 - protein, 7 aa, Staphylococcus
LKGSEIK

SEQ ID NO: 1963004 - protein, 9 aa, Staphylococcus
LKGSNRKKF

SEQ ID NO: 1963005 - protein, 6 aa, Staphylococcus
LKGTNR

SEQ ID NO: 1963006 - protein, 8 aa, Staphylococcus
LKGTNRKK

SEQ ID NO: 1963007 - protein, 9 aa, Staphylococcus
LKGTNRRRF

SEQ ID NO: 1963008 - protein, 12 aa, Staphylococcus
LKGTTGKNGREV

SEQ ID NO: 1963009 - protein, 6 aa, Staphylococcus
LKGYEG

SEQ ID NO: 1963010 - protein, 12 aa, Staphylococcus
LKHESDNVSQQR

SEQ ID NO: 1963011 - protein, 4 aa, Staphylococcus
LKHK

SEQ ID NO: 1963012 - protein, 5 aa, Staphylococcus
LKHNE

SEQ ID NO: 1963013 - protein, 4 aa, Staphylococcus
LKHP

SEQ ID NO: 1963014 - protein, 8 aa, Staphylococcus
LKHPTDMN

SEQ ID NO: 1963015 - protein, 8 aa, Staphylococcus
LKHQPNSF

SEQ ID NO: 1963016 - protein, 5 aa, Staphylococcus
LKHRK

SEQ ID NO: 1963017 - protein, 5 aa, Staphylococcus
LKITE

SEQ ID NO: 1963018 - protein, 8 aa, Staphylococcus
LKKAEDRA

SEQ ID NO: 1963019 - protein, 7 aa, Staphylococcus
LKKDGPR

SEQ ID NO: 1963020 - protein, 7 aa, Staphylococcus
LKKDNRS

SEQ ID NO: 1963021 - protein, 4 aa, Staphylococcus
LKKE

SEQ ID NO: 1963022 - protein, 13 aa, Staphylococcus
LKKEDDDYVTSGG

SEQ ID NO: 1963023 - protein, 10 aa, Staphylococcus
LKKEDKEQVK

SEQ ID NO: 1963024 - protein, 31 aa, Staphylococcus
LKKEEKNGDITEDDLRSQTDDVQKATDNSIK

SEQ ID NO: 1963025 - protein, 5 aa, Staphylococcus
LKKEG

SEQ ID NO: 1963026 - protein, 6 aa, Staphylococcus
LKKEGF

SEQ ID NO: 1963027 - protein, 9 aa, Staphylococcus
LKKEGKIKA

SEQ ID NO: 1963028 - protein, 8 aa, Staphylococcus
LKKEKPDL

SEQ ID NO: 1963029 - protein, 7 aa, Staphylococcus
LKKENPL

SEQ ID NO: 1963030 - protein, 7 aa, Staphylococcus
LKKEQMS

SEQ ID NO: 1963031 - protein, 5 aa, Staphylococcus
LKKET

SEQ ID NO: 1963032 - protein, 6 aa, Staphylococcus
LKKETK

SEQ ID NO: 1963033 - protein, 7 aa, Staphylococcus
LKKETKI

SEQ ID NO: 1963034 - protein, 16 aa, Staphylococcus
LKKFEGNYNYIKEKEY

SEQ ID NO: 1963035 - protein, 5 aa, Staphylococcus
LKKGD

SEQ ID NO: 1963036 - protein, 7 aa, Staphylococcus
LKKGDKI

SEQ ID NO: 1963037 - protein, 5 aa, Staphylococcus
LKKGG

SEQ ID NO: 1963038 - protein, 10 aa, Staphylococcus
LKKGLDALND

SEQ ID NO: 1963039 - protein, 11 aa, Staphylococcus
LKKGLDSLDSD

SEQ ID NO: 1963040 - protein, 10 aa, Staphylococcus
LKKGLDSLND

SEQ ID NO: 1963041 - protein, 6 aa, Staphylococcus
LKKGNT

SEQ ID NO: 1963042 - protein, 5 aa, Staphylococcus
LKKIN

SEQ ID NO: 1963043 - protein, 4 aa, Staphylococcus
LKKK

SEQ ID NO: 1963044 - protein, 5 aa, Staphylococcus
LKKKG

SEQ ID NO: 1963045 - protein, 9 aa, Staphylococcus
LKKKGDYEA

SEQ ID NO: 1963046 - protein, 6 aa, Staphylococcus
LKKKPT

SEQ ID NO: 1963047 - protein, 8 aa, Staphylococcus
LKKKTQRA

SEQ ID NO: 1963048 - protein, 31 aa, Staphylococcus
LKKNQKQSVNLQNYGKTHALQASEEKIQDIE

SEQ ID NO: 1963049 - protein, 10 aa, Staphylococcus
LKKPERSKYR

SEQ ID NO: 1963050 - protein, 10 aa, Staphylococcus
LKKPNYNKTY

SEQ ID NO: 1963051 - protein, 41 aa, Staphylococcus
LKKPRNPEEEERLRKRNEERKRRKEEQDRKLKEKLEQRKAA

SEQ ID NO: 1963052 - protein, 8 aa, Staphylococcus
LKKQGKLE

SEQ ID NO: 1963053 - protein, 11 aa, Staphylococcus
LKKQQKQSVNF

SEQ ID NO: 1963054 - protein, 14 aa, Staphylococcus
LKKQQKQSVNFQNY

SEQ ID NO: 1963055 - protein, 16 aa, Staphylococcus
LKKQRGEFSQKSIEEA

SEQ ID NO: 1963056 - protein, 12 aa, Staphylococcus
LKKRGANYSKAK

SEQ ID NO: 1963057 - protein, 11 aa, Staphylococcus
LKKSGYDTTQL

SEQ ID NO: 1963058 - protein, 10 aa, Staphylococcus
LKKTPRKSKD

SEQ ID NO: 1963059 - protein, 10 aa, Staphylococcus
LKKTSEHQAK

SEQ ID NO: 1963060 - protein, 4 aa, Staphylococcus
LKLD

SEQ ID NO: 1963061 - protein, 10 aa, Staphylococcus
LKLPNEDLGE

SEQ ID NO: 1963062 - protein, 9 aa, Staphylococcus
LKLSDKDKE

SEQ ID NO: 1963063 - protein, 13 aa, Staphylococcus
LKLTEDSINKDKA

SEQ ID NO: 1963064 - protein, 10 aa, Staphylococcus
LKMSADDTIK

SEQ ID NO: 1963065 - protein, 19 aa, Staphylococcus
LKNAANDTLKGGTPEENKA

SEQ ID NO: 1963066 - protein, 20 aa, Staphylococcus
LKNAMGPDREFQATADKIDN

SEQ ID NO: 1963067 - protein, 7 aa, Staphylococcus
LKNDEEI

SEQ ID NO: 1963068 - protein, 7 aa, Staphylococcus
LKNEDEV

SEQ ID NO: 1963069 - protein, 5 aa, Staphylococcus
LKNEE

SEQ ID NO: 1963070 - protein, 8 aa, Staphylococcus
LKNEERIN

SEQ ID NO: 1963071 - protein, 5 aa, Staphylococcus
LKNEG

SEQ ID NO: 1963072 - protein, 7 aa, Staphylococcus
LKNEGAN

SEQ ID NO: 1963073 - protein, 6 aa, Staphylococcus
LKNEKN

SEQ ID NO: 1963074 - protein, 7 aa, Staphylococcus
LKNEQTA

SEQ ID NO: 1963075 - protein, 7 aa, Staphylococcus
LKNESNS

SEQ ID NO: 1963076 - protein, 8 aa, Staphylococcus
LKNGGTLA

SEQ ID NO: 1963077 - protein, 7 aa, Staphylococcus
LKNGHTE

SEQ ID NO: 1963078 - protein, 10 aa, Staphylococcus
LKNGKATPSF

SEQ ID NO: 1963079 - protein, 19 aa, Staphylococcus
LKNKADAYPNQLSGGQKQR

SEQ ID NO: 1963080 - protein, 8 aa, Staphylococcus
LKNKGAKN

SEQ ID NO: 1963081 - protein, 24 aa, Staphylococcus
LKNKNENDFKRYTEEYKNLEEFLV

SEQ ID NO: 1963082 - protein, 6 aa, Staphylococcus
LKNLDE

SEQ ID NO: 1963083 - protein, 6 aa, Staphylococcus
LKNMGK

SEQ ID NO: 1963084 - protein, 5 aa, Staphylococcus
LKNNE

SEQ ID NO: 1963085 - protein, 10 aa, Staphylococcus
LKNNEKLPSY

SEQ ID NO: 1963086 - protein, 8 aa, Staphylococcus
LKNPETPI

SEQ ID NO: 1963087 - protein, 9 aa, Staphylococcus
LKNPGKEEI

SEQ ID NO: 1963088 - protein, 11 aa, Staphylococcus
LKNPPKEWRKS

SEQ ID NO: 1963089 - protein, 7 aa, Staphylococcus
LKNQHDI

SEQ ID NO: 1963090 - protein, 13 aa, Staphylococcus
LKNRKRYIHDYIH

SEQ ID NO: 1963091 - protein, 6 aa, Staphylococcus
LKNSGL

SEQ ID NO: 1963092 - protein, 27 aa, Staphylococcus
LKNSNDQAKLKEASDRVKQLTQQYPLY

SEQ ID NO: 1963093 - protein, 6 aa, Staphylococcus
LKNSVS

SEQ ID NO: 1963094 - protein, 7 aa, Staphylococcus
LKPEDTV

SEQ ID NO: 1963095 - protein, 9 aa, Staphylococcus
LKPESTREQ

SEQ ID NO: 1963096 - protein, 31 aa, Staphylococcus
LKPETSGNQLGGVNTSTEDDNKATIRRGPNI

SEQ ID NO: 1963097 - protein, 7 aa, Staphylococcus
LKPFGKD

SEQ ID NO: 1963098 - protein, 4 aa, Staphylococcus
LKPG

SEQ ID NO: 1963099 - protein, 6 aa, Staphylococcus
LKPGTY

SEQ ID NO: 1963100 - protein, 7 aa, Staphylococcus
LKPITPR

SEQ ID NO: 1963101 - protein, 18 aa, Staphylococcus
LKPKEDDSVVQLILPIRT

SEQ ID NO: 1963102 - protein, 6 aa, Staphylococcus
LKPKKQ

SEQ ID NO: 1963103 - protein, 5 aa, Staphylococcus
LKPLE

SEQ ID NO: 1963104 - protein, 9 aa, Staphylococcus
LKPNTEEQP

SEQ ID NO: 1963105 - protein, 17 aa, Staphylococcus
LKPQDMDQVQDENEKKA

SEQ ID NO: 1963106 - protein, 5 aa, Staphylococcus
LKPQE

SEQ ID NO: 1963107 - protein, 7 aa, Staphylococcus
LKPQNTK

SEQ ID NO: 1963108 - protein, 6 aa, Staphylococcus
LKPSAK

SEQ ID NO: 1963109 - protein, 6 aa, Staphylococcus
LKPTNR

SEQ ID NO: 1963110 - protein, 10 aa, Staphylococcus
LKPTPVSPNN

SEQ ID NO: 1963111 - protein, 6 aa, Staphylococcus
LKPYDV

SEQ ID NO: 1963112 - protein, 20 aa, Staphylococcus
LKPYGKDKTIETVRGVGYVI

SEQ ID NO: 1963113 - protein, 6 aa, Staphylococcus
LKPYRE

SEQ ID NO: 1963114 - protein, 24 aa, Staphylococcus
LKQAYEDTRPKIEKSVRNELKETY

SEQ ID NO: 1963115 - protein, 7 aa, Staphylococcus
LKQDGTS

SEQ ID NO: 1963116 - protein, 7 aa, Staphylococcus
LKQDGTT

SEQ ID NO: 1963117 - protein, 6 aa, Staphylococcus
LKQDKY

SEQ ID NO: 1963118 - protein, 7 aa, Staphylococcus
LKQEGTS

SEQ ID NO: 1963119 - protein, 10 aa, Staphylococcus
LKQEHERNLD

SEQ ID NO: 1963120 - protein, 9 aa, Staphylococcus
LKQEVEDAG

SEQ ID NO: 1963121 - protein, 8 aa, Staphylococcus
LKQGFQSA

SEQ ID NO: 1963122 - protein, 5 aa, Staphylococcus
LKQGG

SEQ ID NO: 1963123 - protein, 8 aa, Staphylococcus
LKQGNITE

SEQ ID NO: 1963124 - protein, 9 aa, Staphylococcus
LKQHSRNYA

SEQ ID NO: 1963125 - protein, 6 aa, Staphylococcus
LKQIEQ

SEQ ID NO: 1963126 - protein, 5 aa, Staphylococcus
LKQKA

SEQ ID NO: 1963127 - protein, 13 aa, Staphylococcus
LKQKDSSDKPHSH

SEQ ID NO: 1963128 - protein, 24 aa, Staphylococcus
LKQKKQDKKTLNKIKDAEAKIARN

SEQ ID NO: 1963129 - protein, 14 aa, Staphylococcus
LKQLDKKNHNSNYN

SEQ ID NO: 1963130 - protein, 11 aa, Staphylococcus
LKQNDEKQKFE

SEQ ID NO: 1963131 - protein, 11 aa, Staphylococcus
LKQNGDKQQFD

SEQ ID NO: 1963132 - protein, 10 aa, Staphylococcus
LKQNGEKQKF

SEQ ID NO: 1963133 - protein, 12 aa, Staphylococcus
LKQNGEKQTFEF

SEQ ID NO: 1963134 - protein, 5 aa, Staphylococcus
LKQNH

SEQ ID NO: 1963135 - protein, 8 aa, Staphylococcus
LKQNTDNA

SEQ ID NO: 1963136 - protein, 7 aa, Staphylococcus
LKQNTGL

SEQ ID NO: 1963137 - protein, 6 aa, Staphylococcus
LKQPNA

SEQ ID NO: 1963138 - protein, 8 aa, Staphylococcus
LKQQEGGD

SEQ ID NO: 1963139 - protein, 7 aa, Staphylococcus
LKQQLEK

SEQ ID NO: 1963140 - protein, 6 aa, Staphylococcus
LKQQPN

SEQ ID NO: 1963141 - protein, 16 aa, Staphylococcus
LKQQQNQEKPSYDTKQ

SEQ ID NO: 1963142 - protein, 7 aa, Staphylococcus
LKQSNPE

SEQ ID NO: 1963143 - protein, 8 aa, Staphylococcus
LKQTQSDI

SEQ ID NO: 1963144 - protein, 6 aa, Staphylococcus
LKQYDV

SEQ ID NO: 1963145 - protein, 7 aa, Staphylococcus
LKQYRGK

SEQ ID NO: 1963146 - protein, 7 aa, Staphylococcus
LKRDDDT

SEQ ID NO: 1963147 - protein, 7 aa, Staphylococcus
LKRDYSK

SEQ ID NO: 1963148 - protein, 8 aa, Staphylococcus
LKRETKKI

SEQ ID NO: 1963149 - protein, 17 aa, Staphylococcus
LKRGKSSNSMKIKDIEF

SEQ ID NO: 1963150 - protein, 9 aa, Staphylococcus
LKRGPATNP

SEQ ID NO: 1963151 - protein, 14 aa, Staphylococcus
LKRKDSDEYTDINS

SEQ ID NO: 1963152 - protein, 20 aa, Staphylococcus
LKRKERKQYSKRKNREQRKN

SEQ ID NO: 1963153 - protein, 6 aa, Staphylococcus
LKRKPN

SEQ ID NO: 1963154 - protein, 8 aa, Staphylococcus
LKRPPVSN

SEQ ID NO: 1963155 - protein, 5 aa, Staphylococcus
LKRQY

SEQ ID NO: 1963156 - protein, 4 aa, Staphylococcus
LKRS

SEQ ID NO: 1963157 - protein, 7 aa, Staphylococcus
LKRSEQF

SEQ ID NO: 1963158 - protein, 10 aa, Staphylococcus
LKRSNKSVSD

SEQ ID NO: 1963159 - protein, 7 aa, Staphylococcus
LKRTDKT

SEQ ID NO: 1963160 - protein, 6 aa, Staphylococcus
LKRTDY

SEQ ID NO: 1963161 - protein, 18 aa, Staphylococcus
LKRTPSFQVSKPEEDTGI

SEQ ID NO: 1963162 - protein, 18 aa, Staphylococcus
LKRTPSFSVNRPNEETGI

SEQ ID NO: 1963163 - protein, 18 aa, Staphylococcus
LKRTPSFSVSKPDEEAGV

SEQ ID NO: 1963164 - protein, 10 aa, Staphylococcus
LKRTSVSRKI

SEQ ID NO: 1963165 - protein, 4 aa, Staphylococcus
LKRY

SEQ ID NO: 1963166 - protein, 7 aa, Staphylococcus
LKSADQP

SEQ ID NO: 1963167 - protein, 12 aa, Staphylococcus
LKSAQIKIKKSE

SEQ ID NO: 1963168 - protein, 4 aa, Staphylococcus
LKSD

SEQ ID NO: 1963169 - protein, 11 aa, Staphylococcus
LKSDDQDEPDY

SEQ ID NO: 1963170 - protein, 10 aa, Staphylococcus
LKSDDSKGKM

SEQ ID NO: 1963171 - protein, 7 aa, Staphylococcus
LKSDPTF

SEQ ID NO: 1963172 - protein, 10 aa, Staphylococcus
LKSETKTLPH

SEQ ID NO: 1963173 - protein, 21 aa, Staphylococcus
LKSETTPSQMPTFDKDKSYTV

SEQ ID NO: 1963174 - protein, 11 aa, Staphylococcus
LKSFNTDVKHT

SEQ ID NO: 1963175 - protein, 7 aa, Staphylococcus
LKSGERK

SEQ ID NO: 1963176 - protein, 6 aa, Staphylococcus
LKSGGA

SEQ ID NO: 1963177 - protein, 9 aa, Staphylococcus
LKSGKLKES

SEQ ID NO: 1963178 - protein, 10 aa, Staphylococcus
LKSGKYSAKE

SEQ ID NO: 1963179 - protein, 10 aa, Staphylococcus
LKSGVGTTKF

SEQ ID NO: 1963180 - protein, 6 aa, Staphylococcus
LKSHPN

SEQ ID NO: 1963181 - protein, 17 aa, Staphylococcus
LKSHTTPSNLKEIEQEI

SEQ ID NO: 1963182 - protein, 4 aa, Staphylococcus
LKSI

SEQ ID NO: 1963183 - protein, 10 aa, Staphylococcus
LKSINSDDAS

SEQ ID NO: 1963184 - protein, 5 aa, Staphylococcus
LKSKG

SEQ ID NO: 1963185 - protein, 7 aa, Staphylococcus
LKSKHVP

SEQ ID NO: 1963186 - protein, 6 aa, Staphylococcus
LKSKIE

SEQ ID NO: 1963187 - protein, 7 aa, Staphylococcus
LKSKPEL

SEQ ID NO: 1963188 - protein, 18 aa, Staphylococcus
LKSLESEAPEVNKANKYL

SEQ ID NO: 1963189 - protein, 7 aa, Staphylococcus
LKSLESQ

SEQ ID NO: 1963190 - protein, 7 aa, Staphylococcus
LKSLGTD

SEQ ID NO: 1963191 - protein, 9 aa, Staphylococcus
LKSLPTTPP

SEQ ID NO: 1963192 - protein, 8 aa, Staphylococcus
LKSLQSDL

SEQ ID NO: 1963193 - protein, 8 aa, Staphylococcus
LKSNKGDI

SEQ ID NO: 1963194 - protein, 7 aa, Staphylococcus
LKSNTIH

SEQ ID NO: 1963195 - protein, 4 aa, Staphylococcus
LKSQ

SEQ ID NO: 1963196 - protein, 7 aa, Staphylococcus
LKSQGVR

SEQ ID NO: 1963197 - protein, 15 aa, Staphylococcus
LKSQQADKEAQQAQV

SEQ ID NO: 1963198 - protein, 8 aa, Staphylococcus
LKSQSQED

SEQ ID NO: 1963199 - protein, 5 aa, Staphylococcus
LKSRI

SEQ ID NO: 1963200 - protein, 9 aa, Staphylococcus
LKSRSTRKQ

SEQ ID NO: 1963201 - protein, 7 aa, Staphylococcus
LKSSDQI

SEQ ID NO: 1963202 - protein, 8 aa, Staphylococcus
LKSSDQVM

SEQ ID NO: 1963203 - protein, 6 aa, Staphylococcus
LKSSDY

SEQ ID NO: 1963204 - protein, 7 aa, Staphylococcus
LKSSLPL

SEQ ID NO: 1963205 - protein, 9 aa, Staphylococcus
LKSSMKKIN

SEQ ID NO: 1963206 - protein, 7 aa, Staphylococcus
LKSSNYS

SEQ ID NO: 1963207 - protein, 6 aa, Staphylococcus
LKSTGL

SEQ ID NO: 1963208 - protein, 10 aa, Staphylococcus
LKSVAAAKAL

SEQ ID NO: 1963209 - protein, 6 aa, Staphylococcus
LKSYDE

SEQ ID NO: 1963210 - protein, 9 aa, Staphylococcus
LKSYPGNYE

SEQ ID NO: 1963211 - protein, 12 aa, Staphylococcus
LKSYTEKEMQQT

SEQ ID NO: 1963212 - protein, 10 aa, Staphylococcus
LKTDLKNKIE

SEQ ID NO: 1963213 - protein, 10 aa, Staphylococcus
LKTDPTIENK

SEQ ID NO: 1963214 - protein, 4 aa, Staphylococcus
LKTE

SEQ ID NO: 1963215 - protein, 10 aa, Staphylococcus
LKTEDSRNVL

SEQ ID NO: 1963216 - protein, 14 aa, Staphylococcus
LKTEDSRQALPNTF

SEQ ID NO: 1963217 - protein, 10 aa, Staphylococcus
LKTEDSRRVL

SEQ ID NO: 1963218 - protein, 10 aa, Staphylococcus
LKTEKNDQAM

SEQ ID NO: 1963219 - protein, 9 aa, Staphylococcus
LKTEPNLTQ

SEQ ID NO: 1963220 - protein, 9 aa, Staphylococcus
LKTGAEAEY

SEQ ID NO: 1963221 - protein, 13 aa, Staphylococcus
LKTGNVQEPDTGC

SEQ ID NO: 1963222 - protein, 7 aa, Staphylococcus
LKTGRNA

SEQ ID NO: 1963223 - protein, 5 aa, Staphylococcus
LKTHN

SEQ ID NO: 1963224 - protein, 23 aa, Staphylococcus
LKTIPDRARQLTDEQLSQELEQS

SEQ ID NO: 1963225 - protein, 12 aa, Staphylococcus
LKTITKDDSNET

SEQ ID NO: 1963226 - protein, 6 aa, Staphylococcus
LKTKNG

SEQ ID NO: 1963227 - protein, 7 aa, Staphylococcus
LKTKQNV

SEQ ID NO: 1963228 - protein, 12 aa, Staphylococcus
LKTNDKKQYLED

SEQ ID NO: 1963229 - protein, 11 aa, Staphylococcus
LKTNDKQQYLE

SEQ ID NO: 1963230 - protein, 12 aa, Staphylococcus
LKTNDKSKYLED

SEQ ID NO: 1963231 - protein, 9 aa, Staphylococcus
LKTNDKSQF

SEQ ID NO: 1963232 - protein, 11 aa, Staphylococcus
LKTNGKSQYLE

SEQ ID NO: 1963233 - protein, 12 aa, Staphylococcus
LKTNGSGKTNEV

SEQ ID NO: 1963234 - protein, 5 aa, Staphylococcus
LKTNN

SEQ ID NO: 1963235 - protein, 10 aa, Staphylococcus
LKTNQYETKD

SEQ ID NO: 1963236 - protein, 5 aa, Staphylococcus
LKTPL

SEQ ID NO: 1963237 - protein, 18 aa, Staphylococcus
LKTPNRDPRDSYETPQLK

SEQ ID NO: 1963238 - protein, 7 aa, Staphylococcus
LKTQLEK

SEQ ID NO: 1963239 - protein, 7 aa, Staphylococcus
LKTQVDK

SEQ ID NO: 1963240 - protein, 15 aa, Staphylococcus
LKTRDELRKLEQNYD

SEQ ID NO: 1963241 - protein, 8 aa, Staphylococcus
LKTREHEL

SEQ ID NO: 1963242 - protein, 11 aa, Staphylococcus
LKTRKEDEVKA

SEQ ID NO: 1963243 - protein, 11 aa, Staphylococcus
LKTRNEDQVKE

SEQ ID NO: 1963244 - protein, 6 aa, Staphylococcus
LKTRVP

SEQ ID NO: 1963245 - protein, 12 aa, Staphylococcus
LKTSGLDTTRKS

SEQ ID NO: 1963246 - protein, 7 aa, Staphylococcus
LKTSMKK

SEQ ID NO: 1963247 - protein, 5 aa, Staphylococcus
LKTTL

SEQ ID NO: 1963248 - protein, 7 aa, Staphylococcus
LKTTQKD

SEQ ID NO: 1963249 - protein, 7 aa, Staphylococcus
LKTTQND

SEQ ID NO: 1963250 - protein, 7 aa, Staphylococcus
LKTTQSD

SEQ ID NO: 1963251 - protein, 8 aa, Staphylococcus
LKTYPGNY

SEQ ID NO: 1963252 - protein, 10 aa, Staphylococcus
LKVKSDKQVY

SEQ ID NO: 1963253 - protein, 10 aa, Staphylococcus
LKVNTKDDGI

SEQ ID NO: 1963254 - protein, 8 aa, Staphylococcus
LKVPDKQD

SEQ ID NO: 1963255 - protein, 12 aa, Staphylococcus
LKVTNSQSEVSG

SEQ ID NO: 1963256 - protein, 8 aa, Staphylococcus
LKYEEGPC

SEQ ID NO: 1963257 - protein, 4 aa, Staphylococcus
LKYK

SEQ ID NO: 1963258 - protein, 11 aa, Staphylococcus
LKYNDRNKGLE

SEQ ID NO: 1963259 - protein, 9 aa, Staphylococcus
LKYSDNTTI

SEQ ID NO: 1963260 - protein, 9 aa, Staphylococcus
LLASTSEKY

SEQ ID NO: 1963261 - protein, 4 aa, Staphylococcus
LLDE

SEQ ID NO: 1963262 - protein, 11 aa, Staphylococcus
LLDEGKKETTV

SEQ ID NO: 1963263 - protein, 11 aa, Staphylococcus
LLDEGKSSNNV

SEQ ID NO: 1963264 - protein, 5 aa, Staphylococcus
LLDEP

SEQ ID NO: 1963265 - protein, 12 aa, Staphylococcus
LLDKGKKEGHLS

SEQ ID NO: 1963266 - protein, 17 aa, Staphylococcus
LLDNGETVAPEVKEGDS

SEQ ID NO: 1963267 - protein, 15 aa, Staphylococcus
LLEERGSVELSPTSD

SEQ ID NO: 1963268 - protein, 12 aa, Staphylococcus
LLEKGKKEGHLS

SEQ ID NO: 1963269 - protein, 6 aa, Staphylococcus
LLGDNG

SEQ ID NO: 1963270 - protein, 6 aa, Staphylococcus
LLGDQG

SEQ ID NO: 1963271 - protein, 24 aa, Staphylococcus
LLGERGATKTYGAQKGASETDLET

SEQ ID NO: 1963272 - protein, 8 aa, Staphylococcus
LLGPNGAT

SEQ ID NO: 1963273 - protein, 5 aa, Staphylococcus
LLKNG

SEQ ID NO: 1963274 - protein, 12 aa, Staphylococcus
LLKTSGDTAYSK

SEQ ID NO: 1963275 - protein, 5 aa, Staphylococcus
LLNDD

SEQ ID NO: 1963276 - protein, 16 aa, Staphylococcus
LLNGPNATFDGDKDEF

SEQ ID NO: 1963277 - protein, 9 aa, Staphylococcus
LLNPPREKG

SEQ ID NO: 1963278 - protein, 5 aa, Staphylococcus
LLPEE

SEQ ID NO: 1963279 - protein, 7 aa, Staphylococcus
LLPKDSE

SEQ ID NO: 1963280 - protein, 11 aa, Staphylococcus
LLPKNNSVSEA

SEQ ID NO: 1963281 - protein, 12 aa, Staphylococcus
LLPTGGVDATNI

SEQ ID NO: 1963282 - protein, 13 aa, Staphylococcus
LLQPKAQKEIQED

SEQ ID NO: 1963283 - protein, 13 aa, Staphylococcus
LLRTGKDALLKNG

SEQ ID NO: 1963284 - protein, 7 aa, Staphylococcus
LLSEAEY

SEQ ID NO: 1963285 - protein, 10 aa, Staphylococcus
LLSSGGKRVR

SEQ ID NO: 1963286 - protein, 13 aa, Staphylococcus
LLSSRKKVQQFTE

SEQ ID NO: 1963287 - protein, 14 aa, Staphylococcus
LLSSRKKVQQFTEN

SEQ ID NO: 1963288 - protein, 12 aa, Staphylococcus
LLTDDKEISPYT

SEQ ID NO: 1963289 - protein, 9 aa, Staphylococcus
LLTKPNQQH

SEQ ID NO: 1963290 - protein, 8 aa, Staphylococcus
LLTRTDGK

SEQ ID NO: 1963291 - protein, 6 aa, Staphylococcus
LMDGTT

SEQ ID NO: 1963292 - protein, 6 aa, Staphylococcus
LMEGDT

SEQ ID NO: 1963293 - protein, 6 aa, Staphylococcus
LMPPNE

SEQ ID NO: 1963294 - protein, 10 aa, Staphylococcus
LMSGSGPTVY

SEQ ID NO: 1963295 - protein, 5 aa, Staphylococcus
LMSST

SEQ ID NO: 1963296 - protein, 6 aa, Staphylococcus
LMTKPK

SEQ ID NO: 1963297 - protein, 5 aa, Staphylococcus
LNAAS

SEQ ID NO: 1963298 - protein, 12 aa, Staphylococcus
LNADTEYPKGTY

SEQ ID NO: 1963299 - protein, 11 aa, Staphylococcus
LNADTVKKHPN

SEQ ID NO: 1963300 - protein, 7 aa, Staphylococcus
LNAEGRK

SEQ ID NO: 1963301 - protein, 6 aa, Staphylococcus
LNAETS

SEQ ID NO: 1963302 - protein, 7 aa, Staphylococcus
LNAGEGR

SEQ ID NO: 1963303 - protein, 8 aa, Staphylococcus
LNAGGKRI

SEQ ID NO: 1963304 - protein, 12 aa, Staphylococcus
LNAPNNGREQEL

SEQ ID NO: 1963305 - protein, 10 aa, Staphylococcus
LNAPSKHAAQ

SEQ ID NO: 1963306 - protein, 11 aa, Staphylococcus
LNAQKQSLTKI

SEQ ID NO: 1963307 - protein, 13 aa, Staphylococcus
LNAQQSDAEFNEK

SEQ ID NO: 1963308 - protein, 5 aa, Staphylococcus
LNARY

SEQ ID NO: 1963309 - protein, 6 aa, Staphylococcus
LNASEF

SEQ ID NO: 1963310 - protein, 5 aa, Staphylococcus
LNAST

SEQ ID NO: 1963311 - protein, 8 aa, Staphylococcus
LNAYPGNY

SEQ ID NO: 1963312 - protein, 4 aa, Staphylococcus
LNDA

SEQ ID NO: 1963313 - protein, 9 aa, Staphylococcus
LNDDFEDSL

SEQ ID NO: 1963314 - protein, 18 aa, Staphylococcus
LNDDNRVANIAKNKDGEV

SEQ ID NO: 1963315 - protein, 8 aa, Staphylococcus
LNDDQNGL

SEQ ID NO: 1963316 - protein, 7 aa, Staphylococcus
LNDDTSQ

SEQ ID NO: 1963317 - protein, 24 aa, Staphylococcus
LNDDYKNDIPNNTEQTDYKVFALV

SEQ ID NO: 1963318 - protein, 5 aa, Staphylococcus
LNDEE

SEQ ID NO: 1963319 - protein, 7 aa, Staphylococcus
LNDEFDE

SEQ ID NO: 1963320 - protein, 7 aa, Staphylococcus
LNDEGIE

SEQ ID NO: 1963321 - protein, 5 aa, Staphylococcus
LNDEK

SEQ ID NO: 1963322 - protein, 10 aa, Staphylococcus
LNDELGGGSI

SEQ ID NO: 1963323 - protein, 7 aa, Staphylococcus
LNDENRV

SEQ ID NO: 1963324 - protein, 9 aa, Staphylococcus
LNDEPYENE

SEQ ID NO: 1963325 - protein, 4 aa, Staphylococcus
LNDG

SEQ ID NO: 1963326 - protein, 7 aa, Staphylococcus
LNDGTKR

SEQ ID NO: 1963327 - protein, 4 aa, Staphylococcus
LNDH

SEQ ID NO: 1963328 - protein, 21 aa, Staphylococcus
LNDKESISGSQAKADKALSDA

SEQ ID NO: 1963329 - protein, 8 aa, Staphylococcus
LNDKQPKL

SEQ ID NO: 1963330 - protein, 9 aa, Staphylococcus
LNDKTPTNL

SEQ ID NO: 1963331 - protein, 8 aa, Staphylococcus
LNDLSDEE

SEQ ID NO: 1963332 - protein, 5 aa, Staphylococcus
LNDND

SEQ ID NO: 1963333 - protein, 10 aa, Staphylococcus
LNDNDADTIA

SEQ ID NO: 1963334 - protein, 8 aa, Staphylococcus
LNDNKDKI

SEQ ID NO: 1963335 - protein, 4 aa, Staphylococcus
LNDP

SEQ ID NO: 1963336 - protein, 6 aa, Staphylococcus
LNDSEA

SEQ ID NO: 1963337 - protein, 10 aa, Staphylococcus
LNDSLGGGSI

SEQ ID NO: 1963338 - protein, 26 aa, Staphylococcus
LNDSQQPSKSTSHLENENSQQQEHYN

SEQ ID NO: 1963339 - protein, 9 aa, Staphylococcus
LNDSQRGLA

SEQ ID NO: 1963340 - protein, 10 aa, Staphylococcus
LNDTLGGGSI

SEQ ID NO: 1963341 - protein, 6 aa, Staphylococcus
LNDTQK

SEQ ID NO: 1963342 - protein, 7 aa, Staphylococcus
LNDTQSQ

SEQ ID NO: 1963343 - protein, 6 aa, Staphylococcus
LNDTSP

SEQ ID NO: 1963344 - protein, 9 aa, Staphylococcus
LNDVAPARA

SEQ ID NO: 1963345 - protein, 26 aa, Staphylococcus
LNDYEEKTKEFEQQLQNQKEEVETLS

SEQ ID NO: 1963346 - protein, 32 aa, Staphylococcus
LNDYKGGDISYNPNVPSYSAKYQLSNDDYNVQ

SEQ ID NO: 1963347 - protein, 4 aa, Staphylococcus
LNEA

SEQ ID NO: 1963348 - protein, 8 aa, Staphylococcus
LNEAADHT

SEQ ID NO: 1963349 - protein, 9 aa, Staphylococcus
LNEAEEKVR

SEQ ID NO: 1963350 - protein, 18 aa, Staphylococcus
LNEAKEAMEQARTNKSGS

SEQ ID NO: 1963351 - protein, 8 aa, Staphylococcus
LNEDDSVS

SEQ ID NO: 1963352 - protein, 7 aa, Staphylococcus
LNEDFEE

SEQ ID NO: 1963353 - protein, 7 aa, Staphylococcus
LNEDGTF

SEQ ID NO: 1963354 - protein, 10 aa, Staphylococcus
LNEDKAADKL

SEQ ID NO: 1963355 - protein, 11 aa, Staphylococcus
LNEDSSRSFSD

SEQ ID NO: 1963356 - protein, 6 aa, Staphylococcus
LNEDTI

SEQ ID NO: 1963357 - protein, 8 aa, Staphylococcus
LNEENDLT

SEQ ID NO: 1963358 - protein, 9 aa, Staphylococcus
LNEENKNTL

SEQ ID NO: 1963359 - protein, 9 aa, Staphylococcus
LNEEPDKYI

SEQ ID NO: 1963360 - protein, 7 aa, Staphylococcus
LNEESKK

SEQ ID NO: 1963361 - protein, 7 aa, Staphylococcus
LNEEYNK

SEQ ID NO: 1963362 - protein, 7 aa, Staphylococcus
LNEGDKI

SEQ ID NO: 1963363 - protein, 5 aa, Staphylococcus
LNEGE

SEQ ID NO: 1963364 - protein, 12 aa, Staphylococcus
LNEHATKENAKG

SEQ ID NO: 1963365 - protein, 9 aa, Staphylococcus
LNEITEDSV

SEQ ID NO: 1963366 - protein, 7 aa, Staphylococcus
LNEKEIN

SEQ ID NO: 1963367 - protein, 9 aa, Staphylococcus
LNEKYGTHY

SEQ ID NO: 1963368 - protein, 4 aa, Staphylococcus
LNEN

SEQ ID NO: 1963369 - protein, 7 aa, Staphylococcus
LNENTSN

SEQ ID NO: 1963370 - protein, 8 aa, Staphylococcus
LNENVESK

SEQ ID NO: 1963371 - protein, 11 aa, Staphylococcus
LNENVKNEKIQ

SEQ ID NO: 1963372 - protein, 7 aa, Staphylococcus
LNEPESD

SEQ ID NO: 1963373 - protein, 7 aa, Staphylococcus
LNEPHAQ

SEQ ID NO: 1963374 - protein, 6 aa, Staphylococcus
LNEPNK

SEQ ID NO: 1963375 - protein, 7 aa, Staphylococcus
LNEPNVR

SEQ ID NO: 1963376 - protein, 9 aa, Staphylococcus
LNEPSIKAA

SEQ ID NO: 1963377 - protein, 11 aa, Staphylococcus
LNEPSKKAAQR

SEQ ID NO: 1963378 - protein, 8 aa, Staphylococcus
LNEPSRKA

SEQ ID NO: 1963379 - protein, 7 aa, Staphylococcus
LNEQEAV

SEQ ID NO: 1963380 - protein, 5 aa, Staphylococcus
LNEQG

SEQ ID NO: 1963381 - protein, 13 aa, Staphylococcus
LNEQTEKNNGSVS

SEQ ID NO: 1963382 - protein, 4 aa, Staphylococcus
LNER

SEQ ID NO: 1963383 - protein, 5 aa, Staphylococcus
LNERD

SEQ ID NO: 1963384 - protein, 6 aa, Staphylococcus
LNESEF

SEQ ID NO: 1963385 - protein, 7 aa, Staphylococcus
LNESERL

SEQ ID NO: 1963386 - protein, 6 aa, Staphylococcus
LNESES

SEQ ID NO: 1963387 - protein, 5 aa, Staphylococcus
LNESF

SEQ ID NO: 1963388 - protein, 5 aa, Staphylococcus
LNESG

SEQ ID NO: 1963389 - protein, 11 aa, Staphylococcus
LNESGGKSIEN

SEQ ID NO: 1963390 - protein, 11 aa, Staphylococcus
LNESGGKSIET

SEQ ID NO: 1963391 - protein, 14 aa, Staphylococcus
LNESVQKWETSKDG

SEQ ID NO: 1963392 - protein, 27 aa, Staphylococcus
LNETNPSNRAQEKKKEPEKKEFKSKNF

SEQ ID NO: 1963393 - protein, 9 aa, Staphylococcus
LNETRKKGH

SEQ ID NO: 1963394 - protein, 7 aa, Staphylococcus
LNETSQN

SEQ ID NO: 1963395 - protein, 6 aa, Staphylococcus
LNETYD

SEQ ID NO: 1963396 - protein, 7 aa, Staphylococcus
LNEVTDE

SEQ ID NO: 1963397 - protein, 11 aa, Staphylococcus
LNEYEKSDLTN

SEQ ID NO: 1963398 - protein, 11 aa, Staphylococcus
LNFDGNEPSFE

SEQ ID NO: 1963399 - protein, 10 aa, Staphylococcus
LNFSDSDSSH

SEQ ID NO: 1963400 - protein, 7 aa, Staphylococcus
LNGAAIK

SEQ ID NO: 1963401 - protein, 7 aa, Staphylococcus
LNGDETV

SEQ ID NO: 1963402 - protein, 6 aa, Staphylococcus
LNGDGI

SEQ ID NO: 1963403 - protein, 8 aa, Staphylococcus
LNGDGPTL

SEQ ID NO: 1963404 - protein, 4 aa, Staphylococcus
LNGE

SEQ ID NO: 1963405 - protein, 7 aa, Staphylococcus
LNGEGVD

SEQ ID NO: 1963406 - protein, 12 aa, Staphylococcus
LNGEHAKDISDK

SEQ ID NO: 1963407 - protein, 10 aa, Staphylococcus
LNGEINEDVT

SEQ ID NO: 1963408 - protein, 15 aa, Staphylococcus
LNGENNIDIEDFTMS

SEQ ID NO: 1963409 - protein, 7 aa, Staphylococcus
LNGEPGI

SEQ ID NO: 1963410 - protein, 8 aa, Staphylococcus
LNGEPGVY

SEQ ID NO: 1963411 - protein, 7 aa, Staphylococcus
LNGEPLD

SEQ ID NO: 1963412 - protein, 8 aa, Staphylococcus
LNGEPVSN

SEQ ID NO: 1963413 - protein, 5 aa, Staphylococcus
LNGET

SEQ ID NO: 1963414 - protein, 34 aa, Staphylococcus
LNGGATQATSNESAASTSEETTTTATTQSVPEGD

SEQ ID NO: 1963415 - protein, 5 aa, Staphylococcus
LNGGP

SEQ ID NO: 1963416 - protein, 43 aa, Staphylococcus
LNGGQATASNESAVATSEETTSSAQSAAVSTEGEYPETTEKIP

SEQ ID NO: 1963417 - protein, 9 aa, Staphylococcus
LNGGSIDLS

SEQ ID NO: 1963418 - protein, 45 aa, Staphylococcus
LNGGSTDSASNESAAASSTGSEETSASASQSVPEGDFPETTEKIP

SEQ ID NO: 1963419 - protein, 9 aa, Staphylococcus
LNGHGPEDL

SEQ ID NO: 1963420 - protein, 12 aa, Staphylococcus
LNGKGSNKETRH

SEQ ID NO: 1963421 - protein, 7 aa, Staphylococcus
LNGKLTG

SEQ ID NO: 1963422 - protein, 11 aa, Staphylococcus
LNGNDSAKAYR

SEQ ID NO: 1963423 - protein, 12 aa, Staphylococcus
LNGNNKNAATYD

SEQ ID NO: 1963424 - protein, 9 aa, Staphylococcus
LNGNPISDD

SEQ ID NO: 1963425 - protein, 8 aa, Staphylococcus
LNGPDNKL

SEQ ID NO: 1963426 - protein, 4 aa, Staphylococcus
LNGQ

SEQ ID NO: 1963427 - protein, 22 aa, Staphylococcus
LNGQDGKNGTPGKDGQTPTVET

SEQ ID NO: 1963428 - protein, 33 aa, Staphylococcus
LNGQDGQKGANGQDGKSVTAITERGTQDGHKGS

SEQ ID NO: 1963429 - protein, 9 aa, Staphylococcus
LNGQELADD

SEQ ID NO: 1963430 - protein, 8 aa, Staphylococcus
LNGQGKLD

SEQ ID NO: 1963431 - protein, 11 aa, Staphylococcus
LNGQGSNKETR

SEQ ID NO: 1963432 - protein, 6 aa, Staphylococcus
LNGQKA

SEQ ID NO: 1963433 - protein, 8 aa, Staphylococcus
LNGQLSGV

SEQ ID NO: 1963434 - protein, 6 aa, Staphylococcus
LNGQLT

SEQ ID NO: 1963435 - protein, 10 aa, Staphylococcus
LNGQLTGAEN

SEQ ID NO: 1963436 - protein, 9 aa, Staphylococcus
LNGQPKEPF

SEQ ID NO: 1963437 - protein, 18 aa, Staphylococcus
LNGQPLDKLSNKALSNIR

SEQ ID NO: 1963438 - protein, 4 aa, Staphylococcus
LNGR

SEQ ID NO: 1963439 - protein, 5 aa, Staphylococcus
LNGRG

SEQ ID NO: 1963440 - protein, 11 aa, Staphylococcus
LNGRGSNKETR

SEQ ID NO: 1963441 - protein, 12 aa, Staphylococcus
LNGRGSNKETRH

SEQ ID NO: 1963442 - protein, 10 aa, Staphylococcus
LNGRGSNKEV

SEQ ID NO: 1963443 - protein, 7 aa, Staphylococcus
LNGRYQG

SEQ ID NO: 1963444 - protein, 5 aa, Staphylococcus
LNGSV

SEQ ID NO: 1963445 - protein, 16 aa, Staphylococcus
LNGTMQSYARNQKEGA

SEQ ID NO: 1963446 - protein, 6 aa, Staphylococcus
LNGTVT

SEQ ID NO: 1963447 - protein, 24 aa, Staphylococcus
LNGVSSAEVDLDKGQVRVGYSEDK

SEQ ID NO: 1963448 - protein, 15 aa, Staphylococcus
LNHHSDEQEESKTVE

SEQ ID NO: 1963449 - protein, 4 aa, Staphylococcus
LNIN

SEQ ID NO: 1963450 - protein, 4 aa, Staphylococcus
LNIP

SEQ ID NO: 1963451 - protein, 5 aa, Staphylococcus
LNIPD

SEQ ID NO: 1963452 - protein, 6 aa, Staphylococcus
LNIPED

SEQ ID NO: 1963453 - protein, 6 aa, Staphylococcus
LNIPSN

SEQ ID NO: 1963454 - protein, 8 aa, Staphylococcus
LNKAQDKL

SEQ ID NO: 1963455 - protein, 16 aa, Staphylococcus
LNKDQRIGPDPATFEG

SEQ ID NO: 1963456 - protein, 15 aa, Staphylococcus
LNKGDRSGEEVAQRM

SEQ ID NO: 1963457 - protein, 12 aa, Staphylococcus
LNKGGRDGEAVA

SEQ ID NO: 1963458 - protein, 11 aa, Staphylococcus
LNKGNVRTGEI

SEQ ID NO: 1963459 - protein, 10 aa, Staphylococcus
LNKGTKEAGH

SEQ ID NO: 1963460 - protein, 4 aa, Staphylococcus
LNKK

SEQ ID NO: 1963461 - protein, 10 aa, Staphylococcus
LNKKDAKNRA

SEQ ID NO: 1963462 - protein, 10 aa, Staphylococcus
LNKKEDGLKF

SEQ ID NO: 1963463 - protein, 7 aa, Staphylococcus
LNKNEHK

SEQ ID NO: 1963464 - protein, 13 aa, Staphylococcus
LNKNGNKVRKQER

SEQ ID NO: 1963465 - protein, 7 aa, Staphylococcus
LNKPKTV

SEQ ID NO: 1963466 - protein, 4 aa, Staphylococcus
LNKQ

SEQ ID NO: 1963467 - protein, 26 aa, Staphylococcus
LNKQGQDVGEKYRTGIYSDDSNHLNE

SEQ ID NO: 1963468 - protein, 26 aa, Staphylococcus
LNKQGVDKGPKYRTGVYSENENHLKE

SEQ ID NO: 1963469 - protein, 6 aa, Staphylococcus
LNKRGY

SEQ ID NO: 1963470 - protein, 6 aa, Staphylococcus
LNKRND

SEQ ID NO: 1963471 - protein, 13 aa, Staphylococcus
LNKSFSENTQSRF

SEQ ID NO: 1963472 - protein, 8 aa, Staphylococcus
LNKSSTIL

SEQ ID NO: 1963473 - protein, 7 aa, Staphylococcus
LNKTAKL

SEQ ID NO: 1963474 - protein, 9 aa, Staphylococcus
LNKTALNTQ

SEQ ID NO: 1963475 - protein, 7 aa, Staphylococcus
LNKTYDD

SEQ ID NO: 1963476 - protein, 4 aa, Staphylococcus
LNLD

SEQ ID NO: 1963477 - protein, 4 aa, Staphylococcus
LNLE

SEQ ID NO: 1963478 - protein, 6 aa, Staphylococcus
LNLPAD

SEQ ID NO: 1963479 - protein, 6 aa, Staphylococcus
LNLPED

SEQ ID NO: 1963480 - protein, 5 aa, Staphylococcus
LNLPK

SEQ ID NO: 1963481 - protein, 6 aa, Staphylococcus
LNLPKD

SEQ ID NO: 1963482 - protein, 6 aa, Staphylococcus
LNLPSD

SEQ ID NO: 1963483 - protein, 6 aa, Staphylococcus
LNNDDE

SEQ ID NO: 1963484 - protein, 6 aa, Staphylococcus
LNNDEV

SEQ ID NO: 1963485 - protein, 8 aa, Staphylococcus
LNNDFEES

SEQ ID NO: 1963486 - protein, 5 aa, Staphylococcus
LNNEE

SEQ ID NO: 1963487 - protein, 5 aa, Staphylococcus
LNNEK

SEQ ID NO: 1963488 - protein, 12 aa, Staphylococcus
LNNEKATLTKDL

SEQ ID NO: 1963489 - protein, 26 aa, Staphylococcus
LNNEKLSDNSLNTDTYPFDHLELMNI

SEQ ID NO: 1963490 - protein, 6 aa, Staphylococcus
LNNEKN

SEQ ID NO: 1963491 - protein, 9 aa, Staphylococcus
LNNEKQERH

SEQ ID NO: 1963492 - protein, 8 aa, Staphylococcus
LNNEQRDV

SEQ ID NO: 1963493 - protein, 14 aa, Staphylococcus
LNNEVGQQQDYYQP

SEQ ID NO: 1963494 - protein, 6 aa, Staphylococcus
LNNGGT

SEQ ID NO: 1963495 - protein, 7 aa, Staphylococcus
LNNGSKI

SEQ ID NO: 1963496 - protein, 7 aa, Staphylococcus
LNNKKER

SEQ ID NO: 1963497 - protein, 10 aa, Staphylococcus
LNNKVGKDEV

SEQ ID NO: 1963498 - protein, 4 aa, Staphylococcus
LNNN

SEQ ID NO: 1963499 - protein, 11 aa, Staphylococcus
LNNNNSPLRPE

SEQ ID NO: 1963500 - protein, 9 aa, Staphylococcus
LNNNSKFQN

SEQ ID NO: 1963501 - protein, 6 aa, Staphylococcus
LNNPEE

SEQ ID NO: 1963502 - protein, 5 aa, Staphylococcus
LNNPF

SEQ ID NO: 1963503 - protein, 5 aa, Staphylococcus
LNNPQ

SEQ ID NO: 1963504 - protein, 5 aa, Staphylococcus
LNNPS

SEQ ID NO: 1963505 - protein, 13 aa, Staphylococcus
LNNPTFTEEQNNK

SEQ ID NO: 1963506 - protein, 7 aa, Staphylococcus
LNNQQDI

SEQ ID NO: 1963507 - protein, 10 aa, Staphylococcus
LNNQQNGSYT

SEQ ID NO: 1963508 - protein, 7 aa, Staphylococcus
LNNRGNM

SEQ ID NO: 1963509 - protein, 7 aa, Staphylococcus
LNNSDKI

SEQ ID NO: 1963510 - protein, 11 aa, Staphylococcus
LNNTKKHAQTN

SEQ ID NO: 1963511 - protein, 6 aa, Staphylococcus
LNNYEQ

SEQ ID NO: 1963512 - protein, 16 aa, Staphylococcus
LNPAPDEIGFSNNKRD

SEQ ID NO: 1963513 - protein, 4 aa, Staphylococcus
LNPD

SEQ ID NO: 1963514 - protein, 12 aa, Staphylococcus
LNPDFKKASEQL

SEQ ID NO: 1963515 - protein, 7 aa, Staphylococcus
LNPDNGA

SEQ ID NO: 1963516 - protein, 4 aa, Staphylococcus
LNPE

SEQ ID NO: 1963517 - protein, 6 aa, Staphylococcus
LNPEDK

SEQ ID NO: 1963518 - protein, 7 aa, Staphylococcus
LNPEITS

SEQ ID NO: 1963519 - protein, 12 aa, Staphylococcus
LNPKARQKWILK

SEQ ID NO: 1963520 - protein, 7 aa, Staphylococcus
LNPKGIN

SEQ ID NO: 1963521 - protein, 5 aa, Staphylococcus
LNPLE

SEQ ID NO: 1963522 - protein, 6 aa, Staphylococcus
LNPLTT

SEQ ID NO: 1963523 - protein, 18 aa, Staphylococcus
LNPNRKKIESKGIKSVRA

SEQ ID NO: 1963524 - protein, 7 aa, Staphylococcus
LNPNRSD

SEQ ID NO: 1963525 - protein, 12 aa, Staphylococcus
LNPNSQRDIQEQ

SEQ ID NO: 1963526 - protein, 5 aa, Staphylococcus
LNPNY

SEQ ID NO: 1963527 - protein, 4 aa, Staphylococcus
LNPQ

SEQ ID NO: 1963528 - protein, 10 aa, Staphylococcus
LNPQATADQI

SEQ ID NO: 1963529 - protein, 6 aa, Staphylococcus
LNPTDE

SEQ ID NO: 1963530 - protein, 7 aa, Staphylococcus
LNPTITS

SEQ ID NO: 1963531 - protein, 24 aa, Staphylococcus
LNPTKVGSNQSEASSNIKYGGRGM

SEQ ID NO: 1963532 - protein, 9 aa, Staphylococcus
LNQADKDVK

SEQ ID NO: 1963533 - protein, 5 aa, Staphylococcus
LNQAS

SEQ ID NO: 1963534 - protein, 12 aa, Staphylococcus
LNQATAADELEQ

SEQ ID NO: 1963535 - protein, 6 aa, Staphylococcus
LNQDDE

SEQ ID NO: 1963536 - protein, 6 aa, Staphylococcus
LNQDPK

SEQ ID NO: 1963537 - protein, 4 aa, Staphylococcus
LNQE

SEQ ID NO: 1963538 - protein, 9 aa, Staphylococcus
LNQEDVETI

SEQ ID NO: 1963539 - protein, 7 aa, Staphylococcus
LNQEEPK

SEQ ID NO: 1963540 - protein, 8 aa, Staphylococcus
LNQEHPEG

SEQ ID NO: 1963541 - protein, 9 aa, Staphylococcus
LNQEQPDKV

SEQ ID NO: 1963542 - protein, 6 aa, Staphylococcus
LNQEQQ

SEQ ID NO: 1963543 - protein, 24 aa, Staphylococcus
LNQGDAQSLRITENSGISFIYTLE

SEQ ID NO: 1963544 - protein, 5 aa, Staphylococcus
LNQGQ

SEQ ID NO: 1963545 - protein, 5 aa, Staphylococcus
LNQGR

SEQ ID NO: 1963546 - protein, 5 aa, Staphylococcus
LNQHN

SEQ ID NO: 1963547 - protein, 8 aa, Staphylococcus
LNQKGGPW

SEQ ID NO: 1963548 - protein, 12 aa, Staphylococcus
LNQKSGEDLAND

SEQ ID NO: 1963549 - protein, 12 aa, Staphylococcus
LNQKSLDDYANK

SEQ ID NO: 1963550 - protein, 6 aa, Staphylococcus
LNQKST

SEQ ID NO: 1963551 - protein, 7 aa, Staphylococcus
LNQKSTI

SEQ ID NO: 1963552 - protein, 8 aa, Staphylococcus
LNQNDPKL

SEQ ID NO: 1963553 - protein, 6 aa, Staphylococcus
LNQNGK

SEQ ID NO: 1963554 - protein, 6 aa, Staphylococcus
LNQNPG

SEQ ID NO: 1963555 - protein, 6 aa, Staphylococcus
LNQNQD

SEQ ID NO: 1963556 - protein, 10 aa, Staphylococcus
LNQNQKEEIN

SEQ ID NO: 1963557 - protein, 5 aa, Staphylococcus
LNQPD

SEQ ID NO: 1963558 - protein, 6 aa, Staphylococcus
LNQPEA

SEQ ID NO: 1963559 - protein, 7 aa, Staphylococcus
LNQQLAE

SEQ ID NO: 1963560 - protein, 10 aa, Staphylococcus
LNQQYKDIKQ

SEQ ID NO: 1963561 - protein, 9 aa, Staphylococcus
LNQRDNQPK

SEQ ID NO: 1963562 - protein, 4 aa, Staphylococcus
LNQS

SEQ ID NO: 1963563 - protein, 10 aa, Staphylococcus
LNQSETQMNQ

SEQ ID NO: 1963564 - protein, 10 aa, Staphylococcus
LNQSGNGQEW

SEQ ID NO: 1963565 - protein, 9 aa, Staphylococcus
LNQSSNDSI

SEQ ID NO: 1963566 - protein, 8 aa, Staphylococcus
LNQTTHGL

SEQ ID NO: 1963567 - protein, 9 aa, Staphylococcus
LNRAEDRKE

SEQ ID NO: 1963568 - protein, 17 aa, Staphylococcus
LNRAQDTNKFAGGKGIN

SEQ ID NO: 1963569 - protein, 5 aa, Staphylococcus
LNRDQ

SEQ ID NO: 1963570 - protein, 10 aa, Staphylococcus
LNREDADTIS

SEQ ID NO: 1963571 - protein, 10 aa, Staphylococcus
LNREKSPFEG

SEQ ID NO: 1963572 - protein, 6 aa, Staphylococcus
LNREKY

SEQ ID NO: 1963573 - protein, 6 aa, Staphylococcus
LNREPY

SEQ ID NO: 1963574 - protein, 6 aa, Staphylococcus
LNRETL

SEQ ID NO: 1963575 - protein, 17 aa, Staphylococcus
LNRGDYRGEEVAKRMER

SEQ ID NO: 1963576 - protein, 16 aa, Staphylococcus
LNRGDYSGEEVAKRME

SEQ ID NO: 1963577 - protein, 12 aa, Staphylococcus
LNRGERSGEEVA

SEQ ID NO: 1963578 - protein, 8 aa, Staphylococcus
LNRGRHTT

SEQ ID NO: 1963579 - protein, 11 aa, Staphylococcus
LNRLSENDLSE

SEQ ID NO: 1963580 - protein, 19 aa, Staphylococcus
LNRNARQGKDPDDVAIGDL

SEQ ID NO: 1963581 - protein, 19 aa, Staphylococcus
LNRNARQGKDPDDVSIGDL

SEQ ID NO: 1963582 - protein, 10 aa, Staphylococcus
LNRQNGDVES

SEQ ID NO: 1963583 - protein, 10 aa, Staphylococcus
LNSANTTMND

SEQ ID NO: 1963584 - protein, 5 aa, Staphylococcus
LNSDA

SEQ ID NO: 1963585 - protein, 16 aa, Staphylococcus
LNSDNELQFDIEKPER

SEQ ID NO: 1963586 - protein, 4 aa, Staphylococcus
LNSE

SEQ ID NO: 1963587 - protein, 8 aa, Staphylococcus
LNSEAYGQ

SEQ ID NO: 1963588 - protein, 8 aa, Staphylococcus
LNSEVKPR

SEQ ID NO: 1963589 - protein, 13 aa, Staphylococcus
LNSEVSTADFPET

SEQ ID NO: 1963590 - protein, 7 aa, Staphylococcus
LNSGADA

SEQ ID NO: 1963591 - protein, 7 aa, Staphylococcus
LNSGDTI

SEQ ID NO: 1963592 - protein, 7 aa, Staphylococcus
LNSGDTL

SEQ ID NO: 1963593 - protein, 8 aa, Staphylococcus
LNSGGKHH

SEQ ID NO: 1963594 - protein, 14 aa, Staphylococcus
LNSGKERKQDKEHI

SEQ ID NO: 1963595 - protein, 9 aa, Staphylococcus
LNSGRTSGF

SEQ ID NO: 1963596 - protein, 7 aa, Staphylococcus
LNSGSAT

SEQ ID NO: 1963597 - protein, 7 aa, Staphylococcus
LNSGTTE

SEQ ID NO: 1963598 - protein, 15 aa, Staphylococcus
LNSIDEKVQETVQNG

SEQ ID NO: 1963599 - protein, 7 aa, Staphylococcus
LNSKQFD

SEQ ID NO: 1963600 - protein, 8 aa, Staphylococcus
LNSLGEQA

SEQ ID NO: 1963601 - protein, 7 aa, Staphylococcus
LNSLTNK

SEQ ID NO: 1963602 - protein, 7 aa, Staphylococcus
LNSNDYS

SEQ ID NO: 1963603 - protein, 7 aa, Staphylococcus
LNSNIDQ

SEQ ID NO: 1963604 - protein, 7 aa, Staphylococcus
LNSPEYI

SEQ ID NO: 1963605 - protein, 6 aa, Staphylococcus
LNSPGV

SEQ ID NO: 1963606 - protein, 22 aa, Staphylococcus
LNSPNIKTRKRARKIIQQHKRS

SEQ ID NO: 1963607 - protein, 12 aa, Staphylococcus
LNSSDNTQEQEK

SEQ ID NO: 1963608 - protein, 5 aa, Staphylococcus
LNSSN

SEQ ID NO: 1963609 - protein, 7 aa, Staphylococcus
LNSSQAV

SEQ ID NO: 1963610 - protein, 5 aa, Staphylococcus
LNSSY

SEQ ID NO: 1963611 - protein, 7 aa, Staphylococcus
LNSTENQ

SEQ ID NO: 1963612 - protein, 8 aa, Staphylococcus
LNSTEQEM

SEQ ID NO: 1963613 - protein, 8 aa, Staphylococcus
LNSTRAAV

SEQ ID NO: 1963614 - protein, 9 aa, Staphylococcus
LNSTRAAVG

SEQ ID NO: 1963615 - protein, 11 aa, Staphylococcus
LNSTSKPDKLE

SEQ ID NO: 1963616 - protein, 13 aa, Staphylococcus
LNSYETTDSRDTG

SEQ ID NO: 1963617 - protein, 10 aa, Staphylococcus
LNTADTSMEE

SEQ ID NO: 1963618 - protein, 6 aa, Staphylococcus
LNTENN

SEQ ID NO: 1963619 - protein, 12 aa, Staphylococcus
LNTGNNPREFTN

SEQ ID NO: 1963620 - protein, 4 aa, Staphylococcus
LNTI

SEQ ID NO: 1963621 - protein, 6 aa, Staphylococcus
LNTMSG

SEQ ID NO: 1963622 - protein, 5 aa, Staphylococcus
LNTNE

SEQ ID NO: 1963623 - protein, 6 aa, Staphylococcus
LNTNNP

SEQ ID NO: 1963624 - protein, 21 aa, Staphylococcus
LNTNVDPRYTGGKVNERTTED

SEQ ID NO: 1963625 - protein, 4 aa, Staphylococcus
LNTS

SEQ ID NO: 1963626 - protein, 8 aa, Staphylococcus
LNTSENYH

SEQ ID NO: 1963627 - protein, 6 aa, Staphylococcus
LNTSPL

SEQ ID NO: 1963628 - protein, 14 aa, Staphylococcus
LNTTEKLYKYSKKT

SEQ ID NO: 1963629 - protein, 10 aa, Staphylococcus
LNTTQKPDKL

SEQ ID NO: 1963630 - protein, 10 aa, Staphylococcus
LNTYNQQQHS

SEQ ID NO: 1963631 - protein, 7 aa, Staphylococcus
LNVDSSG

SEQ ID NO: 1963632 - protein, 20 aa, Staphylococcus
LNVGDSVSYGSTYTATEPTR

SEQ ID NO: 1963633 - protein, 5 aa, Staphylococcus
LNVNP

SEQ ID NO: 1963634 - protein, 13 aa, Staphylococcus
LNVPEESPSGNVH

SEQ ID NO: 1963635 - protein, 6 aa, Staphylococcus
LNVPNE

SEQ ID NO: 1963636 - protein, 4 aa, Staphylococcus
LNVT

SEQ ID NO: 1963637 - protein, 4 aa, Staphylococcus
LNYD

SEQ ID NO: 1963638 - protein, 5 aa, Staphylococcus
LNYRG

SEQ ID NO: 1963639 - protein, 10 aa, Staphylococcus
LNYRTSGEGN

SEQ ID NO: 1963640 - protein, 5 aa, Staphylococcus
LNYSA

SEQ ID NO: 1963641 - protein, 10 aa, Staphylococcus
LNYSEDDAHM

SEQ ID NO: 1963642 - protein, 6 aa, Staphylococcus
LNYSSN

SEQ ID NO: 1963643 - protein, 11 aa, Staphylococcus
LNYTQDPNTEK

SEQ ID NO: 1963644 - protein, 12 aa, Staphylococcus
LPAAEPDRVKQE

SEQ ID NO: 1963645 - protein, 4 aa, Staphylococcus
LPAD

SEQ ID NO: 1963646 - protein, 5 aa, Staphylococcus
LPAEE

SEQ ID NO: 1963647 - protein, 5 aa, Staphylococcus
LPAGQ

SEQ ID NO: 1963648 - protein, 17 aa, Staphylococcus
LPAGTKHDATGSDQPLG

SEQ ID NO: 1963649 - protein, 5 aa, Staphylococcus
LPAGV

SEQ ID NO: 1963650 - protein, 8 aa, Staphylococcus
LPAKESGV

SEQ ID NO: 1963651 - protein, 6 aa, Staphylococcus
LPAKGG

SEQ ID NO: 1963652 - protein, 6 aa, Staphylococcus
LPANAN

SEQ ID NO: 1963653 - protein, 6 aa, Staphylococcus
LPANRN

SEQ ID NO: 1963654 - protein, 7 aa, Staphylococcus
LPANRNT

SEQ ID NO: 1963655 - protein, 8 aa, Staphylococcus
LPANSAYA

SEQ ID NO: 1963656 - protein, 6 aa, Staphylococcus
LPANSQ

SEQ ID NO: 1963657 - protein, 6 aa, Staphylococcus
LPAPKI

SEQ ID NO: 1963658 - protein, 10 aa, Staphylococcus
LPAQKTGTIT

SEQ ID NO: 1963659 - protein, 8 aa, Staphylococcus
LPAQSEGI

SEQ ID NO: 1963660 - protein, 6 aa, Staphylococcus
LPASNI

SEQ ID NO: 1963661 - protein, 8 aa, Staphylococcus
LPASNIKK

SEQ ID NO: 1963662 - protein, 10 aa, Staphylococcus
LPASPGAASG

SEQ ID NO: 1963663 - protein, 15 aa, Staphylococcus
LPASSVKVAGGVEAT

SEQ ID NO: 1963664 - protein, 4 aa, Staphylococcus
LPAT

SEQ ID NO: 1963665 - protein, 12 aa, Staphylococcus
LPAYEGPKHELD

SEQ ID NO: 1963666 - protein, 14 aa, Staphylococcus
LPAYEGPKHELDED

SEQ ID NO: 1963667 - protein, 14 aa, Staphylococcus
LPAYQGPKHELDKD

SEQ ID NO: 1963668 - protein, 13 aa, Staphylococcus
LPAYTGPKHELDD

SEQ ID NO: 1963669 - protein, 8 aa, Staphylococcus
LPDDGDDA

SEQ ID NO: 1963670 - protein, 15 aa, Staphylococcus
LPDDKGHDQKDGLDR

SEQ ID NO: 1963671 - protein, 21 aa, Staphylococcus
LPDEEDIPELEKEKQKLIERG

SEQ ID NO: 1963672 - protein, 11 aa, Staphylococcus
LPDGKTSKREI

SEQ ID NO: 1963673 - protein, 10 aa, Staphylococcus
LPDGNTSKRE

SEQ ID NO: 1963674 - protein, 9 aa, Staphylococcus
LPDGNTSRR

SEQ ID NO: 1963675 - protein, 9 aa, Staphylococcus
LPDGRTSKR

SEQ ID NO: 1963676 - protein, 15 aa, Staphylococcus
LPDGSIVGTSSLRRG

SEQ ID NO: 1963677 - protein, 10 aa, Staphylococcus
LPDGSTSKRE

SEQ ID NO: 1963678 - protein, 4 aa, Staphylococcus
LPDK

SEQ ID NO: 1963679 - protein, 23 aa, Staphylococcus
LPDKSSSTSTSSISKNATSSIKY

SEQ ID NO: 1963680 - protein, 9 aa, Staphylococcus
LPDLSERER

SEQ ID NO: 1963681 - protein, 10 aa, Staphylococcus
LPDLSERERK

SEQ ID NO: 1963682 - protein, 11 aa, Staphylococcus
LPDLSERERKV

SEQ ID NO: 1963683 - protein, 4 aa, Staphylococcus
LPDN

SEQ ID NO: 1963684 - protein, 11 aa, Staphylococcus
LPDNIDDSSMQ

SEQ ID NO: 1963685 - protein, 5 aa, Staphylococcus
LPDPL

SEQ ID NO: 1963686 - protein, 8 aa, Staphylococcus
LPDQPSFK

SEQ ID NO: 1963687 - protein, 9 aa, Staphylococcus
LPDQPSFKS

SEQ ID NO: 1963688 - protein, 5 aa, Staphylococcus
LPDQS

SEQ ID NO: 1963689 - protein, 8 aa, Staphylococcus
LPDRPTSL

SEQ ID NO: 1963690 - protein, 6 aa, Staphylococcus
LPDTDA

SEQ ID NO: 1963691 - protein, 6 aa, Staphylococcus
LPDTTQ

SEQ ID NO: 1963692 - protein, 8 aa, Staphylococcus
LPEAGETV

SEQ ID NO: 1963693 - protein, 9 aa, Staphylococcus
LPEDDERLQ

SEQ ID NO: 1963694 - protein, 6 aa, Staphylococcus
LPEDER

SEQ ID NO: 1963695 - protein, 7 aa, Staphylococcus
LPEDNQD

SEQ ID NO: 1963696 - protein, 7 aa, Staphylococcus
LPEDSSK

SEQ ID NO: 1963697 - protein, 8 aa, Staphylococcus
LPEDYPEN

SEQ ID NO: 1963698 - protein, 4 aa, Staphylococcus
LPEE

SEQ ID NO: 1963699 - protein, 5 aa, Staphylococcus
LPEED

SEQ ID NO: 1963700 - protein, 9 aa, Staphylococcus
LPEEDDRIT

SEQ ID NO: 1963701 - protein, 12 aa, Staphylococcus
LPEELSGGQRQR

SEQ ID NO: 1963702 - protein, 19 aa, Staphylococcus
LPEENNDAGGPAMGGMSGM

SEQ ID NO: 1963703 - protein, 5 aa, Staphylococcus
LPEEP

SEQ ID NO: 1963704 - protein, 6 aa, Staphylococcus
LPEERG

SEQ ID NO: 1963705 - protein, 8 aa, Staphylococcus
LPEERGLH

SEQ ID NO: 1963706 - protein, 5 aa, Staphylococcus
LPEET

SEQ ID NO: 1963707 - protein, 4 aa, Staphylococcus
LPEG

SEQ ID NO: 1963708 - protein, 13 aa, Staphylococcus
LPEGAIEAPNHIE

SEQ ID NO: 1963709 - protein, 5 aa, Staphylococcus
LPEGI

SEQ ID NO: 1963710 - protein, 9 aa, Staphylococcus
LPEHSNELG

SEQ ID NO: 1963711 - protein, 4 aa, Staphylococcus
LPEI

SEQ ID NO: 1963712 - protein, 14 aa, Staphylococcus
LPEKVAKSLKEALN

SEQ ID NO: 1963713 - protein, 4 aa, Staphylococcus
LPEM

SEQ ID NO: 1963714 - protein, 9 aa, Staphylococcus
LPEMNTTAE

SEQ ID NO: 1963715 - protein, 5 aa, Staphylococcus
LPENA

SEQ ID NO: 1963716 - protein, 7 aa, Staphylococcus
LPENERK

SEQ ID NO: 1963717 - protein, 14 aa, Staphylococcus
LPENNDIYNRPKGN

SEQ ID NO: 1963718 - protein, 7 aa, Staphylococcus
LPENNSL

SEQ ID NO: 1963719 - protein, 11 aa, Staphylococcus
LPENPSEADLD

SEQ ID NO: 1963720 - protein, 9 aa, Staphylococcus
LPENQKYGA

SEQ ID NO: 1963721 - protein, 12 aa, Staphylococcus
LPENRKSKRTDL

SEQ ID NO: 1963722 - protein, 11 aa, Staphylococcus
LPENTGHAHAR

SEQ ID NO: 1963723 - protein, 6 aa, Staphylococcus
LPENYK

SEQ ID NO: 1963724 - protein, 23 aa, Staphylococcus
LPEPERTKEHTTSSGETKTPDEM

SEQ ID NO: 1963725 - protein, 16 aa, Staphylococcus
LPEPTVAKQFSEKDLN

SEQ ID NO: 1963726 - protein, 16 aa, Staphylococcus
LPEQLSQEAHRDGQRS

SEQ ID NO: 1963727 - protein, 5 aa, Staphylococcus
LPEQQ

SEQ ID NO: 1963728 - protein, 6 aa, Staphylococcus
LPEQYE

SEQ ID NO: 1963729 - protein, 4 aa, Staphylococcus
LPER

SEQ ID NO: 1963730 - protein, 19 aa, Staphylococcus
LPERARKLTDEQLEQELTE

SEQ ID NO: 1963731 - protein, 6 aa, Staphylococcus
LPERYE

SEQ ID NO: 1963732 - protein, 5 aa, Staphylococcus
LPESG

SEQ ID NO: 1963733 - protein, 6 aa, Staphylococcus
LPESTI

SEQ ID NO: 1963734 - protein, 6 aa, Staphylococcus
LPETDE

SEQ ID NO: 1963735 - protein, 5 aa, Staphylococcus
LPETH

SEQ ID NO: 1963736 - protein, 6 aa, Staphylococcus
LPETKD

SEQ ID NO: 1963737 - protein, 9 aa, Staphylococcus
LPETNDVTQ

SEQ ID NO: 1963738 - protein, 7 aa, Staphylococcus
LPETQET

SEQ ID NO: 1963739 - protein, 17 aa, Staphylococcus
LPETQPDTISTSAGEEL

SEQ ID NO: 1963740 - protein, 6 aa, Staphylococcus
LPETRK

SEQ ID NO: 1963741 - protein, 6 aa, Staphylococcus
LPETSY

SEQ ID NO: 1963742 - protein, 13 aa, Staphylococcus
LPEYDGKALGSRT

SEQ ID NO: 1963743 - protein, 9 aa, Staphylococcus
LPFASKNEG

SEQ ID NO: 1963744 - protein, 5 aa, Staphylococcus
LPFGG

SEQ ID NO: 1963745 - protein, 14 aa, Staphylococcus
LPFGGVGASGIGQY

SEQ ID NO: 1963746 - protein, 4 aa, Staphylococcus
LPFT

SEQ ID NO: 1963747 - protein, 6 aa, Staphylococcus
LPGALK

SEQ ID NO: 1963748 - protein, 8 aa, Staphylococcus
LPGDAGER

SEQ ID NO: 1963749 - protein, 9 aa, Staphylococcus
LPGDEAGIK

SEQ ID NO: 1963750 - protein, 4 aa, Staphylococcus
LPGE

SEQ ID NO: 1963751 - protein, 6 aa, Staphylococcus
LPGFQK

SEQ ID NO: 1963752 - protein, 5 aa, Staphylococcus
LPGHG

SEQ ID NO: 1963753 - protein, 4 aa, Staphylococcus
LPGI

SEQ ID NO: 1963754 - protein, 11 aa, Staphylococcus
LPGIDRPDEVN

SEQ ID NO: 1963755 - protein, 13 aa, Staphylococcus
LPGITDKDADDIN

SEQ ID NO: 1963756 - protein, 13 aa, Staphylococcus
LPGKDVKLSTNAQ

SEQ ID NO: 1963757 - protein, 13 aa, Staphylococcus
LPGKEVKLSTNEQ

SEQ ID NO: 1963758 - protein, 24 aa, Staphylococcus
LPGKKDTTHFSTDNASGSTSQAAN

SEQ ID NO: 1963759 - protein, 24 aa, Staphylococcus
LPGKKDTTHFSTENASGSTSQATN

SEQ ID NO: 1963760 - protein, 14 aa, Staphylococcus
LPGKNITPMAPSGG

SEQ ID NO: 1963761 - protein, 8 aa, Staphylococcus
LPGLSKED

SEQ ID NO: 1963762 - protein, 13 aa, Staphylococcus
LPGNEVKLSTNEQ

SEQ ID NO: 1963763 - protein, 5 aa, Staphylococcus
LPGPS

SEQ ID NO: 1963764 - protein, 5 aa, Staphylococcus
LPGPV

SEQ ID NO: 1963765 - protein, 17 aa, Staphylococcus
LPGQGQTSRANKGQIDD

SEQ ID NO: 1963766 - protein, 17 aa, Staphylococcus
LPGQGQTSRANKGQIED

SEQ ID NO: 1963767 - protein, 15 aa, Staphylococcus
LPGQGQTSRANKGQL

SEQ ID NO: 1963768 - protein, 15 aa, Staphylococcus
LPGQGQTSRANRGQL

SEQ ID NO: 1963769 - protein, 16 aa, Staphylococcus
LPGQGQTSRSNKGQID

SEQ ID NO: 1963770 - protein, 17 aa, Staphylococcus
LPGQGQTSRSNKGQIDN

SEQ ID NO: 1963771 - protein, 7 aa, Staphylococcus
LPGRISN

SEQ ID NO: 1963772 - protein, 14 aa, Staphylococcus
LPGRRSRISEKLDS

SEQ ID NO: 1963773 - protein, 8 aa, Staphylococcus
LPGRYQDY

SEQ ID NO: 1963774 - protein, 5 aa, Staphylococcus
LPGSA

SEQ ID NO: 1963775 - protein, 24 aa, Staphylococcus
LPGSASHPAVSTNKSKDSRAAGKA

SEQ ID NO: 1963776 - protein, 5 aa, Staphylococcus
LPGSK

SEQ ID NO: 1963777 - protein, 6 aa, Staphylococcus
LPGSTS

SEQ ID NO: 1963778 - protein, 6 aa, Staphylococcus
LPGVKK

SEQ ID NO: 1963779 - protein, 8 aa, Staphylococcus
LPGVNKSE

SEQ ID NO: 1963780 - protein, 8 aa, Staphylococcus
LPHAPAPR

SEQ ID NO: 1963781 - protein, 17 aa, Staphylococcus
LPHAPSAQLAEAQGDQI

SEQ ID NO: 1963782 - protein, 17 aa, Staphylococcus
LPHAPSAQLAELQGDQI

SEQ ID NO: 1963783 - protein, 17 aa, Staphylococcus
LPHAPSAQLAEVQGDQI

SEQ ID NO: 1963784 - protein, 15 aa, Staphylococcus
LPHKYRDKVEQEITN

SEQ ID NO: 1963785 - protein, 6 aa, Staphylococcus
LPHSSQ

SEQ ID NO: 1963786 - protein, 4 aa, Staphylococcus
LPID

SEQ ID NO: 1963787 - protein, 4 aa, Staphylococcus
LPIE

SEQ ID NO: 1963788 - protein, 17 aa, Staphylococcus
LPIGTPAMATGGMGDTL

SEQ ID NO: 1963789 - protein, 11 aa, Staphylococcus
LPIKEAKNDEW

SEQ ID NO: 1963790 - protein, 6 aa, Staphylococcus
LPKAKE

SEQ ID NO: 1963791 - protein, 4 aa, Staphylococcus
LPKC

SEQ ID NO: 1963792 - protein, 14 aa, Staphylococcus
LPKDEAVQNQQKEV

SEQ ID NO: 1963793 - protein, 8 aa, Staphylococcus
LPKDGPVN

SEQ ID NO: 1963794 - protein, 7 aa, Staphylococcus
LPKEDPE

SEQ ID NO: 1963795 - protein, 22 aa, Staphylococcus
LPKEEAEKLKEQLEEVGASVEL

SEQ ID NO: 1963796 - protein, 7 aa, Staphylococcus
LPKEGEY

SEQ ID NO: 1963797 - protein, 6 aa, Staphylococcus
LPKEQQ

SEQ ID NO: 1963798 - protein, 6 aa, Staphylococcus
LPKETT

SEQ ID NO: 1963799 - protein, 10 aa, Staphylococcus
LPKGEKNAAL

SEQ ID NO: 1963800 - protein, 11 aa, Staphylococcus
LPKHEKIEKNQ

SEQ ID NO: 1963801 - protein, 4 aa, Staphylococcus
LPKI

SEQ ID NO: 1963802 - protein, 8 aa, Staphylococcus
LPKKAKVK

SEQ ID NO: 1963803 - protein, 18 aa, Staphylococcus
LPKKAVTREEIKAKRENY

SEQ ID NO: 1963804 - protein, 16 aa, Staphylococcus
LPKKDDEPEKPVRRDL

SEQ ID NO: 1963805 - protein, 65 aa, Staphylococcus
LPKKDKSQRPARGKTIQAKTRGKSLDKSKDNHQKNKKKKRKQRKGKNQRQRDKQSSTKHKPFYKD

SEQ ID NO: 1963806 - protein, 7 aa, Staphylococcus
LPKKGGI

SEQ ID NO: 1963807 - protein, 11 aa, Staphylococcus
LPKKQAQGTLL

SEQ ID NO: 1963808 - protein, 8 aa, Staphylococcus
LPKLENKY

SEQ ID NO: 1963809 - protein, 31 aa, Staphylococcus
LPKLQTKANPSNYLEQSQRPNETTDDIKESD

SEQ ID NO: 1963810 - protein, 77 aa, Staphylococcus
LPKNDKSQRPARGKTIQAKTRGKSLDKSKDDNNGKGNKKKRKQRKGKNARKKDKQGKTNHKPFYKDKSVKKKSRRKK

SEQ ID NO: 1963811 - protein, 76 aa, Staphylococcus
LPKNDRSQRPARGKTIQAKTRGKSLDKSKSDDKGNGKNKRKQRKGKNARQQDKKGNTKHKPFYKDKSVKKKSRKKK

SEQ ID NO: 1963812 - protein, 76 aa, Staphylococcus
LPKNDRSQRPSRGKTIQAKTRGKSLDKSKDDDHKGKKKKRKQRKGKNQRSRDKQGKTNHKPFYKDKSVKKKSRRKK

SEQ ID NO: 1963813 - protein, 10 aa, Staphylococcus
LPKPSNAQQF

SEQ ID NO: 1963814 - protein, 8 aa, Staphylococcus
LPKQEAEK

SEQ ID NO: 1963815 - protein, 7 aa, Staphylococcus
LPKQKYD

SEQ ID NO: 1963816 - protein, 5 aa, Staphylococcus
LPKQS

SEQ ID NO: 1963817 - protein, 9 aa, Staphylococcus
LPKRGHNPK

SEQ ID NO: 1963818 - protein, 8 aa, Staphylococcus
LPKSKADF

SEQ ID NO: 1963819 - protein, 14 aa, Staphylococcus
LPKSVEQSKPFPLS

SEQ ID NO: 1963820 - protein, 5 aa, Staphylococcus
LPKSY

SEQ ID NO: 1963821 - protein, 4 aa, Staphylococcus
LPKT

SEQ ID NO: 1963822 - protein, 8 aa, Staphylococcus
LPKTRSGK

SEQ ID NO: 1963823 - protein, 5 aa, Staphylococcus
LPLDT

SEQ ID NO: 1963824 - protein, 13 aa, Staphylococcus
LPLEASPGVTDAS

SEQ ID NO: 1963825 - protein, 21 aa, Staphylococcus
LPLNSNGQLVSEDVQEQTKQV

SEQ ID NO: 1963826 - protein, 12 aa, Staphylococcus
LPLPEGKSYAPA

SEQ ID NO: 1963827 - protein, 15 aa, Staphylococcus
LPLQQKNNKKPRPWM

SEQ ID NO: 1963828 - protein, 6 aa, Staphylococcus
LPLTDK

SEQ ID NO: 1963829 - protein, 6 aa, Staphylococcus
LPLTTE

SEQ ID NO: 1963830 - protein, 4 aa, Staphylococcus
LPME

SEQ ID NO: 1963831 - protein, 11 aa, Staphylococcus
LPMSNDKSEGF

SEQ ID NO: 1963832 - protein, 8 aa, Staphylococcus
LPMTKRDA

SEQ ID NO: 1963833 - protein, 9 aa, Staphylococcus
LPNAPQEKG

SEQ ID NO: 1963834 - protein, 8 aa, Staphylococcus
LPNDDIQS

SEQ ID NO: 1963835 - protein, 16 aa, Staphylococcus
LPNDDQRLKQLQQSAY

SEQ ID NO: 1963836 - protein, 5 aa, Staphylococcus
LPNDY

SEQ ID NO: 1963837 - protein, 6 aa, Staphylococcus
LPNEAG

SEQ ID NO: 1963838 - protein, 7 aa, Staphylococcus
LPNEDLG

SEQ ID NO: 1963839 - protein, 8 aa, Staphylococcus
LPNEDLGA

SEQ ID NO: 1963840 - protein, 7 aa, Staphylococcus
LPNEGDY

SEQ ID NO: 1963841 - protein, 15 aa, Staphylococcus
LPNEGIKRPKQKVTV

SEQ ID NO: 1963842 - protein, 6 aa, Staphylococcus
LPNESG

SEQ ID NO: 1963843 - protein, 7 aa, Staphylococcus
LPNESGA

SEQ ID NO: 1963844 - protein, 10 aa, Staphylococcus
LPNESTQIAK

SEQ ID NO: 1963845 - protein, 5 aa, Staphylococcus
LPNET

SEQ ID NO: 1963846 - protein, 6 aa, Staphylococcus
LPNGAK

SEQ ID NO: 1963847 - protein, 14 aa, Staphylococcus
LPNGGEIRVKIVDI

SEQ ID NO: 1963848 - protein, 9 aa, Staphylococcus
LPNGKRAKR

SEQ ID NO: 1963849 - protein, 7 aa, Staphylococcus
LPNGSNI

SEQ ID NO: 1963850 - protein, 9 aa, Staphylococcus
LPNHDQGNI

SEQ ID NO: 1963851 - protein, 5 aa, Staphylococcus
LPNHK

SEQ ID NO: 1963852 - protein, 8 aa, Staphylococcus
LPNKAPHI

SEQ ID NO: 1963853 - protein, 9 aa, Staphylococcus
LPNKNGMAP

SEQ ID NO: 1963854 - protein, 12 aa, Staphylococcus
LPNKTESEIGPV

SEQ ID NO: 1963855 - protein, 16 aa, Staphylococcus
LPNKYRDKVEQEVTQR

SEQ ID NO: 1963856 - protein, 11 aa, Staphylococcus
LPNLSERERTV

SEQ ID NO: 1963857 - protein, 4 aa, Staphylococcus
LPNN

SEQ ID NO: 1963858 - protein, 11 aa, Staphylococcus
LPNNHTNDENV

SEQ ID NO: 1963859 - protein, 6 aa, Staphylococcus
LPNPLA

SEQ ID NO: 1963860 - protein, 5 aa, Staphylococcus
LPNPQ

SEQ ID NO: 1963861 - protein, 4 aa, Staphylococcus
LPNS

SEQ ID NO: 1963862 - protein, 10 aa, Staphylococcus
LPNSEFSEYR

SEQ ID NO: 1963863 - protein, 8 aa, Staphylococcus
LPNSTELT

SEQ ID NO: 1963864 - protein, 4 aa, Staphylococcus
LPNT

SEQ ID NO: 1963865 - protein, 8 aa, Staphylococcus
LPNTGYGI

SEQ ID NO: 1963866 - protein, 9 aa, Staphylococcus
LPNTKPGAY

SEQ ID NO: 1963867 - protein, 13 aa, Staphylococcus
LPNVDDITDEKKR

SEQ ID NO: 1963868 - protein, 9 aa, Staphylococcus
LPPAHENRD

SEQ ID NO: 1963869 - protein, 14 aa, Staphylococcus
LPPAQTEEQRQSYL

SEQ ID NO: 1963870 - protein, 6 aa, Staphylococcus
LPPEKS

SEQ ID NO: 1963871 - protein, 8 aa, Staphylococcus
LPPEPIDD

SEQ ID NO: 1963872 - protein, 21 aa, Staphylococcus
LPPETVEKYRGKGTEKPKTIE

SEQ ID NO: 1963873 - protein, 14 aa, Staphylococcus
LPPMDNDDYRRGKL

SEQ ID NO: 1963874 - protein, 4 aa, Staphylococcus
LPPN

SEQ ID NO: 1963875 - protein, 6 aa, Staphylococcus
LPPPNV

SEQ ID NO: 1963876 - protein, 7 aa, Staphylococcus
LPPQEEI

SEQ ID NO: 1963877 - protein, 4 aa, Staphylococcus
LPPR

SEQ ID NO: 1963878 - protein, 18 aa, Staphylococcus
LPPREYSIASSNKVNPNS

SEQ ID NO: 1963879 - protein, 19 aa, Staphylococcus
LPPREYSISSSYKATPDEV

SEQ ID NO: 1963880 - protein, 5 aa, Staphylococcus
LPPSI

SEQ ID NO: 1963881 - protein, 8 aa, Staphylococcus
LPQDYPEN

SEQ ID NO: 1963882 - protein, 5 aa, Staphylococcus
LPQES

SEQ ID NO: 1963883 - protein, 5 aa, Staphylococcus
LPQGE

SEQ ID NO: 1963884 - protein, 9 aa, Staphylococcus
LPQGGGALA

SEQ ID NO: 1963885 - protein, 14 aa, Staphylococcus
LPQGMRARTNYKQT

SEQ ID NO: 1963886 - protein, 5 aa, Staphylococcus
LPQGQ

SEQ ID NO: 1963887 - protein, 4 aa, Staphylococcus
LPQI

SEQ ID NO: 1963888 - protein, 6 aa, Staphylococcus
LPQKGD

SEQ ID NO: 1963889 - protein, 6 aa, Staphylococcus
LPQKGN

SEQ ID NO: 1963890 - protein, 8 aa, Staphylococcus
LPQNKAKH

SEQ ID NO: 1963891 - protein, 7 aa, Staphylococcus
LPQPRDT

SEQ ID NO: 1963892 - protein, 6 aa, Staphylococcus
LPQSDI

SEQ ID NO: 1963893 - protein, 12 aa, Staphylococcus
LPQSDIKTDAVS

SEQ ID NO: 1963894 - protein, 12 aa, Staphylococcus
LPQSDIKTDSVE

SEQ ID NO: 1963895 - protein, 13 aa, Staphylococcus
LPQSDIKTDSVES

SEQ ID NO: 1963896 - protein, 12 aa, Staphylococcus
LPQSDINNKSFE

SEQ ID NO: 1963897 - protein, 8 aa, Staphylococcus
LPQSNKTE

SEQ ID NO: 1963898 - protein, 8 aa, Staphylococcus
LPQSTGYP

SEQ ID NO: 1963899 - protein, 12 aa, Staphylococcus
LPQTGKPSFDIE

SEQ ID NO: 1963900 - protein, 4 aa, Staphylococcus
LPQY

SEQ ID NO: 1963901 - protein, 16 aa, Staphylococcus
LPRADSLNTDNSFSDR

SEQ ID NO: 1963902 - protein, 4 aa, Staphylococcus
LPRE

SEQ ID NO: 1963903 - protein, 4 aa, Staphylococcus
LPRK

SEQ ID NO: 1963904 - protein, 13 aa, Staphylococcus
LPRKSGVSDEPMK

SEQ ID NO: 1963905 - protein, 4 aa, Staphylococcus
LPRL

SEQ ID NO: 1963906 - protein, 17 aa, Staphylococcus
LPRSQMGVDAENDYEPK

SEQ ID NO: 1963907 - protein, 6 aa, Staphylococcus
LPSDEV

SEQ ID NO: 1963908 - protein, 6 aa, Staphylococcus
LPSDLG

SEQ ID NO: 1963909 - protein, 10 aa, Staphylococcus
LPSEDEAQAY

SEQ ID NO: 1963910 - protein, 6 aa, Staphylococcus
LPSEDV

SEQ ID NO: 1963911 - protein, 9 aa, Staphylococcus
LPSEEQDAL

SEQ ID NO: 1963912 - protein, 11 aa, Staphylococcus
LPSEKETQDYL

SEQ ID NO: 1963913 - protein, 11 aa, Staphylococcus
LPSENGKITAA

SEQ ID NO: 1963914 - protein, 11 aa, Staphylococcus
LPSGKSPHGKK

SEQ ID NO: 1963915 - protein, 6 aa, Staphylococcus
LPSIQT

SEQ ID NO: 1963916 - protein, 6 aa, Staphylococcus
LPSLSG

SEQ ID NO: 1963917 - protein, 8 aa, Staphylococcus
LPSLSGLS

SEQ ID NO: 1963918 - protein, 14 aa, Staphylococcus
LPSNQVNKVPSTDV

SEQ ID NO: 1963919 - protein, 11 aa, Staphylococcus
LPSPANPPTGC

SEQ ID NO: 1963920 - protein, 6 aa, Staphylococcus
LPSQRD

SEQ ID NO: 1963921 - protein, 5 aa, Staphylococcus
LPSRQ

SEQ ID NO: 1963922 - protein, 17 aa, Staphylococcus
LPSSDDRINQLKDSSYS

SEQ ID NO: 1963923 - protein, 12 aa, Staphylococcus
LPSSPVPTTSNT

SEQ ID NO: 1963924 - protein, 13 aa, Staphylococcus
LPSSPVPTTSNTA

SEQ ID NO: 1963925 - protein, 12 aa, Staphylococcus
LPSSRLGEKQGK

SEQ ID NO: 1963926 - protein, 7 aa, Staphylococcus
LPSSVHR

SEQ ID NO: 1963927 - protein, 8 aa, Staphylococcus
LPSSVQRG

SEQ ID NO: 1963928 - protein, 7 aa, Staphylococcus
LPSTNED

SEQ ID NO: 1963929 - protein, 13 aa, Staphylococcus
LPSTRAKRPFEKS

SEQ ID NO: 1963930 - protein, 13 aa, Staphylococcus
LPSTRAKRPFSEQ

SEQ ID NO: 1963931 - protein, 12 aa, Staphylococcus
LPSTRAPRPFSK

SEQ ID NO: 1963932 - protein, 23 aa, Staphylococcus
LPSVNPKDNERHPRREAQRYASD

SEQ ID NO: 1963933 - protein, 4 aa, Staphylococcus
LPSY

SEQ ID NO: 1963934 - protein, 10 aa, Staphylococcus
LPSYGEVDKE

SEQ ID NO: 1963935 - protein, 9 aa, Staphylococcus
LPTDIEEEA

SEQ ID NO: 1963936 - protein, 8 aa, Staphylococcus
LPTDTEVE

SEQ ID NO: 1963937 - protein, 5 aa, Staphylococcus
LPTED

SEQ ID NO: 1963938 - protein, 9 aa, Staphylococcus
LPTEEELAD

SEQ ID NO: 1963939 - protein, 6 aa, Staphylococcus
LPTEQN

SEQ ID NO: 1963940 - protein, 4 aa, Staphylococcus
LPTH

SEQ ID NO: 1963941 - protein, 4 aa, Staphylococcus
LPTK

SEQ ID NO: 1963942 - protein, 10 aa, Staphylococcus
LPTKDRNTQA

SEQ ID NO: 1963943 - protein, 10 aa, Staphylococcus
LPTKERNTQS

SEQ ID NO: 1963944 - protein, 5 aa, Staphylococcus
LPTKQ

SEQ ID NO: 1963945 - protein, 6 aa, Staphylococcus
LPTLET

SEQ ID NO: 1963946 - protein, 13 aa, Staphylococcus
LPTNAQPFTKDDL

SEQ ID NO: 1963947 - protein, 11 aa, Staphylococcus
LPTNQTARFTN

SEQ ID NO: 1963948 - protein, 11 aa, Staphylococcus
LPTNQTSRFTN

SEQ ID NO: 1963949 - protein, 8 aa, Staphylococcus
LPTPKISE

SEQ ID NO: 1963950 - protein, 7 aa, Staphylococcus
LPTSGNH

SEQ ID NO: 1963951 - protein, 11 aa, Staphylococcus
LPTTDEEDEEI

SEQ ID NO: 1963952 - protein, 8 aa, Staphylococcus
LPTTGEQA

SEQ ID NO: 1963953 - protein, 8 aa, Staphylococcus
LPTTGERA

SEQ ID NO: 1963954 - protein, 10 aa, Staphylococcus
LPTTQGQQSM

SEQ ID NO: 1963955 - protein, 6 aa, Staphylococcus
LPTTTI

SEQ ID NO: 1963956 - protein, 8 aa, Staphylococcus
LPTTTPGM

SEQ ID NO: 1963957 - protein, 4 aa, Staphylococcus
LPTV

SEQ ID NO: 1963958 - protein, 12 aa, Staphylococcus
LPTVESHRSSHP

SEQ ID NO: 1963959 - protein, 9 aa, Staphylococcus
LPVETSDEK

SEQ ID NO: 1963960 - protein, 6 aa, Staphylococcus
LPVPIG

SEQ ID NO: 1963961 - protein, 7 aa, Staphylococcus
LPYGKET

SEQ ID NO: 1963962 - protein, 4 aa, Staphylococcus
LPYP

SEQ ID NO: 1963963 - protein, 19 aa, Staphylococcus
LPYPEKTKFETKGESKSLA

SEQ ID NO: 1963964 - protein, 14 aa, Staphylococcus
LPYPNKTHTENTGV

SEQ ID NO: 1963965 - protein, 7 aa, Staphylococcus
LPYPQNT

SEQ ID NO: 1963966 - protein, 10 aa, Staphylococcus
LPYSTKKPMI

SEQ ID NO: 1963967 - protein, 6 aa, Staphylococcus
LPYTQE

SEQ ID NO: 1963968 - protein, 15 aa, Staphylococcus
LPYTSTGKLKRGSIE

SEQ ID NO: 1963969 - protein, 18 aa, Staphylococcus
LPYTSTGKLQRNKVGTED

SEQ ID NO: 1963970 - protein, 12 aa, Staphylococcus
LQAEGESPLESL

SEQ ID NO: 1963971 - protein, 18 aa, Staphylococcus
LQAKAAEIKRFKSSKSYK

SEQ ID NO: 1963972 - protein, 15 aa, Staphylococcus
LQANGKQPVNWCESE

SEQ ID NO: 1963973 - protein, 11 aa, Staphylococcus
LQANSQSSIGT

SEQ ID NO: 1963974 - protein, 11 aa, Staphylococcus
LQAPDTEPYKT

SEQ ID NO: 1963975 - protein, 10 aa, Staphylococcus
LQARQTADDI

SEQ ID NO: 1963976 - protein, 6 aa, Staphylococcus
LQDDPE

SEQ ID NO: 1963977 - protein, 7 aa, Staphylococcus
LQDDVGT

SEQ ID NO: 1963978 - protein, 7 aa, Staphylococcus
LQDEGYT

SEQ ID NO: 1963979 - protein, 11 aa, Staphylococcus
LQDELKSQGVR

SEQ ID NO: 1963980 - protein, 21 aa, Staphylococcus
LQDENSKLKKQNKKVANERDE

SEQ ID NO: 1963981 - protein, 7 aa, Staphylococcus
LQDETGI

SEQ ID NO: 1963982 - protein, 15 aa, Staphylococcus
LQDGDLNEYSIEGQG

SEQ ID NO: 1963983 - protein, 16 aa, Staphylococcus
LQDGGQSKKSKATTQI

SEQ ID NO: 1963984 - protein, 15 aa, Staphylococcus
LQDGQLNNYNIDGQG

SEQ ID NO: 1963985 - protein, 6 aa, Staphylococcus
LQDKGI

SEQ ID NO: 1963986 - protein, 6 aa, Staphylococcus
LQDKNY

SEQ ID NO: 1963987 - protein, 7 aa, Staphylococcus
LQDPIPA

SEQ ID NO: 1963988 - protein, 9 aa, Staphylococcus
LQDQDSGEI

SEQ ID NO: 1963989 - protein, 14 aa, Staphylococcus
LQDRPDLKLEPDNL

SEQ ID NO: 1963990 - protein, 20 aa, Staphylococcus
LQDTPGVDSNVATHQSSTEE

SEQ ID NO: 1963991 - protein, 10 aa, Staphylococcus
LQDTPSGDAQ

SEQ ID NO: 1963992 - protein, 8 aa, Staphylococcus
LQEAEAAL

SEQ ID NO: 1963993 - protein, 5 aa, Staphylococcus
LQEAS

SEQ ID NO: 1963994 - protein, 9 aa, Staphylococcus
LQECGNSQN

SEQ ID NO: 1963995 - protein, 10 aa, Staphylococcus
LQEDKAPLRR

SEQ ID NO: 1963996 - protein, 7 aa, Staphylococcus
LQEGEDV

SEQ ID NO: 1963997 - protein, 14 aa, Staphylococcus
LQEKDSGISEADVR

SEQ ID NO: 1963998 - protein, 7 aa, Staphylococcus
LQEKNAE

SEQ ID NO: 1963999 - protein, 9 aa, Staphylococcus
LQEKYGKER

SEQ ID NO: 1964000 - protein, 27 aa, Staphylococcus
LQEQQSDEQIHPNDDVNKSQSSNDTFP

SEQ ID NO: 1964001 - protein, 5 aa, Staphylococcus
LQERR

SEQ ID NO: 1964002 - protein, 5 aa, Staphylococcus
LQERS

SEQ ID NO: 1964003 - protein, 6 aa, Staphylococcus
LQERSK

SEQ ID NO: 1964004 - protein, 8 aa, Staphylococcus
LQESNEAP

SEQ ID NO: 1964005 - protein, 11 aa, Staphylococcus
LQETDDHYPGN

SEQ ID NO: 1964006 - protein, 13 aa, Staphylococcus
LQEVRDSRTSIDA

SEQ ID NO: 1964007 - protein, 13 aa, Staphylococcus
LQGAAEDAHSYGE

SEQ ID NO: 1964008 - protein, 12 aa, Staphylococcus
LQGEETKFTYPD

SEQ ID NO: 1964009 - protein, 7 aa, Staphylococcus
LQGEIPD

SEQ ID NO: 1964010 - protein, 6 aa, Staphylococcus
LQGENG

SEQ ID NO: 1964011 - protein, 7 aa, Staphylococcus
LQGEPLD

SEQ ID NO: 1964012 - protein, 9 aa, Staphylococcus
LQGESVVDS

SEQ ID NO: 1964013 - protein, 9 aa, Staphylococcus
LQGHGPEDL

SEQ ID NO: 1964014 - protein, 9 aa, Staphylococcus
LQGKSREDV

SEQ ID NO: 1964015 - protein, 8 aa, Staphylococcus
LQGPKARD

SEQ ID NO: 1964016 - protein, 8 aa, Staphylococcus
LQGPQSNE

SEQ ID NO: 1964017 - protein, 5 aa, Staphylococcus
LQGQI

SEQ ID NO: 1964018 - protein, 12 aa, Staphylococcus
LQGSAEEAHKFG

SEQ ID NO: 1964019 - protein, 11 aa, Staphylococcus
LQGSAEEAHRL

SEQ ID NO: 1964020 - protein, 5 aa, Staphylococcus
LQGSP

SEQ ID NO: 1964021 - protein, 8 aa, Staphylococcus
LQGYTQET

SEQ ID NO: 1964022 - protein, 5 aa, Staphylococcus
LQHGN

SEQ ID NO: 1964023 - protein, 6 aa, Staphylococcus
LQINND

SEQ ID NO: 1964024 - protein, 8 aa, Staphylococcus
LQKAAEKI

SEQ ID NO: 1964025 - protein, 18 aa, Staphylococcus
LQKEETISQSSQFDEHYG

SEQ ID NO: 1964026 - protein, 8 aa, Staphylococcus
LQKEPDES

SEQ ID NO: 1964027 - protein, 5 aa, Staphylococcus
LQKGD

SEQ ID NO: 1964028 - protein, 10 aa, Staphylococcus
LQKHKNEVEH

SEQ ID NO: 1964029 - protein, 7 aa, Staphylococcus
LQKHNPD

SEQ ID NO: 1964030 - protein, 5 aa, Staphylococcus
LQKKN

SEQ ID NO: 1964031 - protein, 9 aa, Staphylococcus
LQKNKLTES

SEQ ID NO: 1964032 - protein, 8 aa, Staphylococcus
LQKNNGPK

SEQ ID NO: 1964033 - protein, 8 aa, Staphylococcus
LQKNRNKL

SEQ ID NO: 1964034 - protein, 7 aa, Staphylococcus
LQKNTNL

SEQ ID NO: 1964035 - protein, 9 aa, Staphylococcus
LQKSGKTVT

SEQ ID NO: 1964036 - protein, 5 aa, Staphylococcus
LQKSH

SEQ ID NO: 1964037 - protein, 9 aa, Staphylococcus
LQKSKLTDS

SEQ ID NO: 1964038 - protein, 9 aa, Staphylococcus
LQKSKLTES

SEQ ID NO: 1964039 - protein, 8 aa, Staphylococcus
LQKSKNLK

SEQ ID NO: 1964040 - protein, 10 aa, Staphylococcus
LQKTETREVE

SEQ ID NO: 1964041 - protein, 11 aa, Staphylococcus
LQKTETREVEE

SEQ ID NO: 1964042 - protein, 6 aa, Staphylococcus
LQKVED

SEQ ID NO: 1964043 - protein, 4 aa, Staphylococcus
LQKY

SEQ ID NO: 1964044 - protein, 11 aa, Staphylococcus
LQLKSGSKWSK

SEQ ID NO: 1964045 - protein, 13 aa, Staphylococcus
LQNCAPSREHPHE

SEQ ID NO: 1964046 - protein, 5 aa, Staphylococcus
LQNDD

SEQ ID NO: 1964047 - protein, 6 aa, Staphylococcus
LQNDPE

SEQ ID NO: 1964048 - protein, 5 aa, Staphylococcus
LQNEI

SEQ ID NO: 1964049 - protein, 12 aa, Staphylococcus
LQNESDARTRNK

SEQ ID NO: 1964050 - protein, 13 aa, Staphylococcus
LQNGELQKANEEL

SEQ ID NO: 1964051 - protein, 10 aa, Staphylococcus
LQNGETLTEV

SEQ ID NO: 1964052 - protein, 10 aa, Staphylococcus
LQNKDLGETS

SEQ ID NO: 1964053 - protein, 4 aa, Staphylococcus
LQNL

SEQ ID NO: 1964054 - protein, 6 aa, Staphylococcus
LQNNRK

SEQ ID NO: 1964055 - protein, 7 aa, Staphylococcus
LQNQYDK

SEQ ID NO: 1964056 - protein, 7 aa, Staphylococcus
LQNQYDQ

SEQ ID NO: 1964057 - protein, 8 aa, Staphylococcus
LQNQYSQL

SEQ ID NO: 1964058 - protein, 24 aa, Staphylococcus
LQNRKQGTSEDTHNNGTDITEPEE

SEQ ID NO: 1964059 - protein, 8 aa, Staphylococcus
LQNSGVDR

SEQ ID NO: 1964060 - protein, 4 aa, Staphylococcus
LQPD

SEQ ID NO: 1964061 - protein, 4 aa, Staphylococcus
LQPE

SEQ ID NO: 1964062 - protein, 9 aa, Staphylococcus
LQPENSSME

SEQ ID NO: 1964063 - protein, 5 aa, Staphylococcus
LQPGD

SEQ ID NO: 1964064 - protein, 6 aa, Staphylococcus
LQPGDE

SEQ ID NO: 1964065 - protein, 6 aa, Staphylococcus
LQPGDQ

SEQ ID NO: 1964066 - protein, 23 aa, Staphylococcus
LQPGQETTYENQYNNVKNAAAKM

SEQ ID NO: 1964067 - protein, 7 aa, Staphylococcus
LQPGQTV

SEQ ID NO: 1964068 - protein, 7 aa, Staphylococcus
LQPKTGA

SEQ ID NO: 1964069 - protein, 11 aa, Staphylococcus
LQPLGDSKPDW

SEQ ID NO: 1964070 - protein, 6 aa, Staphylococcus
LQPNKT

SEQ ID NO: 1964071 - protein, 6 aa, Staphylococcus
LQPPEN

SEQ ID NO: 1964072 - protein, 6 aa, Staphylococcus
LQPTND

SEQ ID NO: 1964073 - protein, 9 aa, Staphylococcus
LQQCGNSQN

SEQ ID NO: 1964074 - protein, 5 aa, Staphylococcus
LQQDA

SEQ ID NO: 1964075 - protein, 6 aa, Staphylococcus
LQQDGS

SEQ ID NO: 1964076 - protein, 10 aa, Staphylococcus
LQQDSTPFTP

SEQ ID NO: 1964077 - protein, 4 aa, Staphylococcus
LQQE

SEQ ID NO: 1964078 - protein, 6 aa, Staphylococcus
LQQEAK

SEQ ID NO: 1964079 - protein, 14 aa, Staphylococcus
LQQKDAPESQKEIT

SEQ ID NO: 1964080 - protein, 14 aa, Staphylococcus
LQQKDAPESQKETT

SEQ ID NO: 1964081 - protein, 14 aa, Staphylococcus
LQQKDAPQSQKEVT

SEQ ID NO: 1964082 - protein, 14 aa, Staphylococcus
LQQKDVPETQKETN

SEQ ID NO: 1964083 - protein, 14 aa, Staphylococcus
LQQKDVPETQKETT

SEQ ID NO: 1964084 - protein, 21 aa, Staphylococcus
LQQKENVIANNQKAIEHARRN

SEQ ID NO: 1964085 - protein, 5 aa, Staphylococcus
LQQKH

SEQ ID NO: 1964086 - protein, 10 aa, Staphylococcus
LQQKQSVNFQ

SEQ ID NO: 1964087 - protein, 17 aa, Staphylococcus
LQQKRQQNKDNEEDQIQ

SEQ ID NO: 1964088 - protein, 15 aa, Staphylococcus
LQQKTSAFGQSTTVT

SEQ ID NO: 1964089 - protein, 9 aa, Staphylococcus
LQQKYGKGI

SEQ ID NO: 1964090 - protein, 6 aa, Staphylococcus
LQQNGT

SEQ ID NO: 1964091 - protein, 6 aa, Staphylococcus
LQQNQT

SEQ ID NO: 1964092 - protein, 6 aa, Staphylococcus
LQQQKD

SEQ ID NO: 1964093 - protein, 13 aa, Staphylococcus
LQQQKSQTEQLGN

SEQ ID NO: 1964094 - protein, 9 aa, Staphylococcus
LQQQSADEL

SEQ ID NO: 1964095 - protein, 8 aa, Staphylococcus
LQQSEQHK

SEQ ID NO: 1964096 - protein, 7 aa, Staphylococcus
LQQSESK

SEQ ID NO: 1964097 - protein, 11 aa, Staphylococcus
LQQSKKDKAEN

SEQ ID NO: 1964098 - protein, 15 aa, Staphylococcus
LQQSSYKLTPQREAT

SEQ ID NO: 1964099 - protein, 5 aa, Staphylococcus
LQQTQ

SEQ ID NO: 1964100 - protein, 7 aa, Staphylococcus
LQREKDR

SEQ ID NO: 1964101 - protein, 7 aa, Staphylococcus
LQREKER

SEQ ID NO: 1964102 - protein, 5 aa, Staphylococcus
LQREN

SEQ ID NO: 1964103 - protein, 4 aa, Staphylococcus
LQRK

SEQ ID NO: 1964104 - protein, 7 aa, Staphylococcus
LQRKTDK

SEQ ID NO: 1964105 - protein, 7 aa, Staphylococcus
LQRTDQT

SEQ ID NO: 1964106 - protein, 7 aa, Staphylococcus
LQSASNP

SEQ ID NO: 1964107 - protein, 8 aa, Staphylococcus
LQSDDKDF

SEQ ID NO: 1964108 - protein, 6 aa, Staphylococcus
LQSDDY

SEQ ID NO: 1964109 - protein, 8 aa, Staphylococcus
LQSDEKEF

SEQ ID NO: 1964110 - protein, 8 aa, Staphylococcus
LQSDNKKF

SEQ ID NO: 1964111 - protein, 7 aa, Staphylococcus
LQSEGYE

SEQ ID NO: 1964112 - protein, 6 aa, Staphylococcus
LQSEKK

SEQ ID NO: 1964113 - protein, 6 aa, Staphylococcus
LQSERN

SEQ ID NO: 1964114 - protein, 9 aa, Staphylococcus
LQSGNYTDS

SEQ ID NO: 1964115 - protein, 12 aa, Staphylococcus
LQSKGKNVNTSI

SEQ ID NO: 1964116 - protein, 9 aa, Staphylococcus
LQSKYGKER

SEQ ID NO: 1964117 - protein, 7 aa, Staphylococcus
LQSNEPC

SEQ ID NO: 1964118 - protein, 9 aa, Staphylococcus
LQSNESLDT

SEQ ID NO: 1964119 - protein, 6 aa, Staphylococcus
LQSSHA

SEQ ID NO: 1964120 - protein, 14 aa, Staphylococcus
LQSSIGEDSDTSLG

SEQ ID NO: 1964121 - protein, 8 aa, Staphylococcus
LQSSKTTL

SEQ ID NO: 1964122 - protein, 12 aa, Staphylococcus
LQSTRKAYENQL

SEQ ID NO: 1964123 - protein, 11 aa, Staphylococcus
LQSTRKSFEKE

SEQ ID NO: 1964124 - protein, 8 aa, Staphylococcus
LQTDPKGF

SEQ ID NO: 1964125 - protein, 10 aa, Staphylococcus
LQTKDSESLP

SEQ ID NO: 1964126 - protein, 4 aa, Staphylococcus
LQTP

SEQ ID NO: 1964127 - protein, 12 aa, Staphylococcus
LQTPQITSINTE

SEQ ID NO: 1964128 - protein, 7 aa, Staphylococcus
LQTPTTG

SEQ ID NO: 1964129 - protein, 4 aa, Staphylococcus
LQTQ

SEQ ID NO: 1964130 - protein, 4 aa, Staphylococcus
LQTS

SEQ ID NO: 1964131 - protein, 5 aa, Staphylococcus
LQTSE

SEQ ID NO: 1964132 - protein, 5 aa, Staphylococcus
LQTTA

SEQ ID NO: 1964133 - protein, 10 aa, Staphylococcus
LQTTPSNGSI

SEQ ID NO: 1964134 - protein, 7 aa, Staphylococcus
LQTTQGI

SEQ ID NO: 1964135 - protein, 15 aa, Staphylococcus
LQYPEGDFWQSKMPR

SEQ ID NO: 1964136 - protein, 9 aa, Staphylococcus
LRADKKVDG

SEQ ID NO: 1964137 - protein, 4 aa, Staphylococcus
LRAE

SEQ ID NO: 1964138 - protein, 14 aa, Staphylococcus
LRAEKATNEMRSEA

SEQ ID NO: 1964139 - protein, 4 aa, Staphylococcus
LRDE

SEQ ID NO: 1964140 - protein, 5 aa, Staphylococcus
LRDEG

SEQ ID NO: 1964141 - protein, 5 aa, Staphylococcus
LRDEP

SEQ ID NO: 1964142 - protein, 23 aa, Staphylococcus
LRDGDKDRYLGKGVTKAVENVNE

SEQ ID NO: 1964143 - protein, 13 aa, Staphylococcus
LRDGDKSRYLGKG

SEQ ID NO: 1964144 - protein, 10 aa, Staphylococcus
LRDGKEREDV

SEQ ID NO: 1964145 - protein, 10 aa, Staphylococcus
LRDKELNKDS

SEQ ID NO: 1964146 - protein, 6 aa, Staphylococcus
LRDKGY

SEQ ID NO: 1964147 - protein, 10 aa, Staphylococcus
LRDKNYKDFK

SEQ ID NO: 1964148 - protein, 5 aa, Staphylococcus
LRDKR

SEQ ID NO: 1964149 - protein, 9 aa, Staphylococcus
LRDKTGKMN

SEQ ID NO: 1964150 - protein, 4 aa, Staphylococcus
LRDN

SEQ ID NO: 1964151 - protein, 11 aa, Staphylococcus
LRDNKGAEVKE

SEQ ID NO: 1964152 - protein, 17 aa, Staphylococcus
LRDQSEVYKNNADRALK

SEQ ID NO: 1964153 - protein, 7 aa, Staphylococcus
LRDSDTT

SEQ ID NO: 1964154 - protein, 8 aa, Staphylococcus
LRDYGTGH

SEQ ID NO: 1964155 - protein, 6 aa, Staphylococcus
LREAEP

SEQ ID NO: 1964156 - protein, 4 aa, Staphylococcus
LRED

SEQ ID NO: 1964157 - protein, 7 aa, Staphylococcus
LREDGYT

SEQ ID NO: 1964158 - protein, 7 aa, Staphylococcus
LREEGRE

SEQ ID NO: 1964159 - protein, 5 aa, Staphylococcus
LREGD

SEQ ID NO: 1964160 - protein, 6 aa, Staphylococcus
LREGDE

SEQ ID NO: 1964161 - protein, 6 aa, Staphylococcus
LREGDT

SEQ ID NO: 1964162 - protein, 7 aa, Staphylococcus
LREHKET

SEQ ID NO: 1964163 - protein, 5 aa, Staphylococcus
LREID

SEQ ID NO: 1964164 - protein, 4 aa, Staphylococcus
LREK

SEQ ID NO: 1964165 - protein, 8 aa, Staphylococcus
LREPNNQK

SEQ ID NO: 1964166 - protein, 9 aa, Staphylococcus
LREQQNKEV

SEQ ID NO: 1964167 - protein, 6 aa, Staphylococcus
LREQTG

SEQ ID NO: 1964168 - protein, 11 aa, Staphylococcus
LREQTGLHGKT

SEQ ID NO: 1964169 - protein, 12 aa, Staphylococcus
LREQTGLKDQTL

SEQ ID NO: 1964170 - protein, 8 aa, Staphylococcus
LREQTGLY

SEQ ID NO: 1964171 - protein, 10 aa, Staphylococcus
LRERGAKNGD

SEQ ID NO: 1964172 - protein, 12 aa, Staphylococcus
LRERNAELERKL

SEQ ID NO: 1964173 - protein, 8 aa, Staphylococcus
LRERTGAG

SEQ ID NO: 1964174 - protein, 12 aa, Staphylococcus
LRESEQNPTAHA

SEQ ID NO: 1964175 - protein, 7 aa, Staphylococcus
LRESGVE

SEQ ID NO: 1964176 - protein, 11 aa, Staphylococcus
LRETAQLPTAH

SEQ ID NO: 1964177 - protein, 9 aa, Staphylococcus
LRETEDPFT

SEQ ID NO: 1964178 - protein, 7 aa, Staphylococcus
LRETGVD

SEQ ID NO: 1964179 - protein, 12 aa, Staphylococcus
LRETSQQPTAHA

SEQ ID NO: 1964180 - protein, 10 aa, Staphylococcus
LRGARASAEL

SEQ ID NO: 1964181 - protein, 8 aa, Staphylococcus
LRGNMDAS

SEQ ID NO: 1964182 - protein, 9 aa, Staphylococcus
LRGNMDASE

SEQ ID NO: 1964183 - protein, 10 aa, Staphylococcus
LRGNTEATAY

SEQ ID NO: 1964184 - protein, 6 aa, Staphylococcus
LRGVDS

SEQ ID NO: 1964185 - protein, 7 aa, Staphylococcus
LRGVDSS

SEQ ID NO: 1964186 - protein, 5 aa, Staphylococcus
LRHTN

SEQ ID NO: 1964187 - protein, 8 aa, Staphylococcus
LRKAKDRA

SEQ ID NO: 1964188 - protein, 11 aa, Staphylococcus
LRKDKGVHDTM

SEQ ID NO: 1964189 - protein, 8 aa, Staphylococcus
LRKEDKIE

SEQ ID NO: 1964190 - protein, 7 aa, Staphylococcus
LRKEGRE

SEQ ID NO: 1964191 - protein, 34 aa, Staphylococcus
LRKNNDGTAMTTNSGMKVSEDENSLTVGDRGPTL

SEQ ID NO: 1964192 - protein, 20 aa, Staphylococcus
LRKQGGRHKGPTPFSNKDQQ

SEQ ID NO: 1964193 - protein, 9 aa, Staphylococcus
LRKQNTQTN

SEQ ID NO: 1964194 - protein, 10 aa, Staphylococcus
LRKQTGLSGH

SEQ ID NO: 1964195 - protein, 13 aa, Staphylococcus
LRKRNTKKVKRNG

SEQ ID NO: 1964196 - protein, 8 aa, Staphylococcus
LRKSDDYN

SEQ ID NO: 1964197 - protein, 7 aa, Staphylococcus
LRNEGRD

SEQ ID NO: 1964198 - protein, 8 aa, Staphylococcus
LRNERTKD

SEQ ID NO: 1964199 - protein, 8 aa, Staphylococcus
LRNGEDKL

SEQ ID NO: 1964200 - protein, 5 aa, Staphylococcus
LRNGG

SEQ ID NO: 1964201 - protein, 5 aa, Staphylococcus
LRNGH

SEQ ID NO: 1964202 - protein, 11 aa, Staphylococcus
LRNGKAVEVPT

SEQ ID NO: 1964203 - protein, 9 aa, Staphylococcus
LRNGKERED

SEQ ID NO: 1964204 - protein, 12 aa, Staphylococcus
LRNGQSVEVPTY

SEQ ID NO: 1964205 - protein, 10 aa, Staphylococcus
LRNGRTNLED

SEQ ID NO: 1964206 - protein, 4 aa, Staphylococcus
LRNK

SEQ ID NO: 1964207 - protein, 5 aa, Staphylococcus
LRNKE

SEQ ID NO: 1964208 - protein, 5 aa, Staphylococcus
LRNQN

SEQ ID NO: 1964209 - protein, 4 aa, Staphylococcus
LRNT

SEQ ID NO: 1964210 - protein, 4 aa, Staphylococcus
LRNV

SEQ ID NO: 1964211 - protein, 5 aa, Staphylococcus
LRPEK

SEQ ID NO: 1964212 - protein, 11 aa, Staphylococcus
LRPGSNLGKDV

SEQ ID NO: 1964213 - protein, 11 aa, Staphylococcus
LRPGSNLGTEV

SEQ ID NO: 1964214 - protein, 6 aa, Staphylococcus
LRPKDE

SEQ ID NO: 1964215 - protein, 12 aa, Staphylococcus
LRPLGRTAAGVR

SEQ ID NO: 1964216 - protein, 13 aa, Staphylococcus
LRPLGRTASGVRG

SEQ ID NO: 1964217 - protein, 6 aa, Staphylococcus
LRPQDV

SEQ ID NO: 1964218 - protein, 6 aa, Staphylococcus
LRPQHE

SEQ ID NO: 1964219 - protein, 10 aa, Staphylococcus
LRPSFDSTGI

SEQ ID NO: 1964220 - protein, 6 aa, Staphylococcus
LRPSGK

SEQ ID NO: 1964221 - protein, 19 aa, Staphylococcus
LRPSIDETGIYPRAEHGPI

SEQ ID NO: 1964222 - protein, 10 aa, Staphylococcus
LRPSLEDTGI

SEQ ID NO: 1964223 - protein, 8 aa, Staphylococcus
LRPSSLDD

SEQ ID NO: 1964224 - protein, 10 aa, Staphylococcus
LRPSVENTGV

SEQ ID NO: 1964225 - protein, 5 aa, Staphylococcus
LRPYE

SEQ ID NO: 1964226 - protein, 16 aa, Staphylococcus
LRPYGQKEFGTKTELK

SEQ ID NO: 1964227 - protein, 17 aa, Staphylococcus
LRPYGQKEFGTKTELKN

SEQ ID NO: 1964228 - protein, 6 aa, Staphylococcus
LRQAGA

SEQ ID NO: 1964229 - protein, 7 aa, Staphylococcus
LRQDGVE

SEQ ID NO: 1964230 - protein, 15 aa, Staphylococcus
LRQESNAAKEEVENR

SEQ ID NO: 1964231 - protein, 4 aa, Staphylococcus
LRQG

SEQ ID NO: 1964232 - protein, 8 aa, Staphylococcus
LRQGQSKI

SEQ ID NO: 1964233 - protein, 7 aa, Staphylococcus
LRQGRKK

SEQ ID NO: 1964234 - protein, 6 aa, Staphylococcus
LRQHNK

SEQ ID NO: 1964235 - protein, 5 aa, Staphylococcus
LRQKN

SEQ ID NO: 1964236 - protein, 15 aa, Staphylococcus
LRQQGQHSAEQSANV

SEQ ID NO: 1964237 - protein, 7 aa, Staphylococcus
LRQSGVE

SEQ ID NO: 1964238 - protein, 10 aa, Staphylococcus
LRQSKYVGKQ

SEQ ID NO: 1964239 - protein, 4 aa, Staphylococcus
LRQT

SEQ ID NO: 1964240 - protein, 7 aa, Staphylococcus
LRQTDGQ

SEQ ID NO: 1964241 - protein, 7 aa, Staphylococcus
LRQTGVE

SEQ ID NO: 1964242 - protein, 14 aa, Staphylococcus
LRQTPKQAETRKEL

SEQ ID NO: 1964243 - protein, 4 aa, Staphylococcus
LRRG

SEQ ID NO: 1964244 - protein, 7 aa, Staphylococcus
LRSAEDQ

SEQ ID NO: 1964245 - protein, 9 aa, Staphylococcus
LRSAQEGAK

SEQ ID NO: 1964246 - protein, 6 aa, Staphylococcus
LRSAQQ

SEQ ID NO: 1964247 - protein, 7 aa, Staphylococcus
LRSASQP

SEQ ID NO: 1964248 - protein, 6 aa, Staphylococcus
LRSEGR

SEQ ID NO: 1964249 - protein, 7 aa, Staphylococcus
LRSEGRE

SEQ ID NO: 1964250 - protein, 11 aa, Staphylococcus
LRSESSSRFEK

SEQ ID NO: 1964251 - protein, 12 aa, Staphylococcus
LRSESSSRFEKG

SEQ ID NO: 1964252 - protein, 4 aa, Staphylococcus
LRSG

SEQ ID NO: 1964253 - protein, 8 aa, Staphylococcus
LRSGTEQY

SEQ ID NO: 1964254 - protein, 6 aa, Staphylococcus
LRSHPN

SEQ ID NO: 1964255 - protein, 17 aa, Staphylococcus
LRSKATYWKKNQGDYDQ

SEQ ID NO: 1964256 - protein, 9 aa, Staphylococcus
LRSKGNNEL

SEQ ID NO: 1964257 - protein, 8 aa, Staphylococcus
LRSNDDSI

SEQ ID NO: 1964258 - protein, 10 aa, Staphylococcus
LRSNEETALG

SEQ ID NO: 1964259 - protein, 5 aa, Staphylococcus
LRSPN

SEQ ID NO: 1964260 - protein, 6 aa, Staphylococcus
LRSSHK

SEQ ID NO: 1964261 - protein, 8 aa, Staphylococcus
LRSVNKDT

SEQ ID NO: 1964262 - protein, 4 aa, Staphylococcus
LRSY

SEQ ID NO: 1964263 - protein, 6 aa, Staphylococcus
LRTAEK

SEQ ID NO: 1964264 - protein, 10 aa, Staphylococcus
LRTATDEAAY

SEQ ID NO: 1964265 - protein, 16 aa, Staphylococcus
LRTEAQRRNIKETEGL

SEQ ID NO: 1964266 - protein, 15 aa, Staphylococcus
LRTEAQRRNIQDTAD

SEQ ID NO: 1964267 - protein, 15 aa, Staphylococcus
LRTEAQRRNIQETED

SEQ ID NO: 1964268 - protein, 26 aa, Staphylococcus
LRTEDARRALPQSFGHNNAVQSSAIS

SEQ ID NO: 1964269 - protein, 9 aa, Staphylococcus
LRTEDSRNV

SEQ ID NO: 1964270 - protein, 12 aa, Staphylococcus
LRTEPKLSLPSA

SEQ ID NO: 1964271 - protein, 8 aa, Staphylococcus
LRTEQAGA

SEQ ID NO: 1964272 - protein, 7 aa, Staphylococcus
LRTERDN

SEQ ID NO: 1964273 - protein, 7 aa, Staphylococcus
LRTGAIQ

SEQ ID NO: 1964274 - protein, 18 aa, Staphylococcus
LRTGAIQEKTFRGGEKVE

SEQ ID NO: 1964275 - protein, 9 aa, Staphylococcus
LRTGKRDVD

SEQ ID NO: 1964276 - protein, 6 aa, Staphylococcus
LRTHGD

SEQ ID NO: 1964277 - protein, 8 aa, Staphylococcus
LRTKDEID

SEQ ID NO: 1964278 - protein, 10 aa, Staphylococcus
LRTNKETALG

SEQ ID NO: 1964279 - protein, 8 aa, Staphylococcus
LRTPSDLG

SEQ ID NO: 1964280 - protein, 11 aa, Staphylococcus
LRTPSDSGLDE

SEQ ID NO: 1964281 - protein, 11 aa, Staphylococcus
LRTPSNAGLEE

SEQ ID NO: 1964282 - protein, 12 aa, Staphylococcus
LRTPTDSGLDEY

SEQ ID NO: 1964283 - protein, 6 aa, Staphylococcus
LRTQTG

SEQ ID NO: 1964284 - protein, 6 aa, Staphylococcus
LRTTGG

SEQ ID NO: 1964285 - protein, 8 aa, Staphylococcus
LRTYPGNY

SEQ ID NO: 1964286 - protein, 5 aa, Staphylococcus
LRYPE

SEQ ID NO: 1964287 - protein, 13 aa, Staphylococcus
LRYSQSKEEFDKA

SEQ ID NO: 1964288 - protein, 6 aa, Staphylococcus
LRYTQA

SEQ ID NO: 1964289 - protein, 8 aa, Staphylococcus
LSADNTNI

SEQ ID NO: 1964290 - protein, 4 aa, Staphylococcus
LSAE

SEQ ID NO: 1964291 - protein, 9 aa, Staphylococcus
LSAEDQETF

SEQ ID NO: 1964292 - protein, 6 aa, Staphylococcus
LSAEED

SEQ ID NO: 1964293 - protein, 10 aa, Staphylococcus
LSAEEKNKHV

SEQ ID NO: 1964294 - protein, 10 aa, Staphylococcus
LSAEEKQKHV

SEQ ID NO: 1964295 - protein, 9 aa, Staphylococcus
LSAEGTQHR

SEQ ID NO: 1964296 - protein, 14 aa, Staphylococcus
LSAELENANQDTKL

SEQ ID NO: 1964297 - protein, 16 aa, Staphylococcus
LSAETEHMSGGEKQRI

SEQ ID NO: 1964298 - protein, 18 aa, Staphylococcus
LSAISEKAIERKTGARGL

SEQ ID NO: 1964299 - protein, 9 aa, Staphylococcus
LSAKGRREY

SEQ ID NO: 1964300 - protein, 13 aa, Staphylococcus
LSAKSRNNRSNWS

SEQ ID NO: 1964301 - protein, 13 aa, Staphylococcus
LSANADLKTANKL

SEQ ID NO: 1964302 - protein, 6 aa, Staphylococcus
LSANDT

SEQ ID NO: 1964303 - protein, 6 aa, Staphylococcus
LSANDY

SEQ ID NO: 1964304 - protein, 8 aa, Staphylococcus
LSANTIGA

SEQ ID NO: 1964305 - protein, 6 aa, Staphylococcus
LSAPSI

SEQ ID NO: 1964306 - protein, 6 aa, Staphylococcus
LSAPVG

SEQ ID NO: 1964307 - protein, 7 aa, Staphylococcus
LSAPVGP

SEQ ID NO: 1964308 - protein, 43 aa, Staphylococcus
LSAQNPALDKVETEKRITELENDKRQAVSKEAYKEADKIQSQI

SEQ ID NO: 1964309 - protein, 36 aa, Staphylococcus
LSASATQAIQKAKDDSINSINTNKADALNNIEEQTT

SEQ ID NO: 1964310 - protein, 7 aa, Staphylococcus
LSASKDD

SEQ ID NO: 1964311 - protein, 11 aa, Staphylococcus
LSASSSAKTID

SEQ ID NO: 1964312 - protein, 5 aa, Staphylococcus
LSATN

SEQ ID NO: 1964313 - protein, 5 aa, Staphylococcus
LSAVE

SEQ ID NO: 1964314 - protein, 9 aa, Staphylococcus
LSAVEEAEA

SEQ ID NO: 1964315 - protein, 5 aa, Staphylococcus
LSDAL

SEQ ID NO: 1964316 - protein, 9 aa, Staphylococcus
LSDAQEEEI

SEQ ID NO: 1964317 - protein, 7 aa, Staphylococcus
LSDASGH

SEQ ID NO: 1964318 - protein, 6 aa, Staphylococcus
LSDDEL

SEQ ID NO: 1964319 - protein, 16 aa, Staphylococcus
LSDDGSKGVPSSKGVI

SEQ ID NO: 1964320 - protein, 35 aa, Staphylococcus
LSDDNKKANYDQFGHDGPQGGFGGQDFSGFGGGGF

SEQ ID NO: 1964321 - protein, 9 aa, Staphylococcus
LSDDSGKVL

SEQ ID NO: 1964322 - protein, 12 aa, Staphylococcus
LSDEDKQTVERA

SEQ ID NO: 1964323 - protein, 12 aa, Staphylococcus
LSDEDKSTVERA

SEQ ID NO: 1964324 - protein, 6 aa, Staphylococcus
LSDEEY

SEQ ID NO: 1964325 - protein, 8 aa, Staphylococcus
LSDEEYNK

SEQ ID NO: 1964326 - protein, 15 aa, Staphylococcus
LSDEQLTKKYREGSW

SEQ ID NO: 1964327 - protein, 5 aa, Staphylococcus
LSDET

SEQ ID NO: 1964328 - protein, 4 aa, Staphylococcus
LSDG

SEQ ID NO: 1964329 - protein, 6 aa, Staphylococcus
LSDGQS

SEQ ID NO: 1964330 - protein, 9 aa, Staphylococcus
LSDGSNVPV

SEQ ID NO: 1964331 - protein, 12 aa, Staphylococcus
LSDINAGNIGQI

SEQ ID NO: 1964332 - protein, 11 aa, Staphylococcus
LSDIPEEEQDD

SEQ ID NO: 1964333 - protein, 13 aa, Staphylococcus
LSDIRKGKIGQIP

SEQ ID NO: 1964334 - protein, 8 aa, Staphylococcus
LSDKEKRL

SEQ ID NO: 1964335 - protein, 9 aa, Staphylococcus
LSDKEQRLF

SEQ ID NO: 1964336 - protein, 7 aa, Staphylococcus
LSDKGQT

SEQ ID NO: 1964337 - protein, 5 aa, Staphylococcus
LSDKH

SEQ ID NO: 1964338 - protein, 5 aa, Staphylococcus
LSDKI

SEQ ID NO: 1964339 - protein, 7 aa, Staphylococcus
LSDKKTL

SEQ ID NO: 1964340 - protein, 6 aa, Staphylococcus
LSDKNG

SEQ ID NO: 1964341 - protein, 10 aa, Staphylococcus
LSDKQKEQFQ

SEQ ID NO: 1964342 - protein, 10 aa, Staphylococcus
LSDKQQQQFQ

SEQ ID NO: 1964343 - protein, 6 aa, Staphylococcus
LSDKSG

SEQ ID NO: 1964344 - protein, 5 aa, Staphylococcus
LSDKT

SEQ ID NO: 1964345 - protein, 6 aa, Staphylococcus
LSDNDN

SEQ ID NO: 1964346 - protein, 6 aa, Staphylococcus
LSDNPE

SEQ ID NO: 1964347 - protein, 4 aa, Staphylococcus
LSDQ

SEQ ID NO: 1964348 - protein, 9 aa, Staphylococcus
LSDQDFTNK

SEQ ID NO: 1964349 - protein, 20 aa, Staphylococcus
LSDQGVEEATTSGDRLKQEG

SEQ ID NO: 1964350 - protein, 5 aa, Staphylococcus
LSDQT

SEQ ID NO: 1964351 - protein, 9 aa, Staphylococcus
LSDRESLTQ

SEQ ID NO: 1964352 - protein, 5 aa, Staphylococcus
LSDRQ

SEQ ID NO: 1964353 - protein, 6 aa, Staphylococcus
LSDRSG

SEQ ID NO: 1964354 - protein, 9 aa, Staphylococcus
LSDSAQQMD

SEQ ID NO: 1964355 - protein, 5 aa, Staphylococcus
LSDSD

SEQ ID NO: 1964356 - protein, 6 aa, Staphylococcus
LSDSDN

SEQ ID NO: 1964357 - protein, 6 aa, Staphylococcus
LSDSEP

SEQ ID NO: 1964358 - protein, 6 aa, Staphylococcus
LSDSET

SEQ ID NO: 1964359 - protein, 9 aa, Staphylococcus
LSDSGQQMD

SEQ ID NO: 1964360 - protein, 6 aa, Staphylococcus
LSDTDR

SEQ ID NO: 1964361 - protein, 12 aa, Staphylococcus
LSDTEQQEKDIK

SEQ ID NO: 1964362 - protein, 11 aa, Staphylococcus
LSDTSKNKSEL

SEQ ID NO: 1964363 - protein, 9 aa, Staphylococcus
LSDTSQDES

SEQ ID NO: 1964364 - protein, 6 aa, Staphylococcus
LSDVRK

SEQ ID NO: 1964365 - protein, 10 aa, Staphylococcus
LSDVRKDGTL

SEQ ID NO: 1964366 - protein, 4 aa, Staphylococcus
LSDY

SEQ ID NO: 1964367 - protein, 10 aa, Staphylococcus
LSEAEKNTFK

SEQ ID NO: 1964368 - protein, 14 aa, Staphylococcus
LSEAERNWLDQQKN

SEQ ID NO: 1964369 - protein, 11 aa, Staphylococcus
LSEAGLAEEGD

SEQ ID NO: 1964370 - protein, 7 aa, Staphylococcus
LSEDDQT

SEQ ID NO: 1964371 - protein, 11 aa, Staphylococcus
LSEDESKSRDM

SEQ ID NO: 1964372 - protein, 12 aa, Staphylococcus
LSEDKAKELNVT

SEQ ID NO: 1964373 - protein, 10 aa, Staphylococcus
LSEDKRDTEF

SEQ ID NO: 1964374 - protein, 8 aa, Staphylococcus
LSEDNEAK

SEQ ID NO: 1964375 - protein, 7 aa, Staphylococcus
LSEDSGI

SEQ ID NO: 1964376 - protein, 21 aa, Staphylococcus
LSEDTLDKMKEKYSDLNFAYI

SEQ ID NO: 1964377 - protein, 6 aa, Staphylococcus
LSEDVK

SEQ ID NO: 1964378 - protein, 26 aa, Staphylococcus
LSEEATRLRDHDADELSHYSNATTDI

SEQ ID NO: 1964379 - protein, 7 aa, Staphylococcus
LSEEDRD

SEQ ID NO: 1964380 - protein, 12 aa, Staphylococcus
LSEEDRQTVERA

SEQ ID NO: 1964381 - protein, 27 aa, Staphylococcus
LSEEDSRYTKTPLENLESAKTNENRYP

SEQ ID NO: 1964382 - protein, 7 aa, Staphylococcus
LSEEEAY

SEQ ID NO: 1964383 - protein, 9 aa, Staphylococcus
LSEEFGDKG

SEQ ID NO: 1964384 - protein, 8 aa, Staphylococcus
LSEEGGDI

SEQ ID NO: 1964385 - protein, 8 aa, Staphylococcus
LSEEGSII

SEQ ID NO: 1964386 - protein, 8 aa, Staphylococcus
LSEELGAK

SEQ ID NO: 1964387 - protein, 13 aa, Staphylococcus
LSEELKDADQDVK

SEQ ID NO: 1964388 - protein, 9 aa, Staphylococcus
LSEEPDKYI

SEQ ID NO: 1964389 - protein, 13 aa, Staphylococcus
LSEEQTEKYKKDI

SEQ ID NO: 1964390 - protein, 9 aa, Staphylococcus
LSEERREKI

SEQ ID NO: 1964391 - protein, 10 aa, Staphylococcus
LSEETDEAKL

SEQ ID NO: 1964392 - protein, 6 aa, Staphylococcus
LSEGDV

SEQ ID NO: 1964393 - protein, 8 aa, Staphylococcus
LSEGELNL

SEQ ID NO: 1964394 - protein, 8 aa, Staphylococcus
LSEGEMNL

SEQ ID NO: 1964395 - protein, 10 aa, Staphylococcus
LSEGIEKGIG

SEQ ID NO: 1964396 - protein, 7 aa, Staphylococcus
LSEGQLN

SEQ ID NO: 1964397 - protein, 8 aa, Staphylococcus
LSEGTTSY

SEQ ID NO: 1964398 - protein, 7 aa, Staphylococcus
LSEGTTT

SEQ ID NO: 1964399 - protein, 8 aa, Staphylococcus
LSEGTTTY

SEQ ID NO: 1964400 - protein, 8 aa, Staphylococcus
LSEGYDGV

SEQ ID NO: 1964401 - protein, 13 aa, Staphylococcus
LSEHASKENAKGM

SEQ ID NO: 1964402 - protein, 12 aa, Staphylococcus
LSEHASKENAKN

SEQ ID NO: 1964403 - protein, 12 aa, Staphylococcus
LSEHATKENAKG

SEQ ID NO: 1964404 - protein, 5 aa, Staphylococcus
LSEHR

SEQ ID NO: 1964405 - protein, 8 aa, Staphylococcus
LSEIQKKK

SEQ ID NO: 1964406 - protein, 4 aa, Staphylococcus
LSEK

SEQ ID NO: 1964407 - protein, 9 aa, Staphylococcus
LSEKDKNFA

SEQ ID NO: 1964408 - protein, 9 aa, Staphylococcus
LSEKDRGLA

SEQ ID NO: 1964409 - protein, 7 aa, Staphylococcus
LSEKEIN

SEQ ID NO: 1964410 - protein, 11 aa, Staphylococcus
LSEKFSEAAAV

SEQ ID NO: 1964411 - protein, 5 aa, Staphylococcus
LSEKG

SEQ ID NO: 1964412 - protein, 7 aa, Staphylococcus
LSEKGDF

SEQ ID NO: 1964413 - protein, 8 aa, Staphylococcus
LSEKGQQL

SEQ ID NO: 1964414 - protein, 11 aa, Staphylococcus
LSEKGTEDING

SEQ ID NO: 1964415 - protein, 6 aa, Staphylococcus
LSEKLG

SEQ ID NO: 1964416 - protein, 15 aa, Staphylococcus
LSEKPNQCCDNDSEI

SEQ ID NO: 1964417 - protein, 20 aa, Staphylococcus
LSEKTAERLSRIQKSGKTVT

SEQ ID NO: 1964418 - protein, 7 aa, Staphylococcus
LSENFDS

SEQ ID NO: 1964419 - protein, 12 aa, Staphylococcus
LSENIPKVTPES

SEQ ID NO: 1964420 - protein, 11 aa, Staphylococcus
LSENKEAIDRN

SEQ ID NO: 1964421 - protein, 21 aa, Staphylococcus
LSENKSNIEEKINDYNKQYQT

SEQ ID NO: 1964422 - protein, 8 aa, Staphylococcus
LSENSDDL

SEQ ID NO: 1964423 - protein, 21 aa, Staphylococcus
LSEPGANNIATTVNKKTGKWS

SEQ ID NO: 1964424 - protein, 6 aa, Staphylococcus
LSEPIP

SEQ ID NO: 1964425 - protein, 6 aa, Staphylococcus
LSEPNR

SEQ ID NO: 1964426 - protein, 19 aa, Staphylococcus
LSEPQSVKAQRDEYRTEMD

SEQ ID NO: 1964427 - protein, 22 aa, Staphylococcus
LSEPRQDNSSTTYTSAKEGQPE

SEQ ID NO: 1964428 - protein, 8 aa, Staphylococcus
LSEPSDAD

SEQ ID NO: 1964429 - protein, 7 aa, Staphylococcus
LSEPSDV

SEQ ID NO: 1964430 - protein, 4 aa, Staphylococcus
LSEQ

SEQ ID NO: 1964431 - protein, 5 aa, Staphylococcus
LSEQD

SEQ ID NO: 1964432 - protein, 8 aa, Staphylococcus
LSEQDKAI

SEQ ID NO: 1964433 - protein, 9 aa, Staphylococcus
LSEQDQAIA

SEQ ID NO: 1964434 - protein, 18 aa, Staphylococcus
LSEQEESINKEKDYLEKT

SEQ ID NO: 1964435 - protein, 20 aa, Staphylococcus
LSEQGENEAITSGKKLKAQG

SEQ ID NO: 1964436 - protein, 20 aa, Staphylococcus
LSEQGIEEAKTAGEKVADNK

SEQ ID NO: 1964437 - protein, 16 aa, Staphylococcus
LSEQGIEEATAAGKKV

SEQ ID NO: 1964438 - protein, 10 aa, Staphylococcus
LSEQGINEAV

SEQ ID NO: 1964439 - protein, 21 aa, Staphylococcus
LSEQGRNEAITSGKKLKENKI

SEQ ID NO: 1964440 - protein, 21 aa, Staphylococcus
LSEQGRNEAITSGRKLKENGI

SEQ ID NO: 1964441 - protein, 5 aa, Staphylococcus
LSEQI

SEQ ID NO: 1964442 - protein, 6 aa, Staphylococcus
LSEQIQ

SEQ ID NO: 1964443 - protein, 6 aa, Staphylococcus
LSEQQL

SEQ ID NO: 1964444 - protein, 13 aa, Staphylococcus
LSEQQQKNIENLA

SEQ ID NO: 1964445 - protein, 15 aa, Staphylococcus
LSEQTDKLKELNNGE

SEQ ID NO: 1964446 - protein, 9 aa, Staphylococcus
LSEQTTFNG

SEQ ID NO: 1964447 - protein, 12 aa, Staphylococcus
LSEQTTINGPQV

SEQ ID NO: 1964448 - protein, 6 aa, Staphylococcus
LSESDE

SEQ ID NO: 1964449 - protein, 8 aa, Staphylococcus
LSESSKGN

SEQ ID NO: 1964450 - protein, 11 aa, Staphylococcus
LSESTIKADPN

SEQ ID NO: 1964451 - protein, 8 aa, Staphylococcus
LSESTLDQ

SEQ ID NO: 1964452 - protein, 11 aa, Staphylococcus
LSESVNKGRYV

SEQ ID NO: 1964453 - protein, 9 aa, Staphylococcus
LSETAEDRL

SEQ ID NO: 1964454 - protein, 9 aa, Staphylococcus
LSETAEERL

SEQ ID NO: 1964455 - protein, 7 aa, Staphylococcus
LSETATD

SEQ ID NO: 1964456 - protein, 10 aa, Staphylococcus
LSETDDKEEI

SEQ ID NO: 1964457 - protein, 9 aa, Staphylococcus
LSETHTRNQ

SEQ ID NO: 1964458 - protein, 8 aa, Staphylococcus
LSETITPY

SEQ ID NO: 1964459 - protein, 10 aa, Staphylococcus
LSETKNTSDI

SEQ ID NO: 1964460 - protein, 7 aa, Staphylococcus
LSETKRT

SEQ ID NO: 1964461 - protein, 5 aa, Staphylococcus
LSETL

SEQ ID NO: 1964462 - protein, 10 aa, Staphylococcus
LSETQKEQFQ

SEQ ID NO: 1964463 - protein, 7 aa, Staphylococcus
LSETRKA

SEQ ID NO: 1964464 - protein, 5 aa, Staphylococcus
LSEVE

SEQ ID NO: 1964465 - protein, 51 aa, Staphylococcus
LSEVSGKGNDVLRKDDVDNSQKQASQPSQSESKSQDSGSKKSNDNPSKPVI

SEQ ID NO: 1964466 - protein, 4 aa, Staphylococcus
LSEY

SEQ ID NO: 1964467 - protein, 13 aa, Staphylococcus
LSEYDKKSLIESN

SEQ ID NO: 1964468 - protein, 6 aa, Staphylococcus
LSEYGN

SEQ ID NO: 1964469 - protein, 13 aa, Staphylococcus
LSEYSESRESWLY

SEQ ID NO: 1964470 - protein, 8 aa, Staphylococcus
LSGAAKAT

SEQ ID NO: 1964471 - protein, 5 aa, Staphylococcus
LSGAM

SEQ ID NO: 1964472 - protein, 5 aa, Staphylococcus
LSGAN

SEQ ID NO: 1964473 - protein, 18 aa, Staphylococcus
LSGDLNDLSSLKGSASID

SEQ ID NO: 1964474 - protein, 8 aa, Staphylococcus
LSGDSKYI

SEQ ID NO: 1964475 - protein, 45 aa, Staphylococcus
LSGDTSSSVDESAASSESAPAETSSAQSAPVSAEGEFPETREKIP

SEQ ID NO: 1964476 - protein, 10 aa, Staphylococcus
LSGDTTFSSI

SEQ ID NO: 1964477 - protein, 4 aa, Staphylococcus
LSGE

SEQ ID NO: 1964478 - protein, 7 aa, Staphylococcus
LSGEDET

SEQ ID NO: 1964479 - protein, 7 aa, Staphylococcus
LSGENEA

SEQ ID NO: 1964480 - protein, 5 aa, Staphylococcus
LSGET

SEQ ID NO: 1964481 - protein, 12 aa, Staphylococcus
LSGEVQVEGAKN

SEQ ID NO: 1964482 - protein, 12 aa, Staphylococcus
LSGFAKKTEQNI

SEQ ID NO: 1964483 - protein, 8 aa, Staphylococcus
LSGGEAQR

SEQ ID NO: 1964484 - protein, 8 aa, Staphylococcus
LSGGEQKR

SEQ ID NO: 1964485 - protein, 19 aa, Staphylococcus
LSGGGEARLHGQSSIGVGG

SEQ ID NO: 1964486 - protein, 18 aa, Staphylococcus
LSGGGEERLHGQSSIGVG

SEQ ID NO: 1964487 - protein, 19 aa, Staphylococcus
LSGGGEQRLHGQSSIGVGG

SEQ ID NO: 1964488 - protein, 18 aa, Staphylococcus
LSGGGESRLHGQSSIGVG

SEQ ID NO: 1964489 - protein, 7 aa, Staphylococcus
LSGGGGV

SEQ ID NO: 1964490 - protein, 8 aa, Staphylococcus
LSGGNQQK

SEQ ID NO: 1964491 - protein, 5 aa, Staphylococcus
LSGGQ

SEQ ID NO: 1964492 - protein, 8 aa, Staphylococcus
LSGGQQKR

SEQ ID NO: 1964493 - protein, 9 aa, Staphylococcus
LSGGQQQRV

SEQ ID NO: 1964494 - protein, 7 aa, Staphylococcus
LSGGQQR

SEQ ID NO: 1964495 - protein, 8 aa, Staphylococcus
LSGGQRQR

SEQ ID NO: 1964496 - protein, 5 aa, Staphylococcus
LSGGV

SEQ ID NO: 1964497 - protein, 9 aa, Staphylococcus
LSGHAAPRE

SEQ ID NO: 1964498 - protein, 4 aa, Staphylococcus
LSGK

SEQ ID NO: 1964499 - protein, 10 aa, Staphylococcus
LSGKNSKKLT

SEQ ID NO: 1964500 - protein, 13 aa, Staphylococcus
LSGKTRDEVRETM

SEQ ID NO: 1964501 - protein, 6 aa, Staphylococcus
LSGMEG

SEQ ID NO: 1964502 - protein, 8 aa, Staphylococcus
LSGNKKDE

SEQ ID NO: 1964503 - protein, 11 aa, Staphylococcus
LSGNPTSPSIP

SEQ ID NO: 1964504 - protein, 13 aa, Staphylococcus
LSGPAKERIENSA

SEQ ID NO: 1964505 - protein, 10 aa, Staphylococcus
LSGPSNYNSM

SEQ ID NO: 1964506 - protein, 7 aa, Staphylococcus
LSGQKGA

SEQ ID NO: 1964507 - protein, 8 aa, Staphylococcus
LSGQSFED

SEQ ID NO: 1964508 - protein, 10 aa, Staphylococcus
LSGQSRDEVR

SEQ ID NO: 1964509 - protein, 10 aa, Staphylococcus
LSGRNYLPEK

SEQ ID NO: 1964510 - protein, 11 aa, Staphylococcus
LSGRSNVGKSS

SEQ ID NO: 1964511 - protein, 4 aa, Staphylococcus
LSGS

SEQ ID NO: 1964512 - protein, 10 aa, Staphylococcus
LSGSDANDGV

SEQ ID NO: 1964513 - protein, 27 aa, Staphylococcus
LSGTGKELEKRPYAPGQHGPNQRKKLS

SEQ ID NO: 1964514 - protein, 28 aa, Staphylococcus
LSGTGKELEKRPYAPGQHGPNQRKKLSE

SEQ ID NO: 1964515 - protein, 8 aa, Staphylococcus
LSGTITPQ

SEQ ID NO: 1964516 - protein, 5 aa, Staphylococcus
LSGTV

SEQ ID NO: 1964517 - protein, 5 aa, Staphylococcus
LSGTY

SEQ ID NO: 1964518 - protein, 6 aa, Staphylococcus
LSGYAK

SEQ ID NO: 1964519 - protein, 4 aa, Staphylococcus
LSHN

SEQ ID NO: 1964520 - protein, 14 aa, Staphylococcus
LSHPKTKKDEELKD

SEQ ID NO: 1964521 - protein, 6 aa, Staphylococcus
LSHQSI

SEQ ID NO: 1964522 - protein, 14 aa, Staphylococcus
LSIETGQMAKQANG

SEQ ID NO: 1964523 - protein, 11 aa, Staphylococcus
LSISDDKLNRW

SEQ ID NO: 1964524 - protein, 4 aa, Staphylococcus
LSKA

SEQ ID NO: 1964525 - protein, 9 aa, Staphylococcus
LSKAESRIQ

SEQ ID NO: 1964526 - protein, 7 aa, Staphylococcus
LSKAGTE

SEQ ID NO: 1964527 - protein, 8 aa, Staphylococcus
LSKANQDE

SEQ ID NO: 1964528 - protein, 6 aa, Staphylococcus
LSKAQD

SEQ ID NO: 1964529 - protein, 6 aa, Staphylococcus
LSKDAY

SEQ ID NO: 1964530 - protein, 7 aa, Staphylococcus
LSKDPSI

SEQ ID NO: 1964531 - protein, 10 aa, Staphylococcus
LSKDRNDDDF

SEQ ID NO: 1964532 - protein, 7 aa, Staphylococcus
LSKDTTN

SEQ ID NO: 1964533 - protein, 10 aa, Staphylococcus
LSKEADKAGI

SEQ ID NO: 1964534 - protein, 10 aa, Staphylococcus
LSKEADQNDF

SEQ ID NO: 1964535 - protein, 10 aa, Staphylococcus
LSKEANDQGF

SEQ ID NO: 1964536 - protein, 9 aa, Staphylococcus
LSKEDRNYA

SEQ ID NO: 1964537 - protein, 14 aa, Staphylococcus
LSKEEIAENINRDN

SEQ ID NO: 1964538 - protein, 22 aa, Staphylococcus
LSKEGKASTTQTQQQLHQKQSD

SEQ ID NO: 1964539 - protein, 23 aa, Staphylococcus
LSKEGKENVSQVEKELNQKRSDV

SEQ ID NO: 1964540 - protein, 14 aa, Staphylococcus
LSKEGKESSAQLQQ

SEQ ID NO: 1964541 - protein, 10 aa, Staphylococcus
LSKEKVGTFD

SEQ ID NO: 1964542 - protein, 8 aa, Staphylococcus
LSKENELQ

SEQ ID NO: 1964543 - protein, 9 aa, Staphylococcus
LSKERRRVA

SEQ ID NO: 1964544 - protein, 10 aa, Staphylococcus
LSKERRTVAR

SEQ ID NO: 1964545 - protein, 16 aa, Staphylococcus
LSKGDRDGEAVAKRME

SEQ ID NO: 1964546 - protein, 9 aa, Staphylococcus
LSKGDREAV

SEQ ID NO: 1964547 - protein, 9 aa, Staphylococcus
LSKGERYDE

SEQ ID NO: 1964548 - protein, 7 aa, Staphylococcus
LSKGNQH

SEQ ID NO: 1964549 - protein, 7 aa, Staphylococcus
LSKGNVH

SEQ ID NO: 1964550 - protein, 5 aa, Staphylococcus
LSKIA

SEQ ID NO: 1964551 - protein, 12 aa, Staphylococcus
LSKITDLTDRST

SEQ ID NO: 1964552 - protein, 10 aa, Staphylococcus
LSKKADKAGF

SEQ ID NO: 1964553 - protein, 11 aa, Staphylococcus
LSKKDIDQKVT

SEQ ID NO: 1964554 - protein, 21 aa, Staphylococcus
LSKKKKEEGLTKEEAKERAEL

SEQ ID NO: 1964555 - protein, 11 aa, Staphylococcus
LSKKKQKQIAE

SEQ ID NO: 1964556 - protein, 12 aa, Staphylococcus
LSKKQRQDKIGY

SEQ ID NO: 1964557 - protein, 18 aa, Staphylococcus
LSKKSETNRITGISSKPP

SEQ ID NO: 1964558 - protein, 18 aa, Staphylococcus
LSKKTIETNLKKESSKGI

SEQ ID NO: 1964559 - protein, 8 aa, Staphylococcus
LSKNAKGI

SEQ ID NO: 1964560 - protein, 11 aa, Staphylococcus
LSKNTKKGKYT

SEQ ID NO: 1964561 - protein, 10 aa, Staphylococcus
LSKNTNDTVQ

SEQ ID NO: 1964562 - protein, 7 aa, Staphylococcus
LSKPTQN

SEQ ID NO: 1964563 - protein, 10 aa, Staphylococcus
LSKQAEASGL

SEQ ID NO: 1964564 - protein, 9 aa, Staphylococcus
LSKQANAEK

SEQ ID NO: 1964565 - protein, 6 aa, Staphylococcus
LSKQAV

SEQ ID NO: 1964566 - protein, 12 aa, Staphylococcus
LSKQLEQQENDN

SEQ ID NO: 1964567 - protein, 16 aa, Staphylococcus
LSKQRSLRDPVRSETD

SEQ ID NO: 1964568 - protein, 9 aa, Staphylococcus
LSKQSETSI

SEQ ID NO: 1964569 - protein, 16 aa, Staphylococcus
LSKQTSLRDSVQSEND

SEQ ID NO: 1964570 - protein, 7 aa, Staphylococcus
LSKRAAP

SEQ ID NO: 1964571 - protein, 11 aa, Staphylococcus
LSKSASKNIED

SEQ ID NO: 1964572 - protein, 7 aa, Staphylococcus
LSKSDEY

SEQ ID NO: 1964573 - protein, 8 aa, Staphylococcus
LSKSEIDE

SEQ ID NO: 1964574 - protein, 9 aa, Staphylococcus
LSKSNPEIA

SEQ ID NO: 1964575 - protein, 8 aa, Staphylococcus
LSKSPEDY

SEQ ID NO: 1964576 - protein, 8 aa, Staphylococcus
LSKSRETF

SEQ ID NO: 1964577 - protein, 5 aa, Staphylococcus
LSKTH

SEQ ID NO: 1964578 - protein, 11 aa, Staphylococcus
LSKVRSKEDER

SEQ ID NO: 1964579 - protein, 11 aa, Staphylococcus
LSKVRSTEDER

SEQ ID NO: 1964580 - protein, 4 aa, Staphylococcus
LSLD

SEQ ID NO: 1964581 - protein, 11 aa, Staphylococcus
LSLSSQITSHQ

SEQ ID NO: 1964582 - protein, 8 aa, Staphylococcus
LSNAQEDE

SEQ ID NO: 1964583 - protein, 6 aa, Staphylococcus
LSNATL

SEQ ID NO: 1964584 - protein, 9 aa, Staphylococcus
LSNDEDSIE

SEQ ID NO: 1964585 - protein, 10 aa, Staphylococcus
LSNDEFETTK

SEQ ID NO: 1964586 - protein, 39 aa, Staphylococcus
LSNDEKPNFQPSPKQVKADLNEGQDGIKGYYSGGTLASE

SEQ ID NO: 1964587 - protein, 5 aa, Staphylococcus
LSNDQ

SEQ ID NO: 1964588 - protein, 10 aa, Staphylococcus
LSNDRNDDRF

SEQ ID NO: 1964589 - protein, 10 aa, Staphylococcus
LSNEADKAGF

SEQ ID NO: 1964590 - protein, 7 aa, Staphylococcus
LSNEDGQ

SEQ ID NO: 1964591 - protein, 10 aa, Staphylococcus
LSNEDKETLK

SEQ ID NO: 1964592 - protein, 8 aa, Staphylococcus
LSNEEKDE

SEQ ID NO: 1964593 - protein, 6 aa, Staphylococcus
LSNEES

SEQ ID NO: 1964594 - protein, 7 aa, Staphylococcus
LSNEKGT

SEQ ID NO: 1964595 - protein, 6 aa, Staphylococcus
LSNEKY

SEQ ID NO: 1964596 - protein, 7 aa, Staphylococcus
LSNENDV

SEQ ID NO: 1964597 - protein, 6 aa, Staphylococcus
LSNEQQ

SEQ ID NO: 1964598 - protein, 5 aa, Staphylococcus
LSNGG

SEQ ID NO: 1964599 - protein, 7 aa, Staphylococcus
LSNGHTQ

SEQ ID NO: 1964600 - protein, 5 aa, Staphylococcus
LSNGK

SEQ ID NO: 1964601 - protein, 6 aa, Staphylococcus
LSNGSI

SEQ ID NO: 1964602 - protein, 9 aa, Staphylococcus
LSNKDITDE

SEQ ID NO: 1964603 - protein, 11 aa, Staphylococcus
LSNKEREAAQN

SEQ ID NO: 1964604 - protein, 11 aa, Staphylococcus
LSNKEREQAQN

SEQ ID NO: 1964605 - protein, 9 aa, Staphylococcus
LSNKERKLY

SEQ ID NO: 1964606 - protein, 11 aa, Staphylococcus
LSNKPSSSSKQ

SEQ ID NO: 1964607 - protein, 8 aa, Staphylococcus
LSNKQNQR

SEQ ID NO: 1964608 - protein, 6 aa, Staphylococcus
LSNKSG

SEQ ID NO: 1964609 - protein, 5 aa, Staphylococcus
LSNME

SEQ ID NO: 1964610 - protein, 4 aa, Staphylococcus
LSNN

SEQ ID NO: 1964611 - protein, 22 aa, Staphylococcus
LSNNDSTSNKTITFSKNETYRV

SEQ ID NO: 1964612 - protein, 8 aa, Staphylococcus
LSNNENFK

SEQ ID NO: 1964613 - protein, 9 aa, Staphylococcus
LSNNGGNAR

SEQ ID NO: 1964614 - protein, 15 aa, Staphylococcus
LSNPEITEKLQQQDQ

SEQ ID NO: 1964615 - protein, 20 aa, Staphylococcus
LSNQEADKYGLSGEDTNQFN

SEQ ID NO: 1964616 - protein, 13 aa, Staphylococcus
LSNQKSEDYENEE

SEQ ID NO: 1964617 - protein, 4 aa, Staphylococcus
LSNR

SEQ ID NO: 1964618 - protein, 15 aa, Staphylococcus
LSNTFEKQDGYQYES

SEQ ID NO: 1964619 - protein, 6 aa, Staphylococcus
LSNTGH

SEQ ID NO: 1964620 - protein, 10 aa, Staphylococcus
LSNTQKEQFQ

SEQ ID NO: 1964621 - protein, 6 aa, Staphylococcus
LSNTTI

SEQ ID NO: 1964622 - protein, 6 aa, Staphylococcus
LSPDKD

SEQ ID NO: 1964623 - protein, 6 aa, Staphylococcus
LSPDKE

SEQ ID NO: 1964624 - protein, 9 aa, Staphylococcus
LSPDSPKED

SEQ ID NO: 1964625 - protein, 4 aa, Staphylococcus
LSPE

SEQ ID NO: 1964626 - protein, 5 aa, Staphylococcus
LSPED

SEQ ID NO: 1964627 - protein, 61 aa, Staphylococcus
LSPEDPDDTSTNTNDNETASNDSSNKDKASSSSDDKEKDNKNDTSSSSEQEQQTNNSQDSN

SEQ ID NO: 1964628 - protein, 12 aa, Staphylococcus
LSPEDQKASGVV

SEQ ID NO: 1964629 - protein, 5 aa, Staphylococcus
LSPEE

SEQ ID NO: 1964630 - protein, 6 aa, Staphylococcus
LSPEGD

SEQ ID NO: 1964631 - protein, 7 aa, Staphylococcus
LSPEKNH

SEQ ID NO: 1964632 - protein, 9 aa, Staphylococcus
LSPESKPYL

SEQ ID NO: 1964633 - protein, 20 aa, Staphylococcus
LSPESLRNNIKQDLQEILDY

SEQ ID NO: 1964634 - protein, 5 aa, Staphylococcus
LSPET

SEQ ID NO: 1964635 - protein, 6 aa, Staphylococcus
LSPGDF

SEQ ID NO: 1964636 - protein, 6 aa, Staphylococcus
LSPGKG

SEQ ID NO: 1964637 - protein, 7 aa, Staphylococcus
LSPGKKS

SEQ ID NO: 1964638 - protein, 6 aa, Staphylococcus
LSPGKM

SEQ ID NO: 1964639 - protein, 13 aa, Staphylococcus
LSPIGNDAHTSWN

SEQ ID NO: 1964640 - protein, 11 aa, Staphylococcus
LSPKDAELKSD

SEQ ID NO: 1964641 - protein, 5 aa, Staphylococcus
LSPKE

SEQ ID NO: 1964642 - protein, 9 aa, Staphylococcus
LSPKKNTQL

SEQ ID NO: 1964643 - protein, 7 aa, Staphylococcus
LSPKPQH

SEQ ID NO: 1964644 - protein, 8 aa, Staphylococcus
LSPKREDN

SEQ ID NO: 1964645 - protein, 11 aa, Staphylococcus
LSPKSNSAIKA

SEQ ID NO: 1964646 - protein, 11 aa, Staphylococcus
LSPKSNSAITA

SEQ ID NO: 1964647 - protein, 13 aa, Staphylococcus
LSPLEYRKQYSSV

SEQ ID NO: 1964648 - protein, 10 aa, Staphylococcus
LSPLGDSKPD

SEQ ID NO: 1964649 - protein, 14 aa, Staphylococcus
LSPLGNDAKTSWEN

SEQ ID NO: 1964650 - protein, 13 aa, Staphylococcus
LSPLQSSQLQGSA

SEQ ID NO: 1964651 - protein, 8 aa, Staphylococcus
LSPNDPFT

SEQ ID NO: 1964652 - protein, 5 aa, Staphylococcus
LSPNE

SEQ ID NO: 1964653 - protein, 11 aa, Staphylococcus
LSPNSEHLKND

SEQ ID NO: 1964654 - protein, 9 aa, Staphylococcus
LSPPNNPDH

SEQ ID NO: 1964655 - protein, 4 aa, Staphylococcus
LSPQ

SEQ ID NO: 1964656 - protein, 5 aa, Staphylococcus
LSPQD

SEQ ID NO: 1964657 - protein, 6 aa, Staphylococcus
LSPQSV

SEQ ID NO: 1964658 - protein, 15 aa, Staphylococcus
LSPQYDNSYSQVKES

SEQ ID NO: 1964659 - protein, 10 aa, Staphylococcus
LSPRERKQQM

SEQ ID NO: 1964660 - protein, 12 aa, Staphylococcus
LSPRTAAAANEL

SEQ ID NO: 1964661 - protein, 4 aa, Staphylococcus
LSPS

SEQ ID NO: 1964662 - protein, 18 aa, Staphylococcus
LSPSEAKKYGLADEDTSQ

SEQ ID NO: 1964663 - protein, 16 aa, Staphylococcus
LSPSEANKYGLNTDDT

SEQ ID NO: 1964664 - protein, 7 aa, Staphylococcus
LSPSGTG

SEQ ID NO: 1964665 - protein, 5 aa, Staphylococcus
LSPSI

SEQ ID NO: 1964666 - protein, 6 aa, Staphylococcus
LSPSLR

SEQ ID NO: 1964667 - protein, 8 aa, Staphylococcus
LSPSSGDV

SEQ ID NO: 1964668 - protein, 14 aa, Staphylococcus
LSPSVSYGQKGTKL

SEQ ID NO: 1964669 - protein, 5 aa, Staphylococcus
LSPTF

SEQ ID NO: 1964670 - protein, 6 aa, Staphylococcus
LSPTFD

SEQ ID NO: 1964671 - protein, 7 aa, Staphylococcus
LSPTIKD

SEQ ID NO: 1964672 - protein, 5 aa, Staphylococcus
LSPTL

SEQ ID NO: 1964673 - protein, 7 aa, Staphylococcus
LSPTSDV

SEQ ID NO: 1964674 - protein, 7 aa, Staphylococcus
LSPTSGK

SEQ ID NO: 1964675 - protein, 4 aa, Staphylococcus
LSPY

SEQ ID NO: 1964676 - protein, 8 aa, Staphylococcus
LSQANEDE

SEQ ID NO: 1964677 - protein, 9 aa, Staphylococcus
LSQDELDKV

SEQ ID NO: 1964678 - protein, 12 aa, Staphylococcus
LSQEDSSQGHGH

SEQ ID NO: 1964679 - protein, 13 aa, Staphylococcus
LSQEDSSQGHGQM

SEQ ID NO: 1964680 - protein, 13 aa, Staphylococcus
LSQEEKNNDITRQ

SEQ ID NO: 1964681 - protein, 6 aa, Staphylococcus
LSQEEQ

SEQ ID NO: 1964682 - protein, 4 aa, Staphylococcus
LSQG

SEQ ID NO: 1964683 - protein, 10 aa, Staphylococcus
LSQGSTGNAY

SEQ ID NO: 1964684 - protein, 16 aa, Staphylococcus
LSQITASSLTGELGKN

SEQ ID NO: 1964685 - protein, 18 aa, Staphylococcus
LSQKDKEILETYKKQLKN

SEQ ID NO: 1964686 - protein, 7 aa, Staphylococcus
LSQKEID

SEQ ID NO: 1964687 - protein, 10 aa, Staphylococcus
LSQKKEPQIY

SEQ ID NO: 1964688 - protein, 6 aa, Staphylococcus
LSQKST

SEQ ID NO: 1964689 - protein, 6 aa, Staphylococcus
LSQKTA

SEQ ID NO: 1964690 - protein, 11 aa, Staphylococcus
LSQKYPENTLE

SEQ ID NO: 1964691 - protein, 4 aa, Staphylococcus
LSQN

SEQ ID NO: 1964692 - protein, 7 aa, Staphylococcus
LSQNLKE

SEQ ID NO: 1964693 - protein, 6 aa, Staphylococcus
LSQNNK

SEQ ID NO: 1964694 - protein, 4 aa, Staphylococcus
LSQP

SEQ ID NO: 1964695 - protein, 8 aa, Staphylococcus
LSQPEDVS

SEQ ID NO: 1964696 - protein, 9 aa, Staphylococcus
LSQPNKKEL

SEQ ID NO: 1964697 - protein, 4 aa, Staphylococcus
LSQQ

SEQ ID NO: 1964698 - protein, 7 aa, Staphylococcus
LSQQAGL

SEQ ID NO: 1964699 - protein, 7 aa, Staphylococcus
LSQQGSH

SEQ ID NO: 1964700 - protein, 4 aa, Staphylococcus
LSQS

SEQ ID NO: 1964701 - protein, 5 aa, Staphylococcus
LSQSA

SEQ ID NO: 1964702 - protein, 5 aa, Staphylococcus
LSQSG

SEQ ID NO: 1964703 - protein, 11 aa, Staphylococcus
LSQSNANEQGY

SEQ ID NO: 1964704 - protein, 7 aa, Staphylococcus
LSQSNVS

SEQ ID NO: 1964705 - protein, 8 aa, Staphylococcus
LSQSSEVN

SEQ ID NO: 1964706 - protein, 4 aa, Staphylococcus
LSQT

SEQ ID NO: 1964707 - protein, 12 aa, Staphylococcus
LSQTNKDIAQPI

SEQ ID NO: 1964708 - protein, 6 aa, Staphylococcus
LSQTQA

SEQ ID NO: 1964709 - protein, 7 aa, Staphylococcus
LSQTTQN

SEQ ID NO: 1964710 - protein, 13 aa, Staphylococcus
LSQYEKRYTKKSH

SEQ ID NO: 1964711 - protein, 8 aa, Staphylococcus
LSQYEPGL

SEQ ID NO: 1964712 - protein, 14 aa, Staphylococcus
LSQYTAPKTDFNGV

SEQ ID NO: 1964713 - protein, 7 aa, Staphylococcus
LSRDGKY

SEQ ID NO: 1964714 - protein, 5 aa, Staphylococcus
LSRED

SEQ ID NO: 1964715 - protein, 12 aa, Staphylococcus
LSRGEAKRKANE

SEQ ID NO: 1964716 - protein, 13 aa, Staphylococcus
LSRKNKKRNRIDN

SEQ ID NO: 1964717 - protein, 12 aa, Staphylococcus
LSRKQKLALFKE

SEQ ID NO: 1964718 - protein, 11 aa, Staphylococcus
LSRKTDKLKTY

SEQ ID NO: 1964719 - protein, 7 aa, Staphylococcus
LSRKTHE

SEQ ID NO: 1964720 - protein, 8 aa, Staphylococcus
LSRNEENF

SEQ ID NO: 1964721 - protein, 7 aa, Staphylococcus
LSRNHTE

SEQ ID NO: 1964722 - protein, 5 aa, Staphylococcus
LSRQN

SEQ ID NO: 1964723 - protein, 7 aa, Staphylococcus
LSRREQS

SEQ ID NO: 1964724 - protein, 18 aa, Staphylococcus
LSRSATPSQARTFKTPSN

SEQ ID NO: 1964725 - protein, 5 aa, Staphylococcus
LSRSD

SEQ ID NO: 1964726 - protein, 5 aa, Staphylococcus
LSRSK

SEQ ID NO: 1964727 - protein, 6 aa, Staphylococcus
LSRSKV

SEQ ID NO: 1964728 - protein, 19 aa, Staphylococcus
LSRSNLARAGESVKSYGNH

SEQ ID NO: 1964729 - protein, 5 aa, Staphylococcus
LSRSQ

SEQ ID NO: 1964730 - protein, 7 aa, Staphylococcus
LSSADSF

SEQ ID NO: 1964731 - protein, 10 aa, Staphylococcus
LSSAKQVDSE

SEQ ID NO: 1964732 - protein, 7 aa, Staphylococcus
LSSDEHW

SEQ ID NO: 1964733 - protein, 15 aa, Staphylococcus
LSSDGSLSEAGGPQY

SEQ ID NO: 1964734 - protein, 10 aa, Staphylococcus
LSSDNKNYQR

SEQ ID NO: 1964735 - protein, 10 aa, Staphylococcus
LSSDRNDDNF

SEQ ID NO: 1964736 - protein, 10 aa, Staphylococcus
LSSDRNDDQF

SEQ ID NO: 1964737 - protein, 10 aa, Staphylococcus
LSSDTSTGEA

SEQ ID NO: 1964738 - protein, 10 aa, Staphylococcus
LSSEPTYHRS

SEQ ID NO: 1964739 - protein, 13 aa, Staphylococcus
LSSETDKEAHTQT

SEQ ID NO: 1964740 - protein, 7 aa, Staphylococcus
LSSGDTF

SEQ ID NO: 1964741 - protein, 9 aa, Staphylococcus
LSSKDFKSP

SEQ ID NO: 1964742 - protein, 8 aa, Staphylococcus
LSSKDIEK

SEQ ID NO: 1964743 - protein, 10 aa, Staphylococcus
LSSKQNGDQV

SEQ ID NO: 1964744 - protein, 6 aa, Staphylococcus
LSSNEF

SEQ ID NO: 1964745 - protein, 6 aa, Staphylococcus
LSSNQI

SEQ ID NO: 1964746 - protein, 7 aa, Staphylococcus
LSSNTLT

SEQ ID NO: 1964747 - protein, 8 aa, Staphylococcus
LSSPNNTL

SEQ ID NO: 1964748 - protein, 13 aa, Staphylococcus
LSSQEQNSTPFTP

SEQ ID NO: 1964749 - protein, 4 aa, Staphylococcus
LSSR

SEQ ID NO: 1964750 - protein, 6 aa, Staphylococcus
LSSSDY

SEQ ID NO: 1964751 - protein, 6 aa, Staphylococcus
LSSSTL

SEQ ID NO: 1964752 - protein, 11 aa, Staphylococcus
LSSSYLNEDHE

SEQ ID NO: 1964753 - protein, 4 aa, Staphylococcus
LSST

SEQ ID NO: 1964754 - protein, 5 aa, Staphylococcus
LSSTL

SEQ ID NO: 1964755 - protein, 11 aa, Staphylococcus
LSSTSPEIGTV

SEQ ID NO: 1964756 - protein, 24 aa, Staphylococcus
LSSTSPEIGTVKEEVNATNVEGGN

SEQ ID NO: 1964757 - protein, 7 aa, Staphylococcus
LSSTTGV

SEQ ID NO: 1964758 - protein, 13 aa, Staphylococcus
LSSYEAPRDTWLY

SEQ ID NO: 1964759 - protein, 4 aa, Staphylococcus
LSTD

SEQ ID NO: 1964760 - protein, 7 aa, Staphylococcus
LSTDELK

SEQ ID NO: 1964761 - protein, 7 aa, Staphylococcus
LSTDGDT

SEQ ID NO: 1964762 - protein, 8 aa, Staphylococcus
LSTDNKNI

SEQ ID NO: 1964763 - protein, 10 aa, Staphylococcus
LSTDPRTGKP

SEQ ID NO: 1964764 - protein, 9 aa, Staphylococcus
LSTEDKDDV

SEQ ID NO: 1964765 - protein, 7 aa, Staphylococcus
LSTEPNM

SEQ ID NO: 1964766 - protein, 7 aa, Staphylococcus
LSTERQP

SEQ ID NO: 1964767 - protein, 8 aa, Staphylococcus
LSTESEII

SEQ ID NO: 1964768 - protein, 7 aa, Staphylococcus
LSTESQY

SEQ ID NO: 1964769 - protein, 5 aa, Staphylococcus
LSTET

SEQ ID NO: 1964770 - protein, 9 aa, Staphylococcus
LSTFEKARD

SEQ ID NO: 1964771 - protein, 9 aa, Staphylococcus
LSTGESTFA

SEQ ID NO: 1964772 - protein, 10 aa, Staphylococcus
LSTGGSVEEA

SEQ ID NO: 1964773 - protein, 12 aa, Staphylococcus
LSTHKKDHHSRR

SEQ ID NO: 1964774 - protein, 7 aa, Staphylococcus
LSTHSQS

SEQ ID NO: 1964775 - protein, 5 aa, Staphylococcus
LSTHT

SEQ ID NO: 1964776 - protein, 7 aa, Staphylococcus
LSTHTSN

SEQ ID NO: 1964777 - protein, 4 aa, Staphylococcus
LSTI

SEQ ID NO: 1964778 - protein, 5 aa, Staphylococcus
LSTKP

SEQ ID NO: 1964779 - protein, 8 aa, Staphylococcus
LSTNDELV

SEQ ID NO: 1964780 - protein, 15 aa, Staphylococcus
LSTNLDNVQADKPFT

SEQ ID NO: 1964781 - protein, 14 aa, Staphylococcus
LSTNLKEKREIGRK

SEQ ID NO: 1964782 - protein, 12 aa, Staphylococcus
LSTNPDVSIPKE

SEQ ID NO: 1964783 - protein, 6 aa, Staphylococcus
LSTPER

SEQ ID NO: 1964784 - protein, 16 aa, Staphylococcus
LSTPKNSTVKEKEKFE

SEQ ID NO: 1964785 - protein, 13 aa, Staphylococcus
LSTPVTEATMGKK

SEQ ID NO: 1964786 - protein, 5 aa, Staphylococcus
LSTQD

SEQ ID NO: 1964787 - protein, 6 aa, Staphylococcus
LSTQPD

SEQ ID NO: 1964788 - protein, 7 aa, Staphylococcus
LSTQPDL

SEQ ID NO: 1964789 - protein, 8 aa, Staphylococcus
LSTQPPTF

SEQ ID NO: 1964790 - protein, 5 aa, Staphylococcus
LSTQQ

SEQ ID NO: 1964791 - protein, 5 aa, Staphylococcus
LSTRP

SEQ ID NO: 1964792 - protein, 7 aa, Staphylococcus
LSTRPDD

SEQ ID NO: 1964793 - protein, 9 aa, Staphylococcus
LSTRQKEYI

SEQ ID NO: 1964794 - protein, 9 aa, Staphylococcus
LSTSKEDNF

SEQ ID NO: 1964795 - protein, 8 aa, Staphylococcus
LSTSQGVE

SEQ ID NO: 1964796 - protein, 11 aa, Staphylococcus
LSTTATSESLN

SEQ ID NO: 1964797 - protein, 8 aa, Staphylococcus
LSTTPELT

SEQ ID NO: 1964798 - protein, 49 aa, Staphylococcus
LSTVSGKGNDVVRKDDVENSQKAAQSQSSQETSKKEEPKKSSGAPNKPV

SEQ ID NO: 1964799 - protein, 7 aa, Staphylococcus
LSTYPDD

SEQ ID NO: 1964800 - protein, 12 aa, Staphylococcus
LSVDDAKDQLNH

SEQ ID NO: 1964801 - protein, 4 aa, Staphylococcus
LSVE

SEQ ID NO: 1964802 - protein, 11 aa, Staphylococcus
LSVSEGTAYRA

SEQ ID NO: 1964803 - protein, 4 aa, Staphylococcus
LSVT

SEQ ID NO: 1964804 - protein, 4 aa, Staphylococcus
LSYE

SEQ ID NO: 1964805 - protein, 6 aa, Staphylococcus
LSYEEA

SEQ ID NO: 1964806 - protein, 18 aa, Staphylococcus
LSYENNKVTVEAQGRATK

SEQ ID NO: 1964807 - protein, 4 aa, Staphylococcus
LSYN

SEQ ID NO: 1964808 - protein, 6 aa, Staphylococcus
LSYTES

SEQ ID NO: 1964809 - protein, 4 aa, Staphylococcus
LTAA

SEQ ID NO: 1964810 - protein, 5 aa, Staphylococcus
LTAAS

SEQ ID NO: 1964811 - protein, 5 aa, Staphylococcus
LTADA

SEQ ID NO: 1964812 - protein, 10 aa, Staphylococcus
LTAEEKSKHI

SEQ ID NO: 1964813 - protein, 17 aa, Staphylococcus
LTAEEQAAFEAEGRQPS

SEQ ID NO: 1964814 - protein, 12 aa, Staphylococcus
LTAETKNKFNAE

SEQ ID NO: 1964815 - protein, 4 aa, Staphylococcus
LTAG

SEQ ID NO: 1964816 - protein, 5 aa, Staphylococcus
LTAKN

SEQ ID NO: 1964817 - protein, 8 aa, Staphylococcus
LTAKTKGM

SEQ ID NO: 1964818 - protein, 17 aa, Staphylococcus
LTANGKLDRKQIAEDIQ

SEQ ID NO: 1964819 - protein, 11 aa, Staphylococcus
LTANNEKSNQY

SEQ ID NO: 1964820 - protein, 7 aa, Staphylococcus
LTANQDA

SEQ ID NO: 1964821 - protein, 5 aa, Staphylococcus
LTAPF

SEQ ID NO: 1964822 - protein, 5 aa, Staphylococcus
LTAPG

SEQ ID NO: 1964823 - protein, 6 aa, Staphylococcus
LTAPGF

SEQ ID NO: 1964824 - protein, 4 aa, Staphylococcus
LTAQ

SEQ ID NO: 1964825 - protein, 5 aa, Staphylococcus
LTAQD

SEQ ID NO: 1964826 - protein, 16 aa, Staphylococcus
LTAQGKSIQHTAREQR

SEQ ID NO: 1964827 - protein, 5 aa, Staphylococcus
LTARE

SEQ ID NO: 1964828 - protein, 8 aa, Staphylococcus
LTASAGVS

SEQ ID NO: 1964829 - protein, 5 aa, Staphylococcus
LTASM

SEQ ID NO: 1964830 - protein, 11 aa, Staphylococcus
LTASSEKGAYV

SEQ ID NO: 1964831 - protein, 6 aa, Staphylococcus
LTASTP

SEQ ID NO: 1964832 - protein, 5 aa, Staphylococcus
LTATP

SEQ ID NO: 1964833 - protein, 13 aa, Staphylococcus
LTATSRKGGPGWV

SEQ ID NO: 1964834 - protein, 10 aa, Staphylococcus
LTCGHPGQAI

SEQ ID NO: 1964835 - protein, 11 aa, Staphylococcus
LTDAPRKVSAE

SEQ ID NO: 1964836 - protein, 10 aa, Staphylococcus
LTDAQHDEKL

SEQ ID NO: 1964837 - protein, 41 aa, Staphylococcus
LTDAREAVGKSLDSIEKSGIKYEHQAKDYDDYYEIKIKLFK

SEQ ID NO: 1964838 - protein, 9 aa, Staphylococcus
LTDATNLER

SEQ ID NO: 1964839 - protein, 12 aa, Staphylococcus
LTDATRDKIADE

SEQ ID NO: 1964840 - protein, 11 aa, Staphylococcus
LTDATRDRIET

SEQ ID NO: 1964841 - protein, 9 aa, Staphylococcus
LTDATRDTI

SEQ ID NO: 1964842 - protein, 10 aa, Staphylococcus
LTDDAEKTKA

SEQ ID NO: 1964843 - protein, 15 aa, Staphylococcus
LTDDELNKIDELFPI

SEQ ID NO: 1964844 - protein, 7 aa, Staphylococcus
LTDDESY

SEQ ID NO: 1964845 - protein, 6 aa, Staphylococcus
LTDDQF

SEQ ID NO: 1964846 - protein, 9 aa, Staphylococcus
LTDDQVNVS

SEQ ID NO: 1964847 - protein, 6 aa, Staphylococcus
LTDDSQ

SEQ ID NO: 1964848 - protein, 4 aa, Staphylococcus
LTDE

SEQ ID NO: 1964849 - protein, 20 aa, Staphylococcus
LTDEEKEKVSYRNGAKLLGL

SEQ ID NO: 1964850 - protein, 7 aa, Staphylococcus
LTDEGQL

SEQ ID NO: 1964851 - protein, 6 aa, Staphylococcus
LTDEPI

SEQ ID NO: 1964852 - protein, 6 aa, Staphylococcus
LTDERR

SEQ ID NO: 1964853 - protein, 8 aa, Staphylococcus
LTDERRER

SEQ ID NO: 1964854 - protein, 6 aa, Staphylococcus
LTDESI

SEQ ID NO: 1964855 - protein, 19 aa, Staphylococcus
LTDESIDALQEKYKDSNYG

SEQ ID NO: 1964856 - protein, 22 aa, Staphylococcus
LTDESIQDIEQKYEGEGYGKLK

SEQ ID NO: 1964857 - protein, 7 aa, Staphylococcus
LTDETKY

SEQ ID NO: 1964858 - protein, 15 aa, Staphylococcus
LTDGKDAPKKMNEAY

SEQ ID NO: 1964859 - protein, 7 aa, Staphylococcus
LTDGQGV

SEQ ID NO: 1964860 - protein, 5 aa, Staphylococcus
LTDGT

SEQ ID NO: 1964861 - protein, 4 aa, Staphylococcus
LTDK

SEQ ID NO: 1964862 - protein, 18 aa, Staphylococcus
LTDKDKKIIQTYKNQLKN

SEQ ID NO: 1964863 - protein, 5 aa, Staphylococcus
LTDKE

SEQ ID NO: 1964864 - protein, 7 aa, Staphylococcus
LTDKGEK

SEQ ID NO: 1964865 - protein, 21 aa, Staphylococcus
LTDKSIKDLETQYENEGYGKF

SEQ ID NO: 1964866 - protein, 5 aa, Staphylococcus
LTDNE

SEQ ID NO: 1964867 - protein, 21 aa, Staphylococcus
LTDNEKAKGITCASAGNHAQG

SEQ ID NO: 1964868 - protein, 7 aa, Staphylococcus
LTDNPSC

SEQ ID NO: 1964869 - protein, 5 aa, Staphylococcus
LTDNT

SEQ ID NO: 1964870 - protein, 7 aa, Staphylococcus
LTDPHGN

SEQ ID NO: 1964871 - protein, 4 aa, Staphylococcus
LTDR

SEQ ID NO: 1964872 - protein, 7 aa, Staphylococcus
LTDREGY

SEQ ID NO: 1964873 - protein, 10 aa, Staphylococcus
LTDSATAGYS

SEQ ID NO: 1964874 - protein, 10 aa, Staphylococcus
LTDSATGGFS

SEQ ID NO: 1964875 - protein, 7 aa, Staphylococcus
LTDSKTT

SEQ ID NO: 1964876 - protein, 4 aa, Staphylococcus
LTDT

SEQ ID NO: 1964877 - protein, 7 aa, Staphylococcus
LTDTDEF

SEQ ID NO: 1964878 - protein, 7 aa, Staphylococcus
LTDTDTI

SEQ ID NO: 1964879 - protein, 5 aa, Staphylococcus
LTDTE

SEQ ID NO: 1964880 - protein, 7 aa, Staphylococcus
LTDTENK

SEQ ID NO: 1964881 - protein, 5 aa, Staphylococcus
LTDTF

SEQ ID NO: 1964882 - protein, 5 aa, Staphylococcus
LTDTY

SEQ ID NO: 1964883 - protein, 14 aa, Staphylococcus
LTEAGKTDNVKDTV

SEQ ID NO: 1964884 - protein, 5 aa, Staphylococcus
LTEAT

SEQ ID NO: 1964885 - protein, 6 aa, Staphylococcus
LTEAYP

SEQ ID NO: 1964886 - protein, 4 aa, Staphylococcus
LTED

SEQ ID NO: 1964887 - protein, 20 aa, Staphylococcus
LTEDDQGRLHGHGSADMKSG

SEQ ID NO: 1964888 - protein, 10 aa, Staphylococcus
LTEDEKNTFK

SEQ ID NO: 1964889 - protein, 9 aa, Staphylococcus
LTEDESNTI

SEQ ID NO: 1964890 - protein, 9 aa, Staphylococcus
LTEDKAQQL

SEQ ID NO: 1964891 - protein, 32 aa, Staphylococcus
LTEDKQVKDSAKAKSEAKPDVQAPQNSSEDQF

SEQ ID NO: 1964892 - protein, 7 aa, Staphylococcus
LTEDNGY

SEQ ID NO: 1964893 - protein, 20 aa, Staphylococcus
LTEDSEGHLHGRGASDMKSG

SEQ ID NO: 1964894 - protein, 9 aa, Staphylococcus
LTEDSTPQY

SEQ ID NO: 1964895 - protein, 9 aa, Staphylococcus
LTEEAASEK

SEQ ID NO: 1964896 - protein, 12 aa, Staphylococcus
LTEEALNKENIN

SEQ ID NO: 1964897 - protein, 19 aa, Staphylococcus
LTEEDGKMYGRGTTDMKGG

SEQ ID NO: 1964898 - protein, 15 aa, Staphylococcus
LTEEEIKKIDTLFPI

SEQ ID NO: 1964899 - protein, 20 aa, Staphylococcus
LTEEEKEKISYKNGAKLLGL

SEQ ID NO: 1964900 - protein, 11 aa, Staphylococcus
LTEEEKTRLNK

SEQ ID NO: 1964901 - protein, 17 aa, Staphylococcus
LTEEERQQFEAEGRRPS

SEQ ID NO: 1964902 - protein, 9 aa, Staphylococcus
LTEEGHQKA

SEQ ID NO: 1964903 - protein, 8 aa, Staphylococcus
LTEEKGLK

SEQ ID NO: 1964904 - protein, 13 aa, Staphylococcus
LTEEQKAEITPKL

SEQ ID NO: 1964905 - protein, 17 aa, Staphylococcus
LTEEQRQQFEAEGRQPS

SEQ ID NO: 1964906 - protein, 9 aa, Staphylococcus
LTEERREKI

SEQ ID NO: 1964907 - protein, 8 aa, Staphylococcus
LTEERRER

SEQ ID NO: 1964908 - protein, 19 aa, Staphylococcus
LTEERSERLEKTRKALEDY

SEQ ID NO: 1964909 - protein, 9 aa, Staphylococcus
LTEEYASKG

SEQ ID NO: 1964910 - protein, 12 aa, Staphylococcus
LTEGNLRKANEE

SEQ ID NO: 1964911 - protein, 16 aa, Staphylococcus
LTEGSVTYNGNKMGES

SEQ ID NO: 1964912 - protein, 24 aa, Staphylococcus
LTEKEFKKEKETNEHFRLEYAENY

SEQ ID NO: 1964913 - protein, 10 aa, Staphylococcus
LTEKGMQSAQ

SEQ ID NO: 1964914 - protein, 12 aa, Staphylococcus
LTEKGVESAKQL

SEQ ID NO: 1964915 - protein, 8 aa, Staphylococcus
LTEKQNRR

SEQ ID NO: 1964916 - protein, 12 aa, Staphylococcus
LTEKQTLEQAGT

SEQ ID NO: 1964917 - protein, 10 aa, Staphylococcus
LTEKQTLERA

SEQ ID NO: 1964918 - protein, 13 aa, Staphylococcus
LTEKQTLKDAGTQ

SEQ ID NO: 1964919 - protein, 14 aa, Staphylococcus
LTEKQTLQDSGSNI

SEQ ID NO: 1964920 - protein, 12 aa, Staphylococcus
LTEKQTLQKAGS

SEQ ID NO: 1964921 - protein, 8 aa, Staphylococcus
LTEKRSQL

SEQ ID NO: 1964922 - protein, 7 aa, Staphylococcus
LTELSDD

SEQ ID NO: 1964923 - protein, 4 aa, Staphylococcus
LTEM

SEQ ID NO: 1964924 - protein, 5 aa, Staphylococcus
LTENG

SEQ ID NO: 1964925 - protein, 17 aa, Staphylococcus
LTENGFESLETSEDVSN

SEQ ID NO: 1964926 - protein, 7 aa, Staphylococcus
LTENHEQ

SEQ ID NO: 1964927 - protein, 13 aa, Staphylococcus
LTENIGTKNEPEE

SEQ ID NO: 1964928 - protein, 14 aa, Staphylococcus
LTENSSDVEKQQIK

SEQ ID NO: 1964929 - protein, 5 aa, Staphylococcus
LTEPF

SEQ ID NO: 1964930 - protein, 14 aa, Staphylococcus
LTEPMPASINQTHD

SEQ ID NO: 1964931 - protein, 7 aa, Staphylococcus
LTEPPTS

SEQ ID NO: 1964932 - protein, 9 aa, Staphylococcus
LTEQEKREI

SEQ ID NO: 1964933 - protein, 7 aa, Staphylococcus
LTEQEMR

SEQ ID NO: 1964934 - protein, 10 aa, Staphylococcus
LTEQGTESAQ

SEQ ID NO: 1964935 - protein, 10 aa, Staphylococcus
LTEQRKNDYI

SEQ ID NO: 1964936 - protein, 10 aa, Staphylococcus
LTEQRTKDEV

SEQ ID NO: 1964937 - protein, 5 aa, Staphylococcus
LTEQT

SEQ ID NO: 1964938 - protein, 10 aa, Staphylococcus
LTEQTSSQLA

SEQ ID NO: 1964939 - protein, 7 aa, Staphylococcus
LTERGTW

SEQ ID NO: 1964940 - protein, 4 aa, Staphylococcus
LTES

SEQ ID NO: 1964941 - protein, 5 aa, Staphylococcus
LTESD

SEQ ID NO: 1964942 - protein, 7 aa, Staphylococcus
LTESPTS

SEQ ID NO: 1964943 - protein, 9 aa, Staphylococcus
LTETAEDRL

SEQ ID NO: 1964944 - protein, 9 aa, Staphylococcus
LTETAEERL

SEQ ID NO: 1964945 - protein, 7 aa, Staphylococcus
LTETDEV

SEQ ID NO: 1964946 - protein, 7 aa, Staphylococcus
LTETEAY

SEQ ID NO: 1964947 - protein, 6 aa, Staphylococcus
LTETEL

SEQ ID NO: 1964948 - protein, 7 aa, Staphylococcus
LTETGKK

SEQ ID NO: 1964949 - protein, 5 aa, Staphylococcus
LTETL

SEQ ID NO: 1964950 - protein, 6 aa, Staphylococcus
LTETRL

SEQ ID NO: 1964951 - protein, 12 aa, Staphylococcus
LTEYDEKQGYPI

SEQ ID NO: 1964952 - protein, 4 aa, Staphylococcus
LTFD

SEQ ID NO: 1964953 - protein, 5 aa, Staphylococcus
LTFGE

SEQ ID NO: 1964954 - protein, 11 aa, Staphylococcus
LTFNETSRTSR

SEQ ID NO: 1964955 - protein, 4 aa, Staphylococcus
LTGA

SEQ ID NO: 1964956 - protein, 7 aa, Staphylococcus
LTGAAPA

SEQ ID NO: 1964957 - protein, 7 aa, Staphylococcus
LTGAEPG

SEQ ID NO: 1964958 - protein, 8 aa, Staphylococcus
LTGAKPGD

SEQ ID NO: 1964959 - protein, 10 aa, Staphylococcus
LTGDSTVDSG

SEQ ID NO: 1964960 - protein, 7 aa, Staphylococcus
LTGEDEY

SEQ ID NO: 1964961 - protein, 8 aa, Staphylococcus
LTGEDGEH

SEQ ID NO: 1964962 - protein, 6 aa, Staphylococcus
LTGEET

SEQ ID NO: 1964963 - protein, 12 aa, Staphylococcus
LTGEVKVSGAKN

SEQ ID NO: 1964964 - protein, 11 aa, Staphylococcus
LTGEVQVEGAK

SEQ ID NO: 1964965 - protein, 7 aa, Staphylococcus
LTGGDKV

SEQ ID NO: 1964966 - protein, 11 aa, Staphylococcus
LTGGDKVTARK

SEQ ID NO: 1964967 - protein, 6 aa, Staphylococcus
LTGGQA

SEQ ID NO: 1964968 - protein, 12 aa, Staphylococcus
LTGGSGKPQGLE

SEQ ID NO: 1964969 - protein, 4 aa, Staphylococcus
LTGK

SEQ ID NO: 1964970 - protein, 21 aa, Staphylococcus
LTGKGLSRLARRGSGSASRSI

SEQ ID NO: 1964971 - protein, 7 aa, Staphylococcus
LTGKPNN

SEQ ID NO: 1964972 - protein, 7 aa, Staphylococcus
LTGKPNT

SEQ ID NO: 1964973 - protein, 4 aa, Staphylococcus
LTGN

SEQ ID NO: 1964974 - protein, 11 aa, Staphylococcus
LTGNAGAKAYR

SEQ ID NO: 1964975 - protein, 11 aa, Staphylococcus
LTGNSEATPYR

SEQ ID NO: 1964976 - protein, 11 aa, Staphylococcus
LTGNSNLTNGE

SEQ ID NO: 1964977 - protein, 9 aa, Staphylococcus
LTGPNDKRE

SEQ ID NO: 1964978 - protein, 10 aa, Staphylococcus
LTGPSKGGEV

SEQ ID NO: 1964979 - protein, 9 aa, Staphylococcus
LTGPSKGGH

SEQ ID NO: 1964980 - protein, 10 aa, Staphylococcus
LTGPSKGGHV

SEQ ID NO: 1964981 - protein, 10 aa, Staphylococcus
LTGPSKGGKV

SEQ ID NO: 1964982 - protein, 10 aa, Staphylococcus
LTGPTEATQT

SEQ ID NO: 1964983 - protein, 12 aa, Staphylococcus
LTGQDSERGTFS

SEQ ID NO: 1964984 - protein, 15 aa, Staphylococcus
LTGRLEGSKYPDETI

SEQ ID NO: 1964985 - protein, 7 aa, Staphylococcus
LTGRPNT

SEQ ID NO: 1964986 - protein, 15 aa, Staphylococcus
LTGRSIGRPKMGTYG

SEQ ID NO: 1964987 - protein, 9 aa, Staphylococcus
LTGSDANDG

SEQ ID NO: 1964988 - protein, 12 aa, Staphylococcus
LTGSDSQQRRNE

SEQ ID NO: 1964989 - protein, 6 aa, Staphylococcus
LTGSNG

SEQ ID NO: 1964990 - protein, 13 aa, Staphylococcus
LTGSTRLKSGTAQ

SEQ ID NO: 1964991 - protein, 21 aa, Staphylococcus
LTGTSSDLRDLTEEAKHGRHR

SEQ ID NO: 1964992 - protein, 4 aa, Staphylococcus
LTGV

SEQ ID NO: 1964993 - protein, 5 aa, Staphylococcus
LTHDF

SEQ ID NO: 1964994 - protein, 6 aa, Staphylococcus
LTHEGL

SEQ ID NO: 1964995 - protein, 7 aa, Staphylococcus
LTHPDKV

SEQ ID NO: 1964996 - protein, 9 aa, Staphylococcus
LTHTDKNHY

SEQ ID NO: 1964997 - protein, 5 aa, Staphylococcus
LTIEG

SEQ ID NO: 1964998 - protein, 4 aa, Staphylococcus
LTIN

SEQ ID NO: 1964999 - protein, 10 aa, Staphylococcus
LTINDDNANR

SEQ ID NO: 1965000 - protein, 6 aa, Staphylococcus
LTKASN

SEQ ID NO: 1965001 - protein, 8 aa, Staphylococcus
LTKASSKY

SEQ ID NO: 1965002 - protein, 4 aa, Staphylococcus
LTKD

SEQ ID NO: 1965003 - protein, 9 aa, Staphylococcus
LTKDELSEQ

SEQ ID NO: 1965004 - protein, 4 aa, Staphylococcus
LTKE

SEQ ID NO: 1965005 - protein, 22 aa, Staphylococcus
LTKEDKASTTQTQQTLNQKRSD

SEQ ID NO: 1965006 - protein, 8 aa, Staphylococcus
LTKEEIDK

SEQ ID NO: 1965007 - protein, 20 aa, Staphylococcus
LTKEEQEKISYTNGAKLLGI

SEQ ID NO: 1965008 - protein, 10 aa, Staphylococcus
LTKEQGEEAT

SEQ ID NO: 1965009 - protein, 7 aa, Staphylococcus
LTKETDL

SEQ ID NO: 1965010 - protein, 12 aa, Staphylococcus
LTKETQNKFNAT

SEQ ID NO: 1965011 - protein, 7 aa, Staphylococcus
LTKEYQQ

SEQ ID NO: 1965012 - protein, 7 aa, Staphylococcus
LTKGATV

SEQ ID NO: 1965013 - protein, 7 aa, Staphylococcus
LTKGRDL

SEQ ID NO: 1965014 - protein, 6 aa, Staphylococcus
LTKGRL

SEQ ID NO: 1965015 - protein, 4 aa, Staphylococcus
LTKH

SEQ ID NO: 1965016 - protein, 5 aa, Staphylococcus
LTKHE

SEQ ID NO: 1965017 - protein, 9 aa, Staphylococcus
LTKHPAVKE

SEQ ID NO: 1965018 - protein, 4 aa, Staphylococcus
LTKI

SEQ ID NO: 1965019 - protein, 13 aa, Staphylococcus
LTKKGEAMAASEN

SEQ ID NO: 1965020 - protein, 8 aa, Staphylococcus
LTKKGKSV

SEQ ID NO: 1965021 - protein, 9 aa, Staphylococcus
LTKLDPEAE

SEQ ID NO: 1965022 - protein, 8 aa, Staphylococcus
LTKNPNKS

SEQ ID NO: 1965023 - protein, 8 aa, Staphylococcus
LTKNQEHG

SEQ ID NO: 1965024 - protein, 4 aa, Staphylococcus
LTKP

SEQ ID NO: 1965025 - protein, 10 aa, Staphylococcus
LTKPSDLDAT

SEQ ID NO: 1965026 - protein, 16 aa, Staphylococcus
LTKQSEVYKNNADRAL

SEQ ID NO: 1965027 - protein, 5 aa, Staphylococcus
LTKSQ

SEQ ID NO: 1965028 - protein, 7 aa, Staphylococcus
LTKTEAK

SEQ ID NO: 1965029 - protein, 5 aa, Staphylococcus
LTKTN

SEQ ID NO: 1965030 - protein, 5 aa, Staphylococcus
LTLPE

SEQ ID NO: 1965031 - protein, 5 aa, Staphylococcus
LTLPK

SEQ ID NO: 1965032 - protein, 6 aa, Staphylococcus
LTLPQD

SEQ ID NO: 1965033 - protein, 7 aa, Staphylococcus
LTNAESG

SEQ ID NO: 1965034 - protein, 6 aa, Staphylococcus
LTNDND

SEQ ID NO: 1965035 - protein, 4 aa, Staphylococcus
LTNE

SEQ ID NO: 1965036 - protein, 6 aa, Staphylococcus
LTNEAR

SEQ ID NO: 1965037 - protein, 7 aa, Staphylococcus
LTNEPIK

SEQ ID NO: 1965038 - protein, 9 aa, Staphylococcus
LTNESEKHH

SEQ ID NO: 1965039 - protein, 4 aa, Staphylococcus
LTNG

SEQ ID NO: 1965040 - protein, 5 aa, Staphylococcus
LTNGA

SEQ ID NO: 1965041 - protein, 9 aa, Staphylococcus
LTNGNYGQK

SEQ ID NO: 1965042 - protein, 9 aa, Staphylococcus
LTNGPLAGI

SEQ ID NO: 1965043 - protein, 5 aa, Staphylococcus
LTNHS

SEQ ID NO: 1965044 - protein, 7 aa, Staphylococcus
LTNISQQ

SEQ ID NO: 1965045 - protein, 7 aa, Staphylococcus
LTNKNEK

SEQ ID NO: 1965046 - protein, 8 aa, Staphylococcus
LTNKPTSV

SEQ ID NO: 1965047 - protein, 14 aa, Staphylococcus
LTNNDGSSKELTKA

SEQ ID NO: 1965048 - protein, 17 aa, Staphylococcus
LTNNNKRPFSEYAGSLE

SEQ ID NO: 1965049 - protein, 9 aa, Staphylococcus
LTNNPSRQF

SEQ ID NO: 1965050 - protein, 9 aa, Staphylococcus
LTNNQVTTY

SEQ ID NO: 1965051 - protein, 17 aa, Staphylococcus
LTNPEITEDLSNKDRFV

SEQ ID NO: 1965052 - protein, 7 aa, Staphylococcus
LTNPYTG

SEQ ID NO: 1965053 - protein, 16 aa, Staphylococcus
LTNQEKEAARLNERNR

SEQ ID NO: 1965054 - protein, 6 aa, Staphylococcus
LTNQYN

SEQ ID NO: 1965055 - protein, 5 aa, Staphylococcus
LTNRE

SEQ ID NO: 1965056 - protein, 17 aa, Staphylococcus
LTNSDADYATHTPSYKR

SEQ ID NO: 1965057 - protein, 19 aa, Staphylococcus
LTNSDVDKYTDTPSYKRTS

SEQ ID NO: 1965058 - protein, 16 aa, Staphylococcus
LTNSIRKAAAQDGNRE

SEQ ID NO: 1965059 - protein, 15 aa, Staphylococcus
LTNSIRKTAASTGHR

SEQ ID NO: 1965060 - protein, 8 aa, Staphylococcus
LTNSKTSV

SEQ ID NO: 1965061 - protein, 5 aa, Staphylococcus
LTNSL

SEQ ID NO: 1965062 - protein, 10 aa, Staphylococcus
LTNSRGVQAK

SEQ ID NO: 1965063 - protein, 11 aa, Staphylococcus
LTNTNARIEPG

SEQ ID NO: 1965064 - protein, 9 aa, Staphylococcus
LTNTTTYNA

SEQ ID NO: 1965065 - protein, 5 aa, Staphylococcus
LTNVD

SEQ ID NO: 1965066 - protein, 6 aa, Staphylococcus
LTPDEK

SEQ ID NO: 1965067 - protein, 6 aa, Staphylococcus
LTPDKE

SEQ ID NO: 1965068 - protein, 5 aa, Staphylococcus
LTPDM

SEQ ID NO: 1965069 - protein, 21 aa, Staphylococcus
LTPDQAKSIDEIKGDMERERP

SEQ ID NO: 1965070 - protein, 12 aa, Staphylococcus
LTPDQAKSIEEI

SEQ ID NO: 1965071 - protein, 22 aa, Staphylococcus
LTPDQAKSIEEIKEDMEKERPM

SEQ ID NO: 1965072 - protein, 21 aa, Staphylococcus
LTPDQGKSIEEIKGDMERERP

SEQ ID NO: 1965073 - protein, 12 aa, Staphylococcus
LTPDQSKSIEEI

SEQ ID NO: 1965074 - protein, 21 aa, Staphylococcus
LTPDQSKSIEEIKGDMERERP

SEQ ID NO: 1965075 - protein, 4 aa, Staphylococcus
LTPE

SEQ ID NO: 1965076 - protein, 9 aa, Staphylococcus
LTPEEPHTY

SEQ ID NO: 1965077 - protein, 9 aa, Staphylococcus
LTPEEQDTF

SEQ ID NO: 1965078 - protein, 5 aa, Staphylococcus
LTPEG

SEQ ID NO: 1965079 - protein, 7 aa, Staphylococcus
LTPEQQT

SEQ ID NO: 1965080 - protein, 7 aa, Staphylococcus
LTPESSA

SEQ ID NO: 1965081 - protein, 7 aa, Staphylococcus
LTPESSS

SEQ ID NO: 1965082 - protein, 7 aa, Staphylococcus
LTPETDN

SEQ ID NO: 1965083 - protein, 17 aa, Staphylococcus
LTPETENKFNKDAFSKM

SEQ ID NO: 1965084 - protein, 11 aa, Staphylococcus
LTPETKDKFNR

SEQ ID NO: 1965085 - protein, 15 aa, Staphylococcus
LTPGDKIVTSEGTFG

SEQ ID NO: 1965086 - protein, 27 aa, Staphylococcus
LTPGKLDDETEKKGEKLEKDNRKDVNK

SEQ ID NO: 1965087 - protein, 5 aa, Staphylococcus
LTPGL

SEQ ID NO: 1965088 - protein, 7 aa, Staphylococcus
LTPGRQR

SEQ ID NO: 1965089 - protein, 10 aa, Staphylococcus
LTPHDGGRNL

SEQ ID NO: 1965090 - protein, 5 aa, Staphylococcus
LTPKE

SEQ ID NO: 1965091 - protein, 7 aa, Staphylococcus
LTPKEIT

SEQ ID NO: 1965092 - protein, 15 aa, Staphylococcus
LTPKGQSDNDFGSQA

SEQ ID NO: 1965093 - protein, 10 aa, Staphylococcus
LTPKGREYIE

SEQ ID NO: 1965094 - protein, 17 aa, Staphylococcus
LTPKKDEKLAVKSDKTI

SEQ ID NO: 1965095 - protein, 10 aa, Staphylococcus
LTPLGDSKPD

SEQ ID NO: 1965096 - protein, 4 aa, Staphylococcus
LTPN

SEQ ID NO: 1965097 - protein, 6 aa, Staphylococcus
LTPNAL

SEQ ID NO: 1965098 - protein, 8 aa, Staphylococcus
LTPNEGQI

SEQ ID NO: 1965099 - protein, 10 aa, Staphylococcus
LTPNETESAA

SEQ ID NO: 1965100 - protein, 6 aa, Staphylococcus
LTPNLD

SEQ ID NO: 1965101 - protein, 6 aa, Staphylococcus
LTPNLE

SEQ ID NO: 1965102 - protein, 5 aa, Staphylococcus
LTPNR

SEQ ID NO: 1965103 - protein, 9 aa, Staphylococcus
LTPNTNQYR

SEQ ID NO: 1965104 - protein, 11 aa, Staphylococcus
LTPPESNVSRY

SEQ ID NO: 1965105 - protein, 10 aa, Staphylococcus
LTPPHDASQF

SEQ ID NO: 1965106 - protein, 9 aa, Staphylococcus
LTPPNNPDH

SEQ ID NO: 1965107 - protein, 8 aa, Staphylococcus
LTPPNNVS

SEQ ID NO: 1965108 - protein, 6 aa, Staphylococcus
LTPPPV

SEQ ID NO: 1965109 - protein, 7 aa, Staphylococcus
LTPPPVK

SEQ ID NO: 1965110 - protein, 8 aa, Staphylococcus
LTPPPVKK

SEQ ID NO: 1965111 - protein, 8 aa, Staphylococcus
LTPPPVKR

SEQ ID NO: 1965112 - protein, 7 aa, Staphylococcus
LTPPRST

SEQ ID NO: 1965113 - protein, 8 aa, Staphylococcus
LTPQGTLA

SEQ ID NO: 1965114 - protein, 19 aa, Staphylococcus
LTPQGTLAEKLRSGGAGIP

SEQ ID NO: 1965115 - protein, 12 aa, Staphylococcus
LTPQKDADERSL

SEQ ID NO: 1965116 - protein, 6 aa, Staphylococcus
LTPQPY

SEQ ID NO: 1965117 - protein, 14 aa, Staphylococcus
LTPQQIKESYRNQD

SEQ ID NO: 1965118 - protein, 5 aa, Staphylococcus
LTPQS

SEQ ID NO: 1965119 - protein, 11 aa, Staphylococcus
LTPQTENQFDS

SEQ ID NO: 1965120 - protein, 10 aa, Staphylococcus
LTPRLKTSDG

SEQ ID NO: 1965121 - protein, 13 aa, Staphylococcus
LTPSEITNSIDEN

SEQ ID NO: 1965122 - protein, 7 aa, Staphylococcus
LTPSTDN

SEQ ID NO: 1965123 - protein, 7 aa, Staphylococcus
LTPSTDT

SEQ ID NO: 1965124 - protein, 8 aa, Staphylococcus
LTPSYSGV

SEQ ID NO: 1965125 - protein, 9 aa, Staphylococcus
LTPSYSGVS

SEQ ID NO: 1965126 - protein, 6 aa, Staphylococcus
LTPTDG

SEQ ID NO: 1965127 - protein, 8 aa, Staphylococcus
LTPTEKEL

SEQ ID NO: 1965128 - protein, 5 aa, Staphylococcus
LTPTI

SEQ ID NO: 1965129 - protein, 5 aa, Staphylococcus
LTPTL

SEQ ID NO: 1965130 - protein, 5 aa, Staphylococcus
LTPTS

SEQ ID NO: 1965131 - protein, 5 aa, Staphylococcus
LTPYE

SEQ ID NO: 1965132 - protein, 4 aa, Staphylococcus
LTQA

SEQ ID NO: 1965133 - protein, 7 aa, Staphylococcus
LTQADTM

SEQ ID NO: 1965134 - protein, 7 aa, Staphylococcus
LTQAESG

SEQ ID NO: 1965135 - protein, 12 aa, Staphylococcus
LTQARDEVGKSI

SEQ ID NO: 1965136 - protein, 18 aa, Staphylococcus
LTQARDEVGKSIQAIEDS

SEQ ID NO: 1965137 - protein, 7 aa, Staphylococcus
LTQDPYS

SEQ ID NO: 1965138 - protein, 7 aa, Staphylococcus
LTQDQPY

SEQ ID NO: 1965139 - protein, 8 aa, Staphylococcus
LTQDQPYE

SEQ ID NO: 1965140 - protein, 14 aa, Staphylococcus
LTQEELAERTDLSK

SEQ ID NO: 1965141 - protein, 15 aa, Staphylococcus
LTQEELAERTDLSKG

SEQ ID NO: 1965142 - protein, 16 aa, Staphylococcus
LTQEKNETTHHQTQQN

SEQ ID NO: 1965143 - protein, 10 aa, Staphylococcus
LTQESQYNSL

SEQ ID NO: 1965144 - protein, 7 aa, Staphylococcus
LTQFNDD

SEQ ID NO: 1965145 - protein, 12 aa, Staphylococcus
LTQGNYDNGNIS

SEQ ID NO: 1965146 - protein, 23 aa, Staphylococcus
LTQKNEEIKDTTAKLNQRQPDYR

SEQ ID NO: 1965147 - protein, 6 aa, Staphylococcus
LTQKST

SEQ ID NO: 1965148 - protein, 5 aa, Staphylococcus
LTQLA

SEQ ID NO: 1965149 - protein, 4 aa, Staphylococcus
LTQN

SEQ ID NO: 1965150 - protein, 21 aa, Staphylococcus
LTQNLREKQEIGKRAAQEIQD

SEQ ID NO: 1965151 - protein, 4 aa, Staphylococcus
LTQP

SEQ ID NO: 1965152 - protein, 28 aa, Staphylococcus
LTQPDVYSDPVKSNELAELKSNTEQELE

SEQ ID NO: 1965153 - protein, 5 aa, Staphylococcus
LTQPY

SEQ ID NO: 1965154 - protein, 7 aa, Staphylococcus
LTQQGTS

SEQ ID NO: 1965155 - protein, 5 aa, Staphylococcus
LTQQQ

SEQ ID NO: 1965156 - protein, 5 aa, Staphylococcus
LTQSD

SEQ ID NO: 1965157 - protein, 8 aa, Staphylococcus
LTQSEKQF

SEQ ID NO: 1965158 - protein, 5 aa, Staphylococcus
LTQSN

SEQ ID NO: 1965159 - protein, 12 aa, Staphylococcus
LTQTGRNSAQAL

SEQ ID NO: 1965160 - protein, 9 aa, Staphylococcus
LTQTKNGNY

SEQ ID NO: 1965161 - protein, 6 aa, Staphylococcus
LTQTKQ

SEQ ID NO: 1965162 - protein, 4 aa, Staphylococcus
LTQY

SEQ ID NO: 1965163 - protein, 10 aa, Staphylococcus
LTRDEVRANM

SEQ ID NO: 1965164 - protein, 11 aa, Staphylococcus
LTRDNKVDPIT

SEQ ID NO: 1965165 - protein, 21 aa, Staphylococcus
LTRERKKSDERIKDAVQEAEK

SEQ ID NO: 1965166 - protein, 5 aa, Staphylococcus
LTRGA

SEQ ID NO: 1965167 - protein, 15 aa, Staphylococcus
LTRGDGTTGEDITEN

SEQ ID NO: 1965168 - protein, 7 aa, Staphylococcus
LTRKGQS

SEQ ID NO: 1965169 - protein, 7 aa, Staphylococcus
LTRNEEF

SEQ ID NO: 1965170 - protein, 15 aa, Staphylococcus
LTRNEEVIEETNKDQ

SEQ ID NO: 1965171 - protein, 6 aa, Staphylococcus
LTRSTA

SEQ ID NO: 1965172 - protein, 4 aa, Staphylococcus
LTRT

SEQ ID NO: 1965173 - protein, 39 aa, Staphylococcus
LTRTDASNSDGKSEEQSDDNTVSEDMESNHQDSASQGGA

SEQ ID NO: 1965174 - protein, 11 aa, Staphylococcus
LTRTQSGGFDI

SEQ ID NO: 1965175 - protein, 11 aa, Staphylococcus
LTRTSSGGFNI

SEQ ID NO: 1965176 - protein, 7 aa, Staphylococcus
LTSADDI

SEQ ID NO: 1965177 - protein, 19 aa, Staphylococcus
LTSDDTFKVSNSEVTISEK

SEQ ID NO: 1965178 - protein, 9 aa, Staphylococcus
LTSDEKDEV

SEQ ID NO: 1965179 - protein, 7 aa, Staphylococcus
LTSDGEK

SEQ ID NO: 1965180 - protein, 12 aa, Staphylococcus
LTSDNEVSSKTA

SEQ ID NO: 1965181 - protein, 6 aa, Staphylococcus
LTSEAI

SEQ ID NO: 1965182 - protein, 8 aa, Staphylococcus
LTSEAKKA

SEQ ID NO: 1965183 - protein, 19 aa, Staphylococcus
LTSEGLAKEIESRMTRGQS

SEQ ID NO: 1965184 - protein, 10 aa, Staphylococcus
LTSEKELEDI

SEQ ID NO: 1965185 - protein, 7 aa, Staphylococcus
LTSEPMQ

SEQ ID NO: 1965186 - protein, 5 aa, Staphylococcus
LTSES

SEQ ID NO: 1965187 - protein, 15 aa, Staphylococcus
LTSGIRKASTEQHND

SEQ ID NO: 1965188 - protein, 12 aa, Staphylococcus
LTSGSKQSTIRA

SEQ ID NO: 1965189 - protein, 14 aa, Staphylococcus
LTSGSKQSTITTKS

SEQ ID NO: 1965190 - protein, 10 aa, Staphylococcus
LTSKEAKAQG

SEQ ID NO: 1965191 - protein, 6 aa, Staphylococcus
LTSNDY

SEQ ID NO: 1965192 - protein, 16 aa, Staphylococcus
LTSNGKIDRKKIAEEL

SEQ ID NO: 1965193 - protein, 17 aa, Staphylococcus
LTSNGKLDRKAIAEVVN

SEQ ID NO: 1965194 - protein, 17 aa, Staphylococcus
LTSNGKLDRKQVAEDID

SEQ ID NO: 1965195 - protein, 17 aa, Staphylococcus
LTSNGKLDRKQVAEDIN

SEQ ID NO: 1965196 - protein, 12 aa, Staphylococcus
LTSNRNEETIES

SEQ ID NO: 1965197 - protein, 13 aa, Staphylococcus
LTSPKEAIEEAGH

SEQ ID NO: 1965198 - protein, 11 aa, Staphylococcus
LTSPKEAIENA

SEQ ID NO: 1965199 - protein, 12 aa, Staphylococcus
LTSPKEAIENAG

SEQ ID NO: 1965200 - protein, 13 aa, Staphylococcus
LTSPKEALEEAGF

SEQ ID NO: 1965201 - protein, 13 aa, Staphylococcus
LTSPKEALENAGF

SEQ ID NO: 1965202 - protein, 8 aa, Staphylococcus
LTSQNHGY

SEQ ID NO: 1965203 - protein, 5 aa, Staphylococcus
LTSQP

SEQ ID NO: 1965204 - protein, 16 aa, Staphylococcus
LTSQSSKEKYKVSSHN

SEQ ID NO: 1965205 - protein, 7 aa, Staphylococcus
LTSRTTD

SEQ ID NO: 1965206 - protein, 7 aa, Staphylococcus
LTSSDQV

SEQ ID NO: 1965207 - protein, 11 aa, Staphylococcus
LTSSGVEVKDH

SEQ ID NO: 1965208 - protein, 9 aa, Staphylococcus
LTSTSNDTI

SEQ ID NO: 1965209 - protein, 6 aa, Staphylococcus
LTSTTE

SEQ ID NO: 1965210 - protein, 7 aa, Staphylococcus
LTSTTEE

SEQ ID NO: 1965211 - protein, 12 aa, Staphylococcus
LTSTTEQQLHEE

SEQ ID NO: 1965212 - protein, 7 aa, Staphylococcus
LTSTTET

SEQ ID NO: 1965213 - protein, 19 aa, Staphylococcus
LTSTTETQLHEEQNIQTTI

SEQ ID NO: 1965214 - protein, 7 aa, Staphylococcus
LTSYENK

SEQ ID NO: 1965215 - protein, 9 aa, Staphylococcus
LTTAEGGAV

SEQ ID NO: 1965216 - protein, 5 aa, Staphylococcus
LTTAG

SEQ ID NO: 1965217 - protein, 6 aa, Staphylococcus
LTTDKY

SEQ ID NO: 1965218 - protein, 6 aa, Staphylococcus
LTTEDM

SEQ ID NO: 1965219 - protein, 4 aa, Staphylococcus
LTTG

SEQ ID NO: 1965220 - protein, 7 aa, Staphylococcus
LTTGDNP

SEQ ID NO: 1965221 - protein, 5 aa, Staphylococcus
LTTGE

SEQ ID NO: 1965222 - protein, 7 aa, Staphylococcus
LTTGESI

SEQ ID NO: 1965223 - protein, 9 aa, Staphylococcus
LTTGQNSLI

SEQ ID NO: 1965224 - protein, 6 aa, Staphylococcus
LTTGSV

SEQ ID NO: 1965225 - protein, 21 aa, Staphylococcus
LTTIGKEAGMTMQEANQRAET

SEQ ID NO: 1965226 - protein, 4 aa, Staphylococcus
LTTK

SEQ ID NO: 1965227 - protein, 7 aa, Staphylococcus
LTTKEIN

SEQ ID NO: 1965228 - protein, 7 aa, Staphylococcus
LTTKQGV

SEQ ID NO: 1965229 - protein, 6 aa, Staphylococcus
LTTKTE

SEQ ID NO: 1965230 - protein, 4 aa, Staphylococcus
LTTN

SEQ ID NO: 1965231 - protein, 5 aa, Staphylococcus
LTTNQ

SEQ ID NO: 1965232 - protein, 10 aa, Staphylococcus
LTTPDEKEAL

SEQ ID NO: 1965233 - protein, 9 aa, Staphylococcus
LTTPDEQEA

SEQ ID NO: 1965234 - protein, 10 aa, Staphylococcus
LTTPDEQEAL

SEQ ID NO: 1965235 - protein, 15 aa, Staphylococcus
LTTQEQHLKDEHEEF

SEQ ID NO: 1965236 - protein, 6 aa, Staphylococcus
LTTQIR

SEQ ID NO: 1965237 - protein, 5 aa, Staphylococcus
LTTSK

SEQ ID NO: 1965238 - protein, 11 aa, Staphylococcus
LTTSKAQPIAL

SEQ ID NO: 1965239 - protein, 18 aa, Staphylococcus
LTTSQNGKEKLQNAGVTP

SEQ ID NO: 1965240 - protein, 9 aa, Staphylococcus
LTTTPKDEE

SEQ ID NO: 1965241 - protein, 6 aa, Staphylococcus
LTVRSS

SEQ ID NO: 1965242 - protein, 4 aa, Staphylococcus
LTVT

SEQ ID NO: 1965243 - protein, 6 aa, Staphylococcus
LTYDEK

SEQ ID NO: 1965244 - protein, 17 aa, Staphylococcus
LTYSSDELSDTGLRAAG

SEQ ID NO: 1965245 - protein, 8 aa, Staphylococcus
LTYTKDEI

SEQ ID NO: 1965246 - protein, 10 aa, Staphylococcus
LVDDSIKKEG

SEQ ID NO: 1965247 - protein, 5 aa, Staphylococcus
LVDNN

SEQ ID NO: 1965248 - protein, 15 aa, Staphylococcus
LVDPPEYTKENRNKL

SEQ ID NO: 1965249 - protein, 14 aa, Staphylococcus
LVEPSEDAEEESED

SEQ ID NO: 1965250 - protein, 18 aa, Staphylococcus
LVEQRSENGWQGMPDDAK

SEQ ID NO: 1965251 - protein, 20 aa, Staphylococcus
LVERTKTDRYQRKGSQTMKN

SEQ ID NO: 1965252 - protein, 12 aa, Staphylococcus
LVGGYYKDYFKE

SEQ ID NO: 1965253 - protein, 5 aa, Staphylococcus
LVGNT

SEQ ID NO: 1965254 - protein, 11 aa, Staphylococcus
LVKASTKNEVI

SEQ ID NO: 1965255 - protein, 7 aa, Staphylococcus
LVKGEAQ

SEQ ID NO: 1965256 - protein, 5 aa, Staphylococcus
LVNSG

SEQ ID NO: 1965257 - protein, 13 aa, Staphylococcus
LVPNKLSGGQQQR

SEQ ID NO: 1965258 - protein, 19 aa, Staphylococcus
LVRGRGGPRCMSQPIYRED

SEQ ID NO: 1965259 - protein, 19 aa, Staphylococcus
LVRGRGGPRCMSQPLFRED

SEQ ID NO: 1965260 - protein, 5 aa, Staphylococcus
LVRGS

SEQ ID NO: 1965261 - protein, 8 aa, Staphylococcus
LVSEKELG

SEQ ID NO: 1965262 - protein, 17 aa, Staphylococcus
LVSKSDMKRVKQLLAYK

SEQ ID NO: 1965263 - protein, 6 aa, Staphylococcus
LVSQEG

SEQ ID NO: 1965264 - protein, 4 aa, Staphylococcus
LVST

SEQ ID NO: 1965265 - protein, 6 aa, Staphylococcus
LVTEEE

SEQ ID NO: 1965266 - protein, 10 aa, Staphylococcus
LVTESDSRTW

SEQ ID NO: 1965267 - protein, 8 aa, Staphylococcus
LVTSGGLG

SEQ ID NO: 1965268 - protein, 4 aa, Staphylococcus
LVTT

SEQ ID NO: 1965269 - protein, 6 aa, Staphylococcus
LWPQSG

SEQ ID NO: 1965270 - protein, 5 aa, Staphylococcus
LYADT

SEQ ID NO: 1965271 - protein, 18 aa, Staphylococcus
LYDASKPKLQGDQGMSDT

SEQ ID NO: 1965272 - protein, 13 aa, Staphylococcus
LYDGSYHDVDSSE

SEQ ID NO: 1965273 - protein, 10 aa, Staphylococcus
LYDQDESIDA

SEQ ID NO: 1965274 - protein, 15 aa, Staphylococcus
LYDSEGNLVNEDKTS

SEQ ID NO: 1965275 - protein, 14 aa, Staphylococcus
LYDSSKPKLQGSQE

SEQ ID NO: 1965276 - protein, 5 aa, Staphylococcus
LYEEG

SEQ ID NO: 1965277 - protein, 6 aa, Staphylococcus
LYEKGE

SEQ ID NO: 1965278 - protein, 14 aa, Staphylococcus
LYGDQSRTTLNRGT

SEQ ID NO: 1965279 - protein, 4 aa, Staphylococcus
LYGE

SEQ ID NO: 1965280 - protein, 6 aa, Staphylococcus
LYGKQS

SEQ ID NO: 1965281 - protein, 6 aa, Staphylococcus
LYGNST

SEQ ID NO: 1965282 - protein, 13 aa, Staphylococcus
LYKGKKKLEDVDS

SEQ ID NO: 1965283 - protein, 15 aa, Staphylococcus
LYKGKKKLKDVPSHT

SEQ ID NO: 1965284 - protein, 13 aa, Staphylococcus
LYKGKKKLSEVDT

SEQ ID NO: 1965285 - protein, 11 aa, Staphylococcus
LYKTAKQQVMK

SEQ ID NO: 1965286 - protein, 7 aa, Staphylococcus
LYNQSER

SEQ ID NO: 1965287 - protein, 7 aa, Staphylococcus
LYNSSDF

SEQ ID NO: 1965288 - protein, 7 aa, Staphylococcus
LYPEENG

SEQ ID NO: 1965289 - protein, 12 aa, Staphylococcus
LYPGPKYQEVKS

SEQ ID NO: 1965290 - protein, 6 aa, Staphylococcus
LYPYNG

SEQ ID NO: 1965291 - protein, 12 aa, Staphylococcus
LYQKGETHSSND

SEQ ID NO: 1965292 - protein, 7 aa, Staphylococcus
LYQSGGT

SEQ ID NO: 1965293 - protein, 16 aa, Staphylococcus
LYRTEYEGTTFRENIG

SEQ ID NO: 1965294 - protein, 11 aa, Staphylococcus
LYSDGGSYSME

SEQ ID NO: 1965295 - protein, 12 aa, Staphylococcus
LYSEDEKHLKEA

SEQ ID NO: 1965296 - protein, 16 aa, Staphylococcus
LYSEEASALSAPQIGV

SEQ ID NO: 1965297 - protein, 5 aa, Staphylococcus
LYSGG

SEQ ID NO: 1965298 - protein, 12 aa, Staphylococcus
LYSKDGKTVGTF

SEQ ID NO: 1965299 - protein, 16 aa, Staphylococcus
LYSSDEQHDEKLENIK

SEQ ID NO: 1965300 - protein, 9 aa, Staphylococcus
LYSSNKQFE

SEQ ID NO: 1965301 - protein, 10 aa, Staphylococcus
LYSTDKGTKL

SEQ ID NO: 1965302 - protein, 5 aa, Staphylococcus
LYTSQ

SEQ ID NO: 1965303 - protein, 4 aa, Staphylococcus
MAAN

SEQ ID NO: 1965304 - protein, 15 aa, Staphylococcus
MAATTSKQSSTHTLQ

SEQ ID NO: 1965305 - protein, 5 aa, Staphylococcus
MADDE

SEQ ID NO: 1965306 - protein, 4 aa, Staphylococcus
MADG

SEQ ID NO: 1965307 - protein, 7 aa, Staphylococcus
MADKEDL

SEQ ID NO: 1965308 - protein, 8 aa, Staphylococcus
MADKGELP

SEQ ID NO: 1965309 - protein, 8 aa, Staphylococcus
MADKGTLP

SEQ ID NO: 1965310 - protein, 9 aa, Staphylococcus
MADPGEYTK

SEQ ID NO: 1965311 - protein, 7 aa, Staphylococcus
MADQDVE

SEQ ID NO: 1965312 - protein, 11 aa, Staphylococcus
MADSSSPIRPE

SEQ ID NO: 1965313 - protein, 5 aa, Staphylococcus
MAEEN

SEQ ID NO: 1965314 - protein, 8 aa, Staphylococcus
MAEPGEYT

SEQ ID NO: 1965315 - protein, 14 aa, Staphylococcus
MAEPNEDDKPSEIK

SEQ ID NO: 1965316 - protein, 14 aa, Staphylococcus
MAEPNEEDKPEEIQ

SEQ ID NO: 1965317 - protein, 14 aa, Staphylococcus
MAEPNENDKPEEIK

SEQ ID NO: 1965318 - protein, 10 aa, Staphylococcus
MAEQTGGDYT

SEQ ID NO: 1965319 - protein, 7 aa, Staphylococcus
MAESNND

SEQ ID NO: 1965320 - protein, 5 aa, Staphylococcus
MAETL

SEQ ID NO: 1965321 - protein, 11 aa, Staphylococcus
MAGGTPQQSAE

SEQ ID NO: 1965322 - protein, 11 aa, Staphylococcus
MAGKGSEVGRN

SEQ ID NO: 1965323 - protein, 11 aa, Staphylococcus
MAGKGSEVGRS

SEQ ID NO: 1965324 - protein, 4 aa, Staphylococcus
MAGR

SEQ ID NO: 1965325 - protein, 17 aa, Staphylococcus
MAGRGTDIKLGDGVEEL

SEQ ID NO: 1965326 - protein, 17 aa, Staphylococcus
MAGRGTDIKLGDGVQEL

SEQ ID NO: 1965327 - protein, 8 aa, Staphylococcus
MAGSTTAE

SEQ ID NO: 1965328 - protein, 8 aa, Staphylococcus
MAGSTTAS

SEQ ID NO: 1965329 - protein, 10 aa, Staphylococcus
MAGSTTPELV

SEQ ID NO: 1965330 - protein, 8 aa, Staphylococcus
MAGSTTPH

SEQ ID NO: 1965331 - protein, 6 aa, Staphylococcus
MAHGDH

SEQ ID NO: 1965332 - protein, 7 aa, Staphylococcus
MAKEKAD

SEQ ID NO: 1965333 - protein, 5 aa, Staphylococcus
MAKGL

SEQ ID NO: 1965334 - protein, 8 aa, Staphylococcus
MALPDEKQ

SEQ ID NO: 1965335 - protein, 10 aa, Staphylococcus
MANGNPGYPP

SEQ ID NO: 1965336 - protein, 4 aa, Staphylococcus
MANL

SEQ ID NO: 1965337 - protein, 18 aa, Staphylococcus
MANPKLNAGETPISASPV

SEQ ID NO: 1965338 - protein, 8 aa, Staphylococcus
MAPEPFDE

SEQ ID NO: 1965339 - protein, 7 aa, Staphylococcus
MAQEQGL

SEQ ID NO: 1965340 - protein, 4 aa, Staphylococcus
MAQK

SEQ ID NO: 1965341 - protein, 10 aa, Staphylococcus
MAQQTNGDYT

SEQ ID NO: 1965342 - protein, 5 aa, Staphylococcus
MARGI

SEQ ID NO: 1965343 - protein, 7 aa, Staphylococcus
MARSAEE

SEQ ID NO: 1965344 - protein, 5 aa, Staphylococcus
MASAT

SEQ ID NO: 1965345 - protein, 4 aa, Staphylococcus
MASD

SEQ ID NO: 1965346 - protein, 8 aa, Staphylococcus
MASKDITK

SEQ ID NO: 1965347 - protein, 4 aa, Staphylococcus
MASQ

SEQ ID NO: 1965348 - protein, 6 aa, Staphylococcus
MASSTG

SEQ ID NO: 1965349 - protein, 11 aa, Staphylococcus
MATAKTCPHDA

SEQ ID NO: 1965350 - protein, 10 aa, Staphylococcus
MATDDSGKLY

SEQ ID NO: 1965351 - protein, 10 aa, Staphylococcus
MATNDEGKMY

SEQ ID NO: 1965352 - protein, 10 aa, Staphylococcus
MATNDKGKMY

SEQ ID NO: 1965353 - protein, 10 aa, Staphylococcus
MATNDNGKMY

SEQ ID NO: 1965354 - protein, 10 aa, Staphylococcus
MATNKNGKMY

SEQ ID NO: 1965355 - protein, 4 aa, Staphylococcus
MATQ

SEQ ID NO: 1965356 - protein, 37 aa, Staphylococcus
MDASNVDGQDNTNQETDTTSAEAETNAQDSKSEGGAY

SEQ ID NO: 1965357 - protein, 5 aa, Staphylococcus
MDDDT

SEQ ID NO: 1965358 - protein, 9 aa, Staphylococcus
MDDEPVRAI

SEQ ID NO: 1965359 - protein, 8 aa, Staphylococcus
MDDESIEK

SEQ ID NO: 1965360 - protein, 18 aa, Staphylococcus
MDDKKELAEAVSDKTDSE

SEQ ID NO: 1965361 - protein, 17 aa, Staphylococcus
MDDLRAKAKEAVESGQY

SEQ ID NO: 1965362 - protein, 17 aa, Staphylococcus
MDDLRQKAKEAVESGQY

SEQ ID NO: 1965363 - protein, 6 aa, Staphylococcus
MDDQEI

SEQ ID NO: 1965364 - protein, 6 aa, Staphylococcus
MDEAGV

SEQ ID NO: 1965365 - protein, 21 aa, Staphylococcus
MDEAKEKANQRVKSATKEADA

SEQ ID NO: 1965366 - protein, 9 aa, Staphylococcus
MDEATLSGN

SEQ ID NO: 1965367 - protein, 9 aa, Staphylococcus
MDEDKRQEE

SEQ ID NO: 1965368 - protein, 8 aa, Staphylococcus
MDEEKTYE

SEQ ID NO: 1965369 - protein, 10 aa, Staphylococcus
MDEQEKKENI

SEQ ID NO: 1965370 - protein, 4 aa, Staphylococcus
MDES

SEQ ID NO: 1965371 - protein, 9 aa, Staphylococcus
MDESGQYEP

SEQ ID NO: 1965372 - protein, 12 aa, Staphylococcus
MDGKDDGKIPNG

SEQ ID NO: 1965373 - protein, 4 aa, Staphylococcus
MDGN

SEQ ID NO: 1965374 - protein, 9 aa, Staphylococcus
MDGQDDEEM

SEQ ID NO: 1965375 - protein, 4 aa, Staphylococcus
MDIN

SEQ ID NO: 1965376 - protein, 5 aa, Staphylococcus
MDKSQ

SEQ ID NO: 1965377 - protein, 4 aa, Staphylococcus
MDKT

SEQ ID NO: 1965378 - protein, 8 aa, Staphylococcus
MDKTGNPN

SEQ ID NO: 1965379 - protein, 8 aa, Staphylococcus
MDKTSNEI

SEQ ID NO: 1965380 - protein, 6 aa, Staphylococcus
MDNHSA

SEQ ID NO: 1965381 - protein, 7 aa, Staphylococcus
MDNPNFS

SEQ ID NO: 1965382 - protein, 6 aa, Staphylococcus
MDNPYG

SEQ ID NO: 1965383 - protein, 13 aa, Staphylococcus
MDNTEKRQNLSNI

SEQ ID NO: 1965384 - protein, 8 aa, Staphylococcus
MDNTTRIK

SEQ ID NO: 1965385 - protein, 22 aa, Staphylococcus
MDPEGNDVTPEKLKQIQKHNKN

SEQ ID NO: 1965386 - protein, 5 aa, Staphylococcus
MDPFN

SEQ ID NO: 1965387 - protein, 19 aa, Staphylococcus
MDPFNGGEISPGPEVQTDE

SEQ ID NO: 1965388 - protein, 10 aa, Staphylococcus
MDPKGGCSGS

SEQ ID NO: 1965389 - protein, 19 aa, Staphylococcus
MDPYNGGEISPGPSVQTDE

SEQ ID NO: 1965390 - protein, 4 aa, Staphylococcus
MDQG

SEQ ID NO: 1965391 - protein, 12 aa, Staphylococcus
MDQGGVDEKQNN

SEQ ID NO: 1965392 - protein, 6 aa, Staphylococcus
MDQQNK

SEQ ID NO: 1965393 - protein, 6 aa, Staphylococcus
MDQQSK

SEQ ID NO: 1965394 - protein, 7 aa, Staphylococcus
MDQQSKY

SEQ ID NO: 1965395 - protein, 7 aa, Staphylococcus
MDRGEEY

SEQ ID NO: 1965396 - protein, 4 aa, Staphylococcus
MDRK

SEQ ID NO: 1965397 - protein, 7 aa, Staphylococcus
MDRQSAK

SEQ ID NO: 1965398 - protein, 9 aa, Staphylococcus
MDRSNSAIP

SEQ ID NO: 1965399 - protein, 6 aa, Staphylococcus
MDSDQM

SEQ ID NO: 1965400 - protein, 19 aa, Staphylococcus
MDSFNGGEISPGPSVQTDE

SEQ ID NO: 1965401 - protein, 9 aa, Staphylococcus
MDSGETDSI

SEQ ID NO: 1965402 - protein, 4 aa, Staphylococcus
MDSI

SEQ ID NO: 1965403 - protein, 7 aa, Staphylococcus
MDSKTQH

SEQ ID NO: 1965404 - protein, 6 aa, Staphylococcus
MDTDDG

SEQ ID NO: 1965405 - protein, 10 aa, Staphylococcus
MDTEAKHTIN

SEQ ID NO: 1965406 - protein, 9 aa, Staphylococcus
MEASQKNQF

SEQ ID NO: 1965407 - protein, 17 aa, Staphylococcus
MEDEPVRAIKRKKDSSM

SEQ ID NO: 1965408 - protein, 8 aa, Staphylococcus
MEDGYPGD

SEQ ID NO: 1965409 - protein, 17 aa, Staphylococcus
MEDLRTKAKEAVESGQY

SEQ ID NO: 1965410 - protein, 10 aa, Staphylococcus
MEDPKTTKGM

SEQ ID NO: 1965411 - protein, 10 aa, Staphylococcus
MEDPRQTKGM

SEQ ID NO: 1965412 - protein, 8 aa, Staphylococcus
MEDTQTWS

SEQ ID NO: 1965413 - protein, 5 aa, Staphylococcus
MEEEN

SEQ ID NO: 1965414 - protein, 5 aa, Staphylococcus
MEEGH

SEQ ID NO: 1965415 - protein, 4 aa, Staphylococcus
MEEI

SEQ ID NO: 1965416 - protein, 9 aa, Staphylococcus
MEENRQPPL

SEQ ID NO: 1965417 - protein, 5 aa, Staphylococcus
MEERD

SEQ ID NO: 1965418 - protein, 11 aa, Staphylococcus
MEESDVPDPYY

SEQ ID NO: 1965419 - protein, 12 aa, Staphylococcus
MEETDVPDPYYT

SEQ ID NO: 1965420 - protein, 9 aa, Staphylococcus
MEETGLNAK

SEQ ID NO: 1965421 - protein, 5 aa, Staphylococcus
MEETS

SEQ ID NO: 1965422 - protein, 10 aa, Staphylococcus
MEGANEEIRE

SEQ ID NO: 1965423 - protein, 7 aa, Staphylococcus
MEGEPKN

SEQ ID NO: 1965424 - protein, 11 aa, Staphylococcus
MEGHPDNVAPT

SEQ ID NO: 1965425 - protein, 4 aa, Staphylococcus
MEGL

SEQ ID NO: 1965426 - protein, 5 aa, Staphylococcus
MEGLN

SEQ ID NO: 1965427 - protein, 8 aa, Staphylococcus
MEGLNGDK

SEQ ID NO: 1965428 - protein, 4 aa, Staphylococcus
MEGN

SEQ ID NO: 1965429 - protein, 11 aa, Staphylococcus
MEGPASEAYAS

SEQ ID NO: 1965430 - protein, 8 aa, Staphylococcus
MEGSQKNA

SEQ ID NO: 1965431 - protein, 8 aa, Staphylococcus
MEGSQKNR

SEQ ID NO: 1965432 - protein, 5 aa, Staphylococcus
MEGYN

SEQ ID NO: 1965433 - protein, 5 aa, Staphylococcus
MEGYQ

SEQ ID NO: 1965434 - protein, 10 aa, Staphylococcus
MEKASESLDF

SEQ ID NO: 1965435 - protein, 5 aa, Staphylococcus
MEKDG

SEQ ID NO: 1965436 - protein, 5 aa, Staphylococcus
MEKDQ

SEQ ID NO: 1965437 - protein, 8 aa, Staphylococcus
MEKGTNKY

SEQ ID NO: 1965438 - protein, 9 aa, Staphylococcus
MEKTGNPRA

SEQ ID NO: 1965439 - protein, 19 aa, Staphylococcus
MEKYQNKQNPTFKPGPVMP

SEQ ID NO: 1965440 - protein, 6 aa, Staphylococcus
MENDEQ

SEQ ID NO: 1965441 - protein, 7 aa, Staphylococcus
MENKGKE

SEQ ID NO: 1965442 - protein, 6 aa, Staphylococcus
MENPQN

SEQ ID NO: 1965443 - protein, 7 aa, Staphylococcus
MENSGVK

SEQ ID NO: 1965444 - protein, 10 aa, Staphylococcus
MENTDAIKSL

SEQ ID NO: 1965445 - protein, 24 aa, Staphylococcus
MENTTIKAQAAQVEKNKNQVHTDE

SEQ ID NO: 1965446 - protein, 13 aa, Staphylococcus
MEPGPKYQEVKNS

SEQ ID NO: 1965447 - protein, 6 aa, Staphylococcus
MEPTQN

SEQ ID NO: 1965448 - protein, 18 aa, Staphylococcus
MEPTRQALKDAGLSTSDI

SEQ ID NO: 1965449 - protein, 18 aa, Staphylococcus
MEPTRQAMKDAGLSSSDI

SEQ ID NO: 1965450 - protein, 4 aa, Staphylococcus
MEQD

SEQ ID NO: 1965451 - protein, 4 aa, Staphylococcus
MEQE

SEQ ID NO: 1965452 - protein, 12 aa, Staphylococcus
MEQGGVDDKQNN

SEQ ID NO: 1965453 - protein, 26 aa, Staphylococcus
MEQISEENDEDKLDKSHDPAVRSDLN

SEQ ID NO: 1965454 - protein, 6 aa, Staphylococcus
MEQKST

SEQ ID NO: 1965455 - protein, 21 aa, Staphylococcus
MEQQRTRAREARQSSQSMQVQ

SEQ ID NO: 1965456 - protein, 5 aa, Staphylococcus
MEQRD

SEQ ID NO: 1965457 - protein, 12 aa, Staphylococcus
MEQTGKEKFKTA

SEQ ID NO: 1965458 - protein, 12 aa, Staphylococcus
MERANPATLNVS

SEQ ID NO: 1965459 - protein, 10 aa, Staphylococcus
MERERQSSTF

SEQ ID NO: 1965460 - protein, 8 aa, Staphylococcus
MERPSTGV

SEQ ID NO: 1965461 - protein, 11 aa, Staphylococcus
MERSGQSREEV

SEQ ID NO: 1965462 - protein, 18 aa, Staphylococcus
MESGNSETVKFENLLSYF

SEQ ID NO: 1965463 - protein, 9 aa, Staphylococcus
MESNNSDVF

SEQ ID NO: 1965464 - protein, 16 aa, Staphylococcus
MESQCDNSNPSPASWK

SEQ ID NO: 1965465 - protein, 7 aa, Staphylococcus
MESSETY

SEQ ID NO: 1965466 - protein, 12 aa, Staphylococcus
METEKSMYSKSI

SEQ ID NO: 1965467 - protein, 6 aa, Staphylococcus
METEPH

SEQ ID NO: 1965468 - protein, 19 aa, Staphylococcus
METGESESIQLDQIVDYFH

SEQ ID NO: 1965469 - protein, 4 aa, Staphylococcus
METI

SEQ ID NO: 1965470 - protein, 11 aa, Staphylococcus
METSRRVAKEE

SEQ ID NO: 1965471 - protein, 13 aa, Staphylococcus
MFEEQAPKESKEI

SEQ ID NO: 1965472 - protein, 4 aa, Staphylococcus
MFGE

SEQ ID NO: 1965473 - protein, 23 aa, Staphylococcus
MGADISADNGTATIKPSKLTGAE

SEQ ID NO: 1965474 - protein, 11 aa, Staphylococcus
MGAQTGPDQIE

SEQ ID NO: 1965475 - protein, 6 aa, Staphylococcus
MGASTE

SEQ ID NO: 1965476 - protein, 15 aa, Staphylococcus
MGDETQTDIIMAHSL

SEQ ID NO: 1965477 - protein, 9 aa, Staphylococcus
MGDNQFETK

SEQ ID NO: 1965478 - protein, 7 aa, Staphylococcus
MGDQDDF

SEQ ID NO: 1965479 - protein, 7 aa, Staphylococcus
MGDRAHQ

SEQ ID NO: 1965480 - protein, 18 aa, Staphylococcus
MGDSSDNIPGVAGVGEKT

SEQ ID NO: 1965481 - protein, 18 aa, Staphylococcus
MGDTSDNIPGVAGVGEKT

SEQ ID NO: 1965482 - protein, 6 aa, Staphylococcus
MGEKSR

SEQ ID NO: 1965483 - protein, 13 aa, Staphylococcus
MGETTTEKDIEQF

SEQ ID NO: 1965484 - protein, 5 aa, Staphylococcus
MGGGK

SEQ ID NO: 1965485 - protein, 8 aa, Staphylococcus
MGGNAENI

SEQ ID NO: 1965486 - protein, 6 aa, Staphylococcus
MGGQTV

SEQ ID NO: 1965487 - protein, 7 aa, Staphylococcus
MGGQTVR

SEQ ID NO: 1965488 - protein, 7 aa, Staphylococcus
MGGSDRY

SEQ ID NO: 1965489 - protein, 10 aa, Staphylococcus
MGGSTETSYF

SEQ ID NO: 1965490 - protein, 7 aa, Staphylococcus
MGGTGGG

SEQ ID NO: 1965491 - protein, 7 aa, Staphylococcus
MGGTSLK

SEQ ID NO: 1965492 - protein, 8 aa, Staphylococcus
MGGTSLKT

SEQ ID NO: 1965493 - protein, 4 aa, Staphylococcus
MGGY

SEQ ID NO: 1965494 - protein, 8 aa, Staphylococcus
MGHESEHN

SEQ ID NO: 1965495 - protein, 5 aa, Staphylococcus
MGHSG

SEQ ID NO: 1965496 - protein, 4 aa, Staphylococcus
MGIP

SEQ ID NO: 1965497 - protein, 13 aa, Staphylococcus
MGKETEGKVTPLP

SEQ ID NO: 1965498 - protein, 8 aa, Staphylococcus
MGNNDEHL

SEQ ID NO: 1965499 - protein, 9 aa, Staphylococcus
MGNNPVDPS

SEQ ID NO: 1965500 - protein, 10 aa, Staphylococcus
MGNSPGDLNA

SEQ ID NO: 1965501 - protein, 9 aa, Staphylococcus
MGNSPGGLE

SEQ ID NO: 1965502 - protein, 8 aa, Staphylococcus
MGPASDEM

SEQ ID NO: 1965503 - protein, 5 aa, Staphylococcus
MGPIQ

SEQ ID NO: 1965504 - protein, 8 aa, Staphylococcus
MGPKETLN

SEQ ID NO: 1965505 - protein, 5 aa, Staphylococcus
MGPSY

SEQ ID NO: 1965506 - protein, 4 aa, Staphylococcus
MGQG

SEQ ID NO: 1965507 - protein, 7 aa, Staphylococcus
MGQPEEI

SEQ ID NO: 1965508 - protein, 7 aa, Staphylococcus
MGQPVEH

SEQ ID NO: 1965509 - protein, 10 aa, Staphylococcus
MGRGITGGNG

SEQ ID NO: 1965510 - protein, 10 aa, Staphylococcus
MGRPGLPEEL

SEQ ID NO: 1965511 - protein, 10 aa, Staphylococcus
MGRSGQPVEL

SEQ ID NO: 1965512 - protein, 4 aa, Staphylococcus
MGSD

SEQ ID NO: 1965513 - protein, 17 aa, Staphylococcus
MGSGGQGVGILYKDRKS

SEQ ID NO: 1965514 - protein, 11 aa, Staphylococcus
MGSPNKEDEEA

SEQ ID NO: 1965515 - protein, 10 aa, Staphylococcus
MGSQTGREQM

SEQ ID NO: 1965516 - protein, 6 aa, Staphylococcus
MGSTLP

SEQ ID NO: 1965517 - protein, 6 aa, Staphylococcus
MGSTPY

SEQ ID NO: 1965518 - protein, 4 aa, Staphylococcus
MGTD

SEQ ID NO: 1965519 - protein, 11 aa, Staphylococcus
MGTDSGTAMNN

SEQ ID NO: 1965520 - protein, 8 aa, Staphylococcus
MGTGTQKV

SEQ ID NO: 1965521 - protein, 4 aa, Staphylococcus
MGTL

SEQ ID NO: 1965522 - protein, 9 aa, Staphylococcus
MGTRSGNID

SEQ ID NO: 1965523 - protein, 10 aa, Staphylococcus
MGTRSGNIDP

SEQ ID NO: 1965524 - protein, 9 aa, Staphylococcus
MGTRSGNLD

SEQ ID NO: 1965525 - protein, 10 aa, Staphylococcus
MGTRSGNLDP

SEQ ID NO: 1965526 - protein, 5 aa, Staphylococcus
MGYEG

SEQ ID NO: 1965527 - protein, 10 aa, Staphylococcus
MGYSKSSVDT

SEQ ID NO: 1965528 - protein, 15 aa, Staphylococcus
MGYTGSPDLKTLRDE

SEQ ID NO: 1965529 - protein, 8 aa, Staphylococcus
MGYTGSPN

SEQ ID NO: 1965530 - protein, 8 aa, Staphylococcus
MHEDGIDE

SEQ ID NO: 1965531 - protein, 11 aa, Staphylococcus
MHEGPAPASQL

SEQ ID NO: 1965532 - protein, 5 aa, Staphylococcus
MHPKN

SEQ ID NO: 1965533 - protein, 4 aa, Staphylococcus
MHQT

SEQ ID NO: 1965534 - protein, 10 aa, Staphylococcus
MHQTEQQIKN

SEQ ID NO: 1965535 - protein, 4 aa, Staphylococcus
MHSG

SEQ ID NO: 1965536 - protein, 19 aa, Staphylococcus
MHSGSVDDKIQINNPKDAA

SEQ ID NO: 1965537 - protein, 5 aa, Staphylococcus
MIADP

SEQ ID NO: 1965538 - protein, 6 aa, Staphylococcus
MIADPE

SEQ ID NO: 1965539 - protein, 5 aa, Staphylococcus
MIEDK

SEQ ID NO: 1965540 - protein, 5 aa, Staphylococcus
MIEDQ

SEQ ID NO: 1965541 - protein, 5 aa, Staphylococcus
MIGTG

SEQ ID NO: 1965542 - protein, 9 aa, Staphylococcus
MIKKSNQSL

SEQ ID NO: 1965543 - protein, 5 aa, Staphylococcus
MIQSS

SEQ ID NO: 1965544 - protein, 10 aa, Staphylococcus
MIRGGEPENM

SEQ ID NO: 1965545 - protein, 12 aa, Staphylococcus
MISDSSMKPDDI

SEQ ID NO: 1965546 - protein, 10 aa, Staphylococcus
MITGGTEAPI

SEQ ID NO: 1965547 - protein, 6 aa, Staphylococcus
MKAEGY

SEQ ID NO: 1965548 - protein, 17 aa, Staphylococcus
MKAESPVEYAEGEKVNY

SEQ ID NO: 1965549 - protein, 7 aa, Staphylococcus
MKARNIK

SEQ ID NO: 1965550 - protein, 7 aa, Staphylococcus
MKARNVN

SEQ ID NO: 1965551 - protein, 5 aa, Staphylococcus
MKATG

SEQ ID NO: 1965552 - protein, 6 aa, Staphylococcus
MKATGE

SEQ ID NO: 1965553 - protein, 5 aa, Staphylococcus
MKDEP

SEQ ID NO: 1965554 - protein, 15 aa, Staphylococcus
MKDESKEDHDDEPIE

SEQ ID NO: 1965555 - protein, 7 aa, Staphylococcus
MKDESRP

SEQ ID NO: 1965556 - protein, 4 aa, Staphylococcus
MKDG

SEQ ID NO: 1965557 - protein, 11 aa, Staphylococcus
MKDGGPKDSTI

SEQ ID NO: 1965558 - protein, 20 aa, Staphylococcus
MKDGSAEESTSITLDNDDFD

SEQ ID NO: 1965559 - protein, 11 aa, Staphylococcus
MKDGSAQDHTS

SEQ ID NO: 1965560 - protein, 20 aa, Staphylococcus
MKDGTDENGKEYKKYRNDEN

SEQ ID NO: 1965561 - protein, 8 aa, Staphylococcus
MKDKRAKL

SEQ ID NO: 1965562 - protein, 5 aa, Staphylococcus
MKDME

SEQ ID NO: 1965563 - protein, 5 aa, Staphylococcus
MKDPN

SEQ ID NO: 1965564 - protein, 10 aa, Staphylococcus
MKDPNLNKSS

SEQ ID NO: 1965565 - protein, 8 aa, Staphylococcus
MKDSPHPS

SEQ ID NO: 1965566 - protein, 5 aa, Staphylococcus
MKEAS

SEQ ID NO: 1965567 - protein, 9 aa, Staphylococcus
MKEGTASDS

SEQ ID NO: 1965568 - protein, 7 aa, Staphylococcus
MKEKEDI

SEQ ID NO: 1965569 - protein, 7 aa, Staphylococcus
MKEKEEV

SEQ ID NO: 1965570 - protein, 5 aa, Staphylococcus
MKEKQ

SEQ ID NO: 1965571 - protein, 6 aa, Staphylococcus
MKEKQR

SEQ ID NO: 1965572 - protein, 19 aa, Staphylococcus
MKEQRGPLEGDSEYNDNNR

SEQ ID NO: 1965573 - protein, 7 aa, Staphylococcus
MKERNIN

SEQ ID NO: 1965574 - protein, 17 aa, Staphylococcus
MKERSKYQLSDNEDLVD

SEQ ID NO: 1965575 - protein, 7 aa, Staphylococcus
MKESADI

SEQ ID NO: 1965576 - protein, 6 aa, Staphylococcus
MKESAK

SEQ ID NO: 1965577 - protein, 7 aa, Staphylococcus
MKETSVE

SEQ ID NO: 1965578 - protein, 17 aa, Staphylococcus
MKGTIARGKTKAEDQLN

SEQ ID NO: 1965579 - protein, 19 aa, Staphylococcus
MKGTMPRGETNKEDQQNYH

SEQ ID NO: 1965580 - protein, 14 aa, Staphylococcus
MKGTMPRGHNEADD

SEQ ID NO: 1965581 - protein, 16 aa, Staphylococcus
MKGTMPRGKTSVEDQL

SEQ ID NO: 1965582 - protein, 17 aa, Staphylococcus
MKGTMPRGRTIEEDETL

SEQ ID NO: 1965583 - protein, 10 aa, Staphylococcus
MKGYEGTQAK

SEQ ID NO: 1965584 - protein, 5 aa, Staphylococcus
MKHDD

SEQ ID NO: 1965585 - protein, 14 aa, Staphylococcus
MKKDEMEKNYQDVT

SEQ ID NO: 1965586 - protein, 10 aa, Staphylococcus
MKKEDDNLNG

SEQ ID NO: 1965587 - protein, 5 aa, Staphylococcus
MKKKA

SEQ ID NO: 1965588 - protein, 12 aa, Staphylococcus
MKKKKEKPTKMV

SEQ ID NO: 1965589 - protein, 9 aa, Staphylococcus
MKKKQESVQ

SEQ ID NO: 1965590 - protein, 5 aa, Staphylococcus
MKKLP

SEQ ID NO: 1965591 - protein, 7 aa, Staphylococcus
MKKRTGV

SEQ ID NO: 1965592 - protein, 10 aa, Staphylococcus
MKKSEAEHKS

SEQ ID NO: 1965593 - protein, 8 aa, Staphylococcus
MKKSEAER

SEQ ID NO: 1965594 - protein, 9 aa, Staphylococcus
MKKSIENLS

SEQ ID NO: 1965595 - protein, 9 aa, Staphylococcus
MKKSIESLS

SEQ ID NO: 1965596 - protein, 4 aa, Staphylococcus
MKND

SEQ ID NO: 1965597 - protein, 5 aa, Staphylococcus
MKNDG

SEQ ID NO: 1965598 - protein, 8 aa, Staphylococcus
MKNETEKH

SEQ ID NO: 1965599 - protein, 5 aa, Staphylococcus
MKNGS

SEQ ID NO: 1965600 - protein, 9 aa, Staphylococcus
MKNNGITSS

SEQ ID NO: 1965601 - protein, 8 aa, Staphylococcus
MKNNGITT

SEQ ID NO: 1965602 - protein, 21 aa, Staphylococcus
MKPGQTGQEAYNESFYGGIFR

SEQ ID NO: 1965603 - protein, 28 aa, Staphylococcus
MKPKKAIKQVAEDRNMKTGEVYDIYHQI

SEQ ID NO: 1965604 - protein, 8 aa, Staphylococcus
MKPSTNSY

SEQ ID NO: 1965605 - protein, 8 aa, Staphylococcus
MKQDGNKA

SEQ ID NO: 1965606 - protein, 9 aa, Staphylococcus
MKQKDSEKV

SEQ ID NO: 1965607 - protein, 9 aa, Staphylococcus
MKQKDTETV

SEQ ID NO: 1965608 - protein, 4 aa, Staphylococcus
MKQR

SEQ ID NO: 1965609 - protein, 7 aa, Staphylococcus
MKQSREK

SEQ ID NO: 1965610 - protein, 10 aa, Staphylococcus
MKQSSAGVDV

SEQ ID NO: 1965611 - protein, 8 aa, Staphylococcus
MKRDMQNG

SEQ ID NO: 1965612 - protein, 4 aa, Staphylococcus
MKRG

SEQ ID NO: 1965613 - protein, 22 aa, Staphylococcus
MKRQERKQFSKRQNRQNRKSRK

SEQ ID NO: 1965614 - protein, 8 aa, Staphylococcus
MKRTAKQA

SEQ ID NO: 1965615 - protein, 11 aa, Staphylococcus
MKRTINGKRPH

SEQ ID NO: 1965616 - protein, 4 aa, Staphylococcus
MKSE

SEQ ID NO: 1965617 - protein, 9 aa, Staphylococcus
MKSKKAKLH

SEQ ID NO: 1965618 - protein, 9 aa, Staphylococcus
MKSNPNDLV

SEQ ID NO: 1965619 - protein, 29 aa, Staphylococcus
MKTDQKQPEEPATPETHQHQNVDNPGGIE

SEQ ID NO: 1965620 - protein, 4 aa, Staphylococcus
MKTG

SEQ ID NO: 1965621 - protein, 9 aa, Staphylococcus
MKTKENKGK

SEQ ID NO: 1965622 - protein, 9 aa, Staphylococcus
MKTKKGPVV

SEQ ID NO: 1965623 - protein, 7 aa, Staphylococcus
MKTREHE

SEQ ID NO: 1965624 - protein, 8 aa, Staphylococcus
MKTREREL

SEQ ID NO: 1965625 - protein, 4 aa, Staphylococcus
MKVD

SEQ ID NO: 1965626 - protein, 5 aa, Staphylococcus
MLADP

SEQ ID NO: 1965627 - protein, 8 aa, Staphylococcus
MLDPAGRK

SEQ ID NO: 1965628 - protein, 9 aa, Staphylococcus
MLDPEGKAS

SEQ ID NO: 1965629 - protein, 9 aa, Staphylococcus
MLDPNAKAS

SEQ ID NO: 1965630 - protein, 9 aa, Staphylococcus
MLDPQAKKS

SEQ ID NO: 1965631 - protein, 9 aa, Staphylococcus
MLDPQGKQS

SEQ ID NO: 1965632 - protein, 13 aa, Staphylococcus
MLEGSAEEAHQFG

SEQ ID NO: 1965633 - protein, 4 aa, Staphylococcus
MLND

SEQ ID NO: 1965634 - protein, 11 aa, Staphylococcus
MLNPTSNIEKT

SEQ ID NO: 1965635 - protein, 10 aa, Staphylococcus
MLNPTSNIEQ

SEQ ID NO: 1965636 - protein, 7 aa, Staphylococcus
MLSKTQR

SEQ ID NO: 1965637 - protein, 4 aa, Staphylococcus
MMSP

SEQ ID NO: 1965638 - protein, 10 aa, Staphylococcus
MNADTDGLAG

SEQ ID NO: 1965639 - protein, 11 aa, Staphylococcus
MNAEDQKVPQQ

SEQ ID NO: 1965640 - protein, 12 aa, Staphylococcus
MNATEKYGTEAV

SEQ ID NO: 1965641 - protein, 4 aa, Staphylococcus
MNDA

SEQ ID NO: 1965642 - protein, 5 aa, Staphylococcus
MNDAG

SEQ ID NO: 1965643 - protein, 9 aa, Staphylococcus
MNDDKARAK

SEQ ID NO: 1965644 - protein, 9 aa, Staphylococcus
MNDDKERAK

SEQ ID NO: 1965645 - protein, 9 aa, Staphylococcus
MNDNDATVQ

SEQ ID NO: 1965646 - protein, 11 aa, Staphylococcus
MNDSKNKKQAF

SEQ ID NO: 1965647 - protein, 15 aa, Staphylococcus
MNDVGGDINKINPEV

SEQ ID NO: 1965648 - protein, 15 aa, Staphylococcus
MNDVGGDLNKINPEV

SEQ ID NO: 1965649 - protein, 9 aa, Staphylococcus
MNEDKAKAQ

SEQ ID NO: 1965650 - protein, 9 aa, Staphylococcus
MNEDKDQAK

SEQ ID NO: 1965651 - protein, 7 aa, Staphylococcus
MNEDSKA

SEQ ID NO: 1965652 - protein, 6 aa, Staphylococcus
MNEEDE

SEQ ID NO: 1965653 - protein, 11 aa, Staphylococcus
MNEEDEKEMFG

SEQ ID NO: 1965654 - protein, 12 aa, Staphylococcus
MNEEDEKEMFGR

SEQ ID NO: 1965655 - protein, 12 aa, Staphylococcus
MNEEDEKKMFGR

SEQ ID NO: 1965656 - protein, 4 aa, Staphylococcus
MNEN

SEQ ID NO: 1965657 - protein, 20 aa, Staphylococcus
MNEPKQVERKPQNAKNRYYG

SEQ ID NO: 1965658 - protein, 4 aa, Staphylococcus
MNEQ

SEQ ID NO: 1965659 - protein, 12 aa, Staphylococcus
MNEQDEKQMFGR

SEQ ID NO: 1965660 - protein, 12 aa, Staphylococcus
MNEQQNKADYTL

SEQ ID NO: 1965661 - protein, 6 aa, Staphylococcus
MNESED

SEQ ID NO: 1965662 - protein, 4 aa, Staphylococcus
MNGE

SEQ ID NO: 1965663 - protein, 11 aa, Staphylococcus
MNGGEQSTSTS

SEQ ID NO: 1965664 - protein, 6 aa, Staphylococcus
MNGQNN

SEQ ID NO: 1965665 - protein, 9 aa, Staphylococcus
MNKDESTTY

SEQ ID NO: 1965666 - protein, 9 aa, Staphylococcus
MNKDKEKAK

SEQ ID NO: 1965667 - protein, 31 aa, Staphylococcus
MNKNTSTESESKSTANTKSKDKIDGNSTGEF

SEQ ID NO: 1965668 - protein, 9 aa, Staphylococcus
MNKPNGDIE

SEQ ID NO: 1965669 - protein, 9 aa, Staphylococcus
MNKSIENLS

SEQ ID NO: 1965670 - protein, 9 aa, Staphylococcus
MNNDKEKAK

SEQ ID NO: 1965671 - protein, 4 aa, Staphylococcus
MNNE

SEQ ID NO: 1965672 - protein, 20 aa, Staphylococcus
MNNEDSLENNPFKDALKNLK

SEQ ID NO: 1965673 - protein, 9 aa, Staphylococcus
MNNETSKTD

SEQ ID NO: 1965674 - protein, 16 aa, Staphylococcus
MNNKGEVLKNSRENET

SEQ ID NO: 1965675 - protein, 8 aa, Staphylococcus
MNNPEKER

SEQ ID NO: 1965676 - protein, 11 aa, Staphylococcus
MNNSSKKVKSN

SEQ ID NO: 1965677 - protein, 13 aa, Staphylococcus
MNNTKKHANTNEI

SEQ ID NO: 1965678 - protein, 52 aa, Staphylococcus
MNNTNSNNFTSTSEVTSQSESSVAQESELNRPTTQSHSKDVSTHKPRFAGSK

SEQ ID NO: 1965679 - protein, 6 aa, Staphylococcus
MNPDTR

SEQ ID NO: 1965680 - protein, 4 aa, Staphylococcus
MNPK

SEQ ID NO: 1965681 - protein, 12 aa, Staphylococcus
MNPKYDQDNRTA

SEQ ID NO: 1965682 - protein, 5 aa, Staphylococcus
MNPND

SEQ ID NO: 1965683 - protein, 52 aa, Staphylococcus
MNPNDHPHGGGEGRAPIGRPSPMSPWGKPTLGKKTRRGKKASDKLIVRGRKR

SEQ ID NO: 1965684 - protein, 5 aa, Staphylococcus
MNPSD

SEQ ID NO: 1965685 - protein, 4 aa, Staphylococcus
MNQE

SEQ ID NO: 1965686 - protein, 11 aa, Staphylococcus
MNQESTPIRPE

SEQ ID NO: 1965687 - protein, 13 aa, Staphylococcus
MNQPPSKSNGKNV

SEQ ID NO: 1965688 - protein, 4 aa, Staphylococcus
MNQR

SEQ ID NO: 1965689 - protein, 11 aa, Staphylococcus
MNQTVGTANKI

SEQ ID NO: 1965690 - protein, 5 aa, Staphylococcus
MNRDN

SEQ ID NO: 1965691 - protein, 5 aa, Staphylococcus
MNREN

SEQ ID NO: 1965692 - protein, 4 aa, Staphylococcus
MNRQ

SEQ ID NO: 1965693 - protein, 5 aa, Staphylococcus
MNRVG

SEQ ID NO: 1965694 - protein, 12 aa, Staphylococcus
MNSDNEVSAETK

SEQ ID NO: 1965695 - protein, 10 aa, Staphylococcus
MNSDSSPYQQ

SEQ ID NO: 1965696 - protein, 12 aa, Staphylococcus
MNSENQVSPETQ

SEQ ID NO: 1965697 - protein, 8 aa, Staphylococcus
MNSHTKQS

SEQ ID NO: 1965698 - protein, 13 aa, Staphylococcus
MNSTLDQLEALLN

SEQ ID NO: 1965699 - protein, 6 aa, Staphylococcus
MNSTNE

SEQ ID NO: 1965700 - protein, 7 aa, Staphylococcus
MNSTRSG

SEQ ID NO: 1965701 - protein, 4 aa, Staphylococcus
MNTD

SEQ ID NO: 1965702 - protein, 9 aa, Staphylococcus
MNTGTEAVE

SEQ ID NO: 1965703 - protein, 10 aa, Staphylococcus
MNTPIQGSAA

SEQ ID NO: 1965704 - protein, 16 aa, Staphylococcus
MNTSEDKINHELEDGT

SEQ ID NO: 1965705 - protein, 8 aa, Staphylococcus
MPAAQRPR

SEQ ID NO: 1965706 - protein, 9 aa, Staphylococcus
MPADEKDDV

SEQ ID NO: 1965707 - protein, 8 aa, Staphylococcus
MPAEEKDE

SEQ ID NO: 1965708 - protein, 12 aa, Staphylococcus
MPDAEKDKRGID

SEQ ID NO: 1965709 - protein, 11 aa, Staphylococcus
MPDEEKDKRGI

SEQ ID NO: 1965710 - protein, 12 aa, Staphylococcus
MPDEEKDKRGID

SEQ ID NO: 1965711 - protein, 7 aa, Staphylococcus
MPDITTN

SEQ ID NO: 1965712 - protein, 9 aa, Staphylococcus
MPDITTSKY

SEQ ID NO: 1965713 - protein, 12 aa, Staphylococcus
MPDNNQEDERIK

SEQ ID NO: 1965714 - protein, 6 aa, Staphylococcus
MPEAAG

SEQ ID NO: 1965715 - protein, 5 aa, Staphylococcus
MPEDR

SEQ ID NO: 1965716 - protein, 4 aa, Staphylococcus
MPEG

SEQ ID NO: 1965717 - protein, 18 aa, Staphylococcus
MPEGPQYYPDGQISDHPE

SEQ ID NO: 1965718 - protein, 5 aa, Staphylococcus
MPEGT

SEQ ID NO: 1965719 - protein, 11 aa, Staphylococcus
MPEKEDGWSGA

SEQ ID NO: 1965720 - protein, 4 aa, Staphylococcus
MPES

SEQ ID NO: 1965721 - protein, 9 aa, Staphylococcus
MPESESLKD

SEQ ID NO: 1965722 - protein, 9 aa, Staphylococcus
MPETDTQSV

SEQ ID NO: 1965723 - protein, 6 aa, Staphylococcus
MPEVKG

SEQ ID NO: 1965724 - protein, 20 aa, Staphylococcus
MPGGQYSNLSQQAKSLGLGE

SEQ ID NO: 1965725 - protein, 21 aa, Staphylococcus
MPGGQYSNLSQQAKSLGLGER

SEQ ID NO: 1965726 - protein, 21 aa, Staphylococcus
MPGGQYSNLSQQAKSLGLGGR

SEQ ID NO: 1965727 - protein, 10 aa, Staphylococcus
MPGGVNSPVR

SEQ ID NO: 1965728 - protein, 9 aa, Staphylococcus
MPGQPDYSI

SEQ ID NO: 1965729 - protein, 11 aa, Staphylococcus
MPGRMGGNTVT

SEQ ID NO: 1965730 - protein, 17 aa, Staphylococcus
MPGTTTANYKKNFYSEA

SEQ ID NO: 1965731 - protein, 6 aa, Staphylococcus
MPGTVS

SEQ ID NO: 1965732 - protein, 4 aa, Staphylococcus
MPHG

SEQ ID NO: 1965733 - protein, 9 aa, Staphylococcus
MPHGDPDKV

SEQ ID NO: 1965734 - protein, 5 aa, Staphylococcus
MPKDD

SEQ ID NO: 1965735 - protein, 6 aa, Staphylococcus
MPKKTG

SEQ ID NO: 1965736 - protein, 5 aa, Staphylococcus
MPKNE

SEQ ID NO: 1965737 - protein, 5 aa, Staphylococcus
MPKRE

SEQ ID NO: 1965738 - protein, 8 aa, Staphylococcus
MPKREEGF

SEQ ID NO: 1965739 - protein, 7 aa, Staphylococcus
MPKVGPK

SEQ ID NO: 1965740 - protein, 14 aa, Staphylococcus
MPNNSRLVGQGKDI

SEQ ID NO: 1965741 - protein, 4 aa, Staphylococcus
MPNQ

SEQ ID NO: 1965742 - protein, 14 aa, Staphylococcus
MPNTAPLANLESPK

SEQ ID NO: 1965743 - protein, 8 aa, Staphylococcus
MPPGESEL

SEQ ID NO: 1965744 - protein, 20 aa, Staphylococcus
MPPHQSVKRGTIQVKRDGSP

SEQ ID NO: 1965745 - protein, 5 aa, Staphylococcus
MPPKS

SEQ ID NO: 1965746 - protein, 19 aa, Staphylococcus
MPQDKPVISSHEKNSDSYL

SEQ ID NO: 1965747 - protein, 15 aa, Staphylococcus
MPQPLSSSSLITDEE

SEQ ID NO: 1965748 - protein, 7 aa, Staphylococcus
MPQPSSR

SEQ ID NO: 1965749 - protein, 7 aa, Staphylococcus
MPQQEEI

SEQ ID NO: 1965750 - protein, 6 aa, Staphylococcus
MPREKQ

SEQ ID NO: 1965751 - protein, 9 aa, Staphylococcus
MPRSEDKSA

SEQ ID NO: 1965752 - protein, 5 aa, Staphylococcus
MPRSG

SEQ ID NO: 1965753 - protein, 6 aa, Staphylococcus
MPRSSH

SEQ ID NO: 1965754 - protein, 10 aa, Staphylococcus
MPRTTNGNIH

SEQ ID NO: 1965755 - protein, 28 aa, Staphylococcus
MPSALRETGRGGLAGTPTGQRLKQKIFG

SEQ ID NO: 1965756 - protein, 7 aa, Staphylococcus
MPSDTGL

SEQ ID NO: 1965757 - protein, 4 aa, Staphylococcus
MPSL

SEQ ID NO: 1965758 - protein, 11 aa, Staphylococcus
MPSLSDDQFEN

SEQ ID NO: 1965759 - protein, 4 aa, Staphylococcus
MPSN

SEQ ID NO: 1965760 - protein, 7 aa, Staphylococcus
MPSPGQI

SEQ ID NO: 1965761 - protein, 8 aa, Staphylococcus
MPSSGESC

SEQ ID NO: 1965762 - protein, 6 aa, Staphylococcus
MPSTAR

SEQ ID NO: 1965763 - protein, 8 aa, Staphylococcus
MPSTGESC

SEQ ID NO: 1965764 - protein, 5 aa, Staphylococcus
MPTAQ

SEQ ID NO: 1965765 - protein, 4 aa, Staphylococcus
MPTL

SEQ ID NO: 1965766 - protein, 9 aa, Staphylococcus
MPTTTNGNI

SEQ ID NO: 1965767 - protein, 5 aa, Staphylococcus
MPTVE

SEQ ID NO: 1965768 - protein, 10 aa, Staphylococcus
MPYGESPSII

SEQ ID NO: 1965769 - protein, 19 aa, Staphylococcus
MPYPDKTHFETKGESKSIA

SEQ ID NO: 1965770 - protein, 16 aa, Staphylococcus
MQAATKPGVTTKELDD

SEQ ID NO: 1965771 - protein, 10 aa, Staphylococcus
MQAGASKQGI

SEQ ID NO: 1965772 - protein, 17 aa, Staphylococcus
MQDDQNRTVNGKRPHYQ

SEQ ID NO: 1965773 - protein, 4 aa, Staphylococcus
MQDE

SEQ ID NO: 1965774 - protein, 4 aa, Staphylococcus
MQDG

SEQ ID NO: 1965775 - protein, 5 aa, Staphylococcus
MQDPD

SEQ ID NO: 1965776 - protein, 5 aa, Staphylococcus
MQEEG

SEQ ID NO: 1965777 - protein, 4 aa, Staphylococcus
MQEG

SEQ ID NO: 1965778 - protein, 8 aa, Staphylococcus
MQEGPMGE

SEQ ID NO: 1965779 - protein, 17 aa, Staphylococcus
MQEKDDDDIEVQRTSEY

SEQ ID NO: 1965780 - protein, 7 aa, Staphylococcus
MQGENGK

SEQ ID NO: 1965781 - protein, 7 aa, Staphylococcus
MQGGSTI

SEQ ID NO: 1965782 - protein, 9 aa, Staphylococcus
MQGNPNQPV

SEQ ID NO: 1965783 - protein, 8 aa, Staphylococcus
MQGNSSDL

SEQ ID NO: 1965784 - protein, 26 aa, Staphylococcus
MQGSAPKPEAQAESAEEEKEEVPAKA

SEQ ID NO: 1965785 - protein, 20 aa, Staphylococcus
MQKQRDRARQARQKSESMQI

SEQ ID NO: 1965786 - protein, 9 aa, Staphylococcus
MQKSIDNLS

SEQ ID NO: 1965787 - protein, 10 aa, Staphylococcus
MQLNENKKRY

SEQ ID NO: 1965788 - protein, 13 aa, Staphylococcus
MQNENKSDKQLKK

SEQ ID NO: 1965789 - protein, 10 aa, Staphylococcus
MQNNEKHSSI

SEQ ID NO: 1965790 - protein, 5 aa, Staphylococcus
MQNSD

SEQ ID NO: 1965791 - protein, 4 aa, Staphylococcus
MQPD

SEQ ID NO: 1965792 - protein, 21 aa, Staphylococcus
MQPDGSKKYIKKDEVRRKTDG

SEQ ID NO: 1965793 - protein, 9 aa, Staphylococcus
MQPGVNAPP

SEQ ID NO: 1965794 - protein, 10 aa, Staphylococcus
MQPKTIKQED

SEQ ID NO: 1965795 - protein, 7 aa, Staphylococcus
MQPQSTD

SEQ ID NO: 1965796 - protein, 4 aa, Staphylococcus
MQPT

SEQ ID NO: 1965797 - protein, 11 aa, Staphylococcus
MQPVQPPTDKL

SEQ ID NO: 1965798 - protein, 11 aa, Staphylococcus
MQPVQPPTDNL

SEQ ID NO: 1965799 - protein, 10 aa, Staphylococcus
MQPVQPPTND

SEQ ID NO: 1965800 - protein, 5 aa, Staphylococcus
MQQQG

SEQ ID NO: 1965801 - protein, 7 aa, Staphylococcus
MQSRKND

SEQ ID NO: 1965802 - protein, 10 aa, Staphylococcus
MRAGETDKSI

SEQ ID NO: 1965803 - protein, 8 aa, Staphylococcus
MRDTSQHI

SEQ ID NO: 1965804 - protein, 4 aa, Staphylococcus
MREA

SEQ ID NO: 1965805 - protein, 6 aa, Staphylococcus
MREAQG

SEQ ID NO: 1965806 - protein, 11 aa, Staphylococcus
MREDGSEFDKD

SEQ ID NO: 1965807 - protein, 7 aa, Staphylococcus
MREEPED

SEQ ID NO: 1965808 - protein, 9 aa, Staphylococcus
MRENPSIKK

SEQ ID NO: 1965809 - protein, 6 aa, Staphylococcus
MREQHR

SEQ ID NO: 1965810 - protein, 5 aa, Staphylococcus
MRGPG

SEQ ID NO: 1965811 - protein, 5 aa, Staphylococcus
MRIGS

SEQ ID NO: 1965812 - protein, 11 aa, Staphylococcus
MRKQYDKDTFN

SEQ ID NO: 1965813 - protein, 9 aa, Staphylococcus
MRKSSEDHE

SEQ ID NO: 1965814 - protein, 5 aa, Staphylococcus
MRNKL

SEQ ID NO: 1965815 - protein, 5 aa, Staphylococcus
MRNNI

SEQ ID NO: 1965816 - protein, 5 aa, Staphylococcus
MRPKK

SEQ ID NO: 1965817 - protein, 15 aa, Staphylococcus
MRPTAKKLTKIITKE

SEQ ID NO: 1965818 - protein, 4 aa, Staphylococcus
MRPY

SEQ ID NO: 1965819 - protein, 5 aa, Staphylococcus
MRQEP

SEQ ID NO: 1965820 - protein, 14 aa, Staphylococcus
MRQTRKNKDDHLTN

SEQ ID NO: 1965821 - protein, 4 aa, Staphylococcus
MRSE

SEQ ID NO: 1965822 - protein, 13 aa, Staphylococcus
MRSRKYDKDGQTH

SEQ ID NO: 1965823 - protein, 12 aa, Staphylococcus
MRSRKYEKEGQT

SEQ ID NO: 1965824 - protein, 13 aa, Staphylococcus
MRSRKYEKEKQTH

SEQ ID NO: 1965825 - protein, 12 aa, Staphylococcus
MRSRKYTKDQQT

SEQ ID NO: 1965826 - protein, 12 aa, Staphylococcus
MRTGEGKTLTAT

SEQ ID NO: 1965827 - protein, 8 aa, Staphylococcus
MRTNKEDF

SEQ ID NO: 1965828 - protein, 5 aa, Staphylococcus
MRTSY

SEQ ID NO: 1965829 - protein, 24 aa, Staphylococcus
MRTSYENQRAHKYDSKLTGERVNG

SEQ ID NO: 1965830 - protein, 10 aa, Staphylococcus
MRVTTQEELE

SEQ ID NO: 1965831 - protein, 8 aa, Staphylococcus
MRYQDSGN

SEQ ID NO: 1965832 - protein, 6 aa, Staphylococcus
MRYRSN

SEQ ID NO: 1965833 - protein, 9 aa, Staphylococcus
MSADEKDDV

SEQ ID NO: 1965834 - protein, 4 aa, Staphylococcus
MSAQ

SEQ ID NO: 1965835 - protein, 11 aa, Staphylococcus
MSAQTGPDQLE

SEQ ID NO: 1965836 - protein, 11 aa, Staphylococcus
MSAQTGPEQLE

SEQ ID NO: 1965837 - protein, 11 aa, Staphylococcus
MSDEAEQQFNS

SEQ ID NO: 1965838 - protein, 7 aa, Staphylococcus
MSDKDID

SEQ ID NO: 1965839 - protein, 6 aa, Staphylococcus
MSDNDI

SEQ ID NO: 1965840 - protein, 7 aa, Staphylococcus
MSDSEED

SEQ ID NO: 1965841 - protein, 7 aa, Staphylococcus
MSDVNST

SEQ ID NO: 1965842 - protein, 5 aa, Staphylococcus
MSEDE

SEQ ID NO: 1965843 - protein, 8 aa, Staphylococcus
MSEDPNDF

SEQ ID NO: 1965844 - protein, 7 aa, Staphylococcus
MSEIDST

SEQ ID NO: 1965845 - protein, 8 aa, Staphylococcus
MSELENNQ

SEQ ID NO: 1965846 - protein, 7 aa, Staphylococcus
MSENKEG

SEQ ID NO: 1965847 - protein, 15 aa, Staphylococcus
MSEQTEKLKELNNVD

SEQ ID NO: 1965848 - protein, 5 aa, Staphylococcus
MSERE

SEQ ID NO: 1965849 - protein, 7 aa, Staphylococcus
MSERKEK

SEQ ID NO: 1965850 - protein, 15 aa, Staphylococcus
MSETENPYGDGHAAE

SEQ ID NO: 1965851 - protein, 14 aa, Staphylococcus
MSETLGDSHNSPTV

SEQ ID NO: 1965852 - protein, 4 aa, Staphylococcus
MSEY

SEQ ID NO: 1965853 - protein, 6 aa, Staphylococcus
MSGEQS

SEQ ID NO: 1965854 - protein, 4 aa, Staphylococcus
MSGG

SEQ ID NO: 1965855 - protein, 8 aa, Staphylococcus
MSGGERQR

SEQ ID NO: 1965856 - protein, 12 aa, Staphylococcus
MSGLTSQPSANS

SEQ ID NO: 1965857 - protein, 6 aa, Staphylococcus
MSGNTI

SEQ ID NO: 1965858 - protein, 6 aa, Staphylococcus
MSGQEC

SEQ ID NO: 1965859 - protein, 7 aa, Staphylococcus
MSGQECA

SEQ ID NO: 1965860 - protein, 9 aa, Staphylococcus
MSGQECADE

SEQ ID NO: 1965861 - protein, 8 aa, Staphylococcus
MSGTGKSK

SEQ ID NO: 1965862 - protein, 10 aa, Staphylococcus
MSKADAKERA

SEQ ID NO: 1965863 - protein, 12 aa, Staphylococcus
MSKDNKSDKQLK

SEQ ID NO: 1965864 - protein, 7 aa, Staphylococcus
MSKDSYK

SEQ ID NO: 1965865 - protein, 14 aa, Staphylococcus
MSKEEKEKNYKEVT

SEQ ID NO: 1965866 - protein, 4 aa, Staphylococcus
MSKF

SEQ ID NO: 1965867 - protein, 8 aa, Staphylococcus
MSKGEGVA

SEQ ID NO: 1965868 - protein, 5 aa, Staphylococcus
MSKGG

SEQ ID NO: 1965869 - protein, 9 aa, Staphylococcus
MSKGTPQDT

SEQ ID NO: 1965870 - protein, 11 aa, Staphylococcus
MSKNAIKAKVE

SEQ ID NO: 1965871 - protein, 16 aa, Staphylococcus
MSKPAQSSDDAESKKV

SEQ ID NO: 1965872 - protein, 8 aa, Staphylococcus
MSKRTGNA

SEQ ID NO: 1965873 - protein, 10 aa, Staphylococcus
MSKSEAKNRA

SEQ ID NO: 1965874 - protein, 5 aa, Staphylococcus
MSKSI

SEQ ID NO: 1965875 - protein, 7 aa, Staphylococcus
MSNGKSG

SEQ ID NO: 1965876 - protein, 4 aa, Staphylococcus
MSNK

SEQ ID NO: 1965877 - protein, 7 aa, Staphylococcus
MSNKGEV

SEQ ID NO: 1965878 - protein, 8 aa, Staphylococcus
MSNKGEVL

SEQ ID NO: 1965879 - protein, 11 aa, Staphylococcus
MSNKGEVLQNS

SEQ ID NO: 1965880 - protein, 18 aa, Staphylococcus
MSNKGEVLQNSVENETIQ

SEQ ID NO: 1965881 - protein, 9 aa, Staphylococcus
MSNNPNEFI

SEQ ID NO: 1965882 - protein, 6 aa, Staphylococcus
MSNPES

SEQ ID NO: 1965883 - protein, 7 aa, Staphylococcus
MSNQQGK

SEQ ID NO: 1965884 - protein, 6 aa, Staphylococcus
MSPEER

SEQ ID NO: 1965885 - protein, 6 aa, Staphylococcus
MSPESF

SEQ ID NO: 1965886 - protein, 4 aa, Staphylococcus
MSPI

SEQ ID NO: 1965887 - protein, 5 aa, Staphylococcus
MSPKA

SEQ ID NO: 1965888 - protein, 18 aa, Staphylococcus
MSPKPDCGEESYEGHGRL

SEQ ID NO: 1965889 - protein, 6 aa, Staphylococcus
MSPLNS

SEQ ID NO: 1965890 - protein, 5 aa, Staphylococcus
MSPTS

SEQ ID NO: 1965891 - protein, 9 aa, Staphylococcus
MSQATDESA

SEQ ID NO: 1965892 - protein, 7 aa, Staphylococcus
MSQEGKV

SEQ ID NO: 1965893 - protein, 4 aa, Staphylococcus
MSQF

SEQ ID NO: 1965894 - protein, 7 aa, Staphylococcus
MSQGDSY

SEQ ID NO: 1965895 - protein, 4 aa, Staphylococcus
MSQK

SEQ ID NO: 1965896 - protein, 16 aa, Staphylococcus
MSQQNHSKLGLATGGT

SEQ ID NO: 1965897 - protein, 8 aa, Staphylococcus
MSQSGKTG

SEQ ID NO: 1965898 - protein, 4 aa, Staphylococcus
MSSA

SEQ ID NO: 1965899 - protein, 5 aa, Staphylococcus
MSSDY

SEQ ID NO: 1965900 - protein, 10 aa, Staphylococcus
MSSKDRKAKV

SEQ ID NO: 1965901 - protein, 14 aa, Staphylococcus
MSSNEKEKLESKVN

SEQ ID NO: 1965902 - protein, 8 aa, Staphylococcus
MSSSGKTG

SEQ ID NO: 1965903 - protein, 11 aa, Staphylococcus
MSTGETVKERI

SEQ ID NO: 1965904 - protein, 8 aa, Staphylococcus
MSTSGKTG

SEQ ID NO: 1965905 - protein, 8 aa, Staphylococcus
MSTTVTDG

SEQ ID NO: 1965906 - protein, 18 aa, Staphylococcus
MSVNTQNKRVKASQKEAL

SEQ ID NO: 1965907 - protein, 7 aa, Staphylococcus
MSVSPMS

SEQ ID NO: 1965908 - protein, 4 aa, Staphylococcus
MSYD

SEQ ID NO: 1965909 - protein, 23 aa, Staphylococcus
MSYKKTPILQDTQRTNLEEYEAN

SEQ ID NO: 1965910 - protein, 6 aa, Staphylococcus
MSYRGQ

SEQ ID NO: 1965911 - protein, 8 aa, Staphylococcus
MTASGKTG

SEQ ID NO: 1965912 - protein, 9 aa, Staphylococcus
MTATGKLAE

SEQ ID NO: 1965913 - protein, 4 aa, Staphylococcus
MTDD

SEQ ID NO: 1965914 - protein, 6 aa, Staphylococcus
MTDDNI

SEQ ID NO: 1965915 - protein, 11 aa, Staphylococcus
MTDEDEKEMFG

SEQ ID NO: 1965916 - protein, 9 aa, Staphylococcus
MTDENTDIG

SEQ ID NO: 1965917 - protein, 5 aa, Staphylococcus
MTDGT

SEQ ID NO: 1965918 - protein, 19 aa, Staphylococcus
MTDNPTYEDVKKGTTGHYE

SEQ ID NO: 1965919 - protein, 7 aa, Staphylococcus
MTDPMKG

SEQ ID NO: 1965920 - protein, 8 aa, Staphylococcus
MTDQQEAH

SEQ ID NO: 1965921 - protein, 10 aa, Staphylococcus
MTDSEIKEVN

SEQ ID NO: 1965922 - protein, 8 aa, Staphylococcus
MTEDKDKI

SEQ ID NO: 1965923 - protein, 5 aa, Staphylococcus
MTEGT

SEQ ID NO: 1965924 - protein, 4 aa, Staphylococcus
MTEN

SEQ ID NO: 1965925 - protein, 5 aa, Staphylococcus
MTENT

SEQ ID NO: 1965926 - protein, 5 aa, Staphylococcus
MTEQE

SEQ ID NO: 1965927 - protein, 8 aa, Staphylococcus
MTEQGSGK

SEQ ID NO: 1965928 - protein, 4 aa, Staphylococcus
MTER

SEQ ID NO: 1965929 - protein, 6 aa, Staphylococcus
MTEREL

SEQ ID NO: 1965930 - protein, 10 aa, Staphylococcus
MTERELKSKL

SEQ ID NO: 1965931 - protein, 6 aa, Staphylococcus
MTETDT

SEQ ID NO: 1965932 - protein, 7 aa, Staphylococcus
MTGAAPA

SEQ ID NO: 1965933 - protein, 6 aa, Staphylococcus
MTGQDT

SEQ ID NO: 1965934 - protein, 6 aa, Staphylococcus
MTGRRL

SEQ ID NO: 1965935 - protein, 4 aa, Staphylococcus
MTGY

SEQ ID NO: 1965936 - protein, 5 aa, Staphylococcus
MTGYQ

SEQ ID NO: 1965937 - protein, 12 aa, Staphylococcus
MTHGNKETYPQL

SEQ ID NO: 1965938 - protein, 12 aa, Staphylococcus
MTHGNPDTYPQV

SEQ ID NO: 1965939 - protein, 12 aa, Staphylococcus
MTHGNTDTYPQV

SEQ ID NO: 1965940 - protein, 19 aa, Staphylococcus
MTIQTATNKTIEQNQPYEK

SEQ ID NO: 1965941 - protein, 10 aa, Staphylococcus
MTKDDSVATS

SEQ ID NO: 1965942 - protein, 6 aa, Staphylococcus
MTKEKI

SEQ ID NO: 1965943 - protein, 4 aa, Staphylococcus
MTKK

SEQ ID NO: 1965944 - protein, 9 aa, Staphylococcus
MTKNGEIKK

SEQ ID NO: 1965945 - protein, 19 aa, Staphylococcus
MTKPETQSNETSESATNEL

SEQ ID NO: 1965946 - protein, 5 aa, Staphylococcus
MTKPG

SEQ ID NO: 1965947 - protein, 20 aa, Staphylococcus
MTKPHTQSDEISESTSNELS

SEQ ID NO: 1965948 - protein, 19 aa, Staphylococcus
MTKPNTTLNETETSATDEL

SEQ ID NO: 1965949 - protein, 20 aa, Staphylococcus
MTKPQTSSQESDKSASDELS

SEQ ID NO: 1965950 - protein, 6 aa, Staphylococcus
MTLPSN

SEQ ID NO: 1965951 - protein, 8 aa, Staphylococcus
MTNATDEA

SEQ ID NO: 1965952 - protein, 8 aa, Staphylococcus
MTNEPIAK

SEQ ID NO: 1965953 - protein, 6 aa, Staphylococcus
MTNMDG

SEQ ID NO: 1965954 - protein, 7 aa, Staphylococcus
MTNPQIT

SEQ ID NO: 1965955 - protein, 6 aa, Staphylococcus
MTNQGH

SEQ ID NO: 1965956 - protein, 4 aa, Staphylococcus
MTPE

SEQ ID NO: 1965957 - protein, 6 aa, Staphylococcus
MTPEEW

SEQ ID NO: 1965958 - protein, 5 aa, Staphylococcus
MTPET

SEQ ID NO: 1965959 - protein, 10 aa, Staphylococcus
MTPGLNAPPL

SEQ ID NO: 1965960 - protein, 7 aa, Staphylococcus
MTPGTNA

SEQ ID NO: 1965961 - protein, 26 aa, Staphylococcus
MTPHSSDDDDQYRSKSIKEGLKANDC

SEQ ID NO: 1965962 - protein, 25 aa, Staphylococcus
MTPHSSDDDDTYRSKEERDAFKTSD

SEQ ID NO: 1965963 - protein, 13 aa, Staphylococcus
MTPKDEIEEREEL

SEQ ID NO: 1965964 - protein, 14 aa, Staphylococcus
MTPKERSNPETLNV

SEQ ID NO: 1965965 - protein, 10 aa, Staphylococcus
MTPNERQDPA

SEQ ID NO: 1965966 - protein, 4 aa, Staphylococcus
MTPP

SEQ ID NO: 1965967 - protein, 19 aa, Staphylococcus
MTPPEASVSTYYPDKAQLK

SEQ ID NO: 1965968 - protein, 8 aa, Staphylococcus
MTPPESNV

SEQ ID NO: 1965969 - protein, 16 aa, Staphylococcus
MTPPETSVTRFTPDKE

SEQ ID NO: 1965970 - protein, 7 aa, Staphylococcus
MTPPPVK

SEQ ID NO: 1965971 - protein, 8 aa, Staphylococcus
MTPQSHSN

SEQ ID NO: 1965972 - protein, 10 aa, Staphylococcus
MTPSERANPA

SEQ ID NO: 1965973 - protein, 10 aa, Staphylococcus
MTPSERENPA

SEQ ID NO: 1965974 - protein, 30 aa, Staphylococcus
MTPSERNDPDTLNVSRKKRIAKGSGRSVQE

SEQ ID NO: 1965975 - protein, 4 aa, Staphylococcus
MTQE

SEQ ID NO: 1965976 - protein, 10 aa, Staphylococcus
MTQEEAETYV

SEQ ID NO: 1965977 - protein, 11 aa, Staphylococcus
MTQLNGNDAYQ

SEQ ID NO: 1965978 - protein, 18 aa, Staphylococcus
MTQQEAAEAFKAQANSTH

SEQ ID NO: 1965979 - protein, 10 aa, Staphylococcus
MTQSDANIEK

SEQ ID NO: 1965980 - protein, 8 aa, Staphylococcus
MTQSDDSI

SEQ ID NO: 1965981 - protein, 7 aa, Staphylococcus
MTQSDEN

SEQ ID NO: 1965982 - protein, 10 aa, Staphylococcus
MTQSDENIEK

SEQ ID NO: 1965983 - protein, 10 aa, Staphylococcus
MTQSTENINR

SEQ ID NO: 1965984 - protein, 11 aa, Staphylococcus
MTQSVGTANTI

SEQ ID NO: 1965985 - protein, 7 aa, Staphylococcus
MTRTEAS

SEQ ID NO: 1965986 - protein, 19 aa, Staphylococcus
MTSAATQAIANTNEPAYGT

SEQ ID NO: 1965987 - protein, 10 aa, Staphylococcus
MTSATTQAIA

SEQ ID NO: 1965988 - protein, 19 aa, Staphylococcus
MTSDETQAYADTDEPAYGT

SEQ ID NO: 1965989 - protein, 7 aa, Staphylococcus
MTSDGHR

SEQ ID NO: 1965990 - protein, 10 aa, Staphylococcus
MTSDPKGVPM

SEQ ID NO: 1965991 - protein, 5 aa, Staphylococcus
MTSGA

SEQ ID NO: 1965992 - protein, 7 aa, Staphylococcus
MTSGDKF

SEQ ID NO: 1965993 - protein, 7 aa, Staphylococcus
MTSIEEK

SEQ ID NO: 1965994 - protein, 4 aa, Staphylococcus
MTSQ

SEQ ID NO: 1965995 - protein, 7 aa, Staphylococcus
MTSSKAR

SEQ ID NO: 1965996 - protein, 8 aa, Staphylococcus
MTSYDERY

SEQ ID NO: 1965997 - protein, 7 aa, Staphylococcus
MTTDEWD

SEQ ID NO: 1965998 - protein, 19 aa, Staphylococcus
MTTGESENIQLDQLINYFK

SEQ ID NO: 1965999 - protein, 25 aa, Staphylococcus
MTTNNKDRETNHSQENSTEEEVNEN

SEQ ID NO: 1966000 - protein, 15 aa, Staphylococcus
MTTNSSTHDGHITQE

SEQ ID NO: 1966001 - protein, 15 aa, Staphylococcus
MTTNSSTKEGHITEE

SEQ ID NO: 1966002 - protein, 10 aa, Staphylococcus
MTTQKDIDNF

SEQ ID NO: 1966003 - protein, 12 aa, Staphylococcus
MTTRDKRDGEID

SEQ ID NO: 1966004 - protein, 12 aa, Staphylococcus
MTTRDKRQGEVD

SEQ ID NO: 1966005 - protein, 5 aa, Staphylococcus
MTTSE

SEQ ID NO: 1966006 - protein, 7 aa, Staphylococcus
MTTVPTD

SEQ ID NO: 1966007 - protein, 7 aa, Staphylococcus
MTYNNEE

SEQ ID NO: 1966008 - protein, 4 aa, Staphylococcus
MVDD

SEQ ID NO: 1966009 - protein, 4 aa, Staphylococcus
MVET

SEQ ID NO: 1966010 - protein, 14 aa, Staphylococcus
MVPSGKANHEMEGL

SEQ ID NO: 1966011 - protein, 5 aa, Staphylococcus
MVQES

SEQ ID NO: 1966012 - protein, 13 aa, Staphylococcus
MWNNSSSELHLAF

SEQ ID NO: 1966013 - protein, 16 aa, Staphylococcus
MYENRHKNIGKKRVDI

SEQ ID NO: 1966014 - protein, 16 aa, Staphylococcus
MYESSKERAKESQENL

SEQ ID NO: 1966015 - protein, 27 aa, Staphylococcus
MYKEKDSKAWEMANDDKKVAKKKKVKK

SEQ ID NO: 1966016 - protein, 11 aa, Staphylococcus
MYKGNEEIDGA

SEQ ID NO: 1966017 - protein, 11 aa, Staphylococcus
MYKGSDEIDGA

SEQ ID NO: 1966018 - protein, 11 aa, Staphylococcus
MYKGTDEIDGA

SEQ ID NO: 1966019 - protein, 12 aa, Staphylococcus
MYKGTDEIDGAS

SEQ ID NO: 1966020 - protein, 11 aa, Staphylococcus
MYKGTEEVDGA

SEQ ID NO: 1966021 - protein, 10 aa, Staphylococcus
MYTQGRPHPM

SEQ ID NO: 1966022 - protein, 7 aa, Staphylococcus
NAADGTR

SEQ ID NO: 1966023 - protein, 8 aa, Staphylococcus
NAAENGKQ

SEQ ID NO: 1966024 - protein, 7 aa, Staphylococcus
NAAKEAQ

SEQ ID NO: 1966025 - protein, 7 aa, Staphylococcus
NAAKNKG

SEQ ID NO: 1966026 - protein, 39 aa, Staphylococcus
NAANLRDKQSKLEKQYEDAKSEWKTSQGGQSTSLSKEDI

SEQ ID NO: 1966027 - protein, 38 aa, Staphylococcus
NAANLRDKQSKLEKQYEEAKNEWKNSQGGVSTALSEED

SEQ ID NO: 1966028 - protein, 40 aa, Staphylococcus
NAANLRDKQTKLEKQYEDAKNEWKTTQGDQSTSLSKEDIG

SEQ ID NO: 1966029 - protein, 38 aa, Staphylococcus
NAANLRDKQTKLEKQYEEAKNEWKNSQDGVSTSLSEED

SEQ ID NO: 1966030 - protein, 6 aa, Staphylococcus
NAANNQ

SEQ ID NO: 1966031 - protein, 6 aa, Staphylococcus
NAAPEV

SEQ ID NO: 1966032 - protein, 9 aa, Staphylococcus
NAAPLPGKI

SEQ ID NO: 1966033 - protein, 9 aa, Staphylococcus
NAATEGVIT

SEQ ID NO: 1966034 - protein, 4 aa, Staphylococcus
NACK

SEQ ID NO: 1966035 - protein, 5 aa, Staphylococcus
NACKN

SEQ ID NO: 1966036 - protein, 9 aa, Staphylococcus
NACPKSDGA

SEQ ID NO: 1966037 - protein, 13 aa, Staphylococcus
NACTGEKGMQDAL

SEQ ID NO: 1966038 - protein, 8 aa, Staphylococcus
NADDPTLR

SEQ ID NO: 1966039 - protein, 7 aa, Staphylococcus
NADEADR

SEQ ID NO: 1966040 - protein, 8 aa, Staphylococcus
NADEPGDL

SEQ ID NO: 1966041 - protein, 10 aa, Staphylococcus
NADEPGDSMK

SEQ ID NO: 1966042 - protein, 5 aa, Staphylococcus
NADET

SEQ ID NO: 1966043 - protein, 16 aa, Staphylococcus
NADETTQERLKSGYED

SEQ ID NO: 1966044 - protein, 8 aa, Staphylococcus
NADEYKQK

SEQ ID NO: 1966045 - protein, 6 aa, Staphylococcus
NADGEI

SEQ ID NO: 1966046 - protein, 12 aa, Staphylococcus
NADGEIKKSYDN

SEQ ID NO: 1966047 - protein, 6 aa, Staphylococcus
NADGRV

SEQ ID NO: 1966048 - protein, 6 aa, Staphylococcus
NADLDK

SEQ ID NO: 1966049 - protein, 7 aa, Staphylococcus
NADPTFN

SEQ ID NO: 1966050 - protein, 8 aa, Staphylococcus
NADPTFNE

SEQ ID NO: 1966051 - protein, 6 aa, Staphylococcus
NADQAH

SEQ ID NO: 1966052 - protein, 14 aa, Staphylococcus
NADQVNAGKKPVKD

SEQ ID NO: 1966053 - protein, 7 aa, Staphylococcus
NADSSYI

SEQ ID NO: 1966054 - protein, 10 aa, Staphylococcus
NADTQSEALD

SEQ ID NO: 1966055 - protein, 8 aa, Staphylococcus
NAEADAAT

SEQ ID NO: 1966056 - protein, 9 aa, Staphylococcus
NAEADAGSL

SEQ ID NO: 1966057 - protein, 9 aa, Staphylococcus
NAEDADTLS

SEQ ID NO: 1966058 - protein, 5 aa, Staphylococcus
NAEEA

SEQ ID NO: 1966059 - protein, 19 aa, Staphylococcus
NAEELDQNSGQTPGIPTGY

SEQ ID NO: 1966060 - protein, 15 aa, Staphylococcus
NAEEVEATEEDIDKE

SEQ ID NO: 1966061 - protein, 51 aa, Staphylococcus
NAEEVEQTDHTVNATETDDEASQADQSSEQNQQEEANNESEKIDPQEEKIN

SEQ ID NO: 1966062 - protein, 4 aa, Staphylococcus
NAEG

SEQ ID NO: 1966063 - protein, 9 aa, Staphylococcus
NAEGETDAE

SEQ ID NO: 1966064 - protein, 10 aa, Staphylococcus
NAEGKDNRVS

SEQ ID NO: 1966065 - protein, 5 aa, Staphylococcus
NAEGL

SEQ ID NO: 1966066 - protein, 6 aa, Staphylococcus
NAEGTI

SEQ ID NO: 1966067 - protein, 6 aa, Staphylococcus
NAEMEG

SEQ ID NO: 1966068 - protein, 5 aa, Staphylococcus
NAENA

SEQ ID NO: 1966069 - protein, 13 aa, Staphylococcus
NAENPEKKFQPCP

SEQ ID NO: 1966070 - protein, 16 aa, Staphylococcus
NAENPEKQFQPTPGKV

SEQ ID NO: 1966071 - protein, 16 aa, Staphylococcus
NAENPEKQFQPTPGTV

SEQ ID NO: 1966072 - protein, 16 aa, Staphylococcus
NAENPERKFQPSPGKV

SEQ ID NO: 1966073 - protein, 14 aa, Staphylococcus
NAEPGSHKKWADKM

SEQ ID NO: 1966074 - protein, 10 aa, Staphylococcus
NAEPSENATA

SEQ ID NO: 1966075 - protein, 5 aa, Staphylococcus
NAEQE

SEQ ID NO: 1966076 - protein, 9 aa, Staphylococcus
NAESGKSQI

SEQ ID NO: 1966077 - protein, 4 aa, Staphylococcus
NAET

SEQ ID NO: 1966078 - protein, 8 aa, Staphylococcus
NAETEEEC

SEQ ID NO: 1966079 - protein, 8 aa, Staphylococcus
NAETPQDI

SEQ ID NO: 1966080 - protein, 11 aa, Staphylococcus
NAETPQDIEAG

SEQ ID NO: 1966081 - protein, 12 aa, Staphylococcus
NAETREKTEKRM

SEQ ID NO: 1966082 - protein, 4 aa, Staphylococcus
NAEV

SEQ ID NO: 1966083 - protein, 5 aa, Staphylococcus
NAEVA

SEQ ID NO: 1966084 - protein, 5 aa, Staphylococcus
NAEVS

SEQ ID NO: 1966085 - protein, 5 aa, Staphylococcus
NAEVT

SEQ ID NO: 1966086 - protein, 19 aa, Staphylococcus
NAEYDENGNLISNTTKVKE

SEQ ID NO: 1966087 - protein, 7 aa, Staphylococcus
NAFEGSK

SEQ ID NO: 1966088 - protein, 7 aa, Staphylococcus
NAFFDPD

SEQ ID NO: 1966089 - protein, 11 aa, Staphylococcus
NAFPHSHTTSI

SEQ ID NO: 1966090 - protein, 12 aa, Staphylococcus
NAFPNQSKLQSL

SEQ ID NO: 1966091 - protein, 13 aa, Staphylococcus
NAFSSGNNVTTGV

SEQ ID NO: 1966092 - protein, 7 aa, Staphylococcus
NAGADGI

SEQ ID NO: 1966093 - protein, 13 aa, Staphylococcus
NAGDGSGQHPTQS

SEQ ID NO: 1966094 - protein, 6 aa, Staphylococcus
NAGDNC

SEQ ID NO: 1966095 - protein, 22 aa, Staphylococcus
NAGEVGDTPRYVKDKKKTAKQL

SEQ ID NO: 1966096 - protein, 7 aa, Staphylococcus
NAGGEAI

SEQ ID NO: 1966097 - protein, 7 aa, Staphylococcus
NAGKKAG

SEQ ID NO: 1966098 - protein, 4 aa, Staphylococcus
NAGM

SEQ ID NO: 1966099 - protein, 5 aa, Staphylococcus
NAGMG

SEQ ID NO: 1966100 - protein, 9 aa, Staphylococcus
NAGPHTNGS

SEQ ID NO: 1966101 - protein, 8 aa, Staphylococcus
NAGRANSN

SEQ ID NO: 1966102 - protein, 5 aa, Staphylococcus
NAGVD

SEQ ID NO: 1966103 - protein, 6 aa, Staphylococcus
NAGVTT

SEQ ID NO: 1966104 - protein, 7 aa, Staphylococcus
NAGYEQG

SEQ ID NO: 1966105 - protein, 10 aa, Staphylococcus
NAGYGDNEEF

SEQ ID NO: 1966106 - protein, 8 aa, Staphylococcus
NAGYTVDG

SEQ ID NO: 1966107 - protein, 13 aa, Staphylococcus
NAGYTVDGAKAEQ

SEQ ID NO: 1966108 - protein, 13 aa, Staphylococcus
NAHGETKAETIKQ

SEQ ID NO: 1966109 - protein, 9 aa, Staphylococcus
NAHGRDRTG

SEQ ID NO: 1966110 - protein, 6 aa, Staphylococcus
NAHLGN

SEQ ID NO: 1966111 - protein, 4 aa, Staphylococcus
NAHP

SEQ ID NO: 1966112 - protein, 5 aa, Staphylococcus
NAHTQ

SEQ ID NO: 1966113 - protein, 4 aa, Staphylococcus
NAIA

SEQ ID NO: 1966114 - protein, 9 aa, Staphylococcus
NAIDDDTAA

SEQ ID NO: 1966115 - protein, 5 aa, Staphylococcus
NAIDG

SEQ ID NO: 1966116 - protein, 8 aa, Staphylococcus
NAIDTKGR

SEQ ID NO: 1966117 - protein, 4 aa, Staphylococcus
NAIE

SEQ ID NO: 1966118 - protein, 10 aa, Staphylococcus
NAIEAAKNAG

SEQ ID NO: 1966119 - protein, 8 aa, Staphylococcus
NAIENEEL

SEQ ID NO: 1966120 - protein, 11 aa, Staphylococcus
NAIENNKYDPT

SEQ ID NO: 1966121 - protein, 6 aa, Staphylococcus
NAIESG

SEQ ID NO: 1966122 - protein, 9 aa, Staphylococcus
NAIKATMDD

SEQ ID NO: 1966123 - protein, 8 aa, Staphylococcus
NAIKDNTK

SEQ ID NO: 1966124 - protein, 9 aa, Staphylococcus
NAIKPNGIN

SEQ ID NO: 1966125 - protein, 8 aa, Staphylococcus
NAIKSGHP

SEQ ID NO: 1966126 - protein, 17 aa, Staphylococcus
NAINGKPNIENGEPKVA

SEQ ID NO: 1966127 - protein, 17 aa, Staphylococcus
NAINPKAPNTIAIPPHF

SEQ ID NO: 1966128 - protein, 7 aa, Staphylococcus
NAIPRED

SEQ ID NO: 1966129 - protein, 20 aa, Staphylococcus
NAIQTDDGSADAQRKAIRST

SEQ ID NO: 1966130 - protein, 15 aa, Staphylococcus
NAIQTSEGSAEAQRR

SEQ ID NO: 1966131 - protein, 7 aa, Staphylococcus
NAIQTSK

SEQ ID NO: 1966132 - protein, 10 aa, Staphylococcus
NAISKEKQSH

SEQ ID NO: 1966133 - protein, 19 aa, Staphylococcus
NAITDKTKAVYAETIGNPR

SEQ ID NO: 1966134 - protein, 22 aa, Staphylococcus
NAITSKGKDIESIQEQQKQLQE

SEQ ID NO: 1966135 - protein, 5 aa, Staphylococcus
NAKAE

SEQ ID NO: 1966136 - protein, 5 aa, Staphylococcus
NAKAQ

SEQ ID NO: 1966137 - protein, 13 aa, Staphylococcus
NAKARSGEAITGR

SEQ ID NO: 1966138 - protein, 13 aa, Staphylococcus
NAKDDVGSGAYDH

SEQ ID NO: 1966139 - protein, 12 aa, Staphylococcus
NAKDEVGSGAYD

SEQ ID NO: 1966140 - protein, 8 aa, Staphylococcus
NAKDPQKR

SEQ ID NO: 1966141 - protein, 5 aa, Staphylococcus
NAKDQ

SEQ ID NO: 1966142 - protein, 5 aa, Staphylococcus
NAKEE

SEQ ID NO: 1966143 - protein, 10 aa, Staphylococcus
NAKEELKEAA

SEQ ID NO: 1966144 - protein, 17 aa, Staphylococcus
NAKEISVDEDASNWATY

SEQ ID NO: 1966145 - protein, 7 aa, Staphylococcus
NAKELED

SEQ ID NO: 1966146 - protein, 5 aa, Staphylococcus
NAKEQ

SEQ ID NO: 1966147 - protein, 15 aa, Staphylococcus
NAKEQLVKEANSGKY

SEQ ID NO: 1966148 - protein, 6 aa, Staphylococcus
NAKERF

SEQ ID NO: 1966149 - protein, 6 aa, Staphylococcus
NAKERK

SEQ ID NO: 1966150 - protein, 9 aa, Staphylococcus
NAKETEDGQ

SEQ ID NO: 1966151 - protein, 20 aa, Staphylococcus
NAKETEDGQFKVPAIMNEED

SEQ ID NO: 1966152 - protein, 20 aa, Staphylococcus
NAKETEDGQFKVPSIISGED

SEQ ID NO: 1966153 - protein, 20 aa, Staphylococcus
NAKETEDGQFKVPSIMNGED

SEQ ID NO: 1966154 - protein, 19 aa, Staphylococcus
NAKEYVNQNEADFKDIKNE

SEQ ID NO: 1966155 - protein, 21 aa, Staphylococcus
NAKFGQTGPKVGSFDAGYGSG

SEQ ID NO: 1966156 - protein, 4 aa, Staphylococcus
NAKI

SEQ ID NO: 1966157 - protein, 12 aa, Staphylococcus
NAKIADVANHHT

SEQ ID NO: 1966158 - protein, 9 aa, Staphylococcus
NAKKDLQID

SEQ ID NO: 1966159 - protein, 9 aa, Staphylococcus
NAKKEDWSP

SEQ ID NO: 1966160 - protein, 9 aa, Staphylococcus
NAKKLYGDD

SEQ ID NO: 1966161 - protein, 11 aa, Staphylococcus
NAKKNDFSQSF

SEQ ID NO: 1966162 - protein, 9 aa, Staphylococcus
NAKKPEIGQ

SEQ ID NO: 1966163 - protein, 8 aa, Staphylococcus
NAKKQAKD

SEQ ID NO: 1966164 - protein, 7 aa, Staphylococcus
NAKNNQP

SEQ ID NO: 1966165 - protein, 6 aa, Staphylococcus
NAKNRK

SEQ ID NO: 1966166 - protein, 6 aa, Staphylococcus
NAKNYQ

SEQ ID NO: 1966167 - protein, 7 aa, Staphylococcus
NAKPGGA

SEQ ID NO: 1966168 - protein, 7 aa, Staphylococcus
NAKPPVA

SEQ ID NO: 1966169 - protein, 6 aa, Staphylococcus
NAKPSE

SEQ ID NO: 1966170 - protein, 13 aa, Staphylococcus
NAKQAIASMSQTQ

SEQ ID NO: 1966171 - protein, 6 aa, Staphylococcus
NAKQTQ

SEQ ID NO: 1966172 - protein, 9 aa, Staphylococcus
NAKREEGEE

SEQ ID NO: 1966173 - protein, 9 aa, Staphylococcus
NAKREEGKE

SEQ ID NO: 1966174 - protein, 8 aa, Staphylococcus
NAKRVNSS

SEQ ID NO: 1966175 - protein, 4 aa, Staphylococcus
NAKS

SEQ ID NO: 1966176 - protein, 8 aa, Staphylococcus
NAKTDDVY

SEQ ID NO: 1966177 - protein, 9 aa, Staphylococcus
NAKTGEVST

SEQ ID NO: 1966178 - protein, 5 aa, Staphylococcus
NAKTQ

SEQ ID NO: 1966179 - protein, 11 aa, Staphylococcus
NAKWSNGDPVT

SEQ ID NO: 1966180 - protein, 5 aa, Staphylococcus
NALAD

SEQ ID NO: 1966181 - protein, 17 aa, Staphylococcus
NALDEASGVIQYSSAFF

SEQ ID NO: 1966182 - protein, 17 aa, Staphylococcus
NALDKTSRIIQYSDAFF

SEQ ID NO: 1966183 - protein, 6 aa, Staphylococcus
NALDTK

SEQ ID NO: 1966184 - protein, 8 aa, Staphylococcus
NALEKGGF

SEQ ID NO: 1966185 - protein, 10 aa, Staphylococcus
NALGQSPEEQ

SEQ ID NO: 1966186 - protein, 11 aa, Staphylococcus
NALKNKAVKGL

SEQ ID NO: 1966187 - protein, 6 aa, Staphylococcus
NALNEN

SEQ ID NO: 1966188 - protein, 8 aa, Staphylococcus
NALPGNKF

SEQ ID NO: 1966189 - protein, 9 aa, Staphylococcus
NALTEKLGE

SEQ ID NO: 1966190 - protein, 10 aa, Staphylococcus
NAMDGVSEDV

SEQ ID NO: 1966191 - protein, 8 aa, Staphylococcus
NAMDGVTE

SEQ ID NO: 1966192 - protein, 7 aa, Staphylococcus
NAMKPDD

SEQ ID NO: 1966193 - protein, 9 aa, Staphylococcus
NAMKQTDEL

SEQ ID NO: 1966194 - protein, 6 aa, Staphylococcus
NAMTVS

SEQ ID NO: 1966195 - protein, 8 aa, Staphylococcus
NANAPGDI

SEQ ID NO: 1966196 - protein, 8 aa, Staphylococcus
NANAQKDI

SEQ ID NO: 1966197 - protein, 8 aa, Staphylococcus
NANATTRY

SEQ ID NO: 1966198 - protein, 5 aa, Staphylococcus
NANDI

SEQ ID NO: 1966199 - protein, 8 aa, Staphylococcus
NANDTLND

SEQ ID NO: 1966200 - protein, 7 aa, Staphylococcus
NANEELK

SEQ ID NO: 1966201 - protein, 6 aa, Staphylococcus
NANELA

SEQ ID NO: 1966202 - protein, 5 aa, Staphylococcus
NANHY

SEQ ID NO: 1966203 - protein, 5 aa, Staphylococcus
NANID

SEQ ID NO: 1966204 - protein, 5 aa, Staphylococcus
NANIE

SEQ ID NO: 1966205 - protein, 10 aa, Staphylococcus
NANKQNIETS

SEQ ID NO: 1966206 - protein, 5 aa, Staphylococcus
NANNQ

SEQ ID NO: 1966207 - protein, 7 aa, Staphylococcus
NANPKAN

SEQ ID NO: 1966208 - protein, 5 aa, Staphylococcus
NANPN

SEQ ID NO: 1966209 - protein, 4 aa, Staphylococcus
NANQ

SEQ ID NO: 1966210 - protein, 5 aa, Staphylococcus
NANQI

SEQ ID NO: 1966211 - protein, 7 aa, Staphylococcus
NANQIIP

SEQ ID NO: 1966212 - protein, 8 aa, Staphylococcus
NANQKDTV

SEQ ID NO: 1966213 - protein, 7 aa, Staphylococcus
NANRNAD

SEQ ID NO: 1966214 - protein, 7 aa, Staphylococcus
NANRSAD

SEQ ID NO: 1966215 - protein, 8 aa, Staphylococcus
NANSNLAE

SEQ ID NO: 1966216 - protein, 8 aa, Staphylococcus
NANTENEC

SEQ ID NO: 1966217 - protein, 10 aa, Staphylococcus
NANTLDPKKT

SEQ ID NO: 1966218 - protein, 14 aa, Staphylococcus
NANVTSPKSIQTAS

SEQ ID NO: 1966219 - protein, 11 aa, Staphylococcus
NANYAKNQFKD

SEQ ID NO: 1966220 - protein, 6 aa, Staphylococcus
NAPAEL

SEQ ID NO: 1966221 - protein, 7 aa, Staphylococcus
NAPDEQL

SEQ ID NO: 1966222 - protein, 12 aa, Staphylococcus
NAPEEKERGITI

SEQ ID NO: 1966223 - protein, 5 aa, Staphylococcus
NAPEI

SEQ ID NO: 1966224 - protein, 6 aa, Staphylococcus
NAPIAA

SEQ ID NO: 1966225 - protein, 6 aa, Staphylococcus
NAPKDD

SEQ ID NO: 1966226 - protein, 7 aa, Staphylococcus
NAPKEQM

SEQ ID NO: 1966227 - protein, 15 aa, Staphylococcus
NAPKEVKKDKIKGAL

SEQ ID NO: 1966228 - protein, 6 aa, Staphylococcus
NAPKMD

SEQ ID NO: 1966229 - protein, 7 aa, Staphylococcus
NAPLKGV

SEQ ID NO: 1966230 - protein, 8 aa, Staphylococcus
NAPLTGQG

SEQ ID NO: 1966231 - protein, 6 aa, Staphylococcus
NAPNLV

SEQ ID NO: 1966232 - protein, 9 aa, Staphylococcus
NAPPDPGAV

SEQ ID NO: 1966233 - protein, 4 aa, Staphylococcus
NAPS

SEQ ID NO: 1966234 - protein, 6 aa, Staphylococcus
NAPTSI

SEQ ID NO: 1966235 - protein, 9 aa, Staphylococcus
NAPTSKDTY

SEQ ID NO: 1966236 - protein, 8 aa, Staphylococcus
NAPTSRNT

SEQ ID NO: 1966237 - protein, 8 aa, Staphylococcus
NAPYEAPY

SEQ ID NO: 1966238 - protein, 10 aa, Staphylococcus
NAPYEEPNNP

SEQ ID NO: 1966239 - protein, 7 aa, Staphylococcus
NAQDNKP

SEQ ID NO: 1966240 - protein, 27 aa, Staphylococcus
NAQEIGTVKDNGQFKVTNGQTTVEENV

SEQ ID NO: 1966241 - protein, 9 aa, Staphylococcus
NAQEQEERP

SEQ ID NO: 1966242 - protein, 6 aa, Staphylococcus
NAQETY

SEQ ID NO: 1966243 - protein, 9 aa, Staphylococcus
NAQGETDAE

SEQ ID NO: 1966244 - protein, 12 aa, Staphylococcus
NAQGETDATTIK

SEQ ID NO: 1966245 - protein, 5 aa, Staphylococcus
NAQHY

SEQ ID NO: 1966246 - protein, 6 aa, Staphylococcus
NAQNHQ

SEQ ID NO: 1966247 - protein, 5 aa, Staphylococcus
NAQNI

SEQ ID NO: 1966248 - protein, 8 aa, Staphylococcus
NAQNNNLT

SEQ ID NO: 1966249 - protein, 6 aa, Staphylococcus
NAQPEG

SEQ ID NO: 1966250 - protein, 10 aa, Staphylococcus
NAQPEHYDKT

SEQ ID NO: 1966251 - protein, 9 aa, Staphylococcus
NAQSDTANY

SEQ ID NO: 1966252 - protein, 6 aa, Staphylococcus
NAQSRV

SEQ ID NO: 1966253 - protein, 8 aa, Staphylococcus
NAQTTEVL

SEQ ID NO: 1966254 - protein, 14 aa, Staphylococcus
NAQVDSPKSIQTAT

SEQ ID NO: 1966255 - protein, 7 aa, Staphylococcus
NAQVTEE

SEQ ID NO: 1966256 - protein, 9 aa, Staphylococcus
NARPEIKDL

SEQ ID NO: 1966257 - protein, 32 aa, Staphylococcus
NARPEIQSITDDTTQYTNEEDGAALYLEHHLL

SEQ ID NO: 1966258 - protein, 5 aa, Staphylococcus
NARPV

SEQ ID NO: 1966259 - protein, 8 aa, Staphylococcus
NARQEIKD

SEQ ID NO: 1966260 - protein, 8 aa, Staphylococcus
NARQEIQE

SEQ ID NO: 1966261 - protein, 8 aa, Staphylococcus
NARSEIKA

SEQ ID NO: 1966262 - protein, 8 aa, Staphylococcus
NARTQEDA

SEQ ID NO: 1966263 - protein, 4 aa, Staphylococcus
NARY

SEQ ID NO: 1966264 - protein, 10 aa, Staphylococcus
NASDDGYPGD

SEQ ID NO: 1966265 - protein, 8 aa, Staphylococcus
NASDEEAM

SEQ ID NO: 1966266 - protein, 6 aa, Staphylococcus
NASEEA

SEQ ID NO: 1966267 - protein, 6 aa, Staphylococcus
NASENV

SEQ ID NO: 1966268 - protein, 5 aa, Staphylococcus
NASGP

SEQ ID NO: 1966269 - protein, 6 aa, Staphylococcus
NASGRV

SEQ ID NO: 1966270 - protein, 5 aa, Staphylococcus
NASIE

SEQ ID NO: 1966271 - protein, 8 aa, Staphylococcus
NASKDYSN

SEQ ID NO: 1966272 - protein, 8 aa, Staphylococcus
NASLTDKR

SEQ ID NO: 1966273 - protein, 7 aa, Staphylococcus
NASNDNP

SEQ ID NO: 1966274 - protein, 6 aa, Staphylococcus
NASPYG

SEQ ID NO: 1966275 - protein, 9 aa, Staphylococcus
NASSGINNL

SEQ ID NO: 1966276 - protein, 6 aa, Staphylococcus
NASSSD

SEQ ID NO: 1966277 - protein, 7 aa, Staphylococcus
NASSTID

SEQ ID NO: 1966278 - protein, 6 aa, Staphylococcus
NASSYK

SEQ ID NO: 1966279 - protein, 6 aa, Staphylococcus
NASTEK

SEQ ID NO: 1966280 - protein, 12 aa, Staphylococcus
NASTISQDASYH

SEQ ID NO: 1966281 - protein, 8 aa, Staphylococcus
NASTQSEC

SEQ ID NO: 1966282 - protein, 24 aa, Staphylococcus
NASVAGATGGCQAEVGSASAIAAA

SEQ ID NO: 1966283 - protein, 14 aa, Staphylococcus
NASVTLTSQGATKI

SEQ ID NO: 1966284 - protein, 13 aa, Staphylococcus
NASYKNFGPSESD

SEQ ID NO: 1966285 - protein, 8 aa, Staphylococcus
NASYPPET

SEQ ID NO: 1966286 - protein, 9 aa, Staphylococcus
NATANPQQV

SEQ ID NO: 1966287 - protein, 7 aa, Staphylococcus
NATAQQV

SEQ ID NO: 1966288 - protein, 7 aa, Staphylococcus
NATDGDN

SEQ ID NO: 1966289 - protein, 6 aa, Staphylococcus
NATDSN

SEQ ID NO: 1966290 - protein, 7 aa, Staphylococcus
NATDYGV

SEQ ID NO: 1966291 - protein, 21 aa, Staphylococcus
NATEAIQHREETVTEGASSNV

SEQ ID NO: 1966292 - protein, 21 aa, Staphylococcus
NATEAIQHRGETVTEGASSNV

SEQ ID NO: 1966293 - protein, 6 aa, Staphylococcus
NATEED

SEQ ID NO: 1966294 - protein, 8 aa, Staphylococcus
NATEEEKP

SEQ ID NO: 1966295 - protein, 7 aa, Staphylococcus
NATEYGL

SEQ ID NO: 1966296 - protein, 8 aa, Staphylococcus
NATHPEEI

SEQ ID NO: 1966297 - protein, 4 aa, Staphylococcus
NATI

SEQ ID NO: 1966298 - protein, 17 aa, Staphylococcus
NATIKTKQEKDKGFDLE

SEQ ID NO: 1966299 - protein, 5 aa, Staphylococcus
NATIS

SEQ ID NO: 1966300 - protein, 7 aa, Staphylococcus
NATKEIK

SEQ ID NO: 1966301 - protein, 10 aa, Staphylococcus
NATKKVKQYS

SEQ ID NO: 1966302 - protein, 15 aa, Staphylococcus
NATMPTRANATDAGY

SEQ ID NO: 1966303 - protein, 7 aa, Staphylococcus
NATMTTS

SEQ ID NO: 1966304 - protein, 6 aa, Staphylococcus
NATNSF

SEQ ID NO: 1966305 - protein, 4 aa, Staphylococcus
NATP

SEQ ID NO: 1966306 - protein, 8 aa, Staphylococcus
NATPEQYD

SEQ ID NO: 1966307 - protein, 11 aa, Staphylococcus
NATPEQYDASY

SEQ ID NO: 1966308 - protein, 9 aa, Staphylococcus
NATPEQYDK

SEQ ID NO: 1966309 - protein, 10 aa, Staphylococcus
NATPEQYDKS

SEQ ID NO: 1966310 - protein, 8 aa, Staphylococcus
NATPGGVV

SEQ ID NO: 1966311 - protein, 13 aa, Staphylococcus
NATPGGVVKKGEV

SEQ ID NO: 1966312 - protein, 4 aa, Staphylococcus
NATQ

SEQ ID NO: 1966313 - protein, 8 aa, Staphylococcus
NATQAVKD

SEQ ID NO: 1966314 - protein, 9 aa, Staphylococcus
NATQPKEIE

SEQ ID NO: 1966315 - protein, 7 aa, Staphylococcus
NATSEIQ

SEQ ID NO: 1966316 - protein, 6 aa, Staphylococcus
NATSNF

SEQ ID NO: 1966317 - protein, 6 aa, Staphylococcus
NATTAL

SEQ ID NO: 1966318 - protein, 13 aa, Staphylococcus
NATTGEDGKFHPE

SEQ ID NO: 1966319 - protein, 12 aa, Staphylococcus
NATTGEDGTFHP

SEQ ID NO: 1966320 - protein, 13 aa, Staphylococcus
NATTGKDGTFHPE

SEQ ID NO: 1966321 - protein, 13 aa, Staphylococcus
NATTGKNGTFHPQ

SEQ ID NO: 1966322 - protein, 13 aa, Staphylococcus
NATVNGRRSPYSL

SEQ ID NO: 1966323 - protein, 14 aa, Staphylococcus
NATVTSPKSIQTAS

SEQ ID NO: 1966324 - protein, 7 aa, Staphylococcus
NATYPTI

SEQ ID NO: 1966325 - protein, 35 aa, Staphylococcus
NAVATTNNTSQQQGTTETKDQTNKVAKQGQYKNQD

SEQ ID NO: 1966326 - protein, 12 aa, Staphylococcus
NAVDTAVENERG

SEQ ID NO: 1966327 - protein, 7 aa, Staphylococcus
NAVEASK

SEQ ID NO: 1966328 - protein, 9 aa, Staphylococcus
NAVEEAESY

SEQ ID NO: 1966329 - protein, 7 aa, Staphylococcus
NAVEETD

SEQ ID NO: 1966330 - protein, 6 aa, Staphylococcus
NAVEKG

SEQ ID NO: 1966331 - protein, 12 aa, Staphylococcus
NAVEKTTGANKE

SEQ ID NO: 1966332 - protein, 13 aa, Staphylococcus
NAVEKTTGANKEA

SEQ ID NO: 1966333 - protein, 12 aa, Staphylococcus
NAVEKTTGANRD

SEQ ID NO: 1966334 - protein, 12 aa, Staphylococcus
NAVEKTTGANRE

SEQ ID NO: 1966335 - protein, 8 aa, Staphylococcus
NAVGYKNY

SEQ ID NO: 1966336 - protein, 11 aa, Staphylococcus
NAVGYKNYSDN

SEQ ID NO: 1966337 - protein, 9 aa, Staphylococcus
NAVKSGANI

SEQ ID NO: 1966338 - protein, 20 aa, Staphylococcus
NAVNEESSTQYDSENEQDDV

SEQ ID NO: 1966339 - protein, 7 aa, Staphylococcus
NAVNKNL

SEQ ID NO: 1966340 - protein, 4 aa, Staphylococcus
NAVP

SEQ ID NO: 1966341 - protein, 8 aa, Staphylococcus
NAVPNHQQ

SEQ ID NO: 1966342 - protein, 9 aa, Staphylococcus
NAVPNQNYK

SEQ ID NO: 1966343 - protein, 14 aa, Staphylococcus
NAVSAQKAVTDTTN

SEQ ID NO: 1966344 - protein, 16 aa, Staphylococcus
NAVTAQRAVTDTTNDL

SEQ ID NO: 1966345 - protein, 8 aa, Staphylococcus
NAVTEGVP

SEQ ID NO: 1966346 - protein, 15 aa, Staphylococcus
NAVTKQRKAIPVLED

SEQ ID NO: 1966347 - protein, 12 aa, Staphylococcus
NAVTSDKKSVAD

SEQ ID NO: 1966348 - protein, 8 aa, Staphylococcus
NAVYSATK

SEQ ID NO: 1966349 - protein, 9 aa, Staphylococcus
NAYDADNQS

SEQ ID NO: 1966350 - protein, 10 aa, Staphylococcus
NAYDADSQSI

SEQ ID NO: 1966351 - protein, 11 aa, Staphylococcus
NAYEPGSTFKS

SEQ ID NO: 1966352 - protein, 4 aa, Staphylococcus
NAYN

SEQ ID NO: 1966353 - protein, 18 aa, Staphylococcus
NAYNQDYMDTKKEKMGHL

SEQ ID NO: 1966354 - protein, 4 aa, Staphylococcus
NAYQ

SEQ ID NO: 1966355 - protein, 6 aa, Staphylococcus
NAYQKI

SEQ ID NO: 1966356 - protein, 7 aa, Staphylococcus
NCAGKST

SEQ ID NO: 1966357 - protein, 4 aa, Staphylococcus
NCDR

SEQ ID NO: 1966358 - protein, 17 aa, Staphylococcus
NCDTTETVKAEMGRQAG

SEQ ID NO: 1966359 - protein, 6 aa, Staphylococcus
NCGKTT

SEQ ID NO: 1966360 - protein, 14 aa, Staphylococcus
NCHTSNDEFSHQTD

SEQ ID NO: 1966361 - protein, 7 aa, Staphylococcus
NCKGAST

SEQ ID NO: 1966362 - protein, 5 aa, Staphylococcus
NCSPK

SEQ ID NO: 1966363 - protein, 16 aa, Staphylococcus
NCSTQEQVKELVHNIA

SEQ ID NO: 1966364 - protein, 13 aa, Staphylococcus
NCTEQEKKDIKES

SEQ ID NO: 1966365 - protein, 5 aa, Staphylococcus
NCTSD

SEQ ID NO: 1966366 - protein, 6 aa, Staphylococcus
NCVEAG

SEQ ID NO: 1966367 - protein, 5 aa, Staphylococcus
NDADR

SEQ ID NO: 1966368 - protein, 9 aa, Staphylococcus
NDAEEDGTL

SEQ ID NO: 1966369 - protein, 8 aa, Staphylococcus
NDAEETGR

SEQ ID NO: 1966370 - protein, 4 aa, Staphylococcus
NDAF

SEQ ID NO: 1966371 - protein, 12 aa, Staphylococcus
NDAGKAQEQKRR

SEQ ID NO: 1966372 - protein, 5 aa, Staphylococcus
NDAIN

SEQ ID NO: 1966373 - protein, 4 aa, Staphylococcus
NDAK

SEQ ID NO: 1966374 - protein, 8 aa, Staphylococcus
NDAKLKSK

SEQ ID NO: 1966375 - protein, 9 aa, Staphylococcus
NDALGGGSI

SEQ ID NO: 1966376 - protein, 7 aa, Staphylococcus
NDALPHG

SEQ ID NO: 1966377 - protein, 4 aa, Staphylococcus
NDAN

SEQ ID NO: 1966378 - protein, 17 aa, Staphylococcus
NDANFNPQKIEDVKRNN

SEQ ID NO: 1966379 - protein, 19 aa, Staphylococcus
NDAPDILGEPDIQNDISKY

SEQ ID NO: 1966380 - protein, 21 aa, Staphylococcus
NDAPEILGQPDIQNDISKYSD

SEQ ID NO: 1966381 - protein, 10 aa, Staphylococcus
NDAPEKLGAP

SEQ ID NO: 1966382 - protein, 19 aa, Staphylococcus
NDASIQKGFETYTSDNGRM

SEQ ID NO: 1966383 - protein, 8 aa, Staphylococcus
NDASLPRL

SEQ ID NO: 1966384 - protein, 8 aa, Staphylococcus
NDATSGEV

SEQ ID NO: 1966385 - protein, 5 aa, Staphylococcus
NDATY

SEQ ID NO: 1966386 - protein, 7 aa, Staphylococcus
NDDDADV

SEQ ID NO: 1966387 - protein, 20 aa, Staphylococcus
NDDDEHSVRNDRPRIDTARK

SEQ ID NO: 1966388 - protein, 14 aa, Staphylococcus
NDDDFAKKYGDLGN

SEQ ID NO: 1966389 - protein, 6 aa, Staphylococcus
NDDDFS

SEQ ID NO: 1966390 - protein, 7 aa, Staphylococcus
NDDDKNV

SEQ ID NO: 1966391 - protein, 7 aa, Staphylococcus
NDDEETK

SEQ ID NO: 1966392 - protein, 8 aa, Staphylococcus
NDDELHTI

SEQ ID NO: 1966393 - protein, 7 aa, Staphylococcus
NDDERAA

SEQ ID NO: 1966394 - protein, 5 aa, Staphylococcus
NDDES

SEQ ID NO: 1966395 - protein, 8 aa, Staphylococcus
NDDESIES

SEQ ID NO: 1966396 - protein, 5 aa, Staphylococcus
NDDET

SEQ ID NO: 1966397 - protein, 8 aa, Staphylococcus
NDDFDGRT

SEQ ID NO: 1966398 - protein, 19 aa, Staphylococcus
NDDGIRKGFETYTSDNGRM

SEQ ID NO: 1966399 - protein, 6 aa, Staphylococcus
NDDGNL

SEQ ID NO: 1966400 - protein, 9 aa, Staphylococcus
NDDGSPSHI

SEQ ID NO: 1966401 - protein, 9 aa, Staphylococcus
NDDGTPSHI

SEQ ID NO: 1966402 - protein, 6 aa, Staphylococcus
NDDIQS

SEQ ID NO: 1966403 - protein, 8 aa, Staphylococcus
NDDITEKD

SEQ ID NO: 1966404 - protein, 8 aa, Staphylococcus
NDDKAKSV

SEQ ID NO: 1966405 - protein, 5 aa, Staphylococcus
NDDKE

SEQ ID NO: 1966406 - protein, 8 aa, Staphylococcus
NDDKEKEV

SEQ ID NO: 1966407 - protein, 6 aa, Staphylococcus
NDDKLD

SEQ ID NO: 1966408 - protein, 7 aa, Staphylococcus
NDDKLDV

SEQ ID NO: 1966409 - protein, 7 aa, Staphylococcus
NDDKPKI

SEQ ID NO: 1966410 - protein, 16 aa, Staphylococcus
NDDLASSKDISDRRGI

SEQ ID NO: 1966411 - protein, 12 aa, Staphylococcus
NDDLSDKVQDNE

SEQ ID NO: 1966412 - protein, 7 aa, Staphylococcus
NDDLVND

SEQ ID NO: 1966413 - protein, 14 aa, Staphylococcus
NDDMKDEITKFLKN

SEQ ID NO: 1966414 - protein, 74 aa, Staphylococcus
NDDNEAQNEIKSDEFENKIDSEASSKSTEAAQPLKNEEHEITEAQYTEMDDAPAEKTEELDSKTETSSQLTEDV

SEQ ID NO: 1966415 - protein, 16 aa, Staphylococcus
NDDNVKKLADKTGDAR

SEQ ID NO: 1966416 - protein, 16 aa, Staphylococcus
NDDNVKKLADKTNDAR

SEQ ID NO: 1966417 - protein, 6 aa, Staphylococcus
NDDPER

SEQ ID NO: 1966418 - protein, 9 aa, Staphylococcus
NDDPETYED

SEQ ID NO: 1966419 - protein, 10 aa, Staphylococcus
NDDQKKIAEN

SEQ ID NO: 1966420 - protein, 6 aa, Staphylococcus
NDDQPK

SEQ ID NO: 1966421 - protein, 5 aa, Staphylococcus
NDDQR

SEQ ID NO: 1966422 - protein, 7 aa, Staphylococcus
NDDQRKV

SEQ ID NO: 1966423 - protein, 6 aa, Staphylococcus
NDDQTF

SEQ ID NO: 1966424 - protein, 6 aa, Staphylococcus
NDDRDI

SEQ ID NO: 1966425 - protein, 8 aa, Staphylococcus
NDDSKAYF

SEQ ID NO: 1966426 - protein, 9 aa, Staphylococcus
NDDSKAYYE

SEQ ID NO: 1966427 - protein, 16 aa, Staphylococcus
NDDSTSIDKALQPTLV

SEQ ID NO: 1966428 - protein, 4 aa, Staphylococcus
NDDT

SEQ ID NO: 1966429 - protein, 10 aa, Staphylococcus
NDDTFAKKYG

SEQ ID NO: 1966430 - protein, 14 aa, Staphylococcus
NDDTLENPAFEGEK

SEQ ID NO: 1966431 - protein, 6 aa, Staphylococcus
NDDTPL

SEQ ID NO: 1966432 - protein, 7 aa, Staphylococcus
NDDTPLG

SEQ ID NO: 1966433 - protein, 8 aa, Staphylococcus
NDDTRAYP

SEQ ID NO: 1966434 - protein, 15 aa, Staphylococcus
NDDVNKSQSSNDTFP

SEQ ID NO: 1966435 - protein, 5 aa, Staphylococcus
NDDYD

SEQ ID NO: 1966436 - protein, 8 aa, Staphylococcus
NDDYDQSA

SEQ ID NO: 1966437 - protein, 12 aa, Staphylococcus
NDDYEDKPIETD

SEQ ID NO: 1966438 - protein, 4 aa, Staphylococcus
NDEA

SEQ ID NO: 1966439 - protein, 7 aa, Staphylococcus
NDEAAQE

SEQ ID NO: 1966440 - protein, 10 aa, Staphylococcus
NDEATRYTPL

SEQ ID NO: 1966441 - protein, 7 aa, Staphylococcus
NDEDGKP

SEQ ID NO: 1966442 - protein, 14 aa, Staphylococcus
NDEDNLELLEFVGG

SEQ ID NO: 1966443 - protein, 20 aa, Staphylococcus
NDEDPESVRNNRPRIDTARK

SEQ ID NO: 1966444 - protein, 5 aa, Staphylococcus
NDEDQ

SEQ ID NO: 1966445 - protein, 7 aa, Staphylococcus
NDEDQKW

SEQ ID NO: 1966446 - protein, 6 aa, Staphylococcus
NDEDSI

SEQ ID NO: 1966447 - protein, 9 aa, Staphylococcus
NDEEDAKRV

SEQ ID NO: 1966448 - protein, 6 aa, Staphylococcus
NDEEIA

SEQ ID NO: 1966449 - protein, 6 aa, Staphylococcus
NDEEIK

SEQ ID NO: 1966450 - protein, 7 aa, Staphylococcus
NDEEIQT

SEQ ID NO: 1966451 - protein, 8 aa, Staphylococcus
NDEEQNEV

SEQ ID NO: 1966452 - protein, 6 aa, Staphylococcus
NDEERA

SEQ ID NO: 1966453 - protein, 5 aa, Staphylococcus
NDEGE

SEQ ID NO: 1966454 - protein, 6 aa, Staphylococcus
NDEGER

SEQ ID NO: 1966455 - protein, 14 aa, Staphylococcus
NDEGHDNVNKKGGT

SEQ ID NO: 1966456 - protein, 9 aa, Staphylococcus
NDEGKQYKH

SEQ ID NO: 1966457 - protein, 13 aa, Staphylococcus
NDEHNHTSKSGGF

SEQ ID NO: 1966458 - protein, 10 aa, Staphylococcus
NDEKEKSEHS

SEQ ID NO: 1966459 - protein, 5 aa, Staphylococcus
NDEKH

SEQ ID NO: 1966460 - protein, 6 aa, Staphylococcus
NDEKLD

SEQ ID NO: 1966461 - protein, 9 aa, Staphylococcus
NDEKRQKVK

SEQ ID NO: 1966462 - protein, 5 aa, Staphylococcus
NDEKY

SEQ ID NO: 1966463 - protein, 26 aa, Staphylococcus
NDELDDIKAETKNAVNPFQNNQIYEL

SEQ ID NO: 1966464 - protein, 5 aa, Staphylococcus
NDELE

SEQ ID NO: 1966465 - protein, 6 aa, Staphylococcus
NDELGE

SEQ ID NO: 1966466 - protein, 6 aa, Staphylococcus
NDELYK

SEQ ID NO: 1966467 - protein, 10 aa, Staphylococcus
NDEMINPQSA

SEQ ID NO: 1966468 - protein, 4 aa, Staphylococcus
NDEN

SEQ ID NO: 1966469 - protein, 5 aa, Staphylococcus
NDENC

SEQ ID NO: 1966470 - protein, 9 aa, Staphylococcus
NDENHPESK

SEQ ID NO: 1966471 - protein, 6 aa, Staphylococcus
NDENIQ

SEQ ID NO: 1966472 - protein, 9 aa, Staphylococcus
NDENQQVDE

SEQ ID NO: 1966473 - protein, 9 aa, Staphylococcus
NDENRVNEY

SEQ ID NO: 1966474 - protein, 16 aa, Staphylococcus
NDENVEKLADKTGDAR

SEQ ID NO: 1966475 - protein, 16 aa, Staphylococcus
NDENVEKLAEKTGDKR

SEQ ID NO: 1966476 - protein, 16 aa, Staphylococcus
NDENVEKLATKTNDAR

SEQ ID NO: 1966477 - protein, 17 aa, Staphylococcus
NDENVKKLANKTNDSRF

SEQ ID NO: 1966478 - protein, 5 aa, Staphylococcus
NDEQI

SEQ ID NO: 1966479 - protein, 7 aa, Staphylococcus
NDEQQVD

SEQ ID NO: 1966480 - protein, 13 aa, Staphylococcus
NDERQPYWTENYT

SEQ ID NO: 1966481 - protein, 6 aa, Staphylococcus
NDERSV

SEQ ID NO: 1966482 - protein, 28 aa, Staphylococcus
NDESGKDVSKWTRDTSQTLVDSREPENN

SEQ ID NO: 1966483 - protein, 19 aa, Staphylococcus
NDESIQKGFETYTSDNGRM

SEQ ID NO: 1966484 - protein, 8 aa, Staphylococcus
NDESKAYY

SEQ ID NO: 1966485 - protein, 6 aa, Staphylococcus
NDESQL

SEQ ID NO: 1966486 - protein, 7 aa, Staphylococcus
NDESQLD

SEQ ID NO: 1966487 - protein, 19 aa, Staphylococcus
NDESTDAAIKTEANETKQQ

SEQ ID NO: 1966488 - protein, 5 aa, Staphylococcus
NDESY

SEQ ID NO: 1966489 - protein, 6 aa, Staphylococcus
NDETFK

SEQ ID NO: 1966490 - protein, 6 aa, Staphylococcus
NDETIN

SEQ ID NO: 1966491 - protein, 8 aa, Staphylococcus
NDETLSSQ

SEQ ID NO: 1966492 - protein, 10 aa, Staphylococcus
NDETQVGEVA

SEQ ID NO: 1966493 - protein, 13 aa, Staphylococcus
NDEVVQNNDPEYL

SEQ ID NO: 1966494 - protein, 4 aa, Staphylococcus
NDFA

SEQ ID NO: 1966495 - protein, 5 aa, Staphylococcus
NDFAN

SEQ ID NO: 1966496 - protein, 4 aa, Staphylococcus
NDFE

SEQ ID NO: 1966497 - protein, 7 aa, Staphylococcus
NDFENKQ

SEQ ID NO: 1966498 - protein, 5 aa, Staphylococcus
NDFET

SEQ ID NO: 1966499 - protein, 14 aa, Staphylococcus
NDFGGGGHPNASGV

SEQ ID NO: 1966500 - protein, 13 aa, Staphylococcus
NDFKKEKIIKIAN

SEQ ID NO: 1966501 - protein, 10 aa, Staphylococcus
NDFNTEEKSM

SEQ ID NO: 1966502 - protein, 15 aa, Staphylococcus
NDFQTNGALTKSDVD

SEQ ID NO: 1966503 - protein, 4 aa, Staphylococcus
NDFS

SEQ ID NO: 1966504 - protein, 15 aa, Staphylococcus
NDFSDTAKQSTRKAF

SEQ ID NO: 1966505 - protein, 8 aa, Staphylococcus
NDFSGNYQ

SEQ ID NO: 1966506 - protein, 10 aa, Staphylococcus
NDFSPNSQAL

SEQ ID NO: 1966507 - protein, 19 aa, Staphylococcus
NDGASQSYVKSKKKAAEKI

SEQ ID NO: 1966508 - protein, 19 aa, Staphylococcus
NDGASQSYVRSKKKAAEKI

SEQ ID NO: 1966509 - protein, 6 aa, Staphylococcus
NDGCDI

SEQ ID NO: 1966510 - protein, 7 aa, Staphylococcus
NDGDHQF

SEQ ID NO: 1966511 - protein, 8 aa, Staphylococcus
NDGEIEKL

SEQ ID NO: 1966512 - protein, 7 aa, Staphylococcus
NDGEYEA

SEQ ID NO: 1966513 - protein, 6 aa, Staphylococcus
NDGGAL

SEQ ID NO: 1966514 - protein, 30 aa, Staphylococcus
NDGGPSAAHAPFGGLKESGYGREGGVEGIE

SEQ ID NO: 1966515 - protein, 28 aa, Staphylococcus
NDGGPSAAHAPFGGMKESGYGREGGIEG

SEQ ID NO: 1966516 - protein, 30 aa, Staphylococcus
NDGGPSAAHAPFGGMKESGYGREGGTEGIE

SEQ ID NO: 1966517 - protein, 4 aa, Staphylococcus
NDGK

SEQ ID NO: 1966518 - protein, 16 aa, Staphylococcus
NDGKDLSQDPHAKDLE

SEQ ID NO: 1966519 - protein, 4 aa, Staphylococcus
NDGL

SEQ ID NO: 1966520 - protein, 7 aa, Staphylococcus
NDGLSIT

SEQ ID NO: 1966521 - protein, 10 aa, Staphylococcus
NDGPKDQGGL

SEQ ID NO: 1966522 - protein, 5 aa, Staphylococcus
NDGPM

SEQ ID NO: 1966523 - protein, 6 aa, Staphylococcus
NDGPQV

SEQ ID NO: 1966524 - protein, 7 aa, Staphylococcus
NDGQEVE

SEQ ID NO: 1966525 - protein, 9 aa, Staphylococcus
NDGQINANH

SEQ ID NO: 1966526 - protein, 5 aa, Staphylococcus
NDGSE

SEQ ID NO: 1966527 - protein, 11 aa, Staphylococcus
NDGSETTMKTG

SEQ ID NO: 1966528 - protein, 8 aa, Staphylococcus
NDGSLSPL

SEQ ID NO: 1966529 - protein, 11 aa, Staphylococcus
NDGSVGSGFDL

SEQ ID NO: 1966530 - protein, 13 aa, Staphylococcus
NDGSVSMKTKEKL

SEQ ID NO: 1966531 - protein, 7 aa, Staphylococcus
NDGTENY

SEQ ID NO: 1966532 - protein, 18 aa, Staphylococcus
NDGTLSGAAIDTYENEAD

SEQ ID NO: 1966533 - protein, 6 aa, Staphylococcus
NDGTQA

SEQ ID NO: 1966534 - protein, 4 aa, Staphylococcus
NDGV

SEQ ID NO: 1966535 - protein, 6 aa, Staphylococcus
NDGYFE

SEQ ID NO: 1966536 - protein, 5 aa, Staphylococcus
NDGYH

SEQ ID NO: 1966537 - protein, 10 aa, Staphylococcus
NDGYHEQAEE

SEQ ID NO: 1966538 - protein, 5 aa, Staphylococcus
NDHEE

SEQ ID NO: 1966539 - protein, 5 aa, Staphylococcus
NDHKF

SEQ ID NO: 1966540 - protein, 16 aa, Staphylococcus
NDHLERNETKVIDVTM

SEQ ID NO: 1966541 - protein, 7 aa, Staphylococcus
NDHPPLN

SEQ ID NO: 1966542 - protein, 5 aa, Staphylococcus
NDHPT

SEQ ID NO: 1966543 - protein, 5 aa, Staphylococcus
NDHRD

SEQ ID NO: 1966544 - protein, 5 aa, Staphylococcus
NDHRT

SEQ ID NO: 1966545 - protein, 16 aa, Staphylococcus
NDHTVAEREGAKGNIT

SEQ ID NO: 1966546 - protein, 4 aa, Staphylococcus
NDHY

SEQ ID NO: 1966547 - protein, 5 aa, Staphylococcus
NDIAT

SEQ ID NO: 1966548 - protein, 6 aa, Staphylococcus
NDIDEK

SEQ ID NO: 1966549 - protein, 4 aa, Staphylococcus
NDIE

SEQ ID NO: 1966550 - protein, 6 aa, Staphylococcus
NDIENA

SEQ ID NO: 1966551 - protein, 6 aa, Staphylococcus
NDIERN

SEQ ID NO: 1966552 - protein, 21 aa, Staphylococcus
NDIKADPTFKQEIENLEKEIR

SEQ ID NO: 1966553 - protein, 7 aa, Staphylococcus
NDIKENQ

SEQ ID NO: 1966554 - protein, 7 aa, Staphylococcus
NDIKPRD

SEQ ID NO: 1966555 - protein, 15 aa, Staphylococcus
NDIKSKLQSVSNTGL

SEQ ID NO: 1966556 - protein, 13 aa, Staphylococcus
NDIKYDKKQIEQM

SEQ ID NO: 1966557 - protein, 4 aa, Staphylococcus
NDIN

SEQ ID NO: 1966558 - protein, 6 aa, Staphylococcus
NDINEM

SEQ ID NO: 1966559 - protein, 13 aa, Staphylococcus
NDINNEGNKAKSI

SEQ ID NO: 1966560 - protein, 8 aa, Staphylococcus
NDIQSEQI

SEQ ID NO: 1966561 - protein, 6 aa, Staphylococcus
NDIREA

SEQ ID NO: 1966562 - protein, 11 aa, Staphylococcus
NDIRQDGNTGE

SEQ ID NO: 1966563 - protein, 11 aa, Staphylococcus
NDIRQDGNTSQ

SEQ ID NO: 1966564 - protein, 12 aa, Staphylococcus
NDIRQDGNTSQM

SEQ ID NO: 1966565 - protein, 8 aa, Staphylococcus
NDIRSNND

SEQ ID NO: 1966566 - protein, 10 aa, Staphylococcus
NDISKSNEPY

SEQ ID NO: 1966567 - protein, 12 aa, Staphylococcus
NDITSIAGNHDK

SEQ ID NO: 1966568 - protein, 6 aa, Staphylococcus
NDITTQ

SEQ ID NO: 1966569 - protein, 12 aa, Staphylococcus
NDIVEKAKATLE

SEQ ID NO: 1966570 - protein, 12 aa, Staphylococcus
NDIVEQAKATLE

SEQ ID NO: 1966571 - protein, 9 aa, Staphylococcus
NDKAKGPFN

SEQ ID NO: 1966572 - protein, 9 aa, Staphylococcus
NDKAPEVMT

SEQ ID NO: 1966573 - protein, 14 aa, Staphylococcus
NDKAQKQDQSKDEL

SEQ ID NO: 1966574 - protein, 9 aa, Staphylococcus
NDKASSTSE

SEQ ID NO: 1966575 - protein, 15 aa, Staphylococcus
NDKDDVGSGAYDHNG

SEQ ID NO: 1966576 - protein, 8 aa, Staphylococcus
NDKDEYRK

SEQ ID NO: 1966577 - protein, 9 aa, Staphylococcus
NDKDIANGN

SEQ ID NO: 1966578 - protein, 7 aa, Staphylococcus
NDKDINN

SEQ ID NO: 1966579 - protein, 9 aa, Staphylococcus
NDKDKLKAY

SEQ ID NO: 1966580 - protein, 18 aa, Staphylococcus
NDKDPNSIKNDKPRIHSA

SEQ ID NO: 1966581 - protein, 7 aa, Staphylococcus
NDKDTLH

SEQ ID NO: 1966582 - protein, 13 aa, Staphylococcus
NDKDTLSKVGHSK

SEQ ID NO: 1966583 - protein, 10 aa, Staphylococcus
NDKDYRTNKE

SEQ ID NO: 1966584 - protein, 4 aa, Staphylococcus
NDKE

SEQ ID NO: 1966585 - protein, 18 aa, Staphylococcus
NDKEDRVYAKSDEKNKAI

SEQ ID NO: 1966586 - protein, 6 aa, Staphylococcus
NDKEEE

SEQ ID NO: 1966587 - protein, 7 aa, Staphylococcus
NDKEGLD

SEQ ID NO: 1966588 - protein, 8 aa, Staphylococcus
NDKEIRSE

SEQ ID NO: 1966589 - protein, 10 aa, Staphylococcus
NDKFDSARAK

SEQ ID NO: 1966590 - protein, 7 aa, Staphylococcus
NDKGELN

SEQ ID NO: 1966591 - protein, 8 aa, Staphylococcus
NDKGELNG

SEQ ID NO: 1966592 - protein, 9 aa, Staphylococcus
NDKGKNDEI

SEQ ID NO: 1966593 - protein, 8 aa, Staphylococcus
NDKGQSMY

SEQ ID NO: 1966594 - protein, 8 aa, Staphylococcus
NDKHEATL

SEQ ID NO: 1966595 - protein, 8 aa, Staphylococcus
NDKHGTGL

SEQ ID NO: 1966596 - protein, 13 aa, Staphylococcus
NDKHPAIRRTAGD

SEQ ID NO: 1966597 - protein, 7 aa, Staphylococcus
NDKIEED

SEQ ID NO: 1966598 - protein, 9 aa, Staphylococcus
NDKKGMEVS

SEQ ID NO: 1966599 - protein, 12 aa, Staphylococcus
NDKKLKDYTEEE

SEQ ID NO: 1966600 - protein, 6 aa, Staphylococcus
NDKKRC

SEQ ID NO: 1966601 - protein, 7 aa, Staphylococcus
NDKLNNG

SEQ ID NO: 1966602 - protein, 6 aa, Staphylococcus
NDKLRQ

SEQ ID NO: 1966603 - protein, 11 aa, Staphylococcus
NDKNDADEINS

SEQ ID NO: 1966604 - protein, 10 aa, Staphylococcus
NDKNHQKKIK

SEQ ID NO: 1966605 - protein, 20 aa, Staphylococcus
NDKNPGVRRTAGDGLSDLGY

SEQ ID NO: 1966606 - protein, 8 aa, Staphylococcus
NDKPATLT

SEQ ID NO: 1966607 - protein, 12 aa, Staphylococcus
NDKPQTFKDFLM

SEQ ID NO: 1966608 - protein, 5 aa, Staphylococcus
NDKPV

SEQ ID NO: 1966609 - protein, 11 aa, Staphylococcus
NDKPYRSKNEG

SEQ ID NO: 1966610 - protein, 4 aa, Staphylococcus
NDKQ

SEQ ID NO: 1966611 - protein, 5 aa, Staphylococcus
NDKQK

SEQ ID NO: 1966612 - protein, 9 aa, Staphylococcus
NDKQKQQFQ

SEQ ID NO: 1966613 - protein, 6 aa, Staphylococcus
NDKQLN

SEQ ID NO: 1966614 - protein, 8 aa, Staphylococcus
NDKQLPQL

SEQ ID NO: 1966615 - protein, 9 aa, Staphylococcus
NDKQPSLET

SEQ ID NO: 1966616 - protein, 9 aa, Staphylococcus
NDKQTVGIG

SEQ ID NO: 1966617 - protein, 4 aa, Staphylococcus
NDKR

SEQ ID NO: 1966618 - protein, 6 aa, Staphylococcus
NDKRPM

SEQ ID NO: 1966619 - protein, 11 aa, Staphylococcus
NDKRQKVKTYP

SEQ ID NO: 1966620 - protein, 10 aa, Staphylococcus
NDKRQQIQDE

SEQ ID NO: 1966621 - protein, 6 aa, Staphylococcus
NDKSQA

SEQ ID NO: 1966622 - protein, 13 aa, Staphylococcus
NDKSQAKILVKLN

SEQ ID NO: 1966623 - protein, 16 aa, Staphylococcus
NDKSQAKILVKLNGDQ

SEQ ID NO: 1966624 - protein, 16 aa, Staphylococcus
NDKSQAKILVRLNGDQ

SEQ ID NO: 1966625 - protein, 4 aa, Staphylococcus
NDKT

SEQ ID NO: 1966626 - protein, 8 aa, Staphylococcus
NDKTEKIV

SEQ ID NO: 1966627 - protein, 6 aa, Staphylococcus
NDKTMK

SEQ ID NO: 1966628 - protein, 6 aa, Staphylococcus
NDKVDN

SEQ ID NO: 1966629 - protein, 13 aa, Staphylococcus
NDLAQIERKFIRT

SEQ ID NO: 1966630 - protein, 4 aa, Staphylococcus
NDLD

SEQ ID NO: 1966631 - protein, 6 aa, Staphylococcus
NDLDNQ

SEQ ID NO: 1966632 - protein, 10 aa, Staphylococcus
NDLDSLKDSL

SEQ ID NO: 1966633 - protein, 5 aa, Staphylococcus
NDLEE

SEQ ID NO: 1966634 - protein, 6 aa, Staphylococcus
NDLESK

SEQ ID NO: 1966635 - protein, 42 aa, Staphylococcus
NDLGENIGEDDKKNAEDKKDALKSALEGEDIDDIKAKKEELE

SEQ ID NO: 1966636 - protein, 11 aa, Staphylococcus
NDLGERNADTF

SEQ ID NO: 1966637 - protein, 11 aa, Staphylococcus
NDLKQQNTEFA

SEQ ID NO: 1966638 - protein, 10 aa, Staphylococcus
NDLNSRGINS

SEQ ID NO: 1966639 - protein, 6 aa, Staphylococcus
NDLPEG

SEQ ID NO: 1966640 - protein, 8 aa, Staphylococcus
NDLPLGKL

SEQ ID NO: 1966641 - protein, 6 aa, Staphylococcus
NDLPRL

SEQ ID NO: 1966642 - protein, 6 aa, Staphylococcus
NDLPYN

SEQ ID NO: 1966643 - protein, 4 aa, Staphylococcus
NDLQ

SEQ ID NO: 1966644 - protein, 4 aa, Staphylococcus
NDLS

SEQ ID NO: 1966645 - protein, 7 aa, Staphylococcus
NDLSEGL

SEQ ID NO: 1966646 - protein, 9 aa, Staphylococcus
NDLSKRIEK

SEQ ID NO: 1966647 - protein, 26 aa, Staphylococcus
NDLSTDDENVKTTTTPNHSKKDNTIN

SEQ ID NO: 1966648 - protein, 6 aa, Staphylococcus
NDLTDT

SEQ ID NO: 1966649 - protein, 45 aa, Staphylococcus
NDLTEEEKAMKNNAQSQSQSTQTSETTSTSQSDSTSTSQSESTSL

SEQ ID NO: 1966650 - protein, 45 aa, Staphylococcus
NDLTPEERAMKESQSQAENNNGTTSTSESSRTSNNQSETSTTHSN

SEQ ID NO: 1966651 - protein, 6 aa, Staphylococcus
NDMDPD

SEQ ID NO: 1966652 - protein, 5 aa, Staphylococcus
NDMPE

SEQ ID NO: 1966653 - protein, 12 aa, Staphylococcus
NDMPHNDNQPSI

SEQ ID NO: 1966654 - protein, 8 aa, Staphylococcus
NDNADTEE

SEQ ID NO: 1966655 - protein, 7 aa, Staphylococcus
NDNAGNK

SEQ ID NO: 1966656 - protein, 10 aa, Staphylococcus
NDNAQNEAKT

SEQ ID NO: 1966657 - protein, 10 aa, Staphylococcus
NDNAYKSKNQ

SEQ ID NO: 1966658 - protein, 4 aa, Staphylococcus
NDND

SEQ ID NO: 1966659 - protein, 6 aa, Staphylococcus
NDNDFT

SEQ ID NO: 1966660 - protein, 16 aa, Staphylococcus
NDNDNHIEHENEQSNH

SEQ ID NO: 1966661 - protein, 5 aa, Staphylococcus
NDNEI

SEQ ID NO: 1966662 - protein, 5 aa, Staphylococcus
NDNEL

SEQ ID NO: 1966663 - protein, 7 aa, Staphylococcus
NDNEQLD

SEQ ID NO: 1966664 - protein, 5 aa, Staphylococcus
NDNEW

SEQ ID NO: 1966665 - protein, 6 aa, Staphylococcus
NDNGEA

SEQ ID NO: 1966666 - protein, 6 aa, Staphylococcus
NDNGTK

SEQ ID NO: 1966667 - protein, 6 aa, Staphylococcus
NDNGTT

SEQ ID NO: 1966668 - protein, 7 aa, Staphylococcus
NDNHKGV

SEQ ID NO: 1966669 - protein, 10 aa, Staphylococcus
NDNKEISDYT

SEQ ID NO: 1966670 - protein, 9 aa, Staphylococcus
NDNKPHAQA

SEQ ID NO: 1966671 - protein, 5 aa, Staphylococcus
NDNLR

SEQ ID NO: 1966672 - protein, 4 aa, Staphylococcus
NDNN

SEQ ID NO: 1966673 - protein, 9 aa, Staphylococcus
NDNPADGRD

SEQ ID NO: 1966674 - protein, 23 aa, Staphylococcus
NDNPSKQSIESSQVYKSRQSRIE

SEQ ID NO: 1966675 - protein, 21 aa, Staphylococcus
NDNPVEKIEENIKSKENKAKF

SEQ ID NO: 1966676 - protein, 11 aa, Staphylococcus
NDNQASSINTG

SEQ ID NO: 1966677 - protein, 16 aa, Staphylococcus
NDNSSSVDETLKPAVV

SEQ ID NO: 1966678 - protein, 8 aa, Staphylococcus
NDNTINTG

SEQ ID NO: 1966679 - protein, 15 aa, Staphylococcus
NDNTPGNTNESEPYG

SEQ ID NO: 1966680 - protein, 5 aa, Staphylococcus
NDNTQ

SEQ ID NO: 1966681 - protein, 8 aa, Staphylococcus
NDNVNTDI

SEQ ID NO: 1966682 - protein, 8 aa, Staphylococcus
NDNYHPES

SEQ ID NO: 1966683 - protein, 24 aa, Staphylococcus
NDNYNNKAKAFNDNYDKKNSDINT

SEQ ID NO: 1966684 - protein, 17 aa, Staphylococcus
NDNYPNRTMIVNNVPLE

SEQ ID NO: 1966685 - protein, 7 aa, Staphylococcus
NDNYWDK

SEQ ID NO: 1966686 - protein, 4 aa, Staphylococcus
NDPA

SEQ ID NO: 1966687 - protein, 8 aa, Staphylococcus
NDPAINPE

SEQ ID NO: 1966688 - protein, 5 aa, Staphylococcus
NDPDF

SEQ ID NO: 1966689 - protein, 7 aa, Staphylococcus
NDPDFQP

SEQ ID NO: 1966690 - protein, 8 aa, Staphylococcus
NDPDGTRF

SEQ ID NO: 1966691 - protein, 5 aa, Staphylococcus
NDPDL

SEQ ID NO: 1966692 - protein, 9 aa, Staphylococcus
NDPEGNGIE

SEQ ID NO: 1966693 - protein, 6 aa, Staphylococcus
NDPERL

SEQ ID NO: 1966694 - protein, 9 aa, Staphylococcus
NDPEYRAKR

SEQ ID NO: 1966695 - protein, 16 aa, Staphylococcus
NDPHRPNAKNKSEKQL

SEQ ID NO: 1966696 - protein, 10 aa, Staphylococcus
NDPIDQKERF

SEQ ID NO: 1966697 - protein, 8 aa, Staphylococcus
NDPIDQRA

SEQ ID NO: 1966698 - protein, 13 aa, Staphylococcus
NDPITGAIAEDDT

SEQ ID NO: 1966699 - protein, 9 aa, Staphylococcus
NDPKLSQLE

SEQ ID NO: 1966700 - protein, 4 aa, Staphylococcus
NDPL

SEQ ID NO: 1966701 - protein, 4 aa, Staphylococcus
NDPN

SEQ ID NO: 1966702 - protein, 8 aa, Staphylococcus
NDPNIDPE

SEQ ID NO: 1966703 - protein, 7 aa, Staphylococcus
NDPNQKD

SEQ ID NO: 1966704 - protein, 8 aa, Staphylococcus
NDPRAEGN

SEQ ID NO: 1966705 - protein, 5 aa, Staphylococcus
NDPRV

SEQ ID NO: 1966706 - protein, 8 aa, Staphylococcus
NDPSDSKK

SEQ ID NO: 1966707 - protein, 6 aa, Staphylococcus
NDPSEL

SEQ ID NO: 1966708 - protein, 4 aa, Staphylococcus
NDPT

SEQ ID NO: 1966709 - protein, 5 aa, Staphylococcus
NDPTE

SEQ ID NO: 1966710 - protein, 5 aa, Staphylococcus
NDPTY

SEQ ID NO: 1966711 - protein, 9 aa, Staphylococcus
NDPTYQKEI

SEQ ID NO: 1966712 - protein, 5 aa, Staphylococcus
NDPWE

SEQ ID NO: 1966713 - protein, 7 aa, Staphylococcus
NDPWETY

SEQ ID NO: 1966714 - protein, 9 aa, Staphylococcus
NDQAKAVGA

SEQ ID NO: 1966715 - protein, 13 aa, Staphylococcus
NDQDLNALKPKSL

SEQ ID NO: 1966716 - protein, 5 aa, Staphylococcus
NDQEK

SEQ ID NO: 1966717 - protein, 6 aa, Staphylococcus
NDQELE

SEQ ID NO: 1966718 - protein, 21 aa, Staphylococcus
NDQEQKKLSAELTQINPQATT

SEQ ID NO: 1966719 - protein, 14 aa, Staphylococcus
NDQGEENLNKKGGQ

SEQ ID NO: 1966720 - protein, 12 aa, Staphylococcus
NDQGIHKRGAEI

SEQ ID NO: 1966721 - protein, 7 aa, Staphylococcus
NDQGKLD

SEQ ID NO: 1966722 - protein, 8 aa, Staphylococcus
NDQGTKVF

SEQ ID NO: 1966723 - protein, 7 aa, Staphylococcus
NDQLANQ

SEQ ID NO: 1966724 - protein, 9 aa, Staphylococcus
NDQLDEEYR

SEQ ID NO: 1966725 - protein, 34 aa, Staphylococcus
NDQLKKDEKNGDITEDDLRSQTEDVQKATDNSIK

SEQ ID NO: 1966726 - protein, 28 aa, Staphylococcus
NDQNSNIYETTSSKSKVPNFSQKDNTVN

SEQ ID NO: 1966727 - protein, 16 aa, Staphylococcus
NDQPGIVGKTGNLLGD

SEQ ID NO: 1966728 - protein, 5 aa, Staphylococcus
NDQRC

SEQ ID NO: 1966729 - protein, 13 aa, Staphylococcus
NDQRQPYWTENYT

SEQ ID NO: 1966730 - protein, 6 aa, Staphylococcus
NDQSMR

SEQ ID NO: 1966731 - protein, 5 aa, Staphylococcus
NDQSV

SEQ ID NO: 1966732 - protein, 5 aa, Staphylococcus
NDQTD

SEQ ID NO: 1966733 - protein, 9 aa, Staphylococcus
NDQTEGSPQ

SEQ ID NO: 1966734 - protein, 14 aa, Staphylococcus
NDQTPQLTLNEGNT

SEQ ID NO: 1966735 - protein, 6 aa, Staphylococcus
NDQTQV

SEQ ID NO: 1966736 - protein, 9 aa, Staphylococcus
NDQTRKRVY

SEQ ID NO: 1966737 - protein, 8 aa, Staphylococcus
NDQVELKE

SEQ ID NO: 1966738 - protein, 8 aa, Staphylococcus
NDREAQDI

SEQ ID NO: 1966739 - protein, 14 aa, Staphylococcus
NDRETEETVETATK

SEQ ID NO: 1966740 - protein, 7 aa, Staphylococcus
NDRGELN

SEQ ID NO: 1966741 - protein, 8 aa, Staphylococcus
NDRKKAKD

SEQ ID NO: 1966742 - protein, 10 aa, Staphylococcus
NDRPGIVGRT

SEQ ID NO: 1966743 - protein, 8 aa, Staphylococcus
NDRPSTAK

SEQ ID NO: 1966744 - protein, 7 aa, Staphylococcus
NDRQGPH

SEQ ID NO: 1966745 - protein, 6 aa, Staphylococcus
NDRRYH

SEQ ID NO: 1966746 - protein, 6 aa, Staphylococcus
NDRRYT

SEQ ID NO: 1966747 - protein, 9 aa, Staphylococcus
NDRTKLEET

SEQ ID NO: 1966748 - protein, 12 aa, Staphylococcus
NDSDKLDNYMFY

SEQ ID NO: 1966749 - protein, 7 aa, Staphylococcus
NDSDYQS

SEQ ID NO: 1966750 - protein, 8 aa, Staphylococcus
NDSERLAD

SEQ ID NO: 1966751 - protein, 8 aa, Staphylococcus
NDSETANR

SEQ ID NO: 1966752 - protein, 11 aa, Staphylococcus
NDSEVGEYTNV

SEQ ID NO: 1966753 - protein, 7 aa, Staphylococcus
NDSEYGL

SEQ ID NO: 1966754 - protein, 6 aa, Staphylococcus
NDSEYI

SEQ ID NO: 1966755 - protein, 18 aa, Staphylococcus
NDSFDAAIDNAKKDMESN

SEQ ID NO: 1966756 - protein, 8 aa, Staphylococcus
NDSFDGST

SEQ ID NO: 1966757 - protein, 11 aa, Staphylococcus
NDSGIDKAGGL

SEQ ID NO: 1966758 - protein, 8 aa, Staphylococcus
NDSGYRIG

SEQ ID NO: 1966759 - protein, 5 aa, Staphylococcus
NDSIN

SEQ ID NO: 1966760 - protein, 6 aa, Staphylococcus
NDSIQS

SEQ ID NO: 1966761 - protein, 8 aa, Staphylococcus
NDSKEARK

SEQ ID NO: 1966762 - protein, 9 aa, Staphylococcus
NDSKERSEH

SEQ ID NO: 1966763 - protein, 15 aa, Staphylococcus
NDSKKLSAKQRHSIE

SEQ ID NO: 1966764 - protein, 16 aa, Staphylococcus
NDSKNDIGAHKDRHEN

SEQ ID NO: 1966765 - protein, 16 aa, Staphylococcus
NDSKNERGAHKDRHEN

SEQ ID NO: 1966766 - protein, 13 aa, Staphylococcus
NDSLGKDKDGNDV

SEQ ID NO: 1966767 - protein, 8 aa, Staphylococcus
NDSNDDLL

SEQ ID NO: 1966768 - protein, 8 aa, Staphylococcus
NDSNEDIL

SEQ ID NO: 1966769 - protein, 8 aa, Staphylococcus
NDSNGQPL

SEQ ID NO: 1966770 - protein, 5 aa, Staphylococcus
NDSNI

SEQ ID NO: 1966771 - protein, 12 aa, Staphylococcus
NDSNNYVHPKDA

SEQ ID NO: 1966772 - protein, 8 aa, Staphylococcus
NDSNQEAF

SEQ ID NO: 1966773 - protein, 8 aa, Staphylococcus
NDSPRNIL

SEQ ID NO: 1966774 - protein, 4 aa, Staphylococcus
NDSS

SEQ ID NO: 1966775 - protein, 17 aa, Staphylococcus
NDSSLFDEKINEADTII

SEQ ID NO: 1966776 - protein, 16 aa, Staphylococcus
NDSTDSCEKILKEIFE

SEQ ID NO: 1966777 - protein, 7 aa, Staphylococcus
NDSTTVI

SEQ ID NO: 1966778 - protein, 11 aa, Staphylococcus
NDSYVSYKETK

SEQ ID NO: 1966779 - protein, 7 aa, Staphylococcus
NDTAEVA

SEQ ID NO: 1966780 - protein, 7 aa, Staphylococcus
NDTAQFT

SEQ ID NO: 1966781 - protein, 14 aa, Staphylococcus
NDTAVGIASSQGNF

SEQ ID NO: 1966782 - protein, 16 aa, Staphylococcus
NDTDETTQSRLTSGYE

SEQ ID NO: 1966783 - protein, 12 aa, Staphylococcus
NDTDNVTTHKAQ

SEQ ID NO: 1966784 - protein, 13 aa, Staphylococcus
NDTEEAVTSATYT

SEQ ID NO: 1966785 - protein, 6 aa, Staphylococcus
NDTELE

SEQ ID NO: 1966786 - protein, 6 aa, Staphylococcus
NDTELP

SEQ ID NO: 1966787 - protein, 35 aa, Staphylococcus
NDTESDDESTDQSNEDSSSSEQQSTSNSSSQNAKQ

SEQ ID NO: 1966788 - protein, 7 aa, Staphylococcus
NDTEYGL

SEQ ID NO: 1966789 - protein, 4 aa, Staphylococcus
NDTF

SEQ ID NO: 1966790 - protein, 16 aa, Staphylococcus
NDTFTTKTLAERAEPV

SEQ ID NO: 1966791 - protein, 16 aa, Staphylococcus
NDTISKLNNDQPKFIV

SEQ ID NO: 1966792 - protein, 17 aa, Staphylococcus
NDTKEAMELTRTSKGDA

SEQ ID NO: 1966793 - protein, 9 aa, Staphylococcus
NDTKPHADT

SEQ ID NO: 1966794 - protein, 7 aa, Staphylococcus
NDTKQRS

SEQ ID NO: 1966795 - protein, 7 aa, Staphylococcus
NDTKYGL

SEQ ID NO: 1966796 - protein, 9 aa, Staphylococcus
NDTNDAPFS

SEQ ID NO: 1966797 - protein, 6 aa, Staphylococcus
NDTNEV

SEQ ID NO: 1966798 - protein, 5 aa, Staphylococcus
NDTNF

SEQ ID NO: 1966799 - protein, 5 aa, Staphylococcus
NDTPI

SEQ ID NO: 1966800 - protein, 6 aa, Staphylococcus
NDTPLN

SEQ ID NO: 1966801 - protein, 8 aa, Staphylococcus
NDTQLDND

SEQ ID NO: 1966802 - protein, 5 aa, Staphylococcus
NDTRA

SEQ ID NO: 1966803 - protein, 19 aa, Staphylococcus
NDTSIQKGFETYTSDNGRM

SEQ ID NO: 1966804 - protein, 10 aa, Staphylococcus
NDTSRFNQAS

SEQ ID NO: 1966805 - protein, 13 aa, Staphylococcus
NDTTNLSETKAQY

SEQ ID NO: 1966806 - protein, 6 aa, Staphylococcus
NDTVLE

SEQ ID NO: 1966807 - protein, 7 aa, Staphylococcus
NDTVRAR

SEQ ID NO: 1966808 - protein, 7 aa, Staphylococcus
NDTYEGV

SEQ ID NO: 1966809 - protein, 16 aa, Staphylococcus
NDVAYREKNISNTQYR

SEQ ID NO: 1966810 - protein, 5 aa, Staphylococcus
NDVDD

SEQ ID NO: 1966811 - protein, 5 aa, Staphylococcus
NDVDG

SEQ ID NO: 1966812 - protein, 4 aa, Staphylococcus
NDVE

SEQ ID NO: 1966813 - protein, 50 aa, Staphylococcus
NDVERENELGNIEKNEHAEDRHNDATSKQKDVTDRLDTHDVKDSDHSGVD

SEQ ID NO: 1966814 - protein, 14 aa, Staphylococcus
NDVGGDINKINPEV

SEQ ID NO: 1966815 - protein, 10 aa, Staphylococcus
NDVKDNTKYE

SEQ ID NO: 1966816 - protein, 6 aa, Staphylococcus
NDVKEG

SEQ ID NO: 1966817 - protein, 6 aa, Staphylococcus
NDVKPY

SEQ ID NO: 1966818 - protein, 8 aa, Staphylococcus
NDVNGAQS

SEQ ID NO: 1966819 - protein, 8 aa, Staphylococcus
NDVNGNTV

SEQ ID NO: 1966820 - protein, 24 aa, Staphylococcus
NDVPGDDANYKMNPPLRSKEDREA

SEQ ID NO: 1966821 - protein, 24 aa, Staphylococcus
NDVPGDDANYKMNPPLRSTEDRDA

SEQ ID NO: 1966822 - protein, 7 aa, Staphylococcus
NDVTNNV

SEQ ID NO: 1966823 - protein, 7 aa, Staphylococcus
NDVTQNV

SEQ ID NO: 1966824 - protein, 39 aa, Staphylococcus
NDVTSLKTTFETDYANKVKTFNDNVTDKTTTFNNNYTTK

SEQ ID NO: 1966825 - protein, 4 aa, Staphylococcus
NDWE

SEQ ID NO: 1966826 - protein, 7 aa, Staphylococcus
NDWGQKE

SEQ ID NO: 1966827 - protein, 12 aa, Staphylococcus
NDWGQKETDVER

SEQ ID NO: 1966828 - protein, 13 aa, Staphylococcus
NDWGQKTKDVDRY

SEQ ID NO: 1966829 - protein, 10 aa, Staphylococcus
NDWPETPRVS

SEQ ID NO: 1966830 - protein, 7 aa, Staphylococcus
NDYADAR

SEQ ID NO: 1966831 - protein, 8 aa, Staphylococcus
NDYADARG

SEQ ID NO: 1966832 - protein, 10 aa, Staphylococcus
NDYADESELD

SEQ ID NO: 1966833 - protein, 11 aa, Staphylococcus
NDYASEEEAIE

SEQ ID NO: 1966834 - protein, 11 aa, Staphylococcus
NDYASEQEAIE

SEQ ID NO: 1966835 - protein, 7 aa, Staphylococcus
NDYDEVR

SEQ ID NO: 1966836 - protein, 4 aa, Staphylococcus
NDYE

SEQ ID NO: 1966837 - protein, 6 aa, Staphylococcus
NDYEPQ

SEQ ID NO: 1966838 - protein, 11 aa, Staphylococcus
NDYESEEEAIE

SEQ ID NO: 1966839 - protein, 11 aa, Staphylococcus
NDYETNKTNQY

SEQ ID NO: 1966840 - protein, 19 aa, Staphylococcus
NDYKNGDISYNPNIPSYSA

SEQ ID NO: 1966841 - protein, 5 aa, Staphylococcus
NDYNN

SEQ ID NO: 1966842 - protein, 8 aa, Staphylococcus
NDYPDVKD

SEQ ID NO: 1966843 - protein, 12 aa, Staphylococcus
NDYPETTQPGEV

SEQ ID NO: 1966844 - protein, 7 aa, Staphylococcus
NDYPNYG

SEQ ID NO: 1966845 - protein, 5 aa, Staphylococcus
NDYQQ

SEQ ID NO: 1966846 - protein, 18 aa, Staphylococcus
NDYRDTKLQSTRKAFEEE

SEQ ID NO: 1966847 - protein, 4 aa, Staphylococcus
NDYS

SEQ ID NO: 1966848 - protein, 6 aa, Staphylococcus
NDYSGH

SEQ ID NO: 1966849 - protein, 8 aa, Staphylococcus
NDYSGHDV

SEQ ID NO: 1966850 - protein, 9 aa, Staphylococcus
NDYSGVTGS

SEQ ID NO: 1966851 - protein, 9 aa, Staphylococcus
NDYSKDDAV

SEQ ID NO: 1966852 - protein, 47 aa, Staphylococcus
NDYTEGVNYNPKKGNAKEQDPEGVEQTNDKEDQHSDSQDNEQADNKN

SEQ ID NO: 1966853 - protein, 4 aa, Staphylococcus
NEAA

SEQ ID NO: 1966854 - protein, 12 aa, Staphylococcus
NEAANDAANEED

SEQ ID NO: 1966855 - protein, 6 aa, Staphylococcus
NEADDV

SEQ ID NO: 1966856 - protein, 10 aa, Staphylococcus
NEADEDTRDL

SEQ ID NO: 1966857 - protein, 9 aa, Staphylococcus
NEADEKEMF

SEQ ID NO: 1966858 - protein, 5 aa, Staphylococcus
NEADF

SEQ ID NO: 1966859 - protein, 6 aa, Staphylococcus
NEADLD

SEQ ID NO: 1966860 - protein, 10 aa, Staphylococcus
NEADNERALQ

SEQ ID NO: 1966861 - protein, 7 aa, Staphylococcus
NEAEDQA

SEQ ID NO: 1966862 - protein, 11 aa, Staphylococcus
NEAEDQSTVTV

SEQ ID NO: 1966863 - protein, 8 aa, Staphylococcus
NEAEEGTY

SEQ ID NO: 1966864 - protein, 8 aa, Staphylococcus
NEAEEKVR

SEQ ID NO: 1966865 - protein, 6 aa, Staphylococcus
NEAENV

SEQ ID NO: 1966866 - protein, 6 aa, Staphylococcus
NEAESR

SEQ ID NO: 1966867 - protein, 8 aa, Staphylococcus
NEAETDCA

SEQ ID NO: 1966868 - protein, 8 aa, Staphylococcus
NEAFEKSE

SEQ ID NO: 1966869 - protein, 27 aa, Staphylococcus
NEAGEKIKIAEDEKMTGNKTYYGPSHG

SEQ ID NO: 1966870 - protein, 6 aa, Staphylococcus
NEAGLK

SEQ ID NO: 1966871 - protein, 22 aa, Staphylococcus
NEAGNQPDLPFGGYKQSGIGRE

SEQ ID NO: 1966872 - protein, 22 aa, Staphylococcus
NEAGRKPDLPFGGYKQSGLGRE

SEQ ID NO: 1966873 - protein, 23 aa, Staphylococcus
NEAGRKPDLPFGGYKQSGLGREW

SEQ ID NO: 1966874 - protein, 6 aa, Staphylococcus
NEAHRE

SEQ ID NO: 1966875 - protein, 5 aa, Staphylococcus
NEAIH

SEQ ID NO: 1966876 - protein, 9 aa, Staphylococcus
NEAITTELT

SEQ ID NO: 1966877 - protein, 11 aa, Staphylococcus
NEAKDDPDKVL

SEQ ID NO: 1966878 - protein, 9 aa, Staphylococcus
NEAKDNPDV

SEQ ID NO: 1966879 - protein, 10 aa, Staphylococcus
NEAKEDPDKV

SEQ ID NO: 1966880 - protein, 11 aa, Staphylococcus
NEAKEDPDKVL

SEQ ID NO: 1966881 - protein, 21 aa, Staphylococcus
NEAKEKANQRVKSATKEADDI

SEQ ID NO: 1966882 - protein, 20 aa, Staphylococcus
NEAKEKANQRVKSATKEADT

SEQ ID NO: 1966883 - protein, 11 aa, Staphylococcus
NEAKIKTEHNT

SEQ ID NO: 1966884 - protein, 9 aa, Staphylococcus
NEAKKIATE

SEQ ID NO: 1966885 - protein, 12 aa, Staphylococcus
NEAKNLLNDNGG

SEQ ID NO: 1966886 - protein, 22 aa, Staphylococcus
NEAMKKATGQQTALTEQDGSAI

SEQ ID NO: 1966887 - protein, 6 aa, Staphylococcus
NEANRK

SEQ ID NO: 1966888 - protein, 5 aa, Staphylococcus
NEANY

SEQ ID NO: 1966889 - protein, 6 aa, Staphylococcus
NEAPTH

SEQ ID NO: 1966890 - protein, 6 aa, Staphylococcus
NEAPTS

SEQ ID NO: 1966891 - protein, 10 aa, Staphylococcus
NEAQDERALQ

SEQ ID NO: 1966892 - protein, 6 aa, Staphylococcus
NEAQLE

SEQ ID NO: 1966893 - protein, 10 aa, Staphylococcus
NEAQNEKALQ

SEQ ID NO: 1966894 - protein, 9 aa, Staphylococcus
NEAQRTGDI

SEQ ID NO: 1966895 - protein, 12 aa, Staphylococcus
NEAQTEPKGDAY

SEQ ID NO: 1966896 - protein, 11 aa, Staphylococcus
NEASHQDDSFS

SEQ ID NO: 1966897 - protein, 7 aa, Staphylococcus
NEASPYI

SEQ ID NO: 1966898 - protein, 6 aa, Staphylococcus
NEATER

SEQ ID NO: 1966899 - protein, 7 aa, Staphylococcus
NEATKQA

SEQ ID NO: 1966900 - protein, 11 aa, Staphylococcus
NEATNENYEDS

SEQ ID NO: 1966901 - protein, 13 aa, Staphylococcus
NEATPSLTLNEGH

SEQ ID NO: 1966902 - protein, 5 aa, Staphylococcus
NEATS

SEQ ID NO: 1966903 - protein, 9 aa, Staphylococcus
NEATSWSNL

SEQ ID NO: 1966904 - protein, 9 aa, Staphylococcus
NEATVDIET

SEQ ID NO: 1966905 - protein, 5 aa, Staphylococcus
NEAVE

SEQ ID NO: 1966906 - protein, 12 aa, Staphylococcus
NEAVQEAGKISE

SEQ ID NO: 1966907 - protein, 13 aa, Staphylococcus
NEAVQEAGKISEG

SEQ ID NO: 1966908 - protein, 14 aa, Staphylococcus
NEAVQEAGKISEGT

SEQ ID NO: 1966909 - protein, 14 aa, Staphylococcus
NEAVQKAGKISEGT

SEQ ID NO: 1966910 - protein, 12 aa, Staphylococcus
NEAVQNAGKISE

SEQ ID NO: 1966911 - protein, 4 aa, Staphylococcus
NEAY

SEQ ID NO: 1966912 - protein, 4 aa, Staphylococcus
NEDA

SEQ ID NO: 1966913 - protein, 7 aa, Staphylococcus
NEDAPLT

SEQ ID NO: 1966914 - protein, 10 aa, Staphylococcus
NEDDDNPDYA

SEQ ID NO: 1966915 - protein, 7 aa, Staphylococcus
NEDDETK

SEQ ID NO: 1966916 - protein, 13 aa, Staphylococcus
NEDDIKDKMSTSR

SEQ ID NO: 1966917 - protein, 5 aa, Staphylococcus
NEDDQ

SEQ ID NO: 1966918 - protein, 7 aa, Staphylococcus
NEDDQKW

SEQ ID NO: 1966919 - protein, 9 aa, Staphylococcus
NEDDTTQTA

SEQ ID NO: 1966920 - protein, 5 aa, Staphylococcus
NEDDY

SEQ ID NO: 1966921 - protein, 4 aa, Staphylococcus
NEDE

SEQ ID NO: 1966922 - protein, 7 aa, Staphylococcus
NEDEDTK

SEQ ID NO: 1966923 - protein, 7 aa, Staphylococcus
NEDEETK

SEQ ID NO: 1966924 - protein, 8 aa, Staphylococcus
NEDEMTSE

SEQ ID NO: 1966925 - protein, 5 aa, Staphylococcus
NEDET

SEQ ID NO: 1966926 - protein, 9 aa, Staphylococcus
NEDETTQTA

SEQ ID NO: 1966927 - protein, 5 aa, Staphylococcus
NEDFK

SEQ ID NO: 1966928 - protein, 9 aa, Staphylococcus
NEDFQGYGY

SEQ ID NO: 1966929 - protein, 4 aa, Staphylococcus
NEDG

SEQ ID NO: 1966930 - protein, 7 aa, Staphylococcus
NEDGDEI

SEQ ID NO: 1966931 - protein, 12 aa, Staphylococcus
NEDGDLSDDTEF

SEQ ID NO: 1966932 - protein, 93 aa, Staphylococcus
NEDGEQITKPSKPKSNSKPKKNNKIGNGSNQNNESKNNQGGRPPKRNNNGRNNQSKNNKPANKKESSSKSGSNSTQKSHSKPKNKPDSKKENK

SEQ ID NO: 1966933 - protein, 5 aa, Staphylococcus
NEDGS

SEQ ID NO: 1966934 - protein, 6 aa, Staphylococcus
NEDGSI

SEQ ID NO: 1966935 - protein, 7 aa, Staphylococcus
NEDGSIA

SEQ ID NO: 1966936 - protein, 7 aa, Staphylococcus
NEDGSTF

SEQ ID NO: 1966937 - protein, 9 aa, Staphylococcus
NEDGTPSAI

SEQ ID NO: 1966938 - protein, 5 aa, Staphylococcus
NEDIE

SEQ ID NO: 1966939 - protein, 6 aa, Staphylococcus
NEDINV

SEQ ID NO: 1966940 - protein, 7 aa, Staphylococcus
NEDIPDE

SEQ ID NO: 1966941 - protein, 7 aa, Staphylococcus
NEDITES

SEQ ID NO: 1966942 - protein, 8 aa, Staphylococcus
NEDITKQI

SEQ ID NO: 1966943 - protein, 5 aa, Staphylococcus
NEDIY

SEQ ID NO: 1966944 - protein, 10 aa, Staphylococcus
NEDKEIKKKI

SEQ ID NO: 1966945 - protein, 8 aa, Staphylococcus
NEDKESEI

SEQ ID NO: 1966946 - protein, 22 aa, Staphylococcus
NEDKGNNKPSNKKNNKQDKNES

SEQ ID NO: 1966947 - protein, 10 aa, Staphylococcus
NEDKKATNIL

SEQ ID NO: 1966948 - protein, 8 aa, Staphylococcus
NEDKKHPQ

SEQ ID NO: 1966949 - protein, 10 aa, Staphylococcus
NEDLAKGEAL

SEQ ID NO: 1966950 - protein, 7 aa, Staphylococcus
NEDNKDI

SEQ ID NO: 1966951 - protein, 63 aa, Staphylococcus
NEDNNQTSTKKPSNKNTKPKKNNTKSPSKNQQNVEKSSNKNGSNKANQSVEKPKQSNQNQNSE

SEQ ID NO: 1966952 - protein, 10 aa, Staphylococcus
NEDNQEEQTL

SEQ ID NO: 1966953 - protein, 19 aa, Staphylococcus
NEDNSISVEDNGRGMPTGM

SEQ ID NO: 1966954 - protein, 7 aa, Staphylococcus
NEDNSYM

SEQ ID NO: 1966955 - protein, 9 aa, Staphylococcus
NEDPDAYED

SEQ ID NO: 1966956 - protein, 9 aa, Staphylococcus
NEDPEAYDD

SEQ ID NO: 1966957 - protein, 9 aa, Staphylococcus
NEDPEAYED

SEQ ID NO: 1966958 - protein, 7 aa, Staphylococcus
NEDPETK

SEQ ID NO: 1966959 - protein, 9 aa, Staphylococcus
NEDPETYED

SEQ ID NO: 1966960 - protein, 7 aa, Staphylococcus
NEDPEYT

SEQ ID NO: 1966961 - protein, 4 aa, Staphylococcus
NEDQ

SEQ ID NO: 1966962 - protein, 15 aa, Staphylococcus
NEDQASRLKEAGVDR

SEQ ID NO: 1966963 - protein, 11 aa, Staphylococcus
NEDQKKSAESY

SEQ ID NO: 1966964 - protein, 10 aa, Staphylococcus
NEDQKNVAEE

SEQ ID NO: 1966965 - protein, 8 aa, Staphylococcus
NEDQKRLA

SEQ ID NO: 1966966 - protein, 11 aa, Staphylococcus
NEDQRETAEQY

SEQ ID NO: 1966967 - protein, 9 aa, Staphylococcus
NEDRENEGD

SEQ ID NO: 1966968 - protein, 5 aa, Staphylococcus
NEDSD

SEQ ID NO: 1966969 - protein, 7 aa, Staphylococcus
NEDSDVV

SEQ ID NO: 1966970 - protein, 6 aa, Staphylococcus
NEDSNA

SEQ ID NO: 1966971 - protein, 8 aa, Staphylococcus
NEDSTRTF

SEQ ID NO: 1966972 - protein, 11 aa, Staphylococcus
NEDTGGNPKSL

SEQ ID NO: 1966973 - protein, 8 aa, Staphylococcus
NEDTSISN

SEQ ID NO: 1966974 - protein, 8 aa, Staphylococcus
NEDTTQMM

SEQ ID NO: 1966975 - protein, 6 aa, Staphylococcus
NEDVDE

SEQ ID NO: 1966976 - protein, 9 aa, Staphylococcus
NEDVDEPDY

SEQ ID NO: 1966977 - protein, 7 aa, Staphylococcus
NEDYQSK

SEQ ID NO: 1966978 - protein, 10 aa, Staphylococcus
NEEADDPDYE

SEQ ID NO: 1966979 - protein, 14 aa, Staphylococcus
NEEAHTLADEIIMI

SEQ ID NO: 1966980 - protein, 12 aa, Staphylococcus
NEEAMQDNHANL

SEQ ID NO: 1966981 - protein, 17 aa, Staphylococcus
NEEAYPNKDKIESTNIS

SEQ ID NO: 1966982 - protein, 8 aa, Staphylococcus
NEEDAKYV

SEQ ID NO: 1966983 - protein, 8 aa, Staphylococcus
NEEDDKVY

SEQ ID NO: 1966984 - protein, 23 aa, Staphylococcus
NEEDESYTVEGYRQKTNDEGKKQ

SEQ ID NO: 1966985 - protein, 7 aa, Staphylococcus
NEEDKEQ

SEQ ID NO: 1966986 - protein, 6 aa, Staphylococcus
NEEDPI

SEQ ID NO: 1966987 - protein, 5 aa, Staphylococcus
NEEDQ

SEQ ID NO: 1966988 - protein, 8 aa, Staphylococcus
NEEDQRYV

SEQ ID NO: 1966989 - protein, 5 aa, Staphylococcus
NEEDR

SEQ ID NO: 1966990 - protein, 6 aa, Staphylococcus
NEEDVR

SEQ ID NO: 1966991 - protein, 5 aa, Staphylococcus
NEEDY

SEQ ID NO: 1966992 - protein, 8 aa, Staphylococcus
NEEENELG

SEQ ID NO: 1966993 - protein, 6 aa, Staphylococcus
NEEENV

SEQ ID NO: 1966994 - protein, 7 aa, Staphylococcus
NEEEVEQ

SEQ ID NO: 1966995 - protein, 8 aa, Staphylococcus
NEEFARRC

SEQ ID NO: 1966996 - protein, 4 aa, Staphylococcus
NEEG

SEQ ID NO: 1966997 - protein, 20 aa, Staphylococcus
NEEGAKKAAEALSKEDQEAV

SEQ ID NO: 1966998 - protein, 19 aa, Staphylococcus
NEEGAKSVESSLTNNEQEA

SEQ ID NO: 1966999 - protein, 5 aa, Staphylococcus
NEEGL

SEQ ID NO: 1967000 - protein, 9 aa, Staphylococcus
NEEGTYDYR

SEQ ID NO: 1967001 - protein, 9 aa, Staphylococcus
NEEHAHRKV

SEQ ID NO: 1967002 - protein, 7 aa, Staphylococcus
NEEHNQD

SEQ ID NO: 1967003 - protein, 6 aa, Staphylococcus
NEEIAS

SEQ ID NO: 1967004 - protein, 6 aa, Staphylococcus
NEEIDK

SEQ ID NO: 1967005 - protein, 6 aa, Staphylococcus
NEEIHN

SEQ ID NO: 1967006 - protein, 11 aa, Staphylococcus
NEEIKNLNEEY

SEQ ID NO: 1967007 - protein, 12 aa, Staphylococcus
NEEIKQLNKEYD

SEQ ID NO: 1967008 - protein, 19 aa, Staphylococcus
NEEIPEQQQETAANEGNNH

SEQ ID NO: 1967009 - protein, 6 aa, Staphylococcus
NEEITP

SEQ ID NO: 1967010 - protein, 4 aa, Staphylococcus
NEEK

SEQ ID NO: 1967011 - protein, 6 aa, Staphylococcus
NEEKAN

SEQ ID NO: 1967012 - protein, 25 aa, Staphylococcus
NEEKEKNGEQPFANPRNAAAGSLRQ

SEQ ID NO: 1967013 - protein, 18 aa, Staphylococcus
NEEKMGSYQYELNYKEIS

SEQ ID NO: 1967014 - protein, 8 aa, Staphylococcus
NEEKQSGI

SEQ ID NO: 1967015 - protein, 6 aa, Staphylococcus
NEEKTT

SEQ ID NO: 1967016 - protein, 5 aa, Staphylococcus
NEEKV

SEQ ID NO: 1967017 - protein, 15 aa, Staphylococcus
NEEKVNTLAQDKGLD

SEQ ID NO: 1967018 - protein, 7 aa, Staphylococcus
NEEKVPL

SEQ ID NO: 1967019 - protein, 5 aa, Staphylococcus
NEELN

SEQ ID NO: 1967020 - protein, 9 aa, Staphylococcus
NEELNNKEI

SEQ ID NO: 1967021 - protein, 13 aa, Staphylococcus
NEELTEDQQVEDG

SEQ ID NO: 1967022 - protein, 7 aa, Staphylococcus
NEENHKL

SEQ ID NO: 1967023 - protein, 7 aa, Staphylococcus
NEENKGK

SEQ ID NO: 1967024 - protein, 8 aa, Staphylococcus
NEENPEPN

SEQ ID NO: 1967025 - protein, 10 aa, Staphylococcus
NEENQSVDEN

SEQ ID NO: 1967026 - protein, 10 aa, Staphylococcus
NEENSNSENL

SEQ ID NO: 1967027 - protein, 9 aa, Staphylococcus
NEENTNVDE

SEQ ID NO: 1967028 - protein, 5 aa, Staphylococcus
NEEPI

SEQ ID NO: 1967029 - protein, 5 aa, Staphylococcus
NEEPP

SEQ ID NO: 1967030 - protein, 4 aa, Staphylococcus
NEEQ

SEQ ID NO: 1967031 - protein, 15 aa, Staphylococcus
NEEQAEKLKAAGVDR

SEQ ID NO: 1967032 - protein, 9 aa, Staphylococcus
NEEQEEYGI

SEQ ID NO: 1967033 - protein, 5 aa, Staphylococcus
NEEQG

SEQ ID NO: 1967034 - protein, 8 aa, Staphylococcus
NEEQNELG

SEQ ID NO: 1967035 - protein, 6 aa, Staphylococcus
NEEQYG

SEQ ID NO: 1967036 - protein, 4 aa, Staphylococcus
NEER

SEQ ID NO: 1967037 - protein, 9 aa, Staphylococcus
NEERTDTEQ

SEQ ID NO: 1967038 - protein, 5 aa, Staphylococcus
NEESD

SEQ ID NO: 1967039 - protein, 6 aa, Staphylococcus
NEESFT

SEQ ID NO: 1967040 - protein, 17 aa, Staphylococcus
NEESGYKISKNANIPYQ

SEQ ID NO: 1967041 - protein, 7 aa, Staphylococcus
NEESKEY

SEQ ID NO: 1967042 - protein, 15 aa, Staphylococcus
NEESKHDMQTSFESA

SEQ ID NO: 1967043 - protein, 5 aa, Staphylococcus
NEESS

SEQ ID NO: 1967044 - protein, 4 aa, Staphylococcus
NEET

SEQ ID NO: 1967045 - protein, 15 aa, Staphylococcus
NEETAKRIAESATQL

SEQ ID NO: 1967046 - protein, 6 aa, Staphylococcus
NEETAL

SEQ ID NO: 1967047 - protein, 6 aa, Staphylococcus
NEETPL

SEQ ID NO: 1967048 - protein, 7 aa, Staphylococcus
NEETSEL

SEQ ID NO: 1967049 - protein, 5 aa, Staphylococcus
NEEVA

SEQ ID NO: 1967050 - protein, 7 aa, Staphylococcus
NEEVEQF

SEQ ID NO: 1967051 - protein, 49 aa, Staphylococcus
NEEVNEETSQTDSVENNDETTETSQDNLQEDDSQEIAEDVDPKDEEIQQ

SEQ ID NO: 1967052 - protein, 6 aa, Staphylococcus
NEEYQQ

SEQ ID NO: 1967053 - protein, 12 aa, Staphylococcus
NEFAGDKSEAVS

SEQ ID NO: 1967054 - protein, 4 aa, Staphylococcus
NEFE

SEQ ID NO: 1967055 - protein, 16 aa, Staphylococcus
NEFEKGKNQNHLTDEQ

SEQ ID NO: 1967056 - protein, 6 aa, Staphylococcus
NEFGTA

SEQ ID NO: 1967057 - protein, 12 aa, Staphylococcus
NEFGTRGLYGSP

SEQ ID NO: 1967058 - protein, 11 aa, Staphylococcus
NEFHNKKPYYE

SEQ ID NO: 1967059 - protein, 6 aa, Staphylococcus
NEFPDE

SEQ ID NO: 1967060 - protein, 6 aa, Staphylococcus
NEFPEK

SEQ ID NO: 1967061 - protein, 5 aa, Staphylococcus
NEFPN

SEQ ID NO: 1967062 - protein, 7 aa, Staphylococcus
NEFTEDN

SEQ ID NO: 1967063 - protein, 7 aa, Staphylococcus
NEFTEDS

SEQ ID NO: 1967064 - protein, 7 aa, Staphylococcus
NEFTTDS

SEQ ID NO: 1967065 - protein, 5 aa, Staphylococcus
NEFTY

SEQ ID NO: 1967066 - protein, 15 aa, Staphylococcus
NEGADGYEIKDVEPQ

SEQ ID NO: 1967067 - protein, 8 aa, Staphylococcus
NEGADRPK

SEQ ID NO: 1967068 - protein, 9 aa, Staphylococcus
NEGANMAAG

SEQ ID NO: 1967069 - protein, 6 aa, Staphylococcus
NEGAQS

SEQ ID NO: 1967070 - protein, 8 aa, Staphylococcus
NEGDGVNN

SEQ ID NO: 1967071 - protein, 5 aa, Staphylococcus
NEGDT

SEQ ID NO: 1967072 - protein, 9 aa, Staphylococcus
NEGDTVEVG

SEQ ID NO: 1967073 - protein, 6 aa, Staphylococcus
NEGDVI

SEQ ID NO: 1967074 - protein, 8 aa, Staphylococcus
NEGEGVDP

SEQ ID NO: 1967075 - protein, 7 aa, Staphylococcus
NEGEGVN

SEQ ID NO: 1967076 - protein, 8 aa, Staphylococcus
NEGEGVND

SEQ ID NO: 1967077 - protein, 8 aa, Staphylococcus
NEGEGVNK

SEQ ID NO: 1967078 - protein, 8 aa, Staphylococcus
NEGEGVNQ

SEQ ID NO: 1967079 - protein, 7 aa, Staphylococcus
NEGEKHP

SEQ ID NO: 1967080 - protein, 8 aa, Staphylococcus
NEGEKHPK

SEQ ID NO: 1967081 - protein, 5 aa, Staphylococcus
NEGEL

SEQ ID NO: 1967082 - protein, 7 aa, Staphylococcus
NEGETVR

SEQ ID NO: 1967083 - protein, 6 aa, Staphylococcus
NEGFNV

SEQ ID NO: 1967084 - protein, 15 aa, Staphylococcus
NEGFTKEEAATTQAL

SEQ ID NO: 1967085 - protein, 15 aa, Staphylococcus
NEGFTPDEAAMPKTL

SEQ ID NO: 1967086 - protein, 4 aa, Staphylococcus
NEGI

SEQ ID NO: 1967087 - protein, 14 aa, Staphylococcus
NEGIASNKTKVGDR

SEQ ID NO: 1967088 - protein, 7 aa, Staphylococcus
NEGISSN

SEQ ID NO: 1967089 - protein, 11 aa, Staphylococcus
NEGKQTYRLDG

SEQ ID NO: 1967090 - protein, 10 aa, Staphylococcus
NEGKRNEVRA

SEQ ID NO: 1967091 - protein, 8 aa, Staphylococcus
NEGKSRSM

SEQ ID NO: 1967092 - protein, 8 aa, Staphylococcus
NEGKSTQM

SEQ ID NO: 1967093 - protein, 6 aa, Staphylococcus
NEGKYV

SEQ ID NO: 1967094 - protein, 4 aa, Staphylococcus
NEGL

SEQ ID NO: 1967095 - protein, 6 aa, Staphylococcus
NEGLKE

SEQ ID NO: 1967096 - protein, 6 aa, Staphylococcus
NEGLPT

SEQ ID NO: 1967097 - protein, 18 aa, Staphylococcus
NEGPLSIDTKARKYPSSI

SEQ ID NO: 1967098 - protein, 12 aa, Staphylococcus
NEGQGKKSVCGQ

SEQ ID NO: 1967099 - protein, 8 aa, Staphylococcus
NEGQGVDP

SEQ ID NO: 1967100 - protein, 7 aa, Staphylococcus
NEGQNLI

SEQ ID NO: 1967101 - protein, 6 aa, Staphylococcus
NEGSIR

SEQ ID NO: 1967102 - protein, 6 aa, Staphylococcus
NEGSKQ

SEQ ID NO: 1967103 - protein, 7 aa, Staphylococcus
NEGSPLP

SEQ ID NO: 1967104 - protein, 11 aa, Staphylococcus
NEGTEKLENKP

SEQ ID NO: 1967105 - protein, 8 aa, Staphylococcus
NEGTPTVS

SEQ ID NO: 1967106 - protein, 6 aa, Staphylococcus
NEGVEQ

SEQ ID NO: 1967107 - protein, 9 aa, Staphylococcus
NEGYSDSNT

SEQ ID NO: 1967108 - protein, 6 aa, Staphylococcus
NEHAGR

SEQ ID NO: 1967109 - protein, 12 aa, Staphylococcus
NEHATKENAKGM

SEQ ID NO: 1967110 - protein, 6 aa, Staphylococcus
NEHDNI

SEQ ID NO: 1967111 - protein, 6 aa, Staphylococcus
NEHESH

SEQ ID NO: 1967112 - protein, 11 aa, Staphylococcus
NEHETTPPDYF

SEQ ID NO: 1967113 - protein, 4 aa, Staphylococcus
NEHG

SEQ ID NO: 1967114 - protein, 17 aa, Staphylococcus
NEHGGKYIEENLDKGTL

SEQ ID NO: 1967115 - protein, 5 aa, Staphylococcus
NEHGS

SEQ ID NO: 1967116 - protein, 6 aa, Staphylococcus
NEHGTI

SEQ ID NO: 1967117 - protein, 5 aa, Staphylococcus
NEHNE

SEQ ID NO: 1967118 - protein, 16 aa, Staphylococcus
NEHNGISTNHFKGGQL

SEQ ID NO: 1967119 - protein, 6 aa, Staphylococcus
NEHNHA

SEQ ID NO: 1967120 - protein, 20 aa, Staphylococcus
NEHNSGVPLGMPSENSAVNP

SEQ ID NO: 1967121 - protein, 7 aa, Staphylococcus
NEHNTGV

SEQ ID NO: 1967122 - protein, 17 aa, Staphylococcus
NEHNTGVGLGTPTFDST

SEQ ID NO: 1967123 - protein, 8 aa, Staphylococcus
NEHNTGVP

SEQ ID NO: 1967124 - protein, 4 aa, Staphylococcus
NEHP

SEQ ID NO: 1967125 - protein, 4 aa, Staphylococcus
NEHQ

SEQ ID NO: 1967126 - protein, 7 aa, Staphylococcus
NEHRDEN

SEQ ID NO: 1967127 - protein, 15 aa, Staphylococcus
NEHSDNGLRLFFIVQ

SEQ ID NO: 1967128 - protein, 10 aa, Staphylococcus
NEHSNKQPSI

SEQ ID NO: 1967129 - protein, 5 aa, Staphylococcus
NEHTK

SEQ ID NO: 1967130 - protein, 7 aa, Staphylococcus
NEHTTDL

SEQ ID NO: 1967131 - protein, 5 aa, Staphylococcus
NEHVR

SEQ ID NO: 1967132 - protein, 10 aa, Staphylococcus
NEHYNESASS

SEQ ID NO: 1967133 - protein, 4 aa, Staphylococcus
NEIA

SEQ ID NO: 1967134 - protein, 14 aa, Staphylococcus
NEIASTKVDSSKTI

SEQ ID NO: 1967135 - protein, 5 aa, Staphylococcus
NEIDG

SEQ ID NO: 1967136 - protein, 9 aa, Staphylococcus
NEIDKSPAQ

SEQ ID NO: 1967137 - protein, 6 aa, Staphylococcus
NEIDNK

SEQ ID NO: 1967138 - protein, 8 aa, Staphylococcus
NEIDPEQI

SEQ ID NO: 1967139 - protein, 5 aa, Staphylococcus
NEIEE

SEQ ID NO: 1967140 - protein, 6 aa, Staphylococcus
NEIEKL

SEQ ID NO: 1967141 - protein, 36 aa, Staphylococcus
NEIEKLQQKKQDKKTLNKINDAQNKMNNEVERRQEL

SEQ ID NO: 1967142 - protein, 5 aa, Staphylococcus
NEIEQ

SEQ ID NO: 1967143 - protein, 5 aa, Staphylococcus
NEIER

SEQ ID NO: 1967144 - protein, 14 aa, Staphylococcus
NEIERLKEEKKQLE

SEQ ID NO: 1967145 - protein, 9 aa, Staphylococcus
NEIESTPKF

SEQ ID NO: 1967146 - protein, 15 aa, Staphylococcus
NEIETEDNDTSDEYQ

SEQ ID NO: 1967147 - protein, 8 aa, Staphylococcus
NEIGKSPA

SEQ ID NO: 1967148 - protein, 5 aa, Staphylococcus
NEIHQ

SEQ ID NO: 1967149 - protein, 7 aa, Staphylococcus
NEIKHER

SEQ ID NO: 1967150 - protein, 6 aa, Staphylococcus
NEIKKS

SEQ ID NO: 1967151 - protein, 6 aa, Staphylococcus
NEIKPG

SEQ ID NO: 1967152 - protein, 8 aa, Staphylococcus
NEIKPSEV

SEQ ID NO: 1967153 - protein, 11 aa, Staphylococcus
NEIKQGFDPSL

SEQ ID NO: 1967154 - protein, 19 aa, Staphylococcus
NEIKQSSEAVREGRTNDVQ

SEQ ID NO: 1967155 - protein, 8 aa, Staphylococcus
NEINADQI

SEQ ID NO: 1967156 - protein, 11 aa, Staphylococcus
NEINEDTEINS

SEQ ID NO: 1967157 - protein, 6 aa, Staphylococcus
NEINTN

SEQ ID NO: 1967158 - protein, 5 aa, Staphylococcus
NEIPH

SEQ ID NO: 1967159 - protein, 6 aa, Staphylococcus
NEIQEK

SEQ ID NO: 1967160 - protein, 5 aa, Staphylococcus
NEIQN

SEQ ID NO: 1967161 - protein, 6 aa, Staphylococcus
NEIQSK

SEQ ID NO: 1967162 - protein, 4 aa, Staphylococcus
NEIR

SEQ ID NO: 1967163 - protein, 6 aa, Staphylococcus
NEIREA

SEQ ID NO: 1967164 - protein, 6 aa, Staphylococcus
NEIRNF

SEQ ID NO: 1967165 - protein, 11 aa, Staphylococcus
NEIRQDGNSGE

SEQ ID NO: 1967166 - protein, 12 aa, Staphylococcus
NEIRQDGNTSQM

SEQ ID NO: 1967167 - protein, 5 aa, Staphylococcus
NEISE

SEQ ID NO: 1967168 - protein, 16 aa, Staphylococcus
NEISEEEIEATGAGDQ

SEQ ID NO: 1967169 - protein, 17 aa, Staphylococcus
NEISEEEIEATGAGDQG

SEQ ID NO: 1967170 - protein, 6 aa, Staphylococcus
NEISQR

SEQ ID NO: 1967171 - protein, 7 aa, Staphylococcus
NEISQTS

SEQ ID NO: 1967172 - protein, 5 aa, Staphylococcus
NEISV

SEQ ID NO: 1967173 - protein, 4 aa, Staphylococcus
NEIT

SEQ ID NO: 1967174 - protein, 7 aa, Staphylococcus
NEITEDS

SEQ ID NO: 1967175 - protein, 10 aa, Staphylococcus
NEITKGKGVN

SEQ ID NO: 1967176 - protein, 5 aa, Staphylococcus
NEITT

SEQ ID NO: 1967177 - protein, 17 aa, Staphylococcus
NEITVDKDGKPSKMNAD

SEQ ID NO: 1967178 - protein, 5 aa, Staphylococcus
NEIVD

SEQ ID NO: 1967179 - protein, 13 aa, Staphylococcus
NEKACNPNAPKDF

SEQ ID NO: 1967180 - protein, 13 aa, Staphylococcus
NEKADDQDEPEYE

SEQ ID NO: 1967181 - protein, 9 aa, Staphylococcus
NEKAGIDYE

SEQ ID NO: 1967182 - protein, 7 aa, Staphylococcus
NEKANAS

SEQ ID NO: 1967183 - protein, 6 aa, Staphylococcus
NEKARK

SEQ ID NO: 1967184 - protein, 13 aa, Staphylococcus
NEKDAIGTGAYDH

SEQ ID NO: 1967185 - protein, 14 aa, Staphylococcus
NEKDDVGSGAYDHN

SEQ ID NO: 1967186 - protein, 14 aa, Staphylococcus
NEKDESYEIKGYKK

SEQ ID NO: 1967187 - protein, 7 aa, Staphylococcus
NEKDRAN

SEQ ID NO: 1967188 - protein, 25 aa, Staphylococcus
NEKDSSDKDSKLNPNDLSAPPGVKI

SEQ ID NO: 1967189 - protein, 25 aa, Staphylococcus
NEKDSSDTDEKLNPHDLSAPPGVKI

SEQ ID NO: 1967190 - protein, 11 aa, Staphylococcus
NEKDSVGTGAY

SEQ ID NO: 1967191 - protein, 7 aa, Staphylococcus
NEKDYPS

SEQ ID NO: 1967192 - protein, 8 aa, Staphylococcus
NEKEANEY

SEQ ID NO: 1967193 - protein, 5 aa, Staphylococcus
NEKEC

SEQ ID NO: 1967194 - protein, 9 aa, Staphylococcus
NEKEIKSED

SEQ ID NO: 1967195 - protein, 8 aa, Staphylococcus
NEKEVDDT

SEQ ID NO: 1967196 - protein, 11 aa, Staphylococcus
NEKEVKNHSPK

SEQ ID NO: 1967197 - protein, 7 aa, Staphylococcus
NEKEYSE

SEQ ID NO: 1967198 - protein, 6 aa, Staphylococcus
NEKEYY

SEQ ID NO: 1967199 - protein, 17 aa, Staphylococcus
NEKGGQLLPEASEQLSE

SEQ ID NO: 1967200 - protein, 4 aa, Staphylococcus
NEKI

SEQ ID NO: 1967201 - protein, 7 aa, Staphylococcus
NEKIPRD

SEQ ID NO: 1967202 - protein, 5 aa, Staphylococcus
NEKIR

SEQ ID NO: 1967203 - protein, 15 aa, Staphylococcus
NEKISGSYDGYDTEE

SEQ ID NO: 1967204 - protein, 4 aa, Staphylococcus
NEKK

SEQ ID NO: 1967205 - protein, 8 aa, Staphylococcus
NEKKDDFN

SEQ ID NO: 1967206 - protein, 8 aa, Staphylococcus
NEKKNESY

SEQ ID NO: 1967207 - protein, 13 aa, Staphylococcus
NEKKNQLPSDSME

SEQ ID NO: 1967208 - protein, 4 aa, Staphylococcus
NEKL

SEQ ID NO: 1967209 - protein, 13 aa, Staphylococcus
NEKLESSRSLDDL

SEQ ID NO: 1967210 - protein, 5 aa, Staphylococcus
NEKLT

SEQ ID NO: 1967211 - protein, 8 aa, Staphylococcus
NEKLTKAS

SEQ ID NO: 1967212 - protein, 7 aa, Staphylococcus
NEKMSKS

SEQ ID NO: 1967213 - protein, 8 aa, Staphylococcus
NEKMSKSL

SEQ ID NO: 1967214 - protein, 6 aa, Staphylococcus
NEKNAF

SEQ ID NO: 1967215 - protein, 10 aa, Staphylococcus
NEKNAGFTDG

SEQ ID NO: 1967216 - protein, 7 aa, Staphylococcus
NEKNEGA

SEQ ID NO: 1967217 - protein, 7 aa, Staphylococcus
NEKNGSV

SEQ ID NO: 1967218 - protein, 5 aa, Staphylococcus
NEKNN

SEQ ID NO: 1967219 - protein, 18 aa, Staphylococcus
NEKNNGISDEGNEVTETE

SEQ ID NO: 1967220 - protein, 15 aa, Staphylococcus
NEKNRDSVPFTAPAE

SEQ ID NO: 1967221 - protein, 8 aa, Staphylococcus
NEKNSLSY

SEQ ID NO: 1967222 - protein, 16 aa, Staphylococcus
NEKNVTVRNDPDGRSR

SEQ ID NO: 1967223 - protein, 4 aa, Staphylococcus
NEKQ

SEQ ID NO: 1967224 - protein, 16 aa, Staphylococcus
NEKQAARLKKAGVDRY

SEQ ID NO: 1967225 - protein, 7 aa, Staphylococcus
NEKQITE

SEQ ID NO: 1967226 - protein, 12 aa, Staphylococcus
NEKQKADTFKGL

SEQ ID NO: 1967227 - protein, 7 aa, Staphylococcus
NEKQNEL

SEQ ID NO: 1967228 - protein, 18 aa, Staphylococcus
NEKQNTNNKERTISLVII

SEQ ID NO: 1967229 - protein, 9 aa, Staphylococcus
NEKRDQIEA

SEQ ID NO: 1967230 - protein, 10 aa, Staphylococcus
NEKRKQTEYI

SEQ ID NO: 1967231 - protein, 10 aa, Staphylococcus
NEKRQQIQDE

SEQ ID NO: 1967232 - protein, 4 aa, Staphylococcus
NEKS

SEQ ID NO: 1967233 - protein, 8 aa, Staphylococcus
NEKSGTAH

SEQ ID NO: 1967234 - protein, 6 aa, Staphylococcus
NEKSQN

SEQ ID NO: 1967235 - protein, 15 aa, Staphylococcus
NEKSTSFKNFSQPKW

SEQ ID NO: 1967236 - protein, 4 aa, Staphylococcus
NEKT

SEQ ID NO: 1967237 - protein, 16 aa, Staphylococcus
NEKTAFPLENGKTIQD

SEQ ID NO: 1967238 - protein, 8 aa, Staphylococcus
NEKTGANV

SEQ ID NO: 1967239 - protein, 7 aa, Staphylococcus
NEKTGHS

SEQ ID NO: 1967240 - protein, 7 aa, Staphylococcus
NEKTKKG

SEQ ID NO: 1967241 - protein, 6 aa, Staphylococcus
NEKVRQ

SEQ ID NO: 1967242 - protein, 10 aa, Staphylococcus
NEKYQGHGYG

SEQ ID NO: 1967243 - protein, 10 aa, Staphylococcus
NEKYQGRGYG

SEQ ID NO: 1967244 - protein, 7 aa, Staphylococcus
NELDEEK

SEQ ID NO: 1967245 - protein, 4 aa, Staphylococcus
NELE

SEQ ID NO: 1967246 - protein, 19 aa, Staphylococcus
NELERRGSYQGKKFEQKVK

SEQ ID NO: 1967247 - protein, 4 aa, Staphylococcus
NELG

SEQ ID NO: 1967248 - protein, 8 aa, Staphylococcus
NELGPDSD

SEQ ID NO: 1967249 - protein, 4 aa, Staphylococcus
NELK

SEQ ID NO: 1967250 - protein, 18 aa, Staphylococcus
NELKEKDKNIDGNDIREG

SEQ ID NO: 1967251 - protein, 10 aa, Staphylococcus
NELKRPPVSN

SEQ ID NO: 1967252 - protein, 17 aa, Staphylococcus
NELKSKNFSLTNLKVSR

SEQ ID NO: 1967253 - protein, 6 aa, Staphylococcus
NELKSR

SEQ ID NO: 1967254 - protein, 13 aa, Staphylococcus
NELKTPEDAVAEA

SEQ ID NO: 1967255 - protein, 4 aa, Staphylococcus
NELL

SEQ ID NO: 1967256 - protein, 4 aa, Staphylococcus
NELP

SEQ ID NO: 1967257 - protein, 18 aa, Staphylococcus
NELPDNSIVGTSSLRRGA

SEQ ID NO: 1967258 - protein, 7 aa, Staphylococcus
NELPLGK

SEQ ID NO: 1967259 - protein, 8 aa, Staphylococcus
NELPNEEE

SEQ ID NO: 1967260 - protein, 6 aa, Staphylococcus
NELPPV

SEQ ID NO: 1967261 - protein, 11 aa, Staphylococcus
NELPQGSTATD

SEQ ID NO: 1967262 - protein, 8 aa, Staphylococcus
NELQNSPL

SEQ ID NO: 1967263 - protein, 13 aa, Staphylococcus
NELSENEKQRADQ

SEQ ID NO: 1967264 - protein, 8 aa, Staphylococcus
NELSGGEK

SEQ ID NO: 1967265 - protein, 7 aa, Staphylococcus
NELSKGK

SEQ ID NO: 1967266 - protein, 6 aa, Staphylococcus
NELSQS

SEQ ID NO: 1967267 - protein, 7 aa, Staphylococcus
NELSQSC

SEQ ID NO: 1967268 - protein, 8 aa, Staphylococcus
NELSRADK

SEQ ID NO: 1967269 - protein, 4 aa, Staphylococcus
NELT

SEQ ID NO: 1967270 - protein, 8 aa, Staphylococcus
NELTDTPF

SEQ ID NO: 1967271 - protein, 6 aa, Staphylococcus
NELTKE

SEQ ID NO: 1967272 - protein, 5 aa, Staphylococcus
NEMEK

SEQ ID NO: 1967273 - protein, 4 aa, Staphylococcus
NEMN

SEQ ID NO: 1967274 - protein, 22 aa, Staphylococcus
NEMQQQRDRARQARQNSQSMQI

SEQ ID NO: 1967275 - protein, 9 aa, Staphylococcus
NEMSDPQIE

SEQ ID NO: 1967276 - protein, 10 aa, Staphylococcus
NEMSGGQKQR

SEQ ID NO: 1967277 - protein, 5 aa, Staphylococcus
NEMSN

SEQ ID NO: 1967278 - protein, 21 aa, Staphylococcus
NEMSQTSEVNQENETSNYETI

SEQ ID NO: 1967279 - protein, 8 aa, Staphylococcus
NEMTKQQD

SEQ ID NO: 1967280 - protein, 15 aa, Staphylococcus
NEMTNQLHGGSNGLD

SEQ ID NO: 1967281 - protein, 5 aa, Staphylococcus
NEMTV

SEQ ID NO: 1967282 - protein, 7 aa, Staphylococcus
NENALNN

SEQ ID NO: 1967283 - protein, 5 aa, Staphylococcus
NENAS

SEQ ID NO: 1967284 - protein, 6 aa, Staphylococcus
NENAVA

SEQ ID NO: 1967285 - protein, 9 aa, Staphylococcus
NENDQTKLE

SEQ ID NO: 1967286 - protein, 5 aa, Staphylococcus
NENDR

SEQ ID NO: 1967287 - protein, 7 aa, Staphylococcus
NENDTKA

SEQ ID NO: 1967288 - protein, 7 aa, Staphylococcus
NENDYPS

SEQ ID NO: 1967289 - protein, 7 aa, Staphylococcus
NENEAHP

SEQ ID NO: 1967290 - protein, 16 aa, Staphylococcus
NENEATKNYTVNPKDV

SEQ ID NO: 1967291 - protein, 9 aa, Staphylococcus
NENEEVPAV

SEQ ID NO: 1967292 - protein, 6 aa, Staphylococcus
NENENA

SEQ ID NO: 1967293 - protein, 4 aa, Staphylococcus
NENG

SEQ ID NO: 1967294 - protein, 18 aa, Staphylococcus
NENGASKIYETPLSDHEK

SEQ ID NO: 1967295 - protein, 6 aa, Staphylococcus
NENGET

SEQ ID NO: 1967296 - protein, 12 aa, Staphylococcus
NENGEYENSGRM

SEQ ID NO: 1967297 - protein, 13 aa, Staphylococcus
NENGGYQADFINK

SEQ ID NO: 1967298 - protein, 14 aa, Staphylococcus
NENHHTPNKTQKKY

SEQ ID NO: 1967299 - protein, 5 aa, Staphylococcus
NENIT

SEQ ID NO: 1967300 - protein, 11 aa, Staphylococcus
NENITDTDAEI

SEQ ID NO: 1967301 - protein, 4 aa, Staphylococcus
NENK

SEQ ID NO: 1967302 - protein, 14 aa, Staphylococcus
NENKIQDTNLKEPI

SEQ ID NO: 1967303 - protein, 9 aa, Staphylococcus
NENKNQPLQ

SEQ ID NO: 1967304 - protein, 5 aa, Staphylococcus
NENKT

SEQ ID NO: 1967305 - protein, 12 aa, Staphylococcus
NENKTYDMTDEA

SEQ ID NO: 1967306 - protein, 10 aa, Staphylococcus
NENKYEDSIE

SEQ ID NO: 1967307 - protein, 8 aa, Staphylococcus
NENLNDKL

SEQ ID NO: 1967308 - protein, 18 aa, Staphylococcus
NENLSTRSIEKRTTEYNT

SEQ ID NO: 1967309 - protein, 17 aa, Staphylococcus
NENLYGPSPKAKEAISN

SEQ ID NO: 1967310 - protein, 16 aa, Staphylococcus
NENLYGPTPKAKEAIK

SEQ ID NO: 1967311 - protein, 6 aa, Staphylococcus
NENNID

SEQ ID NO: 1967312 - protein, 19 aa, Staphylococcus
NENQTSYSHNKGLVETRNA

SEQ ID NO: 1967313 - protein, 4 aa, Staphylococcus
NENR

SEQ ID NO: 1967314 - protein, 13 aa, Staphylococcus
NENRIENLSLLPL

SEQ ID NO: 1967315 - protein, 12 aa, Staphylococcus
NENRVSLSPSGV

SEQ ID NO: 1967316 - protein, 9 aa, Staphylococcus
NENSKKVVY

SEQ ID NO: 1967317 - protein, 6 aa, Staphylococcus
NENTGN

SEQ ID NO: 1967318 - protein, 14 aa, Staphylococcus
NENTQINQLSGGMK

SEQ ID NO: 1967319 - protein, 4 aa, Staphylococcus
NENV

SEQ ID NO: 1967320 - protein, 11 aa, Staphylococcus
NENVEIKPKQM

SEQ ID NO: 1967321 - protein, 6 aa, Staphylococcus
NENYPI

SEQ ID NO: 1967322 - protein, 12 aa, Staphylococcus
NEPASNEAGAKA

SEQ ID NO: 1967323 - protein, 13 aa, Staphylococcus
NEPASNEKGAKAY

SEQ ID NO: 1967324 - protein, 8 aa, Staphylococcus
NEPEESSV

SEQ ID NO: 1967325 - protein, 10 aa, Staphylococcus
NEPEKQQSHF

SEQ ID NO: 1967326 - protein, 5 aa, Staphylococcus
NEPEL

SEQ ID NO: 1967327 - protein, 5 aa, Staphylococcus
NEPER

SEQ ID NO: 1967328 - protein, 7 aa, Staphylococcus
NEPERDE

SEQ ID NO: 1967329 - protein, 9 aa, Staphylococcus
NEPGTPFDS

SEQ ID NO: 1967330 - protein, 4 aa, Staphylococcus
NEPH

SEQ ID NO: 1967331 - protein, 13 aa, Staphylococcus
NEPIGKGKDGQDV

SEQ ID NO: 1967332 - protein, 12 aa, Staphylococcus
NEPIQTMQPKDE

SEQ ID NO: 1967333 - protein, 5 aa, Staphylococcus
NEPKC

SEQ ID NO: 1967334 - protein, 12 aa, Staphylococcus
NEPKDFDSKSAY

SEQ ID NO: 1967335 - protein, 13 aa, Staphylococcus
NEPKDFESKADYE

SEQ ID NO: 1967336 - protein, 6 aa, Staphylococcus
NEPKFT

SEQ ID NO: 1967337 - protein, 6 aa, Staphylococcus
NEPKLD

SEQ ID NO: 1967338 - protein, 6 aa, Staphylococcus
NEPKLT

SEQ ID NO: 1967339 - protein, 12 aa, Staphylococcus
NEPLKPHDDAVE

SEQ ID NO: 1967340 - protein, 11 aa, Staphylococcus
NEPLNSDSPLY

SEQ ID NO: 1967341 - protein, 11 aa, Staphylococcus
NEPLSSDNPLY

SEQ ID NO: 1967342 - protein, 10 aa, Staphylococcus
NEPLTEDDQT

SEQ ID NO: 1967343 - protein, 9 aa, Staphylococcus
NEPLTEEDR

SEQ ID NO: 1967344 - protein, 9 aa, Staphylococcus
NEPLTQEDR

SEQ ID NO: 1967345 - protein, 18 aa, Staphylococcus
NEPNQEALTNVDVATLTS

SEQ ID NO: 1967346 - protein, 8 aa, Staphylococcus
NEPPLDSP

SEQ ID NO: 1967347 - protein, 8 aa, Staphylococcus
NEPQAPGQ

SEQ ID NO: 1967348 - protein, 5 aa, Staphylococcus
NEPQC

SEQ ID NO: 1967349 - protein, 4 aa, Staphylococcus
NEPS

SEQ ID NO: 1967350 - protein, 9 aa, Staphylococcus
NEPSAQDTV

SEQ ID NO: 1967351 - protein, 6 aa, Staphylococcus
NEPSLL

SEQ ID NO: 1967352 - protein, 16 aa, Staphylococcus
NEPSQANLEDKTPDKY

SEQ ID NO: 1967353 - protein, 15 aa, Staphylococcus
NEPSQANLEDTTPDK

SEQ ID NO: 1967354 - protein, 8 aa, Staphylococcus
NEPSTYKN

SEQ ID NO: 1967355 - protein, 10 aa, Staphylococcus
NEPTEASPHE

SEQ ID NO: 1967356 - protein, 5 aa, Staphylococcus
NEPTH

SEQ ID NO: 1967357 - protein, 17 aa, Staphylococcus
NEPTKIKEFDTTRNHTE

SEQ ID NO: 1967358 - protein, 16 aa, Staphylococcus
NEPTQENLEDKTPDKY

SEQ ID NO: 1967359 - protein, 16 aa, Staphylococcus
NEPTQSNLEDKTPDKY

SEQ ID NO: 1967360 - protein, 15 aa, Staphylococcus
NEPTQTNLEGTTPDK

SEQ ID NO: 1967361 - protein, 15 aa, Staphylococcus
NEPTQTNLENKTPEK

SEQ ID NO: 1967362 - protein, 5 aa, Staphylococcus
NEPVG

SEQ ID NO: 1967363 - protein, 7 aa, Staphylococcus
NEQAKAQ

SEQ ID NO: 1967364 - protein, 4 aa, Staphylococcus
NEQC

SEQ ID NO: 1967365 - protein, 10 aa, Staphylococcus
NEQDASTIAS

SEQ ID NO: 1967366 - protein, 5 aa, Staphylococcus
NEQDE

SEQ ID NO: 1967367 - protein, 14 aa, Staphylococcus
NEQDNQKFGKSLAE

SEQ ID NO: 1967368 - protein, 6 aa, Staphylococcus
NEQEEG

SEQ ID NO: 1967369 - protein, 10 aa, Staphylococcus
NEQEEQDVSE

SEQ ID NO: 1967370 - protein, 14 aa, Staphylococcus
NEQEGSVTDQRADQ

SEQ ID NO: 1967371 - protein, 4 aa, Staphylococcus
NEQF

SEQ ID NO: 1967372 - protein, 5 aa, Staphylococcus
NEQFW

SEQ ID NO: 1967373 - protein, 15 aa, Staphylococcus
NEQGAYEIIKALNEE

SEQ ID NO: 1967374 - protein, 5 aa, Staphylococcus
NEQGD

SEQ ID NO: 1967375 - protein, 12 aa, Staphylococcus
NEQGELATTGTT

SEQ ID NO: 1967376 - protein, 7 aa, Staphylococcus
NEQGTNY

SEQ ID NO: 1967377 - protein, 6 aa, Staphylococcus
NEQIAE

SEQ ID NO: 1967378 - protein, 15 aa, Staphylococcus
NEQIEQQQNQKQRAL

SEQ ID NO: 1967379 - protein, 9 aa, Staphylococcus
NEQITKKQY

SEQ ID NO: 1967380 - protein, 16 aa, Staphylococcus
NEQKVTEKNIKSNMAT

SEQ ID NO: 1967381 - protein, 4 aa, Staphylococcus
NEQL

SEQ ID NO: 1967382 - protein, 8 aa, Staphylococcus
NEQLPTEV

SEQ ID NO: 1967383 - protein, 6 aa, Staphylococcus
NEQLTQ

SEQ ID NO: 1967384 - protein, 23 aa, Staphylococcus
NEQLTTPIDGQPYSPIVEPSEEN

SEQ ID NO: 1967385 - protein, 9 aa, Staphylococcus
NEQNEKERP

SEQ ID NO: 1967386 - protein, 7 aa, Staphylococcus
NEQNKNI

SEQ ID NO: 1967387 - protein, 8 aa, Staphylococcus
NEQNQAKY

SEQ ID NO: 1967388 - protein, 18 aa, Staphylococcus
NEQNQAKYASIAQQADFT

SEQ ID NO: 1967389 - protein, 5 aa, Staphylococcus
NEQPI

SEQ ID NO: 1967390 - protein, 6 aa, Staphylococcus
NEQQQL

SEQ ID NO: 1967391 - protein, 13 aa, Staphylococcus
NEQQVTVKEETAV

SEQ ID NO: 1967392 - protein, 6 aa, Staphylococcus
NEQSDV

SEQ ID NO: 1967393 - protein, 11 aa, Staphylococcus
NEQSHQDDSFS

SEQ ID NO: 1967394 - protein, 12 aa, Staphylococcus
NEQSHQDDSFSD

SEQ ID NO: 1967395 - protein, 9 aa, Staphylococcus
NEQSSLTES

SEQ ID NO: 1967396 - protein, 7 aa, Staphylococcus
NEQTGEL

SEQ ID NO: 1967397 - protein, 21 aa, Staphylococcus
NEQTKGRGRFNRPWDSAKGKG

SEQ ID NO: 1967398 - protein, 6 aa, Staphylococcus
NEQTKV

SEQ ID NO: 1967399 - protein, 6 aa, Staphylococcus
NEQTTV

SEQ ID NO: 1967400 - protein, 5 aa, Staphylococcus
NEQWP

SEQ ID NO: 1967401 - protein, 19 aa, Staphylococcus
NEQYDKEAALKYGDTDYYQ

SEQ ID NO: 1967402 - protein, 8 aa, Staphylococcus
NERAEAHN

SEQ ID NO: 1967403 - protein, 5 aa, Staphylococcus
NERAN

SEQ ID NO: 1967404 - protein, 10 aa, Staphylococcus
NERDSKLKEV

SEQ ID NO: 1967405 - protein, 10 aa, Staphylococcus
NEREDSITAK

SEQ ID NO: 1967406 - protein, 13 aa, Staphylococcus
NEREGSITDQRAD

SEQ ID NO: 1967407 - protein, 12 aa, Staphylococcus
NEREGSVTAQRA

SEQ ID NO: 1967408 - protein, 12 aa, Staphylococcus
NEREGSVTDRRA

SEQ ID NO: 1967409 - protein, 5 aa, Staphylococcus
NERFD

SEQ ID NO: 1967410 - protein, 7 aa, Staphylococcus
NERGELN

SEQ ID NO: 1967411 - protein, 6 aa, Staphylococcus
NERGHY

SEQ ID NO: 1967412 - protein, 8 aa, Staphylococcus
NERGIPTN

SEQ ID NO: 1967413 - protein, 18 aa, Staphylococcus
NERGNETMNLDFNVLCNV

SEQ ID NO: 1967414 - protein, 6 aa, Staphylococcus
NERHQR

SEQ ID NO: 1967415 - protein, 4 aa, Staphylococcus
NERI

SEQ ID NO: 1967416 - protein, 5 aa, Staphylococcus
NERID

SEQ ID NO: 1967417 - protein, 8 aa, Staphylococcus
NERKKQGM

SEQ ID NO: 1967418 - protein, 4 aa, Staphylococcus
NERL

SEQ ID NO: 1967419 - protein, 9 aa, Staphylococcus
NERPKTMNE

SEQ ID NO: 1967420 - protein, 5 aa, Staphylococcus
NERPL

SEQ ID NO: 1967421 - protein, 8 aa, Staphylococcus
NERPSTSK

SEQ ID NO: 1967422 - protein, 9 aa, Staphylococcus
NERQEVSVE

SEQ ID NO: 1967423 - protein, 4 aa, Staphylococcus
NERR

SEQ ID NO: 1967424 - protein, 5 aa, Staphylococcus
NERRQ

SEQ ID NO: 1967425 - protein, 6 aa, Staphylococcus
NERRQL

SEQ ID NO: 1967426 - protein, 7 aa, Staphylococcus
NERRTYK

SEQ ID NO: 1967427 - protein, 7 aa, Staphylococcus
NERSFTR

SEQ ID NO: 1967428 - protein, 4 aa, Staphylococcus
NERT

SEQ ID NO: 1967429 - protein, 8 aa, Staphylococcus
NERTGKNV

SEQ ID NO: 1967430 - protein, 7 aa, Staphylococcus
NERTGNH

SEQ ID NO: 1967431 - protein, 7 aa, Staphylococcus
NERTISD

SEQ ID NO: 1967432 - protein, 6 aa, Staphylococcus
NERTKY

SEQ ID NO: 1967433 - protein, 5 aa, Staphylococcus
NERTM

SEQ ID NO: 1967434 - protein, 10 aa, Staphylococcus
NERYQGHGYG

SEQ ID NO: 1967435 - protein, 11 aa, Staphylococcus
NESDSLSDAAR

SEQ ID NO: 1967436 - protein, 24 aa, Staphylococcus
NESDYEITQKGDTFKGTEVSRRSV

SEQ ID NO: 1967437 - protein, 4 aa, Staphylococcus
NESE

SEQ ID NO: 1967438 - protein, 9 aa, Staphylococcus
NESEFEESY

SEQ ID NO: 1967439 - protein, 9 aa, Staphylococcus
NESEGSQEW

SEQ ID NO: 1967440 - protein, 8 aa, Staphylococcus
NESEKQQL

SEQ ID NO: 1967441 - protein, 10 aa, Staphylococcus
NESEMKELSE

SEQ ID NO: 1967442 - protein, 10 aa, Staphylococcus
NESESDEKDI

SEQ ID NO: 1967443 - protein, 11 aa, Staphylococcus
NESESQTNNDR

SEQ ID NO: 1967444 - protein, 4 aa, Staphylococcus
NESF

SEQ ID NO: 1967445 - protein, 5 aa, Staphylococcus
NESFQ

SEQ ID NO: 1967446 - protein, 13 aa, Staphylococcus
NESFYAKGETIER

SEQ ID NO: 1967447 - protein, 4 aa, Staphylococcus
NESG

SEQ ID NO: 1967448 - protein, 5 aa, Staphylococcus
NESGC

SEQ ID NO: 1967449 - protein, 5 aa, Staphylococcus
NESGE

SEQ ID NO: 1967450 - protein, 11 aa, Staphylococcus
NESGHAPHIEE

SEQ ID NO: 1967451 - protein, 9 aa, Staphylococcus
NESGYGQNF

SEQ ID NO: 1967452 - protein, 12 aa, Staphylococcus
NESIGTAQFNQG

SEQ ID NO: 1967453 - protein, 14 aa, Staphylococcus
NESISQPVTKQYLS

SEQ ID NO: 1967454 - protein, 10 aa, Staphylococcus
NESKDKNAID

SEQ ID NO: 1967455 - protein, 10 aa, Staphylococcus
NESKDNSDID

SEQ ID NO: 1967456 - protein, 14 aa, Staphylococcus
NESKHYNKNSKNKR

SEQ ID NO: 1967457 - protein, 10 aa, Staphylococcus
NESKNSNDID

SEQ ID NO: 1967458 - protein, 31 aa, Staphylococcus
NESKRINKTNVNATKIKTEDEINDILKGYQD

SEQ ID NO: 1967459 - protein, 9 aa, Staphylococcus
NESKVAKKL

SEQ ID NO: 1967460 - protein, 8 aa, Staphylococcus
NESLDQDD

SEQ ID NO: 1967461 - protein, 6 aa, Staphylococcus
NESLSQ

SEQ ID NO: 1967462 - protein, 10 aa, Staphylococcus
NESLTKEDLP

SEQ ID NO: 1967463 - protein, 8 aa, Staphylococcus
NESNENSQ

SEQ ID NO: 1967464 - protein, 10 aa, Staphylococcus
NESNKDTDWA

SEQ ID NO: 1967465 - protein, 7 aa, Staphylococcus
NESNPNS

SEQ ID NO: 1967466 - protein, 5 aa, Staphylococcus
NESNY

SEQ ID NO: 1967467 - protein, 9 aa, Staphylococcus
NESPEKLDP

SEQ ID NO: 1967468 - protein, 5 aa, Staphylococcus
NESPF

SEQ ID NO: 1967469 - protein, 13 aa, Staphylococcus
NESPTHNDDPEAQ

SEQ ID NO: 1967470 - protein, 7 aa, Staphylococcus
NESQKRE

SEQ ID NO: 1967471 - protein, 14 aa, Staphylococcus
NESQLNSDESSDFN

SEQ ID NO: 1967472 - protein, 16 aa, Staphylococcus
NESQTAKRSSESGYEA

SEQ ID NO: 1967473 - protein, 16 aa, Staphylococcus
NESRGQVAAKEIGAQS

SEQ ID NO: 1967474 - protein, 10 aa, Staphylococcus
NESRQEYKKV

SEQ ID NO: 1967475 - protein, 8 aa, Staphylococcus
NESSSITE

SEQ ID NO: 1967476 - protein, 7 aa, Staphylococcus
NESSYPS

SEQ ID NO: 1967477 - protein, 8 aa, Staphylococcus
NESTASLK

SEQ ID NO: 1967478 - protein, 41 aa, Staphylococcus
NESTDNYLNKRSQRRQKATQKEEHDSLLPQNNDVYERPKGK

SEQ ID NO: 1967479 - protein, 11 aa, Staphylococcus
NESTEQDTNQV

SEQ ID NO: 1967480 - protein, 14 aa, Staphylococcus
NESTTNEKSTISDV

SEQ ID NO: 1967481 - protein, 7 aa, Staphylococcus
NESVESL

SEQ ID NO: 1967482 - protein, 7 aa, Staphylococcus
NESVESM

SEQ ID NO: 1967483 - protein, 7 aa, Staphylococcus
NESVETM

SEQ ID NO: 1967484 - protein, 5 aa, Staphylococcus
NESVR

SEQ ID NO: 1967485 - protein, 6 aa, Staphylococcus
NESYED

SEQ ID NO: 1967486 - protein, 10 aa, Staphylococcus
NESYEDVTKE

SEQ ID NO: 1967487 - protein, 19 aa, Staphylococcus
NESYIGKGTKAYLEVIKDY

SEQ ID NO: 1967488 - protein, 4 aa, Staphylococcus
NETA

SEQ ID NO: 1967489 - protein, 17 aa, Staphylococcus
NETAAPLKYEDNELERT

SEQ ID NO: 1967490 - protein, 15 aa, Staphylococcus
NETAMETSRRVAKEE

SEQ ID NO: 1967491 - protein, 4 aa, Staphylococcus
NETD

SEQ ID NO: 1967492 - protein, 5 aa, Staphylococcus
NETDG

SEQ ID NO: 1967493 - protein, 8 aa, Staphylococcus
NETDIDPE

SEQ ID NO: 1967494 - protein, 17 aa, Staphylococcus
NETDKFEHQEVPENNEQ

SEQ ID NO: 1967495 - protein, 7 aa, Staphylococcus
NETDTYM

SEQ ID NO: 1967496 - protein, 6 aa, Staphylococcus
NETDVT

SEQ ID NO: 1967497 - protein, 5 aa, Staphylococcus
NETEA

SEQ ID NO: 1967498 - protein, 5 aa, Staphylococcus
NETED

SEQ ID NO: 1967499 - protein, 9 aa, Staphylococcus
NETEDKEEI

SEQ ID NO: 1967500 - protein, 5 aa, Staphylococcus
NETEE

SEQ ID NO: 1967501 - protein, 6 aa, Staphylococcus
NETEGA

SEQ ID NO: 1967502 - protein, 7 aa, Staphylococcus
NETEGIT

SEQ ID NO: 1967503 - protein, 9 aa, Staphylococcus
NETEIADHA

SEQ ID NO: 1967504 - protein, 10 aa, Staphylococcus
NETEMNSEDY

SEQ ID NO: 1967505 - protein, 7 aa, Staphylococcus
NETESER

SEQ ID NO: 1967506 - protein, 6 aa, Staphylococcus
NETFKQ

SEQ ID NO: 1967507 - protein, 4 aa, Staphylococcus
NETG

SEQ ID NO: 1967508 - protein, 6 aa, Staphylococcus
NETGPT

SEQ ID NO: 1967509 - protein, 12 aa, Staphylococcus
NETGQTDKTIAK

SEQ ID NO: 1967510 - protein, 12 aa, Staphylococcus
NETGVTTKVLYQ

SEQ ID NO: 1967511 - protein, 7 aa, Staphylococcus
NETGYTT

SEQ ID NO: 1967512 - protein, 5 aa, Staphylococcus
NETHE

SEQ ID NO: 1967513 - protein, 4 aa, Staphylococcus
NETI

SEQ ID NO: 1967514 - protein, 7 aa, Staphylococcus
NETIENE

SEQ ID NO: 1967515 - protein, 7 aa, Staphylococcus
NETIKGK

SEQ ID NO: 1967516 - protein, 5 aa, Staphylococcus
NETIQ

SEQ ID NO: 1967517 - protein, 6 aa, Staphylococcus
NETIQN

SEQ ID NO: 1967518 - protein, 8 aa, Staphylococcus
NETKDTEV

SEQ ID NO: 1967519 - protein, 7 aa, Staphylococcus
NETKNNK

SEQ ID NO: 1967520 - protein, 9 aa, Staphylococcus
NETKSTSDL

SEQ ID NO: 1967521 - protein, 4 aa, Staphylococcus
NETL

SEQ ID NO: 1967522 - protein, 8 aa, Staphylococcus
NETLASEF

SEQ ID NO: 1967523 - protein, 8 aa, Staphylococcus
NETLASQF

SEQ ID NO: 1967524 - protein, 18 aa, Staphylococcus
NETLTTIKRNAQKLIKAM

SEQ ID NO: 1967525 - protein, 6 aa, Staphylococcus
NETMTP

SEQ ID NO: 1967526 - protein, 6 aa, Staphylococcus
NETNIE

SEQ ID NO: 1967527 - protein, 15 aa, Staphylococcus
NETNIPGYGNAGSGI

SEQ ID NO: 1967528 - protein, 6 aa, Staphylococcus
NETNKH

SEQ ID NO: 1967529 - protein, 7 aa, Staphylococcus
NETNVSS

SEQ ID NO: 1967530 - protein, 6 aa, Staphylococcus
NETPNI

SEQ ID NO: 1967531 - protein, 20 aa, Staphylococcus
NETPQSLKKQFDSQRKRNIN

SEQ ID NO: 1967532 - protein, 6 aa, Staphylococcus
NETPSL

SEQ ID NO: 1967533 - protein, 12 aa, Staphylococcus
NETQTEPKGDQY

SEQ ID NO: 1967534 - protein, 5 aa, Staphylococcus
NETRC

SEQ ID NO: 1967535 - protein, 21 aa, Staphylococcus
NETREDMKSNTYTSAEEGQPE

SEQ ID NO: 1967536 - protein, 7 aa, Staphylococcus
NETRRSM

SEQ ID NO: 1967537 - protein, 9 aa, Staphylococcus
NETSDKEEI

SEQ ID NO: 1967538 - protein, 7 aa, Staphylococcus
NETSEDN

SEQ ID NO: 1967539 - protein, 8 aa, Staphylococcus
NETSEEIE

SEQ ID NO: 1967540 - protein, 14 aa, Staphylococcus
NETSHNKDVTPENN

SEQ ID NO: 1967541 - protein, 7 aa, Staphylococcus
NETSKCN

SEQ ID NO: 1967542 - protein, 7 aa, Staphylococcus
NETSQQD

SEQ ID NO: 1967543 - protein, 6 aa, Staphylococcus
NETTDE

SEQ ID NO: 1967544 - protein, 6 aa, Staphylococcus
NETTEK

SEQ ID NO: 1967545 - protein, 7 aa, Staphylococcus
NETTHSK

SEQ ID NO: 1967546 - protein, 8 aa, Staphylococcus
NETTKTGI

SEQ ID NO: 1967547 - protein, 10 aa, Staphylococcus
NETTPVSEAE

SEQ ID NO: 1967548 - protein, 4 aa, Staphylococcus
NETV

SEQ ID NO: 1967549 - protein, 7 aa, Staphylococcus
NETVESM

SEQ ID NO: 1967550 - protein, 11 aa, Staphylococcus
NETVRADAQTI

SEQ ID NO: 1967551 - protein, 14 aa, Staphylococcus
NEVDHNKHSEEDAS

SEQ ID NO: 1967552 - protein, 13 aa, Staphylococcus
NEVEDAYEKETGK

SEQ ID NO: 1967553 - protein, 6 aa, Staphylococcus
NEVEEP

SEQ ID NO: 1967554 - protein, 8 aa, Staphylococcus
NEVENGTV

SEQ ID NO: 1967555 - protein, 5 aa, Staphylococcus
NEVKE

SEQ ID NO: 1967556 - protein, 8 aa, Staphylococcus
NEVKESKA

SEQ ID NO: 1967557 - protein, 5 aa, Staphylococcus
NEVKK

SEQ ID NO: 1967558 - protein, 9 aa, Staphylococcus
NEVKNIKSR

SEQ ID NO: 1967559 - protein, 9 aa, Staphylococcus
NEVKQRVAD

SEQ ID NO: 1967560 - protein, 11 aa, Staphylococcus
NEVLNPGNTDA

SEQ ID NO: 1967561 - protein, 4 aa, Staphylococcus
NEVN

SEQ ID NO: 1967562 - protein, 5 aa, Staphylococcus
NEVNE

SEQ ID NO: 1967563 - protein, 9 aa, Staphylococcus
NEVNHKRTD

SEQ ID NO: 1967564 - protein, 6 aa, Staphylococcus
NEVNRE

SEQ ID NO: 1967565 - protein, 5 aa, Staphylococcus
NEVPA

SEQ ID NO: 1967566 - protein, 11 aa, Staphylococcus
NEVPERTEGYE

SEQ ID NO: 1967567 - protein, 8 aa, Staphylococcus
NEVPTAQH

SEQ ID NO: 1967568 - protein, 4 aa, Staphylococcus
NEVQ

SEQ ID NO: 1967569 - protein, 5 aa, Staphylococcus
NEVQD

SEQ ID NO: 1967570 - protein, 10 aa, Staphylococcus
NEVQDVGMDS

SEQ ID NO: 1967571 - protein, 8 aa, Staphylococcus
NEVQGSDI

SEQ ID NO: 1967572 - protein, 5 aa, Staphylococcus
NEVRD

SEQ ID NO: 1967573 - protein, 8 aa, Staphylococcus
NEVSEPKA

SEQ ID NO: 1967574 - protein, 13 aa, Staphylococcus
NEVTESYKKEVKS

SEQ ID NO: 1967575 - protein, 6 aa, Staphylococcus
NEVTQN

SEQ ID NO: 1967576 - protein, 19 aa, Staphylococcus
NEVTQSTKAGNSCGKCKKQ

SEQ ID NO: 1967577 - protein, 5 aa, Staphylococcus
NEVTS

SEQ ID NO: 1967578 - protein, 5 aa, Staphylococcus
NEVVT

SEQ ID NO: 1967579 - protein, 12 aa, Staphylococcus
NEVVTKAQRRLQ

SEQ ID NO: 1967580 - protein, 7 aa, Staphylococcus
NEYDDTD

SEQ ID NO: 1967581 - protein, 8 aa, Staphylococcus
NEYDNKPK

SEQ ID NO: 1967582 - protein, 10 aa, Staphylococcus
NEYDTPTYQS

SEQ ID NO: 1967583 - protein, 13 aa, Staphylococcus
NEYEDHADPEFRQ

SEQ ID NO: 1967584 - protein, 8 aa, Staphylococcus
NEYEDHPD

SEQ ID NO: 1967585 - protein, 13 aa, Staphylococcus
NEYEDHPDPNFRQ

SEQ ID NO: 1967586 - protein, 13 aa, Staphylococcus
NEYEDNPDRGFRE

SEQ ID NO: 1967587 - protein, 12 aa, Staphylococcus
NEYEDNPNTEFR

SEQ ID NO: 1967588 - protein, 16 aa, Staphylococcus
NEYGERSLKARQQAYG

SEQ ID NO: 1967589 - protein, 7 aa, Staphylococcus
NEYIEDK

SEQ ID NO: 1967590 - protein, 4 aa, Staphylococcus
NEYM

SEQ ID NO: 1967591 - protein, 5 aa, Staphylococcus
NEYNQ

SEQ ID NO: 1967592 - protein, 11 aa, Staphylococcus
NEYNQDKAEEL

SEQ ID NO: 1967593 - protein, 5 aa, Staphylococcus
NEYPD

SEQ ID NO: 1967594 - protein, 6 aa, Staphylococcus
NEYPKA

SEQ ID NO: 1967595 - protein, 4 aa, Staphylococcus
NEYT

SEQ ID NO: 1967596 - protein, 33 aa, Staphylococcus
NEYVSNRKASGKQGDQDAHEAIRPTSTLRTPEE

SEQ ID NO: 1967597 - protein, 7 aa, Staphylococcus
NFADDDE

SEQ ID NO: 1967598 - protein, 5 aa, Staphylococcus
NFAND

SEQ ID NO: 1967599 - protein, 5 aa, Staphylococcus
NFANE

SEQ ID NO: 1967600 - protein, 5 aa, Staphylococcus
NFDDP

SEQ ID NO: 1967601 - protein, 11 aa, Staphylococcus
NFDEDDEVKRE

SEQ ID NO: 1967602 - protein, 7 aa, Staphylococcus
NFDGDTK

SEQ ID NO: 1967603 - protein, 4 aa, Staphylococcus
NFDK

SEQ ID NO: 1967604 - protein, 11 aa, Staphylococcus
NFDPHSKDEVT

SEQ ID NO: 1967605 - protein, 7 aa, Staphylococcus
NFDSKGK

SEQ ID NO: 1967606 - protein, 15 aa, Staphylococcus
NFDTSFEDLDKDTIE

SEQ ID NO: 1967607 - protein, 5 aa, Staphylococcus
NFEDT

SEQ ID NO: 1967608 - protein, 8 aa, Staphylococcus
NFEEGPSV

SEQ ID NO: 1967609 - protein, 9 aa, Staphylococcus
NFEEGPSVK

SEQ ID NO: 1967610 - protein, 8 aa, Staphylococcus
NFEEGTSI

SEQ ID NO: 1967611 - protein, 13 aa, Staphylococcus
NFEEGTSVKKQPP

SEQ ID NO: 1967612 - protein, 5 aa, Staphylococcus
NFEEI

SEQ ID NO: 1967613 - protein, 5 aa, Staphylococcus
NFENK

SEQ ID NO: 1967614 - protein, 8 aa, Staphylococcus
NFESDTDT

SEQ ID NO: 1967615 - protein, 8 aa, Staphylococcus
NFESESDT

SEQ ID NO: 1967616 - protein, 4 aa, Staphylococcus
NFGE

SEQ ID NO: 1967617 - protein, 5 aa, Staphylococcus
NFGKG

SEQ ID NO: 1967618 - protein, 14 aa, Staphylococcus
NFGNEGNEGEVPFK

SEQ ID NO: 1967619 - protein, 9 aa, Staphylococcus
NFGPTAKQE

SEQ ID NO: 1967620 - protein, 37 aa, Staphylococcus
NFGQNNEEEEEPPTEEIKTKRSEIKKQLEEGKLEQEK

SEQ ID NO: 1967621 - protein, 11 aa, Staphylococcus
NFGRAAAENGI

SEQ ID NO: 1967622 - protein, 11 aa, Staphylococcus
NFGRAAAKTSV

SEQ ID NO: 1967623 - protein, 4 aa, Staphylococcus
NFHG

SEQ ID NO: 1967624 - protein, 10 aa, Staphylococcus
NFHKTGQSYM

SEQ ID NO: 1967625 - protein, 4 aa, Staphylococcus
NFIE

SEQ ID NO: 1967626 - protein, 14 aa, Staphylococcus
NFKDEEDDDYDEDT

SEQ ID NO: 1967627 - protein, 11 aa, Staphylococcus
NFKFPKEGDTP

SEQ ID NO: 1967628 - protein, 9 aa, Staphylococcus
NFKFPQESE

SEQ ID NO: 1967629 - protein, 10 aa, Staphylococcus
NFKFPTEADT

SEQ ID NO: 1967630 - protein, 9 aa, Staphylococcus
NFKKEDTMR

SEQ ID NO: 1967631 - protein, 10 aa, Staphylococcus
NFKPTDTLKE

SEQ ID NO: 1967632 - protein, 4 aa, Staphylococcus
NFKQ

SEQ ID NO: 1967633 - protein, 16 aa, Staphylococcus
NFKQNDKKENPRGRIT

SEQ ID NO: 1967634 - protein, 8 aa, Staphylococcus
NFKSEKTE

SEQ ID NO: 1967635 - protein, 7 aa, Staphylococcus
NFKSNPH

SEQ ID NO: 1967636 - protein, 6 aa, Staphylococcus
NFKTAQ

SEQ ID NO: 1967637 - protein, 8 aa, Staphylococcus
NFNDDDDK

SEQ ID NO: 1967638 - protein, 37 aa, Staphylococcus
NFNQNNEEEEEPPTEEIKTKRSEIKKQLEEGKLEEEK

SEQ ID NO: 1967639 - protein, 9 aa, Staphylococcus
NFPDEAPGI

SEQ ID NO: 1967640 - protein, 6 aa, Staphylococcus
NFPDKT

SEQ ID NO: 1967641 - protein, 10 aa, Staphylococcus
NFPTQSERME

SEQ ID NO: 1967642 - protein, 13 aa, Staphylococcus
NFQTNKKNLNEEI

SEQ ID NO: 1967643 - protein, 6 aa, Staphylococcus
NFRPTE

SEQ ID NO: 1967644 - protein, 6 aa, Staphylococcus
NFRSRE

SEQ ID NO: 1967645 - protein, 6 aa, Staphylococcus
NFRSRK

SEQ ID NO: 1967646 - protein, 11 aa, Staphylococcus
NFSDSEKGKHM

SEQ ID NO: 1967647 - protein, 9 aa, Staphylococcus
NFSEDAEDV

SEQ ID NO: 1967648 - protein, 11 aa, Staphylococcus
NFSEEDPNYDV

SEQ ID NO: 1967649 - protein, 5 aa, Staphylococcus
NFSGD

SEQ ID NO: 1967650 - protein, 7 aa, Staphylococcus
NFSQPKW

SEQ ID NO: 1967651 - protein, 4 aa, Staphylococcus
NFSR

SEQ ID NO: 1967652 - protein, 8 aa, Staphylococcus
NFSSADKL

SEQ ID NO: 1967653 - protein, 6 aa, Staphylococcus
NFSTDT

SEQ ID NO: 1967654 - protein, 6 aa, Staphylococcus
NFTDDN

SEQ ID NO: 1967655 - protein, 4 aa, Staphylococcus
NFTG

SEQ ID NO: 1967656 - protein, 5 aa, Staphylococcus
NFTNT

SEQ ID NO: 1967657 - protein, 5 aa, Staphylococcus
NFTPR

SEQ ID NO: 1967658 - protein, 10 aa, Staphylococcus
NFYQPKPGTD

SEQ ID NO: 1967659 - protein, 4 aa, Staphylococcus
NGAA

SEQ ID NO: 1967660 - protein, 9 aa, Staphylococcus
NGAASLSNS

SEQ ID NO: 1967661 - protein, 7 aa, Staphylococcus
NGAAVNS

SEQ ID NO: 1967662 - protein, 5 aa, Staphylococcus
NGAFA

SEQ ID NO: 1967663 - protein, 12 aa, Staphylococcus
NGAFTGETSPVA

SEQ ID NO: 1967664 - protein, 7 aa, Staphylococcus
NGAGKST

SEQ ID NO: 1967665 - protein, 9 aa, Staphylococcus
NGAGKTTTI

SEQ ID NO: 1967666 - protein, 6 aa, Staphylococcus
NGAHGA

SEQ ID NO: 1967667 - protein, 4 aa, Staphylococcus
NGAK

SEQ ID NO: 1967668 - protein, 30 aa, Staphylococcus
NGAKGEKGEDGKTPKIEQTPIRDSSGNQIG

SEQ ID NO: 1967669 - protein, 9 aa, Staphylococcus
NGAKPTDTV

SEQ ID NO: 1967670 - protein, 13 aa, Staphylococcus
NGAKYITTSDRHL

SEQ ID NO: 1967671 - protein, 23 aa, Staphylococcus
NGALTDRQHKTRTVKETIEGAGL

SEQ ID NO: 1967672 - protein, 5 aa, Staphylococcus
NGAQG

SEQ ID NO: 1967673 - protein, 6 aa, Staphylococcus
NGAQGI

SEQ ID NO: 1967674 - protein, 7 aa, Staphylococcus
NGAQLTS

SEQ ID NO: 1967675 - protein, 8 aa, Staphylococcus
NGARTTLK

SEQ ID NO: 1967676 - protein, 5 aa, Staphylococcus
NGARV

SEQ ID NO: 1967677 - protein, 12 aa, Staphylococcus
NGASDEEQSKAF

SEQ ID NO: 1967678 - protein, 7 aa, Staphylococcus
NGASLSY

SEQ ID NO: 1967679 - protein, 5 aa, Staphylococcus
NGATI

SEQ ID NO: 1967680 - protein, 12 aa, Staphylococcus
NGCATGGSCNCS

SEQ ID NO: 1967681 - protein, 14 aa, Staphylococcus
NGDAAMAGDGQVTL

SEQ ID NO: 1967682 - protein, 8 aa, Staphylococcus
NGDALTQE

SEQ ID NO: 1967683 - protein, 9 aa, Staphylococcus
NGDANDYVG

SEQ ID NO: 1967684 - protein, 14 aa, Staphylococcus
NGDANGSIPTSEPM

SEQ ID NO: 1967685 - protein, 6 aa, Staphylococcus
NGDAYK

SEQ ID NO: 1967686 - protein, 11 aa, Staphylococcus
NGDEEEPNEEG

SEQ ID NO: 1967687 - protein, 8 aa, Staphylococcus
NGDEMTPF

SEQ ID NO: 1967688 - protein, 8 aa, Staphylococcus
NGDFPTRG

SEQ ID NO: 1967689 - protein, 4 aa, Staphylococcus
NGDG

SEQ ID NO: 1967690 - protein, 15 aa, Staphylococcus
NGDGEGVGNPLSEHP

SEQ ID NO: 1967691 - protein, 15 aa, Staphylococcus
NGDGEGVGTPLSEHP

SEQ ID NO: 1967692 - protein, 15 aa, Staphylococcus
NGDGQGVGNPLSEHP

SEQ ID NO: 1967693 - protein, 22 aa, Staphylococcus
NGDGVQELRASRTSMDAQNFDD

SEQ ID NO: 1967694 - protein, 4 aa, Staphylococcus
NGDI

SEQ ID NO: 1967695 - protein, 5 aa, Staphylococcus
NGDIN

SEQ ID NO: 1967696 - protein, 9 aa, Staphylococcus
NGDKDQAKQ

SEQ ID NO: 1967697 - protein, 6 aa, Staphylococcus
NGDKEE

SEQ ID NO: 1967698 - protein, 6 aa, Staphylococcus
NGDKKT

SEQ ID NO: 1967699 - protein, 4 aa, Staphylococcus
NGDL

SEQ ID NO: 1967700 - protein, 12 aa, Staphylococcus
NGDLDNQSEVND

SEQ ID NO: 1967701 - protein, 10 aa, Staphylococcus
NGDNALKQPV

SEQ ID NO: 1967702 - protein, 5 aa, Staphylococcus
NGDNT

SEQ ID NO: 1967703 - protein, 6 aa, Staphylococcus
NGDNTH

SEQ ID NO: 1967704 - protein, 9 aa, Staphylococcus
NGDNTTQPI

SEQ ID NO: 1967705 - protein, 5 aa, Staphylococcus
NGDNV

SEQ ID NO: 1967706 - protein, 6 aa, Staphylococcus
NGDPER

SEQ ID NO: 1967707 - protein, 5 aa, Staphylococcus
NGDPI

SEQ ID NO: 1967708 - protein, 6 aa, Staphylococcus
NGDQGA

SEQ ID NO: 1967709 - protein, 5 aa, Staphylococcus
NGDQT

SEQ ID NO: 1967710 - protein, 5 aa, Staphylococcus
NGDSM

SEQ ID NO: 1967711 - protein, 7 aa, Staphylococcus
NGDSSFE

SEQ ID NO: 1967712 - protein, 9 aa, Staphylococcus
NGDTEVDDH

SEQ ID NO: 1967713 - protein, 7 aa, Staphylococcus
NGDTHQV

SEQ ID NO: 1967714 - protein, 9 aa, Staphylococcus
NGDTKQAKQ

SEQ ID NO: 1967715 - protein, 8 aa, Staphylococcus
NGDTKVTD

SEQ ID NO: 1967716 - protein, 6 aa, Staphylococcus
NGDTPE

SEQ ID NO: 1967717 - protein, 6 aa, Staphylococcus
NGDTYR

SEQ ID NO: 1967718 - protein, 4 aa, Staphylococcus
NGDV

SEQ ID NO: 1967719 - protein, 9 aa, Staphylococcus
NGDVSGDRI

SEQ ID NO: 1967720 - protein, 4 aa, Staphylococcus
NGDY

SEQ ID NO: 1967721 - protein, 4 aa, Staphylococcus
NGEA

SEQ ID NO: 1967722 - protein, 9 aa, Staphylococcus
NGEADTRKI

SEQ ID NO: 1967723 - protein, 6 aa, Staphylococcus
NGEAHV

SEQ ID NO: 1967724 - protein, 5 aa, Staphylococcus
NGEDI

SEQ ID NO: 1967725 - protein, 22 aa, Staphylococcus
NGEDLTEQPSNFKDKAKRFFKG

SEQ ID NO: 1967726 - protein, 4 aa, Staphylococcus
NGEE

SEQ ID NO: 1967727 - protein, 6 aa, Staphylococcus
NGEEAQ

SEQ ID NO: 1967728 - protein, 7 aa, Staphylococcus
NGEEDLD

SEQ ID NO: 1967729 - protein, 8 aa, Staphylococcus
NGEEDLDK

SEQ ID NO: 1967730 - protein, 4 aa, Staphylococcus
NGEG

SEQ ID NO: 1967731 - protein, 13 aa, Staphylococcus
NGEGDGVKTPPFS

SEQ ID NO: 1967732 - protein, 7 aa, Staphylococcus
NGEGHSM

SEQ ID NO: 1967733 - protein, 4 aa, Staphylococcus
NGEI

SEQ ID NO: 1967734 - protein, 5 aa, Staphylococcus
NGEID

SEQ ID NO: 1967735 - protein, 7 aa, Staphylococcus
NGEINGD

SEQ ID NO: 1967736 - protein, 8 aa, Staphylococcus
NGEITNDN

SEQ ID NO: 1967737 - protein, 9 aa, Staphylococcus
NGEKEYSTS

SEQ ID NO: 1967738 - protein, 6 aa, Staphylococcus
NGEKGE

SEQ ID NO: 1967739 - protein, 14 aa, Staphylococcus
NGEKGEAPKAYPHP

SEQ ID NO: 1967740 - protein, 7 aa, Staphylococcus
NGEKNDI

SEQ ID NO: 1967741 - protein, 10 aa, Staphylococcus
NGEKRTKPID

SEQ ID NO: 1967742 - protein, 5 aa, Staphylococcus
NGEKV

SEQ ID NO: 1967743 - protein, 5 aa, Staphylococcus
NGELK

SEQ ID NO: 1967744 - protein, 6 aa, Staphylococcus
NGELKQ

SEQ ID NO: 1967745 - protein, 7 aa, Staphylococcus
NGELKST

SEQ ID NO: 1967746 - protein, 18 aa, Staphylococcus
NGELSTYYQPSSEGPARK

SEQ ID NO: 1967747 - protein, 5 aa, Staphylococcus
NGELT

SEQ ID NO: 1967748 - protein, 11 aa, Staphylococcus
NGELTNKGVAE

SEQ ID NO: 1967749 - protein, 12 aa, Staphylococcus
NGENAKKESDLI

SEQ ID NO: 1967750 - protein, 6 aa, Staphylococcus
NGENGY

SEQ ID NO: 1967751 - protein, 8 aa, Staphylococcus
NGENTTQP

SEQ ID NO: 1967752 - protein, 28 aa, Staphylococcus
NGENVGDGQVGSITKSLQEGFNRYIDTH

SEQ ID NO: 1967753 - protein, 8 aa, Staphylococcus
NGEPAKID

SEQ ID NO: 1967754 - protein, 9 aa, Staphylococcus
NGEPFTGQG

SEQ ID NO: 1967755 - protein, 7 aa, Staphylococcus
NGEPGVY

SEQ ID NO: 1967756 - protein, 9 aa, Staphylococcus
NGEPHPDNE

SEQ ID NO: 1967757 - protein, 4 aa, Staphylococcus
NGEQ

SEQ ID NO: 1967758 - protein, 4 aa, Staphylococcus
NGER

SEQ ID NO: 1967759 - protein, 6 aa, Staphylococcus
NGERGT

SEQ ID NO: 1967760 - protein, 7 aa, Staphylococcus
NGERTFR

SEQ ID NO: 1967761 - protein, 6 aa, Staphylococcus
NGESFT

SEQ ID NO: 1967762 - protein, 22 aa, Staphylococcus
NGESIEEQPSNFKDRARKFFKG

SEQ ID NO: 1967763 - protein, 8 aa, Staphylococcus
NGESKEDF

SEQ ID NO: 1967764 - protein, 4 aa, Staphylococcus
NGET

SEQ ID NO: 1967765 - protein, 9 aa, Staphylococcus
NGETDLDQH

SEQ ID NO: 1967766 - protein, 16 aa, Staphylococcus
NGETIEASKPKLDTDT

SEQ ID NO: 1967767 - protein, 8 aa, Staphylococcus
NGETKDLD

SEQ ID NO: 1967768 - protein, 6 aa, Staphylococcus
NGETPI

SEQ ID NO: 1967769 - protein, 11 aa, Staphylococcus
NGEVEEKHFPD

SEQ ID NO: 1967770 - protein, 4 aa, Staphylococcus
NGEY

SEQ ID NO: 1967771 - protein, 5 aa, Staphylococcus
NGEYE

SEQ ID NO: 1967772 - protein, 13 aa, Staphylococcus
NGEYSEQMKEVYY

SEQ ID NO: 1967773 - protein, 16 aa, Staphylococcus
NGFDYKGQGAYTSLEN

SEQ ID NO: 1967774 - protein, 4 aa, Staphylococcus
NGFE

SEQ ID NO: 1967775 - protein, 8 aa, Staphylococcus
NGFETYKE

SEQ ID NO: 1967776 - protein, 11 aa, Staphylococcus
NGFKDGSYEQR

SEQ ID NO: 1967777 - protein, 38 aa, Staphylococcus
NGFSHKDKNAINEEGIKADKISALTSNSTNEVSKYRAK

SEQ ID NO: 1967778 - protein, 7 aa, Staphylococcus
NGFSNSN

SEQ ID NO: 1967779 - protein, 9 aa, Staphylococcus
NGFSNSTSL

SEQ ID NO: 1967780 - protein, 14 aa, Staphylococcus
NGGAAMAGDGQVTL

SEQ ID NO: 1967781 - protein, 11 aa, Staphylococcus
NGGAPASKPEV

SEQ ID NO: 1967782 - protein, 13 aa, Staphylococcus
NGGDGSGQHPTQS

SEQ ID NO: 1967783 - protein, 7 aa, Staphylococcus
NGGDKVD

SEQ ID NO: 1967784 - protein, 10 aa, Staphylococcus
NGGDSEDAPI

SEQ ID NO: 1967785 - protein, 9 aa, Staphylococcus
NGGEQSVGT

SEQ ID NO: 1967786 - protein, 16 aa, Staphylococcus
NGGGIQGDLNEIDKST

SEQ ID NO: 1967787 - protein, 10 aa, Staphylococcus
NGGHYPVEQP

SEQ ID NO: 1967788 - protein, 6 aa, Staphylococcus
NGGIKG

SEQ ID NO: 1967789 - protein, 5 aa, Staphylococcus
NGGIT

SEQ ID NO: 1967790 - protein, 7 aa, Staphylococcus
NGGITEY

SEQ ID NO: 1967791 - protein, 18 aa, Staphylococcus
NGGKDEKSGKQVGPSYEG

SEQ ID NO: 1967792 - protein, 12 aa, Staphylococcus
NGGKDEKSGMQV

SEQ ID NO: 1967793 - protein, 19 aa, Staphylococcus
NGGKDEKSGNQVGPEYKGI

SEQ ID NO: 1967794 - protein, 10 aa, Staphylococcus
NGGKDSIDNA

SEQ ID NO: 1967795 - protein, 9 aa, Staphylococcus
NGGKHHQFG

SEQ ID NO: 1967796 - protein, 5 aa, Staphylococcus
NGGKM

SEQ ID NO: 1967797 - protein, 10 aa, Staphylococcus
NGGKSNDAPI

SEQ ID NO: 1967798 - protein, 23 aa, Staphylococcus
NGGKTIKVATEEVEVSQSVSKKN

SEQ ID NO: 1967799 - protein, 13 aa, Staphylococcus
NGGKTSDSERPLT

SEQ ID NO: 1967800 - protein, 22 aa, Staphylococcus
NGGKTVNVNTESVEKSRTVTKE

SEQ ID NO: 1967801 - protein, 9 aa, Staphylococcus
NGGKVKNIG

SEQ ID NO: 1967802 - protein, 14 aa, Staphylococcus
NGGLPNSVDNPYIK

SEQ ID NO: 1967803 - protein, 14 aa, Staphylococcus
NGGLPNSVENPYIQ

SEQ ID NO: 1967804 - protein, 7 aa, Staphylococcus
NGGLPVK

SEQ ID NO: 1967805 - protein, 5 aa, Staphylococcus
NGGLT

SEQ ID NO: 1967806 - protein, 12 aa, Staphylococcus
NGGMNGDIGTSF

SEQ ID NO: 1967807 - protein, 7 aa, Staphylococcus
NGGMTRA

SEQ ID NO: 1967808 - protein, 16 aa, Staphylococcus
NGGNQVNSIPEHAESE

SEQ ID NO: 1967809 - protein, 9 aa, Staphylococcus
NGGNTHIDG

SEQ ID NO: 1967810 - protein, 7 aa, Staphylococcus
NGGNTNS

SEQ ID NO: 1967811 - protein, 9 aa, Staphylococcus
NGGNTTEPV

SEQ ID NO: 1967812 - protein, 9 aa, Staphylococcus
NGGNVNDAP

SEQ ID NO: 1967813 - protein, 10 aa, Staphylococcus
NGGPRAERQR

SEQ ID NO: 1967814 - protein, 8 aa, Staphylococcus
NGGQTISV

SEQ ID NO: 1967815 - protein, 12 aa, Staphylococcus
NGGQTMNPSTND

SEQ ID NO: 1967816 - protein, 17 aa, Staphylococcus
NGGRDTFIESDDYGKTW

SEQ ID NO: 1967817 - protein, 24 aa, Staphylococcus
NGGRTTRVKDGELEDEKSVSKEDF

SEQ ID NO: 1967818 - protein, 13 aa, Staphylococcus
NGGSQVNSIPDYA

SEQ ID NO: 1967819 - protein, 15 aa, Staphylococcus
NGGSQVNSVPDHATA

SEQ ID NO: 1967820 - protein, 16 aa, Staphylococcus
NGGSQVNSVPDSATAE

SEQ ID NO: 1967821 - protein, 4 aa, Staphylococcus
NGGT

SEQ ID NO: 1967822 - protein, 6 aa, Staphylococcus
NGGYEN

SEQ ID NO: 1967823 - protein, 7 aa, Staphylococcus
NGHEADE

SEQ ID NO: 1967824 - protein, 4 aa, Staphylococcus
NGHG

SEQ ID NO: 1967825 - protein, 5 aa, Staphylococcus
NGHGQ

SEQ ID NO: 1967826 - protein, 14 aa, Staphylococcus
NGHGSAELYQPQSV

SEQ ID NO: 1967827 - protein, 9 aa, Staphylococcus
NGHGSQELY

SEQ ID NO: 1967828 - protein, 9 aa, Staphylococcus
NGHGTAELY

SEQ ID NO: 1967829 - protein, 4 aa, Staphylococcus
NGHN

SEQ ID NO: 1967830 - protein, 6 aa, Staphylococcus
NGHNQE

SEQ ID NO: 1967831 - protein, 24 aa, Staphylococcus
NGHPNAGVKNDEGKQNANKESGDN

SEQ ID NO: 1967832 - protein, 5 aa, Staphylococcus
NGHQT

SEQ ID NO: 1967833 - protein, 8 aa, Staphylococcus
NGHSIEPG

SEQ ID NO: 1967834 - protein, 8 aa, Staphylococcus
NGHSPFDR

SEQ ID NO: 1967835 - protein, 7 aa, Staphylococcus
NGHSPQQ

SEQ ID NO: 1967836 - protein, 4 aa, Staphylococcus
NGHT

SEQ ID NO: 1967837 - protein, 5 aa, Staphylococcus
NGHYP

SEQ ID NO: 1967838 - protein, 7 aa, Staphylococcus
NGHYTTD

SEQ ID NO: 1967839 - protein, 7 aa, Staphylococcus
NGHYTTK

SEQ ID NO: 1967840 - protein, 7 aa, Staphylococcus
NGIAGQE

SEQ ID NO: 1967841 - protein, 19 aa, Staphylococcus
NGIDDDKNEFVREKASDTF

SEQ ID NO: 1967842 - protein, 8 aa, Staphylococcus
NGIEEKRQ

SEQ ID NO: 1967843 - protein, 12 aa, Staphylococcus
NGIGERAGNAAL

SEQ ID NO: 1967844 - protein, 12 aa, Staphylococcus
NGIGERAGNTAL

SEQ ID NO: 1967845 - protein, 13 aa, Staphylococcus
NGIGERAGNTALE

SEQ ID NO: 1967846 - protein, 5 aa, Staphylococcus
NGIGI

SEQ ID NO: 1967847 - protein, 16 aa, Staphylococcus
NGILGKRQSLDEEFPE

SEQ ID NO: 1967848 - protein, 9 aa, Staphylococcus
NGINQARNG

SEQ ID NO: 1967849 - protein, 8 aa, Staphylococcus
NGINQSRN

SEQ ID NO: 1967850 - protein, 5 aa, Staphylococcus
NGIPD

SEQ ID NO: 1967851 - protein, 5 aa, Staphylococcus
NGIPE

SEQ ID NO: 1967852 - protein, 15 aa, Staphylococcus
NGIQTRQTDSFNQTT

SEQ ID NO: 1967853 - protein, 8 aa, Staphylococcus
NGIRESEV

SEQ ID NO: 1967854 - protein, 12 aa, Staphylococcus
NGISRKDTQTKR

SEQ ID NO: 1967855 - protein, 6 aa, Staphylococcus
NGITDT

SEQ ID NO: 1967856 - protein, 6 aa, Staphylococcus
NGITEE

SEQ ID NO: 1967857 - protein, 6 aa, Staphylococcus
NGKAGE

SEQ ID NO: 1967858 - protein, 24 aa, Staphylococcus
NGKDEAIPGIAKGDPKESNNGKTL

SEQ ID NO: 1967859 - protein, 26 aa, Staphylococcus
NGKDGKDGKTPSIEQQPIKDENGKQI

SEQ ID NO: 1967860 - protein, 4 aa, Staphylococcus
NGKE

SEQ ID NO: 1967861 - protein, 6 aa, Staphylococcus
NGKEFR

SEQ ID NO: 1967862 - protein, 9 aa, Staphylococcus
NGKEIGKDT

SEQ ID NO: 1967863 - protein, 6 aa, Staphylococcus
NGKEPI

SEQ ID NO: 1967864 - protein, 7 aa, Staphylococcus
NGKEPIA

SEQ ID NO: 1967865 - protein, 5 aa, Staphylococcus
NGKET

SEQ ID NO: 1967866 - protein, 15 aa, Staphylococcus
NGKIAGGKSPDSGHE

SEQ ID NO: 1967867 - protein, 21 aa, Staphylococcus
NGKIAYDSQTEMESPRGGEDV

SEQ ID NO: 1967868 - protein, 5 aa, Staphylococcus
NGKID

SEQ ID NO: 1967869 - protein, 5 aa, Staphylococcus
NGKIE

SEQ ID NO: 1967870 - protein, 7 aa, Staphylococcus
NGKIEPK

SEQ ID NO: 1967871 - protein, 8 aa, Staphylococcus
NGKKGALS

SEQ ID NO: 1967872 - protein, 7 aa, Staphylococcus
NGKKSVA

SEQ ID NO: 1967873 - protein, 5 aa, Staphylococcus
NGKKV

SEQ ID NO: 1967874 - protein, 10 aa, Staphylococcus
NGKKVKANHK

SEQ ID NO: 1967875 - protein, 7 aa, Staphylococcus
NGKLGTH

SEQ ID NO: 1967876 - protein, 7 aa, Staphylococcus
NGKLKNT

SEQ ID NO: 1967877 - protein, 10 aa, Staphylococcus
NGKLKQRPIQ

SEQ ID NO: 1967878 - protein, 13 aa, Staphylococcus
NGKMNDKADKYAG

SEQ ID NO: 1967879 - protein, 13 aa, Staphylococcus
NGKMNDNASQYAG

SEQ ID NO: 1967880 - protein, 6 aa, Staphylococcus
NGKMSR

SEQ ID NO: 1967881 - protein, 4 aa, Staphylococcus
NGKP

SEQ ID NO: 1967882 - protein, 10 aa, Staphylococcus
NGKPIRETST

SEQ ID NO: 1967883 - protein, 6 aa, Staphylococcus
NGKPYA

SEQ ID NO: 1967884 - protein, 5 aa, Staphylococcus
NGKQC

SEQ ID NO: 1967885 - protein, 15 aa, Staphylococcus
NGKRITGRVNSHGKY

SEQ ID NO: 1967886 - protein, 4 aa, Staphylococcus
NGKS

SEQ ID NO: 1967887 - protein, 8 aa, Staphylococcus
NGKSQGVQ

SEQ ID NO: 1967888 - protein, 5 aa, Staphylococcus
NGKSV

SEQ ID NO: 1967889 - protein, 6 aa, Staphylococcus
NGKTFG

SEQ ID NO: 1967890 - protein, 6 aa, Staphylococcus
NGKVTE

SEQ ID NO: 1967891 - protein, 12 aa, Staphylococcus
NGKVVNRYQILN

SEQ ID NO: 1967892 - protein, 9 aa, Staphylococcus
NGKYEAPTF

SEQ ID NO: 1967893 - protein, 6 aa, Staphylococcus
NGKYET

SEQ ID NO: 1967894 - protein, 6 aa, Staphylococcus
NGKYGT

SEQ ID NO: 1967895 - protein, 5 aa, Staphylococcus
NGLAP

SEQ ID NO: 1967896 - protein, 4 aa, Staphylococcus
NGLD

SEQ ID NO: 1967897 - protein, 5 aa, Staphylococcus
NGLDA

SEQ ID NO: 1967898 - protein, 9 aa, Staphylococcus
NGLDAQGIK

SEQ ID NO: 1967899 - protein, 17 aa, Staphylococcus
NGLDGVTSSEVSLANGN

SEQ ID NO: 1967900 - protein, 8 aa, Staphylococcus
NGLDPRAV

SEQ ID NO: 1967901 - protein, 9 aa, Staphylococcus
NGLDPRAVR

SEQ ID NO: 1967902 - protein, 11 aa, Staphylococcus
NGLELSEDKQL

SEQ ID NO: 1967903 - protein, 9 aa, Staphylococcus
NGLEPEEVS

SEQ ID NO: 1967904 - protein, 8 aa, Staphylococcus
NGLEPTEV

SEQ ID NO: 1967905 - protein, 5 aa, Staphylococcus
NGLGR

SEQ ID NO: 1967906 - protein, 22 aa, Staphylococcus
NGLGYKDEFDEERKTVDDDARI

SEQ ID NO: 1967907 - protein, 20 aa, Staphylococcus
NGLGYKDEFDEKEKTVHDDA

SEQ ID NO: 1967908 - protein, 4 aa, Staphylococcus
NGLH

SEQ ID NO: 1967909 - protein, 8 aa, Staphylococcus
NGLHPGRT

SEQ ID NO: 1967910 - protein, 9 aa, Staphylococcus
NGLKDPDTA

SEQ ID NO: 1967911 - protein, 10 aa, Staphylococcus
NGLKDPDTAI

SEQ ID NO: 1967912 - protein, 7 aa, Staphylococcus
NGLKPSQ

SEQ ID NO: 1967913 - protein, 4 aa, Staphylococcus
NGLN

SEQ ID NO: 1967914 - protein, 15 aa, Staphylococcus
NGLNGAPQGPQRLSE

SEQ ID NO: 1967915 - protein, 5 aa, Staphylococcus
NGLNK

SEQ ID NO: 1967916 - protein, 12 aa, Staphylococcus
NGLNTSPYFNPD

SEQ ID NO: 1967917 - protein, 4 aa, Staphylococcus
NGLQ

SEQ ID NO: 1967918 - protein, 5 aa, Staphylococcus
NGLSI

SEQ ID NO: 1967919 - protein, 9 aa, Staphylococcus
NGLSPRELY

SEQ ID NO: 1967920 - protein, 9 aa, Staphylococcus
NGLSSKDIA

SEQ ID NO: 1967921 - protein, 6 aa, Staphylococcus
NGLTPN

SEQ ID NO: 1967922 - protein, 10 aa, Staphylococcus
NGMDEATLSG

SEQ ID NO: 1967923 - protein, 14 aa, Staphylococcus
NGMDEATLSGNNEV

SEQ ID NO: 1967924 - protein, 5 aa, Staphylococcus
NGMGD

SEQ ID NO: 1967925 - protein, 13 aa, Staphylococcus
NGMTEQEAIDQAA

SEQ ID NO: 1967926 - protein, 6 aa, Staphylococcus
NGMTSR

SEQ ID NO: 1967927 - protein, 7 aa, Staphylococcus
NGNAIAQ

SEQ ID NO: 1967928 - protein, 8 aa, Staphylococcus
NGNDHSRI

SEQ ID NO: 1967929 - protein, 7 aa, Staphylococcus
NGNDKAL

SEQ ID NO: 1967930 - protein, 18 aa, Staphylococcus
NGNDRNRYKEYATHQENI

SEQ ID NO: 1967931 - protein, 9 aa, Staphylococcus
NGNENVEDV

SEQ ID NO: 1967932 - protein, 9 aa, Staphylococcus
NGNENVNDV

SEQ ID NO: 1967933 - protein, 7 aa, Staphylococcus
NGNEPIA

SEQ ID NO: 1967934 - protein, 11 aa, Staphylococcus
NGNETEPNEAG

SEQ ID NO: 1967935 - protein, 12 aa, Staphylococcus
NGNHDGKERLNY

SEQ ID NO: 1967936 - protein, 11 aa, Staphylococcus
NGNHDGRERLN

SEQ ID NO: 1967937 - protein, 8 aa, Staphylococcus
NGNHREHY

SEQ ID NO: 1967938 - protein, 4 aa, Staphylococcus
NGNI

SEQ ID NO: 1967939 - protein, 6 aa, Staphylococcus
NGNIDE

SEQ ID NO: 1967940 - protein, 29 aa, Staphylococcus
NGNITGPYNKVAGSNLGKAYEYADEKINS

SEQ ID NO: 1967941 - protein, 9 aa, Staphylococcus
NGNKAQAKQ

SEQ ID NO: 1967942 - protein, 5 aa, Staphylococcus
NGNLT

SEQ ID NO: 1967943 - protein, 9 aa, Staphylococcus
NGNNTTQPV

SEQ ID NO: 1967944 - protein, 4 aa, Staphylococcus
NGNQ

SEQ ID NO: 1967945 - protein, 8 aa, Staphylococcus
NGNQNIDQ

SEQ ID NO: 1967946 - protein, 15 aa, Staphylococcus
NGNQNVKPETRDKVN

SEQ ID NO: 1967947 - protein, 14 aa, Staphylococcus
NGNQNVKPETRKKV

SEQ ID NO: 1967948 - protein, 10 aa, Staphylococcus
NGNQSVPVDE

SEQ ID NO: 1967949 - protein, 6 aa, Staphylococcus
NGNREN

SEQ ID NO: 1967950 - protein, 4 aa, Staphylococcus
NGNS

SEQ ID NO: 1967951 - protein, 7 aa, Staphylococcus
NGNSDHT

SEQ ID NO: 1967952 - protein, 4 aa, Staphylococcus
NGNT

SEQ ID NO: 1967953 - protein, 4 aa, Staphylococcus
NGNV

SEQ ID NO: 1967954 - protein, 6 aa, Staphylococcus
NGNVDE

SEQ ID NO: 1967955 - protein, 13 aa, Staphylococcus
NGNVGVEKTTANA

SEQ ID NO: 1967956 - protein, 5 aa, Staphylococcus
NGNYH

SEQ ID NO: 1967957 - protein, 6 aa, Staphylococcus
NGNYNH

SEQ ID NO: 1967958 - protein, 9 aa, Staphylococcus
NGNYYTPRY

SEQ ID NO: 1967959 - protein, 12 aa, Staphylococcus
NGPATIIQREIN

SEQ ID NO: 1967960 - protein, 12 aa, Staphylococcus
NGPATLIRREKG

SEQ ID NO: 1967961 - protein, 4 aa, Staphylococcus
NGPE

SEQ ID NO: 1967962 - protein, 11 aa, Staphylococcus
NGPETGDYQIG

SEQ ID NO: 1967963 - protein, 10 aa, Staphylococcus
NGPFSSYSDK

SEQ ID NO: 1967964 - protein, 7 aa, Staphylococcus
NGPIEGI

SEQ ID NO: 1967965 - protein, 11 aa, Staphylococcus
NGPISKSGVNH

SEQ ID NO: 1967966 - protein, 12 aa, Staphylococcus
NGPKNPERTSYE

SEQ ID NO: 1967967 - protein, 6 aa, Staphylococcus
NGPQTS

SEQ ID NO: 1967968 - protein, 8 aa, Staphylococcus
NGPSHPHD

SEQ ID NO: 1967969 - protein, 5 aa, Staphylococcus
NGPTS

SEQ ID NO: 1967970 - protein, 10 aa, Staphylococcus
NGPTSPQQVS

SEQ ID NO: 1967971 - protein, 7 aa, Staphylococcus
NGPVPEE

SEQ ID NO: 1967972 - protein, 5 aa, Staphylococcus
NGPVT

SEQ ID NO: 1967973 - protein, 7 aa, Staphylococcus
NGQAATD

SEQ ID NO: 1967974 - protein, 5 aa, Staphylococcus
NGQDL

SEQ ID NO: 1967975 - protein, 11 aa, Staphylococcus
NGQDLYNKDER

SEQ ID NO: 1967976 - protein, 10 aa, Staphylococcus
NGQDTGNEHN

SEQ ID NO: 1967977 - protein, 7 aa, Staphylococcus
NGQDVAE

SEQ ID NO: 1967978 - protein, 6 aa, Staphylococcus
NGQEPI

SEQ ID NO: 1967979 - protein, 11 aa, Staphylococcus
NGQERNNTTYN

SEQ ID NO: 1967980 - protein, 12 aa, Staphylococcus
NGQETGNESNDL

SEQ ID NO: 1967981 - protein, 6 aa, Staphylococcus
NGQFEE

SEQ ID NO: 1967982 - protein, 16 aa, Staphylococcus
NGQGGHGSSPHTANDS

SEQ ID NO: 1967983 - protein, 6 aa, Staphylococcus
NGQHPL

SEQ ID NO: 1967984 - protein, 7 aa, Staphylococcus
NGQITKK

SEQ ID NO: 1967985 - protein, 10 aa, Staphylococcus
NGQKESPDEL

SEQ ID NO: 1967986 - protein, 5 aa, Staphylococcus
NGQKF

SEQ ID NO: 1967987 - protein, 7 aa, Staphylococcus
NGQKGSL

SEQ ID NO: 1967988 - protein, 6 aa, Staphylococcus
NGQLTG

SEQ ID NO: 1967989 - protein, 12 aa, Staphylococcus
NGQLVSRFEIPN

SEQ ID NO: 1967990 - protein, 8 aa, Staphylococcus
NGQNSRWY

SEQ ID NO: 1967991 - protein, 6 aa, Staphylococcus
NGQNVQ

SEQ ID NO: 1967992 - protein, 4 aa, Staphylococcus
NGQP

SEQ ID NO: 1967993 - protein, 9 aa, Staphylococcus
NGQPAKIDD

SEQ ID NO: 1967994 - protein, 7 aa, Staphylococcus
NGQPDFQ

SEQ ID NO: 1967995 - protein, 6 aa, Staphylococcus
NGQPKL

SEQ ID NO: 1967996 - protein, 4 aa, Staphylococcus
NGQQ

SEQ ID NO: 1967997 - protein, 15 aa, Staphylococcus
NGQQDEETKKFIQSI

SEQ ID NO: 1967998 - protein, 6 aa, Staphylococcus
NGQRLN

SEQ ID NO: 1967999 - protein, 10 aa, Staphylococcus
NGQSLASLKQ

SEQ ID NO: 1968000 - protein, 7 aa, Staphylococcus
NGQSPIA

SEQ ID NO: 1968001 - protein, 4 aa, Staphylococcus
NGQT

SEQ ID NO: 1968002 - protein, 26 aa, Staphylococcus
NGQTSHSPNKENNSQIQKLTPEETRR

SEQ ID NO: 1968003 - protein, 5 aa, Staphylococcus
NGQVA

SEQ ID NO: 1968004 - protein, 15 aa, Staphylococcus
NGQYQAGDKLPSVEE

SEQ ID NO: 1968005 - protein, 14 aa, Staphylococcus
NGRATAKVSIPSPN

SEQ ID NO: 1968006 - protein, 10 aa, Staphylococcus
NGRELEPDEM

SEQ ID NO: 1968007 - protein, 14 aa, Staphylococcus
NGRELTANEMQQPR

SEQ ID NO: 1968008 - protein, 20 aa, Staphylococcus
NGRENAYPSELSGGQKQRVG

SEQ ID NO: 1968009 - protein, 11 aa, Staphylococcus
NGRGSNKETRH

SEQ ID NO: 1968010 - protein, 4 aa, Staphylococcus
NGRK

SEQ ID NO: 1968011 - protein, 4 aa, Staphylococcus
NGRL

SEQ ID NO: 1968012 - protein, 6 aa, Staphylococcus
NGRLSY

SEQ ID NO: 1968013 - protein, 7 aa, Staphylococcus
NGRNGKS

SEQ ID NO: 1968014 - protein, 7 aa, Staphylococcus
NGRNPKE

SEQ ID NO: 1968015 - protein, 10 aa, Staphylococcus
NGRPAKADDP

SEQ ID NO: 1968016 - protein, 6 aa, Staphylococcus
NGRPIN

SEQ ID NO: 1968017 - protein, 5 aa, Staphylococcus
NGRPT

SEQ ID NO: 1968018 - protein, 17 aa, Staphylococcus
NGRQIGAKASKPKEKQT

SEQ ID NO: 1968019 - protein, 10 aa, Staphylococcus
NGRSDTDKNA

SEQ ID NO: 1968020 - protein, 7 aa, Staphylococcus
NGRSKIK

SEQ ID NO: 1968021 - protein, 7 aa, Staphylococcus
NGRYHTV

SEQ ID NO: 1968022 - protein, 5 aa, Staphylococcus
NGRYI

SEQ ID NO: 1968023 - protein, 9 aa, Staphylococcus
NGSAYYAPA

SEQ ID NO: 1968024 - protein, 5 aa, Staphylococcus
NGSEI

SEQ ID NO: 1968025 - protein, 9 aa, Staphylococcus
NGSGNVRTK

SEQ ID NO: 1968026 - protein, 26 aa, Staphylococcus
NGSGTRSTGKNYKGSKPFSERESRNM

SEQ ID NO: 1968027 - protein, 5 aa, Staphylococcus
NGSHN

SEQ ID NO: 1968028 - protein, 6 aa, Staphylococcus
NGSING

SEQ ID NO: 1968029 - protein, 12 aa, Staphylococcus
NGSIVSDNNEIQ

SEQ ID NO: 1968030 - protein, 10 aa, Staphylococcus
NGSKTETLPA

SEQ ID NO: 1968031 - protein, 4 aa, Staphylococcus
NGSL

SEQ ID NO: 1968032 - protein, 14 aa, Staphylococcus
NGSNNSDSKFDDPH

SEQ ID NO: 1968033 - protein, 14 aa, Staphylococcus
NGSPVDLTKTDMKP

SEQ ID NO: 1968034 - protein, 6 aa, Staphylococcus
NGSQGL

SEQ ID NO: 1968035 - protein, 7 aa, Staphylococcus
NGSQRSV

SEQ ID NO: 1968036 - protein, 8 aa, Staphylococcus
NGSRAQIN

SEQ ID NO: 1968037 - protein, 8 aa, Staphylococcus
NGSRPRPL

SEQ ID NO: 1968038 - protein, 7 aa, Staphylococcus
NGSRSVA

SEQ ID NO: 1968039 - protein, 31 aa, Staphylococcus
NGSTYELEGPNGEKVKLNQSEVDDDDQLEIG

SEQ ID NO: 1968040 - protein, 9 aa, Staphylococcus
NGSVPKDME

SEQ ID NO: 1968041 - protein, 12 aa, Staphylococcus
NGSVSNKTKEKL

SEQ ID NO: 1968042 - protein, 8 aa, Staphylococcus
NGSVYDRE

SEQ ID NO: 1968043 - protein, 8 aa, Staphylococcus
NGSVYERD

SEQ ID NO: 1968044 - protein, 8 aa, Staphylococcus
NGSVYERE

SEQ ID NO: 1968045 - protein, 8 aa, Staphylococcus
NGSVYKRE

SEQ ID NO: 1968046 - protein, 8 aa, Staphylococcus
NGSVYNQD

SEQ ID NO: 1968047 - protein, 7 aa, Staphylococcus
NGSYDKH

SEQ ID NO: 1968048 - protein, 14 aa, Staphylococcus
NGSYTKGSQLPSEH

SEQ ID NO: 1968049 - protein, 5 aa, Staphylococcus
NGTAV

SEQ ID NO: 1968050 - protein, 17 aa, Staphylococcus
NGTDREHTHHTDDTGVD

SEQ ID NO: 1968051 - protein, 8 aa, Staphylococcus
NGTEAASY

SEQ ID NO: 1968052 - protein, 9 aa, Staphylococcus
NGTESKKRE

SEQ ID NO: 1968053 - protein, 5 aa, Staphylococcus
NGTGH

SEQ ID NO: 1968054 - protein, 5 aa, Staphylococcus
NGTGI

SEQ ID NO: 1968055 - protein, 8 aa, Staphylococcus
NGTGIEAD

SEQ ID NO: 1968056 - protein, 8 aa, Staphylococcus
NGTGIEED

SEQ ID NO: 1968057 - protein, 11 aa, Staphylococcus
NGTGKDQPIGL

SEQ ID NO: 1968058 - protein, 10 aa, Staphylococcus
NGTGTALSAH

SEQ ID NO: 1968059 - protein, 11 aa, Staphylococcus
NGTGTALSAHD

SEQ ID NO: 1968060 - protein, 7 aa, Staphylococcus
NGTIGSE

SEQ ID NO: 1968061 - protein, 8 aa, Staphylococcus
NGTIKTAN

SEQ ID NO: 1968062 - protein, 38 aa, Staphylococcus
NGTINDKKMENDAIQEDAIQTRTKENLNNQSQTNNHIK

SEQ ID NO: 1968063 - protein, 7 aa, Staphylococcus
NGTKGSL

SEQ ID NO: 1968064 - protein, 5 aa, Staphylococcus
NGTLE

SEQ ID NO: 1968065 - protein, 4 aa, Staphylococcus
NGTM

SEQ ID NO: 1968066 - protein, 13 aa, Staphylococcus
NGTMGQRWEDGKQ

SEQ ID NO: 1968067 - protein, 12 aa, Staphylococcus
NGTMGQRWEEGK

SEQ ID NO: 1968068 - protein, 13 aa, Staphylococcus
NGTMGQRWEEGKQ

SEQ ID NO: 1968069 - protein, 8 aa, Staphylococcus
NGTNKKHD

SEQ ID NO: 1968070 - protein, 26 aa, Staphylococcus
NGTNNRITQNESEASFATNISREQEK

SEQ ID NO: 1968071 - protein, 8 aa, Staphylococcus
NGTPITND

SEQ ID NO: 1968072 - protein, 6 aa, Staphylococcus
NGTPQK

SEQ ID NO: 1968073 - protein, 6 aa, Staphylococcus
NGTQGT

SEQ ID NO: 1968074 - protein, 5 aa, Staphylococcus
NGTQL

SEQ ID NO: 1968075 - protein, 8 aa, Staphylococcus
NGTRHRAN

SEQ ID NO: 1968076 - protein, 17 aa, Staphylococcus
NGTTAENPTLTDEEKDQ

SEQ ID NO: 1968077 - protein, 5 aa, Staphylococcus
NGTTF

SEQ ID NO: 1968078 - protein, 7 aa, Staphylococcus
NGTVTSS

SEQ ID NO: 1968079 - protein, 10 aa, Staphylococcus
NGVANARNIG

SEQ ID NO: 1968080 - protein, 8 aa, Staphylococcus
NGVDPKSQ

SEQ ID NO: 1968081 - protein, 10 aa, Staphylococcus
NGVESYKDRI

SEQ ID NO: 1968082 - protein, 4 aa, Staphylococcus
NGVK

SEQ ID NO: 1968083 - protein, 9 aa, Staphylococcus
NGVKDGVAM

SEQ ID NO: 1968084 - protein, 6 aa, Staphylococcus
NGVKNG

SEQ ID NO: 1968085 - protein, 13 aa, Staphylococcus
NGVLEREGHTEAT

SEQ ID NO: 1968086 - protein, 4 aa, Staphylococcus
NGVN

SEQ ID NO: 1968087 - protein, 9 aa, Staphylococcus
NGVNKNKFN

SEQ ID NO: 1968088 - protein, 16 aa, Staphylococcus
NGVQAFPDAHSAAEKH

SEQ ID NO: 1968089 - protein, 13 aa, Staphylococcus
NGVQSAEVNLEEN

SEQ ID NO: 1968090 - protein, 17 aa, Staphylococcus
NGVRTAEVDLDKNEVRV

SEQ ID NO: 1968091 - protein, 14 aa, Staphylococcus
NGVSAAEVDLEKGQ

SEQ ID NO: 1968092 - protein, 12 aa, Staphylococcus
NGVSKNPMNGEQ

SEQ ID NO: 1968093 - protein, 7 aa, Staphylococcus
NGVTETM

SEQ ID NO: 1968094 - protein, 13 aa, Staphylococcus
NGVTSAEVDLDKN

SEQ ID NO: 1968095 - protein, 5 aa, Staphylococcus
NGVTT

SEQ ID NO: 1968096 - protein, 11 aa, Staphylococcus
NGYANKKPTLR

SEQ ID NO: 1968097 - protein, 20 aa, Staphylococcus
NGYDQADYTSSEPQQDTSEI

SEQ ID NO: 1968098 - protein, 5 aa, Staphylococcus
NGYGD

SEQ ID NO: 1968099 - protein, 6 aa, Staphylococcus
NGYGDE

SEQ ID NO: 1968100 - protein, 5 aa, Staphylococcus
NGYGK

SEQ ID NO: 1968101 - protein, 11 aa, Staphylococcus
NGYGKRTPLNE

SEQ ID NO: 1968102 - protein, 11 aa, Staphylococcus
NGYGKRTPVDE

SEQ ID NO: 1968103 - protein, 11 aa, Staphylococcus
NGYGKRTPVED

SEQ ID NO: 1968104 - protein, 5 aa, Staphylococcus
NGYGL

SEQ ID NO: 1968105 - protein, 8 aa, Staphylococcus
NGYGQSQH

SEQ ID NO: 1968106 - protein, 6 aa, Staphylococcus
NGYGSE

SEQ ID NO: 1968107 - protein, 9 aa, Staphylococcus
NGYNPSEQY

SEQ ID NO: 1968108 - protein, 5 aa, Staphylococcus
NGYRD

SEQ ID NO: 1968109 - protein, 5 aa, Staphylococcus
NGYRI

SEQ ID NO: 1968110 - protein, 4 aa, Staphylococcus
NGYS

SEQ ID NO: 1968111 - protein, 14 aa, Staphylococcus
NGYSSQLEDEAERY

SEQ ID NO: 1968112 - protein, 5 aa, Staphylococcus
NGYTL

SEQ ID NO: 1968113 - protein, 9 aa, Staphylococcus
NGYTYEADG

SEQ ID NO: 1968114 - protein, 11 aa, Staphylococcus
NGYVEPRNDME

SEQ ID NO: 1968115 - protein, 14 aa, Staphylococcus
NGYYKYKDAQKNNH

SEQ ID NO: 1968116 - protein, 4 aa, Staphylococcus
NHAL

SEQ ID NO: 1968117 - protein, 5 aa, Staphylococcus
NHDDE

SEQ ID NO: 1968118 - protein, 23 aa, Staphylococcus
NHDELDGSETVVSGASCTTNSLA

SEQ ID NO: 1968119 - protein, 12 aa, Staphylococcus
NHDERYKKAEEF

SEQ ID NO: 1968120 - protein, 12 aa, Staphylococcus
NHDGDITGNAGN

SEQ ID NO: 1968121 - protein, 5 aa, Staphylococcus
NHDGE

SEQ ID NO: 1968122 - protein, 6 aa, Staphylococcus
NHDGEV

SEQ ID NO: 1968123 - protein, 9 aa, Staphylococcus
NHDGKARLN

SEQ ID NO: 1968124 - protein, 9 aa, Staphylococcus
NHDGKERLN

SEQ ID NO: 1968125 - protein, 10 aa, Staphylococcus
NHDGKERLNY

SEQ ID NO: 1968126 - protein, 8 aa, Staphylococcus
NHDNEEFE

SEQ ID NO: 1968127 - protein, 4 aa, Staphylococcus
NHDP

SEQ ID NO: 1968128 - protein, 7 aa, Staphylococcus
NHDPKTV

SEQ ID NO: 1968129 - protein, 5 aa, Staphylococcus
NHDPL

SEQ ID NO: 1968130 - protein, 8 aa, Staphylococcus
NHDPLTEK

SEQ ID NO: 1968131 - protein, 10 aa, Staphylococcus
NHDSKERLNY

SEQ ID NO: 1968132 - protein, 11 aa, Staphylococcus
NHDSKERLNYG

SEQ ID NO: 1968133 - protein, 5 aa, Staphylococcus
NHDTG

SEQ ID NO: 1968134 - protein, 13 aa, Staphylococcus
NHEDETKLNEAKS

SEQ ID NO: 1968135 - protein, 5 aa, Staphylococcus
NHEDR

SEQ ID NO: 1968136 - protein, 5 aa, Staphylococcus
NHEEQ

SEQ ID NO: 1968137 - protein, 8 aa, Staphylococcus
NHEESGNI

SEQ ID NO: 1968138 - protein, 6 aa, Staphylococcus
NHEGLN

SEQ ID NO: 1968139 - protein, 24 aa, Staphylococcus
NHEPENIGAGKSNLPGNPIERETV

SEQ ID NO: 1968140 - protein, 22 aa, Staphylococcus
NHEPENVGAGKSNLPGNPIERQ

SEQ ID NO: 1968141 - protein, 10 aa, Staphylococcus
NHEPLPEKMP

SEQ ID NO: 1968142 - protein, 8 aa, Staphylococcus
NHEPSGPI

SEQ ID NO: 1968143 - protein, 5 aa, Staphylococcus
NHEQT

SEQ ID NO: 1968144 - protein, 6 aa, Staphylococcus
NHESEA

SEQ ID NO: 1968145 - protein, 7 aa, Staphylococcus
NHESEHN

SEQ ID NO: 1968146 - protein, 5 aa, Staphylococcus
NHETP

SEQ ID NO: 1968147 - protein, 4 aa, Staphylococcus
NHEY

SEQ ID NO: 1968148 - protein, 11 aa, Staphylococcus
NHFKDGKKHKE

SEQ ID NO: 1968149 - protein, 6 aa, Staphylococcus
NHGDYS

SEQ ID NO: 1968150 - protein, 7 aa, Staphylococcus
NHGGRTH

SEQ ID NO: 1968151 - protein, 11 aa, Staphylococcus
NHGKPLPDSTL

SEQ ID NO: 1968152 - protein, 7 aa, Staphylococcus
NHGREAD

SEQ ID NO: 1968153 - protein, 5 aa, Staphylococcus
NHGSI

SEQ ID NO: 1968154 - protein, 4 aa, Staphylococcus
NHHH

SEQ ID NO: 1968155 - protein, 5 aa, Staphylococcus
NHHQG

SEQ ID NO: 1968156 - protein, 11 aa, Staphylococcus
NHIGSTTEGTI

SEQ ID NO: 1968157 - protein, 13 aa, Staphylococcus
NHIQTDRKKPAID

SEQ ID NO: 1968158 - protein, 22 aa, Staphylococcus
NHKDINKKLSNEDAYKRARPTH

SEQ ID NO: 1968159 - protein, 10 aa, Staphylococcus
NHKEYKEERG

SEQ ID NO: 1968160 - protein, 9 aa, Staphylococcus
NHKLTDKQL

SEQ ID NO: 1968161 - protein, 4 aa, Staphylococcus
NHKS

SEQ ID NO: 1968162 - protein, 9 aa, Staphylococcus
NHKSDDEWR

SEQ ID NO: 1968163 - protein, 6 aa, Staphylococcus
NHKSNN

SEQ ID NO: 1968164 - protein, 4 aa, Staphylococcus
NHKT

SEQ ID NO: 1968165 - protein, 5 aa, Staphylococcus
NHKTD

SEQ ID NO: 1968166 - protein, 12 aa, Staphylococcus
NHLADDGSTFWD

SEQ ID NO: 1968167 - protein, 12 aa, Staphylococcus
NHLKDDGTTFWD

SEQ ID NO: 1968168 - protein, 46 aa, Staphylococcus
NHLNGGGAQAATASNESAAASTSEDTSAVQTQSVPEGDFPETTEKI

SEQ ID NO: 1968169 - protein, 4 aa, Staphylococcus
NHLP

SEQ ID NO: 1968170 - protein, 4 aa, Staphylococcus
NHLR

SEQ ID NO: 1968171 - protein, 7 aa, Staphylococcus
NHLRNSG

SEQ ID NO: 1968172 - protein, 12 aa, Staphylococcus
NHLSANKRKVNT

SEQ ID NO: 1968173 - protein, 10 aa, Staphylococcus
NHLTGYGGGI

SEQ ID NO: 1968174 - protein, 4 aa, Staphylococcus
NHMA

SEQ ID NO: 1968175 - protein, 4 aa, Staphylococcus
NHMD

SEQ ID NO: 1968176 - protein, 5 aa, Staphylococcus
NHMEN

SEQ ID NO: 1968177 - protein, 7 aa, Staphylococcus
NHNDATF

SEQ ID NO: 1968178 - protein, 8 aa, Staphylococcus
NHNDLDEE

SEQ ID NO: 1968179 - protein, 4 aa, Staphylococcus
NHNE

SEQ ID NO: 1968180 - protein, 14 aa, Staphylococcus
NHNEKGDRLFFVAY

SEQ ID NO: 1968181 - protein, 5 aa, Staphylococcus
NHNET

SEQ ID NO: 1968182 - protein, 4 aa, Staphylococcus
NHNG

SEQ ID NO: 1968183 - protein, 20 aa, Staphylococcus
NHNKDHTYTPLPNKNIDTGM

SEQ ID NO: 1968184 - protein, 18 aa, Staphylococcus
NHNKSTYADFKTTDDPTI

SEQ ID NO: 1968185 - protein, 9 aa, Staphylococcus
NHNPGNHSG

SEQ ID NO: 1968186 - protein, 8 aa, Staphylococcus
NHNPTKDD

SEQ ID NO: 1968187 - protein, 13 aa, Staphylococcus
NHNPYINKDNQSL

SEQ ID NO: 1968188 - protein, 8 aa, Staphylococcus
NHNSKPSL

SEQ ID NO: 1968189 - protein, 4 aa, Staphylococcus
NHPA

SEQ ID NO: 1968190 - protein, 6 aa, Staphylococcus
NHPDNL

SEQ ID NO: 1968191 - protein, 4 aa, Staphylococcus
NHPE

SEQ ID NO: 1968192 - protein, 12 aa, Staphylococcus
NHPEKQEDHYNN

SEQ ID NO: 1968193 - protein, 7 aa, Staphylococcus
NHPESEP

SEQ ID NO: 1968194 - protein, 18 aa, Staphylococcus
NHPKQDITIEEDSEDLDG

SEQ ID NO: 1968195 - protein, 7 aa, Staphylococcus
NHPQQET

SEQ ID NO: 1968196 - protein, 14 aa, Staphylococcus
NHPTVKKDGLRVTA

SEQ ID NO: 1968197 - protein, 4 aa, Staphylococcus
NHQG

SEQ ID NO: 1968198 - protein, 8 aa, Staphylococcus
NHQITPDS

SEQ ID NO: 1968199 - protein, 7 aa, Staphylococcus
NHQKKGI

SEQ ID NO: 1968200 - protein, 4 aa, Staphylococcus
NHQP

SEQ ID NO: 1968201 - protein, 7 aa, Staphylococcus
NHQPARS

SEQ ID NO: 1968202 - protein, 9 aa, Staphylococcus
NHQQPNGSE

SEQ ID NO: 1968203 - protein, 9 aa, Staphylococcus
NHQSESQEF

SEQ ID NO: 1968204 - protein, 7 aa, Staphylococcus
NHQSGKE

SEQ ID NO: 1968205 - protein, 6 aa, Staphylococcus
NHQSYD

SEQ ID NO: 1968206 - protein, 6 aa, Staphylococcus
NHQTTA

SEQ ID NO: 1968207 - protein, 7 aa, Staphylococcus
NHRDEQW

SEQ ID NO: 1968208 - protein, 11 aa, Staphylococcus
NHRDKEWKRYS

SEQ ID NO: 1968209 - protein, 12 aa, Staphylococcus
NHRDSEWNRHSS

SEQ ID NO: 1968210 - protein, 7 aa, Staphylococcus
NHRENTS

SEQ ID NO: 1968211 - protein, 7 aa, Staphylococcus
NHRESME

SEQ ID NO: 1968212 - protein, 6 aa, Staphylococcus
NHRKDE

SEQ ID NO: 1968213 - protein, 6 aa, Staphylococcus
NHRRSL

SEQ ID NO: 1968214 - protein, 6 aa, Staphylococcus
NHSAQH

SEQ ID NO: 1968215 - protein, 4 aa, Staphylococcus
NHSD

SEQ ID NO: 1968216 - protein, 23 aa, Staphylococcus
NHSDLDGSETVVSGASCTTNSLA

SEQ ID NO: 1968217 - protein, 6 aa, Staphylococcus
NHSDSD

SEQ ID NO: 1968218 - protein, 6 aa, Staphylococcus
NHSEGL

SEQ ID NO: 1968219 - protein, 16 aa, Staphylococcus
NHSESRDHVMSEFKAM

SEQ ID NO: 1968220 - protein, 7 aa, Staphylococcus
NHSEVNE

SEQ ID NO: 1968221 - protein, 5 aa, Staphylococcus
NHSGP

SEQ ID NO: 1968222 - protein, 17 aa, Staphylococcus
NHSHAKAAKAVEEGKFD

SEQ ID NO: 1968223 - protein, 9 aa, Staphylococcus
NHSNQTEQI

SEQ ID NO: 1968224 - protein, 5 aa, Staphylococcus
NHSPN

SEQ ID NO: 1968225 - protein, 9 aa, Staphylococcus
NHSPTTGSI

SEQ ID NO: 1968226 - protein, 5 aa, Staphylococcus
NHSSY

SEQ ID NO: 1968227 - protein, 11 aa, Staphylococcus
NHSSYQQERGV

SEQ ID NO: 1968228 - protein, 7 aa, Staphylococcus
NHSTETV

SEQ ID NO: 1968229 - protein, 10 aa, Staphylococcus
NHSTSSSHYQ

SEQ ID NO: 1968230 - protein, 14 aa, Staphylococcus
NHTENGYRLFFIAK

SEQ ID NO: 1968231 - protein, 6 aa, Staphylococcus
NHTESG

SEQ ID NO: 1968232 - protein, 6 aa, Staphylococcus
NHTGNG

SEQ ID NO: 1968233 - protein, 7 aa, Staphylococcus
NHTKSTD

SEQ ID NO: 1968234 - protein, 5 aa, Staphylococcus
NHTNE

SEQ ID NO: 1968235 - protein, 5 aa, Staphylococcus
NHTNV

SEQ ID NO: 1968236 - protein, 23 aa, Staphylococcus
NHTPLDQLPDGSIIGTSSLRRGA

SEQ ID NO: 1968237 - protein, 7 aa, Staphylococcus
NHTPSIE

SEQ ID NO: 1968238 - protein, 6 aa, Staphylococcus
NHTPTP

SEQ ID NO: 1968239 - protein, 5 aa, Staphylococcus
NHTSK

SEQ ID NO: 1968240 - protein, 8 aa, Staphylococcus
NHTTDNPR

SEQ ID NO: 1968241 - protein, 12 aa, Staphylococcus
NHTTGRAQMTKT

SEQ ID NO: 1968242 - protein, 12 aa, Staphylococcus
NHTTGRKEMTKT

SEQ ID NO: 1968243 - protein, 5 aa, Staphylococcus
NHVDT

SEQ ID NO: 1968244 - protein, 5 aa, Staphylococcus
NHVGQ

SEQ ID NO: 1968245 - protein, 11 aa, Staphylococcus
NHYDNKKIEQQ

SEQ ID NO: 1968246 - protein, 10 aa, Staphylococcus
NHYKPSPDGI

SEQ ID NO: 1968247 - protein, 4 aa, Staphylococcus
NHYT

SEQ ID NO: 1968248 - protein, 5 aa, Staphylococcus
NIAEG

SEQ ID NO: 1968249 - protein, 11 aa, Staphylococcus
NIAELSGGQQQ

SEQ ID NO: 1968250 - protein, 4 aa, Staphylococcus
NIDA

SEQ ID NO: 1968251 - protein, 5 aa, Staphylococcus
NIDAK

SEQ ID NO: 1968252 - protein, 7 aa, Staphylococcus
NIDDRNS

SEQ ID NO: 1968253 - protein, 9 aa, Staphylococcus
NIDEGTEVI

SEQ ID NO: 1968254 - protein, 5 aa, Staphylococcus
NIDEN

SEQ ID NO: 1968255 - protein, 4 aa, Staphylococcus
NIDF

SEQ ID NO: 1968256 - protein, 22 aa, Staphylococcus
NIDGAKDIDDVTKDVIDILDQL

SEQ ID NO: 1968257 - protein, 22 aa, Staphylococcus
NIDGAKDIDEVTKDVIDILDQL

SEQ ID NO: 1968258 - protein, 21 aa, Staphylococcus
NIDGSKDIEEVTNDVIDILDH

SEQ ID NO: 1968259 - protein, 22 aa, Staphylococcus
NIDGSKDIEEVTTDVIDILDQL

SEQ ID NO: 1968260 - protein, 8 aa, Staphylococcus
NIDGSRDI

SEQ ID NO: 1968261 - protein, 6 aa, Staphylococcus
NIDKES

SEQ ID NO: 1968262 - protein, 6 aa, Staphylococcus
NIDKKD

SEQ ID NO: 1968263 - protein, 6 aa, Staphylococcus
NIDKQG

SEQ ID NO: 1968264 - protein, 11 aa, Staphylococcus
NIDNETTSHHL

SEQ ID NO: 1968265 - protein, 11 aa, Staphylococcus
NIDPRRRGETL

SEQ ID NO: 1968266 - protein, 10 aa, Staphylococcus
NIDRGRDDVD

SEQ ID NO: 1968267 - protein, 11 aa, Staphylococcus
NIDRGRDDVDE

SEQ ID NO: 1968268 - protein, 16 aa, Staphylococcus
NIDSRVNDALTSPNDD

SEQ ID NO: 1968269 - protein, 13 aa, Staphylococcus
NIDTDELNQAYTN

SEQ ID NO: 1968270 - protein, 13 aa, Staphylococcus
NIDTDQLNQAYSE

SEQ ID NO: 1968271 - protein, 6 aa, Staphylococcus
NIDTEN

SEQ ID NO: 1968272 - protein, 12 aa, Staphylococcus
NIDTSVETKAQQ

SEQ ID NO: 1968273 - protein, 5 aa, Staphylococcus
NIDTY

SEQ ID NO: 1968274 - protein, 5 aa, Staphylococcus
NIEAA

SEQ ID NO: 1968275 - protein, 6 aa, Staphylococcus
NIEDAN

SEQ ID NO: 1968276 - protein, 11 aa, Staphylococcus
NIEDNDDVGTM

SEQ ID NO: 1968277 - protein, 11 aa, Staphylococcus
NIEDSEQQLQS

SEQ ID NO: 1968278 - protein, 9 aa, Staphylococcus
NIEEDAKKA

SEQ ID NO: 1968279 - protein, 11 aa, Staphylococcus
NIEEDDNVGTM

SEQ ID NO: 1968280 - protein, 10 aa, Staphylococcus
NIEEDSANRR

SEQ ID NO: 1968281 - protein, 6 aa, Staphylococcus
NIEENA

SEQ ID NO: 1968282 - protein, 9 aa, Staphylococcus
NIEESPDFG

SEQ ID NO: 1968283 - protein, 5 aa, Staphylococcus
NIEGE

SEQ ID NO: 1968284 - protein, 11 aa, Staphylococcus
NIEGTSGRQLY

SEQ ID NO: 1968285 - protein, 18 aa, Staphylococcus
NIEKENNNKMSKQRKKLS

SEQ ID NO: 1968286 - protein, 7 aa, Staphylococcus
NIEKEVP

SEQ ID NO: 1968287 - protein, 26 aa, Staphylococcus
NIEKNSDDLLNKGKDKAKDLNTEENR

SEQ ID NO: 1968288 - protein, 6 aa, Staphylococcus
NIELDT

SEQ ID NO: 1968289 - protein, 5 aa, Staphylococcus
NIENE

SEQ ID NO: 1968290 - protein, 6 aa, Staphylococcus
NIENSI

SEQ ID NO: 1968291 - protein, 4 aa, Staphylococcus
NIEP

SEQ ID NO: 1968292 - protein, 22 aa, Staphylococcus
NIEQAVERAGTKAGNKGAEAAV

SEQ ID NO: 1968293 - protein, 7 aa, Staphylococcus
NIEQDKQ

SEQ ID NO: 1968294 - protein, 10 aa, Staphylococcus
NIEQHPNADV

SEQ ID NO: 1968295 - protein, 4 aa, Staphylococcus
NIES

SEQ ID NO: 1968296 - protein, 6 aa, Staphylococcus
NIESKY

SEQ ID NO: 1968297 - protein, 6 aa, Staphylococcus
NIESSD

SEQ ID NO: 1968298 - protein, 6 aa, Staphylococcus
NIESTN

SEQ ID NO: 1968299 - protein, 6 aa, Staphylococcus
NIETGE

SEQ ID NO: 1968300 - protein, 11 aa, Staphylococcus
NIETGEVTTQA

SEQ ID NO: 1968301 - protein, 5 aa, Staphylococcus
NIETP

SEQ ID NO: 1968302 - protein, 6 aa, Staphylococcus
NIETTD

SEQ ID NO: 1968303 - protein, 6 aa, Staphylococcus
NIETYN

SEQ ID NO: 1968304 - protein, 7 aa, Staphylococcus
NIETYNP

SEQ ID NO: 1968305 - protein, 4 aa, Staphylococcus
NIEV

SEQ ID NO: 1968306 - protein, 4 aa, Staphylococcus
NIEY

SEQ ID NO: 1968307 - protein, 6 aa, Staphylococcus
NIGAPY

SEQ ID NO: 1968308 - protein, 5 aa, Staphylococcus
NIGEI

SEQ ID NO: 1968309 - protein, 8 aa, Staphylococcus
NIGGEAKD

SEQ ID NO: 1968310 - protein, 6 aa, Staphylococcus
NIGGRQ

SEQ ID NO: 1968311 - protein, 5 aa, Staphylococcus
NIGND

SEQ ID NO: 1968312 - protein, 13 aa, Staphylococcus
NIGNSAVSSSIEA

SEQ ID NO: 1968313 - protein, 7 aa, Staphylococcus
NIGNSTA

SEQ ID NO: 1968314 - protein, 14 aa, Staphylococcus
NIGNSVVSSSIEAE

SEQ ID NO: 1968315 - protein, 11 aa, Staphylococcus
NIHPKKEYERR

SEQ ID NO: 1968316 - protein, 7 aa, Staphylococcus
NIHPKSE

SEQ ID NO: 1968317 - protein, 4 aa, Staphylococcus
NIIP

SEQ ID NO: 1968318 - protein, 12 aa, Staphylococcus
NIIPNSTGAAKA

SEQ ID NO: 1968319 - protein, 4 aa, Staphylococcus
NIKA

SEQ ID NO: 1968320 - protein, 6 aa, Staphylococcus
NIKAGD

SEQ ID NO: 1968321 - protein, 11 aa, Staphylococcus
NIKDENEVKNI

SEQ ID NO: 1968322 - protein, 17 aa, Staphylococcus
NIKDNRIGQTNQRQPLG

SEQ ID NO: 1968323 - protein, 5 aa, Staphylococcus
NIKDY

SEQ ID NO: 1968324 - protein, 49 aa, Staphylococcus
NIKETVGNATDNKDLEKEGQGDKASGKAKEVVDNVKDKANDVIDKLKGD

SEQ ID NO: 1968325 - protein, 4 aa, Staphylococcus
NIKG

SEQ ID NO: 1968326 - protein, 8 aa, Staphylococcus
NIKGDKTS

SEQ ID NO: 1968327 - protein, 6 aa, Staphylococcus
NIKGKD

SEQ ID NO: 1968328 - protein, 13 aa, Staphylococcus
NIKGNSEETSSIS

SEQ ID NO: 1968329 - protein, 13 aa, Staphylococcus
NIKGNSEETSTVS

SEQ ID NO: 1968330 - protein, 5 aa, Staphylococcus
NIKKE

SEQ ID NO: 1968331 - protein, 5 aa, Staphylococcus
NIKNE

SEQ ID NO: 1968332 - protein, 8 aa, Staphylococcus
NIKNQASQ

SEQ ID NO: 1968333 - protein, 9 aa, Staphylococcus
NIKPGGTIT

SEQ ID NO: 1968334 - protein, 6 aa, Staphylococcus
NIKPKA

SEQ ID NO: 1968335 - protein, 11 aa, Staphylococcus
NIKQEQPLKIG

SEQ ID NO: 1968336 - protein, 8 aa, Staphylococcus
NIKREDVK

SEQ ID NO: 1968337 - protein, 10 aa, Staphylococcus
NIKSDSEIEK

SEQ ID NO: 1968338 - protein, 8 aa, Staphylococcus
NIKSEDED

SEQ ID NO: 1968339 - protein, 6 aa, Staphylococcus
NIKSGQ

SEQ ID NO: 1968340 - protein, 11 aa, Staphylococcus
NIKSKNKNTPL

SEQ ID NO: 1968341 - protein, 7 aa, Staphylococcus
NIKSRND

SEQ ID NO: 1968342 - protein, 4 aa, Staphylococcus
NIKT

SEQ ID NO: 1968343 - protein, 4 aa, Staphylococcus
NIKV

SEQ ID NO: 1968344 - protein, 42 aa, Staphylococcus
NILSNTKKIETDNIDSKEDIITPKASKKNEQKQSIFSKLFKK

SEQ ID NO: 1968345 - protein, 6 aa, Staphylococcus
NINAPG

SEQ ID NO: 1968346 - protein, 4 aa, Staphylococcus
NIND

SEQ ID NO: 1968347 - protein, 6 aa, Staphylococcus
NINDDR

SEQ ID NO: 1968348 - protein, 6 aa, Staphylococcus
NINDTH

SEQ ID NO: 1968349 - protein, 19 aa, Staphylococcus
NINEDGYASTTLRNDEGEK

SEQ ID NO: 1968350 - protein, 8 aa, Staphylococcus
NINEGGYG

SEQ ID NO: 1968351 - protein, 7 aa, Staphylococcus
NINGKPL

SEQ ID NO: 1968352 - protein, 19 aa, Staphylococcus
NINKDNGTATIKPSTLNGA

SEQ ID NO: 1968353 - protein, 6 aa, Staphylococcus
NINKVE

SEQ ID NO: 1968354 - protein, 4 aa, Staphylococcus
NINN

SEQ ID NO: 1968355 - protein, 9 aa, Staphylococcus
NINNDERKK

SEQ ID NO: 1968356 - protein, 11 aa, Staphylococcus
NINNKSVDLGN

SEQ ID NO: 1968357 - protein, 7 aa, Staphylococcus
NINPNIK

SEQ ID NO: 1968358 - protein, 5 aa, Staphylococcus
NINQQ

SEQ ID NO: 1968359 - protein, 9 aa, Staphylococcus
NINSLEQSS

SEQ ID NO: 1968360 - protein, 7 aa, Staphylococcus
NINSPGQ

SEQ ID NO: 1968361 - protein, 18 aa, Staphylococcus
NINSPSGNAYKAISYVKQ

SEQ ID NO: 1968362 - protein, 7 aa, Staphylococcus
NINTENN

SEQ ID NO: 1968363 - protein, 10 aa, Staphylococcus
NINTSESYHG

SEQ ID NO: 1968364 - protein, 10 aa, Staphylococcus
NINTYNETEV

SEQ ID NO: 1968365 - protein, 8 aa, Staphylococcus
NINYEDKT

SEQ ID NO: 1968366 - protein, 5 aa, Staphylococcus
NINYP

SEQ ID NO: 1968367 - protein, 16 aa, Staphylococcus
NINYQDDLNTLLHQIN

SEQ ID NO: 1968368 - protein, 20 aa, Staphylococcus
NIPEESNNDAQAGMGGMPGM

SEQ ID NO: 1968369 - protein, 8 aa, Staphylococcus
NIPEKNEK

SEQ ID NO: 1968370 - protein, 20 aa, Staphylococcus
NIPEPESNNQPPMGGGMPGM

SEQ ID NO: 1968371 - protein, 9 aa, Staphylococcus
NIPESEHDD

SEQ ID NO: 1968372 - protein, 5 aa, Staphylococcus
NIPFD

SEQ ID NO: 1968373 - protein, 11 aa, Staphylococcus
NIPGDKGIEQV

SEQ ID NO: 1968374 - protein, 7 aa, Staphylococcus
NIPGEGN

SEQ ID NO: 1968375 - protein, 4 aa, Staphylococcus
NIPH

SEQ ID NO: 1968376 - protein, 5 aa, Staphylococcus
NIPKD

SEQ ID NO: 1968377 - protein, 7 aa, Staphylococcus
NIPKDKQ

SEQ ID NO: 1968378 - protein, 12 aa, Staphylococcus
NIPKDTSKDEME

SEQ ID NO: 1968379 - protein, 8 aa, Staphylococcus
NIPKETLD

SEQ ID NO: 1968380 - protein, 13 aa, Staphylococcus
NIPNGASLSSSAS

SEQ ID NO: 1968381 - protein, 5 aa, Staphylococcus
NIPNW

SEQ ID NO: 1968382 - protein, 4 aa, Staphylococcus
NIPP

SEQ ID NO: 1968383 - protein, 10 aa, Staphylococcus
NIPPDNGADI

SEQ ID NO: 1968384 - protein, 7 aa, Staphylococcus
NIPPTNN

SEQ ID NO: 1968385 - protein, 5 aa, Staphylococcus
NIPQG

SEQ ID NO: 1968386 - protein, 6 aa, Staphylococcus
NIPQGR

SEQ ID NO: 1968387 - protein, 6 aa, Staphylococcus
NIPQQF

SEQ ID NO: 1968388 - protein, 5 aa, Staphylococcus
NIPRE

SEQ ID NO: 1968389 - protein, 15 aa, Staphylococcus
NIPSDQEAMDVGPKT

SEQ ID NO: 1968390 - protein, 8 aa, Staphylococcus
NIPSQKDK

SEQ ID NO: 1968391 - protein, 6 aa, Staphylococcus
NIPSSD

SEQ ID NO: 1968392 - protein, 9 aa, Staphylococcus
NIPTARDEA

SEQ ID NO: 1968393 - protein, 9 aa, Staphylococcus
NIPTARDES

SEQ ID NO: 1968394 - protein, 10 aa, Staphylococcus
NIPTARDESV

SEQ ID NO: 1968395 - protein, 7 aa, Staphylococcus
NIPTGEI

SEQ ID NO: 1968396 - protein, 9 aa, Staphylococcus
NIPTKQAPK

SEQ ID NO: 1968397 - protein, 10 aa, Staphylococcus
NIPTPKYGRP

SEQ ID NO: 1968398 - protein, 4 aa, Staphylococcus
NIQE

SEQ ID NO: 1968399 - protein, 19 aa, Staphylococcus
NIQEGSQPYPKVTKEPLKP

SEQ ID NO: 1968400 - protein, 11 aa, Staphylococcus
NIQGKRYDSDI

SEQ ID NO: 1968401 - protein, 11 aa, Staphylococcus
NIQHQSTKEVA

SEQ ID NO: 1968402 - protein, 7 aa, Staphylococcus
NIQNAQD

SEQ ID NO: 1968403 - protein, 9 aa, Staphylococcus
NIQNSPDFG

SEQ ID NO: 1968404 - protein, 7 aa, Staphylococcus
NIQPDKA

SEQ ID NO: 1968405 - protein, 8 aa, Staphylococcus
NIQPSNEG

SEQ ID NO: 1968406 - protein, 6 aa, Staphylococcus
NIQSTD

SEQ ID NO: 1968407 - protein, 6 aa, Staphylococcus
NIQTST

SEQ ID NO: 1968408 - protein, 6 aa, Staphylococcus
NIQTYT

SEQ ID NO: 1968409 - protein, 18 aa, Staphylococcus
NIRESEDSELIDNPSDKL

SEQ ID NO: 1968410 - protein, 12 aa, Staphylococcus
NIRMSSDQAAQL

SEQ ID NO: 1968411 - protein, 10 aa, Staphylococcus
NIRPQKKGTT

SEQ ID NO: 1968412 - protein, 11 aa, Staphylococcus
NISAGRANSNL

SEQ ID NO: 1968413 - protein, 5 aa, Staphylococcus
NISDE

SEQ ID NO: 1968414 - protein, 18 aa, Staphylococcus
NISDEEKAKRLENFKELV

SEQ ID NO: 1968415 - protein, 19 aa, Staphylococcus
NISDEEKEKCLENFKETVQ

SEQ ID NO: 1968416 - protein, 6 aa, Staphylococcus
NISDRN

SEQ ID NO: 1968417 - protein, 7 aa, Staphylococcus
NISDTGW

SEQ ID NO: 1968418 - protein, 6 aa, Staphylococcus
NISELS

SEQ ID NO: 1968419 - protein, 19 aa, Staphylococcus
NISGALDDEVAKKVIELYQ

SEQ ID NO: 1968420 - protein, 5 aa, Staphylococcus
NISIG

SEQ ID NO: 1968421 - protein, 16 aa, Staphylococcus
NISKLSKSELRKKRQK

SEQ ID NO: 1968422 - protein, 9 aa, Staphylococcus
NISLTERGK

SEQ ID NO: 1968423 - protein, 4 aa, Staphylococcus
NISN

SEQ ID NO: 1968424 - protein, 7 aa, Staphylococcus
NISNKDV

SEQ ID NO: 1968425 - protein, 8 aa, Staphylococcus
NISQKEID

SEQ ID NO: 1968426 - protein, 16 aa, Staphylococcus
NISQLSKSDLRKKRQK

SEQ ID NO: 1968427 - protein, 8 aa, Staphylococcus
NISRGSVD

SEQ ID NO: 1968428 - protein, 6 aa, Staphylococcus
NISTTQ

SEQ ID NO: 1968429 - protein, 15 aa, Staphylococcus
NISYTEAMNNEDYRP

SEQ ID NO: 1968430 - protein, 9 aa, Staphylococcus
NITDEPEFS

SEQ ID NO: 1968431 - protein, 6 aa, Staphylococcus
NITEEE

SEQ ID NO: 1968432 - protein, 6 aa, Staphylococcus
NITERY

SEQ ID NO: 1968433 - protein, 6 aa, Staphylococcus
NITETI

SEQ ID NO: 1968434 - protein, 16 aa, Staphylococcus
NITGGFGSQGASTLTQ

SEQ ID NO: 1968435 - protein, 13 aa, Staphylococcus
NITKEEQIDYEII

SEQ ID NO: 1968436 - protein, 7 aa, Staphylococcus
NITKETH

SEQ ID NO: 1968437 - protein, 10 aa, Staphylococcus
NITKQDEPQQ

SEQ ID NO: 1968438 - protein, 11 aa, Staphylococcus
NITKTNKIEKG

SEQ ID NO: 1968439 - protein, 6 aa, Staphylococcus
NITNRD

SEQ ID NO: 1968440 - protein, 15 aa, Staphylococcus
NITPENIQGSQNPSI

SEQ ID NO: 1968441 - protein, 5 aa, Staphylococcus
NITPV

SEQ ID NO: 1968442 - protein, 5 aa, Staphylococcus
NITRK

SEQ ID NO: 1968443 - protein, 6 aa, Staphylococcus
NITRKK

SEQ ID NO: 1968444 - protein, 11 aa, Staphylococcus
NITRRTSGKFK

SEQ ID NO: 1968445 - protein, 14 aa, Staphylococcus
NITSKGGTTQAGLN

SEQ ID NO: 1968446 - protein, 14 aa, Staphylococcus
NITSNDKSTEIKHE

SEQ ID NO: 1968447 - protein, 6 aa, Staphylococcus
NITTKS

SEQ ID NO: 1968448 - protein, 9 aa, Staphylococcus
NIVTGDEPL

SEQ ID NO: 1968449 - protein, 5 aa, Staphylococcus
NIYPD

SEQ ID NO: 1968450 - protein, 4 aa, Staphylococcus
NIYS

SEQ ID NO: 1968451 - protein, 10 aa, Staphylococcus
NKAADNTDGI

SEQ ID NO: 1968452 - protein, 9 aa, Staphylococcus
NKAAKEMKA

SEQ ID NO: 1968453 - protein, 9 aa, Staphylococcus
NKAAKEMKE

SEQ ID NO: 1968454 - protein, 10 aa, Staphylococcus
NKAAKEMKQR

SEQ ID NO: 1968455 - protein, 14 aa, Staphylococcus
NKAARIKSSLMTAA

SEQ ID NO: 1968456 - protein, 10 aa, Staphylococcus
NKADETWGGI

SEQ ID NO: 1968457 - protein, 14 aa, Staphylococcus
NKADRIKSQLMSAD

SEQ ID NO: 1968458 - protein, 14 aa, Staphylococcus
NKADRIKSQLMSSS

SEQ ID NO: 1968459 - protein, 14 aa, Staphylococcus
NKADRIKSQLMTAN

SEQ ID NO: 1968460 - protein, 6 aa, Staphylococcus
NKAEDL

SEQ ID NO: 1968461 - protein, 7 aa, Staphylococcus
NKAEFPE

SEQ ID NO: 1968462 - protein, 8 aa, Staphylococcus
NKAELPEV

SEQ ID NO: 1968463 - protein, 7 aa, Staphylococcus
NKAGDTY

SEQ ID NO: 1968464 - protein, 9 aa, Staphylococcus
NKAGEPGTI

SEQ ID NO: 1968465 - protein, 7 aa, Staphylococcus
NKAGFDR

SEQ ID NO: 1968466 - protein, 8 aa, Staphylococcus
NKAGKSVA

SEQ ID NO: 1968467 - protein, 8 aa, Staphylococcus
NKAIEEGM

SEQ ID NO: 1968468 - protein, 9 aa, Staphylococcus
NKAIEGLPE

SEQ ID NO: 1968469 - protein, 7 aa, Staphylococcus
NKAIENE

SEQ ID NO: 1968470 - protein, 8 aa, Staphylococcus
NKAIENKM

SEQ ID NO: 1968471 - protein, 8 aa, Staphylococcus
NKAIKEGF

SEQ ID NO: 1968472 - protein, 7 aa, Staphylococcus
NKAKNIK

SEQ ID NO: 1968473 - protein, 8 aa, Staphylococcus
NKAKNSDI

SEQ ID NO: 1968474 - protein, 9 aa, Staphylococcus
NKAKTDAAF

SEQ ID NO: 1968475 - protein, 12 aa, Staphylococcus
NKANGVKLVIIR

SEQ ID NO: 1968476 - protein, 21 aa, Staphylococcus
NKAPEKIINEEKAKKHDYQEK

SEQ ID NO: 1968477 - protein, 33 aa, Staphylococcus
NKAPEKIINEEKEKQKHYKEKYDGVKARIEQLK

SEQ ID NO: 1968478 - protein, 22 aa, Staphylococcus
NKAPEKIINEEKEKQQHYQEKY

SEQ ID NO: 1968479 - protein, 33 aa, Staphylococcus
NKAPEKIINEEREKQQKYQEKYNGVKNRIEQLK

SEQ ID NO: 1968480 - protein, 33 aa, Staphylococcus
NKAPEKVINEEKEKQQRYQEKYDGVKNRIEQLK

SEQ ID NO: 1968481 - protein, 22 aa, Staphylococcus
NKAPEKVINEEREKKQTYQEKY

SEQ ID NO: 1968482 - protein, 6 aa, Staphylococcus
NKAPNV

SEQ ID NO: 1968483 - protein, 7 aa, Staphylococcus
NKAPRKA

SEQ ID NO: 1968484 - protein, 7 aa, Staphylococcus
NKAQNDL

SEQ ID NO: 1968485 - protein, 7 aa, Staphylococcus
NKAQNEL

SEQ ID NO: 1968486 - protein, 6 aa, Staphylococcus
NKAQPI

SEQ ID NO: 1968487 - protein, 8 aa, Staphylococcus
NKAQQLAT

SEQ ID NO: 1968488 - protein, 6 aa, Staphylococcus
NKAQQT

SEQ ID NO: 1968489 - protein, 19 aa, Staphylococcus
NKAQREKEAKRVKQMMQED

SEQ ID NO: 1968490 - protein, 15 aa, Staphylococcus
NKARKELSSDKLDEN

SEQ ID NO: 1968491 - protein, 15 aa, Staphylococcus
NKARKELSSDNLDDN

SEQ ID NO: 1968492 - protein, 6 aa, Staphylococcus
NKATHQ

SEQ ID NO: 1968493 - protein, 17 aa, Staphylococcus
NKATKDAEKAPYPSVEE

SEQ ID NO: 1968494 - protein, 10 aa, Staphylococcus
NKATNGGKIK

SEQ ID NO: 1968495 - protein, 18 aa, Staphylococcus
NKATVDTLEQQFLKEIQE

SEQ ID NO: 1968496 - protein, 12 aa, Staphylococcus
NKAVGGAYRPTV

SEQ ID NO: 1968497 - protein, 12 aa, Staphylococcus
NKAYFGKKDAQQ

SEQ ID NO: 1968498 - protein, 9 aa, Staphylococcus
NKAYSNTTK

SEQ ID NO: 1968499 - protein, 26 aa, Staphylococcus
NKCSQSQQKITNDYHHDGQSEDQALN

SEQ ID NO: 1968500 - protein, 9 aa, Staphylococcus
NKDAKADLT

SEQ ID NO: 1968501 - protein, 8 aa, Staphylococcus
NKDALASL

SEQ ID NO: 1968502 - protein, 5 aa, Staphylococcus
NKDAS

SEQ ID NO: 1968503 - protein, 11 aa, Staphylococcus
NKDDDQKYNEL

SEQ ID NO: 1968504 - protein, 5 aa, Staphylococcus
NKDDI

SEQ ID NO: 1968505 - protein, 19 aa, Staphylococcus
NKDDSITVEDNGRGMPTGI

SEQ ID NO: 1968506 - protein, 7 aa, Staphylococcus
NKDDVYA

SEQ ID NO: 1968507 - protein, 5 aa, Staphylococcus
NKDDY

SEQ ID NO: 1968508 - protein, 4 aa, Staphylococcus
NKDE

SEQ ID NO: 1968509 - protein, 20 aa, Staphylococcus
NKDEDITGYTEEERNNNVES

SEQ ID NO: 1968510 - protein, 9 aa, Staphylococcus
NKDEEAFNR

SEQ ID NO: 1968511 - protein, 9 aa, Staphylococcus
NKDEEGKFT

SEQ ID NO: 1968512 - protein, 8 aa, Staphylococcus
NKDEEGRF

SEQ ID NO: 1968513 - protein, 7 aa, Staphylococcus
NKDEGKY

SEQ ID NO: 1968514 - protein, 22 aa, Staphylococcus
NKDEKAFNEYTTEYKNLEAFLS

SEQ ID NO: 1968515 - protein, 6 aa, Staphylococcus
NKDESI

SEQ ID NO: 1968516 - protein, 7 aa, Staphylococcus
NKDESVE

SEQ ID NO: 1968517 - protein, 14 aa, Staphylococcus
NKDFGEENVIGPND

SEQ ID NO: 1968518 - protein, 7 aa, Staphylococcus
NKDFKQK

SEQ ID NO: 1968519 - protein, 34 aa, Staphylococcus
NKDFPKQEQPVPGLQSKLDPKPDCGETSYTGYGR

SEQ ID NO: 1968520 - protein, 7 aa, Staphylococcus
NKDGGQL

SEQ ID NO: 1968521 - protein, 18 aa, Staphylococcus
NKDHSYTPLPNKNIDTGM

SEQ ID NO: 1968522 - protein, 8 aa, Staphylococcus
NKDKEQAK

SEQ ID NO: 1968523 - protein, 9 aa, Staphylococcus
NKDKIDGSL

SEQ ID NO: 1968524 - protein, 9 aa, Staphylococcus
NKDKIEGSL

SEQ ID NO: 1968525 - protein, 16 aa, Staphylococcus
NKDKKIESLSKGNQQK

SEQ ID NO: 1968526 - protein, 9 aa, Staphylococcus
NKDKLDGKN

SEQ ID NO: 1968527 - protein, 18 aa, Staphylococcus
NKDKMSAQAVGGAVGSNP

SEQ ID NO: 1968528 - protein, 7 aa, Staphylococcus
NKDKQHT

SEQ ID NO: 1968529 - protein, 5 aa, Staphylococcus
NKDLE

SEQ ID NO: 1968530 - protein, 36 aa, Staphylococcus
NKDLEQEGKEDKASGKAKEVTENAKDKVNDFIDKLK

SEQ ID NO: 1968531 - protein, 5 aa, Staphylococcus
NKDLK

SEQ ID NO: 1968532 - protein, 11 aa, Staphylococcus
NKDLKRSLTSQ

SEQ ID NO: 1968533 - protein, 7 aa, Staphylococcus
NKDLQEL

SEQ ID NO: 1968534 - protein, 6 aa, Staphylococcus
NKDNDL

SEQ ID NO: 1968535 - protein, 7 aa, Staphylococcus
NKDNHDE

SEQ ID NO: 1968536 - protein, 5 aa, Staphylococcus
NKDNI

SEQ ID NO: 1968537 - protein, 100 aa, Staphylococcus
NKDNRFNNNYSTYAQYNNGYSNNTSSNNYSSYSNYNTANNNYSNYSSYNNNNAGSTPRTGGMGATYSTSDNNVKVSTTSAPSTSSNTMSSRTSSGANYYT

SEQ ID NO: 1968538 - protein, 7 aa, Staphylococcus
NKDNRTA

SEQ ID NO: 1968539 - protein, 7 aa, Staphylococcus
NKDPETK

SEQ ID NO: 1968540 - protein, 8 aa, Staphylococcus
NKDQLEGK

SEQ ID NO: 1968541 - protein, 7 aa, Staphylococcus
NKDSIDV

SEQ ID NO: 1968542 - protein, 9 aa, Staphylococcus
NKDSKDTVL

SEQ ID NO: 1968543 - protein, 6 aa, Staphylococcus
NKDSNI

SEQ ID NO: 1968544 - protein, 5 aa, Staphylococcus
NKDTD

SEQ ID NO: 1968545 - protein, 9 aa, Staphylococcus
NKDTKDLKT

SEQ ID NO: 1968546 - protein, 5 aa, Staphylococcus
NKDTL

SEQ ID NO: 1968547 - protein, 8 aa, Staphylococcus
NKDTTKSI

SEQ ID NO: 1968548 - protein, 4 aa, Staphylococcus
NKDV

SEQ ID NO: 1968549 - protein, 7 aa, Staphylococcus
NKDYPKW

SEQ ID NO: 1968550 - protein, 8 aa, Staphylococcus
NKDYSNQH

SEQ ID NO: 1968551 - protein, 8 aa, Staphylococcus
NKDYYNPK

SEQ ID NO: 1968552 - protein, 9 aa, Staphylococcus
NKEAEEKLA

SEQ ID NO: 1968553 - protein, 33 aa, Staphylococcus
NKEAKAKKQADKLSEKLAKDGKEIKKAIGKDNT

SEQ ID NO: 1968554 - protein, 7 aa, Staphylococcus
NKEATLR

SEQ ID NO: 1968555 - protein, 8 aa, Staphylococcus
NKEDALDA

SEQ ID NO: 1968556 - protein, 18 aa, Staphylococcus
NKEDENEETLKVPQEQPF

SEQ ID NO: 1968557 - protein, 5 aa, Staphylococcus
NKEDI

SEQ ID NO: 1968558 - protein, 9 aa, Staphylococcus
NKEDINEGI

SEQ ID NO: 1968559 - protein, 5 aa, Staphylococcus
NKEDM

SEQ ID NO: 1968560 - protein, 9 aa, Staphylococcus
NKEDVSTHE

SEQ ID NO: 1968561 - protein, 5 aa, Staphylococcus
NKEEE

SEQ ID NO: 1968562 - protein, 17 aa, Staphylococcus
NKEEHSQQETQPDEHFG

SEQ ID NO: 1968563 - protein, 6 aa, Staphylococcus
NKEEVK

SEQ ID NO: 1968564 - protein, 12 aa, Staphylococcus
NKEFKDEDLGSV

SEQ ID NO: 1968565 - protein, 5 aa, Staphylococcus
NKEGK

SEQ ID NO: 1968566 - protein, 5 aa, Staphylococcus
NKEGN

SEQ ID NO: 1968567 - protein, 8 aa, Staphylococcus
NKEGQTKN

SEQ ID NO: 1968568 - protein, 6 aa, Staphylococcus
NKEGRV

SEQ ID NO: 1968569 - protein, 5 aa, Staphylococcus
NKEGT

SEQ ID NO: 1968570 - protein, 6 aa, Staphylococcus
NKEHGT

SEQ ID NO: 1968571 - protein, 12 aa, Staphylococcus
NKEHRNEGIAES

SEQ ID NO: 1968572 - protein, 13 aa, Staphylococcus
NKEHRQSGIAESA

SEQ ID NO: 1968573 - protein, 7 aa, Staphylococcus
NKEIAED

SEQ ID NO: 1968574 - protein, 7 aa, Staphylococcus
NKEIEGA

SEQ ID NO: 1968575 - protein, 7 aa, Staphylococcus
NKEISGL

SEQ ID NO: 1968576 - protein, 5 aa, Staphylococcus
NKEIT

SEQ ID NO: 1968577 - protein, 4 aa, Staphylococcus
NKEK

SEQ ID NO: 1968578 - protein, 14 aa, Staphylococcus
NKEKANEGKAEPVE

SEQ ID NO: 1968579 - protein, 15 aa, Staphylococcus
NKEKEAARISERNRL

SEQ ID NO: 1968580 - protein, 15 aa, Staphylococcus
NKEKERARVNERNRL

SEQ ID NO: 1968581 - protein, 6 aa, Staphylococcus
NKEKFN

SEQ ID NO: 1968582 - protein, 7 aa, Staphylococcus
NKEKIET

SEQ ID NO: 1968583 - protein, 9 aa, Staphylococcus
NKEKLDGKN

SEQ ID NO: 1968584 - protein, 9 aa, Staphylococcus
NKEKLSQEW

SEQ ID NO: 1968585 - protein, 8 aa, Staphylococcus
NKEKNTYK

SEQ ID NO: 1968586 - protein, 30 aa, Staphylococcus
NKEKSYANKWQKQSNVKERIAKKAASQIQS

SEQ ID NO: 1968587 - protein, 7 aa, Staphylococcus
NKEKTEA

SEQ ID NO: 1968588 - protein, 27 aa, Staphylococcus
NKEKTQEVFSTSEDTRSYRSGDRAKFE

SEQ ID NO: 1968589 - protein, 12 aa, Staphylococcus
NKEKVIYKDGTF

SEQ ID NO: 1968590 - protein, 8 aa, Staphylococcus
NKEKVQTL

SEQ ID NO: 1968591 - protein, 7 aa, Staphylococcus
NKEKYKQ

SEQ ID NO: 1968592 - protein, 7 aa, Staphylococcus
NKEKYSG

SEQ ID NO: 1968593 - protein, 8 aa, Staphylococcus
NKELEDAK

SEQ ID NO: 1968594 - protein, 10 aa, Staphylococcus
NKELESYGQH

SEQ ID NO: 1968595 - protein, 7 aa, Staphylococcus
NKELTQD

SEQ ID NO: 1968596 - protein, 9 aa, Staphylococcus
NKENNSDIV

SEQ ID NO: 1968597 - protein, 9 aa, Staphylococcus
NKENPITNY

SEQ ID NO: 1968598 - protein, 8 aa, Staphylococcus
NKENSEDE

SEQ ID NO: 1968599 - protein, 5 aa, Staphylococcus
NKENT

SEQ ID NO: 1968600 - protein, 6 aa, Staphylococcus
NKENVN

SEQ ID NO: 1968601 - protein, 5 aa, Staphylococcus
NKENY

SEQ ID NO: 1968602 - protein, 6 aa, Staphylococcus
NKEPDV

SEQ ID NO: 1968603 - protein, 7 aa, Staphylococcus
NKEPIHE

SEQ ID NO: 1968604 - protein, 7 aa, Staphylococcus
NKEPIHG

SEQ ID NO: 1968605 - protein, 6 aa, Staphylococcus
NKEPLF

SEQ ID NO: 1968606 - protein, 7 aa, Staphylococcus
NKEPLHE

SEQ ID NO: 1968607 - protein, 14 aa, Staphylococcus
NKEPLRYGENPQQD

SEQ ID NO: 1968608 - protein, 6 aa, Staphylococcus
NKEQEH

SEQ ID NO: 1968609 - protein, 5 aa, Staphylococcus
NKEQF

SEQ ID NO: 1968610 - protein, 9 aa, Staphylococcus
NKEQIQARQ

SEQ ID NO: 1968611 - protein, 6 aa, Staphylococcus
NKERIK

SEQ ID NO: 1968612 - protein, 9 aa, Staphylococcus
NKERLQTKA

SEQ ID NO: 1968613 - protein, 7 aa, Staphylococcus
NKESASL

SEQ ID NO: 1968614 - protein, 6 aa, Staphylococcus
NKESGL

SEQ ID NO: 1968615 - protein, 8 aa, Staphylococcus
NKESNIPL

SEQ ID NO: 1968616 - protein, 10 aa, Staphylococcus
NKESNITLSE

SEQ ID NO: 1968617 - protein, 8 aa, Staphylococcus
NKESTQTF

SEQ ID NO: 1968618 - protein, 4 aa, Staphylococcus
NKET

SEQ ID NO: 1968619 - protein, 12 aa, Staphylococcus
NKETEDPYDEDT

SEQ ID NO: 1968620 - protein, 8 aa, Staphylococcus
NKETGKVT

SEQ ID NO: 1968621 - protein, 11 aa, Staphylococcus
NKETISESTDF

SEQ ID NO: 1968622 - protein, 6 aa, Staphylococcus
NKETIT

SEQ ID NO: 1968623 - protein, 15 aa, Staphylococcus
NKETLRYGENPQQSA

SEQ ID NO: 1968624 - protein, 5 aa, Staphylococcus
NKETN

SEQ ID NO: 1968625 - protein, 6 aa, Staphylococcus
NKETYE

SEQ ID NO: 1968626 - protein, 9 aa, Staphylococcus
NKETYETNV

SEQ ID NO: 1968627 - protein, 4 aa, Staphylococcus
NKEV

SEQ ID NO: 1968628 - protein, 5 aa, Staphylococcus
NKEVK

SEQ ID NO: 1968629 - protein, 7 aa, Staphylococcus
NKEVKKD

SEQ ID NO: 1968630 - protein, 12 aa, Staphylococcus
NKEVQQLNHDEE

SEQ ID NO: 1968631 - protein, 13 aa, Staphylococcus
NKEVSDEIINFLW

SEQ ID NO: 1968632 - protein, 5 aa, Staphylococcus
NKEYN

SEQ ID NO: 1968633 - protein, 34 aa, Staphylococcus
NKFKDSDNEQVQKAKDKINEFTDGNDNKDKEDKK

SEQ ID NO: 1968634 - protein, 7 aa, Staphylococcus
NKFKSTL

SEQ ID NO: 1968635 - protein, 15 aa, Staphylococcus
NKFNRKSRMDESNWD

SEQ ID NO: 1968636 - protein, 16 aa, Staphylococcus
NKFNSTDEAKQQTESL

SEQ ID NO: 1968637 - protein, 20 aa, Staphylococcus
NKFRQDKTLQPSGGSRSSNI

SEQ ID NO: 1968638 - protein, 9 aa, Staphylococcus
NKFTENTRA

SEQ ID NO: 1968639 - protein, 11 aa, Staphylococcus
NKFTENTRAAY

SEQ ID NO: 1968640 - protein, 8 aa, Staphylococcus
NKFTESSK

SEQ ID NO: 1968641 - protein, 14 aa, Staphylococcus
NKGADGYEMKDVEP

SEQ ID NO: 1968642 - protein, 5 aa, Staphylococcus
NKGDK

SEQ ID NO: 1968643 - protein, 6 aa, Staphylococcus
NKGDKC

SEQ ID NO: 1968644 - protein, 16 aa, Staphylococcus
NKGDQFGYADQSKNTN

SEQ ID NO: 1968645 - protein, 4 aa, Staphylococcus
NKGE

SEQ ID NO: 1968646 - protein, 8 aa, Staphylococcus
NKGEKHPK

SEQ ID NO: 1968647 - protein, 9 aa, Staphylococcus
NKGEKNPRV

SEQ ID NO: 1968648 - protein, 5 aa, Staphylococcus
NKGEL

SEQ ID NO: 1968649 - protein, 8 aa, Staphylococcus
NKGEVEQL

SEQ ID NO: 1968650 - protein, 8 aa, Staphylococcus
NKGGCPKC

SEQ ID NO: 1968651 - protein, 5 aa, Staphylococcus
NKGGI

SEQ ID NO: 1968652 - protein, 31 aa, Staphylococcus
NKGGLPATGLEKKGKTRKKGTKVTFKPNPEI

SEQ ID NO: 1968653 - protein, 4 aa, Staphylococcus
NKGH

SEQ ID NO: 1968654 - protein, 7 aa, Staphylococcus
NKGHKEV

SEQ ID NO: 1968655 - protein, 10 aa, Staphylococcus
NKGHYNNKEV

SEQ ID NO: 1968656 - protein, 14 aa, Staphylococcus
NKGISAGRLSYEAG

SEQ ID NO: 1968657 - protein, 9 aa, Staphylococcus
NKGKRDAGV

SEQ ID NO: 1968658 - protein, 15 aa, Staphylococcus
NKGKRSGGYSSGAHL

SEQ ID NO: 1968659 - protein, 5 aa, Staphylococcus
NKGKV

SEQ ID NO: 1968660 - protein, 9 aa, Staphylococcus
NKGLEEVSE

SEQ ID NO: 1968661 - protein, 18 aa, Staphylococcus
NKGLENANQASPNQRTTV

SEQ ID NO: 1968662 - protein, 6 aa, Staphylococcus
NKGLKQ

SEQ ID NO: 1968663 - protein, 16 aa, Staphylococcus
NKGNNKYQVTGRISKT

SEQ ID NO: 1968664 - protein, 9 aa, Staphylococcus
NKGNSDGIE

SEQ ID NO: 1968665 - protein, 9 aa, Staphylococcus
NKGNSKIKG

SEQ ID NO: 1968666 - protein, 5 aa, Staphylococcus
NKGNT

SEQ ID NO: 1968667 - protein, 7 aa, Staphylococcus
NKGPRRV

SEQ ID NO: 1968668 - protein, 6 aa, Staphylococcus
NKGQAL

SEQ ID NO: 1968669 - protein, 12 aa, Staphylococcus
NKGQNGKKERKN

SEQ ID NO: 1968670 - protein, 6 aa, Staphylococcus
NKGQNT

SEQ ID NO: 1968671 - protein, 6 aa, Staphylococcus
NKGQQY

SEQ ID NO: 1968672 - protein, 13 aa, Staphylococcus
NKGQTKYLTKTKE

SEQ ID NO: 1968673 - protein, 4 aa, Staphylococcus
NKGR

SEQ ID NO: 1968674 - protein, 18 aa, Staphylococcus
NKGRGYALAEQNKTSDLP

SEQ ID NO: 1968675 - protein, 9 aa, Staphylococcus
NKGSEDFKE

SEQ ID NO: 1968676 - protein, 18 aa, Staphylococcus
NKGSKFDKQMYKLAQELS

SEQ ID NO: 1968677 - protein, 6 aa, Staphylococcus
NKGSMG

SEQ ID NO: 1968678 - protein, 6 aa, Staphylococcus
NKGTDN

SEQ ID NO: 1968679 - protein, 10 aa, Staphylococcus
NKGTEDFDEA

SEQ ID NO: 1968680 - protein, 9 aa, Staphylococcus
NKGTEDFKK

SEQ ID NO: 1968681 - protein, 6 aa, Staphylococcus
NKGTFD

SEQ ID NO: 1968682 - protein, 26 aa, Staphylococcus
NKGTYSSYVRPKAHSYTLSDEPLTQE

SEQ ID NO: 1968683 - protein, 7 aa, Staphylococcus
NKGYKEA

SEQ ID NO: 1968684 - protein, 15 aa, Staphylococcus
NKGYKEAFKANEPLS

SEQ ID NO: 1968685 - protein, 5 aa, Staphylococcus
NKGYN

SEQ ID NO: 1968686 - protein, 9 aa, Staphylococcus
NKGYSQQQI

SEQ ID NO: 1968687 - protein, 7 aa, Staphylococcus
NKGYSTN

SEQ ID NO: 1968688 - protein, 6 aa, Staphylococcus
NKHKLA

SEQ ID NO: 1968689 - protein, 6 aa, Staphylococcus
NKHKNI

SEQ ID NO: 1968690 - protein, 15 aa, Staphylococcus
NKHNTEALDQLYSLL

SEQ ID NO: 1968691 - protein, 5 aa, Staphylococcus
NKHNY

SEQ ID NO: 1968692 - protein, 15 aa, Staphylococcus
NKHNYKNDADIPADG

SEQ ID NO: 1968693 - protein, 7 aa, Staphylococcus
NKHPNYD

SEQ ID NO: 1968694 - protein, 5 aa, Staphylococcus
NKHPR

SEQ ID NO: 1968695 - protein, 10 aa, Staphylococcus
NKHQTAKQRI

SEQ ID NO: 1968696 - protein, 13 aa, Staphylococcus
NKHSAKLTQATAR

SEQ ID NO: 1968697 - protein, 6 aa, Staphylococcus
NKHSDA

SEQ ID NO: 1968698 - protein, 5 aa, Staphylococcus
NKIAA

SEQ ID NO: 1968699 - protein, 5 aa, Staphylococcus
NKIEK

SEQ ID NO: 1968700 - protein, 9 aa, Staphylococcus
NKIENKLES

SEQ ID NO: 1968701 - protein, 7 aa, Staphylococcus
NKIEPAE

SEQ ID NO: 1968702 - protein, 7 aa, Staphylococcus
NKIGADG

SEQ ID NO: 1968703 - protein, 14 aa, Staphylococcus
NKIGSATKNGLNNA

SEQ ID NO: 1968704 - protein, 6 aa, Staphylococcus
NKIKAS

SEQ ID NO: 1968705 - protein, 10 aa, Staphylococcus
NKIKHDKYKN

SEQ ID NO: 1968706 - protein, 8 aa, Staphylococcus
NKIKNKEK

SEQ ID NO: 1968707 - protein, 11 aa, Staphylococcus
NKIKYGNNTYY

SEQ ID NO: 1968708 - protein, 9 aa, Staphylococcus
NKINKQDLA

SEQ ID NO: 1968709 - protein, 10 aa, Staphylococcus
NKIPANKRTV

SEQ ID NO: 1968710 - protein, 7 aa, Staphylococcus
NKISGTY

SEQ ID NO: 1968711 - protein, 8 aa, Staphylococcus
NKISRQDM

SEQ ID NO: 1968712 - protein, 9 aa, Staphylococcus
NKISSDDFE

SEQ ID NO: 1968713 - protein, 14 aa, Staphylococcus
NKISSSTKSAFNNS

SEQ ID NO: 1968714 - protein, 6 aa, Staphylococcus
NKITEA

SEQ ID NO: 1968715 - protein, 6 aa, Staphylococcus
NKITKN

SEQ ID NO: 1968716 - protein, 5 aa, Staphylococcus
NKKAE

SEQ ID NO: 1968717 - protein, 15 aa, Staphylococcus
NKKAFDKGITTEEIA

SEQ ID NO: 1968718 - protein, 10 aa, Staphylococcus
NKKAGREITT

SEQ ID NO: 1968719 - protein, 8 aa, Staphylococcus
NKKAITKK

SEQ ID NO: 1968720 - protein, 7 aa, Staphylococcus
NKKAKMN

SEQ ID NO: 1968721 - protein, 6 aa, Staphylococcus
NKKALS

SEQ ID NO: 1968722 - protein, 8 aa, Staphylococcus
NKKAQLEQ

SEQ ID NO: 1968723 - protein, 11 aa, Staphylococcus
NKKASREVTTS

SEQ ID NO: 1968724 - protein, 6 aa, Staphylococcus
NKKATI

SEQ ID NO: 1968725 - protein, 7 aa, Staphylococcus
NKKDELC

SEQ ID NO: 1968726 - protein, 9 aa, Staphylococcus
NKKDSEGLF

SEQ ID NO: 1968727 - protein, 8 aa, Staphylococcus
NKKEAEDF

SEQ ID NO: 1968728 - protein, 24 aa, Staphylococcus
NKKEKTRNPANPFTTSTLQQEAAR

SEQ ID NO: 1968729 - protein, 24 aa, Staphylococcus
NKKEKTRNPTNPFTTSTLQQEAAR

SEQ ID NO: 1968730 - protein, 9 aa, Staphylococcus
NKKEQETEH

SEQ ID NO: 1968731 - protein, 8 aa, Staphylococcus
NKKETYEF

SEQ ID NO: 1968732 - protein, 5 aa, Staphylococcus
NKKEV

SEQ ID NO: 1968733 - protein, 7 aa, Staphylococcus
NKKEVTS

SEQ ID NO: 1968734 - protein, 12 aa, Staphylococcus
NKKFIRTADNTK

SEQ ID NO: 1968735 - protein, 4 aa, Staphylococcus
NKKG

SEQ ID NO: 1968736 - protein, 9 aa, Staphylococcus
NKKGETIQA

SEQ ID NO: 1968737 - protein, 13 aa, Staphylococcus
NKKGQPGEIVETT

SEQ ID NO: 1968738 - protein, 17 aa, Staphylococcus
NKKHQKPTQLNPEGGIL

SEQ ID NO: 1968739 - protein, 4 aa, Staphylococcus
NKKI

SEQ ID NO: 1968740 - protein, 15 aa, Staphylococcus
NKKINGDSKLTTLSE

SEQ ID NO: 1968741 - protein, 7 aa, Staphylococcus
NKKIPTI

SEQ ID NO: 1968742 - protein, 6 aa, Staphylococcus
NKKKQM

SEQ ID NO: 1968743 - protein, 15 aa, Staphylococcus
NKKKSKTKKVGKNES

SEQ ID NO: 1968744 - protein, 10 aa, Staphylococcus
NKKLKKYEKN

SEQ ID NO: 1968745 - protein, 8 aa, Staphylococcus
NKKLTKAS

SEQ ID NO: 1968746 - protein, 9 aa, Staphylococcus
NKKLTKASN

SEQ ID NO: 1968747 - protein, 5 aa, Staphylococcus
NKKNI

SEQ ID NO: 1968748 - protein, 12 aa, Staphylococcus
NKKNNSGINPDY

SEQ ID NO: 1968749 - protein, 8 aa, Staphylococcus
NKKNPDTL

SEQ ID NO: 1968750 - protein, 10 aa, Staphylococcus
NKKNYAKKPI

SEQ ID NO: 1968751 - protein, 9 aa, Staphylococcus
NKKPFEEQE

SEQ ID NO: 1968752 - protein, 9 aa, Staphylococcus
NKKPGRDNH

SEQ ID NO: 1968753 - protein, 6 aa, Staphylococcus
NKKPID

SEQ ID NO: 1968754 - protein, 4 aa, Staphylococcus
NKKQ

SEQ ID NO: 1968755 - protein, 9 aa, Staphylococcus
NKKQLAEDR

SEQ ID NO: 1968756 - protein, 5 aa, Staphylococcus
NKKQN

SEQ ID NO: 1968757 - protein, 7 aa, Staphylococcus
NKKQNDM

SEQ ID NO: 1968758 - protein, 8 aa, Staphylococcus
NKKSGPWL

SEQ ID NO: 1968759 - protein, 11 aa, Staphylococcus
NKKSIKKENGL

SEQ ID NO: 1968760 - protein, 12 aa, Staphylococcus
NKKSLPNTENSF

SEQ ID NO: 1968761 - protein, 10 aa, Staphylococcus
NKKSNKDHEH

SEQ ID NO: 1968762 - protein, 11 aa, Staphylococcus
NKKSTKWDSNF

SEQ ID NO: 1968763 - protein, 9 aa, Staphylococcus
NKKSYYNYE

SEQ ID NO: 1968764 - protein, 10 aa, Staphylococcus
NKKTFDEQNF

SEQ ID NO: 1968765 - protein, 7 aa, Staphylococcus
NKKTSIG

SEQ ID NO: 1968766 - protein, 10 aa, Staphylococcus
NKKTSYEDRY

SEQ ID NO: 1968767 - protein, 10 aa, Staphylococcus
NKKYDNPFDP

SEQ ID NO: 1968768 - protein, 9 aa, Staphylococcus
NKKYFESSK

SEQ ID NO: 1968769 - protein, 13 aa, Staphylococcus
NKKYKVSNNTFTG

SEQ ID NO: 1968770 - protein, 7 aa, Staphylococcus
NKKYRKY

SEQ ID NO: 1968771 - protein, 11 aa, Staphylococcus
NKLAKSDKEMM

SEQ ID NO: 1968772 - protein, 7 aa, Staphylococcus
NKLESND

SEQ ID NO: 1968773 - protein, 22 aa, Staphylococcus
NKLESNVNDAKNELASKNKEYQ

SEQ ID NO: 1968774 - protein, 18 aa, Staphylococcus
NKLGGKSNSGEGGENPKR

SEQ ID NO: 1968775 - protein, 5 aa, Staphylococcus
NKLGY

SEQ ID NO: 1968776 - protein, 8 aa, Staphylococcus
NKLKETLE

SEQ ID NO: 1968777 - protein, 13 aa, Staphylococcus
NKLKKKKERDKTG

SEQ ID NO: 1968778 - protein, 6 aa, Staphylococcus
NKLNEN

SEQ ID NO: 1968779 - protein, 7 aa, Staphylococcus
NKLNPQA

SEQ ID NO: 1968780 - protein, 7 aa, Staphylococcus
NKLPEKR

SEQ ID NO: 1968781 - protein, 10 aa, Staphylococcus
NKLPKGYDKY

SEQ ID NO: 1968782 - protein, 15 aa, Staphylococcus
NKLPSEISGGQKQRV

SEQ ID NO: 1968783 - protein, 15 aa, Staphylococcus
NKLPSEVSGGQKQRV

SEQ ID NO: 1968784 - protein, 9 aa, Staphylococcus
NKLQDGRKF

SEQ ID NO: 1968785 - protein, 7 aa, Staphylococcus
NKLQTEI

SEQ ID NO: 1968786 - protein, 5 aa, Staphylococcus
NKLRD

SEQ ID NO: 1968787 - protein, 6 aa, Staphylococcus
NKLRET

SEQ ID NO: 1968788 - protein, 12 aa, Staphylococcus
NKLSDSKAHKYS

SEQ ID NO: 1968789 - protein, 10 aa, Staphylococcus
NKLSEKDPKL

SEQ ID NO: 1968790 - protein, 8 aa, Staphylococcus
NKLSGGQK

SEQ ID NO: 1968791 - protein, 13 aa, Staphylococcus
NKLSKEELSNYSD

SEQ ID NO: 1968792 - protein, 11 aa, Staphylococcus
NKLTDEKGLDA

SEQ ID NO: 1968793 - protein, 6 aa, Staphylococcus
NKLTGK

SEQ ID NO: 1968794 - protein, 7 aa, Staphylococcus
NKLTKDE

SEQ ID NO: 1968795 - protein, 6 aa, Staphylococcus
NKLTTD

SEQ ID NO: 1968796 - protein, 4 aa, Staphylococcus
NKMA

SEQ ID NO: 1968797 - protein, 12 aa, Staphylococcus
NKMAEKDPKLAP

SEQ ID NO: 1968798 - protein, 10 aa, Staphylococcus
NKMSEKDPKL

SEQ ID NO: 1968799 - protein, 9 aa, Staphylococcus
NKMSEKNPR

SEQ ID NO: 1968800 - protein, 5 aa, Staphylococcus
NKMSQ

SEQ ID NO: 1968801 - protein, 12 aa, Staphylococcus
NKMTEEKVNHST

SEQ ID NO: 1968802 - protein, 9 aa, Staphylococcus
NKNAGTRKV

SEQ ID NO: 1968803 - protein, 12 aa, Staphylococcus
NKNAQKIFEVEK

SEQ ID NO: 1968804 - protein, 7 aa, Staphylococcus
NKNDEAV

SEQ ID NO: 1968805 - protein, 6 aa, Staphylococcus
NKNDEY

SEQ ID NO: 1968806 - protein, 16 aa, Staphylococcus
NKNDKNYLSSYIYRSI

SEQ ID NO: 1968807 - protein, 6 aa, Staphylococcus
NKNDSE

SEQ ID NO: 1968808 - protein, 4 aa, Staphylococcus
NKNE

SEQ ID NO: 1968809 - protein, 22 aa, Staphylococcus
NKNEKDFKQYADEYKKLEAFLS

SEQ ID NO: 1968810 - protein, 5 aa, Staphylococcus
NKNEQ

SEQ ID NO: 1968811 - protein, 4 aa, Staphylococcus
NKNG

SEQ ID NO: 1968812 - protein, 5 aa, Staphylococcus
NKNGM

SEQ ID NO: 1968813 - protein, 8 aa, Staphylococcus
NKNITKET

SEQ ID NO: 1968814 - protein, 15 aa, Staphylococcus
NKNITKRTAQAHSSI

SEQ ID NO: 1968815 - protein, 8 aa, Staphylococcus
NKNKDAIQ

SEQ ID NO: 1968816 - protein, 8 aa, Staphylococcus
NKNKDKAA

SEQ ID NO: 1968817 - protein, 6 aa, Staphylococcus
NKNKEA

SEQ ID NO: 1968818 - protein, 13 aa, Staphylococcus
NKNKGYYILKSRK

SEQ ID NO: 1968819 - protein, 13 aa, Staphylococcus
NKNKIAVTDGKYT

SEQ ID NO: 1968820 - protein, 13 aa, Staphylococcus
NKNKIAVTDGQRS

SEQ ID NO: 1968821 - protein, 9 aa, Staphylococcus
NKNKNRSIY

SEQ ID NO: 1968822 - protein, 23 aa, Staphylococcus
NKNKRRQANQSNDTNHDSLLPQN

SEQ ID NO: 1968823 - protein, 5 aa, Staphylococcus
NKNKY

SEQ ID NO: 1968824 - protein, 8 aa, Staphylococcus
NKNNAGRI

SEQ ID NO: 1968825 - protein, 7 aa, Staphylococcus
NKNNHGI

SEQ ID NO: 1968826 - protein, 9 aa, Staphylococcus
NKNNKALPE

SEQ ID NO: 1968827 - protein, 7 aa, Staphylococcus
NKNNKTR

SEQ ID NO: 1968828 - protein, 6 aa, Staphylococcus
NKNNYG

SEQ ID NO: 1968829 - protein, 6 aa, Staphylococcus
NKNPDM

SEQ ID NO: 1968830 - protein, 9 aa, Staphylococcus
NKNPEKYAA

SEQ ID NO: 1968831 - protein, 5 aa, Staphylococcus
NKNQA

SEQ ID NO: 1968832 - protein, 5 aa, Staphylococcus
NKNQL

SEQ ID NO: 1968833 - protein, 5 aa, Staphylococcus
NKNQV

SEQ ID NO: 1968834 - protein, 5 aa, Staphylococcus
NKNRA

SEQ ID NO: 1968835 - protein, 7 aa, Staphylococcus
NKNRDIK

SEQ ID NO: 1968836 - protein, 6 aa, Staphylococcus
NKNREI

SEQ ID NO: 1968837 - protein, 13 aa, Staphylococcus
NKNRQPYWTENYT

SEQ ID NO: 1968838 - protein, 6 aa, Staphylococcus
NKNRSI

SEQ ID NO: 1968839 - protein, 13 aa, Staphylococcus
NKNSFTEESQKRV

SEQ ID NO: 1968840 - protein, 13 aa, Staphylococcus
NKNSFTEESQQRT

SEQ ID NO: 1968841 - protein, 8 aa, Staphylococcus
NKNSITNS

SEQ ID NO: 1968842 - protein, 5 aa, Staphylococcus
NKNSK

SEQ ID NO: 1968843 - protein, 8 aa, Staphylococcus
NKNSQVRK

SEQ ID NO: 1968844 - protein, 10 aa, Staphylococcus
NKNTKQKRHL

SEQ ID NO: 1968845 - protein, 11 aa, Staphylococcus
NKNTKQKRQLR

SEQ ID NO: 1968846 - protein, 13 aa, Staphylococcus
NKNTKQKRQLRKS

SEQ ID NO: 1968847 - protein, 6 aa, Staphylococcus
NKNYKL

SEQ ID NO: 1968848 - protein, 6 aa, Staphylococcus
NKPAQN

SEQ ID NO: 1968849 - protein, 7 aa, Staphylococcus
NKPDVAR

SEQ ID NO: 1968850 - protein, 10 aa, Staphylococcus
NKPEETAKAF

SEQ ID NO: 1968851 - protein, 18 aa, Staphylococcus
NKPENKSQMTPKEQLDAI

SEQ ID NO: 1968852 - protein, 7 aa, Staphylococcus
NKPFVGE

SEQ ID NO: 1968853 - protein, 15 aa, Staphylococcus
NKPGIEGKSVKPVER

SEQ ID NO: 1968854 - protein, 8 aa, Staphylococcus
NKPGMDKE

SEQ ID NO: 1968855 - protein, 8 aa, Staphylococcus
NKPGMSKD

SEQ ID NO: 1968856 - protein, 7 aa, Staphylococcus
NKPKAAK

SEQ ID NO: 1968857 - protein, 8 aa, Staphylococcus
NKPKDAKK

SEQ ID NO: 1968858 - protein, 8 aa, Staphylococcus
NKPKYKGA

SEQ ID NO: 1968859 - protein, 11 aa, Staphylococcus
NKPKYNDNTKT

SEQ ID NO: 1968860 - protein, 8 aa, Staphylococcus
NKPLPEKM

SEQ ID NO: 1968861 - protein, 5 aa, Staphylococcus
NKPNK

SEQ ID NO: 1968862 - protein, 10 aa, Staphylococcus
NKPNNGREQQ

SEQ ID NO: 1968863 - protein, 5 aa, Staphylococcus
NKPPM

SEQ ID NO: 1968864 - protein, 6 aa, Staphylococcus
NKPPSA

SEQ ID NO: 1968865 - protein, 14 aa, Staphylococcus
NKPQEQCSYNASKA

SEQ ID NO: 1968866 - protein, 7 aa, Staphylococcus
NKPSDMD

SEQ ID NO: 1968867 - protein, 9 aa, Staphylococcus
NKPSTIPKK

SEQ ID NO: 1968868 - protein, 6 aa, Staphylococcus
NKPSVK

SEQ ID NO: 1968869 - protein, 9 aa, Staphylococcus
NKPTAQEYA

SEQ ID NO: 1968870 - protein, 7 aa, Staphylococcus
NKPTRDN

SEQ ID NO: 1968871 - protein, 6 aa, Staphylococcus
NKPTRL

SEQ ID NO: 1968872 - protein, 6 aa, Staphylococcus
NKPTVK

SEQ ID NO: 1968873 - protein, 23 aa, Staphylococcus
NKPVGNKPADGETMQTGITKEQF

SEQ ID NO: 1968874 - protein, 5 aa, Staphylococcus
NKPVK

SEQ ID NO: 1968875 - protein, 5 aa, Staphylococcus
NKPYS

SEQ ID NO: 1968876 - protein, 12 aa, Staphylococcus
NKQAKTRASEEA

SEQ ID NO: 1968877 - protein, 16 aa, Staphylococcus
NKQALANSLDMSNKEL

SEQ ID NO: 1968878 - protein, 4 aa, Staphylococcus
NKQD

SEQ ID NO: 1968879 - protein, 11 aa, Staphylococcus
NKQDARKRAES

SEQ ID NO: 1968880 - protein, 4 aa, Staphylococcus
NKQE

SEQ ID NO: 1968881 - protein, 28 aa, Staphylococcus
NKQEANQTKHKPQTRKKSGLSYKEKREY

SEQ ID NO: 1968882 - protein, 5 aa, Staphylococcus
NKQEV

SEQ ID NO: 1968883 - protein, 7 aa, Staphylococcus
NKQFDEA

SEQ ID NO: 1968884 - protein, 8 aa, Staphylococcus
NKQFDKEI

SEQ ID NO: 1968885 - protein, 6 aa, Staphylococcus
NKQFWD

SEQ ID NO: 1968886 - protein, 7 aa, Staphylococcus
NKQGLPT

SEQ ID NO: 1968887 - protein, 8 aa, Staphylococcus
NKQGLPTI

SEQ ID NO: 1968888 - protein, 5 aa, Staphylococcus
NKQIN

SEQ ID NO: 1968889 - protein, 13 aa, Staphylococcus
NKQITTLQKNAKD

SEQ ID NO: 1968890 - protein, 6 aa, Staphylococcus
NKQKFI

SEQ ID NO: 1968891 - protein, 24 aa, Staphylococcus
NKQKHPFKYDKNEDDTFSKPQKAI

SEQ ID NO: 1968892 - protein, 8 aa, Staphylococcus
NKQLEEET

SEQ ID NO: 1968893 - protein, 8 aa, Staphylococcus
NKQLKNEF

SEQ ID NO: 1968894 - protein, 9 aa, Staphylococcus
NKQLSEVRK

SEQ ID NO: 1968895 - protein, 12 aa, Staphylococcus
NKQNADVDSLFT

SEQ ID NO: 1968896 - protein, 21 aa, Staphylococcus
NKQNIATATVGEGSSNQGDFH

SEQ ID NO: 1968897 - protein, 12 aa, Staphylococcus
NKQNKTRDPEAA

SEQ ID NO: 1968898 - protein, 25 aa, Staphylococcus
NKQNSASYANDSEFTNNHQDNSQIE

SEQ ID NO: 1968899 - protein, 5 aa, Staphylococcus
NKQNV

SEQ ID NO: 1968900 - protein, 7 aa, Staphylococcus
NKQPLHE

SEQ ID NO: 1968901 - protein, 9 aa, Staphylococcus
NKQPSKGSI

SEQ ID NO: 1968902 - protein, 6 aa, Staphylococcus
NKQPYR

SEQ ID NO: 1968903 - protein, 13 aa, Staphylococcus
NKQQHQLMSADIE

SEQ ID NO: 1968904 - protein, 9 aa, Staphylococcus
NKQQRESRL

SEQ ID NO: 1968905 - protein, 10 aa, Staphylococcus
NKQQTEVTST

SEQ ID NO: 1968906 - protein, 23 aa, Staphylococcus
NKQRGRPSKMKKKNRKVKQENHL

SEQ ID NO: 1968907 - protein, 4 aa, Staphylococcus
NKQS

SEQ ID NO: 1968908 - protein, 10 aa, Staphylococcus
NKQSQELLDE

SEQ ID NO: 1968909 - protein, 29 aa, Staphylococcus
NKQSQRLTLDRSDSGALPEPVKGTTRSTI

SEQ ID NO: 1968910 - protein, 12 aa, Staphylococcus
NKQSYFKKSSEI

SEQ ID NO: 1968911 - protein, 6 aa, Staphylococcus
NKQTAD

SEQ ID NO: 1968912 - protein, 6 aa, Staphylococcus
NKQTNL

SEQ ID NO: 1968913 - protein, 8 aa, Staphylococcus
NKQTVGIG

SEQ ID NO: 1968914 - protein, 5 aa, Staphylococcus
NKQVT

SEQ ID NO: 1968915 - protein, 4 aa, Staphylococcus
NKQW

SEQ ID NO: 1968916 - protein, 4 aa, Staphylococcus
NKQY

SEQ ID NO: 1968917 - protein, 6 aa, Staphylococcus
NKQYQQ

SEQ ID NO: 1968918 - protein, 6 aa, Staphylococcus
NKQYYK

SEQ ID NO: 1968919 - protein, 8 aa, Staphylococcus
NKRDDGKY

SEQ ID NO: 1968920 - protein, 34 aa, Staphylococcus
NKRDNKVTLDRTDSGLLPGNVEGTTRSTKLDSTL

SEQ ID NO: 1968921 - protein, 6 aa, Staphylococcus
NKRDPI

SEQ ID NO: 1968922 - protein, 8 aa, Staphylococcus
NKRDRKKR

SEQ ID NO: 1968923 - protein, 11 aa, Staphylococcus
NKREDNKSNTF

SEQ ID NO: 1968924 - protein, 9 aa, Staphylococcus
NKREKAERG

SEQ ID NO: 1968925 - protein, 7 aa, Staphylococcus
NKRESYR

SEQ ID NO: 1968926 - protein, 13 aa, Staphylococcus
NKRFTNKEEIQKL

SEQ ID NO: 1968927 - protein, 8 aa, Staphylococcus
NKRIAAQK

SEQ ID NO: 1968928 - protein, 14 aa, Staphylococcus
NKRKKEEEKYQKEL

SEQ ID NO: 1968929 - protein, 6 aa, Staphylococcus
NKRKYH

SEQ ID NO: 1968930 - protein, 9 aa, Staphylococcus
NKRNASMKG

SEQ ID NO: 1968931 - protein, 5 aa, Staphylococcus
NKRND

SEQ ID NO: 1968932 - protein, 7 aa, Staphylococcus
NKRNLER

SEQ ID NO: 1968933 - protein, 7 aa, Staphylococcus
NKRPAEY

SEQ ID NO: 1968934 - protein, 17 aa, Staphylococcus
NKRRELAESKYNERLKE

SEQ ID NO: 1968935 - protein, 21 aa, Staphylococcus
NKRRSLTESKYNERRSECENA

SEQ ID NO: 1968936 - protein, 13 aa, Staphylococcus
NKRSTGYKLVIKD

SEQ ID NO: 1968937 - protein, 6 aa, Staphylococcus
NKSAKD

SEQ ID NO: 1968938 - protein, 19 aa, Staphylococcus
NKSAREKEAKRVKQMMQED

SEQ ID NO: 1968939 - protein, 7 aa, Staphylococcus
NKSEDDT

SEQ ID NO: 1968940 - protein, 7 aa, Staphylococcus
NKSEEID

SEQ ID NO: 1968941 - protein, 17 aa, Staphylococcus
NKSEFPKYQRPQGENYQ

SEQ ID NO: 1968942 - protein, 8 aa, Staphylococcus
NKSEVNRP

SEQ ID NO: 1968943 - protein, 5 aa, Staphylococcus
NKSGV

SEQ ID NO: 1968944 - protein, 8 aa, Staphylococcus
NKSGYNSY

SEQ ID NO: 1968945 - protein, 17 aa, Staphylococcus
NKSIAKTGNTPGVTKQQ

SEQ ID NO: 1968946 - protein, 10 aa, Staphylococcus
NKSIDNENVE

SEQ ID NO: 1968947 - protein, 9 aa, Staphylococcus
NKSIEDGDF

SEQ ID NO: 1968948 - protein, 12 aa, Staphylococcus
NKSINHSTSNSV

SEQ ID NO: 1968949 - protein, 5 aa, Staphylococcus
NKSIT

SEQ ID NO: 1968950 - protein, 7 aa, Staphylococcus
NKSITRK

SEQ ID NO: 1968951 - protein, 13 aa, Staphylococcus
NKSITSHSGSTDL

SEQ ID NO: 1968952 - protein, 13 aa, Staphylococcus
NKSKGYYILKSVK

SEQ ID NO: 1968953 - protein, 18 aa, Staphylococcus
NKSKHPFKYKEANDTFCR

SEQ ID NO: 1968954 - protein, 11 aa, Staphylococcus
NKSKLPDYDSN

SEQ ID NO: 1968955 - protein, 10 aa, Staphylococcus
NKSKPREDWV

SEQ ID NO: 1968956 - protein, 8 aa, Staphylococcus
NKSKTFKQ

SEQ ID NO: 1968957 - protein, 4 aa, Staphylococcus
NKSL

SEQ ID NO: 1968958 - protein, 24 aa, Staphylococcus
NKSLDGRKSTSNSSNIEYGGRGMS

SEQ ID NO: 1968959 - protein, 14 aa, Staphylococcus
NKSLESVENDTRPN

SEQ ID NO: 1968960 - protein, 11 aa, Staphylococcus
NKSNAQSISNK

SEQ ID NO: 1968961 - protein, 8 aa, Staphylococcus
NKSNEAAL

SEQ ID NO: 1968962 - protein, 8 aa, Staphylococcus
NKSNEEAL

SEQ ID NO: 1968963 - protein, 9 aa, Staphylococcus
NKSNEERLK

SEQ ID NO: 1968964 - protein, 8 aa, Staphylococcus
NKSNENTL

SEQ ID NO: 1968965 - protein, 8 aa, Staphylococcus
NKSNEQAL

SEQ ID NO: 1968966 - protein, 8 aa, Staphylococcus
NKSNKVPI

SEQ ID NO: 1968967 - protein, 7 aa, Staphylococcus
NKSPISE

SEQ ID NO: 1968968 - protein, 10 aa, Staphylococcus
NKSPKRQGKV

SEQ ID NO: 1968969 - protein, 10 aa, Staphylococcus
NKSPSNKEKA

SEQ ID NO: 1968970 - protein, 5 aa, Staphylococcus
NKSPY

SEQ ID NO: 1968971 - protein, 8 aa, Staphylococcus
NKSPYDGF

SEQ ID NO: 1968972 - protein, 6 aa, Staphylococcus
NKSQDI

SEQ ID NO: 1968973 - protein, 7 aa, Staphylococcus
NKSQDVV

SEQ ID NO: 1968974 - protein, 16 aa, Staphylococcus
NKSQIPVGKNKDGKTV

SEQ ID NO: 1968975 - protein, 8 aa, Staphylococcus
NKSQNKKN

SEQ ID NO: 1968976 - protein, 24 aa, Staphylococcus
NKSQVGRTHKGQTSKIDYGGRGMS

SEQ ID NO: 1968977 - protein, 5 aa, Staphylococcus
NKSQY

SEQ ID NO: 1968978 - protein, 4 aa, Staphylococcus
NKSR

SEQ ID NO: 1968979 - protein, 10 aa, Staphylococcus
NKSRSTEDER

SEQ ID NO: 1968980 - protein, 15 aa, Staphylococcus
NKSSDGRKPSPFSSN

SEQ ID NO: 1968981 - protein, 5 aa, Staphylococcus
NKSSF

SEQ ID NO: 1968982 - protein, 6 aa, Staphylococcus
NKSSLA

SEQ ID NO: 1968983 - protein, 14 aa, Staphylococcus
NKSSRKSREDRDNW

SEQ ID NO: 1968984 - protein, 19 aa, Staphylococcus
NKSSYITGTTINISGGKSR

SEQ ID NO: 1968985 - protein, 10 aa, Staphylococcus
NKSTHSSREV

SEQ ID NO: 1968986 - protein, 13 aa, Staphylococcus
NKSTKQKRKLRKA

SEQ ID NO: 1968987 - protein, 31 aa, Staphylococcus
NKSTKQKRKLRKASLVSKSDMKRVKQLLAYK

SEQ ID NO: 1968988 - protein, 9 aa, Staphylococcus
NKSTPYEAR

SEQ ID NO: 1968989 - protein, 10 aa, Staphylococcus
NKSTRNNRNH

SEQ ID NO: 1968990 - protein, 9 aa, Staphylococcus
NKSTSDTIP

SEQ ID NO: 1968991 - protein, 4 aa, Staphylococcus
NKSY

SEQ ID NO: 1968992 - protein, 7 aa, Staphylococcus
NKTAERL

SEQ ID NO: 1968993 - protein, 5 aa, Staphylococcus
NKTAK

SEQ ID NO: 1968994 - protein, 10 aa, Staphylococcus
NKTDENRFDN

SEQ ID NO: 1968995 - protein, 7 aa, Staphylococcus
NKTDVIT

SEQ ID NO: 1968996 - protein, 13 aa, Staphylococcus
NKTFKTQDNLGQK

SEQ ID NO: 1968997 - protein, 7 aa, Staphylococcus
NKTGGFH

SEQ ID NO: 1968998 - protein, 9 aa, Staphylococcus
NKTGKSEQE

SEQ ID NO: 1968999 - protein, 6 aa, Staphylococcus
NKTGNW

SEQ ID NO: 1969000 - protein, 5 aa, Staphylococcus
NKTHD

SEQ ID NO: 1969001 - protein, 6 aa, Staphylococcus
NKTHDN

SEQ ID NO: 1969002 - protein, 5 aa, Staphylococcus
NKTHK

SEQ ID NO: 1969003 - protein, 6 aa, Staphylococcus
NKTHNN

SEQ ID NO: 1969004 - protein, 5 aa, Staphylococcus
NKTHQ

SEQ ID NO: 1969005 - protein, 12 aa, Staphylococcus
NKTHRNEGIAES

SEQ ID NO: 1969006 - protein, 9 aa, Staphylococcus
NKTIDKPKQ

SEQ ID NO: 1969007 - protein, 5 aa, Staphylococcus
NKTIP

SEQ ID NO: 1969008 - protein, 5 aa, Staphylococcus
NKTIT

SEQ ID NO: 1969009 - protein, 9 aa, Staphylococcus
NKTKENGHR

SEQ ID NO: 1969010 - protein, 10 aa, Staphylococcus
NKTKPKMEAQ

SEQ ID NO: 1969011 - protein, 24 aa, Staphylococcus
NKTKVGRNDATISGNIEYGGRGMS

SEQ ID NO: 1969012 - protein, 23 aa, Staphylococcus
NKTKVGRTNDHKSSKIKYGGRGM

SEQ ID NO: 1969013 - protein, 9 aa, Staphylococcus
NKTLQGNLD

SEQ ID NO: 1969014 - protein, 5 aa, Staphylococcus
NKTLT

SEQ ID NO: 1969015 - protein, 15 aa, Staphylococcus
NKTLTSKHLKLYIAN

SEQ ID NO: 1969016 - protein, 15 aa, Staphylococcus
NKTLTSKHLKLYTEN

SEQ ID NO: 1969017 - protein, 5 aa, Staphylococcus
NKTME

SEQ ID NO: 1969018 - protein, 10 aa, Staphylococcus
NKTNSTAIKP

SEQ ID NO: 1969019 - protein, 17 aa, Staphylococcus
NKTPKEKSSSYYYYGDD

SEQ ID NO: 1969020 - protein, 5 aa, Staphylococcus
NKTPY

SEQ ID NO: 1969021 - protein, 8 aa, Staphylococcus
NKTSEDNM

SEQ ID NO: 1969022 - protein, 10 aa, Staphylococcus
NKTSNEETEY

SEQ ID NO: 1969023 - protein, 9 aa, Staphylococcus
NKTSNQEVE

SEQ ID NO: 1969024 - protein, 7 aa, Staphylococcus
NKTSQRG

SEQ ID NO: 1969025 - protein, 7 aa, Staphylococcus
NKTSSYK

SEQ ID NO: 1969026 - protein, 12 aa, Staphylococcus
NKTTPYEERDQD

SEQ ID NO: 1969027 - protein, 10 aa, Staphylococcus
NKTTPYEERY

SEQ ID NO: 1969028 - protein, 10 aa, Staphylococcus
NKTTPYNERY

SEQ ID NO: 1969029 - protein, 4 aa, Staphylococcus
NKTV

SEQ ID NO: 1969030 - protein, 10 aa, Staphylococcus
NKTVNTFSGG

SEQ ID NO: 1969031 - protein, 11 aa, Staphylococcus
NKTYRDKDKVT

SEQ ID NO: 1969032 - protein, 6 aa, Staphylococcus
NKVDTD

SEQ ID NO: 1969033 - protein, 10 aa, Staphylococcus
NKVDYPKDGV

SEQ ID NO: 1969034 - protein, 7 aa, Staphylococcus
NKVEAYA

SEQ ID NO: 1969035 - protein, 14 aa, Staphylococcus
NKVEEYSKAYPELA

SEQ ID NO: 1969036 - protein, 11 aa, Staphylococcus
NKVEKKTHSVF

SEQ ID NO: 1969037 - protein, 25 aa, Staphylococcus
NKVEVTKDNTTIVDGDGDENSIDAR

SEQ ID NO: 1969038 - protein, 25 aa, Staphylococcus
NKVEVTKDNTTIVDGDGDNNNIDAR

SEQ ID NO: 1969039 - protein, 25 aa, Staphylococcus
NKVEVTKDNTTIVNGDGDKNSIDAR

SEQ ID NO: 1969040 - protein, 25 aa, Staphylococcus
NKVEVTKDNTTVVDGDGDDNSIDAR

SEQ ID NO: 1969041 - protein, 26 aa, Staphylococcus
NKVEVTKDNTTVVDGDGDDNSIDARV

SEQ ID NO: 1969042 - protein, 25 aa, Staphylococcus
NKVEVTKDNTTVVDGDGDENNIDAR

SEQ ID NO: 1969043 - protein, 5 aa, Staphylococcus
NKVHN

SEQ ID NO: 1969044 - protein, 5 aa, Staphylococcus
NKVHS

SEQ ID NO: 1969045 - protein, 7 aa, Staphylococcus
NKVKDPR

SEQ ID NO: 1969046 - protein, 7 aa, Staphylococcus
NKVNKRD

SEQ ID NO: 1969047 - protein, 9 aa, Staphylococcus
NKVNPSSEI

SEQ ID NO: 1969048 - protein, 12 aa, Staphylococcus
NKVNSTENALNN

SEQ ID NO: 1969049 - protein, 6 aa, Staphylococcus
NKVPDE

SEQ ID NO: 1969050 - protein, 9 aa, Staphylococcus
NKVPERAEE

SEQ ID NO: 1969051 - protein, 6 aa, Staphylococcus
NKVPGV

SEQ ID NO: 1969052 - protein, 10 aa, Staphylococcus
NKVPSKGETV

SEQ ID NO: 1969053 - protein, 8 aa, Staphylococcus
NKVPTTRN

SEQ ID NO: 1969054 - protein, 8 aa, Staphylococcus
NKVQDEDG

SEQ ID NO: 1969055 - protein, 6 aa, Staphylococcus
NKVSGI

SEQ ID NO: 1969056 - protein, 17 aa, Staphylococcus
NKVSINGQSDNQGSGHI

SEQ ID NO: 1969057 - protein, 9 aa, Staphylococcus
NKVSNRRKT

SEQ ID NO: 1969058 - protein, 7 aa, Staphylococcus
NKVSSDA

SEQ ID NO: 1969059 - protein, 12 aa, Staphylococcus
NKVTAKDGTEID

SEQ ID NO: 1969060 - protein, 13 aa, Staphylococcus
NKVTSRDGKDITL

SEQ ID NO: 1969061 - protein, 8 aa, Staphylococcus
NKYEKRQV

SEQ ID NO: 1969062 - protein, 18 aa, Staphylococcus
NKYGGAIATGHPYGASGA

SEQ ID NO: 1969063 - protein, 4 aa, Staphylococcus
NKYK

SEQ ID NO: 1969064 - protein, 10 aa, Staphylococcus
NKYKDAYNNY

SEQ ID NO: 1969065 - protein, 19 aa, Staphylococcus
NKYKENEKLLNKEKELESE

SEQ ID NO: 1969066 - protein, 9 aa, Staphylococcus
NKYKNRGFD

SEQ ID NO: 1969067 - protein, 9 aa, Staphylococcus
NKYKTDEVK

SEQ ID NO: 1969068 - protein, 6 aa, Staphylococcus
NKYNHE

SEQ ID NO: 1969069 - protein, 10 aa, Staphylococcus
NKYNSDKDNI

SEQ ID NO: 1969070 - protein, 14 aa, Staphylococcus
NKYNTTLHPYEGTQ

SEQ ID NO: 1969071 - protein, 12 aa, Staphylococcus
NKYPEQQRFGKE

SEQ ID NO: 1969072 - protein, 6 aa, Staphylococcus
NKYRVK

SEQ ID NO: 1969073 - protein, 5 aa, Staphylococcus
NKYVK

SEQ ID NO: 1969074 - protein, 15 aa, Staphylococcus
NLADASGQKYGLGSS

SEQ ID NO: 1969075 - protein, 15 aa, Staphylococcus
NLADDSGQKYGLGSS

SEQ ID NO: 1969076 - protein, 15 aa, Staphylococcus
NLADESGQKYGLGSS

SEQ ID NO: 1969077 - protein, 10 aa, Staphylococcus
NLADKGELPQ

SEQ ID NO: 1969078 - protein, 7 aa, Staphylococcus
NLADRGT

SEQ ID NO: 1969079 - protein, 4 aa, Staphylococcus
NLAN

SEQ ID NO: 1969080 - protein, 13 aa, Staphylococcus
NLASNLPKGYSMT

SEQ ID NO: 1969081 - protein, 7 aa, Staphylococcus
NLASPTP

SEQ ID NO: 1969082 - protein, 4 aa, Staphylococcus
NLAT

SEQ ID NO: 1969083 - protein, 9 aa, Staphylococcus
NLAYGQQSS

SEQ ID NO: 1969084 - protein, 15 aa, Staphylococcus
NLDDANGNKYGLGSS

SEQ ID NO: 1969085 - protein, 15 aa, Staphylococcus
NLDDASGNKYGLGSS

SEQ ID NO: 1969086 - protein, 5 aa, Staphylococcus
NLDDE

SEQ ID NO: 1969087 - protein, 7 aa, Staphylococcus
NLDDQEA

SEQ ID NO: 1969088 - protein, 10 aa, Staphylococcus
NLDEEQGKEV

SEQ ID NO: 1969089 - protein, 10 aa, Staphylococcus
NLDEEQGKQV

SEQ ID NO: 1969090 - protein, 8 aa, Staphylococcus
NLDETLDR

SEQ ID NO: 1969091 - protein, 5 aa, Staphylococcus
NLDGQ

SEQ ID NO: 1969092 - protein, 9 aa, Staphylococcus
NLDLNDKES

SEQ ID NO: 1969093 - protein, 19 aa, Staphylococcus
NLDNEQLKRDMEEYNYEAI

SEQ ID NO: 1969094 - protein, 6 aa, Staphylococcus
NLDPNV

SEQ ID NO: 1969095 - protein, 9 aa, Staphylococcus
NLDRKERAH

SEQ ID NO: 1969096 - protein, 16 aa, Staphylococcus
NLDSRVNDALTSNNDD

SEQ ID NO: 1969097 - protein, 6 aa, Staphylococcus
NLDTNT

SEQ ID NO: 1969098 - protein, 16 aa, Staphylococcus
NLDTRVNDALSSPKDD

SEQ ID NO: 1969099 - protein, 5 aa, Staphylococcus
NLDVE

SEQ ID NO: 1969100 - protein, 4 aa, Staphylococcus
NLEA

SEQ ID NO: 1969101 - protein, 5 aa, Staphylococcus
NLEGS

SEQ ID NO: 1969102 - protein, 6 aa, Staphylococcus
NLEGSI

SEQ ID NO: 1969103 - protein, 6 aa, Staphylococcus
NLEGSV

SEQ ID NO: 1969104 - protein, 7 aa, Staphylococcus
NLEGTGD

SEQ ID NO: 1969105 - protein, 13 aa, Staphylococcus
NLENGNPEVHPAP

SEQ ID NO: 1969106 - protein, 6 aa, Staphylococcus
NLENNT

SEQ ID NO: 1969107 - protein, 4 aa, Staphylococcus
NLEP

SEQ ID NO: 1969108 - protein, 5 aa, Staphylococcus
NLEPA

SEQ ID NO: 1969109 - protein, 6 aa, Staphylococcus
NLEQDG

SEQ ID NO: 1969110 - protein, 13 aa, Staphylococcus
NLEQNRDNEFEQL

SEQ ID NO: 1969111 - protein, 6 aa, Staphylococcus
NLEQPK

SEQ ID NO: 1969112 - protein, 13 aa, Staphylococcus
NLERGNVKSKEIE

SEQ ID NO: 1969113 - protein, 4 aa, Staphylococcus
NLEV

SEQ ID NO: 1969114 - protein, 4 aa, Staphylococcus
NLGE

SEQ ID NO: 1969115 - protein, 8 aa, Staphylococcus
NLGGEQSG

SEQ ID NO: 1969116 - protein, 9 aa, Staphylococcus
NLGGTATDM

SEQ ID NO: 1969117 - protein, 5 aa, Staphylococcus
NLGIS

SEQ ID NO: 1969118 - protein, 7 aa, Staphylococcus
NLGISSP

SEQ ID NO: 1969119 - protein, 8 aa, Staphylococcus
NLGISSPD

SEQ ID NO: 1969120 - protein, 20 aa, Staphylococcus
NLGNTNGTFGLPGGYTSGER

SEQ ID NO: 1969121 - protein, 8 aa, Staphylococcus
NLGSQPPF

SEQ ID NO: 1969122 - protein, 11 aa, Staphylococcus
NLHDRENRENW

SEQ ID NO: 1969123 - protein, 5 aa, Staphylococcus
NLHES

SEQ ID NO: 1969124 - protein, 16 aa, Staphylococcus
NLISSKSKIKYGTPKQ

SEQ ID NO: 1969125 - protein, 7 aa, Staphylococcus
NLKADSE

SEQ ID NO: 1969126 - protein, 6 aa, Staphylococcus
NLKAGD

SEQ ID NO: 1969127 - protein, 41 aa, Staphylococcus
NLKETVGNVTDNKDLEKEGQNDKASGKAKEAVENVKNKAND

SEQ ID NO: 1969128 - protein, 4 aa, Staphylococcus
NLKG

SEQ ID NO: 1969129 - protein, 16 aa, Staphylococcus
NLKGRGTGNGIETYNN

SEQ ID NO: 1969130 - protein, 10 aa, Staphylococcus
NLKKDDPNYD

SEQ ID NO: 1969131 - protein, 10 aa, Staphylococcus
NLKKTTEQFK

SEQ ID NO: 1969132 - protein, 5 aa, Staphylococcus
NLKNE

SEQ ID NO: 1969133 - protein, 7 aa, Staphylococcus
NLKNPQF

SEQ ID NO: 1969134 - protein, 5 aa, Staphylococcus
NLKPE

SEQ ID NO: 1969135 - protein, 7 aa, Staphylococcus
NLKPGGS

SEQ ID NO: 1969136 - protein, 7 aa, Staphylococcus
NLKPIKN

SEQ ID NO: 1969137 - protein, 7 aa, Staphylococcus
NLKPSKG

SEQ ID NO: 1969138 - protein, 11 aa, Staphylococcus
NLKPTTTDEQI

SEQ ID NO: 1969139 - protein, 10 aa, Staphylococcus
NLKRKSDKVN

SEQ ID NO: 1969140 - protein, 4 aa, Staphylococcus
NLKS

SEQ ID NO: 1969141 - protein, 5 aa, Staphylococcus
NLKSE

SEQ ID NO: 1969142 - protein, 12 aa, Staphylococcus
NLKSEKEQAVQT

SEQ ID NO: 1969143 - protein, 7 aa, Staphylococcus
NLKVDNS

SEQ ID NO: 1969144 - protein, 6 aa, Staphylococcus
NLLRGK

SEQ ID NO: 1969145 - protein, 11 aa, Staphylococcus
NLMGDRSTSEL

SEQ ID NO: 1969146 - protein, 11 aa, Staphylococcus
NLNAQSPQSDF

SEQ ID NO: 1969147 - protein, 4 aa, Staphylococcus
NLND

SEQ ID NO: 1969148 - protein, 5 aa, Staphylococcus
NLNDE

SEQ ID NO: 1969149 - protein, 19 aa, Staphylococcus
NLNEDKRVGPDPDNYSGHN

SEQ ID NO: 1969150 - protein, 11 aa, Staphylococcus
NLNEGDSIDDA

SEQ ID NO: 1969151 - protein, 10 aa, Staphylococcus
NLNESDPNYD

SEQ ID NO: 1969152 - protein, 5 aa, Staphylococcus
NLNID

SEQ ID NO: 1969153 - protein, 6 aa, Staphylococcus
NLNKTA

SEQ ID NO: 1969154 - protein, 4 aa, Staphylococcus
NLNN

SEQ ID NO: 1969155 - protein, 13 aa, Staphylococcus
NLNNQEQDSKEQF

SEQ ID NO: 1969156 - protein, 8 aa, Staphylococcus
NLNPDKPT

SEQ ID NO: 1969157 - protein, 9 aa, Staphylococcus
NLNPERTKI

SEQ ID NO: 1969158 - protein, 12 aa, Staphylococcus
NLNPSTSNDQIR

SEQ ID NO: 1969159 - protein, 7 aa, Staphylococcus
NLNPTKV

SEQ ID NO: 1969160 - protein, 9 aa, Staphylococcus
NLNQTNTLD

SEQ ID NO: 1969161 - protein, 11 aa, Staphylococcus
NLNRAEDRKEF

SEQ ID NO: 1969162 - protein, 6 aa, Staphylococcus
NLNREL

SEQ ID NO: 1969163 - protein, 24 aa, Staphylococcus
NLNTANEASLTKVPGIGPSKAKEI

SEQ ID NO: 1969164 - protein, 9 aa, Staphylococcus
NLNTSERYH

SEQ ID NO: 1969165 - protein, 5 aa, Staphylococcus
NLPAD

SEQ ID NO: 1969166 - protein, 6 aa, Staphylococcus
NLPAQL

SEQ ID NO: 1969167 - protein, 4 aa, Staphylococcus
NLPD

SEQ ID NO: 1969168 - protein, 8 aa, Staphylococcus
NLPDDAAK

SEQ ID NO: 1969169 - protein, 5 aa, Staphylococcus
NLPDE

SEQ ID NO: 1969170 - protein, 13 aa, Staphylococcus
NLPDGKSVDQRVK

SEQ ID NO: 1969171 - protein, 10 aa, Staphylococcus
NLPDGRWPSQ

SEQ ID NO: 1969172 - protein, 6 aa, Staphylococcus
NLPDPL

SEQ ID NO: 1969173 - protein, 6 aa, Staphylococcus
NLPDRL

SEQ ID NO: 1969174 - protein, 15 aa, Staphylococcus
NLPEDTAEKITETLE

SEQ ID NO: 1969175 - protein, 7 aa, Staphylococcus
NLPEDTT

SEQ ID NO: 1969176 - protein, 8 aa, Staphylococcus
NLPEEEAY

SEQ ID NO: 1969177 - protein, 7 aa, Staphylococcus
NLPEGTK

SEQ ID NO: 1969178 - protein, 5 aa, Staphylococcus
NLPEK

SEQ ID NO: 1969179 - protein, 7 aa, Staphylococcus
NLPEPSV

SEQ ID NO: 1969180 - protein, 7 aa, Staphylococcus
NLPETRK

SEQ ID NO: 1969181 - protein, 4 aa, Staphylococcus
NLPF

SEQ ID NO: 1969182 - protein, 5 aa, Staphylococcus
NLPFG

SEQ ID NO: 1969183 - protein, 7 aa, Staphylococcus
NLPKEEA

SEQ ID NO: 1969184 - protein, 7 aa, Staphylococcus
NLPNNEN

SEQ ID NO: 1969185 - protein, 6 aa, Staphylococcus
NLPNPA

SEQ ID NO: 1969186 - protein, 14 aa, Staphylococcus
NLPNPADIKDDKQR

SEQ ID NO: 1969187 - protein, 6 aa, Staphylococcus
NLPNPL

SEQ ID NO: 1969188 - protein, 12 aa, Staphylococcus
NLPPSRGLGSSA

SEQ ID NO: 1969189 - protein, 6 aa, Staphylococcus
NLPSDY

SEQ ID NO: 1969190 - protein, 5 aa, Staphylococcus
NLPSQ

SEQ ID NO: 1969191 - protein, 6 aa, Staphylococcus
NLPSQL

SEQ ID NO: 1969192 - protein, 6 aa, Staphylococcus
NLPTEA

SEQ ID NO: 1969193 - protein, 8 aa, Staphylococcus
NLPYKGSL

SEQ ID NO: 1969194 - protein, 9 aa, Staphylococcus
NLPYKGSLN

SEQ ID NO: 1969195 - protein, 9 aa, Staphylococcus
NLPYKGSMN

SEQ ID NO: 1969196 - protein, 9 aa, Staphylococcus
NLQARGEKF

SEQ ID NO: 1969197 - protein, 6 aa, Staphylococcus
NLQAVQ

SEQ ID NO: 1969198 - protein, 8 aa, Staphylococcus
NLQDGRKY

SEQ ID NO: 1969199 - protein, 6 aa, Staphylococcus
NLQEAP

SEQ ID NO: 1969200 - protein, 4 aa, Staphylococcus
NLQH

SEQ ID NO: 1969201 - protein, 10 aa, Staphylococcus
NLQKSGRITG

SEQ ID NO: 1969202 - protein, 11 aa, Staphylococcus
NLQNDDSNVNV

SEQ ID NO: 1969203 - protein, 6 aa, Staphylococcus
NLQNEE

SEQ ID NO: 1969204 - protein, 6 aa, Staphylococcus
NLQRGN

SEQ ID NO: 1969205 - protein, 9 aa, Staphylococcus
NLQTRTKHK

SEQ ID NO: 1969206 - protein, 6 aa, Staphylococcus
NLRENE

SEQ ID NO: 1969207 - protein, 9 aa, Staphylococcus
NLRKAKDRA

SEQ ID NO: 1969208 - protein, 6 aa, Staphylococcus
NLRSRG

SEQ ID NO: 1969209 - protein, 4 aa, Staphylococcus
NLSE

SEQ ID NO: 1969210 - protein, 10 aa, Staphylococcus
NLSEEEKQKH

SEQ ID NO: 1969211 - protein, 8 aa, Staphylococcus
NLSEGELN

SEQ ID NO: 1969212 - protein, 6 aa, Staphylococcus
NLSEPK

SEQ ID NO: 1969213 - protein, 10 aa, Staphylococcus
NLSGESPFDR

SEQ ID NO: 1969214 - protein, 9 aa, Staphylococcus
NLSGGTKRK

SEQ ID NO: 1969215 - protein, 7 aa, Staphylococcus
NLSGKYP

SEQ ID NO: 1969216 - protein, 11 aa, Staphylococcus
NLSKATSEIVE

SEQ ID NO: 1969217 - protein, 13 aa, Staphylococcus
NLSKDETHHILEY

SEQ ID NO: 1969218 - protein, 5 aa, Staphylococcus
NLSKE

SEQ ID NO: 1969219 - protein, 13 aa, Staphylococcus
NLSKENVKQNGLQ

SEQ ID NO: 1969220 - protein, 6 aa, Staphylococcus
NLSKGS

SEQ ID NO: 1969221 - protein, 7 aa, Staphylococcus
NLSKGSR

SEQ ID NO: 1969222 - protein, 11 aa, Staphylococcus
NLSKSEAKQRA

SEQ ID NO: 1969223 - protein, 8 aa, Staphylococcus
NLSNNADL

SEQ ID NO: 1969224 - protein, 5 aa, Staphylococcus
NLSNS

SEQ ID NO: 1969225 - protein, 6 aa, Staphylococcus
NLSPED

SEQ ID NO: 1969226 - protein, 10 aa, Staphylococcus
NLSPEEKQKH

SEQ ID NO: 1969227 - protein, 7 aa, Staphylococcus
NLSPQTL

SEQ ID NO: 1969228 - protein, 7 aa, Staphylococcus
NLSPTNT

SEQ ID NO: 1969229 - protein, 8 aa, Staphylococcus
NLSQENYF

SEQ ID NO: 1969230 - protein, 7 aa, Staphylococcus
NLSSNAF

SEQ ID NO: 1969231 - protein, 8 aa, Staphylococcus
NLSSNKTT

SEQ ID NO: 1969232 - protein, 10 aa, Staphylococcus
NLSYDEGTLT

SEQ ID NO: 1969233 - protein, 9 aa, Staphylococcus
NLSYPSLSS

SEQ ID NO: 1969234 - protein, 13 aa, Staphylococcus
NLSYSDIKKSYGN

SEQ ID NO: 1969235 - protein, 10 aa, Staphylococcus
NLTADEAATE

SEQ ID NO: 1969236 - protein, 10 aa, Staphylococcus
NLTATPKDEE

SEQ ID NO: 1969237 - protein, 12 aa, Staphylococcus
NLTATSGSFSDK

SEQ ID NO: 1969238 - protein, 9 aa, Staphylococcus
NLTDKQSSL

SEQ ID NO: 1969239 - protein, 12 aa, Staphylococcus
NLTEPEAYKTQD

SEQ ID NO: 1969240 - protein, 7 aa, Staphylococcus
NLTGGQA

SEQ ID NO: 1969241 - protein, 4 aa, Staphylococcus
NLTK

SEQ ID NO: 1969242 - protein, 6 aa, Staphylococcus
NLTKAS

SEQ ID NO: 1969243 - protein, 17 aa, Staphylococcus
NLTKASDQFIDLTLKQF

SEQ ID NO: 1969244 - protein, 6 aa, Staphylococcus
NLTKNT

SEQ ID NO: 1969245 - protein, 10 aa, Staphylococcus
NLTNGPIEGI

SEQ ID NO: 1969246 - protein, 10 aa, Staphylococcus
NLTNGPLEGI

SEQ ID NO: 1969247 - protein, 6 aa, Staphylococcus
NLTNSG

SEQ ID NO: 1969248 - protein, 9 aa, Staphylococcus
NLTQEARDG

SEQ ID NO: 1969249 - protein, 6 aa, Staphylococcus
NLTQPE

SEQ ID NO: 1969250 - protein, 7 aa, Staphylococcus
NLTSDER

SEQ ID NO: 1969251 - protein, 8 aa, Staphylococcus
NLTTHQGE

SEQ ID NO: 1969252 - protein, 12 aa, Staphylococcus
NLVGDRSTSELK

SEQ ID NO: 1969253 - protein, 6 aa, Staphylococcus
NLYGGT

SEQ ID NO: 1969254 - protein, 7 aa, Staphylococcus
NMAEDKA

SEQ ID NO: 1969255 - protein, 5 aa, Staphylococcus
NMAGK

SEQ ID NO: 1969256 - protein, 9 aa, Staphylococcus
NMAKDKDLD

SEQ ID NO: 1969257 - protein, 13 aa, Staphylococcus
NMATAKTCPHDAS

SEQ ID NO: 1969258 - protein, 5 aa, Staphylococcus
NMDAD

SEQ ID NO: 1969259 - protein, 5 aa, Staphylococcus
NMENR

SEQ ID NO: 1969260 - protein, 4 aa, Staphylococcus
NMEP

SEQ ID NO: 1969261 - protein, 5 aa, Staphylococcus
NMERD

SEQ ID NO: 1969262 - protein, 8 aa, Staphylococcus
NMEREKDR

SEQ ID NO: 1969263 - protein, 7 aa, Staphylococcus
NMETKQS

SEQ ID NO: 1969264 - protein, 20 aa, Staphylococcus
NMKDSADALSNEYNETYQDD

SEQ ID NO: 1969265 - protein, 6 aa, Staphylococcus
NMKEEP

SEQ ID NO: 1969266 - protein, 7 aa, Staphylococcus
NMKKSDK

SEQ ID NO: 1969267 - protein, 7 aa, Staphylococcus
NMKPKAA

SEQ ID NO: 1969268 - protein, 5 aa, Staphylococcus
NMKSA

SEQ ID NO: 1969269 - protein, 9 aa, Staphylococcus
NMKSPAKHA

SEQ ID NO: 1969270 - protein, 8 aa, Staphylococcus
NMKSRNVK

SEQ ID NO: 1969271 - protein, 6 aa, Staphylococcus
NMNEKD

SEQ ID NO: 1969272 - protein, 6 aa, Staphylococcus
NMNNEF

SEQ ID NO: 1969273 - protein, 10 aa, Staphylococcus
NMPDITKDKY

SEQ ID NO: 1969274 - protein, 8 aa, Staphylococcus
NMPEGTKV

SEQ ID NO: 1969275 - protein, 8 aa, Staphylococcus
NMPKKDKS

SEQ ID NO: 1969276 - protein, 5 aa, Staphylococcus
NMPPN

SEQ ID NO: 1969277 - protein, 6 aa, Staphylococcus
NMPTDH

SEQ ID NO: 1969278 - protein, 6 aa, Staphylococcus
NMPTDY

SEQ ID NO: 1969279 - protein, 33 aa, Staphylococcus
NMQGGAARTVPASGAVQVPEAAGAQAAQPQVVE

SEQ ID NO: 1969280 - protein, 20 aa, Staphylococcus
NMQTGESESVDLDKLVNYFK

SEQ ID NO: 1969281 - protein, 4 aa, Staphylococcus
NMRQ

SEQ ID NO: 1969282 - protein, 13 aa, Staphylococcus
NMSDDDANDQFDQ

SEQ ID NO: 1969283 - protein, 6 aa, Staphylococcus
NMSDKQ

SEQ ID NO: 1969284 - protein, 6 aa, Staphylococcus
NMSEDQ

SEQ ID NO: 1969285 - protein, 13 aa, Staphylococcus
NMSETEKNEVREN

SEQ ID NO: 1969286 - protein, 8 aa, Staphylococcus
NMSKHEDY

SEQ ID NO: 1969287 - protein, 17 aa, Staphylococcus
NMSPKATDEEVKAKYTE

SEQ ID NO: 1969288 - protein, 12 aa, Staphylococcus
NMSQLSKSELRL

SEQ ID NO: 1969289 - protein, 14 aa, Staphylococcus
NMTAHTAQEDDHDF

SEQ ID NO: 1969290 - protein, 4 aa, Staphylococcus
NMTG

SEQ ID NO: 1969291 - protein, 10 aa, Staphylococcus
NMTKEDREKA

SEQ ID NO: 1969292 - protein, 4 aa, Staphylococcus
NMTS

SEQ ID NO: 1969293 - protein, 7 aa, Staphylococcus
NMTSRNI

SEQ ID NO: 1969294 - protein, 9 aa, Staphylococcus
NNAEEKSET

SEQ ID NO: 1969295 - protein, 6 aa, Staphylococcus
NNAESV

SEQ ID NO: 1969296 - protein, 9 aa, Staphylococcus
NNAKKANVK

SEQ ID NO: 1969297 - protein, 6 aa, Staphylococcus
NNAKSV

SEQ ID NO: 1969298 - protein, 5 aa, Staphylococcus
NNALK

SEQ ID NO: 1969299 - protein, 8 aa, Staphylococcus
NNANRNQK

SEQ ID NO: 1969300 - protein, 9 aa, Staphylococcus
NNAPARLSN

SEQ ID NO: 1969301 - protein, 36 aa, Staphylococcus
NNAQIRKQGGRHKGPPPFSKEDKKQFERAFKSVIKQ

SEQ ID NO: 1969302 - protein, 23 aa, Staphylococcus
NNAQIRKQGGRHKGPSPFSKEDR

SEQ ID NO: 1969303 - protein, 7 aa, Staphylococcus
NNAQSFE

SEQ ID NO: 1969304 - protein, 10 aa, Staphylococcus
NNARKAGIES

SEQ ID NO: 1969305 - protein, 5 aa, Staphylococcus
NNARL

SEQ ID NO: 1969306 - protein, 6 aa, Staphylococcus
NNARQT

SEQ ID NO: 1969307 - protein, 6 aa, Staphylococcus
NNASDL

SEQ ID NO: 1969308 - protein, 6 aa, Staphylococcus
NNASTA

SEQ ID NO: 1969309 - protein, 5 aa, Staphylococcus
NNAVN

SEQ ID NO: 1969310 - protein, 9 aa, Staphylococcus
NNAVQNKEH

SEQ ID NO: 1969311 - protein, 4 aa, Staphylococcus
NNCK

SEQ ID NO: 1969312 - protein, 5 aa, Staphylococcus
NNDAI

SEQ ID NO: 1969313 - protein, 6 aa, Staphylococcus
NNDAQY

SEQ ID NO: 1969314 - protein, 13 aa, Staphylococcus
NNDASTEEEISDT

SEQ ID NO: 1969315 - protein, 8 aa, Staphylococcus
NNDDCTKA

SEQ ID NO: 1969316 - protein, 8 aa, Staphylococcus
NNDDISRD

SEQ ID NO: 1969317 - protein, 9 aa, Staphylococcus
NNDDKEVSP

SEQ ID NO: 1969318 - protein, 13 aa, Staphylococcus
NNDDNVENEKNRK

SEQ ID NO: 1969319 - protein, 7 aa, Staphylococcus
NNDDSKT

SEQ ID NO: 1969320 - protein, 8 aa, Staphylococcus
NNDDYKGK

SEQ ID NO: 1969321 - protein, 8 aa, Staphylococcus
NNDECKEA

SEQ ID NO: 1969322 - protein, 6 aa, Staphylococcus
NNDEFT

SEQ ID NO: 1969323 - protein, 7 aa, Staphylococcus
NNDERAE

SEQ ID NO: 1969324 - protein, 6 aa, Staphylococcus
NNDETA

SEQ ID NO: 1969325 - protein, 5 aa, Staphylococcus
NNDGP

SEQ ID NO: 1969326 - protein, 5 aa, Staphylococcus
NNDIG

SEQ ID NO: 1969327 - protein, 6 aa, Staphylococcus
NNDKQY

SEQ ID NO: 1969328 - protein, 9 aa, Staphylococcus
NNDKTIEKT

SEQ ID NO: 1969329 - protein, 6 aa, Staphylococcus
NNDKTK

SEQ ID NO: 1969330 - protein, 11 aa, Staphylococcus
NNDMDKAKELY

SEQ ID NO: 1969331 - protein, 4 aa, Staphylococcus
NNDN

SEQ ID NO: 1969332 - protein, 13 aa, Staphylococcus
NNDNELTFDVTKP

SEQ ID NO: 1969333 - protein, 6 aa, Staphylococcus
NNDNFK

SEQ ID NO: 1969334 - protein, 9 aa, Staphylococcus
NNDNKLAQE

SEQ ID NO: 1969335 - protein, 5 aa, Staphylococcus
NNDNQ

SEQ ID NO: 1969336 - protein, 20 aa, Staphylococcus
NNDNREVAASPASSSSDSTI

SEQ ID NO: 1969337 - protein, 8 aa, Staphylococcus
NNDNYNAT

SEQ ID NO: 1969338 - protein, 8 aa, Staphylococcus
NNDPSAQL

SEQ ID NO: 1969339 - protein, 15 aa, Staphylococcus
NNDPTLSVAKETRTR

SEQ ID NO: 1969340 - protein, 5 aa, Staphylococcus
NNDPV

SEQ ID NO: 1969341 - protein, 5 aa, Staphylococcus
NNDPY

SEQ ID NO: 1969342 - protein, 6 aa, Staphylococcus
NNDQLD

SEQ ID NO: 1969343 - protein, 20 aa, Staphylococcus
NNDQRDIKLQSTRKAYEKEL

SEQ ID NO: 1969344 - protein, 6 aa, Staphylococcus
NNDQTT

SEQ ID NO: 1969345 - protein, 8 aa, Staphylococcus
NNDRPDAF

SEQ ID NO: 1969346 - protein, 7 aa, Staphylococcus
NNDRPLY

SEQ ID NO: 1969347 - protein, 10 aa, Staphylococcus
NNDSAKYDEL

SEQ ID NO: 1969348 - protein, 11 aa, Staphylococcus
NNDSKKYDELK

SEQ ID NO: 1969349 - protein, 18 aa, Staphylococcus
NNDSRDIKLQSTRKAYEQ

SEQ ID NO: 1969350 - protein, 9 aa, Staphylococcus
NNDSTKYDA

SEQ ID NO: 1969351 - protein, 18 aa, Staphylococcus
NNDSTKYDNLKSRYERFQ

SEQ ID NO: 1969352 - protein, 8 aa, Staphylococcus
NNDTAEQA

SEQ ID NO: 1969353 - protein, 9 aa, Staphylococcus
NNDTAKDAV

SEQ ID NO: 1969354 - protein, 8 aa, Staphylococcus
NNDTEAKQ

SEQ ID NO: 1969355 - protein, 19 aa, Staphylococcus
NNDTRDIKLQSTRKAFEKE

SEQ ID NO: 1969356 - protein, 9 aa, Staphylococcus
NNEAELHSQ

SEQ ID NO: 1969357 - protein, 21 aa, Staphylococcus
NNEAQLRTRNNKLQQYQQETH

SEQ ID NO: 1969358 - protein, 4 aa, Staphylococcus
NNED

SEQ ID NO: 1969359 - protein, 9 aa, Staphylococcus
NNEDDDTED

SEQ ID NO: 1969360 - protein, 9 aa, Staphylococcus
NNEDDTREV

SEQ ID NO: 1969361 - protein, 12 aa, Staphylococcus
NNEDEIKKIPPG

SEQ ID NO: 1969362 - protein, 8 aa, Staphylococcus
NNEDIKSN

SEQ ID NO: 1969363 - protein, 5 aa, Staphylococcus
NNEDQ

SEQ ID NO: 1969364 - protein, 7 aa, Staphylococcus
NNEEDEQ

SEQ ID NO: 1969365 - protein, 5 aa, Staphylococcus
NNEER

SEQ ID NO: 1969366 - protein, 5 aa, Staphylococcus
NNEEY

SEQ ID NO: 1969367 - protein, 4 aa, Staphylococcus
NNEF

SEQ ID NO: 1969368 - protein, 7 aa, Staphylococcus
NNEFDDR

SEQ ID NO: 1969369 - protein, 4 aa, Staphylococcus
NNEG

SEQ ID NO: 1969370 - protein, 6 aa, Staphylococcus
NNEGKL

SEQ ID NO: 1969371 - protein, 5 aa, Staphylococcus
NNEGL

SEQ ID NO: 1969372 - protein, 6 aa, Staphylococcus
NNEGPA

SEQ ID NO: 1969373 - protein, 16 aa, Staphylococcus
NNEGYHTYTKPSGTAA

SEQ ID NO: 1969374 - protein, 6 aa, Staphylococcus
NNEHGS

SEQ ID NO: 1969375 - protein, 6 aa, Staphylococcus
NNEHIS

SEQ ID NO: 1969376 - protein, 4 aa, Staphylococcus
NNEI

SEQ ID NO: 1969377 - protein, 6 aa, Staphylococcus
NNEIAE

SEQ ID NO: 1969378 - protein, 14 aa, Staphylococcus
NNEIAQQSHSITEY

SEQ ID NO: 1969379 - protein, 5 aa, Staphylococcus
NNEIK

SEQ ID NO: 1969380 - protein, 8 aa, Staphylococcus
NNEKCTKI

SEQ ID NO: 1969381 - protein, 9 aa, Staphylococcus
NNEKQVQSI

SEQ ID NO: 1969382 - protein, 10 aa, Staphylococcus
NNEKTYNRKA

SEQ ID NO: 1969383 - protein, 4 aa, Staphylococcus
NNEL

SEQ ID NO: 1969384 - protein, 7 aa, Staphylococcus
NNELDMD

SEQ ID NO: 1969385 - protein, 8 aa, Staphylococcus
NNELEKQL

SEQ ID NO: 1969386 - protein, 5 aa, Staphylococcus
NNELN

SEQ ID NO: 1969387 - protein, 11 aa, Staphylococcus
NNELNRADKGL

SEQ ID NO: 1969388 - protein, 7 aa, Staphylococcus
NNELQPV

SEQ ID NO: 1969389 - protein, 8 aa, Staphylococcus
NNENGDSH

SEQ ID NO: 1969390 - protein, 8 aa, Staphylococcus
NNENPNKF

SEQ ID NO: 1969391 - protein, 12 aa, Staphylococcus
NNENQMSPETES

SEQ ID NO: 1969392 - protein, 5 aa, Staphylococcus
NNEPF

SEQ ID NO: 1969393 - protein, 6 aa, Staphylococcus
NNEPVP

SEQ ID NO: 1969394 - protein, 14 aa, Staphylococcus
NNEQAERGKIYDRN

SEQ ID NO: 1969395 - protein, 6 aa, Staphylococcus
NNEQPD

SEQ ID NO: 1969396 - protein, 7 aa, Staphylococcus
NNEQVDS

SEQ ID NO: 1969397 - protein, 56 aa, Staphylococcus
NNEQVNVNTKNDSSAIEADQNQVEQVTPNSDFENQNDENNTAIESSQSDMSENERT

SEQ ID NO: 1969398 - protein, 4 aa, Staphylococcus
NNER

SEQ ID NO: 1969399 - protein, 6 aa, Staphylococcus
NNERDV

SEQ ID NO: 1969400 - protein, 6 aa, Staphylococcus
NNERQV

SEQ ID NO: 1969401 - protein, 6 aa, Staphylococcus
NNESFK

SEQ ID NO: 1969402 - protein, 6 aa, Staphylococcus
NNESLQ

SEQ ID NO: 1969403 - protein, 9 aa, Staphylococcus
NNESNKREV

SEQ ID NO: 1969404 - protein, 6 aa, Staphylococcus
NNETEK

SEQ ID NO: 1969405 - protein, 9 aa, Staphylococcus
NNETGEITQ

SEQ ID NO: 1969406 - protein, 5 aa, Staphylococcus
NNETW

SEQ ID NO: 1969407 - protein, 7 aa, Staphylococcus
NNETYQG

SEQ ID NO: 1969408 - protein, 12 aa, Staphylococcus
NNEYQNKKTYYE

SEQ ID NO: 1969409 - protein, 10 aa, Staphylococcus
NNEYSKDLSR

SEQ ID NO: 1969410 - protein, 20 aa, Staphylococcus
NNFDEAGQQRIRLQDINRAR

SEQ ID NO: 1969411 - protein, 6 aa, Staphylococcus
NNFDNK

SEQ ID NO: 1969412 - protein, 7 aa, Staphylococcus
NNFDNKQ

SEQ ID NO: 1969413 - protein, 7 aa, Staphylococcus
NNFEDDD

SEQ ID NO: 1969414 - protein, 7 aa, Staphylococcus
NNFENKQ

SEQ ID NO: 1969415 - protein, 12 aa, Staphylococcus
NNFGPKAKDEVN

SEQ ID NO: 1969416 - protein, 12 aa, Staphylococcus
NNFGPKSKDEVN

SEQ ID NO: 1969417 - protein, 10 aa, Staphylococcus
NNFKNSDEAF

SEQ ID NO: 1969418 - protein, 7 aa, Staphylococcus
NNFKPDG

SEQ ID NO: 1969419 - protein, 12 aa, Staphylococcus
NNFPRQVKSQSE

SEQ ID NO: 1969420 - protein, 9 aa, Staphylococcus
NNFQDSEAA

SEQ ID NO: 1969421 - protein, 9 aa, Staphylococcus
NNFQPPAEA

SEQ ID NO: 1969422 - protein, 5 aa, Staphylococcus
NNGAD

SEQ ID NO: 1969423 - protein, 11 aa, Staphylococcus
NNGDAEKYDQL

SEQ ID NO: 1969424 - protein, 6 aa, Staphylococcus
NNGDIP

SEQ ID NO: 1969425 - protein, 8 aa, Staphylococcus
NNGDTEKV

SEQ ID NO: 1969426 - protein, 16 aa, Staphylococcus
NNGDTSTKNRSNESNW

SEQ ID NO: 1969427 - protein, 6 aa, Staphylococcus
NNGEDI

SEQ ID NO: 1969428 - protein, 6 aa, Staphylococcus
NNGEKI

SEQ ID NO: 1969429 - protein, 17 aa, Staphylococcus
NNGELSSGDKLPSQREI

SEQ ID NO: 1969430 - protein, 8 aa, Staphylococcus
NNGENYKL

SEQ ID NO: 1969431 - protein, 9 aa, Staphylococcus
NNGGATSFV

SEQ ID NO: 1969432 - protein, 6 aa, Staphylococcus
NNGITQ

SEQ ID NO: 1969433 - protein, 4 aa, Staphylococcus
NNGK

SEQ ID NO: 1969434 - protein, 5 aa, Staphylococcus
NNGKP

SEQ ID NO: 1969435 - protein, 9 aa, Staphylococcus
NNGKRPVLT

SEQ ID NO: 1969436 - protein, 7 aa, Staphylococcus
NNGKTTL

SEQ ID NO: 1969437 - protein, 11 aa, Staphylococcus
NNGLDNKTPYY

SEQ ID NO: 1969438 - protein, 6 aa, Staphylococcus
NNGLSD

SEQ ID NO: 1969439 - protein, 5 aa, Staphylococcus
NNGNM

SEQ ID NO: 1969440 - protein, 10 aa, Staphylococcus
NNGPDSEGTL

SEQ ID NO: 1969441 - protein, 9 aa, Staphylococcus
NNGPDSVGT

SEQ ID NO: 1969442 - protein, 7 aa, Staphylococcus
NNGQTTS

SEQ ID NO: 1969443 - protein, 6 aa, Staphylococcus
NNGRYS

SEQ ID NO: 1969444 - protein, 5 aa, Staphylococcus
NNGSK

SEQ ID NO: 1969445 - protein, 10 aa, Staphylococcus
NNGSVSPKTR

SEQ ID NO: 1969446 - protein, 14 aa, Staphylococcus
NNGSVSTKTKEKLS

SEQ ID NO: 1969447 - protein, 7 aa, Staphylococcus
NNGSYRR

SEQ ID NO: 1969448 - protein, 7 aa, Staphylococcus
NNGTYQR

SEQ ID NO: 1969449 - protein, 8 aa, Staphylococcus
NNGVKVPE

SEQ ID NO: 1969450 - protein, 7 aa, Staphylococcus
NNGVPED

SEQ ID NO: 1969451 - protein, 7 aa, Staphylococcus
NNGYAEY

SEQ ID NO: 1969452 - protein, 5 aa, Staphylococcus
NNGYD

SEQ ID NO: 1969453 - protein, 6 aa, Staphylococcus
NNGYET

SEQ ID NO: 1969454 - protein, 4 aa, Staphylococcus
NNHA

SEQ ID NO: 1969455 - protein, 15 aa, Staphylococcus
NNHDDHGERLFFVAF

SEQ ID NO: 1969456 - protein, 19 aa, Staphylococcus
NNHDELDNNPFKDALKNLK

SEQ ID NO: 1969457 - protein, 14 aa, Staphylococcus
NNHDTTIRINMVIH

SEQ ID NO: 1969458 - protein, 6 aa, Staphylococcus
NNHDYS

SEQ ID NO: 1969459 - protein, 7 aa, Staphylococcus
NNHENKQ

SEQ ID NO: 1969460 - protein, 4 aa, Staphylococcus
NNHP

SEQ ID NO: 1969461 - protein, 7 aa, Staphylococcus
NNHPAKL

SEQ ID NO: 1969462 - protein, 6 aa, Staphylococcus
NNHPVA

SEQ ID NO: 1969463 - protein, 6 aa, Staphylococcus
NNHQKR

SEQ ID NO: 1969464 - protein, 7 aa, Staphylococcus
NNHRSPN

SEQ ID NO: 1969465 - protein, 14 aa, Staphylococcus
NNHSKALDKSYHQT

SEQ ID NO: 1969466 - protein, 4 aa, Staphylococcus
NNIA

SEQ ID NO: 1969467 - protein, 8 aa, Staphylococcus
NNIDKSKS

SEQ ID NO: 1969468 - protein, 8 aa, Staphylococcus
NNIENRKQ

SEQ ID NO: 1969469 - protein, 12 aa, Staphylococcus
NNIEVTTSPELL

SEQ ID NO: 1969470 - protein, 11 aa, Staphylococcus
NNIEVTTSTEL

SEQ ID NO: 1969471 - protein, 9 aa, Staphylococcus
NNIHEYGND

SEQ ID NO: 1969472 - protein, 4 aa, Staphylococcus
NNIK

SEQ ID NO: 1969473 - protein, 21 aa, Staphylococcus
NNINETEKSYKISKKALTEAE

SEQ ID NO: 1969474 - protein, 4 aa, Staphylococcus
NNIQ

SEQ ID NO: 1969475 - protein, 6 aa, Staphylococcus
NNIQPM

SEQ ID NO: 1969476 - protein, 13 aa, Staphylococcus
NNIQVSKDISEKY

SEQ ID NO: 1969477 - protein, 8 aa, Staphylococcus
NNISDEEW

SEQ ID NO: 1969478 - protein, 7 aa, Staphylococcus
NNITPNT

SEQ ID NO: 1969479 - protein, 22 aa, Staphylococcus
NNIYSPSTGYTGGSIVGSVLVD

SEQ ID NO: 1969480 - protein, 13 aa, Staphylococcus
NNKAKKDSSPNVV

SEQ ID NO: 1969481 - protein, 10 aa, Staphylococcus
NNKASNYTKE

SEQ ID NO: 1969482 - protein, 15 aa, Staphylococcus
NNKDDVGSGAYDHNG

SEQ ID NO: 1969483 - protein, 9 aa, Staphylococcus
NNKDEISLP

SEQ ID NO: 1969484 - protein, 6 aa, Staphylococcus
NNKDKK

SEQ ID NO: 1969485 - protein, 7 aa, Staphylococcus
NNKDRIK

SEQ ID NO: 1969486 - protein, 7 aa, Staphylococcus
NNKDYQE

SEQ ID NO: 1969487 - protein, 7 aa, Staphylococcus
NNKEAIE

SEQ ID NO: 1969488 - protein, 7 aa, Staphylococcus
NNKEDRQ

SEQ ID NO: 1969489 - protein, 10 aa, Staphylococcus
NNKEKQEVEQ

SEQ ID NO: 1969490 - protein, 6 aa, Staphylococcus
NNKEQF

SEQ ID NO: 1969491 - protein, 5 aa, Staphylococcus
NNKER

SEQ ID NO: 1969492 - protein, 7 aa, Staphylococcus
NNKERIK

SEQ ID NO: 1969493 - protein, 6 aa, Staphylococcus
NNKERL

SEQ ID NO: 1969494 - protein, 7 aa, Staphylococcus
NNKERVK

SEQ ID NO: 1969495 - protein, 7 aa, Staphylococcus
NNKGNEL

SEQ ID NO: 1969496 - protein, 6 aa, Staphylococcus
NNKGVH

SEQ ID NO: 1969497 - protein, 5 aa, Staphylococcus
NNKIN

SEQ ID NO: 1969498 - protein, 11 aa, Staphylococcus
NNKKDKKESAR

SEQ ID NO: 1969499 - protein, 8 aa, Staphylococcus
NNKKTPKD

SEQ ID NO: 1969500 - protein, 4 aa, Staphylococcus
NNKL

SEQ ID NO: 1969501 - protein, 7 aa, Staphylococcus
NNKLSQA

SEQ ID NO: 1969502 - protein, 12 aa, Staphylococcus
NNKNYQNSKDWS

SEQ ID NO: 1969503 - protein, 10 aa, Staphylococcus
NNKQKRDSNV

SEQ ID NO: 1969504 - protein, 10 aa, Staphylococcus
NNKQKRGPNV

SEQ ID NO: 1969505 - protein, 10 aa, Staphylococcus
NNKQKRNPDV

SEQ ID NO: 1969506 - protein, 15 aa, Staphylococcus
NNKQNFEITDGQDTY

SEQ ID NO: 1969507 - protein, 10 aa, Staphylococcus
NNKRSDDKDY

SEQ ID NO: 1969508 - protein, 15 aa, Staphylococcus
NNKSSELSDKTKDKV

SEQ ID NO: 1969509 - protein, 5 aa, Staphylococcus
NNKSY

SEQ ID NO: 1969510 - protein, 8 aa, Staphylococcus
NNKTGEIV

SEQ ID NO: 1969511 - protein, 9 aa, Staphylococcus
NNKTITSNG

SEQ ID NO: 1969512 - protein, 8 aa, Staphylococcus
NNKTKHEI

SEQ ID NO: 1969513 - protein, 8 aa, Staphylococcus
NNKTKREI

SEQ ID NO: 1969514 - protein, 15 aa, Staphylococcus
NNKTNRNSRENQSNW

SEQ ID NO: 1969515 - protein, 17 aa, Staphylococcus
NNKTYFNPGSVGLNNGK

SEQ ID NO: 1969516 - protein, 4 aa, Staphylococcus
NNKW

SEQ ID NO: 1969517 - protein, 4 aa, Staphylococcus
NNKY

SEQ ID NO: 1969518 - protein, 16 aa, Staphylococcus
NNLDNNSNVSLANQNT

SEQ ID NO: 1969519 - protein, 12 aa, Staphylococcus
NNLEDSKKEIQY

SEQ ID NO: 1969520 - protein, 9 aa, Staphylococcus
NNLEEGARV

SEQ ID NO: 1969521 - protein, 9 aa, Staphylococcus
NNLEKTSYL

SEQ ID NO: 1969522 - protein, 7 aa, Staphylococcus
NNLNDKQ

SEQ ID NO: 1969523 - protein, 6 aa, Staphylococcus
NNLNTN

SEQ ID NO: 1969524 - protein, 5 aa, Staphylococcus
NNLPD

SEQ ID NO: 1969525 - protein, 8 aa, Staphylococcus
NNLPEVPK

SEQ ID NO: 1969526 - protein, 8 aa, Staphylococcus
NNLPHAPT

SEQ ID NO: 1969527 - protein, 10 aa, Staphylococcus
NNLPKEPYEG

SEQ ID NO: 1969528 - protein, 6 aa, Staphylococcus
NNLPSL

SEQ ID NO: 1969529 - protein, 4 aa, Staphylococcus
NNLR

SEQ ID NO: 1969530 - protein, 18 aa, Staphylococcus
NNLSEEEKEKIDSIQSQL

SEQ ID NO: 1969531 - protein, 8 aa, Staphylococcus
NNLSNPYK

SEQ ID NO: 1969532 - protein, 8 aa, Staphylococcus
NNLSNTSA

SEQ ID NO: 1969533 - protein, 8 aa, Staphylococcus
NNLSPTNT

SEQ ID NO: 1969534 - protein, 9 aa, Staphylococcus
NNLSSKEIA

SEQ ID NO: 1969535 - protein, 14 aa, Staphylococcus
NNLSTSYQNEDGTL

SEQ ID NO: 1969536 - protein, 7 aa, Staphylococcus
NNMIGTP

SEQ ID NO: 1969537 - protein, 4 aa, Staphylococcus
NNMP

SEQ ID NO: 1969538 - protein, 9 aa, Staphylococcus
NNNANEAAT

SEQ ID NO: 1969539 - protein, 9 aa, Staphylococcus
NNNANKAAE

SEQ ID NO: 1969540 - protein, 9 aa, Staphylococcus
NNNANTAAG

SEQ ID NO: 1969541 - protein, 15 aa, Staphylococcus
NNNDEIEETAQGETV

SEQ ID NO: 1969542 - protein, 8 aa, Staphylococcus
NNNDVNTK

SEQ ID NO: 1969543 - protein, 4 aa, Staphylococcus
NNNE

SEQ ID NO: 1969544 - protein, 7 aa, Staphylococcus
NNNECQQ

SEQ ID NO: 1969545 - protein, 12 aa, Staphylococcus
NNNEDRVSSFSK

SEQ ID NO: 1969546 - protein, 12 aa, Staphylococcus
NNNEERVSSFSK

SEQ ID NO: 1969547 - protein, 8 aa, Staphylococcus
NNNEKNKI

SEQ ID NO: 1969548 - protein, 6 aa, Staphylococcus
NNNEKY

SEQ ID NO: 1969549 - protein, 8 aa, Staphylococcus
NNNEPTHF

SEQ ID NO: 1969550 - protein, 9 aa, Staphylococcus
NNNEQRVAS

SEQ ID NO: 1969551 - protein, 10 aa, Staphylococcus
NNNEQRVGEF

SEQ ID NO: 1969552 - protein, 10 aa, Staphylococcus
NNNEQRVGNF

SEQ ID NO: 1969553 - protein, 8 aa, Staphylococcus
NNNEQSQV

SEQ ID NO: 1969554 - protein, 7 aa, Staphylococcus
NNNGGYT

SEQ ID NO: 1969555 - protein, 7 aa, Staphylococcus
NNNISQD

SEQ ID NO: 1969556 - protein, 19 aa, Staphylococcus
NNNKDELKKAKSLIEKAEG

SEQ ID NO: 1969557 - protein, 7 aa, Staphylococcus
NNNKDRK

SEQ ID NO: 1969558 - protein, 9 aa, Staphylococcus
NNNKENKQF

SEQ ID NO: 1969559 - protein, 22 aa, Staphylococcus
NNNKKQIEQRKQKLQEYKNSSI

SEQ ID NO: 1969560 - protein, 13 aa, Staphylococcus
NNNKNEVKKAKEL

SEQ ID NO: 1969561 - protein, 9 aa, Staphylococcus
NNNKNFQPM

SEQ ID NO: 1969562 - protein, 7 aa, Staphylococcus
NNNKVSD

SEQ ID NO: 1969563 - protein, 8 aa, Staphylococcus
NNNLGRDV

SEQ ID NO: 1969564 - protein, 5 aa, Staphylococcus
NNNLM

SEQ ID NO: 1969565 - protein, 4 aa, Staphylococcus
NNNN

SEQ ID NO: 1969566 - protein, 9 aa, Staphylococcus
NNNNNEDSR

SEQ ID NO: 1969567 - protein, 7 aa, Staphylococcus
NNNNRKS

SEQ ID NO: 1969568 - protein, 5 aa, Staphylococcus
NNNPM

SEQ ID NO: 1969569 - protein, 10 aa, Staphylococcus
NNNPPKDEDY

SEQ ID NO: 1969570 - protein, 6 aa, Staphylococcus
NNNPTT

SEQ ID NO: 1969571 - protein, 5 aa, Staphylococcus
NNNQK

SEQ ID NO: 1969572 - protein, 4 aa, Staphylococcus
NNNR

SEQ ID NO: 1969573 - protein, 5 aa, Staphylococcus
NNNRE

SEQ ID NO: 1969574 - protein, 17 aa, Staphylococcus
NNNSEKTEQVEKYVEVI

SEQ ID NO: 1969575 - protein, 6 aa, Staphylococcus
NNNSVR

SEQ ID NO: 1969576 - protein, 7 aa, Staphylococcus
NNNTERT

SEQ ID NO: 1969577 - protein, 11 aa, Staphylococcus
NNNTKKRGNID

SEQ ID NO: 1969578 - protein, 8 aa, Staphylococcus
NNNTSGHV

SEQ ID NO: 1969579 - protein, 4 aa, Staphylococcus
NNNY

SEQ ID NO: 1969580 - protein, 6 aa, Staphylococcus
NNPDKP

SEQ ID NO: 1969581 - protein, 6 aa, Staphylococcus
NNPDVV

SEQ ID NO: 1969582 - protein, 7 aa, Staphylococcus
NNPEKEL

SEQ ID NO: 1969583 - protein, 9 aa, Staphylococcus
NNPETTSQP

SEQ ID NO: 1969584 - protein, 6 aa, Staphylococcus
NNPFGI

SEQ ID NO: 1969585 - protein, 6 aa, Staphylococcus
NNPKGE

SEQ ID NO: 1969586 - protein, 7 aa, Staphylococcus
NNPKHDI

SEQ ID NO: 1969587 - protein, 18 aa, Staphylococcus
NNPKHDITIEEDSDNLDG

SEQ ID NO: 1969588 - protein, 18 aa, Staphylococcus
NNPKPVSEIKKEQNKKED

SEQ ID NO: 1969589 - protein, 7 aa, Staphylococcus
NNPKTAI

SEQ ID NO: 1969590 - protein, 14 aa, Staphylococcus
NNPNEATKLINQLF

SEQ ID NO: 1969591 - protein, 8 aa, Staphylococcus
NNPNGSFN

SEQ ID NO: 1969592 - protein, 9 aa, Staphylococcus
NNPNIKNAS

SEQ ID NO: 1969593 - protein, 15 aa, Staphylococcus
NNPNLSDEVTRVGRG

SEQ ID NO: 1969594 - protein, 4 aa, Staphylococcus
NNPQ

SEQ ID NO: 1969595 - protein, 5 aa, Staphylococcus
NNPQA

SEQ ID NO: 1969596 - protein, 7 aa, Staphylococcus
NNPQDKI

SEQ ID NO: 1969597 - protein, 6 aa, Staphylococcus
NNPQQH

SEQ ID NO: 1969598 - protein, 6 aa, Staphylococcus
NNPSAI

SEQ ID NO: 1969599 - protein, 7 aa, Staphylococcus
NNPSFKH

SEQ ID NO: 1969600 - protein, 5 aa, Staphylococcus
NNPSH

SEQ ID NO: 1969601 - protein, 5 aa, Staphylococcus
NNPTA

SEQ ID NO: 1969602 - protein, 9 aa, Staphylococcus
NNPYLSPKR

SEQ ID NO: 1969603 - protein, 10 aa, Staphylococcus
NNQDDSDRVQ

SEQ ID NO: 1969604 - protein, 14 aa, Staphylococcus
NNQEQENYDFTQES

SEQ ID NO: 1969605 - protein, 36 aa, Staphylococcus
NNQGGGPHYYPNNQGVYDSQPEFKKPSFPVDGDGYE

SEQ ID NO: 1969606 - protein, 35 aa, Staphylococcus
NNQGGSTHYYPNSEGAFEDQPEFKKPGLKVEGEAY

SEQ ID NO: 1969607 - protein, 15 aa, Staphylococcus
NNQGHLTTDEQETRK

SEQ ID NO: 1969608 - protein, 12 aa, Staphylococcus
NNQKSDASPEIA

SEQ ID NO: 1969609 - protein, 6 aa, Staphylococcus
NNQKVA

SEQ ID NO: 1969610 - protein, 9 aa, Staphylococcus
NNQLDEDYK

SEQ ID NO: 1969611 - protein, 7 aa, Staphylococcus
NNQLNKK

SEQ ID NO: 1969612 - protein, 11 aa, Staphylococcus
NNQLNTDNELN

SEQ ID NO: 1969613 - protein, 9 aa, Staphylococcus
NNQLSKEDV

SEQ ID NO: 1969614 - protein, 17 aa, Staphylococcus
NNQNETYQLSNKITLER

SEQ ID NO: 1969615 - protein, 8 aa, Staphylococcus
NNQNHKPL

SEQ ID NO: 1969616 - protein, 8 aa, Staphylococcus
NNQNTTEY

SEQ ID NO: 1969617 - protein, 5 aa, Staphylococcus
NNQPH

SEQ ID NO: 1969618 - protein, 20 aa, Staphylococcus
NNQPLEKGSTLTLSNEVKEK

SEQ ID NO: 1969619 - protein, 7 aa, Staphylococcus
NNQPLPN

SEQ ID NO: 1969620 - protein, 12 aa, Staphylococcus
NNQREQNRLDKE

SEQ ID NO: 1969621 - protein, 6 aa, Staphylococcus
NNQRIN

SEQ ID NO: 1969622 - protein, 8 aa, Staphylococcus
NNQSADEF

SEQ ID NO: 1969623 - protein, 6 aa, Staphylococcus
NNQSQI

SEQ ID NO: 1969624 - protein, 4 aa, Staphylococcus
NNQT

SEQ ID NO: 1969625 - protein, 7 aa, Staphylococcus
NNQTPFT

SEQ ID NO: 1969626 - protein, 8 aa, Staphylococcus
NNQTRYKN

SEQ ID NO: 1969627 - protein, 7 aa, Staphylococcus
NNQTYQA

SEQ ID NO: 1969628 - protein, 11 aa, Staphylococcus
NNQVSENEQSY

SEQ ID NO: 1969629 - protein, 7 aa, Staphylococcus
NNQVVDD

SEQ ID NO: 1969630 - protein, 13 aa, Staphylococcus
NNQWDDKYPAREH

SEQ ID NO: 1969631 - protein, 13 aa, Staphylococcus
NNQYGENCMILTF

SEQ ID NO: 1969632 - protein, 4 aa, Staphylococcus
NNRD

SEQ ID NO: 1969633 - protein, 4 aa, Staphylococcus
NNRE

SEQ ID NO: 1969634 - protein, 8 aa, Staphylococcus
NNREEISV

SEQ ID NO: 1969635 - protein, 4 aa, Staphylococcus
NNRK

SEQ ID NO: 1969636 - protein, 10 aa, Staphylococcus
NNRKKDYTPW

SEQ ID NO: 1969637 - protein, 7 aa, Staphylococcus
NNRKLDK

SEQ ID NO: 1969638 - protein, 4 aa, Staphylococcus
NNRL

SEQ ID NO: 1969639 - protein, 4 aa, Staphylococcus
NNRN

SEQ ID NO: 1969640 - protein, 10 aa, Staphylococcus
NNRNGDFNEN

SEQ ID NO: 1969641 - protein, 6 aa, Staphylococcus
NNRNTF

SEQ ID NO: 1969642 - protein, 8 aa, Staphylococcus
NNRQAQID

SEQ ID NO: 1969643 - protein, 7 aa, Staphylococcus
NNSAISE

SEQ ID NO: 1969644 - protein, 9 aa, Staphylococcus
NNSDERISN

SEQ ID NO: 1969645 - protein, 16 aa, Staphylococcus
NNSDIPPPNNTQWQGR

SEQ ID NO: 1969646 - protein, 10 aa, Staphylococcus
NNSDKPEELK

SEQ ID NO: 1969647 - protein, 8 aa, Staphylococcus
NNSEEASD

SEQ ID NO: 1969648 - protein, 6 aa, Staphylococcus
NNSENE

SEQ ID NO: 1969649 - protein, 7 aa, Staphylococcus
NNSENKH

SEQ ID NO: 1969650 - protein, 6 aa, Staphylococcus
NNSETP

SEQ ID NO: 1969651 - protein, 15 aa, Staphylococcus
NNSGGHAAKNAKTYQ

SEQ ID NO: 1969652 - protein, 15 aa, Staphylococcus
NNSGGHAAQNAKTYQ

SEQ ID NO: 1969653 - protein, 8 aa, Staphylococcus
NNSHIGSQ

SEQ ID NO: 1969654 - protein, 4 aa, Staphylococcus
NNSK

SEQ ID NO: 1969655 - protein, 6 aa, Staphylococcus
NNSKAL

SEQ ID NO: 1969656 - protein, 6 aa, Staphylococcus
NNSKQN

SEQ ID NO: 1969657 - protein, 8 aa, Staphylococcus
NNSKRDIL

SEQ ID NO: 1969658 - protein, 5 aa, Staphylococcus
NNSNY

SEQ ID NO: 1969659 - protein, 16 aa, Staphylococcus
NNSQGVPTKYISPKDA

SEQ ID NO: 1969660 - protein, 9 aa, Staphylococcus
NNSQGVPTT

SEQ ID NO: 1969661 - protein, 10 aa, Staphylococcus
NNSQPKLKPE

SEQ ID NO: 1969662 - protein, 8 aa, Staphylococcus
NNSSIPEK

SEQ ID NO: 1969663 - protein, 10 aa, Staphylococcus
NNSSLLTSSA

SEQ ID NO: 1969664 - protein, 6 aa, Staphylococcus
NNSSNI

SEQ ID NO: 1969665 - protein, 9 aa, Staphylococcus
NNSSPLNSQ

SEQ ID NO: 1969666 - protein, 5 aa, Staphylococcus
NNSTA

SEQ ID NO: 1969667 - protein, 12 aa, Staphylococcus
NNSTKEPEEVAS

SEQ ID NO: 1969668 - protein, 10 aa, Staphylococcus
NNSTKTPDQV

SEQ ID NO: 1969669 - protein, 12 aa, Staphylococcus
NNSTKTPEEVTA

SEQ ID NO: 1969670 - protein, 13 aa, Staphylococcus
NNSTKTPEEVTEK

SEQ ID NO: 1969671 - protein, 12 aa, Staphylococcus
NNSTKTPEEVTQ

SEQ ID NO: 1969672 - protein, 10 aa, Staphylococcus
NNSTKTPEQV

SEQ ID NO: 1969673 - protein, 11 aa, Staphylococcus
NNSTNGGFTEG

SEQ ID NO: 1969674 - protein, 8 aa, Staphylococcus
NNSTPRLV

SEQ ID NO: 1969675 - protein, 13 aa, Staphylococcus
NNSVKELETLLTE

SEQ ID NO: 1969676 - protein, 7 aa, Staphylococcus
NNSVSYD

SEQ ID NO: 1969677 - protein, 5 aa, Staphylococcus
NNSVT

SEQ ID NO: 1969678 - protein, 6 aa, Staphylococcus
NNSYEK

SEQ ID NO: 1969679 - protein, 4 aa, Staphylococcus
NNTD

SEQ ID NO: 1969680 - protein, 7 aa, Staphylococcus
NNTDSSN

SEQ ID NO: 1969681 - protein, 5 aa, Staphylococcus
NNTDY

SEQ ID NO: 1969682 - protein, 19 aa, Staphylococcus
NNTEEIDNNPFKDALKNLK

SEQ ID NO: 1969683 - protein, 6 aa, Staphylococcus
NNTELR

SEQ ID NO: 1969684 - protein, 6 aa, Staphylococcus
NNTETK

SEQ ID NO: 1969685 - protein, 9 aa, Staphylococcus
NNTEYKNAK

SEQ ID NO: 1969686 - protein, 7 aa, Staphylococcus
NNTFNKD

SEQ ID NO: 1969687 - protein, 10 aa, Staphylococcus
NNTGGFKTVK

SEQ ID NO: 1969688 - protein, 10 aa, Staphylococcus
NNTGGFKTVS

SEQ ID NO: 1969689 - protein, 14 aa, Staphylococcus
NNTGQDANSTNDPF

SEQ ID NO: 1969690 - protein, 6 aa, Staphylococcus
NNTINQ

SEQ ID NO: 1969691 - protein, 12 aa, Staphylococcus
NNTKIKTDDNGN

SEQ ID NO: 1969692 - protein, 11 aa, Staphylococcus
NNTKIKTNKAG

SEQ ID NO: 1969693 - protein, 8 aa, Staphylococcus
NNTKNETR

SEQ ID NO: 1969694 - protein, 17 aa, Staphylococcus
NNTKNKNHLQSTVKEKS

SEQ ID NO: 1969695 - protein, 9 aa, Staphylococcus
NNTLDSKEF

SEQ ID NO: 1969696 - protein, 5 aa, Staphylococcus
NNTND

SEQ ID NO: 1969697 - protein, 6 aa, Staphylococcus
NNTPAL

SEQ ID NO: 1969698 - protein, 5 aa, Staphylococcus
NNTPF

SEQ ID NO: 1969699 - protein, 8 aa, Staphylococcus
NNTSNYSN

SEQ ID NO: 1969700 - protein, 7 aa, Staphylococcus
NNTTGGN

SEQ ID NO: 1969701 - protein, 11 aa, Staphylococcus
NNTTKVLTEKA

SEQ ID NO: 1969702 - protein, 4 aa, Staphylococcus
NNVA

SEQ ID NO: 1969703 - protein, 18 aa, Staphylococcus
NNVEIKEESTVSSIEYTD

SEQ ID NO: 1969704 - protein, 4 aa, Staphylococcus
NNVG

SEQ ID NO: 1969705 - protein, 6 aa, Staphylococcus
NNVGRQ

SEQ ID NO: 1969706 - protein, 11 aa, Staphylococcus
NNVIDKNDDDI

SEQ ID NO: 1969707 - protein, 14 aa, Staphylococcus
NNVIEDEYKSPKFQ

SEQ ID NO: 1969708 - protein, 4 aa, Staphylococcus
NNVK

SEQ ID NO: 1969709 - protein, 14 aa, Staphylococcus
NNVKDSWPDYENGN

SEQ ID NO: 1969710 - protein, 8 aa, Staphylococcus
NNVKPGAD

SEQ ID NO: 1969711 - protein, 11 aa, Staphylococcus
NNVNRTASDVR

SEQ ID NO: 1969712 - protein, 24 aa, Staphylococcus
NNVNRTASDVRAAFGKNGGNMGVS

SEQ ID NO: 1969713 - protein, 25 aa, Staphylococcus
NNVNRTASDVRAAFGKNGGNMGVSG

SEQ ID NO: 1969714 - protein, 29 aa, Staphylococcus
NNVQGCSDAGSMPDKFPGYQGVEDDEVRA

SEQ ID NO: 1969715 - protein, 27 aa, Staphylococcus
NNVQGCSDMGSMPDQFPGYQKVTDDEI

SEQ ID NO: 1969716 - protein, 17 aa, Staphylococcus
NNVQGCSDMGSMPDQFT

SEQ ID NO: 1969717 - protein, 8 aa, Staphylococcus
NNVQNNKE

SEQ ID NO: 1969718 - protein, 6 aa, Staphylococcus
NNVRKE

SEQ ID NO: 1969719 - protein, 5 aa, Staphylococcus
NNVSA

SEQ ID NO: 1969720 - protein, 5 aa, Staphylococcus
NNVTA

SEQ ID NO: 1969721 - protein, 22 aa, Staphylococcus
NNVTTTEESKKIREQFNKPSMT

SEQ ID NO: 1969722 - protein, 12 aa, Staphylococcus
NNWNTANQPQLT

SEQ ID NO: 1969723 - protein, 11 aa, Staphylococcus
NNYENKQYRKN

SEQ ID NO: 1969724 - protein, 6 aa, Staphylococcus
NNYEVR

SEQ ID NO: 1969725 - protein, 8 aa, Staphylococcus
NNYGDQLR

SEQ ID NO: 1969726 - protein, 5 aa, Staphylococcus
NNYKE

SEQ ID NO: 1969727 - protein, 5 aa, Staphylococcus
NNYNL

SEQ ID NO: 1969728 - protein, 5 aa, Staphylococcus
NNYNV

SEQ ID NO: 1969729 - protein, 21 aa, Staphylococcus
NNYQDTNTTLSNHENEQGFTS

SEQ ID NO: 1969730 - protein, 6 aa, Staphylococcus
NNYSEI

SEQ ID NO: 1969731 - protein, 6 aa, Staphylococcus
NNYVTS

SEQ ID NO: 1969732 - protein, 7 aa, Staphylococcus
NNYYAGQ

SEQ ID NO: 1969733 - protein, 10 aa, Staphylococcus
NPAGAVSKEI

SEQ ID NO: 1969734 - protein, 13 aa, Staphylococcus
NPAIAEKNKVSGS

SEQ ID NO: 1969735 - protein, 7 aa, Staphylococcus
NPAIREE

SEQ ID NO: 1969736 - protein, 13 aa, Staphylococcus
NPAKIQSKGIKSV

SEQ ID NO: 1969737 - protein, 8 aa, Staphylococcus
NPAKNEYP

SEQ ID NO: 1969738 - protein, 22 aa, Staphylococcus
NPAKRKQHWANKKYETSFQPDN

SEQ ID NO: 1969739 - protein, 4 aa, Staphylococcus
NPAN

SEQ ID NO: 1969740 - protein, 8 aa, Staphylococcus
NPANNEYP

SEQ ID NO: 1969741 - protein, 10 aa, Staphylococcus
NPAPAEKLPE

SEQ ID NO: 1969742 - protein, 8 aa, Staphylococcus
NPATGEKF

SEQ ID NO: 1969743 - protein, 8 aa, Staphylococcus
NPATGETI

SEQ ID NO: 1969744 - protein, 5 aa, Staphylococcus
NPATN

SEQ ID NO: 1969745 - protein, 4 aa, Staphylococcus
NPAV

SEQ ID NO: 1969746 - protein, 6 aa, Staphylococcus
NPCPEN

SEQ ID NO: 1969747 - protein, 9 aa, Staphylococcus
NPDDERYKD

SEQ ID NO: 1969748 - protein, 5 aa, Staphylococcus
NPDEY

SEQ ID NO: 1969749 - protein, 7 aa, Staphylococcus
NPDFKDY

SEQ ID NO: 1969750 - protein, 9 aa, Staphylococcus
NPDGTKGQL

SEQ ID NO: 1969751 - protein, 4 aa, Staphylococcus
NPDH

SEQ ID NO: 1969752 - protein, 13 aa, Staphylococcus
NPDKFKNANQQDI

SEQ ID NO: 1969753 - protein, 9 aa, Staphylococcus
NPDNGDEYV

SEQ ID NO: 1969754 - protein, 10 aa, Staphylococcus
NPDNPSPDGF

SEQ ID NO: 1969755 - protein, 7 aa, Staphylococcus
NPDNQVK

SEQ ID NO: 1969756 - protein, 29 aa, Staphylococcus
NPDPEIKPNDAKEAGAKVVGTGRSDFPNQ

SEQ ID NO: 1969757 - protein, 4 aa, Staphylococcus
NPDT

SEQ ID NO: 1969758 - protein, 9 aa, Staphylococcus
NPDTKETNV

SEQ ID NO: 1969759 - protein, 20 aa, Staphylococcus
NPDTKEVTRPFKSKKENPAA

SEQ ID NO: 1969760 - protein, 4 aa, Staphylococcus
NPDW

SEQ ID NO: 1969761 - protein, 6 aa, Staphylococcus
NPEAEE

SEQ ID NO: 1969762 - protein, 7 aa, Staphylococcus
NPEAGGD

SEQ ID NO: 1969763 - protein, 5 aa, Staphylococcus
NPEAL

SEQ ID NO: 1969764 - protein, 5 aa, Staphylococcus
NPEDS

SEQ ID NO: 1969765 - protein, 7 aa, Staphylococcus
NPEEAVK

SEQ ID NO: 1969766 - protein, 6 aa, Staphylococcus
NPEEGV

SEQ ID NO: 1969767 - protein, 7 aa, Staphylococcus
NPEELSS

SEQ ID NO: 1969768 - protein, 8 aa, Staphylococcus
NPEENAYS

SEQ ID NO: 1969769 - protein, 7 aa, Staphylococcus
NPEENYV

SEQ ID NO: 1969770 - protein, 13 aa, Staphylococcus
NPEHIQSRFAVFA

SEQ ID NO: 1969771 - protein, 4 aa, Staphylococcus
NPEI

SEQ ID NO: 1969772 - protein, 5 aa, Staphylococcus
NPEIR

SEQ ID NO: 1969773 - protein, 14 aa, Staphylococcus
NPEKFKDTDTKDIK

SEQ ID NO: 1969774 - protein, 18 aa, Staphylococcus
NPEKNEYPQALNSTGRDE

SEQ ID NO: 1969775 - protein, 5 aa, Staphylococcus
NPEKY

SEQ ID NO: 1969776 - protein, 8 aa, Staphylococcus
NPELDAQG

SEQ ID NO: 1969777 - protein, 4 aa, Staphylococcus
NPEM

SEQ ID NO: 1969778 - protein, 4 aa, Staphylococcus
NPEN

SEQ ID NO: 1969779 - protein, 13 aa, Staphylococcus
NPENETYIITGYK

SEQ ID NO: 1969780 - protein, 5 aa, Staphylococcus
NPENI

SEQ ID NO: 1969781 - protein, 9 aa, Staphylococcus
NPENNDSTH

SEQ ID NO: 1969782 - protein, 7 aa, Staphylococcus
NPENNEY

SEQ ID NO: 1969783 - protein, 94 aa, Staphylococcus
NPENSEDEAYASYTDTQASHAEERSQEANFQQDNRRHRRRRNFEENSNSEQSDFRSSRSSRSRYSQKQHNNANEPSHTSNKRRVQNYTSTYDTK

SEQ ID NO: 1969784 - protein, 8 aa, Staphylococcus
NPENTSIK

SEQ ID NO: 1969785 - protein, 6 aa, Staphylococcus
NPERSN

SEQ ID NO: 1969786 - protein, 6 aa, Staphylococcus
NPESKI

SEQ ID NO: 1969787 - protein, 13 aa, Staphylococcus
NPESSTAADSRMG

SEQ ID NO: 1969788 - protein, 10 aa, Staphylococcus
NPESTPEDFH

SEQ ID NO: 1969789 - protein, 4 aa, Staphylococcus
NPET

SEQ ID NO: 1969790 - protein, 13 aa, Staphylococcus
NPETDEIEYKNTQ

SEQ ID NO: 1969791 - protein, 6 aa, Staphylococcus
NPETGE

SEQ ID NO: 1969792 - protein, 11 aa, Staphylococcus
NPETGVTGQQQ

SEQ ID NO: 1969793 - protein, 5 aa, Staphylococcus
NPETV

SEQ ID NO: 1969794 - protein, 4 aa, Staphylococcus
NPFE

SEQ ID NO: 1969795 - protein, 6 aa, Staphylococcus
NPFGEG

SEQ ID NO: 1969796 - protein, 12 aa, Staphylococcus
NPFGTGKLYRSG

SEQ ID NO: 1969797 - protein, 11 aa, Staphylococcus
NPGDSVDKGEA

SEQ ID NO: 1969798 - protein, 11 aa, Staphylococcus
NPGEFNPSVSS

SEQ ID NO: 1969799 - protein, 5 aa, Staphylococcus
NPGER

SEQ ID NO: 1969800 - protein, 15 aa, Staphylococcus
NPGEYAPTIQRASKN

SEQ ID NO: 1969801 - protein, 14 aa, Staphylococcus
NPGEYTPSISSVSD

SEQ ID NO: 1969802 - protein, 13 aa, Staphylococcus
NPGGPVDGNGLSS

SEQ ID NO: 1969803 - protein, 4 aa, Staphylococcus
NPGK

SEQ ID NO: 1969804 - protein, 9 aa, Staphylococcus
NPGPTGLEK

SEQ ID NO: 1969805 - protein, 8 aa, Staphylococcus
NPGPVRTP

SEQ ID NO: 1969806 - protein, 6 aa, Staphylococcus
NPGQEG

SEQ ID NO: 1969807 - protein, 9 aa, Staphylococcus
NPGTGKTTV

SEQ ID NO: 1969808 - protein, 5 aa, Staphylococcus
NPGTP

SEQ ID NO: 1969809 - protein, 7 aa, Staphylococcus
NPGTPVD

SEQ ID NO: 1969810 - protein, 8 aa, Staphylococcus
NPGTPVDS

SEQ ID NO: 1969811 - protein, 7 aa, Staphylococcus
NPGTPVE

SEQ ID NO: 1969812 - protein, 12 aa, Staphylococcus
NPHPEDNKKSEM

SEQ ID NO: 1969813 - protein, 4 aa, Staphylococcus
NPHQ

SEQ ID NO: 1969814 - protein, 23 aa, Staphylococcus
NPIAGTIKRGATNEEDEANAAQL

SEQ ID NO: 1969815 - protein, 32 aa, Staphylococcus
NPIAGTIKRGSTLEEDNANETQLKNDHKELSE

SEQ ID NO: 1969816 - protein, 11 aa, Staphylococcus
NPIKTPKVEMD

SEQ ID NO: 1969817 - protein, 4 aa, Staphylococcus
NPIN

SEQ ID NO: 1969818 - protein, 12 aa, Staphylococcus
NPINTKGEKVAP

SEQ ID NO: 1969819 - protein, 4 aa, Staphylococcus
NPIQ

SEQ ID NO: 1969820 - protein, 5 aa, Staphylococcus
NPIQP

SEQ ID NO: 1969821 - protein, 8 aa, Staphylococcus
NPISRKEN

SEQ ID NO: 1969822 - protein, 6 aa, Staphylococcus
NPITYP

SEQ ID NO: 1969823 - protein, 10 aa, Staphylococcus
NPKAQDTREI

SEQ ID NO: 1969824 - protein, 25 aa, Staphylococcus
NPKDEAKLKEASDRVAALTSKHPLY

SEQ ID NO: 1969825 - protein, 10 aa, Staphylococcus
NPKDKDTREI

SEQ ID NO: 1969826 - protein, 5 aa, Staphylococcus
NPKEC

SEQ ID NO: 1969827 - protein, 41 aa, Staphylococcus
NPKEEMKKMEKEKEKQIQSRDNSEYSNLTDNNKEDVNIDVA

SEQ ID NO: 1969828 - protein, 11 aa, Staphylococcus
NPKEKDSREIE

SEQ ID NO: 1969829 - protein, 11 aa, Staphylococcus
NPKEPDAREIE

SEQ ID NO: 1969830 - protein, 6 aa, Staphylococcus
NPKFET

SEQ ID NO: 1969831 - protein, 11 aa, Staphylococcus
NPKGAVSKEIS

SEQ ID NO: 1969832 - protein, 8 aa, Staphylococcus
NPKHATGP

SEQ ID NO: 1969833 - protein, 8 aa, Staphylococcus
NPKIAEPL

SEQ ID NO: 1969834 - protein, 7 aa, Staphylococcus
NPKIQTG

SEQ ID NO: 1969835 - protein, 6 aa, Staphylococcus
NPKITY

SEQ ID NO: 1969836 - protein, 11 aa, Staphylococcus
NPKKDDQRELA

SEQ ID NO: 1969837 - protein, 11 aa, Staphylococcus
NPKKDDQRELG

SEQ ID NO: 1969838 - protein, 12 aa, Staphylococcus
NPKKDDQRELGD

SEQ ID NO: 1969839 - protein, 11 aa, Staphylococcus
NPKKEEQQSLA

SEQ ID NO: 1969840 - protein, 4 aa, Staphylococcus
NPKL

SEQ ID NO: 1969841 - protein, 5 aa, Staphylococcus
NPKLD

SEQ ID NO: 1969842 - protein, 8 aa, Staphylococcus
NPKNNAPF

SEQ ID NO: 1969843 - protein, 6 aa, Staphylococcus
NPKNTF

SEQ ID NO: 1969844 - protein, 8 aa, Staphylococcus
NPKPLDIK

SEQ ID NO: 1969845 - protein, 7 aa, Staphylococcus
NPKPQHY

SEQ ID NO: 1969846 - protein, 4 aa, Staphylococcus
NPKQ

SEQ ID NO: 1969847 - protein, 9 aa, Staphylococcus
NPKQCESEI

SEQ ID NO: 1969848 - protein, 10 aa, Staphylococcus
NPKQEDTREI

SEQ ID NO: 1969849 - protein, 8 aa, Staphylococcus
NPKQGKYV

SEQ ID NO: 1969850 - protein, 69 aa, Staphylococcus
NPKQWDSRIPNDGTPESQNLDPNDTEFSNTDYIETENNDTNDLNDTPNNISTTNNHSYHTNHQNTEFNN

SEQ ID NO: 1969851 - protein, 8 aa, Staphylococcus
NPKRDDFP

SEQ ID NO: 1969852 - protein, 8 aa, Staphylococcus
NPKRYTSY

SEQ ID NO: 1969853 - protein, 11 aa, Staphylococcus
NPKSQKNLNDV

SEQ ID NO: 1969854 - protein, 7 aa, Staphylococcus
NPKTFPS

SEQ ID NO: 1969855 - protein, 7 aa, Staphylococcus
NPKVNEK

SEQ ID NO: 1969856 - protein, 5 aa, Staphylococcus
NPKVR

SEQ ID NO: 1969857 - protein, 6 aa, Staphylococcus
NPKVRE

SEQ ID NO: 1969858 - protein, 9 aa, Staphylococcus
NPKYNDRQA

SEQ ID NO: 1969859 - protein, 12 aa, Staphylococcus
NPKYVKTKRKIK

SEQ ID NO: 1969860 - protein, 9 aa, Staphylococcus
NPLESDTGN

SEQ ID NO: 1969861 - protein, 9 aa, Staphylococcus
NPLIGTNGA

SEQ ID NO: 1969862 - protein, 10 aa, Staphylococcus
NPLNNKNTAG

SEQ ID NO: 1969863 - protein, 10 aa, Staphylococcus
NPLQTRTQDK

SEQ ID NO: 1969864 - protein, 6 aa, Staphylococcus
NPLSGQ

SEQ ID NO: 1969865 - protein, 5 aa, Staphylococcus
NPLTG

SEQ ID NO: 1969866 - protein, 6 aa, Staphylococcus
NPMPQL

SEQ ID NO: 1969867 - protein, 9 aa, Staphylococcus
NPNAKGPFN

SEQ ID NO: 1969868 - protein, 9 aa, Staphylococcus
NPNAMGDNG

SEQ ID NO: 1969869 - protein, 10 aa, Staphylococcus
NPNAMGDSGR

SEQ ID NO: 1969870 - protein, 6 aa, Staphylococcus
NPNCST

SEQ ID NO: 1969871 - protein, 7 aa, Staphylococcus
NPNCSTI

SEQ ID NO: 1969872 - protein, 25 aa, Staphylococcus
NPNDAEKIKEATKRVSALTAKHPLY

SEQ ID NO: 1969873 - protein, 9 aa, Staphylococcus
NPNDDRYKD

SEQ ID NO: 1969874 - protein, 13 aa, Staphylococcus
NPNDERYKDVIGK

SEQ ID NO: 1969875 - protein, 4 aa, Staphylococcus
NPNF

SEQ ID NO: 1969876 - protein, 16 aa, Staphylococcus
NPNFSKASEQLKTSHL

SEQ ID NO: 1969877 - protein, 8 aa, Staphylococcus
NPNGSYED

SEQ ID NO: 1969878 - protein, 7 aa, Staphylococcus
NPNHTLA

SEQ ID NO: 1969879 - protein, 5 aa, Staphylococcus
NPNIQ

SEQ ID NO: 1969880 - protein, 7 aa, Staphylococcus
NPNKREL

SEQ ID NO: 1969881 - protein, 5 aa, Staphylococcus
NPNKY

SEQ ID NO: 1969882 - protein, 4 aa, Staphylococcus
NPNL

SEQ ID NO: 1969883 - protein, 14 aa, Staphylococcus
NPNLSDDLTRVGRG

SEQ ID NO: 1969884 - protein, 15 aa, Staphylococcus
NPNLSDEVTRVGRGT

SEQ ID NO: 1969885 - protein, 5 aa, Staphylococcus
NPNNP

SEQ ID NO: 1969886 - protein, 29 aa, Staphylococcus
NPNPEIKPDVAKAAGAKVIGTGRSDFPNQ

SEQ ID NO: 1969887 - protein, 29 aa, Staphylococcus
NPNPEIKPEDAKEAGAKVIGTGRSDFPNQ

SEQ ID NO: 1969888 - protein, 5 aa, Staphylococcus
NPNPI

SEQ ID NO: 1969889 - protein, 7 aa, Staphylococcus
NPNPIDD

SEQ ID NO: 1969890 - protein, 7 aa, Staphylococcus
NPNPIDR

SEQ ID NO: 1969891 - protein, 5 aa, Staphylococcus
NPNPL

SEQ ID NO: 1969892 - protein, 8 aa, Staphylococcus
NPNPYQSK

SEQ ID NO: 1969893 - protein, 9 aa, Staphylococcus
NPNPYQSKV

SEQ ID NO: 1969894 - protein, 4 aa, Staphylococcus
NPNR

SEQ ID NO: 1969895 - protein, 4 aa, Staphylococcus
NPNS

SEQ ID NO: 1969896 - protein, 6 aa, Staphylococcus
NPNSER

SEQ ID NO: 1969897 - protein, 9 aa, Staphylococcus
NPNSMGEEG

SEQ ID NO: 1969898 - protein, 8 aa, Staphylococcus
NPNSNEYF

SEQ ID NO: 1969899 - protein, 11 aa, Staphylococcus
NPNSPHKAGLQ

SEQ ID NO: 1969900 - protein, 19 aa, Staphylococcus
NPNTAAKKIRSAVTDSDGI

SEQ ID NO: 1969901 - protein, 12 aa, Staphylococcus
NPNTAKTVYDAK

SEQ ID NO: 1969902 - protein, 8 aa, Staphylococcus
NPNTMAKA

SEQ ID NO: 1969903 - protein, 9 aa, Staphylococcus
NPNTPKSID

SEQ ID NO: 1969904 - protein, 8 aa, Staphylococcus
NPNTQREL

SEQ ID NO: 1969905 - protein, 14 aa, Staphylococcus
NPNVEKKKKDAREM

SEQ ID NO: 1969906 - protein, 5 aa, Staphylococcus
NPPCD

SEQ ID NO: 1969907 - protein, 5 aa, Staphylococcus
NPPFG

SEQ ID NO: 1969908 - protein, 13 aa, Staphylococcus
NPPLYDSSTFPTE

SEQ ID NO: 1969909 - protein, 4 aa, Staphylococcus
NPPN

SEQ ID NO: 1969910 - protein, 4 aa, Staphylococcus
NPPY

SEQ ID NO: 1969911 - protein, 14 aa, Staphylococcus
NPPYIDEGEARDMD

SEQ ID NO: 1969912 - protein, 7 aa, Staphylococcus
NPPYTAT

SEQ ID NO: 1969913 - protein, 9 aa, Staphylococcus
NPQDGEPCN

SEQ ID NO: 1969914 - protein, 7 aa, Staphylococcus
NPQDTRS

SEQ ID NO: 1969915 - protein, 56 aa, Staphylococcus
NPQDVNPNANSETPTSETTETVSNEENQSINSNETTNTNKSTSENKDVSSSESSSN

SEQ ID NO: 1969916 - protein, 6 aa, Staphylococcus
NPQEAI

SEQ ID NO: 1969917 - protein, 4 aa, Staphylococcus
NPQF

SEQ ID NO: 1969918 - protein, 16 aa, Staphylococcus
NPQFSDEDKKKIETIS

SEQ ID NO: 1969919 - protein, 13 aa, Staphylococcus
NPQGPISNQEKQT

SEQ ID NO: 1969920 - protein, 22 aa, Staphylococcus
NPQGQKYKLTNDDGTNFSKGYT

SEQ ID NO: 1969921 - protein, 5 aa, Staphylococcus
NPQHE

SEQ ID NO: 1969922 - protein, 6 aa, Staphylococcus
NPQHEV

SEQ ID NO: 1969923 - protein, 5 aa, Staphylococcus
NPQHN

SEQ ID NO: 1969924 - protein, 4 aa, Staphylococcus
NPQL

SEQ ID NO: 1969925 - protein, 13 aa, Staphylococcus
NPQNNCYEVTGYR

SEQ ID NO: 1969926 - protein, 7 aa, Staphylococcus
NPQNNEY

SEQ ID NO: 1969927 - protein, 6 aa, Staphylococcus
NPQPEQ

SEQ ID NO: 1969928 - protein, 5 aa, Staphylococcus
NPQPV

SEQ ID NO: 1969929 - protein, 26 aa, Staphylococcus
NPQQEMERIENEEDIQLQKSDERMYK

SEQ ID NO: 1969930 - protein, 4 aa, Staphylococcus
NPQV

SEQ ID NO: 1969931 - protein, 5 aa, Staphylococcus
NPQYV

SEQ ID NO: 1969932 - protein, 6 aa, Staphylococcus
NPRGEL

SEQ ID NO: 1969933 - protein, 6 aa, Staphylococcus
NPRIQT

SEQ ID NO: 1969934 - protein, 5 aa, Staphylococcus
NPRQV

SEQ ID NO: 1969935 - protein, 11 aa, Staphylococcus
NPSAQKAQKWQ

SEQ ID NO: 1969936 - protein, 8 aa, Staphylococcus
NPSAVPED

SEQ ID NO: 1969937 - protein, 24 aa, Staphylococcus
NPSDGKKVVNNPNFEDEKTGNGKN

SEQ ID NO: 1969938 - protein, 7 aa, Staphylococcus
NPSEEIT

SEQ ID NO: 1969939 - protein, 5 aa, Staphylococcus
NPSEI

SEQ ID NO: 1969940 - protein, 13 aa, Staphylococcus
NPSEYRSAFGISQ

SEQ ID NO: 1969941 - protein, 12 aa, Staphylococcus
NPSFKQNLGKTT

SEQ ID NO: 1969942 - protein, 8 aa, Staphylococcus
NPSFSKND

SEQ ID NO: 1969943 - protein, 13 aa, Staphylococcus
NPSILQSKDGKDV

SEQ ID NO: 1969944 - protein, 6 aa, Staphylococcus
NPSKAS

SEQ ID NO: 1969945 - protein, 7 aa, Staphylococcus
NPSKMPL

SEQ ID NO: 1969946 - protein, 5 aa, Staphylococcus
NPSLE

SEQ ID NO: 1969947 - protein, 8 aa, Staphylococcus
NPSNRPEF

SEQ ID NO: 1969948 - protein, 9 aa, Staphylococcus
NPSQMPERD

SEQ ID NO: 1969949 - protein, 4 aa, Staphylococcus
NPST

SEQ ID NO: 1969950 - protein, 10 aa, Staphylococcus
NPSTQQRDAG

SEQ ID NO: 1969951 - protein, 10 aa, Staphylococcus
NPSTSELKPE

SEQ ID NO: 1969952 - protein, 9 aa, Staphylococcus
NPTDPDSPV

SEQ ID NO: 1969953 - protein, 8 aa, Staphylococcus
NPTEGEYN

SEQ ID NO: 1969954 - protein, 6 aa, Staphylococcus
NPTEIG

SEQ ID NO: 1969955 - protein, 8 aa, Staphylococcus
NPTEKTHQ

SEQ ID NO: 1969956 - protein, 6 aa, Staphylococcus
NPTEYI

SEQ ID NO: 1969957 - protein, 4 aa, Staphylococcus
NPTF

SEQ ID NO: 1969958 - protein, 4 aa, Staphylococcus
NPTI

SEQ ID NO: 1969959 - protein, 13 aa, Staphylococcus
NPTQHSYSTEEKQ

SEQ ID NO: 1969960 - protein, 7 aa, Staphylococcus
NPTQLEA

SEQ ID NO: 1969961 - protein, 14 aa, Staphylococcus
NPTQNTYTKEEKQK

SEQ ID NO: 1969962 - protein, 14 aa, Staphylococcus
NPTQNTYTKEQKQK

SEQ ID NO: 1969963 - protein, 5 aa, Staphylococcus
NPTQV

SEQ ID NO: 1969964 - protein, 10 aa, Staphylococcus
NPTSHKDGER

SEQ ID NO: 1969965 - protein, 7 aa, Staphylococcus
NPTTAIP

SEQ ID NO: 1969966 - protein, 7 aa, Staphylococcus
NPTTGEI

SEQ ID NO: 1969967 - protein, 11 aa, Staphylococcus
NPTTGGVSASF

SEQ ID NO: 1969968 - protein, 13 aa, Staphylococcus
NPTTGGVSASFAS

SEQ ID NO: 1969969 - protein, 7 aa, Staphylococcus
NPTTGLP

SEQ ID NO: 1969970 - protein, 10 aa, Staphylococcus
NPTTSELKPE

SEQ ID NO: 1969971 - protein, 4 aa, Staphylococcus
NPTW

SEQ ID NO: 1969972 - protein, 6 aa, Staphylococcus
NPTYKA

SEQ ID NO: 1969973 - protein, 4 aa, Staphylococcus
NPVD

SEQ ID NO: 1969974 - protein, 13 aa, Staphylococcus
NPVGSGDSTVAGI

SEQ ID NO: 1969975 - protein, 12 aa, Staphylococcus
NPVNAEGKKTTP

SEQ ID NO: 1969976 - protein, 13 aa, Staphylococcus
NPVNAKGEKTTPV

SEQ ID NO: 1969977 - protein, 13 aa, Staphylococcus
NPVNNKGEKTTPV

SEQ ID NO: 1969978 - protein, 13 aa, Staphylococcus
NPVNSKGEKTTPV

SEQ ID NO: 1969979 - protein, 6 aa, Staphylococcus
NPVSGE

SEQ ID NO: 1969980 - protein, 4 aa, Staphylococcus
NPWE

SEQ ID NO: 1969981 - protein, 6 aa, Staphylococcus
NPWEGL

SEQ ID NO: 1969982 - protein, 6 aa, Staphylococcus
NPWESL

SEQ ID NO: 1969983 - protein, 8 aa, Staphylococcus
NPYDKQGG

SEQ ID NO: 1969984 - protein, 8 aa, Staphylococcus
NPYDVSGE

SEQ ID NO: 1969985 - protein, 6 aa, Staphylococcus
NPYEGG

SEQ ID NO: 1969986 - protein, 8 aa, Staphylococcus
NPYESDSA

SEQ ID NO: 1969987 - protein, 4 aa, Staphylococcus
NPYI

SEQ ID NO: 1969988 - protein, 5 aa, Staphylococcus
NPYIS

SEQ ID NO: 1969989 - protein, 7 aa, Staphylococcus
NPYKQAW

SEQ ID NO: 1969990 - protein, 12 aa, Staphylococcus
NPYNSEKDDTDL

SEQ ID NO: 1969991 - protein, 13 aa, Staphylococcus
NPYQPRKNFDAER

SEQ ID NO: 1969992 - protein, 9 aa, Staphylococcus
NPYQPRKTF

SEQ ID NO: 1969993 - protein, 13 aa, Staphylococcus
NQAAKAFLDTVET

SEQ ID NO: 1969994 - protein, 5 aa, Staphylococcus
NQAED

SEQ ID NO: 1969995 - protein, 7 aa, Staphylococcus
NQAENHY

SEQ ID NO: 1969996 - protein, 6 aa, Staphylococcus
NQAEYH

SEQ ID NO: 1969997 - protein, 6 aa, Staphylococcus
NQAGSL

SEQ ID NO: 1969998 - protein, 7 aa, Staphylococcus
NQAIKDN

SEQ ID NO: 1969999 - protein, 9 aa, Staphylococcus
NQAIQQGEN

SEQ ID NO: 1970000 - protein, 8 aa, Staphylococcus
NQAKAETV

SEQ ID NO: 1970001 - protein, 12 aa, Staphylococcus
NQAKEKTKNNTG

SEQ ID NO: 1970002 - protein, 10 aa, Staphylococcus
NQAKGKSRNY

SEQ ID NO: 1970003 - protein, 10 aa, Staphylococcus
NQANDTNAGL

SEQ ID NO: 1970004 - protein, 11 aa, Staphylococcus
NQANPNAKTSI

SEQ ID NO: 1970005 - protein, 6 aa, Staphylococcus
NQARTD

SEQ ID NO: 1970006 - protein, 9 aa, Staphylococcus
NQASPNAKM

SEQ ID NO: 1970007 - protein, 10 aa, Staphylococcus
NQASPNAKTS

SEQ ID NO: 1970008 - protein, 11 aa, Staphylococcus
NQASPNARTSI

SEQ ID NO: 1970009 - protein, 11 aa, Staphylococcus
NQASSHSKTNV

SEQ ID NO: 1970010 - protein, 8 aa, Staphylococcus
NQATDSYE

SEQ ID NO: 1970011 - protein, 19 aa, Staphylococcus
NQATKEAEKAPYPSPEETY

SEQ ID NO: 1970012 - protein, 14 aa, Staphylococcus
NQATMDNPNQPNEM

SEQ ID NO: 1970013 - protein, 5 aa, Staphylococcus
NQATS

SEQ ID NO: 1970014 - protein, 8 aa, Staphylococcus
NQAVSEEA

SEQ ID NO: 1970015 - protein, 5 aa, Staphylococcus
NQAYD

SEQ ID NO: 1970016 - protein, 12 aa, Staphylococcus
NQAYKAETEGVT

SEQ ID NO: 1970017 - protein, 6 aa, Staphylococcus
NQDAGA

SEQ ID NO: 1970018 - protein, 6 aa, Staphylococcus
NQDAID

SEQ ID NO: 1970019 - protein, 4 aa, Staphylococcus
NQDG

SEQ ID NO: 1970020 - protein, 5 aa, Staphylococcus
NQDGD

SEQ ID NO: 1970021 - protein, 9 aa, Staphylococcus
NQDGDGSVV

SEQ ID NO: 1970022 - protein, 15 aa, Staphylococcus
NQDGEVITNETLKGK

SEQ ID NO: 1970023 - protein, 5 aa, Staphylococcus
NQDGV

SEQ ID NO: 1970024 - protein, 7 aa, Staphylococcus
NQDGYQL

SEQ ID NO: 1970025 - protein, 4 aa, Staphylococcus
NQDI

SEQ ID NO: 1970026 - protein, 7 aa, Staphylococcus
NQDKQSL

SEQ ID NO: 1970027 - protein, 8 aa, Staphylococcus
NQDLGELT

SEQ ID NO: 1970028 - protein, 5 aa, Staphylococcus
NQDMQ

SEQ ID NO: 1970029 - protein, 30 aa, Staphylococcus
NQDNETLKDMTKSGKQRPWREKKVLLQSKK

SEQ ID NO: 1970030 - protein, 13 aa, Staphylococcus
NQDNQGAARSRNV

SEQ ID NO: 1970031 - protein, 27 aa, Staphylococcus
NQDNSISIEDNGRGMPSGMHASGKPTV

SEQ ID NO: 1970032 - protein, 7 aa, Staphylococcus
NQDNVKH

SEQ ID NO: 1970033 - protein, 8 aa, Staphylococcus
NQDPDVPF

SEQ ID NO: 1970034 - protein, 8 aa, Staphylococcus
NQDPNDGF

SEQ ID NO: 1970035 - protein, 14 aa, Staphylococcus
NQDRRIGPNPLEFN

SEQ ID NO: 1970036 - protein, 5 aa, Staphylococcus
NQDSI

SEQ ID NO: 1970037 - protein, 8 aa, Staphylococcus
NQDVRKGI

SEQ ID NO: 1970038 - protein, 8 aa, Staphylococcus
NQDYKNNK

SEQ ID NO: 1970039 - protein, 12 aa, Staphylococcus
NQEDAKVSYEDR

SEQ ID NO: 1970040 - protein, 9 aa, Staphylococcus
NQEDDLESL

SEQ ID NO: 1970041 - protein, 11 aa, Staphylococcus
NQEDNYKVTKT

SEQ ID NO: 1970042 - protein, 4 aa, Staphylococcus
NQEE

SEQ ID NO: 1970043 - protein, 6 aa, Staphylococcus
NQEEPI

SEQ ID NO: 1970044 - protein, 6 aa, Staphylococcus
NQEERA

SEQ ID NO: 1970045 - protein, 4 aa, Staphylococcus
NQEG

SEQ ID NO: 1970046 - protein, 13 aa, Staphylococcus
NQEGYKSLEEGQA

SEQ ID NO: 1970047 - protein, 4 aa, Staphylococcus
NQEI

SEQ ID NO: 1970048 - protein, 6 aa, Staphylococcus
NQEIAE

SEQ ID NO: 1970049 - protein, 8 aa, Staphylococcus
NQEIPQKG

SEQ ID NO: 1970050 - protein, 14 aa, Staphylococcus
NQEKRIGPNPQDFA

SEQ ID NO: 1970051 - protein, 4 aa, Staphylococcus
NQEL

SEQ ID NO: 1970052 - protein, 6 aa, Staphylococcus
NQEMET

SEQ ID NO: 1970053 - protein, 8 aa, Staphylococcus
NQENNTNV

SEQ ID NO: 1970054 - protein, 6 aa, Staphylococcus
NQENVN

SEQ ID NO: 1970055 - protein, 18 aa, Staphylococcus
NQEPSDFTGELAQKATSI

SEQ ID NO: 1970056 - protein, 5 aa, Staphylococcus
NQEQG

SEQ ID NO: 1970057 - protein, 8 aa, Staphylococcus
NQEQIDNV

SEQ ID NO: 1970058 - protein, 14 aa, Staphylococcus
NQEQPERGKIYDRN

SEQ ID NO: 1970059 - protein, 15 aa, Staphylococcus
NQEQPERGKIYDRNG

SEQ ID NO: 1970060 - protein, 5 aa, Staphylococcus
NQERK

SEQ ID NO: 1970061 - protein, 11 aa, Staphylococcus
NQERPSKDWVP

SEQ ID NO: 1970062 - protein, 7 aa, Staphylococcus
NQESESL

SEQ ID NO: 1970063 - protein, 15 aa, Staphylococcus
NQESPLGGDERGLSG

SEQ ID NO: 1970064 - protein, 8 aa, Staphylococcus
NQESTQTF

SEQ ID NO: 1970065 - protein, 14 aa, Staphylococcus
NQETAPEGVCVQFL

SEQ ID NO: 1970066 - protein, 13 aa, Staphylococcus
NQETKLKMPDYFK

SEQ ID NO: 1970067 - protein, 4 aa, Staphylococcus
NQEY

SEQ ID NO: 1970068 - protein, 11 aa, Staphylococcus
NQEYKSDLTGT

SEQ ID NO: 1970069 - protein, 4 aa, Staphylococcus
NQFA

SEQ ID NO: 1970070 - protein, 7 aa, Staphylococcus
NQFATKK

SEQ ID NO: 1970071 - protein, 5 aa, Staphylococcus
NQFDP

SEQ ID NO: 1970072 - protein, 7 aa, Staphylococcus
NQFETPN

SEQ ID NO: 1970073 - protein, 5 aa, Staphylococcus
NQFGE

SEQ ID NO: 1970074 - protein, 14 aa, Staphylococcus
NQFGGGGHPNASGV

SEQ ID NO: 1970075 - protein, 6 aa, Staphylococcus
NQFGQE

SEQ ID NO: 1970076 - protein, 4 aa, Staphylococcus
NQFH

SEQ ID NO: 1970077 - protein, 6 aa, Staphylococcus
NQFNEA

SEQ ID NO: 1970078 - protein, 7 aa, Staphylococcus
NQFNKNE

SEQ ID NO: 1970079 - protein, 13 aa, Staphylococcus
NQFSNTENVTQGV

SEQ ID NO: 1970080 - protein, 9 aa, Staphylococcus
NQFSTDEVK

SEQ ID NO: 1970081 - protein, 5 aa, Staphylococcus
NQGDA

SEQ ID NO: 1970082 - protein, 6 aa, Staphylococcus
NQGDDA

SEQ ID NO: 1970083 - protein, 13 aa, Staphylococcus
NQGEDVTIKKINV

SEQ ID NO: 1970084 - protein, 5 aa, Staphylococcus
NQGER

SEQ ID NO: 1970085 - protein, 9 aa, Staphylococcus
NQGGNPEVV

SEQ ID NO: 1970086 - protein, 13 aa, Staphylococcus
NQGHLTSDEQEIR

SEQ ID NO: 1970087 - protein, 6 aa, Staphylococcus
NQGKDN

SEQ ID NO: 1970088 - protein, 12 aa, Staphylococcus
NQGKIFEGYANV

SEQ ID NO: 1970089 - protein, 10 aa, Staphylococcus
NQGKKNEVRA

SEQ ID NO: 1970090 - protein, 10 aa, Staphylococcus
NQGKNSEILS

SEQ ID NO: 1970091 - protein, 6 aa, Staphylococcus
NQGLRA

SEQ ID NO: 1970092 - protein, 8 aa, Staphylococcus
NQGLRGGK

SEQ ID NO: 1970093 - protein, 8 aa, Staphylococcus
NQGLRGNK

SEQ ID NO: 1970094 - protein, 8 aa, Staphylococcus
NQGLRQGK

SEQ ID NO: 1970095 - protein, 14 aa, Staphylococcus
NQGNMRRLMSADIE

SEQ ID NO: 1970096 - protein, 5 aa, Staphylococcus
NQGNQ

SEQ ID NO: 1970097 - protein, 6 aa, Staphylococcus
NQGPFE

SEQ ID NO: 1970098 - protein, 6 aa, Staphylococcus
NQGQTL

SEQ ID NO: 1970099 - protein, 8 aa, Staphylococcus
NQGRTVQQ

SEQ ID NO: 1970100 - protein, 6 aa, Staphylococcus
NQGSSE

SEQ ID NO: 1970101 - protein, 8 aa, Staphylococcus
NQGTEEEA

SEQ ID NO: 1970102 - protein, 8 aa, Staphylococcus
NQGVSPAT

SEQ ID NO: 1970103 - protein, 7 aa, Staphylococcus
NQGYNEQ

SEQ ID NO: 1970104 - protein, 6 aa, Staphylococcus
NQHGVH

SEQ ID NO: 1970105 - protein, 7 aa, Staphylococcus
NQHNEDE

SEQ ID NO: 1970106 - protein, 9 aa, Staphylococcus
NQHNPKSPF

SEQ ID NO: 1970107 - protein, 5 aa, Staphylococcus
NQHPD

SEQ ID NO: 1970108 - protein, 5 aa, Staphylococcus
NQHPS

SEQ ID NO: 1970109 - protein, 9 aa, Staphylococcus
NQHQKEAHK

SEQ ID NO: 1970110 - protein, 6 aa, Staphylococcus
NQHSIN

SEQ ID NO: 1970111 - protein, 11 aa, Staphylococcus
NQHSNRNEDQM

SEQ ID NO: 1970112 - protein, 4 aa, Staphylococcus
NQIA

SEQ ID NO: 1970113 - protein, 4 aa, Staphylococcus
NQID

SEQ ID NO: 1970114 - protein, 12 aa, Staphylococcus
NQIEEEQKSNQF

SEQ ID NO: 1970115 - protein, 6 aa, Staphylococcus
NQIEGK

SEQ ID NO: 1970116 - protein, 7 aa, Staphylococcus
NQIEGKA

SEQ ID NO: 1970117 - protein, 8 aa, Staphylococcus
NQIEGKEV

SEQ ID NO: 1970118 - protein, 7 aa, Staphylococcus
NQIEHDK

SEQ ID NO: 1970119 - protein, 13 aa, Staphylococcus
NQIEKQESRHETT

SEQ ID NO: 1970120 - protein, 9 aa, Staphylococcus
NQIEQKETE

SEQ ID NO: 1970121 - protein, 6 aa, Staphylococcus
NQIETG

SEQ ID NO: 1970122 - protein, 35 aa, Staphylococcus
NQIGGKSNSGEGGEDPSRYELQKDGSNKTSAIKQV

SEQ ID NO: 1970123 - protein, 38 aa, Staphylococcus
NQIGGKSNSGEGGEEPERYISGPHGENYTSSIKQVASG

SEQ ID NO: 1970124 - protein, 14 aa, Staphylococcus
NQINNNKKCKYKDL

SEQ ID NO: 1970125 - protein, 7 aa, Staphylococcus
NQIPTAS

SEQ ID NO: 1970126 - protein, 20 aa, Staphylococcus
NQIPTQTHGGYRSSNNSYSF

SEQ ID NO: 1970127 - protein, 13 aa, Staphylococcus
NQIQASDVTELNG

SEQ ID NO: 1970128 - protein, 7 aa, Staphylococcus
NQIQNNV

SEQ ID NO: 1970129 - protein, 6 aa, Staphylococcus
NQISDK

SEQ ID NO: 1970130 - protein, 10 aa, Staphylococcus
NQISGGQKQR

SEQ ID NO: 1970131 - protein, 4 aa, Staphylococcus
NQIT

SEQ ID NO: 1970132 - protein, 12 aa, Staphylococcus
NQITEDNANDIK

SEQ ID NO: 1970133 - protein, 12 aa, Staphylococcus
NQITEENANDIK

SEQ ID NO: 1970134 - protein, 12 aa, Staphylococcus
NQITKENAPNIK

SEQ ID NO: 1970135 - protein, 4 aa, Staphylococcus
NQIV

SEQ ID NO: 1970136 - protein, 5 aa, Staphylococcus
NQIVT

SEQ ID NO: 1970137 - protein, 4 aa, Staphylococcus
NQKA

SEQ ID NO: 1970138 - protein, 6 aa, Staphylococcus
NQKDQD

SEQ ID NO: 1970139 - protein, 4 aa, Staphylococcus
NQKE

SEQ ID NO: 1970140 - protein, 5 aa, Staphylococcus
NQKEE

SEQ ID NO: 1970141 - protein, 15 aa, Staphylococcus
NQKEEDADRLFFVVK

SEQ ID NO: 1970142 - protein, 8 aa, Staphylococcus
NQKEVDNT

SEQ ID NO: 1970143 - protein, 5 aa, Staphylococcus
NQKFA

SEQ ID NO: 1970144 - protein, 4 aa, Staphylococcus
NQKG

SEQ ID NO: 1970145 - protein, 8 aa, Staphylococcus
NQKGEIDD

SEQ ID NO: 1970146 - protein, 7 aa, Staphylococcus
NQKGQDT

SEQ ID NO: 1970147 - protein, 8 aa, Staphylococcus
NQKGSNEI

SEQ ID NO: 1970148 - protein, 7 aa, Staphylococcus
NQKIKAS

SEQ ID NO: 1970149 - protein, 5 aa, Staphylococcus
NQKIN

SEQ ID NO: 1970150 - protein, 6 aa, Staphylococcus
NQKINY

SEQ ID NO: 1970151 - protein, 9 aa, Staphylococcus
NQKISQGEP

SEQ ID NO: 1970152 - protein, 5 aa, Staphylococcus
NQKIT

SEQ ID NO: 1970153 - protein, 29 aa, Staphylococcus
NQKKHKAKRHHHQAPQPQQRHKRKKRYTE

SEQ ID NO: 1970154 - protein, 8 aa, Staphylococcus
NQKKRSRN

SEQ ID NO: 1970155 - protein, 9 aa, Staphylococcus
NQKNKGSTH

SEQ ID NO: 1970156 - protein, 9 aa, Staphylococcus
NQKNNLARK

SEQ ID NO: 1970157 - protein, 13 aa, Staphylococcus
NQKPAKAKKGTDI

SEQ ID NO: 1970158 - protein, 13 aa, Staphylococcus
NQKQKFFDNLYHT

SEQ ID NO: 1970159 - protein, 11 aa, Staphylococcus
NQKRISNTESY

SEQ ID NO: 1970160 - protein, 9 aa, Staphylococcus
NQKRNGYFE

SEQ ID NO: 1970161 - protein, 7 aa, Staphylococcus
NQKSSEV

SEQ ID NO: 1970162 - protein, 6 aa, Staphylococcus
NQKVNY

SEQ ID NO: 1970163 - protein, 5 aa, Staphylococcus
NQKYG

SEQ ID NO: 1970164 - protein, 6 aa, Staphylococcus
NQLDNR

SEQ ID NO: 1970165 - protein, 9 aa, Staphylococcus
NQLEAEGAN

SEQ ID NO: 1970166 - protein, 6 aa, Staphylococcus
NQLEGK

SEQ ID NO: 1970167 - protein, 16 aa, Staphylococcus
NQLEGKEVTVDHDGEA

SEQ ID NO: 1970168 - protein, 4 aa, Staphylococcus
NQLG

SEQ ID NO: 1970169 - protein, 17 aa, Staphylococcus
NQLGGKSNSGEGGEHAY

SEQ ID NO: 1970170 - protein, 5 aa, Staphylococcus
NQLNS

SEQ ID NO: 1970171 - protein, 9 aa, Staphylococcus
NQLNTIEKD

SEQ ID NO: 1970172 - protein, 4 aa, Staphylococcus
NQLP

SEQ ID NO: 1970173 - protein, 15 aa, Staphylococcus
NQLPSEISGGQKQRV

SEQ ID NO: 1970174 - protein, 5 aa, Staphylococcus
NQLPT

SEQ ID NO: 1970175 - protein, 4 aa, Staphylococcus
NQLQ

SEQ ID NO: 1970176 - protein, 8 aa, Staphylococcus
NQLQTQSA

SEQ ID NO: 1970177 - protein, 4 aa, Staphylococcus
NQLS

SEQ ID NO: 1970178 - protein, 9 aa, Staphylococcus
NQLSGGQKR

SEQ ID NO: 1970179 - protein, 13 aa, Staphylococcus
NQLSPKTRDKYDE

SEQ ID NO: 1970180 - protein, 8 aa, Staphylococcus
NQLSQRES

SEQ ID NO: 1970181 - protein, 7 aa, Staphylococcus
NQLTATP

SEQ ID NO: 1970182 - protein, 7 aa, Staphylococcus
NQLTEKG

SEQ ID NO: 1970183 - protein, 12 aa, Staphylococcus
NQLTFEPKEGDE

SEQ ID NO: 1970184 - protein, 6 aa, Staphylococcus
NQLTQT

SEQ ID NO: 1970185 - protein, 8 aa, Staphylococcus
NQMDKEEA

SEQ ID NO: 1970186 - protein, 17 aa, Staphylococcus
NQMGGKSNSGEGGENPE

SEQ ID NO: 1970187 - protein, 6 aa, Staphylococcus
NQMPNY

SEQ ID NO: 1970188 - protein, 6 aa, Staphylococcus
NQNAIP

SEQ ID NO: 1970189 - protein, 9 aa, Staphylococcus
NQNAKPIEL

SEQ ID NO: 1970190 - protein, 6 aa, Staphylococcus
NQNALP

SEQ ID NO: 1970191 - protein, 4 aa, Staphylococcus
NQND

SEQ ID NO: 1970192 - protein, 7 aa, Staphylococcus
NQNDPEK

SEQ ID NO: 1970193 - protein, 9 aa, Staphylococcus
NQNEAADEL

SEQ ID NO: 1970194 - protein, 7 aa, Staphylococcus
NQNEEVA

SEQ ID NO: 1970195 - protein, 16 aa, Staphylococcus
NQNERSQIKNREAAMK

SEQ ID NO: 1970196 - protein, 8 aa, Staphylococcus
NQNEVPEI

SEQ ID NO: 1970197 - protein, 7 aa, Staphylococcus
NQNGELI

SEQ ID NO: 1970198 - protein, 10 aa, Staphylococcus
NQNGNTEQVN

SEQ ID NO: 1970199 - protein, 16 aa, Staphylococcus
NQNGVSISNKDLKGQK

SEQ ID NO: 1970200 - protein, 14 aa, Staphylococcus
NQNINSLEEKKKSF

SEQ ID NO: 1970201 - protein, 8 aa, Staphylococcus
NQNIPRNQ

SEQ ID NO: 1970202 - protein, 16 aa, Staphylococcus
NQNIRSHGKEPEPYTY

SEQ ID NO: 1970203 - protein, 8 aa, Staphylococcus
NQNKFTRT

SEQ ID NO: 1970204 - protein, 8 aa, Staphylococcus
NQNKNEHK

SEQ ID NO: 1970205 - protein, 7 aa, Staphylococcus
NQNNKYE

SEQ ID NO: 1970206 - protein, 7 aa, Staphylococcus
NQNNNYQ

SEQ ID NO: 1970207 - protein, 5 aa, Staphylococcus
NQNNQ

SEQ ID NO: 1970208 - protein, 7 aa, Staphylococcus
NQNNTYD

SEQ ID NO: 1970209 - protein, 7 aa, Staphylococcus
NQNRDHE

SEQ ID NO: 1970210 - protein, 6 aa, Staphylococcus
NQNSAH

SEQ ID NO: 1970211 - protein, 8 aa, Staphylococcus
NQNSKDTV

SEQ ID NO: 1970212 - protein, 8 aa, Staphylococcus
NQNTIEEV

SEQ ID NO: 1970213 - protein, 7 aa, Staphylococcus
NQNTIPD

SEQ ID NO: 1970214 - protein, 4 aa, Staphylococcus
NQNV

SEQ ID NO: 1970215 - protein, 4 aa, Staphylococcus
NQPA

SEQ ID NO: 1970216 - protein, 7 aa, Staphylococcus
NQPANSV

SEQ ID NO: 1970217 - protein, 5 aa, Staphylococcus
NQPAT

SEQ ID NO: 1970218 - protein, 4 aa, Staphylococcus
NQPE

SEQ ID NO: 1970219 - protein, 6 aa, Staphylococcus
NQPELN

SEQ ID NO: 1970220 - protein, 6 aa, Staphylococcus
NQPELT

SEQ ID NO: 1970221 - protein, 7 aa, Staphylococcus
NQPEVNQ

SEQ ID NO: 1970222 - protein, 4 aa, Staphylococcus
NQPG

SEQ ID NO: 1970223 - protein, 10 aa, Staphylococcus
NQPGEESSNV

SEQ ID NO: 1970224 - protein, 12 aa, Staphylococcus
NQPGGLSKEVPY

SEQ ID NO: 1970225 - protein, 23 aa, Staphylococcus
NQPGSLSKELPYEEYLKEIGVLQ

SEQ ID NO: 1970226 - protein, 5 aa, Staphylococcus
NQPID

SEQ ID NO: 1970227 - protein, 6 aa, Staphylococcus
NQPINE

SEQ ID NO: 1970228 - protein, 5 aa, Staphylococcus
NQPIS

SEQ ID NO: 1970229 - protein, 7 aa, Staphylococcus
NQPKAVG

SEQ ID NO: 1970230 - protein, 18 aa, Staphylococcus
NQPKHDITIEKDDDDLDG

SEQ ID NO: 1970231 - protein, 33 aa, Staphylococcus
NQPKPSYENKSQPYQGYNRKSKLVSREKTPKWL

SEQ ID NO: 1970232 - protein, 33 aa, Staphylococcus
NQPKSYDQNFKGNRNYSRQNKQLISKEKTPKWL

SEQ ID NO: 1970233 - protein, 17 aa, Staphylococcus
NQPKTDELRRFLNVINE

SEQ ID NO: 1970234 - protein, 6 aa, Staphylococcus
NQPLHE

SEQ ID NO: 1970235 - protein, 12 aa, Staphylococcus
NQPLPEEKEAET

SEQ ID NO: 1970236 - protein, 6 aa, Staphylococcus
NQPNNV

SEQ ID NO: 1970237 - protein, 7 aa, Staphylococcus
NQPPVKA

SEQ ID NO: 1970238 - protein, 7 aa, Staphylococcus
NQPQGVG

SEQ ID NO: 1970239 - protein, 9 aa, Staphylococcus
NQPQSDKEY

SEQ ID NO: 1970240 - protein, 15 aa, Staphylococcus
NQPQTEELKRFLNVI

SEQ ID NO: 1970241 - protein, 8 aa, Staphylococcus
NQPSLLEG

SEQ ID NO: 1970242 - protein, 8 aa, Staphylococcus
NQPSTDTG

SEQ ID NO: 1970243 - protein, 4 aa, Staphylococcus
NQPT

SEQ ID NO: 1970244 - protein, 6 aa, Staphylococcus
NQPTEI

SEQ ID NO: 1970245 - protein, 5 aa, Staphylococcus
NQPVG

SEQ ID NO: 1970246 - protein, 9 aa, Staphylococcus
NQPVGGGDH

SEQ ID NO: 1970247 - protein, 15 aa, Staphylococcus
NQPVTSQNKKDNTIK

SEQ ID NO: 1970248 - protein, 9 aa, Staphylococcus
NQPYKRQYE

SEQ ID NO: 1970249 - protein, 4 aa, Staphylococcus
NQQA

SEQ ID NO: 1970250 - protein, 6 aa, Staphylococcus
NQQDQN

SEQ ID NO: 1970251 - protein, 19 aa, Staphylococcus
NQQEELDNNPFKDALKNLK

SEQ ID NO: 1970252 - protein, 7 aa, Staphylococcus
NQQENQN

SEQ ID NO: 1970253 - protein, 5 aa, Staphylococcus
NQQGY

SEQ ID NO: 1970254 - protein, 9 aa, Staphylococcus
NQQKEDIQN

SEQ ID NO: 1970255 - protein, 25 aa, Staphylococcus
NQQKEEAGEQAFANPRNAAAGSLRQ

SEQ ID NO: 1970256 - protein, 7 aa, Staphylococcus
NQQLAEE

SEQ ID NO: 1970257 - protein, 7 aa, Staphylococcus
NQQMKEK

SEQ ID NO: 1970258 - protein, 7 aa, Staphylococcus
NQQNDAR

SEQ ID NO: 1970259 - protein, 9 aa, Staphylococcus
NQQNDNQID

SEQ ID NO: 1970260 - protein, 10 aa, Staphylococcus
NQQNNDETDF

SEQ ID NO: 1970261 - protein, 10 aa, Staphylococcus
NQQPQPSGMD

SEQ ID NO: 1970262 - protein, 8 aa, Staphylococcus
NQQPSLSP

SEQ ID NO: 1970263 - protein, 26 aa, Staphylococcus
NQQQNGQLKSRLTQKINNDLSQYKNA

SEQ ID NO: 1970264 - protein, 14 aa, Staphylococcus
NQQQPTERENKASL

SEQ ID NO: 1970265 - protein, 19 aa, Staphylococcus
NQQQSNAVDEDWKKQYEDV

SEQ ID NO: 1970266 - protein, 5 aa, Staphylococcus
NQQRA

SEQ ID NO: 1970267 - protein, 10 aa, Staphylococcus
NQQSEQPNTV

SEQ ID NO: 1970268 - protein, 8 aa, Staphylococcus
NQQSEQRF

SEQ ID NO: 1970269 - protein, 9 aa, Staphylococcus
NQQSESIDL

SEQ ID NO: 1970270 - protein, 13 aa, Staphylococcus
NQQSSEEQQEGFE

SEQ ID NO: 1970271 - protein, 6 aa, Staphylococcus
NQQTDY

SEQ ID NO: 1970272 - protein, 24 aa, Staphylococcus
NQQTDYPSCGPDMPEFEPRGCPRG

SEQ ID NO: 1970273 - protein, 9 aa, Staphylococcus
NQQTNEEGL

SEQ ID NO: 1970274 - protein, 5 aa, Staphylococcus
NQQYT

SEQ ID NO: 1970275 - protein, 7 aa, Staphylococcus
NQRAIEA

SEQ ID NO: 1970276 - protein, 15 aa, Staphylococcus
NQRDGFKHIEHLKRQ

SEQ ID NO: 1970277 - protein, 10 aa, Staphylococcus
NQRDVKGANH

SEQ ID NO: 1970278 - protein, 28 aa, Staphylococcus
NQRENSLTLDRSESGLLPTNVDGTTRST

SEQ ID NO: 1970279 - protein, 9 aa, Staphylococcus
NQRHDQYGV

SEQ ID NO: 1970280 - protein, 8 aa, Staphylococcus
NQRKQSSL

SEQ ID NO: 1970281 - protein, 12 aa, Staphylococcus
NQRNQNRLDQED

SEQ ID NO: 1970282 - protein, 15 aa, Staphylococcus
NQRNQNRLDQEDKAF

SEQ ID NO: 1970283 - protein, 14 aa, Staphylococcus
NQRNTKEQKYENTK

SEQ ID NO: 1970284 - protein, 11 aa, Staphylococcus
NQRQKGQDIVP

SEQ ID NO: 1970285 - protein, 19 aa, Staphylococcus
NQRQKNEDIKKEDVATSFQ

SEQ ID NO: 1970286 - protein, 5 aa, Staphylococcus
NQRQQ

SEQ ID NO: 1970287 - protein, 4 aa, Staphylococcus
NQRR

SEQ ID NO: 1970288 - protein, 6 aa, Staphylococcus
NQRRDL

SEQ ID NO: 1970289 - protein, 11 aa, Staphylococcus
NQRSQNRLDKE

SEQ ID NO: 1970290 - protein, 6 aa, Staphylococcus
NQRTDL

SEQ ID NO: 1970291 - protein, 12 aa, Staphylococcus
NQRTEIEEKLHD

SEQ ID NO: 1970292 - protein, 10 aa, Staphylococcus
NQRVTDSSEI

SEQ ID NO: 1970293 - protein, 8 aa, Staphylococcus
NQRYGTPL

SEQ ID NO: 1970294 - protein, 13 aa, Staphylococcus
NQSAGTGYSNYEN

SEQ ID NO: 1970295 - protein, 7 aa, Staphylococcus
NQSEGTR

SEQ ID NO: 1970296 - protein, 16 aa, Staphylococcus
NQSEINDEDELETGEE

SEQ ID NO: 1970297 - protein, 13 aa, Staphylococcus
NQSEINEEDEFEI

SEQ ID NO: 1970298 - protein, 14 aa, Staphylococcus
NQSEISDDDELEIG

SEQ ID NO: 1970299 - protein, 13 aa, Staphylococcus
NQSEVADEDEFEI

SEQ ID NO: 1970300 - protein, 14 aa, Staphylococcus
NQSEVNEEDELQIG

SEQ ID NO: 1970301 - protein, 5 aa, Staphylococcus
NQSEW

SEQ ID NO: 1970302 - protein, 6 aa, Staphylococcus
NQSFED

SEQ ID NO: 1970303 - protein, 21 aa, Staphylococcus
NQSFKSNEVNVPSINSDESPV

SEQ ID NO: 1970304 - protein, 6 aa, Staphylococcus
NQSFSE

SEQ ID NO: 1970305 - protein, 10 aa, Staphylococcus
NQSGGFKTIS

SEQ ID NO: 1970306 - protein, 12 aa, Staphylococcus
NQSGGLSKEVPY

SEQ ID NO: 1970307 - protein, 7 aa, Staphylococcus
NQSGIGP

SEQ ID NO: 1970308 - protein, 7 aa, Staphylococcus
NQSHQTK

SEQ ID NO: 1970309 - protein, 5 aa, Staphylococcus
NQSHY

SEQ ID NO: 1970310 - protein, 4 aa, Staphylococcus
NQSI

SEQ ID NO: 1970311 - protein, 5 aa, Staphylococcus
NQSIE

SEQ ID NO: 1970312 - protein, 9 aa, Staphylococcus
NQSKPLDDQ

SEQ ID NO: 1970313 - protein, 5 aa, Staphylococcus
NQSKW

SEQ ID NO: 1970314 - protein, 8 aa, Staphylococcus
NQSLDEDT

SEQ ID NO: 1970315 - protein, 5 aa, Staphylococcus
NQSLN

SEQ ID NO: 1970316 - protein, 10 aa, Staphylococcus
NQSLPDDTKK

SEQ ID NO: 1970317 - protein, 9 aa, Staphylococcus
NQSNPTIAP

SEQ ID NO: 1970318 - protein, 15 aa, Staphylococcus
NQSPKAYVDEANERD

SEQ ID NO: 1970319 - protein, 7 aa, Staphylococcus
NQSPNNI

SEQ ID NO: 1970320 - protein, 4 aa, Staphylococcus
NQSQ

SEQ ID NO: 1970321 - protein, 7 aa, Staphylococcus
NQSQIDA

SEQ ID NO: 1970322 - protein, 8 aa, Staphylococcus
NQSQNKKN

SEQ ID NO: 1970323 - protein, 6 aa, Staphylococcus
NQSQQA

SEQ ID NO: 1970324 - protein, 9 aa, Staphylococcus
NQSQTAAEQ

SEQ ID NO: 1970325 - protein, 8 aa, Staphylococcus
NQSSEDNM

SEQ ID NO: 1970326 - protein, 12 aa, Staphylococcus
NQSSEEIDTQKT

SEQ ID NO: 1970327 - protein, 6 aa, Staphylococcus
NQSSKY

SEQ ID NO: 1970328 - protein, 6 aa, Staphylococcus
NQSSLN

SEQ ID NO: 1970329 - protein, 28 aa, Staphylococcus
NQSSNATSEGASDNIASSSTSSVSQETE

SEQ ID NO: 1970330 - protein, 13 aa, Staphylococcus
NQSSQNYATQESS

SEQ ID NO: 1970331 - protein, 6 aa, Staphylococcus
NQSSSA

SEQ ID NO: 1970332 - protein, 10 aa, Staphylococcus
NQSVAAEELE

SEQ ID NO: 1970333 - protein, 105 aa, Staphylococcus
NQSVDNEKEYAKHRQKNDDDFKESASSLSTSEINSDSSSTIVNASNQDTVTSTVDSKQSMTANEGQSFGNNESVEEHDHHSKMNSEGAESSNHFTNSEQHSELDS

SEQ ID NO: 1970334 - protein, 7 aa, Staphylococcus
NQTAKEF

SEQ ID NO: 1970335 - protein, 5 aa, Staphylococcus
NQTDD

SEQ ID NO: 1970336 - protein, 12 aa, Staphylococcus
NQTDNLSDHDQQ

SEQ ID NO: 1970337 - protein, 7 aa, Staphylococcus
NQTEGVT

SEQ ID NO: 1970338 - protein, 4 aa, Staphylococcus
NQTF

SEQ ID NO: 1970339 - protein, 5 aa, Staphylococcus
NQTGG

SEQ ID NO: 1970340 - protein, 9 aa, Staphylococcus
NQTGGFKTI

SEQ ID NO: 1970341 - protein, 6 aa, Staphylococcus
NQTGHT

SEQ ID NO: 1970342 - protein, 7 aa, Staphylococcus
NQTGKSN

SEQ ID NO: 1970343 - protein, 4 aa, Staphylococcus
NQTH

SEQ ID NO: 1970344 - protein, 6 aa, Staphylococcus
NQTHKK

SEQ ID NO: 1970345 - protein, 10 aa, Staphylococcus
NQTKAKGKRI

SEQ ID NO: 1970346 - protein, 6 aa, Staphylococcus
NQTKAM

SEQ ID NO: 1970347 - protein, 9 aa, Staphylococcus
NQTKKEGHR

SEQ ID NO: 1970348 - protein, 9 aa, Staphylococcus
NQTKQNGKR

SEQ ID NO: 1970349 - protein, 5 aa, Staphylococcus
NQTKT

SEQ ID NO: 1970350 - protein, 4 aa, Staphylococcus
NQTL

SEQ ID NO: 1970351 - protein, 6 aa, Staphylococcus
NQTLAE

SEQ ID NO: 1970352 - protein, 7 aa, Staphylococcus
NQTLEDS

SEQ ID NO: 1970353 - protein, 9 aa, Staphylococcus
NQTLGEAAE

SEQ ID NO: 1970354 - protein, 12 aa, Staphylococcus
NQTNQKKGLQSS

SEQ ID NO: 1970355 - protein, 14 aa, Staphylococcus
NQTNQKKGLQSTAL

SEQ ID NO: 1970356 - protein, 14 aa, Staphylococcus
NQTNQQKGLQSTAL

SEQ ID NO: 1970357 - protein, 16 aa, Staphylococcus
NQTNTRHRKGSHEAEK

SEQ ID NO: 1970358 - protein, 4 aa, Staphylococcus
NQTP

SEQ ID NO: 1970359 - protein, 7 aa, Staphylococcus
NQTPDQI

SEQ ID NO: 1970360 - protein, 6 aa, Staphylococcus
NQTPFT

SEQ ID NO: 1970361 - protein, 14 aa, Staphylococcus
NQTPFTNEYAENET

SEQ ID NO: 1970362 - protein, 16 aa, Staphylococcus
NQTQQEFENKKQQALS

SEQ ID NO: 1970363 - protein, 5 aa, Staphylococcus
NQTRM

SEQ ID NO: 1970364 - protein, 12 aa, Staphylococcus
NQTRPSDSKKRI

SEQ ID NO: 1970365 - protein, 11 aa, Staphylococcus
NQTRSNHDQTQ

SEQ ID NO: 1970366 - protein, 11 aa, Staphylococcus
NQTSNEAQLND

SEQ ID NO: 1970367 - protein, 6 aa, Staphylococcus
NQTSNN

SEQ ID NO: 1970368 - protein, 12 aa, Staphylococcus
NQTSQSYSGYES

SEQ ID NO: 1970369 - protein, 4 aa, Staphylococcus
NQTT

SEQ ID NO: 1970370 - protein, 7 aa, Staphylococcus
NQTTSEY

SEQ ID NO: 1970371 - protein, 15 aa, Staphylococcus
NQTTTNNLDKCKEDK

SEQ ID NO: 1970372 - protein, 9 aa, Staphylococcus
NQTVNTDTQ

SEQ ID NO: 1970373 - protein, 13 aa, Staphylococcus
NQTVQKNLENYEK

SEQ ID NO: 1970374 - protein, 10 aa, Staphylococcus
NQTVSANDKS

SEQ ID NO: 1970375 - protein, 10 aa, Staphylococcus
NQTVSSPEQT

SEQ ID NO: 1970376 - protein, 11 aa, Staphylococcus
NQTVSTKDKSF

SEQ ID NO: 1970377 - protein, 7 aa, Staphylococcus
NQVEDSR

SEQ ID NO: 1970378 - protein, 24 aa, Staphylococcus
NQVEEELKGKGESDKEEGQQEVSN

SEQ ID NO: 1970379 - protein, 6 aa, Staphylococcus
NQVEST

SEQ ID NO: 1970380 - protein, 5 aa, Staphylococcus
NQVLT

SEQ ID NO: 1970381 - protein, 8 aa, Staphylococcus
NQVNESSI

SEQ ID NO: 1970382 - protein, 6 aa, Staphylococcus
NQVTDE

SEQ ID NO: 1970383 - protein, 11 aa, Staphylococcus
NQYDRGYASYA

SEQ ID NO: 1970384 - protein, 15 aa, Staphylococcus
NQYDRGYASYATDIR

SEQ ID NO: 1970385 - protein, 11 aa, Staphylococcus
NQYEVEDAEQK

SEQ ID NO: 1970386 - protein, 12 aa, Staphylococcus
NQYGATPSQNHS

SEQ ID NO: 1970387 - protein, 5 aa, Staphylococcus
NQYGD

SEQ ID NO: 1970388 - protein, 5 aa, Staphylococcus
NQYKE

SEQ ID NO: 1970389 - protein, 6 aa, Staphylococcus
NQYKNK

SEQ ID NO: 1970390 - protein, 10 aa, Staphylococcus
NQYKNTPSVS

SEQ ID NO: 1970391 - protein, 5 aa, Staphylococcus
NQYNE

SEQ ID NO: 1970392 - protein, 4 aa, Staphylococcus
NQYP

SEQ ID NO: 1970393 - protein, 8 aa, Staphylococcus
NQYPETAK

SEQ ID NO: 1970394 - protein, 7 aa, Staphylococcus
NQYSDDI

SEQ ID NO: 1970395 - protein, 7 aa, Staphylococcus
NQYSPQE

SEQ ID NO: 1970396 - protein, 8 aa, Staphylococcus
NQYTAEQM

SEQ ID NO: 1970397 - protein, 12 aa, Staphylococcus
NQYTATQSDDDF

SEQ ID NO: 1970398 - protein, 5 aa, Staphylococcus
NQYTL

SEQ ID NO: 1970399 - protein, 6 aa, Staphylococcus
NRAEEL

SEQ ID NO: 1970400 - protein, 11 aa, Staphylococcus
NRAEKVRNQDF

SEQ ID NO: 1970401 - protein, 11 aa, Staphylococcus
NRAKEAVGKTL

SEQ ID NO: 1970402 - protein, 16 aa, Staphylococcus
NRAKETYKFAGGKGIN

SEQ ID NO: 1970403 - protein, 6 aa, Staphylococcus
NRALDG

SEQ ID NO: 1970404 - protein, 5 aa, Staphylococcus
NRALN

SEQ ID NO: 1970405 - protein, 6 aa, Staphylococcus
NRAMDG

SEQ ID NO: 1970406 - protein, 4 aa, Staphylococcus
NRAP

SEQ ID NO: 1970407 - protein, 4 aa, Staphylococcus
NRAQ

SEQ ID NO: 1970408 - protein, 6 aa, Staphylococcus
NRAQDI

SEQ ID NO: 1970409 - protein, 4 aa, Staphylococcus
NRAR

SEQ ID NO: 1970410 - protein, 16 aa, Staphylococcus
NRARETYKFAGGKGIN

SEQ ID NO: 1970411 - protein, 8 aa, Staphylococcus
NRARQAAI

SEQ ID NO: 1970412 - protein, 11 aa, Staphylococcus
NRASKVRDEDF

SEQ ID NO: 1970413 - protein, 9 aa, Staphylococcus
NRASQGTFS

SEQ ID NO: 1970414 - protein, 16 aa, Staphylococcus
NRATETYKFAGGKGIN

SEQ ID NO: 1970415 - protein, 6 aa, Staphylococcus
NRATKN

SEQ ID NO: 1970416 - protein, 16 aa, Staphylococcus
NRATSTYKFAGGKGIN

SEQ ID NO: 1970417 - protein, 16 aa, Staphylococcus
NRATTTHKFAGGKGIN

SEQ ID NO: 1970418 - protein, 5 aa, Staphylococcus
NRDDF

SEQ ID NO: 1970419 - protein, 6 aa, Staphylococcus
NRDDYT

SEQ ID NO: 1970420 - protein, 4 aa, Staphylococcus
NRDE

SEQ ID NO: 1970421 - protein, 8 aa, Staphylococcus
NRDEREAI

SEQ ID NO: 1970422 - protein, 18 aa, Staphylococcus
NRDERQGKDPDEVRIGTL

SEQ ID NO: 1970423 - protein, 6 aa, Staphylococcus
NRDESF

SEQ ID NO: 1970424 - protein, 11 aa, Staphylococcus
NRDITSYNDDY

SEQ ID NO: 1970425 - protein, 13 aa, Staphylococcus
NRDKIAVTDGNHS

SEQ ID NO: 1970426 - protein, 10 aa, Staphylococcus
NRDNDGDASK

SEQ ID NO: 1970427 - protein, 4 aa, Staphylococcus
NRDP

SEQ ID NO: 1970428 - protein, 6 aa, Staphylococcus
NRDQSF

SEQ ID NO: 1970429 - protein, 8 aa, Staphylococcus
NRDQTKIA

SEQ ID NO: 1970430 - protein, 12 aa, Staphylococcus
NRDTGDNKSITH

SEQ ID NO: 1970431 - protein, 8 aa, Staphylococcus
NRDYNDLR

SEQ ID NO: 1970432 - protein, 26 aa, Staphylococcus
NREAQSNSSVTKDSTTKDEKLEKDRK

SEQ ID NO: 1970433 - protein, 7 aa, Staphylococcus
NREDETL

SEQ ID NO: 1970434 - protein, 14 aa, Staphylococcus
NREDGDDSLSPGVN

SEQ ID NO: 1970435 - protein, 5 aa, Staphylococcus
NREDK

SEQ ID NO: 1970436 - protein, 5 aa, Staphylococcus
NREEE

SEQ ID NO: 1970437 - protein, 19 aa, Staphylococcus
NREEEHGNAVKQANKPNFD

SEQ ID NO: 1970438 - protein, 7 aa, Staphylococcus
NREEREA

SEQ ID NO: 1970439 - protein, 6 aa, Staphylococcus
NREHGT

SEQ ID NO: 1970440 - protein, 7 aa, Staphylococcus
NREKEWK

SEQ ID NO: 1970441 - protein, 13 aa, Staphylococcus
NREKEWKKRNPRF

SEQ ID NO: 1970442 - protein, 13 aa, Staphylococcus
NRENKIIDTVMIN

SEQ ID NO: 1970443 - protein, 7 aa, Staphylococcus
NREQEWK

SEQ ID NO: 1970444 - protein, 9 aa, Staphylococcus
NRERENVNN

SEQ ID NO: 1970445 - protein, 6 aa, Staphylococcus
NREREW

SEQ ID NO: 1970446 - protein, 8 aa, Staphylococcus
NRESDEQL

SEQ ID NO: 1970447 - protein, 10 aa, Staphylococcus
NRESEHGNAV

SEQ ID NO: 1970448 - protein, 8 aa, Staphylococcus
NRESGNEA

SEQ ID NO: 1970449 - protein, 14 aa, Staphylococcus
NRETDSVGKLWGVI

SEQ ID NO: 1970450 - protein, 8 aa, Staphylococcus
NRETQYKE

SEQ ID NO: 1970451 - protein, 6 aa, Staphylococcus
NRETTF

SEQ ID NO: 1970452 - protein, 5 aa, Staphylococcus
NRETY

SEQ ID NO: 1970453 - protein, 11 aa, Staphylococcus
NREVSKDSRSF

SEQ ID NO: 1970454 - protein, 5 aa, Staphylococcus
NREYR

SEQ ID NO: 1970455 - protein, 6 aa, Staphylococcus
NREYRR

SEQ ID NO: 1970456 - protein, 8 aa, Staphylococcus
NRFKTDSN

SEQ ID NO: 1970457 - protein, 10 aa, Staphylococcus
NRFNKKEEIA

SEQ ID NO: 1970458 - protein, 11 aa, Staphylococcus
NRFNNEDRKEL

SEQ ID NO: 1970459 - protein, 8 aa, Staphylococcus
NRGANGID

SEQ ID NO: 1970460 - protein, 13 aa, Staphylococcus
NRGANGIDGVTST

SEQ ID NO: 1970461 - protein, 12 aa, Staphylococcus
NRGCESVPSNEI

SEQ ID NO: 1970462 - protein, 4 aa, Staphylococcus
NRGD

SEQ ID NO: 1970463 - protein, 6 aa, Staphylococcus
NRGDDS

SEQ ID NO: 1970464 - protein, 14 aa, Staphylococcus
NRGDLDQYEIEGQG

SEQ ID NO: 1970465 - protein, 4 aa, Staphylococcus
NRGE

SEQ ID NO: 1970466 - protein, 6 aa, Staphylococcus
NRGGNG

SEQ ID NO: 1970467 - protein, 5 aa, Staphylococcus
NRGHD

SEQ ID NO: 1970468 - protein, 6 aa, Staphylococcus
NRGHDS

SEQ ID NO: 1970469 - protein, 6 aa, Staphylococcus
NRGHQK

SEQ ID NO: 1970470 - protein, 8 aa, Staphylococcus
NRGINTEH

SEQ ID NO: 1970471 - protein, 8 aa, Staphylococcus
NRGINTTH

SEQ ID NO: 1970472 - protein, 16 aa, Staphylococcus
NRGKSGFEVTNGPGKW

SEQ ID NO: 1970473 - protein, 10 aa, Staphylococcus
NRGKSTKKVK

SEQ ID NO: 1970474 - protein, 16 aa, Staphylococcus
NRGKYGYELTNGPGKW

SEQ ID NO: 1970475 - protein, 25 aa, Staphylococcus
NRGLETAVGDEGGFAPKFEGTEDAV

SEQ ID NO: 1970476 - protein, 6 aa, Staphylococcus
NRGPVM

SEQ ID NO: 1970477 - protein, 36 aa, Staphylococcus
NRGQEKTDKETTKEEQEQFEKERAAFREQLKRDWEE

SEQ ID NO: 1970478 - protein, 15 aa, Staphylococcus
NRGQGRGPGHLETLD

SEQ ID NO: 1970479 - protein, 15 aa, Staphylococcus
NRGRQQLAERAAQEG

SEQ ID NO: 1970480 - protein, 5 aa, Staphylococcus
NRGTK

SEQ ID NO: 1970481 - protein, 5 aa, Staphylococcus
NRGVE

SEQ ID NO: 1970482 - protein, 14 aa, Staphylococcus
NRHGWTKKDMTDQE

SEQ ID NO: 1970483 - protein, 14 aa, Staphylococcus
NRHGWTKQDMTDEA

SEQ ID NO: 1970484 - protein, 8 aa, Staphylococcus
NRHKDSGS

SEQ ID NO: 1970485 - protein, 5 aa, Staphylococcus
NRHSN

SEQ ID NO: 1970486 - protein, 5 aa, Staphylococcus
NRIEG

SEQ ID NO: 1970487 - protein, 21 aa, Staphylococcus
NRIEKDNKPMSKERDNKSSIK

SEQ ID NO: 1970488 - protein, 13 aa, Staphylococcus
NRIKETEKTLTTE

SEQ ID NO: 1970489 - protein, 6 aa, Staphylococcus
NRIQNK

SEQ ID NO: 1970490 - protein, 8 aa, Staphylococcus
NRIQNSEK

SEQ ID NO: 1970491 - protein, 4 aa, Staphylococcus
NRIT

SEQ ID NO: 1970492 - protein, 9 aa, Staphylococcus
NRKAEDKKK

SEQ ID NO: 1970493 - protein, 8 aa, Staphylococcus
NRKDPTNY

SEQ ID NO: 1970494 - protein, 9 aa, Staphylococcus
NRKEKGDSA

SEQ ID NO: 1970495 - protein, 13 aa, Staphylococcus
NRKFQESKANKKW

SEQ ID NO: 1970496 - protein, 7 aa, Staphylococcus
NRKIAPF

SEQ ID NO: 1970497 - protein, 20 aa, Staphylococcus
NRKKVKRKLSYTEKLKYLFK

SEQ ID NO: 1970498 - protein, 8 aa, Staphylococcus
NRKKYTNS

SEQ ID NO: 1970499 - protein, 4 aa, Staphylococcus
NRKL

SEQ ID NO: 1970500 - protein, 13 aa, Staphylococcus
NRKPAKAKKGTDI

SEQ ID NO: 1970501 - protein, 29 aa, Staphylococcus
NRKPITATDEDLDDNNRARSAKLRIAEIL

SEQ ID NO: 1970502 - protein, 29 aa, Staphylococcus
NRKPITATDTDLDENNRARSAKLRVAEIL

SEQ ID NO: 1970503 - protein, 29 aa, Staphylococcus
NRKPITATEEDLDENNRARSAKLRVAEIL

SEQ ID NO: 1970504 - protein, 5 aa, Staphylococcus
NRKPY

SEQ ID NO: 1970505 - protein, 6 aa, Staphylococcus
NRKRGE

SEQ ID NO: 1970506 - protein, 6 aa, Staphylococcus
NRKSSF

SEQ ID NO: 1970507 - protein, 8 aa, Staphylococcus
NRKVGKEV

SEQ ID NO: 1970508 - protein, 23 aa, Staphylococcus
NRLATAKELGATHTINSTNVEDA

SEQ ID NO: 1970509 - protein, 24 aa, Staphylococcus
NRLATAKSLGATHTINSTHTEEAI

SEQ ID NO: 1970510 - protein, 4 aa, Staphylococcus
NRLE

SEQ ID NO: 1970511 - protein, 13 aa, Staphylococcus
NRLEGEVQVEGAK

SEQ ID NO: 1970512 - protein, 8 aa, Staphylococcus
NRLEPVSG

SEQ ID NO: 1970513 - protein, 23 aa, Staphylococcus
NRLETAKSLGATHTINSSNVEQA

SEQ ID NO: 1970514 - protein, 7 aa, Staphylococcus
NRLNDSE

SEQ ID NO: 1970515 - protein, 16 aa, Staphylococcus
NRLNETVTKDFSNATE

SEQ ID NO: 1970516 - protein, 5 aa, Staphylococcus
NRLPK

SEQ ID NO: 1970517 - protein, 9 aa, Staphylococcus
NRLQTARSL

SEQ ID NO: 1970518 - protein, 9 aa, Staphylococcus
NRLQTSSNI

SEQ ID NO: 1970519 - protein, 9 aa, Staphylococcus
NRLRDSNRE

SEQ ID NO: 1970520 - protein, 10 aa, Staphylococcus
NRLSEDKNKE

SEQ ID NO: 1970521 - protein, 7 aa, Staphylococcus
NRLSEQD

SEQ ID NO: 1970522 - protein, 9 aa, Staphylococcus
NRLTNDEKK

SEQ ID NO: 1970523 - protein, 8 aa, Staphylococcus
NRMSGAHG

SEQ ID NO: 1970524 - protein, 18 aa, Staphylococcus
NRNARQGKDPDEVSIGDL

SEQ ID NO: 1970525 - protein, 19 aa, Staphylococcus
NRNDDIGKGIKAGDFDEMP

SEQ ID NO: 1970526 - protein, 7 aa, Staphylococcus
NRNDEVD

SEQ ID NO: 1970527 - protein, 11 aa, Staphylococcus
NRNEDDFNQYT

SEQ ID NO: 1970528 - protein, 43 aa, Staphylococcus
NRNEDINQSTNAKENERVEKQDPNTNDEVERPSKKGFWSRLFG

SEQ ID NO: 1970529 - protein, 17 aa, Staphylococcus
NRNEDKIDISDANAASQ

SEQ ID NO: 1970530 - protein, 8 aa, Staphylococcus
NRNEDKIE

SEQ ID NO: 1970531 - protein, 6 aa, Staphylococcus
NRNELE

SEQ ID NO: 1970532 - protein, 21 aa, Staphylococcus
NRNESRGAHYKPEFPNRNDEE

SEQ ID NO: 1970533 - protein, 7 aa, Staphylococcus
NRNETYK

SEQ ID NO: 1970534 - protein, 4 aa, Staphylococcus
NRNH

SEQ ID NO: 1970535 - protein, 5 aa, Staphylococcus
NRNHA

SEQ ID NO: 1970536 - protein, 6 aa, Staphylococcus
NRNIKA

SEQ ID NO: 1970537 - protein, 11 aa, Staphylococcus
NRNKNKYDKAF

SEQ ID NO: 1970538 - protein, 17 aa, Staphylococcus
NRNKSGFELTNGPGKWT

SEQ ID NO: 1970539 - protein, 16 aa, Staphylococcus
NRNKSGYELTNGPGKW

SEQ ID NO: 1970540 - protein, 4 aa, Staphylococcus
NRNN

SEQ ID NO: 1970541 - protein, 10 aa, Staphylococcus
NRNNGSEETV

SEQ ID NO: 1970542 - protein, 18 aa, Staphylococcus
NRNNIAGDGYSEVKNGDI

SEQ ID NO: 1970543 - protein, 8 aa, Staphylococcus
NRNNTSLK

SEQ ID NO: 1970544 - protein, 5 aa, Staphylococcus
NRNPD

SEQ ID NO: 1970545 - protein, 8 aa, Staphylococcus
NRNPDNYF

SEQ ID NO: 1970546 - protein, 5 aa, Staphylococcus
NRNPE

SEQ ID NO: 1970547 - protein, 6 aa, Staphylococcus
NRNPEN

SEQ ID NO: 1970548 - protein, 7 aa, Staphylococcus
NRNPVDN

SEQ ID NO: 1970549 - protein, 9 aa, Staphylococcus
NRNPVDNQI

SEQ ID NO: 1970550 - protein, 6 aa, Staphylococcus
NRNRDT

SEQ ID NO: 1970551 - protein, 26 aa, Staphylococcus
NRNYTAESQARLERTISQTSQSLDKH

SEQ ID NO: 1970552 - protein, 25 aa, Staphylococcus
NRNYTKESKERLARTISQTSEGIDK

SEQ ID NO: 1970553 - protein, 26 aa, Staphylococcus
NRNYTKESRERLERTVSQTSQSLDKH

SEQ ID NO: 1970554 - protein, 10 aa, Staphylococcus
NRPAEQPLQG

SEQ ID NO: 1970555 - protein, 6 aa, Staphylococcus
NRPATQ

SEQ ID NO: 1970556 - protein, 5 aa, Staphylococcus
NRPEA

SEQ ID NO: 1970557 - protein, 6 aa, Staphylococcus
NRPEDL

SEQ ID NO: 1970558 - protein, 12 aa, Staphylococcus
NRPEDREKYSDQ

SEQ ID NO: 1970559 - protein, 5 aa, Staphylococcus
NRPEQ

SEQ ID NO: 1970560 - protein, 5 aa, Staphylococcus
NRPES

SEQ ID NO: 1970561 - protein, 6 aa, Staphylococcus
NRPESF

SEQ ID NO: 1970562 - protein, 6 aa, Staphylococcus
NRPESL

SEQ ID NO: 1970563 - protein, 10 aa, Staphylococcus
NRPGVPEELQ

SEQ ID NO: 1970564 - protein, 8 aa, Staphylococcus
NRPIPPLE

SEQ ID NO: 1970565 - protein, 9 aa, Staphylococcus
NRPKSDDFP

SEQ ID NO: 1970566 - protein, 6 aa, Staphylococcus
NRPLET

SEQ ID NO: 1970567 - protein, 8 aa, Staphylococcus
NRPQLRQR

SEQ ID NO: 1970568 - protein, 10 aa, Staphylococcus
NRPQNEVEFK

SEQ ID NO: 1970569 - protein, 12 aa, Staphylococcus
NRPQREEEFKEG

SEQ ID NO: 1970570 - protein, 15 aa, Staphylococcus
NRPQTDELKRFLNVI

SEQ ID NO: 1970571 - protein, 5 aa, Staphylococcus
NRQEI

SEQ ID NO: 1970572 - protein, 9 aa, Staphylococcus
NRQITASEL

SEQ ID NO: 1970573 - protein, 11 aa, Staphylococcus
NRQKALGGEIT

SEQ ID NO: 1970574 - protein, 4 aa, Staphylococcus
NRQN

SEQ ID NO: 1970575 - protein, 6 aa, Staphylococcus
NRQNHS

SEQ ID NO: 1970576 - protein, 6 aa, Staphylococcus
NRQPEL

SEQ ID NO: 1970577 - protein, 5 aa, Staphylococcus
NRQQQ

SEQ ID NO: 1970578 - protein, 4 aa, Staphylococcus
NRQR

SEQ ID NO: 1970579 - protein, 12 aa, Staphylococcus
NRQRENSSSLDV

SEQ ID NO: 1970580 - protein, 17 aa, Staphylococcus
NRQYYHPKSTSKAEQQF

SEQ ID NO: 1970581 - protein, 9 aa, Staphylococcus
NRRDDEWKD

SEQ ID NO: 1970582 - protein, 8 aa, Staphylococcus
NRREDEWG

SEQ ID NO: 1970583 - protein, 8 aa, Staphylococcus
NRRHSPKD

SEQ ID NO: 1970584 - protein, 8 aa, Staphylococcus
NRRNDEWA

SEQ ID NO: 1970585 - protein, 8 aa, Staphylococcus
NRRNDEWS

SEQ ID NO: 1970586 - protein, 11 aa, Staphylococcus
NRRSIEKPTTR

SEQ ID NO: 1970587 - protein, 5 aa, Staphylococcus
NRRVN

SEQ ID NO: 1970588 - protein, 10 aa, Staphylococcus
NRSATDNKKV

SEQ ID NO: 1970589 - protein, 9 aa, Staphylococcus
NRSDETAEI

SEQ ID NO: 1970590 - protein, 5 aa, Staphylococcus
NRSDQ

SEQ ID NO: 1970591 - protein, 9 aa, Staphylococcus
NRSDSASWD

SEQ ID NO: 1970592 - protein, 7 aa, Staphylococcus
NRSERLR

SEQ ID NO: 1970593 - protein, 7 aa, Staphylococcus
NRSGENH

SEQ ID NO: 1970594 - protein, 4 aa, Staphylococcus
NRSI

SEQ ID NO: 1970595 - protein, 13 aa, Staphylococcus
NRSILSDSKLTGS

SEQ ID NO: 1970596 - protein, 13 aa, Staphylococcus
NRSITSHSGSTDL

SEQ ID NO: 1970597 - protein, 22 aa, Staphylococcus
NRSKEKTEQMVEESKGKNIHPT

SEQ ID NO: 1970598 - protein, 13 aa, Staphylococcus
NRSKELNESVPDI

SEQ ID NO: 1970599 - protein, 13 aa, Staphylococcus
NRSKELNESVPEI

SEQ ID NO: 1970600 - protein, 26 aa, Staphylococcus
NRSKNTKENNNKKINQLTRKVMKNLG

SEQ ID NO: 1970601 - protein, 7 aa, Staphylococcus
NRSNEAV

SEQ ID NO: 1970602 - protein, 6 aa, Staphylococcus
NRSNEV

SEQ ID NO: 1970603 - protein, 22 aa, Staphylococcus
NRSNKQSVNKKVNSLVEKVMKS

SEQ ID NO: 1970604 - protein, 7 aa, Staphylococcus
NRSNKSI

SEQ ID NO: 1970605 - protein, 4 aa, Staphylococcus
NRSQ

SEQ ID NO: 1970606 - protein, 22 aa, Staphylococcus
NRSRQKTDEMIEESQGKQIHPT

SEQ ID NO: 1970607 - protein, 22 aa, Staphylococcus
NRSRQKTDEMVEESKGKSIHPT

SEQ ID NO: 1970608 - protein, 10 aa, Staphylococcus
NRSRREDVER

SEQ ID NO: 1970609 - protein, 8 aa, Staphylococcus
NRSSEDNM

SEQ ID NO: 1970610 - protein, 22 aa, Staphylococcus
NRSSEKTDEMVKESEGKNIHPT

SEQ ID NO: 1970611 - protein, 22 aa, Staphylococcus
NRSSEKTDEMVNESKGKQIHPT

SEQ ID NO: 1970612 - protein, 8 aa, Staphylococcus
NRSTDNVS

SEQ ID NO: 1970613 - protein, 17 aa, Staphylococcus
NRSVAQTGNKPGVTKQQ

SEQ ID NO: 1970614 - protein, 16 aa, Staphylococcus
NRSYSLEQSLKEGYAQ

SEQ ID NO: 1970615 - protein, 13 aa, Staphylococcus
NRTAEEKAKFKTL

SEQ ID NO: 1970616 - protein, 5 aa, Staphylococcus
NRTDI

SEQ ID NO: 1970617 - protein, 5 aa, Staphylococcus
NRTDN

SEQ ID NO: 1970618 - protein, 8 aa, Staphylococcus
NRTEVSVE

SEQ ID NO: 1970619 - protein, 5 aa, Staphylococcus
NRTGG

SEQ ID NO: 1970620 - protein, 14 aa, Staphylococcus
NRTHDEETGLNLLR

SEQ ID NO: 1970621 - protein, 6 aa, Staphylococcus
NRTIDP

SEQ ID NO: 1970622 - protein, 5 aa, Staphylococcus
NRTIR

SEQ ID NO: 1970623 - protein, 5 aa, Staphylococcus
NRTND

SEQ ID NO: 1970624 - protein, 17 aa, Staphylococcus
NRTNGAVSEKTSAGTLT

SEQ ID NO: 1970625 - protein, 6 aa, Staphylococcus
NRTNYP

SEQ ID NO: 1970626 - protein, 5 aa, Staphylococcus
NRTPA

SEQ ID NO: 1970627 - protein, 5 aa, Staphylococcus
NRTPV

SEQ ID NO: 1970628 - protein, 20 aa, Staphylococcus
NRTQFSDSEKQDNDDHTNEQ

SEQ ID NO: 1970629 - protein, 8 aa, Staphylococcus
NRTQGNFG

SEQ ID NO: 1970630 - protein, 13 aa, Staphylococcus
NRTTGSTAFQGKH

SEQ ID NO: 1970631 - protein, 12 aa, Staphylococcus
NRTVKGSGKNGK

SEQ ID NO: 1970632 - protein, 5 aa, Staphylococcus
NRTVR

SEQ ID NO: 1970633 - protein, 5 aa, Staphylococcus
NRVET

SEQ ID NO: 1970634 - protein, 12 aa, Staphylococcus
NRVKDGSGSSLK

SEQ ID NO: 1970635 - protein, 13 aa, Staphylococcus
NRVKDTEETLTTE

SEQ ID NO: 1970636 - protein, 6 aa, Staphylococcus
NRVNQQ

SEQ ID NO: 1970637 - protein, 9 aa, Staphylococcus
NRVNQQALP

SEQ ID NO: 1970638 - protein, 8 aa, Staphylococcus
NRVSEDAA

SEQ ID NO: 1970639 - protein, 6 aa, Staphylococcus
NRVSEE

SEQ ID NO: 1970640 - protein, 7 aa, Staphylococcus
NRVSEEF

SEQ ID NO: 1970641 - protein, 8 aa, Staphylococcus
NRVSNDAA

SEQ ID NO: 1970642 - protein, 7 aa, Staphylococcus
NRVSSDA

SEQ ID NO: 1970643 - protein, 10 aa, Staphylococcus
NRYAGKAWDN

SEQ ID NO: 1970644 - protein, 5 aa, Staphylococcus
NRYLP

SEQ ID NO: 1970645 - protein, 6 aa, Staphylococcus
NRYQPR

SEQ ID NO: 1970646 - protein, 6 aa, Staphylococcus
NRYTKQ

SEQ ID NO: 1970647 - protein, 10 aa, Staphylococcus
NSAAEGNFEE

SEQ ID NO: 1970648 - protein, 8 aa, Staphylococcus
NSADKRIQ

SEQ ID NO: 1970649 - protein, 6 aa, Staphylococcus
NSAEDI

SEQ ID NO: 1970650 - protein, 12 aa, Staphylococcus
NSAEGTEANLPP

SEQ ID NO: 1970651 - protein, 5 aa, Staphylococcus
NSAFE

SEQ ID NO: 1970652 - protein, 4 aa, Staphylococcus
NSAG

SEQ ID NO: 1970653 - protein, 6 aa, Staphylococcus
NSAGEA

SEQ ID NO: 1970654 - protein, 9 aa, Staphylococcus
NSAGSPTSI

SEQ ID NO: 1970655 - protein, 5 aa, Staphylococcus
NSAIP

SEQ ID NO: 1970656 - protein, 8 aa, Staphylococcus
NSAKNKGV

SEQ ID NO: 1970657 - protein, 9 aa, Staphylococcus
NSAKTSQGF

SEQ ID NO: 1970658 - protein, 16 aa, Staphylococcus
NSAQKFGDFFNQAFDE

SEQ ID NO: 1970659 - protein, 4 aa, Staphylococcus
NSAS

SEQ ID NO: 1970660 - protein, 8 aa, Staphylococcus
NSASDQDV

SEQ ID NO: 1970661 - protein, 6 aa, Staphylococcus
NSASFY

SEQ ID NO: 1970662 - protein, 16 aa, Staphylococcus
NSASNNGFIVHDENEV

SEQ ID NO: 1970663 - protein, 8 aa, Staphylococcus
NSASYYRE

SEQ ID NO: 1970664 - protein, 6 aa, Staphylococcus
NSATQL

SEQ ID NO: 1970665 - protein, 6 aa, Staphylococcus
NSAYDD

SEQ ID NO: 1970666 - protein, 6 aa, Staphylococcus
NSAYES

SEQ ID NO: 1970667 - protein, 8 aa, Staphylococcus
NSAYLGTN

SEQ ID NO: 1970668 - protein, 4 aa, Staphylococcus
NSDA

SEQ ID NO: 1970669 - protein, 17 aa, Staphylococcus
NSDAFKSKLKEGKSYPR

SEQ ID NO: 1970670 - protein, 9 aa, Staphylococcus
NSDDGEPCN

SEQ ID NO: 1970671 - protein, 6 aa, Staphylococcus
NSDDHP

SEQ ID NO: 1970672 - protein, 8 aa, Staphylococcus
NSDDHQMR

SEQ ID NO: 1970673 - protein, 8 aa, Staphylococcus
NSDDHYHQ

SEQ ID NO: 1970674 - protein, 7 aa, Staphylococcus
NSDDPKF

SEQ ID NO: 1970675 - protein, 11 aa, Staphylococcus
NSDDSRAGRWS

SEQ ID NO: 1970676 - protein, 6 aa, Staphylococcus
NSDDTI

SEQ ID NO: 1970677 - protein, 8 aa, Staphylococcus
NSDDYGTN

SEQ ID NO: 1970678 - protein, 4 aa, Staphylococcus
NSDE

SEQ ID NO: 1970679 - protein, 9 aa, Staphylococcus
NSDEDVENV

SEQ ID NO: 1970680 - protein, 6 aa, Staphylococcus
NSDEEV

SEQ ID NO: 1970681 - protein, 9 aa, Staphylococcus
NSDENELRM

SEQ ID NO: 1970682 - protein, 5 aa, Staphylococcus
NSDEP

SEQ ID NO: 1970683 - protein, 7 aa, Staphylococcus
NSDEPLA

SEQ ID NO: 1970684 - protein, 4 aa, Staphylococcus
NSDF

SEQ ID NO: 1970685 - protein, 20 aa, Staphylococcus
NSDFKGKPNDLVWTNKWQAK

SEQ ID NO: 1970686 - protein, 8 aa, Staphylococcus
NSDGAAKT

SEQ ID NO: 1970687 - protein, 5 aa, Staphylococcus
NSDGI

SEQ ID NO: 1970688 - protein, 9 aa, Staphylococcus
NSDGSRGKL

SEQ ID NO: 1970689 - protein, 15 aa, Staphylococcus
NSDGSVEKFDSKGQP

SEQ ID NO: 1970690 - protein, 13 aa, Staphylococcus
NSDGTYTATLTPT

SEQ ID NO: 1970691 - protein, 7 aa, Staphylococcus
NSDHPKM

SEQ ID NO: 1970692 - protein, 12 aa, Staphylococcus
NSDKALHEALAS

SEQ ID NO: 1970693 - protein, 10 aa, Staphylococcus
NSDKDTELNV

SEQ ID NO: 1970694 - protein, 10 aa, Staphylococcus
NSDKDTELYK

SEQ ID NO: 1970695 - protein, 15 aa, Staphylococcus
NSDKGKYQTERSEQL

SEQ ID NO: 1970696 - protein, 12 aa, Staphylococcus
NSDLTEAQNNHL

SEQ ID NO: 1970697 - protein, 14 aa, Staphylococcus
NSDLTEAQNNQLNS

SEQ ID NO: 1970698 - protein, 11 aa, Staphylococcus
NSDNDIKKAQG

SEQ ID NO: 1970699 - protein, 11 aa, Staphylococcus
NSDNKQMTTVT

SEQ ID NO: 1970700 - protein, 5 aa, Staphylococcus
NSDNL

SEQ ID NO: 1970701 - protein, 9 aa, Staphylococcus
NSDNTASIS

SEQ ID NO: 1970702 - protein, 6 aa, Staphylococcus
NSDPAV

SEQ ID NO: 1970703 - protein, 17 aa, Staphylococcus
NSDPEVLDAEDTRLEPK

SEQ ID NO: 1970704 - protein, 7 aa, Staphylococcus
NSDQIEN

SEQ ID NO: 1970705 - protein, 6 aa, Staphylococcus
NSDQIP

SEQ ID NO: 1970706 - protein, 7 aa, Staphylococcus
NSDQTAS

SEQ ID NO: 1970707 - protein, 9 aa, Staphylococcus
NSDQTESIS

SEQ ID NO: 1970708 - protein, 6 aa, Staphylococcus
NSDSDR

SEQ ID NO: 1970709 - protein, 13 aa, Staphylococcus
NSDSEDGPQLVEF

SEQ ID NO: 1970710 - protein, 9 aa, Staphylococcus
NSDSETVAR

SEQ ID NO: 1970711 - protein, 6 aa, Staphylococcus
NSDSVI

SEQ ID NO: 1970712 - protein, 22 aa, Staphylococcus
NSDVDASVNRDERKDIQKNHSA

SEQ ID NO: 1970713 - protein, 14 aa, Staphylococcus
NSDVKPPNGNEEWT

SEQ ID NO: 1970714 - protein, 14 aa, Staphylococcus
NSDVKQNLSLIGQL

SEQ ID NO: 1970715 - protein, 4 aa, Staphylococcus
NSDY

SEQ ID NO: 1970716 - protein, 7 aa, Staphylococcus
NSEAANV

SEQ ID NO: 1970717 - protein, 11 aa, Staphylococcus
NSEDKDLTSHP

SEQ ID NO: 1970718 - protein, 7 aa, Staphylococcus
NSEDPKF

SEQ ID NO: 1970719 - protein, 11 aa, Staphylococcus
NSEDQAKTSFN

SEQ ID NO: 1970720 - protein, 8 aa, Staphylococcus
NSEEQSEL

SEQ ID NO: 1970721 - protein, 11 aa, Staphylococcus
NSEFGSIPSRV

SEQ ID NO: 1970722 - protein, 8 aa, Staphylococcus
NSEGACPE

SEQ ID NO: 1970723 - protein, 9 aa, Staphylococcus
NSEGACPEC

SEQ ID NO: 1970724 - protein, 14 aa, Staphylococcus
NSEGACPECNGKGV

SEQ ID NO: 1970725 - protein, 8 aa, Staphylococcus
NSEGACPQ

SEQ ID NO: 1970726 - protein, 5 aa, Staphylococcus
NSEGD

SEQ ID NO: 1970727 - protein, 9 aa, Staphylococcus
NSEGDLNRE

SEQ ID NO: 1970728 - protein, 7 aa, Staphylococcus
NSEGHRK

SEQ ID NO: 1970729 - protein, 5 aa, Staphylococcus
NSEGI

SEQ ID NO: 1970730 - protein, 4 aa, Staphylococcus
NSEH

SEQ ID NO: 1970731 - protein, 6 aa, Staphylococcus
NSEISK

SEQ ID NO: 1970732 - protein, 10 aa, Staphylococcus
NSEIYNKDGK

SEQ ID NO: 1970733 - protein, 9 aa, Staphylococcus
NSEKDRSEF

SEQ ID NO: 1970734 - protein, 6 aa, Staphylococcus
NSEKFE

SEQ ID NO: 1970735 - protein, 8 aa, Staphylococcus
NSEKPEEN

SEQ ID NO: 1970736 - protein, 6 aa, Staphylococcus
NSELKD

SEQ ID NO: 1970737 - protein, 7 aa, Staphylococcus
NSELNGV

SEQ ID NO: 1970738 - protein, 5 aa, Staphylococcus
NSEMI

SEQ ID NO: 1970739 - protein, 6 aa, Staphylococcus
NSEMID

SEQ ID NO: 1970740 - protein, 4 aa, Staphylococcus
NSEN

SEQ ID NO: 1970741 - protein, 9 aa, Staphylococcus
NSENESEDH

SEQ ID NO: 1970742 - protein, 5 aa, Staphylococcus
NSENI

SEQ ID NO: 1970743 - protein, 7 aa, Staphylococcus
NSENNKH

SEQ ID NO: 1970744 - protein, 10 aa, Staphylococcus
NSEPVAASET

SEQ ID NO: 1970745 - protein, 7 aa, Staphylococcus
NSEQASH

SEQ ID NO: 1970746 - protein, 17 aa, Staphylococcus
NSEQKYKHDNLTTTECP

SEQ ID NO: 1970747 - protein, 8 aa, Staphylococcus
NSEQNKGK

SEQ ID NO: 1970748 - protein, 14 aa, Staphylococcus
NSEQPERGKIYDRN

SEQ ID NO: 1970749 - protein, 6 aa, Staphylococcus
NSEQYG

SEQ ID NO: 1970750 - protein, 8 aa, Staphylococcus
NSERISTK

SEQ ID NO: 1970751 - protein, 9 aa, Staphylococcus
NSERKQHGL

SEQ ID NO: 1970752 - protein, 8 aa, Staphylococcus
NSERKQHQ

SEQ ID NO: 1970753 - protein, 6 aa, Staphylococcus
NSERYG

SEQ ID NO: 1970754 - protein, 4 aa, Staphylococcus
NSES

SEQ ID NO: 1970755 - protein, 9 aa, Staphylococcus
NSESGNEQM

SEQ ID NO: 1970756 - protein, 14 aa, Staphylococcus
NSESIHEAKEVSDH

SEQ ID NO: 1970757 - protein, 28 aa, Staphylococcus
NSESKDDKGTKTYTTDDGSKVKIPKNPK

SEQ ID NO: 1970758 - protein, 9 aa, Staphylococcus
NSESPDPNF

SEQ ID NO: 1970759 - protein, 6 aa, Staphylococcus
NSESPQ

SEQ ID NO: 1970760 - protein, 11 aa, Staphylococcus
NSETGEAETIP

SEQ ID NO: 1970761 - protein, 7 aa, Staphylococcus
NSETGHE

SEQ ID NO: 1970762 - protein, 11 aa, Staphylococcus
NSETGNEEKIQ

SEQ ID NO: 1970763 - protein, 11 aa, Staphylococcus
NSETGNEETIQ

SEQ ID NO: 1970764 - protein, 9 aa, Staphylococcus
NSETGYEQT

SEQ ID NO: 1970765 - protein, 9 aa, Staphylococcus
NSETPGMQP

SEQ ID NO: 1970766 - protein, 14 aa, Staphylococcus
NSETRDGKYKGENR

SEQ ID NO: 1970767 - protein, 5 aa, Staphylococcus
NSEVS

SEQ ID NO: 1970768 - protein, 5 aa, Staphylococcus
NSEYD

SEQ ID NO: 1970769 - protein, 11 aa, Staphylococcus
NSFEEYKKTGV

SEQ ID NO: 1970770 - protein, 12 aa, Staphylococcus
NSFEREAGSQGA

SEQ ID NO: 1970771 - protein, 8 aa, Staphylococcus
NSFNDSSW

SEQ ID NO: 1970772 - protein, 6 aa, Staphylococcus
NSFNKA

SEQ ID NO: 1970773 - protein, 8 aa, Staphylococcus
NSFSKDPQ

SEQ ID NO: 1970774 - protein, 11 aa, Staphylococcus
NSGDKSGTGVA

SEQ ID NO: 1970775 - protein, 11 aa, Staphylococcus
NSGDNSGTGVA

SEQ ID NO: 1970776 - protein, 10 aa, Staphylococcus
NSGDRSGTGL

SEQ ID NO: 1970777 - protein, 8 aa, Staphylococcus
NSGEAHTI

SEQ ID NO: 1970778 - protein, 11 aa, Staphylococcus
NSGEKSGTGVA

SEQ ID NO: 1970779 - protein, 8 aa, Staphylococcus
NSGEQSEL

SEQ ID NO: 1970780 - protein, 10 aa, Staphylococcus
NSGEQSGTGV

SEQ ID NO: 1970781 - protein, 10 aa, Staphylococcus
NSGERSGTGV

SEQ ID NO: 1970782 - protein, 8 aa, Staphylococcus
NSGETSEL

SEQ ID NO: 1970783 - protein, 7 aa, Staphylococcus
NSGGGDV

SEQ ID NO: 1970784 - protein, 13 aa, Staphylococcus
NSGGHAAGNAKEL

SEQ ID NO: 1970785 - protein, 13 aa, Staphylococcus
NSGGHAAQNAKTY

SEQ ID NO: 1970786 - protein, 9 aa, Staphylococcus
NSGGIVSAE

SEQ ID NO: 1970787 - protein, 10 aa, Staphylococcus
NSGGIVSSEP

SEQ ID NO: 1970788 - protein, 11 aa, Staphylococcus
NSGGIVSSEPL

SEQ ID NO: 1970789 - protein, 8 aa, Staphylococcus
NSGGKHHK

SEQ ID NO: 1970790 - protein, 5 aa, Staphylococcus
NSGGL

SEQ ID NO: 1970791 - protein, 11 aa, Staphylococcus
NSGGPSAPRNL

SEQ ID NO: 1970792 - protein, 8 aa, Staphylococcus
NSGHAHAR

SEQ ID NO: 1970793 - protein, 8 aa, Staphylococcus
NSGHNQET

SEQ ID NO: 1970794 - protein, 7 aa, Staphylococcus
NSGHTDP

SEQ ID NO: 1970795 - protein, 6 aa, Staphylococcus
NSGKAV

SEQ ID NO: 1970796 - protein, 7 aa, Staphylococcus
NSGKPCK

SEQ ID NO: 1970797 - protein, 9 aa, Staphylococcus
NSGKSGTFS

SEQ ID NO: 1970798 - protein, 15 aa, Staphylococcus
NSGKVGGYYKDYFKE

SEQ ID NO: 1970799 - protein, 8 aa, Staphylococcus
NSGKVNPV

SEQ ID NO: 1970800 - protein, 10 aa, Staphylococcus
NSGLSQTIEG

SEQ ID NO: 1970801 - protein, 7 aa, Staphylococcus
NSGMTVE

SEQ ID NO: 1970802 - protein, 6 aa, Staphylococcus
NSGNIE

SEQ ID NO: 1970803 - protein, 10 aa, Staphylococcus
NSGNNSGTGV

SEQ ID NO: 1970804 - protein, 9 aa, Staphylococcus
NSGNSSEPH

SEQ ID NO: 1970805 - protein, 8 aa, Staphylococcus
NSGNTNPV

SEQ ID NO: 1970806 - protein, 8 aa, Staphylococcus
NSGQIQGY

SEQ ID NO: 1970807 - protein, 5 aa, Staphylococcus
NSGQL

SEQ ID NO: 1970808 - protein, 5 aa, Staphylococcus
NSGSI

SEQ ID NO: 1970809 - protein, 14 aa, Staphylococcus
NSGSQFKVSNNQTT

SEQ ID NO: 1970810 - protein, 5 aa, Staphylococcus
NSGTI

SEQ ID NO: 1970811 - protein, 7 aa, Staphylococcus
NSHDKHT

SEQ ID NO: 1970812 - protein, 7 aa, Staphylococcus
NSHFEDE

SEQ ID NO: 1970813 - protein, 11 aa, Staphylococcus
NSHKKKSNSGY

SEQ ID NO: 1970814 - protein, 9 aa, Staphylococcus
NSHKPGPTI

SEQ ID NO: 1970815 - protein, 5 aa, Staphylococcus
NSHQN

SEQ ID NO: 1970816 - protein, 6 aa, Staphylococcus
NSHSDA

SEQ ID NO: 1970817 - protein, 12 aa, Staphylococcus
NSHSSKKDIETS

SEQ ID NO: 1970818 - protein, 14 aa, Staphylococcus
NSIDTKVADRDNHL

SEQ ID NO: 1970819 - protein, 16 aa, Staphylococcus
NSIDTKVEDRDNHLKS

SEQ ID NO: 1970820 - protein, 10 aa, Staphylococcus
NSIGNDKKTE

SEQ ID NO: 1970821 - protein, 21 aa, Staphylococcus
NSINKASQELNISTPALSKRI

SEQ ID NO: 1970822 - protein, 12 aa, Staphylococcus
NSIQKLEDEVSK

SEQ ID NO: 1970823 - protein, 9 aa, Staphylococcus
NSITESNDL

SEQ ID NO: 1970824 - protein, 18 aa, Staphylococcus
NSITKEPWYKSEVNSGEF

SEQ ID NO: 1970825 - protein, 15 aa, Staphylococcus
NSKAFDKGITTEEIA

SEQ ID NO: 1970826 - protein, 15 aa, Staphylococcus
NSKAFDKGTTTEDIA

SEQ ID NO: 1970827 - protein, 69 aa, Staphylococcus
NSKASTKTKKSKNKINPKKLQRKVAKEQKKHPITTQSQQALKKEQELKKKLSKKKNKLQKEVKKKRKRK

SEQ ID NO: 1970828 - protein, 4 aa, Staphylococcus
NSKD

SEQ ID NO: 1970829 - protein, 6 aa, Staphylococcus
NSKEAI

SEQ ID NO: 1970830 - protein, 5 aa, Staphylococcus
NSKED

SEQ ID NO: 1970831 - protein, 12 aa, Staphylococcus
NSKEEAEQAGVS

SEQ ID NO: 1970832 - protein, 6 aa, Staphylococcus
NSKEEH

SEQ ID NO: 1970833 - protein, 15 aa, Staphylococcus
NSKEFDKGTTTEDIA

SEQ ID NO: 1970834 - protein, 10 aa, Staphylococcus
NSKEIIGKDD

SEQ ID NO: 1970835 - protein, 10 aa, Staphylococcus
NSKEIIGTDD

SEQ ID NO: 1970836 - protein, 5 aa, Staphylococcus
NSKEK

SEQ ID NO: 1970837 - protein, 8 aa, Staphylococcus
NSKEKQGI

SEQ ID NO: 1970838 - protein, 7 aa, Staphylococcus
NSKEPIA

SEQ ID NO: 1970839 - protein, 6 aa, Staphylococcus
NSKESN

SEQ ID NO: 1970840 - protein, 5 aa, Staphylococcus
NSKET

SEQ ID NO: 1970841 - protein, 8 aa, Staphylococcus
NSKETDTV

SEQ ID NO: 1970842 - protein, 7 aa, Staphylococcus
NSKFNDE

SEQ ID NO: 1970843 - protein, 11 aa, Staphylococcus
NSKGEKDTSMP

SEQ ID NO: 1970844 - protein, 8 aa, Staphylococcus
NSKGELDV

SEQ ID NO: 1970845 - protein, 8 aa, Staphylococcus
NSKGESTI

SEQ ID NO: 1970846 - protein, 16 aa, Staphylococcus
NSKISNSANSDKEERG

SEQ ID NO: 1970847 - protein, 8 aa, Staphylococcus
NSKKSGYI

SEQ ID NO: 1970848 - protein, 21 aa, Staphylococcus
NSKLAENKKLKDVDPDKLQDS

SEQ ID NO: 1970849 - protein, 15 aa, Staphylococcus
NSKLNTTIDGQPFSP

SEQ ID NO: 1970850 - protein, 6 aa, Staphylococcus
NSKLSL

SEQ ID NO: 1970851 - protein, 18 aa, Staphylococcus
NSKMKERAKYQLTDNENI

SEQ ID NO: 1970852 - protein, 10 aa, Staphylococcus
NSKNGDDALF

SEQ ID NO: 1970853 - protein, 13 aa, Staphylococcus
NSKNYHNLADEDN

SEQ ID NO: 1970854 - protein, 5 aa, Staphylococcus
NSKPP

SEQ ID NO: 1970855 - protein, 7 aa, Staphylococcus
NSKQDIT

SEQ ID NO: 1970856 - protein, 7 aa, Staphylococcus
NSKQNYH

SEQ ID NO: 1970857 - protein, 9 aa, Staphylococcus
NSKQTVGIG

SEQ ID NO: 1970858 - protein, 13 aa, Staphylococcus
NSKQYCQRVVMKE

SEQ ID NO: 1970859 - protein, 8 aa, Staphylococcus
NSKSARTI

SEQ ID NO: 1970860 - protein, 31 aa, Staphylococcus
NSKSFDKGTTTDDIAQSISPGLRKKAVAGKF

SEQ ID NO: 1970861 - protein, 23 aa, Staphylococcus
NSKSTEEKREAYAKDITYSTNNE

SEQ ID NO: 1970862 - protein, 14 aa, Staphylococcus
NSKSTEEKREAYAQ

SEQ ID NO: 1970863 - protein, 14 aa, Staphylococcus
NSKSTNEKREAYAQ

SEQ ID NO: 1970864 - protein, 8 aa, Staphylococcus
NSKTEHPL

SEQ ID NO: 1970865 - protein, 6 aa, Staphylococcus
NSKTEI

SEQ ID NO: 1970866 - protein, 6 aa, Staphylococcus
NSKTIP

SEQ ID NO: 1970867 - protein, 9 aa, Staphylococcus
NSKTNSNVE

SEQ ID NO: 1970868 - protein, 9 aa, Staphylococcus
NSKTQNKKN

SEQ ID NO: 1970869 - protein, 11 aa, Staphylococcus
NSKTTAEKREA

SEQ ID NO: 1970870 - protein, 8 aa, Staphylococcus
NSKTTNAK

SEQ ID NO: 1970871 - protein, 11 aa, Staphylococcus
NSKTTTEKREA

SEQ ID NO: 1970872 - protein, 14 aa, Staphylococcus
NSKTTTEKREAYAQ

SEQ ID NO: 1970873 - protein, 16 aa, Staphylococcus
NSKVRQLGSQFTGQRL

SEQ ID NO: 1970874 - protein, 26 aa, Staphylococcus
NSKVTTSKYVNQTNGLLSDNTNYSAS

SEQ ID NO: 1970875 - protein, 4 aa, Staphylococcus
NSKY

SEQ ID NO: 1970876 - protein, 9 aa, Staphylococcus
NSKYAKQSA

SEQ ID NO: 1970877 - protein, 5 aa, Staphylococcus
NSKYD

SEQ ID NO: 1970878 - protein, 13 aa, Staphylococcus
NSLEKSGNKVSRL

SEQ ID NO: 1970879 - protein, 30 aa, Staphylococcus
NSLGGKSNSGEGGEDPLRYQPQKDGSNKIS

SEQ ID NO: 1970880 - protein, 8 aa, Staphylococcus
NSLKDGGT

SEQ ID NO: 1970881 - protein, 15 aa, Staphylococcus
NSLKESQEKNDVDLQ

SEQ ID NO: 1970882 - protein, 6 aa, Staphylococcus
NSLNQL

SEQ ID NO: 1970883 - protein, 7 aa, Staphylococcus
NSLSHQQ

SEQ ID NO: 1970884 - protein, 8 aa, Staphylococcus
NSLSKGEK

SEQ ID NO: 1970885 - protein, 23 aa, Staphylococcus
NSLSKYNELKKGDLSYNKGNSKV

SEQ ID NO: 1970886 - protein, 10 aa, Staphylococcus
NSLTEAEQQH

SEQ ID NO: 1970887 - protein, 7 aa, Staphylococcus
NSLTENE

SEQ ID NO: 1970888 - protein, 6 aa, Staphylococcus
NSLTPN

SEQ ID NO: 1970889 - protein, 20 aa, Staphylococcus
NSLTQQDGRLKGQDPASYEE

SEQ ID NO: 1970890 - protein, 8 aa, Staphylococcus
NSLYTGYT

SEQ ID NO: 1970891 - protein, 10 aa, Staphylococcus
NSLYTGYTTN

SEQ ID NO: 1970892 - protein, 5 aa, Staphylococcus
NSMAA

SEQ ID NO: 1970893 - protein, 5 aa, Staphylococcus
NSMQT

SEQ ID NO: 1970894 - protein, 4 aa, Staphylococcus
NSNA

SEQ ID NO: 1970895 - protein, 18 aa, Staphylococcus
NSNALTSDPKAFKQNAKD

SEQ ID NO: 1970896 - protein, 6 aa, Staphylococcus
NSNDAR

SEQ ID NO: 1970897 - protein, 6 aa, Staphylococcus
NSNDAS

SEQ ID NO: 1970898 - protein, 7 aa, Staphylococcus
NSNDEIS

SEQ ID NO: 1970899 - protein, 9 aa, Staphylococcus
NSNDGEPCN

SEQ ID NO: 1970900 - protein, 7 aa, Staphylococcus
NSNDSEL

SEQ ID NO: 1970901 - protein, 12 aa, Staphylococcus
NSNDVEAKETDT

SEQ ID NO: 1970902 - protein, 13 aa, Staphylococcus
NSNDVESKETDTL

SEQ ID NO: 1970903 - protein, 19 aa, Staphylococcus
NSNEYSQTHKHRGTERGVD

SEQ ID NO: 1970904 - protein, 7 aa, Staphylococcus
NSNGAQF

SEQ ID NO: 1970905 - protein, 6 aa, Staphylococcus
NSNGDW

SEQ ID NO: 1970906 - protein, 7 aa, Staphylococcus
NSNGGDV

SEQ ID NO: 1970907 - protein, 15 aa, Staphylococcus
NSNGYLANYGDAGSL

SEQ ID NO: 1970908 - protein, 8 aa, Staphylococcus
NSNHTAEQ

SEQ ID NO: 1970909 - protein, 7 aa, Staphylococcus
NSNIQGV

SEQ ID NO: 1970910 - protein, 9 aa, Staphylococcus
NSNIQGVNP

SEQ ID NO: 1970911 - protein, 8 aa, Staphylococcus
NSNISYDP

SEQ ID NO: 1970912 - protein, 9 aa, Staphylococcus
NSNKAANVL

SEQ ID NO: 1970913 - protein, 9 aa, Staphylococcus
NSNKAGTFT

SEQ ID NO: 1970914 - protein, 9 aa, Staphylococcus
NSNKEGTFT

SEQ ID NO: 1970915 - protein, 9 aa, Staphylococcus
NSNKTGTFN

SEQ ID NO: 1970916 - protein, 11 aa, Staphylococcus
NSNLETRNNPE

SEQ ID NO: 1970917 - protein, 6 aa, Staphylococcus
NSNLTN

SEQ ID NO: 1970918 - protein, 4 aa, Staphylococcus
NSNM

SEQ ID NO: 1970919 - protein, 7 aa, Staphylococcus
NSNNAEN

SEQ ID NO: 1970920 - protein, 7 aa, Staphylococcus
NSNNQDY

SEQ ID NO: 1970921 - protein, 8 aa, Staphylococcus
NSNPGLAS

SEQ ID NO: 1970922 - protein, 9 aa, Staphylococcus
NSNPMPPRT

SEQ ID NO: 1970923 - protein, 4 aa, Staphylococcus
NSNQ

SEQ ID NO: 1970924 - protein, 6 aa, Staphylococcus
NSNQIK

SEQ ID NO: 1970925 - protein, 6 aa, Staphylococcus
NSNQTI

SEQ ID NO: 1970926 - protein, 7 aa, Staphylococcus
NSNRKDM

SEQ ID NO: 1970927 - protein, 7 aa, Staphylococcus
NSNSNRV

SEQ ID NO: 1970928 - protein, 4 aa, Staphylococcus
NSNT

SEQ ID NO: 1970929 - protein, 13 aa, Staphylococcus
NSPAVSDANPSEY

SEQ ID NO: 1970930 - protein, 8 aa, Staphylococcus
NSPENAAP

SEQ ID NO: 1970931 - protein, 8 aa, Staphylococcus
NSPENSAP

SEQ ID NO: 1970932 - protein, 12 aa, Staphylococcus
NSPFAGREGDYV

SEQ ID NO: 1970933 - protein, 11 aa, Staphylococcus
NSPFKKQDIPM

SEQ ID NO: 1970934 - protein, 9 aa, Staphylococcus
NSPKDSAPQ

SEQ ID NO: 1970935 - protein, 26 aa, Staphylococcus
NSPKSYTENKFTGKTAQHSQLHENKN

SEQ ID NO: 1970936 - protein, 20 aa, Staphylococcus
NSPKTYKESEYKGEKAQHSA

SEQ ID NO: 1970937 - protein, 5 aa, Staphylococcus
NSPNG

SEQ ID NO: 1970938 - protein, 13 aa, Staphylococcus
NSPSIKEITPTDY

SEQ ID NO: 1970939 - protein, 15 aa, Staphylococcus
NSPVNDLSRGCSKED

SEQ ID NO: 1970940 - protein, 17 aa, Staphylococcus
NSQASNQITGVTQSSMT

SEQ ID NO: 1970941 - protein, 6 aa, Staphylococcus
NSQDKT

SEQ ID NO: 1970942 - protein, 19 aa, Staphylococcus
NSQEAIQTAQKEQSEYTKN

SEQ ID NO: 1970943 - protein, 6 aa, Staphylococcus
NSQFKK

SEQ ID NO: 1970944 - protein, 6 aa, Staphylococcus
NSQGKQ

SEQ ID NO: 1970945 - protein, 7 aa, Staphylococcus
NSQHPDS

SEQ ID NO: 1970946 - protein, 5 aa, Staphylococcus
NSQIY

SEQ ID NO: 1970947 - protein, 16 aa, Staphylococcus
NSQKQVSKSELLNETE

SEQ ID NO: 1970948 - protein, 11 aa, Staphylococcus
NSQKRKRKNDT

SEQ ID NO: 1970949 - protein, 20 aa, Staphylococcus
NSQMTQNSDFNAEKKNSTKI

SEQ ID NO: 1970950 - protein, 20 aa, Staphylococcus
NSQMTQNSDFNDEKKVSSKA

SEQ ID NO: 1970951 - protein, 20 aa, Staphylococcus
NSQMTQNSDFNEEKKISTKT

SEQ ID NO: 1970952 - protein, 8 aa, Staphylococcus
NSQNNKYT

SEQ ID NO: 1970953 - protein, 9 aa, Staphylococcus
NSQNVENQK

SEQ ID NO: 1970954 - protein, 7 aa, Staphylococcus
NSQPIAT

SEQ ID NO: 1970955 - protein, 6 aa, Staphylococcus
NSQQTM

SEQ ID NO: 1970956 - protein, 8 aa, Staphylococcus
NSQSGKEN

SEQ ID NO: 1970957 - protein, 8 aa, Staphylococcus
NSRDPQLV

SEQ ID NO: 1970958 - protein, 5 aa, Staphylococcus
NSRID

SEQ ID NO: 1970959 - protein, 14 aa, Staphylococcus
NSRKGRYKGAKVTI

SEQ ID NO: 1970960 - protein, 6 aa, Staphylococcus
NSRKPL

SEQ ID NO: 1970961 - protein, 32 aa, Staphylococcus
NSRKQHDKEENQTPSNEGEEQQDTDVAQKARD

SEQ ID NO: 1970962 - protein, 10 aa, Staphylococcus
NSRNTTIRSN

SEQ ID NO: 1970963 - protein, 7 aa, Staphylococcus
NSRPSYA

SEQ ID NO: 1970964 - protein, 8 aa, Staphylococcus
NSRQAAQQ

SEQ ID NO: 1970965 - protein, 7 aa, Staphylococcus
NSRQANR

SEQ ID NO: 1970966 - protein, 7 aa, Staphylococcus
NSRQEGK

SEQ ID NO: 1970967 - protein, 7 aa, Staphylococcus
NSRQEID

SEQ ID NO: 1970968 - protein, 8 aa, Staphylococcus
NSRQEIST

SEQ ID NO: 1970969 - protein, 8 aa, Staphylococcus
NSRQELNT

SEQ ID NO: 1970970 - protein, 7 aa, Staphylococcus
NSRTLSE

SEQ ID NO: 1970971 - protein, 8 aa, Staphylococcus
NSRTQNAS

SEQ ID NO: 1970972 - protein, 6 aa, Staphylococcus
NSRVAR

SEQ ID NO: 1970973 - protein, 7 aa, Staphylococcus
NSRVARS

SEQ ID NO: 1970974 - protein, 9 aa, Staphylococcus
NSRVARSNY

SEQ ID NO: 1970975 - protein, 10 aa, Staphylococcus
NSRVARSNYQ

SEQ ID NO: 1970976 - protein, 22 aa, Staphylococcus
NSRVDRQLRGRSGRQGDPGSSQ

SEQ ID NO: 1970977 - protein, 8 aa, Staphylococcus
NSRYQANE

SEQ ID NO: 1970978 - protein, 12 aa, Staphylococcus
NSSAKITAEEAD

SEQ ID NO: 1970979 - protein, 9 aa, Staphylococcus
NSSALSSKA

SEQ ID NO: 1970980 - protein, 13 aa, Staphylococcus
NSSARASDAEQEY

SEQ ID NO: 1970981 - protein, 4 aa, Staphylococcus
NSSC

SEQ ID NO: 1970982 - protein, 4 aa, Staphylococcus
NSSD

SEQ ID NO: 1970983 - protein, 12 aa, Staphylococcus
NSSDELKSALHE

SEQ ID NO: 1970984 - protein, 14 aa, Staphylococcus
NSSDFSVSEEDQQE

SEQ ID NO: 1970985 - protein, 6 aa, Staphylococcus
NSSEEV

SEQ ID NO: 1970986 - protein, 5 aa, Staphylococcus
NSSFE

SEQ ID NO: 1970987 - protein, 8 aa, Staphylococcus
NSSHPQSY

SEQ ID NO: 1970988 - protein, 35 aa, Staphylococcus
NSSHQKPKINNNSQSNFEHTKSNVYSTQSQIGQSI

SEQ ID NO: 1970989 - protein, 4 aa, Staphylococcus
NSSI

SEQ ID NO: 1970990 - protein, 4 aa, Staphylococcus
NSSK

SEQ ID NO: 1970991 - protein, 9 aa, Staphylococcus
NSSKAGTFS

SEQ ID NO: 1970992 - protein, 9 aa, Staphylococcus
NSSKGGTFD

SEQ ID NO: 1970993 - protein, 9 aa, Staphylococcus
NSSKGGTFN

SEQ ID NO: 1970994 - protein, 9 aa, Staphylococcus
NSSKIKTRS

SEQ ID NO: 1970995 - protein, 10 aa, Staphylococcus
NSSKKGENAL

SEQ ID NO: 1970996 - protein, 6 aa, Staphylococcus
NSSLKE

SEQ ID NO: 1970997 - protein, 14 aa, Staphylococcus
NSSNQEYTDTSDPF

SEQ ID NO: 1970998 - protein, 6 aa, Staphylococcus
NSSQGL

SEQ ID NO: 1970999 - protein, 11 aa, Staphylococcus
NSSQYQEFTNQ

SEQ ID NO: 1971000 - protein, 4 aa, Staphylococcus
NSSR

SEQ ID NO: 1971001 - protein, 9 aa, Staphylococcus
NSSRAKTKT

SEQ ID NO: 1971002 - protein, 14 aa, Staphylococcus
NSSRLGNSNAARTK

SEQ ID NO: 1971003 - protein, 7 aa, Staphylococcus
NSSTEVQ

SEQ ID NO: 1971004 - protein, 8 aa, Staphylococcus
NSSTLSQQ

SEQ ID NO: 1971005 - protein, 8 aa, Staphylococcus
NSSVNHST

SEQ ID NO: 1971006 - protein, 7 aa, Staphylococcus
NSSVSIN

SEQ ID NO: 1971007 - protein, 5 aa, Staphylococcus
NSSYD

SEQ ID NO: 1971008 - protein, 7 aa, Staphylococcus
NSTAEQA

SEQ ID NO: 1971009 - protein, 15 aa, Staphylococcus
NSTDDEMKEQFPNTK

SEQ ID NO: 1971010 - protein, 8 aa, Staphylococcus
NSTDTSTV

SEQ ID NO: 1971011 - protein, 7 aa, Staphylococcus
NSTEAEA

SEQ ID NO: 1971012 - protein, 14 aa, Staphylococcus
NSTEFDKGITTEEI

SEQ ID NO: 1971013 - protein, 7 aa, Staphylococcus
NSTEVDE

SEQ ID NO: 1971014 - protein, 8 aa, Staphylococcus
NSTFKGNN

SEQ ID NO: 1971015 - protein, 20 aa, Staphylococcus
NSTGDKGGSKYQLKGVGQRE

SEQ ID NO: 1971016 - protein, 7 aa, Staphylococcus
NSTGKDE

SEQ ID NO: 1971017 - protein, 6 aa, Staphylococcus
NSTIGK

SEQ ID NO: 1971018 - protein, 6 aa, Staphylococcus
NSTKAQ

SEQ ID NO: 1971019 - protein, 10 aa, Staphylococcus
NSTKASKKLE

SEQ ID NO: 1971020 - protein, 5 aa, Staphylococcus
NSTKT

SEQ ID NO: 1971021 - protein, 9 aa, Staphylococcus
NSTKVPSDV

SEQ ID NO: 1971022 - protein, 10 aa, Staphylococcus
NSTNETVGVE

SEQ ID NO: 1971023 - protein, 15 aa, Staphylococcus
NSTNPEEGLPIALLK

SEQ ID NO: 1971024 - protein, 9 aa, Staphylococcus
NSTRDNGNR

SEQ ID NO: 1971025 - protein, 20 aa, Staphylococcus
NSTRKRDPLAQKIRESKHPE

SEQ ID NO: 1971026 - protein, 20 aa, Staphylococcus
NSTRKRGPLAQKIRESKHPE

SEQ ID NO: 1971027 - protein, 8 aa, Staphylococcus
NSTRTKSS

SEQ ID NO: 1971028 - protein, 7 aa, Staphylococcus
NSTRTRA

SEQ ID NO: 1971029 - protein, 7 aa, Staphylococcus
NSTRTRC

SEQ ID NO: 1971030 - protein, 12 aa, Staphylococcus
NSTSEDQDEPDY

SEQ ID NO: 1971031 - protein, 8 aa, Staphylococcus
NSTSTDLN

SEQ ID NO: 1971032 - protein, 9 aa, Staphylococcus
NSTSVKTRK

SEQ ID NO: 1971033 - protein, 6 aa, Staphylococcus
NSTTIS

SEQ ID NO: 1971034 - protein, 4 aa, Staphylococcus
NSTV

SEQ ID NO: 1971035 - protein, 5 aa, Staphylococcus
NSTVG

SEQ ID NO: 1971036 - protein, 4 aa, Staphylococcus
NSTY

SEQ ID NO: 1971037 - protein, 6 aa, Staphylococcus
NSTYQR

SEQ ID NO: 1971038 - protein, 15 aa, Staphylococcus
NSVAPRTGNVSAGTS

SEQ ID NO: 1971039 - protein, 5 aa, Staphylococcus
NSVDP

SEQ ID NO: 1971040 - protein, 14 aa, Staphylococcus
NSVGDYEDADWEEE

SEQ ID NO: 1971041 - protein, 6 aa, Staphylococcus
NSVGRN

SEQ ID NO: 1971042 - protein, 6 aa, Staphylococcus
NSVINK

SEQ ID NO: 1971043 - protein, 7 aa, Staphylococcus
NSVINTD

SEQ ID NO: 1971044 - protein, 34 aa, Staphylococcus
NSVKDDSELQKELEEVKQSNAEWQDKYKQSQLNN

SEQ ID NO: 1971045 - protein, 26 aa, Staphylococcus
NSVKVNDKVEKSPKSQVDPEQDEITV

SEQ ID NO: 1971046 - protein, 10 aa, Staphylococcus
NSVNDPNTIA

SEQ ID NO: 1971047 - protein, 6 aa, Staphylococcus
NSVNPI

SEQ ID NO: 1971048 - protein, 14 aa, Staphylococcus
NSVNVTGKEAEATL

SEQ ID NO: 1971049 - protein, 10 aa, Staphylococcus
NSVPEDADAD

SEQ ID NO: 1971050 - protein, 7 aa, Staphylococcus
NSVQTYK

SEQ ID NO: 1971051 - protein, 9 aa, Staphylococcus
NSVRDQDKS

SEQ ID NO: 1971052 - protein, 21 aa, Staphylococcus
NSVSGKKLKEKLENSKDDALM

SEQ ID NO: 1971053 - protein, 6 aa, Staphylococcus
NSVSNK

SEQ ID NO: 1971054 - protein, 6 aa, Staphylococcus
NSVSQQ

SEQ ID NO: 1971055 - protein, 11 aa, Staphylococcus
NSWSKSNASEL

SEQ ID NO: 1971056 - protein, 4 aa, Staphylococcus
NSYG

SEQ ID NO: 1971057 - protein, 7 aa, Staphylococcus
NSYKQGE

SEQ ID NO: 1971058 - protein, 17 aa, Staphylococcus
NSYKRTSIVNQDDTEPL

SEQ ID NO: 1971059 - protein, 12 aa, Staphylococcus
NSYLGATEENQS

SEQ ID NO: 1971060 - protein, 12 aa, Staphylococcus
NSYQDIKAEQSK

SEQ ID NO: 1971061 - protein, 10 aa, Staphylococcus
NSYRHRKSRN

SEQ ID NO: 1971062 - protein, 4 aa, Staphylococcus
NSYS

SEQ ID NO: 1971063 - protein, 12 aa, Staphylococcus
NSYSKMEYNNVQ

SEQ ID NO: 1971064 - protein, 7 aa, Staphylococcus
NSYSTYP

SEQ ID NO: 1971065 - protein, 13 aa, Staphylococcus
NSYTEEEVDEDEH

SEQ ID NO: 1971066 - protein, 7 aa, Staphylococcus
NSYVGTK

SEQ ID NO: 1971067 - protein, 14 aa, Staphylococcus
NTAANNERKPASIG

SEQ ID NO: 1971068 - protein, 22 aa, Staphylococcus
NTAAVKKEGDAFTLTTESGLSI

SEQ ID NO: 1971069 - protein, 8 aa, Staphylococcus
NTADLDEE

SEQ ID NO: 1971070 - protein, 10 aa, Staphylococcus
NTAESYLGDK

SEQ ID NO: 1971071 - protein, 12 aa, Staphylococcus
NTAGAKTAKEAV

SEQ ID NO: 1971072 - protein, 6 aa, Staphylococcus
NTAGNF

SEQ ID NO: 1971073 - protein, 5 aa, Staphylococcus
NTAKR

SEQ ID NO: 1971074 - protein, 7 aa, Staphylococcus
NTAPTDI

SEQ ID NO: 1971075 - protein, 13 aa, Staphylococcus
NTARIAKKAGFTG

SEQ ID NO: 1971076 - protein, 22 aa, Staphylococcus
NTASQYDLEKDTPKQLPFDIET

SEQ ID NO: 1971077 - protein, 11 aa, Staphylococcus
NTATAYPLPQM

SEQ ID NO: 1971078 - protein, 9 aa, Staphylococcus
NTATKQEDI

SEQ ID NO: 1971079 - protein, 13 aa, Staphylococcus
NTATLIDLHQRFK

SEQ ID NO: 1971080 - protein, 6 aa, Staphylococcus
NTCPIS

SEQ ID NO: 1971081 - protein, 7 aa, Staphylococcus
NTCPSST

SEQ ID NO: 1971082 - protein, 7 aa, Staphylococcus
NTDAEGR

SEQ ID NO: 1971083 - protein, 8 aa, Staphylococcus
NTDAKKFT

SEQ ID NO: 1971084 - protein, 6 aa, Staphylococcus
NTDAPA

SEQ ID NO: 1971085 - protein, 9 aa, Staphylococcus
NTDASSTSE

SEQ ID NO: 1971086 - protein, 13 aa, Staphylococcus
NTDCNAQSTETII

SEQ ID NO: 1971087 - protein, 7 aa, Staphylococcus
NTDDGSR

SEQ ID NO: 1971088 - protein, 9 aa, Staphylococcus
NTDEGARRL

SEQ ID NO: 1971089 - protein, 7 aa, Staphylococcus
NTDEPNT

SEQ ID NO: 1971090 - protein, 17 aa, Staphylococcus
NTDFKENEKAMHAKRIF

SEQ ID NO: 1971091 - protein, 16 aa, Staphylococcus
NTDFRENEKMMHRIFQ

SEQ ID NO: 1971092 - protein, 7 aa, Staphylococcus
NTDGFGT

SEQ ID NO: 1971093 - protein, 20 aa, Staphylococcus
NTDGGGWSLPGGKVEKGETL

SEQ ID NO: 1971094 - protein, 5 aa, Staphylococcus
NTDGT

SEQ ID NO: 1971095 - protein, 6 aa, Staphylococcus
NTDHPF

SEQ ID NO: 1971096 - protein, 13 aa, Staphylococcus
NTDKGKIVSAFYK

SEQ ID NO: 1971097 - protein, 5 aa, Staphylococcus
NTDMT

SEQ ID NO: 1971098 - protein, 8 aa, Staphylococcus
NTDMTEKK

SEQ ID NO: 1971099 - protein, 10 aa, Staphylococcus
NTDNARNLQQ

SEQ ID NO: 1971100 - protein, 8 aa, Staphylococcus
NTDNDKAI

SEQ ID NO: 1971101 - protein, 10 aa, Staphylococcus
NTDNDTRGAY

SEQ ID NO: 1971102 - protein, 5 aa, Staphylococcus
NTDNE

SEQ ID NO: 1971103 - protein, 7 aa, Staphylococcus
NTDNEKA

SEQ ID NO: 1971104 - protein, 9 aa, Staphylococcus
NTDNQDEQA

SEQ ID NO: 1971105 - protein, 10 aa, Staphylococcus
NTDNSSIGNK

SEQ ID NO: 1971106 - protein, 4 aa, Staphylococcus
NTDQ

SEQ ID NO: 1971107 - protein, 9 aa, Staphylococcus
NTDQTENID

SEQ ID NO: 1971108 - protein, 9 aa, Staphylococcus
NTDQTSAIN

SEQ ID NO: 1971109 - protein, 8 aa, Staphylococcus
NTDRLNET

SEQ ID NO: 1971110 - protein, 7 aa, Staphylococcus
NTDSKDK

SEQ ID NO: 1971111 - protein, 7 aa, Staphylococcus
NTDSNFK

SEQ ID NO: 1971112 - protein, 9 aa, Staphylococcus
NTDTKIGKQ

SEQ ID NO: 1971113 - protein, 7 aa, Staphylococcus
NTDTTIG

SEQ ID NO: 1971114 - protein, 10 aa, Staphylococcus
NTEATPEQLK

SEQ ID NO: 1971115 - protein, 5 aa, Staphylococcus
NTEDY

SEQ ID NO: 1971116 - protein, 5 aa, Staphylococcus
NTEEA

SEQ ID NO: 1971117 - protein, 8 aa, Staphylococcus
NTEEGGES

SEQ ID NO: 1971118 - protein, 10 aa, Staphylococcus
NTEEQANSLQ

SEQ ID NO: 1971119 - protein, 4 aa, Staphylococcus
NTEF

SEQ ID NO: 1971120 - protein, 5 aa, Staphylococcus
NTEFD

SEQ ID NO: 1971121 - protein, 4 aa, Staphylococcus
NTEG

SEQ ID NO: 1971122 - protein, 13 aa, Staphylococcus
NTEGGRANGITDT

SEQ ID NO: 1971123 - protein, 5 aa, Staphylococcus
NTEGH

SEQ ID NO: 1971124 - protein, 5 aa, Staphylococcus
NTEHA

SEQ ID NO: 1971125 - protein, 6 aa, Staphylococcus
NTEIGS

SEQ ID NO: 1971126 - protein, 7 aa, Staphylococcus
NTEKQTD

SEQ ID NO: 1971127 - protein, 5 aa, Staphylococcus
NTELS

SEQ ID NO: 1971128 - protein, 6 aa, Staphylococcus
NTELTN

SEQ ID NO: 1971129 - protein, 8 aa, Staphylococcus
NTENDNEL

SEQ ID NO: 1971130 - protein, 9 aa, Staphylococcus
NTENNDGNL

SEQ ID NO: 1971131 - protein, 7 aa, Staphylococcus
NTENNNE

SEQ ID NO: 1971132 - protein, 7 aa, Staphylococcus
NTENTNG

SEQ ID NO: 1971133 - protein, 5 aa, Staphylococcus
NTEPD

SEQ ID NO: 1971134 - protein, 8 aa, Staphylococcus
NTEPSTQL

SEQ ID NO: 1971135 - protein, 9 aa, Staphylococcus
NTEQQSVEQ

SEQ ID NO: 1971136 - protein, 5 aa, Staphylococcus
NTEQY

SEQ ID NO: 1971137 - protein, 7 aa, Staphylococcus
NTERFED

SEQ ID NO: 1971138 - protein, 11 aa, Staphylococcus
NTERPEGVDAG

SEQ ID NO: 1971139 - protein, 7 aa, Staphylococcus
NTESARG

SEQ ID NO: 1971140 - protein, 14 aa, Staphylococcus
NTESHAQDKEQYEY

SEQ ID NO: 1971141 - protein, 15 aa, Staphylococcus
NTESPPARNTDPLQD

SEQ ID NO: 1971142 - protein, 16 aa, Staphylococcus
NTESPPGRNTNPLQDD

SEQ ID NO: 1971143 - protein, 22 aa, Staphylococcus
NTESSGNPSATGPGSSEGTPRG

SEQ ID NO: 1971144 - protein, 7 aa, Staphylococcus
NTETGEF

SEQ ID NO: 1971145 - protein, 10 aa, Staphylococcus
NTETQSIDES

SEQ ID NO: 1971146 - protein, 7 aa, Staphylococcus
NTEVTEQ

SEQ ID NO: 1971147 - protein, 4 aa, Staphylococcus
NTEY

SEQ ID NO: 1971148 - protein, 20 aa, Staphylococcus
NTFGDAAKNLKISSTKSMTG

SEQ ID NO: 1971149 - protein, 19 aa, Staphylococcus
NTFGDAANQLKVSSTKSMT

SEQ ID NO: 1971150 - protein, 19 aa, Staphylococcus
NTFGEAAKSLKVSSTKSMT

SEQ ID NO: 1971151 - protein, 20 aa, Staphylococcus
NTFGEAAKSLKVSSTKSMTG

SEQ ID NO: 1971152 - protein, 5 aa, Staphylococcus
NTFGN

SEQ ID NO: 1971153 - protein, 5 aa, Staphylococcus
NTFND

SEQ ID NO: 1971154 - protein, 6 aa, Staphylococcus
NTGDMQ

SEQ ID NO: 1971155 - protein, 7 aa, Staphylococcus
NTGEISV

SEQ ID NO: 1971156 - protein, 9 aa, Staphylococcus
NTGEMRASS

SEQ ID NO: 1971157 - protein, 8 aa, Staphylococcus
NTGETYKL

SEQ ID NO: 1971158 - protein, 15 aa, Staphylococcus
NTGKDISVPVGEETL

SEQ ID NO: 1971159 - protein, 10 aa, Staphylococcus
NTGKVSEGEL

SEQ ID NO: 1971160 - protein, 8 aa, Staphylococcus
NTGLSTNE

SEQ ID NO: 1971161 - protein, 11 aa, Staphylococcus
NTGNKQVDKNT

SEQ ID NO: 1971162 - protein, 6 aa, Staphylococcus
NTGSNH

SEQ ID NO: 1971163 - protein, 8 aa, Staphylococcus
NTGTFGSV

SEQ ID NO: 1971164 - protein, 7 aa, Staphylococcus
NTGTKEF

SEQ ID NO: 1971165 - protein, 4 aa, Staphylococcus
NTGV

SEQ ID NO: 1971166 - protein, 6 aa, Staphylococcus
NTGVYP

SEQ ID NO: 1971167 - protein, 4 aa, Staphylococcus
NTHA

SEQ ID NO: 1971168 - protein, 4 aa, Staphylococcus
NTHK

SEQ ID NO: 1971169 - protein, 7 aa, Staphylococcus
NTHNQRV

SEQ ID NO: 1971170 - protein, 6 aa, Staphylococcus
NTHTSD

SEQ ID NO: 1971171 - protein, 6 aa, Staphylococcus
NTIDDN

SEQ ID NO: 1971172 - protein, 14 aa, Staphylococcus
NTIDDTTKKDAQQL

SEQ ID NO: 1971173 - protein, 7 aa, Staphylococcus
NTIDKYQ

SEQ ID NO: 1971174 - protein, 5 aa, Staphylococcus
NTIDS

SEQ ID NO: 1971175 - protein, 5 aa, Staphylococcus
NTIED

SEQ ID NO: 1971176 - protein, 5 aa, Staphylococcus
NTIES

SEQ ID NO: 1971177 - protein, 12 aa, Staphylococcus
NTIGEVAQDNNL

SEQ ID NO: 1971178 - protein, 8 aa, Staphylococcus
NTIHDGAR

SEQ ID NO: 1971179 - protein, 14 aa, Staphylococcus
NTIIGGGDSAAAAI

SEQ ID NO: 1971180 - protein, 25 aa, Staphylococcus
NTINNEANPELYDAEGNEVNLEKTS

SEQ ID NO: 1971181 - protein, 6 aa, Staphylococcus
NTIPYD

SEQ ID NO: 1971182 - protein, 4 aa, Staphylococcus
NTIQ

SEQ ID NO: 1971183 - protein, 11 aa, Staphylococcus
NTIQNAGGQAI

SEQ ID NO: 1971184 - protein, 5 aa, Staphylococcus
NTITN

SEQ ID NO: 1971185 - protein, 9 aa, Staphylococcus
NTKATDSEI

SEQ ID NO: 1971186 - protein, 7 aa, Staphylococcus
NTKDKYG

SEQ ID NO: 1971187 - protein, 4 aa, Staphylococcus
NTKE

SEQ ID NO: 1971188 - protein, 8 aa, Staphylococcus
NTKEANTI

SEQ ID NO: 1971189 - protein, 32 aa, Staphylococcus
NTKEFDKGTTTEDIAQSISPGLRKKAVAGKLN

SEQ ID NO: 1971190 - protein, 33 aa, Staphylococcus
NTKEQKLTFDRSESGPLPNPVEGTSRSTYLDTP

SEQ ID NO: 1971191 - protein, 9 aa, Staphylococcus
NTKEQPDYD

SEQ ID NO: 1971192 - protein, 6 aa, Staphylococcus
NTKESL

SEQ ID NO: 1971193 - protein, 7 aa, Staphylococcus
NTKGESM

SEQ ID NO: 1971194 - protein, 7 aa, Staphylococcus
NTKKAEI

SEQ ID NO: 1971195 - protein, 10 aa, Staphylococcus
NTKKHAKTNS

SEQ ID NO: 1971196 - protein, 11 aa, Staphylococcus
NTKKNTDSKEI

SEQ ID NO: 1971197 - protein, 5 aa, Staphylococcus
NTKLQ

SEQ ID NO: 1971198 - protein, 9 aa, Staphylococcus
NTKPQEMEN

SEQ ID NO: 1971199 - protein, 14 aa, Staphylococcus
NTKQAIASMSQTQY

SEQ ID NO: 1971200 - protein, 6 aa, Staphylococcus
NTKQQI

SEQ ID NO: 1971201 - protein, 16 aa, Staphylococcus
NTKSPEEIKAVFEEAD

SEQ ID NO: 1971202 - protein, 23 aa, Staphylococcus
NTKSRYGDIANKAEEKSKSVFNS

SEQ ID NO: 1971203 - protein, 11 aa, Staphylococcus
NTKSVESRDMQ

SEQ ID NO: 1971204 - protein, 11 aa, Staphylococcus
NTKSVETRDMQ

SEQ ID NO: 1971205 - protein, 4 aa, Staphylococcus
NTKT

SEQ ID NO: 1971206 - protein, 8 aa, Staphylococcus
NTKTHSNQ

SEQ ID NO: 1971207 - protein, 6 aa, Staphylococcus
NTKVDY

SEQ ID NO: 1971208 - protein, 10 aa, Staphylococcus
NTKVGAQDKP

SEQ ID NO: 1971209 - protein, 11 aa, Staphylococcus
NTKVGPQDKPL

SEQ ID NO: 1971210 - protein, 14 aa, Staphylococcus
NTKVTAGEAGGITQ

SEQ ID NO: 1971211 - protein, 9 aa, Staphylococcus
NTKYNERQA

SEQ ID NO: 1971212 - protein, 5 aa, Staphylococcus
NTKYR

SEQ ID NO: 1971213 - protein, 7 aa, Staphylococcus
NTLADKG

SEQ ID NO: 1971214 - protein, 17 aa, Staphylococcus
NTLDDADEGTLERTSAV

SEQ ID NO: 1971215 - protein, 15 aa, Staphylococcus
NTLDTGNDDIKAKIT

SEQ ID NO: 1971216 - protein, 8 aa, Staphylococcus
NTLEEQNR

SEQ ID NO: 1971217 - protein, 5 aa, Staphylococcus
NTLEQ

SEQ ID NO: 1971218 - protein, 11 aa, Staphylococcus
NTLKEKEDQYQ

SEQ ID NO: 1971219 - protein, 8 aa, Staphylococcus
NTLNEEGR

SEQ ID NO: 1971220 - protein, 18 aa, Staphylococcus
NTLNGTKQLLDSKGPKAV

SEQ ID NO: 1971221 - protein, 5 aa, Staphylococcus
NTLQP

SEQ ID NO: 1971222 - protein, 9 aa, Staphylococcus
NTLSQKGHS

SEQ ID NO: 1971223 - protein, 5 aa, Staphylococcus
NTLTE

SEQ ID NO: 1971224 - protein, 6 aa, Staphylococcus
NTMEAN

SEQ ID NO: 1971225 - protein, 8 aa, Staphylococcus
NTMSTEMS

SEQ ID NO: 1971226 - protein, 9 aa, Staphylococcus
NTNAKGNVL

SEQ ID NO: 1971227 - protein, 21 aa, Staphylococcus
NTNAKRTLKQNLTSKVKQRPT

SEQ ID NO: 1971228 - protein, 6 aa, Staphylococcus
NTNDGK

SEQ ID NO: 1971229 - protein, 7 aa, Staphylococcus
NTNDTED

SEQ ID NO: 1971230 - protein, 8 aa, Staphylococcus
NTNEDNAT

SEQ ID NO: 1971231 - protein, 16 aa, Staphylococcus
NTNELNASYAADGYAR

SEQ ID NO: 1971232 - protein, 6 aa, Staphylococcus
NTNENY

SEQ ID NO: 1971233 - protein, 5 aa, Staphylococcus
NTNET

SEQ ID NO: 1971234 - protein, 6 aa, Staphylococcus
NTNFRE

SEQ ID NO: 1971235 - protein, 6 aa, Staphylococcus
NTNFYD

SEQ ID NO: 1971236 - protein, 8 aa, Staphylococcus
NTNGQKRL

SEQ ID NO: 1971237 - protein, 6 aa, Staphylococcus
NTNGQY

SEQ ID NO: 1971238 - protein, 9 aa, Staphylococcus
NTNGTEIPM

SEQ ID NO: 1971239 - protein, 6 aa, Staphylococcus
NTNLEK

SEQ ID NO: 1971240 - protein, 14 aa, Staphylococcus
NTNLEKISRKNLNR

SEQ ID NO: 1971241 - protein, 9 aa, Staphylococcus
NTNNPDLDA

SEQ ID NO: 1971242 - protein, 7 aa, Staphylococcus
NTNPNIN

SEQ ID NO: 1971243 - protein, 8 aa, Staphylococcus
NTNPNSAI

SEQ ID NO: 1971244 - protein, 12 aa, Staphylococcus
NTNPNSAVLDSQ

SEQ ID NO: 1971245 - protein, 9 aa, Staphylococcus
NTNRPDDIG

SEQ ID NO: 1971246 - protein, 9 aa, Staphylococcus
NTNRPEDKG

SEQ ID NO: 1971247 - protein, 12 aa, Staphylococcus
NTNRPNDKGTYI

SEQ ID NO: 1971248 - protein, 10 aa, Staphylococcus
NTNRPQDKGT

SEQ ID NO: 1971249 - protein, 11 aa, Staphylococcus
NTNRPQDKGTF

SEQ ID NO: 1971250 - protein, 7 aa, Staphylococcus
NTNRPYQ

SEQ ID NO: 1971251 - protein, 9 aa, Staphylococcus
NTNSDISTV

SEQ ID NO: 1971252 - protein, 8 aa, Staphylococcus
NTNSKPWD

SEQ ID NO: 1971253 - protein, 4 aa, Staphylococcus
NTNT

SEQ ID NO: 1971254 - protein, 8 aa, Staphylococcus
NTNTKISD

SEQ ID NO: 1971255 - protein, 6 aa, Staphylococcus
NTPDAF

SEQ ID NO: 1971256 - protein, 14 aa, Staphylococcus
NTPDVDTSEENPDK

SEQ ID NO: 1971257 - protein, 12 aa, Staphylococcus
NTPDVLTETTAE

SEQ ID NO: 1971258 - protein, 12 aa, Staphylococcus
NTPDVSTRSTAE

SEQ ID NO: 1971259 - protein, 11 aa, Staphylococcus
NTPELQANSTF

SEQ ID NO: 1971260 - protein, 7 aa, Staphylococcus
NTPERFS

SEQ ID NO: 1971261 - protein, 10 aa, Staphylococcus
NTPGDLSPQQ

SEQ ID NO: 1971262 - protein, 12 aa, Staphylococcus
NTPIASTNATAE

SEQ ID NO: 1971263 - protein, 6 aa, Staphylococcus
NTPIEY

SEQ ID NO: 1971264 - protein, 5 aa, Staphylococcus
NTPIQ

SEQ ID NO: 1971265 - protein, 7 aa, Staphylococcus
NTPNDSD

SEQ ID NO: 1971266 - protein, 7 aa, Staphylococcus
NTPRDIS

SEQ ID NO: 1971267 - protein, 5 aa, Staphylococcus
NTPSI

SEQ ID NO: 1971268 - protein, 8 aa, Staphylococcus
NTPSLPIN

SEQ ID NO: 1971269 - protein, 4 aa, Staphylococcus
NTQA

SEQ ID NO: 1971270 - protein, 9 aa, Staphylococcus
NTQATKNVK

SEQ ID NO: 1971271 - protein, 4 aa, Staphylococcus
NTQD

SEQ ID NO: 1971272 - protein, 16 aa, Staphylococcus
NTQDKTVTINEDPSLD

SEQ ID NO: 1971273 - protein, 10 aa, Staphylococcus
NTQGQERHTQ

SEQ ID NO: 1971274 - protein, 5 aa, Staphylococcus
NTQHA

SEQ ID NO: 1971275 - protein, 13 aa, Staphylococcus
NTQKPSKQSVSEL

SEQ ID NO: 1971276 - protein, 11 aa, Staphylococcus
NTQLNQTTQAH

SEQ ID NO: 1971277 - protein, 26 aa, Staphylococcus
NTQNEEQDENEQHESKATIRKGPNIK

SEQ ID NO: 1971278 - protein, 6 aa, Staphylococcus
NTQNKI

SEQ ID NO: 1971279 - protein, 7 aa, Staphylococcus
NTQPLGR

SEQ ID NO: 1971280 - protein, 8 aa, Staphylococcus
NTQYRENV

SEQ ID NO: 1971281 - protein, 8 aa, Staphylococcus
NTRDQSYQ

SEQ ID NO: 1971282 - protein, 8 aa, Staphylococcus
NTREENMQ

SEQ ID NO: 1971283 - protein, 9 aa, Staphylococcus
NTREKSDIK

SEQ ID NO: 1971284 - protein, 33 aa, Staphylococcus
NTREQKITLDRSESGALPSNVEGVTRSTYLDSP

SEQ ID NO: 1971285 - protein, 9 aa, Staphylococcus
NTRKEISTV

SEQ ID NO: 1971286 - protein, 8 aa, Staphylococcus
NTRKTNGY

SEQ ID NO: 1971287 - protein, 4 aa, Staphylococcus
NTRL

SEQ ID NO: 1971288 - protein, 5 aa, Staphylococcus
NTRLI

SEQ ID NO: 1971289 - protein, 6 aa, Staphylococcus
NTRPEE

SEQ ID NO: 1971290 - protein, 8 aa, Staphylococcus
NTRPGNTD

SEQ ID NO: 1971291 - protein, 9 aa, Staphylococcus
NTRPVPDSV

SEQ ID NO: 1971292 - protein, 8 aa, Staphylococcus
NTRPVPDT

SEQ ID NO: 1971293 - protein, 6 aa, Staphylococcus
NTRSEA

SEQ ID NO: 1971294 - protein, 7 aa, Staphylococcus
NTRTTRG

SEQ ID NO: 1971295 - protein, 15 aa, Staphylococcus
NTRYQSINTAKNTLK

SEQ ID NO: 1971296 - protein, 5 aa, Staphylococcus
NTSDQ

SEQ ID NO: 1971297 - protein, 5 aa, Staphylococcus
NTSEA

SEQ ID NO: 1971298 - protein, 6 aa, Staphylococcus
NTSFNK

SEQ ID NO: 1971299 - protein, 7 aa, Staphylococcus
NTSHPES

SEQ ID NO: 1971300 - protein, 4 aa, Staphylococcus
NTSL

SEQ ID NO: 1971301 - protein, 6 aa, Staphylococcus
NTSLDG

SEQ ID NO: 1971302 - protein, 10 aa, Staphylococcus
NTSMEEYDER

SEQ ID NO: 1971303 - protein, 8 aa, Staphylococcus
NTSNQDEH

SEQ ID NO: 1971304 - protein, 14 aa, Staphylococcus
NTSNTKTKDGGREG

SEQ ID NO: 1971305 - protein, 5 aa, Staphylococcus
NTSPI

SEQ ID NO: 1971306 - protein, 4 aa, Staphylococcus
NTSQ

SEQ ID NO: 1971307 - protein, 5 aa, Staphylococcus
NTSSM

SEQ ID NO: 1971308 - protein, 6 aa, Staphylococcus
NTSSNH

SEQ ID NO: 1971309 - protein, 13 aa, Staphylococcus
NTSSVEATPSQLN

SEQ ID NO: 1971310 - protein, 10 aa, Staphylococcus
NTSTKEVTRP

SEQ ID NO: 1971311 - protein, 27 aa, Staphylococcus
NTSYETAEKIKQQYGHAYAESASDQDV

SEQ ID NO: 1971312 - protein, 21 aa, Staphylococcus
NTTDSKLKDVEGFSRQVGGAP

SEQ ID NO: 1971313 - protein, 8 aa, Staphylococcus
NTTDTEEI

SEQ ID NO: 1971314 - protein, 6 aa, Staphylococcus
NTTGEA

SEQ ID NO: 1971315 - protein, 7 aa, Staphylococcus
NTTGKNG

SEQ ID NO: 1971316 - protein, 20 aa, Staphylococcus
NTTHTAEERNISQKNEMRTA

SEQ ID NO: 1971317 - protein, 7 aa, Staphylococcus
NTTIENK

SEQ ID NO: 1971318 - protein, 22 aa, Staphylococcus
NTTIPTSKSQVYSTAADNQPSV

SEQ ID NO: 1971319 - protein, 13 aa, Staphylococcus
NTTKPSKQSVSEL

SEQ ID NO: 1971320 - protein, 9 aa, Staphylococcus
NTTKTTISK

SEQ ID NO: 1971321 - protein, 14 aa, Staphylococcus
NTTMKGTDGDSSLN

SEQ ID NO: 1971322 - protein, 23 aa, Staphylococcus
NTTMVGRNGKSNSSNIEYGGRGM

SEQ ID NO: 1971323 - protein, 8 aa, Staphylococcus
NTTNQDEY

SEQ ID NO: 1971324 - protein, 24 aa, Staphylococcus
NTTRKRDGLKSANRVEEGGLSGRP

SEQ ID NO: 1971325 - protein, 9 aa, Staphylococcus
NTTRQRDGL

SEQ ID NO: 1971326 - protein, 21 aa, Staphylococcus
NTTSGRANGITKSLDGEYDGY

SEQ ID NO: 1971327 - protein, 12 aa, Staphylococcus
NTTSQHTNNEVD

SEQ ID NO: 1971328 - protein, 9 aa, Staphylococcus
NTTSQTTRK

SEQ ID NO: 1971329 - protein, 7 aa, Staphylococcus
NTTSSNH

SEQ ID NO: 1971330 - protein, 7 aa, Staphylococcus
NTTYGMD

SEQ ID NO: 1971331 - protein, 7 aa, Staphylococcus
NTVDNNL

SEQ ID NO: 1971332 - protein, 4 aa, Staphylococcus
NTVE

SEQ ID NO: 1971333 - protein, 9 aa, Staphylococcus
NTVENTEKI

SEQ ID NO: 1971334 - protein, 7 aa, Staphylococcus
NTVESAY

SEQ ID NO: 1971335 - protein, 10 aa, Staphylococcus
NTVGSGDSTV

SEQ ID NO: 1971336 - protein, 11 aa, Staphylococcus
NTVKESTYQQA

SEQ ID NO: 1971337 - protein, 4 aa, Staphylococcus
NTVM

SEQ ID NO: 1971338 - protein, 5 aa, Staphylococcus
NTVNT

SEQ ID NO: 1971339 - protein, 8 aa, Staphylococcus
NTVPESAY

SEQ ID NO: 1971340 - protein, 8 aa, Staphylococcus
NTVQNDQP

SEQ ID NO: 1971341 - protein, 14 aa, Staphylococcus
NTVSASQSGDHAEL

SEQ ID NO: 1971342 - protein, 18 aa, Staphylococcus
NTVSNPNTDNIDGNERGG

SEQ ID NO: 1971343 - protein, 7 aa, Staphylococcus
NTVTSDK

SEQ ID NO: 1971344 - protein, 18 aa, Staphylococcus
NTWQSSKKREDNDNSYGL

SEQ ID NO: 1971345 - protein, 5 aa, Staphylococcus
NTWSE

SEQ ID NO: 1971346 - protein, 7 aa, Staphylococcus
NTYANGT

SEQ ID NO: 1971347 - protein, 7 aa, Staphylococcus
NTYGQKT

SEQ ID NO: 1971348 - protein, 9 aa, Staphylococcus
NTYNQQQHS

SEQ ID NO: 1971349 - protein, 5 aa, Staphylococcus
NTYNS

SEQ ID NO: 1971350 - protein, 12 aa, Staphylococcus
NTYSNTEELTHK

SEQ ID NO: 1971351 - protein, 11 aa, Staphylococcus
NVAKAGTDVKV

SEQ ID NO: 1971352 - protein, 8 aa, Staphylococcus
NVAKQVSK

SEQ ID NO: 1971353 - protein, 28 aa, Staphylococcus
NVAKTYGITREEQDQYALNSHKKTIEAY

SEQ ID NO: 1971354 - protein, 4 aa, Staphylococcus
NVAP

SEQ ID NO: 1971355 - protein, 6 aa, Staphylococcus
NVAPTS

SEQ ID NO: 1971356 - protein, 5 aa, Staphylococcus
NVARK

SEQ ID NO: 1971357 - protein, 6 aa, Staphylococcus
NVARKN

SEQ ID NO: 1971358 - protein, 8 aa, Staphylococcus
NVARKNKN

SEQ ID NO: 1971359 - protein, 13 aa, Staphylococcus
NVATKGKGSGLIQ

SEQ ID NO: 1971360 - protein, 7 aa, Staphylococcus
NVATSFQ

SEQ ID NO: 1971361 - protein, 10 aa, Staphylococcus
NVDDDSNWQY

SEQ ID NO: 1971362 - protein, 24 aa, Staphylococcus
NVDDSRVGDTITHADQPAEQPLKG

SEQ ID NO: 1971363 - protein, 25 aa, Staphylococcus
NVDDSRVGDTITHAERPAEAPLQGY

SEQ ID NO: 1971364 - protein, 24 aa, Staphylococcus
NVDDSRVGDTITHANRPAEAPLKG

SEQ ID NO: 1971365 - protein, 12 aa, Staphylococcus
NVDEENKPKKWE

SEQ ID NO: 1971366 - protein, 5 aa, Staphylococcus
NVDES

SEQ ID NO: 1971367 - protein, 5 aa, Staphylococcus
NVDET

SEQ ID NO: 1971368 - protein, 16 aa, Staphylococcus
NVDETEKAMLKQFEGR

SEQ ID NO: 1971369 - protein, 11 aa, Staphylococcus
NVDGDALKKHT

SEQ ID NO: 1971370 - protein, 16 aa, Staphylococcus
NVDGVYSADPKIDKNA

SEQ ID NO: 1971371 - protein, 16 aa, Staphylococcus
NVDGVYSADPKVDENA

SEQ ID NO: 1971372 - protein, 17 aa, Staphylococcus
NVDGVYSADPKVDKDAV

SEQ ID NO: 1971373 - protein, 16 aa, Staphylococcus
NVDGVYSADPKVDKNA

SEQ ID NO: 1971374 - protein, 19 aa, Staphylococcus
NVDGVYSADPKVDKNAEKY

SEQ ID NO: 1971375 - protein, 16 aa, Staphylococcus
NVDGVYSADPKVDPNA

SEQ ID NO: 1971376 - protein, 17 aa, Staphylococcus
NVDGVYSADPKVDPNAV

SEQ ID NO: 1971377 - protein, 4 aa, Staphylococcus
NVDH

SEQ ID NO: 1971378 - protein, 26 aa, Staphylococcus
NVDHDEELKPQEKEEGKFKKLMKSLF

SEQ ID NO: 1971379 - protein, 6 aa, Staphylococcus
NVDPKE

SEQ ID NO: 1971380 - protein, 11 aa, Staphylococcus
NVDQEEVGKTA

SEQ ID NO: 1971381 - protein, 10 aa, Staphylococcus
NVDRGRTDVD

SEQ ID NO: 1971382 - protein, 10 aa, Staphylococcus
NVDRGRTNVD

SEQ ID NO: 1971383 - protein, 5 aa, Staphylococcus
NVDRT

SEQ ID NO: 1971384 - protein, 6 aa, Staphylococcus
NVDSLP

SEQ ID NO: 1971385 - protein, 13 aa, Staphylococcus
NVDTLQSQYKSQP

SEQ ID NO: 1971386 - protein, 7 aa, Staphylococcus
NVDTSQR

SEQ ID NO: 1971387 - protein, 4 aa, Staphylococcus
NVEA

SEQ ID NO: 1971388 - protein, 5 aa, Staphylococcus
NVEAI

SEQ ID NO: 1971389 - protein, 6 aa, Staphylococcus
NVEDTK

SEQ ID NO: 1971390 - protein, 5 aa, Staphylococcus
NVEDV

SEQ ID NO: 1971391 - protein, 9 aa, Staphylococcus
NVEEETDVE

SEQ ID NO: 1971392 - protein, 18 aa, Staphylococcus
NVEGGMDEFGDEGLDIKS

SEQ ID NO: 1971393 - protein, 17 aa, Staphylococcus
NVEGREVSRIGSTFGKT

SEQ ID NO: 1971394 - protein, 9 aa, Staphylococcus
NVEGSNNSL

SEQ ID NO: 1971395 - protein, 9 aa, Staphylococcus
NVEGSYTGQ

SEQ ID NO: 1971396 - protein, 5 aa, Staphylococcus
NVEGT

SEQ ID NO: 1971397 - protein, 4 aa, Staphylococcus
NVEK

SEQ ID NO: 1971398 - protein, 13 aa, Staphylococcus
NVEKGTVLQMRST

SEQ ID NO: 1971399 - protein, 9 aa, Staphylococcus
NVEKNENKI

SEQ ID NO: 1971400 - protein, 7 aa, Staphylococcus
NVEKQSV

SEQ ID NO: 1971401 - protein, 5 aa, Staphylococcus
NVEKR

SEQ ID NO: 1971402 - protein, 21 aa, Staphylococcus
NVEKRTKPDYESTSIPQVSKK

SEQ ID NO: 1971403 - protein, 11 aa, Staphylococcus
NVELTSDFSSA

SEQ ID NO: 1971404 - protein, 15 aa, Staphylococcus
NVENKELRNLEPGEA

SEQ ID NO: 1971405 - protein, 11 aa, Staphylococcus
NVEPPDDEAVK

SEQ ID NO: 1971406 - protein, 21 aa, Staphylococcus
NVEQRPKPDYESTSIPRVSQD

SEQ ID NO: 1971407 - protein, 10 aa, Staphylococcus
NVEQRPKPLY

SEQ ID NO: 1971408 - protein, 4 aa, Staphylococcus
NVES

SEQ ID NO: 1971409 - protein, 5 aa, Staphylococcus
NVESA

SEQ ID NO: 1971410 - protein, 11 aa, Staphylococcus
NVESGKIETQA

SEQ ID NO: 1971411 - protein, 5 aa, Staphylococcus
NVESN

SEQ ID NO: 1971412 - protein, 5 aa, Staphylococcus
NVFSE

SEQ ID NO: 1971413 - protein, 6 aa, Staphylococcus
NVGAGV

SEQ ID NO: 1971414 - protein, 5 aa, Staphylococcus
NVGAH

SEQ ID NO: 1971415 - protein, 7 aa, Staphylococcus
NVGAKGD

SEQ ID NO: 1971416 - protein, 7 aa, Staphylococcus
NVGDKGD

SEQ ID NO: 1971417 - protein, 5 aa, Staphylococcus
NVGDP

SEQ ID NO: 1971418 - protein, 6 aa, Staphylococcus
NVGDSK

SEQ ID NO: 1971419 - protein, 9 aa, Staphylococcus
NVGKPVKAY

SEQ ID NO: 1971420 - protein, 6 aa, Staphylococcus
NVGPEA

SEQ ID NO: 1971421 - protein, 5 aa, Staphylococcus
NVGRN

SEQ ID NO: 1971422 - protein, 9 aa, Staphylococcus
NVGTPEGVR

SEQ ID NO: 1971423 - protein, 7 aa, Staphylococcus
NVGYGTK

SEQ ID NO: 1971424 - protein, 8 aa, Staphylococcus
NVGYGTKA

SEQ ID NO: 1971425 - protein, 9 aa, Staphylococcus
NVGYGTKAH

SEQ ID NO: 1971426 - protein, 8 aa, Staphylococcus
NVGYGTKQ

SEQ ID NO: 1971427 - protein, 11 aa, Staphylococcus
NVGYGTKSHLQ

SEQ ID NO: 1971428 - protein, 10 aa, Staphylococcus
NVGYGTQQHL

SEQ ID NO: 1971429 - protein, 7 aa, Staphylococcus
NVHPSDD

SEQ ID NO: 1971430 - protein, 7 aa, Staphylococcus
NVIDGSN

SEQ ID NO: 1971431 - protein, 15 aa, Staphylococcus
NVIGTKNAAESAQLA

SEQ ID NO: 1971432 - protein, 7 aa, Staphylococcus
NVIPSEV

SEQ ID NO: 1971433 - protein, 19 aa, Staphylococcus
NVKANESVKPKADKLNPNH

SEQ ID NO: 1971434 - protein, 21 aa, Staphylococcus
NVKANVNVKPKADKTNPSHIG

SEQ ID NO: 1971435 - protein, 17 aa, Staphylococcus
NVKDQHPSALSGGQQQR

SEQ ID NO: 1971436 - protein, 7 aa, Staphylococcus
NVKDTDR

SEQ ID NO: 1971437 - protein, 9 aa, Staphylococcus
NVKEEIKSL

SEQ ID NO: 1971438 - protein, 7 aa, Staphylococcus
NVKEGGM

SEQ ID NO: 1971439 - protein, 31 aa, Staphylococcus
NVKETVGNVTDNENLEKEGKEDKASGKVKEA

SEQ ID NO: 1971440 - protein, 4 aa, Staphylococcus
NVKK

SEQ ID NO: 1971441 - protein, 4 aa, Staphylococcus
NVKN

SEQ ID NO: 1971442 - protein, 4 aa, Staphylococcus
NVKP

SEQ ID NO: 1971443 - protein, 7 aa, Staphylococcus
NVKPGGS

SEQ ID NO: 1971444 - protein, 7 aa, Staphylococcus
NVKPGGT

SEQ ID NO: 1971445 - protein, 8 aa, Staphylococcus
NVKQMQSQ

SEQ ID NO: 1971446 - protein, 8 aa, Staphylococcus
NVKQSGID

SEQ ID NO: 1971447 - protein, 4 aa, Staphylococcus
NVKS

SEQ ID NO: 1971448 - protein, 20 aa, Staphylococcus
NVKTIDDSKEIRKQFNQPKM

SEQ ID NO: 1971449 - protein, 13 aa, Staphylococcus
NVKTIDDTNKIRE

SEQ ID NO: 1971450 - protein, 20 aa, Staphylococcus
NVKTIEDSKKISRQFNQPKM

SEQ ID NO: 1971451 - protein, 8 aa, Staphylococcus
NVKTKGDL

SEQ ID NO: 1971452 - protein, 22 aa, Staphylococcus
NVKTVDDSKKIREQFNQKQPKM

SEQ ID NO: 1971453 - protein, 19 aa, Staphylococcus
NVKTVDDSKKISQQYHTPQ

SEQ ID NO: 1971454 - protein, 6 aa, Staphylococcus
NVLPSD

SEQ ID NO: 1971455 - protein, 6 aa, Staphylococcus
NVLPSE

SEQ ID NO: 1971456 - protein, 5 aa, Staphylococcus
NVLQS

SEQ ID NO: 1971457 - protein, 29 aa, Staphylococcus
NVNASLRDATVNSYQPQNDHQVHAKSTAI

SEQ ID NO: 1971458 - protein, 11 aa, Staphylococcus
NVNASPENDTV

SEQ ID NO: 1971459 - protein, 7 aa, Staphylococcus
NVNDTHS

SEQ ID NO: 1971460 - protein, 4 aa, Staphylococcus
NVNE

SEQ ID NO: 1971461 - protein, 9 aa, Staphylococcus
NVNEKNGSV

SEQ ID NO: 1971462 - protein, 6 aa, Staphylococcus
NVNETR

SEQ ID NO: 1971463 - protein, 5 aa, Staphylococcus
NVNGN

SEQ ID NO: 1971464 - protein, 8 aa, Staphylococcus
NVNHERKQ

SEQ ID NO: 1971465 - protein, 8 aa, Staphylococcus
NVNKKKQR

SEQ ID NO: 1971466 - protein, 4 aa, Staphylococcus
NVNP

SEQ ID NO: 1971467 - protein, 12 aa, Staphylococcus
NVNQRQKGQRNS

SEQ ID NO: 1971468 - protein, 21 aa, Staphylococcus
NVNTDRGGSLDIHDDSGQLPL

SEQ ID NO: 1971469 - protein, 28 aa, Staphylococcus
NVNTENQIASAKAVREALDNDKEMYDPR

SEQ ID NO: 1971470 - protein, 5 aa, Staphylococcus
NVNVD

SEQ ID NO: 1971471 - protein, 7 aa, Staphylococcus
NVPAAIK

SEQ ID NO: 1971472 - protein, 4 aa, Staphylococcus
NVPE

SEQ ID NO: 1971473 - protein, 6 aa, Staphylococcus
NVPELD

SEQ ID NO: 1971474 - protein, 11 aa, Staphylococcus
NVPENQKYGAF

SEQ ID NO: 1971475 - protein, 5 aa, Staphylococcus
NVPEQ

SEQ ID NO: 1971476 - protein, 8 aa, Staphylococcus
NVPGAKKG

SEQ ID NO: 1971477 - protein, 7 aa, Staphylococcus
NVPGEDR

SEQ ID NO: 1971478 - protein, 8 aa, Staphylococcus
NVPKDDEV

SEQ ID NO: 1971479 - protein, 6 aa, Staphylococcus
NVPNNE

SEQ ID NO: 1971480 - protein, 8 aa, Staphylococcus
NVPNQKAS

SEQ ID NO: 1971481 - protein, 10 aa, Staphylococcus
NVPSRRKDIT

SEQ ID NO: 1971482 - protein, 4 aa, Staphylococcus
NVPT

SEQ ID NO: 1971483 - protein, 16 aa, Staphylococcus
NVQAQDLSKKVEAQTD

SEQ ID NO: 1971484 - protein, 4 aa, Staphylococcus
NVQD

SEQ ID NO: 1971485 - protein, 34 aa, Staphylococcus
NVQDQTPIQKADNHDSNISQPSETDTLNAESIPV

SEQ ID NO: 1971486 - protein, 8 aa, Staphylococcus
NVQEEYDD

SEQ ID NO: 1971487 - protein, 15 aa, Staphylococcus
NVQGCSDMGSMPDQF

SEQ ID NO: 1971488 - protein, 5 aa, Staphylococcus
NVQKG

SEQ ID NO: 1971489 - protein, 10 aa, Staphylococcus
NVQNSPDYGR

SEQ ID NO: 1971490 - protein, 5 aa, Staphylococcus
NVQPG

SEQ ID NO: 1971491 - protein, 11 aa, Staphylococcus
NVQPHSGSQAN

SEQ ID NO: 1971492 - protein, 17 aa, Staphylococcus
NVQQRPKPDYETTSIPR

SEQ ID NO: 1971493 - protein, 4 aa, Staphylococcus
NVQS

SEQ ID NO: 1971494 - protein, 12 aa, Staphylococcus
NVQSNYATQESS

SEQ ID NO: 1971495 - protein, 11 aa, Staphylococcus
NVQSSSQQNET

SEQ ID NO: 1971496 - protein, 4 aa, Staphylococcus
NVQT

SEQ ID NO: 1971497 - protein, 4 aa, Staphylococcus
NVRD

SEQ ID NO: 1971498 - protein, 16 aa, Staphylococcus
NVRHQSQDEKSPIQNN

SEQ ID NO: 1971499 - protein, 4 aa, Staphylococcus
NVRK

SEQ ID NO: 1971500 - protein, 41 aa, Staphylococcus
NVRRDSNDELKKQQKNSDITEDDLRTQTDDVQKLTDDSIKE

SEQ ID NO: 1971501 - protein, 5 aa, Staphylococcus
NVRRS

SEQ ID NO: 1971502 - protein, 5 aa, Staphylococcus
NVSAG

SEQ ID NO: 1971503 - protein, 11 aa, Staphylococcus
NVSAKEGALVE

SEQ ID NO: 1971504 - protein, 9 aa, Staphylococcus
NVSAQEGAL

SEQ ID NO: 1971505 - protein, 8 aa, Staphylococcus
NVSAREGA

SEQ ID NO: 1971506 - protein, 8 aa, Staphylococcus
NVSDKKEM

SEQ ID NO: 1971507 - protein, 7 aa, Staphylococcus
NVSDKYG

SEQ ID NO: 1971508 - protein, 7 aa, Staphylococcus
NVSDQYG

SEQ ID NO: 1971509 - protein, 16 aa, Staphylococcus
NVSDTTIKKYKSSARI

SEQ ID NO: 1971510 - protein, 7 aa, Staphylococcus
NVSEAEA

SEQ ID NO: 1971511 - protein, 7 aa, Staphylococcus
NVSEDQA

SEQ ID NO: 1971512 - protein, 6 aa, Staphylococcus
NVSEER

SEQ ID NO: 1971513 - protein, 9 aa, Staphylococcus
NVSEKNGSV

SEQ ID NO: 1971514 - protein, 5 aa, Staphylococcus
NVSEL

SEQ ID NO: 1971515 - protein, 6 aa, Staphylococcus
NVSEQY

SEQ ID NO: 1971516 - protein, 6 aa, Staphylococcus
NVSEST

SEQ ID NO: 1971517 - protein, 6 aa, Staphylococcus
NVSESY

SEQ ID NO: 1971518 - protein, 12 aa, Staphylococcus
NVSKTAGGKGLN

SEQ ID NO: 1971519 - protein, 7 aa, Staphylococcus
NVSKVPD

SEQ ID NO: 1971520 - protein, 15 aa, Staphylococcus
NVSLPETFTNQDANE

SEQ ID NO: 1971521 - protein, 4 aa, Staphylococcus
NVSN

SEQ ID NO: 1971522 - protein, 9 aa, Staphylococcus
NVSNEQAKS

SEQ ID NO: 1971523 - protein, 9 aa, Staphylococcus
NVSNEQARK

SEQ ID NO: 1971524 - protein, 6 aa, Staphylococcus
NVSNKN

SEQ ID NO: 1971525 - protein, 8 aa, Staphylococcus
NVSNQQAR

SEQ ID NO: 1971526 - protein, 8 aa, Staphylococcus
NVSPSTVS

SEQ ID NO: 1971527 - protein, 7 aa, Staphylococcus
NVSPTKV

SEQ ID NO: 1971528 - protein, 4 aa, Staphylococcus
NVSQ

SEQ ID NO: 1971529 - protein, 6 aa, Staphylococcus
NVSQEA

SEQ ID NO: 1971530 - protein, 6 aa, Staphylococcus
NVSRKT

SEQ ID NO: 1971531 - protein, 7 aa, Staphylococcus
NVSSKES

SEQ ID NO: 1971532 - protein, 7 aa, Staphylococcus
NVSYDEA

SEQ ID NO: 1971533 - protein, 7 aa, Staphylococcus
NVSYRSE

SEQ ID NO: 1971534 - protein, 7 aa, Staphylococcus
NVTADSE

SEQ ID NO: 1971535 - protein, 8 aa, Staphylococcus
NVTAEEVN

SEQ ID NO: 1971536 - protein, 7 aa, Staphylococcus
NVTAQSD

SEQ ID NO: 1971537 - protein, 14 aa, Staphylococcus
NVTATQVNEAFEAN

SEQ ID NO: 1971538 - protein, 13 aa, Staphylococcus
NVTEEDEGTTITV

SEQ ID NO: 1971539 - protein, 16 aa, Staphylococcus
NVTGGFGSQGASTLTQ

SEQ ID NO: 1971540 - protein, 9 aa, Staphylococcus
NVTNKIDTK

SEQ ID NO: 1971541 - protein, 6 aa, Staphylococcus
NVTNQN

SEQ ID NO: 1971542 - protein, 4 aa, Staphylococcus
NVTP

SEQ ID NO: 1971543 - protein, 8 aa, Staphylococcus
NVTPTSDY

SEQ ID NO: 1971544 - protein, 10 aa, Staphylococcus
NVTQKGNART

SEQ ID NO: 1971545 - protein, 10 aa, Staphylococcus
NVTQKIDTTE

SEQ ID NO: 1971546 - protein, 8 aa, Staphylococcus
NVTQTRGL

SEQ ID NO: 1971547 - protein, 6 aa, Staphylococcus
NVTQVE

SEQ ID NO: 1971548 - protein, 7 aa, Staphylococcus
NVTSQSD

SEQ ID NO: 1971549 - protein, 8 aa, Staphylococcus
NVTSQSEY

SEQ ID NO: 1971550 - protein, 9 aa, Staphylococcus
NVTSQSPYV

SEQ ID NO: 1971551 - protein, 4 aa, Staphylococcus
NVTT

SEQ ID NO: 1971552 - protein, 6 aa, Staphylococcus
NVTTAN

SEQ ID NO: 1971553 - protein, 7 aa, Staphylococcus
NVTTIKR

SEQ ID NO: 1971554 - protein, 27 aa, Staphylococcus
NVTTKGSGYVTNQSVASGSTLKSNKKI

SEQ ID NO: 1971555 - protein, 21 aa, Staphylococcus
NVTTLEESNKVREKFNKPKLT

SEQ ID NO: 1971556 - protein, 6 aa, Staphylococcus
NVTTNY

SEQ ID NO: 1971557 - protein, 16 aa, Staphylococcus
NVTVKGPKGELSKTLN

SEQ ID NO: 1971558 - protein, 19 aa, Staphylococcus
NVVGQSSQKAQDSLKGKDL

SEQ ID NO: 1971559 - protein, 4 aa, Staphylococcus
NVYK

SEQ ID NO: 1971560 - protein, 5 aa, Staphylococcus
NVYNN

SEQ ID NO: 1971561 - protein, 8 aa, Staphylococcus
NVYNNNVS

SEQ ID NO: 1971562 - protein, 10 aa, Staphylococcus
NWAKTKQVET

SEQ ID NO: 1971563 - protein, 10 aa, Staphylococcus
NWDDEKQNKF

SEQ ID NO: 1971564 - protein, 6 aa, Staphylococcus
NWEEER

SEQ ID NO: 1971565 - protein, 7 aa, Staphylococcus
NWGNEKV

SEQ ID NO: 1971566 - protein, 4 aa, Staphylococcus
NWKN

SEQ ID NO: 1971567 - protein, 7 aa, Staphylococcus
NWQTQDK

SEQ ID NO: 1971568 - protein, 17 aa, Staphylococcus
NWRNANGYTGSPGSLEK

SEQ ID NO: 1971569 - protein, 7 aa, Staphylococcus
NWSDWSS

SEQ ID NO: 1971570 - protein, 12 aa, Staphylococcus
NYAASKEKDDKD

SEQ ID NO: 1971571 - protein, 12 aa, Staphylococcus
NYAASKEKNDND

SEQ ID NO: 1971572 - protein, 13 aa, Staphylococcus
NYAASQKEALETA

SEQ ID NO: 1971573 - protein, 4 aa, Staphylococcus
NYAK

SEQ ID NO: 1971574 - protein, 9 aa, Staphylococcus
NYAKEQFKS

SEQ ID NO: 1971575 - protein, 10 aa, Staphylococcus
NYAKNQFKDN

SEQ ID NO: 1971576 - protein, 10 aa, Staphylococcus
NYAKNQFKNN

SEQ ID NO: 1971577 - protein, 7 aa, Staphylococcus
NYAQQND

SEQ ID NO: 1971578 - protein, 5 aa, Staphylococcus
NYATK

SEQ ID NO: 1971579 - protein, 13 aa, Staphylococcus
NYATSQKEALETA

SEQ ID NO: 1971580 - protein, 4 aa, Staphylococcus
NYDD

SEQ ID NO: 1971581 - protein, 16 aa, Staphylococcus
NYDDEVDNESGEDSIH

SEQ ID NO: 1971582 - protein, 12 aa, Staphylococcus
NYDDQNQPNGSE

SEQ ID NO: 1971583 - protein, 7 aa, Staphylococcus
NYDEDED

SEQ ID NO: 1971584 - protein, 7 aa, Staphylococcus
NYDGKNK

SEQ ID NO: 1971585 - protein, 4 aa, Staphylococcus
NYDI

SEQ ID NO: 1971586 - protein, 11 aa, Staphylococcus
NYDKNNGLSDQ

SEQ ID NO: 1971587 - protein, 10 aa, Staphylococcus
NYDPKDQTQF

SEQ ID NO: 1971588 - protein, 7 aa, Staphylococcus
NYDPNYR

SEQ ID NO: 1971589 - protein, 7 aa, Staphylococcus
NYDPYQQ

SEQ ID NO: 1971590 - protein, 8 aa, Staphylococcus
NYDQQGCY

SEQ ID NO: 1971591 - protein, 6 aa, Staphylococcus
NYDSEL

SEQ ID NO: 1971592 - protein, 6 aa, Staphylococcus
NYDTNE

SEQ ID NO: 1971593 - protein, 6 aa, Staphylococcus
NYDTNY

SEQ ID NO: 1971594 - protein, 7 aa, Staphylococcus
NYDYPKQ

SEQ ID NO: 1971595 - protein, 15 aa, Staphylococcus
NYEAEQLADEIITIG

SEQ ID NO: 1971596 - protein, 14 aa, Staphylococcus
NYEAETLADELIII

SEQ ID NO: 1971597 - protein, 5 aa, Staphylococcus
NYEAK

SEQ ID NO: 1971598 - protein, 6 aa, Staphylococcus
NYEASY

SEQ ID NO: 1971599 - protein, 14 aa, Staphylococcus
NYEATSLAHEIITI

SEQ ID NO: 1971600 - protein, 7 aa, Staphylococcus
NYEDAIQ

SEQ ID NO: 1971601 - protein, 6 aa, Staphylococcus
NYEERA

SEQ ID NO: 1971602 - protein, 7 aa, Staphylococcus
NYEGNDE

SEQ ID NO: 1971603 - protein, 9 aa, Staphylococcus
NYEGQEFSE

SEQ ID NO: 1971604 - protein, 6 aa, Staphylococcus
NYEGQG

SEQ ID NO: 1971605 - protein, 4 aa, Staphylococcus
NYEH

SEQ ID NO: 1971606 - protein, 4 aa, Staphylococcus
NYEK

SEQ ID NO: 1971607 - protein, 11 aa, Staphylococcus
NYEKAEQIYGD

SEQ ID NO: 1971608 - protein, 10 aa, Staphylococcus
NYEKAEQIYN

SEQ ID NO: 1971609 - protein, 18 aa, Staphylococcus
NYENEGTVGKAIDNSHVT

SEQ ID NO: 1971610 - protein, 6 aa, Staphylococcus
NYENEK

SEQ ID NO: 1971611 - protein, 8 aa, Staphylococcus
NYENEQSE

SEQ ID NO: 1971612 - protein, 9 aa, Staphylococcus
NYEPPQGNL

SEQ ID NO: 1971613 - protein, 13 aa, Staphylococcus
NYEPYYTSHSEAD

SEQ ID NO: 1971614 - protein, 4 aa, Staphylococcus
NYER

SEQ ID NO: 1971615 - protein, 4 aa, Staphylococcus
NYGA

SEQ ID NO: 1971616 - protein, 10 aa, Staphylococcus
NYGDENYKTI

SEQ ID NO: 1971617 - protein, 5 aa, Staphylococcus
NYGHA

SEQ ID NO: 1971618 - protein, 9 aa, Staphylococcus
NYGKPFSND

SEQ ID NO: 1971619 - protein, 5 aa, Staphylococcus
NYHGS

SEQ ID NO: 1971620 - protein, 11 aa, Staphylococcus
NYISDEKSDAT

SEQ ID NO: 1971621 - protein, 5 aa, Staphylococcus
NYITQ

SEQ ID NO: 1971622 - protein, 12 aa, Staphylococcus
NYKDFKDKMSKK

SEQ ID NO: 1971623 - protein, 4 aa, Staphylococcus
NYKE

SEQ ID NO: 1971624 - protein, 13 aa, Staphylococcus
NYKGQDKNNQYTF

SEQ ID NO: 1971625 - protein, 8 aa, Staphylococcus
NYKKGLQT

SEQ ID NO: 1971626 - protein, 7 aa, Staphylococcus
NYKPEEE

SEQ ID NO: 1971627 - protein, 9 aa, Staphylococcus
NYKPTNSDL

SEQ ID NO: 1971628 - protein, 11 aa, Staphylococcus
NYKQKKGDIKQ

SEQ ID NO: 1971629 - protein, 17 aa, Staphylococcus
NYKSEKDKSTDALMEDL

SEQ ID NO: 1971630 - protein, 11 aa, Staphylococcus
NYKSGTNGPLD

SEQ ID NO: 1971631 - protein, 8 aa, Staphylococcus
NYKSTPEL

SEQ ID NO: 1971632 - protein, 4 aa, Staphylococcus
NYKT

SEQ ID NO: 1971633 - protein, 17 aa, Staphylococcus
NYKTARERALSNNHIPE

SEQ ID NO: 1971634 - protein, 13 aa, Staphylococcus
NYKTGPNERQDHP

SEQ ID NO: 1971635 - protein, 9 aa, Staphylococcus
NYKTKKKAH

SEQ ID NO: 1971636 - protein, 19 aa, Staphylococcus
NYKTSTNFANHKQDTPLPN

SEQ ID NO: 1971637 - protein, 10 aa, Staphylococcus
NYKVTSKANR

SEQ ID NO: 1971638 - protein, 8 aa, Staphylococcus
NYKYTQSD

SEQ ID NO: 1971639 - protein, 4 aa, Staphylococcus
NYLK

SEQ ID NO: 1971640 - protein, 14 aa, Staphylococcus
NYLNSTPSREHPHD

SEQ ID NO: 1971641 - protein, 14 aa, Staphylococcus
NYMSSKAKSAFNTN

SEQ ID NO: 1971642 - protein, 12 aa, Staphylococcus
NYNDNNHSLSGN

SEQ ID NO: 1971643 - protein, 5 aa, Staphylococcus
NYNEE

SEQ ID NO: 1971644 - protein, 8 aa, Staphylococcus
NYNETHPD

SEQ ID NO: 1971645 - protein, 11 aa, Staphylococcus
NYNGKIPDYPI

SEQ ID NO: 1971646 - protein, 5 aa, Staphylococcus
NYNKN

SEQ ID NO: 1971647 - protein, 4 aa, Staphylococcus
NYNN

SEQ ID NO: 1971648 - protein, 15 aa, Staphylococcus
NYNNTEQEKGPRVQS

SEQ ID NO: 1971649 - protein, 13 aa, Staphylococcus
NYNNVSDIIGLDA

SEQ ID NO: 1971650 - protein, 7 aa, Staphylococcus
NYNPNYK

SEQ ID NO: 1971651 - protein, 7 aa, Staphylococcus
NYNPNYT

SEQ ID NO: 1971652 - protein, 7 aa, Staphylococcus
NYNQMQK

SEQ ID NO: 1971653 - protein, 6 aa, Staphylococcus
NYNRKK

SEQ ID NO: 1971654 - protein, 7 aa, Staphylococcus
NYNRNYP

SEQ ID NO: 1971655 - protein, 4 aa, Staphylococcus
NYNT

SEQ ID NO: 1971656 - protein, 6 aa, Staphylococcus
NYNTDA

SEQ ID NO: 1971657 - protein, 4 aa, Staphylococcus
NYPD

SEQ ID NO: 1971658 - protein, 10 aa, Staphylococcus
NYPDNVPTNV

SEQ ID NO: 1971659 - protein, 6 aa, Staphylococcus
NYPEER

SEQ ID NO: 1971660 - protein, 12 aa, Staphylococcus
NYPKTAQEVGKG

SEQ ID NO: 1971661 - protein, 6 aa, Staphylococcus
NYPPRH

SEQ ID NO: 1971662 - protein, 5 aa, Staphylococcus
NYPSR

SEQ ID NO: 1971663 - protein, 8 aa, Staphylococcus
NYPTDEDG

SEQ ID NO: 1971664 - protein, 8 aa, Staphylococcus
NYPTDEEG

SEQ ID NO: 1971665 - protein, 5 aa, Staphylococcus
NYPTI

SEQ ID NO: 1971666 - protein, 10 aa, Staphylococcus
NYQDKKKEII

SEQ ID NO: 1971667 - protein, 9 aa, Staphylococcus
NYQDRNKGW

SEQ ID NO: 1971668 - protein, 11 aa, Staphylococcus
NYQDYSQNQPV

SEQ ID NO: 1971669 - protein, 7 aa, Staphylococcus
NYQGNDD

SEQ ID NO: 1971670 - protein, 6 aa, Staphylococcus
NYQKGH

SEQ ID NO: 1971671 - protein, 10 aa, Staphylococcus
NYQKQTQEFE

SEQ ID NO: 1971672 - protein, 13 aa, Staphylococcus
NYQPNEAARTLYK

SEQ ID NO: 1971673 - protein, 13 aa, Staphylococcus
NYQPNSAARQLYQ

SEQ ID NO: 1971674 - protein, 5 aa, Staphylococcus
NYQTD

SEQ ID NO: 1971675 - protein, 7 aa, Staphylococcus
NYQTEED

SEQ ID NO: 1971676 - protein, 5 aa, Staphylococcus
NYQTN

SEQ ID NO: 1971677 - protein, 5 aa, Staphylococcus
NYREG

SEQ ID NO: 1971678 - protein, 8 aa, Staphylococcus
NYREQIKG

SEQ ID NO: 1971679 - protein, 7 aa, Staphylococcus
NYRKEKL

SEQ ID NO: 1971680 - protein, 14 aa, Staphylococcus
NYRKPGAGAYPLRG

SEQ ID NO: 1971681 - protein, 9 aa, Staphylococcus
NYRKPGCGA

SEQ ID NO: 1971682 - protein, 13 aa, Staphylococcus
NYRKPGSGAYPLR

SEQ ID NO: 1971683 - protein, 14 aa, Staphylococcus
NYRKPGTGAYPLRG

SEQ ID NO: 1971684 - protein, 9 aa, Staphylococcus
NYRNPNSQR

SEQ ID NO: 1971685 - protein, 9 aa, Staphylococcus
NYRNQGYGR

SEQ ID NO: 1971686 - protein, 11 aa, Staphylococcus
NYRQKKGDIQQ

SEQ ID NO: 1971687 - protein, 11 aa, Staphylococcus
NYRQKKGDLNQ

SEQ ID NO: 1971688 - protein, 14 aa, Staphylococcus
NYRRPGTGAYPLRG

SEQ ID NO: 1971689 - protein, 7 aa, Staphylococcus
NYRSTKT

SEQ ID NO: 1971690 - protein, 8 aa, Staphylococcus
NYRTNKAD

SEQ ID NO: 1971691 - protein, 4 aa, Staphylococcus
NYSD

SEQ ID NO: 1971692 - protein, 6 aa, Staphylococcus
NYSEAA

SEQ ID NO: 1971693 - protein, 10 aa, Staphylococcus
NYSGQEALQT

SEQ ID NO: 1971694 - protein, 5 aa, Staphylococcus
NYSHR

SEQ ID NO: 1971695 - protein, 8 aa, Staphylococcus
NYSKETLE

SEQ ID NO: 1971696 - protein, 9 aa, Staphylococcus
NYSKKTISA

SEQ ID NO: 1971697 - protein, 8 aa, Staphylococcus
NYSKLNKK

SEQ ID NO: 1971698 - protein, 8 aa, Staphylococcus
NYSKLNKS

SEQ ID NO: 1971699 - protein, 11 aa, Staphylococcus
NYSKSEAKKRA

SEQ ID NO: 1971700 - protein, 11 aa, Staphylococcus
NYSKTEAKKRA

SEQ ID NO: 1971701 - protein, 4 aa, Staphylococcus
NYSL

SEQ ID NO: 1971702 - protein, 9 aa, Staphylococcus
NYSNEIEPE

SEQ ID NO: 1971703 - protein, 10 aa, Staphylococcus
NYSPNSIEGT

SEQ ID NO: 1971704 - protein, 7 aa, Staphylococcus
NYSSGMR

SEQ ID NO: 1971705 - protein, 39 aa, Staphylococcus
NYSSSSNQQTTEPQESSEKVGETVRQNQFKPSEHSIKQP

SEQ ID NO: 1971706 - protein, 7 aa, Staphylococcus
NYSTDTF

SEQ ID NO: 1971707 - protein, 10 aa, Staphylococcus
NYTDRDGTIG

SEQ ID NO: 1971708 - protein, 15 aa, Staphylococcus
NYTEAELQGVLEQLQ

SEQ ID NO: 1971709 - protein, 5 aa, Staphylococcus
NYTED

SEQ ID NO: 1971710 - protein, 4 aa, Staphylococcus
NYTK

SEQ ID NO: 1971711 - protein, 6 aa, Staphylococcus
NYTQAA

SEQ ID NO: 1971712 - protein, 5 aa, Staphylococcus
NYTSD

SEQ ID NO: 1971713 - protein, 5 aa, Staphylococcus
NYTSE

SEQ ID NO: 1971714 - protein, 7 aa, Staphylococcus
NYTSEDY

SEQ ID NO: 1971715 - protein, 11 aa, Staphylococcus
NYTVPKNSNLA

SEQ ID NO: 1971716 - protein, 12 aa, Staphylococcus
NYTYESSDKVDN

SEQ ID NO: 1971717 - protein, 8 aa, Staphylococcus
NYVAPRNE

SEQ ID NO: 1971718 - protein, 8 aa, Staphylococcus
NYVGGSKI

SEQ ID NO: 1971719 - protein, 9 aa, Staphylococcus
NYVKTSKDD

SEQ ID NO: 1971720 - protein, 6 aa, Staphylococcus
NYVNQS

SEQ ID NO: 1971721 - protein, 8 aa, Staphylococcus
NYVRHGEK

SEQ ID NO: 1971722 - protein, 22 aa, Staphylococcus
NYYEDGNKEITEAYEYNSDNTN

SEQ ID NO: 1971723 - protein, 22 aa, Staphylococcus
NYYEDGSEKITEAYEYNSDNTN

SEQ ID NO: 1971724 - protein, 5 aa, Staphylococcus
NYYEG

SEQ ID NO: 1971725 - protein, 4 aa, Staphylococcus
NYYQ

SEQ ID NO: 1971726 - protein, 4 aa, Staphylococcus
NYYS

SEQ ID NO: 1971727 - protein, 7 aa, Staphylococcus
PAAAGQM

SEQ ID NO: 1971728 - protein, 7 aa, Staphylococcus
PAAASYS

SEQ ID NO: 1971729 - protein, 6 aa, Staphylococcus
PAADNK

SEQ ID NO: 1971730 - protein, 9 aa, Staphylococcus
PAADNKFSA

SEQ ID NO: 1971731 - protein, 9 aa, Staphylococcus
PAAGKTRLS

SEQ ID NO: 1971732 - protein, 5 aa, Staphylococcus
PAAGR

SEQ ID NO: 1971733 - protein, 6 aa, Staphylococcus
PAAGRK

SEQ ID NO: 1971734 - protein, 8 aa, Staphylococcus
PAAPRGVP

SEQ ID NO: 1971735 - protein, 6 aa, Staphylococcus
PAASGQ

SEQ ID NO: 1971736 - protein, 9 aa, Staphylococcus
PADDQGSSW

SEQ ID NO: 1971737 - protein, 8 aa, Staphylococcus
PADDQSAA

SEQ ID NO: 1971738 - protein, 16 aa, Staphylococcus
PADDTLSKRIQQYKEE

SEQ ID NO: 1971739 - protein, 4 aa, Staphylococcus
PADE

SEQ ID NO: 1971740 - protein, 4 aa, Staphylococcus
PADF

SEQ ID NO: 1971741 - protein, 7 aa, Staphylococcus
PADSSYI

SEQ ID NO: 1971742 - protein, 11 aa, Staphylococcus
PADTKANQNKI

SEQ ID NO: 1971743 - protein, 13 aa, Staphylococcus
PADVPAVKLLIEG

SEQ ID NO: 1971744 - protein, 4 aa, Staphylococcus
PAED

SEQ ID NO: 1971745 - protein, 17 aa, Staphylococcus
PAEEGGENGSAKASYVK

SEQ ID NO: 1971746 - protein, 4 aa, Staphylococcus
PAEF

SEQ ID NO: 1971747 - protein, 4 aa, Staphylococcus
PAEG

SEQ ID NO: 1971748 - protein, 6 aa, Staphylococcus
PAEGDD

SEQ ID NO: 1971749 - protein, 11 aa, Staphylococcus
PAEKVDKAIDQ

SEQ ID NO: 1971750 - protein, 11 aa, Staphylococcus
PAEKVNKALDK

SEQ ID NO: 1971751 - protein, 11 aa, Staphylococcus
PAEKVNKALDQ

SEQ ID NO: 1971752 - protein, 12 aa, Staphylococcus
PAELSGGQQQRI

SEQ ID NO: 1971753 - protein, 9 aa, Staphylococcus
PAENSSNEW

SEQ ID NO: 1971754 - protein, 10 aa, Staphylococcus
PAEPAGRFEG

SEQ ID NO: 1971755 - protein, 20 aa, Staphylococcus
PAEPFERGVSNKKFKAQGGT

SEQ ID NO: 1971756 - protein, 11 aa, Staphylococcus
PAEQQDAEEVQ

SEQ ID NO: 1971757 - protein, 5 aa, Staphylococcus
PAETR

SEQ ID NO: 1971758 - protein, 4 aa, Staphylococcus
PAEV

SEQ ID NO: 1971759 - protein, 4 aa, Staphylococcus
PAFE

SEQ ID NO: 1971760 - protein, 10 aa, Staphylococcus
PAFKNAESKL

SEQ ID NO: 1971761 - protein, 6 aa, Staphylococcus
PAFNGE

SEQ ID NO: 1971762 - protein, 14 aa, Staphylococcus
PAGDGWDSDPFDPV

SEQ ID NO: 1971763 - protein, 14 aa, Staphylococcus
PAGDGWDSDPFKPV

SEQ ID NO: 1971764 - protein, 13 aa, Staphylococcus
PAGDGWDSNPFEP

SEQ ID NO: 1971765 - protein, 14 aa, Staphylococcus
PAGDGWNSDPFKPV

SEQ ID NO: 1971766 - protein, 7 aa, Staphylococcus
PAGDNKF

SEQ ID NO: 1971767 - protein, 12 aa, Staphylococcus
PAGEERPLPTTA

SEQ ID NO: 1971768 - protein, 26 aa, Staphylococcus
PAGEERPLPTTAQIATQQGEHTAKNV

SEQ ID NO: 1971769 - protein, 6 aa, Staphylococcus
PAGEGR

SEQ ID NO: 1971770 - protein, 7 aa, Staphylococcus
PAGEPDK

SEQ ID NO: 1971771 - protein, 9 aa, Staphylococcus
PAGERTKSF

SEQ ID NO: 1971772 - protein, 7 aa, Staphylococcus
PAGESDK

SEQ ID NO: 1971773 - protein, 8 aa, Staphylococcus
PAGGGLAE

SEQ ID NO: 1971774 - protein, 7 aa, Staphylococcus
PAGPSFV

SEQ ID NO: 1971775 - protein, 7 aa, Staphylococcus
PAGTGMR

SEQ ID NO: 1971776 - protein, 8 aa, Staphylococcus
PAGTGMRR

SEQ ID NO: 1971777 - protein, 16 aa, Staphylococcus
PAGTKHDATGSDQPLG

SEQ ID NO: 1971778 - protein, 16 aa, Staphylococcus
PAGTKHNVEGSEQPLG

SEQ ID NO: 1971779 - protein, 16 aa, Staphylococcus
PAGTKYDAEGSEQPLG

SEQ ID NO: 1971780 - protein, 16 aa, Staphylococcus
PAGTKYDAEGSTQPLG

SEQ ID NO: 1971781 - protein, 16 aa, Staphylococcus
PAGTKYDTEGSAQPLG

SEQ ID NO: 1971782 - protein, 16 aa, Staphylococcus
PAGTKYNAEGSEQPLG

SEQ ID NO: 1971783 - protein, 10 aa, Staphylococcus
PAGTQNGKQF

SEQ ID NO: 1971784 - protein, 20 aa, Staphylococcus
PAGTVEQYRGKGTEKPKTIE

SEQ ID NO: 1971785 - protein, 5 aa, Staphylococcus
PAHQK

SEQ ID NO: 1971786 - protein, 19 aa, Staphylococcus
PAHQSVKKGTIQVKRDGTP

SEQ ID NO: 1971787 - protein, 10 aa, Staphylococcus
PAIFEPGSTI

SEQ ID NO: 1971788 - protein, 6 aa, Staphylococcus
PAIPTT

SEQ ID NO: 1971789 - protein, 9 aa, Staphylococcus
PAISQTSQY

SEQ ID NO: 1971790 - protein, 17 aa, Staphylococcus
PAIVNENANKDSNTFST

SEQ ID NO: 1971791 - protein, 4 aa, Staphylococcus
PAKD

SEQ ID NO: 1971792 - protein, 10 aa, Staphylococcus
PAKDKLDPTD

SEQ ID NO: 1971793 - protein, 16 aa, Staphylococcus
PAKDSTGIRTATESGQ

SEQ ID NO: 1971794 - protein, 11 aa, Staphylococcus
PAKDYEFDHNG

SEQ ID NO: 1971795 - protein, 4 aa, Staphylococcus
PAKE

SEQ ID NO: 1971796 - protein, 9 aa, Staphylococcus
PAKEISDND

SEQ ID NO: 1971797 - protein, 9 aa, Staphylococcus
PAKKRSVRV

SEQ ID NO: 1971798 - protein, 10 aa, Staphylococcus
PAKKVDQAID

SEQ ID NO: 1971799 - protein, 7 aa, Staphylococcus
PAKNGAK

SEQ ID NO: 1971800 - protein, 5 aa, Staphylococcus
PAKNM

SEQ ID NO: 1971801 - protein, 8 aa, Staphylococcus
PAKPISDE

SEQ ID NO: 1971802 - protein, 9 aa, Staphylococcus
PAKSISDDD

SEQ ID NO: 1971803 - protein, 10 aa, Staphylococcus
PAKSISDDDL

SEQ ID NO: 1971804 - protein, 9 aa, Staphylococcus
PAKTISDED

SEQ ID NO: 1971805 - protein, 11 aa, Staphylococcus
PALDKNKNHTI

SEQ ID NO: 1971806 - protein, 10 aa, Staphylococcus
PALGGYPKEE

SEQ ID NO: 1971807 - protein, 6 aa, Staphylococcus
PALKKP

SEQ ID NO: 1971808 - protein, 20 aa, Staphylococcus
PALSETIGETANAYFNKAIH

SEQ ID NO: 1971809 - protein, 10 aa, Staphylococcus
PALSNHTYQE

SEQ ID NO: 1971810 - protein, 20 aa, Staphylococcus
PALTKDQRARLKSLPNEAED

SEQ ID NO: 1971811 - protein, 13 aa, Staphylococcus
PAMDNDDFRRGKL

SEQ ID NO: 1971812 - protein, 21 aa, Staphylococcus
PAMDPYNAGEISPGPEVQTDE

SEQ ID NO: 1971813 - protein, 21 aa, Staphylococcus
PAMDPYNGGEISPGPSVQTDE

SEQ ID NO: 1971814 - protein, 9 aa, Staphylococcus
PAMKGKDSI

SEQ ID NO: 1971815 - protein, 18 aa, Staphylococcus
PANDIKGKQQLSGALGEG

SEQ ID NO: 1971816 - protein, 18 aa, Staphylococcus
PANDIKGKQQLSGQLGEG

SEQ ID NO: 1971817 - protein, 18 aa, Staphylococcus
PANDIKGPNQLSGALGEG

SEQ ID NO: 1971818 - protein, 18 aa, Staphylococcus
PANDIKGVNQLSGELGGG

SEQ ID NO: 1971819 - protein, 18 aa, Staphylococcus
PANDMKGAQQLSGQLGGG

SEQ ID NO: 1971820 - protein, 17 aa, Staphylococcus
PANDMKGKQNLSGELAG

SEQ ID NO: 1971821 - protein, 5 aa, Staphylococcus
PANEE

SEQ ID NO: 1971822 - protein, 6 aa, Staphylococcus
PANETI

SEQ ID NO: 1971823 - protein, 4 aa, Staphylococcus
PANK

SEQ ID NO: 1971824 - protein, 5 aa, Staphylococcus
PANKN

SEQ ID NO: 1971825 - protein, 6 aa, Staphylococcus
PANLNN

SEQ ID NO: 1971826 - protein, 8 aa, Staphylococcus
PANPAHHQ

SEQ ID NO: 1971827 - protein, 10 aa, Staphylococcus
PANPSGQFKG

SEQ ID NO: 1971828 - protein, 4 aa, Staphylococcus
PANQ

SEQ ID NO: 1971829 - protein, 12 aa, Staphylococcus
PANQPATKIASS

SEQ ID NO: 1971830 - protein, 10 aa, Staphylococcus
PANTELNEET

SEQ ID NO: 1971831 - protein, 6 aa, Staphylococcus
PAPAID

SEQ ID NO: 1971832 - protein, 9 aa, Staphylococcus
PAPGHTPGT

SEQ ID NO: 1971833 - protein, 8 aa, Staphylococcus
PAPGQELE

SEQ ID NO: 1971834 - protein, 7 aa, Staphylococcus
PAPKTEF

SEQ ID NO: 1971835 - protein, 15 aa, Staphylococcus
PAPLGGNGVGTNPDE

SEQ ID NO: 1971836 - protein, 6 aa, Staphylococcus
PAPSGH

SEQ ID NO: 1971837 - protein, 6 aa, Staphylococcus
PAPTGQ

SEQ ID NO: 1971838 - protein, 7 aa, Staphylococcus
PAPYRDI

SEQ ID NO: 1971839 - protein, 17 aa, Staphylococcus
PAQAGDMRTLDGKKMGV

SEQ ID NO: 1971840 - protein, 5 aa, Staphylococcus
PAQDV

SEQ ID NO: 1971841 - protein, 5 aa, Staphylococcus
PAQFK

SEQ ID NO: 1971842 - protein, 7 aa, Staphylococcus
PAQGEFE

SEQ ID NO: 1971843 - protein, 7 aa, Staphylococcus
PAQHNTE

SEQ ID NO: 1971844 - protein, 7 aa, Staphylococcus
PAQLEQQ

SEQ ID NO: 1971845 - protein, 11 aa, Staphylococcus
PAQQKEKLIDT

SEQ ID NO: 1971846 - protein, 8 aa, Staphylococcus
PAQQKERL

SEQ ID NO: 1971847 - protein, 11 aa, Staphylococcus
PAQSGDMRTLN

SEQ ID NO: 1971848 - protein, 10 aa, Staphylococcus
PAQSGEMRTL

SEQ ID NO: 1971849 - protein, 5 aa, Staphylococcus
PARDM

SEQ ID NO: 1971850 - protein, 5 aa, Staphylococcus
PAREY

SEQ ID NO: 1971851 - protein, 6 aa, Staphylococcus
PARKDA

SEQ ID NO: 1971852 - protein, 13 aa, Staphylococcus
PARKVKDTSHQER

SEQ ID NO: 1971853 - protein, 4 aa, Staphylococcus
PARL

SEQ ID NO: 1971854 - protein, 6 aa, Staphylococcus
PARNGA

SEQ ID NO: 1971855 - protein, 7 aa, Staphylococcus
PARPYKA

SEQ ID NO: 1971856 - protein, 16 aa, Staphylococcus
PARSDKENEARNEVDK

SEQ ID NO: 1971857 - protein, 14 aa, Staphylococcus
PARSDKEQEARDEV

SEQ ID NO: 1971858 - protein, 10 aa, Staphylococcus
PARSDKEQLA

SEQ ID NO: 1971859 - protein, 7 aa, Staphylococcus
PARSGAK

SEQ ID NO: 1971860 - protein, 16 aa, Staphylococcus
PARSNKENEARKEVDK

SEQ ID NO: 1971861 - protein, 17 aa, Staphylococcus
PARSYSISSSNQANPDE

SEQ ID NO: 1971862 - protein, 7 aa, Staphylococcus
PASAGHG

SEQ ID NO: 1971863 - protein, 5 aa, Staphylococcus
PASDL

SEQ ID NO: 1971864 - protein, 6 aa, Staphylococcus
PASDSD

SEQ ID NO: 1971865 - protein, 4 aa, Staphylococcus
PASG

SEQ ID NO: 1971866 - protein, 4 aa, Staphylococcus
PASL

SEQ ID NO: 1971867 - protein, 8 aa, Staphylococcus
PASLGVTE

SEQ ID NO: 1971868 - protein, 7 aa, Staphylococcus
PASLPDE

SEQ ID NO: 1971869 - protein, 7 aa, Staphylococcus
PASPDER

SEQ ID NO: 1971870 - protein, 19 aa, Staphylococcus
PASPSLEKDGTYTNTERRI

SEQ ID NO: 1971871 - protein, 18 aa, Staphylococcus
PASPSLEKTGTFTNTERR

SEQ ID NO: 1971872 - protein, 7 aa, Staphylococcus
PASSGQY

SEQ ID NO: 1971873 - protein, 5 aa, Staphylococcus
PATDF

SEQ ID NO: 1971874 - protein, 5 aa, Staphylococcus
PATDW

SEQ ID NO: 1971875 - protein, 5 aa, Staphylococcus
PATDY

SEQ ID NO: 1971876 - protein, 4 aa, Staphylococcus
PATE

SEQ ID NO: 1971877 - protein, 5 aa, Staphylococcus
PATEE

SEQ ID NO: 1971878 - protein, 26 aa, Staphylococcus
PATEEVAGTIAKGNKEDVEKAVEAAD

SEQ ID NO: 1971879 - protein, 10 aa, Staphylococcus
PATENLNRDI

SEQ ID NO: 1971880 - protein, 5 aa, Staphylococcus
PATEV

SEQ ID NO: 1971881 - protein, 7 aa, Staphylococcus
PATGEAF

SEQ ID NO: 1971882 - protein, 7 aa, Staphylococcus
PATGETI

SEQ ID NO: 1971883 - protein, 8 aa, Staphylococcus
PATGWRTD

SEQ ID NO: 1971884 - protein, 5 aa, Staphylococcus
PATIR

SEQ ID NO: 1971885 - protein, 10 aa, Staphylococcus
PATKDEAGYI

SEQ ID NO: 1971886 - protein, 10 aa, Staphylococcus
PATPPGDVGV

SEQ ID NO: 1971887 - protein, 5 aa, Staphylococcus
PATQN

SEQ ID NO: 1971888 - protein, 7 aa, Staphylococcus
PATQTPL

SEQ ID NO: 1971889 - protein, 12 aa, Staphylococcus
PATSNSYEINDD

SEQ ID NO: 1971890 - protein, 4 aa, Staphylococcus
PATT

SEQ ID NO: 1971891 - protein, 44 aa, Staphylococcus
PATTSVSDNKTDIQENEAGITETETSTSTDQSVSEPVSASTEPL

SEQ ID NO: 1971892 - protein, 7 aa, Staphylococcus
PAVDQGV

SEQ ID NO: 1971893 - protein, 14 aa, Staphylococcus
PAVDQSIQSLKEAG

SEQ ID NO: 1971894 - protein, 14 aa, Staphylococcus
PAVDQSVASLKEAG

SEQ ID NO: 1971895 - protein, 14 aa, Staphylococcus
PAVDQSVKSLNEAG

SEQ ID NO: 1971896 - protein, 13 aa, Staphylococcus
PAVDQSVTSLQEA

SEQ ID NO: 1971897 - protein, 13 aa, Staphylococcus
PAVDTSIKSLQEA

SEQ ID NO: 1971898 - protein, 4 aa, Staphylococcus
PAVN

SEQ ID NO: 1971899 - protein, 8 aa, Staphylococcus
PAVNQASF

SEQ ID NO: 1971900 - protein, 11 aa, Staphylococcus
PAYADGDASDV

SEQ ID NO: 1971901 - protein, 22 aa, Staphylococcus
PAYAPTQINDSHSGLTEKEVQQ

SEQ ID NO: 1971902 - protein, 7 aa, Staphylococcus
PAYDETA

SEQ ID NO: 1971903 - protein, 7 aa, Staphylococcus
PAYDNKK

SEQ ID NO: 1971904 - protein, 12 aa, Staphylococcus
PAYPQKNEETEL

SEQ ID NO: 1971905 - protein, 11 aa, Staphylococcus
PAYSGAKAAIS

SEQ ID NO: 1971906 - protein, 5 aa, Staphylococcus
PAYTA

SEQ ID NO: 1971907 - protein, 5 aa, Staphylococcus
PCETK

SEQ ID NO: 1971908 - protein, 5 aa, Staphylococcus
PCFKE

SEQ ID NO: 1971909 - protein, 5 aa, Staphylococcus
PCPEN

SEQ ID NO: 1971910 - protein, 7 aa, Staphylococcus
PDADRDA

SEQ ID NO: 1971911 - protein, 7 aa, Staphylococcus
PDAEAPC

SEQ ID NO: 1971912 - protein, 14 aa, Staphylococcus
PDAEDESDEKKYER

SEQ ID NO: 1971913 - protein, 15 aa, Staphylococcus
PDAEDESEDKKYERA

SEQ ID NO: 1971914 - protein, 16 aa, Staphylococcus
PDAEEETDESRKDRAI

SEQ ID NO: 1971915 - protein, 15 aa, Staphylococcus
PDAENETEENRKERA

SEQ ID NO: 1971916 - protein, 4 aa, Staphylococcus
PDAK

SEQ ID NO: 1971917 - protein, 28 aa, Staphylococcus
PDAMDYSKQTSLKEDSDLDANNNFRSGS

SEQ ID NO: 1971918 - protein, 4 aa, Staphylococcus
PDAQ

SEQ ID NO: 1971919 - protein, 5 aa, Staphylococcus
PDASR

SEQ ID NO: 1971920 - protein, 5 aa, Staphylococcus
PDATD

SEQ ID NO: 1971921 - protein, 6 aa, Staphylococcus
PDATLD

SEQ ID NO: 1971922 - protein, 12 aa, Staphylococcus
PDDESFSSAGTL

SEQ ID NO: 1971923 - protein, 11 aa, Staphylococcus
PDDESNGRPEV

SEQ ID NO: 1971924 - protein, 12 aa, Staphylococcus
PDDETFSSAGTI

SEQ ID NO: 1971925 - protein, 9 aa, Staphylococcus
PDDGNGKAY

SEQ ID NO: 1971926 - protein, 9 aa, Staphylococcus
PDDGNGRSY

SEQ ID NO: 1971927 - protein, 4 aa, Staphylococcus
PDDK

SEQ ID NO: 1971928 - protein, 6 aa, Staphylococcus
PDDKPR

SEQ ID NO: 1971929 - protein, 5 aa, Staphylococcus
PDDPE

SEQ ID NO: 1971930 - protein, 9 aa, Staphylococcus
PDDPEAENL

SEQ ID NO: 1971931 - protein, 6 aa, Staphylococcus
PDDSEI

SEQ ID NO: 1971932 - protein, 5 aa, Staphylococcus
PDDSF

SEQ ID NO: 1971933 - protein, 10 aa, Staphylococcus
PDDSPISNRN

SEQ ID NO: 1971934 - protein, 9 aa, Staphylococcus
PDDSRRKNL

SEQ ID NO: 1971935 - protein, 6 aa, Staphylococcus
PDDTFS

SEQ ID NO: 1971936 - protein, 5 aa, Staphylococcus
PDDTM

SEQ ID NO: 1971937 - protein, 4 aa, Staphylococcus
PDDV

SEQ ID NO: 1971938 - protein, 7 aa, Staphylococcus
PDDVTSP

SEQ ID NO: 1971939 - protein, 14 aa, Staphylococcus
PDDYKDKAAEARES

SEQ ID NO: 1971940 - protein, 4 aa, Staphylococcus
PDEA

SEQ ID NO: 1971941 - protein, 22 aa, Staphylococcus
PDEDAVRRARKAVDTPIDDIEK

SEQ ID NO: 1971942 - protein, 16 aa, Staphylococcus
PDEDGNPYKSSGGEMI

SEQ ID NO: 1971943 - protein, 9 aa, Staphylococcus
PDEEGDGGK

SEQ ID NO: 1971944 - protein, 10 aa, Staphylococcus
PDEEIGKGPH

SEQ ID NO: 1971945 - protein, 9 aa, Staphylococcus
PDEERKGRM

SEQ ID NO: 1971946 - protein, 5 aa, Staphylococcus
PDEGE

SEQ ID NO: 1971947 - protein, 7 aa, Staphylococcus
PDEGREV

SEQ ID NO: 1971948 - protein, 8 aa, Staphylococcus
PDEHDQPV

SEQ ID NO: 1971949 - protein, 24 aa, Staphylococcus
PDEKAPENMSDKEIEQVKAKEGQR

SEQ ID NO: 1971950 - protein, 24 aa, Staphylococcus
PDEKAPENMSDKEVEQVKEKEGQR

SEQ ID NO: 1971951 - protein, 24 aa, Staphylococcus
PDEKAPETMSDKEIEQVKAKEGQR

SEQ ID NO: 1971952 - protein, 11 aa, Staphylococcus
PDEKENELQNR

SEQ ID NO: 1971953 - protein, 8 aa, Staphylococcus
PDEKTAQK

SEQ ID NO: 1971954 - protein, 5 aa, Staphylococcus
PDELR

SEQ ID NO: 1971955 - protein, 16 aa, Staphylococcus
PDENATAIRTSTETGQ

SEQ ID NO: 1971956 - protein, 16 aa, Staphylococcus
PDENATGIETSTETGQ

SEQ ID NO: 1971957 - protein, 5 aa, Staphylococcus
PDEPF

SEQ ID NO: 1971958 - protein, 6 aa, Staphylococcus
PDEPFS

SEQ ID NO: 1971959 - protein, 8 aa, Staphylococcus
PDEPPKIY

SEQ ID NO: 1971960 - protein, 10 aa, Staphylococcus
PDEQASENLV

SEQ ID NO: 1971961 - protein, 16 aa, Staphylococcus
PDEQATGIKTSTESGQ

SEQ ID NO: 1971962 - protein, 7 aa, Staphylococcus
PDEQPHD

SEQ ID NO: 1971963 - protein, 10 aa, Staphylococcus
PDERYSSSEL

SEQ ID NO: 1971964 - protein, 4 aa, Staphylococcus
PDES

SEQ ID NO: 1971965 - protein, 6 aa, Staphylococcus
PDETKY

SEQ ID NO: 1971966 - protein, 7 aa, Staphylococcus
PDEVTSP

SEQ ID NO: 1971967 - protein, 8 aa, Staphylococcus
PDEVTSPY

SEQ ID NO: 1971968 - protein, 6 aa, Staphylococcus
PDFKQN

SEQ ID NO: 1971969 - protein, 8 aa, Staphylococcus
PDFPGDKI

SEQ ID NO: 1971970 - protein, 12 aa, Staphylococcus
PDFPGDKIRNTI

SEQ ID NO: 1971971 - protein, 18 aa, Staphylococcus
PDFPGDKIRNTIKDRVPG

SEQ ID NO: 1971972 - protein, 7 aa, Staphylococcus
PDFPGDR

SEQ ID NO: 1971973 - protein, 4 aa, Staphylococcus
PDFQ

SEQ ID NO: 1971974 - protein, 7 aa, Staphylococcus
PDGAPAY

SEQ ID NO: 1971975 - protein, 5 aa, Staphylococcus
PDGGK

SEQ ID NO: 1971976 - protein, 7 aa, Staphylococcus
PDGIDQP

SEQ ID NO: 1971977 - protein, 4 aa, Staphylococcus
PDGK

SEQ ID NO: 1971978 - protein, 19 aa, Staphylococcus
PDGKERYEHTAKGLDPVEL

SEQ ID NO: 1971979 - protein, 20 aa, Staphylococcus
PDGKERYEHTESGNNPIELG

SEQ ID NO: 1971980 - protein, 22 aa, Staphylococcus
PDGKERYEHTEVGTDPVKLGNR

SEQ ID NO: 1971981 - protein, 21 aa, Staphylococcus
PDGKERYQHTVRGTDPVALGE

SEQ ID NO: 1971982 - protein, 13 aa, Staphylococcus
PDGKLSCGEPGQK

SEQ ID NO: 1971983 - protein, 13 aa, Staphylococcus
PDGKLTCGEPGQA

SEQ ID NO: 1971984 - protein, 20 aa, Staphylococcus
PDGKQRFEQTATGNDPVELG

SEQ ID NO: 1971985 - protein, 11 aa, Staphylococcus
PDGMPKDDDFR

SEQ ID NO: 1971986 - protein, 9 aa, Staphylococcus
PDGMPQDDT

SEQ ID NO: 1971987 - protein, 26 aa, Staphylococcus
PDGMPQDDTFKYEETDVQEPKNNEVQ

SEQ ID NO: 1971988 - protein, 5 aa, Staphylococcus
PDGNI

SEQ ID NO: 1971989 - protein, 8 aa, Staphylococcus
PDGNTAQL

SEQ ID NO: 1971990 - protein, 10 aa, Staphylococcus
PDGSDNPDFN

SEQ ID NO: 1971991 - protein, 18 aa, Staphylococcus
PDGSDNPDFNPNKPEYQG

SEQ ID NO: 1971992 - protein, 18 aa, Staphylococcus
PDGSDNPEFNPNKPEYKD

SEQ ID NO: 1971993 - protein, 15 aa, Staphylococcus
PDGSIIGTSSLRRGA

SEQ ID NO: 1971994 - protein, 4 aa, Staphylococcus
PDGT

SEQ ID NO: 1971995 - protein, 19 aa, Staphylococcus
PDGTEEIKVEKRKPNVNTV

SEQ ID NO: 1971996 - protein, 8 aa, Staphylococcus
PDGTERYE

SEQ ID NO: 1971997 - protein, 5 aa, Staphylococcus
PDGTG

SEQ ID NO: 1971998 - protein, 20 aa, Staphylococcus
PDGTKRYEHTEVGKNPVDLG

SEQ ID NO: 1971999 - protein, 18 aa, Staphylococcus
PDGTNNPDFNPNKPEFSG

SEQ ID NO: 1972000 - protein, 13 aa, Staphylococcus
PDGTQAAVSNAQR

SEQ ID NO: 1972001 - protein, 5 aa, Staphylococcus
PDGVG

SEQ ID NO: 1972002 - protein, 8 aa, Staphylococcus
PDHEATAD

SEQ ID NO: 1972003 - protein, 9 aa, Staphylococcus
PDHEATGEA

SEQ ID NO: 1972004 - protein, 7 aa, Staphylococcus
PDHPENF

SEQ ID NO: 1972005 - protein, 6 aa, Staphylococcus
PDHPEY

SEQ ID NO: 1972006 - protein, 21 aa, Staphylococcus
PDHTTTSKNSSSSNQSSGETL

SEQ ID NO: 1972007 - protein, 26 aa, Staphylococcus
PDIDDGGAVNGEQEQPEQKQSEDKQP

SEQ ID NO: 1972008 - protein, 4 aa, Staphylococcus
PDIE

SEQ ID NO: 1972009 - protein, 4 aa, Staphylococcus
PDIK

SEQ ID NO: 1972010 - protein, 10 aa, Staphylococcus
PDIRSPQEAY

SEQ ID NO: 1972011 - protein, 6 aa, Staphylococcus
PDISNL

SEQ ID NO: 1972012 - protein, 12 aa, Staphylococcus
PDISYPKDITNE

SEQ ID NO: 1972013 - protein, 10 aa, Staphylococcus
PDITSKGYYQ

SEQ ID NO: 1972014 - protein, 5 aa, Staphylococcus
PDIYN

SEQ ID NO: 1972015 - protein, 5 aa, Staphylococcus
PDKDY

SEQ ID NO: 1972016 - protein, 10 aa, Staphylococcus
PDKEGTTVPA

SEQ ID NO: 1972017 - protein, 4 aa, Staphylococcus
PDKF

SEQ ID NO: 1972018 - protein, 6 aa, Staphylococcus
PDKFED

SEQ ID NO: 1972019 - protein, 12 aa, Staphylococcus
PDKFQSSNHEEI

SEQ ID NO: 1972020 - protein, 7 aa, Staphylococcus
PDKGTTY

SEQ ID NO: 1972021 - protein, 18 aa, Staphylococcus
PDKKGYSHEFKYVTHIEV

SEQ ID NO: 1972022 - protein, 6 aa, Staphylococcus
PDKKTF

SEQ ID NO: 1972023 - protein, 5 aa, Staphylococcus
PDKPL

SEQ ID NO: 1972024 - protein, 8 aa, Staphylococcus
PDKQPIFG

SEQ ID NO: 1972025 - protein, 6 aa, Staphylococcus
PDKQQF

SEQ ID NO: 1972026 - protein, 7 aa, Staphylococcus
PDKRTEL

SEQ ID NO: 1972027 - protein, 7 aa, Staphylococcus
PDKTEFD

SEQ ID NO: 1972028 - protein, 4 aa, Staphylococcus
PDKV

SEQ ID NO: 1972029 - protein, 10 aa, Staphylococcus
PDLDKNKNHT

SEQ ID NO: 1972030 - protein, 10 aa, Staphylococcus
PDLDSKDNET

SEQ ID NO: 1972031 - protein, 11 aa, Staphylococcus
PDLDTKNDTPL

SEQ ID NO: 1972032 - protein, 8 aa, Staphylococcus
PDLENGQS

SEQ ID NO: 1972033 - protein, 10 aa, Staphylococcus
PDLETGTDTE

SEQ ID NO: 1972034 - protein, 12 aa, Staphylococcus
PDLNKNNGYRDR

SEQ ID NO: 1972035 - protein, 10 aa, Staphylococcus
PDLPKLEKKY

SEQ ID NO: 1972036 - protein, 5 aa, Staphylococcus
PDLPQ

SEQ ID NO: 1972037 - protein, 9 aa, Staphylococcus
PDLQPAELS

SEQ ID NO: 1972038 - protein, 8 aa, Staphylococcus
PDLRKNHP

SEQ ID NO: 1972039 - protein, 12 aa, Staphylococcus
PDLSKKNGYRDR

SEQ ID NO: 1972040 - protein, 9 aa, Staphylococcus
PDLSQLSNR

SEQ ID NO: 1972041 - protein, 12 aa, Staphylococcus
PDLTKNNGYRDR

SEQ ID NO: 1972042 - protein, 15 aa, Staphylococcus
PDLTLEEQADKYNPA

SEQ ID NO: 1972043 - protein, 14 aa, Staphylococcus
PDLTLEEQAEKYQP

SEQ ID NO: 1972044 - protein, 14 aa, Staphylococcus
PDLTLEEQANRYNP

SEQ ID NO: 1972045 - protein, 7 aa, Staphylococcus
PDLTQSQ

SEQ ID NO: 1972046 - protein, 10 aa, Staphylococcus
PDLTTGTETE

SEQ ID NO: 1972047 - protein, 10 aa, Staphylococcus
PDLTTSNDTD

SEQ ID NO: 1972048 - protein, 10 aa, Staphylococcus
PDLTTSNDTE

SEQ ID NO: 1972049 - protein, 10 aa, Staphylococcus
PDLTTSNETE

SEQ ID NO: 1972050 - protein, 8 aa, Staphylococcus
PDMNTTAE

SEQ ID NO: 1972051 - protein, 11 aa, Staphylococcus
PDMPAGANTIN

SEQ ID NO: 1972052 - protein, 5 aa, Staphylococcus
PDNDK

SEQ ID NO: 1972053 - protein, 10 aa, Staphylococcus
PDNEDDVDSL

SEQ ID NO: 1972054 - protein, 5 aa, Staphylococcus
PDNEK

SEQ ID NO: 1972055 - protein, 5 aa, Staphylococcus
PDNEN

SEQ ID NO: 1972056 - protein, 5 aa, Staphylococcus
PDNEQ

SEQ ID NO: 1972057 - protein, 5 aa, Staphylococcus
PDNIE

SEQ ID NO: 1972058 - protein, 4 aa, Staphylococcus
PDNK

SEQ ID NO: 1972059 - protein, 15 aa, Staphylococcus
PDNLPGDSNTVHPEG

SEQ ID NO: 1972060 - protein, 11 aa, Staphylococcus
PDNPADDDPKM

SEQ ID NO: 1972061 - protein, 15 aa, Staphylococcus
PDNPANDAPKTLTQE

SEQ ID NO: 1972062 - protein, 12 aa, Staphylococcus
PDNPANDDPKML

SEQ ID NO: 1972063 - protein, 4 aa, Staphylococcus
PDNQ

SEQ ID NO: 1972064 - protein, 5 aa, Staphylococcus
PDNQK

SEQ ID NO: 1972065 - protein, 9 aa, Staphylococcus
PDNSIKAAG

SEQ ID NO: 1972066 - protein, 9 aa, Staphylococcus
PDNSIKASG

SEQ ID NO: 1972067 - protein, 5 aa, Staphylococcus
PDNTI

SEQ ID NO: 1972068 - protein, 8 aa, Staphylococcus
PDNTIKAA

SEQ ID NO: 1972069 - protein, 15 aa, Staphylococcus
PDNTVKYPTTNNYQQ

SEQ ID NO: 1972070 - protein, 8 aa, Staphylococcus
PDPGYTDY

SEQ ID NO: 1972071 - protein, 8 aa, Staphylococcus
PDPKAAQQ

SEQ ID NO: 1972072 - protein, 4 aa, Staphylococcus
PDPV

SEQ ID NO: 1972073 - protein, 4 aa, Staphylococcus
PDQF

SEQ ID NO: 1972074 - protein, 8 aa, Staphylococcus
PDQGEPDY

SEQ ID NO: 1972075 - protein, 5 aa, Staphylococcus
PDQGL

SEQ ID NO: 1972076 - protein, 8 aa, Staphylococcus
PDQISGGQ

SEQ ID NO: 1972077 - protein, 6 aa, Staphylococcus
PDQKAS

SEQ ID NO: 1972078 - protein, 7 aa, Staphylococcus
PDQLTSP

SEQ ID NO: 1972079 - protein, 6 aa, Staphylococcus
PDQQYT

SEQ ID NO: 1972080 - protein, 9 aa, Staphylococcus
PDQSVREKQ

SEQ ID NO: 1972081 - protein, 6 aa, Staphylococcus
PDQTQI

SEQ ID NO: 1972082 - protein, 6 aa, Staphylococcus
PDQVPA

SEQ ID NO: 1972083 - protein, 6 aa, Staphylococcus
PDQVPN

SEQ ID NO: 1972084 - protein, 8 aa, Staphylococcus
PDQVSEQK

SEQ ID NO: 1972085 - protein, 6 aa, Staphylococcus
PDRAAQ

SEQ ID NO: 1972086 - protein, 7 aa, Staphylococcus
PDRAGQL

SEQ ID NO: 1972087 - protein, 11 aa, Staphylococcus
PDRDPSTKTTY

SEQ ID NO: 1972088 - protein, 5 aa, Staphylococcus
PDRER

SEQ ID NO: 1972089 - protein, 10 aa, Staphylococcus
PDRINSSGYR

SEQ ID NO: 1972090 - protein, 7 aa, Staphylococcus
PDRIPHE

SEQ ID NO: 1972091 - protein, 11 aa, Staphylococcus
PDRRPEGTEPY

SEQ ID NO: 1972092 - protein, 7 aa, Staphylococcus
PDRTDED

SEQ ID NO: 1972093 - protein, 4 aa, Staphylococcus
PDSD

SEQ ID NO: 1972094 - protein, 7 aa, Staphylococcus
PDSDRIN

SEQ ID NO: 1972095 - protein, 4 aa, Staphylococcus
PDSE

SEQ ID NO: 1972096 - protein, 5 aa, Staphylococcus
PDSEF

SEQ ID NO: 1972097 - protein, 7 aa, Staphylococcus
PDSERVN

SEQ ID NO: 1972098 - protein, 20 aa, Staphylococcus
PDSFSDGGKFNSVDKATKRV

SEQ ID NO: 1972099 - protein, 20 aa, Staphylococcus
PDSFSDGGKYNSVDKAVARA

SEQ ID NO: 1972100 - protein, 23 aa, Staphylococcus
PDSFSDGGKYNSVEKAVSRAKEM

SEQ ID NO: 1972101 - protein, 23 aa, Staphylococcus
PDSFSDGGKYNSVETAVARGKEM

SEQ ID NO: 1972102 - protein, 15 aa, Staphylococcus
PDSFSDGGKYNTVDR

SEQ ID NO: 1972103 - protein, 5 aa, Staphylococcus
PDSGN

SEQ ID NO: 1972104 - protein, 10 aa, Staphylococcus
PDSISGEYDL

SEQ ID NO: 1972105 - protein, 12 aa, Staphylococcus
PDSKEEASNIKP

SEQ ID NO: 1972106 - protein, 11 aa, Staphylococcus
PDSKSRAEIGD

SEQ ID NO: 1972107 - protein, 20 aa, Staphylococcus
PDSKVAEKTQANTDIDTQDI

SEQ ID NO: 1972108 - protein, 16 aa, Staphylococcus
PDSKVAKLTQSNTNID

SEQ ID NO: 1972109 - protein, 16 aa, Staphylococcus
PDSKVAKLTQSNTQLD

SEQ ID NO: 1972110 - protein, 8 aa, Staphylococcus
PDSLENAK

SEQ ID NO: 1972111 - protein, 22 aa, Staphylococcus
PDSSLQAAKGFSEYTGIPNEQG

SEQ ID NO: 1972112 - protein, 12 aa, Staphylococcus
PDSTGLGSYKEA

SEQ ID NO: 1972113 - protein, 14 aa, Staphylococcus
PDSTSIKSDVKELD

SEQ ID NO: 1972114 - protein, 5 aa, Staphylococcus
PDSWR

SEQ ID NO: 1972115 - protein, 6 aa, Staphylococcus
PDSWRG

SEQ ID NO: 1972116 - protein, 4 aa, Staphylococcus
PDTH

SEQ ID NO: 1972117 - protein, 5 aa, Staphylococcus
PDTIY

SEQ ID NO: 1972118 - protein, 12 aa, Staphylococcus
PDTKFDSHGVYS

SEQ ID NO: 1972119 - protein, 4 aa, Staphylococcus
PDTL

SEQ ID NO: 1972120 - protein, 12 aa, Staphylococcus
PDTMDSNSAEST

SEQ ID NO: 1972121 - protein, 4 aa, Staphylococcus
PDTR

SEQ ID NO: 1972122 - protein, 5 aa, Staphylococcus
PDTSF

SEQ ID NO: 1972123 - protein, 10 aa, Staphylococcus
PDTSKTLNEG

SEQ ID NO: 1972124 - protein, 4 aa, Staphylococcus
PDTT

SEQ ID NO: 1972125 - protein, 5 aa, Staphylococcus
PDTTL

SEQ ID NO: 1972126 - protein, 12 aa, Staphylococcus
PDTVGKPSPNVD

SEQ ID NO: 1972127 - protein, 5 aa, Staphylococcus
PDTWG

SEQ ID NO: 1972128 - protein, 7 aa, Staphylococcus
PDTYYDS

SEQ ID NO: 1972129 - protein, 4 aa, Staphylococcus
PDVE

SEQ ID NO: 1972130 - protein, 11 aa, Staphylococcus
PDVEKDKRGID

SEQ ID NO: 1972131 - protein, 14 aa, Staphylococcus
PDVEVDKAGDTLSN

SEQ ID NO: 1972132 - protein, 13 aa, Staphylococcus
PDVEVDKGADALS

SEQ ID NO: 1972133 - protein, 13 aa, Staphylococcus
PDVEVDKGAEALK

SEQ ID NO: 1972134 - protein, 9 aa, Staphylococcus
PDVEVDKGI

SEQ ID NO: 1972135 - protein, 7 aa, Staphylococcus
PDVKDNM

SEQ ID NO: 1972136 - protein, 8 aa, Staphylococcus
PDVKDNMK

SEQ ID NO: 1972137 - protein, 6 aa, Staphylococcus
PDVPSM

SEQ ID NO: 1972138 - protein, 19 aa, Staphylococcus
PDVSGQTVQKAEDELDAQQ

SEQ ID NO: 1972139 - protein, 8 aa, Staphylococcus
PDVSKQVE

SEQ ID NO: 1972140 - protein, 22 aa, Staphylococcus
PDVVNDSDKLRKYSKEQADLQK

SEQ ID NO: 1972141 - protein, 22 aa, Staphylococcus
PDVVNDSDKLRKYSKEQAELQK

SEQ ID NO: 1972142 - protein, 22 aa, Staphylococcus
PDVVNNPDNLRKYSKEQAELQK

SEQ ID NO: 1972143 - protein, 6 aa, Staphylococcus
PDYDQT

SEQ ID NO: 1972144 - protein, 7 aa, Staphylococcus
PDYDVTT

SEQ ID NO: 1972145 - protein, 9 aa, Staphylococcus
PDYEKSESV

SEQ ID NO: 1972146 - protein, 13 aa, Staphylococcus
PDYEYQPGEKQAI

SEQ ID NO: 1972147 - protein, 8 aa, Staphylococcus
PDYGNSPL

SEQ ID NO: 1972148 - protein, 4 aa, Staphylococcus
PDYQ

SEQ ID NO: 1972149 - protein, 12 aa, Staphylococcus
PDYQESDELKEE

SEQ ID NO: 1972150 - protein, 10 aa, Staphylococcus
PDYQGQGYGR

SEQ ID NO: 1972151 - protein, 4 aa, Staphylococcus
PEAG

SEQ ID NO: 1972152 - protein, 12 aa, Staphylococcus
PEAKNSCEEIKN

SEQ ID NO: 1972153 - protein, 5 aa, Staphylococcus
PEALN

SEQ ID NO: 1972154 - protein, 6 aa, Staphylococcus
PEALTS

SEQ ID NO: 1972155 - protein, 6 aa, Staphylococcus
PEARDE

SEQ ID NO: 1972156 - protein, 17 aa, Staphylococcus
PEASPVLSGGEPGPHKL

SEQ ID NO: 1972157 - protein, 18 aa, Staphylococcus
PEASPVLSGGEPGPHKLQ

SEQ ID NO: 1972158 - protein, 4 aa, Staphylococcus
PEAT

SEQ ID NO: 1972159 - protein, 5 aa, Staphylococcus
PEAWG

SEQ ID NO: 1972160 - protein, 6 aa, Staphylococcus
PEAYAR

SEQ ID NO: 1972161 - protein, 7 aa, Staphylococcus
PEDAGER

SEQ ID NO: 1972162 - protein, 9 aa, Staphylococcus
PEDAKQDIR

SEQ ID NO: 1972163 - protein, 6 aa, Staphylococcus
PEDATI

SEQ ID NO: 1972164 - protein, 5 aa, Staphylococcus
PEDEN

SEQ ID NO: 1972165 - protein, 9 aa, Staphylococcus
PEDFNSPIA

SEQ ID NO: 1972166 - protein, 4 aa, Staphylococcus
PEDG

SEQ ID NO: 1972167 - protein, 6 aa, Staphylococcus
PEDGHD

SEQ ID NO: 1972168 - protein, 6 aa, Staphylococcus
PEDGSL

SEQ ID NO: 1972169 - protein, 16 aa, Staphylococcus
PEDGSLELTSGNAWTS

SEQ ID NO: 1972170 - protein, 7 aa, Staphylococcus
PEDGSLQ

SEQ ID NO: 1972171 - protein, 13 aa, Staphylococcus
PEDHKERAEEARA

SEQ ID NO: 1972172 - protein, 14 aa, Staphylococcus
PEDHKERAEEARSN

SEQ ID NO: 1972173 - protein, 6 aa, Staphylococcus
PEDKEA

SEQ ID NO: 1972174 - protein, 4 aa, Staphylococcus
PEDN

SEQ ID NO: 1972175 - protein, 4 aa, Staphylococcus
PEDQ

SEQ ID NO: 1972176 - protein, 5 aa, Staphylococcus
PEDQR

SEQ ID NO: 1972177 - protein, 18 aa, Staphylococcus
PEDRITVDDRAKAISKDL

SEQ ID NO: 1972178 - protein, 6 aa, Staphylococcus
PEDSEA

SEQ ID NO: 1972179 - protein, 7 aa, Staphylococcus
PEDSEYP

SEQ ID NO: 1972180 - protein, 7 aa, Staphylococcus
PEDSKYP

SEQ ID NO: 1972181 - protein, 5 aa, Staphylococcus
PEDTE

SEQ ID NO: 1972182 - protein, 6 aa, Staphylococcus
PEDTEA

SEQ ID NO: 1972183 - protein, 6 aa, Staphylococcus
PEDTGA

SEQ ID NO: 1972184 - protein, 5 aa, Staphylococcus
PEDTV

SEQ ID NO: 1972185 - protein, 8 aa, Staphylococcus
PEDYDKKE

SEQ ID NO: 1972186 - protein, 9 aa, Staphylococcus
PEDYPSSGV

SEQ ID NO: 1972187 - protein, 9 aa, Staphylococcus
PEEAEEPGI

SEQ ID NO: 1972188 - protein, 7 aa, Staphylococcus
PEEAGER

SEQ ID NO: 1972189 - protein, 4 aa, Staphylococcus
PEED

SEQ ID NO: 1972190 - protein, 5 aa, Staphylococcus
PEEDE

SEQ ID NO: 1972191 - protein, 7 aa, Staphylococcus
PEEDEAY

SEQ ID NO: 1972192 - protein, 4 aa, Staphylococcus
PEEE

SEQ ID NO: 1972193 - protein, 6 aa, Staphylococcus
PEEEDM

SEQ ID NO: 1972194 - protein, 7 aa, Staphylococcus
PEEELER

SEQ ID NO: 1972195 - protein, 4 aa, Staphylococcus
PEEF

SEQ ID NO: 1972196 - protein, 5 aa, Staphylococcus
PEEGQ

SEQ ID NO: 1972197 - protein, 6 aa, Staphylococcus
PEEGRR

SEQ ID NO: 1972198 - protein, 6 aa, Staphylococcus
PEEGTT

SEQ ID NO: 1972199 - protein, 8 aa, Staphylococcus
PEEIEEPG

SEQ ID NO: 1972200 - protein, 12 aa, Staphylococcus
PEEIEKQLNQKK

SEQ ID NO: 1972201 - protein, 12 aa, Staphylococcus
PEEIEKRLNQKK

SEQ ID NO: 1972202 - protein, 4 aa, Staphylococcus
PEEK

SEQ ID NO: 1972203 - protein, 11 aa, Staphylococcus
PEEKGEKPNTL

SEQ ID NO: 1972204 - protein, 8 aa, Staphylococcus
PEEKGSFH

SEQ ID NO: 1972205 - protein, 8 aa, Staphylococcus
PEEKVDKD

SEQ ID NO: 1972206 - protein, 6 aa, Staphylococcus
PEELNP

SEQ ID NO: 1972207 - protein, 26 aa, Staphylococcus
PEELRHTDEQHNQETTHKKEKHTQKT

SEQ ID NO: 1972208 - protein, 9 aa, Staphylococcus
PEELSGGQL

SEQ ID NO: 1972209 - protein, 5 aa, Staphylococcus
PEELT

SEQ ID NO: 1972210 - protein, 4 aa, Staphylococcus
PEEN

SEQ ID NO: 1972211 - protein, 7 aa, Staphylococcus
PEERGLH

SEQ ID NO: 1972212 - protein, 4 aa, Staphylococcus
PEES

SEQ ID NO: 1972213 - protein, 4 aa, Staphylococcus
PEET

SEQ ID NO: 1972214 - protein, 5 aa, Staphylococcus
PEETI

SEQ ID NO: 1972215 - protein, 14 aa, Staphylococcus
PEEVVQKKQERLAE

SEQ ID NO: 1972216 - protein, 10 aa, Staphylococcus
PEFDGQGYGS

SEQ ID NO: 1972217 - protein, 10 aa, Staphylococcus
PEFQGQGYGK

SEQ ID NO: 1972218 - protein, 8 aa, Staphylococcus
PEFSDDKT

SEQ ID NO: 1972219 - protein, 17 aa, Staphylococcus
PEFSDDKTLNLENSRHP

SEQ ID NO: 1972220 - protein, 17 aa, Staphylococcus
PEFSDNKTLSLENSRHP

SEQ ID NO: 1972221 - protein, 10 aa, Staphylococcus
PEGDAATGMV

SEQ ID NO: 1972222 - protein, 5 aa, Staphylococcus
PEGDI

SEQ ID NO: 1972223 - protein, 9 aa, Staphylococcus
PEGHVDATD

SEQ ID NO: 1972224 - protein, 15 aa, Staphylococcus
PEGIEGRTAYKGPLQ

SEQ ID NO: 1972225 - protein, 16 aa, Staphylococcus
PEGIEGRTAYKGPLQD

SEQ ID NO: 1972226 - protein, 10 aa, Staphylococcus
PEGIPNDQTF

SEQ ID NO: 1972227 - protein, 7 aa, Staphylococcus
PEGIPSN

SEQ ID NO: 1972228 - protein, 4 aa, Staphylococcus
PEGL

SEQ ID NO: 1972229 - protein, 8 aa, Staphylococcus
PEGRDTNE

SEQ ID NO: 1972230 - protein, 10 aa, Staphylococcus
PEGTQNGKQF

SEQ ID NO: 1972231 - protein, 10 aa, Staphylococcus
PEGVDNEQQI

SEQ ID NO: 1972232 - protein, 6 aa, Staphylococcus
PEGVEK

SEQ ID NO: 1972233 - protein, 7 aa, Staphylococcus
PEGVEKM

SEQ ID NO: 1972234 - protein, 12 aa, Staphylococcus
PEGVEKMQEAHD

SEQ ID NO: 1972235 - protein, 12 aa, Staphylococcus
PEGVEKMQEAHK

SEQ ID NO: 1972236 - protein, 5 aa, Staphylococcus
PEHAS

SEQ ID NO: 1972237 - protein, 5 aa, Staphylococcus
PEHDN

SEQ ID NO: 1972238 - protein, 7 aa, Staphylococcus
PEHPYPA

SEQ ID NO: 1972239 - protein, 4 aa, Staphylococcus
PEHQ

SEQ ID NO: 1972240 - protein, 8 aa, Staphylococcus
PEHSRSNK

SEQ ID NO: 1972241 - protein, 15 aa, Staphylococcus
PEHTMTESSQTNNDL

SEQ ID NO: 1972242 - protein, 5 aa, Staphylococcus
PEIDE

SEQ ID NO: 1972243 - protein, 5 aa, Staphylococcus
PEIDG

SEQ ID NO: 1972244 - protein, 5 aa, Staphylococcus
PEIGP

SEQ ID NO: 1972245 - protein, 4 aa, Staphylococcus
PEIK

SEQ ID NO: 1972246 - protein, 4 aa, Staphylococcus
PEKA

SEQ ID NO: 1972247 - protein, 6 aa, Staphylococcus
PEKAHG

SEQ ID NO: 1972248 - protein, 7 aa, Staphylococcus
PEKAHGM

SEQ ID NO: 1972249 - protein, 5 aa, Staphylococcus
PEKAQ

SEQ ID NO: 1972250 - protein, 10 aa, Staphylococcus
PEKIKDSDEL

SEQ ID NO: 1972251 - protein, 10 aa, Staphylococcus
PEKISQSDDL

SEQ ID NO: 1972252 - protein, 10 aa, Staphylococcus
PEKLKDSEEL

SEQ ID NO: 1972253 - protein, 11 aa, Staphylococcus
PEKLKDSNELN

SEQ ID NO: 1972254 - protein, 4 aa, Staphylococcus
PEKN

SEQ ID NO: 1972255 - protein, 8 aa, Staphylococcus
PEKNQLSS

SEQ ID NO: 1972256 - protein, 8 aa, Staphylococcus
PEKNSIDS

SEQ ID NO: 1972257 - protein, 8 aa, Staphylococcus
PEKPKHLK

SEQ ID NO: 1972258 - protein, 4 aa, Staphylococcus
PEKQ

SEQ ID NO: 1972259 - protein, 6 aa, Staphylococcus
PEKQAI

SEQ ID NO: 1972260 - protein, 9 aa, Staphylococcus
PEKSGDDGL

SEQ ID NO: 1972261 - protein, 8 aa, Staphylococcus
PEKSGDYG

SEQ ID NO: 1972262 - protein, 11 aa, Staphylococcus
PEKSMQIQNDL

SEQ ID NO: 1972263 - protein, 8 aa, Staphylococcus
PEKSTNQL

SEQ ID NO: 1972264 - protein, 4 aa, Staphylococcus
PEKT

SEQ ID NO: 1972265 - protein, 7 aa, Staphylococcus
PEKTEND

SEQ ID NO: 1972266 - protein, 7 aa, Staphylococcus
PEKTSPY

SEQ ID NO: 1972267 - protein, 14 aa, Staphylococcus
PEKTVINHKRYKIV

SEQ ID NO: 1972268 - protein, 14 aa, Staphylococcus
PEKTVINHKRYTIV

SEQ ID NO: 1972269 - protein, 4 aa, Staphylococcus
PEKV

SEQ ID NO: 1972270 - protein, 7 aa, Staphylococcus
PEKYADK

SEQ ID NO: 1972271 - protein, 20 aa, Staphylococcus
PEKYRDRKPDELSGGQRQRV

SEQ ID NO: 1972272 - protein, 4 aa, Staphylococcus
PELA

SEQ ID NO: 1972273 - protein, 12 aa, Staphylococcus
PELAEDRGIHEG

SEQ ID NO: 1972274 - protein, 26 aa, Staphylococcus
PELAEHTSQRERRAIEAERDTDELKK

SEQ ID NO: 1972275 - protein, 12 aa, Staphylococcus
PELAKDRDIHEG

SEQ ID NO: 1972276 - protein, 13 aa, Staphylococcus
PELAKDRDIHEGA

SEQ ID NO: 1972277 - protein, 13 aa, Staphylococcus
PELAKDRNIHEGA

SEQ ID NO: 1972278 - protein, 5 aa, Staphylococcus
PELAS

SEQ ID NO: 1972279 - protein, 4 aa, Staphylococcus
PELD

SEQ ID NO: 1972280 - protein, 6 aa, Staphylococcus
PELEEN

SEQ ID NO: 1972281 - protein, 6 aa, Staphylococcus
PELHSK

SEQ ID NO: 1972282 - protein, 18 aa, Staphylococcus
PELKPETKKEAQDEKMNA

SEQ ID NO: 1972283 - protein, 7 aa, Staphylococcus
PELNGVD

SEQ ID NO: 1972284 - protein, 11 aa, Staphylococcus
PELPDERKAKY

SEQ ID NO: 1972285 - protein, 10 aa, Staphylococcus
PELPDSKSNR

SEQ ID NO: 1972286 - protein, 9 aa, Staphylococcus
PELPKSVSQ

SEQ ID NO: 1972287 - protein, 14 aa, Staphylococcus
PELTLEEQAEKYNP

SEQ ID NO: 1972288 - protein, 74 aa, Staphylococcus
PELTPEDKKQATHSSEDTKSTSSSHHTSTSEPFSNQEASHSSESVQTSHSTPITHSESEDTVTTETSHSDENHS

SEQ ID NO: 1972289 - protein, 14 aa, Staphylococcus
PEMPEYEPRGCPRG

SEQ ID NO: 1972290 - protein, 7 aa, Staphylococcus
PENAGER

SEQ ID NO: 1972291 - protein, 10 aa, Staphylococcus
PENAKNLASQ

SEQ ID NO: 1972292 - protein, 12 aa, Staphylococcus
PENDDIYDRPRG

SEQ ID NO: 1972293 - protein, 6 aa, Staphylococcus
PENDDM

SEQ ID NO: 1972294 - protein, 7 aa, Staphylococcus
PENDPEL

SEQ ID NO: 1972295 - protein, 6 aa, Staphylococcus
PENERK

SEQ ID NO: 1972296 - protein, 5 aa, Staphylococcus
PENEV

SEQ ID NO: 1972297 - protein, 15 aa, Staphylococcus
PENGHQSKTISVTPY

SEQ ID NO: 1972298 - protein, 16 aa, Staphylococcus
PENHDEKVERLIIAKT

SEQ ID NO: 1972299 - protein, 22 aa, Staphylococcus
PENNNIPGNATKVKKGSQAYYD

SEQ ID NO: 1972300 - protein, 8 aa, Staphylococcus
PENNPDTQ

SEQ ID NO: 1972301 - protein, 4 aa, Staphylococcus
PENP

SEQ ID NO: 1972302 - protein, 5 aa, Staphylococcus
PENQS

SEQ ID NO: 1972303 - protein, 13 aa, Staphylococcus
PENTGSPSEPRNI

SEQ ID NO: 1972304 - protein, 10 aa, Staphylococcus
PENTSQAQNV

SEQ ID NO: 1972305 - protein, 7 aa, Staphylococcus
PENTTAL

SEQ ID NO: 1972306 - protein, 5 aa, Staphylococcus
PENYQ

SEQ ID NO: 1972307 - protein, 6 aa, Staphylococcus
PEPFDE

SEQ ID NO: 1972308 - protein, 6 aa, Staphylococcus
PEPFEK

SEQ ID NO: 1972309 - protein, 71 aa, Staphylococcus
PEPKRRKSEDRPARGTTIQAKSRGKSLSGDKKKGKKKQRKGKNQRSRDKQNNTQHKPYYKSKKVKQKARKK

SEQ ID NO: 1972310 - protein, 12 aa, Staphylococcus
PEPKYMAPSSEA

SEQ ID NO: 1972311 - protein, 7 aa, Staphylococcus
PEPSFEE

SEQ ID NO: 1972312 - protein, 11 aa, Staphylococcus
PEQAYQRNKGL

SEQ ID NO: 1972313 - protein, 4 aa, Staphylococcus
PEQE

SEQ ID NO: 1972314 - protein, 5 aa, Staphylococcus
PEQEK

SEQ ID NO: 1972315 - protein, 10 aa, Staphylococcus
PEQELSQSTI

SEQ ID NO: 1972316 - protein, 11 aa, Staphylococcus
PEQFDESKTYP

SEQ ID NO: 1972317 - protein, 6 aa, Staphylococcus
PEQGSI

SEQ ID NO: 1972318 - protein, 12 aa, Staphylococcus
PEQIEKNKAAYG

SEQ ID NO: 1972319 - protein, 7 aa, Staphylococcus
PEQKQKE

SEQ ID NO: 1972320 - protein, 4 aa, Staphylococcus
PEQN

SEQ ID NO: 1972321 - protein, 15 aa, Staphylococcus
PEQNAKMREVLAQFT

SEQ ID NO: 1972322 - protein, 15 aa, Staphylococcus
PEQNDRMIEVLKHFD

SEQ ID NO: 1972323 - protein, 10 aa, Staphylococcus
PEQPLTEGLG

SEQ ID NO: 1972324 - protein, 19 aa, Staphylococcus
PEQQLDKESVIEKAETLNQ

SEQ ID NO: 1972325 - protein, 4 aa, Staphylococcus
PEQR

SEQ ID NO: 1972326 - protein, 9 aa, Staphylococcus
PEQRKDESV

SEQ ID NO: 1972327 - protein, 10 aa, Staphylococcus
PEQSMKPYDA

SEQ ID NO: 1972328 - protein, 7 aa, Staphylococcus
PEQSQVA

SEQ ID NO: 1972329 - protein, 10 aa, Staphylococcus
PEQVAQSVTD

SEQ ID NO: 1972330 - protein, 10 aa, Staphylococcus
PEQVEDAPTF

SEQ ID NO: 1972331 - protein, 7 aa, Staphylococcus
PEQVSEQ

SEQ ID NO: 1972332 - protein, 7 aa, Staphylococcus
PEQVTSP

SEQ ID NO: 1972333 - protein, 4 aa, Staphylococcus
PERD

SEQ ID NO: 1972334 - protein, 11 aa, Staphylococcus
PEREDNHELPP

SEQ ID NO: 1972335 - protein, 5 aa, Staphylococcus
PEREG

SEQ ID NO: 1972336 - protein, 10 aa, Staphylococcus
PERENVSDTF

SEQ ID NO: 1972337 - protein, 4 aa, Staphylococcus
PERF

SEQ ID NO: 1972338 - protein, 5 aa, Staphylococcus
PERKV

SEQ ID NO: 1972339 - protein, 5 aa, Staphylococcus
PERLP

SEQ ID NO: 1972340 - protein, 7 aa, Staphylococcus
PERMTEE

SEQ ID NO: 1972341 - protein, 8 aa, Staphylococcus
PERNKAIA

SEQ ID NO: 1972342 - protein, 10 aa, Staphylococcus
PERNKAIAKN

SEQ ID NO: 1972343 - protein, 9 aa, Staphylococcus
PERNKEISQ

SEQ ID NO: 1972344 - protein, 5 aa, Staphylococcus
PERNQ

SEQ ID NO: 1972345 - protein, 9 aa, Staphylococcus
PERSELPAE

SEQ ID NO: 1972346 - protein, 7 aa, Staphylococcus
PERSGEL

SEQ ID NO: 1972347 - protein, 7 aa, Staphylococcus
PERTDSR

SEQ ID NO: 1972348 - protein, 9 aa, Staphylococcus
PERTSVKQI

SEQ ID NO: 1972349 - protein, 4 aa, Staphylococcus
PERV

SEQ ID NO: 1972350 - protein, 10 aa, Staphylococcus
PERYESGEKL

SEQ ID NO: 1972351 - protein, 5 aa, Staphylococcus
PESAQ

SEQ ID NO: 1972352 - protein, 4 aa, Staphylococcus
PESD

SEQ ID NO: 1972353 - protein, 9 aa, Staphylococcus
PESEKQRSS

SEQ ID NO: 1972354 - protein, 5 aa, Staphylococcus
PESER

SEQ ID NO: 1972355 - protein, 6 aa, Staphylococcus
PESERR

SEQ ID NO: 1972356 - protein, 10 aa, Staphylococcus
PESGSPSLRK

SEQ ID NO: 1972357 - protein, 9 aa, Staphylococcus
PESKDEAIK

SEQ ID NO: 1972358 - protein, 12 aa, Staphylococcus
PESKDEAKNIKP

SEQ ID NO: 1972359 - protein, 13 aa, Staphylococcus
PESKEEAKSIKPN

SEQ ID NO: 1972360 - protein, 8 aa, Staphylococcus
PESKQSDY

SEQ ID NO: 1972361 - protein, 18 aa, Staphylococcus
PESKVAEVTQAQTALNEE

SEQ ID NO: 1972362 - protein, 7 aa, Staphylococcus
PESLGVT

SEQ ID NO: 1972363 - protein, 8 aa, Staphylococcus
PESLGVTE

SEQ ID NO: 1972364 - protein, 9 aa, Staphylococcus
PESLTEEFG

SEQ ID NO: 1972365 - protein, 8 aa, Staphylococcus
PESPDSTT

SEQ ID NO: 1972366 - protein, 9 aa, Staphylococcus
PESQHKGYG

SEQ ID NO: 1972367 - protein, 11 aa, Staphylococcus
PESQHKGYGSS

SEQ ID NO: 1972368 - protein, 7 aa, Staphylococcus
PESRLPE

SEQ ID NO: 1972369 - protein, 4 aa, Staphylococcus
PESS

SEQ ID NO: 1972370 - protein, 7 aa, Staphylococcus
PESSLEY

SEQ ID NO: 1972371 - protein, 23 aa, Staphylococcus
PESTHKRLTGPDGIQFRFNFYKV

SEQ ID NO: 1972372 - protein, 6 aa, Staphylococcus
PESVHR

SEQ ID NO: 1972373 - protein, 13 aa, Staphylococcus
PESVSDKEGALVE

SEQ ID NO: 1972374 - protein, 7 aa, Staphylococcus
PESYTGE

SEQ ID NO: 1972375 - protein, 4 aa, Staphylococcus
PETA

SEQ ID NO: 1972376 - protein, 11 aa, Staphylococcus
PETAHQSFKEK

SEQ ID NO: 1972377 - protein, 7 aa, Staphylococcus
PETARRN

SEQ ID NO: 1972378 - protein, 5 aa, Staphylococcus
PETCP

SEQ ID NO: 1972379 - protein, 6 aa, Staphylococcus
PETDEV

SEQ ID NO: 1972380 - protein, 6 aa, Staphylococcus
PETEET

SEQ ID NO: 1972381 - protein, 8 aa, Staphylococcus
PETENNHG

SEQ ID NO: 1972382 - protein, 22 aa, Staphylococcus
PETERTKEHTTSSGETKTPDEM

SEQ ID NO: 1972383 - protein, 4 aa, Staphylococcus
PETF

SEQ ID NO: 1972384 - protein, 7 aa, Staphylococcus
PETGESC

SEQ ID NO: 1972385 - protein, 7 aa, Staphylococcus
PETGSPL

SEQ ID NO: 1972386 - protein, 10 aa, Staphylococcus
PETGSPSLRK

SEQ ID NO: 1972387 - protein, 5 aa, Staphylococcus
PETIQ

SEQ ID NO: 1972388 - protein, 5 aa, Staphylococcus
PETIR

SEQ ID NO: 1972389 - protein, 4 aa, Staphylococcus
PETK

SEQ ID NO: 1972390 - protein, 6 aa, Staphylococcus
PETKDT

SEQ ID NO: 1972391 - protein, 6 aa, Staphylococcus
PETKET

SEQ ID NO: 1972392 - protein, 8 aa, Staphylococcus
PETLHSDG

SEQ ID NO: 1972393 - protein, 7 aa, Staphylococcus
PETNETV

SEQ ID NO: 1972394 - protein, 6 aa, Staphylococcus
PETQET

SEQ ID NO: 1972395 - protein, 10 aa, Staphylococcus
PETRGEKLET

SEQ ID NO: 1972396 - protein, 11 aa, Staphylococcus
PETRGKKLESA

SEQ ID NO: 1972397 - protein, 6 aa, Staphylococcus
PETSGI

SEQ ID NO: 1972398 - protein, 7 aa, Staphylococcus
PETSGIG

SEQ ID NO: 1972399 - protein, 18 aa, Staphylococcus
PETSGIGVKPVSKEGTER

SEQ ID NO: 1972400 - protein, 19 aa, Staphylococcus
PETSGIGVKPVSKEGTERL

SEQ ID NO: 1972401 - protein, 4 aa, Staphylococcus
PETV

SEQ ID NO: 1972402 - protein, 7 aa, Staphylococcus
PETVPQK

SEQ ID NO: 1972403 - protein, 6 aa, Staphylococcus
PETVRK

SEQ ID NO: 1972404 - protein, 5 aa, Staphylococcus
PETWE

SEQ ID NO: 1972405 - protein, 9 aa, Staphylococcus
PEVAGTSPE

SEQ ID NO: 1972406 - protein, 20 aa, Staphylococcus
PEVASMGQNLEQAKANNLNA

SEQ ID NO: 1972407 - protein, 12 aa, Staphylococcus
PEVATPEFRKQY

SEQ ID NO: 1972408 - protein, 4 aa, Staphylococcus
PEVD

SEQ ID NO: 1972409 - protein, 10 aa, Staphylococcus
PEVGFPTEAI

SEQ ID NO: 1972410 - protein, 4 aa, Staphylococcus
PEVK

SEQ ID NO: 1972411 - protein, 7 aa, Staphylococcus
PEVKGPM

SEQ ID NO: 1972412 - protein, 5 aa, Staphylococcus
PEVKN

SEQ ID NO: 1972413 - protein, 5 aa, Staphylococcus
PEVLE

SEQ ID NO: 1972414 - protein, 5 aa, Staphylococcus
PEVSP

SEQ ID NO: 1972415 - protein, 4 aa, Staphylococcus
PEVT

SEQ ID NO: 1972416 - protein, 8 aa, Staphylococcus
PEVTPGGR

SEQ ID NO: 1972417 - protein, 5 aa, Staphylococcus
PEVVA

SEQ ID NO: 1972418 - protein, 11 aa, Staphylococcus
PEYADGDASQV

SEQ ID NO: 1972419 - protein, 6 aa, Staphylococcus
PEYAGE

SEQ ID NO: 1972420 - protein, 4 aa, Staphylococcus
PEYD

SEQ ID NO: 1972421 - protein, 14 aa, Staphylococcus
PEYDATVNGENEEY

SEQ ID NO: 1972422 - protein, 12 aa, Staphylococcus
PEYDDVEDATTE

SEQ ID NO: 1972423 - protein, 5 aa, Staphylococcus
PEYDN

SEQ ID NO: 1972424 - protein, 7 aa, Staphylococcus
PEYDNTK

SEQ ID NO: 1972425 - protein, 6 aa, Staphylococcus
PEYEDV

SEQ ID NO: 1972426 - protein, 4 aa, Staphylococcus
PEYG

SEQ ID NO: 1972427 - protein, 15 aa, Staphylococcus
PEYGKSYLKEMGVEH

SEQ ID NO: 1972428 - protein, 4 aa, Staphylococcus
PEYK

SEQ ID NO: 1972429 - protein, 13 aa, Staphylococcus
PEYKESDNQTLQS

SEQ ID NO: 1972430 - protein, 13 aa, Staphylococcus
PEYKGQDSMGTGT

SEQ ID NO: 1972431 - protein, 7 aa, Staphylococcus
PEYNNDK

SEQ ID NO: 1972432 - protein, 5 aa, Staphylococcus
PEYPQ

SEQ ID NO: 1972433 - protein, 19 aa, Staphylococcus
PEYQPVKKGTIQVKRDGTP

SEQ ID NO: 1972434 - protein, 8 aa, Staphylococcus
PEYRGQGI

SEQ ID NO: 1972435 - protein, 9 aa, Staphylococcus
PEYRGQGIA

SEQ ID NO: 1972436 - protein, 9 aa, Staphylococcus
PEYVKQNRD

SEQ ID NO: 1972437 - protein, 5 aa, Staphylococcus
PFAER

SEQ ID NO: 1972438 - protein, 13 aa, Staphylococcus
PFAGKNGGKITFE

SEQ ID NO: 1972439 - protein, 6 aa, Staphylococcus
PFAPPS

SEQ ID NO: 1972440 - protein, 7 aa, Staphylococcus
PFAPTRR

SEQ ID NO: 1972441 - protein, 9 aa, Staphylococcus
PFDSKTEFE

SEQ ID NO: 1972442 - protein, 10 aa, Staphylococcus
PFDSSGRRHT

SEQ ID NO: 1972443 - protein, 11 aa, Staphylococcus
PFDTNTANNEL

SEQ ID NO: 1972444 - protein, 5 aa, Staphylococcus
PFEEE

SEQ ID NO: 1972445 - protein, 10 aa, Staphylococcus
PFEEGEESID

SEQ ID NO: 1972446 - protein, 12 aa, Staphylococcus
PFEEGMESISKD

SEQ ID NO: 1972447 - protein, 23 aa, Staphylococcus
PFEGDTNDFEADKTEVKKEMETG

SEQ ID NO: 1972448 - protein, 7 aa, Staphylococcus
PFEKGQS

SEQ ID NO: 1972449 - protein, 4 aa, Staphylococcus
PFEP

SEQ ID NO: 1972450 - protein, 11 aa, Staphylococcus
PFEQSSINTQA

SEQ ID NO: 1972451 - protein, 4 aa, Staphylococcus
PFES

SEQ ID NO: 1972452 - protein, 10 aa, Staphylococcus
PFGAAGKPNG

SEQ ID NO: 1972453 - protein, 7 aa, Staphylococcus
PFGDNGN

SEQ ID NO: 1972454 - protein, 12 aa, Staphylococcus
PFGEAGQAQLEQ

SEQ ID NO: 1972455 - protein, 5 aa, Staphylococcus
PFGEH

SEQ ID NO: 1972456 - protein, 6 aa, Staphylococcus
PFGENG

SEQ ID NO: 1972457 - protein, 7 aa, Staphylococcus
PFGENGK

SEQ ID NO: 1972458 - protein, 8 aa, Staphylococcus
PFGENGRN

SEQ ID NO: 1972459 - protein, 7 aa, Staphylococcus
PFGGGKG

SEQ ID NO: 1972460 - protein, 15 aa, Staphylococcus
PFGGPAGGDGGDGAS

SEQ ID NO: 1972461 - protein, 14 aa, Staphylococcus
PFGGPAGGDGGRGA

SEQ ID NO: 1972462 - protein, 7 aa, Staphylococcus
PFGKNGK

SEQ ID NO: 1972463 - protein, 4 aa, Staphylococcus
PFGN

SEQ ID NO: 1972464 - protein, 16 aa, Staphylococcus
PFGSDLASAEDLNEQL

SEQ ID NO: 1972465 - protein, 16 aa, Staphylococcus
PFGSDLKSAESLNKQI

SEQ ID NO: 1972466 - protein, 5 aa, Staphylococcus
PFGTD

SEQ ID NO: 1972467 - protein, 5 aa, Staphylococcus
PFGTG

SEQ ID NO: 1972468 - protein, 12 aa, Staphylococcus
PFGTPDEKAKEV

SEQ ID NO: 1972469 - protein, 4 aa, Staphylococcus
PFIG

SEQ ID NO: 1972470 - protein, 11 aa, Staphylococcus
PFKGKNPSTEI

SEQ ID NO: 1972471 - protein, 5 aa, Staphylococcus
PFKKA

SEQ ID NO: 1972472 - protein, 20 aa, Staphylococcus
PFKLKTKKDVEKVTAELDGD

SEQ ID NO: 1972473 - protein, 22 aa, Staphylococcus
PFKLQNKDDVNKITAKLDGDQF

SEQ ID NO: 1972474 - protein, 5 aa, Staphylococcus
PFKNK

SEQ ID NO: 1972475 - protein, 12 aa, Staphylococcus
PFKNKQTDEYET

SEQ ID NO: 1972476 - protein, 4 aa, Staphylococcus
PFKT

SEQ ID NO: 1972477 - protein, 14 aa, Staphylococcus
PFLDQAEQNGNPIY

SEQ ID NO: 1972478 - protein, 9 aa, Staphylococcus
PFNDYPPEE

SEQ ID NO: 1972479 - protein, 7 aa, Staphylococcus
PFNIEGG

SEQ ID NO: 1972480 - protein, 5 aa, Staphylococcus
PFPEE

SEQ ID NO: 1972481 - protein, 18 aa, Staphylococcus
PFPEKTKFETKGESKSLA

SEQ ID NO: 1972482 - protein, 5 aa, Staphylococcus
PFPNE

SEQ ID NO: 1972483 - protein, 6 aa, Staphylococcus
PFPNEK

SEQ ID NO: 1972484 - protein, 6 aa, Staphylococcus
PFPNEN

SEQ ID NO: 1972485 - protein, 18 aa, Staphylococcus
PFPNKTKFETKGESKSLA

SEQ ID NO: 1972486 - protein, 18 aa, Staphylococcus
PFPNQTKFETKGESKSLA

SEQ ID NO: 1972487 - protein, 7 aa, Staphylococcus
PFPNSNK

SEQ ID NO: 1972488 - protein, 4 aa, Staphylococcus
PFPT

SEQ ID NO: 1972489 - protein, 14 aa, Staphylococcus
PFPTIKDSNDERAY

SEQ ID NO: 1972490 - protein, 7 aa, Staphylococcus
PFQMSGG

SEQ ID NO: 1972491 - protein, 13 aa, Staphylococcus
PFQPETRDDQDVS

SEQ ID NO: 1972492 - protein, 18 aa, Staphylococcus
PFSNKTKFETKGESKSIA

SEQ ID NO: 1972493 - protein, 10 aa, Staphylococcus
PFSPRGNKRH

SEQ ID NO: 1972494 - protein, 4 aa, Staphylococcus
PFSQ

SEQ ID NO: 1972495 - protein, 8 aa, Staphylococcus
PFSQADAN

SEQ ID NO: 1972496 - protein, 7 aa, Staphylococcus
PFSRDKD

SEQ ID NO: 1972497 - protein, 24 aa, Staphylococcus
PFTAPKQEDIEKLDSEPENAQANA

SEQ ID NO: 1972498 - protein, 10 aa, Staphylococcus
PFTEKYSEED

SEQ ID NO: 1972499 - protein, 4 aa, Staphylococcus
PFTN

SEQ ID NO: 1972500 - protein, 7 aa, Staphylococcus
PFTNNEV

SEQ ID NO: 1972501 - protein, 12 aa, Staphylococcus
PFTNSGKVARNT

SEQ ID NO: 1972502 - protein, 11 aa, Staphylococcus
PFTPTEYGDPS

SEQ ID NO: 1972503 - protein, 10 aa, Staphylococcus
PFTQEGTFER

SEQ ID NO: 1972504 - protein, 20 aa, Staphylococcus
PFTQSVEQSVATSGNTVNGE

SEQ ID NO: 1972505 - protein, 23 aa, Staphylococcus
PFTSPKDEDIAKLDSEPEKVQAN

SEQ ID NO: 1972506 - protein, 24 aa, Staphylococcus
PFTSPKDEDLDKLDSAPEKAQAKA

SEQ ID NO: 1972507 - protein, 24 aa, Staphylococcus
PFTSPKEEDIKKLDSEPENAQANA

SEQ ID NO: 1972508 - protein, 24 aa, Staphylococcus
PFTSPKKEDIEKLDSEPENAQANA

SEQ ID NO: 1972509 - protein, 23 aa, Staphylococcus
PFTSPKQEDISKLDSEPENVQAN

SEQ ID NO: 1972510 - protein, 24 aa, Staphylococcus
PFTSPKQEDISKLDSEPQNAQANA

SEQ ID NO: 1972511 - protein, 8 aa, Staphylococcus
PFTTESGE

SEQ ID NO: 1972512 - protein, 9 aa, Staphylococcus
PFTTESGEL

SEQ ID NO: 1972513 - protein, 7 aa, Staphylococcus
PFYESNQ

SEQ ID NO: 1972514 - protein, 11 aa, Staphylococcus
PFYESNQSTIT

SEQ ID NO: 1972515 - protein, 15 aa, Staphylococcus
PFYNSNNPEYERGQF

SEQ ID NO: 1972516 - protein, 11 aa, Staphylococcus
PGAGAAGGLGG

SEQ ID NO: 1972517 - protein, 10 aa, Staphylococcus
PGAGGTESQD

SEQ ID NO: 1972518 - protein, 6 aa, Staphylococcus
PGAGTR

SEQ ID NO: 1972519 - protein, 4 aa, Staphylococcus
PGAI

SEQ ID NO: 1972520 - protein, 5 aa, Staphylococcus
PGAIE

SEQ ID NO: 1972521 - protein, 6 aa, Staphylococcus
PGAMTS

SEQ ID NO: 1972522 - protein, 17 aa, Staphylococcus
PGAQTSEATVAKAEEIY

SEQ ID NO: 1972523 - protein, 8 aa, Staphylococcus
PGARHKRE

SEQ ID NO: 1972524 - protein, 7 aa, Staphylococcus
PGASHGY

SEQ ID NO: 1972525 - protein, 14 aa, Staphylococcus
PGASYKNFKPSESD

SEQ ID NO: 1972526 - protein, 14 aa, Staphylococcus
PGASYKTFNPSESD

SEQ ID NO: 1972527 - protein, 16 aa, Staphylococcus
PGATLDSEPHLSGSEE

SEQ ID NO: 1972528 - protein, 11 aa, Staphylococcus
PGAVPRTSTVG

SEQ ID NO: 1972529 - protein, 10 aa, Staphylococcus
PGAVSTELTD

SEQ ID NO: 1972530 - protein, 19 aa, Staphylococcus
PGDADAQENVKSEMGRQAG

SEQ ID NO: 1972531 - protein, 10 aa, Staphylococcus
PGDDLPTAGG

SEQ ID NO: 1972532 - protein, 8 aa, Staphylococcus
PGDEAGVK

SEQ ID NO: 1972533 - protein, 9 aa, Staphylococcus
PGDEQINYK

SEQ ID NO: 1972534 - protein, 4 aa, Staphylococcus
PGDF

SEQ ID NO: 1972535 - protein, 8 aa, Staphylococcus
PGDPKDIG

SEQ ID NO: 1972536 - protein, 10 aa, Staphylococcus
PGDPKEIGDD

SEQ ID NO: 1972537 - protein, 4 aa, Staphylococcus
PGDR

SEQ ID NO: 1972538 - protein, 20 aa, Staphylococcus
PGDSDEKQSVKREMGRQAGQ

SEQ ID NO: 1972539 - protein, 19 aa, Staphylococcus
PGDSDSNQTVKREIGRQAG

SEQ ID NO: 1972540 - protein, 10 aa, Staphylococcus
PGDSETDKAV

SEQ ID NO: 1972541 - protein, 8 aa, Staphylococcus
PGDSSDIG

SEQ ID NO: 1972542 - protein, 17 aa, Staphylococcus
PGDSYAYEHENGQYGKS

SEQ ID NO: 1972543 - protein, 9 aa, Staphylococcus
PGDYRGKEI

SEQ ID NO: 1972544 - protein, 7 aa, Staphylococcus
PGDYRKE

SEQ ID NO: 1972545 - protein, 11 aa, Staphylococcus
PGDYRNKAIND

SEQ ID NO: 1972546 - protein, 8 aa, Staphylococcus
PGEEEEEY

SEQ ID NO: 1972547 - protein, 13 aa, Staphylococcus
PGEGNIKVNDRDV

SEQ ID NO: 1972548 - protein, 13 aa, Staphylococcus
PGEGNIKVNNRDV

SEQ ID NO: 1972549 - protein, 6 aa, Staphylococcus
PGEKEL

SEQ ID NO: 1972550 - protein, 6 aa, Staphylococcus
PGEKEM

SEQ ID NO: 1972551 - protein, 17 aa, Staphylococcus
PGERGRLRSEAYDKDGI

SEQ ID NO: 1972552 - protein, 6 aa, Staphylococcus
PGESFE

SEQ ID NO: 1972553 - protein, 4 aa, Staphylococcus
PGET

SEQ ID NO: 1972554 - protein, 9 aa, Staphylococcus
PGETGQAHQ

SEQ ID NO: 1972555 - protein, 7 aa, Staphylococcus
PGETSQA

SEQ ID NO: 1972556 - protein, 12 aa, Staphylococcus
PGEYGTEESNKA

SEQ ID NO: 1972557 - protein, 15 aa, Staphylococcus
PGEYSPSIASVSQSL

SEQ ID NO: 1972558 - protein, 5 aa, Staphylococcus
PGFAS

SEQ ID NO: 1972559 - protein, 5 aa, Staphylococcus
PGFEK

SEQ ID NO: 1972560 - protein, 8 aa, Staphylococcus
PGGAAARP

SEQ ID NO: 1972561 - protein, 5 aa, Staphylococcus
PGGAL

SEQ ID NO: 1972562 - protein, 12 aa, Staphylococcus
PGGGVKEQTAGM

SEQ ID NO: 1972563 - protein, 4 aa, Staphylococcus
PGGH

SEQ ID NO: 1972564 - protein, 5 aa, Staphylococcus
PGGIK

SEQ ID NO: 1972565 - protein, 10 aa, Staphylococcus
PGGKASYPST

SEQ ID NO: 1972566 - protein, 9 aa, Staphylococcus
PGGKVSTDQ

SEQ ID NO: 1972567 - protein, 17 aa, Staphylococcus
PGGQYSNLGQQAKSLGL

SEQ ID NO: 1972568 - protein, 17 aa, Staphylococcus
PGGQYSNLNQQAKSLGL

SEQ ID NO: 1972569 - protein, 15 aa, Staphylococcus
PGGTMSGEPHGSGTM

SEQ ID NO: 1972570 - protein, 7 aa, Staphylococcus
PGGTVTV

SEQ ID NO: 1972571 - protein, 14 aa, Staphylococcus
PGGVPNEPPIDGIN

SEQ ID NO: 1972572 - protein, 4 aa, Staphylococcus
PGGY

SEQ ID NO: 1972573 - protein, 5 aa, Staphylococcus
PGHAP

SEQ ID NO: 1972574 - protein, 9 aa, Staphylococcus
PGHDERDHE

SEQ ID NO: 1972575 - protein, 11 aa, Staphylococcus
PGHGADQSDLE

SEQ ID NO: 1972576 - protein, 12 aa, Staphylococcus
PGHGADQSLDTE

SEQ ID NO: 1972577 - protein, 12 aa, Staphylococcus
PGHGKDDSPTDQ

SEQ ID NO: 1972578 - protein, 12 aa, Staphylococcus
PGHGNDTSNSKL

SEQ ID NO: 1972579 - protein, 11 aa, Staphylococcus
PGHGQDQSPID

SEQ ID NO: 1972580 - protein, 12 aa, Staphylococcus
PGHGQDTSDMSD

SEQ ID NO: 1972581 - protein, 7 aa, Staphylococcus
PGHQGGQ

SEQ ID NO: 1972582 - protein, 4 aa, Staphylococcus
PGHS

SEQ ID NO: 1972583 - protein, 13 aa, Staphylococcus
PGHSFDKAKEDGF

SEQ ID NO: 1972584 - protein, 13 aa, Staphylococcus
PGHSFDRAKEDGF

SEQ ID NO: 1972585 - protein, 7 aa, Staphylococcus
PGHSPGS

SEQ ID NO: 1972586 - protein, 7 aa, Staphylococcus
PGHTEAA

SEQ ID NO: 1972587 - protein, 4 aa, Staphylococcus
PGIE

SEQ ID NO: 1972588 - protein, 68 aa, Staphylococcus
PGIEDTVGDNSEDSTQKTEKPDVSKEEDNKKEDLKDSAKKEESTDTAKKEEKSEQPPKLDSENVPEPP

SEQ ID NO: 1972589 - protein, 7 aa, Staphylococcus
PGIEIPD

SEQ ID NO: 1972590 - protein, 9 aa, Staphylococcus
PGIGKKTAR

SEQ ID NO: 1972591 - protein, 10 aa, Staphylococcus
PGINPEDDSY

SEQ ID NO: 1972592 - protein, 5 aa, Staphylococcus
PGIPL

SEQ ID NO: 1972593 - protein, 5 aa, Staphylococcus
PGIPY

SEQ ID NO: 1972594 - protein, 7 aa, Staphylococcus
PGIQPYT

SEQ ID NO: 1972595 - protein, 27 aa, Staphylococcus
PGIRPADYAQDDQKRITTPDDARKLGS

SEQ ID NO: 1972596 - protein, 27 aa, Staphylococcus
PGIRPKDASSDDQKRITTPEDAKELGS

SEQ ID NO: 1972597 - protein, 27 aa, Staphylococcus
PGIRPKGAAQNDQQRITTPEEAQTLGS

SEQ ID NO: 1972598 - protein, 27 aa, Staphylococcus
PGIRPKGAAVNDQKRITTPEDAKQLGS

SEQ ID NO: 1972599 - protein, 27 aa, Staphylococcus
PGIRPKGVTADDQQRITTPEDAKQLGS

SEQ ID NO: 1972600 - protein, 26 aa, Staphylococcus
PGIRPQGAAVDDQKRITTPEDAKQLG

SEQ ID NO: 1972601 - protein, 15 aa, Staphylococcus
PGITANNVINMKKAI

SEQ ID NO: 1972602 - protein, 11 aa, Staphylococcus
PGITDKDAADI

SEQ ID NO: 1972603 - protein, 9 aa, Staphylococcus
PGITDKDAD

SEQ ID NO: 1972604 - protein, 10 aa, Staphylococcus
PGITDKDADD

SEQ ID NO: 1972605 - protein, 11 aa, Staphylococcus
PGITEKDADDI

SEQ ID NO: 1972606 - protein, 8 aa, Staphylococcus
PGKAEEKQ

SEQ ID NO: 1972607 - protein, 13 aa, Staphylococcus
PGKATTEATTLKA

SEQ ID NO: 1972608 - protein, 4 aa, Staphylococcus
PGKF

SEQ ID NO: 1972609 - protein, 4 aa, Staphylococcus
PGKG

SEQ ID NO: 1972610 - protein, 5 aa, Staphylococcus
PGKHV

SEQ ID NO: 1972611 - protein, 23 aa, Staphylococcus
PGKKDTSQFSTDNASGSTSQATN

SEQ ID NO: 1972612 - protein, 23 aa, Staphylococcus
PGKKDTTEFSTENASGSTSQAAN

SEQ ID NO: 1972613 - protein, 10 aa, Staphylococcus
PGKLDGKDLD

SEQ ID NO: 1972614 - protein, 5 aa, Staphylococcus
PGKTG

SEQ ID NO: 1972615 - protein, 11 aa, Staphylococcus
PGKVGYSAETV

SEQ ID NO: 1972616 - protein, 14 aa, Staphylococcus
PGLDQDDLKDPVAE

SEQ ID NO: 1972617 - protein, 7 aa, Staphylococcus
PGLNGEN

SEQ ID NO: 1972618 - protein, 5 aa, Staphylococcus
PGLPN

SEQ ID NO: 1972619 - protein, 4 aa, Staphylococcus
PGLQ

SEQ ID NO: 1972620 - protein, 7 aa, Staphylococcus
PGLSDAE

SEQ ID NO: 1972621 - protein, 8 aa, Staphylococcus
PGLSPEAL

SEQ ID NO: 1972622 - protein, 8 aa, Staphylococcus
PGLTETDM

SEQ ID NO: 1972623 - protein, 12 aa, Staphylococcus
PGLVEPDESYHG

SEQ ID NO: 1972624 - protein, 14 aa, Staphylococcus
PGLVEPDESYHGVS

SEQ ID NO: 1972625 - protein, 11 aa, Staphylococcus
PGLVEPDPSYH

SEQ ID NO: 1972626 - protein, 16 aa, Staphylococcus
PGMGSLTEQLAKKAKQ

SEQ ID NO: 1972627 - protein, 15 aa, Staphylococcus
PGMKGAEATVKGAYK

SEQ ID NO: 1972628 - protein, 15 aa, Staphylococcus
PGMTSEKNQGNLGDG

SEQ ID NO: 1972629 - protein, 5 aa, Staphylococcus
PGMTV

SEQ ID NO: 1972630 - protein, 16 aa, Staphylococcus
PGNDEINKKQAENGGA

SEQ ID NO: 1972631 - protein, 7 aa, Staphylococcus
PGNKELE

SEQ ID NO: 1972632 - protein, 6 aa, Staphylococcus
PGNPDI

SEQ ID NO: 1972633 - protein, 14 aa, Staphylococcus
PGNSFDKAKKDGFD

SEQ ID NO: 1972634 - protein, 18 aa, Staphylococcus
PGNTQSSDYITEIWIPIE

SEQ ID NO: 1972635 - protein, 9 aa, Staphylococcus
PGPCKPSDY

SEQ ID NO: 1972636 - protein, 7 aa, Staphylococcus
PGPINTP

SEQ ID NO: 1972637 - protein, 5 aa, Staphylococcus
PGPIY

SEQ ID NO: 1972638 - protein, 5 aa, Staphylococcus
PGPLS

SEQ ID NO: 1972639 - protein, 10 aa, Staphylococcus
PGPPKEMKSM

SEQ ID NO: 1972640 - protein, 9 aa, Staphylococcus
PGPPREMRP

SEQ ID NO: 1972641 - protein, 9 aa, Staphylococcus
PGPPSEMQP

SEQ ID NO: 1972642 - protein, 10 aa, Staphylococcus
PGPPSEMQPM

SEQ ID NO: 1972643 - protein, 4 aa, Staphylococcus
PGPV

SEQ ID NO: 1972644 - protein, 5 aa, Staphylococcus
PGPVD

SEQ ID NO: 1972645 - protein, 12 aa, Staphylococcus
PGPVSATVKIEP

SEQ ID NO: 1972646 - protein, 9 aa, Staphylococcus
PGQKPPKLV

SEQ ID NO: 1972647 - protein, 7 aa, Staphylococcus
PGQSEKE

SEQ ID NO: 1972648 - protein, 7 aa, Staphylococcus
PGQSSFS

SEQ ID NO: 1972649 - protein, 5 aa, Staphylococcus
PGQYE

SEQ ID NO: 1972650 - protein, 8 aa, Staphylococcus
PGQYGDKV

SEQ ID NO: 1972651 - protein, 18 aa, Staphylococcus
PGQYGDKVSPARTHIQSP

SEQ ID NO: 1972652 - protein, 14 aa, Staphylococcus
PGQYGDRVSPIKTT

SEQ ID NO: 1972653 - protein, 20 aa, Staphylococcus
PGRGESSELTTTKDTLDDYS

SEQ ID NO: 1972654 - protein, 13 aa, Staphylococcus
PGRSFDKAKENGF

SEQ ID NO: 1972655 - protein, 8 aa, Staphylococcus
PGSADPFQ

SEQ ID NO: 1972656 - protein, 4 aa, Staphylococcus
PGSH

SEQ ID NO: 1972657 - protein, 13 aa, Staphylococcus
PGSHGSTFGGNPL

SEQ ID NO: 1972658 - protein, 5 aa, Staphylococcus
PGSIG

SEQ ID NO: 1972659 - protein, 13 aa, Staphylococcus
PGSISQSRSNIEE

SEQ ID NO: 1972660 - protein, 14 aa, Staphylococcus
PGSISQSRSNVEET

SEQ ID NO: 1972661 - protein, 15 aa, Staphylococcus
PGSISQSRSQKEETF

SEQ ID NO: 1972662 - protein, 14 aa, Staphylococcus
PGSISQSRSSIEET

SEQ ID NO: 1972663 - protein, 6 aa, Staphylococcus
PGSITT

SEQ ID NO: 1972664 - protein, 21 aa, Staphylococcus
PGSLEEAHSVDEKIEASELQT

SEQ ID NO: 1972665 - protein, 21 aa, Staphylococcus
PGSLEEAHSVDEKIESQELQT

SEQ ID NO: 1972666 - protein, 21 aa, Staphylococcus
PGSLEEAHSVDEKVEKRELEQ

SEQ ID NO: 1972667 - protein, 21 aa, Staphylococcus
PGSLEEAHSVNEKIQKEELKK

SEQ ID NO: 1972668 - protein, 21 aa, Staphylococcus
PGSLTEAHSVDEKITATELQT

SEQ ID NO: 1972669 - protein, 21 aa, Staphylococcus
PGSLTEAHSVDEKVEKEELAQ

SEQ ID NO: 1972670 - protein, 10 aa, Staphylococcus
PGSRNDHQTM

SEQ ID NO: 1972671 - protein, 8 aa, Staphylococcus
PGSSIKGK

SEQ ID NO: 1972672 - protein, 15 aa, Staphylococcus
PGSSSGVIDQLKLAM

SEQ ID NO: 1972673 - protein, 6 aa, Staphylococcus
PGSTGA

SEQ ID NO: 1972674 - protein, 8 aa, Staphylococcus
PGSYNDQG

SEQ ID NO: 1972675 - protein, 4 aa, Staphylococcus
PGTD

SEQ ID NO: 1972676 - protein, 12 aa, Staphylococcus
PGTDGPIDNQED

SEQ ID NO: 1972677 - protein, 5 aa, Staphylococcus
PGTEV

SEQ ID NO: 1972678 - protein, 10 aa, Staphylococcus
PGTGETVGTQ

SEQ ID NO: 1972679 - protein, 12 aa, Staphylococcus
PGTGETVGTQLA

SEQ ID NO: 1972680 - protein, 10 aa, Staphylococcus
PGTKTENADR

SEQ ID NO: 1972681 - protein, 6 aa, Staphylococcus
PGTPPD

SEQ ID NO: 1972682 - protein, 21 aa, Staphylococcus
PGTPPDLLNPPQGDAFARRSQ

SEQ ID NO: 1972683 - protein, 10 aa, Staphylococcus
PGTPSKLSGL

SEQ ID NO: 1972684 - protein, 8 aa, Staphylococcus
PGTRATQI

SEQ ID NO: 1972685 - protein, 7 aa, Staphylococcus
PGTRGVP

SEQ ID NO: 1972686 - protein, 18 aa, Staphylococcus
PGTTTDNYKRNFREETSR

SEQ ID NO: 1972687 - protein, 6 aa, Staphylococcus
PGTTTL

SEQ ID NO: 1972688 - protein, 8 aa, Staphylococcus
PGTTTPAY

SEQ ID NO: 1972689 - protein, 17 aa, Staphylococcus
PGTTTPKYKRNFNRETS

SEQ ID NO: 1972690 - protein, 17 aa, Staphylococcus
PGTTTSRYKRNFNRETS

SEQ ID NO: 1972691 - protein, 6 aa, Staphylococcus
PGTTVQ

SEQ ID NO: 1972692 - protein, 4 aa, Staphylococcus
PGVE

SEQ ID NO: 1972693 - protein, 6 aa, Staphylococcus
PGVPKA

SEQ ID NO: 1972694 - protein, 7 aa, Staphylococcus
PGVPKGN

SEQ ID NO: 1972695 - protein, 7 aa, Staphylococcus
PGVSKGR

SEQ ID NO: 1972696 - protein, 4 aa, Staphylococcus
PGVT

SEQ ID NO: 1972697 - protein, 4 aa, Staphylococcus
PGYD

SEQ ID NO: 1972698 - protein, 12 aa, Staphylococcus
PGYEPDDELKED

SEQ ID NO: 1972699 - protein, 7 aa, Staphylococcus
PGYQQFK

SEQ ID NO: 1972700 - protein, 4 aa, Staphylococcus
PGYS

SEQ ID NO: 1972701 - protein, 9 aa, Staphylococcus
PGYSPDERH

SEQ ID NO: 1972702 - protein, 10 aa, Staphylococcus
PGYSSDDHDF

SEQ ID NO: 1972703 - protein, 10 aa, Staphylococcus
PGYSSEDKNF

SEQ ID NO: 1972704 - protein, 9 aa, Staphylococcus
PGYSTTDKN

SEQ ID NO: 1972705 - protein, 5 aa, Staphylococcus
PHADL

SEQ ID NO: 1972706 - protein, 16 aa, Staphylococcus
PHAPSAQLAEVQGDQI

SEQ ID NO: 1972707 - protein, 4 aa, Staphylococcus
PHDG

SEQ ID NO: 1972708 - protein, 8 aa, Staphylococcus
PHDGEPCN

SEQ ID NO: 1972709 - protein, 6 aa, Staphylococcus
PHDSGE

SEQ ID NO: 1972710 - protein, 6 aa, Staphylococcus
PHDYGT

SEQ ID NO: 1972711 - protein, 5 aa, Staphylococcus
PHEDQ

SEQ ID NO: 1972712 - protein, 6 aa, Staphylococcus
PHEGDT

SEQ ID NO: 1972713 - protein, 5 aa, Staphylococcus
PHELR

SEQ ID NO: 1972714 - protein, 4 aa, Staphylococcus
PHET

SEQ ID NO: 1972715 - protein, 5 aa, Staphylococcus
PHETW

SEQ ID NO: 1972716 - protein, 4 aa, Staphylococcus
PHGG

SEQ ID NO: 1972717 - protein, 5 aa, Staphylococcus
PHGGE

SEQ ID NO: 1972718 - protein, 14 aa, Staphylococcus
PHGGKSDYRINGKD

SEQ ID NO: 1972719 - protein, 5 aa, Staphylococcus
PHGGT

SEQ ID NO: 1972720 - protein, 6 aa, Staphylococcus
PHGSDF

SEQ ID NO: 1972721 - protein, 12 aa, Staphylococcus
PHGTDEAKGDVL

SEQ ID NO: 1972722 - protein, 12 aa, Staphylococcus
PHGTDEAKSAVL

SEQ ID NO: 1972723 - protein, 12 aa, Staphylococcus
PHGTDEAKTSVL

SEQ ID NO: 1972724 - protein, 12 aa, Staphylococcus
PHGTEEAKGNVI

SEQ ID NO: 1972725 - protein, 13 aa, Staphylococcus
PHGTEEAKGNVIQ

SEQ ID NO: 1972726 - protein, 7 aa, Staphylococcus
PHGTSFQ

SEQ ID NO: 1972727 - protein, 8 aa, Staphylococcus
PHIESGEV

SEQ ID NO: 1972728 - protein, 4 aa, Staphylococcus
PHKD

SEQ ID NO: 1972729 - protein, 10 aa, Staphylococcus
PHKHTYSDDD

SEQ ID NO: 1972730 - protein, 5 aa, Staphylococcus
PHKVN

SEQ ID NO: 1972731 - protein, 4 aa, Staphylococcus
PHLK

SEQ ID NO: 1972732 - protein, 5 aa, Staphylococcus
PHLSK

SEQ ID NO: 1972733 - protein, 6 aa, Staphylococcus
PHLSKG

SEQ ID NO: 1972734 - protein, 8 aa, Staphylococcus
PHLTKEDT

SEQ ID NO: 1972735 - protein, 4 aa, Staphylococcus
PHNE

SEQ ID NO: 1972736 - protein, 4 aa, Staphylococcus
PHNI

SEQ ID NO: 1972737 - protein, 9 aa, Staphylococcus
PHNPSGKQY

SEQ ID NO: 1972738 - protein, 7 aa, Staphylococcus
PHNPTGR

SEQ ID NO: 1972739 - protein, 8 aa, Staphylococcus
PHNPTGRV

SEQ ID NO: 1972740 - protein, 6 aa, Staphylococcus
PHPEGG

SEQ ID NO: 1972741 - protein, 15 aa, Staphylococcus
PHPEKLDEIKPKKVF

SEQ ID NO: 1972742 - protein, 9 aa, Staphylococcus
PHPGTDAAI

SEQ ID NO: 1972743 - protein, 5 aa, Staphylococcus
PHPIA

SEQ ID NO: 1972744 - protein, 6 aa, Staphylococcus
PHPIRG

SEQ ID NO: 1972745 - protein, 13 aa, Staphylococcus
PHPPKSKIEASEK

SEQ ID NO: 1972746 - protein, 11 aa, Staphylococcus
PHPPKSKIELA

SEQ ID NO: 1972747 - protein, 13 aa, Staphylococcus
PHPPKSKVEASEK

SEQ ID NO: 1972748 - protein, 12 aa, Staphylococcus
PHPPVSKVQEAK

SEQ ID NO: 1972749 - protein, 5 aa, Staphylococcus
PHPRF

SEQ ID NO: 1972750 - protein, 22 aa, Staphylococcus
PHPSLSEAIGESADAYFGKAIH

SEQ ID NO: 1972751 - protein, 7 aa, Staphylococcus
PHPSPLS

SEQ ID NO: 1972752 - protein, 12 aa, Staphylococcus
PHPYRGKRNEPV

SEQ ID NO: 1972753 - protein, 6 aa, Staphylococcus
PHRKYA

SEQ ID NO: 1972754 - protein, 12 aa, Staphylococcus
PHRSASKIASNI

SEQ ID NO: 1972755 - protein, 6 aa, Staphylococcus
PHRYES

SEQ ID NO: 1972756 - protein, 7 aa, Staphylococcus
PHSDETV

SEQ ID NO: 1972757 - protein, 16 aa, Staphylococcus
PHSKGRLKQEDRDQVE

SEQ ID NO: 1972758 - protein, 20 aa, Staphylococcus
PHSNRRQDDWGGSREKRTNF

SEQ ID NO: 1972759 - protein, 4 aa, Staphylococcus
PHTG

SEQ ID NO: 1972760 - protein, 4 aa, Staphylococcus
PHTL

SEQ ID NO: 1972761 - protein, 14 aa, Staphylococcus
PHVSESTKRHYESA

SEQ ID NO: 1972762 - protein, 9 aa, Staphylococcus
PHYNDTEAQ

SEQ ID NO: 1972763 - protein, 5 aa, Staphylococcus
PHYSG

SEQ ID NO: 1972764 - protein, 17 aa, Staphylococcus
PIAAPSANISGRPSPTT

SEQ ID NO: 1972765 - protein, 12 aa, Staphylococcus
PIAEEYQSLRQK

SEQ ID NO: 1972766 - protein, 7 aa, Staphylococcus
PIAGSEL

SEQ ID NO: 1972767 - protein, 22 aa, Staphylococcus
PIAGTTKRGANKNEDKKNSHAL

SEQ ID NO: 1972768 - protein, 5 aa, Staphylococcus
PIANK

SEQ ID NO: 1972769 - protein, 9 aa, Staphylococcus
PIARDSQSI

SEQ ID NO: 1972770 - protein, 16 aa, Staphylococcus
PIDEQTEERNREAVNE

SEQ ID NO: 1972771 - protein, 4 aa, Staphylococcus
PIDG

SEQ ID NO: 1972772 - protein, 6 aa, Staphylococcus
PIDGSK

SEQ ID NO: 1972773 - protein, 15 aa, Staphylococcus
PIDGTTPASKGQDNA

SEQ ID NO: 1972774 - protein, 4 aa, Staphylococcus
PIDI

SEQ ID NO: 1972775 - protein, 4 aa, Staphylococcus
PIDQ

SEQ ID NO: 1972776 - protein, 12 aa, Staphylococcus
PIDSNGKVDNDT

SEQ ID NO: 1972777 - protein, 4 aa, Staphylococcus
PIEE

SEQ ID NO: 1972778 - protein, 6 aa, Staphylococcus
PIEGSK

SEQ ID NO: 1972779 - protein, 9 aa, Staphylococcus
PIEKNLPPK

SEQ ID NO: 1972780 - protein, 11 aa, Staphylococcus
PIEKSLPPKLE

SEQ ID NO: 1972781 - protein, 11 aa, Staphylococcus
PIENASTGSYT

SEQ ID NO: 1972782 - protein, 10 aa, Staphylococcus
PIENPNYNEN

SEQ ID NO: 1972783 - protein, 9 aa, Staphylococcus
PIENQDEPL

SEQ ID NO: 1972784 - protein, 5 aa, Staphylococcus
PIESG

SEQ ID NO: 1972785 - protein, 11 aa, Staphylococcus
PIESNEKYNEA

SEQ ID NO: 1972786 - protein, 10 aa, Staphylococcus
PIETNEEFDS

SEQ ID NO: 1972787 - protein, 11 aa, Staphylococcus
PIETSTSSRID

SEQ ID NO: 1972788 - protein, 8 aa, Staphylococcus
PIGASGTR

SEQ ID NO: 1972789 - protein, 11 aa, Staphylococcus
PIGGYGGKQEI

SEQ ID NO: 1972790 - protein, 6 aa, Staphylococcus
PIGNPY

SEQ ID NO: 1972791 - protein, 4 aa, Staphylococcus
PIGR

SEQ ID NO: 1972792 - protein, 8 aa, Staphylococcus
PIGRNKDS

SEQ ID NO: 1972793 - protein, 4 aa, Staphylococcus
PIGS

SEQ ID NO: 1972794 - protein, 6 aa, Staphylococcus
PIGSEE

SEQ ID NO: 1972795 - protein, 10 aa, Staphylococcus
PIGSNAGGIK

SEQ ID NO: 1972796 - protein, 12 aa, Staphylococcus
PIGSPRPRFRKS

SEQ ID NO: 1972797 - protein, 5 aa, Staphylococcus
PIGTY

SEQ ID NO: 1972798 - protein, 4 aa, Staphylococcus
PIGV

SEQ ID NO: 1972799 - protein, 8 aa, Staphylococcus
PIGYTDQP

SEQ ID NO: 1972800 - protein, 4 aa, Staphylococcus
PIHR

SEQ ID NO: 1972801 - protein, 8 aa, Staphylococcus
PIHSKNEP

SEQ ID NO: 1972802 - protein, 9 aa, Staphylococcus
PIIRGTDDG

SEQ ID NO: 1972803 - protein, 4 aa, Staphylococcus
PIKD

SEQ ID NO: 1972804 - protein, 11 aa, Staphylococcus
PIKGNGQVVKK

SEQ ID NO: 1972805 - protein, 10 aa, Staphylococcus
PIKNNKSSLK

SEQ ID NO: 1972806 - protein, 5 aa, Staphylococcus
PIKNV

SEQ ID NO: 1972807 - protein, 16 aa, Staphylococcus
PIKNYTKKSKKELEKE

SEQ ID NO: 1972808 - protein, 4 aa, Staphylococcus
PIKP

SEQ ID NO: 1972809 - protein, 18 aa, Staphylococcus
PIKQAKELSNDKKSNEKL

SEQ ID NO: 1972810 - protein, 18 aa, Staphylococcus
PIKQAKELSNDKNSSEKL

SEQ ID NO: 1972811 - protein, 17 aa, Staphylococcus
PIKQAKELSNDKNSYEK

SEQ ID NO: 1972812 - protein, 18 aa, Staphylococcus
PIKQAKELSNDKRSNEKL

SEQ ID NO: 1972813 - protein, 18 aa, Staphylococcus
PIKQAKELSSDKKSTEKL

SEQ ID NO: 1972814 - protein, 6 aa, Staphylococcus
PIKQSD

SEQ ID NO: 1972815 - protein, 7 aa, Staphylococcus
PIKQTDK

SEQ ID NO: 1972816 - protein, 5 aa, Staphylococcus
PILNS

SEQ ID NO: 1972817 - protein, 11 aa, Staphylococcus
PINDDGDTLPL

SEQ ID NO: 1972818 - protein, 6 aa, Staphylococcus
PINEEA

SEQ ID NO: 1972819 - protein, 11 aa, Staphylococcus
PINKKRNKPIY

SEQ ID NO: 1972820 - protein, 6 aa, Staphylococcus
PINLTN

SEQ ID NO: 1972821 - protein, 4 aa, Staphylococcus
PINN

SEQ ID NO: 1972822 - protein, 5 aa, Staphylococcus
PINNE

SEQ ID NO: 1972823 - protein, 11 aa, Staphylococcus
PINQKDNEHST

SEQ ID NO: 1972824 - protein, 11 aa, Staphylococcus
PINQKDNENSR

SEQ ID NO: 1972825 - protein, 5 aa, Staphylococcus
PIPAL

SEQ ID NO: 1972826 - protein, 13 aa, Staphylococcus
PIPDKKLSKQIEK

SEQ ID NO: 1972827 - protein, 6 aa, Staphylococcus
PIPEGK

SEQ ID NO: 1972828 - protein, 5 aa, Staphylococcus
PIPEN

SEQ ID NO: 1972829 - protein, 8 aa, Staphylococcus
PIPHSPAE

SEQ ID NO: 1972830 - protein, 12 aa, Staphylococcus
PIPKSTSIARQI

SEQ ID NO: 1972831 - protein, 7 aa, Staphylococcus
PIPNDRN

SEQ ID NO: 1972832 - protein, 5 aa, Staphylococcus
PIPNG

SEQ ID NO: 1972833 - protein, 4 aa, Staphylococcus
PIPS

SEQ ID NO: 1972834 - protein, 7 aa, Staphylococcus
PIPTEGN

SEQ ID NO: 1972835 - protein, 8 aa, Staphylococcus
PIPTGNGK

SEQ ID NO: 1972836 - protein, 12 aa, Staphylococcus
PIQASTKKEELK

SEQ ID NO: 1972837 - protein, 12 aa, Staphylococcus
PIQASTKKNELK

SEQ ID NO: 1972838 - protein, 9 aa, Staphylococcus
PIQEGPLPE

SEQ ID NO: 1972839 - protein, 11 aa, Staphylococcus
PIQENRGNNNI

SEQ ID NO: 1972840 - protein, 5 aa, Staphylococcus
PIQNG

SEQ ID NO: 1972841 - protein, 5 aa, Staphylococcus
PIQQQ

SEQ ID NO: 1972842 - protein, 11 aa, Staphylococcus
PIQRGGAGGGI

SEQ ID NO: 1972843 - protein, 7 aa, Staphylococcus
PIRGKWN

SEQ ID NO: 1972844 - protein, 5 aa, Staphylococcus
PIRPD

SEQ ID NO: 1972845 - protein, 6 aa, Staphylococcus
PIRRPE

SEQ ID NO: 1972846 - protein, 5 aa, Staphylococcus
PISDR

SEQ ID NO: 1972847 - protein, 12 aa, Staphylococcus
PISDTCNKQSNK

SEQ ID NO: 1972848 - protein, 13 aa, Staphylococcus
PISEAMDRDTDLG

SEQ ID NO: 1972849 - protein, 4 aa, Staphylococcus
PISG

SEQ ID NO: 1972850 - protein, 13 aa, Staphylococcus
PISGGDVGGSKNF

SEQ ID NO: 1972851 - protein, 4 aa, Staphylococcus
PISI

SEQ ID NO: 1972852 - protein, 4 aa, Staphylococcus
PISK

SEQ ID NO: 1972853 - protein, 12 aa, Staphylococcus
PISKKKIERREF

SEQ ID NO: 1972854 - protein, 5 aa, Staphylococcus
PISKN

SEQ ID NO: 1972855 - protein, 5 aa, Staphylococcus
PISND

SEQ ID NO: 1972856 - protein, 7 aa, Staphylococcus
PISNNVK

SEQ ID NO: 1972857 - protein, 8 aa, Staphylococcus
PISPNNED

SEQ ID NO: 1972858 - protein, 10 aa, Staphylococcus
PISQQRSVAT

SEQ ID NO: 1972859 - protein, 7 aa, Staphylococcus
PISRTKL

SEQ ID NO: 1972860 - protein, 5 aa, Staphylococcus
PISSG

SEQ ID NO: 1972861 - protein, 6 aa, Staphylococcus
PISSID

SEQ ID NO: 1972862 - protein, 14 aa, Staphylococcus
PISTPQSPQGRPVN

SEQ ID NO: 1972863 - protein, 11 aa, Staphylococcus
PISVTEKPQPI

SEQ ID NO: 1972864 - protein, 4 aa, Staphylococcus
PITD

SEQ ID NO: 1972865 - protein, 15 aa, Staphylococcus
PITDYGKSKAKAEEK

SEQ ID NO: 1972866 - protein, 7 aa, Staphylococcus
PITEDEW

SEQ ID NO: 1972867 - protein, 6 aa, Staphylococcus
PITGEK

SEQ ID NO: 1972868 - protein, 7 aa, Staphylococcus
PITGTSY

SEQ ID NO: 1972869 - protein, 20 aa, Staphylococcus
PITKSENPVASYHKIKESWL

SEQ ID NO: 1972870 - protein, 12 aa, Staphylococcus
PITKTSNHKPTK

SEQ ID NO: 1972871 - protein, 15 aa, Staphylococcus
PITQRFSKDDQQGLE

SEQ ID NO: 1972872 - protein, 20 aa, Staphylococcus
PITQSDDPVASYHQIKESWL

SEQ ID NO: 1972873 - protein, 20 aa, Staphylococcus
PITQSDDPVKSYQIIKESWL

SEQ ID NO: 1972874 - protein, 20 aa, Staphylococcus
PITQSDRPVESYQNIKESWL

SEQ ID NO: 1972875 - protein, 20 aa, Staphylococcus
PITQSEHPVESYHSIKESWL

SEQ ID NO: 1972876 - protein, 20 aa, Staphylococcus
PITQSENPVESYHTIKESWL

SEQ ID NO: 1972877 - protein, 33 aa, Staphylococcus
PITRKQKRTTRRGFKTEREAKIAEAKLQTEVQA

SEQ ID NO: 1972878 - protein, 6 aa, Staphylococcus
PITSNE

SEQ ID NO: 1972879 - protein, 5 aa, Staphylococcus
PITSR

SEQ ID NO: 1972880 - protein, 6 aa, Staphylococcus
PITSSD

SEQ ID NO: 1972881 - protein, 7 aa, Staphylococcus
PITSSES

SEQ ID NO: 1972882 - protein, 7 aa, Staphylococcus
PITSSET

SEQ ID NO: 1972883 - protein, 12 aa, Staphylococcus
PIVDSETGEIVA

SEQ ID NO: 1972884 - protein, 4 aa, Staphylococcus
PIVE

SEQ ID NO: 1972885 - protein, 12 aa, Staphylococcus
PIVNSDTGEIVA

SEQ ID NO: 1972886 - protein, 12 aa, Staphylococcus
PIVNSETGEIVA

SEQ ID NO: 1972887 - protein, 12 aa, Staphylococcus
PIVPSNTDMSRY

SEQ ID NO: 1972888 - protein, 5 aa, Staphylococcus
PIYET

SEQ ID NO: 1972889 - protein, 12 aa, Staphylococcus
PIYKENKDGSLE

SEQ ID NO: 1972890 - protein, 5 aa, Staphylococcus
PIYNE

SEQ ID NO: 1972891 - protein, 8 aa, Staphylococcus
PIYQSDNQ

SEQ ID NO: 1972892 - protein, 10 aa, Staphylococcus
PIYTEDEKGN

SEQ ID NO: 1972893 - protein, 4 aa, Staphylococcus
PKAA

SEQ ID NO: 1972894 - protein, 9 aa, Staphylococcus
PKAAESFKD

SEQ ID NO: 1972895 - protein, 14 aa, Staphylococcus
PKAGGAVVQTEDEI

SEQ ID NO: 1972896 - protein, 8 aa, Staphylococcus
PKAIAGEA

SEQ ID NO: 1972897 - protein, 10 aa, Staphylococcus
PKAKAEGYVS

SEQ ID NO: 1972898 - protein, 9 aa, Staphylococcus
PKAKFPPSL

SEQ ID NO: 1972899 - protein, 9 aa, Staphylococcus
PKALQPDED

SEQ ID NO: 1972900 - protein, 7 aa, Staphylococcus
PKALTSP

SEQ ID NO: 1972901 - protein, 10 aa, Staphylococcus
PKARGKGVGT

SEQ ID NO: 1972902 - protein, 7 aa, Staphylococcus
PKARTAL

SEQ ID NO: 1972903 - protein, 7 aa, Staphylococcus
PKASKYL

SEQ ID NO: 1972904 - protein, 8 aa, Staphylococcus
PKASKYLE

SEQ ID NO: 1972905 - protein, 13 aa, Staphylococcus
PKASYEEKEELPD

SEQ ID NO: 1972906 - protein, 4 aa, Staphylococcus
PKAV

SEQ ID NO: 1972907 - protein, 21 aa, Staphylococcus
PKDAGKLRASASENFTRATQL

SEQ ID NO: 1972908 - protein, 16 aa, Staphylococcus
PKDAKPIETDEPVDDY

SEQ ID NO: 1972909 - protein, 6 aa, Staphylococcus
PKDAYS

SEQ ID NO: 1972910 - protein, 11 aa, Staphylococcus
PKDDGSEPNNW

SEQ ID NO: 1972911 - protein, 9 aa, Staphylococcus
PKDDTSPII

SEQ ID NO: 1972912 - protein, 6 aa, Staphylococcus
PKDETW

SEQ ID NO: 1972913 - protein, 12 aa, Staphylococcus
PKDFENKGEYEQ

SEQ ID NO: 1972914 - protein, 13 aa, Staphylococcus
PKDGVASFNESGH

SEQ ID NO: 1972915 - protein, 10 aa, Staphylococcus
PKDIESAGLK

SEQ ID NO: 1972916 - protein, 7 aa, Staphylococcus
PKDIETQ

SEQ ID NO: 1972917 - protein, 12 aa, Staphylococcus
PKDIREKEGIAD

SEQ ID NO: 1972918 - protein, 5 aa, Staphylococcus
PKDKA

SEQ ID NO: 1972919 - protein, 7 aa, Staphylococcus
PKDKADF

SEQ ID NO: 1972920 - protein, 8 aa, Staphylococcus
PKDKEELT

SEQ ID NO: 1972921 - protein, 11 aa, Staphylococcus
PKDKMKESYDS

SEQ ID NO: 1972922 - protein, 5 aa, Staphylococcus
PKDKQ

SEQ ID NO: 1972923 - protein, 7 aa, Staphylococcus
PKDKSNY

SEQ ID NO: 1972924 - protein, 6 aa, Staphylococcus
PKDKTL

SEQ ID NO: 1972925 - protein, 7 aa, Staphylococcus
PKDSAEL

SEQ ID NO: 1972926 - protein, 7 aa, Staphylococcus
PKDSEIP

SEQ ID NO: 1972927 - protein, 6 aa, Staphylococcus
PKDSKL

SEQ ID NO: 1972928 - protein, 8 aa, Staphylococcus
PKDSKYPF

SEQ ID NO: 1972929 - protein, 8 aa, Staphylococcus
PKDSQYPF

SEQ ID NO: 1972930 - protein, 10 aa, Staphylococcus
PKDSYQLSED

SEQ ID NO: 1972931 - protein, 5 aa, Staphylococcus
PKDTC

SEQ ID NO: 1972932 - protein, 9 aa, Staphylococcus
PKDTDYRPN

SEQ ID NO: 1972933 - protein, 12 aa, Staphylococcus
PKDTKNGDYSSN

SEQ ID NO: 1972934 - protein, 16 aa, Staphylococcus
PKDTKQLKANYKNIPN

SEQ ID NO: 1972935 - protein, 10 aa, Staphylococcus
PKDTPSNNVE

SEQ ID NO: 1972936 - protein, 5 aa, Staphylococcus
PKDTV

SEQ ID NO: 1972937 - protein, 10 aa, Staphylococcus
PKDVKDAPDF

SEQ ID NO: 1972938 - protein, 12 aa, Staphylococcus
PKDVKNTELIQQ

SEQ ID NO: 1972939 - protein, 18 aa, Staphylococcus
PKDYRYEEVDTPKIENPE

SEQ ID NO: 1972940 - protein, 6 aa, Staphylococcus
PKECQE

SEQ ID NO: 1972941 - protein, 4 aa, Staphylococcus
PKED

SEQ ID NO: 1972942 - protein, 16 aa, Staphylococcus
PKEDDSVTQLILPIRT

SEQ ID NO: 1972943 - protein, 9 aa, Staphylococcus
PKEDDTWGQ

SEQ ID NO: 1972944 - protein, 7 aa, Staphylococcus
PKEDRAG

SEQ ID NO: 1972945 - protein, 6 aa, Staphylococcus
PKEDST

SEQ ID NO: 1972946 - protein, 19 aa, Staphylococcus
PKEDVQKIRQNAKVDVERA

SEQ ID NO: 1972947 - protein, 10 aa, Staphylococcus
PKEEDDAQDV

SEQ ID NO: 1972948 - protein, 8 aa, Staphylococcus
PKEEITDQ

SEQ ID NO: 1972949 - protein, 15 aa, Staphylococcus
PKEGSNENKDFDESD

SEQ ID NO: 1972950 - protein, 7 aa, Staphylococcus
PKEKADF

SEQ ID NO: 1972951 - protein, 6 aa, Staphylococcus
PKEKLI

SEQ ID NO: 1972952 - protein, 6 aa, Staphylococcus
PKEKQD

SEQ ID NO: 1972953 - protein, 5 aa, Staphylococcus
PKELR

SEQ ID NO: 1972954 - protein, 16 aa, Staphylococcus
PKEMGGNGVTESNPEQ

SEQ ID NO: 1972955 - protein, 4 aa, Staphylococcus
PKEN

SEQ ID NO: 1972956 - protein, 5 aa, Staphylococcus
PKENQ

SEQ ID NO: 1972957 - protein, 6 aa, Staphylococcus
PKEQET

SEQ ID NO: 1972958 - protein, 14 aa, Staphylococcus
PKEQRTQNFLSRVL

SEQ ID NO: 1972959 - protein, 7 aa, Staphylococcus
PKESKYT

SEQ ID NO: 1972960 - protein, 8 aa, Staphylococcus
PKESVNKA

SEQ ID NO: 1972961 - protein, 14 aa, Staphylococcus
PKESYQAKEELPDK

SEQ ID NO: 1972962 - protein, 4 aa, Staphylococcus
PKET

SEQ ID NO: 1972963 - protein, 12 aa, Staphylococcus
PKETKEIRQQIE

SEQ ID NO: 1972964 - protein, 7 aa, Staphylococcus
PKETLNT

SEQ ID NO: 1972965 - protein, 13 aa, Staphylococcus
PKETRQGSKQMGN

SEQ ID NO: 1972966 - protein, 13 aa, Staphylococcus
PKETRVGAKQMGT

SEQ ID NO: 1972967 - protein, 13 aa, Staphylococcus
PKETRVGTKQMGT

SEQ ID NO: 1972968 - protein, 8 aa, Staphylococcus
PKEVKSHS

SEQ ID NO: 1972969 - protein, 6 aa, Staphylococcus
PKEVNQ

SEQ ID NO: 1972970 - protein, 11 aa, Staphylococcus
PKFGATDGTIT

SEQ ID NO: 1972971 - protein, 11 aa, Staphylococcus
PKFGTRDGTIT

SEQ ID NO: 1972972 - protein, 11 aa, Staphylococcus
PKFGTTDGTIT

SEQ ID NO: 1972973 - protein, 10 aa, Staphylococcus
PKFKNTESKL

SEQ ID NO: 1972974 - protein, 21 aa, Staphylococcus
PKFKQPKAHDYDLTDEPLTQE

SEQ ID NO: 1972975 - protein, 12 aa, Staphylococcus
PKFTQGGKIQEL

SEQ ID NO: 1972976 - protein, 8 aa, Staphylococcus
PKGAGNKV

SEQ ID NO: 1972977 - protein, 11 aa, Staphylococcus
PKGAVRPSDNG

SEQ ID NO: 1972978 - protein, 6 aa, Staphylococcus
PKGAYS

SEQ ID NO: 1972979 - protein, 5 aa, Staphylococcus
PKGDK

SEQ ID NO: 1972980 - protein, 16 aa, Staphylococcus
PKGDKSIVTKPDSTIK

SEQ ID NO: 1972981 - protein, 15 aa, Staphylococcus
PKGDKSIVTQPESTI

SEQ ID NO: 1972982 - protein, 15 aa, Staphylococcus
PKGDKSIVTRPETTI

SEQ ID NO: 1972983 - protein, 15 aa, Staphylococcus
PKGDKSIVTTPQTTI

SEQ ID NO: 1972984 - protein, 16 aa, Staphylococcus
PKGDKTIVTKPETTIQ

SEQ ID NO: 1972985 - protein, 7 aa, Staphylococcus
PKGEEYL

SEQ ID NO: 1972986 - protein, 7 aa, Staphylococcus
PKGLTKK

SEQ ID NO: 1972987 - protein, 10 aa, Staphylococcus
PKGMPQDDTF

SEQ ID NO: 1972988 - protein, 4 aa, Staphylococcus
PKGQ

SEQ ID NO: 1972989 - protein, 6 aa, Staphylococcus
PKGQQV

SEQ ID NO: 1972990 - protein, 20 aa, Staphylococcus
PKGRKGTNSITKPSFRVPND

SEQ ID NO: 1972991 - protein, 5 aa, Staphylococcus
PKGRL

SEQ ID NO: 1972992 - protein, 9 aa, Staphylococcus
PKGRNMESR

SEQ ID NO: 1972993 - protein, 5 aa, Staphylococcus
PKGTE

SEQ ID NO: 1972994 - protein, 15 aa, Staphylococcus
PKGYISATEDPKQAT

SEQ ID NO: 1972995 - protein, 8 aa, Staphylococcus
PKGYVSAT

SEQ ID NO: 1972996 - protein, 8 aa, Staphylococcus
PKHDISKA

SEQ ID NO: 1972997 - protein, 5 aa, Staphylococcus
PKHDN

SEQ ID NO: 1972998 - protein, 4 aa, Staphylococcus
PKHE

SEQ ID NO: 1972999 - protein, 8 aa, Staphylococcus
PKHEKDFN

SEQ ID NO: 1973000 - protein, 10 aa, Staphylococcus
PKHEKLEKNQ

SEQ ID NO: 1973001 - protein, 7 aa, Staphylococcus
PKHENDF

SEQ ID NO: 1973002 - protein, 10 aa, Staphylococcus
PKHERNNKAI

SEQ ID NO: 1973003 - protein, 13 aa, Staphylococcus
PKHERTKNFLAKV

SEQ ID NO: 1973004 - protein, 5 aa, Staphylococcus
PKHES

SEQ ID NO: 1973005 - protein, 7 aa, Staphylococcus
PKHESDF

SEQ ID NO: 1973006 - protein, 11 aa, Staphylococcus
PKHFESKSHYE

SEQ ID NO: 1973007 - protein, 5 aa, Staphylococcus
PKHKN

SEQ ID NO: 1973008 - protein, 5 aa, Staphylococcus
PKHLD

SEQ ID NO: 1973009 - protein, 10 aa, Staphylococcus
PKHPNNPYKG

SEQ ID NO: 1973010 - protein, 11 aa, Staphylococcus
PKHPSNPNKGY

SEQ ID NO: 1973011 - protein, 8 aa, Staphylococcus
PKHPTTSD

SEQ ID NO: 1973012 - protein, 14 aa, Staphylococcus
PKHRRIAAGPEIQS

SEQ ID NO: 1973013 - protein, 10 aa, Staphylococcus
PKIADNQTLE

SEQ ID NO: 1973014 - protein, 6 aa, Staphylococcus
PKIDED

SEQ ID NO: 1973015 - protein, 9 aa, Staphylococcus
PKITTKEKI

SEQ ID NO: 1973016 - protein, 9 aa, Staphylococcus
PKKAGNPDL

SEQ ID NO: 1973017 - protein, 9 aa, Staphylococcus
PKKDEQLEL

SEQ ID NO: 1973018 - protein, 10 aa, Staphylococcus
PKKDGTTESL

SEQ ID NO: 1973019 - protein, 4 aa, Staphylococcus
PKKE

SEQ ID NO: 1973020 - protein, 9 aa, Staphylococcus
PKKEEQLEL

SEQ ID NO: 1973021 - protein, 11 aa, Staphylococcus
PKKEEQRKLGD

SEQ ID NO: 1973022 - protein, 10 aa, Staphylococcus
PKKEIDNGAV

SEQ ID NO: 1973023 - protein, 10 aa, Staphylococcus
PKKEIDNNAV

SEQ ID NO: 1973024 - protein, 17 aa, Staphylococcus
PKKGVQLKASSESLSQL

SEQ ID NO: 1973025 - protein, 8 aa, Staphylococcus
PKKHVSKT

SEQ ID NO: 1973026 - protein, 9 aa, Staphylococcus
PKKLEENQA

SEQ ID NO: 1973027 - protein, 7 aa, Staphylococcus
PKKLSKK

SEQ ID NO: 1973028 - protein, 10 aa, Staphylococcus
PKKNEGLRGK

SEQ ID NO: 1973029 - protein, 19 aa, Staphylococcus
PKKNENLHGEEGDINYPHS

SEQ ID NO: 1973030 - protein, 12 aa, Staphylococcus
PKKNESLHGDEG

SEQ ID NO: 1973031 - protein, 11 aa, Staphylococcus
PKKNESTHGEE

SEQ ID NO: 1973032 - protein, 11 aa, Staphylococcus
PKKNIEAYKRR

SEQ ID NO: 1973033 - protein, 12 aa, Staphylococcus
PKKNMRAAIDTW

SEQ ID NO: 1973034 - protein, 10 aa, Staphylococcus
PKKNSQLHGT

SEQ ID NO: 1973035 - protein, 6 aa, Staphylococcus
PKKQEF

SEQ ID NO: 1973036 - protein, 17 aa, Staphylococcus
PKKSAFSGKQKLKKVLK

SEQ ID NO: 1973037 - protein, 4 aa, Staphylococcus
PKKT

SEQ ID NO: 1973038 - protein, 8 aa, Staphylococcus
PKKTIPTT

SEQ ID NO: 1973039 - protein, 15 aa, Staphylococcus
PKKTQEERSSSNIQI

SEQ ID NO: 1973040 - protein, 9 aa, Staphylococcus
PKKYQQEVE

SEQ ID NO: 1973041 - protein, 5 aa, Staphylococcus
PKLCT

SEQ ID NO: 1973042 - protein, 7 aa, Staphylococcus
PKLDERK

SEQ ID NO: 1973043 - protein, 4 aa, Staphylococcus
PKLE

SEQ ID NO: 1973044 - protein, 7 aa, Staphylococcus
PKLEPQA

SEQ ID NO: 1973045 - protein, 7 aa, Staphylococcus
PKLKPES

SEQ ID NO: 1973046 - protein, 7 aa, Staphylococcus
PKLNSNH

SEQ ID NO: 1973047 - protein, 7 aa, Staphylococcus
PKLPSTE

SEQ ID NO: 1973048 - protein, 5 aa, Staphylococcus
PKLSI

SEQ ID NO: 1973049 - protein, 4 aa, Staphylococcus
PKMG

SEQ ID NO: 1973050 - protein, 5 aa, Staphylococcus
PKMNP

SEQ ID NO: 1973051 - protein, 7 aa, Staphylococcus
PKMPDTD

SEQ ID NO: 1973052 - protein, 7 aa, Staphylococcus
PKMTYSE

SEQ ID NO: 1973053 - protein, 66 aa, Staphylococcus
PKNAQGGQRHQGNNDFQDYGQGFGGSQSGQNTSYNNNNNRASNNNQSDNPFANANGPIDISDDDLP

SEQ ID NO: 1973054 - protein, 65 aa, Staphylococcus
PKNAQGGQRNQSNNNDFQDYGQGFGGQQSGQNTSYNNNNSSNNKQSDNPFANANGPIDISDDDLP

SEQ ID NO: 1973055 - protein, 64 aa, Staphylococcus
PKNAQHGGQRSQNNEFQDYGQGFGGQQSGQNTSYNNNNASKSNQNDNPFANANGPIDISDDDLP

SEQ ID NO: 1973056 - protein, 7 aa, Staphylococcus
PKNDGTF

SEQ ID NO: 1973057 - protein, 9 aa, Staphylococcus
PKNEEQEKI

SEQ ID NO: 1973058 - protein, 5 aa, Staphylococcus
PKNEI

SEQ ID NO: 1973059 - protein, 10 aa, Staphylococcus
PKNGEKGLKG

SEQ ID NO: 1973060 - protein, 13 aa, Staphylococcus
PKNGVASFNPSGH

SEQ ID NO: 1973061 - protein, 21 aa, Staphylococcus
PKNHVVPGNAETVKRNSEAYY

SEQ ID NO: 1973062 - protein, 18 aa, Staphylococcus
PKNIEEELKKQNVVFENI

SEQ ID NO: 1973063 - protein, 10 aa, Staphylococcus
PKNKGINTEH

SEQ ID NO: 1973064 - protein, 5 aa, Staphylococcus
PKNKQ

SEQ ID NO: 1973065 - protein, 26 aa, Staphylococcus
PKNNEELNNSDEQSQQTEKTFSQEEV

SEQ ID NO: 1973066 - protein, 38 aa, Staphylococcus
PKNNNQQNNQPQQQQGQAPAGNNPFGNASDDISESELP

SEQ ID NO: 1973067 - protein, 37 aa, Staphylococcus
PKNNNQQNSQPQQQRGQAQSGNNPFGNGPDISEDSLP

SEQ ID NO: 1973068 - protein, 9 aa, Staphylococcus
PKNNQISTF

SEQ ID NO: 1973069 - protein, 9 aa, Staphylococcus
PKNPATHQY

SEQ ID NO: 1973070 - protein, 12 aa, Staphylococcus
PKNPNDTELGDF

SEQ ID NO: 1973071 - protein, 18 aa, Staphylococcus
PKNQLTSHTEALINTLII

SEQ ID NO: 1973072 - protein, 9 aa, Staphylococcus
PKNSEQEKI

SEQ ID NO: 1973073 - protein, 7 aa, Staphylococcus
PKNYASQ

SEQ ID NO: 1973074 - protein, 4 aa, Staphylococcus
PKPG

SEQ ID NO: 1973075 - protein, 8 aa, Staphylococcus
PKPIHGHT

SEQ ID NO: 1973076 - protein, 5 aa, Staphylococcus
PKPIQ

SEQ ID NO: 1973077 - protein, 12 aa, Staphylococcus
PKPITFPSNEAE

SEQ ID NO: 1973078 - protein, 7 aa, Staphylococcus
PKPKVNS

SEQ ID NO: 1973079 - protein, 12 aa, Staphylococcus
PKPLDIKGAERY

SEQ ID NO: 1973080 - protein, 12 aa, Staphylococcus
PKPLEISGAERY

SEQ ID NO: 1973081 - protein, 12 aa, Staphylococcus
PKPLNIKGAERY

SEQ ID NO: 1973082 - protein, 5 aa, Staphylococcus
PKPLQ

SEQ ID NO: 1973083 - protein, 10 aa, Staphylococcus
PKPPEDNTHH

SEQ ID NO: 1973084 - protein, 6 aa, Staphylococcus
PKPQDV

SEQ ID NO: 1973085 - protein, 7 aa, Staphylococcus
PKPSTIN

SEQ ID NO: 1973086 - protein, 8 aa, Staphylococcus
PKPVHGHT

SEQ ID NO: 1973087 - protein, 16 aa, Staphylococcus
PKPVIAETTKEIEKLN

SEQ ID NO: 1973088 - protein, 4 aa, Staphylococcus
PKQA

SEQ ID NO: 1973089 - protein, 6 aa, Staphylococcus
PKQALR

SEQ ID NO: 1973090 - protein, 4 aa, Staphylococcus
PKQD

SEQ ID NO: 1973091 - protein, 4 aa, Staphylococcus
PKQE

SEQ ID NO: 1973092 - protein, 5 aa, Staphylococcus
PKQEE

SEQ ID NO: 1973093 - protein, 6 aa, Staphylococcus
PKQEEW

SEQ ID NO: 1973094 - protein, 6 aa, Staphylococcus
PKQETW

SEQ ID NO: 1973095 - protein, 5 aa, Staphylococcus
PKQGL

SEQ ID NO: 1973096 - protein, 6 aa, Staphylococcus
PKQHEI

SEQ ID NO: 1973097 - protein, 9 aa, Staphylococcus
PKQIERAGL

SEQ ID NO: 1973098 - protein, 10 aa, Staphylococcus
PKQKRTDYLT

SEQ ID NO: 1973099 - protein, 13 aa, Staphylococcus
PKQKSWSKTTGSQ

SEQ ID NO: 1973100 - protein, 19 aa, Staphylococcus
PKQLSENDALDSLTYTRDE

SEQ ID NO: 1973101 - protein, 7 aa, Staphylococcus
PKQNISS

SEQ ID NO: 1973102 - protein, 10 aa, Staphylococcus
PKQNPTSDYS

SEQ ID NO: 1973103 - protein, 9 aa, Staphylococcus
PKQNPYSDY

SEQ ID NO: 1973104 - protein, 7 aa, Staphylococcus
PKQQDIQ

SEQ ID NO: 1973105 - protein, 8 aa, Staphylococcus
PKQSKESI

SEQ ID NO: 1973106 - protein, 13 aa, Staphylococcus
PKQSYADKDEFSD

SEQ ID NO: 1973107 - protein, 13 aa, Staphylococcus
PKQSYEDKEEFSD

SEQ ID NO: 1973108 - protein, 8 aa, Staphylococcus
PKQVSEQK

SEQ ID NO: 1973109 - protein, 4 aa, Staphylococcus
PKQY

SEQ ID NO: 1973110 - protein, 7 aa, Staphylococcus
PKQYNTD

SEQ ID NO: 1973111 - protein, 7 aa, Staphylococcus
PKRDDFP

SEQ ID NO: 1973112 - protein, 7 aa, Staphylococcus
PKRFRSQ

SEQ ID NO: 1973113 - protein, 10 aa, Staphylococcus
PKRKRTTYLT

SEQ ID NO: 1973114 - protein, 4 aa, Staphylococcus
PKRS

SEQ ID NO: 1973115 - protein, 15 aa, Staphylococcus
PKRTEDSSVSSNISI

SEQ ID NO: 1973116 - protein, 8 aa, Staphylococcus
PKRTIPGV

SEQ ID NO: 1973117 - protein, 7 aa, Staphylococcus
PKRTSPY

SEQ ID NO: 1973118 - protein, 7 aa, Staphylococcus
PKRVKSR

SEQ ID NO: 1973119 - protein, 7 aa, Staphylococcus
PKRVKTR

SEQ ID NO: 1973120 - protein, 10 aa, Staphylococcus
PKSALESGAD

SEQ ID NO: 1973121 - protein, 6 aa, Staphylococcus
PKSARQ

SEQ ID NO: 1973122 - protein, 11 aa, Staphylococcus
PKSDGSEPNNW

SEQ ID NO: 1973123 - protein, 7 aa, Staphylococcus
PKSDTTI

SEQ ID NO: 1973124 - protein, 9 aa, Staphylococcus
PKSGIPTSI

SEQ ID NO: 1973125 - protein, 4 aa, Staphylococcus
PKSI

SEQ ID NO: 1973126 - protein, 6 aa, Staphylococcus
PKSIKD

SEQ ID NO: 1973127 - protein, 4 aa, Staphylococcus
PKSK

SEQ ID NO: 1973128 - protein, 6 aa, Staphylococcus
PKSKDL

SEQ ID NO: 1973129 - protein, 15 aa, Staphylococcus
PKSKEEREKLKQPRS

SEQ ID NO: 1973130 - protein, 16 aa, Staphylococcus
PKSKIDGLSDSPHQGV

SEQ ID NO: 1973131 - protein, 8 aa, Staphylococcus
PKSKKISI

SEQ ID NO: 1973132 - protein, 11 aa, Staphylococcus
PKSKTPSRIRE

SEQ ID NO: 1973133 - protein, 4 aa, Staphylococcus
PKSM

SEQ ID NO: 1973134 - protein, 10 aa, Staphylococcus
PKSNSAITAV

SEQ ID NO: 1973135 - protein, 9 aa, Staphylococcus
PKSNSGINA

SEQ ID NO: 1973136 - protein, 9 aa, Staphylococcus
PKSNSGISA

SEQ ID NO: 1973137 - protein, 8 aa, Staphylococcus
PKSQMKKP

SEQ ID NO: 1973138 - protein, 4 aa, Staphylococcus
PKSR

SEQ ID NO: 1973139 - protein, 5 aa, Staphylococcus
PKSTI

SEQ ID NO: 1973140 - protein, 7 aa, Staphylococcus
PKSTYIQ

SEQ ID NO: 1973141 - protein, 15 aa, Staphylococcus
PKSWSKKKKTTAIGQ

SEQ ID NO: 1973142 - protein, 7 aa, Staphylococcus
PKSWSNR

SEQ ID NO: 1973143 - protein, 4 aa, Staphylococcus
PKSY

SEQ ID NO: 1973144 - protein, 4 aa, Staphylococcus
PKTC

SEQ ID NO: 1973145 - protein, 4 aa, Staphylococcus
PKTE

SEQ ID NO: 1973146 - protein, 4 aa, Staphylococcus
PKTG

SEQ ID NO: 1973147 - protein, 6 aa, Staphylococcus
PKTINN

SEQ ID NO: 1973148 - protein, 7 aa, Staphylococcus
PKTKFKK

SEQ ID NO: 1973149 - protein, 8 aa, Staphylococcus
PKTKHNEI

SEQ ID NO: 1973150 - protein, 4 aa, Staphylococcus
PKTN

SEQ ID NO: 1973151 - protein, 8 aa, Staphylococcus
PKTNASIG

SEQ ID NO: 1973152 - protein, 9 aa, Staphylococcus
PKTNQWTKD

SEQ ID NO: 1973153 - protein, 9 aa, Staphylococcus
PKTPKNEDV

SEQ ID NO: 1973154 - protein, 9 aa, Staphylococcus
PKTPNNDDV

SEQ ID NO: 1973155 - protein, 8 aa, Staphylococcus
PKTPNNED

SEQ ID NO: 1973156 - protein, 8 aa, Staphylococcus
PKTPQNDD

SEQ ID NO: 1973157 - protein, 8 aa, Staphylococcus
PKTSNNYQ

SEQ ID NO: 1973158 - protein, 12 aa, Staphylococcus
PKTSRTETYEKR

SEQ ID NO: 1973159 - protein, 6 aa, Staphylococcus
PKVDED

SEQ ID NO: 1973160 - protein, 4 aa, Staphylococcus
PKVE

SEQ ID NO: 1973161 - protein, 7 aa, Staphylococcus
PKVGGTV

SEQ ID NO: 1973162 - protein, 14 aa, Staphylococcus
PKVGGTVVQTEDEI

SEQ ID NO: 1973163 - protein, 7 aa, Staphylococcus
PKVKHKP

SEQ ID NO: 1973164 - protein, 28 aa, Staphylococcus
PKVNITPAEPFERGVSNEKFKSQGGTLQ

SEQ ID NO: 1973165 - protein, 6 aa, Staphylococcus
PKVQTN

SEQ ID NO: 1973166 - protein, 5 aa, Staphylococcus
PKVRE

SEQ ID NO: 1973167 - protein, 9 aa, Staphylococcus
PKVYEKDGT

SEQ ID NO: 1973168 - protein, 29 aa, Staphylococcus
PKVYPSIETAQQRHYSERDQEKIEKNKRR

SEQ ID NO: 1973169 - protein, 12 aa, Staphylococcus
PKYAEANTLTYG

SEQ ID NO: 1973170 - protein, 7 aa, Staphylococcus
PKYDPDE

SEQ ID NO: 1973171 - protein, 7 aa, Staphylococcus
PKYDRKL

SEQ ID NO: 1973172 - protein, 8 aa, Staphylococcus
PKYDVKQA

SEQ ID NO: 1973173 - protein, 6 aa, Staphylococcus
PKYERR

SEQ ID NO: 1973174 - protein, 5 aa, Staphylococcus
PKYGA

SEQ ID NO: 1973175 - protein, 11 aa, Staphylococcus
PKYKDKNLGDV

SEQ ID NO: 1973176 - protein, 23 aa, Staphylococcus
PKYKGKDAIGQAFNSGDNVTGST

SEQ ID NO: 1973177 - protein, 23 aa, Staphylococcus
PKYKGKDAIGQALASGDTITGST

SEQ ID NO: 1973178 - protein, 11 aa, Staphylococcus
PKYPEADRGQS

SEQ ID NO: 1973179 - protein, 11 aa, Staphylococcus
PKYPEERKEQK

SEQ ID NO: 1973180 - protein, 11 aa, Staphylococcus
PKYPKEHKDQS

SEQ ID NO: 1973181 - protein, 11 aa, Staphylococcus
PKYPRTSRNQS

SEQ ID NO: 1973182 - protein, 7 aa, Staphylococcus
PKYQDFK

SEQ ID NO: 1973183 - protein, 9 aa, Staphylococcus
PKYQNKPYT

SEQ ID NO: 1973184 - protein, 7 aa, Staphylococcus
PKYSERN

SEQ ID NO: 1973185 - protein, 9 aa, Staphylococcus
PKYSETTER

SEQ ID NO: 1973186 - protein, 17 aa, Staphylococcus
PKYVSSDQVSDEEINHE

SEQ ID NO: 1973187 - protein, 17 aa, Staphylococcus
PKYVSSDQVSEDEINHE

SEQ ID NO: 1973188 - protein, 17 aa, Staphylococcus
PKYVSSDQVSEEEINHE

SEQ ID NO: 1973189 - protein, 15 aa, Staphylococcus
PKYVSSDQVSQEELA

SEQ ID NO: 1973190 - protein, 17 aa, Staphylococcus
PKYVSSEQVSEDEIAHE

SEQ ID NO: 1973191 - protein, 17 aa, Staphylococcus
PKYVSSEQVSEDEINHE

SEQ ID NO: 1973192 - protein, 4 aa, Staphylococcus
PKYY

SEQ ID NO: 1973193 - protein, 14 aa, Staphylococcus
PKYYPDDQISDHPE

SEQ ID NO: 1973194 - protein, 4 aa, Staphylococcus
PLAE

SEQ ID NO: 1973195 - protein, 15 aa, Staphylococcus
PLAGTTNRQAEALTD

SEQ ID NO: 1973196 - protein, 15 aa, Staphylococcus
PLAGTTNRQAESLRD

SEQ ID NO: 1973197 - protein, 14 aa, Staphylococcus
PLAKTTNKQAEAIK

SEQ ID NO: 1973198 - protein, 9 aa, Staphylococcus
PLASEDNKY

SEQ ID NO: 1973199 - protein, 8 aa, Staphylococcus
PLASGNDY

SEQ ID NO: 1973200 - protein, 13 aa, Staphylococcus
PLASTSRALDPTI

SEQ ID NO: 1973201 - protein, 10 aa, Staphylococcus
PLASTSRALE

SEQ ID NO: 1973202 - protein, 11 aa, Staphylococcus
PLATTKNLQQV

SEQ ID NO: 1973203 - protein, 5 aa, Staphylococcus
PLDDE

SEQ ID NO: 1973204 - protein, 7 aa, Staphylococcus
PLDDSFS

SEQ ID NO: 1973205 - protein, 9 aa, Staphylococcus
PLDEDTTHH

SEQ ID NO: 1973206 - protein, 5 aa, Staphylococcus
PLDNE

SEQ ID NO: 1973207 - protein, 8 aa, Staphylococcus
PLDNHDEP

SEQ ID NO: 1973208 - protein, 12 aa, Staphylococcus
PLDPTKSPSVNA

SEQ ID NO: 1973209 - protein, 7 aa, Staphylococcus
PLDSPGG

SEQ ID NO: 1973210 - protein, 4 aa, Staphylococcus
PLED

SEQ ID NO: 1973211 - protein, 10 aa, Staphylococcus
PLEEAEETID

SEQ ID NO: 1973212 - protein, 7 aa, Staphylococcus
PLEEDGE

SEQ ID NO: 1973213 - protein, 16 aa, Staphylococcus
PLESLEGRNTRPTMDK

SEQ ID NO: 1973214 - protein, 12 aa, Staphylococcus
PLFSTQSHNSAL

SEQ ID NO: 1973215 - protein, 9 aa, Staphylococcus
PLGKGAEKR

SEQ ID NO: 1973216 - protein, 18 aa, Staphylococcus
PLGPAYQAGTMAGNPLSM

SEQ ID NO: 1973217 - protein, 10 aa, Staphylococcus
PLGPHERQEH

SEQ ID NO: 1973218 - protein, 11 aa, Staphylococcus
PLGRASEVIKD

SEQ ID NO: 1973219 - protein, 10 aa, Staphylococcus
PLGSGESYGF

SEQ ID NO: 1973220 - protein, 10 aa, Staphylococcus
PLGSHERQEH

SEQ ID NO: 1973221 - protein, 4 aa, Staphylococcus
PLIT

SEQ ID NO: 1973222 - protein, 5 aa, Staphylococcus
PLITS

SEQ ID NO: 1973223 - protein, 20 aa, Staphylococcus
PLKDEQDKIESLLNEAISKL

SEQ ID NO: 1973224 - protein, 5 aa, Staphylococcus
PLKEK

SEQ ID NO: 1973225 - protein, 4 aa, Staphylococcus
PLKG

SEQ ID NO: 1973226 - protein, 15 aa, Staphylococcus
PLKGEIEVPGDKSMT

SEQ ID NO: 1973227 - protein, 5 aa, Staphylococcus
PLKGH

SEQ ID NO: 1973228 - protein, 8 aa, Staphylococcus
PLKKAEED

SEQ ID NO: 1973229 - protein, 8 aa, Staphylococcus
PLKLNNEH

SEQ ID NO: 1973230 - protein, 4 aa, Staphylococcus
PLKN

SEQ ID NO: 1973231 - protein, 6 aa, Staphylococcus
PLKNRK

SEQ ID NO: 1973232 - protein, 5 aa, Staphylococcus
PLKPI

SEQ ID NO: 1973233 - protein, 9 aa, Staphylococcus
PLKSGDEKF

SEQ ID NO: 1973234 - protein, 9 aa, Staphylococcus
PLKSGDEQF

SEQ ID NO: 1973235 - protein, 7 aa, Staphylococcus
PLKSKSH

SEQ ID NO: 1973236 - protein, 8 aa, Staphylococcus
PLKSQNTF

SEQ ID NO: 1973237 - protein, 16 aa, Staphylococcus
PLKSYHEHNKDQQTSY

SEQ ID NO: 1973238 - protein, 9 aa, Staphylococcus
PLMNPDEIT

SEQ ID NO: 1973239 - protein, 8 aa, Staphylococcus
PLMNPDEV

SEQ ID NO: 1973240 - protein, 6 aa, Staphylococcus
PLNKGE

SEQ ID NO: 1973241 - protein, 6 aa, Staphylococcus
PLNKQS

SEQ ID NO: 1973242 - protein, 10 aa, Staphylococcus
PLNPAERASG

SEQ ID NO: 1973243 - protein, 14 aa, Staphylococcus
PLNPTKAPAVNAQN

SEQ ID NO: 1973244 - protein, 13 aa, Staphylococcus
PLNPTKSPSVNAQ

SEQ ID NO: 1973245 - protein, 6 aa, Staphylococcus
PLNQQQ

SEQ ID NO: 1973246 - protein, 12 aa, Staphylococcus
PLNYNNKTSSYL

SEQ ID NO: 1973247 - protein, 5 aa, Staphylococcus
PLPDN

SEQ ID NO: 1973248 - protein, 14 aa, Staphylococcus
PLPKKAGRNNQGKL

SEQ ID NO: 1973249 - protein, 5 aa, Staphylococcus
PLPLD

SEQ ID NO: 1973250 - protein, 6 aa, Staphylococcus
PLPNGA

SEQ ID NO: 1973251 - protein, 15 aa, Staphylococcus
PLPNGGEMKVKIVDI

SEQ ID NO: 1973252 - protein, 9 aa, Staphylococcus
PLPTENQEE

SEQ ID NO: 1973253 - protein, 5 aa, Staphylococcus
PLPTH

SEQ ID NO: 1973254 - protein, 8 aa, Staphylococcus
PLPTTPNN

SEQ ID NO: 1973255 - protein, 7 aa, Staphylococcus
PLQAPEN

SEQ ID NO: 1973256 - protein, 7 aa, Staphylococcus
PLQGHPN

SEQ ID NO: 1973257 - protein, 5 aa, Staphylococcus
PLQNG

SEQ ID NO: 1973258 - protein, 27 aa, Staphylococcus
PLQNVATKAELKQENAAGNFQKLFDKV

SEQ ID NO: 1973259 - protein, 13 aa, Staphylococcus
PLQPKTSNPVFSS

SEQ ID NO: 1973260 - protein, 13 aa, Staphylococcus
PLQSEDKNAPGYV

SEQ ID NO: 1973261 - protein, 13 aa, Staphylococcus
PLQSEDKSAPGYV

SEQ ID NO: 1973262 - protein, 14 aa, Staphylococcus
PLQSEDPKKPGYVP

SEQ ID NO: 1973263 - protein, 9 aa, Staphylococcus
PLRSGDEQY

SEQ ID NO: 1973264 - protein, 5 aa, Staphylococcus
PLSDA

SEQ ID NO: 1973265 - protein, 5 aa, Staphylococcus
PLSDE

SEQ ID NO: 1973266 - protein, 11 aa, Staphylococcus
PLSDEDKQTLK

SEQ ID NO: 1973267 - protein, 11 aa, Staphylococcus
PLSEEDKETLR

SEQ ID NO: 1973268 - protein, 7 aa, Staphylococcus
PLSEGAD

SEQ ID NO: 1973269 - protein, 20 aa, Staphylococcus
PLSETKAAMERARTDKSGSL

SEQ ID NO: 1973270 - protein, 12 aa, Staphylococcus
PLSITSSGQTRE

SEQ ID NO: 1973271 - protein, 15 aa, Staphylococcus
PLSLGGSQGRNRATA

SEQ ID NO: 1973272 - protein, 5 aa, Staphylococcus
PLSPE

SEQ ID NO: 1973273 - protein, 14 aa, Staphylococcus
PLSPEDSSLGHGQM

SEQ ID NO: 1973274 - protein, 7 aa, Staphylococcus
PLSPQKT

SEQ ID NO: 1973275 - protein, 16 aa, Staphylococcus
PLSQVQTKNQLRETQA

SEQ ID NO: 1973276 - protein, 71 aa, Staphylococcus
PLSRKGRNSKGNNNSRRGNNKRGGGKFDNKNRRSSKGFASKKNNNKKFDRKDKSSQGSNKTMKGRTFADHQ

SEQ ID NO: 1973277 - protein, 5 aa, Staphylococcus
PLSSE

SEQ ID NO: 1973278 - protein, 11 aa, Staphylococcus
PLSTLSGGEMQ

SEQ ID NO: 1973279 - protein, 8 aa, Staphylococcus
PLTEDDEK

SEQ ID NO: 1973280 - protein, 9 aa, Staphylococcus
PLTEKTKGM

SEQ ID NO: 1973281 - protein, 7 aa, Staphylococcus
PLTENGK

SEQ ID NO: 1973282 - protein, 8 aa, Staphylococcus
PLTGEDEA

SEQ ID NO: 1973283 - protein, 7 aa, Staphylococcus
PLTNDEL

SEQ ID NO: 1973284 - protein, 5 aa, Staphylococcus
PLTNQ

SEQ ID NO: 1973285 - protein, 4 aa, Staphylococcus
PLTP

SEQ ID NO: 1973286 - protein, 12 aa, Staphylococcus
PLTPDTKGKFDA

SEQ ID NO: 1973287 - protein, 7 aa, Staphylococcus
PLTPETD

SEQ ID NO: 1973288 - protein, 11 aa, Staphylococcus
PLTPKERNAGL

SEQ ID NO: 1973289 - protein, 8 aa, Staphylococcus
PLTPKTKG

SEQ ID NO: 1973290 - protein, 9 aa, Staphylococcus
PLTPKTKGI

SEQ ID NO: 1973291 - protein, 10 aa, Staphylococcus
PLTPKTKGIV

SEQ ID NO: 1973292 - protein, 8 aa, Staphylococcus
PLTPKTRG

SEQ ID NO: 1973293 - protein, 9 aa, Staphylococcus
PLTPKTRGI

SEQ ID NO: 1973294 - protein, 8 aa, Staphylococcus
PLTPNTEK

SEQ ID NO: 1973295 - protein, 5 aa, Staphylococcus
PLTQK

SEQ ID NO: 1973296 - protein, 17 aa, Staphylococcus
PLTSNDKVDESKLPNPE

SEQ ID NO: 1973297 - protein, 7 aa, Staphylococcus
PLTTEDE

SEQ ID NO: 1973298 - protein, 9 aa, Staphylococcus
PLTTPIGGG

SEQ ID NO: 1973299 - protein, 13 aa, Staphylococcus
PLTTPSSIQGKPV

SEQ ID NO: 1973300 - protein, 11 aa, Staphylococcus
PLTTTDSVKET

SEQ ID NO: 1973301 - protein, 10 aa, Staphylococcus
PLVDEPDASF

SEQ ID NO: 1973302 - protein, 8 aa, Staphylococcus
PLVPSTGQ

SEQ ID NO: 1973303 - protein, 4 aa, Staphylococcus
PLYD

SEQ ID NO: 1973304 - protein, 5 aa, Staphylococcus
PLYGD

SEQ ID NO: 1973305 - protein, 7 aa, Staphylococcus
PLYGDST

SEQ ID NO: 1973306 - protein, 4 aa, Staphylococcus
PLYQ

SEQ ID NO: 1973307 - protein, 10 aa, Staphylococcus
PLYQGTNDNM

SEQ ID NO: 1973308 - protein, 19 aa, Staphylococcus
PMAASNTTNTLKDGTKKRI

SEQ ID NO: 1973309 - protein, 9 aa, Staphylococcus
PMAKGAEKR

SEQ ID NO: 1973310 - protein, 4 aa, Staphylococcus
PMDE

SEQ ID NO: 1973311 - protein, 10 aa, Staphylococcus
PMDGIGPEDI

SEQ ID NO: 1973312 - protein, 6 aa, Staphylococcus
PMDSEE

SEQ ID NO: 1973313 - protein, 7 aa, Staphylococcus
PMDSPGG

SEQ ID NO: 1973314 - protein, 5 aa, Staphylococcus
PMEDK

SEQ ID NO: 1973315 - protein, 5 aa, Staphylococcus
PMEGR

SEQ ID NO: 1973316 - protein, 12 aa, Staphylococcus
PMFENPKSEYGA

SEQ ID NO: 1973317 - protein, 11 aa, Staphylococcus
PMGRPGEPEEL

SEQ ID NO: 1973318 - protein, 11 aa, Staphylococcus
PMGRPGEPHEL

SEQ ID NO: 1973319 - protein, 18 aa, Staphylococcus
PMKGTMPRSDVKQQDQYN

SEQ ID NO: 1973320 - protein, 15 aa, Staphylococcus
PMKGTMPRSINKDED

SEQ ID NO: 1973321 - protein, 5 aa, Staphylococcus
PMNDK

SEQ ID NO: 1973322 - protein, 15 aa, Staphylococcus
PMNGADEAQKQTTRS

SEQ ID NO: 1973323 - protein, 15 aa, Staphylococcus
PMNGDDEAQKQTTRS

SEQ ID NO: 1973324 - protein, 13 aa, Staphylococcus
PMNGEDEAQKQIT

SEQ ID NO: 1973325 - protein, 14 aa, Staphylococcus
PMNGEDEAQKQVTR

SEQ ID NO: 1973326 - protein, 15 aa, Staphylococcus
PMNGEDEDQKQTTRS

SEQ ID NO: 1973327 - protein, 12 aa, Staphylococcus
PMNTGAEAVETA

SEQ ID NO: 1973328 - protein, 18 aa, Staphylococcus
PMPNARQTKEDVEVSPFD

SEQ ID NO: 1973329 - protein, 18 aa, Staphylococcus
PMPNARQTNEDVEVSPFD

SEQ ID NO: 1973330 - protein, 18 aa, Staphylococcus
PMPNARQTNEEVEVSPFD

SEQ ID NO: 1973331 - protein, 4 aa, Staphylococcus
PMQN

SEQ ID NO: 1973332 - protein, 4 aa, Staphylococcus
PMRG

SEQ ID NO: 1973333 - protein, 16 aa, Staphylococcus
PMRGGLPKKEPEIQKQ

SEQ ID NO: 1973334 - protein, 16 aa, Staphylococcus
PMRGGLPKKEPQIQEK

SEQ ID NO: 1973335 - protein, 17 aa, Staphylococcus
PMRGGLPNKEPKIQEEW

SEQ ID NO: 1973336 - protein, 6 aa, Staphylococcus
PMSEEG

SEQ ID NO: 1973337 - protein, 8 aa, Staphylococcus
PMSSSDLS

SEQ ID NO: 1973338 - protein, 8 aa, Staphylococcus
PMTGEDEA

SEQ ID NO: 1973339 - protein, 8 aa, Staphylococcus
PMTGEDEP

SEQ ID NO: 1973340 - protein, 9 aa, Staphylococcus
PMTGEDEPV

SEQ ID NO: 1973341 - protein, 5 aa, Staphylococcus
PMTPP

SEQ ID NO: 1973342 - protein, 9 aa, Staphylococcus
PMVPTTGKY

SEQ ID NO: 1973343 - protein, 4 aa, Staphylococcus
PMYT

SEQ ID NO: 1973344 - protein, 7 aa, Staphylococcus
PNADKRF

SEQ ID NO: 1973345 - protein, 13 aa, Staphylococcus
PNAEETHVTSPEG

SEQ ID NO: 1973346 - protein, 11 aa, Staphylococcus
PNAEGESEEKI

SEQ ID NO: 1973347 - protein, 15 aa, Staphylococcus
PNAELNKMSEKDPKL

SEQ ID NO: 1973348 - protein, 7 aa, Staphylococcus
PNAHTQS

SEQ ID NO: 1973349 - protein, 13 aa, Staphylococcus
PNAKEEHITSPEG

SEQ ID NO: 1973350 - protein, 8 aa, Staphylococcus
PNAKSEDW

SEQ ID NO: 1973351 - protein, 6 aa, Staphylococcus
PNANID

SEQ ID NO: 1973352 - protein, 6 aa, Staphylococcus
PNAPDK

SEQ ID NO: 1973353 - protein, 10 aa, Staphylococcus
PNARGKGVGQ

SEQ ID NO: 1973354 - protein, 5 aa, Staphylococcus
PNATA

SEQ ID NO: 1973355 - protein, 4 aa, Staphylococcus
PNAV

SEQ ID NO: 1973356 - protein, 12 aa, Staphylococcus
PNCGNSDPKTVD

SEQ ID NO: 1973357 - protein, 4 aa, Staphylococcus
PNDC

SEQ ID NO: 1973358 - protein, 10 aa, Staphylococcus
PNDDEGRTTT

SEQ ID NO: 1973359 - protein, 10 aa, Staphylococcus
PNDEEERTTT

SEQ ID NO: 1973360 - protein, 15 aa, Staphylococcus
PNDEEINEITSTDNL

SEQ ID NO: 1973361 - protein, 5 aa, Staphylococcus
PNDEK

SEQ ID NO: 1973362 - protein, 5 aa, Staphylococcus
PNDEM

SEQ ID NO: 1973363 - protein, 6 aa, Staphylococcus
PNDFGT

SEQ ID NO: 1973364 - protein, 23 aa, Staphylococcus
PNDGGLAQIGPTSRVTGRMDGMN

SEQ ID NO: 1973365 - protein, 24 aa, Staphylococcus
PNDGGLAQIGPTSRVTGRMDGMNE

SEQ ID NO: 1973366 - protein, 26 aa, Staphylococcus
PNDGGYAQIGPTSRVTGRMDGLNGEG

SEQ ID NO: 1973367 - protein, 11 aa, Staphylococcus
PNDGQINANKY

SEQ ID NO: 1973368 - protein, 5 aa, Staphylococcus
PNDNR

SEQ ID NO: 1973369 - protein, 7 aa, Staphylococcus
PNDQEDL

SEQ ID NO: 1973370 - protein, 19 aa, Staphylococcus
PNDSGLDQIGPTSRVTGRM

SEQ ID NO: 1973371 - protein, 4 aa, Staphylococcus
PNDV

SEQ ID NO: 1973372 - protein, 9 aa, Staphylococcus
PNDYPDTGV

SEQ ID NO: 1973373 - protein, 4 aa, Staphylococcus
PNEA

SEQ ID NO: 1973374 - protein, 5 aa, Staphylococcus
PNEAS

SEQ ID NO: 1973375 - protein, 5 aa, Staphylococcus
PNEDA

SEQ ID NO: 1973376 - protein, 6 aa, Staphylococcus
PNEDKL

SEQ ID NO: 1973377 - protein, 7 aa, Staphylococcus
PNEDMHK

SEQ ID NO: 1973378 - protein, 7 aa, Staphylococcus
PNEDSPC

SEQ ID NO: 1973379 - protein, 5 aa, Staphylococcus
PNEEA

SEQ ID NO: 1973380 - protein, 8 aa, Staphylococcus
PNEEELKE

SEQ ID NO: 1973381 - protein, 7 aa, Staphylococcus
PNEEEVE

SEQ ID NO: 1973382 - protein, 7 aa, Staphylococcus
PNEETIE

SEQ ID NO: 1973383 - protein, 6 aa, Staphylococcus
PNEGEY

SEQ ID NO: 1973384 - protein, 7 aa, Staphylococcus
PNEIPNY

SEQ ID NO: 1973385 - protein, 9 aa, Staphylococcus
PNEKHTEVA

SEQ ID NO: 1973386 - protein, 5 aa, Staphylococcus
PNEKQ

SEQ ID NO: 1973387 - protein, 4 aa, Staphylococcus
PNEL

SEQ ID NO: 1973388 - protein, 9 aa, Staphylococcus
PNENEAQAY

SEQ ID NO: 1973389 - protein, 7 aa, Staphylococcus
PNENNEA

SEQ ID NO: 1973390 - protein, 6 aa, Staphylococcus
PNEPIE

SEQ ID NO: 1973391 - protein, 10 aa, Staphylococcus
PNEPKPNIEA

SEQ ID NO: 1973392 - protein, 8 aa, Staphylococcus
PNEPNVDD

SEQ ID NO: 1973393 - protein, 6 aa, Staphylococcus
PNEQGQ

SEQ ID NO: 1973394 - protein, 13 aa, Staphylococcus
PNERNVTDRQKAY

SEQ ID NO: 1973395 - protein, 13 aa, Staphylococcus
PNERNVTDRQREY

SEQ ID NO: 1973396 - protein, 7 aa, Staphylococcus
PNESQDL

SEQ ID NO: 1973397 - protein, 9 aa, Staphylococcus
PNETEEQFQ

SEQ ID NO: 1973398 - protein, 5 aa, Staphylococcus
PNETG

SEQ ID NO: 1973399 - protein, 6 aa, Staphylococcus
PNETIG

SEQ ID NO: 1973400 - protein, 5 aa, Staphylococcus
PNEVG

SEQ ID NO: 1973401 - protein, 4 aa, Staphylococcus
PNFE

SEQ ID NO: 1973402 - protein, 26 aa, Staphylococcus
PNFGNNDDEEEETPTEEIKTKRSEIK

SEQ ID NO: 1973403 - protein, 26 aa, Staphylococcus
PNFGNNQEDEEEPPTEEIKTKRSEIR

SEQ ID NO: 1973404 - protein, 4 aa, Staphylococcus
PNFK

SEQ ID NO: 1973405 - protein, 12 aa, Staphylococcus
PNFKFPKDGDTP

SEQ ID NO: 1973406 - protein, 25 aa, Staphylococcus
PNFNQNDEEEEAPTEEIKTKRSEIR

SEQ ID NO: 1973407 - protein, 10 aa, Staphylococcus
PNFRTSSEAE

SEQ ID NO: 1973408 - protein, 4 aa, Staphylococcus
PNFS

SEQ ID NO: 1973409 - protein, 5 aa, Staphylococcus
PNFSE

SEQ ID NO: 1973410 - protein, 7 aa, Staphylococcus
PNFSEKE

SEQ ID NO: 1973411 - protein, 16 aa, Staphylococcus
PNFSSVKSANPEEREA

SEQ ID NO: 1973412 - protein, 6 aa, Staphylococcus
PNFTTK

SEQ ID NO: 1973413 - protein, 5 aa, Staphylococcus
PNGAL

SEQ ID NO: 1973414 - protein, 16 aa, Staphylococcus
PNGDADNLNDETKRYE

SEQ ID NO: 1973415 - protein, 16 aa, Staphylococcus
PNGELKRSYINNKLKV

SEQ ID NO: 1973416 - protein, 5 aa, Staphylococcus
PNGES

SEQ ID NO: 1973417 - protein, 7 aa, Staphylococcus
PNGESYD

SEQ ID NO: 1973418 - protein, 5 aa, Staphylococcus
PNGET

SEQ ID NO: 1973419 - protein, 10 aa, Staphylococcus
PNGETSKREI

SEQ ID NO: 1973420 - protein, 10 aa, Staphylococcus
PNGGAQYNAV

SEQ ID NO: 1973421 - protein, 5 aa, Staphylococcus
PNGGK

SEQ ID NO: 1973422 - protein, 4 aa, Staphylococcus
PNGI

SEQ ID NO: 1973423 - protein, 7 aa, Staphylococcus
PNGIQKL

SEQ ID NO: 1973424 - protein, 10 aa, Staphylococcus
PNGNPIAGDY

SEQ ID NO: 1973425 - protein, 12 aa, Staphylococcus
PNGNPISKDYQE

SEQ ID NO: 1973426 - protein, 7 aa, Staphylococcus
PNGQYEK

SEQ ID NO: 1973427 - protein, 7 aa, Staphylococcus
PNHATTS

SEQ ID NO: 1973428 - protein, 8 aa, Staphylococcus
PNHETTSD

SEQ ID NO: 1973429 - protein, 4 aa, Staphylococcus
PNHK

SEQ ID NO: 1973430 - protein, 4 aa, Staphylococcus
PNHN

SEQ ID NO: 1973431 - protein, 13 aa, Staphylococcus
PNHSEETLTSPEG

SEQ ID NO: 1973432 - protein, 4 aa, Staphylococcus
PNIE

SEQ ID NO: 1973433 - protein, 6 aa, Staphylococcus
PNIGRD

SEQ ID NO: 1973434 - protein, 4 aa, Staphylococcus
PNII

SEQ ID NO: 1973435 - protein, 13 aa, Staphylococcus
PNIQTVNDKDVEI

SEQ ID NO: 1973436 - protein, 6 aa, Staphylococcus
PNIRSK

SEQ ID NO: 1973437 - protein, 5 aa, Staphylococcus
PNISA

SEQ ID NO: 1973438 - protein, 16 aa, Staphylococcus
PNISTTIGRKNGYNKA

SEQ ID NO: 1973439 - protein, 4 aa, Staphylococcus
PNIT

SEQ ID NO: 1973440 - protein, 7 aa, Staphylococcus
PNKAEDL

SEQ ID NO: 1973441 - protein, 4 aa, Staphylococcus
PNKD

SEQ ID NO: 1973442 - protein, 9 aa, Staphylococcus
PNKEELKEL

SEQ ID NO: 1973443 - protein, 9 aa, Staphylococcus
PNKEELQEL

SEQ ID NO: 1973444 - protein, 7 aa, Staphylococcus
PNKEGRF

SEQ ID NO: 1973445 - protein, 6 aa, Staphylococcus
PNKGIG

SEQ ID NO: 1973446 - protein, 4 aa, Staphylococcus
PNKH

SEQ ID NO: 1973447 - protein, 7 aa, Staphylococcus
PNKHTTT

SEQ ID NO: 1973448 - protein, 8 aa, Staphylococcus
PNKHVPKT

SEQ ID NO: 1973449 - protein, 4 aa, Staphylococcus
PNKL

SEQ ID NO: 1973450 - protein, 11 aa, Staphylococcus
PNKLKEDKGKI

SEQ ID NO: 1973451 - protein, 17 aa, Staphylococcus
PNKLKGAPKSVKGDRRG

SEQ ID NO: 1973452 - protein, 17 aa, Staphylococcus
PNKLKGAPRSVRGDRRG

SEQ ID NO: 1973453 - protein, 11 aa, Staphylococcus
PNKLSGGQQQR

SEQ ID NO: 1973454 - protein, 10 aa, Staphylococcus
PNKLTDRQKE

SEQ ID NO: 1973455 - protein, 7 aa, Staphylococcus
PNKNKVD

SEQ ID NO: 1973456 - protein, 68 aa, Staphylococcus
PNKPNEPGKPSEPGKPNEPNKPSEPSKPSEPNNQMSQASQASQPSQVSQTNRANQVSQANRTNQFILE

SEQ ID NO: 1973457 - protein, 20 aa, Staphylococcus
PNKPSAYTKTNKIIHKTKKK

SEQ ID NO: 1973458 - protein, 6 aa, Staphylococcus
PNKRGY

SEQ ID NO: 1973459 - protein, 6 aa, Staphylococcus
PNKTDF

SEQ ID NO: 1973460 - protein, 7 aa, Staphylococcus
PNKTLTP

SEQ ID NO: 1973461 - protein, 8 aa, Staphylococcus
PNKTNMNS

SEQ ID NO: 1973462 - protein, 19 aa, Staphylococcus
PNKTVENDGIEKKETAYTG

SEQ ID NO: 1973463 - protein, 5 aa, Staphylococcus
PNKVF

SEQ ID NO: 1973464 - protein, 5 aa, Staphylococcus
PNLAQ

SEQ ID NO: 1973465 - protein, 6 aa, Staphylococcus
PNLEAG

SEQ ID NO: 1973466 - protein, 13 aa, Staphylococcus
PNLEGKTAEEDWE

SEQ ID NO: 1973467 - protein, 11 aa, Staphylococcus
PNLEKKYEEDA

SEQ ID NO: 1973468 - protein, 12 aa, Staphylococcus
PNLGVPSEQDIN

SEQ ID NO: 1973469 - protein, 10 aa, Staphylococcus
PNLPKSLKES

SEQ ID NO: 1973470 - protein, 8 aa, Staphylococcus
PNLSQDND

SEQ ID NO: 1973471 - protein, 6 aa, Staphylococcus
PNMNEK

SEQ ID NO: 1973472 - protein, 6 aa, Staphylococcus
PNNDIG

SEQ ID NO: 1973473 - protein, 7 aa, Staphylococcus
PNNESQL

SEQ ID NO: 1973474 - protein, 5 aa, Staphylococcus
PNNHV

SEQ ID NO: 1973475 - protein, 5 aa, Staphylococcus
PNNKE

SEQ ID NO: 1973476 - protein, 23 aa, Staphylococcus
PNNNIIPGNATKVKKGSKEYYEA

SEQ ID NO: 1973477 - protein, 6 aa, Staphylococcus
PNNPDK

SEQ ID NO: 1973478 - protein, 13 aa, Staphylococcus
PNNPLQPHNDAVE

SEQ ID NO: 1973479 - protein, 6 aa, Staphylococcus
PNNPNI

SEQ ID NO: 1973480 - protein, 8 aa, Staphylococcus
PNNPTGRY

SEQ ID NO: 1973481 - protein, 13 aa, Staphylococcus
PNNPTGSTATKEV

SEQ ID NO: 1973482 - protein, 13 aa, Staphylococcus
PNNPTGSTATKSV

SEQ ID NO: 1973483 - protein, 13 aa, Staphylococcus
PNNPTGSTATQSV

SEQ ID NO: 1973484 - protein, 11 aa, Staphylococcus
PNNPTGSTVTQ

SEQ ID NO: 1973485 - protein, 10 aa, Staphylococcus
PNNPTGSVAT

SEQ ID NO: 1973486 - protein, 9 aa, Staphylococcus
PNNPTGTYV

SEQ ID NO: 1973487 - protein, 15 aa, Staphylococcus
PNNPTGYTPKAEEVK

SEQ ID NO: 1973488 - protein, 15 aa, Staphylococcus
PNNPTGYTPNNDEVT

SEQ ID NO: 1973489 - protein, 15 aa, Staphylococcus
PNNPTGYTPNNEEVQ

SEQ ID NO: 1973490 - protein, 18 aa, Staphylococcus
PNNPTGYTPTASEVEEIS

SEQ ID NO: 1973491 - protein, 15 aa, Staphylococcus
PNNPTGYTPTKDEVK

SEQ ID NO: 1973492 - protein, 15 aa, Staphylococcus
PNNPTGYTPTKEEVR

SEQ ID NO: 1973493 - protein, 15 aa, Staphylococcus
PNNPTGYTPTKQEVK

SEQ ID NO: 1973494 - protein, 7 aa, Staphylococcus
PNNRYGL

SEQ ID NO: 1973495 - protein, 9 aa, Staphylococcus
PNNTEPPIE

SEQ ID NO: 1973496 - protein, 11 aa, Staphylococcus
PNNTPGNSASD

SEQ ID NO: 1973497 - protein, 7 aa, Staphylococcus
PNNYELE

SEQ ID NO: 1973498 - protein, 9 aa, Staphylococcus
PNPDSPCKS

SEQ ID NO: 1973499 - protein, 28 aa, Staphylococcus
PNPEIKPDDAKEAGAKVIGTGRSDFPNQ

SEQ ID NO: 1973500 - protein, 29 aa, Staphylococcus
PNPEINPNDAKDAGAKVVGTGRSDYPNQI

SEQ ID NO: 1973501 - protein, 28 aa, Staphylococcus
PNPEITPDDAKAAGAKVVGTGRSDFPNQ

SEQ ID NO: 1973502 - protein, 21 aa, Staphylococcus
PNPEKKTSSYSADGSSGNNTK

SEQ ID NO: 1973503 - protein, 8 aa, Staphylococcus
PNPENEDT

SEQ ID NO: 1973504 - protein, 8 aa, Staphylococcus
PNPEYENQ

SEQ ID NO: 1973505 - protein, 6 aa, Staphylococcus
PNPNYR

SEQ ID NO: 1973506 - protein, 6 aa, Staphylococcus
PNPSIV

SEQ ID NO: 1973507 - protein, 8 aa, Staphylococcus
PNPSRQPL

SEQ ID NO: 1973508 - protein, 6 aa, Staphylococcus
PNPTRN

SEQ ID NO: 1973509 - protein, 4 aa, Staphylococcus
PNPV

SEQ ID NO: 1973510 - protein, 5 aa, Staphylococcus
PNPVP

SEQ ID NO: 1973511 - protein, 15 aa, Staphylococcus
PNPYQPRKTFDEDKL

SEQ ID NO: 1973512 - protein, 7 aa, Staphylococcus
PNPYQSD

SEQ ID NO: 1973513 - protein, 8 aa, Staphylococcus
PNPYQSDV

SEQ ID NO: 1973514 - protein, 7 aa, Staphylococcus
PNQAPRI

SEQ ID NO: 1973515 - protein, 8 aa, Staphylococcus
PNQDPTKV

SEQ ID NO: 1973516 - protein, 7 aa, Staphylococcus
PNQDYNR

SEQ ID NO: 1973517 - protein, 4 aa, Staphylococcus
PNQH

SEQ ID NO: 1973518 - protein, 8 aa, Staphylococcus
PNQNATTV

SEQ ID NO: 1973519 - protein, 11 aa, Staphylococcus
PNQPGAVPRTS

SEQ ID NO: 1973520 - protein, 8 aa, Staphylococcus
PNQPTYEG

SEQ ID NO: 1973521 - protein, 6 aa, Staphylococcus
PNQQYT

SEQ ID NO: 1973522 - protein, 7 aa, Staphylococcus
PNQSKDL

SEQ ID NO: 1973523 - protein, 11 aa, Staphylococcus
PNQTVSANNQS

SEQ ID NO: 1973524 - protein, 12 aa, Staphylococcus
PNRDPRDEYETP

SEQ ID NO: 1973525 - protein, 6 aa, Staphylococcus
PNRIAK

SEQ ID NO: 1973526 - protein, 14 aa, Staphylococcus
PNRKKIESKGIKSV

SEQ ID NO: 1973527 - protein, 14 aa, Staphylococcus
PNRQNCAPSCEHPH

SEQ ID NO: 1973528 - protein, 7 aa, Staphylococcus
PNRRELK

SEQ ID NO: 1973529 - protein, 15 aa, Staphylococcus
PNRTDEALKDYAEET

SEQ ID NO: 1973530 - protein, 21 aa, Staphylococcus
PNRTELEKEAQKISQAAEIEG

SEQ ID NO: 1973531 - protein, 5 aa, Staphylococcus
PNRVK

SEQ ID NO: 1973532 - protein, 7 aa, Staphylococcus
PNRYSSE

SEQ ID NO: 1973533 - protein, 7 aa, Staphylococcus
PNRYSSK

SEQ ID NO: 1973534 - protein, 7 aa, Staphylococcus
PNRYSTD

SEQ ID NO: 1973535 - protein, 7 aa, Staphylococcus
PNRYSTE

SEQ ID NO: 1973536 - protein, 7 aa, Staphylococcus
PNRYSTN

SEQ ID NO: 1973537 - protein, 10 aa, Staphylococcus
PNSAKDEHGR

SEQ ID NO: 1973538 - protein, 19 aa, Staphylococcus
PNSEATLTAINTPTSSHYF

SEQ ID NO: 1973539 - protein, 9 aa, Staphylococcus
PNSEEKGTV

SEQ ID NO: 1973540 - protein, 12 aa, Staphylococcus
PNSEQPNNLSSN

SEQ ID NO: 1973541 - protein, 9 aa, Staphylococcus
PNSGSASLN

SEQ ID NO: 1973542 - protein, 7 aa, Staphylococcus
PNSKDEL

SEQ ID NO: 1973543 - protein, 7 aa, Staphylococcus
PNSKEEL

SEQ ID NO: 1973544 - protein, 14 aa, Staphylococcus
PNSKHEIAPQRGDD

SEQ ID NO: 1973545 - protein, 14 aa, Staphylococcus
PNSKNEKAPKRGDD

SEQ ID NO: 1973546 - protein, 10 aa, Staphylococcus
PNSKTSKSVV

SEQ ID NO: 1973547 - protein, 7 aa, Staphylococcus
PNSLREN

SEQ ID NO: 1973548 - protein, 12 aa, Staphylococcus
PNSNNEKATVAE

SEQ ID NO: 1973549 - protein, 12 aa, Staphylococcus
PNSPEKQEDHYN

SEQ ID NO: 1973550 - protein, 13 aa, Staphylococcus
PNSPEKRADHYDK

SEQ ID NO: 1973551 - protein, 7 aa, Staphylococcus
PNSPHKW

SEQ ID NO: 1973552 - protein, 4 aa, Staphylococcus
PNSQ

SEQ ID NO: 1973553 - protein, 6 aa, Staphylococcus
PNSSCP

SEQ ID NO: 1973554 - protein, 7 aa, Staphylococcus
PNSSIER

SEQ ID NO: 1973555 - protein, 14 aa, Staphylococcus
PNSSLSAASGYAEE

SEQ ID NO: 1973556 - protein, 16 aa, Staphylococcus
PNSSLSAASGYAEESH

SEQ ID NO: 1973557 - protein, 18 aa, Staphylococcus
PNSSLSAASGYAEESQLP

SEQ ID NO: 1973558 - protein, 17 aa, Staphylococcus
PNSSLSAASGYAEESRL

SEQ ID NO: 1973559 - protein, 22 aa, Staphylococcus
PNSTIDGVEPGKIYNNGQPEDV

SEQ ID NO: 1973560 - protein, 6 aa, Staphylococcus
PNSTYI

SEQ ID NO: 1973561 - protein, 4 aa, Staphylococcus
PNSV

SEQ ID NO: 1973562 - protein, 4 aa, Staphylococcus
PNTA

SEQ ID NO: 1973563 - protein, 12 aa, Staphylococcus
PNTAGAKTAKEA

SEQ ID NO: 1973564 - protein, 11 aa, Staphylococcus
PNTAGAKTVDE

SEQ ID NO: 1973565 - protein, 13 aa, Staphylococcus
PNTALQGYQPDNV

SEQ ID NO: 1973566 - protein, 12 aa, Staphylococcus
PNTASAKTAEEA

SEQ ID NO: 1973567 - protein, 14 aa, Staphylococcus
PNTAYKSFKPSESD

SEQ ID NO: 1973568 - protein, 5 aa, Staphylococcus
PNTDC

SEQ ID NO: 1973569 - protein, 13 aa, Staphylococcus
PNTDFKKNEKIMH

SEQ ID NO: 1973570 - protein, 18 aa, Staphylococcus
PNTDFKQKEIEMHTENIF

SEQ ID NO: 1973571 - protein, 7 aa, Staphylococcus
PNTDFRK

SEQ ID NO: 1973572 - protein, 4 aa, Staphylococcus
PNTE

SEQ ID NO: 1973573 - protein, 7 aa, Staphylococcus
PNTENEI

SEQ ID NO: 1973574 - protein, 5 aa, Staphylococcus
PNTGE

SEQ ID NO: 1973575 - protein, 15 aa, Staphylococcus
PNTKHESSPKRGDDV

SEQ ID NO: 1973576 - protein, 14 aa, Staphylococcus
PNTKKEQTPKRGDD

SEQ ID NO: 1973577 - protein, 15 aa, Staphylococcus
PNTKKEQTPKRGDDV

SEQ ID NO: 1973578 - protein, 14 aa, Staphylococcus
PNTKNEKSPKRGDD

SEQ ID NO: 1973579 - protein, 14 aa, Staphylococcus
PNTKPVPDSEENLN

SEQ ID NO: 1973580 - protein, 14 aa, Staphylococcus
PNTKSEKQPKRGDD

SEQ ID NO: 1973581 - protein, 7 aa, Staphylococcus
PNTNELP

SEQ ID NO: 1973582 - protein, 4 aa, Staphylococcus
PNTR

SEQ ID NO: 1973583 - protein, 8 aa, Staphylococcus
PNTSSTIV

SEQ ID NO: 1973584 - protein, 20 aa, Staphylococcus
PNTYRDRKPDELSGGQRQRV

SEQ ID NO: 1973585 - protein, 7 aa, Staphylococcus
PNVAAEQ

SEQ ID NO: 1973586 - protein, 5 aa, Staphylococcus
PNVAE

SEQ ID NO: 1973587 - protein, 7 aa, Staphylococcus
PNVDAGQ

SEQ ID NO: 1973588 - protein, 6 aa, Staphylococcus
PNVDEG

SEQ ID NO: 1973589 - protein, 7 aa, Staphylococcus
PNVDEGQ

SEQ ID NO: 1973590 - protein, 6 aa, Staphylococcus
PNVDEN

SEQ ID NO: 1973591 - protein, 6 aa, Staphylococcus
PNVEAG

SEQ ID NO: 1973592 - protein, 12 aa, Staphylococcus
PNVEKALKDKFD

SEQ ID NO: 1973593 - protein, 7 aa, Staphylococcus
PNVEQGQ

SEQ ID NO: 1973594 - protein, 7 aa, Staphylococcus
PNVGKST

SEQ ID NO: 1973595 - protein, 8 aa, Staphylococcus
PNVKEDNK

SEQ ID NO: 1973596 - protein, 5 aa, Staphylococcus
PNVKT

SEQ ID NO: 1973597 - protein, 4 aa, Staphylococcus
PNVL

SEQ ID NO: 1973598 - protein, 4 aa, Staphylococcus
PNVM

SEQ ID NO: 1973599 - protein, 4 aa, Staphylococcus
PNVP

SEQ ID NO: 1973600 - protein, 8 aa, Staphylococcus
PNVSSAQK

SEQ ID NO: 1973601 - protein, 7 aa, Staphylococcus
PNYADNE

SEQ ID NO: 1973602 - protein, 7 aa, Staphylococcus
PNYDAEP

SEQ ID NO: 1973603 - protein, 6 aa, Staphylococcus
PNYDVT

SEQ ID NO: 1973604 - protein, 12 aa, Staphylococcus
PNYESGTNGPLE

SEQ ID NO: 1973605 - protein, 5 aa, Staphylococcus
PNYSS

SEQ ID NO: 1973606 - protein, 15 aa, Staphylococcus
PPAQADAEKGTNPEQ

SEQ ID NO: 1973607 - protein, 4 aa, Staphylococcus
PPDI

SEQ ID NO: 1973608 - protein, 7 aa, Staphylococcus
PPEDRET

SEQ ID NO: 1973609 - protein, 7 aa, Staphylococcus
PPEHAKA

SEQ ID NO: 1973610 - protein, 4 aa, Staphylococcus
PPEI

SEQ ID NO: 1973611 - protein, 12 aa, Staphylococcus
PPENNDLFGDSR

SEQ ID NO: 1973612 - protein, 7 aa, Staphylococcus
PPESVET

SEQ ID NO: 1973613 - protein, 11 aa, Staphylococcus
PPFNASDWGQE

SEQ ID NO: 1973614 - protein, 5 aa, Staphylococcus
PPFSP

SEQ ID NO: 1973615 - protein, 4 aa, Staphylococcus
PPFT

SEQ ID NO: 1973616 - protein, 4 aa, Staphylococcus
PPGA

SEQ ID NO: 1973617 - protein, 7 aa, Staphylococcus
PPGTGDI

SEQ ID NO: 1973618 - protein, 5 aa, Staphylococcus
PPGTL

SEQ ID NO: 1973619 - protein, 8 aa, Staphylococcus
PPGYDSET

SEQ ID NO: 1973620 - protein, 8 aa, Staphylococcus
PPGYESES

SEQ ID NO: 1973621 - protein, 4 aa, Staphylococcus
PPIA

SEQ ID NO: 1973622 - protein, 4 aa, Staphylococcus
PPIK

SEQ ID NO: 1973623 - protein, 8 aa, Staphylococcus
PPINNAPT

SEQ ID NO: 1973624 - protein, 6 aa, Staphylococcus
PPINTV

SEQ ID NO: 1973625 - protein, 12 aa, Staphylococcus
PPIPGRTNSTAI

SEQ ID NO: 1973626 - protein, 8 aa, Staphylococcus
PPISPTLT

SEQ ID NO: 1973627 - protein, 5 aa, Staphylococcus
PPITT

SEQ ID NO: 1973628 - protein, 11 aa, Staphylococcus
PPKDVANEDVT

SEQ ID NO: 1973629 - protein, 10 aa, Staphylococcus
PPKNPRENGL

SEQ ID NO: 1973630 - protein, 4 aa, Staphylococcus
PPKV

SEQ ID NO: 1973631 - protein, 54 aa, Staphylococcus
PPLKENENDDNHNDDKNNSTQDQTAQRVSDNDVKTNISKSKNEPLNQTKYEDTD

SEQ ID NO: 1973632 - protein, 7 aa, Staphylococcus
PPLLQTP

SEQ ID NO: 1973633 - protein, 7 aa, Staphylococcus
PPLSPTL

SEQ ID NO: 1973634 - protein, 8 aa, Staphylococcus
PPLSPTLT

SEQ ID NO: 1973635 - protein, 9 aa, Staphylococcus
PPNEETQKH

SEQ ID NO: 1973636 - protein, 7 aa, Staphylococcus
PPNFDGE

SEQ ID NO: 1973637 - protein, 4 aa, Staphylococcus
PPNI

SEQ ID NO: 1973638 - protein, 8 aa, Staphylococcus
PPNIESSD

SEQ ID NO: 1973639 - protein, 5 aa, Staphylococcus
PPNKE

SEQ ID NO: 1973640 - protein, 17 aa, Staphylococcus
PPNLKEAKKRGKQDVQY

SEQ ID NO: 1973641 - protein, 17 aa, Staphylococcus
PPNLKEAKKRGKQEVEY

SEQ ID NO: 1973642 - protein, 13 aa, Staphylococcus
PPNVEKALKEKFK

SEQ ID NO: 1973643 - protein, 13 aa, Staphylococcus
PPQEVPERTENYE

SEQ ID NO: 1973644 - protein, 5 aa, Staphylococcus
PPQKQ

SEQ ID NO: 1973645 - protein, 9 aa, Staphylococcus
PPQPEGVAP

SEQ ID NO: 1973646 - protein, 6 aa, Staphylococcus
PPQPYN

SEQ ID NO: 1973647 - protein, 14 aa, Staphylococcus
PPQQADGKATNPEQ

SEQ ID NO: 1973648 - protein, 15 aa, Staphylococcus
PPREYSISSSYEALP

SEQ ID NO: 1973649 - protein, 16 aa, Staphylococcus
PPREYSISSSYQSLPD

SEQ ID NO: 1973650 - protein, 6 aa, Staphylococcus
PPRKGC

SEQ ID NO: 1973651 - protein, 7 aa, Staphylococcus
PPRKGCE

SEQ ID NO: 1973652 - protein, 23 aa, Staphylococcus
PPRKRDYSSKSHTAENKEEEGSE

SEQ ID NO: 1973653 - protein, 14 aa, Staphylococcus
PPRTPECDEEPPPM

SEQ ID NO: 1973654 - protein, 12 aa, Staphylococcus
PPSFARNKKKTF

SEQ ID NO: 1973655 - protein, 17 aa, Staphylococcus
PPSGRTLSGGLDPASLY

SEQ ID NO: 1973656 - protein, 5 aa, Staphylococcus
PPSIQ

SEQ ID NO: 1973657 - protein, 8 aa, Staphylococcus
PPSKKYQL

SEQ ID NO: 1973658 - protein, 8 aa, Staphylococcus
PPSSPNQR

SEQ ID NO: 1973659 - protein, 5 aa, Staphylococcus
PPSVS

SEQ ID NO: 1973660 - protein, 38 aa, Staphylococcus
PPTDEPSEEEIEAMEGESATEEPEVAGEDKEDEENKDE

SEQ ID NO: 1973661 - protein, 39 aa, Staphylococcus
PPTDEPSEEEVEAMEGESATEEPEVVGDDKESEEENKEE

SEQ ID NO: 1973662 - protein, 40 aa, Staphylococcus
PPTDEPTEEEVEAMEGEAATEEPERVGEEKDDDEEENKEE

SEQ ID NO: 1973663 - protein, 41 aa, Staphylococcus
PPTDEPTEEEVEAMEGEAATEEPEVVGEEKEEDSEEENKDE

SEQ ID NO: 1973664 - protein, 40 aa, Staphylococcus
PPTEEPTEEEIEAMEGEAATEEPEVVGEEKEDESGEDQKE

SEQ ID NO: 1973665 - protein, 36 aa, Staphylococcus
PPTEEPTEEEVEAMEGDAATPEPEVVGESKEDEEAE

SEQ ID NO: 1973666 - protein, 11 aa, Staphylococcus
PPTLSGGEAQR

SEQ ID NO: 1973667 - protein, 34 aa, Staphylococcus
PPTQGPSEAEIEEVEAGDADTPEPEVVGEKEEDE

SEQ ID NO: 1973668 - protein, 10 aa, Staphylococcus
PPTSEEISSI

SEQ ID NO: 1973669 - protein, 5 aa, Staphylococcus
PPTTI

SEQ ID NO: 1973670 - protein, 19 aa, Staphylococcus
PPTTIDGKQYSDGGSYSME

SEQ ID NO: 1973671 - protein, 6 aa, Staphylococcus
PPVDGA

SEQ ID NO: 1973672 - protein, 5 aa, Staphylococcus
PPVDQ

SEQ ID NO: 1973673 - protein, 11 aa, Staphylococcus
PPVERDKNGYR

SEQ ID NO: 1973674 - protein, 8 aa, Staphylococcus
PPVESEIE

SEQ ID NO: 1973675 - protein, 24 aa, Staphylococcus
PPVKDDEDSKESITKYSSSTVEHV

SEQ ID NO: 1973676 - protein, 25 aa, Staphylococcus
PPVPAKEGTYKAEYSYPGAIQVTFK

SEQ ID NO: 1973677 - protein, 12 aa, Staphylococcus
PPVYTTGENKLA

SEQ ID NO: 1973678 - protein, 11 aa, Staphylococcus
PPYAKGNAEEV

SEQ ID NO: 1973679 - protein, 17 aa, Staphylococcus
PQAITGEHTNVKGTNLD

SEQ ID NO: 1973680 - protein, 7 aa, Staphylococcus
PQASLGD

SEQ ID NO: 1973681 - protein, 4 aa, Staphylococcus
PQAY

SEQ ID NO: 1973682 - protein, 19 aa, Staphylococcus
PQCKTKKNVQRKTNARCPN

SEQ ID NO: 1973683 - protein, 15 aa, Staphylococcus
PQDAESIQTIKSEQL

SEQ ID NO: 1973684 - protein, 7 aa, Staphylococcus
PQDEASR

SEQ ID NO: 1973685 - protein, 5 aa, Staphylococcus
PQDID

SEQ ID NO: 1973686 - protein, 8 aa, Staphylococcus
PQDKEDVA

SEQ ID NO: 1973687 - protein, 8 aa, Staphylococcus
PQDNNPRY

SEQ ID NO: 1973688 - protein, 4 aa, Staphylococcus
PQDP

SEQ ID NO: 1973689 - protein, 8 aa, Staphylococcus
PQDSQYPF

SEQ ID NO: 1973690 - protein, 6 aa, Staphylococcus
PQDSWD

SEQ ID NO: 1973691 - protein, 4 aa, Staphylococcus
PQDY

SEQ ID NO: 1973692 - protein, 5 aa, Staphylococcus
PQEDG

SEQ ID NO: 1973693 - protein, 7 aa, Staphylococcus
PQELKDK

SEQ ID NO: 1973694 - protein, 8 aa, Staphylococcus
PQEQTKDA

SEQ ID NO: 1973695 - protein, 9 aa, Staphylococcus
PQESKEEVD

SEQ ID NO: 1973696 - protein, 5 aa, Staphylococcus
PQEYT

SEQ ID NO: 1973697 - protein, 4 aa, Staphylococcus
PQFD

SEQ ID NO: 1973698 - protein, 8 aa, Staphylococcus
PQFKRGRY

SEQ ID NO: 1973699 - protein, 7 aa, Staphylococcus
PQGGKTK

SEQ ID NO: 1973700 - protein, 6 aa, Staphylococcus
PQGKAH

SEQ ID NO: 1973701 - protein, 7 aa, Staphylococcus
PQGNYQS

SEQ ID NO: 1973702 - protein, 5 aa, Staphylococcus
PQHAK

SEQ ID NO: 1973703 - protein, 5 aa, Staphylococcus
PQHAR

SEQ ID NO: 1973704 - protein, 9 aa, Staphylococcus
PQHDSIQQQ

SEQ ID NO: 1973705 - protein, 4 aa, Staphylococcus
PQHE

SEQ ID NO: 1973706 - protein, 5 aa, Staphylococcus
PQHNK

SEQ ID NO: 1973707 - protein, 4 aa, Staphylococcus
PQID

SEQ ID NO: 1973708 - protein, 5 aa, Staphylococcus
PQIDS

SEQ ID NO: 1973709 - protein, 13 aa, Staphylococcus
PQIEGGRPEIDRG

SEQ ID NO: 1973710 - protein, 5 aa, Staphylococcus
PQIEM

SEQ ID NO: 1973711 - protein, 12 aa, Staphylococcus
PQIERQEKMNQR

SEQ ID NO: 1973712 - protein, 7 aa, Staphylococcus
PQIKEDG

SEQ ID NO: 1973713 - protein, 12 aa, Staphylococcus
PQINKRSTEHDC

SEQ ID NO: 1973714 - protein, 4 aa, Staphylococcus
PQIP

SEQ ID NO: 1973715 - protein, 7 aa, Staphylococcus
PQIPQSL

SEQ ID NO: 1973716 - protein, 4 aa, Staphylococcus
PQIV

SEQ ID NO: 1973717 - protein, 9 aa, Staphylococcus
PQKDSASEY

SEQ ID NO: 1973718 - protein, 4 aa, Staphylococcus
PQKI

SEQ ID NO: 1973719 - protein, 8 aa, Staphylococcus
PQKNEADA

SEQ ID NO: 1973720 - protein, 10 aa, Staphylococcus
PQKNETTPYT

SEQ ID NO: 1973721 - protein, 7 aa, Staphylococcus
PQKPGLG

SEQ ID NO: 1973722 - protein, 8 aa, Staphylococcus
PQKQNVDG

SEQ ID NO: 1973723 - protein, 12 aa, Staphylococcus
PQLGVPNSEDIQ

SEQ ID NO: 1973724 - protein, 10 aa, Staphylococcus
PQLLTSPNTL

SEQ ID NO: 1973725 - protein, 4 aa, Staphylococcus
PQLP

SEQ ID NO: 1973726 - protein, 12 aa, Staphylococcus
PQLTSQYGTLSK

SEQ ID NO: 1973727 - protein, 6 aa, Staphylococcus
PQMDKS

SEQ ID NO: 1973728 - protein, 11 aa, Staphylococcus
PQMPEKYEANQ

SEQ ID NO: 1973729 - protein, 4 aa, Staphylococcus
PQMT

SEQ ID NO: 1973730 - protein, 7 aa, Staphylococcus
PQNDDYI

SEQ ID NO: 1973731 - protein, 19 aa, Staphylococcus
PQNEKAVKKYGDKYGTTAE

SEQ ID NO: 1973732 - protein, 4 aa, Staphylococcus
PQNF

SEQ ID NO: 1973733 - protein, 7 aa, Staphylococcus
PQNFGRA

SEQ ID NO: 1973734 - protein, 6 aa, Staphylococcus
PQNLNE

SEQ ID NO: 1973735 - protein, 5 aa, Staphylococcus
PQNSD

SEQ ID NO: 1973736 - protein, 5 aa, Staphylococcus
PQNWD

SEQ ID NO: 1973737 - protein, 10 aa, Staphylococcus
PQPAPADHPW

SEQ ID NO: 1973738 - protein, 9 aa, Staphylococcus
PQPAPATHP

SEQ ID NO: 1973739 - protein, 11 aa, Staphylococcus
PQPAPKDHPWR

SEQ ID NO: 1973740 - protein, 10 aa, Staphylococcus
PQPERTHPDI

SEQ ID NO: 1973741 - protein, 5 aa, Staphylococcus
PQPGF

SEQ ID NO: 1973742 - protein, 4 aa, Staphylococcus
PQQD

SEQ ID NO: 1973743 - protein, 5 aa, Staphylococcus
PQQEN

SEQ ID NO: 1973744 - protein, 13 aa, Staphylococcus
PQQERTQNFLSRV

SEQ ID NO: 1973745 - protein, 16 aa, Staphylococcus
PQQETENDLEEDPRED

SEQ ID NO: 1973746 - protein, 9 aa, Staphylococcus
PQQQTQTAT

SEQ ID NO: 1973747 - protein, 8 aa, Staphylococcus
PQRKGDPI

SEQ ID NO: 1973748 - protein, 5 aa, Staphylococcus
PQRSP

SEQ ID NO: 1973749 - protein, 5 aa, Staphylococcus
PQRYK

SEQ ID NO: 1973750 - protein, 15 aa, Staphylococcus
PQSAELQRFLNMIRE

SEQ ID NO: 1973751 - protein, 5 aa, Staphylococcus
PQSDD

SEQ ID NO: 1973752 - protein, 8 aa, Staphylococcus
PQSDKPGL

SEQ ID NO: 1973753 - protein, 16 aa, Staphylococcus
PQSEEDVDLEEDPRED

SEQ ID NO: 1973754 - protein, 7 aa, Staphylococcus
PQSEGFV

SEQ ID NO: 1973755 - protein, 8 aa, Staphylococcus
PQSEKQLS

SEQ ID NO: 1973756 - protein, 7 aa, Staphylococcus
PQSNEQY

SEQ ID NO: 1973757 - protein, 13 aa, Staphylococcus
PQSPDVADGLTAG

SEQ ID NO: 1973758 - protein, 8 aa, Staphylococcus
PQSSKQLS

SEQ ID NO: 1973759 - protein, 11 aa, Staphylococcus
PQSSPVYDEGN

SEQ ID NO: 1973760 - protein, 5 aa, Staphylococcus
PQSTI

SEQ ID NO: 1973761 - protein, 9 aa, Staphylococcus
PQSVNGRGS

SEQ ID NO: 1973762 - protein, 8 aa, Staphylococcus
PQTEKQLS

SEQ ID NO: 1973763 - protein, 7 aa, Staphylococcus
PQTGEQI

SEQ ID NO: 1973764 - protein, 11 aa, Staphylococcus
PQTGKPSFDLK

SEQ ID NO: 1973765 - protein, 4 aa, Staphylococcus
PQTI

SEQ ID NO: 1973766 - protein, 4 aa, Staphylococcus
PQTN

SEQ ID NO: 1973767 - protein, 17 aa, Staphylococcus
PQTNEVEDLDDDPRDEL

SEQ ID NO: 1973768 - protein, 10 aa, Staphylococcus
PQTPEVADGL

SEQ ID NO: 1973769 - protein, 8 aa, Staphylococcus
PQTPNGED

SEQ ID NO: 1973770 - protein, 10 aa, Staphylococcus
PQTPTVTDSI

SEQ ID NO: 1973771 - protein, 5 aa, Staphylococcus
PQTSG

SEQ ID NO: 1973772 - protein, 16 aa, Staphylococcus
PQTSVEDDIEEDPRED

SEQ ID NO: 1973773 - protein, 5 aa, Staphylococcus
PQTSY

SEQ ID NO: 1973774 - protein, 11 aa, Staphylococcus
PQTTPKEFDAQ

SEQ ID NO: 1973775 - protein, 14 aa, Staphylococcus
PQVATEELRKQYQA

SEQ ID NO: 1973776 - protein, 10 aa, Staphylococcus
PQVLTETTAE

SEQ ID NO: 1973777 - protein, 5 aa, Staphylococcus
PQVPN

SEQ ID NO: 1973778 - protein, 6 aa, Staphylococcus
PQVQSK

SEQ ID NO: 1973779 - protein, 5 aa, Staphylococcus
PQYDA

SEQ ID NO: 1973780 - protein, 4 aa, Staphylococcus
PQYG

SEQ ID NO: 1973781 - protein, 5 aa, Staphylococcus
PQYGD

SEQ ID NO: 1973782 - protein, 8 aa, Staphylococcus
PQYGDHNI

SEQ ID NO: 1973783 - protein, 5 aa, Staphylococcus
PQYID

SEQ ID NO: 1973784 - protein, 8 aa, Staphylococcus
PQYRETAD

SEQ ID NO: 1973785 - protein, 9 aa, Staphylococcus
PQYRGRGVA

SEQ ID NO: 1973786 - protein, 10 aa, Staphylococcus
PQYSQQPTVM

SEQ ID NO: 1973787 - protein, 16 aa, Staphylococcus
PQYSVEKGIQSYLEYQ

SEQ ID NO: 1973788 - protein, 42 aa, Staphylococcus
PQYTTQAAPVYQSSESNSASPVSQNDAATAEKPHSDENYNTI

SEQ ID NO: 1973789 - protein, 6 aa, Staphylococcus
PRAKEV

SEQ ID NO: 1973790 - protein, 8 aa, Staphylococcus
PRAREAQE

SEQ ID NO: 1973791 - protein, 7 aa, Staphylococcus
PRDENNY

SEQ ID NO: 1973792 - protein, 4 aa, Staphylococcus
PRDF

SEQ ID NO: 1973793 - protein, 9 aa, Staphylococcus
PRDNSNNVG

SEQ ID NO: 1973794 - protein, 4 aa, Staphylococcus
PRDS

SEQ ID NO: 1973795 - protein, 7 aa, Staphylococcus
PRDTNQY

SEQ ID NO: 1973796 - protein, 10 aa, Staphylococcus
PREEKNNKAI

SEQ ID NO: 1973797 - protein, 6 aa, Staphylococcus
PREEVQ

SEQ ID NO: 1973798 - protein, 7 aa, Staphylococcus
PREHSGE

SEQ ID NO: 1973799 - protein, 4 aa, Staphylococcus
PREL

SEQ ID NO: 1973800 - protein, 12 aa, Staphylococcus
PRENGSKGSIKF

SEQ ID NO: 1973801 - protein, 6 aa, Staphylococcus
PRERLV

SEQ ID NO: 1973802 - protein, 13 aa, Staphylococcus
PRETRIGAKQMGT

SEQ ID NO: 1973803 - protein, 13 aa, Staphylococcus
PRETRTGTKQMGT

SEQ ID NO: 1973804 - protein, 14 aa, Staphylococcus
PRETRVGAKQMGTR

SEQ ID NO: 1973805 - protein, 7 aa, Staphylococcus
PRFGGGY

SEQ ID NO: 1973806 - protein, 5 aa, Staphylococcus
PRFGS

SEQ ID NO: 1973807 - protein, 21 aa, Staphylococcus
PRFSNDINSNKNSSKHKYETK

SEQ ID NO: 1973808 - protein, 6 aa, Staphylococcus
PRFSPT

SEQ ID NO: 1973809 - protein, 10 aa, Staphylococcus
PRFTKGGKIE

SEQ ID NO: 1973810 - protein, 12 aa, Staphylococcus
PRFTKGGKIEQL

SEQ ID NO: 1973811 - protein, 11 aa, Staphylococcus
PRFTQGGKIES

SEQ ID NO: 1973812 - protein, 12 aa, Staphylococcus
PRFTSNPKLEEM

SEQ ID NO: 1973813 - protein, 5 aa, Staphylococcus
PRGDT

SEQ ID NO: 1973814 - protein, 9 aa, Staphylococcus
PRGGSDITG

SEQ ID NO: 1973815 - protein, 6 aa, Staphylococcus
PRHETK

SEQ ID NO: 1973816 - protein, 4 aa, Staphylococcus
PRHK

SEQ ID NO: 1973817 - protein, 10 aa, Staphylococcus
PRHPGNHQYA

SEQ ID NO: 1973818 - protein, 5 aa, Staphylococcus
PRIEG

SEQ ID NO: 1973819 - protein, 6 aa, Staphylococcus
PRIEGG

SEQ ID NO: 1973820 - protein, 22 aa, Staphylococcus
PRIGTPAARMDDQIDESVKNER

SEQ ID NO: 1973821 - protein, 12 aa, Staphylococcus
PRIGVPNKGEWT

SEQ ID NO: 1973822 - protein, 8 aa, Staphylococcus
PRIKTKPK

SEQ ID NO: 1973823 - protein, 7 aa, Staphylococcus
PRIPQGR

SEQ ID NO: 1973824 - protein, 9 aa, Staphylococcus
PRIPTEDEI

SEQ ID NO: 1973825 - protein, 12 aa, Staphylococcus
PRIPTEDEITTA

SEQ ID NO: 1973826 - protein, 8 aa, Staphylococcus
PRIPTEEE

SEQ ID NO: 1973827 - protein, 9 aa, Staphylococcus
PRIPTEEEI

SEQ ID NO: 1973828 - protein, 10 aa, Staphylococcus
PRIPTEEEIT

SEQ ID NO: 1973829 - protein, 12 aa, Staphylococcus
PRIPTENEIETA

SEQ ID NO: 1973830 - protein, 10 aa, Staphylococcus
PRIPTESEIT

SEQ ID NO: 1973831 - protein, 5 aa, Staphylococcus
PRIQG

SEQ ID NO: 1973832 - protein, 14 aa, Staphylococcus
PRKSGISDGPMSKA

SEQ ID NO: 1973833 - protein, 5 aa, Staphylococcus
PRKVP

SEQ ID NO: 1973834 - protein, 4 aa, Staphylococcus
PRLD

SEQ ID NO: 1973835 - protein, 4 aa, Staphylococcus
PRLE

SEQ ID NO: 1973836 - protein, 6 aa, Staphylococcus
PRLEGG

SEQ ID NO: 1973837 - protein, 7 aa, Staphylococcus
PRLSDNN

SEQ ID NO: 1973838 - protein, 16 aa, Staphylococcus
PRLTKAKIKASRKIKG

SEQ ID NO: 1973839 - protein, 10 aa, Staphylococcus
PRMEGANDEI

SEQ ID NO: 1973840 - protein, 8 aa, Staphylococcus
PRNDSGYR

SEQ ID NO: 1973841 - protein, 15 aa, Staphylococcus
PRNGEQGLKQQIQNK

SEQ ID NO: 1973842 - protein, 6 aa, Staphylococcus
PRNKQG

SEQ ID NO: 1973843 - protein, 6 aa, Staphylococcus
PRPDTG

SEQ ID NO: 1973844 - protein, 7 aa, Staphylococcus
PRPDTGL

SEQ ID NO: 1973845 - protein, 8 aa, Staphylococcus
PRPDTGLS

SEQ ID NO: 1973846 - protein, 10 aa, Staphylococcus
PRPDTGLSTD

SEQ ID NO: 1973847 - protein, 4 aa, Staphylococcus
PRPH

SEQ ID NO: 1973848 - protein, 5 aa, Staphylococcus
PRPSV

SEQ ID NO: 1973849 - protein, 4 aa, Staphylococcus
PRQE

SEQ ID NO: 1973850 - protein, 6 aa, Staphylococcus
PRQEVQ

SEQ ID NO: 1973851 - protein, 10 aa, Staphylococcus
PRQNPESDYS

SEQ ID NO: 1973852 - protein, 10 aa, Staphylococcus
PRQNPTSDYS

SEQ ID NO: 1973853 - protein, 10 aa, Staphylococcus
PRQSGVSDRP

SEQ ID NO: 1973854 - protein, 4 aa, Staphylococcus
PRRT

SEQ ID NO: 1973855 - protein, 11 aa, Staphylococcus
PRSEAEQQESH

SEQ ID NO: 1973856 - protein, 11 aa, Staphylococcus
PRSEEEAKESH

SEQ ID NO: 1973857 - protein, 11 aa, Staphylococcus
PRSEEEARESH

SEQ ID NO: 1973858 - protein, 12 aa, Staphylococcus
PRSNEYKEKYTT

SEQ ID NO: 1973859 - protein, 5 aa, Staphylococcus
PRSQM

SEQ ID NO: 1973860 - protein, 8 aa, Staphylococcus
PRSTNPVH

SEQ ID NO: 1973861 - protein, 7 aa, Staphylococcus
PRTEITE

SEQ ID NO: 1973862 - protein, 8 aa, Staphylococcus
PRTEITQS

SEQ ID NO: 1973863 - protein, 5 aa, Staphylococcus
PRTFT

SEQ ID NO: 1973864 - protein, 6 aa, Staphylococcus
PRTNEP

SEQ ID NO: 1973865 - protein, 9 aa, Staphylococcus
PRTQITSSG

SEQ ID NO: 1973866 - protein, 6 aa, Staphylococcus
PRTTVQ

SEQ ID NO: 1973867 - protein, 4 aa, Staphylococcus
PRTV

SEQ ID NO: 1973868 - protein, 13 aa, Staphylococcus
PRVKGRIGGRRNG

SEQ ID NO: 1973869 - protein, 7 aa, Staphylococcus
PRYNKDG

SEQ ID NO: 1973870 - protein, 8 aa, Staphylococcus
PRYNKDGN

SEQ ID NO: 1973871 - protein, 11 aa, Staphylococcus
PRYTDRQGGYT

SEQ ID NO: 1973872 - protein, 10 aa, Staphylococcus
PRYTKTKESY

SEQ ID NO: 1973873 - protein, 4 aa, Staphylococcus
PSAE

SEQ ID NO: 1973874 - protein, 7 aa, Staphylococcus
PSAEGTI

SEQ ID NO: 1973875 - protein, 9 aa, Staphylococcus
PSAFNSQST

SEQ ID NO: 1973876 - protein, 4 aa, Staphylococcus
PSAI

SEQ ID NO: 1973877 - protein, 10 aa, Staphylococcus
PSAKQAQDAN

SEQ ID NO: 1973878 - protein, 5 aa, Staphylococcus
PSASE

SEQ ID NO: 1973879 - protein, 6 aa, Staphylococcus
PSASGL

SEQ ID NO: 1973880 - protein, 15 aa, Staphylococcus
PSATKKIKEANDGNL

SEQ ID NO: 1973881 - protein, 12 aa, Staphylococcus
PSATMNKQGEPY

SEQ ID NO: 1973882 - protein, 19 aa, Staphylococcus
PSCKTKKNVQRKTNARCPN

SEQ ID NO: 1973883 - protein, 4 aa, Staphylococcus
PSDD

SEQ ID NO: 1973884 - protein, 11 aa, Staphylococcus
PSDEETRKNLH

SEQ ID NO: 1973885 - protein, 5 aa, Staphylococcus
PSDHI

SEQ ID NO: 1973886 - protein, 10 aa, Staphylococcus
PSDIRAAGGV

SEQ ID NO: 1973887 - protein, 11 aa, Staphylococcus
PSDKFERDGDD

SEQ ID NO: 1973888 - protein, 10 aa, Staphylococcus
PSDKFRRDGD

SEQ ID NO: 1973889 - protein, 8 aa, Staphylococcus
PSDKKRLM

SEQ ID NO: 1973890 - protein, 21 aa, Staphylococcus
PSDKKRMLDAQKEKNKSNIQL

SEQ ID NO: 1973891 - protein, 18 aa, Staphylococcus
PSDKKRMMDKNKGKRVNV

SEQ ID NO: 1973892 - protein, 83 aa, Staphylococcus
PSDKKRMMDSKNNSRVNVPGLKPEQQIDQSTEEDSSESQFTSENNLNESETNQQTSHEYQTQSESNDDGITGVSTSDNVNNNH

SEQ ID NO: 1973893 - protein, 22 aa, Staphylococcus
PSDKKRVMDAKKNSVSRNKVNV

SEQ ID NO: 1973894 - protein, 7 aa, Staphylococcus
PSDKQDF

SEQ ID NO: 1973895 - protein, 71 aa, Staphylococcus
PSDKRRMQRANKNNNASTLRPDIKKESESTRENKPEQEQVQDADVEKLQGEQRNNVPENNVKQEEAGHITE

SEQ ID NO: 1973896 - protein, 10 aa, Staphylococcus
PSDLAAEISD

SEQ ID NO: 1973897 - protein, 11 aa, Staphylococcus
PSDQFGGTGQT

SEQ ID NO: 1973898 - protein, 11 aa, Staphylococcus
PSDQRDKNMDD

SEQ ID NO: 1973899 - protein, 6 aa, Staphylococcus
PSDQRQ

SEQ ID NO: 1973900 - protein, 8 aa, Staphylococcus
PSDRKRMM

SEQ ID NO: 1973901 - protein, 11 aa, Staphylococcus
PSDTFERDGDD

SEQ ID NO: 1973902 - protein, 9 aa, Staphylococcus
PSDTFEREG

SEQ ID NO: 1973903 - protein, 18 aa, Staphylococcus
PSDYNSVNAPADTSGKGY

SEQ ID NO: 1973904 - protein, 6 aa, Staphylococcus
PSEALD

SEQ ID NO: 1973905 - protein, 16 aa, Staphylococcus
PSEASTGIKASTESGQ

SEQ ID NO: 1973906 - protein, 9 aa, Staphylococcus
PSEDAGKCM

SEQ ID NO: 1973907 - protein, 8 aa, Staphylococcus
PSEDANEN

SEQ ID NO: 1973908 - protein, 18 aa, Staphylococcus
PSEDGPPTNWESKFGGNA

SEQ ID NO: 1973909 - protein, 11 aa, Staphylococcus
PSEDKDAQDVK

SEQ ID NO: 1973910 - protein, 6 aa, Staphylococcus
PSEDRQ

SEQ ID NO: 1973911 - protein, 10 aa, Staphylococcus
PSEEEDAQEV

SEQ ID NO: 1973912 - protein, 7 aa, Staphylococcus
PSEEISA

SEQ ID NO: 1973913 - protein, 16 aa, Staphylococcus
PSEGIKRPKKKVSVEE

SEQ ID NO: 1973914 - protein, 4 aa, Staphylococcus
PSEH

SEQ ID NO: 1973915 - protein, 15 aa, Staphylococcus
PSEHAERSWDEVPEE

SEQ ID NO: 1973916 - protein, 5 aa, Staphylococcus
PSEHI

SEQ ID NO: 1973917 - protein, 9 aa, Staphylococcus
PSEHTQRSW

SEQ ID NO: 1973918 - protein, 13 aa, Staphylococcus
PSEKEAQEYSKKA

SEQ ID NO: 1973919 - protein, 11 aa, Staphylococcus
PSEKFERDGDD

SEQ ID NO: 1973920 - protein, 11 aa, Staphylococcus
PSEKVDKALDQ

SEQ ID NO: 1973921 - protein, 7 aa, Staphylococcus
PSELNGK

SEQ ID NO: 1973922 - protein, 6 aa, Staphylococcus
PSELTP

SEQ ID NO: 1973923 - protein, 7 aa, Staphylococcus
PSELTPH

SEQ ID NO: 1973924 - protein, 5 aa, Staphylococcus
PSENE

SEQ ID NO: 1973925 - protein, 6 aa, Staphylococcus
PSENFK

SEQ ID NO: 1973926 - protein, 11 aa, Staphylococcus
PSEQYGGTGQS

SEQ ID NO: 1973927 - protein, 9 aa, Staphylococcus
PSEREAQAY

SEQ ID NO: 1973928 - protein, 7 aa, Staphylococcus
PSERYPA

SEQ ID NO: 1973929 - protein, 6 aa, Staphylococcus
PSFARN

SEQ ID NO: 1973930 - protein, 15 aa, Staphylococcus
PSFARNKKKTFSVQK

SEQ ID NO: 1973931 - protein, 22 aa, Staphylococcus
PSFGPDKERGKAYRDSGLFDNN

SEQ ID NO: 1973932 - protein, 15 aa, Staphylococcus
PSFPDAQTLEGSYGR

SEQ ID NO: 1973933 - protein, 7 aa, Staphylococcus
PSFRTGD

SEQ ID NO: 1973934 - protein, 4 aa, Staphylococcus
PSGA

SEQ ID NO: 1973935 - protein, 10 aa, Staphylococcus
PSGASTGEYE

SEQ ID NO: 1973936 - protein, 7 aa, Staphylococcus
PSGCGKS

SEQ ID NO: 1973937 - protein, 14 aa, Staphylococcus
PSGDVTPSKEDIAT

SEQ ID NO: 1973938 - protein, 15 aa, Staphylococcus
PSGDVTPSKEDIETT

SEQ ID NO: 1973939 - protein, 13 aa, Staphylococcus
PSGDVTPSKEDIL

SEQ ID NO: 1973940 - protein, 14 aa, Staphylococcus
PSGDVTPSREDITT

SEQ ID NO: 1973941 - protein, 8 aa, Staphylococcus
PSGEQTKT

SEQ ID NO: 1973942 - protein, 9 aa, Staphylococcus
PSGETTKTL

SEQ ID NO: 1973943 - protein, 4 aa, Staphylococcus
PSGF

SEQ ID NO: 1973944 - protein, 9 aa, Staphylococcus
PSGGNRGKG

SEQ ID NO: 1973945 - protein, 9 aa, Staphylococcus
PSGHVDATD

SEQ ID NO: 1973946 - protein, 8 aa, Staphylococcus
PSGIASQL

SEQ ID NO: 1973947 - protein, 19 aa, Staphylococcus
PSGIVSTKPKVIKKAKSLK

SEQ ID NO: 1973948 - protein, 11 aa, Staphylococcus
PSGKSIKGMGI

SEQ ID NO: 1973949 - protein, 10 aa, Staphylococcus
PSGNNVQNTA

SEQ ID NO: 1973950 - protein, 7 aa, Staphylococcus
PSGPYDA

SEQ ID NO: 1973951 - protein, 8 aa, Staphylococcus
PSGQSYPL

SEQ ID NO: 1973952 - protein, 20 aa, Staphylococcus
PSGSDMTDEQQTRVIEIIKS

SEQ ID NO: 1973953 - protein, 48 aa, Staphylococcus
PSGSLNNGGEVSAKATDKTGNESPKTTKDVADETVPEAPKVDNVTSND

SEQ ID NO: 1973954 - protein, 15 aa, Staphylococcus
PSGSYYGGASLNPTK

SEQ ID NO: 1973955 - protein, 5 aa, Staphylococcus
PSGVG

SEQ ID NO: 1973956 - protein, 14 aa, Staphylococcus
PSGVVSATEDDKHQ

SEQ ID NO: 1973957 - protein, 6 aa, Staphylococcus
PSHESI

SEQ ID NO: 1973958 - protein, 4 aa, Staphylococcus
PSHK

SEQ ID NO: 1973959 - protein, 4 aa, Staphylococcus
PSHP

SEQ ID NO: 1973960 - protein, 7 aa, Staphylococcus
PSHPDNF

SEQ ID NO: 1973961 - protein, 6 aa, Staphylococcus
PSHPGY

SEQ ID NO: 1973962 - protein, 5 aa, Staphylococcus
PSHPT

SEQ ID NO: 1973963 - protein, 5 aa, Staphylococcus
PSHSH

SEQ ID NO: 1973964 - protein, 6 aa, Staphylococcus
PSHSSI

SEQ ID NO: 1973965 - protein, 7 aa, Staphylococcus
PSHTTGE

SEQ ID NO: 1973966 - protein, 5 aa, Staphylococcus
PSHVE

SEQ ID NO: 1973967 - protein, 9 aa, Staphylococcus
PSHYDNHSA

SEQ ID NO: 1973968 - protein, 11 aa, Staphylococcus
PSIATEDQTAI

SEQ ID NO: 1973969 - protein, 6 aa, Staphylococcus
PSIKNH

SEQ ID NO: 1973970 - protein, 4 aa, Staphylococcus
PSIN

SEQ ID NO: 1973971 - protein, 14 aa, Staphylococcus
PSIPAESQQIETNK

SEQ ID NO: 1973972 - protein, 12 aa, Staphylococcus
PSIPNSEHIATT

SEQ ID NO: 1973973 - protein, 6 aa, Staphylococcus
PSIQEP

SEQ ID NO: 1973974 - protein, 4 aa, Staphylococcus
PSIS

SEQ ID NO: 1973975 - protein, 12 aa, Staphylococcus
PSISKSQSIATT

SEQ ID NO: 1973976 - protein, 15 aa, Staphylococcus
PSISNDQLASTNSIS

SEQ ID NO: 1973977 - protein, 6 aa, Staphylococcus
PSISQQ

SEQ ID NO: 1973978 - protein, 8 aa, Staphylococcus
PSKAEEKQ

SEQ ID NO: 1973979 - protein, 9 aa, Staphylococcus
PSKEDKREK

SEQ ID NO: 1973980 - protein, 6 aa, Staphylococcus
PSKGIS

SEQ ID NO: 1973981 - protein, 19 aa, Staphylococcus
PSKHVSKTYKVTSKYPIKN

SEQ ID NO: 1973982 - protein, 7 aa, Staphylococcus
PSKLNQL

SEQ ID NO: 1973983 - protein, 7 aa, Staphylococcus
PSKLTSP

SEQ ID NO: 1973984 - protein, 10 aa, Staphylococcus
PSKQSPSPTD

SEQ ID NO: 1973985 - protein, 7 aa, Staphylococcus
PSKRGAI

SEQ ID NO: 1973986 - protein, 6 aa, Staphylococcus
PSKRKL

SEQ ID NO: 1973987 - protein, 10 aa, Staphylococcus
PSKTAHQSQH

SEQ ID NO: 1973988 - protein, 6 aa, Staphylococcus
PSKTDL

SEQ ID NO: 1973989 - protein, 4 aa, Staphylococcus
PSKV

SEQ ID NO: 1973990 - protein, 9 aa, Staphylococcus
PSKVQIPGL

SEQ ID NO: 1973991 - protein, 14 aa, Staphylococcus
PSKYQDKVETNLSS

SEQ ID NO: 1973992 - protein, 4 aa, Staphylococcus
PSLA

SEQ ID NO: 1973993 - protein, 11 aa, Staphylococcus
PSLAKTKQKQI

SEQ ID NO: 1973994 - protein, 5 aa, Staphylococcus
PSLCT

SEQ ID NO: 1973995 - protein, 5 aa, Staphylococcus
PSLDD

SEQ ID NO: 1973996 - protein, 6 aa, Staphylococcus
PSLDDL

SEQ ID NO: 1973997 - protein, 11 aa, Staphylococcus
PSLDKEGKQNG

SEQ ID NO: 1973998 - protein, 4 aa, Staphylococcus
PSLE

SEQ ID NO: 1973999 - protein, 13 aa, Staphylococcus
PSLESIKNDKQRM

SEQ ID NO: 1974000 - protein, 12 aa, Staphylococcus
PSLGVPSEQNVN

SEQ ID NO: 1974001 - protein, 16 aa, Staphylococcus
PSLKQTIQGNTYDNPV

SEQ ID NO: 1974002 - protein, 7 aa, Staphylococcus
PSLPDSL

SEQ ID NO: 1974003 - protein, 22 aa, Staphylococcus
PSLPKKKQKQIAEQISSNQESE

SEQ ID NO: 1974004 - protein, 5 aa, Staphylococcus
PSLSG

SEQ ID NO: 1974005 - protein, 5 aa, Staphylococcus
PSLSQ

SEQ ID NO: 1974006 - protein, 5 aa, Staphylococcus
PSLSR

SEQ ID NO: 1974007 - protein, 6 aa, Staphylococcus
PSLTTS

SEQ ID NO: 1974008 - protein, 6 aa, Staphylococcus
PSLTTT

SEQ ID NO: 1974009 - protein, 16 aa, Staphylococcus
PSNGERYLSTPLFAFD

SEQ ID NO: 1974010 - protein, 17 aa, Staphylococcus
PSNGERYLSTPLYSFED

SEQ ID NO: 1974011 - protein, 6 aa, Staphylococcus
PSNHVA

SEQ ID NO: 1974012 - protein, 4 aa, Staphylococcus
PSNP

SEQ ID NO: 1974013 - protein, 7 aa, Staphylococcus
PSNPYDA

SEQ ID NO: 1974014 - protein, 14 aa, Staphylococcus
PSNSKFAKNQLDDR

SEQ ID NO: 1974015 - protein, 12 aa, Staphylococcus
PSNTMNQQGQPY

SEQ ID NO: 1974016 - protein, 5 aa, Staphylococcus
PSNVS

SEQ ID NO: 1974017 - protein, 10 aa, Staphylococcus
PSPDERNIER

SEQ ID NO: 1974018 - protein, 4 aa, Staphylococcus
PSPE

SEQ ID NO: 1974019 - protein, 6 aa, Staphylococcus
PSPEEI

SEQ ID NO: 1974020 - protein, 14 aa, Staphylococcus
PSPKVRDDTRTFNP

SEQ ID NO: 1974021 - protein, 4 aa, Staphylococcus
PSPL

SEQ ID NO: 1974022 - protein, 5 aa, Staphylococcus
PSPMT

SEQ ID NO: 1974023 - protein, 9 aa, Staphylococcus
PSPVKRPED

SEQ ID NO: 1974024 - protein, 6 aa, Staphylococcus
PSPYAS

SEQ ID NO: 1974025 - protein, 7 aa, Staphylococcus
PSPYASK

SEQ ID NO: 1974026 - protein, 12 aa, Staphylococcus
PSPYKRDEHRTF

SEQ ID NO: 1974027 - protein, 5 aa, Staphylococcus
PSPYY

SEQ ID NO: 1974028 - protein, 18 aa, Staphylococcus
PSQDGPPTNWESKFGGNA

SEQ ID NO: 1974029 - protein, 10 aa, Staphylococcus
PSQEAMTTER

SEQ ID NO: 1974030 - protein, 6 aa, Staphylococcus
PSQEGV

SEQ ID NO: 1974031 - protein, 5 aa, Staphylococcus
PSQEI

SEQ ID NO: 1974032 - protein, 4 aa, Staphylococcus
PSQI

SEQ ID NO: 1974033 - protein, 6 aa, Staphylococcus
PSQKAT

SEQ ID NO: 1974034 - protein, 19 aa, Staphylococcus
PSQLEENTQDYLNFIQSLN

SEQ ID NO: 1974035 - protein, 11 aa, Staphylococcus
PSQLSGGQQQR

SEQ ID NO: 1974036 - protein, 7 aa, Staphylococcus
PSQLSYQ

SEQ ID NO: 1974037 - protein, 17 aa, Staphylococcus
PSQNADKLEAKAKPLEK

SEQ ID NO: 1974038 - protein, 12 aa, Staphylococcus
PSQNYGGTGDTY

SEQ ID NO: 1974039 - protein, 7 aa, Staphylococcus
PSQPEHF

SEQ ID NO: 1974040 - protein, 12 aa, Staphylococcus
PSQTVSSSEQTF

SEQ ID NO: 1974041 - protein, 5 aa, Staphylococcus
PSQVI

SEQ ID NO: 1974042 - protein, 7 aa, Staphylococcus
PSQVSEQ

SEQ ID NO: 1974043 - protein, 7 aa, Staphylococcus
PSREGAQ

SEQ ID NO: 1974044 - protein, 8 aa, Staphylococcus
PSREHPHD

SEQ ID NO: 1974045 - protein, 19 aa, Staphylococcus
PSRGKSSDLDRDTHTLDDY

SEQ ID NO: 1974046 - protein, 10 aa, Staphylococcus
PSRGRSSNIV

SEQ ID NO: 1974047 - protein, 9 aa, Staphylococcus
PSRQSERFD

SEQ ID NO: 1974048 - protein, 4 aa, Staphylococcus
PSRS

SEQ ID NO: 1974049 - protein, 7 aa, Staphylococcus
PSRSELN

SEQ ID NO: 1974050 - protein, 6 aa, Staphylococcus
PSRSID

SEQ ID NO: 1974051 - protein, 7 aa, Staphylococcus
PSRSIDD

SEQ ID NO: 1974052 - protein, 7 aa, Staphylococcus
PSRTDSD

SEQ ID NO: 1974053 - protein, 7 aa, Staphylococcus
PSRTIED

SEQ ID NO: 1974054 - protein, 10 aa, Staphylococcus
PSRVKTPQDV

SEQ ID NO: 1974055 - protein, 10 aa, Staphylococcus
PSRVQTPSDV

SEQ ID NO: 1974056 - protein, 14 aa, Staphylococcus
PSSAQARPKLQQTL

SEQ ID NO: 1974057 - protein, 10 aa, Staphylococcus
PSSAQARPYL

SEQ ID NO: 1974058 - protein, 6 aa, Staphylococcus
PSSDCP

SEQ ID NO: 1974059 - protein, 6 aa, Staphylococcus
PSSDDV

SEQ ID NO: 1974060 - protein, 9 aa, Staphylococcus
PSSDEDIAS

SEQ ID NO: 1974061 - protein, 5 aa, Staphylococcus
PSSDG

SEQ ID NO: 1974062 - protein, 6 aa, Staphylococcus
PSSDKH

SEQ ID NO: 1974063 - protein, 8 aa, Staphylococcus
PSSEGKEH

SEQ ID NO: 1974064 - protein, 8 aa, Staphylococcus
PSSESDKI

SEQ ID NO: 1974065 - protein, 7 aa, Staphylococcus
PSSETPR

SEQ ID NO: 1974066 - protein, 7 aa, Staphylococcus
PSSFNDT

SEQ ID NO: 1974067 - protein, 9 aa, Staphylococcus
PSSFNSQST

SEQ ID NO: 1974068 - protein, 8 aa, Staphylococcus
PSSHAKAL

SEQ ID NO: 1974069 - protein, 12 aa, Staphylococcus
PSSKDEAEKIKP

SEQ ID NO: 1974070 - protein, 10 aa, Staphylococcus
PSSKEENTLN

SEQ ID NO: 1974071 - protein, 5 aa, Staphylococcus
PSSKF

SEQ ID NO: 1974072 - protein, 10 aa, Staphylococcus
PSSKFRSSGF

SEQ ID NO: 1974073 - protein, 9 aa, Staphylococcus
PSSPEQDIH

SEQ ID NO: 1974074 - protein, 10 aa, Staphylococcus
PSSRTDRGVH

SEQ ID NO: 1974075 - protein, 10 aa, Staphylococcus
PSSSHTAGAV

SEQ ID NO: 1974076 - protein, 19 aa, Staphylococcus
PSSSHTAGAVKIGNSAGSV

SEQ ID NO: 1974077 - protein, 7 aa, Staphylococcus
PSSVKRG

SEQ ID NO: 1974078 - protein, 15 aa, Staphylococcus
PSTEAEKYDKNLNNN

SEQ ID NO: 1974079 - protein, 6 aa, Staphylococcus
PSTEED

SEQ ID NO: 1974080 - protein, 7 aa, Staphylococcus
PSTEGTG

SEQ ID NO: 1974081 - protein, 5 aa, Staphylococcus
PSTEN

SEQ ID NO: 1974082 - protein, 6 aa, Staphylococcus
PSTENV

SEQ ID NO: 1974083 - protein, 5 aa, Staphylococcus
PSTET

SEQ ID NO: 1974084 - protein, 6 aa, Staphylococcus
PSTFPP

SEQ ID NO: 1974085 - protein, 4 aa, Staphylococcus
PSTG

SEQ ID NO: 1974086 - protein, 5 aa, Staphylococcus
PSTKF

SEQ ID NO: 1974087 - protein, 4 aa, Staphylococcus
PSTL

SEQ ID NO: 1974088 - protein, 10 aa, Staphylococcus
PSTLSNHANT

SEQ ID NO: 1974089 - protein, 4 aa, Staphylococcus
PSTM

SEQ ID NO: 1974090 - protein, 5 aa, Staphylococcus
PSTNA

SEQ ID NO: 1974091 - protein, 12 aa, Staphylococcus
PSTNEEAQEIKP

SEQ ID NO: 1974092 - protein, 5 aa, Staphylococcus
PSTRE

SEQ ID NO: 1974093 - protein, 11 aa, Staphylococcus
PSTRLGEKQGK

SEQ ID NO: 1974094 - protein, 7 aa, Staphylococcus
PSTRTRA

SEQ ID NO: 1974095 - protein, 8 aa, Staphylococcus
PSTRTRSA

SEQ ID NO: 1974096 - protein, 6 aa, Staphylococcus
PSTSDV

SEQ ID NO: 1974097 - protein, 23 aa, Staphylococcus
PSTSPTPDKNTTEQTKPTTKKVK

SEQ ID NO: 1974098 - protein, 5 aa, Staphylococcus
PSTYP

SEQ ID NO: 1974099 - protein, 17 aa, Staphylococcus
PSTYPPLKYTFNQIVIK

SEQ ID NO: 1974100 - protein, 17 aa, Staphylococcus
PSTYPPLSYTFDHIIVK

SEQ ID NO: 1974101 - protein, 17 aa, Staphylococcus
PSTYPPLSYTFDHIVVK

SEQ ID NO: 1974102 - protein, 5 aa, Staphylococcus
PSVAR

SEQ ID NO: 1974103 - protein, 13 aa, Staphylococcus
PSVEKRSKPDFER

SEQ ID NO: 1974104 - protein, 4 aa, Staphylococcus
PSVG

SEQ ID NO: 1974105 - protein, 5 aa, Staphylococcus
PSVGL

SEQ ID NO: 1974106 - protein, 8 aa, Staphylococcus
PSVGLPDE

SEQ ID NO: 1974107 - protein, 10 aa, Staphylococcus
PSVGLSKELR

SEQ ID NO: 1974108 - protein, 7 aa, Staphylococcus
PSVGLSN

SEQ ID NO: 1974109 - protein, 9 aa, Staphylococcus
PSVNEKEVS

SEQ ID NO: 1974110 - protein, 7 aa, Staphylococcus
PSVSPLK

SEQ ID NO: 1974111 - protein, 4 aa, Staphylococcus
PSVT

SEQ ID NO: 1974112 - protein, 5 aa, Staphylococcus
PSVTE

SEQ ID NO: 1974113 - protein, 8 aa, Staphylococcus
PSWSEDSD

SEQ ID NO: 1974114 - protein, 4 aa, Staphylococcus
PSYE

SEQ ID NO: 1974115 - protein, 13 aa, Staphylococcus
PSYEGKISPKEVN

SEQ ID NO: 1974116 - protein, 4 aa, Staphylococcus
PSYI

SEQ ID NO: 1974117 - protein, 5 aa, Staphylococcus
PSYNV

SEQ ID NO: 1974118 - protein, 7 aa, Staphylococcus
PSYPPIK

SEQ ID NO: 1974119 - protein, 16 aa, Staphylococcus
PSYPPIKQTLDKKQMP

SEQ ID NO: 1974120 - protein, 19 aa, Staphylococcus
PSYRDKNKQIKMIKKLESL

SEQ ID NO: 1974121 - protein, 4 aa, Staphylococcus
PSYS

SEQ ID NO: 1974122 - protein, 7 aa, Staphylococcus
PSYSPHS

SEQ ID NO: 1974123 - protein, 13 aa, Staphylococcus
PSYSPQTPYCYIY

SEQ ID NO: 1974124 - protein, 7 aa, Staphylococcus
PSYSPRS

SEQ ID NO: 1974125 - protein, 8 aa, Staphylococcus
PSYSPTSI

SEQ ID NO: 1974126 - protein, 7 aa, Staphylococcus
PSYTQEE

SEQ ID NO: 1974127 - protein, 4 aa, Staphylococcus
PTAA

SEQ ID NO: 1974128 - protein, 5 aa, Staphylococcus
PTAAM

SEQ ID NO: 1974129 - protein, 17 aa, Staphylococcus
PTADLEDDKPQLPDEDA

SEQ ID NO: 1974130 - protein, 4 aa, Staphylococcus
PTAE

SEQ ID NO: 1974131 - protein, 5 aa, Staphylococcus
PTAED

SEQ ID NO: 1974132 - protein, 5 aa, Staphylococcus
PTAEI

SEQ ID NO: 1974133 - protein, 10 aa, Staphylococcus
PTAGLDPKSR

SEQ ID NO: 1974134 - protein, 12 aa, Staphylococcus
PTAGLDPKSRDQ

SEQ ID NO: 1974135 - protein, 12 aa, Staphylococcus
PTAGLDPKSRQQ

SEQ ID NO: 1974136 - protein, 9 aa, Staphylococcus
PTAGLDPQS

SEQ ID NO: 1974137 - protein, 12 aa, Staphylococcus
PTAGLDPQSKKQ

SEQ ID NO: 1974138 - protein, 12 aa, Staphylococcus
PTAGTPIKATSA

SEQ ID NO: 1974139 - protein, 4 aa, Staphylococcus
PTAK

SEQ ID NO: 1974140 - protein, 7 aa, Staphylococcus
PTANNDR

SEQ ID NO: 1974141 - protein, 9 aa, Staphylococcus
PTATDKGHD

SEQ ID NO: 1974142 - protein, 8 aa, Staphylococcus
PTATLTDK

SEQ ID NO: 1974143 - protein, 5 aa, Staphylococcus
PTAVP

SEQ ID NO: 1974144 - protein, 10 aa, Staphylococcus
PTCGSNPSFP

SEQ ID NO: 1974145 - protein, 20 aa, Staphylococcus
PTCHTKKNIQRKTNARCPNC

SEQ ID NO: 1974146 - protein, 20 aa, Staphylococcus
PTCKTKKNIQRKTNARCPNC

SEQ ID NO: 1974147 - protein, 20 aa, Staphylococcus
PTCKTKKNVQRKTNARCPNC

SEQ ID NO: 1974148 - protein, 16 aa, Staphylococcus
PTCTDEDVNAAKALKD

SEQ ID NO: 1974149 - protein, 16 aa, Staphylococcus
PTCTDEDVNAAKDLKD

SEQ ID NO: 1974150 - protein, 16 aa, Staphylococcus
PTCTEEDVNAAKALKD

SEQ ID NO: 1974151 - protein, 13 aa, Staphylococcus
PTCTEEDVNAAQA

SEQ ID NO: 1974152 - protein, 14 aa, Staphylococcus
PTCTEQDKAAAQAL

SEQ ID NO: 1974153 - protein, 14 aa, Staphylococcus
PTCTEQDVQAAEAL

SEQ ID NO: 1974154 - protein, 6 aa, Staphylococcus
PTDAED

SEQ ID NO: 1974155 - protein, 7 aa, Staphylococcus
PTDAEDS

SEQ ID NO: 1974156 - protein, 16 aa, Staphylococcus
PTDAEGQYQDRGSQYR

SEQ ID NO: 1974157 - protein, 4 aa, Staphylococcus
PTDD

SEQ ID NO: 1974158 - protein, 27 aa, Staphylococcus
PTDEDDADAKEKREQYTKPDAKAIGTL

SEQ ID NO: 1974159 - protein, 25 aa, Staphylococcus
PTDEDDADAKQKQEKYNKASSNTIG

SEQ ID NO: 1974160 - protein, 23 aa, Staphylococcus
PTDEDDADAKQKQERYATSSNQL

SEQ ID NO: 1974161 - protein, 7 aa, Staphylococcus
PTDENYQ

SEQ ID NO: 1974162 - protein, 9 aa, Staphylococcus
PTDETTSIS

SEQ ID NO: 1974163 - protein, 16 aa, Staphylococcus
PTDGAFDYNKKDDVVE

SEQ ID NO: 1974164 - protein, 11 aa, Staphylococcus
PTDGPFEYKKQ

SEQ ID NO: 1974165 - protein, 12 aa, Staphylococcus
PTDIRKSKNTTF

SEQ ID NO: 1974166 - protein, 5 aa, Staphylococcus
PTDIT

SEQ ID NO: 1974167 - protein, 11 aa, Staphylococcus
PTDKPVQREDY

SEQ ID NO: 1974168 - protein, 8 aa, Staphylococcus
PTDKSYQL

SEQ ID NO: 1974169 - protein, 10 aa, Staphylococcus
PTDKSYQLSE

SEQ ID NO: 1974170 - protein, 6 aa, Staphylococcus
PTDKVQ

SEQ ID NO: 1974171 - protein, 5 aa, Staphylococcus
PTDLS

SEQ ID NO: 1974172 - protein, 5 aa, Staphylococcus
PTDND

SEQ ID NO: 1974173 - protein, 13 aa, Staphylococcus
PTDTLENSQYVNE

SEQ ID NO: 1974174 - protein, 11 aa, Staphylococcus
PTDVTQKDSVD

SEQ ID NO: 1974175 - protein, 16 aa, Staphylococcus
PTDYDENNNYFDTSTV

SEQ ID NO: 1974176 - protein, 4 aa, Staphylococcus
PTEA

SEQ ID NO: 1974177 - protein, 4 aa, Staphylococcus
PTED

SEQ ID NO: 1974178 - protein, 17 aa, Staphylococcus
PTEDDGETTSQKQLEEL

SEQ ID NO: 1974179 - protein, 4 aa, Staphylococcus
PTEE

SEQ ID NO: 1974180 - protein, 8 aa, Staphylococcus
PTEERQTI

SEQ ID NO: 1974181 - protein, 6 aa, Staphylococcus
PTEEVR

SEQ ID NO: 1974182 - protein, 10 aa, Staphylococcus
PTEGENSRER

SEQ ID NO: 1974183 - protein, 15 aa, Staphylococcus
PTEGNLSISNTEITD

SEQ ID NO: 1974184 - protein, 4 aa, Staphylococcus
PTEI

SEQ ID NO: 1974185 - protein, 9 aa, Staphylococcus
PTEKSYQLS

SEQ ID NO: 1974186 - protein, 13 aa, Staphylococcus
PTELKKKDGYVST

SEQ ID NO: 1974187 - protein, 4 aa, Staphylococcus
PTEQ

SEQ ID NO: 1974188 - protein, 7 aa, Staphylococcus
PTEQSAQ

SEQ ID NO: 1974189 - protein, 9 aa, Staphylococcus
PTESLQPDQ

SEQ ID NO: 1974190 - protein, 4 aa, Staphylococcus
PTET

SEQ ID NO: 1974191 - protein, 10 aa, Staphylococcus
PTETYESRAN

SEQ ID NO: 1974192 - protein, 4 aa, Staphylococcus
PTEY

SEQ ID NO: 1974193 - protein, 5 aa, Staphylococcus
PTEYG

SEQ ID NO: 1974194 - protein, 6 aa, Staphylococcus
PTEYGT

SEQ ID NO: 1974195 - protein, 7 aa, Staphylococcus
PTEYGTL

SEQ ID NO: 1974196 - protein, 5 aa, Staphylococcus
PTEYI

SEQ ID NO: 1974197 - protein, 10 aa, Staphylococcus
PTFASGTSIR

SEQ ID NO: 1974198 - protein, 8 aa, Staphylococcus
PTFHDPKK

SEQ ID NO: 1974199 - protein, 8 aa, Staphylococcus
PTFRPGDT

SEQ ID NO: 1974200 - protein, 7 aa, Staphylococcus
PTFRSGD

SEQ ID NO: 1974201 - protein, 24 aa, Staphylococcus
PTGDGDPIVGPREQWNDGSNTLTI

SEQ ID NO: 1974202 - protein, 5 aa, Staphylococcus
PTGEG

SEQ ID NO: 1974203 - protein, 12 aa, Staphylococcus
PTGMEITDEGER

SEQ ID NO: 1974204 - protein, 16 aa, Staphylococcus
PTGMEITEEGKATVRQ

SEQ ID NO: 1974205 - protein, 21 aa, Staphylococcus
PTGNGDIIDGAREQWNDGSNT

SEQ ID NO: 1974206 - protein, 24 aa, Staphylococcus
PTGNGDVIDGAREQWNDGSNTLTI

SEQ ID NO: 1974207 - protein, 7 aa, Staphylococcus
PTGPNVT

SEQ ID NO: 1974208 - protein, 8 aa, Staphylococcus
PTGTLEDG

SEQ ID NO: 1974209 - protein, 5 aa, Staphylococcus
PTHEM

SEQ ID NO: 1974210 - protein, 11 aa, Staphylococcus
PTHKNNPYKGY

SEQ ID NO: 1974211 - protein, 4 aa, Staphylococcus
PTHN

SEQ ID NO: 1974212 - protein, 5 aa, Staphylococcus
PTHNE

SEQ ID NO: 1974213 - protein, 6 aa, Staphylococcus
PTHPLT

SEQ ID NO: 1974214 - protein, 7 aa, Staphylococcus
PTHPLTK

SEQ ID NO: 1974215 - protein, 10 aa, Staphylococcus
PTHPNNPYKG

SEQ ID NO: 1974216 - protein, 7 aa, Staphylococcus
PTHQDGT

SEQ ID NO: 1974217 - protein, 4 aa, Staphylococcus
PTIA

SEQ ID NO: 1974218 - protein, 4 aa, Staphylococcus
PTID

SEQ ID NO: 1974219 - protein, 16 aa, Staphylococcus
PTIGKGNNNGIEIDDG

SEQ ID NO: 1974220 - protein, 4 aa, Staphylococcus
PTII

SEQ ID NO: 1974221 - protein, 4 aa, Staphylococcus
PTIK

SEQ ID NO: 1974222 - protein, 17 aa, Staphylococcus
PTILNENANKDSNTFST

SEQ ID NO: 1974223 - protein, 8 aa, Staphylococcus
PTIPNYDG

SEQ ID NO: 1974224 - protein, 8 aa, Staphylococcus
PTIPPSVK

SEQ ID NO: 1974225 - protein, 4 aa, Staphylococcus
PTIQ

SEQ ID NO: 1974226 - protein, 6 aa, Staphylococcus
PTIQNF

SEQ ID NO: 1974227 - protein, 14 aa, Staphylococcus
PTIQTTQSTEKKNN

SEQ ID NO: 1974228 - protein, 5 aa, Staphylococcus
PTISK

SEQ ID NO: 1974229 - protein, 5 aa, Staphylococcus
PTISN

SEQ ID NO: 1974230 - protein, 6 aa, Staphylococcus
PTISTK

SEQ ID NO: 1974231 - protein, 4 aa, Staphylococcus
PTIV

SEQ ID NO: 1974232 - protein, 8 aa, Staphylococcus
PTKANQYQ

SEQ ID NO: 1974233 - protein, 9 aa, Staphylococcus
PTKGAANNL

SEQ ID NO: 1974234 - protein, 5 aa, Staphylococcus
PTKHD

SEQ ID NO: 1974235 - protein, 14 aa, Staphylococcus
PTKHSAKLTQATAR

SEQ ID NO: 1974236 - protein, 10 aa, Staphylococcus
PTKISDRQKE

SEQ ID NO: 1974237 - protein, 10 aa, Staphylococcus
PTKKVDNDLE

SEQ ID NO: 1974238 - protein, 4 aa, Staphylococcus
PTKL

SEQ ID NO: 1974239 - protein, 14 aa, Staphylococcus
PTKLKNPPANWPRT

SEQ ID NO: 1974240 - protein, 10 aa, Staphylococcus
PTKLNDKQKS

SEQ ID NO: 1974241 - protein, 10 aa, Staphylococcus
PTKLNEKQKE

SEQ ID NO: 1974242 - protein, 10 aa, Staphylococcus
PTKLTDRQKE

SEQ ID NO: 1974243 - protein, 10 aa, Staphylococcus
PTKMNDRQKE

SEQ ID NO: 1974244 - protein, 9 aa, Staphylococcus
PTKMTERQK

SEQ ID NO: 1974245 - protein, 7 aa, Staphylococcus
PTKNEEV

SEQ ID NO: 1974246 - protein, 14 aa, Staphylococcus
PTKPINDKKLKEEI

SEQ ID NO: 1974247 - protein, 8 aa, Staphylococcus
PTKRNDKL

SEQ ID NO: 1974248 - protein, 8 aa, Staphylococcus
PTKSSQTE

SEQ ID NO: 1974249 - protein, 11 aa, Staphylococcus
PTKVTEGTSHF

SEQ ID NO: 1974250 - protein, 15 aa, Staphylococcus
PTKVTEGTSQFSPLK

SEQ ID NO: 1974251 - protein, 5 aa, Staphylococcus
PTKVV

SEQ ID NO: 1974252 - protein, 19 aa, Staphylococcus
PTKVYESDTSRDARTQGGQ

SEQ ID NO: 1974253 - protein, 4 aa, Staphylococcus
PTLE

SEQ ID NO: 1974254 - protein, 5 aa, Staphylococcus
PTLEA

SEQ ID NO: 1974255 - protein, 11 aa, Staphylococcus
PTLEQKEQSRL

SEQ ID NO: 1974256 - protein, 10 aa, Staphylococcus
PTLGTRTANI

SEQ ID NO: 1974257 - protein, 7 aa, Staphylococcus
PTLGVPS

SEQ ID NO: 1974258 - protein, 19 aa, Staphylococcus
PTLKPDTNDDSHGVYSGSA

SEQ ID NO: 1974259 - protein, 7 aa, Staphylococcus
PTLPGSL

SEQ ID NO: 1974260 - protein, 22 aa, Staphylococcus
PTLSTGTFDGSSLATDSNGGVM

SEQ ID NO: 1974261 - protein, 5 aa, Staphylococcus
PTLTE

SEQ ID NO: 1974262 - protein, 6 aa, Staphylococcus
PTMPEK

SEQ ID NO: 1974263 - protein, 8 aa, Staphylococcus
PTNAQKYK

SEQ ID NO: 1974264 - protein, 5 aa, Staphylococcus
PTNAR

SEQ ID NO: 1974265 - protein, 5 aa, Staphylococcus
PTNDT

SEQ ID NO: 1974266 - protein, 11 aa, Staphylococcus
PTNDTMKKIPG

SEQ ID NO: 1974267 - protein, 5 aa, Staphylococcus
PTNET

SEQ ID NO: 1974268 - protein, 5 aa, Staphylococcus
PTNGN

SEQ ID NO: 1974269 - protein, 6 aa, Staphylococcus
PTNNKE

SEQ ID NO: 1974270 - protein, 6 aa, Staphylococcus
PTNNKN

SEQ ID NO: 1974271 - protein, 13 aa, Staphylococcus
PTNNTLATKEQLK

SEQ ID NO: 1974272 - protein, 13 aa, Staphylococcus
PTNPTGVTLSQSE

SEQ ID NO: 1974273 - protein, 8 aa, Staphylococcus
PTNQAAEN

SEQ ID NO: 1974274 - protein, 12 aa, Staphylococcus
PTNSPDPDNQSG

SEQ ID NO: 1974275 - protein, 15 aa, Staphylococcus
PTNSPIKRDDRPDRV

SEQ ID NO: 1974276 - protein, 5 aa, Staphylococcus
PTNYS

SEQ ID NO: 1974277 - protein, 6 aa, Staphylococcus
PTPAGQ

SEQ ID NO: 1974278 - protein, 12 aa, Staphylococcus
PTPALGGYPKDE

SEQ ID NO: 1974279 - protein, 12 aa, Staphylococcus
PTPALGGYPKEK

SEQ ID NO: 1974280 - protein, 15 aa, Staphylococcus
PTPDDVDNLEREDDQ

SEQ ID NO: 1974281 - protein, 10 aa, Staphylococcus
PTPDKAEDNA

SEQ ID NO: 1974282 - protein, 5 aa, Staphylococcus
PTPDN

SEQ ID NO: 1974283 - protein, 9 aa, Staphylococcus
PTPGHTPGT

SEQ ID NO: 1974284 - protein, 9 aa, Staphylococcus
PTPGHTSGT

SEQ ID NO: 1974285 - protein, 6 aa, Staphylococcus
PTPIPD

SEQ ID NO: 1974286 - protein, 12 aa, Staphylococcus
PTPKEKSNYLPS

SEQ ID NO: 1974287 - protein, 22 aa, Staphylococcus
PTPKEVKEFENESDRGAYGSTG

SEQ ID NO: 1974288 - protein, 11 aa, Staphylococcus
PTPNNDDEYES

SEQ ID NO: 1974289 - protein, 5 aa, Staphylococcus
PTPPH

SEQ ID NO: 1974290 - protein, 5 aa, Staphylococcus
PTPSL

SEQ ID NO: 1974291 - protein, 4 aa, Staphylococcus
PTPT

SEQ ID NO: 1974292 - protein, 5 aa, Staphylococcus
PTPTF

SEQ ID NO: 1974293 - protein, 12 aa, Staphylococcus
PTPVEKSNYLPS

SEQ ID NO: 1974294 - protein, 7 aa, Staphylococcus
PTQDELD

SEQ ID NO: 1974295 - protein, 4 aa, Staphylococcus
PTQE

SEQ ID NO: 1974296 - protein, 8 aa, Staphylococcus
PTQEELDE

SEQ ID NO: 1974297 - protein, 9 aa, Staphylococcus
PTQEELEEL

SEQ ID NO: 1974298 - protein, 4 aa, Staphylococcus
PTQI

SEQ ID NO: 1974299 - protein, 4 aa, Staphylococcus
PTQN

SEQ ID NO: 1974300 - protein, 5 aa, Staphylococcus
PTQPN

SEQ ID NO: 1974301 - protein, 5 aa, Staphylococcus
PTQRI

SEQ ID NO: 1974302 - protein, 5 aa, Staphylococcus
PTQSI

SEQ ID NO: 1974303 - protein, 10 aa, Staphylococcus
PTRANPTDSG

SEQ ID NO: 1974304 - protein, 11 aa, Staphylococcus
PTREDKHELPP

SEQ ID NO: 1974305 - protein, 5 aa, Staphylococcus
PTREE

SEQ ID NO: 1974306 - protein, 10 aa, Staphylococcus
PTRGREKQKI

SEQ ID NO: 1974307 - protein, 4 aa, Staphylococcus
PTRI

SEQ ID NO: 1974308 - protein, 12 aa, Staphylococcus
PTRINDLSKSGH

SEQ ID NO: 1974309 - protein, 9 aa, Staphylococcus
PTRREAINT

SEQ ID NO: 1974310 - protein, 8 aa, Staphylococcus
PTRTPNIA

SEQ ID NO: 1974311 - protein, 7 aa, Staphylococcus
PTSAESC

SEQ ID NO: 1974312 - protein, 9 aa, Staphylococcus
PTSALDQEN

SEQ ID NO: 1974313 - protein, 5 aa, Staphylococcus
PTSAM

SEQ ID NO: 1974314 - protein, 5 aa, Staphylococcus
PTSGL

SEQ ID NO: 1974315 - protein, 10 aa, Staphylococcus
PTSIEGELPA

SEQ ID NO: 1974316 - protein, 9 aa, Staphylococcus
PTSKDELTH

SEQ ID NO: 1974317 - protein, 10 aa, Staphylococcus
PTSKGNEIIG

SEQ ID NO: 1974318 - protein, 4 aa, Staphylococcus
PTSM

SEQ ID NO: 1974319 - protein, 9 aa, Staphylococcus
PTSNDEQKK

SEQ ID NO: 1974320 - protein, 6 aa, Staphylococcus
PTSNQF

SEQ ID NO: 1974321 - protein, 7 aa, Staphylococcus
PTSNYKR

SEQ ID NO: 1974322 - protein, 9 aa, Staphylococcus
PTSRTDRGV

SEQ ID NO: 1974323 - protein, 15 aa, Staphylococcus
PTSSFTPEESPDPGF

SEQ ID NO: 1974324 - protein, 5 aa, Staphylococcus
PTSSI

SEQ ID NO: 1974325 - protein, 15 aa, Staphylococcus
PTSSIPSADEITTFE

SEQ ID NO: 1974326 - protein, 9 aa, Staphylococcus
PTSSREDAM

SEQ ID NO: 1974327 - protein, 10 aa, Staphylococcus
PTSVEGELPE

SEQ ID NO: 1974328 - protein, 5 aa, Staphylococcus
PTTAM

SEQ ID NO: 1974329 - protein, 6 aa, Staphylococcus
PTTAMD

SEQ ID NO: 1974330 - protein, 11 aa, Staphylococcus
PTTFNNPRRMA

SEQ ID NO: 1974331 - protein, 7 aa, Staphylococcus
PTTGERA

SEQ ID NO: 1974332 - protein, 6 aa, Staphylococcus
PTTGKQ

SEQ ID NO: 1974333 - protein, 7 aa, Staphylococcus
PTTIGEN

SEQ ID NO: 1974334 - protein, 7 aa, Staphylococcus
PTTKQRL

SEQ ID NO: 1974335 - protein, 6 aa, Staphylococcus
PTTMGS

SEQ ID NO: 1974336 - protein, 11 aa, Staphylococcus
PTTQRCNTDSV

SEQ ID NO: 1974337 - protein, 6 aa, Staphylococcus
PTTSMD

SEQ ID NO: 1974338 - protein, 21 aa, Staphylococcus
PTTVTNGTSHLSPIKEERVAN

SEQ ID NO: 1974339 - protein, 5 aa, Staphylococcus
PTTWD

SEQ ID NO: 1974340 - protein, 6 aa, Staphylococcus
PTTYET

SEQ ID NO: 1974341 - protein, 9 aa, Staphylococcus
PTVEEKEVS

SEQ ID NO: 1974342 - protein, 9 aa, Staphylococcus
PTVEQKEVS

SEQ ID NO: 1974343 - protein, 5 aa, Staphylococcus
PTVGN

SEQ ID NO: 1974344 - protein, 6 aa, Staphylococcus
PTVQQN

SEQ ID NO: 1974345 - protein, 12 aa, Staphylococcus
PTVSKQEKEENI

SEQ ID NO: 1974346 - protein, 13 aa, Staphylococcus
PTVSKREKEENVD

SEQ ID NO: 1974347 - protein, 9 aa, Staphylococcus
PTYENNPDF

SEQ ID NO: 1974348 - protein, 7 aa, Staphylococcus
PTYHGSY

SEQ ID NO: 1974349 - protein, 4 aa, Staphylococcus
PTYK

SEQ ID NO: 1974350 - protein, 7 aa, Staphylococcus
PTYTGKA

SEQ ID NO: 1974351 - protein, 5 aa, Staphylococcus
PVAAS

SEQ ID NO: 1974352 - protein, 6 aa, Staphylococcus
PVAASE

SEQ ID NO: 1974353 - protein, 7 aa, Staphylococcus
PVAASEK

SEQ ID NO: 1974354 - protein, 13 aa, Staphylococcus
PVADDLSKKLGKE

SEQ ID NO: 1974355 - protein, 12 aa, Staphylococcus
PVASLDPLTTKQ

SEQ ID NO: 1974356 - protein, 4 aa, Staphylococcus
PVDD

SEQ ID NO: 1974357 - protein, 14 aa, Staphylococcus
PVDDKGVFTDEAGQ

SEQ ID NO: 1974358 - protein, 8 aa, Staphylococcus
PVDESIEG

SEQ ID NO: 1974359 - protein, 12 aa, Staphylococcus
PVDNNNDSLEEY

SEQ ID NO: 1974360 - protein, 8 aa, Staphylococcus
PVDQGGQH

SEQ ID NO: 1974361 - protein, 4 aa, Staphylococcus
PVEG

SEQ ID NO: 1974362 - protein, 4 aa, Staphylococcus
PVEN

SEQ ID NO: 1974363 - protein, 8 aa, Staphylococcus
PVENDEDD

SEQ ID NO: 1974364 - protein, 4 aa, Staphylococcus
PVEQ

SEQ ID NO: 1974365 - protein, 4 aa, Staphylococcus
PVEY

SEQ ID NO: 1974366 - protein, 8 aa, Staphylococcus
PVFTKGDN

SEQ ID NO: 1974367 - protein, 9 aa, Staphylococcus
PVGAEKTEL

SEQ ID NO: 1974368 - protein, 9 aa, Staphylococcus
PVGAGKTQL

SEQ ID NO: 1974369 - protein, 10 aa, Staphylococcus
PVGDGGEGTM

SEQ ID NO: 1974370 - protein, 16 aa, Staphylococcus
PVGDRENSMTAGPRGP

SEQ ID NO: 1974371 - protein, 9 aa, Staphylococcus
PVGEDQKQH

SEQ ID NO: 1974372 - protein, 8 aa, Staphylococcus
PVGGESLS

SEQ ID NO: 1974373 - protein, 8 aa, Staphylococcus
PVGKDQAA

SEQ ID NO: 1974374 - protein, 11 aa, Staphylococcus
PVGMSQSKASV

SEQ ID NO: 1974375 - protein, 15 aa, Staphylococcus
PVGNYSEQTREDGTV

SEQ ID NO: 1974376 - protein, 21 aa, Staphylococcus
PVGNYSERVDEDGTVTPVNTP

SEQ ID NO: 1974377 - protein, 4 aa, Staphylococcus
PVGP

SEQ ID NO: 1974378 - protein, 7 aa, Staphylococcus
PVGRRSL

SEQ ID NO: 1974379 - protein, 11 aa, Staphylococcus
PVGSGDSSLAG

SEQ ID NO: 1974380 - protein, 12 aa, Staphylococcus
PVGSGDSTVAGI

SEQ ID NO: 1974381 - protein, 10 aa, Staphylococcus
PVGTTLDEAE

SEQ ID NO: 1974382 - protein, 10 aa, Staphylococcus
PVHGESGMDG

SEQ ID NO: 1974383 - protein, 12 aa, Staphylococcus
PVHSEQTKDEAL

SEQ ID NO: 1974384 - protein, 5 aa, Staphylococcus
PVHYE

SEQ ID NO: 1974385 - protein, 5 aa, Staphylococcus
PVIES

SEQ ID NO: 1974386 - protein, 14 aa, Staphylococcus
PVIPGSKDAVNNVS

SEQ ID NO: 1974387 - protein, 14 aa, Staphylococcus
PVIPGSKGAVNSVD

SEQ ID NO: 1974388 - protein, 7 aa, Staphylococcus
PVITPEK

SEQ ID NO: 1974389 - protein, 11 aa, Staphylococcus
PVKAEKDDTDL

SEQ ID NO: 1974390 - protein, 5 aa, Staphylococcus
PVKDI

SEQ ID NO: 1974391 - protein, 6 aa, Staphylococcus
PVKEVN

SEQ ID NO: 1974392 - protein, 22 aa, Staphylococcus
PVKPSSFDQRMDRPNNGREQQL

SEQ ID NO: 1974393 - protein, 4 aa, Staphylococcus
PVKQ

SEQ ID NO: 1974394 - protein, 4 aa, Staphylococcus
PVKS

SEQ ID NO: 1974395 - protein, 11 aa, Staphylococcus
PVKSKNKKKKI

SEQ ID NO: 1974396 - protein, 4 aa, Staphylococcus
PVKT

SEQ ID NO: 1974397 - protein, 11 aa, Staphylococcus
PVLKTGKTVDE

SEQ ID NO: 1974398 - protein, 4 aa, Staphylococcus
PVMP

SEQ ID NO: 1974399 - protein, 10 aa, Staphylococcus
PVNAPKRTHV

SEQ ID NO: 1974400 - protein, 11 aa, Staphylococcus
PVNDDSKQNEM

SEQ ID NO: 1974401 - protein, 16 aa, Staphylococcus
PVNEDTPKLTLNEGHT

SEQ ID NO: 1974402 - protein, 8 aa, Staphylococcus
PVNESKSY

SEQ ID NO: 1974403 - protein, 5 aa, Staphylococcus
PVNET

SEQ ID NO: 1974404 - protein, 10 aa, Staphylococcus
PVNGGEQSVA

SEQ ID NO: 1974405 - protein, 6 aa, Staphylococcus
PVNKTG

SEQ ID NO: 1974406 - protein, 5 aa, Staphylococcus
PVNNG

SEQ ID NO: 1974407 - protein, 10 aa, Staphylococcus
PVNPPERKHV

SEQ ID NO: 1974408 - protein, 11 aa, Staphylococcus
PVNPPERKNIP

SEQ ID NO: 1974409 - protein, 5 aa, Staphylococcus
PVNSD

SEQ ID NO: 1974410 - protein, 4 aa, Staphylococcus
PVNY

SEQ ID NO: 1974411 - protein, 13 aa, Staphylococcus
PVPAAERTLERQG

SEQ ID NO: 1974412 - protein, 4 aa, Staphylococcus
PVPE

SEQ ID NO: 1974413 - protein, 11 aa, Staphylococcus
PVPEKDELPKD

SEQ ID NO: 1974414 - protein, 21 aa, Staphylococcus
PVPERTKEHITSNGETKTPDE

SEQ ID NO: 1974415 - protein, 6 aa, Staphylococcus
PVPEYN

SEQ ID NO: 1974416 - protein, 5 aa, Staphylococcus
PVPKD

SEQ ID NO: 1974417 - protein, 6 aa, Staphylococcus
PVPKLP

SEQ ID NO: 1974418 - protein, 7 aa, Staphylococcus
PVPNGEK

SEQ ID NO: 1974419 - protein, 6 aa, Staphylococcus
PVPPKY

SEQ ID NO: 1974420 - protein, 7 aa, Staphylococcus
PVPREKL

SEQ ID NO: 1974421 - protein, 4 aa, Staphylococcus
PVQD

SEQ ID NO: 1974422 - protein, 11 aa, Staphylococcus
PVQRPTIEGRH

SEQ ID NO: 1974423 - protein, 15 aa, Staphylococcus
PVQRPTIEGRQKEIT

SEQ ID NO: 1974424 - protein, 4 aa, Staphylococcus
PVRE

SEQ ID NO: 1974425 - protein, 8 aa, Staphylococcus
PVRGQKKD

SEQ ID NO: 1974426 - protein, 4 aa, Staphylococcus
PVRP

SEQ ID NO: 1974427 - protein, 11 aa, Staphylococcus
PVSADDYRKYT

SEQ ID NO: 1974428 - protein, 17 aa, Staphylococcus
PVSAGLGGGSADAAATM

SEQ ID NO: 1974429 - protein, 16 aa, Staphylococcus
PVSDRENSMTAGPRGP

SEQ ID NO: 1974430 - protein, 9 aa, Staphylococcus
PVSDTSSHY

SEQ ID NO: 1974431 - protein, 16 aa, Staphylococcus
PVSEALENETELGGAT

SEQ ID NO: 1974432 - protein, 9 aa, Staphylococcus
PVSEETVAK

SEQ ID NO: 1974433 - protein, 7 aa, Staphylococcus
PVSGPEI

SEQ ID NO: 1974434 - protein, 9 aa, Staphylococcus
PVSKDIPST

SEQ ID NO: 1974435 - protein, 12 aa, Staphylococcus
PVSLSSKTNVIT

SEQ ID NO: 1974436 - protein, 8 aa, Staphylococcus
PVSSEDEA

SEQ ID NO: 1974437 - protein, 7 aa, Staphylococcus
PVTDEEW

SEQ ID NO: 1974438 - protein, 11 aa, Staphylococcus
PVTDEKSMAQN

SEQ ID NO: 1974439 - protein, 6 aa, Staphylococcus
PVTEDE

SEQ ID NO: 1974440 - protein, 6 aa, Staphylococcus
PVTENY

SEQ ID NO: 1974441 - protein, 7 aa, Staphylococcus
PVTNEGV

SEQ ID NO: 1974442 - protein, 13 aa, Staphylococcus
PVTNFEEANKSNL

SEQ ID NO: 1974443 - protein, 12 aa, Staphylococcus
PVTNFEQANKSD

SEQ ID NO: 1974444 - protein, 13 aa, Staphylococcus
PVTNFEQANNSDL

SEQ ID NO: 1974445 - protein, 8 aa, Staphylococcus
PVTNSYPE

SEQ ID NO: 1974446 - protein, 6 aa, Staphylococcus
PVTPTN

SEQ ID NO: 1974447 - protein, 6 aa, Staphylococcus
PVTQRP

SEQ ID NO: 1974448 - protein, 5 aa, Staphylococcus
PVTRG

SEQ ID NO: 1974449 - protein, 12 aa, Staphylococcus
PVTRIEKSTNDS

SEQ ID NO: 1974450 - protein, 6 aa, Staphylococcus
PVTTHS

SEQ ID NO: 1974451 - protein, 5 aa, Staphylococcus
PVTVD

SEQ ID NO: 1974452 - protein, 4 aa, Staphylococcus
PVVS

SEQ ID NO: 1974453 - protein, 10 aa, Staphylococcus
PVYDPPEQYM

SEQ ID NO: 1974454 - protein, 12 aa, Staphylococcus
PVYKENKDGSIE

SEQ ID NO: 1974455 - protein, 9 aa, Staphylococcus
PVYSRTNPF

SEQ ID NO: 1974456 - protein, 4 aa, Staphylococcus
PVYT

SEQ ID NO: 1974457 - protein, 17 aa, Staphylococcus
PVYVGQTGGYSTTYKPI

SEQ ID NO: 1974458 - protein, 19 aa, Staphylococcus
PWGGYKQSGIGRELGKEGL

SEQ ID NO: 1974459 - protein, 22 aa, Staphylococcus
PWGGYKQSGIGRELGKEGLAEY

SEQ ID NO: 1974460 - protein, 4 aa, Staphylococcus
PWPD

SEQ ID NO: 1974461 - protein, 7 aa, Staphylococcus
PWPPSED

SEQ ID NO: 1974462 - protein, 5 aa, Staphylococcus
PWPSY

SEQ ID NO: 1974463 - protein, 5 aa, Staphylococcus
PWPTY

SEQ ID NO: 1974464 - protein, 10 aa, Staphylococcus
PWSKREAKDY

SEQ ID NO: 1974465 - protein, 9 aa, Staphylococcus
PYAAPPADA

SEQ ID NO: 1974466 - protein, 7 aa, Staphylococcus
PYAEENN

SEQ ID NO: 1974467 - protein, 9 aa, Staphylococcus
PYAGDKGGQ

SEQ ID NO: 1974468 - protein, 6 aa, Staphylococcus
PYAGQT

SEQ ID NO: 1974469 - protein, 8 aa, Staphylococcus
PYAGSKGG

SEQ ID NO: 1974470 - protein, 7 aa, Staphylococcus
PYAPPSK

SEQ ID NO: 1974471 - protein, 9 aa, Staphylococcus
PYATPPEDA

SEQ ID NO: 1974472 - protein, 24 aa, Staphylococcus
PYATPPKDAYDLTNELEDAPDEAE

SEQ ID NO: 1974473 - protein, 6 aa, Staphylococcus
PYDDAQ

SEQ ID NO: 1974474 - protein, 17 aa, Staphylococcus
PYDSPEEMEEFIKELLN

SEQ ID NO: 1974475 - protein, 8 aa, Staphylococcus
PYEDSTQA

SEQ ID NO: 1974476 - protein, 5 aa, Staphylococcus
PYEGE

SEQ ID NO: 1974477 - protein, 5 aa, Staphylococcus
PYEGG

SEQ ID NO: 1974478 - protein, 5 aa, Staphylococcus
PYEHE

SEQ ID NO: 1974479 - protein, 5 aa, Staphylococcus
PYEKG

SEQ ID NO: 1974480 - protein, 13 aa, Staphylococcus
PYEKGQTKAIYTG

SEQ ID NO: 1974481 - protein, 16 aa, Staphylococcus
PYENQKQKYFEDIFQK

SEQ ID NO: 1974482 - protein, 5 aa, Staphylococcus
PYEPQ

SEQ ID NO: 1974483 - protein, 6 aa, Staphylococcus
PYERPL

SEQ ID NO: 1974484 - protein, 4 aa, Staphylococcus
PYET

SEQ ID NO: 1974485 - protein, 5 aa, Staphylococcus
PYETS

SEQ ID NO: 1974486 - protein, 20 aa, Staphylococcus
PYFASKQKKLRKTVKSLETR

SEQ ID NO: 1974487 - protein, 10 aa, Staphylococcus
PYGDSSSRFD

SEQ ID NO: 1974488 - protein, 12 aa, Staphylococcus
PYGEQKDAAEVE

SEQ ID NO: 1974489 - protein, 5 aa, Staphylococcus
PYGET

SEQ ID NO: 1974490 - protein, 12 aa, Staphylococcus
PYGKQKDADEVE

SEQ ID NO: 1974491 - protein, 11 aa, Staphylococcus
PYGPRPGDEVK

SEQ ID NO: 1974492 - protein, 10 aa, Staphylococcus
PYHSIPSEKD

SEQ ID NO: 1974493 - protein, 10 aa, Staphylococcus
PYKDSKPLKV

SEQ ID NO: 1974494 - protein, 8 aa, Staphylococcus
PYKEGNTV

SEQ ID NO: 1974495 - protein, 5 aa, Staphylococcus
PYLDG

SEQ ID NO: 1974496 - protein, 4 aa, Staphylococcus
PYLP

SEQ ID NO: 1974497 - protein, 4 aa, Staphylococcus
PYLS

SEQ ID NO: 1974498 - protein, 19 aa, Staphylococcus
PYLSPSRREKLSRLYHRAC

SEQ ID NO: 1974499 - protein, 9 aa, Staphylococcus
PYNDASQKV

SEQ ID NO: 1974500 - protein, 8 aa, Staphylococcus
PYNNAAKV

SEQ ID NO: 1974501 - protein, 5 aa, Staphylococcus
PYNTK

SEQ ID NO: 1974502 - protein, 9 aa, Staphylococcus
PYNTNDEQI

SEQ ID NO: 1974503 - protein, 7 aa, Staphylococcus
PYPGGPH

SEQ ID NO: 1974504 - protein, 7 aa, Staphylococcus
PYPYNNK

SEQ ID NO: 1974505 - protein, 4 aa, Staphylococcus
PYQK

SEQ ID NO: 1974506 - protein, 5 aa, Staphylococcus
PYQLT

SEQ ID NO: 1974507 - protein, 10 aa, Staphylococcus
PYQNEAQQDN

SEQ ID NO: 1974508 - protein, 4 aa, Staphylococcus
PYQV

SEQ ID NO: 1974509 - protein, 11 aa, Staphylococcus
PYRIEGQKTGA

SEQ ID NO: 1974510 - protein, 11 aa, Staphylococcus
PYRLEGQKTGA

SEQ ID NO: 1974511 - protein, 11 aa, Staphylococcus
PYRLNGQGFKE

SEQ ID NO: 1974512 - protein, 4 aa, Staphylococcus
PYRN

SEQ ID NO: 1974513 - protein, 7 aa, Staphylococcus
PYRNEGL

SEQ ID NO: 1974514 - protein, 7 aa, Staphylococcus
PYRNQGI

SEQ ID NO: 1974515 - protein, 10 aa, Staphylococcus
PYRPSAKQFN

SEQ ID NO: 1974516 - protein, 6 aa, Staphylococcus
PYSDIP

SEQ ID NO: 1974517 - protein, 14 aa, Staphylococcus
PYSPAFRKSSMPDG

SEQ ID NO: 1974518 - protein, 13 aa, Staphylococcus
PYSSGAQKQLNSA

SEQ ID NO: 1974519 - protein, 7 aa, Staphylococcus
PYTDDKD

SEQ ID NO: 1974520 - protein, 15 aa, Staphylococcus
PYTNYGRPDSKYEQM

SEQ ID NO: 1974521 - protein, 20 aa, Staphylococcus
PYTREDRKVNKAFRHIGHSH

SEQ ID NO: 1974522 - protein, 16 aa, Staphylococcus
PYTSTGKLQRNKFELK

SEQ ID NO: 1974523 - protein, 22 aa, Staphylococcus
PYTSTGKLQRNKVMSKESKNED

SEQ ID NO: 1974524 - protein, 19 aa, Staphylococcus
PYTSTGKLQRSKVSYKGNQ

SEQ ID NO: 1974525 - protein, 12 aa, Staphylococcus
PYTSTGKLQRTR

SEQ ID NO: 1974526 - protein, 20 aa, Staphylococcus
PYTYTPYNEDGTLKKDTDLQ

SEQ ID NO: 1974527 - protein, 15 aa, Staphylococcus
PYVGEDKKNKKPPYK

SEQ ID NO: 1974528 - protein, 15 aa, Staphylococcus
PYVGEDKKNKKPPYR

SEQ ID NO: 1974529 - protein, 4 aa, Staphylococcus
PYYN

SEQ ID NO: 1974530 - protein, 4 aa, Staphylococcus
PYYQ

SEQ ID NO: 1974531 - protein, 5 aa, Staphylococcus
PYYYA

SEQ ID NO: 1974532 - protein, 15 aa, Staphylococcus
QAAAEQFKKQHTKGK

SEQ ID NO: 1974533 - protein, 11 aa, Staphylococcus
QAADAPNHGMR

SEQ ID NO: 1974534 - protein, 8 aa, Staphylococcus
QAAEEATQ

SEQ ID NO: 1974535 - protein, 6 aa, Staphylococcus
QAAEGI

SEQ ID NO: 1974536 - protein, 5 aa, Staphylococcus
QAAEI

SEQ ID NO: 1974537 - protein, 6 aa, Staphylococcus
QAAEIV

SEQ ID NO: 1974538 - protein, 9 aa, Staphylococcus
QAAESQIGA

SEQ ID NO: 1974539 - protein, 8 aa, Staphylococcus
QAAESVEN

SEQ ID NO: 1974540 - protein, 4 aa, Staphylococcus
QAAK

SEQ ID NO: 1974541 - protein, 13 aa, Staphylococcus
QAAKESTKTGKPI

SEQ ID NO: 1974542 - protein, 7 aa, Staphylococcus
QAAKVKK

SEQ ID NO: 1974543 - protein, 6 aa, Staphylococcus
QAAKWG

SEQ ID NO: 1974544 - protein, 4 aa, Staphylococcus
QAAN

SEQ ID NO: 1974545 - protein, 9 aa, Staphylococcus
QAANEAYKS

SEQ ID NO: 1974546 - protein, 8 aa, Staphylococcus
QAAQQVEA

SEQ ID NO: 1974547 - protein, 20 aa, Staphylococcus
QAAQVQGKFSRQSGGRGQYG

SEQ ID NO: 1974548 - protein, 6 aa, Staphylococcus
QAASDM

SEQ ID NO: 1974549 - protein, 6 aa, Staphylococcus
QAASIV

SEQ ID NO: 1974550 - protein, 4 aa, Staphylococcus
QAAV

SEQ ID NO: 1974551 - protein, 9 aa, Staphylococcus
QAAYEKGED

SEQ ID NO: 1974552 - protein, 5 aa, Staphylococcus
QADAL

SEQ ID NO: 1974553 - protein, 13 aa, Staphylococcus
QADDDYKEKMGEK

SEQ ID NO: 1974554 - protein, 8 aa, Staphylococcus
QADDSLND

SEQ ID NO: 1974555 - protein, 11 aa, Staphylococcus
QADEANSNAEF

SEQ ID NO: 1974556 - protein, 11 aa, Staphylococcus
QADEASNEQQF

SEQ ID NO: 1974557 - protein, 10 aa, Staphylococcus
QADESSSQHE

SEQ ID NO: 1974558 - protein, 4 aa, Staphylococcus
QADI

SEQ ID NO: 1974559 - protein, 7 aa, Staphylococcus
QADKAIE

SEQ ID NO: 1974560 - protein, 17 aa, Staphylococcus
QADKPDYIHSQNSAGAL

SEQ ID NO: 1974561 - protein, 7 aa, Staphylococcus
QADKPPM

SEQ ID NO: 1974562 - protein, 7 aa, Staphylococcus
QADNVNN

SEQ ID NO: 1974563 - protein, 8 aa, Staphylococcus
QADPNDGF

SEQ ID NO: 1974564 - protein, 5 aa, Staphylococcus
QADQD

SEQ ID NO: 1974565 - protein, 7 aa, Staphylococcus
QADSMDD

SEQ ID NO: 1974566 - protein, 7 aa, Staphylococcus
QADSSYI

SEQ ID NO: 1974567 - protein, 11 aa, Staphylococcus
QADTLEEARRK

SEQ ID NO: 1974568 - protein, 19 aa, Staphylococcus
QAEAGEKMTTLDDTERELK

SEQ ID NO: 1974569 - protein, 10 aa, Staphylococcus
QAEDQSTVTV

SEQ ID NO: 1974570 - protein, 8 aa, Staphylococcus
QAEEDNEK

SEQ ID NO: 1974571 - protein, 11 aa, Staphylococcus
QAEEDVSKQDK

SEQ ID NO: 1974572 - protein, 7 aa, Staphylococcus
QAEEENL

SEQ ID NO: 1974573 - protein, 11 aa, Staphylococcus
QAEGQSPLDSL

SEQ ID NO: 1974574 - protein, 15 aa, Staphylococcus
QAEGREKRQQAEKEL

SEQ ID NO: 1974575 - protein, 8 aa, Staphylococcus
QAEGYTPK

SEQ ID NO: 1974576 - protein, 6 aa, Staphylococcus
QAEIKG

SEQ ID NO: 1974577 - protein, 8 aa, Staphylococcus
QAEKDDVN

SEQ ID NO: 1974578 - protein, 6 aa, Staphylococcus
QAEKPK

SEQ ID NO: 1974579 - protein, 5 aa, Staphylococcus
QAEKW

SEQ ID NO: 1974580 - protein, 17 aa, Staphylococcus
QAEKWYKDASKEELDEL

SEQ ID NO: 1974581 - protein, 5 aa, Staphylococcus
QAEKY

SEQ ID NO: 1974582 - protein, 13 aa, Staphylococcus
QAENLNKEKTEVQ

SEQ ID NO: 1974583 - protein, 9 aa, Staphylococcus
QAENSDGEA

SEQ ID NO: 1974584 - protein, 7 aa, Staphylococcus
QAENVNN

SEQ ID NO: 1974585 - protein, 5 aa, Staphylococcus
QAEQG

SEQ ID NO: 1974586 - protein, 10 aa, Staphylococcus
QAEQLSTSDI

SEQ ID NO: 1974587 - protein, 43 aa, Staphylococcus
QAEQYTGESSLNQGDNVSNKSNESEIDKSKHSYHSKDKSLVDE

SEQ ID NO: 1974588 - protein, 43 aa, Staphylococcus
QAERYTGESSLNDDTSLKDNNRQAEHTSEDTHNDNNDEKRDYH

SEQ ID NO: 1974589 - protein, 12 aa, Staphylococcus
QAESTAATATQQ

SEQ ID NO: 1974590 - protein, 7 aa, Staphylococcus
QAETSGE

SEQ ID NO: 1974591 - protein, 7 aa, Staphylococcus
QAETSLA

SEQ ID NO: 1974592 - protein, 13 aa, Staphylococcus
QAFDSGDTVTGST

SEQ ID NO: 1974593 - protein, 4 aa, Staphylococcus
QAFK

SEQ ID NO: 1974594 - protein, 7 aa, Staphylococcus
QAFNHPQ

SEQ ID NO: 1974595 - protein, 4 aa, Staphylococcus
QAFP

SEQ ID NO: 1974596 - protein, 4 aa, Staphylococcus
QAFT

SEQ ID NO: 1974597 - protein, 6 aa, Staphylococcus
QAGADG

SEQ ID NO: 1974598 - protein, 7 aa, Staphylococcus
QAGAQNK

SEQ ID NO: 1974599 - protein, 10 aa, Staphylococcus
QAGASDPGIA

SEQ ID NO: 1974600 - protein, 4 aa, Staphylococcus
QAGD

SEQ ID NO: 1974601 - protein, 10 aa, Staphylococcus
QAGDFDRSKT

SEQ ID NO: 1974602 - protein, 8 aa, Staphylococcus
QAGEDAKV

SEQ ID NO: 1974603 - protein, 9 aa, Staphylococcus
QAGEDAKVK

SEQ ID NO: 1974604 - protein, 8 aa, Staphylococcus
QAGEEAKV

SEQ ID NO: 1974605 - protein, 13 aa, Staphylococcus
QAGERGITPSENA

SEQ ID NO: 1974606 - protein, 5 aa, Staphylococcus
QAGGD

SEQ ID NO: 1974607 - protein, 10 aa, Staphylococcus
QAGGLSKELP

SEQ ID NO: 1974608 - protein, 5 aa, Staphylococcus
QAGGR

SEQ ID NO: 1974609 - protein, 6 aa, Staphylococcus
QAGGRF

SEQ ID NO: 1974610 - protein, 11 aa, Staphylococcus
QAGGRYDLTPE

SEQ ID NO: 1974611 - protein, 11 aa, Staphylococcus
QAGGRYELTPE

SEQ ID NO: 1974612 - protein, 11 aa, Staphylococcus
QAGGRYNLTPE

SEQ ID NO: 1974613 - protein, 6 aa, Staphylococcus
QAGITQ

SEQ ID NO: 1974614 - protein, 4 aa, Staphylococcus
QAGL

SEQ ID NO: 1974615 - protein, 6 aa, Staphylococcus
QAGLGG

SEQ ID NO: 1974616 - protein, 10 aa, Staphylococcus
QAGNKEAARQ

SEQ ID NO: 1974617 - protein, 12 aa, Staphylococcus
QAGQSASTSSYL

SEQ ID NO: 1974618 - protein, 8 aa, Staphylococcus
QAGSDLDS

SEQ ID NO: 1974619 - protein, 7 aa, Staphylococcus
QAGSSCD

SEQ ID NO: 1974620 - protein, 7 aa, Staphylococcus
QAGSSCS

SEQ ID NO: 1974621 - protein, 9 aa, Staphylococcus
QAGSSQQIE

SEQ ID NO: 1974622 - protein, 7 aa, Staphylococcus
QAGSSVT

SEQ ID NO: 1974623 - protein, 15 aa, Staphylococcus
QAGTHTKASIDSTNF

SEQ ID NO: 1974624 - protein, 7 aa, Staphylococcus
QAGTQVN

SEQ ID NO: 1974625 - protein, 4 aa, Staphylococcus
QAGV

SEQ ID NO: 1974626 - protein, 7 aa, Staphylococcus
QAGVDTA

SEQ ID NO: 1974627 - protein, 7 aa, Staphylococcus
QAGVETA

SEQ ID NO: 1974628 - protein, 6 aa, Staphylococcus
QAGVPE

SEQ ID NO: 1974629 - protein, 6 aa, Staphylococcus
QAGYND

SEQ ID NO: 1974630 - protein, 11 aa, Staphylococcus
QAGYNDDITEE

SEQ ID NO: 1974631 - protein, 11 aa, Staphylococcus
QAGYNDTINEE

SEQ ID NO: 1974632 - protein, 13 aa, Staphylococcus
QAGYNKTPDVNGF

SEQ ID NO: 1974633 - protein, 10 aa, Staphylococcus
QAHDDVEATI

SEQ ID NO: 1974634 - protein, 6 aa, Staphylococcus
QAHEAG

SEQ ID NO: 1974635 - protein, 5 aa, Staphylococcus
QAHEG

SEQ ID NO: 1974636 - protein, 7 aa, Staphylococcus
QAHFPNE

SEQ ID NO: 1974637 - protein, 6 aa, Staphylococcus
QAHNEP

SEQ ID NO: 1974638 - protein, 7 aa, Staphylococcus
QAHNEPS

SEQ ID NO: 1974639 - protein, 6 aa, Staphylococcus
QAHPNI

SEQ ID NO: 1974640 - protein, 9 aa, Staphylococcus
QAHTKTLEE

SEQ ID NO: 1974641 - protein, 6 aa, Staphylococcus
QAHVTG

SEQ ID NO: 1974642 - protein, 6 aa, Staphylococcus
QAIAQG

SEQ ID NO: 1974643 - protein, 13 aa, Staphylococcus
QAIDNTAKKIKSF

SEQ ID NO: 1974644 - protein, 8 aa, Staphylococcus
QAIEEREA

SEQ ID NO: 1974645 - protein, 6 aa, Staphylococcus
QAIEQS

SEQ ID NO: 1974646 - protein, 6 aa, Staphylococcus
QAIEYD

SEQ ID NO: 1974647 - protein, 7 aa, Staphylococcus
QAIQDEP

SEQ ID NO: 1974648 - protein, 7 aa, Staphylococcus
QAIQPNT

SEQ ID NO: 1974649 - protein, 4 aa, Staphylococcus
QAIS

SEQ ID NO: 1974650 - protein, 8 aa, Staphylococcus
QAKAETVG

SEQ ID NO: 1974651 - protein, 9 aa, Staphylococcus
QAKDEIDKS

SEQ ID NO: 1974652 - protein, 7 aa, Staphylococcus
QAKDKTQ

SEQ ID NO: 1974653 - protein, 7 aa, Staphylococcus
QAKDQMD

SEQ ID NO: 1974654 - protein, 8 aa, Staphylococcus
QAKDQMEG

SEQ ID NO: 1974655 - protein, 16 aa, Staphylococcus
QAKDWYKDATKDELDE

SEQ ID NO: 1974656 - protein, 4 aa, Staphylococcus
QAKE

SEQ ID NO: 1974657 - protein, 9 aa, Staphylococcus
QAKEAYEHQ

SEQ ID NO: 1974658 - protein, 8 aa, Staphylococcus
QAKEEIDS

SEQ ID NO: 1974659 - protein, 13 aa, Staphylococcus
QAKEGNQEINGKD

SEQ ID NO: 1974660 - protein, 8 aa, Staphylococcus
QAKEINEQ

SEQ ID NO: 1974661 - protein, 8 aa, Staphylococcus
QAKEQASE

SEQ ID NO: 1974662 - protein, 13 aa, Staphylococcus
QAKESTHQINGSD

SEQ ID NO: 1974663 - protein, 5 aa, Staphylococcus
QAKEY

SEQ ID NO: 1974664 - protein, 8 aa, Staphylococcus
QAKGEIDK

SEQ ID NO: 1974665 - protein, 6 aa, Staphylococcus
QAKGML

SEQ ID NO: 1974666 - protein, 10 aa, Staphylococcus
QAKGRPSDNP

SEQ ID NO: 1974667 - protein, 9 aa, Staphylococcus
QAKGYLTKE

SEQ ID NO: 1974668 - protein, 7 aa, Staphylococcus
QAKHYTP

SEQ ID NO: 1974669 - protein, 8 aa, Staphylococcus
QAKISGNA

SEQ ID NO: 1974670 - protein, 9 aa, Staphylococcus
QAKKDNGEV

SEQ ID NO: 1974671 - protein, 8 aa, Staphylococcus
QAKKVNEN

SEQ ID NO: 1974672 - protein, 10 aa, Staphylococcus
QAKNDGKNAI

SEQ ID NO: 1974673 - protein, 6 aa, Staphylococcus
QAKNRK

SEQ ID NO: 1974674 - protein, 14 aa, Staphylococcus
QAKPEALNEGPAQI

SEQ ID NO: 1974675 - protein, 7 aa, Staphylococcus
QAKQNGY

SEQ ID NO: 1974676 - protein, 43 aa, Staphylococcus
QAKQYTGESSLDHEENNEEERTTHTEDSTDKMEDTNENTTDNH

SEQ ID NO: 1974677 - protein, 6 aa, Staphylococcus
QAKQYV

SEQ ID NO: 1974678 - protein, 8 aa, Staphylococcus
QAKSAEDF

SEQ ID NO: 1974679 - protein, 8 aa, Staphylococcus
QAKSGGAV

SEQ ID NO: 1974680 - protein, 7 aa, Staphylococcus
QAKSQSL

SEQ ID NO: 1974681 - protein, 13 aa, Staphylococcus
QAKTSTHEISGKD

SEQ ID NO: 1974682 - protein, 5 aa, Staphylococcus
QAKVG

SEQ ID NO: 1974683 - protein, 4 aa, Staphylococcus
QALA

SEQ ID NO: 1974684 - protein, 17 aa, Staphylococcus
QALEDAQYEINDDNAAR

SEQ ID NO: 1974685 - protein, 7 aa, Staphylococcus
QALEEEP

SEQ ID NO: 1974686 - protein, 32 aa, Staphylococcus
QALGQTTEHHSDSYTTASMDTQNNEKTKTSKV

SEQ ID NO: 1974687 - protein, 9 aa, Staphylococcus
QALKNKETQ

SEQ ID NO: 1974688 - protein, 11 aa, Staphylococcus
QALNEGKPANI

SEQ ID NO: 1974689 - protein, 11 aa, Staphylococcus
QALNEGKPEKI

SEQ ID NO: 1974690 - protein, 4 aa, Staphylococcus
QALP

SEQ ID NO: 1974691 - protein, 6 aa, Staphylococcus
QALPDG

SEQ ID NO: 1974692 - protein, 12 aa, Staphylococcus
QALRDSDEYKAI

SEQ ID NO: 1974693 - protein, 11 aa, Staphylococcus
QALSETEMNDV

SEQ ID NO: 1974694 - protein, 8 aa, Staphylococcus
QALSPKDA

SEQ ID NO: 1974695 - protein, 7 aa, Staphylococcus
QALSRQQ

SEQ ID NO: 1974696 - protein, 11 aa, Staphylococcus
QALSSTSSEQF

SEQ ID NO: 1974697 - protein, 7 aa, Staphylococcus
QALVGNQ

SEQ ID NO: 1974698 - protein, 6 aa, Staphylococcus
QAMAKD

SEQ ID NO: 1974699 - protein, 4 aa, Staphylococcus
QAME

SEQ ID NO: 1974700 - protein, 10 aa, Staphylococcus
QAMKKNGAKA

SEQ ID NO: 1974701 - protein, 8 aa, Staphylococcus
QAMQDKQS

SEQ ID NO: 1974702 - protein, 4 aa, Staphylococcus
QAMR

SEQ ID NO: 1974703 - protein, 9 aa, Staphylococcus
QANAKTAGV

SEQ ID NO: 1974704 - protein, 5 aa, Staphylococcus
QANAQ

SEQ ID NO: 1974705 - protein, 6 aa, Staphylococcus
QANEGQ

SEQ ID NO: 1974706 - protein, 18 aa, Staphylococcus
QANENETMTTLDDTERTL

SEQ ID NO: 1974707 - protein, 11 aa, Staphylococcus
QANENGSSLSQ

SEQ ID NO: 1974708 - protein, 15 aa, Staphylococcus
QANGEYDEVATSTAK

SEQ ID NO: 1974709 - protein, 11 aa, Staphylococcus
QANGSSVIKDA

SEQ ID NO: 1974710 - protein, 8 aa, Staphylococcus
QANGTSIV

SEQ ID NO: 1974711 - protein, 4 aa, Staphylococcus
QANI

SEQ ID NO: 1974712 - protein, 8 aa, Staphylococcus
QANKASRL

SEQ ID NO: 1974713 - protein, 16 aa, Staphylococcus
QANKYPKPVVENPPEN

SEQ ID NO: 1974714 - protein, 13 aa, Staphylococcus
QANLDKGLPNKKF

SEQ ID NO: 1974715 - protein, 11 aa, Staphylococcus
QANLDNHQGKT

SEQ ID NO: 1974716 - protein, 6 aa, Staphylococcus
QANLPS

SEQ ID NO: 1974717 - protein, 6 aa, Staphylococcus
QANNDI

SEQ ID NO: 1974718 - protein, 10 aa, Staphylococcus
QANNNTGNKK

SEQ ID NO: 1974719 - protein, 4 aa, Staphylococcus
QANQ

SEQ ID NO: 1974720 - protein, 5 aa, Staphylococcus
QANQY

SEQ ID NO: 1974721 - protein, 11 aa, Staphylococcus
QANRGAAASRN

SEQ ID NO: 1974722 - protein, 12 aa, Staphylococcus
QANSQEIIGQDD

SEQ ID NO: 1974723 - protein, 7 aa, Staphylococcus
QANTQRH

SEQ ID NO: 1974724 - protein, 11 aa, Staphylococcus
QANVDTEDDHL

SEQ ID NO: 1974725 - protein, 19 aa, Staphylococcus
QANVSADTRVKDLTDDELG

SEQ ID NO: 1974726 - protein, 24 aa, Staphylococcus
QANYENAGTSTLEGRSIYILRRTI

SEQ ID NO: 1974727 - protein, 10 aa, Staphylococcus
QAPATKGLTR

SEQ ID NO: 1974728 - protein, 7 aa, Staphylococcus
QAPEEFK

SEQ ID NO: 1974729 - protein, 8 aa, Staphylococcus
QAPEEQRV

SEQ ID NO: 1974730 - protein, 10 aa, Staphylococcus
QAPKSKKITI

SEQ ID NO: 1974731 - protein, 7 aa, Staphylococcus
QAPLNSC

SEQ ID NO: 1974732 - protein, 7 aa, Staphylococcus
QAPQRDK

SEQ ID NO: 1974733 - protein, 9 aa, Staphylococcus
QAPQTPEEF

SEQ ID NO: 1974734 - protein, 5 aa, Staphylococcus
QAPRL

SEQ ID NO: 1974735 - protein, 19 aa, Staphylococcus
QAPSEVSDKQLEELSLRIR

SEQ ID NO: 1974736 - protein, 7 aa, Staphylococcus
QAPTGQK

SEQ ID NO: 1974737 - protein, 5 aa, Staphylococcus
QAQDI

SEQ ID NO: 1974738 - protein, 13 aa, Staphylococcus
QAQENERKRISRE

SEQ ID NO: 1974739 - protein, 15 aa, Staphylococcus
QAQENKLKQYKEEAN

SEQ ID NO: 1974740 - protein, 4 aa, Staphylococcus
QAQK

SEQ ID NO: 1974741 - protein, 5 aa, Staphylococcus
QAQLG

SEQ ID NO: 1974742 - protein, 7 aa, Staphylococcus
QAQPGDK

SEQ ID NO: 1974743 - protein, 20 aa, Staphylococcus
QAQQQNEKESASIQKTQEKI

SEQ ID NO: 1974744 - protein, 8 aa, Staphylococcus
QAQSAKGY

SEQ ID NO: 1974745 - protein, 13 aa, Staphylococcus
QAQSLYESADQNL

SEQ ID NO: 1974746 - protein, 11 aa, Staphylococcus
QAQSSSENDNI

SEQ ID NO: 1974747 - protein, 9 aa, Staphylococcus
QAQSTSDFD

SEQ ID NO: 1974748 - protein, 9 aa, Staphylococcus
QAQSTSDLD

SEQ ID NO: 1974749 - protein, 8 aa, Staphylococcus
QAQSTSEF

SEQ ID NO: 1974750 - protein, 6 aa, Staphylococcus
QAQSYD

SEQ ID NO: 1974751 - protein, 4 aa, Staphylococcus
QAQT

SEQ ID NO: 1974752 - protein, 10 aa, Staphylococcus
QAQTGKDQAR

SEQ ID NO: 1974753 - protein, 6 aa, Staphylococcus
QAQYSK

SEQ ID NO: 1974754 - protein, 8 aa, Staphylococcus
QAQYSKGF

SEQ ID NO: 1974755 - protein, 6 aa, Staphylococcus
QARAND

SEQ ID NO: 1974756 - protein, 19 aa, Staphylococcus
QARKKQVSEKPQVHGKGTN

SEQ ID NO: 1974757 - protein, 20 aa, Staphylococcus
QARKKQVSEKPQVHGKGTNI

SEQ ID NO: 1974758 - protein, 12 aa, Staphylococcus
QARKTVQNKKIY

SEQ ID NO: 1974759 - protein, 20 aa, Staphylococcus
QARNEIEDAGYEQLTSAEDV

SEQ ID NO: 1974760 - protein, 22 aa, Staphylococcus
QARNEIEEAGYEQLTSADEVDS

SEQ ID NO: 1974761 - protein, 21 aa, Staphylococcus
QARNEIEEAGYEQLTTADEVD

SEQ ID NO: 1974762 - protein, 20 aa, Staphylococcus
QARNEIENAGYEQLTTADEV

SEQ ID NO: 1974763 - protein, 20 aa, Staphylococcus
QARNEIENAGYEQLTTPEEV

SEQ ID NO: 1974764 - protein, 20 aa, Staphylococcus
QARNEIESAGYEQLTTSDEV

SEQ ID NO: 1974765 - protein, 5 aa, Staphylococcus
QARNY

SEQ ID NO: 1974766 - protein, 19 aa, Staphylococcus
QARPLQSIDDATKLIMRGD

SEQ ID NO: 1974767 - protein, 7 aa, Staphylococcus
QARQIAD

SEQ ID NO: 1974768 - protein, 10 aa, Staphylococcus
QARQYAAATG

SEQ ID NO: 1974769 - protein, 5 aa, Staphylococcus
QARRS

SEQ ID NO: 1974770 - protein, 20 aa, Staphylococcus
QARSEIEQAGYQQLTTAEEV

SEQ ID NO: 1974771 - protein, 7 aa, Staphylococcus
QARTNGY

SEQ ID NO: 1974772 - protein, 9 aa, Staphylococcus
QARVEKDGI

SEQ ID NO: 1974773 - protein, 5 aa, Staphylococcus
QARYD

SEQ ID NO: 1974774 - protein, 12 aa, Staphylococcus
QARYGETSTNDN

SEQ ID NO: 1974775 - protein, 9 aa, Staphylococcus
QASEMTDSK

SEQ ID NO: 1974776 - protein, 20 aa, Staphylococcus
QASESGDTLTVTNPANGEDL

SEQ ID NO: 1974777 - protein, 10 aa, Staphylococcus
QASESKDLET

SEQ ID NO: 1974778 - protein, 7 aa, Staphylococcus
QASGHTG

SEQ ID NO: 1974779 - protein, 8 aa, Staphylococcus
QASGTSII

SEQ ID NO: 1974780 - protein, 8 aa, Staphylococcus
QASGTSMI

SEQ ID NO: 1974781 - protein, 8 aa, Staphylococcus
QASGTSVI

SEQ ID NO: 1974782 - protein, 19 aa, Staphylococcus
QASGYGDDQFSKQAADQIR

SEQ ID NO: 1974783 - protein, 7 aa, Staphylococcus
QASHGGA

SEQ ID NO: 1974784 - protein, 13 aa, Staphylococcus
QASIEDPNNEHLK

SEQ ID NO: 1974785 - protein, 13 aa, Staphylococcus
QASIEDPRNEHLK

SEQ ID NO: 1974786 - protein, 6 aa, Staphylococcus
QASIEE

SEQ ID NO: 1974787 - protein, 5 aa, Staphylococcus
QASIQ

SEQ ID NO: 1974788 - protein, 6 aa, Staphylococcus
QASKDV

SEQ ID NO: 1974789 - protein, 14 aa, Staphylococcus
QASLEDPKNEHLKS

SEQ ID NO: 1974790 - protein, 7 aa, Staphylococcus
QASLGDE

SEQ ID NO: 1974791 - protein, 7 aa, Staphylococcus
QASLKQQ

SEQ ID NO: 1974792 - protein, 11 aa, Staphylococcus
QASLSGPKRPQ

SEQ ID NO: 1974793 - protein, 26 aa, Staphylococcus
QASSITVQRQGAQAAIPTRDEVINVY

SEQ ID NO: 1974794 - protein, 35 aa, Staphylococcus
QASSNTNEETPSVENEDVTIEEPQAPYSKSNPFQA

SEQ ID NO: 1974795 - protein, 10 aa, Staphylococcus
QASTDKGNYV

SEQ ID NO: 1974796 - protein, 9 aa, Staphylococcus
QASTSSIGA

SEQ ID NO: 1974797 - protein, 9 aa, Staphylococcus
QASTSTIGS

SEQ ID NO: 1974798 - protein, 7 aa, Staphylococcus
QATANAE

SEQ ID NO: 1974799 - protein, 8 aa, Staphylococcus
QATDDINE

SEQ ID NO: 1974800 - protein, 8 aa, Staphylococcus
QATDQAPD

SEQ ID NO: 1974801 - protein, 7 aa, Staphylococcus
QATEAIP

SEQ ID NO: 1974802 - protein, 6 aa, Staphylococcus
QATEGE

SEQ ID NO: 1974803 - protein, 8 aa, Staphylococcus
QATEQATD

SEQ ID NO: 1974804 - protein, 7 aa, Staphylococcus
QATGLKD

SEQ ID NO: 1974805 - protein, 5 aa, Staphylococcus
QATGT

SEQ ID NO: 1974806 - protein, 8 aa, Staphylococcus
QATGTSII

SEQ ID NO: 1974807 - protein, 16 aa, Staphylococcus
QATKDAEAADYPNVEE

SEQ ID NO: 1974808 - protein, 6 aa, Staphylococcus
QATKIK

SEQ ID NO: 1974809 - protein, 4 aa, Staphylococcus
QATL

SEQ ID NO: 1974810 - protein, 9 aa, Staphylococcus
QATLQSRLN

SEQ ID NO: 1974811 - protein, 8 aa, Staphylococcus
QATNQATE

SEQ ID NO: 1974812 - protein, 8 aa, Staphylococcus
QATPENAP

SEQ ID NO: 1974813 - protein, 5 aa, Staphylococcus
QATRC

SEQ ID NO: 1974814 - protein, 7 aa, Staphylococcus
QATSAVR

SEQ ID NO: 1974815 - protein, 22 aa, Staphylococcus
QATSAVRTVSPETTIDGPKLSQ

SEQ ID NO: 1974816 - protein, 6 aa, Staphylococcus
QATSIY

SEQ ID NO: 1974817 - protein, 14 aa, Staphylococcus
QATSQVTDKLKQHE

SEQ ID NO: 1974818 - protein, 9 aa, Staphylococcus
QAVANGANR

SEQ ID NO: 1974819 - protein, 9 aa, Staphylococcus
QAVDDETAA

SEQ ID NO: 1974820 - protein, 5 aa, Staphylococcus
QAVED

SEQ ID NO: 1974821 - protein, 6 aa, Staphylococcus
QAVEDA

SEQ ID NO: 1974822 - protein, 5 aa, Staphylococcus
QAVEI

SEQ ID NO: 1974823 - protein, 4 aa, Staphylococcus
QAVG

SEQ ID NO: 1974824 - protein, 20 aa, Staphylococcus
QAVKDGEASGCVSAGNTGAL

SEQ ID NO: 1974825 - protein, 16 aa, Staphylococcus
QAVKDTIKKASIASGV

SEQ ID NO: 1974826 - protein, 6 aa, Staphylococcus
QAVKRG

SEQ ID NO: 1974827 - protein, 7 aa, Staphylococcus
QAVPENA

SEQ ID NO: 1974828 - protein, 7 aa, Staphylococcus
QAVSEEP

SEQ ID NO: 1974829 - protein, 14 aa, Staphylococcus
QAYDAQKETIGTQM

SEQ ID NO: 1974830 - protein, 7 aa, Staphylococcus
QAYDNDK

SEQ ID NO: 1974831 - protein, 6 aa, Staphylococcus
QAYEDF

SEQ ID NO: 1974832 - protein, 13 aa, Staphylococcus
QAYESGDKVTGTT

SEQ ID NO: 1974833 - protein, 6 aa, Staphylococcus
QAYKPT

SEQ ID NO: 1974834 - protein, 14 aa, Staphylococcus
QAYNKAKKDPQFQQ

SEQ ID NO: 1974835 - protein, 12 aa, Staphylococcus
QAYPQKNMQTEL

SEQ ID NO: 1974836 - protein, 7 aa, Staphylococcus
QAYQDAK

SEQ ID NO: 1974837 - protein, 12 aa, Staphylococcus
QAYQDAKNDPQF

SEQ ID NO: 1974838 - protein, 11 aa, Staphylococcus
QAYSDETEDIT

SEQ ID NO: 1974839 - protein, 15 aa, Staphylococcus
QAYYSRTTYQIIEKL

SEQ ID NO: 1974840 - protein, 6 aa, Staphylococcus
QCEAAQ

SEQ ID NO: 1974841 - protein, 13 aa, Staphylococcus
QCEAAQDSKVAYN

SEQ ID NO: 1974842 - protein, 4 aa, Staphylococcus
QCER

SEQ ID NO: 1974843 - protein, 11 aa, Staphylococcus
QCGNSGNSTEP

SEQ ID NO: 1974844 - protein, 22 aa, Staphylococcus
QCQPDAEFSSVTSANPEDHKAF

SEQ ID NO: 1974845 - protein, 5 aa, Staphylococcus
QCTQK

SEQ ID NO: 1974846 - protein, 5 aa, Staphylococcus
QDAEA

SEQ ID NO: 1974847 - protein, 8 aa, Staphylococcus
QDAETYDE

SEQ ID NO: 1974848 - protein, 5 aa, Staphylococcus
QDAGD

SEQ ID NO: 1974849 - protein, 7 aa, Staphylococcus
QDAPEDF

SEQ ID NO: 1974850 - protein, 5 aa, Staphylococcus
QDAPH

SEQ ID NO: 1974851 - protein, 12 aa, Staphylococcus
QDAPIESYNQVA

SEQ ID NO: 1974852 - protein, 6 aa, Staphylococcus
QDAPLD

SEQ ID NO: 1974853 - protein, 12 aa, Staphylococcus
QDAPYESYGQVA

SEQ ID NO: 1974854 - protein, 10 aa, Staphylococcus
QDAQNEPIQN

SEQ ID NO: 1974855 - protein, 9 aa, Staphylococcus
QDASGEARD

SEQ ID NO: 1974856 - protein, 7 aa, Staphylococcus
QDASGNA

SEQ ID NO: 1974857 - protein, 10 aa, Staphylococcus
QDATGQARDI

SEQ ID NO: 1974858 - protein, 6 aa, Staphylococcus
QDATSL

SEQ ID NO: 1974859 - protein, 7 aa, Staphylococcus
QDAVTSA

SEQ ID NO: 1974860 - protein, 13 aa, Staphylococcus
QDAYPNQGITVVS

SEQ ID NO: 1974861 - protein, 9 aa, Staphylococcus
QDDDGKVQG

SEQ ID NO: 1974862 - protein, 10 aa, Staphylococcus
QDDDNYFEQP

SEQ ID NO: 1974863 - protein, 4 aa, Staphylococcus
QDDE

SEQ ID NO: 1974864 - protein, 5 aa, Staphylococcus
QDDEF

SEQ ID NO: 1974865 - protein, 7 aa, Staphylococcus
QDDEFES

SEQ ID NO: 1974866 - protein, 8 aa, Staphylococcus
QDDEIANR

SEQ ID NO: 1974867 - protein, 8 aa, Staphylococcus
QDDEIATK

SEQ ID NO: 1974868 - protein, 4 aa, Staphylococcus
QDDF

SEQ ID NO: 1974869 - protein, 13 aa, Staphylococcus
QDDFKTIDTFISR

SEQ ID NO: 1974870 - protein, 5 aa, Staphylococcus
QDDIS

SEQ ID NO: 1974871 - protein, 8 aa, Staphylococcus
QDDKENYI

SEQ ID NO: 1974872 - protein, 9 aa, Staphylococcus
QDDKTAVKA

SEQ ID NO: 1974873 - protein, 4 aa, Staphylococcus
QDDL

SEQ ID NO: 1974874 - protein, 9 aa, Staphylococcus
QDDLESMST

SEQ ID NO: 1974875 - protein, 8 aa, Staphylococcus
QDDLTEPI

SEQ ID NO: 1974876 - protein, 4 aa, Staphylococcus
QDDN

SEQ ID NO: 1974877 - protein, 21 aa, Staphylococcus
QDDNPDFESGQITQELQSGYK

SEQ ID NO: 1974878 - protein, 20 aa, Staphylococcus
QDDNPDFKSGDITQELQKGY

SEQ ID NO: 1974879 - protein, 20 aa, Staphylococcus
QDDNPDFKSGEITQELQKGY

SEQ ID NO: 1974880 - protein, 21 aa, Staphylococcus
QDDNPDFNSGEITQELQKGYK

SEQ ID NO: 1974881 - protein, 21 aa, Staphylococcus
QDDNPDYESGEITQELQKGYK

SEQ ID NO: 1974882 - protein, 10 aa, Staphylococcus
QDDNPEYESG

SEQ ID NO: 1974883 - protein, 5 aa, Staphylococcus
QDDPV

SEQ ID NO: 1974884 - protein, 4 aa, Staphylococcus
QDDQ

SEQ ID NO: 1974885 - protein, 17 aa, Staphylococcus
QDDRDIRDERRRQKLEP

SEQ ID NO: 1974886 - protein, 16 aa, Staphylococcus
QDDRDLRQERRKQKLE

SEQ ID NO: 1974887 - protein, 4 aa, Staphylococcus
QDDS

SEQ ID NO: 1974888 - protein, 9 aa, Staphylococcus
QDDSGHARD

SEQ ID NO: 1974889 - protein, 17 aa, Staphylococcus
QDDSISIEDNGRGMPTG

SEQ ID NO: 1974890 - protein, 13 aa, Staphylococcus
QDDTDYSGELKVG

SEQ ID NO: 1974891 - protein, 16 aa, Staphylococcus
QDDYALRESKINSGNQ

SEQ ID NO: 1974892 - protein, 23 aa, Staphylococcus
QDDYHSHTVRQDDKLELLEFVGG

SEQ ID NO: 1974893 - protein, 31 aa, Staphylococcus
QDDYRSPKNLKSIDESVRDFSESVNDNAFTH

SEQ ID NO: 1974894 - protein, 7 aa, Staphylococcus
QDEAAAR

SEQ ID NO: 1974895 - protein, 7 aa, Staphylococcus
QDEAQSI

SEQ ID NO: 1974896 - protein, 14 aa, Staphylococcus
QDEDMKADTPINRL

SEQ ID NO: 1974897 - protein, 4 aa, Staphylococcus
QDEF

SEQ ID NO: 1974898 - protein, 5 aa, Staphylococcus
QDEFE

SEQ ID NO: 1974899 - protein, 6 aa, Staphylococcus
QDEGRF

SEQ ID NO: 1974900 - protein, 17 aa, Staphylococcus
QDEGRIGYQNQGFSTAG

SEQ ID NO: 1974901 - protein, 9 aa, Staphylococcus
QDEGVNVPE

SEQ ID NO: 1974902 - protein, 4 aa, Staphylococcus
QDEI

SEQ ID NO: 1974903 - protein, 8 aa, Staphylococcus
QDEIENND

SEQ ID NO: 1974904 - protein, 8 aa, Staphylococcus
QDEINQVE

SEQ ID NO: 1974905 - protein, 8 aa, Staphylococcus
QDEKENYN

SEQ ID NO: 1974906 - protein, 10 aa, Staphylococcus
QDEKERQSLS

SEQ ID NO: 1974907 - protein, 10 aa, Staphylococcus
QDELETQDDI

SEQ ID NO: 1974908 - protein, 8 aa, Staphylococcus
QDELGETI

SEQ ID NO: 1974909 - protein, 9 aa, Staphylococcus
QDELKSQGV

SEQ ID NO: 1974910 - protein, 6 aa, Staphylococcus
QDENKE

SEQ ID NO: 1974911 - protein, 7 aa, Staphylococcus
QDENTAS

SEQ ID NO: 1974912 - protein, 11 aa, Staphylococcus
QDEPSLPRPVG

SEQ ID NO: 1974913 - protein, 5 aa, Staphylococcus
QDEPY

SEQ ID NO: 1974914 - protein, 4 aa, Staphylococcus
QDEQ

SEQ ID NO: 1974915 - protein, 11 aa, Staphylococcus
QDEQDSRFANE

SEQ ID NO: 1974916 - protein, 10 aa, Staphylococcus
QDEQGEDNDR

SEQ ID NO: 1974917 - protein, 5 aa, Staphylococcus
QDEQR

SEQ ID NO: 1974918 - protein, 8 aa, Staphylococcus
QDEQSNGR

SEQ ID NO: 1974919 - protein, 5 aa, Staphylococcus
QDESL

SEQ ID NO: 1974920 - protein, 7 aa, Staphylococcus
QDESTYT

SEQ ID NO: 1974921 - protein, 7 aa, Staphylococcus
QDESVAE

SEQ ID NO: 1974922 - protein, 7 aa, Staphylococcus
QDEVRSM

SEQ ID NO: 1974923 - protein, 25 aa, Staphylococcus
QDEYEEERRGDNKIGTTKKGIGPAY

SEQ ID NO: 1974924 - protein, 12 aa, Staphylococcus
QDFDNVSKQLEE

SEQ ID NO: 1974925 - protein, 4 aa, Staphylococcus
QDFE

SEQ ID NO: 1974926 - protein, 6 aa, Staphylococcus
QDFEGK

SEQ ID NO: 1974927 - protein, 6 aa, Staphylococcus
QDFEQN

SEQ ID NO: 1974928 - protein, 4 aa, Staphylococcus
QDFP

SEQ ID NO: 1974929 - protein, 7 aa, Staphylococcus
QDFRDEL

SEQ ID NO: 1974930 - protein, 4 aa, Staphylococcus
QDFS

SEQ ID NO: 1974931 - protein, 15 aa, Staphylococcus
QDGDQIGVKSKREAL

SEQ ID NO: 1974932 - protein, 7 aa, Staphylococcus
QDGEQHR

SEQ ID NO: 1974933 - protein, 15 aa, Staphylococcus
QDGEQIGVKQKREAL

SEQ ID NO: 1974934 - protein, 15 aa, Staphylococcus
QDGEQIGVKSKREAL

SEQ ID NO: 1974935 - protein, 16 aa, Staphylococcus
QDGEQIGVKTKNEALE

SEQ ID NO: 1974936 - protein, 4 aa, Staphylococcus
QDGK

SEQ ID NO: 1974937 - protein, 9 aa, Staphylococcus
QDGKRIGKT

SEQ ID NO: 1974938 - protein, 8 aa, Staphylococcus
QDGLTQND

SEQ ID NO: 1974939 - protein, 7 aa, Staphylococcus
QDGNHTI

SEQ ID NO: 1974940 - protein, 16 aa, Staphylococcus
QDGNQKIEAVKPTSLK

SEQ ID NO: 1974941 - protein, 10 aa, Staphylococcus
QDGNRIKQGD

SEQ ID NO: 1974942 - protein, 10 aa, Staphylococcus
QDGQEYEGEL

SEQ ID NO: 1974943 - protein, 9 aa, Staphylococcus
QDGQINANH

SEQ ID NO: 1974944 - protein, 8 aa, Staphylococcus
QDGRRIGK

SEQ ID NO: 1974945 - protein, 22 aa, Staphylococcus
QDGSAWQGHQRGYYQDAKKGES

SEQ ID NO: 1974946 - protein, 5 aa, Staphylococcus
QDGSI

SEQ ID NO: 1974947 - protein, 18 aa, Staphylococcus
QDGTHSDGRVSNSSSKSL

SEQ ID NO: 1974948 - protein, 5 aa, Staphylococcus
QDGTL

SEQ ID NO: 1974949 - protein, 8 aa, Staphylococcus
QDHASELN

SEQ ID NO: 1974950 - protein, 7 aa, Staphylococcus
QDHDGTK

SEQ ID NO: 1974951 - protein, 8 aa, Staphylococcus
QDHTQTYS

SEQ ID NO: 1974952 - protein, 5 aa, Staphylococcus
QDIAN

SEQ ID NO: 1974953 - protein, 7 aa, Staphylococcus
QDIDGND

SEQ ID NO: 1974954 - protein, 7 aa, Staphylococcus
QDIDGNE

SEQ ID NO: 1974955 - protein, 12 aa, Staphylococcus
QDIDQSEHKLKG

SEQ ID NO: 1974956 - protein, 14 aa, Staphylococcus
QDIEDNKDKIEVDS

SEQ ID NO: 1974957 - protein, 8 aa, Staphylococcus
QDIESKTT

SEQ ID NO: 1974958 - protein, 4 aa, Staphylococcus
QDIG

SEQ ID NO: 1974959 - protein, 5 aa, Staphylococcus
QDIGP

SEQ ID NO: 1974960 - protein, 11 aa, Staphylococcus
QDIHPNNRKRV

SEQ ID NO: 1974961 - protein, 9 aa, Staphylococcus
QDIKAEQSR

SEQ ID NO: 1974962 - protein, 10 aa, Staphylococcus
QDIKKQDNGN

SEQ ID NO: 1974963 - protein, 6 aa, Staphylococcus
QDINGD

SEQ ID NO: 1974964 - protein, 20 aa, Staphylococcus
QDINTSLSNEDAYKRARPNH

SEQ ID NO: 1974965 - protein, 10 aa, Staphylococcus
QDIPEGKSLE

SEQ ID NO: 1974966 - protein, 11 aa, Staphylococcus
QDIPKGASNKV

SEQ ID NO: 1974967 - protein, 6 aa, Staphylococcus
QDIRDG

SEQ ID NO: 1974968 - protein, 4 aa, Staphylococcus
QDIT

SEQ ID NO: 1974969 - protein, 12 aa, Staphylococcus
QDITNKASNITN

SEQ ID NO: 1974970 - protein, 58 aa, Staphylococcus
QDITPEEQLSAQSQQSESVLASESNNSKINSLSTSDATSTSENVTSQSSVSQSESTSN

SEQ ID NO: 1974971 - protein, 6 aa, Staphylococcus
QDITSF

SEQ ID NO: 1974972 - protein, 9 aa, Staphylococcus
QDKAKKSLS

SEQ ID NO: 1974973 - protein, 9 aa, Staphylococcus
QDKALNKGS

SEQ ID NO: 1974974 - protein, 10 aa, Staphylococcus
QDKAQGEEHT

SEQ ID NO: 1974975 - protein, 4 aa, Staphylococcus
QDKD

SEQ ID NO: 1974976 - protein, 5 aa, Staphylococcus
QDKDA

SEQ ID NO: 1974977 - protein, 8 aa, Staphylococcus
QDKDQMDG

SEQ ID NO: 1974978 - protein, 5 aa, Staphylococcus
QDKDT

SEQ ID NO: 1974979 - protein, 7 aa, Staphylococcus
QDKEKSF

SEQ ID NO: 1974980 - protein, 6 aa, Staphylococcus
QDKERM

SEQ ID NO: 1974981 - protein, 11 aa, Staphylococcus
QDKFDRKQAKR

SEQ ID NO: 1974982 - protein, 10 aa, Staphylococcus
QDKGYTHTST

SEQ ID NO: 1974983 - protein, 14 aa, Staphylococcus
QDKIDAAKASVETY

SEQ ID NO: 1974984 - protein, 9 aa, Staphylococcus
QDKKEATVI

SEQ ID NO: 1974985 - protein, 7 aa, Staphylococcus
QDKKREI

SEQ ID NO: 1974986 - protein, 10 aa, Staphylococcus
QDKMIDPQSA

SEQ ID NO: 1974987 - protein, 4 aa, Staphylococcus
QDKN

SEQ ID NO: 1974988 - protein, 10 aa, Staphylococcus
QDKNKPLPVE

SEQ ID NO: 1974989 - protein, 13 aa, Staphylococcus
QDKNNNKSPLRPE

SEQ ID NO: 1974990 - protein, 4 aa, Staphylococcus
QDKP

SEQ ID NO: 1974991 - protein, 9 aa, Staphylococcus
QDKPDEDVN

SEQ ID NO: 1974992 - protein, 18 aa, Staphylococcus
QDKQLDSYRRLKRIIEAD

SEQ ID NO: 1974993 - protein, 9 aa, Staphylococcus
QDKQYDPAT

SEQ ID NO: 1974994 - protein, 4 aa, Staphylococcus
QDKS

SEQ ID NO: 1974995 - protein, 6 aa, Staphylococcus
QDKTKI

SEQ ID NO: 1974996 - protein, 10 aa, Staphylococcus
QDKTSNESKI

SEQ ID NO: 1974997 - protein, 8 aa, Staphylococcus
QDKVAEEQ

SEQ ID NO: 1974998 - protein, 11 aa, Staphylococcus
QDKVNQQIRQP

SEQ ID NO: 1974999 - protein, 14 aa, Staphylococcus
QDLAQELDTSPSSI

SEQ ID NO: 1975000 - protein, 13 aa, Staphylococcus
QDLATAKKKDSTG

SEQ ID NO: 1975001 - protein, 10 aa, Staphylococcus
QDLEKDSTSI

SEQ ID NO: 1975002 - protein, 6 aa, Staphylococcus
QDLEQA

SEQ ID NO: 1975003 - protein, 10 aa, Staphylococcus
QDLEQQSSGI

SEQ ID NO: 1975004 - protein, 19 aa, Staphylococcus
QDLGSRAGIAKAKSEIVTG

SEQ ID NO: 1975005 - protein, 17 aa, Staphylococcus
QDLGSREGIAQAKSEIT

SEQ ID NO: 1975006 - protein, 13 aa, Staphylococcus
QDLKEGNQSRGYQ

SEQ ID NO: 1975007 - protein, 4 aa, Staphylococcus
QDLN

SEQ ID NO: 1975008 - protein, 9 aa, Staphylococcus
QDLNNAGTT

SEQ ID NO: 1975009 - protein, 13 aa, Staphylococcus
QDLNNYATTIPQT

SEQ ID NO: 1975010 - protein, 14 aa, Staphylococcus
QDLPYSTKRPMRSA

SEQ ID NO: 1975011 - protein, 6 aa, Staphylococcus
QDLSPE

SEQ ID NO: 1975012 - protein, 5 aa, Staphylococcus
QDLSS

SEQ ID NO: 1975013 - protein, 4 aa, Staphylococcus
QDLT

SEQ ID NO: 1975014 - protein, 13 aa, Staphylococcus
QDLTNETYNLNDT

SEQ ID NO: 1975015 - protein, 8 aa, Staphylococcus
QDLTQQEK

SEQ ID NO: 1975016 - protein, 8 aa, Staphylococcus
QDLTRNEE

SEQ ID NO: 1975017 - protein, 9 aa, Staphylococcus
QDLYPSELE

SEQ ID NO: 1975018 - protein, 11 aa, Staphylococcus
QDMGGKSEKEF

SEQ ID NO: 1975019 - protein, 5 aa, Staphylococcus
QDNAI

SEQ ID NO: 1975020 - protein, 9 aa, Staphylococcus
QDNCTEPVN

SEQ ID NO: 1975021 - protein, 5 aa, Staphylococcus
QDNDA

SEQ ID NO: 1975022 - protein, 6 aa, Staphylococcus
QDNDIK

SEQ ID NO: 1975023 - protein, 7 aa, Staphylococcus
QDNDKQL

SEQ ID NO: 1975024 - protein, 7 aa, Staphylococcus
QDNEEFE

SEQ ID NO: 1975025 - protein, 8 aa, Staphylococcus
QDNEGFEE

SEQ ID NO: 1975026 - protein, 12 aa, Staphylococcus
QDNEGPEAGVKR

SEQ ID NO: 1975027 - protein, 6 aa, Staphylococcus
QDNGYE

SEQ ID NO: 1975028 - protein, 7 aa, Staphylococcus
QDNHETL

SEQ ID NO: 1975029 - protein, 10 aa, Staphylococcus
QDNHNQDDDR

SEQ ID NO: 1975030 - protein, 5 aa, Staphylococcus
QDNIE

SEQ ID NO: 1975031 - protein, 9 aa, Staphylococcus
QDNINPYAQ

SEQ ID NO: 1975032 - protein, 6 aa, Staphylococcus
QDNKDN

SEQ ID NO: 1975033 - protein, 9 aa, Staphylococcus
QDNKNNNVI

SEQ ID NO: 1975034 - protein, 8 aa, Staphylococcus
QDNLEEAR

SEQ ID NO: 1975035 - protein, 7 aa, Staphylococcus
QDNLESS

SEQ ID NO: 1975036 - protein, 7 aa, Staphylococcus
QDNNEDT

SEQ ID NO: 1975037 - protein, 12 aa, Staphylococcus
QDNNESKPYEET

SEQ ID NO: 1975038 - protein, 6 aa, Staphylococcus
QDNNGV

SEQ ID NO: 1975039 - protein, 6 aa, Staphylococcus
QDNNIK

SEQ ID NO: 1975040 - protein, 10 aa, Staphylococcus
QDNPELPRPI

SEQ ID NO: 1975041 - protein, 13 aa, Staphylococcus
QDNPLTPLPDSVE

SEQ ID NO: 1975042 - protein, 10 aa, Staphylococcus
QDNPNGSYKD

SEQ ID NO: 1975043 - protein, 8 aa, Staphylococcus
QDNPPTIY

SEQ ID NO: 1975044 - protein, 5 aa, Staphylococcus
QDNPS

SEQ ID NO: 1975045 - protein, 12 aa, Staphylococcus
QDNQDSKPYEET

SEQ ID NO: 1975046 - protein, 4 aa, Staphylococcus
QDNT

SEQ ID NO: 1975047 - protein, 5 aa, Staphylococcus
QDNTR

SEQ ID NO: 1975048 - protein, 8 aa, Staphylococcus
QDPAARST

SEQ ID NO: 1975049 - protein, 4 aa, Staphylococcus
QDPD

SEQ ID NO: 1975050 - protein, 14 aa, Staphylococcus
QDPEKFKEAVSQGE

SEQ ID NO: 1975051 - protein, 7 aa, Staphylococcus
QDPEQFK

SEQ ID NO: 1975052 - protein, 7 aa, Staphylococcus
QDPGNLG

SEQ ID NO: 1975053 - protein, 6 aa, Staphylococcus
QDPHKL

SEQ ID NO: 1975054 - protein, 4 aa, Staphylococcus
QDPI

SEQ ID NO: 1975055 - protein, 14 aa, Staphylococcus
QDPLASATHPPLNQ

SEQ ID NO: 1975056 - protein, 12 aa, Staphylococcus
QDPLKNSDFSTA

SEQ ID NO: 1975057 - protein, 4 aa, Staphylococcus
QDPN

SEQ ID NO: 1975058 - protein, 9 aa, Staphylococcus
QDPNKFKQA

SEQ ID NO: 1975059 - protein, 7 aa, Staphylococcus
QDPNQFK

SEQ ID NO: 1975060 - protein, 7 aa, Staphylococcus
QDPQQFK

SEQ ID NO: 1975061 - protein, 12 aa, Staphylococcus
QDPQVADDRTNE

SEQ ID NO: 1975062 - protein, 5 aa, Staphylococcus
QDPSI

SEQ ID NO: 1975063 - protein, 14 aa, Staphylococcus
QDPSTTEPSSASMN

SEQ ID NO: 1975064 - protein, 4 aa, Staphylococcus
QDPT

SEQ ID NO: 1975065 - protein, 16 aa, Staphylococcus
QDPTKKMSKSDDNAKN

SEQ ID NO: 1975066 - protein, 9 aa, Staphylococcus
QDPTSVSDD

SEQ ID NO: 1975067 - protein, 8 aa, Staphylococcus
QDPTSVSE

SEQ ID NO: 1975068 - protein, 6 aa, Staphylococcus
QDQAAK

SEQ ID NO: 1975069 - protein, 6 aa, Staphylococcus
QDQATK

SEQ ID NO: 1975070 - protein, 15 aa, Staphylococcus
QDQDTANDKYTGFES

SEQ ID NO: 1975071 - protein, 14 aa, Staphylococcus
QDQDTANDKYTGLE

SEQ ID NO: 1975072 - protein, 16 aa, Staphylococcus
QDQDTANDKYTGYESR

SEQ ID NO: 1975073 - protein, 14 aa, Staphylococcus
QDQDTANDQYTGME

SEQ ID NO: 1975074 - protein, 15 aa, Staphylococcus
QDQDTGNDKYTGYEA

SEQ ID NO: 1975075 - protein, 4 aa, Staphylococcus
QDQE

SEQ ID NO: 1975076 - protein, 16 aa, Staphylococcus
QDQEDDDSDRKQVDPR

SEQ ID NO: 1975077 - protein, 7 aa, Staphylococcus
QDQITRK

SEQ ID NO: 1975078 - protein, 8 aa, Staphylococcus
QDQMINTD

SEQ ID NO: 1975079 - protein, 8 aa, Staphylococcus
QDQNHPLP

SEQ ID NO: 1975080 - protein, 9 aa, Staphylococcus
QDQNKPLPV

SEQ ID NO: 1975081 - protein, 5 aa, Staphylococcus
QDQNL

SEQ ID NO: 1975082 - protein, 4 aa, Staphylococcus
QDQP

SEQ ID NO: 1975083 - protein, 5 aa, Staphylococcus
QDQSI

SEQ ID NO: 1975084 - protein, 8 aa, Staphylococcus
QDQSLDAQ

SEQ ID NO: 1975085 - protein, 10 aa, Staphylococcus
QDQSLDGQID

SEQ ID NO: 1975086 - protein, 6 aa, Staphylococcus
QDQTYT

SEQ ID NO: 1975087 - protein, 5 aa, Staphylococcus
QDQVL

SEQ ID NO: 1975088 - protein, 5 aa, Staphylococcus
QDQVS

SEQ ID NO: 1975089 - protein, 8 aa, Staphylococcus
QDQYSQGM

SEQ ID NO: 1975090 - protein, 4 aa, Staphylococcus
QDRE

SEQ ID NO: 1975091 - protein, 6 aa, Staphylococcus
QDREGR

SEQ ID NO: 1975092 - protein, 5 aa, Staphylococcus
QDRGI

SEQ ID NO: 1975093 - protein, 8 aa, Staphylococcus
QDRPDEGW

SEQ ID NO: 1975094 - protein, 8 aa, Staphylococcus
QDRPNMKT

SEQ ID NO: 1975095 - protein, 8 aa, Staphylococcus
QDRPSDQW

SEQ ID NO: 1975096 - protein, 9 aa, Staphylococcus
QDRPSSGWE

SEQ ID NO: 1975097 - protein, 5 aa, Staphylococcus
QDRPT

SEQ ID NO: 1975098 - protein, 4 aa, Staphylococcus
QDRQ

SEQ ID NO: 1975099 - protein, 8 aa, Staphylococcus
QDRQRYDA

SEQ ID NO: 1975100 - protein, 10 aa, Staphylococcus
QDRVDEEQKR

SEQ ID NO: 1975101 - protein, 14 aa, Staphylococcus
QDRVSKVRSDTDER

SEQ ID NO: 1975102 - protein, 11 aa, Staphylococcus
QDRYQLEQNDG

SEQ ID NO: 1975103 - protein, 14 aa, Staphylococcus
QDSEGFAKVLLEMW

SEQ ID NO: 1975104 - protein, 9 aa, Staphylococcus
QDSHKRRSM

SEQ ID NO: 1975105 - protein, 14 aa, Staphylococcus
QDSITSTTGWNGAE

SEQ ID NO: 1975106 - protein, 11 aa, Staphylococcus
QDSKDHKDQQV

SEQ ID NO: 1975107 - protein, 6 aa, Staphylococcus
QDSKEA

SEQ ID NO: 1975108 - protein, 7 aa, Staphylococcus
QDSKITD

SEQ ID NO: 1975109 - protein, 5 aa, Staphylococcus
QDSKK

SEQ ID NO: 1975110 - protein, 14 aa, Staphylococcus
QDSPERFVKLFKGE

SEQ ID NO: 1975111 - protein, 10 aa, Staphylococcus
QDSQPVQDIS

SEQ ID NO: 1975112 - protein, 7 aa, Staphylococcus
QDSQSFY

SEQ ID NO: 1975113 - protein, 5 aa, Staphylococcus
QDSSS

SEQ ID NO: 1975114 - protein, 7 aa, Staphylococcus
QDSTIEA

SEQ ID NO: 1975115 - protein, 10 aa, Staphylococcus
QDSVEEAEEA

SEQ ID NO: 1975116 - protein, 8 aa, Staphylococcus
QDSYLRSE

SEQ ID NO: 1975117 - protein, 5 aa, Staphylococcus
QDTDL

SEQ ID NO: 1975118 - protein, 9 aa, Staphylococcus
QDTESITPQ

SEQ ID NO: 1975119 - protein, 15 aa, Staphylococcus
QDTGHKPTLIHKIIT

SEQ ID NO: 1975120 - protein, 5 aa, Staphylococcus
QDTGN

SEQ ID NO: 1975121 - protein, 4 aa, Staphylococcus
QDTI

SEQ ID NO: 1975122 - protein, 16 aa, Staphylococcus
QDTKQLENSYQVQSEK

SEQ ID NO: 1975123 - protein, 7 aa, Staphylococcus
QDTLDSS

SEQ ID NO: 1975124 - protein, 7 aa, Staphylococcus
QDTNQVQ

SEQ ID NO: 1975125 - protein, 9 aa, Staphylococcus
QDTPGVDSN

SEQ ID NO: 1975126 - protein, 20 aa, Staphylococcus
QDTPGVDSNISTHLSSTEQY

SEQ ID NO: 1975127 - protein, 19 aa, Staphylococcus
QDTPGVDSNVATHQSSTEQ

SEQ ID NO: 1975128 - protein, 19 aa, Staphylococcus
QDTPGVDSNVATHQSTTEQ

SEQ ID NO: 1975129 - protein, 18 aa, Staphylococcus
QDTPGVDSNVATHQTTTE

SEQ ID NO: 1975130 - protein, 18 aa, Staphylococcus
QDTPGVDSNVSAHQSTTE

SEQ ID NO: 1975131 - protein, 14 aa, Staphylococcus
QDTRYGQQVGNYSD

SEQ ID NO: 1975132 - protein, 11 aa, Staphylococcus
QDTSDSQPYEE

SEQ ID NO: 1975133 - protein, 9 aa, Staphylococcus
QDTSQIDTI

SEQ ID NO: 1975134 - protein, 10 aa, Staphylococcus
QDTSTPSYES

SEQ ID NO: 1975135 - protein, 10 aa, Staphylococcus
QDTSYRERST

SEQ ID NO: 1975136 - protein, 10 aa, Staphylococcus
QDTTAIDNAK

SEQ ID NO: 1975137 - protein, 10 aa, Staphylococcus
QDTTAIENAK

SEQ ID NO: 1975138 - protein, 11 aa, Staphylococcus
QDTTALDNAKE

SEQ ID NO: 1975139 - protein, 10 aa, Staphylococcus
QDTTALENAK

SEQ ID NO: 1975140 - protein, 5 aa, Staphylococcus
QDTTS

SEQ ID NO: 1975141 - protein, 7 aa, Staphylococcus
QDTTSSF

SEQ ID NO: 1975142 - protein, 14 aa, Staphylococcus
QDTTYLSDSPTFNN

SEQ ID NO: 1975143 - protein, 5 aa, Staphylococcus
QDTVD

SEQ ID NO: 1975144 - protein, 9 aa, Staphylococcus
QDVDSSPNE

SEQ ID NO: 1975145 - protein, 25 aa, Staphylococcus
QDVESYKGRKIQSIDNGFKKEGHKN

SEQ ID NO: 1975146 - protein, 4 aa, Staphylococcus
QDVL

SEQ ID NO: 1975147 - protein, 4 aa, Staphylococcus
QDVP

SEQ ID NO: 1975148 - protein, 9 aa, Staphylococcus
QDVPEGKDI

SEQ ID NO: 1975149 - protein, 8 aa, Staphylococcus
QDVPQSDF

SEQ ID NO: 1975150 - protein, 7 aa, Staphylococcus
QDVPTNI

SEQ ID NO: 1975151 - protein, 16 aa, Staphylococcus
QDVSSASKSNNAPFDE

SEQ ID NO: 1975152 - protein, 24 aa, Staphylococcus
QDVTADQVNEAMKQASDESFGYTE

SEQ ID NO: 1975153 - protein, 5 aa, Staphylococcus
QDVTR

SEQ ID NO: 1975154 - protein, 8 aa, Staphylococcus
QDYASGEP

SEQ ID NO: 1975155 - protein, 5 aa, Staphylococcus
QDYEQ

SEQ ID NO: 1975156 - protein, 5 aa, Staphylococcus
QDYGK

SEQ ID NO: 1975157 - protein, 10 aa, Staphylococcus
QDYKKGKKTA

SEQ ID NO: 1975158 - protein, 6 aa, Staphylococcus
QDYKWN

SEQ ID NO: 1975159 - protein, 8 aa, Staphylococcus
QDYPNYND

SEQ ID NO: 1975160 - protein, 4 aa, Staphylococcus
QDYQ

SEQ ID NO: 1975161 - protein, 12 aa, Staphylococcus
QDYQDHKDNPYA

SEQ ID NO: 1975162 - protein, 10 aa, Staphylococcus
QDYQTSEKLN

SEQ ID NO: 1975163 - protein, 9 aa, Staphylococcus
QDYSKSEVI

SEQ ID NO: 1975164 - protein, 7 aa, Staphylococcus
QDYSQEG

SEQ ID NO: 1975165 - protein, 6 aa, Staphylococcus
QDYTTD

SEQ ID NO: 1975166 - protein, 19 aa, Staphylococcus
QDYTVEATTALNKKINGDG

SEQ ID NO: 1975167 - protein, 4 aa, Staphylococcus
QDYY

SEQ ID NO: 1975168 - protein, 12 aa, Staphylococcus
QEAESAKQRNEL

SEQ ID NO: 1975169 - protein, 8 aa, Staphylococcus
QEAGTKKH

SEQ ID NO: 1975170 - protein, 7 aa, Staphylococcus
QEAGVKP

SEQ ID NO: 1975171 - protein, 10 aa, Staphylococcus
QEAHSEKDAL

SEQ ID NO: 1975172 - protein, 4 aa, Staphylococcus
QEAI

SEQ ID NO: 1975173 - protein, 8 aa, Staphylococcus
QEAKPDVA

SEQ ID NO: 1975174 - protein, 6 aa, Staphylococcus
QEALSK

SEQ ID NO: 1975175 - protein, 11 aa, Staphylococcus
QEAMDQNSAWD

SEQ ID NO: 1975176 - protein, 7 aa, Staphylococcus
QEANDNE

SEQ ID NO: 1975177 - protein, 7 aa, Staphylococcus
QEANIKN

SEQ ID NO: 1975178 - protein, 5 aa, Staphylococcus
QEANP

SEQ ID NO: 1975179 - protein, 14 aa, Staphylococcus
QEAPNTMAGKQDEN

SEQ ID NO: 1975180 - protein, 19 aa, Staphylococcus
QEAPPEEISGAEENNDNDI

SEQ ID NO: 1975181 - protein, 20 aa, Staphylococcus
QEAPPENVDDVNAEPTNDSE

SEQ ID NO: 1975182 - protein, 6 aa, Staphylococcus
QEAPTV

SEQ ID NO: 1975183 - protein, 7 aa, Staphylococcus
QEAQGDD

SEQ ID NO: 1975184 - protein, 8 aa, Staphylococcus
QEAQGDDI

SEQ ID NO: 1975185 - protein, 7 aa, Staphylococcus
QEAQTGY

SEQ ID NO: 1975186 - protein, 5 aa, Staphylococcus
QEARR

SEQ ID NO: 1975187 - protein, 9 aa, Staphylococcus
QEASEFPNE

SEQ ID NO: 1975188 - protein, 19 aa, Staphylococcus
QEASPGEVSGAEESVSDSE

SEQ ID NO: 1975189 - protein, 9 aa, Staphylococcus
QEATPNNAP

SEQ ID NO: 1975190 - protein, 10 aa, Staphylococcus
QEATRKAKAM

SEQ ID NO: 1975191 - protein, 10 aa, Staphylococcus
QEATRRAKKL

SEQ ID NO: 1975192 - protein, 7 aa, Staphylococcus
QEDAKRK

SEQ ID NO: 1975193 - protein, 13 aa, Staphylococcus
QEDDKSEAMNLED

SEQ ID NO: 1975194 - protein, 10 aa, Staphylococcus
QEDDQSEAMN

SEQ ID NO: 1975195 - protein, 8 aa, Staphylococcus
QEDDQSEV

SEQ ID NO: 1975196 - protein, 6 aa, Staphylococcus
QEDEHD

SEQ ID NO: 1975197 - protein, 6 aa, Staphylococcus
QEDEQI

SEQ ID NO: 1975198 - protein, 8 aa, Staphylococcus
QEDGAPAY

SEQ ID NO: 1975199 - protein, 5 aa, Staphylococcus
QEDGG

SEQ ID NO: 1975200 - protein, 8 aa, Staphylococcus
QEDGGQEW

SEQ ID NO: 1975201 - protein, 5 aa, Staphylococcus
QEDGI

SEQ ID NO: 1975202 - protein, 6 aa, Staphylococcus
QEDGNI

SEQ ID NO: 1975203 - protein, 8 aa, Staphylococcus
QEDKNDDF

SEQ ID NO: 1975204 - protein, 9 aa, Staphylococcus
QEDKQTGIA

SEQ ID NO: 1975205 - protein, 11 aa, Staphylococcus
QEDKRQLTTDQ

SEQ ID NO: 1975206 - protein, 4 aa, Staphylococcus
QEDL

SEQ ID NO: 1975207 - protein, 4 aa, Staphylococcus
QEDM

SEQ ID NO: 1975208 - protein, 9 aa, Staphylococcus
QEDPEAYED

SEQ ID NO: 1975209 - protein, 10 aa, Staphylococcus
QEDPGYRGMG

SEQ ID NO: 1975210 - protein, 5 aa, Staphylococcus
QEDSA

SEQ ID NO: 1975211 - protein, 11 aa, Staphylococcus
QEDTASKKDAW

SEQ ID NO: 1975212 - protein, 9 aa, Staphylococcus
QEDYPEKGV

SEQ ID NO: 1975213 - protein, 14 aa, Staphylococcus
QEEAEEQDNDETTN

SEQ ID NO: 1975214 - protein, 14 aa, Staphylococcus
QEEAEEQENEEANN

SEQ ID NO: 1975215 - protein, 4 aa, Staphylococcus
QEED

SEQ ID NO: 1975216 - protein, 10 aa, Staphylococcus
QEEDNEYNKV

SEQ ID NO: 1975217 - protein, 16 aa, Staphylococcus
QEEDQQSAKEATEKLE

SEQ ID NO: 1975218 - protein, 7 aa, Staphylococcus
QEEEKNL

SEQ ID NO: 1975219 - protein, 5 aa, Staphylococcus
QEEHD

SEQ ID NO: 1975220 - protein, 7 aa, Staphylococcus
QEEHDQF

SEQ ID NO: 1975221 - protein, 4 aa, Staphylococcus
QEEI

SEQ ID NO: 1975222 - protein, 6 aa, Staphylococcus
QEEIAG

SEQ ID NO: 1975223 - protein, 9 aa, Staphylococcus
QEEIDTVER

SEQ ID NO: 1975224 - protein, 15 aa, Staphylococcus
QEEIDYQKEHGGEIS

SEQ ID NO: 1975225 - protein, 14 aa, Staphylococcus
QEEIDYQRTHGGTI

SEQ ID NO: 1975226 - protein, 12 aa, Staphylococcus
QEEKRELTSEQR

SEQ ID NO: 1975227 - protein, 4 aa, Staphylococcus
QEEL

SEQ ID NO: 1975228 - protein, 5 aa, Staphylococcus
QEELE

SEQ ID NO: 1975229 - protein, 11 aa, Staphylococcus
QEELNDVRKDI

SEQ ID NO: 1975230 - protein, 52 aa, Staphylococcus
QEELSNEKEKQSALQSRVEQEKEKISKLQEKRAELDESRKALEDAENNYDLE

SEQ ID NO: 1975231 - protein, 11 aa, Staphylococcus
QEENIDTQIKE

SEQ ID NO: 1975232 - protein, 25 aa, Staphylococcus
QEEQEKYDSERKSAVGTGDRSERIR

SEQ ID NO: 1975233 - protein, 6 aa, Staphylococcus
QEEQGK

SEQ ID NO: 1975234 - protein, 25 aa, Staphylococcus
QEEQQKYAAQRKSAVGTGDRSERIR

SEQ ID NO: 1975235 - protein, 9 aa, Staphylococcus
QEERDKEAQ

SEQ ID NO: 1975236 - protein, 7 aa, Staphylococcus
QEERKEA

SEQ ID NO: 1975237 - protein, 9 aa, Staphylococcus
QEERQPING

SEQ ID NO: 1975238 - protein, 11 aa, Staphylococcus
QEESSKTTVTG

SEQ ID NO: 1975239 - protein, 8 aa, Staphylococcus
QEETDTSV

SEQ ID NO: 1975240 - protein, 7 aa, Staphylococcus
QEETQAL

SEQ ID NO: 1975241 - protein, 16 aa, Staphylococcus
QEETRFTRSKSNEKIV

SEQ ID NO: 1975242 - protein, 13 aa, Staphylococcus
QEETTAEERQNSF

SEQ ID NO: 1975243 - protein, 9 aa, Staphylococcus
QEEVEGRSE

SEQ ID NO: 1975244 - protein, 10 aa, Staphylococcus
QEEVEGRSEQ

SEQ ID NO: 1975245 - protein, 17 aa, Staphylococcus
QEEVGLRGAKAAAEQIK

SEQ ID NO: 1975246 - protein, 16 aa, Staphylococcus
QEEVGLRGAKASAELV

SEQ ID NO: 1975247 - protein, 16 aa, Staphylococcus
QEEVGLRGAKASTELI

SEQ ID NO: 1975248 - protein, 15 aa, Staphylococcus
QEEVGLRGAKPAAEL

SEQ ID NO: 1975249 - protein, 4 aa, Staphylococcus
QEEY

SEQ ID NO: 1975250 - protein, 9 aa, Staphylococcus
QEEYDKLSK

SEQ ID NO: 1975251 - protein, 6 aa, Staphylococcus
QEFEDY

SEQ ID NO: 1975252 - protein, 7 aa, Staphylococcus
QEFEPES

SEQ ID NO: 1975253 - protein, 7 aa, Staphylococcus
QEFGNGR

SEQ ID NO: 1975254 - protein, 9 aa, Staphylococcus
QEFKEGQEE

SEQ ID NO: 1975255 - protein, 6 aa, Staphylococcus
QEGASD

SEQ ID NO: 1975256 - protein, 5 aa, Staphylococcus
QEGDY

SEQ ID NO: 1975257 - protein, 14 aa, Staphylococcus
QEGESADSLGIDGT

SEQ ID NO: 1975258 - protein, 7 aa, Staphylococcus
QEGESKV

SEQ ID NO: 1975259 - protein, 21 aa, Staphylococcus
QEGESNAKSKQANNKKPKFIQ

SEQ ID NO: 1975260 - protein, 4 aa, Staphylococcus
QEGF

SEQ ID NO: 1975261 - protein, 8 aa, Staphylococcus
QEGGGNPY

SEQ ID NO: 1975262 - protein, 8 aa, Staphylococcus
QEGGHTIE

SEQ ID NO: 1975263 - protein, 9 aa, Staphylococcus
QEGHRPKGD

SEQ ID NO: 1975264 - protein, 18 aa, Staphylococcus
QEGKFDPDKKYTAEPREV

SEQ ID NO: 1975265 - protein, 16 aa, Staphylococcus
QEGKFKPNEKYESGHR

SEQ ID NO: 1975266 - protein, 15 aa, Staphylococcus
QEGKFKPNEKYKSGH

SEQ ID NO: 1975267 - protein, 17 aa, Staphylococcus
QEGKFKPNEKYKSGHRD

SEQ ID NO: 1975268 - protein, 17 aa, Staphylococcus
QEGKFNPKEKYESGHRD

SEQ ID NO: 1975269 - protein, 16 aa, Staphylococcus
QEGKFNPKKKCESGHR

SEQ ID NO: 1975270 - protein, 17 aa, Staphylococcus
QEGKSKQEIFEKTGATV

SEQ ID NO: 1975271 - protein, 14 aa, Staphylococcus
QEGLNDKESRRDQM

SEQ ID NO: 1975272 - protein, 6 aa, Staphylococcus
QEGLPT

SEQ ID NO: 1975273 - protein, 5 aa, Staphylococcus
QEGNH

SEQ ID NO: 1975274 - protein, 8 aa, Staphylococcus
QEGQAEDY

SEQ ID NO: 1975275 - protein, 9 aa, Staphylococcus
QEGRQPKGD

SEQ ID NO: 1975276 - protein, 9 aa, Staphylococcus
QEGRRPKGD

SEQ ID NO: 1975277 - protein, 7 aa, Staphylococcus
QEGTDFP

SEQ ID NO: 1975278 - protein, 6 aa, Staphylococcus
QEGTND

SEQ ID NO: 1975279 - protein, 5 aa, Staphylococcus
QEGYT

SEQ ID NO: 1975280 - protein, 11 aa, Staphylococcus
QEHANQTGNQM

SEQ ID NO: 1975281 - protein, 4 aa, Staphylococcus
QEHD

SEQ ID NO: 1975282 - protein, 6 aa, Staphylococcus
QEHDEL

SEQ ID NO: 1975283 - protein, 7 aa, Staphylococcus
QEHEEQP

SEQ ID NO: 1975284 - protein, 6 aa, Staphylococcus
QEHEGT

SEQ ID NO: 1975285 - protein, 8 aa, Staphylococcus
QEHIDSEA

SEQ ID NO: 1975286 - protein, 4 aa, Staphylococcus
QEHL

SEQ ID NO: 1975287 - protein, 11 aa, Staphylococcus
QEHPANNLDTY

SEQ ID NO: 1975288 - protein, 12 aa, Staphylococcus
QEHPANNLDTYQ

SEQ ID NO: 1975289 - protein, 7 aa, Staphylococcus
QEHQHTG

SEQ ID NO: 1975290 - protein, 10 aa, Staphylococcus
QEHQTEAGRN

SEQ ID NO: 1975291 - protein, 9 aa, Staphylococcus
QEHSERLQD

SEQ ID NO: 1975292 - protein, 10 aa, Staphylococcus
QEHSKSPKEW

SEQ ID NO: 1975293 - protein, 6 aa, Staphylococcus
QEHVTG

SEQ ID NO: 1975294 - protein, 11 aa, Staphylococcus
QEIADRDQYDM

SEQ ID NO: 1975295 - protein, 9 aa, Staphylococcus
QEIADRPKG

SEQ ID NO: 1975296 - protein, 16 aa, Staphylococcus
QEIAVKGEQVEHVEKA

SEQ ID NO: 1975297 - protein, 7 aa, Staphylococcus
QEIDNGL

SEQ ID NO: 1975298 - protein, 7 aa, Staphylococcus
QEIDRGE

SEQ ID NO: 1975299 - protein, 13 aa, Staphylococcus
QEIEAEKISTTAI

SEQ ID NO: 1975300 - protein, 7 aa, Staphylococcus
QEIEDNR

SEQ ID NO: 1975301 - protein, 11 aa, Staphylococcus
QEIEDRDNYDM

SEQ ID NO: 1975302 - protein, 20 aa, Staphylococcus
QEIGREGGEKTASEKGKEFY

SEQ ID NO: 1975303 - protein, 12 aa, Staphylococcus
QEIKQTAQQAEG

SEQ ID NO: 1975304 - protein, 6 aa, Staphylococcus
QEIQDL

SEQ ID NO: 1975305 - protein, 13 aa, Staphylococcus
QEISGHSDEINQE

SEQ ID NO: 1975306 - protein, 6 aa, Staphylococcus
QEITGD

SEQ ID NO: 1975307 - protein, 7 aa, Staphylococcus
QEITGNS

SEQ ID NO: 1975308 - protein, 6 aa, Staphylococcus
QEITKE

SEQ ID NO: 1975309 - protein, 9 aa, Staphylococcus
QEKADHITA

SEQ ID NO: 1975310 - protein, 8 aa, Staphylococcus
QEKAKKAL

SEQ ID NO: 1975311 - protein, 21 aa, Staphylococcus
QEKALREKEDGAAEKNMNKDE

SEQ ID NO: 1975312 - protein, 10 aa, Staphylococcus
QEKDVPPTYS

SEQ ID NO: 1975313 - protein, 7 aa, Staphylococcus
QEKEMTQ

SEQ ID NO: 1975314 - protein, 18 aa, Staphylococcus
QEKENNLKSYKEVQQSVS

SEQ ID NO: 1975315 - protein, 4 aa, Staphylococcus
QEKF

SEQ ID NO: 1975316 - protein, 8 aa, Staphylococcus
QEKHQQEL

SEQ ID NO: 1975317 - protein, 4 aa, Staphylococcus
QEKI

SEQ ID NO: 1975318 - protein, 10 aa, Staphylococcus
QEKIEADLRG

SEQ ID NO: 1975319 - protein, 15 aa, Staphylococcus
QEKIEKDQQKTDLSE

SEQ ID NO: 1975320 - protein, 6 aa, Staphylococcus
QEKINT

SEQ ID NO: 1975321 - protein, 6 aa, Staphylococcus
QEKLEN

SEQ ID NO: 1975322 - protein, 9 aa, Staphylococcus
QEKQDNNEI

SEQ ID NO: 1975323 - protein, 7 aa, Staphylococcus
QEKQTGH

SEQ ID NO: 1975324 - protein, 7 aa, Staphylococcus
QEKSLLG

SEQ ID NO: 1975325 - protein, 16 aa, Staphylococcus
QEKTETYVHSYFADYN

SEQ ID NO: 1975326 - protein, 8 aa, Staphylococcus
QEKTKEKV

SEQ ID NO: 1975327 - protein, 8 aa, Staphylococcus
QEKTNRRI

SEQ ID NO: 1975328 - protein, 8 aa, Staphylococcus
QEKTNRRV

SEQ ID NO: 1975329 - protein, 4 aa, Staphylococcus
QEKV

SEQ ID NO: 1975330 - protein, 9 aa, Staphylococcus
QEKVQSDNI

SEQ ID NO: 1975331 - protein, 8 aa, Staphylococcus
QEKVSADH

SEQ ID NO: 1975332 - protein, 10 aa, Staphylococcus
QEKVSSASYQ

SEQ ID NO: 1975333 - protein, 7 aa, Staphylococcus
QELAQTT

SEQ ID NO: 1975334 - protein, 20 aa, Staphylococcus
QELATSPNLAISSSSRGNLE

SEQ ID NO: 1975335 - protein, 8 aa, Staphylococcus
QELDNNKI

SEQ ID NO: 1975336 - protein, 7 aa, Staphylococcus
QELEDGN

SEQ ID NO: 1975337 - protein, 5 aa, Staphylococcus
QELEN

SEQ ID NO: 1975338 - protein, 11 aa, Staphylococcus
QELENGRIKDD

SEQ ID NO: 1975339 - protein, 7 aa, Staphylococcus
QELENNQ

SEQ ID NO: 1975340 - protein, 7 aa, Staphylococcus
QELENNS

SEQ ID NO: 1975341 - protein, 16 aa, Staphylococcus
QELGQKSAGLDTTRKS

SEQ ID NO: 1975342 - protein, 15 aa, Staphylococcus
QELGRKSAGLDTTRK

SEQ ID NO: 1975343 - protein, 21 aa, Staphylococcus
QELKDKLKPYSWGAQKQLDTA

SEQ ID NO: 1975344 - protein, 14 aa, Staphylococcus
QELKSQNKQEDNQF

SEQ ID NO: 1975345 - protein, 8 aa, Staphylococcus
QELNPETY

SEQ ID NO: 1975346 - protein, 5 aa, Staphylococcus
QELPS

SEQ ID NO: 1975347 - protein, 7 aa, Staphylococcus
QELQENK

SEQ ID NO: 1975348 - protein, 6 aa, Staphylococcus
QELQKL

SEQ ID NO: 1975349 - protein, 20 aa, Staphylococcus
QELQKLRDEETTTIDGRHAE

SEQ ID NO: 1975350 - protein, 51 aa, Staphylococcus
QELSNEKEKQNAIQSRVEEEKGKIAKLQEKRTELDESRKALEDAENNYNLE

SEQ ID NO: 1975351 - protein, 6 aa, Staphylococcus
QELSST

SEQ ID NO: 1975352 - protein, 5 aa, Staphylococcus
QELTP

SEQ ID NO: 1975353 - protein, 4 aa, Staphylococcus
QEMD

SEQ ID NO: 1975354 - protein, 4 aa, Staphylococcus
QEME

SEQ ID NO: 1975355 - protein, 5 aa, Staphylococcus
QEMKK

SEQ ID NO: 1975356 - protein, 7 aa, Staphylococcus
QEMTKPG

SEQ ID NO: 1975357 - protein, 13 aa, Staphylococcus
QEMYSEKISTTEI

SEQ ID NO: 1975358 - protein, 6 aa, Staphylococcus
QENASY

SEQ ID NO: 1975359 - protein, 18 aa, Staphylococcus
QENDIEQRNNTDVSNSYV

SEQ ID NO: 1975360 - protein, 6 aa, Staphylococcus
QENEKD

SEQ ID NO: 1975361 - protein, 20 aa, Staphylococcus
QENEKQLNKQLEQRNKEITS

SEQ ID NO: 1975362 - protein, 10 aa, Staphylococcus
QENERKRISR

SEQ ID NO: 1975363 - protein, 12 aa, Staphylococcus
QENESKQSRLDS

SEQ ID NO: 1975364 - protein, 4 aa, Staphylococcus
QENG

SEQ ID NO: 1975365 - protein, 6 aa, Staphylococcus
QENGEY

SEQ ID NO: 1975366 - protein, 16 aa, Staphylococcus
QENGGVVDKTTSGTLT

SEQ ID NO: 1975367 - protein, 10 aa, Staphylococcus
QENGTEPPFE

SEQ ID NO: 1975368 - protein, 12 aa, Staphylococcus
QENKGAAASRNV

SEQ ID NO: 1975369 - protein, 20 aa, Staphylococcus
QENKKRQSREEAHLDSGSTF

SEQ ID NO: 1975370 - protein, 9 aa, Staphylococcus
QENKSPDSI

SEQ ID NO: 1975371 - protein, 12 aa, Staphylococcus
QENKTADEQGAD

SEQ ID NO: 1975372 - protein, 10 aa, Staphylococcus
QENKTYDMTR

SEQ ID NO: 1975373 - protein, 9 aa, Staphylococcus
QENKVQKKI

SEQ ID NO: 1975374 - protein, 6 aa, Staphylococcus
QENNID

SEQ ID NO: 1975375 - protein, 12 aa, Staphylococcus
QENNKVSDETAE

SEQ ID NO: 1975376 - protein, 38 aa, Staphylococcus
QENNQQDLNETPTTQITNHSETSSRNNNASSNEPLDDY

SEQ ID NO: 1975377 - protein, 8 aa, Staphylococcus
QENPDYHG

SEQ ID NO: 1975378 - protein, 6 aa, Staphylococcus
QENPIP

SEQ ID NO: 1975379 - protein, 13 aa, Staphylococcus
QENPTIAPLAGTD

SEQ ID NO: 1975380 - protein, 12 aa, Staphylococcus
QENQGAARSRNV

SEQ ID NO: 1975381 - protein, 15 aa, Staphylococcus
QENQGAVKSQTLSEK

SEQ ID NO: 1975382 - protein, 7 aa, Staphylococcus
QENTNQS

SEQ ID NO: 1975383 - protein, 5 aa, Staphylococcus
QENVE

SEQ ID NO: 1975384 - protein, 9 aa, Staphylococcus
QENVEGLSS

SEQ ID NO: 1975385 - protein, 9 aa, Staphylococcus
QENVVTEPK

SEQ ID NO: 1975386 - protein, 4 aa, Staphylococcus
QENY

SEQ ID NO: 1975387 - protein, 7 aa, Staphylococcus
QEPERFS

SEQ ID NO: 1975388 - protein, 14 aa, Staphylococcus
QEPGYGNDEFSKEA

SEQ ID NO: 1975389 - protein, 12 aa, Staphylococcus
QEPIKRKDEDVS

SEQ ID NO: 1975390 - protein, 6 aa, Staphylococcus
QEPKDD

SEQ ID NO: 1975391 - protein, 6 aa, Staphylococcus
QEPKYI

SEQ ID NO: 1975392 - protein, 4 aa, Staphylococcus
QEPL

SEQ ID NO: 1975393 - protein, 4 aa, Staphylococcus
QEPP

SEQ ID NO: 1975394 - protein, 8 aa, Staphylococcus
QEPQDIDD

SEQ ID NO: 1975395 - protein, 9 aa, Staphylococcus
QEPRQAIGG

SEQ ID NO: 1975396 - protein, 10 aa, Staphylococcus
QEPSIAENET

SEQ ID NO: 1975397 - protein, 16 aa, Staphylococcus
QEPTKKMSKSDDNQKN

SEQ ID NO: 1975398 - protein, 7 aa, Staphylococcus
QEPTNLD

SEQ ID NO: 1975399 - protein, 5 aa, Staphylococcus
QEPYK

SEQ ID NO: 1975400 - protein, 6 aa, Staphylococcus
QEQAAQ

SEQ ID NO: 1975401 - protein, 7 aa, Staphylococcus
QEQAPIT

SEQ ID NO: 1975402 - protein, 9 aa, Staphylococcus
QEQATTYGH

SEQ ID NO: 1975403 - protein, 4 aa, Staphylococcus
QEQC

SEQ ID NO: 1975404 - protein, 8 aa, Staphylococcus
QEQDRGIT

SEQ ID NO: 1975405 - protein, 6 aa, Staphylococcus
QEQEGR

SEQ ID NO: 1975406 - protein, 5 aa, Staphylococcus
QEQFG

SEQ ID NO: 1975407 - protein, 4 aa, Staphylococcus
QEQG

SEQ ID NO: 1975408 - protein, 12 aa, Staphylococcus
QEQGTMSPEDFE

SEQ ID NO: 1975409 - protein, 12 aa, Staphylococcus
QEQGTMSPEDFQ

SEQ ID NO: 1975410 - protein, 16 aa, Staphylococcus
QEQKAARENGDSDFHK

SEQ ID NO: 1975411 - protein, 8 aa, Staphylococcus
QEQKNKVI

SEQ ID NO: 1975412 - protein, 4 aa, Staphylococcus
QEQL

SEQ ID NO: 1975413 - protein, 5 aa, Staphylococcus
QEQME

SEQ ID NO: 1975414 - protein, 7 aa, Staphylococcus
QEQMPSY

SEQ ID NO: 1975415 - protein, 4 aa, Staphylococcus
QEQP

SEQ ID NO: 1975416 - protein, 12 aa, Staphylococcus
QEQPDLPRPAGK

SEQ ID NO: 1975417 - protein, 14 aa, Staphylococcus
QEQPERGKIYDRNG

SEQ ID NO: 1975418 - protein, 8 aa, Staphylococcus
QEQSLNLN

SEQ ID NO: 1975419 - protein, 6 aa, Staphylococcus
QEQSQR

SEQ ID NO: 1975420 - protein, 5 aa, Staphylococcus
QEQTF

SEQ ID NO: 1975421 - protein, 7 aa, Staphylococcus
QEQTNRR

SEQ ID NO: 1975422 - protein, 4 aa, Staphylococcus
QEQV

SEQ ID NO: 1975423 - protein, 6 aa, Staphylococcus
QEQVET

SEQ ID NO: 1975424 - protein, 14 aa, Staphylococcus
QEQYGAPSKSLEKS

SEQ ID NO: 1975425 - protein, 5 aa, Staphylococcus
QERDD

SEQ ID NO: 1975426 - protein, 15 aa, Staphylococcus
QERELSLNAQGKHYE

SEQ ID NO: 1975427 - protein, 7 aa, Staphylococcus
QERFENR

SEQ ID NO: 1975428 - protein, 4 aa, Staphylococcus
QERH

SEQ ID NO: 1975429 - protein, 4 aa, Staphylococcus
QERK

SEQ ID NO: 1975430 - protein, 10 aa, Staphylococcus
QERKRKANEI

SEQ ID NO: 1975431 - protein, 12 aa, Staphylococcus
QERNITMSMKVV

SEQ ID NO: 1975432 - protein, 8 aa, Staphylococcus
QERPKLKH

SEQ ID NO: 1975433 - protein, 7 aa, Staphylococcus
QERPSEK

SEQ ID NO: 1975434 - protein, 7 aa, Staphylococcus
QERPTSL

SEQ ID NO: 1975435 - protein, 11 aa, Staphylococcus
QERRPAEPHSF

SEQ ID NO: 1975436 - protein, 8 aa, Staphylococcus
QERSGRDA

SEQ ID NO: 1975437 - protein, 6 aa, Staphylococcus
QERVEG

SEQ ID NO: 1975438 - protein, 22 aa, Staphylococcus
QERVNASKELNGPKAEFTGNKE

SEQ ID NO: 1975439 - protein, 22 aa, Staphylococcus
QERVNASKTLNGPKASFEGNKE

SEQ ID NO: 1975440 - protein, 4 aa, Staphylococcus
QERY

SEQ ID NO: 1975441 - protein, 14 aa, Staphylococcus
QESDGLAEIPDDSA

SEQ ID NO: 1975442 - protein, 7 aa, Staphylococcus
QESDTQT

SEQ ID NO: 1975443 - protein, 6 aa, Staphylococcus
QESEKL

SEQ ID NO: 1975444 - protein, 13 aa, Staphylococcus
QESINQKTIEAAS

SEQ ID NO: 1975445 - protein, 4 aa, Staphylococcus
QESL

SEQ ID NO: 1975446 - protein, 8 aa, Staphylococcus
QESNEEIE

SEQ ID NO: 1975447 - protein, 8 aa, Staphylococcus
QESPDEVA

SEQ ID NO: 1975448 - protein, 11 aa, Staphylococcus
QESPLGGDDIP

SEQ ID NO: 1975449 - protein, 10 aa, Staphylococcus
QESRKKAQSF

SEQ ID NO: 1975450 - protein, 7 aa, Staphylococcus
QESRTGY

SEQ ID NO: 1975451 - protein, 10 aa, Staphylococcus
QESTNREYNE

SEQ ID NO: 1975452 - protein, 8 aa, Staphylococcus
QETDEQRK

SEQ ID NO: 1975453 - protein, 7 aa, Staphylococcus
QETDKNV

SEQ ID NO: 1975454 - protein, 9 aa, Staphylococcus
QETELGGAT

SEQ ID NO: 1975455 - protein, 8 aa, Staphylococcus
QETGKSLS

SEQ ID NO: 1975456 - protein, 8 aa, Staphylococcus
QETGQSVS

SEQ ID NO: 1975457 - protein, 6 aa, Staphylococcus
QETGVT

SEQ ID NO: 1975458 - protein, 4 aa, Staphylococcus
QETH

SEQ ID NO: 1975459 - protein, 9 aa, Staphylococcus
QETKPEDVL

SEQ ID NO: 1975460 - protein, 9 aa, Staphylococcus
QETKSTLAI

SEQ ID NO: 1975461 - protein, 6 aa, Staphylococcus
QETLES

SEQ ID NO: 1975462 - protein, 5 aa, Staphylococcus
QETPD

SEQ ID NO: 1975463 - protein, 8 aa, Staphylococcus
QETPDERI

SEQ ID NO: 1975464 - protein, 10 aa, Staphylococcus
QETPPNKCPN

SEQ ID NO: 1975465 - protein, 7 aa, Staphylococcus
QETPPNL

SEQ ID NO: 1975466 - protein, 11 aa, Staphylococcus
QETPPNRCPNC

SEQ ID NO: 1975467 - protein, 7 aa, Staphylococcus
QETQTPV

SEQ ID NO: 1975468 - protein, 6 aa, Staphylococcus
QETRPG

SEQ ID NO: 1975469 - protein, 6 aa, Staphylococcus
QETSEG

SEQ ID NO: 1975470 - protein, 5 aa, Staphylococcus
QETSL

SEQ ID NO: 1975471 - protein, 8 aa, Staphylococcus
QETSSKAY

SEQ ID NO: 1975472 - protein, 17 aa, Staphylococcus
QETTPVERDEATAATTA

SEQ ID NO: 1975473 - protein, 6 aa, Staphylococcus
QETVEA

SEQ ID NO: 1975474 - protein, 22 aa, Staphylococcus
QETYQTYKAKQHELNELESADQ

SEQ ID NO: 1975475 - protein, 5 aa, Staphylococcus
QEVAE

SEQ ID NO: 1975476 - protein, 5 aa, Staphylococcus
QEVAG

SEQ ID NO: 1975477 - protein, 19 aa, Staphylococcus
QEVEKRNRAGENFEVTNGI

SEQ ID NO: 1975478 - protein, 6 aa, Staphylococcus
QEVENI

SEQ ID NO: 1975479 - protein, 8 aa, Staphylococcus
QEVGQTPA

SEQ ID NO: 1975480 - protein, 6 aa, Staphylococcus
QEVKDR

SEQ ID NO: 1975481 - protein, 6 aa, Staphylococcus
QEVKGR

SEQ ID NO: 1975482 - protein, 6 aa, Staphylococcus
QEVKKA

SEQ ID NO: 1975483 - protein, 7 aa, Staphylococcus
QEVNDTF

SEQ ID NO: 1975484 - protein, 11 aa, Staphylococcus
QEVQSPSDHAA

SEQ ID NO: 1975485 - protein, 16 aa, Staphylococcus
QEVRKGESIKQAIREG

SEQ ID NO: 1975486 - protein, 8 aa, Staphylococcus
QEVSNSNS

SEQ ID NO: 1975487 - protein, 4 aa, Staphylococcus
QEVT

SEQ ID NO: 1975488 - protein, 13 aa, Staphylococcus
QEWSNGNVGTNGV

SEQ ID NO: 1975489 - protein, 4 aa, Staphylococcus
QEYD

SEQ ID NO: 1975490 - protein, 4 aa, Staphylococcus
QEYE

SEQ ID NO: 1975491 - protein, 9 aa, Staphylococcus
QEYEANGAA

SEQ ID NO: 1975492 - protein, 9 aa, Staphylococcus
QEYERQQAE

SEQ ID NO: 1975493 - protein, 10 aa, Staphylococcus
QEYERQQDEI

SEQ ID NO: 1975494 - protein, 10 aa, Staphylococcus
QEYERQTQQF

SEQ ID NO: 1975495 - protein, 18 aa, Staphylococcus
QEYKDNRDKWNKEERAKE

SEQ ID NO: 1975496 - protein, 10 aa, Staphylococcus
QEYQKQQDEI

SEQ ID NO: 1975497 - protein, 6 aa, Staphylococcus
QEYRPT

SEQ ID NO: 1975498 - protein, 6 aa, Staphylococcus
QEYSKD

SEQ ID NO: 1975499 - protein, 11 aa, Staphylococcus
QEYSNKAANVL

SEQ ID NO: 1975500 - protein, 20 aa, Staphylococcus
QFAEGTTHDYASASETIAER

SEQ ID NO: 1975501 - protein, 21 aa, Staphylococcus
QFAEGTTHDYASASETIAERA

SEQ ID NO: 1975502 - protein, 9 aa, Staphylococcus
QFAQRCDEE

SEQ ID NO: 1975503 - protein, 5 aa, Staphylococcus
QFDEA

SEQ ID NO: 1975504 - protein, 15 aa, Staphylococcus
QFDGGGHPNASGASV

SEQ ID NO: 1975505 - protein, 9 aa, Staphylococcus
QFDKEQHKY

SEQ ID NO: 1975506 - protein, 10 aa, Staphylococcus
QFDLNGQSYT

SEQ ID NO: 1975507 - protein, 12 aa, Staphylococcus
QFDPQLKDKLLT

SEQ ID NO: 1975508 - protein, 11 aa, Staphylococcus
QFDPSKEYSEK

SEQ ID NO: 1975509 - protein, 12 aa, Staphylococcus
QFDSELKDKILQ

SEQ ID NO: 1975510 - protein, 8 aa, Staphylococcus
QFDSPEKL

SEQ ID NO: 1975511 - protein, 9 aa, Staphylococcus
QFDSPEKLA

SEQ ID NO: 1975512 - protein, 5 aa, Staphylococcus
QFDTP

SEQ ID NO: 1975513 - protein, 12 aa, Staphylococcus
QFDTTVDDLFST

SEQ ID NO: 1975514 - protein, 4 aa, Staphylococcus
QFDY

SEQ ID NO: 1975515 - protein, 6 aa, Staphylococcus
QFEDRR

SEQ ID NO: 1975516 - protein, 11 aa, Staphylococcus
QFEGKSPSTEI

SEQ ID NO: 1975517 - protein, 6 aa, Staphylococcus
QFELTE

SEQ ID NO: 1975518 - protein, 10 aa, Staphylococcus
QFENPANPEI

SEQ ID NO: 1975519 - protein, 5 aa, Staphylococcus
QFETG

SEQ ID NO: 1975520 - protein, 4 aa, Staphylococcus
QFGG

SEQ ID NO: 1975521 - protein, 15 aa, Staphylococcus
QFGGGGHPNASGVSV

SEQ ID NO: 1975522 - protein, 5 aa, Staphylococcus
QFGPD

SEQ ID NO: 1975523 - protein, 5 aa, Staphylococcus
QFGPK

SEQ ID NO: 1975524 - protein, 11 aa, Staphylococcus
QFGPKKITEDT

SEQ ID NO: 1975525 - protein, 12 aa, Staphylococcus
QFGPQKKTEDTY

SEQ ID NO: 1975526 - protein, 6 aa, Staphylococcus
QFGTSL

SEQ ID NO: 1975527 - protein, 9 aa, Staphylococcus
QFGTTTKQT

SEQ ID NO: 1975528 - protein, 11 aa, Staphylococcus
QFGVSTASVRE

SEQ ID NO: 1975529 - protein, 4 aa, Staphylococcus
QFIP

SEQ ID NO: 1975530 - protein, 5 aa, Staphylococcus
QFIPG

SEQ ID NO: 1975531 - protein, 13 aa, Staphylococcus
QFKDESVRQKGIE

SEQ ID NO: 1975532 - protein, 11 aa, Staphylococcus
QFKDKSPSTEI

SEQ ID NO: 1975533 - protein, 11 aa, Staphylococcus
QFKDKSPSTEV

SEQ ID NO: 1975534 - protein, 8 aa, Staphylococcus
QFKDTKTK

SEQ ID NO: 1975535 - protein, 8 aa, Staphylococcus
QFKGTKTK

SEQ ID NO: 1975536 - protein, 6 aa, Staphylococcus
QFKKED

SEQ ID NO: 1975537 - protein, 5 aa, Staphylococcus
QFKNS

SEQ ID NO: 1975538 - protein, 5 aa, Staphylococcus
QFKPG

SEQ ID NO: 1975539 - protein, 8 aa, Staphylococcus
QFKTGDYT

SEQ ID NO: 1975540 - protein, 5 aa, Staphylococcus
QFKTS

SEQ ID NO: 1975541 - protein, 10 aa, Staphylococcus
QFKYSDNAAY

SEQ ID NO: 1975542 - protein, 4 aa, Staphylococcus
QFLP

SEQ ID NO: 1975543 - protein, 9 aa, Staphylococcus
QFMPKDKPR

SEQ ID NO: 1975544 - protein, 5 aa, Staphylococcus
QFNKN

SEQ ID NO: 1975545 - protein, 5 aa, Staphylococcus
QFNNS

SEQ ID NO: 1975546 - protein, 11 aa, Staphylococcus
QFNPGGSIKDR

SEQ ID NO: 1975547 - protein, 5 aa, Staphylococcus
QFNTQ

SEQ ID NO: 1975548 - protein, 5 aa, Staphylococcus
QFPAG

SEQ ID NO: 1975549 - protein, 5 aa, Staphylococcus
QFPEI

SEQ ID NO: 1975550 - protein, 5 aa, Staphylococcus
QFPER

SEQ ID NO: 1975551 - protein, 11 aa, Staphylococcus
QFPKTKEVYGS

SEQ ID NO: 1975552 - protein, 5 aa, Staphylococcus
QFPNI

SEQ ID NO: 1975553 - protein, 4 aa, Staphylococcus
QFPT

SEQ ID NO: 1975554 - protein, 5 aa, Staphylococcus
QFQLN

SEQ ID NO: 1975555 - protein, 12 aa, Staphylococcus
QFQQQTAQFEQN

SEQ ID NO: 1975556 - protein, 7 aa, Staphylococcus
QFQQSAQ

SEQ ID NO: 1975557 - protein, 9 aa, Staphylococcus
QFQTTANNQ

SEQ ID NO: 1975558 - protein, 9 aa, Staphylococcus
QFRDEDKQG

SEQ ID NO: 1975559 - protein, 5 aa, Staphylococcus
QFRGN

SEQ ID NO: 1975560 - protein, 6 aa, Staphylococcus
QFSDDE

SEQ ID NO: 1975561 - protein, 8 aa, Staphylococcus
QFSDGNGF

SEQ ID NO: 1975562 - protein, 9 aa, Staphylococcus
QFSDKEMQK

SEQ ID NO: 1975563 - protein, 4 aa, Staphylococcus
QFSE

SEQ ID NO: 1975564 - protein, 14 aa, Staphylococcus
QFSEEELQQLLDNI

SEQ ID NO: 1975565 - protein, 9 aa, Staphylococcus
QFSEETDYP

SEQ ID NO: 1975566 - protein, 5 aa, Staphylococcus
QFSEH

SEQ ID NO: 1975567 - protein, 11 aa, Staphylococcus
QFSGSESYKDG

SEQ ID NO: 1975568 - protein, 10 aa, Staphylococcus
QFSKASNAEL

SEQ ID NO: 1975569 - protein, 9 aa, Staphylococcus
QFSKSDVSV

SEQ ID NO: 1975570 - protein, 4 aa, Staphylococcus
QFSN

SEQ ID NO: 1975571 - protein, 10 aa, Staphylococcus
QFSQNRTNVD

SEQ ID NO: 1975572 - protein, 7 aa, Staphylococcus
QFSRDTV

SEQ ID NO: 1975573 - protein, 7 aa, Staphylococcus
QFSSFSE

SEQ ID NO: 1975574 - protein, 4 aa, Staphylococcus
QFTE

SEQ ID NO: 1975575 - protein, 12 aa, Staphylococcus
QFTEKSKGFSDE

SEQ ID NO: 1975576 - protein, 10 aa, Staphylococcus
QFTEKSKHFS

SEQ ID NO: 1975577 - protein, 11 aa, Staphylococcus
QFTEKSKHFSE

SEQ ID NO: 1975578 - protein, 12 aa, Staphylococcus
QFTEKSKNFSDD

SEQ ID NO: 1975579 - protein, 12 aa, Staphylococcus
QFTEKSKNFSED

SEQ ID NO: 1975580 - protein, 11 aa, Staphylococcus
QFTGNKEQDKM

SEQ ID NO: 1975581 - protein, 18 aa, Staphylococcus
QFTNEEDGAALFLESKFL

SEQ ID NO: 1975582 - protein, 6 aa, Staphylococcus
QFTNSI

SEQ ID NO: 1975583 - protein, 8 aa, Staphylococcus
QFTRGSRK

SEQ ID NO: 1975584 - protein, 4 aa, Staphylococcus
QFYQ

SEQ ID NO: 1975585 - protein, 6 aa, Staphylococcus
QGAAGA

SEQ ID NO: 1975586 - protein, 10 aa, Staphylococcus
QGADDDSAPI

SEQ ID NO: 1975587 - protein, 8 aa, Staphylococcus
QGAKGASI

SEQ ID NO: 1975588 - protein, 6 aa, Staphylococcus
QGAKTK

SEQ ID NO: 1975589 - protein, 8 aa, Staphylococcus
QGASAKSM

SEQ ID NO: 1975590 - protein, 5 aa, Staphylococcus
QGASS

SEQ ID NO: 1975591 - protein, 10 aa, Staphylococcus
QGASTNSSYV

SEQ ID NO: 1975592 - protein, 9 aa, Staphylococcus
QGATTEVYE

SEQ ID NO: 1975593 - protein, 13 aa, Staphylococcus
QGDAQSLRITEGS

SEQ ID NO: 1975594 - protein, 8 aa, Staphylococcus
QGDATISD

SEQ ID NO: 1975595 - protein, 9 aa, Staphylococcus
QGDDDDETF

SEQ ID NO: 1975596 - protein, 19 aa, Staphylococcus
QGDDDEDTKNETDEVGKTE

SEQ ID NO: 1975597 - protein, 9 aa, Staphylococcus
QGDDDKQTF

SEQ ID NO: 1975598 - protein, 7 aa, Staphylococcus
QGDEEQI

SEQ ID NO: 1975599 - protein, 6 aa, Staphylococcus
QGDEIA

SEQ ID NO: 1975600 - protein, 10 aa, Staphylococcus
QGDEKEKSPF

SEQ ID NO: 1975601 - protein, 5 aa, Staphylococcus
QGDEP

SEQ ID NO: 1975602 - protein, 8 aa, Staphylococcus
QGDEPSLT

SEQ ID NO: 1975603 - protein, 6 aa, Staphylococcus
QGDEQF

SEQ ID NO: 1975604 - protein, 7 aa, Staphylococcus
QGDGGLL

SEQ ID NO: 1975605 - protein, 13 aa, Staphylococcus
QGDGYKTLEEGQS

SEQ ID NO: 1975606 - protein, 8 aa, Staphylococcus
QGDISSPY

SEQ ID NO: 1975607 - protein, 10 aa, Staphylococcus
QGDKGATAYL

SEQ ID NO: 1975608 - protein, 8 aa, Staphylococcus
QGDKGEII

SEQ ID NO: 1975609 - protein, 12 aa, Staphylococcus
QGDLSSDKLGDA

SEQ ID NO: 1975610 - protein, 4 aa, Staphylococcus
QGDN

SEQ ID NO: 1975611 - protein, 10 aa, Staphylococcus
QGDNQDLDEE

SEQ ID NO: 1975612 - protein, 9 aa, Staphylococcus
QGDQDKQSF

SEQ ID NO: 1975613 - protein, 11 aa, Staphylococcus
QGDRFSKATPL

SEQ ID NO: 1975614 - protein, 5 aa, Staphylococcus
QGDSF

SEQ ID NO: 1975615 - protein, 5 aa, Staphylococcus
QGDSI

SEQ ID NO: 1975616 - protein, 14 aa, Staphylococcus
QGDTEVDDHHTTED

SEQ ID NO: 1975617 - protein, 5 aa, Staphylococcus
QGDTP

SEQ ID NO: 1975618 - protein, 7 aa, Staphylococcus
QGDTSDY

SEQ ID NO: 1975619 - protein, 8 aa, Staphylococcus
QGDVSKEE

SEQ ID NO: 1975620 - protein, 5 aa, Staphylococcus
QGDYK

SEQ ID NO: 1975621 - protein, 13 aa, Staphylococcus
QGDYTDEMKEVYY

SEQ ID NO: 1975622 - protein, 6 aa, Staphylococcus
QGEAAR

SEQ ID NO: 1975623 - protein, 5 aa, Staphylococcus
QGEAG

SEQ ID NO: 1975624 - protein, 8 aa, Staphylococcus
QGEAHSHK

SEQ ID NO: 1975625 - protein, 7 aa, Staphylococcus
QGEDDKN

SEQ ID NO: 1975626 - protein, 7 aa, Staphylococcus
QGEDKEL

SEQ ID NO: 1975627 - protein, 8 aa, Staphylococcus
QGEDKREK

SEQ ID NO: 1975628 - protein, 9 aa, Staphylococcus
QGEDNDLEQ

SEQ ID NO: 1975629 - protein, 5 aa, Staphylococcus
QGEEP

SEQ ID NO: 1975630 - protein, 6 aa, Staphylococcus
QGEEPV

SEQ ID NO: 1975631 - protein, 6 aa, Staphylococcus
QGEETK

SEQ ID NO: 1975632 - protein, 5 aa, Staphylococcus
QGEGG

SEQ ID NO: 1975633 - protein, 15 aa, Staphylococcus
QGEGGHGSSPHTAND

SEQ ID NO: 1975634 - protein, 6 aa, Staphylococcus
QGEGTD

SEQ ID NO: 1975635 - protein, 5 aa, Staphylococcus
QGEHV

SEQ ID NO: 1975636 - protein, 8 aa, Staphylococcus
QGEKDNLE

SEQ ID NO: 1975637 - protein, 16 aa, Staphylococcus
QGEKVTQQAPSTTEKL

SEQ ID NO: 1975638 - protein, 5 aa, Staphylococcus
QGELN

SEQ ID NO: 1975639 - protein, 9 aa, Staphylococcus
QGELSGDVA

SEQ ID NO: 1975640 - protein, 4 aa, Staphylococcus
QGEM

SEQ ID NO: 1975641 - protein, 10 aa, Staphylococcus
QGENPWNQNY

SEQ ID NO: 1975642 - protein, 6 aa, Staphylococcus
QGEPQG

SEQ ID NO: 1975643 - protein, 9 aa, Staphylococcus
QGEQAKSDI

SEQ ID NO: 1975644 - protein, 12 aa, Staphylococcus
QGESLTASTLNE

SEQ ID NO: 1975645 - protein, 8 aa, Staphylococcus
QGESTVDS

SEQ ID NO: 1975646 - protein, 19 aa, Staphylococcus
QGETAKGVGIKNNQLTATP

SEQ ID NO: 1975647 - protein, 5 aa, Staphylococcus
QGETE

SEQ ID NO: 1975648 - protein, 5 aa, Staphylococcus
QGETQ

SEQ ID NO: 1975649 - protein, 6 aa, Staphylococcus
QGETTG

SEQ ID NO: 1975650 - protein, 6 aa, Staphylococcus
QGETWT

SEQ ID NO: 1975651 - protein, 11 aa, Staphylococcus
QGFDPSQFGYN

SEQ ID NO: 1975652 - protein, 8 aa, Staphylococcus
QGFDPTEF

SEQ ID NO: 1975653 - protein, 13 aa, Staphylococcus
QGFEDKKEALEKR

SEQ ID NO: 1975654 - protein, 6 aa, Staphylococcus
QGFEPS

SEQ ID NO: 1975655 - protein, 19 aa, Staphylococcus
QGFEPSEHDYHRKQTLSNA

SEQ ID NO: 1975656 - protein, 10 aa, Staphylococcus
QGFESSQSMQ

SEQ ID NO: 1975657 - protein, 4 aa, Staphylococcus
QGFN

SEQ ID NO: 1975658 - protein, 10 aa, Staphylococcus
QGFNPTDYGY

SEQ ID NO: 1975659 - protein, 5 aa, Staphylococcus
QGFNR

SEQ ID NO: 1975660 - protein, 15 aa, Staphylococcus
QGFSKKTTSAIKQNG

SEQ ID NO: 1975661 - protein, 14 aa, Staphylococcus
QGGGQEYGVRSGTV

SEQ ID NO: 1975662 - protein, 17 aa, Staphylococcus
QGGINGAVNTKGEGDSP

SEQ ID NO: 1975663 - protein, 13 aa, Staphylococcus
QGGKKSDSERPLT

SEQ ID NO: 1975664 - protein, 13 aa, Staphylococcus
QGGKTSDSERPLT

SEQ ID NO: 1975665 - protein, 9 aa, Staphylococcus
QGGMDEKQN

SEQ ID NO: 1975666 - protein, 10 aa, Staphylococcus
QGGMDENQNN

SEQ ID NO: 1975667 - protein, 8 aa, Staphylococcus
QGGMTNAS

SEQ ID NO: 1975668 - protein, 9 aa, Staphylococcus
QGGNPGMQG

SEQ ID NO: 1975669 - protein, 12 aa, Staphylococcus
QGGNSDSERKRA

SEQ ID NO: 1975670 - protein, 7 aa, Staphylococcus
QGGNTRA

SEQ ID NO: 1975671 - protein, 21 aa, Staphylococcus
QGGNYDDYETHQWGEASEREK

SEQ ID NO: 1975672 - protein, 6 aa, Staphylococcus
QGGPVG

SEQ ID NO: 1975673 - protein, 8 aa, Staphylococcus
QGGQHERF

SEQ ID NO: 1975674 - protein, 5 aa, Staphylococcus
QGGQI

SEQ ID NO: 1975675 - protein, 6 aa, Staphylococcus
QGGQYE

SEQ ID NO: 1975676 - protein, 7 aa, Staphylococcus
QGGQYEH

SEQ ID NO: 1975677 - protein, 4 aa, Staphylococcus
QGGR

SEQ ID NO: 1975678 - protein, 11 aa, Staphylococcus
QGGTKDAAEQL

SEQ ID NO: 1975679 - protein, 7 aa, Staphylococcus
QGGTKEA

SEQ ID NO: 1975680 - protein, 9 aa, Staphylococcus
QGGTPANTV

SEQ ID NO: 1975681 - protein, 6 aa, Staphylococcus
QGGTSF

SEQ ID NO: 1975682 - protein, 14 aa, Staphylococcus
QGGTVEGIHPTTIS

SEQ ID NO: 1975683 - protein, 12 aa, Staphylococcus
QGGVGDDIGTSY

SEQ ID NO: 1975684 - protein, 4 aa, Staphylococcus
QGHD

SEQ ID NO: 1975685 - protein, 5 aa, Staphylococcus
QGHDI

SEQ ID NO: 1975686 - protein, 4 aa, Staphylococcus
QGHG

SEQ ID NO: 1975687 - protein, 7 aa, Staphylococcus
QGHPGNL

SEQ ID NO: 1975688 - protein, 6 aa, Staphylococcus
QGHYAP

SEQ ID NO: 1975689 - protein, 7 aa, Staphylococcus
QGHYTPD

SEQ ID NO: 1975690 - protein, 6 aa, Staphylococcus
QGIAES

SEQ ID NO: 1975691 - protein, 6 aa, Staphylococcus
QGIDKH

SEQ ID NO: 1975692 - protein, 13 aa, Staphylococcus
QGIENYSAEEAEQ

SEQ ID NO: 1975693 - protein, 26 aa, Staphylococcus
QGIENYTDDEAAEIVGQDRESSQRDL

SEQ ID NO: 1975694 - protein, 26 aa, Staphylococcus
QGIENYTDEEAAEIVGGDRDSSQRDL

SEQ ID NO: 1975695 - protein, 6 aa, Staphylococcus
QGIEPI

SEQ ID NO: 1975696 - protein, 9 aa, Staphylococcus
QGIEPQGDQ

SEQ ID NO: 1975697 - protein, 6 aa, Staphylococcus
QGIEYE

SEQ ID NO: 1975698 - protein, 4 aa, Staphylococcus
QGIG

SEQ ID NO: 1975699 - protein, 10 aa, Staphylococcus
QGIGAGGEVQ

SEQ ID NO: 1975700 - protein, 12 aa, Staphylococcus
QGIGNNAGSLNP

SEQ ID NO: 1975701 - protein, 6 aa, Staphylococcus
QGIGST

SEQ ID NO: 1975702 - protein, 6 aa, Staphylococcus
QGIIEQ

SEQ ID NO: 1975703 - protein, 6 aa, Staphylococcus
QGIPNQ

SEQ ID NO: 1975704 - protein, 5 aa, Staphylococcus
QGIQM

SEQ ID NO: 1975705 - protein, 8 aa, Staphylococcus
QGIQPYSE

SEQ ID NO: 1975706 - protein, 4 aa, Staphylococcus
QGIS

SEQ ID NO: 1975707 - protein, 5 aa, Staphylococcus
QGISN

SEQ ID NO: 1975708 - protein, 6 aa, Staphylococcus
QGKEAK

SEQ ID NO: 1975709 - protein, 6 aa, Staphylococcus
QGKEVN

SEQ ID NO: 1975710 - protein, 5 aa, Staphylococcus
QGKGF

SEQ ID NO: 1975711 - protein, 14 aa, Staphylococcus
QGKGGHGAKPHETI

SEQ ID NO: 1975712 - protein, 14 aa, Staphylococcus
QGKGGHGAKPQETI

SEQ ID NO: 1975713 - protein, 22 aa, Staphylococcus
QGKIDAESFRKQTQSSRQHSKP

SEQ ID NO: 1975714 - protein, 26 aa, Staphylococcus
QGKIDAETFREQTQSLHQQSKPISSI

SEQ ID NO: 1975715 - protein, 6 aa, Staphylococcus
QGKKEA

SEQ ID NO: 1975716 - protein, 5 aa, Staphylococcus
QGKLD

SEQ ID NO: 1975717 - protein, 9 aa, Staphylococcus
QGKLKTKNI

SEQ ID NO: 1975718 - protein, 9 aa, Staphylococcus
QGKNPSINF

SEQ ID NO: 1975719 - protein, 8 aa, Staphylococcus
QGKNSFAT

SEQ ID NO: 1975720 - protein, 8 aa, Staphylococcus
QGKPITTE

SEQ ID NO: 1975721 - protein, 7 aa, Staphylococcus
QGKPKLN

SEQ ID NO: 1975722 - protein, 9 aa, Staphylococcus
QGKQAKDDI

SEQ ID NO: 1975723 - protein, 5 aa, Staphylococcus
QGKSF

SEQ ID NO: 1975724 - protein, 10 aa, Staphylococcus
QGKSIQADAR

SEQ ID NO: 1975725 - protein, 8 aa, Staphylococcus
QGKSLGAK

SEQ ID NO: 1975726 - protein, 5 aa, Staphylococcus
QGKST

SEQ ID NO: 1975727 - protein, 6 aa, Staphylococcus
QGKTIV

SEQ ID NO: 1975728 - protein, 9 aa, Staphylococcus
QGKTKEQID

SEQ ID NO: 1975729 - protein, 13 aa, Staphylococcus
QGKTNKSEIGAYK

SEQ ID NO: 1975730 - protein, 9 aa, Staphylococcus
QGKTPQTVR

SEQ ID NO: 1975731 - protein, 5 aa, Staphylococcus
QGKTT

SEQ ID NO: 1975732 - protein, 7 aa, Staphylococcus
QGKVDEA

SEQ ID NO: 1975733 - protein, 18 aa, Staphylococcus
QGKVSELSGFAKKTEQNI

SEQ ID NO: 1975734 - protein, 6 aa, Staphylococcus
QGKYRD

SEQ ID NO: 1975735 - protein, 7 aa, Staphylococcus
QGKYVSR

SEQ ID NO: 1975736 - protein, 17 aa, Staphylococcus
QGLADPLTGAISDDDTK

SEQ ID NO: 1975737 - protein, 4 aa, Staphylococcus
QGLD

SEQ ID NO: 1975738 - protein, 8 aa, Staphylococcus
QGLDDAGY

SEQ ID NO: 1975739 - protein, 7 aa, Staphylococcus
QGLDEAG

SEQ ID NO: 1975740 - protein, 13 aa, Staphylococcus
QGLEKELAKTGVR

SEQ ID NO: 1975741 - protein, 8 aa, Staphylococcus
QGLKEVSE

SEQ ID NO: 1975742 - protein, 4 aa, Staphylococcus
QGLN

SEQ ID NO: 1975743 - protein, 14 aa, Staphylococcus
QGLNTTYDTAEKIK

SEQ ID NO: 1975744 - protein, 17 aa, Staphylococcus
QGLQDGQLDTLDIDGQG

SEQ ID NO: 1975745 - protein, 5 aa, Staphylococcus
QGLRA

SEQ ID NO: 1975746 - protein, 6 aa, Staphylococcus
QGLRQR

SEQ ID NO: 1975747 - protein, 7 aa, Staphylococcus
QGLRRGE

SEQ ID NO: 1975748 - protein, 7 aa, Staphylococcus
QGLSPEE

SEQ ID NO: 1975749 - protein, 6 aa, Staphylococcus
QGLTEE

SEQ ID NO: 1975750 - protein, 6 aa, Staphylococcus
QGLTPE

SEQ ID NO: 1975751 - protein, 7 aa, Staphylococcus
QGLTPES

SEQ ID NO: 1975752 - protein, 9 aa, Staphylococcus
QGLTPSGDD

SEQ ID NO: 1975753 - protein, 7 aa, Staphylococcus
QGLTSQP

SEQ ID NO: 1975754 - protein, 9 aa, Staphylococcus
QGMDAEEEQ

SEQ ID NO: 1975755 - protein, 15 aa, Staphylococcus
QGMDSTLDQLDKLLK

SEQ ID NO: 1975756 - protein, 5 aa, Staphylococcus
QGMSR

SEQ ID NO: 1975757 - protein, 6 aa, Staphylococcus
QGMTIE

SEQ ID NO: 1975758 - protein, 14 aa, Staphylococcus
QGMTPDKSYKKSAR

SEQ ID NO: 1975759 - protein, 6 aa, Staphylococcus
QGNASD

SEQ ID NO: 1975760 - protein, 7 aa, Staphylococcus
QGNEEQL

SEQ ID NO: 1975761 - protein, 7 aa, Staphylococcus
QGNEIEN

SEQ ID NO: 1975762 - protein, 6 aa, Staphylococcus
QGNEPL

SEQ ID NO: 1975763 - protein, 6 aa, Staphylococcus
QGNETD

SEQ ID NO: 1975764 - protein, 7 aa, Staphylococcus
QGNGGDF

SEQ ID NO: 1975765 - protein, 5 aa, Staphylococcus
QGNGH

SEQ ID NO: 1975766 - protein, 8 aa, Staphylococcus
QGNISTDE

SEQ ID NO: 1975767 - protein, 9 aa, Staphylococcus
QGNKSGTAW

SEQ ID NO: 1975768 - protein, 8 aa, Staphylococcus
QGNLPPRA

SEQ ID NO: 1975769 - protein, 8 aa, Staphylococcus
QGNLPPSC

SEQ ID NO: 1975770 - protein, 10 aa, Staphylococcus
QGNLPPTSLE

SEQ ID NO: 1975771 - protein, 8 aa, Staphylococcus
QGNPNQPV

SEQ ID NO: 1975772 - protein, 16 aa, Staphylococcus
QGNSNQDIAEKKAQKE

SEQ ID NO: 1975773 - protein, 8 aa, Staphylococcus
QGNSNYGK

SEQ ID NO: 1975774 - protein, 7 aa, Staphylococcus
QGNSQSL

SEQ ID NO: 1975775 - protein, 6 aa, Staphylococcus
QGNSSD

SEQ ID NO: 1975776 - protein, 6 aa, Staphylococcus
QGNSYA

SEQ ID NO: 1975777 - protein, 7 aa, Staphylococcus
QGNTAQL

SEQ ID NO: 1975778 - protein, 7 aa, Staphylococcus
QGNVSEA

SEQ ID NO: 1975779 - protein, 8 aa, Staphylococcus
QGPDFPTS

SEQ ID NO: 1975780 - protein, 8 aa, Staphylococcus
QGPGSYTG

SEQ ID NO: 1975781 - protein, 12 aa, Staphylococcus
QGPLTIPYVEDE

SEQ ID NO: 1975782 - protein, 12 aa, Staphylococcus
QGPLTIPYVENE

SEQ ID NO: 1975783 - protein, 13 aa, Staphylococcus
QGPPGVGKTYAAK

SEQ ID NO: 1975784 - protein, 7 aa, Staphylococcus
QGPQRGP

SEQ ID NO: 1975785 - protein, 7 aa, Staphylococcus
QGPSSVG

SEQ ID NO: 1975786 - protein, 4 aa, Staphylococcus
QGPT

SEQ ID NO: 1975787 - protein, 12 aa, Staphylococcus
QGPTITVDESTG

SEQ ID NO: 1975788 - protein, 8 aa, Staphylococcus
QGQAHSHK

SEQ ID NO: 1975789 - protein, 6 aa, Staphylococcus
QGQAIG

SEQ ID NO: 1975790 - protein, 6 aa, Staphylococcus
QGQDNK

SEQ ID NO: 1975791 - protein, 6 aa, Staphylococcus
QGQEKL

SEQ ID NO: 1975792 - protein, 6 aa, Staphylococcus
QGQELN

SEQ ID NO: 1975793 - protein, 12 aa, Staphylococcus
QGQEMTPNNKQQ

SEQ ID NO: 1975794 - protein, 6 aa, Staphylococcus
QGQEVN

SEQ ID NO: 1975795 - protein, 7 aa, Staphylococcus
QGQFRKN

SEQ ID NO: 1975796 - protein, 4 aa, Staphylococcus
QGQG

SEQ ID NO: 1975797 - protein, 6 aa, Staphylococcus
QGQGFG

SEQ ID NO: 1975798 - protein, 7 aa, Staphylococcus
QGQISTD

SEQ ID NO: 1975799 - protein, 7 aa, Staphylococcus
QGQKQAI

SEQ ID NO: 1975800 - protein, 5 aa, Staphylococcus
QGQPF

SEQ ID NO: 1975801 - protein, 10 aa, Staphylococcus
QGQPITTELT

SEQ ID NO: 1975802 - protein, 8 aa, Staphylococcus
QGQQAKAD

SEQ ID NO: 1975803 - protein, 8 aa, Staphylococcus
QGQSLSEI

SEQ ID NO: 1975804 - protein, 6 aa, Staphylococcus
QGQSQF

SEQ ID NO: 1975805 - protein, 8 aa, Staphylococcus
QGQSSKSI

SEQ ID NO: 1975806 - protein, 17 aa, Staphylococcus
QGQSYIGTSEADKAEAF

SEQ ID NO: 1975807 - protein, 5 aa, Staphylococcus
QGQTL

SEQ ID NO: 1975808 - protein, 9 aa, Staphylococcus
QGQVERTIS

SEQ ID NO: 1975809 - protein, 5 aa, Staphylococcus
QGRDI

SEQ ID NO: 1975810 - protein, 6 aa, Staphylococcus
QGREVD

SEQ ID NO: 1975811 - protein, 4 aa, Staphylococcus
QGRG

SEQ ID NO: 1975812 - protein, 7 aa, Staphylococcus
QGRGYGT

SEQ ID NO: 1975813 - protein, 8 aa, Staphylococcus
QGRIEEDS

SEQ ID NO: 1975814 - protein, 4 aa, Staphylococcus
QGRL

SEQ ID NO: 1975815 - protein, 9 aa, Staphylococcus
QGRMTTSGE

SEQ ID NO: 1975816 - protein, 17 aa, Staphylococcus
QGRPAYASGDLHTGTKD

SEQ ID NO: 1975817 - protein, 7 aa, Staphylococcus
QGRPITT

SEQ ID NO: 1975818 - protein, 10 aa, Staphylococcus
QGRPITTELT

SEQ ID NO: 1975819 - protein, 12 aa, Staphylococcus
QGRTIQEGDEIE

SEQ ID NO: 1975820 - protein, 5 aa, Staphylococcus
QGRTT

SEQ ID NO: 1975821 - protein, 6 aa, Staphylococcus
QGRTVD

SEQ ID NO: 1975822 - protein, 20 aa, Staphylococcus
QGSEAGGHRGAFSETASQLT

SEQ ID NO: 1975823 - protein, 11 aa, Staphylococcus
QGSEAGGHRGS

SEQ ID NO: 1975824 - protein, 10 aa, Staphylococcus
QGSEAGGHRS

SEQ ID NO: 1975825 - protein, 13 aa, Staphylococcus
QGSGGHGSSPHMA

SEQ ID NO: 1975826 - protein, 6 aa, Staphylococcus
QGSGKS

SEQ ID NO: 1975827 - protein, 7 aa, Staphylococcus
QGSGTRI

SEQ ID NO: 1975828 - protein, 8 aa, Staphylococcus
QGSHSEMQ

SEQ ID NO: 1975829 - protein, 6 aa, Staphylococcus
QGSITV

SEQ ID NO: 1975830 - protein, 4 aa, Staphylococcus
QGSK

SEQ ID NO: 1975831 - protein, 6 aa, Staphylococcus
QGSKAE

SEQ ID NO: 1975832 - protein, 9 aa, Staphylococcus
QGSKNEPLY

SEQ ID NO: 1975833 - protein, 6 aa, Staphylococcus
QGSNKD

SEQ ID NO: 1975834 - protein, 28 aa, Staphylococcus
QGSNSDVKEFKDKVGQFNENYEREKIQS

SEQ ID NO: 1975835 - protein, 4 aa, Staphylococcus
QGSQ

SEQ ID NO: 1975836 - protein, 7 aa, Staphylococcus
QGSQNED

SEQ ID NO: 1975837 - protein, 5 aa, Staphylococcus
QGSRL

SEQ ID NO: 1975838 - protein, 8 aa, Staphylococcus
QGSSAKSL

SEQ ID NO: 1975839 - protein, 11 aa, Staphylococcus
QGSTKDAAEQL

SEQ ID NO: 1975840 - protein, 7 aa, Staphylococcus
QGSTKEA

SEQ ID NO: 1975841 - protein, 11 aa, Staphylococcus
QGSTKEAAKQL

SEQ ID NO: 1975842 - protein, 6 aa, Staphylococcus
QGSTTQ

SEQ ID NO: 1975843 - protein, 5 aa, Staphylococcus
QGSVE

SEQ ID NO: 1975844 - protein, 6 aa, Staphylococcus
QGSVEL

SEQ ID NO: 1975845 - protein, 11 aa, Staphylococcus
QGSWQKKNADY

SEQ ID NO: 1975846 - protein, 11 aa, Staphylococcus
QGTATIKPSQL

SEQ ID NO: 1975847 - protein, 8 aa, Staphylococcus
QGTDKREK

SEQ ID NO: 1975848 - protein, 4 aa, Staphylococcus
QGTE

SEQ ID NO: 1975849 - protein, 5 aa, Staphylococcus
QGTFN

SEQ ID NO: 1975850 - protein, 5 aa, Staphylococcus
QGTGG

SEQ ID NO: 1975851 - protein, 9 aa, Staphylococcus
QGTGGNNRI

SEQ ID NO: 1975852 - protein, 10 aa, Staphylococcus
QGTKHNIEQA

SEQ ID NO: 1975853 - protein, 11 aa, Staphylococcus
QGTKKDVEEFK

SEQ ID NO: 1975854 - protein, 8 aa, Staphylococcus
QGTNEEQA

SEQ ID NO: 1975855 - protein, 6 aa, Staphylococcus
QGTNND

SEQ ID NO: 1975856 - protein, 7 aa, Staphylococcus
QGTNTYQ

SEQ ID NO: 1975857 - protein, 8 aa, Staphylococcus
QGTQAKED

SEQ ID NO: 1975858 - protein, 8 aa, Staphylococcus
QGTQAKQD

SEQ ID NO: 1975859 - protein, 9 aa, Staphylococcus
QGTQAKQDI

SEQ ID NO: 1975860 - protein, 10 aa, Staphylococcus
QGTQNDISEF

SEQ ID NO: 1975861 - protein, 8 aa, Staphylococcus
QGTRHRAN

SEQ ID NO: 1975862 - protein, 32 aa, Staphylococcus
QGTRTEVKQSLKKGNVTVNGKVEKSAKTQIDP

SEQ ID NO: 1975863 - protein, 6 aa, Staphylococcus
QGTSIL

SEQ ID NO: 1975864 - protein, 8 aa, Staphylococcus
QGTSTTDI

SEQ ID NO: 1975865 - protein, 8 aa, Staphylococcus
QGTSVLPE

SEQ ID NO: 1975866 - protein, 7 aa, Staphylococcus
QGTTSSR

SEQ ID NO: 1975867 - protein, 20 aa, Staphylococcus
QGTVEELPVKTKKVKKKTIQ

SEQ ID NO: 1975868 - protein, 9 aa, Staphylococcus
QGVAPYTTN

SEQ ID NO: 1975869 - protein, 9 aa, Staphylococcus
QGVGEPPIN

SEQ ID NO: 1975870 - protein, 12 aa, Staphylococcus
QGVGKSTAVSKL

SEQ ID NO: 1975871 - protein, 10 aa, Staphylococcus
QGVKPYSDNN

SEQ ID NO: 1975872 - protein, 8 aa, Staphylococcus
QGVNKARF

SEQ ID NO: 1975873 - protein, 6 aa, Staphylococcus
QGVNRE

SEQ ID NO: 1975874 - protein, 4 aa, Staphylococcus
QGVS

SEQ ID NO: 1975875 - protein, 5 aa, Staphylococcus
QGVSC

SEQ ID NO: 1975876 - protein, 9 aa, Staphylococcus
QGVSTDGAT

SEQ ID NO: 1975877 - protein, 9 aa, Staphylococcus
QGVSTEGAT

SEQ ID NO: 1975878 - protein, 17 aa, Staphylococcus
QGVTRNVEKRASQDTFS

SEQ ID NO: 1975879 - protein, 32 aa, Staphylococcus
QGYADDTKDMTATKGRAAYFKEDSKGYIDPGA

SEQ ID NO: 1975880 - protein, 6 aa, Staphylococcus
QGYEPK

SEQ ID NO: 1975881 - protein, 11 aa, Staphylococcus
QGYESSQSMQA

SEQ ID NO: 1975882 - protein, 5 aa, Staphylococcus
QGYFE

SEQ ID NO: 1975883 - protein, 7 aa, Staphylococcus
QGYKPDD

SEQ ID NO: 1975884 - protein, 8 aa, Staphylococcus
QGYNPGDF

SEQ ID NO: 1975885 - protein, 8 aa, Staphylococcus
QGYPGTYV

SEQ ID NO: 1975886 - protein, 12 aa, Staphylococcus
QGYPVGYSKTSQ

SEQ ID NO: 1975887 - protein, 14 aa, Staphylococcus
QGYQYGADSEQQHE

SEQ ID NO: 1975888 - protein, 19 aa, Staphylococcus
QGYSVEEAKKLRKEDPKKY

SEQ ID NO: 1975889 - protein, 19 aa, Staphylococcus
QGYSVEEAKKLRQEDPKKY

SEQ ID NO: 1975890 - protein, 4 aa, Staphylococcus
QGYT

SEQ ID NO: 1975891 - protein, 7 aa, Staphylococcus
QHAADYA

SEQ ID NO: 1975892 - protein, 6 aa, Staphylococcus
QHADDI

SEQ ID NO: 1975893 - protein, 6 aa, Staphylococcus
QHAEDI

SEQ ID NO: 1975894 - protein, 13 aa, Staphylococcus
QHAEDKSLEEIQN

SEQ ID NO: 1975895 - protein, 6 aa, Staphylococcus
QHAEDV

SEQ ID NO: 1975896 - protein, 11 aa, Staphylococcus
QHAEQSGNQMD

SEQ ID NO: 1975897 - protein, 5 aa, Staphylococcus
QHAES

SEQ ID NO: 1975898 - protein, 10 aa, Staphylococcus
QHAKEAAKKV

SEQ ID NO: 1975899 - protein, 6 aa, Staphylococcus
QHANSL

SEQ ID NO: 1975900 - protein, 4 aa, Staphylococcus
QHAQ

SEQ ID NO: 1975901 - protein, 6 aa, Staphylococcus
QHAQDI

SEQ ID NO: 1975902 - protein, 5 aa, Staphylococcus
QHAQI

SEQ ID NO: 1975903 - protein, 9 aa, Staphylococcus
QHDAPQSDF

SEQ ID NO: 1975904 - protein, 7 aa, Staphylococcus
QHDEEKQ

SEQ ID NO: 1975905 - protein, 8 aa, Staphylococcus
QHDKTPAQ

SEQ ID NO: 1975906 - protein, 5 aa, Staphylococcus
QHDQV

SEQ ID NO: 1975907 - protein, 4 aa, Staphylococcus
QHDT

SEQ ID NO: 1975908 - protein, 5 aa, Staphylococcus
QHDTN

SEQ ID NO: 1975909 - protein, 5 aa, Staphylococcus
QHEGP

SEQ ID NO: 1975910 - protein, 5 aa, Staphylococcus
QHEHE

SEQ ID NO: 1975911 - protein, 12 aa, Staphylococcus
QHEKSEKSVENA

SEQ ID NO: 1975912 - protein, 4 aa, Staphylococcus
QHEL

SEQ ID NO: 1975913 - protein, 6 aa, Staphylococcus
QHEPEF

SEQ ID NO: 1975914 - protein, 6 aa, Staphylococcus
QHEPKF

SEQ ID NO: 1975915 - protein, 5 aa, Staphylococcus
QHEQA

SEQ ID NO: 1975916 - protein, 9 aa, Staphylococcus
QHEQQNVEA

SEQ ID NO: 1975917 - protein, 5 aa, Staphylococcus
QHERL

SEQ ID NO: 1975918 - protein, 12 aa, Staphylococcus
QHERTKNFLSRV

SEQ ID NO: 1975919 - protein, 8 aa, Staphylococcus
QHESTEAQ

SEQ ID NO: 1975920 - protein, 12 aa, Staphylococcus
QHETKGSAYENL

SEQ ID NO: 1975921 - protein, 5 aa, Staphylococcus
QHETN

SEQ ID NO: 1975922 - protein, 6 aa, Staphylococcus
QHETND

SEQ ID NO: 1975923 - protein, 6 aa, Staphylococcus
QHETPV

SEQ ID NO: 1975924 - protein, 5 aa, Staphylococcus
QHGAI

SEQ ID NO: 1975925 - protein, 7 aa, Staphylococcus
QHGERTT

SEQ ID NO: 1975926 - protein, 6 aa, Staphylococcus
QHGGKT

SEQ ID NO: 1975927 - protein, 6 aa, Staphylococcus
QHGKGL

SEQ ID NO: 1975928 - protein, 8 aa, Staphylococcus
QHGMNDTK

SEQ ID NO: 1975929 - protein, 6 aa, Staphylococcus
QHGNIG

SEQ ID NO: 1975930 - protein, 9 aa, Staphylococcus
QHGQDAEYE

SEQ ID NO: 1975931 - protein, 8 aa, Staphylococcus
QHGSTDAL

SEQ ID NO: 1975932 - protein, 4 aa, Staphylococcus
QHGV

SEQ ID NO: 1975933 - protein, 7 aa, Staphylococcus
QHHAYNP

SEQ ID NO: 1975934 - protein, 22 aa, Staphylococcus
QHHKQTKNEIQEDIKQTQQAIE

SEQ ID NO: 1975935 - protein, 14 aa, Staphylococcus
QHHQQQQASNKQKT

SEQ ID NO: 1975936 - protein, 8 aa, Staphylococcus
QHHTEGSV

SEQ ID NO: 1975937 - protein, 5 aa, Staphylococcus
QHHTK

SEQ ID NO: 1975938 - protein, 5 aa, Staphylococcus
QHINP

SEQ ID NO: 1975939 - protein, 5 aa, Staphylococcus
QHITT

SEQ ID NO: 1975940 - protein, 8 aa, Staphylococcus
QHKDNKAQ

SEQ ID NO: 1975941 - protein, 11 aa, Staphylococcus
QHKVPGISGSV

SEQ ID NO: 1975942 - protein, 6 aa, Staphylococcus
QHNDET

SEQ ID NO: 1975943 - protein, 8 aa, Staphylococcus
QHNDNGAK

SEQ ID NO: 1975944 - protein, 5 aa, Staphylococcus
QHNEL

SEQ ID NO: 1975945 - protein, 7 aa, Staphylococcus
QHNERHH

SEQ ID NO: 1975946 - protein, 5 aa, Staphylococcus
QHNPI

SEQ ID NO: 1975947 - protein, 11 aa, Staphylococcus
QHNSKFNQDPV

SEQ ID NO: 1975948 - protein, 7 aa, Staphylococcus
QHPADYN

SEQ ID NO: 1975949 - protein, 5 aa, Staphylococcus
QHPFN

SEQ ID NO: 1975950 - protein, 18 aa, Staphylococcus
QHPFNQAYTEATDTNQKG

SEQ ID NO: 1975951 - protein, 9 aa, Staphylococcus
QHPKNKEVA

SEQ ID NO: 1975952 - protein, 7 aa, Staphylococcus
QHPPTEM

SEQ ID NO: 1975953 - protein, 24 aa, Staphylococcus
QHPQLGQSTGYDYTRTKNPTRTAF

SEQ ID NO: 1975954 - protein, 4 aa, Staphylococcus
QHQD

SEQ ID NO: 1975955 - protein, 5 aa, Staphylococcus
QHQDQ

SEQ ID NO: 1975956 - protein, 6 aa, Staphylococcus
QHQGEG

SEQ ID NO: 1975957 - protein, 8 aa, Staphylococcus
QHQKEAHK

SEQ ID NO: 1975958 - protein, 53 aa, Staphylococcus
QHQPSQSNSNQKNKKHNQKRKNQNQKNQNKNKTPKQQQRAEKANSKIEKRTFN

SEQ ID NO: 1975959 - protein, 7 aa, Staphylococcus
QHQPTDN

SEQ ID NO: 1975960 - protein, 6 aa, Staphylococcus
QHQRKA

SEQ ID NO: 1975961 - protein, 5 aa, Staphylococcus
QHQRL

SEQ ID NO: 1975962 - protein, 8 aa, Staphylococcus
QHQSKPSL

SEQ ID NO: 1975963 - protein, 11 aa, Staphylococcus
QHQVPGISGSV

SEQ ID NO: 1975964 - protein, 4 aa, Staphylococcus
QHRK

SEQ ID NO: 1975965 - protein, 11 aa, Staphylococcus
QHRNKNEDAGG

SEQ ID NO: 1975966 - protein, 5 aa, Staphylococcus
QHSED

SEQ ID NO: 1975967 - protein, 10 aa, Staphylococcus
QHSEHSGEDF

SEQ ID NO: 1975968 - protein, 8 aa, Staphylococcus
QHSENELP

SEQ ID NO: 1975969 - protein, 9 aa, Staphylococcus
QHSKAESYI

SEQ ID NO: 1975970 - protein, 10 aa, Staphylococcus
QHSKKEMEQH

SEQ ID NO: 1975971 - protein, 4 aa, Staphylococcus
QHSP

SEQ ID NO: 1975972 - protein, 6 aa, Staphylococcus
QHSPTA

SEQ ID NO: 1975973 - protein, 7 aa, Staphylococcus
QHSRKDD

SEQ ID NO: 1975974 - protein, 7 aa, Staphylococcus
QHSRQYA

SEQ ID NO: 1975975 - protein, 16 aa, Staphylococcus
QHSTDRYTYHEGSTAG

SEQ ID NO: 1975976 - protein, 4 aa, Staphylococcus
QHTK

SEQ ID NO: 1975977 - protein, 10 aa, Staphylococcus
QHTKRKTQRA

SEQ ID NO: 1975978 - protein, 7 aa, Staphylococcus
QHTPESE

SEQ ID NO: 1975979 - protein, 6 aa, Staphylococcus
QHTRSS

SEQ ID NO: 1975980 - protein, 8 aa, Staphylococcus
QHTRYSQQ

SEQ ID NO: 1975981 - protein, 5 aa, Staphylococcus
QHTSD

SEQ ID NO: 1975982 - protein, 18 aa, Staphylococcus
QHTVREDDQLELLEFVGG

SEQ ID NO: 1975983 - protein, 44 aa, Staphylococcus
QHVSAEDGKEKAKKQPIVKGDKVGRNDPCPCGSGKKYKNCHGKE

SEQ ID NO: 1975984 - protein, 17 aa, Staphylococcus
QHYTNNEGLDGKSHSKI

SEQ ID NO: 1975985 - protein, 15 aa, Staphylococcus
QIADKERTRTELNEQ

SEQ ID NO: 1975986 - protein, 5 aa, Staphylococcus
QIAGP

SEQ ID NO: 1975987 - protein, 7 aa, Staphylococcus
QIAGPSE

SEQ ID NO: 1975988 - protein, 11 aa, Staphylococcus
QIAKGAALQTG

SEQ ID NO: 1975989 - protein, 7 aa, Staphylococcus
QIANTKV

SEQ ID NO: 1975990 - protein, 12 aa, Staphylococcus
QIAQGAAVQTGC

SEQ ID NO: 1975991 - protein, 4 aa, Staphylococcus
QIAR

SEQ ID NO: 1975992 - protein, 5 aa, Staphylococcus
QIARG

SEQ ID NO: 1975993 - protein, 14 aa, Staphylococcus
QIDAKQSKPKNTTW

SEQ ID NO: 1975994 - protein, 7 aa, Staphylococcus
QIDEEPF

SEQ ID NO: 1975995 - protein, 7 aa, Staphylococcus
QIDENTT

SEQ ID NO: 1975996 - protein, 5 aa, Staphylococcus
QIDGK

SEQ ID NO: 1975997 - protein, 5 aa, Staphylococcus
QIDPE

SEQ ID NO: 1975998 - protein, 6 aa, Staphylococcus
QIDPET

SEQ ID NO: 1975999 - protein, 4 aa, Staphylococcus
QIDV

SEQ ID NO: 1976000 - protein, 4 aa, Staphylococcus
QIED

SEQ ID NO: 1976001 - protein, 6 aa, Staphylococcus
QIEDEE

SEQ ID NO: 1976002 - protein, 7 aa, Staphylococcus
QIEDNQI

SEQ ID NO: 1976003 - protein, 8 aa, Staphylococcus
QIEDTSVN

SEQ ID NO: 1976004 - protein, 6 aa, Staphylococcus
QIEEHK

SEQ ID NO: 1976005 - protein, 7 aa, Staphylococcus
QIEEKTN

SEQ ID NO: 1976006 - protein, 11 aa, Staphylococcus
QIEESSSASRL

SEQ ID NO: 1976007 - protein, 14 aa, Staphylococcus
QIEETDSDFDREKL

SEQ ID NO: 1976008 - protein, 16 aa, Staphylococcus
QIEGSQARIDAIEEMR

SEQ ID NO: 1976009 - protein, 5 aa, Staphylococcus
QIEGT

SEQ ID NO: 1976010 - protein, 7 aa, Staphylococcus
QIEGTDA

SEQ ID NO: 1976011 - protein, 6 aa, Staphylococcus
QIEGTE

SEQ ID NO: 1976012 - protein, 4 aa, Staphylococcus
QIEH

SEQ ID NO: 1976013 - protein, 8 aa, Staphylococcus
QIEKGKDL

SEQ ID NO: 1976014 - protein, 8 aa, Staphylococcus
QIEKGKYD

SEQ ID NO: 1976015 - protein, 5 aa, Staphylococcus
QIELE

SEQ ID NO: 1976016 - protein, 5 aa, Staphylococcus
QIENE

SEQ ID NO: 1976017 - protein, 5 aa, Staphylococcus
QIENS

SEQ ID NO: 1976018 - protein, 4 aa, Staphylococcus
QIEQ

SEQ ID NO: 1976019 - protein, 5 aa, Staphylococcus
QIESA

SEQ ID NO: 1976020 - protein, 4 aa, Staphylococcus
QIET

SEQ ID NO: 1976021 - protein, 7 aa, Staphylococcus
QIETTSV

SEQ ID NO: 1976022 - protein, 6 aa, Staphylococcus
QIGEED

SEQ ID NO: 1976023 - protein, 6 aa, Staphylococcus
QIGNDR

SEQ ID NO: 1976024 - protein, 7 aa, Staphylococcus
QIGNDRR

SEQ ID NO: 1976025 - protein, 5 aa, Staphylococcus
QIGPL

SEQ ID NO: 1976026 - protein, 6 aa, Staphylococcus
QIGPLT

SEQ ID NO: 1976027 - protein, 5 aa, Staphylococcus
QIGQE

SEQ ID NO: 1976028 - protein, 6 aa, Staphylococcus
QIGQPD

SEQ ID NO: 1976029 - protein, 5 aa, Staphylococcus
QIGSK

SEQ ID NO: 1976030 - protein, 5 aa, Staphylococcus
QIGSN

SEQ ID NO: 1976031 - protein, 6 aa, Staphylococcus
QIGSQK

SEQ ID NO: 1976032 - protein, 9 aa, Staphylococcus
QIGSRNGLD

SEQ ID NO: 1976033 - protein, 22 aa, Staphylococcus
QIGSYIGKERKSIEQIDQFLAS

SEQ ID NO: 1976034 - protein, 4 aa, Staphylococcus
QIGT

SEQ ID NO: 1976035 - protein, 11 aa, Staphylococcus
QIGYESEEAKD

SEQ ID NO: 1976036 - protein, 9 aa, Staphylococcus
QIHETPDKY

SEQ ID NO: 1976037 - protein, 5 aa, Staphylococcus
QIIDT

SEQ ID NO: 1976038 - protein, 9 aa, Staphylococcus
QIKDKENEV

SEQ ID NO: 1976039 - protein, 7 aa, Staphylococcus
QIKEGTN

SEQ ID NO: 1976040 - protein, 9 aa, Staphylococcus
QIKGKESQV

SEQ ID NO: 1976041 - protein, 12 aa, Staphylococcus
QIKGQGNTQTSI

SEQ ID NO: 1976042 - protein, 13 aa, Staphylococcus
QIKRAGGQPISEP

SEQ ID NO: 1976043 - protein, 6 aa, Staphylococcus
QIKSNL

SEQ ID NO: 1976044 - protein, 8 aa, Staphylococcus
QILEPSDM

SEQ ID NO: 1976045 - protein, 11 aa, Staphylococcus
QINDKQQERTI

SEQ ID NO: 1976046 - protein, 9 aa, Staphylococcus
QINDNTKAI

SEQ ID NO: 1976047 - protein, 23 aa, Staphylococcus
QINDVDSSQILNTDTQDHANAPI

SEQ ID NO: 1976048 - protein, 13 aa, Staphylococcus
QINEDDKATTISI

SEQ ID NO: 1976049 - protein, 18 aa, Staphylococcus
QINEDKSKGANTTPETVS

SEQ ID NO: 1976050 - protein, 4 aa, Staphylococcus
QINK

SEQ ID NO: 1976051 - protein, 22 aa, Staphylococcus
QINKRSSKHDCKPQHPRSSTRE

SEQ ID NO: 1976052 - protein, 22 aa, Staphylococcus
QINKRSSKHDCKRKHPRSSTRE

SEQ ID NO: 1976053 - protein, 10 aa, Staphylococcus
QINNEGGQLE

SEQ ID NO: 1976054 - protein, 16 aa, Staphylococcus
QINNIDDATKIIMRGD

SEQ ID NO: 1976055 - protein, 7 aa, Staphylococcus
QINPNIK

SEQ ID NO: 1976056 - protein, 6 aa, Staphylococcus
QINQTG

SEQ ID NO: 1976057 - protein, 7 aa, Staphylococcus
QINSDMG

SEQ ID NO: 1976058 - protein, 7 aa, Staphylococcus
QINSNGS

SEQ ID NO: 1976059 - protein, 6 aa, Staphylococcus
QINVPS

SEQ ID NO: 1976060 - protein, 6 aa, Staphylococcus
QIPEEQ

SEQ ID NO: 1976061 - protein, 8 aa, Staphylococcus
QIPGPNHV

SEQ ID NO: 1976062 - protein, 9 aa, Staphylococcus
QIPGPNKVK

SEQ ID NO: 1976063 - protein, 11 aa, Staphylococcus
QIPGPNSVENR

SEQ ID NO: 1976064 - protein, 11 aa, Staphylococcus
QIPGPNSVQNR

SEQ ID NO: 1976065 - protein, 4 aa, Staphylococcus
QIPP

SEQ ID NO: 1976066 - protein, 14 aa, Staphylococcus
QIPTNKPVQRDDKS

SEQ ID NO: 1976067 - protein, 11 aa, Staphylococcus
QIPTNKPVQRI

SEQ ID NO: 1976068 - protein, 14 aa, Staphylococcus
QIPTNKPVQRQDKS

SEQ ID NO: 1976069 - protein, 13 aa, Staphylococcus
QIPTNKPVQRTDK

SEQ ID NO: 1976070 - protein, 12 aa, Staphylococcus
QIPTNKPVQRVD

SEQ ID NO: 1976071 - protein, 13 aa, Staphylococcus
QIPTNKPVQRVDK

SEQ ID NO: 1976072 - protein, 6 aa, Staphylococcus
QIPTTY

SEQ ID NO: 1976073 - protein, 8 aa, Staphylococcus
QIQDEEKS

SEQ ID NO: 1976074 - protein, 4 aa, Staphylococcus
QIQE

SEQ ID NO: 1976075 - protein, 9 aa, Staphylococcus
QIQPFRPTT

SEQ ID NO: 1976076 - protein, 11 aa, Staphylococcus
QIQQDDLKSSI

SEQ ID NO: 1976077 - protein, 9 aa, Staphylococcus
QIQQQDDQT

SEQ ID NO: 1976078 - protein, 34 aa, Staphylococcus
QIQQQQKAQGGQPIQGAQPGQPGQTGGGQGGDDY

SEQ ID NO: 1976079 - protein, 8 aa, Staphylococcus
QIQTASVS

SEQ ID NO: 1976080 - protein, 6 aa, Staphylococcus
QIRHSG

SEQ ID NO: 1976081 - protein, 10 aa, Staphylococcus
QIRKQPVSQM

SEQ ID NO: 1976082 - protein, 4 aa, Staphylococcus
QIRN

SEQ ID NO: 1976083 - protein, 5 aa, Staphylococcus
QIRNQ

SEQ ID NO: 1976084 - protein, 4 aa, Staphylococcus
QIRT

SEQ ID NO: 1976085 - protein, 9 aa, Staphylococcus
QIRTKNGQN

SEQ ID NO: 1976086 - protein, 13 aa, Staphylococcus
QISDTKLNNQNQR

SEQ ID NO: 1976087 - protein, 22 aa, Staphylococcus
QISEDTTNQSLAHSQIVAEFDT

SEQ ID NO: 1976088 - protein, 9 aa, Staphylococcus
QISELSGGQ

SEQ ID NO: 1976089 - protein, 10 aa, Staphylococcus
QISEQLKNTN

SEQ ID NO: 1976090 - protein, 11 aa, Staphylococcus
QISKEEAFNHP

SEQ ID NO: 1976091 - protein, 11 aa, Staphylococcus
QISKQAKDGDE

SEQ ID NO: 1976092 - protein, 5 aa, Staphylococcus
QISQE

SEQ ID NO: 1976093 - protein, 26 aa, Staphylococcus
QISQEEYEKEKAKDEHFGLEHAENYL

SEQ ID NO: 1976094 - protein, 8 aa, Staphylococcus
QISQGYSG

SEQ ID NO: 1976095 - protein, 9 aa, Staphylococcus
QITEENPET

SEQ ID NO: 1976096 - protein, 7 aa, Staphylococcus
QITNGTK

SEQ ID NO: 1976097 - protein, 5 aa, Staphylococcus
QITQR

SEQ ID NO: 1976098 - protein, 9 aa, Staphylococcus
QITRETTET

SEQ ID NO: 1976099 - protein, 22 aa, Staphylococcus
QITSSKEHISTVNGPPGTGKTT

SEQ ID NO: 1976100 - protein, 5 aa, Staphylococcus
QITTK

SEQ ID NO: 1976101 - protein, 12 aa, Staphylococcus
QKAAANLGLEPE

SEQ ID NO: 1976102 - protein, 19 aa, Staphylococcus
QKAASPKHGVRSRDNVSKV

SEQ ID NO: 1976103 - protein, 6 aa, Staphylococcus
QKADHE

SEQ ID NO: 1976104 - protein, 8 aa, Staphylococcus
QKADPSLS

SEQ ID NO: 1976105 - protein, 8 aa, Staphylococcus
QKAEENNL

SEQ ID NO: 1976106 - protein, 8 aa, Staphylococcus
QKAFDETG

SEQ ID NO: 1976107 - protein, 5 aa, Staphylococcus
QKAGA

SEQ ID NO: 1976108 - protein, 8 aa, Staphylococcus
QKAIRTND

SEQ ID NO: 1976109 - protein, 9 aa, Staphylococcus
QKAIRTNDI

SEQ ID NO: 1976110 - protein, 71 aa, Staphylococcus
QKAKQHKQGVTKTQAQHKPKDHKAKTHKHKPSHKQEKHINQAKNERSETKSQHKKGTFEQWSQKSSSRPKE

SEQ ID NO: 1976111 - protein, 5 aa, Staphylococcus
QKALA

SEQ ID NO: 1976112 - protein, 7 aa, Staphylococcus
QKALAEN

SEQ ID NO: 1976113 - protein, 15 aa, Staphylococcus
QKALNEAQEVTKSVP

SEQ ID NO: 1976114 - protein, 13 aa, Staphylococcus
QKALNEIKPGMTV

SEQ ID NO: 1976115 - protein, 15 aa, Staphylococcus
QKALNQAQEVTKTLP

SEQ ID NO: 1976116 - protein, 13 aa, Staphylococcus
QKANAFTAGFPAS

SEQ ID NO: 1976117 - protein, 15 aa, Staphylococcus
QKANDDGEPSGTAGV

SEQ ID NO: 1976118 - protein, 14 aa, Staphylococcus
QKANDDGEPTGTAG

SEQ ID NO: 1976119 - protein, 15 aa, Staphylococcus
QKANDNGEPSGTAGV

SEQ ID NO: 1976120 - protein, 7 aa, Staphylococcus
QKANELI

SEQ ID NO: 1976121 - protein, 7 aa, Staphylococcus
QKAPISN

SEQ ID NO: 1976122 - protein, 7 aa, Staphylococcus
QKAQAFK

SEQ ID NO: 1976123 - protein, 12 aa, Staphylococcus
QKAQSNAYTPYS

SEQ ID NO: 1976124 - protein, 7 aa, Staphylococcus
QKASAAE

SEQ ID NO: 1976125 - protein, 7 aa, Staphylococcus
QKASAEA

SEQ ID NO: 1976126 - protein, 13 aa, Staphylococcus
QKASAFNAGFPAS

SEQ ID NO: 1976127 - protein, 5 aa, Staphylococcus
QKASL

SEQ ID NO: 1976128 - protein, 14 aa, Staphylococcus
QKASLEDPSNTHLK

SEQ ID NO: 1976129 - protein, 12 aa, Staphylococcus
QKASSFTAGFPA

SEQ ID NO: 1976130 - protein, 6 aa, Staphylococcus
QKATLT

SEQ ID NO: 1976131 - protein, 9 aa, Staphylococcus
QKAYDTTGE

SEQ ID NO: 1976132 - protein, 5 aa, Staphylococcus
QKDAF

SEQ ID NO: 1976133 - protein, 14 aa, Staphylococcus
QKDATDAEQQINEI

SEQ ID NO: 1976134 - protein, 9 aa, Staphylococcus
QKDDNYDLT

SEQ ID NO: 1976135 - protein, 7 aa, Staphylococcus
QKDDSLA

SEQ ID NO: 1976136 - protein, 7 aa, Staphylococcus
QKDEDVV

SEQ ID NO: 1976137 - protein, 7 aa, Staphylococcus
QKDEEGR

SEQ ID NO: 1976138 - protein, 8 aa, Staphylococcus
QKDFNEGN

SEQ ID NO: 1976139 - protein, 5 aa, Staphylococcus
QKDGN

SEQ ID NO: 1976140 - protein, 5 aa, Staphylococcus
QKDGW

SEQ ID NO: 1976141 - protein, 5 aa, Staphylococcus
QKDHP

SEQ ID NO: 1976142 - protein, 22 aa, Staphylococcus
QKDIERISTGQRYYDKDNDIYR

SEQ ID NO: 1976143 - protein, 6 aa, Staphylococcus
QKDIQS

SEQ ID NO: 1976144 - protein, 10 aa, Staphylococcus
QKDITSTEKA

SEQ ID NO: 1976145 - protein, 6 aa, Staphylococcus
QKDKAK

SEQ ID NO: 1976146 - protein, 10 aa, Staphylococcus
QKDKNTEEYL

SEQ ID NO: 1976147 - protein, 16 aa, Staphylococcus
QKDKYPSQLSGGQSQR

SEQ ID NO: 1976148 - protein, 11 aa, Staphylococcus
QKDLENKFSRQ

SEQ ID NO: 1976149 - protein, 11 aa, Staphylococcus
QKDPDTGELNG

SEQ ID NO: 1976150 - protein, 11 aa, Staphylococcus
QKDPDTGQLNG

SEQ ID NO: 1976151 - protein, 4 aa, Staphylococcus
QKDQ

SEQ ID NO: 1976152 - protein, 6 aa, Staphylococcus
QKDQVV

SEQ ID NO: 1976153 - protein, 8 aa, Staphylococcus
QKDTAKSI

SEQ ID NO: 1976154 - protein, 6 aa, Staphylococcus
QKDTLN

SEQ ID NO: 1976155 - protein, 9 aa, Staphylococcus
QKEAAKLAQ

SEQ ID NO: 1976156 - protein, 10 aa, Staphylococcus
QKEAEKQKLD

SEQ ID NO: 1976157 - protein, 9 aa, Staphylococcus
QKEAQGDDI

SEQ ID NO: 1976158 - protein, 14 aa, Staphylococcus
QKEDIQSKVDIPDD

SEQ ID NO: 1976159 - protein, 5 aa, Staphylococcus
QKEDY

SEQ ID NO: 1976160 - protein, 5 aa, Staphylococcus
QKEGK

SEQ ID NO: 1976161 - protein, 14 aa, Staphylococcus
QKEHKRQQRKIERQ

SEQ ID NO: 1976162 - protein, 5 aa, Staphylococcus
QKEIA

SEQ ID NO: 1976163 - protein, 12 aa, Staphylococcus
QKEKEVYKKGKL

SEQ ID NO: 1976164 - protein, 5 aa, Staphylococcus
QKEKL

SEQ ID NO: 1976165 - protein, 10 aa, Staphylococcus
QKELDEKQEL

SEQ ID NO: 1976166 - protein, 42 aa, Staphylococcus
QKELRNSHDKIDKNDKTTTKDMSKPESVEEPLQPDKNNVSYD

SEQ ID NO: 1976167 - protein, 6 aa, Staphylococcus
QKEPAV

SEQ ID NO: 1976168 - protein, 4 aa, Staphylococcus
QKEQ

SEQ ID NO: 1976169 - protein, 16 aa, Staphylococcus
QKEQEDDSETKQVDPR

SEQ ID NO: 1976170 - protein, 5 aa, Staphylococcus
QKEQQ

SEQ ID NO: 1976171 - protein, 7 aa, Staphylococcus
QKEQQSV

SEQ ID NO: 1976172 - protein, 5 aa, Staphylococcus
QKEQS

SEQ ID NO: 1976173 - protein, 7 aa, Staphylococcus
QKERDCD

SEQ ID NO: 1976174 - protein, 9 aa, Staphylococcus
QKERQAKNI

SEQ ID NO: 1976175 - protein, 9 aa, Staphylococcus
QKERQPING

SEQ ID NO: 1976176 - protein, 9 aa, Staphylococcus
QKESNTTPL

SEQ ID NO: 1976177 - protein, 10 aa, Staphylococcus
QKESQAKKVY

SEQ ID NO: 1976178 - protein, 9 aa, Staphylococcus
QKESQAKNI

SEQ ID NO: 1976179 - protein, 14 aa, Staphylococcus
QKESSELVQQSQRI

SEQ ID NO: 1976180 - protein, 8 aa, Staphylococcus
QKESTVRA

SEQ ID NO: 1976181 - protein, 7 aa, Staphylococcus
QKETYTQ

SEQ ID NO: 1976182 - protein, 21 aa, Staphylococcus
QKEVENKIGRPKRVTSNEYGT

SEQ ID NO: 1976183 - protein, 6 aa, Staphylococcus
QKEVPE

SEQ ID NO: 1976184 - protein, 10 aa, Staphylococcus
QKEYDDMTQE

SEQ ID NO: 1976185 - protein, 6 aa, Staphylococcus
QKFKGA

SEQ ID NO: 1976186 - protein, 12 aa, Staphylococcus
QKFNKKQFNQTI

SEQ ID NO: 1976187 - protein, 9 aa, Staphylococcus
QKFSEKGSR

SEQ ID NO: 1976188 - protein, 10 aa, Staphylococcus
QKFSSTVPKN

SEQ ID NO: 1976189 - protein, 14 aa, Staphylococcus
QKGAQVTLDRTGDS

SEQ ID NO: 1976190 - protein, 4 aa, Staphylococcus
QKGD

SEQ ID NO: 1976191 - protein, 15 aa, Staphylococcus
QKGDQFGKAEASKNK

SEQ ID NO: 1976192 - protein, 7 aa, Staphylococcus
QKGEFQS

SEQ ID NO: 1976193 - protein, 5 aa, Staphylococcus
QKGEK

SEQ ID NO: 1976194 - protein, 7 aa, Staphylococcus
QKGEKYK

SEQ ID NO: 1976195 - protein, 10 aa, Staphylococcus
QKGEPLDENI

SEQ ID NO: 1976196 - protein, 5 aa, Staphylococcus
QKGEY

SEQ ID NO: 1976197 - protein, 8 aa, Staphylococcus
QKGHEQQE

SEQ ID NO: 1976198 - protein, 9 aa, Staphylococcus
QKGKKDKAI

SEQ ID NO: 1976199 - protein, 10 aa, Staphylococcus
QKGNEKARER

SEQ ID NO: 1976200 - protein, 8 aa, Staphylococcus
QKGNEVDY

SEQ ID NO: 1976201 - protein, 6 aa, Staphylococcus
QKGNFS

SEQ ID NO: 1976202 - protein, 5 aa, Staphylococcus
QKGPV

SEQ ID NO: 1976203 - protein, 9 aa, Staphylococcus
QKGQKSEAI

SEQ ID NO: 1976204 - protein, 4 aa, Staphylococcus
QKGR

SEQ ID NO: 1976205 - protein, 10 aa, Staphylococcus
QKGRVKRSAL

SEQ ID NO: 1976206 - protein, 11 aa, Staphylococcus
QKGSAGGHNGM

SEQ ID NO: 1976207 - protein, 10 aa, Staphylococcus
QKGSDTSNLG

SEQ ID NO: 1976208 - protein, 5 aa, Staphylococcus
QKGSI

SEQ ID NO: 1976209 - protein, 11 aa, Staphylococcus
QKGTAKGEGNS

SEQ ID NO: 1976210 - protein, 12 aa, Staphylococcus
QKGTATLRNPQV

SEQ ID NO: 1976211 - protein, 8 aa, Staphylococcus
QKGTVRTN

SEQ ID NO: 1976212 - protein, 9 aa, Staphylococcus
QKGTVRTNE

SEQ ID NO: 1976213 - protein, 7 aa, Staphylococcus
QKGVKGK

SEQ ID NO: 1976214 - protein, 7 aa, Staphylococcus
QKGVKGR

SEQ ID NO: 1976215 - protein, 4 aa, Staphylococcus
QKGY

SEQ ID NO: 1976216 - protein, 6 aa, Staphylococcus
QKGYGI

SEQ ID NO: 1976217 - protein, 10 aa, Staphylococcus
QKGYSAQQIA

SEQ ID NO: 1976218 - protein, 6 aa, Staphylococcus
QKHDKP

SEQ ID NO: 1976219 - protein, 6 aa, Staphylococcus
QKHEEY

SEQ ID NO: 1976220 - protein, 4 aa, Staphylococcus
QKHG

SEQ ID NO: 1976221 - protein, 19 aa, Staphylococcus
QKHGEKYKISKSALKKIKP

SEQ ID NO: 1976222 - protein, 6 aa, Staphylococcus
QKHPER

SEQ ID NO: 1976223 - protein, 6 aa, Staphylococcus
QKHPRG

SEQ ID NO: 1976224 - protein, 7 aa, Staphylococcus
QKHQGDK

SEQ ID NO: 1976225 - protein, 4 aa, Staphylococcus
QKHT

SEQ ID NO: 1976226 - protein, 7 aa, Staphylococcus
QKHTRSK

SEQ ID NO: 1976227 - protein, 5 aa, Staphylococcus
QKHYD

SEQ ID NO: 1976228 - protein, 4 aa, Staphylococcus
QKIE

SEQ ID NO: 1976229 - protein, 9 aa, Staphylococcus
QKIEKEELY

SEQ ID NO: 1976230 - protein, 4 aa, Staphylococcus
QKIG

SEQ ID NO: 1976231 - protein, 10 aa, Staphylococcus
QKIGHEKAQR

SEQ ID NO: 1976232 - protein, 6 aa, Staphylococcus
QKIHPD

SEQ ID NO: 1976233 - protein, 9 aa, Staphylococcus
QKINGDELQ

SEQ ID NO: 1976234 - protein, 14 aa, Staphylococcus
QKINKSKIKPGDFD

SEQ ID NO: 1976235 - protein, 14 aa, Staphylococcus
QKINKSKVKPGAFD

SEQ ID NO: 1976236 - protein, 16 aa, Staphylococcus
QKINKSKVKPGDYDSI

SEQ ID NO: 1976237 - protein, 5 aa, Staphylococcus
QKINY

SEQ ID NO: 1976238 - protein, 7 aa, Staphylococcus
QKIQEAA

SEQ ID NO: 1976239 - protein, 7 aa, Staphylococcus
QKIQNYK

SEQ ID NO: 1976240 - protein, 7 aa, Staphylococcus
QKISKES

SEQ ID NO: 1976241 - protein, 22 aa, Staphylococcus
QKISKNKNKNVLPTESSDYQPV

SEQ ID NO: 1976242 - protein, 10 aa, Staphylococcus
QKISQYEPGL

SEQ ID NO: 1976243 - protein, 10 aa, Staphylococcus
QKITKSPKRE

SEQ ID NO: 1976244 - protein, 7 aa, Staphylococcus
QKKAAEL

SEQ ID NO: 1976245 - protein, 9 aa, Staphylococcus
QKKAESEKI

SEQ ID NO: 1976246 - protein, 8 aa, Staphylococcus
QKKAMVKD

SEQ ID NO: 1976247 - protein, 12 aa, Staphylococcus
QKKDNNIKVILK

SEQ ID NO: 1976248 - protein, 13 aa, Staphylococcus
QKKDNNIKVILKP

SEQ ID NO: 1976249 - protein, 8 aa, Staphylococcus
QKKDSKKR

SEQ ID NO: 1976250 - protein, 11 aa, Staphylococcus
QKKDVLSQTEY

SEQ ID NO: 1976251 - protein, 11 aa, Staphylococcus
QKKEAIQTETL

SEQ ID NO: 1976252 - protein, 12 aa, Staphylococcus
QKKETKTEKPYQ

SEQ ID NO: 1976253 - protein, 13 aa, Staphylococcus
QKKGPKKKRIDKV

SEQ ID NO: 1976254 - protein, 7 aa, Staphylococcus
QKKGVGF

SEQ ID NO: 1976255 - protein, 4 aa, Staphylococcus
QKKH

SEQ ID NO: 1976256 - protein, 10 aa, Staphylococcus
QKKKHAEDEK

SEQ ID NO: 1976257 - protein, 8 aa, Staphylococcus
QKKPGEKI

SEQ ID NO: 1976258 - protein, 8 aa, Staphylococcus
QKKQQNHY

SEQ ID NO: 1976259 - protein, 7 aa, Staphylococcus
QKKSAAQ

SEQ ID NO: 1976260 - protein, 7 aa, Staphylococcus
QKKTEHK

SEQ ID NO: 1976261 - protein, 29 aa, Staphylococcus
QKKVSKNYNTEERNYRMGNTSNKSNSKNV

SEQ ID NO: 1976262 - protein, 9 aa, Staphylococcus
QKLAPEKVK

SEQ ID NO: 1976263 - protein, 5 aa, Staphylococcus
QKLAT

SEQ ID NO: 1976264 - protein, 6 aa, Staphylococcus
QKLDSV

SEQ ID NO: 1976265 - protein, 5 aa, Staphylococcus
QKLER

SEQ ID NO: 1976266 - protein, 9 aa, Staphylococcus
QKLERGKRT

SEQ ID NO: 1976267 - protein, 14 aa, Staphylococcus
QKLERYKSRSQRDL

SEQ ID NO: 1976268 - protein, 22 aa, Staphylococcus
QKLETGIEGQPFSPITENSKEN

SEQ ID NO: 1976269 - protein, 9 aa, Staphylococcus
QKLKDIDKE

SEQ ID NO: 1976270 - protein, 6 aa, Staphylococcus
QKLKEE

SEQ ID NO: 1976271 - protein, 23 aa, Staphylococcus
QKLQEAENKLKTYNNEYYTKQRE

SEQ ID NO: 1976272 - protein, 7 aa, Staphylococcus
QKLSDQI

SEQ ID NO: 1976273 - protein, 17 aa, Staphylococcus
QKLSDSEDCEYKQYKGE

SEQ ID NO: 1976274 - protein, 8 aa, Staphylococcus
QKLTEKYP

SEQ ID NO: 1976275 - protein, 9 aa, Staphylococcus
QKLTNGKGV

SEQ ID NO: 1976276 - protein, 6 aa, Staphylococcus
QKLTSP

SEQ ID NO: 1976277 - protein, 12 aa, Staphylococcus
QKMATSYNAPGQ

SEQ ID NO: 1976278 - protein, 4 aa, Staphylococcus
QKMG

SEQ ID NO: 1976279 - protein, 8 aa, Staphylococcus
QKNAQERQ

SEQ ID NO: 1976280 - protein, 5 aa, Staphylococcus
QKNDI

SEQ ID NO: 1976281 - protein, 9 aa, Staphylococcus
QKNDPKSIR

SEQ ID NO: 1976282 - protein, 7 aa, Staphylococcus
QKNEETD

SEQ ID NO: 1976283 - protein, 10 aa, Staphylococcus
QKNGKHIPSD

SEQ ID NO: 1976284 - protein, 5 aa, Staphylococcus
QKNGY

SEQ ID NO: 1976285 - protein, 11 aa, Staphylococcus
QKNGYTEKARY

SEQ ID NO: 1976286 - protein, 7 aa, Staphylococcus
QKNHGNM

SEQ ID NO: 1976287 - protein, 8 aa, Staphylococcus
QKNIPGNH

SEQ ID NO: 1976288 - protein, 8 aa, Staphylococcus
QKNKDKFN

SEQ ID NO: 1976289 - protein, 9 aa, Staphylococcus
QKNKKSNAI

SEQ ID NO: 1976290 - protein, 13 aa, Staphylococcus
QKNKYNKSLPEME

SEQ ID NO: 1976291 - protein, 17 aa, Staphylococcus
QKNKYYDSSLTGSRLSG

SEQ ID NO: 1976292 - protein, 9 aa, Staphylococcus
QKNNDLAAQ

SEQ ID NO: 1976293 - protein, 10 aa, Staphylococcus
QKNNKTRKNM

SEQ ID NO: 1976294 - protein, 7 aa, Staphylococcus
QKNNLSI

SEQ ID NO: 1976295 - protein, 12 aa, Staphylococcus
QKNPDNGELKGA

SEQ ID NO: 1976296 - protein, 11 aa, Staphylococcus
QKNPDTGELKG

SEQ ID NO: 1976297 - protein, 15 aa, Staphylococcus
QKNPDTGELKGAMGA

SEQ ID NO: 1976298 - protein, 12 aa, Staphylococcus
QKNPDTGELNGA

SEQ ID NO: 1976299 - protein, 8 aa, Staphylococcus
QKNPNPQL

SEQ ID NO: 1976300 - protein, 9 aa, Staphylococcus
QKNQKQKAI

SEQ ID NO: 1976301 - protein, 14 aa, Staphylococcus
QKNRDNVPFTAPAE

SEQ ID NO: 1976302 - protein, 4 aa, Staphylococcus
QKNS

SEQ ID NO: 1976303 - protein, 6 aa, Staphylococcus
QKNVSV

SEQ ID NO: 1976304 - protein, 14 aa, Staphylococcus
QKNYDLAEKLFFIK

SEQ ID NO: 1976305 - protein, 15 aa, Staphylococcus
QKPEGFAEVLLNMWH

SEQ ID NO: 1976306 - protein, 8 aa, Staphylococcus
QKPETKLS

SEQ ID NO: 1976307 - protein, 4 aa, Staphylococcus
QKPF

SEQ ID NO: 1976308 - protein, 6 aa, Staphylococcus
QKPFTQ

SEQ ID NO: 1976309 - protein, 6 aa, Staphylococcus
QKPHYV

SEQ ID NO: 1976310 - protein, 9 aa, Staphylococcus
QKPINERTS

SEQ ID NO: 1976311 - protein, 9 aa, Staphylococcus
QKPIQERTS

SEQ ID NO: 1976312 - protein, 5 aa, Staphylococcus
QKPLE

SEQ ID NO: 1976313 - protein, 10 aa, Staphylococcus
QKPLTERPGE

SEQ ID NO: 1976314 - protein, 12 aa, Staphylococcus
QKPNAYEQSFFI

SEQ ID NO: 1976315 - protein, 9 aa, Staphylococcus
QKPNNKIDQ

SEQ ID NO: 1976316 - protein, 8 aa, Staphylococcus
QKPNNYNK

SEQ ID NO: 1976317 - protein, 9 aa, Staphylococcus
QKPSEGTIT

SEQ ID NO: 1976318 - protein, 7 aa, Staphylococcus
QKPTPTV

SEQ ID NO: 1976319 - protein, 11 aa, Staphylococcus
QKPVEQRSSYG

SEQ ID NO: 1976320 - protein, 6 aa, Staphylococcus
QKQAIE

SEQ ID NO: 1976321 - protein, 22 aa, Staphylococcus
QKQERQLKEQYGSKVDISTHKN

SEQ ID NO: 1976322 - protein, 7 aa, Staphylococcus
QKQEYLN

SEQ ID NO: 1976323 - protein, 7 aa, Staphylococcus
QKQGISS

SEQ ID NO: 1976324 - protein, 13 aa, Staphylococcus
QKQIDDEQVEQDK

SEQ ID NO: 1976325 - protein, 6 aa, Staphylococcus
QKQKEA

SEQ ID NO: 1976326 - protein, 5 aa, Staphylococcus
QKQKS

SEQ ID NO: 1976327 - protein, 13 aa, Staphylococcus
QKQKSQRQQIDND

SEQ ID NO: 1976328 - protein, 7 aa, Staphylococcus
QKQLNTA

SEQ ID NO: 1976329 - protein, 7 aa, Staphylococcus
QKQLSDD

SEQ ID NO: 1976330 - protein, 31 aa, Staphylococcus
QKQMQGEEIGEEELQKAQEQAQKIENDSNIS

SEQ ID NO: 1976331 - protein, 31 aa, Staphylococcus
QKQMQGEEIPEEDLAKAQEQAQAIEKDENIS

SEQ ID NO: 1976332 - protein, 31 aa, Staphylococcus
QKQMQGEEIPEEDLQKAQEQAQEIEKDENIS

SEQ ID NO: 1976333 - protein, 6 aa, Staphylococcus
QKQNFD

SEQ ID NO: 1976334 - protein, 7 aa, Staphylococcus
QKQPGET

SEQ ID NO: 1976335 - protein, 7 aa, Staphylococcus
QKQQNKL

SEQ ID NO: 1976336 - protein, 9 aa, Staphylococcus
QKQQTDALD

SEQ ID NO: 1976337 - protein, 5 aa, Staphylococcus
QKQQV

SEQ ID NO: 1976338 - protein, 11 aa, Staphylococcus
QKQRETENNKL

SEQ ID NO: 1976339 - protein, 13 aa, Staphylococcus
QKQSIFEDLSRDL

SEQ ID NO: 1976340 - protein, 5 aa, Staphylococcus
QKQSL

SEQ ID NO: 1976341 - protein, 4 aa, Staphylococcus
QKQY

SEQ ID NO: 1976342 - protein, 13 aa, Staphylococcus
QKQYGAPSTTLEK

SEQ ID NO: 1976343 - protein, 6 aa, Staphylococcus
QKQYGV

SEQ ID NO: 1976344 - protein, 10 aa, Staphylococcus
QKRAKELDEL

SEQ ID NO: 1976345 - protein, 4 aa, Staphylococcus
QKRD

SEQ ID NO: 1976346 - protein, 6 aa, Staphylococcus
QKRDEK

SEQ ID NO: 1976347 - protein, 7 aa, Staphylococcus
QKRDLSH

SEQ ID NO: 1976348 - protein, 4 aa, Staphylococcus
QKRG

SEQ ID NO: 1976349 - protein, 5 aa, Staphylococcus
QKRGY

SEQ ID NO: 1976350 - protein, 7 aa, Staphylococcus
QKRIQKG

SEQ ID NO: 1976351 - protein, 6 aa, Staphylococcus
QKRITN

SEQ ID NO: 1976352 - protein, 6 aa, Staphylococcus
QKRKDI

SEQ ID NO: 1976353 - protein, 4 aa, Staphylococcus
QKRN

SEQ ID NO: 1976354 - protein, 8 aa, Staphylococcus
QKRNAEER

SEQ ID NO: 1976355 - protein, 6 aa, Staphylococcus
QKRNPD

SEQ ID NO: 1976356 - protein, 7 aa, Staphylococcus
QKRNREI

SEQ ID NO: 1976357 - protein, 9 aa, Staphylococcus
QKRRTAETI

SEQ ID NO: 1976358 - protein, 17 aa, Staphylococcus
QKRSEGLESTRNSLDEY

SEQ ID NO: 1976359 - protein, 5 aa, Staphylococcus
QKRSG

SEQ ID NO: 1976360 - protein, 14 aa, Staphylococcus
QKSAEESTKTGKPI

SEQ ID NO: 1976361 - protein, 6 aa, Staphylococcus
QKSDEV

SEQ ID NO: 1976362 - protein, 8 aa, Staphylococcus
QKSDNQLN

SEQ ID NO: 1976363 - protein, 15 aa, Staphylococcus
QKSEAELKEESLTEV

SEQ ID NO: 1976364 - protein, 7 aa, Staphylococcus
QKSEARD

SEQ ID NO: 1976365 - protein, 21 aa, Staphylococcus
QKSEENIYKKSKSTIKQKGHI

SEQ ID NO: 1976366 - protein, 5 aa, Staphylococcus
QKSEF

SEQ ID NO: 1976367 - protein, 14 aa, Staphylococcus
QKSELTEDKLRAFG

SEQ ID NO: 1976368 - protein, 8 aa, Staphylococcus
QKSETYVP

SEQ ID NO: 1976369 - protein, 15 aa, Staphylococcus
QKSFRNGKVLQKNCV

SEQ ID NO: 1976370 - protein, 4 aa, Staphylococcus
QKSG

SEQ ID NO: 1976371 - protein, 5 aa, Staphylococcus
QKSGH

SEQ ID NO: 1976372 - protein, 17 aa, Staphylococcus
QKSGKRDDLTILIIKRV

SEQ ID NO: 1976373 - protein, 11 aa, Staphylococcus
QKSGTTLTEQG

SEQ ID NO: 1976374 - protein, 6 aa, Staphylococcus
QKSIED

SEQ ID NO: 1976375 - protein, 10 aa, Staphylococcus
QKSIERKDDM

SEQ ID NO: 1976376 - protein, 5 aa, Staphylococcus
QKSKH

SEQ ID NO: 1976377 - protein, 6 aa, Staphylococcus
QKSLSI

SEQ ID NO: 1976378 - protein, 7 aa, Staphylococcus
QKSMKDL

SEQ ID NO: 1976379 - protein, 7 aa, Staphylococcus
QKSMRDV

SEQ ID NO: 1976380 - protein, 7 aa, Staphylococcus
QKSNMKL

SEQ ID NO: 1976381 - protein, 9 aa, Staphylococcus
QKSPLDYPE

SEQ ID NO: 1976382 - protein, 7 aa, Staphylococcus
QKSPQSQ

SEQ ID NO: 1976383 - protein, 8 aa, Staphylococcus
QKSQPIES

SEQ ID NO: 1976384 - protein, 7 aa, Staphylococcus
QKSQPVN

SEQ ID NO: 1976385 - protein, 12 aa, Staphylococcus
QKSRDNSRTPIQ

SEQ ID NO: 1976386 - protein, 14 aa, Staphylococcus
QKSRDNSRTPIQWT

SEQ ID NO: 1976387 - protein, 12 aa, Staphylococcus
QKSRDNSRTPMQ

SEQ ID NO: 1976388 - protein, 12 aa, Staphylococcus
QKSRDNSRTPVQ

SEQ ID NO: 1976389 - protein, 6 aa, Staphylococcus
QKSREW

SEQ ID NO: 1976390 - protein, 9 aa, Staphylococcus
QKSRKSAME

SEQ ID NO: 1976391 - protein, 14 aa, Staphylococcus
QKSSESLKTVQFDS

SEQ ID NO: 1976392 - protein, 7 aa, Staphylococcus
QKSTIED

SEQ ID NO: 1976393 - protein, 7 aa, Staphylococcus
QKTAAEQ

SEQ ID NO: 1976394 - protein, 12 aa, Staphylococcus
QKTADEAGKPYE

SEQ ID NO: 1976395 - protein, 11 aa, Staphylococcus
QKTASFYQNGK

SEQ ID NO: 1976396 - protein, 5 aa, Staphylococcus
QKTED

SEQ ID NO: 1976397 - protein, 9 aa, Staphylococcus
QKTETREVE

SEQ ID NO: 1976398 - protein, 23 aa, Staphylococcus
QKTHQDMAKQSDKVNPKFNKDEV

SEQ ID NO: 1976399 - protein, 7 aa, Staphylococcus
QKTITGT

SEQ ID NO: 1976400 - protein, 8 aa, Staphylococcus
QKTKNKKV

SEQ ID NO: 1976401 - protein, 8 aa, Staphylococcus
QKTLDKKG

SEQ ID NO: 1976402 - protein, 10 aa, Staphylococcus
QKTNANPIIT

SEQ ID NO: 1976403 - protein, 17 aa, Staphylococcus
QKTNANPVITSGHPDFS

SEQ ID NO: 1976404 - protein, 7 aa, Staphylococcus
QKTNRRI

SEQ ID NO: 1976405 - protein, 8 aa, Staphylococcus
QKTNTSHA

SEQ ID NO: 1976406 - protein, 8 aa, Staphylococcus
QKTRYNQQ

SEQ ID NO: 1976407 - protein, 4 aa, Staphylococcus
QKTS

SEQ ID NO: 1976408 - protein, 12 aa, Staphylococcus
QKTVKSKNNLDF

SEQ ID NO: 1976409 - protein, 8 aa, Staphylococcus
QKVDKPNH

SEQ ID NO: 1976410 - protein, 18 aa, Staphylococcus
QKVEEARELQQKHGNELP

SEQ ID NO: 1976411 - protein, 21 aa, Staphylococcus
QKVGHDSVSIKKTDVTKPDEV

SEQ ID NO: 1976412 - protein, 6 aa, Staphylococcus
QKVKTE

SEQ ID NO: 1976413 - protein, 8 aa, Staphylococcus
QKVSKEIE

SEQ ID NO: 1976414 - protein, 6 aa, Staphylococcus
QKVSKR

SEQ ID NO: 1976415 - protein, 5 aa, Staphylococcus
QKVTP

SEQ ID NO: 1976416 - protein, 8 aa, Staphylococcus
QKYANGQK

SEQ ID NO: 1976417 - protein, 4 aa, Staphylococcus
QKYD

SEQ ID NO: 1976418 - protein, 10 aa, Staphylococcus
QKYDNDTSRN

SEQ ID NO: 1976419 - protein, 5 aa, Staphylococcus
QKYDR

SEQ ID NO: 1976420 - protein, 9 aa, Staphylococcus
QKYESREVN

SEQ ID NO: 1976421 - protein, 6 aa, Staphylococcus
QKYGAY

SEQ ID NO: 1976422 - protein, 7 aa, Staphylococcus
QKYGEAR

SEQ ID NO: 1976423 - protein, 4 aa, Staphylococcus
QKYH

SEQ ID NO: 1976424 - protein, 4 aa, Staphylococcus
QKYK

SEQ ID NO: 1976425 - protein, 25 aa, Staphylococcus
QKYKKNKHNHPFKSKKVHRVKSSDK

SEQ ID NO: 1976426 - protein, 14 aa, Staphylococcus
QKYNKHSREDQSNW

SEQ ID NO: 1976427 - protein, 6 aa, Staphylococcus
QKYPEY

SEQ ID NO: 1976428 - protein, 17 aa, Staphylococcus
QKYPNEISGGQQQRTAA

SEQ ID NO: 1976429 - protein, 6 aa, Staphylococcus
QKYRDA

SEQ ID NO: 1976430 - protein, 11 aa, Staphylococcus
QKYSETQSDAD

SEQ ID NO: 1976431 - protein, 4 aa, Staphylococcus
QLAA

SEQ ID NO: 1976432 - protein, 7 aa, Staphylococcus
QLADEKD

SEQ ID NO: 1976433 - protein, 12 aa, Staphylococcus
QLAEEGDTVEVG

SEQ ID NO: 1976434 - protein, 10 aa, Staphylococcus
QLAEKTNIQI

SEQ ID NO: 1976435 - protein, 11 aa, Staphylococcus
QLANEGDTVEV

SEQ ID NO: 1976436 - protein, 12 aa, Staphylococcus
QLAPGTEGGYTT

SEQ ID NO: 1976437 - protein, 13 aa, Staphylococcus
QLAPGTEGGYTTY

SEQ ID NO: 1976438 - protein, 13 aa, Staphylococcus
QLAPKSITDTALE

SEQ ID NO: 1976439 - protein, 5 aa, Staphylococcus
QLAQF

SEQ ID NO: 1976440 - protein, 4 aa, Staphylococcus
QLAS

SEQ ID NO: 1976441 - protein, 13 aa, Staphylococcus
QLATNKQKISDNE

SEQ ID NO: 1976442 - protein, 6 aa, Staphylococcus
QLDAES

SEQ ID NO: 1976443 - protein, 9 aa, Staphylococcus
QLDDSLKPY

SEQ ID NO: 1976444 - protein, 16 aa, Staphylococcus
QLDEQQNLKDKYEKQV

SEQ ID NO: 1976445 - protein, 5 aa, Staphylococcus
QLDET

SEQ ID NO: 1976446 - protein, 5 aa, Staphylococcus
QLDKD

SEQ ID NO: 1976447 - protein, 18 aa, Staphylococcus
QLDKENPKLEKVNQADQK

SEQ ID NO: 1976448 - protein, 9 aa, Staphylococcus
QLDQHSSVE

SEQ ID NO: 1976449 - protein, 7 aa, Staphylococcus
QLDSDTE

SEQ ID NO: 1976450 - protein, 15 aa, Staphylococcus
QLDSIDDKVQEAVKH

SEQ ID NO: 1976451 - protein, 17 aa, Staphylococcus
QLDSIDDKVQKAIKNGA

SEQ ID NO: 1976452 - protein, 13 aa, Staphylococcus
QLDTSTPENTADD

SEQ ID NO: 1976453 - protein, 4 aa, Staphylococcus
QLED

SEQ ID NO: 1976454 - protein, 10 aa, Staphylococcus
QLEDEQGDNV

SEQ ID NO: 1976455 - protein, 4 aa, Staphylococcus
QLEE

SEQ ID NO: 1976456 - protein, 6 aa, Staphylococcus
QLEEEK

SEQ ID NO: 1976457 - protein, 6 aa, Staphylococcus
QLEEIN

SEQ ID NO: 1976458 - protein, 8 aa, Staphylococcus
QLEEKGVE

SEQ ID NO: 1976459 - protein, 6 aa, Staphylococcus
QLEEKY

SEQ ID NO: 1976460 - protein, 4 aa, Staphylococcus
QLEH

SEQ ID NO: 1976461 - protein, 13 aa, Staphylococcus
QLEKEYARNITSS

SEQ ID NO: 1976462 - protein, 11 aa, Staphylococcus
QLEKKQEFNGV

SEQ ID NO: 1976463 - protein, 10 aa, Staphylococcus
QLENDAKTNV

SEQ ID NO: 1976464 - protein, 11 aa, Staphylococcus
QLENDMGTDRT

SEQ ID NO: 1976465 - protein, 8 aa, Staphylococcus
QLENKTSR

SEQ ID NO: 1976466 - protein, 5 aa, Staphylococcus
QLEQK

SEQ ID NO: 1976467 - protein, 12 aa, Staphylococcus
QLEQNQMQQEKL

SEQ ID NO: 1976468 - protein, 9 aa, Staphylococcus
QLEQTYDED

SEQ ID NO: 1976469 - protein, 9 aa, Staphylococcus
QLEREEDQR

SEQ ID NO: 1976470 - protein, 5 aa, Staphylococcus
QLESE

SEQ ID NO: 1976471 - protein, 5 aa, Staphylococcus
QLETD

SEQ ID NO: 1976472 - protein, 13 aa, Staphylococcus
QLETDPSLKRFRT

SEQ ID NO: 1976473 - protein, 13 aa, Staphylococcus
QLETEESGTNYDR

SEQ ID NO: 1976474 - protein, 13 aa, Staphylococcus
QLETEESGTSYER

SEQ ID NO: 1976475 - protein, 13 aa, Staphylococcus
QLETEESNTNYDR

SEQ ID NO: 1976476 - protein, 13 aa, Staphylococcus
QLETEETGTSYER

SEQ ID NO: 1976477 - protein, 8 aa, Staphylococcus
QLETEQSY

SEQ ID NO: 1976478 - protein, 8 aa, Staphylococcus
QLETETKV

SEQ ID NO: 1976479 - protein, 5 aa, Staphylococcus
QLETH

SEQ ID NO: 1976480 - protein, 7 aa, Staphylococcus
QLGEGGL

SEQ ID NO: 1976481 - protein, 9 aa, Staphylococcus
QLGEKDPKL

SEQ ID NO: 1976482 - protein, 16 aa, Staphylococcus
QLGGEQETKRRAGTEN

SEQ ID NO: 1976483 - protein, 18 aa, Staphylococcus
QLGGEQETKRRAGTESVP

SEQ ID NO: 1976484 - protein, 7 aa, Staphylococcus
QLGGETK

SEQ ID NO: 1976485 - protein, 4 aa, Staphylococcus
QLGK

SEQ ID NO: 1976486 - protein, 10 aa, Staphylococcus
QLGKDYPEPI

SEQ ID NO: 1976487 - protein, 7 aa, Staphylococcus
QLGKGQE

SEQ ID NO: 1976488 - protein, 8 aa, Staphylococcus
QLGKTSST

SEQ ID NO: 1976489 - protein, 13 aa, Staphylococcus
QLGPKDNEVELQK

SEQ ID NO: 1976490 - protein, 12 aa, Staphylococcus
QLGPNEDEVELQ

SEQ ID NO: 1976491 - protein, 13 aa, Staphylococcus
QLGPNEDEVELQK

SEQ ID NO: 1976492 - protein, 13 aa, Staphylococcus
QLGPSDDDVELQK

SEQ ID NO: 1976493 - protein, 9 aa, Staphylococcus
QLGQRPGAG

SEQ ID NO: 1976494 - protein, 6 aa, Staphylococcus
QLGSVG

SEQ ID NO: 1976495 - protein, 5 aa, Staphylococcus
QLGTA

SEQ ID NO: 1976496 - protein, 10 aa, Staphylococcus
QLGVPAEKDV

SEQ ID NO: 1976497 - protein, 37 aa, Staphylococcus
QLHTPRREEPRTSIPAGSVGIANNQTGLYPKSSPGGW

SEQ ID NO: 1976498 - protein, 13 aa, Staphylococcus
QLHYKSKNAKINE

SEQ ID NO: 1976499 - protein, 11 aa, Staphylococcus
QLIEEAKKETN

SEQ ID NO: 1976500 - protein, 8 aa, Staphylococcus
QLKDDNVD

SEQ ID NO: 1976501 - protein, 5 aa, Staphylococcus
QLKEE

SEQ ID NO: 1976502 - protein, 8 aa, Staphylococcus
QLKEEDHG

SEQ ID NO: 1976503 - protein, 9 aa, Staphylococcus
QLKEKTSPM

SEQ ID NO: 1976504 - protein, 16 aa, Staphylococcus
QLKEQKKQQEAQLSNK

SEQ ID NO: 1976505 - protein, 10 aa, Staphylococcus
QLKESGKAHF

SEQ ID NO: 1976506 - protein, 5 aa, Staphylococcus
QLKEY

SEQ ID NO: 1976507 - protein, 11 aa, Staphylococcus
QLKGGDKDPFR

SEQ ID NO: 1976508 - protein, 11 aa, Staphylococcus
QLKGGDKDPYR

SEQ ID NO: 1976509 - protein, 11 aa, Staphylococcus
QLKGGEKDPYR

SEQ ID NO: 1976510 - protein, 11 aa, Staphylococcus
QLKGGGKDPYR

SEQ ID NO: 1976511 - protein, 12 aa, Staphylococcus
QLKGGNKDPYRV

SEQ ID NO: 1976512 - protein, 42 aa, Staphylococcus
QLKKPRDPEEEERLRKRNEERKRRKEEQDRKLKEKLAKKKAV

SEQ ID NO: 1976513 - protein, 42 aa, Staphylococcus
QLKKPRDPEEEERLRKRNEERKRRKEEQDRKLKEKLAKRKAI

SEQ ID NO: 1976514 - protein, 42 aa, Staphylococcus
QLKKPRDPEEEERLRKRNEERKRRKEEQDRKLKEKLAKRKAS

SEQ ID NO: 1976515 - protein, 27 aa, Staphylococcus
QLKKQQKQSVNLQNYGKETAFHQSENQ

SEQ ID NO: 1976516 - protein, 8 aa, Staphylococcus
QLKNAKDK

SEQ ID NO: 1976517 - protein, 15 aa, Staphylococcus
QLKNDDSDKYEKHGE

SEQ ID NO: 1976518 - protein, 10 aa, Staphylococcus
QLKNDKALKE

SEQ ID NO: 1976519 - protein, 8 aa, Staphylococcus
QLKNEGKM

SEQ ID NO: 1976520 - protein, 10 aa, Staphylococcus
QLKNEKALEE

SEQ ID NO: 1976521 - protein, 9 aa, Staphylococcus
QLKNEKALK

SEQ ID NO: 1976522 - protein, 10 aa, Staphylococcus
QLKNEKALKE

SEQ ID NO: 1976523 - protein, 9 aa, Staphylococcus
QLKPEEVNQ

SEQ ID NO: 1976524 - protein, 7 aa, Staphylococcus
QLKPGET

SEQ ID NO: 1976525 - protein, 10 aa, Staphylococcus
QLKPKKAIKS

SEQ ID NO: 1976526 - protein, 13 aa, Staphylococcus
QLKQNEKDKIEYD

SEQ ID NO: 1976527 - protein, 12 aa, Staphylococcus
QLKQQRSEYEEK

SEQ ID NO: 1976528 - protein, 40 aa, Staphylococcus
QLKQRDEQNAQLQSQVEQAQRSEEIAKKQLEDAESREPEV

SEQ ID NO: 1976529 - protein, 40 aa, Staphylococcus
QLKQRDEQNAQLQSQVEQAQRSEEIAKKQLENAESREPEV

SEQ ID NO: 1976530 - protein, 9 aa, Staphylococcus
QLKSKKIPS

SEQ ID NO: 1976531 - protein, 9 aa, Staphylococcus
QLKSKKISS

SEQ ID NO: 1976532 - protein, 8 aa, Staphylococcus
QLKSQKVA

SEQ ID NO: 1976533 - protein, 27 aa, Staphylococcus
QLKSSVDSWTSSETATNDELKVPNKQD

SEQ ID NO: 1976534 - protein, 8 aa, Staphylococcus
QLKTEKIS

SEQ ID NO: 1976535 - protein, 9 aa, Staphylococcus
QLKTNKAKE

SEQ ID NO: 1976536 - protein, 4 aa, Staphylococcus
QLND

SEQ ID NO: 1976537 - protein, 7 aa, Staphylococcus
QLNDNEN

SEQ ID NO: 1976538 - protein, 9 aa, Staphylococcus
QLNDQPIKR

SEQ ID NO: 1976539 - protein, 18 aa, Staphylococcus
QLNDSNSEDSKKLEQQIQ

SEQ ID NO: 1976540 - protein, 5 aa, Staphylococcus
QLNEA

SEQ ID NO: 1976541 - protein, 20 aa, Staphylococcus
QLNEEYNNIDKSKLDLNNKQ

SEQ ID NO: 1976542 - protein, 5 aa, Staphylococcus
QLNEL

SEQ ID NO: 1976543 - protein, 5 aa, Staphylococcus
QLNEN

SEQ ID NO: 1976544 - protein, 8 aa, Staphylococcus
QLNEQEIN

SEQ ID NO: 1976545 - protein, 7 aa, Staphylococcus
QLNGEYG

SEQ ID NO: 1976546 - protein, 8 aa, Staphylococcus
QLNGEYGH

SEQ ID NO: 1976547 - protein, 9 aa, Staphylococcus
QLNGRYEGE

SEQ ID NO: 1976548 - protein, 5 aa, Staphylococcus
QLNND

SEQ ID NO: 1976549 - protein, 4 aa, Staphylococcus
QLNP

SEQ ID NO: 1976550 - protein, 7 aa, Staphylococcus
QLNPSLS

SEQ ID NO: 1976551 - protein, 11 aa, Staphylococcus
QLNPTTHQERL

SEQ ID NO: 1976552 - protein, 4 aa, Staphylococcus
QLNQ

SEQ ID NO: 1976553 - protein, 6 aa, Staphylococcus
QLNQDA

SEQ ID NO: 1976554 - protein, 5 aa, Staphylococcus
QLNQY

SEQ ID NO: 1976555 - protein, 13 aa, Staphylococcus
QLNRSGYSTKNFH

SEQ ID NO: 1976556 - protein, 9 aa, Staphylococcus
QLNSETDHE

SEQ ID NO: 1976557 - protein, 6 aa, Staphylococcus
QLNSQG

SEQ ID NO: 1976558 - protein, 9 aa, Staphylococcus
QLNSSTHHE

SEQ ID NO: 1976559 - protein, 5 aa, Staphylococcus
QLPAL

SEQ ID NO: 1976560 - protein, 9 aa, Staphylococcus
QLPATYTSV

SEQ ID NO: 1976561 - protein, 5 aa, Staphylococcus
QLPDS

SEQ ID NO: 1976562 - protein, 8 aa, Staphylococcus
QLPDTNEV

SEQ ID NO: 1976563 - protein, 17 aa, Staphylococcus
QLPDVGEKISTPDGQGR

SEQ ID NO: 1976564 - protein, 5 aa, Staphylococcus
QLPEA

SEQ ID NO: 1976565 - protein, 7 aa, Staphylococcus
QLPEETV

SEQ ID NO: 1976566 - protein, 7 aa, Staphylococcus
QLPEKDV

SEQ ID NO: 1976567 - protein, 32 aa, Staphylococcus
QLPELEPKASNHNEVNSNNQSVSSSQPTSNDD

SEQ ID NO: 1976568 - protein, 5 aa, Staphylococcus
QLPER

SEQ ID NO: 1976569 - protein, 9 aa, Staphylococcus
QLPGKTSSW

SEQ ID NO: 1976570 - protein, 10 aa, Staphylococcus
QLPGKTSSWF

SEQ ID NO: 1976571 - protein, 4 aa, Staphylococcus
QLPL

SEQ ID NO: 1976572 - protein, 12 aa, Staphylococcus
QLPQDKVNVKGG

SEQ ID NO: 1976573 - protein, 6 aa, Staphylococcus
QLPQTD

SEQ ID NO: 1976574 - protein, 6 aa, Staphylococcus
QLPRTI

SEQ ID NO: 1976575 - protein, 7 aa, Staphylococcus
QLPSERE

SEQ ID NO: 1976576 - protein, 14 aa, Staphylococcus
QLPSNEDTQQRQKE

SEQ ID NO: 1976577 - protein, 6 aa, Staphylococcus
QLPSRG

SEQ ID NO: 1976578 - protein, 9 aa, Staphylococcus
QLPSTVKRG

SEQ ID NO: 1976579 - protein, 4 aa, Staphylococcus
QLPT

SEQ ID NO: 1976580 - protein, 5 aa, Staphylococcus
QLPTD

SEQ ID NO: 1976581 - protein, 10 aa, Staphylococcus
QLPTEEEQFE

SEQ ID NO: 1976582 - protein, 7 aa, Staphylococcus
QLPTEVK

SEQ ID NO: 1976583 - protein, 9 aa, Staphylococcus
QLQDGNATL

SEQ ID NO: 1976584 - protein, 5 aa, Staphylococcus
QLQDT

SEQ ID NO: 1976585 - protein, 8 aa, Staphylococcus
QLQEEEKS

SEQ ID NO: 1976586 - protein, 4 aa, Staphylococcus
QLQG

SEQ ID NO: 1976587 - protein, 7 aa, Staphylococcus
QLQGSQQ

SEQ ID NO: 1976588 - protein, 9 aa, Staphylococcus
QLQKGTKLN

SEQ ID NO: 1976589 - protein, 43 aa, Staphylococcus
QLQKPRDPEEEERLRKRNEERKRRKEEQDRKLKEKLAKRKQTK

SEQ ID NO: 1976590 - protein, 11 aa, Staphylococcus
QLQQYEKSSHD

SEQ ID NO: 1976591 - protein, 12 aa, Staphylococcus
QLQSTEQQLDTV

SEQ ID NO: 1976592 - protein, 6 aa, Staphylococcus
QLRESE

SEQ ID NO: 1976593 - protein, 6 aa, Staphylococcus
QLRKGK

SEQ ID NO: 1976594 - protein, 6 aa, Staphylococcus
QLRKGN

SEQ ID NO: 1976595 - protein, 6 aa, Staphylococcus
QLRKGS

SEQ ID NO: 1976596 - protein, 6 aa, Staphylococcus
QLRKGT

SEQ ID NO: 1976597 - protein, 10 aa, Staphylococcus
QLRKNNHPNV

SEQ ID NO: 1976598 - protein, 8 aa, Staphylococcus
QLRNAGKV

SEQ ID NO: 1976599 - protein, 10 aa, Staphylococcus
QLRPKQAELN

SEQ ID NO: 1976600 - protein, 6 aa, Staphylococcus
QLRQRP

SEQ ID NO: 1976601 - protein, 9 aa, Staphylococcus
QLRQSDRVR

SEQ ID NO: 1976602 - protein, 6 aa, Staphylococcus
QLRRPD

SEQ ID NO: 1976603 - protein, 4 aa, Staphylococcus
QLRS

SEQ ID NO: 1976604 - protein, 11 aa, Staphylococcus
QLSDEDKATLE

SEQ ID NO: 1976605 - protein, 19 aa, Staphylococcus
QLSDKDKEFLESYKNQLKN

SEQ ID NO: 1976606 - protein, 16 aa, Staphylococcus
QLSDSPEQIKNQQTYS

SEQ ID NO: 1976607 - protein, 6 aa, Staphylococcus
QLSEGT

SEQ ID NO: 1976608 - protein, 8 aa, Staphylococcus
QLSESLSI

SEQ ID NO: 1976609 - protein, 4 aa, Staphylococcus
QLSG

SEQ ID NO: 1976610 - protein, 9 aa, Staphylococcus
QLSGDERVT

SEQ ID NO: 1976611 - protein, 5 aa, Staphylococcus
QLSGG

SEQ ID NO: 1976612 - protein, 10 aa, Staphylococcus
QLSGGQQQRV

SEQ ID NO: 1976613 - protein, 4 aa, Staphylococcus
QLSK

SEQ ID NO: 1976614 - protein, 23 aa, Staphylococcus
QLSKEGKENTTQVQQQLNQKRSD

SEQ ID NO: 1976615 - protein, 23 aa, Staphylococcus
QLSKEGKESTTKTQQQLHQKQSD

SEQ ID NO: 1976616 - protein, 6 aa, Staphylococcus
QLSNDE

SEQ ID NO: 1976617 - protein, 11 aa, Staphylococcus
QLSNDRSDTQF

SEQ ID NO: 1976618 - protein, 7 aa, Staphylococcus
QLSNEKY

SEQ ID NO: 1976619 - protein, 6 aa, Staphylococcus
QLSNEY

SEQ ID NO: 1976620 - protein, 5 aa, Staphylococcus
QLSNK

SEQ ID NO: 1976621 - protein, 6 aa, Staphylococcus
QLSNPF

SEQ ID NO: 1976622 - protein, 7 aa, Staphylococcus
QLSNPYK

SEQ ID NO: 1976623 - protein, 6 aa, Staphylococcus
QLSPKV

SEQ ID NO: 1976624 - protein, 7 aa, Staphylococcus
QLSQPKY

SEQ ID NO: 1976625 - protein, 19 aa, Staphylococcus
QLSRESFAPPTLKISSEQS

SEQ ID NO: 1976626 - protein, 15 aa, Staphylococcus
QLSRESYKAPTLQIN

SEQ ID NO: 1976627 - protein, 13 aa, Staphylococcus
QLSRNSFDPPTLK

SEQ ID NO: 1976628 - protein, 7 aa, Staphylococcus
QLSRQQQ

SEQ ID NO: 1976629 - protein, 14 aa, Staphylococcus
QLSSDRNDDQLRNT

SEQ ID NO: 1976630 - protein, 11 aa, Staphylococcus
QLSSDRSDERL

SEQ ID NO: 1976631 - protein, 5 aa, Staphylococcus
QLSTG

SEQ ID NO: 1976632 - protein, 10 aa, Staphylococcus
QLSTKANNLL

SEQ ID NO: 1976633 - protein, 4 aa, Staphylococcus
QLTA

SEQ ID NO: 1976634 - protein, 4 aa, Staphylococcus
QLTD

SEQ ID NO: 1976635 - protein, 6 aa, Staphylococcus
QLTDET

SEQ ID NO: 1976636 - protein, 4 aa, Staphylococcus
QLTE

SEQ ID NO: 1976637 - protein, 9 aa, Staphylococcus
QLTEGKEVK

SEQ ID NO: 1976638 - protein, 10 aa, Staphylococcus
QLTERAREIG

SEQ ID NO: 1976639 - protein, 13 aa, Staphylococcus
QLTKEGISITRLG

SEQ ID NO: 1976640 - protein, 9 aa, Staphylococcus
QLTKEYGET

SEQ ID NO: 1976641 - protein, 11 aa, Staphylococcus
QLTNDYTIPNE

SEQ ID NO: 1976642 - protein, 4 aa, Staphylococcus
QLTP

SEQ ID NO: 1976643 - protein, 7 aa, Staphylococcus
QLTPESY

SEQ ID NO: 1976644 - protein, 7 aa, Staphylococcus
QLTPETY

SEQ ID NO: 1976645 - protein, 5 aa, Staphylococcus
QLTPR

SEQ ID NO: 1976646 - protein, 27 aa, Staphylococcus
QLTQAGGQPISEPHVNTKYEDTEGNQT

SEQ ID NO: 1976647 - protein, 9 aa, Staphylococcus
QLTQENGLK

SEQ ID NO: 1976648 - protein, 5 aa, Staphylococcus
QLTQP

SEQ ID NO: 1976649 - protein, 5 aa, Staphylococcus
QLTQT

SEQ ID NO: 1976650 - protein, 9 aa, Staphylococcus
QLTRDYKDK

SEQ ID NO: 1976651 - protein, 8 aa, Staphylococcus
QLTRKEAS

SEQ ID NO: 1976652 - protein, 7 aa, Staphylococcus
QLTSNAE

SEQ ID NO: 1976653 - protein, 7 aa, Staphylococcus
QLTTRQA

SEQ ID NO: 1976654 - protein, 12 aa, Staphylococcus
QMAEDTNTFRGN

SEQ ID NO: 1976655 - protein, 8 aa, Staphylococcus
QMDDNDIE

SEQ ID NO: 1976656 - protein, 9 aa, Staphylococcus
QMDDNGLSK

SEQ ID NO: 1976657 - protein, 7 aa, Staphylococcus
QMDDPTR

SEQ ID NO: 1976658 - protein, 15 aa, Staphylococcus
QMEPYTEKVPADDAD

SEQ ID NO: 1976659 - protein, 63 aa, Staphylococcus
QMGYQSEESSSKDNQPPPENHAKTSDTEQTQKTSSSHLQSNNHSAQKSEGRTPNYSKKDNTVN

SEQ ID NO: 1976660 - protein, 5 aa, Staphylococcus
QMKTG

SEQ ID NO: 1976661 - protein, 5 aa, Staphylococcus
QMLEP

SEQ ID NO: 1976662 - protein, 8 aa, Staphylococcus
QMNEDGIE

SEQ ID NO: 1976663 - protein, 8 aa, Staphylococcus
QMNERDLE

SEQ ID NO: 1976664 - protein, 15 aa, Staphylococcus
QMNGTGSGSGCEGCG

SEQ ID NO: 1976665 - protein, 7 aa, Staphylococcus
QMNRQNV

SEQ ID NO: 1976666 - protein, 13 aa, Staphylococcus
QMNRTKSAASQKI

SEQ ID NO: 1976667 - protein, 5 aa, Staphylococcus
QMNRV

SEQ ID NO: 1976668 - protein, 6 aa, Staphylococcus
QMNSTN

SEQ ID NO: 1976669 - protein, 6 aa, Staphylococcus
QMPEGA

SEQ ID NO: 1976670 - protein, 12 aa, Staphylococcus
QMPHSNEAEQSV

SEQ ID NO: 1976671 - protein, 5 aa, Staphylococcus
QMPRQ

SEQ ID NO: 1976672 - protein, 11 aa, Staphylococcus
QMPTEDEQFEA

SEQ ID NO: 1976673 - protein, 20 aa, Staphylococcus
QMRNCSDEALQAKTADFKQR

SEQ ID NO: 1976674 - protein, 9 aa, Staphylococcus
QMSEPLGTH

SEQ ID NO: 1976675 - protein, 5 aa, Staphylococcus
QMSGK

SEQ ID NO: 1976676 - protein, 6 aa, Staphylococcus
QMSGKD

SEQ ID NO: 1976677 - protein, 8 aa, Staphylococcus
QMSNQELE

SEQ ID NO: 1976678 - protein, 6 aa, Staphylococcus
QMTESD

SEQ ID NO: 1976679 - protein, 6 aa, Staphylococcus
QMTKYE

SEQ ID NO: 1976680 - protein, 14 aa, Staphylococcus
QMTQPVKKGMKDKG

SEQ ID NO: 1976681 - protein, 15 aa, Staphylococcus
QMTQPVKKGMKEKGV

SEQ ID NO: 1976682 - protein, 14 aa, Staphylococcus
QMTQPVKKKMKEKG

SEQ ID NO: 1976683 - protein, 8 aa, Staphylococcus
QMTRKEAT

SEQ ID NO: 1976684 - protein, 8 aa, Staphylococcus
QMTRNEAS

SEQ ID NO: 1976685 - protein, 8 aa, Staphylococcus
QMTRSEAT

SEQ ID NO: 1976686 - protein, 6 aa, Staphylococcus
QMVNQS

SEQ ID NO: 1976687 - protein, 4 aa, Staphylococcus
QNAD

SEQ ID NO: 1976688 - protein, 10 aa, Staphylococcus
QNADGNKKYY

SEQ ID NO: 1976689 - protein, 8 aa, Staphylococcus
QNADLDST

SEQ ID NO: 1976690 - protein, 7 aa, Staphylococcus
QNADQPL

SEQ ID NO: 1976691 - protein, 8 aa, Staphylococcus
QNAEIEDA

SEQ ID NO: 1976692 - protein, 9 aa, Staphylococcus
QNAIDTDGR

SEQ ID NO: 1976693 - protein, 9 aa, Staphylococcus
QNAIDTEGR

SEQ ID NO: 1976694 - protein, 22 aa, Staphylococcus
QNAKSTTSVDLANRSRSLTEEN

SEQ ID NO: 1976695 - protein, 4 aa, Staphylococcus
QNAN

SEQ ID NO: 1976696 - protein, 10 aa, Staphylococcus
QNAPEWTKDR

SEQ ID NO: 1976697 - protein, 4 aa, Staphylococcus
QNAQ

SEQ ID NO: 1976698 - protein, 9 aa, Staphylococcus
QNAQDAKAA

SEQ ID NO: 1976699 - protein, 7 aa, Staphylococcus
QNAQIQT

SEQ ID NO: 1976700 - protein, 16 aa, Staphylococcus
QNAQNNQQHTGGKDYL

SEQ ID NO: 1976701 - protein, 8 aa, Staphylococcus
QNAQQQRE

SEQ ID NO: 1976702 - protein, 10 aa, Staphylococcus
QNARSTTSVD

SEQ ID NO: 1976703 - protein, 7 aa, Staphylococcus
QNASVDQ

SEQ ID NO: 1976704 - protein, 4 aa, Staphylococcus
QNAY

SEQ ID NO: 1976705 - protein, 6 aa, Staphylococcus
QNAYYD

SEQ ID NO: 1976706 - protein, 12 aa, Staphylococcus
QNCAPSREHPHE

SEQ ID NO: 1976707 - protein, 8 aa, Staphylococcus
QNDAKKKV

SEQ ID NO: 1976708 - protein, 10 aa, Staphylococcus
QNDAKPDHEI

SEQ ID NO: 1976709 - protein, 10 aa, Staphylococcus
QNDASYENKI

SEQ ID NO: 1976710 - protein, 21 aa, Staphylococcus
QNDASYENKLDAYPSSQGQKG

SEQ ID NO: 1976711 - protein, 9 aa, Staphylococcus
QNDAVNSIS

SEQ ID NO: 1976712 - protein, 8 aa, Staphylococcus
QNDAVTSI

SEQ ID NO: 1976713 - protein, 5 aa, Staphylococcus
QNDDI

SEQ ID NO: 1976714 - protein, 9 aa, Staphylococcus
QNDDRAEGN

SEQ ID NO: 1976715 - protein, 7 aa, Staphylococcus
QNDDTWG

SEQ ID NO: 1976716 - protein, 19 aa, Staphylococcus
QNDEKMGSYQYEINYKEIS

SEQ ID NO: 1976717 - protein, 19 aa, Staphylococcus
QNDEKMGSYQYELKYKEIG

SEQ ID NO: 1976718 - protein, 7 aa, Staphylococcus
QNDELGR

SEQ ID NO: 1976719 - protein, 7 aa, Staphylococcus
QNDESPL

SEQ ID NO: 1976720 - protein, 21 aa, Staphylococcus
QNDESYENKLDEYPSSQGEKG

SEQ ID NO: 1976721 - protein, 8 aa, Staphylococcus
QNDFEKDD

SEQ ID NO: 1976722 - protein, 8 aa, Staphylococcus
QNDGKSIS

SEQ ID NO: 1976723 - protein, 5 aa, Staphylococcus
QNDGP

SEQ ID NO: 1976724 - protein, 8 aa, Staphylococcus
QNDGSYRR

SEQ ID NO: 1976725 - protein, 7 aa, Staphylococcus
QNDIQRK

SEQ ID NO: 1976726 - protein, 9 aa, Staphylococcus
QNDKPEDFK

SEQ ID NO: 1976727 - protein, 6 aa, Staphylococcus
QNDKVS

SEQ ID NO: 1976728 - protein, 9 aa, Staphylococcus
QNDLDEGTY

SEQ ID NO: 1976729 - protein, 7 aa, Staphylococcus
QNDMPDG

SEQ ID NO: 1976730 - protein, 6 aa, Staphylococcus
QNDNEF

SEQ ID NO: 1976731 - protein, 9 aa, Staphylococcus
QNDNIPDEM

SEQ ID NO: 1976732 - protein, 4 aa, Staphylococcus
QNDP

SEQ ID NO: 1976733 - protein, 5 aa, Staphylococcus
QNDPD

SEQ ID NO: 1976734 - protein, 5 aa, Staphylococcus
QNDPQ

SEQ ID NO: 1976735 - protein, 8 aa, Staphylococcus
QNDPQLTD

SEQ ID NO: 1976736 - protein, 9 aa, Staphylococcus
QNDPRAEGN

SEQ ID NO: 1976737 - protein, 5 aa, Staphylococcus
QNDPS

SEQ ID NO: 1976738 - protein, 6 aa, Staphylococcus
QNDPWE

SEQ ID NO: 1976739 - protein, 4 aa, Staphylococcus
QNDR

SEQ ID NO: 1976740 - protein, 10 aa, Staphylococcus
QNDSAKYDKL

SEQ ID NO: 1976741 - protein, 14 aa, Staphylococcus
QNDTCPTCGKTPHY

SEQ ID NO: 1976742 - protein, 10 aa, Staphylococcus
QNDTSYENKI

SEQ ID NO: 1976743 - protein, 24 aa, Staphylococcus
QNDVAETTKAYKQAKSKLTHAENE

SEQ ID NO: 1976744 - protein, 4 aa, Staphylococcus
QNDY

SEQ ID NO: 1976745 - protein, 11 aa, Staphylococcus
QNDYGASSISQ

SEQ ID NO: 1976746 - protein, 7 aa, Staphylococcus
QNDYNTY

SEQ ID NO: 1976747 - protein, 6 aa, Staphylococcus
QNEAIN

SEQ ID NO: 1976748 - protein, 6 aa, Staphylococcus
QNEDEG

SEQ ID NO: 1976749 - protein, 8 aa, Staphylococcus
QNEDIPDE

SEQ ID NO: 1976750 - protein, 6 aa, Staphylococcus
QNEEIK

SEQ ID NO: 1976751 - protein, 23 aa, Staphylococcus
QNEEIPDELAESPSDNGDASHEP

SEQ ID NO: 1976752 - protein, 47 aa, Staphylococcus
QNEENETNNVQQNQPQQSERSYSNQSKLKTVPQKKTTRNYNSEERNV

SEQ ID NO: 1976753 - protein, 8 aa, Staphylococcus
QNEFTEDT

SEQ ID NO: 1976754 - protein, 7 aa, Staphylococcus
QNEFTKN

SEQ ID NO: 1976755 - protein, 8 aa, Staphylococcus
QNEGPFND

SEQ ID NO: 1976756 - protein, 7 aa, Staphylococcus
QNEGTNV

SEQ ID NO: 1976757 - protein, 7 aa, Staphylococcus
QNEGVPE

SEQ ID NO: 1976758 - protein, 8 aa, Staphylococcus
QNELDERQ

SEQ ID NO: 1976759 - protein, 8 aa, Staphylococcus
QNELEEKQ

SEQ ID NO: 1976760 - protein, 10 aa, Staphylococcus
QNELEEKQEL

SEQ ID NO: 1976761 - protein, 9 aa, Staphylococcus
QNELEPNGK

SEQ ID NO: 1976762 - protein, 7 aa, Staphylococcus
QNELNSN

SEQ ID NO: 1976763 - protein, 12 aa, Staphylococcus
QNENAGFTSGTP

SEQ ID NO: 1976764 - protein, 6 aa, Staphylococcus
QNENDV

SEQ ID NO: 1976765 - protein, 5 aa, Staphylococcus
QNENK

SEQ ID NO: 1976766 - protein, 5 aa, Staphylococcus
QNEPE

SEQ ID NO: 1976767 - protein, 14 aa, Staphylococcus
QNEPLGKAKDGQDV

SEQ ID NO: 1976768 - protein, 5 aa, Staphylococcus
QNEPN

SEQ ID NO: 1976769 - protein, 10 aa, Staphylococcus
QNEPTIQPEK

SEQ ID NO: 1976770 - protein, 6 aa, Staphylococcus
QNEQEG

SEQ ID NO: 1976771 - protein, 6 aa, Staphylococcus
QNEQEN

SEQ ID NO: 1976772 - protein, 5 aa, Staphylococcus
QNEQI

SEQ ID NO: 1976773 - protein, 60 aa, Staphylococcus
QNERETLNKDVNKALKDIEKRPDNKKAFNKKENLEKQLDANQQKLDEAKKLQAEHGNELP

SEQ ID NO: 1976774 - protein, 5 aa, Staphylococcus
QNESD

SEQ ID NO: 1976775 - protein, 13 aa, Staphylococcus
QNESEKLKELYLN

SEQ ID NO: 1976776 - protein, 5 aa, Staphylococcus
QNESI

SEQ ID NO: 1976777 - protein, 6 aa, Staphylococcus
QNESID

SEQ ID NO: 1976778 - protein, 9 aa, Staphylococcus
QNESITPEE

SEQ ID NO: 1976779 - protein, 9 aa, Staphylococcus
QNESSEDNM

SEQ ID NO: 1976780 - protein, 7 aa, Staphylococcus
QNETEGY

SEQ ID NO: 1976781 - protein, 7 aa, Staphylococcus
QNEVENT

SEQ ID NO: 1976782 - protein, 12 aa, Staphylococcus
QNEVPERTEGYE

SEQ ID NO: 1976783 - protein, 19 aa, Staphylococcus
QNEYGTAPVYNKETYETNV

SEQ ID NO: 1976784 - protein, 4 aa, Staphylococcus
QNFE

SEQ ID NO: 1976785 - protein, 4 aa, Staphylococcus
QNFL

SEQ ID NO: 1976786 - protein, 5 aa, Staphylococcus
QNFNK

SEQ ID NO: 1976787 - protein, 4 aa, Staphylococcus
QNGA

SEQ ID NO: 1976788 - protein, 4 aa, Staphylococcus
QNGD

SEQ ID NO: 1976789 - protein, 6 aa, Staphylococcus
QNGDRI

SEQ ID NO: 1976790 - protein, 9 aa, Staphylococcus
QNGDTLENP

SEQ ID NO: 1976791 - protein, 8 aa, Staphylococcus
QNGEFTEE

SEQ ID NO: 1976792 - protein, 17 aa, Staphylococcus
QNGGESGAFNLGSSQGY

SEQ ID NO: 1976793 - protein, 9 aa, Staphylococcus
QNGKDKSEF

SEQ ID NO: 1976794 - protein, 6 aa, Staphylococcus
QNGKGI

SEQ ID NO: 1976795 - protein, 9 aa, Staphylococcus
QNGKPSNFD

SEQ ID NO: 1976796 - protein, 5 aa, Staphylococcus
QNGKV

SEQ ID NO: 1976797 - protein, 25 aa, Staphylococcus
QNGLSDENVNRKQYNDNSKDIENKD

SEQ ID NO: 1976798 - protein, 4 aa, Staphylococcus
QNGN

SEQ ID NO: 1976799 - protein, 8 aa, Staphylococcus
QNGNADEA

SEQ ID NO: 1976800 - protein, 5 aa, Staphylococcus
QNGND

SEQ ID NO: 1976801 - protein, 8 aa, Staphylococcus
QNGNFNPN

SEQ ID NO: 1976802 - protein, 8 aa, Staphylococcus
QNGREPLM

SEQ ID NO: 1976803 - protein, 6 aa, Staphylococcus
QNGTKI

SEQ ID NO: 1976804 - protein, 5 aa, Staphylococcus
QNGVY

SEQ ID NO: 1976805 - protein, 12 aa, Staphylococcus
QNHAKGSARSID

SEQ ID NO: 1976806 - protein, 12 aa, Staphylococcus
QNHAKGSARSIE

SEQ ID NO: 1976807 - protein, 5 aa, Staphylococcus
QNHDT

SEQ ID NO: 1976808 - protein, 6 aa, Staphylococcus
QNHEEQ

SEQ ID NO: 1976809 - protein, 6 aa, Staphylococcus
QNHSEI

SEQ ID NO: 1976810 - protein, 5 aa, Staphylococcus
QNHSG

SEQ ID NO: 1976811 - protein, 9 aa, Staphylococcus
QNIDTETDE

SEQ ID NO: 1976812 - protein, 11 aa, Staphylococcus
QNIGDKYGKSI

SEQ ID NO: 1976813 - protein, 8 aa, Staphylococcus
QNIKPKKA

SEQ ID NO: 1976814 - protein, 12 aa, Staphylococcus
QNIMSADNTARD

SEQ ID NO: 1976815 - protein, 4 aa, Staphylococcus
QNIN

SEQ ID NO: 1976816 - protein, 7 aa, Staphylococcus
QNINDAH

SEQ ID NO: 1976817 - protein, 7 aa, Staphylococcus
QNINKSH

SEQ ID NO: 1976818 - protein, 5 aa, Staphylococcus
QNIPH

SEQ ID NO: 1976819 - protein, 19 aa, Staphylococcus
QNIQQQRKDELTQQSQRER

SEQ ID NO: 1976820 - protein, 7 aa, Staphylococcus
QNIQTTI

SEQ ID NO: 1976821 - protein, 31 aa, Staphylococcus
QNIRQQKKDEMAQKSQRESSLRKMAEENRIV

SEQ ID NO: 1976822 - protein, 6 aa, Staphylococcus
QNISAG

SEQ ID NO: 1976823 - protein, 4 aa, Staphylococcus
QNIT

SEQ ID NO: 1976824 - protein, 7 aa, Staphylococcus
QNITTYQ

SEQ ID NO: 1976825 - protein, 8 aa, Staphylococcus
QNKAKGYV

SEQ ID NO: 1976826 - protein, 9 aa, Staphylococcus
QNKDKLKEV

SEQ ID NO: 1976827 - protein, 7 aa, Staphylococcus
QNKEEEY

SEQ ID NO: 1976828 - protein, 13 aa, Staphylococcus
QNKEEKKKIEARH

SEQ ID NO: 1976829 - protein, 7 aa, Staphylococcus
QNKEKIS

SEQ ID NO: 1976830 - protein, 5 aa, Staphylococcus
QNKEQ

SEQ ID NO: 1976831 - protein, 8 aa, Staphylococcus
QNKGASKL

SEQ ID NO: 1976832 - protein, 8 aa, Staphylococcus
QNKGDSKV

SEQ ID NO: 1976833 - protein, 7 aa, Staphylococcus
QNKGDVT

SEQ ID NO: 1976834 - protein, 9 aa, Staphylococcus
QNKGKDTGA

SEQ ID NO: 1976835 - protein, 11 aa, Staphylococcus
QNKGKDTGAYC

SEQ ID NO: 1976836 - protein, 6 aa, Staphylococcus
QNKGNE

SEQ ID NO: 1976837 - protein, 8 aa, Staphylococcus
QNKGPARL

SEQ ID NO: 1976838 - protein, 7 aa, Staphylococcus
QNKGQSH

SEQ ID NO: 1976839 - protein, 6 aa, Staphylococcus
QNKKEA

SEQ ID NO: 1976840 - protein, 5 aa, Staphylococcus
QNKKY

SEQ ID NO: 1976841 - protein, 9 aa, Staphylococcus
QNKLKSDEK

SEQ ID NO: 1976842 - protein, 10 aa, Staphylococcus
QNKNAGFSDH

SEQ ID NO: 1976843 - protein, 6 aa, Staphylococcus
QNKNVT

SEQ ID NO: 1976844 - protein, 4 aa, Staphylococcus
QNKP

SEQ ID NO: 1976845 - protein, 7 aa, Staphylococcus
QNKPEDF

SEQ ID NO: 1976846 - protein, 5 aa, Staphylococcus
QNKPI

SEQ ID NO: 1976847 - protein, 7 aa, Staphylococcus
QNKQKLN

SEQ ID NO: 1976848 - protein, 8 aa, Staphylococcus
QNKQPIAL

SEQ ID NO: 1976849 - protein, 4 aa, Staphylococcus
QNKR

SEQ ID NO: 1976850 - protein, 7 aa, Staphylococcus
QNKRLTE

SEQ ID NO: 1976851 - protein, 12 aa, Staphylococcus
QNKRRSAAFPED

SEQ ID NO: 1976852 - protein, 8 aa, Staphylococcus
QNKTLNNA

SEQ ID NO: 1976853 - protein, 14 aa, Staphylococcus
QNKTRTPGDNYGRR

SEQ ID NO: 1976854 - protein, 9 aa, Staphylococcus
QNKTYDMTN

SEQ ID NO: 1976855 - protein, 9 aa, Staphylococcus
QNKVDIKEE

SEQ ID NO: 1976856 - protein, 8 aa, Staphylococcus
QNLKPKKA

SEQ ID NO: 1976857 - protein, 10 aa, Staphylococcus
QNLKSTTQKL

SEQ ID NO: 1976858 - protein, 4 aa, Staphylococcus
QNLP

SEQ ID NO: 1976859 - protein, 8 aa, Staphylococcus
QNLPEAAA

SEQ ID NO: 1976860 - protein, 5 aa, Staphylococcus
QNLPN

SEQ ID NO: 1976861 - protein, 4 aa, Staphylococcus
QNLS

SEQ ID NO: 1976862 - protein, 10 aa, Staphylococcus
QNLSDEDAEA

SEQ ID NO: 1976863 - protein, 5 aa, Staphylococcus
QNLSE

SEQ ID NO: 1976864 - protein, 10 aa, Staphylococcus
QNLSEEDAEA

SEQ ID NO: 1976865 - protein, 11 aa, Staphylococcus
QNLSEEDAEEY

SEQ ID NO: 1976866 - protein, 6 aa, Staphylococcus
QNLSNH

SEQ ID NO: 1976867 - protein, 9 aa, Staphylococcus
QNLSNNADL

SEQ ID NO: 1976868 - protein, 12 aa, Staphylococcus
QNLTEEDAESYL

SEQ ID NO: 1976869 - protein, 8 aa, Staphylococcus
QNNCTEKI

SEQ ID NO: 1976870 - protein, 9 aa, Staphylococcus
QNNDASNTI

SEQ ID NO: 1976871 - protein, 7 aa, Staphylococcus
QNNDGLK

SEQ ID NO: 1976872 - protein, 6 aa, Staphylococcus
QNNEGL

SEQ ID NO: 1976873 - protein, 11 aa, Staphylococcus
QNNENTDAQDQ

SEQ ID NO: 1976874 - protein, 8 aa, Staphylococcus
QNNESLKD

SEQ ID NO: 1976875 - protein, 21 aa, Staphylococcus
QNNESYENKIDDYPSSLGKDG

SEQ ID NO: 1976876 - protein, 9 aa, Staphylococcus
QNNGEGHRD

SEQ ID NO: 1976877 - protein, 5 aa, Staphylococcus
QNNGF

SEQ ID NO: 1976878 - protein, 8 aa, Staphylococcus
QNNGINDG

SEQ ID NO: 1976879 - protein, 9 aa, Staphylococcus
QNNGVNDGD

SEQ ID NO: 1976880 - protein, 15 aa, Staphylococcus
QNNIKQDYYKNDNKL

SEQ ID NO: 1976881 - protein, 8 aa, Staphylococcus
QNNKEERL

SEQ ID NO: 1976882 - protein, 8 aa, Staphylococcus
QNNLEANY

SEQ ID NO: 1976883 - protein, 13 aa, Staphylococcus
QNNLEEVSADIPK

SEQ ID NO: 1976884 - protein, 7 aa, Staphylococcus
QNNNEQG

SEQ ID NO: 1976885 - protein, 8 aa, Staphylococcus
QNNNQNYK

SEQ ID NO: 1976886 - protein, 4 aa, Staphylococcus
QNNP

SEQ ID NO: 1976887 - protein, 6 aa, Staphylococcus
QNNPIP

SEQ ID NO: 1976888 - protein, 9 aa, Staphylococcus
QNNPSGGID

SEQ ID NO: 1976889 - protein, 6 aa, Staphylococcus
QNNSNN

SEQ ID NO: 1976890 - protein, 15 aa, Staphylococcus
QNNSYSKNKNIKKTK

SEQ ID NO: 1976891 - protein, 7 aa, Staphylococcus
QNNTEGY

SEQ ID NO: 1976892 - protein, 22 aa, Staphylococcus
QNNTSYENKIDEYPSSQGSNGI

SEQ ID NO: 1976893 - protein, 8 aa, Staphylococcus
QNPANAAH

SEQ ID NO: 1976894 - protein, 8 aa, Staphylococcus
QNPAQFSN

SEQ ID NO: 1976895 - protein, 4 aa, Staphylococcus
QNPD

SEQ ID NO: 1976896 - protein, 17 aa, Staphylococcus
QNPDKRDDLTILIIKRV

SEQ ID NO: 1976897 - protein, 6 aa, Staphylococcus
QNPDVT

SEQ ID NO: 1976898 - protein, 6 aa, Staphylococcus
QNPEDF

SEQ ID NO: 1976899 - protein, 5 aa, Staphylococcus
QNPES

SEQ ID NO: 1976900 - protein, 6 aa, Staphylococcus
QNPEYQ

SEQ ID NO: 1976901 - protein, 9 aa, Staphylococcus
QNPKQHDVS

SEQ ID NO: 1976902 - protein, 7 aa, Staphylococcus
QNPKSGN

SEQ ID NO: 1976903 - protein, 6 aa, Staphylococcus
QNPKTQ

SEQ ID NO: 1976904 - protein, 18 aa, Staphylococcus
QNPNETVKPIKGGFRTGR

SEQ ID NO: 1976905 - protein, 17 aa, Staphylococcus
QNPNKKDDMTILIIKRV

SEQ ID NO: 1976906 - protein, 7 aa, Staphylococcus
QNPNKLA

SEQ ID NO: 1976907 - protein, 17 aa, Staphylococcus
QNPNKRDDMTILIIKRV

SEQ ID NO: 1976908 - protein, 17 aa, Staphylococcus
QNPNKRDDMTIMIIKRV

SEQ ID NO: 1976909 - protein, 9 aa, Staphylococcus
QNPNTKPIH

SEQ ID NO: 1976910 - protein, 7 aa, Staphylococcus
QNPQEFK

SEQ ID NO: 1976911 - protein, 6 aa, Staphylococcus
QNPQRL

SEQ ID NO: 1976912 - protein, 9 aa, Staphylococcus
QNPSNAKHL

SEQ ID NO: 1976913 - protein, 17 aa, Staphylococcus
QNPSRKDDMTILIIKRV

SEQ ID NO: 1976914 - protein, 7 aa, Staphylococcus
QNPTRLA

SEQ ID NO: 1976915 - protein, 4 aa, Staphylococcus
QNQD

SEQ ID NO: 1976916 - protein, 4 aa, Staphylococcus
QNQE

SEQ ID NO: 1976917 - protein, 9 aa, Staphylococcus
QNQEVSEEA

SEQ ID NO: 1976918 - protein, 5 aa, Staphylococcus
QNQFT

SEQ ID NO: 1976919 - protein, 11 aa, Staphylococcus
QNQGSDTEKIE

SEQ ID NO: 1976920 - protein, 6 aa, Staphylococcus
QNQHQI

SEQ ID NO: 1976921 - protein, 4 aa, Staphylococcus
QNQI

SEQ ID NO: 1976922 - protein, 6 aa, Staphylococcus
QNQIQS

SEQ ID NO: 1976923 - protein, 5 aa, Staphylococcus
QNQIT

SEQ ID NO: 1976924 - protein, 15 aa, Staphylococcus
QNQITSKIDANTESL

SEQ ID NO: 1976925 - protein, 24 aa, Staphylococcus
QNQLDNGTKEQQSVATVQDVSDTI

SEQ ID NO: 1976926 - protein, 15 aa, Staphylococcus
QNQSSLTEEKLKAFG

SEQ ID NO: 1976927 - protein, 9 aa, Staphylococcus
QNQSVSEEA

SEQ ID NO: 1976928 - protein, 8 aa, Staphylococcus
QNQSYDKK

SEQ ID NO: 1976929 - protein, 18 aa, Staphylococcus
QNQYDEDTYHSDDIEIIN

SEQ ID NO: 1976930 - protein, 6 aa, Staphylococcus
QNQYSK

SEQ ID NO: 1976931 - protein, 5 aa, Staphylococcus
QNRDV

SEQ ID NO: 1976932 - protein, 10 aa, Staphylococcus
QNRGQLTDDA

SEQ ID NO: 1976933 - protein, 6 aa, Staphylococcus
QNRGQR

SEQ ID NO: 1976934 - protein, 4 aa, Staphylococcus
QNRK

SEQ ID NO: 1976935 - protein, 40 aa, Staphylococcus
QNRKQDQHNEAEKIETEPEQEDVAQKAKDLFGEETVHMID

SEQ ID NO: 1976936 - protein, 5 aa, Staphylococcus
QNRLD

SEQ ID NO: 1976937 - protein, 31 aa, Staphylococcus
QNRNANGENNSESGEAQQPAQVDVAQKAKDL

SEQ ID NO: 1976938 - protein, 17 aa, Staphylococcus
QNRRKKLTSVDKENVLS

SEQ ID NO: 1976939 - protein, 5 aa, Staphylococcus
QNRTL

SEQ ID NO: 1976940 - protein, 5 aa, Staphylococcus
QNSAG

SEQ ID NO: 1976941 - protein, 9 aa, Staphylococcus
QNSASYYRE

SEQ ID NO: 1976942 - protein, 7 aa, Staphylococcus
QNSDEMN

SEQ ID NO: 1976943 - protein, 10 aa, Staphylococcus
QNSDKMTASQ

SEQ ID NO: 1976944 - protein, 5 aa, Staphylococcus
QNSEK

SEQ ID NO: 1976945 - protein, 6 aa, Staphylococcus
QNSEKH

SEQ ID NO: 1976946 - protein, 12 aa, Staphylococcus
QNSGTPAKPRNL

SEQ ID NO: 1976947 - protein, 14 aa, Staphylococcus
QNSISNTEQEYQQV

SEQ ID NO: 1976948 - protein, 17 aa, Staphylococcus
QNSLDEAETKEIKAENY

SEQ ID NO: 1976949 - protein, 13 aa, Staphylococcus
QNSNHDDNQIKQE

SEQ ID NO: 1976950 - protein, 4 aa, Staphylococcus
QNSQ

SEQ ID NO: 1976951 - protein, 5 aa, Staphylococcus
QNSQR

SEQ ID NO: 1976952 - protein, 7 aa, Staphylococcus
QNSTTVA

SEQ ID NO: 1976953 - protein, 5 aa, Staphylococcus
QNTEF

SEQ ID NO: 1976954 - protein, 4 aa, Staphylococcus
QNTK

SEQ ID NO: 1976955 - protein, 10 aa, Staphylococcus
QNTNKQKEVS

SEQ ID NO: 1976956 - protein, 11 aa, Staphylococcus
QNTNQISDEIA

SEQ ID NO: 1976957 - protein, 4 aa, Staphylococcus
QNTQ

SEQ ID NO: 1976958 - protein, 20 aa, Staphylococcus
QNTQGDDIQITRSSDLKATL

SEQ ID NO: 1976959 - protein, 17 aa, Staphylococcus
QNTQKRDDMTILIIKRV

SEQ ID NO: 1976960 - protein, 11 aa, Staphylococcus
QNTRKKTQRAI

SEQ ID NO: 1976961 - protein, 5 aa, Staphylococcus
QNTSD

SEQ ID NO: 1976962 - protein, 6 aa, Staphylococcus
QNTSEG

SEQ ID NO: 1976963 - protein, 11 aa, Staphylococcus
QNTSRTPGQHF

SEQ ID NO: 1976964 - protein, 12 aa, Staphylococcus
QNTYEPGSTFKS

SEQ ID NO: 1976965 - protein, 12 aa, Staphylococcus
QNTYEPGSTFKT

SEQ ID NO: 1976966 - protein, 6 aa, Staphylococcus
QNTYPY

SEQ ID NO: 1976967 - protein, 6 aa, Staphylococcus
QNVADG

SEQ ID NO: 1976968 - protein, 4 aa, Staphylococcus
QNVL

SEQ ID NO: 1976969 - protein, 16 aa, Staphylococcus
QNVPQENEFDEYEDEA

SEQ ID NO: 1976970 - protein, 4 aa, Staphylococcus
QNVS

SEQ ID NO: 1976971 - protein, 9 aa, Staphylococcus
QNVTEGPSV

SEQ ID NO: 1976972 - protein, 15 aa, Staphylococcus
QNVTSKGGTTQAGLD

SEQ ID NO: 1976973 - protein, 5 aa, Staphylococcus
QNVTT

SEQ ID NO: 1976974 - protein, 5 aa, Staphylococcus
QNWPY

SEQ ID NO: 1976975 - protein, 5 aa, Staphylococcus
QNYDD

SEQ ID NO: 1976976 - protein, 4 aa, Staphylococcus
QNYE

SEQ ID NO: 1976977 - protein, 8 aa, Staphylococcus
QNYETNRE

SEQ ID NO: 1976978 - protein, 7 aa, Staphylococcus
QNYFSEQ

SEQ ID NO: 1976979 - protein, 5 aa, Staphylococcus
QNYGQ

SEQ ID NO: 1976980 - protein, 5 aa, Staphylococcus
QNYGY

SEQ ID NO: 1976981 - protein, 11 aa, Staphylococcus
QNYHQSSSYKK

SEQ ID NO: 1976982 - protein, 9 aa, Staphylococcus
QNYKKDREY

SEQ ID NO: 1976983 - protein, 18 aa, Staphylococcus
QNYKSEKEQSTDALIEDL

SEQ ID NO: 1976984 - protein, 6 aa, Staphylococcus
QNYLES

SEQ ID NO: 1976985 - protein, 8 aa, Staphylococcus
QPAGTAEG

SEQ ID NO: 1976986 - protein, 5 aa, Staphylococcus
QPAHR

SEQ ID NO: 1976987 - protein, 7 aa, Staphylococcus
QPAKDMD

SEQ ID NO: 1976988 - protein, 7 aa, Staphylococcus
QPAKDMT

SEQ ID NO: 1976989 - protein, 7 aa, Staphylococcus
QPAKNMS

SEQ ID NO: 1976990 - protein, 8 aa, Staphylococcus
QPAKSMST

SEQ ID NO: 1976991 - protein, 4 aa, Staphylococcus
QPAL

SEQ ID NO: 1976992 - protein, 21 aa, Staphylococcus
QPAQPFERGITNDKFKAQGGQ

SEQ ID NO: 1976993 - protein, 21 aa, Staphylococcus
QPAQPFERGVTNDKFKAQGGK

SEQ ID NO: 1976994 - protein, 7 aa, Staphylococcus
QPASQTL

SEQ ID NO: 1976995 - protein, 4 aa, Staphylococcus
QPDA

SEQ ID NO: 1976996 - protein, 10 aa, Staphylococcus
QPDAKFPPSL

SEQ ID NO: 1976997 - protein, 4 aa, Staphylococcus
QPDD

SEQ ID NO: 1976998 - protein, 48 aa, Staphylococcus
QPDDTSLNSNQDDTNETPSQTQSNSVKSQSKPSNTNQSSTNSINNGRF

SEQ ID NO: 1976999 - protein, 7 aa, Staphylococcus
QPDELSP

SEQ ID NO: 1977000 - protein, 11 aa, Staphylococcus
QPDESGDGGKL

SEQ ID NO: 1977001 - protein, 6 aa, Staphylococcus
QPDETT

SEQ ID NO: 1977002 - protein, 7 aa, Staphylococcus
QPDETTF

SEQ ID NO: 1977003 - protein, 5 aa, Staphylococcus
QPDEV

SEQ ID NO: 1977004 - protein, 4 aa, Staphylococcus
QPDF

SEQ ID NO: 1977005 - protein, 9 aa, Staphylococcus
QPDFPMPDS

SEQ ID NO: 1977006 - protein, 8 aa, Staphylococcus
QPDGAPAY

SEQ ID NO: 1977007 - protein, 6 aa, Staphylococcus
QPDHSP

SEQ ID NO: 1977008 - protein, 4 aa, Staphylococcus
QPDI

SEQ ID NO: 1977009 - protein, 5 aa, Staphylococcus
QPDIY

SEQ ID NO: 1977010 - protein, 11 aa, Staphylococcus
QPDKFSKAAPL

SEQ ID NO: 1977011 - protein, 4 aa, Staphylococcus
QPDN

SEQ ID NO: 1977012 - protein, 12 aa, Staphylococcus
QPDQGVIESSTN

SEQ ID NO: 1977013 - protein, 7 aa, Staphylococcus
QPDQTTF

SEQ ID NO: 1977014 - protein, 9 aa, Staphylococcus
QPDTTLEDV

SEQ ID NO: 1977015 - protein, 6 aa, Staphylococcus
QPDYEN

SEQ ID NO: 1977016 - protein, 5 aa, Staphylococcus
QPEAT

SEQ ID NO: 1977017 - protein, 6 aa, Staphylococcus
QPEDLS

SEQ ID NO: 1977018 - protein, 7 aa, Staphylococcus
QPEDVAT

SEQ ID NO: 1977019 - protein, 5 aa, Staphylococcus
QPEFV

SEQ ID NO: 1977020 - protein, 10 aa, Staphylococcus
QPEGKFPPSL

SEQ ID NO: 1977021 - protein, 4 aa, Staphylococcus
QPEH

SEQ ID NO: 1977022 - protein, 5 aa, Staphylococcus
QPEHT

SEQ ID NO: 1977023 - protein, 6 aa, Staphylococcus
QPEIKE

SEQ ID NO: 1977024 - protein, 11 aa, Staphylococcus
QPEKLKGSEEL

SEQ ID NO: 1977025 - protein, 5 aa, Staphylococcus
QPEKR

SEQ ID NO: 1977026 - protein, 6 aa, Staphylococcus
QPELYS

SEQ ID NO: 1977027 - protein, 7 aa, Staphylococcus
QPEQEGE

SEQ ID NO: 1977028 - protein, 6 aa, Staphylococcus
QPERLT

SEQ ID NO: 1977029 - protein, 7 aa, Staphylococcus
QPESLPS

SEQ ID NO: 1977030 - protein, 4 aa, Staphylococcus
QPET

SEQ ID NO: 1977031 - protein, 5 aa, Staphylococcus
QPETD

SEQ ID NO: 1977032 - protein, 5 aa, Staphylococcus
QPETG

SEQ ID NO: 1977033 - protein, 7 aa, Staphylococcus
QPETITE

SEQ ID NO: 1977034 - protein, 14 aa, Staphylococcus
QPFAPMASDDEQEI

SEQ ID NO: 1977035 - protein, 6 aa, Staphylococcus
QPFNPE

SEQ ID NO: 1977036 - protein, 8 aa, Staphylococcus
QPFPQDPL

SEQ ID NO: 1977037 - protein, 8 aa, Staphylococcus
QPFPQEPL

SEQ ID NO: 1977038 - protein, 11 aa, Staphylococcus
QPFTKEQYDEF

SEQ ID NO: 1977039 - protein, 10 aa, Staphylococcus
QPGAQQGEYK

SEQ ID NO: 1977040 - protein, 19 aa, Staphylococcus
QPGASITTTSSVQGYNPNP

SEQ ID NO: 1977041 - protein, 5 aa, Staphylococcus
QPGES

SEQ ID NO: 1977042 - protein, 29 aa, Staphylococcus
QPGEVKYDKGSTLPKSNFQNNEQQKQLQS

SEQ ID NO: 1977043 - protein, 16 aa, Staphylococcus
QPGGKMHSDPHHPGSE

SEQ ID NO: 1977044 - protein, 13 aa, Staphylococcus
QPGGSIKDQDSID

SEQ ID NO: 1977045 - protein, 13 aa, Staphylococcus
QPGGSIKDQESID

SEQ ID NO: 1977046 - protein, 14 aa, Staphylococcus
QPGGSIKDQESIDM

SEQ ID NO: 1977047 - protein, 9 aa, Staphylococcus
QPGLSPQAL

SEQ ID NO: 1977048 - protein, 17 aa, Staphylococcus
QPGLSPQALKEKHGIEG

SEQ ID NO: 1977049 - protein, 5 aa, Staphylococcus
QPGNI

SEQ ID NO: 1977050 - protein, 10 aa, Staphylococcus
QPGSKGNTVG

SEQ ID NO: 1977051 - protein, 8 aa, Staphylococcus
QPGSSDKD

SEQ ID NO: 1977052 - protein, 4 aa, Staphylococcus
QPGV

SEQ ID NO: 1977053 - protein, 4 aa, Staphylococcus
QPHP

SEQ ID NO: 1977054 - protein, 10 aa, Staphylococcus
QPHPEGGYYK

SEQ ID NO: 1977055 - protein, 5 aa, Staphylococcus
QPIAS

SEQ ID NO: 1977056 - protein, 5 aa, Staphylococcus
QPIDE

SEQ ID NO: 1977057 - protein, 4 aa, Staphylococcus
QPIE

SEQ ID NO: 1977058 - protein, 10 aa, Staphylococcus
QPIEGHEPEV

SEQ ID NO: 1977059 - protein, 5 aa, Staphylococcus
QPIGE

SEQ ID NO: 1977060 - protein, 6 aa, Staphylococcus
QPIGEN

SEQ ID NO: 1977061 - protein, 5 aa, Staphylococcus
QPIGQ

SEQ ID NO: 1977062 - protein, 22 aa, Staphylococcus
QPIKDTTDKPVNTTKPKAIAPK

SEQ ID NO: 1977063 - protein, 6 aa, Staphylococcus
QPINGT

SEQ ID NO: 1977064 - protein, 5 aa, Staphylococcus
QPIQA

SEQ ID NO: 1977065 - protein, 6 aa, Staphylococcus
QPIQSE

SEQ ID NO: 1977066 - protein, 4 aa, Staphylococcus
QPIR

SEQ ID NO: 1977067 - protein, 11 aa, Staphylococcus
QPISEAQPDKY

SEQ ID NO: 1977068 - protein, 9 aa, Staphylococcus
QPISRDKDA

SEQ ID NO: 1977069 - protein, 4 aa, Staphylococcus
QPIT

SEQ ID NO: 1977070 - protein, 6 aa, Staphylococcus
QPITRS

SEQ ID NO: 1977071 - protein, 8 aa, Staphylococcus
QPKAVDEA

SEQ ID NO: 1977072 - protein, 13 aa, Staphylococcus
QPKDFASKSSYEQ

SEQ ID NO: 1977073 - protein, 13 aa, Staphylococcus
QPKENLAEVLNKH

SEQ ID NO: 1977074 - protein, 8 aa, Staphylococcus
QPKGIVST

SEQ ID NO: 1977075 - protein, 22 aa, Staphylococcus
QPKGIVSTKTKVIQKAKSLNKT

SEQ ID NO: 1977076 - protein, 9 aa, Staphylococcus
QPKHIEQAT

SEQ ID NO: 1977077 - protein, 4 aa, Staphylococcus
QPKK

SEQ ID NO: 1977078 - protein, 10 aa, Staphylococcus
QPKNWKSDAN

SEQ ID NO: 1977079 - protein, 7 aa, Staphylococcus
QPKPGTD

SEQ ID NO: 1977080 - protein, 4 aa, Staphylococcus
QPKR

SEQ ID NO: 1977081 - protein, 8 aa, Staphylococcus
QPKSYGRV

SEQ ID NO: 1977082 - protein, 19 aa, Staphylococcus
QPKSYPSIDTAKNRQWSDR

SEQ ID NO: 1977083 - protein, 34 aa, Staphylococcus
QPKSYPSINTAQKRNYSTSERNKIEQNKSRVISG

SEQ ID NO: 1977084 - protein, 4 aa, Staphylococcus
QPLD

SEQ ID NO: 1977085 - protein, 5 aa, Staphylococcus
QPLDE

SEQ ID NO: 1977086 - protein, 11 aa, Staphylococcus
QPLDESPEKYV

SEQ ID NO: 1977087 - protein, 5 aa, Staphylococcus
QPLEE

SEQ ID NO: 1977088 - protein, 6 aa, Staphylococcus
QPLEEK

SEQ ID NO: 1977089 - protein, 6 aa, Staphylococcus
QPLESK

SEQ ID NO: 1977090 - protein, 6 aa, Staphylococcus
QPLETG

SEQ ID NO: 1977091 - protein, 5 aa, Staphylococcus
QPLEV

SEQ ID NO: 1977092 - protein, 5 aa, Staphylococcus
QPLGR

SEQ ID NO: 1977093 - protein, 12 aa, Staphylococcus
QPLKESSEKYVQ

SEQ ID NO: 1977094 - protein, 16 aa, Staphylococcus
QPLKGEVTISGAKNSA

SEQ ID NO: 1977095 - protein, 10 aa, Staphylococcus
QPLKGKKKDM

SEQ ID NO: 1977096 - protein, 5 aa, Staphylococcus
QPLNG

SEQ ID NO: 1977097 - protein, 13 aa, Staphylococcus
QPLNSDNNKDNIQ

SEQ ID NO: 1977098 - protein, 7 aa, Staphylococcus
QPLPEDE

SEQ ID NO: 1977099 - protein, 15 aa, Staphylococcus
QPLPKKAGRNNQGKL

SEQ ID NO: 1977100 - protein, 7 aa, Staphylococcus
QPLPNDE

SEQ ID NO: 1977101 - protein, 6 aa, Staphylococcus
QPLSDE

SEQ ID NO: 1977102 - protein, 15 aa, Staphylococcus
QPLSDTARKHSDDMA

SEQ ID NO: 1977103 - protein, 12 aa, Staphylococcus
QPLSTLSGGEIQ

SEQ ID NO: 1977104 - protein, 6 aa, Staphylococcus
QPMHAP

SEQ ID NO: 1977105 - protein, 11 aa, Staphylococcus
QPMTEETEADY

SEQ ID NO: 1977106 - protein, 4 aa, Staphylococcus
QPNA

SEQ ID NO: 1977107 - protein, 8 aa, Staphylococcus
QPNANTVE

SEQ ID NO: 1977108 - protein, 8 aa, Staphylococcus
QPNEEGHG

SEQ ID NO: 1977109 - protein, 5 aa, Staphylococcus
QPNEG

SEQ ID NO: 1977110 - protein, 8 aa, Staphylococcus
QPNGRVDP

SEQ ID NO: 1977111 - protein, 5 aa, Staphylococcus
QPNKA

SEQ ID NO: 1977112 - protein, 5 aa, Staphylococcus
QPNKL

SEQ ID NO: 1977113 - protein, 9 aa, Staphylococcus
QPNPDNNNT

SEQ ID NO: 1977114 - protein, 9 aa, Staphylococcus
QPNQLKSKL

SEQ ID NO: 1977115 - protein, 8 aa, Staphylococcus
QPNSTNYH

SEQ ID NO: 1977116 - protein, 7 aa, Staphylococcus
QPNTKSN

SEQ ID NO: 1977117 - protein, 8 aa, Staphylococcus
QPNWENEI

SEQ ID NO: 1977118 - protein, 5 aa, Staphylococcus
QPNYG

SEQ ID NO: 1977119 - protein, 5 aa, Staphylococcus
QPNYI

SEQ ID NO: 1977120 - protein, 5 aa, Staphylococcus
QPPEA

SEQ ID NO: 1977121 - protein, 6 aa, Staphylococcus
QPPEAF

SEQ ID NO: 1977122 - protein, 5 aa, Staphylococcus
QPPED

SEQ ID NO: 1977123 - protein, 5 aa, Staphylococcus
QPPEN

SEQ ID NO: 1977124 - protein, 7 aa, Staphylococcus
QPPETYP

SEQ ID NO: 1977125 - protein, 7 aa, Staphylococcus
QPPGKNL

SEQ ID NO: 1977126 - protein, 16 aa, Staphylococcus
QPPKEGKTRKTPAEVE

SEQ ID NO: 1977127 - protein, 5 aa, Staphylococcus
QPPLK

SEQ ID NO: 1977128 - protein, 6 aa, Staphylococcus
QPPNAF

SEQ ID NO: 1977129 - protein, 7 aa, Staphylococcus
QPPSAKQ

SEQ ID NO: 1977130 - protein, 18 aa, Staphylococcus
QPPSLKEAKKRGKEDVQY

SEQ ID NO: 1977131 - protein, 18 aa, Staphylococcus
QPPSLKEAKKRGKQEVQY

SEQ ID NO: 1977132 - protein, 18 aa, Staphylococcus
QPPSLKEAKKRGKQQVQY

SEQ ID NO: 1977133 - protein, 19 aa, Staphylococcus
QPPSLKEARKRGKEEVNYN

SEQ ID NO: 1977134 - protein, 18 aa, Staphylococcus
QPPSLKEARKRGKQDINY

SEQ ID NO: 1977135 - protein, 8 aa, Staphylococcus
QPPSPSQF

SEQ ID NO: 1977136 - protein, 7 aa, Staphylococcus
QPPTPKQ

SEQ ID NO: 1977137 - protein, 6 aa, Staphylococcus
QPPYTA

SEQ ID NO: 1977138 - protein, 4 aa, Staphylococcus
QPQD

SEQ ID NO: 1977139 - protein, 12 aa, Staphylococcus
QPQHDSPANRVS

SEQ ID NO: 1977140 - protein, 13 aa, Staphylococcus
QPQHESPANKISS

SEQ ID NO: 1977141 - protein, 5 aa, Staphylococcus
QPQHK

SEQ ID NO: 1977142 - protein, 5 aa, Staphylococcus
QPQNF

SEQ ID NO: 1977143 - protein, 13 aa, Staphylococcus
QPQQAIQLINQLF

SEQ ID NO: 1977144 - protein, 25 aa, Staphylococcus
QPQRQEESSADLTKIETPNVKTAQE

SEQ ID NO: 1977145 - protein, 8 aa, Staphylococcus
QPQSFGRA

SEQ ID NO: 1977146 - protein, 9 aa, Staphylococcus
QPQSFGRAT

SEQ ID NO: 1977147 - protein, 13 aa, Staphylococcus
QPQYDTGTTNDPF

SEQ ID NO: 1977148 - protein, 6 aa, Staphylococcus
QPQYRG

SEQ ID NO: 1977149 - protein, 8 aa, Staphylococcus
QPRKTNDH

SEQ ID NO: 1977150 - protein, 4 aa, Staphylococcus
QPRY

SEQ ID NO: 1977151 - protein, 10 aa, Staphylococcus
QPSAKFPPSL

SEQ ID NO: 1977152 - protein, 7 aa, Staphylococcus
QPSDCKN

SEQ ID NO: 1977153 - protein, 7 aa, Staphylococcus
QPSDDDY

SEQ ID NO: 1977154 - protein, 13 aa, Staphylococcus
QPSHDSPANKIST

SEQ ID NO: 1977155 - protein, 12 aa, Staphylococcus
QPSHDSPANKVA

SEQ ID NO: 1977156 - protein, 17 aa, Staphylococcus
QPSKGEFKGKVEGEVKT

SEQ ID NO: 1977157 - protein, 8 aa, Staphylococcus
QPSKHDRR

SEQ ID NO: 1977158 - protein, 14 aa, Staphylococcus
QPSLTLEEQADQVA

SEQ ID NO: 1977159 - protein, 4 aa, Staphylococcus
QPSQ

SEQ ID NO: 1977160 - protein, 13 aa, Staphylococcus
QPSRTLNQQGQPY

SEQ ID NO: 1977161 - protein, 5 aa, Staphylococcus
QPSTS

SEQ ID NO: 1977162 - protein, 18 aa, Staphylococcus
QPSVAAKKIKSAVTDSDG

SEQ ID NO: 1977163 - protein, 4 aa, Staphylococcus
QPSW

SEQ ID NO: 1977164 - protein, 5 aa, Staphylococcus
QPSYP

SEQ ID NO: 1977165 - protein, 4 aa, Staphylococcus
QPTA

SEQ ID NO: 1977166 - protein, 7 aa, Staphylococcus
QPTANTV

SEQ ID NO: 1977167 - protein, 5 aa, Staphylococcus
QPTDD

SEQ ID NO: 1977168 - protein, 12 aa, Staphylococcus
QPTEDDYQSYDK

SEQ ID NO: 1977169 - protein, 5 aa, Staphylococcus
QPTFA

SEQ ID NO: 1977170 - protein, 15 aa, Staphylococcus
QPTIQDTEKTHDTED

SEQ ID NO: 1977171 - protein, 8 aa, Staphylococcus
QPTKDEFP

SEQ ID NO: 1977172 - protein, 4 aa, Staphylococcus
QPTL

SEQ ID NO: 1977173 - protein, 7 aa, Staphylococcus
QPTNIEE

SEQ ID NO: 1977174 - protein, 8 aa, Staphylococcus
QPTPNTVD

SEQ ID NO: 1977175 - protein, 5 aa, Staphylococcus
QPTRE

SEQ ID NO: 1977176 - protein, 19 aa, Staphylococcus
QPTVTPQMKAEDYQQNSDE

SEQ ID NO: 1977177 - protein, 158 aa, Staphylococcus
QPVAPNSNQEDAATKASSLNEPDLESTKDNQTAKQNNTKTVTADNQSKEQSHIETPSTDSDNQSTKAEEQGTTSNVSINADDSITKHSDSESKSTSKTTSEDKSKQLDEDIANSSETSTQSTSEQQSQTANSASSQSSSVKQPAPKEEKKGFFARLFN

SEQ ID NO: 1977178 - protein, 5 aa, Staphylococcus
QPVGA

SEQ ID NO: 1977179 - protein, 7 aa, Staphylococcus
QPVGPSY

SEQ ID NO: 1977180 - protein, 5 aa, Staphylococcus
QPVPL

SEQ ID NO: 1977181 - protein, 5 aa, Staphylococcus
QPVQK

SEQ ID NO: 1977182 - protein, 10 aa, Staphylococcus
QPVQPPTDDL

SEQ ID NO: 1977183 - protein, 10 aa, Staphylococcus
QPVSLEEQGQ

SEQ ID NO: 1977184 - protein, 5 aa, Staphylococcus
QPVTE

SEQ ID NO: 1977185 - protein, 6 aa, Staphylococcus
QPVTRS

SEQ ID NO: 1977186 - protein, 5 aa, Staphylococcus
QPYYP

SEQ ID NO: 1977187 - protein, 7 aa, Staphylococcus
QQAEDVR

SEQ ID NO: 1977188 - protein, 11 aa, Staphylococcus
QQAEEKGNPIY

SEQ ID NO: 1977189 - protein, 5 aa, Staphylococcus
QQAIR

SEQ ID NO: 1977190 - protein, 8 aa, Staphylococcus
QQAKAKTV

SEQ ID NO: 1977191 - protein, 4 aa, Staphylococcus
QQAL

SEQ ID NO: 1977192 - protein, 5 aa, Staphylococcus
QQALN

SEQ ID NO: 1977193 - protein, 6 aa, Staphylococcus
QQAPEG

SEQ ID NO: 1977194 - protein, 14 aa, Staphylococcus
QQAPRTVIPTGEGA

SEQ ID NO: 1977195 - protein, 6 aa, Staphylococcus
QQAPSI

SEQ ID NO: 1977196 - protein, 5 aa, Staphylococcus
QQAPY

SEQ ID NO: 1977197 - protein, 7 aa, Staphylococcus
QQAQAAG

SEQ ID NO: 1977198 - protein, 5 aa, Staphylococcus
QQAQP

SEQ ID NO: 1977199 - protein, 33 aa, Staphylococcus
QQAQQGDAAGSNQSDVEDAEYTEVKDDDDKKDN

SEQ ID NO: 1977200 - protein, 6 aa, Staphylococcus
QQAQQM

SEQ ID NO: 1977201 - protein, 6 aa, Staphylococcus
QQASPI

SEQ ID NO: 1977202 - protein, 16 aa, Staphylococcus
QQASSISKAEFIRSLA

SEQ ID NO: 1977203 - protein, 8 aa, Staphylococcus
QQASTDQR

SEQ ID NO: 1977204 - protein, 5 aa, Staphylococcus
QQASY

SEQ ID NO: 1977205 - protein, 10 aa, Staphylococcus
QQATEKVTTQ

SEQ ID NO: 1977206 - protein, 11 aa, Staphylococcus
QQATRKAKSLH

SEQ ID NO: 1977207 - protein, 11 aa, Staphylococcus
QQATRKSKKLY

SEQ ID NO: 1977208 - protein, 5 aa, Staphylococcus
QQCYA

SEQ ID NO: 1977209 - protein, 8 aa, Staphylococcus
QQDAKKLN

SEQ ID NO: 1977210 - protein, 9 aa, Staphylococcus
QQDAPASDF

SEQ ID NO: 1977211 - protein, 10 aa, Staphylococcus
QQDDLDSSIT

SEQ ID NO: 1977212 - protein, 8 aa, Staphylococcus
QQDDLESS

SEQ ID NO: 1977213 - protein, 9 aa, Staphylococcus
QQDDLQSSI

SEQ ID NO: 1977214 - protein, 5 aa, Staphylococcus
QQDDN

SEQ ID NO: 1977215 - protein, 6 aa, Staphylococcus
QQDEDV

SEQ ID NO: 1977216 - protein, 7 aa, Staphylococcus
QQDESVE

SEQ ID NO: 1977217 - protein, 8 aa, Staphylococcus
QQDGAPAY

SEQ ID NO: 1977218 - protein, 5 aa, Staphylococcus
QQDGK

SEQ ID NO: 1977219 - protein, 6 aa, Staphylococcus
QQDGPA

SEQ ID NO: 1977220 - protein, 15 aa, Staphylococcus
QQDKDELIDNSKRIE

SEQ ID NO: 1977221 - protein, 7 aa, Staphylococcus
QQDKEKI

SEQ ID NO: 1977222 - protein, 8 aa, Staphylococcus
QQDKPTTL

SEQ ID NO: 1977223 - protein, 12 aa, Staphylococcus
QQDLDSLKTKIR

SEQ ID NO: 1977224 - protein, 13 aa, Staphylococcus
QQDLDSLQQDILN

SEQ ID NO: 1977225 - protein, 6 aa, Staphylococcus
QQDLKD

SEQ ID NO: 1977226 - protein, 6 aa, Staphylococcus
QQDLKV

SEQ ID NO: 1977227 - protein, 6 aa, Staphylococcus
QQDLNQ

SEQ ID NO: 1977228 - protein, 15 aa, Staphylococcus
QQDNCATCGTAANYP

SEQ ID NO: 1977229 - protein, 5 aa, Staphylococcus
QQDNT

SEQ ID NO: 1977230 - protein, 7 aa, Staphylococcus
QQDSIQS

SEQ ID NO: 1977231 - protein, 5 aa, Staphylococcus
QQDVD

SEQ ID NO: 1977232 - protein, 5 aa, Staphylococcus
QQDYH

SEQ ID NO: 1977233 - protein, 10 aa, Staphylococcus
QQDYNKAANY

SEQ ID NO: 1977234 - protein, 5 aa, Staphylococcus
QQEAC

SEQ ID NO: 1977235 - protein, 5 aa, Staphylococcus
QQEAY

SEQ ID NO: 1977236 - protein, 36 aa, Staphylococcus
QQEDEQSAREATEKLEKMKAEKAKQQDNNESSVDKC

SEQ ID NO: 1977237 - protein, 11 aa, Staphylococcus
QQEDEVQSLQK

SEQ ID NO: 1977238 - protein, 9 aa, Staphylococcus
QQEEISEDA

SEQ ID NO: 1977239 - protein, 4 aa, Staphylococcus
QQEF

SEQ ID NO: 1977240 - protein, 9 aa, Staphylococcus
QQEKGDENF

SEQ ID NO: 1977241 - protein, 5 aa, Staphylococcus
QQEKI

SEQ ID NO: 1977242 - protein, 5 aa, Staphylococcus
QQEKK

SEQ ID NO: 1977243 - protein, 5 aa, Staphylococcus
QQEKN

SEQ ID NO: 1977244 - protein, 4 aa, Staphylococcus
QQEL

SEQ ID NO: 1977245 - protein, 7 aa, Staphylococcus
QQELDER

SEQ ID NO: 1977246 - protein, 5 aa, Staphylococcus
QQELQ

SEQ ID NO: 1977247 - protein, 6 aa, Staphylococcus
QQEPNA

SEQ ID NO: 1977248 - protein, 14 aa, Staphylococcus
QQEQPERGKIYDRN

SEQ ID NO: 1977249 - protein, 12 aa, Staphylococcus
QQERQLKAQYGA

SEQ ID NO: 1977250 - protein, 7 aa, Staphylococcus
QQESGGI

SEQ ID NO: 1977251 - protein, 7 aa, Staphylococcus
QQESNNL

SEQ ID NO: 1977252 - protein, 12 aa, Staphylococcus
QQESTQQQIKTV

SEQ ID NO: 1977253 - protein, 14 aa, Staphylococcus
QQEVAERLSKSRPY

SEQ ID NO: 1977254 - protein, 10 aa, Staphylococcus
QQEVEGQPEQ

SEQ ID NO: 1977255 - protein, 14 aa, Staphylococcus
QQEWSNGNVGTNGV

SEQ ID NO: 1977256 - protein, 4 aa, Staphylococcus
QQFD

SEQ ID NO: 1977257 - protein, 8 aa, Staphylococcus
QQFENPAN

SEQ ID NO: 1977258 - protein, 4 aa, Staphylococcus
QQFK

SEQ ID NO: 1977259 - protein, 4 aa, Staphylococcus
QQFL

SEQ ID NO: 1977260 - protein, 8 aa, Staphylococcus
QQFPEISD

SEQ ID NO: 1977261 - protein, 6 aa, Staphylococcus
QQFQSG

SEQ ID NO: 1977262 - protein, 13 aa, Staphylococcus
QQFSSTTSYQISE

SEQ ID NO: 1977263 - protein, 6 aa, Staphylococcus
QQFTEN

SEQ ID NO: 1977264 - protein, 15 aa, Staphylococcus
QQGAEDKLKHHTDKA

SEQ ID NO: 1977265 - protein, 6 aa, Staphylococcus
QQGDAS

SEQ ID NO: 1977266 - protein, 16 aa, Staphylococcus
QQGDKSLTTQNYYTGE

SEQ ID NO: 1977267 - protein, 18 aa, Staphylococcus
QQGDSAESLGLDGKEEIS

SEQ ID NO: 1977268 - protein, 12 aa, Staphylococcus
QQGDVIESKNAS

SEQ ID NO: 1977269 - protein, 5 aa, Staphylococcus
QQGEH

SEQ ID NO: 1977270 - protein, 9 aa, Staphylococcus
QQGESVAKN

SEQ ID NO: 1977271 - protein, 15 aa, Staphylococcus
QQGHYDNEKTSKTSK

SEQ ID NO: 1977272 - protein, 13 aa, Staphylococcus
QQGIENLTDEEAA

SEQ ID NO: 1977273 - protein, 9 aa, Staphylococcus
QQGKRIGKT

SEQ ID NO: 1977274 - protein, 4 aa, Staphylococcus
QQGL

SEQ ID NO: 1977275 - protein, 11 aa, Staphylococcus
QQGLGRTGKWS

SEQ ID NO: 1977276 - protein, 10 aa, Staphylococcus
QQGLGRTGRW

SEQ ID NO: 1977277 - protein, 11 aa, Staphylococcus
QQGLGRTGSWS

SEQ ID NO: 1977278 - protein, 12 aa, Staphylococcus
QQGLGRTGSWSS

SEQ ID NO: 1977279 - protein, 4 aa, Staphylococcus
QQGM

SEQ ID NO: 1977280 - protein, 10 aa, Staphylococcus
QQGMGRTGKW

SEQ ID NO: 1977281 - protein, 18 aa, Staphylococcus
QQGRKEGVGKAKVTSAYN

SEQ ID NO: 1977282 - protein, 10 aa, Staphylococcus
QQGRTVDGYD

SEQ ID NO: 1977283 - protein, 6 aa, Staphylococcus
QQGSGS

SEQ ID NO: 1977284 - protein, 13 aa, Staphylococcus
QQGSLGASGDLAP

SEQ ID NO: 1977285 - protein, 6 aa, Staphylococcus
QQGSSH

SEQ ID NO: 1977286 - protein, 4 aa, Staphylococcus
QQGT

SEQ ID NO: 1977287 - protein, 4 aa, Staphylococcus
QQGV

SEQ ID NO: 1977288 - protein, 4 aa, Staphylococcus
QQHE

SEQ ID NO: 1977289 - protein, 8 aa, Staphylococcus
QQHEPQSL

SEQ ID NO: 1977290 - protein, 7 aa, Staphylococcus
QQHGLTP

SEQ ID NO: 1977291 - protein, 10 aa, Staphylococcus
QQHKEATHNC

SEQ ID NO: 1977292 - protein, 4 aa, Staphylococcus
QQHP

SEQ ID NO: 1977293 - protein, 5 aa, Staphylococcus
QQHPI

SEQ ID NO: 1977294 - protein, 6 aa, Staphylococcus
QQHPIS

SEQ ID NO: 1977295 - protein, 8 aa, Staphylococcus
QQHQDADV

SEQ ID NO: 1977296 - protein, 11 aa, Staphylococcus
QQHQGNKFKES

SEQ ID NO: 1977297 - protein, 7 aa, Staphylococcus
QQHRDDN

SEQ ID NO: 1977298 - protein, 45 aa, Staphylococcus
QQHTQSTSHNETSGRSSGNHFSETVKDNDDTNLNNNKTSATGITH

SEQ ID NO: 1977299 - protein, 4 aa, Staphylococcus
QQHV

SEQ ID NO: 1977300 - protein, 4 aa, Staphylococcus
QQID

SEQ ID NO: 1977301 - protein, 7 aa, Staphylococcus
QQIDEQG

SEQ ID NO: 1977302 - protein, 7 aa, Staphylococcus
QQIDGTL

SEQ ID NO: 1977303 - protein, 10 aa, Staphylococcus
QQIDSEKEVN

SEQ ID NO: 1977304 - protein, 5 aa, Staphylococcus
QQIEN

SEQ ID NO: 1977305 - protein, 6 aa, Staphylococcus
QQIEST

SEQ ID NO: 1977306 - protein, 8 aa, Staphylococcus
QQIGTPEE

SEQ ID NO: 1977307 - protein, 16 aa, Staphylococcus
QQIKSKENDRQSITDQ

SEQ ID NO: 1977308 - protein, 7 aa, Staphylococcus
QQINGEQ

SEQ ID NO: 1977309 - protein, 4 aa, Staphylococcus
QQIP

SEQ ID NO: 1977310 - protein, 5 aa, Staphylococcus
QQIPS

SEQ ID NO: 1977311 - protein, 11 aa, Staphylococcus
QQISEEQGITA

SEQ ID NO: 1977312 - protein, 8 aa, Staphylococcus
QQKAQDKL

SEQ ID NO: 1977313 - protein, 9 aa, Staphylococcus
QQKDGTWKA

SEQ ID NO: 1977314 - protein, 11 aa, Staphylococcus
QQKEDREKQAW

SEQ ID NO: 1977315 - protein, 9 aa, Staphylococcus
QQKEKDGLS

SEQ ID NO: 1977316 - protein, 6 aa, Staphylococcus
QQKESL

SEQ ID NO: 1977317 - protein, 7 aa, Staphylococcus
QQKESRM

SEQ ID NO: 1977318 - protein, 19 aa, Staphylococcus
QQKIDEATALQEKHGNELP

SEQ ID NO: 1977319 - protein, 9 aa, Staphylococcus
QQKIEQQQK

SEQ ID NO: 1977320 - protein, 18 aa, Staphylococcus
QQKKALKQAKIQNDTNLL

SEQ ID NO: 1977321 - protein, 6 aa, Staphylococcus
QQKKER

SEQ ID NO: 1977322 - protein, 8 aa, Staphylococcus
QQKLNQDY

SEQ ID NO: 1977323 - protein, 4 aa, Staphylococcus
QQKM

SEQ ID NO: 1977324 - protein, 4 aa, Staphylococcus
QQKP

SEQ ID NO: 1977325 - protein, 17 aa, Staphylococcus
QQKQHESYQKFKHIIDS

SEQ ID NO: 1977326 - protein, 4 aa, Staphylococcus
QQKS

SEQ ID NO: 1977327 - protein, 8 aa, Staphylococcus
QQKSEDQL

SEQ ID NO: 1977328 - protein, 14 aa, Staphylococcus
QQKTSAFGQSTTVT

SEQ ID NO: 1977329 - protein, 10 aa, Staphylococcus
QQKVTKKQAA

SEQ ID NO: 1977330 - protein, 7 aa, Staphylococcus
QQKYAQM

SEQ ID NO: 1977331 - protein, 6 aa, Staphylococcus
QQLDGT

SEQ ID NO: 1977332 - protein, 6 aa, Staphylococcus
QQLDQQ

SEQ ID NO: 1977333 - protein, 6 aa, Staphylococcus
QQLDYD

SEQ ID NO: 1977334 - protein, 8 aa, Staphylococcus
QQLEGEAV

SEQ ID NO: 1977335 - protein, 5 aa, Staphylococcus
QQLET

SEQ ID NO: 1977336 - protein, 14 aa, Staphylococcus
QQLETYKDKTPLTN

SEQ ID NO: 1977337 - protein, 8 aa, Staphylococcus
QQLGESSD

SEQ ID NO: 1977338 - protein, 19 aa, Staphylococcus
QQLGGEQEAKRRAGTENVP

SEQ ID NO: 1977339 - protein, 14 aa, Staphylococcus
QQLGPNEDEVELQK

SEQ ID NO: 1977340 - protein, 7 aa, Staphylococcus
QQLGTNA

SEQ ID NO: 1977341 - protein, 14 aa, Staphylococcus
QQLKAEKKNNQSHQ

SEQ ID NO: 1977342 - protein, 10 aa, Staphylococcus
QQLKETQNEH

SEQ ID NO: 1977343 - protein, 6 aa, Staphylococcus
QQLNDN

SEQ ID NO: 1977344 - protein, 5 aa, Staphylococcus
QQLNG

SEQ ID NO: 1977345 - protein, 5 aa, Staphylococcus
QQLNP

SEQ ID NO: 1977346 - protein, 13 aa, Staphylococcus
QQLNSETVTTEDL

SEQ ID NO: 1977347 - protein, 23 aa, Staphylococcus
QQLNSTADAVQEQDQQLSNNFGL

SEQ ID NO: 1977348 - protein, 13 aa, Staphylococcus
QQLRTKNKEKEKL

SEQ ID NO: 1977349 - protein, 5 aa, Staphylococcus
QQLSI

SEQ ID NO: 1977350 - protein, 13 aa, Staphylococcus
QQLTDSAKHVKNR

SEQ ID NO: 1977351 - protein, 26 aa, Staphylococcus
QQLTSGTSETQGSQIGAISKDTETML

SEQ ID NO: 1977352 - protein, 29 aa, Staphylococcus
QQLTSNGTVPSQTGSSSTNANGLTEGTEA

SEQ ID NO: 1977353 - protein, 10 aa, Staphylococcus
QQMKEDPLGD

SEQ ID NO: 1977354 - protein, 10 aa, Staphylococcus
QQMKENPLGD

SEQ ID NO: 1977355 - protein, 16 aa, Staphylococcus
QQMTQAKKRQTEQENQ

SEQ ID NO: 1977356 - protein, 5 aa, Staphylococcus
QQNAD

SEQ ID NO: 1977357 - protein, 8 aa, Staphylococcus
QQNADAHH

SEQ ID NO: 1977358 - protein, 5 aa, Staphylococcus
QQNAK

SEQ ID NO: 1977359 - protein, 9 aa, Staphylococcus
QQNDNDKDI

SEQ ID NO: 1977360 - protein, 11 aa, Staphylococcus
QQNEREIEEGL

SEQ ID NO: 1977361 - protein, 8 aa, Staphylococcus
QQNETFKR

SEQ ID NO: 1977362 - protein, 17 aa, Staphylococcus
QQNETFKRRRDTFEKQL

SEQ ID NO: 1977363 - protein, 14 aa, Staphylococcus
QQNGRQKRKEAEKE

SEQ ID NO: 1977364 - protein, 6 aa, Staphylococcus
QQNHEP

SEQ ID NO: 1977365 - protein, 5 aa, Staphylococcus
QQNIG

SEQ ID NO: 1977366 - protein, 10 aa, Staphylococcus
QQNKTYDMTQ

SEQ ID NO: 1977367 - protein, 4 aa, Staphylococcus
QQNL

SEQ ID NO: 1977368 - protein, 19 aa, Staphylococcus
QQNLPSSYIEGEKESAQII

SEQ ID NO: 1977369 - protein, 11 aa, Staphylococcus
QQNNNLNYRQT

SEQ ID NO: 1977370 - protein, 11 aa, Staphylococcus
QQNPELPRPVG

SEQ ID NO: 1977371 - protein, 9 aa, Staphylococcus
QQNPPTEME

SEQ ID NO: 1977372 - protein, 9 aa, Staphylococcus
QQNQAVSEE

SEQ ID NO: 1977373 - protein, 4 aa, Staphylococcus
QQNS

SEQ ID NO: 1977374 - protein, 6 aa, Staphylococcus
QQPASI

SEQ ID NO: 1977375 - protein, 4 aa, Staphylococcus
QQPE

SEQ ID NO: 1977376 - protein, 5 aa, Staphylococcus
QQPED

SEQ ID NO: 1977377 - protein, 13 aa, Staphylococcus
QQPEDMTGESLIN

SEQ ID NO: 1977378 - protein, 9 aa, Staphylococcus
QQPEEYKES

SEQ ID NO: 1977379 - protein, 5 aa, Staphylococcus
QQPFE

SEQ ID NO: 1977380 - protein, 6 aa, Staphylococcus
QQPGFD

SEQ ID NO: 1977381 - protein, 13 aa, Staphylococcus
QQPGYNEQDPDEW

SEQ ID NO: 1977382 - protein, 4 aa, Staphylococcus
QQPH

SEQ ID NO: 1977383 - protein, 8 aa, Staphylococcus
QQPKLDKK

SEQ ID NO: 1977384 - protein, 9 aa, Staphylococcus
QQPKPKVGE

SEQ ID NO: 1977385 - protein, 9 aa, Staphylococcus
QQPKPKVTE

SEQ ID NO: 1977386 - protein, 11 aa, Staphylococcus
QQPLTARPGEY

SEQ ID NO: 1977387 - protein, 4 aa, Staphylococcus
QQPQ

SEQ ID NO: 1977388 - protein, 5 aa, Staphylococcus
QQPQW

SEQ ID NO: 1977389 - protein, 8 aa, Staphylococcus
QQPRPKVK

SEQ ID NO: 1977390 - protein, 10 aa, Staphylococcus
QQPSDRRDKI

SEQ ID NO: 1977391 - protein, 8 aa, Staphylococcus
QQPSTRFD

SEQ ID NO: 1977392 - protein, 6 aa, Staphylococcus
QQPTEL

SEQ ID NO: 1977393 - protein, 5 aa, Staphylococcus
QQPTT

SEQ ID NO: 1977394 - protein, 8 aa, Staphylococcus
QQPTTETF

SEQ ID NO: 1977395 - protein, 6 aa, Staphylococcus
QQPVRL

SEQ ID NO: 1977396 - protein, 5 aa, Staphylococcus
QQQAA

SEQ ID NO: 1977397 - protein, 7 aa, Staphylococcus
QQQAIEA

SEQ ID NO: 1977398 - protein, 7 aa, Staphylococcus
QQQAVDE

SEQ ID NO: 1977399 - protein, 6 aa, Staphylococcus
QQQCKK

SEQ ID NO: 1977400 - protein, 6 aa, Staphylococcus
QQQDNR

SEQ ID NO: 1977401 - protein, 17 aa, Staphylococcus
QQQDVKQIDNKTSDVQA

SEQ ID NO: 1977402 - protein, 6 aa, Staphylococcus
QQQEKR

SEQ ID NO: 1977403 - protein, 5 aa, Staphylococcus
QQQEL

SEQ ID NO: 1977404 - protein, 6 aa, Staphylococcus
QQQEQL

SEQ ID NO: 1977405 - protein, 5 aa, Staphylococcus
QQQGR

SEQ ID NO: 1977406 - protein, 5 aa, Staphylococcus
QQQGT

SEQ ID NO: 1977407 - protein, 5 aa, Staphylococcus
QQQHS

SEQ ID NO: 1977408 - protein, 9 aa, Staphylococcus
QQQKGDENF

SEQ ID NO: 1977409 - protein, 7 aa, Staphylococcus
QQQLTER

SEQ ID NO: 1977410 - protein, 23 aa, Staphylococcus
QQQNELKELQSQITEKLEANNES

SEQ ID NO: 1977411 - protein, 6 aa, Staphylococcus
QQQNIS

SEQ ID NO: 1977412 - protein, 6 aa, Staphylococcus
QQQPQR

SEQ ID NO: 1977413 - protein, 9 aa, Staphylococcus
QQQPSEDVN

SEQ ID NO: 1977414 - protein, 5 aa, Staphylococcus
QQQQE

SEQ ID NO: 1977415 - protein, 6 aa, Staphylococcus
QQQRSV

SEQ ID NO: 1977416 - protein, 6 aa, Staphylococcus
QQQTEL

SEQ ID NO: 1977417 - protein, 9 aa, Staphylococcus
QQQTMAQKR

SEQ ID NO: 1977418 - protein, 6 aa, Staphylococcus
QQQTQS

SEQ ID NO: 1977419 - protein, 15 aa, Staphylococcus
QQQTSAKDVYAGGDA

SEQ ID NO: 1977420 - protein, 7 aa, Staphylococcus
QQQTSVE

SEQ ID NO: 1977421 - protein, 5 aa, Staphylococcus
QQQTT

SEQ ID NO: 1977422 - protein, 7 aa, Staphylococcus
QQQYAQM

SEQ ID NO: 1977423 - protein, 6 aa, Staphylococcus
QQQYET

SEQ ID NO: 1977424 - protein, 4 aa, Staphylococcus
QQRD

SEQ ID NO: 1977425 - protein, 6 aa, Staphylococcus
QQRDPE

SEQ ID NO: 1977426 - protein, 10 aa, Staphylococcus
QQRDTKEEAV

SEQ ID NO: 1977427 - protein, 6 aa, Staphylococcus
QQRDVP

SEQ ID NO: 1977428 - protein, 9 aa, Staphylococcus
QQREKAEKY

SEQ ID NO: 1977429 - protein, 5 aa, Staphylococcus
QQREM

SEQ ID NO: 1977430 - protein, 9 aa, Staphylococcus
QQRENNKSF

SEQ ID NO: 1977431 - protein, 17 aa, Staphylococcus
QQREQDIANGKYDKYKN

SEQ ID NO: 1977432 - protein, 5 aa, Staphylococcus
QQRES

SEQ ID NO: 1977433 - protein, 9 aa, Staphylococcus
QQRGRQMEI

SEQ ID NO: 1977434 - protein, 17 aa, Staphylococcus
QQRKKKLTSVDKENVLA

SEQ ID NO: 1977435 - protein, 10 aa, Staphylococcus
QQRQESKSVS

SEQ ID NO: 1977436 - protein, 8 aa, Staphylococcus
QQRSDRDK

SEQ ID NO: 1977437 - protein, 5 aa, Staphylococcus
QQRTR

SEQ ID NO: 1977438 - protein, 12 aa, Staphylococcus
QQSAEEQDEGFD

SEQ ID NO: 1977439 - protein, 10 aa, Staphylococcus
QQSDDYKESV

SEQ ID NO: 1977440 - protein, 10 aa, Staphylococcus
QQSDEYKESV

SEQ ID NO: 1977441 - protein, 15 aa, Staphylococcus
QQSEDYKESVIPSNI

SEQ ID NO: 1977442 - protein, 8 aa, Staphylococcus
QQSEEDRR

SEQ ID NO: 1977443 - protein, 7 aa, Staphylococcus
QQSEEEE

SEQ ID NO: 1977444 - protein, 14 aa, Staphylococcus
QQSEEKNAEDIHDD

SEQ ID NO: 1977445 - protein, 6 aa, Staphylococcus
QQSEKL

SEQ ID NO: 1977446 - protein, 7 aa, Staphylococcus
QQSHEDL

SEQ ID NO: 1977447 - protein, 4 aa, Staphylococcus
QQSI

SEQ ID NO: 1977448 - protein, 9 aa, Staphylococcus
QQSIDDVSS

SEQ ID NO: 1977449 - protein, 13 aa, Staphylococcus
QQSIGTASLNNGK

SEQ ID NO: 1977450 - protein, 9 aa, Staphylococcus
QQSKEYKDE

SEQ ID NO: 1977451 - protein, 5 aa, Staphylococcus
QQSKL

SEQ ID NO: 1977452 - protein, 9 aa, Staphylococcus
QQSKLQDDD

SEQ ID NO: 1977453 - protein, 10 aa, Staphylococcus
QQSKSITNSD

SEQ ID NO: 1977454 - protein, 21 aa, Staphylococcus
QQSNIATATVGEGSSNQGDFH

SEQ ID NO: 1977455 - protein, 9 aa, Staphylococcus
QQSNKENGE

SEQ ID NO: 1977456 - protein, 5 aa, Staphylococcus
QQSPI

SEQ ID NO: 1977457 - protein, 7 aa, Staphylococcus
QQSQLQD

SEQ ID NO: 1977458 - protein, 7 aa, Staphylococcus
QQSQLSD

SEQ ID NO: 1977459 - protein, 6 aa, Staphylococcus
QQSQSK

SEQ ID NO: 1977460 - protein, 15 aa, Staphylococcus
QQSSFNQVDADPSIR

SEQ ID NO: 1977461 - protein, 5 aa, Staphylococcus
QQSSG

SEQ ID NO: 1977462 - protein, 8 aa, Staphylococcus
QQSSGTIE

SEQ ID NO: 1977463 - protein, 13 aa, Staphylococcus
QQSSIPESQKETT

SEQ ID NO: 1977464 - protein, 4 aa, Staphylococcus
QQSY

SEQ ID NO: 1977465 - protein, 6 aa, Staphylococcus
QQTAVN

SEQ ID NO: 1977466 - protein, 17 aa, Staphylococcus
QQTDKHYKSTTKKNQTV

SEQ ID NO: 1977467 - protein, 7 aa, Staphylococcus
QQTDRPI

SEQ ID NO: 1977468 - protein, 5 aa, Staphylococcus
QQTDY

SEQ ID NO: 1977469 - protein, 7 aa, Staphylococcus
QQTEARE

SEQ ID NO: 1977470 - protein, 7 aa, Staphylococcus
QQTEDKH

SEQ ID NO: 1977471 - protein, 6 aa, Staphylococcus
QQTEEG

SEQ ID NO: 1977472 - protein, 6 aa, Staphylococcus
QQTEEQ

SEQ ID NO: 1977473 - protein, 7 aa, Staphylococcus
QQTEYEQ

SEQ ID NO: 1977474 - protein, 4 aa, Staphylococcus
QQTF

SEQ ID NO: 1977475 - protein, 6 aa, Staphylococcus
QQTFGD

SEQ ID NO: 1977476 - protein, 5 aa, Staphylococcus
QQTGG

SEQ ID NO: 1977477 - protein, 5 aa, Staphylococcus
QQTGL

SEQ ID NO: 1977478 - protein, 12 aa, Staphylococcus
QQTGNSEAKAYR

SEQ ID NO: 1977479 - protein, 4 aa, Staphylococcus
QQTH

SEQ ID NO: 1977480 - protein, 12 aa, Staphylococcus
QQTIDEMKSGSE

SEQ ID NO: 1977481 - protein, 5 aa, Staphylococcus
QQTIQ

SEQ ID NO: 1977482 - protein, 16 aa, Staphylococcus
QQTIRSSGFYKNKGKA

SEQ ID NO: 1977483 - protein, 7 aa, Staphylococcus
QQTISKH

SEQ ID NO: 1977484 - protein, 4 aa, Staphylococcus
QQTK

SEQ ID NO: 1977485 - protein, 9 aa, Staphylococcus
QQTKYDGTP

SEQ ID NO: 1977486 - protein, 4 aa, Staphylococcus
QQTN

SEQ ID NO: 1977487 - protein, 5 aa, Staphylococcus
QQTNG

SEQ ID NO: 1977488 - protein, 5 aa, Staphylococcus
QQTNL

SEQ ID NO: 1977489 - protein, 9 aa, Staphylococcus
QQTNPTIAP

SEQ ID NO: 1977490 - protein, 14 aa, Staphylococcus
QQTNPTIAPLAGSH

SEQ ID NO: 1977491 - protein, 10 aa, Staphylococcus
QQTQLHSNSN

SEQ ID NO: 1977492 - protein, 5 aa, Staphylococcus
QQTRD

SEQ ID NO: 1977493 - protein, 8 aa, Staphylococcus
QQTRYSQQ

SEQ ID NO: 1977494 - protein, 14 aa, Staphylococcus
QQTSAKDVYAGGDA

SEQ ID NO: 1977495 - protein, 4 aa, Staphylococcus
QQTT

SEQ ID NO: 1977496 - protein, 4 aa, Staphylococcus
QQTY

SEQ ID NO: 1977497 - protein, 8 aa, Staphylococcus
QQTYDALT

SEQ ID NO: 1977498 - protein, 5 aa, Staphylococcus
QQTYE

SEQ ID NO: 1977499 - protein, 7 aa, Staphylococcus
QQVAPTI

SEQ ID NO: 1977500 - protein, 17 aa, Staphylococcus
QQVDEYRNESEKNFEVT

SEQ ID NO: 1977501 - protein, 12 aa, Staphylococcus
QQVDSPDQFKSN

SEQ ID NO: 1977502 - protein, 6 aa, Staphylococcus
QQVGAN

SEQ ID NO: 1977503 - protein, 8 aa, Staphylococcus
QQVKPKKA

SEQ ID NO: 1977504 - protein, 55 aa, Staphylococcus
QQVLDETNKDLEAQEAEKAKLEAKSEARPNDKKTANKLNDIKNKISKTTELKEDL

SEQ ID NO: 1977505 - protein, 7 aa, Staphylococcus
QQVNGDD

SEQ ID NO: 1977506 - protein, 6 aa, Staphylococcus
QQVQPF

SEQ ID NO: 1977507 - protein, 6 aa, Staphylococcus
QQVSQS

SEQ ID NO: 1977508 - protein, 4 aa, Staphylococcus
QQVT

SEQ ID NO: 1977509 - protein, 11 aa, Staphylococcus
QQVTKDVNDAI

SEQ ID NO: 1977510 - protein, 8 aa, Staphylococcus
QQWPNDKA

SEQ ID NO: 1977511 - protein, 7 aa, Staphylococcus
QQYEGQT

SEQ ID NO: 1977512 - protein, 4 aa, Staphylococcus
QQYH

SEQ ID NO: 1977513 - protein, 20 aa, Staphylococcus
QQYMSKPAEAENDADSKKRF

SEQ ID NO: 1977514 - protein, 5 aa, Staphylococcus
QQYPG

SEQ ID NO: 1977515 - protein, 6 aa, Staphylococcus
QQYPQY

SEQ ID NO: 1977516 - protein, 9 aa, Staphylococcus
QQYQQGVTS

SEQ ID NO: 1977517 - protein, 6 aa, Staphylococcus
QQYRES

SEQ ID NO: 1977518 - protein, 6 aa, Staphylococcus
QQYRPT

SEQ ID NO: 1977519 - protein, 6 aa, Staphylococcus
QQYSKK

SEQ ID NO: 1977520 - protein, 5 aa, Staphylococcus
QQYTL

SEQ ID NO: 1977521 - protein, 7 aa, Staphylococcus
QQYTSAR

SEQ ID NO: 1977522 - protein, 5 aa, Staphylococcus
QQYVE

SEQ ID NO: 1977523 - protein, 12 aa, Staphylococcus
QRAAPAEGDGEI

SEQ ID NO: 1977524 - protein, 4 aa, Staphylococcus
QRAE

SEQ ID NO: 1977525 - protein, 14 aa, Staphylococcus
QRAENNQKIYKKDN

SEQ ID NO: 1977526 - protein, 5 aa, Staphylococcus
QRAEQ

SEQ ID NO: 1977527 - protein, 17 aa, Staphylococcus
QRAGGKRKDTAINIENG

SEQ ID NO: 1977528 - protein, 8 aa, Staphylococcus
QRAKKRNI

SEQ ID NO: 1977529 - protein, 22 aa, Staphylococcus
QRAQQKQAHKSKRKPSQQRSSL

SEQ ID NO: 1977530 - protein, 23 aa, Staphylococcus
QRAQQQKHSHKSEQKQTKQRPNI

SEQ ID NO: 1977531 - protein, 8 aa, Staphylococcus
QRASTTAL

SEQ ID NO: 1977532 - protein, 4 aa, Staphylococcus
QRAT

SEQ ID NO: 1977533 - protein, 5 aa, Staphylococcus
QRATL

SEQ ID NO: 1977534 - protein, 7 aa, Staphylococcus
QRDGERP

SEQ ID NO: 1977535 - protein, 11 aa, Staphylococcus
QRDGKSLPDYE

SEQ ID NO: 1977536 - protein, 19 aa, Staphylococcus
QRDGTPAAKMKDNVPEDVK

SEQ ID NO: 1977537 - protein, 16 aa, Staphylococcus
QRDGTPAAKMKDNVPL

SEQ ID NO: 1977538 - protein, 25 aa, Staphylococcus
QRDGTPAAKMKDNVPTEVKKDRLQR

SEQ ID NO: 1977539 - protein, 16 aa, Staphylococcus
QRDGTPAAKMNDNVPL

SEQ ID NO: 1977540 - protein, 25 aa, Staphylococcus
QRDGTPAARMKDNVEKEVKKDRLQR

SEQ ID NO: 1977541 - protein, 10 aa, Staphylococcus
QRDLKQQHGI

SEQ ID NO: 1977542 - protein, 6 aa, Staphylococcus
QRDNHS

SEQ ID NO: 1977543 - protein, 9 aa, Staphylococcus
QRDTLNQRK

SEQ ID NO: 1977544 - protein, 10 aa, Staphylococcus
QRDVEAAENN

SEQ ID NO: 1977545 - protein, 15 aa, Staphylococcus
QREFGGGKGANQAIA

SEQ ID NO: 1977546 - protein, 15 aa, Staphylococcus
QREKLKSALDKHKDI

SEQ ID NO: 1977547 - protein, 4 aa, Staphylococcus
QREL

SEQ ID NO: 1977548 - protein, 18 aa, Staphylococcus
QRELEEEVGLSDSKSQNL

SEQ ID NO: 1977549 - protein, 18 aa, Staphylococcus
QRELEEEVGLSSDKSQNM

SEQ ID NO: 1977550 - protein, 5 aa, Staphylococcus
QRELN

SEQ ID NO: 1977551 - protein, 18 aa, Staphylococcus
QRELNEEVGLSEDRSQNI

SEQ ID NO: 1977552 - protein, 7 aa, Staphylococcus
QRELPWR

SEQ ID NO: 1977553 - protein, 5 aa, Staphylococcus
QRELT

SEQ ID NO: 1977554 - protein, 6 aa, Staphylococcus
QREMPW

SEQ ID NO: 1977555 - protein, 11 aa, Staphylococcus
QRENEQSKELE

SEQ ID NO: 1977556 - protein, 5 aa, Staphylococcus
QRENM

SEQ ID NO: 1977557 - protein, 5 aa, Staphylococcus
QREPD

SEQ ID NO: 1977558 - protein, 5 aa, Staphylococcus
QREPE

SEQ ID NO: 1977559 - protein, 21 aa, Staphylococcus
QREQAESFGVDPDKAEDSTMH

SEQ ID NO: 1977560 - protein, 11 aa, Staphylococcus
QRERSDNSVKR

SEQ ID NO: 1977561 - protein, 6 aa, Staphylococcus
QRESQI

SEQ ID NO: 1977562 - protein, 4 aa, Staphylococcus
QRET

SEQ ID NO: 1977563 - protein, 14 aa, Staphylococcus
QRETRRGKKLEHND

SEQ ID NO: 1977564 - protein, 6 aa, Staphylococcus
QRETTF

SEQ ID NO: 1977565 - protein, 7 aa, Staphylococcus
QRETTYP

SEQ ID NO: 1977566 - protein, 8 aa, Staphylococcus
QREYREKE

SEQ ID NO: 1977567 - protein, 5 aa, Staphylococcus
QRFES

SEQ ID NO: 1977568 - protein, 17 aa, Staphylococcus
QRGGPSTGLPTKEEQSD

SEQ ID NO: 1977569 - protein, 16 aa, Staphylococcus
QRGGPSTGLPTKQEQA

SEQ ID NO: 1977570 - protein, 6 aa, Staphylococcus
QRGGPW

SEQ ID NO: 1977571 - protein, 12 aa, Staphylococcus
QRGGSPSGTDRV

SEQ ID NO: 1977572 - protein, 10 aa, Staphylococcus
QRGGSPSGVD

SEQ ID NO: 1977573 - protein, 5 aa, Staphylococcus
QRGGT

SEQ ID NO: 1977574 - protein, 10 aa, Staphylococcus
QRGHGRSEGK

SEQ ID NO: 1977575 - protein, 20 aa, Staphylococcus
QRGHGRSEGKQTFYSNSDEI

SEQ ID NO: 1977576 - protein, 14 aa, Staphylococcus
QRGHGRSEGQPVYY

SEQ ID NO: 1977577 - protein, 10 aa, Staphylococcus
QRGKVDKAYG

SEQ ID NO: 1977578 - protein, 4 aa, Staphylococcus
QRGN

SEQ ID NO: 1977579 - protein, 5 aa, Staphylococcus
QRGQQ

SEQ ID NO: 1977580 - protein, 8 aa, Staphylococcus
QRGRDMEM

SEQ ID NO: 1977581 - protein, 8 aa, Staphylococcus
QRGSKTLP

SEQ ID NO: 1977582 - protein, 6 aa, Staphylococcus
QRGSLK

SEQ ID NO: 1977583 - protein, 7 aa, Staphylococcus
QRGYNQK

SEQ ID NO: 1977584 - protein, 6 aa, Staphylococcus
QRHDAE

SEQ ID NO: 1977585 - protein, 4 aa, Staphylococcus
QRHE

SEQ ID NO: 1977586 - protein, 8 aa, Staphylococcus
QRHGFEND

SEQ ID NO: 1977587 - protein, 8 aa, Staphylococcus
QRHKDATH

SEQ ID NO: 1977588 - protein, 12 aa, Staphylococcus
QRHQGNKFKESY

SEQ ID NO: 1977589 - protein, 12 aa, Staphylococcus
QRHQGNKFKETY

SEQ ID NO: 1977590 - protein, 4 aa, Staphylococcus
QRID

SEQ ID NO: 1977591 - protein, 5 aa, Staphylococcus
QRIEQ

SEQ ID NO: 1977592 - protein, 6 aa, Staphylococcus
QRINPG

SEQ ID NO: 1977593 - protein, 6 aa, Staphylococcus
QRINSN

SEQ ID NO: 1977594 - protein, 5 aa, Staphylococcus
QRIPE

SEQ ID NO: 1977595 - protein, 9 aa, Staphylococcus
QRIPVTPGA

SEQ ID NO: 1977596 - protein, 4 aa, Staphylococcus
QRIQ

SEQ ID NO: 1977597 - protein, 5 aa, Staphylococcus
QRITE

SEQ ID NO: 1977598 - protein, 7 aa, Staphylococcus
QRKDGKW

SEQ ID NO: 1977599 - protein, 9 aa, Staphylococcus
QRKDNEVKR

SEQ ID NO: 1977600 - protein, 8 aa, Staphylococcus
QRKEKMAE

SEQ ID NO: 1977601 - protein, 8 aa, Staphylococcus
QRKGIGQT

SEQ ID NO: 1977602 - protein, 5 aa, Staphylococcus
QRKGL

SEQ ID NO: 1977603 - protein, 8 aa, Staphylococcus
QRKGSTVS

SEQ ID NO: 1977604 - protein, 12 aa, Staphylococcus
QRKKQDINANEL

SEQ ID NO: 1977605 - protein, 8 aa, Staphylococcus
QRKKQDIQ

SEQ ID NO: 1977606 - protein, 26 aa, Staphylococcus
QRKKQQIQSETIPELQEKAHNSGNQM

SEQ ID NO: 1977607 - protein, 4 aa, Staphylococcus
QRKL

SEQ ID NO: 1977608 - protein, 8 aa, Staphylococcus
QRKNENDE

SEQ ID NO: 1977609 - protein, 8 aa, Staphylococcus
QRKNESDE

SEQ ID NO: 1977610 - protein, 11 aa, Staphylococcus
QRKNKSAYTSK

SEQ ID NO: 1977611 - protein, 13 aa, Staphylococcus
QRKNTKKKKNAQI

SEQ ID NO: 1977612 - protein, 13 aa, Staphylococcus
QRKNTKKKKQDKI

SEQ ID NO: 1977613 - protein, 5 aa, Staphylococcus
QRKRA

SEQ ID NO: 1977614 - protein, 6 aa, Staphylococcus
QRKRTY

SEQ ID NO: 1977615 - protein, 8 aa, Staphylococcus
QRKTAEKK

SEQ ID NO: 1977616 - protein, 6 aa, Staphylococcus
QRLDNQ

SEQ ID NO: 1977617 - protein, 13 aa, Staphylococcus
QRLEEGIDKQPFE

SEQ ID NO: 1977618 - protein, 7 aa, Staphylococcus
QRLEENP

SEQ ID NO: 1977619 - protein, 11 aa, Staphylococcus
QRLIDEESGEV

SEQ ID NO: 1977620 - protein, 19 aa, Staphylococcus
QRLKDARAKYNQNEISGAE

SEQ ID NO: 1977621 - protein, 7 aa, Staphylococcus
QRLNGNP

SEQ ID NO: 1977622 - protein, 4 aa, Staphylococcus
QRLP

SEQ ID NO: 1977623 - protein, 5 aa, Staphylococcus
QRLQS

SEQ ID NO: 1977624 - protein, 5 aa, Staphylococcus
QRLQT

SEQ ID NO: 1977625 - protein, 12 aa, Staphylococcus
QRLSETNNFPEF

SEQ ID NO: 1977626 - protein, 6 aa, Staphylococcus
QRLSKE

SEQ ID NO: 1977627 - protein, 10 aa, Staphylococcus
QRLSKSPAMF

SEQ ID NO: 1977628 - protein, 11 aa, Staphylococcus
QRMKKTKVDYS

SEQ ID NO: 1977629 - protein, 7 aa, Staphylococcus
QRMPQAK

SEQ ID NO: 1977630 - protein, 9 aa, Staphylococcus
QRMTQGQSD

SEQ ID NO: 1977631 - protein, 12 aa, Staphylococcus
QRNDLREAKQTL

SEQ ID NO: 1977632 - protein, 20 aa, Staphylococcus
QRNEKDKRVTNASLTDKGRS

SEQ ID NO: 1977633 - protein, 11 aa, Staphylococcus
QRNESQDRPKS

SEQ ID NO: 1977634 - protein, 9 aa, Staphylococcus
QRNGGTRKR

SEQ ID NO: 1977635 - protein, 8 aa, Staphylococcus
QRNGKKYS

SEQ ID NO: 1977636 - protein, 13 aa, Staphylococcus
QRNGQDSKDIDES

SEQ ID NO: 1977637 - protein, 10 aa, Staphylococcus
QRNGQNSDDI

SEQ ID NO: 1977638 - protein, 10 aa, Staphylococcus
QRNGQSRKRT

SEQ ID NO: 1977639 - protein, 11 aa, Staphylococcus
QRNKKEKDYSQ

SEQ ID NO: 1977640 - protein, 13 aa, Staphylococcus
QRNNPPYICAIEK

SEQ ID NO: 1977641 - protein, 14 aa, Staphylococcus
QRNNRKKKKQPQIQ

SEQ ID NO: 1977642 - protein, 22 aa, Staphylococcus
QRNQQKKAQQEQSQRQRKQANI

SEQ ID NO: 1977643 - protein, 10 aa, Staphylococcus
QRNRDESDKR

SEQ ID NO: 1977644 - protein, 7 aa, Staphylococcus
QRPDVAQ

SEQ ID NO: 1977645 - protein, 14 aa, Staphylococcus
QRPELATQTSTKKL

SEQ ID NO: 1977646 - protein, 8 aa, Staphylococcus
QRPELGNE

SEQ ID NO: 1977647 - protein, 10 aa, Staphylococcus
QRPFTAPENT

SEQ ID NO: 1977648 - protein, 6 aa, Staphylococcus
QRPGAL

SEQ ID NO: 1977649 - protein, 5 aa, Staphylococcus
QRPHY

SEQ ID NO: 1977650 - protein, 5 aa, Staphylococcus
QRPSI

SEQ ID NO: 1977651 - protein, 5 aa, Staphylococcus
QRPST

SEQ ID NO: 1977652 - protein, 5 aa, Staphylococcus
QRPTT

SEQ ID NO: 1977653 - protein, 4 aa, Staphylococcus
QRPY

SEQ ID NO: 1977654 - protein, 9 aa, Staphylococcus
QRQAETVEA

SEQ ID NO: 1977655 - protein, 5 aa, Staphylococcus
QRQDQ

SEQ ID NO: 1977656 - protein, 4 aa, Staphylococcus
QRQE

SEQ ID NO: 1977657 - protein, 15 aa, Staphylococcus
QRQEIESLCNAISKI

SEQ ID NO: 1977658 - protein, 5 aa, Staphylococcus
QRQGI

SEQ ID NO: 1977659 - protein, 10 aa, Staphylococcus
QRQLSRNEAL

SEQ ID NO: 1977660 - protein, 9 aa, Staphylococcus
QRQLTRNEA

SEQ ID NO: 1977661 - protein, 4 aa, Staphylococcus
QRQN

SEQ ID NO: 1977662 - protein, 6 aa, Staphylococcus
QRQNGD

SEQ ID NO: 1977663 - protein, 9 aa, Staphylococcus
QRQNQLEGE

SEQ ID NO: 1977664 - protein, 5 aa, Staphylococcus
QRQPY

SEQ ID NO: 1977665 - protein, 23 aa, Staphylococcus
QRQQQKDNKQNQDQNERNRQNTR

SEQ ID NO: 1977666 - protein, 22 aa, Staphylococcus
QRQQQKKAEQQANNQRTHKRAN

SEQ ID NO: 1977667 - protein, 9 aa, Staphylococcus
QRQRPLGGE

SEQ ID NO: 1977668 - protein, 6 aa, Staphylococcus
QRQSRL

SEQ ID NO: 1977669 - protein, 22 aa, Staphylococcus
QRQTAKKYPRKPGTPNKSPLLE

SEQ ID NO: 1977670 - protein, 6 aa, Staphylococcus
QRQYPG

SEQ ID NO: 1977671 - protein, 5 aa, Staphylococcus
QRRAS

SEQ ID NO: 1977672 - protein, 11 aa, Staphylococcus
QRRDDLEKKLT

SEQ ID NO: 1977673 - protein, 5 aa, Staphylococcus
QRRDQ

SEQ ID NO: 1977674 - protein, 4 aa, Staphylococcus
QRRG

SEQ ID NO: 1977675 - protein, 13 aa, Staphylococcus
QRRGESQKAAQRL

SEQ ID NO: 1977676 - protein, 6 aa, Staphylococcus
QRRYGV

SEQ ID NO: 1977677 - protein, 8 aa, Staphylococcus
QRSAGFDT

SEQ ID NO: 1977678 - protein, 11 aa, Staphylococcus
QRSAKMAAQQG

SEQ ID NO: 1977679 - protein, 12 aa, Staphylococcus
QRSAPAEGDGEI

SEQ ID NO: 1977680 - protein, 8 aa, Staphylococcus
QRSDKPEV

SEQ ID NO: 1977681 - protein, 11 aa, Staphylococcus
QRSHSNTSGIK

SEQ ID NO: 1977682 - protein, 5 aa, Staphylococcus
QRSMP

SEQ ID NO: 1977683 - protein, 5 aa, Staphylococcus
QRSNE

SEQ ID NO: 1977684 - protein, 14 aa, Staphylococcus
QRSNGKRKDTAINI

SEQ ID NO: 1977685 - protein, 5 aa, Staphylococcus
QRSNY

SEQ ID NO: 1977686 - protein, 11 aa, Staphylococcus
QRSREDGIDIK

SEQ ID NO: 1977687 - protein, 5 aa, Staphylococcus
QRSYK

SEQ ID NO: 1977688 - protein, 12 aa, Staphylococcus
QRTDLRDAKATL

SEQ ID NO: 1977689 - protein, 12 aa, Staphylococcus
QRTDLREAKQTL

SEQ ID NO: 1977690 - protein, 12 aa, Staphylococcus
QRTDLREAKSTL

SEQ ID NO: 1977691 - protein, 8 aa, Staphylococcus
QRTDNKKI

SEQ ID NO: 1977692 - protein, 14 aa, Staphylococcus
QRTHKKQKITRSTS

SEQ ID NO: 1977693 - protein, 6 aa, Staphylococcus
QRTHTL

SEQ ID NO: 1977694 - protein, 7 aa, Staphylococcus
QRTIEPF

SEQ ID NO: 1977695 - protein, 22 aa, Staphylococcus
QRTKTDRYQRKASNNAKQSKLI

SEQ ID NO: 1977696 - protein, 4 aa, Staphylococcus
QRTM

SEQ ID NO: 1977697 - protein, 7 aa, Staphylococcus
QRTNDKR

SEQ ID NO: 1977698 - protein, 13 aa, Staphylococcus
QRTNKKQKITRST

SEQ ID NO: 1977699 - protein, 14 aa, Staphylococcus
QRTNKKQKITRSTS

SEQ ID NO: 1977700 - protein, 7 aa, Staphylococcus
QRTNKSI

SEQ ID NO: 1977701 - protein, 7 aa, Staphylococcus
QRTNQTF

SEQ ID NO: 1977702 - protein, 7 aa, Staphylococcus
QRTRQER

SEQ ID NO: 1977703 - protein, 11 aa, Staphylococcus
QRTSMDPRQTV

SEQ ID NO: 1977704 - protein, 5 aa, Staphylococcus
QRTST

SEQ ID NO: 1977705 - protein, 6 aa, Staphylococcus
QRTTSW

SEQ ID NO: 1977706 - protein, 6 aa, Staphylococcus
QRVAEY

SEQ ID NO: 1977707 - protein, 10 aa, Staphylococcus
QRVDASPYRQ

SEQ ID NO: 1977708 - protein, 7 aa, Staphylococcus
QRVGSMK

SEQ ID NO: 1977709 - protein, 6 aa, Staphylococcus
QRVQEA

SEQ ID NO: 1977710 - protein, 9 aa, Staphylococcus
QRVQEAEKL

SEQ ID NO: 1977711 - protein, 6 aa, Staphylococcus
QRWPGT

SEQ ID NO: 1977712 - protein, 11 aa, Staphylococcus
QRYGKKEAQTR

SEQ ID NO: 1977713 - protein, 11 aa, Staphylococcus
QRYRGQGIGKR

SEQ ID NO: 1977714 - protein, 12 aa, Staphylococcus
QRYYTGSRNEKV

SEQ ID NO: 1977715 - protein, 10 aa, Staphylococcus
QSADDHFPGD

SEQ ID NO: 1977716 - protein, 27 aa, Staphylococcus
QSAEKIVETAKRSGADVSGPIPLPTER

SEQ ID NO: 1977717 - protein, 5 aa, Staphylococcus
QSAEQ

SEQ ID NO: 1977718 - protein, 8 aa, Staphylococcus
QSAFQGNA

SEQ ID NO: 1977719 - protein, 4 aa, Staphylococcus
QSAG

SEQ ID NO: 1977720 - protein, 6 aa, Staphylococcus
QSAHTF

SEQ ID NO: 1977721 - protein, 9 aa, Staphylococcus
QSAIDSGYL

SEQ ID NO: 1977722 - protein, 15 aa, Staphylococcus
QSAIKAGYSANSAHV

SEQ ID NO: 1977723 - protein, 19 aa, Staphylococcus
QSAIKAGYSPHTASVQGSR

SEQ ID NO: 1977724 - protein, 11 aa, Staphylococcus
QSAKAQQAGQI

SEQ ID NO: 1977725 - protein, 9 aa, Staphylococcus
QSAKDRAEN

SEQ ID NO: 1977726 - protein, 7 aa, Staphylococcus
QSAKMDE

SEQ ID NO: 1977727 - protein, 4 aa, Staphylococcus
QSAL

SEQ ID NO: 1977728 - protein, 5 aa, Staphylococcus
QSAQD

SEQ ID NO: 1977729 - protein, 5 aa, Staphylococcus
QSAQK

SEQ ID NO: 1977730 - protein, 9 aa, Staphylococcus
QSASKAVKQ

SEQ ID NO: 1977731 - protein, 6 aa, Staphylococcus
QSASTS

SEQ ID NO: 1977732 - protein, 9 aa, Staphylococcus
QSDAPQSDF

SEQ ID NO: 1977733 - protein, 17 aa, Staphylococcus
QSDDEKIEKLKKYTEVI

SEQ ID NO: 1977734 - protein, 7 aa, Staphylococcus
QSDDSEY

SEQ ID NO: 1977735 - protein, 4 aa, Staphylococcus
QSDE

SEQ ID NO: 1977736 - protein, 7 aa, Staphylococcus
QSDEAKE

SEQ ID NO: 1977737 - protein, 13 aa, Staphylococcus
QSDEFKGEAKSGP

SEQ ID NO: 1977738 - protein, 6 aa, Staphylococcus
QSDEKT

SEQ ID NO: 1977739 - protein, 9 aa, Staphylococcus
QSDETVTDL

SEQ ID NO: 1977740 - protein, 7 aa, Staphylococcus
QSDHQYN

SEQ ID NO: 1977741 - protein, 5 aa, Staphylococcus
QSDIN

SEQ ID NO: 1977742 - protein, 5 aa, Staphylococcus
QSDIY

SEQ ID NO: 1977743 - protein, 4 aa, Staphylococcus
QSDL

SEQ ID NO: 1977744 - protein, 8 aa, Staphylococcus
QSDNQYTV

SEQ ID NO: 1977745 - protein, 8 aa, Staphylococcus
QSDTNFDK

SEQ ID NO: 1977746 - protein, 15 aa, Staphylococcus
QSDVKSKLEALSKTG

SEQ ID NO: 1977747 - protein, 7 aa, Staphylococcus
QSEADGV

SEQ ID NO: 1977748 - protein, 9 aa, Staphylococcus
QSEAKKANI

SEQ ID NO: 1977749 - protein, 11 aa, Staphylococcus
QSEAKVSYEDR

SEQ ID NO: 1977750 - protein, 4 aa, Staphylococcus
QSEC

SEQ ID NO: 1977751 - protein, 22 aa, Staphylococcus
QSEDDVDTFNQSDHMHLNMEVS

SEQ ID NO: 1977752 - protein, 8 aa, Staphylococcus
QSEDQSKL

SEQ ID NO: 1977753 - protein, 6 aa, Staphylococcus
QSEEEE

SEQ ID NO: 1977754 - protein, 9 aa, Staphylococcus
QSEGPNTKQ

SEQ ID NO: 1977755 - protein, 22 aa, Staphylococcus
QSEIGPSEVLGGSASEFSPTDL

SEQ ID NO: 1977756 - protein, 10 aa, Staphylococcus
QSEINGKTNL

SEQ ID NO: 1977757 - protein, 9 aa, Staphylococcus
QSEIPLDEE

SEQ ID NO: 1977758 - protein, 13 aa, Staphylococcus
QSEISNTERNHQA

SEQ ID NO: 1977759 - protein, 9 aa, Staphylococcus
QSEKEGPTI

SEQ ID NO: 1977760 - protein, 10 aa, Staphylococcus
QSEKQNPAAV

SEQ ID NO: 1977761 - protein, 4 aa, Staphylococcus
QSEL

SEQ ID NO: 1977762 - protein, 5 aa, Staphylococcus
QSELD

SEQ ID NO: 1977763 - protein, 10 aa, Staphylococcus
QSELKPIGEI

SEQ ID NO: 1977764 - protein, 10 aa, Staphylococcus
QSELKSIGDI

SEQ ID NO: 1977765 - protein, 7 aa, Staphylococcus
QSELTNE

SEQ ID NO: 1977766 - protein, 9 aa, Staphylococcus
QSENAISDG

SEQ ID NO: 1977767 - protein, 7 aa, Staphylococcus
QSENENE

SEQ ID NO: 1977768 - protein, 18 aa, Staphylococcus
QSENGFNDYHTRDDQYNF

SEQ ID NO: 1977769 - protein, 6 aa, Staphylococcus
QSEQRV

SEQ ID NO: 1977770 - protein, 7 aa, Staphylococcus
QSERFDQ

SEQ ID NO: 1977771 - protein, 6 aa, Staphylococcus
QSERNQ

SEQ ID NO: 1977772 - protein, 5 aa, Staphylococcus
QSESN

SEQ ID NO: 1977773 - protein, 6 aa, Staphylococcus
QSEVKD

SEQ ID NO: 1977774 - protein, 17 aa, Staphylococcus
QSEVTDIEKKQQVRQQN

SEQ ID NO: 1977775 - protein, 4 aa, Staphylococcus
QSFE

SEQ ID NO: 1977776 - protein, 16 aa, Staphylococcus
QSFEKGKNQNHLTTED

SEQ ID NO: 1977777 - protein, 4 aa, Staphylococcus
QSFN

SEQ ID NO: 1977778 - protein, 11 aa, Staphylococcus
QSFNANDSSAM

SEQ ID NO: 1977779 - protein, 11 aa, Staphylococcus
QSFPAKDDTTM

SEQ ID NO: 1977780 - protein, 11 aa, Staphylococcus
QSFPASSKSDM

SEQ ID NO: 1977781 - protein, 8 aa, Staphylococcus
QSFTASDI

SEQ ID NO: 1977782 - protein, 7 aa, Staphylococcus
QSFTKAA

SEQ ID NO: 1977783 - protein, 4 aa, Staphylococcus
QSGA

SEQ ID NO: 1977784 - protein, 8 aa, Staphylococcus
QSGADQSI

SEQ ID NO: 1977785 - protein, 8 aa, Staphylococcus
QSGALKQG

SEQ ID NO: 1977786 - protein, 10 aa, Staphylococcus
QSGAVSKEIP

SEQ ID NO: 1977787 - protein, 15 aa, Staphylococcus
QSGDLESAKQALDKE

SEQ ID NO: 1977788 - protein, 10 aa, Staphylococcus
QSGFARTGKT

SEQ ID NO: 1977789 - protein, 6 aa, Staphylococcus
QSGGFG

SEQ ID NO: 1977790 - protein, 7 aa, Staphylococcus
QSGIGKV

SEQ ID NO: 1977791 - protein, 14 aa, Staphylococcus
QSGIGSNSCGPELN

SEQ ID NO: 1977792 - protein, 5 aa, Staphylococcus
QSGKL

SEQ ID NO: 1977793 - protein, 10 aa, Staphylococcus
QSGKPTQVPQ

SEQ ID NO: 1977794 - protein, 7 aa, Staphylococcus
QSGKSNI

SEQ ID NO: 1977795 - protein, 14 aa, Staphylococcus
QSGLGRSGKTFATD

SEQ ID NO: 1977796 - protein, 5 aa, Staphylococcus
QSGND

SEQ ID NO: 1977797 - protein, 7 aa, Staphylococcus
QSGNYSD

SEQ ID NO: 1977798 - protein, 8 aa, Staphylococcus
QSGNYSDA

SEQ ID NO: 1977799 - protein, 4 aa, Staphylococcus
QSGP

SEQ ID NO: 1977800 - protein, 5 aa, Staphylococcus
QSGPI

SEQ ID NO: 1977801 - protein, 9 aa, Staphylococcus
QSGSDYSKN

SEQ ID NO: 1977802 - protein, 8 aa, Staphylococcus
QSGSEEYN

SEQ ID NO: 1977803 - protein, 4 aa, Staphylococcus
QSGT

SEQ ID NO: 1977804 - protein, 21 aa, Staphylococcus
QSGTYEITENKNTQSNTGALI

SEQ ID NO: 1977805 - protein, 6 aa, Staphylococcus
QSHDES

SEQ ID NO: 1977806 - protein, 5 aa, Staphylococcus
QSHGI

SEQ ID NO: 1977807 - protein, 7 aa, Staphylococcus
QSHHESI

SEQ ID NO: 1977808 - protein, 4 aa, Staphylococcus
QSHK

SEQ ID NO: 1977809 - protein, 12 aa, Staphylococcus
QSHKYEKEGQTH

SEQ ID NO: 1977810 - protein, 5 aa, Staphylococcus
QSHND

SEQ ID NO: 1977811 - protein, 12 aa, Staphylococcus
QSHQAQSEKLSE

SEQ ID NO: 1977812 - protein, 10 aa, Staphylococcus
QSHRGTNIDT

SEQ ID NO: 1977813 - protein, 4 aa, Staphylococcus
QSIE

SEQ ID NO: 1977814 - protein, 4 aa, Staphylococcus
QSIG

SEQ ID NO: 1977815 - protein, 12 aa, Staphylococcus
QSIKAQNPQGKV

SEQ ID NO: 1977816 - protein, 4 aa, Staphylococcus
QSIL

SEQ ID NO: 1977817 - protein, 5 aa, Staphylococcus
QSILD

SEQ ID NO: 1977818 - protein, 8 aa, Staphylococcus
QSIPHEGY

SEQ ID NO: 1977819 - protein, 6 aa, Staphylococcus
QSIPVS

SEQ ID NO: 1977820 - protein, 6 aa, Staphylococcus
QSIQTH

SEQ ID NO: 1977821 - protein, 15 aa, Staphylococcus
QSIRDVKMKRSWKHI

SEQ ID NO: 1977822 - protein, 16 aa, Staphylococcus
QSISPGLRKKAVAGKF

SEQ ID NO: 1977823 - protein, 7 aa, Staphylococcus
QSISSTS

SEQ ID NO: 1977824 - protein, 18 aa, Staphylococcus
QSITKGQALKNKDKVEVT

SEQ ID NO: 1977825 - protein, 6 aa, Staphylococcus
QSITNA

SEQ ID NO: 1977826 - protein, 6 aa, Staphylococcus
QSITPE

SEQ ID NO: 1977827 - protein, 9 aa, Staphylococcus
QSKANLKSR

SEQ ID NO: 1977828 - protein, 7 aa, Staphylococcus
QSKCNDA

SEQ ID NO: 1977829 - protein, 10 aa, Staphylococcus
QSKDIGPIGD

SEQ ID NO: 1977830 - protein, 8 aa, Staphylococcus
QSKDINRK

SEQ ID NO: 1977831 - protein, 11 aa, Staphylococcus
QSKDMGPVGDS

SEQ ID NO: 1977832 - protein, 7 aa, Staphylococcus
QSKDSIN

SEQ ID NO: 1977833 - protein, 10 aa, Staphylococcus
QSKDVGPIGD

SEQ ID NO: 1977834 - protein, 17 aa, Staphylococcus
QSKEAAEQLAQEIGNEK

SEQ ID NO: 1977835 - protein, 10 aa, Staphylococcus
QSKEDGYPGD

SEQ ID NO: 1977836 - protein, 8 aa, Staphylococcus
QSKEKENY

SEQ ID NO: 1977837 - protein, 7 aa, Staphylococcus
QSKEQTC

SEQ ID NO: 1977838 - protein, 9 aa, Staphylococcus
QSKETGNKE

SEQ ID NO: 1977839 - protein, 7 aa, Staphylococcus
QSKFGDV

SEQ ID NO: 1977840 - protein, 20 aa, Staphylococcus
QSKGEHKGKLEGEVKTIETH

SEQ ID NO: 1977841 - protein, 9 aa, Staphylococcus
QSKGTLESY

SEQ ID NO: 1977842 - protein, 10 aa, Staphylococcus
QSKHTEESPY

SEQ ID NO: 1977843 - protein, 8 aa, Staphylococcus
QSKIRPIS

SEQ ID NO: 1977844 - protein, 7 aa, Staphylococcus
QSKKESV

SEQ ID NO: 1977845 - protein, 9 aa, Staphylococcus
QSKKQANPI

SEQ ID NO: 1977846 - protein, 8 aa, Staphylococcus
QSKKSPYD

SEQ ID NO: 1977847 - protein, 19 aa, Staphylococcus
QSKKVSSRAGMSLTKETSR

SEQ ID NO: 1977848 - protein, 18 aa, Staphylococcus
QSKKVSSRSGMSLTRDTS

SEQ ID NO: 1977849 - protein, 18 aa, Staphylococcus
QSKKVSSRSGMSLTRETS

SEQ ID NO: 1977850 - protein, 9 aa, Staphylococcus
QSKLQSDAE

SEQ ID NO: 1977851 - protein, 13 aa, Staphylococcus
QSKMRSNNPDMPI

SEQ ID NO: 1977852 - protein, 8 aa, Staphylococcus
QSKPDTAN

SEQ ID NO: 1977853 - protein, 11 aa, Staphylococcus
QSKQESYKSAF

SEQ ID NO: 1977854 - protein, 6 aa, Staphylococcus
QSKRQI

SEQ ID NO: 1977855 - protein, 9 aa, Staphylococcus
QSKSDLKLG

SEQ ID NO: 1977856 - protein, 16 aa, Staphylococcus
QSKSFNQQYKGKISDA

SEQ ID NO: 1977857 - protein, 8 aa, Staphylococcus
QSKSILDK

SEQ ID NO: 1977858 - protein, 9 aa, Staphylococcus
QSKSNTVEE

SEQ ID NO: 1977859 - protein, 8 aa, Staphylococcus
QSKSYNGK

SEQ ID NO: 1977860 - protein, 8 aa, Staphylococcus
QSKTLTIN

SEQ ID NO: 1977861 - protein, 19 aa, Staphylococcus
QSLADAGSLIEDDESYSER

SEQ ID NO: 1977862 - protein, 18 aa, Staphylococcus
QSLAEQTKKIIGTKKEIE

SEQ ID NO: 1977863 - protein, 6 aa, Staphylococcus
QSLDDE

SEQ ID NO: 1977864 - protein, 7 aa, Staphylococcus
QSLDDET

SEQ ID NO: 1977865 - protein, 7 aa, Staphylococcus
QSLDKPE

SEQ ID NO: 1977866 - protein, 6 aa, Staphylococcus
QSLDQE

SEQ ID NO: 1977867 - protein, 7 aa, Staphylococcus
QSLDTKD

SEQ ID NO: 1977868 - protein, 6 aa, Staphylococcus
QSLDYE

SEQ ID NO: 1977869 - protein, 7 aa, Staphylococcus
QSLGETA

SEQ ID NO: 1977870 - protein, 4 aa, Staphylococcus
QSLK

SEQ ID NO: 1977871 - protein, 25 aa, Staphylococcus
QSLKDSVDEEKRKAEENKKEVESYR

SEQ ID NO: 1977872 - protein, 4 aa, Staphylococcus
QSLN

SEQ ID NO: 1977873 - protein, 8 aa, Staphylococcus
QSLNGTNR

SEQ ID NO: 1977874 - protein, 13 aa, Staphylococcus
QSLNNHNEKAHHD

SEQ ID NO: 1977875 - protein, 8 aa, Staphylococcus
QSLNNTAQ

SEQ ID NO: 1977876 - protein, 8 aa, Staphylococcus
QSLNQQAR

SEQ ID NO: 1977877 - protein, 7 aa, Staphylococcus
QSLQNTA

SEQ ID NO: 1977878 - protein, 13 aa, Staphylococcus
QSLRASDKEFLEN

SEQ ID NO: 1977879 - protein, 18 aa, Staphylococcus
QSLRNELSENEKQKADKE

SEQ ID NO: 1977880 - protein, 18 aa, Staphylococcus
QSLRNELSESEKLQADQE

SEQ ID NO: 1977881 - protein, 18 aa, Staphylococcus
QSLRNELSESEKQKADQE

SEQ ID NO: 1977882 - protein, 18 aa, Staphylococcus
QSLRNELSESEKQRADQE

SEQ ID NO: 1977883 - protein, 10 aa, Staphylococcus
QSLSASDKEF

SEQ ID NO: 1977884 - protein, 7 aa, Staphylococcus
QSLSDEP

SEQ ID NO: 1977885 - protein, 6 aa, Staphylococcus
QSLSKD

SEQ ID NO: 1977886 - protein, 8 aa, Staphylococcus
QSLSKGEK

SEQ ID NO: 1977887 - protein, 8 aa, Staphylococcus
QSLSNRES

SEQ ID NO: 1977888 - protein, 7 aa, Staphylococcus
QSLSSTY

SEQ ID NO: 1977889 - protein, 5 aa, Staphylococcus
QSLTA

SEQ ID NO: 1977890 - protein, 11 aa, Staphylococcus
QSLTDKPVKGM

SEQ ID NO: 1977891 - protein, 5 aa, Staphylococcus
QSLTE

SEQ ID NO: 1977892 - protein, 7 aa, Staphylococcus
QSLTTEN

SEQ ID NO: 1977893 - protein, 4 aa, Staphylococcus
QSMG

SEQ ID NO: 1977894 - protein, 8 aa, Staphylococcus
QSMKKQYH

SEQ ID NO: 1977895 - protein, 6 aa, Staphylococcus
QSMPEQ

SEQ ID NO: 1977896 - protein, 10 aa, Staphylococcus
QSMPSDSDIY

SEQ ID NO: 1977897 - protein, 6 aa, Staphylococcus
QSMQSD

SEQ ID NO: 1977898 - protein, 6 aa, Staphylococcus
QSMRDQ

SEQ ID NO: 1977899 - protein, 6 aa, Staphylococcus
QSMSKT

SEQ ID NO: 1977900 - protein, 7 aa, Staphylococcus
QSMSPKK

SEQ ID NO: 1977901 - protein, 4 aa, Staphylococcus
QSMT

SEQ ID NO: 1977902 - protein, 5 aa, Staphylococcus
QSNDP

SEQ ID NO: 1977903 - protein, 5 aa, Staphylococcus
QSNEP

SEQ ID NO: 1977904 - protein, 8 aa, Staphylococcus
QSNGEITK

SEQ ID NO: 1977905 - protein, 6 aa, Staphylococcus
QSNGQI

SEQ ID NO: 1977906 - protein, 7 aa, Staphylococcus
QSNHTDM

SEQ ID NO: 1977907 - protein, 7 aa, Staphylococcus
QSNHTEL

SEQ ID NO: 1977908 - protein, 6 aa, Staphylococcus
QSNKER

SEQ ID NO: 1977909 - protein, 9 aa, Staphylococcus
QSNKITATE

SEQ ID NO: 1977910 - protein, 7 aa, Staphylococcus
QSNKTQQ

SEQ ID NO: 1977911 - protein, 4 aa, Staphylococcus
QSNL

SEQ ID NO: 1977912 - protein, 8 aa, Staphylococcus
QSNMDSVD

SEQ ID NO: 1977913 - protein, 5 aa, Staphylococcus
QSNNF

SEQ ID NO: 1977914 - protein, 6 aa, Staphylococcus
QSNPIP

SEQ ID NO: 1977915 - protein, 5 aa, Staphylococcus
QSNPK

SEQ ID NO: 1977916 - protein, 5 aa, Staphylococcus
QSNPL

SEQ ID NO: 1977917 - protein, 12 aa, Staphylococcus
QSNPQTIIDRIE

SEQ ID NO: 1977918 - protein, 5 aa, Staphylococcus
QSNPV

SEQ ID NO: 1977919 - protein, 14 aa, Staphylococcus
QSNQPLRNPEQTYG

SEQ ID NO: 1977920 - protein, 14 aa, Staphylococcus
QSNQVNPDNKNTYG

SEQ ID NO: 1977921 - protein, 9 aa, Staphylococcus
QSNRRDEVE

SEQ ID NO: 1977922 - protein, 6 aa, Staphylococcus
QSNSIY

SEQ ID NO: 1977923 - protein, 9 aa, Staphylococcus
QSNSKEKQS

SEQ ID NO: 1977924 - protein, 5 aa, Staphylococcus
QSNSL

SEQ ID NO: 1977925 - protein, 5 aa, Staphylococcus
QSNTC

SEQ ID NO: 1977926 - protein, 12 aa, Staphylococcus
QSNYDKKQGKNY

SEQ ID NO: 1977927 - protein, 12 aa, Staphylococcus
QSNYDNKHGKPY

SEQ ID NO: 1977928 - protein, 9 aa, Staphylococcus
QSNYDNKHN

SEQ ID NO: 1977929 - protein, 9 aa, Staphylococcus
QSNYDNKYN

SEQ ID NO: 1977930 - protein, 11 aa, Staphylococcus
QSPAGSGKTVT

SEQ ID NO: 1977931 - protein, 7 aa, Staphylococcus
QSPEMTR

SEQ ID NO: 1977932 - protein, 8 aa, Staphylococcus
QSPEQQER

SEQ ID NO: 1977933 - protein, 8 aa, Staphylococcus
QSPEQYAH

SEQ ID NO: 1977934 - protein, 8 aa, Staphylococcus
QSPEQYAR

SEQ ID NO: 1977935 - protein, 5 aa, Staphylococcus
QSPGL

SEQ ID NO: 1977936 - protein, 16 aa, Staphylococcus
QSPHNKGNIRTGETTP

SEQ ID NO: 1977937 - protein, 15 aa, Staphylococcus
QSPLEYKKSYSNEKV

SEQ ID NO: 1977938 - protein, 14 aa, Staphylococcus
QSPLTEDNVDDVQG

SEQ ID NO: 1977939 - protein, 6 aa, Staphylococcus
QSPLTY

SEQ ID NO: 1977940 - protein, 11 aa, Staphylococcus
QSPNDDNGYDI

SEQ ID NO: 1977941 - protein, 12 aa, Staphylococcus
QSPNDDNGYDIS

SEQ ID NO: 1977942 - protein, 16 aa, Staphylococcus
QSPNLAVSSSARGNLE

SEQ ID NO: 1977943 - protein, 4 aa, Staphylococcus
QSPQ

SEQ ID NO: 1977944 - protein, 13 aa, Staphylococcus
QSPRLAEKQNAAN

SEQ ID NO: 1977945 - protein, 9 aa, Staphylococcus
QSPRLATSQ

SEQ ID NO: 1977946 - protein, 20 aa, Staphylococcus
QSPSEYAKARKLTKAAEDVI

SEQ ID NO: 1977947 - protein, 9 aa, Staphylococcus
QSPTEYARS

SEQ ID NO: 1977948 - protein, 7 aa, Staphylococcus
QSPTIGM

SEQ ID NO: 1977949 - protein, 6 aa, Staphylococcus
QSPTLN

SEQ ID NO: 1977950 - protein, 6 aa, Staphylococcus
QSPVNN

SEQ ID NO: 1977951 - protein, 6 aa, Staphylococcus
QSPYEY

SEQ ID NO: 1977952 - protein, 6 aa, Staphylococcus
QSPYKE

SEQ ID NO: 1977953 - protein, 5 aa, Staphylococcus
QSQAL

SEQ ID NO: 1977954 - protein, 10 aa, Staphylococcus
QSQAVRTTEG

SEQ ID NO: 1977955 - protein, 8 aa, Staphylococcus
QSQDTSEI

SEQ ID NO: 1977956 - protein, 4 aa, Staphylococcus
QSQG

SEQ ID NO: 1977957 - protein, 9 aa, Staphylococcus
QSQGGKDNI

SEQ ID NO: 1977958 - protein, 5 aa, Staphylococcus
QSQHD

SEQ ID NO: 1977959 - protein, 10 aa, Staphylococcus
QSQISQSSIS

SEQ ID NO: 1977960 - protein, 7 aa, Staphylococcus
QSQKYQH

SEQ ID NO: 1977961 - protein, 4 aa, Staphylococcus
QSQL

SEQ ID NO: 1977962 - protein, 10 aa, Staphylococcus
QSQLKPIGEI

SEQ ID NO: 1977963 - protein, 16 aa, Staphylococcus
QSQLNKGTTITINIPL

SEQ ID NO: 1977964 - protein, 6 aa, Staphylococcus
QSQLRT

SEQ ID NO: 1977965 - protein, 9 aa, Staphylococcus
QSQPDEGID

SEQ ID NO: 1977966 - protein, 7 aa, Staphylococcus
QSQPNKI

SEQ ID NO: 1977967 - protein, 5 aa, Staphylococcus
QSQQS

SEQ ID NO: 1977968 - protein, 12 aa, Staphylococcus
QSQSDSEQTPAM

SEQ ID NO: 1977969 - protein, 6 aa, Staphylococcus
QSQTKI

SEQ ID NO: 1977970 - protein, 9 aa, Staphylococcus
QSQVDKQEI

SEQ ID NO: 1977971 - protein, 5 aa, Staphylococcus
QSQYQ

SEQ ID NO: 1977972 - protein, 6 aa, Staphylococcus
QSQYRE

SEQ ID NO: 1977973 - protein, 6 aa, Staphylococcus
QSQYTN

SEQ ID NO: 1977974 - protein, 5 aa, Staphylococcus
QSRDN

SEQ ID NO: 1977975 - protein, 16 aa, Staphylococcus
QSREAAEALAKELGDK

SEQ ID NO: 1977976 - protein, 18 aa, Staphylococcus
QSRELSKVARESLEEARE

SEQ ID NO: 1977977 - protein, 5 aa, Staphylococcus
QSRKV

SEQ ID NO: 1977978 - protein, 11 aa, Staphylococcus
QSRKYLANQNN

SEQ ID NO: 1977979 - protein, 7 aa, Staphylococcus
QSRLQDD

SEQ ID NO: 1977980 - protein, 10 aa, Staphylococcus
QSRLQDDTTI

SEQ ID NO: 1977981 - protein, 18 aa, Staphylococcus
QSRMKSNDPDKPIDYEKS

SEQ ID NO: 1977982 - protein, 12 aa, Staphylococcus
QSRMKSNNPEMP

SEQ ID NO: 1977983 - protein, 6 aa, Staphylococcus
QSRQQF

SEQ ID NO: 1977984 - protein, 4 aa, Staphylococcus
QSRR

SEQ ID NO: 1977985 - protein, 8 aa, Staphylococcus
QSRSTKKQ

SEQ ID NO: 1977986 - protein, 13 aa, Staphylococcus
QSRTSSNERAEQY

SEQ ID NO: 1977987 - protein, 8 aa, Staphylococcus
QSSAGEAY

SEQ ID NO: 1977988 - protein, 7 aa, Staphylococcus
QSSALSA

SEQ ID NO: 1977989 - protein, 4 aa, Staphylococcus
QSSD

SEQ ID NO: 1977990 - protein, 5 aa, Staphylococcus
QSSDI

SEQ ID NO: 1977991 - protein, 13 aa, Staphylococcus
QSSDNYGGTCINV

SEQ ID NO: 1977992 - protein, 5 aa, Staphylococcus
QSSDV

SEQ ID NO: 1977993 - protein, 7 aa, Staphylococcus
QSSEDNM

SEQ ID NO: 1977994 - protein, 7 aa, Staphylococcus
QSSFSTY

SEQ ID NO: 1977995 - protein, 4 aa, Staphylococcus
QSSG

SEQ ID NO: 1977996 - protein, 4 aa, Staphylococcus
QSSI

SEQ ID NO: 1977997 - protein, 5 aa, Staphylococcus
QSSIG

SEQ ID NO: 1977998 - protein, 16 aa, Staphylococcus
QSSIQDKASQRDTLKQ

SEQ ID NO: 1977999 - protein, 15 aa, Staphylococcus
QSSISYAGGKDLKSL

SEQ ID NO: 1978000 - protein, 16 aa, Staphylococcus
QSSISYAGGKDLKSLT

SEQ ID NO: 1978001 - protein, 6 aa, Staphylococcus
QSSKFD

SEQ ID NO: 1978002 - protein, 11 aa, Staphylococcus
QSSKLTKSERR

SEQ ID NO: 1978003 - protein, 7 aa, Staphylococcus
QSSKNDD

SEQ ID NO: 1978004 - protein, 26 aa, Staphylococcus
QSSNDFEKLTGEKPDTFETYLHKHYK

SEQ ID NO: 1978005 - protein, 6 aa, Staphylococcus
QSSNFD

SEQ ID NO: 1978006 - protein, 5 aa, Staphylococcus
QSSNI

SEQ ID NO: 1978007 - protein, 6 aa, Staphylococcus
QSSPSL

SEQ ID NO: 1978008 - protein, 8 aa, Staphylococcus
QSSREVNR

SEQ ID NO: 1978009 - protein, 10 aa, Staphylococcus
QSSRQEPGNT

SEQ ID NO: 1978010 - protein, 7 aa, Staphylococcus
QSSRTYK

SEQ ID NO: 1978011 - protein, 25 aa, Staphylococcus
QSSSITNDQKFESDIEQLDSNVKPR

SEQ ID NO: 1978012 - protein, 10 aa, Staphylococcus
QSSSKQDELE

SEQ ID NO: 1978013 - protein, 8 aa, Staphylococcus
QSSSLPNE

SEQ ID NO: 1978014 - protein, 7 aa, Staphylococcus
QSSSPSY

SEQ ID NO: 1978015 - protein, 6 aa, Staphylococcus
QSSSQS

SEQ ID NO: 1978016 - protein, 7 aa, Staphylococcus
QSSSTHR

SEQ ID NO: 1978017 - protein, 5 aa, Staphylococcus
QSSSV

SEQ ID NO: 1978018 - protein, 4 aa, Staphylococcus
QSTD

SEQ ID NO: 1978019 - protein, 6 aa, Staphylococcus
QSTDSV

SEQ ID NO: 1978020 - protein, 12 aa, Staphylococcus
QSTEKSTSSYKN

SEQ ID NO: 1978021 - protein, 6 aa, Staphylococcus
QSTEKY

SEQ ID NO: 1978022 - protein, 13 aa, Staphylococcus
QSTEPHSMGMYIL

SEQ ID NO: 1978023 - protein, 31 aa, Staphylococcus
QSTGHGSTVTSTETVQSAKEKRYSKSNPYKA

SEQ ID NO: 1978024 - protein, 9 aa, Staphylococcus
QSTGKAKKP

SEQ ID NO: 1978025 - protein, 5 aa, Staphylococcus
QSTGL

SEQ ID NO: 1978026 - protein, 23 aa, Staphylococcus
QSTISSTNDLDEDITSTKATRTH

SEQ ID NO: 1978027 - protein, 7 aa, Staphylococcus
QSTKTEV

SEQ ID NO: 1978028 - protein, 9 aa, Staphylococcus
QSTLRPIGE

SEQ ID NO: 1978029 - protein, 6 aa, Staphylococcus
QSTLSR

SEQ ID NO: 1978030 - protein, 11 aa, Staphylococcus
QSTNDILQSPN

SEQ ID NO: 1978031 - protein, 13 aa, Staphylococcus
QSTNEKENIASTK

SEQ ID NO: 1978032 - protein, 11 aa, Staphylococcus
QSTNGGFTNGT

SEQ ID NO: 1978033 - protein, 9 aa, Staphylococcus
QSTNGMPRF

SEQ ID NO: 1978034 - protein, 12 aa, Staphylococcus
QSTNTERQQAIE

SEQ ID NO: 1978035 - protein, 9 aa, Staphylococcus
QSTPTATLG

SEQ ID NO: 1978036 - protein, 31 aa, Staphylococcus
QSTQQDTTENKKSHSSNDEDERKGLNGYRKT

SEQ ID NO: 1978037 - protein, 8 aa, Staphylococcus
QSTRLADT

SEQ ID NO: 1978038 - protein, 4 aa, Staphylococcus
QSTS

SEQ ID NO: 1978039 - protein, 8 aa, Staphylococcus
QSTSLNEL

SEQ ID NO: 1978040 - protein, 8 aa, Staphylococcus
QSTSNAEK

SEQ ID NO: 1978041 - protein, 8 aa, Staphylococcus
QSTSNTVE

SEQ ID NO: 1978042 - protein, 5 aa, Staphylococcus
QSTSQ

SEQ ID NO: 1978043 - protein, 6 aa, Staphylococcus
QSTTEG

SEQ ID NO: 1978044 - protein, 8 aa, Staphylococcus
QSTTYSDR

SEQ ID NO: 1978045 - protein, 8 aa, Staphylococcus
QSVENTKK

SEQ ID NO: 1978046 - protein, 4 aa, Staphylococcus
QSVG

SEQ ID NO: 1978047 - protein, 7 aa, Staphylococcus
QSVHQSV

SEQ ID NO: 1978048 - protein, 7 aa, Staphylococcus
QSVKANS

SEQ ID NO: 1978049 - protein, 17 aa, Staphylococcus
QSVKTDIPKGASNKVDL

SEQ ID NO: 1978050 - protein, 14 aa, Staphylococcus
QSVKVNKDNNGATL

SEQ ID NO: 1978051 - protein, 5 aa, Staphylococcus
QSVLE

SEQ ID NO: 1978052 - protein, 4 aa, Staphylococcus
QSVS

SEQ ID NO: 1978053 - protein, 13 aa, Staphylococcus
QSVTAKHLRRYIE

SEQ ID NO: 1978054 - protein, 4 aa, Staphylococcus
QSVY

SEQ ID NO: 1978055 - protein, 10 aa, Staphylococcus
QSYEGSKVAG

SEQ ID NO: 1978056 - protein, 8 aa, Staphylococcus
QSYETKNG

SEQ ID NO: 1978057 - protein, 13 aa, Staphylococcus
QSYIDDGMSPNQV

SEQ ID NO: 1978058 - protein, 12 aa, Staphylococcus
QSYIEKSRGNIN

SEQ ID NO: 1978059 - protein, 11 aa, Staphylococcus
QSYKPEELNAD

SEQ ID NO: 1978060 - protein, 9 aa, Staphylococcus
QSYKQQLGK

SEQ ID NO: 1978061 - protein, 20 aa, Staphylococcus
QSYMNETEVGEGIKASGIDR

SEQ ID NO: 1978062 - protein, 4 aa, Staphylococcus
QSYP

SEQ ID NO: 1978063 - protein, 6 aa, Staphylococcus
QSYRAG

SEQ ID NO: 1978064 - protein, 4 aa, Staphylococcus
QSYS

SEQ ID NO: 1978065 - protein, 9 aa, Staphylococcus
QSYSTLPYT

SEQ ID NO: 1978066 - protein, 4 aa, Staphylococcus
QSYT

SEQ ID NO: 1978067 - protein, 7 aa, Staphylococcus
QSYTDKV

SEQ ID NO: 1978068 - protein, 19 aa, Staphylococcus
QSYTKAGSVMNDDPEAAAR

SEQ ID NO: 1978069 - protein, 7 aa, Staphylococcus
QSYTNEQ

SEQ ID NO: 1978070 - protein, 5 aa, Staphylococcus
QTAAE

SEQ ID NO: 1978071 - protein, 6 aa, Staphylococcus
QTAEQL

SEQ ID NO: 1978072 - protein, 4 aa, Staphylococcus
QTAG

SEQ ID NO: 1978073 - protein, 18 aa, Staphylococcus
QTAGTVRVNTSKNKVEDV

SEQ ID NO: 1978074 - protein, 6 aa, Staphylococcus
QTAHKK

SEQ ID NO: 1978075 - protein, 4 aa, Staphylococcus
QTAK

SEQ ID NO: 1978076 - protein, 5 aa, Staphylococcus
QTAKM

SEQ ID NO: 1978077 - protein, 11 aa, Staphylococcus
QTALENRPGEY

SEQ ID NO: 1978078 - protein, 9 aa, Staphylococcus
QTAPGPLVR

SEQ ID NO: 1978079 - protein, 10 aa, Staphylococcus
QTAPPGKRMG

SEQ ID NO: 1978080 - protein, 8 aa, Staphylococcus
QTAPRQSV

SEQ ID NO: 1978081 - protein, 9 aa, Staphylococcus
QTASEGGAW

SEQ ID NO: 1978082 - protein, 5 aa, Staphylococcus
QTATF

SEQ ID NO: 1978083 - protein, 13 aa, Staphylococcus
QTCSLRSSSASAR

SEQ ID NO: 1978084 - protein, 4 aa, Staphylococcus
QTDA

SEQ ID NO: 1978085 - protein, 8 aa, Staphylococcus
QTDAEGLE

SEQ ID NO: 1978086 - protein, 4 aa, Staphylococcus
QTDE

SEQ ID NO: 1978087 - protein, 7 aa, Staphylococcus
QTDEAGI

SEQ ID NO: 1978088 - protein, 8 aa, Staphylococcus
QTDEEGIE

SEQ ID NO: 1978089 - protein, 5 aa, Staphylococcus
QTDEL

SEQ ID NO: 1978090 - protein, 7 aa, Staphylococcus
QTDENEL

SEQ ID NO: 1978091 - protein, 9 aa, Staphylococcus
QTDENGKVI

SEQ ID NO: 1978092 - protein, 6 aa, Staphylococcus
QTDERR

SEQ ID NO: 1978093 - protein, 8 aa, Staphylococcus
QTDESGIE

SEQ ID NO: 1978094 - protein, 8 aa, Staphylococcus
QTDESSIE

SEQ ID NO: 1978095 - protein, 7 aa, Staphylococcus
QTDETIE

SEQ ID NO: 1978096 - protein, 4 aa, Staphylococcus
QTDF

SEQ ID NO: 1978097 - protein, 7 aa, Staphylococcus
QTDFNGD

SEQ ID NO: 1978098 - protein, 5 aa, Staphylococcus
QTDHA

SEQ ID NO: 1978099 - protein, 16 aa, Staphylococcus
QTDIDNSLDKISSELR

SEQ ID NO: 1978100 - protein, 8 aa, Staphylococcus
QTDLTPVD

SEQ ID NO: 1978101 - protein, 10 aa, Staphylococcus
QTDNPEPTAS

SEQ ID NO: 1978102 - protein, 5 aa, Staphylococcus
QTDNQ

SEQ ID NO: 1978103 - protein, 9 aa, Staphylococcus
QTDSETIDI

SEQ ID NO: 1978104 - protein, 8 aa, Staphylococcus
QTDSGQVY

SEQ ID NO: 1978105 - protein, 8 aa, Staphylococcus
QTDSPIGE

SEQ ID NO: 1978106 - protein, 4 aa, Staphylococcus
QTDT

SEQ ID NO: 1978107 - protein, 5 aa, Staphylococcus
QTEAM

SEQ ID NO: 1978108 - protein, 6 aa, Staphylococcus
QTEDEI

SEQ ID NO: 1978109 - protein, 8 aa, Staphylococcus
QTEDTAQA

SEQ ID NO: 1978110 - protein, 7 aa, Staphylococcus
QTEDTDR

SEQ ID NO: 1978111 - protein, 6 aa, Staphylococcus
QTEEMQ

SEQ ID NO: 1978112 - protein, 10 aa, Staphylococcus
QTEEQVEANV

SEQ ID NO: 1978113 - protein, 13 aa, Staphylococcus
QTEEQVEANVQGL

SEQ ID NO: 1978114 - protein, 10 aa, Staphylococcus
QTEEQVEQNV

SEQ ID NO: 1978115 - protein, 7 aa, Staphylococcus
QTEERLD

SEQ ID NO: 1978116 - protein, 5 aa, Staphylococcus
QTEIT

SEQ ID NO: 1978117 - protein, 6 aa, Staphylococcus
QTEKDD

SEQ ID NO: 1978118 - protein, 5 aa, Staphylococcus
QTEKL

SEQ ID NO: 1978119 - protein, 7 aa, Staphylococcus
QTEKPFK

SEQ ID NO: 1978120 - protein, 8 aa, Staphylococcus
QTEKVQAA

SEQ ID NO: 1978121 - protein, 5 aa, Staphylococcus
QTEMW

SEQ ID NO: 1978122 - protein, 7 aa, Staphylococcus
QTENLTD

SEQ ID NO: 1978123 - protein, 13 aa, Staphylococcus
QTEPGIKSKVQHG

SEQ ID NO: 1978124 - protein, 12 aa, Staphylococcus
QTEPGIQSKVQH

SEQ ID NO: 1978125 - protein, 5 aa, Staphylococcus
QTEQH

SEQ ID NO: 1978126 - protein, 9 aa, Staphylococcus
QTEQYTKDR

SEQ ID NO: 1978127 - protein, 8 aa, Staphylococcus
QTERNKIV

SEQ ID NO: 1978128 - protein, 7 aa, Staphylococcus
QTESNID

SEQ ID NO: 1978129 - protein, 15 aa, Staphylococcus
QTESPPGRNTDPLQD

SEQ ID NO: 1978130 - protein, 10 aa, Staphylococcus
QTFASGTSIR

SEQ ID NO: 1978131 - protein, 7 aa, Staphylococcus
QTFEDYQ

SEQ ID NO: 1978132 - protein, 4 aa, Staphylococcus
QTFT

SEQ ID NO: 1978133 - protein, 5 aa, Staphylococcus
QTFTA

SEQ ID NO: 1978134 - protein, 6 aa, Staphylococcus
QTGAPR

SEQ ID NO: 1978135 - protein, 7 aa, Staphylococcus
QTGEFGT

SEQ ID NO: 1978136 - protein, 9 aa, Staphylococcus
QTGEPTVEQ

SEQ ID NO: 1978137 - protein, 11 aa, Staphylococcus
QTGFEGLTKEA

SEQ ID NO: 1978138 - protein, 7 aa, Staphylococcus
QTGFQKP

SEQ ID NO: 1978139 - protein, 6 aa, Staphylococcus
QTGGFE

SEQ ID NO: 1978140 - protein, 16 aa, Staphylococcus
QTGGYSTGYKPIQKDL

SEQ ID NO: 1978141 - protein, 4 aa, Staphylococcus
QTGH

SEQ ID NO: 1978142 - protein, 18 aa, Staphylococcus
QTGIHGTEQDNYDGNLEQ

SEQ ID NO: 1978143 - protein, 20 aa, Staphylococcus
QTGLNPKKYSDAIKLQIALW

SEQ ID NO: 1978144 - protein, 4 aa, Staphylococcus
QTGN

SEQ ID NO: 1978145 - protein, 10 aa, Staphylococcus
QTGQEDSKFG

SEQ ID NO: 1978146 - protein, 13 aa, Staphylococcus
QTGQEIDSSLEEQ

SEQ ID NO: 1978147 - protein, 7 aa, Staphylococcus
QTGRDYH

SEQ ID NO: 1978148 - protein, 5 aa, Staphylococcus
QTGRF

SEQ ID NO: 1978149 - protein, 9 aa, Staphylococcus
QTGSGKSTL

SEQ ID NO: 1978150 - protein, 17 aa, Staphylococcus
QTGVHETEADSYDGNLG

SEQ ID NO: 1978151 - protein, 19 aa, Staphylococcus
QTGVHGTEADSYDGNLGQK

SEQ ID NO: 1978152 - protein, 7 aa, Staphylococcus
QTGYQKP

SEQ ID NO: 1978153 - protein, 8 aa, Staphylococcus
QTHAETIN

SEQ ID NO: 1978154 - protein, 5 aa, Staphylococcus
QTHET

SEQ ID NO: 1978155 - protein, 9 aa, Staphylococcus
QTHGRNQEV

SEQ ID NO: 1978156 - protein, 10 aa, Staphylococcus
QTHKEATHNC

SEQ ID NO: 1978157 - protein, 6 aa, Staphylococcus
QTHKTK

SEQ ID NO: 1978158 - protein, 8 aa, Staphylococcus
QTHQGHGT

SEQ ID NO: 1978159 - protein, 5 aa, Staphylococcus
QTHQT

SEQ ID NO: 1978160 - protein, 19 aa, Staphylococcus
QTHSNPDKTTKIIEIDSFK

SEQ ID NO: 1978161 - protein, 6 aa, Staphylococcus
QTIDEI

SEQ ID NO: 1978162 - protein, 6 aa, Staphylococcus
QTIDPT

SEQ ID NO: 1978163 - protein, 6 aa, Staphylococcus
QTIEEL

SEQ ID NO: 1978164 - protein, 12 aa, Staphylococcus
QTIETTSQQAVN

SEQ ID NO: 1978165 - protein, 11 aa, Staphylococcus
QTIGEVAEANN

SEQ ID NO: 1978166 - protein, 6 aa, Staphylococcus
QTIGGY

SEQ ID NO: 1978167 - protein, 25 aa, Staphylococcus
QTINDEVEPELYDSEGNLINDSKTS

SEQ ID NO: 1978168 - protein, 15 aa, Staphylococcus
QTINNSKVKPGEYDE

SEQ ID NO: 1978169 - protein, 9 aa, Staphylococcus
QTINQPDSS

SEQ ID NO: 1978170 - protein, 5 aa, Staphylococcus
QTIQN

SEQ ID NO: 1978171 - protein, 9 aa, Staphylococcus
QTIQSNNSH

SEQ ID NO: 1978172 - protein, 34 aa, Staphylococcus
QTIQTNSSVQSEQLSTKAEAVIQSNEQEIEPTQR

SEQ ID NO: 1978173 - protein, 9 aa, Staphylococcus
QTIREQDWE

SEQ ID NO: 1978174 - protein, 4 aa, Staphylococcus
QTIS

SEQ ID NO: 1978175 - protein, 5 aa, Staphylococcus
QTISN

SEQ ID NO: 1978176 - protein, 4 aa, Staphylococcus
QTKA

SEQ ID NO: 1978177 - protein, 9 aa, Staphylococcus
QTKANLKSR

SEQ ID NO: 1978178 - protein, 4 aa, Staphylococcus
QTKD

SEQ ID NO: 1978179 - protein, 11 aa, Staphylococcus
QTKDIGPVGDS

SEQ ID NO: 1978180 - protein, 8 aa, Staphylococcus
QTKDPDAL

SEQ ID NO: 1978181 - protein, 8 aa, Staphylococcus
QTKEGDHT

SEQ ID NO: 1978182 - protein, 10 aa, Staphylococcus
QTKERQRTGI

SEQ ID NO: 1978183 - protein, 10 aa, Staphylococcus
QTKEVPPTHS

SEQ ID NO: 1978184 - protein, 5 aa, Staphylococcus
QTKFY

SEQ ID NO: 1978185 - protein, 7 aa, Staphylococcus
QTKKKKV

SEQ ID NO: 1978186 - protein, 7 aa, Staphylococcus
QTKKNKI

SEQ ID NO: 1978187 - protein, 16 aa, Staphylococcus
QTKMKKPELLAPAGNL

SEQ ID NO: 1978188 - protein, 4 aa, Staphylococcus
QTKP

SEQ ID NO: 1978189 - protein, 7 aa, Staphylococcus
QTKPKNL

SEQ ID NO: 1978190 - protein, 8 aa, Staphylococcus
QTKPKNLK

SEQ ID NO: 1978191 - protein, 9 aa, Staphylococcus
QTKPKNLKI

SEQ ID NO: 1978192 - protein, 8 aa, Staphylococcus
QTKPQYSN

SEQ ID NO: 1978193 - protein, 7 aa, Staphylococcus
QTKQRNK

SEQ ID NO: 1978194 - protein, 5 aa, Staphylococcus
QTKSK

SEQ ID NO: 1978195 - protein, 6 aa, Staphylococcus
QTKSNA

SEQ ID NO: 1978196 - protein, 6 aa, Staphylococcus
QTKVDY

SEQ ID NO: 1978197 - protein, 8 aa, Staphylococcus
QTKYDGTP

SEQ ID NO: 1978198 - protein, 8 aa, Staphylococcus
QTKYGSVN

SEQ ID NO: 1978199 - protein, 4 aa, Staphylococcus
QTLA

SEQ ID NO: 1978200 - protein, 8 aa, Staphylococcus
QTLDQSKA

SEQ ID NO: 1978201 - protein, 4 aa, Staphylococcus
QTLE

SEQ ID NO: 1978202 - protein, 6 aa, Staphylococcus
QTLEER

SEQ ID NO: 1978203 - protein, 13 aa, Staphylococcus
QTLEETYDSIKHL

SEQ ID NO: 1978204 - protein, 9 aa, Staphylococcus
QTLESPNRN

SEQ ID NO: 1978205 - protein, 11 aa, Staphylococcus
QTLGDDEQEVI

SEQ ID NO: 1978206 - protein, 6 aa, Staphylococcus
QTLGTT

SEQ ID NO: 1978207 - protein, 10 aa, Staphylococcus
QTLIPNEDRE

SEQ ID NO: 1978208 - protein, 16 aa, Staphylococcus
QTLKGDVTISGAKNSA

SEQ ID NO: 1978209 - protein, 16 aa, Staphylococcus
QTLKGEVEISGAKNSA

SEQ ID NO: 1978210 - protein, 16 aa, Staphylococcus
QTLKGEVNISGAKNSA

SEQ ID NO: 1978211 - protein, 16 aa, Staphylococcus
QTLKGEVNNHGAKNSA

SEQ ID NO: 1978212 - protein, 19 aa, Staphylococcus
QTLNDSKKLEQYINQLEEL

SEQ ID NO: 1978213 - protein, 5 aa, Staphylococcus
QTLPQ

SEQ ID NO: 1978214 - protein, 6 aa, Staphylococcus
QTLQGK

SEQ ID NO: 1978215 - protein, 5 aa, Staphylococcus
QTLSN

SEQ ID NO: 1978216 - protein, 5 aa, Staphylococcus
QTLTG

SEQ ID NO: 1978217 - protein, 5 aa, Staphylococcus
QTMDQ

SEQ ID NO: 1978218 - protein, 4 aa, Staphylococcus
QTME

SEQ ID NO: 1978219 - protein, 6 aa, Staphylococcus
QTMGTS

SEQ ID NO: 1978220 - protein, 5 aa, Staphylococcus
QTMHS

SEQ ID NO: 1978221 - protein, 4 aa, Staphylococcus
QTMP

SEQ ID NO: 1978222 - protein, 5 aa, Staphylococcus
QTMPE

SEQ ID NO: 1978223 - protein, 6 aa, Staphylococcus
QTMPES

SEQ ID NO: 1978224 - protein, 30 aa, Staphylococcus
QTMPSALRETGRGGLAGTPTGQRLKQEIFG

SEQ ID NO: 1978225 - protein, 9 aa, Staphylococcus
QTMQTPDGR

SEQ ID NO: 1978226 - protein, 8 aa, Staphylococcus
QTNADGNQ

SEQ ID NO: 1978227 - protein, 13 aa, Staphylococcus
QTNANALKAEGAH

SEQ ID NO: 1978228 - protein, 37 aa, Staphylococcus
QTNANTKTTQDLLGKTDDLQAKLDKANAKSVTTSNGT

SEQ ID NO: 1978229 - protein, 9 aa, Staphylococcus
QTNDGFELS

SEQ ID NO: 1978230 - protein, 10 aa, Staphylococcus
QTNDTDTVLS

SEQ ID NO: 1978231 - protein, 8 aa, Staphylococcus
QTNEDGQQ

SEQ ID NO: 1978232 - protein, 6 aa, Staphylococcus
QTNEDS

SEQ ID NO: 1978233 - protein, 10 aa, Staphylococcus
QTNEEYKGMG

SEQ ID NO: 1978234 - protein, 9 aa, Staphylococcus
QTNENGSQE

SEQ ID NO: 1978235 - protein, 8 aa, Staphylococcus
QTNERIAQ

SEQ ID NO: 1978236 - protein, 13 aa, Staphylococcus
QTNESKVRGYTKG

SEQ ID NO: 1978237 - protein, 14 aa, Staphylococcus
QTNGGALSSSQQQL

SEQ ID NO: 1978238 - protein, 11 aa, Staphylococcus
QTNGSGKTNEV

SEQ ID NO: 1978239 - protein, 11 aa, Staphylococcus
QTNKGVSAARN

SEQ ID NO: 1978240 - protein, 5 aa, Staphylococcus
QTNNN

SEQ ID NO: 1978241 - protein, 15 aa, Staphylococcus
QTNPAEAAPGSIRGD

SEQ ID NO: 1978242 - protein, 6 aa, Staphylococcus
QTNPEG

SEQ ID NO: 1978243 - protein, 5 aa, Staphylococcus
QTNPI

SEQ ID NO: 1978244 - protein, 12 aa, Staphylococcus
QTNQKKGLQSTA

SEQ ID NO: 1978245 - protein, 13 aa, Staphylococcus
QTNQQRGLQSTAL

SEQ ID NO: 1978246 - protein, 15 aa, Staphylococcus
QTNRNERNKGIENNY

SEQ ID NO: 1978247 - protein, 7 aa, Staphylococcus
QTNSTLL

SEQ ID NO: 1978248 - protein, 10 aa, Staphylococcus
QTNTSEPTAS

SEQ ID NO: 1978249 - protein, 7 aa, Staphylococcus
QTNTSLS

SEQ ID NO: 1978250 - protein, 4 aa, Staphylococcus
QTNY

SEQ ID NO: 1978251 - protein, 8 aa, Staphylococcus
QTPAQLGK

SEQ ID NO: 1978252 - protein, 6 aa, Staphylococcus
QTPAVK

SEQ ID NO: 1978253 - protein, 9 aa, Staphylococcus
QTPDGSGKV

SEQ ID NO: 1978254 - protein, 6 aa, Staphylococcus
QTPEEE

SEQ ID NO: 1978255 - protein, 5 aa, Staphylococcus
QTPFT

SEQ ID NO: 1978256 - protein, 7 aa, Staphylococcus
QTPHKRT

SEQ ID NO: 1978257 - protein, 6 aa, Staphylococcus
QTPLER

SEQ ID NO: 1978258 - protein, 8 aa, Staphylococcus
QTPLGRYT

SEQ ID NO: 1978259 - protein, 5 aa, Staphylococcus
QTPLK

SEQ ID NO: 1978260 - protein, 6 aa, Staphylococcus
QTPLQT

SEQ ID NO: 1978261 - protein, 8 aa, Staphylococcus
QTPSNEPV

SEQ ID NO: 1978262 - protein, 22 aa, Staphylococcus
QTPVGRNGIKATFKGKVDGPTI

SEQ ID NO: 1978263 - protein, 6 aa, Staphylococcus
QTPYGN

SEQ ID NO: 1978264 - protein, 5 aa, Staphylococcus
QTPYI

SEQ ID NO: 1978265 - protein, 8 aa, Staphylococcus
QTQDPDPL

SEQ ID NO: 1978266 - protein, 8 aa, Staphylococcus
QTQDPEPL

SEQ ID NO: 1978267 - protein, 10 aa, Staphylococcus
QTQEAEPTAS

SEQ ID NO: 1978268 - protein, 8 aa, Staphylococcus
QTQEASGE

SEQ ID NO: 1978269 - protein, 15 aa, Staphylococcus
QTQEGTLTLKSKDEG

SEQ ID NO: 1978270 - protein, 6 aa, Staphylococcus
QTQELS

SEQ ID NO: 1978271 - protein, 6 aa, Staphylococcus
QTQELT

SEQ ID NO: 1978272 - protein, 9 aa, Staphylococcus
QTQEQTIAS

SEQ ID NO: 1978273 - protein, 15 aa, Staphylococcus
QTQIANGELKPEDAE

SEQ ID NO: 1978274 - protein, 5 aa, Staphylococcus
QTQIT

SEQ ID NO: 1978275 - protein, 6 aa, Staphylococcus
QTQPCR

SEQ ID NO: 1978276 - protein, 6 aa, Staphylococcus
QTQPKR

SEQ ID NO: 1978277 - protein, 6 aa, Staphylococcus
QTQPQR

SEQ ID NO: 1978278 - protein, 6 aa, Staphylococcus
QTQQLS

SEQ ID NO: 1978279 - protein, 5 aa, Staphylococcus
QTQSL

SEQ ID NO: 1978280 - protein, 9 aa, Staphylococcus
QTQTGQTFS

SEQ ID NO: 1978281 - protein, 6 aa, Staphylococcus
QTQVTD

SEQ ID NO: 1978282 - protein, 6 aa, Staphylococcus
QTQVTQ

SEQ ID NO: 1978283 - protein, 7 aa, Staphylococcus
QTRADPL

SEQ ID NO: 1978284 - protein, 6 aa, Staphylococcus
QTRKNK

SEQ ID NO: 1978285 - protein, 16 aa, Staphylococcus
QTRNHYKNNFKEKEGY

SEQ ID NO: 1978286 - protein, 4 aa, Staphylococcus
QTRP

SEQ ID NO: 1978287 - protein, 13 aa, Staphylococcus
QTRPITARLLELS

SEQ ID NO: 1978288 - protein, 11 aa, Staphylococcus
QTRPSDDSRRQ

SEQ ID NO: 1978289 - protein, 10 aa, Staphylococcus
QTRPTATEQM

SEQ ID NO: 1978290 - protein, 8 aa, Staphylococcus
QTRQKQGM

SEQ ID NO: 1978291 - protein, 5 aa, Staphylococcus
QTRRN

SEQ ID NO: 1978292 - protein, 13 aa, Staphylococcus
QTRTITQQLLTLE

SEQ ID NO: 1978293 - protein, 7 aa, Staphylococcus
QTRTKHK

SEQ ID NO: 1978294 - protein, 7 aa, Staphylococcus
QTRTQHK

SEQ ID NO: 1978295 - protein, 5 aa, Staphylococcus
QTSAF

SEQ ID NO: 1978296 - protein, 4 aa, Staphylococcus
QTSD

SEQ ID NO: 1978297 - protein, 7 aa, Staphylococcus
QTSDDND

SEQ ID NO: 1978298 - protein, 5 aa, Staphylococcus
QTSDE

SEQ ID NO: 1978299 - protein, 5 aa, Staphylococcus
QTSDP

SEQ ID NO: 1978300 - protein, 7 aa, Staphylococcus
QTSDPNI

SEQ ID NO: 1978301 - protein, 6 aa, Staphylococcus
QTSDSN

SEQ ID NO: 1978302 - protein, 8 aa, Staphylococcus
QTSEEDRR

SEQ ID NO: 1978303 - protein, 8 aa, Staphylococcus
QTSESTMS

SEQ ID NO: 1978304 - protein, 8 aa, Staphylococcus
QTSETEQL

SEQ ID NO: 1978305 - protein, 12 aa, Staphylococcus
QTSHIDASSKGS

SEQ ID NO: 1978306 - protein, 11 aa, Staphylococcus
QTSHQKQNKVQ

SEQ ID NO: 1978307 - protein, 10 aa, Staphylococcus
QTSHQNQNKI

SEQ ID NO: 1978308 - protein, 11 aa, Staphylococcus
QTSHQNSNKIQ

SEQ ID NO: 1978309 - protein, 14 aa, Staphylococcus
QTSLNDKETRRDQM

SEQ ID NO: 1978310 - protein, 6 aa, Staphylococcus
QTSPNA

SEQ ID NO: 1978311 - protein, 9 aa, Staphylococcus
QTSPTNSVG

SEQ ID NO: 1978312 - protein, 8 aa, Staphylococcus
QTSQETGQ

SEQ ID NO: 1978313 - protein, 7 aa, Staphylococcus
QTSQGAY

SEQ ID NO: 1978314 - protein, 11 aa, Staphylococcus
QTSRQNKNKIQ

SEQ ID NO: 1978315 - protein, 6 aa, Staphylococcus
QTSSPS

SEQ ID NO: 1978316 - protein, 5 aa, Staphylococcus
QTSSS

SEQ ID NO: 1978317 - protein, 5 aa, Staphylococcus
QTSVS

SEQ ID NO: 1978318 - protein, 10 aa, Staphylococcus
QTTAEQAEGY

SEQ ID NO: 1978319 - protein, 5 aa, Staphylococcus
QTTDE

SEQ ID NO: 1978320 - protein, 7 aa, Staphylococcus
QTTDGFE

SEQ ID NO: 1978321 - protein, 8 aa, Staphylococcus
QTTDGFEL

SEQ ID NO: 1978322 - protein, 9 aa, Staphylococcus
QTTDGFELS

SEQ ID NO: 1978323 - protein, 11 aa, Staphylococcus
QTTDHQTSDIN

SEQ ID NO: 1978324 - protein, 8 aa, Staphylococcus
QTTDNITA

SEQ ID NO: 1978325 - protein, 9 aa, Staphylococcus
QTTDPDPLP

SEQ ID NO: 1978326 - protein, 10 aa, Staphylococcus
QTTDPYTGAV

SEQ ID NO: 1978327 - protein, 7 aa, Staphylococcus
QTTDVSV

SEQ ID NO: 1978328 - protein, 7 aa, Staphylococcus
QTTEENP

SEQ ID NO: 1978329 - protein, 4 aa, Staphylococcus
QTTG

SEQ ID NO: 1978330 - protein, 6 aa, Staphylococcus
QTTGET

SEQ ID NO: 1978331 - protein, 9 aa, Staphylococcus
QTTGSEFSS

SEQ ID NO: 1978332 - protein, 10 aa, Staphylococcus
QTTGSEFSSN

SEQ ID NO: 1978333 - protein, 4 aa, Staphylococcus
QTTI

SEQ ID NO: 1978334 - protein, 4 aa, Staphylococcus
QTTN

SEQ ID NO: 1978335 - protein, 8 aa, Staphylococcus
QTTNKVKA

SEQ ID NO: 1978336 - protein, 8 aa, Staphylococcus
QTTNPEFN

SEQ ID NO: 1978337 - protein, 16 aa, Staphylococcus
QTTPENIKSIKEAIET

SEQ ID NO: 1978338 - protein, 7 aa, Staphylococcus
QTTQDDV

SEQ ID NO: 1978339 - protein, 15 aa, Staphylococcus
QTTQSGNNAALYGAI

SEQ ID NO: 1978340 - protein, 17 aa, Staphylococcus
QTTQTENNAALFGAVSV

SEQ ID NO: 1978341 - protein, 17 aa, Staphylococcus
QTTQTKNHAALFGAITK

SEQ ID NO: 1978342 - protein, 4 aa, Staphylococcus
QTTR

SEQ ID NO: 1978343 - protein, 6 aa, Staphylococcus
QTTRAS

SEQ ID NO: 1978344 - protein, 10 aa, Staphylococcus
QTTSFDQKKQ

SEQ ID NO: 1978345 - protein, 14 aa, Staphylococcus
QTTTGISADERTMT

SEQ ID NO: 1978346 - protein, 5 aa, Staphylococcus
QTTTY

SEQ ID NO: 1978347 - protein, 5 aa, Staphylococcus
QTTYY

SEQ ID NO: 1978348 - protein, 16 aa, Staphylococcus
QTVAASAQADKSNSYT

SEQ ID NO: 1978349 - protein, 17 aa, Staphylococcus
QTVDEETAGNEGGDING

SEQ ID NO: 1978350 - protein, 5 aa, Staphylococcus
QTVEQ

SEQ ID NO: 1978351 - protein, 5 aa, Staphylococcus
QTVGI

SEQ ID NO: 1978352 - protein, 6 aa, Staphylococcus
QTVGKG

SEQ ID NO: 1978353 - protein, 8 aa, Staphylococcus
QTVNGGEA

SEQ ID NO: 1978354 - protein, 10 aa, Staphylococcus
QTVNIESEEA

SEQ ID NO: 1978355 - protein, 10 aa, Staphylococcus
QTVNKSDLAE

SEQ ID NO: 1978356 - protein, 26 aa, Staphylococcus
QTVRTKEDLADYNKMSKSEQADVKDV

SEQ ID NO: 1978357 - protein, 4 aa, Staphylococcus
QTVS

SEQ ID NO: 1978358 - protein, 6 aa, Staphylococcus
QTVSPH

SEQ ID NO: 1978359 - protein, 4 aa, Staphylococcus
QTVT

SEQ ID NO: 1978360 - protein, 5 aa, Staphylococcus
QTVTA

SEQ ID NO: 1978361 - protein, 10 aa, Staphylococcus
QTVTNTEGEL

SEQ ID NO: 1978362 - protein, 12 aa, Staphylococcus
QTVTRSTEQSLS

SEQ ID NO: 1978363 - protein, 8 aa, Staphylococcus
QTYDESYE

SEQ ID NO: 1978364 - protein, 12 aa, Staphylococcus
QTYEDFKETDTF

SEQ ID NO: 1978365 - protein, 18 aa, Staphylococcus
QTYEEAYAKKQKLDESLE

SEQ ID NO: 1978366 - protein, 9 aa, Staphylococcus
QTYGGSDEA

SEQ ID NO: 1978367 - protein, 8 aa, Staphylococcus
QTYKASTE

SEQ ID NO: 1978368 - protein, 4 aa, Staphylococcus
QTYM

SEQ ID NO: 1978369 - protein, 8 aa, Staphylococcus
QTYNQPQP

SEQ ID NO: 1978370 - protein, 4 aa, Staphylococcus
QTYP

SEQ ID NO: 1978371 - protein, 8 aa, Staphylococcus
QTYRDDDA

SEQ ID NO: 1978372 - protein, 6 aa, Staphylococcus
QTYRPT

SEQ ID NO: 1978373 - protein, 10 aa, Staphylococcus
QTYTSSTSNY

SEQ ID NO: 1978374 - protein, 6 aa, Staphylococcus
QTYYRT

SEQ ID NO: 1978375 - protein, 7 aa, Staphylococcus
QVAARRA

SEQ ID NO: 1978376 - protein, 12 aa, Staphylococcus
QVAETGSSIDQQ

SEQ ID NO: 1978377 - protein, 8 aa, Staphylococcus
QVAQDNQL

SEQ ID NO: 1978378 - protein, 8 aa, Staphylococcus
QVAQQERA

SEQ ID NO: 1978379 - protein, 7 aa, Staphylococcus
QVASEHH

SEQ ID NO: 1978380 - protein, 9 aa, Staphylococcus
QVASGRFGV

SEQ ID NO: 1978381 - protein, 12 aa, Staphylococcus
QVATKGSHVINE

SEQ ID NO: 1978382 - protein, 5 aa, Staphylococcus
QVDEE

SEQ ID NO: 1978383 - protein, 14 aa, Staphylococcus
QVDLEDTKLTPENL

SEQ ID NO: 1978384 - protein, 14 aa, Staphylococcus
QVDLEETKLTPENL

SEQ ID NO: 1978385 - protein, 9 aa, Staphylococcus
QVDTANTQM

SEQ ID NO: 1978386 - protein, 13 aa, Staphylococcus
QVDTTERETALGN

SEQ ID NO: 1978387 - protein, 8 aa, Staphylococcus
QVEAEGAD

SEQ ID NO: 1978388 - protein, 5 aa, Staphylococcus
QVEAG

SEQ ID NO: 1978389 - protein, 4 aa, Staphylococcus
QVEE

SEQ ID NO: 1978390 - protein, 6 aa, Staphylococcus
QVEESL

SEQ ID NO: 1978391 - protein, 8 aa, Staphylococcus
QVEKNLPG

SEQ ID NO: 1978392 - protein, 6 aa, Staphylococcus
QVELQD

SEQ ID NO: 1978393 - protein, 6 aa, Staphylococcus
QVENGN

SEQ ID NO: 1978394 - protein, 5 aa, Staphylococcus
QVENS

SEQ ID NO: 1978395 - protein, 9 aa, Staphylococcus
QVENSNGEA

SEQ ID NO: 1978396 - protein, 5 aa, Staphylococcus
QVEQQ

SEQ ID NO: 1978397 - protein, 21 aa, Staphylococcus
QVEQQGKTVTLKETADYEMPE

SEQ ID NO: 1978398 - protein, 4 aa, Staphylococcus
QVER

SEQ ID NO: 1978399 - protein, 10 aa, Staphylococcus
QVERSDGEAF

SEQ ID NO: 1978400 - protein, 12 aa, Staphylococcus
QVESTSQSPSLS

SEQ ID NO: 1978401 - protein, 17 aa, Staphylococcus
QVEVETPKEDTESHKDE

SEQ ID NO: 1978402 - protein, 11 aa, Staphylococcus
QVGGSDQWGNI

SEQ ID NO: 1978403 - protein, 6 aa, Staphylococcus
QVGNDR

SEQ ID NO: 1978404 - protein, 15 aa, Staphylococcus
QVGQTVESGSEADIK

SEQ ID NO: 1978405 - protein, 8 aa, Staphylococcus
QVGRKEAV

SEQ ID NO: 1978406 - protein, 7 aa, Staphylococcus
QVGSSHK

SEQ ID NO: 1978407 - protein, 6 aa, Staphylococcus
QVGTQH

SEQ ID NO: 1978408 - protein, 7 aa, Staphylococcus
QVGYNED

SEQ ID NO: 1978409 - protein, 11 aa, Staphylococcus
QVHEKEGQLPD

SEQ ID NO: 1978410 - protein, 6 aa, Staphylococcus
QVHGDL

SEQ ID NO: 1978411 - protein, 13 aa, Staphylococcus
QVKAKIVKKNQIE

SEQ ID NO: 1978412 - protein, 13 aa, Staphylococcus
QVKAKIVKKNQIS

SEQ ID NO: 1978413 - protein, 13 aa, Staphylococcus
QVKAKIVKKNQIT

SEQ ID NO: 1978414 - protein, 5 aa, Staphylococcus
QVKAS

SEQ ID NO: 1978415 - protein, 4 aa, Staphylococcus
QVKE

SEQ ID NO: 1978416 - protein, 11 aa, Staphylococcus
QVKEAANQYSE

SEQ ID NO: 1978417 - protein, 13 aa, Staphylococcus
QVKKSNANDFNEG

SEQ ID NO: 1978418 - protein, 8 aa, Staphylococcus
QVKNELGQ

SEQ ID NO: 1978419 - protein, 8 aa, Staphylococcus
QVKNQEGK

SEQ ID NO: 1978420 - protein, 10 aa, Staphylococcus
QVKPDKGTVY

SEQ ID NO: 1978421 - protein, 8 aa, Staphylococcus
QVKQASND

SEQ ID NO: 1978422 - protein, 10 aa, Staphylococcus
QVKTGETAPE

SEQ ID NO: 1978423 - protein, 10 aa, Staphylococcus
QVKVKSDDQV

SEQ ID NO: 1978424 - protein, 10 aa, Staphylococcus
QVLEPSDMEQ

SEQ ID NO: 1978425 - protein, 8 aa, Staphylococcus
QVLSEQDD

SEQ ID NO: 1978426 - protein, 10 aa, Staphylococcus
QVMTPNNKQQ

SEQ ID NO: 1978427 - protein, 7 aa, Staphylococcus
QVNEKIR

SEQ ID NO: 1978428 - protein, 7 aa, Staphylococcus
QVNGDGR

SEQ ID NO: 1978429 - protein, 14 aa, Staphylococcus
QVNHDEAETANQVD

SEQ ID NO: 1978430 - protein, 12 aa, Staphylococcus
QVNKEKDQQHID

SEQ ID NO: 1978431 - protein, 5 aa, Staphylococcus
QVNPE

SEQ ID NO: 1978432 - protein, 10 aa, Staphylococcus
QVNSLSDDVR

SEQ ID NO: 1978433 - protein, 10 aa, Staphylococcus
QVNTKREELK

SEQ ID NO: 1978434 - protein, 8 aa, Staphylococcus
QVNTLGDD

SEQ ID NO: 1978435 - protein, 8 aa, Staphylococcus
QVNYRGTD

SEQ ID NO: 1978436 - protein, 22 aa, Staphylococcus
QVPEGAPFGGYKKSGIGRETYK

SEQ ID NO: 1978437 - protein, 23 aa, Staphylococcus
QVPEGAPFGGYKKSGIGRETYKG

SEQ ID NO: 1978438 - protein, 12 aa, Staphylococcus
QVPGTGFEGRVT

SEQ ID NO: 1978439 - protein, 6 aa, Staphylococcus
QVPHNE

SEQ ID NO: 1978440 - protein, 5 aa, Staphylococcus
QVPMK

SEQ ID NO: 1978441 - protein, 6 aa, Staphylococcus
QVPNDG

SEQ ID NO: 1978442 - protein, 5 aa, Staphylococcus
QVPNV

SEQ ID NO: 1978443 - protein, 7 aa, Staphylococcus
QVPPYPL

SEQ ID NO: 1978444 - protein, 6 aa, Staphylococcus
QVPQHE

SEQ ID NO: 1978445 - protein, 9 aa, Staphylococcus
QVPQVTPAS

SEQ ID NO: 1978446 - protein, 11 aa, Staphylococcus
QVPREDMDEQI

SEQ ID NO: 1978447 - protein, 6 aa, Staphylococcus
QVPREE

SEQ ID NO: 1978448 - protein, 6 aa, Staphylococcus
QVPRKE

SEQ ID NO: 1978449 - protein, 10 aa, Staphylococcus
QVPRQDMDEA

SEQ ID NO: 1978450 - protein, 5 aa, Staphylococcus
QVPSI

SEQ ID NO: 1978451 - protein, 11 aa, Staphylococcus
QVPSKATSSFR

SEQ ID NO: 1978452 - protein, 10 aa, Staphylococcus
QVPTREPNIS

SEQ ID NO: 1978453 - protein, 18 aa, Staphylococcus
QVQNETTPRIKTSSPEFD

SEQ ID NO: 1978454 - protein, 10 aa, Staphylococcus
QVQQNSACKK

SEQ ID NO: 1978455 - protein, 4 aa, Staphylococcus
QVQR

SEQ ID NO: 1978456 - protein, 8 aa, Staphylococcus
QVQSIDDK

SEQ ID NO: 1978457 - protein, 9 aa, Staphylococcus
QVQSSKAKR

SEQ ID NO: 1978458 - protein, 4 aa, Staphylococcus
QVRD

SEQ ID NO: 1978459 - protein, 6 aa, Staphylococcus
QVRNNE

SEQ ID NO: 1978460 - protein, 5 aa, Staphylococcus
QVRPD

SEQ ID NO: 1978461 - protein, 13 aa, Staphylococcus
QVRPRSGKSLKTK

SEQ ID NO: 1978462 - protein, 5 aa, Staphylococcus
QVRTD

SEQ ID NO: 1978463 - protein, 5 aa, Staphylococcus
QVRVD

SEQ ID NO: 1978464 - protein, 10 aa, Staphylococcus
QVSDDPKYRS

SEQ ID NO: 1978465 - protein, 6 aa, Staphylococcus
QVSDGS

SEQ ID NO: 1978466 - protein, 10 aa, Staphylococcus
QVSDQAKQDG

SEQ ID NO: 1978467 - protein, 10 aa, Staphylococcus
QVSDQAQKNG

SEQ ID NO: 1978468 - protein, 8 aa, Staphylococcus
QVSKTTVS

SEQ ID NO: 1978469 - protein, 7 aa, Staphylococcus
QVSNVEN

SEQ ID NO: 1978470 - protein, 8 aa, Staphylococcus
QVSQPRRP

SEQ ID NO: 1978471 - protein, 11 aa, Staphylococcus
QVSREKKMSQI

SEQ ID NO: 1978472 - protein, 22 aa, Staphylococcus
QVSSTGKYAKSTYRTLNSKQNV

SEQ ID NO: 1978473 - protein, 4 aa, Staphylococcus
QVSY

SEQ ID NO: 1978474 - protein, 7 aa, Staphylococcus
QVTATTV

SEQ ID NO: 1978475 - protein, 12 aa, Staphylococcus
QVTGKEFDTSKL

SEQ ID NO: 1978476 - protein, 6 aa, Staphylococcus
QVTPGD

SEQ ID NO: 1978477 - protein, 7 aa, Staphylococcus
QVTPTSL

SEQ ID NO: 1978478 - protein, 5 aa, Staphylococcus
QVTQP

SEQ ID NO: 1978479 - protein, 7 aa, Staphylococcus
QVTREAV

SEQ ID NO: 1978480 - protein, 7 aa, Staphylococcus
QVTRPRG

SEQ ID NO: 1978481 - protein, 5 aa, Staphylococcus
QVTSP

SEQ ID NO: 1978482 - protein, 5 aa, Staphylococcus
QVTST

SEQ ID NO: 1978483 - protein, 5 aa, Staphylococcus
QVTTQ

SEQ ID NO: 1978484 - protein, 17 aa, Staphylococcus
QVVDQESLKSALNKGNV

SEQ ID NO: 1978485 - protein, 8 aa, Staphylococcus
QVVERPER

SEQ ID NO: 1978486 - protein, 15 aa, Staphylococcus
QVVSGKSSAKQTLSN

SEQ ID NO: 1978487 - protein, 6 aa, Staphylococcus
QVVTST

SEQ ID NO: 1978488 - protein, 8 aa, Staphylococcus
QVYPQDTN

SEQ ID NO: 1978489 - protein, 9 aa, Staphylococcus
QWAKSNAAE

SEQ ID NO: 1978490 - protein, 9 aa, Staphylococcus
QWATSGGLG

SEQ ID NO: 1978491 - protein, 8 aa, Staphylococcus
QWEPSKKI

SEQ ID NO: 1978492 - protein, 5 aa, Staphylococcus
QWPIN

SEQ ID NO: 1978493 - protein, 16 aa, Staphylococcus
QWQGHQHGNHNDAVEG

SEQ ID NO: 1978494 - protein, 6 aa, Staphylococcus
QYADTR

SEQ ID NO: 1978495 - protein, 10 aa, Staphylococcus
QYAKESAKQI

SEQ ID NO: 1978496 - protein, 5 aa, Staphylococcus
QYAPE

SEQ ID NO: 1978497 - protein, 6 aa, Staphylococcus
QYAPSD

SEQ ID NO: 1978498 - protein, 5 aa, Staphylococcus
QYAQQ

SEQ ID NO: 1978499 - protein, 9 aa, Staphylococcus
QYATDATKK

SEQ ID NO: 1978500 - protein, 10 aa, Staphylococcus
QYDEENRQLD

SEQ ID NO: 1978501 - protein, 8 aa, Staphylococcus
QYDEKSDD

SEQ ID NO: 1978502 - protein, 8 aa, Staphylococcus
QYDEKTDA

SEQ ID NO: 1978503 - protein, 8 aa, Staphylococcus
QYDEKTDE

SEQ ID NO: 1978504 - protein, 19 aa, Staphylococcus
QYDKTSAPVADVTEDVEIT

SEQ ID NO: 1978505 - protein, 7 aa, Staphylococcus
QYDPALS

SEQ ID NO: 1978506 - protein, 7 aa, Staphylococcus
QYDSTKL

SEQ ID NO: 1978507 - protein, 7 aa, Staphylococcus
QYDTPDN

SEQ ID NO: 1978508 - protein, 7 aa, Staphylococcus
QYEDGRF

SEQ ID NO: 1978509 - protein, 6 aa, Staphylococcus
QYEEST

SEQ ID NO: 1978510 - protein, 10 aa, Staphylococcus
QYEESTIPAV

SEQ ID NO: 1978511 - protein, 6 aa, Staphylococcus
QYEHYG

SEQ ID NO: 1978512 - protein, 9 aa, Staphylococcus
QYEKEAEMK

SEQ ID NO: 1978513 - protein, 7 aa, Staphylococcus
QYENQKQ

SEQ ID NO: 1978514 - protein, 35 aa, Staphylococcus
QYEQKKKQLEQAIKNKQQRAQGATKVPKGIGAHEA

SEQ ID NO: 1978515 - protein, 20 aa, Staphylococcus
QYERPQKNNYELSDQPLTQE

SEQ ID NO: 1978516 - protein, 5 aa, Staphylococcus
QYERY

SEQ ID NO: 1978517 - protein, 4 aa, Staphylococcus
QYES

SEQ ID NO: 1978518 - protein, 13 aa, Staphylococcus
QYETQEKEKQSHV

SEQ ID NO: 1978519 - protein, 6 aa, Staphylococcus
QYFDKT

SEQ ID NO: 1978520 - protein, 16 aa, Staphylococcus
QYGDKPLDLPHTDTEQ

SEQ ID NO: 1978521 - protein, 11 aa, Staphylococcus
QYGEDTAEQHD

SEQ ID NO: 1978522 - protein, 17 aa, Staphylococcus
QYGESTENNYKQAIQEL

SEQ ID NO: 1978523 - protein, 24 aa, Staphylococcus
QYGGKRKNYYGDGEDALVMWVKLH

SEQ ID NO: 1978524 - protein, 24 aa, Staphylococcus
QYGGKRKNYYGEGEDALVMWVNLN

SEQ ID NO: 1978525 - protein, 8 aa, Staphylococcus
QYGKETDG

SEQ ID NO: 1978526 - protein, 9 aa, Staphylococcus
QYGKETDGY

SEQ ID NO: 1978527 - protein, 7 aa, Staphylococcus
QYGNHNV

SEQ ID NO: 1978528 - protein, 8 aa, Staphylococcus
QYGNQIQE

SEQ ID NO: 1978529 - protein, 11 aa, Staphylococcus
QYGPGEINGQP

SEQ ID NO: 1978530 - protein, 10 aa, Staphylococcus
QYGQKTDSTM

SEQ ID NO: 1978531 - protein, 4 aa, Staphylococcus
QYGT

SEQ ID NO: 1978532 - protein, 6 aa, Staphylococcus
QYGTLS

SEQ ID NO: 1978533 - protein, 5 aa, Staphylococcus
QYGVH

SEQ ID NO: 1978534 - protein, 9 aa, Staphylococcus
QYGVPSREL

SEQ ID NO: 1978535 - protein, 15 aa, Staphylococcus
QYHSNDKFPSKRQLS

SEQ ID NO: 1978536 - protein, 4 aa, Staphylococcus
QYHT

SEQ ID NO: 1978537 - protein, 46 aa, Staphylococcus
QYIGESSLDEDHNDEDINDGQSNNVSESTTTTSFKEDQIGASSYNY

SEQ ID NO: 1978538 - protein, 7 aa, Staphylococcus
QYIPSEP

SEQ ID NO: 1978539 - protein, 10 aa, Staphylococcus
QYISGEETGH

SEQ ID NO: 1978540 - protein, 16 aa, Staphylococcus
QYITKEKSNSMGKGKL

SEQ ID NO: 1978541 - protein, 17 aa, Staphylococcus
QYKAKKKELEDLESADQ

SEQ ID NO: 1978542 - protein, 9 aa, Staphylococcus
QYKEKIKGK

SEQ ID NO: 1978543 - protein, 11 aa, Staphylococcus
QYKNEDDTIEG

SEQ ID NO: 1978544 - protein, 8 aa, Staphylococcus
QYKNKKYN

SEQ ID NO: 1978545 - protein, 9 aa, Staphylococcus
QYKNKNPKV

SEQ ID NO: 1978546 - protein, 4 aa, Staphylococcus
QYKQ

SEQ ID NO: 1978547 - protein, 5 aa, Staphylococcus
QYLPS

SEQ ID NO: 1978548 - protein, 20 aa, Staphylococcus
QYLSDEKAYELGKSEDEAHK

SEQ ID NO: 1978549 - protein, 12 aa, Staphylococcus
QYLTAGKDNPNC

SEQ ID NO: 1978550 - protein, 29 aa, Staphylococcus
QYNEEVKSGAFPSEAHTYKKKIMSEVNKN

SEQ ID NO: 1978551 - protein, 9 aa, Staphylococcus
QYNEKNAKL

SEQ ID NO: 1978552 - protein, 13 aa, Staphylococcus
QYNEVKEQSHNEA

SEQ ID NO: 1978553 - protein, 10 aa, Staphylococcus
QYNKENNPEN

SEQ ID NO: 1978554 - protein, 16 aa, Staphylococcus
QYNNEVKAEQFPGEAH

SEQ ID NO: 1978555 - protein, 11 aa, Staphylococcus
QYNPGGSVKDR

SEQ ID NO: 1978556 - protein, 12 aa, Staphylococcus
QYNPGGSVKDRL

SEQ ID NO: 1978557 - protein, 12 aa, Staphylococcus
QYNSDKEKQINE

SEQ ID NO: 1978558 - protein, 13 aa, Staphylococcus
QYNSHSDSGTTKF

SEQ ID NO: 1978559 - protein, 10 aa, Staphylococcus
QYNTSTLADD

SEQ ID NO: 1978560 - protein, 5 aa, Staphylococcus
QYNVE

SEQ ID NO: 1978561 - protein, 6 aa, Staphylococcus
QYNVNG

SEQ ID NO: 1978562 - protein, 7 aa, Staphylococcus
QYNVNGE

SEQ ID NO: 1978563 - protein, 11 aa, Staphylococcus
QYPADDQSAPW

SEQ ID NO: 1978564 - protein, 11 aa, Staphylococcus
QYPADDQSSPW

SEQ ID NO: 1978565 - protein, 5 aa, Staphylococcus
QYPDP

SEQ ID NO: 1978566 - protein, 4 aa, Staphylococcus
QYPE

SEQ ID NO: 1978567 - protein, 12 aa, Staphylococcus
QYPEGDFWKSKM

SEQ ID NO: 1978568 - protein, 9 aa, Staphylococcus
QYPEPSFEE

SEQ ID NO: 1978569 - protein, 5 aa, Staphylococcus
QYPEY

SEQ ID NO: 1978570 - protein, 4 aa, Staphylococcus
QYPG

SEQ ID NO: 1978571 - protein, 8 aa, Staphylococcus
QYPGEGQE

SEQ ID NO: 1978572 - protein, 4 aa, Staphylococcus
QYPN

SEQ ID NO: 1978573 - protein, 14 aa, Staphylococcus
QYPNSTITSLTTEN

SEQ ID NO: 1978574 - protein, 14 aa, Staphylococcus
QYPSHTNDETFNDE

SEQ ID NO: 1978575 - protein, 13 aa, Staphylococcus
QYPSTLSGGESQR

SEQ ID NO: 1978576 - protein, 10 aa, Staphylococcus
QYQDYSQSHP

SEQ ID NO: 1978577 - protein, 6 aa, Staphylococcus
QYQEEQ

SEQ ID NO: 1978578 - protein, 7 aa, Staphylococcus
QYQEKGN

SEQ ID NO: 1978579 - protein, 7 aa, Staphylococcus
QYQGNKF

SEQ ID NO: 1978580 - protein, 9 aa, Staphylococcus
QYQNSDESL

SEQ ID NO: 1978581 - protein, 7 aa, Staphylococcus
QYQNSGL

SEQ ID NO: 1978582 - protein, 4 aa, Staphylococcus
QYQP

SEQ ID NO: 1978583 - protein, 9 aa, Staphylococcus
QYQPPSHQV

SEQ ID NO: 1978584 - protein, 8 aa, Staphylococcus
QYQQTEDK

SEQ ID NO: 1978585 - protein, 8 aa, Staphylococcus
QYQQTTRK

SEQ ID NO: 1978586 - protein, 8 aa, Staphylococcus
QYQQYQNY

SEQ ID NO: 1978587 - protein, 7 aa, Staphylococcus
QYQSANE

SEQ ID NO: 1978588 - protein, 7 aa, Staphylococcus
QYQSDTA

SEQ ID NO: 1978589 - protein, 10 aa, Staphylococcus
QYQSNTLDHR

SEQ ID NO: 1978590 - protein, 11 aa, Staphylococcus
QYQTEDRKPAD

SEQ ID NO: 1978591 - protein, 5 aa, Staphylococcus
QYQYY

SEQ ID NO: 1978592 - protein, 5 aa, Staphylococcus
QYREE

SEQ ID NO: 1978593 - protein, 14 aa, Staphylococcus
QYRGSGENENQTIE

SEQ ID NO: 1978594 - protein, 14 aa, Staphylococcus
QYRGTTKEQPNTIE

SEQ ID NO: 1978595 - protein, 5 aa, Staphylococcus
QYRGY

SEQ ID NO: 1978596 - protein, 15 aa, Staphylococcus
QYRPEDPAEQSRLSN

SEQ ID NO: 1978597 - protein, 12 aa, Staphylococcus
QYSARSGKNLQS

SEQ ID NO: 1978598 - protein, 4 aa, Staphylococcus
QYSD

SEQ ID NO: 1978599 - protein, 6 aa, Staphylococcus
QYSDET

SEQ ID NO: 1978600 - protein, 11 aa, Staphylococcus
QYSDLTDDQIQ

SEQ ID NO: 1978601 - protein, 10 aa, Staphylococcus
QYSDNINELD

SEQ ID NO: 1978602 - protein, 15 aa, Staphylococcus
QYSEAELKGLIEELN

SEQ ID NO: 1978603 - protein, 22 aa, Staphylococcus
QYSEREQSLRRYDSRSFEEQGL

SEQ ID NO: 1978604 - protein, 7 aa, Staphylococcus
QYSETYH

SEQ ID NO: 1978605 - protein, 5 aa, Staphylococcus
QYSIT

SEQ ID NO: 1978606 - protein, 8 aa, Staphylococcus
QYSKPEVD

SEQ ID NO: 1978607 - protein, 6 aa, Staphylococcus
QYSPDR

SEQ ID NO: 1978608 - protein, 6 aa, Staphylococcus
QYSPQT

SEQ ID NO: 1978609 - protein, 5 aa, Staphylococcus
QYSTD

SEQ ID NO: 1978610 - protein, 14 aa, Staphylococcus
QYSTTSPNKVHRSN

SEQ ID NO: 1978611 - protein, 10 aa, Staphylococcus
QYTDEKFNDA

SEQ ID NO: 1978612 - protein, 5 aa, Staphylococcus
QYTDQ

SEQ ID NO: 1978613 - protein, 12 aa, Staphylococcus
QYTEDNTKLDQR

SEQ ID NO: 1978614 - protein, 7 aa, Staphylococcus
QYTESDI

SEQ ID NO: 1978615 - protein, 14 aa, Staphylococcus
QYTESELEDLLTAM

SEQ ID NO: 1978616 - protein, 8 aa, Staphylococcus
QYTHASNA

SEQ ID NO: 1978617 - protein, 7 aa, Staphylococcus
QYTHSTK

SEQ ID NO: 1978618 - protein, 9 aa, Staphylococcus
QYTKEDDSE

SEQ ID NO: 1978619 - protein, 6 aa, Staphylococcus
QYTKNE

SEQ ID NO: 1978620 - protein, 32 aa, Staphylococcus
QYTPRRNATEGLKQDVSDDKTVENNDNDYTYK

SEQ ID NO: 1978621 - protein, 7 aa, Staphylococcus
QYTQGGV

SEQ ID NO: 1978622 - protein, 5 aa, Staphylococcus
QYTQN

SEQ ID NO: 1978623 - protein, 44 aa, Staphylococcus
QYTQQAPLAPATSTMATPNQSATESPVPQNNDQIDKDDSSYQTI

SEQ ID NO: 1978624 - protein, 22 aa, Staphylococcus
QYTQSGKVARNKMRTVYVKGGF

SEQ ID NO: 1978625 - protein, 8 aa, Staphylococcus
QYTSDNKG

SEQ ID NO: 1978626 - protein, 5 aa, Staphylococcus
QYVGE

SEQ ID NO: 1978627 - protein, 12 aa, Staphylococcus
QYYGQEYNSTTY

SEQ ID NO: 1978628 - protein, 7 aa, Staphylococcus
RAADSIS

SEQ ID NO: 1978629 - protein, 7 aa, Staphylococcus
RAAEEEI

SEQ ID NO: 1978630 - protein, 10 aa, Staphylococcus
RAAEKAGIEG

SEQ ID NO: 1978631 - protein, 8 aa, Staphylococcus
RAAENDIQ

SEQ ID NO: 1978632 - protein, 16 aa, Staphylococcus
RAAHGYGGKRTPKVTS

SEQ ID NO: 1978633 - protein, 8 aa, Staphylococcus
RAAKDNLE

SEQ ID NO: 1978634 - protein, 7 aa, Staphylococcus
RAAKEEI

SEQ ID NO: 1978635 - protein, 11 aa, Staphylococcus
RAAPAEGDGEI

SEQ ID NO: 1978636 - protein, 36 aa, Staphylococcus
RAAQDKIDKTDKMDDPEMARPSALQAPLESKTASFS

SEQ ID NO: 1978637 - protein, 7 aa, Staphylococcus
RAAQEDI

SEQ ID NO: 1978638 - protein, 8 aa, Staphylococcus
RAARDHGL

SEQ ID NO: 1978639 - protein, 8 aa, Staphylococcus
RAARNEHG

SEQ ID NO: 1978640 - protein, 9 aa, Staphylococcus
RAARNEKGE

SEQ ID NO: 1978641 - protein, 9 aa, Staphylococcus
RAARNSRGE

SEQ ID NO: 1978642 - protein, 8 aa, Staphylococcus
RAATPTQA

SEQ ID NO: 1978643 - protein, 7 aa, Staphylococcus
RACGTTI

SEQ ID NO: 1978644 - protein, 8 aa, Staphylococcus
RACGTTID

SEQ ID NO: 1978645 - protein, 7 aa, Staphylococcus
RACSTTI

SEQ ID NO: 1978646 - protein, 6 aa, Staphylococcus
RADEGI

SEQ ID NO: 1978647 - protein, 8 aa, Staphylococcus
RADENEAA

SEQ ID NO: 1978648 - protein, 25 aa, Staphylococcus
RADEVEKTLSANGFKGPFLERVRES

SEQ ID NO: 1978649 - protein, 5 aa, Staphylococcus
RADLR

SEQ ID NO: 1978650 - protein, 9 aa, Staphylococcus
RADNPDEEV

SEQ ID NO: 1978651 - protein, 4 aa, Staphylococcus
RADV

SEQ ID NO: 1978652 - protein, 6 aa, Staphylococcus
RADYER

SEQ ID NO: 1978653 - protein, 14 aa, Staphylococcus
RAEAQRRNIQETED

SEQ ID NO: 1978654 - protein, 9 aa, Staphylococcus
RAEDGRGIQ

SEQ ID NO: 1978655 - protein, 10 aa, Staphylococcus
RAEDGRNVEN

SEQ ID NO: 1978656 - protein, 9 aa, Staphylococcus
RAEDGRSIE

SEQ ID NO: 1978657 - protein, 7 aa, Staphylococcus
RAEEEME

SEQ ID NO: 1978658 - protein, 7 aa, Staphylococcus
RAEEGGD

SEQ ID NO: 1978659 - protein, 10 aa, Staphylococcus
RAEEKGAKVI

SEQ ID NO: 1978660 - protein, 8 aa, Staphylococcus
RAEENGAE

SEQ ID NO: 1978661 - protein, 4 aa, Staphylococcus
RAEH

SEQ ID NO: 1978662 - protein, 6 aa, Staphylococcus
RAEHRP

SEQ ID NO: 1978663 - protein, 7 aa, Staphylococcus
RAEKEME

SEQ ID NO: 1978664 - protein, 5 aa, Staphylococcus
RAEKG

SEQ ID NO: 1978665 - protein, 9 aa, Staphylococcus
RAENPDEEV

SEQ ID NO: 1978666 - protein, 9 aa, Staphylococcus
RAENPEEEV

SEQ ID NO: 1978667 - protein, 6 aa, Staphylococcus
RAEPAW

SEQ ID NO: 1978668 - protein, 7 aa, Staphylococcus
RAEQKPK

SEQ ID NO: 1978669 - protein, 46 aa, Staphylococcus
RAEQNTAAEMPQTELTEQKQETSSEDNIKSTKPVAHEGIRKGPNLK

SEQ ID NO: 1978670 - protein, 4 aa, Staphylococcus
RAER

SEQ ID NO: 1978671 - protein, 9 aa, Staphylococcus
RAESFSKNK

SEQ ID NO: 1978672 - protein, 13 aa, Staphylococcus
RAESYGKGAYRES

SEQ ID NO: 1978673 - protein, 15 aa, Staphylococcus
RAEYSGIGTVEFKVS

SEQ ID NO: 1978674 - protein, 10 aa, Staphylococcus
RAGASYDDIE

SEQ ID NO: 1978675 - protein, 14 aa, Staphylococcus
RAGASYDDIEDSKI

SEQ ID NO: 1978676 - protein, 5 aa, Staphylococcus
RAGEI

SEQ ID NO: 1978677 - protein, 21 aa, Staphylococcus
RAGEPPHGKVRQTQDDVVEWI

SEQ ID NO: 1978678 - protein, 5 aa, Staphylococcus
RAGFD

SEQ ID NO: 1978679 - protein, 21 aa, Staphylococcus
RAGGAYESKLETDPQRKIDNK

SEQ ID NO: 1978680 - protein, 35 aa, Staphylococcus
RAGGKVGSTWGNANNWASAAAAAGYTVNNSPAAGA

SEQ ID NO: 1978681 - protein, 11 aa, Staphylococcus
RAGGSKSPVEL

SEQ ID NO: 1978682 - protein, 8 aa, Staphylococcus
RAGKERED

SEQ ID NO: 1978683 - protein, 9 aa, Staphylococcus
RAGKNEDVL

SEQ ID NO: 1978684 - protein, 6 aa, Staphylococcus
RAGRYA

SEQ ID NO: 1978685 - protein, 4 aa, Staphylococcus
RAGV

SEQ ID NO: 1978686 - protein, 27 aa, Staphylococcus
RAGYETSAYATEREGDATLEAERALEQ

SEQ ID NO: 1978687 - protein, 22 aa, Staphylococcus
RAGYETSAYATERVGDATLEAE

SEQ ID NO: 1978688 - protein, 11 aa, Staphylococcus
RAGYSEQDPEE

SEQ ID NO: 1978689 - protein, 5 aa, Staphylococcus
RAHGS

SEQ ID NO: 1978690 - protein, 10 aa, Staphylococcus
RAHKTPKKRG

SEQ ID NO: 1978691 - protein, 9 aa, Staphylococcus
RAIEKPTTR

SEQ ID NO: 1978692 - protein, 5 aa, Staphylococcus
RAIKQ

SEQ ID NO: 1978693 - protein, 10 aa, Staphylococcus
RAINNNGYVK

SEQ ID NO: 1978694 - protein, 7 aa, Staphylococcus
RAIQPNT

SEQ ID NO: 1978695 - protein, 4 aa, Staphylococcus
RAIT

SEQ ID NO: 1978696 - protein, 8 aa, Staphylococcus
RAKAINGN

SEQ ID NO: 1978697 - protein, 8 aa, Staphylococcus
RAKASANE

SEQ ID NO: 1978698 - protein, 13 aa, Staphylococcus
RAKATDKTNPMET

SEQ ID NO: 1978699 - protein, 13 aa, Staphylococcus
RAKATDTTDPMET

SEQ ID NO: 1978700 - protein, 4 aa, Staphylococcus
RAKE

SEQ ID NO: 1978701 - protein, 8 aa, Staphylococcus
RAKEAYDA

SEQ ID NO: 1978702 - protein, 7 aa, Staphylococcus
RAKEPGG

SEQ ID NO: 1978703 - protein, 13 aa, Staphylococcus
RAKEWNNKFSQSN

SEQ ID NO: 1978704 - protein, 7 aa, Staphylococcus
RAKFEKE

SEQ ID NO: 1978705 - protein, 8 aa, Staphylococcus
RAKKQDSY

SEQ ID NO: 1978706 - protein, 7 aa, Staphylococcus
RAKKRGI

SEQ ID NO: 1978707 - protein, 6 aa, Staphylococcus
RAKKRN

SEQ ID NO: 1978708 - protein, 7 aa, Staphylococcus
RAKKRNI

SEQ ID NO: 1978709 - protein, 6 aa, Staphylococcus
RAKNNK

SEQ ID NO: 1978710 - protein, 6 aa, Staphylococcus
RAKQTG

SEQ ID NO: 1978711 - protein, 6 aa, Staphylococcus
RAKRNG

SEQ ID NO: 1978712 - protein, 15 aa, Staphylococcus
RAKSAIETNADNKNE

SEQ ID NO: 1978713 - protein, 14 aa, Staphylococcus
RAKSEAEKSFGNSE

SEQ ID NO: 1978714 - protein, 15 aa, Staphylococcus
RAKSEAENHLVIVKY

SEQ ID NO: 1978715 - protein, 13 aa, Staphylococcus
RAKSEAQKSFGNS

SEQ ID NO: 1978716 - protein, 5 aa, Staphylococcus
RAKSF

SEQ ID NO: 1978717 - protein, 10 aa, Staphylococcus
RAKSIKHETP

SEQ ID NO: 1978718 - protein, 13 aa, Staphylococcus
RAKSQSYGNGAEQ

SEQ ID NO: 1978719 - protein, 15 aa, Staphylococcus
RAKTAISTDAENKNE

SEQ ID NO: 1978720 - protein, 11 aa, Staphylococcus
RAKTDKRSLTA

SEQ ID NO: 1978721 - protein, 5 aa, Staphylococcus
RAKTG

SEQ ID NO: 1978722 - protein, 8 aa, Staphylococcus
RAKWGERS

SEQ ID NO: 1978723 - protein, 9 aa, Staphylococcus
RAKYGYDSQ

SEQ ID NO: 1978724 - protein, 17 aa, Staphylococcus
RAKYITGQTLSVNGGMY

SEQ ID NO: 1978725 - protein, 15 aa, Staphylococcus
RALEAARNDKVIGKS

SEQ ID NO: 1978726 - protein, 11 aa, Staphylococcus
RALEEARNNKV

SEQ ID NO: 1978727 - protein, 11 aa, Staphylococcus
RALEQARNEKV

SEQ ID NO: 1978728 - protein, 8 aa, Staphylococcus
RALGNKSI

SEQ ID NO: 1978729 - protein, 5 aa, Staphylococcus
RALNE

SEQ ID NO: 1978730 - protein, 9 aa, Staphylococcus
RALSNNPYI

SEQ ID NO: 1978731 - protein, 5 aa, Staphylococcus
RALST

SEQ ID NO: 1978732 - protein, 12 aa, Staphylococcus
RAMDEDKSEYLD

SEQ ID NO: 1978733 - protein, 5 aa, Staphylococcus
RAMDG

SEQ ID NO: 1978734 - protein, 9 aa, Staphylococcus
RAMSGNGRF

SEQ ID NO: 1978735 - protein, 6 aa, Staphylococcus
RAMSKS

SEQ ID NO: 1978736 - protein, 4 aa, Staphylococcus
RAMT

SEQ ID NO: 1978737 - protein, 7 aa, Staphylococcus
RAMTGYQ

SEQ ID NO: 1978738 - protein, 5 aa, Staphylococcus
RANAE

SEQ ID NO: 1978739 - protein, 15 aa, Staphylococcus
RANASSKHKPTTSNF

SEQ ID NO: 1978740 - protein, 7 aa, Staphylococcus
RANDAYN

SEQ ID NO: 1978741 - protein, 8 aa, Staphylococcus
RANDQDYI

SEQ ID NO: 1978742 - protein, 9 aa, Staphylococcus
RANEKEEAW

SEQ ID NO: 1978743 - protein, 9 aa, Staphylococcus
RANENEDAW

SEQ ID NO: 1978744 - protein, 12 aa, Staphylococcus
RANENEESWNDK

SEQ ID NO: 1978745 - protein, 7 aa, Staphylococcus
RANERGI

SEQ ID NO: 1978746 - protein, 5 aa, Staphylococcus
RANEY

SEQ ID NO: 1978747 - protein, 5 aa, Staphylococcus
RANIE

SEQ ID NO: 1978748 - protein, 8 aa, Staphylococcus
RANKKGIK

SEQ ID NO: 1978749 - protein, 17 aa, Staphylococcus
RANKKGIRLSGEANNIR

SEQ ID NO: 1978750 - protein, 5 aa, Staphylococcus
RANKN

SEQ ID NO: 1978751 - protein, 19 aa, Staphylococcus
RANNPEEEVVAKPDDSAEF

SEQ ID NO: 1978752 - protein, 5 aa, Staphylococcus
RANQY

SEQ ID NO: 1978753 - protein, 6 aa, Staphylococcus
RANSNH

SEQ ID NO: 1978754 - protein, 4 aa, Staphylococcus
RANV

SEQ ID NO: 1978755 - protein, 8 aa, Staphylococcus
RANVQPGS

SEQ ID NO: 1978756 - protein, 15 aa, Staphylococcus
RAPGSVGMASDASKV

SEQ ID NO: 1978757 - protein, 31 aa, Staphylococcus
RAPGSVGMASDASRVFKGQKAPGRMGGNTVT

SEQ ID NO: 1978758 - protein, 7 aa, Staphylococcus
RAPKVEP

SEQ ID NO: 1978759 - protein, 10 aa, Staphylococcus
RAPKVEPPEM

SEQ ID NO: 1978760 - protein, 9 aa, Staphylococcus
RAPKVEPPL

SEQ ID NO: 1978761 - protein, 9 aa, Staphylococcus
RAPKVKPPE

SEQ ID NO: 1978762 - protein, 5 aa, Staphylococcus
RAPLQ

SEQ ID NO: 1978763 - protein, 4 aa, Staphylococcus
RAQD

SEQ ID NO: 1978764 - protein, 6 aa, Staphylococcus
RAQDKE

SEQ ID NO: 1978765 - protein, 7 aa, Staphylococcus
RAQDKGI

SEQ ID NO: 1978766 - protein, 14 aa, Staphylococcus
RAQDSGDKRELNQV

SEQ ID NO: 1978767 - protein, 7 aa, Staphylococcus
RAQEAGV

SEQ ID NO: 1978768 - protein, 5 aa, Staphylococcus
RAQER

SEQ ID NO: 1978769 - protein, 26 aa, Staphylococcus
RAQESRKEFNDEVEARNAVERPQGTI

SEQ ID NO: 1978770 - protein, 4 aa, Staphylococcus
RAQG

SEQ ID NO: 1978771 - protein, 11 aa, Staphylococcus
RAQGSQGYGGE

SEQ ID NO: 1978772 - protein, 4 aa, Staphylococcus
RAQH

SEQ ID NO: 1978773 - protein, 14 aa, Staphylococcus
RAQHNDAVGPTKGG

SEQ ID NO: 1978774 - protein, 13 aa, Staphylococcus
RAQHRGGRGVQGM

SEQ ID NO: 1978775 - protein, 14 aa, Staphylococcus
RAQKNPDTGELNGA

SEQ ID NO: 1978776 - protein, 6 aa, Staphylococcus
RAQKSG

SEQ ID NO: 1978777 - protein, 10 aa, Staphylococcus
RAQKVQEEDF

SEQ ID NO: 1978778 - protein, 7 aa, Staphylococcus
RAQQAGV

SEQ ID NO: 1978779 - protein, 11 aa, Staphylococcus
RAQQNAQQLAQ

SEQ ID NO: 1978780 - protein, 4 aa, Staphylococcus
RAQS

SEQ ID NO: 1978781 - protein, 6 aa, Staphylococcus
RAQSKD

SEQ ID NO: 1978782 - protein, 7 aa, Staphylococcus
RAQSKDI

SEQ ID NO: 1978783 - protein, 11 aa, Staphylococcus
RAQSPTRANTD

SEQ ID NO: 1978784 - protein, 5 aa, Staphylococcus
RAQSV

SEQ ID NO: 1978785 - protein, 11 aa, Staphylococcus
RAQTGLKGKTL

SEQ ID NO: 1978786 - protein, 7 aa, Staphylococcus
RARDDQR

SEQ ID NO: 1978787 - protein, 8 aa, Staphylococcus
RARDDQSI

SEQ ID NO: 1978788 - protein, 6 aa, Staphylococcus
RAREAG

SEQ ID NO: 1978789 - protein, 7 aa, Staphylococcus
RAREAGV

SEQ ID NO: 1978790 - protein, 7 aa, Staphylococcus
RAREDGV

SEQ ID NO: 1978791 - protein, 7 aa, Staphylococcus
RARENGV

SEQ ID NO: 1978792 - protein, 18 aa, Staphylococcus
RARFDGEDTRVLDKNGNV

SEQ ID NO: 1978793 - protein, 12 aa, Staphylococcus
RARGEAIKGIKG

SEQ ID NO: 1978794 - protein, 5 aa, Staphylococcus
RARHP

SEQ ID NO: 1978795 - protein, 10 aa, Staphylococcus
RARKDPNQTL

SEQ ID NO: 1978796 - protein, 11 aa, Staphylococcus
RARKVRDKDFE

SEQ ID NO: 1978797 - protein, 9 aa, Staphylococcus
RARLSSDGK

SEQ ID NO: 1978798 - protein, 6 aa, Staphylococcus
RARQAC

SEQ ID NO: 1978799 - protein, 12 aa, Staphylococcus
RARQITKEGYVK

SEQ ID NO: 1978800 - protein, 12 aa, Staphylococcus
RARQTTKEGYLK

SEQ ID NO: 1978801 - protein, 12 aa, Staphylococcus
RARQVNKEGYLK

SEQ ID NO: 1978802 - protein, 5 aa, Staphylococcus
RARRT

SEQ ID NO: 1978803 - protein, 11 aa, Staphylococcus
RARSSRAYGSA

SEQ ID NO: 1978804 - protein, 20 aa, Staphylococcus
RARVAAKKAREVTRRKSALD

SEQ ID NO: 1978805 - protein, 6 aa, Staphylococcus
RASAAT

SEQ ID NO: 1978806 - protein, 16 aa, Staphylococcus
RASFSGKQSLKRMLNK

SEQ ID NO: 1978807 - protein, 9 aa, Staphylococcus
RASHYRSAG

SEQ ID NO: 1978808 - protein, 4 aa, Staphylococcus
RASI

SEQ ID NO: 1978809 - protein, 15 aa, Staphylococcus
RASIKNDANFITSTC

SEQ ID NO: 1978810 - protein, 13 aa, Staphylococcus
RASKPNKSEDSKY

SEQ ID NO: 1978811 - protein, 5 aa, Staphylococcus
RASKY

SEQ ID NO: 1978812 - protein, 6 aa, Staphylococcus
RASPFN

SEQ ID NO: 1978813 - protein, 4 aa, Staphylococcus
RASQ

SEQ ID NO: 1978814 - protein, 4 aa, Staphylococcus
RASS

SEQ ID NO: 1978815 - protein, 17 aa, Staphylococcus
RASSDKSSSYYSYYGEE

SEQ ID NO: 1978816 - protein, 6 aa, Staphylococcus
RASSKL

SEQ ID NO: 1978817 - protein, 4 aa, Staphylococcus
RATE

SEQ ID NO: 1978818 - protein, 18 aa, Staphylococcus
RATEKDVDKAVEAAQTAF

SEQ ID NO: 1978819 - protein, 5 aa, Staphylococcus
RATES

SEQ ID NO: 1978820 - protein, 11 aa, Staphylococcus
RATGDISNTEL

SEQ ID NO: 1978821 - protein, 12 aa, Staphylococcus
RATHKNGKEDIA

SEQ ID NO: 1978822 - protein, 4 aa, Staphylococcus
RATI

SEQ ID NO: 1978823 - protein, 12 aa, Staphylococcus
RATNKTAPFPEQ

SEQ ID NO: 1978824 - protein, 7 aa, Staphylococcus
RATPSAK

SEQ ID NO: 1978825 - protein, 5 aa, Staphylococcus
RATQT

SEQ ID NO: 1978826 - protein, 10 aa, Staphylococcus
RATRSALTSV

SEQ ID NO: 1978827 - protein, 7 aa, Staphylococcus
RATRSRL

SEQ ID NO: 1978828 - protein, 8 aa, Staphylococcus
RATSEYET

SEQ ID NO: 1978829 - protein, 14 aa, Staphylococcus
RATSKKLAKLIEEE

SEQ ID NO: 1978830 - protein, 6 aa, Staphylococcus
RATSRH

SEQ ID NO: 1978831 - protein, 5 aa, Staphylococcus
RATYE

SEQ ID NO: 1978832 - protein, 19 aa, Staphylococcus
RATYETYYGETAASQEYLN

SEQ ID NO: 1978833 - protein, 14 aa, Staphylococcus
RAVAERAGLGYTGR

SEQ ID NO: 1978834 - protein, 7 aa, Staphylococcus
RAVGTEG

SEQ ID NO: 1978835 - protein, 9 aa, Staphylococcus
RAVGTNGSL

SEQ ID NO: 1978836 - protein, 10 aa, Staphylococcus
RAVTSGNDSV

SEQ ID NO: 1978837 - protein, 6 aa, Staphylococcus
RAWELT

SEQ ID NO: 1978838 - protein, 8 aa, Staphylococcus
RAYEDLEK

SEQ ID NO: 1978839 - protein, 18 aa, Staphylococcus
RAYENKKQQLFDSFSHTV

SEQ ID NO: 1978840 - protein, 11 aa, Staphylococcus
RAYFGKKDAQQ

SEQ ID NO: 1978841 - protein, 7 aa, Staphylococcus
RAYGAQT

SEQ ID NO: 1978842 - protein, 16 aa, Staphylococcus
RAYGSPMPMKEANDDE

SEQ ID NO: 1978843 - protein, 9 aa, Staphylococcus
RAYGTTADT

SEQ ID NO: 1978844 - protein, 8 aa, Staphylococcus
RAYGTTAE

SEQ ID NO: 1978845 - protein, 4 aa, Staphylococcus
RAYK

SEQ ID NO: 1978846 - protein, 11 aa, Staphylococcus
RAYQEETDDIT

SEQ ID NO: 1978847 - protein, 14 aa, Staphylococcus
RAYSDNSNQMLTEG

SEQ ID NO: 1978848 - protein, 15 aa, Staphylococcus
RAYSDNSNQMLTEGN

SEQ ID NO: 1978849 - protein, 6 aa, Staphylococcus
RCDSNK

SEQ ID NO: 1978850 - protein, 8 aa, Staphylococcus
RCETSDSI

SEQ ID NO: 1978851 - protein, 5 aa, Staphylococcus
RCGNR

SEQ ID NO: 1978852 - protein, 5 aa, Staphylococcus
RCRER

SEQ ID NO: 1978853 - protein, 10 aa, Staphylococcus
RDAASKPELA

SEQ ID NO: 1978854 - protein, 10 aa, Staphylococcus
RDAESVTADG

SEQ ID NO: 1978855 - protein, 12 aa, Staphylococcus
RDAGFDSIRDQN

SEQ ID NO: 1978856 - protein, 4 aa, Staphylococcus
RDAN

SEQ ID NO: 1978857 - protein, 14 aa, Staphylococcus
RDANGQELADGDTV

SEQ ID NO: 1978858 - protein, 5 aa, Staphylococcus
RDANR

SEQ ID NO: 1978859 - protein, 4 aa, Staphylococcus
RDAR

SEQ ID NO: 1978860 - protein, 9 aa, Staphylococcus
RDASSKPEL

SEQ ID NO: 1978861 - protein, 8 aa, Staphylococcus
RDASVEEE

SEQ ID NO: 1978862 - protein, 5 aa, Staphylococcus
RDDAG

SEQ ID NO: 1978863 - protein, 20 aa, Staphylococcus
RDDAGDDAAGDNDESTNIEK

SEQ ID NO: 1978864 - protein, 7 aa, Staphylococcus
RDDAGTF

SEQ ID NO: 1978865 - protein, 8 aa, Staphylococcus
RDDATKVG

SEQ ID NO: 1978866 - protein, 8 aa, Staphylococcus
RDDDEAVR

SEQ ID NO: 1978867 - protein, 5 aa, Staphylococcus
RDDDH

SEQ ID NO: 1978868 - protein, 9 aa, Staphylococcus
RDDDINKAK

SEQ ID NO: 1978869 - protein, 7 aa, Staphylococcus
RDDDKAV

SEQ ID NO: 1978870 - protein, 9 aa, Staphylococcus
RDDDKGVGI

SEQ ID NO: 1978871 - protein, 21 aa, Staphylococcus
RDDDNKHADNPSKEETSEAIE

SEQ ID NO: 1978872 - protein, 6 aa, Staphylococcus
RDDDTD

SEQ ID NO: 1978873 - protein, 8 aa, Staphylococcus
RDDEINKA

SEQ ID NO: 1978874 - protein, 10 aa, Staphylococcus
RDDEKRTSIE

SEQ ID NO: 1978875 - protein, 5 aa, Staphylococcus
RDDGA

SEQ ID NO: 1978876 - protein, 4 aa, Staphylococcus
RDDI

SEQ ID NO: 1978877 - protein, 8 aa, Staphylococcus
RDDIQQRQ

SEQ ID NO: 1978878 - protein, 4 aa, Staphylococcus
RDDK

SEQ ID NO: 1978879 - protein, 12 aa, Staphylococcus
RDDLKEGNRTNG

SEQ ID NO: 1978880 - protein, 7 aa, Staphylococcus
RDDNKAV

SEQ ID NO: 1978881 - protein, 7 aa, Staphylococcus
RDDNMSQ

SEQ ID NO: 1978882 - protein, 4 aa, Staphylococcus
RDDQ

SEQ ID NO: 1978883 - protein, 8 aa, Staphylococcus
RDDQPQQH

SEQ ID NO: 1978884 - protein, 28 aa, Staphylococcus
RDDRYSDERTEQTVKNRQRKKINMNYIG

SEQ ID NO: 1978885 - protein, 7 aa, Staphylococcus
RDDTERV

SEQ ID NO: 1978886 - protein, 8 aa, Staphylococcus
RDDTERVK

SEQ ID NO: 1978887 - protein, 9 aa, Staphylococcus
RDDTERVKS

SEQ ID NO: 1978888 - protein, 9 aa, Staphylococcus
RDDTERVKT

SEQ ID NO: 1978889 - protein, 8 aa, Staphylococcus
RDDTERVQ

SEQ ID NO: 1978890 - protein, 6 aa, Staphylococcus
RDDTLD

SEQ ID NO: 1978891 - protein, 9 aa, Staphylococcus
RDDTQRVKS

SEQ ID NO: 1978892 - protein, 7 aa, Staphylococcus
RDDYSED

SEQ ID NO: 1978893 - protein, 6 aa, Staphylococcus
RDDYSF

SEQ ID NO: 1978894 - protein, 19 aa, Staphylococcus
RDEAGEKAFQDVKDRFLVR

SEQ ID NO: 1978895 - protein, 16 aa, Staphylococcus
RDEAGKHASYKAGGML

SEQ ID NO: 1978896 - protein, 6 aa, Staphylococcus
RDEAIE

SEQ ID NO: 1978897 - protein, 9 aa, Staphylococcus
RDEARVNEY

SEQ ID NO: 1978898 - protein, 10 aa, Staphylococcus
RDEARVNEYS

SEQ ID NO: 1978899 - protein, 8 aa, Staphylococcus
RDEASELI

SEQ ID NO: 1978900 - protein, 7 aa, Staphylococcus
RDEDNQL

SEQ ID NO: 1978901 - protein, 10 aa, Staphylococcus
RDEDSDSKGI

SEQ ID NO: 1978902 - protein, 6 aa, Staphylococcus
RDEDTL

SEQ ID NO: 1978903 - protein, 30 aa, Staphylococcus
RDEEFSPLKNKEGKDSVATATADLERMNII

SEQ ID NO: 1978904 - protein, 6 aa, Staphylococcus
RDEEGQ

SEQ ID NO: 1978905 - protein, 7 aa, Staphylococcus
RDEEGRL

SEQ ID NO: 1978906 - protein, 7 aa, Staphylococcus
RDEEGTV

SEQ ID NO: 1978907 - protein, 8 aa, Staphylococcus
RDEFQQEK

SEQ ID NO: 1978908 - protein, 15 aa, Staphylococcus
RDEGEVTASDITHDS

SEQ ID NO: 1978909 - protein, 16 aa, Staphylococcus
RDEGEVTASDITHDSD

SEQ ID NO: 1978910 - protein, 5 aa, Staphylococcus
RDEGF

SEQ ID NO: 1978911 - protein, 14 aa, Staphylococcus
RDEGRAEISSREIG

SEQ ID NO: 1978912 - protein, 7 aa, Staphylococcus
RDEIAPD

SEQ ID NO: 1978913 - protein, 4 aa, Staphylococcus
RDEK

SEQ ID NO: 1978914 - protein, 5 aa, Staphylococcus
RDEKI

SEQ ID NO: 1978915 - protein, 16 aa, Staphylococcus
RDEKKQDDMRKKYNNA

SEQ ID NO: 1978916 - protein, 17 aa, Staphylococcus
RDEKKQDDMRKKYNNPK

SEQ ID NO: 1978917 - protein, 10 aa, Staphylococcus
RDEKNAEVKE

SEQ ID NO: 1978918 - protein, 5 aa, Staphylococcus
RDELA

SEQ ID NO: 1978919 - protein, 25 aa, Staphylococcus
RDELAEQGYMKQRKQSKKKKKQTMQ

SEQ ID NO: 1978920 - protein, 7 aa, Staphylococcus
RDELEDV

SEQ ID NO: 1978921 - protein, 13 aa, Staphylococcus
RDELEDVASDNEV

SEQ ID NO: 1978922 - protein, 6 aa, Staphylococcus
RDELEE

SEQ ID NO: 1978923 - protein, 13 aa, Staphylococcus
RDELESATGQRLT

SEQ ID NO: 1978924 - protein, 9 aa, Staphylococcus
RDELESENA

SEQ ID NO: 1978925 - protein, 4 aa, Staphylococcus
RDEQ

SEQ ID NO: 1978926 - protein, 5 aa, Staphylococcus
RDEQV

SEQ ID NO: 1978927 - protein, 19 aa, Staphylococcus
RDERDEDNIREDSYHYEGG

SEQ ID NO: 1978928 - protein, 18 aa, Staphylococcus
RDEREDKEQREDTYHYEG

SEQ ID NO: 1978929 - protein, 17 aa, Staphylococcus
RDERGEEVREDTYHYEG

SEQ ID NO: 1978930 - protein, 9 aa, Staphylococcus
RDESGTDVN

SEQ ID NO: 1978931 - protein, 11 aa, Staphylococcus
RDESLKPNLTE

SEQ ID NO: 1978932 - protein, 8 aa, Staphylococcus
RDESRTVK

SEQ ID NO: 1978933 - protein, 13 aa, Staphylococcus
RDESTSAEERQTS

SEQ ID NO: 1978934 - protein, 7 aa, Staphylococcus
RDETGGR

SEQ ID NO: 1978935 - protein, 8 aa, Staphylococcus
RDETGTDV

SEQ ID NO: 1978936 - protein, 9 aa, Staphylococcus
RDETGTDVN

SEQ ID NO: 1978937 - protein, 7 aa, Staphylococcus
RDEVAPQ

SEQ ID NO: 1978938 - protein, 14 aa, Staphylococcus
RDEVSEKSQKYDEL

SEQ ID NO: 1978939 - protein, 5 aa, Staphylococcus
RDEYT

SEQ ID NO: 1978940 - protein, 4 aa, Staphylococcus
RDFD

SEQ ID NO: 1978941 - protein, 4 aa, Staphylococcus
RDFR

SEQ ID NO: 1978942 - protein, 4 aa, Staphylococcus
RDFS

SEQ ID NO: 1978943 - protein, 15 aa, Staphylococcus
RDGATDLNRKTSLNP

SEQ ID NO: 1978944 - protein, 37 aa, Staphylococcus
RDGDGKEIGRQTVTNGQDGKSITAVTARGEQNNQTGS

SEQ ID NO: 1978945 - protein, 8 aa, Staphylococcus
RDGDYAEV

SEQ ID NO: 1978946 - protein, 11 aa, Staphylococcus
RDGELSGAHGR

SEQ ID NO: 1978947 - protein, 10 aa, Staphylococcus
RDGEQTPGVS

SEQ ID NO: 1978948 - protein, 8 aa, Staphylococcus
RDGETALH

SEQ ID NO: 1978949 - protein, 20 aa, Staphylococcus
RDGETDEFEYETNGTWQEKR

SEQ ID NO: 1978950 - protein, 7 aa, Staphylococcus
RDGFGTH

SEQ ID NO: 1978951 - protein, 6 aa, Staphylococcus
RDGFST

SEQ ID NO: 1978952 - protein, 7 aa, Staphylococcus
RDGGGVH

SEQ ID NO: 1978953 - protein, 4 aa, Staphylococcus
RDGK

SEQ ID NO: 1978954 - protein, 15 aa, Staphylococcus
RDGKEPLKPKAELNY

SEQ ID NO: 1978955 - protein, 10 aa, Staphylococcus
RDGKLSKDKA

SEQ ID NO: 1978956 - protein, 6 aa, Staphylococcus
RDGKSI

SEQ ID NO: 1978957 - protein, 7 aa, Staphylococcus
RDGQGRF

SEQ ID NO: 1978958 - protein, 7 aa, Staphylococcus
RDGQTHV

SEQ ID NO: 1978959 - protein, 11 aa, Staphylococcus
RDGRAQVSVGA

SEQ ID NO: 1978960 - protein, 11 aa, Staphylococcus
RDGRARVSVGA

SEQ ID NO: 1978961 - protein, 7 aa, Staphylococcus
RDHEEIE

SEQ ID NO: 1978962 - protein, 6 aa, Staphylococcus
RDHEGI

SEQ ID NO: 1978963 - protein, 7 aa, Staphylococcus
RDHENED

SEQ ID NO: 1978964 - protein, 24 aa, Staphylococcus
RDHGATTYDFGGTDNNPSKDSEHY

SEQ ID NO: 1978965 - protein, 7 aa, Staphylococcus
RDHPRAT

SEQ ID NO: 1978966 - protein, 8 aa, Staphylococcus
RDIDPQVS

SEQ ID NO: 1978967 - protein, 4 aa, Staphylococcus
RDIE

SEQ ID NO: 1978968 - protein, 6 aa, Staphylococcus
RDIEPN

SEQ ID NO: 1978969 - protein, 7 aa, Staphylococcus
RDIEPNV

SEQ ID NO: 1978970 - protein, 9 aa, Staphylococcus
RDIGDGDHG

SEQ ID NO: 1978971 - protein, 11 aa, Staphylococcus
RDIGTYETSIQ

SEQ ID NO: 1978972 - protein, 7 aa, Staphylococcus
RDIPDNA

SEQ ID NO: 1978973 - protein, 16 aa, Staphylococcus
RDIPNVSDSALKNLDD

SEQ ID NO: 1978974 - protein, 16 aa, Staphylococcus
RDIPNVSESALKNLDD

SEQ ID NO: 1978975 - protein, 17 aa, Staphylococcus
RDIPNVSESALKNLDDR

SEQ ID NO: 1978976 - protein, 16 aa, Staphylococcus
RDIPNVSESALKNLDE

SEQ ID NO: 1978977 - protein, 5 aa, Staphylococcus
RDIPT

SEQ ID NO: 1978978 - protein, 6 aa, Staphylococcus
RDIQST

SEQ ID NO: 1978979 - protein, 4 aa, Staphylococcus
RDIS

SEQ ID NO: 1978980 - protein, 6 aa, Staphylococcus
RDISAN

SEQ ID NO: 1978981 - protein, 24 aa, Staphylococcus
RDITDDVAQGLNTSFDTAEKVKHQ

SEQ ID NO: 1978982 - protein, 7 aa, Staphylococcus
RDITEDI

SEQ ID NO: 1978983 - protein, 7 aa, Staphylococcus
RDKAYGK

SEQ ID NO: 1978984 - protein, 9 aa, Staphylococcus
RDKDAKPEL

SEQ ID NO: 1978985 - protein, 6 aa, Staphylococcus
RDKDID

SEQ ID NO: 1978986 - protein, 7 aa, Staphylococcus
RDKDIDD

SEQ ID NO: 1978987 - protein, 9 aa, Staphylococcus
RDKDPLDKR

SEQ ID NO: 1978988 - protein, 9 aa, Staphylococcus
RDKETGTLT

SEQ ID NO: 1978989 - protein, 23 aa, Staphylococcus
RDKGATSYDFGGTDNNPPKDSEH

SEQ ID NO: 1978990 - protein, 9 aa, Staphylococcus
RDKGAYTIE

SEQ ID NO: 1978991 - protein, 10 aa, Staphylococcus
RDKGKVTEAD

SEQ ID NO: 1978992 - protein, 5 aa, Staphylococcus
RDKGL

SEQ ID NO: 1978993 - protein, 8 aa, Staphylococcus
RDKIENEY

SEQ ID NO: 1978994 - protein, 6 aa, Staphylococcus
RDKISQ

SEQ ID NO: 1978995 - protein, 4 aa, Staphylococcus
RDKK

SEQ ID NO: 1978996 - protein, 9 aa, Staphylococcus
RDKKGANRP

SEQ ID NO: 1978997 - protein, 10 aa, Staphylococcus
RDKNAKPELA

SEQ ID NO: 1978998 - protein, 10 aa, Staphylococcus
RDKNDVEETE

SEQ ID NO: 1978999 - protein, 9 aa, Staphylococcus
RDKNDVPET

SEQ ID NO: 1979000 - protein, 19 aa, Staphylococcus
RDKNKEANQHAQQALYKLI

SEQ ID NO: 1979001 - protein, 11 aa, Staphylococcus
RDKNKEANQLA

SEQ ID NO: 1979002 - protein, 13 aa, Staphylococcus
RDKNPAVRRTAGD

SEQ ID NO: 1979003 - protein, 10 aa, Staphylococcus
RDKNTGTKEF

SEQ ID NO: 1979004 - protein, 9 aa, Staphylococcus
RDKPELKGK

SEQ ID NO: 1979005 - protein, 22 aa, Staphylococcus
RDKTTPVYDRHDKTEKRTPDEI

SEQ ID NO: 1979006 - protein, 8 aa, Staphylococcus
RDKYEESL

SEQ ID NO: 1979007 - protein, 8 aa, Staphylococcus
RDLADKGI

SEQ ID NO: 1979008 - protein, 7 aa, Staphylococcus
RDLEPND

SEQ ID NO: 1979009 - protein, 11 aa, Staphylococcus
RDLETPPSDKF

SEQ ID NO: 1979010 - protein, 8 aa, Staphylococcus
RDLKGGQT

SEQ ID NO: 1979011 - protein, 13 aa, Staphylococcus
RDLKNGDITESEV

SEQ ID NO: 1979012 - protein, 13 aa, Staphylococcus
RDLNNGTITESEV

SEQ ID NO: 1979013 - protein, 7 aa, Staphylococcus
RDLPADA

SEQ ID NO: 1979014 - protein, 4 aa, Staphylococcus
RDLQ

SEQ ID NO: 1979015 - protein, 4 aa, Staphylococcus
RDLS

SEQ ID NO: 1979016 - protein, 15 aa, Staphylococcus
RDLTKQVKEYEEYGA

SEQ ID NO: 1979017 - protein, 12 aa, Staphylococcus
RDLTNDEFRQQV

SEQ ID NO: 1979018 - protein, 6 aa, Staphylococcus
RDLTNK

SEQ ID NO: 1979019 - protein, 7 aa, Staphylococcus
RDLTQLA

SEQ ID NO: 1979020 - protein, 6 aa, Staphylococcus
RDMPSS

SEQ ID NO: 1979021 - protein, 10 aa, Staphylococcus
RDNAAKPELA

SEQ ID NO: 1979022 - protein, 14 aa, Staphylococcus
RDNADELANSLNAA

SEQ ID NO: 1979023 - protein, 9 aa, Staphylococcus
RDNARTPMQ

SEQ ID NO: 1979024 - protein, 4 aa, Staphylococcus
RDND

SEQ ID NO: 1979025 - protein, 8 aa, Staphylococcus
RDNDEGVG

SEQ ID NO: 1979026 - protein, 17 aa, Staphylococcus
RDNDGNGSLERTKKDSF

SEQ ID NO: 1979027 - protein, 5 aa, Staphylococcus
RDNDI

SEQ ID NO: 1979028 - protein, 5 aa, Staphylococcus
RDNDQ

SEQ ID NO: 1979029 - protein, 7 aa, Staphylococcus
RDNDQAV

SEQ ID NO: 1979030 - protein, 6 aa, Staphylococcus
RDNEAE

SEQ ID NO: 1979031 - protein, 17 aa, Staphylococcus
RDNEGHGTLERKKKASF

SEQ ID NO: 1979032 - protein, 17 aa, Staphylococcus
RDNEGNGSLERTKKASF

SEQ ID NO: 1979033 - protein, 12 aa, Staphylococcus
RDNELKRPPVSN

SEQ ID NO: 1979034 - protein, 8 aa, Staphylococcus
RDNEPIKQ

SEQ ID NO: 1979035 - protein, 8 aa, Staphylococcus
RDNEPRLQ

SEQ ID NO: 1979036 - protein, 9 aa, Staphylococcus
RDNETEAFR

SEQ ID NO: 1979037 - protein, 10 aa, Staphylococcus
RDNETEQFRE

SEQ ID NO: 1979038 - protein, 12 aa, Staphylococcus
RDNHNGESRELN

SEQ ID NO: 1979039 - protein, 6 aa, Staphylococcus
RDNHTF

SEQ ID NO: 1979040 - protein, 8 aa, Staphylococcus
RDNKENEC

SEQ ID NO: 1979041 - protein, 7 aa, Staphylococcus
RDNKEVD

SEQ ID NO: 1979042 - protein, 17 aa, Staphylococcus
RDNKGQGTLERTKKDSF

SEQ ID NO: 1979043 - protein, 8 aa, Staphylococcus
RDNKPGVS

SEQ ID NO: 1979044 - protein, 10 aa, Staphylococcus
RDNKTERFRE

SEQ ID NO: 1979045 - protein, 5 aa, Staphylococcus
RDNNM

SEQ ID NO: 1979046 - protein, 6 aa, Staphylococcus
RDNNMK

SEQ ID NO: 1979047 - protein, 10 aa, Staphylococcus
RDNPKLKGKP

SEQ ID NO: 1979048 - protein, 11 aa, Staphylococcus
RDNPKLKGKPV

SEQ ID NO: 1979049 - protein, 10 aa, Staphylococcus
RDNPKLQGKP

SEQ ID NO: 1979050 - protein, 9 aa, Staphylococcus
RDNPKLRGK

SEQ ID NO: 1979051 - protein, 8 aa, Staphylococcus
RDNPLYSP

SEQ ID NO: 1979052 - protein, 9 aa, Staphylococcus
RDNPQLKGK

SEQ ID NO: 1979053 - protein, 9 aa, Staphylococcus
RDNPTLKGK

SEQ ID NO: 1979054 - protein, 7 aa, Staphylococcus
RDNRKND

SEQ ID NO: 1979055 - protein, 10 aa, Staphylococcus
RDNSAKPELA

SEQ ID NO: 1979056 - protein, 12 aa, Staphylococcus
RDNVAKGYETSL

SEQ ID NO: 1979057 - protein, 6 aa, Staphylococcus
RDNYGT

SEQ ID NO: 1979058 - protein, 5 aa, Staphylococcus
RDPDK

SEQ ID NO: 1979059 - protein, 12 aa, Staphylococcus
RDPEDKEKYMDD

SEQ ID NO: 1979060 - protein, 7 aa, Staphylococcus
RDPERVQ

SEQ ID NO: 1979061 - protein, 10 aa, Staphylococcus
RDPETGGISH

SEQ ID NO: 1979062 - protein, 4 aa, Staphylococcus
RDPF

SEQ ID NO: 1979063 - protein, 9 aa, Staphylococcus
RDPQASIGH

SEQ ID NO: 1979064 - protein, 10 aa, Staphylococcus
RDPQASIGRG

SEQ ID NO: 1979065 - protein, 7 aa, Staphylococcus
RDPQHAY

SEQ ID NO: 1979066 - protein, 5 aa, Staphylococcus
RDPQR

SEQ ID NO: 1979067 - protein, 9 aa, Staphylococcus
RDPRQKENL

SEQ ID NO: 1979068 - protein, 4 aa, Staphylococcus
RDQD

SEQ ID NO: 1979069 - protein, 6 aa, Staphylococcus
RDQDID

SEQ ID NO: 1979070 - protein, 8 aa, Staphylococcus
RDQFSEDR

SEQ ID NO: 1979071 - protein, 12 aa, Staphylococcus
RDQGADQTDERS

SEQ ID NO: 1979072 - protein, 5 aa, Staphylococcus
RDQGY

SEQ ID NO: 1979073 - protein, 12 aa, Staphylococcus
RDQGYEDTFREK

SEQ ID NO: 1979074 - protein, 9 aa, Staphylococcus
RDQKAGKQV

SEQ ID NO: 1979075 - protein, 6 aa, Staphylococcus
RDQLDE

SEQ ID NO: 1979076 - protein, 21 aa, Staphylococcus
RDQNKEANQHAQQALYKILKA

SEQ ID NO: 1979077 - protein, 8 aa, Staphylococcus
RDQPNETI

SEQ ID NO: 1979078 - protein, 11 aa, Staphylococcus
RDQSPTRAKTN

SEQ ID NO: 1979079 - protein, 7 aa, Staphylococcus
RDQVEES

SEQ ID NO: 1979080 - protein, 8 aa, Staphylococcus
RDRDIRDK

SEQ ID NO: 1979081 - protein, 18 aa, Staphylococcus
RDREKNGEAAAKPKNYFR

SEQ ID NO: 1979082 - protein, 8 aa, Staphylococcus
RDRGEGER

SEQ ID NO: 1979083 - protein, 11 aa, Staphylococcus
RDRKAEKDYSK

SEQ ID NO: 1979084 - protein, 13 aa, Staphylococcus
RDRNQVPFTAPAE

SEQ ID NO: 1979085 - protein, 17 aa, Staphylococcus
RDRNSHNEVEENNAAYE

SEQ ID NO: 1979086 - protein, 17 aa, Staphylococcus
RDRSSHDEVEENNSAYE

SEQ ID NO: 1979087 - protein, 9 aa, Staphylococcus
RDRTEVNEA

SEQ ID NO: 1979088 - protein, 14 aa, Staphylococcus
RDSADELAKQLNAA

SEQ ID NO: 1979089 - protein, 9 aa, Staphylococcus
RDSADELAR

SEQ ID NO: 1979090 - protein, 8 aa, Staphylococcus
RDSAERKT

SEQ ID NO: 1979091 - protein, 13 aa, Staphylococcus
RDSARKAGRIPSG

SEQ ID NO: 1979092 - protein, 14 aa, Staphylococcus
RDSDMQQQAKENIR

SEQ ID NO: 1979093 - protein, 8 aa, Staphylococcus
RDSDYITG

SEQ ID NO: 1979094 - protein, 8 aa, Staphylococcus
RDSEEFEE

SEQ ID NO: 1979095 - protein, 7 aa, Staphylococcus
RDSEGFD

SEQ ID NO: 1979096 - protein, 14 aa, Staphylococcus
RDSGQTEISSRDIG

SEQ ID NO: 1979097 - protein, 9 aa, Staphylococcus
RDSHKRRSM

SEQ ID NO: 1979098 - protein, 9 aa, Staphylococcus
RDSHSVETA

SEQ ID NO: 1979099 - protein, 8 aa, Staphylococcus
RDSKVAPT

SEQ ID NO: 1979100 - protein, 9 aa, Staphylococcus
RDSKVAPTI

SEQ ID NO: 1979101 - protein, 18 aa, Staphylococcus
RDSKVAPTIHADSPDPEC

SEQ ID NO: 1979102 - protein, 8 aa, Staphylococcus
RDSLENTD

SEQ ID NO: 1979103 - protein, 7 aa, Staphylococcus
RDSNGEY

SEQ ID NO: 1979104 - protein, 5 aa, Staphylococcus
RDSPR

SEQ ID NO: 1979105 - protein, 7 aa, Staphylococcus
RDSQVEM

SEQ ID NO: 1979106 - protein, 4 aa, Staphylococcus
RDSY

SEQ ID NO: 1979107 - protein, 11 aa, Staphylococcus
RDTAQHREQTI

SEQ ID NO: 1979108 - protein, 9 aa, Staphylococcus
RDTASSHAR

SEQ ID NO: 1979109 - protein, 10 aa, Staphylococcus
RDTEGKVSAD

SEQ ID NO: 1979110 - protein, 5 aa, Staphylococcus
RDTEI

SEQ ID NO: 1979111 - protein, 8 aa, Staphylococcus
RDTEIQKT

SEQ ID NO: 1979112 - protein, 10 aa, Staphylococcus
RDTENLTDHD

SEQ ID NO: 1979113 - protein, 7 aa, Staphylococcus
RDTEQAE

SEQ ID NO: 1979114 - protein, 8 aa, Staphylococcus
RDTGGGAV

SEQ ID NO: 1979115 - protein, 10 aa, Staphylococcus
RDTHERGRSM

SEQ ID NO: 1979116 - protein, 14 aa, Staphylococcus
RDTHSTLDTDLEEK

SEQ ID NO: 1979117 - protein, 4 aa, Staphylococcus
RDTI

SEQ ID NO: 1979118 - protein, 9 aa, Staphylococcus
RDTKDNDEI

SEQ ID NO: 1979119 - protein, 5 aa, Staphylococcus
RDTLN

SEQ ID NO: 1979120 - protein, 8 aa, Staphylococcus
RDTNGQTY

SEQ ID NO: 1979121 - protein, 7 aa, Staphylococcus
RDTNPNG

SEQ ID NO: 1979122 - protein, 6 aa, Staphylococcus
RDTNSG

SEQ ID NO: 1979123 - protein, 25 aa, Staphylococcus
RDTNTGKLTPTDNQQIAPEGVHVSF

SEQ ID NO: 1979124 - protein, 8 aa, Staphylococcus
RDTPNETY

SEQ ID NO: 1979125 - protein, 10 aa, Staphylococcus
RDTQERGRSM

SEQ ID NO: 1979126 - protein, 15 aa, Staphylococcus
RDTSKLEKVATPFPR

SEQ ID NO: 1979127 - protein, 15 aa, Staphylococcus
RDTSKLEKVKTPFPR

SEQ ID NO: 1979128 - protein, 10 aa, Staphylococcus
RDTTSDSGGL

SEQ ID NO: 1979129 - protein, 4 aa, Staphylococcus
RDTY

SEQ ID NO: 1979130 - protein, 5 aa, Staphylococcus
RDVAE

SEQ ID NO: 1979131 - protein, 18 aa, Staphylococcus
RDVERNRRQDGAPTNNTL

SEQ ID NO: 1979132 - protein, 9 aa, Staphylococcus
RDVESRNAY

SEQ ID NO: 1979133 - protein, 8 aa, Staphylococcus
RDVQDESS

SEQ ID NO: 1979134 - protein, 6 aa, Staphylococcus
RDVSDK

SEQ ID NO: 1979135 - protein, 5 aa, Staphylococcus
RDYDG

SEQ ID NO: 1979136 - protein, 11 aa, Staphylococcus
RDYGDRSDRMQ

SEQ ID NO: 1979137 - protein, 13 aa, Staphylococcus
RDYGNREERTNAR

SEQ ID NO: 1979138 - protein, 8 aa, Staphylococcus
RDYGTGKM

SEQ ID NO: 1979139 - protein, 4 aa, Staphylococcus
RDYK

SEQ ID NO: 1979140 - protein, 5 aa, Staphylococcus
RDYKW

SEQ ID NO: 1979141 - protein, 6 aa, Staphylococcus
RDYPDP

SEQ ID NO: 1979142 - protein, 5 aa, Staphylococcus
RDYQE

SEQ ID NO: 1979143 - protein, 6 aa, Staphylococcus
RDYQNA

SEQ ID NO: 1979144 - protein, 4 aa, Staphylococcus
RDYR

SEQ ID NO: 1979145 - protein, 10 aa, Staphylococcus
RDYRNKDKVT

SEQ ID NO: 1979146 - protein, 19 aa, Staphylococcus
RDYSNEEFRDQVKSSIQKH

SEQ ID NO: 1979147 - protein, 9 aa, Staphylococcus
RDYSNMPPN

SEQ ID NO: 1979148 - protein, 6 aa, Staphylococcus
RDYTER

SEQ ID NO: 1979149 - protein, 7 aa, Staphylococcus
RDYTSPL

SEQ ID NO: 1979150 - protein, 7 aa, Staphylococcus
RDYTSRH

SEQ ID NO: 1979151 - protein, 4 aa, Staphylococcus
REAA

SEQ ID NO: 1979152 - protein, 8 aa, Staphylococcus
READNDAV

SEQ ID NO: 1979153 - protein, 5 aa, Staphylococcus
READQ

SEQ ID NO: 1979154 - protein, 8 aa, Staphylococcus
REAEDPFT

SEQ ID NO: 1979155 - protein, 5 aa, Staphylococcus
REAEG

SEQ ID NO: 1979156 - protein, 6 aa, Staphylococcus
REAEVG

SEQ ID NO: 1979157 - protein, 9 aa, Staphylococcus
REAEVGQVY

SEQ ID NO: 1979158 - protein, 6 aa, Staphylococcus
REAGAD

SEQ ID NO: 1979159 - protein, 4 aa, Staphylococcus
REAI

SEQ ID NO: 1979160 - protein, 6 aa, Staphylococcus
REAIEG

SEQ ID NO: 1979161 - protein, 7 aa, Staphylococcus
REALEEK

SEQ ID NO: 1979162 - protein, 12 aa, Staphylococcus
REALENDETITS

SEQ ID NO: 1979163 - protein, 10 aa, Staphylococcus
REALQQSHAR

SEQ ID NO: 1979164 - protein, 6 aa, Staphylococcus
REANEV

SEQ ID NO: 1979165 - protein, 12 aa, Staphylococcus
REAQRRSYSPYS

SEQ ID NO: 1979166 - protein, 12 aa, Staphylococcus
REAQSKAYAPYS

SEQ ID NO: 1979167 - protein, 8 aa, Staphylococcus
REAQSRAY

SEQ ID NO: 1979168 - protein, 12 aa, Staphylococcus
REAQSRSYSPYS

SEQ ID NO: 1979169 - protein, 10 aa, Staphylococcus
REARKKKLET

SEQ ID NO: 1979170 - protein, 8 aa, Staphylococcus
REASHKEE

SEQ ID NO: 1979171 - protein, 9 aa, Staphylococcus
REASKEEEQ

SEQ ID NO: 1979172 - protein, 7 aa, Staphylococcus
REASRIG

SEQ ID NO: 1979173 - protein, 8 aa, Staphylococcus
REASRLGD

SEQ ID NO: 1979174 - protein, 5 aa, Staphylococcus
REATL

SEQ ID NO: 1979175 - protein, 8 aa, Staphylococcus
REATYGTK

SEQ ID NO: 1979176 - protein, 7 aa, Staphylococcus
REAVKDA

SEQ ID NO: 1979177 - protein, 7 aa, Staphylococcus
REAVNDA

SEQ ID NO: 1979178 - protein, 8 aa, Staphylococcus
REAYEPGD

SEQ ID NO: 1979179 - protein, 4 aa, Staphylococcus
REDA

SEQ ID NO: 1979180 - protein, 6 aa, Staphylococcus
REDAAQ

SEQ ID NO: 1979181 - protein, 6 aa, Staphylococcus
REDAKQ

SEQ ID NO: 1979182 - protein, 6 aa, Staphylococcus
REDAQF

SEQ ID NO: 1979183 - protein, 5 aa, Staphylococcus
REDDD

SEQ ID NO: 1979184 - protein, 11 aa, Staphylococcus
REDDDNYFEQP

SEQ ID NO: 1979185 - protein, 12 aa, Staphylococcus
REDDGLAKSSRN

SEQ ID NO: 1979186 - protein, 13 aa, Staphylococcus
REDDGLAKSSRNI

SEQ ID NO: 1979187 - protein, 29 aa, Staphylococcus
REDEFSPLKNKEGKDSVETATSDLERLNL

SEQ ID NO: 1979188 - protein, 5 aa, Staphylococcus
REDEI

SEQ ID NO: 1979189 - protein, 6 aa, Staphylococcus
REDGDD

SEQ ID NO: 1979190 - protein, 10 aa, Staphylococcus
REDGEQEIES

SEQ ID NO: 1979191 - protein, 5 aa, Staphylococcus
REDGN

SEQ ID NO: 1979192 - protein, 10 aa, Staphylococcus
REDGSEFDKN

SEQ ID NO: 1979193 - protein, 9 aa, Staphylococcus
REDGSEFDR

SEQ ID NO: 1979194 - protein, 10 aa, Staphylococcus
REDGSEFERD

SEQ ID NO: 1979195 - protein, 19 aa, Staphylococcus
REDHGNNRKINSEKIEQAL

SEQ ID NO: 1979196 - protein, 5 aa, Staphylococcus
REDIT

SEQ ID NO: 1979197 - protein, 4 aa, Staphylococcus
REDK

SEQ ID NO: 1979198 - protein, 11 aa, Staphylococcus
REDKAQEGIPQ

SEQ ID NO: 1979199 - protein, 5 aa, Staphylococcus
REDKL

SEQ ID NO: 1979200 - protein, 19 aa, Staphylococcus
REDKTSYSHNKGLPETRQA

SEQ ID NO: 1979201 - protein, 6 aa, Staphylococcus
REDLDI

SEQ ID NO: 1979202 - protein, 7 aa, Staphylococcus
REDLEST

SEQ ID NO: 1979203 - protein, 13 aa, Staphylococcus
REDLKTGDKHRGY

SEQ ID NO: 1979204 - protein, 6 aa, Staphylococcus
REDNEA

SEQ ID NO: 1979205 - protein, 8 aa, Staphylococcus
REDNERMN

SEQ ID NO: 1979206 - protein, 8 aa, Staphylococcus
REDNKQQH

SEQ ID NO: 1979207 - protein, 6 aa, Staphylococcus
REDNLE

SEQ ID NO: 1979208 - protein, 9 aa, Staphylococcus
REDQKVPKA

SEQ ID NO: 1979209 - protein, 6 aa, Staphylococcus
REDREV

SEQ ID NO: 1979210 - protein, 4 aa, Staphylococcus
REDS

SEQ ID NO: 1979211 - protein, 10 aa, Staphylococcus
REDTLNRAPY

SEQ ID NO: 1979212 - protein, 8 aa, Staphylococcus
REDTQYEV

SEQ ID NO: 1979213 - protein, 21 aa, Staphylococcus
REDYNQLKDTAYRNSKEKPFS

SEQ ID NO: 1979214 - protein, 5 aa, Staphylococcus
REDYV

SEQ ID NO: 1979215 - protein, 6 aa, Staphylococcus
REEAAT

SEQ ID NO: 1979216 - protein, 8 aa, Staphylococcus
REEAMRRA

SEQ ID NO: 1979217 - protein, 15 aa, Staphylococcus
REEAQKRNISETEDL

SEQ ID NO: 1979218 - protein, 21 aa, Staphylococcus
REEARQLRRSHTQRPYNTLKD

SEQ ID NO: 1979219 - protein, 6 aa, Staphylococcus
REEATI

SEQ ID NO: 1979220 - protein, 22 aa, Staphylococcus
REEAYDKVQPKAMKSWETKTPF

SEQ ID NO: 1979221 - protein, 5 aa, Staphylococcus
REEDR

SEQ ID NO: 1979222 - protein, 4 aa, Staphylococcus
REEE

SEQ ID NO: 1979223 - protein, 29 aa, Staphylococcus
REEEFSPLKNKEGKDSVETATADLKRMGM

SEQ ID NO: 1979224 - protein, 29 aa, Staphylococcus
REEEFSPLKNKEGKDSVETATADLKRMNM

SEQ ID NO: 1979225 - protein, 29 aa, Staphylococcus
REEEFSPLKNREGKDSVETATEDLKRRNL

SEQ ID NO: 1979226 - protein, 8 aa, Staphylococcus
REEEITAT

SEQ ID NO: 1979227 - protein, 10 aa, Staphylococcus
REEGKISEDD

SEQ ID NO: 1979228 - protein, 20 aa, Staphylococcus
REEGKISENDIQTLVEWRDN

SEQ ID NO: 1979229 - protein, 8 aa, Staphylococcus
REEGLKAA

SEQ ID NO: 1979230 - protein, 9 aa, Staphylococcus
REEGLKAAN

SEQ ID NO: 1979231 - protein, 9 aa, Staphylococcus
REEGSCNQQ

SEQ ID NO: 1979232 - protein, 5 aa, Staphylococcus
REEGY

SEQ ID NO: 1979233 - protein, 4 aa, Staphylococcus
REEH

SEQ ID NO: 1979234 - protein, 5 aa, Staphylococcus
REEHD

SEQ ID NO: 1979235 - protein, 7 aa, Staphylococcus
REEHGFK

SEQ ID NO: 1979236 - protein, 8 aa, Staphylococcus
REEKMKSA

SEQ ID NO: 1979237 - protein, 6 aa, Staphylococcus
REEKRC

SEQ ID NO: 1979238 - protein, 7 aa, Staphylococcus
REELEQT

SEQ ID NO: 1979239 - protein, 7 aa, Staphylococcus
REELGLS

SEQ ID NO: 1979240 - protein, 7 aa, Staphylococcus
REELHEA

SEQ ID NO: 1979241 - protein, 8 aa, Staphylococcus
REENGAIK

SEQ ID NO: 1979242 - protein, 16 aa, Staphylococcus
REENGAIKHNKEISKV

SEQ ID NO: 1979243 - protein, 12 aa, Staphylococcus
REENGAITHNKE

SEQ ID NO: 1979244 - protein, 13 aa, Staphylococcus
REENGPIKHNKEI

SEQ ID NO: 1979245 - protein, 13 aa, Staphylococcus
REENGSIKHHSEI

SEQ ID NO: 1979246 - protein, 8 aa, Staphylococcus
REENIDNE

SEQ ID NO: 1979247 - protein, 9 aa, Staphylococcus
REENIDNEK

SEQ ID NO: 1979248 - protein, 11 aa, Staphylococcus
REEPANDTVTI

SEQ ID NO: 1979249 - protein, 7 aa, Staphylococcus
REEPTYE

SEQ ID NO: 1979250 - protein, 5 aa, Staphylococcus
REEQP

SEQ ID NO: 1979251 - protein, 4 aa, Staphylococcus
REER

SEQ ID NO: 1979252 - protein, 8 aa, Staphylococcus
REERERGG

SEQ ID NO: 1979253 - protein, 5 aa, Staphylococcus
REESD

SEQ ID NO: 1979254 - protein, 7 aa, Staphylococcus
REESIEE

SEQ ID NO: 1979255 - protein, 5 aa, Staphylococcus
REESK

SEQ ID NO: 1979256 - protein, 6 aa, Staphylococcus
REETEN

SEQ ID NO: 1979257 - protein, 11 aa, Staphylococcus
REETNDYPKKV

SEQ ID NO: 1979258 - protein, 7 aa, Staphylococcus
REETTGK

SEQ ID NO: 1979259 - protein, 6 aa, Staphylococcus
REEVDI

SEQ ID NO: 1979260 - protein, 9 aa, Staphylococcus
REFNKKDLR

SEQ ID NO: 1979261 - protein, 14 aa, Staphylococcus
REFNTNQLDAQGFD

SEQ ID NO: 1979262 - protein, 10 aa, Staphylococcus
REGAEETKAA

SEQ ID NO: 1979263 - protein, 16 aa, Staphylococcus
REGAEKLNKKTSLNPN

SEQ ID NO: 1979264 - protein, 13 aa, Staphylococcus
REGDYPGDVTPDG

SEQ ID NO: 1979265 - protein, 4 aa, Staphylococcus
REGE

SEQ ID NO: 1979266 - protein, 8 aa, Staphylococcus
REGERESK

SEQ ID NO: 1979267 - protein, 10 aa, Staphylococcus
REGGDEKEAI

SEQ ID NO: 1979268 - protein, 16 aa, Staphylococcus
REGGRTVGSGVVTEIF

SEQ ID NO: 1979269 - protein, 16 aa, Staphylococcus
REGGRTVGSGVVTEIH

SEQ ID NO: 1979270 - protein, 16 aa, Staphylococcus
REGGRTVGSGVVTEII

SEQ ID NO: 1979271 - protein, 16 aa, Staphylococcus
REGGRTVGSGVVTEIM

SEQ ID NO: 1979272 - protein, 16 aa, Staphylococcus
REGGRTVGSGVVTVIN

SEQ ID NO: 1979273 - protein, 5 aa, Staphylococcus
REGHY

SEQ ID NO: 1979274 - protein, 26 aa, Staphylococcus
REGINKLEKERQELTQQIKEDKAKYK

SEQ ID NO: 1979275 - protein, 15 aa, Staphylococcus
REGKEPLKPNSDLSY

SEQ ID NO: 1979276 - protein, 14 aa, Staphylococcus
REGKEPVKPNPELS

SEQ ID NO: 1979277 - protein, 14 aa, Staphylococcus
REGKEPVKPNSELS

SEQ ID NO: 1979278 - protein, 20 aa, Staphylococcus
REGKGVTNAIGTGGRDLSTE

SEQ ID NO: 1979279 - protein, 5 aa, Staphylococcus
REGKR

SEQ ID NO: 1979280 - protein, 6 aa, Staphylococcus
REGKTV

SEQ ID NO: 1979281 - protein, 8 aa, Staphylococcus
REGKVEEA

SEQ ID NO: 1979282 - protein, 18 aa, Staphylococcus
REGKYQVEQKEENNELKQ

SEQ ID NO: 1979283 - protein, 5 aa, Staphylococcus
REGLR

SEQ ID NO: 1979284 - protein, 6 aa, Staphylococcus
REGNIN

SEQ ID NO: 1979285 - protein, 7 aa, Staphylococcus
REGNKED

SEQ ID NO: 1979286 - protein, 11 aa, Staphylococcus
REGQEDKDAIN

SEQ ID NO: 1979287 - protein, 9 aa, Staphylococcus
REGQEDSDA

SEQ ID NO: 1979288 - protein, 5 aa, Staphylococcus
REGQK

SEQ ID NO: 1979289 - protein, 13 aa, Staphylococcus
REGQKRYKANLKE

SEQ ID NO: 1979290 - protein, 13 aa, Staphylococcus
REGQKRYKASLKE

SEQ ID NO: 1979291 - protein, 13 aa, Staphylococcus
REGQKRYKLKLKK

SEQ ID NO: 1979292 - protein, 17 aa, Staphylococcus
REGQKRYKQKIKKEAEK

SEQ ID NO: 1979293 - protein, 10 aa, Staphylococcus
REGQNDQNAI

SEQ ID NO: 1979294 - protein, 10 aa, Staphylococcus
REGQNENDAL

SEQ ID NO: 1979295 - protein, 10 aa, Staphylococcus
REGQSDKEAI

SEQ ID NO: 1979296 - protein, 10 aa, Staphylococcus
REGQTDKDAI

SEQ ID NO: 1979297 - protein, 6 aa, Staphylococcus
REGQYS

SEQ ID NO: 1979298 - protein, 4 aa, Staphylococcus
REGR

SEQ ID NO: 1979299 - protein, 12 aa, Staphylococcus
REGRPLPEGSTT

SEQ ID NO: 1979300 - protein, 5 aa, Staphylococcus
REGRR

SEQ ID NO: 1979301 - protein, 5 aa, Staphylococcus
REGRT

SEQ ID NO: 1979302 - protein, 5 aa, Staphylococcus
REGTE

SEQ ID NO: 1979303 - protein, 8 aa, Staphylococcus
REGYQPNI

SEQ ID NO: 1979304 - protein, 4 aa, Staphylococcus
REHA

SEQ ID NO: 1979305 - protein, 7 aa, Staphylococcus
REHGKGS

SEQ ID NO: 1979306 - protein, 7 aa, Staphylococcus
REHGQYS

SEQ ID NO: 1979307 - protein, 4 aa, Staphylococcus
REHH

SEQ ID NO: 1979308 - protein, 4 aa, Staphylococcus
REHK

SEQ ID NO: 1979309 - protein, 6 aa, Staphylococcus
REHKDT

SEQ ID NO: 1979310 - protein, 5 aa, Staphylococcus
REHKP

SEQ ID NO: 1979311 - protein, 5 aa, Staphylococcus
REHLS

SEQ ID NO: 1979312 - protein, 7 aa, Staphylococcus
REHNTKN

SEQ ID NO: 1979313 - protein, 7 aa, Staphylococcus
REHQPIE

SEQ ID NO: 1979314 - protein, 4 aa, Staphylococcus
REID

SEQ ID NO: 1979315 - protein, 5 aa, Staphylococcus
REIDA

SEQ ID NO: 1979316 - protein, 4 aa, Staphylococcus
REIG

SEQ ID NO: 1979317 - protein, 4 aa, Staphylococcus
REIK

SEQ ID NO: 1979318 - protein, 5 aa, Staphylococcus
REIKR

SEQ ID NO: 1979319 - protein, 7 aa, Staphylococcus
REINSNN

SEQ ID NO: 1979320 - protein, 5 aa, Staphylococcus
REIPT

SEQ ID NO: 1979321 - protein, 4 aa, Staphylococcus
REKA

SEQ ID NO: 1979322 - protein, 19 aa, Staphylococcus
REKAGEKEIQPTNNRLIVK

SEQ ID NO: 1979323 - protein, 6 aa, Staphylococcus
REKAYG

SEQ ID NO: 1979324 - protein, 7 aa, Staphylococcus
REKAYGK

SEQ ID NO: 1979325 - protein, 9 aa, Staphylococcus
REKDPQHRP

SEQ ID NO: 1979326 - protein, 13 aa, Staphylococcus
REKEAAKINERNR

SEQ ID NO: 1979327 - protein, 6 aa, Staphylococcus
REKENY

SEQ ID NO: 1979328 - protein, 23 aa, Staphylococcus
REKGATTYDFGGTDNDPDKDSEH

SEQ ID NO: 1979329 - protein, 6 aa, Staphylococcus
REKGFG

SEQ ID NO: 1979330 - protein, 15 aa, Staphylococcus
REKIENAKDHTSDFK

SEQ ID NO: 1979331 - protein, 23 aa, Staphylococcus
REKINEKKHKQPETLNVKSDLDK

SEQ ID NO: 1979332 - protein, 6 aa, Staphylococcus
REKKPE

SEQ ID NO: 1979333 - protein, 8 aa, Staphylococcus
REKNGYLT

SEQ ID NO: 1979334 - protein, 8 aa, Staphylococcus
REKPKYEV

SEQ ID NO: 1979335 - protein, 4 aa, Staphylococcus
REKQ

SEQ ID NO: 1979336 - protein, 6 aa, Staphylococcus
REKQSL

SEQ ID NO: 1979337 - protein, 5 aa, Staphylococcus
REKQV

SEQ ID NO: 1979338 - protein, 8 aa, Staphylococcus
REKRDEIN

SEQ ID NO: 1979339 - protein, 9 aa, Staphylococcus
REKRQTKAA

SEQ ID NO: 1979340 - protein, 6 aa, Staphylococcus
REKSQK

SEQ ID NO: 1979341 - protein, 7 aa, Staphylococcus
REKSQNL

SEQ ID NO: 1979342 - protein, 4 aa, Staphylococcus
REKY

SEQ ID NO: 1979343 - protein, 7 aa, Staphylococcus
REKYHGK

SEQ ID NO: 1979344 - protein, 12 aa, Staphylococcus
REKYSDFNVSYI

SEQ ID NO: 1979345 - protein, 5 aa, Staphylococcus
RELAP

SEQ ID NO: 1979346 - protein, 12 aa, Staphylococcus
RELDQDKSTIAQ

SEQ ID NO: 1979347 - protein, 11 aa, Staphylococcus
RELEKSKNTID

SEQ ID NO: 1979348 - protein, 8 aa, Staphylococcus
RELENRGT

SEQ ID NO: 1979349 - protein, 7 aa, Staphylococcus
RELEPND

SEQ ID NO: 1979350 - protein, 8 aa, Staphylococcus
RELNGSLR

SEQ ID NO: 1979351 - protein, 6 aa, Staphylococcus
RELNPS

SEQ ID NO: 1979352 - protein, 6 aa, Staphylococcus
RELQEK

SEQ ID NO: 1979353 - protein, 4 aa, Staphylococcus
RELS

SEQ ID NO: 1979354 - protein, 13 aa, Staphylococcus
RELSGPVATSYTV

SEQ ID NO: 1979355 - protein, 8 aa, Staphylococcus
RELSRGGQ

SEQ ID NO: 1979356 - protein, 12 aa, Staphylococcus
RELTKKDKKFGK

SEQ ID NO: 1979357 - protein, 19 aa, Staphylococcus
RELTNDDFRSQVKSSIQEH

SEQ ID NO: 1979358 - protein, 6 aa, Staphylococcus
REMGTD

SEQ ID NO: 1979359 - protein, 4 aa, Staphylococcus
REMP

SEQ ID NO: 1979360 - protein, 10 aa, Staphylococcus
REMREGEQDG

SEQ ID NO: 1979361 - protein, 4 aa, Staphylococcus
REMS

SEQ ID NO: 1979362 - protein, 11 aa, Staphylococcus
REMSGTQSKVS

SEQ ID NO: 1979363 - protein, 4 aa, Staphylococcus
REMT

SEQ ID NO: 1979364 - protein, 8 aa, Staphylococcus
RENADKAV

SEQ ID NO: 1979365 - protein, 12 aa, Staphylococcus
RENALKRPPVSN

SEQ ID NO: 1979366 - protein, 15 aa, Staphylococcus
RENANELADSLNASG

SEQ ID NO: 1979367 - protein, 15 aa, Staphylococcus
RENANELADSLNKEG

SEQ ID NO: 1979368 - protein, 16 aa, Staphylococcus
RENANELAQSLNESGI

SEQ ID NO: 1979369 - protein, 4 aa, Staphylococcus
REND

SEQ ID NO: 1979370 - protein, 5 aa, Staphylococcus
RENDI

SEQ ID NO: 1979371 - protein, 9 aa, Staphylococcus
RENDTVKKA

SEQ ID NO: 1979372 - protein, 10 aa, Staphylococcus
RENDTVKKAL

SEQ ID NO: 1979373 - protein, 6 aa, Staphylococcus
RENDYE

SEQ ID NO: 1979374 - protein, 6 aa, Staphylococcus
RENDYQ

SEQ ID NO: 1979375 - protein, 4 aa, Staphylococcus
RENE

SEQ ID NO: 1979376 - protein, 5 aa, Staphylococcus
RENGD

SEQ ID NO: 1979377 - protein, 9 aa, Staphylococcus
RENGENEIH

SEQ ID NO: 1979378 - protein, 6 aa, Staphylococcus
RENGGD

SEQ ID NO: 1979379 - protein, 6 aa, Staphylococcus
RENGGT

SEQ ID NO: 1979380 - protein, 6 aa, Staphylococcus
RENGGV

SEQ ID NO: 1979381 - protein, 12 aa, Staphylococcus
RENGKSSYEPAD

SEQ ID NO: 1979382 - protein, 5 aa, Staphylococcus
RENGS

SEQ ID NO: 1979383 - protein, 6 aa, Staphylococcus
RENIGE

SEQ ID NO: 1979384 - protein, 7 aa, Staphylococcus
RENIGTP

SEQ ID NO: 1979385 - protein, 9 aa, Staphylococcus
RENKKGDKV

SEQ ID NO: 1979386 - protein, 9 aa, Staphylococcus
RENKKGEQI

SEQ ID NO: 1979387 - protein, 8 aa, Staphylococcus
RENKPGVS

SEQ ID NO: 1979388 - protein, 7 aa, Staphylococcus
RENKTEN

SEQ ID NO: 1979389 - protein, 9 aa, Staphylococcus
RENKTIKDA

SEQ ID NO: 1979390 - protein, 5 aa, Staphylococcus
RENLE

SEQ ID NO: 1979391 - protein, 7 aa, Staphylococcus
RENLGEP

SEQ ID NO: 1979392 - protein, 6 aa, Staphylococcus
RENNIQ

SEQ ID NO: 1979393 - protein, 8 aa, Staphylococcus
RENNTNVP

SEQ ID NO: 1979394 - protein, 8 aa, Staphylococcus
RENPTYEV

SEQ ID NO: 1979395 - protein, 9 aa, Staphylococcus
RENQMDNRQ

SEQ ID NO: 1979396 - protein, 8 aa, Staphylococcus
RENSGNLT

SEQ ID NO: 1979397 - protein, 12 aa, Staphylococcus
RENSPSTPYPRY

SEQ ID NO: 1979398 - protein, 5 aa, Staphylococcus
REPAL

SEQ ID NO: 1979399 - protein, 5 aa, Staphylococcus
REPEL

SEQ ID NO: 1979400 - protein, 23 aa, Staphylococcus
REPGGEHKETIETGTKSAARGGF

SEQ ID NO: 1979401 - protein, 23 aa, Staphylococcus
REPGGEHKETIKTGTKAAARGGF

SEQ ID NO: 1979402 - protein, 12 aa, Staphylococcus
REPGGVKTGEQI

SEQ ID NO: 1979403 - protein, 8 aa, Staphylococcus
REPGSDIT

SEQ ID NO: 1979404 - protein, 4 aa, Staphylococcus
REPL

SEQ ID NO: 1979405 - protein, 7 aa, Staphylococcus
REPVEAG

SEQ ID NO: 1979406 - protein, 19 aa, Staphylococcus
REQAGEKDIKPVEPRFLIK

SEQ ID NO: 1979407 - protein, 7 aa, Staphylococcus
REQASQT

SEQ ID NO: 1979408 - protein, 8 aa, Staphylococcus
REQEDTDI

SEQ ID NO: 1979409 - protein, 12 aa, Staphylococcus
REQGASEEDERT

SEQ ID NO: 1979410 - protein, 20 aa, Staphylococcus
REQLTEDNVETVSGSDGLSL

SEQ ID NO: 1979411 - protein, 11 aa, Staphylococcus
REQNETPLEAS

SEQ ID NO: 1979412 - protein, 22 aa, Staphylococcus
REQNKEANHHAKQTLYQYIKNK

SEQ ID NO: 1979413 - protein, 11 aa, Staphylococcus
REQNKEANQMA

SEQ ID NO: 1979414 - protein, 8 aa, Staphylococcus
REQPKYEV

SEQ ID NO: 1979415 - protein, 4 aa, Staphylococcus
REQQ

SEQ ID NO: 1979416 - protein, 5 aa, Staphylococcus
REQRG

SEQ ID NO: 1979417 - protein, 5 aa, Staphylococcus
REQRL

SEQ ID NO: 1979418 - protein, 19 aa, Staphylococcus
REQTESELRERRGELQRQE

SEQ ID NO: 1979419 - protein, 6 aa, Staphylococcus
RERDPE

SEQ ID NO: 1979420 - protein, 5 aa, Staphylococcus
RERFE

SEQ ID NO: 1979421 - protein, 8 aa, Staphylococcus
RERGEGER

SEQ ID NO: 1979422 - protein, 6 aa, Staphylococcus
RERGHY

SEQ ID NO: 1979423 - protein, 9 aa, Staphylococcus
RERHPKDRR

SEQ ID NO: 1979424 - protein, 6 aa, Staphylococcus
RERLGL

SEQ ID NO: 1979425 - protein, 9 aa, Staphylococcus
RERLSSDGK

SEQ ID NO: 1979426 - protein, 6 aa, Staphylococcus
RERNPF

SEQ ID NO: 1979427 - protein, 4 aa, Staphylococcus
RERQ

SEQ ID NO: 1979428 - protein, 13 aa, Staphylococcus
RERQAAADQIAEQ

SEQ ID NO: 1979429 - protein, 10 aa, Staphylococcus
RERQDDWAAR

SEQ ID NO: 1979430 - protein, 8 aa, Staphylococcus
RERSEIDQ

SEQ ID NO: 1979431 - protein, 6 aa, Staphylococcus
RERSGE

SEQ ID NO: 1979432 - protein, 5 aa, Staphylococcus
RERTN

SEQ ID NO: 1979433 - protein, 5 aa, Staphylococcus
RERTR

SEQ ID NO: 1979434 - protein, 4 aa, Staphylococcus
RESA

SEQ ID NO: 1979435 - protein, 17 aa, Staphylococcus
RESAAAGIESAKNTEDC

SEQ ID NO: 1979436 - protein, 8 aa, Staphylococcus
RESADELA

SEQ ID NO: 1979437 - protein, 8 aa, Staphylococcus
RESDTKDV

SEQ ID NO: 1979438 - protein, 9 aa, Staphylococcus
RESELSPYK

SEQ ID NO: 1979439 - protein, 11 aa, Staphylococcus
RESETDKEAME

SEQ ID NO: 1979440 - protein, 8 aa, Staphylococcus
RESETDKI

SEQ ID NO: 1979441 - protein, 5 aa, Staphylococcus
RESFE

SEQ ID NO: 1979442 - protein, 6 aa, Staphylococcus
RESGGT

SEQ ID NO: 1979443 - protein, 9 aa, Staphylococcus
RESQAEAND

SEQ ID NO: 1979444 - protein, 6 aa, Staphylococcus
RESQNA

SEQ ID NO: 1979445 - protein, 8 aa, Staphylococcus
RESSKTVR

SEQ ID NO: 1979446 - protein, 6 aa, Staphylococcus
RESVNN

SEQ ID NO: 1979447 - protein, 7 aa, Staphylococcus
RESYGDD

SEQ ID NO: 1979448 - protein, 12 aa, Staphylococcus
RESYREYIDAQE

SEQ ID NO: 1979449 - protein, 7 aa, Staphylococcus
RETDGEI

SEQ ID NO: 1979450 - protein, 8 aa, Staphylococcus
RETDGTSI

SEQ ID NO: 1979451 - protein, 8 aa, Staphylococcus
RETDTQPL

SEQ ID NO: 1979452 - protein, 7 aa, Staphylococcus
RETEGTS

SEQ ID NO: 1979453 - protein, 6 aa, Staphylococcus
RETEKY

SEQ ID NO: 1979454 - protein, 7 aa, Staphylococcus
RETEKYG

SEQ ID NO: 1979455 - protein, 5 aa, Staphylococcus
RETEP

SEQ ID NO: 1979456 - protein, 20 aa, Staphylococcus
RETEPKDKVRQTQDDIVEWL

SEQ ID NO: 1979457 - protein, 6 aa, Staphylococcus
RETGEN

SEQ ID NO: 1979458 - protein, 15 aa, Staphylococcus
RETGGLPDADKFDTA

SEQ ID NO: 1979459 - protein, 15 aa, Staphylococcus
RETGGLPSDDKFEAT

SEQ ID NO: 1979460 - protein, 6 aa, Staphylococcus
RETGGT

SEQ ID NO: 1979461 - protein, 14 aa, Staphylococcus
RETGMSKKEAYQRA

SEQ ID NO: 1979462 - protein, 15 aa, Staphylococcus
RETGNLPDDAKFESA

SEQ ID NO: 1979463 - protein, 9 aa, Staphylococcus
RETHPTLDE

SEQ ID NO: 1979464 - protein, 15 aa, Staphylococcus
RETHPTLDTDLETKF

SEQ ID NO: 1979465 - protein, 6 aa, Staphylococcus
RETHYN

SEQ ID NO: 1979466 - protein, 5 aa, Staphylococcus
RETIR

SEQ ID NO: 1979467 - protein, 15 aa, Staphylococcus
RETKSLPDGEKFEQA

SEQ ID NO: 1979468 - protein, 9 aa, Staphylococcus
RETNDERNL

SEQ ID NO: 1979469 - protein, 12 aa, Staphylococcus
RETNSSLSLEKQ

SEQ ID NO: 1979470 - protein, 7 aa, Staphylococcus
RETPKYE

SEQ ID NO: 1979471 - protein, 13 aa, Staphylococcus
RETPTLSGGESQR

SEQ ID NO: 1979472 - protein, 5 aa, Staphylococcus
RETQK

SEQ ID NO: 1979473 - protein, 7 aa, Staphylococcus
RETSDPN

SEQ ID NO: 1979474 - protein, 8 aa, Staphylococcus
RETTDNDT

SEQ ID NO: 1979475 - protein, 5 aa, Staphylococcus
RETTF

SEQ ID NO: 1979476 - protein, 5 aa, Staphylococcus
RETTL

SEQ ID NO: 1979477 - protein, 13 aa, Staphylococcus
RETTTLSGGESQR

SEQ ID NO: 1979478 - protein, 8 aa, Staphylococcus
RETTTPVY

SEQ ID NO: 1979479 - protein, 4 aa, Staphylococcus
RETY

SEQ ID NO: 1979480 - protein, 12 aa, Staphylococcus
RETYIKNSKTEV

SEQ ID NO: 1979481 - protein, 7 aa, Staphylococcus
REVANKA

SEQ ID NO: 1979482 - protein, 15 aa, Staphylococcus
REVDTNLEATKKAEN

SEQ ID NO: 1979483 - protein, 12 aa, Staphylococcus
REVEGKHTADYL

SEQ ID NO: 1979484 - protein, 11 aa, Staphylococcus
REVEGKYTGDY

SEQ ID NO: 1979485 - protein, 12 aa, Staphylococcus
REVEGKYTGSYL

SEQ ID NO: 1979486 - protein, 5 aa, Staphylococcus
REVER

SEQ ID NO: 1979487 - protein, 14 aa, Staphylococcus
REVKDTTGAGDTFN

SEQ ID NO: 1979488 - protein, 5 aa, Staphylococcus
REVNE

SEQ ID NO: 1979489 - protein, 7 aa, Staphylococcus
REVNSDN

SEQ ID NO: 1979490 - protein, 10 aa, Staphylococcus
REVQKSDDNL

SEQ ID NO: 1979491 - protein, 11 aa, Staphylococcus
REVRRGKKLEH

SEQ ID NO: 1979492 - protein, 11 aa, Staphylococcus
REVSGQAYVEE

SEQ ID NO: 1979493 - protein, 8 aa, Staphylococcus
REVSPEQL

SEQ ID NO: 1979494 - protein, 7 aa, Staphylococcus
REVTDKN

SEQ ID NO: 1979495 - protein, 17 aa, Staphylococcus
REVYQQNENPKHSREEL

SEQ ID NO: 1979496 - protein, 8 aa, Staphylococcus
REYDEDKD

SEQ ID NO: 1979497 - protein, 10 aa, Staphylococcus
REYERTQHET

SEQ ID NO: 1979498 - protein, 17 aa, Staphylococcus
REYGETLPKQVGKDNHQ

SEQ ID NO: 1979499 - protein, 5 aa, Staphylococcus
REYKD

SEQ ID NO: 1979500 - protein, 4 aa, Staphylococcus
REYP

SEQ ID NO: 1979501 - protein, 5 aa, Staphylococcus
REYPS

SEQ ID NO: 1979502 - protein, 6 aa, Staphylococcus
REYSGE

SEQ ID NO: 1979503 - protein, 6 aa, Staphylococcus
REYTER

SEQ ID NO: 1979504 - protein, 16 aa, Staphylococcus
RFDAPPVKDGSITDPD

SEQ ID NO: 1979505 - protein, 9 aa, Staphylococcus
RFDKETVER

SEQ ID NO: 1979506 - protein, 10 aa, Staphylococcus
RFDKKDTKPF

SEQ ID NO: 1979507 - protein, 5 aa, Staphylococcus
RFDNE

SEQ ID NO: 1979508 - protein, 5 aa, Staphylococcus
RFEDA

SEQ ID NO: 1979509 - protein, 10 aa, Staphylococcus
RFEGGSATNI

SEQ ID NO: 1979510 - protein, 5 aa, Staphylococcus
RFERT

SEQ ID NO: 1979511 - protein, 4 aa, Staphylococcus
RFET

SEQ ID NO: 1979512 - protein, 11 aa, Staphylococcus
RFGDERRSEIQ

SEQ ID NO: 1979513 - protein, 5 aa, Staphylococcus
RFGDP

SEQ ID NO: 1979514 - protein, 15 aa, Staphylococcus
RFGEDAKEAGEFTNE

SEQ ID NO: 1979515 - protein, 7 aa, Staphylococcus
RFGEDKD

SEQ ID NO: 1979516 - protein, 16 aa, Staphylococcus
RFGGAAKTSGAGGGDC

SEQ ID NO: 1979517 - protein, 5 aa, Staphylococcus
RFGNT

SEQ ID NO: 1979518 - protein, 9 aa, Staphylococcus
RFGRGSEAI

SEQ ID NO: 1979519 - protein, 6 aa, Staphylococcus
RFGSTN

SEQ ID NO: 1979520 - protein, 7 aa, Staphylococcus
RFKDSGD

SEQ ID NO: 1979521 - protein, 16 aa, Staphylococcus
RFKNKSSGKVSKKEMK

SEQ ID NO: 1979522 - protein, 7 aa, Staphylococcus
RFKSGEY

SEQ ID NO: 1979523 - protein, 5 aa, Staphylococcus
RFNET

SEQ ID NO: 1979524 - protein, 9 aa, Staphylococcus
RFNETKVGN

SEQ ID NO: 1979525 - protein, 9 aa, Staphylococcus
RFNETKYDQ

SEQ ID NO: 1979526 - protein, 7 aa, Staphylococcus
RFNETNV

SEQ ID NO: 1979527 - protein, 8 aa, Staphylococcus
RFNETSRD

SEQ ID NO: 1979528 - protein, 12 aa, Staphylococcus
RFNNGDFYGKPE

SEQ ID NO: 1979529 - protein, 13 aa, Staphylococcus
RFPAKNKKIKEAN

SEQ ID NO: 1979530 - protein, 21 aa, Staphylococcus
RFPETSGIGVKPVSKEGTERL

SEQ ID NO: 1979531 - protein, 11 aa, Staphylococcus
RFRSGGSKVAP

SEQ ID NO: 1979532 - protein, 13 aa, Staphylococcus
RFRSGGTKTAPVT

SEQ ID NO: 1979533 - protein, 13 aa, Staphylococcus
RFRSGNSKQAPVT

SEQ ID NO: 1979534 - protein, 8 aa, Staphylococcus
RFSDKNRN

SEQ ID NO: 1979535 - protein, 17 aa, Staphylococcus
RFSEEQLQSGKHYGATW

SEQ ID NO: 1979536 - protein, 8 aa, Staphylococcus
RFSETSRE

SEQ ID NO: 1979537 - protein, 4 aa, Staphylococcus
RFSG

SEQ ID NO: 1979538 - protein, 5 aa, Staphylococcus
RFSNY

SEQ ID NO: 1979539 - protein, 5 aa, Staphylococcus
RFSPE

SEQ ID NO: 1979540 - protein, 8 aa, Staphylococcus
RFTDEKRD

SEQ ID NO: 1979541 - protein, 18 aa, Staphylococcus
RFTEEEKETLFGKDYKKG

SEQ ID NO: 1979542 - protein, 9 aa, Staphylococcus
RFTNKTSHE

SEQ ID NO: 1979543 - protein, 6 aa, Staphylococcus
RFTPDG

SEQ ID NO: 1979544 - protein, 20 aa, Staphylococcus
RFTPDKTYSTSNKSSAEVYD

SEQ ID NO: 1979545 - protein, 5 aa, Staphylococcus
RFTPE

SEQ ID NO: 1979546 - protein, 8 aa, Staphylococcus
RFTPKSKL

SEQ ID NO: 1979547 - protein, 9 aa, Staphylococcus
RGAADMKSG

SEQ ID NO: 1979548 - protein, 16 aa, Staphylococcus
RGAAPRDHAFPTPSVE

SEQ ID NO: 1979549 - protein, 10 aa, Staphylococcus
RGAGGKKPNG

SEQ ID NO: 1979550 - protein, 10 aa, Staphylococcus
RGAKSNNLKD

SEQ ID NO: 1979551 - protein, 6 aa, Staphylococcus
RGANDY

SEQ ID NO: 1979552 - protein, 13 aa, Staphylococcus
RGANHPVKDLATG

SEQ ID NO: 1979553 - protein, 25 aa, Staphylococcus
RGANHPVKDLRSGKVDITSQNHGYA

SEQ ID NO: 1979554 - protein, 25 aa, Staphylococcus
RGANHPVKDLRTGKVDITSQNHGYA

SEQ ID NO: 1979555 - protein, 26 aa, Staphylococcus
RGANHPVKDLRTGKVDITSQNHGYAI

SEQ ID NO: 1979556 - protein, 27 aa, Staphylococcus
RGANHPVKNLRTGKVDITSQNHGYSID

SEQ ID NO: 1979557 - protein, 5 aa, Staphylococcus
RGANV

SEQ ID NO: 1979558 - protein, 12 aa, Staphylococcus
RGARAAAEQIDP

SEQ ID NO: 1979559 - protein, 6 aa, Staphylococcus
RGASLS

SEQ ID NO: 1979560 - protein, 7 aa, Staphylococcus
RGASQPL

SEQ ID NO: 1979561 - protein, 7 aa, Staphylococcus
RGATPGI

SEQ ID NO: 1979562 - protein, 20 aa, Staphylococcus
RGATSYHPKITKKIVISILF

SEQ ID NO: 1979563 - protein, 18 aa, Staphylococcus
RGATSYPPKMITSCILSN

SEQ ID NO: 1979564 - protein, 16 aa, Staphylococcus
RGDADAMITGGSEAPI

SEQ ID NO: 1979565 - protein, 17 aa, Staphylococcus
RGDADAMITGGTEAPIT

SEQ ID NO: 1979566 - protein, 11 aa, Staphylococcus
RGDAFKGERIP

SEQ ID NO: 1979567 - protein, 16 aa, Staphylococcus
RGDAPDLEDEAHAYEQ

SEQ ID NO: 1979568 - protein, 7 aa, Staphylococcus
RGDEADG

SEQ ID NO: 1979569 - protein, 7 aa, Staphylococcus
RGDETDG

SEQ ID NO: 1979570 - protein, 5 aa, Staphylococcus
RGDFN

SEQ ID NO: 1979571 - protein, 8 aa, Staphylococcus
RGDKDVQT

SEQ ID NO: 1979572 - protein, 8 aa, Staphylococcus
RGDMDGAE

SEQ ID NO: 1979573 - protein, 5 aa, Staphylococcus
RGDNT

SEQ ID NO: 1979574 - protein, 5 aa, Staphylococcus
RGDYP

SEQ ID NO: 1979575 - protein, 11 aa, Staphylococcus
RGEESQQDFQK

SEQ ID NO: 1979576 - protein, 11 aa, Staphylococcus
RGEETQSDFQR

SEQ ID NO: 1979577 - protein, 8 aa, Staphylococcus
RGEGGNWQ

SEQ ID NO: 1979578 - protein, 7 aa, Staphylococcus
RGEHTKH

SEQ ID NO: 1979579 - protein, 5 aa, Staphylococcus
RGEIK

SEQ ID NO: 1979580 - protein, 7 aa, Staphylococcus
RGEKEKV

SEQ ID NO: 1979581 - protein, 9 aa, Staphylococcus
RGEKTMEER

SEQ ID NO: 1979582 - protein, 27 aa, Staphylococcus
RGELAQKIGEEKIKQGTKVYDPQREKE

SEQ ID NO: 1979583 - protein, 27 aa, Staphylococcus
RGELAQKIGEEKIKQGTRVYDPQREKE

SEQ ID NO: 1979584 - protein, 12 aa, Staphylococcus
RGENTTSGQPMP

SEQ ID NO: 1979585 - protein, 5 aa, Staphylococcus
RGEQH

SEQ ID NO: 1979586 - protein, 6 aa, Staphylococcus
RGEQTK

SEQ ID NO: 1979587 - protein, 9 aa, Staphylococcus
RGEQVDHSS

SEQ ID NO: 1979588 - protein, 7 aa, Staphylococcus
RGESYEP

SEQ ID NO: 1979589 - protein, 12 aa, Staphylococcus
RGEYKENPETGK

SEQ ID NO: 1979590 - protein, 13 aa, Staphylococcus
RGEYKENPQSGKV

SEQ ID NO: 1979591 - protein, 10 aa, Staphylococcus
RGFLPGNGAI

SEQ ID NO: 1979592 - protein, 8 aa, Staphylococcus
RGGEEAEI

SEQ ID NO: 1979593 - protein, 10 aa, Staphylococcus
RGGEEAEQLA

SEQ ID NO: 1979594 - protein, 18 aa, Staphylococcus
RGGEYSTKFLEQNNIMNE

SEQ ID NO: 1979595 - protein, 8 aa, Staphylococcus
RGGGKNGF

SEQ ID NO: 1979596 - protein, 9 aa, Staphylococcus
RGGGKNGYI

SEQ ID NO: 1979597 - protein, 7 aa, Staphylococcus
RGGGYQK

SEQ ID NO: 1979598 - protein, 7 aa, Staphylococcus
RGGGYRG

SEQ ID NO: 1979599 - protein, 15 aa, Staphylococcus
RGGIGADGITGDGAG

SEQ ID NO: 1979600 - protein, 15 aa, Staphylococcus
RGGIGADGMTGDGAG

SEQ ID NO: 1979601 - protein, 15 aa, Staphylococcus
RGGIGADGVTGDGAG

SEQ ID NO: 1979602 - protein, 15 aa, Staphylococcus
RGGISADGMTGDGAG

SEQ ID NO: 1979603 - protein, 5 aa, Staphylococcus
RGGKG

SEQ ID NO: 1979604 - protein, 4 aa, Staphylococcus
RGGL

SEQ ID NO: 1979605 - protein, 9 aa, Staphylococcus
RGGLGKVPH

SEQ ID NO: 1979606 - protein, 7 aa, Staphylococcus
RGGMTQA

SEQ ID NO: 1979607 - protein, 32 aa, Staphylococcus
RGGRGGRGNSRFATPRNPAPDFSENGEPGEEL

SEQ ID NO: 1979608 - protein, 10 aa, Staphylococcus
RGGSPTGQDR

SEQ ID NO: 1979609 - protein, 5 aa, Staphylococcus
RGGSV

SEQ ID NO: 1979610 - protein, 18 aa, Staphylococcus
RGGYYSEGPAAEMESGDR

SEQ ID NO: 1979611 - protein, 18 aa, Staphylococcus
RGGYYSEGPTAEIESGDR

SEQ ID NO: 1979612 - protein, 18 aa, Staphylococcus
RGGYYTEGPAAEVESGDR

SEQ ID NO: 1979613 - protein, 14 aa, Staphylococcus
RGHENKNSDTDNEV

SEQ ID NO: 1979614 - protein, 11 aa, Staphylococcus
RGHGKSSRCDS

SEQ ID NO: 1979615 - protein, 14 aa, Staphylococcus
RGHGKSSRPDSYNL

SEQ ID NO: 1979616 - protein, 6 aa, Staphylococcus
RGHGTD

SEQ ID NO: 1979617 - protein, 5 aa, Staphylococcus
RGHTQ

SEQ ID NO: 1979618 - protein, 4 aa, Staphylococcus
RGIA

SEQ ID NO: 1979619 - protein, 14 aa, Staphylococcus
RGIDGGLPKRPFAP

SEQ ID NO: 1979620 - protein, 31 aa, Staphylococcus
RGIDGGVPKRPFSPFNEANRKELNQLIETYN

SEQ ID NO: 1979621 - protein, 31 aa, Staphylococcus
RGIDGSVPKRPFKPFNEANRSKLDKLIKDYN

SEQ ID NO: 1979622 - protein, 6 aa, Staphylococcus
RGIDHK

SEQ ID NO: 1979623 - protein, 23 aa, Staphylococcus
RGIDHNEVKSTRIRKSVGTERTF

SEQ ID NO: 1979624 - protein, 23 aa, Staphylococcus
RGIDHNPVKPTRIRKSVGTERTF

SEQ ID NO: 1979625 - protein, 4 aa, Staphylococcus
RGIE

SEQ ID NO: 1979626 - protein, 20 aa, Staphylococcus
RGIEFPGGKIEKNETSENAI

SEQ ID NO: 1979627 - protein, 18 aa, Staphylococcus
RGIEFPGGKREHGESSID

SEQ ID NO: 1979628 - protein, 6 aa, Staphylococcus
RGIGNQ

SEQ ID NO: 1979629 - protein, 8 aa, Staphylococcus
RGIGYAPN

SEQ ID NO: 1979630 - protein, 9 aa, Staphylococcus
RGIKSGLKQ

SEQ ID NO: 1979631 - protein, 4 aa, Staphylococcus
RGIN

SEQ ID NO: 1979632 - protein, 9 aa, Staphylococcus
RGINSDGAV

SEQ ID NO: 1979633 - protein, 12 aa, Staphylococcus
RGIPKNFRQQEG

SEQ ID NO: 1979634 - protein, 5 aa, Staphylococcus
RGIPQ

SEQ ID NO: 1979635 - protein, 7 aa, Staphylococcus
RGIQAKQ

SEQ ID NO: 1979636 - protein, 6 aa, Staphylococcus
RGIQNP

SEQ ID NO: 1979637 - protein, 12 aa, Staphylococcus
RGISGKSMNRPE

SEQ ID NO: 1979638 - protein, 11 aa, Staphylococcus
RGKASHSSMPQ

SEQ ID NO: 1979639 - protein, 15 aa, Staphylococcus
RGKDGGYKANQYTST

SEQ ID NO: 1979640 - protein, 8 aa, Staphylococcus
RGKEREEY

SEQ ID NO: 1979641 - protein, 12 aa, Staphylococcus
RGKERSRRPEDI

SEQ ID NO: 1979642 - protein, 16 aa, Staphylococcus
RGKGFNLDDKPRGSGL

SEQ ID NO: 1979643 - protein, 6 aa, Staphylococcus
RGKGIA

SEQ ID NO: 1979644 - protein, 10 aa, Staphylococcus
RGKGKVTEAD

SEQ ID NO: 1979645 - protein, 5 aa, Staphylococcus
RGKGS

SEQ ID NO: 1979646 - protein, 6 aa, Staphylococcus
RGKIVD

SEQ ID NO: 1979647 - protein, 28 aa, Staphylococcus
RGKKKYDKRQALKEKAMKRDVDRAMKAR

SEQ ID NO: 1979648 - protein, 28 aa, Staphylococcus
RGKKKYDKRQALKEKAVQRDVAREMKAR

SEQ ID NO: 1979649 - protein, 28 aa, Staphylococcus
RGKKKYDKRQDLKDKAVKRDMQRAMKDR

SEQ ID NO: 1979650 - protein, 9 aa, Staphylococcus
RGKKPIQRN

SEQ ID NO: 1979651 - protein, 16 aa, Staphylococcus
RGKNGFELTNGPGKWT

SEQ ID NO: 1979652 - protein, 20 aa, Staphylococcus
RGKPIYRSSEYETFRKPGDN

SEQ ID NO: 1979653 - protein, 5 aa, Staphylococcus
RGKQN

SEQ ID NO: 1979654 - protein, 6 aa, Staphylococcus
RGKQVK

SEQ ID NO: 1979655 - protein, 8 aa, Staphylococcus
RGKTSASM

SEQ ID NO: 1979656 - protein, 8 aa, Staphylococcus
RGKYYGAT

SEQ ID NO: 1979657 - protein, 11 aa, Staphylococcus
RGLASKKTTTV

SEQ ID NO: 1979658 - protein, 4 aa, Staphylococcus
RGLE

SEQ ID NO: 1979659 - protein, 14 aa, Staphylococcus
RGLETAVGDEGGFA

SEQ ID NO: 1979660 - protein, 5 aa, Staphylococcus
RGLGA

SEQ ID NO: 1979661 - protein, 5 aa, Staphylococcus
RGLGR

SEQ ID NO: 1979662 - protein, 10 aa, Staphylococcus
RGLGSSASEL

SEQ ID NO: 1979663 - protein, 8 aa, Staphylococcus
RGLKTGRS

SEQ ID NO: 1979664 - protein, 4 aa, Staphylococcus
RGLL

SEQ ID NO: 1979665 - protein, 15 aa, Staphylococcus
RGLLEGDSECNDNNR

SEQ ID NO: 1979666 - protein, 11 aa, Staphylococcus
RGLMDEPEGGL

SEQ ID NO: 1979667 - protein, 6 aa, Staphylococcus
RGLNDE

SEQ ID NO: 1979668 - protein, 12 aa, Staphylococcus
RGLNDETKHKIA

SEQ ID NO: 1979669 - protein, 6 aa, Staphylococcus
RGLPEG

SEQ ID NO: 1979670 - protein, 19 aa, Staphylococcus
RGLPKGLAAKIDTQSFPTP

SEQ ID NO: 1979671 - protein, 11 aa, Staphylococcus
RGLRKSANKDY

SEQ ID NO: 1979672 - protein, 7 aa, Staphylococcus
RGLSTPR

SEQ ID NO: 1979673 - protein, 4 aa, Staphylococcus
RGMD

SEQ ID NO: 1979674 - protein, 15 aa, Staphylococcus
RGMKTGEVYNIYHDV

SEQ ID NO: 1979675 - protein, 5 aa, Staphylococcus
RGMPK

SEQ ID NO: 1979676 - protein, 6 aa, Staphylococcus
RGMPKG

SEQ ID NO: 1979677 - protein, 6 aa, Staphylococcus
RGNEVD

SEQ ID NO: 1979678 - protein, 14 aa, Staphylococcus
RGNNGSEGKDEFYG

SEQ ID NO: 1979679 - protein, 14 aa, Staphylococcus
RGNNGSEGKDEFYR

SEQ ID NO: 1979680 - protein, 12 aa, Staphylococcus
RGNNGSEGRDEF

SEQ ID NO: 1979681 - protein, 16 aa, Staphylococcus
RGNNGSEGRDEFSGKD

SEQ ID NO: 1979682 - protein, 8 aa, Staphylococcus
RGNNQGEF

SEQ ID NO: 1979683 - protein, 7 aa, Staphylococcus
RGNSLPL

SEQ ID NO: 1979684 - protein, 7 aa, Staphylococcus
RGNTKEI

SEQ ID NO: 1979685 - protein, 7 aa, Staphylococcus
RGNTKGA

SEQ ID NO: 1979686 - protein, 10 aa, Staphylococcus
RGNVDKSLSP

SEQ ID NO: 1979687 - protein, 12 aa, Staphylococcus
RGNYNLGGEQSG

SEQ ID NO: 1979688 - protein, 4 aa, Staphylococcus
RGPE

SEQ ID NO: 1979689 - protein, 22 aa, Staphylococcus
RGPEYGKDDPAEEMYPGGENER

SEQ ID NO: 1979690 - protein, 16 aa, Staphylococcus
RGPIGKGNAKATVDGE

SEQ ID NO: 1979691 - protein, 16 aa, Staphylococcus
RGPIGKGTAKATVDGQ

SEQ ID NO: 1979692 - protein, 15 aa, Staphylococcus
RGPKKIKRTSKDGHE

SEQ ID NO: 1979693 - protein, 5 aa, Staphylococcus
RGPNY

SEQ ID NO: 1979694 - protein, 4 aa, Staphylococcus
RGPV

SEQ ID NO: 1979695 - protein, 9 aa, Staphylococcus
RGQAAHSSM

SEQ ID NO: 1979696 - protein, 15 aa, Staphylococcus
RGQDFGEENIVGPND

SEQ ID NO: 1979697 - protein, 6 aa, Staphylococcus
RGQIDY

SEQ ID NO: 1979698 - protein, 5 aa, Staphylococcus
RGQKE

SEQ ID NO: 1979699 - protein, 6 aa, Staphylococcus
RGQKEA

SEQ ID NO: 1979700 - protein, 12 aa, Staphylococcus
RGQNSSDITEET

SEQ ID NO: 1979701 - protein, 10 aa, Staphylococcus
RGQPSNDKPW

SEQ ID NO: 1979702 - protein, 4 aa, Staphylococcus
RGQR

SEQ ID NO: 1979703 - protein, 4 aa, Staphylococcus
RGQT

SEQ ID NO: 1979704 - protein, 6 aa, Staphylococcus
RGRALE

SEQ ID NO: 1979705 - protein, 9 aa, Staphylococcus
RGRIGSGQV

SEQ ID NO: 1979706 - protein, 12 aa, Staphylococcus
RGRKDDKGELAE

SEQ ID NO: 1979707 - protein, 11 aa, Staphylococcus
RGRKDDKGRLA

SEQ ID NO: 1979708 - protein, 12 aa, Staphylococcus
RGRKDSKGDLAE

SEQ ID NO: 1979709 - protein, 25 aa, Staphylococcus
RGRNAKSYTKAKNTDIQTYRKSSAI

SEQ ID NO: 1979710 - protein, 26 aa, Staphylococcus
RGRNAKSYTKAKNTDIQTYRKSSGLE

SEQ ID NO: 1979711 - protein, 11 aa, Staphylococcus
RGRPDAKGKLA

SEQ ID NO: 1979712 - protein, 9 aa, Staphylococcus
RGRSPLNPA

SEQ ID NO: 1979713 - protein, 10 aa, Staphylococcus
RGSAKSKGQL

SEQ ID NO: 1979714 - protein, 8 aa, Staphylococcus
RGSAKSVG

SEQ ID NO: 1979715 - protein, 6 aa, Staphylococcus
RGSEQV

SEQ ID NO: 1979716 - protein, 4 aa, Staphylococcus
RGSF

SEQ ID NO: 1979717 - protein, 7 aa, Staphylococcus
RGSGHHT

SEQ ID NO: 1979718 - protein, 20 aa, Staphylococcus
RGSIHGKSYVTKDSLGAEGD

SEQ ID NO: 1979719 - protein, 4 aa, Staphylococcus
RGSQ

SEQ ID NO: 1979720 - protein, 6 aa, Staphylococcus
RGSREE

SEQ ID NO: 1979721 - protein, 10 aa, Staphylococcus
RGSSGSNGVL

SEQ ID NO: 1979722 - protein, 11 aa, Staphylococcus
RGSSKSNGVLS

SEQ ID NO: 1979723 - protein, 9 aa, Staphylococcus
RGTADADAK

SEQ ID NO: 1979724 - protein, 10 aa, Staphylococcus
RGTEPLDNKY

SEQ ID NO: 1979725 - protein, 7 aa, Staphylococcus
RGTGLGS

SEQ ID NO: 1979726 - protein, 10 aa, Staphylococcus
RGTKTETSDR

SEQ ID NO: 1979727 - protein, 6 aa, Staphylococcus
RGTKTL

SEQ ID NO: 1979728 - protein, 14 aa, Staphylococcus
RGTKVEHSNREGLK

SEQ ID NO: 1979729 - protein, 13 aa, Staphylococcus
RGTKVERAGRDGL

SEQ ID NO: 1979730 - protein, 12 aa, Staphylococcus
RGTKVERAGREQ

SEQ ID NO: 1979731 - protein, 14 aa, Staphylococcus
RGTKVERSNREGLK

SEQ ID NO: 1979732 - protein, 13 aa, Staphylococcus
RGTKVERTGREGL

SEQ ID NO: 1979733 - protein, 14 aa, Staphylococcus
RGTLSGQGKAFADG

SEQ ID NO: 1979734 - protein, 8 aa, Staphylococcus
RGTSDMKA

SEQ ID NO: 1979735 - protein, 9 aa, Staphylococcus
RGTTAADAS

SEQ ID NO: 1979736 - protein, 15 aa, Staphylococcus
RGTTSYPPKMITSCI

SEQ ID NO: 1979737 - protein, 14 aa, Staphylococcus
RGTTVERSNREGLK

SEQ ID NO: 1979738 - protein, 4 aa, Staphylococcus
RGTY

SEQ ID NO: 1979739 - protein, 5 aa, Staphylococcus
RGTYE

SEQ ID NO: 1979740 - protein, 5 aa, Staphylococcus
RGTYG

SEQ ID NO: 1979741 - protein, 16 aa, Staphylococcus
RGVAPREHSFPTPPTK

SEQ ID NO: 1979742 - protein, 13 aa, Staphylococcus
RGVESRNDKRPML

SEQ ID NO: 1979743 - protein, 8 aa, Staphylococcus
RGVHGGNG

SEQ ID NO: 1979744 - protein, 5 aa, Staphylococcus
RGVPH

SEQ ID NO: 1979745 - protein, 5 aa, Staphylococcus
RGVQG

SEQ ID NO: 1979746 - protein, 10 aa, Staphylococcus
RGVSKENANL

SEQ ID NO: 1979747 - protein, 15 aa, Staphylococcus
RGVSPRNHSFPTPEV

SEQ ID NO: 1979748 - protein, 7 aa, Staphylococcus
RGVTARN

SEQ ID NO: 1979749 - protein, 8 aa, Staphylococcus
RGVTPRND

SEQ ID NO: 1979750 - protein, 5 aa, Staphylococcus
RGWPA

SEQ ID NO: 1979751 - protein, 7 aa, Staphylococcus
RGWPPFN

SEQ ID NO: 1979752 - protein, 5 aa, Staphylococcus
RGWPS

SEQ ID NO: 1979753 - protein, 7 aa, Staphylococcus
RGWTTPA

SEQ ID NO: 1979754 - protein, 10 aa, Staphylococcus
RGWTTPAKGI

SEQ ID NO: 1979755 - protein, 15 aa, Staphylococcus
RGYDYKNGIKEPDNE

SEQ ID NO: 1979756 - protein, 4 aa, Staphylococcus
RGYE

SEQ ID NO: 1979757 - protein, 6 aa, Staphylococcus
RGYEVE

SEQ ID NO: 1979758 - protein, 7 aa, Staphylococcus
RGYNQYN

SEQ ID NO: 1979759 - protein, 10 aa, Staphylococcus
RGYPQKSNGY

SEQ ID NO: 1979760 - protein, 4 aa, Staphylococcus
RGYQ

SEQ ID NO: 1979761 - protein, 5 aa, Staphylococcus
RGYQL

SEQ ID NO: 1979762 - protein, 7 aa, Staphylococcus
RGYTGRS

SEQ ID NO: 1979763 - protein, 7 aa, Staphylococcus
RGYYPGY

SEQ ID NO: 1979764 - protein, 7 aa, Staphylococcus
RGYYRGS

SEQ ID NO: 1979765 - protein, 7 aa, Staphylococcus
RHAEGSK

SEQ ID NO: 1979766 - protein, 9 aa, Staphylococcus
RHAGQMSAE

SEQ ID NO: 1979767 - protein, 7 aa, Staphylococcus
RHAKKAK

SEQ ID NO: 1979768 - protein, 8 aa, Staphylococcus
RHANKAEI

SEQ ID NO: 1979769 - protein, 20 aa, Staphylococcus
RHAPPVQDGRITKEDTLKKS

SEQ ID NO: 1979770 - protein, 4 aa, Staphylococcus
RHDA

SEQ ID NO: 1979771 - protein, 9 aa, Staphylococcus
RHDGVDTAH

SEQ ID NO: 1979772 - protein, 4 aa, Staphylococcus
RHDN

SEQ ID NO: 1979773 - protein, 14 aa, Staphylococcus
RHDNKNIETYSDDY

SEQ ID NO: 1979774 - protein, 7 aa, Staphylococcus
RHDPSKV

SEQ ID NO: 1979775 - protein, 5 aa, Staphylococcus
RHDTI

SEQ ID NO: 1979776 - protein, 5 aa, Staphylococcus
RHEDG

SEQ ID NO: 1979777 - protein, 7 aa, Staphylococcus
RHEKAER

SEQ ID NO: 1979778 - protein, 13 aa, Staphylococcus
RHEKNEKRQPDDI

SEQ ID NO: 1979779 - protein, 13 aa, Staphylococcus
RHENTEKRTKDEI

SEQ ID NO: 1979780 - protein, 13 aa, Staphylococcus
RHERNEKRTKDEI

SEQ ID NO: 1979781 - protein, 14 aa, Staphylococcus
RHERTEKREKDEVG

SEQ ID NO: 1979782 - protein, 7 aa, Staphylococcus
RHETEQQ

SEQ ID NO: 1979783 - protein, 10 aa, Staphylococcus
RHGEKQAETL

SEQ ID NO: 1979784 - protein, 5 aa, Staphylococcus
RHGHQ

SEQ ID NO: 1979785 - protein, 9 aa, Staphylococcus
RHGIAGEAN

SEQ ID NO: 1979786 - protein, 9 aa, Staphylococcus
RHGITDEAN

SEQ ID NO: 1979787 - protein, 18 aa, Staphylococcus
RHGITGEANFEANDYHEQ

SEQ ID NO: 1979788 - protein, 14 aa, Staphylococcus
RHGITGKANFEAEN

SEQ ID NO: 1979789 - protein, 6 aa, Staphylococcus
RHGKQY

SEQ ID NO: 1979790 - protein, 11 aa, Staphylococcus
RHGQARGPMGH

SEQ ID NO: 1979791 - protein, 10 aa, Staphylococcus
RHGQGRGPMA

SEQ ID NO: 1979792 - protein, 9 aa, Staphylococcus
RHGQNNEVS

SEQ ID NO: 1979793 - protein, 11 aa, Staphylococcus
RHGSTNSTRAA

SEQ ID NO: 1979794 - protein, 5 aa, Staphylococcus
RHHPE

SEQ ID NO: 1979795 - protein, 13 aa, Staphylococcus
RHINPKSKAASLD

SEQ ID NO: 1979796 - protein, 15 aa, Staphylococcus
RHKDKLNGQPLTDKE

SEQ ID NO: 1979797 - protein, 8 aa, Staphylococcus
RHKDNGAQ

SEQ ID NO: 1979798 - protein, 6 aa, Staphylococcus
RHKDNQ

SEQ ID NO: 1979799 - protein, 7 aa, Staphylococcus
RHKGSMP

SEQ ID NO: 1979800 - protein, 8 aa, Staphylococcus
RHKGSMPK

SEQ ID NO: 1979801 - protein, 8 aa, Staphylococcus
RHKGSMPR

SEQ ID NO: 1979802 - protein, 16 aa, Staphylococcus
RHKKLTSVDKENVLSS

SEQ ID NO: 1979803 - protein, 16 aa, Staphylococcus
RHMKTGEVYDIYHDVN

SEQ ID NO: 1979804 - protein, 7 aa, Staphylococcus
RHNEAHH

SEQ ID NO: 1979805 - protein, 13 aa, Staphylococcus
RHNEETAEGYANK

SEQ ID NO: 1979806 - protein, 7 aa, Staphylococcus
RHNEKKA

SEQ ID NO: 1979807 - protein, 6 aa, Staphylococcus
RHNESE

SEQ ID NO: 1979808 - protein, 5 aa, Staphylococcus
RHNFE

SEQ ID NO: 1979809 - protein, 18 aa, Staphylococcus
RHNGDKVELNGQKGHKKV

SEQ ID NO: 1979810 - protein, 4 aa, Staphylococcus
RHNP

SEQ ID NO: 1979811 - protein, 11 aa, Staphylococcus
RHNQARGPMSH

SEQ ID NO: 1979812 - protein, 4 aa, Staphylococcus
RHPE

SEQ ID NO: 1979813 - protein, 5 aa, Staphylococcus
RHPEF

SEQ ID NO: 1979814 - protein, 25 aa, Staphylococcus
RHPESGKLSLTDGQHHAAEGVCVIF

SEQ ID NO: 1979815 - protein, 8 aa, Staphylococcus
RHPGEDKR

SEQ ID NO: 1979816 - protein, 5 aa, Staphylococcus
RHPKR

SEQ ID NO: 1979817 - protein, 5 aa, Staphylococcus
RHPNE

SEQ ID NO: 1979818 - protein, 6 aa, Staphylococcus
RHPNEY

SEQ ID NO: 1979819 - protein, 6 aa, Staphylococcus
RHPNRV

SEQ ID NO: 1979820 - protein, 5 aa, Staphylococcus
RHQQY

SEQ ID NO: 1979821 - protein, 4 aa, Staphylococcus
RHQY

SEQ ID NO: 1979822 - protein, 6 aa, Staphylococcus
RHRQSD

SEQ ID NO: 1979823 - protein, 9 aa, Staphylococcus
RHSATSSLF

SEQ ID NO: 1979824 - protein, 8 aa, Staphylococcus
RHSDNGAK

SEQ ID NO: 1979825 - protein, 5 aa, Staphylococcus
RHSES

SEQ ID NO: 1979826 - protein, 7 aa, Staphylococcus
RHSGNNP

SEQ ID NO: 1979827 - protein, 4 aa, Staphylococcus
RHSI

SEQ ID NO: 1979828 - protein, 8 aa, Staphylococcus
RHSKNGPI

SEQ ID NO: 1979829 - protein, 7 aa, Staphylococcus
RHSQDVE

SEQ ID NO: 1979830 - protein, 10 aa, Staphylococcus
RHSQSGPQLT

SEQ ID NO: 1979831 - protein, 4 aa, Staphylococcus
RHSS

SEQ ID NO: 1979832 - protein, 5 aa, Staphylococcus
RHSYK

SEQ ID NO: 1979833 - protein, 6 aa, Staphylococcus
RHTEMS

SEQ ID NO: 1979834 - protein, 6 aa, Staphylococcus
RHTGQR

SEQ ID NO: 1979835 - protein, 8 aa, Staphylococcus
RHTSKEDT

SEQ ID NO: 1979836 - protein, 4 aa, Staphylococcus
RHYD

SEQ ID NO: 1979837 - protein, 6 aa, Staphylococcus
RIAAEE

SEQ ID NO: 1979838 - protein, 16 aa, Staphylococcus
RIAAKKAREVTRRKSA

SEQ ID NO: 1979839 - protein, 12 aa, Staphylococcus
RIADNDGQQPID

SEQ ID NO: 1979840 - protein, 11 aa, Staphylococcus
RIADNKGNQPI

SEQ ID NO: 1979841 - protein, 6 aa, Staphylococcus
RIAKTG

SEQ ID NO: 1979842 - protein, 6 aa, Staphylococcus
RIARSG

SEQ ID NO: 1979843 - protein, 14 aa, Staphylococcus
RIASKNVTKETHSS

SEQ ID NO: 1979844 - protein, 4 aa, Staphylococcus
RIAT

SEQ ID NO: 1979845 - protein, 14 aa, Staphylococcus
RIATPDSPYFKEGE

SEQ ID NO: 1979846 - protein, 8 aa, Staphylococcus
RIDAPNDV

SEQ ID NO: 1979847 - protein, 13 aa, Staphylococcus
RIDEAAKDIQELG

SEQ ID NO: 1979848 - protein, 15 aa, Staphylococcus
RIDNPANVLRSQEAR

SEQ ID NO: 1979849 - protein, 11 aa, Staphylococcus
RIDNPQTPSDW

SEQ ID NO: 1979850 - protein, 6 aa, Staphylococcus
RIDNYD

SEQ ID NO: 1979851 - protein, 9 aa, Staphylococcus
RIDPRSPYA

SEQ ID NO: 1979852 - protein, 6 aa, Staphylococcus
RIDTTD

SEQ ID NO: 1979853 - protein, 11 aa, Staphylococcus
RIEAGDQKEDA

SEQ ID NO: 1979854 - protein, 8 aa, Staphylococcus
RIEENKEH

SEQ ID NO: 1979855 - protein, 5 aa, Staphylococcus
RIEGN

SEQ ID NO: 1979856 - protein, 16 aa, Staphylococcus
RIEKGKTGEPGTIIET

SEQ ID NO: 1979857 - protein, 12 aa, Staphylococcus
RIEKRSAESDLE

SEQ ID NO: 1979858 - protein, 8 aa, Staphylococcus
RIEKTESG

SEQ ID NO: 1979859 - protein, 7 aa, Staphylococcus
RIEQAPK

SEQ ID NO: 1979860 - protein, 13 aa, Staphylococcus
RIEQNREQKPIET

SEQ ID NO: 1979861 - protein, 9 aa, Staphylococcus
RIEQTSTEM

SEQ ID NO: 1979862 - protein, 7 aa, Staphylococcus
RIGAATG

SEQ ID NO: 1979863 - protein, 22 aa, Staphylococcus
RIGAEGMTTESVEGRTNTFQAN

SEQ ID NO: 1979864 - protein, 10 aa, Staphylococcus
RIGDNAASIA

SEQ ID NO: 1979865 - protein, 5 aa, Staphylococcus
RIGEE

SEQ ID NO: 1979866 - protein, 9 aa, Staphylococcus
RIGGNPNTI

SEQ ID NO: 1979867 - protein, 6 aa, Staphylococcus
RIGIPN

SEQ ID NO: 1979868 - protein, 6 aa, Staphylococcus
RIGNKR

SEQ ID NO: 1979869 - protein, 18 aa, Staphylococcus
RIGSGKSVESNLSQGGSI

SEQ ID NO: 1979870 - protein, 6 aa, Staphylococcus
RIGTDN

SEQ ID NO: 1979871 - protein, 21 aa, Staphylococcus
RIGTPAARMGDQIDESIKNER

SEQ ID NO: 1979872 - protein, 16 aa, Staphylococcus
RIGTSSAAAYLASDGT

SEQ ID NO: 1979873 - protein, 27 aa, Staphylococcus
RIHNKRQPKMANVAQPKQYISREKTPK

SEQ ID NO: 1979874 - protein, 4 aa, Staphylococcus
RIHQ

SEQ ID NO: 1979875 - protein, 27 aa, Staphylococcus
RIHSKRQPKMANVAQPKQYISREKTPK

SEQ ID NO: 1979876 - protein, 7 aa, Staphylococcus
RIKDTED

SEQ ID NO: 1979877 - protein, 5 aa, Staphylococcus
RIKEH

SEQ ID NO: 1979878 - protein, 12 aa, Staphylococcus
RIKETEKTLATE

SEQ ID NO: 1979879 - protein, 9 aa, Staphylococcus
RIKETETTL

SEQ ID NO: 1979880 - protein, 16 aa, Staphylococcus
RIKRSAPAEGDGENHK

SEQ ID NO: 1979881 - protein, 22 aa, Staphylococcus
RIKSKLKGLSPKNFRKQTFEIL

SEQ ID NO: 1979882 - protein, 12 aa, Staphylococcus
RIKTAGPSTPVE

SEQ ID NO: 1979883 - protein, 14 aa, Staphylococcus
RILNEDEVEAYFEN

SEQ ID NO: 1979884 - protein, 9 aa, Staphylococcus
RILPQGTGY

SEQ ID NO: 1979885 - protein, 12 aa, Staphylococcus
RILPSDSKSIST

SEQ ID NO: 1979886 - protein, 14 aa, Staphylococcus
RILSEEEMEAYFEY

SEQ ID NO: 1979887 - protein, 7 aa, Staphylococcus
RINAGST

SEQ ID NO: 1979888 - protein, 12 aa, Staphylococcus
RINGEYVSTEDS

SEQ ID NO: 1979889 - protein, 6 aa, Staphylococcus
RINRLG

SEQ ID NO: 1979890 - protein, 11 aa, Staphylococcus
RIPDAETNSDW

SEQ ID NO: 1979891 - protein, 4 aa, Staphylococcus
RIPE

SEQ ID NO: 1979892 - protein, 6 aa, Staphylococcus
RIPEGD

SEQ ID NO: 1979893 - protein, 7 aa, Staphylococcus
RIPEGDQ

SEQ ID NO: 1979894 - protein, 15 aa, Staphylococcus
RIPEGDQLSRTKGFD

SEQ ID NO: 1979895 - protein, 8 aa, Staphylococcus
RIPNGKNP

SEQ ID NO: 1979896 - protein, 6 aa, Staphylococcus
RIPNTD

SEQ ID NO: 1979897 - protein, 9 aa, Staphylococcus
RIPQDKLPN

SEQ ID NO: 1979898 - protein, 5 aa, Staphylococcus
RIPQN

SEQ ID NO: 1979899 - protein, 7 aa, Staphylococcus
RIPSGKK

SEQ ID NO: 1979900 - protein, 4 aa, Staphylococcus
RIQD

SEQ ID NO: 1979901 - protein, 8 aa, Staphylococcus
RIQDQDDE

SEQ ID NO: 1979902 - protein, 8 aa, Staphylococcus
RIQESLTG

SEQ ID NO: 1979903 - protein, 11 aa, Staphylococcus
RIQGASDSPLT

SEQ ID NO: 1979904 - protein, 13 aa, Staphylococcus
RIQGSSDSPLTDL

SEQ ID NO: 1979905 - protein, 15 aa, Staphylococcus
RIQKENETNKTYQSQ

SEQ ID NO: 1979906 - protein, 15 aa, Staphylococcus
RIQNENQINKTYQAQ

SEQ ID NO: 1979907 - protein, 11 aa, Staphylococcus
RIQNENQTLKT

SEQ ID NO: 1979908 - protein, 7 aa, Staphylococcus
RIQNSEN

SEQ ID NO: 1979909 - protein, 8 aa, Staphylococcus
RIQNSENL

SEQ ID NO: 1979910 - protein, 8 aa, Staphylococcus
RIQPGDTV

SEQ ID NO: 1979911 - protein, 6 aa, Staphylococcus
RIQQDN

SEQ ID NO: 1979912 - protein, 12 aa, Staphylococcus
RIQSERSGSRET

SEQ ID NO: 1979913 - protein, 10 aa, Staphylococcus
RIQSSDNSKI

SEQ ID NO: 1979914 - protein, 5 aa, Staphylococcus
RIQTP

SEQ ID NO: 1979915 - protein, 6 aa, Staphylococcus
RIRNDN

SEQ ID NO: 1979916 - protein, 15 aa, Staphylococcus
RIRNENETNKKYQAQ

SEQ ID NO: 1979917 - protein, 7 aa, Staphylococcus
RIRSSSA

SEQ ID NO: 1979918 - protein, 6 aa, Staphylococcus
RIRVGS

SEQ ID NO: 1979919 - protein, 5 aa, Staphylococcus
RISAN

SEQ ID NO: 1979920 - protein, 7 aa, Staphylococcus
RISDEEY

SEQ ID NO: 1979921 - protein, 6 aa, Staphylococcus
RISETA

SEQ ID NO: 1979922 - protein, 4 aa, Staphylococcus
RISK

SEQ ID NO: 1979923 - protein, 8 aa, Staphylococcus
RISKPGTI

SEQ ID NO: 1979924 - protein, 8 aa, Staphylococcus
RISKTGTI

SEQ ID NO: 1979925 - protein, 8 aa, Staphylococcus
RISPEGMK

SEQ ID NO: 1979926 - protein, 8 aa, Staphylococcus
RISQSGTV

SEQ ID NO: 1979927 - protein, 4 aa, Staphylococcus
RISR

SEQ ID NO: 1979928 - protein, 12 aa, Staphylococcus
RISTAAEAKDFG

SEQ ID NO: 1979929 - protein, 6 aa, Staphylococcus
RISTTQ

SEQ ID NO: 1979930 - protein, 9 aa, Staphylococcus
RITDKQSTL

SEQ ID NO: 1979931 - protein, 7 aa, Staphylococcus
RITDNGL

SEQ ID NO: 1979932 - protein, 8 aa, Staphylococcus
RITDNGLD

SEQ ID NO: 1979933 - protein, 15 aa, Staphylococcus
RITENSGISFIYTLE

SEQ ID NO: 1979934 - protein, 8 aa, Staphylococcus
RITGKPGV

SEQ ID NO: 1979935 - protein, 9 aa, Staphylococcus
RITNELKSE

SEQ ID NO: 1979936 - protein, 5 aa, Staphylococcus
RITPQ

SEQ ID NO: 1979937 - protein, 12 aa, Staphylococcus
RITSTTKGSVTS

SEQ ID NO: 1979938 - protein, 5 aa, Staphylococcus
RIYGG

SEQ ID NO: 1979939 - protein, 15 aa, Staphylococcus
RKAAQSLETDERTLD

SEQ ID NO: 1979940 - protein, 7 aa, Staphylococcus
RKAEDKK

SEQ ID NO: 1979941 - protein, 7 aa, Staphylococcus
RKAEEKK

SEQ ID NO: 1979942 - protein, 7 aa, Staphylococcus
RKAEEQK

SEQ ID NO: 1979943 - protein, 7 aa, Staphylococcus
RKAEQQK

SEQ ID NO: 1979944 - protein, 7 aa, Staphylococcus
RKAESQK

SEQ ID NO: 1979945 - protein, 6 aa, Staphylococcus
RKAGDM

SEQ ID NO: 1979946 - protein, 6 aa, Staphylococcus
RKAGGM

SEQ ID NO: 1979947 - protein, 8 aa, Staphylococcus
RKAGKDYS

SEQ ID NO: 1979948 - protein, 6 aa, Staphylococcus
RKAIND

SEQ ID NO: 1979949 - protein, 8 aa, Staphylococcus
RKAKEKVN

SEQ ID NO: 1979950 - protein, 9 aa, Staphylococcus
RKAKGARAN

SEQ ID NO: 1979951 - protein, 10 aa, Staphylococcus
RKAKGARSNI

SEQ ID NO: 1979952 - protein, 9 aa, Staphylococcus
RKAKKQSDV

SEQ ID NO: 1979953 - protein, 6 aa, Staphylococcus
RKANGF

SEQ ID NO: 1979954 - protein, 8 aa, Staphylococcus
RKAPKLDG

SEQ ID NO: 1979955 - protein, 7 aa, Staphylococcus
RKAPKLE

SEQ ID NO: 1979956 - protein, 7 aa, Staphylococcus
RKAQEKK

SEQ ID NO: 1979957 - protein, 7 aa, Staphylococcus
RKARDYS

SEQ ID NO: 1979958 - protein, 10 aa, Staphylococcus
RKARKDKLTT

SEQ ID NO: 1979959 - protein, 9 aa, Staphylococcus
RKASEDNEW

SEQ ID NO: 1979960 - protein, 9 aa, Staphylococcus
RKASEENEW

SEQ ID NO: 1979961 - protein, 19 aa, Staphylococcus
RKASIAAGKKGTDLPGQVA

SEQ ID NO: 1979962 - protein, 6 aa, Staphylococcus
RKATTD

SEQ ID NO: 1979963 - protein, 13 aa, Staphylococcus
RKAVAKGTKGLEQ

SEQ ID NO: 1979964 - protein, 14 aa, Staphylococcus
RKDAKKFVELYHAI

SEQ ID NO: 1979965 - protein, 10 aa, Staphylococcus
RKDDTHKGDY

SEQ ID NO: 1979966 - protein, 6 aa, Staphylococcus
RKDDVE

SEQ ID NO: 1979967 - protein, 8 aa, Staphylococcus
RKDEDGQL

SEQ ID NO: 1979968 - protein, 8 aa, Staphylococcus
RKDEDQRK

SEQ ID NO: 1979969 - protein, 5 aa, Staphylococcus
RKDEF

SEQ ID NO: 1979970 - protein, 5 aa, Staphylococcus
RKDEL

SEQ ID NO: 1979971 - protein, 6 aa, Staphylococcus
RKDELE

SEQ ID NO: 1979972 - protein, 8 aa, Staphylococcus
RKDENHKK

SEQ ID NO: 1979973 - protein, 20 aa, Staphylococcus
RKDEPKGKVRQPATDVIEWV

SEQ ID NO: 1979974 - protein, 9 aa, Staphylococcus
RKDERLESD

SEQ ID NO: 1979975 - protein, 5 aa, Staphylococcus
RKDGD

SEQ ID NO: 1979976 - protein, 13 aa, Staphylococcus
RKDGKYGLIETTE

SEQ ID NO: 1979977 - protein, 13 aa, Staphylococcus
RKDGKYGLIETVE

SEQ ID NO: 1979978 - protein, 5 aa, Staphylococcus
RKDGN

SEQ ID NO: 1979979 - protein, 8 aa, Staphylococcus
RKDGNHKK

SEQ ID NO: 1979980 - protein, 4 aa, Staphylococcus
RKDI

SEQ ID NO: 1979981 - protein, 26 aa, Staphylococcus
RKDINQAKHKQPSSLNVKSNLDKLSH

SEQ ID NO: 1979982 - protein, 4 aa, Staphylococcus
RKDK

SEQ ID NO: 1979983 - protein, 9 aa, Staphylococcus
RKDKEKQNI

SEQ ID NO: 1979984 - protein, 9 aa, Staphylococcus
RKDKNNAYR

SEQ ID NO: 1979985 - protein, 9 aa, Staphylococcus
RKDNGKGVT

SEQ ID NO: 1979986 - protein, 7 aa, Staphylococcus
RKDNSIQ

SEQ ID NO: 1979987 - protein, 21 aa, Staphylococcus
RKDRKANNVENEVKAELKTKG

SEQ ID NO: 1979988 - protein, 9 aa, Staphylococcus
RKDRPNYNK

SEQ ID NO: 1979989 - protein, 4 aa, Staphylococcus
RKDS

SEQ ID NO: 1979990 - protein, 9 aa, Staphylococcus
RKDSASDNS

SEQ ID NO: 1979991 - protein, 9 aa, Staphylococcus
RKDTGATTY

SEQ ID NO: 1979992 - protein, 4 aa, Staphylococcus
RKEA

SEQ ID NO: 1979993 - protein, 7 aa, Staphylococcus
RKEARRM

SEQ ID NO: 1979994 - protein, 11 aa, Staphylococcus
RKEDDAFVTSG

SEQ ID NO: 1979995 - protein, 13 aa, Staphylococcus
RKEDEIKTSTKRR

SEQ ID NO: 1979996 - protein, 6 aa, Staphylococcus
RKEDLE

SEQ ID NO: 1979997 - protein, 4 aa, Staphylococcus
RKEE

SEQ ID NO: 1979998 - protein, 29 aa, Staphylococcus
RKEEFSPLKNKEGKDSVETATDDLKRMNV

SEQ ID NO: 1979999 - protein, 7 aa, Staphylococcus
RKEELEK

SEQ ID NO: 1980000 - protein, 8 aa, Staphylococcus
RKEELEPF

SEQ ID NO: 1980001 - protein, 19 aa, Staphylococcus
RKEEPKDKVRQPAEDVIEW

SEQ ID NO: 1980002 - protein, 15 aa, Staphylococcus
RKEEQVQALEDNGVK

SEQ ID NO: 1980003 - protein, 6 aa, Staphylococcus
RKEERI

SEQ ID NO: 1980004 - protein, 10 aa, Staphylococcus
RKEESHKGDY

SEQ ID NO: 1980005 - protein, 10 aa, Staphylococcus
RKEETHKGDY

SEQ ID NO: 1980006 - protein, 6 aa, Staphylococcus
RKEEYQ

SEQ ID NO: 1980007 - protein, 6 aa, Staphylococcus
RKEGKK

SEQ ID NO: 1980008 - protein, 8 aa, Staphylococcus
RKEGNKRM

SEQ ID NO: 1980009 - protein, 7 aa, Staphylococcus
RKEHGKT

SEQ ID NO: 1980010 - protein, 5 aa, Staphylococcus
RKEIN

SEQ ID NO: 1980011 - protein, 7 aa, Staphylococcus
RKEKDKI

SEQ ID NO: 1980012 - protein, 7 aa, Staphylococcus
RKEKDKV

SEQ ID NO: 1980013 - protein, 7 aa, Staphylococcus
RKEKEKL

SEQ ID NO: 1980014 - protein, 7 aa, Staphylococcus
RKEKEKV

SEQ ID NO: 1980015 - protein, 9 aa, Staphylococcus
RKEKKDKGV

SEQ ID NO: 1980016 - protein, 9 aa, Staphylococcus
RKEKQKHSI

SEQ ID NO: 1980017 - protein, 8 aa, Staphylococcus
RKEKSGAL

SEQ ID NO: 1980018 - protein, 5 aa, Staphylococcus
RKEND

SEQ ID NO: 1980019 - protein, 8 aa, Staphylococcus
RKENLEAT

SEQ ID NO: 1980020 - protein, 21 aa, Staphylococcus
RKENPTKLKTRQPQEDVIEWI

SEQ ID NO: 1980021 - protein, 7 aa, Staphylococcus
RKERERK

SEQ ID NO: 1980022 - protein, 32 aa, Staphylococcus
RKERERKVQQKRKFKEALQNKRQQTDEEDSIQ

SEQ ID NO: 1980023 - protein, 6 aa, Staphylococcus
RKEREY

SEQ ID NO: 1980024 - protein, 7 aa, Staphylococcus
RKERQAR

SEQ ID NO: 1980025 - protein, 8 aa, Staphylococcus
RKESIPSI

SEQ ID NO: 1980026 - protein, 8 aa, Staphylococcus
RKEVDGKN

SEQ ID NO: 1980027 - protein, 23 aa, Staphylococcus
RKFPREIEESARIGIPNKGEWTE

SEQ ID NO: 1980028 - protein, 4 aa, Staphylococcus
RKFR

SEQ ID NO: 1980029 - protein, 8 aa, Staphylococcus
RKFTKEEN

SEQ ID NO: 1980030 - protein, 8 aa, Staphylococcus
RKFTRTPI

SEQ ID NO: 1980031 - protein, 4 aa, Staphylococcus
RKGD

SEQ ID NO: 1980032 - protein, 9 aa, Staphylococcus
RKGDKHAEV

SEQ ID NO: 1980033 - protein, 9 aa, Staphylococcus
RKGDQNKAL

SEQ ID NO: 1980034 - protein, 10 aa, Staphylococcus
RKGDQNKALG

SEQ ID NO: 1980035 - protein, 13 aa, Staphylococcus
RKGDYNLGGEQSG

SEQ ID NO: 1980036 - protein, 10 aa, Staphylococcus
RKGEAASHRN

SEQ ID NO: 1980037 - protein, 9 aa, Staphylococcus
RKGEAHSHK

SEQ ID NO: 1980038 - protein, 8 aa, Staphylococcus
RKGENEVI

SEQ ID NO: 1980039 - protein, 6 aa, Staphylococcus
RKGEPI

SEQ ID NO: 1980040 - protein, 30 aa, Staphylococcus
RKGIPFEPKELDNTEEEAAKQVLIDRANKS

SEQ ID NO: 1980041 - protein, 29 aa, Staphylococcus
RKGIPFEPKQLDNTEEEAAKRVIIERSSK

SEQ ID NO: 1980042 - protein, 28 aa, Staphylococcus
RKGIPFTPKQLDNTEEEAAKYVIIERSE

SEQ ID NO: 1980043 - protein, 12 aa, Staphylococcus
RKGKATEEQAQE

SEQ ID NO: 1980044 - protein, 9 aa, Staphylococcus
RKGKGLQEE

SEQ ID NO: 1980045 - protein, 9 aa, Staphylococcus
RKGKGLTDE

SEQ ID NO: 1980046 - protein, 4 aa, Staphylococcus
RKGL

SEQ ID NO: 1980047 - protein, 18 aa, Staphylococcus
RKGLNANENIKYSSEYNK

SEQ ID NO: 1980048 - protein, 13 aa, Staphylococcus
RKGLSSNERGHNK

SEQ ID NO: 1980049 - protein, 6 aa, Staphylococcus
RKGLTP

SEQ ID NO: 1980050 - protein, 18 aa, Staphylococcus
RKGMNSSETFKYSPEFAQ

SEQ ID NO: 1980051 - protein, 19 aa, Staphylococcus
RKGMSAKENIHYSSEYGQE

SEQ ID NO: 1980052 - protein, 9 aa, Staphylococcus
RKGMTPETA

SEQ ID NO: 1980053 - protein, 6 aa, Staphylococcus
RKGNCL

SEQ ID NO: 1980054 - protein, 9 aa, Staphylococcus
RKGNQNKAL

SEQ ID NO: 1980055 - protein, 18 aa, Staphylococcus
RKGNRPGFSNSKNPEEAN

SEQ ID NO: 1980056 - protein, 17 aa, Staphylococcus
RKGNRPGFTQSMSPDCA

SEQ ID NO: 1980057 - protein, 4 aa, Staphylococcus
RKGQ

SEQ ID NO: 1980058 - protein, 5 aa, Staphylococcus
RKGQK

SEQ ID NO: 1980059 - protein, 9 aa, Staphylococcus
RKGQQNEAL

SEQ ID NO: 1980060 - protein, 9 aa, Staphylococcus
RKGQSYTYE

SEQ ID NO: 1980061 - protein, 7 aa, Staphylococcus
RKGRATE

SEQ ID NO: 1980062 - protein, 7 aa, Staphylococcus
RKGRHSN

SEQ ID NO: 1980063 - protein, 7 aa, Staphylococcus
RKGRRQV

SEQ ID NO: 1980064 - protein, 7 aa, Staphylococcus
RKGSEVN

SEQ ID NO: 1980065 - protein, 7 aa, Staphylococcus
RKGSHEK

SEQ ID NO: 1980066 - protein, 11 aa, Staphylococcus
RKGSTLDSREI

SEQ ID NO: 1980067 - protein, 7 aa, Staphylococcus
RKGTDLP

SEQ ID NO: 1980068 - protein, 15 aa, Staphylococcus
RKGTDLTYQQKDKIE

SEQ ID NO: 1980069 - protein, 9 aa, Staphylococcus
RKGYSGQQI

SEQ ID NO: 1980070 - protein, 8 aa, Staphylococcus
RKHIRKND

SEQ ID NO: 1980071 - protein, 6 aa, Staphylococcus
RKHKPE

SEQ ID NO: 1980072 - protein, 10 aa, Staphylococcus
RKHLTENGNQ

SEQ ID NO: 1980073 - protein, 13 aa, Staphylococcus
RKHNETIGLNLLD

SEQ ID NO: 1980074 - protein, 9 aa, Staphylococcus
RKHNTQSNV

SEQ ID NO: 1980075 - protein, 10 aa, Staphylococcus
RKHSEQPKVT

SEQ ID NO: 1980076 - protein, 6 aa, Staphylococcus
RKHSSR

SEQ ID NO: 1980077 - protein, 11 aa, Staphylococcus
RKIAGSAQVRQ

SEQ ID NO: 1980078 - protein, 13 aa, Staphylococcus
RKIDEGSYQPSRA

SEQ ID NO: 1980079 - protein, 6 aa, Staphylococcus
RKIEHG

SEQ ID NO: 1980080 - protein, 28 aa, Staphylococcus
RKIGKTEATVQRYESGNIKNLKNDTIES

SEQ ID NO: 1980081 - protein, 7 aa, Staphylococcus
RKIGPQD

SEQ ID NO: 1980082 - protein, 8 aa, Staphylococcus
RKIKEQGI

SEQ ID NO: 1980083 - protein, 6 aa, Staphylococcus
RKIKTD

SEQ ID NO: 1980084 - protein, 14 aa, Staphylococcus
RKINIGSKHPLTRT

SEQ ID NO: 1980085 - protein, 11 aa, Staphylococcus
RKINKKTEDQF

SEQ ID NO: 1980086 - protein, 16 aa, Staphylococcus
RKIPREQLNPNIPQGR

SEQ ID NO: 1980087 - protein, 12 aa, Staphylococcus
RKIQTTKPSVVS

SEQ ID NO: 1980088 - protein, 7 aa, Staphylococcus
RKISAGN

SEQ ID NO: 1980089 - protein, 11 aa, Staphylococcus
RKITSETGHNE

SEQ ID NO: 1980090 - protein, 24 aa, Staphylococcus
RKITVNTKQQLDTFTEQSTETFEV

SEQ ID NO: 1980091 - protein, 5 aa, Staphylococcus
RKKDS

SEQ ID NO: 1980092 - protein, 5 aa, Staphylococcus
RKKEL

SEQ ID NO: 1980093 - protein, 8 aa, Staphylococcus
RKKESNLP

SEQ ID NO: 1980094 - protein, 9 aa, Staphylococcus
RKKGIENLR

SEQ ID NO: 1980095 - protein, 5 aa, Staphylococcus
RKKGN

SEQ ID NO: 1980096 - protein, 8 aa, Staphylococcus
RKKGRSSQ

SEQ ID NO: 1980097 - protein, 5 aa, Staphylococcus
RKKGV

SEQ ID NO: 1980098 - protein, 27 aa, Staphylococcus
RKKGVKDCSSWKGKPKHKNWPKTAWYR

SEQ ID NO: 1980099 - protein, 14 aa, Staphylococcus
RKKGVSISGSVNSI

SEQ ID NO: 1980100 - protein, 10 aa, Staphylococcus
RKKKNSVHYE

SEQ ID NO: 1980101 - protein, 9 aa, Staphylococcus
RKKKSKGVA

SEQ ID NO: 1980102 - protein, 10 aa, Staphylococcus
RKKPKSDDEL

SEQ ID NO: 1980103 - protein, 9 aa, Staphylococcus
RKKPRTEEE

SEQ ID NO: 1980104 - protein, 8 aa, Staphylococcus
RKKQLSKA

SEQ ID NO: 1980105 - protein, 14 aa, Staphylococcus
RKKQVVPQITEILT

SEQ ID NO: 1980106 - protein, 13 aa, Staphylococcus
RKKQVVPQITEVL

SEQ ID NO: 1980107 - protein, 12 aa, Staphylococcus
RKKRASNNQNKP

SEQ ID NO: 1980108 - protein, 7 aa, Staphylococcus
RKKRGQT

SEQ ID NO: 1980109 - protein, 8 aa, Staphylococcus
RKKRPNWT

SEQ ID NO: 1980110 - protein, 9 aa, Staphylococcus
RKLDPTSIP

SEQ ID NO: 1980111 - protein, 14 aa, Staphylococcus
RKLEKDGIRRYLEE

SEQ ID NO: 1980112 - protein, 10 aa, Staphylococcus
RKLEVEQSTT

SEQ ID NO: 1980113 - protein, 9 aa, Staphylococcus
RKLGDGDHG

SEQ ID NO: 1980114 - protein, 12 aa, Staphylococcus
RKLPGLSERERK

SEQ ID NO: 1980115 - protein, 5 aa, Staphylococcus
RKLSD

SEQ ID NO: 1980116 - protein, 7 aa, Staphylococcus
RKMTASE

SEQ ID NO: 1980117 - protein, 7 aa, Staphylococcus
RKMTEAA

SEQ ID NO: 1980118 - protein, 4 aa, Staphylococcus
RKNA

SEQ ID NO: 1980119 - protein, 8 aa, Staphylococcus
RKNDDFKV

SEQ ID NO: 1980120 - protein, 10 aa, Staphylococcus
RKNDKHRTSE

SEQ ID NO: 1980121 - protein, 7 aa, Staphylococcus
RKNDPYI

SEQ ID NO: 1980122 - protein, 8 aa, Staphylococcus
RKNDQQIR

SEQ ID NO: 1980123 - protein, 5 aa, Staphylococcus
RKNDS

SEQ ID NO: 1980124 - protein, 10 aa, Staphylococcus
RKNDVSPRTL

SEQ ID NO: 1980125 - protein, 12 aa, Staphylococcus
RKNEIKRPPVSN

SEQ ID NO: 1980126 - protein, 13 aa, Staphylococcus
RKNGISADKDYLN

SEQ ID NO: 1980127 - protein, 9 aa, Staphylococcus
RKNGNNKTV

SEQ ID NO: 1980128 - protein, 12 aa, Staphylococcus
RKNGVKADKDYL

SEQ ID NO: 1980129 - protein, 4 aa, Staphylococcus
RKNH

SEQ ID NO: 1980130 - protein, 7 aa, Staphylococcus
RKNHFNT

SEQ ID NO: 1980131 - protein, 4 aa, Staphylococcus
RKNI

SEQ ID NO: 1980132 - protein, 8 aa, Staphylococcus
RKNKDDLA

SEQ ID NO: 1980133 - protein, 8 aa, Staphylococcus
RKNKDDLN

SEQ ID NO: 1980134 - protein, 8 aa, Staphylococcus
RKNKDNDV

SEQ ID NO: 1980135 - protein, 9 aa, Staphylococcus
RKNKETALG

SEQ ID NO: 1980136 - protein, 15 aa, Staphylococcus
RKNKNGARLKSGERK

SEQ ID NO: 1980137 - protein, 8 aa, Staphylococcus
RKNKNHEL

SEQ ID NO: 1980138 - protein, 6 aa, Staphylococcus
RKNLDE

SEQ ID NO: 1980139 - protein, 6 aa, Staphylococcus
RKNPQF

SEQ ID NO: 1980140 - protein, 4 aa, Staphylococcus
RKNQ

SEQ ID NO: 1980141 - protein, 20 aa, Staphylococcus
RKNQGKLEVSPKVKVTNKEE

SEQ ID NO: 1980142 - protein, 30 aa, Staphylococcus
RKNQNKNDDFEGEKKEEAEPNNDNLVKDET

SEQ ID NO: 1980143 - protein, 17 aa, Staphylococcus
RKNSLRDTYFNINQRGD

SEQ ID NO: 1980144 - protein, 44 aa, Staphylococcus
RKNSNAQSNNQPQQSGQAQSDNNPFSNGMQNANGPIDISDEDLP

SEQ ID NO: 1980145 - protein, 9 aa, Staphylococcus
RKNSVLEPS

SEQ ID NO: 1980146 - protein, 14 aa, Staphylococcus
RKNTFQNTKNANNL

SEQ ID NO: 1980147 - protein, 13 aa, Staphylococcus
RKNVKKKKNAKIQ

SEQ ID NO: 1980148 - protein, 6 aa, Staphylococcus
RKNVSR

SEQ ID NO: 1980149 - protein, 8 aa, Staphylococcus
RKPDAKLT

SEQ ID NO: 1980150 - protein, 5 aa, Staphylococcus
RKPDI

SEQ ID NO: 1980151 - protein, 5 aa, Staphylococcus
RKPDT

SEQ ID NO: 1980152 - protein, 4 aa, Staphylococcus
RKPE

SEQ ID NO: 1980153 - protein, 6 aa, Staphylococcus
RKPELR

SEQ ID NO: 1980154 - protein, 9 aa, Staphylococcus
RKPFPQEPL

SEQ ID NO: 1980155 - protein, 6 aa, Staphylococcus
RKPHPK

SEQ ID NO: 1980156 - protein, 13 aa, Staphylococcus
RKPKALSGGQRQR

SEQ ID NO: 1980157 - protein, 7 aa, Staphylococcus
RKPLEPQ

SEQ ID NO: 1980158 - protein, 7 aa, Staphylococcus
RKPNTLD

SEQ ID NO: 1980159 - protein, 11 aa, Staphylococcus
RKPNTSDIGLN

SEQ ID NO: 1980160 - protein, 5 aa, Staphylococcus
RKPSL

SEQ ID NO: 1980161 - protein, 21 aa, Staphylococcus
RKPSQYRHDKGQVDMSDATEP

SEQ ID NO: 1980162 - protein, 4 aa, Staphylococcus
RKPV

SEQ ID NO: 1980163 - protein, 4 aa, Staphylococcus
RKPY

SEQ ID NO: 1980164 - protein, 9 aa, Staphylococcus
RKPYQLSSE

SEQ ID NO: 1980165 - protein, 8 aa, Staphylococcus
RKPYQLST

SEQ ID NO: 1980166 - protein, 5 aa, Staphylococcus
RKQAR

SEQ ID NO: 1980167 - protein, 8 aa, Staphylococcus
RKQFGKPL

SEQ ID NO: 1980168 - protein, 5 aa, Staphylococcus
RKQFP

SEQ ID NO: 1980169 - protein, 6 aa, Staphylococcus
RKQFST

SEQ ID NO: 1980170 - protein, 16 aa, Staphylococcus
RKQGGRHKGPPPFTKN

SEQ ID NO: 1980171 - protein, 20 aa, Staphylococcus
RKQGGRHKGPPPFTKQDRQH

SEQ ID NO: 1980172 - protein, 7 aa, Staphylococcus
RKQHFTA

SEQ ID NO: 1980173 - protein, 6 aa, Staphylococcus
RKQKEA

SEQ ID NO: 1980174 - protein, 7 aa, Staphylococcus
RKQNGYS

SEQ ID NO: 1980175 - protein, 10 aa, Staphylococcus
RKQPEAKKVK

SEQ ID NO: 1980176 - protein, 11 aa, Staphylococcus
RKQPNEKAHKT

SEQ ID NO: 1980177 - protein, 7 aa, Staphylococcus
RKQPTYN

SEQ ID NO: 1980178 - protein, 7 aa, Staphylococcus
RKQQDTF

SEQ ID NO: 1980179 - protein, 8 aa, Staphylococcus
RKQSESHV

SEQ ID NO: 1980180 - protein, 9 aa, Staphylococcus
RKQSPYKNV

SEQ ID NO: 1980181 - protein, 8 aa, Staphylococcus
RKQTLSNA

SEQ ID NO: 1980182 - protein, 6 aa, Staphylococcus
RKQTRQ

SEQ ID NO: 1980183 - protein, 8 aa, Staphylococcus
RKQTSGNF

SEQ ID NO: 1980184 - protein, 11 aa, Staphylococcus
RKRGESEEHSI

SEQ ID NO: 1980185 - protein, 7 aa, Staphylococcus
RKRHEEY

SEQ ID NO: 1980186 - protein, 7 aa, Staphylococcus
RKRKRAY

SEQ ID NO: 1980187 - protein, 31 aa, Staphylococcus
RKRLSEEKAQDAENVEKEEAINKATENTTID

SEQ ID NO: 1980188 - protein, 31 aa, Staphylococcus
RKRLSEEKKVNAENVEKEEAINKAVNNAEVD

SEQ ID NO: 1980189 - protein, 31 aa, Staphylococcus
RKRLSEQKAEEAENVEKEEAINKATDNATID

SEQ ID NO: 1980190 - protein, 31 aa, Staphylococcus
RKRLSEQKATEAENTEKEEAINKATENTTID

SEQ ID NO: 1980191 - protein, 40 aa, Staphylococcus
RKRNDHHSSESTKDNTKEETSDIAQKAKDLFGEDTVNIID

SEQ ID NO: 1980192 - protein, 7 aa, Staphylococcus
RKRNDRI

SEQ ID NO: 1980193 - protein, 8 aa, Staphylococcus
RKRPATAK

SEQ ID NO: 1980194 - protein, 6 aa, Staphylococcus
RKRRGE

SEQ ID NO: 1980195 - protein, 9 aa, Staphylococcus
RKRSHQDKK

SEQ ID NO: 1980196 - protein, 6 aa, Staphylococcus
RKRYDT

SEQ ID NO: 1980197 - protein, 14 aa, Staphylococcus
RKRYPISTESAKEN

SEQ ID NO: 1980198 - protein, 9 aa, Staphylococcus
RKSAKTVGD

SEQ ID NO: 1980199 - protein, 5 aa, Staphylococcus
RKSAM

SEQ ID NO: 1980200 - protein, 12 aa, Staphylococcus
RKSDNGGPNRKY

SEQ ID NO: 1980201 - protein, 14 aa, Staphylococcus
RKSEAHLKDEHEEF

SEQ ID NO: 1980202 - protein, 7 aa, Staphylococcus
RKSEEPI

SEQ ID NO: 1980203 - protein, 9 aa, Staphylococcus
RKSEGKTQA

SEQ ID NO: 1980204 - protein, 6 aa, Staphylococcus
RKSFEL

SEQ ID NO: 1980205 - protein, 8 aa, Staphylococcus
RKSGKDYN

SEQ ID NO: 1980206 - protein, 9 aa, Staphylococcus
RKSGNQGLD

SEQ ID NO: 1980207 - protein, 9 aa, Staphylococcus
RKSISNKNS

SEQ ID NO: 1980208 - protein, 18 aa, Staphylococcus
RKSKAKKSDSPALNKGFN

SEQ ID NO: 1980209 - protein, 9 aa, Staphylococcus
RKSKEKTAV

SEQ ID NO: 1980210 - protein, 20 aa, Staphylococcus
RKSKEVKQSSKVKDIDADKD

SEQ ID NO: 1980211 - protein, 18 aa, Staphylococcus
RKSKLKKDKNEVTLKERA

SEQ ID NO: 1980212 - protein, 31 aa, Staphylococcus
RKSKRRNGDLTQNKDDSLLPENNDIYDRPRG

SEQ ID NO: 1980213 - protein, 35 aa, Staphylococcus
RKSKTKKSDSPALNRGFNSKKKQFTNLNSPQKRGV

SEQ ID NO: 1980214 - protein, 5 aa, Staphylococcus
RKSLP

SEQ ID NO: 1980215 - protein, 8 aa, Staphylococcus
RKSNESPF

SEQ ID NO: 1980216 - protein, 14 aa, Staphylococcus
RKSPGLNGTEVEPR

SEQ ID NO: 1980217 - protein, 6 aa, Staphylococcus
RKSRNL

SEQ ID NO: 1980218 - protein, 5 aa, Staphylococcus
RKSSN

SEQ ID NO: 1980219 - protein, 8 aa, Staphylococcus
RKSSYKNV

SEQ ID NO: 1980220 - protein, 5 aa, Staphylococcus
RKSTF

SEQ ID NO: 1980221 - protein, 7 aa, Staphylococcus
RKSTREF

SEQ ID NO: 1980222 - protein, 10 aa, Staphylococcus
RKSVKGFDPD

SEQ ID NO: 1980223 - protein, 22 aa, Staphylococcus
RKSYGSTGQESVRHQIKVAKDL

SEQ ID NO: 1980224 - protein, 7 aa, Staphylococcus
RKSYTAK

SEQ ID NO: 1980225 - protein, 5 aa, Staphylococcus
RKSYY

SEQ ID NO: 1980226 - protein, 13 aa, Staphylococcus
RKTELRKTFKNDS

SEQ ID NO: 1980227 - protein, 11 aa, Staphylococcus
RKTFNNQGEPY

SEQ ID NO: 1980228 - protein, 7 aa, Staphylococcus
RKTNSNR

SEQ ID NO: 1980229 - protein, 20 aa, Staphylococcus
RKTPLLPGKNGSFRKFRFFN

SEQ ID NO: 1980230 - protein, 9 aa, Staphylococcus
RKTPNNSEE

SEQ ID NO: 1980231 - protein, 8 aa, Staphylococcus
RKTQHNES

SEQ ID NO: 1980232 - protein, 14 aa, Staphylococcus
RKTSRKFQGDYNQY

SEQ ID NO: 1980233 - protein, 10 aa, Staphylococcus
RKTYNHTTTH

SEQ ID NO: 1980234 - protein, 8 aa, Staphylococcus
RKTYNNES

SEQ ID NO: 1980235 - protein, 7 aa, Staphylococcus
RKTYQRE

SEQ ID NO: 1980236 - protein, 9 aa, Staphylococcus
RKTYRGESV

SEQ ID NO: 1980237 - protein, 13 aa, Staphylococcus
RKVEGSALKNAYS

SEQ ID NO: 1980238 - protein, 14 aa, Staphylococcus
RKVEYGDIKTSTRF

SEQ ID NO: 1980239 - protein, 17 aa, Staphylococcus
RKVGHARGKVLGGSSSI

SEQ ID NO: 1980240 - protein, 6 aa, Staphylococcus
RKVGNK

SEQ ID NO: 1980241 - protein, 8 aa, Staphylococcus
RKVKSGES

SEQ ID NO: 1980242 - protein, 7 aa, Staphylococcus
RKVNGVE

SEQ ID NO: 1980243 - protein, 5 aa, Staphylococcus
RKVRR

SEQ ID NO: 1980244 - protein, 33 aa, Staphylococcus
RKVTNKPIEAKVGPRRAGDPSKLVASSDKAQSI

SEQ ID NO: 1980245 - protein, 4 aa, Staphylococcus
RKYE

SEQ ID NO: 1980246 - protein, 7 aa, Staphylococcus
RKYEGRQ

SEQ ID NO: 1980247 - protein, 6 aa, Staphylococcus
RKYGKN

SEQ ID NO: 1980248 - protein, 7 aa, Staphylococcus
RKYGSAF

SEQ ID NO: 1980249 - protein, 13 aa, Staphylococcus
RKYGSKDQETVEK

SEQ ID NO: 1980250 - protein, 13 aa, Staphylococcus
RKYGSQDQETIER

SEQ ID NO: 1980251 - protein, 13 aa, Staphylococcus
RKYGSQDQETVEK

SEQ ID NO: 1980252 - protein, 7 aa, Staphylococcus
RKYNETT

SEQ ID NO: 1980253 - protein, 7 aa, Staphylococcus
RKYPGYS

SEQ ID NO: 1980254 - protein, 7 aa, Staphylococcus
RKYPKSI

SEQ ID NO: 1980255 - protein, 7 aa, Staphylococcus
RKYPNDT

SEQ ID NO: 1980256 - protein, 7 aa, Staphylococcus
RKYPNET

SEQ ID NO: 1980257 - protein, 9 aa, Staphylococcus
RKYSHEDNE

SEQ ID NO: 1980258 - protein, 5 aa, Staphylococcus
RKYSN

SEQ ID NO: 1980259 - protein, 8 aa, Staphylococcus
RKYSNKDD

SEQ ID NO: 1980260 - protein, 7 aa, Staphylococcus
RKYTGKQ

SEQ ID NO: 1980261 - protein, 7 aa, Staphylococcus
RKYTGRQ

SEQ ID NO: 1980262 - protein, 5 aa, Staphylococcus
RLAKE

SEQ ID NO: 1980263 - protein, 11 aa, Staphylococcus
RLAKKTNKKQG

SEQ ID NO: 1980264 - protein, 11 aa, Staphylococcus
RLAKKTPKKEG

SEQ ID NO: 1980265 - protein, 6 aa, Staphylococcus
RLASNS

SEQ ID NO: 1980266 - protein, 4 aa, Staphylococcus
RLDA

SEQ ID NO: 1980267 - protein, 4 aa, Staphylococcus
RLDD

SEQ ID NO: 1980268 - protein, 7 aa, Staphylococcus
RLDDDGQ

SEQ ID NO: 1980269 - protein, 6 aa, Staphylococcus
RLDEDG

SEQ ID NO: 1980270 - protein, 7 aa, Staphylococcus
RLDESYR

SEQ ID NO: 1980271 - protein, 10 aa, Staphylococcus
RLDGDNVRHG

SEQ ID NO: 1980272 - protein, 9 aa, Staphylococcus
RLDRGEPVK

SEQ ID NO: 1980273 - protein, 12 aa, Staphylococcus
RLEAAKEEIEQY

SEQ ID NO: 1980274 - protein, 6 aa, Staphylococcus
RLEAET

SEQ ID NO: 1980275 - protein, 9 aa, Staphylococcus
RLEGEYGQE

SEQ ID NO: 1980276 - protein, 5 aa, Staphylococcus
RLEGG

SEQ ID NO: 1980277 - protein, 12 aa, Staphylococcus
RLEGGEIQTANY

SEQ ID NO: 1980278 - protein, 7 aa, Staphylococcus
RLEPSFN

SEQ ID NO: 1980279 - protein, 7 aa, Staphylococcus
RLEPSRK

SEQ ID NO: 1980280 - protein, 8 aa, Staphylococcus
RLEPSYNS

SEQ ID NO: 1980281 - protein, 5 aa, Staphylococcus
RLEQA

SEQ ID NO: 1980282 - protein, 17 aa, Staphylococcus
RLEQNEKKRCEKEGIEY

SEQ ID NO: 1980283 - protein, 7 aa, Staphylococcus
RLEREDD

SEQ ID NO: 1980284 - protein, 22 aa, Staphylococcus
RLESENKLTRTHGGAKVTENIG

SEQ ID NO: 1980285 - protein, 6 aa, Staphylococcus
RLETDG

SEQ ID NO: 1980286 - protein, 11 aa, Staphylococcus
RLETDGKLLTG

SEQ ID NO: 1980287 - protein, 5 aa, Staphylococcus
RLETE

SEQ ID NO: 1980288 - protein, 7 aa, Staphylococcus
RLETNYK

SEQ ID NO: 1980289 - protein, 15 aa, Staphylococcus
RLETSEEDVYASGDA

SEQ ID NO: 1980290 - protein, 6 aa, Staphylococcus
RLGDMS

SEQ ID NO: 1980291 - protein, 7 aa, Staphylococcus
RLGDMSK

SEQ ID NO: 1980292 - protein, 6 aa, Staphylococcus
RLGEMS

SEQ ID NO: 1980293 - protein, 10 aa, Staphylococcus
RLGNKNSRVD

SEQ ID NO: 1980294 - protein, 7 aa, Staphylococcus
RLGQAPE

SEQ ID NO: 1980295 - protein, 12 aa, Staphylococcus
RLGRKDEKVKEL

SEQ ID NO: 1980296 - protein, 4 aa, Staphylococcus
RLGS

SEQ ID NO: 1980297 - protein, 5 aa, Staphylococcus
RLGSY

SEQ ID NO: 1980298 - protein, 8 aa, Staphylococcus
RLGTGKVA

SEQ ID NO: 1980299 - protein, 4 aa, Staphylococcus
RLHT

SEQ ID NO: 1980300 - protein, 13 aa, Staphylococcus
RLHTPRRDEPRVK

SEQ ID NO: 1980301 - protein, 5 aa, Staphylococcus
RLKEE

SEQ ID NO: 1980302 - protein, 8 aa, Staphylococcus
RLKEELAS

SEQ ID NO: 1980303 - protein, 5 aa, Staphylococcus
RLKEK

SEQ ID NO: 1980304 - protein, 8 aa, Staphylococcus
RLKEQGAD

SEQ ID NO: 1980305 - protein, 9 aa, Staphylococcus
RLKEQGADA

SEQ ID NO: 1980306 - protein, 9 aa, Staphylococcus
RLKEQGANA

SEQ ID NO: 1980307 - protein, 7 aa, Staphylococcus
RLKERKP

SEQ ID NO: 1980308 - protein, 15 aa, Staphylococcus
RLKPDYESTAIPQVP

SEQ ID NO: 1980309 - protein, 5 aa, Staphylococcus
RLKPE

SEQ ID NO: 1980310 - protein, 8 aa, Staphylococcus
RLKSDPAF

SEQ ID NO: 1980311 - protein, 8 aa, Staphylococcus
RLKSDPDF

SEQ ID NO: 1980312 - protein, 5 aa, Staphylococcus
RLKSK

SEQ ID NO: 1980313 - protein, 4 aa, Staphylococcus
RLND

SEQ ID NO: 1980314 - protein, 7 aa, Staphylococcus
RLNDTSN

SEQ ID NO: 1980315 - protein, 15 aa, Staphylococcus
RLNENAYGLSGGQQQ

SEQ ID NO: 1980316 - protein, 12 aa, Staphylococcus
RLNERVNTKKVR

SEQ ID NO: 1980317 - protein, 13 aa, Staphylococcus
RLNGKRKDTSVNI

SEQ ID NO: 1980318 - protein, 14 aa, Staphylococcus
RLNGNSRNKMSPSK

SEQ ID NO: 1980319 - protein, 5 aa, Staphylococcus
RLNIA

SEQ ID NO: 1980320 - protein, 10 aa, Staphylococcus
RLNKDDMEHV

SEQ ID NO: 1980321 - protein, 8 aa, Staphylococcus
RLNKDDQV

SEQ ID NO: 1980322 - protein, 5 aa, Staphylococcus
RLNNP

SEQ ID NO: 1980323 - protein, 6 aa, Staphylococcus
RLNNPF

SEQ ID NO: 1980324 - protein, 5 aa, Staphylococcus
RLNPE

SEQ ID NO: 1980325 - protein, 4 aa, Staphylococcus
RLNQ

SEQ ID NO: 1980326 - protein, 6 aa, Staphylococcus
RLNQDD

SEQ ID NO: 1980327 - protein, 4 aa, Staphylococcus
RLNT

SEQ ID NO: 1980328 - protein, 5 aa, Staphylococcus
RLNTQ

SEQ ID NO: 1980329 - protein, 7 aa, Staphylococcus
RLPANYE

SEQ ID NO: 1980330 - protein, 4 aa, Staphylococcus
RLPD

SEQ ID NO: 1980331 - protein, 4 aa, Staphylococcus
RLPE

SEQ ID NO: 1980332 - protein, 6 aa, Staphylococcus
RLPGPV

SEQ ID NO: 1980333 - protein, 5 aa, Staphylococcus
RLPGR

SEQ ID NO: 1980334 - protein, 10 aa, Staphylococcus
RLPQKEIKKP

SEQ ID NO: 1980335 - protein, 6 aa, Staphylococcus
RLPQLD

SEQ ID NO: 1980336 - protein, 4 aa, Staphylococcus
RLPT

SEQ ID NO: 1980337 - protein, 4 aa, Staphylococcus
RLQE

SEQ ID NO: 1980338 - protein, 5 aa, Staphylococcus
RLQEA

SEQ ID NO: 1980339 - protein, 8 aa, Staphylococcus
RLQKSPAF

SEQ ID NO: 1980340 - protein, 10 aa, Staphylococcus
RLQPENSSMD

SEQ ID NO: 1980341 - protein, 9 aa, Staphylococcus
RLQPENSTM

SEQ ID NO: 1980342 - protein, 8 aa, Staphylococcus
RLQPGDTV

SEQ ID NO: 1980343 - protein, 5 aa, Staphylococcus
RLRAQ

SEQ ID NO: 1980344 - protein, 5 aa, Staphylococcus
RLRKN

SEQ ID NO: 1980345 - protein, 5 aa, Staphylococcus
RLRTQ

SEQ ID NO: 1980346 - protein, 10 aa, Staphylococcus
RLSDGELKHP

SEQ ID NO: 1980347 - protein, 8 aa, Staphylococcus
RLSDTQNM

SEQ ID NO: 1980348 - protein, 10 aa, Staphylococcus
RLSEDDAKKG

SEQ ID NO: 1980349 - protein, 8 aa, Staphylococcus
RLSEDKDK

SEQ ID NO: 1980350 - protein, 9 aa, Staphylococcus
RLSGESEEI

SEQ ID NO: 1980351 - protein, 30 aa, Staphylococcus
RLSKSKPIAIDKNNEAVGLSGTNGKKYVGV

SEQ ID NO: 1980352 - protein, 8 aa, Staphylococcus
RLSKSPAM

SEQ ID NO: 1980353 - protein, 9 aa, Staphylococcus
RLSKSPAMF

SEQ ID NO: 1980354 - protein, 10 aa, Staphylococcus
RLSPSSIGSE

SEQ ID NO: 1980355 - protein, 8 aa, Staphylococcus
RLSPTDVQ

SEQ ID NO: 1980356 - protein, 4 aa, Staphylococcus
RLST

SEQ ID NO: 1980357 - protein, 5 aa, Staphylococcus
RLSYE

SEQ ID NO: 1980358 - protein, 8 aa, Staphylococcus
RLSYEAGR

SEQ ID NO: 1980359 - protein, 10 aa, Staphylococcus
RLTAEDKKEI

SEQ ID NO: 1980360 - protein, 12 aa, Staphylococcus
RLTDDEGTGKIE

SEQ ID NO: 1980361 - protein, 7 aa, Staphylococcus
RLTDEDR

SEQ ID NO: 1980362 - protein, 9 aa, Staphylococcus
RLTDNGRDK

SEQ ID NO: 1980363 - protein, 4 aa, Staphylococcus
RLTE

SEQ ID NO: 1980364 - protein, 8 aa, Staphylococcus
RLTEDKDK

SEQ ID NO: 1980365 - protein, 7 aa, Staphylococcus
RLTEGDL

SEQ ID NO: 1980366 - protein, 11 aa, Staphylococcus
RLTEGKYDSEV

SEQ ID NO: 1980367 - protein, 6 aa, Staphylococcus
RLTEPA

SEQ ID NO: 1980368 - protein, 7 aa, Staphylococcus
RLTETEL

SEQ ID NO: 1980369 - protein, 13 aa, Staphylococcus
RLTKEGISITKLG

SEQ ID NO: 1980370 - protein, 6 aa, Staphylococcus
RLTNSN

SEQ ID NO: 1980371 - protein, 16 aa, Staphylococcus
RLTQQQAQTTKEMTNV

SEQ ID NO: 1980372 - protein, 6 aa, Staphylococcus
RLTRET

SEQ ID NO: 1980373 - protein, 19 aa, Staphylococcus
RLTTAKKFGATHTINSSHV

SEQ ID NO: 1980374 - protein, 9 aa, Staphylococcus
RLYGKNSEI

SEQ ID NO: 1980375 - protein, 5 aa, Staphylococcus
RMAED

SEQ ID NO: 1980376 - protein, 11 aa, Staphylococcus
RMAEPGEYSKR

SEQ ID NO: 1980377 - protein, 9 aa, Staphylococcus
RMDDSKSYI

SEQ ID NO: 1980378 - protein, 12 aa, Staphylococcus
RMDEATLSGDNE

SEQ ID NO: 1980379 - protein, 7 aa, Staphylococcus
RMDQQSK

SEQ ID NO: 1980380 - protein, 12 aa, Staphylococcus
RMEQKKIPEDLD

SEQ ID NO: 1980381 - protein, 10 aa, Staphylococcus
RMEQKKIPHD

SEQ ID NO: 1980382 - protein, 7 aa, Staphylococcus
RMERSAA

SEQ ID NO: 1980383 - protein, 8 aa, Staphylococcus
RMGDNAAS

SEQ ID NO: 1980384 - protein, 4 aa, Staphylococcus
RMGP

SEQ ID NO: 1980385 - protein, 14 aa, Staphylococcus
RMGPAGLAESHPHD

SEQ ID NO: 1980386 - protein, 14 aa, Staphylococcus
RMGPAGLAESHPHN

SEQ ID NO: 1980387 - protein, 8 aa, Staphylococcus
RMKDEKGL

SEQ ID NO: 1980388 - protein, 5 aa, Staphylococcus
RMKDG

SEQ ID NO: 1980389 - protein, 8 aa, Staphylococcus
RMKEEVGQ

SEQ ID NO: 1980390 - protein, 8 aa, Staphylococcus
RMKQNART

SEQ ID NO: 1980391 - protein, 24 aa, Staphylococcus
RMKRQERKQFSKRQNRQQRKNNKK

SEQ ID NO: 1980392 - protein, 24 aa, Staphylococcus
RMKRQERKQYSKQRSRQQRKNNKK

SEQ ID NO: 1980393 - protein, 16 aa, Staphylococcus
RMKSNNPEQPIDYNQS

SEQ ID NO: 1980394 - protein, 9 aa, Staphylococcus
RMKTREKEL

SEQ ID NO: 1980395 - protein, 4 aa, Staphylococcus
RMNP

SEQ ID NO: 1980396 - protein, 9 aa, Staphylococcus
RMPASERPR

SEQ ID NO: 1980397 - protein, 9 aa, Staphylococcus
RMPEEARPR

SEQ ID NO: 1980398 - protein, 9 aa, Staphylococcus
RMPESERPR

SEQ ID NO: 1980399 - protein, 9 aa, Staphylococcus
RMPKDERPR

SEQ ID NO: 1980400 - protein, 9 aa, Staphylococcus
RMPKEERPR

SEQ ID NO: 1980401 - protein, 9 aa, Staphylococcus
RMPKNERPR

SEQ ID NO: 1980402 - protein, 10 aa, Staphylococcus
RMQAASENLE

SEQ ID NO: 1980403 - protein, 12 aa, Staphylococcus
RMRGKGKVTEAD

SEQ ID NO: 1980404 - protein, 7 aa, Staphylococcus
RMSNEEI

SEQ ID NO: 1980405 - protein, 8 aa, Staphylococcus
RMSQSSNK

SEQ ID NO: 1980406 - protein, 11 aa, Staphylococcus
RMTKASEDLDF

SEQ ID NO: 1980407 - protein, 4 aa, Staphylococcus
RMTP

SEQ ID NO: 1980408 - protein, 5 aa, Staphylococcus
RMTPG

SEQ ID NO: 1980409 - protein, 27 aa, Staphylococcus
RMTPHSSDDDDKYRTQEERDSLKEGDC

SEQ ID NO: 1980410 - protein, 8 aa, Staphylococcus
RMTPSDSY

SEQ ID NO: 1980411 - protein, 7 aa, Staphylococcus
RMTQGQS

SEQ ID NO: 1980412 - protein, 8 aa, Staphylococcus
RMTTGESI

SEQ ID NO: 1980413 - protein, 7 aa, Staphylococcus
RNAEQKV

SEQ ID NO: 1980414 - protein, 11 aa, Staphylococcus
RNAGQQGDVEK

SEQ ID NO: 1980415 - protein, 11 aa, Staphylococcus
RNAIDGETLEQ

SEQ ID NO: 1980416 - protein, 7 aa, Staphylococcus
RNAPEYN

SEQ ID NO: 1980417 - protein, 9 aa, Staphylococcus
RNAPTWKRS

SEQ ID NO: 1980418 - protein, 5 aa, Staphylococcus
RNAQE

SEQ ID NO: 1980419 - protein, 9 aa, Staphylococcus
RNARASQAI

SEQ ID NO: 1980420 - protein, 8 aa, Staphylococcus
RNASDALN

SEQ ID NO: 1980421 - protein, 95 aa, Staphylococcus
RNAVSSDIEYATNEDEENDERLAQDTNKEDQKLSQSEDIQHESLNNEDVSLTSNKTDDSEHLEKDSLNEDKKAEPSFNKTNKAPQKMSIKPGSKP

SEQ ID NO: 1980422 - protein, 7 aa, Staphylococcus
RNDEETA

SEQ ID NO: 1980423 - protein, 17 aa, Staphylococcus
RNDEGSWEDSSEGLPNE

SEQ ID NO: 1980424 - protein, 10 aa, Staphylococcus
RNDETHKGDY

SEQ ID NO: 1980425 - protein, 5 aa, Staphylococcus
RNDGF

SEQ ID NO: 1980426 - protein, 16 aa, Staphylococcus
RNDKVDESKLPRPQIQ

SEQ ID NO: 1980427 - protein, 6 aa, Staphylococcus
RNDLDN

SEQ ID NO: 1980428 - protein, 10 aa, Staphylococcus
RNDLTEKAEH

SEQ ID NO: 1980429 - protein, 8 aa, Staphylococcus
RNDNTSVK

SEQ ID NO: 1980430 - protein, 10 aa, Staphylococcus
RNDPKDETVT

SEQ ID NO: 1980431 - protein, 11 aa, Staphylococcus
RNDYSKKTISA

SEQ ID NO: 1980432 - protein, 16 aa, Staphylococcus
RNEAANKKLKQAEKSI

SEQ ID NO: 1980433 - protein, 6 aa, Staphylococcus
RNEAVP

SEQ ID NO: 1980434 - protein, 6 aa, Staphylococcus
RNEDDK

SEQ ID NO: 1980435 - protein, 7 aa, Staphylococcus
RNEDDKG

SEQ ID NO: 1980436 - protein, 13 aa, Staphylococcus
RNEDGTVAVSGRE

SEQ ID NO: 1980437 - protein, 18 aa, Staphylococcus
RNEDSQQPGQPKESSEIT

SEQ ID NO: 1980438 - protein, 10 aa, Staphylococcus
RNEEADDTVT

SEQ ID NO: 1980439 - protein, 6 aa, Staphylococcus
RNEEDQ

SEQ ID NO: 1980440 - protein, 6 aa, Staphylococcus
RNEEDY

SEQ ID NO: 1980441 - protein, 18 aa, Staphylococcus
RNEERGRAAVKTLENKGI

SEQ ID NO: 1980442 - protein, 5 aa, Staphylococcus
RNEFE

SEQ ID NO: 1980443 - protein, 4 aa, Staphylococcus
RNEG

SEQ ID NO: 1980444 - protein, 8 aa, Staphylococcus
RNEGPFND

SEQ ID NO: 1980445 - protein, 16 aa, Staphylococcus
RNEGREKKLNYFGYRN

SEQ ID NO: 1980446 - protein, 10 aa, Staphylococcus
RNEGTKLPHT

SEQ ID NO: 1980447 - protein, 9 aa, Staphylococcus
RNEKQIKAA

SEQ ID NO: 1980448 - protein, 6 aa, Staphylococcus
RNELKG

SEQ ID NO: 1980449 - protein, 5 aa, Staphylococcus
RNELN

SEQ ID NO: 1980450 - protein, 5 aa, Staphylococcus
RNEMK

SEQ ID NO: 1980451 - protein, 5 aa, Staphylococcus
RNENE

SEQ ID NO: 1980452 - protein, 6 aa, Staphylococcus
RNENEK

SEQ ID NO: 1980453 - protein, 13 aa, Staphylococcus
RNEQGENENNGRC

SEQ ID NO: 1980454 - protein, 8 aa, Staphylococcus
RNEQRGME

SEQ ID NO: 1980455 - protein, 8 aa, Staphylococcus
RNERETIT

SEQ ID NO: 1980456 - protein, 4 aa, Staphylococcus
RNEY

SEQ ID NO: 1980457 - protein, 8 aa, Staphylococcus
RNFRDDPA

SEQ ID NO: 1980458 - protein, 10 aa, Staphylococcus
RNGAEETKAA

SEQ ID NO: 1980459 - protein, 9 aa, Staphylococcus
RNGATDNEL

SEQ ID NO: 1980460 - protein, 14 aa, Staphylococcus
RNGDASETVIKALF

SEQ ID NO: 1980461 - protein, 15 aa, Staphylococcus
RNGDELTSEEQQKVN

SEQ ID NO: 1980462 - protein, 9 aa, Staphylococcus
RNGEEGLDG

SEQ ID NO: 1980463 - protein, 10 aa, Staphylococcus
RNGEISNRQI

SEQ ID NO: 1980464 - protein, 12 aa, Staphylococcus
RNGESLKKTNAF

SEQ ID NO: 1980465 - protein, 6 aa, Staphylococcus
RNGIPE

SEQ ID NO: 1980466 - protein, 7 aa, Staphylococcus
RNGKDAI

SEQ ID NO: 1980467 - protein, 6 aa, Staphylococcus
RNGKQM

SEQ ID NO: 1980468 - protein, 7 aa, Staphylococcus
RNGKSIP

SEQ ID NO: 1980469 - protein, 6 aa, Staphylococcus
RNGLPI

SEQ ID NO: 1980470 - protein, 19 aa, Staphylococcus
RNGNKEEIEYQKAHGGEIS

SEQ ID NO: 1980471 - protein, 7 aa, Staphylococcus
RNGQNNH

SEQ ID NO: 1980472 - protein, 5 aa, Staphylococcus
RNGRS

SEQ ID NO: 1980473 - protein, 10 aa, Staphylococcus
RNGSGKSSLS

SEQ ID NO: 1980474 - protein, 9 aa, Staphylococcus
RNGSGKSTL

SEQ ID NO: 1980475 - protein, 19 aa, Staphylococcus
RNGSQEEIEYQKTHGGDIS

SEQ ID NO: 1980476 - protein, 8 aa, Staphylococcus
RNGTEINT

SEQ ID NO: 1980477 - protein, 8 aa, Staphylococcus
RNHEDNDK

SEQ ID NO: 1980478 - protein, 16 aa, Staphylococcus
RNHEPQALSGGQKQRV

SEQ ID NO: 1980479 - protein, 14 aa, Staphylococcus
RNHHKNTFKQNEGY

SEQ ID NO: 1980480 - protein, 4 aa, Staphylococcus
RNHP

SEQ ID NO: 1980481 - protein, 5 aa, Staphylococcus
RNHSD

SEQ ID NO: 1980482 - protein, 14 aa, Staphylococcus
RNHYKNKFKKEEGY

SEQ ID NO: 1980483 - protein, 13 aa, Staphylococcus
RNIEQSLKDKHTA

SEQ ID NO: 1980484 - protein, 4 aa, Staphylococcus
RNIG

SEQ ID NO: 1980485 - protein, 6 aa, Staphylococcus
RNIGQG

SEQ ID NO: 1980486 - protein, 13 aa, Staphylococcus
RNIKTLSGGQRQR

SEQ ID NO: 1980487 - protein, 7 aa, Staphylococcus
RNINSPT

SEQ ID NO: 1980488 - protein, 4 aa, Staphylococcus
RNIP

SEQ ID NO: 1980489 - protein, 6 aa, Staphylococcus
RNIPGV

SEQ ID NO: 1980490 - protein, 5 aa, Staphylococcus
RNIPK

SEQ ID NO: 1980491 - protein, 7 aa, Staphylococcus
RNIQGGQ

SEQ ID NO: 1980492 - protein, 14 aa, Staphylococcus
RNISELSSELGTSH

SEQ ID NO: 1980493 - protein, 7 aa, Staphylococcus
RNITNEM

SEQ ID NO: 1980494 - protein, 7 aa, Staphylococcus
RNKAIAQ

SEQ ID NO: 1980495 - protein, 7 aa, Staphylococcus
RNKDGEI

SEQ ID NO: 1980496 - protein, 10 aa, Staphylococcus
RNKDGIPAKV

SEQ ID NO: 1980497 - protein, 9 aa, Staphylococcus
RNKDKGYVT

SEQ ID NO: 1980498 - protein, 9 aa, Staphylococcus
RNKEQLKEN

SEQ ID NO: 1980499 - protein, 8 aa, Staphylococcus
RNKGEVLQ

SEQ ID NO: 1980500 - protein, 9 aa, Staphylococcus
RNKGINTQH

SEQ ID NO: 1980501 - protein, 21 aa, Staphylococcus
RNKHKRPFKPKNKHKHHRRKA

SEQ ID NO: 1980502 - protein, 12 aa, Staphylococcus
RNKIAKARHAVM

SEQ ID NO: 1980503 - protein, 5 aa, Staphylococcus
RNKIH

SEQ ID NO: 1980504 - protein, 24 aa, Staphylococcus
RNKKRRQGTQSQQNNQDSLLPQNN

SEQ ID NO: 1980505 - protein, 8 aa, Staphylococcus
RNKKVTPE

SEQ ID NO: 1980506 - protein, 6 aa, Staphylococcus
RNKMKG

SEQ ID NO: 1980507 - protein, 7 aa, Staphylococcus
RNKNADA

SEQ ID NO: 1980508 - protein, 11 aa, Staphylococcus
RNKNNEKLTSI

SEQ ID NO: 1980509 - protein, 12 aa, Staphylococcus
RNKTNDTEIKPD

SEQ ID NO: 1980510 - protein, 5 aa, Staphylococcus
RNKTR

SEQ ID NO: 1980511 - protein, 4 aa, Staphylococcus
RNKV

SEQ ID NO: 1980512 - protein, 26 aa, Staphylococcus
RNKVAERPKAPYEVSKTEIKNRSTQS

SEQ ID NO: 1980513 - protein, 5 aa, Staphylococcus
RNKYD

SEQ ID NO: 1980514 - protein, 7 aa, Staphylococcus
RNLDEDK

SEQ ID NO: 1980515 - protein, 7 aa, Staphylococcus
RNLEAGE

SEQ ID NO: 1980516 - protein, 6 aa, Staphylococcus
RNLEKE

SEQ ID NO: 1980517 - protein, 11 aa, Staphylococcus
RNLGNPPFATR

SEQ ID NO: 1980518 - protein, 18 aa, Staphylococcus
RNLGNPPFATRESLPDIR

SEQ ID NO: 1980519 - protein, 22 aa, Staphylococcus
RNLGNPPFATRESLPDIREQEL

SEQ ID NO: 1980520 - protein, 26 aa, Staphylococcus
RNLGNPPFATRESLPDYREKELEEAA

SEQ ID NO: 1980521 - protein, 16 aa, Staphylococcus
RNLGNPPFATRESLPE

SEQ ID NO: 1980522 - protein, 18 aa, Staphylococcus
RNLGNPPFATRESLPNIR

SEQ ID NO: 1980523 - protein, 24 aa, Staphylococcus
RNLGNPPFATRETLPDIREKELEN

SEQ ID NO: 1980524 - protein, 5 aa, Staphylococcus
RNLGR

SEQ ID NO: 1980525 - protein, 13 aa, Staphylococcus
RNLKTLSGGQRQR

SEQ ID NO: 1980526 - protein, 11 aa, Staphylococcus
RNLNSAEAKPV

SEQ ID NO: 1980527 - protein, 4 aa, Staphylococcus
RNLP

SEQ ID NO: 1980528 - protein, 24 aa, Staphylococcus
RNLPASLRETGLGGLAGTPTGEEI

SEQ ID NO: 1980529 - protein, 8 aa, Staphylococcus
RNLPQHEA

SEQ ID NO: 1980530 - protein, 10 aa, Staphylococcus
RNLQQKGEKF

SEQ ID NO: 1980531 - protein, 11 aa, Staphylococcus
RNLTQEAKDGL

SEQ ID NO: 1980532 - protein, 20 aa, Staphylococcus
RNMPNNFDKPQQVERVSLDG

SEQ ID NO: 1980533 - protein, 9 aa, Staphylococcus
RNMREGEVD

SEQ ID NO: 1980534 - protein, 13 aa, Staphylococcus
RNNAEKQLGPDKA

SEQ ID NO: 1980535 - protein, 13 aa, Staphylococcus
RNNAEKSLGADKA

SEQ ID NO: 1980536 - protein, 12 aa, Staphylococcus
RNNAEQNLGADK

SEQ ID NO: 1980537 - protein, 7 aa, Staphylococcus
RNNATLH

SEQ ID NO: 1980538 - protein, 7 aa, Staphylococcus
RNNATNY

SEQ ID NO: 1980539 - protein, 10 aa, Staphylococcus
RNNDPYPKEL

SEQ ID NO: 1980540 - protein, 17 aa, Staphylococcus
RNNDPYPKELHDTAEQL

SEQ ID NO: 1980541 - protein, 6 aa, Staphylococcus
RNNDVE

SEQ ID NO: 1980542 - protein, 8 aa, Staphylococcus
RNNEPEAF

SEQ ID NO: 1980543 - protein, 10 aa, Staphylococcus
RNNETVERPV

SEQ ID NO: 1980544 - protein, 8 aa, Staphylococcus
RNNGPFND

SEQ ID NO: 1980545 - protein, 8 aa, Staphylococcus
RNNKTRKN

SEQ ID NO: 1980546 - protein, 13 aa, Staphylococcus
RNNLQNVSTKLPK

SEQ ID NO: 1980547 - protein, 5 aa, Staphylococcus
RNNNE

SEQ ID NO: 1980548 - protein, 8 aa, Staphylococcus
RNNNTNVP

SEQ ID NO: 1980549 - protein, 7 aa, Staphylococcus
RNNPYKG

SEQ ID NO: 1980550 - protein, 7 aa, Staphylococcus
RNNQSLK

SEQ ID NO: 1980551 - protein, 5 aa, Staphylococcus
RNNRE

SEQ ID NO: 1980552 - protein, 8 aa, Staphylococcus
RNNSPNEI

SEQ ID NO: 1980553 - protein, 8 aa, Staphylococcus
RNNSTNVP

SEQ ID NO: 1980554 - protein, 4 aa, Staphylococcus
RNPA

SEQ ID NO: 1980555 - protein, 9 aa, Staphylococcus
RNPDKMPSH

SEQ ID NO: 1980556 - protein, 5 aa, Staphylococcus
RNPDQ

SEQ ID NO: 1980557 - protein, 9 aa, Staphylococcus
RNPEQVSTL

SEQ ID NO: 1980558 - protein, 14 aa, Staphylococcus
RNPESHAKDKAQYE

SEQ ID NO: 1980559 - protein, 8 aa, Staphylococcus
RNPGSYER

SEQ ID NO: 1980560 - protein, 8 aa, Staphylococcus
RNPITGEA

SEQ ID NO: 1980561 - protein, 9 aa, Staphylococcus
RNPKKVTRK

SEQ ID NO: 1980562 - protein, 18 aa, Staphylococcus
RNPNETVKPIKGGFRTGR

SEQ ID NO: 1980563 - protein, 14 aa, Staphylococcus
RNPQLTEKEGSEIA

SEQ ID NO: 1980564 - protein, 6 aa, Staphylococcus
RNPTTE

SEQ ID NO: 1980565 - protein, 7 aa, Staphylococcus
RNPTTEA

SEQ ID NO: 1980566 - protein, 9 aa, Staphylococcus
RNPVSGENK

SEQ ID NO: 1980567 - protein, 9 aa, Staphylococcus
RNPVTGDNQ

SEQ ID NO: 1980568 - protein, 9 aa, Staphylococcus
RNPVTGENK

SEQ ID NO: 1980569 - protein, 9 aa, Staphylococcus
RNPVTGENQ

SEQ ID NO: 1980570 - protein, 8 aa, Staphylococcus
RNQDYRLN

SEQ ID NO: 1980571 - protein, 9 aa, Staphylococcus
RNQEKLTYS

SEQ ID NO: 1980572 - protein, 12 aa, Staphylococcus
RNQGADVTDERS

SEQ ID NO: 1980573 - protein, 10 aa, Staphylococcus
RNQGESSTLQ

SEQ ID NO: 1980574 - protein, 7 aa, Staphylococcus
RNQGGDV

SEQ ID NO: 1980575 - protein, 16 aa, Staphylococcus
RNQHGWTKKDMTDQEW

SEQ ID NO: 1980576 - protein, 4 aa, Staphylococcus
RNQL

SEQ ID NO: 1980577 - protein, 7 aa, Staphylococcus
RNQNDLN

SEQ ID NO: 1980578 - protein, 5 aa, Staphylococcus
RNQNI

SEQ ID NO: 1980579 - protein, 13 aa, Staphylococcus
RNQNKEANHHAKQ

SEQ ID NO: 1980580 - protein, 8 aa, Staphylococcus
RNQNNYRE

SEQ ID NO: 1980581 - protein, 4 aa, Staphylococcus
RNQP

SEQ ID NO: 1980582 - protein, 13 aa, Staphylococcus
RNQQAVDAHNKSA

SEQ ID NO: 1980583 - protein, 5 aa, Staphylococcus
RNQSK

SEQ ID NO: 1980584 - protein, 15 aa, Staphylococcus
RNQSNTTREMTEEEK

SEQ ID NO: 1980585 - protein, 16 aa, Staphylococcus
RNQSNTTREMTEEEKE

SEQ ID NO: 1980586 - protein, 22 aa, Staphylococcus
RNQTGDMTEPYTIGGGTYARNL

SEQ ID NO: 1980587 - protein, 6 aa, Staphylococcus
RNQVGD

SEQ ID NO: 1980588 - protein, 18 aa, Staphylococcus
RNRAETLGLSAESTYNSL

SEQ ID NO: 1980589 - protein, 13 aa, Staphylococcus
RNRAGFDEGNRPI

SEQ ID NO: 1980590 - protein, 5 aa, Staphylococcus
RNREI

SEQ ID NO: 1980591 - protein, 11 aa, Staphylococcus
RNRKEEKDYSK

SEQ ID NO: 1980592 - protein, 6 aa, Staphylococcus
RNRKRL

SEQ ID NO: 1980593 - protein, 9 aa, Staphylococcus
RNRNENEGK

SEQ ID NO: 1980594 - protein, 16 aa, Staphylococcus
RNRQGWTKKDMTDQEW

SEQ ID NO: 1980595 - protein, 10 aa, Staphylococcus
RNRQSSQDID

SEQ ID NO: 1980596 - protein, 6 aa, Staphylococcus
RNRSQN

SEQ ID NO: 1980597 - protein, 6 aa, Staphylococcus
RNRTID

SEQ ID NO: 1980598 - protein, 8 aa, Staphylococcus
RNRTRNDY

SEQ ID NO: 1980599 - protein, 5 aa, Staphylococcus
RNSAG

SEQ ID NO: 1980600 - protein, 11 aa, Staphylococcus
RNSEQPQVEHT

SEQ ID NO: 1980601 - protein, 7 aa, Staphylococcus
RNSFGRQ

SEQ ID NO: 1980602 - protein, 4 aa, Staphylococcus
RNSG

SEQ ID NO: 1980603 - protein, 6 aa, Staphylococcus
RNSGGL

SEQ ID NO: 1980604 - protein, 8 aa, Staphylococcus
RNSGNDPS

SEQ ID NO: 1980605 - protein, 8 aa, Staphylococcus
RNSGNNPA

SEQ ID NO: 1980606 - protein, 8 aa, Staphylococcus
RNSGNNPS

SEQ ID NO: 1980607 - protein, 4 aa, Staphylococcus
RNSI

SEQ ID NO: 1980608 - protein, 6 aa, Staphylococcus
RNSIPE

SEQ ID NO: 1980609 - protein, 7 aa, Staphylococcus
RNSNADT

SEQ ID NO: 1980610 - protein, 8 aa, Staphylococcus
RNSNEFSE

SEQ ID NO: 1980611 - protein, 7 aa, Staphylococcus
RNSPLSE

SEQ ID NO: 1980612 - protein, 8 aa, Staphylococcus
RNSQEQVD

SEQ ID NO: 1980613 - protein, 8 aa, Staphylococcus
RNSRPISE

SEQ ID NO: 1980614 - protein, 6 aa, Staphylococcus
RNTDAD

SEQ ID NO: 1980615 - protein, 7 aa, Staphylococcus
RNTFGDK

SEQ ID NO: 1980616 - protein, 7 aa, Staphylococcus
RNTGNDV

SEQ ID NO: 1980617 - protein, 20 aa, Staphylococcus
RNTKAEDEPTILNSEKPEDN

SEQ ID NO: 1980618 - protein, 7 aa, Staphylococcus
RNTKDGK

SEQ ID NO: 1980619 - protein, 9 aa, Staphylococcus
RNTKPSGYR

SEQ ID NO: 1980620 - protein, 9 aa, Staphylococcus
RNTNARIEP

SEQ ID NO: 1980621 - protein, 5 aa, Staphylococcus
RNTNG

SEQ ID NO: 1980622 - protein, 13 aa, Staphylococcus
RNTNPEPVNWFGK

SEQ ID NO: 1980623 - protein, 16 aa, Staphylococcus
RNTQGWTKKDMTGQEW

SEQ ID NO: 1980624 - protein, 22 aa, Staphylococcus
RNTSSTNIKKQNEQFEPIQLNP

SEQ ID NO: 1980625 - protein, 6 aa, Staphylococcus
RNTTNV

SEQ ID NO: 1980626 - protein, 11 aa, Staphylococcus
RNVDQEEVGRT

SEQ ID NO: 1980627 - protein, 4 aa, Staphylococcus
RNVE

SEQ ID NO: 1980628 - protein, 13 aa, Staphylococcus
RNVEPDQLSTQEI

SEQ ID NO: 1980629 - protein, 9 aa, Staphylococcus
RNVKSPGSY

SEQ ID NO: 1980630 - protein, 4 aa, Staphylococcus
RNVN

SEQ ID NO: 1980631 - protein, 5 aa, Staphylococcus
RNVQQ

SEQ ID NO: 1980632 - protein, 11 aa, Staphylococcus
RNWEDNKQEKF

SEQ ID NO: 1980633 - protein, 7 aa, Staphylococcus
RNWPPYT

SEQ ID NO: 1980634 - protein, 14 aa, Staphylococcus
RNYHKNSFKNNEGY

SEQ ID NO: 1980635 - protein, 14 aa, Staphylococcus
RNYHKQSFKESEGY

SEQ ID NO: 1980636 - protein, 16 aa, Staphylococcus
RNYISTKNKRNNPERI

SEQ ID NO: 1980637 - protein, 16 aa, Staphylococcus
RNYISTKNKRTNPERI

SEQ ID NO: 1980638 - protein, 16 aa, Staphylococcus
RNYISTKNKRTNPERV

SEQ ID NO: 1980639 - protein, 15 aa, Staphylococcus
RNYITTKNKRNNPER

SEQ ID NO: 1980640 - protein, 16 aa, Staphylococcus
RNYITTKNKRTNPERI

SEQ ID NO: 1980641 - protein, 11 aa, Staphylococcus
RNYKDKNQTPV

SEQ ID NO: 1980642 - protein, 4 aa, Staphylococcus
RNYN

SEQ ID NO: 1980643 - protein, 15 aa, Staphylococcus
RNYNVPKKEGSATRL

SEQ ID NO: 1980644 - protein, 15 aa, Staphylococcus
RNYNVPKKETSAKRL

SEQ ID NO: 1980645 - protein, 14 aa, Staphylococcus
RNYNVPKKETSATR

SEQ ID NO: 1980646 - protein, 14 aa, Staphylococcus
RNYNVPKQSNLASR

SEQ ID NO: 1980647 - protein, 12 aa, Staphylococcus
RNYVKNESKRFV

SEQ ID NO: 1980648 - protein, 5 aa, Staphylococcus
RPAEG

SEQ ID NO: 1980649 - protein, 6 aa, Staphylococcus
RPAEGF

SEQ ID NO: 1980650 - protein, 6 aa, Staphylococcus
RPAENF

SEQ ID NO: 1980651 - protein, 6 aa, Staphylococcus
RPAGGF

SEQ ID NO: 1980652 - protein, 5 aa, Staphylococcus
RPALF

SEQ ID NO: 1980653 - protein, 5 aa, Staphylococcus
RPARS

SEQ ID NO: 1980654 - protein, 6 aa, Staphylococcus
RPASEI

SEQ ID NO: 1980655 - protein, 12 aa, Staphylococcus
RPASQRKGYGTD

SEQ ID NO: 1980656 - protein, 6 aa, Staphylococcus
RPATNF

SEQ ID NO: 1980657 - protein, 10 aa, Staphylococcus
RPATPDDFDR

SEQ ID NO: 1980658 - protein, 5 aa, Staphylococcus
RPAYR

SEQ ID NO: 1980659 - protein, 16 aa, Staphylococcus
RPDEKSVTERAYENPR

SEQ ID NO: 1980660 - protein, 7 aa, Staphylococcus
RPDHSEF

SEQ ID NO: 1980661 - protein, 12 aa, Staphylococcus
RPDKETGEGESI

SEQ ID NO: 1980662 - protein, 11 aa, Staphylococcus
RPDNEGQVKGK

SEQ ID NO: 1980663 - protein, 7 aa, Staphylococcus
RPDNTTK

SEQ ID NO: 1980664 - protein, 8 aa, Staphylococcus
RPDNTTKE

SEQ ID NO: 1980665 - protein, 15 aa, Staphylococcus
RPDSGAKRAAEAENV

SEQ ID NO: 1980666 - protein, 15 aa, Staphylococcus
RPDSGAKRAAEQENV

SEQ ID NO: 1980667 - protein, 4 aa, Staphylococcus
RPDT

SEQ ID NO: 1980668 - protein, 15 aa, Staphylococcus
RPDTGAKRAADNEGV

SEQ ID NO: 1980669 - protein, 5 aa, Staphylococcus
RPDVQ

SEQ ID NO: 1980670 - protein, 9 aa, Staphylococcus
RPDYRGHGY

SEQ ID NO: 1980671 - protein, 4 aa, Staphylococcus
RPEA

SEQ ID NO: 1980672 - protein, 6 aa, Staphylococcus
RPEDLQ

SEQ ID NO: 1980673 - protein, 16 aa, Staphylococcus
RPEEVTDIERSSEDAE

SEQ ID NO: 1980674 - protein, 17 aa, Staphylococcus
RPEEVTDIERSVESAEV

SEQ ID NO: 1980675 - protein, 9 aa, Staphylococcus
RPEHSRSNK

SEQ ID NO: 1980676 - protein, 4 aa, Staphylococcus
RPEI

SEQ ID NO: 1980677 - protein, 10 aa, Staphylococcus
RPEINETTAL

SEQ ID NO: 1980678 - protein, 5 aa, Staphylococcus
RPELN

SEQ ID NO: 1980679 - protein, 5 aa, Staphylococcus
RPELQ

SEQ ID NO: 1980680 - protein, 6 aa, Staphylococcus
RPELSY

SEQ ID NO: 1980681 - protein, 6 aa, Staphylococcus
RPEMPN

SEQ ID NO: 1980682 - protein, 10 aa, Staphylococcus
RPENVEDAPS

SEQ ID NO: 1980683 - protein, 7 aa, Staphylococcus
RPERRST

SEQ ID NO: 1980684 - protein, 5 aa, Staphylococcus
RPEVQ

SEQ ID NO: 1980685 - protein, 5 aa, Staphylococcus
RPFEP

SEQ ID NO: 1980686 - protein, 8 aa, Staphylococcus
RPFKENGQ

SEQ ID NO: 1980687 - protein, 26 aa, Staphylococcus
RPFNSDGTWGKKTKTRTQYDENGNAI

SEQ ID NO: 1980688 - protein, 6 aa, Staphylococcus
RPFPEL

SEQ ID NO: 1980689 - protein, 11 aa, Staphylococcus
RPFRASKPYYE

SEQ ID NO: 1980690 - protein, 5 aa, Staphylococcus
RPFSQ

SEQ ID NO: 1980691 - protein, 5 aa, Staphylococcus
RPFTQ

SEQ ID NO: 1980692 - protein, 10 aa, Staphylococcus
RPGADLGKKV

SEQ ID NO: 1980693 - protein, 6 aa, Staphylococcus
RPGAIT

SEQ ID NO: 1980694 - protein, 8 aa, Staphylococcus
RPGAQLGA

SEQ ID NO: 1980695 - protein, 15 aa, Staphylococcus
RPGDSFNKAKEDGLD

SEQ ID NO: 1980696 - protein, 7 aa, Staphylococcus
RPGMDKE

SEQ ID NO: 1980697 - protein, 6 aa, Staphylococcus
RPGPME

SEQ ID NO: 1980698 - protein, 7 aa, Staphylococcus
RPGSITK

SEQ ID NO: 1980699 - protein, 7 aa, Staphylococcus
RPGSITQ

SEQ ID NO: 1980700 - protein, 8 aa, Staphylococcus
RPGSLNSQ

SEQ ID NO: 1980701 - protein, 9 aa, Staphylococcus
RPGSNLGAD

SEQ ID NO: 1980702 - protein, 10 aa, Staphylococcus
RPGSNLGSDV

SEQ ID NO: 1980703 - protein, 5 aa, Staphylococcus
RPHSY

SEQ ID NO: 1980704 - protein, 6 aa, Staphylococcus
RPIAPG

SEQ ID NO: 1980705 - protein, 8 aa, Staphylococcus
RPIESDGD

SEQ ID NO: 1980706 - protein, 6 aa, Staphylococcus
RPIPSR

SEQ ID NO: 1980707 - protein, 7 aa, Staphylococcus
RPKDRQD

SEQ ID NO: 1980708 - protein, 8 aa, Staphylococcus
RPKKGTNT

SEQ ID NO: 1980709 - protein, 5 aa, Staphylococcus
RPKKI

SEQ ID NO: 1980710 - protein, 5 aa, Staphylococcus
RPKLQ

SEQ ID NO: 1980711 - protein, 9 aa, Staphylococcus
RPKNDKKIR

SEQ ID NO: 1980712 - protein, 8 aa, Staphylococcus
RPKNNTEL

SEQ ID NO: 1980713 - protein, 4 aa, Staphylococcus
RPKP

SEQ ID NO: 1980714 - protein, 8 aa, Staphylococcus
RPKQEDFP

SEQ ID NO: 1980715 - protein, 4 aa, Staphylococcus
RPKR

SEQ ID NO: 1980716 - protein, 4 aa, Staphylococcus
RPLD

SEQ ID NO: 1980717 - protein, 7 aa, Staphylococcus
RPLEEDG

SEQ ID NO: 1980718 - protein, 8 aa, Staphylococcus
RPLEEDGE

SEQ ID NO: 1980719 - protein, 6 aa, Staphylococcus
RPLGVQ

SEQ ID NO: 1980720 - protein, 7 aa, Staphylococcus
RPLKTEL

SEQ ID NO: 1980721 - protein, 6 aa, Staphylococcus
RPLKTK

SEQ ID NO: 1980722 - protein, 4 aa, Staphylococcus
RPLP

SEQ ID NO: 1980723 - protein, 5 aa, Staphylococcus
RPLPD

SEQ ID NO: 1980724 - protein, 6 aa, Staphylococcus
RPLRRP

SEQ ID NO: 1980725 - protein, 4 aa, Staphylococcus
RPLT

SEQ ID NO: 1980726 - protein, 9 aa, Staphylococcus
RPLTPLDDE

SEQ ID NO: 1980727 - protein, 4 aa, Staphylococcus
RPLY

SEQ ID NO: 1980728 - protein, 7 aa, Staphylococcus
RPMNDDE

SEQ ID NO: 1980729 - protein, 21 aa, Staphylococcus
RPNAPEDTDYTRDKRRAREFD

SEQ ID NO: 1980730 - protein, 16 aa, Staphylococcus
RPNAVARGLASKRTTT

SEQ ID NO: 1980731 - protein, 6 aa, Staphylococcus
RPNEKR

SEQ ID NO: 1980732 - protein, 4 aa, Staphylococcus
RPNL

SEQ ID NO: 1980733 - protein, 9 aa, Staphylococcus
RPNPNQNAT

SEQ ID NO: 1980734 - protein, 10 aa, Staphylococcus
RPNPYQPRKH

SEQ ID NO: 1980735 - protein, 9 aa, Staphylococcus
RPNTDLSST

SEQ ID NO: 1980736 - protein, 4 aa, Staphylococcus
RPPF

SEQ ID NO: 1980737 - protein, 5 aa, Staphylococcus
RPPHR

SEQ ID NO: 1980738 - protein, 12 aa, Staphylococcus
RPQEDGSHDNVT

SEQ ID NO: 1980739 - protein, 5 aa, Staphylococcus
RPQIK

SEQ ID NO: 1980740 - protein, 5 aa, Staphylococcus
RPQLQ

SEQ ID NO: 1980741 - protein, 8 aa, Staphylococcus
RPQSNMPS

SEQ ID NO: 1980742 - protein, 12 aa, Staphylococcus
RPQSQHKGYGTS

SEQ ID NO: 1980743 - protein, 5 aa, Staphylococcus
RPQSV

SEQ ID NO: 1980744 - protein, 6 aa, Staphylococcus
RPQSVY

SEQ ID NO: 1980745 - protein, 7 aa, Staphylococcus
RPQSVYE

SEQ ID NO: 1980746 - protein, 11 aa, Staphylococcus
RPQVKDDGYIY

SEQ ID NO: 1980747 - protein, 6 aa, Staphylococcus
RPQYVD

SEQ ID NO: 1980748 - protein, 6 aa, Staphylococcus
RPRTLT

SEQ ID NO: 1980749 - protein, 5 aa, Staphylococcus
RPSDH

SEQ ID NO: 1980750 - protein, 6 aa, Staphylococcus
RPSDNI

SEQ ID NO: 1980751 - protein, 16 aa, Staphylococcus
RPSDSKDDRTDHGTTR

SEQ ID NO: 1980752 - protein, 15 aa, Staphylococcus
RPSDSKDDRTVHGTT

SEQ ID NO: 1980753 - protein, 16 aa, Staphylococcus
RPSDSKEDRTDHGTTR

SEQ ID NO: 1980754 - protein, 15 aa, Staphylococcus
RPSDSQKDRTVHGTT

SEQ ID NO: 1980755 - protein, 12 aa, Staphylococcus
RPSDYTETEYAE

SEQ ID NO: 1980756 - protein, 5 aa, Staphylococcus
RPSEH

SEQ ID NO: 1980757 - protein, 6 aa, Staphylococcus
RPSENK

SEQ ID NO: 1980758 - protein, 4 aa, Staphylococcus
RPSH

SEQ ID NO: 1980759 - protein, 8 aa, Staphylococcus
RPSKETKE

SEQ ID NO: 1980760 - protein, 16 aa, Staphylococcus
RPSRVDLTKRKQAIRQ

SEQ ID NO: 1980761 - protein, 8 aa, Staphylococcus
RPSSEESA

SEQ ID NO: 1980762 - protein, 6 aa, Staphylococcus
RPSSLD

SEQ ID NO: 1980763 - protein, 8 aa, Staphylococcus
RPSTVPRK

SEQ ID NO: 1980764 - protein, 8 aa, Staphylococcus
RPSVGKTG

SEQ ID NO: 1980765 - protein, 4 aa, Staphylococcus
RPSY

SEQ ID NO: 1980766 - protein, 5 aa, Staphylococcus
RPSYQ

SEQ ID NO: 1980767 - protein, 14 aa, Staphylococcus
RPTASRIKNLLKGE

SEQ ID NO: 1980768 - protein, 15 aa, Staphylococcus
RPTDSKDDRTVHGTT

SEQ ID NO: 1980769 - protein, 15 aa, Staphylococcus
RPTDSKEDRTVHGTT

SEQ ID NO: 1980770 - protein, 15 aa, Staphylococcus
RPTESKEDRTVHGTT

SEQ ID NO: 1980771 - protein, 7 aa, Staphylococcus
RPTETGF

SEQ ID NO: 1980772 - protein, 14 aa, Staphylococcus
RPTFNPETGEDFGK

SEQ ID NO: 1980773 - protein, 15 aa, Staphylococcus
RPTFNPETGKDFGKT

SEQ ID NO: 1980774 - protein, 8 aa, Staphylococcus
RPTINKDD

SEQ ID NO: 1980775 - protein, 11 aa, Staphylococcus
RPTINKKDVEE

SEQ ID NO: 1980776 - protein, 7 aa, Staphylococcus
RPTINKQ

SEQ ID NO: 1980777 - protein, 7 aa, Staphylococcus
RPTKDKK

SEQ ID NO: 1980778 - protein, 13 aa, Staphylococcus
RPTKGKIQTNGRI

SEQ ID NO: 1980779 - protein, 11 aa, Staphylococcus
RPTKVTSGMSQ

SEQ ID NO: 1980780 - protein, 8 aa, Staphylococcus
RPTMPNTN

SEQ ID NO: 1980781 - protein, 7 aa, Staphylococcus
RPTNKKL

SEQ ID NO: 1980782 - protein, 4 aa, Staphylococcus
RPTP

SEQ ID NO: 1980783 - protein, 14 aa, Staphylococcus
RPTSKKIAQLIREE

SEQ ID NO: 1980784 - protein, 9 aa, Staphylococcus
RPTVNKDDV

SEQ ID NO: 1980785 - protein, 6 aa, Staphylococcus
RPVGKN

SEQ ID NO: 1980786 - protein, 7 aa, Staphylococcus
RPVHGHT

SEQ ID NO: 1980787 - protein, 7 aa, Staphylococcus
RPVTKEL

SEQ ID NO: 1980788 - protein, 9 aa, Staphylococcus
RPVTMEDGT

SEQ ID NO: 1980789 - protein, 13 aa, Staphylococcus
RPVVADSGAIGGH

SEQ ID NO: 1980790 - protein, 14 aa, Staphylococcus
RPVVADSGAIGGSH

SEQ ID NO: 1980791 - protein, 8 aa, Staphylococcus
RPYAEANN

SEQ ID NO: 1980792 - protein, 9 aa, Staphylococcus
RPYAEDNQV

SEQ ID NO: 1980793 - protein, 6 aa, Staphylococcus
RPYANN

SEQ ID NO: 1980794 - protein, 6 aa, Staphylococcus
RPYAQN

SEQ ID NO: 1980795 - protein, 8 aa, Staphylococcus
RPYAQNYE

SEQ ID NO: 1980796 - protein, 6 aa, Staphylococcus
RPYATN

SEQ ID NO: 1980797 - protein, 9 aa, Staphylococcus
RPYKDESLQ

SEQ ID NO: 1980798 - protein, 20 aa, Staphylococcus
RPYKQKKKTRATEAKRKGLE

SEQ ID NO: 1980799 - protein, 5 aa, Staphylococcus
RQADD

SEQ ID NO: 1980800 - protein, 4 aa, Staphylococcus
RQAE

SEQ ID NO: 1980801 - protein, 5 aa, Staphylococcus
RQAEP

SEQ ID NO: 1980802 - protein, 6 aa, Staphylococcus
RQAGSE

SEQ ID NO: 1980803 - protein, 5 aa, Staphylococcus
RQAGV

SEQ ID NO: 1980804 - protein, 11 aa, Staphylococcus
RQAITNPNTIQ

SEQ ID NO: 1980805 - protein, 21 aa, Staphylococcus
RQAKADEEMTTLDNQERQLKE

SEQ ID NO: 1980806 - protein, 8 aa, Staphylococcus
RQAKEPLV

SEQ ID NO: 1980807 - protein, 9 aa, Staphylococcus
RQALREKGA

SEQ ID NO: 1980808 - protein, 12 aa, Staphylococcus
RQALRGNDEGIN

SEQ ID NO: 1980809 - protein, 4 aa, Staphylococcus
RQAP

SEQ ID NO: 1980810 - protein, 9 aa, Staphylococcus
RQAPGFDEL

SEQ ID NO: 1980811 - protein, 9 aa, Staphylococcus
RQARKNADL

SEQ ID NO: 1980812 - protein, 12 aa, Staphylococcus
RQARSEVNTPLS

SEQ ID NO: 1980813 - protein, 8 aa, Staphylococcus
RQATGLKG

SEQ ID NO: 1980814 - protein, 7 aa, Staphylococcus
RQAVEGE

SEQ ID NO: 1980815 - protein, 6 aa, Staphylococcus
RQCNQS

SEQ ID NO: 1980816 - protein, 13 aa, Staphylococcus
RQDDSESKPYEET

SEQ ID NO: 1980817 - protein, 10 aa, Staphylococcus
RQDETNLSPV

SEQ ID NO: 1980818 - protein, 13 aa, Staphylococcus
RQDLESNGYETYE

SEQ ID NO: 1980819 - protein, 12 aa, Staphylococcus
RQDNQDSKPYDE

SEQ ID NO: 1980820 - protein, 12 aa, Staphylococcus
RQDNQEAKAYEE

SEQ ID NO: 1980821 - protein, 8 aa, Staphylococcus
RQDSEAQA

SEQ ID NO: 1980822 - protein, 10 aa, Staphylococcus
RQDTDQSTPY

SEQ ID NO: 1980823 - protein, 10 aa, Staphylococcus
RQEEADDTVT

SEQ ID NO: 1980824 - protein, 7 aa, Staphylococcus
RQEEDYE

SEQ ID NO: 1980825 - protein, 6 aa, Staphylococcus
RQEEVT

SEQ ID NO: 1980826 - protein, 4 aa, Staphylococcus
RQEG

SEQ ID NO: 1980827 - protein, 7 aa, Staphylococcus
RQEGDKD

SEQ ID NO: 1980828 - protein, 15 aa, Staphylococcus
RQEIGARNKRNKKGN

SEQ ID NO: 1980829 - protein, 6 aa, Staphylococcus
RQENNN

SEQ ID NO: 1980830 - protein, 5 aa, Staphylococcus
RQESN

SEQ ID NO: 1980831 - protein, 6 aa, Staphylococcus
RQEVSV

SEQ ID NO: 1980832 - protein, 9 aa, Staphylococcus
RQFTKTPVE

SEQ ID NO: 1980833 - protein, 5 aa, Staphylococcus
RQGAS

SEQ ID NO: 1980834 - protein, 9 aa, Staphylococcus
RQGDQNEAL

SEQ ID NO: 1980835 - protein, 9 aa, Staphylococcus
RQGEAHSHK

SEQ ID NO: 1980836 - protein, 9 aa, Staphylococcus
RQGEAHSHR

SEQ ID NO: 1980837 - protein, 9 aa, Staphylococcus
RQGEHTKSA

SEQ ID NO: 1980838 - protein, 12 aa, Staphylococcus
RQGFKNVKHLKD

SEQ ID NO: 1980839 - protein, 5 aa, Staphylococcus
RQGGL

SEQ ID NO: 1980840 - protein, 8 aa, Staphylococcus
RQGKREVD

SEQ ID NO: 1980841 - protein, 6 aa, Staphylococcus
RQGNMD

SEQ ID NO: 1980842 - protein, 9 aa, Staphylococcus
RQGQAHSHK

SEQ ID NO: 1980843 - protein, 5 aa, Staphylococcus
RQGRN

SEQ ID NO: 1980844 - protein, 5 aa, Staphylococcus
RQGSV

SEQ ID NO: 1980845 - protein, 4 aa, Staphylococcus
RQGT

SEQ ID NO: 1980846 - protein, 5 aa, Staphylococcus
RQGYD

SEQ ID NO: 1980847 - protein, 16 aa, Staphylococcus
RQGYEYSRTANPTRTA

SEQ ID NO: 1980848 - protein, 5 aa, Staphylococcus
RQHKP

SEQ ID NO: 1980849 - protein, 13 aa, Staphylococcus
RQIKGLSQNEMEE

SEQ ID NO: 1980850 - protein, 4 aa, Staphylococcus
RQIN

SEQ ID NO: 1980851 - protein, 9 aa, Staphylococcus
RQINEKDDD

SEQ ID NO: 1980852 - protein, 13 aa, Staphylococcus
RQINGLSKNEMAE

SEQ ID NO: 1980853 - protein, 12 aa, Staphylococcus
RQINQKEGRLPE

SEQ ID NO: 1980854 - protein, 6 aa, Staphylococcus
RQIPKN

SEQ ID NO: 1980855 - protein, 5 aa, Staphylococcus
RQISI

SEQ ID NO: 1980856 - protein, 11 aa, Staphylococcus
RQKGEAINEAN

SEQ ID NO: 1980857 - protein, 9 aa, Staphylococcus
RQKLREKGA

SEQ ID NO: 1980858 - protein, 9 aa, Staphylococcus
RQKNDVADT

SEQ ID NO: 1980859 - protein, 10 aa, Staphylococcus
RQKNDVPDTE

SEQ ID NO: 1980860 - protein, 8 aa, Staphylococcus
RQKNEEIV

SEQ ID NO: 1980861 - protein, 9 aa, Staphylococcus
RQKNEEVVK

SEQ ID NO: 1980862 - protein, 9 aa, Staphylococcus
RQKNKREIN

SEQ ID NO: 1980863 - protein, 18 aa, Staphylococcus
RQKNLTQEELAERTDLSK

SEQ ID NO: 1980864 - protein, 19 aa, Staphylococcus
RQKNLTQEELAERTDLSKG

SEQ ID NO: 1980865 - protein, 18 aa, Staphylococcus
RQKQQANAVDVGAFRRLF

SEQ ID NO: 1980866 - protein, 27 aa, Staphylococcus
RQKQTQAQAEKEKQENSEENKREKRQK

SEQ ID NO: 1980867 - protein, 6 aa, Staphylococcus
RQKRQW

SEQ ID NO: 1980868 - protein, 19 aa, Staphylococcus
RQLDEDAAKENYPEISNEQ

SEQ ID NO: 1980869 - protein, 4 aa, Staphylococcus
RQLE

SEQ ID NO: 1980870 - protein, 17 aa, Staphylococcus
RQLENGQRITPDVNEGD

SEQ ID NO: 1980871 - protein, 14 aa, Staphylococcus
RQLETEESDTNYDR

SEQ ID NO: 1980872 - protein, 14 aa, Staphylococcus
RQLETKEDGTSYDR

SEQ ID NO: 1980873 - protein, 6 aa, Staphylococcus
RQLPQN

SEQ ID NO: 1980874 - protein, 17 aa, Staphylococcus
RQLRGRAGRQGDPGQSQ

SEQ ID NO: 1980875 - protein, 5 aa, Staphylococcus
RQLSN

SEQ ID NO: 1980876 - protein, 6 aa, Staphylococcus
RQLSRN

SEQ ID NO: 1980877 - protein, 5 aa, Staphylococcus
RQLTE

SEQ ID NO: 1980878 - protein, 5 aa, Staphylococcus
RQLTN

SEQ ID NO: 1980879 - protein, 13 aa, Staphylococcus
RQMDSNDNDDVDE

SEQ ID NO: 1980880 - protein, 19 aa, Staphylococcus
RQMPNNYDKPRQVERVSFD

SEQ ID NO: 1980881 - protein, 9 aa, Staphylococcus
RQMREGEVN

SEQ ID NO: 1980882 - protein, 8 aa, Staphylococcus
RQNDQGYI

SEQ ID NO: 1980883 - protein, 6 aa, Staphylococcus
RQNDST

SEQ ID NO: 1980884 - protein, 8 aa, Staphylococcus
RQNDTDYL

SEQ ID NO: 1980885 - protein, 7 aa, Staphylococcus
RQNEINE

SEQ ID NO: 1980886 - protein, 12 aa, Staphylococcus
RQNELKKQYGIE

SEQ ID NO: 1980887 - protein, 12 aa, Staphylococcus
RQNELKRPPVSN

SEQ ID NO: 1980888 - protein, 7 aa, Staphylococcus
RQNGSTS

SEQ ID NO: 1980889 - protein, 17 aa, Staphylococcus
RQNKGDIQQFNKLLNKI

SEQ ID NO: 1980890 - protein, 9 aa, Staphylococcus
RQNKPLPDN

SEQ ID NO: 1980891 - protein, 28 aa, Staphylococcus
RQNKSLAQLSSNITGLTSLSSSKAHRVG

SEQ ID NO: 1980892 - protein, 4 aa, Staphylococcus
RQNN

SEQ ID NO: 1980893 - protein, 9 aa, Staphylococcus
RQNNSQSLG

SEQ ID NO: 1980894 - protein, 5 aa, Staphylococcus
RQNPD

SEQ ID NO: 1980895 - protein, 5 aa, Staphylococcus
RQNPE

SEQ ID NO: 1980896 - protein, 6 aa, Staphylococcus
RQNQTT

SEQ ID NO: 1980897 - protein, 6 aa, Staphylococcus
RQPDEA

SEQ ID NO: 1980898 - protein, 6 aa, Staphylococcus
RQPDSA

SEQ ID NO: 1980899 - protein, 7 aa, Staphylococcus
RQPELSH

SEQ ID NO: 1980900 - protein, 4 aa, Staphylococcus
RQPH

SEQ ID NO: 1980901 - protein, 6 aa, Staphylococcus
RQPING

SEQ ID NO: 1980902 - protein, 9 aa, Staphylococcus
RQPKKDTIN

SEQ ID NO: 1980903 - protein, 7 aa, Staphylococcus
RQPLEPQ

SEQ ID NO: 1980904 - protein, 12 aa, Staphylococcus
RQPLQQSDFSTA

SEQ ID NO: 1980905 - protein, 12 aa, Staphylococcus
RQPLTDEERETF

SEQ ID NO: 1980906 - protein, 4 aa, Staphylococcus
RQPM

SEQ ID NO: 1980907 - protein, 5 aa, Staphylococcus
RQPQH

SEQ ID NO: 1980908 - protein, 10 aa, Staphylococcus
RQPQIGDTIN

SEQ ID NO: 1980909 - protein, 7 aa, Staphylococcus
RQPQIGE

SEQ ID NO: 1980910 - protein, 7 aa, Staphylococcus
RQQAMKG

SEQ ID NO: 1980911 - protein, 7 aa, Staphylococcus
RQQDGSS

SEQ ID NO: 1980912 - protein, 8 aa, Staphylococcus
RQQDGSSI

SEQ ID NO: 1980913 - protein, 5 aa, Staphylococcus
RQQEI

SEQ ID NO: 1980914 - protein, 5 aa, Staphylococcus
RQQEN

SEQ ID NO: 1980915 - protein, 5 aa, Staphylococcus
RQQES

SEQ ID NO: 1980916 - protein, 4 aa, Staphylococcus
RQQG

SEQ ID NO: 1980917 - protein, 7 aa, Staphylococcus
RQQIKDE

SEQ ID NO: 1980918 - protein, 17 aa, Staphylococcus
RQQLPSQLNTTATNNEG

SEQ ID NO: 1980919 - protein, 6 aa, Staphylococcus
RQQNSN

SEQ ID NO: 1980920 - protein, 24 aa, Staphylococcus
RQQSQGNIPSYPDDAYAYEGQPQQ

SEQ ID NO: 1980921 - protein, 5 aa, Staphylococcus
RQQYG

SEQ ID NO: 1980922 - protein, 12 aa, Staphylococcus
RQRDIETKTTLN

SEQ ID NO: 1980923 - protein, 7 aa, Staphylococcus
RQRELAQ

SEQ ID NO: 1980924 - protein, 6 aa, Staphylococcus
RQRELS

SEQ ID NO: 1980925 - protein, 7 aa, Staphylococcus
RQRELTN

SEQ ID NO: 1980926 - protein, 8 aa, Staphylococcus
RQRGEGER

SEQ ID NO: 1980927 - protein, 5 aa, Staphylococcus
RQRHP

SEQ ID NO: 1980928 - protein, 14 aa, Staphylococcus
RQRKESKIKNIQTR

SEQ ID NO: 1980929 - protein, 14 aa, Staphylococcus
RQRKTSNQNGVKRL

SEQ ID NO: 1980930 - protein, 6 aa, Staphylococcus
RQRNHN

SEQ ID NO: 1980931 - protein, 11 aa, Staphylococcus
RQRNSGSVKTQ

SEQ ID NO: 1980932 - protein, 8 aa, Staphylococcus
RQRPSIQP

SEQ ID NO: 1980933 - protein, 23 aa, Staphylococcus
RQRQMPNNYDKPRRVERVSFNGE

SEQ ID NO: 1980934 - protein, 6 aa, Staphylococcus
RQRQYT

SEQ ID NO: 1980935 - protein, 9 aa, Staphylococcus
RQRSEADKR

SEQ ID NO: 1980936 - protein, 10 aa, Staphylococcus
RQRSLRDPIR

SEQ ID NO: 1980937 - protein, 6 aa, Staphylococcus
RQRYKT

SEQ ID NO: 1980938 - protein, 11 aa, Staphylococcus
RQSAEDSAVAT

SEQ ID NO: 1980939 - protein, 5 aa, Staphylococcus
RQSDD

SEQ ID NO: 1980940 - protein, 9 aa, Staphylococcus
RQSEKHRRA

SEQ ID NO: 1980941 - protein, 6 aa, Staphylococcus
RQSENG

SEQ ID NO: 1980942 - protein, 5 aa, Staphylococcus
RQSFT

SEQ ID NO: 1980943 - protein, 7 aa, Staphylococcus
RQSGSKT

SEQ ID NO: 1980944 - protein, 4 aa, Staphylococcus
RQSK

SEQ ID NO: 1980945 - protein, 10 aa, Staphylococcus
RQSKKLSNAD

SEQ ID NO: 1980946 - protein, 35 aa, Staphylococcus
RQSKSKKSDSPALNRGFNSKKKQFTDLNSPQKRGV

SEQ ID NO: 1980947 - protein, 35 aa, Staphylococcus
RQSKSKKSDSPALNRGFNSKKKQFTELNSPQKRGV

SEQ ID NO: 1980948 - protein, 35 aa, Staphylococcus
RQSKSKKSDSPALNRGFNSKKKQFTHLNSPQKRGV

SEQ ID NO: 1980949 - protein, 35 aa, Staphylococcus
RQSKSKKSDSPALNRNFNSKKKKFTDLNSPQKRGV

SEQ ID NO: 1980950 - protein, 13 aa, Staphylococcus
RQSKSKKSDSPVL

SEQ ID NO: 1980951 - protein, 8 aa, Staphylococcus
RQSLEDPG

SEQ ID NO: 1980952 - protein, 7 aa, Staphylococcus
RQSLPAQ

SEQ ID NO: 1980953 - protein, 7 aa, Staphylococcus
RQSNTKS

SEQ ID NO: 1980954 - protein, 4 aa, Staphylococcus
RQSP

SEQ ID NO: 1980955 - protein, 7 aa, Staphylococcus
RQSPLPH

SEQ ID NO: 1980956 - protein, 7 aa, Staphylococcus
RQSPSYQ

SEQ ID NO: 1980957 - protein, 6 aa, Staphylococcus
RQSQHG

SEQ ID NO: 1980958 - protein, 7 aa, Staphylococcus
RQSQSGR

SEQ ID NO: 1980959 - protein, 5 aa, Staphylococcus
RQSQY

SEQ ID NO: 1980960 - protein, 12 aa, Staphylococcus
RQSRVEVNTPLS

SEQ ID NO: 1980961 - protein, 13 aa, Staphylococcus
RQSRVEVNTPLSK

SEQ ID NO: 1980962 - protein, 10 aa, Staphylococcus
RQSTAHHDQE

SEQ ID NO: 1980963 - protein, 7 aa, Staphylococcus
RQSVEGE

SEQ ID NO: 1980964 - protein, 8 aa, Staphylococcus
RQSYEDFK

SEQ ID NO: 1980965 - protein, 6 aa, Staphylococcus
RQTANT

SEQ ID NO: 1980966 - protein, 8 aa, Staphylococcus
RQTDAEDV

SEQ ID NO: 1980967 - protein, 9 aa, Staphylococcus
RQTENSEQA

SEQ ID NO: 1980968 - protein, 7 aa, Staphylococcus
RQTHPHL

SEQ ID NO: 1980969 - protein, 10 aa, Staphylococcus
RQTKPHGALP

SEQ ID NO: 1980970 - protein, 5 aa, Staphylococcus
RQTKQ

SEQ ID NO: 1980971 - protein, 8 aa, Staphylococcus
RQTNRAVT

SEQ ID NO: 1980972 - protein, 8 aa, Staphylococcus
RQTPAHHT

SEQ ID NO: 1980973 - protein, 5 aa, Staphylococcus
RQTQD

SEQ ID NO: 1980974 - protein, 6 aa, Staphylococcus
RQTQDI

SEQ ID NO: 1980975 - protein, 5 aa, Staphylococcus
RQTQS

SEQ ID NO: 1980976 - protein, 6 aa, Staphylococcus
RQTQSI

SEQ ID NO: 1980977 - protein, 8 aa, Staphylococcus
RQTSSEDL

SEQ ID NO: 1980978 - protein, 15 aa, Staphylococcus
RQTTENAERLFNLNQ

SEQ ID NO: 1980979 - protein, 10 aa, Staphylococcus
RQTYEDFKSS

SEQ ID NO: 1980980 - protein, 10 aa, Staphylococcus
RQVGGAPANV

SEQ ID NO: 1980981 - protein, 13 aa, Staphylococcus
RQVGGAPANVAST

SEQ ID NO: 1980982 - protein, 9 aa, Staphylococcus
RQVGGAPCN

SEQ ID NO: 1980983 - protein, 8 aa, Staphylococcus
RQVPNADN

SEQ ID NO: 1980984 - protein, 4 aa, Staphylococcus
RQVR

SEQ ID NO: 1980985 - protein, 9 aa, Staphylococcus
RQYAEDTQS

SEQ ID NO: 1980986 - protein, 13 aa, Staphylococcus
RQYGSQDQETLEK

SEQ ID NO: 1980987 - protein, 13 aa, Staphylococcus
RQYGSQDQQTLER

SEQ ID NO: 1980988 - protein, 5 aa, Staphylococcus
RQYNN

SEQ ID NO: 1980989 - protein, 4 aa, Staphylococcus
RQYR

SEQ ID NO: 1980990 - protein, 4 aa, Staphylococcus
RQYT

SEQ ID NO: 1980991 - protein, 8 aa, Staphylococcus
RRAQEADA

SEQ ID NO: 1980992 - protein, 8 aa, Staphylococcus
RRAQEEDA

SEQ ID NO: 1980993 - protein, 6 aa, Staphylococcus
RRAQEI

SEQ ID NO: 1980994 - protein, 8 aa, Staphylococcus
RRDADGNV

SEQ ID NO: 1980995 - protein, 9 aa, Staphylococcus
RRDAFEQKK

SEQ ID NO: 1980996 - protein, 9 aa, Staphylococcus
RRDDCPTCG

SEQ ID NO: 1980997 - protein, 4 aa, Staphylococcus
RRDG

SEQ ID NO: 1980998 - protein, 7 aa, Staphylococcus
RRDGDKF

SEQ ID NO: 1980999 - protein, 6 aa, Staphylococcus
RRDKNN

SEQ ID NO: 1981000 - protein, 9 aa, Staphylococcus
RRDKPGYAQ

SEQ ID NO: 1981001 - protein, 4 aa, Staphylococcus
RRDL

SEQ ID NO: 1981002 - protein, 11 aa, Staphylococcus
RRDNGESEEVE

SEQ ID NO: 1981003 - protein, 12 aa, Staphylococcus
RRDQSPTRANTN

SEQ ID NO: 1981004 - protein, 11 aa, Staphylococcus
RRDSDDATHSH

SEQ ID NO: 1981005 - protein, 18 aa, Staphylococcus
RRDSNDDLKKDEKEGVIS

SEQ ID NO: 1981006 - protein, 6 aa, Staphylococcus
RRDSYE

SEQ ID NO: 1981007 - protein, 7 aa, Staphylococcus
RRDTFEA

SEQ ID NO: 1981008 - protein, 10 aa, Staphylococcus
RRDTGESEDV

SEQ ID NO: 1981009 - protein, 9 aa, Staphylococcus
RRDTGGGAV

SEQ ID NO: 1981010 - protein, 34 aa, Staphylococcus
RRDYGESELTEPLPESAANPDDNYRVKRDAKDIA

SEQ ID NO: 1981011 - protein, 12 aa, Staphylococcus
RRDYSNDEFRKQ

SEQ ID NO: 1981012 - protein, 5 aa, Staphylococcus
RRDYT

SEQ ID NO: 1981013 - protein, 7 aa, Staphylococcus
RRECEEC

SEQ ID NO: 1981014 - protein, 4 aa, Staphylococcus
RRED

SEQ ID NO: 1981015 - protein, 8 aa, Staphylococcus
RREEISKH

SEQ ID NO: 1981016 - protein, 4 aa, Staphylococcus
RREG

SEQ ID NO: 1981017 - protein, 5 aa, Staphylococcus
RREGV

SEQ ID NO: 1981018 - protein, 9 aa, Staphylococcus
RREGYKPNI

SEQ ID NO: 1981019 - protein, 16 aa, Staphylococcus
RREKELVDTDPNREPV

SEQ ID NO: 1981020 - protein, 6 aa, Staphylococcus
RREKLN

SEQ ID NO: 1981021 - protein, 5 aa, Staphylococcus
RREMS

SEQ ID NO: 1981022 - protein, 12 aa, Staphylococcus
RREQSPSRQATN

SEQ ID NO: 1981023 - protein, 12 aa, Staphylococcus
RREQSPTRANTD

SEQ ID NO: 1981024 - protein, 10 aa, Staphylococcus
RRERDHRKIG

SEQ ID NO: 1981025 - protein, 9 aa, Staphylococcus
RRERDHRRI

SEQ ID NO: 1981026 - protein, 18 aa, Staphylococcus
RREREEEKESERDAVAAY

SEQ ID NO: 1981027 - protein, 34 aa, Staphylococcus
RREREKKAQQKRKFKEALQNKRQQSSDSDNETQK

SEQ ID NO: 1981028 - protein, 6 aa, Staphylococcus
RRERER

SEQ ID NO: 1981029 - protein, 9 aa, Staphylococcus
RRESISHGY

SEQ ID NO: 1981030 - protein, 11 aa, Staphylococcus
RRESISQGYSG

SEQ ID NO: 1981031 - protein, 8 aa, Staphylococcus
RREVTDRK

SEQ ID NO: 1981032 - protein, 8 aa, Staphylococcus
RREVTNKK

SEQ ID NO: 1981033 - protein, 8 aa, Staphylococcus
RREVTNRK

SEQ ID NO: 1981034 - protein, 10 aa, Staphylococcus
RRFDESNGKT

SEQ ID NO: 1981035 - protein, 10 aa, Staphylococcus
RRFDESTGKT

SEQ ID NO: 1981036 - protein, 5 aa, Staphylococcus
RRFER

SEQ ID NO: 1981037 - protein, 7 aa, Staphylococcus
RRGERSI

SEQ ID NO: 1981038 - protein, 16 aa, Staphylococcus
RRGGMTTTTGLPDPKH

SEQ ID NO: 1981039 - protein, 11 aa, Staphylococcus
RRGKSPLNPTN

SEQ ID NO: 1981040 - protein, 6 aa, Staphylococcus
RRGKVR

SEQ ID NO: 1981041 - protein, 8 aa, Staphylococcus
RRGPADNP

SEQ ID NO: 1981042 - protein, 6 aa, Staphylococcus
RRGQEL

SEQ ID NO: 1981043 - protein, 6 aa, Staphylococcus
RRGQSY

SEQ ID NO: 1981044 - protein, 6 aa, Staphylococcus
RRGTSL

SEQ ID NO: 1981045 - protein, 25 aa, Staphylococcus
RRGYGESELTEPLPDEAINPNSRYR

SEQ ID NO: 1981046 - protein, 34 aa, Staphylococcus
RRGYGQSELTESLPEEVSNPESRYRVKRDAQDIA

SEQ ID NO: 1981047 - protein, 7 aa, Staphylococcus
RRGYGYS

SEQ ID NO: 1981048 - protein, 7 aa, Staphylococcus
RRGYKSM

SEQ ID NO: 1981049 - protein, 11 aa, Staphylococcus
RRHAEPIKDGR

SEQ ID NO: 1981050 - protein, 7 aa, Staphylococcus
RRHEPSK

SEQ ID NO: 1981051 - protein, 5 aa, Staphylococcus
RRHGY

SEQ ID NO: 1981052 - protein, 16 aa, Staphylococcus
RRHSAQGQHFKKKQEV

SEQ ID NO: 1981053 - protein, 8 aa, Staphylococcus
RRHSSKEV

SEQ ID NO: 1981054 - protein, 7 aa, Staphylococcus
RRIEQVD

SEQ ID NO: 1981055 - protein, 5 aa, Staphylococcus
RRIES

SEQ ID NO: 1981056 - protein, 14 aa, Staphylococcus
RRIKDKKERYEAQA

SEQ ID NO: 1981057 - protein, 17 aa, Staphylococcus
RRIQKENETNRAYKAQS

SEQ ID NO: 1981058 - protein, 13 aa, Staphylococcus
RRIQKENQTMKAY

SEQ ID NO: 1981059 - protein, 16 aa, Staphylococcus
RRIQNENKINKTYQAQ

SEQ ID NO: 1981060 - protein, 7 aa, Staphylococcus
RRKDISI

SEQ ID NO: 1981061 - protein, 24 aa, Staphylococcus
RRKDSKRKKGHRQPFTKLTIDKIN

SEQ ID NO: 1981062 - protein, 24 aa, Staphylococcus
RRKDSKRKKGHRQPYTKLTIDKIK

SEQ ID NO: 1981063 - protein, 24 aa, Staphylococcus
RRKDSKRKKGHRQPYTKLTVDKIN

SEQ ID NO: 1981064 - protein, 13 aa, Staphylococcus
RRKGKATKEQAED

SEQ ID NO: 1981065 - protein, 13 aa, Staphylococcus
RRKGKATKEQAEE

SEQ ID NO: 1981066 - protein, 11 aa, Staphylococcus
RRKGKDNSLPP

SEQ ID NO: 1981067 - protein, 8 aa, Staphylococcus
RRKGRQTV

SEQ ID NO: 1981068 - protein, 14 aa, Staphylococcus
RRKHEIQTNDIPKL

SEQ ID NO: 1981069 - protein, 10 aa, Staphylococcus
RRKKANTEIK

SEQ ID NO: 1981070 - protein, 4 aa, Staphylococcus
RRKM

SEQ ID NO: 1981071 - protein, 8 aa, Staphylococcus
RRKPHEDE

SEQ ID NO: 1981072 - protein, 10 aa, Staphylococcus
RRKPKDQSEL

SEQ ID NO: 1981073 - protein, 10 aa, Staphylococcus
RRKQESEGIE

SEQ ID NO: 1981074 - protein, 13 aa, Staphylococcus
RRKQWSGKPTYRT

SEQ ID NO: 1981075 - protein, 10 aa, Staphylococcus
RRKSSSVKSL

SEQ ID NO: 1981076 - protein, 24 aa, Staphylococcus
RRKSYGSTGQESVKHQLNVAKSLL

SEQ ID NO: 1981077 - protein, 9 aa, Staphylococcus
RRLGKSRPY

SEQ ID NO: 1981078 - protein, 18 aa, Staphylococcus
RRNANRLKHKQPSTLNVK

SEQ ID NO: 1981079 - protein, 13 aa, Staphylococcus
RRNGKATKEQAEE

SEQ ID NO: 1981080 - protein, 10 aa, Staphylococcus
RRNGKSDKND

SEQ ID NO: 1981081 - protein, 13 aa, Staphylococcus
RRNGVKADKDYLQ

SEQ ID NO: 1981082 - protein, 12 aa, Staphylococcus
RRNKKKTGNITK

SEQ ID NO: 1981083 - protein, 5 aa, Staphylococcus
RRNPD

SEQ ID NO: 1981084 - protein, 14 aa, Staphylococcus
RRNRAGFDEGNRPI

SEQ ID NO: 1981085 - protein, 6 aa, Staphylococcus
RRNSAI

SEQ ID NO: 1981086 - protein, 19 aa, Staphylococcus
RRNTNEGGTAANVVLHKTK

SEQ ID NO: 1981087 - protein, 9 aa, Staphylococcus
RRPEDAETY

SEQ ID NO: 1981088 - protein, 8 aa, Staphylococcus
RRPENQKM

SEQ ID NO: 1981089 - protein, 9 aa, Staphylococcus
RRPGYEPNI

SEQ ID NO: 1981090 - protein, 9 aa, Staphylococcus
RRPGYKPNI

SEQ ID NO: 1981091 - protein, 8 aa, Staphylococcus
RRPNTDEL

SEQ ID NO: 1981092 - protein, 9 aa, Staphylococcus
RRPNTDEMG

SEQ ID NO: 1981093 - protein, 8 aa, Staphylococcus
RRQDPSKV

SEQ ID NO: 1981094 - protein, 5 aa, Staphylococcus
RRQGI

SEQ ID NO: 1981095 - protein, 5 aa, Staphylococcus
RRQGV

SEQ ID NO: 1981096 - protein, 4 aa, Staphylococcus
RRQI

SEQ ID NO: 1981097 - protein, 5 aa, Staphylococcus
RRQNY

SEQ ID NO: 1981098 - protein, 9 aa, Staphylococcus
RRQPAKDTI

SEQ ID NO: 1981099 - protein, 12 aa, Staphylococcus
RRQRHKKKQTAI

SEQ ID NO: 1981100 - protein, 7 aa, Staphylococcus
RRQSHKD

SEQ ID NO: 1981101 - protein, 8 aa, Staphylococcus
RRQSSEQV

SEQ ID NO: 1981102 - protein, 14 aa, Staphylococcus
RRQSYGSTGPDAVK

SEQ ID NO: 1981103 - protein, 22 aa, Staphylococcus
RRQTPKKYPRKPGTPNKAPLLE

SEQ ID NO: 1981104 - protein, 9 aa, Staphylococcus
RRQYSSDAD

SEQ ID NO: 1981105 - protein, 7 aa, Staphylococcus
RRRASEG

SEQ ID NO: 1981106 - protein, 6 aa, Staphylococcus
RRREMA

SEQ ID NO: 1981107 - protein, 13 aa, Staphylococcus
RRRGALQRGNEVD

SEQ ID NO: 1981108 - protein, 9 aa, Staphylococcus
RRRQSPNEV

SEQ ID NO: 1981109 - protein, 8 aa, Staphylococcus
RRRRERHL

SEQ ID NO: 1981110 - protein, 18 aa, Staphylococcus
RRRYTQPAQEADNAPNEI

SEQ ID NO: 1981111 - protein, 4 aa, Staphylococcus
RRSF

SEQ ID NO: 1981112 - protein, 9 aa, Staphylococcus
RRSGAETEL

SEQ ID NO: 1981113 - protein, 14 aa, Staphylococcus
RRSGYSTGHKPKKY

SEQ ID NO: 1981114 - protein, 10 aa, Staphylococcus
RRSIEKPSAR

SEQ ID NO: 1981115 - protein, 6 aa, Staphylococcus
RRSNNG

SEQ ID NO: 1981116 - protein, 4 aa, Staphylococcus
RRSQ

SEQ ID NO: 1981117 - protein, 9 aa, Staphylococcus
RRSRGTPRV

SEQ ID NO: 1981118 - protein, 10 aa, Staphylococcus
RRSSQEDTDF

SEQ ID NO: 1981119 - protein, 6 aa, Staphylococcus
RRTAQL

SEQ ID NO: 1981120 - protein, 9 aa, Staphylococcus
RRTGTSEDV

SEQ ID NO: 1981121 - protein, 6 aa, Staphylococcus
RRTGVG

SEQ ID NO: 1981122 - protein, 6 aa, Staphylococcus
RRTIRQ

SEQ ID NO: 1981123 - protein, 14 aa, Staphylococcus
RRTSRKLANLMKGE

SEQ ID NO: 1981124 - protein, 7 aa, Staphylococcus
RRTVENH

SEQ ID NO: 1981125 - protein, 9 aa, Staphylococcus
RRTYGNSET

SEQ ID NO: 1981126 - protein, 10 aa, Staphylococcus
RRVKAPSTVQ

SEQ ID NO: 1981127 - protein, 4 aa, Staphylococcus
RRVN

SEQ ID NO: 1981128 - protein, 5 aa, Staphylococcus
RRVTI

SEQ ID NO: 1981129 - protein, 15 aa, Staphylococcus
RRWAGEDEETSDMAY

SEQ ID NO: 1981130 - protein, 5 aa, Staphylococcus
RRWNP

SEQ ID NO: 1981131 - protein, 25 aa, Staphylococcus
RRYEDDGQLVSRKEADALITNTDEA

SEQ ID NO: 1981132 - protein, 26 aa, Staphylococcus
RRYEDDGQLVSRKEPDAVISDSEEAL

SEQ ID NO: 1981133 - protein, 26 aa, Staphylococcus
RRYEDDGQLVSRQESDATITNTDEAL

SEQ ID NO: 1981134 - protein, 26 aa, Staphylococcus
RRYEDNGQLVNRKESDAVITDTDEAL

SEQ ID NO: 1981135 - protein, 26 aa, Staphylococcus
RRYEDNGQLVSRKEADAVITNTEEAL

SEQ ID NO: 1981136 - protein, 26 aa, Staphylococcus
RRYENNGQLVNRRENDAVITDTDEAL

SEQ ID NO: 1981137 - protein, 25 aa, Staphylococcus
RRYESNGQLVSRKESDAVISDTEAA

SEQ ID NO: 1981138 - protein, 4 aa, Staphylococcus
RRYP

SEQ ID NO: 1981139 - protein, 5 aa, Staphylococcus
RSADG

SEQ ID NO: 1981140 - protein, 12 aa, Staphylococcus
RSAEENQDRLSR

SEQ ID NO: 1981141 - protein, 6 aa, Staphylococcus
RSAEGF

SEQ ID NO: 1981142 - protein, 14 aa, Staphylococcus
RSAEGMEDALEGGS

SEQ ID NO: 1981143 - protein, 15 aa, Staphylococcus
RSASAYAKKTRSVKS

SEQ ID NO: 1981144 - protein, 7 aa, Staphylococcus
RSATEGN

SEQ ID NO: 1981145 - protein, 10 aa, Staphylococcus
RSATSNELKE

SEQ ID NO: 1981146 - protein, 6 aa, Staphylococcus
RSDDTE

SEQ ID NO: 1981147 - protein, 7 aa, Staphylococcus
RSDEQLK

SEQ ID NO: 1981148 - protein, 14 aa, Staphylococcus
RSDKINDDKQQHHY

SEQ ID NO: 1981149 - protein, 11 aa, Staphylococcus
RSDKQSDDPKI

SEQ ID NO: 1981150 - protein, 11 aa, Staphylococcus
RSDKQSDEPKI

SEQ ID NO: 1981151 - protein, 11 aa, Staphylococcus
RSDLTEKAETH

SEQ ID NO: 1981152 - protein, 6 aa, Staphylococcus
RSDSTF

SEQ ID NO: 1981153 - protein, 8 aa, Staphylococcus
RSDTIENK

SEQ ID NO: 1981154 - protein, 12 aa, Staphylococcus
RSEANAKKLAER

SEQ ID NO: 1981155 - protein, 5 aa, Staphylococcus
RSEDD

SEQ ID NO: 1981156 - protein, 5 aa, Staphylococcus
RSEDN

SEQ ID NO: 1981157 - protein, 15 aa, Staphylococcus
RSEDSAGAFSKNRKT

SEQ ID NO: 1981158 - protein, 14 aa, Staphylococcus
RSEDSAGAYHQNRK

SEQ ID NO: 1981159 - protein, 8 aa, Staphylococcus
RSEDSEYG

SEQ ID NO: 1981160 - protein, 13 aa, Staphylococcus
RSEDSKDASGEHR

SEQ ID NO: 1981161 - protein, 6 aa, Staphylococcus
RSEEDY

SEQ ID NO: 1981162 - protein, 6 aa, Staphylococcus
RSEGAR

SEQ ID NO: 1981163 - protein, 7 aa, Staphylococcus
RSEGARV

SEQ ID NO: 1981164 - protein, 13 aa, Staphylococcus
RSEGDYDDHRRPN

SEQ ID NO: 1981165 - protein, 8 aa, Staphylococcus
RSEGFGEE

SEQ ID NO: 1981166 - protein, 8 aa, Staphylococcus
RSEGFGKE

SEQ ID NO: 1981167 - protein, 6 aa, Staphylococcus
RSEGFP

SEQ ID NO: 1981168 - protein, 4 aa, Staphylococcus
RSEI

SEQ ID NO: 1981169 - protein, 5 aa, Staphylococcus
RSEIN

SEQ ID NO: 1981170 - protein, 6 aa, Staphylococcus
RSEKPF

SEQ ID NO: 1981171 - protein, 4 aa, Staphylococcus
RSEL

SEQ ID NO: 1981172 - protein, 21 aa, Staphylococcus
RSELTDNGFTSLESSEDVSNY

SEQ ID NO: 1981173 - protein, 9 aa, Staphylococcus
RSELTENGF

SEQ ID NO: 1981174 - protein, 8 aa, Staphylococcus
RSELTGRD

SEQ ID NO: 1981175 - protein, 5 aa, Staphylococcus
RSELV

SEQ ID NO: 1981176 - protein, 7 aa, Staphylococcus
RSENDKG

SEQ ID NO: 1981177 - protein, 6 aa, Staphylococcus
RSENDY

SEQ ID NO: 1981178 - protein, 5 aa, Staphylococcus
RSENG

SEQ ID NO: 1981179 - protein, 7 aa, Staphylococcus
RSENKTV

SEQ ID NO: 1981180 - protein, 5 aa, Staphylococcus
RSENM

SEQ ID NO: 1981181 - protein, 8 aa, Staphylococcus
RSENPNAK

SEQ ID NO: 1981182 - protein, 9 aa, Staphylococcus
RSEPGKRAR

SEQ ID NO: 1981183 - protein, 7 aa, Staphylococcus
RSEPVAE

SEQ ID NO: 1981184 - protein, 5 aa, Staphylococcus
RSEQM

SEQ ID NO: 1981185 - protein, 5 aa, Staphylococcus
RSERT

SEQ ID NO: 1981186 - protein, 9 aa, Staphylococcus
RSESSLDAV

SEQ ID NO: 1981187 - protein, 10 aa, Staphylococcus
RSETDTLKQQ

SEQ ID NO: 1981188 - protein, 9 aa, Staphylococcus
RSETNTLKK

SEQ ID NO: 1981189 - protein, 5 aa, Staphylococcus
RSETY

SEQ ID NO: 1981190 - protein, 5 aa, Staphylococcus
RSEYN

SEQ ID NO: 1981191 - protein, 9 aa, Staphylococcus
RSEYRKKEG

SEQ ID NO: 1981192 - protein, 6 aa, Staphylococcus
RSFDED

SEQ ID NO: 1981193 - protein, 10 aa, Staphylococcus
RSFDSKKRQL

SEQ ID NO: 1981194 - protein, 19 aa, Staphylococcus
RSFEDGELSSETSEVRGQK

SEQ ID NO: 1981195 - protein, 21 aa, Staphylococcus
RSFENGEWSQETSEVRGKKVR

SEQ ID NO: 1981196 - protein, 13 aa, Staphylococcus
RSFNPSNRDETIG

SEQ ID NO: 1981197 - protein, 11 aa, Staphylococcus
RSFQGGEGKPL

SEQ ID NO: 1981198 - protein, 11 aa, Staphylococcus
RSFQGGESKPL

SEQ ID NO: 1981199 - protein, 6 aa, Staphylococcus
RSFTGG

SEQ ID NO: 1981200 - protein, 13 aa, Staphylococcus
RSFTQAAAKELAQ

SEQ ID NO: 1981201 - protein, 6 aa, Staphylococcus
RSGASD

SEQ ID NO: 1981202 - protein, 11 aa, Staphylococcus
RSGATDEELKE

SEQ ID NO: 1981203 - protein, 9 aa, Staphylococcus
RSGATHQKL

SEQ ID NO: 1981204 - protein, 4 aa, Staphylococcus
RSGD

SEQ ID NO: 1981205 - protein, 6 aa, Staphylococcus
RSGDDV

SEQ ID NO: 1981206 - protein, 7 aa, Staphylococcus
RSGDSAY

SEQ ID NO: 1981207 - protein, 6 aa, Staphylococcus
RSGESE

SEQ ID NO: 1981208 - protein, 8 aa, Staphylococcus
RSGKEREE

SEQ ID NO: 1981209 - protein, 6 aa, Staphylococcus
RSGKLD

SEQ ID NO: 1981210 - protein, 9 aa, Staphylococcus
RSGKRTANA

SEQ ID NO: 1981211 - protein, 9 aa, Staphylococcus
RSGNEGLPE

SEQ ID NO: 1981212 - protein, 12 aa, Staphylococcus
RSGNSPETKATV

SEQ ID NO: 1981213 - protein, 7 aa, Staphylococcus
RSGQPYV

SEQ ID NO: 1981214 - protein, 12 aa, Staphylococcus
RSGSSACHSNSI

SEQ ID NO: 1981215 - protein, 7 aa, Staphylococcus
RSHDKLN

SEQ ID NO: 1981216 - protein, 7 aa, Staphylococcus
RSHKTID

SEQ ID NO: 1981217 - protein, 5 aa, Staphylococcus
RSHQT

SEQ ID NO: 1981218 - protein, 16 aa, Staphylococcus
RSIAETGNKPGVTKQQ

SEQ ID NO: 1981219 - protein, 4 aa, Staphylococcus
RSID

SEQ ID NO: 1981220 - protein, 5 aa, Staphylococcus
RSIDG

SEQ ID NO: 1981221 - protein, 5 aa, Staphylococcus
RSIEA

SEQ ID NO: 1981222 - protein, 6 aa, Staphylococcus
RSIEAG

SEQ ID NO: 1981223 - protein, 7 aa, Staphylococcus
RSIEGSE

SEQ ID NO: 1981224 - protein, 11 aa, Staphylococcus
RSIGDGDHGVN

SEQ ID NO: 1981225 - protein, 9 aa, Staphylococcus
RSIGGVGRN

SEQ ID NO: 1981226 - protein, 9 aa, Staphylococcus
RSIHSNDTL

SEQ ID NO: 1981227 - protein, 12 aa, Staphylococcus
RSIKAQNPKGQV

SEQ ID NO: 1981228 - protein, 6 aa, Staphylococcus
RSINKQ

SEQ ID NO: 1981229 - protein, 8 aa, Staphylococcus
RSIQLTDS

SEQ ID NO: 1981230 - protein, 9 aa, Staphylococcus
RSITEDKEF

SEQ ID NO: 1981231 - protein, 8 aa, Staphylococcus
RSITEDKK

SEQ ID NO: 1981232 - protein, 9 aa, Staphylococcus
RSITEDKKL

SEQ ID NO: 1981233 - protein, 10 aa, Staphylococcus
RSKADAEQYG

SEQ ID NO: 1981234 - protein, 9 aa, Staphylococcus
RSKDMSKHL

SEQ ID NO: 1981235 - protein, 8 aa, Staphylococcus
RSKDNPYR

SEQ ID NO: 1981236 - protein, 9 aa, Staphylococcus
RSKEDAENH

SEQ ID NO: 1981237 - protein, 10 aa, Staphylococcus
RSKEKAQDYI

SEQ ID NO: 1981238 - protein, 12 aa, Staphylococcus
RSKGKHEWTHTA

SEQ ID NO: 1981239 - protein, 9 aa, Staphylococcus
RSKGNKELH

SEQ ID NO: 1981240 - protein, 8 aa, Staphylococcus
RSKGNQEL

SEQ ID NO: 1981241 - protein, 8 aa, Staphylococcus
RSKGVGQS

SEQ ID NO: 1981242 - protein, 10 aa, Staphylococcus
RSKGYDQRPS

SEQ ID NO: 1981243 - protein, 11 aa, Staphylococcus
RSKGYDQRPSI

SEQ ID NO: 1981244 - protein, 12 aa, Staphylococcus
RSKGYDQRPSIP

SEQ ID NO: 1981245 - protein, 13 aa, Staphylococcus
RSKGYDQRPSIPV

SEQ ID NO: 1981246 - protein, 12 aa, Staphylococcus
RSKGYDQRPSLN

SEQ ID NO: 1981247 - protein, 12 aa, Staphylococcus
RSKGYDQRPSLT

SEQ ID NO: 1981248 - protein, 12 aa, Staphylococcus
RSKGYGQRPSIT

SEQ ID NO: 1981249 - protein, 8 aa, Staphylococcus
RSKHPDGI

SEQ ID NO: 1981250 - protein, 5 aa, Staphylococcus
RSKIE

SEQ ID NO: 1981251 - protein, 6 aa, Staphylococcus
RSKKGQ

SEQ ID NO: 1981252 - protein, 6 aa, Staphylococcus
RSKLEE

SEQ ID NO: 1981253 - protein, 11 aa, Staphylococcus
RSKLRKHDSYA

SEQ ID NO: 1981254 - protein, 11 aa, Staphylococcus
RSKNAPEGNDL

SEQ ID NO: 1981255 - protein, 10 aa, Staphylococcus
RSKNGRDAHY

SEQ ID NO: 1981256 - protein, 16 aa, Staphylococcus
RSKNIDKTVKHFRKYF

SEQ ID NO: 1981257 - protein, 10 aa, Staphylococcus
RSKQRKANEI

SEQ ID NO: 1981258 - protein, 10 aa, Staphylococcus
RSKSKNTNFL

SEQ ID NO: 1981259 - protein, 21 aa, Staphylococcus
RSKTPKKYPRKAGTPNKSPLL

SEQ ID NO: 1981260 - protein, 12 aa, Staphylococcus
RSKTQESPGTIS

SEQ ID NO: 1981261 - protein, 10 aa, Staphylococcus
RSLDKKKQVI

SEQ ID NO: 1981262 - protein, 7 aa, Staphylococcus
RSLEPDE

SEQ ID NO: 1981263 - protein, 8 aa, Staphylococcus
RSLKGGQT

SEQ ID NO: 1981264 - protein, 10 aa, Staphylococcus
RSLKKGDEIN

SEQ ID NO: 1981265 - protein, 10 aa, Staphylococcus
RSLPDGLSAD

SEQ ID NO: 1981266 - protein, 12 aa, Staphylococcus
RSLSGELGIQGK

SEQ ID NO: 1981267 - protein, 9 aa, Staphylococcus
RSMDNDDIS

SEQ ID NO: 1981268 - protein, 5 aa, Staphylococcus
RSMED

SEQ ID NO: 1981269 - protein, 11 aa, Staphylococcus
RSMEENEVSKY

SEQ ID NO: 1981270 - protein, 4 aa, Staphylococcus
RSMQ

SEQ ID NO: 1981271 - protein, 9 aa, Staphylococcus
RSMREGEVD

SEQ ID NO: 1981272 - protein, 22 aa, Staphylococcus
RSNAGQPEDKANDFKDSVSAQD

SEQ ID NO: 1981273 - protein, 13 aa, Staphylococcus
RSNDGQTEQEANH

SEQ ID NO: 1981274 - protein, 22 aa, Staphylococcus
RSNEGLSEEQSNDFKDSITTQD

SEQ ID NO: 1981275 - protein, 14 aa, Staphylococcus
RSNEGQSESEANYF

SEQ ID NO: 1981276 - protein, 10 aa, Staphylococcus
RSNERLRGEF

SEQ ID NO: 1981277 - protein, 4 aa, Staphylococcus
RSNM

SEQ ID NO: 1981278 - protein, 8 aa, Staphylococcus
RSNNEVDY

SEQ ID NO: 1981279 - protein, 4 aa, Staphylococcus
RSNP

SEQ ID NO: 1981280 - protein, 17 aa, Staphylococcus
RSNRRSNKKDVFDSNRA

SEQ ID NO: 1981281 - protein, 22 aa, Staphylococcus
RSNSGQTEEEANNFKDSITAQD

SEQ ID NO: 1981282 - protein, 12 aa, Staphylococcus
RSNSQGGKGHVN

SEQ ID NO: 1981283 - protein, 5 aa, Staphylococcus
RSNTI

SEQ ID NO: 1981284 - protein, 14 aa, Staphylococcus
RSNTQTVTKQLFLK

SEQ ID NO: 1981285 - protein, 8 aa, Staphylococcus
RSNYPKTE

SEQ ID NO: 1981286 - protein, 7 aa, Staphylococcus
RSPDFES

SEQ ID NO: 1981287 - protein, 4 aa, Staphylococcus
RSPH

SEQ ID NO: 1981288 - protein, 16 aa, Staphylococcus
RSPHVTETVHKFLQYF

SEQ ID NO: 1981289 - protein, 5 aa, Staphylococcus
RSPKK

SEQ ID NO: 1981290 - protein, 9 aa, Staphylococcus
RSPKVQPPE

SEQ ID NO: 1981291 - protein, 7 aa, Staphylococcus
RSPLAGR

SEQ ID NO: 1981292 - protein, 7 aa, Staphylococcus
RSPSFNN

SEQ ID NO: 1981293 - protein, 4 aa, Staphylococcus
RSQA

SEQ ID NO: 1981294 - protein, 9 aa, Staphylococcus
RSQDNARRL

SEQ ID NO: 1981295 - protein, 10 aa, Staphylococcus
RSQDTQPIAK

SEQ ID NO: 1981296 - protein, 8 aa, Staphylococcus
RSQENAQK

SEQ ID NO: 1981297 - protein, 9 aa, Staphylococcus
RSQENAQRL

SEQ ID NO: 1981298 - protein, 16 aa, Staphylococcus
RSQNIDSTVNKFLSYY

SEQ ID NO: 1981299 - protein, 8 aa, Staphylococcus
RSQRADSN

SEQ ID NO: 1981300 - protein, 8 aa, Staphylococcus
RSQSNMPS

SEQ ID NO: 1981301 - protein, 22 aa, Staphylococcus
RSQTPKKYPRKPGTPNKSPLLE

SEQ ID NO: 1981302 - protein, 11 aa, Staphylococcus
RSQYDDGTPTG

SEQ ID NO: 1981303 - protein, 12 aa, Staphylococcus
RSRDPKKVVEQA

SEQ ID NO: 1981304 - protein, 11 aa, Staphylococcus
RSREEKDERNL

SEQ ID NO: 1981305 - protein, 7 aa, Staphylococcus
RSREGKL

SEQ ID NO: 1981306 - protein, 11 aa, Staphylococcus
RSRHEDAEKEL

SEQ ID NO: 1981307 - protein, 12 aa, Staphylococcus
RSRHEDAERDYN

SEQ ID NO: 1981308 - protein, 11 aa, Staphylococcus
RSRKGTLPTEV

SEQ ID NO: 1981309 - protein, 11 aa, Staphylococcus
RSRKYEKDNQT

SEQ ID NO: 1981310 - protein, 21 aa, Staphylococcus
RSRQKTDEMVEESKGKNIHPT

SEQ ID NO: 1981311 - protein, 15 aa, Staphylococcus
RSRQTTKPGYLNKNK

SEQ ID NO: 1981312 - protein, 6 aa, Staphylococcus
RSRSQN

SEQ ID NO: 1981313 - protein, 7 aa, Staphylococcus
RSRTRKD

SEQ ID NO: 1981314 - protein, 10 aa, Staphylococcus
RSSARETAAR

SEQ ID NO: 1981315 - protein, 6 aa, Staphylococcus
RSSDRF

SEQ ID NO: 1981316 - protein, 10 aa, Staphylococcus
RSSESRSRCQ

SEQ ID NO: 1981317 - protein, 6 aa, Staphylococcus
RSSGGY

SEQ ID NO: 1981318 - protein, 9 aa, Staphylococcus
RSSHKRRSM

SEQ ID NO: 1981319 - protein, 9 aa, Staphylococcus
RSSKDNPKR

SEQ ID NO: 1981320 - protein, 10 aa, Staphylococcus
RSSKDNPKRD

SEQ ID NO: 1981321 - protein, 7 aa, Staphylococcus
RSSKGKG

SEQ ID NO: 1981322 - protein, 8 aa, Staphylococcus
RSSKPLTT

SEQ ID NO: 1981323 - protein, 22 aa, Staphylococcus
RSSKSGNTTYNNNTGVATYNTK

SEQ ID NO: 1981324 - protein, 14 aa, Staphylococcus
RSSRIDEQSKAATL

SEQ ID NO: 1981325 - protein, 10 aa, Staphylococcus
RSSSANETNA

SEQ ID NO: 1981326 - protein, 10 aa, Staphylococcus
RSSSEAETEA

SEQ ID NO: 1981327 - protein, 11 aa, Staphylococcus
RSSSEKETEAI

SEQ ID NO: 1981328 - protein, 10 aa, Staphylococcus
RSSSQAETEA

SEQ ID NO: 1981329 - protein, 11 aa, Staphylococcus
RSSSSDETNAI

SEQ ID NO: 1981330 - protein, 17 aa, Staphylococcus
RSSTKYSAEVQDPESLS

SEQ ID NO: 1981331 - protein, 5 aa, Staphylococcus
RSTAL

SEQ ID NO: 1981332 - protein, 8 aa, Staphylococcus
RSTDEQSR

SEQ ID NO: 1981333 - protein, 8 aa, Staphylococcus
RSTEEENY

SEQ ID NO: 1981334 - protein, 10 aa, Staphylococcus
RSTETIQSRF

SEQ ID NO: 1981335 - protein, 11 aa, Staphylococcus
RSTFENKAQAA

SEQ ID NO: 1981336 - protein, 11 aa, Staphylococcus
RSTIEKGGTIK

SEQ ID NO: 1981337 - protein, 6 aa, Staphylococcus
RSTLAS

SEQ ID NO: 1981338 - protein, 7 aa, Staphylococcus
RSTNAMN

SEQ ID NO: 1981339 - protein, 8 aa, Staphylococcus
RSTNAMNV

SEQ ID NO: 1981340 - protein, 19 aa, Staphylococcus
RSTNMRRKNFENRPLNVFK

SEQ ID NO: 1981341 - protein, 19 aa, Staphylococcus
RSTNMRRKNFENSPLNVFK

SEQ ID NO: 1981342 - protein, 8 aa, Staphylococcus
RSTNVAGS

SEQ ID NO: 1981343 - protein, 4 aa, Staphylococcus
RSTS

SEQ ID NO: 1981344 - protein, 6 aa, Staphylococcus
RSTTQL

SEQ ID NO: 1981345 - protein, 6 aa, Staphylococcus
RSVDGK

SEQ ID NO: 1981346 - protein, 7 aa, Staphylococcus
RSVEAGT

SEQ ID NO: 1981347 - protein, 18 aa, Staphylococcus
RSVGEKNVVTTSRFPGTT

SEQ ID NO: 1981348 - protein, 9 aa, Staphylococcus
RSVGGGQYD

SEQ ID NO: 1981349 - protein, 8 aa, Staphylococcus
RSVKEPSL

SEQ ID NO: 1981350 - protein, 6 aa, Staphylococcus
RSVLEP

SEQ ID NO: 1981351 - protein, 8 aa, Staphylococcus
RSVTEDKH

SEQ ID NO: 1981352 - protein, 4 aa, Staphylococcus
RSYA

SEQ ID NO: 1981353 - protein, 20 aa, Staphylococcus
RSYEKHQKHSNIDEPISTNL

SEQ ID NO: 1981354 - protein, 10 aa, Staphylococcus
RSYGHNPEKL

SEQ ID NO: 1981355 - protein, 11 aa, Staphylococcus
RSYRGKGYAST

SEQ ID NO: 1981356 - protein, 5 aa, Staphylococcus
RSYTE

SEQ ID NO: 1981357 - protein, 5 aa, Staphylococcus
RTAEG

SEQ ID NO: 1981358 - protein, 8 aa, Staphylococcus
RTAEIAKE

SEQ ID NO: 1981359 - protein, 5 aa, Staphylococcus
RTAGV

SEQ ID NO: 1981360 - protein, 15 aa, Staphylococcus
RTAKPKPFLSNQSGK

SEQ ID NO: 1981361 - protein, 14 aa, Staphylococcus
RTAMEGAPLKRGAA

SEQ ID NO: 1981362 - protein, 7 aa, Staphylococcus
RTANKKP

SEQ ID NO: 1981363 - protein, 7 aa, Staphylococcus
RTAQGVF

SEQ ID NO: 1981364 - protein, 11 aa, Staphylococcus
RTATSGKNGAT

SEQ ID NO: 1981365 - protein, 8 aa, Staphylococcus
RTATVKNI

SEQ ID NO: 1981366 - protein, 7 aa, Staphylococcus
RTAYEDF

SEQ ID NO: 1981367 - protein, 7 aa, Staphylococcus
RTAYEKN

SEQ ID NO: 1981368 - protein, 7 aa, Staphylococcus
RTCAGTD

SEQ ID NO: 1981369 - protein, 6 aa, Staphylococcus
RTDDQL

SEQ ID NO: 1981370 - protein, 8 aa, Staphylococcus
RTDDTEFK

SEQ ID NO: 1981371 - protein, 7 aa, Staphylococcus
RTDEETA

SEQ ID NO: 1981372 - protein, 10 aa, Staphylococcus
RTDEETATGI

SEQ ID NO: 1981373 - protein, 8 aa, Staphylococcus
RTDEETSM

SEQ ID NO: 1981374 - protein, 6 aa, Staphylococcus
RTDEGF

SEQ ID NO: 1981375 - protein, 13 aa, Staphylococcus
RTDGNSGKNPVKC

SEQ ID NO: 1981376 - protein, 8 aa, Staphylococcus
RTDQANTA

SEQ ID NO: 1981377 - protein, 7 aa, Staphylococcus
RTDQETA

SEQ ID NO: 1981378 - protein, 9 aa, Staphylococcus
RTDTAQESG

SEQ ID NO: 1981379 - protein, 7 aa, Staphylococcus
RTDTDHA

SEQ ID NO: 1981380 - protein, 6 aa, Staphylococcus
RTEAGH

SEQ ID NO: 1981381 - protein, 15 aa, Staphylococcus
RTEAQRRNIKETSDL

SEQ ID NO: 1981382 - protein, 4 aa, Staphylococcus
RTEE

SEQ ID NO: 1981383 - protein, 8 aa, Staphylococcus
RTEEDERR

SEQ ID NO: 1981384 - protein, 5 aa, Staphylococcus
RTEHE

SEQ ID NO: 1981385 - protein, 5 aa, Staphylococcus
RTELS

SEQ ID NO: 1981386 - protein, 5 aa, Staphylococcus
RTENE

SEQ ID NO: 1981387 - protein, 6 aa, Staphylococcus
RTENGH

SEQ ID NO: 1981388 - protein, 7 aa, Staphylococcus
RTENKAR

SEQ ID NO: 1981389 - protein, 5 aa, Staphylococcus
RTEPT

SEQ ID NO: 1981390 - protein, 5 aa, Staphylococcus
RTEQP

SEQ ID NO: 1981391 - protein, 19 aa, Staphylococcus
RTEQTCPKCQGTGQEFEEP

SEQ ID NO: 1981392 - protein, 7 aa, Staphylococcus
RTETNAY

SEQ ID NO: 1981393 - protein, 6 aa, Staphylococcus
RTEVKL

SEQ ID NO: 1981394 - protein, 11 aa, Staphylococcus
RTFSGQDDFDA

SEQ ID NO: 1981395 - protein, 6 aa, Staphylococcus
RTGAIQ

SEQ ID NO: 1981396 - protein, 12 aa, Staphylococcus
RTGCSASTIRRD

SEQ ID NO: 1981397 - protein, 9 aa, Staphylococcus
RTGDQGRIW

SEQ ID NO: 1981398 - protein, 7 aa, Staphylococcus
RTGEATP

SEQ ID NO: 1981399 - protein, 4 aa, Staphylococcus
RTGK

SEQ ID NO: 1981400 - protein, 7 aa, Staphylococcus
RTGLDRD

SEQ ID NO: 1981401 - protein, 10 aa, Staphylococcus
RTGNEAAPEI

SEQ ID NO: 1981402 - protein, 10 aa, Staphylococcus
RTGNEAAPKI

SEQ ID NO: 1981403 - protein, 9 aa, Staphylococcus
RTGNEAVPE

SEQ ID NO: 1981404 - protein, 10 aa, Staphylococcus
RTGNEGAPKI

SEQ ID NO: 1981405 - protein, 6 aa, Staphylococcus
RTGNEI

SEQ ID NO: 1981406 - protein, 8 aa, Staphylococcus
RTGNTGKV

SEQ ID NO: 1981407 - protein, 18 aa, Staphylococcus
RTGRKENDLQDQSKLKEY

SEQ ID NO: 1981408 - protein, 7 aa, Staphylococcus
RTGTPIH

SEQ ID NO: 1981409 - protein, 8 aa, Staphylococcus
RTGTPIHP

SEQ ID NO: 1981410 - protein, 7 aa, Staphylococcus
RTGTPLH

SEQ ID NO: 1981411 - protein, 12 aa, Staphylococcus
RTHEADTGSPEV

SEQ ID NO: 1981412 - protein, 10 aa, Staphylococcus
RTHENDPAYE

SEQ ID NO: 1981413 - protein, 12 aa, Staphylococcus
RTHETDTGSPEV

SEQ ID NO: 1981414 - protein, 6 aa, Staphylococcus
RTHGGA

SEQ ID NO: 1981415 - protein, 5 aa, Staphylococcus
RTHQS

SEQ ID NO: 1981416 - protein, 13 aa, Staphylococcus
RTHQSPLRESGAL

SEQ ID NO: 1981417 - protein, 18 aa, Staphylococcus
RTHRESAFPERKKVQDAR

SEQ ID NO: 1981418 - protein, 18 aa, Staphylococcus
RTHRQSAFPARKKAQDAR

SEQ ID NO: 1981419 - protein, 17 aa, Staphylococcus
RTHRQSPFSERKQAQYQ

SEQ ID NO: 1981420 - protein, 12 aa, Staphylococcus
RTHSKAQELAEK

SEQ ID NO: 1981421 - protein, 4 aa, Staphylococcus
RTHV

SEQ ID NO: 1981422 - protein, 8 aa, Staphylococcus
RTIDAPRY

SEQ ID NO: 1981423 - protein, 6 aa, Staphylococcus
RTIEGG

SEQ ID NO: 1981424 - protein, 6 aa, Staphylococcus
RTIQRD

SEQ ID NO: 1981425 - protein, 23 aa, Staphylococcus
RTITDKLEDEREQQAIINAIELN

SEQ ID NO: 1981426 - protein, 7 aa, Staphylococcus
RTITPLT

SEQ ID NO: 1981427 - protein, 17 aa, Staphylococcus
RTIYKTKTSISISDEEL

SEQ ID NO: 1981428 - protein, 17 aa, Staphylococcus
RTIYSTETTISISDKEL

SEQ ID NO: 1981429 - protein, 6 aa, Staphylococcus
RTKDFS

SEQ ID NO: 1981430 - protein, 17 aa, Staphylococcus
RTKDGKAYYGGNVENAA

SEQ ID NO: 1981431 - protein, 9 aa, Staphylococcus
RTKDGNEFY

SEQ ID NO: 1981432 - protein, 9 aa, Staphylococcus
RTKDGRTFH

SEQ ID NO: 1981433 - protein, 4 aa, Staphylococcus
RTKE

SEQ ID NO: 1981434 - protein, 9 aa, Staphylococcus
RTKEISDKN

SEQ ID NO: 1981435 - protein, 19 aa, Staphylococcus
RTKERAQQLAEKHQTQYAD

SEQ ID NO: 1981436 - protein, 6 aa, Staphylococcus
RTKGEI

SEQ ID NO: 1981437 - protein, 11 aa, Staphylococcus
RTKGEPGTGNI

SEQ ID NO: 1981438 - protein, 8 aa, Staphylococcus
RTKGNNEL

SEQ ID NO: 1981439 - protein, 12 aa, Staphylococcus
RTKKGPTSKVKQ

SEQ ID NO: 1981440 - protein, 9 aa, Staphylococcus
RTKKRAFNT

SEQ ID NO: 1981441 - protein, 10 aa, Staphylococcus
RTKKRAIKTI

SEQ ID NO: 1981442 - protein, 8 aa, Staphylococcus
RTKLGLTQ

SEQ ID NO: 1981443 - protein, 7 aa, Staphylococcus
RTKNGQN

SEQ ID NO: 1981444 - protein, 9 aa, Staphylococcus
RTKNKGFYS

SEQ ID NO: 1981445 - protein, 7 aa, Staphylococcus
RTKPSYP

SEQ ID NO: 1981446 - protein, 29 aa, Staphylococcus
RTKQYVNSAADQNKLEPQNHQNINTHTKQ

SEQ ID NO: 1981447 - protein, 4 aa, Staphylococcus
RTKS

SEQ ID NO: 1981448 - protein, 8 aa, Staphylococcus
RTKSPDMQ

SEQ ID NO: 1981449 - protein, 9 aa, Staphylococcus
RTKTDNDSF

SEQ ID NO: 1981450 - protein, 18 aa, Staphylococcus
RTKTDRYQRKASNKNLSS

SEQ ID NO: 1981451 - protein, 10 aa, Staphylococcus
RTKTEKADTL

SEQ ID NO: 1981452 - protein, 9 aa, Staphylococcus
RTKTEKAND

SEQ ID NO: 1981453 - protein, 9 aa, Staphylococcus
RTKTEKANE

SEQ ID NO: 1981454 - protein, 9 aa, Staphylococcus
RTKTENANE

SEQ ID NO: 1981455 - protein, 8 aa, Staphylococcus
RTKYDLDH

SEQ ID NO: 1981456 - protein, 7 aa, Staphylococcus
RTLEENS

SEQ ID NO: 1981457 - protein, 7 aa, Staphylococcus
RTLEQAE

SEQ ID NO: 1981458 - protein, 10 aa, Staphylococcus
RTLKGLSRQQ

SEQ ID NO: 1981459 - protein, 7 aa, Staphylococcus
RTLPENS

SEQ ID NO: 1981460 - protein, 8 aa, Staphylococcus
RTLTPGQT

SEQ ID NO: 1981461 - protein, 9 aa, Staphylococcus
RTMEDGSQE

SEQ ID NO: 1981462 - protein, 14 aa, Staphylococcus
RTMSKQGQISEEAA

SEQ ID NO: 1981463 - protein, 9 aa, Staphylococcus
RTMSSNDSI

SEQ ID NO: 1981464 - protein, 6 aa, Staphylococcus
RTNDID

SEQ ID NO: 1981465 - protein, 5 aa, Staphylococcus
RTNDP

SEQ ID NO: 1981466 - protein, 7 aa, Staphylococcus
RTNEANT

SEQ ID NO: 1981467 - protein, 9 aa, Staphylococcus
RTNEEIAQP

SEQ ID NO: 1981468 - protein, 20 aa, Staphylococcus
RTNETAEARNISQKNDMRSA

SEQ ID NO: 1981469 - protein, 7 aa, Staphylococcus
RTNIGTE

SEQ ID NO: 1981470 - protein, 4 aa, Staphylococcus
RTNK

SEQ ID NO: 1981471 - protein, 16 aa, Staphylococcus
RTNKYYNDSKATNTLA

SEQ ID NO: 1981472 - protein, 7 aa, Staphylococcus
RTNNTDR

SEQ ID NO: 1981473 - protein, 6 aa, Staphylococcus
RTPDKA

SEQ ID NO: 1981474 - protein, 12 aa, Staphylococcus
RTPDNATDQPLP

SEQ ID NO: 1981475 - protein, 6 aa, Staphylococcus
RTPDYN

SEQ ID NO: 1981476 - protein, 6 aa, Staphylococcus
RTPEQV

SEQ ID NO: 1981477 - protein, 11 aa, Staphylococcus
RTPKDSTPYKH

SEQ ID NO: 1981478 - protein, 7 aa, Staphylococcus
RTPNNED

SEQ ID NO: 1981479 - protein, 9 aa, Staphylococcus
RTPQHNESF

SEQ ID NO: 1981480 - protein, 9 aa, Staphylococcus
RTPQNGGMM

SEQ ID NO: 1981481 - protein, 9 aa, Staphylococcus
RTPSTTDYN

SEQ ID NO: 1981482 - protein, 8 aa, Staphylococcus
RTPTDSGL

SEQ ID NO: 1981483 - protein, 8 aa, Staphylococcus
RTQENNEG

SEQ ID NO: 1981484 - protein, 4 aa, Staphylococcus
RTQL

SEQ ID NO: 1981485 - protein, 11 aa, Staphylococcus
RTQNPEAEKEL

SEQ ID NO: 1981486 - protein, 7 aa, Staphylococcus
RTQRQGF

SEQ ID NO: 1981487 - protein, 14 aa, Staphylococcus
RTQSANSEQSEPHA

SEQ ID NO: 1981488 - protein, 7 aa, Staphylococcus
RTQSEGV

SEQ ID NO: 1981489 - protein, 14 aa, Staphylococcus
RTQSSKPEQSEPHA

SEQ ID NO: 1981490 - protein, 14 aa, Staphylococcus
RTQSTSAEQSEPHA

SEQ ID NO: 1981491 - protein, 5 aa, Staphylococcus
RTQTI

SEQ ID NO: 1981492 - protein, 6 aa, Staphylococcus
RTQTLS

SEQ ID NO: 1981493 - protein, 14 aa, Staphylococcus
RTQTSKPEQSEPHA

SEQ ID NO: 1981494 - protein, 14 aa, Staphylococcus
RTQTTTPEQSEPHA

SEQ ID NO: 1981495 - protein, 6 aa, Staphylococcus
RTQYIS

SEQ ID NO: 1981496 - protein, 4 aa, Staphylococcus
RTRE

SEQ ID NO: 1981497 - protein, 11 aa, Staphylococcus
RTREEKDERNL

SEQ ID NO: 1981498 - protein, 15 aa, Staphylococcus
RTRHQDSDLKRGQRQ

SEQ ID NO: 1981499 - protein, 10 aa, Staphylococcus
RTRKRAYNSI

SEQ ID NO: 1981500 - protein, 5 aa, Staphylococcus
RTRLS

SEQ ID NO: 1981501 - protein, 9 aa, Staphylococcus
RTRNAEHDL

SEQ ID NO: 1981502 - protein, 16 aa, Staphylococcus
RTRNKKVTSVDKENVL

SEQ ID NO: 1981503 - protein, 7 aa, Staphylococcus
RTRPTVS

SEQ ID NO: 1981504 - protein, 16 aa, Staphylococcus
RTRQQTSKSLNLNYYS

SEQ ID NO: 1981505 - protein, 14 aa, Staphylococcus
RTRSELVESGEDDL

SEQ ID NO: 1981506 - protein, 14 aa, Staphylococcus
RTRSELVESGQDDL

SEQ ID NO: 1981507 - protein, 4 aa, Staphylococcus
RTRY

SEQ ID NO: 1981508 - protein, 4 aa, Staphylococcus
RTSD

SEQ ID NO: 1981509 - protein, 6 aa, Staphylococcus
RTSDEY

SEQ ID NO: 1981510 - protein, 9 aa, Staphylococcus
RTSDINQEI

SEQ ID NO: 1981511 - protein, 9 aa, Staphylococcus
RTSDSDSNL

SEQ ID NO: 1981512 - protein, 7 aa, Staphylococcus
RTSEPEF

SEQ ID NO: 1981513 - protein, 7 aa, Staphylococcus
RTSETYL

SEQ ID NO: 1981514 - protein, 5 aa, Staphylococcus
RTSGW

SEQ ID NO: 1981515 - protein, 7 aa, Staphylococcus
RTSHYPY

SEQ ID NO: 1981516 - protein, 5 aa, Staphylococcus
RTSNI

SEQ ID NO: 1981517 - protein, 15 aa, Staphylococcus
RTSNQGGKGNVEETT

SEQ ID NO: 1981518 - protein, 14 aa, Staphylococcus
RTSNQGGLGDFGED

SEQ ID NO: 1981519 - protein, 11 aa, Staphylococcus
RTSNSKHTIAG

SEQ ID NO: 1981520 - protein, 17 aa, Staphylococcus
RTSNSKHTIAGAKQLHG

SEQ ID NO: 1981521 - protein, 6 aa, Staphylococcus
RTSPIP

SEQ ID NO: 1981522 - protein, 12 aa, Staphylococcus
RTSPRYDEARTD

SEQ ID NO: 1981523 - protein, 7 aa, Staphylococcus
RTSRLEE

SEQ ID NO: 1981524 - protein, 5 aa, Staphylococcus
RTSRQ

SEQ ID NO: 1981525 - protein, 17 aa, Staphylococcus
RTSSSKHTIAGAKQLHG

SEQ ID NO: 1981526 - protein, 15 aa, Staphylococcus
RTSTRSFNASGVTEI

SEQ ID NO: 1981527 - protein, 6 aa, Staphylococcus
RTSYGQ

SEQ ID NO: 1981528 - protein, 5 aa, Staphylococcus
RTSYI

SEQ ID NO: 1981529 - protein, 9 aa, Staphylococcus
RTTDKGPEI

SEQ ID NO: 1981530 - protein, 9 aa, Staphylococcus
RTTDMTGEV

SEQ ID NO: 1981531 - protein, 9 aa, Staphylococcus
RTTEDRHKQ

SEQ ID NO: 1981532 - protein, 12 aa, Staphylococcus
RTTEISEKNRRI

SEQ ID NO: 1981533 - protein, 9 aa, Staphylococcus
RTTEKRHEE

SEQ ID NO: 1981534 - protein, 20 aa, Staphylococcus
RTTENAEARNISQKNAMRTA

SEQ ID NO: 1981535 - protein, 9 aa, Staphylococcus
RTTEQRHKQ

SEQ ID NO: 1981536 - protein, 20 aa, Staphylococcus
RTTETAEARNISKKNAMRTA

SEQ ID NO: 1981537 - protein, 37 aa, Staphylococcus
RTTETAEERNISQKNAMRTAVKNAKSAIENNADNKAE

SEQ ID NO: 1981538 - protein, 5 aa, Staphylococcus
RTTGF

SEQ ID NO: 1981539 - protein, 9 aa, Staphylococcus
RTTHNIENA

SEQ ID NO: 1981540 - protein, 8 aa, Staphylococcus
RTTHPTLD

SEQ ID NO: 1981541 - protein, 10 aa, Staphylococcus
RTTKKAESFK

SEQ ID NO: 1981542 - protein, 7 aa, Staphylococcus
RTTNKEV

SEQ ID NO: 1981543 - protein, 4 aa, Staphylococcus
RTTS

SEQ ID NO: 1981544 - protein, 8 aa, Staphylococcus
RTTSGNYD

SEQ ID NO: 1981545 - protein, 5 aa, Staphylococcus
RTTYD

SEQ ID NO: 1981546 - protein, 12 aa, Staphylococcus
RTVEAKRLRNNP

SEQ ID NO: 1981547 - protein, 16 aa, Staphylococcus
RTVGREDRLPDDDGGH

SEQ ID NO: 1981548 - protein, 5 aa, Staphylococcus
RTVQK

SEQ ID NO: 1981549 - protein, 7 aa, Staphylococcus
RTVQSHR

SEQ ID NO: 1981550 - protein, 10 aa, Staphylococcus
RTVQTYENGF

SEQ ID NO: 1981551 - protein, 4 aa, Staphylococcus
RTVR

SEQ ID NO: 1981552 - protein, 5 aa, Staphylococcus
RTVRA

SEQ ID NO: 1981553 - protein, 6 aa, Staphylococcus
RTVTST

SEQ ID NO: 1981554 - protein, 10 aa, Staphylococcus
RTWEDEKQEK

SEQ ID NO: 1981555 - protein, 13 aa, Staphylococcus
RTWQGKTSTNNVY

SEQ ID NO: 1981556 - protein, 4 aa, Staphylococcus
RTYD

SEQ ID NO: 1981557 - protein, 15 aa, Staphylococcus
RTYDANDLNSVKTQM

SEQ ID NO: 1981558 - protein, 10 aa, Staphylococcus
RTYDFSSKNG

SEQ ID NO: 1981559 - protein, 7 aa, Staphylococcus
RTYDPND

SEQ ID NO: 1981560 - protein, 7 aa, Staphylococcus
RTYDTED

SEQ ID NO: 1981561 - protein, 5 aa, Staphylococcus
RTYPQ

SEQ ID NO: 1981562 - protein, 18 aa, Staphylococcus
RTYTNQEPKYLNSPETPI

SEQ ID NO: 1981563 - protein, 6 aa, Staphylococcus
RVAAKQ

SEQ ID NO: 1981564 - protein, 6 aa, Staphylococcus
RVAEGD

SEQ ID NO: 1981565 - protein, 8 aa, Staphylococcus
RVAETTTA

SEQ ID NO: 1981566 - protein, 8 aa, Staphylococcus
RVAGGREV

SEQ ID NO: 1981567 - protein, 13 aa, Staphylococcus
RVAKKSGEEIKSN

SEQ ID NO: 1981568 - protein, 6 aa, Staphylococcus
RVAKNK

SEQ ID NO: 1981569 - protein, 8 aa, Staphylococcus
RVAQGDLG

SEQ ID NO: 1981570 - protein, 20 aa, Staphylococcus
RVAREGARTVPPRENGGNCD

SEQ ID NO: 1981571 - protein, 6 aa, Staphylococcus
RVDEGE

SEQ ID NO: 1981572 - protein, 6 aa, Staphylococcus
RVDLET

SEQ ID NO: 1981573 - protein, 26 aa, Staphylococcus
RVDSEGYDYEGEAGTSNESASSTAHN

SEQ ID NO: 1981574 - protein, 11 aa, Staphylococcus
RVDSQNDPKQF

SEQ ID NO: 1981575 - protein, 5 aa, Staphylococcus
RVDYG

SEQ ID NO: 1981576 - protein, 21 aa, Staphylococcus
RVDYGQAHAEKYGHDRYGRTY

SEQ ID NO: 1981577 - protein, 15 aa, Staphylococcus
RVEDRDPKVLKDDEV

SEQ ID NO: 1981578 - protein, 15 aa, Staphylococcus
RVEDREPKELKDNEV

SEQ ID NO: 1981579 - protein, 15 aa, Staphylococcus
RVEDREPKQLKDNEV

SEQ ID NO: 1981580 - protein, 4 aa, Staphylococcus
RVEE

SEQ ID NO: 1981581 - protein, 15 aa, Staphylococcus
RVEERESKPLKDNEV

SEQ ID NO: 1981582 - protein, 10 aa, Staphylococcus
RVEKRNELPP

SEQ ID NO: 1981583 - protein, 6 aa, Staphylococcus
RVENNQ

SEQ ID NO: 1981584 - protein, 7 aa, Staphylococcus
RVEPGDK

SEQ ID NO: 1981585 - protein, 12 aa, Staphylococcus
RVEPLKAEASIA

SEQ ID NO: 1981586 - protein, 11 aa, Staphylococcus
RVEPLKEEAAI

SEQ ID NO: 1981587 - protein, 15 aa, Staphylococcus
RVESEMKKQDWTEVK

SEQ ID NO: 1981588 - protein, 40 aa, Staphylococcus
RVESGQEKPVYDQSNQSSEEENIDDPNAEINAATNEDEYV

SEQ ID NO: 1981589 - protein, 9 aa, Staphylococcus
RVESTNGLH

SEQ ID NO: 1981590 - protein, 4 aa, Staphylococcus
RVET

SEQ ID NO: 1981591 - protein, 9 aa, Staphylococcus
RVGAQAAKQ

SEQ ID NO: 1981592 - protein, 15 aa, Staphylococcus
RVGDKQCDDKEFERT

SEQ ID NO: 1981593 - protein, 8 aa, Staphylococcus
RVGGSAQI

SEQ ID NO: 1981594 - protein, 4 aa, Staphylococcus
RVGI

SEQ ID NO: 1981595 - protein, 8 aa, Staphylococcus
RVGKTESI

SEQ ID NO: 1981596 - protein, 9 aa, Staphylococcus
RVGKTESIV

SEQ ID NO: 1981597 - protein, 5 aa, Staphylococcus
RVGPF

SEQ ID NO: 1981598 - protein, 8 aa, Staphylococcus
RVGRSDHQ

SEQ ID NO: 1981599 - protein, 9 aa, Staphylococcus
RVGRSEQQS

SEQ ID NO: 1981600 - protein, 8 aa, Staphylococcus
RVGRSSRV

SEQ ID NO: 1981601 - protein, 7 aa, Staphylococcus
RVHPGTK

SEQ ID NO: 1981602 - protein, 6 aa, Staphylococcus
RVIGKD

SEQ ID NO: 1981603 - protein, 9 aa, Staphylococcus
RVKDDKDKR

SEQ ID NO: 1981604 - protein, 5 aa, Staphylococcus
RVKEE

SEQ ID NO: 1981605 - protein, 5 aa, Staphylococcus
RVKES

SEQ ID NO: 1981606 - protein, 5 aa, Staphylococcus
RVKGK

SEQ ID NO: 1981607 - protein, 5 aa, Staphylococcus
RVKGN

SEQ ID NO: 1981608 - protein, 8 aa, Staphylococcus
RVKKSRNV

SEQ ID NO: 1981609 - protein, 14 aa, Staphylococcus
RVKNLRKSENYNSE

SEQ ID NO: 1981610 - protein, 7 aa, Staphylococcus
RVKPGAD

SEQ ID NO: 1981611 - protein, 7 aa, Staphylococcus
RVKPGAE

SEQ ID NO: 1981612 - protein, 12 aa, Staphylococcus
RVKPGAKLSQIG

SEQ ID NO: 1981613 - protein, 9 aa, Staphylococcus
RVKQSLNER

SEQ ID NO: 1981614 - protein, 9 aa, Staphylococcus
RVKRGIPGE

SEQ ID NO: 1981615 - protein, 5 aa, Staphylococcus
RVKSD

SEQ ID NO: 1981616 - protein, 17 aa, Staphylococcus
RVLDNGEKVAPEVKEGD

SEQ ID NO: 1981617 - protein, 14 aa, Staphylococcus
RVLGTGEKVLSRSD

SEQ ID NO: 1981618 - protein, 9 aa, Staphylococcus
RVNETRSNG

SEQ ID NO: 1981619 - protein, 6 aa, Staphylococcus
RVNEYS

SEQ ID NO: 1981620 - protein, 21 aa, Staphylococcus
RVNGKEVKSFEEPDASKLPWG

SEQ ID NO: 1981621 - protein, 6 aa, Staphylococcus
RVNGNR

SEQ ID NO: 1981622 - protein, 6 aa, Staphylococcus
RVNKTQ

SEQ ID NO: 1981623 - protein, 10 aa, Staphylococcus
RVNKTQVKDA

SEQ ID NO: 1981624 - protein, 8 aa, Staphylococcus
RVNQQALP

SEQ ID NO: 1981625 - protein, 11 aa, Staphylococcus
RVNRENTETKI

SEQ ID NO: 1981626 - protein, 11 aa, Staphylococcus
RVNSDDEKSYT

SEQ ID NO: 1981627 - protein, 5 aa, Staphylococcus
RVNTG

SEQ ID NO: 1981628 - protein, 10 aa, Staphylococcus
RVPDAVNEAT

SEQ ID NO: 1981629 - protein, 6 aa, Staphylococcus
RVPNDE

SEQ ID NO: 1981630 - protein, 12 aa, Staphylococcus
RVPNTSDIGIQN

SEQ ID NO: 1981631 - protein, 9 aa, Staphylococcus
RVPQPTRAE

SEQ ID NO: 1981632 - protein, 7 aa, Staphylococcus
RVPSQRI

SEQ ID NO: 1981633 - protein, 7 aa, Staphylococcus
RVQDGRL

SEQ ID NO: 1981634 - protein, 14 aa, Staphylococcus
RVQDNKEQEARNEV

SEQ ID NO: 1981635 - protein, 15 aa, Staphylococcus
RVQEAASATNEEDLY

SEQ ID NO: 1981636 - protein, 8 aa, Staphylococcus
RVQGKNDN

SEQ ID NO: 1981637 - protein, 8 aa, Staphylococcus
RVQPGDTV

SEQ ID NO: 1981638 - protein, 17 aa, Staphylococcus
RVREGKEAVKPNKDLNY

SEQ ID NO: 1981639 - protein, 4 aa, Staphylococcus
RVRP

SEQ ID NO: 1981640 - protein, 11 aa, Staphylococcus
RVSAEGDLKPV

SEQ ID NO: 1981641 - protein, 9 aa, Staphylococcus
RVSAEGELK

SEQ ID NO: 1981642 - protein, 4 aa, Staphylococcus
RVSD

SEQ ID NO: 1981643 - protein, 4 aa, Staphylococcus
RVSG

SEQ ID NO: 1981644 - protein, 4 aa, Staphylococcus
RVSI

SEQ ID NO: 1981645 - protein, 6 aa, Staphylococcus
RVSKGQ

SEQ ID NO: 1981646 - protein, 10 aa, Staphylococcus
RVSNGTGHAL

SEQ ID NO: 1981647 - protein, 9 aa, Staphylococcus
RVSNQEELE

SEQ ID NO: 1981648 - protein, 8 aa, Staphylococcus
RVSSGGFQ

SEQ ID NO: 1981649 - protein, 11 aa, Staphylococcus
RVTAEDELKPV

SEQ ID NO: 1981650 - protein, 6 aa, Staphylococcus
RVTESN

SEQ ID NO: 1981651 - protein, 11 aa, Staphylococcus
RVTNADYTQTE

SEQ ID NO: 1981652 - protein, 11 aa, Staphylococcus
RVTNQEELENA

SEQ ID NO: 1981653 - protein, 9 aa, Staphylococcus
RVTQDIGDA

SEQ ID NO: 1981654 - protein, 15 aa, Staphylococcus
RVYRPTGKNDENAGI

SEQ ID NO: 1981655 - protein, 30 aa, Staphylococcus
RVYRPTGKNDEYAAPKGDNGEKNMNKMGGK

SEQ ID NO: 1981656 - protein, 13 aa, Staphylococcus
RWAGEDQETSDLA

SEQ ID NO: 1981657 - protein, 13 aa, Staphylococcus
RWASENQDTSDLA

SEQ ID NO: 1981658 - protein, 6 aa, Staphylococcus
RWGQKE

SEQ ID NO: 1981659 - protein, 4 aa, Staphylococcus
RWNK

SEQ ID NO: 1981660 - protein, 7 aa, Staphylococcus
RWQTKSD

SEQ ID NO: 1981661 - protein, 5 aa, Staphylococcus
RWSKS

SEQ ID NO: 1981662 - protein, 5 aa, Staphylococcus
RWSSG

SEQ ID NO: 1981663 - protein, 4 aa, Staphylococcus
RWTD

SEQ ID NO: 1981664 - protein, 4 aa, Staphylococcus
RWTK

SEQ ID NO: 1981665 - protein, 5 aa, Staphylococcus
RWTPS

SEQ ID NO: 1981666 - protein, 13 aa, Staphylococcus
RYAGTDKDDDANI

SEQ ID NO: 1981667 - protein, 12 aa, Staphylococcus
RYAGTDKDDEAN

SEQ ID NO: 1981668 - protein, 8 aa, Staphylococcus
RYAKRSQL

SEQ ID NO: 1981669 - protein, 7 aa, Staphylococcus
RYANDNN

SEQ ID NO: 1981670 - protein, 14 aa, Staphylococcus
RYARSIKGTKPTFY

SEQ ID NO: 1981671 - protein, 5 aa, Staphylococcus
RYDDG

SEQ ID NO: 1981672 - protein, 11 aa, Staphylococcus
RYDETKNSENL

SEQ ID NO: 1981673 - protein, 6 aa, Staphylococcus
RYDGNP

SEQ ID NO: 1981674 - protein, 5 aa, Staphylococcus
RYDGS

SEQ ID NO: 1981675 - protein, 7 aa, Staphylococcus
RYDKTPA

SEQ ID NO: 1981676 - protein, 7 aa, Staphylococcus
RYDTDTL

SEQ ID NO: 1981677 - protein, 10 aa, Staphylococcus
RYEDTSGNQT

SEQ ID NO: 1981678 - protein, 11 aa, Staphylococcus
RYEHEDTVNRG

SEQ ID NO: 1981679 - protein, 9 aa, Staphylococcus
RYEHQDTVN

SEQ ID NO: 1981680 - protein, 7 aa, Staphylococcus
RYEKTPA

SEQ ID NO: 1981681 - protein, 8 aa, Staphylococcus
RYENEQPM

SEQ ID NO: 1981682 - protein, 5 aa, Staphylococcus
RYEPK

SEQ ID NO: 1981683 - protein, 4 aa, Staphylococcus
RYER

SEQ ID NO: 1981684 - protein, 5 aa, Staphylococcus
RYERA

SEQ ID NO: 1981685 - protein, 10 aa, Staphylococcus
RYESIPNEER

SEQ ID NO: 1981686 - protein, 7 aa, Staphylococcus
RYETQLN

SEQ ID NO: 1981687 - protein, 13 aa, Staphylococcus
RYFESESDVPQQA

SEQ ID NO: 1981688 - protein, 16 aa, Staphylococcus
RYGAAAKTSGAGGGDC

SEQ ID NO: 1981689 - protein, 8 aa, Staphylococcus
RYGKAAAA

SEQ ID NO: 1981690 - protein, 4 aa, Staphylococcus
RYGP

SEQ ID NO: 1981691 - protein, 9 aa, Staphylococcus
RYGREPKSI

SEQ ID NO: 1981692 - protein, 11 aa, Staphylococcus
RYGSDKPDTRF

SEQ ID NO: 1981693 - protein, 8 aa, Staphylococcus
RYHDSPSE

SEQ ID NO: 1981694 - protein, 11 aa, Staphylococcus
RYHESPSEYTR

SEQ ID NO: 1981695 - protein, 7 aa, Staphylococcus
RYKAEGK

SEQ ID NO: 1981696 - protein, 11 aa, Staphylococcus
RYKESRRAHPL

SEQ ID NO: 1981697 - protein, 16 aa, Staphylococcus
RYKESRRAHPLNQNGQ

SEQ ID NO: 1981698 - protein, 5 aa, Staphylococcus
RYKGP

SEQ ID NO: 1981699 - protein, 6 aa, Staphylococcus
RYKKEQ

SEQ ID NO: 1981700 - protein, 7 aa, Staphylococcus
RYKNEDI

SEQ ID NO: 1981701 - protein, 4 aa, Staphylococcus
RYKQ

SEQ ID NO: 1981702 - protein, 5 aa, Staphylococcus
RYKQE

SEQ ID NO: 1981703 - protein, 13 aa, Staphylococcus
RYKSNPSATNSGY

SEQ ID NO: 1981704 - protein, 10 aa, Staphylococcus
RYKSPRSERV

SEQ ID NO: 1981705 - protein, 7 aa, Staphylococcus
RYKTDSQ

SEQ ID NO: 1981706 - protein, 7 aa, Staphylococcus
RYKTDST

SEQ ID NO: 1981707 - protein, 12 aa, Staphylococcus
RYLNSQDSDTLS

SEQ ID NO: 1981708 - protein, 5 aa, Staphylococcus
RYLSD

SEQ ID NO: 1981709 - protein, 7 aa, Staphylococcus
RYLSDSK

SEQ ID NO: 1981710 - protein, 9 aa, Staphylococcus
RYLSDSKQH

SEQ ID NO: 1981711 - protein, 7 aa, Staphylococcus
RYLSDSQ

SEQ ID NO: 1981712 - protein, 8 aa, Staphylococcus
RYNDENGE

SEQ ID NO: 1981713 - protein, 10 aa, Staphylococcus
RYNERQGGYT

SEQ ID NO: 1981714 - protein, 13 aa, Staphylococcus
RYNEYKEKYHFLG

SEQ ID NO: 1981715 - protein, 7 aa, Staphylococcus
RYNKDGS

SEQ ID NO: 1981716 - protein, 7 aa, Staphylococcus
RYNKDGT

SEQ ID NO: 1981717 - protein, 5 aa, Staphylococcus
RYNKE

SEQ ID NO: 1981718 - protein, 7 aa, Staphylococcus
RYNKEGN

SEQ ID NO: 1981719 - protein, 7 aa, Staphylococcus
RYNKEGQ

SEQ ID NO: 1981720 - protein, 19 aa, Staphylococcus
RYNKSTFGEPDKNISADTY

SEQ ID NO: 1981721 - protein, 8 aa, Staphylococcus
RYPADDID

SEQ ID NO: 1981722 - protein, 8 aa, Staphylococcus
RYPGKEEE

SEQ ID NO: 1981723 - protein, 4 aa, Staphylococcus
RYPN

SEQ ID NO: 1981724 - protein, 13 aa, Staphylococcus
RYPSELSGGQQQR

SEQ ID NO: 1981725 - protein, 13 aa, Staphylococcus
RYPTEFKKENIRK

SEQ ID NO: 1981726 - protein, 7 aa, Staphylococcus
RYQAEGK

SEQ ID NO: 1981727 - protein, 6 aa, Staphylococcus
RYQEEM

SEQ ID NO: 1981728 - protein, 8 aa, Staphylococcus
RYQEPRDV

SEQ ID NO: 1981729 - protein, 10 aa, Staphylococcus
RYQGDKFKEH

SEQ ID NO: 1981730 - protein, 7 aa, Staphylococcus
RYQKTPA

SEQ ID NO: 1981731 - protein, 4 aa, Staphylococcus
RYQN

SEQ ID NO: 1981732 - protein, 6 aa, Staphylococcus
RYQNGD

SEQ ID NO: 1981733 - protein, 6 aa, Staphylococcus
RYQPNK

SEQ ID NO: 1981734 - protein, 6 aa, Staphylococcus
RYQPRQ

SEQ ID NO: 1981735 - protein, 7 aa, Staphylococcus
RYQPRQV

SEQ ID NO: 1981736 - protein, 7 aa, Staphylococcus
RYQQEGK

SEQ ID NO: 1981737 - protein, 7 aa, Staphylococcus
RYQRPQT

SEQ ID NO: 1981738 - protein, 6 aa, Staphylococcus
RYRASQ

SEQ ID NO: 1981739 - protein, 11 aa, Staphylococcus
RYRDKNEDAGG

SEQ ID NO: 1981740 - protein, 7 aa, Staphylococcus
RYRGKGV

SEQ ID NO: 1981741 - protein, 7 aa, Staphylococcus
RYRGQGI

SEQ ID NO: 1981742 - protein, 12 aa, Staphylococcus
RYRLQPENSAMS

SEQ ID NO: 1981743 - protein, 9 aa, Staphylococcus
RYRNSGDTA

SEQ ID NO: 1981744 - protein, 4 aa, Staphylococcus
RYRP

SEQ ID NO: 1981745 - protein, 8 aa, Staphylococcus
RYRSTPEL

SEQ ID NO: 1981746 - protein, 7 aa, Staphylococcus
RYSDSKA

SEQ ID NO: 1981747 - protein, 18 aa, Staphylococcus
RYSEDMRQYSDEQLQDKT

SEQ ID NO: 1981748 - protein, 13 aa, Staphylococcus
RYSEGKKTRIVGP

SEQ ID NO: 1981749 - protein, 4 aa, Staphylococcus
RYSS

SEQ ID NO: 1981750 - protein, 7 aa, Staphylococcus
RYSSSKF

SEQ ID NO: 1981751 - protein, 8 aa, Staphylococcus
RYSTTKSN

SEQ ID NO: 1981752 - protein, 10 aa, Staphylococcus
RYTDRQGGYT

SEQ ID NO: 1981753 - protein, 10 aa, Staphylococcus
RYTGDANKHI

SEQ ID NO: 1981754 - protein, 8 aa, Staphylococcus
RYTGPSEA

SEQ ID NO: 1981755 - protein, 4 aa, Staphylococcus
RYTH

SEQ ID NO: 1981756 - protein, 6 aa, Staphylococcus
RYTKEE

SEQ ID NO: 1981757 - protein, 8 aa, Staphylococcus
RYTPGEQK

SEQ ID NO: 1981758 - protein, 8 aa, Staphylococcus
RYTPSEQK

SEQ ID NO: 1981759 - protein, 12 aa, Staphylococcus
RYVSAKSQAQTL

SEQ ID NO: 1981760 - protein, 11 aa, Staphylococcus
SAAAYTKLTGK

SEQ ID NO: 1981761 - protein, 9 aa, Staphylococcus
SAADEEIGQ

SEQ ID NO: 1981762 - protein, 5 aa, Staphylococcus
SAADL

SEQ ID NO: 1981763 - protein, 9 aa, Staphylococcus
SAAEAEESH

SEQ ID NO: 1981764 - protein, 13 aa, Staphylococcus
SAAGKSDSVDDTV

SEQ ID NO: 1981765 - protein, 17 aa, Staphylococcus
SAAGSASSSSQFVNKGA

SEQ ID NO: 1981766 - protein, 8 aa, Staphylococcus
SAAKDPIK

SEQ ID NO: 1981767 - protein, 9 aa, Staphylococcus
SAAKDPVKM

SEQ ID NO: 1981768 - protein, 8 aa, Staphylococcus
SAAKEVTE

SEQ ID NO: 1981769 - protein, 5 aa, Staphylococcus
SAAKT

SEQ ID NO: 1981770 - protein, 15 aa, Staphylococcus
SAANKKYHNESEGIT

SEQ ID NO: 1981771 - protein, 8 aa, Staphylococcus
SAASGFAG

SEQ ID NO: 1981772 - protein, 7 aa, Staphylococcus
SAATTAQ

SEQ ID NO: 1981773 - protein, 9 aa, Staphylococcus
SAATTAQWD

SEQ ID NO: 1981774 - protein, 15 aa, Staphylococcus
SACDKTLKDAENKVN

SEQ ID NO: 1981775 - protein, 7 aa, Staphylococcus
SACESND

SEQ ID NO: 1981776 - protein, 5 aa, Staphylococcus
SACQE

SEQ ID NO: 1981777 - protein, 6 aa, Staphylococcus
SADAEK

SEQ ID NO: 1981778 - protein, 24 aa, Staphylococcus
SADARADRADKRTEEYVNARANIK

SEQ ID NO: 1981779 - protein, 8 aa, Staphylococcus
SADASTRL

SEQ ID NO: 1981780 - protein, 5 aa, Staphylococcus
SADEF

SEQ ID NO: 1981781 - protein, 11 aa, Staphylococcus
SADEPGDSMNE

SEQ ID NO: 1981782 - protein, 7 aa, Staphylococcus
SADEVDN

SEQ ID NO: 1981783 - protein, 18 aa, Staphylococcus
SADGPPTNWQSKFGGNAW

SEQ ID NO: 1981784 - protein, 11 aa, Staphylococcus
SADIFTPKRTS

SEQ ID NO: 1981785 - protein, 4 aa, Staphylococcus
SADK

SEQ ID NO: 1981786 - protein, 69 aa, Staphylococcus
SADKTDDSEDDSNATEASKNSKDESKSKDKNSKQDSSSSSKSESKDSSSSDSKKDSNSDSKINSSSSDD

SEQ ID NO: 1981787 - protein, 6 aa, Staphylococcus
SADKYE

SEQ ID NO: 1981788 - protein, 7 aa, Staphylococcus
SADKYEL

SEQ ID NO: 1981789 - protein, 5 aa, Staphylococcus
SADNV

SEQ ID NO: 1981790 - protein, 10 aa, Staphylococcus
SADPEGTRST

SEQ ID NO: 1981791 - protein, 18 aa, Staphylococcus
SADQANPDIGDSAITETI

SEQ ID NO: 1981792 - protein, 5 aa, Staphylococcus
SADRF

SEQ ID NO: 1981793 - protein, 5 aa, Staphylococcus
SADRP

SEQ ID NO: 1981794 - protein, 7 aa, Staphylococcus
SADSEEV

SEQ ID NO: 1981795 - protein, 6 aa, Staphylococcus
SADTTA

SEQ ID NO: 1981796 - protein, 6 aa, Staphylococcus
SADYAK

SEQ ID NO: 1981797 - protein, 12 aa, Staphylococcus
SADYSKNNKQLR

SEQ ID NO: 1981798 - protein, 18 aa, Staphylococcus
SAEADAFNGKISNESPMA

SEQ ID NO: 1981799 - protein, 11 aa, Staphylococcus
SAEAEPGKNDE

SEQ ID NO: 1981800 - protein, 13 aa, Staphylococcus
SAEDKTEEKREYE

SEQ ID NO: 1981801 - protein, 6 aa, Staphylococcus
SAEDWD

SEQ ID NO: 1981802 - protein, 18 aa, Staphylococcus
SAEEAKDYGLVDQVMVPE

SEQ ID NO: 1981803 - protein, 13 aa, Staphylococcus
SAEEAKKYGFNED

SEQ ID NO: 1981804 - protein, 11 aa, Staphylococcus
SAEEAPGENDE

SEQ ID NO: 1981805 - protein, 11 aa, Staphylococcus
SAEEAPGSNDE

SEQ ID NO: 1981806 - protein, 10 aa, Staphylococcus
SAEEEPGEND

SEQ ID NO: 1981807 - protein, 16 aa, Staphylococcus
SAEEGDEIIEYLNEVI

SEQ ID NO: 1981808 - protein, 8 aa, Staphylococcus
SAEEHQDH

SEQ ID NO: 1981809 - protein, 15 aa, Staphylococcus
SAEEHQDRLDKHPED

SEQ ID NO: 1981810 - protein, 5 aa, Staphylococcus
SAEEI

SEQ ID NO: 1981811 - protein, 10 aa, Staphylococcus
SAEEPSNQLG

SEQ ID NO: 1981812 - protein, 11 aa, Staphylococcus
SAEEQPGENDE

SEQ ID NO: 1981813 - protein, 11 aa, Staphylococcus
SAEETAGDNDE

SEQ ID NO: 1981814 - protein, 5 aa, Staphylococcus
SAEEV

SEQ ID NO: 1981815 - protein, 16 aa, Staphylococcus
SAEEVTKDSTVYSATK

SEQ ID NO: 1981816 - protein, 9 aa, Staphylococcus
SAEGDTDGL

SEQ ID NO: 1981817 - protein, 13 aa, Staphylococcus
SAEGKNAGEFYTP

SEQ ID NO: 1981818 - protein, 4 aa, Staphylococcus
SAEH

SEQ ID NO: 1981819 - protein, 5 aa, Staphylococcus
SAEKN

SEQ ID NO: 1981820 - protein, 7 aa, Staphylococcus
SAENPVV

SEQ ID NO: 1981821 - protein, 10 aa, Staphylococcus
SAENSGTSIT

SEQ ID NO: 1981822 - protein, 5 aa, Staphylococcus
SAENV

SEQ ID NO: 1981823 - protein, 14 aa, Staphylococcus
SAEPEEGLPIALLK

SEQ ID NO: 1981824 - protein, 16 aa, Staphylococcus
SAERDDYTKALIDVYQ

SEQ ID NO: 1981825 - protein, 9 aa, Staphylococcus
SAESAKLGA

SEQ ID NO: 1981826 - protein, 14 aa, Staphylococcus
SAESEEGLPLALLK

SEQ ID NO: 1981827 - protein, 34 aa, Staphylococcus
SAESTDGTTDESSKQSLDKSSDKKDKSKKKDSSS

SEQ ID NO: 1981828 - protein, 14 aa, Staphylococcus
SAESVENVKNALKN

SEQ ID NO: 1981829 - protein, 6 aa, Staphylococcus
SAESWD

SEQ ID NO: 1981830 - protein, 6 aa, Staphylococcus
SAESYR

SEQ ID NO: 1981831 - protein, 4 aa, Staphylococcus
SAEV

SEQ ID NO: 1981832 - protein, 17 aa, Staphylococcus
SAEVTRTVRQSSEFGID

SEQ ID NO: 1981833 - protein, 18 aa, Staphylococcus
SAEYAETHKKRGTSKGVD

SEQ ID NO: 1981834 - protein, 14 aa, Staphylococcus
SAEYDSDRTINNKG

SEQ ID NO: 1981835 - protein, 5 aa, Staphylococcus
SAEYE

SEQ ID NO: 1981836 - protein, 6 aa, Staphylococcus
SAFHPE

SEQ ID NO: 1981837 - protein, 5 aa, Staphylococcus
SAFKE

SEQ ID NO: 1981838 - protein, 12 aa, Staphylococcus
SAFKNGNAQPGC

SEQ ID NO: 1981839 - protein, 6 aa, Staphylococcus
SAFKNK

SEQ ID NO: 1981840 - protein, 4 aa, Staphylococcus
SAGA

SEQ ID NO: 1981841 - protein, 8 aa, Staphylococcus
SAGACPEC

SEQ ID NO: 1981842 - protein, 6 aa, Staphylococcus
SAGAID

SEQ ID NO: 1981843 - protein, 5 aa, Staphylococcus
SAGAM

SEQ ID NO: 1981844 - protein, 8 aa, Staphylococcus
SAGCANDT

SEQ ID NO: 1981845 - protein, 6 aa, Staphylococcus
SAGCGK

SEQ ID NO: 1981846 - protein, 5 aa, Staphylococcus
SAGDI

SEQ ID NO: 1981847 - protein, 11 aa, Staphylococcus
SAGDRSIEGDF

SEQ ID NO: 1981848 - protein, 5 aa, Staphylococcus
SAGDS

SEQ ID NO: 1981849 - protein, 6 aa, Staphylococcus
SAGENI

SEQ ID NO: 1981850 - protein, 8 aa, Staphylococcus
SAGEPLNK

SEQ ID NO: 1981851 - protein, 8 aa, Staphylococcus
SAGEPLNQ

SEQ ID NO: 1981852 - protein, 7 aa, Staphylococcus
SAGHYTG

SEQ ID NO: 1981853 - protein, 6 aa, Staphylococcus
SAGLGS

SEQ ID NO: 1981854 - protein, 11 aa, Staphylococcus
SAGNHAQGVAY

SEQ ID NO: 1981855 - protein, 8 aa, Staphylococcus
SAGPIRTL

SEQ ID NO: 1981856 - protein, 8 aa, Staphylococcus
SAGPIRTV

SEQ ID NO: 1981857 - protein, 13 aa, Staphylococcus
SAGQSLSSKITDY

SEQ ID NO: 1981858 - protein, 6 aa, Staphylococcus
SAGTLN

SEQ ID NO: 1981859 - protein, 6 aa, Staphylococcus
SAGTVN

SEQ ID NO: 1981860 - protein, 7 aa, Staphylococcus
SAGVDEP

SEQ ID NO: 1981861 - protein, 5 aa, Staphylococcus
SAGVT

SEQ ID NO: 1981862 - protein, 12 aa, Staphylococcus
SAHASENADEAI

SEQ ID NO: 1981863 - protein, 15 aa, Staphylococcus
SAHASENADEAKNAL

SEQ ID NO: 1981864 - protein, 12 aa, Staphylococcus
SAHASENADEAL

SEQ ID NO: 1981865 - protein, 5 aa, Staphylococcus
SAHEA

SEQ ID NO: 1981866 - protein, 4 aa, Staphylococcus
SAHK

SEQ ID NO: 1981867 - protein, 4 aa, Staphylococcus
SAHP

SEQ ID NO: 1981868 - protein, 11 aa, Staphylococcus
SAHQSSEAIDE

SEQ ID NO: 1981869 - protein, 8 aa, Staphylococcus
SAHQTVHG

SEQ ID NO: 1981870 - protein, 4 aa, Staphylococcus
SAHR

SEQ ID NO: 1981871 - protein, 6 aa, Staphylococcus
SAHRTP

SEQ ID NO: 1981872 - protein, 8 aa, Staphylococcus
SAHSSFSD

SEQ ID NO: 1981873 - protein, 7 aa, Staphylococcus
SAIASGY

SEQ ID NO: 1981874 - protein, 10 aa, Staphylococcus
SAIDSAKAAA

SEQ ID NO: 1981875 - protein, 10 aa, Staphylococcus
SAIDSAKASA

SEQ ID NO: 1981876 - protein, 5 aa, Staphylococcus
SAIGV

SEQ ID NO: 1981877 - protein, 9 aa, Staphylococcus
SAINEGQQL

SEQ ID NO: 1981878 - protein, 14 aa, Staphylococcus
SAINGALSQSPTMG

SEQ ID NO: 1981879 - protein, 9 aa, Staphylococcus
SAIQNGDEA

SEQ ID NO: 1981880 - protein, 17 aa, Staphylococcus
SAISEKAIARKTGARGL

SEQ ID NO: 1981881 - protein, 17 aa, Staphylococcus
SAISNKAIKRKTGARGL

SEQ ID NO: 1981882 - protein, 9 aa, Staphylococcus
SAKADDGAA

SEQ ID NO: 1981883 - protein, 7 aa, Staphylococcus
SAKAETS

SEQ ID NO: 1981884 - protein, 13 aa, Staphylococcus
SAKAVKDSLDNVK

SEQ ID NO: 1981885 - protein, 8 aa, Staphylococcus
SAKDQSLS

SEQ ID NO: 1981886 - protein, 9 aa, Staphylococcus
SAKDRLNTL

SEQ ID NO: 1981887 - protein, 4 aa, Staphylococcus
SAKE

SEQ ID NO: 1981888 - protein, 9 aa, Staphylococcus
SAKEISDEN

SEQ ID NO: 1981889 - protein, 9 aa, Staphylococcus
SAKESRIQR

SEQ ID NO: 1981890 - protein, 10 aa, Staphylococcus
SAKGEEELAE

SEQ ID NO: 1981891 - protein, 9 aa, Staphylococcus
SAKGLANGV

SEQ ID NO: 1981892 - protein, 7 aa, Staphylococcus
SAKGVGD

SEQ ID NO: 1981893 - protein, 12 aa, Staphylococcus
SAKKKKAEDEKE

SEQ ID NO: 1981894 - protein, 11 aa, Staphylococcus
SAKKNTDDNWN

SEQ ID NO: 1981895 - protein, 9 aa, Staphylococcus
SAKKYGLEA

SEQ ID NO: 1981896 - protein, 11 aa, Staphylococcus
SAKMGPASDPM

SEQ ID NO: 1981897 - protein, 10 aa, Staphylococcus
SAKMGPATDP

SEQ ID NO: 1981898 - protein, 4 aa, Staphylococcus
SAKN

SEQ ID NO: 1981899 - protein, 8 aa, Staphylococcus
SAKPVGEA

SEQ ID NO: 1981900 - protein, 9 aa, Staphylococcus
SAKPVGEAL

SEQ ID NO: 1981901 - protein, 10 aa, Staphylococcus
SAKPVGKALE

SEQ ID NO: 1981902 - protein, 8 aa, Staphylococcus
SAKPVGRA

SEQ ID NO: 1981903 - protein, 10 aa, Staphylococcus
SAKQNAESHH

SEQ ID NO: 1981904 - protein, 9 aa, Staphylococcus
SAKQQGYSK

SEQ ID NO: 1981905 - protein, 6 aa, Staphylococcus
SAKQQR

SEQ ID NO: 1981906 - protein, 9 aa, Staphylococcus
SAKSGLERI

SEQ ID NO: 1981907 - protein, 9 aa, Staphylococcus
SAKTGEGGK

SEQ ID NO: 1981908 - protein, 10 aa, Staphylococcus
SAKTGESGKL

SEQ ID NO: 1981909 - protein, 6 aa, Staphylococcus
SAKTGM

SEQ ID NO: 1981910 - protein, 9 aa, Staphylococcus
SAKTLGLSG

SEQ ID NO: 1981911 - protein, 4 aa, Staphylococcus
SAKV

SEQ ID NO: 1981912 - protein, 20 aa, Staphylococcus
SAKVGAPRYCSPTQSYEARA

SEQ ID NO: 1981913 - protein, 4 aa, Staphylococcus
SALD

SEQ ID NO: 1981914 - protein, 10 aa, Staphylococcus
SALDPVGRNE

SEQ ID NO: 1981915 - protein, 6 aa, Staphylococcus
SALEAY

SEQ ID NO: 1981916 - protein, 8 aa, Staphylococcus
SALEKGYT

SEQ ID NO: 1981917 - protein, 6 aa, Staphylococcus
SALETN

SEQ ID NO: 1981918 - protein, 12 aa, Staphylococcus
SALETTLKREST

SEQ ID NO: 1981919 - protein, 17 aa, Staphylococcus
SALKNESDNASKQRLQE

SEQ ID NO: 1981920 - protein, 5 aa, Staphylococcus
SALNH

SEQ ID NO: 1981921 - protein, 6 aa, Staphylococcus
SALPDG

SEQ ID NO: 1981922 - protein, 7 aa, Staphylococcus
SALQEDI

SEQ ID NO: 1981923 - protein, 10 aa, Staphylococcus
SALQSGNYDD

SEQ ID NO: 1981924 - protein, 16 aa, Staphylococcus
SALSRDKINVSGGQRG

SEQ ID NO: 1981925 - protein, 5 aa, Staphylococcus
SAMDG

SEQ ID NO: 1981926 - protein, 5 aa, Staphylococcus
SAMSG

SEQ ID NO: 1981927 - protein, 7 aa, Staphylococcus
SAMSQSI

SEQ ID NO: 1981928 - protein, 4 aa, Staphylococcus
SANA

SEQ ID NO: 1981929 - protein, 22 aa, Staphylococcus
SANAHQAPSAPQPAQQNNDVSS

SEQ ID NO: 1981930 - protein, 19 aa, Staphylococcus
SANAKSPEQVESFLKETFN

SEQ ID NO: 1981931 - protein, 5 aa, Staphylococcus
SANEK

SEQ ID NO: 1981932 - protein, 16 aa, Staphylococcus
SANEVSKESALYSATK

SEQ ID NO: 1981933 - protein, 13 aa, Staphylococcus
SANGNISSRSMGT

SEQ ID NO: 1981934 - protein, 4 aa, Staphylococcus
SANI

SEQ ID NO: 1981935 - protein, 5 aa, Staphylococcus
SANKG

SEQ ID NO: 1981936 - protein, 9 aa, Staphylococcus
SANKSPEEI

SEQ ID NO: 1981937 - protein, 6 aa, Staphylococcus
SANLGG

SEQ ID NO: 1981938 - protein, 5 aa, Staphylococcus
SANMG

SEQ ID NO: 1981939 - protein, 8 aa, Staphylococcus
SANNTQSE

SEQ ID NO: 1981940 - protein, 7 aa, Staphylococcus
SANPTGD

SEQ ID NO: 1981941 - protein, 7 aa, Staphylococcus
SANQDDL

SEQ ID NO: 1981942 - protein, 7 aa, Staphylococcus
SANQESE

SEQ ID NO: 1981943 - protein, 10 aa, Staphylococcus
SANQTQVKGR

SEQ ID NO: 1981944 - protein, 14 aa, Staphylococcus
SANRQPEQIEENIK

SEQ ID NO: 1981945 - protein, 8 aa, Staphylococcus
SANSASWA

SEQ ID NO: 1981946 - protein, 7 aa, Staphylococcus
SANSDGI

SEQ ID NO: 1981947 - protein, 8 aa, Staphylococcus
SANVPGST

SEQ ID NO: 1981948 - protein, 8 aa, Staphylococcus
SAPAKGDV

SEQ ID NO: 1981949 - protein, 8 aa, Staphylococcus
SAPATGDL

SEQ ID NO: 1981950 - protein, 8 aa, Staphylococcus
SAPEELSS

SEQ ID NO: 1981951 - protein, 17 aa, Staphylococcus
SAPESENYANRIESSEG

SEQ ID NO: 1981952 - protein, 4 aa, Staphylococcus
SAPF

SEQ ID NO: 1981953 - protein, 28 aa, Staphylococcus
SAPGEETKTFKGTVSGEITHARQGTHGF

SEQ ID NO: 1981954 - protein, 7 aa, Staphylococcus
SAPGGKA

SEQ ID NO: 1981955 - protein, 16 aa, Staphylococcus
SAPHTMSGKQKENIVN

SEQ ID NO: 1981956 - protein, 4 aa, Staphylococcus
SAPL

SEQ ID NO: 1981957 - protein, 28 aa, Staphylococcus
SAPNGETTQFKGTVTGEITTEPIGDNGF

SEQ ID NO: 1981958 - protein, 8 aa, Staphylococcus
SAPNTLPR

SEQ ID NO: 1981959 - protein, 6 aa, Staphylococcus
SAPPFG

SEQ ID NO: 1981960 - protein, 10 aa, Staphylococcus
SAPPSEQGKI

SEQ ID NO: 1981961 - protein, 21 aa, Staphylococcus
SAPQPSNNTKRLYANPNNAFK

SEQ ID NO: 1981962 - protein, 30 aa, Staphylococcus
SAPQRVERRKERRTESKKTIEYLSEVRHIE

SEQ ID NO: 1981963 - protein, 17 aa, Staphylococcus
SAPQSENYAERVESTEG

SEQ ID NO: 1981964 - protein, 16 aa, Staphylococcus
SAPQSENYATRVDSTD

SEQ ID NO: 1981965 - protein, 17 aa, Staphylococcus
SAPQSENYATRVESTEG

SEQ ID NO: 1981966 - protein, 17 aa, Staphylococcus
SAPQTENYASRVDSTEG

SEQ ID NO: 1981967 - protein, 17 aa, Staphylococcus
SAPQTENYATRVDSTEG

SEQ ID NO: 1981968 - protein, 16 aa, Staphylococcus
SAPQTENYATRVNSTD

SEQ ID NO: 1981969 - protein, 9 aa, Staphylococcus
SAPSEKEEA

SEQ ID NO: 1981970 - protein, 11 aa, Staphylococcus
SAPSEKEEKSI

SEQ ID NO: 1981971 - protein, 9 aa, Staphylococcus
SAPSTPEMA

SEQ ID NO: 1981972 - protein, 7 aa, Staphylococcus
SAPTEED

SEQ ID NO: 1981973 - protein, 6 aa, Staphylococcus
SAPTIQ

SEQ ID NO: 1981974 - protein, 6 aa, Staphylococcus
SAPVES

SEQ ID NO: 1981975 - protein, 6 aa, Staphylococcus
SAPVGP

SEQ ID NO: 1981976 - protein, 8 aa, Staphylococcus
SAPVTEAT

SEQ ID NO: 1981977 - protein, 12 aa, Staphylococcus
SAPVTEATIGKK

SEQ ID NO: 1981978 - protein, 12 aa, Staphylococcus
SAPVTEATLGKK

SEQ ID NO: 1981979 - protein, 11 aa, Staphylococcus
SAPVTQATIGR

SEQ ID NO: 1981980 - protein, 4 aa, Staphylococcus
SAPY

SEQ ID NO: 1981981 - protein, 12 aa, Staphylococcus
SAPYDDERQQDD

SEQ ID NO: 1981982 - protein, 9 aa, Staphylococcus
SAPYEAPDH

SEQ ID NO: 1981983 - protein, 13 aa, Staphylococcus
SAPYEAPKHPEIT

SEQ ID NO: 1981984 - protein, 5 aa, Staphylococcus
SAPYW

SEQ ID NO: 1981985 - protein, 10 aa, Staphylococcus
SAQDKMNTVD

SEQ ID NO: 1981986 - protein, 6 aa, Staphylococcus
SAQELG

SEQ ID NO: 1981987 - protein, 5 aa, Staphylococcus
SAQFE

SEQ ID NO: 1981988 - protein, 7 aa, Staphylococcus
SAQIEAG

SEQ ID NO: 1981989 - protein, 5 aa, Staphylococcus
SAQKM

SEQ ID NO: 1981990 - protein, 7 aa, Staphylococcus
SAQLTDA

SEQ ID NO: 1981991 - protein, 4 aa, Staphylococcus
SAQM

SEQ ID NO: 1981992 - protein, 9 aa, Staphylococcus
SAQPQLTKK

SEQ ID NO: 1981993 - protein, 7 aa, Staphylococcus
SAQTEKL

SEQ ID NO: 1981994 - protein, 6 aa, Staphylococcus
SAQYDA

SEQ ID NO: 1981995 - protein, 7 aa, Staphylococcus
SAQYSKN

SEQ ID NO: 1981996 - protein, 4 aa, Staphylococcus
SARE

SEQ ID NO: 1981997 - protein, 14 aa, Staphylococcus
SARRQPEETAENIK

SEQ ID NO: 1981998 - protein, 15 aa, Staphylococcus
SARRQPEETQEDVNG

SEQ ID NO: 1981999 - protein, 14 aa, Staphylococcus
SARRQPEETREDIK

SEQ ID NO: 1982000 - protein, 10 aa, Staphylococcus
SARSAGKKID

SEQ ID NO: 1982001 - protein, 10 aa, Staphylococcus
SARTKPRQLE

SEQ ID NO: 1982002 - protein, 7 aa, Staphylococcus
SASDQDI

SEQ ID NO: 1982003 - protein, 6 aa, Staphylococcus
SASDTS

SEQ ID NO: 1982004 - protein, 16 aa, Staphylococcus
SASEFQKGERKNVEGK

SEQ ID NO: 1982005 - protein, 5 aa, Staphylococcus
SASEK

SEQ ID NO: 1982006 - protein, 8 aa, Staphylococcus
SASEKEFV

SEQ ID NO: 1982007 - protein, 50 aa, Staphylococcus
SASENNSETNIKEKQEHIKNDDDSDESIDSKKDNNNLKYEDSSKPLNNGR

SEQ ID NO: 1982008 - protein, 8 aa, Staphylococcus
SASENTLN

SEQ ID NO: 1982009 - protein, 8 aa, Staphylococcus
SASEYTRD

SEQ ID NO: 1982010 - protein, 10 aa, Staphylococcus
SASFAQKVEE

SEQ ID NO: 1982011 - protein, 6 aa, Staphylococcus
SASFYR

SEQ ID NO: 1982012 - protein, 6 aa, Staphylococcus
SASGIG

SEQ ID NO: 1982013 - protein, 8 aa, Staphylococcus
SASGNTDG

SEQ ID NO: 1982014 - protein, 8 aa, Staphylococcus
SASGRTPY

SEQ ID NO: 1982015 - protein, 4 aa, Staphylococcus
SASI

SEQ ID NO: 1982016 - protein, 8 aa, Staphylococcus
SASISQME

SEQ ID NO: 1982017 - protein, 10 aa, Staphylococcus
SASKSEMQNQ

SEQ ID NO: 1982018 - protein, 10 aa, Staphylococcus
SASKSPEEIK

SEQ ID NO: 1982019 - protein, 9 aa, Staphylococcus
SASKSPKEI

SEQ ID NO: 1982020 - protein, 7 aa, Staphylococcus
SASKYEI

SEQ ID NO: 1982021 - protein, 7 aa, Staphylococcus
SASLPYR

SEQ ID NO: 1982022 - protein, 11 aa, Staphylococcus
SASMAQQTGGY

SEQ ID NO: 1982023 - protein, 7 aa, Staphylococcus
SASNTKS

SEQ ID NO: 1982024 - protein, 5 aa, Staphylococcus
SASNV

SEQ ID NO: 1982025 - protein, 7 aa, Staphylococcus
SASPDGK

SEQ ID NO: 1982026 - protein, 12 aa, Staphylococcus
SASQAGDDAELA

SEQ ID NO: 1982027 - protein, 11 aa, Staphylococcus
SASQIAQKPFS

SEQ ID NO: 1982028 - protein, 11 aa, Staphylococcus
SASQNKTKGRY

SEQ ID NO: 1982029 - protein, 11 aa, Staphylococcus
SASSGAKGGYQ

SEQ ID NO: 1982030 - protein, 7 aa, Staphylococcus
SASSPSF

SEQ ID NO: 1982031 - protein, 13 aa, Staphylococcus
SASSQAGQVGNPG

SEQ ID NO: 1982032 - protein, 13 aa, Staphylococcus
SASSQNIGHTPER

SEQ ID NO: 1982033 - protein, 17 aa, Staphylococcus
SASSQNVGHAPEQVTEA

SEQ ID NO: 1982034 - protein, 20 aa, Staphylococcus
SASSQNVGHAPKKVSDAIKA

SEQ ID NO: 1982035 - protein, 22 aa, Staphylococcus
SASSQNVGHAPKKVTDAIKKQA

SEQ ID NO: 1982036 - protein, 20 aa, Staphylococcus
SASSQNVGHAPKKVTEAIKK

SEQ ID NO: 1982037 - protein, 22 aa, Staphylococcus
SASSQNVGHAPKPVTEAIKKQA

SEQ ID NO: 1982038 - protein, 20 aa, Staphylococcus
SASSQNVGHAPKQVTEAIKK

SEQ ID NO: 1982039 - protein, 7 aa, Staphylococcus
SASTIRR

SEQ ID NO: 1982040 - protein, 7 aa, Staphylococcus
SASTYSP

SEQ ID NO: 1982041 - protein, 33 aa, Staphylococcus
SASVEGFTDDDAQNANNSDKKSQTTKNAIENEF

SEQ ID NO: 1982042 - protein, 13 aa, Staphylococcus
SASVNGEYELTGG

SEQ ID NO: 1982043 - protein, 7 aa, Staphylococcus
SASYELQ

SEQ ID NO: 1982044 - protein, 7 aa, Staphylococcus
SASYQQD

SEQ ID NO: 1982045 - protein, 19 aa, Staphylococcus
SASYRSDEALYSERTDEKI

SEQ ID NO: 1982046 - protein, 9 aa, Staphylococcus
SATAPNPFG

SEQ ID NO: 1982047 - protein, 7 aa, Staphylococcus
SATEKEL

SEQ ID NO: 1982048 - protein, 7 aa, Staphylococcus
SATENAT

SEQ ID NO: 1982049 - protein, 14 aa, Staphylococcus
SATGCKESLGFDQN

SEQ ID NO: 1982050 - protein, 8 aa, Staphylococcus
SATGCKQS

SEQ ID NO: 1982051 - protein, 15 aa, Staphylococcus
SATGETPTLIHTVIT

SEQ ID NO: 1982052 - protein, 7 aa, Staphylococcus
SATGFDK

SEQ ID NO: 1982053 - protein, 8 aa, Staphylococcus
SATGGATF

SEQ ID NO: 1982054 - protein, 12 aa, Staphylococcus
SATIPTTSQPAI

SEQ ID NO: 1982055 - protein, 5 aa, Staphylococcus
SATKG

SEQ ID NO: 1982056 - protein, 6 aa, Staphylococcus
SATKGA

SEQ ID NO: 1982057 - protein, 11 aa, Staphylococcus
SATKKSERSLG

SEQ ID NO: 1982058 - protein, 5 aa, Staphylococcus
SATKV

SEQ ID NO: 1982059 - protein, 7 aa, Staphylococcus
SATLPTD

SEQ ID NO: 1982060 - protein, 6 aa, Staphylococcus
SATLSE

SEQ ID NO: 1982061 - protein, 6 aa, Staphylococcus
SATLYG

SEQ ID NO: 1982062 - protein, 4 aa, Staphylococcus
SATM

SEQ ID NO: 1982063 - protein, 23 aa, Staphylococcus
SATNGELSQASYKDLEEKTGMPL

SEQ ID NO: 1982064 - protein, 9 aa, Staphylococcus
SATPGRDNH

SEQ ID NO: 1982065 - protein, 8 aa, Staphylococcus
SATPPFSI

SEQ ID NO: 1982066 - protein, 8 aa, Staphylococcus
SATPSLES

SEQ ID NO: 1982067 - protein, 15 aa, Staphylococcus
SATPSLESYARTEKG

SEQ ID NO: 1982068 - protein, 15 aa, Staphylococcus
SATPSLETYARAEKD

SEQ ID NO: 1982069 - protein, 6 aa, Staphylococcus
SATQPE

SEQ ID NO: 1982070 - protein, 9 aa, Staphylococcus
SATQQPDKL

SEQ ID NO: 1982071 - protein, 4 aa, Staphylococcus
SATS

SEQ ID NO: 1982072 - protein, 6 aa, Staphylococcus
SATTEI

SEQ ID NO: 1982073 - protein, 5 aa, Staphylococcus
SATVN

SEQ ID NO: 1982074 - protein, 9 aa, Staphylococcus
SAVAKRAKG

SEQ ID NO: 1982075 - protein, 8 aa, Staphylococcus
SAVARRAK

SEQ ID NO: 1982076 - protein, 10 aa, Staphylococcus
SAVEDVPKSL

SEQ ID NO: 1982077 - protein, 9 aa, Staphylococcus
SAVEEAEAY

SEQ ID NO: 1982078 - protein, 13 aa, Staphylococcus
SAVEGTDLEAKSI

SEQ ID NO: 1982079 - protein, 10 aa, Staphylococcus
SAVGNGEKAI

SEQ ID NO: 1982080 - protein, 17 aa, Staphylococcus
SAVNGDANASIPTSEPM

SEQ ID NO: 1982081 - protein, 6 aa, Staphylococcus
SAVNHP

SEQ ID NO: 1982082 - protein, 8 aa, Staphylococcus
SAVPPATG

SEQ ID NO: 1982083 - protein, 5 aa, Staphylococcus
SAVSP

SEQ ID NO: 1982084 - protein, 7 aa, Staphylococcus
SAVSRQI

SEQ ID NO: 1982085 - protein, 14 aa, Staphylococcus
SAVSSTQERASDTL

SEQ ID NO: 1982086 - protein, 8 aa, Staphylococcus
SAVTLGTS

SEQ ID NO: 1982087 - protein, 5 aa, Staphylococcus
SAYAP

SEQ ID NO: 1982088 - protein, 7 aa, Staphylococcus
SAYEDFK

SEQ ID NO: 1982089 - protein, 6 aa, Staphylococcus
SAYPRE

SEQ ID NO: 1982090 - protein, 6 aa, Staphylococcus
SAYSRQ

SEQ ID NO: 1982091 - protein, 14 aa, Staphylococcus
SCDDDQRIKDLKEK

SEQ ID NO: 1982092 - protein, 16 aa, Staphylococcus
SCDETSASVIKNGKEI

SEQ ID NO: 1982093 - protein, 4 aa, Staphylococcus
SCEN

SEQ ID NO: 1982094 - protein, 6 aa, Staphylococcus
SCFRED

SEQ ID NO: 1982095 - protein, 12 aa, Staphylococcus
SCGNDGQTDYAG

SEQ ID NO: 1982096 - protein, 8 aa, Staphylococcus
SCHNNNNE

SEQ ID NO: 1982097 - protein, 6 aa, Staphylococcus
SCNVND

SEQ ID NO: 1982098 - protein, 9 aa, Staphylococcus
SCPHRSSEL

SEQ ID NO: 1982099 - protein, 6 aa, Staphylococcus
SCRSQM

SEQ ID NO: 1982100 - protein, 6 aa, Staphylococcus
SCRTSA

SEQ ID NO: 1982101 - protein, 22 aa, Staphylococcus
SCSANKKVTQRRTLQDGSKEYY

SEQ ID NO: 1982102 - protein, 6 aa, Staphylococcus
SDAAGL

SEQ ID NO: 1982103 - protein, 13 aa, Staphylococcus
SDAAIDPLFELLN

SEQ ID NO: 1982104 - protein, 8 aa, Staphylococcus
SDAANAAN

SEQ ID NO: 1982105 - protein, 4 aa, Staphylococcus
SDAC

SEQ ID NO: 1982106 - protein, 5 aa, Staphylococcus
SDADM

SEQ ID NO: 1982107 - protein, 6 aa, Staphylococcus
SDAEAL

SEQ ID NO: 1982108 - protein, 9 aa, Staphylococcus
SDAEGEELT

SEQ ID NO: 1982109 - protein, 6 aa, Staphylococcus
SDAEIG

SEQ ID NO: 1982110 - protein, 11 aa, Staphylococcus
SDAEKYKAQAN

SEQ ID NO: 1982111 - protein, 6 aa, Staphylococcus
SDAEPE

SEQ ID NO: 1982112 - protein, 7 aa, Staphylococcus
SDAETLA

SEQ ID NO: 1982113 - protein, 5 aa, Staphylococcus
SDAEY

SEQ ID NO: 1982114 - protein, 6 aa, Staphylococcus
SDAEYT

SEQ ID NO: 1982115 - protein, 9 aa, Staphylococcus
SDAGNAANL

SEQ ID NO: 1982116 - protein, 7 aa, Staphylococcus
SDAHEDE

SEQ ID NO: 1982117 - protein, 4 aa, Staphylococcus
SDAI

SEQ ID NO: 1982118 - protein, 6 aa, Staphylococcus
SDAIET

SEQ ID NO: 1982119 - protein, 17 aa, Staphylococcus
SDAKHTLAGAKQLHGKQ

SEQ ID NO: 1982120 - protein, 8 aa, Staphylococcus
SDAKPETY

SEQ ID NO: 1982121 - protein, 10 aa, Staphylococcus
SDANKYHEQA

SEQ ID NO: 1982122 - protein, 7 aa, Staphylococcus
SDAPHQG

SEQ ID NO: 1982123 - protein, 9 aa, Staphylococcus
SDAPNTIAG

SEQ ID NO: 1982124 - protein, 5 aa, Staphylococcus
SDAPR

SEQ ID NO: 1982125 - protein, 9 aa, Staphylococcus
SDAPVPSQD

SEQ ID NO: 1982126 - protein, 5 aa, Staphylococcus
SDAQD

SEQ ID NO: 1982127 - protein, 29 aa, Staphylococcus
SDAQKESYTKEVEEAIDQARTGNNQPAVK

SEQ ID NO: 1982128 - protein, 10 aa, Staphylococcus
SDARKLGVSE

SEQ ID NO: 1982129 - protein, 13 aa, Staphylococcus
SDASATLKAGADI

SEQ ID NO: 1982130 - protein, 16 aa, Staphylococcus
SDASELQNKNENYIYS

SEQ ID NO: 1982131 - protein, 10 aa, Staphylococcus
SDASGDGNQI

SEQ ID NO: 1982132 - protein, 17 aa, Staphylococcus
SDATKQLNKEKINQKNL

SEQ ID NO: 1982133 - protein, 11 aa, Staphylococcus
SDATTALRAGA

SEQ ID NO: 1982134 - protein, 7 aa, Staphylococcus
SDATTSL

SEQ ID NO: 1982135 - protein, 6 aa, Staphylococcus
SDATTV

SEQ ID NO: 1982136 - protein, 7 aa, Staphylococcus
SDAYDDL

SEQ ID NO: 1982137 - protein, 12 aa, Staphylococcus
SDCPNIKNENER

SEQ ID NO: 1982138 - protein, 5 aa, Staphylococcus
SDDDA

SEQ ID NO: 1982139 - protein, 5 aa, Staphylococcus
SDDDF

SEQ ID NO: 1982140 - protein, 8 aa, Staphylococcus
SDDDIDKS

SEQ ID NO: 1982141 - protein, 10 aa, Staphylococcus
SDDEADGLAS

SEQ ID NO: 1982142 - protein, 9 aa, Staphylococcus
SDDEAYRSE

SEQ ID NO: 1982143 - protein, 8 aa, Staphylococcus
SDDEGANI

SEQ ID NO: 1982144 - protein, 6 aa, Staphylococcus
SDDEKH

SEQ ID NO: 1982145 - protein, 23 aa, Staphylococcus
SDDEQQLRDSADAVEDVKSALKN

SEQ ID NO: 1982146 - protein, 9 aa, Staphylococcus
SDDERAKHS

SEQ ID NO: 1982147 - protein, 4 aa, Staphylococcus
SDDF

SEQ ID NO: 1982148 - protein, 8 aa, Staphylococcus
SDDFSKNA

SEQ ID NO: 1982149 - protein, 13 aa, Staphylococcus
SDDGALSKELKEE

SEQ ID NO: 1982150 - protein, 5 aa, Staphylococcus
SDDGD

SEQ ID NO: 1982151 - protein, 5 aa, Staphylococcus
SDDGI

SEQ ID NO: 1982152 - protein, 9 aa, Staphylococcus
SDDGKRMTY

SEQ ID NO: 1982153 - protein, 11 aa, Staphylococcus
SDDHANEQFEE

SEQ ID NO: 1982154 - protein, 19 aa, Staphylococcus
SDDHDEDEGHNHAETENDP

SEQ ID NO: 1982155 - protein, 9 aa, Staphylococcus
SDDIEKTKA

SEQ ID NO: 1982156 - protein, 16 aa, Staphylococcus
SDDITRGEVEEKQFGL

SEQ ID NO: 1982157 - protein, 10 aa, Staphylococcus
SDDKREPLDL

SEQ ID NO: 1982158 - protein, 19 aa, Staphylococcus
SDDKRTFARETIEKDKEIN

SEQ ID NO: 1982159 - protein, 14 aa, Staphylococcus
SDDKTLKLKNSRHP

SEQ ID NO: 1982160 - protein, 7 aa, Staphylococcus
SDDMPDT

SEQ ID NO: 1982161 - protein, 6 aa, Staphylococcus
SDDNEK

SEQ ID NO: 1982162 - protein, 12 aa, Staphylococcus
SDDNKRANYDQF

SEQ ID NO: 1982163 - protein, 39 aa, Staphylococcus
SDDNKRANYDQFGHEGPQGGFGSQGFGGGDFGGFSGGGF

SEQ ID NO: 1982164 - protein, 36 aa, Staphylococcus
SDDNKRANYDQFGHSGAQGGFGSQGFGGQDFSGFGG

SEQ ID NO: 1982165 - protein, 36 aa, Staphylococcus
SDDNKRANYDQFGHSGPQGGFGNQGFGGQDFSGFGG

SEQ ID NO: 1982166 - protein, 6 aa, Staphylococcus
SDDNQH

SEQ ID NO: 1982167 - protein, 6 aa, Staphylococcus
SDDPKF

SEQ ID NO: 1982168 - protein, 10 aa, Staphylococcus
SDDPTDGLEE

SEQ ID NO: 1982169 - protein, 7 aa, Staphylococcus
SDDPYKQ

SEQ ID NO: 1982170 - protein, 7 aa, Staphylococcus
SDDQATQ

SEQ ID NO: 1982171 - protein, 5 aa, Staphylococcus
SDDQR

SEQ ID NO: 1982172 - protein, 10 aa, Staphylococcus
SDDRELRQSA

SEQ ID NO: 1982173 - protein, 11 aa, Staphylococcus
SDDRELRQSAY

SEQ ID NO: 1982174 - protein, 8 aa, Staphylococcus
SDDRELRR

SEQ ID NO: 1982175 - protein, 9 aa, Staphylococcus
SDDRKLRES

SEQ ID NO: 1982176 - protein, 12 aa, Staphylococcus
SDDRKLRESAYK

SEQ ID NO: 1982177 - protein, 9 aa, Staphylococcus
SDDSLDDEV

SEQ ID NO: 1982178 - protein, 9 aa, Staphylococcus
SDDSYLRSE

SEQ ID NO: 1982179 - protein, 7 aa, Staphylococcus
SDDTATG

SEQ ID NO: 1982180 - protein, 8 aa, Staphylococcus
SDDTTVTV

SEQ ID NO: 1982181 - protein, 6 aa, Staphylococcus
SDDVYT

SEQ ID NO: 1982182 - protein, 9 aa, Staphylococcus
SDDYPSEGV

SEQ ID NO: 1982183 - protein, 10 aa, Staphylococcus
SDEAGSGDYF

SEQ ID NO: 1982184 - protein, 8 aa, Staphylococcus
SDEAKDTL

SEQ ID NO: 1982185 - protein, 8 aa, Staphylococcus
SDEAKERL

SEQ ID NO: 1982186 - protein, 7 aa, Staphylococcus
SDEANKA

SEQ ID NO: 1982187 - protein, 12 aa, Staphylococcus
SDEAQPEDFNRP

SEQ ID NO: 1982188 - protein, 20 aa, Staphylococcus
SDEASGITGQNLTVDGRLTM

SEQ ID NO: 1982189 - protein, 15 aa, Staphylococcus
SDEDAKIAAKEHGIE

SEQ ID NO: 1982190 - protein, 6 aa, Staphylococcus
SDEDAQ

SEQ ID NO: 1982191 - protein, 7 aa, Staphylococcus
SDEDFTN

SEQ ID NO: 1982192 - protein, 6 aa, Staphylococcus
SDEDKV

SEQ ID NO: 1982193 - protein, 9 aa, Staphylococcus
SDEDNEQLD

SEQ ID NO: 1982194 - protein, 7 aa, Staphylococcus
SDEDQRA

SEQ ID NO: 1982195 - protein, 6 aa, Staphylococcus
SDEDSD

SEQ ID NO: 1982196 - protein, 8 aa, Staphylococcus
SDEDVPTW

SEQ ID NO: 1982197 - protein, 9 aa, Staphylococcus
SDEEAIAAA

SEQ ID NO: 1982198 - protein, 9 aa, Staphylococcus
SDEEARELA

SEQ ID NO: 1982199 - protein, 6 aa, Staphylococcus
SDEEKL

SEQ ID NO: 1982200 - protein, 7 aa, Staphylococcus
SDEELKT

SEQ ID NO: 1982201 - protein, 8 aa, Staphylococcus
SDEEMKTN

SEQ ID NO: 1982202 - protein, 9 aa, Staphylococcus
SDEEMTSDD

SEQ ID NO: 1982203 - protein, 7 aa, Staphylococcus
SDEENHK

SEQ ID NO: 1982204 - protein, 7 aa, Staphylococcus
SDEERVN

SEQ ID NO: 1982205 - protein, 6 aa, Staphylococcus
SDEETA

SEQ ID NO: 1982206 - protein, 5 aa, Staphylococcus
SDEEW

SEQ ID NO: 1982207 - protein, 8 aa, Staphylococcus
SDEFDETK

SEQ ID NO: 1982208 - protein, 17 aa, Staphylococcus
SDEFKTNTYDIDSTDEI

SEQ ID NO: 1982209 - protein, 4 aa, Staphylococcus
SDEG

SEQ ID NO: 1982210 - protein, 6 aa, Staphylococcus
SDEGAD

SEQ ID NO: 1982211 - protein, 7 aa, Staphylococcus
SDEGEGI

SEQ ID NO: 1982212 - protein, 9 aa, Staphylococcus
SDEGGINKQ

SEQ ID NO: 1982213 - protein, 19 aa, Staphylococcus
SDEGGVNKQYTLEEGTNLE

SEQ ID NO: 1982214 - protein, 6 aa, Staphylococcus
SDEGIQ

SEQ ID NO: 1982215 - protein, 8 aa, Staphylococcus
SDEGKDTL

SEQ ID NO: 1982216 - protein, 24 aa, Staphylococcus
SDEGNSGVSPGKPWKNGPVPEDKA

SEQ ID NO: 1982217 - protein, 24 aa, Staphylococcus
SDEGNTGVAPGKPWKNGPVPEDKA

SEQ ID NO: 1982218 - protein, 7 aa, Staphylococcus
SDEGSQF

SEQ ID NO: 1982219 - protein, 6 aa, Staphylococcus
SDEHKA

SEQ ID NO: 1982220 - protein, 21 aa, Staphylococcus
SDEHNKGVAPGKPWKNGPVPM

SEQ ID NO: 1982221 - protein, 8 aa, Staphylococcus
SDEIDDPL

SEQ ID NO: 1982222 - protein, 10 aa, Staphylococcus
SDEIDNDDTI

SEQ ID NO: 1982223 - protein, 15 aa, Staphylococcus
SDEIGKARIDEKTVN

SEQ ID NO: 1982224 - protein, 11 aa, Staphylococcus
SDEIKKGDLYA

SEQ ID NO: 1982225 - protein, 5 aa, Staphylococcus
SDEIY

SEQ ID NO: 1982226 - protein, 4 aa, Staphylococcus
SDEK

SEQ ID NO: 1982227 - protein, 6 aa, Staphylococcus
SDEKIN

SEQ ID NO: 1982228 - protein, 6 aa, Staphylococcus
SDELQQ

SEQ ID NO: 1982229 - protein, 16 aa, Staphylococcus
SDELTNELERSPSISE

SEQ ID NO: 1982230 - protein, 7 aa, Staphylococcus
SDEMKSY

SEQ ID NO: 1982231 - protein, 9 aa, Staphylococcus
SDEMTGEKA

SEQ ID NO: 1982232 - protein, 6 aa, Staphylococcus
SDENAH

SEQ ID NO: 1982233 - protein, 36 aa, Staphylococcus
SDENKRANYDQFGHDGPQGGFGGQGFGGGQDFGGFG

SEQ ID NO: 1982234 - protein, 39 aa, Staphylococcus
SDENKRANYDQFGHDGPQGGFGGQGFGGQDFSGFGGGGF

SEQ ID NO: 1982235 - protein, 9 aa, Staphylococcus
SDENRVNEY

SEQ ID NO: 1982236 - protein, 18 aa, Staphylococcus
SDENTDNNDDTEKVDSDD

SEQ ID NO: 1982237 - protein, 10 aa, Staphylococcus
SDENTIKKEQ

SEQ ID NO: 1982238 - protein, 4 aa, Staphylococcus
SDEQ

SEQ ID NO: 1982239 - protein, 12 aa, Staphylococcus
SDEQHDEKLEEI

SEQ ID NO: 1982240 - protein, 8 aa, Staphylococcus
SDEQIKEV

SEQ ID NO: 1982241 - protein, 8 aa, Staphylococcus
SDEQTSKL

SEQ ID NO: 1982242 - protein, 7 aa, Staphylococcus
SDEQVDK

SEQ ID NO: 1982243 - protein, 10 aa, Staphylococcus
SDERLQGEFS

SEQ ID NO: 1982244 - protein, 8 aa, Staphylococcus
SDERLTKP

SEQ ID NO: 1982245 - protein, 5 aa, Staphylococcus
SDESE

SEQ ID NO: 1982246 - protein, 7 aa, Staphylococcus
SDESQID

SEQ ID NO: 1982247 - protein, 7 aa, Staphylococcus
SDESQLD

SEQ ID NO: 1982248 - protein, 7 aa, Staphylococcus
SDESQLE

SEQ ID NO: 1982249 - protein, 9 aa, Staphylococcus
SDESRGSSG

SEQ ID NO: 1982250 - protein, 4 aa, Staphylococcus
SDET

SEQ ID NO: 1982251 - protein, 14 aa, Staphylococcus
SDETDKEGSVEPGV

SEQ ID NO: 1982252 - protein, 7 aa, Staphylococcus
SDETIND

SEQ ID NO: 1982253 - protein, 12 aa, Staphylococcus
SDETLEQSIGKE

SEQ ID NO: 1982254 - protein, 15 aa, Staphylococcus
SDEVAEAAKELGIDG

SEQ ID NO: 1982255 - protein, 15 aa, Staphylococcus
SDEVAEAAKELGIEG

SEQ ID NO: 1982256 - protein, 9 aa, Staphylococcus
SDEVAEAAR

SEQ ID NO: 1982257 - protein, 14 aa, Staphylococcus
SDEVAEAARELGID

SEQ ID NO: 1982258 - protein, 15 aa, Staphylococcus
SDEVAESAKELGIEG

SEQ ID NO: 1982259 - protein, 15 aa, Staphylococcus
SDEVAETAKELGIDS

SEQ ID NO: 1982260 - protein, 14 aa, Staphylococcus
SDEVGKANIDEATV

SEQ ID NO: 1982261 - protein, 13 aa, Staphylococcus
SDEVRKKLEEYQQ

SEQ ID NO: 1982262 - protein, 9 aa, Staphylococcus
SDEVTGQKA

SEQ ID NO: 1982263 - protein, 18 aa, Staphylococcus
SDEVTKGEAVKKAIRNGV

SEQ ID NO: 1982264 - protein, 14 aa, Staphylococcus
SDFDNYSVGNTDDG

SEQ ID NO: 1982265 - protein, 15 aa, Staphylococcus
SDFGGGGHPNASGVS

SEQ ID NO: 1982266 - protein, 6 aa, Staphylococcus
SDFGPM

SEQ ID NO: 1982267 - protein, 4 aa, Staphylococcus
SDFK

SEQ ID NO: 1982268 - protein, 9 aa, Staphylococcus
SDFKSPNTE

SEQ ID NO: 1982269 - protein, 7 aa, Staphylococcus
SDFNRPI

SEQ ID NO: 1982270 - protein, 4 aa, Staphylococcus
SDFP

SEQ ID NO: 1982271 - protein, 8 aa, Staphylococcus
SDFPIPNT

SEQ ID NO: 1982272 - protein, 6 aa, Staphylococcus
SDGDGI

SEQ ID NO: 1982273 - protein, 6 aa, Staphylococcus
SDGDND

SEQ ID NO: 1982274 - protein, 4 aa, Staphylococcus
SDGE

SEQ ID NO: 1982275 - protein, 5 aa, Staphylococcus
SDGEI

SEQ ID NO: 1982276 - protein, 14 aa, Staphylococcus
SDGEITKEEALNQN

SEQ ID NO: 1982277 - protein, 13 aa, Staphylococcus
SDGEMFDTKPRGL

SEQ ID NO: 1982278 - protein, 6 aa, Staphylococcus
SDGEYH

SEQ ID NO: 1982279 - protein, 7 aa, Staphylococcus
SDGGFAE

SEQ ID NO: 1982280 - protein, 14 aa, Staphylococcus
SDGINTKAGSLTAN

SEQ ID NO: 1982281 - protein, 12 aa, Staphylococcus
SDGKDYKLEKYK

SEQ ID NO: 1982282 - protein, 16 aa, Staphylococcus
SDGKIVSSYEETYQHG

SEQ ID NO: 1982283 - protein, 13 aa, Staphylococcus
SDGKKFGKTEGGA

SEQ ID NO: 1982284 - protein, 18 aa, Staphylococcus
SDGKSQKRVGGIGAGGGM

SEQ ID NO: 1982285 - protein, 9 aa, Staphylococcus
SDGKVESGL

SEQ ID NO: 1982286 - protein, 11 aa, Staphylococcus
SDGKVKPAELI

SEQ ID NO: 1982287 - protein, 4 aa, Staphylococcus
SDGL

SEQ ID NO: 1982288 - protein, 7 aa, Staphylococcus
SDGLTDK

SEQ ID NO: 1982289 - protein, 15 aa, Staphylococcus
SDGLTYEQRASTSAL

SEQ ID NO: 1982290 - protein, 9 aa, Staphylococcus
SDGMTQVDD

SEQ ID NO: 1982291 - protein, 11 aa, Staphylococcus
SDGPNSGYKSI

SEQ ID NO: 1982292 - protein, 10 aa, Staphylococcus
SDGPRTAQTR

SEQ ID NO: 1982293 - protein, 34 aa, Staphylococcus
SDGQNGKDGQNGMNGKSITAETRPGTDADGNTGA

SEQ ID NO: 1982294 - protein, 16 aa, Staphylococcus
SDGQQGELSKKAEAYI

SEQ ID NO: 1982295 - protein, 15 aa, Staphylococcus
SDGQYKYKDAQKNDH

SEQ ID NO: 1982296 - protein, 6 aa, Staphylococcus
SDGRMN

SEQ ID NO: 1982297 - protein, 5 aa, Staphylococcus
SDGRQ

SEQ ID NO: 1982298 - protein, 14 aa, Staphylococcus
SDGSEYTGAYDLSK

SEQ ID NO: 1982299 - protein, 8 aa, Staphylococcus
SDGSYTYF

SEQ ID NO: 1982300 - protein, 10 aa, Staphylococcus
SDGTDKSSQE

SEQ ID NO: 1982301 - protein, 18 aa, Staphylococcus
SDGTDNPDFNPNKPQYKG

SEQ ID NO: 1982302 - protein, 18 aa, Staphylococcus
SDGTIKDGRPRIDTARRA

SEQ ID NO: 1982303 - protein, 4 aa, Staphylococcus
SDGV

SEQ ID NO: 1982304 - protein, 6 aa, Staphylococcus
SDGVRQ

SEQ ID NO: 1982305 - protein, 9 aa, Staphylococcus
SDGYPNHGN

SEQ ID NO: 1982306 - protein, 6 aa, Staphylococcus
SDGYYT

SEQ ID NO: 1982307 - protein, 6 aa, Staphylococcus
SDHEVT

SEQ ID NO: 1982308 - protein, 4 aa, Staphylococcus
SDHP

SEQ ID NO: 1982309 - protein, 6 aa, Staphylococcus
SDHTYD

SEQ ID NO: 1982310 - protein, 7 aa, Staphylococcus
SDHYTEN

SEQ ID NO: 1982311 - protein, 6 aa, Staphylococcus
SDIAGE

SEQ ID NO: 1982312 - protein, 12 aa, Staphylococcus
SDIDATGDVETG

SEQ ID NO: 1982313 - protein, 10 aa, Staphylococcus
SDIDDKDRET

SEQ ID NO: 1982314 - protein, 8 aa, Staphylococcus
SDIDEQTG

SEQ ID NO: 1982315 - protein, 8 aa, Staphylococcus
SDIDERTG

SEQ ID NO: 1982316 - protein, 8 aa, Staphylococcus
SDIDETTG

SEQ ID NO: 1982317 - protein, 6 aa, Staphylococcus
SDIDKN

SEQ ID NO: 1982318 - protein, 8 aa, Staphylococcus
SDIEGNVN

SEQ ID NO: 1982319 - protein, 10 aa, Staphylococcus
SDIEKRLNQK

SEQ ID NO: 1982320 - protein, 9 aa, Staphylococcus
SDIEKTDDG

SEQ ID NO: 1982321 - protein, 5 aa, Staphylococcus
SDIEP

SEQ ID NO: 1982322 - protein, 5 aa, Staphylococcus
SDIEQ

SEQ ID NO: 1982323 - protein, 7 aa, Staphylococcus
SDIKGKT

SEQ ID NO: 1982324 - protein, 9 aa, Staphylococcus
SDIKSPNTE

SEQ ID NO: 1982325 - protein, 4 aa, Staphylococcus
SDIL

SEQ ID NO: 1982326 - protein, 11 aa, Staphylococcus
SDILGGKNAGI

SEQ ID NO: 1982327 - protein, 11 aa, Staphylococcus
SDILGGKNANI

SEQ ID NO: 1982328 - protein, 6 aa, Staphylococcus
SDINDE

SEQ ID NO: 1982329 - protein, 27 aa, Staphylococcus
SDINEAEKQSTTTKKELKNAEQQLNEY

SEQ ID NO: 1982330 - protein, 4 aa, Staphylococcus
SDIP

SEQ ID NO: 1982331 - protein, 10 aa, Staphylococcus
SDIPDKAKNK

SEQ ID NO: 1982332 - protein, 6 aa, Staphylococcus
SDIPNK

SEQ ID NO: 1982333 - protein, 4 aa, Staphylococcus
SDIQ

SEQ ID NO: 1982334 - protein, 12 aa, Staphylococcus
SDIQAEGDVETG

SEQ ID NO: 1982335 - protein, 11 aa, Staphylococcus
SDIRKGNIGQI

SEQ ID NO: 1982336 - protein, 13 aa, Staphylococcus
SDIRQGKVGQIPD

SEQ ID NO: 1982337 - protein, 7 aa, Staphylococcus
SDISEAL

SEQ ID NO: 1982338 - protein, 5 aa, Staphylococcus
SDISQ

SEQ ID NO: 1982339 - protein, 11 aa, Staphylococcus
SDISYDENGIS

SEQ ID NO: 1982340 - protein, 5 aa, Staphylococcus
SDITK

SEQ ID NO: 1982341 - protein, 5 aa, Staphylococcus
SDITP

SEQ ID NO: 1982342 - protein, 7 aa, Staphylococcus
SDITYNK

SEQ ID NO: 1982343 - protein, 7 aa, Staphylococcus
SDITYSE

SEQ ID NO: 1982344 - protein, 8 aa, Staphylococcus
SDKDKDEM

SEQ ID NO: 1982345 - protein, 21 aa, Staphylococcus
SDKDLSRLARRGSGSASRSIY

SEQ ID NO: 1982346 - protein, 9 aa, Staphylococcus
SDKEDAPIY

SEQ ID NO: 1982347 - protein, 8 aa, Staphylococcus
SDKEGGRL

SEQ ID NO: 1982348 - protein, 8 aa, Staphylococcus
SDKEIDDT

SEQ ID NO: 1982349 - protein, 11 aa, Staphylococcus
SDKEKEQAQNE

SEQ ID NO: 1982350 - protein, 6 aa, Staphylococcus
SDKEKL

SEQ ID NO: 1982351 - protein, 10 aa, Staphylococcus
SDKEKTDDLS

SEQ ID NO: 1982352 - protein, 7 aa, Staphylococcus
SDKESRE

SEQ ID NO: 1982353 - protein, 16 aa, Staphylococcus
SDKEVTKRQARAHSSI

SEQ ID NO: 1982354 - protein, 5 aa, Staphylococcus
SDKEY

SEQ ID NO: 1982355 - protein, 6 aa, Staphylococcus
SDKEYD

SEQ ID NO: 1982356 - protein, 10 aa, Staphylococcus
SDKEYETTKR

SEQ ID NO: 1982357 - protein, 6 aa, Staphylococcus
SDKFAN

SEQ ID NO: 1982358 - protein, 10 aa, Staphylococcus
SDKHDDSLQE

SEQ ID NO: 1982359 - protein, 9 aa, Staphylococcus
SDKHQHGEQ

SEQ ID NO: 1982360 - protein, 5 aa, Staphylococcus
SDKHY

SEQ ID NO: 1982361 - protein, 8 aa, Staphylococcus
SDKKAFTA

SEQ ID NO: 1982362 - protein, 6 aa, Staphylococcus
SDKKEV

SEQ ID NO: 1982363 - protein, 6 aa, Staphylococcus
SDKLGN

SEQ ID NO: 1982364 - protein, 8 aa, Staphylococcus
SDKMPYRA

SEQ ID NO: 1982365 - protein, 8 aa, Staphylococcus
SDKMTAEL

SEQ ID NO: 1982366 - protein, 9 aa, Staphylococcus
SDKNENALR

SEQ ID NO: 1982367 - protein, 18 aa, Staphylococcus
SDKPEKVKDEIKKKTKLA

SEQ ID NO: 1982368 - protein, 13 aa, Staphylococcus
SDKPSSGKSTVSA

SEQ ID NO: 1982369 - protein, 4 aa, Staphylococcus
SDKQ

SEQ ID NO: 1982370 - protein, 10 aa, Staphylococcus
SDKQQESGAI

SEQ ID NO: 1982371 - protein, 16 aa, Staphylococcus
SDKSQAKILVELNGDQ

SEQ ID NO: 1982372 - protein, 6 aa, Staphylococcus
SDKTIR

SEQ ID NO: 1982373 - protein, 4 aa, Staphylococcus
SDKV

SEQ ID NO: 1982374 - protein, 6 aa, Staphylococcus
SDKVNP

SEQ ID NO: 1982375 - protein, 9 aa, Staphylococcus
SDKVSQNNH

SEQ ID NO: 1982376 - protein, 7 aa, Staphylococcus
SDKYMTK

SEQ ID NO: 1982377 - protein, 18 aa, Staphylococcus
SDKYPTELSGGQIQRTSA

SEQ ID NO: 1982378 - protein, 9 aa, Staphylococcus
SDLAQEISQ

SEQ ID NO: 1982379 - protein, 8 aa, Staphylococcus
SDLDDRVK

SEQ ID NO: 1982380 - protein, 8 aa, Staphylococcus
SDLDEGPI

SEQ ID NO: 1982381 - protein, 4 aa, Staphylococcus
SDLG

SEQ ID NO: 1982382 - protein, 6 aa, Staphylococcus
SDLGRE

SEQ ID NO: 1982383 - protein, 11 aa, Staphylococcus
SDLGRKSNETH

SEQ ID NO: 1982384 - protein, 24 aa, Staphylococcus
SDLKEAMDDTAAHKGWKKTYLQYH

SEQ ID NO: 1982385 - protein, 7 aa, Staphylococcus
SDLKEGA

SEQ ID NO: 1982386 - protein, 8 aa, Staphylococcus
SDLKSSLP

SEQ ID NO: 1982387 - protein, 8 aa, Staphylococcus
SDLNAEDV

SEQ ID NO: 1982388 - protein, 7 aa, Staphylococcus
SDLNEQK

SEQ ID NO: 1982389 - protein, 6 aa, Staphylococcus
SDLNNK

SEQ ID NO: 1982390 - protein, 6 aa, Staphylococcus
SDLNPV

SEQ ID NO: 1982391 - protein, 7 aa, Staphylococcus
SDLPQSY

SEQ ID NO: 1982392 - protein, 8 aa, Staphylococcus
SDLPVAEE

SEQ ID NO: 1982393 - protein, 6 aa, Staphylococcus
SDLREG

SEQ ID NO: 1982394 - protein, 5 aa, Staphylococcus
SDLRY

SEQ ID NO: 1982395 - protein, 6 aa, Staphylococcus
SDLSAE

SEQ ID NO: 1982396 - protein, 5 aa, Staphylococcus
SDLSI

SEQ ID NO: 1982397 - protein, 9 aa, Staphylococcus
SDLSINNEE

SEQ ID NO: 1982398 - protein, 8 aa, Staphylococcus
SDLSKTKD

SEQ ID NO: 1982399 - protein, 8 aa, Staphylococcus
SDLSKTKE

SEQ ID NO: 1982400 - protein, 8 aa, Staphylococcus
SDLSKTNK

SEQ ID NO: 1982401 - protein, 7 aa, Staphylococcus
SDLSKTQ

SEQ ID NO: 1982402 - protein, 9 aa, Staphylococcus
SDLSTKTGE

SEQ ID NO: 1982403 - protein, 4 aa, Staphylococcus
SDLT

SEQ ID NO: 1982404 - protein, 12 aa, Staphylococcus
SDLTDEERQDID

SEQ ID NO: 1982405 - protein, 21 aa, Staphylococcus
SDLTEDAKKIMQQDNNPQWDE

SEQ ID NO: 1982406 - protein, 5 aa, Staphylococcus
SDLTI

SEQ ID NO: 1982407 - protein, 6 aa, Staphylococcus
SDLTTA

SEQ ID NO: 1982408 - protein, 7 aa, Staphylococcus
SDMDPDE

SEQ ID NO: 1982409 - protein, 7 aa, Staphylococcus
SDMGGDY

SEQ ID NO: 1982410 - protein, 5 aa, Staphylococcus
SDMSE

SEQ ID NO: 1982411 - protein, 5 aa, Staphylococcus
SDNAV

SEQ ID NO: 1982412 - protein, 6 aa, Staphylococcus
SDNDED

SEQ ID NO: 1982413 - protein, 9 aa, Staphylococcus
SDNDKPIPT

SEQ ID NO: 1982414 - protein, 9 aa, Staphylococcus
SDNEEIELG

SEQ ID NO: 1982415 - protein, 13 aa, Staphylococcus
SDNEKGRYQDENG

SEQ ID NO: 1982416 - protein, 8 aa, Staphylococcus
SDNEQAQL

SEQ ID NO: 1982417 - protein, 17 aa, Staphylococcus
SDNETQTFDISKGLGVV

SEQ ID NO: 1982418 - protein, 5 aa, Staphylococcus
SDNEY

SEQ ID NO: 1982419 - protein, 8 aa, Staphylococcus
SDNGDPHM

SEQ ID NO: 1982420 - protein, 5 aa, Staphylococcus
SDNID

SEQ ID NO: 1982421 - protein, 10 aa, Staphylococcus
SDNIPATKEE

SEQ ID NO: 1982422 - protein, 7 aa, Staphylococcus
SDNITDG

SEQ ID NO: 1982423 - protein, 4 aa, Staphylococcus
SDNK

SEQ ID NO: 1982424 - protein, 6 aa, Staphylococcus
SDNKEK

SEQ ID NO: 1982425 - protein, 8 aa, Staphylococcus
SDNLPGTK

SEQ ID NO: 1982426 - protein, 8 aa, Staphylococcus
SDNNDGYV

SEQ ID NO: 1982427 - protein, 13 aa, Staphylococcus
SDNNGIKNPFETV

SEQ ID NO: 1982428 - protein, 10 aa, Staphylococcus
SDNNKATDEF

SEQ ID NO: 1982429 - protein, 11 aa, Staphylococcus
SDNNQESGEIA

SEQ ID NO: 1982430 - protein, 7 aa, Staphylococcus
SDNNTAY

SEQ ID NO: 1982431 - protein, 6 aa, Staphylococcus
SDNPII

SEQ ID NO: 1982432 - protein, 8 aa, Staphylococcus
SDNPKYRS

SEQ ID NO: 1982433 - protein, 12 aa, Staphylococcus
SDNQAEQYKKDV

SEQ ID NO: 1982434 - protein, 5 aa, Staphylococcus
SDNQF

SEQ ID NO: 1982435 - protein, 11 aa, Staphylococcus
SDNQKGRYQDE

SEQ ID NO: 1982436 - protein, 12 aa, Staphylococcus
SDNQKGRYQDEH

SEQ ID NO: 1982437 - protein, 12 aa, Staphylococcus
SDNQKGRYQDKN

SEQ ID NO: 1982438 - protein, 13 aa, Staphylococcus
SDNQKGRYQDQYG

SEQ ID NO: 1982439 - protein, 5 aa, Staphylococcus
SDNQN

SEQ ID NO: 1982440 - protein, 4 aa, Staphylococcus
SDNS

SEQ ID NO: 1982441 - protein, 4 aa, Staphylococcus
SDNT

SEQ ID NO: 1982442 - protein, 7 aa, Staphylococcus
SDNTASG

SEQ ID NO: 1982443 - protein, 6 aa, Staphylococcus
SDPDLL

SEQ ID NO: 1982444 - protein, 8 aa, Staphylococcus
SDPEGNGI

SEQ ID NO: 1982445 - protein, 6 aa, Staphylococcus
SDPEGT

SEQ ID NO: 1982446 - protein, 20 aa, Staphylococcus
SDPEKAGELADEKNNTEQQL

SEQ ID NO: 1982447 - protein, 9 aa, Staphylococcus
SDPEKVPEF

SEQ ID NO: 1982448 - protein, 5 aa, Staphylococcus
SDPES

SEQ ID NO: 1982449 - protein, 21 aa, Staphylococcus
SDPIHSPQSQTSTSSYNNNQS

SEQ ID NO: 1982450 - protein, 7 aa, Staphylococcus
SDPKTGA

SEQ ID NO: 1982451 - protein, 4 aa, Staphylococcus
SDPM

SEQ ID NO: 1982452 - protein, 8 aa, Staphylococcus
SDPQAAKQ

SEQ ID NO: 1982453 - protein, 7 aa, Staphylococcus
SDPVADG

SEQ ID NO: 1982454 - protein, 11 aa, Staphylococcus
SDPVADGPTIM

SEQ ID NO: 1982455 - protein, 6 aa, Staphylococcus
SDQAGL

SEQ ID NO: 1982456 - protein, 9 aa, Staphylococcus
SDQDFDKTE

SEQ ID NO: 1982457 - protein, 5 aa, Staphylococcus
SDQEL

SEQ ID NO: 1982458 - protein, 7 aa, Staphylococcus
SDQENSI

SEQ ID NO: 1982459 - protein, 8 aa, Staphylococcus
SDQGTGFN

SEQ ID NO: 1982460 - protein, 7 aa, Staphylococcus
SDQPNNL

SEQ ID NO: 1982461 - protein, 5 aa, Staphylococcus
SDQPT

SEQ ID NO: 1982462 - protein, 7 aa, Staphylococcus
SDQRITK

SEQ ID NO: 1982463 - protein, 6 aa, Staphylococcus
SDQSQL

SEQ ID NO: 1982464 - protein, 5 aa, Staphylococcus
SDQTY

SEQ ID NO: 1982465 - protein, 8 aa, Staphylococcus
SDQYETTN

SEQ ID NO: 1982466 - protein, 14 aa, Staphylococcus
SDRENSITAGPRGP

SEQ ID NO: 1982467 - protein, 18 aa, Staphylococcus
SDRGVGFKRGDDPKGTGL

SEQ ID NO: 1982468 - protein, 7 aa, Staphylococcus
SDRHKEI

SEQ ID NO: 1982469 - protein, 19 aa, Staphylococcus
SDRITVDERATQLSKDLKS

SEQ ID NO: 1982470 - protein, 6 aa, Staphylococcus
SDRLEQ

SEQ ID NO: 1982471 - protein, 9 aa, Staphylococcus
SDRPAIDKS

SEQ ID NO: 1982472 - protein, 10 aa, Staphylococcus
SDRPPKEISK

SEQ ID NO: 1982473 - protein, 9 aa, Staphylococcus
SDRPSEGWT

SEQ ID NO: 1982474 - protein, 6 aa, Staphylococcus
SDRRKV

SEQ ID NO: 1982475 - protein, 6 aa, Staphylococcus
SDRVEQ

SEQ ID NO: 1982476 - protein, 4 aa, Staphylococcus
SDRY

SEQ ID NO: 1982477 - protein, 7 aa, Staphylococcus
SDRYEDT

SEQ ID NO: 1982478 - protein, 7 aa, Staphylococcus
SDRYPSH

SEQ ID NO: 1982479 - protein, 4 aa, Staphylococcus
SDSD

SEQ ID NO: 1982480 - protein, 6 aa, Staphylococcus
SDSDEE

SEQ ID NO: 1982481 - protein, 10 aa, Staphylococcus
SDSEAQKQLN

SEQ ID NO: 1982482 - protein, 8 aa, Staphylococcus
SDSEDKLH

SEQ ID NO: 1982483 - protein, 6 aa, Staphylococcus
SDSEED

SEQ ID NO: 1982484 - protein, 9 aa, Staphylococcus
SDSEPVDES

SEQ ID NO: 1982485 - protein, 12 aa, Staphylococcus
SDSFGRAERINN

SEQ ID NO: 1982486 - protein, 8 aa, Staphylococcus
SDSIMQSK

SEQ ID NO: 1982487 - protein, 11 aa, Staphylococcus
SDSKGTIEPEV

SEQ ID NO: 1982488 - protein, 8 aa, Staphylococcus
SDSKNDFG

SEQ ID NO: 1982489 - protein, 8 aa, Staphylococcus
SDSKRDIL

SEQ ID NO: 1982490 - protein, 8 aa, Staphylococcus
SDSNETLH

SEQ ID NO: 1982491 - protein, 5 aa, Staphylococcus
SDSPL

SEQ ID NO: 1982492 - protein, 8 aa, Staphylococcus
SDSQAMDR

SEQ ID NO: 1982493 - protein, 5 aa, Staphylococcus
SDSQC

SEQ ID NO: 1982494 - protein, 8 aa, Staphylococcus
SDSRDLNK

SEQ ID NO: 1982495 - protein, 8 aa, Staphylococcus
SDSRLSRS

SEQ ID NO: 1982496 - protein, 4 aa, Staphylococcus
SDSS

SEQ ID NO: 1982497 - protein, 8 aa, Staphylococcus
SDSSAINL

SEQ ID NO: 1982498 - protein, 8 aa, Staphylococcus
SDSSGLKP

SEQ ID NO: 1982499 - protein, 11 aa, Staphylococcus
SDSSNDLGNID

SEQ ID NO: 1982500 - protein, 4 aa, Staphylococcus
SDSV

SEQ ID NO: 1982501 - protein, 9 aa, Staphylococcus
SDSVESAKR

SEQ ID NO: 1982502 - protein, 6 aa, Staphylococcus
SDTADV

SEQ ID NO: 1982503 - protein, 7 aa, Staphylococcus
SDTASDF

SEQ ID NO: 1982504 - protein, 6 aa, Staphylococcus
SDTDAL

SEQ ID NO: 1982505 - protein, 5 aa, Staphylococcus
SDTDL

SEQ ID NO: 1982506 - protein, 9 aa, Staphylococcus
SDTEAEEQV

SEQ ID NO: 1982507 - protein, 5 aa, Staphylococcus
SDTED

SEQ ID NO: 1982508 - protein, 5 aa, Staphylococcus
SDTEI

SEQ ID NO: 1982509 - protein, 6 aa, Staphylococcus
SDTEKA

SEQ ID NO: 1982510 - protein, 6 aa, Staphylococcus
SDTEQL

SEQ ID NO: 1982511 - protein, 7 aa, Staphylococcus
SDTGEAT

SEQ ID NO: 1982512 - protein, 8 aa, Staphylococcus
SDTGSASV

SEQ ID NO: 1982513 - protein, 9 aa, Staphylococcus
SDTHAFEKG

SEQ ID NO: 1982514 - protein, 4 aa, Staphylococcus
SDTI

SEQ ID NO: 1982515 - protein, 10 aa, Staphylococcus
SDTKKGTEQF

SEQ ID NO: 1982516 - protein, 4 aa, Staphylococcus
SDTL

SEQ ID NO: 1982517 - protein, 7 aa, Staphylococcus
SDTLAES

SEQ ID NO: 1982518 - protein, 7 aa, Staphylococcus
SDTLEKR

SEQ ID NO: 1982519 - protein, 14 aa, Staphylococcus
SDTLENTSALNAEL

SEQ ID NO: 1982520 - protein, 6 aa, Staphylococcus
SDTLKS

SEQ ID NO: 1982521 - protein, 14 aa, Staphylococcus
SDTMAEKTDAELQK

SEQ ID NO: 1982522 - protein, 5 aa, Staphylococcus
SDTNR

SEQ ID NO: 1982523 - protein, 6 aa, Staphylococcus
SDTPEK

SEQ ID NO: 1982524 - protein, 7 aa, Staphylococcus
SDTPIKQ

SEQ ID NO: 1982525 - protein, 6 aa, Staphylococcus
SDTPQG

SEQ ID NO: 1982526 - protein, 10 aa, Staphylococcus
SDTPQSAEAL

SEQ ID NO: 1982527 - protein, 7 aa, Staphylococcus
SDTPSKV

SEQ ID NO: 1982528 - protein, 13 aa, Staphylococcus
SDTQLEQRSFQNE

SEQ ID NO: 1982529 - protein, 8 aa, Staphylococcus
SDTQLNHS

SEQ ID NO: 1982530 - protein, 6 aa, Staphylococcus
SDTQNL

SEQ ID NO: 1982531 - protein, 7 aa, Staphylococcus
SDTQSLE

SEQ ID NO: 1982532 - protein, 6 aa, Staphylococcus
SDTQYI

SEQ ID NO: 1982533 - protein, 14 aa, Staphylococcus
SDTRDKETDKGGQL

SEQ ID NO: 1982534 - protein, 14 aa, Staphylococcus
SDTRDKKSDKGGQL

SEQ ID NO: 1982535 - protein, 9 aa, Staphylococcus
SDTRKGVQQ

SEQ ID NO: 1982536 - protein, 14 aa, Staphylococcus
SDTRNKETDKGGQL

SEQ ID NO: 1982537 - protein, 5 aa, Staphylococcus
SDTSH

SEQ ID NO: 1982538 - protein, 4 aa, Staphylococcus
SDTV

SEQ ID NO: 1982539 - protein, 9 aa, Staphylococcus
SDTVNQQRQ

SEQ ID NO: 1982540 - protein, 7 aa, Staphylococcus
SDTWKTK

SEQ ID NO: 1982541 - protein, 17 aa, Staphylococcus
SDVDKYTDTPSYKRTNA

SEQ ID NO: 1982542 - protein, 18 aa, Staphylococcus
SDVDPYTDTPSYKRTSAR

SEQ ID NO: 1982543 - protein, 16 aa, Staphylococcus
SDVDQYTDTPSYKRTS

SEQ ID NO: 1982544 - protein, 9 aa, Staphylococcus
SDVEQRRGV

SEQ ID NO: 1982545 - protein, 9 aa, Staphylococcus
SDVGQSSFD

SEQ ID NO: 1982546 - protein, 6 aa, Staphylococcus
SDVPKA

SEQ ID NO: 1982547 - protein, 6 aa, Staphylococcus
SDVPTY

SEQ ID NO: 1982548 - protein, 8 aa, Staphylococcus
SDVQTGGN

SEQ ID NO: 1982549 - protein, 8 aa, Staphylococcus
SDVRKDGT

SEQ ID NO: 1982550 - protein, 4 aa, Staphylococcus
SDVS

SEQ ID NO: 1982551 - protein, 6 aa, Staphylococcus
SDVYDD

SEQ ID NO: 1982552 - protein, 6 aa, Staphylococcus
SDVYGT

SEQ ID NO: 1982553 - protein, 6 aa, Staphylococcus
SDWENE

SEQ ID NO: 1982554 - protein, 7 aa, Staphylococcus
SDWSRSQ

SEQ ID NO: 1982555 - protein, 8 aa, Staphylococcus
SDYAANIE

SEQ ID NO: 1982556 - protein, 20 aa, Staphylococcus
SDYEKDEAINQRIRDGKPFE

SEQ ID NO: 1982557 - protein, 10 aa, Staphylococcus
SDYEKEESEL

SEQ ID NO: 1982558 - protein, 12 aa, Staphylococcus
SDYEKNNDAGSY

SEQ ID NO: 1982559 - protein, 13 aa, Staphylococcus
SDYEQQVEAYSKK

SEQ ID NO: 1982560 - protein, 7 aa, Staphylococcus
SDYETEA

SEQ ID NO: 1982561 - protein, 8 aa, Staphylococcus
SDYETGET

SEQ ID NO: 1982562 - protein, 14 aa, Staphylococcus
SDYKTKARETGHSR

SEQ ID NO: 1982563 - protein, 12 aa, Staphylococcus
SDYNKNNGLSDQ

SEQ ID NO: 1982564 - protein, 11 aa, Staphylococcus
SDYNPATDAIA

SEQ ID NO: 1982565 - protein, 6 aa, Staphylococcus
SDYNTK

SEQ ID NO: 1982566 - protein, 10 aa, Staphylococcus
SDYPDTPNHK

SEQ ID NO: 1982567 - protein, 4 aa, Staphylococcus
SDYQ

SEQ ID NO: 1982568 - protein, 5 aa, Staphylococcus
SDYQS

SEQ ID NO: 1982569 - protein, 4 aa, Staphylococcus
SDYR

SEQ ID NO: 1982570 - protein, 8 aa, Staphylococcus
SDYRGDSY

SEQ ID NO: 1982571 - protein, 6 aa, Staphylococcus
SDYRNQ

SEQ ID NO: 1982572 - protein, 4 aa, Staphylococcus
SDYT

SEQ ID NO: 1982573 - protein, 18 aa, Staphylococcus
SDYYTDEEEQDEHYHSAT

SEQ ID NO: 1982574 - protein, 20 aa, Staphylococcus
SEAADGMTGQNITVDGGLTM

SEQ ID NO: 1982575 - protein, 5 aa, Staphylococcus
SEACN

SEQ ID NO: 1982576 - protein, 22 aa, Staphylococcus
SEADKAKGITCASAGNHAQGVA

SEQ ID NO: 1982577 - protein, 8 aa, Staphylococcus
SEADLQEI

SEQ ID NO: 1982578 - protein, 7 aa, Staphylococcus
SEAEKGH

SEQ ID NO: 1982579 - protein, 6 aa, Staphylococcus
SEAEKS

SEQ ID NO: 1982580 - protein, 20 aa, Staphylococcus
SEAENETMKQNLSKMLSSLE

SEQ ID NO: 1982581 - protein, 25 aa, Staphylococcus
SEAETGSPTRGGKPSTHAVKDGDNY

SEQ ID NO: 1982582 - protein, 10 aa, Staphylococcus
SEAGGESIAV

SEQ ID NO: 1982583 - protein, 9 aa, Staphylococcus
SEAGNRAAV

SEQ ID NO: 1982584 - protein, 18 aa, Staphylococcus
SEAGQEGSEGQSLYSGTK

SEQ ID NO: 1982585 - protein, 6 aa, Staphylococcus
SEAGQF

SEQ ID NO: 1982586 - protein, 6 aa, Staphylococcus
SEAHED

SEQ ID NO: 1982587 - protein, 23 aa, Staphylococcus
SEAIDGQSSEEQDSEKDSKDSKD

SEQ ID NO: 1982588 - protein, 7 aa, Staphylococcus
SEAKEDE

SEQ ID NO: 1982589 - protein, 10 aa, Staphylococcus
SEAKPPVNKD

SEQ ID NO: 1982590 - protein, 5 aa, Staphylococcus
SEANI

SEQ ID NO: 1982591 - protein, 7 aa, Staphylococcus
SEANKGK

SEQ ID NO: 1982592 - protein, 15 aa, Staphylococcus
SEANQELLALIYQLD

SEQ ID NO: 1982593 - protein, 8 aa, Staphylococcus
SEAPSDDD

SEQ ID NO: 1982594 - protein, 9 aa, Staphylococcus
SEARIPNSG

SEQ ID NO: 1982595 - protein, 8 aa, Staphylococcus
SEASLSSK

SEQ ID NO: 1982596 - protein, 13 aa, Staphylococcus
SEATDKNNGDRTL

SEQ ID NO: 1982597 - protein, 7 aa, Staphylococcus
SEATEAD

SEQ ID NO: 1982598 - protein, 5 aa, Staphylococcus
SEATV

SEQ ID NO: 1982599 - protein, 6 aa, Staphylococcus
SEAVTN

SEQ ID NO: 1982600 - protein, 22 aa, Staphylococcus
SEAYDPKKDEFKDVSQDDLKGS

SEQ ID NO: 1982601 - protein, 10 aa, Staphylococcus
SEAYKNESLK

SEQ ID NO: 1982602 - protein, 5 aa, Staphylococcus
SECGF

SEQ ID NO: 1982603 - protein, 9 aa, Staphylococcus
SEDAEPKWI

SEQ ID NO: 1982604 - protein, 4 aa, Staphylococcus
SEDD

SEQ ID NO: 1982605 - protein, 7 aa, Staphylococcus
SEDDGAD

SEQ ID NO: 1982606 - protein, 10 aa, Staphylococcus
SEDDKNYARQ

SEQ ID NO: 1982607 - protein, 24 aa, Staphylococcus
SEDDYNYDEKTKAVQLTEQGIDKA

SEQ ID NO: 1982608 - protein, 4 aa, Staphylococcus
SEDE

SEQ ID NO: 1982609 - protein, 5 aa, Staphylococcus
SEDEK

SEQ ID NO: 1982610 - protein, 16 aa, Staphylococcus
SEDELADLTEGNVTAS

SEQ ID NO: 1982611 - protein, 7 aa, Staphylococcus
SEDELED

SEQ ID NO: 1982612 - protein, 10 aa, Staphylococcus
SEDEMDSEDY

SEQ ID NO: 1982613 - protein, 10 aa, Staphylococcus
SEDEMNSEDY

SEQ ID NO: 1982614 - protein, 5 aa, Staphylococcus
SEDEQ

SEQ ID NO: 1982615 - protein, 7 aa, Staphylococcus
SEDESLK

SEQ ID NO: 1982616 - protein, 22 aa, Staphylococcus
SEDEVKTRLGESDTQINSEDKL

SEQ ID NO: 1982617 - protein, 9 aa, Staphylococcus
SEDGGQTFT

SEQ ID NO: 1982618 - protein, 15 aa, Staphylococcus
SEDGGRSAKAALTAE

SEQ ID NO: 1982619 - protein, 5 aa, Staphylococcus
SEDGQ

SEQ ID NO: 1982620 - protein, 7 aa, Staphylococcus
SEDGQNT

SEQ ID NO: 1982621 - protein, 6 aa, Staphylococcus
SEDHAY

SEQ ID NO: 1982622 - protein, 6 aa, Staphylococcus
SEDHGF

SEQ ID NO: 1982623 - protein, 11 aa, Staphylococcus
SEDKELNSFER

SEQ ID NO: 1982624 - protein, 8 aa, Staphylococcus
SEDKLEAV

SEQ ID NO: 1982625 - protein, 8 aa, Staphylococcus
SEDKQIKE

SEQ ID NO: 1982626 - protein, 19 aa, Staphylococcus
SEDKTSYSHNKGLTETRQA

SEQ ID NO: 1982627 - protein, 24 aa, Staphylococcus
SEDKVENQGGETPMERRGQPAELA

SEQ ID NO: 1982628 - protein, 8 aa, Staphylococcus
SEDNEQHL

SEQ ID NO: 1982629 - protein, 9 aa, Staphylococcus
SEDNRSDIG

SEQ ID NO: 1982630 - protein, 7 aa, Staphylococcus
SEDPEKI

SEQ ID NO: 1982631 - protein, 10 aa, Staphylococcus
SEDPNQNKGK

SEQ ID NO: 1982632 - protein, 5 aa, Staphylococcus
SEDPR

SEQ ID NO: 1982633 - protein, 7 aa, Staphylococcus
SEDRNKI

SEQ ID NO: 1982634 - protein, 7 aa, Staphylococcus
SEDTKRQ

SEQ ID NO: 1982635 - protein, 7 aa, Staphylococcus
SEDTNDN

SEQ ID NO: 1982636 - protein, 9 aa, Staphylococcus
SEDTPDPQA

SEQ ID NO: 1982637 - protein, 9 aa, Staphylococcus
SEDTSEEDV

SEQ ID NO: 1982638 - protein, 13 aa, Staphylococcus
SEDTVGASGDNRI

SEQ ID NO: 1982639 - protein, 4 aa, Staphylococcus
SEDV

SEQ ID NO: 1982640 - protein, 6 aa, Staphylococcus
SEDVAR

SEQ ID NO: 1982641 - protein, 8 aa, Staphylococcus
SEDWRNRD

SEQ ID NO: 1982642 - protein, 7 aa, Staphylococcus
SEDYPEF

SEQ ID NO: 1982643 - protein, 9 aa, Staphylococcus
SEDYQGPDM

SEQ ID NO: 1982644 - protein, 14 aa, Staphylococcus
SEDYQVGDKLPSIQ

SEQ ID NO: 1982645 - protein, 9 aa, Staphylococcus
SEDYTGPDM

SEQ ID NO: 1982646 - protein, 10 aa, Staphylococcus
SEEAKNRGIT

SEQ ID NO: 1982647 - protein, 10 aa, Staphylococcus
SEEDDNPDYA

SEQ ID NO: 1982648 - protein, 6 aa, Staphylococcus
SEEDGI

SEQ ID NO: 1982649 - protein, 7 aa, Staphylococcus
SEEDIAN

SEQ ID NO: 1982650 - protein, 7 aa, Staphylococcus
SEEDKTL

SEQ ID NO: 1982651 - protein, 5 aa, Staphylococcus
SEEDL

SEQ ID NO: 1982652 - protein, 8 aa, Staphylococcus
SEEDNKEE

SEQ ID NO: 1982653 - protein, 8 aa, Staphylococcus
SEEDNSVE

SEQ ID NO: 1982654 - protein, 6 aa, Staphylococcus
SEEDQE

SEQ ID NO: 1982655 - protein, 5 aa, Staphylococcus
SEEDY

SEQ ID NO: 1982656 - protein, 4 aa, Staphylococcus
SEEE

SEQ ID NO: 1982657 - protein, 5 aa, Staphylococcus
SEEEF

SEQ ID NO: 1982658 - protein, 9 aa, Staphylococcus
SEEEIGTNF

SEQ ID NO: 1982659 - protein, 7 aa, Staphylococcus
SEEELSS

SEQ ID NO: 1982660 - protein, 12 aa, Staphylococcus
SEEEMQNNHANL

SEQ ID NO: 1982661 - protein, 11 aa, Staphylococcus
SEEEQRKSGVL

SEQ ID NO: 1982662 - protein, 10 aa, Staphylococcus
SEEETEEMAN

SEQ ID NO: 1982663 - protein, 5 aa, Staphylococcus
SEEGH

SEQ ID NO: 1982664 - protein, 8 aa, Staphylococcus
SEEGKEKI

SEQ ID NO: 1982665 - protein, 5 aa, Staphylococcus
SEEGL

SEQ ID NO: 1982666 - protein, 5 aa, Staphylococcus
SEEGQ

SEQ ID NO: 1982667 - protein, 8 aa, Staphylococcus
SEEIENGK

SEQ ID NO: 1982668 - protein, 22 aa, Staphylococcus
SEEIERQTDQSITTNFNKRDDA

SEQ ID NO: 1982669 - protein, 10 aa, Staphylococcus
SEEIGVNRDT

SEQ ID NO: 1982670 - protein, 6 aa, Staphylococcus
SEEIKM

SEQ ID NO: 1982671 - protein, 4 aa, Staphylococcus
SEEK

SEQ ID NO: 1982672 - protein, 7 aa, Staphylococcus
SEEKADE

SEQ ID NO: 1982673 - protein, 8 aa, Staphylococcus
SEEKFESS

SEQ ID NO: 1982674 - protein, 6 aa, Staphylococcus
SEEKGR

SEQ ID NO: 1982675 - protein, 17 aa, Staphylococcus
SEEKRQEHIQQTKDNPL

SEQ ID NO: 1982676 - protein, 20 aa, Staphylococcus
SEEKRTFARETIEKDKEINQ

SEQ ID NO: 1982677 - protein, 7 aa, Staphylococcus
SEEKSDF

SEQ ID NO: 1982678 - protein, 9 aa, Staphylococcus
SEEKSIEKT

SEQ ID NO: 1982679 - protein, 7 aa, Staphylococcus
SEEKSIS

SEQ ID NO: 1982680 - protein, 8 aa, Staphylococcus
SEEKSVEN

SEQ ID NO: 1982681 - protein, 4 aa, Staphylococcus
SEEL

SEQ ID NO: 1982682 - protein, 4 aa, Staphylococcus
SEEM

SEQ ID NO: 1982683 - protein, 4 aa, Staphylococcus
SEEN

SEQ ID NO: 1982684 - protein, 36 aa, Staphylococcus
SEENDKRMKDLNNQRKLDNKNKQQSSLWANAIKNGK

SEQ ID NO: 1982685 - protein, 8 aa, Staphylococcus
SEENEAKY

SEQ ID NO: 1982686 - protein, 8 aa, Staphylococcus
SEENEARY

SEQ ID NO: 1982687 - protein, 8 aa, Staphylococcus
SEENEDKY

SEQ ID NO: 1982688 - protein, 7 aa, Staphylococcus
SEENHKL

SEQ ID NO: 1982689 - protein, 8 aa, Staphylococcus
SEENHKLK

SEQ ID NO: 1982690 - protein, 11 aa, Staphylococcus
SEENSIKKEQI

SEQ ID NO: 1982691 - protein, 10 aa, Staphylococcus
SEEPKQQIHT

SEQ ID NO: 1982692 - protein, 7 aa, Staphylococcus
SEEQQFK

SEQ ID NO: 1982693 - protein, 7 aa, Staphylococcus
SEEQQLR

SEQ ID NO: 1982694 - protein, 4 aa, Staphylococcus
SEER

SEQ ID NO: 1982695 - protein, 6 aa, Staphylococcus
SEESHG

SEQ ID NO: 1982696 - protein, 5 aa, Staphylococcus
SEETS

SEQ ID NO: 1982697 - protein, 11 aa, Staphylococcus
SEETTIKKDQV

SEQ ID NO: 1982698 - protein, 10 aa, Staphylococcus
SEETTIKKEK

SEQ ID NO: 1982699 - protein, 11 aa, Staphylococcus
SEETVEEGVRK

SEQ ID NO: 1982700 - protein, 11 aa, Staphylococcus
SEETVEKEKGI

SEQ ID NO: 1982701 - protein, 10 aa, Staphylococcus
SEEVAQTAAE

SEQ ID NO: 1982702 - protein, 26 aa, Staphylococcus
SEEVEDFSKRQREVKKKKNGKKYDEE

SEQ ID NO: 1982703 - protein, 11 aa, Staphylococcus
SEEVEKGEQIK

SEQ ID NO: 1982704 - protein, 6 aa, Staphylococcus
SEEVPP

SEQ ID NO: 1982705 - protein, 4 aa, Staphylococcus
SEFA

SEQ ID NO: 1982706 - protein, 6 aa, Staphylococcus
SEFDNY

SEQ ID NO: 1982707 - protein, 14 aa, Staphylococcus
SEFDNYSVGNTDDG

SEQ ID NO: 1982708 - protein, 28 aa, Staphylococcus
SEFEKSVTAPAGNQGHGFDKKEFDKTAE

SEQ ID NO: 1982709 - protein, 4 aa, Staphylococcus
SEFF

SEQ ID NO: 1982710 - protein, 5 aa, Staphylococcus
SEFGL

SEQ ID NO: 1982711 - protein, 5 aa, Staphylococcus
SEFGP

SEQ ID NO: 1982712 - protein, 5 aa, Staphylococcus
SEFNN

SEQ ID NO: 1982713 - protein, 6 aa, Staphylococcus
SEFNNY

SEQ ID NO: 1982714 - protein, 4 aa, Staphylococcus
SEFR

SEQ ID NO: 1982715 - protein, 6 aa, Staphylococcus
SEFSTY

SEQ ID NO: 1982716 - protein, 6 aa, Staphylococcus
SEFTPH

SEQ ID NO: 1982717 - protein, 4 aa, Staphylococcus
SEGA

SEQ ID NO: 1982718 - protein, 4 aa, Staphylococcus
SEGD

SEQ ID NO: 1982719 - protein, 9 aa, Staphylococcus
SEGDQNDWD

SEQ ID NO: 1982720 - protein, 8 aa, Staphylococcus
SEGDSNNW

SEQ ID NO: 1982721 - protein, 11 aa, Staphylococcus
SEGDTVEEGES

SEQ ID NO: 1982722 - protein, 11 aa, Staphylococcus
SEGDTVNEGDS

SEQ ID NO: 1982723 - protein, 6 aa, Staphylococcus
SEGDVI

SEQ ID NO: 1982724 - protein, 6 aa, Staphylococcus
SEGEKR

SEQ ID NO: 1982725 - protein, 8 aa, Staphylococcus
SEGELEEA

SEQ ID NO: 1982726 - protein, 6 aa, Staphylococcus
SEGEVD

SEQ ID NO: 1982727 - protein, 13 aa, Staphylococcus
SEGFTPEEAATEK

SEQ ID NO: 1982728 - protein, 7 aa, Staphylococcus
SEGGALQ

SEQ ID NO: 1982729 - protein, 7 aa, Staphylococcus
SEGGGVH

SEQ ID NO: 1982730 - protein, 6 aa, Staphylococcus
SEGHSL

SEQ ID NO: 1982731 - protein, 7 aa, Staphylococcus
SEGIPTD

SEQ ID NO: 1982732 - protein, 6 aa, Staphylococcus
SEGIRP

SEQ ID NO: 1982733 - protein, 23 aa, Staphylococcus
SEGIVTDREARKRNVGGEVLAYV

SEQ ID NO: 1982734 - protein, 4 aa, Staphylococcus
SEGK

SEQ ID NO: 1982735 - protein, 8 aa, Staphylococcus
SEGKPAVE

SEQ ID NO: 1982736 - protein, 4 aa, Staphylococcus
SEGL

SEQ ID NO: 1982737 - protein, 5 aa, Staphylococcus
SEGLA

SEQ ID NO: 1982738 - protein, 5 aa, Staphylococcus
SEGLT

SEQ ID NO: 1982739 - protein, 4 aa, Staphylococcus
SEGN

SEQ ID NO: 1982740 - protein, 5 aa, Staphylococcus
SEGNR

SEQ ID NO: 1982741 - protein, 9 aa, Staphylococcus
SEGNREQWS

SEQ ID NO: 1982742 - protein, 6 aa, Staphylococcus
SEGQKA

SEQ ID NO: 1982743 - protein, 8 aa, Staphylococcus
SEGQNLQD

SEQ ID NO: 1982744 - protein, 8 aa, Staphylococcus
SEGSQTEI

SEQ ID NO: 1982745 - protein, 8 aa, Staphylococcus
SEGTAYRA

SEQ ID NO: 1982746 - protein, 19 aa, Staphylococcus
SEGTDFPDFESALKAYKEL

SEQ ID NO: 1982747 - protein, 6 aa, Staphylococcus
SEGTTS

SEQ ID NO: 1982748 - protein, 6 aa, Staphylococcus
SEGTTT

SEQ ID NO: 1982749 - protein, 11 aa, Staphylococcus
SEGVSRTPNRA

SEQ ID NO: 1982750 - protein, 9 aa, Staphylococcus
SEGYGPNKY

SEQ ID NO: 1982751 - protein, 7 aa, Staphylococcus
SEGYHEY

SEQ ID NO: 1982752 - protein, 10 aa, Staphylococcus
SEGYKPGDFE

SEQ ID NO: 1982753 - protein, 6 aa, Staphylococcus
SEHEQR

SEQ ID NO: 1982754 - protein, 11 aa, Staphylococcus
SEHETTPPEYF

SEQ ID NO: 1982755 - protein, 5 aa, Staphylococcus
SEHKP

SEQ ID NO: 1982756 - protein, 6 aa, Staphylococcus
SEHKYD

SEQ ID NO: 1982757 - protein, 10 aa, Staphylococcus
SEHNETPLEA

SEQ ID NO: 1982758 - protein, 4 aa, Staphylococcus
SEHP

SEQ ID NO: 1982759 - protein, 6 aa, Staphylococcus
SEHPGD

SEQ ID NO: 1982760 - protein, 23 aa, Staphylococcus
SEHPQNEVSESEWKSRRDAMNGK

SEQ ID NO: 1982761 - protein, 5 aa, Staphylococcus
SEHPY

SEQ ID NO: 1982762 - protein, 4 aa, Staphylococcus
SEHQ

SEQ ID NO: 1982763 - protein, 18 aa, Staphylococcus
SEHQYESMSPSDDGSHLD

SEQ ID NO: 1982764 - protein, 14 aa, Staphylococcus
SEHSAIQAAEAQTG

SEQ ID NO: 1982765 - protein, 6 aa, Staphylococcus
SEHSTY

SEQ ID NO: 1982766 - protein, 8 aa, Staphylococcus
SEHTSGHI

SEQ ID NO: 1982767 - protein, 5 aa, Staphylococcus
SEIAK

SEQ ID NO: 1982768 - protein, 4 aa, Staphylococcus
SEID

SEQ ID NO: 1982769 - protein, 8 aa, Staphylococcus
SEIDDNTG

SEQ ID NO: 1982770 - protein, 11 aa, Staphylococcus
SEIDQDKIEKD

SEQ ID NO: 1982771 - protein, 9 aa, Staphylococcus
SEIENKQRY

SEQ ID NO: 1982772 - protein, 6 aa, Staphylococcus
SEIGEN

SEQ ID NO: 1982773 - protein, 8 aa, Staphylococcus
SEIGKRKN

SEQ ID NO: 1982774 - protein, 9 aa, Staphylococcus
SEIKKAQGL

SEQ ID NO: 1982775 - protein, 4 aa, Staphylococcus
SEIN

SEQ ID NO: 1982776 - protein, 9 aa, Staphylococcus
SEINEKPEV

SEQ ID NO: 1982777 - protein, 5 aa, Staphylococcus
SEINQ

SEQ ID NO: 1982778 - protein, 10 aa, Staphylococcus
SEIPEDKKSY

SEQ ID NO: 1982779 - protein, 13 aa, Staphylococcus
SEIPKDKVKTKTI

SEQ ID NO: 1982780 - protein, 16 aa, Staphylococcus
SEIPKNKVARFFEAKS

SEQ ID NO: 1982781 - protein, 4 aa, Staphylococcus
SEIQ

SEQ ID NO: 1982782 - protein, 7 aa, Staphylococcus
SEIQDDE

SEQ ID NO: 1982783 - protein, 6 aa, Staphylococcus
SEIQPK

SEQ ID NO: 1982784 - protein, 8 aa, Staphylococcus
SEIRKHDP

SEQ ID NO: 1982785 - protein, 8 aa, Staphylococcus
SEIRKHDS

SEQ ID NO: 1982786 - protein, 5 aa, Staphylococcus
SEITP

SEQ ID NO: 1982787 - protein, 14 aa, Staphylococcus
SEKAIERKTGARGL

SEQ ID NO: 1982788 - protein, 8 aa, Staphylococcus
SEKANDQR

SEQ ID NO: 1982789 - protein, 17 aa, Staphylococcus
SEKANTITRNQTNYDNE

SEQ ID NO: 1982790 - protein, 4 aa, Staphylococcus
SEKD

SEQ ID NO: 1982791 - protein, 8 aa, Staphylococcus
SEKDAQTI

SEQ ID NO: 1982792 - protein, 8 aa, Staphylococcus
SEKDGLVT

SEQ ID NO: 1982793 - protein, 6 aa, Staphylococcus
SEKDPE

SEQ ID NO: 1982794 - protein, 8 aa, Staphylococcus
SEKDQHQI

SEQ ID NO: 1982795 - protein, 14 aa, Staphylococcus
SEKEEAVKAHQTKI

SEQ ID NO: 1982796 - protein, 9 aa, Staphylococcus
SEKEITQEE

SEQ ID NO: 1982797 - protein, 8 aa, Staphylococcus
SEKEVNDT

SEQ ID NO: 1982798 - protein, 10 aa, Staphylococcus
SEKEYETTQR

SEQ ID NO: 1982799 - protein, 11 aa, Staphylococcus
SEKGNKSFTKY

SEQ ID NO: 1982800 - protein, 7 aa, Staphylococcus
SEKGQQL

SEQ ID NO: 1982801 - protein, 11 aa, Staphylococcus
SEKGTTDINGE

SEQ ID NO: 1982802 - protein, 8 aa, Staphylococcus
SEKHSNEF

SEQ ID NO: 1982803 - protein, 10 aa, Staphylococcus
SEKHTETAEL

SEQ ID NO: 1982804 - protein, 8 aa, Staphylococcus
SEKHYPYP

SEQ ID NO: 1982805 - protein, 8 aa, Staphylococcus
SEKIPYRA

SEQ ID NO: 1982806 - protein, 5 aa, Staphylococcus
SEKIS

SEQ ID NO: 1982807 - protein, 14 aa, Staphylococcus
SEKKNQLPSDSIES

SEQ ID NO: 1982808 - protein, 8 aa, Staphylococcus
SEKLPYRA

SEQ ID NO: 1982809 - protein, 15 aa, Staphylococcus
SEKLTNDVEAPTSGT

SEQ ID NO: 1982810 - protein, 8 aa, Staphylococcus
SEKMEADL

SEQ ID NO: 1982811 - protein, 8 aa, Staphylococcus
SEKMPYRA

SEQ ID NO: 1982812 - protein, 6 aa, Staphylococcus
SEKNAQ

SEQ ID NO: 1982813 - protein, 8 aa, Staphylococcus
SEKNEAKY

SEQ ID NO: 1982814 - protein, 11 aa, Staphylococcus
SEKNISKRTAI

SEQ ID NO: 1982815 - protein, 6 aa, Staphylococcus
SEKNYI

SEQ ID NO: 1982816 - protein, 4 aa, Staphylococcus
SEKP

SEQ ID NO: 1982817 - protein, 13 aa, Staphylococcus
SEKPDIDYDDDGG

SEQ ID NO: 1982818 - protein, 13 aa, Staphylococcus
SEKPDIDYNDDGG

SEQ ID NO: 1982819 - protein, 13 aa, Staphylococcus
SEKPNEIKPKKVF

SEQ ID NO: 1982820 - protein, 5 aa, Staphylococcus
SEKPP

SEQ ID NO: 1982821 - protein, 13 aa, Staphylococcus
SEKPSAGKPTISA

SEQ ID NO: 1982822 - protein, 10 aa, Staphylococcus
SEKPVGKALE

SEQ ID NO: 1982823 - protein, 11 aa, Staphylococcus
SEKQAGFTSGT

SEQ ID NO: 1982824 - protein, 10 aa, Staphylococcus
SEKQKHDPKF

SEQ ID NO: 1982825 - protein, 7 aa, Staphylococcus
SEKQQKY

SEQ ID NO: 1982826 - protein, 5 aa, Staphylococcus
SEKQV

SEQ ID NO: 1982827 - protein, 22 aa, Staphylococcus
SEKREDNKSNTFTSAQEGQPDF

SEQ ID NO: 1982828 - protein, 22 aa, Staphylococcus
SEKRKDNQSNTYTSAQDGQPDF

SEQ ID NO: 1982829 - protein, 7 aa, Staphylococcus
SEKRNLT

SEQ ID NO: 1982830 - protein, 21 aa, Staphylococcus
SEKRSDNKSDTYTHAADGQPE

SEQ ID NO: 1982831 - protein, 9 aa, Staphylococcus
SEKRSKTLS

SEQ ID NO: 1982832 - protein, 7 aa, Staphylococcus
SEKSRTS

SEQ ID NO: 1982833 - protein, 7 aa, Staphylococcus
SEKSVRT

SEQ ID NO: 1982834 - protein, 4 aa, Staphylococcus
SEKT

SEQ ID NO: 1982835 - protein, 12 aa, Staphylococcus
SEKTEPYERERP

SEQ ID NO: 1982836 - protein, 13 aa, Staphylococcus
SEKTLPTTSQPAI

SEQ ID NO: 1982837 - protein, 4 aa, Staphylococcus
SEKV

SEQ ID NO: 1982838 - protein, 5 aa, Staphylococcus
SEKYD

SEQ ID NO: 1982839 - protein, 6 aa, Staphylococcus
SEKYKQ

SEQ ID NO: 1982840 - protein, 9 aa, Staphylococcus
SEKYNKKDV

SEQ ID NO: 1982841 - protein, 4 aa, Staphylococcus
SELA

SEQ ID NO: 1982842 - protein, 6 aa, Staphylococcus
SELAET

SEQ ID NO: 1982843 - protein, 9 aa, Staphylococcus
SELANNPNL

SEQ ID NO: 1982844 - protein, 32 aa, Staphylococcus
SELDQTTQSYKRLETEQRNAQRLASSGFGRSI

SEQ ID NO: 1982845 - protein, 5 aa, Staphylococcus
SELDR

SEQ ID NO: 1982846 - protein, 13 aa, Staphylococcus
SELDRKGQSYTYD

SEQ ID NO: 1982847 - protein, 4 aa, Staphylococcus
SELE

SEQ ID NO: 1982848 - protein, 9 aa, Staphylococcus
SELEDMDTT

SEQ ID NO: 1982849 - protein, 8 aa, Staphylococcus
SELEKGRQ

SEQ ID NO: 1982850 - protein, 9 aa, Staphylococcus
SELEKNPTP

SEQ ID NO: 1982851 - protein, 7 aa, Staphylococcus
SELENNQ

SEQ ID NO: 1982852 - protein, 8 aa, Staphylococcus
SELETSVR

SEQ ID NO: 1982853 - protein, 5 aa, Staphylococcus
SELGR

SEQ ID NO: 1982854 - protein, 9 aa, Staphylococcus
SELKPTPKW

SEQ ID NO: 1982855 - protein, 6 aa, Staphylococcus
SELKQE

SEQ ID NO: 1982856 - protein, 6 aa, Staphylococcus
SELKSR

SEQ ID NO: 1982857 - protein, 9 aa, Staphylococcus
SELNDSYEK

SEQ ID NO: 1982858 - protein, 9 aa, Staphylococcus
SELNNGMKQ

SEQ ID NO: 1982859 - protein, 21 aa, Staphylococcus
SELNRASQNNENQATDKFNDT

SEQ ID NO: 1982860 - protein, 5 aa, Staphylococcus
SELPE

SEQ ID NO: 1982861 - protein, 8 aa, Staphylococcus
SELPEDIT

SEQ ID NO: 1982862 - protein, 7 aa, Staphylococcus
SELPELE

SEQ ID NO: 1982863 - protein, 8 aa, Staphylococcus
SELPISNA

SEQ ID NO: 1982864 - protein, 13 aa, Staphylococcus
SELPNSDTYHNLG

SEQ ID NO: 1982865 - protein, 8 aa, Staphylococcus
SELQDNGF

SEQ ID NO: 1982866 - protein, 8 aa, Staphylococcus
SELQETKD

SEQ ID NO: 1982867 - protein, 8 aa, Staphylococcus
SELQKGRQ

SEQ ID NO: 1982868 - protein, 8 aa, Staphylococcus
SELQSQQE

SEQ ID NO: 1982869 - protein, 7 aa, Staphylococcus
SELQTVT

SEQ ID NO: 1982870 - protein, 4 aa, Staphylococcus
SELR

SEQ ID NO: 1982871 - protein, 8 aa, Staphylococcus
SELRKGRQ

SEQ ID NO: 1982872 - protein, 6 aa, Staphylococcus
SELSAE

SEQ ID NO: 1982873 - protein, 20 aa, Staphylococcus
SELSEYKAKHQALKSEMNKQ

SEQ ID NO: 1982874 - protein, 5 aa, Staphylococcus
SELSG

SEQ ID NO: 1982875 - protein, 7 aa, Staphylococcus
SELSGGQ

SEQ ID NO: 1982876 - protein, 8 aa, Staphylococcus
SELSSKTD

SEQ ID NO: 1982877 - protein, 7 aa, Staphylococcus
SELSYQG

SEQ ID NO: 1982878 - protein, 7 aa, Staphylococcus
SELTGKE

SEQ ID NO: 1982879 - protein, 17 aa, Staphylococcus
SELTPQPDCGETSYEGH

SEQ ID NO: 1982880 - protein, 10 aa, Staphylococcus
SELTTPTGAA

SEQ ID NO: 1982881 - protein, 11 aa, Staphylococcus
SELTTTQGDIR

SEQ ID NO: 1982882 - protein, 4 aa, Staphylococcus
SEMA

SEQ ID NO: 1982883 - protein, 9 aa, Staphylococcus
SEMAQRDHQ

SEQ ID NO: 1982884 - protein, 12 aa, Staphylococcus
SEMDPNKEKSLD

SEQ ID NO: 1982885 - protein, 10 aa, Staphylococcus
SEMKRQPLGD

SEQ ID NO: 1982886 - protein, 10 aa, Staphylococcus
SEMKTENESL

SEQ ID NO: 1982887 - protein, 14 aa, Staphylococcus
SEMQESLKDYKSSE

SEQ ID NO: 1982888 - protein, 13 aa, Staphylococcus
SEMQTGEGKTLTA

SEQ ID NO: 1982889 - protein, 13 aa, Staphylococcus
SEMRTGEGKTLTA

SEQ ID NO: 1982890 - protein, 14 aa, Staphylococcus
SEMRTGEGKTLTAT

SEQ ID NO: 1982891 - protein, 7 aa, Staphylococcus
SEMSDEF

SEQ ID NO: 1982892 - protein, 4 aa, Staphylococcus
SEMT

SEQ ID NO: 1982893 - protein, 15 aa, Staphylococcus
SEMTPEPDCGETSYV

SEQ ID NO: 1982894 - protein, 9 aa, Staphylococcus
SENAKPIEL

SEQ ID NO: 1982895 - protein, 10 aa, Staphylococcus
SENALDHEEQ

SEQ ID NO: 1982896 - protein, 15 aa, Staphylococcus
SENATMPTRANEFDS

SEQ ID NO: 1982897 - protein, 7 aa, Staphylococcus
SENAVKA

SEQ ID NO: 1982898 - protein, 9 aa, Staphylococcus
SENCTDPIN

SEQ ID NO: 1982899 - protein, 15 aa, Staphylococcus
SENDNDNIPSSKGVI

SEQ ID NO: 1982900 - protein, 15 aa, Staphylococcus
SENEDTDLDRQEQEA

SEQ ID NO: 1982901 - protein, 9 aa, Staphylococcus
SENEELNDS

SEQ ID NO: 1982902 - protein, 8 aa, Staphylococcus
SENEGDIK

SEQ ID NO: 1982903 - protein, 8 aa, Staphylococcus
SENEGNIE

SEQ ID NO: 1982904 - protein, 5 aa, Staphylococcus
SENEL

SEQ ID NO: 1982905 - protein, 6 aa, Staphylococcus
SENELP

SEQ ID NO: 1982906 - protein, 4 aa, Staphylococcus
SENF

SEQ ID NO: 1982907 - protein, 5 aa, Staphylococcus
SENGA

SEQ ID NO: 1982908 - protein, 6 aa, Staphylococcus
SENGGI

SEQ ID NO: 1982909 - protein, 7 aa, Staphylococcus
SENGLKE

SEQ ID NO: 1982910 - protein, 17 aa, Staphylococcus
SENGNVTFKGQLNKNAI

SEQ ID NO: 1982911 - protein, 7 aa, Staphylococcus
SENGPQV

SEQ ID NO: 1982912 - protein, 5 aa, Staphylococcus
SENGR

SEQ ID NO: 1982913 - protein, 6 aa, Staphylococcus
SENHDY

SEQ ID NO: 1982914 - protein, 19 aa, Staphylococcus
SENHHKELKKKSTQTTSNV

SEQ ID NO: 1982915 - protein, 8 aa, Staphylococcus
SENHHREL

SEQ ID NO: 1982916 - protein, 19 aa, Staphylococcus
SENHHRELKKKSTQTTSNV

SEQ ID NO: 1982917 - protein, 16 aa, Staphylococcus
SENHNPESNRLFFIVK

SEQ ID NO: 1982918 - protein, 8 aa, Staphylococcus
SENHPSYL

SEQ ID NO: 1982919 - protein, 5 aa, Staphylococcus
SENIA

SEQ ID NO: 1982920 - protein, 7 aa, Staphylococcus
SENIDQQ

SEQ ID NO: 1982921 - protein, 10 aa, Staphylococcus
SENKQSHGIG

SEQ ID NO: 1982922 - protein, 5 aa, Staphylococcus
SENNA

SEQ ID NO: 1982923 - protein, 5 aa, Staphylococcus
SENNI

SEQ ID NO: 1982924 - protein, 8 aa, Staphylococcus
SENNKGKM

SEQ ID NO: 1982925 - protein, 6 aa, Staphylococcus
SENNQE

SEQ ID NO: 1982926 - protein, 6 aa, Staphylococcus
SENNSL

SEQ ID NO: 1982927 - protein, 6 aa, Staphylococcus
SENPAK

SEQ ID NO: 1982928 - protein, 5 aa, Staphylococcus
SENPL

SEQ ID NO: 1982929 - protein, 7 aa, Staphylococcus
SENPNKN

SEQ ID NO: 1982930 - protein, 8 aa, Staphylococcus
SENQSDFN

SEQ ID NO: 1982931 - protein, 7 aa, Staphylococcus
SENQYDS

SEQ ID NO: 1982932 - protein, 8 aa, Staphylococcus
SENRASAI

SEQ ID NO: 1982933 - protein, 6 aa, Staphylococcus
SENRTL

SEQ ID NO: 1982934 - protein, 11 aa, Staphylococcus
SENSDYAANIE

SEQ ID NO: 1982935 - protein, 12 aa, Staphylococcus
SENSDYAANIEK

SEQ ID NO: 1982936 - protein, 4 aa, Staphylococcus
SENT

SEQ ID NO: 1982937 - protein, 7 aa, Staphylococcus
SENTDFP

SEQ ID NO: 1982938 - protein, 5 aa, Staphylococcus
SENTG

SEQ ID NO: 1982939 - protein, 7 aa, Staphylococcus
SENTPDL

SEQ ID NO: 1982940 - protein, 6 aa, Staphylococcus
SENTSN

SEQ ID NO: 1982941 - protein, 10 aa, Staphylococcus
SENVDANKKR

SEQ ID NO: 1982942 - protein, 29 aa, Staphylococcus
SEPDQPTRTFKGTVSGRITDERRGDNGFG

SEQ ID NO: 1982943 - protein, 4 aa, Staphylococcus
SEPE

SEQ ID NO: 1982944 - protein, 8 aa, Staphylococcus
SEPFNQEQ

SEQ ID NO: 1982945 - protein, 4 aa, Staphylococcus
SEPI

SEQ ID NO: 1982946 - protein, 12 aa, Staphylococcus
SEPIKGSELSQR

SEQ ID NO: 1982947 - protein, 6 aa, Staphylococcus
SEPKQR

SEQ ID NO: 1982948 - protein, 4 aa, Staphylococcus
SEPL

SEQ ID NO: 1982949 - protein, 6 aa, Staphylococcus
SEPLGT

SEQ ID NO: 1982950 - protein, 7 aa, Staphylococcus
SEPLKYD

SEQ ID NO: 1982951 - protein, 4 aa, Staphylococcus
SEPM

SEQ ID NO: 1982952 - protein, 4 aa, Staphylococcus
SEPN

SEQ ID NO: 1982953 - protein, 6 aa, Staphylococcus
SEPQKY

SEQ ID NO: 1982954 - protein, 8 aa, Staphylococcus
SEPTEGHI

SEQ ID NO: 1982955 - protein, 14 aa, Staphylococcus
SEPTFQQASADEQH

SEQ ID NO: 1982956 - protein, 21 aa, Staphylococcus
SEPYKELEETKLKAKSLLEVS

SEQ ID NO: 1982957 - protein, 11 aa, Staphylococcus
SEQDAQASIKG

SEQ ID NO: 1982958 - protein, 12 aa, Staphylococcus
SEQDAQASIKSG

SEQ ID NO: 1982959 - protein, 7 aa, Staphylococcus
SEQDGRH

SEQ ID NO: 1982960 - protein, 10 aa, Staphylococcus
SEQDITSEDY

SEQ ID NO: 1982961 - protein, 6 aa, Staphylococcus
SEQDKE

SEQ ID NO: 1982962 - protein, 8 aa, Staphylococcus
SEQDQKIA

SEQ ID NO: 1982963 - protein, 6 aa, Staphylococcus
SEQDRK

SEQ ID NO: 1982964 - protein, 6 aa, Staphylococcus
SEQDRR

SEQ ID NO: 1982965 - protein, 15 aa, Staphylococcus
SEQEIEVDTQGTKMT

SEQ ID NO: 1982966 - protein, 8 aa, Staphylococcus
SEQEQADY

SEQ ID NO: 1982967 - protein, 12 aa, Staphylococcus
SEQERNKSKRRQ

SEQ ID NO: 1982968 - protein, 6 aa, Staphylococcus
SEQEYD

SEQ ID NO: 1982969 - protein, 15 aa, Staphylococcus
SEQGIELTDQQQQQF

SEQ ID NO: 1982970 - protein, 5 aa, Staphylococcus
SEQGV

SEQ ID NO: 1982971 - protein, 13 aa, Staphylococcus
SEQGVTAHSNSTY

SEQ ID NO: 1982972 - protein, 4 aa, Staphylococcus
SEQI

SEQ ID NO: 1982973 - protein, 10 aa, Staphylococcus
SEQKINTQNT

SEQ ID NO: 1982974 - protein, 4 aa, Staphylococcus
SEQL

SEQ ID NO: 1982975 - protein, 6 aa, Staphylococcus
SEQNAR

SEQ ID NO: 1982976 - protein, 6 aa, Staphylococcus
SEQPAY

SEQ ID NO: 1982977 - protein, 10 aa, Staphylococcus
SEQPQSEDCK

SEQ ID NO: 1982978 - protein, 8 aa, Staphylococcus
SEQQADNQ

SEQ ID NO: 1982979 - protein, 5 aa, Staphylococcus
SEQQI

SEQ ID NO: 1982980 - protein, 6 aa, Staphylococcus
SEQQNF

SEQ ID NO: 1982981 - protein, 11 aa, Staphylococcus
SEQSDYAANIE

SEQ ID NO: 1982982 - protein, 8 aa, Staphylococcus
SEQTDYNE

SEQ ID NO: 1982983 - protein, 9 aa, Staphylococcus
SEQTNDAVN

SEQ ID NO: 1982984 - protein, 8 aa, Staphylococcus
SEQTNDAY

SEQ ID NO: 1982985 - protein, 5 aa, Staphylococcus
SEQTV

SEQ ID NO: 1982986 - protein, 16 aa, Staphylococcus
SEQTWQGIPKGTKIGN

SEQ ID NO: 1982987 - protein, 7 aa, Staphylococcus
SEQYTNG

SEQ ID NO: 1982988 - protein, 4 aa, Staphylococcus
SERE

SEQ ID NO: 1982989 - protein, 5 aa, Staphylococcus
SEREY

SEQ ID NO: 1982990 - protein, 18 aa, Staphylococcus
SERFKSNYKTTSNSTYHH

SEQ ID NO: 1982991 - protein, 9 aa, Staphylococcus
SERGGLGTI

SEQ ID NO: 1982992 - protein, 26 aa, Staphylococcus
SERGLETAVGDEGGFAPKFDGTEDAV

SEQ ID NO: 1982993 - protein, 26 aa, Staphylococcus
SERGLETAVGDEGGFAPRFDGTEDAV

SEQ ID NO: 1982994 - protein, 11 aa, Staphylococcus
SERGYKEGKRI

SEQ ID NO: 1982995 - protein, 4 aa, Staphylococcus
SERH

SEQ ID NO: 1982996 - protein, 9 aa, Staphylococcus
SERHKEDLE

SEQ ID NO: 1982997 - protein, 4 aa, Staphylococcus
SERI

SEQ ID NO: 1982998 - protein, 17 aa, Staphylococcus
SERIKSSANEAKPTYQA

SEQ ID NO: 1982999 - protein, 4 aa, Staphylococcus
SERK

SEQ ID NO: 1983000 - protein, 11 aa, Staphylococcus
SERKEEPRLGE

SEQ ID NO: 1983001 - protein, 5 aa, Staphylococcus
SERKG

SEQ ID NO: 1983002 - protein, 10 aa, Staphylococcus
SERKHEPRLG

SEQ ID NO: 1983003 - protein, 11 aa, Staphylococcus
SERKQEPRLGE

SEQ ID NO: 1983004 - protein, 11 aa, Staphylococcus
SERKSEPRLGE

SEQ ID NO: 1983005 - protein, 13 aa, Staphylococcus
SERLGLSSEVKPG

SEQ ID NO: 1983006 - protein, 21 aa, Staphylococcus
SERLKSNSKLQSSTNSELTYH

SEQ ID NO: 1983007 - protein, 6 aa, Staphylococcus
SERLTG

SEQ ID NO: 1983008 - protein, 6 aa, Staphylococcus
SERNPL

SEQ ID NO: 1983009 - protein, 7 aa, Staphylococcus
SERNTLN

SEQ ID NO: 1983010 - protein, 13 aa, Staphylococcus
SERPDIDYDDDGG

SEQ ID NO: 1983011 - protein, 5 aa, Staphylococcus
SERQA

SEQ ID NO: 1983012 - protein, 6 aa, Staphylococcus
SERQKA

SEQ ID NO: 1983013 - protein, 6 aa, Staphylococcus
SERSIE

SEQ ID NO: 1983014 - protein, 11 aa, Staphylococcus
SERTGKAFSSD

SEQ ID NO: 1983015 - protein, 28 aa, Staphylococcus
SERTKKGLEAARARGRKGGRPSLPDYKK

SEQ ID NO: 1983016 - protein, 9 aa, Staphylococcus
SERTSAEAI

SEQ ID NO: 1983017 - protein, 11 aa, Staphylococcus
SERTSAPAVEE

SEQ ID NO: 1983018 - protein, 13 aa, Staphylococcus
SERVEQGQYHHTT

SEQ ID NO: 1983019 - protein, 4 aa, Staphylococcus
SERY

SEQ ID NO: 1983020 - protein, 7 aa, Staphylococcus
SERYPSH

SEQ ID NO: 1983021 - protein, 10 aa, Staphylococcus
SERYSEPSLE

SEQ ID NO: 1983022 - protein, 11 aa, Staphylococcus
SESANEVRERG

SEQ ID NO: 1983023 - protein, 8 aa, Staphylococcus
SESAQRTL

SEQ ID NO: 1983024 - protein, 9 aa, Staphylococcus
SESDDEDIE

SEQ ID NO: 1983025 - protein, 11 aa, Staphylococcus
SESDEEPTGAV

SEQ ID NO: 1983026 - protein, 7 aa, Staphylococcus
SESDNSS

SEQ ID NO: 1983027 - protein, 5 aa, Staphylococcus
SESDT

SEQ ID NO: 1983028 - protein, 13 aa, Staphylococcus
SESDTKVTDLEGS

SEQ ID NO: 1983029 - protein, 4 aa, Staphylococcus
SESE

SEQ ID NO: 1983030 - protein, 8 aa, Staphylococcus
SESEASHK

SEQ ID NO: 1983031 - protein, 8 aa, Staphylococcus
SESEDVQQ

SEQ ID NO: 1983032 - protein, 7 aa, Staphylococcus
SESEIET

SEQ ID NO: 1983033 - protein, 6 aa, Staphylococcus
SESELQ

SEQ ID NO: 1983034 - protein, 9 aa, Staphylococcus
SESEPTFQQ

SEQ ID NO: 1983035 - protein, 9 aa, Staphylococcus
SESEPTLQQ

SEQ ID NO: 1983036 - protein, 10 aa, Staphylococcus
SESEPTLSQK

SEQ ID NO: 1983037 - protein, 10 aa, Staphylococcus
SESEPTTQQK

SEQ ID NO: 1983038 - protein, 9 aa, Staphylococcus
SESEQEQLD

SEQ ID NO: 1983039 - protein, 6 aa, Staphylococcus
SESEYD

SEQ ID NO: 1983040 - protein, 7 aa, Staphylococcus
SESFNPK

SEQ ID NO: 1983041 - protein, 4 aa, Staphylococcus
SESG

SEQ ID NO: 1983042 - protein, 13 aa, Staphylococcus
SESGALPQGDFGT

SEQ ID NO: 1983043 - protein, 12 aa, Staphylococcus
SESGERMKEEVV

SEQ ID NO: 1983044 - protein, 9 aa, Staphylococcus
SESGGLGTI

SEQ ID NO: 1983045 - protein, 7 aa, Staphylococcus
SESGNAQ

SEQ ID NO: 1983046 - protein, 7 aa, Staphylococcus
SESGSYF

SEQ ID NO: 1983047 - protein, 4 aa, Staphylococcus
SESH

SEQ ID NO: 1983048 - protein, 4 aa, Staphylococcus
SESK

SEQ ID NO: 1983049 - protein, 13 aa, Staphylococcus
SESKKTIQGHEEE

SEQ ID NO: 1983050 - protein, 9 aa, Staphylococcus
SESKSIKTR

SEQ ID NO: 1983051 - protein, 17 aa, Staphylococcus
SESKSLKSRQVYPQDTN

SEQ ID NO: 1983052 - protein, 17 aa, Staphylococcus
SESKSYKAKQVFPQDTN

SEQ ID NO: 1983053 - protein, 7 aa, Staphylococcus
SESLESG

SEQ ID NO: 1983054 - protein, 17 aa, Staphylococcus
SESLETDNQLSSDLKEE

SEQ ID NO: 1983055 - protein, 6 aa, Staphylococcus
SESLGG

SEQ ID NO: 1983056 - protein, 9 aa, Staphylococcus
SESLSSIQR

SEQ ID NO: 1983057 - protein, 4 aa, Staphylococcus
SESM

SEQ ID NO: 1983058 - protein, 4 aa, Staphylococcus
SESN

SEQ ID NO: 1983059 - protein, 10 aa, Staphylococcus
SESNDAWSRS

SEQ ID NO: 1983060 - protein, 9 aa, Staphylococcus
SESNEITSK

SEQ ID NO: 1983061 - protein, 16 aa, Staphylococcus
SESNKNVSREKINNQT

SEQ ID NO: 1983062 - protein, 8 aa, Staphylococcus
SESPTTGI

SEQ ID NO: 1983063 - protein, 5 aa, Staphylococcus
SESQG

SEQ ID NO: 1983064 - protein, 18 aa, Staphylococcus
SESQKDDQGRDYPILHLK

SEQ ID NO: 1983065 - protein, 7 aa, Staphylococcus
SESQKTI

SEQ ID NO: 1983066 - protein, 5 aa, Staphylococcus
SESQL

SEQ ID NO: 1983067 - protein, 7 aa, Staphylococcus
SESSIDN

SEQ ID NO: 1983068 - protein, 6 aa, Staphylococcus
SESTIS

SEQ ID NO: 1983069 - protein, 5 aa, Staphylococcus
SESTP

SEQ ID NO: 1983070 - protein, 10 aa, Staphylococcus
SESTSLAPRK

SEQ ID NO: 1983071 - protein, 12 aa, Staphylococcus
SESTSQHNIGYT

SEQ ID NO: 1983072 - protein, 5 aa, Staphylococcus
SESVK

SEQ ID NO: 1983073 - protein, 13 aa, Staphylococcus
SESVSTPSGTDGF

SEQ ID NO: 1983074 - protein, 5 aa, Staphylococcus
SESYK

SEQ ID NO: 1983075 - protein, 13 aa, Staphylococcus
SESYNEEAGAHFT

SEQ ID NO: 1983076 - protein, 4 aa, Staphylococcus
SETA

SEQ ID NO: 1983077 - protein, 6 aa, Staphylococcus
SETAQT

SEQ ID NO: 1983078 - protein, 5 aa, Staphylococcus
SETDM

SEQ ID NO: 1983079 - protein, 6 aa, Staphylococcus
SETDPM

SEQ ID NO: 1983080 - protein, 5 aa, Staphylococcus
SETDY

SEQ ID NO: 1983081 - protein, 8 aa, Staphylococcus
SETEDTGQ

SEQ ID NO: 1983082 - protein, 6 aa, Staphylococcus
SETEQI

SEQ ID NO: 1983083 - protein, 16 aa, Staphylococcus
SETFESGALGLNYQVL

SEQ ID NO: 1983084 - protein, 5 aa, Staphylococcus
SETGE

SEQ ID NO: 1983085 - protein, 6 aa, Staphylococcus
SETGEA

SEQ ID NO: 1983086 - protein, 7 aa, Staphylococcus
SETGEAT

SEQ ID NO: 1983087 - protein, 14 aa, Staphylococcus
SETGEIDDPFGGSI

SEQ ID NO: 1983088 - protein, 8 aa, Staphylococcus
SETGISRN

SEQ ID NO: 1983089 - protein, 8 aa, Staphylococcus
SETGNAQS

SEQ ID NO: 1983090 - protein, 4 aa, Staphylococcus
SETH

SEQ ID NO: 1983091 - protein, 9 aa, Staphylococcus
SETHDDDTH

SEQ ID NO: 1983092 - protein, 18 aa, Staphylococcus
SETHDNSTYEDSKGSKSV

SEQ ID NO: 1983093 - protein, 14 aa, Staphylococcus
SETKKAVEMYIDSS

SEQ ID NO: 1983094 - protein, 7 aa, Staphylococcus
SETKNLE

SEQ ID NO: 1983095 - protein, 9 aa, Staphylococcus
SETKQPKGY

SEQ ID NO: 1983096 - protein, 5 aa, Staphylococcus
SETLG

SEQ ID NO: 1983097 - protein, 5 aa, Staphylococcus
SETMN

SEQ ID NO: 1983098 - protein, 8 aa, Staphylococcus
SETNLPSR

SEQ ID NO: 1983099 - protein, 9 aa, Staphylococcus
SETNQPKGY

SEQ ID NO: 1983100 - protein, 5 aa, Staphylococcus
SETPE

SEQ ID NO: 1983101 - protein, 32 aa, Staphylococcus
SETPEVGTSSKSDSSSESNAKESTSSSGTVTR

SEQ ID NO: 1983102 - protein, 25 aa, Staphylococcus
SETQAQMDKRMKEKSSGKVSKKEMK

SEQ ID NO: 1983103 - protein, 24 aa, Staphylococcus
SETQAQMNKRMKEKTNGKVSRKEM

SEQ ID NO: 1983104 - protein, 7 aa, Staphylococcus
SETQDYR

SEQ ID NO: 1983105 - protein, 24 aa, Staphylococcus
SETQEQMDRRHKNKGKSKVSKREM

SEQ ID NO: 1983106 - protein, 7 aa, Staphylococcus
SETQQRQ

SEQ ID NO: 1983107 - protein, 9 aa, Staphylococcus
SETQQSEIE

SEQ ID NO: 1983108 - protein, 5 aa, Staphylococcus
SETRA

SEQ ID NO: 1983109 - protein, 5 aa, Staphylococcus
SETSA

SEQ ID NO: 1983110 - protein, 11 aa, Staphylococcus
SETSGFTSHTN

SEQ ID NO: 1983111 - protein, 6 aa, Staphylococcus
SETSGV

SEQ ID NO: 1983112 - protein, 11 aa, Staphylococcus
SETSNKQPSID

SEQ ID NO: 1983113 - protein, 8 aa, Staphylococcus
SETSQNTH

SEQ ID NO: 1983114 - protein, 6 aa, Staphylococcus
SETSSF

SEQ ID NO: 1983115 - protein, 5 aa, Staphylococcus
SETSV

SEQ ID NO: 1983116 - protein, 11 aa, Staphylococcus
SETTSLEPSKK

SEQ ID NO: 1983117 - protein, 4 aa, Staphylococcus
SETV

SEQ ID NO: 1983118 - protein, 13 aa, Staphylococcus
SETVEAGNSIQNI

SEQ ID NO: 1983119 - protein, 15 aa, Staphylococcus
SETVEKGKSIQSEAR

SEQ ID NO: 1983120 - protein, 13 aa, Staphylococcus
SETVTDVSEQRTV

SEQ ID NO: 1983121 - protein, 13 aa, Staphylococcus
SEVAEIAQSGGFN

SEQ ID NO: 1983122 - protein, 50 aa, Staphylococcus
SEVAGKSNDVVRKEDVNNSQNQAKQSSQNDNKPSGNEAKKSSDKPSKPVI

SEQ ID NO: 1983123 - protein, 4 aa, Staphylococcus
SEVD

SEQ ID NO: 1983124 - protein, 5 aa, Staphylococcus
SEVDE

SEQ ID NO: 1983125 - protein, 10 aa, Staphylococcus
SEVDEDTFAT

SEQ ID NO: 1983126 - protein, 18 aa, Staphylococcus
SEVDKRNKAGECLEVING

SEQ ID NO: 1983127 - protein, 4 aa, Staphylococcus
SEVE

SEQ ID NO: 1983128 - protein, 5 aa, Staphylococcus
SEVED

SEQ ID NO: 1983129 - protein, 6 aa, Staphylococcus
SEVEGI

SEQ ID NO: 1983130 - protein, 8 aa, Staphylococcus
SEVEKNGY

SEQ ID NO: 1983131 - protein, 5 aa, Staphylococcus
SEVEQ

SEQ ID NO: 1983132 - protein, 9 aa, Staphylococcus
SEVETAKRL

SEQ ID NO: 1983133 - protein, 11 aa, Staphylococcus
SEVETAKRLGV

SEQ ID NO: 1983134 - protein, 5 aa, Staphylococcus
SEVGK

SEQ ID NO: 1983135 - protein, 7 aa, Staphylococcus
SEVGPDL

SEQ ID NO: 1983136 - protein, 14 aa, Staphylococcus
SEVKEEKKQIEKRY

SEQ ID NO: 1983137 - protein, 11 aa, Staphylococcus
SEVKKEDKNGV

SEQ ID NO: 1983138 - protein, 5 aa, Staphylococcus
SEVKT

SEQ ID NO: 1983139 - protein, 4 aa, Staphylococcus
SEVL

SEQ ID NO: 1983140 - protein, 4 aa, Staphylococcus
SEVN

SEQ ID NO: 1983141 - protein, 6 aa, Staphylococcus
SEVNNQ

SEQ ID NO: 1983142 - protein, 16 aa, Staphylococcus
SEVNPDDLNQDNQSKL

SEQ ID NO: 1983143 - protein, 6 aa, Staphylococcus
SEVNRD

SEQ ID NO: 1983144 - protein, 13 aa, Staphylococcus
SEVPGAGAAGGTG

SEQ ID NO: 1983145 - protein, 4 aa, Staphylococcus
SEVQ

SEQ ID NO: 1983146 - protein, 5 aa, Staphylococcus
SEVQD

SEQ ID NO: 1983147 - protein, 10 aa, Staphylococcus
SEVQGGQGNI

SEQ ID NO: 1983148 - protein, 8 aa, Staphylococcus
SEVSDETF

SEQ ID NO: 1983149 - protein, 9 aa, Staphylococcus
SEVSDETTN

SEQ ID NO: 1983150 - protein, 11 aa, Staphylococcus
SEVSEGQHAPD

SEQ ID NO: 1983151 - protein, 8 aa, Staphylococcus
SEVSPNNK

SEQ ID NO: 1983152 - protein, 6 aa, Staphylococcus
SEVTDQ

SEQ ID NO: 1983153 - protein, 9 aa, Staphylococcus
SEVTDQTQN

SEQ ID NO: 1983154 - protein, 8 aa, Staphylococcus
SEVTDQTR

SEQ ID NO: 1983155 - protein, 9 aa, Staphylococcus
SEVTEQTTN

SEQ ID NO: 1983156 - protein, 8 aa, Staphylococcus
SEVTGPHE

SEQ ID NO: 1983157 - protein, 15 aa, Staphylococcus
SEVTKEDRQHQNGHK

SEQ ID NO: 1983158 - protein, 15 aa, Staphylococcus
SEVTKSDRQQQNGHK

SEQ ID NO: 1983159 - protein, 14 aa, Staphylococcus
SEVVKGSSTPGLDT

SEQ ID NO: 1983160 - protein, 7 aa, Staphylococcus
SEWSRSQ

SEQ ID NO: 1983161 - protein, 10 aa, Staphylococcus
SEWSSRKASL

SEQ ID NO: 1983162 - protein, 7 aa, Staphylococcus
SEYDPIS

SEQ ID NO: 1983163 - protein, 11 aa, Staphylococcus
SEYDVAPTADV

SEQ ID NO: 1983164 - protein, 4 aa, Staphylococcus
SEYE

SEQ ID NO: 1983165 - protein, 13 aa, Staphylococcus
SEYEGAKDKETQR

SEQ ID NO: 1983166 - protein, 6 aa, Staphylococcus
SEYGSS

SEQ ID NO: 1983167 - protein, 9 aa, Staphylococcus
SEYIEQAKD

SEQ ID NO: 1983168 - protein, 7 aa, Staphylococcus
SEYKNDD

SEQ ID NO: 1983169 - protein, 9 aa, Staphylococcus
SEYNRQNNN

SEQ ID NO: 1983170 - protein, 16 aa, Staphylococcus
SEYPRLSDSEISEIIM

SEQ ID NO: 1983171 - protein, 7 aa, Staphylococcus
SEYRDTK

SEQ ID NO: 1983172 - protein, 8 aa, Staphylococcus
SEYRGQGI

SEQ ID NO: 1983173 - protein, 53 aa, Staphylococcus
SEYTEEQEVKNEDTSTVENVEDTTSDSDNSSNDSSNEESSEETAVDPKDEEIQ

SEQ ID NO: 1983174 - protein, 6 aa, Staphylococcus
SEYTKE

SEQ ID NO: 1983175 - protein, 5 aa, Staphylococcus
SEYTS

SEQ ID NO: 1983176 - protein, 8 aa, Staphylococcus
SFAEANEA

SEQ ID NO: 1983177 - protein, 11 aa, Staphylococcus
SFAESDNDGMS

SEQ ID NO: 1983178 - protein, 14 aa, Staphylococcus
SFAGSAIGGIKETQ

SEQ ID NO: 1983179 - protein, 11 aa, Staphylococcus
SFAKKYGDLGN

SEQ ID NO: 1983180 - protein, 10 aa, Staphylococcus
SFANSNEENQ

SEQ ID NO: 1983181 - protein, 12 aa, Staphylococcus
SFAPKGQDPSMI

SEQ ID NO: 1983182 - protein, 6 aa, Staphylococcus
SFASDI

SEQ ID NO: 1983183 - protein, 8 aa, Staphylococcus
SFASKNKG

SEQ ID NO: 1983184 - protein, 8 aa, Staphylococcus
SFATDYGE

SEQ ID NO: 1983185 - protein, 8 aa, Staphylococcus
SFDAKQPL

SEQ ID NO: 1983186 - protein, 11 aa, Staphylococcus
SFDASSKKTAD

SEQ ID NO: 1983187 - protein, 4 aa, Staphylococcus
SFDD

SEQ ID NO: 1983188 - protein, 4 aa, Staphylococcus
SFDE

SEQ ID NO: 1983189 - protein, 5 aa, Staphylococcus
SFDEQ

SEQ ID NO: 1983190 - protein, 5 aa, Staphylococcus
SFDGE

SEQ ID NO: 1983191 - protein, 6 aa, Staphylococcus
SFDGEE

SEQ ID NO: 1983192 - protein, 10 aa, Staphylococcus
SFDKKTKEGN

SEQ ID NO: 1983193 - protein, 10 aa, Staphylococcus
SFDLNGKSYT

SEQ ID NO: 1983194 - protein, 16 aa, Staphylococcus
SFDRDESVKSRLTTEK

SEQ ID NO: 1983195 - protein, 9 aa, Staphylococcus
SFDYKTNKS

SEQ ID NO: 1983196 - protein, 18 aa, Staphylococcus
SFEAGDLSVPEGKTYAPA

SEQ ID NO: 1983197 - protein, 6 aa, Staphylococcus
SFEDLK

SEQ ID NO: 1983198 - protein, 8 aa, Staphylococcus
SFEDTDKN

SEQ ID NO: 1983199 - protein, 6 aa, Staphylococcus
SFEEGE

SEQ ID NO: 1983200 - protein, 5 aa, Staphylococcus
SFEIK

SEQ ID NO: 1983201 - protein, 11 aa, Staphylococcus
SFEQRQTINQT

SEQ ID NO: 1983202 - protein, 4 aa, Staphylococcus
SFER

SEQ ID NO: 1983203 - protein, 4 aa, Staphylococcus
SFES

SEQ ID NO: 1983204 - protein, 5 aa, Staphylococcus
SFESA

SEQ ID NO: 1983205 - protein, 6 aa, Staphylococcus
SFEVRG

SEQ ID NO: 1983206 - protein, 5 aa, Staphylococcus
SFGAK

SEQ ID NO: 1983207 - protein, 6 aa, Staphylococcus
SFGEGK

SEQ ID NO: 1983208 - protein, 10 aa, Staphylococcus
SFGGETKHEV

SEQ ID NO: 1983209 - protein, 13 aa, Staphylococcus
SFGITGKEAEEAL

SEQ ID NO: 1983210 - protein, 6 aa, Staphylococcus
SFGKEN

SEQ ID NO: 1983211 - protein, 9 aa, Staphylococcus
SFGNIPSRV

SEQ ID NO: 1983212 - protein, 19 aa, Staphylococcus
SFGQKEEHHAREITPDEIR

SEQ ID NO: 1983213 - protein, 20 aa, Staphylococcus
SFGQQQEHHAREITTEEIEQ

SEQ ID NO: 1983214 - protein, 7 aa, Staphylococcus
SFGQTEE

SEQ ID NO: 1983215 - protein, 4 aa, Staphylococcus
SFHP

SEQ ID NO: 1983216 - protein, 17 aa, Staphylococcus
SFIGSAQQRNKIKSQFP

SEQ ID NO: 1983217 - protein, 10 aa, Staphylococcus
SFIGSSEQRL

SEQ ID NO: 1983218 - protein, 8 aa, Staphylococcus
SFKDQPVN

SEQ ID NO: 1983219 - protein, 10 aa, Staphylococcus
SFKDSKQTMQ

SEQ ID NO: 1983220 - protein, 14 aa, Staphylococcus
SFKESLSAAEAGRA

SEQ ID NO: 1983221 - protein, 14 aa, Staphylococcus
SFKESMSAKQASIA

SEQ ID NO: 1983222 - protein, 17 aa, Staphylococcus
SFKPDMQELPSQAIAEA

SEQ ID NO: 1983223 - protein, 6 aa, Staphylococcus
SFKPDV

SEQ ID NO: 1983224 - protein, 8 aa, Staphylococcus
SFKSENDS

SEQ ID NO: 1983225 - protein, 11 aa, Staphylococcus
SFLNNDSESIL

SEQ ID NO: 1983226 - protein, 8 aa, Staphylococcus
SFNAKPSE

SEQ ID NO: 1983227 - protein, 14 aa, Staphylococcus
SFNDSNNDGIGDLP

SEQ ID NO: 1983228 - protein, 15 aa, Staphylococcus
SFNDTTGDGKGDLNG

SEQ ID NO: 1983229 - protein, 14 aa, Staphylococcus
SFNDTTGNGEGDIN

SEQ ID NO: 1983230 - protein, 14 aa, Staphylococcus
SFNDTTGNGEGDLK

SEQ ID NO: 1983231 - protein, 14 aa, Staphylococcus
SFNDTTGNGEGDLQ

SEQ ID NO: 1983232 - protein, 12 aa, Staphylococcus
SFNDTTGNGVGD

SEQ ID NO: 1983233 - protein, 14 aa, Staphylococcus
SFNDTTGSGEGDLQ

SEQ ID NO: 1983234 - protein, 4 aa, Staphylococcus
SFNE

SEQ ID NO: 1983235 - protein, 14 aa, Staphylococcus
SFNGREAWDNSDRP

SEQ ID NO: 1983236 - protein, 14 aa, Staphylococcus
SFNGREAWNNEDRP

SEQ ID NO: 1983237 - protein, 7 aa, Staphylococcus
SFNNGVG

SEQ ID NO: 1983238 - protein, 12 aa, Staphylococcus
SFNNPTFTDAQN

SEQ ID NO: 1983239 - protein, 7 aa, Staphylococcus
SFNPSGH

SEQ ID NO: 1983240 - protein, 6 aa, Staphylococcus
SFNQQD

SEQ ID NO: 1983241 - protein, 8 aa, Staphylococcus
SFNQSEAD

SEQ ID NO: 1983242 - protein, 9 aa, Staphylococcus
SFNSKTRFQ

SEQ ID NO: 1983243 - protein, 7 aa, Staphylococcus
SFNSNDL

SEQ ID NO: 1983244 - protein, 7 aa, Staphylococcus
SFNSPNG

SEQ ID NO: 1983245 - protein, 10 aa, Staphylococcus
SFNTTNKTKN

SEQ ID NO: 1983246 - protein, 5 aa, Staphylococcus
SFPDQ

SEQ ID NO: 1983247 - protein, 4 aa, Staphylococcus
SFPT

SEQ ID NO: 1983248 - protein, 15 aa, Staphylococcus
SFPTFEKGSSKEVAL

SEQ ID NO: 1983249 - protein, 7 aa, Staphylococcus
SFQDEVN

SEQ ID NO: 1983250 - protein, 16 aa, Staphylococcus
SFQDEVNGYRKRYDTE

SEQ ID NO: 1983251 - protein, 14 aa, Staphylococcus
SFQDGRQRLENEGL

SEQ ID NO: 1983252 - protein, 10 aa, Staphylococcus
SFQKNSSIDF

SEQ ID NO: 1983253 - protein, 16 aa, Staphylococcus
SFQNEVDGYRKRYDTE

SEQ ID NO: 1983254 - protein, 13 aa, Staphylococcus
SFQPGRERLEEAG

SEQ ID NO: 1983255 - protein, 13 aa, Staphylococcus
SFQSGRQRLEDAG

SEQ ID NO: 1983256 - protein, 5 aa, Staphylococcus
SFRSA

SEQ ID NO: 1983257 - protein, 6 aa, Staphylococcus
SFSDGE

SEQ ID NO: 1983258 - protein, 7 aa, Staphylococcus
SFSEKNY

SEQ ID NO: 1983259 - protein, 7 aa, Staphylococcus
SFSGDPK

SEQ ID NO: 1983260 - protein, 13 aa, Staphylococcus
SFSKKGKDDRMKA

SEQ ID NO: 1983261 - protein, 14 aa, Staphylococcus
SFSKKGKEDRFKSK

SEQ ID NO: 1983262 - protein, 13 aa, Staphylococcus
SFSKTSDQSPNSS

SEQ ID NO: 1983263 - protein, 6 aa, Staphylococcus
SFSNNG

SEQ ID NO: 1983264 - protein, 14 aa, Staphylococcus
SFSPPEVDTSQLVM

SEQ ID NO: 1983265 - protein, 7 aa, Staphylococcus
SFSSERR

SEQ ID NO: 1983266 - protein, 8 aa, Staphylococcus
SFSSKSEL

SEQ ID NO: 1983267 - protein, 5 aa, Staphylococcus
SFSTE

SEQ ID NO: 1983268 - protein, 18 aa, Staphylococcus
SFSTGSSIMPQKKNPDMA

SEQ ID NO: 1983269 - protein, 5 aa, Staphylococcus
SFSYT

SEQ ID NO: 1983270 - protein, 7 aa, Staphylococcus
SFTDADK

SEQ ID NO: 1983271 - protein, 12 aa, Staphylococcus
SFTDNEERTMGL

SEQ ID NO: 1983272 - protein, 5 aa, Staphylococcus
SFTET

SEQ ID NO: 1983273 - protein, 4 aa, Staphylococcus
SFTG

SEQ ID NO: 1983274 - protein, 5 aa, Staphylococcus
SFTGG

SEQ ID NO: 1983275 - protein, 13 aa, Staphylococcus
SFTGGVAAMHLGY

SEQ ID NO: 1983276 - protein, 5 aa, Staphylococcus
SFTGK

SEQ ID NO: 1983277 - protein, 7 aa, Staphylococcus
SFTGSTD

SEQ ID NO: 1983278 - protein, 11 aa, Staphylococcus
SFTGSTSVGYG

SEQ ID NO: 1983279 - protein, 6 aa, Staphylococcus
SFTHED

SEQ ID NO: 1983280 - protein, 7 aa, Staphylococcus
SFTHEDG

SEQ ID NO: 1983281 - protein, 10 aa, Staphylococcus
SFTKRSENLF

SEQ ID NO: 1983282 - protein, 4 aa, Staphylococcus
SFTL

SEQ ID NO: 1983283 - protein, 4 aa, Staphylococcus
SFTN

SEQ ID NO: 1983284 - protein, 12 aa, Staphylococcus
SFTPEESPDPGF

SEQ ID NO: 1983285 - protein, 4 aa, Staphylococcus
SFTV

SEQ ID NO: 1983286 - protein, 6 aa, Staphylococcus
SFTYKT

SEQ ID NO: 1983287 - protein, 8 aa, Staphylococcus
SFVPKPGD

SEQ ID NO: 1983288 - protein, 4 aa, Staphylococcus
SFVT

SEQ ID NO: 1983289 - protein, 15 aa, Staphylococcus
SGADAALNAFDYIIR

SEQ ID NO: 1983290 - protein, 13 aa, Staphylococcus
SGADEFEGVNEYD

SEQ ID NO: 1983291 - protein, 8 aa, Staphylococcus
SGAEAVEN

SEQ ID NO: 1983292 - protein, 9 aa, Staphylococcus
SGAESYKEG

SEQ ID NO: 1983293 - protein, 4 aa, Staphylococcus
SGAG

SEQ ID NO: 1983294 - protein, 7 aa, Staphylococcus
SGAGAYS

SEQ ID NO: 1983295 - protein, 7 aa, Staphylococcus
SGAGNAA

SEQ ID NO: 1983296 - protein, 7 aa, Staphylococcus
SGAGPTI

SEQ ID NO: 1983297 - protein, 7 aa, Staphylococcus
SGAGPTV

SEQ ID NO: 1983298 - protein, 25 aa, Staphylococcus
SGAGRKGKKGKRSQMENMLKGMNLP

SEQ ID NO: 1983299 - protein, 4 aa, Staphylococcus
SGAI

SEQ ID NO: 1983300 - protein, 8 aa, Staphylococcus
SGAISKSN

SEQ ID NO: 1983301 - protein, 11 aa, Staphylococcus
SGAISKSNTTA

SEQ ID NO: 1983302 - protein, 8 aa, Staphylococcus
SGAKLSSS

SEQ ID NO: 1983303 - protein, 6 aa, Staphylococcus
SGAKVE

SEQ ID NO: 1983304 - protein, 6 aa, Staphylococcus
SGALGI

SEQ ID NO: 1983305 - protein, 7 aa, Staphylococcus
SGAMTSN

SEQ ID NO: 1983306 - protein, 4 aa, Staphylococcus
SGAN

SEQ ID NO: 1983307 - protein, 15 aa, Staphylococcus
SGANAALNAFDYLIR

SEQ ID NO: 1983308 - protein, 15 aa, Staphylococcus
SGANAALSAFDYIIR

SEQ ID NO: 1983309 - protein, 20 aa, Staphylococcus
SGANGSKPRDVYITEADLNK

SEQ ID NO: 1983310 - protein, 20 aa, Staphylococcus
SGANGSKPRDVYITEADLNQ

SEQ ID NO: 1983311 - protein, 20 aa, Staphylococcus
SGANGSKPRDVYITESDLNE

SEQ ID NO: 1983312 - protein, 5 aa, Staphylococcus
SGASE

SEQ ID NO: 1983313 - protein, 24 aa, Staphylococcus
SGASNLSESYKNNLQTLKTKAREA

SEQ ID NO: 1983314 - protein, 24 aa, Staphylococcus
SGASNPPDEYKKNVEELQSKAREA

SEQ ID NO: 1983315 - protein, 4 aa, Staphylococcus
SGAT

SEQ ID NO: 1983316 - protein, 9 aa, Staphylococcus
SGATESNNM

SEQ ID NO: 1983317 - protein, 12 aa, Staphylococcus
SGATESNNTAIK

SEQ ID NO: 1983318 - protein, 11 aa, Staphylococcus
SGATRDSIDEW

SEQ ID NO: 1983319 - protein, 7 aa, Staphylococcus
SGAVTED

SEQ ID NO: 1983320 - protein, 7 aa, Staphylococcus
SGAWYSY

SEQ ID NO: 1983321 - protein, 8 aa, Staphylococcus
SGAYDNQD

SEQ ID NO: 1983322 - protein, 13 aa, Staphylococcus
SGAYYGGDTLKST

SEQ ID NO: 1983323 - protein, 6 aa, Staphylococcus
SGCGKS

SEQ ID NO: 1983324 - protein, 8 aa, Staphylococcus
SGCGKSTT

SEQ ID NO: 1983325 - protein, 6 aa, Staphylococcus
SGDAFP

SEQ ID NO: 1983326 - protein, 7 aa, Staphylococcus
SGDEDIV

SEQ ID NO: 1983327 - protein, 10 aa, Staphylococcus
SGDEDYKEEL

SEQ ID NO: 1983328 - protein, 6 aa, Staphylococcus
SGDEFP

SEQ ID NO: 1983329 - protein, 7 aa, Staphylococcus
SGDEGLE

SEQ ID NO: 1983330 - protein, 8 aa, Staphylococcus
SGDEGLEQ

SEQ ID NO: 1983331 - protein, 6 aa, Staphylococcus
SGDEIV

SEQ ID NO: 1983332 - protein, 17 aa, Staphylococcus
SGDITIDGQSITKARGK

SEQ ID NO: 1983333 - protein, 17 aa, Staphylococcus
SGDITIEGKSITKAKGK

SEQ ID NO: 1983334 - protein, 6 aa, Staphylococcus
SGDKID

SEQ ID NO: 1983335 - protein, 7 aa, Staphylococcus
SGDKPSF

SEQ ID NO: 1983336 - protein, 6 aa, Staphylococcus
SGDNNH

SEQ ID NO: 1983337 - protein, 7 aa, Staphylococcus
SGDPDLL

SEQ ID NO: 1983338 - protein, 12 aa, Staphylococcus
SGDPKDIERADQ

SEQ ID NO: 1983339 - protein, 7 aa, Staphylococcus
SGDQAQG

SEQ ID NO: 1983340 - protein, 7 aa, Staphylococcus
SGDQFPR

SEQ ID NO: 1983341 - protein, 11 aa, Staphylococcus
SGDQSQNKDNY

SEQ ID NO: 1983342 - protein, 4 aa, Staphylococcus
SGDS

SEQ ID NO: 1983343 - protein, 9 aa, Staphylococcus
SGDSEQKHR

SEQ ID NO: 1983344 - protein, 10 aa, Staphylococcus
SGDSKREHLK

SEQ ID NO: 1983345 - protein, 13 aa, Staphylococcus
SGDSLMDDAGKHA

SEQ ID NO: 1983346 - protein, 15 aa, Staphylococcus
SGDSLMDDDTKKHLQ

SEQ ID NO: 1983347 - protein, 15 aa, Staphylococcus
SGDSLMDDDTKSHLQ

SEQ ID NO: 1983348 - protein, 16 aa, Staphylococcus
SGDSLMDDQTKQKLQS

SEQ ID NO: 1983349 - protein, 8 aa, Staphylococcus
SGDTGADC

SEQ ID NO: 1983350 - protein, 8 aa, Staphylococcus
SGDTVHAT

SEQ ID NO: 1983351 - protein, 8 aa, Staphylococcus
SGDTVNVG

SEQ ID NO: 1983352 - protein, 5 aa, Staphylococcus
SGDVD

SEQ ID NO: 1983353 - protein, 5 aa, Staphylococcus
SGDYF

SEQ ID NO: 1983354 - protein, 5 aa, Staphylococcus
SGEAF

SEQ ID NO: 1983355 - protein, 6 aa, Staphylococcus
SGEARE

SEQ ID NO: 1983356 - protein, 7 aa, Staphylococcus
SGEASKH

SEQ ID NO: 1983357 - protein, 7 aa, Staphylococcus
SGEASVG

SEQ ID NO: 1983358 - protein, 16 aa, Staphylococcus
SGEATTNERIDPPLPF

SEQ ID NO: 1983359 - protein, 16 aa, Staphylococcus
SGEDATGIKTSTESGQ

SEQ ID NO: 1983360 - protein, 14 aa, Staphylococcus
SGEEIGDTLSGHEE

SEQ ID NO: 1983361 - protein, 22 aa, Staphylococcus
SGEEITEQPTNFKERARRFFKG

SEQ ID NO: 1983362 - protein, 8 aa, Staphylococcus
SGEETKHG

SEQ ID NO: 1983363 - protein, 19 aa, Staphylococcus
SGEEVSVDNPANMPDRDKI

SEQ ID NO: 1983364 - protein, 13 aa, Staphylococcus
SGEIKNKKGVNLP

SEQ ID NO: 1983365 - protein, 6 aa, Staphylococcus
SGEINL

SEQ ID NO: 1983366 - protein, 6 aa, Staphylococcus
SGEKER

SEQ ID NO: 1983367 - protein, 5 aa, Staphylococcus
SGELA

SEQ ID NO: 1983368 - protein, 5 aa, Staphylococcus
SGELE

SEQ ID NO: 1983369 - protein, 7 aa, Staphylococcus
SGELKDK

SEQ ID NO: 1983370 - protein, 13 aa, Staphylococcus
SGELKNKKGVNLP

SEQ ID NO: 1983371 - protein, 18 aa, Staphylococcus
SGELSHEGPDDEMFYRLK

SEQ ID NO: 1983372 - protein, 4 aa, Staphylococcus
SGEM

SEQ ID NO: 1983373 - protein, 7 aa, Staphylococcus
SGEPQGL

SEQ ID NO: 1983374 - protein, 4 aa, Staphylococcus
SGEQ

SEQ ID NO: 1983375 - protein, 15 aa, Staphylococcus
SGEQSIEDALDQFKN

SEQ ID NO: 1983376 - protein, 6 aa, Staphylococcus
SGERPT

SEQ ID NO: 1983377 - protein, 6 aa, Staphylococcus
SGERYQ

SEQ ID NO: 1983378 - protein, 13 aa, Staphylococcus
SGETAAGLYPEEA

SEQ ID NO: 1983379 - protein, 5 aa, Staphylococcus
SGETV

SEQ ID NO: 1983380 - protein, 4 aa, Staphylococcus
SGEV

SEQ ID NO: 1983381 - protein, 9 aa, Staphylococcus
SGEVAGGIH

SEQ ID NO: 1983382 - protein, 6 aa, Staphylococcus
SGEVDP

SEQ ID NO: 1983383 - protein, 7 aa, Staphylococcus
SGEVPVT

SEQ ID NO: 1983384 - protein, 6 aa, Staphylococcus
SGEYAV

SEQ ID NO: 1983385 - protein, 10 aa, Staphylococcus
SGEYSMTKAA

SEQ ID NO: 1983386 - protein, 8 aa, Staphylococcus
SGFEPKEV

SEQ ID NO: 1983387 - protein, 8 aa, Staphylococcus
SGFLDQDE

SEQ ID NO: 1983388 - protein, 7 aa, Staphylococcus
SGFNKSG

SEQ ID NO: 1983389 - protein, 11 aa, Staphylococcus
SGFRDGSYETK

SEQ ID NO: 1983390 - protein, 7 aa, Staphylococcus
SGFSNKY

SEQ ID NO: 1983391 - protein, 4 aa, Staphylococcus
SGFT

SEQ ID NO: 1983392 - protein, 12 aa, Staphylococcus
SGFTDADKLSYH

SEQ ID NO: 1983393 - protein, 9 aa, Staphylococcus
SGFYKNKAK

SEQ ID NO: 1983394 - protein, 9 aa, Staphylococcus
SGFYRNKGK

SEQ ID NO: 1983395 - protein, 6 aa, Staphylococcus
SGGAER

SEQ ID NO: 1983396 - protein, 20 aa, Staphylococcus
SGGDQKVRGHGGYVGDDQIP

SEQ ID NO: 1983397 - protein, 22 aa, Staphylococcus
SGGDTPPNNVGQSEWASRQEAL

SEQ ID NO: 1983398 - protein, 11 aa, Staphylococcus
SGGDVGGSKNY

SEQ ID NO: 1983399 - protein, 24 aa, Staphylococcus
SGGEIGALTGPSLMPGGQQEAYNK

SEQ ID NO: 1983400 - protein, 5 aa, Staphylococcus
SGGEK

SEQ ID NO: 1983401 - protein, 7 aa, Staphylococcus
SGGEKQR

SEQ ID NO: 1983402 - protein, 9 aa, Staphylococcus
SGGERGTQI

SEQ ID NO: 1983403 - protein, 6 aa, Staphylococcus
SGGERQ

SEQ ID NO: 1983404 - protein, 6 aa, Staphylococcus
SGGERV

SEQ ID NO: 1983405 - protein, 22 aa, Staphylococcus
SGGEVGALTGPSLMPGGQEAAF

SEQ ID NO: 1983406 - protein, 24 aa, Staphylococcus
SGGEVGALTGPSLMPGGQEDAYNK

SEQ ID NO: 1983407 - protein, 4 aa, Staphylococcus
SGGF

SEQ ID NO: 1983408 - protein, 5 aa, Staphylococcus
SGGFD

SEQ ID NO: 1983409 - protein, 18 aa, Staphylococcus
SGGFGVKDTTKTESSYRT

SEQ ID NO: 1983410 - protein, 5 aa, Staphylococcus
SGGFN

SEQ ID NO: 1983411 - protein, 11 aa, Staphylococcus
SGGGAVYHDKG

SEQ ID NO: 1983412 - protein, 11 aa, Staphylococcus
SGGGAVYHDQG

SEQ ID NO: 1983413 - protein, 18 aa, Staphylococcus
SGGGEERLHGQSSVGVGG

SEQ ID NO: 1983414 - protein, 9 aa, Staphylococcus
SGGGEVMSG

SEQ ID NO: 1983415 - protein, 9 aa, Staphylococcus
SGGGGGIPV

SEQ ID NO: 1983416 - protein, 8 aa, Staphylococcus
SGGGGNAQ

SEQ ID NO: 1983417 - protein, 8 aa, Staphylococcus
SGGGGNPE

SEQ ID NO: 1983418 - protein, 7 aa, Staphylococcus
SGGHRGA

SEQ ID NO: 1983419 - protein, 6 aa, Staphylococcus
SGGIKG

SEQ ID NO: 1983420 - protein, 9 aa, Staphylococcus
SGGILTSEP

SEQ ID NO: 1983421 - protein, 13 aa, Staphylococcus
SGGIQEEAPSLGK

SEQ ID NO: 1983422 - protein, 12 aa, Staphylococcus
SGGIQEEAPSLN

SEQ ID NO: 1983423 - protein, 13 aa, Staphylococcus
SGGIQEEAPSLNK

SEQ ID NO: 1983424 - protein, 30 aa, Staphylococcus
SGGKGTAKEKIKTLNENGVKTADTPSEIGS

SEQ ID NO: 1983425 - protein, 12 aa, Staphylococcus
SGGKGTASEKIK

SEQ ID NO: 1983426 - protein, 9 aa, Staphylococcus
SGGKHHQYG

SEQ ID NO: 1983427 - protein, 6 aa, Staphylococcus
SGGKRV

SEQ ID NO: 1983428 - protein, 5 aa, Staphylococcus
SGGLS

SEQ ID NO: 1983429 - protein, 4 aa, Staphylococcus
SGGM

SEQ ID NO: 1983430 - protein, 6 aa, Staphylococcus
SGGNSS

SEQ ID NO: 1983431 - protein, 8 aa, Staphylococcus
SGGNSSAL

SEQ ID NO: 1983432 - protein, 8 aa, Staphylococcus
SGGNSSML

SEQ ID NO: 1983433 - protein, 7 aa, Staphylococcus
SGGPKGI

SEQ ID NO: 1983434 - protein, 11 aa, Staphylococcus
SGGPNSVYEEG

SEQ ID NO: 1983435 - protein, 16 aa, Staphylococcus
SGGPNSVYEEGSYTID

SEQ ID NO: 1983436 - protein, 9 aa, Staphylococcus
SGGQDSTLA

SEQ ID NO: 1983437 - protein, 10 aa, Staphylococcus
SGGQDSTLAG

SEQ ID NO: 1983438 - protein, 10 aa, Staphylococcus
SGGQDSTLTG

SEQ ID NO: 1983439 - protein, 12 aa, Staphylococcus
SGGQPQDKIPEF

SEQ ID NO: 1983440 - protein, 26 aa, Staphylococcus
SGGQPQSAIPEFGQATPLGRAGQPVE

SEQ ID NO: 1983441 - protein, 14 aa, Staphylococcus
SGGQPQSKIPSFGQ

SEQ ID NO: 1983442 - protein, 8 aa, Staphylococcus
SGGRNYKD

SEQ ID NO: 1983443 - protein, 8 aa, Staphylococcus
SGGSSAKY

SEQ ID NO: 1983444 - protein, 10 aa, Staphylococcus
SGGSSEKYNQ

SEQ ID NO: 1983445 - protein, 11 aa, Staphylococcus
SGGSSEKYNQY

SEQ ID NO: 1983446 - protein, 11 aa, Staphylococcus
SGGSTRESIDE

SEQ ID NO: 1983447 - protein, 8 aa, Staphylococcus
SGGSVAGS

SEQ ID NO: 1983448 - protein, 7 aa, Staphylococcus
SGGTDNH

SEQ ID NO: 1983449 - protein, 7 aa, Staphylococcus
SGGYEPV

SEQ ID NO: 1983450 - protein, 12 aa, Staphylococcus
SGGYGNQKEKTF

SEQ ID NO: 1983451 - protein, 12 aa, Staphylococcus
SGGYSTGYQPIT

SEQ ID NO: 1983452 - protein, 9 aa, Staphylococcus
SGHAPHIEE

SEQ ID NO: 1983453 - protein, 10 aa, Staphylococcus
SGHAPHIEEP

SEQ ID NO: 1983454 - protein, 12 aa, Staphylococcus
SGHAPHIEEPEK

SEQ ID NO: 1983455 - protein, 9 aa, Staphylococcus
SGHAPYVEE

SEQ ID NO: 1983456 - protein, 5 aa, Staphylococcus
SGHDS

SEQ ID NO: 1983457 - protein, 6 aa, Staphylococcus
SGHFTT

SEQ ID NO: 1983458 - protein, 5 aa, Staphylococcus
SGHIK

SEQ ID NO: 1983459 - protein, 6 aa, Staphylococcus
SGHIQG

SEQ ID NO: 1983460 - protein, 9 aa, Staphylococcus
SGHKKAVDD

SEQ ID NO: 1983461 - protein, 6 aa, Staphylococcus
SGHLQQ

SEQ ID NO: 1983462 - protein, 13 aa, Staphylococcus
SGHLTDRQSKTRI

SEQ ID NO: 1983463 - protein, 7 aa, Staphylococcus
SGHPAVQ

SEQ ID NO: 1983464 - protein, 5 aa, Staphylococcus
SGHPD

SEQ ID NO: 1983465 - protein, 7 aa, Staphylococcus
SGHPDFS

SEQ ID NO: 1983466 - protein, 11 aa, Staphylococcus
SGHRGALPHGV

SEQ ID NO: 1983467 - protein, 4 aa, Staphylococcus
SGHT

SEQ ID NO: 1983468 - protein, 5 aa, Staphylococcus
SGHTG

SEQ ID NO: 1983469 - protein, 14 aa, Staphylococcus
SGHTTADLGGSYKT

SEQ ID NO: 1983470 - protein, 5 aa, Staphylococcus
SGHTV

SEQ ID NO: 1983471 - protein, 11 aa, Staphylococcus
SGHYAASKAAL

SEQ ID NO: 1983472 - protein, 15 aa, Staphylococcus
SGHYTERGEDQGYGY

SEQ ID NO: 1983473 - protein, 14 aa, Staphylococcus
SGHYTERGNEQGFG

SEQ ID NO: 1983474 - protein, 10 aa, Staphylococcus
SGIAAPAYAG

SEQ ID NO: 1983475 - protein, 9 aa, Staphylococcus
SGIASGQAI

SEQ ID NO: 1983476 - protein, 6 aa, Staphylococcus
SGICSE

SEQ ID NO: 1983477 - protein, 4 aa, Staphylococcus
SGID

SEQ ID NO: 1983478 - protein, 9 aa, Staphylococcus
SGIEDADVP

SEQ ID NO: 1983479 - protein, 8 aa, Staphylococcus
SGIETDNI

SEQ ID NO: 1983480 - protein, 11 aa, Staphylococcus
SGIETNHKKDL

SEQ ID NO: 1983481 - protein, 4 aa, Staphylococcus
SGIG

SEQ ID NO: 1983482 - protein, 10 aa, Staphylococcus
SGIGKVNATI

SEQ ID NO: 1983483 - protein, 5 aa, Staphylococcus
SGIGP

SEQ ID NO: 1983484 - protein, 10 aa, Staphylococcus
SGIGQNSARQ

SEQ ID NO: 1983485 - protein, 14 aa, Staphylococcus
SGIGTHSCGPELPK

SEQ ID NO: 1983486 - protein, 6 aa, Staphylococcus
SGIGYK

SEQ ID NO: 1983487 - protein, 8 aa, Staphylococcus
SGIHSNGY

SEQ ID NO: 1983488 - protein, 4 aa, Staphylococcus
SGIN

SEQ ID NO: 1983489 - protein, 7 aa, Staphylococcus
SGINEQQ

SEQ ID NO: 1983490 - protein, 5 aa, Staphylococcus
SGINL

SEQ ID NO: 1983491 - protein, 12 aa, Staphylococcus
SGINTQTNEKVK

SEQ ID NO: 1983492 - protein, 5 aa, Staphylococcus
SGIPD

SEQ ID NO: 1983493 - protein, 10 aa, Staphylococcus
SGIPDTTPAM

SEQ ID NO: 1983494 - protein, 5 aa, Staphylococcus
SGIPN

SEQ ID NO: 1983495 - protein, 6 aa, Staphylococcus
SGIPQL

SEQ ID NO: 1983496 - protein, 5 aa, Staphylococcus
SGIPS

SEQ ID NO: 1983497 - protein, 9 aa, Staphylococcus
SGIRDEQDV

SEQ ID NO: 1983498 - protein, 5 aa, Staphylococcus
SGIRV

SEQ ID NO: 1983499 - protein, 4 aa, Staphylococcus
SGIS

SEQ ID NO: 1983500 - protein, 13 aa, Staphylococcus
SGISGKNIEGRPA

SEQ ID NO: 1983501 - protein, 7 aa, Staphylococcus
SGISKKD

SEQ ID NO: 1983502 - protein, 9 aa, Staphylococcus
SGISNSELK

SEQ ID NO: 1983503 - protein, 4 aa, Staphylococcus
SGIT

SEQ ID NO: 1983504 - protein, 10 aa, Staphylococcus
SGITKSVGKE

SEQ ID NO: 1983505 - protein, 13 aa, Staphylococcus
SGIYQGSRHRANE

SEQ ID NO: 1983506 - protein, 7 aa, Staphylococcus
SGKADQA

SEQ ID NO: 1983507 - protein, 19 aa, Staphylococcus
SGKAKALPMNTGAEAVETA

SEQ ID NO: 1983508 - protein, 4 aa, Staphylococcus
SGKD

SEQ ID NO: 1983509 - protein, 8 aa, Staphylococcus
SGKDAGDI

SEQ ID NO: 1983510 - protein, 8 aa, Staphylococcus
SGKDAGRI

SEQ ID NO: 1983511 - protein, 9 aa, Staphylococcus
SGKESYKEG

SEQ ID NO: 1983512 - protein, 8 aa, Staphylococcus
SGKFSPAK

SEQ ID NO: 1983513 - protein, 10 aa, Staphylococcus
SGKGKATGTL

SEQ ID NO: 1983514 - protein, 8 aa, Staphylococcus
SGKGRSGF

SEQ ID NO: 1983515 - protein, 13 aa, Staphylococcus
SGKHNKYKLPNDE

SEQ ID NO: 1983516 - protein, 4 aa, Staphylococcus
SGKI

SEQ ID NO: 1983517 - protein, 6 aa, Staphylococcus
SGKISK

SEQ ID NO: 1983518 - protein, 12 aa, Staphylococcus
SGKKAGREDEKE

SEQ ID NO: 1983519 - protein, 14 aa, Staphylococcus
SGKKGEPGTIVETT

SEQ ID NO: 1983520 - protein, 20 aa, Staphylococcus
SGKKVKSQSVDADTKTLPNS

SEQ ID NO: 1983521 - protein, 5 aa, Staphylococcus
SGKLD

SEQ ID NO: 1983522 - protein, 4 aa, Staphylococcus
SGKM

SEQ ID NO: 1983523 - protein, 11 aa, Staphylococcus
SGKMEYYSPKG

SEQ ID NO: 1983524 - protein, 14 aa, Staphylococcus
SGKMNDKADKYQGM

SEQ ID NO: 1983525 - protein, 14 aa, Staphylococcus
SGKNGDPGKIIETT

SEQ ID NO: 1983526 - protein, 9 aa, Staphylococcus
SGKNHQKLS

SEQ ID NO: 1983527 - protein, 8 aa, Staphylococcus
SGKNSHKL

SEQ ID NO: 1983528 - protein, 9 aa, Staphylococcus
SGKNSQKLT

SEQ ID NO: 1983529 - protein, 5 aa, Staphylococcus
SGKPI

SEQ ID NO: 1983530 - protein, 8 aa, Staphylococcus
SGKPQNKL

SEQ ID NO: 1983531 - protein, 5 aa, Staphylococcus
SGKPV

SEQ ID NO: 1983532 - protein, 4 aa, Staphylococcus
SGKR

SEQ ID NO: 1983533 - protein, 9 aa, Staphylococcus
SGKSARGIN

SEQ ID NO: 1983534 - protein, 10 aa, Staphylococcus
SGKSDLTTDV

SEQ ID NO: 1983535 - protein, 59 aa, Staphylococcus
SGKSEDEIQKELTEDVESDETSDSDASSESGEPNVTDTIEEPKPKKKPKKLSEADFDED

SEQ ID NO: 1983536 - protein, 7 aa, Staphylococcus
SGKSEEL

SEQ ID NO: 1983537 - protein, 17 aa, Staphylococcus
SGKSGKSNNGNDNENKE

SEQ ID NO: 1983538 - protein, 10 aa, Staphylococcus
SGKSGLNKTV

SEQ ID NO: 1983539 - protein, 11 aa, Staphylococcus
SGKSIQNDSRQ

SEQ ID NO: 1983540 - protein, 8 aa, Staphylococcus
SGKSKNKI

SEQ ID NO: 1983541 - protein, 9 aa, Staphylococcus
SGKSKNKIF

SEQ ID NO: 1983542 - protein, 9 aa, Staphylococcus
SGKSKNKII

SEQ ID NO: 1983543 - protein, 9 aa, Staphylococcus
SGKSKNKLI

SEQ ID NO: 1983544 - protein, 9 aa, Staphylococcus
SGKSKNKLM

SEQ ID NO: 1983545 - protein, 8 aa, Staphylococcus
SGKSKSVV

SEQ ID NO: 1983546 - protein, 55 aa, Staphylococcus
SGKSSDEEKELKDLDQDEKQDSESSKEDSKPEPKSTLPEAQPKEEKKEETKDDFE

SEQ ID NO: 1983547 - protein, 9 aa, Staphylococcus
SGKSTFSRQ

SEQ ID NO: 1983548 - protein, 9 aa, Staphylococcus
SGKTEDEIP

SEQ ID NO: 1983549 - protein, 19 aa, Staphylococcus
SGKTSERLTQLQKSGTTVT

SEQ ID NO: 1983550 - protein, 8 aa, Staphylococcus
SGKTSSIS

SEQ ID NO: 1983551 - protein, 7 aa, Staphylococcus
SGKTTLA

SEQ ID NO: 1983552 - protein, 7 aa, Staphylococcus
SGKTTTL

SEQ ID NO: 1983553 - protein, 7 aa, Staphylococcus
SGKTYTE

SEQ ID NO: 1983554 - protein, 18 aa, Staphylococcus
SGKVSELSGFAKKTEQNI

SEQ ID NO: 1983555 - protein, 16 aa, Staphylococcus
SGKYAAEIDDATDIED

SEQ ID NO: 1983556 - protein, 6 aa, Staphylococcus
SGKYDR

SEQ ID NO: 1983557 - protein, 7 aa, Staphylococcus
SGLAGET

SEQ ID NO: 1983558 - protein, 4 aa, Staphylococcus
SGLD

SEQ ID NO: 1983559 - protein, 11 aa, Staphylococcus
SGLDKNTKSYL

SEQ ID NO: 1983560 - protein, 8 aa, Staphylococcus
SGLDQETT

SEQ ID NO: 1983561 - protein, 12 aa, Staphylococcus
SGLDYEKRQNLL

SEQ ID NO: 1983562 - protein, 7 aa, Staphylococcus
SGLEKEA

SEQ ID NO: 1983563 - protein, 6 aa, Staphylococcus
SGLEPM

SEQ ID NO: 1983564 - protein, 14 aa, Staphylococcus
SGLGATRNKGIELA

SEQ ID NO: 1983565 - protein, 6 aa, Staphylococcus
SGLGKV

SEQ ID NO: 1983566 - protein, 15 aa, Staphylococcus
SGLISDDEKKYFQEE

SEQ ID NO: 1983567 - protein, 9 aa, Staphylococcus
SGLKGVHNP

SEQ ID NO: 1983568 - protein, 11 aa, Staphylococcus
SGLKGVKNPSE

SEQ ID NO: 1983569 - protein, 10 aa, Staphylococcus
SGLKGVQNPS

SEQ ID NO: 1983570 - protein, 9 aa, Staphylococcus
SGLKHVPDN

SEQ ID NO: 1983571 - protein, 5 aa, Staphylococcus
SGLNE

SEQ ID NO: 1983572 - protein, 5 aa, Staphylococcus
SGLQA

SEQ ID NO: 1983573 - protein, 10 aa, Staphylococcus
SGLRQSEHPN

SEQ ID NO: 1983574 - protein, 11 aa, Staphylococcus
SGLSENEEKEL

SEQ ID NO: 1983575 - protein, 8 aa, Staphylococcus
SGLSNALT

SEQ ID NO: 1983576 - protein, 10 aa, Staphylococcus
SGLTDKDGHA

SEQ ID NO: 1983577 - protein, 5 aa, Staphylococcus
SGLTE

SEQ ID NO: 1983578 - protein, 6 aa, Staphylococcus
SGLTEE

SEQ ID NO: 1983579 - protein, 5 aa, Staphylococcus
SGLTK

SEQ ID NO: 1983580 - protein, 5 aa, Staphylococcus
SGLTN

SEQ ID NO: 1983581 - protein, 12 aa, Staphylococcus
SGLTSQPSGNSL

SEQ ID NO: 1983582 - protein, 10 aa, Staphylococcus
SGLTSQPSVN

SEQ ID NO: 1983583 - protein, 15 aa, Staphylococcus
SGLYQEGDKLPSERK

SEQ ID NO: 1983584 - protein, 9 aa, Staphylococcus
SGMDPDEYI

SEQ ID NO: 1983585 - protein, 13 aa, Staphylococcus
SGMGQATAERLNK

SEQ ID NO: 1983586 - protein, 5 aa, Staphylococcus
SGMGR

SEQ ID NO: 1983587 - protein, 9 aa, Staphylococcus
SGMGYTGSH

SEQ ID NO: 1983588 - protein, 16 aa, Staphylococcus
SGMGYTGSKDLETLRE

SEQ ID NO: 1983589 - protein, 13 aa, Staphylococcus
SGMGYTGSRNLEA

SEQ ID NO: 1983590 - protein, 18 aa, Staphylococcus
SGMGYTGSRNLKQLREEA

SEQ ID NO: 1983591 - protein, 15 aa, Staphylococcus
SGMKGATANIDNVKK

SEQ ID NO: 1983592 - protein, 6 aa, Staphylococcus
SGMNAE

SEQ ID NO: 1983593 - protein, 8 aa, Staphylococcus
SGMNKPNG

SEQ ID NO: 1983594 - protein, 13 aa, Staphylococcus
SGMSAATNSTYGD

SEQ ID NO: 1983595 - protein, 8 aa, Staphylococcus
SGMTGPIG

SEQ ID NO: 1983596 - protein, 14 aa, Staphylococcus
SGMTGTAKTEEEEF

SEQ ID NO: 1983597 - protein, 12 aa, Staphylococcus
SGNDKSDLDEQT

SEQ ID NO: 1983598 - protein, 5 aa, Staphylococcus
SGNEI

SEQ ID NO: 1983599 - protein, 10 aa, Staphylococcus
SGNHSKSDFA

SEQ ID NO: 1983600 - protein, 4 aa, Staphylococcus
SGNI

SEQ ID NO: 1983601 - protein, 8 aa, Staphylococcus
SGNIDNPR

SEQ ID NO: 1983602 - protein, 4 aa, Staphylococcus
SGNK

SEQ ID NO: 1983603 - protein, 9 aa, Staphylococcus
SGNKKAVDR

SEQ ID NO: 1983604 - protein, 7 aa, Staphylococcus
SGNNNDR

SEQ ID NO: 1983605 - protein, 8 aa, Staphylococcus
SGNNPKID

SEQ ID NO: 1983606 - protein, 6 aa, Staphylococcus
SGNNVI

SEQ ID NO: 1983607 - protein, 10 aa, Staphylococcus
SGNPGGGESL

SEQ ID NO: 1983608 - protein, 13 aa, Staphylococcus
SGNPKDIERADEE

SEQ ID NO: 1983609 - protein, 8 aa, Staphylococcus
SGNPNAEV

SEQ ID NO: 1983610 - protein, 27 aa, Staphylococcus
SGNPNQFEPKVEGNKIYGRGSADMKAG

SEQ ID NO: 1983611 - protein, 9 aa, Staphylococcus
SGNPQATEA

SEQ ID NO: 1983612 - protein, 7 aa, Staphylococcus
SGNRPQI

SEQ ID NO: 1983613 - protein, 9 aa, Staphylococcus
SGNSDQSKL

SEQ ID NO: 1983614 - protein, 14 aa, Staphylococcus
SGNSRISVATQEKV

SEQ ID NO: 1983615 - protein, 18 aa, Staphylococcus
SGNTFDKNFRKSAKTVGD

SEQ ID NO: 1983616 - protein, 8 aa, Staphylococcus
SGNTFEKN

SEQ ID NO: 1983617 - protein, 7 aa, Staphylococcus
SGNTNER

SEQ ID NO: 1983618 - protein, 5 aa, Staphylococcus
SGNVD

SEQ ID NO: 1983619 - protein, 10 aa, Staphylococcus
SGNVDSNRLR

SEQ ID NO: 1983620 - protein, 7 aa, Staphylococcus
SGPENMP

SEQ ID NO: 1983621 - protein, 5 aa, Staphylococcus
SGPGA

SEQ ID NO: 1983622 - protein, 11 aa, Staphylococcus
SGPGATNAITG

SEQ ID NO: 1983623 - protein, 14 aa, Staphylococcus
SGPIPPNPSELIGS

SEQ ID NO: 1983624 - protein, 7 aa, Staphylococcus
SGPITSA

SEQ ID NO: 1983625 - protein, 7 aa, Staphylococcus
SGPITST

SEQ ID NO: 1983626 - protein, 19 aa, Staphylococcus
SGPPRPGRAHVRVRQPPVP

SEQ ID NO: 1983627 - protein, 10 aa, Staphylococcus
SGPPSRGEEV

SEQ ID NO: 1983628 - protein, 6 aa, Staphylococcus
SGPQYT

SEQ ID NO: 1983629 - protein, 56 aa, Staphylococcus
SGPSEEDIEKELSSEEVSDDSSKQMDDEPQASQHELEEDKPKKKPRKLSEADFDED

SEQ ID NO: 1983630 - protein, 6 aa, Staphylococcus
SGPSFV

SEQ ID NO: 1983631 - protein, 10 aa, Staphylococcus
SGPSGCGKST

SEQ ID NO: 1983632 - protein, 7 aa, Staphylococcus
SGQALSG

SEQ ID NO: 1983633 - protein, 12 aa, Staphylococcus
SGQAMKQYLKMG

SEQ ID NO: 1983634 - protein, 21 aa, Staphylococcus
SGQDESQLREQMKDDAEQRIK

SEQ ID NO: 1983635 - protein, 22 aa, Staphylococcus
SGQDESQMREQMKGDAEQRVKT

SEQ ID NO: 1983636 - protein, 13 aa, Staphylococcus
SGQDIKDALEQTA

SEQ ID NO: 1983637 - protein, 4 aa, Staphylococcus
SGQE

SEQ ID NO: 1983638 - protein, 9 aa, Staphylococcus
SGQHKKADF

SEQ ID NO: 1983639 - protein, 5 aa, Staphylococcus
SGQID

SEQ ID NO: 1983640 - protein, 8 aa, Staphylococcus
SGQIKGAA

SEQ ID NO: 1983641 - protein, 6 aa, Staphylococcus
SGQKCS

SEQ ID NO: 1983642 - protein, 8 aa, Staphylococcus
SGQKCSAC

SEQ ID NO: 1983643 - protein, 17 aa, Staphylococcus
SGQKVKTQSVKSGSELL

SEQ ID NO: 1983644 - protein, 22 aa, Staphylococcus
SGQNEDQLREQMKDDAEQRVKT

SEQ ID NO: 1983645 - protein, 6 aa, Staphylococcus
SGQPAG

SEQ ID NO: 1983646 - protein, 21 aa, Staphylococcus
SGQPEQFEPKIKGDKIYGRGS

SEQ ID NO: 1983647 - protein, 12 aa, Staphylococcus
SGQRRITDQKEL

SEQ ID NO: 1983648 - protein, 5 aa, Staphylococcus
SGQRY

SEQ ID NO: 1983649 - protein, 10 aa, Staphylococcus
SGQTLSDITS

SEQ ID NO: 1983650 - protein, 4 aa, Staphylococcus
SGQY

SEQ ID NO: 1983651 - protein, 12 aa, Staphylococcus
SGRAGRHEKPGK

SEQ ID NO: 1983652 - protein, 11 aa, Staphylococcus
SGRAPKEKESI

SEQ ID NO: 1983653 - protein, 10 aa, Staphylococcus
SGRAPKEKQA

SEQ ID NO: 1983654 - protein, 19 aa, Staphylococcus
SGRASKGKRCSCNYCTYYF

SEQ ID NO: 1983655 - protein, 10 aa, Staphylococcus
SGREINVPDI

SEQ ID NO: 1983656 - protein, 19 aa, Staphylococcus
SGREKAYPSELSGGQKQRV

SEQ ID NO: 1983657 - protein, 10 aa, Staphylococcus
SGRGDKDMDT

SEQ ID NO: 1983658 - protein, 9 aa, Staphylococcus
SGRGDKDME

SEQ ID NO: 1983659 - protein, 11 aa, Staphylococcus
SGRGDKDMETI

SEQ ID NO: 1983660 - protein, 22 aa, Staphylococcus
SGRGDKDMETIRNYTESRGDID

SEQ ID NO: 1983661 - protein, 7 aa, Staphylococcus
SGRGGTN

SEQ ID NO: 1983662 - protein, 19 aa, Staphylococcus
SGRGLGHTGGTIDKLESAN

SEQ ID NO: 1983663 - protein, 5 aa, Staphylococcus
SGRGQ

SEQ ID NO: 1983664 - protein, 9 aa, Staphylococcus
SGRNSQKLT

SEQ ID NO: 1983665 - protein, 6 aa, Staphylococcus
SGRNVA

SEQ ID NO: 1983666 - protein, 4 aa, Staphylococcus
SGRP

SEQ ID NO: 1983667 - protein, 6 aa, Staphylococcus
SGRPLE

SEQ ID NO: 1983668 - protein, 10 aa, Staphylococcus
SGRPPKEEQA

SEQ ID NO: 1983669 - protein, 11 aa, Staphylococcus
SGRPPKEEQSV

SEQ ID NO: 1983670 - protein, 5 aa, Staphylococcus
SGRPT

SEQ ID NO: 1983671 - protein, 7 aa, Staphylococcus
SGRPTEG

SEQ ID NO: 1983672 - protein, 10 aa, Staphylococcus
SGRPTEGMLP

SEQ ID NO: 1983673 - protein, 9 aa, Staphylococcus
SGRSDVDKN

SEQ ID NO: 1983674 - protein, 7 aa, Staphylococcus
SGRSKER

SEQ ID NO: 1983675 - protein, 4 aa, Staphylococcus
SGRT

SEQ ID NO: 1983676 - protein, 20 aa, Staphylococcus
SGRTYRNQEPKYLNSPETPI

SEQ ID NO: 1983677 - protein, 7 aa, Staphylococcus
SGRWDAY

SEQ ID NO: 1983678 - protein, 4 aa, Staphylococcus
SGRY

SEQ ID NO: 1983679 - protein, 17 aa, Staphylococcus
SGSAAANYTPAISESSL

SEQ ID NO: 1983680 - protein, 14 aa, Staphylococcus
SGSACTAGSTEPSH

SEQ ID NO: 1983681 - protein, 14 aa, Staphylococcus
SGSACTAGTTTPSH

SEQ ID NO: 1983682 - protein, 9 aa, Staphylococcus
SGSDANDGI

SEQ ID NO: 1983683 - protein, 7 aa, Staphylococcus
SGSDLSN

SEQ ID NO: 1983684 - protein, 10 aa, Staphylococcus
SGSEGRDPFD

SEQ ID NO: 1983685 - protein, 10 aa, Staphylococcus
SGSEGRDPFN

SEQ ID NO: 1983686 - protein, 10 aa, Staphylococcus
SGSEGRDPID

SEQ ID NO: 1983687 - protein, 10 aa, Staphylococcus
SGSEGRDPIE

SEQ ID NO: 1983688 - protein, 10 aa, Staphylococcus
SGSEGRDPLE

SEQ ID NO: 1983689 - protein, 12 aa, Staphylococcus
SGSEGRDPLEDY

SEQ ID NO: 1983690 - protein, 11 aa, Staphylococcus
SGSEGRDPYED

SEQ ID NO: 1983691 - protein, 15 aa, Staphylococcus
SGSEKISYKQLEEDS

SEQ ID NO: 1983692 - protein, 11 aa, Staphylococcus
SGSEPTQSQKS

SEQ ID NO: 1983693 - protein, 12 aa, Staphylococcus
SGSEQNPDLTNK

SEQ ID NO: 1983694 - protein, 7 aa, Staphylococcus
SGSFNRD

SEQ ID NO: 1983695 - protein, 7 aa, Staphylococcus
SGSFSDQ

SEQ ID NO: 1983696 - protein, 7 aa, Staphylococcus
SGSGAMD

SEQ ID NO: 1983697 - protein, 7 aa, Staphylococcus
SGSGKST

SEQ ID NO: 1983698 - protein, 8 aa, Staphylococcus
SGSGKSTL

SEQ ID NO: 1983699 - protein, 10 aa, Staphylococcus
SGSGQEFEEP

SEQ ID NO: 1983700 - protein, 9 aa, Staphylococcus
SGSHNKADF

SEQ ID NO: 1983701 - protein, 8 aa, Staphylococcus
SGSHPTSL

SEQ ID NO: 1983702 - protein, 9 aa, Staphylococcus
SGSHTKADF

SEQ ID NO: 1983703 - protein, 6 aa, Staphylococcus
SGSKEA

SEQ ID NO: 1983704 - protein, 8 aa, Staphylococcus
SGSLDREA

SEQ ID NO: 1983705 - protein, 5 aa, Staphylococcus
SGSLS

SEQ ID NO: 1983706 - protein, 5 aa, Staphylococcus
SGSMA

SEQ ID NO: 1983707 - protein, 9 aa, Staphylococcus
SGSMDAEAT

SEQ ID NO: 1983708 - protein, 8 aa, Staphylococcus
SGSNEDLD

SEQ ID NO: 1983709 - protein, 20 aa, Staphylococcus
SGSNGSKPREVYLTSAEINE

SEQ ID NO: 1983710 - protein, 14 aa, Staphylococcus
SGSNKGNKRYSPFT

SEQ ID NO: 1983711 - protein, 9 aa, Staphylococcus
SGSNPDYNA

SEQ ID NO: 1983712 - protein, 8 aa, Staphylococcus
SGSNPEYN

SEQ ID NO: 1983713 - protein, 8 aa, Staphylococcus
SGSNPHYY

SEQ ID NO: 1983714 - protein, 8 aa, Staphylococcus
SGSNPKYN

SEQ ID NO: 1983715 - protein, 9 aa, Staphylococcus
SGSNPKYNE

SEQ ID NO: 1983716 - protein, 9 aa, Staphylococcus
SGSNPKYNQ

SEQ ID NO: 1983717 - protein, 9 aa, Staphylococcus
SGSNPRYNP

SEQ ID NO: 1983718 - protein, 9 aa, Staphylococcus
SGSNTRGDF

SEQ ID NO: 1983719 - protein, 13 aa, Staphylococcus
SGSPDQNGSNAEY

SEQ ID NO: 1983720 - protein, 7 aa, Staphylococcus
SGSPLTM

SEQ ID NO: 1983721 - protein, 13 aa, Staphylococcus
SGSPNYDGSNEQY

SEQ ID NO: 1983722 - protein, 11 aa, Staphylococcus
SGSSGVPKGVK

SEQ ID NO: 1983723 - protein, 4 aa, Staphylococcus
SGST

SEQ ID NO: 1983724 - protein, 10 aa, Staphylococcus
SGSTDKPKGV

SEQ ID NO: 1983725 - protein, 10 aa, Staphylococcus
SGSTGQPKGV

SEQ ID NO: 1983726 - protein, 10 aa, Staphylococcus
SGSTGVPKGV

SEQ ID NO: 1983727 - protein, 13 aa, Staphylococcus
SGSTKTSSETMEW

SEQ ID NO: 1983728 - protein, 19 aa, Staphylococcus
SGSTKTSSETMEWEDGNEY

SEQ ID NO: 1983729 - protein, 13 aa, Staphylococcus
SGSTKTSSETMKW

SEQ ID NO: 1983730 - protein, 10 aa, Staphylococcus
SGSTRESIDD

SEQ ID NO: 1983731 - protein, 8 aa, Staphylococcus
SGSTSEGF

SEQ ID NO: 1983732 - protein, 10 aa, Staphylococcus
SGSTSTGKTF

SEQ ID NO: 1983733 - protein, 19 aa, Staphylococcus
SGSVDGEAFEGGQAEKYDL

SEQ ID NO: 1983734 - protein, 14 aa, Staphylococcus
SGSYYGGDSLKPTR

SEQ ID NO: 1983735 - protein, 18 aa, Staphylococcus
SGTAATNYTSAVAESDIS

SEQ ID NO: 1983736 - protein, 7 aa, Staphylococcus
SGTAERS

SEQ ID NO: 1983737 - protein, 26 aa, Staphylococcus
SGTASRAAGNYGDDAPNASPAEQKHA

SEQ ID NO: 1983738 - protein, 5 aa, Staphylococcus
SGTDD

SEQ ID NO: 1983739 - protein, 7 aa, Staphylococcus
SGTDDYV

SEQ ID NO: 1983740 - protein, 8 aa, Staphylococcus
SGTDGVGT

SEQ ID NO: 1983741 - protein, 5 aa, Staphylococcus
SGTDR

SEQ ID NO: 1983742 - protein, 6 aa, Staphylococcus
SGTDRF

SEQ ID NO: 1983743 - protein, 11 aa, Staphylococcus
SGTDSKAGGPD

SEQ ID NO: 1983744 - protein, 8 aa, Staphylococcus
SGTGEAEK

SEQ ID NO: 1983745 - protein, 5 aa, Staphylococcus
SGTGY

SEQ ID NO: 1983746 - protein, 11 aa, Staphylococcus
SGTGYQDRKNV

SEQ ID NO: 1983747 - protein, 7 aa, Staphylococcus
SGTKGAL

SEQ ID NO: 1983748 - protein, 8 aa, Staphylococcus
SGTKKRAP

SEQ ID NO: 1983749 - protein, 9 aa, Staphylococcus
SGTKKRAPK

SEQ ID NO: 1983750 - protein, 9 aa, Staphylococcus
SGTKKRAPR

SEQ ID NO: 1983751 - protein, 5 aa, Staphylococcus
SGTNA

SEQ ID NO: 1983752 - protein, 7 aa, Staphylococcus
SGTNDQN

SEQ ID NO: 1983753 - protein, 10 aa, Staphylococcus
SGTNGKDDHI

SEQ ID NO: 1983754 - protein, 10 aa, Staphylococcus
SGTNGKDDHV

SEQ ID NO: 1983755 - protein, 11 aa, Staphylococcus
SGTNGKDDQIA

SEQ ID NO: 1983756 - protein, 12 aa, Staphylococcus
SGTNGKDEGISS

SEQ ID NO: 1983757 - protein, 18 aa, Staphylococcus
SGTPIEEQTYERNREAVD

SEQ ID NO: 1983758 - protein, 7 aa, Staphylococcus
SGTPKDF

SEQ ID NO: 1983759 - protein, 5 aa, Staphylococcus
SGTQT

SEQ ID NO: 1983760 - protein, 9 aa, Staphylococcus
SGTRFKQGE

SEQ ID NO: 1983761 - protein, 7 aa, Staphylococcus
SGTSALE

SEQ ID NO: 1983762 - protein, 10 aa, Staphylococcus
SGTSDDDHSI

SEQ ID NO: 1983763 - protein, 11 aa, Staphylococcus
SGTSGSGKSTL

SEQ ID NO: 1983764 - protein, 9 aa, Staphylococcus
SGTTGFPKG

SEQ ID NO: 1983765 - protein, 11 aa, Staphylococcus
SGTTGKPKGTV

SEQ ID NO: 1983766 - protein, 13 aa, Staphylococcus
SGTTGKPKGTVVP

SEQ ID NO: 1983767 - protein, 15 aa, Staphylococcus
SGTTGLPKAYYRNEP

SEQ ID NO: 1983768 - protein, 8 aa, Staphylococcus
SGTTGLQK

SEQ ID NO: 1983769 - protein, 8 aa, Staphylococcus
SGTTGMPK

SEQ ID NO: 1983770 - protein, 9 aa, Staphylococcus
SGTTGMPKG

SEQ ID NO: 1983771 - protein, 13 aa, Staphylococcus
SGTTGMPKGVSIQ

SEQ ID NO: 1983772 - protein, 13 aa, Staphylococcus
SGTTGNPKGIKIT

SEQ ID NO: 1983773 - protein, 12 aa, Staphylococcus
SGTTGPQKAVPQ

SEQ ID NO: 1983774 - protein, 13 aa, Staphylococcus
SGTTGPQKAVSQT

SEQ ID NO: 1983775 - protein, 9 aa, Staphylococcus
SGTTGTPKG

SEQ ID NO: 1983776 - protein, 21 aa, Staphylococcus
SGTTHSTEEIKANTKAFQDKA

SEQ ID NO: 1983777 - protein, 6 aa, Staphylococcus
SGTTNE

SEQ ID NO: 1983778 - protein, 10 aa, Staphylococcus
SGTTPSIDEI

SEQ ID NO: 1983779 - protein, 21 aa, Staphylococcus
SGTTQAAEDIKNNVKELQDKA

SEQ ID NO: 1983780 - protein, 15 aa, Staphylococcus
SGTTQAANTIKENAK

SEQ ID NO: 1983781 - protein, 13 aa, Staphylococcus
SGTVHTPDGGVAL

SEQ ID NO: 1983782 - protein, 9 aa, Staphylococcus
SGTVKIEDK

SEQ ID NO: 1983783 - protein, 9 aa, Staphylococcus
SGTYGDKDI

SEQ ID NO: 1983784 - protein, 7 aa, Staphylococcus
SGTYGES

SEQ ID NO: 1983785 - protein, 4 aa, Staphylococcus
SGVD

SEQ ID NO: 1983786 - protein, 14 aa, Staphylococcus
SGVDGAIGSTYNVN

SEQ ID NO: 1983787 - protein, 18 aa, Staphylococcus
SGVDGAIGSTYNVNGRRA

SEQ ID NO: 1983788 - protein, 5 aa, Staphylococcus
SGVDK

SEQ ID NO: 1983789 - protein, 19 aa, Staphylococcus
SGVDSDKKAAFSNAYSKGF

SEQ ID NO: 1983790 - protein, 9 aa, Staphylococcus
SGVDTRSIT

SEQ ID NO: 1983791 - protein, 11 aa, Staphylococcus
SGVDYEKLTPE

SEQ ID NO: 1983792 - protein, 4 aa, Staphylococcus
SGVE

SEQ ID NO: 1983793 - protein, 7 aa, Staphylococcus
SGVEYAQ

SEQ ID NO: 1983794 - protein, 8 aa, Staphylococcus
SGVEYAQA

SEQ ID NO: 1983795 - protein, 8 aa, Staphylococcus
SGVEYAQS

SEQ ID NO: 1983796 - protein, 8 aa, Staphylococcus
SGVGTAKF

SEQ ID NO: 1983797 - protein, 6 aa, Staphylococcus
SGVHAK

SEQ ID NO: 1983798 - protein, 7 aa, Staphylococcus
SGVNPEE

SEQ ID NO: 1983799 - protein, 7 aa, Staphylococcus
SGVPAEN

SEQ ID NO: 1983800 - protein, 6 aa, Staphylococcus
SGVPSA

SEQ ID NO: 1983801 - protein, 6 aa, Staphylococcus
SGVSDQ

SEQ ID NO: 1983802 - protein, 7 aa, Staphylococcus
SGVSGIA

SEQ ID NO: 1983803 - protein, 7 aa, Staphylococcus
SGVSKHY

SEQ ID NO: 1983804 - protein, 7 aa, Staphylococcus
SGVSPRT

SEQ ID NO: 1983805 - protein, 14 aa, Staphylococcus
SGWGADYSDPTSYL

SEQ ID NO: 1983806 - protein, 7 aa, Staphylococcus
SGYAQRA

SEQ ID NO: 1983807 - protein, 4 aa, Staphylococcus
SGYD

SEQ ID NO: 1983808 - protein, 5 aa, Staphylococcus
SGYDV

SEQ ID NO: 1983809 - protein, 9 aa, Staphylococcus
SGYEATKTL

SEQ ID NO: 1983810 - protein, 12 aa, Staphylococcus
SGYGDPQGEAVR

SEQ ID NO: 1983811 - protein, 14 aa, Staphylococcus
SGYGTSYFSSGRAG

SEQ ID NO: 1983812 - protein, 12 aa, Staphylococcus
SGYNNTEIEYGP

SEQ ID NO: 1983813 - protein, 6 aa, Staphylococcus
SGYQID

SEQ ID NO: 1983814 - protein, 5 aa, Staphylococcus
SGYRD

SEQ ID NO: 1983815 - protein, 14 aa, Staphylococcus
SGYSGGDIENPTYE

SEQ ID NO: 1983816 - protein, 13 aa, Staphylococcus
SGYSGGHIENPTY

SEQ ID NO: 1983817 - protein, 13 aa, Staphylococcus
SGYSGGHVENPTY

SEQ ID NO: 1983818 - protein, 7 aa, Staphylococcus
SGYTETY

SEQ ID NO: 1983819 - protein, 6 aa, Staphylococcus
SGYTSE

SEQ ID NO: 1983820 - protein, 5 aa, Staphylococcus
SGYTT

SEQ ID NO: 1983821 - protein, 12 aa, Staphylococcus
SGYVKEATRKRI

SEQ ID NO: 1983822 - protein, 7 aa, Staphylococcus
SHAGGIT

SEQ ID NO: 1983823 - protein, 19 aa, Staphylococcus
SHAQANDIGTEQADDYNDY

SEQ ID NO: 1983824 - protein, 4 aa, Staphylococcus
SHDE

SEQ ID NO: 1983825 - protein, 8 aa, Staphylococcus
SHDEAGTF

SEQ ID NO: 1983826 - protein, 11 aa, Staphylococcus
SHDFNASNVKP

SEQ ID NO: 1983827 - protein, 4 aa, Staphylococcus
SHDK

SEQ ID NO: 1983828 - protein, 4 aa, Staphylococcus
SHDP

SEQ ID NO: 1983829 - protein, 7 aa, Staphylococcus
SHDPENK

SEQ ID NO: 1983830 - protein, 13 aa, Staphylococcus
SHDQPVEKLIIFN

SEQ ID NO: 1983831 - protein, 5 aa, Staphylococcus
SHDQS

SEQ ID NO: 1983832 - protein, 7 aa, Staphylococcus
SHDRGKT

SEQ ID NO: 1983833 - protein, 7 aa, Staphylococcus
SHEDRKV

SEQ ID NO: 1983834 - protein, 8 aa, Staphylococcus
SHEGITGN

SEQ ID NO: 1983835 - protein, 6 aa, Staphylococcus
SHEGQA

SEQ ID NO: 1983836 - protein, 9 aa, Staphylococcus
SHEKLESSR

SEQ ID NO: 1983837 - protein, 10 aa, Staphylococcus
SHEKLPSKRV

SEQ ID NO: 1983838 - protein, 8 aa, Staphylococcus
SHEKRKTL

SEQ ID NO: 1983839 - protein, 6 aa, Staphylococcus
SHEQRR

SEQ ID NO: 1983840 - protein, 5 aa, Staphylococcus
SHERP

SEQ ID NO: 1983841 - protein, 8 aa, Staphylococcus
SHERQEHS

SEQ ID NO: 1983842 - protein, 8 aa, Staphylococcus
SHESGANE

SEQ ID NO: 1983843 - protein, 7 aa, Staphylococcus
SHESGIH

SEQ ID NO: 1983844 - protein, 6 aa, Staphylococcus
SHGADT

SEQ ID NO: 1983845 - protein, 7 aa, Staphylococcus
SHGIGAA

SEQ ID NO: 1983846 - protein, 10 aa, Staphylococcus
SHGKSGALHG

SEQ ID NO: 1983847 - protein, 5 aa, Staphylococcus
SHGNT

SEQ ID NO: 1983848 - protein, 5 aa, Staphylococcus
SHGRA

SEQ ID NO: 1983849 - protein, 8 aa, Staphylococcus
SHGRDRTG

SEQ ID NO: 1983850 - protein, 17 aa, Staphylococcus
SHGSQGGYKIQDAQSKI

SEQ ID NO: 1983851 - protein, 8 aa, Staphylococcus
SHGSTFGG

SEQ ID NO: 1983852 - protein, 10 aa, Staphylococcus
SHGSTFGGNP

SEQ ID NO: 1983853 - protein, 9 aa, Staphylococcus
SHGTINPSP

SEQ ID NO: 1983854 - protein, 7 aa, Staphylococcus
SHGTIPG

SEQ ID NO: 1983855 - protein, 11 aa, Staphylococcus
SHGVPLPDDTL

SEQ ID NO: 1983856 - protein, 6 aa, Staphylococcus
SHGVPS

SEQ ID NO: 1983857 - protein, 8 aa, Staphylococcus
SHGYGKEF

SEQ ID NO: 1983858 - protein, 9 aa, Staphylococcus
SHHESRHNK

SEQ ID NO: 1983859 - protein, 6 aa, Staphylococcus
SHHRVD

SEQ ID NO: 1983860 - protein, 11 aa, Staphylococcus
SHHSDDATGHD

SEQ ID NO: 1983861 - protein, 51 aa, Staphylococcus
SHHSTSESIQSSTKEQVESNSENTSSSDKQSNSLQAQQSRSPKKRVTGGKP

SEQ ID NO: 1983862 - protein, 12 aa, Staphylococcus
SHIKPGTKAASV

SEQ ID NO: 1983863 - protein, 10 aa, Staphylococcus
SHIKRTDVAN

SEQ ID NO: 1983864 - protein, 9 aa, Staphylococcus
SHIRKQQSQ

SEQ ID NO: 1983865 - protein, 4 aa, Staphylococcus
SHKD

SEQ ID NO: 1983866 - protein, 13 aa, Staphylococcus
SHKDGTIRKRHLM

SEQ ID NO: 1983867 - protein, 7 aa, Staphylococcus
SHKDSGE

SEQ ID NO: 1983868 - protein, 10 aa, Staphylococcus
SHKEKHTHQM

SEQ ID NO: 1983869 - protein, 8 aa, Staphylococcus
SHKESGEI

SEQ ID NO: 1983870 - protein, 7 aa, Staphylococcus
SHKETYL

SEQ ID NO: 1983871 - protein, 4 aa, Staphylococcus
SHKI

SEQ ID NO: 1983872 - protein, 6 aa, Staphylococcus
SHKKTY

SEQ ID NO: 1983873 - protein, 4 aa, Staphylococcus
SHKQ

SEQ ID NO: 1983874 - protein, 10 aa, Staphylococcus
SHKSDDEWRE

SEQ ID NO: 1983875 - protein, 11 aa, Staphylococcus
SHKSLKEDYEV

SEQ ID NO: 1983876 - protein, 11 aa, Staphylococcus
SHKTKDKYLRP

SEQ ID NO: 1983877 - protein, 7 aa, Staphylococcus
SHLSNEE

SEQ ID NO: 1983878 - protein, 5 aa, Staphylococcus
SHMSD

SEQ ID NO: 1983879 - protein, 9 aa, Staphylococcus
SHNAKQEDP

SEQ ID NO: 1983880 - protein, 16 aa, Staphylococcus
SHNENVSLKGEETEVG

SEQ ID NO: 1983881 - protein, 8 aa, Staphylococcus
SHNGPFDS

SEQ ID NO: 1983882 - protein, 19 aa, Staphylococcus
SHNHPSAVEPYQGAATGVG

SEQ ID NO: 1983883 - protein, 15 aa, Staphylococcus
SHNIDKTVTKMKSYF

SEQ ID NO: 1983884 - protein, 8 aa, Staphylococcus
SHNPKDYN

SEQ ID NO: 1983885 - protein, 8 aa, Staphylococcus
SHNPKEYN

SEQ ID NO: 1983886 - protein, 8 aa, Staphylococcus
SHNPKNYN

SEQ ID NO: 1983887 - protein, 9 aa, Staphylococcus
SHNPKNYNG

SEQ ID NO: 1983888 - protein, 5 aa, Staphylococcus
SHNPN

SEQ ID NO: 1983889 - protein, 13 aa, Staphylococcus
SHNTQNAQTAKAH

SEQ ID NO: 1983890 - protein, 7 aa, Staphylococcus
SHNVNTP

SEQ ID NO: 1983891 - protein, 13 aa, Staphylococcus
SHPDQDIDETKLK

SEQ ID NO: 1983892 - protein, 10 aa, Staphylococcus
SHPEHRTQYD

SEQ ID NO: 1983893 - protein, 6 aa, Staphylococcus
SHPEIK

SEQ ID NO: 1983894 - protein, 5 aa, Staphylococcus
SHPEW

SEQ ID NO: 1983895 - protein, 5 aa, Staphylococcus
SHPGE

SEQ ID NO: 1983896 - protein, 5 aa, Staphylococcus
SHPHG

SEQ ID NO: 1983897 - protein, 7 aa, Staphylococcus
SHPKATL

SEQ ID NO: 1983898 - protein, 10 aa, Staphylococcus
SHPKTKTAQN

SEQ ID NO: 1983899 - protein, 4 aa, Staphylococcus
SHPL

SEQ ID NO: 1983900 - protein, 13 aa, Staphylococcus
SHPLQDEDQVQGS

SEQ ID NO: 1983901 - protein, 12 aa, Staphylococcus
SHPLQEEGQVQG

SEQ ID NO: 1983902 - protein, 9 aa, Staphylococcus
SHPNMPSTI

SEQ ID NO: 1983903 - protein, 6 aa, Staphylococcus
SHPSEK

SEQ ID NO: 1983904 - protein, 7 aa, Staphylococcus
SHPSPLS

SEQ ID NO: 1983905 - protein, 4 aa, Staphylococcus
SHPT

SEQ ID NO: 1983906 - protein, 5 aa, Staphylococcus
SHQAV

SEQ ID NO: 1983907 - protein, 12 aa, Staphylococcus
SHQEEVSYSSDP

SEQ ID NO: 1983908 - protein, 5 aa, Staphylococcus
SHQEK

SEQ ID NO: 1983909 - protein, 4 aa, Staphylococcus
SHQF

SEQ ID NO: 1983910 - protein, 5 aa, Staphylococcus
SHQFP

SEQ ID NO: 1983911 - protein, 13 aa, Staphylococcus
SHQGESEGSPKYL

SEQ ID NO: 1983912 - protein, 6 aa, Staphylococcus
SHQKIE

SEQ ID NO: 1983913 - protein, 9 aa, Staphylococcus
SHQKSPNAI

SEQ ID NO: 1983914 - protein, 9 aa, Staphylococcus
SHQQSEGKF

SEQ ID NO: 1983915 - protein, 9 aa, Staphylococcus
SHQRNQNEQ

SEQ ID NO: 1983916 - protein, 4 aa, Staphylococcus
SHQS

SEQ ID NO: 1983917 - protein, 14 aa, Staphylococcus
SHQSALKQRQEVSV

SEQ ID NO: 1983918 - protein, 8 aa, Staphylococcus
SHQSHEDL

SEQ ID NO: 1983919 - protein, 5 aa, Staphylococcus
SHQTF

SEQ ID NO: 1983920 - protein, 5 aa, Staphylococcus
SHRDR

SEQ ID NO: 1983921 - protein, 43 aa, Staphylococcus
SHRKAMAENDNVKKQLSETQQKIKQYNEKQTKLKKQKAENDID

SEQ ID NO: 1983922 - protein, 13 aa, Staphylococcus
SHRKQIKKGQVIS

SEQ ID NO: 1983923 - protein, 7 aa, Staphylococcus
SHRNEQA

SEQ ID NO: 1983924 - protein, 6 aa, Staphylococcus
SHRRKY

SEQ ID NO: 1983925 - protein, 21 aa, Staphylococcus
SHRSIRTAAQPGANKPIYTTG

SEQ ID NO: 1983926 - protein, 8 aa, Staphylococcus
SHRTANDK

SEQ ID NO: 1983927 - protein, 8 aa, Staphylococcus
SHRTESPR

SEQ ID NO: 1983928 - protein, 30 aa, Staphylococcus
SHSEPNTEQESNTDKNSHNDKKGLFSRLFG

SEQ ID NO: 1983929 - protein, 11 aa, Staphylococcus
SHSEYRAQYDT

SEQ ID NO: 1983930 - protein, 9 aa, Staphylococcus
SHSLEETLE

SEQ ID NO: 1983931 - protein, 7 aa, Staphylococcus
SHSNVPG

SEQ ID NO: 1983932 - protein, 8 aa, Staphylococcus
SHSPKISN

SEQ ID NO: 1983933 - protein, 13 aa, Staphylococcus
SHSQHSQAIHRTG

SEQ ID NO: 1983934 - protein, 5 aa, Staphylococcus
SHSVT

SEQ ID NO: 1983935 - protein, 24 aa, Staphylococcus
SHSVTGMGAQGGMPTFSEIAGELD

SEQ ID NO: 1983936 - protein, 4 aa, Staphylococcus
SHSY

SEQ ID NO: 1983937 - protein, 5 aa, Staphylococcus
SHTAE

SEQ ID NO: 1983938 - protein, 40 aa, Staphylococcus
SHTGNKRQTIQQPKAKPQQKRGFSKRMTSPKKQVSSSEWK

SEQ ID NO: 1983939 - protein, 12 aa, Staphylococcus
SHTGSKAKSQFS

SEQ ID NO: 1983940 - protein, 9 aa, Staphylococcus
SHTIEPFRD

SEQ ID NO: 1983941 - protein, 6 aa, Staphylococcus
SHTNPV

SEQ ID NO: 1983942 - protein, 7 aa, Staphylococcus
SHTSGHV

SEQ ID NO: 1983943 - protein, 7 aa, Staphylococcus
SHTSTNI

SEQ ID NO: 1983944 - protein, 10 aa, Staphylococcus
SHTTPTNLKS

SEQ ID NO: 1983945 - protein, 6 aa, Staphylococcus
SHTVGL

SEQ ID NO: 1983946 - protein, 11 aa, Staphylococcus
SHVGAGADAGI

SEQ ID NO: 1983947 - protein, 12 aa, Staphylococcus
SHVGAGADKGIQ

SEQ ID NO: 1983948 - protein, 11 aa, Staphylococcus
SHVGEGTDAGI

SEQ ID NO: 1983949 - protein, 5 aa, Staphylococcus
SHYHD

SEQ ID NO: 1983950 - protein, 13 aa, Staphylococcus
SIADKKKSVSDRD

SEQ ID NO: 1983951 - protein, 5 aa, Staphylococcus
SIAEA

SEQ ID NO: 1983952 - protein, 11 aa, Staphylococcus
SIAEDADYPVP

SEQ ID NO: 1983953 - protein, 17 aa, Staphylococcus
SIAKNQPSLDVKDESLI

SEQ ID NO: 1983954 - protein, 10 aa, Staphylococcus
SIAKTHNTSI

SEQ ID NO: 1983955 - protein, 7 aa, Staphylococcus
SIAQQTA

SEQ ID NO: 1983956 - protein, 4 aa, Staphylococcus
SIDA

SEQ ID NO: 1983957 - protein, 8 aa, Staphylococcus
SIDDNEGY

SEQ ID NO: 1983958 - protein, 11 aa, Staphylococcus
SIDDVSSVSEV

SEQ ID NO: 1983959 - protein, 9 aa, Staphylococcus
SIDENKETL

SEQ ID NO: 1983960 - protein, 9 aa, Staphylococcus
SIDETPYYE

SEQ ID NO: 1983961 - protein, 6 aa, Staphylococcus
SIDETQ

SEQ ID NO: 1983962 - protein, 5 aa, Staphylococcus
SIDEV

SEQ ID NO: 1983963 - protein, 9 aa, Staphylococcus
SIDNATETS

SEQ ID NO: 1983964 - protein, 9 aa, Staphylococcus
SIDNRKGQE

SEQ ID NO: 1983965 - protein, 6 aa, Staphylococcus
SIDNYK

SEQ ID NO: 1983966 - protein, 7 aa, Staphylococcus
SIDRRNG

SEQ ID NO: 1983967 - protein, 14 aa, Staphylococcus
SIDRTSNQKGKVKD

SEQ ID NO: 1983968 - protein, 4 aa, Staphylococcus
SIDT

SEQ ID NO: 1983969 - protein, 7 aa, Staphylococcus
SIDTKYD

SEQ ID NO: 1983970 - protein, 13 aa, Staphylococcus
SIDTNQEDRDNHL

SEQ ID NO: 1983971 - protein, 6 aa, Staphylococcus
SIDYGN

SEQ ID NO: 1983972 - protein, 7 aa, Staphylococcus
SIDYGNK

SEQ ID NO: 1983973 - protein, 16 aa, Staphylococcus
SIEANYDEQPEASWQE

SEQ ID NO: 1983974 - protein, 8 aa, Staphylococcus
SIEDEGDV

SEQ ID NO: 1983975 - protein, 8 aa, Staphylococcus
SIEDKGDY

SEQ ID NO: 1983976 - protein, 12 aa, Staphylococcus
SIEDKGDYKEIN

SEQ ID NO: 1983977 - protein, 5 aa, Staphylococcus
SIEDM

SEQ ID NO: 1983978 - protein, 8 aa, Staphylococcus
SIEDNGDH

SEQ ID NO: 1983979 - protein, 7 aa, Staphylococcus
SIEDPDA

SEQ ID NO: 1983980 - protein, 7 aa, Staphylococcus
SIEDQGD

SEQ ID NO: 1983981 - protein, 7 aa, Staphylococcus
SIEDSEL

SEQ ID NO: 1983982 - protein, 16 aa, Staphylococcus
SIEDSIQTNYEEPKGK

SEQ ID NO: 1983983 - protein, 8 aa, Staphylococcus
SIEDSKSF

SEQ ID NO: 1983984 - protein, 6 aa, Staphylococcus
SIEEAV

SEQ ID NO: 1983985 - protein, 6 aa, Staphylococcus
SIEEGK

SEQ ID NO: 1983986 - protein, 10 aa, Staphylococcus
SIEERGGGRQ

SEQ ID NO: 1983987 - protein, 7 aa, Staphylococcus
SIEETAQ

SEQ ID NO: 1983988 - protein, 9 aa, Staphylococcus
SIEETPYYE

SEQ ID NO: 1983989 - protein, 12 aa, Staphylococcus
SIEGANGPEITI

SEQ ID NO: 1983990 - protein, 8 aa, Staphylococcus
SIEGELPE

SEQ ID NO: 1983991 - protein, 6 aa, Staphylococcus
SIEGLE

SEQ ID NO: 1983992 - protein, 5 aa, Staphylococcus
SIEGT

SEQ ID NO: 1983993 - protein, 5 aa, Staphylococcus
SIEIT

SEQ ID NO: 1983994 - protein, 5 aa, Staphylococcus
SIEKA

SEQ ID NO: 1983995 - protein, 9 aa, Staphylococcus
SIEKGKEMT

SEQ ID NO: 1983996 - protein, 8 aa, Staphylococcus
SIEKPTTR

SEQ ID NO: 1983997 - protein, 5 aa, Staphylococcus
SIENE

SEQ ID NO: 1983998 - protein, 16 aa, Staphylococcus
SIENKGTKIYISVPLS

SEQ ID NO: 1983999 - protein, 10 aa, Staphylococcus
SIENKNDYVA

SEQ ID NO: 1984000 - protein, 6 aa, Staphylococcus
SIEPKL

SEQ ID NO: 1984001 - protein, 5 aa, Staphylococcus
SIEPS

SEQ ID NO: 1984002 - protein, 22 aa, Staphylococcus
SIEQAVERAGTKAGNKGSEAAV

SEQ ID NO: 1984003 - protein, 13 aa, Staphylococcus
SIEQNYDQDPEMS

SEQ ID NO: 1984004 - protein, 6 aa, Staphylococcus
SIERET

SEQ ID NO: 1984005 - protein, 9 aa, Staphylococcus
SIERNEDEQ

SEQ ID NO: 1984006 - protein, 5 aa, Staphylococcus
SIERS

SEQ ID NO: 1984007 - protein, 8 aa, Staphylococcus
SIESGNIK

SEQ ID NO: 1984008 - protein, 20 aa, Staphylococcus
SIESLQSKNIDEYQESFEKV

SEQ ID NO: 1984009 - protein, 4 aa, Staphylococcus
SIET

SEQ ID NO: 1984010 - protein, 5 aa, Staphylococcus
SIETG

SEQ ID NO: 1984011 - protein, 11 aa, Staphylococcus
SIETNESFDNL

SEQ ID NO: 1984012 - protein, 7 aa, Staphylococcus
SIGDTAE

SEQ ID NO: 1984013 - protein, 4 aa, Staphylococcus
SIGE

SEQ ID NO: 1984014 - protein, 8 aa, Staphylococcus
SIGGAASE

SEQ ID NO: 1984015 - protein, 7 aa, Staphylococcus
SIGGAAT

SEQ ID NO: 1984016 - protein, 6 aa, Staphylococcus
SIGGGK

SEQ ID NO: 1984017 - protein, 9 aa, Staphylococcus
SIGGGLNPM

SEQ ID NO: 1984018 - protein, 7 aa, Staphylococcus
SIGGGTI

SEQ ID NO: 1984019 - protein, 8 aa, Staphylococcus
SIGGTATD

SEQ ID NO: 1984020 - protein, 4 aa, Staphylococcus
SIGH

SEQ ID NO: 1984021 - protein, 22 aa, Staphylococcus
SIGHETFDTDASIDTAKNGDIV

SEQ ID NO: 1984022 - protein, 7 aa, Staphylococcus
SIGKQKH

SEQ ID NO: 1984023 - protein, 16 aa, Staphylococcus
SIGNDQSVLGEKENPI

SEQ ID NO: 1984024 - protein, 11 aa, Staphylococcus
SIGPDAVKTGM

SEQ ID NO: 1984025 - protein, 7 aa, Staphylococcus
SIGPSAK

SEQ ID NO: 1984026 - protein, 12 aa, Staphylococcus
SIGSDDKSKELK

SEQ ID NO: 1984027 - protein, 6 aa, Staphylococcus
SIGSPI

SEQ ID NO: 1984028 - protein, 9 aa, Staphylococcus
SIGSQNTVD

SEQ ID NO: 1984029 - protein, 6 aa, Staphylococcus
SIGTDA

SEQ ID NO: 1984030 - protein, 4 aa, Staphylococcus
SIGY

SEQ ID NO: 1984031 - protein, 9 aa, Staphylococcus
SIGYKKNDL

SEQ ID NO: 1984032 - protein, 11 aa, Staphylococcus
SIHAQSTKEIA

SEQ ID NO: 1984033 - protein, 6 aa, Staphylococcus
SIHDTK

SEQ ID NO: 1984034 - protein, 4 aa, Staphylococcus
SIHN

SEQ ID NO: 1984035 - protein, 4 aa, Staphylococcus
SIHS

SEQ ID NO: 1984036 - protein, 6 aa, Staphylococcus
SIHSEQ

SEQ ID NO: 1984037 - protein, 11 aa, Staphylococcus
SIHTQSTKEIA

SEQ ID NO: 1984038 - protein, 11 aa, Staphylococcus
SIIDSDESGGL

SEQ ID NO: 1984039 - protein, 10 aa, Staphylococcus
SIIDSEDSSE

SEQ ID NO: 1984040 - protein, 6 aa, Staphylococcus
SIIETE

SEQ ID NO: 1984041 - protein, 5 aa, Staphylococcus
SIKAN

SEQ ID NO: 1984042 - protein, 7 aa, Staphylococcus
SIKARGG

SEQ ID NO: 1984043 - protein, 4 aa, Staphylococcus
SIKD

SEQ ID NO: 1984044 - protein, 4 aa, Staphylococcus
SIKE

SEQ ID NO: 1984045 - protein, 8 aa, Staphylococcus
SIKESALD

SEQ ID NO: 1984046 - protein, 12 aa, Staphylococcus
SIKGAKSNNLKD

SEQ ID NO: 1984047 - protein, 19 aa, Staphylococcus
SIKIDSKSYTPTLIHKIIT

SEQ ID NO: 1984048 - protein, 13 aa, Staphylococcus
SIKNDKEEHDLDS

SEQ ID NO: 1984049 - protein, 16 aa, Staphylococcus
SIKNDLEQIERKFKRV

SEQ ID NO: 1984050 - protein, 11 aa, Staphylococcus
SIKNESTPRIL

SEQ ID NO: 1984051 - protein, 7 aa, Staphylococcus
SIKNHED

SEQ ID NO: 1984052 - protein, 17 aa, Staphylococcus
SIKNNKQQQIWDMIESY

SEQ ID NO: 1984053 - protein, 7 aa, Staphylococcus
SIKNQGH

SEQ ID NO: 1984054 - protein, 7 aa, Staphylococcus
SIKNQGN

SEQ ID NO: 1984055 - protein, 11 aa, Staphylococcus
SIKNQGTKEIA

SEQ ID NO: 1984056 - protein, 6 aa, Staphylococcus
SIKPEY

SEQ ID NO: 1984057 - protein, 8 aa, Staphylococcus
SIKPTSPC

SEQ ID NO: 1984058 - protein, 22 aa, Staphylococcus
SIKQSENSNQSNENPNPENDTE

SEQ ID NO: 1984059 - protein, 6 aa, Staphylococcus
SIKRPN

SEQ ID NO: 1984060 - protein, 18 aa, Staphylococcus
SIKSAKEKKFSKANPYQA

SEQ ID NO: 1984061 - protein, 9 aa, Staphylococcus
SIKTDKEKD

SEQ ID NO: 1984062 - protein, 11 aa, Staphylococcus
SIKYSDNASYF

SEQ ID NO: 1984063 - protein, 18 aa, Staphylococcus
SILNGGEAHSHDIEGIGS

SEQ ID NO: 1984064 - protein, 21 aa, Staphylococcus
SILNGGPSHTHATEGIGSEKW

SEQ ID NO: 1984065 - protein, 12 aa, Staphylococcus
SILPNENKSVVS

SEQ ID NO: 1984066 - protein, 20 aa, Staphylococcus
SILPTTKEEIAERRAKAETI

SEQ ID NO: 1984067 - protein, 6 aa, Staphylococcus
SILSSG

SEQ ID NO: 1984068 - protein, 14 aa, Staphylococcus
SILTSNTQETSNAK

SEQ ID NO: 1984069 - protein, 11 aa, Staphylococcus
SINDKDGKVGS

SEQ ID NO: 1984070 - protein, 5 aa, Staphylococcus
SINES

SEQ ID NO: 1984071 - protein, 8 aa, Staphylococcus
SINETAKQ

SEQ ID NO: 1984072 - protein, 7 aa, Staphylococcus
SINHSDQ

SEQ ID NO: 1984073 - protein, 4 aa, Staphylococcus
SINI

SEQ ID NO: 1984074 - protein, 9 aa, Staphylococcus
SINKKEQEL

SEQ ID NO: 1984075 - protein, 7 aa, Staphylococcus
SINNSGF

SEQ ID NO: 1984076 - protein, 14 aa, Staphylococcus
SINPAKDVDGFHPE

SEQ ID NO: 1984077 - protein, 15 aa, Staphylococcus
SINPDKDVDGFHPSN

SEQ ID NO: 1984078 - protein, 7 aa, Staphylococcus
SINPNLK

SEQ ID NO: 1984079 - protein, 19 aa, Staphylococcus
SINPVNDQSKEIEINGVEG

SEQ ID NO: 1984080 - protein, 6 aa, Staphylococcus
SINPYT

SEQ ID NO: 1984081 - protein, 8 aa, Staphylococcus
SINSQQPD

SEQ ID NO: 1984082 - protein, 9 aa, Staphylococcus
SIPAPKTEF

SEQ ID NO: 1984083 - protein, 5 aa, Staphylococcus
SIPDI

SEQ ID NO: 1984084 - protein, 5 aa, Staphylococcus
SIPEG

SEQ ID NO: 1984085 - protein, 5 aa, Staphylococcus
SIPEK

SEQ ID NO: 1984086 - protein, 19 aa, Staphylococcus
SIPEKEVQEFRDKTKILEM

SEQ ID NO: 1984087 - protein, 7 aa, Staphylococcus
SIPENEV

SEQ ID NO: 1984088 - protein, 19 aa, Staphylococcus
SIPENEVQEFKDKTKILER

SEQ ID NO: 1984089 - protein, 11 aa, Staphylococcus
SIPENQKYGAF

SEQ ID NO: 1984090 - protein, 7 aa, Staphylococcus
SIPHERT

SEQ ID NO: 1984091 - protein, 4 aa, Staphylococcus
SIPM

SEQ ID NO: 1984092 - protein, 9 aa, Staphylococcus
SIPNSVAKQ

SEQ ID NO: 1984093 - protein, 5 aa, Staphylococcus
SIPQG

SEQ ID NO: 1984094 - protein, 7 aa, Staphylococcus
SIPREDV

SEQ ID NO: 1984095 - protein, 9 aa, Staphylococcus
SIPSPKLCT

SEQ ID NO: 1984096 - protein, 19 aa, Staphylococcus
SIPSSKVKKTVKSIQPELT

SEQ ID NO: 1984097 - protein, 7 aa, Staphylococcus
SIPTEGA

SEQ ID NO: 1984098 - protein, 4 aa, Staphylococcus
SIQD

SEQ ID NO: 1984099 - protein, 11 aa, Staphylococcus
SIQDELKSQGV

SEQ ID NO: 1984100 - protein, 7 aa, Staphylococcus
SIQDGAA

SEQ ID NO: 1984101 - protein, 10 aa, Staphylococcus
SIQEDTMDSI

SEQ ID NO: 1984102 - protein, 10 aa, Staphylococcus
SIQEIKDSND

SEQ ID NO: 1984103 - protein, 9 aa, Staphylococcus
SIQIDDSKG

SEQ ID NO: 1984104 - protein, 15 aa, Staphylococcus
SIQKPESCCDNDEIN

SEQ ID NO: 1984105 - protein, 7 aa, Staphylococcus
SIQNSKQ

SEQ ID NO: 1984106 - protein, 5 aa, Staphylococcus
SIQSH

SEQ ID NO: 1984107 - protein, 7 aa, Staphylococcus
SIQSRLE

SEQ ID NO: 1984108 - protein, 9 aa, Staphylococcus
SIQSSPDFG

SEQ ID NO: 1984109 - protein, 7 aa, Staphylococcus
SIQTHQQ

SEQ ID NO: 1984110 - protein, 11 aa, Staphylococcus
SIQYDPNRSAN

SEQ ID NO: 1984111 - protein, 4 aa, Staphylococcus
SIRA

SEQ ID NO: 1984112 - protein, 9 aa, Staphylococcus
SIRGSDTDA

SEQ ID NO: 1984113 - protein, 5 aa, Staphylococcus
SIRHS

SEQ ID NO: 1984114 - protein, 4 aa, Staphylococcus
SIRQ

SEQ ID NO: 1984115 - protein, 7 aa, Staphylococcus
SIRSNEN

SEQ ID NO: 1984116 - protein, 8 aa, Staphylococcus
SIRSSAPQ

SEQ ID NO: 1984117 - protein, 7 aa, Staphylococcus
SIRTDGG

SEQ ID NO: 1984118 - protein, 8 aa, Staphylococcus
SIRTQQSV

SEQ ID NO: 1984119 - protein, 5 aa, Staphylococcus
SIRTT

SEQ ID NO: 1984120 - protein, 4 aa, Staphylococcus
SIRY

SEQ ID NO: 1984121 - protein, 10 aa, Staphylococcus
SISAADEEIG

SEQ ID NO: 1984122 - protein, 4 aa, Staphylococcus
SISD

SEQ ID NO: 1984123 - protein, 6 aa, Staphylococcus
SISDEE

SEQ ID NO: 1984124 - protein, 22 aa, Staphylococcus
SISDPGLNPLDKETRKQTARKI

SEQ ID NO: 1984125 - protein, 8 aa, Staphylococcus
SISDRDYQ

SEQ ID NO: 1984126 - protein, 9 aa, Staphylococcus
SISDTNIND

SEQ ID NO: 1984127 - protein, 32 aa, Staphylococcus
SISDVSSVSEVKYQRKTELTDQEGAKYEQKGI

SEQ ID NO: 1984128 - protein, 27 aa, Staphylococcus
SISEPATLPFSRKQASKVARAVNEYQA

SEQ ID NO: 1984129 - protein, 9 aa, Staphylococcus
SISEPGTMP

SEQ ID NO: 1984130 - protein, 4 aa, Staphylococcus
SISG

SEQ ID NO: 1984131 - protein, 29 aa, Staphylococcus
SISIAETNPDYDVDNRTSKLAANLIHHFL

SEQ ID NO: 1984132 - protein, 5 aa, Staphylococcus
SISIG

SEQ ID NO: 1984133 - protein, 5 aa, Staphylococcus
SISIQ

SEQ ID NO: 1984134 - protein, 13 aa, Staphylococcus
SISKTHKKAYPQQ

SEQ ID NO: 1984135 - protein, 11 aa, Staphylococcus
SISNKTEKGIY

SEQ ID NO: 1984136 - protein, 6 aa, Staphylococcus
SISPGM

SEQ ID NO: 1984137 - protein, 73 aa, Staphylococcus
SISPKDGKDFSKPDSVSGDSKDDLSVKGKPDDNTTSNKPQGQGGSSNSSSSSNSSNNNSTSNTNNSSNQQSAA

SEQ ID NO: 1984138 - protein, 14 aa, Staphylococcus
SISPTSGNIERNGE

SEQ ID NO: 1984139 - protein, 10 aa, Staphylococcus
SISQTKDDYL

SEQ ID NO: 1984140 - protein, 4 aa, Staphylococcus
SISS

SEQ ID NO: 1984141 - protein, 9 aa, Staphylococcus
SISSATKMG

SEQ ID NO: 1984142 - protein, 9 aa, Staphylococcus
SISSPFDTD

SEQ ID NO: 1984143 - protein, 5 aa, Staphylococcus
SISSV

SEQ ID NO: 1984144 - protein, 4 aa, Staphylococcus
SIST

SEQ ID NO: 1984145 - protein, 5 aa, Staphylococcus
SISTY

SEQ ID NO: 1984146 - protein, 4 aa, Staphylococcus
SISY

SEQ ID NO: 1984147 - protein, 15 aa, Staphylococcus
SITADNALKAREDGI

SEQ ID NO: 1984148 - protein, 6 aa, Staphylococcus
SITAKD

SEQ ID NO: 1984149 - protein, 8 aa, Staphylococcus
SITDDGYG

SEQ ID NO: 1984150 - protein, 5 aa, Staphylococcus
SITDE

SEQ ID NO: 1984151 - protein, 7 aa, Staphylococcus
SITDEEG

SEQ ID NO: 1984152 - protein, 6 aa, Staphylococcus
SITDEH

SEQ ID NO: 1984153 - protein, 6 aa, Staphylococcus
SITEDK

SEQ ID NO: 1984154 - protein, 7 aa, Staphylococcus
SITEDKK

SEQ ID NO: 1984155 - protein, 10 aa, Staphylococcus
SITEGSNLEG

SEQ ID NO: 1984156 - protein, 7 aa, Staphylococcus
SITEGTV

SEQ ID NO: 1984157 - protein, 7 aa, Staphylococcus
SITEKTY

SEQ ID NO: 1984158 - protein, 9 aa, Staphylococcus
SITENSNLE

SEQ ID NO: 1984159 - protein, 7 aa, Staphylococcus
SITEQAR

SEQ ID NO: 1984160 - protein, 6 aa, Staphylococcus
SITEQP

SEQ ID NO: 1984161 - protein, 9 aa, Staphylococcus
SITGGEPMF

SEQ ID NO: 1984162 - protein, 14 aa, Staphylococcus
SITGTVQKVNGAWY

SEQ ID NO: 1984163 - protein, 19 aa, Staphylococcus
SITIEEKGETPTLIHKIIT

SEQ ID NO: 1984164 - protein, 9 aa, Staphylococcus
SITKARGKE

SEQ ID NO: 1984165 - protein, 11 aa, Staphylococcus
SITKDAYGKTI

SEQ ID NO: 1984166 - protein, 7 aa, Staphylococcus
SITNQGY

SEQ ID NO: 1984167 - protein, 16 aa, Staphylococcus
SITPDNPKSGKPTTQA

SEQ ID NO: 1984168 - protein, 7 aa, Staphylococcus
SITPEDF

SEQ ID NO: 1984169 - protein, 8 aa, Staphylococcus
SITPSRIT

SEQ ID NO: 1984170 - protein, 18 aa, Staphylococcus
SITSISEQSGFSSHTNFT

SEQ ID NO: 1984171 - protein, 6 aa, Staphylococcus
SITSTF

SEQ ID NO: 1984172 - protein, 5 aa, Staphylococcus
SITYN

SEQ ID NO: 1984173 - protein, 4 aa, Staphylococcus
SIVE

SEQ ID NO: 1984174 - protein, 11 aa, Staphylococcus
SIVNGRKSPFT

SEQ ID NO: 1984175 - protein, 14 aa, Staphylococcus
SIYGKGKKRHVPDT

SEQ ID NO: 1984176 - protein, 9 aa, Staphylococcus
SKAARKPII

SEQ ID NO: 1984177 - protein, 9 aa, Staphylococcus
SKAARKPMI

SEQ ID NO: 1984178 - protein, 9 aa, Staphylococcus
SKADDDKLR

SEQ ID NO: 1984179 - protein, 14 aa, Staphylococcus
SKADDDYKEKMGEK

SEQ ID NO: 1984180 - protein, 13 aa, Staphylococcus
SKADPAEYDNKEP

SEQ ID NO: 1984181 - protein, 4 aa, Staphylococcus
SKAE

SEQ ID NO: 1984182 - protein, 14 aa, Staphylococcus
SKAEARTTRTGDQA

SEQ ID NO: 1984183 - protein, 5 aa, Staphylococcus
SKAEE

SEQ ID NO: 1984184 - protein, 6 aa, Staphylococcus
SKAEEE

SEQ ID NO: 1984185 - protein, 11 aa, Staphylococcus
SKAENREAYEK

SEQ ID NO: 1984186 - protein, 8 aa, Staphylococcus
SKAEQAMR

SEQ ID NO: 1984187 - protein, 7 aa, Staphylococcus
SKAEQIL

SEQ ID NO: 1984188 - protein, 7 aa, Staphylococcus
SKAETVE

SEQ ID NO: 1984189 - protein, 5 aa, Staphylococcus
SKAGA

SEQ ID NO: 1984190 - protein, 13 aa, Staphylococcus
SKAGQTDNVKDTV

SEQ ID NO: 1984191 - protein, 11 aa, Staphylococcus
SKAGSCLDNQP

SEQ ID NO: 1984192 - protein, 10 aa, Staphylococcus
SKAGSSAQIP

SEQ ID NO: 1984193 - protein, 10 aa, Staphylococcus
SKAGSSAQVP

SEQ ID NO: 1984194 - protein, 7 aa, Staphylococcus
SKAHTGD

SEQ ID NO: 1984195 - protein, 9 aa, Staphylococcus
SKAKANGYQ

SEQ ID NO: 1984196 - protein, 14 aa, Staphylococcus
SKAKDEYGNNEENE

SEQ ID NO: 1984197 - protein, 12 aa, Staphylococcus
SKAKPEKPDNCR

SEQ ID NO: 1984198 - protein, 6 aa, Staphylococcus
SKAKPL

SEQ ID NO: 1984199 - protein, 12 aa, Staphylococcus
SKAKPTKPEGCK

SEQ ID NO: 1984200 - protein, 12 aa, Staphylococcus
SKAKPVKPENCQ

SEQ ID NO: 1984201 - protein, 10 aa, Staphylococcus
SKAKSYLSKE

SEQ ID NO: 1984202 - protein, 11 aa, Staphylococcus
SKALAPDEDEF

SEQ ID NO: 1984203 - protein, 11 aa, Staphylococcus
SKANLSSDNTA

SEQ ID NO: 1984204 - protein, 8 aa, Staphylococcus
SKANQSSV

SEQ ID NO: 1984205 - protein, 9 aa, Staphylococcus
SKAPENTIA

SEQ ID NO: 1984206 - protein, 18 aa, Staphylococcus
SKAPENTLASYKKAADIP

SEQ ID NO: 1984207 - protein, 6 aa, Staphylococcus
SKAPIR

SEQ ID NO: 1984208 - protein, 7 aa, Staphylococcus
SKAPNVK

SEQ ID NO: 1984209 - protein, 8 aa, Staphylococcus
SKAPTFED

SEQ ID NO: 1984210 - protein, 9 aa, Staphylococcus
SKAQNEPSW

SEQ ID NO: 1984211 - protein, 8 aa, Staphylococcus
SKAQQESI

SEQ ID NO: 1984212 - protein, 7 aa, Staphylococcus
SKARDTF

SEQ ID NO: 1984213 - protein, 6 aa, Staphylococcus
SKARET

SEQ ID NO: 1984214 - protein, 9 aa, Staphylococcus
SKASDTTDV

SEQ ID NO: 1984215 - protein, 7 aa, Staphylococcus
SKASEGL

SEQ ID NO: 1984216 - protein, 6 aa, Staphylococcus
SKASGH

SEQ ID NO: 1984217 - protein, 9 aa, Staphylococcus
SKASQYNNL

SEQ ID NO: 1984218 - protein, 12 aa, Staphylococcus
SKATDTEKQHAQ

SEQ ID NO: 1984219 - protein, 22 aa, Staphylococcus
SKATKDDVEKAFESSNKAYKSW

SEQ ID NO: 1984220 - protein, 11 aa, Staphylococcus
SKATKDDVENA

SEQ ID NO: 1984221 - protein, 21 aa, Staphylococcus
SKATKEDVDKAFESSNKAYKA

SEQ ID NO: 1984222 - protein, 21 aa, Staphylococcus
SKATQKDVDDAFEAANEAYKS

SEQ ID NO: 1984223 - protein, 6 aa, Staphylococcus
SKAVES

SEQ ID NO: 1984224 - protein, 13 aa, Staphylococcus
SKAVKITKGAGTG

SEQ ID NO: 1984225 - protein, 7 aa, Staphylococcus
SKCEQQG

SEQ ID NO: 1984226 - protein, 12 aa, Staphylococcus
SKCNDEQELKAG

SEQ ID NO: 1984227 - protein, 14 aa, Staphylococcus
SKCNNEDELKKGIE

SEQ ID NO: 1984228 - protein, 13 aa, Staphylococcus
SKCNNEEELKNGI

SEQ ID NO: 1984229 - protein, 15 aa, Staphylococcus
SKDAIAKNKYKYAKK

SEQ ID NO: 1984230 - protein, 8 aa, Staphylococcus
SKDATQRY

SEQ ID NO: 1984231 - protein, 5 aa, Staphylococcus
SKDAY

SEQ ID NO: 1984232 - protein, 8 aa, Staphylococcus
SKDDERQV

SEQ ID NO: 1984233 - protein, 9 aa, Staphylococcus
SKDDGKTFY

SEQ ID NO: 1984234 - protein, 12 aa, Staphylococcus
SKDDRYVSYQET

SEQ ID NO: 1984235 - protein, 7 aa, Staphylococcus
SKDDSYV

SEQ ID NO: 1984236 - protein, 6 aa, Staphylococcus
SKDDVP

SEQ ID NO: 1984237 - protein, 4 aa, Staphylococcus
SKDE

SEQ ID NO: 1984238 - protein, 8 aa, Staphylococcus
SKDEDVTQ

SEQ ID NO: 1984239 - protein, 12 aa, Staphylococcus
SKDEEEEKNSKL

SEQ ID NO: 1984240 - protein, 7 aa, Staphylococcus
SKDEHWN

SEQ ID NO: 1984241 - protein, 9 aa, Staphylococcus
SKDEKDIEK

SEQ ID NO: 1984242 - protein, 7 aa, Staphylococcus
SKDFEDI

SEQ ID NO: 1984243 - protein, 14 aa, Staphylococcus
SKDFKQNGQPKKEM

SEQ ID NO: 1984244 - protein, 9 aa, Staphylococcus
SKDGERHHT

SEQ ID NO: 1984245 - protein, 13 aa, Staphylococcus
SKDGETESSSSLA

SEQ ID NO: 1984246 - protein, 10 aa, Staphylococcus
SKDGQLEDRD

SEQ ID NO: 1984247 - protein, 9 aa, Staphylococcus
SKDGQSPEY

SEQ ID NO: 1984248 - protein, 10 aa, Staphylococcus
SKDGQYEQNQ

SEQ ID NO: 1984249 - protein, 7 aa, Staphylococcus
SKDGTFE

SEQ ID NO: 1984250 - protein, 7 aa, Staphylococcus
SKDIGQT

SEQ ID NO: 1984251 - protein, 5 aa, Staphylococcus
SKDIP

SEQ ID NO: 1984252 - protein, 6 aa, Staphylococcus
SKDIPD

SEQ ID NO: 1984253 - protein, 18 aa, Staphylococcus
SKDIPDNALAFGNPIQIR

SEQ ID NO: 1984254 - protein, 4 aa, Staphylococcus
SKDK

SEQ ID NO: 1984255 - protein, 6 aa, Staphylococcus
SKDKEI

SEQ ID NO: 1984256 - protein, 9 aa, Staphylococcus
SKDKGGEYG

SEQ ID NO: 1984257 - protein, 7 aa, Staphylococcus
SKDKTNK

SEQ ID NO: 1984258 - protein, 7 aa, Staphylococcus
SKDKYDD

SEQ ID NO: 1984259 - protein, 4 aa, Staphylococcus
SKDM

SEQ ID NO: 1984260 - protein, 7 aa, Staphylococcus
SKDMSKY

SEQ ID NO: 1984261 - protein, 5 aa, Staphylococcus
SKDNA

SEQ ID NO: 1984262 - protein, 9 aa, Staphylococcus
SKDNEPRLQ

SEQ ID NO: 1984263 - protein, 7 aa, Staphylococcus
SKDNGNN

SEQ ID NO: 1984264 - protein, 9 aa, Staphylococcus
SKDNKDTVL

SEQ ID NO: 1984265 - protein, 5 aa, Staphylococcus
SKDNP

SEQ ID NO: 1984266 - protein, 6 aa, Staphylococcus
SKDNRI

SEQ ID NO: 1984267 - protein, 4 aa, Staphylococcus
SKDP

SEQ ID NO: 1984268 - protein, 7 aa, Staphylococcus
SKDPFEH

SEQ ID NO: 1984269 - protein, 6 aa, Staphylococcus
SKDPFV

SEQ ID NO: 1984270 - protein, 17 aa, Staphylococcus
SKDPNEKIKPVKGGYRL

SEQ ID NO: 1984271 - protein, 8 aa, Staphylococcus
SKDPSVEL

SEQ ID NO: 1984272 - protein, 5 aa, Staphylococcus
SKDPY

SEQ ID NO: 1984273 - protein, 5 aa, Staphylococcus
SKDQL

SEQ ID NO: 1984274 - protein, 7 aa, Staphylococcus
SKDQYDD

SEQ ID NO: 1984275 - protein, 14 aa, Staphylococcus
SKDSAGAYSENRKQ

SEQ ID NO: 1984276 - protein, 9 aa, Staphylococcus
SKDSEPRLQ

SEQ ID NO: 1984277 - protein, 7 aa, Staphylococcus
SKDSGIE

SEQ ID NO: 1984278 - protein, 8 aa, Staphylococcus
SKDSGIEV

SEQ ID NO: 1984279 - protein, 11 aa, Staphylococcus
SKDSIGASGEH

SEQ ID NO: 1984280 - protein, 7 aa, Staphylococcus
SKDSKIE

SEQ ID NO: 1984281 - protein, 7 aa, Staphylococcus
SKDSNIE

SEQ ID NO: 1984282 - protein, 7 aa, Staphylococcus
SKDSSIE

SEQ ID NO: 1984283 - protein, 8 aa, Staphylococcus
SKDTDIRA

SEQ ID NO: 1984284 - protein, 22 aa, Staphylococcus
SKDTDSETINDDSDSNKAQKVT

SEQ ID NO: 1984285 - protein, 9 aa, Staphylococcus
SKDTQHQIN

SEQ ID NO: 1984286 - protein, 9 aa, Staphylococcus
SKDTQNHIN

SEQ ID NO: 1984287 - protein, 5 aa, Staphylococcus
SKDTV

SEQ ID NO: 1984288 - protein, 13 aa, Staphylococcus
SKDTVGASGEQRV

SEQ ID NO: 1984289 - protein, 19 aa, Staphylococcus
SKDVPNDTIAFGNPMQIHN

SEQ ID NO: 1984290 - protein, 17 aa, Staphylococcus
SKDVPSNSVAFGNPIQI

SEQ ID NO: 1984291 - protein, 7 aa, Staphylococcus
SKDYEHP

SEQ ID NO: 1984292 - protein, 9 aa, Staphylococcus
SKDYKGAAT

SEQ ID NO: 1984293 - protein, 9 aa, Staphylococcus
SKDYNGPDM

SEQ ID NO: 1984294 - protein, 11 aa, Staphylococcus
SKDYRQGLQEQ

SEQ ID NO: 1984295 - protein, 4 aa, Staphylococcus
SKEA

SEQ ID NO: 1984296 - protein, 15 aa, Staphylococcus
SKEAAKQIQEDLDQV

SEQ ID NO: 1984297 - protein, 8 aa, Staphylococcus
SKEANTLD

SEQ ID NO: 1984298 - protein, 7 aa, Staphylococcus
SKEAQAE

SEQ ID NO: 1984299 - protein, 4 aa, Staphylococcus
SKED

SEQ ID NO: 1984300 - protein, 12 aa, Staphylococcus
SKEDASSGLGQM

SEQ ID NO: 1984301 - protein, 9 aa, Staphylococcus
SKEDDADEL

SEQ ID NO: 1984302 - protein, 7 aa, Staphylococcus
SKEDENK

SEQ ID NO: 1984303 - protein, 5 aa, Staphylococcus
SKEDF

SEQ ID NO: 1984304 - protein, 6 aa, Staphylococcus
SKEDFK

SEQ ID NO: 1984305 - protein, 8 aa, Staphylococcus
SKEDKGRE

SEQ ID NO: 1984306 - protein, 11 aa, Staphylococcus
SKEDKSSLHRY

SEQ ID NO: 1984307 - protein, 6 aa, Staphylococcus
SKEDLI

SEQ ID NO: 1984308 - protein, 7 aa, Staphylococcus
SKEDNIG

SEQ ID NO: 1984309 - protein, 5 aa, Staphylococcus
SKEDQ

SEQ ID NO: 1984310 - protein, 5 aa, Staphylococcus
SKEDT

SEQ ID NO: 1984311 - protein, 8 aa, Staphylococcus
SKEEAAEV

SEQ ID NO: 1984312 - protein, 9 aa, Staphylococcus
SKEEAAQYF

SEQ ID NO: 1984313 - protein, 8 aa, Staphylococcus
SKEEASEI

SEQ ID NO: 1984314 - protein, 8 aa, Staphylococcus
SKEEATEV

SEQ ID NO: 1984315 - protein, 5 aa, Staphylococcus
SKEEI

SEQ ID NO: 1984316 - protein, 7 aa, Staphylococcus
SKEELKN

SEQ ID NO: 1984317 - protein, 6 aa, Staphylococcus
SKEELN

SEQ ID NO: 1984318 - protein, 7 aa, Staphylococcus
SKEERVD

SEQ ID NO: 1984319 - protein, 6 aa, Staphylococcus
SKEETE

SEQ ID NO: 1984320 - protein, 7 aa, Staphylococcus
SKEFNEM

SEQ ID NO: 1984321 - protein, 5 aa, Staphylococcus
SKEGA

SEQ ID NO: 1984322 - protein, 6 aa, Staphylococcus
SKEGIT

SEQ ID NO: 1984323 - protein, 10 aa, Staphylococcus
SKEGKKKPTL

SEQ ID NO: 1984324 - protein, 5 aa, Staphylococcus
SKEGL

SEQ ID NO: 1984325 - protein, 9 aa, Staphylococcus
SKEGRRINK

SEQ ID NO: 1984326 - protein, 8 aa, Staphylococcus
SKEGYAPE

SEQ ID NO: 1984327 - protein, 4 aa, Staphylococcus
SKEI

SEQ ID NO: 1984328 - protein, 7 aa, Staphylococcus
SKEIKED

SEQ ID NO: 1984329 - protein, 8 aa, Staphylococcus
SKEIKGES

SEQ ID NO: 1984330 - protein, 9 aa, Staphylococcus
SKEITDKAA

SEQ ID NO: 1984331 - protein, 8 aa, Staphylococcus
SKEKAKID

SEQ ID NO: 1984332 - protein, 5 aa, Staphylococcus
SKEKE

SEQ ID NO: 1984333 - protein, 8 aa, Staphylococcus
SKEKEPQI

SEQ ID NO: 1984334 - protein, 8 aa, Staphylococcus
SKEKEYTY

SEQ ID NO: 1984335 - protein, 10 aa, Staphylococcus
SKEKHPNADK

SEQ ID NO: 1984336 - protein, 11 aa, Staphylococcus
SKEKKDARAKE

SEQ ID NO: 1984337 - protein, 11 aa, Staphylococcus
SKEKKDQKAEE

SEQ ID NO: 1984338 - protein, 11 aa, Staphylococcus
SKEKKDSKAKE

SEQ ID NO: 1984339 - protein, 8 aa, Staphylococcus
SKEKREEI

SEQ ID NO: 1984340 - protein, 8 aa, Staphylococcus
SKEKRKRK

SEQ ID NO: 1984341 - protein, 7 aa, Staphylococcus
SKEKRVS

SEQ ID NO: 1984342 - protein, 6 aa, Staphylococcus
SKEKYD

SEQ ID NO: 1984343 - protein, 4 aa, Staphylococcus
SKEL

SEQ ID NO: 1984344 - protein, 6 aa, Staphylococcus
SKELEP

SEQ ID NO: 1984345 - protein, 8 aa, Staphylococcus
SKELNSEK

SEQ ID NO: 1984346 - protein, 7 aa, Staphylococcus
SKELTDP

SEQ ID NO: 1984347 - protein, 10 aa, Staphylococcus
SKELTDPQIK

SEQ ID NO: 1984348 - protein, 7 aa, Staphylococcus
SKEMEKS

SEQ ID NO: 1984349 - protein, 6 aa, Staphylococcus
SKEMND

SEQ ID NO: 1984350 - protein, 7 aa, Staphylococcus
SKENEDV

SEQ ID NO: 1984351 - protein, 6 aa, Staphylococcus
SKENGN

SEQ ID NO: 1984352 - protein, 16 aa, Staphylococcus
SKENHDTTYNDENTNI

SEQ ID NO: 1984353 - protein, 11 aa, Staphylococcus
SKENKSDKQLK

SEQ ID NO: 1984354 - protein, 10 aa, Staphylococcus
SKEPDQNKNI

SEQ ID NO: 1984355 - protein, 9 aa, Staphylococcus
SKEPGTIDS

SEQ ID NO: 1984356 - protein, 9 aa, Staphylococcus
SKEPGTIKP

SEQ ID NO: 1984357 - protein, 7 aa, Staphylococcus
SKEPHQN

SEQ ID NO: 1984358 - protein, 6 aa, Staphylococcus
SKEPVR

SEQ ID NO: 1984359 - protein, 7 aa, Staphylococcus
SKEPVRT

SEQ ID NO: 1984360 - protein, 8 aa, Staphylococcus
SKEPYQNQ

SEQ ID NO: 1984361 - protein, 10 aa, Staphylococcus
SKEQKQKSIK

SEQ ID NO: 1984362 - protein, 7 aa, Staphylococcus
SKEQLTN

SEQ ID NO: 1984363 - protein, 8 aa, Staphylococcus
SKEQQERI

SEQ ID NO: 1984364 - protein, 7 aa, Staphylococcus
SKEQREQ

SEQ ID NO: 1984365 - protein, 7 aa, Staphylococcus
SKEQVAK

SEQ ID NO: 1984366 - protein, 19 aa, Staphylococcus
SKEQVDNLQDADKSYMRAM

SEQ ID NO: 1984367 - protein, 17 aa, Staphylococcus
SKERKSIEQIDTFLSQY

SEQ ID NO: 1984368 - protein, 9 aa, Staphylococcus
SKERRKVAR

SEQ ID NO: 1984369 - protein, 6 aa, Staphylococcus
SKERYD

SEQ ID NO: 1984370 - protein, 5 aa, Staphylococcus
SKESI

SEQ ID NO: 1984371 - protein, 9 aa, Staphylococcus
SKESKGQLN

SEQ ID NO: 1984372 - protein, 7 aa, Staphylococcus
SKESSNI

SEQ ID NO: 1984373 - protein, 8 aa, Staphylococcus
SKESSVET

SEQ ID NO: 1984374 - protein, 7 aa, Staphylococcus
SKETDTI

SEQ ID NO: 1984375 - protein, 8 aa, Staphylococcus
SKETETIQ

SEQ ID NO: 1984376 - protein, 5 aa, Staphylococcus
SKETF

SEQ ID NO: 1984377 - protein, 9 aa, Staphylococcus
SKETGISRT

SEQ ID NO: 1984378 - protein, 8 aa, Staphylococcus
SKETGNKE

SEQ ID NO: 1984379 - protein, 5 aa, Staphylococcus
SKETM

SEQ ID NO: 1984380 - protein, 8 aa, Staphylococcus
SKETNPSA

SEQ ID NO: 1984381 - protein, 6 aa, Staphylococcus
SKETPE

SEQ ID NO: 1984382 - protein, 9 aa, Staphylococcus
SKETQEHIN

SEQ ID NO: 1984383 - protein, 9 aa, Staphylococcus
SKETQTHIN

SEQ ID NO: 1984384 - protein, 11 aa, Staphylococcus
SKETVHDGART

SEQ ID NO: 1984385 - protein, 6 aa, Staphylococcus
SKETYK

SEQ ID NO: 1984386 - protein, 4 aa, Staphylococcus
SKEV

SEQ ID NO: 1984387 - protein, 5 aa, Staphylococcus
SKEVE

SEQ ID NO: 1984388 - protein, 9 aa, Staphylococcus
SKEVEQGMS

SEQ ID NO: 1984389 - protein, 5 aa, Staphylococcus
SKEVQ

SEQ ID NO: 1984390 - protein, 4 aa, Staphylococcus
SKEY

SEQ ID NO: 1984391 - protein, 16 aa, Staphylococcus
SKEYDEITNPKQHRPF

SEQ ID NO: 1984392 - protein, 5 aa, Staphylococcus
SKFEE

SEQ ID NO: 1984393 - protein, 7 aa, Staphylococcus
SKFGGNA

SEQ ID NO: 1984394 - protein, 8 aa, Staphylococcus
SKFGGNAW

SEQ ID NO: 1984395 - protein, 8 aa, Staphylococcus
SKFGPGGK

SEQ ID NO: 1984396 - protein, 7 aa, Staphylococcus
SKFKEAE

SEQ ID NO: 1984397 - protein, 12 aa, Staphylococcus
SKFKKKKSTVHH

SEQ ID NO: 1984398 - protein, 8 aa, Staphylococcus
SKFPSPQM

SEQ ID NO: 1984399 - protein, 6 aa, Staphylococcus
SKFQPE

SEQ ID NO: 1984400 - protein, 6 aa, Staphylococcus
SKFTQI

SEQ ID NO: 1984401 - protein, 14 aa, Staphylococcus
SKGACPNCGGKGYI

SEQ ID NO: 1984402 - protein, 6 aa, Staphylococcus
SKGAFA

SEQ ID NO: 1984403 - protein, 8 aa, Staphylococcus
SKGANESA

SEQ ID NO: 1984404 - protein, 16 aa, Staphylococcus
SKGASKDEIKKAYRKL

SEQ ID NO: 1984405 - protein, 14 aa, Staphylococcus
SKGAVDKTNNTSQL

SEQ ID NO: 1984406 - protein, 7 aa, Staphylococcus
SKGDANY

SEQ ID NO: 1984407 - protein, 10 aa, Staphylococcus
SKGDEKTEVK

SEQ ID NO: 1984408 - protein, 6 aa, Staphylococcus
SKGDGV

SEQ ID NO: 1984409 - protein, 7 aa, Staphylococcus
SKGDINT

SEQ ID NO: 1984410 - protein, 4 aa, Staphylococcus
SKGE

SEQ ID NO: 1984411 - protein, 6 aa, Staphylococcus
SKGEHA

SEQ ID NO: 1984412 - protein, 13 aa, Staphylococcus
SKGEIDAIPGKTM

SEQ ID NO: 1984413 - protein, 13 aa, Staphylococcus
SKGEIEGIPGKTM

SEQ ID NO: 1984414 - protein, 8 aa, Staphylococcus
SKGEPEIT

SEQ ID NO: 1984415 - protein, 7 aa, Staphylococcus
SKGEPFD

SEQ ID NO: 1984416 - protein, 8 aa, Staphylococcus
SKGERYDE

SEQ ID NO: 1984417 - protein, 7 aa, Staphylococcus
SKGESAL

SEQ ID NO: 1984418 - protein, 13 aa, Staphylococcus
SKGEVEAIPGKTM

SEQ ID NO: 1984419 - protein, 13 aa, Staphylococcus
SKGEVEGMPGKTM

SEQ ID NO: 1984420 - protein, 11 aa, Staphylococcus
SKGEVQELNSN

SEQ ID NO: 1984421 - protein, 6 aa, Staphylococcus
SKGFEK

SEQ ID NO: 1984422 - protein, 6 aa, Staphylococcus
SKGFNS

SEQ ID NO: 1984423 - protein, 4 aa, Staphylococcus
SKGG

SEQ ID NO: 1984424 - protein, 11 aa, Staphylococcus
SKGGDQSFEEK

SEQ ID NO: 1984425 - protein, 7 aa, Staphylococcus
SKGGKLT

SEQ ID NO: 1984426 - protein, 10 aa, Staphylococcus
SKGGNQSFEE

SEQ ID NO: 1984427 - protein, 11 aa, Staphylococcus
SKGGNQSFEEK

SEQ ID NO: 1984428 - protein, 7 aa, Staphylococcus
SKGGQLT

SEQ ID NO: 1984429 - protein, 11 aa, Staphylococcus
SKGGSQSFEEK

SEQ ID NO: 1984430 - protein, 4 aa, Staphylococcus
SKGH

SEQ ID NO: 1984431 - protein, 6 aa, Staphylococcus
SKGIEP

SEQ ID NO: 1984432 - protein, 7 aa, Staphylococcus
SKGIEPR

SEQ ID NO: 1984433 - protein, 10 aa, Staphylococcus
SKGKDPSYVK

SEQ ID NO: 1984434 - protein, 6 aa, Staphylococcus
SKGKEI

SEQ ID NO: 1984435 - protein, 14 aa, Staphylococcus
SKGKSPINWCENGE

SEQ ID NO: 1984436 - protein, 6 aa, Staphylococcus
SKGLKR

SEQ ID NO: 1984437 - protein, 13 aa, Staphylococcus
SKGLTEEKEGGLR

SEQ ID NO: 1984438 - protein, 7 aa, Staphylococcus
SKGLTSV

SEQ ID NO: 1984439 - protein, 7 aa, Staphylococcus
SKGNFSA

SEQ ID NO: 1984440 - protein, 10 aa, Staphylococcus
SKGPHPSESY

SEQ ID NO: 1984441 - protein, 6 aa, Staphylococcus
SKGQNT

SEQ ID NO: 1984442 - protein, 8 aa, Staphylococcus
SKGQSHHE

SEQ ID NO: 1984443 - protein, 5 aa, Staphylococcus
SKGQY

SEQ ID NO: 1984444 - protein, 7 aa, Staphylococcus
SKGRLTK

SEQ ID NO: 1984445 - protein, 13 aa, Staphylococcus
SKGRMKKEDYEQV

SEQ ID NO: 1984446 - protein, 9 aa, Staphylococcus
SKGRSGKGL

SEQ ID NO: 1984447 - protein, 9 aa, Staphylococcus
SKGRSSHSS

SEQ ID NO: 1984448 - protein, 8 aa, Staphylococcus
SKGSIPRF

SEQ ID NO: 1984449 - protein, 8 aa, Staphylococcus
SKGSPMPL

SEQ ID NO: 1984450 - protein, 9 aa, Staphylococcus
SKGSTGRSY

SEQ ID NO: 1984451 - protein, 7 aa, Staphylococcus
SKGTIEE

SEQ ID NO: 1984452 - protein, 13 aa, Staphylococcus
SKGVARANDVSDT

SEQ ID NO: 1984453 - protein, 4 aa, Staphylococcus
SKGY

SEQ ID NO: 1984454 - protein, 16 aa, Staphylococcus
SKGYKAEGLHGDITQA

SEQ ID NO: 1984455 - protein, 19 aa, Staphylococcus
SKGYKIDETEWTQANYSKK

SEQ ID NO: 1984456 - protein, 9 aa, Staphylococcus
SKGYPPSVR

SEQ ID NO: 1984457 - protein, 7 aa, Staphylococcus
SKGYREA

SEQ ID NO: 1984458 - protein, 7 aa, Staphylococcus
SKGYTPK

SEQ ID NO: 1984459 - protein, 4 aa, Staphylococcus
SKHE

SEQ ID NO: 1984460 - protein, 8 aa, Staphylococcus
SKHEKAER

SEQ ID NO: 1984461 - protein, 4 aa, Staphylococcus
SKHI

SEQ ID NO: 1984462 - protein, 7 aa, Staphylococcus
SKHIPSE

SEQ ID NO: 1984463 - protein, 10 aa, Staphylococcus
SKHKKQYPAK

SEQ ID NO: 1984464 - protein, 7 aa, Staphylococcus
SKHNYDG

SEQ ID NO: 1984465 - protein, 5 aa, Staphylococcus
SKHPE

SEQ ID NO: 1984466 - protein, 7 aa, Staphylococcus
SKHPLTR

SEQ ID NO: 1984467 - protein, 7 aa, Staphylococcus
SKHPTDL

SEQ ID NO: 1984468 - protein, 4 aa, Staphylococcus
SKHT

SEQ ID NO: 1984469 - protein, 9 aa, Staphylococcus
SKHTRSDET

SEQ ID NO: 1984470 - protein, 10 aa, Staphylococcus
SKIDAKQLKP

SEQ ID NO: 1984471 - protein, 8 aa, Staphylococcus
SKIDKEDF

SEQ ID NO: 1984472 - protein, 8 aa, Staphylococcus
SKIDNYDE

SEQ ID NO: 1984473 - protein, 6 aa, Staphylococcus
SKIDPY

SEQ ID NO: 1984474 - protein, 20 aa, Staphylococcus
SKIEDAPTNKVNDTKYLSEK

SEQ ID NO: 1984475 - protein, 18 aa, Staphylococcus
SKIEDNENAELQDQHQDT

SEQ ID NO: 1984476 - protein, 6 aa, Staphylococcus
SKIEKG

SEQ ID NO: 1984477 - protein, 6 aa, Staphylococcus
SKIEQR

SEQ ID NO: 1984478 - protein, 10 aa, Staphylococcus
SKIEREKRES

SEQ ID NO: 1984479 - protein, 9 aa, Staphylococcus
SKIESGQAI

SEQ ID NO: 1984480 - protein, 8 aa, Staphylococcus
SKIGKDDF

SEQ ID NO: 1984481 - protein, 6 aa, Staphylococcus
SKIGYK

SEQ ID NO: 1984482 - protein, 6 aa, Staphylococcus
SKIKPG

SEQ ID NO: 1984483 - protein, 15 aa, Staphylococcus
SKIKTSLKEAIEDGM

SEQ ID NO: 1984484 - protein, 11 aa, Staphylococcus
SKIKYGTPKQV

SEQ ID NO: 1984485 - protein, 5 aa, Staphylococcus
SKINN

SEQ ID NO: 1984486 - protein, 8 aa, Staphylococcus
SKINQSSL

SEQ ID NO: 1984487 - protein, 14 aa, Staphylococcus
SKIPEEGLPLALLK

SEQ ID NO: 1984488 - protein, 11 aa, Staphylococcus
SKIQEVDDNRA

SEQ ID NO: 1984489 - protein, 5 aa, Staphylococcus
SKISE

SEQ ID NO: 1984490 - protein, 8 aa, Staphylococcus
SKISSGNG

SEQ ID NO: 1984491 - protein, 12 aa, Staphylococcus
SKISSTNQRIKQ

SEQ ID NO: 1984492 - protein, 7 aa, Staphylococcus
SKISVGN

SEQ ID NO: 1984493 - protein, 10 aa, Staphylococcus
SKITDLTDRS

SEQ ID NO: 1984494 - protein, 7 aa, Staphylococcus
SKITDYK

SEQ ID NO: 1984495 - protein, 7 aa, Staphylococcus
SKITERH

SEQ ID NO: 1984496 - protein, 11 aa, Staphylococcus
SKITNEEQAYD

SEQ ID NO: 1984497 - protein, 7 aa, Staphylococcus
SKITNTE

SEQ ID NO: 1984498 - protein, 17 aa, Staphylococcus
SKKAETNRITGISSKPP

SEQ ID NO: 1984499 - protein, 9 aa, Staphylococcus
SKKAETQRI

SEQ ID NO: 1984500 - protein, 9 aa, Staphylococcus
SKKAETSRI

SEQ ID NO: 1984501 - protein, 10 aa, Staphylococcus
SKKAIDEATS

SEQ ID NO: 1984502 - protein, 7 aa, Staphylococcus
SKKAQSL

SEQ ID NO: 1984503 - protein, 4 aa, Staphylococcus
SKKD

SEQ ID NO: 1984504 - protein, 8 aa, Staphylococcus
SKKDARRM

SEQ ID NO: 1984505 - protein, 14 aa, Staphylococcus
SKKDEITSKEIATY

SEQ ID NO: 1984506 - protein, 9 aa, Staphylococcus
SKKDGEPDK

SEQ ID NO: 1984507 - protein, 20 aa, Staphylococcus
SKKDMKHNHATPKLDVDPQT

SEQ ID NO: 1984508 - protein, 20 aa, Staphylococcus
SKKDMKNNNATPDLDVDPQT

SEQ ID NO: 1984509 - protein, 8 aa, Staphylococcus
SKKDPIGA

SEQ ID NO: 1984510 - protein, 9 aa, Staphylococcus
SKKDPIGAM

SEQ ID NO: 1984511 - protein, 9 aa, Staphylococcus
SKKEANRVH

SEQ ID NO: 1984512 - protein, 8 aa, Staphylococcus
SKKEASPY

SEQ ID NO: 1984513 - protein, 11 aa, Staphylococcus
SKKEMNDKDIT

SEQ ID NO: 1984514 - protein, 5 aa, Staphylococcus
SKKET

SEQ ID NO: 1984515 - protein, 8 aa, Staphylococcus
SKKEVDNT

SEQ ID NO: 1984516 - protein, 4 aa, Staphylococcus
SKKF

SEQ ID NO: 1984517 - protein, 10 aa, Staphylococcus
SKKFERDGDD

SEQ ID NO: 1984518 - protein, 7 aa, Staphylococcus
SKKGIEV

SEQ ID NO: 1984519 - protein, 7 aa, Staphylococcus
SKKGISV

SEQ ID NO: 1984520 - protein, 10 aa, Staphylococcus
SKKGKSLKTK

SEQ ID NO: 1984521 - protein, 8 aa, Staphylococcus
SKKGLSPE

SEQ ID NO: 1984522 - protein, 9 aa, Staphylococcus
SKKHDLSKG

SEQ ID NO: 1984523 - protein, 15 aa, Staphylococcus
SKKIEELKSQLKEDK

SEQ ID NO: 1984524 - protein, 9 aa, Staphylococcus
SKKINKNVR

SEQ ID NO: 1984525 - protein, 5 aa, Staphylococcus
SKKIT

SEQ ID NO: 1984526 - protein, 6 aa, Staphylococcus
SKKKKA

SEQ ID NO: 1984527 - protein, 8 aa, Staphylococcus
SKKKRSRN

SEQ ID NO: 1984528 - protein, 7 aa, Staphylococcus
SKKLGKT

SEQ ID NO: 1984529 - protein, 9 aa, Staphylococcus
SKKNRAILE

SEQ ID NO: 1984530 - protein, 8 aa, Staphylococcus
SKKNRAML

SEQ ID NO: 1984531 - protein, 10 aa, Staphylococcus
SKKNRAVLES

SEQ ID NO: 1984532 - protein, 9 aa, Staphylococcus
SKKNYDKDR

SEQ ID NO: 1984533 - protein, 9 aa, Staphylococcus
SKKPGTIEP

SEQ ID NO: 1984534 - protein, 17 aa, Staphylococcus
SKKPHYANKLSKRESEV

SEQ ID NO: 1984535 - protein, 8 aa, Staphylococcus
SKKPYESV

SEQ ID NO: 1984536 - protein, 7 aa, Staphylococcus
SKKQELN

SEQ ID NO: 1984537 - protein, 21 aa, Staphylococcus
SKKQTLNKEPLVKKDGLKGGG

SEQ ID NO: 1984538 - protein, 8 aa, Staphylococcus
SKKREDNF

SEQ ID NO: 1984539 - protein, 8 aa, Staphylococcus
SKKRLSQR

SEQ ID NO: 1984540 - protein, 10 aa, Staphylococcus
SKKRNKNDER

SEQ ID NO: 1984541 - protein, 7 aa, Staphylococcus
SKKSGPW

SEQ ID NO: 1984542 - protein, 7 aa, Staphylococcus
SKKSHAM

SEQ ID NO: 1984543 - protein, 7 aa, Staphylococcus
SKKSKPD

SEQ ID NO: 1984544 - protein, 5 aa, Staphylococcus
SKKTI

SEQ ID NO: 1984545 - protein, 17 aa, Staphylococcus
SKKTTTEENNFKNGPLT

SEQ ID NO: 1984546 - protein, 8 aa, Staphylococcus
SKKVGDNV

SEQ ID NO: 1984547 - protein, 9 aa, Staphylococcus
SKKWSEEEL

SEQ ID NO: 1984548 - protein, 7 aa, Staphylococcus
SKKYMEA

SEQ ID NO: 1984549 - protein, 10 aa, Staphylococcus
SKKYNEKDLT

SEQ ID NO: 1984550 - protein, 17 aa, Staphylococcus
SKKYPDESSFKRPYQTF

SEQ ID NO: 1984551 - protein, 6 aa, Staphylococcus
SKKYYN

SEQ ID NO: 1984552 - protein, 8 aa, Staphylococcus
SKLAGKDT

SEQ ID NO: 1984553 - protein, 17 aa, Staphylococcus
SKLAGTERGITEPEPSF

SEQ ID NO: 1984554 - protein, 15 aa, Staphylococcus
SKLAGTERGITEPVP

SEQ ID NO: 1984555 - protein, 17 aa, Staphylococcus
SKLAQYNSKSDSGTTKF

SEQ ID NO: 1984556 - protein, 8 aa, Staphylococcus
SKLDDMTK

SEQ ID NO: 1984557 - protein, 5 aa, Staphylococcus
SKLDV

SEQ ID NO: 1984558 - protein, 17 aa, Staphylococcus
SKLEQSYDAPGRMSFHL

SEQ ID NO: 1984559 - protein, 11 aa, Staphylococcus
SKLERSFNAPG

SEQ ID NO: 1984560 - protein, 8 aa, Staphylococcus
SKLERYDD

SEQ ID NO: 1984561 - protein, 4 aa, Staphylococcus
SKLG

SEQ ID NO: 1984562 - protein, 7 aa, Staphylococcus
SKLGGHS

SEQ ID NO: 1984563 - protein, 6 aa, Staphylococcus
SKLHDD

SEQ ID NO: 1984564 - protein, 6 aa, Staphylococcus
SKLHED

SEQ ID NO: 1984565 - protein, 6 aa, Staphylococcus
SKLIDN

SEQ ID NO: 1984566 - protein, 7 aa, Staphylococcus
SKLKEEG

SEQ ID NO: 1984567 - protein, 8 aa, Staphylococcus
SKLKKDGE

SEQ ID NO: 1984568 - protein, 17 aa, Staphylococcus
SKLKKKIESGKEPKVVK

SEQ ID NO: 1984569 - protein, 7 aa, Staphylococcus
SKLKPDG

SEQ ID NO: 1984570 - protein, 16 aa, Staphylococcus
SKLNDQSKSIQDVDNE

SEQ ID NO: 1984571 - protein, 7 aa, Staphylococcus
SKLNEND

SEQ ID NO: 1984572 - protein, 7 aa, Staphylococcus
SKLPQAK

SEQ ID NO: 1984573 - protein, 6 aa, Staphylococcus
SKLPSN

SEQ ID NO: 1984574 - protein, 4 aa, Staphylococcus
SKLQ

SEQ ID NO: 1984575 - protein, 9 aa, Staphylococcus
SKLQDEPGY

SEQ ID NO: 1984576 - protein, 7 aa, Staphylococcus
SKLQDTV

SEQ ID NO: 1984577 - protein, 5 aa, Staphylococcus
SKLQH

SEQ ID NO: 1984578 - protein, 11 aa, Staphylococcus
SKLQKGSIYSE

SEQ ID NO: 1984579 - protein, 16 aa, Staphylococcus
SKLRKPAAEVKKFDDS

SEQ ID NO: 1984580 - protein, 10 aa, Staphylococcus
SKLRQHSPYQ

SEQ ID NO: 1984581 - protein, 14 aa, Staphylococcus
SKLRRAEKNTKQFK

SEQ ID NO: 1984582 - protein, 14 aa, Staphylococcus
SKLRRAEKNTKQFQ

SEQ ID NO: 1984583 - protein, 14 aa, Staphylococcus
SKLRRAEKNTKQFR

SEQ ID NO: 1984584 - protein, 14 aa, Staphylococcus
SKLRRAESNAKQFR

SEQ ID NO: 1984585 - protein, 12 aa, Staphylococcus
SKLSEGYKESEM

SEQ ID NO: 1984586 - protein, 10 aa, Staphylococcus
SKLSGEGTTV

SEQ ID NO: 1984587 - protein, 16 aa, Staphylococcus
SKLSNQTRSIKDIDKE

SEQ ID NO: 1984588 - protein, 13 aa, Staphylococcus
SKLTDENDNNFSN

SEQ ID NO: 1984589 - protein, 17 aa, Staphylococcus
SKLTEAKNKQSEDEEKL

SEQ ID NO: 1984590 - protein, 10 aa, Staphylococcus
SKLTGERVDG

SEQ ID NO: 1984591 - protein, 9 aa, Staphylococcus
SKLTNHEKA

SEQ ID NO: 1984592 - protein, 6 aa, Staphylococcus
SKLTQA

SEQ ID NO: 1984593 - protein, 8 aa, Staphylococcus
SKMDPDEY

SEQ ID NO: 1984594 - protein, 19 aa, Staphylococcus
SKMERSFNAPGRMCLYVNP

SEQ ID NO: 1984595 - protein, 20 aa, Staphylococcus
SKMFSPAPAHFGAKPNSNTN

SEQ ID NO: 1984596 - protein, 6 aa, Staphylococcus
SKMIEN

SEQ ID NO: 1984597 - protein, 7 aa, Staphylococcus
SKMKDYD

SEQ ID NO: 1984598 - protein, 6 aa, Staphylococcus
SKMKLS

SEQ ID NO: 1984599 - protein, 5 aa, Staphylococcus
SKMNE

SEQ ID NO: 1984600 - protein, 15 aa, Staphylococcus
SKMRSKGKDKGFDLD

SEQ ID NO: 1984601 - protein, 20 aa, Staphylococcus
SKMTPQPDCGETSYKGHERL

SEQ ID NO: 1984602 - protein, 5 aa, Staphylococcus
SKMYG

SEQ ID NO: 1984603 - protein, 10 aa, Staphylococcus
SKNAKVTTSV

SEQ ID NO: 1984604 - protein, 9 aa, Staphylococcus
SKNASGQLR

SEQ ID NO: 1984605 - protein, 12 aa, Staphylococcus
SKNDANAPVGPS

SEQ ID NO: 1984606 - protein, 6 aa, Staphylococcus
SKNDDL

SEQ ID NO: 1984607 - protein, 7 aa, Staphylococcus
SKNDDRV

SEQ ID NO: 1984608 - protein, 10 aa, Staphylococcus
SKNDEKGSNI

SEQ ID NO: 1984609 - protein, 12 aa, Staphylococcus
SKNDGVNKPFET

SEQ ID NO: 1984610 - protein, 6 aa, Staphylococcus
SKNDKL

SEQ ID NO: 1984611 - protein, 20 aa, Staphylococcus
SKNDRTTTQVKELKKEDKID

SEQ ID NO: 1984612 - protein, 12 aa, Staphylococcus
SKNDTHVSYKET

SEQ ID NO: 1984613 - protein, 14 aa, Staphylococcus
SKNEELTKREEDIN

SEQ ID NO: 1984614 - protein, 5 aa, Staphylococcus
SKNEI

SEQ ID NO: 1984615 - protein, 8 aa, Staphylococcus
SKNEQKQY

SEQ ID NO: 1984616 - protein, 10 aa, Staphylococcus
SKNEVSEGAI

SEQ ID NO: 1984617 - protein, 5 aa, Staphylococcus
SKNFK

SEQ ID NO: 1984618 - protein, 10 aa, Staphylococcus
SKNGDLEDKA

SEQ ID NO: 1984619 - protein, 8 aa, Staphylococcus
SKNGHRIN

SEQ ID NO: 1984620 - protein, 6 aa, Staphylococcus
SKNGQI

SEQ ID NO: 1984621 - protein, 9 aa, Staphylococcus
SKNGVPDKL

SEQ ID NO: 1984622 - protein, 15 aa, Staphylococcus
SKNGYQNISDIIGLD

SEQ ID NO: 1984623 - protein, 7 aa, Staphylococcus
SKNGYYD

SEQ ID NO: 1984624 - protein, 9 aa, Staphylococcus
SKNIADTTG

SEQ ID NO: 1984625 - protein, 12 aa, Staphylococcus
SKNIKQVQERLG

SEQ ID NO: 1984626 - protein, 10 aa, Staphylococcus
SKNITDKQDI

SEQ ID NO: 1984627 - protein, 11 aa, Staphylococcus
SKNKKDAKDNL

SEQ ID NO: 1984628 - protein, 15 aa, Staphylococcus
SKNKKLTSQEGKSQL

SEQ ID NO: 1984629 - protein, 7 aa, Staphylococcus
SKNKSLA

SEQ ID NO: 1984630 - protein, 15 aa, Staphylococcus
SKNKTEEGGLSGKPL

SEQ ID NO: 1984631 - protein, 6 aa, Staphylococcus
SKNLGE

SEQ ID NO: 1984632 - protein, 5 aa, Staphylococcus
SKNLN

SEQ ID NO: 1984633 - protein, 5 aa, Staphylococcus
SKNMN

SEQ ID NO: 1984634 - protein, 4 aa, Staphylococcus
SKNN

SEQ ID NO: 1984635 - protein, 9 aa, Staphylococcus
SKNNEASRK

SEQ ID NO: 1984636 - protein, 6 aa, Staphylococcus
SKNNTL

SEQ ID NO: 1984637 - protein, 6 aa, Staphylococcus
SKNNVI

SEQ ID NO: 1984638 - protein, 7 aa, Staphylococcus
SKNPDIS

SEQ ID NO: 1984639 - protein, 11 aa, Staphylococcus
SKNPKENLNKN

SEQ ID NO: 1984640 - protein, 7 aa, Staphylococcus
SKNPKTV

SEQ ID NO: 1984641 - protein, 9 aa, Staphylococcus
SKNPMNGEQ

SEQ ID NO: 1984642 - protein, 9 aa, Staphylococcus
SKNPMNGSQ

SEQ ID NO: 1984643 - protein, 7 aa, Staphylococcus
SKNQALR

SEQ ID NO: 1984644 - protein, 6 aa, Staphylococcus
SKNQDA

SEQ ID NO: 1984645 - protein, 7 aa, Staphylococcus
SKNQELN

SEQ ID NO: 1984646 - protein, 6 aa, Staphylococcus
SKNQKS

SEQ ID NO: 1984647 - protein, 10 aa, Staphylococcus
SKNQPVGRRS

SEQ ID NO: 1984648 - protein, 9 aa, Staphylococcus
SKNSEGELK

SEQ ID NO: 1984649 - protein, 14 aa, Staphylococcus
SKNTIHDGARHQTI

SEQ ID NO: 1984650 - protein, 6 aa, Staphylococcus
SKNTKL

SEQ ID NO: 1984651 - protein, 13 aa, Staphylococcus
SKNTNKLKATLEK

SEQ ID NO: 1984652 - protein, 9 aa, Staphylococcus
SKNTNNTLK

SEQ ID NO: 1984653 - protein, 8 aa, Staphylococcus
SKNTSERN

SEQ ID NO: 1984654 - protein, 4 aa, Staphylococcus
SKNV

SEQ ID NO: 1984655 - protein, 9 aa, Staphylococcus
SKNVKSEGL

SEQ ID NO: 1984656 - protein, 12 aa, Staphylococcus
SKNVNDDHSISG

SEQ ID NO: 1984657 - protein, 9 aa, Staphylococcus
SKNVNLPTK

SEQ ID NO: 1984658 - protein, 5 aa, Staphylococcus
SKPAG

SEQ ID NO: 1984659 - protein, 8 aa, Staphylococcus
SKPAVTKS

SEQ ID NO: 1984660 - protein, 10 aa, Staphylococcus
SKPEAYRTQA

SEQ ID NO: 1984661 - protein, 23 aa, Staphylococcus
SKPEKDAKEIAKAREAKQSSYPA

SEQ ID NO: 1984662 - protein, 21 aa, Staphylococcus
SKPEKDAKQIAKAKAEPAKHY

SEQ ID NO: 1984663 - protein, 6 aa, Staphylococcus
SKPFIP

SEQ ID NO: 1984664 - protein, 7 aa, Staphylococcus
SKPFVPP

SEQ ID NO: 1984665 - protein, 26 aa, Staphylococcus
SKPGSASTPATRKDANGYRENPHGTL

SEQ ID NO: 1984666 - protein, 15 aa, Staphylococcus
SKPKLKDEKFERDNT

SEQ ID NO: 1984667 - protein, 6 aa, Staphylococcus
SKPLIS

SEQ ID NO: 1984668 - protein, 10 aa, Staphylococcus
SKPLNELEGR

SEQ ID NO: 1984669 - protein, 6 aa, Staphylococcus
SKPNRL

SEQ ID NO: 1984670 - protein, 8 aa, Staphylococcus
SKPNRLHQ

SEQ ID NO: 1984671 - protein, 16 aa, Staphylococcus
SKPPHALSQEERKKPV

SEQ ID NO: 1984672 - protein, 6 aa, Staphylococcus
SKPPHV

SEQ ID NO: 1984673 - protein, 17 aa, Staphylococcus
SKPPHVLDPEERKKPVQ

SEQ ID NO: 1984674 - protein, 17 aa, Staphylococcus
SKPPHVLEPDARKKSID

SEQ ID NO: 1984675 - protein, 16 aa, Staphylococcus
SKPPHVLSPEERKKTI

SEQ ID NO: 1984676 - protein, 16 aa, Staphylococcus
SKPPHVLSPEERKKTV

SEQ ID NO: 1984677 - protein, 7 aa, Staphylococcus
SKPRSGY

SEQ ID NO: 1984678 - protein, 8 aa, Staphylococcus
SKPRSGYY

SEQ ID NO: 1984679 - protein, 9 aa, Staphylococcus
SKPSMSSGV

SEQ ID NO: 1984680 - protein, 9 aa, Staphylococcus
SKPSMSTGV

SEQ ID NO: 1984681 - protein, 7 aa, Staphylococcus
SKPTAKR

SEQ ID NO: 1984682 - protein, 16 aa, Staphylococcus
SKPTGGLFDGEAEGNI

SEQ ID NO: 1984683 - protein, 7 aa, Staphylococcus
SKPVKEN

SEQ ID NO: 1984684 - protein, 6 aa, Staphylococcus
SKPVQQ

SEQ ID NO: 1984685 - protein, 7 aa, Staphylococcus
SKPYFGT

SEQ ID NO: 1984686 - protein, 6 aa, Staphylococcus
SKPYGE

SEQ ID NO: 1984687 - protein, 9 aa, Staphylococcus
SKPYQLSPE

SEQ ID NO: 1984688 - protein, 29 aa, Staphylococcus
SKPYSKANAYLESKGQTPIQWCEREDTTH

SEQ ID NO: 1984689 - protein, 9 aa, Staphylococcus
SKPYSKTND

SEQ ID NO: 1984690 - protein, 9 aa, Staphylococcus
SKPYSQANT

SEQ ID NO: 1984691 - protein, 9 aa, Staphylococcus
SKPYSRANA

SEQ ID NO: 1984692 - protein, 9 aa, Staphylococcus
SKPYSRANT

SEQ ID NO: 1984693 - protein, 26 aa, Staphylococcus
SKPYSRTNDYLKSKGKTPIQWCESGE

SEQ ID NO: 1984694 - protein, 9 aa, Staphylococcus
SKPYSRTNE

SEQ ID NO: 1984695 - protein, 32 aa, Staphylococcus
SKQAQKEADKTSYSKTLSKYKAELNQKNDDIE

SEQ ID NO: 1984696 - protein, 22 aa, Staphylococcus
SKQATLNKEPLVKKDGLKGGGY

SEQ ID NO: 1984697 - protein, 8 aa, Staphylococcus
SKQATSPV

SEQ ID NO: 1984698 - protein, 9 aa, Staphylococcus
SKQDEGKTI

SEQ ID NO: 1984699 - protein, 17 aa, Staphylococcus
SKQDGKDKYDVTSDNYR

SEQ ID NO: 1984700 - protein, 9 aa, Staphylococcus
SKQDQPIKE

SEQ ID NO: 1984701 - protein, 11 aa, Staphylococcus
SKQDTINKEPL

SEQ ID NO: 1984702 - protein, 11 aa, Staphylococcus
SKQEIDKEVKE

SEQ ID NO: 1984703 - protein, 6 aa, Staphylococcus
SKQETH

SEQ ID NO: 1984704 - protein, 12 aa, Staphylococcus
SKQFQSATQFKF

SEQ ID NO: 1984705 - protein, 9 aa, Staphylococcus
SKQHTEQKL

SEQ ID NO: 1984706 - protein, 8 aa, Staphylococcus
SKQIDKTS

SEQ ID NO: 1984707 - protein, 7 aa, Staphylococcus
SKQINGR

SEQ ID NO: 1984708 - protein, 9 aa, Staphylococcus
SKQISKKQY

SEQ ID NO: 1984709 - protein, 4 aa, Staphylococcus
SKQK

SEQ ID NO: 1984710 - protein, 6 aa, Staphylococcus
SKQKGI

SEQ ID NO: 1984711 - protein, 8 aa, Staphylococcus
SKQKRSRN

SEQ ID NO: 1984712 - protein, 7 aa, Staphylococcus
SKQMEQS

SEQ ID NO: 1984713 - protein, 4 aa, Staphylococcus
SKQN

SEQ ID NO: 1984714 - protein, 12 aa, Staphylococcus
SKQNDYVEPQKP

SEQ ID NO: 1984715 - protein, 10 aa, Staphylococcus
SKQPVSEQPS

SEQ ID NO: 1984716 - protein, 6 aa, Staphylococcus
SKQQFD

SEQ ID NO: 1984717 - protein, 7 aa, Staphylococcus
SKQQPDA

SEQ ID NO: 1984718 - protein, 9 aa, Staphylococcus
SKQQPFTGE

SEQ ID NO: 1984719 - protein, 6 aa, Staphylococcus
SKQRAD

SEQ ID NO: 1984720 - protein, 10 aa, Staphylococcus
SKQRSLREAV

SEQ ID NO: 1984721 - protein, 6 aa, Staphylococcus
SKQRYQ

SEQ ID NO: 1984722 - protein, 6 aa, Staphylococcus
SKQSAT

SEQ ID NO: 1984723 - protein, 8 aa, Staphylococcus
SKQSEARG

SEQ ID NO: 1984724 - protein, 9 aa, Staphylococcus
SKQSEMRQF

SEQ ID NO: 1984725 - protein, 9 aa, Staphylococcus
SKQSNKDMR

SEQ ID NO: 1984726 - protein, 6 aa, Staphylococcus
SKQTFD

SEQ ID NO: 1984727 - protein, 9 aa, Staphylococcus
SKQTKSTSH

SEQ ID NO: 1984728 - protein, 5 aa, Staphylococcus
SKQTM

SEQ ID NO: 1984729 - protein, 6 aa, Staphylococcus
SKQTME

SEQ ID NO: 1984730 - protein, 6 aa, Staphylococcus
SKQTSL

SEQ ID NO: 1984731 - protein, 15 aa, Staphylococcus
SKQTSLRDPVNSETD

SEQ ID NO: 1984732 - protein, 6 aa, Staphylococcus
SKQYKG

SEQ ID NO: 1984733 - protein, 7 aa, Staphylococcus
SKQYPEL

SEQ ID NO: 1984734 - protein, 8 aa, Staphylococcus
SKRAQTVN

SEQ ID NO: 1984735 - protein, 7 aa, Staphylococcus
SKRDDAL

SEQ ID NO: 1984736 - protein, 8 aa, Staphylococcus
SKRDNQPK

SEQ ID NO: 1984737 - protein, 6 aa, Staphylococcus
SKRDQY

SEQ ID NO: 1984738 - protein, 10 aa, Staphylococcus
SKRDSAKAKM

SEQ ID NO: 1984739 - protein, 6 aa, Staphylococcus
SKRDTL

SEQ ID NO: 1984740 - protein, 4 aa, Staphylococcus
SKRE

SEQ ID NO: 1984741 - protein, 7 aa, Staphylococcus
SKREISK

SEQ ID NO: 1984742 - protein, 5 aa, Staphylococcus
SKREM

SEQ ID NO: 1984743 - protein, 7 aa, Staphylococcus
SKRESND

SEQ ID NO: 1984744 - protein, 6 aa, Staphylococcus
SKRETE

SEQ ID NO: 1984745 - protein, 8 aa, Staphylococcus
SKREYKDF

SEQ ID NO: 1984746 - protein, 5 aa, Staphylococcus
SKRGA

SEQ ID NO: 1984747 - protein, 11 aa, Staphylococcus
SKRGCRNTSSI

SEQ ID NO: 1984748 - protein, 26 aa, Staphylococcus
SKRGLETAVGDEGGFAPKFEGTEDAV

SEQ ID NO: 1984749 - protein, 7 aa, Staphylococcus
SKRGVEI

SEQ ID NO: 1984750 - protein, 7 aa, Staphylococcus
SKRHIQA

SEQ ID NO: 1984751 - protein, 7 aa, Staphylococcus
SKRHQSI

SEQ ID NO: 1984752 - protein, 5 aa, Staphylococcus
SKRIG

SEQ ID NO: 1984753 - protein, 8 aa, Staphylococcus
SKRIKANS

SEQ ID NO: 1984754 - protein, 7 aa, Staphylococcus
SKRKAKK

SEQ ID NO: 1984755 - protein, 7 aa, Staphylococcus
SKRKFQQ

SEQ ID NO: 1984756 - protein, 9 aa, Staphylococcus
SKRKPQPNG

SEQ ID NO: 1984757 - protein, 6 aa, Staphylococcus
SKRKQL

SEQ ID NO: 1984758 - protein, 13 aa, Staphylococcus
SKRKQLNIDPNDT

SEQ ID NO: 1984759 - protein, 14 aa, Staphylococcus
SKRKQLNIDTSSKN

SEQ ID NO: 1984760 - protein, 7 aa, Staphylococcus
SKRLKRP

SEQ ID NO: 1984761 - protein, 8 aa, Staphylococcus
SKRLNQPL

SEQ ID NO: 1984762 - protein, 7 aa, Staphylococcus
SKRNQNL

SEQ ID NO: 1984763 - protein, 8 aa, Staphylococcus
SKRPDKER

SEQ ID NO: 1984764 - protein, 7 aa, Staphylococcus
SKRPSLD

SEQ ID NO: 1984765 - protein, 4 aa, Staphylococcus
SKRQ

SEQ ID NO: 1984766 - protein, 13 aa, Staphylococcus
SKRQSTKDNNPND

SEQ ID NO: 1984767 - protein, 13 aa, Staphylococcus
SKRQSTKDNNPNN

SEQ ID NO: 1984768 - protein, 6 aa, Staphylococcus
SKRRVA

SEQ ID NO: 1984769 - protein, 8 aa, Staphylococcus
SKRVKDNS

SEQ ID NO: 1984770 - protein, 8 aa, Staphylococcus
SKRYDKAK

SEQ ID NO: 1984771 - protein, 8 aa, Staphylococcus
SKRYNPPI

SEQ ID NO: 1984772 - protein, 9 aa, Staphylococcus
SKRYPENSY

SEQ ID NO: 1984773 - protein, 4 aa, Staphylococcus
SKSA

SEQ ID NO: 1984774 - protein, 10 aa, Staphylococcus
SKSAGLDTTR

SEQ ID NO: 1984775 - protein, 8 aa, Staphylococcus
SKSANIAH

SEQ ID NO: 1984776 - protein, 9 aa, Staphylococcus
SKSASIANQ

SEQ ID NO: 1984777 - protein, 9 aa, Staphylococcus
SKSATTQNI

SEQ ID NO: 1984778 - protein, 8 aa, Staphylococcus
SKSEAMRR

SEQ ID NO: 1984779 - protein, 8 aa, Staphylococcus
SKSEAQSE

SEQ ID NO: 1984780 - protein, 6 aa, Staphylococcus
SKSEDI

SEQ ID NO: 1984781 - protein, 6 aa, Staphylococcus
SKSELQ

SEQ ID NO: 1984782 - protein, 8 aa, Staphylococcus
SKSEPTLK

SEQ ID NO: 1984783 - protein, 8 aa, Staphylococcus
SKSETDDE

SEQ ID NO: 1984784 - protein, 5 aa, Staphylococcus
SKSEY

SEQ ID NO: 1984785 - protein, 8 aa, Staphylococcus
SKSFPTNI

SEQ ID NO: 1984786 - protein, 14 aa, Staphylococcus
SKSGDVVKIVEIPK

SEQ ID NO: 1984787 - protein, 8 aa, Staphylococcus
SKSGEHKE

SEQ ID NO: 1984788 - protein, 7 aa, Staphylococcus
SKSGFGP

SEQ ID NO: 1984789 - protein, 14 aa, Staphylococcus
SKSGGKSGHYQRQD

SEQ ID NO: 1984790 - protein, 6 aa, Staphylococcus
SKSGHM

SEQ ID NO: 1984791 - protein, 9 aa, Staphylococcus
SKSGSVELS

SEQ ID NO: 1984792 - protein, 6 aa, Staphylococcus
SKSHEP

SEQ ID NO: 1984793 - protein, 7 aa, Staphylococcus
SKSIEGK

SEQ ID NO: 1984794 - protein, 5 aa, Staphylococcus
SKSIS

SEQ ID NO: 1984795 - protein, 8 aa, Staphylococcus
SKSISNGL

SEQ ID NO: 1984796 - protein, 9 aa, Staphylococcus
SKSITDDES

SEQ ID NO: 1984797 - protein, 9 aa, Staphylococcus
SKSKASSIV

SEQ ID NO: 1984798 - protein, 8 aa, Staphylococcus
SKSKDYYD

SEQ ID NO: 1984799 - protein, 7 aa, Staphylococcus
SKSKGQH

SEQ ID NO: 1984800 - protein, 21 aa, Staphylococcus
SKSKSHGKQNQIEGAASKGKK

SEQ ID NO: 1984801 - protein, 20 aa, Staphylococcus
SKSKSHGKQNQIEGALSKGK

SEQ ID NO: 1984802 - protein, 21 aa, Staphylococcus
SKSKSHGKQNQIEGAPSKGKK

SEQ ID NO: 1984803 - protein, 21 aa, Staphylococcus
SKSKSHGKQNQIEGAQSKNKK

SEQ ID NO: 1984804 - protein, 21 aa, Staphylococcus
SKSKSHGKQNQIEGAVSKGKK

SEQ ID NO: 1984805 - protein, 14 aa, Staphylococcus
SKSKVSGFEQDSSN

SEQ ID NO: 1984806 - protein, 4 aa, Staphylococcus
SKSL

SEQ ID NO: 1984807 - protein, 6 aa, Staphylococcus
SKSLEG

SEQ ID NO: 1984808 - protein, 8 aa, Staphylococcus
SKSLKHRN

SEQ ID NO: 1984809 - protein, 5 aa, Staphylococcus
SKSMR

SEQ ID NO: 1984810 - protein, 7 aa, Staphylococcus
SKSNIIT

SEQ ID NO: 1984811 - protein, 8 aa, Staphylococcus
SKSNISAQ

SEQ ID NO: 1984812 - protein, 7 aa, Staphylococcus
SKSNNDR

SEQ ID NO: 1984813 - protein, 17 aa, Staphylococcus
SKSNNIDNTVNEFKKYF

SEQ ID NO: 1984814 - protein, 6 aa, Staphylococcus
SKSQIA

SEQ ID NO: 1984815 - protein, 5 aa, Staphylococcus
SKSRA

SEQ ID NO: 1984816 - protein, 7 aa, Staphylococcus
SKSREWE

SEQ ID NO: 1984817 - protein, 7 aa, Staphylococcus
SKSRVDD

SEQ ID NO: 1984818 - protein, 30 aa, Staphylococcus
SKSSGREQHYPDDAIDDKDERRKNKEETYH

SEQ ID NO: 1984819 - protein, 7 aa, Staphylococcus
SKSSIDG

SEQ ID NO: 1984820 - protein, 5 aa, Staphylococcus
SKSSL

SEQ ID NO: 1984821 - protein, 7 aa, Staphylococcus
SKSSLDS

SEQ ID NO: 1984822 - protein, 6 aa, Staphylococcus
SKSSYI

SEQ ID NO: 1984823 - protein, 8 aa, Staphylococcus
SKSTASKI

SEQ ID NO: 1984824 - protein, 7 aa, Staphylococcus
SKSTDTM

SEQ ID NO: 1984825 - protein, 11 aa, Staphylococcus
SKSTQQHVNET

SEQ ID NO: 1984826 - protein, 14 aa, Staphylococcus
SKSYEPLTLESEDK

SEQ ID NO: 1984827 - protein, 9 aa, Staphylococcus
SKTADESMT

SEQ ID NO: 1984828 - protein, 13 aa, Staphylococcus
SKTAFDGRGNYTL

SEQ ID NO: 1984829 - protein, 8 aa, Staphylococcus
SKTANQIQ

SEQ ID NO: 1984830 - protein, 8 aa, Staphylococcus
SKTATKIQ

SEQ ID NO: 1984831 - protein, 5 aa, Staphylococcus
SKTDD

SEQ ID NO: 1984832 - protein, 7 aa, Staphylococcus
SKTDVIT

SEQ ID NO: 1984833 - protein, 5 aa, Staphylococcus
SKTDY

SEQ ID NO: 1984834 - protein, 29 aa, Staphylococcus
SKTEEMKAKRNKVSEEIAQKKRNKENADD

SEQ ID NO: 1984835 - protein, 6 aa, Staphylococcus
SKTEEY

SEQ ID NO: 1984836 - protein, 16 aa, Staphylococcus
SKTEYRGREATDFKEE

SEQ ID NO: 1984837 - protein, 22 aa, Staphylococcus
SKTGELENKETIKKRIKEAEQY

SEQ ID NO: 1984838 - protein, 12 aa, Staphylococcus
SKTGGKSGEYYR

SEQ ID NO: 1984839 - protein, 13 aa, Staphylococcus
SKTGKQKEGFNQT

SEQ ID NO: 1984840 - protein, 15 aa, Staphylococcus
SKTGSHIVPNGKEDK

SEQ ID NO: 1984841 - protein, 8 aa, Staphylococcus
SKTIDLDN

SEQ ID NO: 1984842 - protein, 5 aa, Staphylococcus
SKTIF

SEQ ID NO: 1984843 - protein, 4 aa, Staphylococcus
SKTK

SEQ ID NO: 1984844 - protein, 15 aa, Staphylococcus
SKTKDDKDPQVHIYS

SEQ ID NO: 1984845 - protein, 9 aa, Staphylococcus
SKTKESNIL

SEQ ID NO: 1984846 - protein, 6 aa, Staphylococcus
SKTKQL

SEQ ID NO: 1984847 - protein, 9 aa, Staphylococcus
SKTLGEEIE

SEQ ID NO: 1984848 - protein, 7 aa, Staphylococcus
SKTMSKQ

SEQ ID NO: 1984849 - protein, 14 aa, Staphylococcus
SKTNEITSKEIATY

SEQ ID NO: 1984850 - protein, 11 aa, Staphylococcus
SKTNETRSNEI

SEQ ID NO: 1984851 - protein, 7 aa, Staphylococcus
SKTNKKI

SEQ ID NO: 1984852 - protein, 7 aa, Staphylococcus
SKTNQQL

SEQ ID NO: 1984853 - protein, 8 aa, Staphylococcus
SKTNTDPI

SEQ ID NO: 1984854 - protein, 9 aa, Staphylococcus
SKTPELEDK

SEQ ID NO: 1984855 - protein, 12 aa, Staphylococcus
SKTPPTTSQPAI

SEQ ID NO: 1984856 - protein, 9 aa, Staphylococcus
SKTQHPNAD

SEQ ID NO: 1984857 - protein, 6 aa, Staphylococcus
SKTQKY

SEQ ID NO: 1984858 - protein, 9 aa, Staphylococcus
SKTQNRTAL

SEQ ID NO: 1984859 - protein, 7 aa, Staphylococcus
SKTQPHN

SEQ ID NO: 1984860 - protein, 13 aa, Staphylococcus
SKTREGKYKGQER

SEQ ID NO: 1984861 - protein, 15 aa, Staphylococcus
SKTRESAATKAKIAD

SEQ ID NO: 1984862 - protein, 12 aa, Staphylococcus
SKTSATLAAKQG

SEQ ID NO: 1984863 - protein, 17 aa, Staphylococcus
SKTSPKTSVDEQTLNKP

SEQ ID NO: 1984864 - protein, 17 aa, Staphylococcus
SKTTAKAIATTGTAAAG

SEQ ID NO: 1984865 - protein, 8 aa, Staphylococcus
SKTTLEDT

SEQ ID NO: 1984866 - protein, 14 aa, Staphylococcus
SKTVISSGLETARE

SEQ ID NO: 1984867 - protein, 7 aa, Staphylococcus
SKTYDDI

SEQ ID NO: 1984868 - protein, 7 aa, Staphylococcus
SKTYPTV

SEQ ID NO: 1984869 - protein, 14 aa, Staphylococcus
SKVAHQTEAKTQLD

SEQ ID NO: 1984870 - protein, 7 aa, Staphylococcus
SKVATPA

SEQ ID NO: 1984871 - protein, 13 aa, Staphylococcus
SKVDEDEDYLSKG

SEQ ID NO: 1984872 - protein, 15 aa, Staphylococcus
SKVDVEKEIKGMTEG

SEQ ID NO: 1984873 - protein, 21 aa, Staphylococcus
SKVEGLNKEGINEEVTNGIDH

SEQ ID NO: 1984874 - protein, 5 aa, Staphylococcus
SKVGD

SEQ ID NO: 1984875 - protein, 6 aa, Staphylococcus
SKVGGK

SEQ ID NO: 1984876 - protein, 10 aa, Staphylococcus
SKVGNLEDEE

SEQ ID NO: 1984877 - protein, 8 aa, Staphylococcus
SKVKNGPT

SEQ ID NO: 1984878 - protein, 16 aa, Staphylococcus
SKVLSGPKSNFDGNRE

SEQ ID NO: 1984879 - protein, 22 aa, Staphylococcus
SKVNQSSNISSLQGKSKVTAAE

SEQ ID NO: 1984880 - protein, 9 aa, Staphylococcus
SKVPARDTN

SEQ ID NO: 1984881 - protein, 7 aa, Staphylococcus
SKVPYNH

SEQ ID NO: 1984882 - protein, 5 aa, Staphylococcus
SKVQS

SEQ ID NO: 1984883 - protein, 4 aa, Staphylococcus
SKVR

SEQ ID NO: 1984884 - protein, 14 aa, Staphylococcus
SKVRPGKVDEIEGI

SEQ ID NO: 1984885 - protein, 10 aa, Staphylococcus
SKVRSTEDER

SEQ ID NO: 1984886 - protein, 4 aa, Staphylococcus
SKWN

SEQ ID NO: 1984887 - protein, 9 aa, Staphylococcus
SKWNEQNQM

SEQ ID NO: 1984888 - protein, 7 aa, Staphylococcus
SKWQEQW

SEQ ID NO: 1984889 - protein, 4 aa, Staphylococcus
SKWR

SEQ ID NO: 1984890 - protein, 4 aa, Staphylococcus
SKYA

SEQ ID NO: 1984891 - protein, 17 aa, Staphylococcus
SKYAQANDLSDDADNDL

SEQ ID NO: 1984892 - protein, 12 aa, Staphylococcus
SKYASKEEINQK

SEQ ID NO: 1984893 - protein, 7 aa, Staphylococcus
SKYDDIK

SEQ ID NO: 1984894 - protein, 5 aa, Staphylococcus
SKYDR

SEQ ID NO: 1984895 - protein, 7 aa, Staphylococcus
SKYDYYR

SEQ ID NO: 1984896 - protein, 5 aa, Staphylococcus
SKYEK

SEQ ID NO: 1984897 - protein, 13 aa, Staphylococcus
SKYGKDADITTDV

SEQ ID NO: 1984898 - protein, 6 aa, Staphylococcus
SKYGSN

SEQ ID NO: 1984899 - protein, 9 aa, Staphylococcus
SKYGSNAEE

SEQ ID NO: 1984900 - protein, 7 aa, Staphylococcus
SKYGSNV

SEQ ID NO: 1984901 - protein, 10 aa, Staphylococcus
SKYGYKKTNI

SEQ ID NO: 1984902 - protein, 7 aa, Staphylococcus
SKYHEPS

SEQ ID NO: 1984903 - protein, 15 aa, Staphylococcus
SKYIDSRAADKHGID

SEQ ID NO: 1984904 - protein, 8 aa, Staphylococcus
SKYKDGKV

SEQ ID NO: 1984905 - protein, 9 aa, Staphylococcus
SKYKSDTDL

SEQ ID NO: 1984906 - protein, 4 aa, Staphylococcus
SKYL

SEQ ID NO: 1984907 - protein, 4 aa, Staphylococcus
SKYN

SEQ ID NO: 1984908 - protein, 12 aa, Staphylococcus
SKYNDKEVSYEP

SEQ ID NO: 1984909 - protein, 5 aa, Staphylococcus
SKYNI

SEQ ID NO: 1984910 - protein, 12 aa, Staphylococcus
SKYPDLERPTGA

SEQ ID NO: 1984911 - protein, 8 aa, Staphylococcus
SKYPYNNT

SEQ ID NO: 1984912 - protein, 6 aa, Staphylococcus
SKYQNQ

SEQ ID NO: 1984913 - protein, 5 aa, Staphylococcus
SKYRV

SEQ ID NO: 1984914 - protein, 8 aa, Staphylococcus
SKYSDDDA

SEQ ID NO: 1984915 - protein, 5 aa, Staphylococcus
SKYTS

SEQ ID NO: 1984916 - protein, 6 aa, Staphylococcus
SLADEA

SEQ ID NO: 1984917 - protein, 10 aa, Staphylococcus
SLADKNGGTI

SEQ ID NO: 1984918 - protein, 7 aa, Staphylococcus
SLAENAE

SEQ ID NO: 1984919 - protein, 7 aa, Staphylococcus
SLAEQTK

SEQ ID NO: 1984920 - protein, 6 aa, Staphylococcus
SLAGGM

SEQ ID NO: 1984921 - protein, 6 aa, Staphylococcus
SLAGSA

SEQ ID NO: 1984922 - protein, 10 aa, Staphylococcus
SLAGVGRKTA

SEQ ID NO: 1984923 - protein, 4 aa, Staphylococcus
SLAP

SEQ ID NO: 1984924 - protein, 18 aa, Staphylococcus
SLAPENTIASYETAAKIP

SEQ ID NO: 1984925 - protein, 7 aa, Staphylococcus
SLAPEYQ

SEQ ID NO: 1984926 - protein, 16 aa, Staphylococcus
SLAPKSYVDQAEKQGL

SEQ ID NO: 1984927 - protein, 6 aa, Staphylococcus
SLAQQT

SEQ ID NO: 1984928 - protein, 10 aa, Staphylococcus
SLASEAREKL

SEQ ID NO: 1984929 - protein, 6 aa, Staphylococcus
SLATQI

SEQ ID NO: 1984930 - protein, 5 aa, Staphylococcus
SLDDG

SEQ ID NO: 1984931 - protein, 13 aa, Staphylococcus
SLDESDVLSDSEP

SEQ ID NO: 1984932 - protein, 13 aa, Staphylococcus
SLDGGKVDFGKGG

SEQ ID NO: 1984933 - protein, 15 aa, Staphylococcus
SLDGKQATDTGESKW

SEQ ID NO: 1984934 - protein, 6 aa, Staphylococcus
SLDGNG

SEQ ID NO: 1984935 - protein, 6 aa, Staphylococcus
SLDKND

SEQ ID NO: 1984936 - protein, 6 aa, Staphylococcus
SLDNPT

SEQ ID NO: 1984937 - protein, 16 aa, Staphylococcus
SLDQDGEKSLRISEKS

SEQ ID NO: 1984938 - protein, 5 aa, Staphylococcus
SLDSE

SEQ ID NO: 1984939 - protein, 8 aa, Staphylococcus
SLDSPSNE

SEQ ID NO: 1984940 - protein, 6 aa, Staphylococcus
SLDSQD

SEQ ID NO: 1984941 - protein, 6 aa, Staphylococcus
SLDTTG

SEQ ID NO: 1984942 - protein, 5 aa, Staphylococcus
SLEAD

SEQ ID NO: 1984943 - protein, 7 aa, Staphylococcus
SLEASDK

SEQ ID NO: 1984944 - protein, 4 aa, Staphylococcus
SLED

SEQ ID NO: 1984945 - protein, 8 aa, Staphylococcus
SLEDAKAR

SEQ ID NO: 1984946 - protein, 8 aa, Staphylococcus
SLEEAKAR

SEQ ID NO: 1984947 - protein, 7 aa, Staphylococcus
SLEEKKK

SEQ ID NO: 1984948 - protein, 12 aa, Staphylococcus
SLEGRNTRPTMD

SEQ ID NO: 1984949 - protein, 8 aa, Staphylococcus
SLEGTRVK

SEQ ID NO: 1984950 - protein, 14 aa, Staphylococcus
SLEKQKAKLKTQQE

SEQ ID NO: 1984951 - protein, 9 aa, Staphylococcus
SLEKSKKQY

SEQ ID NO: 1984952 - protein, 7 aa, Staphylococcus
SLENTPN

SEQ ID NO: 1984953 - protein, 5 aa, Staphylococcus
SLEQG

SEQ ID NO: 1984954 - protein, 4 aa, Staphylococcus
SLER

SEQ ID NO: 1984955 - protein, 16 aa, Staphylococcus
SLESQYAKIADFQRHH

SEQ ID NO: 1984956 - protein, 8 aa, Staphylococcus
SLESRYKD

SEQ ID NO: 1984957 - protein, 8 aa, Staphylococcus
SLETADEV

SEQ ID NO: 1984958 - protein, 13 aa, Staphylococcus
SLETSENRGKKVR

SEQ ID NO: 1984959 - protein, 4 aa, Staphylococcus
SLEV

SEQ ID NO: 1984960 - protein, 10 aa, Staphylococcus
SLFGNDTHED

SEQ ID NO: 1984961 - protein, 5 aa, Staphylococcus
SLGAT

SEQ ID NO: 1984962 - protein, 6 aa, Staphylococcus
SLGDEY

SEQ ID NO: 1984963 - protein, 7 aa, Staphylococcus
SLGDRFE

SEQ ID NO: 1984964 - protein, 9 aa, Staphylococcus
SLGDTTGNT

SEQ ID NO: 1984965 - protein, 7 aa, Staphylococcus
SLGEQKR

SEQ ID NO: 1984966 - protein, 7 aa, Staphylococcus
SLGERFE

SEQ ID NO: 1984967 - protein, 4 aa, Staphylococcus
SLGI

SEQ ID NO: 1984968 - protein, 14 aa, Staphylococcus
SLGKEEDAQNKNLT

SEQ ID NO: 1984969 - protein, 10 aa, Staphylococcus
SLGKTDMEQN

SEQ ID NO: 1984970 - protein, 4 aa, Staphylococcus
SLGL

SEQ ID NO: 1984971 - protein, 6 aa, Staphylococcus
SLGNPK

SEQ ID NO: 1984972 - protein, 4 aa, Staphylococcus
SLGR

SEQ ID NO: 1984973 - protein, 12 aa, Staphylococcus
SLGSDDKSKELK

SEQ ID NO: 1984974 - protein, 7 aa, Staphylococcus
SLGSKKI

SEQ ID NO: 1984975 - protein, 12 aa, Staphylococcus
SLGSKKLNDAIR

SEQ ID NO: 1984976 - protein, 12 aa, Staphylococcus
SLGSKKLNETIR

SEQ ID NO: 1984977 - protein, 11 aa, Staphylococcus
SLGSKKLNQAI

SEQ ID NO: 1984978 - protein, 6 aa, Staphylococcus
SLGTGD

SEQ ID NO: 1984979 - protein, 7 aa, Staphylococcus
SLGYDET

SEQ ID NO: 1984980 - protein, 5 aa, Staphylococcus
SLHGE

SEQ ID NO: 1984981 - protein, 5 aa, Staphylococcus
SLHGS

SEQ ID NO: 1984982 - protein, 25 aa, Staphylococcus
SLHTSEQKEENQPEQPAKKYTPGVD

SEQ ID NO: 1984983 - protein, 7 aa, Staphylococcus
SLISDEE

SEQ ID NO: 1984984 - protein, 16 aa, Staphylococcus
SLITDEEKKYFQEQSS

SEQ ID NO: 1984985 - protein, 7 aa, Staphylococcus
SLKDGLS

SEQ ID NO: 1984986 - protein, 16 aa, Staphylococcus
SLKDQQGRDYPIYYLK

SEQ ID NO: 1984987 - protein, 17 aa, Staphylococcus
SLKDSVQRGELSGAHGR

SEQ ID NO: 1984988 - protein, 10 aa, Staphylococcus
SLKEGPPSSY

SEQ ID NO: 1984989 - protein, 10 aa, Staphylococcus
SLKEKPEGNL

SEQ ID NO: 1984990 - protein, 6 aa, Staphylococcus
SLKENH

SEQ ID NO: 1984991 - protein, 13 aa, Staphylococcus
SLKESQEKNEVDL

SEQ ID NO: 1984992 - protein, 10 aa, Staphylococcus
SLKKEEDLKE

SEQ ID NO: 1984993 - protein, 7 aa, Staphylococcus
SLKKENT

SEQ ID NO: 1984994 - protein, 8 aa, Staphylococcus
SLKKGHGK

SEQ ID NO: 1984995 - protein, 13 aa, Staphylococcus
SLKKQRQEINEEI

SEQ ID NO: 1984996 - protein, 8 aa, Staphylococcus
SLKNDGER

SEQ ID NO: 1984997 - protein, 26 aa, Staphylococcus
SLKNQQKQSVNFQNYGKDTAFRQSEN

SEQ ID NO: 1984998 - protein, 13 aa, Staphylococcus
SLKNSDEEGTGTP

SEQ ID NO: 1984999 - protein, 7 aa, Staphylococcus
SLKNSDN

SEQ ID NO: 1985000 - protein, 7 aa, Staphylococcus
SLKPEDV

SEQ ID NO: 1985001 - protein, 16 aa, Staphylococcus
SLKPGQEVAVREKSQK

SEQ ID NO: 1985002 - protein, 19 aa, Staphylococcus
SLKRQQRKLSRKKKGSHNW

SEQ ID NO: 1985003 - protein, 10 aa, Staphylococcus
SLKSGKPDAI

SEQ ID NO: 1985004 - protein, 8 aa, Staphylococcus
SLKSQSTQ

SEQ ID NO: 1985005 - protein, 6 aa, Staphylococcus
SLKTAI

SEQ ID NO: 1985006 - protein, 12 aa, Staphylococcus
SLLGADDKAGVA

SEQ ID NO: 1985007 - protein, 6 aa, Staphylococcus
SLLPED

SEQ ID NO: 1985008 - protein, 4 aa, Staphylococcus
SLNA

SEQ ID NO: 1985009 - protein, 5 aa, Staphylococcus
SLNDG

SEQ ID NO: 1985010 - protein, 12 aa, Staphylococcus
SLNDKENRRDDM

SEQ ID NO: 1985011 - protein, 11 aa, Staphylococcus
SLNDKENRRDQ

SEQ ID NO: 1985012 - protein, 5 aa, Staphylococcus
SLNDQ

SEQ ID NO: 1985013 - protein, 5 aa, Staphylococcus
SLNED

SEQ ID NO: 1985014 - protein, 6 aa, Staphylococcus
SLNESG

SEQ ID NO: 1985015 - protein, 4 aa, Staphylococcus
SLNG

SEQ ID NO: 1985016 - protein, 6 aa, Staphylococcus
SLNGAT

SEQ ID NO: 1985017 - protein, 5 aa, Staphylococcus
SLNGK

SEQ ID NO: 1985018 - protein, 5 aa, Staphylococcus
SLNGQ

SEQ ID NO: 1985019 - protein, 9 aa, Staphylococcus
SLNGQYSPD

SEQ ID NO: 1985020 - protein, 4 aa, Staphylococcus
SLNI

SEQ ID NO: 1985021 - protein, 10 aa, Staphylococcus
SLNKDEKGIN

SEQ ID NO: 1985022 - protein, 18 aa, Staphylococcus
SLNKDERMGPHPAEYNGH

SEQ ID NO: 1985023 - protein, 8 aa, Staphylococcus
SLNKQNSI

SEQ ID NO: 1985024 - protein, 11 aa, Staphylococcus
SLNKRWTKSYK

SEQ ID NO: 1985025 - protein, 7 aa, Staphylococcus
SLNKTGD

SEQ ID NO: 1985026 - protein, 6 aa, Staphylococcus
SLNNPD

SEQ ID NO: 1985027 - protein, 18 aa, Staphylococcus
SLNNPTFTEEQNNKILTT

SEQ ID NO: 1985028 - protein, 6 aa, Staphylococcus
SLNPTM

SEQ ID NO: 1985029 - protein, 8 aa, Staphylococcus
SLNQEQAA

SEQ ID NO: 1985030 - protein, 19 aa, Staphylococcus
SLNQNRNDLSSKNSELEDV

SEQ ID NO: 1985031 - protein, 17 aa, Staphylococcus
SLNQQGQDIGEKYRTGL

SEQ ID NO: 1985032 - protein, 20 aa, Staphylococcus
SLNRNDRQGKDPDEVAIGDL

SEQ ID NO: 1985033 - protein, 4 aa, Staphylococcus
SLPD

SEQ ID NO: 1985034 - protein, 7 aa, Staphylococcus
SLPEGTT

SEQ ID NO: 1985035 - protein, 8 aa, Staphylococcus
SLPEGTTV

SEQ ID NO: 1985036 - protein, 5 aa, Staphylococcus
SLPEN

SEQ ID NO: 1985037 - protein, 15 aa, Staphylococcus
SLPGEDGKDLKDGLD

SEQ ID NO: 1985038 - protein, 18 aa, Staphylococcus
SLPGKLADCSSKNPDESE

SEQ ID NO: 1985039 - protein, 5 aa, Staphylococcus
SLPGL

SEQ ID NO: 1985040 - protein, 6 aa, Staphylococcus
SLPKDI

SEQ ID NO: 1985041 - protein, 8 aa, Staphylococcus
SLPKGFPE

SEQ ID NO: 1985042 - protein, 9 aa, Staphylococcus
SLPKGLNTS

SEQ ID NO: 1985043 - protein, 10 aa, Staphylococcus
SLPKGVDSNY

SEQ ID NO: 1985044 - protein, 5 aa, Staphylococcus
SLPLQ

SEQ ID NO: 1985045 - protein, 9 aa, Staphylococcus
SLPNAPTTS

SEQ ID NO: 1985046 - protein, 8 aa, Staphylococcus
SLPNKESH

SEQ ID NO: 1985047 - protein, 9 aa, Staphylococcus
SLPNTKYGI

SEQ ID NO: 1985048 - protein, 7 aa, Staphylococcus
SLPPGAE

SEQ ID NO: 1985049 - protein, 7 aa, Staphylococcus
SLPPYDA

SEQ ID NO: 1985050 - protein, 4 aa, Staphylococcus
SLPQ

SEQ ID NO: 1985051 - protein, 10 aa, Staphylococcus
SLPQGSTATD

SEQ ID NO: 1985052 - protein, 7 aa, Staphylococcus
SLPSNPK

SEQ ID NO: 1985053 - protein, 12 aa, Staphylococcus
SLPTTEEDDAEM

SEQ ID NO: 1985054 - protein, 7 aa, Staphylococcus
SLQDSEF

SEQ ID NO: 1985055 - protein, 10 aa, Staphylococcus
SLQGNYAPDL

SEQ ID NO: 1985056 - protein, 4 aa, Staphylococcus
SLQK

SEQ ID NO: 1985057 - protein, 12 aa, Staphylococcus
SLQKACEEGEVS

SEQ ID NO: 1985058 - protein, 13 aa, Staphylococcus
SLQNGKPYRETST

SEQ ID NO: 1985059 - protein, 16 aa, Staphylococcus
SLQNGKPYRETSTIDV

SEQ ID NO: 1985060 - protein, 21 aa, Staphylococcus
SLQNGKPYRETSTIDVPQAAN

SEQ ID NO: 1985061 - protein, 5 aa, Staphylococcus
SLQPG

SEQ ID NO: 1985062 - protein, 5 aa, Staphylococcus
SLQPV

SEQ ID NO: 1985063 - protein, 17 aa, Staphylococcus
SLQSKELNKDYNDLTSQ

SEQ ID NO: 1985064 - protein, 4 aa, Staphylococcus
SLQT

SEQ ID NO: 1985065 - protein, 13 aa, Staphylococcus
SLQYGAEKLSDRA

SEQ ID NO: 1985066 - protein, 6 aa, Staphylococcus
SLRANQ

SEQ ID NO: 1985067 - protein, 15 aa, Staphylococcus
SLRDELESATGQRLT

SEQ ID NO: 1985068 - protein, 16 aa, Staphylococcus
SLREKEAKRVKQMMQD

SEQ ID NO: 1985069 - protein, 8 aa, Staphylococcus
SLRGNSLT

SEQ ID NO: 1985070 - protein, 9 aa, Staphylococcus
SLRGNSLTN

SEQ ID NO: 1985071 - protein, 7 aa, Staphylococcus
SLRRNSQ

SEQ ID NO: 1985072 - protein, 5 aa, Staphylococcus
SLRRP

SEQ ID NO: 1985073 - protein, 16 aa, Staphylococcus
SLRSYNASGVNEIGVK

SEQ ID NO: 1985074 - protein, 13 aa, Staphylococcus
SLRTEPKLSLPTA

SEQ ID NO: 1985075 - protein, 13 aa, Staphylococcus
SLSAKELKEGFKD

SEQ ID NO: 1985076 - protein, 14 aa, Staphylococcus
SLSASELKEGFKDV

SEQ ID NO: 1985077 - protein, 9 aa, Staphylococcus
SLSDRFEYS

SEQ ID NO: 1985078 - protein, 22 aa, Staphylococcus
SLSDSFSKRLNTPNNGREEQLS

SEQ ID NO: 1985079 - protein, 7 aa, Staphylococcus
SLSEDEF

SEQ ID NO: 1985080 - protein, 7 aa, Staphylococcus
SLSEDSS

SEQ ID NO: 1985081 - protein, 10 aa, Staphylococcus
SLSEELGAKG

SEQ ID NO: 1985082 - protein, 5 aa, Staphylococcus
SLSES

SEQ ID NO: 1985083 - protein, 9 aa, Staphylococcus
SLSGGEKQR

SEQ ID NO: 1985084 - protein, 5 aa, Staphylococcus
SLSGN

SEQ ID NO: 1985085 - protein, 13 aa, Staphylococcus
SLSGNKVTFVGDE

SEQ ID NO: 1985086 - protein, 9 aa, Staphylococcus
SLSGTITPQ

SEQ ID NO: 1985087 - protein, 7 aa, Staphylococcus
SLSHGYS

SEQ ID NO: 1985088 - protein, 5 aa, Staphylococcus
SLSKA

SEQ ID NO: 1985089 - protein, 15 aa, Staphylococcus
SLSKPKYISQHEPGL

SEQ ID NO: 1985090 - protein, 8 aa, Staphylococcus
SLSPEDKI

SEQ ID NO: 1985091 - protein, 5 aa, Staphylococcus
SLSPN

SEQ ID NO: 1985092 - protein, 7 aa, Staphylococcus
SLSPSNT

SEQ ID NO: 1985093 - protein, 15 aa, Staphylococcus
SLSPTEGDIKRDGDV

SEQ ID NO: 1985094 - protein, 9 aa, Staphylococcus
SLSPTLNQP

SEQ ID NO: 1985095 - protein, 14 aa, Staphylococcus
SLSPTSGKIDRKGD

SEQ ID NO: 1985096 - protein, 5 aa, Staphylococcus
SLSQN

SEQ ID NO: 1985097 - protein, 7 aa, Staphylococcus
SLSQPAA

SEQ ID NO: 1985098 - protein, 6 aa, Staphylococcus
SLSQSN

SEQ ID NO: 1985099 - protein, 13 aa, Staphylococcus
SLSSEAEYQRGYG

SEQ ID NO: 1985100 - protein, 13 aa, Staphylococcus
SLSSEPEYQRGYG

SEQ ID NO: 1985101 - protein, 7 aa, Staphylococcus
SLSSGDY

SEQ ID NO: 1985102 - protein, 13 aa, Staphylococcus
SLSSQDSYKKGFG

SEQ ID NO: 1985103 - protein, 6 aa, Staphylococcus
SLSSSD

SEQ ID NO: 1985104 - protein, 13 aa, Staphylococcus
SLSTEQKREAYNA

SEQ ID NO: 1985105 - protein, 6 aa, Staphylococcus
SLSTKP

SEQ ID NO: 1985106 - protein, 11 aa, Staphylococcus
SLTDAQKKDLA

SEQ ID NO: 1985107 - protein, 9 aa, Staphylococcus
SLTDKPVKG

SEQ ID NO: 1985108 - protein, 23 aa, Staphylococcus
SLTEAEDPLSAAREFKDEIKRIW

SEQ ID NO: 1985109 - protein, 10 aa, Staphylococcus
SLTEAKGLKD

SEQ ID NO: 1985110 - protein, 5 aa, Staphylococcus
SLTEE

SEQ ID NO: 1985111 - protein, 9 aa, Staphylococcus
SLTEEKGLK

SEQ ID NO: 1985112 - protein, 5 aa, Staphylococcus
SLTEL

SEQ ID NO: 1985113 - protein, 8 aa, Staphylococcus
SLTGSTRE

SEQ ID NO: 1985114 - protein, 4 aa, Staphylococcus
SLTK

SEQ ID NO: 1985115 - protein, 15 aa, Staphylococcus
SLTKKQQKEIEDDLR

SEQ ID NO: 1985116 - protein, 13 aa, Staphylococcus
SLTNNNEEHQNGE

SEQ ID NO: 1985117 - protein, 6 aa, Staphylococcus
SLTNRE

SEQ ID NO: 1985118 - protein, 8 aa, Staphylococcus
SLTPGRQR

SEQ ID NO: 1985119 - protein, 6 aa, Staphylococcus
SLTPSE

SEQ ID NO: 1985120 - protein, 13 aa, Staphylococcus
SLTPVKPTTINLP

SEQ ID NO: 1985121 - protein, 10 aa, Staphylococcus
SLTQNEKGIN

SEQ ID NO: 1985122 - protein, 8 aa, Staphylococcus
SLTQRGKS

SEQ ID NO: 1985123 - protein, 9 aa, Staphylococcus
SLTREEKGI

SEQ ID NO: 1985124 - protein, 5 aa, Staphylococcus
SLTRP

SEQ ID NO: 1985125 - protein, 5 aa, Staphylococcus
SLTTD

SEQ ID NO: 1985126 - protein, 5 aa, Staphylococcus
SLTTE

SEQ ID NO: 1985127 - protein, 9 aa, Staphylococcus
SLTTENRTQ

SEQ ID NO: 1985128 - protein, 10 aa, Staphylococcus
SLTTTPRDQE

SEQ ID NO: 1985129 - protein, 4 aa, Staphylococcus
SLVN

SEQ ID NO: 1985130 - protein, 18 aa, Staphylococcus
SLVSKSDMKRVKQLLAYK

SEQ ID NO: 1985131 - protein, 8 aa, Staphylococcus
SLYEKGEI

SEQ ID NO: 1985132 - protein, 10 aa, Staphylococcus
SLYGKSAKTI

SEQ ID NO: 1985133 - protein, 15 aa, Staphylococcus
SLYGPTVGDSVRLGD

SEQ ID NO: 1985134 - protein, 6 aa, Staphylococcus
SLYGSQ

SEQ ID NO: 1985135 - protein, 4 aa, Staphylococcus
SLYT

SEQ ID NO: 1985136 - protein, 10 aa, Staphylococcus
SMAQQSGGYY

SEQ ID NO: 1985137 - protein, 6 aa, Staphylococcus
SMDKKE

SEQ ID NO: 1985138 - protein, 10 aa, Staphylococcus
SMDRKEKNKW

SEQ ID NO: 1985139 - protein, 7 aa, Staphylococcus
SMEDEEI

SEQ ID NO: 1985140 - protein, 5 aa, Staphylococcus
SMEEA

SEQ ID NO: 1985141 - protein, 5 aa, Staphylococcus
SMEEP

SEQ ID NO: 1985142 - protein, 5 aa, Staphylococcus
SMEET

SEQ ID NO: 1985143 - protein, 13 aa, Staphylococcus
SMFPTKEAAQQAV

SEQ ID NO: 1985144 - protein, 7 aa, Staphylococcus
SMGGDGT

SEQ ID NO: 1985145 - protein, 10 aa, Staphylococcus
SMGGKINEPL

SEQ ID NO: 1985146 - protein, 6 aa, Staphylococcus
SMGGQN

SEQ ID NO: 1985147 - protein, 9 aa, Staphylococcus
SMGKPIPGV

SEQ ID NO: 1985148 - protein, 9 aa, Staphylococcus
SMGKPLPGI

SEQ ID NO: 1985149 - protein, 9 aa, Staphylococcus
SMGKPLPGV

SEQ ID NO: 1985150 - protein, 8 aa, Staphylococcus
SMGKSSTR

SEQ ID NO: 1985151 - protein, 6 aa, Staphylococcus
SMIEDK

SEQ ID NO: 1985152 - protein, 10 aa, Staphylococcus
SMIGQDEQEI

SEQ ID NO: 1985153 - protein, 6 aa, Staphylococcus
SMKENN

SEQ ID NO: 1985154 - protein, 10 aa, Staphylococcus
SMLDPKARED

SEQ ID NO: 1985155 - protein, 6 aa, Staphylococcus
SMNNKE

SEQ ID NO: 1985156 - protein, 6 aa, Staphylococcus
SMNRDN

SEQ ID NO: 1985157 - protein, 8 aa, Staphylococcus
SMNSTDDT

SEQ ID NO: 1985158 - protein, 6 aa, Staphylococcus
SMPEGT

SEQ ID NO: 1985159 - protein, 5 aa, Staphylococcus
SMPHE

SEQ ID NO: 1985160 - protein, 7 aa, Staphylococcus
SMPHENT

SEQ ID NO: 1985161 - protein, 9 aa, Staphylococcus
SMPSQADIK

SEQ ID NO: 1985162 - protein, 21 aa, Staphylococcus
SMQPDKIEEEVEEELPSKAQI

SEQ ID NO: 1985163 - protein, 17 aa, Staphylococcus
SMQPPKSDEKEDVPSKD

SEQ ID NO: 1985164 - protein, 19 aa, Staphylococcus
SMQPPKSEEKEEVPSKEQI

SEQ ID NO: 1985165 - protein, 23 aa, Staphylococcus
SMQPPKSEESKDEVEEPSKAQID

SEQ ID NO: 1985166 - protein, 21 aa, Staphylococcus
SMQPPKSEKVEHEAPSKAQIN

SEQ ID NO: 1985167 - protein, 22 aa, Staphylococcus
SMQPPKSSEDDKEEVPSKSQID

SEQ ID NO: 1985168 - protein, 15 aa, Staphylococcus
SMQTAKERGQAYQDF

SEQ ID NO: 1985169 - protein, 4 aa, Staphylococcus
SMRA

SEQ ID NO: 1985170 - protein, 17 aa, Staphylococcus
SMRAGKAVYKNAADTVK

SEQ ID NO: 1985171 - protein, 8 aa, Staphylococcus
SMRAGKSV

SEQ ID NO: 1985172 - protein, 8 aa, Staphylococcus
SMSSSKQV

SEQ ID NO: 1985173 - protein, 9 aa, Staphylococcus
SMSTSKEVL

SEQ ID NO: 1985174 - protein, 8 aa, Staphylococcus
SMSTVPES

SEQ ID NO: 1985175 - protein, 6 aa, Staphylococcus
SMSVNQ

SEQ ID NO: 1985176 - protein, 12 aa, Staphylococcus
SMTEQQAANTIN

SEQ ID NO: 1985177 - protein, 7 aa, Staphylococcus
SMTETTG

SEQ ID NO: 1985178 - protein, 4 aa, Staphylococcus
SMTN

SEQ ID NO: 1985179 - protein, 5 aa, Staphylococcus
SMTPH

SEQ ID NO: 1985180 - protein, 4 aa, Staphylococcus
SMTR

SEQ ID NO: 1985181 - protein, 7 aa, Staphylococcus
SMTTQEK

SEQ ID NO: 1985182 - protein, 8 aa, Staphylococcus
SMTTVPED

SEQ ID NO: 1985183 - protein, 8 aa, Staphylococcus
SMTTVPEE

SEQ ID NO: 1985184 - protein, 4 aa, Staphylococcus
SMVD

SEQ ID NO: 1985185 - protein, 20 aa, Staphylococcus
SMVNGGSRAYSPKAPQARKL

SEQ ID NO: 1985186 - protein, 10 aa, Staphylococcus
SNADGEGNQL

SEQ ID NO: 1985187 - protein, 6 aa, Staphylococcus
SNAEQI

SEQ ID NO: 1985188 - protein, 5 aa, Staphylococcus
SNAES

SEQ ID NO: 1985189 - protein, 14 aa, Staphylococcus
SNAFSSGNNVTTGV

SEQ ID NO: 1985190 - protein, 9 aa, Staphylococcus
SNAGGLGTI

SEQ ID NO: 1985191 - protein, 15 aa, Staphylococcus
SNAGGYSSKTEKEIK

SEQ ID NO: 1985192 - protein, 13 aa, Staphylococcus
SNAIQTGKSYAKT

SEQ ID NO: 1985193 - protein, 9 aa, Staphylococcus
SNAKDPQKR

SEQ ID NO: 1985194 - protein, 10 aa, Staphylococcus
SNAKDYNEGD

SEQ ID NO: 1985195 - protein, 10 aa, Staphylococcus
SNANGEDNQI

SEQ ID NO: 1985196 - protein, 7 aa, Staphylococcus
SNANSEV

SEQ ID NO: 1985197 - protein, 4 aa, Staphylococcus
SNAR

SEQ ID NO: 1985198 - protein, 6 aa, Staphylococcus
SNARKE

SEQ ID NO: 1985199 - protein, 10 aa, Staphylococcus
SNASGEGNQI

SEQ ID NO: 1985200 - protein, 8 aa, Staphylococcus
SNASHNEN

SEQ ID NO: 1985201 - protein, 7 aa, Staphylococcus
SNASTYS

SEQ ID NO: 1985202 - protein, 9 aa, Staphylococcus
SNATSKEEV

SEQ ID NO: 1985203 - protein, 5 aa, Staphylococcus
SNDCE

SEQ ID NO: 1985204 - protein, 10 aa, Staphylococcus
SNDDANQFTR

SEQ ID NO: 1985205 - protein, 24 aa, Staphylococcus
SNDDIEAPQDFTKDDHIHLNAEVS

SEQ ID NO: 1985206 - protein, 5 aa, Staphylococcus
SNDDY

SEQ ID NO: 1985207 - protein, 13 aa, Staphylococcus
SNDEEAIQTDLSE

SEQ ID NO: 1985208 - protein, 9 aa, Staphylococcus
SNDERNATY

SEQ ID NO: 1985209 - protein, 7 aa, Staphylococcus
SNDETKV

SEQ ID NO: 1985210 - protein, 7 aa, Staphylococcus
SNDEVDY

SEQ ID NO: 1985211 - protein, 7 aa, Staphylococcus
SNDFTNV

SEQ ID NO: 1985212 - protein, 9 aa, Staphylococcus
SNDGGESWN

SEQ ID NO: 1985213 - protein, 9 aa, Staphylococcus
SNDGVKTRN

SEQ ID NO: 1985214 - protein, 10 aa, Staphylococcus
SNDIEVRETD

SEQ ID NO: 1985215 - protein, 5 aa, Staphylococcus
SNDIV

SEQ ID NO: 1985216 - protein, 9 aa, Staphylococcus
SNDKDTIKI

SEQ ID NO: 1985217 - protein, 6 aa, Staphylococcus
SNDKGV

SEQ ID NO: 1985218 - protein, 11 aa, Staphylococcus
SNDKKGNEVEM

SEQ ID NO: 1985219 - protein, 5 aa, Staphylococcus
SNDKR

SEQ ID NO: 1985220 - protein, 9 aa, Staphylococcus
SNDKRSSYV

SEQ ID NO: 1985221 - protein, 7 aa, Staphylococcus
SNDKRTK

SEQ ID NO: 1985222 - protein, 10 aa, Staphylococcus
SNDLDEQTIT

SEQ ID NO: 1985223 - protein, 7 aa, Staphylococcus
SNDMEGG

SEQ ID NO: 1985224 - protein, 7 aa, Staphylococcus
SNDMNDM

SEQ ID NO: 1985225 - protein, 8 aa, Staphylococcus
SNDNIERQ

SEQ ID NO: 1985226 - protein, 4 aa, Staphylococcus
SNDP

SEQ ID NO: 1985227 - protein, 6 aa, Staphylococcus
SNDQEN

SEQ ID NO: 1985228 - protein, 31 aa, Staphylococcus
SNDQPIKVERQTEKTPQERKQEDAKKDVVYS

SEQ ID NO: 1985229 - protein, 14 aa, Staphylococcus
SNDQPYAKGTHSEL

SEQ ID NO: 1985230 - protein, 9 aa, Staphylococcus
SNDQSNRHF

SEQ ID NO: 1985231 - protein, 6 aa, Staphylococcus
SNDQVA

SEQ ID NO: 1985232 - protein, 7 aa, Staphylococcus
SNDRPYK

SEQ ID NO: 1985233 - protein, 16 aa, Staphylococcus
SNDSDEIQTDRSEQLG

SEQ ID NO: 1985234 - protein, 9 aa, Staphylococcus
SNDSKKKIQ

SEQ ID NO: 1985235 - protein, 10 aa, Staphylococcus
SNDSSKITEL

SEQ ID NO: 1985236 - protein, 7 aa, Staphylococcus
SNDTNQL

SEQ ID NO: 1985237 - protein, 7 aa, Staphylococcus
SNDTTYH

SEQ ID NO: 1985238 - protein, 5 aa, Staphylococcus
SNDVK

SEQ ID NO: 1985239 - protein, 9 aa, Staphylococcus
SNDYHGPDM

SEQ ID NO: 1985240 - protein, 6 aa, Staphylococcus
SNDYPV

SEQ ID NO: 1985241 - protein, 10 aa, Staphylococcus
SNEAAKYDES

SEQ ID NO: 1985242 - protein, 6 aa, Staphylococcus
SNEADD

SEQ ID NO: 1985243 - protein, 7 aa, Staphylococcus
SNEAQEQ

SEQ ID NO: 1985244 - protein, 7 aa, Staphylococcus
SNEAYEV

SEQ ID NO: 1985245 - protein, 17 aa, Staphylococcus
SNEDKGSLHRNKADESY

SEQ ID NO: 1985246 - protein, 11 aa, Staphylococcus
SNEDKGSLHRY

SEQ ID NO: 1985247 - protein, 9 aa, Staphylococcus
SNEDKNALH

SEQ ID NO: 1985248 - protein, 17 aa, Staphylococcus
SNEDKNSLHRYKADESY

SEQ ID NO: 1985249 - protein, 11 aa, Staphylococcus
SNEDKSSLHRY

SEQ ID NO: 1985250 - protein, 8 aa, Staphylococcus
SNEDNQQH

SEQ ID NO: 1985251 - protein, 8 aa, Staphylococcus
SNEDRNKI

SEQ ID NO: 1985252 - protein, 7 aa, Staphylococcus
SNEDTGY

SEQ ID NO: 1985253 - protein, 9 aa, Staphylococcus
SNEEAMRRA

SEQ ID NO: 1985254 - protein, 6 aa, Staphylococcus
SNEERM

SEQ ID NO: 1985255 - protein, 4 aa, Staphylococcus
SNEF

SEQ ID NO: 1985256 - protein, 12 aa, Staphylococcus
SNEFNNKKSYYE

SEQ ID NO: 1985257 - protein, 4 aa, Staphylococcus
SNEG

SEQ ID NO: 1985258 - protein, 13 aa, Staphylococcus
SNEGGISENEINQ

SEQ ID NO: 1985259 - protein, 9 aa, Staphylococcus
SNEGLKSRV

SEQ ID NO: 1985260 - protein, 5 aa, Staphylococcus
SNEHQ

SEQ ID NO: 1985261 - protein, 9 aa, Staphylococcus
SNEIDTSTA

SEQ ID NO: 1985262 - protein, 5 aa, Staphylococcus
SNEIK

SEQ ID NO: 1985263 - protein, 18 aa, Staphylococcus
SNEINEKKQHLSKSEATC

SEQ ID NO: 1985264 - protein, 4 aa, Staphylococcus
SNEK

SEQ ID NO: 1985265 - protein, 9 aa, Staphylococcus
SNEKPERQD

SEQ ID NO: 1985266 - protein, 13 aa, Staphylococcus
SNEKWQGVPDEAK

SEQ ID NO: 1985267 - protein, 6 aa, Staphylococcus
SNELKT

SEQ ID NO: 1985268 - protein, 5 aa, Staphylococcus
SNELR

SEQ ID NO: 1985269 - protein, 31 aa, Staphylococcus
SNELTAIKETSKYSVKSSDYLTDDDEKNQEI

SEQ ID NO: 1985270 - protein, 5 aa, Staphylococcus
SNEMR

SEQ ID NO: 1985271 - protein, 7 aa, Staphylococcus
SNENFDA

SEQ ID NO: 1985272 - protein, 19 aa, Staphylococcus
SNENGSQTMKLDFEVICNV

SEQ ID NO: 1985273 - protein, 19 aa, Staphylococcus
SNENGSQTMQLKFAVLCYI

SEQ ID NO: 1985274 - protein, 18 aa, Staphylococcus
SNENLYGPSPKAKEAIKE

SEQ ID NO: 1985275 - protein, 17 aa, Staphylococcus
SNENLYGPSPKAKQAVQ

SEQ ID NO: 1985276 - protein, 15 aa, Staphylococcus
SNENLYGPSPKVKEA

SEQ ID NO: 1985277 - protein, 17 aa, Staphylococcus
SNENLYGPSPKVKQAIT

SEQ ID NO: 1985278 - protein, 14 aa, Staphylococcus
SNENLYGPSPRVKE

SEQ ID NO: 1985279 - protein, 7 aa, Staphylococcus
SNENNTE

SEQ ID NO: 1985280 - protein, 22 aa, Staphylococcus
SNENVDEINSVKKDTNKNNKIC

SEQ ID NO: 1985281 - protein, 5 aa, Staphylococcus
SNEPI

SEQ ID NO: 1985282 - protein, 15 aa, Staphylococcus
SNEPTIDEYSERTDN

SEQ ID NO: 1985283 - protein, 6 aa, Staphylococcus
SNESAI

SEQ ID NO: 1985284 - protein, 7 aa, Staphylococcus
SNESFDA

SEQ ID NO: 1985285 - protein, 6 aa, Staphylococcus
SNESIE

SEQ ID NO: 1985286 - protein, 15 aa, Staphylococcus
SNESINKTHKKIEEA

SEQ ID NO: 1985287 - protein, 27 aa, Staphylococcus
SNESIPQDDSKATFASNISREDERIDW

SEQ ID NO: 1985288 - protein, 7 aa, Staphylococcus
SNESNID

SEQ ID NO: 1985289 - protein, 4 aa, Staphylococcus
SNET

SEQ ID NO: 1985290 - protein, 10 aa, Staphylococcus
SNETQSEIEA

SEQ ID NO: 1985291 - protein, 8 aa, Staphylococcus
SNETTKQV

SEQ ID NO: 1985292 - protein, 5 aa, Staphylococcus
SNEVD

SEQ ID NO: 1985293 - protein, 11 aa, Staphylococcus
SNEVEKPNAKI

SEQ ID NO: 1985294 - protein, 10 aa, Staphylococcus
SNEVNPVTEE

SEQ ID NO: 1985295 - protein, 11 aa, Staphylococcus
SNEVPDDASTN

SEQ ID NO: 1985296 - protein, 5 aa, Staphylococcus
SNEYD

SEQ ID NO: 1985297 - protein, 12 aa, Staphylococcus
SNEYNEAQNECF

SEQ ID NO: 1985298 - protein, 7 aa, Staphylococcus
SNFEYNS

SEQ ID NO: 1985299 - protein, 12 aa, Staphylococcus
SNFGPNSKDEVD

SEQ ID NO: 1985300 - protein, 8 aa, Staphylococcus
SNFKAQTE

SEQ ID NO: 1985301 - protein, 10 aa, Staphylococcus
SNFKNASSQL

SEQ ID NO: 1985302 - protein, 13 aa, Staphylococcus
SNFKNGNISIQDK

SEQ ID NO: 1985303 - protein, 8 aa, Staphylococcus
SNFPRDVK

SEQ ID NO: 1985304 - protein, 6 aa, Staphylococcus
SNFPYN

SEQ ID NO: 1985305 - protein, 6 aa, Staphylococcus
SNFSEG

SEQ ID NO: 1985306 - protein, 4 aa, Staphylococcus
SNFT

SEQ ID NO: 1985307 - protein, 13 aa, Staphylococcus
SNGAITSKHTNGI

SEQ ID NO: 1985308 - protein, 10 aa, Staphylococcus
SNGAKGATVR

SEQ ID NO: 1985309 - protein, 8 aa, Staphylococcus
SNGATEVA

SEQ ID NO: 1985310 - protein, 6 aa, Staphylococcus
SNGDGV

SEQ ID NO: 1985311 - protein, 6 aa, Staphylococcus
SNGDNE

SEQ ID NO: 1985312 - protein, 7 aa, Staphylococcus
SNGDSAQ

SEQ ID NO: 1985313 - protein, 4 aa, Staphylococcus
SNGE

SEQ ID NO: 1985314 - protein, 11 aa, Staphylococcus
SNGEDYKLEEY

SEQ ID NO: 1985315 - protein, 7 aa, Staphylococcus
SNGEIAG

SEQ ID NO: 1985316 - protein, 7 aa, Staphylococcus
SNGENYK

SEQ ID NO: 1985317 - protein, 9 aa, Staphylococcus
SNGESAMRN

SEQ ID NO: 1985318 - protein, 15 aa, Staphylococcus
SNGGRDGKVFSEDNT

SEQ ID NO: 1985319 - protein, 4 aa, Staphylococcus
SNGK

SEQ ID NO: 1985320 - protein, 18 aa, Staphylococcus
SNGKAQKRVGGIGTGGGM

SEQ ID NO: 1985321 - protein, 16 aa, Staphylococcus
SNGKKMSKSKGNVINP

SEQ ID NO: 1985322 - protein, 5 aa, Staphylococcus
SNGKP

SEQ ID NO: 1985323 - protein, 11 aa, Staphylococcus
SNGLKKTKVAT

SEQ ID NO: 1985324 - protein, 6 aa, Staphylococcus
SNGNDS

SEQ ID NO: 1985325 - protein, 9 aa, Staphylococcus
SNGNPSEIA

SEQ ID NO: 1985326 - protein, 8 aa, Staphylococcus
SNGNQAVQ

SEQ ID NO: 1985327 - protein, 10 aa, Staphylococcus
SNGPGDPDEV

SEQ ID NO: 1985328 - protein, 11 aa, Staphylococcus
SNGPGDPEDVP

SEQ ID NO: 1985329 - protein, 9 aa, Staphylococcus
SNGPGDPEE

SEQ ID NO: 1985330 - protein, 10 aa, Staphylococcus
SNGPGDPEEI

SEQ ID NO: 1985331 - protein, 10 aa, Staphylococcus
SNGPGDPEEV

SEQ ID NO: 1985332 - protein, 6 aa, Staphylococcus
SNGQQI

SEQ ID NO: 1985333 - protein, 5 aa, Staphylococcus
SNGRF

SEQ ID NO: 1985334 - protein, 6 aa, Staphylococcus
SNGSPL

SEQ ID NO: 1985335 - protein, 8 aa, Staphylococcus
SNGSYKPH

SEQ ID NO: 1985336 - protein, 12 aa, Staphylococcus
SNGTPRLKTDKG

SEQ ID NO: 1985337 - protein, 4 aa, Staphylococcus
SNGY

SEQ ID NO: 1985338 - protein, 15 aa, Staphylococcus
SNGYNNVNEIIGLDV

SEQ ID NO: 1985339 - protein, 5 aa, Staphylococcus
SNHEA

SEQ ID NO: 1985340 - protein, 6 aa, Staphylococcus
SNHEKE

SEQ ID NO: 1985341 - protein, 6 aa, Staphylococcus
SNHKFD

SEQ ID NO: 1985342 - protein, 6 aa, Staphylococcus
SNHNPV

SEQ ID NO: 1985343 - protein, 23 aa, Staphylococcus
SNHPGGIKSISAGELKANNPERL

SEQ ID NO: 1985344 - protein, 22 aa, Staphylococcus
SNHPGGIKSVTAGELKRNNPAR

SEQ ID NO: 1985345 - protein, 23 aa, Staphylococcus
SNHPGGIKSVTAGELKRNNPERL

SEQ ID NO: 1985346 - protein, 8 aa, Staphylococcus
SNHPGGLK

SEQ ID NO: 1985347 - protein, 22 aa, Staphylococcus
SNHPGGLKSISAGELRRTNPER

SEQ ID NO: 1985348 - protein, 22 aa, Staphylococcus
SNHPGGLKSITAGELRRTNPER

SEQ ID NO: 1985349 - protein, 4 aa, Staphylococcus
SNHQ

SEQ ID NO: 1985350 - protein, 5 aa, Staphylococcus
SNHQH

SEQ ID NO: 1985351 - protein, 10 aa, Staphylococcus
SNHQPLTDEE

SEQ ID NO: 1985352 - protein, 9 aa, Staphylococcus
SNHQYKNDK

SEQ ID NO: 1985353 - protein, 15 aa, Staphylococcus
SNHREETGGLSGKPL

SEQ ID NO: 1985354 - protein, 9 aa, Staphylococcus
SNHRQQGHG

SEQ ID NO: 1985355 - protein, 8 aa, Staphylococcus
SNIDERTG

SEQ ID NO: 1985356 - protein, 5 aa, Staphylococcus
SNIDK

SEQ ID NO: 1985357 - protein, 13 aa, Staphylococcus
SNIDKTAGGKGLN

SEQ ID NO: 1985358 - protein, 4 aa, Staphylococcus
SNIE

SEQ ID NO: 1985359 - protein, 10 aa, Staphylococcus
SNIEDYPHNT

SEQ ID NO: 1985360 - protein, 7 aa, Staphylococcus
SNIEEYR

SEQ ID NO: 1985361 - protein, 5 aa, Staphylococcus
SNIEK

SEQ ID NO: 1985362 - protein, 13 aa, Staphylococcus
SNIEKISRKNLNK

SEQ ID NO: 1985363 - protein, 6 aa, Staphylococcus
SNIESN

SEQ ID NO: 1985364 - protein, 28 aa, Staphylococcus
SNIESQDNKKANDKTIGKPNSEKMDNAI

SEQ ID NO: 1985365 - protein, 6 aa, Staphylococcus
SNIHDK

SEQ ID NO: 1985366 - protein, 4 aa, Staphylococcus
SNIK

SEQ ID NO: 1985367 - protein, 8 aa, Staphylococcus
SNIKIGSG

SEQ ID NO: 1985368 - protein, 6 aa, Staphylococcus
SNIPPN

SEQ ID NO: 1985369 - protein, 7 aa, Staphylococcus
SNIPQGR

SEQ ID NO: 1985370 - protein, 8 aa, Staphylococcus
SNIQDYPH

SEQ ID NO: 1985371 - protein, 8 aa, Staphylococcus
SNIQTKAI

SEQ ID NO: 1985372 - protein, 7 aa, Staphylococcus
SNIRDNN

SEQ ID NO: 1985373 - protein, 7 aa, Staphylococcus
SNISDTD

SEQ ID NO: 1985374 - protein, 9 aa, Staphylococcus
SNISMGKED

SEQ ID NO: 1985375 - protein, 7 aa, Staphylococcus
SNISNDD

SEQ ID NO: 1985376 - protein, 9 aa, Staphylococcus
SNISREDER

SEQ ID NO: 1985377 - protein, 7 aa, Staphylococcus
SNITDKD

SEQ ID NO: 1985378 - protein, 14 aa, Staphylococcus
SNKADRIKSQLMSA

SEQ ID NO: 1985379 - protein, 15 aa, Staphylococcus
SNKADRIKSQLMSSS

SEQ ID NO: 1985380 - protein, 15 aa, Staphylococcus
SNKADRVKSQLMSAN

SEQ ID NO: 1985381 - protein, 11 aa, Staphylococcus
SNKATENINGE

SEQ ID NO: 1985382 - protein, 10 aa, Staphylococcus
SNKATLTGNG

SEQ ID NO: 1985383 - protein, 5 aa, Staphylococcus
SNKDH

SEQ ID NO: 1985384 - protein, 8 aa, Staphylococcus
SNKEDLPM

SEQ ID NO: 1985385 - protein, 9 aa, Staphylococcus
SNKESVDHA

SEQ ID NO: 1985386 - protein, 10 aa, Staphylococcus
SNKEVTKRTA

SEQ ID NO: 1985387 - protein, 6 aa, Staphylococcus
SNKFNK

SEQ ID NO: 1985388 - protein, 9 aa, Staphylococcus
SNKGAEITK

SEQ ID NO: 1985389 - protein, 16 aa, Staphylococcus
SNKGRVRTHKDKVSWS

SEQ ID NO: 1985390 - protein, 10 aa, Staphylococcus
SNKKEATQTI

SEQ ID NO: 1985391 - protein, 106 aa, Staphylococcus
SNKKIQKLESQLEEERQLNNSFDTVTSNRQNINPQEATFTGESQNINQQQKKSQPTENEINHKDVSEEKKNDRTKEDKFVEETKSNSDDNREVEPPKKGFWSRFFG

SEQ ID NO: 1985392 - protein, 18 aa, Staphylococcus
SNKNPNTNPVEEERKDHK

SEQ ID NO: 1985393 - protein, 6 aa, Staphylococcus
SNKNRS

SEQ ID NO: 1985394 - protein, 6 aa, Staphylococcus
SNKNRT

SEQ ID NO: 1985395 - protein, 7 aa, Staphylococcus
SNKPAVN

SEQ ID NO: 1985396 - protein, 6 aa, Staphylococcus
SNKPEF

SEQ ID NO: 1985397 - protein, 8 aa, Staphylococcus
SNKPNAKV

SEQ ID NO: 1985398 - protein, 7 aa, Staphylococcus
SNKQHRG

SEQ ID NO: 1985399 - protein, 8 aa, Staphylococcus
SNKQYDHE

SEQ ID NO: 1985400 - protein, 5 aa, Staphylococcus
SNKRE

SEQ ID NO: 1985401 - protein, 13 aa, Staphylococcus
SNKRKSAPFPSDY

SEQ ID NO: 1985402 - protein, 13 aa, Staphylococcus
SNKRYKNKEDLEA

SEQ ID NO: 1985403 - protein, 8 aa, Staphylococcus
SNKSITKR

SEQ ID NO: 1985404 - protein, 16 aa, Staphylococcus
SNKSNHPFKYEKDDKD

SEQ ID NO: 1985405 - protein, 5 aa, Staphylococcus
SNKSY

SEQ ID NO: 1985406 - protein, 15 aa, Staphylococcus
SNKTDKAQAPKGYEN

SEQ ID NO: 1985407 - protein, 9 aa, Staphylococcus
SNKTDYATG

SEQ ID NO: 1985408 - protein, 7 aa, Staphylococcus
SNKTETI

SEQ ID NO: 1985409 - protein, 9 aa, Staphylococcus
SNKTIESKM

SEQ ID NO: 1985410 - protein, 10 aa, Staphylococcus
SNKYNNKHSY

SEQ ID NO: 1985411 - protein, 16 aa, Staphylococcus
SNLDDANGHKYGLGSS

SEQ ID NO: 1985412 - protein, 14 aa, Staphylococcus
SNLEGTRKVKQDFE

SEQ ID NO: 1985413 - protein, 14 aa, Staphylococcus
SNLEKSKAKKILNE

SEQ ID NO: 1985414 - protein, 7 aa, Staphylococcus
SNLEQRI

SEQ ID NO: 1985415 - protein, 10 aa, Staphylococcus
SNLESAAGDL

SEQ ID NO: 1985416 - protein, 9 aa, Staphylococcus
SNLGNANDT

SEQ ID NO: 1985417 - protein, 11 aa, Staphylococcus
SNLGPYNDNEN

SEQ ID NO: 1985418 - protein, 9 aa, Staphylococcus
SNLGQAQEM

SEQ ID NO: 1985419 - protein, 10 aa, Staphylococcus
SNLLKGKSEA

SEQ ID NO: 1985420 - protein, 10 aa, Staphylococcus
SNLLRGKDES

SEQ ID NO: 1985421 - protein, 5 aa, Staphylococcus
SNLNG

SEQ ID NO: 1985422 - protein, 8 aa, Staphylococcus
SNLNPNVH

SEQ ID NO: 1985423 - protein, 14 aa, Staphylococcus
SNLPKKKQKQIADQ

SEQ ID NO: 1985424 - protein, 6 aa, Staphylococcus
SNLQST

SEQ ID NO: 1985425 - protein, 12 aa, Staphylococcus
SNLSGTAQKPRL

SEQ ID NO: 1985426 - protein, 13 aa, Staphylococcus
SNLSKKKQEQIAQ

SEQ ID NO: 1985427 - protein, 8 aa, Staphylococcus
SNLSNKQI

SEQ ID NO: 1985428 - protein, 16 aa, Staphylococcus
SNLSQTARHATYREGS

SEQ ID NO: 1985429 - protein, 6 aa, Staphylococcus
SNLSSQ

SEQ ID NO: 1985430 - protein, 9 aa, Staphylococcus
SNLTTQEKQ

SEQ ID NO: 1985431 - protein, 5 aa, Staphylococcus
SNLVG

SEQ ID NO: 1985432 - protein, 4 aa, Staphylococcus
SNLY

SEQ ID NO: 1985433 - protein, 12 aa, Staphylococcus
SNLYPPRKFDGE

SEQ ID NO: 1985434 - protein, 9 aa, Staphylococcus
SNMKEAHKS

SEQ ID NO: 1985435 - protein, 12 aa, Staphylococcus
SNMKESKIEYAT

SEQ ID NO: 1985436 - protein, 4 aa, Staphylococcus
SNMN

SEQ ID NO: 1985437 - protein, 7 aa, Staphylococcus
SNNAKSV

SEQ ID NO: 1985438 - protein, 4 aa, Staphylococcus
SNND

SEQ ID NO: 1985439 - protein, 7 aa, Staphylococcus
SNNDGEI

SEQ ID NO: 1985440 - protein, 11 aa, Staphylococcus
SNNDGVKTPFE

SEQ ID NO: 1985441 - protein, 6 aa, Staphylococcus
SNNDHS

SEQ ID NO: 1985442 - protein, 9 aa, Staphylococcus
SNNDSNYSI

SEQ ID NO: 1985443 - protein, 11 aa, Staphylococcus
SNNEEQDSETV

SEQ ID NO: 1985444 - protein, 6 aa, Staphylococcus
SNNEIT

SEQ ID NO: 1985445 - protein, 12 aa, Staphylococcus
SNNEKDALENKV

SEQ ID NO: 1985446 - protein, 12 aa, Staphylococcus
SNNEKEQLEEKV

SEQ ID NO: 1985447 - protein, 6 aa, Staphylococcus
SNNEKI

SEQ ID NO: 1985448 - protein, 8 aa, Staphylococcus
SNNEKSKI

SEQ ID NO: 1985449 - protein, 6 aa, Staphylococcus
SNNELL

SEQ ID NO: 1985450 - protein, 11 aa, Staphylococcus
SNNEPVGRRSL

SEQ ID NO: 1985451 - protein, 5 aa, Staphylococcus
SNNEQ

SEQ ID NO: 1985452 - protein, 6 aa, Staphylococcus
SNNEVT

SEQ ID NO: 1985453 - protein, 13 aa, Staphylococcus
SNNHALDQGDEGL

SEQ ID NO: 1985454 - protein, 8 aa, Staphylococcus
SNNHANQT

SEQ ID NO: 1985455 - protein, 4 aa, Staphylococcus
SNNI

SEQ ID NO: 1985456 - protein, 6 aa, Staphylococcus
SNNIDN

SEQ ID NO: 1985457 - protein, 5 aa, Staphylococcus
SNNIS

SEQ ID NO: 1985458 - protein, 7 aa, Staphylococcus
SNNKDEI

SEQ ID NO: 1985459 - protein, 21 aa, Staphylococcus
SNNKDITSKTIKPKKGESVGR

SEQ ID NO: 1985460 - protein, 7 aa, Staphylococcus
SNNKDLT

SEQ ID NO: 1985461 - protein, 20 aa, Staphylococcus
SNNKESYNFPPSRIERAKDK

SEQ ID NO: 1985462 - protein, 5 aa, Staphylococcus
SNNKY

SEQ ID NO: 1985463 - protein, 21 aa, Staphylococcus
SNNMPQVAPAEYGYSPQSGSQ

SEQ ID NO: 1985464 - protein, 5 aa, Staphylococcus
SNNMQ

SEQ ID NO: 1985465 - protein, 29 aa, Staphylococcus
SNNNIRSDERFSRQTRYTPFGNDGQKALE

SEQ ID NO: 1985466 - protein, 8 aa, Staphylococcus
SNNPEKFK

SEQ ID NO: 1985467 - protein, 10 aa, Staphylococcus
SNNPKKFESL

SEQ ID NO: 1985468 - protein, 7 aa, Staphylococcus
SNNPNAK

SEQ ID NO: 1985469 - protein, 9 aa, Staphylococcus
SNNQKEPLK

SEQ ID NO: 1985470 - protein, 11 aa, Staphylococcus
SNNQPVGRRSL

SEQ ID NO: 1985471 - protein, 14 aa, Staphylococcus
SNNQRHSNETEKIL

SEQ ID NO: 1985472 - protein, 4 aa, Staphylococcus
SNNS

SEQ ID NO: 1985473 - protein, 11 aa, Staphylococcus
SNNSDYSKGLQ

SEQ ID NO: 1985474 - protein, 13 aa, Staphylococcus
SNNSEKRVSGFSK

SEQ ID NO: 1985475 - protein, 9 aa, Staphylococcus
SNNSNSNNL

SEQ ID NO: 1985476 - protein, 4 aa, Staphylococcus
SNNV

SEQ ID NO: 1985477 - protein, 7 aa, Staphylococcus
SNNVDNC

SEQ ID NO: 1985478 - protein, 6 aa, Staphylococcus
SNNYAN

SEQ ID NO: 1985479 - protein, 8 aa, Staphylococcus
SNNYANQT

SEQ ID NO: 1985480 - protein, 7 aa, Staphylococcus
SNNYSEI

SEQ ID NO: 1985481 - protein, 9 aa, Staphylococcus
SNPEKEKRI

SEQ ID NO: 1985482 - protein, 8 aa, Staphylococcus
SNPERKEL

SEQ ID NO: 1985483 - protein, 7 aa, Staphylococcus
SNPHERL

SEQ ID NO: 1985484 - protein, 9 aa, Staphylococcus
SNPHERLSD

SEQ ID NO: 1985485 - protein, 10 aa, Staphylococcus
SNPHERLSET

SEQ ID NO: 1985486 - protein, 4 aa, Staphylococcus
SNPK

SEQ ID NO: 1985487 - protein, 16 aa, Staphylococcus
SNPLDEFRKSKASLLT

SEQ ID NO: 1985488 - protein, 9 aa, Staphylococcus
SNPNFSKKD

SEQ ID NO: 1985489 - protein, 7 aa, Staphylococcus
SNPNNAQ

SEQ ID NO: 1985490 - protein, 29 aa, Staphylococcus
SNPNSNESSSSNQSTITDDFDGSPALQEN

SEQ ID NO: 1985491 - protein, 6 aa, Staphylococcus
SNPNTK

SEQ ID NO: 1985492 - protein, 4 aa, Staphylococcus
SNPP

SEQ ID NO: 1985493 - protein, 5 aa, Staphylococcus
SNPPY

SEQ ID NO: 1985494 - protein, 6 aa, Staphylococcus
SNPPYI

SEQ ID NO: 1985495 - protein, 8 aa, Staphylococcus
SNPPYIDD

SEQ ID NO: 1985496 - protein, 9 aa, Staphylococcus
SNPPYIDQT

SEQ ID NO: 1985497 - protein, 14 aa, Staphylococcus
SNPPYISEKETCQM

SEQ ID NO: 1985498 - protein, 9 aa, Staphylococcus
SNPRTQKAS

SEQ ID NO: 1985499 - protein, 4 aa, Staphylococcus
SNPS

SEQ ID NO: 1985500 - protein, 15 aa, Staphylococcus
SNPSKSEDPEDIAKD

SEQ ID NO: 1985501 - protein, 9 aa, Staphylococcus
SNPVSKDTF

SEQ ID NO: 1985502 - protein, 6 aa, Staphylococcus
SNPYDA

SEQ ID NO: 1985503 - protein, 4 aa, Staphylococcus
SNQA

SEQ ID NO: 1985504 - protein, 12 aa, Staphylococcus
SNQARTDNETTY

SEQ ID NO: 1985505 - protein, 15 aa, Staphylococcus
SNQATLDDPKANNEM

SEQ ID NO: 1985506 - protein, 14 aa, Staphylococcus
SNQATSDNPNQPNE

SEQ ID NO: 1985507 - protein, 11 aa, Staphylococcus
SNQDAYREQAQ

SEQ ID NO: 1985508 - protein, 12 aa, Staphylococcus
SNQDEKATNDPF

SEQ ID NO: 1985509 - protein, 7 aa, Staphylococcus
SNQDFNA

SEQ ID NO: 1985510 - protein, 10 aa, Staphylococcus
SNQDKVQQLQ

SEQ ID NO: 1985511 - protein, 14 aa, Staphylococcus
SNQDLQGGSPKENK

SEQ ID NO: 1985512 - protein, 4 aa, Staphylococcus
SNQE

SEQ ID NO: 1985513 - protein, 5 aa, Staphylococcus
SNQEG

SEQ ID NO: 1985514 - protein, 9 aa, Staphylococcus
SNQEGDREA

SEQ ID NO: 1985515 - protein, 6 aa, Staphylococcus
SNQEIS

SEQ ID NO: 1985516 - protein, 8 aa, Staphylococcus
SNQGHAHA

SEQ ID NO: 1985517 - protein, 7 aa, Staphylococcus
SNQIEPR

SEQ ID NO: 1985518 - protein, 10 aa, Staphylococcus
SNQKAKDVLE

SEQ ID NO: 1985519 - protein, 5 aa, Staphylococcus
SNQKS

SEQ ID NO: 1985520 - protein, 4 aa, Staphylococcus
SNQN

SEQ ID NO: 1985521 - protein, 9 aa, Staphylococcus
SNQNGNQSV

SEQ ID NO: 1985522 - protein, 6 aa, Staphylococcus
SNQNVS

SEQ ID NO: 1985523 - protein, 6 aa, Staphylococcus
SNQPNA

SEQ ID NO: 1985524 - protein, 7 aa, Staphylococcus
SNQPSAK

SEQ ID NO: 1985525 - protein, 4 aa, Staphylococcus
SNQR

SEQ ID NO: 1985526 - protein, 12 aa, Staphylococcus
SNQRDQNRLDQE

SEQ ID NO: 1985527 - protein, 17 aa, Staphylococcus
SNQRHDDYGVDSLENRA

SEQ ID NO: 1985528 - protein, 13 aa, Staphylococcus
SNQRHQHQKEAHK

SEQ ID NO: 1985529 - protein, 10 aa, Staphylococcus
SNQSDEQLKA

SEQ ID NO: 1985530 - protein, 4 aa, Staphylococcus
SNQT

SEQ ID NO: 1985531 - protein, 8 aa, Staphylococcus
SNQTGHRE

SEQ ID NO: 1985532 - protein, 9 aa, Staphylococcus
SNQTGYGDK

SEQ ID NO: 1985533 - protein, 4 aa, Staphylococcus
SNQV

SEQ ID NO: 1985534 - protein, 8 aa, Staphylococcus
SNQWSGSR

SEQ ID NO: 1985535 - protein, 5 aa, Staphylococcus
SNQYA

SEQ ID NO: 1985536 - protein, 7 aa, Staphylococcus
SNQYGNH

SEQ ID NO: 1985537 - protein, 12 aa, Staphylococcus
SNQYQSHTRFKW

SEQ ID NO: 1985538 - protein, 12 aa, Staphylococcus
SNQYQSMTKFKW

SEQ ID NO: 1985539 - protein, 5 aa, Staphylococcus
SNRDY

SEQ ID NO: 1985540 - protein, 6 aa, Staphylococcus
SNRETE

SEQ ID NO: 1985541 - protein, 5 aa, Staphylococcus
SNREY

SEQ ID NO: 1985542 - protein, 18 aa, Staphylococcus
SNRGGKGIKTATITEKNG

SEQ ID NO: 1985543 - protein, 6 aa, Staphylococcus
SNRGYE

SEQ ID NO: 1985544 - protein, 4 aa, Staphylococcus
SNRH

SEQ ID NO: 1985545 - protein, 4 aa, Staphylococcus
SNRL

SEQ ID NO: 1985546 - protein, 8 aa, Staphylococcus
SNRLGTPL

SEQ ID NO: 1985547 - protein, 6 aa, Staphylococcus
SNRLQQ

SEQ ID NO: 1985548 - protein, 4 aa, Staphylococcus
SNRM

SEQ ID NO: 1985549 - protein, 20 aa, Staphylococcus
SNRQPNTSPHTKEIDGNTYT

SEQ ID NO: 1985550 - protein, 9 aa, Staphylococcus
SNRQSDGFK

SEQ ID NO: 1985551 - protein, 5 aa, Staphylococcus
SNRRT

SEQ ID NO: 1985552 - protein, 4 aa, Staphylococcus
SNRS

SEQ ID NO: 1985553 - protein, 8 aa, Staphylococcus
SNRSGKEI

SEQ ID NO: 1985554 - protein, 10 aa, Staphylococcus
SNRSLKSPEV

SEQ ID NO: 1985555 - protein, 11 aa, Staphylococcus
SNRTGKSFSSH

SEQ ID NO: 1985556 - protein, 11 aa, Staphylococcus
SNRVKKGLPDQ

SEQ ID NO: 1985557 - protein, 4 aa, Staphylococcus
SNSA

SEQ ID NO: 1985558 - protein, 4 aa, Staphylococcus
SNSD

SEQ ID NO: 1985559 - protein, 5 aa, Staphylococcus
SNSDD

SEQ ID NO: 1985560 - protein, 12 aa, Staphylococcus
SNSDNDPEKAKE

SEQ ID NO: 1985561 - protein, 12 aa, Staphylococcus
SNSDNDPNKEKE

SEQ ID NO: 1985562 - protein, 6 aa, Staphylococcus
SNSDYD

SEQ ID NO: 1985563 - protein, 6 aa, Staphylococcus
SNSEDL

SEQ ID NO: 1985564 - protein, 7 aa, Staphylococcus
SNSEELS

SEQ ID NO: 1985565 - protein, 23 aa, Staphylococcus
SNSGNTKVSKEDVSSKVFSSGKR

SEQ ID NO: 1985566 - protein, 4 aa, Staphylococcus
SNSI

SEQ ID NO: 1985567 - protein, 7 aa, Staphylococcus
SNSKKTY

SEQ ID NO: 1985568 - protein, 11 aa, Staphylococcus
SNSKLTPDEAQ

SEQ ID NO: 1985569 - protein, 8 aa, Staphylococcus
SNSKRDHF

SEQ ID NO: 1985570 - protein, 6 aa, Staphylococcus
SNSKYD

SEQ ID NO: 1985571 - protein, 8 aa, Staphylococcus
SNSLSSKK

SEQ ID NO: 1985572 - protein, 10 aa, Staphylococcus
SNSPKQNYEL

SEQ ID NO: 1985573 - protein, 5 aa, Staphylococcus
SNSPP

SEQ ID NO: 1985574 - protein, 5 aa, Staphylococcus
SNSPT

SEQ ID NO: 1985575 - protein, 11 aa, Staphylococcus
SNSQAEQPTTI

SEQ ID NO: 1985576 - protein, 9 aa, Staphylococcus
SNSQFNSES

SEQ ID NO: 1985577 - protein, 4 aa, Staphylococcus
SNSR

SEQ ID NO: 1985578 - protein, 6 aa, Staphylococcus
SNSRGH

SEQ ID NO: 1985579 - protein, 9 aa, Staphylococcus
SNSSDKQSI

SEQ ID NO: 1985580 - protein, 8 aa, Staphylococcus
SNSSRYNA

SEQ ID NO: 1985581 - protein, 9 aa, Staphylococcus
SNSSRYNAE

SEQ ID NO: 1985582 - protein, 10 aa, Staphylococcus
SNSSRYNAET

SEQ ID NO: 1985583 - protein, 8 aa, Staphylococcus
SNSTDKQG

SEQ ID NO: 1985584 - protein, 8 aa, Staphylococcus
SNSTGEFR

SEQ ID NO: 1985585 - protein, 8 aa, Staphylococcus
SNSTIGSE

SEQ ID NO: 1985586 - protein, 6 aa, Staphylococcus
SNSTVL

SEQ ID NO: 1985587 - protein, 8 aa, Staphylococcus
SNSVDALD

SEQ ID NO: 1985588 - protein, 7 aa, Staphylococcus
SNSYDQS

SEQ ID NO: 1985589 - protein, 7 aa, Staphylococcus
SNTAEFG

SEQ ID NO: 1985590 - protein, 9 aa, Staphylococcus
SNTAEYGDY

SEQ ID NO: 1985591 - protein, 6 aa, Staphylococcus
SNTEDL

SEQ ID NO: 1985592 - protein, 6 aa, Staphylococcus
SNTEKQ

SEQ ID NO: 1985593 - protein, 8 aa, Staphylococcus
SNTEQDVV

SEQ ID NO: 1985594 - protein, 7 aa, Staphylococcus
SNTESLS

SEQ ID NO: 1985595 - protein, 6 aa, Staphylococcus
SNTHTY

SEQ ID NO: 1985596 - protein, 5 aa, Staphylococcus
SNTIT

SEQ ID NO: 1985597 - protein, 10 aa, Staphylococcus
SNTKPKNLDE

SEQ ID NO: 1985598 - protein, 7 aa, Staphylococcus
SNTLNSN

SEQ ID NO: 1985599 - protein, 8 aa, Staphylococcus
SNTNTSNQ

SEQ ID NO: 1985600 - protein, 5 aa, Staphylococcus
SNTPI

SEQ ID NO: 1985601 - protein, 18 aa, Staphylococcus
SNTQAAQKTVSQCQAHGG

SEQ ID NO: 1985602 - protein, 6 aa, Staphylococcus
SNTQNL

SEQ ID NO: 1985603 - protein, 6 aa, Staphylococcus
SNTQQN

SEQ ID NO: 1985604 - protein, 7 aa, Staphylococcus
SNTRDAL

SEQ ID NO: 1985605 - protein, 7 aa, Staphylococcus
SNTREDS

SEQ ID NO: 1985606 - protein, 11 aa, Staphylococcus
SNTRRNTERRL

SEQ ID NO: 1985607 - protein, 5 aa, Staphylococcus
SNTSI

SEQ ID NO: 1985608 - protein, 11 aa, Staphylococcus
SNTSKSQLEAK

SEQ ID NO: 1985609 - protein, 5 aa, Staphylococcus
SNTSW

SEQ ID NO: 1985610 - protein, 6 aa, Staphylococcus
SNTTGH

SEQ ID NO: 1985611 - protein, 13 aa, Staphylococcus
SNTWKNNKAVQNG

SEQ ID NO: 1985612 - protein, 9 aa, Staphylococcus
SNVASTQID

SEQ ID NO: 1985613 - protein, 8 aa, Staphylococcus
SNVDNADR

SEQ ID NO: 1985614 - protein, 7 aa, Staphylococcus
SNVEIGN

SEQ ID NO: 1985615 - protein, 5 aa, Staphylococcus
SNVEQ

SEQ ID NO: 1985616 - protein, 6 aa, Staphylococcus
SNVEQN

SEQ ID NO: 1985617 - protein, 10 aa, Staphylococcus
SNVGGKAQPL

SEQ ID NO: 1985618 - protein, 16 aa, Staphylococcus
SNVKTKDKYSESQAGV

SEQ ID NO: 1985619 - protein, 6 aa, Staphylococcus
SNVNIG

SEQ ID NO: 1985620 - protein, 13 aa, Staphylococcus
SNVNNRQNGQRNA

SEQ ID NO: 1985621 - protein, 10 aa, Staphylococcus
SNVNQLNQEM

SEQ ID NO: 1985622 - protein, 6 aa, Staphylococcus
SNVNRS

SEQ ID NO: 1985623 - protein, 8 aa, Staphylococcus
SNVPTTRN

SEQ ID NO: 1985624 - protein, 4 aa, Staphylococcus
SNVQ

SEQ ID NO: 1985625 - protein, 7 aa, Staphylococcus
SNVREEV

SEQ ID NO: 1985626 - protein, 12 aa, Staphylococcus
SNVRESSKKREA

SEQ ID NO: 1985627 - protein, 5 aa, Staphylococcus
SNVSA

SEQ ID NO: 1985628 - protein, 6 aa, Staphylococcus
SNVTGT

SEQ ID NO: 1985629 - protein, 14 aa, Staphylococcus
SNVTNNESSANMRE

SEQ ID NO: 1985630 - protein, 5 aa, Staphylococcus
SNYDG

SEQ ID NO: 1985631 - protein, 4 aa, Staphylococcus
SNYE

SEQ ID NO: 1985632 - protein, 11 aa, Staphylococcus
SNYGTSRETVR

SEQ ID NO: 1985633 - protein, 7 aa, Staphylococcus
SNYIGTG

SEQ ID NO: 1985634 - protein, 4 aa, Staphylococcus
SNYK

SEQ ID NO: 1985635 - protein, 9 aa, Staphylococcus
SNYKKRKDM

SEQ ID NO: 1985636 - protein, 10 aa, Staphylococcus
SNYKNSTELR

SEQ ID NO: 1985637 - protein, 5 aa, Staphylococcus
SNYLK

SEQ ID NO: 1985638 - protein, 13 aa, Staphylococcus
SNYNEASQPIAPG

SEQ ID NO: 1985639 - protein, 7 aa, Staphylococcus
SNYPATR

SEQ ID NO: 1985640 - protein, 5 aa, Staphylococcus
SNYPE

SEQ ID NO: 1985641 - protein, 8 aa, Staphylococcus
SNYPGGIK

SEQ ID NO: 1985642 - protein, 5 aa, Staphylococcus
SNYQK

SEQ ID NO: 1985643 - protein, 6 aa, Staphylococcus
SNYSTN

SEQ ID NO: 1985644 - protein, 12 aa, Staphylococcus
SNYYRPPNVSRD

SEQ ID NO: 1985645 - protein, 8 aa, Staphylococcus
SNYYSEEY

SEQ ID NO: 1985646 - protein, 8 aa, Staphylococcus
SPAAQSLH

SEQ ID NO: 1985647 - protein, 8 aa, Staphylococcus
SPAEPVNP

SEQ ID NO: 1985648 - protein, 11 aa, Staphylococcus
SPAKQSEIENE

SEQ ID NO: 1985649 - protein, 19 aa, Staphylococcus
SPANDVKGKGRLSGELGEG

SEQ ID NO: 1985650 - protein, 5 aa, Staphylococcus
SPCPS

SEQ ID NO: 1985651 - protein, 15 aa, Staphylococcus
SPDAKMDRKKDKIGY

SEQ ID NO: 1985652 - protein, 7 aa, Staphylococcus
SPDDEHN

SEQ ID NO: 1985653 - protein, 12 aa, Staphylococcus
SPDEEDNISAIE

SEQ ID NO: 1985654 - protein, 7 aa, Staphylococcus
SPDETEE

SEQ ID NO: 1985655 - protein, 12 aa, Staphylococcus
SPDEWKDETLEA

SEQ ID NO: 1985656 - protein, 7 aa, Staphylococcus
SPDGSEA

SEQ ID NO: 1985657 - protein, 14 aa, Staphylococcus
SPDHLRGDAEGRYG

SEQ ID NO: 1985658 - protein, 15 aa, Staphylococcus
SPDHLRGDVDGRYGT

SEQ ID NO: 1985659 - protein, 4 aa, Staphylococcus
SPDI

SEQ ID NO: 1985660 - protein, 9 aa, Staphylococcus
SPDIDGQAQ

SEQ ID NO: 1985661 - protein, 9 aa, Staphylococcus
SPDKLESQI

SEQ ID NO: 1985662 - protein, 8 aa, Staphylococcus
SPDKNEKI

SEQ ID NO: 1985663 - protein, 5 aa, Staphylococcus
SPDKV

SEQ ID NO: 1985664 - protein, 8 aa, Staphylococcus
SPDMPEEV

SEQ ID NO: 1985665 - protein, 9 aa, Staphylococcus
SPDNPETQA

SEQ ID NO: 1985666 - protein, 8 aa, Staphylococcus
SPDPNGVP

SEQ ID NO: 1985667 - protein, 7 aa, Staphylococcus
SPDPNIN

SEQ ID NO: 1985668 - protein, 7 aa, Staphylococcus
SPDPNIS

SEQ ID NO: 1985669 - protein, 6 aa, Staphylococcus
SPDPNL

SEQ ID NO: 1985670 - protein, 7 aa, Staphylococcus
SPDPNLS

SEQ ID NO: 1985671 - protein, 5 aa, Staphylococcus
SPDSH

SEQ ID NO: 1985672 - protein, 10 aa, Staphylococcus
SPDSKKGLSS

SEQ ID NO: 1985673 - protein, 7 aa, Staphylococcus
SPDYDGA

SEQ ID NO: 1985674 - protein, 15 aa, Staphylococcus
SPDYLRGDTEGRYGT

SEQ ID NO: 1985675 - protein, 11 aa, Staphylococcus
SPEAASGGPIG

SEQ ID NO: 1985676 - protein, 11 aa, Staphylococcus
SPEAKYPTAIE

SEQ ID NO: 1985677 - protein, 4 aa, Staphylococcus
SPED

SEQ ID NO: 1985678 - protein, 10 aa, Staphylococcus
SPEDASRTDQ

SEQ ID NO: 1985679 - protein, 10 aa, Staphylococcus
SPEDATRTDT

SEQ ID NO: 1985680 - protein, 12 aa, Staphylococcus
SPEEAESPGISM

SEQ ID NO: 1985681 - protein, 11 aa, Staphylococcus
SPEEAESPGIT

SEQ ID NO: 1985682 - protein, 14 aa, Staphylococcus
SPEEAEYVKYLLLE

SEQ ID NO: 1985683 - protein, 10 aa, Staphylococcus
SPEEQESPGI

SEQ ID NO: 1985684 - protein, 6 aa, Staphylococcus
SPEERE

SEQ ID NO: 1985685 - protein, 10 aa, Staphylococcus
SPEETTEMQD

SEQ ID NO: 1985686 - protein, 4 aa, Staphylococcus
SPEG

SEQ ID NO: 1985687 - protein, 10 aa, Staphylococcus
SPEGEEEIYS

SEQ ID NO: 1985688 - protein, 11 aa, Staphylococcus
SPEGENEIYSK

SEQ ID NO: 1985689 - protein, 15 aa, Staphylococcus
SPEGGYTAIDPASLQ

SEQ ID NO: 1985690 - protein, 15 aa, Staphylococcus
SPEGGYTAIDPQSLQ

SEQ ID NO: 1985691 - protein, 10 aa, Staphylococcus
SPEGQIDATD

SEQ ID NO: 1985692 - protein, 5 aa, Staphylococcus
SPEGT

SEQ ID NO: 1985693 - protein, 8 aa, Staphylococcus
SPEHKKDI

SEQ ID NO: 1985694 - protein, 8 aa, Staphylococcus
SPEHRDKI

SEQ ID NO: 1985695 - protein, 10 aa, Staphylococcus
SPEIDGETQS

SEQ ID NO: 1985696 - protein, 17 aa, Staphylococcus
SPEIEDNYETKENTSGR

SEQ ID NO: 1985697 - protein, 5 aa, Staphylococcus
SPEKG

SEQ ID NO: 1985698 - protein, 9 aa, Staphylococcus
SPEKSTNQL

SEQ ID NO: 1985699 - protein, 4 aa, Staphylococcus
SPEL

SEQ ID NO: 1985700 - protein, 22 aa, Staphylococcus
SPELDNEASQQFRDDQTNSAAN

SEQ ID NO: 1985701 - protein, 9 aa, Staphylococcus
SPENEITED

SEQ ID NO: 1985702 - protein, 9 aa, Staphylococcus
SPENPDGTE

SEQ ID NO: 1985703 - protein, 10 aa, Staphylococcus
SPEPAYMPGY

SEQ ID NO: 1985704 - protein, 8 aa, Staphylococcus
SPEPLGVT

SEQ ID NO: 1985705 - protein, 4 aa, Staphylococcus
SPET

SEQ ID NO: 1985706 - protein, 7 aa, Staphylococcus
SPETHDK

SEQ ID NO: 1985707 - protein, 8 aa, Staphylococcus
SPETLGVT

SEQ ID NO: 1985708 - protein, 7 aa, Staphylococcus
SPETTDY

SEQ ID NO: 1985709 - protein, 9 aa, Staphylococcus
SPFAGREGD

SEQ ID NO: 1985710 - protein, 11 aa, Staphylococcus
SPFAGREGDYV

SEQ ID NO: 1985711 - protein, 19 aa, Staphylococcus
SPFAGREGDYVTSRQIQER

SEQ ID NO: 1985712 - protein, 11 aa, Staphylococcus
SPFAGREGQYV

SEQ ID NO: 1985713 - protein, 6 aa, Staphylococcus
SPFDTD

SEQ ID NO: 1985714 - protein, 11 aa, Staphylococcus
SPFGGGVHTPE

SEQ ID NO: 1985715 - protein, 9 aa, Staphylococcus
SPFGQGRPG

SEQ ID NO: 1985716 - protein, 13 aa, Staphylococcus
SPFGSSSHLTDQH

SEQ ID NO: 1985717 - protein, 14 aa, Staphylococcus
SPFGSSSKHNDPHF

SEQ ID NO: 1985718 - protein, 14 aa, Staphylococcus
SPFGSSSKLNDPNF

SEQ ID NO: 1985719 - protein, 12 aa, Staphylococcus
SPFGSSSPLNDA

SEQ ID NO: 1985720 - protein, 14 aa, Staphylococcus
SPFGSSSPLTNPNF

SEQ ID NO: 1985721 - protein, 6 aa, Staphylococcus
SPFGTD

SEQ ID NO: 1985722 - protein, 11 aa, Staphylococcus
SPFKSKQQLST

SEQ ID NO: 1985723 - protein, 10 aa, Staphylococcus
SPFKSKSHLA

SEQ ID NO: 1985724 - protein, 11 aa, Staphylococcus
SPFKSKSHLSS

SEQ ID NO: 1985725 - protein, 8 aa, Staphylococcus
SPFKSRSY

SEQ ID NO: 1985726 - protein, 8 aa, Staphylococcus
SPFNIEGG

SEQ ID NO: 1985727 - protein, 5 aa, Staphylococcus
SPFPE

SEQ ID NO: 1985728 - protein, 6 aa, Staphylococcus
SPFPEE

SEQ ID NO: 1985729 - protein, 15 aa, Staphylococcus
SPFPEIKDSNDERAY

SEQ ID NO: 1985730 - protein, 13 aa, Staphylococcus
SPFTNTKSKKYKV

SEQ ID NO: 1985731 - protein, 14 aa, Staphylococcus
SPFTNTKSKRYKAE

SEQ ID NO: 1985732 - protein, 13 aa, Staphylococcus
SPFTNTSRKQFKD

SEQ ID NO: 1985733 - protein, 4 aa, Staphylococcus
SPFV

SEQ ID NO: 1985734 - protein, 5 aa, Staphylococcus
SPFVG

SEQ ID NO: 1985735 - protein, 7 aa, Staphylococcus
SPGDNEQ

SEQ ID NO: 1985736 - protein, 5 aa, Staphylococcus
SPGEH

SEQ ID NO: 1985737 - protein, 8 aa, Staphylococcus
SPGEQQRY

SEQ ID NO: 1985738 - protein, 4 aa, Staphylococcus
SPGF

SEQ ID NO: 1985739 - protein, 12 aa, Staphylococcus
SPGGKPVTPPID

SEQ ID NO: 1985740 - protein, 13 aa, Staphylococcus
SPGGKPVTPPVEG

SEQ ID NO: 1985741 - protein, 9 aa, Staphylococcus
SPGGNGKTT

SEQ ID NO: 1985742 - protein, 14 aa, Staphylococcus
SPGGQPVTPPVDGI

SEQ ID NO: 1985743 - protein, 19 aa, Staphylococcus
SPGGTDGGEIHKANEGIPT

SEQ ID NO: 1985744 - protein, 19 aa, Staphylococcus
SPGGTDGGEIHKANQGIPT

SEQ ID NO: 1985745 - protein, 19 aa, Staphylococcus
SPGGTDGGEIHKANSGIPT

SEQ ID NO: 1985746 - protein, 16 aa, Staphylococcus
SPGGTDGGEIHKANTG

SEQ ID NO: 1985747 - protein, 9 aa, Staphylococcus
SPGHSPGSL

SEQ ID NO: 1985748 - protein, 10 aa, Staphylococcus
SPGPGAPRDY

SEQ ID NO: 1985749 - protein, 13 aa, Staphylococcus
SPGPGHPEDTEDL

SEQ ID NO: 1985750 - protein, 10 aa, Staphylococcus
SPGPGHPLDD

SEQ ID NO: 1985751 - protein, 10 aa, Staphylococcus
SPGPGHPLDK

SEQ ID NO: 1985752 - protein, 10 aa, Staphylococcus
SPGPGRPSDY

SEQ ID NO: 1985753 - protein, 8 aa, Staphylococcus
SPGRYAQE

SEQ ID NO: 1985754 - protein, 6 aa, Staphylococcus
SPGSDI

SEQ ID NO: 1985755 - protein, 4 aa, Staphylococcus
SPGY

SEQ ID NO: 1985756 - protein, 5 aa, Staphylococcus
SPGYI

SEQ ID NO: 1985757 - protein, 5 aa, Staphylococcus
SPGYQ

SEQ ID NO: 1985758 - protein, 6 aa, Staphylococcus
SPHELR

SEQ ID NO: 1985759 - protein, 8 aa, Staphylococcus
SPHPPHDN

SEQ ID NO: 1985760 - protein, 7 aa, Staphylococcus
SPHPSPL

SEQ ID NO: 1985761 - protein, 12 aa, Staphylococcus
SPHRKDAYAANE

SEQ ID NO: 1985762 - protein, 12 aa, Staphylococcus
SPHRKDAYQANE

SEQ ID NO: 1985763 - protein, 12 aa, Staphylococcus
SPHRKDAYRANE

SEQ ID NO: 1985764 - protein, 8 aa, Staphylococcus
SPIEGSRH

SEQ ID NO: 1985765 - protein, 12 aa, Staphylococcus
SPIERDTQRTFN

SEQ ID NO: 1985766 - protein, 12 aa, Staphylococcus
SPIGNDAETTWQ

SEQ ID NO: 1985767 - protein, 13 aa, Staphylococcus
SPIGNDAKSTWDN

SEQ ID NO: 1985768 - protein, 12 aa, Staphylococcus
SPIGNDAKTTWA

SEQ ID NO: 1985769 - protein, 12 aa, Staphylococcus
SPIGNDAQTNWE

SEQ ID NO: 1985770 - protein, 13 aa, Staphylococcus
SPIGNDAQTSWEN

SEQ ID NO: 1985771 - protein, 8 aa, Staphylococcus
SPIGRNGI

SEQ ID NO: 1985772 - protein, 10 aa, Staphylococcus
SPIKESRVKG

SEQ ID NO: 1985773 - protein, 15 aa, Staphylococcus
SPINSRFTEEDQRQL

SEQ ID NO: 1985774 - protein, 10 aa, Staphylococcus
SPIPGTESKV

SEQ ID NO: 1985775 - protein, 9 aa, Staphylococcus
SPIPNTESK

SEQ ID NO: 1985776 - protein, 10 aa, Staphylococcus
SPIPNTESKL

SEQ ID NO: 1985777 - protein, 10 aa, Staphylococcus
SPIPNTESKV

SEQ ID NO: 1985778 - protein, 11 aa, Staphylococcus
SPIQHGSNAEY

SEQ ID NO: 1985779 - protein, 5 aa, Staphylococcus
SPIQQ

SEQ ID NO: 1985780 - protein, 6 aa, Staphylococcus
SPISDY

SEQ ID NO: 1985781 - protein, 6 aa, Staphylococcus
SPISKQ

SEQ ID NO: 1985782 - protein, 8 aa, Staphylococcus
SPISNNDF

SEQ ID NO: 1985783 - protein, 9 aa, Staphylococcus
SPITAGPTQ

SEQ ID NO: 1985784 - protein, 7 aa, Staphylococcus
SPITTPK

SEQ ID NO: 1985785 - protein, 4 aa, Staphylococcus
SPIV

SEQ ID NO: 1985786 - protein, 14 aa, Staphylococcus
SPKAPELKTDKAFK

SEQ ID NO: 1985787 - protein, 6 aa, Staphylococcus
SPKDIN

SEQ ID NO: 1985788 - protein, 5 aa, Staphylococcus
SPKDR

SEQ ID NO: 1985789 - protein, 8 aa, Staphylococcus
SPKEAKNI

SEQ ID NO: 1985790 - protein, 13 aa, Staphylococcus
SPKEDHHTIIALN

SEQ ID NO: 1985791 - protein, 5 aa, Staphylococcus
SPKEK

SEQ ID NO: 1985792 - protein, 9 aa, Staphylococcus
SPKEKSGQL

SEQ ID NO: 1985793 - protein, 5 aa, Staphylococcus
SPKEP

SEQ ID NO: 1985794 - protein, 11 aa, Staphylococcus
SPKEYRQLTKS

SEQ ID NO: 1985795 - protein, 5 aa, Staphylococcus
SPKGI

SEQ ID NO: 1985796 - protein, 8 aa, Staphylococcus
SPKGNTDV

SEQ ID NO: 1985797 - protein, 9 aa, Staphylococcus
SPKNGPKIY

SEQ ID NO: 1985798 - protein, 10 aa, Staphylococcus
SPKPADAPGF

SEQ ID NO: 1985799 - protein, 19 aa, Staphylococcus
SPKPKDAPGFPVRAFAIKP

SEQ ID NO: 1985800 - protein, 18 aa, Staphylococcus
SPKPKNAPGFPVRAFAIK

SEQ ID NO: 1985801 - protein, 7 aa, Staphylococcus
SPKPYFD

SEQ ID NO: 1985802 - protein, 19 aa, Staphylococcus
SPKSKNDNILPNTSYDEDA

SEQ ID NO: 1985803 - protein, 5 aa, Staphylococcus
SPKTK

SEQ ID NO: 1985804 - protein, 4 aa, Staphylococcus
SPLA

SEQ ID NO: 1985805 - protein, 19 aa, Staphylococcus
SPLAGSADNYSKGDHPEHD

SEQ ID NO: 1985806 - protein, 16 aa, Staphylococcus
SPLAHDSKQEIATPYG

SEQ ID NO: 1985807 - protein, 8 aa, Staphylococcus
SPLENKNE

SEQ ID NO: 1985808 - protein, 6 aa, Staphylococcus
SPLGKK

SEQ ID NO: 1985809 - protein, 19 aa, Staphylococcus
SPLGTLSEQKYNEILQLLD

SEQ ID NO: 1985810 - protein, 22 aa, Staphylococcus
SPLRKADDAITLDTTGKSIETV

SEQ ID NO: 1985811 - protein, 21 aa, Staphylococcus
SPLRKADDAITVNTTGKSIEQ

SEQ ID NO: 1985812 - protein, 4 aa, Staphylococcus
SPMK

SEQ ID NO: 1985813 - protein, 5 aa, Staphylococcus
SPMPK

SEQ ID NO: 1985814 - protein, 8 aa, Staphylococcus
SPNATGKL

SEQ ID NO: 1985815 - protein, 11 aa, Staphylococcus
SPNDESAKEVI

SEQ ID NO: 1985816 - protein, 8 aa, Staphylococcus
SPNDMPHS

SEQ ID NO: 1985817 - protein, 7 aa, Staphylococcus
SPNIRSK

SEQ ID NO: 1985818 - protein, 19 aa, Staphylococcus
SPNIRSKSTYWPKNNGDFK

SEQ ID NO: 1985819 - protein, 6 aa, Staphylococcus
SPNKYE

SEQ ID NO: 1985820 - protein, 8 aa, Staphylococcus
SPNPHTSK

SEQ ID NO: 1985821 - protein, 8 aa, Staphylococcus
SPNQHTTE

SEQ ID NO: 1985822 - protein, 8 aa, Staphylococcus
SPNQPDGA

SEQ ID NO: 1985823 - protein, 7 aa, Staphylococcus
SPNQYQD

SEQ ID NO: 1985824 - protein, 8 aa, Staphylococcus
SPNRYSSD

SEQ ID NO: 1985825 - protein, 5 aa, Staphylococcus
SPNTL

SEQ ID NO: 1985826 - protein, 4 aa, Staphylococcus
SPNV

SEQ ID NO: 1985827 - protein, 6 aa, Staphylococcus
SPNYGG

SEQ ID NO: 1985828 - protein, 4 aa, Staphylococcus
SPPL

SEQ ID NO: 1985829 - protein, 18 aa, Staphylococcus
SPPMNSKSLKETTKKEKL

SEQ ID NO: 1985830 - protein, 5 aa, Staphylococcus
SPPQW

SEQ ID NO: 1985831 - protein, 9 aa, Staphylococcus
SPPSNPEKF

SEQ ID NO: 1985832 - protein, 5 aa, Staphylococcus
SPPYP

SEQ ID NO: 1985833 - protein, 7 aa, Staphylococcus
SPQALRD

SEQ ID NO: 1985834 - protein, 8 aa, Staphylococcus
SPQDFETK

SEQ ID NO: 1985835 - protein, 7 aa, Staphylococcus
SPQDGKL

SEQ ID NO: 1985836 - protein, 8 aa, Staphylococcus
SPQEAQQS

SEQ ID NO: 1985837 - protein, 6 aa, Staphylococcus
SPQHDE

SEQ ID NO: 1985838 - protein, 4 aa, Staphylococcus
SPQI

SEQ ID NO: 1985839 - protein, 8 aa, Staphylococcus
SPQIQRQE

SEQ ID NO: 1985840 - protein, 4 aa, Staphylococcus
SPQL

SEQ ID NO: 1985841 - protein, 9 aa, Staphylococcus
SPQNKDKND

SEQ ID NO: 1985842 - protein, 9 aa, Staphylococcus
SPQPETYAS

SEQ ID NO: 1985843 - protein, 8 aa, Staphylococcus
SPQPGLQS

SEQ ID NO: 1985844 - protein, 5 aa, Staphylococcus
SPQRE

SEQ ID NO: 1985845 - protein, 7 aa, Staphylococcus
SPQSGTI

SEQ ID NO: 1985846 - protein, 5 aa, Staphylococcus
SPQTK

SEQ ID NO: 1985847 - protein, 31 aa, Staphylococcus
SPQTPQNYSSQGTNFSTKPKQYTKKEDAERK

SEQ ID NO: 1985848 - protein, 7 aa, Staphylococcus
SPQTVRE

SEQ ID NO: 1985849 - protein, 8 aa, Staphylococcus
SPREVSRQ

SEQ ID NO: 1985850 - protein, 5 aa, Staphylococcus
SPRHG

SEQ ID NO: 1985851 - protein, 4 aa, Staphylococcus
SPRN

SEQ ID NO: 1985852 - protein, 7 aa, Staphylococcus
SPRPGTI

SEQ ID NO: 1985853 - protein, 7 aa, Staphylococcus
SPRQKAY

SEQ ID NO: 1985854 - protein, 16 aa, Staphylococcus
SPRSAGTKVEFQGKTY

SEQ ID NO: 1985855 - protein, 6 aa, Staphylococcus
SPRTIQ

SEQ ID NO: 1985856 - protein, 5 aa, Staphylococcus
SPRYG

SEQ ID NO: 1985857 - protein, 6 aa, Staphylococcus
SPSAYE

SEQ ID NO: 1985858 - protein, 6 aa, Staphylococcus
SPSEIA

SEQ ID NO: 1985859 - protein, 13 aa, Staphylococcus
SPSFDKKDKNGNS

SEQ ID NO: 1985860 - protein, 20 aa, Staphylococcus
SPSKHVSKTYEVTSKKPVTK

SEQ ID NO: 1985861 - protein, 5 aa, Staphylococcus
SPSNT

SEQ ID NO: 1985862 - protein, 8 aa, Staphylococcus
SPSNYAQA

SEQ ID NO: 1985863 - protein, 22 aa, Staphylococcus
SPSPNTSETPSSTHEKEDKINW

SEQ ID NO: 1985864 - protein, 9 aa, Staphylococcus
SPSSGLAGE

SEQ ID NO: 1985865 - protein, 4 aa, Staphylococcus
SPSY

SEQ ID NO: 1985866 - protein, 14 aa, Staphylococcus
SPTCTKEDVAAAQA

SEQ ID NO: 1985867 - protein, 6 aa, Staphylococcus
SPTDGE

SEQ ID NO: 1985868 - protein, 8 aa, Staphylococcus
SPTENIND

SEQ ID NO: 1985869 - protein, 6 aa, Staphylococcus
SPTEPV

SEQ ID NO: 1985870 - protein, 6 aa, Staphylococcus
SPTFPQ

SEQ ID NO: 1985871 - protein, 5 aa, Staphylococcus
SPTFQ

SEQ ID NO: 1985872 - protein, 14 aa, Staphylococcus
SPTHQRTQNFLSRV

SEQ ID NO: 1985873 - protein, 4 aa, Staphylococcus
SPTI

SEQ ID NO: 1985874 - protein, 6 aa, Staphylococcus
SPTIKD

SEQ ID NO: 1985875 - protein, 6 aa, Staphylococcus
SPTKGE

SEQ ID NO: 1985876 - protein, 8 aa, Staphylococcus
SPTKNEDV

SEQ ID NO: 1985877 - protein, 8 aa, Staphylococcus
SPTKTAYP

SEQ ID NO: 1985878 - protein, 5 aa, Staphylococcus
SPTNQ

SEQ ID NO: 1985879 - protein, 13 aa, Staphylococcus
SPTPLAVTDENNR

SEQ ID NO: 1985880 - protein, 8 aa, Staphylococcus
SPTTNEQV

SEQ ID NO: 1985881 - protein, 8 aa, Staphylococcus
SPTVGVTD

SEQ ID NO: 1985882 - protein, 5 aa, Staphylococcus
SPVAG

SEQ ID NO: 1985883 - protein, 6 aa, Staphylococcus
SPVERD

SEQ ID NO: 1985884 - protein, 11 aa, Staphylococcus
SPVHKTSQELD

SEQ ID NO: 1985885 - protein, 5 aa, Staphylococcus
SPVNA

SEQ ID NO: 1985886 - protein, 5 aa, Staphylococcus
SPVNI

SEQ ID NO: 1985887 - protein, 6 aa, Staphylococcus
SPVPVG

SEQ ID NO: 1985888 - protein, 11 aa, Staphylococcus
SPVQGSEQGGI

SEQ ID NO: 1985889 - protein, 4 aa, Staphylococcus
SPWA

SEQ ID NO: 1985890 - protein, 5 aa, Staphylococcus
SPWDE

SEQ ID NO: 1985891 - protein, 6 aa, Staphylococcus
SPWDEE

SEQ ID NO: 1985892 - protein, 6 aa, Staphylococcus
SPWDQG

SEQ ID NO: 1985893 - protein, 5 aa, Staphylococcus
SPYAS

SEQ ID NO: 1985894 - protein, 6 aa, Staphylococcus
SPYENQ

SEQ ID NO: 1985895 - protein, 5 aa, Staphylococcus
SPYET

SEQ ID NO: 1985896 - protein, 17 aa, Staphylococcus
SPYGSSSALTDADFPQT

SEQ ID NO: 1985897 - protein, 11 aa, Staphylococcus
SPYKDNQAQDE

SEQ ID NO: 1985898 - protein, 8 aa, Staphylococcus
SPYNIEGG

SEQ ID NO: 1985899 - protein, 5 aa, Staphylococcus
SPYPV

SEQ ID NO: 1985900 - protein, 6 aa, Staphylococcus
SPYSYE

SEQ ID NO: 1985901 - protein, 10 aa, Staphylococcus
SPYTTRYSEQ

SEQ ID NO: 1985902 - protein, 4 aa, Staphylococcus
SPYV

SEQ ID NO: 1985903 - protein, 6 aa, Staphylococcus
SQADYY

SEQ ID NO: 1985904 - protein, 7 aa, Staphylococcus
SQAEEAK

SEQ ID NO: 1985905 - protein, 9 aa, Staphylococcus
SQAEENNVS

SEQ ID NO: 1985906 - protein, 8 aa, Staphylococcus
SQAKQAGH

SEQ ID NO: 1985907 - protein, 9 aa, Staphylococcus
SQAKQAGQY

SEQ ID NO: 1985908 - protein, 4 aa, Staphylococcus
SQAM

SEQ ID NO: 1985909 - protein, 8 aa, Staphylococcus
SQANSGGA

SEQ ID NO: 1985910 - protein, 6 aa, Staphylococcus
SQAPSE

SEQ ID NO: 1985911 - protein, 37 aa, Staphylococcus
SQAPSVSQGPSSTSNNNAQQDSQSTDTQNEENAIKSP

SEQ ID NO: 1985912 - protein, 6 aa, Staphylococcus
SQAQAG

SEQ ID NO: 1985913 - protein, 5 aa, Staphylococcus
SQAQL

SEQ ID NO: 1985914 - protein, 8 aa, Staphylococcus
SQARASEK

SEQ ID NO: 1985915 - protein, 8 aa, Staphylococcus
SQARDLQQ

SEQ ID NO: 1985916 - protein, 7 aa, Staphylococcus
SQARNTI

SEQ ID NO: 1985917 - protein, 6 aa, Staphylococcus
SQAYQS

SEQ ID NO: 1985918 - protein, 14 aa, Staphylococcus
SQCDNSNPSPANWK

SEQ ID NO: 1985919 - protein, 7 aa, Staphylococcus
SQCREDA

SEQ ID NO: 1985920 - protein, 5 aa, Staphylococcus
SQCTL

SEQ ID NO: 1985921 - protein, 7 aa, Staphylococcus
SQDAITP

SEQ ID NO: 1985922 - protein, 6 aa, Staphylococcus
SQDAQL

SEQ ID NO: 1985923 - protein, 8 aa, Staphylococcus
SQDASPTV

SEQ ID NO: 1985924 - protein, 4 aa, Staphylococcus
SQDD

SEQ ID NO: 1985925 - protein, 8 aa, Staphylococcus
SQDDETLD

SEQ ID NO: 1985926 - protein, 6 aa, Staphylococcus
SQDDSL

SEQ ID NO: 1985927 - protein, 6 aa, Staphylococcus
SQDEDG

SEQ ID NO: 1985928 - protein, 13 aa, Staphylococcus
SQDEETAKRYGLR

SEQ ID NO: 1985929 - protein, 9 aa, Staphylococcus
SQDENGNLN

SEQ ID NO: 1985930 - protein, 10 aa, Staphylococcus
SQDFTSTNDE

SEQ ID NO: 1985931 - protein, 15 aa, Staphylococcus
SQDHSKQLTNQAQQN

SEQ ID NO: 1985932 - protein, 10 aa, Staphylococcus
SQDKEGNINA

SEQ ID NO: 1985933 - protein, 9 aa, Staphylococcus
SQDLSAVDK

SEQ ID NO: 1985934 - protein, 6 aa, Staphylococcus
SQDPYY

SEQ ID NO: 1985935 - protein, 9 aa, Staphylococcus
SQDRKDIGI

SEQ ID NO: 1985936 - protein, 5 aa, Staphylococcus
SQDSM

SEQ ID NO: 1985937 - protein, 11 aa, Staphylococcus
SQDSNAITGNI

SEQ ID NO: 1985938 - protein, 5 aa, Staphylococcus
SQDSQ

SEQ ID NO: 1985939 - protein, 6 aa, Staphylococcus
SQDTAS

SEQ ID NO: 1985940 - protein, 8 aa, Staphylococcus
SQDTTFSS

SEQ ID NO: 1985941 - protein, 7 aa, Staphylococcus
SQDTTYH

SEQ ID NO: 1985942 - protein, 4 aa, Staphylococcus
SQDV

SEQ ID NO: 1985943 - protein, 5 aa, Staphylococcus
SQDVP

SEQ ID NO: 1985944 - protein, 9 aa, Staphylococcus
SQEAAYRDP

SEQ ID NO: 1985945 - protein, 10 aa, Staphylococcus
SQEEAMKRAE

SEQ ID NO: 1985946 - protein, 5 aa, Staphylococcus
SQEEI

SEQ ID NO: 1985947 - protein, 6 aa, Staphylococcus
SQEELE

SEQ ID NO: 1985948 - protein, 16 aa, Staphylococcus
SQEESDEIIEYLNQVI

SEQ ID NO: 1985949 - protein, 16 aa, Staphylococcus
SQEESEEIIEYLNQVI

SEQ ID NO: 1985950 - protein, 10 aa, Staphylococcus
SQEEWAQTQA

SEQ ID NO: 1985951 - protein, 14 aa, Staphylococcus
SQEGRLNEAGGPQY

SEQ ID NO: 1985952 - protein, 13 aa, Staphylococcus
SQEGVEGSKDERT

SEQ ID NO: 1985953 - protein, 5 aa, Staphylococcus
SQEIN

SEQ ID NO: 1985954 - protein, 4 aa, Staphylococcus
SQEK

SEQ ID NO: 1985955 - protein, 11 aa, Staphylococcus
SQEKKDKKARE

SEQ ID NO: 1985956 - protein, 11 aa, Staphylococcus
SQEKKEKKAKE

SEQ ID NO: 1985957 - protein, 6 aa, Staphylococcus
SQELQR

SEQ ID NO: 1985958 - protein, 5 aa, Staphylococcus
SQEND

SEQ ID NO: 1985959 - protein, 10 aa, Staphylococcus
SQENEKSLGN

SEQ ID NO: 1985960 - protein, 9 aa, Staphylococcus
SQENPTIAP

SEQ ID NO: 1985961 - protein, 5 aa, Staphylococcus
SQENS

SEQ ID NO: 1985962 - protein, 4 aa, Staphylococcus
SQEQ

SEQ ID NO: 1985963 - protein, 6 aa, Staphylococcus
SQEQID

SEQ ID NO: 1985964 - protein, 11 aa, Staphylococcus
SQEQKDNLTKK

SEQ ID NO: 1985965 - protein, 12 aa, Staphylococcus
SQFEGQDSITRP

SEQ ID NO: 1985966 - protein, 13 aa, Staphylococcus
SQFEHQDGYQYES

SEQ ID NO: 1985967 - protein, 14 aa, Staphylococcus
SQFQPQVGGAPTNV

SEQ ID NO: 1985968 - protein, 8 aa, Staphylococcus
SQFQSSRR

SEQ ID NO: 1985969 - protein, 5 aa, Staphylococcus
SQGAC

SEQ ID NO: 1985970 - protein, 6 aa, Staphylococcus
SQGDGE

SEQ ID NO: 1985971 - protein, 5 aa, Staphylococcus
SQGDL

SEQ ID NO: 1985972 - protein, 12 aa, Staphylococcus
SQGETEEKQAEL

SEQ ID NO: 1985973 - protein, 4 aa, Staphylococcus
SQGF

SEQ ID NO: 1985974 - protein, 15 aa, Staphylococcus
SQGHAHAQNLKDNGY

SEQ ID NO: 1985975 - protein, 7 aa, Staphylococcus
SQGHVPG

SEQ ID NO: 1985976 - protein, 5 aa, Staphylococcus
SQGRA

SEQ ID NO: 1985977 - protein, 8 aa, Staphylococcus
SQGRNTRS

SEQ ID NO: 1985978 - protein, 6 aa, Staphylococcus
SQGVPG

SEQ ID NO: 1985979 - protein, 27 aa, Staphylococcus
SQGVSASGQTQSPKKPVRSQQRSKNAF

SEQ ID NO: 1985980 - protein, 4 aa, Staphylococcus
SQGY

SEQ ID NO: 1985981 - protein, 6 aa, Staphylococcus
SQGYKT

SEQ ID NO: 1985982 - protein, 6 aa, Staphylococcus
SQHIKG

SEQ ID NO: 1985983 - protein, 6 aa, Staphylococcus
SQHNAK

SEQ ID NO: 1985984 - protein, 5 aa, Staphylococcus
SQHPE

SEQ ID NO: 1985985 - protein, 21 aa, Staphylococcus
SQHPEARAEDFNNAVKDPTIK

SEQ ID NO: 1985986 - protein, 7 aa, Staphylococcus
SQHSTNE

SEQ ID NO: 1985987 - protein, 8 aa, Staphylococcus
SQIDDTTG

SEQ ID NO: 1985988 - protein, 11 aa, Staphylococcus
SQIDKENNVEV

SEQ ID NO: 1985989 - protein, 8 aa, Staphylococcus
SQIDPKRD

SEQ ID NO: 1985990 - protein, 9 aa, Staphylococcus
SQIDPKRDV

SEQ ID NO: 1985991 - protein, 5 aa, Staphylococcus
SQIED

SEQ ID NO: 1985992 - protein, 12 aa, Staphylococcus
SQIEERRQLNIE

SEQ ID NO: 1985993 - protein, 16 aa, Staphylococcus
SQIEETNSDFDREKLQ

SEQ ID NO: 1985994 - protein, 6 aa, Staphylococcus
SQIEVT

SEQ ID NO: 1985995 - protein, 13 aa, Staphylococcus
SQIGKTAGGKGLN

SEQ ID NO: 1985996 - protein, 5 aa, Staphylococcus
SQIGQ

SEQ ID NO: 1985997 - protein, 5 aa, Staphylococcus
SQIGT

SEQ ID NO: 1985998 - protein, 12 aa, Staphylococcus
SQIKERRLLNIE

SEQ ID NO: 1985999 - protein, 4 aa, Staphylococcus
SQIN

SEQ ID NO: 1986000 - protein, 5 aa, Staphylococcus
SQINR

SEQ ID NO: 1986001 - protein, 5 aa, Staphylococcus
SQIPS

SEQ ID NO: 1986002 - protein, 13 aa, Staphylococcus
SQIPVGKDKDNKA

SEQ ID NO: 1986003 - protein, 13 aa, Staphylococcus
SQIPVGKNNENKV

SEQ ID NO: 1986004 - protein, 8 aa, Staphylococcus
SQIQEGQN

SEQ ID NO: 1986005 - protein, 22 aa, Staphylococcus
SQIQEQEEARDQLNQQHEELKQ

SEQ ID NO: 1986006 - protein, 6 aa, Staphylococcus
SQIQPG

SEQ ID NO: 1986007 - protein, 13 aa, Staphylococcus
SQIRKMYNEFHPR

SEQ ID NO: 1986008 - protein, 13 aa, Staphylococcus
SQIRQMYNQFHPR

SEQ ID NO: 1986009 - protein, 6 aa, Staphylococcus
SQIRQQ

SEQ ID NO: 1986010 - protein, 13 aa, Staphylococcus
SQISSNDRGSLNS

SEQ ID NO: 1986011 - protein, 12 aa, Staphylococcus
SQIYNTQKNGQI

SEQ ID NO: 1986012 - protein, 11 aa, Staphylococcus
SQKAPEGESYQ

SEQ ID NO: 1986013 - protein, 9 aa, Staphylococcus
SQKDKEGLS

SEQ ID NO: 1986014 - protein, 8 aa, Staphylococcus
SQKEKEGL

SEQ ID NO: 1986015 - protein, 10 aa, Staphylococcus
SQKEYETTKR

SEQ ID NO: 1986016 - protein, 15 aa, Staphylococcus
SQKGATQAPKNLREK

SEQ ID NO: 1986017 - protein, 10 aa, Staphylococcus
SQKGYSGQQI

SEQ ID NO: 1986018 - protein, 5 aa, Staphylococcus
SQKID

SEQ ID NO: 1986019 - protein, 7 aa, Staphylococcus
SQKLNQL

SEQ ID NO: 1986020 - protein, 6 aa, Staphylococcus
SQKLQQ

SEQ ID NO: 1986021 - protein, 7 aa, Staphylococcus
SQKLTDS

SEQ ID NO: 1986022 - protein, 8 aa, Staphylococcus
SQKNKDGF

SEQ ID NO: 1986023 - protein, 6 aa, Staphylococcus
SQKQIK

SEQ ID NO: 1986024 - protein, 23 aa, Staphylococcus
SQKQYSVKVSDNDAKIQERRVKL

SEQ ID NO: 1986025 - protein, 7 aa, Staphylococcus
SQKSNQI

SEQ ID NO: 1986026 - protein, 12 aa, Staphylococcus
SQKVENKNEIAQ

SEQ ID NO: 1986027 - protein, 9 aa, Staphylococcus
SQKWPGTKT

SEQ ID NO: 1986028 - protein, 13 aa, Staphylococcus
SQKWQDDKALNRR

SEQ ID NO: 1986029 - protein, 7 aa, Staphylococcus
SQLARPK

SEQ ID NO: 1986030 - protein, 4 aa, Staphylococcus
SQLD

SEQ ID NO: 1986031 - protein, 17 aa, Staphylococcus
SQLDATSLKPFEAFVAE

SEQ ID NO: 1986032 - protein, 5 aa, Staphylococcus
SQLDE

SEQ ID NO: 1986033 - protein, 5 aa, Staphylococcus
SQLDS

SEQ ID NO: 1986034 - protein, 6 aa, Staphylococcus
SQLEQQ

SEQ ID NO: 1986035 - protein, 8 aa, Staphylococcus
SQLESALA

SEQ ID NO: 1986036 - protein, 7 aa, Staphylococcus
SQLGEGG

SEQ ID NO: 1986037 - protein, 5 aa, Staphylococcus
SQLGK

SEQ ID NO: 1986038 - protein, 5 aa, Staphylococcus
SQLGR

SEQ ID NO: 1986039 - protein, 4 aa, Staphylococcus
SQLI

SEQ ID NO: 1986040 - protein, 10 aa, Staphylococcus
SQLKQDTSKI

SEQ ID NO: 1986041 - protein, 5 aa, Staphylococcus
SQLPE

SEQ ID NO: 1986042 - protein, 13 aa, Staphylococcus
SQLPEPYGWHITQ

SEQ ID NO: 1986043 - protein, 13 aa, Staphylococcus
SQLPIGKDRDGKA

SEQ ID NO: 1986044 - protein, 10 aa, Staphylococcus
SQLPKDSMDA

SEQ ID NO: 1986045 - protein, 32 aa, Staphylococcus
SQLPLKPQTIDKPIGKDKFHSNRRRVSPTGQH

SEQ ID NO: 1986046 - protein, 5 aa, Staphylococcus
SQLPQ

SEQ ID NO: 1986047 - protein, 14 aa, Staphylococcus
SQLQQENNLDEEEV

SEQ ID NO: 1986048 - protein, 6 aa, Staphylococcus
SQLRDS

SEQ ID NO: 1986049 - protein, 4 aa, Staphylococcus
SQLS

SEQ ID NO: 1986050 - protein, 7 aa, Staphylococcus
SQLSADD

SEQ ID NO: 1986051 - protein, 8 aa, Staphylococcus
SQLSGGQL

SEQ ID NO: 1986052 - protein, 9 aa, Staphylococcus
SQLSNEQGV

SEQ ID NO: 1986053 - protein, 5 aa, Staphylococcus
SQLSP

SEQ ID NO: 1986054 - protein, 15 aa, Staphylococcus
SQLSPGMKARTKYKQ

SEQ ID NO: 1986055 - protein, 9 aa, Staphylococcus
SQLTDEEKI

SEQ ID NO: 1986056 - protein, 7 aa, Staphylococcus
SQLTNTQ

SEQ ID NO: 1986057 - protein, 7 aa, Staphylococcus
SQLTPAS

SEQ ID NO: 1986058 - protein, 15 aa, Staphylococcus
SQLTPEPDCGETSYV

SEQ ID NO: 1986059 - protein, 7 aa, Staphylococcus
SQLTPES

SEQ ID NO: 1986060 - protein, 8 aa, Staphylococcus
SQLTPESY

SEQ ID NO: 1986061 - protein, 11 aa, Staphylococcus
SQLTPSVNNQY

SEQ ID NO: 1986062 - protein, 4 aa, Staphylococcus
SQME

SEQ ID NO: 1986063 - protein, 6 aa, Staphylococcus
SQMPPN

SEQ ID NO: 1986064 - protein, 10 aa, Staphylococcus
SQMQDQGLDQ

SEQ ID NO: 1986065 - protein, 5 aa, Staphylococcus
SQMTQ

SEQ ID NO: 1986066 - protein, 4 aa, Staphylococcus
SQNA

SEQ ID NO: 1986067 - protein, 7 aa, Staphylococcus
SQNEENT

SEQ ID NO: 1986068 - protein, 10 aa, Staphylococcus
SQNEGSDPAA

SEQ ID NO: 1986069 - protein, 11 aa, Staphylococcus
SQNEPVGRRSL

SEQ ID NO: 1986070 - protein, 7 aa, Staphylococcus
SQNEQIQ

SEQ ID NO: 1986071 - protein, 6 aa, Staphylococcus
SQNIDA

SEQ ID NO: 1986072 - protein, 15 aa, Staphylococcus
SQNIDKTVNKLKHYF

SEQ ID NO: 1986073 - protein, 4 aa, Staphylococcus
SQNK

SEQ ID NO: 1986074 - protein, 8 aa, Staphylococcus
SQNKEDKY

SEQ ID NO: 1986075 - protein, 6 aa, Staphylococcus
SQNKGD

SEQ ID NO: 1986076 - protein, 6 aa, Staphylococcus
SQNKHR

SEQ ID NO: 1986077 - protein, 9 aa, Staphylococcus
SQNKIANPL

SEQ ID NO: 1986078 - protein, 4 aa, Staphylococcus
SQNN

SEQ ID NO: 1986079 - protein, 7 aa, Staphylococcus
SQNNESL

SEQ ID NO: 1986080 - protein, 5 aa, Staphylococcus
SQNNP

SEQ ID NO: 1986081 - protein, 11 aa, Staphylococcus
SQNQPVGRRSL

SEQ ID NO: 1986082 - protein, 7 aa, Staphylococcus
SQNRGDV

SEQ ID NO: 1986083 - protein, 10 aa, Staphylococcus
SQNRSKQEKV

SEQ ID NO: 1986084 - protein, 8 aa, Staphylococcus
SQNSAGSL

SEQ ID NO: 1986085 - protein, 7 aa, Staphylococcus
SQNTLEK

SEQ ID NO: 1986086 - protein, 6 aa, Staphylococcus
SQNTPV

SEQ ID NO: 1986087 - protein, 8 aa, Staphylococcus
SQNTRYHQ

SEQ ID NO: 1986088 - protein, 15 aa, Staphylococcus
SQNTSDNEEDLPQAK

SEQ ID NO: 1986089 - protein, 13 aa, Staphylococcus
SQNVDNKNEIAQV

SEQ ID NO: 1986090 - protein, 11 aa, Staphylococcus
SQNVPAYERER

SEQ ID NO: 1986091 - protein, 9 aa, Staphylococcus
SQNVRTNYE

SEQ ID NO: 1986092 - protein, 14 aa, Staphylococcus
SQPAETEEAQKEQY

SEQ ID NO: 1986093 - protein, 6 aa, Staphylococcus
SQPDQL

SEQ ID NO: 1986094 - protein, 7 aa, Staphylococcus
SQPEAEL

SEQ ID NO: 1986095 - protein, 13 aa, Staphylococcus
SQPEEMTGVSLIE

SEQ ID NO: 1986096 - protein, 7 aa, Staphylococcus
SQPEQLS

SEQ ID NO: 1986097 - protein, 5 aa, Staphylococcus
SQPEW

SEQ ID NO: 1986098 - protein, 4 aa, Staphylococcus
SQPF

SEQ ID NO: 1986099 - protein, 7 aa, Staphylococcus
SQPFGRK

SEQ ID NO: 1986100 - protein, 5 aa, Staphylococcus
SQPFV

SEQ ID NO: 1986101 - protein, 12 aa, Staphylococcus
SQPGNPLNRTTL

SEQ ID NO: 1986102 - protein, 12 aa, Staphylococcus
SQPGYSEQDPEE

SEQ ID NO: 1986103 - protein, 7 aa, Staphylococcus
SQPIAPG

SEQ ID NO: 1986104 - protein, 7 aa, Staphylococcus
SQPLGNA

SEQ ID NO: 1986105 - protein, 11 aa, Staphylococcus
SQPLGNAIGNG

SEQ ID NO: 1986106 - protein, 12 aa, Staphylococcus
SQPNKQDIESSQ

SEQ ID NO: 1986107 - protein, 5 aa, Staphylococcus
SQPTE

SEQ ID NO: 1986108 - protein, 12 aa, Staphylococcus
SQPYKNEGQQDQ

SEQ ID NO: 1986109 - protein, 6 aa, Staphylococcus
SQQADA

SEQ ID NO: 1986110 - protein, 11 aa, Staphylococcus
SQQAKSANPDI

SEQ ID NO: 1986111 - protein, 11 aa, Staphylococcus
SQQALQDEELK

SEQ ID NO: 1986112 - protein, 12 aa, Staphylococcus
SQQDLDTLKQQL

SEQ ID NO: 1986113 - protein, 6 aa, Staphylococcus
SQQEID

SEQ ID NO: 1986114 - protein, 8 aa, Staphylococcus
SQQGGMRR

SEQ ID NO: 1986115 - protein, 15 aa, Staphylococcus
SQQGIENLTDEEAAD

SEQ ID NO: 1986116 - protein, 12 aa, Staphylococcus
SQQGKRKANEVG

SEQ ID NO: 1986117 - protein, 4 aa, Staphylococcus
SQQL

SEQ ID NO: 1986118 - protein, 7 aa, Staphylococcus
SQQLDQQ

SEQ ID NO: 1986119 - protein, 4 aa, Staphylococcus
SQQM

SEQ ID NO: 1986120 - protein, 9 aa, Staphylococcus
SQQNNATGN

SEQ ID NO: 1986121 - protein, 8 aa, Staphylococcus
SQQNPLQE

SEQ ID NO: 1986122 - protein, 4 aa, Staphylococcus
SQQQ

SEQ ID NO: 1986123 - protein, 9 aa, Staphylococcus
SQQQEEGKF

SEQ ID NO: 1986124 - protein, 10 aa, Staphylococcus
SQQRFKQRED

SEQ ID NO: 1986125 - protein, 6 aa, Staphylococcus
SQQRGT

SEQ ID NO: 1986126 - protein, 5 aa, Staphylococcus
SQQRR

SEQ ID NO: 1986127 - protein, 14 aa, Staphylococcus
SQQRVGGIGTGGGM

SEQ ID NO: 1986128 - protein, 13 aa, Staphylococcus
SQQTLQDDKKKAE

SEQ ID NO: 1986129 - protein, 9 aa, Staphylococcus
SQQTRYKQQ

SEQ ID NO: 1986130 - protein, 16 aa, Staphylococcus
SQQVQSVKEDENDNED

SEQ ID NO: 1986131 - protein, 7 aa, Staphylococcus
SQQYNTL

SEQ ID NO: 1986132 - protein, 10 aa, Staphylococcus
SQRADITLSE

SEQ ID NO: 1986133 - protein, 11 aa, Staphylococcus
SQRETIKTNFP

SEQ ID NO: 1986134 - protein, 4 aa, Staphylococcus
SQRK

SEQ ID NO: 1986135 - protein, 16 aa, Staphylococcus
SQRKKKLTSVDKENVL

SEQ ID NO: 1986136 - protein, 7 aa, Staphylococcus
SQRLTKA

SEQ ID NO: 1986137 - protein, 7 aa, Staphylococcus
SQRNNRE

SEQ ID NO: 1986138 - protein, 8 aa, Staphylococcus
SQRPQYVD

SEQ ID NO: 1986139 - protein, 4 aa, Staphylococcus
SQRQ

SEQ ID NO: 1986140 - protein, 12 aa, Staphylococcus
SQRQESHDRPKS

SEQ ID NO: 1986141 - protein, 14 aa, Staphylococcus
SQRSAKLAATQGMG

SEQ ID NO: 1986142 - protein, 7 aa, Staphylococcus
SQRSNDL

SEQ ID NO: 1986143 - protein, 9 aa, Staphylococcus
SQRYPQPTL

SEQ ID NO: 1986144 - protein, 14 aa, Staphylococcus
SQSADAKKTKYNAT

SEQ ID NO: 1986145 - protein, 13 aa, Staphylococcus
SQSAEAKSTQYNA

SEQ ID NO: 1986146 - protein, 13 aa, Staphylococcus
SQSALQDEEKQKE

SEQ ID NO: 1986147 - protein, 5 aa, Staphylococcus
SQSDA

SEQ ID NO: 1986148 - protein, 6 aa, Staphylococcus
SQSEGF

SEQ ID NO: 1986149 - protein, 4 aa, Staphylococcus
SQSF

SEQ ID NO: 1986150 - protein, 8 aa, Staphylococcus
SQSGQPIE

SEQ ID NO: 1986151 - protein, 5 aa, Staphylococcus
SQSHP

SEQ ID NO: 1986152 - protein, 24 aa, Staphylococcus
SQSIPDGTFPTLNSPNPEDESAFE

SEQ ID NO: 1986153 - protein, 9 aa, Staphylococcus
SQSITSDYQ

SEQ ID NO: 1986154 - protein, 8 aa, Staphylococcus
SQSKEDEY

SEQ ID NO: 1986155 - protein, 8 aa, Staphylococcus
SQSKEEEY

SEQ ID NO: 1986156 - protein, 7 aa, Staphylococcus
SQSKGDV

SEQ ID NO: 1986157 - protein, 7 aa, Staphylococcus
SQSKREH

SEQ ID NO: 1986158 - protein, 7 aa, Staphylococcus
SQSKYYG

SEQ ID NO: 1986159 - protein, 4 aa, Staphylococcus
SQSL

SEQ ID NO: 1986160 - protein, 14 aa, Staphylococcus
SQSLAKQTKDIIET

SEQ ID NO: 1986161 - protein, 7 aa, Staphylococcus
SQSLEYD

SEQ ID NO: 1986162 - protein, 5 aa, Staphylococcus
SQSMR

SEQ ID NO: 1986163 - protein, 6 aa, Staphylococcus
SQSNEF

SEQ ID NO: 1986164 - protein, 11 aa, Staphylococcus
SQSNHKGEAEL

SEQ ID NO: 1986165 - protein, 9 aa, Staphylococcus
SQSNPPNAA

SEQ ID NO: 1986166 - protein, 9 aa, Staphylococcus
SQSNSFDKA

SEQ ID NO: 1986167 - protein, 5 aa, Staphylococcus
SQSQL

SEQ ID NO: 1986168 - protein, 10 aa, Staphylococcus
SQSQSEDQTL

SEQ ID NO: 1986169 - protein, 4 aa, Staphylococcus
SQSS

SEQ ID NO: 1986170 - protein, 7 aa, Staphylococcus
SQSSGDI

SEQ ID NO: 1986171 - protein, 7 aa, Staphylococcus
SQSSIPI

SEQ ID NO: 1986172 - protein, 9 aa, Staphylococcus
SQSSPVGTQ

SEQ ID NO: 1986173 - protein, 7 aa, Staphylococcus
SQSTIGA

SEQ ID NO: 1986174 - protein, 10 aa, Staphylococcus
SQSVNEHRTD

SEQ ID NO: 1986175 - protein, 9 aa, Staphylococcus
SQSYQEATS

SEQ ID NO: 1986176 - protein, 10 aa, Staphylococcus
SQSYSTLPYK

SEQ ID NO: 1986177 - protein, 6 aa, Staphylococcus
SQTEDK

SEQ ID NO: 1986178 - protein, 8 aa, Staphylococcus
SQTEDTDR

SEQ ID NO: 1986179 - protein, 7 aa, Staphylococcus
SQTHPES

SEQ ID NO: 1986180 - protein, 5 aa, Staphylococcus
SQTID

SEQ ID NO: 1986181 - protein, 12 aa, Staphylococcus
SQTKGEINYQGE

SEQ ID NO: 1986182 - protein, 6 aa, Staphylococcus
SQTLQE

SEQ ID NO: 1986183 - protein, 4 aa, Staphylococcus
SQTM

SEQ ID NO: 1986184 - protein, 13 aa, Staphylococcus
SQTREGKYEGEER

SEQ ID NO: 1986185 - protein, 14 aa, Staphylococcus
SQTRTKDNHGMTKN

SEQ ID NO: 1986186 - protein, 6 aa, Staphylococcus
SQTSCP

SEQ ID NO: 1986187 - protein, 8 aa, Staphylococcus
SQTSCPHR

SEQ ID NO: 1986188 - protein, 10 aa, Staphylococcus
SQTTSPITLP

SEQ ID NO: 1986189 - protein, 11 aa, Staphylococcus
SQTTTFQEQGF

SEQ ID NO: 1986190 - protein, 4 aa, Staphylococcus
SQTV

SEQ ID NO: 1986191 - protein, 4 aa, Staphylococcus
SQTY

SEQ ID NO: 1986192 - protein, 8 aa, Staphylococcus
SQVAGNHD

SEQ ID NO: 1986193 - protein, 7 aa, Staphylococcus
SQVDPKS

SEQ ID NO: 1986194 - protein, 6 aa, Staphylococcus
SQVNRD

SEQ ID NO: 1986195 - protein, 20 aa, Staphylococcus
SQVPGTGFEGRVTKKDIETY

SEQ ID NO: 1986196 - protein, 5 aa, Staphylococcus
SQWAG

SEQ ID NO: 1986197 - protein, 5 aa, Staphylococcus
SQWRM

SEQ ID NO: 1986198 - protein, 8 aa, Staphylococcus
SQYASPSM

SEQ ID NO: 1986199 - protein, 4 aa, Staphylococcus
SQYD

SEQ ID NO: 1986200 - protein, 6 aa, Staphylococcus
SQYDDI

SEQ ID NO: 1986201 - protein, 5 aa, Staphylococcus
SQYEA

SEQ ID NO: 1986202 - protein, 14 aa, Staphylococcus
SQYEFDDKSTLTSG

SEQ ID NO: 1986203 - protein, 8 aa, Staphylococcus
SQYENNEN

SEQ ID NO: 1986204 - protein, 6 aa, Staphylococcus
SQYGQY

SEQ ID NO: 1986205 - protein, 6 aa, Staphylococcus
SQYGSV

SEQ ID NO: 1986206 - protein, 10 aa, Staphylococcus
SQYKKRDSSY

SEQ ID NO: 1986207 - protein, 9 aa, Staphylococcus
SQYNQHNNQ

SEQ ID NO: 1986208 - protein, 4 aa, Staphylococcus
SQYP

SEQ ID NO: 1986209 - protein, 5 aa, Staphylococcus
SQYPP

SEQ ID NO: 1986210 - protein, 12 aa, Staphylococcus
SRAARNLKSQQL

SEQ ID NO: 1986211 - protein, 12 aa, Staphylococcus
SRAFDPSSPVGK

SEQ ID NO: 1986212 - protein, 5 aa, Staphylococcus
SRAGE

SEQ ID NO: 1986213 - protein, 7 aa, Staphylococcus
SRAKHEA

SEQ ID NO: 1986214 - protein, 15 aa, Staphylococcus
SRAKSEAEKSFGNSE

SEQ ID NO: 1986215 - protein, 5 aa, Staphylococcus
SRAQH

SEQ ID NO: 1986216 - protein, 5 aa, Staphylococcus
SRATS

SEQ ID NO: 1986217 - protein, 14 aa, Staphylococcus
SRDAERGRQAADEL

SEQ ID NO: 1986218 - protein, 7 aa, Staphylococcus
SRDDAGK

SEQ ID NO: 1986219 - protein, 9 aa, Staphylococcus
SRDDVQRGQ

SEQ ID NO: 1986220 - protein, 8 aa, Staphylococcus
SRDEEDKL

SEQ ID NO: 1986221 - protein, 8 aa, Staphylococcus
SRDEHDER

SEQ ID NO: 1986222 - protein, 10 aa, Staphylococcus
SRDENDKDKV

SEQ ID NO: 1986223 - protein, 8 aa, Staphylococcus
SRDEQDEF

SEQ ID NO: 1986224 - protein, 10 aa, Staphylococcus
SRDESDKDKV

SEQ ID NO: 1986225 - protein, 11 aa, Staphylococcus
SRDGKSMTDSP

SEQ ID NO: 1986226 - protein, 10 aa, Staphylococcus
SRDKSGTDVN

SEQ ID NO: 1986227 - protein, 5 aa, Staphylococcus
SRDNI

SEQ ID NO: 1986228 - protein, 4 aa, Staphylococcus
SRDQ

SEQ ID NO: 1986229 - protein, 4 aa, Staphylococcus
SRDT

SEQ ID NO: 1986230 - protein, 6 aa, Staphylococcus
SRDTDH

SEQ ID NO: 1986231 - protein, 7 aa, Staphylococcus
SRDTEEK

SEQ ID NO: 1986232 - protein, 6 aa, Staphylococcus
SRDTEH

SEQ ID NO: 1986233 - protein, 7 aa, Staphylococcus
SRDTGEK

SEQ ID NO: 1986234 - protein, 14 aa, Staphylococcus
SREALKSGNEGIKR

SEQ ID NO: 1986235 - protein, 7 aa, Staphylococcus
SREATHY

SEQ ID NO: 1986236 - protein, 10 aa, Staphylococcus
SREDANTDLS

SEQ ID NO: 1986237 - protein, 6 aa, Staphylococcus
SREDKL

SEQ ID NO: 1986238 - protein, 7 aa, Staphylococcus
SREDKLN

SEQ ID NO: 1986239 - protein, 7 aa, Staphylococcus
SREDNLQ

SEQ ID NO: 1986240 - protein, 13 aa, Staphylococcus
SREDSSQGQGQMS

SEQ ID NO: 1986241 - protein, 7 aa, Staphylococcus
SREEANE

SEQ ID NO: 1986242 - protein, 5 aa, Staphylococcus
SREEW

SEQ ID NO: 1986243 - protein, 4 aa, Staphylococcus
SREG

SEQ ID NO: 1986244 - protein, 4 aa, Staphylococcus
SREH

SEQ ID NO: 1986245 - protein, 5 aa, Staphylococcus
SREHQ

SEQ ID NO: 1986246 - protein, 4 aa, Staphylococcus
SREK

SEQ ID NO: 1986247 - protein, 10 aa, Staphylococcus
SREKEMSDPY

SEQ ID NO: 1986248 - protein, 5 aa, Staphylococcus
SREKF

SEQ ID NO: 1986249 - protein, 8 aa, Staphylococcus
SREKTPKW

SEQ ID NO: 1986250 - protein, 5 aa, Staphylococcus
SREPN

SEQ ID NO: 1986251 - protein, 7 aa, Staphylococcus
SREPNQN

SEQ ID NO: 1986252 - protein, 5 aa, Staphylococcus
SREQS

SEQ ID NO: 1986253 - protein, 9 aa, Staphylococcus
SRESEARLK

SEQ ID NO: 1986254 - protein, 10 aa, Staphylococcus
SRESEDRLKR

SEQ ID NO: 1986255 - protein, 10 aa, Staphylococcus
SRESTNLSPV

SEQ ID NO: 1986256 - protein, 14 aa, Staphylococcus
SRESTSLSGGESQR

SEQ ID NO: 1986257 - protein, 7 aa, Staphylococcus
SRETENK

SEQ ID NO: 1986258 - protein, 5 aa, Staphylococcus
SRETH

SEQ ID NO: 1986259 - protein, 8 aa, Staphylococcus
SRETREGV

SEQ ID NO: 1986260 - protein, 8 aa, Staphylococcus
SRFGEGKD

SEQ ID NO: 1986261 - protein, 16 aa, Staphylococcus
SRFKSGKETVPQYEGK

SEQ ID NO: 1986262 - protein, 17 aa, Staphylococcus
SRFTSGEYKVTSKANRV

SEQ ID NO: 1986263 - protein, 4 aa, Staphylococcus
SRGC

SEQ ID NO: 1986264 - protein, 8 aa, Staphylococcus
SRGEHTKH

SEQ ID NO: 1986265 - protein, 12 aa, Staphylococcus
SRGEHTKHPKVH

SEQ ID NO: 1986266 - protein, 4 aa, Staphylococcus
SRGG

SEQ ID NO: 1986267 - protein, 11 aa, Staphylococcus
SRGGDQSFEEK

SEQ ID NO: 1986268 - protein, 15 aa, Staphylococcus
SRGIDGGLPKRPFRP

SEQ ID NO: 1986269 - protein, 6 aa, Staphylococcus
SRGIGR

SEQ ID NO: 1986270 - protein, 19 aa, Staphylococcus
SRGKSSEIERDNHTLDDYS

SEQ ID NO: 1986271 - protein, 22 aa, Staphylococcus
SRGKSSNIDRNNHTLDDYSERI

SEQ ID NO: 1986272 - protein, 21 aa, Staphylococcus
SRGKYSRTWSGVTDTPNATVG

SEQ ID NO: 1986273 - protein, 6 aa, Staphylococcus
SRGLGT

SEQ ID NO: 1986274 - protein, 6 aa, Staphylococcus
SRGLNS

SEQ ID NO: 1986275 - protein, 14 aa, Staphylococcus
SRGLTDEPEGGKRC

SEQ ID NO: 1986276 - protein, 12 aa, Staphylococcus
SRGLTEEPEGGL

SEQ ID NO: 1986277 - protein, 16 aa, Staphylococcus
SRGMKLEEVSDALIHN

SEQ ID NO: 1986278 - protein, 5 aa, Staphylococcus
SRGPI

SEQ ID NO: 1986279 - protein, 7 aa, Staphylococcus
SRGTEKE

SEQ ID NO: 1986280 - protein, 5 aa, Staphylococcus
SRGYQ

SEQ ID NO: 1986281 - protein, 14 aa, Staphylococcus
SRHADEANAIRRRR

SEQ ID NO: 1986282 - protein, 19 aa, Staphylococcus
SRHADEANAIRRRRECENC

SEQ ID NO: 1986283 - protein, 8 aa, Staphylococcus
SRHADEVN

SEQ ID NO: 1986284 - protein, 14 aa, Staphylococcus
SRHAEDANAIRRRR

SEQ ID NO: 1986285 - protein, 9 aa, Staphylococcus
SRHDNETME

SEQ ID NO: 1986286 - protein, 12 aa, Staphylococcus
SRHEDAESELNA

SEQ ID NO: 1986287 - protein, 18 aa, Staphylococcus
SRHQKSGNFKGERKDIKK

SEQ ID NO: 1986288 - protein, 13 aa, Staphylococcus
SRIGEHYNNPSFG

SEQ ID NO: 1986289 - protein, 22 aa, Staphylococcus
SRIGTPAARMDNQIDEDIKNER

SEQ ID NO: 1986290 - protein, 22 aa, Staphylococcus
SRIGTPAARMDNQIDEDVKNER

SEQ ID NO: 1986291 - protein, 6 aa, Staphylococcus
SRINQE

SEQ ID NO: 1986292 - protein, 6 aa, Staphylococcus
SRIPTD

SEQ ID NO: 1986293 - protein, 4 aa, Staphylococcus
SRIS

SEQ ID NO: 1986294 - protein, 8 aa, Staphylococcus
SRISEDVS

SEQ ID NO: 1986295 - protein, 9 aa, Staphylococcus
SRISGVNPA

SEQ ID NO: 1986296 - protein, 4 aa, Staphylococcus
SRIT

SEQ ID NO: 1986297 - protein, 4 aa, Staphylococcus
SRIY

SEQ ID NO: 1986298 - protein, 9 aa, Staphylococcus
SRKATSYSY

SEQ ID NO: 1986299 - protein, 4 aa, Staphylococcus
SRKD

SEQ ID NO: 1986300 - protein, 41 aa, Staphylococcus
SRKERNRVGRGAATGNGKTSGRGHKGQKARSGGKVRPGFEG

SEQ ID NO: 1986301 - protein, 42 aa, Staphylococcus
SRKERNRVGRGAATGNGKTSGRGQKGQKARSGGGVRPGFEGG

SEQ ID NO: 1986302 - protein, 7 aa, Staphylococcus
SRKFSGR

SEQ ID NO: 1986303 - protein, 15 aa, Staphylococcus
SRKGLEVSAQSAKEN

SEQ ID NO: 1986304 - protein, 14 aa, Staphylococcus
SRKHEIVKKSLDCL

SEQ ID NO: 1986305 - protein, 5 aa, Staphylococcus
SRKKQ

SEQ ID NO: 1986306 - protein, 24 aa, Staphylococcus
SRKNGLEDLKKARESVDMAIQVWD

SEQ ID NO: 1986307 - protein, 11 aa, Staphylococcus
SRKNQPSNHSD

SEQ ID NO: 1986308 - protein, 12 aa, Staphylococcus
SRKNQPSNSSDY

SEQ ID NO: 1986309 - protein, 14 aa, Staphylococcus
SRKPAKAKKGTDIT

SEQ ID NO: 1986310 - protein, 8 aa, Staphylococcus
SRKPQPNG

SEQ ID NO: 1986311 - protein, 8 aa, Staphylococcus
SRKPRLPH

SEQ ID NO: 1986312 - protein, 5 aa, Staphylococcus
SRKRG

SEQ ID NO: 1986313 - protein, 8 aa, Staphylococcus
SRKRGEGV

SEQ ID NO: 1986314 - protein, 9 aa, Staphylococcus
SRKSTLYTT

SEQ ID NO: 1986315 - protein, 41 aa, Staphylococcus
SRKVRNRVGRGAATGNGKTSGRGQKGQKARSGGKVRPGFEG

SEQ ID NO: 1986316 - protein, 42 aa, Staphylococcus
SRKVRNRVGRGAATGNGKTSGRGQKGQKARSGGSVRPGFEGG

SEQ ID NO: 1986317 - protein, 6 aa, Staphylococcus
SRKYMQ

SEQ ID NO: 1986318 - protein, 15 aa, Staphylococcus
SRLARRGSGSASRSI

SEQ ID NO: 1986319 - protein, 12 aa, Staphylococcus
SRLDRPKQRLNK

SEQ ID NO: 1986320 - protein, 21 aa, Staphylococcus
SRLDTPKQPQPFATNNHKKEN

SEQ ID NO: 1986321 - protein, 12 aa, Staphylococcus
SRLDTPKQRKPQ

SEQ ID NO: 1986322 - protein, 17 aa, Staphylococcus
SRLDTPKQRNQDTTYNH

SEQ ID NO: 1986323 - protein, 24 aa, Staphylococcus
SRLDTPRQRPNENRKFNLHFPNEN

SEQ ID NO: 1986324 - protein, 18 aa, Staphylococcus
SRLENNNNIIEGDSRYAK

SEQ ID NO: 1986325 - protein, 10 aa, Staphylococcus
SRLGANANQI

SEQ ID NO: 1986326 - protein, 6 aa, Staphylococcus
SRLGLT

SEQ ID NO: 1986327 - protein, 6 aa, Staphylococcus
SRLKAN

SEQ ID NO: 1986328 - protein, 11 aa, Staphylococcus
SRLKNDEAIER

SEQ ID NO: 1986329 - protein, 11 aa, Staphylococcus
SRLRNDEAVER

SEQ ID NO: 1986330 - protein, 10 aa, Staphylococcus
SRLRNDEKVE

SEQ ID NO: 1986331 - protein, 14 aa, Staphylococcus
SRLSRNNKDSTQIE

SEQ ID NO: 1986332 - protein, 9 aa, Staphylococcus
SRNATEYSA

SEQ ID NO: 1986333 - protein, 7 aa, Staphylococcus
SRNDGTL

SEQ ID NO: 1986334 - protein, 5 aa, Staphylococcus
SRNED

SEQ ID NO: 1986335 - protein, 6 aa, Staphylococcus
SRNEEN

SEQ ID NO: 1986336 - protein, 14 aa, Staphylococcus
SRNEERGQQASKEL

SEQ ID NO: 1986337 - protein, 5 aa, Staphylococcus
SRNEG

SEQ ID NO: 1986338 - protein, 16 aa, Staphylococcus
SRNESELTLDKLKAFG

SEQ ID NO: 1986339 - protein, 4 aa, Staphylococcus
SRNG

SEQ ID NO: 1986340 - protein, 9 aa, Staphylococcus
SRNGGTRHR

SEQ ID NO: 1986341 - protein, 10 aa, Staphylococcus
SRNGGTRRRK

SEQ ID NO: 1986342 - protein, 5 aa, Staphylococcus
SRNGN

SEQ ID NO: 1986343 - protein, 6 aa, Staphylococcus
SRNIDE

SEQ ID NO: 1986344 - protein, 8 aa, Staphylococcus
SRNKNYIG

SEQ ID NO: 1986345 - protein, 6 aa, Staphylococcus
SRNPAY

SEQ ID NO: 1986346 - protein, 5 aa, Staphylococcus
SRNPI

SEQ ID NO: 1986347 - protein, 5 aa, Staphylococcus
SRNPL

SEQ ID NO: 1986348 - protein, 8 aa, Staphylococcus
SRNREKYY

SEQ ID NO: 1986349 - protein, 8 aa, Staphylococcus
SRNSEDKL

SEQ ID NO: 1986350 - protein, 8 aa, Staphylococcus
SRNVDSEQ

SEQ ID NO: 1986351 - protein, 13 aa, Staphylococcus
SRNYFNSNSRKKW

SEQ ID NO: 1986352 - protein, 8 aa, Staphylococcus
SRPAENFK

SEQ ID NO: 1986353 - protein, 5 aa, Staphylococcus
SRPDQ

SEQ ID NO: 1986354 - protein, 5 aa, Staphylococcus
SRPEE

SEQ ID NO: 1986355 - protein, 6 aa, Staphylococcus
SRPKPL

SEQ ID NO: 1986356 - protein, 9 aa, Staphylococcus
SRPLISNPV

SEQ ID NO: 1986357 - protein, 5 aa, Staphylococcus
SRPNE

SEQ ID NO: 1986358 - protein, 6 aa, Staphylococcus
SRPTNI

SEQ ID NO: 1986359 - protein, 6 aa, Staphylococcus
SRPYSA

SEQ ID NO: 1986360 - protein, 12 aa, Staphylococcus
SRPYSGLNESAI

SEQ ID NO: 1986361 - protein, 15 aa, Staphylococcus
SRPYSKLKESEIQQS

SEQ ID NO: 1986362 - protein, 15 aa, Staphylococcus
SRPYSKLSEKQIQQS

SEQ ID NO: 1986363 - protein, 14 aa, Staphylococcus
SRPYSSLKPSEIKQ

SEQ ID NO: 1986364 - protein, 17 aa, Staphylococcus
SRPYSTINESDIQQSLT

SEQ ID NO: 1986365 - protein, 8 aa, Staphylococcus
SRQAETQF

SEQ ID NO: 1986366 - protein, 6 aa, Staphylococcus
SRQAGQ

SEQ ID NO: 1986367 - protein, 8 aa, Staphylococcus
SRQATQYT

SEQ ID NO: 1986368 - protein, 4 aa, Staphylococcus
SRQD

SEQ ID NO: 1986369 - protein, 11 aa, Staphylococcus
SRQDTLDKEPL

SEQ ID NO: 1986370 - protein, 5 aa, Staphylococcus
SRQEE

SEQ ID NO: 1986371 - protein, 7 aa, Staphylococcus
SRQGNPF

SEQ ID NO: 1986372 - protein, 12 aa, Staphylococcus
SRQNQPSNASDY

SEQ ID NO: 1986373 - protein, 12 aa, Staphylococcus
SRQNQPSNSSDY

SEQ ID NO: 1986374 - protein, 8 aa, Staphylococcus
SRQVGGAP

SEQ ID NO: 1986375 - protein, 13 aa, Staphylococcus
SRQVGGAPANVAS

SEQ ID NO: 1986376 - protein, 8 aa, Staphylococcus
SRQVNTSS

SEQ ID NO: 1986377 - protein, 8 aa, Staphylococcus
SRRASGIT

SEQ ID NO: 1986378 - protein, 9 aa, Staphylococcus
SRRDEAQEF

SEQ ID NO: 1986379 - protein, 6 aa, Staphylococcus
SRREVR

SEQ ID NO: 1986380 - protein, 7 aa, Staphylococcus
SRRGQGI

SEQ ID NO: 1986381 - protein, 7 aa, Staphylococcus
SRRKDIS

SEQ ID NO: 1986382 - protein, 8 aa, Staphylococcus
SRRKDISI

SEQ ID NO: 1986383 - protein, 9 aa, Staphylococcus
SRRKQTAAK

SEQ ID NO: 1986384 - protein, 14 aa, Staphylococcus
SRRKSYGSTGQDAV

SEQ ID NO: 1986385 - protein, 9 aa, Staphylococcus
SRRNEAQEF

SEQ ID NO: 1986386 - protein, 9 aa, Staphylococcus
SRRNKNNPI

SEQ ID NO: 1986387 - protein, 41 aa, Staphylococcus; identical to SEQ ID NO: 1767048

SEQ ID NO: 1986388 - protein, 42 aa, Staphylococcus
SRRVRNRVGRGAGSGNGKTSARGQKGQKARSGGSVRPGFEGG

SEQ ID NO: 1986389 - protein, 42 aa, Staphylococcus
SRRVRNRVGRGAGSGNGKTSGRGQKGQKARSGGGVRPGFEGG

SEQ ID NO: 1986390 - protein, 9 aa, Staphylococcus
SRSAEDLKA

SEQ ID NO: 1986391 - protein, 6 aa, Staphylococcus
SRSDSP

SEQ ID NO: 1986392 - protein, 20 aa, Staphylococcus
SRSDTKQNKLDSLLLALKVL

SEQ ID NO: 1986393 - protein, 7 aa, Staphylococcus
SRSECDT

SEQ ID NO: 1986394 - protein, 13 aa, Staphylococcus
SRSECDTSVQFGP

SEQ ID NO: 1986395 - protein, 9 aa, Staphylococcus
SRSECDTTV

SEQ ID NO: 1986396 - protein, 14 aa, Staphylococcus
SRSEDRGKKAANEL

SEQ ID NO: 1986397 - protein, 4 aa, Staphylococcus
SRSF

SEQ ID NO: 1986398 - protein, 12 aa, Staphylococcus
SRSFKSFSQPKW

SEQ ID NO: 1986399 - protein, 4 aa, Staphylococcus
SRSG

SEQ ID NO: 1986400 - protein, 8 aa, Staphylococcus
SRSGVSSK

SEQ ID NO: 1986401 - protein, 7 aa, Staphylococcus
SRSIAKQ

SEQ ID NO: 1986402 - protein, 6 aa, Staphylococcus
SRSIKE

SEQ ID NO: 1986403 - protein, 5 aa, Staphylococcus
SRSKV

SEQ ID NO: 1986404 - protein, 8 aa, Staphylococcus
SRSMTGYQ

SEQ ID NO: 1986405 - protein, 5 aa, Staphylococcus
SRSQR

SEQ ID NO: 1986406 - protein, 9 aa, Staphylococcus
SRSRTEETY

SEQ ID NO: 1986407 - protein, 7 aa, Staphylococcus
SRSSEEL

SEQ ID NO: 1986408 - protein, 10 aa, Staphylococcus
SRSSFEPPTI

SEQ ID NO: 1986409 - protein, 10 aa, Staphylococcus
SRSYTQAHDE

SEQ ID NO: 1986410 - protein, 8 aa, Staphylococcus
SRTAQGVF

SEQ ID NO: 1986411 - protein, 6 aa, Staphylococcus
SRTDQK

SEQ ID NO: 1986412 - protein, 7 aa, Staphylococcus
SRTDYDL

SEQ ID NO: 1986413 - protein, 5 aa, Staphylococcus
SRTFD

SEQ ID NO: 1986414 - protein, 6 aa, Staphylococcus
SRTFND

SEQ ID NO: 1986415 - protein, 8 aa, Staphylococcus
SRTGGAEI

SEQ ID NO: 1986416 - protein, 6 aa, Staphylococcus
SRTGKH

SEQ ID NO: 1986417 - protein, 8 aa, Staphylococcus
SRTHRDTE

SEQ ID NO: 1986418 - protein, 5 aa, Staphylococcus
SRTIK

SEQ ID NO: 1986419 - protein, 15 aa, Staphylococcus
SRTISASQAAGYNYI

SEQ ID NO: 1986420 - protein, 33 aa, Staphylococcus
SRTKEKAEKLAEATQQKYGVKAKTYDQADEAME

SEQ ID NO: 1986421 - protein, 11 aa, Staphylococcus
SRTKENAERLA

SEQ ID NO: 1986422 - protein, 7 aa, Staphylococcus
SRTLSEQ

SEQ ID NO: 1986423 - protein, 15 aa, Staphylococcus
SRTNMTIDPETVETL

SEQ ID NO: 1986424 - protein, 14 aa, Staphylococcus
SRTNMTIEPETVET

SEQ ID NO: 1986425 - protein, 16 aa, Staphylococcus
SRTNMTIEPETVETLS

SEQ ID NO: 1986426 - protein, 15 aa, Staphylococcus
SRTNMTINPETVETL

SEQ ID NO: 1986427 - protein, 13 aa, Staphylococcus
SRTNQQNEYYTSE

SEQ ID NO: 1986428 - protein, 14 aa, Staphylococcus
SRTNRVEDETKPYG

SEQ ID NO: 1986429 - protein, 14 aa, Staphylococcus
SRTNRVEEPTKPYG

SEQ ID NO: 1986430 - protein, 14 aa, Staphylococcus
SRTNRVEKETKPYG

SEQ ID NO: 1986431 - protein, 4 aa, Staphylococcus
SRTQ

SEQ ID NO: 1986432 - protein, 7 aa, Staphylococcus
SRTQKPK

SEQ ID NO: 1986433 - protein, 7 aa, Staphylococcus
SRTQNAS

SEQ ID NO: 1986434 - protein, 8 aa, Staphylococcus
SRTQNSSI

SEQ ID NO: 1986435 - protein, 10 aa, Staphylococcus
SRTRAKAETL

SEQ ID NO: 1986436 - protein, 7 aa, Staphylococcus
SRTRKKA

SEQ ID NO: 1986437 - protein, 4 aa, Staphylococcus
SRTS

SEQ ID NO: 1986438 - protein, 5 aa, Staphylococcus
SRTTQ

SEQ ID NO: 1986439 - protein, 4 aa, Staphylococcus
SRTV

SEQ ID NO: 1986440 - protein, 6 aa, Staphylococcus
SRTYTS

SEQ ID NO: 1986441 - protein, 7 aa, Staphylococcus
SRVDSPE

SEQ ID NO: 1986442 - protein, 8 aa, Staphylococcus
SRVEPGSK

SEQ ID NO: 1986443 - protein, 8 aa, Staphylococcus
SRVKPGAD

SEQ ID NO: 1986444 - protein, 8 aa, Staphylococcus
SRVKPGAE

SEQ ID NO: 1986445 - protein, 14 aa, Staphylococcus
SRVLPTESERISQA

SEQ ID NO: 1986446 - protein, 8 aa, Staphylococcus
SRVNAGNP

SEQ ID NO: 1986447 - protein, 11 aa, Staphylococcus
SRVNNDTPINP

SEQ ID NO: 1986448 - protein, 8 aa, Staphylococcus
SRVNYEAQ

SEQ ID NO: 1986449 - protein, 7 aa, Staphylococcus
SRVPDDL

SEQ ID NO: 1986450 - protein, 8 aa, Staphylococcus
SRVRARKQ

SEQ ID NO: 1986451 - protein, 9 aa, Staphylococcus
SRVRGRNQL

SEQ ID NO: 1986452 - protein, 16 aa, Staphylococcus
SRVRTKLSGTAEKPRL

SEQ ID NO: 1986453 - protein, 8 aa, Staphylococcus
SRVRTRKK

SEQ ID NO: 1986454 - protein, 12 aa, Staphylococcus
SRVTGKLSGNIG

SEQ ID NO: 1986455 - protein, 8 aa, Staphylococcus
SRVTPGAE

SEQ ID NO: 1986456 - protein, 11 aa, Staphylococcus
SRYETMNNPGD

SEQ ID NO: 1986457 - protein, 12 aa, Staphylococcus
SRYGSDKPDTRF

SEQ ID NO: 1986458 - protein, 6 aa, Staphylococcus
SRYPSA

SEQ ID NO: 1986459 - protein, 5 aa, Staphylococcus
SRYQS

SEQ ID NO: 1986460 - protein, 5 aa, Staphylococcus
SRYVD

SEQ ID NO: 1986461 - protein, 7 aa, Staphylococcus
SSAAARP

SEQ ID NO: 1986462 - protein, 19 aa, Staphylococcus
SSAAARSTLEEGLKQQNYN

SEQ ID NO: 1986463 - protein, 8 aa, Staphylococcus
SSAASDRL

SEQ ID NO: 1986464 - protein, 7 aa, Staphylococcus
SSAAYRA

SEQ ID NO: 1986465 - protein, 9 aa, Staphylococcus
SSAEARPKL

SEQ ID NO: 1986466 - protein, 6 aa, Staphylococcus
SSAENA

SEQ ID NO: 1986467 - protein, 24 aa, Staphylococcus
SSAGRIAARARGRYGGRPEKLNKQ

SEQ ID NO: 1986468 - protein, 24 aa, Staphylococcus
SSAGRIAARARGRYGGRPEKLNKR

SEQ ID NO: 1986469 - protein, 25 aa, Staphylococcus
SSAGRIAARARGRYGGRPEKLNQKD

SEQ ID NO: 1986470 - protein, 7 aa, Staphylococcus
SSAGVSY

SEQ ID NO: 1986471 - protein, 7 aa, Staphylococcus
SSAIEND

SEQ ID NO: 1986472 - protein, 7 aa, Staphylococcus
SSAIESG

SEQ ID NO: 1986473 - protein, 4 aa, Staphylococcus
SSAP

SEQ ID NO: 1986474 - protein, 5 aa, Staphylococcus
SSAPE

SEQ ID NO: 1986475 - protein, 16 aa, Staphylococcus
SSAPGSVSQVRESTQS

SEQ ID NO: 1986476 - protein, 7 aa, Staphylococcus
SSAPLEE

SEQ ID NO: 1986477 - protein, 8 aa, Staphylococcus
SSAPSRNI

SEQ ID NO: 1986478 - protein, 12 aa, Staphylococcus
SSAPVVTASTDS

SEQ ID NO: 1986479 - protein, 4 aa, Staphylococcus
SSAS

SEQ ID NO: 1986480 - protein, 9 aa, Staphylococcus
SSASMTTEA

SEQ ID NO: 1986481 - protein, 13 aa, Staphylococcus
SSATIPTTSQPAV

SEQ ID NO: 1986482 - protein, 23 aa, Staphylococcus
SSATNGKLSQKSYQDLEKQTGMT

SEQ ID NO: 1986483 - protein, 23 aa, Staphylococcus
SSATNGKLSQKSYTDLEQQTGMP

SEQ ID NO: 1986484 - protein, 12 aa, Staphylococcus
SSATNGKLSQLS

SEQ ID NO: 1986485 - protein, 14 aa, Staphylococcus
SSAVNGEKNTEKMQ

SEQ ID NO: 1986486 - protein, 10 aa, Staphylococcus
SSAVSKGYDM

SEQ ID NO: 1986487 - protein, 17 aa, Staphylococcus
SSAYAQTHRKRGTKRGV

SEQ ID NO: 1986488 - protein, 7 aa, Staphylococcus
SSAYQDS

SEQ ID NO: 1986489 - protein, 5 aa, Staphylococcus
SSDAD

SEQ ID NO: 1986490 - protein, 13 aa, Staphylococcus
SSDASAALKAGAD

SEQ ID NO: 1986491 - protein, 14 aa, Staphylococcus
SSDASAALKAGADI

SEQ ID NO: 1986492 - protein, 14 aa, Staphylococcus
SSDASAALKAGSDI

SEQ ID NO: 1986493 - protein, 9 aa, Staphylococcus
SSDATSYTR

SEQ ID NO: 1986494 - protein, 21 aa, Staphylococcus
SSDAYGKTHKKRGTKQGVDNK

SEQ ID NO: 1986495 - protein, 9 aa, Staphylococcus
SSDDHVNQL

SEQ ID NO: 1986496 - protein, 16 aa, Staphylococcus
SSDDKTFEQRASTSAL

SEQ ID NO: 1986497 - protein, 8 aa, Staphylococcus
SSDEDKED

SEQ ID NO: 1986498 - protein, 7 aa, Staphylococcus
SSDETTY

SEQ ID NO: 1986499 - protein, 6 aa, Staphylococcus
SSDFEA

SEQ ID NO: 1986500 - protein, 7 aa, Staphylococcus
SSDFESI

SEQ ID NO: 1986501 - protein, 5 aa, Staphylococcus
SSDFQ

SEQ ID NO: 1986502 - protein, 6 aa, Staphylococcus
SSDGDT

SEQ ID NO: 1986503 - protein, 8 aa, Staphylococcus
SSDKIADK

SEQ ID NO: 1986504 - protein, 9 aa, Staphylococcus
SSDKQLKSL

SEQ ID NO: 1986505 - protein, 6 aa, Staphylococcus
SSDLDD

SEQ ID NO: 1986506 - protein, 8 aa, Staphylococcus
SSDNAPVL

SEQ ID NO: 1986507 - protein, 9 aa, Staphylococcus
SSDNKSIQD

SEQ ID NO: 1986508 - protein, 13 aa, Staphylococcus
SSDNSGLPEPIGT

SEQ ID NO: 1986509 - protein, 7 aa, Staphylococcus
SSDNTNI

SEQ ID NO: 1986510 - protein, 4 aa, Staphylococcus
SSDR

SEQ ID NO: 1986511 - protein, 8 aa, Staphylococcus
SSDREASI

SEQ ID NO: 1986512 - protein, 9 aa, Staphylococcus
SSDRKRSIQ

SEQ ID NO: 1986513 - protein, 9 aa, Staphylococcus
SSDSDYITG

SEQ ID NO: 1986514 - protein, 6 aa, Staphylococcus
SSDSTL

SEQ ID NO: 1986515 - protein, 6 aa, Staphylococcus
SSDTDT

SEQ ID NO: 1986516 - protein, 9 aa, Staphylococcus
SSDTSTGEA

SEQ ID NO: 1986517 - protein, 10 aa, Staphylococcus
SSDTSTGKAL

SEQ ID NO: 1986518 - protein, 13 aa, Staphylococcus
SSDTSTGQALNRQ

SEQ ID NO: 1986519 - protein, 7 aa, Staphylococcus
SSDTSTL

SEQ ID NO: 1986520 - protein, 9 aa, Staphylococcus
SSDYHGPDM

SEQ ID NO: 1986521 - protein, 9 aa, Staphylococcus
SSEDHKNQL

SEQ ID NO: 1986522 - protein, 9 aa, Staphylococcus
SSEDHSNQL

SEQ ID NO: 1986523 - protein, 9 aa, Staphylococcus
SSEDLANEL

SEQ ID NO: 1986524 - protein, 4 aa, Staphylococcus
SSEE

SEQ ID NO: 1986525 - protein, 6 aa, Staphylococcus
SSEEKY

SEQ ID NO: 1986526 - protein, 11 aa, Staphylococcus
SSEENEDKQQD

SEQ ID NO: 1986527 - protein, 12 aa, Staphylococcus
SSEESTIKKEQI

SEQ ID NO: 1986528 - protein, 10 aa, Staphylococcus
SSEETEEMAN

SEQ ID NO: 1986529 - protein, 8 aa, Staphylococcus
SSEGLAEE

SEQ ID NO: 1986530 - protein, 8 aa, Staphylococcus
SSEGLAQE

SEQ ID NO: 1986531 - protein, 5 aa, Staphylococcus
SSEHK

SEQ ID NO: 1986532 - protein, 7 aa, Staphylococcus
SSEHNHV

SEQ ID NO: 1986533 - protein, 8 aa, Staphylococcus
SSEHNPDD

SEQ ID NO: 1986534 - protein, 7 aa, Staphylococcus
SSEIYAK

SEQ ID NO: 1986535 - protein, 9 aa, Staphylococcus
SSEKGNIQR

SEQ ID NO: 1986536 - protein, 5 aa, Staphylococcus
SSEKQ

SEQ ID NO: 1986537 - protein, 9 aa, Staphylococcus
SSELKDDNK

SEQ ID NO: 1986538 - protein, 8 aa, Staphylococcus
SSELPLGK

SEQ ID NO: 1986539 - protein, 6 aa, Staphylococcus
SSEMNS

SEQ ID NO: 1986540 - protein, 4 aa, Staphylococcus
SSEN

SEQ ID NO: 1986541 - protein, 28 aa, Staphylococcus
SSENIEVEEDTTESQPTETVEIEDEDAE

SEQ ID NO: 1986542 - protein, 9 aa, Staphylococcus
SSENVTTAH

SEQ ID NO: 1986543 - protein, 6 aa, Staphylococcus
SSEPQA

SEQ ID NO: 1986544 - protein, 6 aa, Staphylococcus
SSEPRI

SEQ ID NO: 1986545 - protein, 4 aa, Staphylococcus
SSEQ

SEQ ID NO: 1986546 - protein, 8 aa, Staphylococcus
SSEQFDSD

SEQ ID NO: 1986547 - protein, 7 aa, Staphylococcus
SSEREKE

SEQ ID NO: 1986548 - protein, 7 aa, Staphylococcus
SSERIPA

SEQ ID NO: 1986549 - protein, 9 aa, Staphylococcus
SSERWEQGK

SEQ ID NO: 1986550 - protein, 9 aa, Staphylococcus
SSERWETGK

SEQ ID NO: 1986551 - protein, 6 aa, Staphylococcus
SSESVD

SEQ ID NO: 1986552 - protein, 4 aa, Staphylococcus
SSET

SEQ ID NO: 1986553 - protein, 6 aa, Staphylococcus
SSETSH

SEQ ID NO: 1986554 - protein, 6 aa, Staphylococcus
SSETST

SEQ ID NO: 1986555 - protein, 5 aa, Staphylococcus
SSEYD

SEQ ID NO: 1986556 - protein, 8 aa, Staphylococcus
SSEYGLED

SEQ ID NO: 1986557 - protein, 6 aa, Staphylococcus
SSEYHD

SEQ ID NO: 1986558 - protein, 9 aa, Staphylococcus
SSEYTTERL

SEQ ID NO: 1986559 - protein, 7 aa, Staphylococcus
SSFGDRE

SEQ ID NO: 1986560 - protein, 12 aa, Staphylococcus
SSFGEGSEEISG

SEQ ID NO: 1986561 - protein, 8 aa, Staphylococcus
SSFKDKAV

SEQ ID NO: 1986562 - protein, 13 aa, Staphylococcus
SSFLESPTRATSD

SEQ ID NO: 1986563 - protein, 7 aa, Staphylococcus
SSFNDSS

SEQ ID NO: 1986564 - protein, 14 aa, Staphylococcus
SSFNKKGKDGRFKA

SEQ ID NO: 1986565 - protein, 7 aa, Staphylococcus
SSFQGNA

SEQ ID NO: 1986566 - protein, 4 aa, Staphylococcus
SSFS

SEQ ID NO: 1986567 - protein, 136 aa, Staphylococcus
SSFSETVANQNSTTLTKSSTSTSNTSTSIESSESETTNTSSQSENTTNTESSNSENVESTHSESAASTSESNQSKENQSTEASSSSQSASTDQQSESTSEKASTAGDASQSETSIAKSAAISGSDSGKADSSESGS

SEQ ID NO: 1986568 - protein, 10 aa, Staphylococcus
SSFTDAGSGH

SEQ ID NO: 1986569 - protein, 7 aa, Staphylococcus
SSFTDIG

SEQ ID NO: 1986570 - protein, 8 aa, Staphylococcus
SSGADDYL

SEQ ID NO: 1986571 - protein, 9 aa, Staphylococcus
SSGAGHDSQ

SEQ ID NO: 1986572 - protein, 10 aa, Staphylococcus
SSGAKLSKEQ

SEQ ID NO: 1986573 - protein, 9 aa, Staphylococcus
SSGAKLSTS

SEQ ID NO: 1986574 - protein, 6 aa, Staphylococcus
SSGDTL

SEQ ID NO: 1986575 - protein, 15 aa, Staphylococcus
SSGDTTQVPAQIESE

SEQ ID NO: 1986576 - protein, 6 aa, Staphylococcus
SSGEHL

SEQ ID NO: 1986577 - protein, 5 aa, Staphylococcus
SSGEV

SEQ ID NO: 1986578 - protein, 16 aa, Staphylococcus
SSGFDTPELENAKPND

SEQ ID NO: 1986579 - protein, 8 aa, Staphylococcus
SSGFSTLS

SEQ ID NO: 1986580 - protein, 9 aa, Staphylococcus
SSGGGGIPV

SEQ ID NO: 1986581 - protein, 7 aa, Staphylococcus
SSGISTQ

SEQ ID NO: 1986582 - protein, 4 aa, Staphylococcus
SSGK

SEQ ID NO: 1986583 - protein, 13 aa, Staphylococcus
SSGKNNAYKLPNK

SEQ ID NO: 1986584 - protein, 6 aa, Staphylococcus
SSGLEP

SEQ ID NO: 1986585 - protein, 9 aa, Staphylococcus
SSGLETARE

SEQ ID NO: 1986586 - protein, 6 aa, Staphylococcus
SSGLGK

SEQ ID NO: 1986587 - protein, 9 aa, Staphylococcus
SSGLTNTKG

SEQ ID NO: 1986588 - protein, 7 aa, Staphylococcus
SSGMGKA

SEQ ID NO: 1986589 - protein, 4 aa, Staphylococcus
SSGN

SEQ ID NO: 1986590 - protein, 6 aa, Staphylococcus
SSGNKV

SEQ ID NO: 1986591 - protein, 5 aa, Staphylococcus
SSGPT

SEQ ID NO: 1986592 - protein, 4 aa, Staphylococcus
SSGR

SEQ ID NO: 1986593 - protein, 15 aa, Staphylococcus
SSGSACTAGSTTPSH

SEQ ID NO: 1986594 - protein, 8 aa, Staphylococcus
SSGSNPNF

SEQ ID NO: 1986595 - protein, 11 aa, Staphylococcus
SSGSTKDSIDE

SEQ ID NO: 1986596 - protein, 10 aa, Staphylococcus
SSGTEATQDT

SEQ ID NO: 1986597 - protein, 8 aa, Staphylococcus
SSGTSSLE

SEQ ID NO: 1986598 - protein, 7 aa, Staphylococcus
SSGTSVL

SEQ ID NO: 1986599 - protein, 18 aa, Staphylococcus
SSGVTGENIHVDAGFHAI

SEQ ID NO: 1986600 - protein, 18 aa, Staphylococcus
SSGVTGENIHVDGGFHAI

SEQ ID NO: 1986601 - protein, 18 aa, Staphylococcus
SSGVTGENIHVDSGYHIV

SEQ ID NO: 1986602 - protein, 6 aa, Staphylococcus
SSHCSD

SEQ ID NO: 1986603 - protein, 4 aa, Staphylococcus
SSHD

SEQ ID NO: 1986604 - protein, 7 aa, Staphylococcus
SSHDQIA

SEQ ID NO: 1986605 - protein, 7 aa, Staphylococcus
SSHEEKL

SEQ ID NO: 1986606 - protein, 7 aa, Staphylococcus
SSHGADT

SEQ ID NO: 1986607 - protein, 6 aa, Staphylococcus
SSHNED

SEQ ID NO: 1986608 - protein, 10 aa, Staphylococcus
SSHPEYRAQY

SEQ ID NO: 1986609 - protein, 5 aa, Staphylococcus
SSHPT

SEQ ID NO: 1986610 - protein, 22 aa, Staphylococcus
SSHQTLEHYSPDKIYDYFYSIF

SEQ ID NO: 1986611 - protein, 6 aa, Staphylococcus
SSHTDA

SEQ ID NO: 1986612 - protein, 14 aa, Staphylococcus
SSHVANKEQGLSCG

SEQ ID NO: 1986613 - protein, 7 aa, Staphylococcus
SSHYNDP

SEQ ID NO: 1986614 - protein, 8 aa, Staphylococcus
SSIAESKT

SEQ ID NO: 1986615 - protein, 10 aa, Staphylococcus
SSIAGYNEED

SEQ ID NO: 1986616 - protein, 6 aa, Staphylococcus
SSIDAA

SEQ ID NO: 1986617 - protein, 7 aa, Staphylococcus
SSIDAKG

SEQ ID NO: 1986618 - protein, 9 aa, Staphylococcus
SSIDEAYTQ

SEQ ID NO: 1986619 - protein, 14 aa, Staphylococcus
SSIDHQTLASGSAI

SEQ ID NO: 1986620 - protein, 16 aa, Staphylococcus
SSIDTRVDDRDAHLRS

SEQ ID NO: 1986621 - protein, 5 aa, Staphylococcus
SSIEA

SEQ ID NO: 1986622 - protein, 12 aa, Staphylococcus
SSIETDGMKDKN

SEQ ID NO: 1986623 - protein, 7 aa, Staphylococcus
SSIGGKV

SEQ ID NO: 1986624 - protein, 7 aa, Staphylococcus
SSIGQPD

SEQ ID NO: 1986625 - protein, 5 aa, Staphylococcus
SSIKK

SEQ ID NO: 1986626 - protein, 9 aa, Staphylococcus
SSIKNKEFS

SEQ ID NO: 1986627 - protein, 7 aa, Staphylococcus
SSINSKE

SEQ ID NO: 1986628 - protein, 19 aa, Staphylococcus
SSIPSNRYNTQMETAESEM

SEQ ID NO: 1986629 - protein, 4 aa, Staphylococcus
SSIQ

SEQ ID NO: 1986630 - protein, 9 aa, Staphylococcus
SSIQATYNQ

SEQ ID NO: 1986631 - protein, 9 aa, Staphylococcus
SSIQQAEDR

SEQ ID NO: 1986632 - protein, 6 aa, Staphylococcus
SSIRDK

SEQ ID NO: 1986633 - protein, 8 aa, Staphylococcus
SSIREEVN

SEQ ID NO: 1986634 - protein, 4 aa, Staphylococcus
SSIS

SEQ ID NO: 1986635 - protein, 13 aa, Staphylococcus
SSISDAKAAAGVA

SEQ ID NO: 1986636 - protein, 5 aa, Staphylococcus
SSISE

SEQ ID NO: 1986637 - protein, 8 aa, Staphylococcus
SSISKNDL

SEQ ID NO: 1986638 - protein, 9 aa, Staphylococcus
SSISTSDNF

SEQ ID NO: 1986639 - protein, 14 aa, Staphylococcus
SSISYAGGKDLDSL

SEQ ID NO: 1986640 - protein, 15 aa, Staphylococcus
SSISYAGGKDLKSLT

SEQ ID NO: 1986641 - protein, 14 aa, Staphylococcus
SSISYAGGKDLNSL

SEQ ID NO: 1986642 - protein, 4 aa, Staphylococcus
SSIT

SEQ ID NO: 1986643 - protein, 6 aa, Staphylococcus
SSITDN

SEQ ID NO: 1986644 - protein, 15 aa, Staphylococcus
SSKADDDYKDKMGEK

SEQ ID NO: 1986645 - protein, 8 aa, Staphylococcus
SSKAGITV

SEQ ID NO: 1986646 - protein, 11 aa, Staphylococcus
SSKALPPEEDE

SEQ ID NO: 1986647 - protein, 7 aa, Staphylococcus
SSKDDLS

SEQ ID NO: 1986648 - protein, 7 aa, Staphylococcus
SSKDIEK

SEQ ID NO: 1986649 - protein, 21 aa, Staphylococcus
SSKDLSRLARRGSGSASRSIY

SEQ ID NO: 1986650 - protein, 8 aa, Staphylococcus
SSKDRAEN

SEQ ID NO: 1986651 - protein, 9 aa, Staphylococcus
SSKEEAEKL

SEQ ID NO: 1986652 - protein, 17 aa, Staphylococcus
SSKEGDFEGTEVSRKSV

SEQ ID NO: 1986653 - protein, 6 aa, Staphylococcus
SSKEIA

SEQ ID NO: 1986654 - protein, 9 aa, Staphylococcus
SSKETVEAM

SEQ ID NO: 1986655 - protein, 5 aa, Staphylococcus
SSKFD

SEQ ID NO: 1986656 - protein, 11 aa, Staphylococcus
SSKGEAYKGQH

SEQ ID NO: 1986657 - protein, 10 aa, Staphylococcus
SSKGEEELDE

SEQ ID NO: 1986658 - protein, 10 aa, Staphylococcus
SSKGEEELQE

SEQ ID NO: 1986659 - protein, 10 aa, Staphylococcus
SSKGGEELEE

SEQ ID NO: 1986660 - protein, 8 aa, Staphylococcus
SSKGKTHE

SEQ ID NO: 1986661 - protein, 15 aa, Staphylococcus
SSKIGSSTRNAYNSA

SEQ ID NO: 1986662 - protein, 18 aa, Staphylococcus
SSKISNTARKHSKNMSEN

SEQ ID NO: 1986663 - protein, 9 aa, Staphylococcus
SSKKQEKRS

SEQ ID NO: 1986664 - protein, 8 aa, Staphylococcus
SSKKTNKL

SEQ ID NO: 1986665 - protein, 4 aa, Staphylococcus
SSKL

SEQ ID NO: 1986666 - protein, 12 aa, Staphylococcus
SSKLTPGSKAAA

SEQ ID NO: 1986667 - protein, 6 aa, Staphylococcus
SSKNRT

SEQ ID NO: 1986668 - protein, 8 aa, Staphylococcus
SSKNSIKY

SEQ ID NO: 1986669 - protein, 7 aa, Staphylococcus
SSKNYSP

SEQ ID NO: 1986670 - protein, 8 aa, Staphylococcus
SSKPHFTN

SEQ ID NO: 1986671 - protein, 6 aa, Staphylococcus
SSKPIE

SEQ ID NO: 1986672 - protein, 7 aa, Staphylococcus
SSKPLTD

SEQ ID NO: 1986673 - protein, 4 aa, Staphylococcus
SSKQ

SEQ ID NO: 1986674 - protein, 8 aa, Staphylococcus
SSKQARPL

SEQ ID NO: 1986675 - protein, 6 aa, Staphylococcus
SSKQKH

SEQ ID NO: 1986676 - protein, 7 aa, Staphylococcus
SSKQQYN

SEQ ID NO: 1986677 - protein, 10 aa, Staphylococcus
SSKQSVEKLR

SEQ ID NO: 1986678 - protein, 8 aa, Staphylococcus
SSKRDEIN

SEQ ID NO: 1986679 - protein, 9 aa, Staphylococcus
SSKRSKTLT

SEQ ID NO: 1986680 - protein, 8 aa, Staphylococcus
SSKSGVIS

SEQ ID NO: 1986681 - protein, 5 aa, Staphylococcus
SSKSH

SEQ ID NO: 1986682 - protein, 8 aa, Staphylococcus
SSKSSIKK

SEQ ID NO: 1986683 - protein, 12 aa, Staphylococcus
SSKSYDARFTPD

SEQ ID NO: 1986684 - protein, 12 aa, Staphylococcus
SSKSYDERFTPD

SEQ ID NO: 1986685 - protein, 13 aa, Staphylococcus
SSKSYDKRFSPDQ

SEQ ID NO: 1986686 - protein, 13 aa, Staphylococcus
SSKSYDQRFSPDE

SEQ ID NO: 1986687 - protein, 12 aa, Staphylococcus
SSKSYDQRFTPD

SEQ ID NO: 1986688 - protein, 12 aa, Staphylococcus
SSKSYEQRFTPE

SEQ ID NO: 1986689 - protein, 13 aa, Staphylococcus
SSKTFPTTSQPAI

SEQ ID NO: 1986690 - protein, 8 aa, Staphylococcus
SSKYSGTL

SEQ ID NO: 1986691 - protein, 9 aa, Staphylococcus
SSKYTRTKL

SEQ ID NO: 1986692 - protein, 12 aa, Staphylococcus
SSLDDATKDESI

SEQ ID NO: 1986693 - protein, 11 aa, Staphylococcus
SSLDDATKEES

SEQ ID NO: 1986694 - protein, 11 aa, Staphylococcus
SSLDDATRGEG

SEQ ID NO: 1986695 - protein, 12 aa, Staphylococcus
SSLDDNTKRESM

SEQ ID NO: 1986696 - protein, 5 aa, Staphylococcus
SSLDT

SEQ ID NO: 1986697 - protein, 9 aa, Staphylococcus
SSLEKLEST

SEQ ID NO: 1986698 - protein, 21 aa, Staphylococcus
SSLENTISSTQSFTPDREIQE

SEQ ID NO: 1986699 - protein, 5 aa, Staphylococcus
SSLGV

SEQ ID NO: 1986700 - protein, 6 aa, Staphylococcus
SSLGYK

SEQ ID NO: 1986701 - protein, 7 aa, Staphylococcus
SSLHQQT

SEQ ID NO: 1986702 - protein, 14 aa, Staphylococcus
SSLHQQTLSEEEVT

SEQ ID NO: 1986703 - protein, 6 aa, Staphylococcus
SSLIDE

SEQ ID NO: 1986704 - protein, 24 aa, Staphylococcus
SSLIGDNATIPNHKDITDQLDYEG

SEQ ID NO: 1986705 - protein, 6 aa, Staphylococcus
SSLKAT

SEQ ID NO: 1986706 - protein, 9 aa, Staphylococcus
SSLNEDDMN

SEQ ID NO: 1986707 - protein, 12 aa, Staphylococcus
SSLNKKQQSEIE

SEQ ID NO: 1986708 - protein, 17 aa, Staphylococcus
SSLNQNKRIGPNPAEFN

SEQ ID NO: 1986709 - protein, 4 aa, Staphylococcus
SSLP

SEQ ID NO: 1986710 - protein, 18 aa, Staphylococcus
SSLPGKLADCSSKDPSRS

SEQ ID NO: 1986711 - protein, 19 aa, Staphylococcus
SSLPGKLADCSSKKPEESE

SEQ ID NO: 1986712 - protein, 19 aa, Staphylococcus
SSLPGKLADCSSKNPDESE

SEQ ID NO: 1986713 - protein, 18 aa, Staphylococcus
SSLPGKLADCSSKNPEES

SEQ ID NO: 1986714 - protein, 8 aa, Staphylococcus
SSLPNGFS

SEQ ID NO: 1986715 - protein, 10 aa, Staphylococcus
SSLQNHKSTN

SEQ ID NO: 1986716 - protein, 7 aa, Staphylococcus
SSLSAES

SEQ ID NO: 1986717 - protein, 6 aa, Staphylococcus
SSLSKA

SEQ ID NO: 1986718 - protein, 8 aa, Staphylococcus
SSLSNDEV

SEQ ID NO: 1986719 - protein, 11 aa, Staphylococcus
SSLSPDESQEL

SEQ ID NO: 1986720 - protein, 15 aa, Staphylococcus
SSLSQKDQKAIEAEL

SEQ ID NO: 1986721 - protein, 17 aa, Staphylococcus
SSLSQKQQKQIEQELAS

SEQ ID NO: 1986722 - protein, 9 aa, Staphylococcus
SSLTDENGV

SEQ ID NO: 1986723 - protein, 12 aa, Staphylococcus
SSLTEAKEMKNY

SEQ ID NO: 1986724 - protein, 8 aa, Staphylococcus
SSLTKPAN

SEQ ID NO: 1986725 - protein, 13 aa, Staphylococcus
SSLTQKQQKEIEQ

SEQ ID NO: 1986726 - protein, 16 aa, Staphylococcus
SSLTQKQQKEIETQLR

SEQ ID NO: 1986727 - protein, 18 aa, Staphylococcus
SSLTQKQQKEVEQELKQG

SEQ ID NO: 1986728 - protein, 7 aa, Staphylococcus
SSLTRKQ

SEQ ID NO: 1986729 - protein, 4 aa, Staphylococcus
SSME

SEQ ID NO: 1986730 - protein, 8 aa, Staphylococcus
SSMEGYGP

SEQ ID NO: 1986731 - protein, 10 aa, Staphylococcus
SSMGRKAQIN

SEQ ID NO: 1986732 - protein, 6 aa, Staphylococcus
SSMREE

SEQ ID NO: 1986733 - protein, 14 aa, Staphylococcus
SSMSGLTSQPSANS

SEQ ID NO: 1986734 - protein, 4 aa, Staphylococcus
SSMY

SEQ ID NO: 1986735 - protein, 5 aa, Staphylococcus
SSNCK

SEQ ID NO: 1986736 - protein, 9 aa, Staphylococcus
SSNDDGTIA

SEQ ID NO: 1986737 - protein, 9 aa, Staphylococcus
SSNDDGTIS

SEQ ID NO: 1986738 - protein, 10 aa, Staphylococcus
SSNDDGTISD

SEQ ID NO: 1986739 - protein, 7 aa, Staphylococcus
SSNDIPP

SEQ ID NO: 1986740 - protein, 7 aa, Staphylococcus
SSNDPKF

SEQ ID NO: 1986741 - protein, 12 aa, Staphylococcus
SSNDVESKETDT

SEQ ID NO: 1986742 - protein, 6 aa, Staphylococcus
SSNDYR

SEQ ID NO: 1986743 - protein, 5 aa, Staphylococcus
SSNEI

SEQ ID NO: 1986744 - protein, 11 aa, Staphylococcus
SSNEKEHLSEK

SEQ ID NO: 1986745 - protein, 10 aa, Staphylococcus
SSNEKENIAA

SEQ ID NO: 1986746 - protein, 13 aa, Staphylococcus
SSNEKEQLDEKVN

SEQ ID NO: 1986747 - protein, 11 aa, Staphylococcus
SSNEKQALEDK

SEQ ID NO: 1986748 - protein, 7 aa, Staphylococcus
SSNENEM

SEQ ID NO: 1986749 - protein, 21 aa, Staphylococcus
SSNEVKHNKESDSNKKVVYST

SEQ ID NO: 1986750 - protein, 8 aa, Staphylococcus
SSNFNKYE

SEQ ID NO: 1986751 - protein, 14 aa, Staphylococcus
SSNFTKAGLTSNSE

SEQ ID NO: 1986752 - protein, 8 aa, Staphylococcus
SSNGHVPG

SEQ ID NO: 1986753 - protein, 6 aa, Staphylococcus
SSNGTH

SEQ ID NO: 1986754 - protein, 7 aa, Staphylococcus
SSNGTLG

SEQ ID NO: 1986755 - protein, 11 aa, Staphylococcus
SSNGTRGDAEG

SEQ ID NO: 1986756 - protein, 10 aa, Staphylococcus
SSNGTSGEVK

SEQ ID NO: 1986757 - protein, 11 aa, Staphylococcus
SSNGTSGEVND

SEQ ID NO: 1986758 - protein, 11 aa, Staphylococcus
SSNGTTGEIED

SEQ ID NO: 1986759 - protein, 12 aa, Staphylococcus
SSNGTTGEVNDE

SEQ ID NO: 1986760 - protein, 4 aa, Staphylococcus
SSNL

SEQ ID NO: 1986761 - protein, 18 aa, Staphylococcus
SSNNGAVENISKDLPKME

SEQ ID NO: 1986762 - protein, 10 aa, Staphylococcus
SSNPDNNRDK

SEQ ID NO: 1986763 - protein, 8 aa, Staphylococcus
SSNPIAGN

SEQ ID NO: 1986764 - protein, 13 aa, Staphylococcus
SSNPKKEIKQLKA

SEQ ID NO: 1986765 - protein, 18 aa, Staphylococcus
SSNPVAGNVTVGGGVGPT

SEQ ID NO: 1986766 - protein, 10 aa, Staphylococcus
SSNSDEDIKN

SEQ ID NO: 1986767 - protein, 19 aa, Staphylococcus
SSNSDTANSAFKASSGAIQ

SEQ ID NO: 1986768 - protein, 7 aa, Staphylococcus
SSNSTLQ

SEQ ID NO: 1986769 - protein, 10 aa, Staphylococcus
SSNTSTGNAL

SEQ ID NO: 1986770 - protein, 8 aa, Staphylococcus
SSNTVKAD

SEQ ID NO: 1986771 - protein, 6 aa, Staphylococcus
SSNYTK

SEQ ID NO: 1986772 - protein, 8 aa, Staphylococcus
SSNYTQPE

SEQ ID NO: 1986773 - protein, 6 aa, Staphylococcus
SSPAED

SEQ ID NO: 1986774 - protein, 5 aa, Staphylococcus
SSPAT

SEQ ID NO: 1986775 - protein, 8 aa, Staphylococcus
SSPDAAEK

SEQ ID NO: 1986776 - protein, 6 aa, Staphylococcus
SSPEAR

SEQ ID NO: 1986777 - protein, 27 aa, Staphylococcus
SSPESYQESKYHGKQAQHSQLHENRDV

SEQ ID NO: 1986778 - protein, 6 aa, Staphylococcus
SSPFKT

SEQ ID NO: 1986779 - protein, 13 aa, Staphylococcus
SSPGMPPGANTIN

SEQ ID NO: 1986780 - protein, 6 aa, Staphylococcus
SSPHKD

SEQ ID NO: 1986781 - protein, 9 aa, Staphylococcus
SSPNKLSKI

SEQ ID NO: 1986782 - protein, 5 aa, Staphylococcus
SSPNL

SEQ ID NO: 1986783 - protein, 9 aa, Staphylococcus
SSPNPTTAA

SEQ ID NO: 1986784 - protein, 26 aa, Staphylococcus
SSPNPTTAATTEISYGHDSQITLKTN

SEQ ID NO: 1986785 - protein, 16 aa, Staphylococcus
SSPNPTTAATTELSYG

SEQ ID NO: 1986786 - protein, 29 aa, Staphylococcus
SSPNPTTAATTELSYGEDSQITLKSSEQL

SEQ ID NO: 1986787 - protein, 26 aa, Staphylococcus
SSPNPTTAATTELSYGEDSQITLKTE

SEQ ID NO: 1986788 - protein, 19 aa, Staphylococcus
SSPNPTTAATTELSYGEQS

SEQ ID NO: 1986789 - protein, 29 aa, Staphylococcus
SSPNPTTAATTELTYGESSSITLKSSKQL

SEQ ID NO: 1986790 - protein, 9 aa, Staphylococcus
SSPQLDIPE

SEQ ID NO: 1986791 - protein, 9 aa, Staphylococcus
SSPQLDVPE

SEQ ID NO: 1986792 - protein, 7 aa, Staphylococcus
SSPQYKD

SEQ ID NO: 1986793 - protein, 9 aa, Staphylococcus
SSPSFSSDK

SEQ ID NO: 1986794 - protein, 6 aa, Staphylococcus
SSPVEA

SEQ ID NO: 1986795 - protein, 11 aa, Staphylococcus
SSQDDGSDETL

SEQ ID NO: 1986796 - protein, 8 aa, Staphylococcus
SSQDGFKN

SEQ ID NO: 1986797 - protein, 9 aa, Staphylococcus
SSQDLTRND

SEQ ID NO: 1986798 - protein, 6 aa, Staphylococcus
SSQDTL

SEQ ID NO: 1986799 - protein, 6 aa, Staphylococcus
SSQEGY

SEQ ID NO: 1986800 - protein, 9 aa, Staphylococcus
SSQERACDT

SEQ ID NO: 1986801 - protein, 9 aa, Staphylococcus
SSQGSWQQK

SEQ ID NO: 1986802 - protein, 16 aa, Staphylococcus
SSQHSSYFERYLYPVK

SEQ ID NO: 1986803 - protein, 4 aa, Staphylococcus
SSQI

SEQ ID NO: 1986804 - protein, 5 aa, Staphylococcus
SSQIA

SEQ ID NO: 1986805 - protein, 6 aa, Staphylococcus
SSQKEC

SEQ ID NO: 1986806 - protein, 14 aa, Staphylococcus
SSQKEEGLPVALLK

SEQ ID NO: 1986807 - protein, 8 aa, Staphylococcus
SSQKEEIK

SEQ ID NO: 1986808 - protein, 9 aa, Staphylococcus
SSQKHDLDG

SEQ ID NO: 1986809 - protein, 9 aa, Staphylococcus
SSQKQEFDR

SEQ ID NO: 1986810 - protein, 9 aa, Staphylococcus
SSQKQHLNG

SEQ ID NO: 1986811 - protein, 5 aa, Staphylococcus
SSQKR

SEQ ID NO: 1986812 - protein, 7 aa, Staphylococcus
SSQQLKQ

SEQ ID NO: 1986813 - protein, 5 aa, Staphylococcus
SSQQP

SEQ ID NO: 1986814 - protein, 6 aa, Staphylococcus
SSQQQF

SEQ ID NO: 1986815 - protein, 7 aa, Staphylococcus
SSQQQYN

SEQ ID NO: 1986816 - protein, 9 aa, Staphylococcus
SSQRAEVDK

SEQ ID NO: 1986817 - protein, 10 aa, Staphylococcus
SSQRESEGFK

SEQ ID NO: 1986818 - protein, 18 aa, Staphylococcus
SSQSLSDLQNDIMEAIVC

SEQ ID NO: 1986819 - protein, 6 aa, Staphylococcus
SSQSNQ

SEQ ID NO: 1986820 - protein, 8 aa, Staphylococcus
SSQSTEVD

SEQ ID NO: 1986821 - protein, 8 aa, Staphylococcus
SSQTPVDI

SEQ ID NO: 1986822 - protein, 7 aa, Staphylococcus
SSQVQNK

SEQ ID NO: 1986823 - protein, 6 aa, Staphylococcus
SSQYQE

SEQ ID NO: 1986824 - protein, 7 aa, Staphylococcus
SSQYQTS

SEQ ID NO: 1986825 - protein, 10 aa, Staphylococcus
SSRAKWGERS

SEQ ID NO: 1986826 - protein, 6 aa, Staphylococcus
SSRDRN

SEQ ID NO: 1986827 - protein, 4 aa, Staphylococcus
SSRE

SEQ ID NO: 1986828 - protein, 16 aa, Staphylococcus
SSREALKSSDEGMDQL

SEQ ID NO: 1986829 - protein, 7 aa, Staphylococcus
SSREDRL

SEQ ID NO: 1986830 - protein, 17 aa, Staphylococcus
SSREEVELNERAFLKEL

SEQ ID NO: 1986831 - protein, 8 aa, Staphylococcus
SSREGANV

SEQ ID NO: 1986832 - protein, 14 aa, Staphylococcus
SSRKSLKEGDQGID

SEQ ID NO: 1986833 - protein, 7 aa, Staphylococcus
SSRNEST

SEQ ID NO: 1986834 - protein, 10 aa, Staphylococcus
SSRNGGTRHR

SEQ ID NO: 1986835 - protein, 15 aa, Staphylococcus
SSRPKLIGGERAHYT

SEQ ID NO: 1986836 - protein, 8 aa, Staphylococcus
SSRPSYVS

SEQ ID NO: 1986837 - protein, 6 aa, Staphylococcus
SSRQAD

SEQ ID NO: 1986838 - protein, 10 aa, Staphylococcus
SSRRSEQDYK

SEQ ID NO: 1986839 - protein, 16 aa, Staphylococcus
SSRRSLKEGDEGIDKL

SEQ ID NO: 1986840 - protein, 12 aa, Staphylococcus
SSRTKKQLSRQQ

SEQ ID NO: 1986841 - protein, 6 aa, Staphylococcus
SSRVSR

SEQ ID NO: 1986842 - protein, 5 aa, Staphylococcus
SSSAN

SEQ ID NO: 1986843 - protein, 6 aa, Staphylococcus
SSSCKT

SEQ ID NO: 1986844 - protein, 5 aa, Staphylococcus
SSSDY

SEQ ID NO: 1986845 - protein, 9 aa, Staphylococcus
SSSEKVTEA

SEQ ID NO: 1986846 - protein, 15 aa, Staphylococcus
SSSESLNAYINEILS

SEQ ID NO: 1986847 - protein, 5 aa, Staphylococcus
SSSET

SEQ ID NO: 1986848 - protein, 25 aa, Staphylococcus
SSSFGSNNNVSQGVSVEVGEKQAAV

SEQ ID NO: 1986849 - protein, 5 aa, Staphylococcus
SSSGA

SEQ ID NO: 1986850 - protein, 9 aa, Staphylococcus
SSSGGTQFS

SEQ ID NO: 1986851 - protein, 5 aa, Staphylococcus
SSSGS

SEQ ID NO: 1986852 - protein, 6 aa, Staphylococcus
SSSGSI

SEQ ID NO: 1986853 - protein, 6 aa, Staphylococcus
SSSIEN

SEQ ID NO: 1986854 - protein, 8 aa, Staphylococcus
SSSIQYEN

SEQ ID NO: 1986855 - protein, 13 aa, Staphylococcus
SSSKANQKVRKEI

SEQ ID NO: 1986856 - protein, 9 aa, Staphylococcus
SSSKEKNVK

SEQ ID NO: 1986857 - protein, 9 aa, Staphylococcus
SSSKEVKET

SEQ ID NO: 1986858 - protein, 7 aa, Staphylococcus
SSSKNII

SEQ ID NO: 1986859 - protein, 7 aa, Staphylococcus
SSSKQNA

SEQ ID NO: 1986860 - protein, 18 aa, Staphylococcus
SSSLDGKQATDSDESKWI

SEQ ID NO: 1986861 - protein, 9 aa, Staphylococcus
SSSLTRDQQ

SEQ ID NO: 1986862 - protein, 10 aa, Staphylococcus
SSSNDNPVAK

SEQ ID NO: 1986863 - protein, 7 aa, Staphylococcus
SSSNITQ

SEQ ID NO: 1986864 - protein, 21 aa, Staphylococcus
SSSPGIKDENNRHERQQIDAA

SEQ ID NO: 1986865 - protein, 10 aa, Staphylococcus
SSSPKQFKKP

SEQ ID NO: 1986866 - protein, 5 aa, Staphylococcus
SSSPS

SEQ ID NO: 1986867 - protein, 9 aa, Staphylococcus
SSSQERACE

SEQ ID NO: 1986868 - protein, 17 aa, Staphylococcus
SSSQHSSYFERYLYPIK

SEQ ID NO: 1986869 - protein, 17 aa, Staphylococcus
SSSQHSSYFERYLYPIN

SEQ ID NO: 1986870 - protein, 9 aa, Staphylococcus
SSSQYGGCT

SEQ ID NO: 1986871 - protein, 7 aa, Staphylococcus
SSSREKE

SEQ ID NO: 1986872 - protein, 4 aa, Staphylococcus
SSSS

SEQ ID NO: 1986873 - protein, 7 aa, Staphylococcus
SSSSAVN

SEQ ID NO: 1986874 - protein, 7 aa, Staphylococcus
SSSSDFY

SEQ ID NO: 1986875 - protein, 9 aa, Staphylococcus
SSSSDKQSI

SEQ ID NO: 1986876 - protein, 5 aa, Staphylococcus
SSSSN

SEQ ID NO: 1986877 - protein, 9 aa, Staphylococcus
SSSTEHNSD

SEQ ID NO: 1986878 - protein, 8 aa, Staphylococcus
SSSTFTPN

SEQ ID NO: 1986879 - protein, 5 aa, Staphylococcus
SSSTY

SEQ ID NO: 1986880 - protein, 13 aa, Staphylococcus
SSSVKTTANSELP

SEQ ID NO: 1986881 - protein, 6 aa, Staphylococcus
SSSVPV

SEQ ID NO: 1986882 - protein, 5 aa, Staphylococcus
SSSYA

SEQ ID NO: 1986883 - protein, 6 aa, Staphylococcus
SSSYTK

SEQ ID NO: 1986884 - protein, 9 aa, Staphylococcus
SSSYTNEDG

SEQ ID NO: 1986885 - protein, 7 aa, Staphylococcus
SSSYTSR

SEQ ID NO: 1986886 - protein, 6 aa, Staphylococcus
SSTART

SEQ ID NO: 1986887 - protein, 8 aa, Staphylococcus
SSTDSAHL

SEQ ID NO: 1986888 - protein, 9 aa, Staphylococcus
SSTDSAHLA

SEQ ID NO: 1986889 - protein, 8 aa, Staphylococcus
SSTDSAHV

SEQ ID NO: 1986890 - protein, 9 aa, Staphylococcus
SSTDSAHVA

SEQ ID NO: 1986891 - protein, 5 aa, Staphylococcus
SSTEM

SEQ ID NO: 1986892 - protein, 13 aa, Staphylococcus
SSTENKKHEFSEY

SEQ ID NO: 1986893 - protein, 6 aa, Staphylococcus
SSTEQL

SEQ ID NO: 1986894 - protein, 10 aa, Staphylococcus
SSTFADNTTI

SEQ ID NO: 1986895 - protein, 6 aa, Staphylococcus
SSTFAQ

SEQ ID NO: 1986896 - protein, 15 aa, Staphylococcus
SSTFNQKVKEGSNYA

SEQ ID NO: 1986897 - protein, 7 aa, Staphylococcus
SSTFPKE

SEQ ID NO: 1986898 - protein, 5 aa, Staphylococcus
SSTFS

SEQ ID NO: 1986899 - protein, 9 aa, Staphylococcus
SSTFSDPYT

SEQ ID NO: 1986900 - protein, 9 aa, Staphylococcus
SSTFSNPFT

SEQ ID NO: 1986901 - protein, 11 aa, Staphylococcus
SSTFSNPYTAA

SEQ ID NO: 1986902 - protein, 7 aa, Staphylococcus
SSTGAGK

SEQ ID NO: 1986903 - protein, 5 aa, Staphylococcus
SSTGE

SEQ ID NO: 1986904 - protein, 4 aa, Staphylococcus
SSTL

SEQ ID NO: 1986905 - protein, 8 aa, Staphylococcus
SSTLDPNK

SEQ ID NO: 1986906 - protein, 6 aa, Staphylococcus
SSTLSD

SEQ ID NO: 1986907 - protein, 7 aa, Staphylococcus
SSTNAQH

SEQ ID NO: 1986908 - protein, 7 aa, Staphylococcus
SSTNKNQ

SEQ ID NO: 1986909 - protein, 8 aa, Staphylococcus
SSTNSQLP

SEQ ID NO: 1986910 - protein, 9 aa, Staphylococcus
SSTPDPSQL

SEQ ID NO: 1986911 - protein, 5 aa, Staphylococcus
SSTPL

SEQ ID NO: 1986912 - protein, 6 aa, Staphylococcus
SSTPQK

SEQ ID NO: 1986913 - protein, 10 aa, Staphylococcus
SSTQERASDT

SEQ ID NO: 1986914 - protein, 10 aa, Staphylococcus
SSTRDSEGFK

SEQ ID NO: 1986915 - protein, 14 aa, Staphylococcus
SSTRLGNTVKDRTA

SEQ ID NO: 1986916 - protein, 14 aa, Staphylococcus
SSTRLGNTVKERTA

SEQ ID NO: 1986917 - protein, 6 aa, Staphylococcus
SSTRQL

SEQ ID NO: 1986918 - protein, 8 aa, Staphylococcus
SSTSAEVT

SEQ ID NO: 1986919 - protein, 9 aa, Staphylococcus
SSTSAEVTP

SEQ ID NO: 1986920 - protein, 7 aa, Staphylococcus
SSTSAQN

SEQ ID NO: 1986921 - protein, 11 aa, Staphylococcus
SSTSPEIGTVK

SEQ ID NO: 1986922 - protein, 23 aa, Staphylococcus
SSTSPEIGTVKEDVKASNVDGGN

SEQ ID NO: 1986923 - protein, 8 aa, Staphylococcus
SSTSSENY

SEQ ID NO: 1986924 - protein, 8 aa, Staphylococcus
SSTSSESY

SEQ ID NO: 1986925 - protein, 8 aa, Staphylococcus
SSTSSPDF

SEQ ID NO: 1986926 - protein, 8 aa, Staphylococcus
SSTSSQDY

SEQ ID NO: 1986927 - protein, 6 aa, Staphylococcus
SSTYTQ

SEQ ID NO: 1986928 - protein, 8 aa, Staphylococcus
SSVADATQ

SEQ ID NO: 1986929 - protein, 8 aa, Staphylococcus
SSVDERKA

SEQ ID NO: 1986930 - protein, 23 aa, Staphylococcus
SSVDGELDEKNTIPHTFLHLVRK

SEQ ID NO: 1986931 - protein, 7 aa, Staphylococcus
SSVDNNY

SEQ ID NO: 1986932 - protein, 16 aa, Staphylococcus
SSVDTQNEDRDNHLKS

SEQ ID NO: 1986933 - protein, 4 aa, Staphylococcus
SSVE

SEQ ID NO: 1986934 - protein, 13 aa, Staphylococcus
SSVEGKLDEKSTI

SEQ ID NO: 1986935 - protein, 13 aa, Staphylococcus
SSVEGQLDEKNTI

SEQ ID NO: 1986936 - protein, 6 aa, Staphylococcus
SSVEMD

SEQ ID NO: 1986937 - protein, 6 aa, Staphylococcus
SSVEVD

SEQ ID NO: 1986938 - protein, 13 aa, Staphylococcus
SSVGMEEQDFEDY

SEQ ID NO: 1986939 - protein, 9 aa, Staphylococcus
SSVKNHKNL

SEQ ID NO: 1986940 - protein, 9 aa, Staphylococcus
SSVMGSGSL

SEQ ID NO: 1986941 - protein, 4 aa, Staphylococcus
SSVN

SEQ ID NO: 1986942 - protein, 20 aa, Staphylococcus
SSVPGTGFEGRVTKKDIENY

SEQ ID NO: 1986943 - protein, 12 aa, Staphylococcus
SSVPQFKTTRYN

SEQ ID NO: 1986944 - protein, 10 aa, Staphylococcus
SSVQGYNPSP

SEQ ID NO: 1986945 - protein, 10 aa, Staphylococcus
SSVQKSLQDH

SEQ ID NO: 1986946 - protein, 9 aa, Staphylococcus
SSVRAREKA

SEQ ID NO: 1986947 - protein, 7 aa, Staphylococcus
SSVRTAL

SEQ ID NO: 1986948 - protein, 4 aa, Staphylococcus
SSVS

SEQ ID NO: 1986949 - protein, 9 aa, Staphylococcus
SSVSKYKNQ

SEQ ID NO: 1986950 - protein, 7 aa, Staphylococcus
SSVSQLK

SEQ ID NO: 1986951 - protein, 9 aa, Staphylococcus
SSVTRVKEG

SEQ ID NO: 1986952 - protein, 9 aa, Staphylococcus
SSVTTVDGP

SEQ ID NO: 1986953 - protein, 5 aa, Staphylococcus
SSWDG

SEQ ID NO: 1986954 - protein, 6 aa, Staphylococcus
SSWDGE

SEQ ID NO: 1986955 - protein, 8 aa, Staphylococcus
SSYAKEKL

SEQ ID NO: 1986956 - protein, 7 aa, Staphylococcus
SSYDDRD

SEQ ID NO: 1986957 - protein, 9 aa, Staphylococcus
SSYEATPDE

SEQ ID NO: 1986958 - protein, 6 aa, Staphylococcus
SSYKDN

SEQ ID NO: 1986959 - protein, 10 aa, Staphylococcus
SSYKQKKLRD

SEQ ID NO: 1986960 - protein, 7 aa, Staphylococcus
SSYLTSD

SEQ ID NO: 1986961 - protein, 5 aa, Staphylococcus
SSYNY

SEQ ID NO: 1986962 - protein, 5 aa, Staphylococcus
SSYPN

SEQ ID NO: 1986963 - protein, 4 aa, Staphylococcus
SSYR

SEQ ID NO: 1986964 - protein, 6 aa, Staphylococcus
SSYRDN

SEQ ID NO: 1986965 - protein, 8 aa, Staphylococcus
SSYTHENG

SEQ ID NO: 1986966 - protein, 8 aa, Staphylococcus
SSYTYGEQ

SEQ ID NO: 1986967 - protein, 7 aa, Staphylococcus
STADKDV

SEQ ID NO: 1986968 - protein, 8 aa, Staphylococcus
STAEDQTM

SEQ ID NO: 1986969 - protein, 13 aa, Staphylococcus
STAGQSDDVKDTV

SEQ ID NO: 1986970 - protein, 7 aa, Staphylococcus
STAHERP

SEQ ID NO: 1986971 - protein, 33 aa, Staphylococcus
STAKATTSVRDPKQQKRLSKLAKKAKVKNAQLT

SEQ ID NO: 1986972 - protein, 4 aa, Staphylococcus
STAL

SEQ ID NO: 1986973 - protein, 7 aa, Staphylococcus
STALPED

SEQ ID NO: 1986974 - protein, 4 aa, Staphylococcus
STAN

SEQ ID NO: 1986975 - protein, 11 aa, Staphylococcus
STAPDGNVAEG

SEQ ID NO: 1986976 - protein, 13 aa, Staphylococcus
STAQSEVEGGRLH

SEQ ID NO: 1986977 - protein, 10 aa, Staphylococcus
STASGEGNQL

SEQ ID NO: 1986978 - protein, 10 aa, Staphylococcus
STASGEGNQV

SEQ ID NO: 1986979 - protein, 8 aa, Staphylococcus
STASYEAR

SEQ ID NO: 1986980 - protein, 9 aa, Staphylococcus
STASYEARK

SEQ ID NO: 1986981 - protein, 8 aa, Staphylococcus
STATLGVR

SEQ ID NO: 1986982 - protein, 9 aa, Staphylococcus
STATSQTPV

SEQ ID NO: 1986983 - protein, 12 aa, Staphylococcus
STCTDNEEGQQI

SEQ ID NO: 1986984 - protein, 9 aa, Staphylococcus
STDAGESYN

SEQ ID NO: 1986985 - protein, 5 aa, Staphylococcus
STDAH

SEQ ID NO: 1986986 - protein, 9 aa, Staphylococcus
STDAIEDLK

SEQ ID NO: 1986987 - protein, 8 aa, Staphylococcus
STDAPKIY

SEQ ID NO: 1986988 - protein, 10 aa, Staphylococcus
STDAPNHGMR

SEQ ID NO: 1986989 - protein, 10 aa, Staphylococcus
STDDATKGAY

SEQ ID NO: 1986990 - protein, 36 aa, Staphylococcus
STDDPNDNTSLTDSSGSDSNNTSDNSTDTTSNDKND

SEQ ID NO: 1986991 - protein, 8 aa, Staphylococcus
STDEDKRE

SEQ ID NO: 1986992 - protein, 10 aa, Staphylococcus
STDEGSKRLG

SEQ ID NO: 1986993 - protein, 7 aa, Staphylococcus
STDEKEA

SEQ ID NO: 1986994 - protein, 8 aa, Staphylococcus
STDELGDK

SEQ ID NO: 1986995 - protein, 6 aa, Staphylococcus
STDGDT

SEQ ID NO: 1986996 - protein, 5 aa, Staphylococcus
STDGL

SEQ ID NO: 1986997 - protein, 9 aa, Staphylococcus
STDGPGFMG

SEQ ID NO: 1986998 - protein, 6 aa, Staphylococcus
STDIQE

SEQ ID NO: 1986999 - protein, 9 aa, Staphylococcus
STDKDAMDK

SEQ ID NO: 1987000 - protein, 13 aa, Staphylococcus
STDKVGKGTHTIK

SEQ ID NO: 1987001 - protein, 6 aa, Staphylococcus
STDLDE

SEQ ID NO: 1987002 - protein, 12 aa, Staphylococcus
STDLESESRSVE

SEQ ID NO: 1987003 - protein, 11 aa, Staphylococcus
STDLQKSENEK

SEQ ID NO: 1987004 - protein, 7 aa, Staphylococcus
STDLSFN

SEQ ID NO: 1987005 - protein, 4 aa, Staphylococcus
STDN

SEQ ID NO: 1987006 - protein, 8 aa, Staphylococcus
STDPASNL

SEQ ID NO: 1987007 - protein, 9 aa, Staphylococcus
STDPDADRL

SEQ ID NO: 1987008 - protein, 9 aa, Staphylococcus
STDPRTGKP

SEQ ID NO: 1987009 - protein, 7 aa, Staphylococcus
STDQSLE

SEQ ID NO: 1987010 - protein, 14 aa, Staphylococcus
STDYEKQEQPLPGL

SEQ ID NO: 1987011 - protein, 8 aa, Staphylococcus
STDYSKDE

SEQ ID NO: 1987012 - protein, 21 aa, Staphylococcus
STEAGRANGISETLSDKYDGY

SEQ ID NO: 1987013 - protein, 21 aa, Staphylococcus
STEAGRANGTTSNLNGEYDGY

SEQ ID NO: 1987014 - protein, 9 aa, Staphylococcus
STEASSTSE

SEQ ID NO: 1987015 - protein, 5 aa, Staphylococcus
STEAV

SEQ ID NO: 1987016 - protein, 6 aa, Staphylococcus
STEDFK

SEQ ID NO: 1987017 - protein, 7 aa, Staphylococcus
STEDKES

SEQ ID NO: 1987018 - protein, 27 aa, Staphylococcus
STEDLKKAMDDTAAHKGWKKTYLRYHW

SEQ ID NO: 1987019 - protein, 9 aa, Staphylococcus
STEDVTASI

SEQ ID NO: 1987020 - protein, 15 aa, Staphylococcus
STEEDKWKVIDTFKL

SEQ ID NO: 1987021 - protein, 6 aa, Staphylococcus
STEEFK

SEQ ID NO: 1987022 - protein, 11 aa, Staphylococcus
STEESNIKKEK

SEQ ID NO: 1987023 - protein, 5 aa, Staphylococcus
STEEV

SEQ ID NO: 1987024 - protein, 12 aa, Staphylococcus
STEEVEDERQMT

SEQ ID NO: 1987025 - protein, 5 aa, Staphylococcus
STEHY

SEQ ID NO: 1987026 - protein, 7 aa, Staphylococcus
STELDGE

SEQ ID NO: 1987027 - protein, 14 aa, Staphylococcus
STELKESEREELER

SEQ ID NO: 1987028 - protein, 24 aa, Staphylococcus
STELPRDEVETVSTKTPYVSTGSD

SEQ ID NO: 1987029 - protein, 9 aa, Staphylococcus
STENGLKGT

SEQ ID NO: 1987030 - protein, 10 aa, Staphylococcus
STEPFSENQS

SEQ ID NO: 1987031 - protein, 8 aa, Staphylococcus
STEPNTVD

SEQ ID NO: 1987032 - protein, 20 aa, Staphylococcus
STEPSKALRASFERADNHYT

SEQ ID NO: 1987033 - protein, 21 aa, Staphylococcus
STEPSKRLRESFNRSRKDDFS

SEQ ID NO: 1987034 - protein, 10 aa, Staphylococcus
STEQGSDKRE

SEQ ID NO: 1987035 - protein, 8 aa, Staphylococcus
STESWGGI

SEQ ID NO: 1987036 - protein, 7 aa, Staphylococcus
STETLDI

SEQ ID NO: 1987037 - protein, 4 aa, Staphylococcus
STEV

SEQ ID NO: 1987038 - protein, 6 aa, Staphylococcus
STEVGQ

SEQ ID NO: 1987039 - protein, 6 aa, Staphylococcus
STEVSG

SEQ ID NO: 1987040 - protein, 4 aa, Staphylococcus
STEY

SEQ ID NO: 1987041 - protein, 7 aa, Staphylococcus
STEYTTK

SEQ ID NO: 1987042 - protein, 11 aa, Staphylococcus
STFDEPPEHHT

SEQ ID NO: 1987043 - protein, 13 aa, Staphylococcus
STFDHDATKPYSE

SEQ ID NO: 1987044 - protein, 5 aa, Staphylococcus
STFEG

SEQ ID NO: 1987045 - protein, 6 aa, Staphylococcus
STFGQK

SEQ ID NO: 1987046 - protein, 6 aa, Staphylococcus
STFGQR

SEQ ID NO: 1987047 - protein, 4 aa, Staphylococcus
STFK

SEQ ID NO: 1987048 - protein, 5 aa, Staphylococcus
STFNE

SEQ ID NO: 1987049 - protein, 5 aa, Staphylococcus
STFNQ

SEQ ID NO: 1987050 - protein, 4 aa, Staphylococcus
STFQ

SEQ ID NO: 1987051 - protein, 4 aa, Staphylococcus
STFS

SEQ ID NO: 1987052 - protein, 8 aa, Staphylococcus
STFSNPFT

SEQ ID NO: 1987053 - protein, 10 aa, Staphylococcus
STFSNPQLEQ

SEQ ID NO: 1987054 - protein, 4 aa, Staphylococcus
STFT

SEQ ID NO: 1987055 - protein, 10 aa, Staphylococcus
STFTNQDANE

SEQ ID NO: 1987056 - protein, 13 aa, Staphylococcus
STGDPAGTSTTRV

SEQ ID NO: 1987057 - protein, 6 aa, Staphylococcus
STGDSK

SEQ ID NO: 1987058 - protein, 11 aa, Staphylococcus
STGDTLGDQAK

SEQ ID NO: 1987059 - protein, 4 aa, Staphylococcus
STGE

SEQ ID NO: 1987060 - protein, 15 aa, Staphylococcus
STGELKATNFEDEST

SEQ ID NO: 1987061 - protein, 15 aa, Staphylococcus
STGELKATQIEDEDT

SEQ ID NO: 1987062 - protein, 15 aa, Staphylococcus
STGELKTTQFEGTST

SEQ ID NO: 1987063 - protein, 6 aa, Staphylococcus
STGERQ

SEQ ID NO: 1987064 - protein, 5 aa, Staphylococcus
STGEY

SEQ ID NO: 1987065 - protein, 6 aa, Staphylococcus
STGEYE

SEQ ID NO: 1987066 - protein, 14 aa, Staphylococcus
STGFAGGGATAEDV

SEQ ID NO: 1987067 - protein, 14 aa, Staphylococcus
STGFAGGGATPEDV

SEQ ID NO: 1987068 - protein, 13 aa, Staphylococcus
STGFEKNQVMGQS

SEQ ID NO: 1987069 - protein, 12 aa, Staphylococcus
STGGGIIENDDS

SEQ ID NO: 1987070 - protein, 9 aa, Staphylococcus
STGGSSINA

SEQ ID NO: 1987071 - protein, 7 aa, Staphylococcus
STGGSSL

SEQ ID NO: 1987072 - protein, 9 aa, Staphylococcus
STGGSSVTA

SEQ ID NO: 1987073 - protein, 4 aa, Staphylococcus
STGH

SEQ ID NO: 1987074 - protein, 12 aa, Staphylococcus
STGHDEKRKQLP

SEQ ID NO: 1987075 - protein, 5 aa, Staphylococcus
STGHG

SEQ ID NO: 1987076 - protein, 9 aa, Staphylococcus
STGHVDATD

SEQ ID NO: 1987077 - protein, 5 aa, Staphylococcus
STGIS

SEQ ID NO: 1987078 - protein, 6 aa, Staphylococcus
STGKDD

SEQ ID NO: 1987079 - protein, 6 aa, Staphylococcus
STGKDE

SEQ ID NO: 1987080 - protein, 16 aa, Staphylococcus
STGKKGAEDKLKTLGA

SEQ ID NO: 1987081 - protein, 7 aa, Staphylococcus
STGKPTI

SEQ ID NO: 1987082 - protein, 8 aa, Staphylococcus
STGKRENV

SEQ ID NO: 1987083 - protein, 8 aa, Staphylococcus
STGKYEGS

SEQ ID NO: 1987084 - protein, 13 aa, Staphylococcus
STGKYTGRSPKDK

SEQ ID NO: 1987085 - protein, 32 aa, Staphylococcus
STGNEEVELSSTSPEIGTVKEDVNANDVEGSN

SEQ ID NO: 1987086 - protein, 6 aa, Staphylococcus
STGNEV

SEQ ID NO: 1987087 - protein, 14 aa, Staphylococcus
STGNHESKERLTQL

SEQ ID NO: 1987088 - protein, 9 aa, Staphylococcus
STGNNEAAD

SEQ ID NO: 1987089 - protein, 17 aa, Staphylococcus
STGNTSAAAAAYAARSG

SEQ ID NO: 1987090 - protein, 7 aa, Staphylococcus
STGQKQK

SEQ ID NO: 1987091 - protein, 6 aa, Staphylococcus
STGQQQ

SEQ ID NO: 1987092 - protein, 9 aa, Staphylococcus
STGQSETLE

SEQ ID NO: 1987093 - protein, 5 aa, Staphylococcus
STGRD

SEQ ID NO: 1987094 - protein, 5 aa, Staphylococcus
STGRI

SEQ ID NO: 1987095 - protein, 12 aa, Staphylococcus
STGTISKSGVNH

SEQ ID NO: 1987096 - protein, 6 aa, Staphylococcus
STGTYE

SEQ ID NO: 1987097 - protein, 4 aa, Staphylococcus
STGV

SEQ ID NO: 1987098 - protein, 10 aa, Staphylococcus
STGVKDRKRR

SEQ ID NO: 1987099 - protein, 7 aa, Staphylococcus
STGVQPQ

SEQ ID NO: 1987100 - protein, 11 aa, Staphylococcus
STGVQVGGGDH

SEQ ID NO: 1987101 - protein, 4 aa, Staphylococcus
STHA

SEQ ID NO: 1987102 - protein, 17 aa, Staphylococcus
STHLPNKEDANYEDKLN

SEQ ID NO: 1987103 - protein, 6 aa, Staphylococcus
STHPEG

SEQ ID NO: 1987104 - protein, 15 aa, Staphylococcus
STHTGQGAIGLVVLR

SEQ ID NO: 1987105 - protein, 15 aa, Staphylococcus
STHTGQGAIGLVVVR

SEQ ID NO: 1987106 - protein, 6 aa, Staphylococcus
STHYTR

SEQ ID NO: 1987107 - protein, 12 aa, Staphylococcus
STIDGKEETLPA

SEQ ID NO: 1987108 - protein, 14 aa, Staphylococcus
STIDRSTNEVDTVA

SEQ ID NO: 1987109 - protein, 7 aa, Staphylococcus
STIEAQE

SEQ ID NO: 1987110 - protein, 8 aa, Staphylococcus
STIEAQEK

SEQ ID NO: 1987111 - protein, 7 aa, Staphylococcus
STIEAQT

SEQ ID NO: 1987112 - protein, 9 aa, Staphylococcus
STIEPSRKQ

SEQ ID NO: 1987113 - protein, 7 aa, Staphylococcus
STIESDK

SEQ ID NO: 1987114 - protein, 4 aa, Staphylococcus
STIG

SEQ ID NO: 1987115 - protein, 5 aa, Staphylococcus
STIGK

SEQ ID NO: 1987116 - protein, 6 aa, Staphylococcus
STIGQS

SEQ ID NO: 1987117 - protein, 11 aa, Staphylococcus
STIGSTEEIAE

SEQ ID NO: 1987118 - protein, 6 aa, Staphylococcus
STIGTG

SEQ ID NO: 1987119 - protein, 10 aa, Staphylococcus
STIKHDPYTM

SEQ ID NO: 1987120 - protein, 12 aa, Staphylococcus
STILGADDKAGL

SEQ ID NO: 1987121 - protein, 12 aa, Staphylococcus
STILGSDDKAGL

SEQ ID NO: 1987122 - protein, 6 aa, Staphylococcus
STINKQ

SEQ ID NO: 1987123 - protein, 6 aa, Staphylococcus
STINNY

SEQ ID NO: 1987124 - protein, 8 aa, Staphylococcus
STINRDKA

SEQ ID NO: 1987125 - protein, 7 aa, Staphylococcus
STINSKE

SEQ ID NO: 1987126 - protein, 5 aa, Staphylococcus
STIPA

SEQ ID NO: 1987127 - protein, 13 aa, Staphylococcus
STIPEQLQNETKL

SEQ ID NO: 1987128 - protein, 6 aa, Staphylococcus
STIPKA

SEQ ID NO: 1987129 - protein, 6 aa, Staphylococcus
STIRAN

SEQ ID NO: 1987130 - protein, 4 aa, Staphylococcus
STIS

SEQ ID NO: 1987131 - protein, 5 aa, Staphylococcus
STISH

SEQ ID NO: 1987132 - protein, 6 aa, Staphylococcus
STISNS

SEQ ID NO: 1987133 - protein, 6 aa, Staphylococcus
STISSS

SEQ ID NO: 1987134 - protein, 11 aa, Staphylococcus
STITDNVPNES

SEQ ID NO: 1987135 - protein, 16 aa, Staphylococcus
STITKRSLQNNKTEND

SEQ ID NO: 1987136 - protein, 6 aa, Staphylococcus
STIYED

SEQ ID NO: 1987137 - protein, 12 aa, Staphylococcus
STKASKTTIALN

SEQ ID NO: 1987138 - protein, 11 aa, Staphylococcus
STKATEQMNGE

SEQ ID NO: 1987139 - protein, 21 aa, Staphylococcus
STKAVAGTIKRTNDEAEDKKH

SEQ ID NO: 1987140 - protein, 6 aa, Staphylococcus
STKDAM

SEQ ID NO: 1987141 - protein, 12 aa, Staphylococcus
STKDASEETLDA

SEQ ID NO: 1987142 - protein, 12 aa, Staphylococcus
STKDASEQTLDA

SEQ ID NO: 1987143 - protein, 12 aa, Staphylococcus
STKDGSEQTLDA

SEQ ID NO: 1987144 - protein, 8 aa, Staphylococcus
STKEEKFG

SEQ ID NO: 1987145 - protein, 7 aa, Staphylococcus
STKEQKY

SEQ ID NO: 1987146 - protein, 5 aa, Staphylococcus
STKGA

SEQ ID NO: 1987147 - protein, 5 aa, Staphylococcus
STKGI

SEQ ID NO: 1987148 - protein, 8 aa, Staphylococcus
STKGMSEA

SEQ ID NO: 1987149 - protein, 5 aa, Staphylococcus
STKGN

SEQ ID NO: 1987150 - protein, 8 aa, Staphylococcus
STKGNGFV

SEQ ID NO: 1987151 - protein, 11 aa, Staphylococcus
STKGQQYIDES

SEQ ID NO: 1987152 - protein, 14 aa, Staphylococcus
STKGSAKSDDVDKV

SEQ ID NO: 1987153 - protein, 30 aa, Staphylococcus
STKGSAKSDDVEKVESATKLAQEKTEEEGL

SEQ ID NO: 1987154 - protein, 5 aa, Staphylococcus
STKGY

SEQ ID NO: 1987155 - protein, 10 aa, Staphylococcus
STKHREAAHN

SEQ ID NO: 1987156 - protein, 8 aa, Staphylococcus
STKKGNAK

SEQ ID NO: 1987157 - protein, 10 aa, Staphylococcus
STKKHTDDNW

SEQ ID NO: 1987158 - protein, 12 aa, Staphylococcus
STKKKLKSKFPD

SEQ ID NO: 1987159 - protein, 8 aa, Staphylococcus
STKKLEEY

SEQ ID NO: 1987160 - protein, 10 aa, Staphylococcus
STKLKQDKPI

SEQ ID NO: 1987161 - protein, 24 aa, Staphylococcus
STKLNAVKSKSKPARKAKANKGKK

SEQ ID NO: 1987162 - protein, 9 aa, Staphylococcus
STKLSKPQF

SEQ ID NO: 1987163 - protein, 10 aa, Staphylococcus
STKNAGFTDS

SEQ ID NO: 1987164 - protein, 10 aa, Staphylococcus
STKNKKSRAI

SEQ ID NO: 1987165 - protein, 15 aa, Staphylococcus
STKNSGGASVPRNKA

SEQ ID NO: 1987166 - protein, 9 aa, Staphylococcus
STKNTSVKV

SEQ ID NO: 1987167 - protein, 6 aa, Staphylococcus
STKNVS

SEQ ID NO: 1987168 - protein, 8 aa, Staphylococcus
STKQIADA

SEQ ID NO: 1987169 - protein, 8 aa, Staphylococcus
STKQSTSI

SEQ ID NO: 1987170 - protein, 9 aa, Staphylococcus
STKRDNNAS

SEQ ID NO: 1987171 - protein, 7 aa, Staphylococcus
STKREEV

SEQ ID NO: 1987172 - protein, 19 aa, Staphylococcus
STKSFELQKDERGLSNETI

SEQ ID NO: 1987173 - protein, 10 aa, Staphylococcus
STKSRTESDL

SEQ ID NO: 1987174 - protein, 51 aa, Staphylococcus
STKSTEDIEKELTEDEELDQPSTKDNEQENEEPAPKKKKPRKLSEADFDED

SEQ ID NO: 1987175 - protein, 49 aa, Staphylococcus
STKSTEDIEQELSEEEGNQSSTIHDDNDEAQIEPKKKPRKLSEADFDDD

SEQ ID NO: 1987176 - protein, 12 aa, Staphylococcus
STKTPYVSTGSN

SEQ ID NO: 1987177 - protein, 8 aa, Staphylococcus
STKTQQDI

SEQ ID NO: 1987178 - protein, 4 aa, Staphylococcus
STKV

SEQ ID NO: 1987179 - protein, 6 aa, Staphylococcus
STKVDI

SEQ ID NO: 1987180 - protein, 6 aa, Staphylococcus
STKVGD

SEQ ID NO: 1987181 - protein, 8 aa, Staphylococcus
STLASGEY

SEQ ID NO: 1987182 - protein, 8 aa, Staphylococcus
STLEEAKD

SEQ ID NO: 1987183 - protein, 9 aa, Staphylococcus
STLEEAKGA

SEQ ID NO: 1987184 - protein, 9 aa, Staphylococcus
STLEEAKSA

SEQ ID NO: 1987185 - protein, 10 aa, Staphylococcus
STLEENASHM

SEQ ID NO: 1987186 - protein, 9 aa, Staphylococcus
STLEKDGPR

SEQ ID NO: 1987187 - protein, 7 aa, Staphylococcus
STLNNES

SEQ ID NO: 1987188 - protein, 21 aa, Staphylococcus
STLNNESSYNQEPQPDEHYGE

SEQ ID NO: 1987189 - protein, 13 aa, Staphylococcus
STLNRNETASSGM

SEQ ID NO: 1987190 - protein, 6 aa, Staphylococcus
STLPND

SEQ ID NO: 1987191 - protein, 8 aa, Staphylococcus
STLPNRVK

SEQ ID NO: 1987192 - protein, 4 aa, Staphylococcus
STLS

SEQ ID NO: 1987193 - protein, 9 aa, Staphylococcus
STLSEAQQM

SEQ ID NO: 1987194 - protein, 10 aa, Staphylococcus
STLSGGESFQ

SEQ ID NO: 1987195 - protein, 9 aa, Staphylococcus
STLSKTDLA

SEQ ID NO: 1987196 - protein, 6 aa, Staphylococcus
STLSND

SEQ ID NO: 1987197 - protein, 4 aa, Staphylococcus
STLT

SEQ ID NO: 1987198 - protein, 7 aa, Staphylococcus
STLTNDQ

SEQ ID NO: 1987199 - protein, 11 aa, Staphylococcus
STLTPDAVRAE

SEQ ID NO: 1987200 - protein, 6 aa, Staphylococcus
STMSDA

SEQ ID NO: 1987201 - protein, 4 aa, Staphylococcus
STNA

SEQ ID NO: 1987202 - protein, 7 aa, Staphylococcus
STNARKE

SEQ ID NO: 1987203 - protein, 6 aa, Staphylococcus
STNAYE

SEQ ID NO: 1987204 - protein, 4 aa, Staphylococcus
STND

SEQ ID NO: 1987205 - protein, 12 aa, Staphylococcus
STNDAYRGMGTT

SEQ ID NO: 1987206 - protein, 5 aa, Staphylococcus
STNDF

SEQ ID NO: 1987207 - protein, 5 aa, Staphylococcus
STNEG

SEQ ID NO: 1987208 - protein, 8 aa, Staphylococcus
STNEKGHS

SEQ ID NO: 1987209 - protein, 6 aa, Staphylococcus
STNGKV

SEQ ID NO: 1987210 - protein, 8 aa, Staphylococcus
STNGMPRF

SEQ ID NO: 1987211 - protein, 7 aa, Staphylococcus
STNKEDL

SEQ ID NO: 1987212 - protein, 7 aa, Staphylococcus
STNKPLR

SEQ ID NO: 1987213 - protein, 6 aa, Staphylococcus
STNLKL

SEQ ID NO: 1987214 - protein, 7 aa, Staphylococcus
STNLPND

SEQ ID NO: 1987215 - protein, 4 aa, Staphylococcus
STNN

SEQ ID NO: 1987216 - protein, 9 aa, Staphylococcus
STNPDENGE

SEQ ID NO: 1987217 - protein, 10 aa, Staphylococcus
STNQDKLKGR

SEQ ID NO: 1987218 - protein, 6 aa, Staphylococcus
STNQVP

SEQ ID NO: 1987219 - protein, 8 aa, Staphylococcus
STNQVPLT

SEQ ID NO: 1987220 - protein, 5 aa, Staphylococcus
STNRV

SEQ ID NO: 1987221 - protein, 5 aa, Staphylococcus
STNSH

SEQ ID NO: 1987222 - protein, 5 aa, Staphylococcus
STNSL

SEQ ID NO: 1987223 - protein, 6 aa, Staphylococcus
STNSLV

SEQ ID NO: 1987224 - protein, 8 aa, Staphylococcus
STNSNQTL

SEQ ID NO: 1987225 - protein, 9 aa, Staphylococcus
STNSRSGKI

SEQ ID NO: 1987226 - protein, 16 aa, Staphylococcus
STNSTEDFEHAQKELD

SEQ ID NO: 1987227 - protein, 7 aa, Staphylococcus
STNTPKI

SEQ ID NO: 1987228 - protein, 10 aa, Staphylococcus
STNTTDDARK

SEQ ID NO: 1987229 - protein, 5 aa, Staphylococcus
STNYD

SEQ ID NO: 1987230 - protein, 9 aa, Staphylococcus
STNYDDPQA

SEQ ID NO: 1987231 - protein, 19 aa, Staphylococcus
STPAEESSNAWNNAGTGHS

SEQ ID NO: 1987232 - protein, 8 aa, Staphylococcus
STPAENIG

SEQ ID NO: 1987233 - protein, 6 aa, Staphylococcus
STPANT

SEQ ID NO: 1987234 - protein, 7 aa, Staphylococcus
STPDTSI

SEQ ID NO: 1987235 - protein, 6 aa, Staphylococcus
STPFTP

SEQ ID NO: 1987236 - protein, 9 aa, Staphylococcus
STPGEETVQ

SEQ ID NO: 1987237 - protein, 7 aa, Staphylococcus
STPHGGE

SEQ ID NO: 1987238 - protein, 4 aa, Staphylococcus
STPK

SEQ ID NO: 1987239 - protein, 4 aa, Staphylococcus
STPL

SEQ ID NO: 1987240 - protein, 22 aa, Staphylococcus
STPLKKVTTPKDVANTVAYLVS

SEQ ID NO: 1987241 - protein, 15 aa, Staphylococcus
STPNQDNPITEGKTP

SEQ ID NO: 1987242 - protein, 10 aa, Staphylococcus
STPPDYVPRP

SEQ ID NO: 1987243 - protein, 42 aa, Staphylococcus
STPQQSQPAAQIQTQATSNATPESNNASASNEAPAGKTVNAP

SEQ ID NO: 1987244 - protein, 7 aa, Staphylococcus
STPRSFV

SEQ ID NO: 1987245 - protein, 8 aa, Staphylococcus
STPTYAEV

SEQ ID NO: 1987246 - protein, 4 aa, Staphylococcus
STPV

SEQ ID NO: 1987247 - protein, 7 aa, Staphylococcus
STPYDHD

SEQ ID NO: 1987248 - protein, 13 aa, Staphylococcus
STPYYLDGKNLRN

SEQ ID NO: 1987249 - protein, 13 aa, Staphylococcus
STPYYLEGKNYRN

SEQ ID NO: 1987250 - protein, 18 aa, Staphylococcus
STQAQLSTIQNEDGSPVN

SEQ ID NO: 1987251 - protein, 7 aa, Staphylococcus
STQDEII

SEQ ID NO: 1987252 - protein, 9 aa, Staphylococcus
STQERASDT

SEQ ID NO: 1987253 - protein, 12 aa, Staphylococcus
STQGLHNRGSFE

SEQ ID NO: 1987254 - protein, 11 aa, Staphylococcus
STQGLHNRGTF

SEQ ID NO: 1987255 - protein, 18 aa, Staphylococcus
STQGRLYTGTKESDCEIS

SEQ ID NO: 1987256 - protein, 5 aa, Staphylococcus
STQIG

SEQ ID NO: 1987257 - protein, 6 aa, Staphylococcus
STQIKD

SEQ ID NO: 1987258 - protein, 5 aa, Staphylococcus
STQKA

SEQ ID NO: 1987259 - protein, 10 aa, Staphylococcus
STQLSTKGIQ

SEQ ID NO: 1987260 - protein, 16 aa, Staphylococcus
STQNKSEFENAKQTLD

SEQ ID NO: 1987261 - protein, 10 aa, Staphylococcus
STQPAARSTA

SEQ ID NO: 1987262 - protein, 8 aa, Staphylococcus
STQPENVQ

SEQ ID NO: 1987263 - protein, 5 aa, Staphylococcus
STQQF

SEQ ID NO: 1987264 - protein, 8 aa, Staphylococcus
STQQHVEG

SEQ ID NO: 1987265 - protein, 18 aa, Staphylococcus
STQRKIDDTNKTITTDGP

SEQ ID NO: 1987266 - protein, 10 aa, Staphylococcus
STQSHGDVRS

SEQ ID NO: 1987267 - protein, 11 aa, Staphylococcus
STQSKSTPVFK

SEQ ID NO: 1987268 - protein, 9 aa, Staphylococcus
STQSQGDVR

SEQ ID NO: 1987269 - protein, 11 aa, Staphylococcus
STQSQGDVRSA

SEQ ID NO: 1987270 - protein, 4 aa, Staphylococcus
STQT

SEQ ID NO: 1987271 - protein, 8 aa, Staphylococcus
STQTGEEF

SEQ ID NO: 1987272 - protein, 6 aa, Staphylococcus
STQYDR

SEQ ID NO: 1987273 - protein, 6 aa, Staphylococcus
STRELP

SEQ ID NO: 1987274 - protein, 14 aa, Staphylococcus
STREPGGVPTGEEI

SEQ ID NO: 1987275 - protein, 14 aa, Staphylococcus
STREPGGVSTGEEI

SEQ ID NO: 1987276 - protein, 7 aa, Staphylococcus
STRHKDI

SEQ ID NO: 1987277 - protein, 9 aa, Staphylococcus
STRIPEDQQ

SEQ ID NO: 1987278 - protein, 10 aa, Staphylococcus
STRNNSEDFK

SEQ ID NO: 1987279 - protein, 13 aa, Staphylococcus
STRNPKSKAIPER

SEQ ID NO: 1987280 - protein, 7 aa, Staphylococcus
STRPDDY

SEQ ID NO: 1987281 - protein, 7 aa, Staphylococcus
STRPEDY

SEQ ID NO: 1987282 - protein, 7 aa, Staphylococcus
STRRDEV

SEQ ID NO: 1987283 - protein, 9 aa, Staphylococcus
STRRDEVDK

SEQ ID NO: 1987284 - protein, 4 aa, Staphylococcus
STRV

SEQ ID NO: 1987285 - protein, 6 aa, Staphylococcus
STSADL

SEQ ID NO: 1987286 - protein, 5 aa, Staphylococcus
STSAE

SEQ ID NO: 1987287 - protein, 15 aa, Staphylococcus
STSAGIQSEADKVER

SEQ ID NO: 1987288 - protein, 13 aa, Staphylococcus
STSALDTHNKERV

SEQ ID NO: 1987289 - protein, 13 aa, Staphylococcus
STSALDTKNKENI

SEQ ID NO: 1987290 - protein, 9 aa, Staphylococcus
STSALDTQN

SEQ ID NO: 1987291 - protein, 13 aa, Staphylococcus
STSALDTQNKEKI

SEQ ID NO: 1987292 - protein, 5 aa, Staphylococcus
STSDA

SEQ ID NO: 1987293 - protein, 13 aa, Staphylococcus
STSEADQKIESDN

SEQ ID NO: 1987294 - protein, 5 aa, Staphylococcus
STSEI

SEQ ID NO: 1987295 - protein, 6 aa, Staphylococcus
STSEIT

SEQ ID NO: 1987296 - protein, 11 aa, Staphylococcus
STSEQSEHGYS

SEQ ID NO: 1987297 - protein, 17 aa, Staphylococcus
STSEQSEHGYSEKEQEQ

SEQ ID NO: 1987298 - protein, 16 aa, Staphylococcus
STSEQSEHGYSVKEQE

SEQ ID NO: 1987299 - protein, 13 aa, Staphylococcus
STSETVGYRKPHP

SEQ ID NO: 1987300 - protein, 14 aa, Staphylococcus
STSGGGVTVSGGEP

SEQ ID NO: 1987301 - protein, 4 aa, Staphylococcus
STSI

SEQ ID NO: 1987302 - protein, 16 aa, Staphylococcus
STSIDGKQATDYGQSQ

SEQ ID NO: 1987303 - protein, 9 aa, Staphylococcus
STSKEGGIE

SEQ ID NO: 1987304 - protein, 11 aa, Staphylococcus
STSKITGEEEI

SEQ ID NO: 1987305 - protein, 17 aa, Staphylococcus
STSLDGKQATDSGQSQW

SEQ ID NO: 1987306 - protein, 6 aa, Staphylococcus
STSLTP

SEQ ID NO: 1987307 - protein, 9 aa, Staphylococcus
STSNAQNVA

SEQ ID NO: 1987308 - protein, 6 aa, Staphylococcus
STSNDA

SEQ ID NO: 1987309 - protein, 4 aa, Staphylococcus
STSP

SEQ ID NO: 1987310 - protein, 5 aa, Staphylococcus
STSPF

SEQ ID NO: 1987311 - protein, 23 aa, Staphylococcus
STSPGIANEALRKERQAIDQARG

SEQ ID NO: 1987312 - protein, 17 aa, Staphylococcus
STSPGIENSDERQERQL

SEQ ID NO: 1987313 - protein, 22 aa, Staphylococcus
STSPGIHQADERLERQQIDAAR

SEQ ID NO: 1987314 - protein, 22 aa, Staphylococcus
STSPGIQSEEDRIERQQVDAAR

SEQ ID NO: 1987315 - protein, 7 aa, Staphylococcus
STSPIKD

SEQ ID NO: 1987316 - protein, 18 aa, Staphylococcus
STSPTKETYENGKQLGEA

SEQ ID NO: 1987317 - protein, 4 aa, Staphylococcus
STSQ

SEQ ID NO: 1987318 - protein, 10 aa, Staphylococcus
STSQDNVPDS

SEQ ID NO: 1987319 - protein, 10 aa, Staphylococcus
STSQEKLKGR

SEQ ID NO: 1987320 - protein, 11 aa, Staphylococcus
STSRPDVFNST

SEQ ID NO: 1987321 - protein, 7 aa, Staphylococcus
STSSDDL

SEQ ID NO: 1987322 - protein, 10 aa, Staphylococcus
STSSVADETQ

SEQ ID NO: 1987323 - protein, 5 aa, Staphylococcus
STSTD

SEQ ID NO: 1987324 - protein, 6 aa, Staphylococcus
STSTDF

SEQ ID NO: 1987325 - protein, 9 aa, Staphylococcus
STSVPGLKA

SEQ ID NO: 1987326 - protein, 8 aa, Staphylococcus
STSYSEPF

SEQ ID NO: 1987327 - protein, 7 aa, Staphylococcus
STTDNGL

SEQ ID NO: 1987328 - protein, 12 aa, Staphylococcus
STTDVEAKETDT

SEQ ID NO: 1987329 - protein, 20 aa, Staphylococcus
STTDVYSNPYNESSKALYTE

SEQ ID NO: 1987330 - protein, 9 aa, Staphylococcus
STTEEGEQF

SEQ ID NO: 1987331 - protein, 12 aa, Staphylococcus
STTEKEERKQLP

SEQ ID NO: 1987332 - protein, 4 aa, Staphylococcus
STTF

SEQ ID NO: 1987333 - protein, 5 aa, Staphylococcus
STTFA

SEQ ID NO: 1987334 - protein, 11 aa, Staphylococcus
STTFAEKVEEN

SEQ ID NO: 1987335 - protein, 10 aa, Staphylococcus
STTFAQKVEE

SEQ ID NO: 1987336 - protein, 6 aa, Staphylococcus
STTGEA

SEQ ID NO: 1987337 - protein, 10 aa, Staphylococcus
STTGKNGGFT

SEQ ID NO: 1987338 - protein, 8 aa, Staphylococcus
STTGRYTH

SEQ ID NO: 1987339 - protein, 9 aa, Staphylococcus
STTGYPVNN

SEQ ID NO: 1987340 - protein, 8 aa, Staphylococcus
STTHTGDA

SEQ ID NO: 1987341 - protein, 9 aa, Staphylococcus
STTHTTDDK

SEQ ID NO: 1987342 - protein, 6 aa, Staphylococcus
STTIDR

SEQ ID NO: 1987343 - protein, 12 aa, Staphylococcus
STTKKEIKKLKV

SEQ ID NO: 1987344 - protein, 12 aa, Staphylococcus
STTKKEIKQLKV

SEQ ID NO: 1987345 - protein, 8 aa, Staphylococcus
STTKNEIR

SEQ ID NO: 1987346 - protein, 11 aa, Staphylococcus
STTLKEEAPYE

SEQ ID NO: 1987347 - protein, 8 aa, Staphylococcus
STTLSSKK

SEQ ID NO: 1987348 - protein, 7 aa, Staphylococcus
STTNLER

SEQ ID NO: 1987349 - protein, 12 aa, Staphylococcus
STTRKAAAFPEP

SEQ ID NO: 1987350 - protein, 8 aa, Staphylococcus
STTSHKGK

SEQ ID NO: 1987351 - protein, 11 aa, Staphylococcus
STTSLEPRKKV

SEQ ID NO: 1987352 - protein, 6 aa, Staphylococcus
STTSLK

SEQ ID NO: 1987353 - protein, 6 aa, Staphylococcus
STTTGI

SEQ ID NO: 1987354 - protein, 7 aa, Staphylococcus
STTVTDG

SEQ ID NO: 1987355 - protein, 9 aa, Staphylococcus
STTYTNDKI

SEQ ID NO: 1987356 - protein, 11 aa, Staphylococcus
STVEDAIKGAQ

SEQ ID NO: 1987357 - protein, 10 aa, Staphylococcus
STVNKENNDM

SEQ ID NO: 1987358 - protein, 6 aa, Staphylococcus
STVPED

SEQ ID NO: 1987359 - protein, 13 aa, Staphylococcus
STVPEDFKGESKL

SEQ ID NO: 1987360 - protein, 14 aa, Staphylococcus
STVRVNTSRTDVET

SEQ ID NO: 1987361 - protein, 4 aa, Staphylococcus
STVS

SEQ ID NO: 1987362 - protein, 6 aa, Staphylococcus
STVSED

SEQ ID NO: 1987363 - protein, 6 aa, Staphylococcus
STVTSN

SEQ ID NO: 1987364 - protein, 8 aa, Staphylococcus
STVTTKYG

SEQ ID NO: 1987365 - protein, 4 aa, Staphylococcus
STYA

SEQ ID NO: 1987366 - protein, 7 aa, Staphylococcus
STYDGQK

SEQ ID NO: 1987367 - protein, 14 aa, Staphylococcus
STYDSSKEINENER

SEQ ID NO: 1987368 - protein, 14 aa, Staphylococcus
STYEREKSLPEDEF

SEQ ID NO: 1987369 - protein, 13 aa, Staphylococcus
STYEVPERKVEDV

SEQ ID NO: 1987370 - protein, 13 aa, Staphylococcus
STYNKVKKSQCNY

SEQ ID NO: 1987371 - protein, 6 aa, Staphylococcus
STYQDN

SEQ ID NO: 1987372 - protein, 7 aa, Staphylococcus
STYQDNE

SEQ ID NO: 1987373 - protein, 16 aa, Staphylococcus
STYRAQNRGGRGVQGM

SEQ ID NO: 1987374 - protein, 16 aa, Staphylococcus
STYRSQHRGGRGVQGM

SEQ ID NO: 1987375 - protein, 9 aa, Staphylococcus
SVADKAKLG

SEQ ID NO: 1987376 - protein, 4 aa, Staphylococcus
SVAE

SEQ ID NO: 1987377 - protein, 15 aa, Staphylococcus
SVAEKKAPGAKIQGN

SEQ ID NO: 1987378 - protein, 7 aa, Staphylococcus
SVANTLT

SEQ ID NO: 1987379 - protein, 13 aa, Staphylococcus
SVAPRTGNISAGT

SEQ ID NO: 1987380 - protein, 13 aa, Staphylococcus
SVAPRTGNVSAGT

SEQ ID NO: 1987381 - protein, 27 aa, Staphylococcus
SVASGIPDFRSSGGLYDDVSKDGYAPE

SEQ ID NO: 1987382 - protein, 6 aa, Staphylococcus
SVDDDQ

SEQ ID NO: 1987383 - protein, 10 aa, Staphylococcus
SVDDDREWNY

SEQ ID NO: 1987384 - protein, 10 aa, Staphylococcus
SVDDDSNWTY

SEQ ID NO: 1987385 - protein, 7 aa, Staphylococcus
SVDDDTE

SEQ ID NO: 1987386 - protein, 15 aa, Staphylococcus
SVDDFNERKPRTRIS

SEQ ID NO: 1987387 - protein, 7 aa, Staphylococcus
SVDDNSQ

SEQ ID NO: 1987388 - protein, 9 aa, Staphylococcus
SVDDTYKAR

SEQ ID NO: 1987389 - protein, 5 aa, Staphylococcus
SVDEE

SEQ ID NO: 1987390 - protein, 7 aa, Staphylococcus
SVDETAA

SEQ ID NO: 1987391 - protein, 5 aa, Staphylococcus
SVDEV

SEQ ID NO: 1987392 - protein, 13 aa, Staphylococcus
SVDGPNSKEINQN

SEQ ID NO: 1987393 - protein, 9 aa, Staphylococcus
SVDGSTGDL

SEQ ID NO: 1987394 - protein, 10 aa, Staphylococcus
SVDKDSERIS

SEQ ID NO: 1987395 - protein, 5 aa, Staphylococcus
SVDKE

SEQ ID NO: 1987396 - protein, 17 aa, Staphylococcus
SVDKEGKPSRMNPPYQQ

SEQ ID NO: 1987397 - protein, 6 aa, Staphylococcus
SVDQVD

SEQ ID NO: 1987398 - protein, 16 aa, Staphylococcus
SVDSRTILDSGGAERL

SEQ ID NO: 1987399 - protein, 4 aa, Staphylococcus
SVDT

SEQ ID NO: 1987400 - protein, 5 aa, Staphylococcus
SVDTD

SEQ ID NO: 1987401 - protein, 7 aa, Staphylococcus
SVDTKQN

SEQ ID NO: 1987402 - protein, 4 aa, Staphylococcus
SVED

SEQ ID NO: 1987403 - protein, 7 aa, Staphylococcus
SVEDENA

SEQ ID NO: 1987404 - protein, 13 aa, Staphylococcus
SVEDGQGTLSDAV

SEQ ID NO: 1987405 - protein, 9 aa, Staphylococcus
SVEDTYKAR

SEQ ID NO: 1987406 - protein, 9 aa, Staphylococcus
SVEDTYKSR

SEQ ID NO: 1987407 - protein, 4 aa, Staphylococcus
SVEE

SEQ ID NO: 1987408 - protein, 7 aa, Staphylococcus
SVEEAIN

SEQ ID NO: 1987409 - protein, 6 aa, Staphylococcus
SVEERK

SEQ ID NO: 1987410 - protein, 6 aa, Staphylococcus
SVEERR

SEQ ID NO: 1987411 - protein, 9 aa, Staphylococcus
SVEGDSPSV

SEQ ID NO: 1987412 - protein, 26 aa, Staphylococcus
SVEGRSAKIEGKSELQGAQVKATDLR

SEQ ID NO: 1987413 - protein, 5 aa, Staphylococcus
SVEIP

SEQ ID NO: 1987414 - protein, 6 aa, Staphylococcus
SVEKQD

SEQ ID NO: 1987415 - protein, 10 aa, Staphylococcus
SVENGETYKY

SEQ ID NO: 1987416 - protein, 12 aa, Staphylococcus
SVENKKSQAIPE

SEQ ID NO: 1987417 - protein, 6 aa, Staphylococcus
SVEPTD

SEQ ID NO: 1987418 - protein, 10 aa, Staphylococcus
SVEQASNNYQ

SEQ ID NO: 1987419 - protein, 6 aa, Staphylococcus
SVEQLE

SEQ ID NO: 1987420 - protein, 7 aa, Staphylococcus
SVEQLEE

SEQ ID NO: 1987421 - protein, 9 aa, Staphylococcus
SVEQTPYYE

SEQ ID NO: 1987422 - protein, 6 aa, Staphylococcus
SVERQS

SEQ ID NO: 1987423 - protein, 18 aa, Staphylococcus
SVESTDMKVQSTSGTFSD

SEQ ID NO: 1987424 - protein, 15 aa, Staphylococcus
SVESTQTIAKQGLVD

SEQ ID NO: 1987425 - protein, 11 aa, Staphylococcus
SVETDEDISKE

SEQ ID NO: 1987426 - protein, 15 aa, Staphylococcus
SVETSMDKILADAKQ

SEQ ID NO: 1987427 - protein, 12 aa, Staphylococcus
SVFPTQEAAQQA

SEQ ID NO: 1987428 - protein, 17 aa, Staphylococcus
SVGEKDVVTTSRFPGTT

SEQ ID NO: 1987429 - protein, 8 aa, Staphylococcus
SVGEQLKG

SEQ ID NO: 1987430 - protein, 7 aa, Staphylococcus
SVGETAE

SEQ ID NO: 1987431 - protein, 9 aa, Staphylococcus
SVGETAEQV

SEQ ID NO: 1987432 - protein, 17 aa, Staphylococcus
SVGETGPVRSPGRREIG

SEQ ID NO: 1987433 - protein, 23 aa, Staphylococcus
SVGGEDKSANDVKGIPSGTPQAG

SEQ ID NO: 1987434 - protein, 6 aa, Staphylococcus
SVGGTQ

SEQ ID NO: 1987435 - protein, 23 aa, Staphylococcus
SVGGTTDEEVKEVAQTSFKENTF

SEQ ID NO: 1987436 - protein, 9 aa, Staphylococcus
SVGGTTPSF

SEQ ID NO: 1987437 - protein, 5 aa, Staphylococcus
SVGKN

SEQ ID NO: 1987438 - protein, 13 aa, Staphylococcus
SVGKVKKSSHTQE

SEQ ID NO: 1987439 - protein, 7 aa, Staphylococcus
SVGLNNG

SEQ ID NO: 1987440 - protein, 12 aa, Staphylococcus
SVGLSAEQAEAL

SEQ ID NO: 1987441 - protein, 17 aa, Staphylococcus
SVGLSESQAKEAGYDVS

SEQ ID NO: 1987442 - protein, 7 aa, Staphylococcus
SVGNSEV

SEQ ID NO: 1987443 - protein, 8 aa, Staphylococcus
SVGNTEQG

SEQ ID NO: 1987444 - protein, 14 aa, Staphylococcus
SVGPKLGNKTKNIQ

SEQ ID NO: 1987445 - protein, 6 aa, Staphylococcus
SVGSQI

SEQ ID NO: 1987446 - protein, 10 aa, Staphylococcus
SVGTASFENG

SEQ ID NO: 1987447 - protein, 8 aa, Staphylococcus
SVGTERTF

SEQ ID NO: 1987448 - protein, 8 aa, Staphylococcus
SVGTSEGG

SEQ ID NO: 1987449 - protein, 7 aa, Staphylococcus
SVGYGAN

SEQ ID NO: 1987450 - protein, 7 aa, Staphylococcus
SVHPNVS

SEQ ID NO: 1987451 - protein, 6 aa, Staphylococcus
SVIKNE

SEQ ID NO: 1987452 - protein, 5 aa, Staphylococcus
SVISG

SEQ ID NO: 1987453 - protein, 11 aa, Staphylococcus
SVKENGKEVNI

SEQ ID NO: 1987454 - protein, 7 aa, Staphylococcus
SVKERKE

SEQ ID NO: 1987455 - protein, 7 aa, Staphylococcus
SVKERQD

SEQ ID NO: 1987456 - protein, 11 aa, Staphylococcus
SVKGARSNNLK

SEQ ID NO: 1987457 - protein, 8 aa, Staphylococcus
SVKKEQQE

SEQ ID NO: 1987458 - protein, 8 aa, Staphylococcus
SVKKRSNG

SEQ ID NO: 1987459 - protein, 10 aa, Staphylococcus
SVKKSSHEYY

SEQ ID NO: 1987460 - protein, 6 aa, Staphylococcus
SVKKTG

SEQ ID NO: 1987461 - protein, 6 aa, Staphylococcus
SVKNKD

SEQ ID NO: 1987462 - protein, 17 aa, Staphylococcus
SVKNNKQQQIWNVIEKY

SEQ ID NO: 1987463 - protein, 7 aa, Staphylococcus
SVKNNNI

SEQ ID NO: 1987464 - protein, 18 aa, Staphylococcus
SVKNPTYEQVKSGTTGHY

SEQ ID NO: 1987465 - protein, 8 aa, Staphylococcus
SVKNRETQ

SEQ ID NO: 1987466 - protein, 6 aa, Staphylococcus
SVKPQY

SEQ ID NO: 1987467 - protein, 7 aa, Staphylococcus
SVKQLEE

SEQ ID NO: 1987468 - protein, 4 aa, Staphylococcus
SVKS

SEQ ID NO: 1987469 - protein, 7 aa, Staphylococcus
SVKSGSV

SEQ ID NO: 1987470 - protein, 26 aa, Staphylococcus
SVKVGAPTVEGATVSATVNKQGRGKK

SEQ ID NO: 1987471 - protein, 26 aa, Staphylococcus
SVKVGAPTVEGATVTATVNKNGRGKK

SEQ ID NO: 1987472 - protein, 16 aa, Staphylococcus
SVLDDKNAMGIIQSKM

SEQ ID NO: 1987473 - protein, 5 aa, Staphylococcus
SVLSS

SEQ ID NO: 1987474 - protein, 7 aa, Staphylococcus
SVNDERA

SEQ ID NO: 1987475 - protein, 8 aa, Staphylococcus
SVNDKAGI

SEQ ID NO: 1987476 - protein, 6 aa, Staphylococcus
SVNDNE

SEQ ID NO: 1987477 - protein, 10 aa, Staphylococcus
SVNDTHKSRY

SEQ ID NO: 1987478 - protein, 5 aa, Staphylococcus
SVNEL

SEQ ID NO: 1987479 - protein, 11 aa, Staphylococcus
SVNEQERAELK

SEQ ID NO: 1987480 - protein, 8 aa, Staphylococcus
SVNETSKM

SEQ ID NO: 1987481 - protein, 12 aa, Staphylococcus
SVNGATAAETAG

SEQ ID NO: 1987482 - protein, 9 aa, Staphylococcus
SVNGATAAF

SEQ ID NO: 1987483 - protein, 10 aa, Staphylococcus
SVNGATAANL

SEQ ID NO: 1987484 - protein, 11 aa, Staphylococcus
SVNGATAAVTA

SEQ ID NO: 1987485 - protein, 4 aa, Staphylococcus
SVNI

SEQ ID NO: 1987486 - protein, 13 aa, Staphylococcus
SVNITGKVAEETL

SEQ ID NO: 1987487 - protein, 8 aa, Staphylococcus
SVNKKDYV

SEQ ID NO: 1987488 - protein, 7 aa, Staphylococcus
SVNKPEA

SEQ ID NO: 1987489 - protein, 10 aa, Staphylococcus
SVNKQGQDVG

SEQ ID NO: 1987490 - protein, 22 aa, Staphylococcus
SVNKYKDSIRNVGSTMRSVGST

SEQ ID NO: 1987491 - protein, 14 aa, Staphylococcus
SVNLTGKQAEETLD

SEQ ID NO: 1987492 - protein, 5 aa, Staphylococcus
SVNNQ

SEQ ID NO: 1987493 - protein, 4 aa, Staphylococcus
SVNP

SEQ ID NO: 1987494 - protein, 15 aa, Staphylococcus
SVNPEELNPENQSKL

SEQ ID NO: 1987495 - protein, 8 aa, Staphylococcus
SVNPGGGM

SEQ ID NO: 1987496 - protein, 5 aa, Staphylococcus
SVNPI

SEQ ID NO: 1987497 - protein, 15 aa, Staphylococcus
SVNPNDLDPNKQSKL

SEQ ID NO: 1987498 - protein, 14 aa, Staphylococcus
SVNPNDLDPNKQSR

SEQ ID NO: 1987499 - protein, 6 aa, Staphylococcus
SVNPNN

SEQ ID NO: 1987500 - protein, 6 aa, Staphylococcus
SVNPNT

SEQ ID NO: 1987501 - protein, 8 aa, Staphylococcus
SVNQDNPT

SEQ ID NO: 1987502 - protein, 12 aa, Staphylococcus
SVNQLDENVENY

SEQ ID NO: 1987503 - protein, 6 aa, Staphylococcus
SVNSDT

SEQ ID NO: 1987504 - protein, 9 aa, Staphylococcus
SVNSNGSIR

SEQ ID NO: 1987505 - protein, 13 aa, Staphylococcus
SVNVPDDSTIIEP

SEQ ID NO: 1987506 - protein, 7 aa, Staphylococcus
SVPEDIQ

SEQ ID NO: 1987507 - protein, 9 aa, Staphylococcus
SVPERDTAK

SEQ ID NO: 1987508 - protein, 13 aa, Staphylococcus
SVPGRHNDDSSTI

SEQ ID NO: 1987509 - protein, 4 aa, Staphylococcus
SVPH

SEQ ID NO: 1987510 - protein, 11 aa, Staphylococcus
SVPKSIPDDAY

SEQ ID NO: 1987511 - protein, 12 aa, Staphylococcus
SVPNNKKEKRVT

SEQ ID NO: 1987512 - protein, 7 aa, Staphylococcus
SVPQNER

SEQ ID NO: 1987513 - protein, 20 aa, Staphylococcus
SVPTSRKSAFKDRKKAQDAR

SEQ ID NO: 1987514 - protein, 20 aa, Staphylococcus
SVPTSRKSPFPERKKAQDAR

SEQ ID NO: 1987515 - protein, 19 aa, Staphylococcus
SVPTSRKSPFSERKQKQYA

SEQ ID NO: 1987516 - protein, 5 aa, Staphylococcus
SVPVT

SEQ ID NO: 1987517 - protein, 4 aa, Staphylococcus
SVQD

SEQ ID NO: 1987518 - protein, 12 aa, Staphylococcus
SVQELTDEAASE

SEQ ID NO: 1987519 - protein, 14 aa, Staphylococcus
SVQGGKGQKNGNTY

SEQ ID NO: 1987520 - protein, 9 aa, Staphylococcus
SVQGYNPSP

SEQ ID NO: 1987521 - protein, 6 aa, Staphylococcus
SVQNTQ

SEQ ID NO: 1987522 - protein, 9 aa, Staphylococcus
SVQRAPLKE

SEQ ID NO: 1987523 - protein, 7 aa, Staphylococcus
SVQSQEM

SEQ ID NO: 1987524 - protein, 21 aa, Staphylococcus
SVRDDNQASEEAPVGPGPREA

SEQ ID NO: 1987525 - protein, 21 aa, Staphylococcus
SVRDDSKANDDAPVGPGPKEA

SEQ ID NO: 1987526 - protein, 21 aa, Staphylococcus
SVRDDSKASDETPVGPGPRQA

SEQ ID NO: 1987527 - protein, 21 aa, Staphylococcus
SVRDDSKASEDAPVGPGPRQA

SEQ ID NO: 1987528 - protein, 21 aa, Staphylococcus
SVRDDSKATSDAPLGPGPKAA

SEQ ID NO: 1987529 - protein, 21 aa, Staphylococcus
SVREDDKASAENPVGPGPRQA

SEQ ID NO: 1987530 - protein, 10 aa, Staphylococcus
SVRKGKGLTE

SEQ ID NO: 1987531 - protein, 7 aa, Staphylococcus
SVRPDMD

SEQ ID NO: 1987532 - protein, 8 aa, Staphylococcus
SVRSGSQI

SEQ ID NO: 1987533 - protein, 9 aa, Staphylococcus
SVRTPTGKP

SEQ ID NO: 1987534 - protein, 5 aa, Staphylococcus
SVSAN

SEQ ID NO: 1987535 - protein, 7 aa, Staphylococcus
SVSARTA

SEQ ID NO: 1987536 - protein, 10 aa, Staphylococcus
SVSDDRGRKV

SEQ ID NO: 1987537 - protein, 11 aa, Staphylococcus
SVSDLKPVNQK

SEQ ID NO: 1987538 - protein, 6 aa, Staphylococcus
SVSDSD

SEQ ID NO: 1987539 - protein, 5 aa, Staphylococcus
SVSEK

SEQ ID NO: 1987540 - protein, 7 aa, Staphylococcus
SVSELEK

SEQ ID NO: 1987541 - protein, 12 aa, Staphylococcus
SVSEYGENDGQT

SEQ ID NO: 1987542 - protein, 6 aa, Staphylococcus
SVSIAN

SEQ ID NO: 1987543 - protein, 9 aa, Staphylococcus
SVSKQPALK

SEQ ID NO: 1987544 - protein, 11 aa, Staphylococcus
SVSNKRNNKVY

SEQ ID NO: 1987545 - protein, 10 aa, Staphylococcus
SVSNKVDQSI

SEQ ID NO: 1987546 - protein, 7 aa, Staphylococcus
SVSNNNI

SEQ ID NO: 1987547 - protein, 9 aa, Staphylococcus
SVSNSRNNH

SEQ ID NO: 1987548 - protein, 23 aa, Staphylococcus
SVSPNESLKGKKDIEIELSAPDA

SEQ ID NO: 1987549 - protein, 5 aa, Staphylococcus
SVSQA

SEQ ID NO: 1987550 - protein, 11 aa, Staphylococcus
SVSQETINDSY

SEQ ID NO: 1987551 - protein, 8 aa, Staphylococcus
SVSREKAS

SEQ ID NO: 1987552 - protein, 6 aa, Staphylococcus
SVSSGQ

SEQ ID NO: 1987553 - protein, 15 aa, Staphylococcus
SVSSGSACTAGSTMP

SEQ ID NO: 1987554 - protein, 6 aa, Staphylococcus
SVSSQV

SEQ ID NO: 1987555 - protein, 18 aa, Staphylococcus
SVSTKQIAEGLKKQHDIK

SEQ ID NO: 1987556 - protein, 9 aa, Staphylococcus
SVSTKQIAQ

SEQ ID NO: 1987557 - protein, 10 aa, Staphylococcus
SVSTKQITQA

SEQ ID NO: 1987558 - protein, 12 aa, Staphylococcus
SVSTNGASPKLN

SEQ ID NO: 1987559 - protein, 6 aa, Staphylococcus
SVTAED

SEQ ID NO: 1987560 - protein, 5 aa, Staphylococcus
SVTAS

SEQ ID NO: 1987561 - protein, 4 aa, Staphylococcus
SVTD

SEQ ID NO: 1987562 - protein, 19 aa, Staphylococcus
SVTDLTRENAKEMIAQNHR

SEQ ID NO: 1987563 - protein, 19 aa, Staphylococcus
SVTDLTRENAKEMIAQNQR

SEQ ID NO: 1987564 - protein, 14 aa, Staphylococcus
SVTEGHPDKIADQI

SEQ ID NO: 1987565 - protein, 12 aa, Staphylococcus
SVTEGSDAQAQV

SEQ ID NO: 1987566 - protein, 18 aa, Staphylococcus
SVTELTRENAREMIAQNH

SEQ ID NO: 1987567 - protein, 21 aa, Staphylococcus
SVTELTRQNAKEMIEQNQRLR

SEQ ID NO: 1987568 - protein, 6 aa, Staphylococcus
SVTEYD

SEQ ID NO: 1987569 - protein, 6 aa, Staphylococcus
SVTGAI

SEQ ID NO: 1987570 - protein, 8 aa, Staphylococcus
SVTGTDFP

SEQ ID NO: 1987571 - protein, 10 aa, Staphylococcus
SVTKNKEGIG

SEQ ID NO: 1987572 - protein, 9 aa, Staphylococcus
SVTKSDVQQ

SEQ ID NO: 1987573 - protein, 8 aa, Staphylococcus
SVTKSSLP

SEQ ID NO: 1987574 - protein, 4 aa, Staphylococcus
SVTL

SEQ ID NO: 1987575 - protein, 17 aa, Staphylococcus
SVTLTTGSFKGSEEQEI

SEQ ID NO: 1987576 - protein, 22 aa, Staphylococcus
SVTNANPLNTIDDATKLIMRGD

SEQ ID NO: 1987577 - protein, 12 aa, Staphylococcus
SVTNDSVDNKIN

SEQ ID NO: 1987578 - protein, 10 aa, Staphylococcus
SVTNESIHEE

SEQ ID NO: 1987579 - protein, 17 aa, Staphylococcus
SVTNKNQQVIWDAIERY

SEQ ID NO: 1987580 - protein, 11 aa, Staphylococcus
SVTNKSIHNQI

SEQ ID NO: 1987581 - protein, 4 aa, Staphylococcus
SVTP

SEQ ID NO: 1987582 - protein, 5 aa, Staphylococcus
SVTPD

SEQ ID NO: 1987583 - protein, 5 aa, Staphylococcus
SVTPH

SEQ ID NO: 1987584 - protein, 8 aa, Staphylococcus
SVTPQRIE

SEQ ID NO: 1987585 - protein, 8 aa, Staphylococcus
SVTPSRIE

SEQ ID NO: 1987586 - protein, 8 aa, Staphylococcus
SVTPSRIK

SEQ ID NO: 1987587 - protein, 6 aa, Staphylococcus
SVTRSL

SEQ ID NO: 1987588 - protein, 6 aa, Staphylococcus
SVTSGY

SEQ ID NO: 1987589 - protein, 5 aa, Staphylococcus
SVTSK

SEQ ID NO: 1987590 - protein, 9 aa, Staphylococcus
SVTSSRIEE

SEQ ID NO: 1987591 - protein, 5 aa, Staphylococcus
SVTTK

SEQ ID NO: 1987592 - protein, 14 aa, Staphylococcus
SVYGKGKKHQVPEE

SEQ ID NO: 1987593 - protein, 10 aa, Staphylococcus
SVYNDPEQTR

SEQ ID NO: 1987594 - protein, 7 aa, Staphylococcus
SVYPKLE

SEQ ID NO: 1987595 - protein, 13 aa, Staphylococcus
SVYTEGPSQGQTY

SEQ ID NO: 1987596 - protein, 14 aa, Staphylococcus
SVYTNTDGQTITAE

SEQ ID NO: 1987597 - protein, 9 aa, Staphylococcus
SWASQTGNT

SEQ ID NO: 1987598 - protein, 9 aa, Staphylococcus
SWEASEDGK

SEQ ID NO: 1987599 - protein, 10 aa, Staphylococcus
SWGKTPKEER

SEQ ID NO: 1987600 - protein, 4 aa, Staphylococcus
SWNG

SEQ ID NO: 1987601 - protein, 7 aa, Staphylococcus
SWNQETI

SEQ ID NO: 1987602 - protein, 5 aa, Staphylococcus
SWQDS

SEQ ID NO: 1987603 - protein, 4 aa, Staphylococcus
SWQN

SEQ ID NO: 1987604 - protein, 5 aa, Staphylococcus
SWSHD

SEQ ID NO: 1987605 - protein, 7 aa, Staphylococcus
SWSTPEG

SEQ ID NO: 1987606 - protein, 4 aa, Staphylococcus
SWTD

SEQ ID NO: 1987607 - protein, 4 aa, Staphylococcus
SWTG

SEQ ID NO: 1987608 - protein, 10 aa, Staphylococcus
SWTKSNGSDL

SEQ ID NO: 1987609 - protein, 9 aa, Staphylococcus
SWTKTQQVD

SEQ ID NO: 1987610 - protein, 5 aa, Staphylococcus
SWTQY

SEQ ID NO: 1987611 - protein, 10 aa, Staphylococcus
SYAKDQLEID

SEQ ID NO: 1987612 - protein, 17 aa, Staphylococcus
SYAKRKINEDSEYKEKW

SEQ ID NO: 1987613 - protein, 5 aa, Staphylococcus
SYAPA

SEQ ID NO: 1987614 - protein, 8 aa, Staphylococcus
SYAPDHLP

SEQ ID NO: 1987615 - protein, 11 aa, Staphylococcus
SYAPKPLPQTW

SEQ ID NO: 1987616 - protein, 9 aa, Staphylococcus
SYARSDQYE

SEQ ID NO: 1987617 - protein, 7 aa, Staphylococcus
SYATSEN

SEQ ID NO: 1987618 - protein, 15 aa, Staphylococcus
SYDASNDKQRRELDE

SEQ ID NO: 1987619 - protein, 4 aa, Staphylococcus
SYDD

SEQ ID NO: 1987620 - protein, 6 aa, Staphylococcus
SYDDKE

SEQ ID NO: 1987621 - protein, 12 aa, Staphylococcus
SYDDSEKSKELK

SEQ ID NO: 1987622 - protein, 5 aa, Staphylococcus
SYDIP

SEQ ID NO: 1987623 - protein, 7 aa, Staphylococcus
SYDKGEL

SEQ ID NO: 1987624 - protein, 5 aa, Staphylococcus
SYDPA

SEQ ID NO: 1987625 - protein, 4 aa, Staphylococcus
SYDQ

SEQ ID NO: 1987626 - protein, 9 aa, Staphylococcus
SYDRPYDDF

SEQ ID NO: 1987627 - protein, 12 aa, Staphylococcus
SYDRPYEELQNG

SEQ ID NO: 1987628 - protein, 8 aa, Staphylococcus
SYDRPYEQ

SEQ ID NO: 1987629 - protein, 12 aa, Staphylococcus
SYDRPYKSLEEG

SEQ ID NO: 1987630 - protein, 4 aa, Staphylococcus
SYDS

SEQ ID NO: 1987631 - protein, 10 aa, Staphylococcus
SYDSEDDAQF

SEQ ID NO: 1987632 - protein, 6 aa, Staphylococcus
SYDTAK

SEQ ID NO: 1987633 - protein, 6 aa, Staphylococcus
SYDYPY

SEQ ID NO: 1987634 - protein, 5 aa, Staphylococcus
SYEDD

SEQ ID NO: 1987635 - protein, 6 aa, Staphylococcus
SYEDSL

SEQ ID NO: 1987636 - protein, 6 aa, Staphylococcus
SYEERA

SEQ ID NO: 1987637 - protein, 7 aa, Staphylococcus
SYEESDE

SEQ ID NO: 1987638 - protein, 5 aa, Staphylococcus
SYEEY

SEQ ID NO: 1987639 - protein, 4 aa, Staphylococcus
SYEG

SEQ ID NO: 1987640 - protein, 6 aa, Staphylococcus
SYEGET

SEQ ID NO: 1987641 - protein, 9 aa, Staphylococcus
SYEGPHQFK

SEQ ID NO: 1987642 - protein, 5 aa, Staphylococcus
SYEHT

SEQ ID NO: 1987643 - protein, 7 aa, Staphylococcus
SYENETL

SEQ ID NO: 1987644 - protein, 16 aa, Staphylococcus
SYEPGKEDGLHPNAKG

SEQ ID NO: 1987645 - protein, 7 aa, Staphylococcus
SYEPRVS

SEQ ID NO: 1987646 - protein, 7 aa, Staphylococcus
SYEPTQK

SEQ ID NO: 1987647 - protein, 10 aa, Staphylococcus
SYEQATLNEP

SEQ ID NO: 1987648 - protein, 6 aa, Staphylococcus
SYEQTQ

SEQ ID NO: 1987649 - protein, 5 aa, Staphylococcus
SYESH

SEQ ID NO: 1987650 - protein, 7 aa, Staphylococcus
SYESKGN

SEQ ID NO: 1987651 - protein, 6 aa, Staphylococcus
SYETAS

SEQ ID NO: 1987652 - protein, 8 aa, Staphylococcus
SYETMGEE

SEQ ID NO: 1987653 - protein, 8 aa, Staphylococcus
SYETPSRL

SEQ ID NO: 1987654 - protein, 7 aa, Staphylococcus
SYETSSK

SEQ ID NO: 1987655 - protein, 4 aa, Staphylococcus
SYGA

SEQ ID NO: 1987656 - protein, 15 aa, Staphylococcus
SYGCSPRKYYQQHLT

SEQ ID NO: 1987657 - protein, 13 aa, Staphylococcus
SYGDDQKIALGET

SEQ ID NO: 1987658 - protein, 5 aa, Staphylococcus
SYGEM

SEQ ID NO: 1987659 - protein, 8 aa, Staphylococcus
SYGGSPTA

SEQ ID NO: 1987660 - protein, 11 aa, Staphylococcus
SYGKRTERHPR

SEQ ID NO: 1987661 - protein, 10 aa, Staphylococcus
SYGNRHRQQE

SEQ ID NO: 1987662 - protein, 6 aa, Staphylococcus
SYGRPF

SEQ ID NO: 1987663 - protein, 22 aa, Staphylococcus
SYGSTGQSSVQQQLDIIHKELS

SEQ ID NO: 1987664 - protein, 25 aa, Staphylococcus
SYGTKSGLIKEDKERLSGEDTREGM

SEQ ID NO: 1987665 - protein, 25 aa, Staphylococcus
SYGTKSKIIKEDKDRLSGEDTREGL

SEQ ID NO: 1987666 - protein, 10 aa, Staphylococcus
SYGYTPKEIR

SEQ ID NO: 1987667 - protein, 12 aa, Staphylococcus
SYHDHNKEQQTD

SEQ ID NO: 1987668 - protein, 12 aa, Staphylococcus
SYHEHNKEQQTN

SEQ ID NO: 1987669 - protein, 10 aa, Staphylococcus
SYHEKQNNLS

SEQ ID NO: 1987670 - protein, 10 aa, Staphylococcus
SYHPNSIQGS

SEQ ID NO: 1987671 - protein, 8 aa, Staphylococcus
SYHPSQQQ

SEQ ID NO: 1987672 - protein, 6 aa, Staphylococcus
SYIDES

SEQ ID NO: 1987673 - protein, 9 aa, Staphylococcus
SYIGKGPEQ

SEQ ID NO: 1987674 - protein, 14 aa, Staphylococcus
SYIPNKNDFKNDEN

SEQ ID NO: 1987675 - protein, 18 aa, Staphylococcus
SYKAGASDVKVNYSDSKL

SEQ ID NO: 1987676 - protein, 7 aa, Staphylococcus
SYKQSRK

SEQ ID NO: 1987677 - protein, 10 aa, Staphylococcus
SYKSKKEELA

SEQ ID NO: 1987678 - protein, 11 aa, Staphylococcus
SYKSKKEELED

SEQ ID NO: 1987679 - protein, 6 aa, Staphylococcus
SYLSAS

SEQ ID NO: 1987680 - protein, 7 aa, Staphylococcus
SYLSESE

SEQ ID NO: 1987681 - protein, 8 aa, Staphylococcus
SYLSPDDY

SEQ ID NO: 1987682 - protein, 5 aa, Staphylococcus
SYNAT

SEQ ID NO: 1987683 - protein, 6 aa, Staphylococcus
SYNATV

SEQ ID NO: 1987684 - protein, 14 aa, Staphylococcus
SYNHPEDDIGPRIQ

SEQ ID NO: 1987685 - protein, 13 aa, Staphylococcus
SYNHPEEDIGPRI

SEQ ID NO: 1987686 - protein, 13 aa, Staphylococcus
SYNHPERDIGPRI

SEQ ID NO: 1987687 - protein, 12 aa, Staphylococcus
SYNNLKEKAHGY

SEQ ID NO: 1987688 - protein, 8 aa, Staphylococcus
SYNNLSND

SEQ ID NO: 1987689 - protein, 8 aa, Staphylococcus
SYNQRKAE

SEQ ID NO: 1987690 - protein, 18 aa, Staphylococcus
SYNRNDNQIEISDTHAAK

SEQ ID NO: 1987691 - protein, 4 aa, Staphylococcus
SYNS

SEQ ID NO: 1987692 - protein, 5 aa, Staphylococcus
SYPDH

SEQ ID NO: 1987693 - protein, 5 aa, Staphylococcus
SYPDP

SEQ ID NO: 1987694 - protein, 12 aa, Staphylococcus
SYPEKGKTRRPY

SEQ ID NO: 1987695 - protein, 4 aa, Staphylococcus
SYPG

SEQ ID NO: 1987696 - protein, 8 aa, Staphylococcus
SYPGGPAI

SEQ ID NO: 1987697 - protein, 7 aa, Staphylococcus
SYPKGEF

SEQ ID NO: 1987698 - protein, 4 aa, Staphylococcus
SYPP

SEQ ID NO: 1987699 - protein, 6 aa, Staphylococcus
SYPPET

SEQ ID NO: 1987700 - protein, 5 aa, Staphylococcus
SYPPI

SEQ ID NO: 1987701 - protein, 5 aa, Staphylococcus
SYPQI

SEQ ID NO: 1987702 - protein, 5 aa, Staphylococcus
SYPQM

SEQ ID NO: 1987703 - protein, 6 aa, Staphylococcus
SYPQNT

SEQ ID NO: 1987704 - protein, 6 aa, Staphylococcus
SYPQQD

SEQ ID NO: 1987705 - protein, 5 aa, Staphylococcus
SYPTE

SEQ ID NO: 1987706 - protein, 5 aa, Staphylococcus
SYQAT

SEQ ID NO: 1987707 - protein, 9 aa, Staphylococcus
SYQERANYE

SEQ ID NO: 1987708 - protein, 4 aa, Staphylococcus
SYQF

SEQ ID NO: 1987709 - protein, 6 aa, Staphylococcus
SYQKGQ

SEQ ID NO: 1987710 - protein, 9 aa, Staphylococcus
SYQNEHNKK

SEQ ID NO: 1987711 - protein, 20 aa, Staphylococcus
SYQQDDRDVRDERRKQKLEP

SEQ ID NO: 1987712 - protein, 5 aa, Staphylococcus
SYQQQ

SEQ ID NO: 1987713 - protein, 13 aa, Staphylococcus
SYQSAQPIQQETS

SEQ ID NO: 1987714 - protein, 4 aa, Staphylococcus
SYRE

SEQ ID NO: 1987715 - protein, 6 aa, Staphylococcus
SYRGIT

SEQ ID NO: 1987716 - protein, 10 aa, Staphylococcus
SYRKEDNKKE

SEQ ID NO: 1987717 - protein, 11 aa, Staphylococcus
SYRNNTNIFGS

SEQ ID NO: 1987718 - protein, 19 aa, Staphylococcus
SYRNPETYKSTIGKEITDK

SEQ ID NO: 1987719 - protein, 8 aa, Staphylococcus
SYRNQGLA

SEQ ID NO: 1987720 - protein, 8 aa, Staphylococcus
SYRSEDLP

SEQ ID NO: 1987721 - protein, 8 aa, Staphylococcus
SYRSENLP

SEQ ID NO: 1987722 - protein, 12 aa, Staphylococcus
SYRSSAMHKSRI

SEQ ID NO: 1987723 - protein, 5 aa, Staphylococcus
SYRST

SEQ ID NO: 1987724 - protein, 6 aa, Staphylococcus
SYSERE

SEQ ID NO: 1987725 - protein, 7 aa, Staphylococcus
SYSESEA

SEQ ID NO: 1987726 - protein, 5 aa, Staphylococcus
SYSGN

SEQ ID NO: 1987727 - protein, 11 aa, Staphylococcus
SYSGNGKSRRR

SEQ ID NO: 1987728 - protein, 13 aa, Staphylococcus
SYSIKESKAISDK

SEQ ID NO: 1987729 - protein, 4 aa, Staphylococcus
SYSR

SEQ ID NO: 1987730 - protein, 21 aa, Staphylococcus
SYSSSISDTARKHSKDMADNN

SEQ ID NO: 1987731 - protein, 8 aa, Staphylococcus
SYSTDEVK

SEQ ID NO: 1987732 - protein, 23 aa, Staphylococcus
SYSTHTRSKIGGFNGRALKKDDH

SEQ ID NO: 1987733 - protein, 19 aa, Staphylococcus
SYTASGTKHNRLGLMAGHK

SEQ ID NO: 1987734 - protein, 10 aa, Staphylococcus
SYTASKNNPW

SEQ ID NO: 1987735 - protein, 19 aa, Staphylococcus
SYTDAGTKHGRLGLMAGHK

SEQ ID NO: 1987736 - protein, 19 aa, Staphylococcus
SYTDAGTKYGRLGLMAGHK

SEQ ID NO: 1987737 - protein, 6 aa, Staphylococcus
SYTDEK

SEQ ID NO: 1987738 - protein, 13 aa, Staphylococcus
SYTDPKTGTTTSA

SEQ ID NO: 1987739 - protein, 19 aa, Staphylococcus
SYTDSGTKHGRLGLMAGHK

SEQ ID NO: 1987740 - protein, 19 aa, Staphylococcus
SYTEAGTKHGRLGLMAGHK

SEQ ID NO: 1987741 - protein, 8 aa, Staphylococcus
SYTERLQR

SEQ ID NO: 1987742 - protein, 7 aa, Staphylococcus
SYTETLG

SEQ ID NO: 1987743 - protein, 6 aa, Staphylococcus
SYTGQG

SEQ ID NO: 1987744 - protein, 10 aa, Staphylococcus
SYTKHTSTAI

SEQ ID NO: 1987745 - protein, 44 aa, Staphylococcus
SYTNATDEEMKQFNEAKKQKYGQNQEDNNQNTNGNQEETQEEIN

SEQ ID NO: 1987746 - protein, 13 aa, Staphylococcus
SYTNLSKAEDNRK

SEQ ID NO: 1987747 - protein, 18 aa, Staphylococcus
SYTNTDVSEDLNKSTIQA

SEQ ID NO: 1987748 - protein, 13 aa, Staphylococcus
SYTPDDEQENDDQ

SEQ ID NO: 1987749 - protein, 9 aa, Staphylococcus
SYTRHTNTA

SEQ ID NO: 1987750 - protein, 7 aa, Staphylococcus
SYTSLKK

SEQ ID NO: 1987751 - protein, 10 aa, Staphylococcus
SYTSRSDQLQ

SEQ ID NO: 1987752 - protein, 5 aa, Staphylococcus
SYTSS

SEQ ID NO: 1987753 - protein, 10 aa, Staphylococcus
SYTTEADIET

SEQ ID NO: 1987754 - protein, 11 aa, Staphylococcus
SYVESDAGTFN

SEQ ID NO: 1987755 - protein, 7 aa, Staphylococcus
SYVNGDQ

SEQ ID NO: 1987756 - protein, 8 aa, Staphylococcus
SYVNGNGQ

SEQ ID NO: 1987757 - protein, 7 aa, Staphylococcus
SYVNGNQ

SEQ ID NO: 1987758 - protein, 9 aa, Staphylococcus
SYVNGNQQP

SEQ ID NO: 1987759 - protein, 4 aa, Staphylococcus
SYYE

SEQ ID NO: 1987760 - protein, 13 aa, Staphylococcus
SYYEGYPIGSDQL

SEQ ID NO: 1987761 - protein, 9 aa, Staphylococcus
SYYEPDESD

SEQ ID NO: 1987762 - protein, 10 aa, Staphylococcus
SYYNSAYNSV

SEQ ID NO: 1987763 - protein, 15 aa, Staphylococcus
SYYQEAGRAGRDGLN

SEQ ID NO: 1987764 - protein, 18 aa, Staphylococcus
SYYTDKPWRGQMATAGGG

SEQ ID NO: 1987765 - protein, 6 aa, Staphylococcus
TAADAS

SEQ ID NO: 1987766 - protein, 9 aa, Staphylococcus
TAADGGEAY

SEQ ID NO: 1987767 - protein, 10 aa, Staphylococcus
TAADNATDYR

SEQ ID NO: 1987768 - protein, 18 aa, Staphylococcus
TAAEKLNTKSNGFYTFDN

SEQ ID NO: 1987769 - protein, 6 aa, Staphylococcus
TAAERA

SEQ ID NO: 1987770 - protein, 7 aa, Staphylococcus
TAAKHED

SEQ ID NO: 1987771 - protein, 16 aa, Staphylococcus
TAAKRAREIDEKPESA

SEQ ID NO: 1987772 - protein, 16 aa, Staphylococcus
TAAKRARELDEKANTA

SEQ ID NO: 1987773 - protein, 15 aa, Staphylococcus
TAAKRARELDEKHET

SEQ ID NO: 1987774 - protein, 16 aa, Staphylococcus
TAAKRARELDEKPETA

SEQ ID NO: 1987775 - protein, 16 aa, Staphylococcus
TAAKRARELDERPETA

SEQ ID NO: 1987776 - protein, 30 aa, Staphylococcus
TAAKRARELDERPETALETEYHSAKPVGKA

SEQ ID NO: 1987777 - protein, 7 aa, Staphylococcus
TAALTTS

SEQ ID NO: 1987778 - protein, 8 aa, Staphylococcus
TAAQAEAR

SEQ ID NO: 1987779 - protein, 16 aa, Staphylococcus
TAAQNGKFDQAESLVE

SEQ ID NO: 1987780 - protein, 10 aa, Staphylococcus
TAARELASRG

SEQ ID NO: 1987781 - protein, 5 aa, Staphylococcus
TAASG

SEQ ID NO: 1987782 - protein, 8 aa, Staphylococcus
TAASKRIK

SEQ ID NO: 1987783 - protein, 18 aa, Staphylococcus
TAAYQAEGATQADGKGRV

SEQ ID NO: 1987784 - protein, 4 aa, Staphylococcus
TADA

SEQ ID NO: 1987785 - protein, 8 aa, Staphylococcus
TADATGVD

SEQ ID NO: 1987786 - protein, 8 aa, Staphylococcus
TADDPKLR

SEQ ID NO: 1987787 - protein, 4 aa, Staphylococcus
TADE

SEQ ID NO: 1987788 - protein, 10 aa, Staphylococcus
TADNEATDEF

SEQ ID NO: 1987789 - protein, 5 aa, Staphylococcus
TADPY

SEQ ID NO: 1987790 - protein, 8 aa, Staphylococcus
TADQSKSI

SEQ ID NO: 1987791 - protein, 16 aa, Staphylococcus
TADRSKDLQPTRDTLD

SEQ ID NO: 1987792 - protein, 13 aa, Staphylococcus
TADSAEQKSIAEI

SEQ ID NO: 1987793 - protein, 7 aa, Staphylococcus
TADSTQI

SEQ ID NO: 1987794 - protein, 11 aa, Staphylococcus
TAEDGLKTQDF

SEQ ID NO: 1987795 - protein, 11 aa, Staphylococcus
TAEDGVKTQDF

SEQ ID NO: 1987796 - protein, 6 aa, Staphylococcus
TAEDRG

SEQ ID NO: 1987797 - protein, 11 aa, Staphylococcus
TAEEEPGENDE

SEQ ID NO: 1987798 - protein, 12 aa, Staphylococcus
TAEEPKSYTVKP

SEQ ID NO: 1987799 - protein, 5 aa, Staphylococcus
TAEEQ

SEQ ID NO: 1987800 - protein, 6 aa, Staphylococcus
TAEEQG

SEQ ID NO: 1987801 - protein, 19 aa, Staphylococcus
TAEEREMSGAEKLKEQGYV

SEQ ID NO: 1987802 - protein, 7 aa, Staphylococcus
TAEEYGC

SEQ ID NO: 1987803 - protein, 18 aa, Staphylococcus
TAEGIGGAGYNDGTPCKE

SEQ ID NO: 1987804 - protein, 18 aa, Staphylococcus
TAEISAKNLKHANQVASW

SEQ ID NO: 1987805 - protein, 7 aa, Staphylococcus
TAEKNTV

SEQ ID NO: 1987806 - protein, 9 aa, Staphylococcus
TAEKPGDIK

SEQ ID NO: 1987807 - protein, 4 aa, Staphylococcus
TAEN

SEQ ID NO: 1987808 - protein, 10 aa, Staphylococcus
TAENATTEIP

SEQ ID NO: 1987809 - protein, 10 aa, Staphylococcus
TAENTKTTSG

SEQ ID NO: 1987810 - protein, 5 aa, Staphylococcus
TAENW

SEQ ID NO: 1987811 - protein, 8 aa, Staphylococcus
TAEPKQQE

SEQ ID NO: 1987812 - protein, 9 aa, Staphylococcus
TAEPQSNAT

SEQ ID NO: 1987813 - protein, 8 aa, Staphylococcus
TAERPGDV

SEQ ID NO: 1987814 - protein, 18 aa, Staphylococcus
TAESQYPSSAPLGKPNPF

SEQ ID NO: 1987815 - protein, 6 aa, Staphylococcus
TAESWD

SEQ ID NO: 1987816 - protein, 4 aa, Staphylococcus
TAET

SEQ ID NO: 1987817 - protein, 10 aa, Staphylococcus
TAETASEIDV

SEQ ID NO: 1987818 - protein, 11 aa, Staphylococcus
TAEVPSSYAGT

SEQ ID NO: 1987819 - protein, 11 aa, Staphylococcus
TAEVPSTEAGK

SEQ ID NO: 1987820 - protein, 11 aa, Staphylococcus
TAEVPSTVSGK

SEQ ID NO: 1987821 - protein, 12 aa, Staphylococcus
TAEVPSTVSGTI

SEQ ID NO: 1987822 - protein, 15 aa, Staphylococcus
TAEYKEVNSKSEALT

SEQ ID NO: 1987823 - protein, 7 aa, Staphylococcus
TAFGKYA

SEQ ID NO: 1987824 - protein, 9 aa, Staphylococcus
TAFGKYGGS

SEQ ID NO: 1987825 - protein, 5 aa, Staphylococcus
TAFKN

SEQ ID NO: 1987826 - protein, 6 aa, Staphylococcus
TAFNPD

SEQ ID NO: 1987827 - protein, 4 aa, Staphylococcus
TAFT

SEQ ID NO: 1987828 - protein, 4 aa, Staphylococcus
TAGA

SEQ ID NO: 1987829 - protein, 5 aa, Staphylococcus
TAGAD

SEQ ID NO: 1987830 - protein, 10 aa, Staphylococcus
TAGASGGVTY

SEQ ID NO: 1987831 - protein, 22 aa, Staphylococcus
TAGASGGVTYKPEMSKAEATEV

SEQ ID NO: 1987832 - protein, 22 aa, Staphylococcus
TAGASGGVTYRPTMSKEEAEEV

SEQ ID NO: 1987833 - protein, 11 aa, Staphylococcus
TAGDTKSVKEA

SEQ ID NO: 1987834 - protein, 12 aa, Staphylococcus
TAGEAYINGRAG

SEQ ID NO: 1987835 - protein, 13 aa, Staphylococcus
TAGEEKEQLGSAQ

SEQ ID NO: 1987836 - protein, 12 aa, Staphylococcus
TAGEGGDKLTQF

SEQ ID NO: 1987837 - protein, 7 aa, Staphylococcus
TAGEGSF

SEQ ID NO: 1987838 - protein, 9 aa, Staphylococcus
TAGERGPSL

SEQ ID NO: 1987839 - protein, 36 aa, Staphylococcus
TAGGGGKGIRVARDEKELENGYKMTQQEAETAFGNG

SEQ ID NO: 1987840 - protein, 22 aa, Staphylococcus
TAGGGGKGIRVARDEKELETGY

SEQ ID NO: 1987841 - protein, 36 aa, Staphylococcus
TAGGGGKGIRVARNDQELEKGYKMTQQEAETAFGNG

SEQ ID NO: 1987842 - protein, 36 aa, Staphylococcus
TAGGGGKGIRVARNENDLENGYRMTQQEAQTAFGNG

SEQ ID NO: 1987843 - protein, 22 aa, Staphylococcus
TAGGGGKGIRVARTEKELENGY

SEQ ID NO: 1987844 - protein, 5 aa, Staphylococcus
TAGGI

SEQ ID NO: 1987845 - protein, 4 aa, Staphylococcus
TAGL

SEQ ID NO: 1987846 - protein, 13 aa, Staphylococcus
TAGLDAASRDEIH

SEQ ID NO: 1987847 - protein, 11 aa, Staphylococcus
TAGMDVSGREE

SEQ ID NO: 1987848 - protein, 8 aa, Staphylococcus
TAGNDNNS

SEQ ID NO: 1987849 - protein, 21 aa, Staphylococcus
TAGNYTLTTEKTKKLPFDIST

SEQ ID NO: 1987850 - protein, 4 aa, Staphylococcus
TAGP

SEQ ID NO: 1987851 - protein, 9 aa, Staphylococcus
TAGPYHDDN

SEQ ID NO: 1987852 - protein, 11 aa, Staphylococcus
TAGRNESKEWS

SEQ ID NO: 1987853 - protein, 7 aa, Staphylococcus
TAGSPID

SEQ ID NO: 1987854 - protein, 6 aa, Staphylococcus
TAGTSA

SEQ ID NO: 1987855 - protein, 8 aa, Staphylococcus
TAGTVSKS

SEQ ID NO: 1987856 - protein, 12 aa, Staphylococcus
TAHASTPSEGIS

SEQ ID NO: 1987857 - protein, 6 aa, Staphylococcus
TAHEET

SEQ ID NO: 1987858 - protein, 11 aa, Staphylococcus
TAHRDETDKPV

SEQ ID NO: 1987859 - protein, 11 aa, Staphylococcus
TAHREHASNVG

SEQ ID NO: 1987860 - protein, 10 aa, Staphylococcus
TAHRSHASNV

SEQ ID NO: 1987861 - protein, 22 aa, Staphylococcus
TAHSSDDDDKYRTQEERDGLKE

SEQ ID NO: 1987862 - protein, 8 aa, Staphylococcus
TAHTSFND

SEQ ID NO: 1987863 - protein, 4 aa, Staphylococcus
TAIA

SEQ ID NO: 1987864 - protein, 7 aa, Staphylococcus
TAIDTTS

SEQ ID NO: 1987865 - protein, 5 aa, Staphylococcus
TAIEE

SEQ ID NO: 1987866 - protein, 12 aa, Staphylococcus
TAIGNAGAKNAG

SEQ ID NO: 1987867 - protein, 7 aa, Staphylococcus
TAINYKG

SEQ ID NO: 1987868 - protein, 5 aa, Staphylococcus
TAIRE

SEQ ID NO: 1987869 - protein, 11 aa, Staphylococcus
TAKAGQHSPVA

SEQ ID NO: 1987870 - protein, 4 aa, Staphylococcus
TAKD

SEQ ID NO: 1987871 - protein, 7 aa, Staphylococcus
TAKDADI

SEQ ID NO: 1987872 - protein, 17 aa, Staphylococcus
TAKDKGIKIPMIDEAGD

SEQ ID NO: 1987873 - protein, 17 aa, Staphylococcus
TAKDKGVQIPMIDEAGD

SEQ ID NO: 1987874 - protein, 14 aa, Staphylococcus
TAKEAQSQGYNYNE

SEQ ID NO: 1987875 - protein, 8 aa, Staphylococcus
TAKEARIE

SEQ ID NO: 1987876 - protein, 16 aa, Staphylococcus
TAKEKFDDESLEGKTV

SEQ ID NO: 1987877 - protein, 7 aa, Staphylococcus
TAKEKGV

SEQ ID NO: 1987878 - protein, 7 aa, Staphylococcus
TAKELGT

SEQ ID NO: 1987879 - protein, 7 aa, Staphylococcus
TAKELNK

SEQ ID NO: 1987880 - protein, 9 aa, Staphylococcus
TAKKGNVLN

SEQ ID NO: 1987881 - protein, 13 aa, Staphylococcus
TAKKKKADDEKKT

SEQ ID NO: 1987882 - protein, 5 aa, Staphylococcus
TAKKL

SEQ ID NO: 1987883 - protein, 9 aa, Staphylococcus
TAKKYGLDP

SEQ ID NO: 1987884 - protein, 9 aa, Staphylococcus
TAKNAEERA

SEQ ID NO: 1987885 - protein, 6 aa, Staphylococcus
TAKNEN

SEQ ID NO: 1987886 - protein, 8 aa, Staphylococcus
TAKNGKSV

SEQ ID NO: 1987887 - protein, 8 aa, Staphylococcus
TAKNKKLQ

SEQ ID NO: 1987888 - protein, 23 aa, Staphylococcus
TAKNLNDDEIGITETYSTASSTV

SEQ ID NO: 1987889 - protein, 19 aa, Staphylococcus
TAKNRVYSEREKEKLEQNK

SEQ ID NO: 1987890 - protein, 12 aa, Staphylococcus
TAKPKPLQEGHA

SEQ ID NO: 1987891 - protein, 8 aa, Staphylococcus
TAKQQDNH

SEQ ID NO: 1987892 - protein, 5 aa, Staphylococcus
TAKRM

SEQ ID NO: 1987893 - protein, 8 aa, Staphylococcus
TAKRSFKY

SEQ ID NO: 1987894 - protein, 10 aa, Staphylococcus
TAKSGEGGKL

SEQ ID NO: 1987895 - protein, 12 aa, Staphylococcus
TAKSKEGKAPRV

SEQ ID NO: 1987896 - protein, 13 aa, Staphylococcus
TAKSNEGKKPRVK

SEQ ID NO: 1987897 - protein, 7 aa, Staphylococcus
TAKSVEI

SEQ ID NO: 1987898 - protein, 9 aa, Staphylococcus
TAKTCPHDA

SEQ ID NO: 1987899 - protein, 9 aa, Staphylococcus
TAKTIGKTA

SEQ ID NO: 1987900 - protein, 11 aa, Staphylococcus
TAKTNKGKTFT

SEQ ID NO: 1987901 - protein, 44 aa, Staphylococcus
TAKTVSDKLKDTDNEKAKQASEQIDKFTGGSDNDNKDYKKEKDE

SEQ ID NO: 1987902 - protein, 11 aa, Staphylococcus
TAKVTKEEMQG

SEQ ID NO: 1987903 - protein, 10 aa, Staphylococcus
TAKVTNEEMD

SEQ ID NO: 1987904 - protein, 10 aa, Staphylococcus
TAKVTQDEMD

SEQ ID NO: 1987905 - protein, 11 aa, Staphylococcus
TALAKEEKAYT

SEQ ID NO: 1987906 - protein, 5 aa, Staphylococcus
TALEE

SEQ ID NO: 1987907 - protein, 6 aa, Staphylococcus
TALETG

SEQ ID NO: 1987908 - protein, 5 aa, Staphylococcus
TALPG

SEQ ID NO: 1987909 - protein, 4 aa, Staphylococcus
TALQ

SEQ ID NO: 1987910 - protein, 40 aa, Staphylococcus
TALQESPNSKKNKNKHTQVTQQVASNQRKIKETETQMDKE

SEQ ID NO: 1987911 - protein, 8 aa, Staphylococcus
TALSGESV

SEQ ID NO: 1987912 - protein, 12 aa, Staphylococcus
TALTEEKGLKDA

SEQ ID NO: 1987913 - protein, 11 aa, Staphylococcus
TALTQGNGATI

SEQ ID NO: 1987914 - protein, 5 aa, Staphylococcus
TANAL

SEQ ID NO: 1987915 - protein, 6 aa, Staphylococcus
TANDDV

SEQ ID NO: 1987916 - protein, 7 aa, Staphylococcus
TANDMKT

SEQ ID NO: 1987917 - protein, 9 aa, Staphylococcus
TANEMQGTT

SEQ ID NO: 1987918 - protein, 12 aa, Staphylococcus
TANESKIKRKNQ

SEQ ID NO: 1987919 - protein, 7 aa, Staphylococcus
TANEVGT

SEQ ID NO: 1987920 - protein, 8 aa, Staphylococcus
TANGKRTS

SEQ ID NO: 1987921 - protein, 5 aa, Staphylococcus
TANGR

SEQ ID NO: 1987922 - protein, 9 aa, Staphylococcus
TANGTAAIP

SEQ ID NO: 1987923 - protein, 5 aa, Staphylococcus
TANHQ

SEQ ID NO: 1987924 - protein, 4 aa, Staphylococcus
TANI

SEQ ID NO: 1987925 - protein, 6 aa, Staphylococcus
TANINT

SEQ ID NO: 1987926 - protein, 9 aa, Staphylococcus
TANKKRTSI

SEQ ID NO: 1987927 - protein, 9 aa, Staphylococcus
TANKTMTLP

SEQ ID NO: 1987928 - protein, 5 aa, Staphylococcus
TANLP

SEQ ID NO: 1987929 - protein, 9 aa, Staphylococcus
TANMRKDPH

SEQ ID NO: 1987930 - protein, 9 aa, Staphylococcus
TANNEGKKI

SEQ ID NO: 1987931 - protein, 9 aa, Staphylococcus
TANNGGEKI

SEQ ID NO: 1987932 - protein, 7 aa, Staphylococcus
TANNGKS

SEQ ID NO: 1987933 - protein, 10 aa, Staphylococcus
TANNNQLKKM

SEQ ID NO: 1987934 - protein, 10 aa, Staphylococcus
TANPKNTEVA

SEQ ID NO: 1987935 - protein, 10 aa, Staphylococcus
TANQSGNKSF

SEQ ID NO: 1987936 - protein, 9 aa, Staphylococcus
TANTGGEKI

SEQ ID NO: 1987937 - protein, 9 aa, Staphylococcus
TANTNGEKI

SEQ ID NO: 1987938 - protein, 5 aa, Staphylococcus
TANWT

SEQ ID NO: 1987939 - protein, 11 aa, Staphylococcus
TANYDNKHGQD

SEQ ID NO: 1987940 - protein, 16 aa, Staphylococcus
TAPAPQGEGGSRAMQA

SEQ ID NO: 1987941 - protein, 4 aa, Staphylococcus
TAPD

SEQ ID NO: 1987942 - protein, 10 aa, Staphylococcus
TAPDRNRVNG

SEQ ID NO: 1987943 - protein, 12 aa, Staphylococcus
TAPGTQQLERDE

SEQ ID NO: 1987944 - protein, 4 aa, Staphylococcus
TAPH

SEQ ID NO: 1987945 - protein, 6 aa, Staphylococcus
TAPHQG

SEQ ID NO: 1987946 - protein, 4 aa, Staphylococcus
TAPI

SEQ ID NO: 1987947 - protein, 10 aa, Staphylococcus
TAPKEQRDRL

SEQ ID NO: 1987948 - protein, 9 aa, Staphylococcus
TAPKNQRDH

SEQ ID NO: 1987949 - protein, 10 aa, Staphylococcus
TAPKSERNRL

SEQ ID NO: 1987950 - protein, 6 aa, Staphylococcus
TAPMAP

SEQ ID NO: 1987951 - protein, 7 aa, Staphylococcus
TAPMTSL

SEQ ID NO: 1987952 - protein, 7 aa, Staphylococcus
TAPPHLT

SEQ ID NO: 1987953 - protein, 30 aa, Staphylococcus
TAPQRVARRKERRDESKNTIEYLSKIQHIE

SEQ ID NO: 1987954 - protein, 19 aa, Staphylococcus
TAPQRVKRRKDRREESKRT

SEQ ID NO: 1987955 - protein, 5 aa, Staphylococcus
TAPRV

SEQ ID NO: 1987956 - protein, 7 aa, Staphylococcus
TAPSEAK

SEQ ID NO: 1987957 - protein, 6 aa, Staphylococcus
TAPTQT

SEQ ID NO: 1987958 - protein, 13 aa, Staphylococcus
TAQASSPSEGLGF

SEQ ID NO: 1987959 - protein, 13 aa, Staphylococcus
TAQASSPTEGIGF

SEQ ID NO: 1987960 - protein, 4 aa, Staphylococcus
TAQE

SEQ ID NO: 1987961 - protein, 4 aa, Staphylococcus
TAQG

SEQ ID NO: 1987962 - protein, 13 aa, Staphylococcus
TAQKEQSDYTKNN

SEQ ID NO: 1987963 - protein, 6 aa, Staphylococcus
TAQPEG

SEQ ID NO: 1987964 - protein, 4 aa, Staphylococcus
TAQT

SEQ ID NO: 1987965 - protein, 7 aa, Staphylococcus
TAQTPFG

SEQ ID NO: 1987966 - protein, 12 aa, Staphylococcus
TAQVTDRLKTKA

SEQ ID NO: 1987967 - protein, 8 aa, Staphylococcus
TAQYQETG

SEQ ID NO: 1987968 - protein, 8 aa, Staphylococcus
TARDPLDP

SEQ ID NO: 1987969 - protein, 11 aa, Staphylococcus
TAREQDPKHRQ

SEQ ID NO: 1987970 - protein, 8 aa, Staphylococcus
TARKGLRT

SEQ ID NO: 1987971 - protein, 5 aa, Staphylococcus
TARKP

SEQ ID NO: 1987972 - protein, 8 aa, Staphylococcus
TARKYGLE

SEQ ID NO: 1987973 - protein, 25 aa, Staphylococcus
TARNVTKTHTSNINTFQSPNQGPLG

SEQ ID NO: 1987974 - protein, 5 aa, Staphylococcus
TARQT

SEQ ID NO: 1987975 - protein, 7 aa, Staphylococcus
TARQTVD

SEQ ID NO: 1987976 - protein, 8 aa, Staphylococcus
TARQTVDA

SEQ ID NO: 1987977 - protein, 10 aa, Staphylococcus
TARQTVDDAG

SEQ ID NO: 1987978 - protein, 10 aa, Staphylococcus
TARQTVDGAG

SEQ ID NO: 1987979 - protein, 9 aa, Staphylococcus
TARQTVDNA

SEQ ID NO: 1987980 - protein, 7 aa, Staphylococcus
TARQTVH

SEQ ID NO: 1987981 - protein, 4 aa, Staphylococcus
TART

SEQ ID NO: 1987982 - protein, 17 aa, Staphylococcus
TARYGINSGGEPTQGAG

SEQ ID NO: 1987983 - protein, 17 aa, Staphylococcus
TARYGIQSGGEPTQGAG

SEQ ID NO: 1987984 - protein, 7 aa, Staphylococcus
TASAHGA

SEQ ID NO: 1987985 - protein, 6 aa, Staphylococcus
TASAQG

SEQ ID NO: 1987986 - protein, 8 aa, Staphylococcus
TASDVEQD

SEQ ID NO: 1987987 - protein, 6 aa, Staphylococcus
TASEPA

SEQ ID NO: 1987988 - protein, 10 aa, Staphylococcus
TASESIEAKP

SEQ ID NO: 1987989 - protein, 5 aa, Staphylococcus
TASEV

SEQ ID NO: 1987990 - protein, 9 aa, Staphylococcus
TASGETQQV

SEQ ID NO: 1987991 - protein, 11 aa, Staphylococcus
TASGRPAPFPD

SEQ ID NO: 1987992 - protein, 4 aa, Staphylococcus
TASI

SEQ ID NO: 1987993 - protein, 11 aa, Staphylococcus
TASKGRSGYVS

SEQ ID NO: 1987994 - protein, 6 aa, Staphylococcus
TASKLN

SEQ ID NO: 1987995 - protein, 7 aa, Staphylococcus
TASKLNR

SEQ ID NO: 1987996 - protein, 4 aa, Staphylococcus
TASL

SEQ ID NO: 1987997 - protein, 12 aa, Staphylococcus
TASLAESKTQID

SEQ ID NO: 1987998 - protein, 8 aa, Staphylococcus
TASNGQEA

SEQ ID NO: 1987999 - protein, 6 aa, Staphylococcus
TASNTN

SEQ ID NO: 1988000 - protein, 16 aa, Staphylococcus
TASNTNYLQDGTEINE

SEQ ID NO: 1988001 - protein, 6 aa, Staphylococcus
TASNTT

SEQ ID NO: 1988002 - protein, 5 aa, Staphylococcus
TASPE

SEQ ID NO: 1988003 - protein, 7 aa, Staphylococcus
TASPSFD

SEQ ID NO: 1988004 - protein, 9 aa, Staphylococcus
TASPTPENL

SEQ ID NO: 1988005 - protein, 8 aa, Staphylococcus
TASRDETK

SEQ ID NO: 1988006 - protein, 8 aa, Staphylococcus
TASREETI

SEQ ID NO: 1988007 - protein, 9 aa, Staphylococcus
TASREETIN

SEQ ID NO: 1988008 - protein, 9 aa, Staphylococcus
TASRNETIE

SEQ ID NO: 1988009 - protein, 8 aa, Staphylococcus
TASRPESI

SEQ ID NO: 1988010 - protein, 16 aa, Staphylococcus
TASRPGAMGKSIPGSY

SEQ ID NO: 1988011 - protein, 9 aa, Staphylococcus
TASRQETID

SEQ ID NO: 1988012 - protein, 7 aa, Staphylococcus
TASSAVQ

SEQ ID NO: 1988013 - protein, 14 aa, Staphylococcus
TASSLTGKSGKNIQ

SEQ ID NO: 1988014 - protein, 6 aa, Staphylococcus
TASSQY

SEQ ID NO: 1988015 - protein, 8 aa, Staphylococcus
TASTDEVY

SEQ ID NO: 1988016 - protein, 6 aa, Staphylococcus
TASTDS

SEQ ID NO: 1988017 - protein, 4 aa, Staphylococcus
TASV

SEQ ID NO: 1988018 - protein, 12 aa, Staphylococcus
TASVSTQTLQRD

SEQ ID NO: 1988019 - protein, 9 aa, Staphylococcus
TATAAEQAL

SEQ ID NO: 1988020 - protein, 7 aa, Staphylococcus
TATAEVQ

SEQ ID NO: 1988021 - protein, 5 aa, Staphylococcus
TATDL

SEQ ID NO: 1988022 - protein, 8 aa, Staphylococcus
TATEDINE

SEQ ID NO: 1988023 - protein, 11 aa, Staphylococcus
TATEDKKAEDI

SEQ ID NO: 1988024 - protein, 10 aa, Staphylococcus
TATETTPNQV

SEQ ID NO: 1988025 - protein, 18 aa, Staphylococcus
TATKHSNSQVVTASTDSV

SEQ ID NO: 1988026 - protein, 6 aa, Staphylococcus
TATNDE

SEQ ID NO: 1988027 - protein, 9 aa, Staphylococcus
TATSEGDPV

SEQ ID NO: 1988028 - protein, 11 aa, Staphylococcus
TATSEQNEPHA

SEQ ID NO: 1988029 - protein, 10 aa, Staphylococcus
TATSNQPVDT

SEQ ID NO: 1988030 - protein, 11 aa, Staphylococcus
TATSRHGEFPS

SEQ ID NO: 1988031 - protein, 13 aa, Staphylococcus
TATSSVQKGESLY

SEQ ID NO: 1988032 - protein, 7 aa, Staphylococcus
TATSVDE

SEQ ID NO: 1988033 - protein, 15 aa, Staphylococcus
TATSVDEAIENERSG

SEQ ID NO: 1988034 - protein, 15 aa, Staphylococcus
TATSVEEAIANESAG

SEQ ID NO: 1988035 - protein, 8 aa, Staphylococcus
TATTEVQR

SEQ ID NO: 1988036 - protein, 7 aa, Staphylococcus
TATTFSG

SEQ ID NO: 1988037 - protein, 14 aa, Staphylococcus
TATVKGPKGELTRT

SEQ ID NO: 1988038 - protein, 10 aa, Staphylococcus
TAVAEDKTQL

SEQ ID NO: 1988039 - protein, 12 aa, Staphylococcus
TAVASEENNREF

SEQ ID NO: 1988040 - protein, 11 aa, Staphylococcus
TAVATEKVGNG

SEQ ID NO: 1988041 - protein, 10 aa, Staphylococcus
TAVATREQAP

SEQ ID NO: 1988042 - protein, 11 aa, Staphylococcus
TAVATRGQSPY

SEQ ID NO: 1988043 - protein, 10 aa, Staphylococcus
TAVETGRVSN

SEQ ID NO: 1988044 - protein, 10 aa, Staphylococcus
TAVETGRVTN

SEQ ID NO: 1988045 - protein, 7 aa, Staphylococcus
TAVGKTE

SEQ ID NO: 1988046 - protein, 7 aa, Staphylococcus
TAVKTED

SEQ ID NO: 1988047 - protein, 14 aa, Staphylococcus
TAVNEQDVSAKSID

SEQ ID NO: 1988048 - protein, 7 aa, Staphylococcus
TAVNYKD

SEQ ID NO: 1988049 - protein, 15 aa, Staphylococcus
TAVSKSKDAKERLDR

SEQ ID NO: 1988050 - protein, 5 aa, Staphylococcus
TAYED

SEQ ID NO: 1988051 - protein, 6 aa, Staphylococcus
TAYEKR

SEQ ID NO: 1988052 - protein, 5 aa, Staphylococcus
TAYEN

SEQ ID NO: 1988053 - protein, 6 aa, Staphylococcus
TAYEND

SEQ ID NO: 1988054 - protein, 9 aa, Staphylococcus
TAYFSPKKD

SEQ ID NO: 1988055 - protein, 5 aa, Staphylococcus
TAYPS

SEQ ID NO: 1988056 - protein, 8 aa, Staphylococcus
TAYQKTLT

SEQ ID NO: 1988057 - protein, 13 aa, Staphylococcus
TAYQQTVTGTLST

SEQ ID NO: 1988058 - protein, 14 aa, Staphylococcus
TCDETLKDAEKRVN

SEQ ID NO: 1988059 - protein, 21 aa, Staphylococcus
TCEQRDPKGLYKKARTGEIPE

SEQ ID NO: 1988060 - protein, 9 aa, Staphylococcus
TCESAGADY

SEQ ID NO: 1988061 - protein, 21 aa, Staphylococcus
TCESRDPKGLYQKARNGEIKG

SEQ ID NO: 1988062 - protein, 6 aa, Staphylococcus
TCGNGH

SEQ ID NO: 1988063 - protein, 7 aa, Staphylococcus
TCGNGND

SEQ ID NO: 1988064 - protein, 4 aa, Staphylococcus
TCIP

SEQ ID NO: 1988065 - protein, 16 aa, Staphylococcus
TCKDGEVVERKSKKNR

SEQ ID NO: 1988066 - protein, 30 aa, Staphylococcus
TCNGEGAKPGTSKKTCSYCKGSGRTSVEQN

SEQ ID NO: 1988067 - protein, 8 aa, Staphylococcus
TCNGQRLN

SEQ ID NO: 1988068 - protein, 4 aa, Staphylococcus
TCPI

SEQ ID NO: 1988069 - protein, 11 aa, Staphylococcus
TCQSENQNKHY

SEQ ID NO: 1988070 - protein, 28 aa, Staphylococcus
TCSDCQESKRYLNSQEISYSHKDVSQNL

SEQ ID NO: 1988071 - protein, 12 aa, Staphylococcus
TCTDGQSGHEIY

SEQ ID NO: 1988072 - protein, 9 aa, Staphylococcus
TCTDNENGF

SEQ ID NO: 1988073 - protein, 11 aa, Staphylococcus
TCTDNEQGHEI

SEQ ID NO: 1988074 - protein, 11 aa, Staphylococcus
TCTDSENGHEI

SEQ ID NO: 1988075 - protein, 8 aa, Staphylococcus
TDAADINR

SEQ ID NO: 1988076 - protein, 12 aa, Staphylococcus
TDADRKAYEKAT

SEQ ID NO: 1988077 - protein, 9 aa, Staphylococcus
TDAEAQNHS

SEQ ID NO: 1988078 - protein, 10 aa, Staphylococcus
TDAENNKELI

SEQ ID NO: 1988079 - protein, 8 aa, Staphylococcus
TDAETEAV

SEQ ID NO: 1988080 - protein, 7 aa, Staphylococcus
TDAETEY

SEQ ID NO: 1988081 - protein, 5 aa, Staphylococcus
TDAEY

SEQ ID NO: 1988082 - protein, 5 aa, Staphylococcus
TDAHH

SEQ ID NO: 1988083 - protein, 6 aa, Staphylococcus
TDAHHT

SEQ ID NO: 1988084 - protein, 9 aa, Staphylococcus
TDAKPLMES

SEQ ID NO: 1988085 - protein, 7 aa, Staphylococcus
TDALEGK

SEQ ID NO: 1988086 - protein, 7 aa, Staphylococcus
TDALSEA

SEQ ID NO: 1988087 - protein, 9 aa, Staphylococcus
TDANSQGAK

SEQ ID NO: 1988088 - protein, 6 aa, Staphylococcus
TDAPEI

SEQ ID NO: 1988089 - protein, 8 aa, Staphylococcus
TDAPLKST

SEQ ID NO: 1988090 - protein, 5 aa, Staphylococcus
TDAQA

SEQ ID NO: 1988091 - protein, 8 aa, Staphylococcus
TDAQNEAD

SEQ ID NO: 1988092 - protein, 6 aa, Staphylococcus
TDARQW

SEQ ID NO: 1988093 - protein, 16 aa, Staphylococcus
TDASDNAKKNIKNKCD

SEQ ID NO: 1988094 - protein, 10 aa, Staphylococcus
TDASLSEYQT

SEQ ID NO: 1988095 - protein, 9 aa, Staphylococcus
TDASQRESL

SEQ ID NO: 1988096 - protein, 15 aa, Staphylococcus
TDATIGSSTSGIMPS

SEQ ID NO: 1988097 - protein, 14 aa, Staphylococcus
TDAVEKTTKADRNA

SEQ ID NO: 1988098 - protein, 14 aa, Staphylococcus
TDAVNTGTIYNDTN

SEQ ID NO: 1988099 - protein, 7 aa, Staphylococcus
TDAYRPE

SEQ ID NO: 1988100 - protein, 10 aa, Staphylococcus
TDCPNIKNEH

SEQ ID NO: 1988101 - protein, 11 aa, Staphylococcus
TDCPNIKNEKE

SEQ ID NO: 1988102 - protein, 12 aa, Staphylococcus
TDCPNIKNETER

SEQ ID NO: 1988103 - protein, 12 aa, Staphylococcus
TDCPNVKNETER

SEQ ID NO: 1988104 - protein, 4 aa, Staphylococcus
TDCS

SEQ ID NO: 1988105 - protein, 7 aa, Staphylococcus
TDDAARN

SEQ ID NO: 1988106 - protein, 6 aa, Staphylococcus
TDDADD

SEQ ID NO: 1988107 - protein, 6 aa, Staphylococcus
TDDAIN

SEQ ID NO: 1988108 - protein, 4 aa, Staphylococcus
TDDD

SEQ ID NO: 1988109 - protein, 10 aa, Staphylococcus
TDDDAQAQFG

SEQ ID NO: 1988110 - protein, 7 aa, Staphylococcus
TDDDMDK

SEQ ID NO: 1988111 - protein, 5 aa, Staphylococcus
TDDDW

SEQ ID NO: 1988112 - protein, 15 aa, Staphylococcus
TDDDYITSTHRGHGH

SEQ ID NO: 1988113 - protein, 4 aa, Staphylococcus
TDDE

SEQ ID NO: 1988114 - protein, 13 aa, Staphylococcus
TDDEIGNGESIFD

SEQ ID NO: 1988115 - protein, 5 aa, Staphylococcus
TDDEL

SEQ ID NO: 1988116 - protein, 4 aa, Staphylococcus
TDDG

SEQ ID NO: 1988117 - protein, 5 aa, Staphylococcus
TDDHI

SEQ ID NO: 1988118 - protein, 7 aa, Staphylococcus
TDDIEKT

SEQ ID NO: 1988119 - protein, 8 aa, Staphylococcus
TDDIEKTK

SEQ ID NO: 1988120 - protein, 8 aa, Staphylococcus
TDDITEEN

SEQ ID NO: 1988121 - protein, 5 aa, Staphylococcus
TDDKR

SEQ ID NO: 1988122 - protein, 5 aa, Staphylococcus
TDDNA

SEQ ID NO: 1988123 - protein, 6 aa, Staphylococcus
TDDNKH

SEQ ID NO: 1988124 - protein, 9 aa, Staphylococcus
TDDNPDKAV

SEQ ID NO: 1988125 - protein, 5 aa, Staphylococcus
TDDNQ

SEQ ID NO: 1988126 - protein, 5 aa, Staphylococcus
TDDPY

SEQ ID NO: 1988127 - protein, 9 aa, Staphylococcus
TDDPYVPYK

SEQ ID NO: 1988128 - protein, 4 aa, Staphylococcus
TDDQ

SEQ ID NO: 1988129 - protein, 7 aa, Staphylococcus
TDDQLDQ

SEQ ID NO: 1988130 - protein, 8 aa, Staphylococcus
TDDQTFCK

SEQ ID NO: 1988131 - protein, 6 aa, Staphylococcus
TDDSIN

SEQ ID NO: 1988132 - protein, 21 aa, Staphylococcus
TDDSINAISERSGFSSHTNFT

SEQ ID NO: 1988133 - protein, 11 aa, Staphylococcus
TDDSNRDEDLA

SEQ ID NO: 1988134 - protein, 8 aa, Staphylococcus
TDDTKRDF

SEQ ID NO: 1988135 - protein, 5 aa, Staphylococcus
TDDTQ

SEQ ID NO: 1988136 - protein, 8 aa, Staphylococcus
TDDTTVTV

SEQ ID NO: 1988137 - protein, 5 aa, Staphylococcus
TDDVD

SEQ ID NO: 1988138 - protein, 8 aa, Staphylococcus
TDDVDQAK

SEQ ID NO: 1988139 - protein, 8 aa, Staphylococcus
TDDVEKTK

SEQ ID NO: 1988140 - protein, 7 aa, Staphylococcus
TDDVTED

SEQ ID NO: 1988141 - protein, 7 aa, Staphylococcus
TDDYKNS

SEQ ID NO: 1988142 - protein, 4 aa, Staphylococcus
TDEA

SEQ ID NO: 1988143 - protein, 9 aa, Staphylococcus
TDEAASEPF

SEQ ID NO: 1988144 - protein, 6 aa, Staphylococcus
TDEAAY

SEQ ID NO: 1988145 - protein, 25 aa, Staphylococcus
TDEAKEGRDAFKEKRKPDFDQFPKF

SEQ ID NO: 1988146 - protein, 12 aa, Staphylococcus
TDEALKAKTQEF

SEQ ID NO: 1988147 - protein, 16 aa, Staphylococcus
TDEATINKQIENAQKA

SEQ ID NO: 1988148 - protein, 4 aa, Staphylococcus
TDED

SEQ ID NO: 1988149 - protein, 7 aa, Staphylococcus
TDEDAEF

SEQ ID NO: 1988150 - protein, 5 aa, Staphylococcus
TDEDE

SEQ ID NO: 1988151 - protein, 11 aa, Staphylococcus
TDEDLTNYQEK

SEQ ID NO: 1988152 - protein, 6 aa, Staphylococcus
TDEDMP

SEQ ID NO: 1988153 - protein, 7 aa, Staphylococcus
TDEDVNK

SEQ ID NO: 1988154 - protein, 12 aa, Staphylococcus
TDEEAAKVILNK

SEQ ID NO: 1988155 - protein, 8 aa, Staphylococcus
TDEEALAD

SEQ ID NO: 1988156 - protein, 8 aa, Staphylococcus
TDEEINKK

SEQ ID NO: 1988157 - protein, 6 aa, Staphylococcus
TDEEKI

SEQ ID NO: 1988158 - protein, 7 aa, Staphylococcus
TDEEMET

SEQ ID NO: 1988159 - protein, 9 aa, Staphylococcus
TDEERKEAV

SEQ ID NO: 1988160 - protein, 9 aa, Staphylococcus
TDEERNPLI

SEQ ID NO: 1988161 - protein, 7 aa, Staphylococcus
TDEESDW

SEQ ID NO: 1988162 - protein, 17 aa, Staphylococcus
TDEETAMGTIPGAKTIP

SEQ ID NO: 1988163 - protein, 8 aa, Staphylococcus
TDEEVNKK

SEQ ID NO: 1988164 - protein, 9 aa, Staphylococcus
TDEEVNKKA

SEQ ID NO: 1988165 - protein, 4 aa, Staphylococcus
TDEG

SEQ ID NO: 1988166 - protein, 14 aa, Staphylococcus
TDEGIRGNSSVEKL

SEQ ID NO: 1988167 - protein, 5 aa, Staphylococcus
TDEGN

SEQ ID NO: 1988168 - protein, 6 aa, Staphylococcus
TDEGPK

SEQ ID NO: 1988169 - protein, 6 aa, Staphylococcus
TDEGRI

SEQ ID NO: 1988170 - protein, 9 aa, Staphylococcus
TDEGTVNDM

SEQ ID NO: 1988171 - protein, 5 aa, Staphylococcus
TDEHD

SEQ ID NO: 1988172 - protein, 5 aa, Staphylococcus
TDEHY

SEQ ID NO: 1988173 - protein, 4 aa, Staphylococcus
TDEI

SEQ ID NO: 1988174 - protein, 16 aa, Staphylococcus
TDEIKPSGTGESPLAN

SEQ ID NO: 1988175 - protein, 6 aa, Staphylococcus
TDEISG

SEQ ID NO: 1988176 - protein, 4 aa, Staphylococcus
TDEK

SEQ ID NO: 1988177 - protein, 14 aa, Staphylococcus
TDEKISSDDFEKIE

SEQ ID NO: 1988178 - protein, 7 aa, Staphylococcus
TDEKPEH

SEQ ID NO: 1988179 - protein, 18 aa, Staphylococcus
TDEKTGMKGRRETNTMPQ

SEQ ID NO: 1988180 - protein, 7 aa, Staphylococcus
TDELSRK

SEQ ID NO: 1988181 - protein, 4 aa, Staphylococcus
TDEM

SEQ ID NO: 1988182 - protein, 10 aa, Staphylococcus
TDENAGGQLA

SEQ ID NO: 1988183 - protein, 7 aa, Staphylococcus
TDENRTI

SEQ ID NO: 1988184 - protein, 8 aa, Staphylococcus
TDENRTIV

SEQ ID NO: 1988185 - protein, 4 aa, Staphylococcus
TDEP

SEQ ID NO: 1988186 - protein, 10 aa, Staphylococcus
TDEPEITSHP

SEQ ID NO: 1988187 - protein, 17 aa, Staphylococcus
TDEPVRAIKRKKDSSMV

SEQ ID NO: 1988188 - protein, 8 aa, Staphylococcus
TDEQLVPD

SEQ ID NO: 1988189 - protein, 19 aa, Staphylococcus
TDERDEDDIRQDSYHYEGG

SEQ ID NO: 1988190 - protein, 7 aa, Staphylococcus
TDERNPL

SEQ ID NO: 1988191 - protein, 14 aa, Staphylococcus
TDESEIPKELTDLY

SEQ ID NO: 1988192 - protein, 5 aa, Staphylococcus
TDETG

SEQ ID NO: 1988193 - protein, 9 aa, Staphylococcus
TDETKGARE

SEQ ID NO: 1988194 - protein, 5 aa, Staphylococcus
TDETS

SEQ ID NO: 1988195 - protein, 4 aa, Staphylococcus
TDEV

SEQ ID NO: 1988196 - protein, 10 aa, Staphylococcus
TDEVEEKIES

SEQ ID NO: 1988197 - protein, 24 aa, Staphylococcus
TDEVTEETNEEDGAAKYLKSRLLD

SEQ ID NO: 1988198 - protein, 4 aa, Staphylococcus
TDEY

SEQ ID NO: 1988199 - protein, 6 aa, Staphylococcus
TDFDRP

SEQ ID NO: 1988200 - protein, 6 aa, Staphylococcus
TDFREE

SEQ ID NO: 1988201 - protein, 11 aa, Staphylococcus
TDFSDEEDGMY

SEQ ID NO: 1988202 - protein, 7 aa, Staphylococcus
TDFTDRS

SEQ ID NO: 1988203 - protein, 7 aa, Staphylococcus
TDGDLTM

SEQ ID NO: 1988204 - protein, 6 aa, Staphylococcus
TDGDRD

SEQ ID NO: 1988205 - protein, 5 aa, Staphylococcus
TDGEE

SEQ ID NO: 1988206 - protein, 14 aa, Staphylococcus
TDGEPFAGDPRTNL

SEQ ID NO: 1988207 - protein, 14 aa, Staphylococcus
TDGEPFEGDPRANL

SEQ ID NO: 1988208 - protein, 5 aa, Staphylococcus
TDGET

SEQ ID NO: 1988209 - protein, 15 aa, Staphylococcus
TDGEVAYSKEEAAQY

SEQ ID NO: 1988210 - protein, 6 aa, Staphylococcus
TDGEVP

SEQ ID NO: 1988211 - protein, 6 aa, Staphylococcus
TDGGGS

SEQ ID NO: 1988212 - protein, 18 aa, Staphylococcus
TDGGGWSFPGGKVEPEET

SEQ ID NO: 1988213 - protein, 17 aa, Staphylococcus
TDGGGWSLPGGKVEYGE

SEQ ID NO: 1988214 - protein, 8 aa, Staphylococcus
TDGHAGQS

SEQ ID NO: 1988215 - protein, 13 aa, Staphylococcus
TDGIEVTTGPLGQ

SEQ ID NO: 1988216 - protein, 5 aa, Staphylococcus
TDGKQ

SEQ ID NO: 1988217 - protein, 9 aa, Staphylococcus
TDGKSEDFP

SEQ ID NO: 1988218 - protein, 5 aa, Staphylococcus
TDGND

SEQ ID NO: 1988219 - protein, 7 aa, Staphylococcus
TDGNEDH

SEQ ID NO: 1988220 - protein, 8 aa, Staphylococcus
TDGNEDPF

SEQ ID NO: 1988221 - protein, 5 aa, Staphylococcus
TDGNQ

SEQ ID NO: 1988222 - protein, 7 aa, Staphylococcus
TDGNQDA

SEQ ID NO: 1988223 - protein, 8 aa, Staphylococcus
TDGNQDPF

SEQ ID NO: 1988224 - protein, 8 aa, Staphylococcus
TDGNTDPF

SEQ ID NO: 1988225 - protein, 7 aa, Staphylococcus
TDGPGFM

SEQ ID NO: 1988226 - protein, 16 aa, Staphylococcus
TDGPGFMGDEPYETLG

SEQ ID NO: 1988227 - protein, 14 aa, Staphylococcus
TDGPGFTGDEPYET

SEQ ID NO: 1988228 - protein, 6 aa, Staphylococcus
TDGPMS

SEQ ID NO: 1988229 - protein, 6 aa, Staphylococcus
TDGPSF

SEQ ID NO: 1988230 - protein, 7 aa, Staphylococcus
TDGQALN

SEQ ID NO: 1988231 - protein, 16 aa, Staphylococcus
TDGQALNLSKAEAKIQ

SEQ ID NO: 1988232 - protein, 9 aa, Staphylococcus
TDGQIQMNG

SEQ ID NO: 1988233 - protein, 9 aa, Staphylococcus
TDGQITMNG

SEQ ID NO: 1988234 - protein, 5 aa, Staphylococcus
TDGQQ

SEQ ID NO: 1988235 - protein, 8 aa, Staphylococcus
TDGSYYTG

SEQ ID NO: 1988236 - protein, 21 aa, Staphylococcus
TDGTHKVRGRQRTDEEKVQAR

SEQ ID NO: 1988237 - protein, 9 aa, Staphylococcus
TDGTIEMNG

SEQ ID NO: 1988238 - protein, 5 aa, Staphylococcus
TDGTK

SEQ ID NO: 1988239 - protein, 13 aa, Staphylococcus
TDGTPFEGDPRAN

SEQ ID NO: 1988240 - protein, 22 aa, Staphylococcus
TDGTQKVRGRQRSEDEKLKARD

SEQ ID NO: 1988241 - protein, 18 aa, Staphylococcus
TDGTSHLSPLKQDRVEGT

SEQ ID NO: 1988242 - protein, 13 aa, Staphylococcus
TDGVEVTTGPLGQ

SEQ ID NO: 1988243 - protein, 6 aa, Staphylococcus
TDHAED

SEQ ID NO: 1988244 - protein, 7 aa, Staphylococcus
TDHDEVG

SEQ ID NO: 1988245 - protein, 11 aa, Staphylococcus
TDHFADSDVPT

SEQ ID NO: 1988246 - protein, 17 aa, Staphylococcus
TDHGEKEKIPVTQSNYQ

SEQ ID NO: 1988247 - protein, 7 aa, Staphylococcus
TDHKGRI

SEQ ID NO: 1988248 - protein, 7 aa, Staphylococcus
TDHPQHD

SEQ ID NO: 1988249 - protein, 8 aa, Staphylococcus
TDHQEKTK

SEQ ID NO: 1988250 - protein, 9 aa, Staphylococcus
TDHSAENVT

SEQ ID NO: 1988251 - protein, 6 aa, Staphylococcus
TDIDDN

SEQ ID NO: 1988252 - protein, 8 aa, Staphylococcus
TDIDEESA

SEQ ID NO: 1988253 - protein, 6 aa, Staphylococcus
TDIDEQ

SEQ ID NO: 1988254 - protein, 8 aa, Staphylococcus
TDIDTQNK

SEQ ID NO: 1988255 - protein, 9 aa, Staphylococcus
TDIEAQSDY

SEQ ID NO: 1988256 - protein, 6 aa, Staphylococcus
TDIEDA

SEQ ID NO: 1988257 - protein, 9 aa, Staphylococcus
TDIEDQSEY

SEQ ID NO: 1988258 - protein, 5 aa, Staphylococcus
TDIEE

SEQ ID NO: 1988259 - protein, 13 aa, Staphylococcus
TDIEKDKQRCNRQ

SEQ ID NO: 1988260 - protein, 12 aa, Staphylococcus
TDIEKDKQRTHI

SEQ ID NO: 1988261 - protein, 15 aa, Staphylococcus
TDIEKDKQRTNQQPQ

SEQ ID NO: 1988262 - protein, 14 aa, Staphylococcus
TDIEKDRQRCNQQP

SEQ ID NO: 1988263 - protein, 15 aa, Staphylococcus
TDIEKDRQRTSNQPQ

SEQ ID NO: 1988264 - protein, 14 aa, Staphylococcus
TDIEKDRSRVKNQP

SEQ ID NO: 1988265 - protein, 6 aa, Staphylococcus
TDIENG

SEQ ID NO: 1988266 - protein, 8 aa, Staphylococcus
TDIEPTQH

SEQ ID NO: 1988267 - protein, 4 aa, Staphylococcus
TDIG

SEQ ID NO: 1988268 - protein, 20 aa, Staphylococcus
TDIGGRTKKDKIHITYHTLF

SEQ ID NO: 1988269 - protein, 8 aa, Staphylococcus
TDIGKTGW

SEQ ID NO: 1988270 - protein, 6 aa, Staphylococcus
TDILTT

SEQ ID NO: 1988271 - protein, 7 aa, Staphylococcus
TDINDDE

SEQ ID NO: 1988272 - protein, 6 aa, Staphylococcus
TDIPDS

SEQ ID NO: 1988273 - protein, 13 aa, Staphylococcus
TDIPPRSKAATLD

SEQ ID NO: 1988274 - protein, 5 aa, Staphylococcus
TDIQM

SEQ ID NO: 1988275 - protein, 6 aa, Staphylococcus
TDIQPE

SEQ ID NO: 1988276 - protein, 17 aa, Staphylococcus
TDISSYQINKDTGVSYG

SEQ ID NO: 1988277 - protein, 7 aa, Staphylococcus
TDITSEY

SEQ ID NO: 1988278 - protein, 19 aa, Staphylococcus
TDITSVESKMQEIHSEVFD

SEQ ID NO: 1988279 - protein, 14 aa, Staphylococcus
TDITTDSRTAEEGS

SEQ ID NO: 1988280 - protein, 12 aa, Staphylococcus
TDKAEQQRNREQ

SEQ ID NO: 1988281 - protein, 19 aa, Staphylococcus
TDKAKEVIAEEGYDPEYGA

SEQ ID NO: 1988282 - protein, 18 aa, Staphylococcus
TDKAKGALKQLADNEGYE

SEQ ID NO: 1988283 - protein, 9 aa, Staphylococcus
TDKANAQCI

SEQ ID NO: 1988284 - protein, 9 aa, Staphylococcus
TDKAPTDDQ

SEQ ID NO: 1988285 - protein, 10 aa, Staphylococcus
TDKAQTERVR

SEQ ID NO: 1988286 - protein, 8 aa, Staphylococcus
TDKARNEE

SEQ ID NO: 1988287 - protein, 10 aa, Staphylococcus
TDKATQENTY

SEQ ID NO: 1988288 - protein, 7 aa, Staphylococcus
TDKATTA

SEQ ID NO: 1988289 - protein, 8 aa, Staphylococcus
TDKDEFEA

SEQ ID NO: 1988290 - protein, 15 aa, Staphylococcus
TDKDIETIEQLFPIE

SEQ ID NO: 1988291 - protein, 13 aa, Staphylococcus
TDKDKAQAHIDAG

SEQ ID NO: 1988292 - protein, 14 aa, Staphylococcus
TDKDKAQAHVDAGA

SEQ ID NO: 1988293 - protein, 10 aa, Staphylococcus
TDKDPELREK

SEQ ID NO: 1988294 - protein, 11 aa, Staphylococcus
TDKDPHYKNTQ

SEQ ID NO: 1988295 - protein, 10 aa, Staphylococcus
TDKEDNVKPE

SEQ ID NO: 1988296 - protein, 10 aa, Staphylococcus
TDKEKAEAHI

SEQ ID NO: 1988297 - protein, 13 aa, Staphylococcus
TDKEKAEAHINAG

SEQ ID NO: 1988298 - protein, 18 aa, Staphylococcus
TDKEQKIKNEKYWGEIVW

SEQ ID NO: 1988299 - protein, 8 aa, Staphylococcus
TDKGESII

SEQ ID NO: 1988300 - protein, 8 aa, Staphylococcus
TDKGPGIF

SEQ ID NO: 1988301 - protein, 7 aa, Staphylococcus
TDKGYYQ

SEQ ID NO: 1988302 - protein, 11 aa, Staphylococcus
TDKHKGKGPLA

SEQ ID NO: 1988303 - protein, 12 aa, Staphylococcus
TDKISTHDDPTY

SEQ ID NO: 1988304 - protein, 12 aa, Staphylococcus
TDKITTHDDPTY

SEQ ID NO: 1988305 - protein, 12 aa, Staphylococcus
TDKITTHDNPTY

SEQ ID NO: 1988306 - protein, 11 aa, Staphylococcus
TDKKTENDELE

SEQ ID NO: 1988307 - protein, 5 aa, Staphylococcus
TDKLS

SEQ ID NO: 1988308 - protein, 8 aa, Staphylococcus
TDKLSRKI

SEQ ID NO: 1988309 - protein, 7 aa, Staphylococcus
TDKNAKW

SEQ ID NO: 1988310 - protein, 15 aa, Staphylococcus
TDKNKATKSPFDDLT

SEQ ID NO: 1988311 - protein, 8 aa, Staphylococcus
TDKPFKRS

SEQ ID NO: 1988312 - protein, 10 aa, Staphylococcus
TDKPIQRQDL

SEQ ID NO: 1988313 - protein, 8 aa, Staphylococcus
TDKPLESL

SEQ ID NO: 1988314 - protein, 16 aa, Staphylococcus
TDKPMEVGGGIRDRNT

SEQ ID NO: 1988315 - protein, 13 aa, Staphylococcus
TDKQSKARDNDAA

SEQ ID NO: 1988316 - protein, 8 aa, Staphylococcus
TDKQTTDA

SEQ ID NO: 1988317 - protein, 10 aa, Staphylococcus
TDKRNRKKRV

SEQ ID NO: 1988318 - protein, 8 aa, Staphylococcus
TDKRVSPD

SEQ ID NO: 1988319 - protein, 4 aa, Staphylococcus
TDKS

SEQ ID NO: 1988320 - protein, 5 aa, Staphylococcus
TDKSD

SEQ ID NO: 1988321 - protein, 7 aa, Staphylococcus
TDKTKTI

SEQ ID NO: 1988322 - protein, 8 aa, Staphylococcus
TDKTSSYS

SEQ ID NO: 1988323 - protein, 9 aa, Staphylococcus
TDKTSSYSR

SEQ ID NO: 1988324 - protein, 4 aa, Staphylococcus
TDKV

SEQ ID NO: 1988325 - protein, 6 aa, Staphylococcus
TDKVGK

SEQ ID NO: 1988326 - protein, 40 aa, Staphylococcus
TDKWDEKRGNSTWGNNELDTAIANQETIYEPNSRGTGQSL

SEQ ID NO: 1988327 - protein, 6 aa, Staphylococcus
TDLDEQ

SEQ ID NO: 1988328 - protein, 9 aa, Staphylococcus
TDLDSVKQS

SEQ ID NO: 1988329 - protein, 22 aa, Staphylococcus
TDLDTKNKTVTVEKDGNQSEVS

SEQ ID NO: 1988330 - protein, 11 aa, Staphylococcus
TDLGKSPVEAY

SEQ ID NO: 1988331 - protein, 4 aa, Staphylococcus
TDLH

SEQ ID NO: 1988332 - protein, 11 aa, Staphylococcus
TDLNSPQKRGV

SEQ ID NO: 1988333 - protein, 8 aa, Staphylococcus
TDLPHSLK

SEQ ID NO: 1988334 - protein, 6 aa, Staphylococcus
TDLQST

SEQ ID NO: 1988335 - protein, 4 aa, Staphylococcus
TDLS

SEQ ID NO: 1988336 - protein, 6 aa, Staphylococcus
TDLSEE

SEQ ID NO: 1988337 - protein, 9 aa, Staphylococcus
TDLSPNDGY

SEQ ID NO: 1988338 - protein, 15 aa, Staphylococcus
TDLSTSWGKTVIKWT

SEQ ID NO: 1988339 - protein, 13 aa, Staphylococcus
TDLTPKRITQSGH

SEQ ID NO: 1988340 - protein, 6 aa, Staphylococcus
TDLTPQ

SEQ ID NO: 1988341 - protein, 10 aa, Staphylococcus
TDLTSESPKE

SEQ ID NO: 1988342 - protein, 8 aa, Staphylococcus
TDMNDDEE

SEQ ID NO: 1988343 - protein, 6 aa, Staphylococcus
TDMPNR

SEQ ID NO: 1988344 - protein, 8 aa, Staphylococcus
TDMQEEED

SEQ ID NO: 1988345 - protein, 7 aa, Staphylococcus
TDMSEDP

SEQ ID NO: 1988346 - protein, 12 aa, Staphylococcus
TDMSGRASDHDP

SEQ ID NO: 1988347 - protein, 12 aa, Staphylococcus
TDNDEKPLGSRT

SEQ ID NO: 1988348 - protein, 11 aa, Staphylococcus
TDNDGQDADLA

SEQ ID NO: 1988349 - protein, 4 aa, Staphylococcus
TDNE

SEQ ID NO: 1988350 - protein, 5 aa, Staphylococcus
TDNEI

SEQ ID NO: 1988351 - protein, 6 aa, Staphylococcus
TDNEYF

SEQ ID NO: 1988352 - protein, 4 aa, Staphylococcus
TDNG

SEQ ID NO: 1988353 - protein, 5 aa, Staphylococcus
TDNGF

SEQ ID NO: 1988354 - protein, 5 aa, Staphylococcus
TDNGL

SEQ ID NO: 1988355 - protein, 16 aa, Staphylococcus
TDNISQEINHALMDFT

SEQ ID NO: 1988356 - protein, 5 aa, Staphylococcus
TDNKK

SEQ ID NO: 1988357 - protein, 12 aa, Staphylococcus
TDNKKSQSIPQR

SEQ ID NO: 1988358 - protein, 9 aa, Staphylococcus
TDNKVELPN

SEQ ID NO: 1988359 - protein, 9 aa, Staphylococcus
TDNLTNNHK

SEQ ID NO: 1988360 - protein, 4 aa, Staphylococcus
TDNN

SEQ ID NO: 1988361 - protein, 10 aa, Staphylococcus
TDNNKATDEF

SEQ ID NO: 1988362 - protein, 8 aa, Staphylococcus
TDNNKKAV

SEQ ID NO: 1988363 - protein, 9 aa, Staphylococcus
TDNPENVQN

SEQ ID NO: 1988364 - protein, 9 aa, Staphylococcus
TDNPNGSYA

SEQ ID NO: 1988365 - protein, 10 aa, Staphylococcus
TDNPNGSYDD

SEQ ID NO: 1988366 - protein, 5 aa, Staphylococcus
TDNPY

SEQ ID NO: 1988367 - protein, 4 aa, Staphylococcus
TDNQ

SEQ ID NO: 1988368 - protein, 4 aa, Staphylococcus
TDNS

SEQ ID NO: 1988369 - protein, 5 aa, Staphylococcus
TDNSI

SEQ ID NO: 1988370 - protein, 10 aa, Staphylococcus
TDNTNHDEDL

SEQ ID NO: 1988371 - protein, 5 aa, Staphylococcus
TDNTS

SEQ ID NO: 1988372 - protein, 6 aa, Staphylococcus
TDNVER

SEQ ID NO: 1988373 - protein, 6 aa, Staphylococcus
TDPDGH

SEQ ID NO: 1988374 - protein, 12 aa, Staphylococcus
TDPDGHKFNFLV

SEQ ID NO: 1988375 - protein, 6 aa, Staphylococcus
TDPDVD

SEQ ID NO: 1988376 - protein, 7 aa, Staphylococcus
TDPEGNK

SEQ ID NO: 1988377 - protein, 5 aa, Staphylococcus
TDPEI

SEQ ID NO: 1988378 - protein, 7 aa, Staphylococcus
TDPELNQ

SEQ ID NO: 1988379 - protein, 4 aa, Staphylococcus
TDPI

SEQ ID NO: 1988380 - protein, 8 aa, Staphylococcus
TDPKSGEL

SEQ ID NO: 1988381 - protein, 8 aa, Staphylococcus
TDPQNYST

SEQ ID NO: 1988382 - protein, 8 aa, Staphylococcus
TDPRTGKP

SEQ ID NO: 1988383 - protein, 5 aa, Staphylococcus
TDPTI

SEQ ID NO: 1988384 - protein, 7 aa, Staphylococcus
TDQCPNC

SEQ ID NO: 1988385 - protein, 10 aa, Staphylococcus
TDQDPQVRAQ

SEQ ID NO: 1988386 - protein, 14 aa, Staphylococcus
TDQDTETRNQYSEV

SEQ ID NO: 1988387 - protein, 4 aa, Staphylococcus
TDQG

SEQ ID NO: 1988388 - protein, 7 aa, Staphylococcus
TDQGQER

SEQ ID NO: 1988389 - protein, 7 aa, Staphylococcus
TDQGRPI

SEQ ID NO: 1988390 - protein, 6 aa, Staphylococcus
TDQGRY

SEQ ID NO: 1988391 - protein, 16 aa, Staphylococcus
TDQIKPSGTGESPLAN

SEQ ID NO: 1988392 - protein, 6 aa, Staphylococcus
TDQKIQ

SEQ ID NO: 1988393 - protein, 4 aa, Staphylococcus
TDQP

SEQ ID NO: 1988394 - protein, 9 aa, Staphylococcus
TDQPDSNID

SEQ ID NO: 1988395 - protein, 14 aa, Staphylococcus
TDQPIGQVKYPSIM

SEQ ID NO: 1988396 - protein, 5 aa, Staphylococcus
TDQQY

SEQ ID NO: 1988397 - protein, 15 aa, Staphylococcus
TDQSVNIDTGAGHGD

SEQ ID NO: 1988398 - protein, 5 aa, Staphylococcus
TDQTD

SEQ ID NO: 1988399 - protein, 19 aa, Staphylococcus
TDQTIAEYEKQNENREVKQ

SEQ ID NO: 1988400 - protein, 4 aa, Staphylococcus
TDQV

SEQ ID NO: 1988401 - protein, 5 aa, Staphylococcus
TDQVE

SEQ ID NO: 1988402 - protein, 11 aa, Staphylococcus
TDQVPSKGETV

SEQ ID NO: 1988403 - protein, 7 aa, Staphylococcus
TDRAEGI

SEQ ID NO: 1988404 - protein, 5 aa, Staphylococcus
TDRDG

SEQ ID NO: 1988405 - protein, 7 aa, Staphylococcus
TDRDGAH

SEQ ID NO: 1988406 - protein, 8 aa, Staphylococcus
TDREDNLQ

SEQ ID NO: 1988407 - protein, 14 aa, Staphylococcus
TDRISTHDDPTYKK

SEQ ID NO: 1988408 - protein, 12 aa, Staphylococcus
TDRKAQDAQDQA

SEQ ID NO: 1988409 - protein, 12 aa, Staphylococcus
TDRKAQNAQDQA

SEQ ID NO: 1988410 - protein, 12 aa, Staphylococcus
TDRKAQNEQDQA

SEQ ID NO: 1988411 - protein, 4 aa, Staphylococcus
TDRL

SEQ ID NO: 1988412 - protein, 7 aa, Staphylococcus
TDRLNET

SEQ ID NO: 1988413 - protein, 17 aa, Staphylococcus
TDRLSETVKKDFSNATE

SEQ ID NO: 1988414 - protein, 11 aa, Staphylococcus
TDRNAQNNHDQ

SEQ ID NO: 1988415 - protein, 9 aa, Staphylococcus
TDRRGEDLN

SEQ ID NO: 1988416 - protein, 8 aa, Staphylococcus
TDRRVSPD

SEQ ID NO: 1988417 - protein, 11 aa, Staphylococcus
TDRTAQNAHDQ

SEQ ID NO: 1988418 - protein, 12 aa, Staphylococcus
TDRTAQNAQDQA

SEQ ID NO: 1988419 - protein, 12 aa, Staphylococcus
TDRTAQRQQDQA

SEQ ID NO: 1988420 - protein, 4 aa, Staphylococcus
TDSA

SEQ ID NO: 1988421 - protein, 8 aa, Staphylococcus
TDSALREH

SEQ ID NO: 1988422 - protein, 5 aa, Staphylococcus
TDSAP

SEQ ID NO: 1988423 - protein, 24 aa, Staphylococcus
TDSASEDTQARLNEGYKSATDYNR

SEQ ID NO: 1988424 - protein, 11 aa, Staphylococcus
TDSAVNDGDLA

SEQ ID NO: 1988425 - protein, 9 aa, Staphylococcus
TDSDIESTW

SEQ ID NO: 1988426 - protein, 11 aa, Staphylococcus
TDSEDKVSPNT

SEQ ID NO: 1988427 - protein, 10 aa, Staphylococcus
TDSEEKAMGL

SEQ ID NO: 1988428 - protein, 10 aa, Staphylococcus
TDSEGKWKNK

SEQ ID NO: 1988429 - protein, 11 aa, Staphylococcus
TDSEGNSIING

SEQ ID NO: 1988430 - protein, 5 aa, Staphylococcus
TDSEI

SEQ ID NO: 1988431 - protein, 9 aa, Staphylococcus
TDSESAEGL

SEQ ID NO: 1988432 - protein, 13 aa, Staphylococcus
TDSGISPRPIPGV

SEQ ID NO: 1988433 - protein, 9 aa, Staphylococcus
TDSGKTYTG

SEQ ID NO: 1988434 - protein, 15 aa, Staphylococcus
TDSIEPSGTGESPLA

SEQ ID NO: 1988435 - protein, 8 aa, Staphylococcus
TDSIRATQ

SEQ ID NO: 1988436 - protein, 15 aa, Staphylococcus
TDSKGCASGGTCNCS

SEQ ID NO: 1988437 - protein, 9 aa, Staphylococcus
TDSKRDHFK

SEQ ID NO: 1988438 - protein, 4 aa, Staphylococcus
TDSN

SEQ ID NO: 1988439 - protein, 7 aa, Staphylococcus
TDSNTVS

SEQ ID NO: 1988440 - protein, 5 aa, Staphylococcus
TDSPL

SEQ ID NO: 1988441 - protein, 7 aa, Staphylococcus
TDSQATL

SEQ ID NO: 1988442 - protein, 8 aa, Staphylococcus
TDSQATLE

SEQ ID NO: 1988443 - protein, 9 aa, Staphylococcus
TDSQATMEQ

SEQ ID NO: 1988444 - protein, 9 aa, Staphylococcus
TDSRKKALK

SEQ ID NO: 1988445 - protein, 6 aa, Staphylococcus
TDSSDL

SEQ ID NO: 1988446 - protein, 12 aa, Staphylococcus
TDSSVNQPRKEL

SEQ ID NO: 1988447 - protein, 8 aa, Staphylococcus
TDSTGIPH

SEQ ID NO: 1988448 - protein, 4 aa, Staphylococcus
TDSV

SEQ ID NO: 1988449 - protein, 12 aa, Staphylococcus
TDSVEPDKETDV

SEQ ID NO: 1988450 - protein, 12 aa, Staphylococcus
TDSVNKANKENL

SEQ ID NO: 1988451 - protein, 4 aa, Staphylococcus
TDSY

SEQ ID NO: 1988452 - protein, 12 aa, Staphylococcus
TDSYKKDASQKF

SEQ ID NO: 1988453 - protein, 4 aa, Staphylococcus
TDTA

SEQ ID NO: 1988454 - protein, 4 aa, Staphylococcus
TDTD

SEQ ID NO: 1988455 - protein, 18 aa, Staphylococcus
TDTDEATAERLETGYQAA

SEQ ID NO: 1988456 - protein, 4 aa, Staphylococcus
TDTE

SEQ ID NO: 1988457 - protein, 5 aa, Staphylococcus
TDTEH

SEQ ID NO: 1988458 - protein, 8 aa, Staphylococcus
TDTETKSR

SEQ ID NO: 1988459 - protein, 5 aa, Staphylococcus
TDTFE

SEQ ID NO: 1988460 - protein, 7 aa, Staphylococcus
TDTGDIQ

SEQ ID NO: 1988461 - protein, 4 aa, Staphylococcus
TDTH

SEQ ID NO: 1988462 - protein, 6 aa, Staphylococcus
TDTIKF

SEQ ID NO: 1988463 - protein, 15 aa, Staphylococcus
TDTKEIEATKGRAAY

SEQ ID NO: 1988464 - protein, 9 aa, Staphylococcus
TDTKGRRVD

SEQ ID NO: 1988465 - protein, 28 aa, Staphylococcus
TDTKTTKDNKKQDKVDNKKKDEEKNKDI

SEQ ID NO: 1988466 - protein, 5 aa, Staphylococcus
TDTMP

SEQ ID NO: 1988467 - protein, 20 aa, Staphylococcus
TDTNEHSGVGKAIMKVLTEE

SEQ ID NO: 1988468 - protein, 10 aa, Staphylococcus
TDTNEQSGVG

SEQ ID NO: 1988469 - protein, 6 aa, Staphylococcus
TDTNIE

SEQ ID NO: 1988470 - protein, 8 aa, Staphylococcus
TDTQQHIQ

SEQ ID NO: 1988471 - protein, 9 aa, Staphylococcus
TDTSDHTGE

SEQ ID NO: 1988472 - protein, 4 aa, Staphylococcus
TDTT

SEQ ID NO: 1988473 - protein, 8 aa, Staphylococcus
TDTTDHTG

SEQ ID NO: 1988474 - protein, 7 aa, Staphylococcus
TDTTHIN

SEQ ID NO: 1988475 - protein, 10 aa, Staphylococcus
TDTTNHDDDL

SEQ ID NO: 1988476 - protein, 18 aa, Staphylococcus
TDTTPKERDEATAATTAY

SEQ ID NO: 1988477 - protein, 18 aa, Staphylococcus
TDTTPKQRDEATAATTAY

SEQ ID NO: 1988478 - protein, 15 aa, Staphylococcus
TDTTPLERDEATGAI

SEQ ID NO: 1988479 - protein, 5 aa, Staphylococcus
TDTYP

SEQ ID NO: 1988480 - protein, 5 aa, Staphylococcus
TDVAQ

SEQ ID NO: 1988481 - protein, 4 aa, Staphylococcus
TDVD

SEQ ID NO: 1988482 - protein, 4 aa, Staphylococcus
TDVG

SEQ ID NO: 1988483 - protein, 5 aa, Staphylococcus
TDVIE

SEQ ID NO: 1988484 - protein, 4 aa, Staphylococcus
TDVK

SEQ ID NO: 1988485 - protein, 29 aa, Staphylococcus
TDVLNTNDWKSQLRRSATTQALKKTTTNA

SEQ ID NO: 1988486 - protein, 15 aa, Staphylococcus
TDVNTNFGGKIEGNI

SEQ ID NO: 1988487 - protein, 8 aa, Staphylococcus
TDVSDPTG

SEQ ID NO: 1988488 - protein, 8 aa, Staphylococcus
TDVTDAVD

SEQ ID NO: 1988489 - protein, 7 aa, Staphylococcus
TDWNKNQ

SEQ ID NO: 1988490 - protein, 10 aa, Staphylococcus
TDYDTSDKQL

SEQ ID NO: 1988491 - protein, 5 aa, Staphylococcus
TDYGN

SEQ ID NO: 1988492 - protein, 9 aa, Staphylococcus
TDYKTAQPI

SEQ ID NO: 1988493 - protein, 6 aa, Staphylococcus
TDYLEQ

SEQ ID NO: 1988494 - protein, 12 aa, Staphylococcus
TDYNPGSSVTNN

SEQ ID NO: 1988495 - protein, 12 aa, Staphylococcus
TDYPRPSIKTTH

SEQ ID NO: 1988496 - protein, 13 aa, Staphylococcus
TDYPRPSIKTTHG

SEQ ID NO: 1988497 - protein, 10 aa, Staphylococcus
TDYQKSSGSM

SEQ ID NO: 1988498 - protein, 5 aa, Staphylococcus
TDYRH

SEQ ID NO: 1988499 - protein, 7 aa, Staphylococcus
TDYRHSQ

SEQ ID NO: 1988500 - protein, 7 aa, Staphylococcus
TDYRSRN

SEQ ID NO: 1988501 - protein, 6 aa, Staphylococcus
TDYSEE

SEQ ID NO: 1988502 - protein, 10 aa, Staphylococcus
TDYTKDKGCH

SEQ ID NO: 1988503 - protein, 8 aa, Staphylococcus
TDYTNASR

SEQ ID NO: 1988504 - protein, 6 aa, Staphylococcus
TEAAEA

SEQ ID NO: 1988505 - protein, 10 aa, Staphylococcus
TEAAQKAFNT

SEQ ID NO: 1988506 - protein, 10 aa, Staphylococcus
TEAARNAYEN

SEQ ID NO: 1988507 - protein, 11 aa, Staphylococcus
TEADQKRINEI

SEQ ID NO: 1988508 - protein, 4 aa, Staphylococcus
TEAE

SEQ ID NO: 1988509 - protein, 13 aa, Staphylococcus
TEAERNWIDQQKN

SEQ ID NO: 1988510 - protein, 6 aa, Staphylococcus
TEAETE

SEQ ID NO: 1988511 - protein, 12 aa, Staphylococcus
TEAEYYDNKPFI

SEQ ID NO: 1988512 - protein, 4 aa, Staphylococcus
TEAF

SEQ ID NO: 1988513 - protein, 7 aa, Staphylococcus
TEAGDIY

SEQ ID NO: 1988514 - protein, 19 aa, Staphylococcus
TEAGRANGTTQRLDDEYDG

SEQ ID NO: 1988515 - protein, 20 aa, Staphylococcus
TEAGRVNGTTNNLDGPYDGY

SEQ ID NO: 1988516 - protein, 21 aa, Staphylococcus
TEAHRKGRTACSHAQGTESIQ

SEQ ID NO: 1988517 - protein, 7 aa, Staphylococcus
TEAIKEG

SEQ ID NO: 1988518 - protein, 11 aa, Staphylococcus
TEANAIKAEGA

SEQ ID NO: 1988519 - protein, 12 aa, Staphylococcus
TEANNATDYRDL

SEQ ID NO: 1988520 - protein, 8 aa, Staphylococcus
TEANPREY

SEQ ID NO: 1988521 - protein, 5 aa, Staphylococcus
TEAQA

SEQ ID NO: 1988522 - protein, 10 aa, Staphylococcus
TEARELEPND

SEQ ID NO: 1988523 - protein, 5 aa, Staphylococcus
TEARK

SEQ ID NO: 1988524 - protein, 8 aa, Staphylococcus
TEARKHDK

SEQ ID NO: 1988525 - protein, 10 aa, Staphylococcus
TEARKQGKAI

SEQ ID NO: 1988526 - protein, 8 aa, Staphylococcus
TEARYTDG

SEQ ID NO: 1988527 - protein, 15 aa, Staphylococcus
TEASLKEGEVDQLES

SEQ ID NO: 1988528 - protein, 11 aa, Staphylococcus
TEASNATDYRD

SEQ ID NO: 1988529 - protein, 12 aa, Staphylococcus
TEASSGGSTITQ

SEQ ID NO: 1988530 - protein, 14 aa, Staphylococcus
TEATELSNIDNNDA

SEQ ID NO: 1988531 - protein, 6 aa, Staphylococcus
TECDNL

SEQ ID NO: 1988532 - protein, 11 aa, Staphylococcus
TEDAIKNGASE

SEQ ID NO: 1988533 - protein, 7 aa, Staphylococcus
TEDDGSA

SEQ ID NO: 1988534 - protein, 6 aa, Staphylococcus
TEDDIN

SEQ ID NO: 1988535 - protein, 9 aa, Staphylococcus
TEDDNTSSI

SEQ ID NO: 1988536 - protein, 4 aa, Staphylococcus
TEDE

SEQ ID NO: 1988537 - protein, 6 aa, Staphylococcus
TEDEAQ

SEQ ID NO: 1988538 - protein, 12 aa, Staphylococcus
TEDEAVQETYNK

SEQ ID NO: 1988539 - protein, 6 aa, Staphylococcus
TEDEQP

SEQ ID NO: 1988540 - protein, 10 aa, Staphylococcus
TEDETTEMQN

SEQ ID NO: 1988541 - protein, 4 aa, Staphylococcus
TEDF

SEQ ID NO: 1988542 - protein, 5 aa, Staphylococcus
TEDFT

SEQ ID NO: 1988543 - protein, 5 aa, Staphylococcus
TEDGN

SEQ ID NO: 1988544 - protein, 8 aa, Staphylococcus
TEDGTFSD

SEQ ID NO: 1988545 - protein, 12 aa, Staphylococcus
TEDGWDGMPDNA

SEQ ID NO: 1988546 - protein, 11 aa, Staphylococcus
TEDHASEKSWL

SEQ ID NO: 1988547 - protein, 7 aa, Staphylococcus
TEDIEDV

SEQ ID NO: 1988548 - protein, 9 aa, Staphylococcus
TEDKAKSLD

SEQ ID NO: 1988549 - protein, 11 aa, Staphylococcus
TEDKAKSLDIQ

SEQ ID NO: 1988550 - protein, 8 aa, Staphylococcus
TEDKEKIT

SEQ ID NO: 1988551 - protein, 8 aa, Staphylococcus
TEDKKVES

SEQ ID NO: 1988552 - protein, 5 aa, Staphylococcus
TEDKY

SEQ ID NO: 1988553 - protein, 8 aa, Staphylococcus
TEDMKRQS

SEQ ID NO: 1988554 - protein, 9 aa, Staphylococcus
TEDNEASAA

SEQ ID NO: 1988555 - protein, 16 aa, Staphylococcus
TEDNIEPIAQNGADGV

SEQ ID NO: 1988556 - protein, 34 aa, Staphylococcus
TEDNKDDVEAYQKEAAKKSDLERTGLSKEKSGVF

SEQ ID NO: 1988557 - protein, 8 aa, Staphylococcus
TEDNSNSI

SEQ ID NO: 1988558 - protein, 10 aa, Staphylococcus
TEDNVDDVQG

SEQ ID NO: 1988559 - protein, 4 aa, Staphylococcus
TEDP

SEQ ID NO: 1988560 - protein, 7 aa, Staphylococcus
TEDPQKD

SEQ ID NO: 1988561 - protein, 5 aa, Staphylococcus
TEDRD

SEQ ID NO: 1988562 - protein, 6 aa, Staphylococcus
TEDREK

SEQ ID NO: 1988563 - protein, 18 aa, Staphylococcus
TEDSKGRPLNNKKKYPVK

SEQ ID NO: 1988564 - protein, 18 aa, Staphylococcus
TEDSKGYTHSKDKKYPVK

SEQ ID NO: 1988565 - protein, 5 aa, Staphylococcus
TEDSQ

SEQ ID NO: 1988566 - protein, 16 aa, Staphylococcus
TEDSQLDKEAYDRGTS

SEQ ID NO: 1988567 - protein, 8 aa, Staphylococcus
TEDTKDDF

SEQ ID NO: 1988568 - protein, 10 aa, Staphylococcus
TEDTKMNDEG

SEQ ID NO: 1988569 - protein, 10 aa, Staphylococcus
TEDTLTDERV

SEQ ID NO: 1988570 - protein, 11 aa, Staphylococcus
TEDTPDAKISA

SEQ ID NO: 1988571 - protein, 10 aa, Staphylococcus
TEDTPDSKIS

SEQ ID NO: 1988572 - protein, 7 aa, Staphylococcus
TEDVPTW

SEQ ID NO: 1988573 - protein, 13 aa, Staphylococcus
TEDYDKNKENHYA

SEQ ID NO: 1988574 - protein, 11 aa, Staphylococcus
TEDYPEQKGNH

SEQ ID NO: 1988575 - protein, 6 aa, Staphylococcus
TEDYQN

SEQ ID NO: 1988576 - protein, 8 aa, Staphylococcus
TEEAASEK

SEQ ID NO: 1988577 - protein, 6 aa, Staphylococcus
TEEADD

SEQ ID NO: 1988578 - protein, 8 aa, Staphylococcus
TEEAIKKA

SEQ ID NO: 1988579 - protein, 7 aa, Staphylococcus
TEEASAL

SEQ ID NO: 1988580 - protein, 15 aa, Staphylococcus
TEEAVARAKKGEGPT

SEQ ID NO: 1988581 - protein, 4 aa, Staphylococcus
TEED

SEQ ID NO: 1988582 - protein, 8 aa, Staphylococcus
TEEDANTM

SEQ ID NO: 1988583 - protein, 7 aa, Staphylococcus
TEEDKRE

SEQ ID NO: 1988584 - protein, 9 aa, Staphylococcus
TEEEFKGKG

SEQ ID NO: 1988585 - protein, 16 aa, Staphylococcus
TEEEGDEIIEYLNEVI

SEQ ID NO: 1988586 - protein, 14 aa, Staphylococcus
TEEEIEKIEKLFPI

SEQ ID NO: 1988587 - protein, 10 aa, Staphylococcus
TEEEKQEVAP

SEQ ID NO: 1988588 - protein, 8 aa, Staphylococcus
TEEEKRKI

SEQ ID NO: 1988589 - protein, 7 aa, Staphylococcus
TEEELEQ

SEQ ID NO: 1988590 - protein, 14 aa, Staphylococcus
TEEEVNDAIEKSKC

SEQ ID NO: 1988591 - protein, 17 aa, Staphylococcus
TEEEVNDAIEKSKHAQL

SEQ ID NO: 1988592 - protein, 17 aa, Staphylococcus
TEEEVNEAIEKSKHAQL

SEQ ID NO: 1988593 - protein, 4 aa, Staphylococcus
TEEF

SEQ ID NO: 1988594 - protein, 8 aa, Staphylococcus
TEEFEKYS

SEQ ID NO: 1988595 - protein, 21 aa, Staphylococcus
TEEGIGQSSAVGIGGDPVNGT

SEQ ID NO: 1988596 - protein, 7 aa, Staphylococcus
TEEGRER

SEQ ID NO: 1988597 - protein, 6 aa, Staphylococcus
TEEHGH

SEQ ID NO: 1988598 - protein, 12 aa, Staphylococcus
TEEHPSAPEFDQ

SEQ ID NO: 1988599 - protein, 8 aa, Staphylococcus
TEEHQSNF

SEQ ID NO: 1988600 - protein, 4 aa, Staphylococcus
TEEK

SEQ ID NO: 1988601 - protein, 9 aa, Staphylococcus
TEEKKADIQ

SEQ ID NO: 1988602 - protein, 6 aa, Staphylococcus
TEEKLS

SEQ ID NO: 1988603 - protein, 9 aa, Staphylococcus
TEENSVEEA

SEQ ID NO: 1988604 - protein, 13 aa, Staphylococcus
TEEPKIDVSRTVE

SEQ ID NO: 1988605 - protein, 6 aa, Staphylococcus
TEEQAE

SEQ ID NO: 1988606 - protein, 6 aa, Staphylococcus
TEEQDF

SEQ ID NO: 1988607 - protein, 14 aa, Staphylococcus
TEEQGKPYGESLGE

SEQ ID NO: 1988608 - protein, 11 aa, Staphylococcus
TEEQSSQPLTD

SEQ ID NO: 1988609 - protein, 4 aa, Staphylococcus
TEER

SEQ ID NO: 1988610 - protein, 7 aa, Staphylococcus
TEERRKE

SEQ ID NO: 1988611 - protein, 6 aa, Staphylococcus
TEERRQ

SEQ ID NO: 1988612 - protein, 5 aa, Staphylococcus
TEETD

SEQ ID NO: 1988613 - protein, 5 aa, Staphylococcus
TEETE

SEQ ID NO: 1988614 - protein, 18 aa, Staphylococcus
TEEVEDDDEEYITLFTIK

SEQ ID NO: 1988615 - protein, 7 aa, Staphylococcus
TEEVEKF

SEQ ID NO: 1988616 - protein, 7 aa, Staphylococcus
TEEYEKF

SEQ ID NO: 1988617 - protein, 12 aa, Staphylococcus
TEEYNQLEDVLI

SEQ ID NO: 1988618 - protein, 27 aa, Staphylococcus
TEFEKSVTAPAGNQGHGLDESEFDKKA

SEQ ID NO: 1988619 - protein, 26 aa, Staphylococcus
TEFEKSVTAPAGNQGHGLDKSEFNKK

SEQ ID NO: 1988620 - protein, 6 aa, Staphylococcus
TEFGSS

SEQ ID NO: 1988621 - protein, 7 aa, Staphylococcus
TEFPRDV

SEQ ID NO: 1988622 - protein, 19 aa, Staphylococcus
TEFTNEEDGAAKYLEKHLL

SEQ ID NO: 1988623 - protein, 10 aa, Staphylococcus
TEGAGALPTA

SEQ ID NO: 1988624 - protein, 7 aa, Staphylococcus
TEGALAK

SEQ ID NO: 1988625 - protein, 9 aa, Staphylococcus
TEGASPASH

SEQ ID NO: 1988626 - protein, 11 aa, Staphylococcus
TEGASPASHVE

SEQ ID NO: 1988627 - protein, 5 aa, Staphylococcus
TEGDV

SEQ ID NO: 1988628 - protein, 8 aa, Staphylococcus
TEGEPIAE

SEQ ID NO: 1988629 - protein, 6 aa, Staphylococcus
TEGETI

SEQ ID NO: 1988630 - protein, 7 aa, Staphylococcus
TEGGGIH

SEQ ID NO: 1988631 - protein, 7 aa, Staphylococcus
TEGGGVH

SEQ ID NO: 1988632 - protein, 16 aa, Staphylococcus
TEGGHETHTPETEEYG

SEQ ID NO: 1988633 - protein, 16 aa, Staphylococcus
TEGGHKAHTPETEEYG

SEQ ID NO: 1988634 - protein, 4 aa, Staphylococcus
TEGH

SEQ ID NO: 1988635 - protein, 5 aa, Staphylococcus
TEGHT

SEQ ID NO: 1988636 - protein, 11 aa, Staphylococcus
TEGIKAGKRHQ

SEQ ID NO: 1988637 - protein, 14 aa, Staphylococcus
TEGIQSNKTKVGDR

SEQ ID NO: 1988638 - protein, 18 aa, Staphylococcus
TEGISTTKIKKELYGDSE

SEQ ID NO: 1988639 - protein, 17 aa, Staphylococcus
TEGISTTQIKEELYGKE

SEQ ID NO: 1988640 - protein, 18 aa, Staphylococcus
TEGISTTQIKQELYGKDA

SEQ ID NO: 1988641 - protein, 5 aa, Staphylococcus
TEGKD

SEQ ID NO: 1988642 - protein, 5 aa, Staphylococcus
TEGKE

SEQ ID NO: 1988643 - protein, 18 aa, Staphylococcus
TEGKGQFKPVGNANPHLG

SEQ ID NO: 1988644 - protein, 6 aa, Staphylococcus
TEGKKE

SEQ ID NO: 1988645 - protein, 8 aa, Staphylococcus
TEGKPAVE

SEQ ID NO: 1988646 - protein, 9 aa, Staphylococcus
TEGKSNIES

SEQ ID NO: 1988647 - protein, 46 aa, Staphylococcus
TEGNSSQGLSQTANVQSNKMTQTNNETQDTNNQTQDSSDDKEIKSS

SEQ ID NO: 1988648 - protein, 6 aa, Staphylococcus
TEGNYA

SEQ ID NO: 1988649 - protein, 6 aa, Staphylococcus
TEGPGL

SEQ ID NO: 1988650 - protein, 4 aa, Staphylococcus
TEGQ

SEQ ID NO: 1988651 - protein, 11 aa, Staphylococcus
TEGQAKLSKQT

SEQ ID NO: 1988652 - protein, 5 aa, Staphylococcus
TEGQL

SEQ ID NO: 1988653 - protein, 8 aa, Staphylococcus
TEGQPAVD

SEQ ID NO: 1988654 - protein, 8 aa, Staphylococcus
TEGQPAVE

SEQ ID NO: 1988655 - protein, 14 aa, Staphylococcus
TEGQRGDQATNVVV

SEQ ID NO: 1988656 - protein, 14 aa, Staphylococcus
TEGQRGEQATNVVT

SEQ ID NO: 1988657 - protein, 15 aa, Staphylococcus
TEGQRGEQATNVVVL

SEQ ID NO: 1988658 - protein, 14 aa, Staphylococcus
TEGQRGKQATNVVP

SEQ ID NO: 1988659 - protein, 9 aa, Staphylococcus
TEGQTFDPN

SEQ ID NO: 1988660 - protein, 8 aa, Staphylococcus
TEGRNRQV

SEQ ID NO: 1988661 - protein, 15 aa, Staphylococcus
TEGSIVGTSSLRRGA

SEQ ID NO: 1988662 - protein, 13 aa, Staphylococcus
TEGSVDLETAENQ

SEQ ID NO: 1988663 - protein, 5 aa, Staphylococcus
TEGTA

SEQ ID NO: 1988664 - protein, 11 aa, Staphylococcus
TEGTAEDAEQA

SEQ ID NO: 1988665 - protein, 9 aa, Staphylococcus
TEGTAQKLA

SEQ ID NO: 1988666 - protein, 6 aa, Staphylococcus
TEGVPE

SEQ ID NO: 1988667 - protein, 8 aa, Staphylococcus
TEGYGPNE

SEQ ID NO: 1988668 - protein, 4 aa, Staphylococcus
TEHG

SEQ ID NO: 1988669 - protein, 4 aa, Staphylococcus
TEHI

SEQ ID NO: 1988670 - protein, 7 aa, Staphylococcus
TEHKGER

SEQ ID NO: 1988671 - protein, 10 aa, Staphylococcus
TEHMSQKEGR

SEQ ID NO: 1988672 - protein, 10 aa, Staphylococcus
TEHQSVEESV

SEQ ID NO: 1988673 - protein, 7 aa, Staphylococcus
TEHRDKI

SEQ ID NO: 1988674 - protein, 7 aa, Staphylococcus
TEHRNKI

SEQ ID NO: 1988675 - protein, 52 aa, Staphylococcus
TEHTEENETVKNEASSLNDVENNPSEEELNNESTSEHDNEDKNDQSKDEEIQ

SEQ ID NO: 1988676 - protein, 17 aa, Staphylococcus
TEHTKEKFSDPKTRAET

SEQ ID NO: 1988677 - protein, 9 aa, Staphylococcus
TEHTSGTIE

SEQ ID NO: 1988678 - protein, 5 aa, Staphylococcus
TEIAN

SEQ ID NO: 1988679 - protein, 14 aa, Staphylococcus
TEIAQKANDQTRSM

SEQ ID NO: 1988680 - protein, 9 aa, Staphylococcus
TEIDEESAV

SEQ ID NO: 1988681 - protein, 10 aa, Staphylococcus
TEIEGHPDNV

SEQ ID NO: 1988682 - protein, 4 aa, Staphylococcus
TEIG

SEQ ID NO: 1988683 - protein, 8 aa, Staphylococcus
TEIGNPDE

SEQ ID NO: 1988684 - protein, 12 aa, Staphylococcus
TEIGSNPTELDQ

SEQ ID NO: 1988685 - protein, 5 aa, Staphylococcus
TEIHE

SEQ ID NO: 1988686 - protein, 4 aa, Staphylococcus
TEIK

SEQ ID NO: 1988687 - protein, 6 aa, Staphylococcus
TEIKDV

SEQ ID NO: 1988688 - protein, 4 aa, Staphylococcus
TEIN

SEQ ID NO: 1988689 - protein, 5 aa, Staphylococcus
TEINE

SEQ ID NO: 1988690 - protein, 6 aa, Staphylococcus
TEINGT

SEQ ID NO: 1988691 - protein, 7 aa, Staphylococcus
TEINGTH

SEQ ID NO: 1988692 - protein, 7 aa, Staphylococcus
TEINNED

SEQ ID NO: 1988693 - protein, 9 aa, Staphylococcus
TEIRDENGK

SEQ ID NO: 1988694 - protein, 7 aa, Staphylococcus
TEISGSH

SEQ ID NO: 1988695 - protein, 8 aa, Staphylococcus
TEISNSTF

SEQ ID NO: 1988696 - protein, 5 aa, Staphylococcus
TEITE

SEQ ID NO: 1988697 - protein, 8 aa, Staphylococcus
TEITPGHF

SEQ ID NO: 1988698 - protein, 4 aa, Staphylococcus
TEIV

SEQ ID NO: 1988699 - protein, 19 aa, Staphylococcus
TEKAKEKIAEEGYDPEYGA

SEQ ID NO: 1988700 - protein, 8 aa, Staphylococcus
TEKDIKDA

SEQ ID NO: 1988701 - protein, 10 aa, Staphylococcus
TEKDPEVRQQ

SEQ ID NO: 1988702 - protein, 11 aa, Staphylococcus
TEKEFEHEKEV

SEQ ID NO: 1988703 - protein, 14 aa, Staphylococcus
TEKEKAEAHINAGA

SEQ ID NO: 1988704 - protein, 4 aa, Staphylococcus
TEKF

SEQ ID NO: 1988705 - protein, 8 aa, Staphylococcus
TEKGAKLV

SEQ ID NO: 1988706 - protein, 13 aa, Staphylococcus
TEKGKQFNRESKS

SEQ ID NO: 1988707 - protein, 6 aa, Staphylococcus
TEKGNA

SEQ ID NO: 1988708 - protein, 13 aa, Staphylococcus
TEKGRKYTEENNK

SEQ ID NO: 1988709 - protein, 9 aa, Staphylococcus
TEKGYGDAF

SEQ ID NO: 1988710 - protein, 6 aa, Staphylococcus
TEKGYS

SEQ ID NO: 1988711 - protein, 5 aa, Staphylococcus
TEKHE

SEQ ID NO: 1988712 - protein, 4 aa, Staphylococcus
TEKI

SEQ ID NO: 1988713 - protein, 6 aa, Staphylococcus
TEKIPA

SEQ ID NO: 1988714 - protein, 8 aa, Staphylococcus
TEKITEPK

SEQ ID NO: 1988715 - protein, 8 aa, Staphylococcus
TEKLQQQA

SEQ ID NO: 1988716 - protein, 6 aa, Staphylococcus
TEKMAG

SEQ ID NO: 1988717 - protein, 7 aa, Staphylococcus
TEKMTGQ

SEQ ID NO: 1988718 - protein, 5 aa, Staphylococcus
TEKNF

SEQ ID NO: 1988719 - protein, 10 aa, Staphylococcus
TEKNFRTTTN

SEQ ID NO: 1988720 - protein, 6 aa, Staphylococcus
TEKNGI

SEQ ID NO: 1988721 - protein, 6 aa, Staphylococcus
TEKPFK

SEQ ID NO: 1988722 - protein, 7 aa, Staphylococcus
TEKPGDV

SEQ ID NO: 1988723 - protein, 14 aa, Staphylococcus
TEKQGVNKAAVSRR

SEQ ID NO: 1988724 - protein, 17 aa, Staphylococcus
TEKQREKVAEKFANYVS

SEQ ID NO: 1988725 - protein, 13 aa, Staphylococcus
TEKQSGKSIESRP

SEQ ID NO: 1988726 - protein, 8 aa, Staphylococcus
TEKRESLS

SEQ ID NO: 1988727 - protein, 7 aa, Staphylococcus
TEKSTFD

SEQ ID NO: 1988728 - protein, 4 aa, Staphylococcus
TEKT

SEQ ID NO: 1988729 - protein, 10 aa, Staphylococcus
TEKTHLSRPA

SEQ ID NO: 1988730 - protein, 7 aa, Staphylococcus
TEKVQAA

SEQ ID NO: 1988731 - protein, 8 aa, Staphylococcus
TEKVSKPV

SEQ ID NO: 1988732 - protein, 6 aa, Staphylococcus
TELDDN

SEQ ID NO: 1988733 - protein, 6 aa, Staphylococcus
TELDGE

SEQ ID NO: 1988734 - protein, 6 aa, Staphylococcus
TELDNG

SEQ ID NO: 1988735 - protein, 6 aa, Staphylococcus
TELDNN

SEQ ID NO: 1988736 - protein, 17 aa, Staphylococcus
TELDSFKDEVKQKLDGF

SEQ ID NO: 1988737 - protein, 12 aa, Staphylococcus
TELDSVKQDIKA

SEQ ID NO: 1988738 - protein, 7 aa, Staphylococcus
TELEERL

SEQ ID NO: 1988739 - protein, 5 aa, Staphylococcus
TELEG

SEQ ID NO: 1988740 - protein, 12 aa, Staphylococcus
TELESATGQRLT

SEQ ID NO: 1988741 - protein, 7 aa, Staphylococcus
TELGEGG

SEQ ID NO: 1988742 - protein, 7 aa, Staphylococcus
TELGTAT

SEQ ID NO: 1988743 - protein, 6 aa, Staphylococcus
TELKEQ

SEQ ID NO: 1988744 - protein, 4 aa, Staphylococcus
TELN

SEQ ID NO: 1988745 - protein, 7 aa, Staphylococcus
TELNGTH

SEQ ID NO: 1988746 - protein, 4 aa, Staphylococcus
TELP

SEQ ID NO: 1988747 - protein, 6 aa, Staphylococcus
TELPQN

SEQ ID NO: 1988748 - protein, 7 aa, Staphylococcus
TELSDSD

SEQ ID NO: 1988749 - protein, 7 aa, Staphylococcus
TELSGTH

SEQ ID NO: 1988750 - protein, 10 aa, Staphylococcus
TELTASAGVS

SEQ ID NO: 1988751 - protein, 5 aa, Staphylococcus
TELTE

SEQ ID NO: 1988752 - protein, 12 aa, Staphylococcus
TEMDDHDHDHDH

SEQ ID NO: 1988753 - protein, 4 aa, Staphylococcus
TEMG

SEQ ID NO: 1988754 - protein, 5 aa, Staphylococcus
TEMGA

SEQ ID NO: 1988755 - protein, 6 aa, Staphylococcus
TEMPPY

SEQ ID NO: 1988756 - protein, 14 aa, Staphylococcus
TEMQSAEGYSIDGQ

SEQ ID NO: 1988757 - protein, 4 aa, Staphylococcus
TEMS

SEQ ID NO: 1988758 - protein, 11 aa, Staphylococcus
TEMSHAQDKMK

SEQ ID NO: 1988759 - protein, 9 aa, Staphylococcus
TENAATARR

SEQ ID NO: 1988760 - protein, 6 aa, Staphylococcus
TENASS

SEQ ID NO: 1988761 - protein, 9 aa, Staphylococcus
TENATTARR

SEQ ID NO: 1988762 - protein, 4 aa, Staphylococcus
TEND

SEQ ID NO: 1988763 - protein, 38 aa, Staphylococcus
TENDANHITSNQAEKNDSNKIDNAKNEENDSTNEHTYQ

SEQ ID NO: 1988764 - protein, 5 aa, Staphylococcus
TENDI

SEQ ID NO: 1988765 - protein, 6 aa, Staphylococcus
TENDLE

SEQ ID NO: 1988766 - protein, 14 aa, Staphylococcus
TENDTRLSKPKKKK

SEQ ID NO: 1988767 - protein, 10 aa, Staphylococcus
TENEASSISS

SEQ ID NO: 1988768 - protein, 6 aa, Staphylococcus
TENEAY

SEQ ID NO: 1988769 - protein, 6 aa, Staphylococcus
TENEGA

SEQ ID NO: 1988770 - protein, 5 aa, Staphylococcus
TENER

SEQ ID NO: 1988771 - protein, 10 aa, Staphylococcus
TENERMKYGT

SEQ ID NO: 1988772 - protein, 12 aa, Staphylococcus
TENGNESLTGYE

SEQ ID NO: 1988773 - protein, 5 aa, Staphylococcus
TENGT

SEQ ID NO: 1988774 - protein, 8 aa, Staphylococcus
TENGTQFM

SEQ ID NO: 1988775 - protein, 7 aa, Staphylococcus
TENLNET

SEQ ID NO: 1988776 - protein, 6 aa, Staphylococcus
TENNEE

SEQ ID NO: 1988777 - protein, 6 aa, Staphylococcus
TENNKE

SEQ ID NO: 1988778 - protein, 8 aa, Staphylococcus
TENNSNTA

SEQ ID NO: 1988779 - protein, 8 aa, Staphylococcus
TENPKAEA

SEQ ID NO: 1988780 - protein, 7 aa, Staphylococcus
TENPQRD

SEQ ID NO: 1988781 - protein, 8 aa, Staphylococcus
TENQDEIQ

SEQ ID NO: 1988782 - protein, 5 aa, Staphylococcus
TENQR

SEQ ID NO: 1988783 - protein, 5 aa, Staphylococcus
TENQS

SEQ ID NO: 1988784 - protein, 6 aa, Staphylococcus
TENQSA

SEQ ID NO: 1988785 - protein, 18 aa, Staphylococcus
TENREKKIESLSKGNQQK

SEQ ID NO: 1988786 - protein, 10 aa, Staphylococcus
TENSEATDEF

SEQ ID NO: 1988787 - protein, 15 aa, Staphylococcus
TENSRVAAATTSTIL

SEQ ID NO: 1988788 - protein, 9 aa, Staphylococcus
TENTLTDER

SEQ ID NO: 1988789 - protein, 11 aa, Staphylococcus
TENTLTDERVS

SEQ ID NO: 1988790 - protein, 11 aa, Staphylococcus
TENTLTDERVT

SEQ ID NO: 1988791 - protein, 7 aa, Staphylococcus
TENTVEP

SEQ ID NO: 1988792 - protein, 8 aa, Staphylococcus
TENTVPNT

SEQ ID NO: 1988793 - protein, 15 aa, Staphylococcus
TENVEDSAKLSHEIK

SEQ ID NO: 1988794 - protein, 11 aa, Staphylococcus
TENVEVKETDT

SEQ ID NO: 1988795 - protein, 13 aa, Staphylococcus
TENYAASQVILEK

SEQ ID NO: 1988796 - protein, 24 aa, Staphylococcus
TENYEDKMYSDEKLSKKETSQIKH

SEQ ID NO: 1988797 - protein, 9 aa, Staphylococcus
TENYRDNDL

SEQ ID NO: 1988798 - protein, 10 aa, Staphylococcus
TEPENDIEVA

SEQ ID NO: 1988799 - protein, 6 aa, Staphylococcus
TEPERF

SEQ ID NO: 1988800 - protein, 5 aa, Staphylococcus
TEPGE

SEQ ID NO: 1988801 - protein, 13 aa, Staphylococcus
TEPGYNEQDPDSW

SEQ ID NO: 1988802 - protein, 8 aa, Staphylococcus
TEPKNYST

SEQ ID NO: 1988803 - protein, 9 aa, Staphylococcus
TEPQGGAHK

SEQ ID NO: 1988804 - protein, 8 aa, Staphylococcus
TEPRNYST

SEQ ID NO: 1988805 - protein, 5 aa, Staphylococcus
TEPSA

SEQ ID NO: 1988806 - protein, 7 aa, Staphylococcus
TEPSEKV

SEQ ID NO: 1988807 - protein, 9 aa, Staphylococcus
TEPSYKDNI

SEQ ID NO: 1988808 - protein, 9 aa, Staphylococcus
TEPTAQELN

SEQ ID NO: 1988809 - protein, 6 aa, Staphylococcus
TEPVDK

SEQ ID NO: 1988810 - protein, 6 aa, Staphylococcus
TEPYFG

SEQ ID NO: 1988811 - protein, 5 aa, Staphylococcus
TEQAK

SEQ ID NO: 1988812 - protein, 7 aa, Staphylococcus
TEQAKEQ

SEQ ID NO: 1988813 - protein, 16 aa, Staphylococcus
TEQDGKLYGRGTTDMK

SEQ ID NO: 1988814 - protein, 5 aa, Staphylococcus
TEQEG

SEQ ID NO: 1988815 - protein, 8 aa, Staphylococcus
TEQEKDKI

SEQ ID NO: 1988816 - protein, 8 aa, Staphylococcus
TEQEKQQA

SEQ ID NO: 1988817 - protein, 5 aa, Staphylococcus
TEQEL

SEQ ID NO: 1988818 - protein, 7 aa, Staphylococcus
TEQEQHP

SEQ ID NO: 1988819 - protein, 6 aa, Staphylococcus
TEQERA

SEQ ID NO: 1988820 - protein, 5 aa, Staphylococcus
TEQFE

SEQ ID NO: 1988821 - protein, 7 aa, Staphylococcus
TEQFKQG

SEQ ID NO: 1988822 - protein, 8 aa, Staphylococcus
TEQGLKRG

SEQ ID NO: 1988823 - protein, 4 aa, Staphylococcus
TEQI

SEQ ID NO: 1988824 - protein, 6 aa, Staphylococcus
TEQLNY

SEQ ID NO: 1988825 - protein, 10 aa, Staphylococcus
TEQMQGNKIA

SEQ ID NO: 1988826 - protein, 13 aa, Staphylococcus
TEQNPDVRRQYSE

SEQ ID NO: 1988827 - protein, 15 aa, Staphylococcus
TEQPDPLLGQTAPVT

SEQ ID NO: 1988828 - protein, 11 aa, Staphylococcus
TEQPDYFETDG

SEQ ID NO: 1988829 - protein, 10 aa, Staphylococcus
TEQPSDETYE

SEQ ID NO: 1988830 - protein, 5 aa, Staphylococcus
TEQPV

SEQ ID NO: 1988831 - protein, 4 aa, Staphylococcus
TEQQ

SEQ ID NO: 1988832 - protein, 8 aa, Staphylococcus
TEQQPDES

SEQ ID NO: 1988833 - protein, 5 aa, Staphylococcus
TEQQV

SEQ ID NO: 1988834 - protein, 41 aa, Staphylococcus
TEQSNNQNNSTPVIQSEGNSQDKSISENNPSNDSSKTITSP

SEQ ID NO: 1988835 - protein, 18 aa, Staphylococcus
TEQTCPKCEGSGQEFEEP

SEQ ID NO: 1988836 - protein, 10 aa, Staphylococcus
TEQTLTDDKV

SEQ ID NO: 1988837 - protein, 4 aa, Staphylococcus
TEQY

SEQ ID NO: 1988838 - protein, 6 aa, Staphylococcus
TEQYPS

SEQ ID NO: 1988839 - protein, 12 aa, Staphylococcus
TEQYQSTTHFKK

SEQ ID NO: 1988840 - protein, 9 aa, Staphylococcus
TEQYRKPSY

SEQ ID NO: 1988841 - protein, 8 aa, Staphylococcus
TERATVNR

SEQ ID NO: 1988842 - protein, 5 aa, Staphylococcus
TERCE

SEQ ID NO: 1988843 - protein, 7 aa, Staphylococcus
TEREQAT

SEQ ID NO: 1988844 - protein, 13 aa, Staphylococcus
TERGKEIKKPLSE

SEQ ID NO: 1988845 - protein, 13 aa, Staphylococcus
TERGTKLNQNHTI

SEQ ID NO: 1988846 - protein, 27 aa, Staphylococcus
TERHESRRIDDQLRGRSGRQGDNGDSR

SEQ ID NO: 1988847 - protein, 26 aa, Staphylococcus
TERHESRRIDDQLRGRSGRQGDRGES

SEQ ID NO: 1988848 - protein, 11 aa, Staphylococcus
TERKEEPRLGE

SEQ ID NO: 1988849 - protein, 9 aa, Staphylococcus
TERLEKEVN

SEQ ID NO: 1988850 - protein, 6 aa, Staphylococcus
TERLQK

SEQ ID NO: 1988851 - protein, 5 aa, Staphylococcus
TERNK

SEQ ID NO: 1988852 - protein, 7 aa, Staphylococcus
TERNNAE

SEQ ID NO: 1988853 - protein, 12 aa, Staphylococcus
TERNYKDENDEI

SEQ ID NO: 1988854 - protein, 14 aa, Staphylococcus
TERNYNYQGQTQQA

SEQ ID NO: 1988855 - protein, 10 aa, Staphylococcus
TERPEGVEAG

SEQ ID NO: 1988856 - protein, 10 aa, Staphylococcus
TERPEGVTAG

SEQ ID NO: 1988857 - protein, 4 aa, Staphylococcus
TERQ

SEQ ID NO: 1988858 - protein, 6 aa, Staphylococcus
TERQAQ

SEQ ID NO: 1988859 - protein, 5 aa, Staphylococcus
TERQD

SEQ ID NO: 1988860 - protein, 14 aa, Staphylococcus
TERQDSAKDKETSE

SEQ ID NO: 1988861 - protein, 5 aa, Staphylococcus
TERRE

SEQ ID NO: 1988862 - protein, 18 aa, Staphylococcus
TERTNKSIQVDAEQNGNY

SEQ ID NO: 1988863 - protein, 8 aa, Staphylococcus
TERVKKGE

SEQ ID NO: 1988864 - protein, 7 aa, Staphylococcus
TERVQAA

SEQ ID NO: 1988865 - protein, 7 aa, Staphylococcus
TESAKQA

SEQ ID NO: 1988866 - protein, 7 aa, Staphylococcus
TESASVE

SEQ ID NO: 1988867 - protein, 8 aa, Staphylococcus
TESDADRM

SEQ ID NO: 1988868 - protein, 7 aa, Staphylococcus
TESDEFK

SEQ ID NO: 1988869 - protein, 9 aa, Staphylococcus
TESDHGGYK

SEQ ID NO: 1988870 - protein, 15 aa, Staphylococcus
TESDLVGSTGYGYDD

SEQ ID NO: 1988871 - protein, 8 aa, Staphylococcus
TESDSNIV

SEQ ID NO: 1988872 - protein, 8 aa, Staphylococcus
TESEKQEI

SEQ ID NO: 1988873 - protein, 5 aa, Staphylococcus
TESEL

SEQ ID NO: 1988874 - protein, 8 aa, Staphylococcus
TESEQAQY

SEQ ID NO: 1988875 - protein, 8 aa, Staphylococcus
TESFESGE

SEQ ID NO: 1988876 - protein, 4 aa, Staphylococcus
TESG

SEQ ID NO: 1988877 - protein, 13 aa, Staphylococcus
TESGVSPRPIPGV

SEQ ID NO: 1988878 - protein, 5 aa, Staphylococcus
TESGY

SEQ ID NO: 1988879 - protein, 5 aa, Staphylococcus
TESHE

SEQ ID NO: 1988880 - protein, 10 aa, Staphylococcus
TESITPYEGG

SEQ ID NO: 1988881 - protein, 9 aa, Staphylococcus
TESKAQFQN

SEQ ID NO: 1988882 - protein, 6 aa, Staphylococcus
TESKEF

SEQ ID NO: 1988883 - protein, 5 aa, Staphylococcus
TESPF

SEQ ID NO: 1988884 - protein, 14 aa, Staphylococcus
TESPPGRNTDPLQN

SEQ ID NO: 1988885 - protein, 7 aa, Staphylococcus
TESPQQL

SEQ ID NO: 1988886 - protein, 8 aa, Staphylococcus
TESPYPSE

SEQ ID NO: 1988887 - protein, 4 aa, Staphylococcus
TESQ

SEQ ID NO: 1988888 - protein, 7 aa, Staphylococcus
TESQAGD

SEQ ID NO: 1988889 - protein, 11 aa, Staphylococcus
TESQGGQGVLD

SEQ ID NO: 1988890 - protein, 7 aa, Staphylococcus
TESQKIE

SEQ ID NO: 1988891 - protein, 4 aa, Staphylococcus
TESR

SEQ ID NO: 1988892 - protein, 9 aa, Staphylococcus
TESRHPDFK

SEQ ID NO: 1988893 - protein, 5 aa, Staphylococcus
TESRL

SEQ ID NO: 1988894 - protein, 10 aa, Staphylococcus
TESSEPTASI

SEQ ID NO: 1988895 - protein, 6 aa, Staphylococcus
TESSKE

SEQ ID NO: 1988896 - protein, 23 aa, Staphylococcus
TESTSNNEEDIKGTVSQDPKRRV

SEQ ID NO: 1988897 - protein, 8 aa, Staphylococcus
TESVDEAR

SEQ ID NO: 1988898 - protein, 29 aa, Staphylococcus
TESYQADETKAPNKKANHDKCDEKEASFE

SEQ ID NO: 1988899 - protein, 4 aa, Staphylococcus
TETA

SEQ ID NO: 1988900 - protein, 9 aa, Staphylococcus
TETADINRS

SEQ ID NO: 1988901 - protein, 11 aa, Staphylococcus
TETAKQLAAQR

SEQ ID NO: 1988902 - protein, 6 aa, Staphylococcus
TETARE

SEQ ID NO: 1988903 - protein, 7 aa, Staphylococcus
TETARIE

SEQ ID NO: 1988904 - protein, 6 aa, Staphylococcus
TETARK

SEQ ID NO: 1988905 - protein, 6 aa, Staphylococcus
TETARN

SEQ ID NO: 1988906 - protein, 9 aa, Staphylococcus
TETDDKEEI

SEQ ID NO: 1988907 - protein, 5 aa, Staphylococcus
TETDK

SEQ ID NO: 1988908 - protein, 10 aa, Staphylococcus
TETDKEAEYL

SEQ ID NO: 1988909 - protein, 6 aa, Staphylococcus
TETERK

SEQ ID NO: 1988910 - protein, 4 aa, Staphylococcus
TETF

SEQ ID NO: 1988911 - protein, 5 aa, Staphylococcus
TETFN

SEQ ID NO: 1988912 - protein, 6 aa, Staphylococcus
TETFNG

SEQ ID NO: 1988913 - protein, 10 aa, Staphylococcus
TETFNNKASH

SEQ ID NO: 1988914 - protein, 12 aa, Staphylococcus
TETGIKSAKKLK

SEQ ID NO: 1988915 - protein, 5 aa, Staphylococcus
TETGL

SEQ ID NO: 1988916 - protein, 4 aa, Staphylococcus
TETH

SEQ ID NO: 1988917 - protein, 4 aa, Staphylococcus
TETI

SEQ ID NO: 1988918 - protein, 7 aa, Staphylococcus
TETIDEA

SEQ ID NO: 1988919 - protein, 5 aa, Staphylococcus
TETIP

SEQ ID NO: 1988920 - protein, 7 aa, Staphylococcus
TETKANQ

SEQ ID NO: 1988921 - protein, 18 aa, Staphylococcus
TETKELKANDVKVEGKQF

SEQ ID NO: 1988922 - protein, 7 aa, Staphylococcus
TETKENR

SEQ ID NO: 1988923 - protein, 9 aa, Staphylococcus
TETKKERVK

SEQ ID NO: 1988924 - protein, 6 aa, Staphylococcus
TETKNQ

SEQ ID NO: 1988925 - protein, 6 aa, Staphylococcus
TETKPE

SEQ ID NO: 1988926 - protein, 10 aa, Staphylococcus
TETLENSVGN

SEQ ID NO: 1988927 - protein, 9 aa, Staphylococcus
TETNKSYTK

SEQ ID NO: 1988928 - protein, 7 aa, Staphylococcus
TETPETL

SEQ ID NO: 1988929 - protein, 7 aa, Staphylococcus
TETPGDV

SEQ ID NO: 1988930 - protein, 6 aa, Staphylococcus
TETPGE

SEQ ID NO: 1988931 - protein, 7 aa, Staphylococcus
TETPGEV

SEQ ID NO: 1988932 - protein, 9 aa, Staphylococcus
TETPQPKQY

SEQ ID NO: 1988933 - protein, 47 aa, Staphylococcus
TETQAQMDKRHKNKKSDKVNKKDLKKYMNNDEGIENNPFQDALKGLK

SEQ ID NO: 1988934 - protein, 26 aa, Staphylococcus
TETQAQMDQRLKNKNNGKVSKKDMKK

SEQ ID NO: 1988935 - protein, 9 aa, Staphylococcus
TETQEQMDK

SEQ ID NO: 1988936 - protein, 4 aa, Staphylococcus
TETS

SEQ ID NO: 1988937 - protein, 8 aa, Staphylococcus
TETSHSNE

SEQ ID NO: 1988938 - protein, 7 aa, Staphylococcus
TETTAPY

SEQ ID NO: 1988939 - protein, 5 aa, Staphylococcus
TETTV

SEQ ID NO: 1988940 - protein, 4 aa, Staphylococcus
TETV

SEQ ID NO: 1988941 - protein, 5 aa, Staphylococcus
TETVD

SEQ ID NO: 1988942 - protein, 7 aa, Staphylococcus
TETVDEA

SEQ ID NO: 1988943 - protein, 8 aa, Staphylococcus
TETYERTR

SEQ ID NO: 1988944 - protein, 8 aa, Staphylococcus
TETYSSDD

SEQ ID NO: 1988945 - protein, 18 aa, Staphylococcus
TEVEDSDVSDDDDRQEVR

SEQ ID NO: 1988946 - protein, 15 aa, Staphylococcus
TEVEEGTLSATGSGL

SEQ ID NO: 1988947 - protein, 16 aa, Staphylococcus
TEVEGGTLSATGSGLS

SEQ ID NO: 1988948 - protein, 5 aa, Staphylococcus
TEVET

SEQ ID NO: 1988949 - protein, 12 aa, Staphylococcus
TEVHDNKKDLDK

SEQ ID NO: 1988950 - protein, 13 aa, Staphylococcus
TEVNETEDSLGDV

SEQ ID NO: 1988951 - protein, 11 aa, Staphylococcus
TEVPGTTRDTL

SEQ ID NO: 1988952 - protein, 7 aa, Staphylococcus
TEVRELS

SEQ ID NO: 1988953 - protein, 10 aa, Staphylococcus
TEVRNEAGDF

SEQ ID NO: 1988954 - protein, 13 aa, Staphylococcus
TEVSDSEESVNSE

SEQ ID NO: 1988955 - protein, 10 aa, Staphylococcus
TEVSKSYPDI

SEQ ID NO: 1988956 - protein, 5 aa, Staphylococcus
TEVSP

SEQ ID NO: 1988957 - protein, 8 aa, Staphylococcus
TEYANAEP

SEQ ID NO: 1988958 - protein, 5 aa, Staphylococcus
TEYDR

SEQ ID NO: 1988959 - protein, 10 aa, Staphylococcus
TEYDTSSQAR

SEQ ID NO: 1988960 - protein, 4 aa, Staphylococcus
TEYE

SEQ ID NO: 1988961 - protein, 5 aa, Staphylococcus
TEYEG

SEQ ID NO: 1988962 - protein, 5 aa, Staphylococcus
TEYEQ

SEQ ID NO: 1988963 - protein, 4 aa, Staphylococcus
TEYG

SEQ ID NO: 1988964 - protein, 5 aa, Staphylococcus
TEYGT

SEQ ID NO: 1988965 - protein, 6 aa, Staphylococcus
TEYGTL

SEQ ID NO: 1988966 - protein, 8 aa, Staphylococcus
TEYHDQRG

SEQ ID NO: 1988967 - protein, 4 aa, Staphylococcus
TEYK

SEQ ID NO: 1988968 - protein, 6 aa, Staphylococcus
TEYKDD

SEQ ID NO: 1988969 - protein, 12 aa, Staphylococcus
TEYNLRKAKDRA

SEQ ID NO: 1988970 - protein, 9 aa, Staphylococcus
TEYNPSAYT

SEQ ID NO: 1988971 - protein, 5 aa, Staphylococcus
TEYQN

SEQ ID NO: 1988972 - protein, 5 aa, Staphylococcus
TEYSV

SEQ ID NO: 1988973 - protein, 12 aa, Staphylococcus
TEYYGPDGLPED

SEQ ID NO: 1988974 - protein, 12 aa, Staphylococcus
TFAGGGDNACGA

SEQ ID NO: 1988975 - protein, 7 aa, Staphylococcus
TFAQETS

SEQ ID NO: 1988976 - protein, 7 aa, Staphylococcus
TFAQKYG

SEQ ID NO: 1988977 - protein, 6 aa, Staphylococcus
TFDAKG

SEQ ID NO: 1988978 - protein, 5 aa, Staphylococcus
TFDED

SEQ ID NO: 1988979 - protein, 26 aa, Staphylococcus
TFDEDKVENQGGDTPMGRRGQPAELA

SEQ ID NO: 1988980 - protein, 26 aa, Staphylococcus
TFDEEKVENQGGDTPMGRRGQPAELA

SEQ ID NO: 1988981 - protein, 5 aa, Staphylococcus
TFDEV

SEQ ID NO: 1988982 - protein, 4 aa, Staphylococcus
TFDN

SEQ ID NO: 1988983 - protein, 11 aa, Staphylococcus
TFDNAEKTIHV

SEQ ID NO: 1988984 - protein, 12 aa, Staphylococcus
TFDNNKPRTRIQ

SEQ ID NO: 1988985 - protein, 13 aa, Staphylococcus
TFDPESPIDYTKP

SEQ ID NO: 1988986 - protein, 12 aa, Staphylococcus
TFDPNLKDKILN

SEQ ID NO: 1988987 - protein, 9 aa, Staphylococcus
TFDQDDSLE

SEQ ID NO: 1988988 - protein, 7 aa, Staphylococcus
TFDQTEL

SEQ ID NO: 1988989 - protein, 11 aa, Staphylococcus
TFDSNEKKLKA

SEQ ID NO: 1988990 - protein, 4 aa, Staphylococcus
TFDT

SEQ ID NO: 1988991 - protein, 5 aa, Staphylococcus
TFDVP

SEQ ID NO: 1988992 - protein, 10 aa, Staphylococcus
TFEANGQSYT

SEQ ID NO: 1988993 - protein, 10 aa, Staphylococcus
TFEANPDELT

SEQ ID NO: 1988994 - protein, 5 aa, Staphylococcus
TFEDA

SEQ ID NO: 1988995 - protein, 5 aa, Staphylococcus
TFEDY

SEQ ID NO: 1988996 - protein, 15 aa, Staphylococcus
TFEEKGTDKKANYYY

SEQ ID NO: 1988997 - protein, 8 aa, Staphylococcus
TFEERGDK

SEQ ID NO: 1988998 - protein, 7 aa, Staphylococcus
TFEERGN

SEQ ID NO: 1988999 - protein, 8 aa, Staphylococcus
TFEGQGKT

SEQ ID NO: 1989000 - protein, 16 aa, Staphylococcus
TFEGRDEGYKDRVNQA

SEQ ID NO: 1989001 - protein, 7 aa, Staphylococcus
TFEPKYE

SEQ ID NO: 1989002 - protein, 5 aa, Staphylococcus
TFEQN

SEQ ID NO: 1989003 - protein, 14 aa, Staphylococcus
TFEQTAKDLGGQAR

SEQ ID NO: 1989004 - protein, 4 aa, Staphylococcus
TFER

SEQ ID NO: 1989005 - protein, 6 aa, Staphylococcus
TFERTQ

SEQ ID NO: 1989006 - protein, 14 aa, Staphylococcus
TFESTAKALGGAAE

SEQ ID NO: 1989007 - protein, 12 aa, Staphylococcus
TFESTAKEFGGE

SEQ ID NO: 1989008 - protein, 34 aa, Staphylococcus
TFETTAKELGGKANVEISKSYPGFRRNDSETVTQ

SEQ ID NO: 1989009 - protein, 15 aa, Staphylococcus
TFGATKDDEYRGHHG

SEQ ID NO: 1989010 - protein, 14 aa, Staphylococcus
TFGATKDDQFRGHH

SEQ ID NO: 1989011 - protein, 18 aa, Staphylococcus
TFGDAANNLKVSSTKSMT

SEQ ID NO: 1989012 - protein, 12 aa, Staphylococcus
TFGNRDAVSHDM

SEQ ID NO: 1989013 - protein, 5 aa, Staphylococcus
TFGQR

SEQ ID NO: 1989014 - protein, 6 aa, Staphylococcus
TFGSGK

SEQ ID NO: 1989015 - protein, 10 aa, Staphylococcus
TFKEKEDKYQ

SEQ ID NO: 1989016 - protein, 10 aa, Staphylococcus
TFKEKENQYQ

SEQ ID NO: 1989017 - protein, 10 aa, Staphylococcus
TFKEQEDALT

SEQ ID NO: 1989018 - protein, 7 aa, Staphylococcus
TFKGDEV

SEQ ID NO: 1989019 - protein, 19 aa, Staphylococcus
TFKPEKRKDIELGEFKPCQ

SEQ ID NO: 1989020 - protein, 8 aa, Staphylococcus
TFKPHHKD

SEQ ID NO: 1989021 - protein, 8 aa, Staphylococcus
TFKPHNQN

SEQ ID NO: 1989022 - protein, 11 aa, Staphylococcus
TFKTNDNLGQK

SEQ ID NO: 1989023 - protein, 11 aa, Staphylococcus
TFKTSDNLGQK

SEQ ID NO: 1989024 - protein, 5 aa, Staphylococcus
TFKVN

SEQ ID NO: 1989025 - protein, 7 aa, Staphylococcus
TFNADGR

SEQ ID NO: 1989026 - protein, 4 aa, Staphylococcus
TFND

SEQ ID NO: 1989027 - protein, 5 aa, Staphylococcus
TFNDK

SEQ ID NO: 1989028 - protein, 8 aa, Staphylococcus
TFNDKSQK

SEQ ID NO: 1989029 - protein, 8 aa, Staphylococcus
TFNEDGSL

SEQ ID NO: 1989030 - protein, 5 aa, Staphylococcus
TFNKN

SEQ ID NO: 1989031 - protein, 12 aa, Staphylococcus
TFNPNMKEIIMS

SEQ ID NO: 1989032 - protein, 8 aa, Staphylococcus
TFNSEREF

SEQ ID NO: 1989033 - protein, 7 aa, Staphylococcus
TFNSKDR

SEQ ID NO: 1989034 - protein, 5 aa, Staphylococcus
TFNYG

SEQ ID NO: 1989035 - protein, 4 aa, Staphylococcus
TFPN

SEQ ID NO: 1989036 - protein, 5 aa, Staphylococcus
TFPNE

SEQ ID NO: 1989037 - protein, 5 aa, Staphylococcus
TFPTP

SEQ ID NO: 1989038 - protein, 6 aa, Staphylococcus
TFQDRR

SEQ ID NO: 1989039 - protein, 15 aa, Staphylococcus
TFQGRDANYKNRVNQ

SEQ ID NO: 1989040 - protein, 18 aa, Staphylococcus
TFRRKGISEEKTPEQKQY

SEQ ID NO: 1989041 - protein, 5 aa, Staphylococcus
TFSEE

SEQ ID NO: 1989042 - protein, 11 aa, Staphylococcus
TFSESAGKDLS

SEQ ID NO: 1989043 - protein, 10 aa, Staphylococcus
TFSETRSKDV

SEQ ID NO: 1989044 - protein, 9 aa, Staphylococcus
TFSGESHGI

SEQ ID NO: 1989045 - protein, 13 aa, Staphylococcus
TFSGSSRSTKREF

SEQ ID NO: 1989046 - protein, 4 aa, Staphylococcus
TFSK

SEQ ID NO: 1989047 - protein, 5 aa, Staphylococcus
TFSLN

SEQ ID NO: 1989048 - protein, 5 aa, Staphylococcus
TFSQT

SEQ ID NO: 1989049 - protein, 7 aa, Staphylococcus
TFSTTSL

SEQ ID NO: 1989050 - protein, 4 aa, Staphylococcus
TFTD

SEQ ID NO: 1989051 - protein, 7 aa, Staphylococcus
TFTGQES

SEQ ID NO: 1989052 - protein, 33 aa, Staphylococcus
TFTPKNNKTNLKKQTKSDVSKQQKHSNNTQNIK

SEQ ID NO: 1989053 - protein, 4 aa, Staphylococcus
TFTQ

SEQ ID NO: 1989054 - protein, 7 aa, Staphylococcus
TGAANGI

SEQ ID NO: 1989055 - protein, 8 aa, Staphylococcus
TGAEYEEA

SEQ ID NO: 1989056 - protein, 6 aa, Staphylococcus
TGAEYK

SEQ ID NO: 1989057 - protein, 4 aa, Staphylococcus
TGAG

SEQ ID NO: 1989058 - protein, 5 aa, Staphylococcus
TGAGH

SEQ ID NO: 1989059 - protein, 7 aa, Staphylococcus
TGAGKTE

SEQ ID NO: 1989060 - protein, 10 aa, Staphylococcus
TGAGSGIGEA

SEQ ID NO: 1989061 - protein, 12 aa, Staphylococcus
TGAHGKTSTTGL

SEQ ID NO: 1989062 - protein, 9 aa, Staphylococcus
TGAIAEEDT

SEQ ID NO: 1989063 - protein, 5 aa, Staphylococcus
TGAIT

SEQ ID NO: 1989064 - protein, 6 aa, Staphylococcus
TGAKPA

SEQ ID NO: 1989065 - protein, 52 aa, Staphylococcus
TGAKPFDGFTARDTVKTPEGKDYASTVKSPLKFNPKEAKQHLNKAKKALGKD

SEQ ID NO: 1989066 - protein, 22 aa, Staphylococcus
TGAKSNIPNIEGIDSAQNVYDS

SEQ ID NO: 1989067 - protein, 4 aa, Staphylococcus
TGAM

SEQ ID NO: 1989068 - protein, 13 aa, Staphylococcus
TGAMNDQAGKYQG

SEQ ID NO: 1989069 - protein, 20 aa, Staphylococcus
TGANGSKPRDVLITEADITN

SEQ ID NO: 1989070 - protein, 8 aa, Staphylococcus
TGANSGDV

SEQ ID NO: 1989071 - protein, 6 aa, Staphylococcus
TGAPKI

SEQ ID NO: 1989072 - protein, 9 aa, Staphylococcus
TGAQANIPK

SEQ ID NO: 1989073 - protein, 7 aa, Staphylococcus
TGAQGKI

SEQ ID NO: 1989074 - protein, 5 aa, Staphylococcus
TGAQH

SEQ ID NO: 1989075 - protein, 10 aa, Staphylococcus
TGASKSAVPI

SEQ ID NO: 1989076 - protein, 11 aa, Staphylococcus
TGASSGIGASI

SEQ ID NO: 1989077 - protein, 11 aa, Staphylococcus
TGCSASTVRRD

SEQ ID NO: 1989078 - protein, 15 aa, Staphylococcus
TGDANDYVGKGLSGG

SEQ ID NO: 1989079 - protein, 16 aa, Staphylococcus
TGDANDYVGKGLSGGK

SEQ ID NO: 1989080 - protein, 11 aa, Staphylococcus
TGDATVKNESK

SEQ ID NO: 1989081 - protein, 8 aa, Staphylococcus
TGDDPRKV

SEQ ID NO: 1989082 - protein, 7 aa, Staphylococcus
TGDERTV

SEQ ID NO: 1989083 - protein, 8 aa, Staphylococcus
TGDESNGN

SEQ ID NO: 1989084 - protein, 10 aa, Staphylococcus
TGDKAKEDNG

SEQ ID NO: 1989085 - protein, 19 aa, Staphylococcus
TGDKTQVDLPKGVKSGLKE

SEQ ID NO: 1989086 - protein, 6 aa, Staphylococcus
TGDPSA

SEQ ID NO: 1989087 - protein, 15 aa, Staphylococcus
TGDPSKIGHLPGATN

SEQ ID NO: 1989088 - protein, 14 aa, Staphylococcus
TGDPSKVGHLPGAN

SEQ ID NO: 1989089 - protein, 15 aa, Staphylococcus
TGDPSKVGHLPGATN

SEQ ID NO: 1989090 - protein, 17 aa, Staphylococcus
TGDPSKVGHLPGSTNVY

SEQ ID NO: 1989091 - protein, 7 aa, Staphylococcus
TGDQAEG

SEQ ID NO: 1989092 - protein, 7 aa, Staphylococcus
TGDQKFN

SEQ ID NO: 1989093 - protein, 37 aa, Staphylococcus
TGDQMTQDGPHKKGDKRRARAAAQNIVPNSTGAAKAI

SEQ ID NO: 1989094 - protein, 37 aa, Staphylococcus
TGDQNTQDGPHRKGDKRRARAAAENIVPNSTGAAKAI

SEQ ID NO: 1989095 - protein, 24 aa, Staphylococcus
TGDQSTQDAPHRKGDKRRARAAAE

SEQ ID NO: 1989096 - protein, 20 aa, Staphylococcus
TGDQTQIDLPKGVKSGLKEA

SEQ ID NO: 1989097 - protein, 19 aa, Staphylococcus
TGDQTQVDLPKGVKSGLKE

SEQ ID NO: 1989098 - protein, 6 aa, Staphylococcus
TGDRPF

SEQ ID NO: 1989099 - protein, 4 aa, Staphylococcus
TGDS

SEQ ID NO: 1989100 - protein, 9 aa, Staphylococcus
TGDSKFDVK

SEQ ID NO: 1989101 - protein, 9 aa, Staphylococcus
TGDSPLASN

SEQ ID NO: 1989102 - protein, 8 aa, Staphylococcus
TGDTDQSK

SEQ ID NO: 1989103 - protein, 10 aa, Staphylococcus
TGDTHLTNGE

SEQ ID NO: 1989104 - protein, 6 aa, Staphylococcus
TGDTTH

SEQ ID NO: 1989105 - protein, 10 aa, Staphylococcus
TGDVSDIDKP

SEQ ID NO: 1989106 - protein, 8 aa, Staphylococcus
TGEAEPSL

SEQ ID NO: 1989107 - protein, 6 aa, Staphylococcus
TGEAHI

SEQ ID NO: 1989108 - protein, 24 aa, Staphylococcus
TGEAHVEAKPATGGSGSQAGDSTI

SEQ ID NO: 1989109 - protein, 17 aa, Staphylococcus
TGEAKPYANVILASDVL

SEQ ID NO: 1989110 - protein, 8 aa, Staphylococcus
TGEDIHPA

SEQ ID NO: 1989111 - protein, 8 aa, Staphylococcus
TGEDIHPT

SEQ ID NO: 1989112 - protein, 9 aa, Staphylococcus
TGEDIHPTT

SEQ ID NO: 1989113 - protein, 10 aa, Staphylococcus
TGEDISPSTL

SEQ ID NO: 1989114 - protein, 14 aa, Staphylococcus
TGEEFVSSSEEMNR

SEQ ID NO: 1989115 - protein, 5 aa, Staphylococcus
TGEEI

SEQ ID NO: 1989116 - protein, 6 aa, Staphylococcus
TGEEYN

SEQ ID NO: 1989117 - protein, 7 aa, Staphylococcus
TGEEYQI

SEQ ID NO: 1989118 - protein, 4 aa, Staphylococcus
TGEF

SEQ ID NO: 1989119 - protein, 6 aa, Staphylococcus
TGEFGT

SEQ ID NO: 1989120 - protein, 4 aa, Staphylococcus
TGEG

SEQ ID NO: 1989121 - protein, 12 aa, Staphylococcus
TGEGASKDQPVG

SEQ ID NO: 1989122 - protein, 9 aa, Staphylococcus
TGEGKMDAQ

SEQ ID NO: 1989123 - protein, 19 aa, Staphylococcus
TGEGTSLKKEFSDISTHVV

SEQ ID NO: 1989124 - protein, 10 aa, Staphylococcus
TGEIKNNISP

SEQ ID NO: 1989125 - protein, 4 aa, Staphylococcus
TGEK

SEQ ID NO: 1989126 - protein, 9 aa, Staphylococcus
TGEKGLNKT

SEQ ID NO: 1989127 - protein, 16 aa, Staphylococcus
TGEKYDKVEVTKTEAL

SEQ ID NO: 1989128 - protein, 4 aa, Staphylococcus
TGEL

SEQ ID NO: 1989129 - protein, 6 aa, Staphylococcus
TGELAP

SEQ ID NO: 1989130 - protein, 5 aa, Staphylococcus
TGELE

SEQ ID NO: 1989131 - protein, 9 aa, Staphylococcus
TGENVRSNC

SEQ ID NO: 1989132 - protein, 8 aa, Staphylococcus
TGEPFGRE

SEQ ID NO: 1989133 - protein, 6 aa, Staphylococcus
TGERDG

SEQ ID NO: 1989134 - protein, 9 aa, Staphylococcus
TGERPNNPF

SEQ ID NO: 1989135 - protein, 5 aa, Staphylococcus
TGERY

SEQ ID NO: 1989136 - protein, 10 aa, Staphylococcus
TGESEPNSTV

SEQ ID NO: 1989137 - protein, 18 aa, Staphylococcus
TGESSISNMADEKAGVSA

SEQ ID NO: 1989138 - protein, 4 aa, Staphylococcus
TGET

SEQ ID NO: 1989139 - protein, 5 aa, Staphylococcus
TGETA

SEQ ID NO: 1989140 - protein, 8 aa, Staphylococcus
TGETGQTI

SEQ ID NO: 1989141 - protein, 6 aa, Staphylococcus
TGETRE

SEQ ID NO: 1989142 - protein, 7 aa, Staphylococcus
TGETSDC

SEQ ID NO: 1989143 - protein, 5 aa, Staphylococcus
TGEVT

SEQ ID NO: 1989144 - protein, 6 aa, Staphylococcus
TGEYEV

SEQ ID NO: 1989145 - protein, 6 aa, Staphylococcus
TGEYSG

SEQ ID NO: 1989146 - protein, 54 aa, Staphylococcus
TGFEGRVTKKDIEKAIKEGTSKTSSNIISPKDSPKVSKQAVYNEPSPGSSIPVN

SEQ ID NO: 1989147 - protein, 9 aa, Staphylococcus
TGFEHRKPG

SEQ ID NO: 1989148 - protein, 16 aa, Staphylococcus
TGFGGGSSEGQDYETI

SEQ ID NO: 1989149 - protein, 8 aa, Staphylococcus
TGFGHREP

SEQ ID NO: 1989150 - protein, 6 aa, Staphylococcus
TGFGRT

SEQ ID NO: 1989151 - protein, 14 aa, Staphylococcus
TGFKRKSDAKHQAE

SEQ ID NO: 1989152 - protein, 5 aa, Staphylococcus
TGFNK

SEQ ID NO: 1989153 - protein, 6 aa, Staphylococcus
TGFNRP

SEQ ID NO: 1989154 - protein, 15 aa, Staphylococcus
TGFPYNDNPNNVGAS

SEQ ID NO: 1989155 - protein, 13 aa, Staphylococcus
TGFQRKSDAKHHA

SEQ ID NO: 1989156 - protein, 7 aa, Staphylococcus
TGFSRGD

SEQ ID NO: 1989157 - protein, 16 aa, Staphylococcus
TGGAGLSAAATALDNN

SEQ ID NO: 1989158 - protein, 11 aa, Staphylococcus
TGGASGLGKAM

SEQ ID NO: 1989159 - protein, 20 aa, Staphylococcus
TGGASGLGKAMGKGLAEAGA

SEQ ID NO: 1989160 - protein, 10 aa, Staphylococcus
TGGATSTPSF

SEQ ID NO: 1989161 - protein, 7 aa, Staphylococcus
TGGDEAD

SEQ ID NO: 1989162 - protein, 8 aa, Staphylococcus
TGGDESDL

SEQ ID NO: 1989163 - protein, 11 aa, Staphylococcus
TGGDGSNSFNI

SEQ ID NO: 1989164 - protein, 11 aa, Staphylococcus
TGGDKSNSFNI

SEQ ID NO: 1989165 - protein, 12 aa, Staphylococcus
TGGDRSGSFNIS

SEQ ID NO: 1989166 - protein, 13 aa, Staphylococcus
TGGFEDALETSDE

SEQ ID NO: 1989167 - protein, 9 aa, Staphylococcus
TGGGIIEGD

SEQ ID NO: 1989168 - protein, 6 aa, Staphylococcus
TGGGIT

SEQ ID NO: 1989169 - protein, 15 aa, Staphylococcus
TGGGIVESTSAMNTL

SEQ ID NO: 1989170 - protein, 8 aa, Staphylococcus
TGGGQGIG

SEQ ID NO: 1989171 - protein, 14 aa, Staphylococcus
TGGGYDSHLIIPVI

SEQ ID NO: 1989172 - protein, 8 aa, Staphylococcus
TGGIGTVA

SEQ ID NO: 1989173 - protein, 9 aa, Staphylococcus
TGGISTSDV

SEQ ID NO: 1989174 - protein, 4 aa, Staphylococcus
TGGK

SEQ ID NO: 1989175 - protein, 5 aa, Staphylococcus
TGGKY

SEQ ID NO: 1989176 - protein, 5 aa, Staphylococcus
TGGLD

SEQ ID NO: 1989177 - protein, 5 aa, Staphylococcus
TGGLH

SEQ ID NO: 1989178 - protein, 5 aa, Staphylococcus
TGGLN

SEQ ID NO: 1989179 - protein, 12 aa, Staphylococcus
TGGLQECGNSQN

SEQ ID NO: 1989180 - protein, 13 aa, Staphylococcus
TGGLQECGNSQNC

SEQ ID NO: 1989181 - protein, 5 aa, Staphylococcus
TGGPG

SEQ ID NO: 1989182 - protein, 9 aa, Staphylococcus
TGGQPNEED

SEQ ID NO: 1989183 - protein, 9 aa, Staphylococcus
TGGQPNELD

SEQ ID NO: 1989184 - protein, 8 aa, Staphylococcus
TGGQPNQM

SEQ ID NO: 1989185 - protein, 27 aa, Staphylococcus
TGGQPQEKIPEFGQQTPLKRAGQPVEL

SEQ ID NO: 1989186 - protein, 27 aa, Staphylococcus
TGGQPQRNIPKFGKNTPLGRAGQPVEL

SEQ ID NO: 1989187 - protein, 27 aa, Staphylococcus
TGGQPQSAIPQFGQDTPLGRAGQPVEL

SEQ ID NO: 1989188 - protein, 27 aa, Staphylococcus
TGGQPQSAIPTFGQQTPLGRAGQPVEL

SEQ ID NO: 1989189 - protein, 14 aa, Staphylococcus
TGGQYDSHLLVPII

SEQ ID NO: 1989190 - protein, 14 aa, Staphylococcus
TGGQYDSQLIIPVT

SEQ ID NO: 1989191 - protein, 6 aa, Staphylococcus
TGGRFS

SEQ ID NO: 1989192 - protein, 14 aa, Staphylococcus
TGGRNGHVQTDDKA

SEQ ID NO: 1989193 - protein, 6 aa, Staphylococcus
TGGSAN

SEQ ID NO: 1989194 - protein, 10 aa, Staphylococcus
TGGSDWTKQI

SEQ ID NO: 1989195 - protein, 10 aa, Staphylococcus
TGGSDWTKTI

SEQ ID NO: 1989196 - protein, 6 aa, Staphylococcus
TGGSTM

SEQ ID NO: 1989197 - protein, 10 aa, Staphylococcus
TGGTGIAPRD

SEQ ID NO: 1989198 - protein, 8 aa, Staphylococcus
TGGTGIAQ

SEQ ID NO: 1989199 - protein, 10 aa, Staphylococcus
TGGTGISQRD

SEQ ID NO: 1989200 - protein, 6 aa, Staphylococcus
TGGTMT

SEQ ID NO: 1989201 - protein, 12 aa, Staphylococcus
TGGTPESSLKAG

SEQ ID NO: 1989202 - protein, 12 aa, Staphylococcus
TGGTSKNAIGSD

SEQ ID NO: 1989203 - protein, 17 aa, Staphylococcus
TGGTSVPQTGSTGDGYQ

SEQ ID NO: 1989204 - protein, 13 aa, Staphylococcus
TGGVTSPTDHPNF

SEQ ID NO: 1989205 - protein, 7 aa, Staphylococcus
TGGYSTG

SEQ ID NO: 1989206 - protein, 11 aa, Staphylococcus
TGGYSTGYQPI

SEQ ID NO: 1989207 - protein, 7 aa, Staphylococcus
TGHAPEN

SEQ ID NO: 1989208 - protein, 4 aa, Staphylococcus
TGHG

SEQ ID NO: 1989209 - protein, 13 aa, Staphylococcus
TGHGVGQSLHEAP

SEQ ID NO: 1989210 - protein, 12 aa, Staphylococcus
TGHKVASAETEI

SEQ ID NO: 1989211 - protein, 6 aa, Staphylococcus
TGHLSK

SEQ ID NO: 1989212 - protein, 9 aa, Staphylococcus
TGHPKSVEQ

SEQ ID NO: 1989213 - protein, 10 aa, Staphylococcus
TGHPYAASGA

SEQ ID NO: 1989214 - protein, 7 aa, Staphylococcus
TGHQTTL

SEQ ID NO: 1989215 - protein, 17 aa, Staphylococcus
TGHRTSVEGAPLKRGAA

SEQ ID NO: 1989216 - protein, 20 aa, Staphylococcus
TGHSEKPTQKQNLTSKVKHR

SEQ ID NO: 1989217 - protein, 4 aa, Staphylococcus
TGIA

SEQ ID NO: 1989218 - protein, 5 aa, Staphylococcus
TGIAP

SEQ ID NO: 1989219 - protein, 5 aa, Staphylococcus
TGIAQ

SEQ ID NO: 1989220 - protein, 4 aa, Staphylococcus
TGID

SEQ ID NO: 1989221 - protein, 12 aa, Staphylococcus
TGIDPKRRGETL

SEQ ID NO: 1989222 - protein, 8 aa, Staphylococcus
TGIDSNEI

SEQ ID NO: 1989223 - protein, 8 aa, Staphylococcus
TGIDTNHN

SEQ ID NO: 1989224 - protein, 8 aa, Staphylococcus
TGIEEGKH

SEQ ID NO: 1989225 - protein, 8 aa, Staphylococcus
TGIGPKSA

SEQ ID NO: 1989226 - protein, 6 aa, Staphylococcus
TGIGRT

SEQ ID NO: 1989227 - protein, 16 aa, Staphylococcus
TGIGSSKRQAREDVNN

SEQ ID NO: 1989228 - protein, 12 aa, Staphylococcus
TGIKASKHIGGF

SEQ ID NO: 1989229 - protein, 12 aa, Staphylococcus
TGIKESKHIGGF

SEQ ID NO: 1989230 - protein, 9 aa, Staphylococcus
TGIKPTHED

SEQ ID NO: 1989231 - protein, 8 aa, Staphylococcus
TGIKQSKH

SEQ ID NO: 1989232 - protein, 12 aa, Staphylococcus
TGIKQSKHVGGF

SEQ ID NO: 1989233 - protein, 4 aa, Staphylococcus
TGIP

SEQ ID NO: 1989234 - protein, 20 aa, Staphylococcus
TGIQNGSLEDRHGWRFVVPR

SEQ ID NO: 1989235 - protein, 20 aa, Staphylococcus
TGIQSGKLDDPQGWRVVVPE

SEQ ID NO: 1989236 - protein, 16 aa, Staphylococcus
TGISSSKRQAREDVNN

SEQ ID NO: 1989237 - protein, 8 aa, Staphylococcus
TGKEFDTD

SEQ ID NO: 1989238 - protein, 8 aa, Staphylococcus
TGKEGDPQ

SEQ ID NO: 1989239 - protein, 7 aa, Staphylococcus
TGKEIQN

SEQ ID NO: 1989240 - protein, 9 aa, Staphylococcus
TGKESYKEG

SEQ ID NO: 1989241 - protein, 8 aa, Staphylococcus
TGKEVADK

SEQ ID NO: 1989242 - protein, 16 aa, Staphylococcus
TGKFGGLGNTLKTGTK

SEQ ID NO: 1989243 - protein, 9 aa, Staphylococcus
TGKFNHGDK

SEQ ID NO: 1989244 - protein, 4 aa, Staphylococcus
TGKG

SEQ ID NO: 1989245 - protein, 14 aa, Staphylococcus
TGKGGHGAKPHETI

SEQ ID NO: 1989246 - protein, 9 aa, Staphylococcus
TGKGLSRQQ

SEQ ID NO: 1989247 - protein, 9 aa, Staphylococcus
TGKGQAHNH

SEQ ID NO: 1989248 - protein, 9 aa, Staphylococcus
TGKGQAVNH

SEQ ID NO: 1989249 - protein, 10 aa, Staphylococcus
TGKGSESGNA

SEQ ID NO: 1989250 - protein, 6 aa, Staphylococcus
TGKHKK

SEQ ID NO: 1989251 - protein, 12 aa, Staphylococcus
TGKIKKTIEPKE

SEQ ID NO: 1989252 - protein, 17 aa, Staphylococcus
TGKINQLGSSDNTAVKS

SEQ ID NO: 1989253 - protein, 11 aa, Staphylococcus
TGKISKSGVNH

SEQ ID NO: 1989254 - protein, 9 aa, Staphylococcus
TGKKDPIGA

SEQ ID NO: 1989255 - protein, 17 aa, Staphylococcus
TGKKPKSVYEEFGIGKD

SEQ ID NO: 1989256 - protein, 9 aa, Staphylococcus
TGKLRDAEY

SEQ ID NO: 1989257 - protein, 5 aa, Staphylococcus
TGKME

SEQ ID NO: 1989258 - protein, 4 aa, Staphylococcus
TGKN

SEQ ID NO: 1989259 - protein, 7 aa, Staphylococcus
TGKNADE

SEQ ID NO: 1989260 - protein, 8 aa, Staphylococcus
TGKNAEEV

SEQ ID NO: 1989261 - protein, 8 aa, Staphylococcus
TGKNIHST

SEQ ID NO: 1989262 - protein, 9 aa, Staphylococcus
TGKPARGIE

SEQ ID NO: 1989263 - protein, 4 aa, Staphylococcus
TGKS

SEQ ID NO: 1989264 - protein, 6 aa, Staphylococcus
TGKSAS

SEQ ID NO: 1989265 - protein, 10 aa, Staphylococcus
TGKSASVAPI

SEQ ID NO: 1989266 - protein, 12 aa, Staphylococcus
TGKSATSDDANE

SEQ ID NO: 1989267 - protein, 13 aa, Staphylococcus
TGKSATSDDANEM

SEQ ID NO: 1989268 - protein, 13 aa, Staphylococcus
TGKSATSEDANEM

SEQ ID NO: 1989269 - protein, 5 aa, Staphylococcus
TGKSH

SEQ ID NO: 1989270 - protein, 6 aa, Staphylococcus
TGKSKA

SEQ ID NO: 1989271 - protein, 10 aa, Staphylococcus
TGKSPKEYTY

SEQ ID NO: 1989272 - protein, 12 aa, Staphylococcus
TGKSSTAKDANE

SEQ ID NO: 1989273 - protein, 13 aa, Staphylococcus
TGKSSTAKDANEM

SEQ ID NO: 1989274 - protein, 7 aa, Staphylococcus
TGKSTAM

SEQ ID NO: 1989275 - protein, 6 aa, Staphylococcus
TGKSTL

SEQ ID NO: 1989276 - protein, 7 aa, Staphylococcus
TGKSTLG

SEQ ID NO: 1989277 - protein, 5 aa, Staphylococcus
TGKSY

SEQ ID NO: 1989278 - protein, 7 aa, Staphylococcus
TGKTADE

SEQ ID NO: 1989279 - protein, 15 aa, Staphylococcus
TGKTLKENNKGKEIT

SEQ ID NO: 1989280 - protein, 9 aa, Staphylococcus
TGKTSSYSR

SEQ ID NO: 1989281 - protein, 9 aa, Staphylococcus
TGKTSTYSK

SEQ ID NO: 1989282 - protein, 7 aa, Staphylococcus
TGKTTIG

SEQ ID NO: 1989283 - protein, 6 aa, Staphylococcus
TGKTTL

SEQ ID NO: 1989284 - protein, 7 aa, Staphylococcus
TGKTTVG

SEQ ID NO: 1989285 - protein, 19 aa, Staphylococcus
TGKTVAENLEQQPDLTDNK

SEQ ID NO: 1989286 - protein, 7 aa, Staphylococcus
TGKVVSP

SEQ ID NO: 1989287 - protein, 6 aa, Staphylococcus
TGLDKN

SEQ ID NO: 1989288 - protein, 7 aa, Staphylococcus
TGLEGQI

SEQ ID NO: 1989289 - protein, 8 aa, Staphylococcus
TGLENNDP

SEQ ID NO: 1989290 - protein, 15 aa, Staphylococcus
TGLGAQGAMPYRKDL

SEQ ID NO: 1989291 - protein, 6 aa, Staphylococcus
TGLGGG

SEQ ID NO: 1989292 - protein, 9 aa, Staphylococcus
TGLGGGVIS

SEQ ID NO: 1989293 - protein, 11 aa, Staphylococcus
TGLKGVKNPSE

SEQ ID NO: 1989294 - protein, 4 aa, Staphylococcus
TGLP

SEQ ID NO: 1989295 - protein, 5 aa, Staphylococcus
TGLPA

SEQ ID NO: 1989296 - protein, 7 aa, Staphylococcus
TGLPSER

SEQ ID NO: 1989297 - protein, 9 aa, Staphylococcus
TGLRTSEYE

SEQ ID NO: 1989298 - protein, 6 aa, Staphylococcus
TGLSQT

SEQ ID NO: 1989299 - protein, 9 aa, Staphylococcus
TGLTREELD

SEQ ID NO: 1989300 - protein, 10 aa, Staphylococcus
TGLTSSAGIS

SEQ ID NO: 1989301 - protein, 10 aa, Staphylococcus
TGLTSSAGVS

SEQ ID NO: 1989302 - protein, 4 aa, Staphylococcus
TGME

SEQ ID NO: 1989303 - protein, 7 aa, Staphylococcus
TGMEITE

SEQ ID NO: 1989304 - protein, 13 aa, Staphylococcus
TGMEITEKGKEVI

SEQ ID NO: 1989305 - protein, 4 aa, Staphylococcus
TGMG

SEQ ID NO: 1989306 - protein, 15 aa, Staphylococcus
TGMIGDPSGKSEERI

SEQ ID NO: 1989307 - protein, 30 aa, Staphylococcus
TGMIGDPSGKSEERTLQTEAQVETNVQGIN

SEQ ID NO: 1989308 - protein, 30 aa, Staphylococcus
TGMIGDPSGKSEERVLQTEDQVAKNVEGLS

SEQ ID NO: 1989309 - protein, 29 aa, Staphylococcus
TGMIGDPSGKSEERVLQTEEQVEDNVQGI

SEQ ID NO: 1989310 - protein, 15 aa, Staphylococcus
TGMIGDPSGKTDERV

SEQ ID NO: 1989311 - protein, 16 aa, Staphylococcus
TGMPSEGGFGVTVAEL

SEQ ID NO: 1989312 - protein, 5 aa, Staphylococcus
TGMRK

SEQ ID NO: 1989313 - protein, 4 aa, Staphylococcus
TGNA

SEQ ID NO: 1989314 - protein, 8 aa, Staphylococcus
TGNDHGIN

SEQ ID NO: 1989315 - protein, 14 aa, Staphylococcus
TGNDKENKKKATKI

SEQ ID NO: 1989316 - protein, 10 aa, Staphylococcus
TGNDKNINRD

SEQ ID NO: 1989317 - protein, 9 aa, Staphylococcus
TGNDQPALG

SEQ ID NO: 1989318 - protein, 24 aa, Staphylococcus
TGNDTRGAEASAHAYAARDGQYRG

SEQ ID NO: 1989319 - protein, 24 aa, Staphylococcus
TGNDTRGAEASAHAYASRDEQYRG

SEQ ID NO: 1989320 - protein, 12 aa, Staphylococcus
TGNDTRGAEASV

SEQ ID NO: 1989321 - protein, 24 aa, Staphylococcus
TGNDTRGAEATAHAYASKDGQYRG

SEQ ID NO: 1989322 - protein, 13 aa, Staphylococcus
TGNDTRSAEASAH

SEQ ID NO: 1989323 - protein, 10 aa, Staphylococcus
TGNDYNNKID

SEQ ID NO: 1989324 - protein, 6 aa, Staphylococcus
TGNESF

SEQ ID NO: 1989325 - protein, 15 aa, Staphylococcus
TGNETEGYKGSTTFT

SEQ ID NO: 1989326 - protein, 5 aa, Staphylococcus
TGNGA

SEQ ID NO: 1989327 - protein, 13 aa, Staphylococcus
TGNGNENKSEVTG

SEQ ID NO: 1989328 - protein, 12 aa, Staphylococcus
TGNGQSDLDAST

SEQ ID NO: 1989329 - protein, 22 aa, Staphylococcus
TGNGSNPINSKTIQQNIKGKKI

SEQ ID NO: 1989330 - protein, 24 aa, Staphylococcus
TGNGSNPINSKTVQQKVKNKKVAN

SEQ ID NO: 1989331 - protein, 22 aa, Staphylococcus
TGNGTIEADNPQYTTRIQEGKH

SEQ ID NO: 1989332 - protein, 13 aa, Staphylococcus
TGNGTINADNPLY

SEQ ID NO: 1989333 - protein, 12 aa, Staphylococcus
TGNIEKKNAKTV

SEQ ID NO: 1989334 - protein, 6 aa, Staphylococcus
TGNKEI

SEQ ID NO: 1989335 - protein, 9 aa, Staphylococcus
TGNNATEPL

SEQ ID NO: 1989336 - protein, 17 aa, Staphylococcus
TGNPIAEEYQANRQKKH

SEQ ID NO: 1989337 - protein, 6 aa, Staphylococcus
TGNPNA

SEQ ID NO: 1989338 - protein, 6 aa, Staphylococcus
TGNQAI

SEQ ID NO: 1989339 - protein, 10 aa, Staphylococcus
TGNQSIDHTS

SEQ ID NO: 1989340 - protein, 11 aa, Staphylococcus
TGNRRKEALDK

SEQ ID NO: 1989341 - protein, 9 aa, Staphylococcus
TGNRRPEAL

SEQ ID NO: 1989342 - protein, 8 aa, Staphylococcus
TGNSADVR

SEQ ID NO: 1989343 - protein, 6 aa, Staphylococcus
TGNSSI

SEQ ID NO: 1989344 - protein, 7 aa, Staphylococcus
TGNTEVN

SEQ ID NO: 1989345 - protein, 18 aa, Staphylococcus
TGNTSRKRNSLKITSIEF

SEQ ID NO: 1989346 - protein, 11 aa, Staphylococcus
TGNYNDKTAEI

SEQ ID NO: 1989347 - protein, 12 aa, Staphylococcus
TGNYNDKTANIY

SEQ ID NO: 1989348 - protein, 10 aa, Staphylococcus
TGPAIERPGD

SEQ ID NO: 1989349 - protein, 6 aa, Staphylococcus
TGPGLV

SEQ ID NO: 1989350 - protein, 7 aa, Staphylococcus
TGPIATP

SEQ ID NO: 1989351 - protein, 7 aa, Staphylococcus
TGPIDTP

SEQ ID NO: 1989352 - protein, 11 aa, Staphylococcus
TGPISKSGVNH

SEQ ID NO: 1989353 - protein, 10 aa, Staphylococcus
TGPLGDTVSA

SEQ ID NO: 1989354 - protein, 9 aa, Staphylococcus
TGPLTTSSL

SEQ ID NO: 1989355 - protein, 8 aa, Staphylococcus
TGPREAAI

SEQ ID NO: 1989356 - protein, 4 aa, Staphylococcus
TGPS

SEQ ID NO: 1989357 - protein, 9 aa, Staphylococcus
TGPSKGGDV

SEQ ID NO: 1989358 - protein, 9 aa, Staphylococcus
TGPSKGGEV

SEQ ID NO: 1989359 - protein, 8 aa, Staphylococcus
TGPSKGGH

SEQ ID NO: 1989360 - protein, 14 aa, Staphylococcus
TGPTAVATSTEDVV

SEQ ID NO: 1989361 - protein, 5 aa, Staphylococcus
TGPVK

SEQ ID NO: 1989362 - protein, 5 aa, Staphylococcus
TGQDL

SEQ ID NO: 1989363 - protein, 11 aa, Staphylococcus
TGQDSERGTFS

SEQ ID NO: 1989364 - protein, 9 aa, Staphylococcus
TGQGGNGGQ

SEQ ID NO: 1989365 - protein, 20 aa, Staphylococcus
TGQHSNKLDIEGSEYTHDSR

SEQ ID NO: 1989366 - protein, 20 aa, Staphylococcus
TGQHSNKLPIEGKEYTHDSR

SEQ ID NO: 1989367 - protein, 12 aa, Staphylococcus
TGQIDTELTFAT

SEQ ID NO: 1989368 - protein, 11 aa, Staphylococcus
TGQLKQDYSPM

SEQ ID NO: 1989369 - protein, 5 aa, Staphylococcus
TGQLP

SEQ ID NO: 1989370 - protein, 8 aa, Staphylococcus
TGQLPKGV

SEQ ID NO: 1989371 - protein, 7 aa, Staphylococcus
TGQNAEE

SEQ ID NO: 1989372 - protein, 18 aa, Staphylococcus
TGQNPESPKQVAEAVSKI

SEQ ID NO: 1989373 - protein, 21 aa, Staphylococcus
TGQNPQSAQQVALDTLKALGH

SEQ ID NO: 1989374 - protein, 21 aa, Staphylococcus
TGQNPQSGKAVAEKFLELKNN

SEQ ID NO: 1989375 - protein, 19 aa, Staphylococcus
TGQNPQSGKAVAEKFLESQ

SEQ ID NO: 1989376 - protein, 21 aa, Staphylococcus
TGQNPQSPKGVAEKVLYLLNV

SEQ ID NO: 1989377 - protein, 20 aa, Staphylococcus
TGQNPQSPSQVAEAVKKQLL

SEQ ID NO: 1989378 - protein, 19 aa, Staphylococcus
TGQNPQSSEVIGKALVNAL

SEQ ID NO: 1989379 - protein, 18 aa, Staphylococcus
TGQNPQSSVAIGKAIRDA

SEQ ID NO: 1989380 - protein, 8 aa, Staphylococcus
TGQNVRSN

SEQ ID NO: 1989381 - protein, 4 aa, Staphylococcus
TGQQ

SEQ ID NO: 1989382 - protein, 7 aa, Staphylococcus
TGQQLPQ

SEQ ID NO: 1989383 - protein, 6 aa, Staphylococcus
TGQTAY

SEQ ID NO: 1989384 - protein, 7 aa, Staphylococcus
TGQTAYN

SEQ ID NO: 1989385 - protein, 13 aa, Staphylococcus
TGQTDIKDAINNI

SEQ ID NO: 1989386 - protein, 15 aa, Staphylococcus
TGQTIEAKKEKLNTE

SEQ ID NO: 1989387 - protein, 5 aa, Staphylococcus
TGQWD

SEQ ID NO: 1989388 - protein, 12 aa, Staphylococcus
TGQYTGRSPKDK

SEQ ID NO: 1989389 - protein, 12 aa, Staphylococcus
TGRAQKNVADEA

SEQ ID NO: 1989390 - protein, 9 aa, Staphylococcus
TGRDESRLA

SEQ ID NO: 1989391 - protein, 8 aa, Staphylococcus
TGRDKVTK

SEQ ID NO: 1989392 - protein, 8 aa, Staphylococcus
TGRIGGRA

SEQ ID NO: 1989393 - protein, 6 aa, Staphylococcus
TGRKDD

SEQ ID NO: 1989394 - protein, 7 aa, Staphylococcus
TGRKDDH

SEQ ID NO: 1989395 - protein, 10 aa, Staphylococcus
TGRKGHSSIE

SEQ ID NO: 1989396 - protein, 10 aa, Staphylococcus
TGRKGSSSIE

SEQ ID NO: 1989397 - protein, 9 aa, Staphylococcus
TGRKGYSSL

SEQ ID NO: 1989398 - protein, 11 aa, Staphylococcus
TGRKPNTDLNL

SEQ ID NO: 1989399 - protein, 14 aa, Staphylococcus
TGRKTEGYHGSTTF

SEQ ID NO: 1989400 - protein, 9 aa, Staphylococcus
TGRKVNRSM

SEQ ID NO: 1989401 - protein, 4 aa, Staphylococcus
TGRL

SEQ ID NO: 1989402 - protein, 5 aa, Staphylococcus
TGRPL

SEQ ID NO: 1989403 - protein, 15 aa, Staphylococcus
TGRPTEGYQGSTTFT

SEQ ID NO: 1989404 - protein, 7 aa, Staphylococcus
TGRQPNI

SEQ ID NO: 1989405 - protein, 8 aa, Staphylococcus
TGRQPNIK

SEQ ID NO: 1989406 - protein, 14 aa, Staphylococcus
TGRQPNTQGLGLEN

SEQ ID NO: 1989407 - protein, 10 aa, Staphylococcus
TGRQPNTQVA

SEQ ID NO: 1989408 - protein, 7 aa, Staphylococcus
TGRSEEH

SEQ ID NO: 1989409 - protein, 7 aa, Staphylococcus
TGRVPNV

SEQ ID NO: 1989410 - protein, 8 aa, Staphylococcus
TGSAGALD

SEQ ID NO: 1989411 - protein, 10 aa, Staphylococcus
TGSAGALDED

SEQ ID NO: 1989412 - protein, 10 aa, Staphylococcus
TGSAGALDES

SEQ ID NO: 1989413 - protein, 11 aa, Staphylococcus
TGSAGALDESL

SEQ ID NO: 1989414 - protein, 11 aa, Staphylococcus
TGSAGALDKSL

SEQ ID NO: 1989415 - protein, 7 aa, Staphylococcus
TGSDDAI

SEQ ID NO: 1989416 - protein, 5 aa, Staphylococcus
TGSDE

SEQ ID NO: 1989417 - protein, 5 aa, Staphylococcus
TGSDM

SEQ ID NO: 1989418 - protein, 4 aa, Staphylococcus
TGSE

SEQ ID NO: 1989419 - protein, 7 aa, Staphylococcus
TGSEADG

SEQ ID NO: 1989420 - protein, 15 aa, Staphylococcus
TGSEDLQNADGEQLD

SEQ ID NO: 1989421 - protein, 8 aa, Staphylococcus
TGSEESHC

SEQ ID NO: 1989422 - protein, 16 aa, Staphylococcus
TGSGISPRPIPGTKGG

SEQ ID NO: 1989423 - protein, 21 aa, Staphylococcus
TGSGKTLTSFKSSQVLSEQEN

SEQ ID NO: 1989424 - protein, 10 aa, Staphylococcus
TGSGPTGAKI

SEQ ID NO: 1989425 - protein, 10 aa, Staphylococcus
TGSGPTGSSI

SEQ ID NO: 1989426 - protein, 23 aa, Staphylococcus
TGSGTLNADNPQYTTRIEEGKNP

SEQ ID NO: 1989427 - protein, 4 aa, Staphylococcus
TGSI

SEQ ID NO: 1989428 - protein, 7 aa, Staphylococcus
TGSKEHN

SEQ ID NO: 1989429 - protein, 5 aa, Staphylococcus
TGSLE

SEQ ID NO: 1989430 - protein, 12 aa, Staphylococcus
TGSNGKTTTKDM

SEQ ID NO: 1989431 - protein, 11 aa, Staphylococcus
TGSNGSGKTSL

SEQ ID NO: 1989432 - protein, 7 aa, Staphylococcus
TGSNTIS

SEQ ID NO: 1989433 - protein, 7 aa, Staphylococcus
TGSNTVS

SEQ ID NO: 1989434 - protein, 8 aa, Staphylococcus
TGSNTVSV

SEQ ID NO: 1989435 - protein, 8 aa, Staphylococcus
TGSPASSH

SEQ ID NO: 1989436 - protein, 9 aa, Staphylococcus
TGSPASSPY

SEQ ID NO: 1989437 - protein, 8 aa, Staphylococcus
TGSQPADL

SEQ ID NO: 1989438 - protein, 6 aa, Staphylococcus
TGSQPM

SEQ ID NO: 1989439 - protein, 6 aa, Staphylococcus
TGSQRV

SEQ ID NO: 1989440 - protein, 6 aa, Staphylococcus
TGSRPF

SEQ ID NO: 1989441 - protein, 9 aa, Staphylococcus
TGSSPFVPP

SEQ ID NO: 1989442 - protein, 16 aa, Staphylococcus
TGSSPGNDLRYSTEKV

SEQ ID NO: 1989443 - protein, 10 aa, Staphylococcus
TGSSSDPTSF

SEQ ID NO: 1989444 - protein, 5 aa, Staphylococcus
TGSTK

SEQ ID NO: 1989445 - protein, 7 aa, Staphylococcus
TGSTNVG

SEQ ID NO: 1989446 - protein, 15 aa, Staphylococcus
TGSTPIDKKAVSKRI

SEQ ID NO: 1989447 - protein, 8 aa, Staphylococcus
TGSTPKSL

SEQ ID NO: 1989448 - protein, 8 aa, Staphylococcus
TGSTPVGK

SEQ ID NO: 1989449 - protein, 12 aa, Staphylococcus
TGSTRLKSGTAQ

SEQ ID NO: 1989450 - protein, 9 aa, Staphylococcus
TGSVDEASL

SEQ ID NO: 1989451 - protein, 5 aa, Staphylococcus
TGSVN

SEQ ID NO: 1989452 - protein, 6 aa, Staphylococcus
TGSWQK

SEQ ID NO: 1989453 - protein, 8 aa, Staphylococcus
TGTAELGG

SEQ ID NO: 1989454 - protein, 6 aa, Staphylococcus
TGTAKL

SEQ ID NO: 1989455 - protein, 13 aa, Staphylococcus
TGTAKQGEKELND

SEQ ID NO: 1989456 - protein, 6 aa, Staphylococcus
TGTAQL

SEQ ID NO: 1989457 - protein, 21 aa, Staphylococcus
TGTDEHGQKIQEKAHKAGVSE

SEQ ID NO: 1989458 - protein, 23 aa, Staphylococcus
TGTDEHGQKIQEKAQKAGKSEIE

SEQ ID NO: 1989459 - protein, 23 aa, Staphylococcus
TGTDEHGQKIQEKAQKAGKTELE

SEQ ID NO: 1989460 - protein, 4 aa, Staphylococcus
TGTE

SEQ ID NO: 1989461 - protein, 11 aa, Staphylococcus
TGTHRDQTQEE

SEQ ID NO: 1989462 - protein, 8 aa, Staphylococcus
TGTHTSSN

SEQ ID NO: 1989463 - protein, 5 aa, Staphylococcus
TGTID

SEQ ID NO: 1989464 - protein, 10 aa, Staphylococcus
TGTKDDGSFN

SEQ ID NO: 1989465 - protein, 7 aa, Staphylococcus
TGTMPYE

SEQ ID NO: 1989466 - protein, 10 aa, Staphylococcus
TGTNGKTTVT

SEQ ID NO: 1989467 - protein, 5 aa, Staphylococcus
TGTNL

SEQ ID NO: 1989468 - protein, 6 aa, Staphylococcus
TGTPIH

SEQ ID NO: 1989469 - protein, 5 aa, Staphylococcus
TGTPM

SEQ ID NO: 1989470 - protein, 26 aa, Staphylococcus
TGTPPRVNSKTIDYSKTEIQPGDDVG

SEQ ID NO: 1989471 - protein, 27 aa, Staphylococcus
TGTPPRVNSKTIDYSKTEIQPGDDVGR

SEQ ID NO: 1989472 - protein, 8 aa, Staphylococcus
TGTPSPNS

SEQ ID NO: 1989473 - protein, 9 aa, Staphylococcus
TGTQSKISG

SEQ ID NO: 1989474 - protein, 9 aa, Staphylococcus
TGTQSKLSG

SEQ ID NO: 1989475 - protein, 9 aa, Staphylococcus
TGTQTKLSG

SEQ ID NO: 1989476 - protein, 6 aa, Staphylococcus
TGTSEI

SEQ ID NO: 1989477 - protein, 5 aa, Staphylococcus
TGTSH

SEQ ID NO: 1989478 - protein, 6 aa, Staphylococcus
TGTSHW

SEQ ID NO: 1989479 - protein, 11 aa, Staphylococcus
TGTSNYEDISD

SEQ ID NO: 1989480 - protein, 11 aa, Staphylococcus
TGTSPIVSGEL

SEQ ID NO: 1989481 - protein, 17 aa, Staphylococcus
TGTTLKSNGLEEREQIG

SEQ ID NO: 1989482 - protein, 13 aa, Staphylococcus
TGTTLKSNGLVEK

SEQ ID NO: 1989483 - protein, 8 aa, Staphylococcus
TGTTTIGE

SEQ ID NO: 1989484 - protein, 15 aa, Staphylococcus
TGTYNVADDDPVRGD

SEQ ID NO: 1989485 - protein, 8 aa, Staphylococcus
TGTYRSST

SEQ ID NO: 1989486 - protein, 9 aa, Staphylococcus
TGTYTKGET

SEQ ID NO: 1989487 - protein, 4 aa, Staphylococcus
TGVD

SEQ ID NO: 1989488 - protein, 6 aa, Staphylococcus
TGVDDN

SEQ ID NO: 1989489 - protein, 5 aa, Staphylococcus
TGVEE

SEQ ID NO: 1989490 - protein, 4 aa, Staphylococcus
TGVF

SEQ ID NO: 1989491 - protein, 8 aa, Staphylococcus
TGVGGGII

SEQ ID NO: 1989492 - protein, 12 aa, Staphylococcus
TGVGKTELAKSL

SEQ ID NO: 1989493 - protein, 10 aa, Staphylococcus
TGVGKTETAK

SEQ ID NO: 1989494 - protein, 18 aa, Staphylococcus
TGVHGSESDQYDGNLGQT

SEQ ID NO: 1989495 - protein, 10 aa, Staphylococcus
TGVKASTVTQ

SEQ ID NO: 1989496 - protein, 14 aa, Staphylococcus
TGVPEEMGGQGIGS

SEQ ID NO: 1989497 - protein, 6 aa, Staphylococcus
TGVQPQ

SEQ ID NO: 1989498 - protein, 14 aa, Staphylococcus
TGVSDELGGQGLGT

SEQ ID NO: 1989499 - protein, 12 aa, Staphylococcus
TGVSKGKGFQGA

SEQ ID NO: 1989500 - protein, 7 aa, Staphylococcus
TGVTEHQ

SEQ ID NO: 1989501 - protein, 19 aa, Staphylococcus
TGVTSKEELAQKETQPTYT

SEQ ID NO: 1989502 - protein, 19 aa, Staphylococcus
TGVTSYEEIQTKQPKPTYS

SEQ ID NO: 1989503 - protein, 18 aa, Staphylococcus
TGVTTKEEIEKKSVPPTY

SEQ ID NO: 1989504 - protein, 4 aa, Staphylococcus
TGVV

SEQ ID NO: 1989505 - protein, 17 aa, Staphylococcus
TGVVKASNRLKQPLKRR

SEQ ID NO: 1989506 - protein, 12 aa, Staphylococcus
TGYIKDQPGRLP

SEQ ID NO: 1989507 - protein, 14 aa, Staphylococcus
TGYPKRWEDQEHYK

SEQ ID NO: 1989508 - protein, 7 aa, Staphylococcus
TGYQKPM

SEQ ID NO: 1989509 - protein, 6 aa, Staphylococcus
TGYSSI

SEQ ID NO: 1989510 - protein, 5 aa, Staphylococcus
TGYTD

SEQ ID NO: 1989511 - protein, 8 aa, Staphylococcus
THAALRNP

SEQ ID NO: 1989512 - protein, 11 aa, Staphylococcus
THAALRNPKMA

SEQ ID NO: 1989513 - protein, 12 aa, Staphylococcus
THAALRNSKMAS

SEQ ID NO: 1989514 - protein, 6 aa, Staphylococcus
THAANT

SEQ ID NO: 1989515 - protein, 4 aa, Staphylococcus
THAP

SEQ ID NO: 1989516 - protein, 6 aa, Staphylococcus
THASGI

SEQ ID NO: 1989517 - protein, 6 aa, Staphylococcus
THASKA

SEQ ID NO: 1989518 - protein, 5 aa, Staphylococcus
THASN

SEQ ID NO: 1989519 - protein, 6 aa, Staphylococcus
THASNA

SEQ ID NO: 1989520 - protein, 13 aa, Staphylococcus
THASQWRSYRIIR

SEQ ID NO: 1989521 - protein, 13 aa, Staphylococcus
THDEEPYNQPGRV

SEQ ID NO: 1989522 - protein, 6 aa, Staphylococcus
THDITE

SEQ ID NO: 1989523 - protein, 5 aa, Staphylococcus
THDKE

SEQ ID NO: 1989524 - protein, 6 aa, Staphylococcus
THDLTE

SEQ ID NO: 1989525 - protein, 7 aa, Staphylococcus
THDLTED

SEQ ID NO: 1989526 - protein, 10 aa, Staphylococcus
THDNNSDGIG

SEQ ID NO: 1989527 - protein, 5 aa, Staphylococcus
THDSN

SEQ ID NO: 1989528 - protein, 10 aa, Staphylococcus
THDTTNKQSL

SEQ ID NO: 1989529 - protein, 21 aa, Staphylococcus
THDVSTQNVKQDFKQQFNEQD

SEQ ID NO: 1989530 - protein, 22 aa, Staphylococcus
THEESIDDEQKAEIAQEIAAQF

SEQ ID NO: 1989531 - protein, 22 aa, Staphylococcus
THEETLNDEVKKEIAAQIQAQF

SEQ ID NO: 1989532 - protein, 4 aa, Staphylococcus
THEN

SEQ ID NO: 1989533 - protein, 5 aa, Staphylococcus
THENE

SEQ ID NO: 1989534 - protein, 24 aa, Staphylococcus
THENKRDKTNQPSIERATVDEPTN

SEQ ID NO: 1989535 - protein, 5 aa, Staphylococcus
THEQS

SEQ ID NO: 1989536 - protein, 4 aa, Staphylococcus
THER

SEQ ID NO: 1989537 - protein, 4 aa, Staphylococcus
THES

SEQ ID NO: 1989538 - protein, 8 aa, Staphylococcus
THETTSTA

SEQ ID NO: 1989539 - protein, 5 aa, Staphylococcus
THFEP

SEQ ID NO: 1989540 - protein, 4 aa, Staphylococcus
THGA

SEQ ID NO: 1989541 - protein, 10 aa, Staphylococcus
THGAKYKELG

SEQ ID NO: 1989542 - protein, 8 aa, Staphylococcus
THGDSFGG

SEQ ID NO: 1989543 - protein, 44 aa, Staphylococcus
THGETNNHIDDKSQNNVTESQSAKNALNSYKSQDTDAKNNNGRF

SEQ ID NO: 1989544 - protein, 8 aa, Staphylococcus
THGHAGQS

SEQ ID NO: 1989545 - protein, 7 aa, Staphylococcus
THGLTED

SEQ ID NO: 1989546 - protein, 11 aa, Staphylococcus
THGTAPKYAGL

SEQ ID NO: 1989547 - protein, 10 aa, Staphylococcus
THGTAPKYAN

SEQ ID NO: 1989548 - protein, 5 aa, Staphylococcus
THGTL

SEQ ID NO: 1989549 - protein, 15 aa, Staphylococcus
THGYGNNDTDRKEGI

SEQ ID NO: 1989550 - protein, 4 aa, Staphylococcus
THHL

SEQ ID NO: 1989551 - protein, 21 aa, Staphylococcus
THIGGGTGASEGTKATTVTPG

SEQ ID NO: 1989552 - protein, 22 aa, Staphylococcus
THIGGGTGASEGTKATTVTPGP

SEQ ID NO: 1989553 - protein, 6 aa, Staphylococcus
THIGGK

SEQ ID NO: 1989554 - protein, 6 aa, Staphylococcus
THKEEK

SEQ ID NO: 1989555 - protein, 5 aa, Staphylococcus
THKEI

SEQ ID NO: 1989556 - protein, 9 aa, Staphylococcus
THKEKYKDK

SEQ ID NO: 1989557 - protein, 6 aa, Staphylococcus
THKETK

SEQ ID NO: 1989558 - protein, 26 aa, Staphylococcus
THKQQAGFSQASQIHKKDKHIKGQKR

SEQ ID NO: 1989559 - protein, 7 aa, Staphylococcus
THKTEDI

SEQ ID NO: 1989560 - protein, 10 aa, Staphylococcus
THKTKDKHLR

SEQ ID NO: 1989561 - protein, 8 aa, Staphylococcus
THKTKDKV

SEQ ID NO: 1989562 - protein, 7 aa, Staphylococcus
THKTNDI

SEQ ID NO: 1989563 - protein, 6 aa, Staphylococcus
THKTNW

SEQ ID NO: 1989564 - protein, 7 aa, Staphylococcus
THKTQDI

SEQ ID NO: 1989565 - protein, 5 aa, Staphylococcus
THLDE

SEQ ID NO: 1989566 - protein, 14 aa, Staphylococcus
THMTAEQSEQCSTV

SEQ ID NO: 1989567 - protein, 15 aa, Staphylococcus
THNAGKGAKYTKTRR

SEQ ID NO: 1989568 - protein, 6 aa, Staphylococcus
THNASL

SEQ ID NO: 1989569 - protein, 10 aa, Staphylococcus
THNDEDTRKL

SEQ ID NO: 1989570 - protein, 5 aa, Staphylococcus
THNKN

SEQ ID NO: 1989571 - protein, 6 aa, Staphylococcus
THNNEA

SEQ ID NO: 1989572 - protein, 6 aa, Staphylococcus
THNNRG

SEQ ID NO: 1989573 - protein, 6 aa, Staphylococcus
THNQDE

SEQ ID NO: 1989574 - protein, 9 aa, Staphylococcus
THNSTELET

SEQ ID NO: 1989575 - protein, 5 aa, Staphylococcus
THNTK

SEQ ID NO: 1989576 - protein, 6 aa, Staphylococcus
THNTND

SEQ ID NO: 1989577 - protein, 6 aa, Staphylococcus
THNTQD

SEQ ID NO: 1989578 - protein, 7 aa, Staphylococcus
THNTQDI

SEQ ID NO: 1989579 - protein, 7 aa, Staphylococcus
THNTSDI

SEQ ID NO: 1989580 - protein, 5 aa, Staphylococcus
THPDK

SEQ ID NO: 1989581 - protein, 7 aa, Staphylococcus
THPDWEK

SEQ ID NO: 1989582 - protein, 5 aa, Staphylococcus
THPEK

SEQ ID NO: 1989583 - protein, 6 aa, Staphylococcus
THPEKV

SEQ ID NO: 1989584 - protein, 9 aa, Staphylococcus
THPGKKTPV

SEQ ID NO: 1989585 - protein, 14 aa, Staphylococcus
THPGSPNGEFTKEE

SEQ ID NO: 1989586 - protein, 14 aa, Staphylococcus
THPGSPNGEFTKEN

SEQ ID NO: 1989587 - protein, 11 aa, Staphylococcus
THPGSPNGTFT

SEQ ID NO: 1989588 - protein, 5 aa, Staphylococcus
THPHR

SEQ ID NO: 1989589 - protein, 19 aa, Staphylococcus
THPHYKPSKYLKAVFINIK

SEQ ID NO: 1989590 - protein, 19 aa, Staphylococcus
THPHYKPSKYLKAVFIQIK

SEQ ID NO: 1989591 - protein, 18 aa, Staphylococcus
THPHYKPSKYLKAVFVKI

SEQ ID NO: 1989592 - protein, 23 aa, Staphylococcus
THPKYGKQLKAETFEKELPQTKE

SEQ ID NO: 1989593 - protein, 5 aa, Staphylococcus
THPNK

SEQ ID NO: 1989594 - protein, 9 aa, Staphylococcus
THPNNPYKG

SEQ ID NO: 1989595 - protein, 6 aa, Staphylococcus
THPRYT

SEQ ID NO: 1989596 - protein, 5 aa, Staphylococcus
THPSD

SEQ ID NO: 1989597 - protein, 6 aa, Staphylococcus
THPTAD

SEQ ID NO: 1989598 - protein, 10 aa, Staphylococcus
THQLHKSDKY

SEQ ID NO: 1989599 - protein, 6 aa, Staphylococcus
THQTKD

SEQ ID NO: 1989600 - protein, 5 aa, Staphylococcus
THRIT

SEQ ID NO: 1989601 - protein, 8 aa, Staphylococcus
THRNPFES

SEQ ID NO: 1989602 - protein, 11 aa, Staphylococcus
THRNQGVATKL

SEQ ID NO: 1989603 - protein, 5 aa, Staphylococcus
THSDK

SEQ ID NO: 1989604 - protein, 13 aa, Staphylococcus
THSGRDSKKKEQI

SEQ ID NO: 1989605 - protein, 8 aa, Staphylococcus
THSKETIR

SEQ ID NO: 1989606 - protein, 8 aa, Staphylococcus
THSLKNAS

SEQ ID NO: 1989607 - protein, 11 aa, Staphylococcus
THSLPDGYSGF

SEQ ID NO: 1989608 - protein, 7 aa, Staphylococcus
THSPETS

SEQ ID NO: 1989609 - protein, 10 aa, Staphylococcus
THSPNSIEGT

SEQ ID NO: 1989610 - protein, 4 aa, Staphylococcus
THSQ

SEQ ID NO: 1989611 - protein, 12 aa, Staphylococcus
THSVGHSERTGA

SEQ ID NO: 1989612 - protein, 20 aa, Staphylococcus
THSYTNHGEDMTLISMVIDY

SEQ ID NO: 1989613 - protein, 14 aa, Staphylococcus
THTGKGAIGLTFLR

SEQ ID NO: 1989614 - protein, 15 aa, Staphylococcus
THTGKGAIGLVVVRE

SEQ ID NO: 1989615 - protein, 16 aa, Staphylococcus
THTGQGAIGLVVVRES

SEQ ID NO: 1989616 - protein, 9 aa, Staphylococcus
THTKEENQF

SEQ ID NO: 1989617 - protein, 6 aa, Staphylococcus
THTQLD

SEQ ID NO: 1989618 - protein, 12 aa, Staphylococcus
THTSSGRTPSEL

SEQ ID NO: 1989619 - protein, 13 aa, Staphylococcus
THTSSNDDGTISD

SEQ ID NO: 1989620 - protein, 8 aa, Staphylococcus
THTSTEEV

SEQ ID NO: 1989621 - protein, 7 aa, Staphylococcus
THTYEDR

SEQ ID NO: 1989622 - protein, 7 aa, Staphylococcus
THTYKDR

SEQ ID NO: 1989623 - protein, 13 aa, Staphylococcus
THVAPEGVCVTFL

SEQ ID NO: 1989624 - protein, 16 aa, Staphylococcus
THVGQYSEINNSRIGN

SEQ ID NO: 1989625 - protein, 12 aa, Staphylococcus
THVTEGEAGGIT

SEQ ID NO: 1989626 - protein, 7 aa, Staphylococcus
THYDDPT

SEQ ID NO: 1989627 - protein, 13 aa, Staphylococcus
THYDQAENADGDA

SEQ ID NO: 1989628 - protein, 13 aa, Staphylococcus
THYEQVENSDSEA

SEQ ID NO: 1989629 - protein, 4 aa, Staphylococcus
THYP

SEQ ID NO: 1989630 - protein, 9 aa, Staphylococcus
THYPTDDEG

SEQ ID NO: 1989631 - protein, 13 aa, Staphylococcus
THYQNNDEFAEAT

SEQ ID NO: 1989632 - protein, 4 aa, Staphylococcus
THYS

SEQ ID NO: 1989633 - protein, 5 aa, Staphylococcus
THYSG

SEQ ID NO: 1989634 - protein, 11 aa, Staphylococcus
TIAEQSQKYGK

SEQ ID NO: 1989635 - protein, 9 aa, Staphylococcus
TIANQSDHA

SEQ ID NO: 1989636 - protein, 10 aa, Staphylococcus
TIAPDTPFTQ

SEQ ID NO: 1989637 - protein, 5 aa, Staphylococcus
TIDDF

SEQ ID NO: 1989638 - protein, 9 aa, Staphylococcus
TIDDPDTFA

SEQ ID NO: 1989639 - protein, 8 aa, Staphylococcus
TIDDPETF

SEQ ID NO: 1989640 - protein, 11 aa, Staphylococcus
TIDEVNTKAFQ

SEQ ID NO: 1989641 - protein, 8 aa, Staphylococcus
TIDGQTSV

SEQ ID NO: 1989642 - protein, 6 aa, Staphylococcus
TIDGQY

SEQ ID NO: 1989643 - protein, 9 aa, Staphylococcus
TIDHDGDEF

SEQ ID NO: 1989644 - protein, 9 aa, Staphylococcus
TIDHDGNEF

SEQ ID NO: 1989645 - protein, 4 aa, Staphylococcus
TIDI

SEQ ID NO: 1989646 - protein, 10 aa, Staphylococcus
TIDNGQRREH

SEQ ID NO: 1989647 - protein, 7 aa, Staphylococcus
TIDNKQN

SEQ ID NO: 1989648 - protein, 8 aa, Staphylococcus
TIDNREQE

SEQ ID NO: 1989649 - protein, 18 aa, Staphylococcus
TIDPRYKGGRTNDKTTEQ

SEQ ID NO: 1989650 - protein, 6 aa, Staphylococcus
TIDPSL

SEQ ID NO: 1989651 - protein, 5 aa, Staphylococcus
TIDPV

SEQ ID NO: 1989652 - protein, 15 aa, Staphylococcus
TIDRTSNGKGKVKAY

SEQ ID NO: 1989653 - protein, 17 aa, Staphylococcus
TIDRTSNGKGKVKDYTL

SEQ ID NO: 1989654 - protein, 12 aa, Staphylococcus
TIDRTSNGRGKV

SEQ ID NO: 1989655 - protein, 22 aa, Staphylococcus
TIDSDPENEVQEFRDKAKILEM

SEQ ID NO: 1989656 - protein, 21 aa, Staphylococcus
TIDSNPEAEVAEFKSKTKILE

SEQ ID NO: 1989657 - protein, 8 aa, Staphylococcus
TIDSPSDH

SEQ ID NO: 1989658 - protein, 6 aa, Staphylococcus
TIDSSY

SEQ ID NO: 1989659 - protein, 8 aa, Staphylococcus
TIDSTSPP

SEQ ID NO: 1989660 - protein, 12 aa, Staphylococcus
TIDTNHTSKQEL

SEQ ID NO: 1989661 - protein, 16 aa, Staphylococcus
TIDYSKTEIQPGDDVG

SEQ ID NO: 1989662 - protein, 17 aa, Staphylococcus
TIDYSKTEIQPGDDVGR

SEQ ID NO: 1989663 - protein, 11 aa, Staphylococcus
TIEDASDVSEV

SEQ ID NO: 1989664 - protein, 8 aa, Staphylococcus
TIEDNENI

SEQ ID NO: 1989665 - protein, 14 aa, Staphylococcus
TIEDSKHPDYQKGD

SEQ ID NO: 1989666 - protein, 5 aa, Staphylococcus
TIEDY

SEQ ID NO: 1989667 - protein, 4 aa, Staphylococcus
TIEE

SEQ ID NO: 1989668 - protein, 10 aa, Staphylococcus
TIEEENQLKT

SEQ ID NO: 1989669 - protein, 11 aa, Staphylococcus
TIEETSQNAVN

SEQ ID NO: 1989670 - protein, 5 aa, Staphylococcus
TIEGT

SEQ ID NO: 1989671 - protein, 14 aa, Staphylococcus
TIEHSDDPRYSKGQ

SEQ ID NO: 1989672 - protein, 7 aa, Staphylococcus
TIEKEQK

SEQ ID NO: 1989673 - protein, 10 aa, Staphylococcus
TIENDPEESV

SEQ ID NO: 1989674 - protein, 9 aa, Staphylococcus
TIENEASDS

SEQ ID NO: 1989675 - protein, 8 aa, Staphylococcus
TIENNESQ

SEQ ID NO: 1989676 - protein, 5 aa, Staphylococcus
TIENS

SEQ ID NO: 1989677 - protein, 4 aa, Staphylococcus
TIEP

SEQ ID NO: 1989678 - protein, 5 aa, Staphylococcus
TIEPS

SEQ ID NO: 1989679 - protein, 10 aa, Staphylococcus
TIEQKPKMEG

SEQ ID NO: 1989680 - protein, 12 aa, Staphylococcus
TIESDKTSKQGL

SEQ ID NO: 1989681 - protein, 11 aa, Staphylococcus
TIESNESFDTM

SEQ ID NO: 1989682 - protein, 10 aa, Staphylococcus
TIESSETFDS

SEQ ID NO: 1989683 - protein, 12 aa, Staphylococcus
TIETARKKYPNK

SEQ ID NO: 1989684 - protein, 12 aa, Staphylococcus
TIETARKKYPQK

SEQ ID NO: 1989685 - protein, 7 aa, Staphylococcus
TIETDPQ

SEQ ID NO: 1989686 - protein, 12 aa, Staphylococcus
TIETGEDGIPNT

SEQ ID NO: 1989687 - protein, 5 aa, Staphylococcus
TIETL

SEQ ID NO: 1989688 - protein, 6 aa, Staphylococcus
TIETNE

SEQ ID NO: 1989689 - protein, 11 aa, Staphylococcus
TIETNESFDSM

SEQ ID NO: 1989690 - protein, 11 aa, Staphylococcus
TIETNESFGNL

SEQ ID NO: 1989691 - protein, 10 aa, Staphylococcus
TIETNGSAIN

SEQ ID NO: 1989692 - protein, 13 aa, Staphylococcus
TIETNGSAINEST

SEQ ID NO: 1989693 - protein, 12 aa, Staphylococcus
TIETNGSAINQD

SEQ ID NO: 1989694 - protein, 12 aa, Staphylococcus
TIETNGSAINRD

SEQ ID NO: 1989695 - protein, 12 aa, Staphylococcus
TIETNGSAINRE

SEQ ID NO: 1989696 - protein, 11 aa, Staphylococcus
TIETNGSAVDD

SEQ ID NO: 1989697 - protein, 9 aa, Staphylococcus
TIGKNPKTM

SEQ ID NO: 1989698 - protein, 12 aa, Staphylococcus
TIGKYKDVTEVS

SEQ ID NO: 1989699 - protein, 4 aa, Staphylococcus
TIGM

SEQ ID NO: 1989700 - protein, 11 aa, Staphylococcus
TIGNDNKETIY

SEQ ID NO: 1989701 - protein, 9 aa, Staphylococcus
TIGNNEGMT

SEQ ID NO: 1989702 - protein, 22 aa, Staphylococcus
TIGTIGDSIAKGSLAKSNFTQQ

SEQ ID NO: 1989703 - protein, 14 aa, Staphylococcus
TIGTLDSEKPIAPG

SEQ ID NO: 1989704 - protein, 4 aa, Staphylococcus
TIHQ

SEQ ID NO: 1989705 - protein, 10 aa, Staphylococcus
TIIGGGDSAA

SEQ ID NO: 1989706 - protein, 5 aa, Staphylococcus
TIINT

SEQ ID NO: 1989707 - protein, 8 aa, Staphylococcus
TIKDNYQS

SEQ ID NO: 1989708 - protein, 7 aa, Staphylococcus
TIKDPDG

SEQ ID NO: 1989709 - protein, 10 aa, Staphylococcus
TIKDPKYAGY

SEQ ID NO: 1989710 - protein, 10 aa, Staphylococcus
TIKDSKTISP

SEQ ID NO: 1989711 - protein, 4 aa, Staphylococcus
TIKG

SEQ ID NO: 1989712 - protein, 5 aa, Staphylococcus
TIKHS

SEQ ID NO: 1989713 - protein, 5 aa, Staphylococcus
TIKIE

SEQ ID NO: 1989714 - protein, 6 aa, Staphylococcus
TIKIGS

SEQ ID NO: 1989715 - protein, 6 aa, Staphylococcus
TIKKSD

SEQ ID NO: 1989716 - protein, 10 aa, Staphylococcus
TIKNNGYESD

SEQ ID NO: 1989717 - protein, 7 aa, Staphylococcus
TIKPSAQ

SEQ ID NO: 1989718 - protein, 8 aa, Staphylococcus
TIKQQTRK

SEQ ID NO: 1989719 - protein, 10 aa, Staphylococcus
TIKQSKLADV

SEQ ID NO: 1989720 - protein, 9 aa, Staphylococcus
TIKRDSPIE

SEQ ID NO: 1989721 - protein, 4 aa, Staphylococcus
TIKS

SEQ ID NO: 1989722 - protein, 9 aa, Staphylococcus
TIKSGQDVN

SEQ ID NO: 1989723 - protein, 5 aa, Staphylococcus
TIKSN

SEQ ID NO: 1989724 - protein, 11 aa, Staphylococcus
TIKSSDNNNDI

SEQ ID NO: 1989725 - protein, 8 aa, Staphylococcus
TIKSYQNQ

SEQ ID NO: 1989726 - protein, 7 aa, Staphylococcus
TIKVGSG

SEQ ID NO: 1989727 - protein, 11 aa, Staphylococcus
TILGADDKAGL

SEQ ID NO: 1989728 - protein, 27 aa, Staphylococcus
TINDKDGKVGSVTLESTKDGSEQTLDA

SEQ ID NO: 1989729 - protein, 26 aa, Staphylococcus
TINDKDGKVGSVTLESTKDGSEVTYD

SEQ ID NO: 1989730 - protein, 24 aa, Staphylococcus
TINEEIEPEMYDSEGNLLNGTKTS

SEQ ID NO: 1989731 - protein, 11 aa, Staphylococcus
TINEKAEDMTY

SEQ ID NO: 1989732 - protein, 27 aa, Staphylococcus
TINEKDGKVGSVTLESTKDGSEETYDA

SEQ ID NO: 1989733 - protein, 6 aa, Staphylococcus
TINEQD

SEQ ID NO: 1989734 - protein, 18 aa, Staphylococcus
TINESPGTLTTKVNTGDN

SEQ ID NO: 1989735 - protein, 8 aa, Staphylococcus
TINGPASK

SEQ ID NO: 1989736 - protein, 24 aa, Staphylococcus
TINKDTQCNQPSKKNTLKSSLVND

SEQ ID NO: 1989737 - protein, 17 aa, Staphylococcus
TINKETSRLSDKVNSGD

SEQ ID NO: 1989738 - protein, 9 aa, Staphylococcus
TINKNSPIE

SEQ ID NO: 1989739 - protein, 6 aa, Staphylococcus
TINLPN

SEQ ID NO: 1989740 - protein, 24 aa, Staphylococcus
TINNAEDNDIKGVEECEPQPPSED

SEQ ID NO: 1989741 - protein, 16 aa, Staphylococcus
TINNGEIEGYGAIVIE

SEQ ID NO: 1989742 - protein, 9 aa, Staphylococcus
TINNQSAKL

SEQ ID NO: 1989743 - protein, 9 aa, Staphylococcus
TINNTQRNV

SEQ ID NO: 1989744 - protein, 5 aa, Staphylococcus
TINNY

SEQ ID NO: 1989745 - protein, 4 aa, Staphylococcus
TINP

SEQ ID NO: 1989746 - protein, 4 aa, Staphylococcus
TINQ

SEQ ID NO: 1989747 - protein, 13 aa, Staphylococcus
TINQQSSKLTDKV

SEQ ID NO: 1989748 - protein, 16 aa, Staphylococcus
TINRTSNGEGKVKDYT

SEQ ID NO: 1989749 - protein, 6 aa, Staphylococcus
TINSDS

SEQ ID NO: 1989750 - protein, 11 aa, Staphylococcus
TINSNPDDEVK

SEQ ID NO: 1989751 - protein, 6 aa, Staphylococcus
TINSPT

SEQ ID NO: 1989752 - protein, 7 aa, Staphylococcus
TINSQQQ

SEQ ID NO: 1989753 - protein, 7 aa, Staphylococcus
TINSRYP

SEQ ID NO: 1989754 - protein, 4 aa, Staphylococcus
TINT

SEQ ID NO: 1989755 - protein, 11 aa, Staphylococcus
TINTDKLTKQG

SEQ ID NO: 1989756 - protein, 8 aa, Staphylococcus
TINTDYGK

SEQ ID NO: 1989757 - protein, 4 aa, Staphylococcus
TIPA

SEQ ID NO: 1989758 - protein, 10 aa, Staphylococcus
TIPANSPSKK

SEQ ID NO: 1989759 - protein, 6 aa, Staphylococcus
TIPEAE

SEQ ID NO: 1989760 - protein, 20 aa, Staphylococcus
TIPEKDQSEQAGMGGGMPGM

SEQ ID NO: 1989761 - protein, 15 aa, Staphylococcus
TIPELPDERKEKYVN

SEQ ID NO: 1989762 - protein, 19 aa, Staphylococcus
TIPEPDNNDNPGMGGMPGM

SEQ ID NO: 1989763 - protein, 7 aa, Staphylococcus
TIPESGV

SEQ ID NO: 1989764 - protein, 14 aa, Staphylococcus
TIPKRARQLTDEQL

SEQ ID NO: 1989765 - protein, 8 aa, Staphylococcus
TIPVRPGR

SEQ ID NO: 1989766 - protein, 4 aa, Staphylococcus
TIPY

SEQ ID NO: 1989767 - protein, 5 aa, Staphylococcus
TIQDL

SEQ ID NO: 1989768 - protein, 11 aa, Staphylococcus
TIQEPSNGDNL

SEQ ID NO: 1989769 - protein, 4 aa, Staphylococcus
TIQG

SEQ ID NO: 1989770 - protein, 16 aa, Staphylococcus
TIQKNDQENADKISNK

SEQ ID NO: 1989771 - protein, 4 aa, Staphylococcus
TIQN

SEQ ID NO: 1989772 - protein, 23 aa, Staphylococcus
TIQPAQPFERGITNDKFKEQGGT

SEQ ID NO: 1989773 - protein, 6 aa, Staphylococcus
TIQQQG

SEQ ID NO: 1989774 - protein, 8 aa, Staphylococcus
TIQSDYQS

SEQ ID NO: 1989775 - protein, 5 aa, Staphylococcus
TIQSG

SEQ ID NO: 1989776 - protein, 11 aa, Staphylococcus
TIQSPSNGDNL

SEQ ID NO: 1989777 - protein, 5 aa, Staphylococcus
TIQTD

SEQ ID NO: 1989778 - protein, 13 aa, Staphylococcus
TIQTEASGNINAS

SEQ ID NO: 1989779 - protein, 7 aa, Staphylococcus
TIQTTGK

SEQ ID NO: 1989780 - protein, 14 aa, Staphylococcus
TIRETTNEAQRAPF

SEQ ID NO: 1989781 - protein, 6 aa, Staphylococcus
TIRNDE

SEQ ID NO: 1989782 - protein, 6 aa, Staphylococcus
TIRNYT

SEQ ID NO: 1989783 - protein, 15 aa, Staphylococcus
TIRPEGVKKDERASF

SEQ ID NO: 1989784 - protein, 6 aa, Staphylococcus
TISAKD

SEQ ID NO: 1989785 - protein, 7 aa, Staphylococcus
TISDLGR

SEQ ID NO: 1989786 - protein, 11 aa, Staphylococcus
TISEDNRSDIG

SEQ ID NO: 1989787 - protein, 5 aa, Staphylococcus
TISGN

SEQ ID NO: 1989788 - protein, 8 aa, Staphylococcus
TISKDSPR

SEQ ID NO: 1989789 - protein, 6 aa, Staphylococcus
TISKEA

SEQ ID NO: 1989790 - protein, 11 aa, Staphylococcus
TISKNIKSIED

SEQ ID NO: 1989791 - protein, 10 aa, Staphylococcus
TISKPRPGHA

SEQ ID NO: 1989792 - protein, 5 aa, Staphylococcus
TISKS

SEQ ID NO: 1989793 - protein, 10 aa, Staphylococcus
TISKSKNEDL

SEQ ID NO: 1989794 - protein, 23 aa, Staphylococcus
TISMSEDETNKVIENEQNPISKH

SEQ ID NO: 1989795 - protein, 23 aa, Staphylococcus
TISMSQDEANKVVTNKDNPISNH

SEQ ID NO: 1989796 - protein, 8 aa, Staphylococcus
TISMSQNQ

SEQ ID NO: 1989797 - protein, 5 aa, Staphylococcus
TISPD

SEQ ID NO: 1989798 - protein, 5 aa, Staphylococcus
TISQE

SEQ ID NO: 1989799 - protein, 7 aa, Staphylococcus
TISQKTY

SEQ ID NO: 1989800 - protein, 7 aa, Staphylococcus
TISQQQG

SEQ ID NO: 1989801 - protein, 4 aa, Staphylococcus
TISS

SEQ ID NO: 1989802 - protein, 13 aa, Staphylococcus
TISSSMAQQAGGY

SEQ ID NO: 1989803 - protein, 12 aa, Staphylococcus
TISTSDLASSHA

SEQ ID NO: 1989804 - protein, 12 aa, Staphylococcus
TISTTGEQTSEI

SEQ ID NO: 1989805 - protein, 10 aa, Staphylococcus
TITDKIPPNF

SEQ ID NO: 1989806 - protein, 6 aa, Staphylococcus
TITDKT

SEQ ID NO: 1989807 - protein, 5 aa, Staphylococcus
TITDV

SEQ ID NO: 1989808 - protein, 10 aa, Staphylococcus
TITEANVQSA

SEQ ID NO: 1989809 - protein, 8 aa, Staphylococcus
TITEEGEN

SEQ ID NO: 1989810 - protein, 7 aa, Staphylococcus
TITESGK

SEQ ID NO: 1989811 - protein, 10 aa, Staphylococcus
TITGKRVSGS

SEQ ID NO: 1989812 - protein, 10 aa, Staphylococcus
TITKPRPGHA

SEQ ID NO: 1989813 - protein, 6 aa, Staphylococcus
TITPEN

SEQ ID NO: 1989814 - protein, 8 aa, Staphylococcus
TITQRKAG

SEQ ID NO: 1989815 - protein, 11 aa, Staphylococcus
TITRDDDGAYV

SEQ ID NO: 1989816 - protein, 11 aa, Staphylococcus
TITRTSEASLS

SEQ ID NO: 1989817 - protein, 4 aa, Staphylococcus
TITT

SEQ ID NO: 1989818 - protein, 11 aa, Staphylococcus
TITTDDGKEIR

SEQ ID NO: 1989819 - protein, 11 aa, Staphylococcus
TITTDDGTEIR

SEQ ID NO: 1989820 - protein, 11 aa, Staphylococcus
TITTDEGKKIR

SEQ ID NO: 1989821 - protein, 11 aa, Staphylococcus
TITTDQGQEIR

SEQ ID NO: 1989822 - protein, 10 aa, Staphylococcus
TITTKQFSKQ

SEQ ID NO: 1989823 - protein, 8 aa, Staphylococcus
TITTNEEN

SEQ ID NO: 1989824 - protein, 10 aa, Staphylococcus
TIVKTSQGDF

SEQ ID NO: 1989825 - protein, 6 aa, Staphylococcus
TIYHTG

SEQ ID NO: 1989826 - protein, 9 aa, Staphylococcus
TIYHTGDTG

SEQ ID NO: 1989827 - protein, 5 aa, Staphylococcus
TIYSQ

SEQ ID NO: 1989828 - protein, 13 aa, Staphylococcus
TKAAEEAPYPSVE

SEQ ID NO: 1989829 - protein, 6 aa, Staphylococcus
TKAAPA

SEQ ID NO: 1989830 - protein, 10 aa, Staphylococcus
TKAASQNGWI

SEQ ID NO: 1989831 - protein, 5 aa, Staphylococcus
TKAAY

SEQ ID NO: 1989832 - protein, 8 aa, Staphylococcus
TKAEHTIQ

SEQ ID NO: 1989833 - protein, 9 aa, Staphylococcus
TKAEPTEEQ

SEQ ID NO: 1989834 - protein, 8 aa, Staphylococcus
TKAESDDE

SEQ ID NO: 1989835 - protein, 7 aa, Staphylococcus
TKAESVE

SEQ ID NO: 1989836 - protein, 6 aa, Staphylococcus
TKAETV

SEQ ID NO: 1989837 - protein, 5 aa, Staphylococcus
TKAGE

SEQ ID NO: 1989838 - protein, 8 aa, Staphylococcus
TKAGITYA

SEQ ID NO: 1989839 - protein, 12 aa, Staphylococcus
TKAGQTDNVKDT

SEQ ID NO: 1989840 - protein, 4 aa, Staphylococcus
TKAK

SEQ ID NO: 1989841 - protein, 10 aa, Staphylococcus
TKAKAQKNVR

SEQ ID NO: 1989842 - protein, 9 aa, Staphylococcus
TKAKDNQTF

SEQ ID NO: 1989843 - protein, 6 aa, Staphylococcus
TKAKEL

SEQ ID NO: 1989844 - protein, 12 aa, Staphylococcus
TKAKPEKPENCK

SEQ ID NO: 1989845 - protein, 18 aa, Staphylococcus
TKAKSKVTDKPVGTGPYQ

SEQ ID NO: 1989846 - protein, 22 aa, Staphylococcus
TKALKNDGDLTTVETSQGNFTG

SEQ ID NO: 1989847 - protein, 8 aa, Staphylococcus
TKANEEDI

SEQ ID NO: 1989848 - protein, 7 aa, Staphylococcus
TKANIDI

SEQ ID NO: 1989849 - protein, 4 aa, Staphylococcus
TKAP

SEQ ID NO: 1989850 - protein, 33 aa, Staphylococcus
TKAQAQRVARTEAGRAMSQAGLDSAKVAKDNGL

SEQ ID NO: 1989851 - protein, 9 aa, Staphylococcus
TKAQLQDNI

SEQ ID NO: 1989852 - protein, 8 aa, Staphylococcus
TKASDIDD

SEQ ID NO: 1989853 - protein, 13 aa, Staphylococcus
TKASLNQEREELV

SEQ ID NO: 1989854 - protein, 10 aa, Staphylococcus
TKASSFAPTT

SEQ ID NO: 1989855 - protein, 8 aa, Staphylococcus
TKASSFKP

SEQ ID NO: 1989856 - protein, 6 aa, Staphylococcus
TKASVN

SEQ ID NO: 1989857 - protein, 5 aa, Staphylococcus
TKAVE

SEQ ID NO: 1989858 - protein, 27 aa, Staphylococcus
TKAYEIQKNKRQLSNNEIRDNLIKLYL

SEQ ID NO: 1989859 - protein, 7 aa, Staphylococcus
TKAYENK

SEQ ID NO: 1989860 - protein, 6 aa, Staphylococcus
TKAYYN

SEQ ID NO: 1989861 - protein, 20 aa, Staphylococcus
TKCADAGGTVALNNAKKGAD

SEQ ID NO: 1989862 - protein, 8 aa, Staphylococcus
TKCGLSGQ

SEQ ID NO: 1989863 - protein, 4 aa, Staphylococcus
TKDA

SEQ ID NO: 1989864 - protein, 4 aa, Staphylococcus
TKDD

SEQ ID NO: 1989865 - protein, 29 aa, Staphylococcus
TKDDKDSDKENKLPKLEQGDKVTATQIEP

SEQ ID NO: 1989866 - protein, 24 aa, Staphylococcus
TKDDKNTADVQSGRVTGPQGGSDL

SEQ ID NO: 1989867 - protein, 7 aa, Staphylococcus
TKDDLNA

SEQ ID NO: 1989868 - protein, 8 aa, Staphylococcus
TKDDQTLI

SEQ ID NO: 1989869 - protein, 9 aa, Staphylococcus
TKDDQTYIN

SEQ ID NO: 1989870 - protein, 20 aa, Staphylococcus
TKDDSEDGKDNKLPNIGEGE

SEQ ID NO: 1989871 - protein, 10 aa, Staphylococcus
TKDEAAQQGA

SEQ ID NO: 1989872 - protein, 11 aa, Staphylococcus
TKDEADFVTSG

SEQ ID NO: 1989873 - protein, 19 aa, Staphylococcus
TKDEALTAKIENCKPYLIE

SEQ ID NO: 1989874 - protein, 7 aa, Staphylococcus
TKDEGDC

SEQ ID NO: 1989875 - protein, 5 aa, Staphylococcus
TKDES

SEQ ID NO: 1989876 - protein, 16 aa, Staphylococcus
TKDETFKGTEVSRKSV

SEQ ID NO: 1989877 - protein, 6 aa, Staphylococcus
TKDETN

SEQ ID NO: 1989878 - protein, 17 aa, Staphylococcus
TKDEVNQAIEKSKQAQL

SEQ ID NO: 1989879 - protein, 8 aa, Staphylococcus
TKDFGKEL

SEQ ID NO: 1989880 - protein, 11 aa, Staphylococcus
TKDGDKDTRLP

SEQ ID NO: 1989881 - protein, 6 aa, Staphylococcus
TKDGDN

SEQ ID NO: 1989882 - protein, 10 aa, Staphylococcus
TKDGFSDQDQ

SEQ ID NO: 1989883 - protein, 12 aa, Staphylococcus
TKDGKKPNNDFV

SEQ ID NO: 1989884 - protein, 31 aa, Staphylococcus
TKDGNKKVYSITEEGQQFVEENKENSDFSER

SEQ ID NO: 1989885 - protein, 7 aa, Staphylococcus
TKDGPKV

SEQ ID NO: 1989886 - protein, 14 aa, Staphylococcus
TKDGYASEEPTYTH

SEQ ID NO: 1989887 - protein, 9 aa, Staphylococcus
TKDIPDNQV

SEQ ID NO: 1989888 - protein, 9 aa, Staphylococcus
TKDIPDNTL

SEQ ID NO: 1989889 - protein, 4 aa, Staphylococcus
TKDK

SEQ ID NO: 1989890 - protein, 10 aa, Staphylococcus
TKDKHPDADK

SEQ ID NO: 1989891 - protein, 9 aa, Staphylococcus
TKDKLSSAR

SEQ ID NO: 1989892 - protein, 9 aa, Staphylococcus
TKDKVTGDL

SEQ ID NO: 1989893 - protein, 4 aa, Staphylococcus
TKDL

SEQ ID NO: 1989894 - protein, 5 aa, Staphylococcus
TKDLA

SEQ ID NO: 1989895 - protein, 18 aa, Staphylococcus
TKDLTRNDEVIEETKQDG

SEQ ID NO: 1989896 - protein, 4 aa, Staphylococcus
TKDM

SEQ ID NO: 1989897 - protein, 5 aa, Staphylococcus
TKDMK

SEQ ID NO: 1989898 - protein, 10 aa, Staphylococcus
TKDNKMSKEG

SEQ ID NO: 1989899 - protein, 23 aa, Staphylococcus
TKDNPQNNTGWNDSSYDTSFNNV

SEQ ID NO: 1989900 - protein, 6 aa, Staphylococcus
TKDNVQ

SEQ ID NO: 1989901 - protein, 14 aa, Staphylococcus
TKDPEYRSTPSGVS

SEQ ID NO: 1989902 - protein, 11 aa, Staphylococcus
TKDQLAKTEPL

SEQ ID NO: 1989903 - protein, 7 aa, Staphylococcus
TKDREQD

SEQ ID NO: 1989904 - protein, 9 aa, Staphylococcus
TKDRGQVSV

SEQ ID NO: 1989905 - protein, 14 aa, Staphylococcus
TKDSEKYITETPNE

SEQ ID NO: 1989906 - protein, 6 aa, Staphylococcus
TKDSLK

SEQ ID NO: 1989907 - protein, 7 aa, Staphylococcus
TKDSMDL

SEQ ID NO: 1989908 - protein, 4 aa, Staphylococcus
TKDT

SEQ ID NO: 1989909 - protein, 8 aa, Staphylococcus
TKDTKEDF

SEQ ID NO: 1989910 - protein, 7 aa, Staphylococcus
TKDTKND

SEQ ID NO: 1989911 - protein, 5 aa, Staphylococcus
TKDTL

SEQ ID NO: 1989912 - protein, 9 aa, Staphylococcus
TKDTRTRHS

SEQ ID NO: 1989913 - protein, 8 aa, Staphylococcus
TKDTSKLK

SEQ ID NO: 1989914 - protein, 14 aa, Staphylococcus
TKDTTSHVEADKAN

SEQ ID NO: 1989915 - protein, 4 aa, Staphylococcus
TKDV

SEQ ID NO: 1989916 - protein, 9 aa, Staphylococcus
TKDVPPNSL

SEQ ID NO: 1989917 - protein, 9 aa, Staphylococcus
TKDVPPTHS

SEQ ID NO: 1989918 - protein, 6 aa, Staphylococcus
TKDWDS

SEQ ID NO: 1989919 - protein, 6 aa, Staphylococcus
TKDYQA

SEQ ID NO: 1989920 - protein, 8 aa, Staphylococcus
TKEADPDL

SEQ ID NO: 1989921 - protein, 16 aa, Staphylococcus
TKEAFSKALGSGLGKT

SEQ ID NO: 1989922 - protein, 7 aa, Staphylococcus
TKEAQNA

SEQ ID NO: 1989923 - protein, 19 aa, Staphylococcus
TKEARYGNETPRVAETDSG

SEQ ID NO: 1989924 - protein, 10 aa, Staphylococcus
TKEATNGDDW

SEQ ID NO: 1989925 - protein, 4 aa, Staphylococcus
TKED

SEQ ID NO: 1989926 - protein, 5 aa, Staphylococcus
TKEDA

SEQ ID NO: 1989927 - protein, 9 aa, Staphylococcus
TKEDAETRL

SEQ ID NO: 1989928 - protein, 10 aa, Staphylococcus
TKEDASTQGA

SEQ ID NO: 1989929 - protein, 8 aa, Staphylococcus
TKEDDNQV

SEQ ID NO: 1989930 - protein, 7 aa, Staphylococcus
TKEDEQE

SEQ ID NO: 1989931 - protein, 8 aa, Staphylococcus
TKEDEQEW

SEQ ID NO: 1989932 - protein, 5 aa, Staphylococcus
TKEDG

SEQ ID NO: 1989933 - protein, 5 aa, Staphylococcus
TKEDH

SEQ ID NO: 1989934 - protein, 6 aa, Staphylococcus
TKEDID

SEQ ID NO: 1989935 - protein, 8 aa, Staphylococcus
TKEDIEKT

SEQ ID NO: 1989936 - protein, 8 aa, Staphylococcus
TKEDKQEW

SEQ ID NO: 1989937 - protein, 13 aa, Staphylococcus
TKEDKSIKNNSPF

SEQ ID NO: 1989938 - protein, 11 aa, Staphylococcus
TKEDREKVKDK

SEQ ID NO: 1989939 - protein, 16 aa, Staphylococcus
TKEEAAQHFRDQDAAT

SEQ ID NO: 1989940 - protein, 16 aa, Staphylococcus
TKEEAAQHFRDQEAAT

SEQ ID NO: 1989941 - protein, 17 aa, Staphylococcus
TKEEAAQHFRDQEAATN

SEQ ID NO: 1989942 - protein, 9 aa, Staphylococcus
TKEEARIQG

SEQ ID NO: 1989943 - protein, 12 aa, Staphylococcus
TKEEIADETNLD

SEQ ID NO: 1989944 - protein, 8 aa, Staphylococcus
TKEEQAAY

SEQ ID NO: 1989945 - protein, 7 aa, Staphylococcus
TKEEQYA

SEQ ID NO: 1989946 - protein, 18 aa, Staphylococcus
TKEEVNNAIEKSKHAQRE

SEQ ID NO: 1989947 - protein, 5 aa, Staphylococcus
TKEFY

SEQ ID NO: 1989948 - protein, 11 aa, Staphylococcus
TKEGGKPLKEA

SEQ ID NO: 1989949 - protein, 18 aa, Staphylococcus
TKEGGKPLKEAQGEVDYA

SEQ ID NO: 1989950 - protein, 18 aa, Staphylococcus
TKEGGKPWKEADADTAEA

SEQ ID NO: 1989951 - protein, 11 aa, Staphylococcus
TKEGKEGSVDI

SEQ ID NO: 1989952 - protein, 6 aa, Staphylococcus
TKEGKI

SEQ ID NO: 1989953 - protein, 7 aa, Staphylococcus
TKEGKID

SEQ ID NO: 1989954 - protein, 7 aa, Staphylococcus
TKEGNKK

SEQ ID NO: 1989955 - protein, 10 aa, Staphylococcus
TKEGQNGDID

SEQ ID NO: 1989956 - protein, 9 aa, Staphylococcus
TKEGQQTGL

SEQ ID NO: 1989957 - protein, 8 aa, Staphylococcus
TKEITQNK

SEQ ID NO: 1989958 - protein, 9 aa, Staphylococcus
TKEKETADS

SEQ ID NO: 1989959 - protein, 5 aa, Staphylococcus
TKELE

SEQ ID NO: 1989960 - protein, 5 aa, Staphylococcus
TKELN

SEQ ID NO: 1989961 - protein, 4 aa, Staphylococcus
TKEN

SEQ ID NO: 1989962 - protein, 7 aa, Staphylococcus
TKENADF

SEQ ID NO: 1989963 - protein, 10 aa, Staphylococcus
TKENETADSY

SEQ ID NO: 1989964 - protein, 5 aa, Staphylococcus
TKENI

SEQ ID NO: 1989965 - protein, 11 aa, Staphylococcus
TKENKDGSIDV

SEQ ID NO: 1989966 - protein, 12 aa, Staphylococcus
TKENKSDKQLNK

SEQ ID NO: 1989967 - protein, 10 aa, Staphylococcus
TKENPPIAGH

SEQ ID NO: 1989968 - protein, 11 aa, Staphylococcus
TKEPGGGTTDY

SEQ ID NO: 1989969 - protein, 9 aa, Staphylococcus
TKEQAAEAT

SEQ ID NO: 1989970 - protein, 10 aa, Staphylococcus
TKEQAKEATM

SEQ ID NO: 1989971 - protein, 7 aa, Staphylococcus
TKEQAQK

SEQ ID NO: 1989972 - protein, 6 aa, Staphylococcus
TKEQGQ

SEQ ID NO: 1989973 - protein, 7 aa, Staphylococcus
TKEQPAY

SEQ ID NO: 1989974 - protein, 7 aa, Staphylococcus
TKEQTTT

SEQ ID NO: 1989975 - protein, 7 aa, Staphylococcus
TKEQYGD

SEQ ID NO: 1989976 - protein, 7 aa, Staphylococcus
TKEQYGN

SEQ ID NO: 1989977 - protein, 8 aa, Staphylococcus
TKERYDKL

SEQ ID NO: 1989978 - protein, 8 aa, Staphylococcus
TKERYRRL

SEQ ID NO: 1989979 - protein, 8 aa, Staphylococcus
TKESHQVV

SEQ ID NO: 1989980 - protein, 13 aa, Staphylococcus
TKESMEPTLKPPG

SEQ ID NO: 1989981 - protein, 16 aa, Staphylococcus
TKESVRAIRDAKRAGI

SEQ ID NO: 1989982 - protein, 16 aa, Staphylococcus
TKESVRTIRDAKKAGI

SEQ ID NO: 1989983 - protein, 7 aa, Staphylococcus
TKETADI

SEQ ID NO: 1989984 - protein, 6 aa, Staphylococcus
TKETGA

SEQ ID NO: 1989985 - protein, 15 aa, Staphylococcus
TKETLKKNNLNTPNP

SEQ ID NO: 1989986 - protein, 10 aa, Staphylococcus
TKETPPIPGH

SEQ ID NO: 1989987 - protein, 11 aa, Staphylococcus
TKETVDKEKGI

SEQ ID NO: 1989988 - protein, 5 aa, Staphylococcus
TKETY

SEQ ID NO: 1989989 - protein, 4 aa, Staphylococcus
TKEY

SEQ ID NO: 1989990 - protein, 7 aa, Staphylococcus
TKFDEAQ

SEQ ID NO: 1989991 - protein, 7 aa, Staphylococcus
TKFDSDQ

SEQ ID NO: 1989992 - protein, 4 aa, Staphylococcus
TKFG

SEQ ID NO: 1989993 - protein, 6 aa, Staphylococcus
TKFGDM

SEQ ID NO: 1989994 - protein, 6 aa, Staphylococcus
TKFGSM

SEQ ID NO: 1989995 - protein, 10 aa, Staphylococcus
TKFKKGDRVT

SEQ ID NO: 1989996 - protein, 7 aa, Staphylococcus
TKFKPGF

SEQ ID NO: 1989997 - protein, 4 aa, Staphylococcus
TKFP

SEQ ID NO: 1989998 - protein, 5 aa, Staphylococcus
TKFPE

SEQ ID NO: 1989999 - protein, 13 aa, Staphylococcus
TKFPKKSKDGKTL

SEQ ID NO: 1990000 - protein, 7 aa, Staphylococcus
TKFPRGN

SEQ ID NO: 1990001 - protein, 7 aa, Staphylococcus
TKFTGYT

SEQ ID NO: 1990002 - protein, 15 aa, Staphylococcus
TKGAISKNTSRVANE

SEQ ID NO: 1990003 - protein, 10 aa, Staphylococcus
TKGDIPDYQA

SEQ ID NO: 1990004 - protein, 11 aa, Staphylococcus
TKGDIPDYQAS

SEQ ID NO: 1990005 - protein, 8 aa, Staphylococcus
TKGDNDSF

SEQ ID NO: 1990006 - protein, 6 aa, Staphylococcus
TKGDQI

SEQ ID NO: 1990007 - protein, 7 aa, Staphylococcus
TKGDQIV

SEQ ID NO: 1990008 - protein, 9 aa, Staphylococcus
TKGEAKIEK

SEQ ID NO: 1990009 - protein, 7 aa, Staphylococcus
TKGEALK

SEQ ID NO: 1990010 - protein, 7 aa, Staphylococcus
TKGFTHT

SEQ ID NO: 1990011 - protein, 10 aa, Staphylococcus
TKGGEDANVS

SEQ ID NO: 1990012 - protein, 12 aa, Staphylococcus
TKGGLTPIDPVS

SEQ ID NO: 1990013 - protein, 7 aa, Staphylococcus
TKGIGAS

SEQ ID NO: 1990014 - protein, 9 aa, Staphylococcus
TKGKEFERD

SEQ ID NO: 1990015 - protein, 19 aa, Staphylococcus
TKGKQSLGDFETYPSKPFS

SEQ ID NO: 1990016 - protein, 6 aa, Staphylococcus
TKGKYK

SEQ ID NO: 1990017 - protein, 4 aa, Staphylococcus
TKGL

SEQ ID NO: 1990018 - protein, 5 aa, Staphylococcus
TKGLE

SEQ ID NO: 1990019 - protein, 27 aa, Staphylococcus
TKGLTSVEEVTKATKAGNSCGKCKGQI

SEQ ID NO: 1990020 - protein, 27 aa, Staphylococcus
TKGLTTVDEVTKTTKAGNSCGKCKGQI

SEQ ID NO: 1990021 - protein, 4 aa, Staphylococcus
TKGN

SEQ ID NO: 1990022 - protein, 6 aa, Staphylococcus
TKGNAL

SEQ ID NO: 1990023 - protein, 11 aa, Staphylococcus
TKGNLKRAQEG

SEQ ID NO: 1990024 - protein, 16 aa, Staphylococcus
TKGPSQGRTYESDDGR

SEQ ID NO: 1990025 - protein, 6 aa, Staphylococcus
TKGQAL

SEQ ID NO: 1990026 - protein, 8 aa, Staphylococcus
TKGQSGRK

SEQ ID NO: 1990027 - protein, 14 aa, Staphylococcus
TKGQTSPSSAPGFV

SEQ ID NO: 1990028 - protein, 13 aa, Staphylococcus
TKGQTSPSSAQGF

SEQ ID NO: 1990029 - protein, 21 aa, Staphylococcus
TKGRASYFKEASKGYMDPGAQ

SEQ ID NO: 1990030 - protein, 8 aa, Staphylococcus
TKGSIDDA

SEQ ID NO: 1990031 - protein, 8 aa, Staphylococcus
TKGSQVRK

SEQ ID NO: 1990032 - protein, 8 aa, Staphylococcus
TKGTADKL

SEQ ID NO: 1990033 - protein, 13 aa, Staphylococcus
TKGTAEKLEDNQI

SEQ ID NO: 1990034 - protein, 13 aa, Staphylococcus
TKGTAEKLNQNDI

SEQ ID NO: 1990035 - protein, 9 aa, Staphylococcus
TKGTAKVDK

SEQ ID NO: 1990036 - protein, 10 aa, Staphylococcus
TKGTEQINGE

SEQ ID NO: 1990037 - protein, 5 aa, Staphylococcus
TKGTF

SEQ ID NO: 1990038 - protein, 5 aa, Staphylococcus
TKGTI

SEQ ID NO: 1990039 - protein, 6 aa, Staphylococcus
TKGVDP

SEQ ID NO: 1990040 - protein, 10 aa, Staphylococcus
TKGYPPSVRE

SEQ ID NO: 1990041 - protein, 7 aa, Staphylococcus
TKGYYRA

SEQ ID NO: 1990042 - protein, 4 aa, Staphylococcus
TKHG

SEQ ID NO: 1990043 - protein, 9 aa, Staphylococcus
TKHKPQPNG

SEQ ID NO: 1990044 - protein, 26 aa, Staphylococcus
TKHNDNSETIHEQSQQKEKTFSQEEV

SEQ ID NO: 1990045 - protein, 5 aa, Staphylococcus
TKHPG

SEQ ID NO: 1990046 - protein, 7 aa, Staphylococcus
TKHPTDL

SEQ ID NO: 1990047 - protein, 16 aa, Staphylococcus
TKHTPISGGDVGGSAN

SEQ ID NO: 1990048 - protein, 21 aa, Staphylococcus
TKIDDESATELAKRSRGTPRV

SEQ ID NO: 1990049 - protein, 10 aa, Staphylococcus
TKIDDESAVE

SEQ ID NO: 1990050 - protein, 6 aa, Staphylococcus
TKIDGI

SEQ ID NO: 1990051 - protein, 7 aa, Staphylococcus
TKIDGVD

SEQ ID NO: 1990052 - protein, 14 aa, Staphylococcus
TKIDRNAKKVETDA

SEQ ID NO: 1990053 - protein, 15 aa, Staphylococcus
TKIDRNAKKVETDSG

SEQ ID NO: 1990054 - protein, 9 aa, Staphylococcus
TKIEKTDKA

SEQ ID NO: 1990055 - protein, 9 aa, Staphylococcus
TKIERDKPK

SEQ ID NO: 1990056 - protein, 6 aa, Staphylococcus
TKIGKA

SEQ ID NO: 1990057 - protein, 5 aa, Staphylococcus
TKIHH

SEQ ID NO: 1990058 - protein, 5 aa, Staphylococcus
TKIPH

SEQ ID NO: 1990059 - protein, 4 aa, Staphylococcus
TKIS

SEQ ID NO: 1990060 - protein, 13 aa, Staphylococcus
TKISEQAKEKMTI

SEQ ID NO: 1990061 - protein, 5 aa, Staphylococcus
TKITE

SEQ ID NO: 1990062 - protein, 9 aa, Staphylococcus
TKITQPSTW

SEQ ID NO: 1990063 - protein, 18 aa, Staphylococcus
TKITRENAKEMIEQNHSA

SEQ ID NO: 1990064 - protein, 16 aa, Staphylococcus
TKIYAGENVGRGGDDT

SEQ ID NO: 1990065 - protein, 9 aa, Staphylococcus
TKKADVGSE

SEQ ID NO: 1990066 - protein, 8 aa, Staphylococcus
TKKAEDSK

SEQ ID NO: 1990067 - protein, 8 aa, Staphylococcus
TKKDAANY

SEQ ID NO: 1990068 - protein, 8 aa, Staphylococcus
TKKDASQY

SEQ ID NO: 1990069 - protein, 8 aa, Staphylococcus
TKKDASSY

SEQ ID NO: 1990070 - protein, 8 aa, Staphylococcus
TKKDIKDT

SEQ ID NO: 1990071 - protein, 8 aa, Staphylococcus
TKKEASDY

SEQ ID NO: 1990072 - protein, 7 aa, Staphylococcus
TKKEDED

SEQ ID NO: 1990073 - protein, 15 aa, Staphylococcus
TKKESTIQNKESVKK

SEQ ID NO: 1990074 - protein, 16 aa, Staphylococcus
TKKESTIQNKESVKKE

SEQ ID NO: 1990075 - protein, 13 aa, Staphylococcus
TKKETQASAPKSL

SEQ ID NO: 1990076 - protein, 14 aa, Staphylococcus
TKKGIEGAKNLESY

SEQ ID NO: 1990077 - protein, 16 aa, Staphylococcus
TKKGKSAFKTYLNMNI

SEQ ID NO: 1990078 - protein, 14 aa, Staphylococcus
TKKGNDKQLPDELK

SEQ ID NO: 1990079 - protein, 16 aa, Staphylococcus
TKKGVDRKKMSTAEFR

SEQ ID NO: 1990080 - protein, 9 aa, Staphylococcus
TKKGVKRKE

SEQ ID NO: 1990081 - protein, 11 aa, Staphylococcus
TKKGVKRKEMP

SEQ ID NO: 1990082 - protein, 4 aa, Staphylococcus
TKKH

SEQ ID NO: 1990083 - protein, 9 aa, Staphylococcus
TKKHTDDKW

SEQ ID NO: 1990084 - protein, 11 aa, Staphylococcus
TKKIAKEEKAY

SEQ ID NO: 1990085 - protein, 13 aa, Staphylococcus
TKKIDQPQTESDW

SEQ ID NO: 1990086 - protein, 21 aa, Staphylococcus
TKKIKQAYKEDIKKSKELTIE

SEQ ID NO: 1990087 - protein, 8 aa, Staphylococcus
TKKKAQTI

SEQ ID NO: 1990088 - protein, 8 aa, Staphylococcus
TKKKHAQA

SEQ ID NO: 1990089 - protein, 9 aa, Staphylococcus
TKKKKEEFE

SEQ ID NO: 1990090 - protein, 5 aa, Staphylococcus
TKKKP

SEQ ID NO: 1990091 - protein, 8 aa, Staphylococcus
TKKKYNLS

SEQ ID NO: 1990092 - protein, 7 aa, Staphylococcus
TKKNDFV

SEQ ID NO: 1990093 - protein, 5 aa, Staphylococcus
TKKNK

SEQ ID NO: 1990094 - protein, 9 aa, Staphylococcus
TKKPRPLEN

SEQ ID NO: 1990095 - protein, 7 aa, Staphylococcus
TKKQFNT

SEQ ID NO: 1990096 - protein, 9 aa, Staphylococcus
TKKQNIEIT

SEQ ID NO: 1990097 - protein, 4 aa, Staphylococcus
TKKR

SEQ ID NO: 1990098 - protein, 9 aa, Staphylococcus
TKKRRPIEN

SEQ ID NO: 1990099 - protein, 7 aa, Staphylococcus
TKKSMSH

SEQ ID NO: 1990100 - protein, 7 aa, Staphylococcus
TKKSMTH

SEQ ID NO: 1990101 - protein, 8 aa, Staphylococcus
TKKTTIGS

SEQ ID NO: 1990102 - protein, 11 aa, Staphylococcus
TKKVAKAEKAY

SEQ ID NO: 1990103 - protein, 13 aa, Staphylococcus
TKKVRADLERLIN

SEQ ID NO: 1990104 - protein, 18 aa, Staphylococcus
TKKVSTAFQSTKQNPAAV

SEQ ID NO: 1990105 - protein, 7 aa, Staphylococcus
TKLAAKP

SEQ ID NO: 1990106 - protein, 8 aa, Staphylococcus
TKLATTGG

SEQ ID NO: 1990107 - protein, 7 aa, Staphylococcus
TKLDGTK

SEQ ID NO: 1990108 - protein, 13 aa, Staphylococcus
TKLENQDDNTNKI

SEQ ID NO: 1990109 - protein, 6 aa, Staphylococcus
TKLEPA

SEQ ID NO: 1990110 - protein, 11 aa, Staphylococcus
TKLEPPLDQQI

SEQ ID NO: 1990111 - protein, 4 aa, Staphylococcus
TKLK

SEQ ID NO: 1990112 - protein, 6 aa, Staphylococcus
TKLLPG

SEQ ID NO: 1990113 - protein, 8 aa, Staphylococcus
TKLNHNNK

SEQ ID NO: 1990114 - protein, 13 aa, Staphylococcus
TKLPESPDSTAKI

SEQ ID NO: 1990115 - protein, 8 aa, Staphylococcus
TKLPLSEA

SEQ ID NO: 1990116 - protein, 7 aa, Staphylococcus
TKLQATN

SEQ ID NO: 1990117 - protein, 7 aa, Staphylococcus
TKLQSGL

SEQ ID NO: 1990118 - protein, 11 aa, Staphylococcus
TKLSDINDNHE

SEQ ID NO: 1990119 - protein, 9 aa, Staphylococcus
TKLSDTDST

SEQ ID NO: 1990120 - protein, 13 aa, Staphylococcus
TKLSGTAEKPRLN

SEQ ID NO: 1990121 - protein, 17 aa, Staphylococcus
TKLSKEGKETTTQTQQH

SEQ ID NO: 1990122 - protein, 12 aa, Staphylococcus
TKLSPKVKGQLK

SEQ ID NO: 1990123 - protein, 8 aa, Staphylococcus
TKLTPENL

SEQ ID NO: 1990124 - protein, 14 aa, Staphylococcus
TKMKRPNNGREKQL

SEQ ID NO: 1990125 - protein, 13 aa, Staphylococcus
TKMPDLNAADEEA

SEQ ID NO: 1990126 - protein, 4 aa, Staphylococcus
TKNA

SEQ ID NO: 1990127 - protein, 11 aa, Staphylococcus
TKNDIKDTLER

SEQ ID NO: 1990128 - protein, 5 aa, Staphylococcus
TKNEQ

SEQ ID NO: 1990129 - protein, 9 aa, Staphylococcus
TKNEVAPYK

SEQ ID NO: 1990130 - protein, 11 aa, Staphylococcus
TKNKDFEDEKR

SEQ ID NO: 1990131 - protein, 6 aa, Staphylococcus
TKNKEQ

SEQ ID NO: 1990132 - protein, 13 aa, Staphylococcus
TKNKGYYILRSSK

SEQ ID NO: 1990133 - protein, 6 aa, Staphylococcus
TKNNGF

SEQ ID NO: 1990134 - protein, 9 aa, Staphylococcus
TKNNNTIDI

SEQ ID NO: 1990135 - protein, 6 aa, Staphylococcus
TKNNPI

SEQ ID NO: 1990136 - protein, 5 aa, Staphylococcus
TKNPD

SEQ ID NO: 1990137 - protein, 6 aa, Staphylococcus
TKNPNI

SEQ ID NO: 1990138 - protein, 5 aa, Staphylococcus
TKNQI

SEQ ID NO: 1990139 - protein, 8 aa, Staphylococcus
TKNQPISE

SEQ ID NO: 1990140 - protein, 7 aa, Staphylococcus
TKNRKFP

SEQ ID NO: 1990141 - protein, 4 aa, Staphylococcus
TKNT

SEQ ID NO: 1990142 - protein, 6 aa, Staphylococcus
TKNTEF

SEQ ID NO: 1990143 - protein, 8 aa, Staphylococcus
TKNTTSTV

SEQ ID NO: 1990144 - protein, 6 aa, Staphylococcus
TKNVNE

SEQ ID NO: 1990145 - protein, 7 aa, Staphylococcus
TKPCANE

SEQ ID NO: 1990146 - protein, 6 aa, Staphylococcus
TKPCPN

SEQ ID NO: 1990147 - protein, 7 aa, Staphylococcus
TKPCQSE

SEQ ID NO: 1990148 - protein, 6 aa, Staphylococcus
TKPEAS

SEQ ID NO: 1990149 - protein, 9 aa, Staphylococcus
TKPENLDEA

SEQ ID NO: 1990150 - protein, 18 aa, Staphylococcus
TKPETQSTETSDQTNDEI

SEQ ID NO: 1990151 - protein, 8 aa, Staphylococcus
TKPEYDHT

SEQ ID NO: 1990152 - protein, 9 aa, Staphylococcus
TKPFDTKEL

SEQ ID NO: 1990153 - protein, 10 aa, Staphylococcus
TKPFTAASDK

SEQ ID NO: 1990154 - protein, 9 aa, Staphylococcus
TKPIHDDKL

SEQ ID NO: 1990155 - protein, 9 aa, Staphylococcus
TKPIPNDKL

SEQ ID NO: 1990156 - protein, 6 aa, Staphylococcus
TKPIQT

SEQ ID NO: 1990157 - protein, 7 aa, Staphylococcus
TKPKNLK

SEQ ID NO: 1990158 - protein, 9 aa, Staphylococcus
TKPNHEGHG

SEQ ID NO: 1990159 - protein, 6 aa, Staphylococcus
TKPNPF

SEQ ID NO: 1990160 - protein, 6 aa, Staphylococcus
TKPQEF

SEQ ID NO: 1990161 - protein, 9 aa, Staphylococcus
TKPRPGHAD

SEQ ID NO: 1990162 - protein, 11 aa, Staphylococcus
TKPSHEDKRNE

SEQ ID NO: 1990163 - protein, 6 aa, Staphylococcus
TKQAGL

SEQ ID NO: 1990164 - protein, 8 aa, Staphylococcus
TKQASAYR

SEQ ID NO: 1990165 - protein, 8 aa, Staphylococcus
TKQDEIQH

SEQ ID NO: 1990166 - protein, 12 aa, Staphylococcus
TKQDEKKYKKDK

SEQ ID NO: 1990167 - protein, 9 aa, Staphylococcus
TKQDIKETL

SEQ ID NO: 1990168 - protein, 5 aa, Staphylococcus
TKQEA

SEQ ID NO: 1990169 - protein, 14 aa, Staphylococcus
TKQEGVKITTTPEQ

SEQ ID NO: 1990170 - protein, 8 aa, Staphylococcus
TKQENTIE

SEQ ID NO: 1990171 - protein, 4 aa, Staphylococcus
TKQG

SEQ ID NO: 1990172 - protein, 13 aa, Staphylococcus
TKQHGSKGLPEET

SEQ ID NO: 1990173 - protein, 6 aa, Staphylococcus
TKQIAE

SEQ ID NO: 1990174 - protein, 7 aa, Staphylococcus
TKQIEGS

SEQ ID NO: 1990175 - protein, 24 aa, Staphylococcus
TKQKKQRKRTKTISNAEKIKSYQD

SEQ ID NO: 1990176 - protein, 24 aa, Staphylococcus
TKQKKQRKRTKTLSNAEKIKSYQD

SEQ ID NO: 1990177 - protein, 24 aa, Staphylococcus
TKQKKQRKRTKTMSNAEKIKSYQD

SEQ ID NO: 1990178 - protein, 7 aa, Staphylococcus
TKQNFST

SEQ ID NO: 1990179 - protein, 7 aa, Staphylococcus
TKQNVGN

SEQ ID NO: 1990180 - protein, 9 aa, Staphylococcus
TKQQGTSDC

SEQ ID NO: 1990181 - protein, 5 aa, Staphylococcus
TKQQN

SEQ ID NO: 1990182 - protein, 8 aa, Staphylococcus
TKQQQNIE

SEQ ID NO: 1990183 - protein, 9 aa, Staphylococcus
TKQRENLPY

SEQ ID NO: 1990184 - protein, 8 aa, Staphylococcus
TKQREQLS

SEQ ID NO: 1990185 - protein, 8 aa, Staphylococcus
TKQRESES

SEQ ID NO: 1990186 - protein, 4 aa, Staphylococcus
TKQT

SEQ ID NO: 1990187 - protein, 8 aa, Staphylococcus
TKQTVGIG

SEQ ID NO: 1990188 - protein, 6 aa, Staphylococcus
TKQTYD

SEQ ID NO: 1990189 - protein, 16 aa, Staphylococcus
TKQYAAPSKSLAKSYE

SEQ ID NO: 1990190 - protein, 18 aa, Staphylococcus
TKRDAETVNPKIKTGQVE

SEQ ID NO: 1990191 - protein, 10 aa, Staphylococcus
TKRDEAKEAV

SEQ ID NO: 1990192 - protein, 6 aa, Staphylococcus
TKRDEI

SEQ ID NO: 1990193 - protein, 18 aa, Staphylococcus
TKRDPETINPKIKTGQVE

SEQ ID NO: 1990194 - protein, 9 aa, Staphylococcus
TKREGEHMS

SEQ ID NO: 1990195 - protein, 14 aa, Staphylococcus
TKRESLQNEREVLA

SEQ ID NO: 1990196 - protein, 11 aa, Staphylococcus
TKRGETRTFNN

SEQ ID NO: 1990197 - protein, 19 aa, Staphylococcus
TKRGGTTVTTGLPDPKAQF

SEQ ID NO: 1990198 - protein, 7 aa, Staphylococcus
TKRGPLY

SEQ ID NO: 1990199 - protein, 9 aa, Staphylococcus
TKRGRKPKG

SEQ ID NO: 1990200 - protein, 13 aa, Staphylococcus
TKRIPDDKLKKEI

SEQ ID NO: 1990201 - protein, 10 aa, Staphylococcus
TKRKQGRSYY

SEQ ID NO: 1990202 - protein, 5 aa, Staphylococcus
TKRKY

SEQ ID NO: 1990203 - protein, 5 aa, Staphylococcus
TKRLQ

SEQ ID NO: 1990204 - protein, 7 aa, Staphylococcus
TKRMNNS

SEQ ID NO: 1990205 - protein, 7 aa, Staphylococcus
TKRNTLN

SEQ ID NO: 1990206 - protein, 7 aa, Staphylococcus
TKRPTSG

SEQ ID NO: 1990207 - protein, 4 aa, Staphylococcus
TKRQ

SEQ ID NO: 1990208 - protein, 5 aa, Staphylococcus
TKRQA

SEQ ID NO: 1990209 - protein, 8 aa, Staphylococcus
TKRQAGKE

SEQ ID NO: 1990210 - protein, 4 aa, Staphylococcus
TKRR

SEQ ID NO: 1990211 - protein, 12 aa, Staphylococcus
TKRTGKAFSSDT

SEQ ID NO: 1990212 - protein, 9 aa, Staphylococcus
TKSDIEETL

SEQ ID NO: 1990213 - protein, 8 aa, Staphylococcus
TKSDNDAF

SEQ ID NO: 1990214 - protein, 6 aa, Staphylococcus
TKSDRD

SEQ ID NO: 1990215 - protein, 9 aa, Staphylococcus
TKSEALKRE

SEQ ID NO: 1990216 - protein, 17 aa, Staphylococcus
TKSENISNTISQFLQNV

SEQ ID NO: 1990217 - protein, 14 aa, Staphylococcus
TKSFPTNVYSQKNQ

SEQ ID NO: 1990218 - protein, 6 aa, Staphylococcus
TKSGFG

SEQ ID NO: 1990219 - protein, 14 aa, Staphylococcus
TKSGGKSGDYRRES

SEQ ID NO: 1990220 - protein, 12 aa, Staphylococcus
TKSGKSASGVSI

SEQ ID NO: 1990221 - protein, 6 aa, Staphylococcus
TKSGPW

SEQ ID NO: 1990222 - protein, 8 aa, Staphylococcus
TKSGSVEL

SEQ ID NO: 1990223 - protein, 12 aa, Staphylococcus
TKSGVRRKDGSY

SEQ ID NO: 1990224 - protein, 6 aa, Staphylococcus
TKSIKS

SEQ ID NO: 1990225 - protein, 13 aa, Staphylococcus
TKSIQPKQGESVG

SEQ ID NO: 1990226 - protein, 12 aa, Staphylococcus
TKSITEEVEAGD

SEQ ID NO: 1990227 - protein, 11 aa, Staphylococcus
TKSITKEVKQG

SEQ ID NO: 1990228 - protein, 10 aa, Staphylococcus
TKSITQEVKQ

SEQ ID NO: 1990229 - protein, 15 aa, Staphylococcus
TKSKPGKAPRTNSEI

SEQ ID NO: 1990230 - protein, 4 aa, Staphylococcus
TKSL

SEQ ID NO: 1990231 - protein, 8 aa, Staphylococcus
TKSNRNMQ

SEQ ID NO: 1990232 - protein, 9 aa, Staphylococcus
TKSPADLSH

SEQ ID NO: 1990233 - protein, 8 aa, Staphylococcus
TKSPETYD

SEQ ID NO: 1990234 - protein, 6 aa, Staphylococcus
TKSPLN

SEQ ID NO: 1990235 - protein, 12 aa, Staphylococcus
TKSRKYPQFNDE

SEQ ID NO: 1990236 - protein, 16 aa, Staphylococcus
TKSRPGSMGKEIPGSR

SEQ ID NO: 1990237 - protein, 12 aa, Staphylococcus
TKSSARELASRG

SEQ ID NO: 1990238 - protein, 8 aa, Staphylococcus
TKSSQQRQ

SEQ ID NO: 1990239 - protein, 9 aa, Staphylococcus
TKSSTPRLV

SEQ ID NO: 1990240 - protein, 9 aa, Staphylococcus
TKSTPEKSL

SEQ ID NO: 1990241 - protein, 12 aa, Staphylococcus
TKSTPKGNIEQN

SEQ ID NO: 1990242 - protein, 11 aa, Staphylococcus
TKSVTKEVKQG

SEQ ID NO: 1990243 - protein, 9 aa, Staphylococcus
TKTATINNE

SEQ ID NO: 1990244 - protein, 8 aa, Staphylococcus
TKTDNDAF

SEQ ID NO: 1990245 - protein, 7 aa, Staphylococcus
TKTEISN

SEQ ID NO: 1990246 - protein, 6 aa, Staphylococcus
TKTEKP

SEQ ID NO: 1990247 - protein, 12 aa, Staphylococcus
TKTEKSNEKVDW

SEQ ID NO: 1990248 - protein, 8 aa, Staphylococcus
TKTEQSQY

SEQ ID NO: 1990249 - protein, 10 aa, Staphylococcus
TKTESKIGDV

SEQ ID NO: 1990250 - protein, 6 aa, Staphylococcus
TKTESY

SEQ ID NO: 1990251 - protein, 5 aa, Staphylococcus
TKTGA

SEQ ID NO: 1990252 - protein, 5 aa, Staphylococcus
TKTGF

SEQ ID NO: 1990253 - protein, 6 aa, Staphylococcus
TKTGFG

SEQ ID NO: 1990254 - protein, 20 aa, Staphylococcus
TKTGKNAFYAGDDASNPMSE

SEQ ID NO: 1990255 - protein, 9 aa, Staphylococcus
TKTIEPFRD

SEQ ID NO: 1990256 - protein, 21 aa, Staphylococcus
TKTKNQTNVRSATKDQTETMK

SEQ ID NO: 1990257 - protein, 10 aa, Staphylococcus
TKTLNEEAPY

SEQ ID NO: 1990258 - protein, 9 aa, Staphylococcus
TKTNEEKQF

SEQ ID NO: 1990259 - protein, 7 aa, Staphylococcus
TKTPDVE

SEQ ID NO: 1990260 - protein, 8 aa, Staphylococcus
TKTPMGAR

SEQ ID NO: 1990261 - protein, 4 aa, Staphylococcus
TKTQ

SEQ ID NO: 1990262 - protein, 17 aa, Staphylococcus
TKTSNESTKVEEIKNNP

SEQ ID NO: 1990263 - protein, 18 aa, Staphylococcus
TKTSNKSSKVKEIQSNPE

SEQ ID NO: 1990264 - protein, 9 aa, Staphylococcus
TKTSRDSLK

SEQ ID NO: 1990265 - protein, 7 aa, Staphylococcus
TKTTDQL

SEQ ID NO: 1990266 - protein, 5 aa, Staphylococcus
TKTTF

SEQ ID NO: 1990267 - protein, 12 aa, Staphylococcus
TKTTPKGNIEQN

SEQ ID NO: 1990268 - protein, 5 aa, Staphylococcus
TKTTY

SEQ ID NO: 1990269 - protein, 5 aa, Staphylococcus
TKVDD

SEQ ID NO: 1990270 - protein, 9 aa, Staphylococcus
TKVENNEKL

SEQ ID NO: 1990271 - protein, 11 aa, Staphylococcus
TKVERQQRNQH

SEQ ID NO: 1990272 - protein, 16 aa, Staphylococcus
TKVGEAIAKKANDKGI

SEQ ID NO: 1990273 - protein, 6 aa, Staphylococcus
TKVGND

SEQ ID NO: 1990274 - protein, 8 aa, Staphylococcus
TKVKNNQS

SEQ ID NO: 1990275 - protein, 11 aa, Staphylococcus
TKVKPSDQVEV

SEQ ID NO: 1990276 - protein, 21 aa, Staphylococcus
TKVREKLKNGESLPKAFSRPE

SEQ ID NO: 1990277 - protein, 21 aa, Staphylococcus
TKVREKLRNGEPLPKEFSRPE

SEQ ID NO: 1990278 - protein, 21 aa, Staphylococcus
TKVREKLRNGESLPEKFSRPE

SEQ ID NO: 1990279 - protein, 21 aa, Staphylococcus
TKVREKLRNGESLPTKFSRPE

SEQ ID NO: 1990280 - protein, 20 aa, Staphylococcus
TKVREKLRNGESLPTQFSRP

SEQ ID NO: 1990281 - protein, 4 aa, Staphylococcus
TKVS

SEQ ID NO: 1990282 - protein, 10 aa, Staphylococcus
TKVSHSDTVE

SEQ ID NO: 1990283 - protein, 11 aa, Staphylococcus
TKVSNSDTVEV

SEQ ID NO: 1990284 - protein, 5 aa, Staphylococcus
TKVSS

SEQ ID NO: 1990285 - protein, 12 aa, Staphylococcus
TKVTEGEAGGIT

SEQ ID NO: 1990286 - protein, 7 aa, Staphylococcus
TKYDKPS

SEQ ID NO: 1990287 - protein, 8 aa, Staphylococcus
TKYDRSSQ

SEQ ID NO: 1990288 - protein, 11 aa, Staphylococcus
TKYDSQAGAYK

SEQ ID NO: 1990289 - protein, 6 aa, Staphylococcus
TKYPDI

SEQ ID NO: 1990290 - protein, 16 aa, Staphylococcus
TKYPLDPNNPEDVKAA

SEQ ID NO: 1990291 - protein, 16 aa, Staphylococcus
TKYPYDPSNPEDVRAA

SEQ ID NO: 1990292 - protein, 16 aa, Staphylococcus
TKYPYDPTNPEDVKAA

SEQ ID NO: 1990293 - protein, 16 aa, Staphylococcus
TKYPYDPTNPEDVRAA

SEQ ID NO: 1990294 - protein, 7 aa, Staphylococcus
TKYQGTT

SEQ ID NO: 1990295 - protein, 4 aa, Staphylococcus
TKYR

SEQ ID NO: 1990296 - protein, 5 aa, Staphylococcus
TKYRK

SEQ ID NO: 1990297 - protein, 6 aa, Staphylococcus
TKYRKA

SEQ ID NO: 1990298 - protein, 14 aa, Staphylococcus
TKYSEEVQDPESLS

SEQ ID NO: 1990299 - protein, 7 aa, Staphylococcus
TKYSETM

SEQ ID NO: 1990300 - protein, 4 aa, Staphylococcus
TKYV

SEQ ID NO: 1990301 - protein, 4 aa, Staphylococcus
TKYY

SEQ ID NO: 1990302 - protein, 6 aa, Staphylococcus
TKYYGD

SEQ ID NO: 1990303 - protein, 6 aa, Staphylococcus
TKYYGK

SEQ ID NO: 1990304 - protein, 7 aa, Staphylococcus
TLAASDE

SEQ ID NO: 1990305 - protein, 9 aa, Staphylococcus
TLADGKKVK

SEQ ID NO: 1990306 - protein, 8 aa, Staphylococcus
TLADKGHN

SEQ ID NO: 1990307 - protein, 5 aa, Staphylococcus
TLADT

SEQ ID NO: 1990308 - protein, 5 aa, Staphylococcus
TLAEG

SEQ ID NO: 1990309 - protein, 5 aa, Staphylococcus
TLAEK

SEQ ID NO: 1990310 - protein, 8 aa, Staphylococcus
TLAEKGHP

SEQ ID NO: 1990311 - protein, 7 aa, Staphylococcus
TLAERGH

SEQ ID NO: 1990312 - protein, 6 aa, Staphylococcus
TLANAS

SEQ ID NO: 1990313 - protein, 4 aa, Staphylococcus
TLDD

SEQ ID NO: 1990314 - protein, 7 aa, Staphylococcus
TLDDEDR

SEQ ID NO: 1990315 - protein, 9 aa, Staphylococcus
TLDDFSDSL

SEQ ID NO: 1990316 - protein, 7 aa, Staphylococcus
TLDEEDK

SEQ ID NO: 1990317 - protein, 6 aa, Staphylococcus
TLDEEG

SEQ ID NO: 1990318 - protein, 6 aa, Staphylococcus
TLDGQK

SEQ ID NO: 1990319 - protein, 5 aa, Staphylococcus
TLDIQ

SEQ ID NO: 1990320 - protein, 11 aa, Staphylococcus
TLDKDSKTMKK

SEQ ID NO: 1990321 - protein, 5 aa, Staphylococcus
TLDLT

SEQ ID NO: 1990322 - protein, 11 aa, Staphylococcus
TLDMDSENTPI

SEQ ID NO: 1990323 - protein, 5 aa, Staphylococcus
TLDPQ

SEQ ID NO: 1990324 - protein, 9 aa, Staphylococcus
TLDPYRDET

SEQ ID NO: 1990325 - protein, 9 aa, Staphylococcus
TLDQETLDT

SEQ ID NO: 1990326 - protein, 10 aa, Staphylococcus
TLDQETLETS

SEQ ID NO: 1990327 - protein, 13 aa, Staphylococcus
TLDTGKTLEESYA

SEQ ID NO: 1990328 - protein, 14 aa, Staphylococcus
TLDTGKTLEESYAD

SEQ ID NO: 1990329 - protein, 14 aa, Staphylococcus
TLDTGKTLGESYAD

SEQ ID NO: 1990330 - protein, 12 aa, Staphylococcus
TLDTGKTYEESL

SEQ ID NO: 1990331 - protein, 12 aa, Staphylococcus
TLEATEPGSTQG

SEQ ID NO: 1990332 - protein, 5 aa, Staphylococcus
TLEDF

SEQ ID NO: 1990333 - protein, 5 aa, Staphylococcus
TLEEA

SEQ ID NO: 1990334 - protein, 8 aa, Staphylococcus
TLEEAKGA

SEQ ID NO: 1990335 - protein, 11 aa, Staphylococcus
TLEEAKNADEL

SEQ ID NO: 1990336 - protein, 6 aa, Staphylococcus
TLEEAL

SEQ ID NO: 1990337 - protein, 7 aa, Staphylococcus
TLEEARD

SEQ ID NO: 1990338 - protein, 7 aa, Staphylococcus
TLEEDES

SEQ ID NO: 1990339 - protein, 6 aa, Staphylococcus
TLEEDG

SEQ ID NO: 1990340 - protein, 9 aa, Staphylococcus
TLEEGKTAD

SEQ ID NO: 1990341 - protein, 8 aa, Staphylococcus
TLEERGYN

SEQ ID NO: 1990342 - protein, 6 aa, Staphylococcus
TLEESK

SEQ ID NO: 1990343 - protein, 7 aa, Staphylococcus
TLEETDS

SEQ ID NO: 1990344 - protein, 8 aa, Staphylococcus
TLEGAGLD

SEQ ID NO: 1990345 - protein, 13 aa, Staphylococcus
TLEKKDKKLSADI

SEQ ID NO: 1990346 - protein, 5 aa, Staphylococcus
TLENR

SEQ ID NO: 1990347 - protein, 6 aa, Staphylococcus
TLEPDT

SEQ ID NO: 1990348 - protein, 5 aa, Staphylococcus
TLEPN

SEQ ID NO: 1990349 - protein, 6 aa, Staphylococcus
TLEQAN

SEQ ID NO: 1990350 - protein, 7 aa, Staphylococcus
TLEQANV

SEQ ID NO: 1990351 - protein, 8 aa, Staphylococcus
TLEQKEVS

SEQ ID NO: 1990352 - protein, 5 aa, Staphylococcus
TLEQP

SEQ ID NO: 1990353 - protein, 9 aa, Staphylococcus
TLERDDESK

SEQ ID NO: 1990354 - protein, 7 aa, Staphylococcus
TLERSAP

SEQ ID NO: 1990355 - protein, 4 aa, Staphylococcus
TLET

SEQ ID NO: 1990356 - protein, 8 aa, Staphylococcus
TLETESNG

SEQ ID NO: 1990357 - protein, 11 aa, Staphylococcus
TLETPTDIKSQ

SEQ ID NO: 1990358 - protein, 12 aa, Staphylococcus
TLGDVTKTSSAT

SEQ ID NO: 1990359 - protein, 8 aa, Staphylococcus
TLGGQTGL

SEQ ID NO: 1990360 - protein, 8 aa, Staphylococcus
TLGKQGYK

SEQ ID NO: 1990361 - protein, 9 aa, Staphylococcus
TLGKTEDEI

SEQ ID NO: 1990362 - protein, 9 aa, Staphylococcus
TLGKTEEEI

SEQ ID NO: 1990363 - protein, 9 aa, Staphylococcus
TLGKTEQDI

SEQ ID NO: 1990364 - protein, 9 aa, Staphylococcus
TLGKTESDI

SEQ ID NO: 1990365 - protein, 9 aa, Staphylococcus
TLGNTENNT

SEQ ID NO: 1990366 - protein, 5 aa, Staphylococcus
TLGPA

SEQ ID NO: 1990367 - protein, 5 aa, Staphylococcus
TLGPS

SEQ ID NO: 1990368 - protein, 6 aa, Staphylococcus
TLGPSQ

SEQ ID NO: 1990369 - protein, 8 aa, Staphylococcus
TLGQDNKR

SEQ ID NO: 1990370 - protein, 7 aa, Staphylococcus
TLGRTEE

SEQ ID NO: 1990371 - protein, 19 aa, Staphylococcus
TLGSEGGTRGLPGGFTSPE

SEQ ID NO: 1990372 - protein, 18 aa, Staphylococcus
TLGTPHNGTHAADELGNE

SEQ ID NO: 1990373 - protein, 8 aa, Staphylococcus
TLGTSARK

SEQ ID NO: 1990374 - protein, 14 aa, Staphylococcus
TLGTTLDTLFWEND

SEQ ID NO: 1990375 - protein, 4 aa, Staphylococcus
TLHE

SEQ ID NO: 1990376 - protein, 6 aa, Staphylococcus
TLHQGD

SEQ ID NO: 1990377 - protein, 9 aa, Staphylococcus
TLISKGDDI

SEQ ID NO: 1990378 - protein, 10 aa, Staphylococcus
TLKDSEHDAI

SEQ ID NO: 1990379 - protein, 7 aa, Staphylococcus
TLKDTEA

SEQ ID NO: 1990380 - protein, 12 aa, Staphylococcus
TLKEKPDNSNLG

SEQ ID NO: 1990381 - protein, 12 aa, Staphylococcus
TLKEKPDPSELG

SEQ ID NO: 1990382 - protein, 12 aa, Staphylococcus
TLKEKPDTSKLG

SEQ ID NO: 1990383 - protein, 11 aa, Staphylococcus
TLKEKPEGNLG

SEQ ID NO: 1990384 - protein, 7 aa, Staphylococcus
TLKGETL

SEQ ID NO: 1990385 - protein, 7 aa, Staphylococcus
TLKGKQK

SEQ ID NO: 1990386 - protein, 10 aa, Staphylococcus
TLKGQGPKDL

SEQ ID NO: 1990387 - protein, 5 aa, Staphylococcus
TLKHG

SEQ ID NO: 1990388 - protein, 11 aa, Staphylococcus
TLKNEKALEEV

SEQ ID NO: 1990389 - protein, 13 aa, Staphylococcus
TLKPGQEISVREK

SEQ ID NO: 1990390 - protein, 8 aa, Staphylococcus
TLKPKTLT

SEQ ID NO: 1990391 - protein, 11 aa, Staphylococcus
TLKREKDLSAK

SEQ ID NO: 1990392 - protein, 8 aa, Staphylococcus
TLKSQSEF

SEQ ID NO: 1990393 - protein, 6 aa, Staphylococcus
TLKTDD

SEQ ID NO: 1990394 - protein, 6 aa, Staphylococcus
TLKTQS

SEQ ID NO: 1990395 - protein, 12 aa, Staphylococcus
TLKVSTKPAEAD

SEQ ID NO: 1990396 - protein, 14 aa, Staphylococcus
TLLGQKGDVPEEPY

SEQ ID NO: 1990397 - protein, 12 aa, Staphylococcus
TLLGQKGEVPEE

SEQ ID NO: 1990398 - protein, 15 aa, Staphylococcus
TLLGQKGNVPEEPYT

SEQ ID NO: 1990399 - protein, 14 aa, Staphylococcus
TLLGQKSNVPEEPY

SEQ ID NO: 1990400 - protein, 4 aa, Staphylococcus
TLND

SEQ ID NO: 1990401 - protein, 8 aa, Staphylococcus
TLNDNTTL

SEQ ID NO: 1990402 - protein, 6 aa, Staphylococcus
TLNEAG

SEQ ID NO: 1990403 - protein, 11 aa, Staphylococcus
TLNELQENTNY

SEQ ID NO: 1990404 - protein, 18 aa, Staphylococcus
TLNERNADKLEGKPLSDA

SEQ ID NO: 1990405 - protein, 7 aa, Staphylococcus
TLNGEKS

SEQ ID NO: 1990406 - protein, 6 aa, Staphylococcus
TLNHDQ

SEQ ID NO: 1990407 - protein, 4 aa, Staphylococcus
TLNN

SEQ ID NO: 1990408 - protein, 6 aa, Staphylococcus
TLNNQQ

SEQ ID NO: 1990409 - protein, 6 aa, Staphylococcus
TLNPAN

SEQ ID NO: 1990410 - protein, 9 aa, Staphylococcus
TLNPENPRA

SEQ ID NO: 1990411 - protein, 4 aa, Staphylococcus
TLNQ

SEQ ID NO: 1990412 - protein, 7 aa, Staphylococcus
TLNQGDV

SEQ ID NO: 1990413 - protein, 8 aa, Staphylococcus
TLNQNSPP

SEQ ID NO: 1990414 - protein, 16 aa, Staphylococcus
TLNSEKETLESQYDQD

SEQ ID NO: 1990415 - protein, 19 aa, Staphylococcus
TLNSGSYVKNSTKDKRERV

SEQ ID NO: 1990416 - protein, 8 aa, Staphylococcus
TLNSTEKA

SEQ ID NO: 1990417 - protein, 7 aa, Staphylococcus
TLNTQSE

SEQ ID NO: 1990418 - protein, 5 aa, Staphylococcus
TLPAA

SEQ ID NO: 1990419 - protein, 8 aa, Staphylococcus
TLPDPKEV

SEQ ID NO: 1990420 - protein, 9 aa, Staphylococcus
TLPDPKEVE

SEQ ID NO: 1990421 - protein, 9 aa, Staphylococcus
TLPDTKEVE

SEQ ID NO: 1990422 - protein, 22 aa, Staphylococcus
TLPERATHLTDKELKKEIDQPI

SEQ ID NO: 1990423 - protein, 4 aa, Staphylococcus
TLPI

SEQ ID NO: 1990424 - protein, 12 aa, Staphylococcus
TLPKAKGTTGDK

SEQ ID NO: 1990425 - protein, 6 aa, Staphylococcus
TLPKAY

SEQ ID NO: 1990426 - protein, 6 aa, Staphylococcus
TLPKTS

SEQ ID NO: 1990427 - protein, 18 aa, Staphylococcus
TLPNQYEQPIKVERVAFN

SEQ ID NO: 1990428 - protein, 10 aa, Staphylococcus
TLPQGSTATD

SEQ ID NO: 1990429 - protein, 8 aa, Staphylococcus
TLPSKATL

SEQ ID NO: 1990430 - protein, 7 aa, Staphylococcus
TLPSPFE

SEQ ID NO: 1990431 - protein, 10 aa, Staphylococcus
TLPSSPNGSF

SEQ ID NO: 1990432 - protein, 6 aa, Staphylococcus
TLPTDQ

SEQ ID NO: 1990433 - protein, 10 aa, Staphylococcus
TLPTNGKRAN

SEQ ID NO: 1990434 - protein, 6 aa, Staphylococcus
TLPTPF

SEQ ID NO: 1990435 - protein, 19 aa, Staphylococcus
TLPVGQARPGTTLSTTDEG

SEQ ID NO: 1990436 - protein, 5 aa, Staphylococcus
TLPYA

SEQ ID NO: 1990437 - protein, 6 aa, Staphylococcus
TLQENS

SEQ ID NO: 1990438 - protein, 13 aa, Staphylococcus
TLQGDGAIGNAPS

SEQ ID NO: 1990439 - protein, 20 aa, Staphylococcus
TLQKGDNIEVTEANGELVIK

SEQ ID NO: 1990440 - protein, 6 aa, Staphylococcus
TLQNQG

SEQ ID NO: 1990441 - protein, 10 aa, Staphylococcus
TLQRKYGKGI

SEQ ID NO: 1990442 - protein, 9 aa, Staphylococcus
TLQSSDATA

SEQ ID NO: 1990443 - protein, 4 aa, Staphylococcus
TLRA

SEQ ID NO: 1990444 - protein, 5 aa, Staphylococcus
TLRED

SEQ ID NO: 1990445 - protein, 31 aa, Staphylococcus
TLRENKKKYQSLSQKYNETENSIKKTKEQIS

SEQ ID NO: 1990446 - protein, 10 aa, Staphylococcus
TLRGEGPEDL

SEQ ID NO: 1990447 - protein, 9 aa, Staphylococcus
TLRKKENCD

SEQ ID NO: 1990448 - protein, 6 aa, Staphylococcus
TLRNND

SEQ ID NO: 1990449 - protein, 12 aa, Staphylococcus
TLRQNKETALGY

SEQ ID NO: 1990450 - protein, 4 aa, Staphylococcus
TLRS

SEQ ID NO: 1990451 - protein, 6 aa, Staphylococcus
TLRSEG

SEQ ID NO: 1990452 - protein, 5 aa, Staphylococcus
TLSAQ

SEQ ID NO: 1990453 - protein, 12 aa, Staphylococcus
TLSDGSGEAKFA

SEQ ID NO: 1990454 - protein, 7 aa, Staphylococcus
TLSDTEV

SEQ ID NO: 1990455 - protein, 5 aa, Staphylococcus
TLSEA

SEQ ID NO: 1990456 - protein, 8 aa, Staphylococcus
TLSEAGAD

SEQ ID NO: 1990457 - protein, 9 aa, Staphylococcus
TLSEEEENF

SEQ ID NO: 1990458 - protein, 5 aa, Staphylococcus
TLSET

SEQ ID NO: 1990459 - protein, 9 aa, Staphylococcus
TLSGGQRQR

SEQ ID NO: 1990460 - protein, 16 aa, Staphylococcus
TLSGNPVEEGQTAPDF

SEQ ID NO: 1990461 - protein, 14 aa, Staphylococcus
TLSGQQVKEGDIAP

SEQ ID NO: 1990462 - protein, 14 aa, Staphylococcus
TLSGQQVNEGDVAP

SEQ ID NO: 1990463 - protein, 12 aa, Staphylococcus
TLSGSSRSTKHE

SEQ ID NO: 1990464 - protein, 5 aa, Staphylococcus
TLSHA

SEQ ID NO: 1990465 - protein, 10 aa, Staphylococcus
TLSKETNQKV

SEQ ID NO: 1990466 - protein, 11 aa, Staphylococcus
TLSKSGSKNVV

SEQ ID NO: 1990467 - protein, 8 aa, Staphylococcus
TLSKSRET

SEQ ID NO: 1990468 - protein, 18 aa, Staphylococcus
TLSKTGSIKGDAGDSIKK

SEQ ID NO: 1990469 - protein, 7 aa, Staphylococcus
TLSNNEF

SEQ ID NO: 1990470 - protein, 20 aa, Staphylococcus
TLSPSDLSKKIGNKKSTITG

SEQ ID NO: 1990471 - protein, 19 aa, Staphylococcus
TLSSGSYVKNSSKDKRERV

SEQ ID NO: 1990472 - protein, 19 aa, Staphylococcus
TLSSGSYVKNSTKGKRERV

SEQ ID NO: 1990473 - protein, 19 aa, Staphylococcus
TLSSGSYVKNSTKNKRERV

SEQ ID NO: 1990474 - protein, 7 aa, Staphylococcus
TLSVENG

SEQ ID NO: 1990475 - protein, 10 aa, Staphylococcus
TLTDDERNTF

SEQ ID NO: 1990476 - protein, 8 aa, Staphylococcus
TLTDDSEP

SEQ ID NO: 1990477 - protein, 9 aa, Staphylococcus
TLTDDTTVT

SEQ ID NO: 1990478 - protein, 10 aa, Staphylococcus
TLTDPEKEAF

SEQ ID NO: 1990479 - protein, 11 aa, Staphylococcus
TLTDSEKETFK

SEQ ID NO: 1990480 - protein, 11 aa, Staphylococcus
TLTEDEKNTFK

SEQ ID NO: 1990481 - protein, 7 aa, Staphylococcus
TLTEEEV

SEQ ID NO: 1990482 - protein, 9 aa, Staphylococcus
TLTEEKGLK

SEQ ID NO: 1990483 - protein, 8 aa, Staphylococcus
TLTEKGQQ

SEQ ID NO: 1990484 - protein, 8 aa, Staphylococcus
TLTENELK

SEQ ID NO: 1990485 - protein, 7 aa, Staphylococcus
TLTEQQR

SEQ ID NO: 1990486 - protein, 5 aa, Staphylococcus
TLTGE

SEQ ID NO: 1990487 - protein, 9 aa, Staphylococcus
TLTGGKAKL

SEQ ID NO: 1990488 - protein, 8 aa, Staphylococcus
TLTGSDGE

SEQ ID NO: 1990489 - protein, 7 aa, Staphylococcus
TLTGSNG

SEQ ID NO: 1990490 - protein, 5 aa, Staphylococcus
TLTPE

SEQ ID NO: 1990491 - protein, 6 aa, Staphylococcus
TLTPFD

SEQ ID NO: 1990492 - protein, 4 aa, Staphylococcus
TLTQ

SEQ ID NO: 1990493 - protein, 9 aa, Staphylococcus
TLTQSETTQ

SEQ ID NO: 1990494 - protein, 4 aa, Staphylococcus
TLTS

SEQ ID NO: 1990495 - protein, 18 aa, Staphylococcus
TLTSAGATVVPSGFNKSG

SEQ ID NO: 1990496 - protein, 7 aa, Staphylococcus
TLTSDGE

SEQ ID NO: 1990497 - protein, 19 aa, Staphylococcus
TLTSGSYIKNSTKDKRERV

SEQ ID NO: 1990498 - protein, 19 aa, Staphylococcus
TLTSGSYVKNSTKDKRERV

SEQ ID NO: 1990499 - protein, 19 aa, Staphylococcus
TLTSGSYVKNSTKNKRERV

SEQ ID NO: 1990500 - protein, 10 aa, Staphylococcus
TLTSQGATKI

SEQ ID NO: 1990501 - protein, 10 aa, Staphylococcus
TLTSTPKDQE

SEQ ID NO: 1990502 - protein, 10 aa, Staphylococcus
TLTSTPKEQE

SEQ ID NO: 1990503 - protein, 5 aa, Staphylococcus
TLTTQ

SEQ ID NO: 1990504 - protein, 10 aa, Staphylococcus
TLTTSPKDQE

SEQ ID NO: 1990505 - protein, 5 aa, Staphylococcus
TLTTT

SEQ ID NO: 1990506 - protein, 7 aa, Staphylococcus
TLTTTEY

SEQ ID NO: 1990507 - protein, 4 aa, Staphylococcus
TLTY

SEQ ID NO: 1990508 - protein, 5 aa, Staphylococcus
TLTYG

SEQ ID NO: 1990509 - protein, 11 aa, Staphylococcus
TLVTESDGRTW

SEQ ID NO: 1990510 - protein, 7 aa, Staphylococcus
TLYATPD

SEQ ID NO: 1990511 - protein, 10 aa, Staphylococcus
TLYATPDYDK

SEQ ID NO: 1990512 - protein, 16 aa, Staphylococcus
TLYATPDYDKIQQMKE

SEQ ID NO: 1990513 - protein, 16 aa, Staphylococcus
TLYATPDYDKIQSMKQ

SEQ ID NO: 1990514 - protein, 10 aa, Staphylococcus
TLYDTKPRGL

SEQ ID NO: 1990515 - protein, 6 aa, Staphylococcus
TLYEEE

SEQ ID NO: 1990516 - protein, 5 aa, Staphylococcus
TLYGG

SEQ ID NO: 1990517 - protein, 11 aa, Staphylococcus
TLYPKSSSIED

SEQ ID NO: 1990518 - protein, 12 aa, Staphylococcus
TLYTENDAHEAL

SEQ ID NO: 1990519 - protein, 5 aa, Staphylococcus
TMAEG

SEQ ID NO: 1990520 - protein, 24 aa, Staphylococcus
TMAGDDPTRYRTSDEDADWEKKDP

SEQ ID NO: 1990521 - protein, 23 aa, Staphylococcus
TMAGDDPTRYRTSDEDAEWEKKD

SEQ ID NO: 1990522 - protein, 24 aa, Staphylococcus
TMAGDDPTRYRTSDEDAEWEKKDP

SEQ ID NO: 1990523 - protein, 24 aa, Staphylococcus
TMAGDDPTRYRTSDEDSEWEKKDP

SEQ ID NO: 1990524 - protein, 4 aa, Staphylococcus
TMDD

SEQ ID NO: 1990525 - protein, 5 aa, Staphylococcus
TMDDT

SEQ ID NO: 1990526 - protein, 12 aa, Staphylococcus
TMDEKTTEGNVD

SEQ ID NO: 1990527 - protein, 6 aa, Staphylococcus
TMDNSK

SEQ ID NO: 1990528 - protein, 7 aa, Staphylococcus
TMDQQSK

SEQ ID NO: 1990529 - protein, 5 aa, Staphylococcus
TMDRG

SEQ ID NO: 1990530 - protein, 5 aa, Staphylococcus
TMDSI

SEQ ID NO: 1990531 - protein, 5 aa, Staphylococcus
TMEAG

SEQ ID NO: 1990532 - protein, 9 aa, Staphylococcus
TMEDKDYHD

SEQ ID NO: 1990533 - protein, 5 aa, Staphylococcus
TMEDR

SEQ ID NO: 1990534 - protein, 8 aa, Staphylococcus
TMEKSGPR

SEQ ID NO: 1990535 - protein, 19 aa, Staphylococcus
TMEPTRQALKDAGLSTSEI

SEQ ID NO: 1990536 - protein, 19 aa, Staphylococcus
TMEPTRQAMKDAGLSNSDI

SEQ ID NO: 1990537 - protein, 5 aa, Staphylococcus
TMESI

SEQ ID NO: 1990538 - protein, 7 aa, Staphylococcus
TMGGTSL

SEQ ID NO: 1990539 - protein, 9 aa, Staphylococcus
TMGGTSLKT

SEQ ID NO: 1990540 - protein, 19 aa, Staphylococcus
TMGPTRQALSDAGLSSNDI

SEQ ID NO: 1990541 - protein, 6 aa, Staphylococcus
TMGSGQ

SEQ ID NO: 1990542 - protein, 11 aa, Staphylococcus
TMGTRSGNIDP

SEQ ID NO: 1990543 - protein, 9 aa, Staphylococcus
TMIGTDEQE

SEQ ID NO: 1990544 - protein, 5 aa, Staphylococcus
TMKET

SEQ ID NO: 1990545 - protein, 12 aa, Staphylococcus
TMKGTDGASNLD

SEQ ID NO: 1990546 - protein, 4 aa, Staphylococcus
TMKT

SEQ ID NO: 1990547 - protein, 10 aa, Staphylococcus
TMKTEDNTTL

SEQ ID NO: 1990548 - protein, 10 aa, Staphylococcus
TMKTENGSTL

SEQ ID NO: 1990549 - protein, 9 aa, Staphylococcus
TMLSTQGDE

SEQ ID NO: 1990550 - protein, 5 aa, Staphylococcus
TMNPD

SEQ ID NO: 1990551 - protein, 7 aa, Staphylococcus
TMNPENR

SEQ ID NO: 1990552 - protein, 5 aa, Staphylococcus
TMNQT

SEQ ID NO: 1990553 - protein, 7 aa, Staphylococcus
TMPKREE

SEQ ID NO: 1990554 - protein, 8 aa, Staphylococcus
TMPQRDKG

SEQ ID NO: 1990555 - protein, 4 aa, Staphylococcus
TMPR

SEQ ID NO: 1990556 - protein, 11 aa, Staphylococcus
TMQDAQQGLPK

SEQ ID NO: 1990557 - protein, 5 aa, Staphylococcus
TMREA

SEQ ID NO: 1990558 - protein, 11 aa, Staphylococcus
TMRNDPDGRSR

SEQ ID NO: 1990559 - protein, 8 aa, Staphylococcus
TMSEEEQN

SEQ ID NO: 1990560 - protein, 13 aa, Staphylococcus
TMSKQGQISEEAA

SEQ ID NO: 1990561 - protein, 8 aa, Staphylococcus
TMSTNRKQ

SEQ ID NO: 1990562 - protein, 4 aa, Staphylococcus
TMTD

SEQ ID NO: 1990563 - protein, 14 aa, Staphylococcus
TMTKQGQISEEAAS

SEQ ID NO: 1990564 - protein, 6 aa, Staphylococcus
TMTLPK

SEQ ID NO: 1990565 - protein, 6 aa, Staphylococcus
TMTLPN

SEQ ID NO: 1990566 - protein, 18 aa, Staphylococcus
TMTPPESNVSRFDPDQSQ

SEQ ID NO: 1990567 - protein, 18 aa, Staphylococcus
TMTPPETNVSRYTPDKEA

SEQ ID NO: 1990568 - protein, 9 aa, Staphylococcus
TMTPPETSV

SEQ ID NO: 1990569 - protein, 12 aa, Staphylococcus
TMTPRKPNSALR

SEQ ID NO: 1990570 - protein, 11 aa, Staphylococcus
TMTQSDENITK

SEQ ID NO: 1990571 - protein, 4 aa, Staphylococcus
TMYE

SEQ ID NO: 1990572 - protein, 11 aa, Staphylococcus
TMYGTGQLPKF

SEQ ID NO: 1990573 - protein, 10 aa, Staphylococcus
TMYNTKPRGL

SEQ ID NO: 1990574 - protein, 13 aa, Staphylococcus
TMYTENDAKEALP

SEQ ID NO: 1990575 - protein, 4 aa, Staphylococcus
TNAD

SEQ ID NO: 1990576 - protein, 7 aa, Staphylococcus
TNADSYV

SEQ ID NO: 1990577 - protein, 6 aa, Staphylococcus
TNAGKS

SEQ ID NO: 1990578 - protein, 8 aa, Staphylococcus
TNAGQTCV

SEQ ID NO: 1990579 - protein, 22 aa, Staphylococcus
TNAGSGSYFEDEDYKQAGAEIV

SEQ ID NO: 1990580 - protein, 4 aa, Staphylococcus
TNAI

SEQ ID NO: 1990581 - protein, 4 aa, Staphylococcus
TNAK

SEQ ID NO: 1990582 - protein, 9 aa, Staphylococcus
TNAKDPQKR

SEQ ID NO: 1990583 - protein, 9 aa, Staphylococcus
TNAKGVHAK

SEQ ID NO: 1990584 - protein, 6 aa, Staphylococcus
TNALAD

SEQ ID NO: 1990585 - protein, 5 aa, Staphylococcus
TNANR

SEQ ID NO: 1990586 - protein, 7 aa, Staphylococcus
TNAPEDN

SEQ ID NO: 1990587 - protein, 7 aa, Staphylococcus
TNAPEEN

SEQ ID NO: 1990588 - protein, 8 aa, Staphylococcus
TNAPEENV

SEQ ID NO: 1990589 - protein, 7 aa, Staphylococcus
TNAPETN

SEQ ID NO: 1990590 - protein, 6 aa, Staphylococcus
TNAPSL

SEQ ID NO: 1990591 - protein, 22 aa, Staphylococcus
TNAPTKLASMSESMDASRIPYS

SEQ ID NO: 1990592 - protein, 8 aa, Staphylococcus
TNAQPKFY

SEQ ID NO: 1990593 - protein, 10 aa, Staphylococcus
TNARETLQSS

SEQ ID NO: 1990594 - protein, 8 aa, Staphylococcus
TNASEPVY

SEQ ID NO: 1990595 - protein, 8 aa, Staphylococcus
TNATDTEA

SEQ ID NO: 1990596 - protein, 6 aa, Staphylococcus
TNATGA

SEQ ID NO: 1990597 - protein, 17 aa, Staphylococcus
TNATSGMPQQYKEKQAS

SEQ ID NO: 1990598 - protein, 7 aa, Staphylococcus
TNATTPV

SEQ ID NO: 1990599 - protein, 6 aa, Staphylococcus
TNAVGG

SEQ ID NO: 1990600 - protein, 10 aa, Staphylococcus
TNAVQEAQTR

SEQ ID NO: 1990601 - protein, 10 aa, Staphylococcus
TNDAGTGQID

SEQ ID NO: 1990602 - protein, 6 aa, Staphylococcus
TNDARF

SEQ ID NO: 1990603 - protein, 10 aa, Staphylococcus
TNDARQIAKK

SEQ ID NO: 1990604 - protein, 4 aa, Staphylococcus
TNDD

SEQ ID NO: 1990605 - protein, 5 aa, Staphylococcus
TNDDA

SEQ ID NO: 1990606 - protein, 6 aa, Staphylococcus
TNDEQY

SEQ ID NO: 1990607 - protein, 8 aa, Staphylococcus
TNDGKHPL

SEQ ID NO: 1990608 - protein, 14 aa, Staphylococcus
TNDGTLSEAGGPQY

SEQ ID NO: 1990609 - protein, 14 aa, Staphylococcus
TNDIPPNSLAAGVP

SEQ ID NO: 1990610 - protein, 4 aa, Staphylococcus
TNDK

SEQ ID NO: 1990611 - protein, 8 aa, Staphylococcus
TNDKDQIK

SEQ ID NO: 1990612 - protein, 8 aa, Staphylococcus
TNDKDRQH

SEQ ID NO: 1990613 - protein, 7 aa, Staphylococcus
TNDKFDR

SEQ ID NO: 1990614 - protein, 9 aa, Staphylococcus
TNDKGQNQI

SEQ ID NO: 1990615 - protein, 18 aa, Staphylococcus
TNDKHRPNAIDKSKKQLN

SEQ ID NO: 1990616 - protein, 10 aa, Staphylococcus
TNDKTDTERV

SEQ ID NO: 1990617 - protein, 7 aa, Staphylococcus
TNDLADK

SEQ ID NO: 1990618 - protein, 6 aa, Staphylococcus
TNDLDE

SEQ ID NO: 1990619 - protein, 6 aa, Staphylococcus
TNDLSQ

SEQ ID NO: 1990620 - protein, 7 aa, Staphylococcus
TNDLSQG

SEQ ID NO: 1990621 - protein, 5 aa, Staphylococcus
TNDND

SEQ ID NO: 1990622 - protein, 6 aa, Staphylococcus
TNDNHI

SEQ ID NO: 1990623 - protein, 5 aa, Staphylococcus
TNDNN

SEQ ID NO: 1990624 - protein, 17 aa, Staphylococcus
TNDNRVNQQIAASKPQH

SEQ ID NO: 1990625 - protein, 5 aa, Staphylococcus
TNDPY

SEQ ID NO: 1990626 - protein, 21 aa, Staphylococcus
TNDQNNIDNPHKDLRRARSCG

SEQ ID NO: 1990627 - protein, 6 aa, Staphylococcus
TNDQTI

SEQ ID NO: 1990628 - protein, 7 aa, Staphylococcus
TNDSEKY

SEQ ID NO: 1990629 - protein, 6 aa, Staphylococcus
TNDTSS

SEQ ID NO: 1990630 - protein, 8 aa, Staphylococcus
TNDVDDYD

SEQ ID NO: 1990631 - protein, 8 aa, Staphylococcus
TNDVGEAA

SEQ ID NO: 1990632 - protein, 6 aa, Staphylococcus
TNDWPD

SEQ ID NO: 1990633 - protein, 5 aa, Staphylococcus
TNDYD

SEQ ID NO: 1990634 - protein, 27 aa, Staphylococcus
TNEAMNKADELTSERLGKHTKGLNIPG

SEQ ID NO: 1990635 - protein, 27 aa, Staphylococcus
TNEAMNKADKLTQERLGKHTQGLNIPG

SEQ ID NO: 1990636 - protein, 7 aa, Staphylococcus
TNEASIK

SEQ ID NO: 1990637 - protein, 7 aa, Staphylococcus
TNEDDKE

SEQ ID NO: 1990638 - protein, 8 aa, Staphylococcus
TNEDHPTQ

SEQ ID NO: 1990639 - protein, 28 aa, Staphylococcus
TNEDLKEAAKAAIDSHGVGAGAVRSING

SEQ ID NO: 1990640 - protein, 27 aa, Staphylococcus
TNEDLKEAAKKAIDSHGVGAGAVRSIN

SEQ ID NO: 1990641 - protein, 29 aa, Staphylococcus
TNEDLKQAAKDAIDTHGVGAGAVRSINGT

SEQ ID NO: 1990642 - protein, 21 aa, Staphylococcus
TNEDLKQVAKDAVDKYGVGAG

SEQ ID NO: 1990643 - protein, 28 aa, Staphylococcus
TNEDLKSAAKHAIDSHGVGAGAVRSING

SEQ ID NO: 1990644 - protein, 28 aa, Staphylococcus
TNEDLKTAAKSAIDSHGVGAGAVRSING

SEQ ID NO: 1990645 - protein, 4 aa, Staphylococcus
TNEE

SEQ ID NO: 1990646 - protein, 7 aa, Staphylococcus
TNEELEN

SEQ ID NO: 1990647 - protein, 16 aa, Staphylococcus
TNEEQAEKLKEAGVDR

SEQ ID NO: 1990648 - protein, 12 aa, Staphylococcus
TNEFGNVKSMII

SEQ ID NO: 1990649 - protein, 8 aa, Staphylococcus
TNEIDKSK

SEQ ID NO: 1990650 - protein, 10 aa, Staphylococcus
TNEIEQRYKG

SEQ ID NO: 1990651 - protein, 8 aa, Staphylococcus
TNEKDKYH

SEQ ID NO: 1990652 - protein, 8 aa, Staphylococcus
TNEKDKYK

SEQ ID NO: 1990653 - protein, 6 aa, Staphylococcus
TNEKDL

SEQ ID NO: 1990654 - protein, 9 aa, Staphylococcus
TNEKITDID

SEQ ID NO: 1990655 - protein, 12 aa, Staphylococcus
TNEKVTDTDAEI

SEQ ID NO: 1990656 - protein, 6 aa, Staphylococcus
TNELAE

SEQ ID NO: 1990657 - protein, 10 aa, Staphylococcus
TNELKRGEYE

SEQ ID NO: 1990658 - protein, 14 aa, Staphylococcus
TNELNASYAADGYA

SEQ ID NO: 1990659 - protein, 14 aa, Staphylococcus
TNELNASYATDGYA

SEQ ID NO: 1990660 - protein, 9 aa, Staphylococcus
TNELPLGKL

SEQ ID NO: 1990661 - protein, 5 aa, Staphylococcus
TNELS

SEQ ID NO: 1990662 - protein, 5 aa, Staphylococcus
TNENG

SEQ ID NO: 1990663 - protein, 5 aa, Staphylococcus
TNENN

SEQ ID NO: 1990664 - protein, 5 aa, Staphylococcus
TNENY

SEQ ID NO: 1990665 - protein, 11 aa, Staphylococcus
TNEPLTNVQSQ

SEQ ID NO: 1990666 - protein, 6 aa, Staphylococcus
TNEQGH

SEQ ID NO: 1990667 - protein, 9 aa, Staphylococcus
TNEQLTDFQ

SEQ ID NO: 1990668 - protein, 15 aa, Staphylococcus
TNERQTLEKDLGKAL

SEQ ID NO: 1990669 - protein, 7 aa, Staphylococcus
TNESIKD

SEQ ID NO: 1990670 - protein, 7 aa, Staphylococcus
TNETEKY

SEQ ID NO: 1990671 - protein, 13 aa, Staphylococcus
TNETWNEELSRLN

SEQ ID NO: 1990672 - protein, 5 aa, Staphylococcus
TNEVN

SEQ ID NO: 1990673 - protein, 4 aa, Staphylococcus
TNEY

SEQ ID NO: 1990674 - protein, 11 aa, Staphylococcus
TNEYETKTYQE

SEQ ID NO: 1990675 - protein, 18 aa, Staphylococcus
TNEYGTAPVHNKETFETN

SEQ ID NO: 1990676 - protein, 19 aa, Staphylococcus
TNEYGTAPVHNKETYETNV

SEQ ID NO: 1990677 - protein, 18 aa, Staphylococcus
TNEYGTAPVYDKETYETN

SEQ ID NO: 1990678 - protein, 9 aa, Staphylococcus
TNFDEEGKA

SEQ ID NO: 1990679 - protein, 4 aa, Staphylococcus
TNFS

SEQ ID NO: 1990680 - protein, 5 aa, Staphylococcus
TNFSA

SEQ ID NO: 1990681 - protein, 7 aa, Staphylococcus
TNFSTDN

SEQ ID NO: 1990682 - protein, 5 aa, Staphylococcus
TNGDF

SEQ ID NO: 1990683 - protein, 8 aa, Staphylococcus
TNGDKDPF

SEQ ID NO: 1990684 - protein, 11 aa, Staphylococcus
TNGDTPDYQAS

SEQ ID NO: 1990685 - protein, 5 aa, Staphylococcus
TNGEI

SEQ ID NO: 1990686 - protein, 11 aa, Staphylococcus
TNGEIPDYQAS

SEQ ID NO: 1990687 - protein, 13 aa, Staphylococcus
TNGELTDRQHKTR

SEQ ID NO: 1990688 - protein, 5 aa, Staphylococcus
TNGEY

SEQ ID NO: 1990689 - protein, 9 aa, Staphylococcus
TNGGDSAFV

SEQ ID NO: 1990690 - protein, 5 aa, Staphylococcus
TNGGG

SEQ ID NO: 1990691 - protein, 16 aa, Staphylococcus
TNGGHAEHTPETEEYG

SEQ ID NO: 1990692 - protein, 4 aa, Staphylococcus
TNGK

SEQ ID NO: 1990693 - protein, 4 aa, Staphylococcus
TNGM

SEQ ID NO: 1990694 - protein, 4 aa, Staphylococcus
TNGP

SEQ ID NO: 1990695 - protein, 10 aa, Staphylococcus
TNGPYSGEPL

SEQ ID NO: 1990696 - protein, 6 aa, Staphylococcus
TNGQVR

SEQ ID NO: 1990697 - protein, 11 aa, Staphylococcus
TNGSDRPHKTI

SEQ ID NO: 1990698 - protein, 7 aa, Staphylococcus
TNGTSRS

SEQ ID NO: 1990699 - protein, 10 aa, Staphylococcus
TNGYYRGSNH

SEQ ID NO: 1990700 - protein, 5 aa, Staphylococcus
TNHEA

SEQ ID NO: 1990701 - protein, 8 aa, Staphylococcus
TNHERARV

SEQ ID NO: 1990702 - protein, 10 aa, Staphylococcus
TNHERERVSD

SEQ ID NO: 1990703 - protein, 7 aa, Staphylococcus
TNHESQV

SEQ ID NO: 1990704 - protein, 6 aa, Staphylococcus
TNHKLE

SEQ ID NO: 1990705 - protein, 5 aa, Staphylococcus
TNHKN

SEQ ID NO: 1990706 - protein, 13 aa, Staphylococcus
TNHKNDDKQKSIT

SEQ ID NO: 1990707 - protein, 9 aa, Staphylococcus
TNHPEDKGT

SEQ ID NO: 1990708 - protein, 6 aa, Staphylococcus
TNHQGM

SEQ ID NO: 1990709 - protein, 12 aa, Staphylococcus
TNHTRSNETIAF

SEQ ID NO: 1990710 - protein, 18 aa, Staphylococcus
TNHVPTAAGLASSASAYA

SEQ ID NO: 1990711 - protein, 4 aa, Staphylococcus
TNID

SEQ ID NO: 1990712 - protein, 6 aa, Staphylococcus
TNIDEN

SEQ ID NO: 1990713 - protein, 5 aa, Staphylococcus
TNIDK

SEQ ID NO: 1990714 - protein, 8 aa, Staphylococcus
TNIDKNIT

SEQ ID NO: 1990715 - protein, 5 aa, Staphylococcus
TNIEA

SEQ ID NO: 1990716 - protein, 9 aa, Staphylococcus
TNIEKTDQA

SEQ ID NO: 1990717 - protein, 9 aa, Staphylococcus
TNIEKTEDG

SEQ ID NO: 1990718 - protein, 11 aa, Staphylococcus
TNIENDGLDKV

SEQ ID NO: 1990719 - protein, 18 aa, Staphylococcus
TNIEPSQHFTQPPPRYTE

SEQ ID NO: 1990720 - protein, 8 aa, Staphylococcus
TNIKESKH

SEQ ID NO: 1990721 - protein, 13 aa, Staphylococcus
TNIKNSKSKIERM

SEQ ID NO: 1990722 - protein, 7 aa, Staphylococcus
TNIPQGR

SEQ ID NO: 1990723 - protein, 12 aa, Staphylococcus
TNIQDEPAEDIE

SEQ ID NO: 1990724 - protein, 5 aa, Staphylococcus
TNIRP

SEQ ID NO: 1990725 - protein, 8 aa, Staphylococcus
TNIYSKKD

SEQ ID NO: 1990726 - protein, 10 aa, Staphylococcus
TNKDKIEGSL

SEQ ID NO: 1990727 - protein, 11 aa, Staphylococcus
TNKDKQEGKLS

SEQ ID NO: 1990728 - protein, 11 aa, Staphylococcus
TNKDKTEGELS

SEQ ID NO: 1990729 - protein, 7 aa, Staphylococcus
TNKDRIK

SEQ ID NO: 1990730 - protein, 9 aa, Staphylococcus
TNKDTPNGN

SEQ ID NO: 1990731 - protein, 9 aa, Staphylococcus
TNKEDMKRI

SEQ ID NO: 1990732 - protein, 13 aa, Staphylococcus
TNKEETDKARKQI

SEQ ID NO: 1990733 - protein, 7 aa, Staphylococcus
TNKERIK

SEQ ID NO: 1990734 - protein, 5 aa, Staphylococcus
TNKES

SEQ ID NO: 1990735 - protein, 15 aa, Staphylococcus
TNKETLQKACENNEV

SEQ ID NO: 1990736 - protein, 5 aa, Staphylococcus
TNKGD

SEQ ID NO: 1990737 - protein, 8 aa, Staphylococcus
TNKGVENV

SEQ ID NO: 1990738 - protein, 6 aa, Staphylococcus
TNKNNY

SEQ ID NO: 1990739 - protein, 6 aa, Staphylococcus
TNKPES

SEQ ID NO: 1990740 - protein, 9 aa, Staphylococcus
TNKPFDTSR

SEQ ID NO: 1990741 - protein, 9 aa, Staphylococcus
TNKRNEKMK

SEQ ID NO: 1990742 - protein, 7 aa, Staphylococcus
TNKSAEE

SEQ ID NO: 1990743 - protein, 7 aa, Staphylococcus
TNKSKDP

SEQ ID NO: 1990744 - protein, 8 aa, Staphylococcus
TNKSRARV

SEQ ID NO: 1990745 - protein, 9 aa, Staphylococcus
TNKTDYATG

SEQ ID NO: 1990746 - protein, 10 aa, Staphylococcus
TNKTSEREHV

SEQ ID NO: 1990747 - protein, 4 aa, Staphylococcus
TNKV

SEQ ID NO: 1990748 - protein, 5 aa, Staphylococcus
TNKVG

SEQ ID NO: 1990749 - protein, 6 aa, Staphylococcus
TNKVGN

SEQ ID NO: 1990750 - protein, 13 aa, Staphylococcus
TNLATRQPKAASM

SEQ ID NO: 1990751 - protein, 6 aa, Staphylococcus
TNLDDN

SEQ ID NO: 1990752 - protein, 28 aa, Staphylococcus
TNLNGKTLEVDTSEIKNAPLPNNKVESL

SEQ ID NO: 1990753 - protein, 6 aa, Staphylococcus
TNLNQN

SEQ ID NO: 1990754 - protein, 13 aa, Staphylococcus
TNLPPSRGLGSSA

SEQ ID NO: 1990755 - protein, 14 aa, Staphylococcus
TNLPPSRGLGSSAA

SEQ ID NO: 1990756 - protein, 6 aa, Staphylococcus
TNLSEN

SEQ ID NO: 1990757 - protein, 12 aa, Staphylococcus
TNMKQNSSGVDV

SEQ ID NO: 1990758 - protein, 6 aa, Staphylococcus
TNMSEQ

SEQ ID NO: 1990759 - protein, 6 aa, Staphylococcus
TNNAEV

SEQ ID NO: 1990760 - protein, 12 aa, Staphylococcus
TNNDLKSLKKVK

SEQ ID NO: 1990761 - protein, 17 aa, Staphylococcus
TNNEEAQQLYHQFLKAL

SEQ ID NO: 1990762 - protein, 9 aa, Staphylococcus
TNNEPHMGG

SEQ ID NO: 1990763 - protein, 5 aa, Staphylococcus
TNNEQ

SEQ ID NO: 1990764 - protein, 20 aa, Staphylococcus
TNNESTKYTPKGIHENKDIT

SEQ ID NO: 1990765 - protein, 9 aa, Staphylococcus
TNNETSYDQ

SEQ ID NO: 1990766 - protein, 7 aa, Staphylococcus
TNNGGYT

SEQ ID NO: 1990767 - protein, 6 aa, Staphylococcus
TNNGRI

SEQ ID NO: 1990768 - protein, 8 aa, Staphylococcus
TNNGSLPL

SEQ ID NO: 1990769 - protein, 8 aa, Staphylococcus
TNNGTHPL

SEQ ID NO: 1990770 - protein, 9 aa, Staphylococcus
TNNGTNPLQ

SEQ ID NO: 1990771 - protein, 9 aa, Staphylococcus
TNNGTQSLQ

SEQ ID NO: 1990772 - protein, 9 aa, Staphylococcus
TNNKAVNQQ

SEQ ID NO: 1990773 - protein, 21 aa, Staphylococcus
TNNKESVKKGKNLLEKSGTKI

SEQ ID NO: 1990774 - protein, 8 aa, Staphylococcus
TNNKGLDA

SEQ ID NO: 1990775 - protein, 7 aa, Staphylococcus
TNNLNNN

SEQ ID NO: 1990776 - protein, 4 aa, Staphylococcus
TNNN

SEQ ID NO: 1990777 - protein, 11 aa, Staphylococcus
TNNNGDIGTGD

SEQ ID NO: 1990778 - protein, 8 aa, Staphylococcus
TNNNKKAI

SEQ ID NO: 1990779 - protein, 8 aa, Staphylococcus
TNNPEKVQ

SEQ ID NO: 1990780 - protein, 16 aa, Staphylococcus
TNNPLDEFRKSRASLL

SEQ ID NO: 1990781 - protein, 12 aa, Staphylococcus
TNNQGDIGSGSF

SEQ ID NO: 1990782 - protein, 7 aa, Staphylococcus
TNNQLKN

SEQ ID NO: 1990783 - protein, 5 aa, Staphylococcus
TNNRE

SEQ ID NO: 1990784 - protein, 7 aa, Staphylococcus
TNNRGYK

SEQ ID NO: 1990785 - protein, 7 aa, Staphylococcus
TNNVDNC

SEQ ID NO: 1990786 - protein, 10 aa, Staphylococcus
TNPDDQANGE

SEQ ID NO: 1990787 - protein, 10 aa, Staphylococcus
TNPDSPIGEL

SEQ ID NO: 1990788 - protein, 10 aa, Staphylococcus
TNPDTAESQV

SEQ ID NO: 1990789 - protein, 5 aa, Staphylococcus
TNPEN

SEQ ID NO: 1990790 - protein, 8 aa, Staphylococcus
TNPEREEL

SEQ ID NO: 1990791 - protein, 8 aa, Staphylococcus
TNPESEEF

SEQ ID NO: 1990792 - protein, 4 aa, Staphylococcus
TNPF

SEQ ID NO: 1990793 - protein, 6 aa, Staphylococcus
TNPFTG

SEQ ID NO: 1990794 - protein, 13 aa, Staphylococcus
TNPGGKGANQAVA

SEQ ID NO: 1990795 - protein, 7 aa, Staphylococcus
TNPGVKQ

SEQ ID NO: 1990796 - protein, 8 aa, Staphylococcus
TNPKGEWS

SEQ ID NO: 1990797 - protein, 5 aa, Staphylococcus
TNPKL

SEQ ID NO: 1990798 - protein, 7 aa, Staphylococcus
TNPKRPQ

SEQ ID NO: 1990799 - protein, 12 aa, Staphylococcus
TNPLAGDPENAY

SEQ ID NO: 1990800 - protein, 5 aa, Staphylococcus
TNPLY

SEQ ID NO: 1990801 - protein, 11 aa, Staphylococcus
TNPNTQESKVN

SEQ ID NO: 1990802 - protein, 6 aa, Staphylococcus
TNPQTH

SEQ ID NO: 1990803 - protein, 5 aa, Staphylococcus
TNPRD

SEQ ID NO: 1990804 - protein, 9 aa, Staphylococcus
TNPTSKIGE

SEQ ID NO: 1990805 - protein, 7 aa, Staphylococcus
TNQDANE

SEQ ID NO: 1990806 - protein, 8 aa, Staphylococcus
TNQDGDEI

SEQ ID NO: 1990807 - protein, 8 aa, Staphylococcus
TNQDNMQE

SEQ ID NO: 1990808 - protein, 4 aa, Staphylococcus
TNQE

SEQ ID NO: 1990809 - protein, 9 aa, Staphylococcus
TNQENKSEI

SEQ ID NO: 1990810 - protein, 7 aa, Staphylococcus
TNQFQDG

SEQ ID NO: 1990811 - protein, 8 aa, Staphylococcus
TNQGHAHA

SEQ ID NO: 1990812 - protein, 20 aa, Staphylococcus
TNQGLATSHDMTYEELSSVL

SEQ ID NO: 1990813 - protein, 8 aa, Staphylococcus
TNQHGSRE

SEQ ID NO: 1990814 - protein, 16 aa, Staphylococcus
TNQISKSLNRGKHTTR

SEQ ID NO: 1990815 - protein, 9 aa, Staphylococcus
TNQKLTKKQ

SEQ ID NO: 1990816 - protein, 9 aa, Staphylococcus
TNQLKGDND

SEQ ID NO: 1990817 - protein, 15 aa, Staphylococcus
TNQLNLKDTSSETQY

SEQ ID NO: 1990818 - protein, 8 aa, Staphylococcus
TNQNQQVQ

SEQ ID NO: 1990819 - protein, 4 aa, Staphylococcus
TNQP

SEQ ID NO: 1990820 - protein, 31 aa, Staphylococcus
TNQQINDSITKKTKRQYKQRDVASIEKTPKW

SEQ ID NO: 1990821 - protein, 6 aa, Staphylococcus
TNQSHI

SEQ ID NO: 1990822 - protein, 6 aa, Staphylococcus
TNQSST

SEQ ID NO: 1990823 - protein, 7 aa, Staphylococcus
TNQTEDF

SEQ ID NO: 1990824 - protein, 10 aa, Staphylococcus
TNQTGAKFEL

SEQ ID NO: 1990825 - protein, 7 aa, Staphylococcus
TNQTTDI

SEQ ID NO: 1990826 - protein, 12 aa, Staphylococcus
TNQYQSQTRFKR

SEQ ID NO: 1990827 - protein, 12 aa, Staphylococcus
TNQYQSYTKFKW

SEQ ID NO: 1990828 - protein, 4 aa, Staphylococcus
TNRD

SEQ ID NO: 1990829 - protein, 10 aa, Staphylococcus
TNRDKIDGSL

SEQ ID NO: 1990830 - protein, 4 aa, Staphylococcus
TNRG

SEQ ID NO: 1990831 - protein, 7 aa, Staphylococcus
TNRLNET

SEQ ID NO: 1990832 - protein, 12 aa, Staphylococcus
TNRLSQQLNTET

SEQ ID NO: 1990833 - protein, 6 aa, Staphylococcus
TNRNEL

SEQ ID NO: 1990834 - protein, 12 aa, Staphylococcus
TNRNPEPVNFFS

SEQ ID NO: 1990835 - protein, 10 aa, Staphylococcus
TNRPQDPGTY

SEQ ID NO: 1990836 - protein, 11 aa, Staphylococcus
TNRPSDNFPDV

SEQ ID NO: 1990837 - protein, 7 aa, Staphylococcus
TNRQRGE

SEQ ID NO: 1990838 - protein, 13 aa, Staphylococcus
TNRRETKQPLEYP

SEQ ID NO: 1990839 - protein, 8 aa, Staphylococcus
TNSDDLPN

SEQ ID NO: 1990840 - protein, 6 aa, Staphylococcus
TNSDTV

SEQ ID NO: 1990841 - protein, 15 aa, Staphylococcus
TNSEELDWESDPTSL

SEQ ID NO: 1990842 - protein, 7 aa, Staphylococcus
TNSEVKQ

SEQ ID NO: 1990843 - protein, 6 aa, Staphylococcus
TNSGLN

SEQ ID NO: 1990844 - protein, 9 aa, Staphylococcus
TNSINEKMN

SEQ ID NO: 1990845 - protein, 22 aa, Staphylococcus
TNSKAKERSRYQLTDDKDIVDD

SEQ ID NO: 1990846 - protein, 6 aa, Staphylococcus
TNSKDT

SEQ ID NO: 1990847 - protein, 8 aa, Staphylococcus
TNSKFDRK

SEQ ID NO: 1990848 - protein, 8 aa, Staphylococcus
TNSKIQDT

SEQ ID NO: 1990849 - protein, 7 aa, Staphylococcus
TNSKKDF

SEQ ID NO: 1990850 - protein, 6 aa, Staphylococcus
TNSKQA

SEQ ID NO: 1990851 - protein, 11 aa, Staphylococcus
TNSKSKNRSMY

SEQ ID NO: 1990852 - protein, 11 aa, Staphylococcus
TNSMINTGSAA

SEQ ID NO: 1990853 - protein, 5 aa, Staphylococcus
TNSPD

SEQ ID NO: 1990854 - protein, 4 aa, Staphylococcus
TNSR

SEQ ID NO: 1990855 - protein, 29 aa, Staphylococcus
TNSRRQGITAAKNMAGKDATMPRVSGTSG

SEQ ID NO: 1990856 - protein, 8 aa, Staphylococcus
TNSRRQGV

SEQ ID NO: 1990857 - protein, 11 aa, Staphylococcus
TNSRRQGVTAA

SEQ ID NO: 1990858 - protein, 8 aa, Staphylococcus
TNSRRQGY

SEQ ID NO: 1990859 - protein, 9 aa, Staphylococcus
TNSSSGQPY

SEQ ID NO: 1990860 - protein, 5 aa, Staphylococcus
TNSTV

SEQ ID NO: 1990861 - protein, 4 aa, Staphylococcus
TNSV

SEQ ID NO: 1990862 - protein, 14 aa, Staphylococcus
TNSYGFGEKNQSDG

SEQ ID NO: 1990863 - protein, 12 aa, Staphylococcus
TNSYKKDASQKF

SEQ ID NO: 1990864 - protein, 5 aa, Staphylococcus
TNSYT

SEQ ID NO: 1990865 - protein, 9 aa, Staphylococcus
TNTDYTEKM

SEQ ID NO: 1990866 - protein, 4 aa, Staphylococcus
TNTE

SEQ ID NO: 1990867 - protein, 15 aa, Staphylococcus
TNTFKSGVVQLIYSK

SEQ ID NO: 1990868 - protein, 6 aa, Staphylococcus
TNTGEG

SEQ ID NO: 1990869 - protein, 8 aa, Staphylococcus
TNTGELTV

SEQ ID NO: 1990870 - protein, 7 aa, Staphylococcus
TNTGHAH

SEQ ID NO: 1990871 - protein, 13 aa, Staphylococcus
TNTIGEVAQDNGL

SEQ ID NO: 1990872 - protein, 13 aa, Staphylococcus
TNTIGEVAQNNNL

SEQ ID NO: 1990873 - protein, 12 aa, Staphylococcus
TNTKPEPINFFS

SEQ ID NO: 1990874 - protein, 5 aa, Staphylococcus
TNTNI

SEQ ID NO: 1990875 - protein, 12 aa, Staphylococcus
TNTNPEPVNWFS

SEQ ID NO: 1990876 - protein, 9 aa, Staphylococcus
TNTRGVQAK

SEQ ID NO: 1990877 - protein, 8 aa, Staphylococcus
TNTSGIPI

SEQ ID NO: 1990878 - protein, 6 aa, Staphylococcus
TNTSIG

SEQ ID NO: 1990879 - protein, 10 aa, Staphylococcus
TNTSLPTKES

SEQ ID NO: 1990880 - protein, 6 aa, Staphylococcus
TNTTES

SEQ ID NO: 1990881 - protein, 5 aa, Staphylococcus
TNTVG

SEQ ID NO: 1990882 - protein, 9 aa, Staphylococcus
TNTVQDETE

SEQ ID NO: 1990883 - protein, 4 aa, Staphylococcus
TNTY

SEQ ID NO: 1990884 - protein, 8 aa, Staphylococcus
TNTYYSDT

SEQ ID NO: 1990885 - protein, 4 aa, Staphylococcus
TNVE

SEQ ID NO: 1990886 - protein, 7 aa, Staphylococcus
TNVEDAV

SEQ ID NO: 1990887 - protein, 12 aa, Staphylococcus
TNVEYDQALIEV

SEQ ID NO: 1990888 - protein, 12 aa, Staphylococcus
TNVEYDQVLVKV

SEQ ID NO: 1990889 - protein, 5 aa, Staphylococcus
TNVNG

SEQ ID NO: 1990890 - protein, 13 aa, Staphylococcus
TNVPGSTLSREAD

SEQ ID NO: 1990891 - protein, 6 aa, Staphylococcus
TNVSAG

SEQ ID NO: 1990892 - protein, 15 aa, Staphylococcus
TNVSSIKGTDFKDGK

SEQ ID NO: 1990893 - protein, 5 aa, Staphylococcus
TNVTR

SEQ ID NO: 1990894 - protein, 4 aa, Staphylococcus
TNVY

SEQ ID NO: 1990895 - protein, 4 aa, Staphylococcus
TNWN

SEQ ID NO: 1990896 - protein, 8 aa, Staphylococcus
TNYAVSKS

SEQ ID NO: 1990897 - protein, 5 aa, Staphylococcus
TNYDG

SEQ ID NO: 1990898 - protein, 4 aa, Staphylococcus
TNYG

SEQ ID NO: 1990899 - protein, 12 aa, Staphylococcus
TNYIDNPKTPVI

SEQ ID NO: 1990900 - protein, 4 aa, Staphylococcus
TNYL

SEQ ID NO: 1990901 - protein, 8 aa, Staphylococcus
TNYNANYN

SEQ ID NO: 1990902 - protein, 5 aa, Staphylococcus
TNYQE

SEQ ID NO: 1990903 - protein, 5 aa, Staphylococcus
TNYQT

SEQ ID NO: 1990904 - protein, 12 aa, Staphylococcus
TPAGMDNNQDIP

SEQ ID NO: 1990905 - protein, 8 aa, Staphylococcus
TPAGMNQN

SEQ ID NO: 1990906 - protein, 22 aa, Staphylococcus
TPAIDDKEVNNTFKSILKKDLN

SEQ ID NO: 1990907 - protein, 5 aa, Staphylococcus
TPAKP

SEQ ID NO: 1990908 - protein, 11 aa, Staphylococcus
TPALGGYPKDE

SEQ ID NO: 1990909 - protein, 12 aa, Staphylococcus
TPAMATGGMGDT

SEQ ID NO: 1990910 - protein, 7 aa, Staphylococcus
TPANKDI

SEQ ID NO: 1990911 - protein, 6 aa, Staphylococcus
TPANLN

SEQ ID NO: 1990912 - protein, 9 aa, Staphylococcus
TPAQNGTEI

SEQ ID NO: 1990913 - protein, 9 aa, Staphylococcus
TPAQQDTEI

SEQ ID NO: 1990914 - protein, 17 aa, Staphylococcus
TPASKKRIERREYNTYG

SEQ ID NO: 1990915 - protein, 5 aa, Staphylococcus
TPDEE

SEQ ID NO: 1990916 - protein, 8 aa, Staphylococcus
TPDELKQR

SEQ ID NO: 1990917 - protein, 15 aa, Staphylococcus
TPDETITETEAPYEK

SEQ ID NO: 1990918 - protein, 7 aa, Staphylococcus
TPDEVNK

SEQ ID NO: 1990919 - protein, 4 aa, Staphylococcus
TPDH

SEQ ID NO: 1990920 - protein, 4 aa, Staphylococcus
TPDL

SEQ ID NO: 1990921 - protein, 13 aa, Staphylococcus
TPDLNKKNGYRDR

SEQ ID NO: 1990922 - protein, 18 aa, Staphylococcus
TPDMSDEQFAGQTSGEAM

SEQ ID NO: 1990923 - protein, 12 aa, Staphylococcus
TPDNAQAKPMSI

SEQ ID NO: 1990924 - protein, 9 aa, Staphylococcus
TPDPEKVKR

SEQ ID NO: 1990925 - protein, 5 aa, Staphylococcus
TPDSQ

SEQ ID NO: 1990926 - protein, 7 aa, Staphylococcus
TPDTKLT

SEQ ID NO: 1990927 - protein, 4 aa, Staphylococcus
TPEA

SEQ ID NO: 1990928 - protein, 9 aa, Staphylococcus
TPEANGKRY

SEQ ID NO: 1990929 - protein, 7 aa, Staphylococcus
TPEANNQ

SEQ ID NO: 1990930 - protein, 11 aa, Staphylococcus
TPEEAAQKVAD

SEQ ID NO: 1990931 - protein, 9 aa, Staphylococcus
TPEEAAQRV

SEQ ID NO: 1990932 - protein, 5 aa, Staphylococcus
TPEEL

SEQ ID NO: 1990933 - protein, 4 aa, Staphylococcus
TPEG

SEQ ID NO: 1990934 - protein, 6 aa, Staphylococcus
TPEGAN

SEQ ID NO: 1990935 - protein, 11 aa, Staphylococcus
TPEGEKDTRLP

SEQ ID NO: 1990936 - protein, 5 aa, Staphylococcus
TPEGK

SEQ ID NO: 1990937 - protein, 5 aa, Staphylococcus
TPEGM

SEQ ID NO: 1990938 - protein, 6 aa, Staphylococcus
TPEGNI

SEQ ID NO: 1990939 - protein, 7 aa, Staphylococcus
TPEIDTS

SEQ ID NO: 1990940 - protein, 11 aa, Staphylococcus
TPEIGKGRGPV

SEQ ID NO: 1990941 - protein, 9 aa, Staphylococcus
TPEKIETES

SEQ ID NO: 1990942 - protein, 9 aa, Staphylococcus
TPEKKEEIQ

SEQ ID NO: 1990943 - protein, 9 aa, Staphylococcus
TPEKKNDIQ

SEQ ID NO: 1990944 - protein, 11 aa, Staphylococcus
TPEKNGSEKFQ

SEQ ID NO: 1990945 - protein, 10 aa, Staphylococcus
TPEQGQETFE

SEQ ID NO: 1990946 - protein, 5 aa, Staphylococcus
TPEQM

SEQ ID NO: 1990947 - protein, 8 aa, Staphylococcus
TPEQSNIE

SEQ ID NO: 1990948 - protein, 9 aa, Staphylococcus
TPERFRSGA

SEQ ID NO: 1990949 - protein, 9 aa, Staphylococcus
TPERTAGNK

SEQ ID NO: 1990950 - protein, 9 aa, Staphylococcus
TPERTEGNK

SEQ ID NO: 1990951 - protein, 4 aa, Staphylococcus
TPES

SEQ ID NO: 1990952 - protein, 5 aa, Staphylococcus
TPESD

SEQ ID NO: 1990953 - protein, 8 aa, Staphylococcus
TPESDTSY

SEQ ID NO: 1990954 - protein, 8 aa, Staphylococcus
TPESREAE

SEQ ID NO: 1990955 - protein, 9 aa, Staphylococcus
TPESREAEY

SEQ ID NO: 1990956 - protein, 8 aa, Staphylococcus
TPESVAQQ

SEQ ID NO: 1990957 - protein, 5 aa, Staphylococcus
TPETI

SEQ ID NO: 1990958 - protein, 8 aa, Staphylococcus
TPETLHKD

SEQ ID NO: 1990959 - protein, 10 aa, Staphylococcus
TPETLHSDGD

SEQ ID NO: 1990960 - protein, 10 aa, Staphylococcus
TPETSDLKPE

SEQ ID NO: 1990961 - protein, 4 aa, Staphylococcus
TPFD

SEQ ID NO: 1990962 - protein, 11 aa, Staphylococcus
TPFEEGHESIS

SEQ ID NO: 1990963 - protein, 8 aa, Staphylococcus
TPFEHRDP

SEQ ID NO: 1990964 - protein, 8 aa, Staphylococcus
TPFEHRNP

SEQ ID NO: 1990965 - protein, 7 aa, Staphylococcus
TPFGKYG

SEQ ID NO: 1990966 - protein, 8 aa, Staphylococcus
TPFGKYGG

SEQ ID NO: 1990967 - protein, 10 aa, Staphylococcus
TPFKQKSKEK

SEQ ID NO: 1990968 - protein, 11 aa, Staphylococcus
TPFKQKSKEKV

SEQ ID NO: 1990969 - protein, 13 aa, Staphylococcus
TPFKRKSKEKVNI

SEQ ID NO: 1990970 - protein, 4 aa, Staphylococcus
TPFP

SEQ ID NO: 1990971 - protein, 5 aa, Staphylococcus
TPFPR

SEQ ID NO: 1990972 - protein, 4 aa, Staphylococcus
TPFS

SEQ ID NO: 1990973 - protein, 6 aa, Staphylococcus
TPFTNN

SEQ ID NO: 1990974 - protein, 16 aa, Staphylococcus
TPGDTEDKDGCFSGTG

SEQ ID NO: 1990975 - protein, 6 aa, Staphylococcus
TPGEQK

SEQ ID NO: 1990976 - protein, 5 aa, Staphylococcus
TPGFS

SEQ ID NO: 1990977 - protein, 7 aa, Staphylococcus
TPGGTIY

SEQ ID NO: 1990978 - protein, 8 aa, Staphylococcus
TPGHDKRE

SEQ ID NO: 1990979 - protein, 11 aa, Staphylococcus
TPGHENETSAA

SEQ ID NO: 1990980 - protein, 14 aa, Staphylococcus
TPGLGDAGDRLFGT

SEQ ID NO: 1990981 - protein, 4 aa, Staphylococcus
TPGN

SEQ ID NO: 1990982 - protein, 18 aa, Staphylococcus
TPGNGQFKPIEGANPHIG

SEQ ID NO: 1990983 - protein, 6 aa, Staphylococcus
TPGRQH

SEQ ID NO: 1990984 - protein, 17 aa, Staphylococcus
TPGSAAQEAADQIVDSG

SEQ ID NO: 1990985 - protein, 7 aa, Staphylococcus
TPGSDEA

SEQ ID NO: 1990986 - protein, 23 aa, Staphylococcus
TPGSEAMKGAIKKAKELKEEHGY

SEQ ID NO: 1990987 - protein, 37 aa, Staphylococcus
TPGSEAMKGAIKKAKELKEEHGYYEPQQFENPANPRV

SEQ ID NO: 1990988 - protein, 7 aa, Staphylococcus
TPGSEEA

SEQ ID NO: 1990989 - protein, 13 aa, Staphylococcus
TPGSHGSTFGGNP

SEQ ID NO: 1990990 - protein, 11 aa, Staphylococcus
TPGSVAQSVSD

SEQ ID NO: 1990991 - protein, 13 aa, Staphylococcus
TPGTHGSTFGGNP

SEQ ID NO: 1990992 - protein, 4 aa, Staphylococcus
TPGV

SEQ ID NO: 1990993 - protein, 12 aa, Staphylococcus
TPGYSEKDTPFT

SEQ ID NO: 1990994 - protein, 11 aa, Staphylococcus
TPGYSKSDKRF

SEQ ID NO: 1990995 - protein, 8 aa, Staphylococcus
TPHPEGGY

SEQ ID NO: 1990996 - protein, 9 aa, Staphylococcus
TPHPEGGYY

SEQ ID NO: 1990997 - protein, 21 aa, Staphylococcus
TPHSSDDDDTYRTKEEREALK

SEQ ID NO: 1990998 - protein, 4 aa, Staphylococcus
TPHT

SEQ ID NO: 1990999 - protein, 5 aa, Staphylococcus
TPHTM

SEQ ID NO: 1991000 - protein, 4 aa, Staphylococcus
TPHY

SEQ ID NO: 1991001 - protein, 6 aa, Staphylococcus
TPIEEI

SEQ ID NO: 1991002 - protein, 11 aa, Staphylococcus
TPIEETPDTAD

SEQ ID NO: 1991003 - protein, 9 aa, Staphylococcus
TPIEKEGFE

SEQ ID NO: 1991004 - protein, 5 aa, Staphylococcus
TPIGA

SEQ ID NO: 1991005 - protein, 12 aa, Staphylococcus
TPIGKYKGKLRN

SEQ ID NO: 1991006 - protein, 5 aa, Staphylococcus
TPIGR

SEQ ID NO: 1991007 - protein, 7 aa, Staphylococcus
TPIGRYG

SEQ ID NO: 1991008 - protein, 5 aa, Staphylococcus
TPIGV

SEQ ID NO: 1991009 - protein, 5 aa, Staphylococcus
TPIIE

SEQ ID NO: 1991010 - protein, 14 aa, Staphylococcus
TPIKTTATNNTTTV

SEQ ID NO: 1991011 - protein, 6 aa, Staphylococcus
TPILTT

SEQ ID NO: 1991012 - protein, 7 aa, Staphylococcus
TPIPDDS

SEQ ID NO: 1991013 - protein, 10 aa, Staphylococcus
TPIPNSESKV

SEQ ID NO: 1991014 - protein, 14 aa, Staphylococcus
TPIPNSESKVVKEP

SEQ ID NO: 1991015 - protein, 14 aa, Staphylococcus
TPIPNTESKVVKEP

SEQ ID NO: 1991016 - protein, 7 aa, Staphylococcus
TPIPPIE

SEQ ID NO: 1991017 - protein, 11 aa, Staphylococcus
TPIPRTKPQAK

SEQ ID NO: 1991018 - protein, 5 aa, Staphylococcus
TPITK

SEQ ID NO: 1991019 - protein, 8 aa, Staphylococcus
TPITKANY

SEQ ID NO: 1991020 - protein, 9 aa, Staphylococcus
TPITKANYQ

SEQ ID NO: 1991021 - protein, 8 aa, Staphylococcus
TPITKQNY

SEQ ID NO: 1991022 - protein, 16 aa, Staphylococcus
TPKEVKETKKGLEDGT

SEQ ID NO: 1991023 - protein, 4 aa, Staphylococcus
TPKI

SEQ ID NO: 1991024 - protein, 10 aa, Staphylococcus
TPKLTGNEKH

SEQ ID NO: 1991025 - protein, 7 aa, Staphylococcus
TPKVKPE

SEQ ID NO: 1991026 - protein, 8 aa, Staphylococcus
TPKYEKKL

SEQ ID NO: 1991027 - protein, 4 aa, Staphylococcus
TPLA

SEQ ID NO: 1991028 - protein, 14 aa, Staphylococcus
TPLAHDSKQELGSE

SEQ ID NO: 1991029 - protein, 6 aa, Staphylococcus
TPLEQG

SEQ ID NO: 1991030 - protein, 11 aa, Staphylococcus
TPLEQTPDKAD

SEQ ID NO: 1991031 - protein, 4 aa, Staphylococcus
TPLG

SEQ ID NO: 1991032 - protein, 12 aa, Staphylococcus
TPLIAPGSDGIN

SEQ ID NO: 1991033 - protein, 9 aa, Staphylococcus
TPLKDRDQS

SEQ ID NO: 1991034 - protein, 9 aa, Staphylococcus
TPLKDRDTS

SEQ ID NO: 1991035 - protein, 5 aa, Staphylococcus
TPLKE

SEQ ID NO: 1991036 - protein, 8 aa, Staphylococcus
TPLKNKNT

SEQ ID NO: 1991037 - protein, 9 aa, Staphylococcus
TPLKNRDES

SEQ ID NO: 1991038 - protein, 12 aa, Staphylococcus
TPLNKRTEEYKN

SEQ ID NO: 1991039 - protein, 5 aa, Staphylococcus
TPLNT

SEQ ID NO: 1991040 - protein, 5 aa, Staphylococcus
TPLQT

SEQ ID NO: 1991041 - protein, 9 aa, Staphylococcus
TPLQTKQGI

SEQ ID NO: 1991042 - protein, 10 aa, Staphylococcus
TPLSDKEKQL

SEQ ID NO: 1991043 - protein, 5 aa, Staphylococcus
TPLSI

SEQ ID NO: 1991044 - protein, 11 aa, Staphylococcus
TPLSKEPPDFL

SEQ ID NO: 1991045 - protein, 4 aa, Staphylococcus
TPLT

SEQ ID NO: 1991046 - protein, 6 aa, Staphylococcus
TPLTEG

SEQ ID NO: 1991047 - protein, 4 aa, Staphylococcus
TPMA

SEQ ID NO: 1991048 - protein, 8 aa, Staphylococcus
TPMAPSGG

SEQ ID NO: 1991049 - protein, 12 aa, Staphylococcus
TPMGGSADSYIP

SEQ ID NO: 1991050 - protein, 11 aa, Staphylococcus
TPMNNGDKYKR

SEQ ID NO: 1991051 - protein, 5 aa, Staphylococcus
TPMPP

SEQ ID NO: 1991052 - protein, 5 aa, Staphylococcus
TPMPR

SEQ ID NO: 1991053 - protein, 20 aa, Staphylococcus
TPMTEGNDFGGRKKLDTRDI

SEQ ID NO: 1991054 - protein, 20 aa, Staphylococcus
TPMTEGYDFGDRKKLDPENI

SEQ ID NO: 1991055 - protein, 19 aa, Staphylococcus
TPMTEQSDFGGRKKLETYD

SEQ ID NO: 1991056 - protein, 20 aa, Staphylococcus
TPMTERSDFGGRKKLDPENI

SEQ ID NO: 1991057 - protein, 8 aa, Staphylococcus
TPNAETAR

SEQ ID NO: 1991058 - protein, 8 aa, Staphylococcus
TPNDYRSL

SEQ ID NO: 1991059 - protein, 8 aa, Staphylococcus
TPNESESE

SEQ ID NO: 1991060 - protein, 10 aa, Staphylococcus
TPNETESENM

SEQ ID NO: 1991061 - protein, 9 aa, Staphylococcus
TPNEYRSCN

SEQ ID NO: 1991062 - protein, 7 aa, Staphylococcus
TPNEYRT

SEQ ID NO: 1991063 - protein, 9 aa, Staphylococcus
TPNHQTFNQ

SEQ ID NO: 1991064 - protein, 8 aa, Staphylococcus
TPNKVQKK

SEQ ID NO: 1991065 - protein, 6 aa, Staphylococcus
TPNNNK

SEQ ID NO: 1991066 - protein, 11 aa, Staphylococcus
TPNQLEQTETV

SEQ ID NO: 1991067 - protein, 4 aa, Staphylococcus
TPNY

SEQ ID NO: 1991068 - protein, 9 aa, Staphylococcus
TPPDYDSET

SEQ ID NO: 1991069 - protein, 5 aa, Staphylococcus
TPPEN

SEQ ID NO: 1991070 - protein, 11 aa, Staphylococcus
TPPEPSETISE

SEQ ID NO: 1991071 - protein, 12 aa, Staphylococcus
TPPEVATRRTHG

SEQ ID NO: 1991072 - protein, 12 aa, Staphylococcus
TPPEVTTRRTHG

SEQ ID NO: 1991073 - protein, 6 aa, Staphylococcus
TPPGDF

SEQ ID NO: 1991074 - protein, 6 aa, Staphylococcus
TPPGQF

SEQ ID NO: 1991075 - protein, 6 aa, Staphylococcus
TPPGTF

SEQ ID NO: 1991076 - protein, 9 aa, Staphylococcus
TPPGYDSES

SEQ ID NO: 1991077 - protein, 9 aa, Staphylococcus
TPPGYNSEQ

SEQ ID NO: 1991078 - protein, 9 aa, Staphylococcus
TPPHDPSQF

SEQ ID NO: 1991079 - protein, 6 aa, Staphylococcus
TPPKEL

SEQ ID NO: 1991080 - protein, 4 aa, Staphylococcus
TPPL

SEQ ID NO: 1991081 - protein, 7 aa, Staphylococcus
TPPNHSD

SEQ ID NO: 1991082 - protein, 15 aa, Staphylococcus
TPPNYEQLKDANTLG

SEQ ID NO: 1991083 - protein, 4 aa, Staphylococcus
TPPR

SEQ ID NO: 1991084 - protein, 5 aa, Staphylococcus
TPPRH

SEQ ID NO: 1991085 - protein, 16 aa, Staphylococcus
TPPSDEAYEYGKQLGE

SEQ ID NO: 1991086 - protein, 7 aa, Staphylococcus
TPPVDGA

SEQ ID NO: 1991087 - protein, 5 aa, Staphylococcus
TPPYD

SEQ ID NO: 1991088 - protein, 4 aa, Staphylococcus
TPQA

SEQ ID NO: 1991089 - protein, 5 aa, Staphylococcus
TPQDR

SEQ ID NO: 1991090 - protein, 4 aa, Staphylococcus
TPQE

SEQ ID NO: 1991091 - protein, 6 aa, Staphylococcus
TPQEGR

SEQ ID NO: 1991092 - protein, 9 aa, Staphylococcus
TPQPPRSYY

SEQ ID NO: 1991093 - protein, 12 aa, Staphylococcus
TPQPQAAYNTSK

SEQ ID NO: 1991094 - protein, 13 aa, Staphylococcus
TPQPQAAYNTSKG

SEQ ID NO: 1991095 - protein, 4 aa, Staphylococcus
TPQR

SEQ ID NO: 1991096 - protein, 9 aa, Staphylococcus
TPQSDKQLS

SEQ ID NO: 1991097 - protein, 5 aa, Staphylococcus
TPQSP

SEQ ID NO: 1991098 - protein, 17 aa, Staphylococcus
TPRFEENASQDGRATAD

SEQ ID NO: 1991099 - protein, 17 aa, Staphylococcus
TPRFEENKSQDGRSTAD

SEQ ID NO: 1991100 - protein, 6 aa, Staphylococcus
TPRKEY

SEQ ID NO: 1991101 - protein, 12 aa, Staphylococcus
TPRMEGANEEIR

SEQ ID NO: 1991102 - protein, 13 aa, Staphylococcus
TPRPPDTEAPSHP

SEQ ID NO: 1991103 - protein, 18 aa, Staphylococcus
TPRTNKTFEADVQEGGTY

SEQ ID NO: 1991104 - protein, 8 aa, Staphylococcus
TPSAHTAR

SEQ ID NO: 1991105 - protein, 13 aa, Staphylococcus
TPSASYGGTGQSY

SEQ ID NO: 1991106 - protein, 4 aa, Staphylococcus
TPSE

SEQ ID NO: 1991107 - protein, 8 aa, Staphylococcus
TPSEETAR

SEQ ID NO: 1991108 - protein, 8 aa, Staphylococcus
TPSEKTAR

SEQ ID NO: 1991109 - protein, 20 aa, Staphylococcus
TPSGKYAKTEYKTLSSHHSA

SEQ ID NO: 1991110 - protein, 14 aa, Staphylococcus
TPSHPHDAPRSHDE

SEQ ID NO: 1991111 - protein, 8 aa, Staphylococcus
TPSITEDR

SEQ ID NO: 1991112 - protein, 5 aa, Staphylococcus
TPSKA

SEQ ID NO: 1991113 - protein, 9 aa, Staphylococcus
TPSKAAHPN

SEQ ID NO: 1991114 - protein, 13 aa, Staphylococcus
TPSKPNLPPRSQV

SEQ ID NO: 1991115 - protein, 15 aa, Staphylococcus
TPSKPNQWPRSKAEI

SEQ ID NO: 1991116 - protein, 8 aa, Staphylococcus
TPSPETAR

SEQ ID NO: 1991117 - protein, 13 aa, Staphylococcus
TPSQSYGGTGKTY

SEQ ID NO: 1991118 - protein, 7 aa, Staphylococcus
TPSQYPG

SEQ ID NO: 1991119 - protein, 13 aa, Staphylococcus
TPSRRNEGGSAII

SEQ ID NO: 1991120 - protein, 6 aa, Staphylococcus
TPSSEV

SEQ ID NO: 1991121 - protein, 21 aa, Staphylococcus
TPSSGELSISGTNIKDNIEEY

SEQ ID NO: 1991122 - protein, 20 aa, Staphylococcus
TPSSGSVNINGQIKQTPSPD

SEQ ID NO: 1991123 - protein, 11 aa, Staphylococcus
TPSTINANSQH

SEQ ID NO: 1991124 - protein, 7 aa, Staphylococcus
TPSYAGV

SEQ ID NO: 1991125 - protein, 7 aa, Staphylococcus
TPSYIDS

SEQ ID NO: 1991126 - protein, 12 aa, Staphylococcus
TPTAGSSGTIPG

SEQ ID NO: 1991127 - protein, 4 aa, Staphylococcus
TPTE

SEQ ID NO: 1991128 - protein, 9 aa, Staphylococcus
TPTEGTIEV

SEQ ID NO: 1991129 - protein, 7 aa, Staphylococcus
TPTENSI

SEQ ID NO: 1991130 - protein, 8 aa, Staphylococcus
TPTETTVR

SEQ ID NO: 1991131 - protein, 5 aa, Staphylococcus
TPTGL

SEQ ID NO: 1991132 - protein, 4 aa, Staphylococcus
TPTI

SEQ ID NO: 1991133 - protein, 4 aa, Staphylococcus
TPTK

SEQ ID NO: 1991134 - protein, 4 aa, Staphylococcus
TPTL

SEQ ID NO: 1991135 - protein, 9 aa, Staphylococcus
TPTLQQNND

SEQ ID NO: 1991136 - protein, 7 aa, Staphylococcus
TPTQSEL

SEQ ID NO: 1991137 - protein, 14 aa, Staphylococcus
TPTRINDLSKDGTL

SEQ ID NO: 1991138 - protein, 7 aa, Staphylococcus
TPTSELP

SEQ ID NO: 1991139 - protein, 8 aa, Staphylococcus
TPTSGSID

SEQ ID NO: 1991140 - protein, 21 aa, Staphylococcus
TPTSGSLSISNTNITDDIETY

SEQ ID NO: 1991141 - protein, 5 aa, Staphylococcus
TPTTF

SEQ ID NO: 1991142 - protein, 11 aa, Staphylococcus
TPTTFNNPRRM

SEQ ID NO: 1991143 - protein, 6 aa, Staphylococcus
TPTTMG

SEQ ID NO: 1991144 - protein, 5 aa, Staphylococcus
TPTVE

SEQ ID NO: 1991145 - protein, 13 aa, Staphylococcus
TPTYPLTSNPDDV

SEQ ID NO: 1991146 - protein, 11 aa, Staphylococcus
TPVDDTSHDDE

SEQ ID NO: 1991147 - protein, 7 aa, Staphylococcus
TPVEKDD

SEQ ID NO: 1991148 - protein, 14 aa, Staphylococcus
TPVERPEIQETTAL

SEQ ID NO: 1991149 - protein, 5 aa, Staphylococcus
TPVGK

SEQ ID NO: 1991150 - protein, 6 aa, Staphylococcus
TPVGRN

SEQ ID NO: 1991151 - protein, 4 aa, Staphylococcus
TPVI

SEQ ID NO: 1991152 - protein, 15 aa, Staphylococcus
TPVKEIDGEDPIKAE

SEQ ID NO: 1991153 - protein, 15 aa, Staphylococcus
TPVKEIDGEDPIKAN

SEQ ID NO: 1991154 - protein, 5 aa, Staphylococcus
TPVNG

SEQ ID NO: 1991155 - protein, 6 aa, Staphylococcus
TPVSDE

SEQ ID NO: 1991156 - protein, 10 aa, Staphylococcus
TPVSGGDVNE

SEQ ID NO: 1991157 - protein, 12 aa, Staphylococcus
TPWRANSKGFTD

SEQ ID NO: 1991158 - protein, 4 aa, Staphylococcus
TPYE

SEQ ID NO: 1991159 - protein, 11 aa, Staphylococcus
TPYEDESQQET

SEQ ID NO: 1991160 - protein, 5 aa, Staphylococcus
TPYEE

SEQ ID NO: 1991161 - protein, 5 aa, Staphylococcus
TPYKD

SEQ ID NO: 1991162 - protein, 5 aa, Staphylococcus
TPYKE

SEQ ID NO: 1991163 - protein, 11 aa, Staphylococcus
TPYKTSYSEED

SEQ ID NO: 1991164 - protein, 7 aa, Staphylococcus
TPYNEER

SEQ ID NO: 1991165 - protein, 4 aa, Staphylococcus
TPYP

SEQ ID NO: 1991166 - protein, 13 aa, Staphylococcus
TPYRKSDAGLSGR

SEQ ID NO: 1991167 - protein, 5 aa, Staphylococcus
TPYTM

SEQ ID NO: 1991168 - protein, 7 aa, Staphylococcus
TPYTQKP

SEQ ID NO: 1991169 - protein, 7 aa, Staphylococcus
TQAARRN

SEQ ID NO: 1991170 - protein, 10 aa, Staphylococcus
TQAAYEQGED

SEQ ID NO: 1991171 - protein, 6 aa, Staphylococcus
TQADSE

SEQ ID NO: 1991172 - protein, 6 aa, Staphylococcus
TQADSY

SEQ ID NO: 1991173 - protein, 7 aa, Staphylococcus
TQAGDIS

SEQ ID NO: 1991174 - protein, 4 aa, Staphylococcus
TQAK

SEQ ID NO: 1991175 - protein, 5 aa, Staphylococcus
TQAKE

SEQ ID NO: 1991176 - protein, 7 aa, Staphylococcus
TQANATK

SEQ ID NO: 1991177 - protein, 5 aa, Staphylococcus
TQANF

SEQ ID NO: 1991178 - protein, 5 aa, Staphylococcus
TQAPN

SEQ ID NO: 1991179 - protein, 17 aa, Staphylococcus
TQARDEVGKSIQAIEQS

SEQ ID NO: 1991180 - protein, 7 aa, Staphylococcus
TQARDKA

SEQ ID NO: 1991181 - protein, 6 aa, Staphylococcus
TQATFK

SEQ ID NO: 1991182 - protein, 9 aa, Staphylococcus
TQAVSEEAQ

SEQ ID NO: 1991183 - protein, 4 aa, Staphylococcus
TQCN

SEQ ID NO: 1991184 - protein, 16 aa, Staphylococcus
TQDDEKELVFENGNWS

SEQ ID NO: 1991185 - protein, 6 aa, Staphylococcus
TQDDSL

SEQ ID NO: 1991186 - protein, 4 aa, Staphylococcus
TQDE

SEQ ID NO: 1991187 - protein, 6 aa, Staphylococcus
TQDENA

SEQ ID NO: 1991188 - protein, 6 aa, Staphylococcus
TQDESL

SEQ ID NO: 1991189 - protein, 6 aa, Staphylococcus
TQDESM

SEQ ID NO: 1991190 - protein, 5 aa, Staphylococcus
TQDEY

SEQ ID NO: 1991191 - protein, 4 aa, Staphylococcus
TQDG

SEQ ID NO: 1991192 - protein, 16 aa, Staphylococcus
TQDGKEEIVFKDGNWA

SEQ ID NO: 1991193 - protein, 13 aa, Staphylococcus
TQDIPKASEYQGL

SEQ ID NO: 1991194 - protein, 16 aa, Staphylococcus
TQDIRDALRKQNWYYD

SEQ ID NO: 1991195 - protein, 15 aa, Staphylococcus
TQDKAEILNLLKETD

SEQ ID NO: 1991196 - protein, 16 aa, Staphylococcus
TQDKFAKLGNSQGKEV

SEQ ID NO: 1991197 - protein, 6 aa, Staphylococcus
TQDNDE

SEQ ID NO: 1991198 - protein, 9 aa, Staphylococcus
TQDNQREIQ

SEQ ID NO: 1991199 - protein, 7 aa, Staphylococcus
TQDPTEI

SEQ ID NO: 1991200 - protein, 5 aa, Staphylococcus
TQDQP

SEQ ID NO: 1991201 - protein, 6 aa, Staphylococcus
TQDQPY

SEQ ID NO: 1991202 - protein, 12 aa, Staphylococcus
TQDVSEESARNA

SEQ ID NO: 1991203 - protein, 7 aa, Staphylococcus
TQEEEQQ

SEQ ID NO: 1991204 - protein, 5 aa, Staphylococcus
TQEEL

SEQ ID NO: 1991205 - protein, 13 aa, Staphylococcus
TQEELAERTDLSK

SEQ ID NO: 1991206 - protein, 13 aa, Staphylococcus
TQEELAERTDLTK

SEQ ID NO: 1991207 - protein, 7 aa, Staphylococcus
TQEEYAE

SEQ ID NO: 1991208 - protein, 15 aa, Staphylococcus
TQEFKPSNYESEQEM

SEQ ID NO: 1991209 - protein, 6 aa, Staphylococcus
TQEGPK

SEQ ID NO: 1991210 - protein, 6 aa, Staphylococcus
TQEHGH

SEQ ID NO: 1991211 - protein, 6 aa, Staphylococcus
TQEILG

SEQ ID NO: 1991212 - protein, 4 aa, Staphylococcus
TQEQ

SEQ ID NO: 1991213 - protein, 14 aa, Staphylococcus
TQEQPERGKIYDRN

SEQ ID NO: 1991214 - protein, 7 aa, Staphylococcus
TQEQSHT

SEQ ID NO: 1991215 - protein, 8 aa, Staphylococcus
TQERDHAD

SEQ ID NO: 1991216 - protein, 15 aa, Staphylococcus
TQESINEKESRRDQM

SEQ ID NO: 1991217 - protein, 5 aa, Staphylococcus
TQETE

SEQ ID NO: 1991218 - protein, 6 aa, Staphylococcus
TQETGA

SEQ ID NO: 1991219 - protein, 4 aa, Staphylococcus
TQFE

SEQ ID NO: 1991220 - protein, 5 aa, Staphylococcus
TQFKA

SEQ ID NO: 1991221 - protein, 25 aa, Staphylococcus
TQFSGNTDNAKKATTDDEPSFENSK

SEQ ID NO: 1991222 - protein, 11 aa, Staphylococcus
TQFSPKSIKDL

SEQ ID NO: 1991223 - protein, 6 aa, Staphylococcus
TQGESV

SEQ ID NO: 1991224 - protein, 4 aa, Staphylococcus
TQGH

SEQ ID NO: 1991225 - protein, 9 aa, Staphylococcus
TQGKDKLRN

SEQ ID NO: 1991226 - protein, 18 aa, Staphylococcus
TQGNQPTEEQNNQPKQKT

SEQ ID NO: 1991227 - protein, 18 aa, Staphylococcus
TQGNQQTKEQNQQSNQKT

SEQ ID NO: 1991228 - protein, 6 aa, Staphylococcus
TQGQLR

SEQ ID NO: 1991229 - protein, 14 aa, Staphylococcus
TQGTAEKLKEDNIP

SEQ ID NO: 1991230 - protein, 9 aa, Staphylococcus
TQGTAQKLE

SEQ ID NO: 1991231 - protein, 16 aa, Staphylococcus
TQGTARKLAENNIPSE

SEQ ID NO: 1991232 - protein, 5 aa, Staphylococcus
TQGVG

SEQ ID NO: 1991233 - protein, 9 aa, Staphylococcus
TQHAEKSVD

SEQ ID NO: 1991234 - protein, 7 aa, Staphylococcus
TQHDNTK

SEQ ID NO: 1991235 - protein, 8 aa, Staphylococcus
TQHEEYQN

SEQ ID NO: 1991236 - protein, 8 aa, Staphylococcus
TQHFPTDK

SEQ ID NO: 1991237 - protein, 15 aa, Staphylococcus
TQHHYESDAEIPAEG

SEQ ID NO: 1991238 - protein, 9 aa, Staphylococcus
TQHNDKPIE

SEQ ID NO: 1991239 - protein, 17 aa, Staphylococcus
TQHPDFSKQKSDATKDY

SEQ ID NO: 1991240 - protein, 25 aa, Staphylococcus
TQHPEYRTADSPTVRVGGSAQSTFE

SEQ ID NO: 1991241 - protein, 8 aa, Staphylococcus
TQHPNKVD

SEQ ID NO: 1991242 - protein, 16 aa, Staphylococcus
TQHQKDPSARPELNDE

SEQ ID NO: 1991243 - protein, 16 aa, Staphylococcus
TQHQKDQSANPKLNDE

SEQ ID NO: 1991244 - protein, 5 aa, Staphylococcus
TQHTM

SEQ ID NO: 1991245 - protein, 4 aa, Staphylococcus
TQIA

SEQ ID NO: 1991246 - protein, 7 aa, Staphylococcus
TQIDPNE

SEQ ID NO: 1991247 - protein, 10 aa, Staphylococcus
TQIEKGKDFE

SEQ ID NO: 1991248 - protein, 4 aa, Staphylococcus
TQIG

SEQ ID NO: 1991249 - protein, 4 aa, Staphylococcus
TQIK

SEQ ID NO: 1991250 - protein, 6 aa, Staphylococcus
TQIPDG

SEQ ID NO: 1991251 - protein, 6 aa, Staphylococcus
TQIRQP

SEQ ID NO: 1991252 - protein, 6 aa, Staphylococcus
TQISKQ

SEQ ID NO: 1991253 - protein, 17 aa, Staphylococcus
TQITEDTVTYEKDRRTI

SEQ ID NO: 1991254 - protein, 19 aa, Staphylococcus
TQITEENVTYEKDGKTITI

SEQ ID NO: 1991255 - protein, 8 aa, Staphylococcus
TQITYDEY

SEQ ID NO: 1991256 - protein, 11 aa, Staphylococcus
TQKAPEGESYA

SEQ ID NO: 1991257 - protein, 11 aa, Staphylococcus
TQKAPEGESYQ

SEQ ID NO: 1991258 - protein, 4 aa, Staphylococcus
TQKD

SEQ ID NO: 1991259 - protein, 14 aa, Staphylococcus
TQKDKVSLTIINPY

SEQ ID NO: 1991260 - protein, 10 aa, Staphylococcus
TQKDLNDKLG

SEQ ID NO: 1991261 - protein, 14 aa, Staphylococcus
TQKETNGYHGSTTF

SEQ ID NO: 1991262 - protein, 15 aa, Staphylococcus
TQKEVATRLGKSRPY

SEQ ID NO: 1991263 - protein, 13 aa, Staphylococcus
TQKFTDHSEYEGI

SEQ ID NO: 1991264 - protein, 12 aa, Staphylococcus
TQKKHDAIAIFD

SEQ ID NO: 1991265 - protein, 6 aa, Staphylococcus
TQKNDF

SEQ ID NO: 1991266 - protein, 4 aa, Staphylococcus
TQKP

SEQ ID NO: 1991267 - protein, 20 aa, Staphylococcus
TQKPEREAIPINRGDLSRFI

SEQ ID NO: 1991268 - protein, 8 aa, Staphylococcus
TQKPIGEA

SEQ ID NO: 1991269 - protein, 7 aa, Staphylococcus
TQKPIIA

SEQ ID NO: 1991270 - protein, 20 aa, Staphylococcus
TQKPPGEALPINRGDLSRFI

SEQ ID NO: 1991271 - protein, 20 aa, Staphylococcus
TQKPQQEAIPLNRGDLSRFI

SEQ ID NO: 1991272 - protein, 20 aa, Staphylococcus
TQKPRSEALPINRGDLSRFI

SEQ ID NO: 1991273 - protein, 20 aa, Staphylococcus
TQKPRSETLPINRGDLSRFI

SEQ ID NO: 1991274 - protein, 9 aa, Staphylococcus
TQKPYGETL

SEQ ID NO: 1991275 - protein, 6 aa, Staphylococcus
TQKRDL

SEQ ID NO: 1991276 - protein, 11 aa, Staphylococcus
TQKRGAGNEIQ

SEQ ID NO: 1991277 - protein, 4 aa, Staphylococcus
TQKS

SEQ ID NO: 1991278 - protein, 5 aa, Staphylococcus
TQKSN

SEQ ID NO: 1991279 - protein, 7 aa, Staphylococcus
TQKSNQV

SEQ ID NO: 1991280 - protein, 6 aa, Staphylococcus
TQKTQS

SEQ ID NO: 1991281 - protein, 9 aa, Staphylococcus
TQKTYDEER

SEQ ID NO: 1991282 - protein, 6 aa, Staphylococcus
TQKVGN

SEQ ID NO: 1991283 - protein, 5 aa, Staphylococcus
TQLAA

SEQ ID NO: 1991284 - protein, 4 aa, Staphylococcus
TQLD

SEQ ID NO: 1991285 - protein, 6 aa, Staphylococcus
TQLDYA

SEQ ID NO: 1991286 - protein, 4 aa, Staphylococcus
TQLE

SEQ ID NO: 1991287 - protein, 7 aa, Staphylococcus
TQLGEGG

SEQ ID NO: 1991288 - protein, 7 aa, Staphylococcus
TQLGESG

SEQ ID NO: 1991289 - protein, 5 aa, Staphylococcus
TQLPE

SEQ ID NO: 1991290 - protein, 16 aa, Staphylococcus
TQLPQGMRARTKYQNT

SEQ ID NO: 1991291 - protein, 8 aa, Staphylococcus
TQLQESDY

SEQ ID NO: 1991292 - protein, 8 aa, Staphylococcus
TQLQGTDY

SEQ ID NO: 1991293 - protein, 7 aa, Staphylococcus
TQLSPTP

SEQ ID NO: 1991294 - protein, 14 aa, Staphylococcus
TQLSRDSFNPPQIK

SEQ ID NO: 1991295 - protein, 10 aa, Staphylococcus
TQLTASAGVS

SEQ ID NO: 1991296 - protein, 7 aa, Staphylococcus
TQLTESQ

SEQ ID NO: 1991297 - protein, 10 aa, Staphylococcus
TQLTGQYGGY

SEQ ID NO: 1991298 - protein, 12 aa, Staphylococcus
TQLTKSRYAERS

SEQ ID NO: 1991299 - protein, 20 aa, Staphylococcus
TQLTTKELKARVKEKFEDEN

SEQ ID NO: 1991300 - protein, 14 aa, Staphylococcus
TQLTTKIDDNTASI

SEQ ID NO: 1991301 - protein, 6 aa, Staphylococcus
TQLTTN

SEQ ID NO: 1991302 - protein, 8 aa, Staphylococcus
TQNDENPE

SEQ ID NO: 1991303 - protein, 5 aa, Staphylococcus
TQNDI

SEQ ID NO: 1991304 - protein, 14 aa, Staphylococcus
TQNDKVQASQKEAL

SEQ ID NO: 1991305 - protein, 7 aa, Staphylococcus
TQNEKNY

SEQ ID NO: 1991306 - protein, 8 aa, Staphylococcus
TQNEQGQL

SEQ ID NO: 1991307 - protein, 6 aa, Staphylococcus
TQNESL

SEQ ID NO: 1991308 - protein, 5 aa, Staphylococcus
TQNFD

SEQ ID NO: 1991309 - protein, 4 aa, Staphylococcus
TQNG

SEQ ID NO: 1991310 - protein, 6 aa, Staphylococcus
TQNGKN

SEQ ID NO: 1991311 - protein, 8 aa, Staphylococcus
TQNGRDIK

SEQ ID NO: 1991312 - protein, 20 aa, Staphylococcus
TQNGRPIRLTGQDSERGTFS

SEQ ID NO: 1991313 - protein, 5 aa, Staphylococcus
TQNKQ

SEQ ID NO: 1991314 - protein, 8 aa, Staphylococcus
TQNKTRTC

SEQ ID NO: 1991315 - protein, 5 aa, Staphylococcus
TQNLE

SEQ ID NO: 1991316 - protein, 10 aa, Staphylococcus
TQNPFKNNQT

SEQ ID NO: 1991317 - protein, 11 aa, Staphylococcus
TQNPYGDGNAS

SEQ ID NO: 1991318 - protein, 5 aa, Staphylococcus
TQNQC

SEQ ID NO: 1991319 - protein, 7 aa, Staphylococcus
TQNQNGV

SEQ ID NO: 1991320 - protein, 5 aa, Staphylococcus
TQNQT

SEQ ID NO: 1991321 - protein, 5 aa, Staphylococcus
TQNRI

SEQ ID NO: 1991322 - protein, 7 aa, Staphylococcus
TQNSAGS

SEQ ID NO: 1991323 - protein, 4 aa, Staphylococcus
TQNT

SEQ ID NO: 1991324 - protein, 5 aa, Staphylococcus
TQNTF

SEQ ID NO: 1991325 - protein, 6 aa, Staphylococcus
TQNYSD

SEQ ID NO: 1991326 - protein, 4 aa, Staphylococcus
TQPE

SEQ ID NO: 1991327 - protein, 9 aa, Staphylococcus
TQPEASREV

SEQ ID NO: 1991328 - protein, 14 aa, Staphylococcus
TQPEEMTGESLIKH

SEQ ID NO: 1991329 - protein, 8 aa, Staphylococcus
TQPERQEL

SEQ ID NO: 1991330 - protein, 5 aa, Staphylococcus
TQPFG

SEQ ID NO: 1991331 - protein, 5 aa, Staphylococcus
TQPHT

SEQ ID NO: 1991332 - protein, 4 aa, Staphylococcus
TQPI

SEQ ID NO: 1991333 - protein, 15 aa, Staphylococcus
TQPPHVNVNQITIRP

SEQ ID NO: 1991334 - protein, 8 aa, Staphylococcus
TQPSDRSE

SEQ ID NO: 1991335 - protein, 11 aa, Staphylococcus
TQPVAEEDWEN

SEQ ID NO: 1991336 - protein, 4 aa, Staphylococcus
TQQA

SEQ ID NO: 1991337 - protein, 18 aa, Staphylococcus
TQQAEKWYQDATESELEQ

SEQ ID NO: 1991338 - protein, 5 aa, Staphylococcus
TQQDI

SEQ ID NO: 1991339 - protein, 11 aa, Staphylococcus
TQQDQLNYEQQ

SEQ ID NO: 1991340 - protein, 15 aa, Staphylococcus
TQQDVAQRLSKSRPY

SEQ ID NO: 1991341 - protein, 4 aa, Staphylococcus
TQQE

SEQ ID NO: 1991342 - protein, 12 aa, Staphylococcus
TQQEAETAFGNG

SEQ ID NO: 1991343 - protein, 12 aa, Staphylococcus
TQQEAETAFGNN

SEQ ID NO: 1991344 - protein, 5 aa, Staphylococcus
TQQEL

SEQ ID NO: 1991345 - protein, 5 aa, Staphylococcus
TQQEV

SEQ ID NO: 1991346 - protein, 6 aa, Staphylococcus
TQQEVD

SEQ ID NO: 1991347 - protein, 4 aa, Staphylococcus
TQQF

SEQ ID NO: 1991348 - protein, 27 aa, Staphylococcus
TQQGIENLQPDEAARTIAEDRESSQRD

SEQ ID NO: 1991349 - protein, 4 aa, Staphylococcus
TQQH

SEQ ID NO: 1991350 - protein, 4 aa, Staphylococcus
TQQK

SEQ ID NO: 1991351 - protein, 15 aa, Staphylococcus
TQQKVAERLGKSRPY

SEQ ID NO: 1991352 - protein, 12 aa, Staphylococcus
TQQLNTKLSNSK

SEQ ID NO: 1991353 - protein, 8 aa, Staphylococcus
TQQLREQG

SEQ ID NO: 1991354 - protein, 4 aa, Staphylococcus
TQQN

SEQ ID NO: 1991355 - protein, 6 aa, Staphylococcus
TQQPFD

SEQ ID NO: 1991356 - protein, 4 aa, Staphylococcus
TQQQ

SEQ ID NO: 1991357 - protein, 5 aa, Staphylococcus
TQQQI

SEQ ID NO: 1991358 - protein, 5 aa, Staphylococcus
TQQSA

SEQ ID NO: 1991359 - protein, 10 aa, Staphylococcus
TQQSLSNTKA

SEQ ID NO: 1991360 - protein, 7 aa, Staphylococcus
TQQSLTN

SEQ ID NO: 1991361 - protein, 9 aa, Staphylococcus
TQQSSDTTY

SEQ ID NO: 1991362 - protein, 4 aa, Staphylococcus
TQQT

SEQ ID NO: 1991363 - protein, 18 aa, Staphylococcus
TQQTCPKCDGTGQEFEEP

SEQ ID NO: 1991364 - protein, 24 aa, Staphylococcus
TQQTQQTQQDNQEANGYDPNNPYM

SEQ ID NO: 1991365 - protein, 5 aa, Staphylococcus
TQQTY

SEQ ID NO: 1991366 - protein, 14 aa, Staphylococcus
TQQYGAPSSSLEKG

SEQ ID NO: 1991367 - protein, 11 aa, Staphylococcus
TQRAPGGDNYN

SEQ ID NO: 1991368 - protein, 14 aa, Staphylococcus
TQRGVGALSPNIKK

SEQ ID NO: 1991369 - protein, 5 aa, Staphylococcus
TQRHE

SEQ ID NO: 1991370 - protein, 4 aa, Staphylococcus
TQRQ

SEQ ID NO: 1991371 - protein, 7 aa, Staphylococcus
TQRQTTY

SEQ ID NO: 1991372 - protein, 6 aa, Staphylococcus
TQRTKI

SEQ ID NO: 1991373 - protein, 7 aa, Staphylococcus
TQRWNEQ

SEQ ID NO: 1991374 - protein, 25 aa, Staphylococcus
TQSDAFKEAHKNTGKSSTEDSPVVT

SEQ ID NO: 1991375 - protein, 8 aa, Staphylococcus
TQSDATEI

SEQ ID NO: 1991376 - protein, 4 aa, Staphylococcus
TQSE

SEQ ID NO: 1991377 - protein, 5 aa, Staphylococcus
TQSEF

SEQ ID NO: 1991378 - protein, 5 aa, Staphylococcus
TQSEI

SEQ ID NO: 1991379 - protein, 8 aa, Staphylococcus
TQSETEPI

SEQ ID NO: 1991380 - protein, 5 aa, Staphylococcus
TQSEW

SEQ ID NO: 1991381 - protein, 9 aa, Staphylococcus
TQSFNPRQQ

SEQ ID NO: 1991382 - protein, 4 aa, Staphylococcus
TQSI

SEQ ID NO: 1991383 - protein, 4 aa, Staphylococcus
TQSK

SEQ ID NO: 1991384 - protein, 17 aa, Staphylococcus
TQSKETAIDKIDEADYD

SEQ ID NO: 1991385 - protein, 9 aa, Staphylococcus
TQSKKQDDV

SEQ ID NO: 1991386 - protein, 7 aa, Staphylococcus
TQSNVSH

SEQ ID NO: 1991387 - protein, 9 aa, Staphylococcus
TQSPKENDL

SEQ ID NO: 1991388 - protein, 9 aa, Staphylococcus
TQSPKQDDL

SEQ ID NO: 1991389 - protein, 9 aa, Staphylococcus
TQSPRKDDL

SEQ ID NO: 1991390 - protein, 10 aa, Staphylococcus
TQSQGDVRSA

SEQ ID NO: 1991391 - protein, 8 aa, Staphylococcus
TQSREENI

SEQ ID NO: 1991392 - protein, 21 aa, Staphylococcus
TQSRKIATNYPSVRPYPGAKP

SEQ ID NO: 1991393 - protein, 9 aa, Staphylococcus
TQSRYDKLK

SEQ ID NO: 1991394 - protein, 6 aa, Staphylococcus
TQSSDV

SEQ ID NO: 1991395 - protein, 7 aa, Staphylococcus
TQSSEDL

SEQ ID NO: 1991396 - protein, 9 aa, Staphylococcus
TQSSFQGNA

SEQ ID NO: 1991397 - protein, 6 aa, Staphylococcus
TQSSQF

SEQ ID NO: 1991398 - protein, 8 aa, Staphylococcus
TQSTPLME

SEQ ID NO: 1991399 - protein, 13 aa, Staphylococcus
TQTAARDLADKGI

SEQ ID NO: 1991400 - protein, 8 aa, Staphylococcus
TQTDIKQT

SEQ ID NO: 1991401 - protein, 4 aa, Staphylococcus
TQTG

SEQ ID NO: 1991402 - protein, 7 aa, Staphylococcus
TQTGDIQ

SEQ ID NO: 1991403 - protein, 6 aa, Staphylococcus
TQTGET

SEQ ID NO: 1991404 - protein, 10 aa, Staphylococcus
TQTITQQVKQ

SEQ ID NO: 1991405 - protein, 10 aa, Staphylococcus
TQTNKSLTAY

SEQ ID NO: 1991406 - protein, 5 aa, Staphylococcus
TQTQD

SEQ ID NO: 1991407 - protein, 8 aa, Staphylococcus
TQTQVGKE

SEQ ID NO: 1991408 - protein, 8 aa, Staphylococcus
TQTTDEAR

SEQ ID NO: 1991409 - protein, 4 aa, Staphylococcus
TQTY

SEQ ID NO: 1991410 - protein, 5 aa, Staphylococcus
TQTYE

SEQ ID NO: 1991411 - protein, 9 aa, Staphylococcus
TQVNLTPKE

SEQ ID NO: 1991412 - protein, 11 aa, Staphylococcus
TQVSEQAKNDG

SEQ ID NO: 1991413 - protein, 5 aa, Staphylococcus
TQVTP

SEQ ID NO: 1991414 - protein, 8 aa, Staphylococcus
TQYDTSSQ

SEQ ID NO: 1991415 - protein, 7 aa, Staphylococcus
TQYEKPD

SEQ ID NO: 1991416 - protein, 16 aa, Staphylococcus
TQYKDKAQKRTDGIPA

SEQ ID NO: 1991417 - protein, 9 aa, Staphylococcus
TQYKSESEI

SEQ ID NO: 1991418 - protein, 5 aa, Staphylococcus
TQYPD

SEQ ID NO: 1991419 - protein, 7 aa, Staphylococcus
TQYPEDL

SEQ ID NO: 1991420 - protein, 7 aa, Staphylococcus
TQYSEST

SEQ ID NO: 1991421 - protein, 6 aa, Staphylococcus
TRAAND

SEQ ID NO: 1991422 - protein, 11 aa, Staphylococcus
TRADKGTRKIE

SEQ ID NO: 1991423 - protein, 15 aa, Staphylococcus
TRAELGGALGKGERV

SEQ ID NO: 1991424 - protein, 14 aa, Staphylococcus
TRAKHEATINGKRY

SEQ ID NO: 1991425 - protein, 12 aa, Staphylococcus
TRAKSRFKEVTT

SEQ ID NO: 1991426 - protein, 7 aa, Staphylococcus
TRAQGEI

SEQ ID NO: 1991427 - protein, 7 aa, Staphylococcus
TRARTIE

SEQ ID NO: 1991428 - protein, 11 aa, Staphylococcus
TRDDTTHETVQ

SEQ ID NO: 1991429 - protein, 6 aa, Staphylococcus
TRDEAI

SEQ ID NO: 1991430 - protein, 6 aa, Staphylococcus
TRDEDM

SEQ ID NO: 1991431 - protein, 12 aa, Staphylococcus
TRDGAEKTKAAR

SEQ ID NO: 1991432 - protein, 6 aa, Staphylococcus
TRDGEK

SEQ ID NO: 1991433 - protein, 7 aa, Staphylococcus
TRDGGAE

SEQ ID NO: 1991434 - protein, 12 aa, Staphylococcus
TRDGTEKTKAAR

SEQ ID NO: 1991435 - protein, 5 aa, Staphylococcus
TRDHT

SEQ ID NO: 1991436 - protein, 14 aa, Staphylococcus
TRDKDNEKLTSIDN

SEQ ID NO: 1991437 - protein, 6 aa, Staphylococcus
TRDKSY

SEQ ID NO: 1991438 - protein, 14 aa, Staphylococcus
TRDPEYRTTPSGVS

SEQ ID NO: 1991439 - protein, 7 aa, Staphylococcus
TRDQSYQ

SEQ ID NO: 1991440 - protein, 10 aa, Staphylococcus
TRDRKASELR

SEQ ID NO: 1991441 - protein, 8 aa, Staphylococcus
TRDRKPIT

SEQ ID NO: 1991442 - protein, 8 aa, Staphylococcus
TRDRKPVT

SEQ ID NO: 1991443 - protein, 8 aa, Staphylococcus
TRDSKIEN

SEQ ID NO: 1991444 - protein, 5 aa, Staphylococcus
TRDVN

SEQ ID NO: 1991445 - protein, 6 aa, Staphylococcus
TREDAI

SEQ ID NO: 1991446 - protein, 13 aa, Staphylococcus
TREDGVSDYPENA

SEQ ID NO: 1991447 - protein, 12 aa, Staphylococcus
TREGAEKTKAAR

SEQ ID NO: 1991448 - protein, 12 aa, Staphylococcus
TREGSEKTKAAR

SEQ ID NO: 1991449 - protein, 14 aa, Staphylococcus
TREKFSDPKTREET

SEQ ID NO: 1991450 - protein, 5 aa, Staphylococcus
TRELE

SEQ ID NO: 1991451 - protein, 5 aa, Staphylococcus
TRELH

SEQ ID NO: 1991452 - protein, 11 aa, Staphylococcus
TREPGGVPAAE

SEQ ID NO: 1991453 - protein, 5 aa, Staphylococcus
TREQH

SEQ ID NO: 1991454 - protein, 17 aa, Staphylococcus
TRGASPRDHAFPGPDVK

SEQ ID NO: 1991455 - protein, 16 aa, Staphylococcus
TRGASPREHSFPTPPV

SEQ ID NO: 1991456 - protein, 11 aa, Staphylococcus
TRGDGTIGEDI

SEQ ID NO: 1991457 - protein, 9 aa, Staphylococcus
TRGEKLESA

SEQ ID NO: 1991458 - protein, 14 aa, Staphylococcus
TRGEYKVTSKANRA

SEQ ID NO: 1991459 - protein, 8 aa, Staphylococcus
TRGQRRPN

SEQ ID NO: 1991460 - protein, 4 aa, Staphylococcus
TRGS

SEQ ID NO: 1991461 - protein, 5 aa, Staphylococcus
TRGSG

SEQ ID NO: 1991462 - protein, 4 aa, Staphylococcus
TRGT

SEQ ID NO: 1991463 - protein, 7 aa, Staphylococcus
TRGTPYG

SEQ ID NO: 1991464 - protein, 6 aa, Staphylococcus
TRHDGS

SEQ ID NO: 1991465 - protein, 12 aa, Staphylococcus
TRHGEKKAETLL

SEQ ID NO: 1991466 - protein, 5 aa, Staphylococcus
TRHNP

SEQ ID NO: 1991467 - protein, 8 aa, Staphylococcus
TRHSADIE

SEQ ID NO: 1991468 - protein, 21 aa, Staphylococcus
TRHSSDYKEVQTTTELSDSES

SEQ ID NO: 1991469 - protein, 7 aa, Staphylococcus
TRHTTTA

SEQ ID NO: 1991470 - protein, 11 aa, Staphylococcus
TRIEKGKYNQR

SEQ ID NO: 1991471 - protein, 5 aa, Staphylococcus
TRIKG

SEQ ID NO: 1991472 - protein, 35 aa, Staphylococcus
TRIRRTEKTKQAHHQVSNRDTREPERTRERTKTTH

SEQ ID NO: 1991473 - protein, 9 aa, Staphylococcus
TRKAEVGSE

SEQ ID NO: 1991474 - protein, 6 aa, Staphylococcus
TRKDAI

SEQ ID NO: 1991475 - protein, 13 aa, Staphylococcus
TRKDGKYGLIETT

SEQ ID NO: 1991476 - protein, 6 aa, Staphylococcus
TRKGQK

SEQ ID NO: 1991477 - protein, 12 aa, Staphylococcus
TRKHRDENAAVT

SEQ ID NO: 1991478 - protein, 5 aa, Staphylococcus
TRKNG

SEQ ID NO: 1991479 - protein, 7 aa, Staphylococcus
TRKRGEG

SEQ ID NO: 1991480 - protein, 18 aa, Staphylococcus
TRKSSLRDTYFNINQKGG

SEQ ID NO: 1991481 - protein, 15 aa, Staphylococcus
TRKSTILSDKKVGDA

SEQ ID NO: 1991482 - protein, 8 aa, Staphylococcus
TRKTGYTA

SEQ ID NO: 1991483 - protein, 8 aa, Staphylococcus
TRKTSLRD

SEQ ID NO: 1991484 - protein, 7 aa, Staphylococcus
TRLDPDF

SEQ ID NO: 1991485 - protein, 19 aa, Staphylococcus
TRLQEQKVKNISAAGRLEY

SEQ ID NO: 1991486 - protein, 7 aa, Staphylococcus
TRLSEVE

SEQ ID NO: 1991487 - protein, 6 aa, Staphylococcus
TRLTDA

SEQ ID NO: 1991488 - protein, 5 aa, Staphylococcus
TRLTP

SEQ ID NO: 1991489 - protein, 5 aa, Staphylococcus
TRMGP

SEQ ID NO: 1991490 - protein, 14 aa, Staphylococcus
TRMGPAGLAESHPH

SEQ ID NO: 1991491 - protein, 7 aa, Staphylococcus
TRMTETE

SEQ ID NO: 1991492 - protein, 7 aa, Staphylococcus
TRMTQGQ

SEQ ID NO: 1991493 - protein, 8 aa, Staphylococcus
TRNEAKNY

SEQ ID NO: 1991494 - protein, 6 aa, Staphylococcus
TRNEAS

SEQ ID NO: 1991495 - protein, 15 aa, Staphylococcus
TRNHHKNSFKENEGY

SEQ ID NO: 1991496 - protein, 5 aa, Staphylococcus
TRNID

SEQ ID NO: 1991497 - protein, 15 aa, Staphylococcus
TRNKNNEKLTSIDSD

SEQ ID NO: 1991498 - protein, 18 aa, Staphylococcus
TRNMNNKASNVAEKLISD

SEQ ID NO: 1991499 - protein, 10 aa, Staphylococcus
TRNMREGEVD

SEQ ID NO: 1991500 - protein, 15 aa, Staphylococcus
TRNPKSKLGLATGGT

SEQ ID NO: 1991501 - protein, 8 aa, Staphylococcus
TRNSALSS

SEQ ID NO: 1991502 - protein, 7 aa, Staphylococcus
TRNSAQC

SEQ ID NO: 1991503 - protein, 7 aa, Staphylococcus
TRNSEQC

SEQ ID NO: 1991504 - protein, 8 aa, Staphylococcus
TRNSEQCA

SEQ ID NO: 1991505 - protein, 9 aa, Staphylococcus
TRNSEQCKQ

SEQ ID NO: 1991506 - protein, 8 aa, Staphylococcus
TRNSEQCR

SEQ ID NO: 1991507 - protein, 6 aa, Staphylococcus
TRPDCL

SEQ ID NO: 1991508 - protein, 8 aa, Staphylococcus
TRPDRQEL

SEQ ID NO: 1991509 - protein, 8 aa, Staphylococcus
TRPERQEL

SEQ ID NO: 1991510 - protein, 6 aa, Staphylococcus
TRPSDF

SEQ ID NO: 1991511 - protein, 9 aa, Staphylococcus
TRPSDIEKR

SEQ ID NO: 1991512 - protein, 11 aa, Staphylococcus
TRPSNVEKRNE

SEQ ID NO: 1991513 - protein, 4 aa, Staphylococcus
TRQG

SEQ ID NO: 1991514 - protein, 4 aa, Staphylococcus
TRQI

SEQ ID NO: 1991515 - protein, 4 aa, Staphylococcus
TRQL

SEQ ID NO: 1991516 - protein, 8 aa, Staphylococcus
TRQNDSSA

SEQ ID NO: 1991517 - protein, 10 aa, Staphylococcus
TRQNRQTIKT

SEQ ID NO: 1991518 - protein, 9 aa, Staphylococcus
TRQRGDGER

SEQ ID NO: 1991519 - protein, 4 aa, Staphylococcus
TRQT

SEQ ID NO: 1991520 - protein, 6 aa, Staphylococcus
TRQTGA

SEQ ID NO: 1991521 - protein, 9 aa, Staphylococcus
TRRANNKKN

SEQ ID NO: 1991522 - protein, 18 aa, Staphylococcus
TRRDGDKFKLNGSHGHKK

SEQ ID NO: 1991523 - protein, 5 aa, Staphylococcus
TRRED

SEQ ID NO: 1991524 - protein, 8 aa, Staphylococcus
TRRGQEID

SEQ ID NO: 1991525 - protein, 6 aa, Staphylococcus
TRRLSA

SEQ ID NO: 1991526 - protein, 7 aa, Staphylococcus
TRRLTSK

SEQ ID NO: 1991527 - protein, 10 aa, Staphylococcus
TRRPASFPAH

SEQ ID NO: 1991528 - protein, 29 aa, Staphylococcus
TRRQHSKHQLNSEDSLLPENNDIYERPKG

SEQ ID NO: 1991529 - protein, 5 aa, Staphylococcus
TRRRK

SEQ ID NO: 1991530 - protein, 7 aa, Staphylococcus
TRRVPDT

SEQ ID NO: 1991531 - protein, 12 aa, Staphylococcus
TRRYGAKKNKIH

SEQ ID NO: 1991532 - protein, 22 aa, Staphylococcus
TRSDFLPDKDDPSYDEKAQQVH

SEQ ID NO: 1991533 - protein, 13 aa, Staphylococcus
TRSHRSENGSITS

SEQ ID NO: 1991534 - protein, 10 aa, Staphylococcus
TRSNRQTVKT

SEQ ID NO: 1991535 - protein, 12 aa, Staphylococcus
TRSPRKITSPEV

SEQ ID NO: 1991536 - protein, 19 aa, Staphylococcus
TRSRPKQSRLGKRERFKAD

SEQ ID NO: 1991537 - protein, 8 aa, Staphylococcus
TRSTHQCT

SEQ ID NO: 1991538 - protein, 19 aa, Staphylococcus
TRSVQDDTHEGGKVQTDFS

SEQ ID NO: 1991539 - protein, 9 aa, Staphylococcus
TRTANYSQL

SEQ ID NO: 1991540 - protein, 19 aa, Staphylococcus
TRTDSTRISAGAKAETKEF

SEQ ID NO: 1991541 - protein, 13 aa, Staphylococcus
TRTGNDGQYTKKG

SEQ ID NO: 1991542 - protein, 6 aa, Staphylococcus
TRTITR

SEQ ID NO: 1991543 - protein, 6 aa, Staphylococcus
TRTKET

SEQ ID NO: 1991544 - protein, 5 aa, Staphylococcus
TRTLR

SEQ ID NO: 1991545 - protein, 11 aa, Staphylococcus
TRTNKDIAQPI

SEQ ID NO: 1991546 - protein, 6 aa, Staphylococcus
TRTQAL

SEQ ID NO: 1991547 - protein, 6 aa, Staphylococcus
TRTQET

SEQ ID NO: 1991548 - protein, 14 aa, Staphylococcus
TRTSFNTPKSVTIQ

SEQ ID NO: 1991549 - protein, 8 aa, Staphylococcus
TRTTPQCE

SEQ ID NO: 1991550 - protein, 8 aa, Staphylococcus
TRTTQQCQ

SEQ ID NO: 1991551 - protein, 11 aa, Staphylococcus
TRTVDDGDVSL

SEQ ID NO: 1991552 - protein, 8 aa, Staphylococcus
TRVSSPVQ

SEQ ID NO: 1991553 - protein, 12 aa, Staphylococcus
TRYEDTKDNQTV

SEQ ID NO: 1991554 - protein, 12 aa, Staphylococcus
TRYISNNDGEIY

SEQ ID NO: 1991555 - protein, 4 aa, Staphylococcus
TRYP

SEQ ID NO: 1991556 - protein, 23 aa, Staphylococcus
TRYQSGRTHSRDTITKNDNKKER

SEQ ID NO: 1991557 - protein, 13 aa, Staphylococcus
TRYRLQPENSTMS

SEQ ID NO: 1991558 - protein, 5 aa, Staphylococcus
TRYTK

SEQ ID NO: 1991559 - protein, 10 aa, Staphylococcus
TRYYANSDQR

SEQ ID NO: 1991560 - protein, 10 aa, Staphylococcus
TSAATTAAWD

SEQ ID NO: 1991561 - protein, 10 aa, Staphylococcus
TSAATTAEWD

SEQ ID NO: 1991562 - protein, 10 aa, Staphylococcus
TSAATTAQWD

SEQ ID NO: 1991563 - protein, 10 aa, Staphylococcus
TSAATTAQWN

SEQ ID NO: 1991564 - protein, 10 aa, Staphylococcus
TSAATTASWQ

SEQ ID NO: 1991565 - protein, 12 aa, Staphylococcus
TSACSSKKASLN

SEQ ID NO: 1991566 - protein, 10 aa, Staphylococcus
TSACSSKRGH

SEQ ID NO: 1991567 - protein, 9 aa, Staphylococcus
TSADNTNKT

SEQ ID NO: 1991568 - protein, 16 aa, Staphylococcus
TSADSKETFENKIKEE

SEQ ID NO: 1991569 - protein, 5 aa, Staphylococcus
TSAEI

SEQ ID NO: 1991570 - protein, 9 aa, Staphylococcus
TSAGLDYNK

SEQ ID NO: 1991571 - protein, 9 aa, Staphylococcus
TSAGLNNND

SEQ ID NO: 1991572 - protein, 14 aa, Staphylococcus
TSAGSQVSATLSSP

SEQ ID NO: 1991573 - protein, 6 aa, Staphylococcus
TSAIPE

SEQ ID NO: 1991574 - protein, 5 aa, Staphylococcus
TSAIR

SEQ ID NO: 1991575 - protein, 14 aa, Staphylococcus
TSALDIETENKIQK

SEQ ID NO: 1991576 - protein, 10 aa, Staphylococcus
TSALDTANKR

SEQ ID NO: 1991577 - protein, 7 aa, Staphylococcus
TSAMPDE

SEQ ID NO: 1991578 - protein, 17 aa, Staphylococcus
TSANTGGVMKVPEYLIE

SEQ ID NO: 1991579 - protein, 7 aa, Staphylococcus
TSANYGL

SEQ ID NO: 1991580 - protein, 5 aa, Staphylococcus
TSAQE

SEQ ID NO: 1991581 - protein, 5 aa, Staphylococcus
TSAQT

SEQ ID NO: 1991582 - protein, 4 aa, Staphylococcus
TSAS

SEQ ID NO: 1991583 - protein, 5 aa, Staphylococcus
TSATY

SEQ ID NO: 1991584 - protein, 4 aa, Staphylococcus
TSAV

SEQ ID NO: 1991585 - protein, 19 aa, Staphylococcus
TSAVKYTENYKPVAKSSTM

SEQ ID NO: 1991586 - protein, 6 aa, Staphylococcus
TSAYSG

SEQ ID NO: 1991587 - protein, 7 aa, Staphylococcus
TSAYTGK

SEQ ID NO: 1991588 - protein, 13 aa, Staphylococcus
TSAYYGPYKRPQR

SEQ ID NO: 1991589 - protein, 6 aa, Staphylococcus
TSDAAG

SEQ ID NO: 1991590 - protein, 7 aa, Staphylococcus
TSDAELA

SEQ ID NO: 1991591 - protein, 8 aa, Staphylococcus
TSDDGNSF

SEQ ID NO: 1991592 - protein, 7 aa, Staphylococcus
TSDDGSL

SEQ ID NO: 1991593 - protein, 7 aa, Staphylococcus
TSDDGTL

SEQ ID NO: 1991594 - protein, 6 aa, Staphylococcus
TSDDIK

SEQ ID NO: 1991595 - protein, 7 aa, Staphylococcus
TSDDSKF

SEQ ID NO: 1991596 - protein, 4 aa, Staphylococcus
TSDE

SEQ ID NO: 1991597 - protein, 6 aa, Staphylococcus
TSDEQM

SEQ ID NO: 1991598 - protein, 10 aa, Staphylococcus
TSDESGASQL

SEQ ID NO: 1991599 - protein, 7 aa, Staphylococcus
TSDGENI

SEQ ID NO: 1991600 - protein, 4 aa, Staphylococcus
TSDI

SEQ ID NO: 1991601 - protein, 8 aa, Staphylococcus
TSDIDGEI

SEQ ID NO: 1991602 - protein, 9 aa, Staphylococcus
TSDIGKDIK

SEQ ID NO: 1991603 - protein, 10 aa, Staphylococcus
TSDIQGGINA

SEQ ID NO: 1991604 - protein, 12 aa, Staphylococcus
TSDITHAGVEII

SEQ ID NO: 1991605 - protein, 12 aa, Staphylococcus
TSDITQSGVEII

SEQ ID NO: 1991606 - protein, 11 aa, Staphylococcus
TSDLPVSEEAA

SEQ ID NO: 1991607 - protein, 7 aa, Staphylococcus
TSDNAEA

SEQ ID NO: 1991608 - protein, 8 aa, Staphylococcus
TSDNAEEI

SEQ ID NO: 1991609 - protein, 6 aa, Staphylococcus
TSDNND

SEQ ID NO: 1991610 - protein, 11 aa, Staphylococcus
TSDNQALGQGG

SEQ ID NO: 1991611 - protein, 5 aa, Staphylococcus
TSDPE

SEQ ID NO: 1991612 - protein, 9 aa, Staphylococcus
TSDSEKGVT

SEQ ID NO: 1991613 - protein, 10 aa, Staphylococcus
TSDSKHTIAG

SEQ ID NO: 1991614 - protein, 9 aa, Staphylococcus
TSDSKKGVE

SEQ ID NO: 1991615 - protein, 7 aa, Staphylococcus
TSDSRKG

SEQ ID NO: 1991616 - protein, 11 aa, Staphylococcus
TSDSSSLLSDA

SEQ ID NO: 1991617 - protein, 7 aa, Staphylococcus
TSDTEST

SEQ ID NO: 1991618 - protein, 9 aa, Staphylococcus
TSDTKKGTL

SEQ ID NO: 1991619 - protein, 9 aa, Staphylococcus
TSDTKKGVD

SEQ ID NO: 1991620 - protein, 9 aa, Staphylococcus
TSDTKKGVT

SEQ ID NO: 1991621 - protein, 4 aa, Staphylococcus
TSDV

SEQ ID NO: 1991622 - protein, 6 aa, Staphylococcus
TSDVDG

SEQ ID NO: 1991623 - protein, 11 aa, Staphylococcus
TSDVLGGKNAG

SEQ ID NO: 1991624 - protein, 6 aa, Staphylococcus
TSDVPA

SEQ ID NO: 1991625 - protein, 8 aa, Staphylococcus
TSDVSGEV

SEQ ID NO: 1991626 - protein, 14 aa, Staphylococcus
TSDYEKQEQELPGL

SEQ ID NO: 1991627 - protein, 6 aa, Staphylococcus
TSEAIS

SEQ ID NO: 1991628 - protein, 22 aa, Staphylococcus
TSEAKEKGITCASAGNHAQGVA

SEQ ID NO: 1991629 - protein, 9 aa, Staphylococcus
TSEDDLENL

SEQ ID NO: 1991630 - protein, 12 aa, Staphylococcus
TSEDEKGNLNGA

SEQ ID NO: 1991631 - protein, 7 aa, Staphylococcus
TSEDGSL

SEQ ID NO: 1991632 - protein, 8 aa, Staphylococcus
TSEDGSLS

SEQ ID NO: 1991633 - protein, 7 aa, Staphylococcus
TSEDGTL

SEQ ID NO: 1991634 - protein, 7 aa, Staphylococcus
TSEDNKY

SEQ ID NO: 1991635 - protein, 14 aa, Staphylococcus
TSEEKAKAHIDAGA

SEQ ID NO: 1991636 - protein, 7 aa, Staphylococcus
TSEEQER

SEQ ID NO: 1991637 - protein, 5 aa, Staphylococcus
TSEER

SEQ ID NO: 1991638 - protein, 9 aa, Staphylococcus
TSEERIKNI

SEQ ID NO: 1991639 - protein, 7 aa, Staphylococcus
TSEGGMR

SEQ ID NO: 1991640 - protein, 16 aa, Staphylococcus
TSEGITLTEAKKKIDA

SEQ ID NO: 1991641 - protein, 14 aa, Staphylococcus
TSEGTLSEAGGPQY

SEQ ID NO: 1991642 - protein, 24 aa, Staphylococcus
TSEGVVTDKEARKRNIGGEILGYI

SEQ ID NO: 1991643 - protein, 6 aa, Staphylococcus
TSEIDG

SEQ ID NO: 1991644 - protein, 6 aa, Staphylococcus
TSEIGN

SEQ ID NO: 1991645 - protein, 15 aa, Staphylococcus
TSEIKPSGTGESPLA

SEQ ID NO: 1991646 - protein, 14 aa, Staphylococcus
TSEKPDIDYDDDGG

SEQ ID NO: 1991647 - protein, 15 aa, Staphylococcus
TSEKPDIDYDDDGGH

SEQ ID NO: 1991648 - protein, 14 aa, Staphylococcus
TSEKPDIDYEDDGG

SEQ ID NO: 1991649 - protein, 14 aa, Staphylococcus
TSEKPDIDYNDDGG

SEQ ID NO: 1991650 - protein, 10 aa, Staphylococcus
TSEKQEQHEL

SEQ ID NO: 1991651 - protein, 12 aa, Staphylococcus
TSELEDEREYAV

SEQ ID NO: 1991652 - protein, 8 aa, Staphylococcus
TSELKPET

SEQ ID NO: 1991653 - protein, 10 aa, Staphylococcus
TSENKTLPHY

SEQ ID NO: 1991654 - protein, 4 aa, Staphylococcus
TSEP

SEQ ID NO: 1991655 - protein, 5 aa, Staphylococcus
TSEPR

SEQ ID NO: 1991656 - protein, 4 aa, Staphylococcus
TSEQ

SEQ ID NO: 1991657 - protein, 5 aa, Staphylococcus
TSEQH

SEQ ID NO: 1991658 - protein, 12 aa, Staphylococcus
TSEQHTKNEVEE

SEQ ID NO: 1991659 - protein, 10 aa, Staphylococcus
TSEQTPSSVG

SEQ ID NO: 1991660 - protein, 9 aa, Staphylococcus
TSEQTSYTL

SEQ ID NO: 1991661 - protein, 5 aa, Staphylococcus
TSESA

SEQ ID NO: 1991662 - protein, 8 aa, Staphylococcus
TSESEGVP

SEQ ID NO: 1991663 - protein, 6 aa, Staphylococcus
TSESEI

SEQ ID NO: 1991664 - protein, 6 aa, Staphylococcus
TSESLT

SEQ ID NO: 1991665 - protein, 5 aa, Staphylococcus
TSESR

SEQ ID NO: 1991666 - protein, 6 aa, Staphylococcus
TSETKT

SEQ ID NO: 1991667 - protein, 15 aa, Staphylococcus
TSETLSQSVSNSISN

SEQ ID NO: 1991668 - protein, 9 aa, Staphylococcus
TSETQAAIN

SEQ ID NO: 1991669 - protein, 5 aa, Staphylococcus
TSEWK

SEQ ID NO: 1991670 - protein, 4 aa, Staphylococcus
TSEY

SEQ ID NO: 1991671 - protein, 6 aa, Staphylococcus
TSFDDD

SEQ ID NO: 1991672 - protein, 11 aa, Staphylococcus
TSFDKKTKEGH

SEQ ID NO: 1991673 - protein, 9 aa, Staphylococcus
TSFEHREPG

SEQ ID NO: 1991674 - protein, 12 aa, Staphylococcus
TSFEKKTKDGSA

SEQ ID NO: 1991675 - protein, 7 aa, Staphylococcus
TSFESAE

SEQ ID NO: 1991676 - protein, 13 aa, Staphylococcus
TSFGEKQRASVTN

SEQ ID NO: 1991677 - protein, 4 aa, Staphylococcus
TSFK

SEQ ID NO: 1991678 - protein, 6 aa, Staphylococcus
TSFNDK

SEQ ID NO: 1991679 - protein, 8 aa, Staphylococcus
TSFSEEEY

SEQ ID NO: 1991680 - protein, 8 aa, Staphylococcus
TSFTNDGQ

SEQ ID NO: 1991681 - protein, 23 aa, Staphylococcus
TSGAISKNNVYPVKDKKNNSNFK

SEQ ID NO: 1991682 - protein, 29 aa, Staphylococcus
TSGALEKQNEIEREQSELNAQRQPAGDKE

SEQ ID NO: 1991683 - protein, 11 aa, Staphylococcus
TSGAPSKVASA

SEQ ID NO: 1991684 - protein, 8 aa, Staphylococcus
TSGAQIAS

SEQ ID NO: 1991685 - protein, 7 aa, Staphylococcus
TSGCGKT

SEQ ID NO: 1991686 - protein, 4 aa, Staphylococcus
TSGD

SEQ ID NO: 1991687 - protein, 4 aa, Staphylococcus
TSGE

SEQ ID NO: 1991688 - protein, 24 aa, Staphylococcus
TSGELTDRQHKTRTLKETLEGAGL

SEQ ID NO: 1991689 - protein, 7 aa, Staphylococcus
TSGEQRL

SEQ ID NO: 1991690 - protein, 16 aa, Staphylococcus
TSGGAQAATGLTSDKS

SEQ ID NO: 1991691 - protein, 11 aa, Staphylococcus
TSGGDSPGMNA

SEQ ID NO: 1991692 - protein, 33 aa, Staphylococcus
TSGGGGDFIPNQADPYTAGEGSDMQTPAERHEP

SEQ ID NO: 1991693 - protein, 8 aa, Staphylococcus
TSGHAGQS

SEQ ID NO: 1991694 - protein, 7 aa, Staphylococcus
TSGKHYN

SEQ ID NO: 1991695 - protein, 25 aa, Staphylococcus
TSGKLTDRQYKTRTVKETLEGAGLN

SEQ ID NO: 1991696 - protein, 4 aa, Staphylococcus
TSGL

SEQ ID NO: 1991697 - protein, 18 aa, Staphylococcus
TSGLDLNGKNHIDIEEAT

SEQ ID NO: 1991698 - protein, 13 aa, Staphylococcus
TSGLDYQDKKRQI

SEQ ID NO: 1991699 - protein, 8 aa, Staphylococcus
TSGLTNTH

SEQ ID NO: 1991700 - protein, 9 aa, Staphylococcus
TSGPFPDSI

SEQ ID NO: 1991701 - protein, 11 aa, Staphylococcus
TSGPGATNAIT

SEQ ID NO: 1991702 - protein, 9 aa, Staphylococcus
TSGPGSTNV

SEQ ID NO: 1991703 - protein, 14 aa, Staphylococcus
TSGQITIDGKDVRK

SEQ ID NO: 1991704 - protein, 8 aa, Staphylococcus
TSGQITNY

SEQ ID NO: 1991705 - protein, 7 aa, Staphylococcus
TSGQRIS

SEQ ID NO: 1991706 - protein, 6 aa, Staphylococcus
TSGQVD

SEQ ID NO: 1991707 - protein, 4 aa, Staphylococcus
TSGR

SEQ ID NO: 1991708 - protein, 17 aa, Staphylococcus
TSGREAVENNLSQQIGE

SEQ ID NO: 1991709 - protein, 22 aa, Staphylococcus
TSGREEVENNLSQNIGELGKTF

SEQ ID NO: 1991710 - protein, 21 aa, Staphylococcus
TSGREEVENNLSQSIGELGKT

SEQ ID NO: 1991711 - protein, 22 aa, Staphylococcus
TSGREEVENNLSQSIGELGKTF

SEQ ID NO: 1991712 - protein, 18 aa, Staphylococcus
TSGREEVEQNASKNIGAL

SEQ ID NO: 1991713 - protein, 6 aa, Staphylococcus
TSGRET

SEQ ID NO: 1991714 - protein, 8 aa, Staphylococcus
TSGSGHLS

SEQ ID NO: 1991715 - protein, 8 aa, Staphylococcus
TSGSHANQ

SEQ ID NO: 1991716 - protein, 24 aa, Staphylococcus
TSGSLTDRQYKTRTVKETLEGAGL

SEQ ID NO: 1991717 - protein, 8 aa, Staphylococcus
TSGTPQME

SEQ ID NO: 1991718 - protein, 22 aa, Staphylococcus
TSGTQKTRGRDRTEEEKEAARQ

SEQ ID NO: 1991719 - protein, 11 aa, Staphylococcus
TSGVAAPAYAG

SEQ ID NO: 1991720 - protein, 4 aa, Staphylococcus
TSGY

SEQ ID NO: 1991721 - protein, 7 aa, Staphylococcus
TSGYETL

SEQ ID NO: 1991722 - protein, 6 aa, Staphylococcus
TSHELK

SEQ ID NO: 1991723 - protein, 7 aa, Staphylococcus
TSHGDDL

SEQ ID NO: 1991724 - protein, 7 aa, Staphylococcus
TSHHDDK

SEQ ID NO: 1991725 - protein, 9 aa, Staphylococcus
TSHHQYQDD

SEQ ID NO: 1991726 - protein, 4 aa, Staphylococcus
TSHI

SEQ ID NO: 1991727 - protein, 8 aa, Staphylococcus
TSHKGQHA

SEQ ID NO: 1991728 - protein, 4 aa, Staphylococcus
TSHL

SEQ ID NO: 1991729 - protein, 5 aa, Staphylococcus
TSHLE

SEQ ID NO: 1991730 - protein, 6 aa, Staphylococcus
TSHRMP

SEQ ID NO: 1991731 - protein, 10 aa, Staphylococcus
TSHTEEDINK

SEQ ID NO: 1991732 - protein, 5 aa, Staphylococcus
TSHTM

SEQ ID NO: 1991733 - protein, 6 aa, Staphylococcus
TSHTSN

SEQ ID NO: 1991734 - protein, 6 aa, Staphylococcus
TSIAGQ

SEQ ID NO: 1991735 - protein, 6 aa, Staphylococcus
TSIATN

SEQ ID NO: 1991736 - protein, 6 aa, Staphylococcus
TSIDTK

SEQ ID NO: 1991737 - protein, 5 aa, Staphylococcus
TSIEQ

SEQ ID NO: 1991738 - protein, 13 aa, Staphylococcus
TSIGSDDKSKELK

SEQ ID NO: 1991739 - protein, 14 aa, Staphylococcus
TSIKNNVNNIGASA

SEQ ID NO: 1991740 - protein, 6 aa, Staphylococcus
TSIKSA

SEQ ID NO: 1991741 - protein, 4 aa, Staphylococcus
TSIL

SEQ ID NO: 1991742 - protein, 5 aa, Staphylococcus
TSINS

SEQ ID NO: 1991743 - protein, 6 aa, Staphylococcus
TSIPQG

SEQ ID NO: 1991744 - protein, 14 aa, Staphylococcus
TSIRQHSAQKHNDA

SEQ ID NO: 1991745 - protein, 8 aa, Staphylococcus
TSIRTDDK

SEQ ID NO: 1991746 - protein, 23 aa, Staphylococcus
TSISDPALEPLDPEKRKDVARNI

SEQ ID NO: 1991747 - protein, 12 aa, Staphylococcus
TSISNNQTKEIK

SEQ ID NO: 1991748 - protein, 6 aa, Staphylococcus
TSISPG

SEQ ID NO: 1991749 - protein, 24 aa, Staphylococcus
TSITHSDGHTSISKTPKVTGKGQQ

SEQ ID NO: 1991750 - protein, 8 aa, Staphylococcus
TSKAGYSG

SEQ ID NO: 1991751 - protein, 9 aa, Staphylococcus
TSKDATTSL

SEQ ID NO: 1991752 - protein, 13 aa, Staphylococcus
TSKDDKYVSYKET

SEQ ID NO: 1991753 - protein, 6 aa, Staphylococcus
TSKDND

SEQ ID NO: 1991754 - protein, 7 aa, Staphylococcus
TSKEIDE

SEQ ID NO: 1991755 - protein, 7 aa, Staphylococcus
TSKEVNE

SEQ ID NO: 1991756 - protein, 8 aa, Staphylococcus
TSKGDVEQ

SEQ ID NO: 1991757 - protein, 7 aa, Staphylococcus
TSKGHEQ

SEQ ID NO: 1991758 - protein, 14 aa, Staphylococcus
TSKGRSSHSSTPFM

SEQ ID NO: 1991759 - protein, 17 aa, Staphylococcus
TSKGSEALNENTPLNPN

SEQ ID NO: 1991760 - protein, 15 aa, Staphylococcus
TSKGVPAHSSLPSLG

SEQ ID NO: 1991761 - protein, 8 aa, Staphylococcus
TSKINDDD

SEQ ID NO: 1991762 - protein, 10 aa, Staphylococcus
TSKKEMSKDG

SEQ ID NO: 1991763 - protein, 6 aa, Staphylococcus
TSKKPI

SEQ ID NO: 1991764 - protein, 10 aa, Staphylococcus
TSKNKIDDTE

SEQ ID NO: 1991765 - protein, 7 aa, Staphylococcus
TSKNRYT

SEQ ID NO: 1991766 - protein, 13 aa, Staphylococcus
TSKPSEIKKMNPD

SEQ ID NO: 1991767 - protein, 7 aa, Staphylococcus
TSKPSIL

SEQ ID NO: 1991768 - protein, 6 aa, Staphylococcus
TSKQFK

SEQ ID NO: 1991769 - protein, 7 aa, Staphylococcus
TSKQFKT

SEQ ID NO: 1991770 - protein, 7 aa, Staphylococcus
TSKQHST

SEQ ID NO: 1991771 - protein, 8 aa, Staphylococcus
TSKQNNTK

SEQ ID NO: 1991772 - protein, 15 aa, Staphylococcus
TSKSFGSAGNPSPMT

SEQ ID NO: 1991773 - protein, 14 aa, Staphylococcus
TSKSGGKSGDYHRS

SEQ ID NO: 1991774 - protein, 6 aa, Staphylococcus
TSKSHF

SEQ ID NO: 1991775 - protein, 9 aa, Staphylococcus
TSKSNLSAQ

SEQ ID NO: 1991776 - protein, 9 aa, Staphylococcus
TSKSNLSSQ

SEQ ID NO: 1991777 - protein, 8 aa, Staphylococcus
TSKTETSL

SEQ ID NO: 1991778 - protein, 6 aa, Staphylococcus
TSKTPK

SEQ ID NO: 1991779 - protein, 4 aa, Staphylococcus
TSKY

SEQ ID NO: 1991780 - protein, 8 aa, Staphylococcus
TSKYDDVR

SEQ ID NO: 1991781 - protein, 9 aa, Staphylococcus
TSLAPGSKV

SEQ ID NO: 1991782 - protein, 4 aa, Staphylococcus
TSLE

SEQ ID NO: 1991783 - protein, 4 aa, Staphylococcus
TSLG

SEQ ID NO: 1991784 - protein, 5 aa, Staphylococcus
TSLGR

SEQ ID NO: 1991785 - protein, 4 aa, Staphylococcus
TSLK

SEQ ID NO: 1991786 - protein, 11 aa, Staphylococcus
TSLLGADDKAG

SEQ ID NO: 1991787 - protein, 6 aa, Staphylococcus
TSLNDE

SEQ ID NO: 1991788 - protein, 11 aa, Staphylococcus
TSLNDEEKNEL

SEQ ID NO: 1991789 - protein, 12 aa, Staphylococcus
TSLNEKETKEFN

SEQ ID NO: 1991790 - protein, 41 aa, Staphylococcus
TSLQENPNSKKNKTKHTQIKQQYDSNERKISQTKDEIAKEG

SEQ ID NO: 1991791 - protein, 9 aa, Staphylococcus
TSLRDTEDI

SEQ ID NO: 1991792 - protein, 10 aa, Staphylococcus
TSLSGGEAQR

SEQ ID NO: 1991793 - protein, 6 aa, Staphylococcus
TSLSKA

SEQ ID NO: 1991794 - protein, 9 aa, Staphylococcus
TSLSKGEKV

SEQ ID NO: 1991795 - protein, 7 aa, Staphylococcus
TSLSPDE

SEQ ID NO: 1991796 - protein, 9 aa, Staphylococcus
TSLSQAQEM

SEQ ID NO: 1991797 - protein, 8 aa, Staphylococcus
TSLSSEQL

SEQ ID NO: 1991798 - protein, 7 aa, Staphylococcus
TSLTTSK

SEQ ID NO: 1991799 - protein, 11 aa, Staphylococcus
TSMAGRGTDIK

SEQ ID NO: 1991800 - protein, 8 aa, Staphylococcus
TSMEDDDQ

SEQ ID NO: 1991801 - protein, 10 aa, Staphylococcus
TSMKASKNTS

SEQ ID NO: 1991802 - protein, 13 aa, Staphylococcus
TSNAGTKDGGREG

SEQ ID NO: 1991803 - protein, 81 aa, Staphylococcus
TSNAKNEKVDDQADVKANPTSSEDKAKPETAPDINSKEDTKNEQQDQQSLTEDETTQEPQRIENNGDKNNLKTKTKFDTEK

SEQ ID NO: 1991804 - protein, 11 aa, Staphylococcus
TSNASKDGGFQ

SEQ ID NO: 1991805 - protein, 8 aa, Staphylococcus
TSNDLKRT

SEQ ID NO: 1991806 - protein, 12 aa, Staphylococcus
TSNEKTKDGARE

SEQ ID NO: 1991807 - protein, 14 aa, Staphylococcus
TSNGKSVHSSMPSL

SEQ ID NO: 1991808 - protein, 7 aa, Staphylococcus
TSNKIAT

SEQ ID NO: 1991809 - protein, 6 aa, Staphylococcus
TSNKSA

SEQ ID NO: 1991810 - protein, 15 aa, Staphylococcus
TSNLPNGMKARTKYH

SEQ ID NO: 1991811 - protein, 5 aa, Staphylococcus
TSNNI

SEQ ID NO: 1991812 - protein, 12 aa, Staphylococcus
TSNPKIKEIQED

SEQ ID NO: 1991813 - protein, 6 aa, Staphylococcus
TSNPNV

SEQ ID NO: 1991814 - protein, 8 aa, Staphylococcus
TSNPPYAY

SEQ ID NO: 1991815 - protein, 8 aa, Staphylococcus
TSNQQLSY

SEQ ID NO: 1991816 - protein, 4 aa, Staphylococcus
TSNR

SEQ ID NO: 1991817 - protein, 10 aa, Staphylococcus
TSNSNEALDK

SEQ ID NO: 1991818 - protein, 10 aa, Staphylococcus
TSNSNQALDR

SEQ ID NO: 1991819 - protein, 9 aa, Staphylococcus
TSNSPMNAH

SEQ ID NO: 1991820 - protein, 10 aa, Staphylococcus
TSNSTQGKKM

SEQ ID NO: 1991821 - protein, 4 aa, Staphylococcus
TSNT

SEQ ID NO: 1991822 - protein, 13 aa, Staphylococcus
TSNTRSHQIAKDA

SEQ ID NO: 1991823 - protein, 6 aa, Staphylococcus
TSNVEK

SEQ ID NO: 1991824 - protein, 4 aa, Staphylococcus
TSPA

SEQ ID NO: 1991825 - protein, 5 aa, Staphylococcus
TSPAQ

SEQ ID NO: 1991826 - protein, 8 aa, Staphylococcus
TSPDFNAS

SEQ ID NO: 1991827 - protein, 13 aa, Staphylococcus
TSPDFNASNVNPQ

SEQ ID NO: 1991828 - protein, 12 aa, Staphylococcus
TSPDFNATNVNP

SEQ ID NO: 1991829 - protein, 12 aa, Staphylococcus
TSPDFNATNVQP

SEQ ID NO: 1991830 - protein, 19 aa, Staphylococcus
TSPDGPPTNWESKFGGNAW

SEQ ID NO: 1991831 - protein, 9 aa, Staphylococcus
TSPDSPIGE

SEQ ID NO: 1991832 - protein, 10 aa, Staphylococcus
TSPDYRGQGI

SEQ ID NO: 1991833 - protein, 5 aa, Staphylococcus
TSPEG

SEQ ID NO: 1991834 - protein, 6 aa, Staphylococcus
TSPEQI

SEQ ID NO: 1991835 - protein, 7 aa, Staphylococcus
TSPGFAN

SEQ ID NO: 1991836 - protein, 6 aa, Staphylococcus
TSPHTM

SEQ ID NO: 1991837 - protein, 22 aa, Staphylococcus
TSPLTEKETHHDYPEINSDAQL

SEQ ID NO: 1991838 - protein, 9 aa, Staphylococcus
TSPLVGKPI

SEQ ID NO: 1991839 - protein, 9 aa, Staphylococcus
TSPNSAIGK

SEQ ID NO: 1991840 - protein, 5 aa, Staphylococcus
TSPQA

SEQ ID NO: 1991841 - protein, 6 aa, Staphylococcus
TSPRNT

SEQ ID NO: 1991842 - protein, 8 aa, Staphylococcus
TSPSFSAD

SEQ ID NO: 1991843 - protein, 6 aa, Staphylococcus
TSPSNA

SEQ ID NO: 1991844 - protein, 7 aa, Staphylococcus
TSPSNYL

SEQ ID NO: 1991845 - protein, 7 aa, Staphylococcus
TSPSNYM

SEQ ID NO: 1991846 - protein, 7 aa, Staphylococcus
TSPSSYI

SEQ ID NO: 1991847 - protein, 7 aa, Staphylococcus
TSPSSYL

SEQ ID NO: 1991848 - protein, 6 aa, Staphylococcus
TSPTGK

SEQ ID NO: 1991849 - protein, 8 aa, Staphylococcus
TSPTPDKV

SEQ ID NO: 1991850 - protein, 4 aa, Staphylococcus
TSPV

SEQ ID NO: 1991851 - protein, 18 aa, Staphylococcus
TSPVAAGGDSREGRWSNN

SEQ ID NO: 1991852 - protein, 17 aa, Staphylococcus
TSPVQARTMEKRGGQGP

SEQ ID NO: 1991853 - protein, 17 aa, Staphylococcus
TSPVQARTMEKRHGQGP

SEQ ID NO: 1991854 - protein, 17 aa, Staphylococcus
TSPVQARTMEKRNGEGP

SEQ ID NO: 1991855 - protein, 17 aa, Staphylococcus
TSPVQARTMEKRNGQGP

SEQ ID NO: 1991856 - protein, 16 aa, Staphylococcus
TSPVQARTMEKRNGVG

SEQ ID NO: 1991857 - protein, 8 aa, Staphylococcus
TSPYTKSK

SEQ ID NO: 1991858 - protein, 9 aa, Staphylococcus
TSPYTKSKF

SEQ ID NO: 1991859 - protein, 10 aa, Staphylococcus
TSQESGADIA

SEQ ID NO: 1991860 - protein, 8 aa, Staphylococcus
TSQGATKI

SEQ ID NO: 1991861 - protein, 12 aa, Staphylococcus
TSQGEKDTSLPG

SEQ ID NO: 1991862 - protein, 6 aa, Staphylococcus
TSQIKD

SEQ ID NO: 1991863 - protein, 16 aa, Staphylococcus
TSQLPQGMKARAKHNN

SEQ ID NO: 1991864 - protein, 8 aa, Staphylococcus
TSQNDTSS

SEQ ID NO: 1991865 - protein, 8 aa, Staphylococcus
TSQNQQMQ

SEQ ID NO: 1991866 - protein, 6 aa, Staphylococcus
TSQNYK

SEQ ID NO: 1991867 - protein, 7 aa, Staphylococcus
TSQPFKE

SEQ ID NO: 1991868 - protein, 10 aa, Staphylococcus
TSQPLTSSDL

SEQ ID NO: 1991869 - protein, 9 aa, Staphylococcus
TSQPSISRD

SEQ ID NO: 1991870 - protein, 6 aa, Staphylococcus
TSQPTI

SEQ ID NO: 1991871 - protein, 8 aa, Staphylococcus
TSQPTTPV

SEQ ID NO: 1991872 - protein, 6 aa, Staphylococcus
TSQPYP

SEQ ID NO: 1991873 - protein, 5 aa, Staphylococcus
TSQQI

SEQ ID NO: 1991874 - protein, 6 aa, Staphylococcus
TSQQSE

SEQ ID NO: 1991875 - protein, 9 aa, Staphylococcus
TSQQSHEDL

SEQ ID NO: 1991876 - protein, 8 aa, Staphylococcus
TSQQTYEA

SEQ ID NO: 1991877 - protein, 13 aa, Staphylococcus
TSQRHESADRPKS

SEQ ID NO: 1991878 - protein, 4 aa, Staphylococcus
TSQS

SEQ ID NO: 1991879 - protein, 4 aa, Staphylococcus
TSQT

SEQ ID NO: 1991880 - protein, 8 aa, Staphylococcus
TSQTGETF

SEQ ID NO: 1991881 - protein, 6 aa, Staphylococcus
TSQTPH

SEQ ID NO: 1991882 - protein, 12 aa, Staphylococcus
TSQTSTGQALNR

SEQ ID NO: 1991883 - protein, 10 aa, Staphylococcus
TSQYPDGTET

SEQ ID NO: 1991884 - protein, 11 aa, Staphylococcus
TSQYQPPSEAC

SEQ ID NO: 1991885 - protein, 9 aa, Staphylococcus
TSRDTAENF

SEQ ID NO: 1991886 - protein, 9 aa, Staphylococcus
TSREISPFK

SEQ ID NO: 1991887 - protein, 10 aa, Staphylococcus
TSRGDRKEIQ

SEQ ID NO: 1991888 - protein, 5 aa, Staphylococcus
TSRGK

SEQ ID NO: 1991889 - protein, 6 aa, Staphylococcus
TSRIDA

SEQ ID NO: 1991890 - protein, 7 aa, Staphylococcus
TSRIPTD

SEQ ID NO: 1991891 - protein, 10 aa, Staphylococcus
TSRLDAPENV

SEQ ID NO: 1991892 - protein, 8 aa, Staphylococcus
TSRNDAQL

SEQ ID NO: 1991893 - protein, 6 aa, Staphylococcus
TSRNNA

SEQ ID NO: 1991894 - protein, 5 aa, Staphylococcus
TSRNT

SEQ ID NO: 1991895 - protein, 15 aa, Staphylococcus
TSRNTSNKENEENVT

SEQ ID NO: 1991896 - protein, 4 aa, Staphylococcus
TSRP

SEQ ID NO: 1991897 - protein, 22 aa, Staphylococcus
TSRPQDNKSFASGSANSNNNNV

SEQ ID NO: 1991898 - protein, 19 aa, Staphylococcus
TSRPQENKNFSSNASTNNV

SEQ ID NO: 1991899 - protein, 27 aa, Staphylococcus
TSRPQENKNFSSNNNVTTKNNSSNNNV

SEQ ID NO: 1991900 - protein, 22 aa, Staphylococcus
TSRPSDNKSFASSNSKSANNNV

SEQ ID NO: 1991901 - protein, 22 aa, Staphylococcus
TSRPSDNKSFSSNNSSSSNNNV

SEQ ID NO: 1991902 - protein, 10 aa, Staphylococcus
TSRPVKYPTD

SEQ ID NO: 1991903 - protein, 6 aa, Staphylococcus
TSRRKI

SEQ ID NO: 1991904 - protein, 9 aa, Staphylococcus
TSRRVAKEE

SEQ ID NO: 1991905 - protein, 14 aa, Staphylococcus
TSRSYFPKDNSDYF

SEQ ID NO: 1991906 - protein, 4 aa, Staphylococcus
TSRT

SEQ ID NO: 1991907 - protein, 9 aa, Staphylococcus
TSRTPDDLN

SEQ ID NO: 1991908 - protein, 9 aa, Staphylococcus
TSRVPDDLD

SEQ ID NO: 1991909 - protein, 7 aa, Staphylococcus
TSSDTLA

SEQ ID NO: 1991910 - protein, 14 aa, Staphylococcus
TSSEKKLGKPVGSD

SEQ ID NO: 1991911 - protein, 14 aa, Staphylococcus
TSSENKLGKPVGSD

SEQ ID NO: 1991912 - protein, 19 aa, Staphylococcus
TSSFTKKGKDGRLKAKGQH

SEQ ID NO: 1991913 - protein, 14 aa, Staphylococcus
TSSFTPEESPDPGF

SEQ ID NO: 1991914 - protein, 7 aa, Staphylococcus
TSSGIGY

SEQ ID NO: 1991915 - protein, 14 aa, Staphylococcus
TSSHPGEPPRTNQE

SEQ ID NO: 1991916 - protein, 9 aa, Staphylococcus
TSSHQKALD

SEQ ID NO: 1991917 - protein, 6 aa, Staphylococcus
TSSHRE

SEQ ID NO: 1991918 - protein, 4 aa, Staphylococcus
TSSK

SEQ ID NO: 1991919 - protein, 7 aa, Staphylococcus
TSSKKEI

SEQ ID NO: 1991920 - protein, 18 aa, Staphylococcus
TSSKPQQTPRAKSEVEEA

SEQ ID NO: 1991921 - protein, 6 aa, Staphylococcus
TSSLGV

SEQ ID NO: 1991922 - protein, 8 aa, Staphylococcus
TSSLRRGA

SEQ ID NO: 1991923 - protein, 6 aa, Staphylococcus
TSSNIS

SEQ ID NO: 1991924 - protein, 7 aa, Staphylococcus
TSSNKKW

SEQ ID NO: 1991925 - protein, 12 aa, Staphylococcus
TSSNNNSIAKDS

SEQ ID NO: 1991926 - protein, 10 aa, Staphylococcus
TSSNSTNEIK

SEQ ID NO: 1991927 - protein, 20 aa, Staphylococcus
TSSPLAEFKKSKASLLTSSY

SEQ ID NO: 1991928 - protein, 6 aa, Staphylococcus
TSSQNK

SEQ ID NO: 1991929 - protein, 15 aa, Staphylococcus
TSSRLGNTNAKRTQL

SEQ ID NO: 1991930 - protein, 12 aa, Staphylococcus
TSSSEEKRKQLP

SEQ ID NO: 1991931 - protein, 4 aa, Staphylococcus
TSST

SEQ ID NO: 1991932 - protein, 6 aa, Staphylococcus
TSSTLT

SEQ ID NO: 1991933 - protein, 5 aa, Staphylococcus
TSSVA

SEQ ID NO: 1991934 - protein, 9 aa, Staphylococcus
TSSVHDETQ

SEQ ID NO: 1991935 - protein, 10 aa, Staphylococcus
TSSVKDETQI

SEQ ID NO: 1991936 - protein, 9 aa, Staphylococcus
TSSVRDDTQ

SEQ ID NO: 1991937 - protein, 6 aa, Staphylococcus
TSSWKS

SEQ ID NO: 1991938 - protein, 5 aa, Staphylococcus
TSSYK

SEQ ID NO: 1991939 - protein, 5 aa, Staphylococcus
TSSYR

SEQ ID NO: 1991940 - protein, 6 aa, Staphylococcus
TSSYRE

SEQ ID NO: 1991941 - protein, 6 aa, Staphylococcus
TSSYRQ

SEQ ID NO: 1991942 - protein, 9 aa, Staphylococcus
TSTADIDGE

SEQ ID NO: 1991943 - protein, 14 aa, Staphylococcus
TSTEKQLGKPVGSD

SEQ ID NO: 1991944 - protein, 13 aa, Staphylococcus
TSTEPKSGGMYKV

SEQ ID NO: 1991945 - protein, 6 aa, Staphylococcus
TSTEQK

SEQ ID NO: 1991946 - protein, 6 aa, Staphylococcus
TSTGCD

SEQ ID NO: 1991947 - protein, 9 aa, Staphylococcus
TSTGCDGIH

SEQ ID NO: 1991948 - protein, 6 aa, Staphylococcus
TSTGCE

SEQ ID NO: 1991949 - protein, 15 aa, Staphylococcus
TSTGFAGGGATPEDV

SEQ ID NO: 1991950 - protein, 13 aa, Staphylococcus
TSTGFAGGGATVE

SEQ ID NO: 1991951 - protein, 6 aa, Staphylococcus
TSTHNS

SEQ ID NO: 1991952 - protein, 7 aa, Staphylococcus
TSTIPQI

SEQ ID NO: 1991953 - protein, 6 aa, Staphylococcus
TSTIQA

SEQ ID NO: 1991954 - protein, 11 aa, Staphylococcus
TSTKDNPVANR

SEQ ID NO: 1991955 - protein, 7 aa, Staphylococcus
TSTKKNR

SEQ ID NO: 1991956 - protein, 8 aa, Staphylococcus
TSTKSVLY

SEQ ID NO: 1991957 - protein, 6 aa, Staphylococcus
TSTLEN

SEQ ID NO: 1991958 - protein, 6 aa, Staphylococcus
TSTLKE

SEQ ID NO: 1991959 - protein, 7 aa, Staphylococcus
TSTNDQN

SEQ ID NO: 1991960 - protein, 6 aa, Staphylococcus
TSTNEG

SEQ ID NO: 1991961 - protein, 6 aa, Staphylococcus
TSTNYN

SEQ ID NO: 1991962 - protein, 7 aa, Staphylococcus
TSTPNEV

SEQ ID NO: 1991963 - protein, 18 aa, Staphylococcus
TSTPNEVKQAIENENDTY

SEQ ID NO: 1991964 - protein, 18 aa, Staphylococcus
TSTPNEVKRAIEDENDAY

SEQ ID NO: 1991965 - protein, 18 aa, Staphylococcus
TSTPNEVKRAIENENDTY

SEQ ID NO: 1991966 - protein, 7 aa, Staphylococcus
TSTRTRA

SEQ ID NO: 1991967 - protein, 10 aa, Staphylococcus
TSTRYDNKDA

SEQ ID NO: 1991968 - protein, 9 aa, Staphylococcus
TSTSKRTQM

SEQ ID NO: 1991969 - protein, 11 aa, Staphylococcus
TSTSQHTVTGT

SEQ ID NO: 1991970 - protein, 13 aa, Staphylococcus
TSTTHKTLRGPRG

SEQ ID NO: 1991971 - protein, 5 aa, Staphylococcus
TSTTN

SEQ ID NO: 1991972 - protein, 7 aa, Staphylococcus
TSTVGDI

SEQ ID NO: 1991973 - protein, 13 aa, Staphylococcus
TSVAEAAANETAG

SEQ ID NO: 1991974 - protein, 5 aa, Staphylococcus
TSVEG

SEQ ID NO: 1991975 - protein, 6 aa, Staphylococcus
TSVENE

SEQ ID NO: 1991976 - protein, 14 aa, Staphylococcus
TSVERPEVQETTAL

SEQ ID NO: 1991977 - protein, 6 aa, Staphylococcus
TSVGYG

SEQ ID NO: 1991978 - protein, 18 aa, Staphylococcus
TSVKDQRPHALSGGQQQR

SEQ ID NO: 1991979 - protein, 36 aa, Staphylococcus
TSVNDRQNVNSQEATFTEEPKDIDQEQENEHPTEVQ

SEQ ID NO: 1991980 - protein, 6 aa, Staphylococcus
TSVPAE

SEQ ID NO: 1991981 - protein, 7 aa, Staphylococcus
TSVPNER

SEQ ID NO: 1991982 - protein, 7 aa, Staphylococcus
TSVPSER

SEQ ID NO: 1991983 - protein, 5 aa, Staphylococcus
TSVSD

SEQ ID NO: 1991984 - protein, 7 aa, Staphylococcus
TSVSPGM

SEQ ID NO: 1991985 - protein, 6 aa, Staphylococcus
TSVTTA

SEQ ID NO: 1991986 - protein, 12 aa, Staphylococcus
TSVTVDSQTDHR

SEQ ID NO: 1991987 - protein, 5 aa, Staphylococcus
TSYDS

SEQ ID NO: 1991988 - protein, 8 aa, Staphylococcus
TSYDTSSQ

SEQ ID NO: 1991989 - protein, 11 aa, Staphylococcus
TSYGPNSIEGT

SEQ ID NO: 1991990 - protein, 5 aa, Staphylococcus
TSYPK

SEQ ID NO: 1991991 - protein, 5 aa, Staphylococcus
TSYPQ

SEQ ID NO: 1991992 - protein, 4 aa, Staphylococcus
TSYS

SEQ ID NO: 1991993 - protein, 10 aa, Staphylococcus
TSYVNGDGQP

SEQ ID NO: 1991994 - protein, 6 aa, Staphylococcus
TTAANV

SEQ ID NO: 1991995 - protein, 10 aa, Staphylococcus
TTADSKETFK

SEQ ID NO: 1991996 - protein, 5 aa, Staphylococcus
TTAEL

SEQ ID NO: 1991997 - protein, 5 aa, Staphylococcus
TTAEN

SEQ ID NO: 1991998 - protein, 6 aa, Staphylococcus
TTAGEM

SEQ ID NO: 1991999 - protein, 12 aa, Staphylococcus
TTAGGGTDAGSI

SEQ ID NO: 1992000 - protein, 10 aa, Staphylococcus
TTAGNYELNT

SEQ ID NO: 1992001 - protein, 4 aa, Staphylococcus
TTAH

SEQ ID NO: 1992002 - protein, 4 aa, Staphylococcus
TTAK

SEQ ID NO: 1992003 - protein, 5 aa, Staphylococcus
TTAKA

SEQ ID NO: 1992004 - protein, 12 aa, Staphylococcus
TTAKASKHSPVA

SEQ ID NO: 1992005 - protein, 12 aa, Staphylococcus
TTAKQGQHSPVA

SEQ ID NO: 1992006 - protein, 15 aa, Staphylococcus
TTANLANGQSPKDAV

SEQ ID NO: 1992007 - protein, 7 aa, Staphylococcus
TTAPSRN

SEQ ID NO: 1992008 - protein, 9 aa, Staphylococcus
TTAQSRAEM

SEQ ID NO: 1992009 - protein, 10 aa, Staphylococcus
TTASAAAATL

SEQ ID NO: 1992010 - protein, 5 aa, Staphylococcus
TTATG

SEQ ID NO: 1992011 - protein, 9 aa, Staphylococcus
TTATSQKPL

SEQ ID NO: 1992012 - protein, 9 aa, Staphylococcus
TTATSQTPV

SEQ ID NO: 1992013 - protein, 10 aa, Staphylococcus
TTATTQITVP

SEQ ID NO: 1992014 - protein, 11 aa, Staphylococcus
TTAYNADFDGD

SEQ ID NO: 1992015 - protein, 10 aa, Staphylococcus
TTCGPNPTYP

SEQ ID NO: 1992016 - protein, 4 aa, Staphylococcus
TTCP

SEQ ID NO: 1992017 - protein, 4 aa, Staphylococcus
TTCV

SEQ ID NO: 1992018 - protein, 9 aa, Staphylococcus
TTDADHVKE

SEQ ID NO: 1992019 - protein, 6 aa, Staphylococcus
TTDADI

SEQ ID NO: 1992020 - protein, 19 aa, Staphylococcus
TTDAGTGAVHTAPGHGEDD

SEQ ID NO: 1992021 - protein, 8 aa, Staphylococcus
TTDAGTGC

SEQ ID NO: 1992022 - protein, 15 aa, Staphylococcus
TTDASSLLGDNPNNV

SEQ ID NO: 1992023 - protein, 5 aa, Staphylococcus
TTDDL

SEQ ID NO: 1992024 - protein, 5 aa, Staphylococcus
TTDDM

SEQ ID NO: 1992025 - protein, 14 aa, Staphylococcus
TTDDNIGNGESIFD

SEQ ID NO: 1992026 - protein, 10 aa, Staphylococcus
TTDEGSVNEI

SEQ ID NO: 1992027 - protein, 13 aa, Staphylococcus
TTDEGSVNEIDEN

SEQ ID NO: 1992028 - protein, 10 aa, Staphylococcus
TTDEGSVNQI

SEQ ID NO: 1992029 - protein, 14 aa, Staphylococcus
TTDEGSVNQIDDNT

SEQ ID NO: 1992030 - protein, 13 aa, Staphylococcus
TTDEGTVNEIDEN

SEQ ID NO: 1992031 - protein, 5 aa, Staphylococcus
TTDGI

SEQ ID NO: 1992032 - protein, 8 aa, Staphylococcus
TTDGTSTI

SEQ ID NO: 1992033 - protein, 8 aa, Staphylococcus
TTDGTYEA

SEQ ID NO: 1992034 - protein, 9 aa, Staphylococcus
TTDHVSSNF

SEQ ID NO: 1992035 - protein, 6 aa, Staphylococcus
TTDIDS

SEQ ID NO: 1992036 - protein, 7 aa, Staphylococcus
TTDIEDG

SEQ ID NO: 1992037 - protein, 7 aa, Staphylococcus
TTDIENG

SEQ ID NO: 1992038 - protein, 21 aa, Staphylococcus
TTDIKPKMNDSISNSKLPDDI

SEQ ID NO: 1992039 - protein, 5 aa, Staphylococcus
TTDIN

SEQ ID NO: 1992040 - protein, 7 aa, Staphylococcus
TTDIQDG

SEQ ID NO: 1992041 - protein, 11 aa, Staphylococcus
TTDKEKGALKQ

SEQ ID NO: 1992042 - protein, 19 aa, Staphylococcus
TTDKPVEMGTTKTVDPNYQ

SEQ ID NO: 1992043 - protein, 8 aa, Staphylococcus
TTDLTDEQ

SEQ ID NO: 1992044 - protein, 6 aa, Staphylococcus
TTDNEI

SEQ ID NO: 1992045 - protein, 8 aa, Staphylococcus
TTDNSEED

SEQ ID NO: 1992046 - protein, 7 aa, Staphylococcus
TTDPGMG

SEQ ID NO: 1992047 - protein, 17 aa, Staphylococcus
TTDPTKEINVETTSNLN

SEQ ID NO: 1992048 - protein, 5 aa, Staphylococcus
TTDQE

SEQ ID NO: 1992049 - protein, 8 aa, Staphylococcus
TTDRPPYT

SEQ ID NO: 1992050 - protein, 15 aa, Staphylococcus
TTDSGTNSKSSKADG

SEQ ID NO: 1992051 - protein, 11 aa, Staphylococcus
TTDSRTAKEGS

SEQ ID NO: 1992052 - protein, 5 aa, Staphylococcus
TTDTY

SEQ ID NO: 1992053 - protein, 5 aa, Staphylococcus
TTDYQ

SEQ ID NO: 1992054 - protein, 9 aa, Staphylococcus
TTEAAEKLA

SEQ ID NO: 1992055 - protein, 8 aa, Staphylococcus
TTEADVNR

SEQ ID NO: 1992056 - protein, 9 aa, Staphylococcus
TTEANGNYT

SEQ ID NO: 1992057 - protein, 4 aa, Staphylococcus
TTED

SEQ ID NO: 1992058 - protein, 6 aa, Staphylococcus
TTEDER

SEQ ID NO: 1992059 - protein, 8 aa, Staphylococcus
TTEDNKEA

SEQ ID NO: 1992060 - protein, 5 aa, Staphylococcus
TTEDP

SEQ ID NO: 1992061 - protein, 11 aa, Staphylococcus
TTEDPENDFMP

SEQ ID NO: 1992062 - protein, 6 aa, Staphylococcus
TTEDPL

SEQ ID NO: 1992063 - protein, 13 aa, Staphylococcus
TTEDPSNDFMPDS

SEQ ID NO: 1992064 - protein, 12 aa, Staphylococcus
TTEDPTNDFMPD

SEQ ID NO: 1992065 - protein, 13 aa, Staphylococcus
TTEDPTNDFMPDS

SEQ ID NO: 1992066 - protein, 13 aa, Staphylococcus
TTEDPTNNFMPDS

SEQ ID NO: 1992067 - protein, 6 aa, Staphylococcus
TTEEDI

SEQ ID NO: 1992068 - protein, 6 aa, Staphylococcus
TTEEIT

SEQ ID NO: 1992069 - protein, 5 aa, Staphylococcus
TTEEL

SEQ ID NO: 1992070 - protein, 10 aa, Staphylococcus
TTEESGANQL

SEQ ID NO: 1992071 - protein, 6 aa, Staphylococcus
TTEEYE

SEQ ID NO: 1992072 - protein, 5 aa, Staphylococcus
TTEGI

SEQ ID NO: 1992073 - protein, 14 aa, Staphylococcus
TTEGSLSEAGGPQY

SEQ ID NO: 1992074 - protein, 14 aa, Staphylococcus
TTEHKAKQHEENEM

SEQ ID NO: 1992075 - protein, 9 aa, Staphylococcus
TTEHLSTET

SEQ ID NO: 1992076 - protein, 6 aa, Staphylococcus
TTEHPK

SEQ ID NO: 1992077 - protein, 5 aa, Staphylococcus
TTEHQ

SEQ ID NO: 1992078 - protein, 5 aa, Staphylococcus
TTEHR

SEQ ID NO: 1992079 - protein, 17 aa, Staphylococcus
TTEIKNAPLPNNKVESL

SEQ ID NO: 1992080 - protein, 14 aa, Staphylococcus
TTEKDFVNNSDDYK

SEQ ID NO: 1992081 - protein, 10 aa, Staphylococcus
TTEKPPNAYR

SEQ ID NO: 1992082 - protein, 6 aa, Staphylococcus
TTEKQL

SEQ ID NO: 1992083 - protein, 6 aa, Staphylococcus
TTELPL

SEQ ID NO: 1992084 - protein, 24 aa, Staphylococcus
TTELPRDEVSTVSTKTPYVSTGSD

SEQ ID NO: 1992085 - protein, 16 aa, Staphylococcus
TTENDKKDKTPDSQKN

SEQ ID NO: 1992086 - protein, 8 aa, Staphylococcus
TTEPDKVQ

SEQ ID NO: 1992087 - protein, 20 aa, Staphylococcus
TTEPIDGRSTTYSSDIAKGY

SEQ ID NO: 1992088 - protein, 20 aa, Staphylococcus
TTEPIDGRSTTYSSDVAKGY

SEQ ID NO: 1992089 - protein, 19 aa, Staphylococcus
TTEPVDGRSTTYSTDIAKG

SEQ ID NO: 1992090 - protein, 6 aa, Staphylococcus
TTEQLT

SEQ ID NO: 1992091 - protein, 5 aa, Staphylococcus
TTERA

SEQ ID NO: 1992092 - protein, 7 aa, Staphylococcus
TTERAPY

SEQ ID NO: 1992093 - protein, 7 aa, Staphylococcus
TTEREPF

SEQ ID NO: 1992094 - protein, 11 aa, Staphylococcus
TTERPEGVEAG

SEQ ID NO: 1992095 - protein, 11 aa, Staphylococcus
TTERPEGVSAG

SEQ ID NO: 1992096 - protein, 10 aa, Staphylococcus
TTERQGEHGF

SEQ ID NO: 1992097 - protein, 7 aa, Staphylococcus
TTESEIE

SEQ ID NO: 1992098 - protein, 9 aa, Staphylococcus
TTESGETIE

SEQ ID NO: 1992099 - protein, 11 aa, Staphylococcus
TTESVQEGQTR

SEQ ID NO: 1992100 - protein, 12 aa, Staphylococcus
TTETNYKVTPEA

SEQ ID NO: 1992101 - protein, 6 aa, Staphylococcus
TTETTQ

SEQ ID NO: 1992102 - protein, 8 aa, Staphylococcus
TTETYEQL

SEQ ID NO: 1992103 - protein, 9 aa, Staphylococcus
TTEYDTSSQ

SEQ ID NO: 1992104 - protein, 4 aa, Staphylococcus
TTFD

SEQ ID NO: 1992105 - protein, 8 aa, Staphylococcus
TTFEEKEH

SEQ ID NO: 1992106 - protein, 10 aa, Staphylococcus
TTFETQKSRM

SEQ ID NO: 1992107 - protein, 4 aa, Staphylococcus
TTFN

SEQ ID NO: 1992108 - protein, 4 aa, Staphylococcus
TTFQ

SEQ ID NO: 1992109 - protein, 5 aa, Staphylococcus
TTFQQ

SEQ ID NO: 1992110 - protein, 11 aa, Staphylococcus
TTGASPASHVD

SEQ ID NO: 1992111 - protein, 5 aa, Staphylococcus
TTGDI

SEQ ID NO: 1992112 - protein, 5 aa, Staphylococcus
TTGEA

SEQ ID NO: 1992113 - protein, 13 aa, Staphylococcus
TTGEEKEQEGAKR

SEQ ID NO: 1992114 - protein, 15 aa, Staphylococcus
TTGEEMEQLGSQNLY

SEQ ID NO: 1992115 - protein, 15 aa, Staphylococcus
TTGEFPKYGNNDARV

SEQ ID NO: 1992116 - protein, 8 aa, Staphylococcus
TTGEKDTL

SEQ ID NO: 1992117 - protein, 12 aa, Staphylococcus
TTGEKEKITEKL

SEQ ID NO: 1992118 - protein, 11 aa, Staphylococcus
TTGEKEKITQK

SEQ ID NO: 1992119 - protein, 8 aa, Staphylococcus
TTGEKEQI

SEQ ID NO: 1992120 - protein, 10 aa, Staphylococcus
TTGEKEQLTA

SEQ ID NO: 1992121 - protein, 7 aa, Staphylococcus
TTGELNG

SEQ ID NO: 1992122 - protein, 6 aa, Staphylococcus
TTGERV

SEQ ID NO: 1992123 - protein, 9 aa, Staphylococcus
TTGHAGQSI

SEQ ID NO: 1992124 - protein, 6 aa, Staphylococcus
TTGHTI

SEQ ID NO: 1992125 - protein, 5 aa, Staphylococcus
TTGLH

SEQ ID NO: 1992126 - protein, 18 aa, Staphylococcus
TTGNAQNNTGWGSKEYDN

SEQ ID NO: 1992127 - protein, 9 aa, Staphylococcus
TTGNDKRQK

SEQ ID NO: 1992128 - protein, 5 aa, Staphylococcus
TTGNE

SEQ ID NO: 1992129 - protein, 16 aa, Staphylococcus
TTGNSQNNTEWSNKEY

SEQ ID NO: 1992130 - protein, 11 aa, Staphylococcus
TTGNSRAYSPR

SEQ ID NO: 1992131 - protein, 12 aa, Staphylococcus
TTGPKAKQFEEN

SEQ ID NO: 1992132 - protein, 12 aa, Staphylococcus
TTGQNALSQARS

SEQ ID NO: 1992133 - protein, 9 aa, Staphylococcus
TTGRAHMTK

SEQ ID NO: 1992134 - protein, 5 aa, Staphylococcus
TTGRE

SEQ ID NO: 1992135 - protein, 7 aa, Staphylococcus
TTGRNDL

SEQ ID NO: 1992136 - protein, 10 aa, Staphylococcus
TTGRQHMTKT

SEQ ID NO: 1992137 - protein, 10 aa, Staphylococcus
TTGSDSGKEL

SEQ ID NO: 1992138 - protein, 6 aa, Staphylococcus
TTGSHA

SEQ ID NO: 1992139 - protein, 12 aa, Staphylococcus
TTHDVKSASLSD

SEQ ID NO: 1992140 - protein, 20 aa, Staphylococcus
TTHGKFDEKVEATENGIRYK

SEQ ID NO: 1992141 - protein, 6 aa, Staphylococcus
TTHGRF

SEQ ID NO: 1992142 - protein, 15 aa, Staphylococcus
TTHGRYDKKVEPIED

SEQ ID NO: 1992143 - protein, 15 aa, Staphylococcus
TTHGRYDKRVEPIES

SEQ ID NO: 1992144 - protein, 17 aa, Staphylococcus
TTHGTYDKKVEATENGI

SEQ ID NO: 1992145 - protein, 22 aa, Staphylococcus
TTHIGGGTGASEGAKATTVAPG

SEQ ID NO: 1992146 - protein, 22 aa, Staphylococcus
TTHIGGGTGASEGAKATTVTPG

SEQ ID NO: 1992147 - protein, 5 aa, Staphylococcus
TTHND

SEQ ID NO: 1992148 - protein, 6 aa, Staphylococcus
TTHNHD

SEQ ID NO: 1992149 - protein, 10 aa, Staphylococcus
TTHNPDAYTH

SEQ ID NO: 1992150 - protein, 5 aa, Staphylococcus
TTHPG

SEQ ID NO: 1992151 - protein, 6 aa, Staphylococcus
TTHPSS

SEQ ID NO: 1992152 - protein, 13 aa, Staphylococcus
TTHRTYQTNEPLN

SEQ ID NO: 1992153 - protein, 13 aa, Staphylococcus
TTIDEALSSANVT

SEQ ID NO: 1992154 - protein, 9 aa, Staphylococcus
TTIDGPKLS

SEQ ID NO: 1992155 - protein, 12 aa, Staphylococcus
TTIESDKHFDGG

SEQ ID NO: 1992156 - protein, 9 aa, Staphylococcus
TTIGGESKK

SEQ ID NO: 1992157 - protein, 12 aa, Staphylococcus
TTILGADDKAGL

SEQ ID NO: 1992158 - protein, 17 aa, Staphylococcus
TTINGKTAHASTPNEGI

SEQ ID NO: 1992159 - protein, 13 aa, Staphylococcus
TTINNAMKNYGKK

SEQ ID NO: 1992160 - protein, 6 aa, Staphylococcus
TTIPQT

SEQ ID NO: 1992161 - protein, 5 aa, Staphylococcus
TTISA

SEQ ID NO: 1992162 - protein, 6 aa, Staphylococcus
TTITKN

SEQ ID NO: 1992163 - protein, 6 aa, Staphylococcus
TTIVEQ

SEQ ID NO: 1992164 - protein, 40 aa, Staphylococcus
TTIYAPQKTFKPHTQQTKQGDRPYGGVAPKGMTSAQYAEL

SEQ ID NO: 1992165 - protein, 4 aa, Staphylococcus
TTKA

SEQ ID NO: 1992166 - protein, 9 aa, Staphylococcus
TTKAERKKQ

SEQ ID NO: 1992167 - protein, 5 aa, Staphylococcus
TTKAH

SEQ ID NO: 1992168 - protein, 9 aa, Staphylococcus
TTKDDAQNK

SEQ ID NO: 1992169 - protein, 8 aa, Staphylococcus
TTKDDQLD

SEQ ID NO: 1992170 - protein, 6 aa, Staphylococcus
TTKDKE

SEQ ID NO: 1992171 - protein, 5 aa, Staphylococcus
TTKDV

SEQ ID NO: 1992172 - protein, 6 aa, Staphylococcus
TTKEAF

SEQ ID NO: 1992173 - protein, 6 aa, Staphylococcus
TTKEAP

SEQ ID NO: 1992174 - protein, 10 aa, Staphylococcus
TTKERSPFKT

SEQ ID NO: 1992175 - protein, 14 aa, Staphylococcus
TTKEVKETKEGLKS

SEQ ID NO: 1992176 - protein, 15 aa, Staphylococcus
TTKEVRETKEGLKSG

SEQ ID NO: 1992177 - protein, 4 aa, Staphylococcus
TTKF

SEQ ID NO: 1992178 - protein, 5 aa, Staphylococcus
TTKGI

SEQ ID NO: 1992179 - protein, 14 aa, Staphylococcus
TTKGKDIKEPLSNI

SEQ ID NO: 1992180 - protein, 19 aa, Staphylococcus
TTKGLSSIDTADDINEGQR

SEQ ID NO: 1992181 - protein, 12 aa, Staphylococcus
TTKKKKGEDEKE

SEQ ID NO: 1992182 - protein, 12 aa, Staphylococcus
TTKKKQANDEKE

SEQ ID NO: 1992183 - protein, 15 aa, Staphylococcus
TTKKSEAIQLINQLF

SEQ ID NO: 1992184 - protein, 11 aa, Staphylococcus
TTKLDANTESL

SEQ ID NO: 1992185 - protein, 8 aa, Staphylococcus
TTKLGGQA

SEQ ID NO: 1992186 - protein, 10 aa, Staphylococcus
TTKLSEDDIT

SEQ ID NO: 1992187 - protein, 9 aa, Staphylococcus
TTKPKDCKI

SEQ ID NO: 1992188 - protein, 7 aa, Staphylococcus
TTKPNDM

SEQ ID NO: 1992189 - protein, 13 aa, Staphylococcus
TTKQQSLAAQKQT

SEQ ID NO: 1992190 - protein, 14 aa, Staphylococcus
TTKQQSLAAQKQTI

SEQ ID NO: 1992191 - protein, 9 aa, Staphylococcus
TTKRNKGQV

SEQ ID NO: 1992192 - protein, 4 aa, Staphylococcus
TTKS

SEQ ID NO: 1992193 - protein, 10 aa, Staphylococcus
TTKSDAQSRL

SEQ ID NO: 1992194 - protein, 13 aa, Staphylococcus
TTKSQFKVTPEQI

SEQ ID NO: 1992195 - protein, 4 aa, Staphylococcus
TTKT

SEQ ID NO: 1992196 - protein, 6 aa, Staphylococcus
TTKTNM

SEQ ID NO: 1992197 - protein, 8 aa, Staphylococcus
TTKTTVTG

SEQ ID NO: 1992198 - protein, 4 aa, Staphylococcus
TTKV

SEQ ID NO: 1992199 - protein, 14 aa, Staphylococcus
TTKVEDVSQRLDNK

SEQ ID NO: 1992200 - protein, 9 aa, Staphylococcus
TTKVKNGPT

SEQ ID NO: 1992201 - protein, 6 aa, Staphylococcus
TTKVSE

SEQ ID NO: 1992202 - protein, 11 aa, Staphylococcus
TTLASKGDEIL

SEQ ID NO: 1992203 - protein, 7 aa, Staphylococcus
TTLGEQG

SEQ ID NO: 1992204 - protein, 28 aa, Staphylococcus
TTLKGKELDVDTTEIENAPLPNNKVESL

SEQ ID NO: 1992205 - protein, 8 aa, Staphylococcus
TTLNETKR

SEQ ID NO: 1992206 - protein, 6 aa, Staphylococcus
TTLNNQ

SEQ ID NO: 1992207 - protein, 9 aa, Staphylococcus
TTLPSEGDA

SEQ ID NO: 1992208 - protein, 11 aa, Staphylococcus
TTLQNKGPRRV

SEQ ID NO: 1992209 - protein, 7 aa, Staphylococcus
TTLSNKG

SEQ ID NO: 1992210 - protein, 9 aa, Staphylococcus
TTLTDSDQF

SEQ ID NO: 1992211 - protein, 15 aa, Staphylococcus
TTLTESDQKNYQSRL

SEQ ID NO: 1992212 - protein, 10 aa, Staphylococcus
TTLTETDKVK

SEQ ID NO: 1992213 - protein, 15 aa, Staphylococcus
TTLTKGETKIVDVTT

SEQ ID NO: 1992214 - protein, 12 aa, Staphylococcus
TTLTSADQSIYQ

SEQ ID NO: 1992215 - protein, 8 aa, Staphylococcus
TTMKEREV

SEQ ID NO: 1992216 - protein, 11 aa, Staphylococcus
TTMKPKELRTR

SEQ ID NO: 1992217 - protein, 6 aa, Staphylococcus
TTNAEV

SEQ ID NO: 1992218 - protein, 11 aa, Staphylococcus
TTNAHQPDSAT

SEQ ID NO: 1992219 - protein, 11 aa, Staphylococcus
TTNAHQPNEDT

SEQ ID NO: 1992220 - protein, 10 aa, Staphylococcus
TTNEEYRGMG

SEQ ID NO: 1992221 - protein, 10 aa, Staphylococcus
TTNEHQPDSE

SEQ ID NO: 1992222 - protein, 16 aa, Staphylococcus
TTNELNGAYTADGYAR

SEQ ID NO: 1992223 - protein, 16 aa, Staphylococcus
TTNELNGSYAADGYAR

SEQ ID NO: 1992224 - protein, 12 aa, Staphylococcus
TTNESGADDKIK

SEQ ID NO: 1992225 - protein, 6 aa, Staphylococcus
TTNGAY

SEQ ID NO: 1992226 - protein, 7 aa, Staphylococcus
TTNIKQN

SEQ ID NO: 1992227 - protein, 11 aa, Staphylococcus
TTNKDEQRKQL

SEQ ID NO: 1992228 - protein, 5 aa, Staphylococcus
TTNLT

SEQ ID NO: 1992229 - protein, 9 aa, Staphylococcus
TTNNQREPL

SEQ ID NO: 1992230 - protein, 11 aa, Staphylococcus
TTNNSSKELIQ

SEQ ID NO: 1992231 - protein, 18 aa, Staphylococcus
TTNNTARELTLTKDSKKI

SEQ ID NO: 1992232 - protein, 4 aa, Staphylococcus
TTNP

SEQ ID NO: 1992233 - protein, 10 aa, Staphylococcus
TTNPKNVASQ

SEQ ID NO: 1992234 - protein, 4 aa, Staphylococcus
TTNQ

SEQ ID NO: 1992235 - protein, 8 aa, Staphylococcus
TTNRNSRR

SEQ ID NO: 1992236 - protein, 14 aa, Staphylococcus
TTNSDVKASQKEAL

SEQ ID NO: 1992237 - protein, 8 aa, Staphylococcus
TTNVGKST

SEQ ID NO: 1992238 - protein, 4 aa, Staphylococcus
TTNY

SEQ ID NO: 1992239 - protein, 6 aa, Staphylococcus
TTPAGH

SEQ ID NO: 1992240 - protein, 13 aa, Staphylococcus
TTPAGMDKNNDSV

SEQ ID NO: 1992241 - protein, 10 aa, Staphylococcus
TTPAGMSENQ

SEQ ID NO: 1992242 - protein, 9 aa, Staphylococcus
TTPATATGV

SEQ ID NO: 1992243 - protein, 6 aa, Staphylococcus
TTPDEK

SEQ ID NO: 1992244 - protein, 9 aa, Staphylococcus
TTPEATSYT

SEQ ID NO: 1992245 - protein, 35 aa, Staphylococcus
TTPEHQEEVKAYQKEASMKSDLERTDLAKDKSGVF

SEQ ID NO: 1992246 - protein, 10 aa, Staphylococcus
TTPEKAAQDV

SEQ ID NO: 1992247 - protein, 9 aa, Staphylococcus
TTPEPHMDG

SEQ ID NO: 1992248 - protein, 5 aa, Staphylococcus
TTPEY

SEQ ID NO: 1992249 - protein, 4 aa, Staphylococcus
TTPF

SEQ ID NO: 1992250 - protein, 6 aa, Staphylococcus
TTPFKE

SEQ ID NO: 1992251 - protein, 12 aa, Staphylococcus
TTPFKQKSKEKV

SEQ ID NO: 1992252 - protein, 12 aa, Staphylococcus
TTPGGGTDAGSI

SEQ ID NO: 1992253 - protein, 7 aa, Staphylococcus
TTPGSAD

SEQ ID NO: 1992254 - protein, 5 aa, Staphylococcus
TTPHT

SEQ ID NO: 1992255 - protein, 6 aa, Staphylococcus
TTPHTM

SEQ ID NO: 1992256 - protein, 13 aa, Staphylococcus
TTPIKKVTAPQDV

SEQ ID NO: 1992257 - protein, 7 aa, Staphylococcus
TTPIQGA

SEQ ID NO: 1992258 - protein, 5 aa, Staphylococcus
TTPKR

SEQ ID NO: 1992259 - protein, 9 aa, Staphylococcus
TTPKYDVPR

SEQ ID NO: 1992260 - protein, 4 aa, Staphylococcus
TTPL

SEQ ID NO: 1992261 - protein, 15 aa, Staphylococcus
TTPLGHDSKQEIATP

SEQ ID NO: 1992262 - protein, 17 aa, Staphylococcus
TTPLGHDSKQEISTPFG

SEQ ID NO: 1992263 - protein, 5 aa, Staphylococcus
TTPLH

SEQ ID NO: 1992264 - protein, 13 aa, Staphylococcus
TTPLKKVTTPQDV

SEQ ID NO: 1992265 - protein, 5 aa, Staphylococcus
TTPLR

SEQ ID NO: 1992266 - protein, 4 aa, Staphylococcus
TTPN

SEQ ID NO: 1992267 - protein, 16 aa, Staphylococcus
TTPNQDNPITEGKTPI

SEQ ID NO: 1992268 - protein, 5 aa, Staphylococcus
TTPQT

SEQ ID NO: 1992269 - protein, 12 aa, Staphylococcus
TTPRGGTDAGSI

SEQ ID NO: 1992270 - protein, 8 aa, Staphylococcus
TTPSADGT

SEQ ID NO: 1992271 - protein, 8 aa, Staphylococcus
TTPSSSEI

SEQ ID NO: 1992272 - protein, 11 aa, Staphylococcus
TTQDKDGNLNA

SEQ ID NO: 1992273 - protein, 14 aa, Staphylococcus
TTQDKHDPISDSER

SEQ ID NO: 1992274 - protein, 5 aa, Staphylococcus
TTQDN

SEQ ID NO: 1992275 - protein, 4 aa, Staphylococcus
TTQE

SEQ ID NO: 1992276 - protein, 5 aa, Staphylococcus
TTQEQ

SEQ ID NO: 1992277 - protein, 7 aa, Staphylococcus
TTQETLN

SEQ ID NO: 1992278 - protein, 7 aa, Staphylococcus
TTQGQVN

SEQ ID NO: 1992279 - protein, 7 aa, Staphylococcus
TTQIEEA

SEQ ID NO: 1992280 - protein, 8 aa, Staphylococcus
TTQPTDAN

SEQ ID NO: 1992281 - protein, 8 aa, Staphylococcus
TTQQREAL

SEQ ID NO: 1992282 - protein, 5 aa, Staphylococcus
TTQQV

SEQ ID NO: 1992283 - protein, 4 aa, Staphylococcus
TTQT

SEQ ID NO: 1992284 - protein, 7 aa, Staphylococcus
TTQTKDI

SEQ ID NO: 1992285 - protein, 7 aa, Staphylococcus
TTQTNTR

SEQ ID NO: 1992286 - protein, 134 aa, Staphylococcus
TTQTTTAETNTSSTKDNTSKTTDSHSTKTSQSTPLTESKELTPSKTQQDSNVNQDAIKNNDVEAPSTGKTNDTVDTTETKQTVTAKQPTDPAAPTVNTLNTKDEAISIDGTTNETVGHKDAKDQKNSQAGLETL

SEQ ID NO: 1992287 - protein, 4 aa, Staphylococcus
TTQV

SEQ ID NO: 1992288 - protein, 11 aa, Staphylococcus
TTQVATEPNND

SEQ ID NO: 1992289 - protein, 5 aa, Staphylococcus
TTQYD

SEQ ID NO: 1992290 - protein, 4 aa, Staphylococcus
TTRA

SEQ ID NO: 1992291 - protein, 8 aa, Staphylococcus
TTRAAAEL

SEQ ID NO: 1992292 - protein, 11 aa, Staphylococcus
TTRAGSLTAPL

SEQ ID NO: 1992293 - protein, 13 aa, Staphylococcus
TTREDGKSPYPRD

SEQ ID NO: 1992294 - protein, 6 aa, Staphylococcus
TTREGG

SEQ ID NO: 1992295 - protein, 13 aa, Staphylococcus
TTREGGSSPYPER

SEQ ID NO: 1992296 - protein, 13 aa, Staphylococcus
TTREGGYSLYPES

SEQ ID NO: 1992297 - protein, 9 aa, Staphylococcus
TTRENGLSH

SEQ ID NO: 1992298 - protein, 23 aa, Staphylococcus
TTRKRDGLTSSNKVEDGGLSGQP

SEQ ID NO: 1992299 - protein, 6 aa, Staphylococcus
TTRKVG

SEQ ID NO: 1992300 - protein, 8 aa, Staphylococcus
TTRLTDEQ

SEQ ID NO: 1992301 - protein, 6 aa, Staphylococcus
TTRNKK

SEQ ID NO: 1992302 - protein, 23 aa, Staphylococcus
TTRPQENKNFSSNGSNNASSNNV

SEQ ID NO: 1992303 - protein, 22 aa, Staphylococcus
TTRPQENKNFSSNNGNNSSNNV

SEQ ID NO: 1992304 - protein, 23 aa, Staphylococcus
TTRQRGGLSSPNKVEDGGLSGRP

SEQ ID NO: 1992305 - protein, 23 aa, Staphylococcus
TTRRREGLSSDNKNEEGGLSGRP

SEQ ID NO: 1992306 - protein, 9 aa, Staphylococcus
TTRSDLRKE

SEQ ID NO: 1992307 - protein, 10 aa, Staphylococcus
TTSAKDIAEA

SEQ ID NO: 1992308 - protein, 10 aa, Staphylococcus
TTSASPDEIE

SEQ ID NO: 1992309 - protein, 10 aa, Staphylococcus
TTSATPDEIE

SEQ ID NO: 1992310 - protein, 9 aa, Staphylococcus
TTSATPNEI

SEQ ID NO: 1992311 - protein, 9 aa, Staphylococcus
TTSDQQLSK

SEQ ID NO: 1992312 - protein, 4 aa, Staphylococcus
TTSE

SEQ ID NO: 1992313 - protein, 17 aa, Staphylococcus
TTSEHGKQKLENAGVQP

SEQ ID NO: 1992314 - protein, 21 aa, Staphylococcus
TTSEQERNEITASPLKASVEE

SEQ ID NO: 1992315 - protein, 6 aa, Staphylococcus
TTSERI

SEQ ID NO: 1992316 - protein, 7 aa, Staphylococcus
TTSERIS

SEQ ID NO: 1992317 - protein, 8 aa, Staphylococcus
TTSGESTI

SEQ ID NO: 1992318 - protein, 9 aa, Staphylococcus
TTSGFQGNA

SEQ ID NO: 1992319 - protein, 14 aa, Staphylococcus
TTSGISQRPIPGVK

SEQ ID NO: 1992320 - protein, 13 aa, Staphylococcus
TTSGRSKFHSNEI

SEQ ID NO: 1992321 - protein, 8 aa, Staphylococcus
TTSIKIGS

SEQ ID NO: 1992322 - protein, 7 aa, Staphylococcus
TTSIPKG

SEQ ID NO: 1992323 - protein, 11 aa, Staphylococcus
TTSLSGGEAQR

SEQ ID NO: 1992324 - protein, 4 aa, Staphylococcus
TTSQ

SEQ ID NO: 1992325 - protein, 6 aa, Staphylococcus
TTSQTL

SEQ ID NO: 1992326 - protein, 15 aa, Staphylococcus
TTSQTYFPKDNSAYF

SEQ ID NO: 1992327 - protein, 16 aa, Staphylococcus
TTSSETYPTHLNEQSQ

SEQ ID NO: 1992328 - protein, 5 aa, Staphylococcus
TTSSQ

SEQ ID NO: 1992329 - protein, 9 aa, Staphylococcus
TTSSTQSLQ

SEQ ID NO: 1992330 - protein, 6 aa, Staphylococcus
TTSSYT

SEQ ID NO: 1992331 - protein, 11 aa, Staphylococcus
TTSVATRGQAP

SEQ ID NO: 1992332 - protein, 10 aa, Staphylococcus
TTSVQNTKNT

SEQ ID NO: 1992333 - protein, 7 aa, Staphylococcus
TTTDNGL

SEQ ID NO: 1992334 - protein, 4 aa, Staphylococcus
TTTE

SEQ ID NO: 1992335 - protein, 9 aa, Staphylococcus
TTTEMTNQM

SEQ ID NO: 1992336 - protein, 12 aa, Staphylococcus
TTTEPNEGDRFD

SEQ ID NO: 1992337 - protein, 7 aa, Staphylococcus
TTTGDIQ

SEQ ID NO: 1992338 - protein, 8 aa, Staphylococcus
TTTGESTL

SEQ ID NO: 1992339 - protein, 9 aa, Staphylococcus
TTTHGKTQI

SEQ ID NO: 1992340 - protein, 13 aa, Staphylococcus
TTTHKTLRGPRGG

SEQ ID NO: 1992341 - protein, 4 aa, Staphylococcus
TTTK

SEQ ID NO: 1992342 - protein, 7 aa, Staphylococcus
TTTKDTY

SEQ ID NO: 1992343 - protein, 16 aa, Staphylococcus
TTTMGPGVKIDTSSFK

SEQ ID NO: 1992344 - protein, 16 aa, Staphylococcus
TTTMGPGVKVDTASFK

SEQ ID NO: 1992345 - protein, 16 aa, Staphylococcus
TTTMGPGVKVDTSNFK

SEQ ID NO: 1992346 - protein, 5 aa, Staphylococcus
TTTNK

SEQ ID NO: 1992347 - protein, 9 aa, Staphylococcus
TTTPKYNVK

SEQ ID NO: 1992348 - protein, 15 aa, Staphylococcus
TTTPLTGVDKQPGIH

SEQ ID NO: 1992349 - protein, 12 aa, Staphylococcus
TTTQHTNNEVEE

SEQ ID NO: 1992350 - protein, 7 aa, Staphylococcus
TTTQNER

SEQ ID NO: 1992351 - protein, 6 aa, Staphylococcus
TTTRRK

SEQ ID NO: 1992352 - protein, 12 aa, Staphylococcus
TTTSDESRKQLP

SEQ ID NO: 1992353 - protein, 11 aa, Staphylococcus
TTTSQKTIDGT

SEQ ID NO: 1992354 - protein, 23 aa, Staphylococcus
TTTTFSNPQLQQDIEANPDKKGL

SEQ ID NO: 1992355 - protein, 9 aa, Staphylococcus
TTTTNGKEA

SEQ ID NO: 1992356 - protein, 8 aa, Staphylococcus
TTTTNQYY

SEQ ID NO: 1992357 - protein, 12 aa, Staphylococcus
TTTTTSKLGSET

SEQ ID NO: 1992358 - protein, 7 aa, Staphylococcus
TTTVTDG

SEQ ID NO: 1992359 - protein, 17 aa, Staphylococcus
TTTYNNNENLDEDKEHY

SEQ ID NO: 1992360 - protein, 9 aa, Staphylococcus
TTVDGPKLS

SEQ ID NO: 1992361 - protein, 8 aa, Staphylococcus
TTVEDSKK

SEQ ID NO: 1992362 - protein, 13 aa, Staphylococcus
TTVEEAIENEKAG

SEQ ID NO: 1992363 - protein, 12 aa, Staphylococcus
TTVLGADDKAGL

SEQ ID NO: 1992364 - protein, 17 aa, Staphylococcus
TTVLNDENGIKDIPQTL

SEQ ID NO: 1992365 - protein, 11 aa, Staphylococcus
TTVPKGASNKV

SEQ ID NO: 1992366 - protein, 7 aa, Staphylococcus
TTVPNVG

SEQ ID NO: 1992367 - protein, 6 aa, Staphylococcus
TTVQGT

SEQ ID NO: 1992368 - protein, 9 aa, Staphylococcus
TTVQKELPA

SEQ ID NO: 1992369 - protein, 9 aa, Staphylococcus
TTVTSPNQT

SEQ ID NO: 1992370 - protein, 17 aa, Staphylococcus
TTYDNNGRPKDDEKRYP

SEQ ID NO: 1992371 - protein, 6 aa, Staphylococcus
TTYEEI

SEQ ID NO: 1992372 - protein, 11 aa, Staphylococcus
TTYESKENLSL

SEQ ID NO: 1992373 - protein, 6 aa, Staphylococcus
TTYGTG

SEQ ID NO: 1992374 - protein, 7 aa, Staphylococcus
TTYPNGK

SEQ ID NO: 1992375 - protein, 5 aa, Staphylococcus
TTYQP

SEQ ID NO: 1992376 - protein, 11 aa, Staphylococcus
TTYQSKGVGNK

SEQ ID NO: 1992377 - protein, 6 aa, Staphylococcus
TTYTDK

SEQ ID NO: 1992378 - protein, 12 aa, Staphylococcus
TVADKKKAVTDR

SEQ ID NO: 1992379 - protein, 13 aa, Staphylococcus
TVADPISKFTSGK

SEQ ID NO: 1992380 - protein, 5 aa, Staphylococcus
TVADT

SEQ ID NO: 1992381 - protein, 8 aa, Staphylococcus
TVAEKEVS

SEQ ID NO: 1992382 - protein, 7 aa, Staphylococcus
TVAGPNA

SEQ ID NO: 1992383 - protein, 12 aa, Staphylococcus
TVAKPIDEFTSG

SEQ ID NO: 1992384 - protein, 13 aa, Staphylococcus
TVAKPIDEFTSGG

SEQ ID NO: 1992385 - protein, 13 aa, Staphylococcus
TVAKPIDQFTSGG

SEQ ID NO: 1992386 - protein, 12 aa, Staphylococcus
TVAKPISEFTTG

SEQ ID NO: 1992387 - protein, 9 aa, Staphylococcus
TVANDNDLK

SEQ ID NO: 1992388 - protein, 9 aa, Staphylococcus
TVANPDVTE

SEQ ID NO: 1992389 - protein, 14 aa, Staphylococcus
TVAPNNSEIGKPTI

SEQ ID NO: 1992390 - protein, 8 aa, Staphylococcus
TVAQKEVS

SEQ ID NO: 1992391 - protein, 7 aa, Staphylococcus
TVAQPID

SEQ ID NO: 1992392 - protein, 6 aa, Staphylococcus
TVARET

SEQ ID NO: 1992393 - protein, 10 aa, Staphylococcus
TVDDKYKARY

SEQ ID NO: 1992394 - protein, 11 aa, Staphylococcus
TVDDNQKKIDK

SEQ ID NO: 1992395 - protein, 5 aa, Staphylococcus
TVDEN

SEQ ID NO: 1992396 - protein, 5 aa, Staphylococcus
TVDEV

SEQ ID NO: 1992397 - protein, 8 aa, Staphylococcus
TVDGNDPI

SEQ ID NO: 1992398 - protein, 10 aa, Staphylococcus
TVDGPDDYKS

SEQ ID NO: 1992399 - protein, 11 aa, Staphylococcus
TVDGPDDYKSM

SEQ ID NO: 1992400 - protein, 10 aa, Staphylococcus
TVDKDSNTMK

SEQ ID NO: 1992401 - protein, 10 aa, Staphylococcus
TVDKETNTMK

SEQ ID NO: 1992402 - protein, 31 aa, Staphylococcus
TVDNDETNEKQQTELPKKMTKKERQKTIENI

SEQ ID NO: 1992403 - protein, 31 aa, Staphylococcus
TVDNDETNEKQQTEVPKKMTKKERQKTIENI

SEQ ID NO: 1992404 - protein, 10 aa, Staphylococcus
TVDNPEKVPY

SEQ ID NO: 1992405 - protein, 16 aa, Staphylococcus
TVDPKDPAKLLPEEED

SEQ ID NO: 1992406 - protein, 16 aa, Staphylococcus
TVDPQDPGKLLPEEEE

SEQ ID NO: 1992407 - protein, 14 aa, Staphylococcus
TVDTDEKADALFSA

SEQ ID NO: 1992408 - protein, 18 aa, Staphylococcus
TVDTTKPEEVEKAIKENT

SEQ ID NO: 1992409 - protein, 4 aa, Staphylococcus
TVED

SEQ ID NO: 1992410 - protein, 5 aa, Staphylococcus
TVEDV

SEQ ID NO: 1992411 - protein, 4 aa, Staphylococcus
TVEE

SEQ ID NO: 1992412 - protein, 6 aa, Staphylococcus
TVEEAI

SEQ ID NO: 1992413 - protein, 9 aa, Staphylococcus
TVEGANGDV

SEQ ID NO: 1992414 - protein, 11 aa, Staphylococcus
TVEGANGPEIT

SEQ ID NO: 1992415 - protein, 6 aa, Staphylococcus
TVEGEA

SEQ ID NO: 1992416 - protein, 11 aa, Staphylococcus
TVEGPDDYKSM

SEQ ID NO: 1992417 - protein, 26 aa, Staphylococcus
TVEGRNAKIEGKSELQGAQVKATDLR

SEQ ID NO: 1992418 - protein, 27 aa, Staphylococcus
TVEGRNAKITGKSKLQGAQVKATDLRA

SEQ ID NO: 1992419 - protein, 26 aa, Staphylococcus
TVEGRSAKIQGKSQLQGAQVKATDLR

SEQ ID NO: 1992420 - protein, 9 aa, Staphylococcus
TVEHPRYGK

SEQ ID NO: 1992421 - protein, 9 aa, Staphylococcus
TVEKGGEVK

SEQ ID NO: 1992422 - protein, 9 aa, Staphylococcus
TVEKRQDQR

SEQ ID NO: 1992423 - protein, 5 aa, Staphylococcus
TVEKS

SEQ ID NO: 1992424 - protein, 4 aa, Staphylococcus
TVEN

SEQ ID NO: 1992425 - protein, 43 aa, Staphylococcus
TVENDETNAQEQTTVPKKMTKKERQKTIENIEKEMKKAAKELD

SEQ ID NO: 1992426 - protein, 30 aa, Staphylococcus
TVENDETNEQQQTEVPKKMTKKEREKTIAN

SEQ ID NO: 1992427 - protein, 8 aa, Staphylococcus
TVENEGEI

SEQ ID NO: 1992428 - protein, 8 aa, Staphylococcus
TVENNGEI

SEQ ID NO: 1992429 - protein, 8 aa, Staphylococcus
TVENNGEV

SEQ ID NO: 1992430 - protein, 8 aa, Staphylococcus
TVENPDVT

SEQ ID NO: 1992431 - protein, 12 aa, Staphylococcus
TVENPDVTEADA

SEQ ID NO: 1992432 - protein, 8 aa, Staphylococcus
TVENYEPN

SEQ ID NO: 1992433 - protein, 14 aa, Staphylococcus
TVEQKNKTAAPIDR

SEQ ID NO: 1992434 - protein, 15 aa, Staphylococcus
TVEQPNGNRSPEGSH

SEQ ID NO: 1992435 - protein, 10 aa, Staphylococcus
TVEQRPKMDG

SEQ ID NO: 1992436 - protein, 10 aa, Staphylococcus
TVEQRPKMEG

SEQ ID NO: 1992437 - protein, 8 aa, Staphylococcus
TVEQTDRN

SEQ ID NO: 1992438 - protein, 4 aa, Staphylococcus
TVER

SEQ ID NO: 1992439 - protein, 11 aa, Staphylococcus
TVERGGAGGGV

SEQ ID NO: 1992440 - protein, 31 aa, Staphylococcus
TVESDDTNENKQTEVPKKMTKKERQKTIENI

SEQ ID NO: 1992441 - protein, 31 aa, Staphylococcus
TVESDETNDQKQTELPKKMTKKERQKTIENI

SEQ ID NO: 1992442 - protein, 13 aa, Staphylococcus
TVETANDIVKILK

SEQ ID NO: 1992443 - protein, 6 aa, Staphylococcus
TVETED

SEQ ID NO: 1992444 - protein, 12 aa, Staphylococcus
TVETKRKKSYPQ

SEQ ID NO: 1992445 - protein, 7 aa, Staphylococcus
TVETLSE

SEQ ID NO: 1992446 - protein, 5 aa, Staphylococcus
TVGDD

SEQ ID NO: 1992447 - protein, 70 aa, Staphylococcus
TVGEGSGSPSQSSSEDKKEDTSSKEDTSKSEEKSQPAASETSSKEESSSNSDQRVNATPSARKYAREKGI

SEQ ID NO: 1992448 - protein, 8 aa, Staphylococcus
TVGIDPSL

SEQ ID NO: 1992449 - protein, 10 aa, Staphylococcus
TVGKPSNDVE

SEQ ID NO: 1992450 - protein, 10 aa, Staphylococcus
TVGKSPVKEV

SEQ ID NO: 1992451 - protein, 9 aa, Staphylococcus
TVGNGDAIA

SEQ ID NO: 1992452 - protein, 11 aa, Staphylococcus
TVGNGGNVARK

SEQ ID NO: 1992453 - protein, 5 aa, Staphylococcus
TVGNR

SEQ ID NO: 1992454 - protein, 5 aa, Staphylococcus
TVGNT

SEQ ID NO: 1992455 - protein, 11 aa, Staphylococcus
TVGNTENNTYM

SEQ ID NO: 1992456 - protein, 5 aa, Staphylococcus
TVGQV

SEQ ID NO: 1992457 - protein, 7 aa, Staphylococcus
TVGRNKK

SEQ ID NO: 1992458 - protein, 9 aa, Staphylococcus
TVGTGVGPT

SEQ ID NO: 1992459 - protein, 10 aa, Staphylococcus
TVGTGVGPTY

SEQ ID NO: 1992460 - protein, 4 aa, Staphylococcus
TVHQ

SEQ ID NO: 1992461 - protein, 20 aa, Staphylococcus
TVIKEQGDNYTVSTESGLEI

SEQ ID NO: 1992462 - protein, 11 aa, Staphylococcus
TVIPDDHPYSI

SEQ ID NO: 1992463 - protein, 12 aa, Staphylococcus
TVISGGGSDGNI

SEQ ID NO: 1992464 - protein, 12 aa, Staphylococcus
TVISSGLETARE

SEQ ID NO: 1992465 - protein, 9 aa, Staphylococcus
TVKDGGRYD

SEQ ID NO: 1992466 - protein, 6 aa, Staphylococcus
TVKEKM

SEQ ID NO: 1992467 - protein, 11 aa, Staphylococcus
TVKGPDDYKSM

SEQ ID NO: 1992468 - protein, 12 aa, Staphylococcus
TVKGPGPGRESA

SEQ ID NO: 1992469 - protein, 12 aa, Staphylococcus
TVKGPKGELERT

SEQ ID NO: 1992470 - protein, 10 aa, Staphylococcus
TVKGSGKNGK

SEQ ID NO: 1992471 - protein, 9 aa, Staphylococcus
TVKGTAQDR

SEQ ID NO: 1992472 - protein, 5 aa, Staphylococcus
TVKHH

SEQ ID NO: 1992473 - protein, 13 aa, Staphylococcus
TVKNGDRPSTSGV

SEQ ID NO: 1992474 - protein, 5 aa, Staphylococcus
TVKPE

SEQ ID NO: 1992475 - protein, 4 aa, Staphylococcus
TVKS

SEQ ID NO: 1992476 - protein, 6 aa, Staphylococcus
TVKSGS

SEQ ID NO: 1992477 - protein, 16 aa, Staphylococcus
TVKSLEGNDQGDVTKV

SEQ ID NO: 1992478 - protein, 4 aa, Staphylococcus
TVKT

SEQ ID NO: 1992479 - protein, 12 aa, Staphylococcus
TVLAGGGSDGNI

SEQ ID NO: 1992480 - protein, 11 aa, Staphylococcus
TVLPDSHPYSV

SEQ ID NO: 1992481 - protein, 8 aa, Staphylococcus
TVMDGSVK

SEQ ID NO: 1992482 - protein, 6 aa, Staphylococcus
TVNANR

SEQ ID NO: 1992483 - protein, 14 aa, Staphylococcus
TVNEEKISKISNTD

SEQ ID NO: 1992484 - protein, 4 aa, Staphylococcus
TVNG

SEQ ID NO: 1992485 - protein, 13 aa, Staphylococcus
TVNPGDIEQSKGN

SEQ ID NO: 1992486 - protein, 10 aa, Staphylococcus
TVNPKDKDIS

SEQ ID NO: 1992487 - protein, 11 aa, Staphylococcus
TVNPSGRSSSV

SEQ ID NO: 1992488 - protein, 8 aa, Staphylococcus
TVNQDNPT

SEQ ID NO: 1992489 - protein, 8 aa, Staphylococcus
TVNQNGQV

SEQ ID NO: 1992490 - protein, 13 aa, Staphylococcus
TVNRTEKEQLEKR

SEQ ID NO: 1992491 - protein, 17 aa, Staphylococcus
TVNTENNEVKSSQKEAL

SEQ ID NO: 1992492 - protein, 5 aa, Staphylococcus
TVNTQ

SEQ ID NO: 1992493 - protein, 6 aa, Staphylococcus
TVNTQD

SEQ ID NO: 1992494 - protein, 17 aa, Staphylococcus
TVNTQNNDVKASQKEAL

SEQ ID NO: 1992495 - protein, 17 aa, Staphylococcus
TVNTTTDHVQASQKEAL

SEQ ID NO: 1992496 - protein, 5 aa, Staphylococcus
TVNVE

SEQ ID NO: 1992497 - protein, 20 aa, Staphylococcus
TVPEENEEVKSDKKDSQLTM

SEQ ID NO: 1992498 - protein, 9 aa, Staphylococcus
TVPGFDEEQ

SEQ ID NO: 1992499 - protein, 5 aa, Staphylococcus
TVPHQ

SEQ ID NO: 1992500 - protein, 12 aa, Staphylococcus
TVPKYDAKRTDL

SEQ ID NO: 1992501 - protein, 6 aa, Staphylococcus
TVPKYN

SEQ ID NO: 1992502 - protein, 5 aa, Staphylococcus
TVPNN

SEQ ID NO: 1992503 - protein, 4 aa, Staphylococcus
TVPS

SEQ ID NO: 1992504 - protein, 12 aa, Staphylococcus
TVPSDENANEHE

SEQ ID NO: 1992505 - protein, 7 aa, Staphylococcus
TVQEEVG

SEQ ID NO: 1992506 - protein, 10 aa, Staphylococcus
TVQESLSGAQ

SEQ ID NO: 1992507 - protein, 5 aa, Staphylococcus
TVQFG

SEQ ID NO: 1992508 - protein, 9 aa, Staphylococcus
TVQKEKGNI

SEQ ID NO: 1992509 - protein, 9 aa, Staphylococcus
TVQKTGTEV

SEQ ID NO: 1992510 - protein, 10 aa, Staphylococcus
TVQSGEAIET

SEQ ID NO: 1992511 - protein, 14 aa, Staphylococcus
TVQSLNGDEQGNVT

SEQ ID NO: 1992512 - protein, 21 aa, Staphylococcus
TVQSTDQALTKEQYDKLVARF

SEQ ID NO: 1992513 - protein, 33 aa, Staphylococcus
TVQTTAEPLSTSTSSDDTTATEPTSDAGATEPT

SEQ ID NO: 1992514 - protein, 10 aa, Staphylococcus
TVQYENKDIT

SEQ ID NO: 1992515 - protein, 11 aa, Staphylococcus
TVQYENPNISQ

SEQ ID NO: 1992516 - protein, 11 aa, Staphylococcus
TVQYSNENITQ

SEQ ID NO: 1992517 - protein, 10 aa, Staphylococcus
TVRDQGTNID

SEQ ID NO: 1992518 - protein, 6 aa, Staphylococcus
TVREAS

SEQ ID NO: 1992519 - protein, 12 aa, Staphylococcus
TVRGQGYKVEAH

SEQ ID NO: 1992520 - protein, 12 aa, Staphylococcus
TVRGQGYKVEHH

SEQ ID NO: 1992521 - protein, 5 aa, Staphylococcus
TVRQY

SEQ ID NO: 1992522 - protein, 11 aa, Staphylococcus
TVSAREKEENL

SEQ ID NO: 1992523 - protein, 8 aa, Staphylococcus
TVSDKGEA

SEQ ID NO: 1992524 - protein, 9 aa, Staphylococcus
TVSENSGDL

SEQ ID NO: 1992525 - protein, 4 aa, Staphylococcus
TVSG

SEQ ID NO: 1992526 - protein, 5 aa, Staphylococcus
TVSGK

SEQ ID NO: 1992527 - protein, 21 aa, Staphylococcus
TVSGLSSSQLQTLKDTKPARI

SEQ ID NO: 1992528 - protein, 6 aa, Staphylococcus
TVSGWS

SEQ ID NO: 1992529 - protein, 8 aa, Staphylococcus
TVSITSPI

SEQ ID NO: 1992530 - protein, 12 aa, Staphylococcus
TVSKHEKDESVD

SEQ ID NO: 1992531 - protein, 11 aa, Staphylococcus
TVSKSGTIQEV

SEQ ID NO: 1992532 - protein, 11 aa, Staphylococcus
TVSNREKEENI

SEQ ID NO: 1992533 - protein, 16 aa, Staphylococcus
TVSQEDVKKWSAEDEY

SEQ ID NO: 1992534 - protein, 11 aa, Staphylococcus
TVSQETINDSY

SEQ ID NO: 1992535 - protein, 11 aa, Staphylococcus
TVSQKTVTGTL

SEQ ID NO: 1992536 - protein, 11 aa, Staphylococcus
TVSRHEKEENI

SEQ ID NO: 1992537 - protein, 10 aa, Staphylococcus
TVSSGDAIAT

SEQ ID NO: 1992538 - protein, 4 aa, Staphylococcus
TVST

SEQ ID NO: 1992539 - protein, 5 aa, Staphylococcus
TVSTE

SEQ ID NO: 1992540 - protein, 11 aa, Staphylococcus
TVSTSGKTGVE

SEQ ID NO: 1992541 - protein, 15 aa, Staphylococcus
TVSTVSAGISYIEFI

SEQ ID NO: 1992542 - protein, 18 aa, Staphylococcus
TVSVKDYDGKYIGEHKER

SEQ ID NO: 1992543 - protein, 19 aa, Staphylococcus
TVSVKDYDGKYIGEHKERN

SEQ ID NO: 1992544 - protein, 15 aa, Staphylococcus
TVSYGSTYTAEKSEK

SEQ ID NO: 1992545 - protein, 20 aa, Staphylococcus
TVTDGEGIQTGDLLVELEKD

SEQ ID NO: 1992546 - protein, 5 aa, Staphylococcus
TVTEV

SEQ ID NO: 1992547 - protein, 13 aa, Staphylococcus
TVTGFSNSEEQAV

SEQ ID NO: 1992548 - protein, 21 aa, Staphylococcus
TVTGKPAQIKGSYSSGTAERE

SEQ ID NO: 1992549 - protein, 17 aa, Staphylococcus
TVTGKTLRENNEGKEIK

SEQ ID NO: 1992550 - protein, 4 aa, Staphylococcus
TVTK

SEQ ID NO: 1992551 - protein, 20 aa, Staphylococcus
TVTKRDPETVNPKIKTGNVE

SEQ ID NO: 1992552 - protein, 8 aa, Staphylococcus
TVTNNGDV

SEQ ID NO: 1992553 - protein, 11 aa, Staphylococcus
TVTPDAVKAEN

SEQ ID NO: 1992554 - protein, 6 aa, Staphylococcus
TVTPEQ

SEQ ID NO: 1992555 - protein, 4 aa, Staphylococcus
TVTQ

SEQ ID NO: 1992556 - protein, 10 aa, Staphylococcus
TVTQASGESA

SEQ ID NO: 1992557 - protein, 8 aa, Staphylococcus
TVTREASD

SEQ ID NO: 1992558 - protein, 10 aa, Staphylococcus
TVTRENTQLK

SEQ ID NO: 1992559 - protein, 6 aa, Staphylococcus
TVTSDL

SEQ ID NO: 1992560 - protein, 11 aa, Staphylococcus
TVTTDDGKALR

SEQ ID NO: 1992561 - protein, 7 aa, Staphylococcus
TVTTDID

SEQ ID NO: 1992562 - protein, 11 aa, Staphylococcus
TVTTEDGSEIR

SEQ ID NO: 1992563 - protein, 5 aa, Staphylococcus
TVYDG

SEQ ID NO: 1992564 - protein, 10 aa, Staphylococcus
TVYSQKDNTL

SEQ ID NO: 1992565 - protein, 4 aa, Staphylococcus
TWAL

SEQ ID NO: 1992566 - protein, 8 aa, Staphylococcus
TWDDSQTI

SEQ ID NO: 1992567 - protein, 10 aa, Staphylococcus
TWDGSAKDQI

SEQ ID NO: 1992568 - protein, 10 aa, Staphylococcus
TWDGSAKEDI

SEQ ID NO: 1992569 - protein, 5 aa, Staphylococcus
TWDNI

SEQ ID NO: 1992570 - protein, 7 aa, Staphylococcus
TWKQEDN

SEQ ID NO: 1992571 - protein, 6 aa, Staphylococcus
TWQGAT

SEQ ID NO: 1992572 - protein, 6 aa, Staphylococcus
TWSGNK

SEQ ID NO: 1992573 - protein, 8 aa, Staphylococcus
TYADAQGN

SEQ ID NO: 1992574 - protein, 6 aa, Staphylococcus
TYANKK

SEQ ID NO: 1992575 - protein, 9 aa, Staphylococcus
TYANSATKI

SEQ ID NO: 1992576 - protein, 9 aa, Staphylococcus
TYANSSTKI

SEQ ID NO: 1992577 - protein, 10 aa, Staphylococcus
TYARNQQEGA

SEQ ID NO: 1992578 - protein, 10 aa, Staphylococcus
TYASRQHKSL

SEQ ID NO: 1992579 - protein, 6 aa, Staphylococcus
TYDERY

SEQ ID NO: 1992580 - protein, 7 aa, Staphylococcus
TYDGKTY

SEQ ID NO: 1992581 - protein, 22 aa, Staphylococcus
TYDKEKEAENVYGTTEEAHPGV

SEQ ID NO: 1992582 - protein, 6 aa, Staphylococcus
TYDNET

SEQ ID NO: 1992583 - protein, 9 aa, Staphylococcus
TYDNLPTKA

SEQ ID NO: 1992584 - protein, 4 aa, Staphylococcus
TYDQ

SEQ ID NO: 1992585 - protein, 8 aa, Staphylococcus
TYDQTVSD

SEQ ID NO: 1992586 - protein, 5 aa, Staphylococcus
TYDTG

SEQ ID NO: 1992587 - protein, 12 aa, Staphylococcus
TYEAKGEEKTIE

SEQ ID NO: 1992588 - protein, 12 aa, Staphylococcus
TYEAKGEEQTIE

SEQ ID NO: 1992589 - protein, 9 aa, Staphylococcus
TYEDLETGI

SEQ ID NO: 1992590 - protein, 11 aa, Staphylococcus
TYEGGTHEEGF

SEQ ID NO: 1992591 - protein, 19 aa, Staphylococcus
TYEKQTKNEYDPQLEKDRE

SEQ ID NO: 1992592 - protein, 4 aa, Staphylococcus
TYEM

SEQ ID NO: 1992593 - protein, 7 aa, Staphylococcus
TYENEAP

SEQ ID NO: 1992594 - protein, 15 aa, Staphylococcus
TYEREDEKAMKLLET

SEQ ID NO: 1992595 - protein, 17 aa, Staphylococcus
TYERKDKDGIFHTQWTE

SEQ ID NO: 1992596 - protein, 17 aa, Staphylococcus
TYERKDKEGIFHTQWVE

SEQ ID NO: 1992597 - protein, 17 aa, Staphylococcus
TYERKDKEGVFHTQWVE

SEQ ID NO: 1992598 - protein, 13 aa, Staphylococcus
TYESENESVVTDK

SEQ ID NO: 1992599 - protein, 13 aa, Staphylococcus
TYEYKEKPYEKDY

SEQ ID NO: 1992600 - protein, 6 aa, Staphylococcus
TYFKQG

SEQ ID NO: 1992601 - protein, 10 aa, Staphylococcus
TYFPQDSGNV

SEQ ID NO: 1992602 - protein, 16 aa, Staphylococcus
TYGAAAKTSGAGGGDC

SEQ ID NO: 1992603 - protein, 9 aa, Staphylococcus
TYGAASKGI

SEQ ID NO: 1992604 - protein, 21 aa, Staphylococcus
TYGAKRAADDYDSKDEAVKRA

SEQ ID NO: 1992605 - protein, 11 aa, Staphylococcus
TYGNKQTEQEV

SEQ ID NO: 1992606 - protein, 7 aa, Staphylococcus
TYGNTPK

SEQ ID NO: 1992607 - protein, 4 aa, Staphylococcus
TYGS

SEQ ID NO: 1992608 - protein, 6 aa, Staphylococcus
TYGSLT

SEQ ID NO: 1992609 - protein, 9 aa, Staphylococcus
TYGTDDEPG

SEQ ID NO: 1992610 - protein, 8 aa, Staphylococcus
TYGTDEKH

SEQ ID NO: 1992611 - protein, 8 aa, Staphylococcus
TYGTKQTI

SEQ ID NO: 1992612 - protein, 9 aa, Staphylococcus
TYGTNDQPG

SEQ ID NO: 1992613 - protein, 9 aa, Staphylococcus
TYGTNEQPG

SEQ ID NO: 1992614 - protein, 4 aa, Staphylococcus
TYGY

SEQ ID NO: 1992615 - protein, 12 aa, Staphylococcus
TYHTGDKAKEEN

SEQ ID NO: 1992616 - protein, 6 aa, Staphylococcus
TYIPNQ

SEQ ID NO: 1992617 - protein, 7 aa, Staphylococcus
TYISGNE

SEQ ID NO: 1992618 - protein, 4 aa, Staphylococcus
TYKD

SEQ ID NO: 1992619 - protein, 15 aa, Staphylococcus
TYKEEDEKATQIISA

SEQ ID NO: 1992620 - protein, 7 aa, Staphylococcus
TYKKASK

SEQ ID NO: 1992621 - protein, 12 aa, Staphylococcus
TYKNGTVDSPYR

SEQ ID NO: 1992622 - protein, 9 aa, Staphylococcus
TYKQDESTL

SEQ ID NO: 1992623 - protein, 22 aa, Staphylococcus
TYLEDGKAVPEPFPLSSGTQAT

SEQ ID NO: 1992624 - protein, 4 aa, Staphylococcus
TYLP

SEQ ID NO: 1992625 - protein, 4 aa, Staphylococcus
TYME

SEQ ID NO: 1992626 - protein, 4 aa, Staphylococcus
TYMK

SEQ ID NO: 1992627 - protein, 4 aa, Staphylococcus
TYMN

SEQ ID NO: 1992628 - protein, 12 aa, Staphylococcus
TYNADEPEYEPA

SEQ ID NO: 1992629 - protein, 6 aa, Staphylococcus
TYNENE

SEQ ID NO: 1992630 - protein, 14 aa, Staphylococcus
TYNKENNSVTVDAT

SEQ ID NO: 1992631 - protein, 6 aa, Staphylococcus
TYNMTD

SEQ ID NO: 1992632 - protein, 13 aa, Staphylococcus
TYNPANVNAPEVK

SEQ ID NO: 1992633 - protein, 7 aa, Staphylococcus
TYNPKKV

SEQ ID NO: 1992634 - protein, 9 aa, Staphylococcus
TYNPSKGQR

SEQ ID NO: 1992635 - protein, 4 aa, Staphylococcus
TYNQ

SEQ ID NO: 1992636 - protein, 12 aa, Staphylococcus
TYNRNATETTDE

SEQ ID NO: 1992637 - protein, 4 aa, Staphylococcus
TYPD

SEQ ID NO: 1992638 - protein, 5 aa, Staphylococcus
TYPET

SEQ ID NO: 1992639 - protein, 11 aa, Staphylococcus
TYPGAPGSGGI

SEQ ID NO: 1992640 - protein, 4 aa, Staphylococcus
TYPN

SEQ ID NO: 1992641 - protein, 5 aa, Staphylococcus
TYPNA

SEQ ID NO: 1992642 - protein, 5 aa, Staphylococcus
TYPQG

SEQ ID NO: 1992643 - protein, 9 aa, Staphylococcus
TYPRTDSNF

SEQ ID NO: 1992644 - protein, 10 aa, Staphylococcus
TYPRTDSNYL

SEQ ID NO: 1992645 - protein, 10 aa, Staphylococcus
TYPTTQIEAS

SEQ ID NO: 1992646 - protein, 6 aa, Staphylococcus
TYQDLS

SEQ ID NO: 1992647 - protein, 5 aa, Staphylococcus
TYQDN

SEQ ID NO: 1992648 - protein, 9 aa, Staphylococcus
TYQKESDSE

SEQ ID NO: 1992649 - protein, 6 aa, Staphylococcus
TYQNGE

SEQ ID NO: 1992650 - protein, 6 aa, Staphylococcus
TYQNKT

SEQ ID NO: 1992651 - protein, 15 aa, Staphylococcus
TYQNSDLTQTIENDR

SEQ ID NO: 1992652 - protein, 9 aa, Staphylococcus
TYQNSTTKI

SEQ ID NO: 1992653 - protein, 9 aa, Staphylococcus
TYQQASDWK

SEQ ID NO: 1992654 - protein, 9 aa, Staphylococcus
TYQQEDDSE

SEQ ID NO: 1992655 - protein, 5 aa, Staphylococcus
TYQQG

SEQ ID NO: 1992656 - protein, 4 aa, Staphylococcus
TYQR

SEQ ID NO: 1992657 - protein, 7 aa, Staphylococcus
TYQSEGQ

SEQ ID NO: 1992658 - protein, 5 aa, Staphylococcus
TYRGY

SEQ ID NO: 1992659 - protein, 8 aa, Staphylococcus
TYRPGQKE

SEQ ID NO: 1992660 - protein, 6 aa, Staphylococcus
TYRSEV

SEQ ID NO: 1992661 - protein, 18 aa, Staphylococcus
TYRSSGAGGQHVNTTDSA

SEQ ID NO: 1992662 - protein, 5 aa, Staphylococcus
TYRYD

SEQ ID NO: 1992663 - protein, 5 aa, Staphylococcus
TYSGY

SEQ ID NO: 1992664 - protein, 10 aa, Staphylococcus
TYSKDYPELA

SEQ ID NO: 1992665 - protein, 10 aa, Staphylococcus
TYSKSKIKQR

SEQ ID NO: 1992666 - protein, 12 aa, Staphylococcus
TYSKSNTNDRYT

SEQ ID NO: 1992667 - protein, 11 aa, Staphylococcus
TYSKSSTKNRY

SEQ ID NO: 1992668 - protein, 10 aa, Staphylococcus
TYSKTSDNHR

SEQ ID NO: 1992669 - protein, 8 aa, Staphylococcus
TYSNAEDA

SEQ ID NO: 1992670 - protein, 9 aa, Staphylococcus
TYSNSATKI

SEQ ID NO: 1992671 - protein, 9 aa, Staphylococcus
TYSNSTTKV

SEQ ID NO: 1992672 - protein, 5 aa, Staphylococcus
TYSPE

SEQ ID NO: 1992673 - protein, 5 aa, Staphylococcus
TYTAS

SEQ ID NO: 1992674 - protein, 10 aa, Staphylococcus
TYTDASDEQA

SEQ ID NO: 1992675 - protein, 13 aa, Staphylococcus
TYTEDNEQLDGRL

SEQ ID NO: 1992676 - protein, 5 aa, Staphylococcus
TYTEG

SEQ ID NO: 1992677 - protein, 6 aa, Staphylococcus
TYTEQY

SEQ ID NO: 1992678 - protein, 7 aa, Staphylococcus
TYTESGK

SEQ ID NO: 1992679 - protein, 9 aa, Staphylococcus
TYTETGGEA

SEQ ID NO: 1992680 - protein, 10 aa, Staphylococcus
TYTETGGNAD

SEQ ID NO: 1992681 - protein, 9 aa, Staphylococcus
TYTETGQSK

SEQ ID NO: 1992682 - protein, 23 aa, Staphylococcus
TYTGIQSGKLEDKHGWRVIVPEY

SEQ ID NO: 1992683 - protein, 22 aa, Staphylococcus
TYTGIQSGKLEDKHGWRVVVPK

SEQ ID NO: 1992684 - protein, 23 aa, Staphylococcus
TYTGIQSGKLEDTHGWRVVVPEY

SEQ ID NO: 1992685 - protein, 9 aa, Staphylococcus
TYTKDSNEE

SEQ ID NO: 1992686 - protein, 9 aa, Staphylococcus
TYTKENSDE

SEQ ID NO: 1992687 - protein, 8 aa, Staphylococcus
TYTKESAN

SEQ ID NO: 1992688 - protein, 10 aa, Staphylococcus
TYTKTGGNAD

SEQ ID NO: 1992689 - protein, 9 aa, Staphylococcus
TYTQTGGNA

SEQ ID NO: 1992690 - protein, 5 aa, Staphylococcus
TYTSM

SEQ ID NO: 1992691 - protein, 23 aa, Staphylococcus
TYTTDTNENSGVGKAIMKLIDQK

SEQ ID NO: 1992692 - protein, 6 aa, Staphylococcus
TYVPEK

SEQ ID NO: 1992693 - protein, 12 aa, Staphylococcus
TYVPSDNKNLAY

SEQ ID NO: 1992694 - protein, 4 aa, Staphylococcus
TYVT

SEQ ID NO: 1992695 - protein, 11 aa, Staphylococcus
TYWPQNQGDYK

SEQ ID NO: 1992696 - protein, 4 aa, Staphylococcus
TYYE

SEQ ID NO: 1992697 - protein, 6 aa, Staphylococcus
TYYETN

SEQ ID NO: 1992698 - protein, 6 aa, Staphylococcus
VAAASK

SEQ ID NO: 1992699 - protein, 8 aa, Staphylococcus
VAADNDLK

SEQ ID NO: 1992700 - protein, 5 aa, Staphylococcus
VAAGD

SEQ ID NO: 1992701 - protein, 33 aa, Staphylococcus
VAAGTATAFNDDLATRDDIEKIKDQVTMTVLDG

SEQ ID NO: 1992702 - protein, 13 aa, Staphylococcus
VAASSNSKEEKME

SEQ ID NO: 1992703 - protein, 9 aa, Staphylococcus
VAATTPEKV

SEQ ID NO: 1992704 - protein, 8 aa, Staphylococcus
VADDEVRA

SEQ ID NO: 1992705 - protein, 10 aa, Staphylococcus
VADDLSKKLD

SEQ ID NO: 1992706 - protein, 8 aa, Staphylococcus
VADDSSID

SEQ ID NO: 1992707 - protein, 6 aa, Staphylococcus
VADGST

SEQ ID NO: 1992708 - protein, 11 aa, Staphylococcus
VADGTSGEAAD

SEQ ID NO: 1992709 - protein, 12 aa, Staphylococcus
VADKKKSVSDRD

SEQ ID NO: 1992710 - protein, 12 aa, Staphylococcus
VADNSDQDGTVG

SEQ ID NO: 1992711 - protein, 5 aa, Staphylococcus
VADQS

SEQ ID NO: 1992712 - protein, 9 aa, Staphylococcus
VADSASGTA

SEQ ID NO: 1992713 - protein, 9 aa, Staphylococcus
VADSQTSES

SEQ ID NO: 1992714 - protein, 10 aa, Staphylococcus
VADSTNETVT

SEQ ID NO: 1992715 - protein, 27 aa, Staphylococcus
VADVSSQDVADATRIQYGGSVKPNNVK

SEQ ID NO: 1992716 - protein, 5 aa, Staphylococcus
VAEAG

SEQ ID NO: 1992717 - protein, 5 aa, Staphylococcus
VAEDV

SEQ ID NO: 1992718 - protein, 8 aa, Staphylococcus
VAEEDTHR

SEQ ID NO: 1992719 - protein, 6 aa, Staphylococcus
VAEETL

SEQ ID NO: 1992720 - protein, 4 aa, Staphylococcus
VAEG

SEQ ID NO: 1992721 - protein, 7 aa, Staphylococcus
VAEGADV

SEQ ID NO: 1992722 - protein, 7 aa, Staphylococcus
VAEGDEV

SEQ ID NO: 1992723 - protein, 7 aa, Staphylococcus
VAEGDQV

SEQ ID NO: 1992724 - protein, 7 aa, Staphylococcus
VAEGEHD

SEQ ID NO: 1992725 - protein, 7 aa, Staphylococcus
VAEGETF

SEQ ID NO: 1992726 - protein, 13 aa, Staphylococcus
VAEGGGLSRTDEK

SEQ ID NO: 1992727 - protein, 5 aa, Staphylococcus
VAEKA

SEQ ID NO: 1992728 - protein, 8 aa, Staphylococcus
VAEKEGLE

SEQ ID NO: 1992729 - protein, 5 aa, Staphylococcus
VAENG

SEQ ID NO: 1992730 - protein, 9 aa, Staphylococcus
VAENNLGDS

SEQ ID NO: 1992731 - protein, 7 aa, Staphylococcus
VAEPAGA

SEQ ID NO: 1992732 - protein, 12 aa, Staphylococcus
VAEQNDKKPDHK

SEQ ID NO: 1992733 - protein, 12 aa, Staphylococcus
VAEQNDKKPTNK

SEQ ID NO: 1992734 - protein, 7 aa, Staphylococcus
VAEQTNL

SEQ ID NO: 1992735 - protein, 16 aa, Staphylococcus
VAEQTTENAERLFNLK

SEQ ID NO: 1992736 - protein, 4 aa, Staphylococcus
VAER

SEQ ID NO: 1992737 - protein, 11 aa, Staphylococcus
VAERLGKSRPY

SEQ ID NO: 1992738 - protein, 8 aa, Staphylococcus
VAESDTHR

SEQ ID NO: 1992739 - protein, 10 aa, Staphylococcus
VAESRPSPGY

SEQ ID NO: 1992740 - protein, 12 aa, Staphylococcus
VAESSKPEYMKS

SEQ ID NO: 1992741 - protein, 5 aa, Staphylococcus
VAETY

SEQ ID NO: 1992742 - protein, 22 aa, Staphylococcus
VAFETNQTKSNSHYSEETNGPK

SEQ ID NO: 1992743 - protein, 11 aa, Staphylococcus
VAGDAEDDVSQ

SEQ ID NO: 1992744 - protein, 14 aa, Staphylococcus
VAGDDQAFNNPTKP

SEQ ID NO: 1992745 - protein, 10 aa, Staphylococcus
VAGEAGDDVS

SEQ ID NO: 1992746 - protein, 11 aa, Staphylococcus
VAGEAGDDVSE

SEQ ID NO: 1992747 - protein, 14 aa, Staphylococcus
VAGERGAADAERDI

SEQ ID NO: 1992748 - protein, 12 aa, Staphylococcus
VAGERGAADLER

SEQ ID NO: 1992749 - protein, 7 aa, Staphylococcus
VAGFNKS

SEQ ID NO: 1992750 - protein, 14 aa, Staphylococcus
VAGFSNSEESQMGV

SEQ ID NO: 1992751 - protein, 24 aa, Staphylococcus
VAGKTGTAQVADSDNGGYVNGENP

SEQ ID NO: 1992752 - protein, 8 aa, Staphylococcus
VAGNNDNQ

SEQ ID NO: 1992753 - protein, 14 aa, Staphylococcus
VAGNPARFIREVPL

SEQ ID NO: 1992754 - protein, 14 aa, Staphylococcus
VAGNQSVEKNTKNA

SEQ ID NO: 1992755 - protein, 6 aa, Staphylococcus
VAGNYA

SEQ ID NO: 1992756 - protein, 9 aa, Staphylococcus
VAGPEDENE

SEQ ID NO: 1992757 - protein, 9 aa, Staphylococcus
VAGQTTSNH

SEQ ID NO: 1992758 - protein, 14 aa, Staphylococcus
VAGSGKNGRITKED

SEQ ID NO: 1992759 - protein, 16 aa, Staphylococcus
VAGSITDQIENMEYQG

SEQ ID NO: 1992760 - protein, 16 aa, Staphylococcus
VAGSITEDMESTEYDY

SEQ ID NO: 1992761 - protein, 12 aa, Staphylococcus
VAGSYRRYKEMS

SEQ ID NO: 1992762 - protein, 6 aa, Staphylococcus
VAGTHD

SEQ ID NO: 1992763 - protein, 17 aa, Staphylococcus
VAGTTRDAIDTEYTYDN

SEQ ID NO: 1992764 - protein, 10 aa, Staphylococcus
VAHETREHAE

SEQ ID NO: 1992765 - protein, 4 aa, Staphylococcus
VAHQ

SEQ ID NO: 1992766 - protein, 5 aa, Staphylococcus
VAHQG

SEQ ID NO: 1992767 - protein, 7 aa, Staphylococcus
VAHSKEG

SEQ ID NO: 1992768 - protein, 7 aa, Staphylococcus
VAHSKNG

SEQ ID NO: 1992769 - protein, 4 aa, Staphylococcus
VAIQ

SEQ ID NO: 1992770 - protein, 6 aa, Staphylococcus
VAKAES

SEQ ID NO: 1992771 - protein, 19 aa, Staphylococcus
VAKANEKDVDKAVQSAHEA

SEQ ID NO: 1992772 - protein, 19 aa, Staphylococcus
VAKAQASDFAKTYAEGDSF

SEQ ID NO: 1992773 - protein, 9 aa, Staphylococcus
VAKASAGAI

SEQ ID NO: 1992774 - protein, 12 aa, Staphylococcus
VAKDQLKEENLE

SEQ ID NO: 1992775 - protein, 5 aa, Staphylococcus
VAKED

SEQ ID NO: 1992776 - protein, 22 aa, Staphylococcus
VAKEDAEKLKEQLEEVGATVEL

SEQ ID NO: 1992777 - protein, 5 aa, Staphylococcus
VAKEE

SEQ ID NO: 1992778 - protein, 8 aa, Staphylococcus
VAKEEKAY

SEQ ID NO: 1992779 - protein, 14 aa, Staphylococcus
VAKEQKQPKDLTKA

SEQ ID NO: 1992780 - protein, 17 aa, Staphylococcus
VAKGNEEDVNKAVEAAD

SEQ ID NO: 1992781 - protein, 15 aa, Staphylococcus
VAKGNEKDVEKAVQA

SEQ ID NO: 1992782 - protein, 16 aa, Staphylococcus
VAKGNSNDVEKAVEAA

SEQ ID NO: 1992783 - protein, 8 aa, Staphylococcus
VAKMSDKD

SEQ ID NO: 1992784 - protein, 9 aa, Staphylococcus
VAKNDTKLD

SEQ ID NO: 1992785 - protein, 11 aa, Staphylococcus
VAKPDVTEAEA

SEQ ID NO: 1992786 - protein, 9 aa, Staphylococcus
VAKRGGNVR

SEQ ID NO: 1992787 - protein, 9 aa, Staphylococcus
VAKRGMDSK

SEQ ID NO: 1992788 - protein, 6 aa, Staphylococcus
VAKRND

SEQ ID NO: 1992789 - protein, 8 aa, Staphylococcus
VAKRNDAQ

SEQ ID NO: 1992790 - protein, 8 aa, Staphylococcus
VAKRNEAK

SEQ ID NO: 1992791 - protein, 9 aa, Staphylococcus
VAKSISQSL

SEQ ID NO: 1992792 - protein, 8 aa, Staphylococcus
VAKSNDIN

SEQ ID NO: 1992793 - protein, 19 aa, Staphylococcus
VAKTTNMSGSELNKMGNEI

SEQ ID NO: 1992794 - protein, 9 aa, Staphylococcus
VALEESNGL

SEQ ID NO: 1992795 - protein, 13 aa, Staphylococcus
VALTNSSTPPRDA

SEQ ID NO: 1992796 - protein, 13 aa, Staphylococcus
VALTSRADTPEEI

SEQ ID NO: 1992797 - protein, 7 aa, Staphylococcus
VANASQI

SEQ ID NO: 1992798 - protein, 18 aa, Staphylococcus
VANGDAIATGDLLIEIEK

SEQ ID NO: 1992799 - protein, 16 aa, Staphylococcus
VANGNEEDVNKAVEAA

SEQ ID NO: 1992800 - protein, 5 aa, Staphylococcus
VANKY

SEQ ID NO: 1992801 - protein, 7 aa, Staphylococcus
VANPDEV

SEQ ID NO: 1992802 - protein, 12 aa, Staphylococcus
VANPDVTEDDAI

SEQ ID NO: 1992803 - protein, 7 aa, Staphylococcus
VANPGDT

SEQ ID NO: 1992804 - protein, 12 aa, Staphylococcus
VANPNVTEEDAI

SEQ ID NO: 1992805 - protein, 6 aa, Staphylococcus
VANRDD

SEQ ID NO: 1992806 - protein, 7 aa, Staphylococcus
VANRGQI

SEQ ID NO: 1992807 - protein, 4 aa, Staphylococcus
VAPA

SEQ ID NO: 1992808 - protein, 6 aa, Staphylococcus
VAPDDE

SEQ ID NO: 1992809 - protein, 6 aa, Staphylococcus
VAPDEE

SEQ ID NO: 1992810 - protein, 9 aa, Staphylococcus
VAPDGTDEP

SEQ ID NO: 1992811 - protein, 10 aa, Staphylococcus
VAPDGTDQPT

SEQ ID NO: 1992812 - protein, 4 aa, Staphylococcus
VAPE

SEQ ID NO: 1992813 - protein, 6 aa, Staphylococcus
VAPEKE

SEQ ID NO: 1992814 - protein, 7 aa, Staphylococcus
VAPKPCN

SEQ ID NO: 1992815 - protein, 6 aa, Staphylococcus
VAPKTV

SEQ ID NO: 1992816 - protein, 15 aa, Staphylococcus
VAPPNQGLGDLWGTI

SEQ ID NO: 1992817 - protein, 5 aa, Staphylococcus
VAPRR

SEQ ID NO: 1992818 - protein, 10 aa, Staphylococcus
VAPSNDDQGV

SEQ ID NO: 1992819 - protein, 19 aa, Staphylococcus
VAPSNDEQGVLQIIEQEVL

SEQ ID NO: 1992820 - protein, 19 aa, Staphylococcus
VAPSNDEQGVLQVIDDVVL

SEQ ID NO: 1992821 - protein, 9 aa, Staphylococcus
VAPTNEFEK

SEQ ID NO: 1992822 - protein, 14 aa, Staphylococcus
VAPVASSEEEVEVT

SEQ ID NO: 1992823 - protein, 6 aa, Staphylococcus
VAPYKY

SEQ ID NO: 1992824 - protein, 6 aa, Staphylococcus
VAQATG

SEQ ID NO: 1992825 - protein, 8 aa, Staphylococcus
VAQDTHPD

SEQ ID NO: 1992826 - protein, 9 aa, Staphylococcus
VAQETSPDE

SEQ ID NO: 1992827 - protein, 9 aa, Staphylococcus
VAQETSPNE

SEQ ID NO: 1992828 - protein, 7 aa, Staphylococcus
VAQEVKA

SEQ ID NO: 1992829 - protein, 7 aa, Staphylococcus
VAQEVSS

SEQ ID NO: 1992830 - protein, 13 aa, Staphylococcus
VAQGGGLSRTDEK

SEQ ID NO: 1992831 - protein, 5 aa, Staphylococcus
VAQGQ

SEQ ID NO: 1992832 - protein, 7 aa, Staphylococcus
VAQNNNL

SEQ ID NO: 1992833 - protein, 8 aa, Staphylococcus
VAQNQTQR

SEQ ID NO: 1992834 - protein, 38 aa, Staphylococcus
VAQQPAPSIAQPQVAQSAPQVSDNAQAQEEVADNYETI

SEQ ID NO: 1992835 - protein, 39 aa, Staphylococcus
VAQQPAQQISQPQAAPQPQSTTQSGEETQESASDNYETI

SEQ ID NO: 1992836 - protein, 5 aa, Staphylococcus
VAQSE

SEQ ID NO: 1992837 - protein, 22 aa, Staphylococcus
VAQSKQKKAPDNIDVESKTDAQ

SEQ ID NO: 1992838 - protein, 16 aa, Staphylococcus
VARAGKEDVDKAVQAA

SEQ ID NO: 1992839 - protein, 9 aa, Staphylococcus
VARDHEGKV

SEQ ID NO: 1992840 - protein, 18 aa, Staphylococcus
VAREQKKAEEKAEEAAKL

SEQ ID NO: 1992841 - protein, 6 aa, Staphylococcus
VARKGF

SEQ ID NO: 1992842 - protein, 7 aa, Staphylococcus
VARKNKD

SEQ ID NO: 1992843 - protein, 8 aa, Staphylococcus
VARKNKDV

SEQ ID NO: 1992844 - protein, 7 aa, Staphylococcus
VARKNQD

SEQ ID NO: 1992845 - protein, 12 aa, Staphylococcus
VARPDVTEEEAI

SEQ ID NO: 1992846 - protein, 10 aa, Staphylococcus
VARTEAKKRA

SEQ ID NO: 1992847 - protein, 12 aa, Staphylococcus
VASAESKENTLE

SEQ ID NO: 1992848 - protein, 9 aa, Staphylococcus
VASDNAHQL

SEQ ID NO: 1992849 - protein, 8 aa, Staphylococcus
VASEDEAK

SEQ ID NO: 1992850 - protein, 32 aa, Staphylococcus
VASEDKSPKLNKLGGTEWKKTKAKVQQSVEDM

SEQ ID NO: 1992851 - protein, 12 aa, Staphylococcus
VASEDKTPRLNK

SEQ ID NO: 1992852 - protein, 5 aa, Staphylococcus
VASEY

SEQ ID NO: 1992853 - protein, 14 aa, Staphylococcus
VASGTATAFSDDLA

SEQ ID NO: 1992854 - protein, 10 aa, Staphylococcus
VASGTPKQVM

SEQ ID NO: 1992855 - protein, 4 aa, Staphylococcus
VASK

SEQ ID NO: 1992856 - protein, 12 aa, Staphylococcus
VASKNITKETHT

SEQ ID NO: 1992857 - protein, 9 aa, Staphylococcus
VASNHGLRT

SEQ ID NO: 1992858 - protein, 7 aa, Staphylococcus
VASNKGL

SEQ ID NO: 1992859 - protein, 9 aa, Staphylococcus
VASNKGLRE

SEQ ID NO: 1992860 - protein, 10 aa, Staphylococcus
VASNKGLRQE

SEQ ID NO: 1992861 - protein, 11 aa, Staphylococcus
VASNKGLRTSL

SEQ ID NO: 1992862 - protein, 18 aa, Staphylococcus
VASNNQGGGQDVSRQGVQ

SEQ ID NO: 1992863 - protein, 18 aa, Staphylococcus
VASNRGLRESISKQCENN

SEQ ID NO: 1992864 - protein, 11 aa, Staphylococcus
VASPGIGQDAF

SEQ ID NO: 1992865 - protein, 8 aa, Staphylococcus
VASPQDYR

SEQ ID NO: 1992866 - protein, 15 aa, Staphylococcus
VASREAVEKGSEGLQ

SEQ ID NO: 1992867 - protein, 6 aa, Staphylococcus
VASSAP

SEQ ID NO: 1992868 - protein, 15 aa, Staphylococcus
VASSNKGVLDEKNTI

SEQ ID NO: 1992869 - protein, 6 aa, Staphylococcus
VASTKE

SEQ ID NO: 1992870 - protein, 14 aa, Staphylococcus
VATAEATKALYEAG

SEQ ID NO: 1992871 - protein, 9 aa, Staphylococcus
VATAEATKD

SEQ ID NO: 1992872 - protein, 14 aa, Staphylococcus
VATAEGTKALYEAG

SEQ ID NO: 1992873 - protein, 11 aa, Staphylococcus
VATAEQSEPHA

SEQ ID NO: 1992874 - protein, 6 aa, Staphylococcus
VATEDI

SEQ ID NO: 1992875 - protein, 8 aa, Staphylococcus
VATGEATK

SEQ ID NO: 1992876 - protein, 29 aa, Staphylococcus
VATGQGKTKKESEQKAAESAYSKLKSNNN

SEQ ID NO: 1992877 - protein, 6 aa, Staphylococcus
VATHED

SEQ ID NO: 1992878 - protein, 8 aa, Staphylococcus
VATHEDNY

SEQ ID NO: 1992879 - protein, 11 aa, Staphylococcus
VATKAGVPTVE

SEQ ID NO: 1992880 - protein, 8 aa, Staphylococcus
VATNEGNY

SEQ ID NO: 1992881 - protein, 18 aa, Staphylococcus
VATNNANSGQDVSRQGVQ

SEQ ID NO: 1992882 - protein, 18 aa, Staphylococcus
VATNNQSSGQDVSRQGVQ

SEQ ID NO: 1992883 - protein, 18 aa, Staphylococcus
VATNNSNSGQDVSRQGVQ

SEQ ID NO: 1992884 - protein, 4 aa, Staphylococcus
VATP

SEQ ID NO: 1992885 - protein, 5 aa, Staphylococcus
VATPN

SEQ ID NO: 1992886 - protein, 4 aa, Staphylococcus
VATS

SEQ ID NO: 1992887 - protein, 7 aa, Staphylococcus
VATSEYD

SEQ ID NO: 1992888 - protein, 6 aa, Staphylococcus
VATTKT

SEQ ID NO: 1992889 - protein, 7 aa, Staphylococcus
VAVGDTK

SEQ ID NO: 1992890 - protein, 7 aa, Staphylococcus
VAVGETK

SEQ ID NO: 1992891 - protein, 6 aa, Staphylococcus
VAVGQT

SEQ ID NO: 1992892 - protein, 7 aa, Staphylococcus
VAVGSTK

SEQ ID NO: 1992893 - protein, 20 aa, Staphylococcus
VAYAEQSELPDVESLYKDVF

SEQ ID NO: 1992894 - protein, 16 aa, Staphylococcus
VAYESSPATSQMEEEV

SEQ ID NO: 1992895 - protein, 9 aa, Staphylococcus
VAYNGREAL

SEQ ID NO: 1992896 - protein, 8 aa, Staphylococcus
VAYSNKKM

SEQ ID NO: 1992897 - protein, 9 aa, Staphylococcus
VDAAKGFGI

SEQ ID NO: 1992898 - protein, 10 aa, Staphylococcus
VDAAKGFGIE

SEQ ID NO: 1992899 - protein, 6 aa, Staphylococcus
VDAATK

SEQ ID NO: 1992900 - protein, 8 aa, Staphylococcus
VDAETHQL

SEQ ID NO: 1992901 - protein, 5 aa, Staphylococcus
VDAGA

SEQ ID NO: 1992902 - protein, 8 aa, Staphylococcus
VDAGADGI

SEQ ID NO: 1992903 - protein, 13 aa, Staphylococcus
VDAHDSTSAPVDD

SEQ ID NO: 1992904 - protein, 12 aa, Staphylococcus
VDANNKNKEDMS

SEQ ID NO: 1992905 - protein, 8 aa, Staphylococcus
VDASDEEI

SEQ ID NO: 1992906 - protein, 14 aa, Staphylococcus
VDASGKYAKTSYET

SEQ ID NO: 1992907 - protein, 7 aa, Staphylococcus
VDASHYR

SEQ ID NO: 1992908 - protein, 6 aa, Staphylococcus
VDASNK

SEQ ID NO: 1992909 - protein, 5 aa, Staphylococcus
VDASY

SEQ ID NO: 1992910 - protein, 4 aa, Staphylococcus
VDDD

SEQ ID NO: 1992911 - protein, 7 aa, Staphylococcus
VDDDTIT

SEQ ID NO: 1992912 - protein, 5 aa, Staphylococcus
VDDDV

SEQ ID NO: 1992913 - protein, 11 aa, Staphylococcus
VDDEDATERKV

SEQ ID NO: 1992914 - protein, 8 aa, Staphylococcus
VDDGKDAV

SEQ ID NO: 1992915 - protein, 10 aa, Staphylococcus
VDDGKGDKIA

SEQ ID NO: 1992916 - protein, 23 aa, Staphylococcus
VDDGKGDKTALNYKDAERQESYT

SEQ ID NO: 1992917 - protein, 6 aa, Staphylococcus
VDDHQK

SEQ ID NO: 1992918 - protein, 15 aa, Staphylococcus
VDDITTDSRTAKEGS

SEQ ID NO: 1992919 - protein, 9 aa, Staphylococcus
VDDKSSEQF

SEQ ID NO: 1992920 - protein, 12 aa, Staphylococcus
VDDKTEEKVEDV

SEQ ID NO: 1992921 - protein, 5 aa, Staphylococcus
VDDLG

SEQ ID NO: 1992922 - protein, 7 aa, Staphylococcus
VDDMSAT

SEQ ID NO: 1992923 - protein, 5 aa, Staphylococcus
VDDNT

SEQ ID NO: 1992924 - protein, 5 aa, Staphylococcus
VDDQL

SEQ ID NO: 1992925 - protein, 15 aa, Staphylococcus
VDDRAMDSNDLERER

SEQ ID NO: 1992926 - protein, 10 aa, Staphylococcus
VDDSKKLTDA

SEQ ID NO: 1992927 - protein, 10 aa, Staphylococcus
VDDSKKLTDT

SEQ ID NO: 1992928 - protein, 11 aa, Staphylococcus
VDDSKKLTDTK

SEQ ID NO: 1992929 - protein, 4 aa, Staphylococcus
VDEA

SEQ ID NO: 1992930 - protein, 14 aa, Staphylococcus
VDEAAYDALPDPDE

SEQ ID NO: 1992931 - protein, 10 aa, Staphylococcus
VDEANTSEDY

SEQ ID NO: 1992932 - protein, 10 aa, Staphylococcus
VDEDGSDSAI

SEQ ID NO: 1992933 - protein, 7 aa, Staphylococcus
VDEDKQV

SEQ ID NO: 1992934 - protein, 4 aa, Staphylococcus
VDEE

SEQ ID NO: 1992935 - protein, 11 aa, Staphylococcus
VDEEELRNGRK

SEQ ID NO: 1992936 - protein, 10 aa, Staphylococcus
VDEEELRSGR

SEQ ID NO: 1992937 - protein, 10 aa, Staphylococcus
VDEENAKAEL

SEQ ID NO: 1992938 - protein, 8 aa, Staphylococcus
VDEENDSG

SEQ ID NO: 1992939 - protein, 9 aa, Staphylococcus
VDEENESGA

SEQ ID NO: 1992940 - protein, 10 aa, Staphylococcus
VDEENESGAY

SEQ ID NO: 1992941 - protein, 8 aa, Staphylococcus
VDEEPEVD

SEQ ID NO: 1992942 - protein, 7 aa, Staphylococcus
VDEEPLD

SEQ ID NO: 1992943 - protein, 11 aa, Staphylococcus
VDEETLRNGRQ

SEQ ID NO: 1992944 - protein, 13 aa, Staphylococcus
VDEETMQQNHANL

SEQ ID NO: 1992945 - protein, 5 aa, Staphylococcus
VDEFD

SEQ ID NO: 1992946 - protein, 4 aa, Staphylococcus
VDEG

SEQ ID NO: 1992947 - protein, 8 aa, Staphylococcus
VDEGKGDK

SEQ ID NO: 1992948 - protein, 7 aa, Staphylococcus
VDEIPDL

SEQ ID NO: 1992949 - protein, 5 aa, Staphylococcus
VDEKQ

SEQ ID NO: 1992950 - protein, 11 aa, Staphylococcus
VDEKTSKTCLS

SEQ ID NO: 1992951 - protein, 9 aa, Staphylococcus
VDELPNDES

SEQ ID NO: 1992952 - protein, 11 aa, Staphylococcus
VDEMPESDEDV

SEQ ID NO: 1992953 - protein, 4 aa, Staphylococcus
VDEN

SEQ ID NO: 1992954 - protein, 9 aa, Staphylococcus
VDEPSVEDT

SEQ ID NO: 1992955 - protein, 4 aa, Staphylococcus
VDEQ

SEQ ID NO: 1992956 - protein, 8 aa, Staphylococcus
VDEQGSEY

SEQ ID NO: 1992957 - protein, 10 aa, Staphylococcus
VDEQSKTVGA

SEQ ID NO: 1992958 - protein, 15 aa, Staphylococcus
VDERAMDSNDIERER

SEQ ID NO: 1992959 - protein, 16 aa, Staphylococcus
VDERAMDSNDLERERG

SEQ ID NO: 1992960 - protein, 6 aa, Staphylococcus
VDERSK

SEQ ID NO: 1992961 - protein, 5 aa, Staphylococcus
VDETI

SEQ ID NO: 1992962 - protein, 8 aa, Staphylococcus
VDETTVSN

SEQ ID NO: 1992963 - protein, 7 aa, Staphylococcus
VDEVEDK

SEQ ID NO: 1992964 - protein, 4 aa, Staphylococcus
VDEY

SEQ ID NO: 1992965 - protein, 11 aa, Staphylococcus
VDFGTGGPKDV

SEQ ID NO: 1992966 - protein, 17 aa, Staphylococcus
VDGAIGSTYNVNGRRAR

SEQ ID NO: 1992967 - protein, 7 aa, Staphylococcus
VDGAKGD

SEQ ID NO: 1992968 - protein, 8 aa, Staphylococcus
VDGDAEKA

SEQ ID NO: 1992969 - protein, 11 aa, Staphylococcus
VDGDFDKSSSL

SEQ ID NO: 1992970 - protein, 10 aa, Staphylococcus
VDGEETAFPD

SEQ ID NO: 1992971 - protein, 5 aa, Staphylococcus
VDGEG

SEQ ID NO: 1992972 - protein, 7 aa, Staphylococcus
VDGENQG

SEQ ID NO: 1992973 - protein, 7 aa, Staphylococcus
VDGGMSD

SEQ ID NO: 1992974 - protein, 10 aa, Staphylococcus
VDGKNYTPQE

SEQ ID NO: 1992975 - protein, 7 aa, Staphylococcus
VDGKQAD

SEQ ID NO: 1992976 - protein, 4 aa, Staphylococcus
VDGM

SEQ ID NO: 1992977 - protein, 11 aa, Staphylococcus
VDGNTDDYGTN

SEQ ID NO: 1992978 - protein, 11 aa, Staphylococcus
VDGPNTKEIAQ

SEQ ID NO: 1992979 - protein, 8 aa, Staphylococcus
VDGQNAGM

SEQ ID NO: 1992980 - protein, 15 aa, Staphylococcus
VDGRATSKVSIPSPN

SEQ ID NO: 1992981 - protein, 10 aa, Staphylococcus
VDGRHEEAEE

SEQ ID NO: 1992982 - protein, 7 aa, Staphylococcus
VDGSAGD

SEQ ID NO: 1992983 - protein, 8 aa, Staphylococcus
VDGSEGDI

SEQ ID NO: 1992984 - protein, 10 aa, Staphylococcus
VDGSEPISVA

SEQ ID NO: 1992985 - protein, 7 aa, Staphylococcus
VDGSTGN

SEQ ID NO: 1992986 - protein, 9 aa, Staphylococcus
VDGTDEYDT

SEQ ID NO: 1992987 - protein, 9 aa, Staphylococcus
VDGTGTELT

SEQ ID NO: 1992988 - protein, 9 aa, Staphylococcus
VDGTGTNLE

SEQ ID NO: 1992989 - protein, 9 aa, Staphylococcus
VDGTGTTLE

SEQ ID NO: 1992990 - protein, 7 aa, Staphylococcus
VDHKETI

SEQ ID NO: 1992991 - protein, 4 aa, Staphylococcus
VDHM

SEQ ID NO: 1992992 - protein, 7 aa, Staphylococcus
VDHRETI

SEQ ID NO: 1992993 - protein, 8 aa, Staphylococcus
VDIDTKEI

SEQ ID NO: 1992994 - protein, 10 aa, Staphylococcus
VDIENTTRNA

SEQ ID NO: 1992995 - protein, 8 aa, Staphylococcus
VDIKPEER

SEQ ID NO: 1992996 - protein, 4 aa, Staphylococcus
VDIP

SEQ ID NO: 1992997 - protein, 5 aa, Staphylococcus
VDIPS

SEQ ID NO: 1992998 - protein, 6 aa, Staphylococcus
VDISGK

SEQ ID NO: 1992999 - protein, 10 aa, Staphylococcus
VDISTKKQVG

SEQ ID NO: 1993000 - protein, 4 aa, Staphylococcus
VDKA

SEQ ID NO: 1993001 - protein, 8 aa, Staphylococcus
VDKAAQRN

SEQ ID NO: 1993002 - protein, 9 aa, Staphylococcus
VDKASQSNL

SEQ ID NO: 1993003 - protein, 7 aa, Staphylococcus
VDKATEK

SEQ ID NO: 1993004 - protein, 8 aa, Staphylococcus
VDKATETY

SEQ ID NO: 1993005 - protein, 4 aa, Staphylococcus
VDKD

SEQ ID NO: 1993006 - protein, 10 aa, Staphylococcus
VDKDAKQKVE

SEQ ID NO: 1993007 - protein, 10 aa, Staphylococcus
VDKDGKDSPI

SEQ ID NO: 1993008 - protein, 8 aa, Staphylococcus
VDKETEKI

SEQ ID NO: 1993009 - protein, 7 aa, Staphylococcus
VDKGATL

SEQ ID NO: 1993010 - protein, 7 aa, Staphylococcus
VDKGDSW

SEQ ID NO: 1993011 - protein, 10 aa, Staphylococcus
VDKGITAPHH

SEQ ID NO: 1993012 - protein, 7 aa, Staphylococcus
VDKGQLN

SEQ ID NO: 1993013 - protein, 8 aa, Staphylococcus
VDKGSGIA

SEQ ID NO: 1993014 - protein, 6 aa, Staphylococcus
VDKGTI

SEQ ID NO: 1993015 - protein, 11 aa, Staphylococcus
VDKGTSFGAST

SEQ ID NO: 1993016 - protein, 16 aa, Staphylococcus
VDKGTSFGASTLQENK

SEQ ID NO: 1993017 - protein, 9 aa, Staphylococcus
VDKGYEQSR

SEQ ID NO: 1993018 - protein, 13 aa, Staphylococcus
VDKHSTGGVGDTT

SEQ ID NO: 1993019 - protein, 9 aa, Staphylococcus
VDKKEDVEI

SEQ ID NO: 1993020 - protein, 11 aa, Staphylococcus
VDKLSEDETQI

SEQ ID NO: 1993021 - protein, 4 aa, Staphylococcus
VDKN

SEQ ID NO: 1993022 - protein, 5 aa, Staphylococcus
VDKND

SEQ ID NO: 1993023 - protein, 13 aa, Staphylococcus
VDKNDSTSAPVED

SEQ ID NO: 1993024 - protein, 5 aa, Staphylococcus
VDKNN

SEQ ID NO: 1993025 - protein, 6 aa, Staphylococcus
VDKPKS

SEQ ID NO: 1993026 - protein, 6 aa, Staphylococcus
VDKPSI

SEQ ID NO: 1993027 - protein, 8 aa, Staphylococcus
VDKQSGVT

SEQ ID NO: 1993028 - protein, 8 aa, Staphylococcus
VDKRLPKV

SEQ ID NO: 1993029 - protein, 15 aa, Staphylococcus
VDKRRAEFHPQGART

SEQ ID NO: 1993030 - protein, 18 aa, Staphylococcus
VDKRREEFHPQGTRSHKT

SEQ ID NO: 1993031 - protein, 16 aa, Staphylococcus
VDKRREEFHPSGSRSH

SEQ ID NO: 1993032 - protein, 4 aa, Staphylococcus
VDKS

SEQ ID NO: 1993033 - protein, 9 aa, Staphylococcus
VDKSENTLK

SEQ ID NO: 1993034 - protein, 9 aa, Staphylococcus
VDKSGAWYS

SEQ ID NO: 1993035 - protein, 7 aa, Staphylococcus
VDKTAQA

SEQ ID NO: 1993036 - protein, 12 aa, Staphylococcus
VDKTDRPKLIIK

SEQ ID NO: 1993037 - protein, 12 aa, Staphylococcus
VDKTIKSGVVHQ

SEQ ID NO: 1993038 - protein, 8 aa, Staphylococcus
VDKYKNSV

SEQ ID NO: 1993039 - protein, 37 aa, Staphylococcus
VDLDPNAKDSPYKAKDKVENETATPRKRADAEEVEAD

SEQ ID NO: 1993040 - protein, 10 aa, Staphylococcus
VDMTTPKPIE

SEQ ID NO: 1993041 - protein, 8 aa, Staphylococcus
VDNDINDP

SEQ ID NO: 1993042 - protein, 6 aa, Staphylococcus
VDNEHT

SEQ ID NO: 1993043 - protein, 9 aa, Staphylococcus
VDNGESLTA

SEQ ID NO: 1993044 - protein, 7 aa, Staphylococcus
VDNGRHP

SEQ ID NO: 1993045 - protein, 8 aa, Staphylococcus
VDNGSVNE

SEQ ID NO: 1993046 - protein, 15 aa, Staphylococcus
VDNGTSFGASTLQEN

SEQ ID NO: 1993047 - protein, 4 aa, Staphylococcus
VDNH

SEQ ID NO: 1993048 - protein, 12 aa, Staphylococcus
VDNINKDAATKR

SEQ ID NO: 1993049 - protein, 9 aa, Staphylococcus
VDNISSKNQ

SEQ ID NO: 1993050 - protein, 6 aa, Staphylococcus
VDNNEI

SEQ ID NO: 1993051 - protein, 10 aa, Staphylococcus
VDNNHKDNLK

SEQ ID NO: 1993052 - protein, 6 aa, Staphylococcus
VDNNRD

SEQ ID NO: 1993053 - protein, 9 aa, Staphylococcus
VDNPEKVPY

SEQ ID NO: 1993054 - protein, 7 aa, Staphylococcus
VDNPEMK

SEQ ID NO: 1993055 - protein, 17 aa, Staphylococcus
VDNPSYEQVKTGNTGHL

SEQ ID NO: 1993056 - protein, 10 aa, Staphylococcus
VDNQFDYDST

SEQ ID NO: 1993057 - protein, 7 aa, Staphylococcus
VDNQVSS

SEQ ID NO: 1993058 - protein, 9 aa, Staphylococcus
VDNTIDKKG

SEQ ID NO: 1993059 - protein, 11 aa, Staphylococcus
VDNYSSAGSFR

SEQ ID NO: 1993060 - protein, 8 aa, Staphylococcus
VDPAANPY

SEQ ID NO: 1993061 - protein, 10 aa, Staphylococcus
VDPDKVSVED

SEQ ID NO: 1993062 - protein, 7 aa, Staphylococcus
VDPDLPN

SEQ ID NO: 1993063 - protein, 24 aa, Staphylococcus
VDPDRQGIADTWPDSIDTSCSRNE

SEQ ID NO: 1993064 - protein, 4 aa, Staphylococcus
VDPE

SEQ ID NO: 1993065 - protein, 6 aa, Staphylococcus
VDPEEI

SEQ ID NO: 1993066 - protein, 6 aa, Staphylococcus
VDPEKI

SEQ ID NO: 1993067 - protein, 25 aa, Staphylococcus
VDPERQNIASTWPDSIDTSCSRGEW

SEQ ID NO: 1993068 - protein, 11 aa, Staphylococcus
VDPEVRGQGIG

SEQ ID NO: 1993069 - protein, 6 aa, Staphylococcus
VDPGES

SEQ ID NO: 1993070 - protein, 4 aa, Staphylococcus
VDPI

SEQ ID NO: 1993071 - protein, 9 aa, Staphylococcus
VDPKGGCTG

SEQ ID NO: 1993072 - protein, 5 aa, Staphylococcus
VDPKN

SEQ ID NO: 1993073 - protein, 8 aa, Staphylococcus
VDPKTASE

SEQ ID NO: 1993074 - protein, 6 aa, Staphylococcus
VDPNDG

SEQ ID NO: 1993075 - protein, 7 aa, Staphylococcus
VDPNDVS

SEQ ID NO: 1993076 - protein, 16 aa, Staphylococcus
VDPQDVYDKTMKLTDL

SEQ ID NO: 1993077 - protein, 5 aa, Staphylococcus
VDPQK

SEQ ID NO: 1993078 - protein, 15 aa, Staphylococcus
VDPQNPGQLLPEEED

SEQ ID NO: 1993079 - protein, 17 aa, Staphylococcus
VDPSYEPDISIEDSKQY

SEQ ID NO: 1993080 - protein, 16 aa, Staphylococcus
VDPSYEPEISIEDSKQ

SEQ ID NO: 1993081 - protein, 18 aa, Staphylococcus
VDPSYEPEISIEESKTYI

SEQ ID NO: 1993082 - protein, 4 aa, Staphylococcus
VDPT

SEQ ID NO: 1993083 - protein, 5 aa, Staphylococcus
VDPTE

SEQ ID NO: 1993084 - protein, 15 aa, Staphylococcus
VDPTEIKNASLPNHK

SEQ ID NO: 1993085 - protein, 21 aa, Staphylococcus
VDPVEGTKPTTKQDMTDLQST

SEQ ID NO: 1993086 - protein, 20 aa, Staphylococcus
VDQAGKYAATSYQPINASEQ

SEQ ID NO: 1993087 - protein, 5 aa, Staphylococcus
VDQAK

SEQ ID NO: 1993088 - protein, 9 aa, Staphylococcus
VDQENEQID

SEQ ID NO: 1993089 - protein, 10 aa, Staphylococcus
VDQETINDSY

SEQ ID NO: 1993090 - protein, 4 aa, Staphylococcus
VDQH

SEQ ID NO: 1993091 - protein, 10 aa, Staphylococcus
VDQKTSHNLN

SEQ ID NO: 1993092 - protein, 5 aa, Staphylococcus
VDQLE

SEQ ID NO: 1993093 - protein, 5 aa, Staphylococcus
VDQNN

SEQ ID NO: 1993094 - protein, 5 aa, Staphylococcus
VDQNV

SEQ ID NO: 1993095 - protein, 4 aa, Staphylococcus
VDQQ

SEQ ID NO: 1993096 - protein, 20 aa, Staphylococcus
VDQRIQEASIENPDNAHLKN

SEQ ID NO: 1993097 - protein, 7 aa, Staphylococcus
VDRATRL

SEQ ID NO: 1993098 - protein, 14 aa, Staphylococcus
VDRDDEAFSNPTKP

SEQ ID NO: 1993099 - protein, 15 aa, Staphylococcus
VDRDKKAIKTAPKIT

SEQ ID NO: 1993100 - protein, 14 aa, Staphylococcus
VDREKAKNKRGKIG

SEQ ID NO: 1993101 - protein, 13 aa, Staphylococcus
VDRENPGPSTLKR

SEQ ID NO: 1993102 - protein, 18 aa, Staphylococcus
VDRGNRSYFESKQSTPYA

SEQ ID NO: 1993103 - protein, 5 aa, Staphylococcus
VDRTR

SEQ ID NO: 1993104 - protein, 18 aa, Staphylococcus
VDSASPGELGGTYAGNPL

SEQ ID NO: 1993105 - protein, 8 aa, Staphylococcus
VDSDDKDI

SEQ ID NO: 1993106 - protein, 7 aa, Staphylococcus
VDSDEKD

SEQ ID NO: 1993107 - protein, 7 aa, Staphylococcus
VDSDEKQ

SEQ ID NO: 1993108 - protein, 11 aa, Staphylococcus
VDSDKPSSPCG

SEQ ID NO: 1993109 - protein, 6 aa, Staphylococcus
VDSDLA

SEQ ID NO: 1993110 - protein, 11 aa, Staphylococcus
VDSDTSSKVSL

SEQ ID NO: 1993111 - protein, 11 aa, Staphylococcus
VDSEEDVQFTQ

SEQ ID NO: 1993112 - protein, 12 aa, Staphylococcus
VDSEETVEYSQK

SEQ ID NO: 1993113 - protein, 9 aa, Staphylococcus
VDSEGGVET

SEQ ID NO: 1993114 - protein, 12 aa, Staphylococcus
VDSEKPSSPCGT

SEQ ID NO: 1993115 - protein, 7 aa, Staphylococcus
VDSGREE

SEQ ID NO: 1993116 - protein, 11 aa, Staphylococcus
VDSGSKRSSIG

SEQ ID NO: 1993117 - protein, 6 aa, Staphylococcus
VDSKDH

SEQ ID NO: 1993118 - protein, 8 aa, Staphylococcus
VDSKSEAL

SEQ ID NO: 1993119 - protein, 10 aa, Staphylococcus
VDSKSQNKKN

SEQ ID NO: 1993120 - protein, 7 aa, Staphylococcus
VDSKTGG

SEQ ID NO: 1993121 - protein, 4 aa, Staphylococcus
VDSL

SEQ ID NO: 1993122 - protein, 12 aa, Staphylococcus
VDSLATEAREKL

SEQ ID NO: 1993123 - protein, 13 aa, Staphylococcus
VDSLATEAREKLA

SEQ ID NO: 1993124 - protein, 12 aa, Staphylococcus
VDSNYGPTWYDA

SEQ ID NO: 1993125 - protein, 12 aa, Staphylococcus
VDSNYGSTWYDA

SEQ ID NO: 1993126 - protein, 7 aa, Staphylococcus
VDSSGQS

SEQ ID NO: 1993127 - protein, 12 aa, Staphylococcus
VDSSYGPTWYDA

SEQ ID NO: 1993128 - protein, 8 aa, Staphylococcus
VDSTGQSL

SEQ ID NO: 1993129 - protein, 8 aa, Staphylococcus
VDSTQLKA

SEQ ID NO: 1993130 - protein, 16 aa, Staphylococcus
VDSTQTKAKKALVGNK

SEQ ID NO: 1993131 - protein, 8 aa, Staphylococcus
VDTDDDNS

SEQ ID NO: 1993132 - protein, 5 aa, Staphylococcus
VDTDL

SEQ ID NO: 1993133 - protein, 11 aa, Staphylococcus
VDTDSKKGMRD

SEQ ID NO: 1993134 - protein, 5 aa, Staphylococcus
VDTEE

SEQ ID NO: 1993135 - protein, 8 aa, Staphylococcus
VDTEQSVE

SEQ ID NO: 1993136 - protein, 15 aa, Staphylococcus
VDTESTDSEATGEGE

SEQ ID NO: 1993137 - protein, 6 aa, Staphylococcus
VDTETF

SEQ ID NO: 1993138 - protein, 5 aa, Staphylococcus
VDTGE

SEQ ID NO: 1993139 - protein, 5 aa, Staphylococcus
VDTIG

SEQ ID NO: 1993140 - protein, 8 aa, Staphylococcus
VDTKDAMG

SEQ ID NO: 1993141 - protein, 7 aa, Staphylococcus
VDTKDDQ

SEQ ID NO: 1993142 - protein, 4 aa, Staphylococcus
VDTP

SEQ ID NO: 1993143 - protein, 6 aa, Staphylococcus
VDTPLS

SEQ ID NO: 1993144 - protein, 4 aa, Staphylococcus
VDTQ

SEQ ID NO: 1993145 - protein, 7 aa, Staphylococcus
VDTRSIT

SEQ ID NO: 1993146 - protein, 12 aa, Staphylococcus
VDTSNEEAQKVN

SEQ ID NO: 1993147 - protein, 9 aa, Staphylococcus
VDTTAAGDT

SEQ ID NO: 1993148 - protein, 8 aa, Staphylococcus
VDTTDDLK

SEQ ID NO: 1993149 - protein, 22 aa, Staphylococcus
VDTTDEAGQKLSAKLSTSYGKI

SEQ ID NO: 1993150 - protein, 11 aa, Staphylococcus
VDTTGAGDTFN

SEQ ID NO: 1993151 - protein, 16 aa, Staphylococcus
VDTTQPNNIEQAIQSN

SEQ ID NO: 1993152 - protein, 9 aa, Staphylococcus
VDTTTNENI

SEQ ID NO: 1993153 - protein, 8 aa, Staphylococcus
VDTVENTG

SEQ ID NO: 1993154 - protein, 13 aa, Staphylococcus
VDVDGKSYTPQEI

SEQ ID NO: 1993155 - protein, 6 aa, Staphylococcus
VDVDRA

SEQ ID NO: 1993156 - protein, 13 aa, Staphylococcus
VDVGTTVTGAPTQ

SEQ ID NO: 1993157 - protein, 13 aa, Staphylococcus
VDVPNAKAIRETM

SEQ ID NO: 1993158 - protein, 13 aa, Staphylococcus
VDVPNAKAIRSTM

SEQ ID NO: 1993159 - protein, 6 aa, Staphylococcus
VDYANG

SEQ ID NO: 1993160 - protein, 25 aa, Staphylococcus
VDYDKENGSVTVDASATLNEEAPYE

SEQ ID NO: 1993161 - protein, 5 aa, Staphylococcus
VDYNM

SEQ ID NO: 1993162 - protein, 6 aa, Staphylococcus
VDYQGQ

SEQ ID NO: 1993163 - protein, 8 aa, Staphylococcus
VEAADKDY

SEQ ID NO: 1993164 - protein, 9 aa, Staphylococcus
VEAAKGKDE

SEQ ID NO: 1993165 - protein, 5 aa, Staphylococcus
VEADN

SEQ ID NO: 1993166 - protein, 4 aa, Staphylococcus
VEAG

SEQ ID NO: 1993167 - protein, 6 aa, Staphylococcus
VEAGLT

SEQ ID NO: 1993168 - protein, 7 aa, Staphylococcus
VEAGRYD

SEQ ID NO: 1993169 - protein, 14 aa, Staphylococcus
VEAGVNNDGAKLGT

SEQ ID NO: 1993170 - protein, 4 aa, Staphylococcus
VEAH

SEQ ID NO: 1993171 - protein, 5 aa, Staphylococcus
VEAKG

SEQ ID NO: 1993172 - protein, 15 aa, Staphylococcus
VEAKNPEGHDVLIWK

SEQ ID NO: 1993173 - protein, 10 aa, Staphylococcus
VEAKRLQNNP

SEQ ID NO: 1993174 - protein, 10 aa, Staphylococcus
VEAKRLRNNP

SEQ ID NO: 1993175 - protein, 8 aa, Staphylococcus
VEAPASGT

SEQ ID NO: 1993176 - protein, 8 aa, Staphylococcus
VEASGGRI

SEQ ID NO: 1993177 - protein, 6 aa, Staphylococcus
VEASTE

SEQ ID NO: 1993178 - protein, 8 aa, Staphylococcus
VEASYTGK

SEQ ID NO: 1993179 - protein, 7 aa, Staphylococcus
VEATGKD

SEQ ID NO: 1993180 - protein, 8 aa, Staphylococcus
VEATPENI

SEQ ID NO: 1993181 - protein, 36 aa, Staphylococcus
VEATPGNLKQLEQQNKRAEADRQKEIDDAKALKSKL

SEQ ID NO: 1993182 - protein, 35 aa, Staphylococcus
VEATPGNLKQLEQQNKRAEADRQQEIDDAKALKEK

SEQ ID NO: 1993183 - protein, 36 aa, Staphylococcus
VEATPGNLKQLEQQNKRAEADRQQEIDDAKALKEKL

SEQ ID NO: 1993184 - protein, 36 aa, Staphylococcus
VEATPGNLKQLQQQNKHAEQEREQEIEDAKALKKKL

SEQ ID NO: 1993185 - protein, 37 aa, Staphylococcus
VEATPGNLRQLEQKNKAAEAERQQEIEDAKKLKEQLS

SEQ ID NO: 1993186 - protein, 12 aa, Staphylococcus
VEATQQIKKDLP

SEQ ID NO: 1993187 - protein, 10 aa, Staphylococcus
VEATTLESQE

SEQ ID NO: 1993188 - protein, 6 aa, Staphylococcus
VEAVGQ

SEQ ID NO: 1993189 - protein, 7 aa, Staphylococcus
VEAVKSG

SEQ ID NO: 1993190 - protein, 8 aa, Staphylococcus
VECGETPL

SEQ ID NO: 1993191 - protein, 4 aa, Staphylococcus
VEDA

SEQ ID NO: 1993192 - protein, 18 aa, Staphylococcus
VEDDNEAEQLYHQYLKSL

SEQ ID NO: 1993193 - protein, 4 aa, Staphylococcus
VEDE

SEQ ID NO: 1993194 - protein, 10 aa, Staphylococcus
VEDEDMRRGV

SEQ ID NO: 1993195 - protein, 27 aa, Staphylococcus
VEDEDTTERKVDLQQKDAPQSQQEETA

SEQ ID NO: 1993196 - protein, 14 aa, Staphylococcus
VEDEDYKPGFTIRN

SEQ ID NO: 1993197 - protein, 6 aa, Staphylococcus
VEDEEL

SEQ ID NO: 1993198 - protein, 11 aa, Staphylococcus
VEDEELRNGRK

SEQ ID NO: 1993199 - protein, 7 aa, Staphylococcus
VEDGDTF

SEQ ID NO: 1993200 - protein, 19 aa, Staphylococcus
VEDIEARKKQRNKLNSNKS

SEQ ID NO: 1993201 - protein, 8 aa, Staphylococcus
VEDKKFDE

SEQ ID NO: 1993202 - protein, 15 aa, Staphylococcus
VEDKSKARDSHTGDQ

SEQ ID NO: 1993203 - protein, 8 aa, Staphylococcus
VEDKTSWN

SEQ ID NO: 1993204 - protein, 10 aa, Staphylococcus
VEDNGTFEVT

SEQ ID NO: 1993205 - protein, 11 aa, Staphylococcus
VEDNLGQEQQF

SEQ ID NO: 1993206 - protein, 11 aa, Staphylococcus
VEDPDLRKNHP

SEQ ID NO: 1993207 - protein, 11 aa, Staphylococcus
VEDPDLRTNHP

SEQ ID NO: 1993208 - protein, 4 aa, Staphylococcus
VEDQ

SEQ ID NO: 1993209 - protein, 15 aa, Staphylococcus
VEDRGGYYESSGALK

SEQ ID NO: 1993210 - protein, 11 aa, Staphylococcus
VEDRNAPITEQ

SEQ ID NO: 1993211 - protein, 5 aa, Staphylococcus
VEDSN

SEQ ID NO: 1993212 - protein, 5 aa, Staphylococcus
VEDSS

SEQ ID NO: 1993213 - protein, 10 aa, Staphylococcus
VEDSVKEGDN

SEQ ID NO: 1993214 - protein, 7 aa, Staphylococcus
VEDTAIQ

SEQ ID NO: 1993215 - protein, 7 aa, Staphylococcus
VEDTASA

SEQ ID NO: 1993216 - protein, 7 aa, Staphylococcus
VEDTDNK

SEQ ID NO: 1993217 - protein, 16 aa, Staphylococcus
VEDTNSISTKEETEAV

SEQ ID NO: 1993218 - protein, 5 aa, Staphylococcus
VEDTQ

SEQ ID NO: 1993219 - protein, 4 aa, Staphylococcus
VEEA

SEQ ID NO: 1993220 - protein, 13 aa, Staphylococcus
VEEAARKGEYAKT

SEQ ID NO: 1993221 - protein, 8 aa, Staphylococcus
VEEAHKHD

SEQ ID NO: 1993222 - protein, 9 aa, Staphylococcus
VEEAHKHGK

SEQ ID NO: 1993223 - protein, 11 aa, Staphylococcus
VEEAKNETGAN

SEQ ID NO: 1993224 - protein, 11 aa, Staphylococcus
VEEAKQETGAN

SEQ ID NO: 1993225 - protein, 6 aa, Staphylococcus
VEEARK

SEQ ID NO: 1993226 - protein, 8 aa, Staphylococcus
VEEAVNAD

SEQ ID NO: 1993227 - protein, 10 aa, Staphylococcus
VEEDEDAGVN

SEQ ID NO: 1993228 - protein, 9 aa, Staphylococcus
VEEDEEPFE

SEQ ID NO: 1993229 - protein, 8 aa, Staphylococcus
VEEDENIG

SEQ ID NO: 1993230 - protein, 8 aa, Staphylococcus
VEEDENVG

SEQ ID NO: 1993231 - protein, 11 aa, Staphylococcus
VEEEALRNGRK

SEQ ID NO: 1993232 - protein, 7 aa, Staphylococcus
VEEEDTF

SEQ ID NO: 1993233 - protein, 5 aa, Staphylococcus
VEEEG

SEQ ID NO: 1993234 - protein, 5 aa, Staphylococcus
VEEEI

SEQ ID NO: 1993235 - protein, 8 aa, Staphylococcus
VEEENTEV

SEQ ID NO: 1993236 - protein, 5 aa, Staphylococcus
VEEES

SEQ ID NO: 1993237 - protein, 25 aa, Staphylococcus
VEEESTLEESAENPKELGRQIGIKH

SEQ ID NO: 1993238 - protein, 4 aa, Staphylococcus
VEEG

SEQ ID NO: 1993239 - protein, 6 aa, Staphylococcus
VEEGEI

SEQ ID NO: 1993240 - protein, 6 aa, Staphylococcus
VEEGTA

SEQ ID NO: 1993241 - protein, 5 aa, Staphylococcus
VEEGY

SEQ ID NO: 1993242 - protein, 5 aa, Staphylococcus
VEEIA

SEQ ID NO: 1993243 - protein, 15 aa, Staphylococcus
VEEIKAGKVEYRAEK

SEQ ID NO: 1993244 - protein, 17 aa, Staphylococcus
VEEIKAGKVEYRAEKSG

SEQ ID NO: 1993245 - protein, 12 aa, Staphylococcus
VEEIKGKDSEDI

SEQ ID NO: 1993246 - protein, 15 aa, Staphylococcus
VEEKEEDAPKSLFDE

SEQ ID NO: 1993247 - protein, 27 aa, Staphylococcus
VEEKLKEQKEEKTDDIEQTKKDVQDTL

SEQ ID NO: 1993248 - protein, 7 aa, Staphylococcus
VEEKPSI

SEQ ID NO: 1993249 - protein, 8 aa, Staphylococcus
VEEKQAED

SEQ ID NO: 1993250 - protein, 14 aa, Staphylococcus
VEEMASTENEQDLY

SEQ ID NO: 1993251 - protein, 8 aa, Staphylococcus
VEENPYQG

SEQ ID NO: 1993252 - protein, 10 aa, Staphylococcus
VEEPDEDALE

SEQ ID NO: 1993253 - protein, 5 aa, Staphylococcus
VEEPI

SEQ ID NO: 1993254 - protein, 10 aa, Staphylococcus
VEEPPISVKD

SEQ ID NO: 1993255 - protein, 6 aa, Staphylococcus
VEEPQA

SEQ ID NO: 1993256 - protein, 5 aa, Staphylococcus
VEEQA

SEQ ID NO: 1993257 - protein, 36 aa, Staphylococcus
VEEQGYDIEAKNEDMQSKEDKNTKFNSANVGEGLNP

SEQ ID NO: 1993258 - protein, 4 aa, Staphylococcus
VEER

SEQ ID NO: 1993259 - protein, 7 aa, Staphylococcus
VEERAKA

SEQ ID NO: 1993260 - protein, 10 aa, Staphylococcus
VEERAKSQHY

SEQ ID NO: 1993261 - protein, 9 aa, Staphylococcus
VEERARAEN

SEQ ID NO: 1993262 - protein, 8 aa, Staphylococcus
VEERVESE

SEQ ID NO: 1993263 - protein, 5 aa, Staphylococcus
VEESE

SEQ ID NO: 1993264 - protein, 5 aa, Staphylococcus
VEESG

SEQ ID NO: 1993265 - protein, 6 aa, Staphylococcus
VEESGY

SEQ ID NO: 1993266 - protein, 5 aa, Staphylococcus
VEESL

SEQ ID NO: 1993267 - protein, 12 aa, Staphylococcus
VEESMDDREEIS

SEQ ID NO: 1993268 - protein, 11 aa, Staphylococcus
VEESPSPILTE

SEQ ID NO: 1993269 - protein, 23 aa, Staphylococcus
VEETGDTFEANAKLKSEAAAKAL

SEQ ID NO: 1993270 - protein, 10 aa, Staphylococcus
VEETGTTFEE

SEQ ID NO: 1993271 - protein, 12 aa, Staphylococcus
VEETGTTFEENA

SEQ ID NO: 1993272 - protein, 23 aa, Staphylococcus
VEETGTTFEENARLKSEAAAKAL

SEQ ID NO: 1993273 - protein, 21 aa, Staphylococcus
VEETGTTFEENARLKSEEAAK

SEQ ID NO: 1993274 - protein, 4 aa, Staphylococcus
VEEV

SEQ ID NO: 1993275 - protein, 22 aa, Staphylococcus
VEEVDDVTDEQSNEIEGQSDES

SEQ ID NO: 1993276 - protein, 5 aa, Staphylococcus
VEEVQ

SEQ ID NO: 1993277 - protein, 12 aa, Staphylococcus
VEEVSDHRDEVD

SEQ ID NO: 1993278 - protein, 15 aa, Staphylococcus
VEEYERHSSQSQGIH

SEQ ID NO: 1993279 - protein, 6 aa, Staphylococcus
VEFEPH

SEQ ID NO: 1993280 - protein, 8 aa, Staphylococcus
VEGAHDTL

SEQ ID NO: 1993281 - protein, 7 aa, Staphylococcus
VEGAHET

SEQ ID NO: 1993282 - protein, 7 aa, Staphylococcus
VEGAPSN

SEQ ID NO: 1993283 - protein, 12 aa, Staphylococcus
VEGAQTGQTYRV

SEQ ID NO: 1993284 - protein, 5 aa, Staphylococcus
VEGDD

SEQ ID NO: 1993285 - protein, 8 aa, Staphylococcus
VEGDNSIS

SEQ ID NO: 1993286 - protein, 9 aa, Staphylococcus
VEGDTPDDL

SEQ ID NO: 1993287 - protein, 12 aa, Staphylococcus
VEGEDTRVLGKD

SEQ ID NO: 1993288 - protein, 7 aa, Staphylococcus
VEGEEGY

SEQ ID NO: 1993289 - protein, 10 aa, Staphylococcus
VEGEGDNGYA

SEQ ID NO: 1993290 - protein, 6 aa, Staphylococcus
VEGEKA

SEQ ID NO: 1993291 - protein, 7 aa, Staphylococcus
VEGENDT

SEQ ID NO: 1993292 - protein, 11 aa, Staphylococcus
VEGEPLPEAGD

SEQ ID NO: 1993293 - protein, 7 aa, Staphylococcus
VEGESGY

SEQ ID NO: 1993294 - protein, 9 aa, Staphylococcus
VEGESPDDL

SEQ ID NO: 1993295 - protein, 9 aa, Staphylococcus
VEGETPTEL

SEQ ID NO: 1993296 - protein, 5 aa, Staphylococcus
VEGGA

SEQ ID NO: 1993297 - protein, 7 aa, Staphylococcus
VEGGGKA

SEQ ID NO: 1993298 - protein, 12 aa, Staphylococcus
VEGGTEMTTEEK

SEQ ID NO: 1993299 - protein, 21 aa, Staphylococcus
VEGGTEMTTEEKIASGLNDSN

SEQ ID NO: 1993300 - protein, 13 aa, Staphylococcus
VEGINNKKILVKD

SEQ ID NO: 1993301 - protein, 7 aa, Staphylococcus
VEGKPSR

SEQ ID NO: 1993302 - protein, 11 aa, Staphylococcus
VEGLENETKRL

SEQ ID NO: 1993303 - protein, 4 aa, Staphylococcus
VEGN

SEQ ID NO: 1993304 - protein, 8 aa, Staphylococcus
VEGNGDKR

SEQ ID NO: 1993305 - protein, 4 aa, Staphylococcus
VEGP

SEQ ID NO: 1993306 - protein, 8 aa, Staphylococcus
VEGPKGAM

SEQ ID NO: 1993307 - protein, 18 aa, Staphylococcus
VEGPLAEEIEKEYNELVA

SEQ ID NO: 1993308 - protein, 9 aa, Staphylococcus
VEGQEKISQ

SEQ ID NO: 1993309 - protein, 24 aa, Staphylococcus
VEGSEENDNNLKGLPVTDEEMARK

SEQ ID NO: 1993310 - protein, 7 aa, Staphylococcus
VEGSPYK

SEQ ID NO: 1993311 - protein, 15 aa, Staphylococcus
VEGTDKAIASTIDGE

SEQ ID NO: 1993312 - protein, 10 aa, Staphylococcus
VEGTHTSAEE

SEQ ID NO: 1993313 - protein, 16 aa, Staphylococcus
VEGTNKAIASTIDGEA

SEQ ID NO: 1993314 - protein, 15 aa, Staphylococcus
VEGTNKAVASTIDGE

SEQ ID NO: 1993315 - protein, 16 aa, Staphylococcus
VEGTQKAIASTIDGEA

SEQ ID NO: 1993316 - protein, 15 aa, Staphylococcus
VEGTTPHTITGRFGS

SEQ ID NO: 1993317 - protein, 4 aa, Staphylococcus
VEGV

SEQ ID NO: 1993318 - protein, 4 aa, Staphylococcus
VEGY

SEQ ID NO: 1993319 - protein, 6 aa, Staphylococcus
VEHDGE

SEQ ID NO: 1993320 - protein, 7 aa, Staphylococcus
VEHGTEA

SEQ ID NO: 1993321 - protein, 15 aa, Staphylococcus
VEHTSNHLRETQQEM

SEQ ID NO: 1993322 - protein, 8 aa, Staphylococcus
VEHYEGRR

SEQ ID NO: 1993323 - protein, 5 aa, Staphylococcus
VEIEG

SEQ ID NO: 1993324 - protein, 17 aa, Staphylococcus
VEINSKPPKKHLNPKRL

SEQ ID NO: 1993325 - protein, 7 aa, Staphylococcus
VEIPDKP

SEQ ID NO: 1993326 - protein, 4 aa, Staphylococcus
VEKA

SEQ ID NO: 1993327 - protein, 20 aa, Staphylococcus
VEKAGKKIEMKRTEEYDMPE

SEQ ID NO: 1993328 - protein, 5 aa, Staphylococcus
VEKDG

SEQ ID NO: 1993329 - protein, 21 aa, Staphylococcus
VEKDGKDAANQAQEKAEQDGK

SEQ ID NO: 1993330 - protein, 11 aa, Staphylococcus
VEKDQQKTGLN

SEQ ID NO: 1993331 - protein, 6 aa, Staphylococcus
VEKEFD

SEQ ID NO: 1993332 - protein, 6 aa, Staphylococcus
VEKEFN

SEQ ID NO: 1993333 - protein, 21 aa, Staphylococcus
VEKEGKDAANEAQDKAEKEGK

SEQ ID NO: 1993334 - protein, 21 aa, Staphylococcus
VEKEGKDAANEAQSKAEQEGK

SEQ ID NO: 1993335 - protein, 21 aa, Staphylococcus
VEKEGKDKANAAQEQAEKDGK

SEQ ID NO: 1993336 - protein, 4 aa, Staphylococcus
VEKG

SEQ ID NO: 1993337 - protein, 8 aa, Staphylococcus
VEKGEVPL

SEQ ID NO: 1993338 - protein, 9 aa, Staphylococcus
VEKGFSNEK

SEQ ID NO: 1993339 - protein, 22 aa, Staphylococcus
VEKGTTGDGVESVTGYTGHDAA

SEQ ID NO: 1993340 - protein, 14 aa, Staphylococcus
VEKHNAKTNNPRLA

SEQ ID NO: 1993341 - protein, 4 aa, Staphylococcus
VEKI

SEQ ID NO: 1993342 - protein, 11 aa, Staphylococcus
VEKKDSSKGNI

SEQ ID NO: 1993343 - protein, 10 aa, Staphylococcus
VEKKKRDEIE

SEQ ID NO: 1993344 - protein, 10 aa, Staphylococcus
VEKKNGNQGI

SEQ ID NO: 1993345 - protein, 4 aa, Staphylococcus
VEKL

SEQ ID NO: 1993346 - protein, 15 aa, Staphylococcus
VEKNDEQINIDDNNA

SEQ ID NO: 1993347 - protein, 7 aa, Staphylococcus
VEKPESE

SEQ ID NO: 1993348 - protein, 7 aa, Staphylococcus
VEKPGAF

SEQ ID NO: 1993349 - protein, 14 aa, Staphylococcus
VEKPNYIHSQNSAA

SEQ ID NO: 1993350 - protein, 14 aa, Staphylococcus
VEKPTNKIPSSIDA

SEQ ID NO: 1993351 - protein, 6 aa, Staphylococcus
VEKQER

SEQ ID NO: 1993352 - protein, 5 aa, Staphylococcus
VEKQF

SEQ ID NO: 1993353 - protein, 8 aa, Staphylococcus
VEKQSNPL

SEQ ID NO: 1993354 - protein, 16 aa, Staphylococcus
VEKRREEFHPKGSRSH

SEQ ID NO: 1993355 - protein, 20 aa, Staphylococcus
VEKRREEFHPQGSRSQKTIQ

SEQ ID NO: 1993356 - protein, 5 aa, Staphylococcus
VEKTG

SEQ ID NO: 1993357 - protein, 10 aa, Staphylococcus
VEKTNNPKGV

SEQ ID NO: 1993358 - protein, 6 aa, Staphylococcus
VEKTNR

SEQ ID NO: 1993359 - protein, 11 aa, Staphylococcus
VEKTNTQIKRP

SEQ ID NO: 1993360 - protein, 9 aa, Staphylococcus
VEKTNTSYA

SEQ ID NO: 1993361 - protein, 10 aa, Staphylococcus
VEKTTGANKE

SEQ ID NO: 1993362 - protein, 17 aa, Staphylococcus
VEKVDRQSKTVTTSKGI

SEQ ID NO: 1993363 - protein, 10 aa, Staphylococcus
VEKYDTAKNT

SEQ ID NO: 1993364 - protein, 6 aa, Staphylococcus
VELGPK

SEQ ID NO: 1993365 - protein, 17 aa, Staphylococcus
VELNKGRVGAKEGPNAI

SEQ ID NO: 1993366 - protein, 12 aa, Staphylococcus
VELQDTQLTPEN

SEQ ID NO: 1993367 - protein, 18 aa, Staphylococcus
VELSQDEINQIDSLFPIN

SEQ ID NO: 1993368 - protein, 9 aa, Staphylococcus
VELSSETRN

SEQ ID NO: 1993369 - protein, 6 aa, Staphylococcus
VEMNDD

SEQ ID NO: 1993370 - protein, 6 aa, Staphylococcus
VEMTKS

SEQ ID NO: 1993371 - protein, 9 aa, Staphylococcus
VEMTPNNRQ

SEQ ID NO: 1993372 - protein, 4 aa, Staphylococcus
VENA

SEQ ID NO: 1993373 - protein, 5 aa, Staphylococcus
VENAA

SEQ ID NO: 1993374 - protein, 8 aa, Staphylococcus
VENASYPA

SEQ ID NO: 1993375 - protein, 11 aa, Staphylococcus
VENDAKKGLRD

SEQ ID NO: 1993376 - protein, 21 aa, Staphylococcus
VENDGKEAANKAQERAEQQGK

SEQ ID NO: 1993377 - protein, 5 aa, Staphylococcus
VENDN

SEQ ID NO: 1993378 - protein, 7 aa, Staphylococcus
VENEKGS

SEQ ID NO: 1993379 - protein, 10 aa, Staphylococcus
VENELGKEEQ

SEQ ID NO: 1993380 - protein, 4 aa, Staphylococcus
VENF

SEQ ID NO: 1993381 - protein, 5 aa, Staphylococcus
VENGD

SEQ ID NO: 1993382 - protein, 7 aa, Staphylococcus
VENGDTF

SEQ ID NO: 1993383 - protein, 6 aa, Staphylococcus
VENGHS

SEQ ID NO: 1993384 - protein, 9 aa, Staphylococcus
VENGKLEQG

SEQ ID NO: 1993385 - protein, 12 aa, Staphylococcus
VENGLQSITDGE

SEQ ID NO: 1993386 - protein, 5 aa, Staphylococcus
VENGN

SEQ ID NO: 1993387 - protein, 8 aa, Staphylococcus
VENKEPQS

SEQ ID NO: 1993388 - protein, 6 aa, Staphylococcus
VENKES

SEQ ID NO: 1993389 - protein, 6 aa, Staphylococcus
VENKGS

SEQ ID NO: 1993390 - protein, 6 aa, Staphylococcus
VENKGT

SEQ ID NO: 1993391 - protein, 10 aa, Staphylococcus
VENKGYSQQE

SEQ ID NO: 1993392 - protein, 21 aa, Staphylococcus
VENKIGEEQRYQGHLGDNAQT

SEQ ID NO: 1993393 - protein, 9 aa, Staphylococcus
VENKSDVEV

SEQ ID NO: 1993394 - protein, 10 aa, Staphylococcus
VENLTDHDQQ

SEQ ID NO: 1993395 - protein, 14 aa, Staphylococcus
VENNDLKADIASEL

SEQ ID NO: 1993396 - protein, 10 aa, Staphylococcus
VENNDNGLDK

SEQ ID NO: 1993397 - protein, 5 aa, Staphylococcus
VENNE

SEQ ID NO: 1993398 - protein, 6 aa, Staphylococcus
VENNEL

SEQ ID NO: 1993399 - protein, 20 aa, Staphylococcus
VENNNTSSASKEDAGKTINA

SEQ ID NO: 1993400 - protein, 6 aa, Staphylococcus
VENNQY

SEQ ID NO: 1993401 - protein, 6 aa, Staphylococcus
VENNRK

SEQ ID NO: 1993402 - protein, 7 aa, Staphylococcus
VENPDKP

SEQ ID NO: 1993403 - protein, 8 aa, Staphylococcus
VENPEQFN

SEQ ID NO: 1993404 - protein, 5 aa, Staphylococcus
VENPF

SEQ ID NO: 1993405 - protein, 4 aa, Staphylococcus
VENS

SEQ ID NO: 1993406 - protein, 10 aa, Staphylococcus
VENSDQCKDA

SEQ ID NO: 1993407 - protein, 11 aa, Staphylococcus
VENSGKADQYK

SEQ ID NO: 1993408 - protein, 8 aa, Staphylococcus
VENSINKH

SEQ ID NO: 1993409 - protein, 7 aa, Staphylococcus
VENSQDP

SEQ ID NO: 1993410 - protein, 15 aa, Staphylococcus
VENTEDDIQSCQYHT

SEQ ID NO: 1993411 - protein, 7 aa, Staphylococcus
VENTEHT

SEQ ID NO: 1993412 - protein, 8 aa, Staphylococcus
VENTEKEL

SEQ ID NO: 1993413 - protein, 8 aa, Staphylococcus
VENTNEND

SEQ ID NO: 1993414 - protein, 8 aa, Staphylococcus
VENTPDSW

SEQ ID NO: 1993415 - protein, 6 aa, Staphylococcus
VENTRE

SEQ ID NO: 1993416 - protein, 10 aa, Staphylococcus
VENYNTPEEM

SEQ ID NO: 1993417 - protein, 9 aa, Staphylococcus
VEPAGASSM

SEQ ID NO: 1993418 - protein, 8 aa, Staphylococcus
VEPAGGTI

SEQ ID NO: 1993419 - protein, 5 aa, Staphylococcus
VEPAS

SEQ ID NO: 1993420 - protein, 6 aa, Staphylococcus
VEPASE

SEQ ID NO: 1993421 - protein, 5 aa, Staphylococcus
VEPDD

SEQ ID NO: 1993422 - protein, 12 aa, Staphylococcus
VEPDDSKYSNVN

SEQ ID NO: 1993423 - protein, 5 aa, Staphylococcus
VEPDL

SEQ ID NO: 1993424 - protein, 14 aa, Staphylococcus
VEPGKIYNNGQPED

SEQ ID NO: 1993425 - protein, 15 aa, Staphylococcus
VEPGKIYNSGTPENV

SEQ ID NO: 1993426 - protein, 6 aa, Staphylococcus
VEPGLT

SEQ ID NO: 1993427 - protein, 7 aa, Staphylococcus
VEPGNYT

SEQ ID NO: 1993428 - protein, 7 aa, Staphylococcus
VEPGTDA

SEQ ID NO: 1993429 - protein, 6 aa, Staphylococcus
VEPIEN

SEQ ID NO: 1993430 - protein, 5 aa, Staphylococcus
VEPKL

SEQ ID NO: 1993431 - protein, 8 aa, Staphylococcus
VEPKPQHY

SEQ ID NO: 1993432 - protein, 8 aa, Staphylococcus
VEPKVEKN

SEQ ID NO: 1993433 - protein, 11 aa, Staphylococcus
VEPLKAEASIA

SEQ ID NO: 1993434 - protein, 10 aa, Staphylococcus
VEPLKEEAAI

SEQ ID NO: 1993435 - protein, 13 aa, Staphylococcus
VEPLKEEAAIAKE

SEQ ID NO: 1993436 - protein, 5 aa, Staphylococcus
VEPLR

SEQ ID NO: 1993437 - protein, 6 aa, Staphylococcus
VEPLRE

SEQ ID NO: 1993438 - protein, 6 aa, Staphylococcus
VEPNDG

SEQ ID NO: 1993439 - protein, 9 aa, Staphylococcus
VEPPIATTN

SEQ ID NO: 1993440 - protein, 8 aa, Staphylococcus
VEPPYSAT

SEQ ID NO: 1993441 - protein, 9 aa, Staphylococcus
VEPSGASSM

SEQ ID NO: 1993442 - protein, 13 aa, Staphylococcus
VEPSLSGPKRPQD

SEQ ID NO: 1993443 - protein, 7 aa, Staphylococcus
VEPSNDV

SEQ ID NO: 1993444 - protein, 9 aa, Staphylococcus
VEPSNYEED

SEQ ID NO: 1993445 - protein, 7 aa, Staphylococcus
VEPTEAQ

SEQ ID NO: 1993446 - protein, 17 aa, Staphylococcus
VEPTKAKRKNKNLITKF

SEQ ID NO: 1993447 - protein, 11 aa, Staphylococcus
VEQAKASNPQI

SEQ ID NO: 1993448 - protein, 12 aa, Staphylococcus
VEQANSGHPGLP

SEQ ID NO: 1993449 - protein, 9 aa, Staphylococcus
VEQAQQKGV

SEQ ID NO: 1993450 - protein, 7 aa, Staphylococcus
VEQDRQK

SEQ ID NO: 1993451 - protein, 6 aa, Staphylococcus
VEQERP

SEQ ID NO: 1993452 - protein, 10 aa, Staphylococcus
VEQGLKDAME

SEQ ID NO: 1993453 - protein, 7 aa, Staphylococcus
VEQGTRE

SEQ ID NO: 1993454 - protein, 8 aa, Staphylococcus
VEQHPEKP

SEQ ID NO: 1993455 - protein, 9 aa, Staphylococcus
VEQIDTPEG

SEQ ID NO: 1993456 - protein, 15 aa, Staphylococcus
VEQIDTPEGFQEHPR

SEQ ID NO: 1993457 - protein, 21 aa, Staphylococcus
VEQLTNDGKLHGTVTSNVETY

SEQ ID NO: 1993458 - protein, 4 aa, Staphylococcus
VEQN

SEQ ID NO: 1993459 - protein, 11 aa, Staphylococcus
VEQNGQSNEVT

SEQ ID NO: 1993460 - protein, 8 aa, Staphylococcus
VEQNNVSQ

SEQ ID NO: 1993461 - protein, 6 aa, Staphylococcus
VEQNRR

SEQ ID NO: 1993462 - protein, 9 aa, Staphylococcus
VEQNSSYTR

SEQ ID NO: 1993463 - protein, 6 aa, Staphylococcus
VEQPEA

SEQ ID NO: 1993464 - protein, 5 aa, Staphylococcus
VEQQI

SEQ ID NO: 1993465 - protein, 10 aa, Staphylococcus
VEQSETDDED

SEQ ID NO: 1993466 - protein, 5 aa, Staphylococcus
VEQSL

SEQ ID NO: 1993467 - protein, 4 aa, Staphylococcus
VEQV

SEQ ID NO: 1993468 - protein, 5 aa, Staphylococcus
VERAC

SEQ ID NO: 1993469 - protein, 16 aa, Staphylococcus
VERAGTKAGNKGAEAA

SEQ ID NO: 1993470 - protein, 8 aa, Staphylococcus
VERATDEA

SEQ ID NO: 1993471 - protein, 9 aa, Staphylococcus
VERCDTKSQ

SEQ ID NO: 1993472 - protein, 7 aa, Staphylococcus
VERDGKT

SEQ ID NO: 1993473 - protein, 5 aa, Staphylococcus
VERDH

SEQ ID NO: 1993474 - protein, 6 aa, Staphylococcus
VERETN

SEQ ID NO: 1993475 - protein, 4 aa, Staphylococcus
VERL

SEQ ID NO: 1993476 - protein, 4 aa, Staphylococcus
VERN

SEQ ID NO: 1993477 - protein, 12 aa, Staphylococcus
VERPEIQETTAL

SEQ ID NO: 1993478 - protein, 5 aa, Staphylococcus
VERPR

SEQ ID NO: 1993479 - protein, 4 aa, Staphylococcus
VERR

SEQ ID NO: 1993480 - protein, 10 aa, Staphylococcus
VERSRKALGE

SEQ ID NO: 1993481 - protein, 7 aa, Staphylococcus
VERTHGG

SEQ ID NO: 1993482 - protein, 23 aa, Staphylococcus
VERTKTDRYQRKQSHKSSNSKLI

SEQ ID NO: 1993483 - protein, 4 aa, Staphylococcus
VERY

SEQ ID NO: 1993484 - protein, 11 aa, Staphylococcus
VESADEEEKIN

SEQ ID NO: 1993485 - protein, 5 aa, Staphylococcus
VESAE

SEQ ID NO: 1993486 - protein, 8 aa, Staphylococcus
VESAEAGE

SEQ ID NO: 1993487 - protein, 12 aa, Staphylococcus
VESDIGKEEQFK

SEQ ID NO: 1993488 - protein, 8 aa, Staphylococcus
VESDNGSL

SEQ ID NO: 1993489 - protein, 8 aa, Staphylococcus
VESDTPAI

SEQ ID NO: 1993490 - protein, 8 aa, Staphylococcus
VESEEDAK

SEQ ID NO: 1993491 - protein, 8 aa, Staphylococcus
VESEEPAI

SEQ ID NO: 1993492 - protein, 8 aa, Staphylococcus
VESEGGDI

SEQ ID NO: 1993493 - protein, 7 aa, Staphylococcus
VESENKR

SEQ ID NO: 1993494 - protein, 6 aa, Staphylococcus
VESERD

SEQ ID NO: 1993495 - protein, 9 aa, Staphylococcus
VESETPDQL

SEQ ID NO: 1993496 - protein, 10 aa, Staphylococcus
VESGADADIK

SEQ ID NO: 1993497 - protein, 11 aa, Staphylococcus
VESGEDADIKV

SEQ ID NO: 1993498 - protein, 9 aa, Staphylococcus
VESGTPQEI

SEQ ID NO: 1993499 - protein, 18 aa, Staphylococcus
VESGTSKEVLTSPQHPYT

SEQ ID NO: 1993500 - protein, 8 aa, Staphylococcus
VESKRAEE

SEQ ID NO: 1993501 - protein, 15 aa, Staphylococcus
VESKSYNDVSELPES

SEQ ID NO: 1993502 - protein, 4 aa, Staphylococcus
VESN

SEQ ID NO: 1993503 - protein, 15 aa, Staphylococcus
VESNNKSLDKVYNQT

SEQ ID NO: 1993504 - protein, 6 aa, Staphylococcus
VESQAG

SEQ ID NO: 1993505 - protein, 7 aa, Staphylococcus
VESQDSH

SEQ ID NO: 1993506 - protein, 7 aa, Staphylococcus
VESQDSV

SEQ ID NO: 1993507 - protein, 10 aa, Staphylococcus
VESQRSEGNI

SEQ ID NO: 1993508 - protein, 14 aa, Staphylococcus
VESQYGGEVPSDPD

SEQ ID NO: 1993509 - protein, 11 aa, Staphylococcus
VESRAKEAGYN

SEQ ID NO: 1993510 - protein, 18 aa, Staphylococcus
VESSGGKVIDEPGTYQGY

SEQ ID NO: 1993511 - protein, 11 aa, Staphylococcus
VESSNKNTREI

SEQ ID NO: 1993512 - protein, 7 aa, Staphylococcus
VESSQYD

SEQ ID NO: 1993513 - protein, 12 aa, Staphylococcus
VESSYGATWYDA

SEQ ID NO: 1993514 - protein, 8 aa, Staphylococcus
VESSYTGK

SEQ ID NO: 1993515 - protein, 13 aa, Staphylococcus
VESTKESKHTDYH

SEQ ID NO: 1993516 - protein, 4 aa, Staphylococcus
VETA

SEQ ID NO: 1993517 - protein, 11 aa, Staphylococcus
VETADTPSEIG

SEQ ID NO: 1993518 - protein, 11 aa, Staphylococcus
VETANTPSEIG

SEQ ID NO: 1993519 - protein, 6 aa, Staphylococcus
VETASF

SEQ ID NO: 1993520 - protein, 10 aa, Staphylococcus
VETDKGNVFS

SEQ ID NO: 1993521 - protein, 9 aa, Staphylococcus
VETDKTDIE

SEQ ID NO: 1993522 - protein, 5 aa, Staphylococcus
VETDN

SEQ ID NO: 1993523 - protein, 17 aa, Staphylococcus
VETDQSDDLVIFKKYIN

SEQ ID NO: 1993524 - protein, 19 aa, Staphylococcus
VETDQSYANQDNGHQVASD

SEQ ID NO: 1993525 - protein, 10 aa, Staphylococcus
VETDSGQIYE

SEQ ID NO: 1993526 - protein, 11 aa, Staphylococcus
VETEALRNGRQ

SEQ ID NO: 1993527 - protein, 6 aa, Staphylococcus
VETEDQ

SEQ ID NO: 1993528 - protein, 5 aa, Staphylococcus
VETEE

SEQ ID NO: 1993529 - protein, 9 aa, Staphylococcus
VETEKGREI

SEQ ID NO: 1993530 - protein, 9 aa, Staphylococcus
VETELGNAT

SEQ ID NO: 1993531 - protein, 9 aa, Staphylococcus
VETELQPSA

SEQ ID NO: 1993532 - protein, 6 aa, Staphylococcus
VETENK

SEQ ID NO: 1993533 - protein, 5 aa, Staphylococcus
VETER

SEQ ID NO: 1993534 - protein, 11 aa, Staphylococcus
VETETLRSGRQ

SEQ ID NO: 1993535 - protein, 6 aa, Staphylococcus
VETEYG

SEQ ID NO: 1993536 - protein, 4 aa, Staphylococcus
VETF

SEQ ID NO: 1993537 - protein, 6 aa, Staphylococcus
VETGGE

SEQ ID NO: 1993538 - protein, 9 aa, Staphylococcus
VETGKPEDI

SEQ ID NO: 1993539 - protein, 8 aa, Staphylococcus
VETGKPKG

SEQ ID NO: 1993540 - protein, 10 aa, Staphylococcus
VETGRASDIL

SEQ ID NO: 1993541 - protein, 13 aa, Staphylococcus
VETGSPKAKRMKK

SEQ ID NO: 1993542 - protein, 4 aa, Staphylococcus
VETH

SEQ ID NO: 1993543 - protein, 5 aa, Staphylococcus
VETIE

SEQ ID NO: 1993544 - protein, 9 aa, Staphylococcus
VETKDTKGY

SEQ ID NO: 1993545 - protein, 28 aa, Staphylococcus
VETKEENEKDQKVVPKKLTKKEREKTIA

SEQ ID NO: 1993546 - protein, 7 aa, Staphylococcus
VETNNGR

SEQ ID NO: 1993547 - protein, 7 aa, Staphylococcus
VETNQQT

SEQ ID NO: 1993548 - protein, 7 aa, Staphylococcus
VETNQRR

SEQ ID NO: 1993549 - protein, 5 aa, Staphylococcus
VETNY

SEQ ID NO: 1993550 - protein, 5 aa, Staphylococcus
VETPN

SEQ ID NO: 1993551 - protein, 11 aa, Staphylococcus
VETPNAHTAQE

SEQ ID NO: 1993552 - protein, 9 aa, Staphylococcus
VETPNSLKN

SEQ ID NO: 1993553 - protein, 6 aa, Staphylococcus
VETQIE

SEQ ID NO: 1993554 - protein, 11 aa, Staphylococcus
VETQRSNDNIE

SEQ ID NO: 1993555 - protein, 12 aa, Staphylococcus
VETQRSNDNIEE

SEQ ID NO: 1993556 - protein, 12 aa, Staphylococcus
VETQRSNDNLES

SEQ ID NO: 1993557 - protein, 6 aa, Staphylococcus
VETRNH

SEQ ID NO: 1993558 - protein, 11 aa, Staphylococcus
VETRTSAGSAF

SEQ ID NO: 1993559 - protein, 12 aa, Staphylococcus
VETSHGKTWYDA

SEQ ID NO: 1993560 - protein, 6 aa, Staphylococcus
VETSTE

SEQ ID NO: 1993561 - protein, 13 aa, Staphylococcus
VETSTLGQDSEED

SEQ ID NO: 1993562 - protein, 13 aa, Staphylococcus
VETSTLGQNSEED

SEQ ID NO: 1993563 - protein, 12 aa, Staphylococcus
VETTEARAKELR

SEQ ID NO: 1993564 - protein, 7 aa, Staphylococcus
VETTETY

SEQ ID NO: 1993565 - protein, 9 aa, Staphylococcus
VETTTNQSI

SEQ ID NO: 1993566 - protein, 18 aa, Staphylococcus
VETVDRSAQTVTTSKGVE

SEQ ID NO: 1993567 - protein, 5 aa, Staphylococcus
VETYG

SEQ ID NO: 1993568 - protein, 10 aa, Staphylococcus
VEVENGTEAL

SEQ ID NO: 1993569 - protein, 15 aa, Staphylococcus
VEVEVPDDSTVIEPQ

SEQ ID NO: 1993570 - protein, 6 aa, Staphylococcus
VEVNGQ

SEQ ID NO: 1993571 - protein, 6 aa, Staphylococcus
VEVNQT

SEQ ID NO: 1993572 - protein, 10 aa, Staphylococcus
VEVPDDEDID

SEQ ID NO: 1993573 - protein, 13 aa, Staphylococcus
VEVPDNKKLSIEQ

SEQ ID NO: 1993574 - protein, 8 aa, Staphylococcus
VEVPDTVE

SEQ ID NO: 1993575 - protein, 13 aa, Staphylococcus
VEVPNAKAIRSTM

SEQ ID NO: 1993576 - protein, 12 aa, Staphylococcus
VEVSQSVSKENF

SEQ ID NO: 1993577 - protein, 11 aa, Staphylococcus
VEYEDGSSELL

SEQ ID NO: 1993578 - protein, 12 aa, Staphylococcus
VEYHTPKTVEIS

SEQ ID NO: 1993579 - protein, 9 aa, Staphylococcus
VEYNKEEGA

SEQ ID NO: 1993580 - protein, 15 aa, Staphylococcus
VEYTKGSLSEVQEEM

SEQ ID NO: 1993581 - protein, 11 aa, Staphylococcus
VFAEPASNASI

SEQ ID NO: 1993582 - protein, 16 aa, Staphylococcus
VFDGTKPINFDDNREW

SEQ ID NO: 1993583 - protein, 9 aa, Staphylococcus
VFENPQHDV

SEQ ID NO: 1993584 - protein, 10 aa, Staphylococcus
VFNSQADDQL

SEQ ID NO: 1993585 - protein, 14 aa, Staphylococcus
VFPKEGPLGKPNPF

SEQ ID NO: 1993586 - protein, 4 aa, Staphylococcus
VFST

SEQ ID NO: 1993587 - protein, 9 aa, Staphylococcus
VGAAATGLR

SEQ ID NO: 1993588 - protein, 9 aa, Staphylococcus
VGAAATGMR

SEQ ID NO: 1993589 - protein, 7 aa, Staphylococcus
VGAADIP

SEQ ID NO: 1993590 - protein, 6 aa, Staphylococcus
VGAETQ

SEQ ID NO: 1993591 - protein, 10 aa, Staphylococcus
VGAGADKGIN

SEQ ID NO: 1993592 - protein, 5 aa, Staphylococcus
VGAGT

SEQ ID NO: 1993593 - protein, 8 aa, Staphylococcus
VGAHGEVT

SEQ ID NO: 1993594 - protein, 6 aa, Staphylococcus
VGANNQ

SEQ ID NO: 1993595 - protein, 4 aa, Staphylococcus
VGAP

SEQ ID NO: 1993596 - protein, 26 aa, Staphylococcus
VGAPTKRNAPSISTNNASWGGPNRDS

SEQ ID NO: 1993597 - protein, 6 aa, Staphylococcus
VGAPTQ

SEQ ID NO: 1993598 - protein, 9 aa, Staphylococcus
VGAQHPKYV

SEQ ID NO: 1993599 - protein, 16 aa, Staphylococcus
VGAQHPKYVQRPSADQ

SEQ ID NO: 1993600 - protein, 14 aa, Staphylococcus
VGAQNPAYVQRPTV

SEQ ID NO: 1993601 - protein, 12 aa, Staphylococcus
VGAQNPKYVQRP

SEQ ID NO: 1993602 - protein, 16 aa, Staphylococcus
VGAQNPKYVQRPSASK

SEQ ID NO: 1993603 - protein, 14 aa, Staphylococcus
VGAQNPKYVQRPTV

SEQ ID NO: 1993604 - protein, 15 aa, Staphylococcus
VGAQNPQYVQRPSVD

SEQ ID NO: 1993605 - protein, 10 aa, Staphylococcus
VGASGIGEYH

SEQ ID NO: 1993606 - protein, 9 aa, Staphylococcus
VGASGSKGI

SEQ ID NO: 1993607 - protein, 4 aa, Staphylococcus
VGAT

SEQ ID NO: 1993608 - protein, 4 aa, Staphylococcus
VGDD

SEQ ID NO: 1993609 - protein, 5 aa, Staphylococcus
VGDDA

SEQ ID NO: 1993610 - protein, 9 aa, Staphylococcus
VGDDGIPNT

SEQ ID NO: 1993611 - protein, 16 aa, Staphylococcus
VGDDSAVIQRSTPYAS

SEQ ID NO: 1993612 - protein, 6 aa, Staphylococcus
VGDDTL

SEQ ID NO: 1993613 - protein, 16 aa, Staphylococcus
VGDDVGEKKHHGGPEK

SEQ ID NO: 1993614 - protein, 7 aa, Staphylococcus
VGDEEAS

SEQ ID NO: 1993615 - protein, 14 aa, Staphylococcus
VGDELTNELGRSPS

SEQ ID NO: 1993616 - protein, 6 aa, Staphylococcus
VGDEVK

SEQ ID NO: 1993617 - protein, 7 aa, Staphylococcus
VGDGGIP

SEQ ID NO: 1993618 - protein, 8 aa, Staphylococcus
VGDGLKEE

SEQ ID NO: 1993619 - protein, 5 aa, Staphylococcus
VGDGS

SEQ ID NO: 1993620 - protein, 37 aa, Staphylococcus
VGDKESKDKSDVKYSEVPEVEGQETQKAQDKVNSKSL

SEQ ID NO: 1993621 - protein, 10 aa, Staphylococcus
VGDKTKVGPF

SEQ ID NO: 1993622 - protein, 5 aa, Staphylococcus
VGDKV

SEQ ID NO: 1993623 - protein, 9 aa, Staphylococcus
VGDKVKSGD

SEQ ID NO: 1993624 - protein, 10 aa, Staphylococcus
VGDKVNAGES

SEQ ID NO: 1993625 - protein, 8 aa, Staphylococcus
VGDKVNVG

SEQ ID NO: 1993626 - protein, 12 aa, Staphylococcus
VGDKVTHKSWGE

SEQ ID NO: 1993627 - protein, 10 aa, Staphylococcus
VGDPLDDKTD

SEQ ID NO: 1993628 - protein, 12 aa, Staphylococcus
VGDPLDDNTDYG

SEQ ID NO: 1993629 - protein, 14 aa, Staphylococcus
VGDPLDKNTQVGPI

SEQ ID NO: 1993630 - protein, 14 aa, Staphylococcus
VGDPREDGTQVGPI

SEQ ID NO: 1993631 - protein, 20 aa, Staphylococcus
VGDPTDENTQMGSQTGQAQI

SEQ ID NO: 1993632 - protein, 12 aa, Staphylococcus
VGDPYDENTDYG

SEQ ID NO: 1993633 - protein, 6 aa, Staphylococcus
VGDQTF

SEQ ID NO: 1993634 - protein, 10 aa, Staphylococcus
VGDQTFTQKS

SEQ ID NO: 1993635 - protein, 9 aa, Staphylococcus
VGDQVKEGD

SEQ ID NO: 1993636 - protein, 7 aa, Staphylococcus
VGDREHQ

SEQ ID NO: 1993637 - protein, 9 aa, Staphylococcus
VGDRSDDKH

SEQ ID NO: 1993638 - protein, 7 aa, Staphylococcus
VGDSGHR

SEQ ID NO: 1993639 - protein, 5 aa, Staphylococcus
VGDSR

SEQ ID NO: 1993640 - protein, 9 aa, Staphylococcus
VGDSVNKGE

SEQ ID NO: 1993641 - protein, 6 aa, Staphylococcus
VGDTHR

SEQ ID NO: 1993642 - protein, 10 aa, Staphylococcus
VGDTVKEGEP

SEQ ID NO: 1993643 - protein, 5 aa, Staphylococcus
VGEAD

SEQ ID NO: 1993644 - protein, 19 aa, Staphylococcus
VGEAGGKLHTGRSRNDQVA

SEQ ID NO: 1993645 - protein, 5 aa, Staphylococcus
VGEAK

SEQ ID NO: 1993646 - protein, 7 aa, Staphylococcus
VGEDDEI

SEQ ID NO: 1993647 - protein, 12 aa, Staphylococcus
VGEDKESKEESA

SEQ ID NO: 1993648 - protein, 13 aa, Staphylococcus
VGEDKKNKKAPYK

SEQ ID NO: 1993649 - protein, 13 aa, Staphylococcus
VGEDKKNKRPPYK

SEQ ID NO: 1993650 - protein, 8 aa, Staphylococcus
VGEDNPEH

SEQ ID NO: 1993651 - protein, 8 aa, Staphylococcus
VGEDQKQH

SEQ ID NO: 1993652 - protein, 5 aa, Staphylococcus
VGEDV

SEQ ID NO: 1993653 - protein, 10 aa, Staphylococcus
VGEEQAENFG

SEQ ID NO: 1993654 - protein, 10 aa, Staphylococcus
VGEGERNQTL

SEQ ID NO: 1993655 - protein, 12 aa, Staphylococcus
VGEGESGKDAIA

SEQ ID NO: 1993656 - protein, 17 aa, Staphylococcus
VGEGKSGKDAIEKAHEL

SEQ ID NO: 1993657 - protein, 8 aa, Staphylococcus
VGEGLSPM

SEQ ID NO: 1993658 - protein, 69 aa, Staphylococcus
VGEGSGNASSSKEESSDQSQSANNDEATKELAQPTESQSNNEETQSNPNNQRVNATPSARRHARENGVD

SEQ ID NO: 1993659 - protein, 18 aa, Staphylococcus
VGEGSSGKEAIEKAHTLN

SEQ ID NO: 1993660 - protein, 12 aa, Staphylococcus
VGEGSSNQGDFH

SEQ ID NO: 1993661 - protein, 13 aa, Staphylococcus
VGEITSEAIDSTL

SEQ ID NO: 1993662 - protein, 7 aa, Staphylococcus
VGEKEGR

SEQ ID NO: 1993663 - protein, 6 aa, Staphylococcus
VGENDT

SEQ ID NO: 1993664 - protein, 5 aa, Staphylococcus
VGENR

SEQ ID NO: 1993665 - protein, 9 aa, Staphylococcus
VGENSDEVR

SEQ ID NO: 1993666 - protein, 9 aa, Staphylococcus
VGENSSPIR

SEQ ID NO: 1993667 - protein, 9 aa, Staphylococcus
VGENSSTVR

SEQ ID NO: 1993668 - protein, 8 aa, Staphylococcus
VGEPVTAS

SEQ ID NO: 1993669 - protein, 6 aa, Staphylococcus
VGEQHR

SEQ ID NO: 1993670 - protein, 8 aa, Staphylococcus
VGEQITSN

SEQ ID NO: 1993671 - protein, 8 aa, Staphylococcus
VGEQLSGS

SEQ ID NO: 1993672 - protein, 5 aa, Staphylococcus
VGERL

SEQ ID NO: 1993673 - protein, 16 aa, Staphylococcus
VGERLNAEVGTKAYGS

SEQ ID NO: 1993674 - protein, 16 aa, Staphylococcus
VGERLNAQVGTKAYGS

SEQ ID NO: 1993675 - protein, 16 aa, Staphylococcus
VGERLNATVGTKAYGS

SEQ ID NO: 1993676 - protein, 12 aa, Staphylococcus
VGESGAQNQIAS

SEQ ID NO: 1993677 - protein, 11 aa, Staphylococcus
VGESTTPSITE

SEQ ID NO: 1993678 - protein, 10 aa, Staphylococcus
VGETDKTGTV

SEQ ID NO: 1993679 - protein, 6 aa, Staphylococcus
VGETEI

SEQ ID NO: 1993680 - protein, 11 aa, Staphylococcus
VGETKSDDIPA

SEQ ID NO: 1993681 - protein, 11 aa, Staphylococcus
VGETQDDHGNR

SEQ ID NO: 1993682 - protein, 6 aa, Staphylococcus
VGETVS

SEQ ID NO: 1993683 - protein, 13 aa, Staphylococcus
VGFKEDEYKATWL

SEQ ID NO: 1993684 - protein, 21 aa, Staphylococcus
VGFSSKTTHYQTKSHEQAKHD

SEQ ID NO: 1993685 - protein, 8 aa, Staphylococcus
VGGASGPL

SEQ ID NO: 1993686 - protein, 7 aa, Staphylococcus
VGGAYDT

SEQ ID NO: 1993687 - protein, 8 aa, Staphylococcus
VGGAYSTL

SEQ ID NO: 1993688 - protein, 11 aa, Staphylococcus
VGGDSTNSLTI

SEQ ID NO: 1993689 - protein, 11 aa, Staphylococcus
VGGGNSGAEAA

SEQ ID NO: 1993690 - protein, 9 aa, Staphylococcus
VGGGPGGVT

SEQ ID NO: 1993691 - protein, 6 aa, Staphylococcus
VGGGTK

SEQ ID NO: 1993692 - protein, 10 aa, Staphylococcus
VGGGVGPTAV

SEQ ID NO: 1993693 - protein, 8 aa, Staphylococcus
VGGKDERL

SEQ ID NO: 1993694 - protein, 23 aa, Staphylococcus
VGGKGGGRPDMAQGGGSEPSKIT

SEQ ID NO: 1993695 - protein, 24 aa, Staphylococcus
VGGKGGGRPDMAQGGGTEPKNITE

SEQ ID NO: 1993696 - protein, 23 aa, Staphylococcus
VGGKGGGRPDMAQGGGTQPENIS

SEQ ID NO: 1993697 - protein, 24 aa, Staphylococcus
VGGKGGGRPDMAQGGGTQPENISE

SEQ ID NO: 1993698 - protein, 24 aa, Staphylococcus
VGGKGGGRPDMAQGGGTQPENITE

SEQ ID NO: 1993699 - protein, 6 aa, Staphylococcus
VGGKGS

SEQ ID NO: 1993700 - protein, 9 aa, Staphylococcus
VGGKGSNLL

SEQ ID NO: 1993701 - protein, 9 aa, Staphylococcus
VGGKGTNLL

SEQ ID NO: 1993702 - protein, 13 aa, Staphylococcus
VGGKKYNTKPRGL

SEQ ID NO: 1993703 - protein, 5 aa, Staphylococcus
VGGKQ

SEQ ID NO: 1993704 - protein, 6 aa, Staphylococcus
VGGKQN

SEQ ID NO: 1993705 - protein, 7 aa, Staphylococcus
VGGPEDM

SEQ ID NO: 1993706 - protein, 10 aa, Staphylococcus
VGGPYANGGM

SEQ ID NO: 1993707 - protein, 14 aa, Staphylococcus
VGGRKGHVNTDDNA

SEQ ID NO: 1993708 - protein, 14 aa, Staphylococcus
VGGRKGHVQTDDKA

SEQ ID NO: 1993709 - protein, 14 aa, Staphylococcus
VGGRKGHVQTDDNA

SEQ ID NO: 1993710 - protein, 6 aa, Staphylococcus
VGGSHV

SEQ ID NO: 1993711 - protein, 16 aa, Staphylococcus
VGGSIDETIEALNKTF

SEQ ID NO: 1993712 - protein, 5 aa, Staphylococcus
VGGTT

SEQ ID NO: 1993713 - protein, 11 aa, Staphylococcus
VGHTGTLDPEV

SEQ ID NO: 1993714 - protein, 7 aa, Staphylococcus
VGHYSEK

SEQ ID NO: 1993715 - protein, 19 aa, Staphylococcus
VGIANNQTGLYPQDSPGGW

SEQ ID NO: 1993716 - protein, 13 aa, Staphylococcus
VGIGGDAGGIDDL

SEQ ID NO: 1993717 - protein, 6 aa, Staphylococcus
VGKDET

SEQ ID NO: 1993718 - protein, 6 aa, Staphylococcus
VGKDGL

SEQ ID NO: 1993719 - protein, 6 aa, Staphylococcus
VGKDTE

SEQ ID NO: 1993720 - protein, 7 aa, Staphylococcus
VGKEEMA

SEQ ID NO: 1993721 - protein, 7 aa, Staphylococcus
VGKEGNA

SEQ ID NO: 1993722 - protein, 9 aa, Staphylococcus
VGKGSKDAR

SEQ ID NO: 1993723 - protein, 5 aa, Staphylococcus
VGKIS

SEQ ID NO: 1993724 - protein, 7 aa, Staphylococcus
VGKKGGV

SEQ ID NO: 1993725 - protein, 4 aa, Staphylococcus
VGKN

SEQ ID NO: 1993726 - protein, 9 aa, Staphylococcus
VGKPEGLEK

SEQ ID NO: 1993727 - protein, 7 aa, Staphylococcus
VGKPFSE

SEQ ID NO: 1993728 - protein, 4 aa, Staphylococcus
VGKQ

SEQ ID NO: 1993729 - protein, 6 aa, Staphylococcus
VGKQTD

SEQ ID NO: 1993730 - protein, 22 aa, Staphylococcus
VGKTANEAIQEVNRSSFKSTAF

SEQ ID NO: 1993731 - protein, 11 aa, Staphylococcus
VGKTPHSSHQK

SEQ ID NO: 1993732 - protein, 11 aa, Staphylococcus
VGKTVGDSPKV

SEQ ID NO: 1993733 - protein, 12 aa, Staphylococcus
VGKVSSTRFNEN

SEQ ID NO: 1993734 - protein, 5 aa, Staphylococcus
VGLDE

SEQ ID NO: 1993735 - protein, 5 aa, Staphylococcus
VGLDS

SEQ ID NO: 1993736 - protein, 7 aa, Staphylococcus
VGLHPED

SEQ ID NO: 1993737 - protein, 4 aa, Staphylococcus
VGLK

SEQ ID NO: 1993738 - protein, 13 aa, Staphylococcus
VGLSEQQAKDAGY

SEQ ID NO: 1993739 - protein, 13 aa, Staphylococcus
VGLSGRSNVGKST

SEQ ID NO: 1993740 - protein, 18 aa, Staphylococcus
VGLTGKDNINVRSTTIDR

SEQ ID NO: 1993741 - protein, 21 aa, Staphylococcus
VGLTGKENLLPSKLSGGQQQR

SEQ ID NO: 1993742 - protein, 10 aa, Staphylococcus
VGNADGEDPF

SEQ ID NO: 1993743 - protein, 6 aa, Staphylococcus
VGNADV

SEQ ID NO: 1993744 - protein, 5 aa, Staphylococcus
VGNEL

SEQ ID NO: 1993745 - protein, 10 aa, Staphylococcus
VGNEQKTAAI

SEQ ID NO: 1993746 - protein, 10 aa, Staphylococcus
VGNESKTAAI

SEQ ID NO: 1993747 - protein, 11 aa, Staphylococcus
VGNGEGEAAAY

SEQ ID NO: 1993748 - protein, 9 aa, Staphylococcus
VGNGLDKGV

SEQ ID NO: 1993749 - protein, 7 aa, Staphylococcus
VGNGNEA

SEQ ID NO: 1993750 - protein, 7 aa, Staphylococcus
VGNKGTV

SEQ ID NO: 1993751 - protein, 10 aa, Staphylococcus
VGNPDERFDE

SEQ ID NO: 1993752 - protein, 14 aa, Staphylococcus
VGNPREEGTQVGPI

SEQ ID NO: 1993753 - protein, 10 aa, Staphylococcus
VGNPSERFKE

SEQ ID NO: 1993754 - protein, 8 aa, Staphylococcus
VGNPYERF

SEQ ID NO: 1993755 - protein, 10 aa, Staphylococcus
VGNQARELQN

SEQ ID NO: 1993756 - protein, 29 aa, Staphylococcus
VGNRPLNDGSTTWDPSKKYIKESVKSSLK

SEQ ID NO: 1993757 - protein, 22 aa, Staphylococcus
VGNRPTEDGGTTWDPSKKYIKE

SEQ ID NO: 1993758 - protein, 6 aa, Staphylococcus
VGNYSD

SEQ ID NO: 1993759 - protein, 7 aa, Staphylococcus
VGPDVTK

SEQ ID NO: 1993760 - protein, 11 aa, Staphylococcus
VGPEKVKAKPF

SEQ ID NO: 1993761 - protein, 5 aa, Staphylococcus
VGPGN

SEQ ID NO: 1993762 - protein, 10 aa, Staphylococcus
VGPGNQKDVQ

SEQ ID NO: 1993763 - protein, 11 aa, Staphylococcus
VGPGRGSAAGS

SEQ ID NO: 1993764 - protein, 12 aa, Staphylococcus
VGPKLETDNVGA

SEQ ID NO: 1993765 - protein, 15 aa, Staphylococcus
VGPKQTVQKLSGGMK

SEQ ID NO: 1993766 - protein, 13 aa, Staphylococcus
VGPNGSGKSNVTD

SEQ ID NO: 1993767 - protein, 7 aa, Staphylococcus
VGPPGKI

SEQ ID NO: 1993768 - protein, 7 aa, Staphylococcus
VGPPGKV

SEQ ID NO: 1993769 - protein, 8 aa, Staphylococcus
VGPPTNQF

SEQ ID NO: 1993770 - protein, 10 aa, Staphylococcus
VGPSGSGKST

SEQ ID NO: 1993771 - protein, 12 aa, Staphylococcus
VGPSKDIPAPDV

SEQ ID NO: 1993772 - protein, 8 aa, Staphylococcus
VGPSPRNS

SEQ ID NO: 1993773 - protein, 12 aa, Staphylococcus
VGPTKDIPAPDV

SEQ ID NO: 1993774 - protein, 5 aa, Staphylococcus
VGQDD

SEQ ID NO: 1993775 - protein, 9 aa, Staphylococcus
VGQDDEDVR

SEQ ID NO: 1993776 - protein, 10 aa, Staphylococcus
VGQDDENVKS

SEQ ID NO: 1993777 - protein, 15 aa, Staphylococcus
VGQFNEDYGREEIQS

SEQ ID NO: 1993778 - protein, 4 aa, Staphylococcus
VGQG

SEQ ID NO: 1993779 - protein, 6 aa, Staphylococcus
VGQGDT

SEQ ID NO: 1993780 - protein, 11 aa, Staphylococcus
VGQGPEPEDVE

SEQ ID NO: 1993781 - protein, 13 aa, Staphylococcus
VGQGTAIYIEIPL

SEQ ID NO: 1993782 - protein, 7 aa, Staphylococcus
VGQPESS

SEQ ID NO: 1993783 - protein, 8 aa, Staphylococcus
VGQPGDTI

SEQ ID NO: 1993784 - protein, 9 aa, Staphylococcus
VGQPTERFE

SEQ ID NO: 1993785 - protein, 17 aa, Staphylococcus
VGQQTAKEFEEETGNKA

SEQ ID NO: 1993786 - protein, 4 aa, Staphylococcus
VGQR

SEQ ID NO: 1993787 - protein, 10 aa, Staphylococcus
VGQSSDEIKY

SEQ ID NO: 1993788 - protein, 11 aa, Staphylococcus
VGQTEDDHGNR

SEQ ID NO: 1993789 - protein, 19 aa, Staphylococcus
VGQTIENGEEADIKTGNAL

SEQ ID NO: 1993790 - protein, 5 aa, Staphylococcus
VGQTK

SEQ ID NO: 1993791 - protein, 12 aa, Staphylococcus
VGQTQDNEGNRG

SEQ ID NO: 1993792 - protein, 5 aa, Staphylococcus
VGRAE

SEQ ID NO: 1993793 - protein, 6 aa, Staphylococcus
VGRATG

SEQ ID NO: 1993794 - protein, 5 aa, Staphylococcus
VGRDI

SEQ ID NO: 1993795 - protein, 5 aa, Staphylococcus
VGREC

SEQ ID NO: 1993796 - protein, 26 aa, Staphylococcus
VGRGLPAELRETGLGGLAGTPTGEAI

SEQ ID NO: 1993797 - protein, 9 aa, Staphylococcus
VGRKAHAPD

SEQ ID NO: 1993798 - protein, 11 aa, Staphylococcus
VGRKKQAPNGN

SEQ ID NO: 1993799 - protein, 19 aa, Staphylococcus
VGRNGIKATFKGKENGPTI

SEQ ID NO: 1993800 - protein, 19 aa, Staphylococcus
VGRNGIKATFKGSENGPTI

SEQ ID NO: 1993801 - protein, 6 aa, Staphylococcus
VGRNKK

SEQ ID NO: 1993802 - protein, 5 aa, Staphylococcus
VGRPK

SEQ ID NO: 1993803 - protein, 4 aa, Staphylococcus
VGRQ

SEQ ID NO: 1993804 - protein, 5 aa, Staphylococcus
VGRSC

SEQ ID NO: 1993805 - protein, 9 aa, Staphylococcus
VGSAATGLR

SEQ ID NO: 1993806 - protein, 7 aa, Staphylococcus
VGSAGTD

SEQ ID NO: 1993807 - protein, 6 aa, Staphylococcus
VGSANM

SEQ ID NO: 1993808 - protein, 7 aa, Staphylococcus
VGSDDTT

SEQ ID NO: 1993809 - protein, 5 aa, Staphylococcus
VGSDH

SEQ ID NO: 1993810 - protein, 9 aa, Staphylococcus
VGSEEFENQ

SEQ ID NO: 1993811 - protein, 6 aa, Staphylococcus
VGSETA

SEQ ID NO: 1993812 - protein, 5 aa, Staphylococcus
VGSEV

SEQ ID NO: 1993813 - protein, 16 aa, Staphylococcus
VGSFEEQQAAASSGTG

SEQ ID NO: 1993814 - protein, 4 aa, Staphylococcus
VGSG

SEQ ID NO: 1993815 - protein, 8 aa, Staphylococcus
VGSGGTFT

SEQ ID NO: 1993816 - protein, 8 aa, Staphylococcus
VGSGGTYA

SEQ ID NO: 1993817 - protein, 21 aa, Staphylococcus
VGSGKSGQEIYNDNFYGGIFR

SEQ ID NO: 1993818 - protein, 10 aa, Staphylococcus
VGSGKTGQEV

SEQ ID NO: 1993819 - protein, 7 aa, Staphylococcus
VGSGQPV

SEQ ID NO: 1993820 - protein, 6 aa, Staphylococcus
VGSHTN

SEQ ID NO: 1993821 - protein, 8 aa, Staphylococcus
VGSHTTAL

SEQ ID NO: 1993822 - protein, 6 aa, Staphylococcus
VGSKEG

SEQ ID NO: 1993823 - protein, 9 aa, Staphylococcus
VGSKEGTTA

SEQ ID NO: 1993824 - protein, 8 aa, Staphylococcus
VGSKGARV

SEQ ID NO: 1993825 - protein, 9 aa, Staphylococcus
VGSKGTVYG

SEQ ID NO: 1993826 - protein, 17 aa, Staphylococcus
VGSKKDETQSAQYSKVP

SEQ ID NO: 1993827 - protein, 9 aa, Staphylococcus
VGSKKVGRA

SEQ ID NO: 1993828 - protein, 7 aa, Staphylococcus
VGSKKVN

SEQ ID NO: 1993829 - protein, 9 aa, Staphylococcus
VGSKPYDWN

SEQ ID NO: 1993830 - protein, 5 aa, Staphylococcus
VGSKS

SEQ ID NO: 1993831 - protein, 5 aa, Staphylococcus
VGSNV

SEQ ID NO: 1993832 - protein, 6 aa, Staphylococcus
VGSNVN

SEQ ID NO: 1993833 - protein, 5 aa, Staphylococcus
VGSQV

SEQ ID NO: 1993834 - protein, 12 aa, Staphylococcus
VGSSEQIKANHR

SEQ ID NO: 1993835 - protein, 11 aa, Staphylococcus
VGSSGNGKEAY

SEQ ID NO: 1993836 - protein, 7 aa, Staphylococcus
VGSSIEE

SEQ ID NO: 1993837 - protein, 36 aa, Staphylococcus
VGSSKDKTNKAKYSKVPNVEGDATQDAKSKLQDKSL

SEQ ID NO: 1993838 - protein, 7 aa, Staphylococcus
VGSSVNN

SEQ ID NO: 1993839 - protein, 4 aa, Staphylococcus
VGST

SEQ ID NO: 1993840 - protein, 9 aa, Staphylococcus
VGSTDKTGT

SEQ ID NO: 1993841 - protein, 9 aa, Staphylococcus
VGSTDNVDS

SEQ ID NO: 1993842 - protein, 11 aa, Staphylococcus
VGSTEQIRSNH

SEQ ID NO: 1993843 - protein, 7 aa, Staphylococcus
VGSTGNL

SEQ ID NO: 1993844 - protein, 5 aa, Staphylococcus
VGTDK

SEQ ID NO: 1993845 - protein, 12 aa, Staphylococcus
VGTFSSNHDRAT

SEQ ID NO: 1993846 - protein, 8 aa, Staphylococcus
VGTGASDI

SEQ ID NO: 1993847 - protein, 12 aa, Staphylococcus
VGTGGTLSGAGK

SEQ ID NO: 1993848 - protein, 13 aa, Staphylococcus
VGTGGTLSGAGKV

SEQ ID NO: 1993849 - protein, 10 aa, Staphylococcus
VGTGGTLTGV

SEQ ID NO: 1993850 - protein, 6 aa, Staphylococcus
VGTGGY

SEQ ID NO: 1993851 - protein, 9 aa, Staphylococcus
VGTGSDDAI

SEQ ID NO: 1993852 - protein, 10 aa, Staphylococcus
VGTGSQKINL

SEQ ID NO: 1993853 - protein, 7 aa, Staphylococcus
VGTGTSL

SEQ ID NO: 1993854 - protein, 10 aa, Staphylococcus
VGTGVGPTSV

SEQ ID NO: 1993855 - protein, 4 aa, Staphylococcus
VGTK

SEQ ID NO: 1993856 - protein, 10 aa, Staphylococcus
VGTKLTQQKA

SEQ ID NO: 1993857 - protein, 5 aa, Staphylococcus
VGTLE

SEQ ID NO: 1993858 - protein, 24 aa, Staphylococcus
VGTPEGVRELENAGADATKVGIGP

SEQ ID NO: 1993859 - protein, 25 aa, Staphylococcus
VGTPEGVRELENAGADATKVGIGPG

SEQ ID NO: 1993860 - protein, 8 aa, Staphylococcus
VGTPEQVA

SEQ ID NO: 1993861 - protein, 6 aa, Staphylococcus
VGTQTM

SEQ ID NO: 1993862 - protein, 12 aa, Staphylococcus
VGTRLNQGQASR

SEQ ID NO: 1993863 - protein, 14 aa, Staphylococcus
VGTRNEVKQSLKKG

SEQ ID NO: 1993864 - protein, 7 aa, Staphylococcus
VGTRSEV

SEQ ID NO: 1993865 - protein, 6 aa, Staphylococcus
VGTRTE

SEQ ID NO: 1993866 - protein, 7 aa, Staphylococcus
VGTRTEV

SEQ ID NO: 1993867 - protein, 19 aa, Staphylococcus
VGTRTEVKQRLKKKQVTID

SEQ ID NO: 1993868 - protein, 6 aa, Staphylococcus
VGTSKI

SEQ ID NO: 1993869 - protein, 5 aa, Staphylococcus
VGTSP

SEQ ID NO: 1993870 - protein, 7 aa, Staphylococcus
VGTTLDE

SEQ ID NO: 1993871 - protein, 19 aa, Staphylococcus
VGTYASTDKYGEKTQGGYS

SEQ ID NO: 1993872 - protein, 6 aa, Staphylococcus
VGVDPK

SEQ ID NO: 1993873 - protein, 11 aa, Staphylococcus
VGVGKSSLTRA

SEQ ID NO: 1993874 - protein, 11 aa, Staphylococcus
VGVGKSTLTQA

SEQ ID NO: 1993875 - protein, 11 aa, Staphylococcus
VGVGKSTLTRA

SEQ ID NO: 1993876 - protein, 14 aa, Staphylococcus
VGVGTTVTHAPTQM

SEQ ID NO: 1993877 - protein, 24 aa, Staphylococcus
VGVKSKQKLKGDYSQSGISEETAQ

SEQ ID NO: 1993878 - protein, 11 aa, Staphylococcus
VGYEIQTPNSY

SEQ ID NO: 1993879 - protein, 7 aa, Staphylococcus
VGYGTKA

SEQ ID NO: 1993880 - protein, 18 aa, Staphylococcus
VGYKSISENIDTSNASGE

SEQ ID NO: 1993881 - protein, 8 aa, Staphylococcus
VGYNPKTL

SEQ ID NO: 1993882 - protein, 17 aa, Staphylococcus
VGYPKRWEDQEQYKGGW

SEQ ID NO: 1993883 - protein, 7 aa, Staphylococcus
VGYQPTL

SEQ ID NO: 1993884 - protein, 13 aa, Staphylococcus
VGYSRTGKKGGPF

SEQ ID NO: 1993885 - protein, 16 aa, Staphylococcus
VHDEKAGAMEDDPFYQ

SEQ ID NO: 1993886 - protein, 4 aa, Staphylococcus
VHDY

SEQ ID NO: 1993887 - protein, 14 aa, Staphylococcus
VHEAASAENEKDLY

SEQ ID NO: 1993888 - protein, 13 aa, Staphylococcus
VHEAASAENEQAL

SEQ ID NO: 1993889 - protein, 14 aa, Staphylococcus
VHEAASAENEQDLY

SEQ ID NO: 1993890 - protein, 5 aa, Staphylococcus
VHEQG

SEQ ID NO: 1993891 - protein, 7 aa, Staphylococcus
VHGETGM

SEQ ID NO: 1993892 - protein, 33 aa, Staphylococcus
VHGGATLNQSSALEPNLADKRSTNLREKQEIGR

SEQ ID NO: 1993893 - protein, 8 aa, Staphylococcus
VHGGRTKS

SEQ ID NO: 1993894 - protein, 5 aa, Staphylococcus
VHGPN

SEQ ID NO: 1993895 - protein, 6 aa, Staphylococcus
VHGPNH

SEQ ID NO: 1993896 - protein, 5 aa, Staphylococcus
VHGPQ

SEQ ID NO: 1993897 - protein, 12 aa, Staphylococcus
VHGPYKGEPNLG

SEQ ID NO: 1993898 - protein, 8 aa, Staphylococcus
VHHSRSQQ

SEQ ID NO: 1993899 - protein, 12 aa, Staphylococcus
VHKPSGAKPGFV

SEQ ID NO: 1993900 - protein, 13 aa, Staphylococcus
VHKPSGAKPGFVT

SEQ ID NO: 1993901 - protein, 10 aa, Staphylococcus
VHNGRRVSAS

SEQ ID NO: 1993902 - protein, 8 aa, Staphylococcus
VHNNQRDA

SEQ ID NO: 1993903 - protein, 9 aa, Staphylococcus
VHNNQRDAM

SEQ ID NO: 1993904 - protein, 6 aa, Staphylococcus
VHPDDA

SEQ ID NO: 1993905 - protein, 9 aa, Staphylococcus
VHPGSAKDA

SEQ ID NO: 1993906 - protein, 7 aa, Staphylococcus
VHPNDEY

SEQ ID NO: 1993907 - protein, 10 aa, Staphylococcus
VHQGAATPLI

SEQ ID NO: 1993908 - protein, 14 aa, Staphylococcus
VHQPNGNYSPKGSH

SEQ ID NO: 1993909 - protein, 5 aa, Staphylococcus
VHQSV

SEQ ID NO: 1993910 - protein, 9 aa, Staphylococcus
VHRGASKPL

SEQ ID NO: 1993911 - protein, 9 aa, Staphylococcus
VHRGSAKPL

SEQ ID NO: 1993912 - protein, 9 aa, Staphylococcus
VHRGSSQPL

SEQ ID NO: 1993913 - protein, 4 aa, Staphylococcus
VHSR

SEQ ID NO: 1993914 - protein, 5 aa, Staphylococcus
VHTAT

SEQ ID NO: 1993915 - protein, 10 aa, Staphylococcus
VHTSPSTETQ

SEQ ID NO: 1993916 - protein, 12 aa, Staphylococcus
VIAEDEKQTKNS

SEQ ID NO: 1993917 - protein, 10 aa, Staphylococcus
VIAPNSQTSF

SEQ ID NO: 1993918 - protein, 14 aa, Staphylococcus
VIDPEGNDVTPDKV

SEQ ID NO: 1993919 - protein, 22 aa, Staphylococcus
VIDPEGNDVTPEKLKKIQEQNK

SEQ ID NO: 1993920 - protein, 24 aa, Staphylococcus
VIDPEGNDVTPEKLKKIQERKKND

SEQ ID NO: 1993921 - protein, 23 aa, Staphylococcus
VIDPEGNDVTPEKLKKIQQNKKE

SEQ ID NO: 1993922 - protein, 23 aa, Staphylococcus
VIDPEGNDVTPEKLKKIQSEKNN

SEQ ID NO: 1993923 - protein, 6 aa, Staphylococcus
VIDSAS

SEQ ID NO: 1993924 - protein, 7 aa, Staphylococcus
VIDSGEN

SEQ ID NO: 1993925 - protein, 13 aa, Staphylococcus
VIDTTGAGDTFNG

SEQ ID NO: 1993926 - protein, 9 aa, Staphylococcus
VIEETKQDG

SEQ ID NO: 1993927 - protein, 7 aa, Staphylococcus
VIEGRQK

SEQ ID NO: 1993928 - protein, 6 aa, Staphylococcus
VIENNE

SEQ ID NO: 1993929 - protein, 4 aa, Staphylococcus
VIEP

SEQ ID NO: 1993930 - protein, 10 aa, Staphylococcus
VIEPNSNKEI

SEQ ID NO: 1993931 - protein, 6 aa, Staphylococcus
VIEQGQ

SEQ ID NO: 1993932 - protein, 13 aa, Staphylococcus
VIEQKQNDKQRAL

SEQ ID NO: 1993933 - protein, 14 aa, Staphylococcus
VIEQKQQEKQKALY

SEQ ID NO: 1993934 - protein, 10 aa, Staphylococcus
VIGKPDPIRG

SEQ ID NO: 1993935 - protein, 10 aa, Staphylococcus
VIGPGGKKIN

SEQ ID NO: 1993936 - protein, 6 aa, Staphylococcus
VINDPD

SEQ ID NO: 1993937 - protein, 13 aa, Staphylococcus
VINDSKVGAYTKV

SEQ ID NO: 1993938 - protein, 22 aa, Staphylococcus
VINTADELNGYNEERAKESIEN

SEQ ID NO: 1993939 - protein, 22 aa, Staphylococcus
VINTADELNGYNETRAKESIEG

SEQ ID NO: 1993940 - protein, 4 aa, Staphylococcus
VIPG

SEQ ID NO: 1993941 - protein, 6 aa, Staphylococcus
VIPGGA

SEQ ID NO: 1993942 - protein, 13 aa, Staphylococcus
VIPGSTDAVNSVE

SEQ ID NO: 1993943 - protein, 15 aa, Staphylococcus
VIPGSTDEVKSVEEI

SEQ ID NO: 1993944 - protein, 53 aa, Staphylococcus
VIPPKDGEKSSAHVTEDNRSDSDKLNSNSREVSSGYKTQSQPEKQKSQEINHN

SEQ ID NO: 1993945 - protein, 29 aa, Staphylococcus
VIPPKQDSLQNSNNATSKSQRNQPKNAHD

SEQ ID NO: 1993946 - protein, 4 aa, Staphylococcus
VIRP

SEQ ID NO: 1993947 - protein, 4 aa, Staphylococcus
VISG

SEQ ID NO: 1993948 - protein, 8 aa, Staphylococcus
VISPEGAS

SEQ ID NO: 1993949 - protein, 4 aa, Staphylococcus
VISQ

SEQ ID NO: 1993950 - protein, 12 aa, Staphylococcus
VISRNGKEIDLE

SEQ ID NO: 1993951 - protein, 11 aa, Staphylococcus
VISSGLETARE

SEQ ID NO: 1993952 - protein, 31 aa, Staphylococcus
VISSKSKIKYGTPQDTVRSRMGKPLDSITKG

SEQ ID NO: 1993953 - protein, 5 aa, Staphylococcus
VITPD

SEQ ID NO: 1993954 - protein, 10 aa, Staphylococcus
VITPDNKGNV

SEQ ID NO: 1993955 - protein, 5 aa, Staphylococcus
VITSS

SEQ ID NO: 1993956 - protein, 14 aa, Staphylococcus
VKAAEELEKDGHSV

SEQ ID NO: 1993957 - protein, 14 aa, Staphylococcus
VKAAQGHDGAKLGT

SEQ ID NO: 1993958 - protein, 28 aa, Staphylococcus
VKADPANDGLASIPQPTESGAAETGTPV

SEQ ID NO: 1993959 - protein, 8 aa, Staphylococcus
VKADYPDV

SEQ ID NO: 1993960 - protein, 12 aa, Staphylococcus
VKAEEDKYLKLQ

SEQ ID NO: 1993961 - protein, 10 aa, Staphylococcus
VKAEKDDTDL

SEQ ID NO: 1993962 - protein, 7 aa, Staphylococcus
VKAGDYE

SEQ ID NO: 1993963 - protein, 12 aa, Staphylococcus
VKAGQDQDWAKL

SEQ ID NO: 1993964 - protein, 8 aa, Staphylococcus
VKAHEESK

SEQ ID NO: 1993965 - protein, 7 aa, Staphylococcus
VKAHGGH

SEQ ID NO: 1993966 - protein, 12 aa, Staphylococcus
VKAKIVKKNQIS

SEQ ID NO: 1993967 - protein, 12 aa, Staphylococcus
VKAKQDEQVAEK

SEQ ID NO: 1993968 - protein, 6 aa, Staphylococcus
VKANRD

SEQ ID NO: 1993969 - protein, 15 aa, Staphylococcus
VKANTLASVGSKAIE

SEQ ID NO: 1993970 - protein, 10 aa, Staphylococcus
VKASGGVRSL

SEQ ID NO: 1993971 - protein, 5 aa, Staphylococcus
VKASK

SEQ ID NO: 1993972 - protein, 23 aa, Staphylococcus
VKASKFSASAAEAIDAKGGAHEV

SEQ ID NO: 1993973 - protein, 8 aa, Staphylococcus
VKASPDHP

SEQ ID NO: 1993974 - protein, 8 aa, Staphylococcus
VKASPFDG

SEQ ID NO: 1993975 - protein, 8 aa, Staphylococcus
VKASPYEG

SEQ ID NO: 1993976 - protein, 13 aa, Staphylococcus
VKASSTNKDTWSN

SEQ ID NO: 1993977 - protein, 4 aa, Staphylococcus
VKAT

SEQ ID NO: 1993978 - protein, 8 aa, Staphylococcus
VKATNEQL

SEQ ID NO: 1993979 - protein, 10 aa, Staphylococcus
VKDAANEAEI

SEQ ID NO: 1993980 - protein, 6 aa, Staphylococcus
VKDAAT

SEQ ID NO: 1993981 - protein, 22 aa, Staphylococcus
VKDAQSYKKRDALKDIDATSPP

SEQ ID NO: 1993982 - protein, 6 aa, Staphylococcus
VKDDDA

SEQ ID NO: 1993983 - protein, 12 aa, Staphylococcus
VKDDKAKTKSLS

SEQ ID NO: 1993984 - protein, 11 aa, Staphylococcus
VKDDKEKTKAL

SEQ ID NO: 1993985 - protein, 11 aa, Staphylococcus
VKDDKEKTKEL

SEQ ID NO: 1993986 - protein, 11 aa, Staphylococcus
VKDDKQKTKEL

SEQ ID NO: 1993987 - protein, 16 aa, Staphylococcus
VKDDNNNNIHNSDLNA

SEQ ID NO: 1993988 - protein, 8 aa, Staphylococcus
VKDDSSIN

SEQ ID NO: 1993989 - protein, 10 aa, Staphylococcus
VKDEEKVAKA

SEQ ID NO: 1993990 - protein, 8 aa, Staphylococcus
VKDEKDLE

SEQ ID NO: 1993991 - protein, 7 aa, Staphylococcus
VKDERPD

SEQ ID NO: 1993992 - protein, 10 aa, Staphylococcus
VKDGDDSLKE

SEQ ID NO: 1993993 - protein, 6 aa, Staphylococcus
VKDGEK

SEQ ID NO: 1993994 - protein, 11 aa, Staphylococcus
VKDGKTTGKFE

SEQ ID NO: 1993995 - protein, 15 aa, Staphylococcus
VKDIPGAGAAGGLGT

SEQ ID NO: 1993996 - protein, 10 aa, Staphylococcus
VKDIQDDKKR

SEQ ID NO: 1993997 - protein, 6 aa, Staphylococcus
VKDKEY

SEQ ID NO: 1993998 - protein, 10 aa, Staphylococcus
VKDKYKSRYD

SEQ ID NO: 1993999 - protein, 7 aa, Staphylococcus
VKDLGRK

SEQ ID NO: 1994000 - protein, 5 aa, Staphylococcus
VKDPR

SEQ ID NO: 1994001 - protein, 6 aa, Staphylococcus
VKDPRV

SEQ ID NO: 1994002 - protein, 4 aa, Staphylococcus
VKDQ

SEQ ID NO: 1994003 - protein, 9 aa, Staphylococcus
VKDQEEINT

SEQ ID NO: 1994004 - protein, 11 aa, Staphylococcus
VKDQNEAIEKA

SEQ ID NO: 1994005 - protein, 4 aa, Staphylococcus
VKDS

SEQ ID NO: 1994006 - protein, 7 aa, Staphylococcus
VKDTDRL

SEQ ID NO: 1994007 - protein, 12 aa, Staphylococcus
VKDTGKDISVPV

SEQ ID NO: 1994008 - protein, 17 aa, Staphylococcus
VKDTGKDISVPVGDETL

SEQ ID NO: 1994009 - protein, 14 aa, Staphylococcus
VKDTIKKASIASGV

SEQ ID NO: 1994010 - protein, 6 aa, Staphylococcus
VKDTKH

SEQ ID NO: 1994011 - protein, 7 aa, Staphylococcus
VKDTNRI

SEQ ID NO: 1994012 - protein, 27 aa, Staphylococcus
VKDTTNKPVNKKRPTIPAPNPSKIKKA

SEQ ID NO: 1994013 - protein, 11 aa, Staphylococcus
VKDYEANGANA

SEQ ID NO: 1994014 - protein, 8 aa, Staphylococcus
VKDYSGEH

SEQ ID NO: 1994015 - protein, 7 aa, Staphylococcus
VKDYTKD

SEQ ID NO: 1994016 - protein, 4 aa, Staphylococcus
VKEA

SEQ ID NO: 1994017 - protein, 10 aa, Staphylococcus
VKEAADKAGV

SEQ ID NO: 1994018 - protein, 22 aa, Staphylococcus
VKEAAKATTGKVVNNTGQVCTA

SEQ ID NO: 1994019 - protein, 11 aa, Staphylococcus
VKEAGKNYAAE

SEQ ID NO: 1994020 - protein, 16 aa, Staphylococcus
VKEAKVQGIHGKDSTP

SEQ ID NO: 1994021 - protein, 8 aa, Staphylococcus
VKEDYREY

SEQ ID NO: 1994022 - protein, 4 aa, Staphylococcus
VKEE

SEQ ID NO: 1994023 - protein, 12 aa, Staphylococcus
VKEEAPVKGLVY

SEQ ID NO: 1994024 - protein, 5 aa, Staphylococcus
VKEED

SEQ ID NO: 1994025 - protein, 24 aa, Staphylococcus
VKEEEDNQADSDDTDASETATEEV

SEQ ID NO: 1994026 - protein, 12 aa, Staphylococcus
VKEESDKAALTL

SEQ ID NO: 1994027 - protein, 12 aa, Staphylococcus
VKEESDKEGLSL

SEQ ID NO: 1994028 - protein, 11 aa, Staphylococcus
VKEESDKEKLT

SEQ ID NO: 1994029 - protein, 12 aa, Staphylococcus
VKEESDKESLTL

SEQ ID NO: 1994030 - protein, 12 aa, Staphylococcus
VKEESDKKELTL

SEQ ID NO: 1994031 - protein, 8 aa, Staphylococcus
VKEESGVD

SEQ ID NO: 1994032 - protein, 6 aa, Staphylococcus
VKEETG

SEQ ID NO: 1994033 - protein, 5 aa, Staphylococcus
VKEGG

SEQ ID NO: 1994034 - protein, 11 aa, Staphylococcus
VKEGKAQGLKI

SEQ ID NO: 1994035 - protein, 12 aa, Staphylococcus
VKEGNTTKTPAK

SEQ ID NO: 1994036 - protein, 11 aa, Staphylococcus
VKEGRKNTDAL

SEQ ID NO: 1994037 - protein, 9 aa, Staphylococcus
VKEGTEKFG

SEQ ID NO: 1994038 - protein, 5 aa, Staphylococcus
VKEIA

SEQ ID NO: 1994039 - protein, 6 aa, Staphylococcus
VKEKGF

SEQ ID NO: 1994040 - protein, 23 aa, Staphylococcus
VKEKKKEVEIPRNKIAKARHAVL

SEQ ID NO: 1994041 - protein, 8 aa, Staphylococcus
VKEKNGSV

SEQ ID NO: 1994042 - protein, 6 aa, Staphylococcus
VKEKSY

SEQ ID NO: 1994043 - protein, 9 aa, Staphylococcus
VKEKTTQPF

SEQ ID NO: 1994044 - protein, 4 aa, Staphylococcus
VKEN

SEQ ID NO: 1994045 - protein, 11 aa, Staphylococcus
VKENKGYMPPE

SEQ ID NO: 1994046 - protein, 7 aa, Staphylococcus
VKENNGV

SEQ ID NO: 1994047 - protein, 8 aa, Staphylococcus
VKENPYEG

SEQ ID NO: 1994048 - protein, 7 aa, Staphylococcus
VKENQDN

SEQ ID NO: 1994049 - protein, 15 aa, Staphylococcus
VKENTFATVGSSALE

SEQ ID NO: 1994050 - protein, 7 aa, Staphylococcus
VKEPREK

SEQ ID NO: 1994051 - protein, 8 aa, Staphylococcus
VKEQEIQE

SEQ ID NO: 1994052 - protein, 8 aa, Staphylococcus
VKEQTASI

SEQ ID NO: 1994053 - protein, 6 aa, Staphylococcus
VKESEG

SEQ ID NO: 1994054 - protein, 4 aa, Staphylococcus
VKET

SEQ ID NO: 1994055 - protein, 11 aa, Staphylococcus
VKETEETLTTE

SEQ ID NO: 1994056 - protein, 5 aa, Staphylococcus
VKETN

SEQ ID NO: 1994057 - protein, 8 aa, Staphylococcus
VKETPNSR

SEQ ID NO: 1994058 - protein, 12 aa, Staphylococcus
VKETTDENPERV

SEQ ID NO: 1994059 - protein, 8 aa, Staphylococcus
VKETTFAT

SEQ ID NO: 1994060 - protein, 8 aa, Staphylococcus
VKETTMAT

SEQ ID NO: 1994061 - protein, 17 aa, Staphylococcus
VKETTREEIEQHDAENF

SEQ ID NO: 1994062 - protein, 5 aa, Staphylococcus
VKEVE

SEQ ID NO: 1994063 - protein, 6 aa, Staphylococcus
VKEVKP

SEQ ID NO: 1994064 - protein, 9 aa, Staphylococcus
VKEYQQSDL

SEQ ID NO: 1994065 - protein, 7 aa, Staphylococcus
VKGAELP

SEQ ID NO: 1994066 - protein, 8 aa, Staphylococcus
VKGAESIN

SEQ ID NO: 1994067 - protein, 15 aa, Staphylococcus
VKGASSVIKQGTKVK

SEQ ID NO: 1994068 - protein, 7 aa, Staphylococcus
VKGEENK

SEQ ID NO: 1994069 - protein, 7 aa, Staphylococcus
VKGENQH

SEQ ID NO: 1994070 - protein, 7 aa, Staphylococcus
VKGEQQH

SEQ ID NO: 1994071 - protein, 12 aa, Staphylococcus
VKGETKVIDVTM

SEQ ID NO: 1994072 - protein, 8 aa, Staphylococcus
VKGETPAI

SEQ ID NO: 1994073 - protein, 4 aa, Staphylococcus
VKGG

SEQ ID NO: 1994074 - protein, 10 aa, Staphylococcus
VKGGNTTGKF

SEQ ID NO: 1994075 - protein, 7 aa, Staphylococcus
VKGINGS

SEQ ID NO: 1994076 - protein, 19 aa, Staphylococcus
VKGNGKARKALNQANTEQE

SEQ ID NO: 1994077 - protein, 20 aa, Staphylococcus
VKGNTDNENLVTKNNEIHQR

SEQ ID NO: 1994078 - protein, 16 aa, Staphylococcus
VKGPDGLHFRFNFIEV

SEQ ID NO: 1994079 - protein, 11 aa, Staphylococcus
VKGPKGELTRT

SEQ ID NO: 1994080 - protein, 9 aa, Staphylococcus
VKGPSGTAH

SEQ ID NO: 1994081 - protein, 8 aa, Staphylococcus
VKGQDGIN

SEQ ID NO: 1994082 - protein, 12 aa, Staphylococcus
VKGQQQEEIEKA

SEQ ID NO: 1994083 - protein, 12 aa, Staphylococcus
VKGQRQSEKTSV

SEQ ID NO: 1994084 - protein, 18 aa, Staphylococcus
VKGSGYDREYSTVNGAQG

SEQ ID NO: 1994085 - protein, 7 aa, Staphylococcus
VKGSLSR

SEQ ID NO: 1994086 - protein, 4 aa, Staphylococcus
VKGT

SEQ ID NO: 1994087 - protein, 7 aa, Staphylococcus
VKGTELD

SEQ ID NO: 1994088 - protein, 9 aa, Staphylococcus
VKGTHGSDG

SEQ ID NO: 1994089 - protein, 10 aa, Staphylococcus
VKHESTPRIL

SEQ ID NO: 1994090 - protein, 5 aa, Staphylococcus
VKHET

SEQ ID NO: 1994091 - protein, 9 aa, Staphylococcus
VKHSSAQTL

SEQ ID NO: 1994092 - protein, 8 aa, Staphylococcus
VKIETGNP

SEQ ID NO: 1994093 - protein, 11 aa, Staphylococcus
VKIQRKDYTVN

SEQ ID NO: 1994094 - protein, 9 aa, Staphylococcus
VKKAERKKM

SEQ ID NO: 1994095 - protein, 9 aa, Staphylococcus
VKKAERKTM

SEQ ID NO: 1994096 - protein, 4 aa, Staphylococcus
VKKD

SEQ ID NO: 1994097 - protein, 9 aa, Staphylococcus
VKKDDSAFK

SEQ ID NO: 1994098 - protein, 10 aa, Staphylococcus
VKKDEYNNQI

SEQ ID NO: 1994099 - protein, 10 aa, Staphylococcus
VKKDGLKGGG

SEQ ID NO: 1994100 - protein, 9 aa, Staphylococcus
VKKDQPDVF

SEQ ID NO: 1994101 - protein, 11 aa, Staphylococcus
VKKDSRHKAYY

SEQ ID NO: 1994102 - protein, 13 aa, Staphylococcus
VKKEEKEALSQRL

SEQ ID NO: 1994103 - protein, 17 aa, Staphylococcus
VKKEVGKDPHKGVNPDE

SEQ ID NO: 1994104 - protein, 18 aa, Staphylococcus
VKKEVGKDPHKGVNPDEV

SEQ ID NO: 1994105 - protein, 12 aa, Staphylococcus
VKKGPDSVEHGE

SEQ ID NO: 1994106 - protein, 14 aa, Staphylococcus
VKKGSGKYFGPYPN

SEQ ID NO: 1994107 - protein, 23 aa, Staphylococcus
VKKGSGKYFGPYPNAYSAQETKK

SEQ ID NO: 1994108 - protein, 7 aa, Staphylococcus
VKKGSKA

SEQ ID NO: 1994109 - protein, 12 aa, Staphylococcus
VKKHPDQENFSK

SEQ ID NO: 1994110 - protein, 5 aa, Staphylococcus
VKKID

SEQ ID NO: 1994111 - protein, 6 aa, Staphylococcus
VKKMRE

SEQ ID NO: 1994112 - protein, 5 aa, Staphylococcus
VKKND

SEQ ID NO: 1994113 - protein, 8 aa, Staphylococcus
VKKNIESG

SEQ ID NO: 1994114 - protein, 8 aa, Staphylococcus
VKKNVENG

SEQ ID NO: 1994115 - protein, 10 aa, Staphylococcus
VKKQDKDKNI

SEQ ID NO: 1994116 - protein, 7 aa, Staphylococcus
VKKSNDS

SEQ ID NO: 1994117 - protein, 8 aa, Staphylococcus
VKKSRQTV

SEQ ID NO: 1994118 - protein, 8 aa, Staphylococcus
VKKTQSEL

SEQ ID NO: 1994119 - protein, 4 aa, Staphylococcus
VKKV

SEQ ID NO: 1994120 - protein, 7 aa, Staphylococcus
VKKVDEA

SEQ ID NO: 1994121 - protein, 24 aa, Staphylococcus
VKKVNPKRLQREVAKEQKKPKFTT

SEQ ID NO: 1994122 - protein, 4 aa, Staphylococcus
VKKY

SEQ ID NO: 1994123 - protein, 5 aa, Staphylococcus
VKKYP

SEQ ID NO: 1994124 - protein, 4 aa, Staphylococcus
VKLD

SEQ ID NO: 1994125 - protein, 8 aa, Staphylococcus
VKLGNKQN

SEQ ID NO: 1994126 - protein, 11 aa, Staphylococcus
VKLSGNSVIGE

SEQ ID NO: 1994127 - protein, 17 aa, Staphylococcus
VKMGQRGEVQVNPQLQT

SEQ ID NO: 1994128 - protein, 9 aa, Staphylococcus
VKNAESKIE

SEQ ID NO: 1994129 - protein, 7 aa, Staphylococcus
VKNDEDV

SEQ ID NO: 1994130 - protein, 7 aa, Staphylococcus
VKNDENN

SEQ ID NO: 1994131 - protein, 9 aa, Staphylococcus
VKNDNVQGE

SEQ ID NO: 1994132 - protein, 5 aa, Staphylococcus
VKNEA

SEQ ID NO: 1994133 - protein, 17 aa, Staphylococcus
VKNEPEKREAQKRLAEE

SEQ ID NO: 1994134 - protein, 15 aa, Staphylococcus
VKNETSEYNGKTYEN

SEQ ID NO: 1994135 - protein, 11 aa, Staphylococcus
VKNETSLDDEG

SEQ ID NO: 1994136 - protein, 12 aa, Staphylococcus
VKNFATEKPEYS

SEQ ID NO: 1994137 - protein, 6 aa, Staphylococcus
VKNGNS

SEQ ID NO: 1994138 - protein, 4 aa, Staphylococcus
VKNI

SEQ ID NO: 1994139 - protein, 14 aa, Staphylococcus
VKNKDGKYKAEYRQ

SEQ ID NO: 1994140 - protein, 7 aa, Staphylococcus
VKNKENI

SEQ ID NO: 1994141 - protein, 10 aa, Staphylococcus
VKNKVSQINS

SEQ ID NO: 1994142 - protein, 8 aa, Staphylococcus
VKNPDTVA

SEQ ID NO: 1994143 - protein, 12 aa, Staphylococcus
VKNQDKDKNTTL

SEQ ID NO: 1994144 - protein, 28 aa, Staphylococcus
VKNQSSEDNEDTESNNIDENKQEESSEN

SEQ ID NO: 1994145 - protein, 7 aa, Staphylococcus
VKNRKGD

SEQ ID NO: 1994146 - protein, 8 aa, Staphylococcus
VKNRLSSG

SEQ ID NO: 1994147 - protein, 9 aa, Staphylococcus
VKNRNGEKI

SEQ ID NO: 1994148 - protein, 9 aa, Staphylococcus
VKNRNGNEI

SEQ ID NO: 1994149 - protein, 10 aa, Staphylococcus
VKNRNNEEIT

SEQ ID NO: 1994150 - protein, 8 aa, Staphylococcus
VKNRNNEI

SEQ ID NO: 1994151 - protein, 10 aa, Staphylococcus
VKNSDKVPYY

SEQ ID NO: 1994152 - protein, 11 aa, Staphylococcus
VKNSGKDTSEI

SEQ ID NO: 1994153 - protein, 8 aa, Staphylococcus
VKNSPFEG

SEQ ID NO: 1994154 - protein, 14 aa, Staphylococcus
VKNTEGKYKAEYRQ

SEQ ID NO: 1994155 - protein, 8 aa, Staphylococcus
VKNTYGTG

SEQ ID NO: 1994156 - protein, 16 aa, Staphylococcus
VKNYKRNARQKLQRFF

SEQ ID NO: 1994157 - protein, 4 aa, Staphylococcus
VKPD

SEQ ID NO: 1994158 - protein, 7 aa, Staphylococcus
VKPDEEL

SEQ ID NO: 1994159 - protein, 7 aa, Staphylococcus
VKPETLK

SEQ ID NO: 1994160 - protein, 5 aa, Staphylococcus
VKPGD

SEQ ID NO: 1994161 - protein, 6 aa, Staphylococcus
VKPGLQ

SEQ ID NO: 1994162 - protein, 8 aa, Staphylococcus
VKPGTDAL

SEQ ID NO: 1994163 - protein, 6 aa, Staphylococcus
VKPKQN

SEQ ID NO: 1994164 - protein, 7 aa, Staphylococcus
VKPKQNG

SEQ ID NO: 1994165 - protein, 9 aa, Staphylococcus
VKPKRGEVE

SEQ ID NO: 1994166 - protein, 7 aa, Staphylococcus
VKPNDRV

SEQ ID NO: 1994167 - protein, 12 aa, Staphylococcus
VKPNHLDEGEYN

SEQ ID NO: 1994168 - protein, 9 aa, Staphylococcus
VKPNRRKPY

SEQ ID NO: 1994169 - protein, 12 aa, Staphylococcus
VKPNYKVKQNDN

SEQ ID NO: 1994170 - protein, 7 aa, Staphylococcus
VKPSDSV

SEQ ID NO: 1994171 - protein, 7 aa, Staphylococcus
VKPSKDG

SEQ ID NO: 1994172 - protein, 11 aa, Staphylococcus
VKPSQEKGISD

SEQ ID NO: 1994173 - protein, 10 aa, Staphylococcus
VKPSSDPGIS

SEQ ID NO: 1994174 - protein, 12 aa, Staphylococcus
VKPSVESKSETR

SEQ ID NO: 1994175 - protein, 4 aa, Staphylococcus
VKPT

SEQ ID NO: 1994176 - protein, 11 aa, Staphylococcus
VKPTKQSVSEL

SEQ ID NO: 1994177 - protein, 9 aa, Staphylococcus
VKPVEQETQ

SEQ ID NO: 1994178 - protein, 4 aa, Staphylococcus
VKQD

SEQ ID NO: 1994179 - protein, 23 aa, Staphylococcus
VKQDGETVEYDHTSKKAMKDSTS

SEQ ID NO: 1994180 - protein, 11 aa, Staphylococcus
VKQDGLKGGGY

SEQ ID NO: 1994181 - protein, 7 aa, Staphylococcus
VKQDTGV

SEQ ID NO: 1994182 - protein, 60 aa, Staphylococcus
VKQEDDADEAESDIESDNAQGESNSEEVIEGGAPGKAIQTEVTDEEQGSEDTQDGDERID

SEQ ID NO: 1994183 - protein, 10 aa, Staphylococcus
VKQEGLKGGG

SEQ ID NO: 1994184 - protein, 8 aa, Staphylococcus
VKQEKDAI

SEQ ID NO: 1994185 - protein, 14 aa, Staphylococcus
VKQEKNNPGNIHNQ

SEQ ID NO: 1994186 - protein, 12 aa, Staphylococcus
VKQESDKAGLTL

SEQ ID NO: 1994187 - protein, 12 aa, Staphylococcus
VKQESDKEGLTL

SEQ ID NO: 1994188 - protein, 4 aa, Staphylococcus
VKQG

SEQ ID NO: 1994189 - protein, 9 aa, Staphylococcus
VKQGGTNSF

SEQ ID NO: 1994190 - protein, 8 aa, Staphylococcus
VKQMNREN

SEQ ID NO: 1994191 - protein, 6 aa, Staphylococcus
VKQNDH

SEQ ID NO: 1994192 - protein, 9 aa, Staphylococcus
VKQNNNKEL

SEQ ID NO: 1994193 - protein, 7 aa, Staphylococcus
VKQPDHE

SEQ ID NO: 1994194 - protein, 7 aa, Staphylococcus
VKQPDYN

SEQ ID NO: 1994195 - protein, 4 aa, Staphylococcus
VKQR

SEQ ID NO: 1994196 - protein, 5 aa, Staphylococcus
VKQSY

SEQ ID NO: 1994197 - protein, 9 aa, Staphylococcus
VKQTEARVK

SEQ ID NO: 1994198 - protein, 18 aa, Staphylococcus
VKQTEARVKQKIGPEKVK

SEQ ID NO: 1994199 - protein, 22 aa, Staphylococcus
VKQTEARVKQKIGPEKVKAQSF

SEQ ID NO: 1994200 - protein, 20 aa, Staphylococcus
VKQTEARVKQQVGPEKVTAQ

SEQ ID NO: 1994201 - protein, 18 aa, Staphylococcus
VKQTEDKVRQKTGPEKIK

SEQ ID NO: 1994202 - protein, 19 aa, Staphylococcus
VKQTEDKVRQKTGPEKVKA

SEQ ID NO: 1994203 - protein, 7 aa, Staphylococcus
VKQTEPD

SEQ ID NO: 1994204 - protein, 6 aa, Staphylococcus
VKQYDK

SEQ ID NO: 1994205 - protein, 8 aa, Staphylococcus
VKRAEEMV

SEQ ID NO: 1994206 - protein, 12 aa, Staphylococcus
VKRAQEIEQETR

SEQ ID NO: 1994207 - protein, 9 aa, Staphylococcus
VKRATTDFE

SEQ ID NO: 1994208 - protein, 7 aa, Staphylococcus
VKRDGTP

SEQ ID NO: 1994209 - protein, 8 aa, Staphylococcus
VKRDKAAI

SEQ ID NO: 1994210 - protein, 15 aa, Staphylococcus
VKRDPRTNMRSAQNN

SEQ ID NO: 1994211 - protein, 7 aa, Staphylococcus
VKRELGQ

SEQ ID NO: 1994212 - protein, 5 aa, Staphylococcus
VKRGQ

SEQ ID NO: 1994213 - protein, 6 aa, Staphylococcus
VKRGYR

SEQ ID NO: 1994214 - protein, 8 aa, Staphylococcus
VKRHERKK

SEQ ID NO: 1994215 - protein, 4 aa, Staphylococcus
VKRK

SEQ ID NO: 1994216 - protein, 5 aa, Staphylococcus
VKRKA

SEQ ID NO: 1994217 - protein, 15 aa, Staphylococcus
VKRKMDFNEKIQNLF

SEQ ID NO: 1994218 - protein, 16 aa, Staphylococcus
VKRKMNYKEKLQNLFE

SEQ ID NO: 1994219 - protein, 13 aa, Staphylococcus
VKRRGDMEEDPAY

SEQ ID NO: 1994220 - protein, 13 aa, Staphylococcus
VKRRGDMEEDSTF

SEQ ID NO: 1994221 - protein, 9 aa, Staphylococcus
VKRSSLSNF

SEQ ID NO: 1994222 - protein, 7 aa, Staphylococcus
VKRTNSN

SEQ ID NO: 1994223 - protein, 8 aa, Staphylococcus
VKRTVKAE

SEQ ID NO: 1994224 - protein, 4 aa, Staphylococcus
VKSD

SEQ ID NO: 1994225 - protein, 11 aa, Staphylococcus
VKSDENGEVDV

SEQ ID NO: 1994226 - protein, 8 aa, Staphylococcus
VKSDEQVV

SEQ ID NO: 1994227 - protein, 9 aa, Staphylococcus
VKSDSGTAR

SEQ ID NO: 1994228 - protein, 6 aa, Staphylococcus
VKSEKE

SEQ ID NO: 1994229 - protein, 8 aa, Staphylococcus
VKSEKSGI

SEQ ID NO: 1994230 - protein, 18 aa, Staphylococcus
VKSGEADGCVSAGNTGAL

SEQ ID NO: 1994231 - protein, 10 aa, Staphylococcus
VKSGGPELAK

SEQ ID NO: 1994232 - protein, 7 aa, Staphylococcus
VKSGSKA

SEQ ID NO: 1994233 - protein, 5 aa, Staphylococcus
VKSGY

SEQ ID NO: 1994234 - protein, 4 aa, Staphylococcus
VKSI

SEQ ID NO: 1994235 - protein, 24 aa, Staphylococcus
VKSIGHETFDTDASVDTAKNGDIV

SEQ ID NO: 1994236 - protein, 4 aa, Staphylococcus
VKSK

SEQ ID NO: 1994237 - protein, 9 aa, Staphylococcus
VKSKDGTHE

SEQ ID NO: 1994238 - protein, 10 aa, Staphylococcus
VKSKDGTSEK

SEQ ID NO: 1994239 - protein, 9 aa, Staphylococcus
VKSKDGVQE

SEQ ID NO: 1994240 - protein, 12 aa, Staphylococcus
VKSKDTGPIGDT

SEQ ID NO: 1994241 - protein, 10 aa, Staphylococcus
VKSKEGTSEK

SEQ ID NO: 1994242 - protein, 17 aa, Staphylococcus
VKSKGYDRVNSKTISEA

SEQ ID NO: 1994243 - protein, 10 aa, Staphylococcus
VKSKNGTSEK

SEQ ID NO: 1994244 - protein, 4 aa, Staphylococcus
VKSN

SEQ ID NO: 1994245 - protein, 11 aa, Staphylococcus
VKSNAKKQGKL

SEQ ID NO: 1994246 - protein, 5 aa, Staphylococcus
VKSNE

SEQ ID NO: 1994247 - protein, 8 aa, Staphylococcus
VKSNFKDK

SEQ ID NO: 1994248 - protein, 8 aa, Staphylococcus
VKSNSDFT

SEQ ID NO: 1994249 - protein, 6 aa, Staphylococcus
VKSPTV

SEQ ID NO: 1994250 - protein, 4 aa, Staphylococcus
VKSQ

SEQ ID NO: 1994251 - protein, 7 aa, Staphylococcus
VKSQGRD

SEQ ID NO: 1994252 - protein, 8 aa, Staphylococcus
VKSQNDPL

SEQ ID NO: 1994253 - protein, 9 aa, Staphylococcus
VKSRMSNAK

SEQ ID NO: 1994254 - protein, 8 aa, Staphylococcus
VKSSDSVI

SEQ ID NO: 1994255 - protein, 8 aa, Staphylococcus
VKSSRHGQ

SEQ ID NO: 1994256 - protein, 7 aa, Staphylococcus
VKSTDDF

SEQ ID NO: 1994257 - protein, 7 aa, Staphylococcus
VKSTHHS

SEQ ID NO: 1994258 - protein, 9 aa, Staphylococcus
VKSTQENLA

SEQ ID NO: 1994259 - protein, 9 aa, Staphylococcus
VKSTTFATV

SEQ ID NO: 1994260 - protein, 17 aa, Staphylococcus
VKSVGHETFDTDASVDV

SEQ ID NO: 1994261 - protein, 4 aa, Staphylococcus
VKSY

SEQ ID NO: 1994262 - protein, 6 aa, Staphylococcus
VKSYEV

SEQ ID NO: 1994263 - protein, 10 aa, Staphylococcus
VKTADTPSEI

SEQ ID NO: 1994264 - protein, 7 aa, Staphylococcus
VKTAKGR

SEQ ID NO: 1994265 - protein, 10 aa, Staphylococcus
VKTAKVKKKH

SEQ ID NO: 1994266 - protein, 15 aa, Staphylococcus
VKTAQDHLSSKEGTT

SEQ ID NO: 1994267 - protein, 7 aa, Staphylococcus
VKTDDVY

SEQ ID NO: 1994268 - protein, 6 aa, Staphylococcus
VKTDEG

SEQ ID NO: 1994269 - protein, 16 aa, Staphylococcus
VKTDNNDVKSSQKEAL

SEQ ID NO: 1994270 - protein, 6 aa, Staphylococcus
VKTDRD

SEQ ID NO: 1994271 - protein, 40 aa, Staphylococcus
VKTEDAKQASDTFSTKKEAKQRAKEIADNRGTQVIEHQKD

SEQ ID NO: 1994272 - protein, 8 aa, Staphylococcus
VKTEEEAK

SEQ ID NO: 1994273 - protein, 9 aa, Staphylococcus
VKTERNEDV

SEQ ID NO: 1994274 - protein, 8 aa, Staphylococcus
VKTGEEKD

SEQ ID NO: 1994275 - protein, 9 aa, Staphylococcus
VKTGEEKDV

SEQ ID NO: 1994276 - protein, 8 aa, Staphylococcus
VKTGEEKE

SEQ ID NO: 1994277 - protein, 8 aa, Staphylococcus
VKTGEGGK

SEQ ID NO: 1994278 - protein, 6 aa, Staphylococcus
VKTGER

SEQ ID NO: 1994279 - protein, 7 aa, Staphylococcus
VKTGERI

SEQ ID NO: 1994280 - protein, 10 aa, Staphylococcus
VKTGGEELAQ

SEQ ID NO: 1994281 - protein, 16 aa, Staphylococcus
VKTGGPELAKRLEDEG

SEQ ID NO: 1994282 - protein, 16 aa, Staphylococcus
VKTGSKNVQDNIQDGK

SEQ ID NO: 1994283 - protein, 7 aa, Staphylococcus
VKTKNGL

SEQ ID NO: 1994284 - protein, 8 aa, Staphylococcus
VKTNDATR

SEQ ID NO: 1994285 - protein, 8 aa, Staphylococcus
VKTNDGTH

SEQ ID NO: 1994286 - protein, 7 aa, Staphylococcus
VKTNGGR

SEQ ID NO: 1994287 - protein, 8 aa, Staphylococcus
VKTPEEID

SEQ ID NO: 1994288 - protein, 7 aa, Staphylococcus
VKTPKED

SEQ ID NO: 1994289 - protein, 6 aa, Staphylococcus
VKTPLT

SEQ ID NO: 1994290 - protein, 8 aa, Staphylococcus
VKTQKYTI

SEQ ID NO: 1994291 - protein, 12 aa, Staphylococcus
VKTQYSNMGAES

SEQ ID NO: 1994292 - protein, 13 aa, Staphylococcus
VKTRQTQSFNQPT

SEQ ID NO: 1994293 - protein, 6 aa, Staphylococcus
VKTSDR

SEQ ID NO: 1994294 - protein, 8 aa, Staphylococcus
VKTSNGKY

SEQ ID NO: 1994295 - protein, 10 aa, Staphylococcus
VKTSNLGKPI

SEQ ID NO: 1994296 - protein, 9 aa, Staphylococcus
VKTTDSYGI

SEQ ID NO: 1994297 - protein, 12 aa, Staphylococcus
VKTTDSYGTEQR

SEQ ID NO: 1994298 - protein, 9 aa, Staphylococcus
VKTTDTYGI

SEQ ID NO: 1994299 - protein, 14 aa, Staphylococcus
VKTTEIEGHPDFSG

SEQ ID NO: 1994300 - protein, 9 aa, Staphylococcus
VKTTGSGFV

SEQ ID NO: 1994301 - protein, 12 aa, Staphylococcus
VKTTQSYGSEQR

SEQ ID NO: 1994302 - protein, 7 aa, Staphylococcus
VKVEEGQ

SEQ ID NO: 1994303 - protein, 13 aa, Staphylococcus
VKVETDGKLLTGK

SEQ ID NO: 1994304 - protein, 4 aa, Staphylococcus
VKVG

SEQ ID NO: 1994305 - protein, 25 aa, Staphylococcus
VKVGAPTVEGASVTATVNKQGRGKK

SEQ ID NO: 1994306 - protein, 9 aa, Staphylococcus
VKVKSDNQV

SEQ ID NO: 1994307 - protein, 19 aa, Staphylococcus
VKVNDGKDLSQDAHAKDLE

SEQ ID NO: 1994308 - protein, 6 aa, Staphylococcus
VKVNGE

SEQ ID NO: 1994309 - protein, 6 aa, Staphylococcus
VKVNGQ

SEQ ID NO: 1994310 - protein, 9 aa, Staphylococcus
VKVNSNSVT

SEQ ID NO: 1994311 - protein, 8 aa, Staphylococcus
VKVSSKYK

SEQ ID NO: 1994312 - protein, 8 aa, Staphylococcus
VKVTNKEE

SEQ ID NO: 1994313 - protein, 10 aa, Staphylococcus
VKYNKQKNRI

SEQ ID NO: 1994314 - protein, 15 aa, Staphylococcus
VKYPYSKETSTITQY

SEQ ID NO: 1994315 - protein, 19 aa, Staphylococcus
VKYSKKYKTHDENNSAKLG

SEQ ID NO: 1994316 - protein, 24 aa, Staphylococcus
VLDPESNDVTPDKLKKIQRDQNKR

SEQ ID NO: 1994317 - protein, 11 aa, Staphylococcus
VLDSKEEVEPM

SEQ ID NO: 1994318 - protein, 6 aa, Staphylococcus
VLDSNP

SEQ ID NO: 1994319 - protein, 11 aa, Staphylococcus
VLDSSEEIEPM

SEQ ID NO: 1994320 - protein, 13 aa, Staphylococcus
VLDSSEEKEPIYG

SEQ ID NO: 1994321 - protein, 13 aa, Staphylococcus
VLDSSEESEPIYG

SEQ ID NO: 1994322 - protein, 11 aa, Staphylococcus
VLDSSEEVEPM

SEQ ID NO: 1994323 - protein, 13 aa, Staphylococcus
VLDTSDEEPEPIY

SEQ ID NO: 1994324 - protein, 4 aa, Staphylococcus
VLES

SEQ ID NO: 1994325 - protein, 9 aa, Staphylococcus
VLESEEKNI

SEQ ID NO: 1994326 - protein, 21 aa, Staphylococcus
VLESNEELEDSPEFVNESPYE

SEQ ID NO: 1994327 - protein, 17 aa, Staphylococcus
VLGDHERKDTVKNAEET

SEQ ID NO: 1994328 - protein, 17 aa, Staphylococcus
VLGNHERKDTVKNAEET

SEQ ID NO: 1994329 - protein, 15 aa, Staphylococcus
VLGQAQTGTGKTGAF

SEQ ID NO: 1994330 - protein, 7 aa, Staphylococcus
VLKGERG

SEQ ID NO: 1994331 - protein, 10 aa, Staphylococcus
VLNEQNGQSF

SEQ ID NO: 1994332 - protein, 4 aa, Staphylococcus
VLPK

SEQ ID NO: 1994333 - protein, 18 aa, Staphylococcus
VLRDEGEAYANKLREAGV

SEQ ID NO: 1994334 - protein, 11 aa, Staphylococcus
VLSQEEAEKYL

SEQ ID NO: 1994335 - protein, 4 aa, Staphylococcus
VLST

SEQ ID NO: 1994336 - protein, 24 aa, Staphylococcus
VLSTKAVAGTIKRSNDIDEDEKNI

SEQ ID NO: 1994337 - protein, 12 aa, Staphylococcus
VLTDDEKKTQAY

SEQ ID NO: 1994338 - protein, 10 aa, Staphylococcus
VLTETAEERL

SEQ ID NO: 1994339 - protein, 5 aa, Staphylococcus
VLTQE

SEQ ID NO: 1994340 - protein, 9 aa, Staphylococcus
VLTQEGSTI

SEQ ID NO: 1994341 - protein, 8 aa, Staphylococcus
VLTSESNV

SEQ ID NO: 1994342 - protein, 8 aa, Staphylococcus
VMNETDNP

SEQ ID NO: 1994343 - protein, 6 aa, Staphylococcus
VMPEAD

SEQ ID NO: 1994344 - protein, 17 aa, Staphylococcus
VMQGETSNIAAQREIKE

SEQ ID NO: 1994345 - protein, 24 aa, Staphylococcus
VMSQASKSYEELNSKRYTRNKEKY

SEQ ID NO: 1994346 - protein, 10 aa, Staphylococcus
VNADEYEAVG

SEQ ID NO: 1994347 - protein, 8 aa, Staphylococcus
VNAEHSEA

SEQ ID NO: 1994348 - protein, 8 aa, Staphylococcus
VNAEHSED

SEQ ID NO: 1994349 - protein, 8 aa, Staphylococcus
VNAEHSES

SEQ ID NO: 1994350 - protein, 5 aa, Staphylococcus
VNAET

SEQ ID NO: 1994351 - protein, 5 aa, Staphylococcus
VNAKD

SEQ ID NO: 1994352 - protein, 17 aa, Staphylococcus
VNAKNPEGHDVLIWSPK

SEQ ID NO: 1994353 - protein, 5 aa, Staphylococcus
VNANN

SEQ ID NO: 1994354 - protein, 7 aa, Staphylococcus
VNANNTI

SEQ ID NO: 1994355 - protein, 10 aa, Staphylococcus
VNAPKRTNLP

SEQ ID NO: 1994356 - protein, 17 aa, Staphylococcus
VNAPPQKYYSTTCVKLA

SEQ ID NO: 1994357 - protein, 8 aa, Staphylococcus
VNAQTTQL

SEQ ID NO: 1994358 - protein, 16 aa, Staphylococcus
VNASTGKYTGRSPKDK

SEQ ID NO: 1994359 - protein, 16 aa, Staphylococcus
VNATEATMLKQFEGRE

SEQ ID NO: 1994360 - protein, 7 aa, Staphylococcus
VNATEEM

SEQ ID NO: 1994361 - protein, 4 aa, Staphylococcus
VNAY

SEQ ID NO: 1994362 - protein, 8 aa, Staphylococcus
VNAYGKDI

SEQ ID NO: 1994363 - protein, 10 aa, Staphylococcus
VNDANDKDLS

SEQ ID NO: 1994364 - protein, 8 aa, Staphylococcus
VNDANPEV

SEQ ID NO: 1994365 - protein, 6 aa, Staphylococcus
VNDAPF

SEQ ID NO: 1994366 - protein, 16 aa, Staphylococcus
VNDDSDTITITTKDRN

SEQ ID NO: 1994367 - protein, 8 aa, Staphylococcus
VNDDYQSE

SEQ ID NO: 1994368 - protein, 4 aa, Staphylococcus
VNDE

SEQ ID NO: 1994369 - protein, 8 aa, Staphylococcus
VNDEASYQ

SEQ ID NO: 1994370 - protein, 6 aa, Staphylococcus
VNDERA

SEQ ID NO: 1994371 - protein, 5 aa, Staphylococcus
VNDGD

SEQ ID NO: 1994372 - protein, 17 aa, Staphylococcus
VNDGSTRIKGKTLDYRK

SEQ ID NO: 1994373 - protein, 18 aa, Staphylococcus
VNDGSTRVKGKTLEYRDN

SEQ ID NO: 1994374 - protein, 5 aa, Staphylococcus
VNDGY

SEQ ID NO: 1994375 - protein, 11 aa, Staphylococcus
VNDKNQVHTPT

SEQ ID NO: 1994376 - protein, 6 aa, Staphylococcus
VNDLEG

SEQ ID NO: 1994377 - protein, 5 aa, Staphylococcus
VNDLS

SEQ ID NO: 1994378 - protein, 4 aa, Staphylococcus
VNDN

SEQ ID NO: 1994379 - protein, 5 aa, Staphylococcus
VNDND

SEQ ID NO: 1994380 - protein, 6 aa, Staphylococcus
VNDNDT

SEQ ID NO: 1994381 - protein, 7 aa, Staphylococcus
VNDNDVP

SEQ ID NO: 1994382 - protein, 6 aa, Staphylococcus
VNDNEI

SEQ ID NO: 1994383 - protein, 6 aa, Staphylococcus
VNDNEL

SEQ ID NO: 1994384 - protein, 10 aa, Staphylococcus
VNDNKRKYTF

SEQ ID NO: 1994385 - protein, 7 aa, Staphylococcus
VNDNQLD

SEQ ID NO: 1994386 - protein, 6 aa, Staphylococcus
VNDPDV

SEQ ID NO: 1994387 - protein, 11 aa, Staphylococcus
VNDPTIEESTD

SEQ ID NO: 1994388 - protein, 11 aa, Staphylococcus
VNDQDLDTDTY

SEQ ID NO: 1994389 - protein, 4 aa, Staphylococcus
VNDR

SEQ ID NO: 1994390 - protein, 11 aa, Staphylococcus
VNDTNKNMQSY

SEQ ID NO: 1994391 - protein, 14 aa, Staphylococcus
VNDTPQTFAQFLSQ

SEQ ID NO: 1994392 - protein, 19 aa, Staphylococcus
VNDTTSTDEHNDDQLSEDN

SEQ ID NO: 1994393 - protein, 11 aa, Staphylococcus
VNEALSSNNDD

SEQ ID NO: 1994394 - protein, 6 aa, Staphylococcus
VNEDDN

SEQ ID NO: 1994395 - protein, 7 aa, Staphylococcus
VNEDQNY

SEQ ID NO: 1994396 - protein, 6 aa, Staphylococcus
VNEDSV

SEQ ID NO: 1994397 - protein, 4 aa, Staphylococcus
VNEE

SEQ ID NO: 1994398 - protein, 7 aa, Staphylococcus
VNEEDQI

SEQ ID NO: 1994399 - protein, 6 aa, Staphylococcus
VNEEDT

SEQ ID NO: 1994400 - protein, 7 aa, Staphylococcus
VNEEESY

SEQ ID NO: 1994401 - protein, 5 aa, Staphylococcus
VNEEF

SEQ ID NO: 1994402 - protein, 6 aa, Staphylococcus
VNEETE

SEQ ID NO: 1994403 - protein, 16 aa, Staphylococcus
VNEETPQITLNGGSTP

SEQ ID NO: 1994404 - protein, 16 aa, Staphylococcus
VNEETPQLTLNEGNTP

SEQ ID NO: 1994405 - protein, 7 aa, Staphylococcus
VNEGDAF

SEQ ID NO: 1994406 - protein, 17 aa, Staphylococcus
VNEGDARSFKKRAEDLE

SEQ ID NO: 1994407 - protein, 9 aa, Staphylococcus
VNEGKSTQM

SEQ ID NO: 1994408 - protein, 4 aa, Staphylococcus
VNEH

SEQ ID NO: 1994409 - protein, 10 aa, Staphylococcus
VNEKDGAFYG

SEQ ID NO: 1994410 - protein, 5 aa, Staphylococcus
VNEKE

SEQ ID NO: 1994411 - protein, 9 aa, Staphylococcus
VNEKNQVPN

SEQ ID NO: 1994412 - protein, 17 aa, Staphylococcus
VNEKRGIKAEKQDAPEI

SEQ ID NO: 1994413 - protein, 17 aa, Staphylococcus
VNEKRGIKEEEPDAPEV

SEQ ID NO: 1994414 - protein, 17 aa, Staphylococcus
VNEKRGIKEETPDAPEV

SEQ ID NO: 1994415 - protein, 16 aa, Staphylococcus
VNEKRGIKEETPDVPD

SEQ ID NO: 1994416 - protein, 16 aa, Staphylococcus
VNEKRGIKEETTTPEI

SEQ ID NO: 1994417 - protein, 16 aa, Staphylococcus
VNEKRGITEETPDTPE

SEQ ID NO: 1994418 - protein, 17 aa, Staphylococcus
VNEKRGITEEVPDAPDV

SEQ ID NO: 1994419 - protein, 11 aa, Staphylococcus
VNENKKKYGFE

SEQ ID NO: 1994420 - protein, 5 aa, Staphylococcus
VNENP

SEQ ID NO: 1994421 - protein, 8 aa, Staphylococcus
VNENSEAI

SEQ ID NO: 1994422 - protein, 15 aa, Staphylococcus
VNENTPNVTLNEGQT

SEQ ID NO: 1994423 - protein, 7 aa, Staphylococcus
VNEQQAK

SEQ ID NO: 1994424 - protein, 5 aa, Staphylococcus
VNERE

SEQ ID NO: 1994425 - protein, 15 aa, Staphylococcus
VNETENEMLKQFKGR

SEQ ID NO: 1994426 - protein, 5 aa, Staphylococcus
VNETR

SEQ ID NO: 1994427 - protein, 10 aa, Staphylococcus
VNETYDTAHP

SEQ ID NO: 1994428 - protein, 15 aa, Staphylococcus
VNGDANGSIPTSEPL

SEQ ID NO: 1994429 - protein, 6 aa, Staphylococcus
VNGDGR

SEQ ID NO: 1994430 - protein, 8 aa, Staphylococcus
VNGDNEHP

SEQ ID NO: 1994431 - protein, 7 aa, Staphylococcus
VNGEERH

SEQ ID NO: 1994432 - protein, 11 aa, Staphylococcus
VNGEIGTSYDD

SEQ ID NO: 1994433 - protein, 10 aa, Staphylococcus
VNGGEHETAT

SEQ ID NO: 1994434 - protein, 7 aa, Staphylococcus
VNGGEQS

SEQ ID NO: 1994435 - protein, 8 aa, Staphylococcus
VNGGFTEG

SEQ ID NO: 1994436 - protein, 9 aa, Staphylococcus
VNGGFTEGT

SEQ ID NO: 1994437 - protein, 8 aa, Staphylococcus
VNGGGCTG

SEQ ID NO: 1994438 - protein, 18 aa, Staphylococcus
VNGKEVKSFDEPDASKLP

SEQ ID NO: 1994439 - protein, 18 aa, Staphylococcus
VNGKEVKSFEEPDASKLP

SEQ ID NO: 1994440 - protein, 19 aa, Staphylococcus
VNGKEVKSFEEPDASKLPW

SEQ ID NO: 1994441 - protein, 19 aa, Staphylococcus
VNGKEVKSYEEPDASKLPW

SEQ ID NO: 1994442 - protein, 7 aa, Staphylococcus
VNGKGYT

SEQ ID NO: 1994443 - protein, 16 aa, Staphylococcus
VNGNQNVKPETRDKVN

SEQ ID NO: 1994444 - protein, 15 aa, Staphylococcus
VNGNQNVKPETRKKV

SEQ ID NO: 1994445 - protein, 16 aa, Staphylococcus
VNGNQNVKPETRKKVN

SEQ ID NO: 1994446 - protein, 6 aa, Staphylococcus
VNGNQV

SEQ ID NO: 1994447 - protein, 18 aa, Staphylococcus
VNGPNFIKPDDPKAKSLI

SEQ ID NO: 1994448 - protein, 8 aa, Staphylococcus
VNGRGVPK

SEQ ID NO: 1994449 - protein, 5 aa, Staphylococcus
VNGRR

SEQ ID NO: 1994450 - protein, 8 aa, Staphylococcus
VNGSIDES

SEQ ID NO: 1994451 - protein, 17 aa, Staphylococcus
VNGTASLDAEKQDENMQ

SEQ ID NO: 1994452 - protein, 17 aa, Staphylococcus
VNGTASLDPETQDDNMQ

SEQ ID NO: 1994453 - protein, 17 aa, Staphylococcus
VNGTASLDSEKQDENMQ

SEQ ID NO: 1994454 - protein, 16 aa, Staphylococcus
VNGTASLESDNQDENM

SEQ ID NO: 1994455 - protein, 17 aa, Staphylococcus
VNGTASLNSEQQDENMQ

SEQ ID NO: 1994456 - protein, 17 aa, Staphylococcus
VNGTASVDSEKQDENMQ

SEQ ID NO: 1994457 - protein, 18 aa, Staphylococcus
VNGTNDSISQDDTQATFA

SEQ ID NO: 1994458 - protein, 4 aa, Staphylococcus
VNHD

SEQ ID NO: 1994459 - protein, 8 aa, Staphylococcus
VNHSKSNK

SEQ ID NO: 1994460 - protein, 17 aa, Staphylococcus
VNHTGVSGSLEGQGIGT

SEQ ID NO: 1994461 - protein, 10 aa, Staphylococcus
VNIDKTTANA

SEQ ID NO: 1994462 - protein, 5 aa, Staphylococcus
VNIPS

SEQ ID NO: 1994463 - protein, 4 aa, Staphylococcus
VNIS

SEQ ID NO: 1994464 - protein, 11 aa, Staphylococcus
VNKALKSINGT

SEQ ID NO: 1994465 - protein, 10 aa, Staphylococcus
VNKDDADLGF

SEQ ID NO: 1994466 - protein, 7 aa, Staphylococcus
VNKDELE

SEQ ID NO: 1994467 - protein, 8 aa, Staphylococcus
VNKDGELI

SEQ ID NO: 1994468 - protein, 10 aa, Staphylococcus
VNKDITPNNE

SEQ ID NO: 1994469 - protein, 8 aa, Staphylococcus
VNKDNGVT

SEQ ID NO: 1994470 - protein, 7 aa, Staphylococcus
VNKENGE

SEQ ID NO: 1994471 - protein, 6 aa, Staphylococcus
VNKESA

SEQ ID NO: 1994472 - protein, 5 aa, Staphylococcus
VNKET

SEQ ID NO: 1994473 - protein, 6 aa, Staphylococcus
VNKETQ

SEQ ID NO: 1994474 - protein, 25 aa, Staphylococcus
VNKGSEVDASVNKDERRSIQKNHSA

SEQ ID NO: 1994475 - protein, 8 aa, Staphylococcus
VNKGTTIR

SEQ ID NO: 1994476 - protein, 25 aa, Staphylococcus
VNKKEKTRNPANPFTTSTLQQEAAR

SEQ ID NO: 1994477 - protein, 25 aa, Staphylococcus
VNKKEKTRNPAQPFTTSTLQQEAAR

SEQ ID NO: 1994478 - protein, 25 aa, Staphylococcus
VNKKEKTRYPANPFTTSTLQQEAAR

SEQ ID NO: 1994479 - protein, 8 aa, Staphylococcus
VNKKPSVG

SEQ ID NO: 1994480 - protein, 4 aa, Staphylococcus
VNKN

SEQ ID NO: 1994481 - protein, 13 aa, Staphylococcus
VNKNPDQQVFSAK

SEQ ID NO: 1994482 - protein, 20 aa, Staphylococcus
VNKPGSASTPATRANSNGWK

SEQ ID NO: 1994483 - protein, 9 aa, Staphylococcus
VNKQGGQLE

SEQ ID NO: 1994484 - protein, 7 aa, Staphylococcus
VNKQNAN

SEQ ID NO: 1994485 - protein, 9 aa, Staphylococcus
VNKSENTLK

SEQ ID NO: 1994486 - protein, 24 aa, Staphylococcus
VNKSETPNKNIIGTSRAYKKLTDK

SEQ ID NO: 1994487 - protein, 6 aa, Staphylococcus
VNKSIE

SEQ ID NO: 1994488 - protein, 7 aa, Staphylococcus
VNKSSLV

SEQ ID NO: 1994489 - protein, 7 aa, Staphylococcus
VNLGPDA

SEQ ID NO: 1994490 - protein, 8 aa, Staphylococcus
VNLKDDEN

SEQ ID NO: 1994491 - protein, 6 aa, Staphylococcus
VNLKQD

SEQ ID NO: 1994492 - protein, 4 aa, Staphylococcus
VNLS

SEQ ID NO: 1994493 - protein, 6 aa, Staphylococcus
VNNDGS

SEQ ID NO: 1994494 - protein, 8 aa, Staphylococcus
VNNDSLDV

SEQ ID NO: 1994495 - protein, 7 aa, Staphylococcus
VNNEKDA

SEQ ID NO: 1994496 - protein, 8 aa, Staphylococcus
VNNENIDE

SEQ ID NO: 1994497 - protein, 8 aa, Staphylococcus
VNNEQKKI

SEQ ID NO: 1994498 - protein, 6 aa, Staphylococcus
VNNEQT

SEQ ID NO: 1994499 - protein, 7 aa, Staphylococcus
VNNGDAV

SEQ ID NO: 1994500 - protein, 10 aa, Staphylococcus
VNNGPDSVGT

SEQ ID NO: 1994501 - protein, 7 aa, Staphylococcus
VNNKTEI

SEQ ID NO: 1994502 - protein, 8 aa, Staphylococcus
VNNMGDDM

SEQ ID NO: 1994503 - protein, 6 aa, Staphylococcus
VNNNER

SEQ ID NO: 1994504 - protein, 8 aa, Staphylococcus
VNNNLGRD

SEQ ID NO: 1994505 - protein, 16 aa, Staphylococcus
VNNPLNTELLKILTKV

SEQ ID NO: 1994506 - protein, 11 aa, Staphylococcus
VNNRKEQGNFK

SEQ ID NO: 1994507 - protein, 10 aa, Staphylococcus
VNNTGTFGSV

SEQ ID NO: 1994508 - protein, 15 aa, Staphylococcus
VNPAKIKSKGIKSVR

SEQ ID NO: 1994509 - protein, 17 aa, Staphylococcus
VNPAKIKSKGIKSVRSR

SEQ ID NO: 1994510 - protein, 7 aa, Staphylococcus
VNPDEVS

SEQ ID NO: 1994511 - protein, 8 aa, Staphylococcus
VNPDEVSV

SEQ ID NO: 1994512 - protein, 7 aa, Staphylococcus
VNPDTLK

SEQ ID NO: 1994513 - protein, 4 aa, Staphylococcus [sequence omitted]

SEQ ID NO: 1994514 - protein, 7 aa, Staphylococcus
VNPERMK

SEQ ID NO: 1994515 - protein, 7 aa, Staphylococcus
VNPETQY

SEQ ID NO: 1994516 - protein, 11 aa, Staphylococcus
VNPFPSRQQND

SEQ ID NO: 1994517 - protein, 29 aa, Staphylococcus
VNPGGSMSGGGMRQSKSILAQKDELTTMK

SEQ ID NO: 1994518 - protein, 28 aa, Staphylococcus
VNPGGSMTGGGARKTKSILSQKDELTTM

SEQ ID NO: 1994519 - protein, 27 aa, Staphylococcus
VNPGGSMTGGGDRKTKSILAQKDDLAK

SEQ ID NO: 1994520 - protein, 17 aa, Staphylococcus
VNPGGSMTGGGQRQTKS

SEQ ID NO: 1994521 - protein, 12 aa, Staphylococcus
VNPLENHDKNDA

SEQ ID NO: 1994522 - protein, 6 aa, Staphylococcus
VNPNYD

SEQ ID NO: 1994523 - protein, 12 aa, Staphylococcus
VNPPKQRNDNKL

SEQ ID NO: 1994524 - protein, 7 aa, Staphylococcus
VNPPKSW

SEQ ID NO: 1994525 - protein, 5 aa, Staphylococcus
VNPPQ

SEQ ID NO: 1994526 - protein, 8 aa, Staphylococcus
VNPQASQE

SEQ ID NO: 1994527 - protein, 6 aa, Staphylococcus
VNPRGV

SEQ ID NO: 1994528 - protein, 6 aa, Staphylococcus
VNPSGV

SEQ ID NO: 1994529 - protein, 18 aa, Staphylococcus
VNPSKSLSKQKLSEVTGF

SEQ ID NO: 1994530 - protein, 7 aa, Staphylococcus
VNPTQSH

SEQ ID NO: 1994531 - protein, 8 aa, Staphylococcus
VNPTSDGE

SEQ ID NO: 1994532 - protein, 15 aa, Staphylococcus
VNPVDGKTRIRPING

SEQ ID NO: 1994533 - protein, 15 aa, Staphylococcus
VNPVDTKIRKTPVEH

SEQ ID NO: 1994534 - protein, 18 aa, Staphylococcus
VNPVDTKIRQTPIQNPPR

SEQ ID NO: 1994535 - protein, 19 aa, Staphylococcus
VNPVDTKQRLTEVKSSPRI

SEQ ID NO: 1994536 - protein, 14 aa, Staphylococcus
VNPVDTKQRQLPVS

SEQ ID NO: 1994537 - protein, 8 aa, Staphylococcus
VNQAGSLV

SEQ ID NO: 1994538 - protein, 10 aa, Staphylococcus
VNQAGSLVES

SEQ ID NO: 1994539 - protein, 6 aa, Staphylococcus
VNQAKG

SEQ ID NO: 1994540 - protein, 7 aa, Staphylococcus
VNQAKGY

SEQ ID NO: 1994541 - protein, 8 aa, Staphylococcus
VNQEIRQP

SEQ ID NO: 1994542 - protein, 7 aa, Staphylococcus
VNQENQV

SEQ ID NO: 1994543 - protein, 5 aa, Staphylococcus
VNQFD

SEQ ID NO: 1994544 - protein, 9 aa, Staphylococcus
VNQGHQEEA

SEQ ID NO: 1994545 - protein, 17 aa, Staphylococcus
VNQGKETADELKRFLEQ

SEQ ID NO: 1994546 - protein, 7 aa, Staphylococcus
VNQKELS

SEQ ID NO: 1994547 - protein, 8 aa, Staphylococcus
VNQMRSGS

SEQ ID NO: 1994548 - protein, 23 aa, Staphylococcus
VNQNPNKQDIEASQVYQTRKARI

SEQ ID NO: 1994549 - protein, 7 aa, Staphylococcus
VNQPEND

SEQ ID NO: 1994550 - protein, 7 aa, Staphylococcus
VNQPIDE

SEQ ID NO: 1994551 - protein, 26 aa, Staphylococcus
VNQPKKENQSNKRNYKQKQLASREMT

SEQ ID NO: 1994552 - protein, 10 aa, Staphylococcus
VNQPQEELYK

SEQ ID NO: 1994553 - protein, 6 aa, Staphylococcus
VNQPVN

SEQ ID NO: 1994554 - protein, 7 aa, Staphylococcus
VNQQALP

SEQ ID NO: 1994555 - protein, 8 aa, Staphylococcus
VNQQIRQP

SEQ ID NO: 1994556 - protein, 8 aa, Staphylococcus
VNQSDEEF

SEQ ID NO: 1994557 - protein, 12 aa, Staphylococcus
VNQTKEELNHRK

SEQ ID NO: 1994558 - protein, 7 aa, Staphylococcus
VNRDGQV

SEQ ID NO: 1994559 - protein, 22 aa, Staphylococcus
VNRKKDLNSKQSLTSKVKQGPT

SEQ ID NO: 1994560 - protein, 30 aa, Staphylococcus
VNRKPISASEEDLAENNRARSAKLRVAEIL

SEQ ID NO: 1994561 - protein, 30 aa, Staphylococcus; identical to SEQ ID NO: 1792357

SEQ ID NO: 1994562 - protein, 30 aa, Staphylococcus
VNRKPITATEEDLNQNNRARSAKLRVAEIL

SEQ ID NO: 1994563 - protein, 8 aa, Staphylococcus
VNRPERKH

SEQ ID NO: 1994564 - protein, 10 aa, Staphylococcus
VNRPQRENVP

SEQ ID NO: 1994565 - protein, 4 aa, Staphylococcus
VNRS

SEQ ID NO: 1994566 - protein, 5 aa, Staphylococcus
VNRSG

SEQ ID NO: 1994567 - protein, 7 aa, Staphylococcus
VNSDAQS

SEQ ID NO: 1994568 - protein, 7 aa, Staphylococcus
VNSDEDV

SEQ ID NO: 1994569 - protein, 12 aa, Staphylococcus
VNSDKSHASNYR

SEQ ID NO: 1994570 - protein, 5 aa, Staphylococcus
VNSDT

SEQ ID NO: 1994571 - protein, 14 aa, Staphylococcus
VNSDTPKLTLNEGH

SEQ ID NO: 1994572 - protein, 9 aa, Staphylococcus
VNSEDEAKQ

SEQ ID NO: 1994573 - protein, 13 aa, Staphylococcus
VNSEDSHAKNYQI

SEQ ID NO: 1994574 - protein, 12 aa, Staphylococcus
VNSEDSHAKNYR

SEQ ID NO: 1994575 - protein, 12 aa, Staphylococcus
VNSEKSHAQNYR

SEQ ID NO: 1994576 - protein, 9 aa, Staphylococcus
VNSETGEIV

SEQ ID NO: 1994577 - protein, 5 aa, Staphylococcus
VNSEV

SEQ ID NO: 1994578 - protein, 4 aa, Staphylococcus
VNSG

SEQ ID NO: 1994579 - protein, 7 aa, Staphylococcus
VNSGETL

SEQ ID NO: 1994580 - protein, 6 aa, Staphylococcus
VNSHTK

SEQ ID NO: 1994581 - protein, 7 aa, Staphylococcus
VNSHTNA

SEQ ID NO: 1994582 - protein, 12 aa, Staphylococcus
VNSKEELENQIN

SEQ ID NO: 1994583 - protein, 14 aa, Staphylococcus
VNSKELKDAYEKQF

SEQ ID NO: 1994584 - protein, 7 aa, Staphylococcus
VNSKGLT

SEQ ID NO: 1994585 - protein, 9 aa, Staphylococcus
VNSKKSHAM

SEQ ID NO: 1994586 - protein, 8 aa, Staphylococcus
VNSKQSHA

SEQ ID NO: 1994587 - protein, 5 aa, Staphylococcus
VNSLS

SEQ ID NO: 1994588 - protein, 4 aa, Staphylococcus
VNSN

SEQ ID NO: 1994589 - protein, 6 aa, Staphylococcus
VNSNGH

SEQ ID NO: 1994590 - protein, 8 aa, Staphylococcus
VNSNLGRN

SEQ ID NO: 1994591 - protein, 9 aa, Staphylococcus
VNSPKGAAA

SEQ ID NO: 1994592 - protein, 7 aa, Staphylococcus
VNSPNKL

SEQ ID NO: 1994593 - protein, 5 aa, Staphylococcus
VNSRR

SEQ ID NO: 1994594 - protein, 9 aa, Staphylococcus
VNSSDEQEL

SEQ ID NO: 1994595 - protein, 8 aa, Staphylococcus
VNSTNGSL

SEQ ID NO: 1994596 - protein, 7 aa, Staphylococcus
VNSTQSN

SEQ ID NO: 1994597 - protein, 9 aa, Staphylococcus
VNSYGKDIE

SEQ ID NO: 1994598 - protein, 10 aa, Staphylococcus
VNSYGKDIEG

SEQ ID NO: 1994599 - protein, 7 aa, Staphylococcus
VNTASQS

SEQ ID NO: 1994600 - protein, 11 aa, Staphylococcus
VNTEDAKLTKA

SEQ ID NO: 1994601 - protein, 9 aa, Staphylococcus
VNTETGEIV

SEQ ID NO: 1994602 - protein, 9 aa, Staphylococcus
VNTGDEDVE

SEQ ID NO: 1994603 - protein, 8 aa, Staphylococcus
VNTGTKEF

SEQ ID NO: 1994604 - protein, 11 aa, Staphylococcus
VNTKNQDATEI

SEQ ID NO: 1994605 - protein, 11 aa, Staphylococcus
VNTKNQDAVEE

SEQ ID NO: 1994606 - protein, 4 aa, Staphylococcus
VNTL

SEQ ID NO: 1994607 - protein, 8 aa, Staphylococcus
VNTLGDDV

SEQ ID NO: 1994608 - protein, 4 aa, Staphylococcus
VNTN

SEQ ID NO: 1994609 - protein, 8 aa, Staphylococcus
VNTNDHST

SEQ ID NO: 1994610 - protein, 8 aa, Staphylococcus
VNTNLGRD

SEQ ID NO: 1994611 - protein, 9 aa, Staphylococcus
VNTNPKPWD

SEQ ID NO: 1994612 - protein, 8 aa, Staphylococcus
VNTNPVDQ

SEQ ID NO: 1994613 - protein, 5 aa, Staphylococcus
VNTPL

SEQ ID NO: 1994614 - protein, 6 aa, Staphylococcus
VNTPQG

SEQ ID NO: 1994615 - protein, 7 aa, Staphylococcus
VNTRTDL

SEQ ID NO: 1994616 - protein, 8 aa, Staphylococcus
VNTSEELK

SEQ ID NO: 1994617 - protein, 9 aa, Staphylococcus
VNTSGHSVK

SEQ ID NO: 1994618 - protein, 7 aa, Staphylococcus
VNTVTDT

SEQ ID NO: 1994619 - protein, 8 aa, Staphylococcus
VNVKSKEI

SEQ ID NO: 1994620 - protein, 7 aa, Staphylococcus
VNVPRTE

SEQ ID NO: 1994621 - protein, 8 aa, Staphylococcus
VNVSRQTV

SEQ ID NO: 1994622 - protein, 4 aa, Staphylococcus
VNYD

SEQ ID NO: 1994623 - protein, 8 aa, Staphylococcus
VNYDDPST

SEQ ID NO: 1994624 - protein, 7 aa, Staphylococcus
VNYDDTK

SEQ ID NO: 1994625 - protein, 8 aa, Staphylococcus
VNYENAGT

SEQ ID NO: 1994626 - protein, 12 aa, Staphylococcus
VNYTEASSNDSI

SEQ ID NO: 1994627 - protein, 14 aa, Staphylococcus
VPADDENGAPKPRL

SEQ ID NO: 1994628 - protein, 6 aa, Staphylococcus
VPAETY

SEQ ID NO: 1994629 - protein, 14 aa, Staphylococcus
VPAFKAGKALKDAV

SEQ ID NO: 1994630 - protein, 7 aa, Staphylococcus
VPAGAEA

SEQ ID NO: 1994631 - protein, 14 aa, Staphylococcus
VPAKTIKKRFDDET

SEQ ID NO: 1994632 - protein, 12 aa, Staphylococcus
VPALDKNKNHTI

SEQ ID NO: 1994633 - protein, 7 aa, Staphylococcus
VPAPATA

SEQ ID NO: 1994634 - protein, 8 aa, Staphylococcus
VPAPATAE

SEQ ID NO: 1994635 - protein, 9 aa, Staphylococcus
VPAPTRAER

SEQ ID NO: 1994636 - protein, 4 aa, Staphylococcus
VPAS

SEQ ID NO: 1994637 - protein, 8 aa, Staphylococcus
VPASELTN

SEQ ID NO: 1994638 - protein, 24 aa, Staphylococcus
VPASSVKKNTTTTTNKKGSKEPTV

SEQ ID NO: 1994639 - protein, 10 aa, Staphylococcus
VPATDETVKT

SEQ ID NO: 1994640 - protein, 28 aa, Staphylococcus
VPATTDKESIEKKYEAGEGKLSTDVASY

SEQ ID NO: 1994641 - protein, 13 aa, Staphylococcus
VPDDLDPAAASSI

SEQ ID NO: 1994642 - protein, 7 aa, Staphylococcus
VPDLPPV

SEQ ID NO: 1994643 - protein, 8 aa, Staphylococcus
VPDNDLGN

SEQ ID NO: 1994644 - protein, 9 aa, Staphylococcus
VPDQKATFE

SEQ ID NO: 1994645 - protein, 9 aa, Staphylococcus
VPDQPSFKS

SEQ ID NO: 1994646 - protein, 4 aa, Staphylococcus
VPDS

SEQ ID NO: 1994647 - protein, 8 aa, Staphylococcus
VPDSTDGR

SEQ ID NO: 1994648 - protein, 4 aa, Staphylococcus
VPDV

SEQ ID NO: 1994649 - protein, 4 aa, Staphylococcus
VPDY

SEQ ID NO: 1994650 - protein, 21 aa, Staphylococcus
VPEAEPLKSIDDATKIIMRGD

SEQ ID NO: 1994651 - protein, 5 aa, Staphylococcus
VPEAP

SEQ ID NO: 1994652 - protein, 6 aa, Staphylococcus
VPEDAA

SEQ ID NO: 1994653 - protein, 10 aa, Staphylococcus
VPEDVRNERG

SEQ ID NO: 1994654 - protein, 10 aa, Staphylococcus
VPEEAESSEA

SEQ ID NO: 1994655 - protein, 10 aa, Staphylococcus
VPEEVRNERG

SEQ ID NO: 1994656 - protein, 4 aa, Staphylococcus
VPEG

SEQ ID NO: 1994657 - protein, 11 aa, Staphylococcus
VPEGATDEDNI

SEQ ID NO: 1994658 - protein, 11 aa, Staphylococcus
VPEGVDNEQQI

SEQ ID NO: 1994659 - protein, 12 aa, Staphylococcus
VPEGVDNEQQIR

SEQ ID NO: 1994660 - protein, 10 aa, Staphylococcus
VPEGVDTEQQ

SEQ ID NO: 1994661 - protein, 8 aa, Staphylococcus
VPEKELEE

SEQ ID NO: 1994662 - protein, 8 aa, Staphylococcus
VPEKELQE

SEQ ID NO: 1994663 - protein, 6 aa, Staphylococcus
VPELGP

SEQ ID NO: 1994664 - protein, 11 aa, Staphylococcus
VPELSRQSKGI

SEQ ID NO: 1994665 - protein, 12 aa, Staphylococcus
VPELSRQSKGIP

SEQ ID NO: 1994666 - protein, 4 aa, Staphylococcus
VPEN

SEQ ID NO: 1994667 - protein, 5 aa, Staphylococcus
VPENA

SEQ ID NO: 1994668 - protein, 7 aa, Staphylococcus
VPENDGA

SEQ ID NO: 1994669 - protein, 7 aa, Staphylococcus
VPENETA

SEQ ID NO: 1994670 - protein, 5 aa, Staphylococcus
VPESL

SEQ ID NO: 1994671 - protein, 6 aa, Staphylococcus
VPESQI

SEQ ID NO: 1994672 - protein, 5 aa, Staphylococcus
VPESV

SEQ ID NO: 1994673 - protein, 8 aa, Staphylococcus
VPESYESS

SEQ ID NO: 1994674 - protein, 10 aa, Staphylococcus
VPETDYKNKR

SEQ ID NO: 1994675 - protein, 13 aa, Staphylococcus
VPETLDPAAASSI

SEQ ID NO: 1994676 - protein, 9 aa, Staphylococcus
VPEYDTEKR

SEQ ID NO: 1994677 - protein, 8 aa, Staphylococcus
VPFQNDSS

SEQ ID NO: 1994678 - protein, 5 aa, Staphylococcus
VPGDK

SEQ ID NO: 1994679 - protein, 8 aa, Staphylococcus
VPGDKSMT

SEQ ID NO: 1994680 - protein, 5 aa, Staphylococcus
VPGEE

SEQ ID NO: 1994681 - protein, 9 aa, Staphylococcus
VPGKADEKN

SEQ ID NO: 1994682 - protein, 23 aa, Staphylococcus
VPGLPKKKQKQIAEQIASNQETE

SEQ ID NO: 1994683 - protein, 12 aa, Staphylococcus
VPGRHNDDSATI

SEQ ID NO: 1994684 - protein, 11 aa, Staphylococcus
VPGRHNDDTST

SEQ ID NO: 1994685 - protein, 15 aa, Staphylococcus
VPGRPGSMGKAIPGS

SEQ ID NO: 1994686 - protein, 13 aa, Staphylococcus
VPGTIDNDINGTD

SEQ ID NO: 1994687 - protein, 6 aa, Staphylococcus
VPGYER

SEQ ID NO: 1994688 - protein, 11 aa, Staphylococcus
VPHGDDTTHEI

SEQ ID NO: 1994689 - protein, 7 aa, Staphylococcus
VPHSEGY

SEQ ID NO: 1994690 - protein, 4 aa, Staphylococcus
VPHV

SEQ ID NO: 1994691 - protein, 11 aa, Staphylococcus
VPIGSTAGGIK

SEQ ID NO: 1994692 - protein, 5 aa, Staphylococcus
VPISD

SEQ ID NO: 1994693 - protein, 13 aa, Staphylococcus
VPKADTSKIKAGD

SEQ ID NO: 1994694 - protein, 13 aa, Staphylococcus
VPKDQTDKIKAGD

SEQ ID NO: 1994695 - protein, 6 aa, Staphylococcus
VPKENV

SEQ ID NO: 1994696 - protein, 13 aa, Staphylococcus
VPKEQTDKIKAGD

SEQ ID NO: 1994697 - protein, 9 aa, Staphylococcus
VPKEVREAR

SEQ ID NO: 1994698 - protein, 9 aa, Staphylococcus
VPKGASNKV

SEQ ID NO: 1994699 - protein, 6 aa, Staphylococcus
VPKIGA

SEQ ID NO: 1994700 - protein, 11 aa, Staphylococcus
VPKKEGSAERL

SEQ ID NO: 1994701 - protein, 6 aa, Staphylococcus
VPKLEE

SEQ ID NO: 1994702 - protein, 4 aa, Staphylococcus
VPKN

SEQ ID NO: 1994703 - protein, 6 aa, Staphylococcus
VPKQAV

SEQ ID NO: 1994704 - protein, 4 aa, Staphylococcus
VPKS

SEQ ID NO: 1994705 - protein, 13 aa, Staphylococcus
VPKSETDKVKAGD

SEQ ID NO: 1994706 - protein, 5 aa, Staphylococcus
VPKSI

SEQ ID NO: 1994707 - protein, 15 aa, Staphylococcus
VPKSIADDIIKKNKG

SEQ ID NO: 1994708 - protein, 15 aa, Staphylococcus
VPKSIADEIIKKNKG

SEQ ID NO: 1994709 - protein, 15 aa, Staphylococcus
VPKSIAEEIIKKNKG

SEQ ID NO: 1994710 - protein, 6 aa, Staphylococcus
VPKSKL

SEQ ID NO: 1994711 - protein, 9 aa, Staphylococcus
VPKSKLDHM

SEQ ID NO: 1994712 - protein, 6 aa, Staphylococcus
VPKTYQ

SEQ ID NO: 1994713 - protein, 7 aa, Staphylococcus
VPLPRPE

SEQ ID NO: 1994714 - protein, 8 aa, Staphylococcus
VPLSNDEL

SEQ ID NO: 1994715 - protein, 6 aa, Staphylococcus
VPLTDK

SEQ ID NO: 1994716 - protein, 14 aa, Staphylococcus
VPNDKAVDFMSLIK

SEQ ID NO: 1994717 - protein, 5 aa, Staphylococcus
VPNEE

SEQ ID NO: 1994718 - protein, 4 aa, Staphylococcus
VPNG

SEQ ID NO: 1994719 - protein, 5 aa, Staphylococcus
VPNLK

SEQ ID NO: 1994720 - protein, 9 aa, Staphylococcus
VPNQNPAKV

SEQ ID NO: 1994721 - protein, 9 aa, Staphylococcus
VPNQNPTKV

SEQ ID NO: 1994722 - protein, 10 aa, Staphylococcus
VPNQNSSKVS

SEQ ID NO: 1994723 - protein, 9 aa, Staphylococcus
VPNSDINRV

SEQ ID NO: 1994724 - protein, 7 aa, Staphylococcus
VPNSDKN

SEQ ID NO: 1994725 - protein, 10 aa, Staphylococcus
VPNSIPSDAY

SEQ ID NO: 1994726 - protein, 4 aa, Staphylococcus
VPPH

SEQ ID NO: 1994727 - protein, 6 aa, Staphylococcus
VPPKDG

SEQ ID NO: 1994728 - protein, 8 aa, Staphylococcus
VPPKGNAN

SEQ ID NO: 1994729 - protein, 12 aa, Staphylococcus
VPPNKCPNCESS

SEQ ID NO: 1994730 - protein, 12 aa, Staphylococcus
VPPPEGDPEAPL

SEQ ID NO: 1994731 - protein, 12 aa, Staphylococcus
VPPPEGDPSAPL

SEQ ID NO: 1994732 - protein, 12 aa, Staphylococcus
VPPPEGDPSEPL

SEQ ID NO: 1994733 - protein, 6 aa, Staphylococcus
VPPSND

SEQ ID NO: 1994734 - protein, 8 aa, Staphylococcus
VPPSNDID

SEQ ID NO: 1994735 - protein, 12 aa, Staphylococcus
VPQDAYTASKGA

SEQ ID NO: 1994736 - protein, 8 aa, Staphylococcus
VPQENAGA

SEQ ID NO: 1994737 - protein, 9 aa, Staphylococcus
VPQENSGAV

SEQ ID NO: 1994738 - protein, 12 aa, Staphylococcus
VPQGERDTETQA

SEQ ID NO: 1994739 - protein, 10 aa, Staphylococcus
VPQNDERINK

SEQ ID NO: 1994740 - protein, 15 aa, Staphylococcus
VPQPDPESERTRTRI

SEQ ID NO: 1994741 - protein, 12 aa, Staphylococcus
VPQPDPESERVR

SEQ ID NO: 1994742 - protein, 22 aa, Staphylococcus
VPQPKGKTATSPQEALNNAREI

SEQ ID NO: 1994743 - protein, 22 aa, Staphylococcus
VPQPNGKTATSPQEALENARSI

SEQ ID NO: 1994744 - protein, 21 aa, Staphylococcus
VPQPQGKTATSPKEALENARN

SEQ ID NO: 1994745 - protein, 21 aa, Staphylococcus
VPQPQGKTSTSPKEALENARE

SEQ ID NO: 1994746 - protein, 4 aa, Staphylococcus
VPQS

SEQ ID NO: 1994747 - protein, 10 aa, Staphylococcus
VPQSIPSDAY

SEQ ID NO: 1994748 - protein, 6 aa, Staphylococcus
VPQSKI

SEQ ID NO: 1994749 - protein, 8 aa, Staphylococcus
VPQSKKSK

SEQ ID NO: 1994750 - protein, 8 aa, Staphylococcus
VPQTGESC

SEQ ID NO: 1994751 - protein, 18 aa, Staphylococcus
VPRGTGRVRNMPTAAHTK

SEQ ID NO: 1994752 - protein, 19 aa, Staphylococcus
VPRGTGRVRNMPTAAHTKD

SEQ ID NO: 1994753 - protein, 10 aa, Staphylococcus
VPRKPGMSRD

SEQ ID NO: 1994754 - protein, 5 aa, Staphylococcus
VPRPK

SEQ ID NO: 1994755 - protein, 4 aa, Staphylococcus
VPSD

SEQ ID NO: 1994756 - protein, 5 aa, Staphylococcus
VPSDK

SEQ ID NO: 1994757 - protein, 8 aa, Staphylococcus
VPSDPENF

SEQ ID NO: 1994758 - protein, 19 aa, Staphylococcus
VPSDSGETLEVTNPANGEV

SEQ ID NO: 1994759 - protein, 8 aa, Staphylococcus
VPSEAEAL

SEQ ID NO: 1994760 - protein, 6 aa, Staphylococcus
VPSEKV

SEQ ID NO: 1994761 - protein, 9 aa, Staphylococcus
VPSENAGSV

SEQ ID NO: 1994762 - protein, 5 aa, Staphylococcus
VPSEQ

SEQ ID NO: 1994763 - protein, 19 aa, Staphylococcus
VPSESGETLEVTNPSNGEV

SEQ ID NO: 1994764 - protein, 10 aa, Staphylococcus
VPSGDQRDYE

SEQ ID NO: 1994765 - protein, 12 aa, Staphylococcus
VPSGKSNHEMEG

SEQ ID NO: 1994766 - protein, 5 aa, Staphylococcus
VPSGL

SEQ ID NO: 1994767 - protein, 13 aa, Staphylococcus
VPSHEGKIRPKEV

SEQ ID NO: 1994768 - protein, 15 aa, Staphylococcus
VPSLPKKKQKQIAEQ

SEQ ID NO: 1994769 - protein, 10 aa, Staphylococcus
VPSPVKRPQD

SEQ ID NO: 1994770 - protein, 9 aa, Staphylococcus
VPSRRKDIS

SEQ ID NO: 1994771 - protein, 6 aa, Staphylococcus
VPSSPS

SEQ ID NO: 1994772 - protein, 6 aa, Staphylococcus
VPSTAK

SEQ ID NO: 1994773 - protein, 9 aa, Staphylococcus
VPSYSPSSI

SEQ ID NO: 1994774 - protein, 16 aa, Staphylococcus
VPTAAGLASSASAYAA

SEQ ID NO: 1994775 - protein, 6 aa, Staphylococcus
VPTDDQ

SEQ ID NO: 1994776 - protein, 7 aa, Staphylococcus
VPTDEDL

SEQ ID NO: 1994777 - protein, 9 aa, Staphylococcus
VPTDIEEEA

SEQ ID NO: 1994778 - protein, 7 aa, Staphylococcus
VPTDLDE

SEQ ID NO: 1994779 - protein, 4 aa, Staphylococcus
VPTG

SEQ ID NO: 1994780 - protein, 10 aa, Staphylococcus
VPTREQGISP

SEQ ID NO: 1994781 - protein, 16 aa, Staphylococcus
VPTSNNRLYPKKPYDK

SEQ ID NO: 1994782 - protein, 5 aa, Staphylococcus
VPTTG

SEQ ID NO: 1994783 - protein, 8 aa, Staphylococcus
VPVGGGDH

SEQ ID NO: 1994784 - protein, 25 aa, Staphylococcus
VPVGSTSGKSSQEIYNENFHGGIFR

SEQ ID NO: 1994785 - protein, 7 aa, Staphylococcus
VPVKNKD

SEQ ID NO: 1994786 - protein, 11 aa, Staphylococcus
VPVQVDGKDYN

SEQ ID NO: 1994787 - protein, 10 aa, Staphylococcus
VPVTEDDGKY

SEQ ID NO: 1994788 - protein, 7 aa, Staphylococcus
VPYKSRH

SEQ ID NO: 1994789 - protein, 9 aa, Staphylococcus
VPYRSKNEG

SEQ ID NO: 1994790 - protein, 14 aa, Staphylococcus
VQAAQGHDGAKLGT

SEQ ID NO: 1994791 - protein, 18 aa, Staphylococcus
VQAENDNPYGNSKRQGEA

SEQ ID NO: 1994792 - protein, 15 aa, Staphylococcus
VQAGIAADGAKIGSG

SEQ ID NO: 1994793 - protein, 15 aa, Staphylococcus
VQAGIAGDGAKLGTS

SEQ ID NO: 1994794 - protein, 13 aa, Staphylococcus
VQAGQDKDWGKMG

SEQ ID NO: 1994795 - protein, 7 aa, Staphylococcus
VQAIENP

SEQ ID NO: 1994796 - protein, 5 aa, Staphylococcus
VQAPR

SEQ ID NO: 1994797 - protein, 13 aa, Staphylococcus
VQASREDTEEQLK

SEQ ID NO: 1994798 - protein, 12 aa, Staphylococcus
VQDAITDGETYQ

SEQ ID NO: 1994799 - protein, 9 aa, Staphylococcus
VQDDEYDNF

SEQ ID NO: 1994800 - protein, 7 aa, Staphylococcus
VQDEREL

SEQ ID NO: 1994801 - protein, 4 aa, Staphylococcus
VQDG

SEQ ID NO: 1994802 - protein, 7 aa, Staphylococcus
VQDHPGS

SEQ ID NO: 1994803 - protein, 7 aa, Staphylococcus
VQDSHSV

SEQ ID NO: 1994804 - protein, 11 aa, Staphylococcus
VQDSKQNEVPA

SEQ ID NO: 1994805 - protein, 4 aa, Staphylococcus
VQDT

SEQ ID NO: 1994806 - protein, 4 aa, Staphylococcus
VQDY

SEQ ID NO: 1994807 - protein, 4 aa, Staphylococcus
VQEA

SEQ ID NO: 1994808 - protein, 5 aa, Staphylococcus
VQEAG

SEQ ID NO: 1994809 - protein, 5 aa, Staphylococcus
VQEAK

SEQ ID NO: 1994810 - protein, 26 aa, Staphylococcus
VQEDLEDELEGTSDSETPGEGEATVS

SEQ ID NO: 1994811 - protein, 6 aa, Staphylococcus
VQEEGL

SEQ ID NO: 1994812 - protein, 9 aa, Staphylococcus
VQEESGGIT

SEQ ID NO: 1994813 - protein, 6 aa, Staphylococcus
VQEETG

SEQ ID NO: 1994814 - protein, 18 aa, Staphylococcus
VQEEVGLRGASAAAELID

SEQ ID NO: 1994815 - protein, 6 aa, Staphylococcus
VQEFDP

SEQ ID NO: 1994816 - protein, 5 aa, Staphylococcus
VQEGK

SEQ ID NO: 1994817 - protein, 8 aa, Staphylococcus
VQEGVSVT

SEQ ID NO: 1994818 - protein, 6 aa, Staphylococcus
VQEGYE

SEQ ID NO: 1994819 - protein, 7 aa, Staphylococcus
VQEIEPD

SEQ ID NO: 1994820 - protein, 6 aa, Staphylococcus
VQENDY

SEQ ID NO: 1994821 - protein, 11 aa, Staphylococcus
VQENKTYDMTK

SEQ ID NO: 1994822 - protein, 12 aa, Staphylococcus
VQENRGNSNTRS

SEQ ID NO: 1994823 - protein, 9 aa, Staphylococcus
VQEPDTGCV

SEQ ID NO: 1994824 - protein, 8 aa, Staphylococcus
VQEPKEGE

SEQ ID NO: 1994825 - protein, 157 aa, Staphylococcus
VQEPTSINEPSLKPDNQSKEEVKTQSSLQNTEDKSVKSQEGSKSLEPELKPSYTKEAPVDKTAHPNEQKSETESLEPRLTPEQPSNNKDEAEKEEEEKQEDISDTETLEESISEDEETQNEIDTHDKQENNENEVEDKSKQSADSEIKRPLRKGAKP

SEQ ID NO: 1994826 - protein, 7 aa, Staphylococcus
VQEREAL

SEQ ID NO: 1994827 - protein, 4 aa, Staphylococcus
VQFE

SEQ ID NO: 1994828 - protein, 5 aa, Staphylococcus
VQFPR

SEQ ID NO: 1994829 - protein, 10 aa, Staphylococcus
VQGAEQNERY

SEQ ID NO: 1994830 - protein, 10 aa, Staphylococcus
VQGGSDRNET

SEQ ID NO: 1994831 - protein, 5 aa, Staphylococcus
VQGNT

SEQ ID NO: 1994832 - protein, 9 aa, Staphylococcus
VQGPEARDY

SEQ ID NO: 1994833 - protein, 9 aa, Staphylococcus
VQGPKARDL

SEQ ID NO: 1994834 - protein, 7 aa, Staphylococcus
VQGSIDD

SEQ ID NO: 1994835 - protein, 8 aa, Staphylococcus
VQGSTEFE

SEQ ID NO: 1994836 - protein, 5 aa, Staphylococcus
VQGSV

SEQ ID NO: 1994837 - protein, 6 aa, Staphylococcus
VQGSVE

SEQ ID NO: 1994838 - protein, 4 aa, Staphylococcus
VQGT

SEQ ID NO: 1994839 - protein, 9 aa, Staphylococcus
VQGTESYNY

SEQ ID NO: 1994840 - protein, 10 aa, Staphylococcus
VQGTKDIDGE

SEQ ID NO: 1994841 - protein, 5 aa, Staphylococcus
VQGTT

SEQ ID NO: 1994842 - protein, 7 aa, Staphylococcus
VQHDYQD

SEQ ID NO: 1994843 - protein, 8 aa, Staphylococcus
VQHTEKGT

SEQ ID NO: 1994844 - protein, 6 aa, Staphylococcus
VQHTSY

SEQ ID NO: 1994845 - protein, 12 aa, Staphylococcus
VQIDTKEIERSY

SEQ ID NO: 1994846 - protein, 16 aa, Staphylococcus
VQIETTGTLTKGATVT

SEQ ID NO: 1994847 - protein, 10 aa, Staphylococcus
VQITEENSDT

SEQ ID NO: 1994848 - protein, 8 aa, Staphylococcus
VQKKNKER

SEQ ID NO: 1994849 - protein, 4 aa, Staphylococcus
VQKN

SEQ ID NO: 1994850 - protein, 9 aa, Staphylococcus
VQKNDDNLG

SEQ ID NO: 1994851 - protein, 7 aa, Staphylococcus
VQKNGGI

SEQ ID NO: 1994852 - protein, 7 aa, Staphylococcus
VQKQGGV

SEQ ID NO: 1994853 - protein, 5 aa, Staphylococcus
VQKSI

SEQ ID NO: 1994854 - protein, 8 aa, Staphylococcus
VQKSNDNE

SEQ ID NO: 1994855 - protein, 10 aa, Staphylococcus
VQLRETQKEL

SEQ ID NO: 1994856 - protein, 5 aa, Staphylococcus
VQNAQ

SEQ ID NO: 1994857 - protein, 8 aa, Staphylococcus
VQNDIKSG

SEQ ID NO: 1994858 - protein, 6 aa, Staphylococcus
VQNDKS

SEQ ID NO: 1994859 - protein, 9 aa, Staphylococcus
VQNEDKVPY

SEQ ID NO: 1994860 - protein, 8 aa, Staphylococcus
VQNEEEAK

SEQ ID NO: 1994861 - protein, 12 aa, Staphylococcus
VQNKNGYYTFDN

SEQ ID NO: 1994862 - protein, 6 aa, Staphylococcus
VQNNKN

SEQ ID NO: 1994863 - protein, 6 aa, Staphylococcus
VQNPSI

SEQ ID NO: 1994864 - protein, 29 aa, Staphylococcus
VQNQTDEQTNSDNVDNQTEVSNESHEPYN

SEQ ID NO: 1994865 - protein, 10 aa, Staphylococcus
VQNTGKDISV

SEQ ID NO: 1994866 - protein, 9 aa, Staphylococcus
VQNTSTPEV

SEQ ID NO: 1994867 - protein, 4 aa, Staphylococcus
VQNV

SEQ ID NO: 1994868 - protein, 11 aa, Staphylococcus
VQNYKKDTKNL

SEQ ID NO: 1994869 - protein, 6 aa, Staphylococcus
VQPAER

SEQ ID NO: 1994870 - protein, 10 aa, Staphylococcus
VQPARGTKKE

SEQ ID NO: 1994871 - protein, 12 aa, Staphylococcus
VQPDDFKEGKDS

SEQ ID NO: 1994872 - protein, 8 aa, Staphylococcus
VQPDETTL

SEQ ID NO: 1994873 - protein, 6 aa, Staphylococcus
VQPDKI

SEQ ID NO: 1994874 - protein, 8 aa, Staphylococcus
VQPDQLPG

SEQ ID NO: 1994875 - protein, 9 aa, Staphylococcus
VQPDQTATS

SEQ ID NO: 1994876 - protein, 6 aa, Staphylococcus
VQPDTL

SEQ ID NO: 1994877 - protein, 7 aa, Staphylococcus
VQPDTLK

SEQ ID NO: 1994878 - protein, 10 aa, Staphylococcus
VQPDVREQGL

SEQ ID NO: 1994879 - protein, 4 aa, Staphylococcus
VQPG

SEQ ID NO: 1994880 - protein, 7 aa, Staphylococcus
VQPGNVL

SEQ ID NO: 1994881 - protein, 9 aa, Staphylococcus
VQPHSGSQA

SEQ ID NO: 1994882 - protein, 4 aa, Staphylococcus
VQPK

SEQ ID NO: 1994883 - protein, 11 aa, Staphylococcus
VQPKLNKKNLN

SEQ ID NO: 1994884 - protein, 5 aa, Staphylococcus
VQPKQ

SEQ ID NO: 1994885 - protein, 5 aa, Staphylococcus
VQPQS

SEQ ID NO: 1994886 - protein, 5 aa, Staphylococcus
VQPQV

SEQ ID NO: 1994887 - protein, 7 aa, Staphylococcus
VQPSETH

SEQ ID NO: 1994888 - protein, 6 aa, Staphylococcus
VQPTIS

SEQ ID NO: 1994889 - protein, 6 aa, Staphylococcus
VQQGAR

SEQ ID NO: 1994890 - protein, 4 aa, Staphylococcus
VQQN

SEQ ID NO: 1994891 - protein, 9 aa, Staphylococcus
VQQNNGKGK

SEQ ID NO: 1994892 - protein, 10 aa, Staphylococcus
VQQPDGSIDI

SEQ ID NO: 1994893 - protein, 11 aa, Staphylococcus
VQQPGRSNQVN

SEQ ID NO: 1994894 - protein, 8 aa, Staphylococcus
VQQSGADQ

SEQ ID NO: 1994895 - protein, 6 aa, Staphylococcus
VQQSGV

SEQ ID NO: 1994896 - protein, 10 aa, Staphylococcus
VQQSQKDAGE

SEQ ID NO: 1994897 - protein, 9 aa, Staphylococcus
VQQVRQDDV

SEQ ID NO: 1994898 - protein, 17 aa, Staphylococcus
VQRASEDYKSAGGKGIN

SEQ ID NO: 1994899 - protein, 6 aa, Staphylococcus
VQRQQQ

SEQ ID NO: 1994900 - protein, 10 aa, Staphylococcus
VQRREKKSTY

SEQ ID NO: 1994901 - protein, 20 aa, Staphylococcus
VQRSSEDREVSEDNSNEAYD

SEQ ID NO: 1994902 - protein, 5 aa, Staphylococcus
VQRTM

SEQ ID NO: 1994903 - protein, 4 aa, Staphylococcus
VQSG

SEQ ID NO: 1994904 - protein, 6 aa, Staphylococcus
VQSGDY

SEQ ID NO: 1994905 - protein, 7 aa, Staphylococcus
VQSGSVT

SEQ ID NO: 1994906 - protein, 8 aa, Staphylococcus
VQSPDAQK

SEQ ID NO: 1994907 - protein, 10 aa, Staphylococcus
VQSQKRLRTY

SEQ ID NO: 1994908 - protein, 8 aa, Staphylococcus
VQSSPVEK

SEQ ID NO: 1994909 - protein, 6 aa, Staphylococcus
VQSTLQ

SEQ ID NO: 1994910 - protein, 21 aa, Staphylococcus
VQSVQRQNGYYDVETSQGTLQ

SEQ ID NO: 1994911 - protein, 12 aa, Staphylococcus
VQTAKNGRRIFD

SEQ ID NO: 1994912 - protein, 17 aa, Staphylococcus
VQTARRNLKSPNIKTRK

SEQ ID NO: 1994913 - protein, 4 aa, Staphylococcus
VQTE

SEQ ID NO: 1994914 - protein, 13 aa, Staphylococcus
VQTEDESTQEKIN

SEQ ID NO: 1994915 - protein, 6 aa, Staphylococcus
VQTETG

SEQ ID NO: 1994916 - protein, 4 aa, Staphylococcus
VQTF

SEQ ID NO: 1994917 - protein, 7 aa, Staphylococcus
VQTGDIE

SEQ ID NO: 1994918 - protein, 8 aa, Staphylococcus
VQTGKQQA

SEQ ID NO: 1994919 - protein, 4 aa, Staphylococcus
VQTN

SEQ ID NO: 1994920 - protein, 4 aa, Staphylococcus
VQTP

SEQ ID NO: 1994921 - protein, 10 aa, Staphylococcus
VQTPKNGELQ

SEQ ID NO: 1994922 - protein, 5 aa, Staphylococcus
VQTPL

SEQ ID NO: 1994923 - protein, 8 aa, Staphylococcus
VQTSSKQN

SEQ ID NO: 1994924 - protein, 10 aa, Staphylococcus
VQTTDKDQVV

SEQ ID NO: 1994925 - protein, 11 aa, Staphylococcus
VQTTEDYEKFS

SEQ ID NO: 1994926 - protein, 22 aa, Staphylococcus
VQTTSAVRTVSSVTTVDGPKLS

SEQ ID NO: 1994927 - protein, 10 aa, Staphylococcus
VQTTSDNVQL

SEQ ID NO: 1994928 - protein, 6 aa, Staphylococcus
VQTVGK

SEQ ID NO: 1994929 - protein, 4 aa, Staphylococcus
VQVK

SEQ ID NO: 1994930 - protein, 7 aa, Staphylococcus
VQYDTPD

SEQ ID NO: 1994931 - protein, 7 aa, Staphylococcus
VQYNEEE

SEQ ID NO: 1994932 - protein, 8 aa, Staphylococcus
VQYNGEEI

SEQ ID NO: 1994933 - protein, 7 aa, Staphylococcus
VQYNRED

SEQ ID NO: 1994934 - protein, 7 aa, Staphylococcus
VQYPQDS

SEQ ID NO: 1994935 - protein, 12 aa, Staphylococcus
VRDALNEDKGSE

SEQ ID NO: 1994936 - protein, 17 aa, Staphylococcus
VRDARHDKGEITSYSDD

SEQ ID NO: 1994937 - protein, 9 aa, Staphylococcus
VRDDHNGDH

SEQ ID NO: 1994938 - protein, 20 aa, Staphylococcus
VRDDSLASEDAPVGPGPRKA

SEQ ID NO: 1994939 - protein, 4 aa, Staphylococcus
VRDE

SEQ ID NO: 1994940 - protein, 8 aa, Staphylococcus
VRDEKGRT

SEQ ID NO: 1994941 - protein, 4 aa, Staphylococcus
VRDG

SEQ ID NO: 1994942 - protein, 7 aa, Staphylococcus
VRDNNGV

SEQ ID NO: 1994943 - protein, 6 aa, Staphylococcus
VRDNNQ

SEQ ID NO: 1994944 - protein, 4 aa, Staphylococcus
VRDY

SEQ ID NO: 1994945 - protein, 8 aa, Staphylococcus
VREATGAK

SEQ ID NO: 1994946 - protein, 8 aa, Staphylococcus
VREEDGNL

SEQ ID NO: 1994947 - protein, 7 aa, Staphylococcus
VREEGIS

SEQ ID NO: 1994948 - protein, 20 aa, Staphylococcus
VREEPNEKEIQPVDARFLVR

SEQ ID NO: 1994949 - protein, 11 aa, Staphylococcus
VREGDFPSEAY

SEQ ID NO: 1994950 - protein, 15 aa, Staphylococcus
VREGKEPVKPKEGLS

SEQ ID NO: 1994951 - protein, 16 aa, Staphylococcus
VREGKEPVKPNSDLSY

SEQ ID NO: 1994952 - protein, 8 aa, Staphylococcus
VREGNDST

SEQ ID NO: 1994953 - protein, 7 aa, Staphylococcus
VREKAGK

SEQ ID NO: 1994954 - protein, 5 aa, Staphylococcus
VREKG

SEQ ID NO: 1994955 - protein, 9 aa, Staphylococcus
VRERGEGER

SEQ ID NO: 1994956 - protein, 20 aa, Staphylococcus
VRESANEKEIKPVEDRFIIK

SEQ ID NO: 1994957 - protein, 6 aa, Staphylococcus
VRETNY

SEQ ID NO: 1994958 - protein, 14 aa, Staphylococcus
VREVEERTFSANEQ

SEQ ID NO: 1994959 - protein, 4 aa, Staphylococcus
VRGI

SEQ ID NO: 1994960 - protein, 10 aa, Staphylococcus
VRGNNVTPGY

SEQ ID NO: 1994961 - protein, 19 aa, Staphylococcus
VRGRGGPRCMSQPLYREEI

SEQ ID NO: 1994962 - protein, 11 aa, Staphylococcus
VRHGEKKSTIE

SEQ ID NO: 1994963 - protein, 12 aa, Staphylococcus
VRIEGGKNLTDA

SEQ ID NO: 1994964 - protein, 7 aa, Staphylococcus
VRIEGTK

SEQ ID NO: 1994965 - protein, 16 aa, Staphylococcus
VRKASGKKLAQENPVE

SEQ ID NO: 1994966 - protein, 17 aa, Staphylococcus
VRKASGKKLAQESPANA

SEQ ID NO: 1994967 - protein, 17 aa, Staphylococcus
VRKASGKRLAEESPAKA

SEQ ID NO: 1994968 - protein, 16 aa, Staphylococcus
VRKASGKRLAQESPVE

SEQ ID NO: 1994969 - protein, 15 aa, Staphylococcus
VRKDEQVKALEDNGI

SEQ ID NO: 1994970 - protein, 15 aa, Staphylococcus
VRKEEQESALKDQGV

SEQ ID NO: 1994971 - protein, 16 aa, Staphylococcus
VRKEEQVKELKDQDVD

SEQ ID NO: 1994972 - protein, 8 aa, Staphylococcus
VRKGKGKN

SEQ ID NO: 1994973 - protein, 10 aa, Staphylococcus
VRKNEQIETL

SEQ ID NO: 1994974 - protein, 14 aa, Staphylococcus
VRKQDNSADGLNPK

SEQ ID NO: 1994975 - protein, 18 aa, Staphylococcus
VRKQSGKQLAKESPASNA

SEQ ID NO: 1994976 - protein, 13 aa, Staphylococcus
VRKSDNGGPKRKY

SEQ ID NO: 1994977 - protein, 13 aa, Staphylococcus
VRLKEQDQTHLQH

SEQ ID NO: 1994978 - protein, 20 aa, Staphylococcus
VRLTEGDYETKEAMSRTAEE

SEQ ID NO: 1994979 - protein, 29 aa, Staphylococcus
VRNASKAQDLADKGVSVREGDFKKPETLK

SEQ ID NO: 1994980 - protein, 11 aa, Staphylococcus
VRNDNAQGEYY

SEQ ID NO: 1994981 - protein, 5 aa, Staphylococcus
VRNEQ

SEQ ID NO: 1994982 - protein, 17 aa, Staphylococcus
VRNNKGKLQLKSGSRWS

SEQ ID NO: 1994983 - protein, 7 aa, Staphylococcus
VRNREQV

SEQ ID NO: 1994984 - protein, 8 aa, Staphylococcus
VRNTPESW

SEQ ID NO: 1994985 - protein, 15 aa, Staphylococcus
VRNTSKKLASLIKED

SEQ ID NO: 1994986 - protein, 6 aa, Staphylococcus
VRNTTI

SEQ ID NO: 1994987 - protein, 4 aa, Staphylococcus
VRPD

SEQ ID NO: 1994988 - protein, 6 aa, Staphylococcus
VRPDKD

SEQ ID NO: 1994989 - protein, 5 aa, Staphylococcus
VRPDM

SEQ ID NO: 1994990 - protein, 10 aa, Staphylococcus
VRPNTDESAA

SEQ ID NO: 1994991 - protein, 9 aa, Staphylococcus
VRPPEPISQ

SEQ ID NO: 1994992 - protein, 9 aa, Staphylococcus
VRPPEPVSS

SEQ ID NO: 1994993 - protein, 10 aa, Staphylococcus
VRPRLGNSLK

SEQ ID NO: 1994994 - protein, 11 aa, Staphylococcus
VRPSLDQLSQR

SEQ ID NO: 1994995 - protein, 8 aa, Staphylococcus
VRPTENQI

SEQ ID NO: 1994996 - protein, 6 aa, Staphylococcus
VRPTVR

SEQ ID NO: 1994997 - protein, 8 aa, Staphylococcus
VRPYTDGE

SEQ ID NO: 1994998 - protein, 8 aa, Staphylococcus
VRPYTEGE

SEQ ID NO: 1994999 - protein, 7 aa, Staphylococcus
VRPYTEQ

SEQ ID NO: 1995000 - protein, 8 aa, Staphylococcus
VRPYTNNE

SEQ ID NO: 1995001 - protein, 20 aa, Staphylococcus
VRQANSNEKMTTLDNAERDL

SEQ ID NO: 1995002 - protein, 7 aa, Staphylococcus
VRQGKMD

SEQ ID NO: 1995003 - protein, 8 aa, Staphylococcus
VRQGNMDP

SEQ ID NO: 1995004 - protein, 8 aa, Staphylococcus
VRQGQRQT

SEQ ID NO: 1995005 - protein, 11 aa, Staphylococcus
VRQPDGSINIE

SEQ ID NO: 1995006 - protein, 10 aa, Staphylococcus
VRQPDGTIDI

SEQ ID NO: 1995007 - protein, 4 aa, Staphylococcus
VRQV

SEQ ID NO: 1995008 - protein, 44 aa, Staphylococcus
VRRAESAKERAESHLNNNDEDTDINRAKRALERAENRLKVSDLL

SEQ ID NO: 1995009 - protein, 28 aa, Staphylococcus
VRRGRNAKSHTKAKNTDVQTYRKSSGLE

SEQ ID NO: 1995010 - protein, 27 aa, Staphylococcus
VRRGRNAKSYTKAKNTDIQTYRKSSGL

SEQ ID NO: 1995011 - protein, 6 aa, Staphylococcus
VRRTET

SEQ ID NO: 1995012 - protein, 22 aa, Staphylococcus
VRSADGKLTKDHMNSMESQRYY

SEQ ID NO: 1995013 - protein, 26 aa, Staphylococcus
VRSAGGELISEPHSNTRYEDTEGNQT

SEQ ID NO: 1995014 - protein, 9 aa, Staphylococcus
VRSEDSNSH

SEQ ID NO: 1995015 - protein, 9 aa, Staphylococcus
VRSEQANSH

SEQ ID NO: 1995016 - protein, 7 aa, Staphylococcus
VRSGSVT

SEQ ID NO: 1995017 - protein, 6 aa, Staphylococcus
VRSGTC

SEQ ID NO: 1995018 - protein, 9 aa, Staphylococcus
VRSKASDTF

SEQ ID NO: 1995019 - protein, 9 aa, Staphylococcus
VRSNDDVKY

SEQ ID NO: 1995020 - protein, 9 aa, Staphylococcus
VRSNEDVDY

SEQ ID NO: 1995021 - protein, 17 aa, Staphylococcus
VRSNGGDYKKVKQVSKA

SEQ ID NO: 1995022 - protein, 15 aa, Staphylococcus
VRSQRAVTDTTNDLL

SEQ ID NO: 1995023 - protein, 7 aa, Staphylococcus
VRSSLTA

SEQ ID NO: 1995024 - protein, 9 aa, Staphylococcus
VRTNIGTEY

SEQ ID NO: 1995025 - protein, 6 aa, Staphylococcus
VRTNYE

SEQ ID NO: 1995026 - protein, 10 aa, Staphylococcus
VRTRNNDEIT

SEQ ID NO: 1995027 - protein, 15 aa, Staphylococcus
VRTSLSGTAEKPRLN

SEQ ID NO: 1995028 - protein, 20 aa, Staphylococcus
VRTSRQSAFKERKKAQDARL

SEQ ID NO: 1995029 - protein, 16 aa, Staphylococcus
VRVEDREPKVLKDNEV

SEQ ID NO: 1995030 - protein, 16 aa, Staphylococcus
VRVEDRKSKELQDNEV

SEQ ID NO: 1995031 - protein, 18 aa, Staphylococcus
VSAAEKAGAEHTWIEYLG

SEQ ID NO: 1995032 - protein, 9 aa, Staphylococcus
VSAALNKSK

SEQ ID NO: 1995033 - protein, 9 aa, Staphylococcus
VSAAMNPTS

SEQ ID NO: 1995034 - protein, 6 aa, Staphylococcus
VSAASD

SEQ ID NO: 1995035 - protein, 6 aa, Staphylococcus
VSADDY

SEQ ID NO: 1995036 - protein, 8 aa, Staphylococcus
VSAEHSDE

SEQ ID NO: 1995037 - protein, 8 aa, Staphylococcus
VSAEHSEE

SEQ ID NO: 1995038 - protein, 7 aa, Staphylococcus
VSAETKY

SEQ ID NO: 1995039 - protein, 6 aa, Staphylococcus
VSAETQ

SEQ ID NO: 1995040 - protein, 7 aa, Staphylococcus
VSAETQY

SEQ ID NO: 1995041 - protein, 9 aa, Staphylococcus
VSAGEPLNR

SEQ ID NO: 1995042 - protein, 9 aa, Staphylococcus
VSAGNTGAL

SEQ ID NO: 1995043 - protein, 9 aa, Staphylococcus
VSATENQKI

SEQ ID NO: 1995044 - protein, 4 aa, Staphylococcus
VSCH

SEQ ID NO: 1995045 - protein, 8 aa, Staphylococcus
VSDDAKKW

SEQ ID NO: 1995046 - protein, 7 aa, Staphylococcus
VSDDGNV

SEQ ID NO: 1995047 - protein, 9 aa, Staphylococcus
VSDDKSVQQ

SEQ ID NO: 1995048 - protein, 5 aa, Staphylococcus
VSDDL

SEQ ID NO: 1995049 - protein, 10 aa, Staphylococcus
VSDDTETSNI

SEQ ID NO: 1995050 - protein, 10 aa, Staphylococcus
VSDDTKKVSD

SEQ ID NO: 1995051 - protein, 5 aa, Staphylococcus
VSDDY

SEQ ID NO: 1995052 - protein, 4 aa, Staphylococcus
VSDE

SEQ ID NO: 1995053 - protein, 7 aa, Staphylococcus
VSDEAKA

SEQ ID NO: 1995054 - protein, 7 aa, Staphylococcus
VSDEAKK

SEQ ID NO: 1995055 - protein, 8 aa, Staphylococcus
VSDEAKKW

SEQ ID NO: 1995056 - protein, 8 aa, Staphylococcus
VSDEASYQ

SEQ ID NO: 1995057 - protein, 13 aa, Staphylococcus
VSDEELEDILLGR

SEQ ID NO: 1995058 - protein, 8 aa, Staphylococcus
VSDEESYQ

SEQ ID NO: 1995059 - protein, 7 aa, Staphylococcus
VSDEHDL

SEQ ID NO: 1995060 - protein, 16 aa, Staphylococcus
VSDELTNELERSPSIA

SEQ ID NO: 1995061 - protein, 17 aa, Staphylococcus
VSDELTNELERSPSISE

SEQ ID NO: 1995062 - protein, 17 aa, Staphylococcus
VSDELTNELERSPSITE

SEQ ID NO: 1995063 - protein, 15 aa, Staphylococcus
VSDEQSAKMTHRHNN

SEQ ID NO: 1995064 - protein, 8 aa, Staphylococcus
VSDEQSYD

SEQ ID NO: 1995065 - protein, 14 aa, Staphylococcus
VSDERSAYMTRGHN

SEQ ID NO: 1995066 - protein, 12 aa, Staphylococcus
VSDERSAYMTRS

SEQ ID NO: 1995067 - protein, 14 aa, Staphylococcus
VSDERSAYMTRSHN

SEQ ID NO: 1995068 - protein, 8 aa, Staphylococcus
VSDESSDE

SEQ ID NO: 1995069 - protein, 8 aa, Staphylococcus
VSDGCEAT

SEQ ID NO: 1995070 - protein, 10 aa, Staphylococcus
VSDGCEETNT

SEQ ID NO: 1995071 - protein, 10 aa, Staphylococcus
VSDGCEQTNT

SEQ ID NO: 1995072 - protein, 9 aa, Staphylococcus
VSDKDGDMH

SEQ ID NO: 1995073 - protein, 12 aa, Staphylococcus
VSDKGKYAKTSY

SEQ ID NO: 1995074 - protein, 8 aa, Staphylococcus
VSDKGPLA

SEQ ID NO: 1995075 - protein, 7 aa, Staphylococcus
VSDLQHT

SEQ ID NO: 1995076 - protein, 44 aa, Staphylococcus
VSDNSSSKKVYSDNSFNVSSSFKASKSQNVSSKQGVSEDEIRAM

SEQ ID NO: 1995077 - protein, 5 aa, Staphylococcus
VSDPY

SEQ ID NO: 1995078 - protein, 4 aa, Staphylococcus
VSDQ

SEQ ID NO: 1995079 - protein, 8 aa, Staphylococcus
VSDQSDRM

SEQ ID NO: 1995080 - protein, 15 aa, Staphylococcus
VSDRENSMTAGQRGP

SEQ ID NO: 1995081 - protein, 16 aa, Staphylococcus
VSDRTQAAIYAIENKL

SEQ ID NO: 1995082 - protein, 16 aa, Staphylococcus
VSDRTQAAIYAMENKL

SEQ ID NO: 1995083 - protein, 16 aa, Staphylococcus
VSDRTQAAIYAMQNNL

SEQ ID NO: 1995084 - protein, 4 aa, Staphylococcus
VSDS

SEQ ID NO: 1995085 - protein, 5 aa, Staphylococcus
VSDSE

SEQ ID NO: 1995086 - protein, 7 aa, Staphylococcus
VSDSEDD

SEQ ID NO: 1995087 - protein, 5 aa, Staphylococcus
VSDSQ

SEQ ID NO: 1995088 - protein, 13 aa, Staphylococcus
VSDSVDNAEAYQH

SEQ ID NO: 1995089 - protein, 7 aa, Staphylococcus
VSDTVDS

SEQ ID NO: 1995090 - protein, 4 aa, Staphylococcus
VSDY

SEQ ID NO: 1995091 - protein, 10 aa, Staphylococcus
VSEADAKAAM

SEQ ID NO: 1995092 - protein, 29 aa, Staphylococcus
VSEADTGSPTRGGRPATHAIKTKDGYKLN

SEQ ID NO: 1995093 - protein, 26 aa, Staphylococcus
VSEADTGSPTRGGRPATHAVKQDDGY

SEQ ID NO: 1995094 - protein, 24 aa, Staphylococcus
VSEAEKAGANIATGGKKVENSPSD

SEQ ID NO: 1995095 - protein, 22 aa, Staphylococcus
VSEAETGSPTRGGRPATHAVKE

SEQ ID NO: 1995096 - protein, 25 aa, Staphylococcus
VSEAETGSPTRGGRPATNAIKNENG

SEQ ID NO: 1995097 - protein, 21 aa, Staphylococcus
VSEAETGSPTRGGRPATNAVK

SEQ ID NO: 1995098 - protein, 26 aa, Staphylococcus
VSEAETGSPTRGGRPGTHAVKEDNGY

SEQ ID NO: 1995099 - protein, 5 aa, Staphylococcus
VSEAN

SEQ ID NO: 1995100 - protein, 7 aa, Staphylococcus
VSEDSQS

SEQ ID NO: 1995101 - protein, 4 aa, Staphylococcus
VSEE

SEQ ID NO: 1995102 - protein, 5 aa, Staphylococcus
VSEED

SEQ ID NO: 1995103 - protein, 7 aa, Staphylococcus
VSEEDVQ

SEQ ID NO: 1995104 - protein, 10 aa, Staphylococcus
VSEEEANQLE

SEQ ID NO: 1995105 - protein, 5 aa, Staphylococcus
VSEEQ

SEQ ID NO: 1995106 - protein, 11 aa, Staphylococcus
VSEGCQQTNTA

SEQ ID NO: 1995107 - protein, 12 aa, Staphylococcus
VSEGDKGFGQEA

SEQ ID NO: 1995108 - protein, 36 aa, Staphylococcus
VSEGDSASKKAPASSKAKAEDEHDAHVGTDQFNTHN

SEQ ID NO: 1995109 - protein, 12 aa, Staphylococcus
VSEGERNSTLAS

SEQ ID NO: 1995110 - protein, 8 aa, Staphylococcus
VSEGETVE

SEQ ID NO: 1995111 - protein, 8 aa, Staphylococcus
VSEGKVRS

SEQ ID NO: 1995112 - protein, 8 aa, Staphylococcus
VSEGNITI

SEQ ID NO: 1995113 - protein, 10 aa, Staphylococcus
VSEGTSHLSP

SEQ ID NO: 1995114 - protein, 15 aa, Staphylococcus
VSEKAIERKTGARGL

SEQ ID NO: 1995115 - protein, 10 aa, Staphylococcus
VSEKGGLGTI

SEQ ID NO: 1995116 - protein, 10 aa, Staphylococcus
VSEKSDRMGY

SEQ ID NO: 1995117 - protein, 7 aa, Staphylococcus
VSEKSDV

SEQ ID NO: 1995118 - protein, 4 aa, Staphylococcus
VSEM

SEQ ID NO: 1995119 - protein, 4 aa, Staphylococcus
VSEN

SEQ ID NO: 1995120 - protein, 7 aa, Staphylococcus
VSENEGD

SEQ ID NO: 1995121 - protein, 10 aa, Staphylococcus
VSENGKYAKT

SEQ ID NO: 1995122 - protein, 5 aa, Staphylococcus
VSENK

SEQ ID NO: 1995123 - protein, 7 aa, Staphylococcus
VSENYPN

SEQ ID NO: 1995124 - protein, 8 aa, Staphylococcus
VSEPDVED

SEQ ID NO: 1995125 - protein, 8 aa, Staphylococcus
VSEQANHN

SEQ ID NO: 1995126 - protein, 12 aa, Staphylococcus
VSEQPVIDVAEV

SEQ ID NO: 1995127 - protein, 18 aa, Staphylococcus
VSEQTGSVQLSERSSGEL

SEQ ID NO: 1995128 - protein, 5 aa, Staphylococcus
VSEQY

SEQ ID NO: 1995129 - protein, 9 aa, Staphylococcus
VSESAQKDG

SEQ ID NO: 1995130 - protein, 18 aa, Staphylococcus
VSESKHGGIQCFNLVKNL

SEQ ID NO: 1995131 - protein, 15 aa, Staphylococcus
VSETGDISESTEKAV

SEQ ID NO: 1995132 - protein, 9 aa, Staphylococcus
VSETGTSKI

SEQ ID NO: 1995133 - protein, 7 aa, Staphylococcus
VSETKPD

SEQ ID NO: 1995134 - protein, 8 aa, Staphylococcus
VSEWKDTD

SEQ ID NO: 1995135 - protein, 7 aa, Staphylococcus
VSFESDN

SEQ ID NO: 1995136 - protein, 11 aa, Staphylococcus
VSGDSKKKHQN

SEQ ID NO: 1995137 - protein, 10 aa, Staphylococcus
VSGDSVGGNM

SEQ ID NO: 1995138 - protein, 11 aa, Staphylococcus
VSGDTKKKHQN

SEQ ID NO: 1995139 - protein, 5 aa, Staphylococcus
VSGEE

SEQ ID NO: 1995140 - protein, 23 aa, Staphylococcus
VSGEEIKEQHSNFKDKARKFFRG

SEQ ID NO: 1995141 - protein, 15 aa, Staphylococcus
VSGEITTERKGDYGF

SEQ ID NO: 1995142 - protein, 14 aa, Staphylococcus
VSGERGAADAERDI

SEQ ID NO: 1995143 - protein, 12 aa, Staphylococcus
VSGERGAADLER

SEQ ID NO: 1995144 - protein, 11 aa, Staphylococcus
VSGESSKHGIS

SEQ ID NO: 1995145 - protein, 12 aa, Staphylococcus
VSGESSKQGVSL

SEQ ID NO: 1995146 - protein, 8 aa, Staphylococcus
VSGGDVND

SEQ ID NO: 1995147 - protein, 6 aa, Staphylococcus
VSGGKR

SEQ ID NO: 1995148 - protein, 6 aa, Staphylococcus
VSGGLD

SEQ ID NO: 1995149 - protein, 4 aa, Staphylococcus
VSGK

SEQ ID NO: 1995150 - protein, 8 aa, Staphylococcus
VSGKGGTN

SEQ ID NO: 1995151 - protein, 9 aa, Staphylococcus
VSGKGGTNF

SEQ ID NO: 1995152 - protein, 17 aa, Staphylococcus
VSGKKLKEKLENGQEDA

SEQ ID NO: 1995153 - protein, 10 aa, Staphylococcus
VSGKSDVEKN

SEQ ID NO: 1995154 - protein, 27 aa, Staphylococcus
VSGKTLAQASTQEKDLANESGSKVELS

SEQ ID NO: 1995155 - protein, 7 aa, Staphylococcus
VSGLPKE

SEQ ID NO: 1995156 - protein, 14 aa, Staphylococcus
VSGLPKEKVIGSGT

SEQ ID NO: 1995157 - protein, 7 aa, Staphylococcus
VSGNGAF

SEQ ID NO: 1995158 - protein, 8 aa, Staphylococcus
VSGNGAYS

SEQ ID NO: 1995159 - protein, 11 aa, Staphylococcus
VSGPSLDRPGD

SEQ ID NO: 1995160 - protein, 5 aa, Staphylococcus
VSGQE

SEQ ID NO: 1995161 - protein, 8 aa, Staphylococcus
VSGRESHA

SEQ ID NO: 1995162 - protein, 9 aa, Staphylococcus
VSGSGAYSK

SEQ ID NO: 1995163 - protein, 9 aa, Staphylococcus
VSGSSEAYL

SEQ ID NO: 1995164 - protein, 9 aa, Staphylococcus
VSGTAERSW

SEQ ID NO: 1995165 - protein, 9 aa, Staphylococcus
VSGTATAGI

SEQ ID NO: 1995166 - protein, 19 aa, Staphylococcus
VSGVDGAIGSTYNVNGRRA

SEQ ID NO: 1995167 - protein, 6 aa, Staphylococcus
VSHAEA

SEQ ID NO: 1995168 - protein, 8 aa, Staphylococcus
VSHDGNEI

SEQ ID NO: 1995169 - protein, 11 aa, Staphylococcus
VSHKEEKNPYY

SEQ ID NO: 1995170 - protein, 6 aa, Staphylococcus
VSHNDN

SEQ ID NO: 1995171 - protein, 7 aa, Staphylococcus
VSHQGNF

SEQ ID NO: 1995172 - protein, 9 aa, Staphylococcus
VSHQTPQAI

SEQ ID NO: 1995173 - protein, 9 aa, Staphylococcus
VSIDSRDIH

SEQ ID NO: 1995174 - protein, 77 aa, Staphylococcus
VSIEKKKPKKVNPKRLQRQVAKEQKQPKTSTYAQKAIKKEQEMKKVQGKKSKKLKKEQAKARKRQLKVQKNKQKKKG

SEQ ID NO: 1995175 - protein, 10 aa, Staphylococcus
VSIEKTTSNA

SEQ ID NO: 1995176 - protein, 7 aa, Staphylococcus
VSIGGGK

SEQ ID NO: 1995177 - protein, 7 aa, Staphylococcus
VSIGKRP

SEQ ID NO: 1995178 - protein, 8 aa, Staphylococcus
VSIGKRPM

SEQ ID NO: 1995179 - protein, 22 aa, Staphylococcus
VSKATKDDVDNAFESSNKAYDA

SEQ ID NO: 1995180 - protein, 7 aa, Staphylococcus
VSKATTN

SEQ ID NO: 1995181 - protein, 9 aa, Staphylococcus
VSKAYRDSV

SEQ ID NO: 1995182 - protein, 9 aa, Staphylococcus
VSKDCNNKT

SEQ ID NO: 1995183 - protein, 10 aa, Staphylococcus
VSKDDTYSKK

SEQ ID NO: 1995184 - protein, 14 aa, Staphylococcus
VSKDGEDNLAPYSQ

SEQ ID NO: 1995185 - protein, 14 aa, Staphylococcus
VSKDGKDNLAPYSQ

SEQ ID NO: 1995186 - protein, 12 aa, Staphylococcus
VSKDIQPNNEQV

SEQ ID NO: 1995187 - protein, 7 aa, Staphylococcus
VSKDLTE

SEQ ID NO: 1995188 - protein, 5 aa, Staphylococcus
VSKDQ

SEQ ID NO: 1995189 - protein, 5 aa, Staphylococcus
VSKEA

SEQ ID NO: 1995190 - protein, 7 aa, Staphylococcus
VSKEAEN

SEQ ID NO: 1995191 - protein, 7 aa, Staphylococcus
VSKEAQM

SEQ ID NO: 1995192 - protein, 8 aa, Staphylococcus
VSKEEAQK

SEQ ID NO: 1995193 - protein, 13 aa, Staphylococcus
VSKEMDDKLRQNV

SEQ ID NO: 1995194 - protein, 8 aa, Staphylococcus
VSKERDKI

SEQ ID NO: 1995195 - protein, 8 aa, Staphylococcus
VSKESGVT

SEQ ID NO: 1995196 - protein, 4 aa, Staphylococcus
VSKG

SEQ ID NO: 1995197 - protein, 6 aa, Staphylococcus
VSKGGH

SEQ ID NO: 1995198 - protein, 6 aa, Staphylococcus
VSKGHA

SEQ ID NO: 1995199 - protein, 5 aa, Staphylococcus
VSKGK

SEQ ID NO: 1995200 - protein, 6 aa, Staphylococcus
VSKGNA

SEQ ID NO: 1995201 - protein, 16 aa, Staphylococcus
VSKKDDTVLSGYTSKN

SEQ ID NO: 1995202 - protein, 7 aa, Staphylococcus
VSKKEYK

SEQ ID NO: 1995203 - protein, 7 aa, Staphylococcus
VSKKEYV

SEQ ID NO: 1995204 - protein, 9 aa, Staphylococcus
VSKKQREQF

SEQ ID NO: 1995205 - protein, 8 aa, Staphylococcus
VSKKSGTI

SEQ ID NO: 1995206 - protein, 10 aa, Staphylococcus
VSKNGKEIDL

SEQ ID NO: 1995207 - protein, 6 aa, Staphylococcus
VSKNGQ

SEQ ID NO: 1995208 - protein, 10 aa, Staphylococcus
VSKNPLNDTN

SEQ ID NO: 1995209 - protein, 8 aa, Staphylococcus
VSKQGGLG

SEQ ID NO: 1995210 - protein, 7 aa, Staphylococcus
VSKQSFD

SEQ ID NO: 1995211 - protein, 16 aa, Staphylococcus
VSKSDLKRVKQLLAYK

SEQ ID NO: 1995212 - protein, 16 aa, Staphylococcus
VSKSDMKRVKQLLSYK

SEQ ID NO: 1995213 - protein, 7 aa, Staphylococcus
VSKSPAQ

SEQ ID NO: 1995214 - protein, 8 aa, Staphylococcus
VSKTGLGP

SEQ ID NO: 1995215 - protein, 12 aa, Staphylococcus
VSKTVIPVEIED

SEQ ID NO: 1995216 - protein, 10 aa, Staphylococcus
VSKVTSVSTR

SEQ ID NO: 1995217 - protein, 5 aa, Staphylococcus
VSLDQ

SEQ ID NO: 1995218 - protein, 17 aa, Staphylococcus
VSLEDKTLRSLKPGEAL

SEQ ID NO: 1995219 - protein, 9 aa, Staphylococcus
VSLEKNNNL

SEQ ID NO: 1995220 - protein, 7 aa, Staphylococcus
VSLNRQG

SEQ ID NO: 1995221 - protein, 8 aa, Staphylococcus
VSLPNAKR

SEQ ID NO: 1995222 - protein, 9 aa, Staphylococcus
VSLSSETTN

SEQ ID NO: 1995223 - protein, 9 aa, Staphylococcus
VSLTDDDNK

SEQ ID NO: 1995224 - protein, 5 aa, Staphylococcus
VSLTQ

SEQ ID NO: 1995225 - protein, 5 aa, Staphylococcus
VSMEQ

SEQ ID NO: 1995226 - protein, 11 aa, Staphylococcus
VSNDAKKGLRD

SEQ ID NO: 1995227 - protein, 8 aa, Staphylococcus
VSNDDMQN

SEQ ID NO: 1995228 - protein, 7 aa, Staphylococcus
VSNDELD

SEQ ID NO: 1995229 - protein, 10 aa, Staphylococcus
VSNEATITDK

SEQ ID NO: 1995230 - protein, 6 aa, Staphylococcus
VSNEDA

SEQ ID NO: 1995231 - protein, 10 aa, Staphylococcus
VSNEDAGRAM

SEQ ID NO: 1995232 - protein, 9 aa, Staphylococcus
VSNETQNSL

SEQ ID NO: 1995233 - protein, 24 aa, Staphylococcus
VSNHKDINKKLSNEDAYKRARPSH

SEQ ID NO: 1995234 - protein, 8 aa, Staphylococcus
VSNIRNSK

SEQ ID NO: 1995235 - protein, 8 aa, Staphylococcus
VSNKGGLG

SEQ ID NO: 1995236 - protein, 8 aa, Staphylococcus
VSNKQPSI

SEQ ID NO: 1995237 - protein, 20 aa, Staphylococcus
VSNNKDVTSKTIQPKHGESV

SEQ ID NO: 1995238 - protein, 10 aa, Staphylococcus
VSNNYDASIS

SEQ ID NO: 1995239 - protein, 5 aa, Staphylococcus
VSNQA

SEQ ID NO: 1995240 - protein, 5 aa, Staphylococcus
VSNQF

SEQ ID NO: 1995241 - protein, 7 aa, Staphylococcus
VSNQSYY

SEQ ID NO: 1995242 - protein, 4 aa, Staphylococcus
VSNR

SEQ ID NO: 1995243 - protein, 9 aa, Staphylococcus
VSNSSRFNA

SEQ ID NO: 1995244 - protein, 12 aa, Staphylococcus
VSNTTSTITEKV

SEQ ID NO: 1995245 - protein, 8 aa, Staphylococcus
VSPAAQGL

SEQ ID NO: 1995246 - protein, 9 aa, Staphylococcus
VSPAAQGLH

SEQ ID NO: 1995247 - protein, 5 aa, Staphylococcus
VSPAL

SEQ ID NO: 1995248 - protein, 6 aa, Staphylococcus
VSPAST

SEQ ID NO: 1995249 - protein, 7 aa, Staphylococcus
VSPDPSM

SEQ ID NO: 1995250 - protein, 5 aa, Staphylococcus
VSPDQ

SEQ ID NO: 1995251 - protein, 11 aa, Staphylococcus
VSPEAASGGPI

SEQ ID NO: 1995252 - protein, 7 aa, Staphylococcus
VSPEEKE

SEQ ID NO: 1995253 - protein, 13 aa, Staphylococcus
VSPGDSSKWQTPP

SEQ ID NO: 1995254 - protein, 10 aa, Staphylococcus
VSPIAKDYQE

SEQ ID NO: 1995255 - protein, 4 aa, Staphylococcus
VSPK

SEQ ID NO: 1995256 - protein, 9 aa, Staphylococcus
VSPKEAGLT

SEQ ID NO: 1995257 - protein, 5 aa, Staphylococcus
VSPNN

SEQ ID NO: 1995258 - protein, 6 aa, Staphylococcus
VSPSFE

SEQ ID NO: 1995259 - protein, 9 aa, Staphylococcus
VSPSNVDEQ

SEQ ID NO: 1995260 - protein, 9 aa, Staphylococcus
VSPTDSPDT

SEQ ID NO: 1995261 - protein, 5 aa, Staphylococcus
VSPTN

SEQ ID NO: 1995262 - protein, 6 aa, Staphylococcus
VSPWDK

SEQ ID NO: 1995263 - protein, 4 aa, Staphylococcus
VSPY

SEQ ID NO: 1995264 - protein, 6 aa, Staphylococcus
VSPYQT

SEQ ID NO: 1995265 - protein, 7 aa, Staphylococcus
VSPYTGY

SEQ ID NO: 1995266 - protein, 6 aa, Staphylococcus
VSQDDA

SEQ ID NO: 1995267 - protein, 10 aa, Staphylococcus
VSQEEAEQYV

SEQ ID NO: 1995268 - protein, 4 aa, Staphylococcus
VSQG

SEQ ID NO: 1995269 - protein, 7 aa, Staphylococcus
VSQGYEK

SEQ ID NO: 1995270 - protein, 13 aa, Staphylococcus
VSQPEDLNDMNKE

SEQ ID NO: 1995271 - protein, 4 aa, Staphylococcus
VSQQ

SEQ ID NO: 1995272 - protein, 8 aa, Staphylococcus
VSQSYPDV

SEQ ID NO: 1995273 - protein, 9 aa, Staphylococcus
VSQTDNKQI

SEQ ID NO: 1995274 - protein, 11 aa, Staphylococcus
VSQTEANNLEI

SEQ ID NO: 1995275 - protein, 7 aa, Staphylococcus
VSQTEIK

SEQ ID NO: 1995276 - protein, 9 aa, Staphylococcus
VSQTGTSKI

SEQ ID NO: 1995277 - protein, 10 aa, Staphylococcus
VSRAKDPVKM

SEQ ID NO: 1995278 - protein, 7 aa, Staphylococcus
VSRDEAK

SEQ ID NO: 1995279 - protein, 8 aa, Staphylococcus
VSREKRMS

SEQ ID NO: 1995280 - protein, 10 aa, Staphylococcus
VSREKTPKWL

SEQ ID NO: 1995281 - protein, 7 aa, Staphylococcus
VSREPAY

SEQ ID NO: 1995282 - protein, 4 aa, Staphylococcus
VSRG

SEQ ID NO: 1995283 - protein, 9 aa, Staphylococcus
VSRKEAKDF

SEQ ID NO: 1995284 - protein, 10 aa, Staphylococcus
VSRKEKGDQA

SEQ ID NO: 1995285 - protein, 6 aa, Staphylococcus
VSRNEA

SEQ ID NO: 1995286 - protein, 6 aa, Staphylococcus
VSRNNI

SEQ ID NO: 1995287 - protein, 4 aa, Staphylococcus
VSRP

SEQ ID NO: 1995288 - protein, 14 aa, Staphylococcus
VSRPGTKLTTTEDG

SEQ ID NO: 1995289 - protein, 15 aa, Staphylococcus
VSRPGTTLSTTDEGE

SEQ ID NO: 1995290 - protein, 8 aa, Staphylococcus
VSRPNTSL

SEQ ID NO: 1995291 - protein, 9 aa, Staphylococcus
VSRQKRKKV

SEQ ID NO: 1995292 - protein, 5 aa, Staphylococcus
VSRQT

SEQ ID NO: 1995293 - protein, 8 aa, Staphylococcus
VSRRNPTL

SEQ ID NO: 1995294 - protein, 11 aa, Staphylococcus
VSRRNQENRVY

SEQ ID NO: 1995295 - protein, 10 aa, Staphylococcus
VSRSERPEWN

SEQ ID NO: 1995296 - protein, 8 aa, Staphylococcus
VSRSPVRD

SEQ ID NO: 1995297 - protein, 9 aa, Staphylococcus
VSRTGSSKI

SEQ ID NO: 1995298 - protein, 8 aa, Staphylococcus
VSSDDNSI

SEQ ID NO: 1995299 - protein, 7 aa, Staphylococcus
VSSDEYD

SEQ ID NO: 1995300 - protein, 6 aa, Staphylococcus
VSSDHD

SEQ ID NO: 1995301 - protein, 7 aa, Staphylococcus
VSSDQQQ

SEQ ID NO: 1995302 - protein, 7 aa, Staphylococcus
VSSDRSY

SEQ ID NO: 1995303 - protein, 4 aa, Staphylococcus
VSSE

SEQ ID NO: 1995304 - protein, 5 aa, Staphylococcus
VSSED

SEQ ID NO: 1995305 - protein, 7 aa, Staphylococcus
VSSEDAD

SEQ ID NO: 1995306 - protein, 8 aa, Staphylococcus
VSSEDEAK

SEQ ID NO: 1995307 - protein, 5 aa, Staphylococcus
VSSEK

SEQ ID NO: 1995308 - protein, 8 aa, Staphylococcus
VSSETDIP

SEQ ID NO: 1995309 - protein, 8 aa, Staphylococcus
VSSETGYK

SEQ ID NO: 1995310 - protein, 4 aa, Staphylococcus
VSSG

SEQ ID NO: 1995311 - protein, 13 aa, Staphylococcus
VSSGKISSSSYTA

SEQ ID NO: 1995312 - protein, 5 aa, Staphylococcus
VSSID

SEQ ID NO: 1995313 - protein, 7 aa, Staphylococcus
VSSIKQG

SEQ ID NO: 1995314 - protein, 5 aa, Staphylococcus
VSSKA

SEQ ID NO: 1995315 - protein, 6 aa, Staphylococcus
VSSKEQ

SEQ ID NO: 1995316 - protein, 10 aa, Staphylococcus
VSSKKGNYVR

SEQ ID NO: 1995317 - protein, 15 aa, Staphylococcus
VSSKPHNTNKLSKRE

SEQ ID NO: 1995318 - protein, 11 aa, Staphylococcus
VSSKSEKSIGV

SEQ ID NO: 1995319 - protein, 7 aa, Staphylococcus
VSSKTNR

SEQ ID NO: 1995320 - protein, 11 aa, Staphylococcus
VSSNDDGSISN

SEQ ID NO: 1995321 - protein, 21 aa, Staphylococcus
VSSNEDITKQSNHNDDDIDHS

SEQ ID NO: 1995322 - protein, 7 aa, Staphylococcus
VSSNEYD

SEQ ID NO: 1995323 - protein, 25 aa, Staphylococcus
VSSNPLDFPGYQEKVEKDQKKTGLN

SEQ ID NO: 1995324 - protein, 11 aa, Staphylococcus
VSSPHTDHSEA

SEQ ID NO: 1995325 - protein, 4 aa, Staphylococcus
VSSQ

SEQ ID NO: 1995326 - protein, 6 aa, Staphylococcus
VSSRTI

SEQ ID NO: 1995327 - protein, 12 aa, Staphylococcus
VSSSKFENLGNC

SEQ ID NO: 1995328 - protein, 6 aa, Staphylococcus
VSSTSH

SEQ ID NO: 1995329 - protein, 8 aa, Staphylococcus
VSSVGSAN

SEQ ID NO: 1995330 - protein, 10 aa, Staphylococcus
VSTAGQKGAV

SEQ ID NO: 1995331 - protein, 5 aa, Staphylococcus
VSTDD

SEQ ID NO: 1995332 - protein, 11 aa, Staphylococcus
VSTDGASPKLA

SEQ ID NO: 1995333 - protein, 11 aa, Staphylococcus
VSTDGASPKLG

SEQ ID NO: 1995334 - protein, 7 aa, Staphylococcus
VSTDGDT

SEQ ID NO: 1995335 - protein, 5 aa, Staphylococcus
VSTDS

SEQ ID NO: 1995336 - protein, 7 aa, Staphylococcus
VSTDTPS

SEQ ID NO: 1995337 - protein, 5 aa, Staphylococcus
VSTED

SEQ ID NO: 1995338 - protein, 6 aa, Staphylococcus
VSTEDY

SEQ ID NO: 1995339 - protein, 17 aa, Staphylococcus
VSTEELDARKQNVKPFK

SEQ ID NO: 1995340 - protein, 11 aa, Staphylococcus
VSTEGASPKLG

SEQ ID NO: 1995341 - protein, 5 aa, Staphylococcus
VSTGE

SEQ ID NO: 1995342 - protein, 9 aa, Staphylococcus
VSTGGGAKS

SEQ ID NO: 1995343 - protein, 10 aa, Staphylococcus
VSTGNRNQTL

SEQ ID NO: 1995344 - protein, 9 aa, Staphylococcus
VSTGQAPQF

SEQ ID NO: 1995345 - protein, 10 aa, Staphylococcus
VSTGQQPQFI

SEQ ID NO: 1995346 - protein, 13 aa, Staphylococcus
VSTGQQPQFIGKP

SEQ ID NO: 1995347 - protein, 10 aa, Staphylococcus
VSTGTADSPV

SEQ ID NO: 1995348 - protein, 8 aa, Staphylococcus
VSTKDQRS

SEQ ID NO: 1995349 - protein, 7 aa, Staphylococcus
VSTKQIA

SEQ ID NO: 1995350 - protein, 15 aa, Staphylococcus
VSTKREIESSKYYQG

SEQ ID NO: 1995351 - protein, 5 aa, Staphylococcus
VSTLN

SEQ ID NO: 1995352 - protein, 11 aa, Staphylococcus
VSTLSGGNKRK

SEQ ID NO: 1995353 - protein, 8 aa, Staphylococcus
VSTLSGGQ

SEQ ID NO: 1995354 - protein, 5 aa, Staphylococcus
VSTNY

SEQ ID NO: 1995355 - protein, 7 aa, Staphylococcus
VSTPDGR

SEQ ID NO: 1995356 - protein, 7 aa, Staphylococcus
VSTPDHR

SEQ ID NO: 1995357 - protein, 7 aa, Staphylococcus
VSTPDQR

SEQ ID NO: 1995358 - protein, 7 aa, Staphylococcus
VSTPDSR

SEQ ID NO: 1995359 - protein, 13 aa, Staphylococcus
VSTQQIAQSGRYT

SEQ ID NO: 1995360 - protein, 5 aa, Staphylococcus
VSTRE

SEQ ID NO: 1995361 - protein, 10 aa, Staphylococcus
VSTRKDGTKH

SEQ ID NO: 1995362 - protein, 10 aa, Staphylococcus
VSTRKDGTKR

SEQ ID NO: 1995363 - protein, 9 aa, Staphylococcus
VSTRPGHQE

SEQ ID NO: 1995364 - protein, 9 aa, Staphylococcus
VSTRPGYEE

SEQ ID NO: 1995365 - protein, 5 aa, Staphylococcus
VSTSG

SEQ ID NO: 1995366 - protein, 8 aa, Staphylococcus
VSTSNQYM

SEQ ID NO: 1995367 - protein, 5 aa, Staphylococcus
VSTSS

SEQ ID NO: 1995368 - protein, 8 aa, Staphylococcus
VSTSTQSL

SEQ ID NO: 1995369 - protein, 14 aa, Staphylococcus
VSTTTEDQTGDTLE

SEQ ID NO: 1995370 - protein, 12 aa, Staphylococcus
VSTWTRNTSQEL

SEQ ID NO: 1995371 - protein, 4 aa, Staphylococcus
VSTY

SEQ ID NO: 1995372 - protein, 5 aa, Staphylococcus
VSVDI

SEQ ID NO: 1995373 - protein, 6 aa, Staphylococcus
VSVEED

SEQ ID NO: 1995374 - protein, 20 aa, Staphylococcus
VSVEGNTITVKGPKGELSRT

SEQ ID NO: 1995375 - protein, 9 aa, Staphylococcus
VSVKGSGTV

SEQ ID NO: 1995376 - protein, 4 aa, Staphylococcus
VSVN

SEQ ID NO: 1995377 - protein, 4 aa, Staphylococcus
VSYK

SEQ ID NO: 1995378 - protein, 11 aa, Staphylococcus
VSYKSKNPGAM

SEQ ID NO: 1995379 - protein, 14 aa, Staphylococcus
VSYNIEKNAKHRGF

SEQ ID NO: 1995380 - protein, 24 aa, Staphylococcus
VSYNKEENAVKVDATQKLNEEAPY

SEQ ID NO: 1995381 - protein, 6 aa, Staphylococcus
VSYSTQ

SEQ ID NO: 1995382 - protein, 9 aa, Staphylococcus
VTAAGRQTA

SEQ ID NO: 1995383 - protein, 24 aa, Staphylococcus
VTAEAKDIAQSDGYQRDLQANTQF

SEQ ID NO: 1995384 - protein, 12 aa, Staphylococcus
VTAEDKENLEKR

SEQ ID NO: 1995385 - protein, 12 aa, Staphylococcus
VTAEVPSTISGT

SEQ ID NO: 1995386 - protein, 6 aa, Staphylococcus
VTAGAR

SEQ ID NO: 1995387 - protein, 8 aa, Staphylococcus
VTAGINGD

SEQ ID NO: 1995388 - protein, 8 aa, Staphylococcus
VTAGKENI

SEQ ID NO: 1995389 - protein, 10 aa, Staphylococcus
VTAKNAKERE

SEQ ID NO: 1995390 - protein, 10 aa, Staphylococcus
VTARNNQYKE

SEQ ID NO: 1995391 - protein, 8 aa, Staphylococcus
VTASGAVP

SEQ ID NO: 1995392 - protein, 4 aa, Staphylococcus
VTAT

SEQ ID NO: 1995393 - protein, 7 aa, Staphylococcus
VTATNDE

SEQ ID NO: 1995394 - protein, 6 aa, Staphylococcus
VTAYRG

SEQ ID NO: 1995395 - protein, 4 aa, Staphylococcus
VTDD

SEQ ID NO: 1995396 - protein, 5 aa, Staphylococcus
VTDDE

SEQ ID NO: 1995397 - protein, 14 aa, Staphylococcus
VTDDEIGNGDSIFD

SEQ ID NO: 1995398 - protein, 13 aa, Staphylococcus
VTDDSVDYEDITK

SEQ ID NO: 1995399 - protein, 5 aa, Staphylococcus
VTDDY

SEQ ID NO: 1995400 - protein, 13 aa, Staphylococcus
VTDEGKKFVNEHG

SEQ ID NO: 1995401 - protein, 17 aa, Staphylococcus
VTDELTNELERSPSITE

SEQ ID NO: 1995402 - protein, 13 aa, Staphylococcus
VTDEQSINKQAVE

SEQ ID NO: 1995403 - protein, 8 aa, Staphylococcus
VTDETSVQ

SEQ ID NO: 1995404 - protein, 10 aa, Staphylococcus
VTDGDGNVVS

SEQ ID NO: 1995405 - protein, 12 aa, Staphylococcus
VTDGQGTLSDAV

SEQ ID NO: 1995406 - protein, 8 aa, Staphylococcus
VTDIDTEQ

SEQ ID NO: 1995407 - protein, 20 aa, Staphylococcus
VTDKAKEKIAEEGYDPEYGA

SEQ ID NO: 1995408 - protein, 11 aa, Staphylococcus
VTDKPEKPSMS

SEQ ID NO: 1995409 - protein, 23 aa, Staphylococcus
VTDLDTNKKTITVEHDGQSSTVS

SEQ ID NO: 1995410 - protein, 5 aa, Staphylococcus
VTDLN

SEQ ID NO: 1995411 - protein, 7 aa, Staphylococcus
VTDLNTD

SEQ ID NO: 1995412 - protein, 5 aa, Staphylococcus
VTDLS

SEQ ID NO: 1995413 - protein, 8 aa, Staphylococcus
VTDNQSLG

SEQ ID NO: 1995414 - protein, 16 aa, Staphylococcus
VTDRTQAAIYAIENKL

SEQ ID NO: 1995415 - protein, 16 aa, Staphylococcus
VTDRTQAAIYAMQNNL

SEQ ID NO: 1995416 - protein, 9 aa, Staphylococcus
VTDSGEYEA

SEQ ID NO: 1995417 - protein, 6 aa, Staphylococcus
VTDSGF

SEQ ID NO: 1995418 - protein, 12 aa, Staphylococcus
VTDSNENSGVSK

SEQ ID NO: 1995419 - protein, 19 aa, Staphylococcus
VTDTESLSQAIQDKEDQIH

SEQ ID NO: 1995420 - protein, 17 aa, Staphylococcus
VTDTKGPNGGSPNYKDI

SEQ ID NO: 1995421 - protein, 13 aa, Staphylococcus
VTDTKKINTKRIK

SEQ ID NO: 1995422 - protein, 5 aa, Staphylococcus
VTDTN

SEQ ID NO: 1995423 - protein, 11 aa, Staphylococcus
VTDTNENSGVG

SEQ ID NO: 1995424 - protein, 7 aa, Staphylococcus
VTDTPKI

SEQ ID NO: 1995425 - protein, 4 aa, Staphylococcus
VTDY

SEQ ID NO: 1995426 - protein, 20 aa, Staphylococcus
VTEAAKEKIAEEGYDPEYGA

SEQ ID NO: 1995427 - protein, 7 aa, Staphylococcus
VTEADAS

SEQ ID NO: 1995428 - protein, 10 aa, Staphylococcus
VTEAHEGEVS

SEQ ID NO: 1995429 - protein, 12 aa, Staphylococcus
VTEARNKEGEFI

SEQ ID NO: 1995430 - protein, 12 aa, Staphylococcus
VTEARNKKGEFI

SEQ ID NO: 1995431 - protein, 12 aa, Staphylococcus
VTEARNREGEFI

SEQ ID NO: 1995432 - protein, 9 aa, Staphylococcus
VTEARNSMG

SEQ ID NO: 1995433 - protein, 6 aa, Staphylococcus
VTEDGG

SEQ ID NO: 1995434 - protein, 11 aa, Staphylococcus
VTEDKANELEI

SEQ ID NO: 1995435 - protein, 6 aa, Staphylococcus
VTEDPD

SEQ ID NO: 1995436 - protein, 4 aa, Staphylococcus
VTEE

SEQ ID NO: 1995437 - protein, 7 aa, Staphylococcus
VTEEAKA

SEQ ID NO: 1995438 - protein, 11 aa, Staphylococcus
VTEEEADKLEI

SEQ ID NO: 1995439 - protein, 6 aa, Staphylococcus
VTEEGL

SEQ ID NO: 1995440 - protein, 11 aa, Staphylococcus
VTEEQADAYEL

SEQ ID NO: 1995441 - protein, 5 aa, Staphylococcus
VTEFE

SEQ ID NO: 1995442 - protein, 6 aa, Staphylococcus
VTEGAR

SEQ ID NO: 1995443 - protein, 7 aa, Staphylococcus
VTEGELN

SEQ ID NO: 1995444 - protein, 6 aa, Staphylococcus
VTEGGF

SEQ ID NO: 1995445 - protein, 5 aa, Staphylococcus
VTEGI

SEQ ID NO: 1995446 - protein, 8 aa, Staphylococcus
VTEGIDAQ

SEQ ID NO: 1995447 - protein, 7 aa, Staphylococcus
VTEGPGL

SEQ ID NO: 1995448 - protein, 10 aa, Staphylococcus
VTEGRSEKDL

SEQ ID NO: 1995449 - protein, 9 aa, Staphylococcus
VTEGSLSEG

SEQ ID NO: 1995450 - protein, 7 aa, Staphylococcus
VTEHTYE

SEQ ID NO: 1995451 - protein, 20 aa, Staphylococcus
VTEKAKEKIAEEGYDPQYGA

SEQ ID NO: 1995452 - protein, 8 aa, Staphylococcus
VTEKDEAQ

SEQ ID NO: 1995453 - protein, 14 aa, Staphylococcus
VTEKVDNGNEYQHG

SEQ ID NO: 1995454 - protein, 21 aa, Staphylococcus
VTELTRENAKEMISQNQRKSS

SEQ ID NO: 1995455 - protein, 6 aa, Staphylococcus
VTENGR

SEQ ID NO: 1995456 - protein, 9 aa, Staphylococcus
VTENNAQAV

SEQ ID NO: 1995457 - protein, 12 aa, Staphylococcus
VTENPNKEDIQQ

SEQ ID NO: 1995458 - protein, 12 aa, Staphylococcus
VTENSMKDISNQ

SEQ ID NO: 1995459 - protein, 6 aa, Staphylococcus
VTENSR

SEQ ID NO: 1995460 - protein, 7 aa, Staphylococcus
VTERAEV

SEQ ID NO: 1995461 - protein, 17 aa, Staphylococcus
VTESEADKALVEEGRTN

SEQ ID NO: 1995462 - protein, 13 aa, Staphylococcus
VTESNADGFNKGD

SEQ ID NO: 1995463 - protein, 10 aa, Staphylococcus
VTESNHDEQN

SEQ ID NO: 1995464 - protein, 26 aa, Staphylococcus
VTETEPGIKGDTANGATKSATVETGY

SEQ ID NO: 1995465 - protein, 26 aa, Staphylococcus
VTETEPGIKGDTATGATKSATVETGY

SEQ ID NO: 1995466 - protein, 8 aa, Staphylococcus
VTETKGNY

SEQ ID NO: 1995467 - protein, 11 aa, Staphylococcus
VTETQANELNI

SEQ ID NO: 1995468 - protein, 13 aa, Staphylococcus
VTETTKYEEVGLD

SEQ ID NO: 1995469 - protein, 11 aa, Staphylococcus
VTETVKKYGSK

SEQ ID NO: 1995470 - protein, 4 aa, Staphylococcus
VTEY

SEQ ID NO: 1995471 - protein, 13 aa, Staphylococcus
VTFSKKAKRQLKD

SEQ ID NO: 1995472 - protein, 6 aa, Staphylococcus
VTFTSG

SEQ ID NO: 1995473 - protein, 18 aa, Staphylococcus
VTGDWTEKDYIYTQVSWI

SEQ ID NO: 1995474 - protein, 14 aa, Staphylococcus
VTGDYTIEDEPETS

SEQ ID NO: 1995475 - protein, 6 aa, Staphylococcus
VTGEQV

SEQ ID NO: 1995476 - protein, 4 aa, Staphylococcus
VTGF

SEQ ID NO: 1995477 - protein, 5 aa, Staphylococcus
VTGFS

SEQ ID NO: 1995478 - protein, 9 aa, Staphylococcus
VTGGSTMAR

SEQ ID NO: 1995479 - protein, 9 aa, Staphylococcus
VTGKEAYEA

SEQ ID NO: 1995480 - protein, 21 aa, Staphylococcus
VTGKPTEIEGEFTSGTAERSW

SEQ ID NO: 1995481 - protein, 5 aa, Staphylococcus
VTGKQ

SEQ ID NO: 1995482 - protein, 15 aa, Staphylococcus
VTGKTLKENNEGKEI

SEQ ID NO: 1995483 - protein, 16 aa, Staphylococcus
VTGKTLRENNEGKEIK

SEQ ID NO: 1995484 - protein, 18 aa, Staphylococcus
VTGKTLRENNEGKEIQNE

SEQ ID NO: 1995485 - protein, 16 aa, Staphylococcus
VTGKTLRENNQGKEIK

SEQ ID NO: 1995486 - protein, 8 aa, Staphylococcus
VTGPITGY

SEQ ID NO: 1995487 - protein, 11 aa, Staphylococcus
VTGQNESFHPE

SEQ ID NO: 1995488 - protein, 28 aa, Staphylococcus
VTGQRENINKLEKERQELTQRIKEDKVK

SEQ ID NO: 1995489 - protein, 12 aa, Staphylococcus
VTGRETNQKHQE

SEQ ID NO: 1995490 - protein, 8 aa, Staphylococcus
VTGRPRGV

SEQ ID NO: 1995491 - protein, 12 aa, Staphylococcus
VTGSNNESVAEQ

SEQ ID NO: 1995492 - protein, 9 aa, Staphylococcus
VTGSVDAKA

SEQ ID NO: 1995493 - protein, 8 aa, Staphylococcus
VTGSVDEA

SEQ ID NO: 1995494 - protein, 9 aa, Staphylococcus
VTGSVDEAA

SEQ ID NO: 1995495 - protein, 9 aa, Staphylococcus
VTGSVDEAS

SEQ ID NO: 1995496 - protein, 10 aa, Staphylococcus
VTGSVDEASL

SEQ ID NO: 1995497 - protein, 13 aa, Staphylococcus
VTGSVNYADTADS

SEQ ID NO: 1995498 - protein, 7 aa, Staphylococcus
VTGTAKL

SEQ ID NO: 1995499 - protein, 9 aa, Staphylococcus
VTGTSELDG

SEQ ID NO: 1995500 - protein, 13 aa, Staphylococcus
VTGTVQKVNGGWY

SEQ ID NO: 1995501 - protein, 4 aa, Staphylococcus
VTGV

SEQ ID NO: 1995502 - protein, 7 aa, Staphylococcus
VTHKSWG

SEQ ID NO: 1995503 - protein, 8 aa, Staphylococcus
VTHPRYGK

SEQ ID NO: 1995504 - protein, 6 aa, Staphylococcus
VTHSKA

SEQ ID NO: 1995505 - protein, 9 aa, Staphylococcus
VTHSSGEQA

SEQ ID NO: 1995506 - protein, 36 aa, Staphylococcus
VTHTNHSNKEQSSSTLSNSNLMTTDDEIGNGESIFD

SEQ ID NO: 1995507 - protein, 9 aa, Staphylococcus
VTIDSRAVQ

SEQ ID NO: 1995508 - protein, 5 aa, Staphylococcus
VTIEG

SEQ ID NO: 1995509 - protein, 11 aa, Staphylococcus
VTITEEDSESL

SEQ ID NO: 1995510 - protein, 15 aa, Staphylococcus
VTKAGAHHTWIESLG

SEQ ID NO: 1995511 - protein, 14 aa, Staphylococcus
VTKAPNGQNLHKGT

SEQ ID NO: 1995512 - protein, 18 aa, Staphylococcus
VTKATKAGNSCGKCKPQI

SEQ ID NO: 1995513 - protein, 8 aa, Staphylococcus
VTKDIGDA

SEQ ID NO: 1995514 - protein, 8 aa, Staphylococcus
VTKDINDA

SEQ ID NO: 1995515 - protein, 6 aa, Staphylococcus
VTKDIP

SEQ ID NO: 1995516 - protein, 10 aa, Staphylococcus
VTKEAEPTAS

SEQ ID NO: 1995517 - protein, 12 aa, Staphylococcus
VTKEDGNTNIDA

SEQ ID NO: 1995518 - protein, 6 aa, Staphylococcus
VTKEDV

SEQ ID NO: 1995519 - protein, 22 aa, Staphylococcus
VTKEKNQTNVRSSNKDQTVTMK

SEQ ID NO: 1995520 - protein, 10 aa, Staphylococcus
VTKELNQNTD

SEQ ID NO: 1995521 - protein, 5 aa, Staphylococcus
VTKEY

SEQ ID NO: 1995522 - protein, 26 aa, Staphylococcus
VTKKEKKRYPANPFTTSTLQQEASRK

SEQ ID NO: 1995523 - protein, 25 aa, Staphylococcus
VTKKEKTRYPANPFTTSTLQQEAAR

SEQ ID NO: 1995524 - protein, 6 aa, Staphylococcus
VTKPHR

SEQ ID NO: 1995525 - protein, 14 aa, Staphylococcus
VTKPKGYYTFDNIN

SEQ ID NO: 1995526 - protein, 7 aa, Staphylococcus
VTKQGFS

SEQ ID NO: 1995527 - protein, 17 aa, Staphylococcus
VTKQNKKVQYDVTPQNY

SEQ ID NO: 1995528 - protein, 7 aa, Staphylococcus
VTKRNEI

SEQ ID NO: 1995529 - protein, 19 aa, Staphylococcus
VTKSQPSSKKASTTKQTIS

SEQ ID NO: 1995530 - protein, 7 aa, Staphylococcus
VTKTDFP

SEQ ID NO: 1995531 - protein, 5 aa, Staphylococcus
VTLDN

SEQ ID NO: 1995532 - protein, 17 aa, Staphylococcus
VTLDNNSNGIPHALKRL

SEQ ID NO: 1995533 - protein, 6 aa, Staphylococcus
VTLGTS

SEQ ID NO: 1995534 - protein, 4 aa, Staphylococcus
VTLQ

SEQ ID NO: 1995535 - protein, 13 aa, Staphylococcus
VTLRETGKLGDLA

SEQ ID NO: 1995536 - protein, 11 aa, Staphylococcus
VTLRETGRLGD

SEQ ID NO: 1995537 - protein, 11 aa, Staphylococcus
VTLTSQGATKI

SEQ ID NO: 1995538 - protein, 11 aa, Staphylococcus
VTNAPNGQNLH

SEQ ID NO: 1995539 - protein, 8 aa, Staphylococcus
VTNAQSSI

SEQ ID NO: 1995540 - protein, 4 aa, Staphylococcus
VTND

SEQ ID NO: 1995541 - protein, 5 aa, Staphylococcus
VTNEA

SEQ ID NO: 1995542 - protein, 5 aa, Staphylococcus
VTNEE

SEQ ID NO: 1995543 - protein, 7 aa, Staphylococcus
VTNEGAL

SEQ ID NO: 1995544 - protein, 6 aa, Staphylococcus
VTNEYT

SEQ ID NO: 1995545 - protein, 18 aa, Staphylococcus
VTNGDSEFTHNWSGSPVS

SEQ ID NO: 1995546 - protein, 8 aa, Staphylococcus
VTNGPGKW

SEQ ID NO: 1995547 - protein, 7 aa, Staphylococcus
VTNGSKA

SEQ ID NO: 1995548 - protein, 23 aa, Staphylococcus
VTNHKDINQKLSNEDAYKRARPT

SEQ ID NO: 1995549 - protein, 9 aa, Staphylococcus
VTNIRKDNG

SEQ ID NO: 1995550 - protein, 6 aa, Staphylococcus
VTNKAD

SEQ ID NO: 1995551 - protein, 11 aa, Staphylococcus
VTNKENVSETV

SEQ ID NO: 1995552 - protein, 5 aa, Staphylococcus
VTNKG

SEQ ID NO: 1995553 - protein, 11 aa, Staphylococcus
VTNPANGEDLA

SEQ ID NO: 1995554 - protein, 8 aa, Staphylococcus
VTNPDDVN

SEQ ID NO: 1995555 - protein, 8 aa, Staphylococcus
VTNPEDVQ

SEQ ID NO: 1995556 - protein, 8 aa, Staphylococcus
VTNPENVS

SEQ ID NO: 1995557 - protein, 7 aa, Staphylococcus
VTNPQDV

SEQ ID NO: 1995558 - protein, 8 aa, Staphylococcus
VTNRDEVD

SEQ ID NO: 1995559 - protein, 7 aa, Staphylococcus
VTNRKEV

SEQ ID NO: 1995560 - protein, 8 aa, Staphylococcus
VTNSEGTG

SEQ ID NO: 1995561 - protein, 7 aa, Staphylococcus
VTNSKKD

SEQ ID NO: 1995562 - protein, 6 aa, Staphylococcus
VTPCGL

SEQ ID NO: 1995563 - protein, 9 aa, Staphylococcus
VTPDGEVSK

SEQ ID NO: 1995564 - protein, 7 aa, Staphylococcus
VTPEKIA

SEQ ID NO: 1995565 - protein, 9 aa, Staphylococcus
VTPEKKDEI

SEQ ID NO: 1995566 - protein, 5 aa, Staphylococcus
VTPEL

SEQ ID NO: 1995567 - protein, 5 aa, Staphylococcus
VTPER

SEQ ID NO: 1995568 - protein, 6 aa, Staphylococcus
VTPETL

SEQ ID NO: 1995569 - protein, 8 aa, Staphylococcus
VTPGSEEA

SEQ ID NO: 1995570 - protein, 7 aa, Staphylococcus
VTPGTDA

SEQ ID NO: 1995571 - protein, 12 aa, Staphylococcus
VTPGVSIGDGSV

SEQ ID NO: 1995572 - protein, 4 aa, Staphylococcus
VTPH

SEQ ID NO: 1995573 - protein, 6 aa, Staphylococcus
VTPHRI

SEQ ID NO: 1995574 - protein, 6 aa, Staphylococcus
VTPKAF

SEQ ID NO: 1995575 - protein, 5 aa, Staphylococcus
VTPKI

SEQ ID NO: 1995576 - protein, 5 aa, Staphylococcus
VTPKL

SEQ ID NO: 1995577 - protein, 4 aa, Staphylococcus
VTPL

SEQ ID NO: 1995578 - protein, 13 aa, Staphylococcus
VTPNDYRKLSKYD

SEQ ID NO: 1995579 - protein, 7 aa, Staphylococcus
VTPNGQI

SEQ ID NO: 1995580 - protein, 18 aa, Staphylococcus
VTPNNDSQKAIGENIYSP

SEQ ID NO: 1995581 - protein, 6 aa, Staphylococcus
VTPNNK

SEQ ID NO: 1995582 - protein, 7 aa, Staphylococcus
VTPNNKF

SEQ ID NO: 1995583 - protein, 4 aa, Staphylococcus
VTPP

SEQ ID NO: 1995584 - protein, 8 aa, Staphylococcus
VTPPQLNG

SEQ ID NO: 1995585 - protein, 4 aa, Staphylococcus
VTPQ

SEQ ID NO: 1995586 - protein, 12 aa, Staphylococcus
VTPQSLTEGQTN

SEQ ID NO: 1995587 - protein, 10 aa, Staphylococcus
VTPSTTPGIS

SEQ ID NO: 1995588 - protein, 8 aa, Staphylococcus
VTPTDQPD

SEQ ID NO: 1995589 - protein, 8 aa, Staphylococcus
VTPTDSPD

SEQ ID NO: 1995590 - protein, 10 aa, Staphylococcus
VTPTDSPDAW

SEQ ID NO: 1995591 - protein, 12 aa, Staphylococcus
VTQARDEVGKSI

SEQ ID NO: 1995592 - protein, 4 aa, Staphylococcus
VTQF

SEQ ID NO: 1995593 - protein, 8 aa, Staphylococcus
VTQNKDQF

SEQ ID NO: 1995594 - protein, 6 aa, Staphylococcus
VTQNNK

SEQ ID NO: 1995595 - protein, 14 aa, Staphylococcus
VTQNNLNNVKTSIP

SEQ ID NO: 1995596 - protein, 9 aa, Staphylococcus
VTQQRNGYF

SEQ ID NO: 1995597 - protein, 7 aa, Staphylococcus
VTQRDEI

SEQ ID NO: 1995598 - protein, 19 aa, Staphylococcus
VTQRDEPFKGTEVSRKSVA

SEQ ID NO: 1995599 - protein, 20 aa, Staphylococcus
VTQSAIKAGYSPHTATVQGS

SEQ ID NO: 1995600 - protein, 10 aa, Staphylococcus
VTQSASGTAH

SEQ ID NO: 1995601 - protein, 16 aa, Staphylococcus
VTQSELAKSLGKSQSF

SEQ ID NO: 1995602 - protein, 12 aa, Staphylococcus
VTQSNFKEAPKA

SEQ ID NO: 1995603 - protein, 22 aa, Staphylococcus
VTQSTIKAGYSPHTASEQGSRL

SEQ ID NO: 1995604 - protein, 8 aa, Staphylococcus
VTQTESPD

SEQ ID NO: 1995605 - protein, 13 aa, Staphylococcus
VTRATRKSKRDYE

SEQ ID NO: 1995606 - protein, 5 aa, Staphylococcus
VTRDE

SEQ ID NO: 1995607 - protein, 6 aa, Staphylococcus
VTRDEA

SEQ ID NO: 1995608 - protein, 7 aa, Staphylococcus
VTREASD

SEQ ID NO: 1995609 - protein, 6 aa, Staphylococcus
VTREGK

SEQ ID NO: 1995610 - protein, 7 aa, Staphylococcus
VTRENDG

SEQ ID NO: 1995611 - protein, 14 aa, Staphylococcus
VTRGNIDVNLKANA

SEQ ID NO: 1995612 - protein, 32 aa, Staphylococcus
VTRNKKKYGFEDTLTNSEKVKKDNSQKESKHN

SEQ ID NO: 1995613 - protein, 5 aa, Staphylococcus
VTRNN

SEQ ID NO: 1995614 - protein, 7 aa, Staphylococcus
VTRPRGT

SEQ ID NO: 1995615 - protein, 7 aa, Staphylococcus
VTRVGRG

SEQ ID NO: 1995616 - protein, 11 aa, Staphylococcus
VTSASAAAQSM
